United States Patent 7,655,785 (BIOINFORMATICALLY DETECTABLE GROUP OF NOVEL REGULATORY OLIGONUCLEOTIDES AND USES THEREOF) - sequence listing, part 19

SEQ ID NO: 753128 - RNA, 16 nt, Homo sapiens
uaauucaacccagcca

SEQ ID NO: 753129 - RNA, 19 nt, Homo sapiens
uaauucaagaaaacaacuu

SEQ ID NO: 753130 - RNA, 21 nt, Homo sapiens
uaauucacagaauagcacaaa

SEQ ID NO: 753131 - RNA, 13 nt, Homo sapiens
uaauucaguguca

SEQ ID NO: 753132 - RNA, 14 nt, Homo sapiens
uaauucaugauuca

SEQ ID NO: 753133 - RNA, 23 nt, Homo sapiens
uaauuccacacccucacugcugu

SEQ ID NO: 753134 - RNA, 19 nt, Homo sapiens
uaauuccacaggucaucag

SEQ ID NO: 753135 - RNA, 18 nt, Homo sapiens
uaauuccuguuacuuuac

SEQ ID NO: 753136 - RNA, 17 nt, Homo sapiens
uaauucuaagucuucca

SEQ ID NO: 753137 - RNA, 19 nt, Homo sapiens
uaauucuguuacuuugcua

SEQ ID NO: 753138 - RNA, 22 nt, Homo sapiens
uaauucuuagauacacuaaaaa

SEQ ID NO: 753139 - RNA, 23 nt, Homo sapiens
uaauugcaucaguucauugaccu

SEQ ID NO: 753140 - RNA, 14 nt, Homo sapiens
uaauugcaugacaa

SEQ ID NO: 753141 - RNA, 20 nt, Homo sapiens
uaauugccuuugagguuauu

SEQ ID NO: 753142 - RNA, 18 nt, Homo sapiens
uaauugcuccuauacuau

SEQ ID NO: 753143 - RNA, 22 nt, Homo sapiens
uaauugcuccuauacuauugaa

SEQ ID NO: 753144 - RNA, 16 nt, Homo sapiens
uaauugcuuacauuuu

SEQ ID NO: 753145 - RNA, 13 nt, Homo sapiens
uaauugcuuugcc

SEQ ID NO: 753146 - RNA, 20 nt, Homo sapiens
uaauuggaauuguugaagcu

SEQ ID NO: 753147 - RNA, 15 nt, Homo sapiens
uaauuguguggauuc

SEQ ID NO: 753148 - RNA, 13 nt, Homo sapiens
uaauuguguuugu

SEQ ID NO: 753149 - RNA, 19 nt, Homo sapiens
uaauuguuuaaaaugccuc

SEQ ID NO: 753150 - RNA, 16 nt, Homo sapiens
uaauuuaacacccuuu

SEQ ID NO: 753151 - RNA, 15 nt, Homo sapiens
uaauuuaaguacuug

SEQ ID NO: 753152 - RNA, 17 nt, Homo sapiens
uaauuuaaguacuugag

SEQ ID NO: 753153 - RNA, 15 nt, Homo sapiens
uaauuuaagugacac

SEQ ID NO: 753154 - RNA, 14 nt, Homo sapiens
uaauuuaaugcaug

SEQ ID NO: 753155 - RNA, 14 nt, Homo sapiens
uaauuuaguuccac

SEQ ID NO: 753156 - RNA, 21 nt, Homo sapiens
uaauuuauuuaauauacuuua

SEQ ID NO: 753157 - RNA, 15 nt, Homo sapiens
uaauuucauguguau

SEQ ID NO: 753158 - RNA, 17 nt, Homo sapiens
uaauuuccauaguguga

SEQ ID NO: 753159 - RNA, 20 nt, Homo sapiens
uaauuucuuuuuuccucuga

SEQ ID NO: 753160 - RNA, 23 nt, Homo sapiens
uaauuugaaugugguuacuuccu

SEQ ID NO: 753161 - RNA, 14 nt, Homo sapiens
uaauuuuacauguu

SEQ ID NO: 753162 - RNA, 21 nt, Homo sapiens
uaauuuuagagaaacuuugag

SEQ ID NO: 753163 - RNA, 15 nt, Homo sapiens
uaauuuuaguuucau

SEQ ID NO: 753164 - RNA, 19 nt, Homo sapiens
uaauuuuauuuugugaagu

SEQ ID NO: 753165 - RNA, 13 nt, Homo sapiens
uaauuuugcuugc

SEQ ID NO: 753166 - RNA, 16 nt, Homo sapiens
uaauuuugugcauucu

SEQ ID NO: 753167 - RNA, 23 nt, Homo sapiens
uaauuuuguuuauauuuucccau

SEQ ID NO: 753168 - RNA, 13 nt, Homo sapiens
uaauuuuuccaua

SEQ ID NO: 753169 - RNA, 13 nt, Homo sapiens
uaauuuuuggaga

SEQ ID NO: 753170 - RNA, 20 nt, Homo sapiens
uacaaaaauuagcugggcau

SEQ ID NO: 753171 - RNA, 22 nt, Homo sapiens
uacaaaugccaaaauucauuca

SEQ ID NO: 753172 - RNA, 14 nt, Homo sapiens
uacaaauggacaua

SEQ ID NO: 753173 - RNA, 15 nt, Homo sapiens
uacaaauguaagcaa

SEQ ID NO: 753174 - RNA, 17 nt, Homo sapiens
uacaaccuccgccuccc

SEQ ID NO: 753175 - RNA, 20 nt, Homo sapiens
uacaacgccgagugcacugc

SEQ ID NO: 753176 - RNA, 22 nt, Homo sapiens
uacaacgccgagugcacugcau

SEQ ID NO: 753177 - RNA, 15 nt, Homo sapiens
uacaacugauugcaa

SEQ ID NO: 753178 - RNA, 18 nt, Homo sapiens
uacaacugauugcaacag

SEQ ID NO: 753179 - RNA, 14 nt, Homo sapiens
uacaagaaagcaau

SEQ ID NO: 753180 - RNA, 15 nt, Homo sapiens
uacaagaucucaggu

SEQ ID NO: 753181 - RNA, 19 nt, Homo sapiens
uacaaguguucuuagguuu

SEQ ID NO: 753182 - RNA, 20 nt, Homo sapiens
uacaaguguucuuagguuua

SEQ ID NO: 753183 - RNA, 14 nt, Homo sapiens
uacaaguguuuacu

SEQ ID NO: 753184 - RNA, 17 nt, Homo sapiens
uacaauaaaaagaaauu

SEQ ID NO: 753185 - RNA, 21 nt, Homo sapiens
uacaauaaaacuuugcugcca

SEQ ID NO: 753186 - RNA, 23 nt, Homo sapiens
uacaauaacauaauuuguacaua

SEQ ID NO: 753187 - RNA, 23 nt, Homo sapiens
uacaauaggugcuuauucucaaa

SEQ ID NO: 753188 - RNA, 20 nt, Homo sapiens
uacaauguagaaaaugagga

SEQ ID NO: 753189 - RNA, 21 nt, Homo sapiens
uacaauuaugucucuugagca

SEQ ID NO: 753190 - RNA, 22 nt, Homo sapiens
uacaauuauuuuuacaguucuc

SEQ ID NO: 753191 - RNA, 13 nt, Homo sapiens
uacaauucauugu

SEQ ID NO: 753192 - RNA, 16 nt, Homo sapiens
uacaauuugacauaca

SEQ ID NO: 753193 - RNA, 23 nt, Homo sapiens
uacacaaggaaggcauuuggacc

SEQ ID NO: 753194 - RNA, 15 nt, Homo sapiens
uacacaauacaguau

SEQ ID NO: 753195 - RNA, 19 nt, Homo sapiens
uacacagaaacacugccuu

SEQ ID NO: 753196 - RNA, 18 nt, Homo sapiens
uacacagaaaugcugcug

SEQ ID NO: 753197 - RNA, 11 nt, Homo sapiens
uacacagagaa

SEQ ID NO: 753198 - RNA, 15 nt, Homo sapiens
uacacagaucacagc

SEQ ID NO: 753199 - RNA, 14 nt, Homo sapiens
uacacagcuuuaug

SEQ ID NO: 753200 - RNA, 20 nt, Homo sapiens
uacacagcuuuaugauauca

SEQ ID NO: 753201 - RNA, 16 nt, Homo sapiens
uacacaggagucuuca

SEQ ID NO: 753202 - RNA, 20 nt, Homo sapiens
uacacagugggaacucugac

SEQ ID NO: 753203 - RNA, 21 nt, Homo sapiens
uacacaucagccaucaacuaa

SEQ ID NO: 753204 - RNA, 22 nt, Homo sapiens
uacacauccccagaauccauaa

SEQ ID NO: 753205 - RNA, 17 nt, Homo sapiens
uacacauuagauuuuau

SEQ ID NO: 753206 - RNA, 18 nt, Homo sapiens
uacaccauuaucuuggaa

SEQ ID NO: 753207 - RNA, 18 nt, Homo sapiens
uacacccaguugccaaag

SEQ ID NO: 753208 - RNA, 15 nt, Homo sapiens
uacacccccaccucc

SEQ ID NO: 753209 - RNA, 17 nt, Homo sapiens
uacacugaggacugugg

SEQ ID NO: 753210 - RNA, 13 nt, Homo sapiens
uacacuggucuaa

SEQ ID NO: 753211 - RNA, 12 nt, Homo sapiens
uacacugugaag

SEQ ID NO: 753212 - RNA, 20 nt, Homo sapiens
uacacuguguaaauacccau

SEQ ID NO: 753213 - RNA, 14 nt, Homo sapiens
uacacuugugcacc

SEQ ID NO: 753214 - RNA, 21 nt, Homo sapiens
uacagaaauacugcucugaau

SEQ ID NO: 753215 - RNA, 16 nt, Homo sapiens
uacagaacuacuucuu

SEQ ID NO: 753216 - RNA, 22 nt, Homo sapiens
uacagaaguccccucuacuuua

SEQ ID NO: 753217 - RNA, 16 nt, Homo sapiens
uaggaagagaaaccag

SEQ ID NO: 753218 - RNA, 19 nt, Homo sapiens
uaggaagauggagguuuac

SEQ ID NO: 753219 - RNA, 18 nt, Homo sapiens
uaggaagggaucugagaa

SEQ ID NO: 753220 - RNA, 19 nt, Homo sapiens
uaggaagguuaauguucau

SEQ ID NO: 753221 - RNA, 13 nt, Homo sapiens
uaggaaucccaga

SEQ ID NO: 753222 - RNA, 22 nt, Homo sapiens
uaggacacauuuagaugcacua

SEQ ID NO: 753223 - RNA, 16 nt, Homo sapiens
uaggacauugugucag

SEQ ID NO: 753224 - RNA, 12 nt, Homo sapiens
uaggaccaagau

SEQ ID NO: 753225 - RNA, 17 nt, Homo sapiens
uaggaccaauaccuccu

SEQ ID NO: 753226 - RNA, 17 nt, Homo sapiens
uaggacucaaaguuuca

SEQ ID NO: 753227 - RNA, 19 nt, Homo sapiens
uaggagacacgacagcaca

SEQ ID NO: 753228 - RNA, 15 nt, Homo sapiens
uaggagacuaaugga

SEQ ID NO: 753229 - RNA, 14 nt, Homo sapiens
uaggagacuugcca

SEQ ID NO: 753230 - RNA, 13 nt, Homo sapiens
uaggagauuuauu

SEQ ID NO: 753231 - RNA, 16 nt, Homo sapiens
uaggaggaaacaguuc

SEQ ID NO: 753232 - RNA, 19 nt, Homo sapiens
uaggauacagaaaugcaaa

SEQ ID NO: 753233 - RNA, 15 nt, Homo sapiens
uaggauguugcucag

SEQ ID NO: 753234 - RNA, 12 nt, Homo sapiens
uaggcacacaga

SEQ ID NO: 753235 - RNA, 22 nt, Homo sapiens
uaggcacacagauccccuggaa

SEQ ID NO: 753236 - RNA, 21 nt, Homo sapiens
uaggcagcaaaagaccaaauc

SEQ ID NO: 753237 - RNA, 15 nt, Homo sapiens
uaggcauacacugua

SEQ ID NO: 753238 - RNA, 17 nt, Homo sapiens
uaggcauguagcuacag

SEQ ID NO: 753239 - RNA, 18 nt, Homo sapiens
uaggccuuaacacacugg

SEQ ID NO: 753240 - RNA, 16 nt, Homo sapiens
uaggcgcaggugcaca

SEQ ID NO: 753241 - RNA, 14 nt, Homo sapiens
uaggcuauucacaa

SEQ ID NO: 753242 - RNA, 22 nt, Homo sapiens
uaggcuggaagagccaaagaau

SEQ ID NO: 753243 - RNA, 16 nt, Homo sapiens
uaggcuuaucagggag

SEQ ID NO: 753244 - RNA, 21 nt, Homo sapiens
uaggcuuuguaugacagugaa

SEQ ID NO: 753245 - RNA, 22 nt, Homo sapiens
uagggacacacaggcagcugaa

SEQ ID NO: 753246 - RNA, 19 nt, Homo sapiens
uagggcacuuuaagucagu

SEQ ID NO: 753247 - RNA, 14 nt, Homo sapiens
uaggggaaagaagg

SEQ ID NO: 753248 - RNA, 21 nt, Homo sapiens
uaggggaagggcuuugagggu

SEQ ID NO: 753249 - RNA, 11 nt, Homo sapiens
uaggggaugag

SEQ ID NO: 753250 - RNA, 13 nt, Homo sapiens
uaggggcaaaaau

SEQ ID NO: 753251 - RNA, 21 nt, Homo sapiens
uaggggugugggucaaaccaa

SEQ ID NO: 753252 - RNA, 13 nt, Homo sapiens
uagguagacuuug

SEQ ID NO: 753253 - RNA, 14 nt, Homo sapiens
uagguaucauucaa

SEQ ID NO: 753254 - RNA, 23 nt, Homo sapiens
uagguccuuguuguuucuugccu

SEQ ID NO: 753255 - RNA, 17 nt, Homo sapiens
uaggucuccucagggug

SEQ ID NO: 753256 - RNA, 18 nt, Homo sapiens
uaggugaggcugggcccu

SEQ ID NO: 753257 - RNA, 22 nt, Homo sapiens
uagguguaagagaaauggaaau

SEQ ID NO: 753258 - RNA, 20 nt, Homo sapiens
uagguuuacauucaucucau

SEQ ID NO: 753259 - RNA, 16 nt, Homo sapiens
uagguuuagcaguaua

SEQ ID NO: 753260 - RNA, 22 nt, Homo sapiens
uaguaaagccguuguuuacuua

SEQ ID NO: 753261 - RNA, 19 nt, Homo sapiens
uaguaaaggggcccagaaa

SEQ ID NO: 753262 - RNA, 14 nt, Homo sapiens
uaguaaaugcgugc

SEQ ID NO: 753263 - RNA, 15 nt, Homo sapiens
uaguaacaguuguga

SEQ ID NO: 753264 - RNA, 16 nt, Homo sapiens
uaguaacaucaaagau

SEQ ID NO: 753265 - RNA, 19 nt, Homo sapiens
uaguaacuuuccauagggc

SEQ ID NO: 753266 - RNA, 16 nt, Homo sapiens
uaguaagaugcacuga

SEQ ID NO: 753267 - RNA, 13 nt, Homo sapiens
uaguaagugcuuu

SEQ ID NO: 753268 - RNA, 19 nt, Homo sapiens
uaguaauaccaaagacuau

SEQ ID NO: 753269 - RNA, 15 nt, Homo sapiens
uaguaaucacaguug

SEQ ID NO: 753270 - RNA, 17 nt, Homo sapiens
uaguaaugcucugacca

SEQ ID NO: 753271 - RNA, 11 nt, Homo sapiens
uaguacuccuu

SEQ ID NO: 753272 - RNA, 20 nt, Homo sapiens
uaguacuuauguugcacaau

SEQ ID NO: 753273 - RNA, 13 nt, Homo sapiens
uaguagcaaugug

SEQ ID NO: 753274 - RNA, 13 nt, Homo sapiens
uaguauacuuugu

SEQ ID NO: 753275 - RNA, 16 nt, Homo sapiens
uaguauauuuauacuc

SEQ ID NO: 753276 - RNA, 15 nt, Homo sapiens
uaguaugaaugcagu

SEQ ID NO: 753277 - RNA, 11 nt, Homo sapiens
uaguaugcagu

SEQ ID NO: 753278 - RNA, 17 nt, Homo sapiens
uaguauggcacuugaug

SEQ ID NO: 753279 - RNA, 17 nt, Homo sapiens
uaguauuccauggugua

SEQ ID NO: 753280 - RNA, 20 nt, Homo sapiens
uaguauugguguauguauga

SEQ ID NO: 753281 - RNA, 22 nt, Homo sapiens
uagucaacugcuguuuuauguc

SEQ ID NO: 753282 - RNA, 16 nt, Homo sapiens
uagucaaggaggaaag

SEQ ID NO: 753283 - RNA, 12 nt, Homo sapiens
uagucaauccug

SEQ ID NO: 753284 - RNA, 17 nt, Homo sapiens
uagucaauuucuacuuc

SEQ ID NO: 753285 - RNA, 12 nt, Homo sapiens
uagucacauggc

SEQ ID NO: 753286 - RNA, 20 nt, Homo sapiens
uagucacauggccuaugcac

SEQ ID NO: 753287 - RNA, 23 nt, Homo sapiens
uagucacauggccuaugcacaua

SEQ ID NO: 753288 - RNA, 19 nt, Homo sapiens
uagucagaagcagguucuu

SEQ ID NO: 753289 - RNA, 13 nt, Homo sapiens
uagucagauuuca

SEQ ID NO: 753290 - RNA, 18 nt, Homo sapiens
uagucaggaauggcugca

SEQ ID NO: 753291 - RNA, 15 nt, Homo sapiens
uagucaguugcucau

SEQ ID NO: 753292 - RNA, 20 nt, Homo sapiens
uagucauacucccuggugua

SEQ ID NO: 753293 - RNA, 15 nt, Homo sapiens
uagucaugggguccc

SEQ ID NO: 753294 - RNA, 13 nt, Homo sapiens
uaguccaaaaagc

SEQ ID NO: 753295 - RNA, 18 nt, Homo sapiens
uagucccagcuacucaga

SEQ ID NO: 753296 - RNA, 23 nt, Homo sapiens
uagucccauuuuucucuugccau

SEQ ID NO: 753297 - RNA, 19 nt, Homo sapiens
uaguccuuguaaacaauau

SEQ ID NO: 753298 - RNA, 20 nt, Homo sapiens
uagucugcgucucugcuuua

SEQ ID NO: 753299 - RNA, 19 nt, Homo sapiens
uagucuguaauacacucca

SEQ ID NO: 753300 - RNA, 19 nt, Homo sapiens
uagucuuaacuggucuccu

SEQ ID NO: 753301 - RNA, 19 nt, Homo sapiens
uagugaaauggccacuacu

SEQ ID NO: 753302 - RNA, 18 nt, Homo sapiens
uagugaaguugugcaacg

SEQ ID NO: 753303 - RNA, 21 nt, Homo sapiens
uagugacuugugucccaugau

SEQ ID NO: 753304 - RNA, 19 nt, Homo sapiens
uagugagaaacugauuuau

SEQ ID NO: 753305 - RNA, 18 nt, Homo sapiens
uagugauucugauuucag

SEQ ID NO: 753306 - RNA, 14 nt, Homo sapiens
uagugccacccacc

SEQ ID NO: 753307 - RNA, 21 nt, Homo sapiens
uagugccacccaccuuugcca

SEQ ID NO: 753308 - RNA, 11 nt, Homo sapiens
uagugcugcug

SEQ ID NO: 753309 - RNA, 19 nt, Homo sapiens
uaguguaacacugcaagaa

SEQ ID NO: 753310 - RNA, 17 nt, Homo sapiens
uaguguaacuugcuuaa

SEQ ID NO: 753311 - RNA, 13 nt, Homo sapiens
uaguguauucucu

SEQ ID NO: 753312 - RNA, 12 nt, Homo sapiens
uagugucacuua

SEQ ID NO: 753313 - RNA, 13 nt, Homo sapiens
uagugucaucacu

SEQ ID NO: 753314 - RNA, 14 nt, Homo sapiens
uagugugccuucca

SEQ ID NO: 753315 - RNA, 18 nt, Homo sapiens
uaguguguguguguauau

SEQ ID NO: 753316 - RNA, 14 nt, Homo sapiens
uaguguucacaaac

SEQ ID NO: 753317 - RNA, 19 nt, Homo sapiens
uaguguucacaaacuguga

SEQ ID NO: 753318 - RNA, 16 nt, Homo sapiens
uaguuaaagaaaggaa

SEQ ID NO: 753319 - RNA, 20 nt, Homo sapiens
uaguuaaauguuaccucuga

SEQ ID NO: 753320 - RNA, 19 nt, Homo sapiens
uaguuaauuguggcuuuau

SEQ ID NO: 753321 - RNA, 20 nt, Homo sapiens
uaguuaccaagccugccaug

SEQ ID NO: 753322 - RNA, 20 nt, Homo sapiens
uaguuacgaguuuucccuca

SEQ ID NO: 753323 - RNA, 17 nt, Homo sapiens
uaguucaguagaauuac

SEQ ID NO: 753324 - RNA, 20 nt, Homo sapiens
uaguugauauguaacaguug

SEQ ID NO: 753325 - RNA, 20 nt, Homo sapiens
uaguugcguggacucugcac

SEQ ID NO: 753326 - RNA, 22 nt, Homo sapiens
uaguugcguggacucugcacau

SEQ ID NO: 753327 - RNA, 23 nt, Homo sapiens
uaguuguaaaccaagugaucaaa

SEQ ID NO: 753328 - RNA, 16 nt, Homo sapiens
uaguuuaugaugcaaa

SEQ ID NO: 753329 - RNA, 13 nt, Homo sapiens
uaguuucucucaa

SEQ ID NO: 753330 - RNA, 19 nt, Homo sapiens
uaguuugaccucacaguga

SEQ ID NO: 753331 - RNA, 21 nt, Homo sapiens
uaguuuguuuuagaaccagcc

SEQ ID NO: 753332 - RNA, 18 nt, Homo sapiens
ucuuaaagacaucuuaau

SEQ ID NO: 753333 - RNA, 19 nt, Homo sapiens
ucuuaaccuuugcuaugua

SEQ ID NO: 753334 - RNA, 20 nt, Homo sapiens
ucuuaaccuuugcuauguaa

SEQ ID NO: 753335 - RNA, 18 nt, Homo sapiens
ucuuaagcagcauggaaa

SEQ ID NO: 753336 - RNA, 16 nt, Homo sapiens
ucuuaauccugaaugu

SEQ ID NO: 753337 - RNA, 15 nt, Homo sapiens
ucuuaaugugcagca

SEQ ID NO: 753338 - RNA, 13 nt, Homo sapiens
ucuuacaugcauu

SEQ ID NO: 753339 - RNA, 14 nt, Homo sapiens
ucuuacaugcauuu

SEQ ID NO: 753340 - RNA, 22 nt, Homo sapiens
ucuuacauuuuucagacuucau

SEQ ID NO: 753341 - RNA, 21 nt, Homo sapiens
ucuuaccaucugagccgucag

SEQ ID NO: 753342 - RNA, 15 nt, Homo sapiens
ucuuaccauuucaca

SEQ ID NO: 753343 - RNA, 14 nt, Homo sapiens
ucuuaccugggacc

SEQ ID NO: 753344 - RNA, 23 nt, Homo sapiens
ucuuacuguaccuguuccuuaga

SEQ ID NO: 753345 - RNA, 19 nt, Homo sapiens
ucuuagaguugauuccuca

SEQ ID NO: 753346 - RNA, 14 nt, Homo sapiens
ucuuagcugucacc

SEQ ID NO: 753347 - RNA, 14 nt, Homo sapiens
ucuuagugugccaa

SEQ ID NO: 753348 - RNA, 18 nt, Homo sapiens
ucuuaguugacaaccuag

SEQ ID NO: 753349 - RNA, 21 nt, Homo sapiens
ucuuauccaacaucaacaucu

SEQ ID NO: 753350 - RNA, 22 nt, Homo sapiens
ucuuaugauuacuaucauggca

SEQ ID NO: 753351 - RNA, 13 nt, Homo sapiens
ucuuauguugaau

SEQ ID NO: 753352 - RNA, 14 nt, Homo sapiens
ucuuauuaaucaua

SEQ ID NO: 753353 - RNA, 19 nt, Homo sapiens
ucuuauucccaaacuacag

SEQ ID NO: 753354 - RNA, 18 nt, Homo sapiens
ucuuauucucacuccacc

SEQ ID NO: 753355 - RNA, 13 nt, Homo sapiens
ucuuauugacaau

SEQ ID NO: 753356 - RNA, 20 nt, Homo sapiens
ucuuauuucauuucuuugag

SEQ ID NO: 753357 - RNA, 14 nt, Homo sapiens
ucuuauuuccucaa

SEQ ID NO: 753358 - RNA, 22 nt, Homo sapiens
ucuucaaacugugaagcauuua

SEQ ID NO: 753359 - RNA, 19 nt, Homo sapiens
ucuucaacuuuugugcucc

SEQ ID NO: 753360 - RNA, 19 nt, Homo sapiens
ucuucaauaguuuuaccua

SEQ ID NO: 753361 - RNA, 18 nt, Homo sapiens
ucuucacaggcacuccug

SEQ ID NO: 753362 - RNA, 18 nt, Homo sapiens
ucuucaccaagugcaaua

SEQ ID NO: 753363 - RNA, 15 nt, Homo sapiens
ucuucaccucuucca

SEQ ID NO: 753364 - RNA, 15 nt, Homo sapiens
ucuucaccuuauuca

SEQ ID NO: 753365 - RNA, 15 nt, Homo sapiens
ucuucacucccaaua

SEQ ID NO: 753366 - RNA, 20 nt, Homo sapiens
ucuucacugucugacuuuag

SEQ ID NO: 753367 - RNA, 20 nt, Homo sapiens
ucuucacuuccccacaggcu

SEQ ID NO: 753368 - RNA, 21 nt, Homo sapiens
ucuucacuucuaaaugcauau

SEQ ID NO: 753369 - RNA, 12 nt, Homo sapiens
ucuucagaacac

SEQ ID NO: 753370 - RNA, 18 nt, Homo sapiens
ucuucagauacaaacugc

SEQ ID NO: 753371 - RNA, 12 nt, Homo sapiens
ucuucagccuag

SEQ ID NO: 753372 - RNA, 14 nt, Homo sapiens
ucuucaggcccagc

SEQ ID NO: 753373 - RNA, 16 nt, Homo sapiens
ucuucaggccucccuc

SEQ ID NO: 753374 - RNA, 19 nt, Homo sapiens
ucuucagguucucaugaua

SEQ ID NO: 753375 - RNA, 13 nt, Homo sapiens
ucuucagucucua

SEQ ID NO: 753376 - RNA, 21 nt, Homo sapiens
ucuucagucucuauaccaaua

SEQ ID NO: 753377 - RNA, 17 nt, Homo sapiens
ucuucaguguaauguga

SEQ ID NO: 753378 - RNA, 22 nt, Homo sapiens
ucuucauauucagcuugcacau

SEQ ID NO: 753379 - RNA, 17 nt, Homo sapiens
ucuucaucccauuccag

SEQ ID NO: 753380 - RNA, 12 nt, Homo sapiens
ucuucaugcaau

SEQ ID NO: 753381 - RNA, 11 nt, Homo sapiens
ucuucauucag

SEQ ID NO: 753382 - RNA, 16 nt, Homo sapiens
ucuucauugucuacau

SEQ ID NO: 753383 - RNA, 18 nt, Homo sapiens
ucuuccaaagcacauuga

SEQ ID NO: 753384 - RNA, 18 nt, Homo sapiens
ucuuccaacccacuggcc

SEQ ID NO: 753385 - RNA, 19 nt, Homo sapiens
ucuuccacaaaaaauacuu

SEQ ID NO: 753386 - RNA, 20 nt, Homo sapiens
ucuuccagaaggcaaaaaga

SEQ ID NO: 753387 - RNA, 22 nt, Homo sapiens
ucuuccagcccaucuccgggga

SEQ ID NO: 753388 - RNA, 12 nt, Homo sapiens
ucuuccauucca

SEQ ID NO: 753389 - RNA, 15 nt, Homo sapiens
ucuucccgcaaauca

SEQ ID NO: 753390 - RNA, 21 nt, Homo sapiens
ucuucccgcaaaucaacacuu

SEQ ID NO: 753391 - RNA, 11 nt, Homo sapiens
ucuucccuacc

SEQ ID NO: 753392 - RNA, 18 nt, Homo sapiens
ucuucccuaccucaggca

SEQ ID NO: 753393 - RNA, 22 nt, Homo sapiens
ucuucccucucugcagacuucc

SEQ ID NO: 753394 - RNA, 17 nt, Homo sapiens
ucuucccuuaacuccaa

SEQ ID NO: 753395 - RNA, 23 nt, Homo sapiens
ucuuccguggucagagugccacu

SEQ ID NO: 753396 - RNA, 17 nt, Homo sapiens
ucuuccucacuaugaca

SEQ ID NO: 753397 - RNA, 23 nt, Homo sapiens
ucuuccuccucgcugccagauga

SEQ ID NO: 753398 - RNA, 14 nt, Homo sapiens
ucuuccugacacuu

SEQ ID NO: 753399 - RNA, 20 nt, Homo sapiens
ucuuccugaguggugccaaa

SEQ ID NO: 753400 - RNA, 16 nt, Homo sapiens
ucuuccugcacccaca

SEQ ID NO: 753401 - RNA, 19 nt, Homo sapiens
ucuuccuuccuaauaggca

SEQ ID NO: 753402 - RNA, 21 nt, Homo sapiens
ucuucgacauccgucauugcu

SEQ ID NO: 753403 - RNA, 17 nt, Homo sapiens
ucuucgggagacauguu

SEQ ID NO: 753404 - RNA, 13 nt, Homo sapiens
ucuucuaagcaaa

SEQ ID NO: 753405 - RNA, 21 nt, Homo sapiens
ucuucuacagaugagucacac

SEQ ID NO: 753406 - RNA, 14 nt, Homo sapiens
ucuucuauaucuga

SEQ ID NO: 753407 - RNA, 12 nt, Homo sapiens
ucuucuaugcaa

SEQ ID NO: 753408 - RNA, 12 nt, Homo sapiens
ucuucucaaagc

SEQ ID NO: 753409 - RNA, 17 nt, Homo sapiens
ucuucucaaagcacugu

SEQ ID NO: 753410 - RNA, 17 nt, Homo sapiens
ucuucucaggauuuaaa

SEQ ID NO: 753411 - RNA, 14 nt, Homo sapiens
ucuucuccacugga

SEQ ID NO: 753412 - RNA, 17 nt, Homo sapiens
ucuucuccuaugcauuu

SEQ ID NO: 753413 - RNA, 16 nt, Homo sapiens
ucuucuccuccaugaa

SEQ ID NO: 753414 - RNA, 20 nt, Homo sapiens
ucuucuggacuuggucuuga

SEQ ID NO: 753415 - RNA, 23 nt, Homo sapiens
ucuucuggagauggaagcuuguu

SEQ ID NO: 753416 - RNA, 19 nt, Homo sapiens
ucuucuuacaugcauuuga

SEQ ID NO: 753417 - RNA, 17 nt, Homo sapiens
ucuucuuacuggugcua

SEQ ID NO: 753418 - RNA, 19 nt, Homo sapiens
ucuucuuggggcccagugc

SEQ ID NO: 753419 - RNA, 20 nt, Homo sapiens
ucuucuugugauugcugcca

SEQ ID NO: 753420 - RNA, 21 nt, Homo sapiens
ucuugaaacauagagaucuau

SEQ ID NO: 753421 - RNA, 19 nt, Homo sapiens
ucuugaagaaaauucagaa

SEQ ID NO: 753422 - RNA, 15 nt, Homo sapiens
ucuugaaguucaugg

SEQ ID NO: 753423 - RNA, 16 nt, Homo sapiens
ucuugaauaagaguga

SEQ ID NO: 753424 - RNA, 21 nt, Homo sapiens
ucuugaauccuuccauuccac

SEQ ID NO: 753425 - RNA, 18 nt, Homo sapiens
ucuugagcagaugauucc

SEQ ID NO: 753426 - RNA, 16 nt, Homo sapiens
ucuugagcaguggcug

SEQ ID NO: 753427 - RNA, 15 nt, Homo sapiens
ucuugaggccaggag

SEQ ID NO: 753428 - RNA, 22 nt, Homo sapiens
ucuugaguucuggaagggacuu

SEQ ID NO: 753429 - RNA, 20 nt, Homo sapiens
ucuugauaucucgaacuuuc

SEQ ID NO: 753430 - RNA, 18 nt, Homo sapiens
ucuugauaugaccuguua

SEQ ID NO: 753431 - RNA, 17 nt, Homo sapiens
ucuugcaacucuguaaa

SEQ ID NO: 753432 - RNA, 18 nt, Homo sapiens
ucuugcaacucuguaaau

SEQ ID NO: 753433 - RNA, 14 nt, Homo sapiens
ucuugcauccaaac

SEQ ID NO: 753434 - RNA, 17 nt, Homo sapiens
ucuugcccgcaccccuc

SEQ ID NO: 753435 - RNA, 20 nt, Homo sapiens
ucuugcgggccuggacaagg

SEQ ID NO: 753436 - RNA, 15 nt, Homo sapiens
ucuugcuauaugauu

SEQ ID NO: 753437 - RNA, 21 nt, Homo sapiens
ucuugcucuaaugaucaaaac

SEQ ID NO: 753438 - RNA, 14 nt, Homo sapiens
ucuugcucugccac

SEQ ID NO: 753439 - RNA, 16 nt, Homo sapiens
ucuugcucuguucaca

SEQ ID NO: 753440 - RNA, 18 nt, Homo sapiens
ucuugcuggcucugagaa

SEQ ID NO: 753441 - RNA, 22 nt, Homo sapiens
ucuugcuugacucuacuauuaa

SEQ ID NO: 753442 - RNA, 16 nt, Homo sapiens
ucuuggaagacuuaau

SEQ ID NO: 753443 - RNA, 17 nt, Homo sapiens
ucuuggcaauuccucuu

SEQ ID NO: 753444 - RNA, 17 nt, Homo sapiens
ucuuggccuaaaccuca

SEQ ID NO: 753445 - RNA, 15 nt, Homo sapiens
ucuuggcuuugccac

SEQ ID NO: 753446 - RNA, 16 nt, Homo sapiens
ucuuggcuuugccaca

SEQ ID NO: 753447 - RNA, 19 nt, Homo sapiens
ugaagggaaguggggagua

SEQ ID NO: 753448 - RNA, 16 nt, Homo sapiens
ugaagggauuucuuaa

SEQ ID NO: 753449 - RNA, 14 nt, Homo sapiens
ugaaggggccauga

SEQ ID NO: 753450 - RNA, 18 nt, Homo sapiens
ugaagggucuuucucaaa

SEQ ID NO: 753451 - RNA, 14 nt, Homo sapiens
ugaaggucaauaaa

SEQ ID NO: 753452 - RNA, 14 nt, Homo sapiens
ugaaggugaccucu

SEQ ID NO: 753453 - RNA, 13 nt, Homo sapiens
ugaaggugguggg

SEQ ID NO: 753454 - RNA, 13 nt, Homo sapiens
ugaaguaagcaac

SEQ ID NO: 753455 - RNA, 14 nt, Homo sapiens
ugaaguacauauua

SEQ ID NO: 753456 - RNA, 13 nt, Homo sapiens
ugaaguagaaucc

SEQ ID NO: 753457 - RNA, 18 nt, Homo sapiens
ugaaguaggcauauauca

SEQ ID NO: 753458 - RNA, 20 nt, Homo sapiens
ugaaguaggugugacuugaa

SEQ ID NO: 753459 - RNA, 16 nt, Homo sapiens
ugaaguagugugcagu

SEQ ID NO: 753460 - RNA, 15 nt, Homo sapiens
ugaagucacauucca

SEQ ID NO: 753461 - RNA, 18 nt, Homo sapiens
ugaagucaccgggaugaa

SEQ ID NO: 753462 - RNA, 20 nt, Homo sapiens
ugaagucagccacacugggc

SEQ ID NO: 753463 - RNA, 18 nt, Homo sapiens
ugaaguccaggacugggu

SEQ ID NO: 753464 - RNA, 14 nt, Homo sapiens
ugaagucucccuug

SEQ ID NO: 753465 - RNA, 19 nt, Homo sapiens
ugaagucuguacagauuca

SEQ ID NO: 753466 - RNA, 21 nt, Homo sapiens
ugaagugaaugaaacacucag

SEQ ID NO: 753467 - RNA, 23 nt, Homo sapiens
ugaagugaccuggaaucagugaa

SEQ ID NO: 753468 - RNA, 19 nt, Homo sapiens
ugaaguggaaaaaggagag

SEQ ID NO: 753469 - RNA, 17 nt, Homo sapiens
ugaaguggccagaugag

SEQ ID NO: 753470 - RNA, 19 nt, Homo sapiens
ugaaguguggcugcaucuu

SEQ ID NO: 753471 - RNA, 18 nt, Homo sapiens
ugaaguugcaaugcuuca

SEQ ID NO: 753472 - RNA, 13 nt, Homo sapiens
ugaaguugcugag

SEQ ID NO: 753473 - RNA, 17 nt, Homo sapiens
ugaaguugguuuagcuu

SEQ ID NO: 753474 - RNA, 15 nt, Homo sapiens
ugaauaaaaacccug

SEQ ID NO: 753475 - RNA, 17 nt, Homo sapiens
ugaauaaaaacccugua

SEQ ID NO: 753476 - RNA, 23 nt, Homo sapiens
ugaauaaaugauuaaaaaaucag

SEQ ID NO: 753477 - RNA, 13 nt, Homo sapiens
ugaauaacuaaga

SEQ ID NO: 753478 - RNA, 18 nt, Homo sapiens
ugaauacagucucaucuu

SEQ ID NO: 753479 - RNA, 21 nt, Homo sapiens
ugaauacauuaacggugcuaa

SEQ ID NO: 753480 - RNA, 18 nt, Homo sapiens
ugaauacugcauuuacag

SEQ ID NO: 753481 - RNA, 22 nt, Homo sapiens
ugaauacuuacuauaauuugac

SEQ ID NO: 753482 - RNA, 22 nt, Homo sapiens
ugaauagauggguuauuucaac

SEQ ID NO: 753483 - RNA, 22 nt, Homo sapiens
ugaauagcacaggugaccccua

SEQ ID NO: 753484 - RNA, 17 nt, Homo sapiens
ugaauaguugcuuaauu

SEQ ID NO: 753485 - RNA, 21 nt, Homo sapiens
ugaauauaaaugggaaaucag

SEQ ID NO: 753486 - RNA, 12 nt, Homo sapiens
ugaauaucgaga

SEQ ID NO: 753487 - RNA, 15 nt, Homo sapiens
ugaauauuacucuca

SEQ ID NO: 753488 - RNA, 16 nt, Homo sapiens
ugaauauuccuggacu

SEQ ID NO: 753489 - RNA, 20 nt, Homo sapiens
ugaaucacugugcucagcca

SEQ ID NO: 753490 - RNA, 19 nt, Homo sapiens
ugaaucagaaugccuucaa

SEQ ID NO: 753491 - RNA, 18 nt, Homo sapiens
ugaaucagcugggaugac

SEQ ID NO: 753492 - RNA, 21 nt, Homo sapiens
ugaaucaugagccugcuggaa

SEQ ID NO: 753493 - RNA, 21 nt, Homo sapiens
ugaauccagaucauuccucag

SEQ ID NO: 753494 - RNA, 18 nt, Homo sapiens
ugaauccaggccacucuu

SEQ ID NO: 753495 - RNA, 18 nt, Homo sapiens
ugaauccucaugaggcuu

SEQ ID NO: 753496 - RNA, 17 nt, Homo sapiens
ugaauccuuccauucca

SEQ ID NO: 753497 - RNA, 21 nt, Homo sapiens
ugaaucgcaaggccugugcug

SEQ ID NO: 753498 - RNA, 23 nt, Homo sapiens
ugaaucgcaaggccugugcugca

SEQ ID NO: 753499 - RNA, 17 nt, Homo sapiens
ugaaucuaacacauuuc

SEQ ID NO: 753500 - RNA, 11 nt, Homo sapiens
ugaaucuacaa

SEQ ID NO: 753501 - RNA, 14 nt, Homo sapiens
ugaaucuacauuca

SEQ ID NO: 753502 - RNA, 17 nt, Homo sapiens
ugaaucuauaaguagua

SEQ ID NO: 753503 - RNA, 17 nt, Homo sapiens
ugaaucuguaucuugcc

SEQ ID NO: 753504 - RNA, 20 nt, Homo sapiens
ugaaucugugccugcacuga

SEQ ID NO: 753505 - RNA, 16 nt, Homo sapiens
ugaaugaacaaaugaa

SEQ ID NO: 753506 - RNA, 15 nt, Homo sapiens
ugaaugauaaacucu

SEQ ID NO: 753507 - RNA, 18 nt, Homo sapiens
ugaaugcacuuuugcuca

SEQ ID NO: 753508 - RNA, 15 nt, Homo sapiens
ugaaugcuccaguca

SEQ ID NO: 753509 - RNA, 14 nt, Homo sapiens
ugaaugcuccauua

SEQ ID NO: 753510 - RNA, 12 nt, Homo sapiens
ugaaugcuuccu

SEQ ID NO: 753511 - RNA, 14 nt, Homo sapiens
ugaauggacucaaa

SEQ ID NO: 753512 - RNA, 21 nt, Homo sapiens
ugaauggacucaaacugccuu

SEQ ID NO: 753513 - RNA, 20 nt, Homo sapiens
ugaaugggacccuguugaug

SEQ ID NO: 753514 - RNA, 23 nt, Homo sapiens
ugaaugggagccagaauucacua

SEQ ID NO: 753515 - RNA, 13 nt, Homo sapiens
ugaauggggacca

SEQ ID NO: 753516 - RNA, 18 nt, Homo sapiens
ugaaugugucacuacuca

SEQ ID NO: 753517 - RNA, 14 nt, Homo sapiens
ugaaugugucaggu

SEQ ID NO: 753518 - RNA, 19 nt, Homo sapiens
ugaaugugugaauucaaua

SEQ ID NO: 753519 - RNA, 18 nt, Homo sapiens
ugaauguugugauguauu

SEQ ID NO: 753520 - RNA, 23 nt, Homo sapiens
ugaauucacuccagucaacagau

SEQ ID NO: 753521 - RNA, 14 nt, Homo sapiens
ugaauucauguugg

SEQ ID NO: 753522 - RNA, 21 nt, Homo sapiens
ugaauucuaccuuuaaggguu

SEQ ID NO: 753523 - RNA, 15 nt, Homo sapiens
ugaauuucacaagcu

SEQ ID NO: 753524 - RNA, 18 nt, Homo sapiens
ugaauuucacaagcuauu

SEQ ID NO: 753525 - RNA, 18 nt, Homo sapiens
ugaauuuggccagacaca

SEQ ID NO: 753526 - RNA, 19 nt, Homo sapiens
ugaauuuucugcagcuguu

SEQ ID NO: 753527 - RNA, 22 nt, Homo sapiens
ugaauuuugggacuucuaccca

SEQ ID NO: 753528 - RNA, 14 nt, Homo sapiens
ugaauuuuguugcu

SEQ ID NO: 753529 - RNA, 17 nt, Homo sapiens
ugacaaaaauauuuucc

SEQ ID NO: 753530 - RNA, 14 nt, Homo sapiens
ugacaaaacacagc

SEQ ID NO: 753531 - RNA, 16 nt, Homo sapiens
ugacaaacauauccuu

SEQ ID NO: 753532 - RNA, 15 nt, Homo sapiens
ugacaaauauucucu

SEQ ID NO: 753533 - RNA, 14 nt, Homo sapiens
ugacaacaguuuua

SEQ ID NO: 753534 - RNA, 19 nt, Homo sapiens
ugacaacaucccacagugg

SEQ ID NO: 753535 - RNA, 12 nt, Homo sapiens
ugacaacaucgc

SEQ ID NO: 753536 - RNA, 21 nt, Homo sapiens
ugacaaccgagaagguuuauc

SEQ ID NO: 753537 - RNA, 19 nt, Homo sapiens
ugacaaccugaauuaucua

SEQ ID NO: 753538 - RNA, 17 nt, Homo sapiens
ugacaacugugacugua

SEQ ID NO: 753539 - RNA, 16 nt, Homo sapiens
ugacaagggcccuucu

SEQ ID NO: 753540 - RNA, 16 nt, Homo sapiens
ugacaagggcugaccu

SEQ ID NO: 753541 - RNA, 14 nt, Homo sapiens
ugacaaucaacucu

SEQ ID NO: 753542 - RNA, 23 nt, Homo sapiens
ugacaaucaacucuaauagugcu

SEQ ID NO: 753543 - RNA, 14 nt, Homo sapiens
ugacaauuacucag

SEQ ID NO: 753544 - RNA, 21 nt, Homo sapiens
ugacacacaaaucccauuaaa

SEQ ID NO: 753545 - RNA, 12 nt, Homo sapiens
ugacacagcagc

SEQ ID NO: 753546 - RNA, 13 nt, Homo sapiens
ugacacauaugca

SEQ ID NO: 753547 - RNA, 18 nt, Homo sapiens
ugacaccaaaacaugccg

SEQ ID NO: 753548 - RNA, 21 nt, Homo sapiens
ugacacggccucccucugcua

SEQ ID NO: 753549 - RNA, 12 nt, Homo sapiens
ugacacugugua

SEQ ID NO: 753550 - RNA, 13 nt, Homo sapiens
ugacacuguguaa

SEQ ID NO: 753551 - RNA, 16 nt, Homo sapiens
ugacagaccacaucuu

SEQ ID NO: 753552 - RNA, 17 nt, Homo sapiens
ugacagccagagccugu

SEQ ID NO: 753553 - RNA, 16 nt, Homo sapiens
ugacagggaaaacugc

SEQ ID NO: 753554 - RNA, 22 nt, Homo sapiens
ugacagucauaaauacugucaa

SEQ ID NO: 753555 - RNA, 19 nt, Homo sapiens
ugacaguccacaggggcca

SEQ ID NO: 753556 - RNA, 20 nt, Homo sapiens
ugacagugaagcagcacugu

SEQ ID NO: 753557 - RNA, 22 nt, Homo sapiens
ugacagugaagcagcacuguga

SEQ ID NO: 753558 - RNA, 16 nt, Homo sapiens
ugacaguuuguggcau

SEQ ID NO: 753559 - RNA, 20 nt, Homo sapiens
ugacauaaaauuuacauuua

SEQ ID NO: 753560 - RNA, 19 nt, Homo sapiens
ugacauacauauuaucuca

SEQ ID NO: 753561 - RNA, 12 nt, Homo sapiens
ugacauaccuac

SEQ ID NO: 753562 - RNA, 14 nt, Homo sapiens
ugauaaacauuaaa

SEQ ID NO: 753563 - RNA, 12 nt, Homo sapiens
ugauaaaccaaa

SEQ ID NO: 753564 - RNA, 15 nt, Homo sapiens
ugauaaagcaguauu

SEQ ID NO: 753565 - RNA, 20 nt, Homo sapiens
ugauaaauccucuauugacu

SEQ ID NO: 753566 - RNA, 14 nt, Homo sapiens
ugauaacaccagug

SEQ ID NO: 753567 - RNA, 18 nt, Homo sapiens
ugauaagcauugacuugc

SEQ ID NO: 753568 - RNA, 18 nt, Homo sapiens
ugauaaguucauacauug

SEQ ID NO: 753569 - RNA, 20 nt, Homo sapiens
ugauaauagagggcuggaau

SEQ ID NO: 753570 - RNA, 16 nt, Homo sapiens
ugauaauagauucucu

SEQ ID NO: 753571 - RNA, 15 nt, Homo sapiens
ugauaauagcacuaa

SEQ ID NO: 753572 - RNA, 21 nt, Homo sapiens
ugauacacagaauauaaucuu

SEQ ID NO: 753573 - RNA, 22 nt, Homo sapiens
ugauacaugagccagugauuau

SEQ ID NO: 753574 - RNA, 14 nt, Homo sapiens
ugauaccacugcac

SEQ ID NO: 753575 - RNA, 14 nt, Homo sapiens
ugauacccugaauu

SEQ ID NO: 753576 - RNA, 19 nt, Homo sapiens
ugauacgcaacauaauuaa

SEQ ID NO: 753577 - RNA, 12 nt, Homo sapiens
ugauacugcuga

SEQ ID NO: 753578 - RNA, 20 nt, Homo sapiens
ugauacuggaggaacacuug

SEQ ID NO: 753579 - RNA, 20 nt, Homo sapiens
ugauacuuccaagugauaau

SEQ ID NO: 753580 - RNA, 17 nt, Homo sapiens
ugauacuuuagccauca

SEQ ID NO: 753581 - RNA, 12 nt, Homo sapiens
ugauacuuuuaa

SEQ ID NO: 753582 - RNA, 15 nt, Homo sapiens
ugauagggaacuggg

SEQ ID NO: 753583 - RNA, 22 nt, Homo sapiens
ugauagggaaggcuacuaccua

SEQ ID NO: 753584 - RNA, 20 nt, Homo sapiens
ugauaguuaauuauuucaac

SEQ ID NO: 753585 - RNA, 14 nt, Homo sapiens
ugauauaaaugcaa

SEQ ID NO: 753586 - RNA, 14 nt, Homo sapiens
ugauauacaaagug

SEQ ID NO: 753587 - RNA, 13 nt, Homo sapiens
ugauauacauugu

SEQ ID NO: 753588 - RNA, 13 nt, Homo sapiens
ugauauaccaaau

SEQ ID NO: 753589 - RNA, 14 nt, Homo sapiens
ugauauaugcaugu

SEQ ID NO: 753590 - RNA, 19 nt, Homo sapiens
ugauaucaacagcuucccu

SEQ ID NO: 753591 - RNA, 14 nt, Homo sapiens
ugauauccaugcca

SEQ ID NO: 753592 - RNA, 19 nt, Homo sapiens
ugauauguaaguacuucca

SEQ ID NO: 753593 - RNA, 19 nt, Homo sapiens
ugauauguucaacuggaga

SEQ ID NO: 753594 - RNA, 23 nt, Homo sapiens
ugauauucaggcuacucauucag

SEQ ID NO: 753595 - RNA, 19 nt, Homo sapiens
ugauauugcccaggcuguu

SEQ ID NO: 753596 - RNA, 15 nt, Homo sapiens
ugauauuuuccaaau

SEQ ID NO: 753597 - RNA, 17 nt, Homo sapiens
ugaucaaaaauaaacua

SEQ ID NO: 753598 - RNA, 12 nt, Homo sapiens
ugaucaacuguu

SEQ ID NO: 753599 - RNA, 16 nt, Homo sapiens
ugaucaagaaugcaau

SEQ ID NO: 753600 - RNA, 11 nt, Homo sapiens
ugaucaaguca

SEQ ID NO: 753601 - RNA, 15 nt, Homo sapiens
ugaucacacaguguu

SEQ ID NO: 753602 - RNA, 12 nt, Homo sapiens
ugaucacaguga

SEQ ID NO: 753603 - RNA, 20 nt, Homo sapiens
ugaucacauucuuuccaaaa

SEQ ID NO: 753604 - RNA, 16 nt, Homo sapiens
ugaucacccaaugcau

SEQ ID NO: 753605 - RNA, 21 nt, Homo sapiens
ugaucagcuuucaaagcauuu

SEQ ID NO: 753606 - RNA, 19 nt, Homo sapiens
ugaucagugcaauugaccu

SEQ ID NO: 753607 - RNA, 15 nt, Homo sapiens
ugaucauugcuggca

SEQ ID NO: 753608 - RNA, 21 nt, Homo sapiens
ugauccacagaaauacaugaa

SEQ ID NO: 753609 - RNA, 14 nt, Homo sapiens
ugauccauuaucua

SEQ ID NO: 753610 - RNA, 17 nt, Homo sapiens
ugauccguuccauugca

SEQ ID NO: 753611 - RNA, 10 nt, Homo sapiens
ugauccucac

SEQ ID NO: 753612 - RNA, 14 nt, Homo sapiens
ugauccugcuccag

SEQ ID NO: 753613 - RNA, 18 nt, Homo sapiens
ugauccugcugaccucac

SEQ ID NO: 753614 - RNA, 20 nt, Homo sapiens
ugaucucaaguauaugucau

SEQ ID NO: 753615 - RNA, 17 nt, Homo sapiens
ugaucucuguuacaaaa

SEQ ID NO: 753616 - RNA, 23 nt, Homo sapiens
ugaucucuucuuuuggcuuccau

SEQ ID NO: 753617 - RNA, 19 nt, Homo sapiens
ugaucuuaacaaagccuuu

SEQ ID NO: 753618 - RNA, 19 nt, Homo sapiens
ugaucuuaauuuacuuuaa

SEQ ID NO: 753619 - RNA, 11 nt, Homo sapiens
ugaucuugccu

SEQ ID NO: 753620 - RNA, 17 nt, Homo sapiens
ugaucuuguuacuguga

SEQ ID NO: 753621 - RNA, 14 nt, Homo sapiens
ugaucuuucuagag

SEQ ID NO: 753622 - RNA, 19 nt, Homo sapiens
ugaucuuucucaaucuuga

SEQ ID NO: 753623 - RNA, 16 nt, Homo sapiens
ugaugaaggauucaua

SEQ ID NO: 753624 - RNA, 20 nt, Homo sapiens
ugaugaauguacuaugucug

SEQ ID NO: 753625 - RNA, 18 nt, Homo sapiens
ugaugacccuuuucauga

SEQ ID NO: 753626 - RNA, 19 nt, Homo sapiens
ugaugagaauuguauguca

SEQ ID NO: 753627 - RNA, 14 nt, Homo sapiens
ugaugagcacgguu

SEQ ID NO: 753628 - RNA, 21 nt, Homo sapiens
ugaugaguguccuugcagggg

SEQ ID NO: 753629 - RNA, 17 nt, Homo sapiens
ugaugaugaugaugacu

SEQ ID NO: 753630 - RNA, 15 nt, Homo sapiens
ugaugcagacacaga

SEQ ID NO: 753631 - RNA, 19 nt, Homo sapiens
ugaugcauuuuuaauaagc

SEQ ID NO: 753632 - RNA, 16 nt, Homo sapiens
ugaugccaggugcaau

SEQ ID NO: 753633 - RNA, 23 nt, Homo sapiens
ugaugccauuacagaaccaaauc

SEQ ID NO: 753634 - RNA, 18 nt, Homo sapiens
ugaugcccagaugcucua

SEQ ID NO: 753635 - RNA, 21 nt, Homo sapiens
ugauggaagaugguccgugcc

SEQ ID NO: 753636 - RNA, 13 nt, Homo sapiens
ugauggaugucuu

SEQ ID NO: 753637 - RNA, 17 nt, Homo sapiens
ugauggcaacagaucug

SEQ ID NO: 753638 - RNA, 21 nt, Homo sapiens
ugauggcaccacugcacucca

SEQ ID NO: 753639 - RNA, 15 nt, Homo sapiens
ugauggccaccagcu

SEQ ID NO: 753640 - RNA, 16 nt, Homo sapiens
ugauggccaccagcuu

SEQ ID NO: 753641 - RNA, 15 nt, Homo sapiens
ugauggcgauucccu

SEQ ID NO: 753642 - RNA, 12 nt, Homo sapiens
ugauggcugaag

SEQ ID NO: 753643 - RNA, 18 nt, Homo sapiens
ugauggugagcugggaag

SEQ ID NO: 753644 - RNA, 17 nt, Homo sapiens
ugaugguggacuaagca

SEQ ID NO: 753645 - RNA, 19 nt, Homo sapiens
ugauguacagucugucaug

SEQ ID NO: 753646 - RNA, 18 nt, Homo sapiens
ugauguacugaauuccau

SEQ ID NO: 753647 - RNA, 22 nt, Homo sapiens
ugaugucaagcaccacacccca

SEQ ID NO: 753648 - RNA, 18 nt, Homo sapiens
ugauguguccucagggag

SEQ ID NO: 753649 - RNA, 11 nt, Homo sapiens
ugauguugcug

SEQ ID NO: 753650 - RNA, 12 nt, Homo sapiens
ugauguuucaua

SEQ ID NO: 753651 - RNA, 14 nt, Homo sapiens
ugauuaauguuucu

SEQ ID NO: 753652 - RNA, 15 nt, Homo sapiens
ugauuaccugccaau

SEQ ID NO: 753653 - RNA, 19 nt, Homo sapiens
ugauuacuaucauggcaua

SEQ ID NO: 753654 - RNA, 15 nt, Homo sapiens
ugauuacugcucuau

SEQ ID NO: 753655 - RNA, 22 nt, Homo sapiens
ugauuagagugcaaaagugaga

SEQ ID NO: 753656 - RNA, 15 nt, Homo sapiens
ugauuaggaagcauu

SEQ ID NO: 753657 - RNA, 23 nt, Homo sapiens
ugauuaggaauaugaccauuuga

SEQ ID NO: 753658 - RNA, 14 nt, Homo sapiens
ugauuauauucaca

SEQ ID NO: 753659 - RNA, 22 nt, Homo sapiens
ugauuaucucuuugaucuacuu

SEQ ID NO: 753660 - RNA, 22 nt, Homo sapiens
ugauuaugccacugcuuuccag

SEQ ID NO: 753661 - RNA, 20 nt, Homo sapiens
ugauuauuuuuuauacugua

SEQ ID NO: 753662 - RNA, 17 nt, Homo sapiens
ugauucacugccuuccu

SEQ ID NO: 753663 - RNA, 13 nt, Homo sapiens
ugauuccaaauau

SEQ ID NO: 753664 - RNA, 17 nt, Homo sapiens
ugauuccccuaguugag

SEQ ID NO: 753665 - RNA, 16 nt, Homo sapiens
ugauucgcccaccuca

SEQ ID NO: 753666 - RNA, 18 nt, Homo sapiens
ugauucuaauggggacac

SEQ ID NO: 753667 - RNA, 16 nt, Homo sapiens
ugauucuccugccuca

SEQ ID NO: 753668 - RNA, 20 nt, Homo sapiens
ugauucuguaauaacuagaa

SEQ ID NO: 753669 - RNA, 22 nt, Homo sapiens
ugauucuuauuugaugguggua

SEQ ID NO: 753670 - RNA, 16 nt, Homo sapiens
ugauugacacacagca

SEQ ID NO: 753671 - RNA, 20 nt, Homo sapiens
ugauugggaaaacauuugcu

SEQ ID NO: 753672 - RNA, 21 nt, Homo sapiens
ugauugggaaaacauuugcug

SEQ ID NO: 753673 - RNA, 12 nt, Homo sapiens
ugauuguacaaa

SEQ ID NO: 753674 - RNA, 15 nt, Homo sapiens
ugauuguauuuaccu

SEQ ID NO: 753675 - RNA, 17 nt, Homo sapiens
ugauugucagcuacuaa

SEQ ID NO: 753676 - RNA, 15 nt, Homo sapiens
ugauuguuugacaca

SEQ ID NO: 753677 - RNA, 20 nt, Homo sapiens
uucagacuucaucuucaaaa

SEQ ID NO: 753678 - RNA, 19 nt, Homo sapiens
uucagagcuaauaagugcu

SEQ ID NO: 753679 - RNA, 21 nt, Homo sapiens
uucagagcuaauaagugcuuu

SEQ ID NO: 753680 - RNA, 20 nt, Homo sapiens
uucagaugaccucaaugccu

SEQ ID NO: 753681 - RNA, 15 nt, Homo sapiens
uucagauuugccuua

SEQ ID NO: 753682 - RNA, 14 nt, Homo sapiens
uucagcaacuuauu

SEQ ID NO: 753683 - RNA, 15 nt, Homo sapiens
uucagcacacacaaa

SEQ ID NO: 753684 - RNA, 20 nt, Homo sapiens
uucagcacccugggugccau

SEQ ID NO: 753685 - RNA, 22 nt, Homo sapiens
uucagcacugucccuugccuca

SEQ ID NO: 753686 - RNA, 22 nt, Homo sapiens
uucagcagcagcucacacccua

SEQ ID NO: 753687 - RNA, 13 nt, Homo sapiens
uucagcagugccu

SEQ ID NO: 753688 - RNA, 21 nt, Homo sapiens
uucagcauccgcaggugcugg

SEQ ID NO: 753689 - RNA, 13 nt, Homo sapiens
uucagcaugucca

SEQ ID NO: 753690 - RNA, 14 nt, Homo sapiens
uucagccccuccuc

SEQ ID NO: 753691 - RNA, 19 nt, Homo sapiens
uucagcuucuaugcauuaa

SEQ ID NO: 753692 - RNA, 14 nt, Homo sapiens
uucaggcaggccaa

SEQ ID NO: 753693 - RNA, 16 nt, Homo sapiens
uucaggccgcaagcag

SEQ ID NO: 753694 - RNA, 21 nt, Homo sapiens
uucaggcuaagaagagauuuc

SEQ ID NO: 753695 - RNA, 18 nt, Homo sapiens
uucagguacuaaauaccu

SEQ ID NO: 753696 - RNA, 13 nt, Homo sapiens
uucaggugcuuuu

SEQ ID NO: 753697 - RNA, 21 nt, Homo sapiens
uucaguaaaagcaaaaugaua

SEQ ID NO: 753698 - RNA, 13 nt, Homo sapiens
uucaguaauaacu

SEQ ID NO: 753699 - RNA, 15 nt, Homo sapiens
uucaguacuugugaa

SEQ ID NO: 753700 - RNA, 23 nt, Homo sapiens
uucaguacuugugaaacacagcu

SEQ ID NO: 753701 - RNA, 21 nt, Homo sapiens
uucaguagaauuaccauuaau

SEQ ID NO: 753702 - RNA, 15 nt, Homo sapiens
uucaguauacugugu

SEQ ID NO: 753703 - RNA, 20 nt, Homo sapiens
uucaguauguccccauaaga

SEQ ID NO: 753704 - RNA, 22 nt, Homo sapiens
uucagucauugucuuauaugcu

SEQ ID NO: 753705 - RNA, 18 nt, Homo sapiens
uucagucucagcugcuga

SEQ ID NO: 753706 - RNA, 14 nt, Homo sapiens
uucagucucuauac

SEQ ID NO: 753707 - RNA, 23 nt, Homo sapiens
uucagucucuauaccaauaaagu

SEQ ID NO: 753708 - RNA, 14 nt, Homo sapiens
uucagucugugaaa

SEQ ID NO: 753709 - RNA, 18 nt, Homo sapiens
uucagugaagaugcugua

SEQ ID NO: 753710 - RNA, 22 nt, Homo sapiens
uucagugcaccuacugcuuacu

SEQ ID NO: 753711 - RNA, 14 nt, Homo sapiens
uucagugcaguuuc

SEQ ID NO: 753712 - RNA, 14 nt, Homo sapiens
uucagugccuuccu

SEQ ID NO: 753713 - RNA, 20 nt, Homo sapiens
uucagugcuuuuacuaucug

SEQ ID NO: 753714 - RNA, 22 nt, Homo sapiens
uucaguggcuaccuacauacaa

SEQ ID NO: 753715 - RNA, 15 nt, Homo sapiens
uucaguguaauguga

SEQ ID NO: 753716 - RNA, 23 nt, Homo sapiens
uucaguucccaccaucugauuaa

SEQ ID NO: 753717 - RNA, 15 nt, Homo sapiens
uucaguuuauuucca

SEQ ID NO: 753718 - RNA, 13 nt, Homo sapiens
uucauacagcauu

SEQ ID NO: 753719 - RNA, 12 nt, Homo sapiens
uucauacuguaa

SEQ ID NO: 753720 - RNA, 13 nt, Homo sapiens
uucauagaugaau

SEQ ID NO: 753721 - RNA, 17 nt, Homo sapiens
uucauauaccagcaaua

SEQ ID NO: 753722 - RNA, 14 nt, Homo sapiens
uucauaugcagaug

SEQ ID NO: 753723 - RNA, 15 nt, Homo sapiens
uucauaugcuguaua

SEQ ID NO: 753724 - RNA, 20 nt, Homo sapiens
uucauauguaccauguacau

SEQ ID NO: 753725 - RNA, 19 nt, Homo sapiens
uucauauucagcuugcaca

SEQ ID NO: 753726 - RNA, 15 nt, Homo sapiens
uucauauucaugcaa

SEQ ID NO: 753727 - RNA, 18 nt, Homo sapiens
uucauauuuauugauuaa

SEQ ID NO: 753728 - RNA, 20 nt, Homo sapiens
uucaucagacuccugugcaa

SEQ ID NO: 753729 - RNA, 22 nt, Homo sapiens
uucaucagacuccugugcaacu

SEQ ID NO: 753730 - RNA, 13 nt, Homo sapiens
uucauccaaugca

SEQ ID NO: 753731 - RNA, 20 nt, Homo sapiens
uucaucccguaucacagugu

SEQ ID NO: 753732 - RNA, 21 nt, Homo sapiens
uucaucccucgggugugcuau

SEQ ID NO: 753733 - RNA, 23 nt, Homo sapiens
uucaucucuuguuuacgauuuca

SEQ ID NO: 753734 - RNA, 18 nt, Homo sapiens
uucaucuucacugcaauu

SEQ ID NO: 753735 - RNA, 13 nt, Homo sapiens
uucaugaaacugu

SEQ ID NO: 753736 - RNA, 20 nt, Homo sapiens
uucaugaaugugcuggugaa

SEQ ID NO: 753737 - RNA, 19 nt, Homo sapiens
uucaugauuagcaaguuac

SEQ ID NO: 753738 - RNA, 12 nt, Homo sapiens
uucauggaccaa

SEQ ID NO: 753739 - RNA, 17 nt, Homo sapiens
uucaugggaaaacagac

SEQ ID NO: 753740 - RNA, 21 nt, Homo sapiens
uucaugggaaaacagaccugu

SEQ ID NO: 753741 - RNA, 23 nt, Homo sapiens
uucaugggaaaacagaccugugu

SEQ ID NO: 753742 - RNA, 14 nt, Homo sapiens
uucaugucacuaaa

SEQ ID NO: 753743 - RNA, 18 nt, Homo sapiens
uucaugugcugccugcaa

SEQ ID NO: 753744 - RNA, 19 nt, Homo sapiens
uucauguggcucagugccu

SEQ ID NO: 753745 - RNA, 19 nt, Homo sapiens
uucaugugguucagugccu

SEQ ID NO: 753746 - RNA, 21 nt, Homo sapiens
uucaugugguucagugccuuc

SEQ ID NO: 753747 - RNA, 21 nt, Homo sapiens
uucauguuggucugacaucaa

SEQ ID NO: 753748 - RNA, 12 nt, Homo sapiens
uucauuaccuca

SEQ ID NO: 753749 - RNA, 21 nt, Homo sapiens
uucauuaccuuuuuugauaaa

SEQ ID NO: 753750 - RNA, 22 nt, Homo sapiens
uucauuagcgauccauguaauc

SEQ ID NO: 753751 - RNA, 22 nt, Homo sapiens
uucauuagugagccaugaaauc

SEQ ID NO: 753752 - RNA, 18 nt, Homo sapiens
uucauuaucauaugaacu

SEQ ID NO: 753753 - RNA, 21 nt, Homo sapiens
uucauuaucucaaaacugcac

SEQ ID NO: 753754 - RNA, 20 nt, Homo sapiens
uucauucaaccccuucuggg

SEQ ID NO: 753755 - RNA, 20 nt, Homo sapiens
uucauuccaaaugcuuucag

SEQ ID NO: 753756 - RNA, 15 nt, Homo sapiens
uucauucucucucau

SEQ ID NO: 753757 - RNA, 15 nt, Homo sapiens
uucauuguaaaucac

SEQ ID NO: 753758 - RNA, 15 nt, Homo sapiens
uucauuguguucucu

SEQ ID NO: 753759 - RNA, 19 nt, Homo sapiens
uucauuguuuccuucugac

SEQ ID NO: 753760 - RNA, 20 nt, Homo sapiens
uucauuuaggaugcuuucau

SEQ ID NO: 753761 - RNA, 13 nt, Homo sapiens
uucauuucaggaa

SEQ ID NO: 753762 - RNA, 14 nt, Homo sapiens
uucauuucauuuca

SEQ ID NO: 753763 - RNA, 15 nt, Homo sapiens
uucauuucauuucag

SEQ ID NO: 753764 - RNA, 15 nt, Homo sapiens
uucauuuguaacuuu

SEQ ID NO: 753765 - RNA, 13 nt, Homo sapiens
uucauuuguauug

SEQ ID NO: 753766 - RNA, 17 nt, Homo sapiens
uucauuuuagacauuca

SEQ ID NO: 753767 - RNA, 15 nt, Homo sapiens
uuccaaaacauuucu

SEQ ID NO: 753768 - RNA, 15 nt, Homo sapiens
uuccaaaacuuuaau

SEQ ID NO: 753769 - RNA, 17 nt, Homo sapiens
uuccaaaauaaagcaua

SEQ ID NO: 753770 - RNA, 16 nt, Homo sapiens
uuccaaacacauacag

SEQ ID NO: 753771 - RNA, 19 nt, Homo sapiens
uuccaaaccaggacacuac

SEQ ID NO: 753772 - RNA, 15 nt, Homo sapiens
uuccaacaccacaga

SEQ ID NO: 753773 - RNA, 20 nt, Homo sapiens
uuccaacauuucucacugaa

SEQ ID NO: 753774 - RNA, 14 nt, Homo sapiens
uuccaaucaugaaa

SEQ ID NO: 753775 - RNA, 23 nt, Homo sapiens
uuccaauguagcucaguaauucc

SEQ ID NO: 753776 - RNA, 20 nt, Homo sapiens
uuccaauuugacaaaaccca

SEQ ID NO: 753777 - RNA, 16 nt, Homo sapiens
uuccacaauucacuag

SEQ ID NO: 753778 - RNA, 21 nt, Homo sapiens
uuccacacccucacugcugua

SEQ ID NO: 753779 - RNA, 19 nt, Homo sapiens
uuccaccagccugcacuac

SEQ ID NO: 753780 - RNA, 18 nt, Homo sapiens
uuccacucccuuugccag

SEQ ID NO: 753781 - RNA, 20 nt, Homo sapiens
uuccacucccuuugccagug

SEQ ID NO: 753782 - RNA, 18 nt, Homo sapiens
uuccacucgaugaugcuu

SEQ ID NO: 753783 - RNA, 15 nt, Homo sapiens
uuccacugaacaaaa

SEQ ID NO: 753784 - RNA, 19 nt, Homo sapiens
uuccacuuguuugcacugu

SEQ ID NO: 753785 - RNA, 20 nt, Homo sapiens
uuccacuuguuugcacugug

SEQ ID NO: 753786 - RNA, 23 nt, Homo sapiens
uuccagaagaagagaagcugcug

SEQ ID NO: 753787 - RNA, 22 nt, Homo sapiens
uuccagaaggcaaaaagacauu

SEQ ID NO: 753788 - RNA, 12 nt, Homo sapiens
uuccagauagca

SEQ ID NO: 753789 - RNA, 16 nt, Homo sapiens
uuccagaucacugcca

SEQ ID NO: 753790 - RNA, 15 nt, Homo sapiens
uuccagaugagucag

SEQ ID NO: 753791 - RNA, 23 nt, Homo sapiens
uucucugggcugaauguauguca

SEQ ID NO: 753792 - RNA, 19 nt, Homo sapiens
uucucuggucuccuugaga

SEQ ID NO: 753793 - RNA, 18 nt, Homo sapiens
uucucugugcaguagcau

SEQ ID NO: 753794 - RNA, 14 nt, Homo sapiens
uucucuguugucaa

SEQ ID NO: 753795 - RNA, 21 nt, Homo sapiens
uucucuuagaacauuguauua

SEQ ID NO: 753796 - RNA, 22 nt, Homo sapiens
uucucuuugcugcuggugcuaa

SEQ ID NO: 753797 - RNA, 13 nt, Homo sapiens
uucugaaacacac

SEQ ID NO: 753798 - RNA, 13 nt, Homo sapiens
uucugacaucagc

SEQ ID NO: 753799 - RNA, 11 nt, Homo sapiens
uucugacccac

SEQ ID NO: 753800 - RNA, 16 nt, Homo sapiens
uucugacuacuuguug

SEQ ID NO: 753801 - RNA, 13 nt, Homo sapiens
uucugacuuauga

SEQ ID NO: 753802 - RNA, 19 nt, Homo sapiens
uucugagcgagugcucuca

SEQ ID NO: 753803 - RNA, 19 nt, Homo sapiens
uucugaggacaccagugaa

SEQ ID NO: 753804 - RNA, 19 nt, Homo sapiens
uucugagguccuuaugucc

SEQ ID NO: 753805 - RNA, 16 nt, Homo sapiens
uucugauaaacacaau

SEQ ID NO: 753806 - RNA, 17 nt, Homo sapiens
uucugauaccacugcac

SEQ ID NO: 753807 - RNA, 13 nt, Homo sapiens
uucugaugagcau

SEQ ID NO: 753808 - RNA, 21 nt, Homo sapiens
uucugaugaucauugcuggca

SEQ ID NO: 753809 - RNA, 22 nt, Homo sapiens
uucugauuccccuccaccaaac

SEQ ID NO: 753810 - RNA, 18 nt, Homo sapiens
uucugcaccaacucaccu

SEQ ID NO: 753811 - RNA, 16 nt, Homo sapiens
uucugcagucaucucc

SEQ ID NO: 753812 - RNA, 21 nt, Homo sapiens
uucugccuccauucugaccau

SEQ ID NO: 753813 - RNA, 17 nt, Homo sapiens
uucugccugagauucuu

SEQ ID NO: 753814 - RNA, 18 nt, Homo sapiens
uucugcgcuguguacaau

SEQ ID NO: 753815 - RNA, 13 nt, Homo sapiens
uucugcucuggaa

SEQ ID NO: 753816 - RNA, 11 nt, Homo sapiens
uucugcugcuu

SEQ ID NO: 753817 - RNA, 17 nt, Homo sapiens
uucuggaagucaucuca

SEQ ID NO: 753818 - RNA, 13 nt, Homo sapiens
uucuggagucaca

SEQ ID NO: 753819 - RNA, 18 nt, Homo sapiens
uucugggaacuuccucag

SEQ ID NO: 753820 - RNA, 23 nt, Homo sapiens
uucugggagacacccaaagggug

SEQ ID NO: 753821 - RNA, 21 nt, Homo sapiens
uucugggccacucaggccagu

SEQ ID NO: 753822 - RNA, 14 nt, Homo sapiens
uucugggccaguga

SEQ ID NO: 753823 - RNA, 19 nt, Homo sapiens
uucugggguugcuccgggg

SEQ ID NO: 753824 - RNA, 18 nt, Homo sapiens
uucugggucagcuugaau

SEQ ID NO: 753825 - RNA, 18 nt, Homo sapiens
uucugguagcauauucau

SEQ ID NO: 753826 - RNA, 18 nt, Homo sapiens
uucugguuguuaugugau

SEQ ID NO: 753827 - RNA, 16 nt, Homo sapiens
uucuguaaacugugcu

SEQ ID NO: 753828 - RNA, 23 nt, Homo sapiens
uucuguaucuuucauccuugacu

SEQ ID NO: 753829 - RNA, 10 nt, Homo sapiens
uucugucacc

SEQ ID NO: 753830 - RNA, 23 nt, Homo sapiens
uucuguccugagaagcauguaau

SEQ ID NO: 753831 - RNA, 12 nt, Homo sapiens
uucugucuuccc

SEQ ID NO: 753832 - RNA, 21 nt, Homo sapiens
uucugucuucccaaacccagu

SEQ ID NO: 753833 - RNA, 13 nt, Homo sapiens
uucugugaucuuu

SEQ ID NO: 753834 - RNA, 24 nt, Homo sapiens
uucugugaucuuuuaaaguguuac

SEQ ID NO: 753835 - RNA, 22 nt, Homo sapiens
uucugugccagacauugcucuc

SEQ ID NO: 753836 - RNA, 14 nt, Homo sapiens
uucuguggauucua

SEQ ID NO: 753837 - RNA, 15 nt, Homo sapiens
uucuguggcuaaaca

SEQ ID NO: 753838 - RNA, 22 nt, Homo sapiens
uucugugggagaauucuuacau

SEQ ID NO: 753839 - RNA, 19 nt, Homo sapiens
uucugugguuucauguuag

SEQ ID NO: 753840 - RNA, 14 nt, Homo sapiens
uucuguuuggcacu

SEQ ID NO: 753841 - RNA, 22 nt, Homo sapiens
uucuguuuuguuguuugauuca

SEQ ID NO: 753842 - RNA, 15 nt, Homo sapiens
uucuuaaacucagaa

SEQ ID NO: 753843 - RNA, 23 nt, Homo sapiens
uucuuaaccaagaaacaaauaau

SEQ ID NO: 753844 - RNA, 18 nt, Homo sapiens
uucuuaacccuuuccaga

SEQ ID NO: 753845 - RNA, 16 nt, Homo sapiens
uucuuacaauugcacu

SEQ ID NO: 753846 - RNA, 18 nt, Homo sapiens
uucuuacacugugucauu

SEQ ID NO: 753847 - RNA, 14 nt, Homo sapiens
uucuuacaugcauu

SEQ ID NO: 753848 - RNA, 16 nt, Homo sapiens
uucuuagcgcaguugu

SEQ ID NO: 753849 - RNA, 13 nt, Homo sapiens
uucuuagcuguca

SEQ ID NO: 753850 - RNA, 17 nt, Homo sapiens
uucuuagucacaaaaua

SEQ ID NO: 753851 - RNA, 14 nt, Homo sapiens
uucuuauaauauua

SEQ ID NO: 753852 - RNA, 17 nt, Homo sapiens
uucuuauuaaucauaca

SEQ ID NO: 753853 - RNA, 15 nt, Homo sapiens
uucuuauuacuauua

SEQ ID NO: 753854 - RNA, 23 nt, Homo sapiens
uucuuauugaccaauuccugaca

SEQ ID NO: 753855 - RNA, 17 nt, Homo sapiens
uucuuauuuuuguacuu

SEQ ID NO: 753856 - RNA, 18 nt, Homo sapiens
uucuucaguguaauguga

SEQ ID NO: 753857 - RNA, 21 nt, Homo sapiens
uucuucaucccuuuccaguua

SEQ ID NO: 753858 - RNA, 17 nt, Homo sapiens
uucuucccuuaacucca

SEQ ID NO: 753859 - RNA, 21 nt, Homo sapiens
uucuuccuaaugucagaacag

SEQ ID NO: 753860 - RNA, 20 nt, Homo sapiens
uucuucuaagaagacauuuu

SEQ ID NO: 753861 - RNA, 12 nt, Homo sapiens
uucuucuagcuc

SEQ ID NO: 753862 - RNA, 21 nt, Homo sapiens
uucuucuauauaugaaccuau

SEQ ID NO: 753863 - RNA, 13 nt, Homo sapiens
uucuucuuuuugc

SEQ ID NO: 753864 - RNA, 20 nt, Homo sapiens
uucuugaaauguaggcauca

SEQ ID NO: 753865 - RNA, 18 nt, Homo sapiens
uucuugacaaaaccuaac

SEQ ID NO: 753866 - RNA, 19 nt, Homo sapiens
uucuugaguugucuuuugc

SEQ ID NO: 753867 - RNA, 18 nt, Homo sapiens
uucuugcuacccaugacu

SEQ ID NO: 753868 - RNA, 18 nt, Homo sapiens
uucuugcuggcucugaga

SEQ ID NO: 753869 - RNA, 23 nt, Homo sapiens
uucuuggcagcuuaacauugacu

SEQ ID NO: 753870 - RNA, 15 nt, Homo sapiens
uucuuguaagccauc

SEQ ID NO: 753871 - RNA, 15 nt, Homo sapiens
uucuuuaaaggcauc

SEQ ID NO: 753872 - RNA, 15 nt, Homo sapiens
uucuuuacaauuuca

SEQ ID NO: 753873 - RNA, 17 nt, Homo sapiens
uucuuuaccaaggauau

SEQ ID NO: 753874 - RNA, 12 nt, Homo sapiens
uucuuuaccuca

SEQ ID NO: 753875 - RNA, 22 nt, Homo sapiens
uucuuucaucucccuccuccag

SEQ ID NO: 753876 - RNA, 16 nt, Homo sapiens
uucuuucccauguauu

SEQ ID NO: 753877 - RNA, 13 nt, Homo sapiens
uucuuuccucaca

SEQ ID NO: 753878 - RNA, 14 nt, Homo sapiens
uucuuugcauucca

SEQ ID NO: 753879 - RNA, 22 nt, Homo sapiens
uucuuugucuugccccuaggaa

SEQ ID NO: 753880 - RNA, 14 nt, Homo sapiens
uucuuugugccuuu

SEQ ID NO: 753881 - RNA, 13 nt, Homo sapiens
uucuuuuauguga

SEQ ID NO: 753882 - RNA, 15 nt, Homo sapiens
uucuuuucuuuacaa

SEQ ID NO: 753883 - RNA, 13 nt, Homo sapiens
uucuuuugauaaa

SEQ ID NO: 753884 - RNA, 16 nt, Homo sapiens
uucuuuuggcuuccau

SEQ ID NO: 753885 - RNA, 20 nt, Homo sapiens
uucuuuuuccacaaggaaua

SEQ ID NO: 753886 - RNA, 18 nt, Homo sapiens
uucuuuuucguuggugua

SEQ ID NO: 753887 - RNA, 20 nt, Homo sapiens
uugaaaaaaaacccuugauu

SEQ ID NO: 753888 - RNA, 18 nt, Homo sapiens
uugaaaaccacagucagu

SEQ ID NO: 753889 - RNA, 17 nt, Homo sapiens
uugaaaagacuccaaag

SEQ ID NO: 753890 - RNA, 13 nt, Homo sapiens
uugaaaauaguua

SEQ ID NO: 753891 - RNA, 14 nt, Homo sapiens
uugaaaaugcauua

SEQ ID NO: 753892 - RNA, 15 nt, Homo sapiens
uugaaaaugggcuca

SEQ ID NO: 753893 - RNA, 12 nt, Homo sapiens
uugaaaauguuc

SEQ ID NO: 753894 - RNA, 14 nt, Homo sapiens
uugaaaauguucag

SEQ ID NO: 753895 - RNA, 17 nt, Homo sapiens
uugaaacguuaugauga

SEQ ID NO: 753896 - RNA, 12 nt, Homo sapiens
uugaaacugagu

SEQ ID NO: 753897 - RNA, 16 nt, Homo sapiens
uugaaagaaccagaga

SEQ ID NO: 753898 - RNA, 11 nt, Homo sapiens
uugaaagaaga

SEQ ID NO: 753899 - RNA, 18 nt, Homo sapiens
uugaaagacaucaaugaa

SEQ ID NO: 753900 - RNA, 19 nt, Homo sapiens
uugaaaguuagagauuuua

SEQ ID NO: 753901 - RNA, 21 nt, Homo sapiens
uugaaauaaaugacaauguaa

SEQ ID NO: 753902 - RNA, 14 nt, Homo sapiens
uugaaauaguugau

SEQ ID NO: 753903 - RNA, 16 nt, Homo sapiens
uugaaaugaaagggaa

SEQ ID NO: 753904 - RNA, 12 nt, Homo sapiens
uugaaaugauua

SEQ ID NO: 753905 - RNA, 14 nt, Homo sapiens
uugaaccaaucagu

SEQ ID NO: 753906 - RNA, 19 nt, Homo sapiens
uuccaggcagccucuguca

SEQ ID NO: 753907 - RNA, 14 nt, Homo sapiens
uuccagggaagcaa

SEQ ID NO: 753908 - RNA, 21 nt, Homo sapiens
uuccagguuccauccaccacc

SEQ ID NO: 753909 - RNA, 17 nt, Homo sapiens
uuccaguaaaugcagac

SEQ ID NO: 753910 - RNA, 19 nt, Homo sapiens
uuccagugaacauucccag

SEQ ID NO: 753911 - RNA, 18 nt, Homo sapiens
uuccauaggacauacugc

SEQ ID NO: 753912 - RNA, 19 nt, Homo sapiens
uuccauccauuaccuccau

SEQ ID NO: 753913 - RNA, 16 nt, Homo sapiens
uuccaugaguuaucau

SEQ ID NO: 753914 - RNA, 15 nt, Homo sapiens
uuccaugaugguuau

SEQ ID NO: 753915 - RNA, 14 nt, Homo sapiens
uuccaugugccuuu

SEQ ID NO: 753916 - RNA, 17 nt, Homo sapiens
uuccauguugcugccaa

SEQ ID NO: 753917 - RNA, 15 nt, Homo sapiens
uuccauuauguucau

SEQ ID NO: 753918 - RNA, 16 nt, Homo sapiens
uuccauucacaccagc

SEQ ID NO: 753919 - RNA, 15 nt, Homo sapiens
uuccauuccaagccu

SEQ ID NO: 753920 - RNA, 22 nt, Homo sapiens
uuccauugaagccgacucuggc

SEQ ID NO: 753921 - RNA, 20 nt, Homo sapiens
uuccauuuccaguucaucua

SEQ ID NO: 753922 - RNA, 20 nt, Homo sapiens
uucccaauaaaagugacucu

SEQ ID NO: 753923 - RNA, 23 nt, Homo sapiens
uucccaauuaggaaguguaacag

SEQ ID NO: 753924 - RNA, 18 nt, Homo sapiens
uucccaccuacugcacuu

SEQ ID NO: 753925 - RNA, 12 nt, Homo sapiens
uucccacugcca

SEQ ID NO: 753926 - RNA, 17 nt, Homo sapiens
uucccagaaucucugag

SEQ ID NO: 753927 - RNA, 17 nt, Homo sapiens
uucccauaguggggccu

SEQ ID NO: 753928 - RNA, 15 nt, Homo sapiens
uucccaucuccauug

SEQ ID NO: 753929 - RNA, 17 nt, Homo sapiens
uucccaucugcaccccu

SEQ ID NO: 753930 - RNA, 20 nt, Homo sapiens
uucccaucuuccaaggguac

SEQ ID NO: 753931 - RNA, 20 nt, Homo sapiens
uuccccaaggacucuuccac

SEQ ID NO: 753932 - RNA, 16 nt, Homo sapiens
uuccccaaugcuccau

SEQ ID NO: 753933 - RNA, 22 nt, Homo sapiens
uuccccaccccagcucaugccc

SEQ ID NO: 753934 - RNA, 12 nt, Homo sapiens
uuccccacugac

SEQ ID NO: 753935 - RNA, 21 nt, Homo sapiens
uuccccagcgucccagucucu

SEQ ID NO: 753936 - RNA, 19 nt, Homo sapiens
uucccccaccgguccagcu

SEQ ID NO: 753937 - RNA, 21 nt, Homo sapiens
uucccccagcccaauaaaggu

SEQ ID NO: 753938 - RNA, 15 nt, Homo sapiens
uuccccuccuuggcu

SEQ ID NO: 753939 - RNA, 12 nt, Homo sapiens
uuccccucugcu

SEQ ID NO: 753940 - RNA, 17 nt, Homo sapiens
uuccccucuucugcuaa

SEQ ID NO: 753941 - RNA, 21 nt, Homo sapiens
uuccccuugcccagggcucag

SEQ ID NO: 753942 - RNA, 15 nt, Homo sapiens
uuccccuugccuaaa

SEQ ID NO: 753943 - RNA, 14 nt, Homo sapiens
uucccgaugaacaa

SEQ ID NO: 753944 - RNA, 19 nt, Homo sapiens
uucccggcgucccuaccuc

SEQ ID NO: 753945 - RNA, 17 nt, Homo sapiens
uucccuaggggacacuu

SEQ ID NO: 753946 - RNA, 16 nt, Homo sapiens
uucccucccaguuuuc

SEQ ID NO: 753947 - RNA, 15 nt, Homo sapiens
uucccucuugcucag

SEQ ID NO: 753948 - RNA, 22 nt, Homo sapiens
uucccugaauguauugaacuug

SEQ ID NO: 753949 - RNA, 21 nt, Homo sapiens
uucccugaggaaugaaaaagg

SEQ ID NO: 753950 - RNA, 13 nt, Homo sapiens
uucccugagucac

SEQ ID NO: 753951 - RNA, 23 nt, Homo sapiens
uucccugcagucuagcaccucua

SEQ ID NO: 753952 - RNA, 19 nt, Homo sapiens
uucccuguacuuuucccau

SEQ ID NO: 753953 - RNA, 20 nt, Homo sapiens
uucccuguacuuuucccauu

SEQ ID NO: 753954 - RNA, 20 nt, Homo sapiens
uucccuguggguggggagcu

SEQ ID NO: 753955 - RNA, 22 nt, Homo sapiens
uucccuguguauucuagugaau

SEQ ID NO: 753956 - RNA, 17 nt, Homo sapiens
uucccuucccagaccag

SEQ ID NO: 753957 - RNA, 14 nt, Homo sapiens
uucccuugcuggaa

SEQ ID NO: 753958 - RNA, 20 nt, Homo sapiens
uucccuuuuaaucaacugua

SEQ ID NO: 753959 - RNA, 17 nt, Homo sapiens
uuccgucuaaucucuca

SEQ ID NO: 753960 - RNA, 17 nt, Homo sapiens
uuccuaacuagaauuag

SEQ ID NO: 753961 - RNA, 16 nt, Homo sapiens
uuccuaauaugcuuua

SEQ ID NO: 753962 - RNA, 19 nt, Homo sapiens
uuccuaauaugcuuuacaa

SEQ ID NO: 753963 - RNA, 22 nt, Homo sapiens
uuccuacacguuagauuugccg

SEQ ID NO: 753964 - RNA, 17 nt, Homo sapiens
uuccuacccaaccacuc

SEQ ID NO: 753965 - RNA, 17 nt, Homo sapiens
uuccuacuugcacucuu

SEQ ID NO: 753966 - RNA, 17 nt, Homo sapiens
uuccuauaacacuguga

SEQ ID NO: 753967 - RNA, 16 nt, Homo sapiens
uuccuauguaacugca

SEQ ID NO: 753968 - RNA, 18 nt, Homo sapiens
uuccuauuucuuucagca

SEQ ID NO: 753969 - RNA, 14 nt, Homo sapiens
uuccucagcugcca

SEQ ID NO: 753970 - RNA, 16 nt, Homo sapiens
uuccucaugaauguaa

SEQ ID NO: 753971 - RNA, 20 nt, Homo sapiens
uuccuccaagcuauucaauu

SEQ ID NO: 753972 - RNA, 13 nt, Homo sapiens
uuccuccauaaau

SEQ ID NO: 753973 - RNA, 15 nt, Homo sapiens
uuccucccaacaagc

SEQ ID NO: 753974 - RNA, 15 nt, Homo sapiens
uuccuccuacuuaca

SEQ ID NO: 753975 - RNA, 22 nt, Homo sapiens
uuccuccucuauuuaagauaua

SEQ ID NO: 753976 - RNA, 20 nt, Homo sapiens
uuccucucucuaccagucua

SEQ ID NO: 753977 - RNA, 18 nt, Homo sapiens
uuccucucucucuuccuc

SEQ ID NO: 753978 - RNA, 18 nt, Homo sapiens
uuccugaaaauugcaaua

SEQ ID NO: 753979 - RNA, 20 nt, Homo sapiens
uuccugacaaaaguuccaua

SEQ ID NO: 753980 - RNA, 16 nt, Homo sapiens
uuccugauacauuaaa

SEQ ID NO: 753981 - RNA, 21 nt, Homo sapiens
uuccugcaacucaaggacuuu

SEQ ID NO: 753982 - RNA, 18 nt, Homo sapiens
uuccugcaucucugugaa

SEQ ID NO: 753983 - RNA, 21 nt, Homo sapiens
uuccugcgcgucaucucugac

SEQ ID NO: 753984 - RNA, 16 nt, Homo sapiens
uuccugcuccaugacu

SEQ ID NO: 753985 - RNA, 19 nt, Homo sapiens
uuccugcugccauccucac

SEQ ID NO: 753986 - RNA, 22 nt, Homo sapiens
uuccuggccuucugaacuccau

SEQ ID NO: 753987 - RNA, 13 nt, Homo sapiens
uuccugggaacau

SEQ ID NO: 753988 - RNA, 21 nt, Homo sapiens
uuccugguggauacuguagaa

SEQ ID NO: 753989 - RNA, 14 nt, Homo sapiens
uuccugguuugacu

SEQ ID NO: 753990 - RNA, 14 nt, Homo sapiens
uuccuguagggggc

SEQ ID NO: 753991 - RNA, 11 nt, Homo sapiens
uuccugugauu

SEQ ID NO: 753992 - RNA, 15 nt, Homo sapiens
uuccuguucagugag

SEQ ID NO: 753993 - RNA, 15 nt, Homo sapiens
uuccuuaaacugugu

SEQ ID NO: 753994 - RNA, 15 nt, Homo sapiens
uuccuuagaauggag

SEQ ID NO: 753995 - RNA, 21 nt, Homo sapiens
uuccuugccuaaggugucuga

SEQ ID NO: 753996 - RNA, 17 nt, Homo sapiens
uuccuugccugugacuu

SEQ ID NO: 753997 - RNA, 18 nt, Homo sapiens
uuccuuggccaugcagaa

SEQ ID NO: 753998 - RNA, 22 nt, Homo sapiens
uuccuuguuccaauuugacaaa

SEQ ID NO: 753999 - RNA, 23 nt, Homo sapiens
cuuaguucugguugauucacuca

SEQ ID NO: 754000 - RNA, 15 nt, Homo sapiens
cuuauauuaagcaaa

SEQ ID NO: 754001 - RNA, 17 nt, Homo sapiens
cuuauauuaagcaaaca

SEQ ID NO: 754002 - RNA, 19 nt, Homo sapiens
cuuaucaacauuuguucca

SEQ ID NO: 754003 - RNA, 15 nt, Homo sapiens
cuuaucaacuaauga

SEQ ID NO: 754004 - RNA, 14 nt, Homo sapiens
cuuaucugucacac

SEQ ID NO: 754005 - RNA, 12 nt, Homo sapiens
cuuaucuugcac

SEQ ID NO: 754006 - RNA, 21 nt, Homo sapiens
cuuaugcaaucuauguuugca

SEQ ID NO: 754007 - RNA, 12 nt, Homo sapiens
cuuauggccaau

SEQ ID NO: 754008 - RNA, 15 nt, Homo sapiens
cuuauguguugugua

SEQ ID NO: 754009 - RNA, 14 nt, Homo sapiens
cuuauguugcacaa

SEQ ID NO: 754010 - RNA, 22 nt, Homo sapiens
cuuauguugcacaaugagaaaa

SEQ ID NO: 754011 - RNA, 17 nt, Homo sapiens
cuuauuaaucauacaaa

SEQ ID NO: 754012 - RNA, 19 nt, Homo sapiens
cuuauuagaagccaaguaa

SEQ ID NO: 754013 - RNA, 24 nt, Homo sapiens
cuuauugcaucccaaaccacgccu

SEQ ID NO: 754014 - RNA, 19 nt, Homo sapiens
cuuauugugugcgcugccu

SEQ ID NO: 754015 - RNA, 16 nt, Homo sapiens
cuuauuuaaugaaaga

SEQ ID NO: 754016 - RNA, 14 nt, Homo sapiens
cuuauuuauaccuc

SEQ ID NO: 754017 - RNA, 21 nt, Homo sapiens
cuuauuucacuaaauguaaaa

SEQ ID NO: 754018 - RNA, 19 nt, Homo sapiens
cuuauuucuagaagcacau

SEQ ID NO: 754019 - RNA, 16 nt, Homo sapiens
cuuauuucucauauca

SEQ ID NO: 754020 - RNA, 14 nt, Homo sapiens
cuuccgauguuugu

SEQ ID NO: 754021 - RNA, 15 nt, Homo sapiens
cuuccguccauccau

SEQ ID NO: 754022 - RNA, 20 nt, Homo sapiens
cuuccuaauaugcuuuacaa

SEQ ID NO: 754023 - RNA, 12 nt, Homo sapiens
cuuccuaccucu

SEQ ID NO: 754024 - RNA, 16 nt, Homo sapiens
cuuccuauuucagaag

SEQ ID NO: 754025 - RNA, 17 nt, Homo sapiens
cuuccucacuaugacac

SEQ ID NO: 754026 - RNA, 18 nt, Homo sapiens
cuuccucacuaugacacu

SEQ ID NO: 754027 - RNA, 20 nt, Homo sapiens
cuuccuccugauggccaaga

SEQ ID NO: 754028 - RNA, 21 nt, Homo sapiens
cuuccucucaggcucuugacu

SEQ ID NO: 754029 - RNA, 13 nt, Homo sapiens
cuuccucucucua

SEQ ID NO: 754030 - RNA, 15 nt, Homo sapiens
cuuccugacacuuua

SEQ ID NO: 754031 - RNA, 19 nt, Homo sapiens
cuuccugaguggugccaaa

SEQ ID NO: 754032 - RNA, 20 nt, Homo sapiens
cuuccugaguggugccaaac

SEQ ID NO: 754033 - RNA, 11 nt, Homo sapiens
cuuccugauga

SEQ ID NO: 754034 - RNA, 17 nt, Homo sapiens
cuuccugggcaaagaag

SEQ ID NO: 754035 - RNA, 16 nt, Homo sapiens
cuuccuguaaugcagg

SEQ ID NO: 754036 - RNA, 15 nt, Homo sapiens
cuuccuguacuugaa

SEQ ID NO: 754037 - RNA, 15 nt, Homo sapiens
cuuccuguccacucu

SEQ ID NO: 754038 - RNA, 15 nt, Homo sapiens
cuuccuguccagcuc

SEQ ID NO: 754039 - RNA, 22 nt, Homo sapiens
cuuccugucccacuacuguaga

SEQ ID NO: 754040 - RNA, 15 nt, Homo sapiens
cuuccugugauccac

SEQ ID NO: 754041 - RNA, 23 nt, Homo sapiens
cuuccuguguggccugccuucac

SEQ ID NO: 754042 - RNA, 18 nt, Homo sapiens
cuuccuuuuaacugccaa

SEQ ID NO: 754043 - RNA, 15 nt, Homo sapiens
cuucgaccacagcaa

SEQ ID NO: 754044 - RNA, 17 nt, Homo sapiens
cuucgacuacugcuccu

SEQ ID NO: 754045 - RNA, 14 nt, Homo sapiens
cuucgacucaggau

SEQ ID NO: 754046 - RNA, 19 nt, Homo sapiens
cuucgaggcuuuacagugu

SEQ ID NO: 754047 - RNA, 14 nt, Homo sapiens
cuucgaguccagga

SEQ ID NO: 754048 - RNA, 23 nt, Homo sapiens
cuucgauacaccgggccuggaga

SEQ ID NO: 754049 - RNA, 13 nt, Homo sapiens
cuucgcccugugc

SEQ ID NO: 754050 - RNA, 18 nt, Homo sapiens
cuucggcagggaggugaa

SEQ ID NO: 754051 - RNA, 14 nt, Homo sapiens
cuucggcaucuucu

SEQ ID NO: 754052 - RNA, 22 nt, Homo sapiens
cuucgggcugugcccggggaaa

SEQ ID NO: 754053 - RNA, 18 nt, Homo sapiens
cuucgguuucugagcaua

SEQ ID NO: 754054 - RNA, 19 nt, Homo sapiens
cuucuaaaugagucacuga

SEQ ID NO: 754055 - RNA, 16 nt, Homo sapiens
cuucuaagaaaagccu

SEQ ID NO: 754056 - RNA, 19 nt, Homo sapiens
cuucuaauuagaucaauua

SEQ ID NO: 754057 - RNA, 23 nt, Homo sapiens
cuucuaccucuuggcugccuugu

SEQ ID NO: 754058 - RNA, 16 nt, Homo sapiens
cuucuaccugccccca

SEQ ID NO: 754059 - RNA, 13 nt, Homo sapiens
cuucuaccuggaa

SEQ ID NO: 754060 - RNA, 22 nt, Homo sapiens
cuucuauaccgcuucgacugga

SEQ ID NO: 754061 - RNA, 13 nt, Homo sapiens
cuucuauuaauca

SEQ ID NO: 754062 - RNA, 14 nt, Homo sapiens
cuucuauuaaucaa

SEQ ID NO: 754063 - RNA, 19 nt, Homo sapiens
cuucuauuuaaugcuucca

SEQ ID NO: 754064 - RNA, 23 nt, Homo sapiens
cuucuauuuuuaucaugaauucc

SEQ ID NO: 754065 - RNA, 18 nt, Homo sapiens
cuucucagaagcacagaa

SEQ ID NO: 754066 - RNA, 11 nt, Homo sapiens
cuucucagugu

SEQ ID NO: 754067 - RNA, 15 nt, Homo sapiens
cuucuccaaaugaga

SEQ ID NO: 754068 - RNA, 16 nt, Homo sapiens
cuucuccaaaugagau

SEQ ID NO: 754069 - RNA, 16 nt, Homo sapiens
cuucuccaugcugcaa

SEQ ID NO: 754070 - RNA, 23 nt, Homo sapiens
cuucuccaugcugcaaaggagaa

SEQ ID NO: 754071 - RNA, 17 nt, Homo sapiens
cuucuccgccagccucc

SEQ ID NO: 754072 - RNA, 16 nt, Homo sapiens
cuucucguuaaggaga

SEQ ID NO: 754073 - RNA, 18 nt, Homo sapiens
cuucucuacagacuucuc

SEQ ID NO: 754074 - RNA, 17 nt, Homo sapiens
cuucucugugaacuauu

SEQ ID NO: 754075 - RNA, 19 nt, Homo sapiens
cuucucuuccuagaucugc

SEQ ID NO: 754076 - RNA, 12 nt, Homo sapiens
cuucucuugucc

SEQ ID NO: 754077 - RNA, 17 nt, Homo sapiens
cuucugaaaaaguaucc

SEQ ID NO: 754078 - RNA, 18 nt, Homo sapiens
cuucugaauaaagcaauu

SEQ ID NO: 754079 - RNA, 19 nt, Homo sapiens
cuucugagagcaaagggaa

SEQ ID NO: 754080 - RNA, 18 nt, Homo sapiens
cuucugagcacuguuuau

SEQ ID NO: 754081 - RNA, 13 nt, Homo sapiens
cuucugcacacaa

SEQ ID NO: 754082 - RNA, 16 nt, Homo sapiens
cuucugcaccaacuca

SEQ ID NO: 754083 - RNA, 13 nt, Homo sapiens
cuucugcaguuag

SEQ ID NO: 754084 - RNA, 17 nt, Homo sapiens
cuucugccuaacuugua

SEQ ID NO: 754085 - RNA, 21 nt, Homo sapiens
cuucugccucgucauggccag

SEQ ID NO: 754086 - RNA, 15 nt, Homo sapiens
cuucugccuguuaua

SEQ ID NO: 754087 - RNA, 15 nt, Homo sapiens
cuucugcugcccuga

SEQ ID NO: 754088 - RNA, 22 nt, Homo sapiens
cuucugcuggcagaaagcaaau

SEQ ID NO: 754089 - RNA, 18 nt, Homo sapiens
cuucuggaacauuccaaa

SEQ ID NO: 754090 - RNA, 18 nt, Homo sapiens
cuucuggagaaagcucau

SEQ ID NO: 754091 - RNA, 23 nt, Homo sapiens
cuucuggagauggauccuuccau

SEQ ID NO: 754092 - RNA, 21 nt, Homo sapiens
cuucuggcagggaagugggga

SEQ ID NO: 754093 - RNA, 17 nt, Homo sapiens
cuucuggccggugcugg

SEQ ID NO: 754094 - RNA, 18 nt, Homo sapiens
cuucugggaacuuccuca

SEQ ID NO: 754095 - RNA, 16 nt, Homo sapiens
cuucugggacuggaca

SEQ ID NO: 754096 - RNA, 21 nt, Homo sapiens
cuucugguuguauuucuauau

SEQ ID NO: 754097 - RNA, 11 nt, Homo sapiens
cuucugugguc

SEQ ID NO: 754098 - RNA, 16 nt, Homo sapiens
cuucuguucugcagac

SEQ ID NO: 754099 - RNA, 16 nt, Homo sapiens
cuucuuacaacagaga

SEQ ID NO: 754100 - RNA, 17 nt, Homo sapiens
cuucuuacaacagagau

SEQ ID NO: 754101 - RNA, 21 nt, Homo sapiens
cuucuugcuauaugauuuagc

SEQ ID NO: 754102 - RNA, 13 nt, Homo sapiens
cuucuugcucccc

SEQ ID NO: 754103 - RNA, 21 nt, Homo sapiens
cuucuuugccuucucuugucc

SEQ ID NO: 754104 - RNA, 14 nt, Homo sapiens
cuucuuugcugcug

SEQ ID NO: 754105 - RNA, 15 nt, Homo sapiens
cuucuuugcugcugc

SEQ ID NO: 754106 - RNA, 16 nt, Homo sapiens
cuucuuugcugcugcu

SEQ ID NO: 754107 - RNA, 15 nt, Homo sapiens
cuucuuugugccuuu

SEQ ID NO: 754108 - RNA, 17 nt, Homo sapiens
cuucuuuuggcuuccau

SEQ ID NO: 754109 - RNA, 21 nt, Homo sapiens
cuugaaaagcuaguguaccuc

SEQ ID NO: 754110 - RNA, 23 nt, Homo sapiens
cuugaaaagcuaguguaccuccu

SEQ ID NO: 754111 - RNA, 14 nt, Homo sapiens
cuugaaacauuaua

SEQ ID NO: 754112 - RNA, 15 nt, Homo sapiens
cuugaaaguagcaau

SEQ ID NO: 754113 - RNA, 17 nt, Homo sapiens
cuugaaaugaaagggaa

SEQ ID NO: 754114 - RNA, 15 nt, Homo sapiens
cuugaaauguagaau

SEQ ID NO: 754115 - RNA, 15 nt, Homo sapiens
uucuguguugccaag

SEQ ID NO: 754116 - RNA, 14 nt, Homo sapiens
uucuguuacuuugc

SEQ ID NO: 754117 - RNA, 14 nt, Homo sapiens
uucuguugauccca

SEQ ID NO: 754118 - RNA, 13 nt, Homo sapiens
uucuguugccaca

SEQ ID NO: 754119 - RNA, 20 nt, Homo sapiens
uucuguuuggcacuuguauu

SEQ ID NO: 754120 - RNA, 22 nt, Homo sapiens
uucuguuuuuaaugcuauuuga

SEQ ID NO: 754121 - RNA, 17 nt, Homo sapiens
uucuuaaaaaacauaua

SEQ ID NO: 754122 - RNA, 21 nt, Homo sapiens
uucuuaaaauguuaacuggca

SEQ ID NO: 754123 - RNA, 17 nt, Homo sapiens
uucuuaaagcaaaguca

SEQ ID NO: 754124 - RNA, 22 nt, Homo sapiens
uucuuaaauggaauuauuuuga

SEQ ID NO: 754125 - RNA, 19 nt, Homo sapiens
uucuuaacuaucauuauuu

SEQ ID NO: 754126 - RNA, 17 nt, Homo sapiens
uucuuaagggcacacac

SEQ ID NO: 754127 - RNA, 20 nt, Homo sapiens
uucuuaaguaaugauacugu

SEQ ID NO: 754128 - RNA, 21 nt, Homo sapiens
uucuuaauccaguucugcaaa

SEQ ID NO: 754129 - RNA, 12 nt, Homo sapiens
uucuuaaugugu

SEQ ID NO: 754130 - RNA, 21 nt, Homo sapiens
uucuuacaauugcacugcugu

SEQ ID NO: 754131 - RNA, 17 nt, Homo sapiens
uucuuacaugcauuuga

SEQ ID NO: 754132 - RNA, 19 nt, Homo sapiens
uucuuacuucccuaaugaa

SEQ ID NO: 754133 - RNA, 15 nt, Homo sapiens
uucuuagacuuaucu

SEQ ID NO: 754134 - RNA, 16 nt, Homo sapiens
uucuuagaguguagcu

SEQ ID NO: 754135 - RNA, 15 nt, Homo sapiens
cuuguaacaucaggg

SEQ ID NO: 754136 - RNA, 12 nt, Homo sapiens
cuuguaagccau

SEQ ID NO: 754137 - RNA, 17 nt, Homo sapiens
cuuguaaucaagccuuu

SEQ ID NO: 754138 - RNA, 23 nt, Homo sapiens
cuuguaauuguggauuaauguca

SEQ ID NO: 754139 - RNA, 15 nt, Homo sapiens
cuuguaccauauaga

SEQ ID NO: 754140 - RNA, 23 nt, Homo sapiens
cuuguaguauuuugggagcaaaa

SEQ ID NO: 754141 - RNA, 15 nt, Homo sapiens
cuuguauguuuagag

SEQ ID NO: 754142 - RNA, 24 nt, Homo sapiens
cuugucacgaauuccaucuuguaa

SEQ ID NO: 754143 - RNA, 12 nt, Homo sapiens
cuugucauccac

SEQ ID NO: 754144 - RNA, 17 nt, Homo sapiens
cuugucaugugacaggu

SEQ ID NO: 754145 - RNA, 16 nt, Homo sapiens
cuugucauuccagagu

SEQ ID NO: 754146 - RNA, 20 nt, Homo sapiens
cuugucccucucacucccca

SEQ ID NO: 754147 - RNA, 16 nt, Homo sapiens
cuugucccuuucccua

SEQ ID NO: 754148 - RNA, 19 nt, Homo sapiens
cuuguccuugagugcucuu

SEQ ID NO: 754149 - RNA, 14 nt, Homo sapiens
cuugucuucuggua

SEQ ID NO: 754150 - RNA, 19 nt, Homo sapiens
cuugugaaacacagcuguu

SEQ ID NO: 754151 - RNA, 17 nt, Homo sapiens
cuugugaaguggaaaug

SEQ ID NO: 754152 - RNA, 22 nt, Homo sapiens
cuugugagagcccauucccacc

SEQ ID NO: 754153 - RNA, 16 nt, Homo sapiens
cuugugauccuaaaau

SEQ ID NO: 754154 - RNA, 22 nt, Homo sapiens
cuuguggcuucucucucuagca

SEQ ID NO: 754155 - RNA, 18 nt, Homo sapiens
cuugugguugaaaaccac

SEQ ID NO: 754156 - RNA, 21 nt, Homo sapiens
cuugugguugaaaaccacagu

SEQ ID NO: 754157 - RNA, 19 nt, Homo sapiens
cuugugucuuuggugggga

SEQ ID NO: 754158 - RNA, 23 nt, Homo sapiens
cuuguguguguguguugauccca

SEQ ID NO: 754159 - RNA, 17 nt, Homo sapiens
cuuguguuacuugccaa

SEQ ID NO: 754160 - RNA, 15 nt, Homo sapiens
cuuguuaacagugga

SEQ ID NO: 754161 - RNA, 13 nt, Homo sapiens
cuuguuaauguca

SEQ ID NO: 754162 - RNA, 18 nt, Homo sapiens
cuuguuaauuuuauucaa

SEQ ID NO: 754163 - RNA, 15 nt, Homo sapiens
cuuguuacugugaua

SEQ ID NO: 754164 - RNA, 15 nt, Homo sapiens
cuuguucuacugaga

SEQ ID NO: 754165 - RNA, 14 nt, Homo sapiens
cuuguuuacagcac

SEQ ID NO: 754166 - RNA, 20 nt, Homo sapiens
cuuguuuccuuuugggcuca

SEQ ID NO: 754167 - RNA, 13 nt, Homo sapiens
cuuguuugcacug

SEQ ID NO: 754168 - RNA, 18 nt, Homo sapiens
cuuguuuggggcacagua

SEQ ID NO: 754169 - RNA, 18 nt, Homo sapiens
cuuguuuuacccuauaca

SEQ ID NO: 754170 - RNA, 16 nt, Homo sapiens
cuuguuuuaugcucag

SEQ ID NO: 754171 - RNA, 15 nt, Homo sapiens
cuuguuuucuucaca

SEQ ID NO: 754172 - RNA, 16 nt, Homo sapiens
cuuguuuucuucacag

SEQ ID NO: 754173 - RNA, 21 nt, Homo sapiens
cuuguuuuuccacuacugcua

SEQ ID NO: 754174 - RNA, 16 nt, Homo sapiens
cuuguuuuugcacaug

SEQ ID NO: 754175 - RNA, 20 nt, Homo sapiens
cuuuaaaaguauccagagau

SEQ ID NO: 754176 - RNA, 14 nt, Homo sapiens
cuuuaaacuuggaa

SEQ ID NO: 754177 - RNA, 17 nt, Homo sapiens
cuuuaaaguaccuguag

SEQ ID NO: 754178 - RNA, 16 nt, Homo sapiens
cuuuaaaucugugaug

SEQ ID NO: 754179 - RNA, 13 nt, Homo sapiens
cuuuaaaugcaac

SEQ ID NO: 754180 - RNA, 21 nt, Homo sapiens
cuuuaaauguaaaauauuuga

SEQ ID NO: 754181 - RNA, 19 nt, Homo sapiens
cuuuaacugacaagccauc

SEQ ID NO: 754182 - RNA, 21 nt, Homo sapiens
cuuuaacuuucagaggcaaua

SEQ ID NO: 754183 - RNA, 20 nt, Homo sapiens
cuuuaagaacaaacucugaa

SEQ ID NO: 754184 - RNA, 21 nt, Homo sapiens
cuuuaagcauugguuauucaa

SEQ ID NO: 754185 - RNA, 20 nt, Homo sapiens
cuuuaagccugcauucuuaa

SEQ ID NO: 754186 - RNA, 21 nt, Homo sapiens
cuuuaauaaauuuaauaaaua

SEQ ID NO: 754187 - RNA, 18 nt, Homo sapiens
cuuuaauagaaguuuuau

SEQ ID NO: 754188 - RNA, 12 nt, Homo sapiens
cuuuaauguugu

SEQ ID NO: 754189 - RNA, 12 nt, Homo sapiens
cuuuaauuguau

SEQ ID NO: 754190 - RNA, 20 nt, Homo sapiens
cuuuacaaucugcacuuuaa

SEQ ID NO: 754191 - RNA, 18 nt, Homo sapiens
cuuuacaccaacuccuaa

SEQ ID NO: 754192 - RNA, 16 nt, Homo sapiens
cuuuacagacaggaaa

SEQ ID NO: 754193 - RNA, 21 nt, Homo sapiens
cuuuacuaauaaacuguguag

SEQ ID NO: 754194 - RNA, 14 nt, Homo sapiens
cuuuacuacugugg

SEQ ID NO: 754195 - RNA, 18 nt, Homo sapiens
cuuuacucaaauugguga

SEQ ID NO: 754196 - RNA, 15 nt, Homo sapiens
cuuuacuccguaaca

SEQ ID NO: 754197 - RNA, 20 nt, Homo sapiens
cuuuacuccguaacagauuu

SEQ ID NO: 754198 - RNA, 22 nt, Homo sapiens
cuuuacucucuccgauuugcuu

SEQ ID NO: 754199 - RNA, 14 nt, Homo sapiens
cuuuacugugcuua

SEQ ID NO: 754200 - RNA, 19 nt, Homo sapiens
cuuuacuguuagucauuug

SEQ ID NO: 754201 - RNA, 13 nt, Homo sapiens
cuuuacuucucac

SEQ ID NO: 754202 - RNA, 17 nt, Homo sapiens
cuuuagaaacucaaaaa

SEQ ID NO: 754203 - RNA, 14 nt, Homo sapiens
cuuuagaacucuag

SEQ ID NO: 754204 - RNA, 15 nt, Homo sapiens
cuuuagacuucccac

SEQ ID NO: 754205 - RNA, 21 nt, Homo sapiens
cuuuagagaauaccaguguua

SEQ ID NO: 754206 - RNA, 16 nt, Homo sapiens
cuuuagagaaugccac

SEQ ID NO: 754207 - RNA, 18 nt, Homo sapiens
cuuuagaugccaaaccac

SEQ ID NO: 754208 - RNA, 13 nt, Homo sapiens
cuuuagcaugcua

SEQ ID NO: 754209 - RNA, 17 nt, Homo sapiens
cuuuaguagacauuuau

SEQ ID NO: 754210 - RNA, 21 nt, Homo sapiens
cuuuauaaaacauguacaaaa

SEQ ID NO: 754211 - RNA, 19 nt, Homo sapiens
cuuuauaaucuacuccuug

SEQ ID NO: 754212 - RNA, 19 nt, Homo sapiens
cuuuauacacaguggauug

SEQ ID NO: 754213 - RNA, 21 nt, Homo sapiens
cuuuauauuuuggguacugga

SEQ ID NO: 754214 - RNA, 14 nt, Homo sapiens
cuuuaucauugcua

SEQ ID NO: 754215 - RNA, 11 nt, Homo sapiens
cuuuaucucag

SEQ ID NO: 754216 - RNA, 13 nt, Homo sapiens
cuuuaucucaggg

SEQ ID NO: 754217 - RNA, 19 nt, Homo sapiens
cuuuaugaucuggcccuug

SEQ ID NO: 754218 - RNA, 23 nt, Homo sapiens
cuuuaugaugacugcuuaacucc

SEQ ID NO: 754219 - RNA, 22 nt, Homo sapiens
cuuuaugcaaauacaaucagcc

SEQ ID NO: 754220 - RNA, 13 nt, Homo sapiens
cuuuaugcacauu

SEQ ID NO: 754221 - RNA, 15 nt, Homo sapiens
cuuuaugcagagcca

SEQ ID NO: 754222 - RNA, 21 nt, Homo sapiens
cuuuaugcagagccacagcug

SEQ ID NO: 754223 - RNA, 18 nt, Homo sapiens
cuuuaugccggaugugcu

SEQ ID NO: 754224 - RNA, 21 nt, Homo sapiens
cuuuaugcuaguuugaccuca

SEQ ID NO: 754225 - RNA, 22 nt, Homo sapiens
cuuuaugcuaguuugaccucau

SEQ ID NO: 754226 - RNA, 14 nt, Homo sapiens
cuuuaugugcaaaa

SEQ ID NO: 754227 - RNA, 17 nt, Homo sapiens
cuuuauuaauaaaaccu

SEQ ID NO: 754228 - RNA, 19 nt, Homo sapiens
cuuuauucagagcuaauaa

SEQ ID NO: 754229 - RNA, 20 nt, Homo sapiens
cuuuauuucuagcagaguga

SEQ ID NO: 754230 - RNA, 14 nt, Homo sapiens
cuuucaaacauaua

SEQ ID NO: 754231 - RNA, 15 nt, Homo sapiens
uugccucuacuuuga

SEQ ID NO: 754232 - RNA, 22 nt, Homo sapiens
uugccugcagauugucugugau

SEQ ID NO: 754233 - RNA, 19 nt, Homo sapiens
uugccugcagggccauggc

SEQ ID NO: 754234 - RNA, 14 nt, Homo sapiens
uugccugccauuuu

SEQ ID NO: 754235 - RNA, 22 nt, Homo sapiens
uugccuucaucuucacugcaau

SEQ ID NO: 754236 - RNA, 15 nt, Homo sapiens
uugccuugggcugcu

SEQ ID NO: 754237 - RNA, 15 nt, Homo sapiens
uugcgauagagucuc

SEQ ID NO: 754238 - RNA, 15 nt, Homo sapiens
uugcuaaaagauuau

SEQ ID NO: 754239 - RNA, 12 nt, Homo sapiens
uugcuacauucu

SEQ ID NO: 754240 - RNA, 15 nt, Homo sapiens
uugcuaccucaaggg

SEQ ID NO: 754241 - RNA, 17 nt, Homo sapiens
uugcuacugguucagca

SEQ ID NO: 754242 - RNA, 12 nt, Homo sapiens
uugcuagauuuc

SEQ ID NO: 754243 - RNA, 13 nt, Homo sapiens
uugcuagcaguaa

SEQ ID NO: 754244 - RNA, 21 nt, Homo sapiens
uugcuagguuuugcuacauga

SEQ ID NO: 754245 - RNA, 15 nt, Homo sapiens
uugcuauagagccua

SEQ ID NO: 754246 - RNA, 14 nt, Homo sapiens
uugcuaugaagcgu

SEQ ID NO: 754247 - RNA, 19 nt, Homo sapiens
uugcuccuauacuauugaa

SEQ ID NO: 754248 - RNA, 20 nt, Homo sapiens
uugcucugaauguccugaca

SEQ ID NO: 754249 - RNA, 16 nt, Homo sapiens
uugcucuggacagaga

SEQ ID NO: 754250 - RNA, 14 nt, Homo sapiens
gaaggcuaugggga

SEQ ID NO: 754251 - RNA, 14 nt, Homo sapiens
gaaggcuucugugu

SEQ ID NO: 754252 - RNA, 14 nt, Homo sapiens
gaagggaaguugcu

SEQ ID NO: 754253 - RNA, 20 nt, Homo sapiens
gaagggaauuaaaaagaaga

SEQ ID NO: 754254 - RNA, 16 nt, Homo sapiens
gaagggagaauugaga

SEQ ID NO: 754255 - RNA, 10 nt, Homo sapiens
gaagggccag

SEQ ID NO: 754256 - RNA, 14 nt, Homo sapiens
gaagggggcugugu

SEQ ID NO: 754257 - RNA, 15 nt, Homo sapiens
gaagggggcugugug

SEQ ID NO: 754258 - RNA, 19 nt, Homo sapiens
gaagggggucaaaggaaga

SEQ ID NO: 754259 - RNA, 17 nt, Homo sapiens
gaagggucucucuccag

SEQ ID NO: 754260 - RNA, 21 nt, Homo sapiens
gaaggguuuugcuacauucua

SEQ ID NO: 754261 - RNA, 21 nt, Homo sapiens
gaagguaauguuuaauguuga

SEQ ID NO: 754262 - RNA, 19 nt, Homo sapiens
gaagguagcccagcacugu

SEQ ID NO: 754263 - RNA, 20 nt, Homo sapiens
gaagguauuagcaaagcaaa

SEQ ID NO: 754264 - RNA, 18 nt, Homo sapiens
gaagguccccuggcagug

SEQ ID NO: 754265 - RNA, 14 nt, Homo sapiens
gaagguuaucagug

SEQ ID NO: 754266 - RNA, 18 nt, Homo sapiens
gaaguaaacagauggcac

SEQ ID NO: 754267 - RNA, 19 nt, Homo sapiens
gaaguacuuaaacuuccac

SEQ ID NO: 754268 - RNA, 22 nt, Homo sapiens
gaaguagaauuuguccaauaac

SEQ ID NO: 754269 - RNA, 21 nt, Homo sapiens
gaaguagauuaagagccauau

SEQ ID NO: 754270 - RNA, 15 nt, Homo sapiens
gaaguaucagcacua

SEQ ID NO: 754271 - RNA, 20 nt, Homo sapiens
gaagucacucacacuggcca

SEQ ID NO: 754272 - RNA, 21 nt, Homo sapiens
gaagucacucacacuggccac

SEQ ID NO: 754273 - RNA, 21 nt, Homo sapiens
gaagucaucagcuuugugcca

SEQ ID NO: 754274 - RNA, 13 nt, Homo sapiens
gaagucaucucau

SEQ ID NO: 754275 - RNA, 21 nt, Homo sapiens
gaagucaucucauuccacugu

SEQ ID NO: 754276 - RNA, 15 nt, Homo sapiens
gaagucuaacgcuga

SEQ ID NO: 754277 - RNA, 17 nt, Homo sapiens
gaagucuaagagugaag

SEQ ID NO: 754278 - RNA, 18 nt, Homo sapiens
gaagucuggcuuugcucu

SEQ ID NO: 754279 - RNA, 23 nt, Homo sapiens
gaagucuggcuuugcucuauuaa

SEQ ID NO: 754280 - RNA, 14 nt, Homo sapiens
gaagucuugcaguu

SEQ ID NO: 754281 - RNA, 22 nt, Homo sapiens
gaagucuuuucugucaccaaau

SEQ ID NO: 754282 - RNA, 17 nt, Homo sapiens
gaagugagagauguugc

SEQ ID NO: 754283 - RNA, 18 nt, Homo sapiens
gaagugagggcucacuca

SEQ ID NO: 754284 - RNA, 22 nt, Homo sapiens
gaagugcgugguauaaucucca

SEQ ID NO: 754285 - RNA, 13 nt, Homo sapiens
gaagugcucuuuc

SEQ ID NO: 754286 - RNA, 19 nt, Homo sapiens
gaagugcuuuguaucagga

SEQ ID NO: 754287 - RNA, 15 nt, Homo sapiens
gaaguggcagugaaa

SEQ ID NO: 754288 - RNA, 15 nt, Homo sapiens
gaaguggucucccca

SEQ ID NO: 754289 - RNA, 13 nt, Homo sapiens
gaagugucaugca

SEQ ID NO: 754290 - RNA, 15 nt, Homo sapiens
gaaguuaaagggaag

SEQ ID NO: 754291 - RNA, 22 nt, Homo sapiens
gaaguuauggcuucacauucau

SEQ ID NO: 754292 - RNA, 19 nt, Homo sapiens
gaaguucucagaauaacua

SEQ ID NO: 754293 - RNA, 22 nt, Homo sapiens
gaaguucuccagcuucagcuca

SEQ ID NO: 754294 - RNA, 20 nt, Homo sapiens
gaaguugcagugagcugaua

SEQ ID NO: 754295 - RNA, 20 nt, Homo sapiens
gaaguugcugagcaguauuc

SEQ ID NO: 754296 - RNA, 15 nt, Homo sapiens
gaaguuuacaaucaa

SEQ ID NO: 754297 - RNA, 17 nt, Homo sapiens
gaaguuucuggugccau

SEQ ID NO: 754298 - RNA, 14 nt, Homo sapiens
gaaguuuguguucu

SEQ ID NO: 754299 - RNA, 22 nt, Homo sapiens
gaaguuuugaguuucucuccac

SEQ ID NO: 754300 - RNA, 16 nt, Homo sapiens
gaaguuuuucuuugug

SEQ ID NO: 754301 - RNA, 16 nt, Homo sapiens
gaaguuuuuucuacca

SEQ ID NO: 754302 - RNA, 15 nt, Homo sapiens
gaauaaaaacauuuc

SEQ ID NO: 754303 - RNA, 22 nt, Homo sapiens
gaauaaaacuuuucugcugaua

SEQ ID NO: 754304 - RNA, 15 nt, Homo sapiens
gaauaaaaugaaggu

SEQ ID NO: 754305 - RNA, 17 nt, Homo sapiens
gaauaaaggcaguuuuc

SEQ ID NO: 754306 - RNA, 12 nt, Homo sapiens
gaauaaagucaa

SEQ ID NO: 754307 - RNA, 19 nt, Homo sapiens
gaauaaaguugcugugaau

SEQ ID NO: 754308 - RNA, 16 nt, Homo sapiens
gaauaagaauggagca

SEQ ID NO: 754309 - RNA, 12 nt, Homo sapiens
gaauaagccuuc

SEQ ID NO: 754310 - RNA, 23 nt, Homo sapiens
gaauaagcucuaguucuuaacaa

SEQ ID NO: 754311 - RNA, 19 nt, Homo sapiens
gaauaaguaccuuuguguc

SEQ ID NO: 754312 - RNA, 15 nt, Homo sapiens
gaauaauaggccagg

SEQ ID NO: 754313 - RNA, 13 nt, Homo sapiens
gaauaaucacuug

SEQ ID NO: 754314 - RNA, 16 nt, Homo sapiens
gaauaauuacagugcc

SEQ ID NO: 754315 - RNA, 22 nt, Homo sapiens
gaauacaggaggcagacaauga

SEQ ID NO: 754316 - RNA, 14 nt, Homo sapiens
gaauacauugcaau

SEQ ID NO: 754317 - RNA, 13 nt, Homo sapiens
gaauacugugcau

SEQ ID NO: 754318 - RNA, 22 nt, Homo sapiens
gaauacuuaacucaauaauucu

SEQ ID NO: 754319 - RNA, 14 nt, Homo sapiens
gaauagacuaucua

SEQ ID NO: 754320 - RNA, 12 nt, Homo sapiens
gaauagcacaaa

SEQ ID NO: 754321 - RNA, 19 nt, Homo sapiens
gaauauaaaugggaaauca

SEQ ID NO: 754322 - RNA, 13 nt, Homo sapiens
gaauauagagggu

SEQ ID NO: 754323 - RNA, 20 nt, Homo sapiens
gaauaucagaaguauaucug

SEQ ID NO: 754324 - RNA, 14 nt, Homo sapiens
gaauauccauguac

SEQ ID NO: 754325 - RNA, 20 nt, Homo sapiens
gaauauccuuuaaaauuuaa

SEQ ID NO: 754326 - RNA, 22 nt, Homo sapiens
gaauaugaucagguaacuuucg

SEQ ID NO: 754327 - RNA, 17 nt, Homo sapiens
gaauaugguggaaaaua

SEQ ID NO: 754328 - RNA, 19 nt, Homo sapiens
gaauauguagucuaagcau

SEQ ID NO: 754329 - RNA, 17 nt, Homo sapiens
gaauauucaacagcuca

SEQ ID NO: 754330 - RNA, 12 nt, Homo sapiens
gaauauucccaa

SEQ ID NO: 754331 - RNA, 18 nt, Homo sapiens
gaauauucccaagcccau

SEQ ID NO: 754332 - RNA, 21 nt, Homo sapiens
gaauauuuauuaccucugaua

SEQ ID NO: 754333 - RNA, 12 nt, Homo sapiens
gaauauuugcca

SEQ ID NO: 754334 - RNA, 16 nt, Homo sapiens
gaaucacugugcucag

SEQ ID NO: 754335 - RNA, 17 nt, Homo sapiens
gaaucacuuaaauguca

SEQ ID NO: 754336 - RNA, 15 nt, Homo sapiens
gaaucagaccugguu

SEQ ID NO: 754337 - RNA, 17 nt, Homo sapiens
gaaucagacugacaguu

SEQ ID NO: 754338 - RNA, 19 nt, Homo sapiens
gaaucagacugacaguuua

SEQ ID NO: 754339 - RNA, 17 nt, Homo sapiens
gaaucagaucauuucaa

SEQ ID NO: 754340 - RNA, 20 nt, Homo sapiens
gaaucaggaauauuuuccaa

SEQ ID NO: 754341 - RNA, 19 nt, Homo sapiens
gaaucauauucauaugcag

SEQ ID NO: 754342 - RNA, 23 nt, Homo sapiens
gaaucaucaaagcucacaccaaa

SEQ ID NO: 754343 - RNA, 14 nt, Homo sapiens
gaaucauuaucuua

SEQ ID NO: 754344 - RNA, 19 nt, Homo sapiens
gaauccauaaauguguucc

SEQ ID NO: 754345 - RNA, 20 nt, Homo sapiens
gaauccauaaauguguuccu

SEQ ID NO: 754346 - RNA, 12 nt, Homo sapiens
gaauccaugcuu

SEQ ID NO: 754347 - RNA, 22 nt, Homo sapiens
gaaucccuuugcaccugagacc

SEQ ID NO: 754348 - RNA, 18 nt, Homo sapiens
gaauccgcucccaagggu

SEQ ID NO: 754349 - RNA, 17 nt, Homo sapiens
gaauccuauuuaucaga

SEQ ID NO: 754350 - RNA, 20 nt, Homo sapiens
gaauccuuccauuccacaca

SEQ ID NO: 754351 - RNA, 21 nt, Homo sapiens
gaauccuuggggagcacuugu

SEQ ID NO: 754352 - RNA, 22 nt, Homo sapiens
gaaucggcuggggacugcuacc

SEQ ID NO: 754353 - RNA, 17 nt, Homo sapiens
gaaucuaaugaaugugc

SEQ ID NO: 754354 - RNA, 22 nt, Homo sapiens
gaaucucaccugcuggggaccu

SEQ ID NO: 754355 - RNA, 13 nt, Homo sapiens
gaaucucucccuc

SEQ ID NO: 754356 - RNA, 13 nt, Homo sapiens
ugaccaucauuuc

SEQ ID NO: 754357 - RNA, 16 nt, Homo sapiens
ugaccauuucaggggu

SEQ ID NO: 754358 - RNA, 16 nt, Homo sapiens
ugaccauuugacuguu

SEQ ID NO: 754359 - RNA, 16 nt, Homo sapiens
ugaccauuuucugcca

SEQ ID NO: 754360 - RNA, 16 nt, Homo sapiens
ugacccaaaaaaguca

SEQ ID NO: 754361 - RNA, 18 nt, Homo sapiens
ugacccaccccugugcuc

SEQ ID NO: 754362 - RNA, 15 nt, Homo sapiens
ugacccacugaucuc

SEQ ID NO: 754363 - RNA, 13 nt, Homo sapiens
ugaccccauuccu

SEQ ID NO: 754364 - RNA, 21 nt, Homo sapiens
ugaccccauuccugaucccau

SEQ ID NO: 754365 - RNA, 18 nt, Homo sapiens
ugacccugauacaggcau

SEQ ID NO: 754366 - RNA, 13 nt, Homo sapiens
ugacccuguucuc

SEQ ID NO: 754367 - RNA, 16 nt, Homo sapiens
ugacccuuccagacau

SEQ ID NO: 754368 - RNA, 13 nt, Homo sapiens
ugacccuuuucau

SEQ ID NO: 754369 - RNA, 23 nt, Homo sapiens
ugaccuaaauuauuuacugcaaa

SEQ ID NO: 754370 - RNA, 22 nt, Homo sapiens
ugaccuacuuugguaguggaau

SEQ ID NO: 754371 - RNA, 15 nt, Homo sapiens
ugaccuaguuuucca

SEQ ID NO: 754372 - RNA, 18 nt, Homo sapiens
ugaccuaugaugaaguca

SEQ ID NO: 754373 - RNA, 14 nt, Homo sapiens
ugaccuauuuccag

SEQ ID NO: 754374 - RNA, 15 nt, Homo sapiens
ugaccucaagugauu

SEQ ID NO: 754375 - RNA, 23 nt, Homo sapiens
ugaccucaaugccuuuguucacc

SEQ ID NO: 754376 - RNA, 15 nt, Homo sapiens
ugaccucacagugac

SEQ ID NO: 754377 - RNA, 14 nt, Homo sapiens
ugaccucagcugca

SEQ ID NO: 754378 - RNA, 18 nt, Homo sapiens
ugaccucgugaucugccc

SEQ ID NO: 754379 - RNA, 23 nt, Homo sapiens
ugaccugcggcaguauguacuuc

SEQ ID NO: 754380 - RNA, 22 nt, Homo sapiens
ugaccuggugggagcaccugcc

SEQ ID NO: 754381 - RNA, 17 nt, Homo sapiens
ugaccugugaccagcac

SEQ ID NO: 754382 - RNA, 15 nt, Homo sapiens
ugaccuguguucccu

SEQ ID NO: 754383 - RNA, 16 nt, Homo sapiens
ugaccuguuauuacca

SEQ ID NO: 754384 - RNA, 23 nt, Homo sapiens
ugaccuguuauuaccauuagcau

SEQ ID NO: 754385 - RNA, 16 nt, Homo sapiens
ugaccuugcaauguuc

SEQ ID NO: 754386 - RNA, 22 nt, Homo sapiens
ugacgacaagugcugaacagug

SEQ ID NO: 754387 - RNA, 15 nt, Homo sapiens
ugacgagcagggugg

SEQ ID NO: 754388 - RNA, 20 nt, Homo sapiens
ugacgagcaugagcuggaug

SEQ ID NO: 754389 - RNA, 19 nt, Homo sapiens
ugacgcauucucguaucca

SEQ ID NO: 754390 - RNA, 16 nt, Homo sapiens
ugacggggggugggaa

SEQ ID NO: 754391 - RNA, 16 nt, Homo sapiens
ugacggguugugagac

SEQ ID NO: 754392 - RNA, 20 nt, Homo sapiens
ugacgucaucaucacauuca

SEQ ID NO: 754393 - RNA, 23 nt, Homo sapiens
ugacgugcaccuguacucaggag

SEQ ID NO: 754394 - RNA, 14 nt, Homo sapiens
ugacguguguggcu

SEQ ID NO: 754395 - RNA, 17 nt, Homo sapiens
ugacguguuucuugaac

SEQ ID NO: 754396 - RNA, 16 nt, Homo sapiens
ugacguuuacauauau

SEQ ID NO: 754397 - RNA, 20 nt, Homo sapiens
ugacuaaacaacuaccuccu

SEQ ID NO: 754398 - RNA, 11 nt, Homo sapiens
ugacuaaagag

SEQ ID NO: 754399 - RNA, 17 nt, Homo sapiens
ugacuaacuagacacca

SEQ ID NO: 754400 - RNA, 20 nt, Homo sapiens
ugacucauccccacagcugg

SEQ ID NO: 754401 - RNA, 14 nt, Homo sapiens
ugacuccauucaaa

SEQ ID NO: 754402 - RNA, 16 nt, Homo sapiens
ugacuccuccaaggaa

SEQ ID NO: 754403 - RNA, 21 nt, Homo sapiens
ugacuccuccaaggaaaggga

SEQ ID NO: 754404 - RNA, 16 nt, Homo sapiens
ugacuccugcucucug

SEQ ID NO: 754405 - RNA, 22 nt, Homo sapiens
ugacuccuuucucuaaaacugc

SEQ ID NO: 754406 - RNA, 13 nt, Homo sapiens
ugacucugagcua

SEQ ID NO: 754407 - RNA, 13 nt, Homo sapiens
ugacucugcauuu

SEQ ID NO: 754408 - RNA, 20 nt, Homo sapiens
ugacugauagcuuacacuga

SEQ ID NO: 754409 - RNA, 14 nt, Homo sapiens
ugacugccacccac

SEQ ID NO: 754410 - RNA, 22 nt, Homo sapiens
ugacugcuuuuaaaugaccaaa

SEQ ID NO: 754411 - RNA, 16 nt, Homo sapiens
ugacuguaucuugaua

SEQ ID NO: 754412 - RNA, 19 nt, Homo sapiens
ugacuguccaagugccaca

SEQ ID NO: 754413 - RNA, 19 nt, Homo sapiens
ugacugugauuagaucaca

SEQ ID NO: 754414 - RNA, 12 nt, Homo sapiens
ugacuguuacag

SEQ ID NO: 754415 - RNA, 20 nt, Homo sapiens
ugacuuaaagugcaaaaagc

SEQ ID NO: 754416 - RNA, 15 nt, Homo sapiens
ugacuuaaccauaua

SEQ ID NO: 754417 - RNA, 18 nt, Homo sapiens
ugacuuagcgucaagaca

SEQ ID NO: 754418 - RNA, 15 nt, Homo sapiens
ugacuuaucuaccau

SEQ ID NO: 754419 - RNA, 19 nt, Homo sapiens
ugacuuaucuaccauugaa

SEQ ID NO: 754420 - RNA, 14 nt, Homo sapiens
ugacuucaaugaua

SEQ ID NO: 754421 - RNA, 17 nt, Homo sapiens
ugacuucacccacgcau

SEQ ID NO: 754422 - RNA, 19 nt, Homo sapiens
ugacuucagaauaacagca

SEQ ID NO: 754423 - RNA, 16 nt, Homo sapiens
ugacuuccccacugcu

SEQ ID NO: 754424 - RNA, 18 nt, Homo sapiens
ugacuuccccacugcucu

SEQ ID NO: 754425 - RNA, 19 nt, Homo sapiens
ugacuuccccacugcucuc

SEQ ID NO: 754426 - RNA, 15 nt, Homo sapiens
ugacuuuauguauua

SEQ ID NO: 754427 - RNA, 21 nt, Homo sapiens
ugacuuuauguuguaugauuc

SEQ ID NO: 754428 - RNA, 17 nt, Homo sapiens
ugacuuucuaaguagga

SEQ ID NO: 754429 - RNA, 15 nt, Homo sapiens
ugacuuucugauuac

SEQ ID NO: 754430 - RNA, 18 nt, Homo sapiens
ugacuuucugauuacugu

SEQ ID NO: 754431 - RNA, 22 nt, Homo sapiens
ugacuuucugauuggugauuca

SEQ ID NO: 754432 - RNA, 21 nt, Homo sapiens
ugacuuugggaaagagggacc

SEQ ID NO: 754433 - RNA, 15 nt, Homo sapiens
ugacuuuucaaguau

SEQ ID NO: 754434 - RNA, 15 nt, Homo sapiens
ugagaaaaauaaaaa

SEQ ID NO: 754435 - RNA, 19 nt, Homo sapiens
ccccucggccccagcacau

SEQ ID NO: 754436 - RNA, 15 nt, Homo sapiens
ccccucuucugcuaa

SEQ ID NO: 754437 - RNA, 16 nt, Homo sapiens
ccccugagccacagaa

SEQ ID NO: 754438 - RNA, 17 nt, Homo sapiens
ccccugcccugggaugu

SEQ ID NO: 754439 - RNA, 15 nt, Homo sapiens
ccccuggcagugcug

SEQ ID NO: 754440 - RNA, 18 nt, Homo sapiens
ccccuggcagugcugagg

SEQ ID NO: 754441 - RNA, 20 nt, Homo sapiens
ccccuggcccagcggccccu

SEQ ID NO: 754442 - RNA, 15 nt, Homo sapiens
ccccuggcuuugccu

SEQ ID NO: 754443 - RNA, 16 nt, Homo sapiens
ccccuguagcagucac

SEQ ID NO: 754444 - RNA, 17 nt, Homo sapiens
ccccugucccauucuag

SEQ ID NO: 754445 - RNA, 22 nt, Homo sapiens
ccccuuaaggguugaaggcagu

SEQ ID NO: 754446 - RNA, 16 nt, Homo sapiens
ccccuuauuugcacuu

SEQ ID NO: 754447 - RNA, 13 nt, Homo sapiens
ccccuucuguguu

SEQ ID NO: 754448 - RNA, 14 nt, Homo sapiens
ccccuuguccuuuc

SEQ ID NO: 754449 - RNA, 16 nt, Homo sapiens
ccccuuucacacugga

SEQ ID NO: 754450 - RNA, 13 nt, Homo sapiens
cccgacagccugg

SEQ ID NO: 754451 - RNA, 14 nt, Homo sapiens
cccgacuuccugac

SEQ ID NO: 754452 - RNA, 21 nt, Homo sapiens
cccgcagugcugggaccagag

SEQ ID NO: 754453 - RNA, 22 nt, Homo sapiens
cccgccucuucuucuucagaag

SEQ ID NO: 754454 - RNA, 15 nt, Homo sapiens
cccgcggugcucugg

SEQ ID NO: 754455 - RNA, 17 nt, Homo sapiens
cccggacucugaucucu

SEQ ID NO: 754456 - RNA, 17 nt, Homo sapiens
cccggccagcgggcaca

SEQ ID NO: 754457 - RNA, 21 nt, Homo sapiens
cccggccgcuccaccagcauc

SEQ ID NO: 754458 - RNA, 17 nt, Homo sapiens
cccggcgccgggcacca

SEQ ID NO: 754459 - RNA, 19 nt, Homo sapiens
cccggcucguguauuuauu

SEQ ID NO: 754460 - RNA, 23 nt, Homo sapiens
cccgggagguggagguugcagug

SEQ ID NO: 754461 - RNA, 16 nt, Homo sapiens
cccggggccagcacuu

SEQ ID NO: 754462 - RNA, 17 nt, Homo sapiens
cccggggccagcacuuc

SEQ ID NO: 754463 - RNA, 17 nt, Homo sapiens
cccggggcuccacugaa

SEQ ID NO: 754464 - RNA, 16 nt, Homo sapiens
cccggggugaguccau

SEQ ID NO: 754465 - RNA, 18 nt, Homo sapiens
cccgggucucucacuguu

SEQ ID NO: 754466 - RNA, 19 nt, Homo sapiens
cccggguggggcugcagaa

SEQ ID NO: 754467 - RNA, 16 nt, Homo sapiens
cccgucauguuccuca

SEQ ID NO: 754468 - RNA, 15 nt, Homo sapiens
cccguggcauuucaa

SEQ ID NO: 754469 - RNA, 20 nt, Homo sapiens
cccguggucuccuugcacuu

SEQ ID NO: 754470 - RNA, 21 nt, Homo sapiens
cccuaaaaauccagacucuuu

SEQ ID NO: 754471 - RNA, 14 nt, Homo sapiens
ugaguuggggccau

SEQ ID NO: 754472 - RNA, 19 nt, Homo sapiens
ugaguuucuggcucuugag

SEQ ID NO: 754473 - RNA, 16 nt, Homo sapiens
ugauaaaagauggcca

SEQ ID NO: 754474 - RNA, 13 nt, Homo sapiens
ugauaaacauuaa

SEQ ID NO: 754475 - RNA, 14 nt, Homo sapiens
ugauaaaccaaaau

SEQ ID NO: 754476 - RNA, 13 nt, Homo sapiens
ugauaaagaggca

SEQ ID NO: 754477 - RNA, 13 nt, Homo sapiens
ugauaagccuuuc

SEQ ID NO: 754478 - RNA, 22 nt, Homo sapiens
ugauaagcuauugucuguaaua

SEQ ID NO: 754479 - RNA, 17 nt, Homo sapiens
ugauaagcugagcuccu

SEQ ID NO: 754480 - RNA, 13 nt, Homo sapiens
ugauaagugcagg

SEQ ID NO: 754481 - RNA, 13 nt, Homo sapiens
ugauaaguucaua

SEQ ID NO: 754482 - RNA, 23 nt, Homo sapiens
ugauaauaaauuagguaagauaa

SEQ ID NO: 754483 - RNA, 15 nt, Homo sapiens
ugauaauagauucuc

SEQ ID NO: 754484 - RNA, 19 nt, Homo sapiens
ugauacaagaaagcaaugc

SEQ ID NO: 754485 - RNA, 19 nt, Homo sapiens
ugauacauuuuuguacuaa

SEQ ID NO: 754486 - RNA, 12 nt, Homo sapiens
ugauaccacugc

SEQ ID NO: 754487 - RNA, 22 nt, Homo sapiens
ugauacugcugagucagacugu

SEQ ID NO: 754488 - RNA, 17 nt, Homo sapiens
ugauacuuugacagugu

SEQ ID NO: 754489 - RNA, 18 nt, Homo sapiens
ugauacuuugacaguguu

SEQ ID NO: 754490 - RNA, 16 nt, Homo sapiens
ugauagaguguuauca

SEQ ID NO: 754491 - RNA, 19 nt, Homo sapiens
ugauagauuucuacacuga

SEQ ID NO: 754492 - RNA, 14 nt, Homo sapiens
ugauauaugccuau

SEQ ID NO: 754493 - RNA, 21 nt, Homo sapiens
ugauauauucuugaagacauc

SEQ ID NO: 754494 - RNA, 13 nt, Homo sapiens
ugauauauuucag

SEQ ID NO: 754495 - RNA, 13 nt, Homo sapiens
ugauaucaccucu

SEQ ID NO: 754496 - RNA, 18 nt, Homo sapiens
ugauaucccccagccuca

SEQ ID NO: 754497 - RNA, 12 nt, Homo sapiens
ugauaucugauc

SEQ ID NO: 754498 - RNA, 14 nt, Homo sapiens
ugauaugucagggc

SEQ ID NO: 754499 - RNA, 19 nt, Homo sapiens
ugauauuauggcaagugau

SEQ ID NO: 754500 - RNA, 15 nt, Homo sapiens
ugauauuucuugcuu

SEQ ID NO: 754501 - RNA, 17 nt, Homo sapiens
ugauauuuuuacuugca

SEQ ID NO: 754502 - RNA, 22 nt, Homo sapiens
ugaucaaaaauaaacuaguuuc

SEQ ID NO: 754503 - RNA, 19 nt, Homo sapiens
ugaucaaaaccugugccag

SEQ ID NO: 754504 - RNA, 15 nt, Homo sapiens
ugaucaagaaugcaa

SEQ ID NO: 754505 - RNA, 17 nt, Homo sapiens
ugaucaauuauaguuuc

SEQ ID NO: 754506 - RNA, 17 nt, Homo sapiens
ugaucacauucuuucca

SEQ ID NO: 754507 - RNA, 21 nt, Homo sapiens
ugaucagacauacagcugccu

SEQ ID NO: 754508 - RNA, 15 nt, Homo sapiens
ugaucagguaacuuu

SEQ ID NO: 754509 - RNA, 17 nt, Homo sapiens
ugaucagugggccucca

SEQ ID NO: 754510 - RNA, 22 nt, Homo sapiens
ugaucaugccacugcacuccag

SEQ ID NO: 754511 - RNA, 13 nt, Homo sapiens
ugauccgccuacc

SEQ ID NO: 754512 - RNA, 16 nt, Homo sapiens
ugauccguuccauugc

SEQ ID NO: 754513 - RNA, 17 nt, Homo sapiens
ugauccuccaacagcug

SEQ ID NO: 754514 - RNA, 17 nt, Homo sapiens
ugauccuuccaccucag

SEQ ID NO: 754515 - RNA, 15 nt, Homo sapiens
ugaucuacuugccuc

SEQ ID NO: 754516 - RNA, 15 nt, Homo sapiens
ugaucuauacaaauu

SEQ ID NO: 754517 - RNA, 12 nt, Homo sapiens
ugaucucagcuc

SEQ ID NO: 754518 - RNA, 13 nt, Homo sapiens
ugaucucagcuca

SEQ ID NO: 754519 - RNA, 19 nt, Homo sapiens
ugaucucccucuaagcaca

SEQ ID NO: 754520 - RNA, 20 nt, Homo sapiens
ugaucucccuucagcaacuu

SEQ ID NO: 754521 - RNA, 23 nt, Homo sapiens
ugaucucccuucagcaacuuauu

SEQ ID NO: 754522 - RNA, 19 nt, Homo sapiens
ugaucucggaugaccaaac

SEQ ID NO: 754523 - RNA, 13 nt, Homo sapiens
ugaucuuacucac

SEQ ID NO: 754524 - RNA, 17 nt, Homo sapiens
ugaucuugauugugggu

SEQ ID NO: 754525 - RNA, 21 nt, Homo sapiens
ugaugaaaacuaaggauuuuu

SEQ ID NO: 754526 - RNA, 14 nt, Homo sapiens
ugaugacuuacuau

SEQ ID NO: 754527 - RNA, 20 nt, Homo sapiens
ugaugaggaaggacuugacu

SEQ ID NO: 754528 - RNA, 16 nt, Homo sapiens
ugaugcaagccagcuu

SEQ ID NO: 754529 - RNA, 13 nt, Homo sapiens
ugaugcaugagcu

SEQ ID NO: 754530 - RNA, 16 nt, Homo sapiens
ugaugcccccacagca

SEQ ID NO: 754531 - RNA, 21 nt, Homo sapiens
ugaugcccugcugaccaugca

SEQ ID NO: 754532 - RNA, 21 nt, Homo sapiens
ugaugcgucuacccagacuca

SEQ ID NO: 754533 - RNA, 12 nt, Homo sapiens
ugaugcuagcca

SEQ ID NO: 754534 - RNA, 15 nt, Homo sapiens
ugauggcagagccag

SEQ ID NO: 754535 - RNA, 16 nt, Homo sapiens
ugauggcagguccucu

SEQ ID NO: 754536 - RNA, 22 nt, Homo sapiens
ugauggcccuaaguuaagcaaa

SEQ ID NO: 754537 - RNA, 14 nt, Homo sapiens
ugauggcugaagaa

SEQ ID NO: 754538 - RNA, 19 nt, Homo sapiens
ugauggggaaggaguacaa

SEQ ID NO: 754539 - RNA, 16 nt, Homo sapiens
ugauggugcaugccug

SEQ ID NO: 754540 - RNA, 19 nt, Homo sapiens
ugaugguggacuaagcaau

SEQ ID NO: 754541 - RNA, 20 nt, Homo sapiens
ugauguacagauucuuucag

SEQ ID NO: 754542 - RNA, 21 nt, Homo sapiens
ugauguauuucaagucucuca

SEQ ID NO: 754543 - RNA, 19 nt, Homo sapiens
ugaugugucaucuaauuaa

SEQ ID NO: 754544 - RNA, 17 nt, Homo sapiens
ugaugugugagcuaugc

SEQ ID NO: 754545 - RNA, 17 nt, Homo sapiens
ugauguuagugaggaac

SEQ ID NO: 754546 - RNA, 22 nt, Homo sapiens
ugauguuuuuucuguaauguaa

SEQ ID NO: 754547 - RNA, 20 nt, Homo sapiens
ugauuaacaucuacaaucag

SEQ ID NO: 754548 - RNA, 13 nt, Homo sapiens
ugauuaacuugcu

SEQ ID NO: 754549 - RNA, 14 nt, Homo sapiens
ugauuaaucaaagg

SEQ ID NO: 754550 - RNA, 17 nt, Homo sapiens
ugauuacaaggcuuuau

SEQ ID NO: 754551 - RNA, 17 nt, Homo sapiens
ugauuacuaauuaucaa

SEQ ID NO: 754552 - RNA, 24 nt, Homo sapiens
ugauuagaaauuaccuguggauau

SEQ ID NO: 754553 - RNA, 15 nt, Homo sapiens
ccuacucacacuuca

SEQ ID NO: 754554 - RNA, 14 nt, Homo sapiens
ccuacugcccacau

SEQ ID NO: 754555 - RNA, 20 nt, Homo sapiens
ccuacugucccucucagugc

SEQ ID NO: 754556 - RNA, 16 nt, Homo sapiens
ccuacuucuuuugcuc

SEQ ID NO: 754557 - RNA, 19 nt, Homo sapiens
ccuacuuugacuuuuugca

SEQ ID NO: 754558 - RNA, 14 nt, Homo sapiens
ccuagaaagacaga

SEQ ID NO: 754559 - RNA, 13 nt, Homo sapiens
ccuagaaauaucu

SEQ ID NO: 754560 - RNA, 22 nt, Homo sapiens
ccuagaaugucagauuucuggu

SEQ ID NO: 754561 - RNA, 23 nt, Homo sapiens
ccuagaccagcagacagagccag

SEQ ID NO: 754562 - RNA, 19 nt, Homo sapiens
ccuagcaccuggcuaguuu

SEQ ID NO: 754563 - RNA, 17 nt, Homo sapiens
ccuagccuaauuuacca

SEQ ID NO: 754564 - RNA, 21 nt, Homo sapiens
ccuagcuaccuucucuaccca

SEQ ID NO: 754565 - RNA, 14 nt, Homo sapiens
ccuagcugugucag

SEQ ID NO: 754566 - RNA, 16 nt, Homo sapiens
ccuaggaggcuggcca

SEQ ID NO: 754567 - RNA, 20 nt, Homo sapiens
ccuaggauuucaugauuuca

SEQ ID NO: 754568 - RNA, 15 nt, Homo sapiens
ccuaggcuaccucaa

SEQ ID NO: 754569 - RNA, 14 nt, Homo sapiens
ccuagggcacuuua

SEQ ID NO: 754570 - RNA, 15 nt, Homo sapiens
ccuagggcacuuuaa

SEQ ID NO: 754571 - RNA, 14 nt, Homo sapiens
ccuaggggacacuu

SEQ ID NO: 754572 - RNA, 22 nt, Homo sapiens
ccuaguacugccccccaugagg

SEQ ID NO: 754573 - RNA, 22 nt, Homo sapiens
ccuaguauaucagugacaguug

SEQ ID NO: 754574 - RNA, 21 nt, Homo sapiens
ccuaguuguucagcauggcau

SEQ ID NO: 754575 - RNA, 18 nt, Homo sapiens
ccuauaaggagaguucaa

SEQ ID NO: 754576 - RNA, 14 nt, Homo sapiens
ccuauagacuguaa

SEQ ID NO: 754577 - RNA, 20 nt, Homo sapiens
ccuaucagaguugcugcaaa

SEQ ID NO: 754578 - RNA, 13 nt, Homo sapiens
ccuaucugaccaa

SEQ ID NO: 754579 - RNA, 12 nt, Homo sapiens
ccuaucuggaag

SEQ ID NO: 754580 - RNA, 15 nt, Homo sapiens
ccuaugaaauuucaa

SEQ ID NO: 754581 - RNA, 22 nt, Homo sapiens
ccuauguccuaaggacacacua

SEQ ID NO: 754582 - RNA, 12 nt, Homo sapiens
ccuauuccagga

SEQ ID NO: 754583 - RNA, 13 nt, Homo sapiens
ccuauucuuucua

SEQ ID NO: 754584 - RNA, 22 nt, Homo sapiens
ccuauugggagaggucauaaaa

SEQ ID NO: 754585 - RNA, 14 nt, Homo sapiens
ccuauuguucacuu

SEQ ID NO: 754586 - RNA, 17 nt, Homo sapiens
cuaaaaaauggugggag

SEQ ID NO: 754587 - RNA, 23 nt, Homo sapiens
cuaaaaaugaaccugcaagccuu

SEQ ID NO: 754588 - RNA, 18 nt, Homo sapiens
cuaaaaaugagcuugauu

SEQ ID NO: 754589 - RNA, 17 nt, Homo sapiens
cuaaaaccacaugugca

SEQ ID NO: 754590 - RNA, 18 nt, Homo sapiens
cuaaaacuaugguuccca

SEQ ID NO: 754591 - RNA, 12 nt, Homo sapiens
cuaaaacugcuc

SEQ ID NO: 754592 - RNA, 18 nt, Homo sapiens
cuaaaagacaauuuuccu

SEQ ID NO: 754593 - RNA, 12 nt, Homo sapiens
cuaaaagauuau

SEQ ID NO: 754594 - RNA, 21 nt, Homo sapiens
cuaaaauaauuuuauuaugca

SEQ ID NO: 754595 - RNA, 16 nt, Homo sapiens
cuaaaauacaaaccca

SEQ ID NO: 754596 - RNA, 18 nt, Homo sapiens
cuaaaauacucaccaaaa

SEQ ID NO: 754597 - RNA, 15 nt, Homo sapiens
cuaaaauuagaugaa

SEQ ID NO: 754598 - RNA, 14 nt, Homo sapiens
cuaaaauucuguca

SEQ ID NO: 754599 - RNA, 17 nt, Homo sapiens
cuaaaauucugucaggg

SEQ ID NO: 754600 - RNA, 21 nt, Homo sapiens
cuaaaauugcuucuuuaccaa

SEQ ID NO: 754601 - RNA, 16 nt, Homo sapiens
cuaaacaaugcugauu

SEQ ID NO: 754602 - RNA, 16 nt, Homo sapiens
cuaaacagauguaaug

SEQ ID NO: 754603 - RNA, 20 nt, Homo sapiens
cuaaaccaaggacugagcac

SEQ ID NO: 754604 - RNA, 21 nt, Homo sapiens
cuaaacucauuuauaaagcua

SEQ ID NO: 754605 - RNA, 23 nt, Homo sapiens
cuaaacuccuuccuggccugaga

SEQ ID NO: 754606 - RNA, 17 nt, Homo sapiens
cuaaagacaauucauuc

SEQ ID NO: 754607 - RNA, 15 nt, Homo sapiens
cuaaagagcccuugc

SEQ ID NO: 754608 - RNA, 12 nt, Homo sapiens
cuaaagauauca

SEQ ID NO: 754609 - RNA, 20 nt, Homo sapiens
cuaaagcacuuugcacuuaa

SEQ ID NO: 754610 - RNA, 15 nt, Homo sapiens
cuaaagcagacuuuu

SEQ ID NO: 754611 - RNA, 20 nt, Homo sapiens
cuaaagcagaggcaacacug

SEQ ID NO: 754612 - RNA, 19 nt, Homo sapiens
cuaaagguccacaggucua

SEQ ID NO: 754613 - RNA, 22 nt, Homo sapiens
cuaaaguuaaauaggauauuaa

SEQ ID NO: 754614 - RNA, 15 nt, Homo sapiens
cuaaaguuacaaaca

SEQ ID NO: 754615 - RNA, 12 nt, Homo sapiens
cuaaaguucuaa

SEQ ID NO: 754616 - RNA, 13 nt, Homo sapiens
cuaaauaaaugaa

SEQ ID NO: 754617 - RNA, 17 nt, Homo sapiens
cuaaauaagaaaauaac

SEQ ID NO: 754618 - RNA, 22 nt, Homo sapiens
cuaaauagaaauaaaugauccc

SEQ ID NO: 754619 - RNA, 22 nt, Homo sapiens
cuaaauaguucuaucaggaaaa

SEQ ID NO: 754620 - RNA, 20 nt, Homo sapiens
cuaaauccuuuuguuuugaa

SEQ ID NO: 754621 - RNA, 14 nt, Homo sapiens
cuaaaucugaggaa

SEQ ID NO: 754622 - RNA, 16 nt, Homo sapiens
cuaaauguaaucacga

SEQ ID NO: 754623 - RNA, 15 nt, Homo sapiens
cuaaauuugguucua

SEQ ID NO: 754624 - RNA, 18 nt, Homo sapiens
cuaacaaaagaacuaaga

SEQ ID NO: 754625 - RNA, 22 nt, Homo sapiens
cuaacaaguagcacccuggauu

SEQ ID NO: 754626 - RNA, 23 nt, Homo sapiens
cuaacacccagucuguuccccau

SEQ ID NO: 754627 - RNA, 17 nt, Homo sapiens
cuaacagcaaauaacag

SEQ ID NO: 754628 - RNA, 22 nt, Homo sapiens
cuaacagcccuccucugcacuc

SEQ ID NO: 754629 - RNA, 20 nt, Homo sapiens
cuaacauccuuggacugaga

SEQ ID NO: 754630 - RNA, 13 nt, Homo sapiens
cuaacaugaauug

SEQ ID NO: 754631 - RNA, 17 nt, Homo sapiens
cuaacgcugaacugaca

SEQ ID NO: 754632 - RNA, 16 nt, Homo sapiens
cuaacguccacuagcu

SEQ ID NO: 754633 - RNA, 18 nt, Homo sapiens
cuaacuaaauaccauuca

SEQ ID NO: 754634 - RNA, 18 nt, Homo sapiens
cuaacucaucugcuggua

SEQ ID NO: 754635 - RNA, 24 nt, Homo sapiens
cuaacuccuuaacaacuguagcaa

SEQ ID NO: 754636 - RNA, 14 nt, Homo sapiens
cuaacucuggugcu

SEQ ID NO: 754637 - RNA, 15 nt, Homo sapiens
cuaacugacagcuuc

SEQ ID NO: 754638 - RNA, 23 nt, Homo sapiens
cuaacugcaauguggauguuuua

SEQ ID NO: 754639 - RNA, 16 nt, Homo sapiens
cuaacugcagaccaug

SEQ ID NO: 754640 - RNA, 19 nt, Homo sapiens
cuaacuggacaugaaggaa

SEQ ID NO: 754641 - RNA, 20 nt, Homo sapiens
cuaacuggcaggggagacag

SEQ ID NO: 754642 - RNA, 21 nt, Homo sapiens
cuaagaaagaggagugcuugu

SEQ ID NO: 754643 - RNA, 20 nt, Homo sapiens
cuaagaaaugcugaaaauca

SEQ ID NO: 754644 - RNA, 13 nt, Homo sapiens
cuaagaagacauu

SEQ ID NO: 754645 - RNA, 16 nt, Homo sapiens
cuaagaauguccuuau

SEQ ID NO: 754646 - RNA, 12 nt, Homo sapiens
cuaagacuacua

SEQ ID NO: 754647 - RNA, 17 nt, Homo sapiens
cuaagagacacauacag

SEQ ID NO: 754648 - RNA, 15 nt, Homo sapiens
cuaagaggggaaccu

SEQ ID NO: 754649 - RNA, 15 nt, Homo sapiens
cuaagagugaaguag

SEQ ID NO: 754650 - RNA, 23 nt, Homo sapiens
cuaagcacuuuaucuauaucuca

SEQ ID NO: 754651 - RNA, 13 nt, Homo sapiens
cuaagcagcuuau

SEQ ID NO: 754652 - RNA, 14 nt, Homo sapiens
cuaagcaguggcau

SEQ ID NO: 754653 - RNA, 21 nt, Homo sapiens
cuaagcauggccuggacugac

SEQ ID NO: 754654 - RNA, 15 nt, Homo sapiens
cuaagccaguuuuca

SEQ ID NO: 754655 - RNA, 16 nt, Homo sapiens
cuaagcuauucaguaa

SEQ ID NO: 754656 - RNA, 18 nt, Homo sapiens
cuaagcuauucaguaaua

SEQ ID NO: 754657 - RNA, 18 nt, Homo sapiens
cuaaggacaagacacuga

SEQ ID NO: 754658 - RNA, 21 nt, Homo sapiens
cuaaggaugguuuuaucuucc

SEQ ID NO: 754659 - RNA, 13 nt, Homo sapiens
cuaaggcagcuaa

SEQ ID NO: 754660 - RNA, 15 nt, Homo sapiens
cuaagggcccaaagg

SEQ ID NO: 754661 - RNA, 22 nt, Homo sapiens
cuaagggucgaaagcucuagaa

SEQ ID NO: 754662 - RNA, 21 nt, Homo sapiens
cuaagguaguaacuuuccaua

SEQ ID NO: 754663 - RNA, 15 nt, Homo sapiens
cuaagucucugugaa

SEQ ID NO: 754664 - RNA, 17 nt, Homo sapiens
cuaaguuauuuacuuuu

SEQ ID NO: 754665 - RNA, 19 nt, Homo sapiens
cuaaguuucuaagauucua

SEQ ID NO: 754666 - RNA, 18 nt, Homo sapiens
cuaaguuuuuauaccagc

SEQ ID NO: 754667 - RNA, 17 nt, Homo sapiens
cuaauaaacauccuuca

SEQ ID NO: 754668 - RNA, 18 nt, Homo sapiens
cuaauaaacuguguaguu

SEQ ID NO: 754669 - RNA, 15 nt, Homo sapiens
cuaauaagcaguaug

SEQ ID NO: 754670 - RNA, 20 nt, Homo sapiens
cuaauacccaguuacuuaug

SEQ ID NO: 754671 - RNA, 21 nt, Homo sapiens
uggaggaccuggcgugcucag

SEQ ID NO: 754672 - RNA, 21 nt, Homo sapiens
uggaggcacugaagugcuuag

SEQ ID NO: 754673 - RNA, 18 nt, Homo sapiens
uggaggccccaacccugu

SEQ ID NO: 754674 - RNA, 16 nt, Homo sapiens
uggaggccgcagccaa

SEQ ID NO: 754675 - RNA, 20 nt, Homo sapiens
uggaggccggaaucucagcc

SEQ ID NO: 754676 - RNA, 21 nt, Homo sapiens
uggaggcugcuguggggacca

SEQ ID NO: 754677 - RNA, 19 nt, Homo sapiens
uggagggaaugcucagaaa

SEQ ID NO: 754678 - RNA, 14 nt, Homo sapiens
uggagggacuuuua

SEQ ID NO: 754679 - RNA, 19 nt, Homo sapiens
uggaggggagggaucuccu

SEQ ID NO: 754680 - RNA, 19 nt, Homo sapiens
uggagggucccuaauucuc

SEQ ID NO: 754681 - RNA, 18 nt, Homo sapiens
uggagguucuaaggccua

SEQ ID NO: 754682 - RNA, 19 nt, Homo sapiens
uggagguucugaaauaccu

SEQ ID NO: 754683 - RNA, 21 nt, Homo sapiens
uggagguuuguuuagaagaag

SEQ ID NO: 754684 - RNA, 16 nt, Homo sapiens
uggagugcagugccac

SEQ ID NO: 754685 - RNA, 21 nt, Homo sapiens
uggagugcaguggugccauca

SEQ ID NO: 754686 - RNA, 20 nt, Homo sapiens
uggaguguuuuuacauugau

SEQ ID NO: 754687 - RNA, 17 nt, Homo sapiens
uggaguucuugugccau

SEQ ID NO: 754688 - RNA, 16 nt, Homo sapiens
uggaguugacucggug

SEQ ID NO: 754689 - RNA, 21 nt, Homo sapiens
uggaguuuuaaaaggcuccca

SEQ ID NO: 754690 - RNA, 19 nt, Homo sapiens
uggaguuuuguuuccucug

SEQ ID NO: 754691 - RNA, 19 nt, Homo sapiens
uggauaaaauaaaugcaau

SEQ ID NO: 754692 - RNA, 22 nt, Homo sapiens
uggauaaaauuggguuuuaaca

SEQ ID NO: 754693 - RNA, 15 nt, Homo sapiens
uggauaugacccaca

SEQ ID NO: 754694 - RNA, 22 nt, Homo sapiens
uggauauuuaguucaacuguau

SEQ ID NO: 754695 - RNA, 13 nt, Homo sapiens
uggauauuucaau

SEQ ID NO: 754696 - RNA, 18 nt, Homo sapiens
uggauauuuuuuacuuua

SEQ ID NO: 754697 - RNA, 15 nt, Homo sapiens
uggaucacacacaug

SEQ ID NO: 754698 - RNA, 15 nt, Homo sapiens
uggaucaccauuaua

SEQ ID NO: 754699 - RNA, 21 nt, Homo sapiens
uggaucacucaccauucccag

SEQ ID NO: 754700 - RNA, 18 nt, Homo sapiens
cuagccugggccagagaa

SEQ ID NO: 754701 - RNA, 17 nt, Homo sapiens
cuagcgcaagaccaguc

SEQ ID NO: 754702 - RNA, 16 nt, Homo sapiens
cuagcucuaguucaaa

SEQ ID NO: 754703 - RNA, 14 nt, Homo sapiens
cuagcugucccaug

SEQ ID NO: 754704 - RNA, 14 nt, Homo sapiens
cuagcugugggggu

SEQ ID NO: 754705 - RNA, 13 nt, Homo sapiens
cuagcugugucag

SEQ ID NO: 754706 - RNA, 16 nt, Homo sapiens
cuagcuucugcaaugu

SEQ ID NO: 754707 - RNA, 19 nt, Homo sapiens
cuaggaaacucacacuccc

SEQ ID NO: 754708 - RNA, 16 nt, Homo sapiens
cuaggaaauccauuca

SEQ ID NO: 754709 - RNA, 18 nt, Homo sapiens
cuaggaagagcaggacuc

SEQ ID NO: 754710 - RNA, 18 nt, Homo sapiens
cuaggaggucaucaaccg

SEQ ID NO: 754711 - RNA, 18 nt, Homo sapiens
cuaggaguugaguacagu

SEQ ID NO: 754712 - RNA, 23 nt, Homo sapiens
cuaggaguuggacggaauggagg

SEQ ID NO: 754713 - RNA, 13 nt, Homo sapiens
cuaggaugugaug

SEQ ID NO: 754714 - RNA, 22 nt, Homo sapiens
cuaggcguuuguuauauaaaaa

SEQ ID NO: 754715 - RNA, 18 nt, Homo sapiens
cuaggcuaagcacuuuau

SEQ ID NO: 754716 - RNA, 14 nt, Homo sapiens
cuaggcugagcaau

SEQ ID NO: 754717 - RNA, 13 nt, Homo sapiens
cuagggagccauu

SEQ ID NO: 754718 - RNA, 19 nt, Homo sapiens
cuagggcuaguagaacugg

SEQ ID NO: 754719 - RNA, 17 nt, Homo sapiens
cuagguaacgagggcaa

SEQ ID NO: 754720 - RNA, 13 nt, Homo sapiens
cuagguaucauuc

SEQ ID NO: 754721 - RNA, 22 nt, Homo sapiens
cuagguaucauucaacucucca

SEQ ID NO: 754722 - RNA, 16 nt, Homo sapiens
cuagguguggcuguga

SEQ ID NO: 754723 - RNA, 23 nt, Homo sapiens
cuagguucuaaaaauugugauca

SEQ ID NO: 754724 - RNA, 23 nt, Homo sapiens
cuaguaauugccuagaaauaucu

SEQ ID NO: 754725 - RNA, 16 nt, Homo sapiens
cuaguauaucagugac

SEQ ID NO: 754726 - RNA, 17 nt, Homo sapiens
cuaguauaucagugaca

SEQ ID NO: 754727 - RNA, 20 nt, Homo sapiens
cuaguaucuucaaacuuuca

SEQ ID NO: 754728 - RNA, 16 nt, Homo sapiens
cuaguaugaaauuaua

SEQ ID NO: 754729 - RNA, 21 nt, Homo sapiens
cuaguauuucaugcugggaau

SEQ ID NO: 754730 - RNA, 19 nt, Homo sapiens
cuagucacaaagacuccuu

SEQ ID NO: 754731 - RNA, 15 nt, Homo sapiens
cuaguccuugcugca

SEQ ID NO: 754732 - RNA, 18 nt, Homo sapiens
cuagucuucccuuaccuc

SEQ ID NO: 754733 - RNA, 22 nt, Homo sapiens
cuagugugaguggcagccaugc

SEQ ID NO: 754734 - RNA, 21 nt, Homo sapiens
cuaguuaauguuuauuguuca

SEQ ID NO: 754735 - RNA, 12 nt, Homo sapiens
cuaguuacacau

SEQ ID NO: 754736 - RNA, 20 nt, Homo sapiens
cuaguucaaauuauuuggaa

SEQ ID NO: 754737 - RNA, 21 nt, Homo sapiens
cuaguuuauuggaaguguuca

SEQ ID NO: 754738 - RNA, 14 nt, Homo sapiens
cuaguuucucucaa

SEQ ID NO: 754739 - RNA, 15 nt, Homo sapiens
cuaguuuugcugaaa

SEQ ID NO: 754740 - RNA, 18 nt, Homo sapiens
cuauaacaaucacuggcu

SEQ ID NO: 754741 - RNA, 17 nt, Homo sapiens
cuauaacaugucuuuca

SEQ ID NO: 754742 - RNA, 18 nt, Homo sapiens
cuauaacaugucuuucag

SEQ ID NO: 754743 - RNA, 13 nt, Homo sapiens
cuauaaccucagc

SEQ ID NO: 754744 - RNA, 16 nt, Homo sapiens
cuauaagcccacuguu

SEQ ID NO: 754745 - RNA, 17 nt, Homo sapiens
cuauaagcccacuguua

SEQ ID NO: 754746 - RNA, 14 nt, Homo sapiens
cuauaauuuugccu

SEQ ID NO: 754747 - RNA, 12 nt, Homo sapiens
cuauaccaauaa

SEQ ID NO: 754748 - RNA, 22 nt, Homo sapiens
cuauacccacccagaaugagac

SEQ ID NO: 754749 - RNA, 18 nt, Homo sapiens
cuauacugguuauaguug

SEQ ID NO: 754750 - RNA, 14 nt, Homo sapiens
cuauagacuguaag

SEQ ID NO: 754751 - RNA, 15 nt, Homo sapiens
cuauagucauggggu

SEQ ID NO: 754752 - RNA, 23 nt, Homo sapiens
cuauauaguuuauugacaauaau

SEQ ID NO: 754753 - RNA, 23 nt, Homo sapiens
cuauauauaaagacaacaaaaga

SEQ ID NO: 754754 - RNA, 14 nt, Homo sapiens
cuauauauguguau

SEQ ID NO: 754755 - RNA, 22 nt, Homo sapiens
cuauauccugugacugucucac

SEQ ID NO: 754756 - RNA, 16 nt, Homo sapiens
cuauaucuguauauaa

SEQ ID NO: 754757 - RNA, 21 nt, Homo sapiens
cuauauggcaaauagccacaa

SEQ ID NO: 754758 - RNA, 18 nt, Homo sapiens
cuauauguaguauaaaga

SEQ ID NO: 754759 - RNA, 17 nt, Homo sapiens
cuauauucucaguguag

SEQ ID NO: 754760 - RNA, 17 nt, Homo sapiens
cuauauugcacugugac

SEQ ID NO: 754761 - RNA, 20 nt, Homo sapiens
cuaucaccucuuaugcacac

SEQ ID NO: 754762 - RNA, 15 nt, Homo sapiens
cuaucaccugucauc

SEQ ID NO: 754763 - RNA, 23 nt, Homo sapiens
cuaucagcauuuuacuacuuuaa

SEQ ID NO: 754764 - RNA, 16 nt, Homo sapiens
cuaucauggcauauaa

SEQ ID NO: 754765 - RNA, 22 nt, Homo sapiens
cuaucauuggccuccaaacaca

SEQ ID NO: 754766 - RNA, 18 nt, Homo sapiens
cuauccagcagaucauuu

SEQ ID NO: 754767 - RNA, 20 nt, Homo sapiens
cuauccauauuuuacugauc

SEQ ID NO: 754768 - RNA, 18 nt, Homo sapiens
cuaucccugcggccucca

SEQ ID NO: 754769 - RNA, 18 nt, Homo sapiens
cuauccucucuuccucuu

SEQ ID NO: 754770 - RNA, 14 nt, Homo sapiens
cuauccuuuugccu

SEQ ID NO: 754771 - RNA, 21 nt, Homo sapiens
cuaucuacuacaaacuucaaa

SEQ ID NO: 754772 - RNA, 13 nt, Homo sapiens
cuaucuccugaca

SEQ ID NO: 754773 - RNA, 20 nt, Homo sapiens
cuaucugauuuccuaauguc

SEQ ID NO: 754774 - RNA, 17 nt, Homo sapiens
cuaucuuuuaguuuuag

SEQ ID NO: 754775 - RNA, 17 nt, Homo sapiens
cuaucuuuucuggauga

SEQ ID NO: 754776 - RNA, 20 nt, Homo sapiens
cuaugaaaaugagcaucaga

SEQ ID NO: 754777 - RNA, 21 nt, Homo sapiens
cuaugacauaaaaacaacuuu

SEQ ID NO: 754778 - RNA, 16 nt, Homo sapiens
cuaugacauuacugua

SEQ ID NO: 754779 - RNA, 17 nt, Homo sapiens
cuaugacauuacuguau

SEQ ID NO: 754780 - RNA, 15 nt, Homo sapiens
cuaugacuguaucuu

SEQ ID NO: 754781 - RNA, 21 nt, Homo sapiens
cuaugagaauugggauuacau

SEQ ID NO: 754782 - RNA, 14 nt, Homo sapiens
cuaugagccaggca

SEQ ID NO: 754783 - RNA, 20 nt, Homo sapiens
cuaugaguuggacuucaguc

SEQ ID NO: 754784 - RNA, 19 nt, Homo sapiens
cuaugaucuggacuuccua

SEQ ID NO: 754785 - RNA, 15 nt, Homo sapiens
cuaugauggugacau

SEQ ID NO: 754786 - RNA, 14 nt, Homo sapiens
ugggauuacaggca

SEQ ID NO: 754787 - RNA, 23 nt, Homo sapiens
ugggauuacaggcaugagccauu

SEQ ID NO: 754788 - RNA, 23 nt, Homo sapiens
ugggauuacaggugugagccacc

SEQ ID NO: 754789 - RNA, 22 nt, Homo sapiens
ugggauuagcccgcuagcauua

SEQ ID NO: 754790 - RNA, 18 nt, Homo sapiens
ugggauuauauaggcaug

SEQ ID NO: 754791 - RNA, 14 nt, Homo sapiens
ugggauuccugacc

SEQ ID NO: 754792 - RNA, 21 nt, Homo sapiens
ugggauugggggcuggugcca

SEQ ID NO: 754793 - RNA, 21 nt, Homo sapiens
ugggcaaaacccacagaagac

SEQ ID NO: 754794 - RNA, 19 nt, Homo sapiens
ugggcaaagggaaguaaca

SEQ ID NO: 754795 - RNA, 19 nt, Homo sapiens
ugggcaacaagagcgagac

SEQ ID NO: 754796 - RNA, 18 nt, Homo sapiens
ugggcaacauaguaagac

SEQ ID NO: 754797 - RNA, 23 nt, Homo sapiens
ugggcaacauaguaagaccccau

SEQ ID NO: 754798 - RNA, 22 nt, Homo sapiens
ugggcaagagaugggacaagca

SEQ ID NO: 754799 - RNA, 19 nt, Homo sapiens
ugggcacaguggacucagc

SEQ ID NO: 754800 - RNA, 14 nt, Homo sapiens
ugggcacaugccuu

SEQ ID NO: 754801 - RNA, 14 nt, Homo sapiens
ugggcagaaagugg

SEQ ID NO: 754802 - RNA, 15 nt, Homo sapiens
ugggcagagcugcau

SEQ ID NO: 754803 - RNA, 21 nt, Homo sapiens
ugggcagcaaaacgacacugc

SEQ ID NO: 754804 - RNA, 14 nt, Homo sapiens
ugggcagggaugau

SEQ ID NO: 754805 - RNA, 12 nt, Homo sapiens
ugggcaggguga

SEQ ID NO: 754806 - RNA, 14 nt, Homo sapiens
ugggccaccagaga

SEQ ID NO: 754807 - RNA, 22 nt, Homo sapiens
ugggccacucaggggucauuca

SEQ ID NO: 754808 - RNA, 20 nt, Homo sapiens
ugggccagaaguaccagacu

SEQ ID NO: 754809 - RNA, 16 nt, Homo sapiens
ugggccagacaugcca

SEQ ID NO: 754810 - RNA, 14 nt, Homo sapiens
ugggccauguccaa

SEQ ID NO: 754811 - RNA, 18 nt, Homo sapiens
ugggccauguccaaagag

SEQ ID NO: 754812 - RNA, 17 nt, Homo sapiens
ugggccauuaaaaacua

SEQ ID NO: 754813 - RNA, 19 nt, Homo sapiens
ugggcccagcaggggcccu

SEQ ID NO: 754814 - RNA, 18 nt, Homo sapiens
cucagccuacuccgcuca

SEQ ID NO: 754815 - RNA, 17 nt, Homo sapiens
cucagccuccaaagugg

SEQ ID NO: 754816 - RNA, 20 nt, Homo sapiens
cucagccuccugaguagcug

SEQ ID NO: 754817 - RNA, 14 nt, Homo sapiens
cucagccucugcca

SEQ ID NO: 754818 - RNA, 19 nt, Homo sapiens
cucagccuggccagacaca

SEQ ID NO: 754819 - RNA, 20 nt, Homo sapiens
cucagcgcgucucagcucag

SEQ ID NO: 754820 - RNA, 16 nt, Homo sapiens
cucagcucggggagcc

SEQ ID NO: 754821 - RNA, 20 nt, Homo sapiens
cucagcucggggagccuuag

SEQ ID NO: 754822 - RNA, 14 nt, Homo sapiens
cucagcugcugaaa

SEQ ID NO: 754823 - RNA, 15 nt, Homo sapiens
cucagcuguccugca

SEQ ID NO: 754824 - RNA, 20 nt, Homo sapiens
cucagcuucucaaaguacug

SEQ ID NO: 754825 - RNA, 21 nt, Homo sapiens
cucagcuuuccuuaaggauau

SEQ ID NO: 754826 - RNA, 18 nt, Homo sapiens
cucagcuuugagaagccu

SEQ ID NO: 754827 - RNA, 19 nt, Homo sapiens
cucagcuuuuuaauuaaau

SEQ ID NO: 754828 - RNA, 22 nt, Homo sapiens
cucaggcaaggggcauuucaca

SEQ ID NO: 754829 - RNA, 21 nt, Homo sapiens
cucaggccaagcccaauacag

SEQ ID NO: 754830 - RNA, 16 nt, Homo sapiens
cucagggagcagggaa

SEQ ID NO: 754831 - RNA, 17 nt, Homo sapiens
cucagggagcagggaag

SEQ ID NO: 754832 - RNA, 17 nt, Homo sapiens
cucagggguuaagagcu

SEQ ID NO: 754833 - RNA, 15 nt, Homo sapiens
cucagggguuucauu

SEQ ID NO: 754834 - RNA, 21 nt, Homo sapiens
cucaggugaaaauccaucuca

SEQ ID NO: 754835 - RNA, 21 nt, Homo sapiens
cucaggugaucuaccugccuc

SEQ ID NO: 754836 - RNA, 15 nt, Homo sapiens
cucagguguugccaa

SEQ ID NO: 754837 - RNA, 19 nt, Homo sapiens
cucagguuccuuuuucaaa

SEQ ID NO: 754838 - RNA, 15 nt, Homo sapiens
cucagguucuuucca

SEQ ID NO: 754839 - RNA, 12 nt, Homo sapiens
cucaguaauucc

SEQ ID NO: 754840 - RNA, 20 nt, Homo sapiens
cucaguaucaguauuuacau

SEQ ID NO: 754841 - RNA, 22 nt, Homo sapiens
cucagucucccagcuaauugag

SEQ ID NO: 754842 - RNA, 20 nt, Homo sapiens
cucagugagcuggggccguc

SEQ ID NO: 754843 - RNA, 15 nt, Homo sapiens
cucagugcacgagcu

SEQ ID NO: 754844 - RNA, 23 nt, Homo sapiens
cucagugcagcaauauauuacca

SEQ ID NO: 754845 - RNA, 23 nt, Homo sapiens
cucaguuauuacauguaauuuga

SEQ ID NO: 754846 - RNA, 13 nt, Homo sapiens
cucaguuccugcc

SEQ ID NO: 754847 - RNA, 22 nt, Homo sapiens
cucaguucuugagggccucccc

SEQ ID NO: 754848 - RNA, 20 nt, Homo sapiens
cucaguuggaaucauugcua

SEQ ID NO: 754849 - RNA, 15 nt, Homo sapiens
cucaguuucuaggca

SEQ ID NO: 754850 - RNA, 15 nt, Homo sapiens
cucauaaggugcuau

SEQ ID NO: 754851 - RNA, 22 nt, Homo sapiens
cucauaaguuggaccagaggaa

SEQ ID NO: 754852 - RNA, 14 nt, Homo sapiens
cucauaauuuugca

SEQ ID NO: 754853 - RNA, 16 nt, Homo sapiens
cucauaauuuugcaaa

SEQ ID NO: 754854 - RNA, 12 nt, Homo sapiens
cucauaccucag

SEQ ID NO: 754855 - RNA, 17 nt, Homo sapiens
cucauacuuaagcaaaa

SEQ ID NO: 754856 - RNA, 14 nt, Homo sapiens
cucauagaggugag

SEQ ID NO: 754857 - RNA, 19 nt, Homo sapiens
cucauaucaugguagucac

SEQ ID NO: 754858 - RNA, 20 nt, Homo sapiens
cucauaucaugguagucacu

SEQ ID NO: 754859 - RNA, 19 nt, Homo sapiens
cucauaugcauguagucac

SEQ ID NO: 754860 - RNA, 20 nt, Homo sapiens
cucaucaauggggccaguca

SEQ ID NO: 754861 - RNA, 22 nt, Homo sapiens
cucaucaguguccucuugcuca

SEQ ID NO: 754862 - RNA, 22 nt, Homo sapiens
cucaucauaaaauaaaguauau

SEQ ID NO: 754863 - RNA, 12 nt, Homo sapiens
cucauccaaagu

SEQ ID NO: 754864 - RNA, 18 nt, Homo sapiens
cucauccccacagcuggc

SEQ ID NO: 754865 - RNA, 22 nt, Homo sapiens
cucauccugauuuuuacuauca

SEQ ID NO: 754866 - RNA, 19 nt, Homo sapiens
cucauccuggcacgcccua

SEQ ID NO: 754867 - RNA, 16 nt, Homo sapiens
cucaucuuucuccuuc

SEQ ID NO: 754868 - RNA, 15 nt, Homo sapiens
cucaucuuucuugau

SEQ ID NO: 754869 - RNA, 14 nt, Homo sapiens
cucaugaagcauac

SEQ ID NO: 754870 - RNA, 11 nt, Homo sapiens
cucaugacagc

SEQ ID NO: 754871 - RNA, 15 nt, Homo sapiens
cucaugaccuugaaa

SEQ ID NO: 754872 - RNA, 18 nt, Homo sapiens
cucaugccuguaaucuca

SEQ ID NO: 754873 - RNA, 21 nt, Homo sapiens
cucauggcuguguccacugca

SEQ ID NO: 754874 - RNA, 16 nt, Homo sapiens
cucauguuacucagug

SEQ ID NO: 754875 - RNA, 23 nt, Homo sapiens
cucauguuguugaggcugucaca

SEQ ID NO: 754876 - RNA, 12 nt, Homo sapiens
cucauucaaaag

SEQ ID NO: 754877 - RNA, 23 nt, Homo sapiens
cucauucccaacgugcaaagcca

SEQ ID NO: 754878 - RNA, 18 nt, Homo sapiens
cucauuccccaaccacuu

SEQ ID NO: 754879 - RNA, 19 nt, Homo sapiens
cucauuggccugcccuuca

SEQ ID NO: 754880 - RNA, 19 nt, Homo sapiens
cucauuugagauaaaguca

SEQ ID NO: 754881 - RNA, 14 nt, Homo sapiens
cucauuuuaacuca

SEQ ID NO: 754882 - RNA, 16 nt, Homo sapiens
cucauuuuauacccaa

SEQ ID NO: 754883 - RNA, 17 nt, Homo sapiens
cuccaaaccuccagccu

SEQ ID NO: 754884 - RNA, 22 nt, Homo sapiens
cuccaaagaaauguaagggaaa

SEQ ID NO: 754885 - RNA, 19 nt, Homo sapiens
cuccaaagaacaacuugcu

SEQ ID NO: 754886 - RNA, 14 nt, Homo sapiens
cuccaaagggcagu

SEQ ID NO: 754887 - RNA, 14 nt, Homo sapiens
cuccaaagucguuu

SEQ ID NO: 754888 - RNA, 17 nt, Homo sapiens
cuccaacagccagugug

SEQ ID NO: 754889 - RNA, 24 nt, Homo sapiens
cuccaaccacugugccacugacuu

SEQ ID NO: 754890 - RNA, 23 nt, Homo sapiens
cuccaacgccccuguggccaacu

SEQ ID NO: 754891 - RNA, 19 nt, Homo sapiens
cuccaacugaaauguuaag

SEQ ID NO: 754892 - RNA, 18 nt, Homo sapiens
cuccaagccugccuccca

SEQ ID NO: 754893 - RNA, 15 nt, Homo sapiens
cuccaaucaguguuu

SEQ ID NO: 754894 - RNA, 18 nt, Homo sapiens
cuccaauuucaagaguga

SEQ ID NO: 754895 - RNA, 19 nt, Homo sapiens
cuccacagcgagggcagcu

SEQ ID NO: 754896 - RNA, 19 nt, Homo sapiens
cuccaccagccugcugaca

SEQ ID NO: 754897 - RNA, 16 nt, Homo sapiens
cuccacccaccaguca

SEQ ID NO: 754898 - RNA, 11 nt, Homo sapiens
cuccaccucaa

SEQ ID NO: 754899 - RNA, 15 nt, Homo sapiens
cuccaccugcuggug

SEQ ID NO: 754900 - RNA, 18 nt, Homo sapiens
cuccaccuugcucuucuu

SEQ ID NO: 754901 - RNA, 14 nt, Homo sapiens
cuccacucacucca

SEQ ID NO: 754902 - RNA, 17 nt, Homo sapiens
uguaaucucagcacuuu

SEQ ID NO: 754903 - RNA, 21 nt, Homo sapiens
uguaaugaaaaugaauaucua

SEQ ID NO: 754904 - RNA, 16 nt, Homo sapiens
uguaaugacagugcua

SEQ ID NO: 754905 - RNA, 12 nt, Homo sapiens
uguaaugcugca

SEQ ID NO: 754906 - RNA, 15 nt, Homo sapiens
uguaauggaaaccaa

SEQ ID NO: 754907 - RNA, 13 nt, Homo sapiens
uguaauguguaca

SEQ ID NO: 754908 - RNA, 17 nt, Homo sapiens
uguaauguuauuuccac

SEQ ID NO: 754909 - RNA, 13 nt, Homo sapiens
uguaauucauuga

SEQ ID NO: 754910 - RNA, 22 nt, Homo sapiens
uguaauugcaugacaaaccuua

SEQ ID NO: 754911 - RNA, 22 nt, Homo sapiens
uguaauuuaagugacacagaca

SEQ ID NO: 754912 - RNA, 21 nt, Homo sapiens
uguaauuucgccuuaaacucu

SEQ ID NO: 754913 - RNA, 16 nt, Homo sapiens
uguaauuugcaaagaa

SEQ ID NO: 754914 - RNA, 13 nt, Homo sapiens
uguacacugugua

SEQ ID NO: 754915 - RNA, 17 nt, Homo sapiens
uguacagaccaccuuuc

SEQ ID NO: 754916 - RNA, 15 nt, Homo sapiens
uguacagagugcuuu

SEQ ID NO: 754917 - RNA, 11 nt, Homo sapiens
uguacagugaa

SEQ ID NO: 754918 - RNA, 13 nt, Homo sapiens
uguacagugaauu

SEQ ID NO: 754919 - RNA, 22 nt, Homo sapiens
uguacauguuccuguuuaugca

SEQ ID NO: 754920 - RNA, 12 nt, Homo sapiens
uguacauuucac

SEQ ID NO: 754921 - RNA, 14 nt, Homo sapiens
uguaccaggcucuc

SEQ ID NO: 754922 - RNA, 19 nt, Homo sapiens
uguaccaucugucuugcca

SEQ ID NO: 754923 - RNA, 13 nt, Homo sapiens
uguaccauguaca

SEQ ID NO: 754924 - RNA, 21 nt, Homo sapiens
uguacccagucucaaaggcca

SEQ ID NO: 754925 - RNA, 19 nt, Homo sapiens
uguacccucgcaugacugu

SEQ ID NO: 754926 - RNA, 14 nt, Homo sapiens
uguaccuugcugug

SEQ ID NO: 754927 - RNA, 16 nt, Homo sapiens
uguacguuuugcacau

SEQ ID NO: 754928 - RNA, 15 nt, Homo sapiens
uguacuaagcaguaa

SEQ ID NO: 754929 - RNA, 13 nt, Homo sapiens
cugcugacuggca

SEQ ID NO: 754930 - RNA, 22 nt, Homo sapiens
cugcugagucagacugucagaa

SEQ ID NO: 754931 - RNA, 19 nt, Homo sapiens
cugcugagugcaccacuuc

SEQ ID NO: 754932 - RNA, 17 nt, Homo sapiens
cugcugauguaggagcu

SEQ ID NO: 754933 - RNA, 17 nt, Homo sapiens
cugcugcaaacauugua

SEQ ID NO: 754934 - RNA, 13 nt, Homo sapiens
cugcugccaucca

SEQ ID NO: 754935 - RNA, 16 nt, Homo sapiens
cugcugccauccucac

SEQ ID NO: 754936 - RNA, 21 nt, Homo sapiens
cugcugccucccuggggacca

SEQ ID NO: 754937 - RNA, 15 nt, Homo sapiens
cugcuggaaaaagcc

SEQ ID NO: 754938 - RNA, 16 nt, Homo sapiens
cugcuggaaaugcuga

SEQ ID NO: 754939 - RNA, 23 nt, Homo sapiens
cugcuggcagaaagcaaauguga

SEQ ID NO: 754940 - RNA, 16 nt, Homo sapiens
cugcuggggaccucac

SEQ ID NO: 754941 - RNA, 13 nt, Homo sapiens
cugcuggugaaua

SEQ ID NO: 754942 - RNA, 11 nt, Homo sapiens
cugcuggugag

SEQ ID NO: 754943 - RNA, 15 nt, Homo sapiens
cugcuggugcuaaaa

SEQ ID NO: 754944 - RNA, 11 nt, Homo sapiens
cugcugugauc

SEQ ID NO: 754945 - RNA, 14 nt, Homo sapiens
cugcugugaugacu

SEQ ID NO: 754946 - RNA, 19 nt, Homo sapiens
cugcugugauuccacuaca

SEQ ID NO: 754947 - RNA, 21 nt, Homo sapiens
cugcuguggggaccacacuga

SEQ ID NO: 754948 - RNA, 22 nt, Homo sapiens
cugcuguggggaccacacugau

SEQ ID NO: 754949 - RNA, 20 nt, Homo sapiens
cugcuguuccugcuccauga

SEQ ID NO: 754950 - RNA, 12 nt, Homo sapiens
cugcuuacuguu

SEQ ID NO: 754951 - RNA, 18 nt, Homo sapiens
cugcuucauccaauguga

SEQ ID NO: 754952 - RNA, 13 nt, Homo sapiens
cugcuucauggga

SEQ ID NO: 754953 - RNA, 20 nt, Homo sapiens
cugcuucaugggaaaacaga

SEQ ID NO: 754954 - RNA, 20 nt, Homo sapiens
cugcuuccaauuuucuggaa

SEQ ID NO: 754955 - RNA, 10 nt, Homo sapiens
cugcuuccag

SEQ ID NO: 754956 - RNA, 16 nt, Homo sapiens
cugcuucccacugggg

SEQ ID NO: 754957 - RNA, 15 nt, Homo sapiens
cugcuucccuguuga

SEQ ID NO: 754958 - RNA, 16 nt, Homo sapiens
cugcuucuuggagcuu

SEQ ID NO: 754959 - RNA, 11 nt, Homo sapiens
cugcuugcaca

SEQ ID NO: 754960 - RNA, 15 nt, Homo sapiens
cugcuugcuuggccc

SEQ ID NO: 754961 - RNA, 21 nt, Homo sapiens
cugcuuguccugcucucuuca

SEQ ID NO: 754962 - RNA, 18 nt, Homo sapiens
cugcuuuaaacugcauuu

SEQ ID NO: 754963 - RNA, 21 nt, Homo sapiens
cugcuuuaguuucacauugca

SEQ ID NO: 754964 - RNA, 19 nt, Homo sapiens
cugcuuugaaacuugccug

SEQ ID NO: 754965 - RNA, 17 nt, Homo sapiens
cugcuuuucccauugcc

SEQ ID NO: 754966 - RNA, 13 nt, Homo sapiens
cuggaaaaagccc

SEQ ID NO: 754967 - RNA, 16 nt, Homo sapiens
cuggaaaaauuccaga

SEQ ID NO: 754968 - RNA, 15 nt, Homo sapiens
cuggaaaacugccuu

SEQ ID NO: 754969 - RNA, 14 nt, Homo sapiens
cuggaaaagggaag

SEQ ID NO: 754970 - RNA, 23 nt, Homo sapiens
cuggaaaggcucagucucaggag

SEQ ID NO: 754971 - RNA, 21 nt, Homo sapiens
cuggaaagugugaaugcugaa

SEQ ID NO: 754972 - RNA, 16 nt, Homo sapiens
cuggaaaucauaauaa

SEQ ID NO: 754973 - RNA, 14 nt, Homo sapiens
cuggaaaugcugac

SEQ ID NO: 754974 - RNA, 18 nt, Homo sapiens
cuggaacauuaguaguua

SEQ ID NO: 754975 - RNA, 23 nt, Homo sapiens
cuggaagaaaaaaaccacacaaa

SEQ ID NO: 754976 - RNA, 14 nt, Homo sapiens
cuggaagaagugag

SEQ ID NO: 754977 - RNA, 14 nt, Homo sapiens
cuggaagacacuuc

SEQ ID NO: 754978 - RNA, 24 nt, Homo sapiens
cuggaagagccaaagaauauucca

SEQ ID NO: 754979 - RNA, 16 nt, Homo sapiens
cuggaagaggaaccag

SEQ ID NO: 754980 - RNA, 16 nt, Homo sapiens
cuggaagauacauaaa

SEQ ID NO: 754981 - RNA, 22 nt, Homo sapiens
cuggaagaucagcacccuaaga

SEQ ID NO: 754982 - RNA, 22 nt, Homo sapiens
cuggaagauuuaugaacagaaa

SEQ ID NO: 754983 - RNA, 23 nt, Homo sapiens
cuggaagcauguaggagaaucca

SEQ ID NO: 754984 - RNA, 23 nt, Homo sapiens
cuggaaggagugagaggggacaa

SEQ ID NO: 754985 - RNA, 21 nt, Homo sapiens
cuggaagggcagaguagccag

SEQ ID NO: 754986 - RNA, 18 nt, Homo sapiens
cuggaagucaucucauuc

SEQ ID NO: 754987 - RNA, 20 nt, Homo sapiens
cuggaauauaaaacagucau

SEQ ID NO: 754988 - RNA, 17 nt, Homo sapiens
cuggaaucacauucuua

SEQ ID NO: 754989 - RNA, 20 nt, Homo sapiens
cuggaaugcagugacacaau

SEQ ID NO: 754990 - RNA, 20 nt, Homo sapiens
cuggaauguaaucaauguuu

SEQ ID NO: 754991 - RNA, 22 nt, Homo sapiens
cuggaauuacaaaacucagaga

SEQ ID NO: 754992 - RNA, 16 nt, Homo sapiens
cuggacaaggucucuu

SEQ ID NO: 754993 - RNA, 16 nt, Homo sapiens
cuggacaguaucccac

SEQ ID NO: 754994 - RNA, 22 nt, Homo sapiens
cuggacagugacgaggacucuc

SEQ ID NO: 754995 - RNA, 21 nt, Homo sapiens
cuggaccugcccugggccaca

SEQ ID NO: 754996 - RNA, 22 nt, Homo sapiens
cuggacggcaggcucacugcca

SEQ ID NO: 754997 - RNA, 12 nt, Homo sapiens
cuggacucagga

SEQ ID NO: 754998 - RNA, 13 nt, Homo sapiens
cuggacucaggau

SEQ ID NO: 754999 - RNA, 19 nt, Homo sapiens
cuggacucaggaugcccag

SEQ ID NO: 755000 - RNA, 12 nt, Homo sapiens
cuggacugacca

SEQ ID NO: 755001 - RNA, 12 nt, Homo sapiens
cuggacuuuccu

SEQ ID NO: 755002 - RNA, 22 nt, Homo sapiens
cuggagaaaagggauggagcug

SEQ ID NO: 755003 - RNA, 20 nt, Homo sapiens
cuggagaccgcuucaccccu

SEQ ID NO: 755004 - RNA, 13 nt, Homo sapiens
cuggagauaugaa

SEQ ID NO: 755005 - RNA, 20 nt, Homo sapiens
cuggagauggacaacucaau

SEQ ID NO: 755006 - RNA, 22 nt, Homo sapiens
cuggagauggacaacucaauga

SEQ ID NO: 755007 - RNA, 15 nt, Homo sapiens
cuggagcccgaggca

SEQ ID NO: 755008 - RNA, 23 nt, Homo sapiens
cuggagcccgaggcaccaguguc

SEQ ID NO: 755009 - RNA, 14 nt, Homo sapiens
cuggagccugcaga

SEQ ID NO: 755010 - RNA, 22 nt, Homo sapiens
cuggaggcccaguucacccuga

SEQ ID NO: 755011 - RNA, 21 nt, Homo sapiens
cuggagggaggcugggcgggu

SEQ ID NO: 755012 - RNA, 20 nt, Homo sapiens
cuggagggggagcaccagcg

SEQ ID NO: 755013 - RNA, 20 nt, Homo sapiens
cuggaguacaguggcacgau

SEQ ID NO: 755014 - RNA, 14 nt, Homo sapiens
cuggagugcagugg

SEQ ID NO: 755015 - RNA, 19 nt, Homo sapiens
cuggagugcaguggcgcau

SEQ ID NO: 755016 - RNA, 20 nt, Homo sapiens
cuggagugcaguggcgcgau

SEQ ID NO: 755017 - RNA, 20 nt, Homo sapiens
cuggagugcaguggugcaau

SEQ ID NO: 755018 - RNA, 20 nt, Homo sapiens
cuggagugcaguggugccau

SEQ ID NO: 755019 - RNA, 20 nt, Homo sapiens
cuggagugcaguggugugau

SEQ ID NO: 755020 - RNA, 13 nt, Homo sapiens
cuggauauuucaa

SEQ ID NO: 755021 - RNA, 12 nt, Homo sapiens
uuauccuagauc

SEQ ID NO: 755022 - RNA, 17 nt, Homo sapiens
uuauccugcuagcugua

SEQ ID NO: 755023 - RNA, 18 nt, Homo sapiens
uuaucgggagcagugucu

SEQ ID NO: 755024 - RNA, 16 nt, Homo sapiens
uuaucuauucugagaa

SEQ ID NO: 755025 - RNA, 21 nt, Homo sapiens
uuaucugugucaaaagccaga

SEQ ID NO: 755026 - RNA, 17 nt, Homo sapiens
uuaucuguuuccugaca

SEQ ID NO: 755027 - RNA, 13 nt, Homo sapiens
uuaucuuaugcca

SEQ ID NO: 755028 - RNA, 18 nt, Homo sapiens
uuaugagaaaguucucau

SEQ ID NO: 755029 - RNA, 23 nt, Homo sapiens
uuaugagaggcaaugauuguuaa

SEQ ID NO: 755030 - RNA, 20 nt, Homo sapiens
uuaugaucuggcccuugcuu

SEQ ID NO: 755031 - RNA, 13 nt, Homo sapiens
uuaugaucuuggc

SEQ ID NO: 755032 - RNA, 18 nt, Homo sapiens
uuaugauggucugcauua

SEQ ID NO: 755033 - RNA, 18 nt, Homo sapiens
uuaugauugcauuguaug

SEQ ID NO: 755034 - RNA, 14 nt, Homo sapiens
uuaugcacugccug

SEQ ID NO: 755035 - RNA, 15 nt, Homo sapiens
uuaugccuucacuuu

SEQ ID NO: 755036 - RNA, 12 nt, Homo sapiens
uuaugccuuuau

SEQ ID NO: 755037 - RNA, 18 nt, Homo sapiens
uuaugcuauuuggacaau

SEQ ID NO: 755038 - RNA, 13 nt, Homo sapiens
uuaugcugugaca

SEQ ID NO: 755039 - RNA, 21 nt, Homo sapiens
uuauggaaaaggggugaccua

SEQ ID NO: 755040 - RNA, 19 nt, Homo sapiens
uuaugguuaauacuauuaa

SEQ ID NO: 755041 - RNA, 18 nt, Homo sapiens
uuauguaaaacccuuuaa

SEQ ID NO: 755042 - RNA, 14 nt, Homo sapiens
uuauguaaugcaaa

SEQ ID NO: 755043 - RNA, 12 nt, Homo sapiens
uuaugugcuaug

SEQ ID NO: 755044 - RNA, 16 nt, Homo sapiens
cuggugggcggggcca

SEQ ID NO: 755045 - RNA, 23 nt, Homo sapiens
cuggugggcuagccaauagaguu

SEQ ID NO: 755046 - RNA, 18 nt, Homo sapiens
cugguguaugcacagggu

SEQ ID NO: 755047 - RNA, 23 nt, Homo sapiens
cuggugucacccuggauaggcaa

SEQ ID NO: 755048 - RNA, 22 nt, Homo sapiens
cugguguccugcccgccuuuca

SEQ ID NO: 755049 - RNA, 12 nt, Homo sapiens
cugguguucuau

SEQ ID NO: 755050 - RNA, 19 nt, Homo sapiens
cugguuaccaccagccuuu

SEQ ID NO: 755051 - RNA, 20 nt, Homo sapiens
cugguucucaucuuucuuga

SEQ ID NO: 755052 - RNA, 21 nt, Homo sapiens
cugguugauuuguaacacagu

SEQ ID NO: 755053 - RNA, 21 nt, Homo sapiens
cugguuguugccaaacagcca

SEQ ID NO: 755054 - RNA, 14 nt, Homo sapiens
cugguuuacuucaa

SEQ ID NO: 755055 - RNA, 20 nt, Homo sapiens
cuguaaaaaauggagcucag

SEQ ID NO: 755056 - RNA, 23 nt, Homo sapiens
cuguaaaauggaggccauugugu

SEQ ID NO: 755057 - RNA, 15 nt, Homo sapiens
cuguaaacuguguau

SEQ ID NO: 755058 - RNA, 20 nt, Homo sapiens
cuguaaacuuuaucacuuaa

SEQ ID NO: 755059 - RNA, 23 nt, Homo sapiens
cuguaaagguuuuuggaauuaug

SEQ ID NO: 755060 - RNA, 14 nt, Homo sapiens
cuguaaauaaccua

SEQ ID NO: 755061 - RNA, 15 nt, Homo sapiens
cuguaaauaaccuau

SEQ ID NO: 755062 - RNA, 19 nt, Homo sapiens
cuguaaauauuuuucacau

SEQ ID NO: 755063 - RNA, 16 nt, Homo sapiens
cuguaaggcucuagau

SEQ ID NO: 755064 - RNA, 12 nt, Homo sapiens
cuguaauagugu

SEQ ID NO: 755065 - RNA, 21 nt, Homo sapiens
cuguaauaguuuuauauuguu

SEQ ID NO: 755066 - RNA, 15 nt, Homo sapiens
cuguaaucagcaaua

SEQ ID NO: 755067 - RNA, 20 nt, Homo sapiens
cuguaaucccagcacuuugg

SEQ ID NO: 755068 - RNA, 21 nt, Homo sapiens
cuguaaucccagcacuuuggg

SEQ ID NO: 755069 - RNA, 19 nt, Homo sapiens
cuguaaucccagcuacuca

SEQ ID NO: 755070 - RNA, 20 nt, Homo sapiens
cuguaaucucggaaggcuga

SEQ ID NO: 755071 - RNA, 19 nt, Homo sapiens
cuguaauguaaauaaacua

SEQ ID NO: 755072 - RNA, 19 nt, Homo sapiens
cuguaauuaauaucuugcu

SEQ ID NO: 755073 - RNA, 14 nt, Homo sapiens
cuguaauuccagcu

SEQ ID NO: 755074 - RNA, 15 nt, Homo sapiens
cuguaauuccagcua

SEQ ID NO: 755075 - RNA, 16 nt, Homo sapiens
cuguaauugaauauaa

SEQ ID NO: 755076 - RNA, 21 nt, Homo sapiens
cuguaauuuaauuuaggacac

SEQ ID NO: 755077 - RNA, 13 nt, Homo sapiens
cuguacacaggcg

SEQ ID NO: 755078 - RNA, 16 nt, Homo sapiens
cuguacacauauuuga

SEQ ID NO: 755079 - RNA, 18 nt, Homo sapiens
cuguacacugacuugaga

SEQ ID NO: 755080 - RNA, 19 nt, Homo sapiens
cuguacacugacuugagac

SEQ ID NO: 755081 - RNA, 15 nt, Homo sapiens
cuguacauugugagc

SEQ ID NO: 755082 - RNA, 22 nt, Homo sapiens
cuguaccacaucugcucuaggg

SEQ ID NO: 755083 - RNA, 15 nt, Homo sapiens
cuguaccaguuaauu

SEQ ID NO: 755084 - RNA, 12 nt, Homo sapiens
cuguacuguuac

SEQ ID NO: 755085 - RNA, 15 nt, Homo sapiens
cuguacuuuuuccag

SEQ ID NO: 755086 - RNA, 14 nt, Homo sapiens
cuguagaaaugaug

SEQ ID NO: 755087 - RNA, 21 nt, Homo sapiens
cuguagaagaagcccauauca

SEQ ID NO: 755088 - RNA, 15 nt, Homo sapiens
cuguagaguugcuga

SEQ ID NO: 755089 - RNA, 13 nt, Homo sapiens
cuguagaugaugu

SEQ ID NO: 755090 - RNA, 18 nt, Homo sapiens
cuguagauucuguggaac

SEQ ID NO: 755091 - RNA, 14 nt, Homo sapiens
cuguagggggcgau

SEQ ID NO: 755092 - RNA, 18 nt, Homo sapiens
cuguagguucaugcccaa

SEQ ID NO: 755093 - RNA, 12 nt, Homo sapiens
cuguagucccag

SEQ ID NO: 755094 - RNA, 22 nt, Homo sapiens
cuguagucccagcuacucagga

SEQ ID NO: 755095 - RNA, 22 nt, Homo sapiens
cuguagucccagcuacucggga

SEQ ID NO: 755096 - RNA, 14 nt, Homo sapiens
cuguaguuacugug

SEQ ID NO: 755097 - RNA, 12 nt, Homo sapiens
cuguaguugcag

SEQ ID NO: 755098 - RNA, 17 nt, Homo sapiens
cuguaguugggccuaaa

SEQ ID NO: 755099 - RNA, 16 nt, Homo sapiens
cuguauaguacuggca

SEQ ID NO: 755100 - RNA, 17 nt, Homo sapiens
cuguaucuugauaucuc

SEQ ID NO: 755101 - RNA, 16 nt, Homo sapiens
cuguaugauuccuuga

SEQ ID NO: 755102 - RNA, 22 nt, Homo sapiens
cuguaugucaauaaacaacagc

SEQ ID NO: 755103 - RNA, 15 nt, Homo sapiens
cuguaugugccaaag

SEQ ID NO: 755104 - RNA, 21 nt, Homo sapiens
cuguauucuguuugcguacuu

SEQ ID NO: 755105 - RNA, 14 nt, Homo sapiens
cuguauuuaagaaa

SEQ ID NO: 755106 - RNA, 15 nt, Homo sapiens
cuguauuuagaucuc

SEQ ID NO: 755107 - RNA, 20 nt, Homo sapiens
cuguauuugagagacugcca

SEQ ID NO: 755108 - RNA, 19 nt, Homo sapiens
cuguauuuugccagacuua

SEQ ID NO: 755109 - RNA, 22 nt, Homo sapiens
cugucaagaagaggaaagggag

SEQ ID NO: 755110 - RNA, 18 nt, Homo sapiens
cugucaauaaacagcuuc

SEQ ID NO: 755111 - RNA, 16 nt, Homo sapiens
cugucacagaguagaa

SEQ ID NO: 755112 - RNA, 23 nt, Homo sapiens
cugucacagaguagaaacucaaa

SEQ ID NO: 755113 - RNA, 16 nt, Homo sapiens
cugucacucugugccu

SEQ ID NO: 755114 - RNA, 18 nt, Homo sapiens
cugucacugcuugaggga

SEQ ID NO: 755115 - RNA, 12 nt, Homo sapiens
cugucagagccg

SEQ ID NO: 755116 - RNA, 23 nt, Homo sapiens
cugucaguucuaaccuccuaagc

SEQ ID NO: 755117 - RNA, 12 nt, Homo sapiens
cugucaguucuc

SEQ ID NO: 755118 - RNA, 15 nt, Homo sapiens
cugucaucagccugu

SEQ ID NO: 755119 - RNA, 20 nt, Homo sapiens
cugucauccucaggaaccaa

SEQ ID NO: 755120 - RNA, 20 nt, Homo sapiens
cugucaucuuuuuccacuuu

SEQ ID NO: 755121 - RNA, 20 nt, Homo sapiens
cugucaugcuucaucauucc

SEQ ID NO: 755122 - RNA, 18 nt, Homo sapiens
cugucauguuaauguggg

SEQ ID NO: 755123 - RNA, 19 nt, Homo sapiens
cugucauuaguauuucaca

SEQ ID NO: 755124 - RNA, 20 nt, Homo sapiens
cugucauuaguauuucacaa

SEQ ID NO: 755125 - RNA, 16 nt, Homo sapiens
cugucauuuugcacug

SEQ ID NO: 755126 - RNA, 20 nt, Homo sapiens
cugucauuuugcacuguaaa

SEQ ID NO: 755127 - RNA, 13 nt, Homo sapiens
cuguccaaaugga

SEQ ID NO: 755128 - RNA, 23 nt, Homo sapiens
cuguccacugggccauuguggug

SEQ ID NO: 755129 - RNA, 12 nt, Homo sapiens
cuguccagcucc

SEQ ID NO: 755130 - RNA, 18 nt, Homo sapiens
cuguccagcuuauagucu

SEQ ID NO: 755131 - RNA, 21 nt, Homo sapiens
cuguccaggccacuguggcca

SEQ ID NO: 755132 - RNA, 14 nt, Homo sapiens
cugucccacccaca

SEQ ID NO: 755133 - RNA, 22 nt, Homo sapiens
cugucccagagcuuauuggcca

SEQ ID NO: 755134 - RNA, 21 nt, Homo sapiens
cuguccccugaaaaacugauc

SEQ ID NO: 755135 - RNA, 16 nt, Homo sapiens
cuguccguucacaugu

SEQ ID NO: 755136 - RNA, 19 nt, Homo sapiens
cuguccuaaggaaccuucc

SEQ ID NO: 755137 - RNA, 12 nt, Homo sapiens
cuguccuaggcc

SEQ ID NO: 755138 - RNA, 18 nt, Homo sapiens
cuguccucccgagcuccu

SEQ ID NO: 755139 - RNA, 15 nt, Homo sapiens
cuguccucucagaac

SEQ ID NO: 755140 - RNA, 18 nt, Homo sapiens
cuguccucucagaacucc

SEQ ID NO: 755141 - RNA, 16 nt, Homo sapiens
cuguccucucauuugc

SEQ ID NO: 755142 - RNA, 11 nt, Homo sapiens
cuguccugcuc

SEQ ID NO: 755143 - RNA, 22 nt, Homo sapiens
cuguccuugaaaaacaaaguuu

SEQ ID NO: 755144 - RNA, 17 nt, Homo sapiens
cuguccuugcacacucc

SEQ ID NO: 755145 - RNA, 16 nt, Homo sapiens
cuguccuuucuugcag

SEQ ID NO: 755146 - RNA, 20 nt, Homo sapiens
cugucuacaguagcugcuac

SEQ ID NO: 755147 - RNA, 14 nt, Homo sapiens
cugucuacauuucu

SEQ ID NO: 755148 - RNA, 22 nt, Homo sapiens
cugucuauuaauauucagggua

SEQ ID NO: 755149 - RNA, 23 nt, Homo sapiens
cugucucagagauauacuggccc

SEQ ID NO: 755150 - RNA, 17 nt, Homo sapiens
cugucucuaaccauuca

SEQ ID NO: 755151 - RNA, 13 nt, Homo sapiens
cugucucugaggg

SEQ ID NO: 755152 - RNA, 19 nt, Homo sapiens
cugucugaaggacacuucc

SEQ ID NO: 755153 - RNA, 12 nt, Homo sapiens
cugucugcauuu

SEQ ID NO: 755154 - RNA, 16 nt, Homo sapiens
cugucuggcugaggau

SEQ ID NO: 755155 - RNA, 23 nt, Homo sapiens
cugucuuaaaugagaaguacuug

SEQ ID NO: 755156 - RNA, 16 nt, Homo sapiens
cugucuuaccauaaca

SEQ ID NO: 755157 - RNA, 13 nt, Homo sapiens
cugucuuccucaa

SEQ ID NO: 755158 - RNA, 16 nt, Homo sapiens
ccuaggaaaccagcuc

SEQ ID NO: 755159 - RNA, 21 nt, Homo sapiens
ccuaggaauucccagcccaaa

SEQ ID NO: 755160 - RNA, 16 nt, Homo sapiens
ccuaggagacuaggag

SEQ ID NO: 755161 - RNA, 18 nt, Homo sapiens
ccuaggagcaacaggcca

SEQ ID NO: 755162 - RNA, 22 nt, Homo sapiens
ccuaggcuaccucaagacucac

SEQ ID NO: 755163 - RNA, 23 nt, Homo sapiens
ccuagggaauggucccagcacga

SEQ ID NO: 755164 - RNA, 15 nt, Homo sapiens
ccuaguaauugccua

SEQ ID NO: 755165 - RNA, 15 nt, Homo sapiens
ccuaguaugccaaaa

SEQ ID NO: 755166 - RNA, 21 nt, Homo sapiens
ccuaguauuccuaaccuguca

SEQ ID NO: 755167 - RNA, 21 nt, Homo sapiens
ccuaguuaguguuuugccuca

SEQ ID NO: 755168 - RNA, 15 nt, Homo sapiens
ccuauacauccacag

SEQ ID NO: 755169 - RNA, 13 nt, Homo sapiens
ccuauacauuaua

SEQ ID NO: 755170 - RNA, 11 nt, Homo sapiens
ccuaucaccuc

SEQ ID NO: 755171 - RNA, 14 nt, Homo sapiens
ccuaucuccugaca

SEQ ID NO: 755172 - RNA, 20 nt, Homo sapiens
ccuaucugaccaaacuggau

SEQ ID NO: 755173 - RNA, 18 nt, Homo sapiens
ccuaucuuccuuccucuc

SEQ ID NO: 755174 - RNA, 22 nt, Homo sapiens
ccuaucuugauuucacuggaau

SEQ ID NO: 755175 - RNA, 16 nt, Homo sapiens
ccuaugacauuacugu

SEQ ID NO: 755176 - RNA, 17 nt, Homo sapiens
ccuaugacauuacugua

SEQ ID NO: 755177 - RNA, 18 nt, Homo sapiens
ccuaugacauuacuguau

SEQ ID NO: 755178 - RNA, 12 nt, Homo sapiens
ccuaugauccca

SEQ ID NO: 755179 - RNA, 14 nt, Homo sapiens
ccuaugcacauaug

SEQ ID NO: 755180 - RNA, 20 nt, Homo sapiens
ccuaugggucuaggacacag

SEQ ID NO: 755181 - RNA, 23 nt, Homo sapiens
ccuaugucaauuuguauaucaug

SEQ ID NO: 755182 - RNA, 20 nt, Homo sapiens
ccuauuagaguauuuuccac

SEQ ID NO: 755183 - RNA, 21 nt, Homo sapiens
ccuauucccucucucucccag

SEQ ID NO: 755184 - RNA, 17 nt, Homo sapiens
ccuauugggagagguca

SEQ ID NO: 755185 - RNA, 21 nt, Homo sapiens
ccucaaacuuccagucaggua

SEQ ID NO: 755186 - RNA, 17 nt, Homo sapiens
ccucaaagcacacguca

SEQ ID NO: 755187 - RNA, 17 nt, Homo sapiens
ccucaaauauaguauau

SEQ ID NO: 755188 - RNA, 21 nt, Homo sapiens
ccucaacauugcauggugcua

SEQ ID NO: 755189 - RNA, 19 nt, Homo sapiens
ccucaacccacaugggguu

SEQ ID NO: 755190 - RNA, 15 nt, Homo sapiens
ccucaagugauccac

SEQ ID NO: 755191 - RNA, 14 nt, Homo sapiens
ccucacaagcauga

SEQ ID NO: 755192 - RNA, 23 nt, Homo sapiens
ccucacagagugcauugugaggg

SEQ ID NO: 755193 - RNA, 18 nt, Homo sapiens
ccucacaggccccaggaa

SEQ ID NO: 755194 - RNA, 13 nt, Homo sapiens
ccucacagguguc

SEQ ID NO: 755195 - RNA, 17 nt, Homo sapiens
ccucacaucuuucacac

SEQ ID NO: 755196 - RNA, 23 nt, Homo sapiens
ccucacauuuggaugauugucau

SEQ ID NO: 755197 - RNA, 17 nt, Homo sapiens
ccucaccaaggugacac

SEQ ID NO: 755198 - RNA, 22 nt, Homo sapiens
ccucaccaauacacggacacaa

SEQ ID NO: 755199 - RNA, 20 nt, Homo sapiens
ccucacccccagcuuugcua

SEQ ID NO: 755200 - RNA, 22 nt, Homo sapiens
ccucaccucccgaagccaccau

SEQ ID NO: 755201 - RNA, 12 nt, Homo sapiens
ccucaccugcug

SEQ ID NO: 755202 - RNA, 12 nt, Homo sapiens
ccucaccugguc

SEQ ID NO: 755203 - RNA, 22 nt, Homo sapiens
ccucacuccuguuacuuaccua

SEQ ID NO: 755204 - RNA, 11 nt, Homo sapiens
ccucacugcag

SEQ ID NO: 755205 - RNA, 13 nt, Homo sapiens
ccucagaaacccu

SEQ ID NO: 755206 - RNA, 15 nt, Homo sapiens
ccucagaacuuucua

SEQ ID NO: 755207 - RNA, 19 nt, Homo sapiens
ccucagaagaaaacaaagu

SEQ ID NO: 755208 - RNA, 19 nt, Homo sapiens
ccucagaaggccccagaga

SEQ ID NO: 755209 - RNA, 20 nt, Homo sapiens
ccucagacuucaagaccauc

SEQ ID NO: 755210 - RNA, 21 nt, Homo sapiens
ccucagagggccauugaacuc

SEQ ID NO: 755211 - RNA, 19 nt, Homo sapiens
ccucagaguguggguccuu

SEQ ID NO: 755212 - RNA, 19 nt, Homo sapiens
cccugcuaaagaguguuca

SEQ ID NO: 755213 - RNA, 13 nt, Homo sapiens
cccugcuugcaca

SEQ ID NO: 755214 - RNA, 17 nt, Homo sapiens
cccugcuuugcaucuuu

SEQ ID NO: 755215 - RNA, 20 nt, Homo sapiens
cccuggaaaccuuccaccca

SEQ ID NO: 755216 - RNA, 14 nt, Homo sapiens
cccuggaaccggga

SEQ ID NO: 755217 - RNA, 20 nt, Homo sapiens
cccuggaucuaccagcauaa

SEQ ID NO: 755218 - RNA, 20 nt, Homo sapiens
cccuggauguggauuucaca

SEQ ID NO: 755219 - RNA, 19 nt, Homo sapiens
cccuggccuugaguagaaa

SEQ ID NO: 755220 - RNA, 15 nt, Homo sapiens
cccugggaagccugu

SEQ ID NO: 755221 - RNA, 19 nt, Homo sapiens
cccugggccccaccaccua

SEQ ID NO: 755222 - RNA, 21 nt, Homo sapiens
cccuggggagcuuuugcccac

SEQ ID NO: 755223 - RNA, 16 nt, Homo sapiens
cccuggggcugagucu

SEQ ID NO: 755224 - RNA, 22 nt, Homo sapiens
cccuggggcuucuccugaccca

SEQ ID NO: 755225 - RNA, 20 nt, Homo sapiens
cccugggguggccaccagua

SEQ ID NO: 755226 - RNA, 16 nt, Homo sapiens
cccugguccuucacug

SEQ ID NO: 755227 - RNA, 17 nt, Homo sapiens
cccugguccuucacugg

SEQ ID NO: 755228 - RNA, 16 nt, Homo sapiens
cccuggugucaggcag

SEQ ID NO: 755229 - RNA, 21 nt, Homo sapiens
cccuguaccacaaacacauua

SEQ ID NO: 755230 - RNA, 14 nt, Homo sapiens
cccuguauuaccuc

SEQ ID NO: 755231 - RNA, 13 nt, Homo sapiens
cccugucauccag

SEQ ID NO: 755232 - RNA, 19 nt, Homo sapiens
cccugucccuucgagucca

SEQ ID NO: 755233 - RNA, 16 nt, Homo sapiens
cccuguccuugcccuu

SEQ ID NO: 755234 - RNA, 14 nt, Homo sapiens
cccugucucaaaaa

SEQ ID NO: 755235 - RNA, 16 nt, Homo sapiens
cccugucucuuaaaaa

SEQ ID NO: 755236 - RNA, 17 nt, Homo sapiens
cccugucuuccacagcc

SEQ ID NO: 755237 - RNA, 19 nt, Homo sapiens
cccugugcuccgugccucc

SEQ ID NO: 755238 - RNA, 20 nt, Homo sapiens
cccuguggccaacugcaaaa

SEQ ID NO: 755239 - RNA, 18 nt, Homo sapiens
cccugugguccugaauuc

SEQ ID NO: 755240 - RNA, 23 nt, Homo sapiens
cccuguuuuaguuucugaacucu

SEQ ID NO: 755241 - RNA, 17 nt, Homo sapiens
cccuuaagagucaucca

SEQ ID NO: 755242 - RNA, 20 nt, Homo sapiens
cccuuaaggguugaaggcag

SEQ ID NO: 755243 - RNA, 18 nt, Homo sapiens
cccuuacuaugaucucag

SEQ ID NO: 755244 - RNA, 17 nt, Homo sapiens
cccuuagccucccugaa

SEQ ID NO: 755245 - RNA, 17 nt, Homo sapiens
cccuuauaauuggugca

SEQ ID NO: 755246 - RNA, 14 nt, Homo sapiens
cccuuauacagugg

SEQ ID NO: 755247 - RNA, 18 nt, Homo sapiens
cccuuauguguuguguau

SEQ ID NO: 755248 - RNA, 23 nt, Homo sapiens
cccuucaucuuccuguguccuga

SEQ ID NO: 755249 - RNA, 13 nt, Homo sapiens
cccuuccagauca

SEQ ID NO: 755250 - RNA, 16 nt, Homo sapiens
cccuucccaaucagca

SEQ ID NO: 755251 - RNA, 18 nt, Homo sapiens
cccuucccuguccuugcc

SEQ ID NO: 755252 - RNA, 20 nt, Homo sapiens
cccuuccuucuuugucuugc

SEQ ID NO: 755253 - RNA, 15 nt, Homo sapiens
cccuucugacuguuu

SEQ ID NO: 755254 - RNA, 17 nt, Homo sapiens
cccuugagcuacuucaa

SEQ ID NO: 755255 - RNA, 18 nt, Homo sapiens
cccuugcuuguugggauu

SEQ ID NO: 755256 - RNA, 22 nt, Homo sapiens
cccuuggaauaaaaacauuucu

SEQ ID NO: 755257 - RNA, 15 nt, Homo sapiens
cccuuggugacucug

SEQ ID NO: 755258 - RNA, 19 nt, Homo sapiens
cccuuggugagaaagggau

SEQ ID NO: 755259 - RNA, 17 nt, Homo sapiens
cccuuucagaugucuuc

SEQ ID NO: 755260 - RNA, 22 nt, Homo sapiens
cccuuucaguauguccccauaa

SEQ ID NO: 755261 - RNA, 19 nt, Homo sapiens
cccuuuccuacucucagga

SEQ ID NO: 755262 - RNA, 19 nt, Homo sapiens
cccuuugaugauuaauuca

SEQ ID NO: 755263 - RNA, 13 nt, Homo sapiens
cccuuuuacauac

SEQ ID NO: 755264 - RNA, 18 nt, Homo sapiens
cccuuuuacauacugcug

SEQ ID NO: 755265 - RNA, 23 nt, Homo sapiens
cccuuuugggccuagaauucuga

SEQ ID NO: 755266 - RNA, 22 nt, Homo sapiens
cccuuuuguauucucuuccuca

SEQ ID NO: 755267 - RNA, 18 nt, Homo sapiens
cccuuuuuuuacauuuca

SEQ ID NO: 755268 - RNA, 18 nt, Homo sapiens
ccgaaaaggauaugcagu

SEQ ID NO: 755269 - RNA, 14 nt, Homo sapiens
ccgaccacuuccag

SEQ ID NO: 755270 - RNA, 21 nt, Homo sapiens
aucaggcuauguauggaauac

SEQ ID NO: 755271 - RNA, 21 nt, Homo sapiens
aucagggaaaaggaguaggga

SEQ ID NO: 755272 - RNA, 17 nt, Homo sapiens
aucagggaggucauuuu

SEQ ID NO: 755273 - RNA, 22 nt, Homo sapiens
aucagguagacuuuuaauauca

SEQ ID NO: 755274 - RNA, 18 nt, Homo sapiens
aucaguaaauaacuggaa

SEQ ID NO: 755275 - RNA, 15 nt, Homo sapiens
aucaguauuuacaua

SEQ ID NO: 755276 - RNA, 15 nt, Homo sapiens
aucagucaacaacuu

SEQ ID NO: 755277 - RNA, 18 nt, Homo sapiens
aucagucuccaacauguu

SEQ ID NO: 755278 - RNA, 21 nt, Homo sapiens
aucagugaagccaaagggacu

SEQ ID NO: 755279 - RNA, 23 nt, Homo sapiens
aucagugacagaguucacuauaa

SEQ ID NO: 755280 - RNA, 16 nt, Homo sapiens
aucagugaggagggau

SEQ ID NO: 755281 - RNA, 13 nt, Homo sapiens
aucagugcaguga

SEQ ID NO: 755282 - RNA, 15 nt, Homo sapiens
aucagugcagugaua

SEQ ID NO: 755283 - RNA, 15 nt, Homo sapiens
aucaguguaugcgaa

SEQ ID NO: 755284 - RNA, 14 nt, Homo sapiens
aucaguuacucuga

SEQ ID NO: 755285 - RNA, 18 nt, Homo sapiens
aucaguuucucaaacuga

SEQ ID NO: 755286 - RNA, 12 nt, Homo sapiens
aucaguuugacu

SEQ ID NO: 755287 - RNA, 19 nt, Homo sapiens
aucauaaccaugugaaaag

SEQ ID NO: 755288 - RNA, 18 nt, Homo sapiens
aucauaacuauacuugau

SEQ ID NO: 755289 - RNA, 16 nt, Homo sapiens
aucauaagacaaugga

SEQ ID NO: 755290 - RNA, 17 nt, Homo sapiens
aucauaauucagcacuu

SEQ ID NO: 755291 - RNA, 18 nt, Homo sapiens
aucauaauucagcacuua

SEQ ID NO: 755292 - RNA, 22 nt, Homo sapiens
aucauaauucagcacuuaacua

SEQ ID NO: 755293 - RNA, 23 nt, Homo sapiens
aucauauaauaaauguacauuaa

SEQ ID NO: 755294 - RNA, 17 nt, Homo sapiens
aucauauucauaugcag

SEQ ID NO: 755295 - RNA, 20 nt, Homo sapiens
aucauauuccaacccagcca

SEQ ID NO: 755296 - RNA, 21 nt, Homo sapiens
aucaucaacaagauuuccuug

SEQ ID NO: 755297 - RNA, 12 nt, Homo sapiens
aucaucacugua

SEQ ID NO: 755298 - RNA, 23 nt, Homo sapiens
aucaucccuggauguggauuuca

SEQ ID NO: 755299 - RNA, 18 nt, Homo sapiens
aucaucuagggaguauga

SEQ ID NO: 755300 - RNA, 15 nt, Homo sapiens
aucaucuuuccuguu

SEQ ID NO: 755301 - RNA, 14 nt, Homo sapiens
aucaucuuuuagac

SEQ ID NO: 755302 - RNA, 14 nt, Homo sapiens
aucaugaagcacau

SEQ ID NO: 755303 - RNA, 21 nt, Homo sapiens
aucaugaagcacaucaauuac

SEQ ID NO: 755304 - RNA, 20 nt, Homo sapiens
aucaugauccuuguguucag

SEQ ID NO: 755305 - RNA, 23 nt, Homo sapiens
aucaugaugcuagccagcaaaga

SEQ ID NO: 755306 - RNA, 16 nt, Homo sapiens
aucaugccacugcacu

SEQ ID NO: 755307 - RNA, 20 nt, Homo sapiens
aucaugccacugcacuccag

SEQ ID NO: 755308 - RNA, 16 nt, Homo sapiens
aucauggcaacauaau

SEQ ID NO: 755309 - RNA, 16 nt, Homo sapiens
aucaugggcuggacau

SEQ ID NO: 755310 - RNA, 13 nt, Homo sapiens
aucauguaccuca

SEQ ID NO: 755311 - RNA, 19 nt, Homo sapiens
aucauguccauacacuuug

SEQ ID NO: 755312 - RNA, 20 nt, Homo sapiens
aucaugugggugagccagug

SEQ ID NO: 755313 - RNA, 19 nt, Homo sapiens
aucauguuaccauuacaaa

SEQ ID NO: 755314 - RNA, 19 nt, Homo sapiens
aucauuacugguaaagccu

SEQ ID NO: 755315 - RNA, 14 nt, Homo sapiens
aucauuacuuauga

SEQ ID NO: 755316 - RNA, 13 nt, Homo sapiens
aucauuagggcuu

SEQ ID NO: 755317 - RNA, 23 nt, Homo sapiens
aucauuauuuaagccguucuuau

SEQ ID NO: 755318 - RNA, 13 nt, Homo sapiens
aucauuccuugag

SEQ ID NO: 755319 - RNA, 19 nt, Homo sapiens
aucauugcaggagccauau

SEQ ID NO: 755320 - RNA, 21 nt, Homo sapiens
aucauugcaggagccauauga

SEQ ID NO: 755321 - RNA, 17 nt, Homo sapiens
aucauuucaagacuaga

SEQ ID NO: 755322 - RNA, 14 nt, Homo sapiens
aucauuugagcuca

SEQ ID NO: 755323 - RNA, 21 nt, Homo sapiens
aucauuuguuuacauuugaug

SEQ ID NO: 755324 - RNA, 11 nt, Homo sapiens
auccaaaaaga

SEQ ID NO: 755325 - RNA, 14 nt, Homo sapiens
auccaaaucugucc

SEQ ID NO: 755326 - RNA, 19 nt, Homo sapiens
auccaacacuggaugguca

SEQ ID NO: 755327 - RNA, 16 nt, Homo sapiens
auccaacuccaggaua

SEQ ID NO: 755328 - RNA, 12 nt, Homo sapiens
auccaacuuuca

SEQ ID NO: 755329 - RNA, 18 nt, Homo sapiens
auccaacuuucacaguga

SEQ ID NO: 755330 - RNA, 18 nt, Homo sapiens
auccaagaaucagugaag

SEQ ID NO: 755331 - RNA, 15 nt, Homo sapiens
auccaagauucugcu

SEQ ID NO: 755332 - RNA, 12 nt, Homo sapiens
auccacaaggac

SEQ ID NO: 755333 - RNA, 17 nt, Homo sapiens
auccacaaggaccucuu

SEQ ID NO: 755334 - RNA, 19 nt, Homo sapiens
auccaccaagaacauaaga

SEQ ID NO: 755335 - RNA, 19 nt, Homo sapiens
auccaccaccuugccaaug

SEQ ID NO: 755336 - RNA, 22 nt, Homo sapiens
auccacccaacccuaucuccug

SEQ ID NO: 755337 - RNA, 18 nt, Homo sapiens
auccacccaccuuggccu

SEQ ID NO: 755338 - RNA, 21 nt, Homo sapiens
auccagacucagagcucucuc

SEQ ID NO: 755339 - RNA, 15 nt, Homo sapiens
auccagaggaacaag

SEQ ID NO: 755340 - RNA, 15 nt, Homo sapiens
auccagccagacccc

SEQ ID NO: 755341 - RNA, 13 nt, Homo sapiens
auccagccuccag

SEQ ID NO: 755342 - RNA, 16 nt, Homo sapiens
auccagccuccagggc

SEQ ID NO: 755343 - RNA, 19 nt, Homo sapiens
auccagccucccacaagaa

SEQ ID NO: 755344 - RNA, 19 nt, Homo sapiens
auccagccuuuccaaguca

SEQ ID NO: 755345 - RNA, 22 nt, Homo sapiens
auccagcucuugcucagugaag

SEQ ID NO: 755346 - RNA, 23 nt, Homo sapiens
auccaggccagggcuccuguggc

SEQ ID NO: 755347 - RNA, 14 nt, Homo sapiens
auccaggcuuugua

SEQ ID NO: 755348 - RNA, 16 nt, Homo sapiens
auccaggcuuuguaca

SEQ ID NO: 755349 - RNA, 23 nt, Homo sapiens
auccagggaaugaugacaacaau

SEQ ID NO: 755350 - RNA, 12 nt, Homo sapiens
auccagugacaa

SEQ ID NO: 755351 - RNA, 14 nt, Homo sapiens
auccauaaagacaa

SEQ ID NO: 755352 - RNA, 16 nt, Homo sapiens
auccauaaauguguuc

SEQ ID NO: 755353 - RNA, 18 nt, Homo sapiens
auccauaaauguguuccu

SEQ ID NO: 755354 - RNA, 20 nt, Homo sapiens
auccauacaaaacuaucggu

SEQ ID NO: 755355 - RNA, 22 nt, Homo sapiens
auccauaggcgcaggugcacag

SEQ ID NO: 755356 - RNA, 16 nt, Homo sapiens
auccauauuuuacuga

SEQ ID NO: 755357 - RNA, 18 nt, Homo sapiens
auccaucuugagccacag

SEQ ID NO: 755358 - RNA, 14 nt, Homo sapiens
auccaugagcugcu

SEQ ID NO: 755359 - RNA, 19 nt, Homo sapiens
auccaugagggacuccucc

SEQ ID NO: 755360 - RNA, 19 nt, Homo sapiens
auccaugcaccuaccuuag

SEQ ID NO: 755361 - RNA, 15 nt, Homo sapiens
auccaugcugugcug

SEQ ID NO: 755362 - RNA, 21 nt, Homo sapiens
auccauguuaguuuuuacuuu

SEQ ID NO: 755363 - RNA, 14 nt, Homo sapiens
auccauuaccucca

SEQ ID NO: 755364 - RNA, 15 nt, Homo sapiens
auccauuaccuccau

SEQ ID NO: 755365 - RNA, 23 nt, Homo sapiens
auccauuccucagggacagagac

SEQ ID NO: 755366 - RNA, 14 nt, Homo sapiens
auccauuuuacaca

SEQ ID NO: 755367 - RNA, 21 nt, Homo sapiens
aucccaaagcaaggagaucau

SEQ ID NO: 755368 - RNA, 13 nt, Homo sapiens
aucccaacuuccu

SEQ ID NO: 755369 - RNA, 12 nt, Homo sapiens
aucccaagagaa

SEQ ID NO: 755370 - RNA, 19 nt, Homo sapiens
aucccaaucaaagaauuac

SEQ ID NO: 755371 - RNA, 15 nt, Homo sapiens
aucccagcacuuugg

SEQ ID NO: 755372 - RNA, 22 nt, Homo sapiens
aucccagcuacucagguggcua

SEQ ID NO: 755373 - RNA, 20 nt, Homo sapiens
aucccaggggcuuaucucuu

SEQ ID NO: 755374 - RNA, 13 nt, Homo sapiens
aucccauggaaua

SEQ ID NO: 755375 - RNA, 13 nt, Homo sapiens
aucccaugucacc

SEQ ID NO: 755376 - RNA, 23 nt, Homo sapiens
auccccaacuaugcaugccaagg

SEQ ID NO: 755377 - RNA, 14 nt, Homo sapiens
auccccacccaguc

SEQ ID NO: 755378 - RNA, 15 nt, Homo sapiens
aucccccagccucaa

SEQ ID NO: 755379 - RNA, 17 nt, Homo sapiens
auccccuuuguguagaa

SEQ ID NO: 755380 - RNA, 15 nt, Homo sapiens
aucccgauaccucag

SEQ ID NO: 755381 - RNA, 19 nt, Homo sapiens
aucccuacaucuaacucau

SEQ ID NO: 755382 - RNA, 22 nt, Homo sapiens
aucccuccauucauccuuccau

SEQ ID NO: 755383 - RNA, 14 nt, Homo sapiens
aucccucuaaugag

SEQ ID NO: 755384 - RNA, 18 nt, Homo sapiens
aucccugucauuuuuaac

SEQ ID NO: 755385 - RNA, 16 nt, Homo sapiens
aucccuuaagaaugag

SEQ ID NO: 755386 - RNA, 20 nt, Homo sapiens
aucccuuccucucaggcucu

SEQ ID NO: 755387 - RNA, 15 nt, Homo sapiens
aucccuuccuggaaa

SEQ ID NO: 755388 - RNA, 12 nt, Homo sapiens
aucccuuuccag

SEQ ID NO: 755389 - RNA, 21 nt, Homo sapiens
aucccuuugcagucaguucau

SEQ ID NO: 755390 - RNA, 13 nt, Homo sapiens
auccgaaacggca

SEQ ID NO: 755391 - RNA, 22 nt, Homo sapiens
auccgaggcagggucaggagag

SEQ ID NO: 755392 - RNA, 14 nt, Homo sapiens
auccgccugccucu

SEQ ID NO: 755393 - RNA, 16 nt, Homo sapiens
auccgcgugugccugu

SEQ ID NO: 755394 - RNA, 15 nt, Homo sapiens
auccgucagaucucu

SEQ ID NO: 755395 - RNA, 20 nt, Homo sapiens
auccuaccccuuugcacuug

SEQ ID NO: 755396 - RNA, 19 nt, Homo sapiens
auccuacccuuuucugggg

SEQ ID NO: 755397 - RNA, 19 nt, Homo sapiens
auccuagaucaccacugga

SEQ ID NO: 755398 - RNA, 23 nt, Homo sapiens
auccuagucacuaccuucaugca

SEQ ID NO: 755399 - RNA, 19 nt, Homo sapiens
auccuauuaaaacacagcu

SEQ ID NO: 755400 - RNA, 11 nt, Homo sapiens
auccuauuuau

SEQ ID NO: 755401 - RNA, 15 nt, Homo sapiens
auccuauuuaucaga

SEQ ID NO: 755402 - RNA, 18 nt, Homo sapiens
auccucacccagcaccca

SEQ ID NO: 755403 - RNA, 18 nt, Homo sapiens
auccuccaagaauuugac

SEQ ID NO: 755404 - RNA, 12 nt, Homo sapiens
auccuccauugc

SEQ ID NO: 755405 - RNA, 15 nt, Homo sapiens
auccuccauugcucc

SEQ ID NO: 755406 - RNA, 17 nt, Homo sapiens
auccucccuacuuccaa

SEQ ID NO: 755407 - RNA, 22 nt, Homo sapiens
auccucugagugugaccaggca

SEQ ID NO: 755408 - RNA, 23 nt, Homo sapiens
auccugauuauugaauguuauau

SEQ ID NO: 755409 - RNA, 13 nt, Homo sapiens
auccugauuccaa

SEQ ID NO: 755410 - RNA, 12 nt, Homo sapiens
auccugccaacu

SEQ ID NO: 755411 - RNA, 18 nt, Homo sapiens
auccugcuagcuguagaa

SEQ ID NO: 755412 - RNA, 23 nt, Homo sapiens
auccuggaaaauucuauggaaua

SEQ ID NO: 755413 - RNA, 18 nt, Homo sapiens
auccuggcuaacacguga

SEQ ID NO: 755414 - RNA, 18 nt, Homo sapiens
auccuguguuaucugugg

SEQ ID NO: 755415 - RNA, 22 nt, Homo sapiens
auccuguuacuugcuucagugg

SEQ ID NO: 755416 - RNA, 23 nt, Homo sapiens
auccuuacagcuaucuguagaau

SEQ ID NO: 755417 - RNA, 16 nt, Homo sapiens
auccuuaugcaugaaa

SEQ ID NO: 755418 - RNA, 20 nt, Homo sapiens
auccuucacaggcagugcau

SEQ ID NO: 755419 - RNA, 16 nt, Homo sapiens
auccuuccacuaucau

SEQ ID NO: 755420 - RNA, 18 nt, Homo sapiens
auccuuccuaaacccaau

SEQ ID NO: 755421 - RNA, 13 nt, Homo sapiens
auccuucuacuug

SEQ ID NO: 755422 - RNA, 18 nt, Homo sapiens
auccuucuaguuucccac

SEQ ID NO: 755423 - RNA, 23 nt, Homo sapiens
auccuugucuuuugagcuauuca

SEQ ID NO: 755424 - RNA, 20 nt, Homo sapiens
auccuuuagguaagaaguuu

SEQ ID NO: 755425 - RNA, 19 nt, Homo sapiens
auccuuucaagacagaaag

SEQ ID NO: 755426 - RNA, 19 nt, Homo sapiens
auccuuugcuucauuccaa

SEQ ID NO: 755427 - RNA, 13 nt, Homo sapiens
aucgaacuucaca

SEQ ID NO: 755428 - RNA, 12 nt, Homo sapiens
aucgaugugcuc

SEQ ID NO: 755429 - RNA, 23 nt, Homo sapiens
aucgccguguuacuguugcacug

SEQ ID NO: 755430 - RNA, 18 nt, Homo sapiens
aucgcucauagaucagca

SEQ ID NO: 755431 - RNA, 21 nt, Homo sapiens
aucgcuggaaaugaauagcca

SEQ ID NO: 755432 - RNA, 16 nt, Homo sapiens
aucggaagcagugccu

SEQ ID NO: 755433 - RNA, 22 nt, Homo sapiens
aucguccagcgaccuuccucau

SEQ ID NO: 755434 - RNA, 19 nt, Homo sapiens
aucgugaugggccccucag

SEQ ID NO: 755435 - RNA, 17 nt, Homo sapiens
aucguucucugccucac

SEQ ID NO: 755436 - RNA, 22 nt, Homo sapiens
aucguuuuggggggaaugcucc

SEQ ID NO: 755437 - RNA, 14 nt, Homo sapiens
aucuaaaaauaacu

SEQ ID NO: 755438 - RNA, 17 nt, Homo sapiens
aucuaagaaaaggggag

SEQ ID NO: 755439 - RNA, 15 nt, Homo sapiens
aucuaagcagcuuau

SEQ ID NO: 755440 - RNA, 16 nt, Homo sapiens
aucuaagcaguggcau

SEQ ID NO: 755441 - RNA, 16 nt, Homo sapiens
aucuaauaaacuuuau

SEQ ID NO: 755442 - RNA, 17 nt, Homo sapiens
aucuaauaauuauucau

SEQ ID NO: 755443 - RNA, 16 nt, Homo sapiens
aucuaaugugaaguag

SEQ ID NO: 755444 - RNA, 16 nt, Homo sapiens
aucuacaccaaugaaa

SEQ ID NO: 755445 - RNA, 23 nt, Homo sapiens
aucuacaccaaugaaaacaugua

SEQ ID NO: 755446 - RNA, 14 nt, Homo sapiens
aucuacagaacugg

SEQ ID NO: 755447 - RNA, 12 nt, Homo sapiens
aucuacaguacu

SEQ ID NO: 755448 - RNA, 19 nt, Homo sapiens
aucuacauaaggaugaagg

SEQ ID NO: 755449 - RNA, 12 nt, Homo sapiens
aucuacauuugu

SEQ ID NO: 755450 - RNA, 18 nt, Homo sapiens
aucuaccacuguaugagu

SEQ ID NO: 755451 - RNA, 20 nt, Homo sapiens
aucuagccagagcccuucac

SEQ ID NO: 755452 - RNA, 15 nt, Homo sapiens
aucuaggaugugaug

SEQ ID NO: 755453 - RNA, 20 nt, Homo sapiens
aucuagguguggcugugaag

SEQ ID NO: 755454 - RNA, 13 nt, Homo sapiens
aucuaguuuacag

SEQ ID NO: 755455 - RNA, 19 nt, Homo sapiens
aucuauaauuuaccuaaga

SEQ ID NO: 755456 - RNA, 16 nt, Homo sapiens
aucuauagaacaucca

SEQ ID NO: 755457 - RNA, 15 nt, Homo sapiens
aucuaucaacuauaa

SEQ ID NO: 755458 - RNA, 10 nt, Homo sapiens
aucuauccaa

SEQ ID NO: 755459 - RNA, 14 nt, Homo sapiens
aucuauuaucucaa

SEQ ID NO: 755460 - RNA, 13 nt, Homo sapiens
aucuauuauuaca

SEQ ID NO: 755461 - RNA, 23 nt, Homo sapiens
aucuauugcagagacucauuuca

SEQ ID NO: 755462 - RNA, 15 nt, Homo sapiens
aucuauuuguacaau

SEQ ID NO: 755463 - RNA, 16 nt, Homo sapiens
aucuauuuguacaauu

SEQ ID NO: 755464 - RNA, 17 nt, Homo sapiens
aucucaaaucacaagga

SEQ ID NO: 755465 - RNA, 22 nt, Homo sapiens
aucucaaguauaugucauuuac

SEQ ID NO: 755466 - RNA, 14 nt, Homo sapiens
aucucaauuugcag

SEQ ID NO: 755467 - RNA, 16 nt, Homo sapiens
aucucagaaaauauua

SEQ ID NO: 755468 - RNA, 13 nt, Homo sapiens
aucucagcucacu

SEQ ID NO: 755469 - RNA, 13 nt, Homo sapiens
aucucagcuuuga

SEQ ID NO: 755470 - RNA, 20 nt, Homo sapiens
aucucaggagcuugcaagaa

SEQ ID NO: 755471 - RNA, 15 nt, Homo sapiens
aucucaggugccacu

SEQ ID NO: 755472 - RNA, 19 nt, Homo sapiens
aucucagguugucuaagug

SEQ ID NO: 755473 - RNA, 18 nt, Homo sapiens
aucucccagugacaacau

SEQ ID NO: 755474 - RNA, 22 nt, Homo sapiens
aucucccuuggucuuccauggg

SEQ ID NO: 755475 - RNA, 13 nt, Homo sapiens
aucuccgccucca

SEQ ID NO: 755476 - RNA, 23 nt, Homo sapiens
aucuccuaacaaaagaacuaaga

SEQ ID NO: 755477 - RNA, 15 nt, Homo sapiens
aucuccucuguaaug

SEQ ID NO: 755478 - RNA, 17 nt, Homo sapiens
aucuccugcgcccuuca

SEQ ID NO: 755479 - RNA, 15 nt, Homo sapiens
aucuccugcugccuu

SEQ ID NO: 755480 - RNA, 19 nt, Homo sapiens
aucuccugugcauggguga

SEQ ID NO: 755481 - RNA, 22 nt, Homo sapiens
aucucggcucacugaaaccucu

SEQ ID NO: 755482 - RNA, 20 nt, Homo sapiens
aucucggcucacugcaagcu

SEQ ID NO: 755483 - RNA, 19 nt, Homo sapiens
aucucggcuguuccugaga

SEQ ID NO: 755484 - RNA, 17 nt, Homo sapiens
aucucggcuuauggcaa

SEQ ID NO: 755485 - RNA, 19 nt, Homo sapiens
aucucuaaaauucuagucu

SEQ ID NO: 755486 - RNA, 16 nt, Homo sapiens
aucucuacuaccacaa

SEQ ID NO: 755487 - RNA, 17 nt, Homo sapiens
aucucuccagagcccuu

SEQ ID NO: 755488 - RNA, 16 nt, Homo sapiens
aucucucuacugcugg

SEQ ID NO: 755489 - RNA, 15 nt, Homo sapiens
aucucugaggcaugg

SEQ ID NO: 755490 - RNA, 18 nt, Homo sapiens
aucucugauuaaauuuaa

SEQ ID NO: 755491 - RNA, 19 nt, Homo sapiens
aucucugugguuacaagaa

SEQ ID NO: 755492 - RNA, 21 nt, Homo sapiens
aucucuuaaaaaaugaauuug

SEQ ID NO: 755493 - RNA, 16 nt, Homo sapiens
aucucuuauuuuacaa

SEQ ID NO: 755494 - RNA, 15 nt, Homo sapiens
aucucuucacuaccc

SEQ ID NO: 755495 - RNA, 13 nt, Homo sapiens
aucucuucagucu

SEQ ID NO: 755496 - RNA, 17 nt, Homo sapiens
aucucuucagucucuau

SEQ ID NO: 755497 - RNA, 16 nt, Homo sapiens
aucucuuccuacccaa

SEQ ID NO: 755498 - RNA, 22 nt, Homo sapiens
aucucuuguuuacgauuucacu

SEQ ID NO: 755499 - RNA, 22 nt, Homo sapiens
aucucuuuuggucccauccucu

SEQ ID NO: 755500 - RNA, 18 nt, Homo sapiens
aucugaagaaacuuccca

SEQ ID NO: 755501 - RNA, 19 nt, Homo sapiens
aucugaagcuuuaccaggu

SEQ ID NO: 755502 - RNA, 14 nt, Homo sapiens
aucugaaugcugau

SEQ ID NO: 755503 - RNA, 13 nt, Homo sapiens
aucugacaaaaug

SEQ ID NO: 755504 - RNA, 14 nt, Homo sapiens
aucugacuaugaca

SEQ ID NO: 755505 - RNA, 19 nt, Homo sapiens
aucugagaaaaaaagugag

SEQ ID NO: 755506 - RNA, 14 nt, Homo sapiens
aucugagaaacucu

SEQ ID NO: 755507 - RNA, 19 nt, Homo sapiens
aucugagagaugacaggga

SEQ ID NO: 755508 - RNA, 17 nt, Homo sapiens
aucugaggaauggacau

SEQ ID NO: 755509 - RNA, 20 nt, Homo sapiens
aucugagggagacugcaaau

SEQ ID NO: 755510 - RNA, 23 nt, Homo sapiens
aucugaucgggggcguagcauca

SEQ ID NO: 755511 - RNA, 15 nt, Homo sapiens
aucugauguuucaua

SEQ ID NO: 755512 - RNA, 20 nt, Homo sapiens
aucugauguuucauauuuaa

SEQ ID NO: 755513 - RNA, 15 nt, Homo sapiens
aucugccaucugcuu

SEQ ID NO: 755514 - RNA, 20 nt, Homo sapiens
aucugccccaguagucagaa

SEQ ID NO: 755515 - RNA, 17 nt, Homo sapiens
aucugccuuaaaaccaa

SEQ ID NO: 755516 - RNA, 22 nt, Homo sapiens
aucugcuggauauuuaguucaa

SEQ ID NO: 755517 - RNA, 16 nt, Homo sapiens
aucugcugguaccuau

SEQ ID NO: 755518 - RNA, 17 nt, Homo sapiens
aucugcuguugccagug

SEQ ID NO: 755519 - RNA, 20 nt, Homo sapiens
aucugcuucauccaauguga

SEQ ID NO: 755520 - RNA, 18 nt, Homo sapiens
aucuggaacccagacuca

SEQ ID NO: 755521 - RNA, 15 nt, Homo sapiens
aucuggaaccucagc

SEQ ID NO: 755522 - RNA, 23 nt, Homo sapiens
aucuggaagccaccucaccaagg

SEQ ID NO: 755523 - RNA, 23 nt, Homo sapiens
aucuggauucuacaaaaaaccag

SEQ ID NO: 755524 - RNA, 15 nt, Homo sapiens
aucuggcacacuccc

SEQ ID NO: 755525 - RNA, 22 nt, Homo sapiens
aucuggcccaggaauuagagaa

SEQ ID NO: 755526 - RNA, 18 nt, Homo sapiens
aucuggcuuagugccacc

SEQ ID NO: 755527 - RNA, 9 nt, Homo sapiens
aucugggca

SEQ ID NO: 755528 - RNA, 18 nt, Homo sapiens
aucugggcugugggcaag

SEQ ID NO: 755529 - RNA, 22 nt, Homo sapiens
aucuggguaagaagaaagcaaa

SEQ ID NO: 755530 - RNA, 18 nt, Homo sapiens
aucugggucuuaguucug

SEQ ID NO: 755531 - RNA, 17 nt, Homo sapiens
aucugggugacugagca

SEQ ID NO: 755532 - RNA, 22 nt, Homo sapiens
aucugguauauguaaguguuca

SEQ ID NO: 755533 - RNA, 15 nt, Homo sapiens
aucuguaccaugacc

SEQ ID NO: 755534 - RNA, 23 nt, Homo sapiens
aucuguauauacaauaacauaau

SEQ ID NO: 755535 - RNA, 15 nt, Homo sapiens
aucuguucaauguuu

SEQ ID NO: 755536 - RNA, 14 nt, Homo sapiens
aucuguucaguguu

SEQ ID NO: 755537 - RNA, 15 nt, Homo sapiens
aucuguucuugcuac

SEQ ID NO: 755538 - RNA, 16 nt, Homo sapiens
aucuguuuucuaccuc

SEQ ID NO: 755539 - RNA, 18 nt, Homo sapiens
aucuguuuucuaccuccu

SEQ ID NO: 755540 - RNA, 14 nt, Homo sapiens
aucuuaaaugagac

SEQ ID NO: 755541 - RNA, 20 nt, Homo sapiens
aucuuaaaugagaccaaagu

SEQ ID NO: 755542 - RNA, 23 nt, Homo sapiens
aucuuaauucccaucucuauacu

SEQ ID NO: 755543 - RNA, 14 nt, Homo sapiens
aucuuagugccuga

SEQ ID NO: 755544 - RNA, 15 nt, Homo sapiens
aucuuauaguucuag

SEQ ID NO: 755545 - RNA, 15 nt, Homo sapiens
aucuuauuuucucaa

SEQ ID NO: 755546 - RNA, 15 nt, Homo sapiens
aucuucaaacuuuca

SEQ ID NO: 755547 - RNA, 18 nt, Homo sapiens
aucuucaaacuuucacuu

SEQ ID NO: 755548 - RNA, 19 nt, Homo sapiens
aucuucaaagcuugaagau

SEQ ID NO: 755549 - RNA, 13 nt, Homo sapiens
aucuucaacagac

SEQ ID NO: 755550 - RNA, 18 nt, Homo sapiens
aucuucacugucugacuu

SEQ ID NO: 755551 - RNA, 12 nt, Homo sapiens
aucuucauagau

SEQ ID NO: 755552 - RNA, 21 nt, Homo sapiens
aucuuccaaggguacuaagga

SEQ ID NO: 755553 - RNA, 22 nt, Homo sapiens
aucuucccuuuauuacaagaag

SEQ ID NO: 755554 - RNA, 20 nt, Homo sapiens
aucuuccucucgcagcuuga

SEQ ID NO: 755555 - RNA, 12 nt, Homo sapiens
aucuuccuuccu

SEQ ID NO: 755556 - RNA, 14 nt, Homo sapiens
aucuucuacuguau

SEQ ID NO: 755557 - RNA, 18 nt, Homo sapiens
aucuucucuuugacaauu

SEQ ID NO: 755558 - RNA, 17 nt, Homo sapiens
aucuucuuuggggcccu

SEQ ID NO: 755559 - RNA, 16 nt, Homo sapiens
aucuugaauccuucca

SEQ ID NO: 755560 - RNA, 22 nt, Homo sapiens
aucuugagccacagucacugga

SEQ ID NO: 755561 - RNA, 17 nt, Homo sapiens
aucuugauuucacugga

SEQ ID NO: 755562 - RNA, 18 nt, Homo sapiens
aucuugcaacucuguaaa

SEQ ID NO: 755563 - RNA, 24 nt, Homo sapiens
aucuugccugucuggcucaggguc

SEQ ID NO: 755564 - RNA, 18 nt, Homo sapiens
aucuuggacaaaucacau

SEQ ID NO: 755565 - RNA, 14 nt, Homo sapiens
aucuuggacugaca

SEQ ID NO: 755566 - RNA, 18 nt, Homo sapiens
aucuuggagaaugugaga

SEQ ID NO: 755567 - RNA, 18 nt, Homo sapiens
aucuuggauggugacauu

SEQ ID NO: 755568 - RNA, 16 nt, Homo sapiens
aucuuggggcugauga

SEQ ID NO: 755569 - RNA, 13 nt, Homo sapiens
aucuugugcucag

SEQ ID NO: 755570 - RNA, 22 nt, Homo sapiens
aucuugugguaacuugcugcuu

SEQ ID NO: 755571 - RNA, 14 nt, Homo sapiens
aucuuguuaauguc

SEQ ID NO: 755572 - RNA, 17 nt, Homo sapiens
aucuuguuacugugaua

SEQ ID NO: 755573 - RNA, 15 nt, Homo sapiens
aucuuuaacaaccuc

SEQ ID NO: 755574 - RNA, 17 nt, Homo sapiens
aucuuuaacaaccucug

SEQ ID NO: 755575 - RNA, 23 nt, Homo sapiens
aucuuuaggagacuaauggaaau

SEQ ID NO: 755576 - RNA, 20 nt, Homo sapiens
aucuuuaucaugaagcacau

SEQ ID NO: 755577 - RNA, 16 nt, Homo sapiens
aucuuucuaaaacugc

SEQ ID NO: 755578 - RNA, 18 nt, Homo sapiens
aucuuucuuuaccugaga

SEQ ID NO: 755579 - RNA, 23 nt, Homo sapiens
aucuuucuuuccaaaacauuucu

SEQ ID NO: 755580 - RNA, 18 nt, Homo sapiens
aucuuugccuuuaucucu

SEQ ID NO: 755581 - RNA, 12 nt, Homo sapiens
aucuuugcuacu

SEQ ID NO: 755582 - RNA, 20 nt, Homo sapiens
aucuuugcucccugcaagaa

SEQ ID NO: 755583 - RNA, 21 nt, Homo sapiens
aucuuugcuguauacuuuuaa

SEQ ID NO: 755584 - RNA, 20 nt, Homo sapiens
aucuuuuccagaguaugcaa

SEQ ID NO: 755585 - RNA, 18 nt, Homo sapiens
aucuuuugcuaaugcaau

SEQ ID NO: 755586 - RNA, 19 nt, Homo sapiens
aucuuuuucuauauucuca

SEQ ID NO: 755587 - RNA, 20 nt, Homo sapiens
augaaaaaaaugcauuuuau

SEQ ID NO: 755588 - RNA, 20 nt, Homo sapiens
augaaaaagacaagauuuau

SEQ ID NO: 755589 - RNA, 23 nt, Homo sapiens
augaaaaauguguuccauugcca

SEQ ID NO: 755590 - RNA, 22 nt, Homo sapiens
augaaaacauagcaucucagga

SEQ ID NO: 755591 - RNA, 13 nt, Homo sapiens
augaaaacuguaa

SEQ ID NO: 755592 - RNA, 21 nt, Homo sapiens
augaaaagcugaauccagauc

SEQ ID NO: 755593 - RNA, 21 nt, Homo sapiens
augaaaauuuauuuuuaguga

SEQ ID NO: 755594 - RNA, 17 nt, Homo sapiens
augaaacaaauaaucac

SEQ ID NO: 755595 - RNA, 15 nt, Homo sapiens
augaaacaauuugag

SEQ ID NO: 755596 - RNA, 19 nt, Homo sapiens
augaaacuauuuuaccuga

SEQ ID NO: 755597 - RNA, 22 nt, Homo sapiens
augaaacuccugauuuuguagu

SEQ ID NO: 755598 - RNA, 16 nt, Homo sapiens
augaaaguggacaagg

SEQ ID NO: 755599 - RNA, 14 nt, Homo sapiens
augaaaguuuugca

SEQ ID NO: 755600 - RNA, 19 nt, Homo sapiens
augaaauaaugcacugagu

SEQ ID NO: 755601 - RNA, 16 nt, Homo sapiens
augaaaucagcaagag

SEQ ID NO: 755602 - RNA, 13 nt, Homo sapiens
augaaauccagug

SEQ ID NO: 755603 - RNA, 15 nt, Homo sapiens
augaaauccagugag

SEQ ID NO: 755604 - RNA, 21 nt, Homo sapiens
augaaauccagugagcacuag

SEQ ID NO: 755605 - RNA, 15 nt, Homo sapiens
augaaaucuugcaau

SEQ ID NO: 755606 - RNA, 16 nt, Homo sapiens
augaaauuauauaagu

SEQ ID NO: 755607 - RNA, 21 nt, Homo sapiens
augaaauucaagccuaaagac

SEQ ID NO: 755608 - RNA, 22 nt, Homo sapiens
augaaauucuuauguugaauau

SEQ ID NO: 755609 - RNA, 11 nt, Homo sapiens
augaacacaga

SEQ ID NO: 755610 - RNA, 16 nt, Homo sapiens
augaacacuacagaua

SEQ ID NO: 755611 - RNA, 13 nt, Homo sapiens
augaacacuuuuu

SEQ ID NO: 755612 - RNA, 18 nt, Homo sapiens
augaacaugugaaguuau

SEQ ID NO: 755613 - RNA, 22 nt, Homo sapiens
augaacuaacugacagcuucau

SEQ ID NO: 755614 - RNA, 13 nt, Homo sapiens
augaacucauguc

SEQ ID NO: 755615 - RNA, 16 nt, Homo sapiens
augaacucuuaaucaa

SEQ ID NO: 755616 - RNA, 22 nt, Homo sapiens
augaagaacacagcaugugcca

SEQ ID NO: 755617 - RNA, 15 nt, Homo sapiens
augaagaagacaccu

SEQ ID NO: 755618 - RNA, 16 nt, Homo sapiens
augaagacaucaggaa

SEQ ID NO: 755619 - RNA, 21 nt, Homo sapiens
augaagacccccuccaaagag

SEQ ID NO: 755620 - RNA, 23 nt, Homo sapiens
augaagcagcuuuaaacaaauuc

SEQ ID NO: 755621 - RNA, 13 nt, Homo sapiens
augaagcaugcua

SEQ ID NO: 755622 - RNA, 20 nt, Homo sapiens
augaagccaagugggauuug

SEQ ID NO: 755623 - RNA, 12 nt, Homo sapiens
augaagccagcu

SEQ ID NO: 755624 - RNA, 23 nt, Homo sapiens
augaagcguugccauugaacuca

SEQ ID NO: 755625 - RNA, 20 nt, Homo sapiens
augaagcuaccucaaacuuc

SEQ ID NO: 755626 - RNA, 23 nt, Homo sapiens
augaagcugcucugaaaucuccu

SEQ ID NO: 755627 - RNA, 13 nt, Homo sapiens
augaagugcacag

SEQ ID NO: 755628 - RNA, 23 nt, Homo sapiens
augaagugcuuuguaucaggaaa

SEQ ID NO: 755629 - RNA, 16 nt, Homo sapiens
augaauaaaguguaag

SEQ ID NO: 755630 - RNA, 13 nt, Homo sapiens
augaauacugaau

SEQ ID NO: 755631 - RNA, 20 nt, Homo sapiens
augaauagaugugaucacug

SEQ ID NO: 755632 - RNA, 13 nt, Homo sapiens
augaauagccagg

SEQ ID NO: 755633 - RNA, 17 nt, Homo sapiens
augaauaggaugauucc

SEQ ID NO: 755634 - RNA, 20 nt, Homo sapiens
augaaucauauucauaugca

SEQ ID NO: 755635 - RNA, 15 nt, Homo sapiens
augaaucaucaaagc

SEQ ID NO: 755636 - RNA, 22 nt, Homo sapiens
augaaucucaagauucaguaga

SEQ ID NO: 755637 - RNA, 21 nt, Homo sapiens
augaaugaacaaaccugugau

SEQ ID NO: 755638 - RNA, 12 nt, Homo sapiens
augaaugcacac

SEQ ID NO: 755639 - RNA, 23 nt, Homo sapiens
augaauguuuacacucuuuguaa

SEQ ID NO: 755640 - RNA, 16 nt, Homo sapiens
augaauuaguucuccu

SEQ ID NO: 755641 - RNA, 16 nt, Homo sapiens
augacaaaggcacuga

SEQ ID NO: 755642 - RNA, 21 nt, Homo sapiens
augacaagaugggacagcaac

SEQ ID NO: 755643 - RNA, 13 nt, Homo sapiens
augacagccagag

SEQ ID NO: 755644 - RNA, 18 nt, Homo sapiens
augacagcugucccuguc

SEQ ID NO: 755645 - RNA, 12 nt, Homo sapiens
augacagucaca

SEQ ID NO: 755646 - RNA, 11 nt, Homo sapiens
augacagugaa

SEQ ID NO: 755647 - RNA, 12 nt, Homo sapiens
augacagugcua

SEQ ID NO: 755648 - RNA, 22 nt, Homo sapiens
augacauaaaaacaacuuuaua

SEQ ID NO: 755649 - RNA, 21 nt, Homo sapiens
augacauaaaauuuacauuua

SEQ ID NO: 755650 - RNA, 14 nt, Homo sapiens
augacaucuucaaa

SEQ ID NO: 755651 - RNA, 15 nt, Homo sapiens
augacauuacuguau

SEQ ID NO: 755652 - RNA, 23 nt, Homo sapiens
augacauuuuuuuuaacuacuau

SEQ ID NO: 755653 - RNA, 17 nt, Homo sapiens
augaccauuugacuguu

SEQ ID NO: 755654 - RNA, 19 nt, Homo sapiens
augacccaccccugugcuc

SEQ ID NO: 755655 - RNA, 13 nt, Homo sapiens
augaccuggaaau

SEQ ID NO: 755656 - RNA, 20 nt, Homo sapiens
augaccuggcaacaaaaagu

SEQ ID NO: 755657 - RNA, 22 nt, Homo sapiens
augaccuguuauuaccauuagc

SEQ ID NO: 755658 - RNA, 16 nt, Homo sapiens
augaccuugggguaca

SEQ ID NO: 755659 - RNA, 20 nt, Homo sapiens
augacgguguuaauuuugcu

SEQ ID NO: 755660 - RNA, 22 nt, Homo sapiens
augacgguguuaauuuugcuaa

SEQ ID NO: 755661 - RNA, 22 nt, Homo sapiens
augacguuaugggcacaugccu

SEQ ID NO: 755662 - RNA, 14 nt, Homo sapiens
augacuccauucaa

SEQ ID NO: 755663 - RNA, 16 nt, Homo sapiens
augacugcuuaacucc

SEQ ID NO: 755664 - RNA, 15 nt, Homo sapiens
augacuuaaccauau

SEQ ID NO: 755665 - RNA, 15 nt, Homo sapiens
augacuucacccacg

SEQ ID NO: 755666 - RNA, 13 nt, Homo sapiens
augagaagcagaa

SEQ ID NO: 755667 - RNA, 20 nt, Homo sapiens
augagaaucagaucauuuca

SEQ ID NO: 755668 - RNA, 17 nt, Homo sapiens
augagaauuguauguca

SEQ ID NO: 755669 - RNA, 20 nt, Homo sapiens
augagaccguucgcauggca

SEQ ID NO: 755670 - RNA, 14 nt, Homo sapiens
augagagaacugga

SEQ ID NO: 755671 - RNA, 18 nt, Homo sapiens
augagagcaaaugcaaaa

SEQ ID NO: 755672 - RNA, 23 nt, Homo sapiens
augagaguuucuguuaaucaugu

SEQ ID NO: 755673 - RNA, 19 nt, Homo sapiens
augagauguuaaauacuuu

SEQ ID NO: 755674 - RNA, 18 nt, Homo sapiens
augagauguuauuacugu

SEQ ID NO: 755675 - RNA, 22 nt, Homo sapiens
augagcaaauggugcugaauac

SEQ ID NO: 755676 - RNA, 21 nt, Homo sapiens
augagcaagaggcuaacucag

SEQ ID NO: 755677 - RNA, 13 nt, Homo sapiens
augagcagucaca

SEQ ID NO: 755678 - RNA, 18 nt, Homo sapiens
augagccacugugcccag

SEQ ID NO: 755679 - RNA, 14 nt, Homo sapiens
augagcucuuccaa

SEQ ID NO: 755680 - RNA, 16 nt, Homo sapiens
augagcugacaucuca

SEQ ID NO: 755681 - RNA, 17 nt, Homo sapiens
augagcugacaucucag

SEQ ID NO: 755682 - RNA, 21 nt, Homo sapiens
augagcugcuccaucaccugg

SEQ ID NO: 755683 - RNA, 21 nt, Homo sapiens
augagcuuucuuugcacuuaa

SEQ ID NO: 755684 - RNA, 22 nt, Homo sapiens
augaggaaggaacagcaauggu

SEQ ID NO: 755685 - RNA, 14 nt, Homo sapiens
augaggaauccaaa

SEQ ID NO: 755686 - RNA, 19 nt, Homo sapiens
augaggaggucccacuugc

SEQ ID NO: 755687 - RNA, 15 nt, Homo sapiens
augaggcaaugucag

SEQ ID NO: 755688 - RNA, 14 nt, Homo sapiens
augaggcuucucag

SEQ ID NO: 755689 - RNA, 13 nt, Homo sapiens
augagggaaaaug

SEQ ID NO: 755690 - RNA, 16 nt, Homo sapiens
augagggaaaaugagu

SEQ ID NO: 755691 - RNA, 17 nt, Homo sapiens
augagggugacugucaa

SEQ ID NO: 755692 - RNA, 14 nt, Homo sapiens
augaggguggcaug

SEQ ID NO: 755693 - RNA, 20 nt, Homo sapiens
augagguacucuccuggaaa

SEQ ID NO: 755694 - RNA, 21 nt, Homo sapiens
augaguaacauuugcuguuuu

SEQ ID NO: 755695 - RNA, 21 nt, Homo sapiens
augaguaauacaucaaagagu

SEQ ID NO: 755696 - RNA, 17 nt, Homo sapiens
augaguccccugugaga

SEQ ID NO: 755697 - RNA, 15 nt, Homo sapiens
augaguuucacugua

SEQ ID NO: 755698 - RNA, 18 nt, Homo sapiens
augaguuuuucaguuuug

SEQ ID NO: 755699 - RNA, 21 nt, Homo sapiens
augaguuuuugauagcuuuau

SEQ ID NO: 755700 - RNA, 13 nt, Homo sapiens
augauacaaugaa

SEQ ID NO: 755701 - RNA, 22 nt, Homo sapiens
augauacuccacucccagcagc

SEQ ID NO: 755702 - RNA, 13 nt, Homo sapiens
augauacuuccaa

SEQ ID NO: 755703 - RNA, 16 nt, Homo sapiens
augauaugaccaaaau

SEQ ID NO: 755704 - RNA, 20 nt, Homo sapiens
augaucagcuguuugucaua

SEQ ID NO: 755705 - RNA, 22 nt, Homo sapiens
augaucaguguuguugcucuag

SEQ ID NO: 755706 - RNA, 18 nt, Homo sapiens
augaucaugccacugcac

SEQ ID NO: 755707 - RNA, 13 nt, Homo sapiens
augaucauugcug

SEQ ID NO: 755708 - RNA, 17 nt, Homo sapiens
augaucauugcuggcau

SEQ ID NO: 755709 - RNA, 13 nt, Homo sapiens
augaucccaguca

SEQ ID NO: 755710 - RNA, 19 nt, Homo sapiens
augaucgagccacugcacu

SEQ ID NO: 755711 - RNA, 18 nt, Homo sapiens
augaucuuguuacuguga

SEQ ID NO: 755712 - RNA, 16 nt, Homo sapiens
augaugagaagcagaa

SEQ ID NO: 755713 - RNA, 19 nt, Homo sapiens
augaugaucuuuaaaauac

SEQ ID NO: 755714 - RNA, 12 nt, Homo sapiens
augaugaugaua

SEQ ID NO: 755715 - RNA, 12 nt, Homo sapiens
augaugcaaauc

SEQ ID NO: 755716 - RNA, 21 nt, Homo sapiens
augaugcaaaucugccaagag

SEQ ID NO: 755717 - RNA, 20 nt, Homo sapiens
augauggccuuacacugaaa

SEQ ID NO: 755718 - RNA, 23 nt, Homo sapiens
augauggucugcauuagucucau

SEQ ID NO: 755719 - RNA, 20 nt, Homo sapiens
augaugguuuuaaacuuuca

SEQ ID NO: 755720 - RNA, 15 nt, Homo sapiens
augauguuugcccaa

SEQ ID NO: 755721 - RNA, 18 nt, Homo sapiens
augauucaaauugcugcu

SEQ ID NO: 755722 - RNA, 19 nt, Homo sapiens
augauucaaauugcugcuu

SEQ ID NO: 755723 - RNA, 15 nt, Homo sapiens
augauucccacccaa

SEQ ID NO: 755724 - RNA, 21 nt, Homo sapiens
augauucuuuguuacaggcac

SEQ ID NO: 755725 - RNA, 20 nt, Homo sapiens
augauuguuugacacaccau

SEQ ID NO: 755726 - RNA, 21 nt, Homo sapiens
augauuguuuuugcucaaggc

SEQ ID NO: 755727 - RNA, 14 nt, Homo sapiens
augauuuaggcuuc

SEQ ID NO: 755728 - RNA, 18 nt, Homo sapiens
augauuuagguacgucaa

SEQ ID NO: 755729 - RNA, 15 nt, Homo sapiens
augauuuugaaguca

SEQ ID NO: 755730 - RNA, 15 nt, Homo sapiens
augcaaagaugaacc

SEQ ID NO: 755731 - RNA, 14 nt, Homo sapiens
augcaaagcacuga

SEQ ID NO: 755732 - RNA, 18 nt, Homo sapiens
augcaaaguagcaauuuc

SEQ ID NO: 755733 - RNA, 23 nt, Homo sapiens
augcaaauacaaucagcccagug

SEQ ID NO: 755734 - RNA, 18 nt, Homo sapiens
augcaagaaguacugcca

SEQ ID NO: 755735 - RNA, 22 nt, Homo sapiens
augcaaggaaggaaagaaagaa

SEQ ID NO: 755736 - RNA, 12 nt, Homo sapiens
augcaagugcaa

SEQ ID NO: 755737 - RNA, 14 nt, Homo sapiens
augcaaucagacaa

SEQ ID NO: 755738 - RNA, 15 nt, Homo sapiens
augcaaucagacaag

SEQ ID NO: 755739 - RNA, 16 nt, Homo sapiens
augcaaucagacaagu

SEQ ID NO: 755740 - RNA, 15 nt, Homo sapiens
augcaaugccaaaua

SEQ ID NO: 755741 - RNA, 19 nt, Homo sapiens
augcaauuuggguuuuaga

SEQ ID NO: 755742 - RNA, 13 nt, Homo sapiens
augcacacagaua

SEQ ID NO: 755743 - RNA, 17 nt, Homo sapiens
augcacacucaugugca

SEQ ID NO: 755744 - RNA, 22 nt, Homo sapiens
augcacaguacaauaauguacu

SEQ ID NO: 755745 - RNA, 21 nt, Homo sapiens
augcacauauggacucugcac

SEQ ID NO: 755746 - RNA, 12 nt, Homo sapiens
augcacaugccu

SEQ ID NO: 755747 - RNA, 12 nt, Homo sapiens
augcacauuucu

SEQ ID NO: 755748 - RNA, 16 nt, Homo sapiens
augcaccauggucaaa

SEQ ID NO: 755749 - RNA, 22 nt, Homo sapiens
augcaccucuuguuacucccug

SEQ ID NO: 755750 - RNA, 22 nt, Homo sapiens
augcacguggggcccacugcuc

SEQ ID NO: 755751 - RNA, 12 nt, Homo sapiens
augcacugagua

SEQ ID NO: 755752 - RNA, 15 nt, Homo sapiens
augcacugauguugu

SEQ ID NO: 755753 - RNA, 16 nt, Homo sapiens
augcacuuauucaaua

SEQ ID NO: 755754 - RNA, 23 nt, Homo sapiens
augcagaacaccaauauuaacac

SEQ ID NO: 755755 - RNA, 15 nt, Homo sapiens
augcagaagcaaaca

SEQ ID NO: 755756 - RNA, 14 nt, Homo sapiens
augcagaaguauuc

SEQ ID NO: 755757 - RNA, 16 nt, Homo sapiens
augcagacugcugcaa

SEQ ID NO: 755758 - RNA, 16 nt, Homo sapiens
augcagcuacuggaau

SEQ ID NO: 755759 - RNA, 18 nt, Homo sapiens
augcaggugaugccauua

SEQ ID NO: 755760 - RNA, 15 nt, Homo sapiens
augcaggugguggga

SEQ ID NO: 755761 - RNA, 18 nt, Homo sapiens
augcaguuuuaagaauug

SEQ ID NO: 755762 - RNA, 16 nt, Homo sapiens
augcauaaagccaaau

SEQ ID NO: 755763 - RNA, 18 nt, Homo sapiens
augcauagcuuugcacuu

SEQ ID NO: 755764 - RNA, 16 nt, Homo sapiens
augcaucuuguuucau

SEQ ID NO: 755765 - RNA, 21 nt, Homo sapiens
augcaugaaaugaaugucuga

SEQ ID NO: 755766 - RNA, 16 nt, Homo sapiens
augcaugagcucccuc

SEQ ID NO: 755767 - RNA, 19 nt, Homo sapiens
augcaugcuucuucucaaa

SEQ ID NO: 755768 - RNA, 16 nt, Homo sapiens
augcauggugccccag

SEQ ID NO: 755769 - RNA, 20 nt, Homo sapiens
augcaugucaaacaugagau

SEQ ID NO: 755770 - RNA, 18 nt, Homo sapiens
augcauucacaaggugac

SEQ ID NO: 755771 - RNA, 22 nt, Homo sapiens
augcauugccuguaacaaugua

SEQ ID NO: 755772 - RNA, 15 nt, Homo sapiens
augcauuuaauaaag

SEQ ID NO: 755773 - RNA, 14 nt, Homo sapiens
augccaaacacuag

SEQ ID NO: 755774 - RNA, 15 nt, Homo sapiens
augccaaacacuagc

SEQ ID NO: 755775 - RNA, 16 nt, Homo sapiens
augccaaacacuagcu

SEQ ID NO: 755776 - RNA, 20 nt, Homo sapiens
augccaccaacacugcucac

SEQ ID NO: 755777 - RNA, 14 nt, Homo sapiens
augccacccuagcc

SEQ ID NO: 755778 - RNA, 15 nt, Homo sapiens
augccacccuagcca

SEQ ID NO: 755779 - RNA, 12 nt, Homo sapiens
augccacuccuc

SEQ ID NO: 755780 - RNA, 11 nt, Homo sapiens
augccacugcu

SEQ ID NO: 755781 - RNA, 22 nt, Homo sapiens
augccaguaacgcgucuuccug

SEQ ID NO: 755782 - RNA, 19 nt, Homo sapiens
augccagugacacuuccag

SEQ ID NO: 755783 - RNA, 21 nt, Homo sapiens
augccauuacagaaccaaauc

SEQ ID NO: 755784 - RNA, 19 nt, Homo sapiens
augccauuuuguacaugua

SEQ ID NO: 755785 - RNA, 17 nt, Homo sapiens
augcccucauacccaug

SEQ ID NO: 755786 - RNA, 15 nt, Homo sapiens
augccuaucugacca

SEQ ID NO: 755787 - RNA, 16 nt, Homo sapiens
augccuccaagccauu

SEQ ID NO: 755788 - RNA, 13 nt, Homo sapiens
augccugguacca

SEQ ID NO: 755789 - RNA, 19 nt, Homo sapiens
augccugugaagcagucag

SEQ ID NO: 755790 - RNA, 22 nt, Homo sapiens
augccuuaaaccuaccucccac

SEQ ID NO: 755791 - RNA, 15 nt, Homo sapiens
augccuuaagcagaa

SEQ ID NO: 755792 - RNA, 15 nt, Homo sapiens
augcgacccaagacc

SEQ ID NO: 755793 - RNA, 15 nt, Homo sapiens
augcggauccugcug

SEQ ID NO: 755794 - RNA, 19 nt, Homo sapiens
augcgguucuuacagcaca

SEQ ID NO: 755795 - RNA, 17 nt, Homo sapiens
augcgucccuguacaga

SEQ ID NO: 755796 - RNA, 21 nt, Homo sapiens
augcuaaaugggaaugcaaag

SEQ ID NO: 755797 - RNA, 21 nt, Homo sapiens
augcuaccacugguacuuccu

SEQ ID NO: 755798 - RNA, 17 nt, Homo sapiens
augcuaccggggaccgg

SEQ ID NO: 755799 - RNA, 17 nt, Homo sapiens
augcuaguuugaccuca

SEQ ID NO: 755800 - RNA, 15 nt, Homo sapiens
augcuaucucugugu

SEQ ID NO: 755801 - RNA, 20 nt, Homo sapiens
augcuauguucugucuuccc

SEQ ID NO: 755802 - RNA, 17 nt, Homo sapiens
augcucaaccacugugg

SEQ ID NO: 755803 - RNA, 14 nt, Homo sapiens
augcucaccaagga

SEQ ID NO: 755804 - RNA, 16 nt, Homo sapiens
augcucauugaacuuu

SEQ ID NO: 755805 - RNA, 12 nt, Homo sapiens
augcuccaagau

SEQ ID NO: 755806 - RNA, 24 nt, Homo sapiens
augcuccagucaacaaacuauuuc

SEQ ID NO: 755807 - RNA, 15 nt, Homo sapiens
augcucgugugauuu

SEQ ID NO: 755808 - RNA, 17 nt, Homo sapiens
augcucugcauguuaca

SEQ ID NO: 755809 - RNA, 16 nt, Homo sapiens
augcucuuuugcacaa

SEQ ID NO: 755810 - RNA, 20 nt, Homo sapiens
augcucuuuugcacaaggaa

SEQ ID NO: 755811 - RNA, 23 nt, Homo sapiens
augcugacacuuuuucagggcug

SEQ ID NO: 755812 - RNA, 17 nt, Homo sapiens
augcugagaagaucuga

SEQ ID NO: 755813 - RNA, 22 nt, Homo sapiens
augcugagguuaugaacaaagu

SEQ ID NO: 755814 - RNA, 16 nt, Homo sapiens
augcugcaaaggagaa

SEQ ID NO: 755815 - RNA, 23 nt, Homo sapiens
augcugcugagguuuugaaagaa

SEQ ID NO: 755816 - RNA, 20 nt, Homo sapiens
augcugcuggggaagacagu

SEQ ID NO: 755817 - RNA, 23 nt, Homo sapiens
augcugcuggggaagacaguggc

SEQ ID NO: 755818 - RNA, 19 nt, Homo sapiens
augcugcuuuccccugugg

SEQ ID NO: 755819 - RNA, 15 nt, Homo sapiens
augcuggcauuugca

SEQ ID NO: 755820 - RNA, 23 nt, Homo sapiens
augcuggcauuugcaccuaccuc

SEQ ID NO: 755821 - RNA, 14 nt, Homo sapiens
augcuguaacuuaa

SEQ ID NO: 755822 - RNA, 14 nt, Homo sapiens
augcugugacaggu

SEQ ID NO: 755823 - RNA, 15 nt, Homo sapiens
augcugugcucuuug

SEQ ID NO: 755824 - RNA, 18 nt, Homo sapiens
augcuguuugacaaaguu

SEQ ID NO: 755825 - RNA, 18 nt, Homo sapiens
augcuucaguacuuguga

SEQ ID NO: 755826 - RNA, 16 nt, Homo sapiens
augcuucugagagcaa

SEQ ID NO: 755827 - RNA, 15 nt, Homo sapiens
augcuucugcacaca

SEQ ID NO: 755828 - RNA, 23 nt, Homo sapiens
augcuucuucucaaagcacuguu

SEQ ID NO: 755829 - RNA, 22 nt, Homo sapiens
augcuugacauaccuaccagua

SEQ ID NO: 755830 - RNA, 11 nt, Homo sapiens
augcuuuacaa

SEQ ID NO: 755831 - RNA, 17 nt, Homo sapiens
augcuuucccugaggaa

SEQ ID NO: 755832 - RNA, 18 nt, Homo sapiens
augcuuucucaugucuca

SEQ ID NO: 755833 - RNA, 12 nt, Homo sapiens
augcuuugcccc

SEQ ID NO: 755834 - RNA, 15 nt, Homo sapiens
augcuuuuauagcug

SEQ ID NO: 755835 - RNA, 15 nt, Homo sapiens
augcuuuuucucaga

SEQ ID NO: 755836 - RNA, 23 nt, Homo sapiens
auggaaaaccuucaagaucucau

SEQ ID NO: 755837 - RNA, 20 nt, Homo sapiens
auggaaagaaucuaauagag

SEQ ID NO: 755838 - RNA, 17 nt, Homo sapiens
auggaaaguuguaucca

SEQ ID NO: 755839 - RNA, 20 nt, Homo sapiens
auggaacacacuuggaugca

SEQ ID NO: 755840 - RNA, 15 nt, Homo sapiens
auggaacagcauuac

SEQ ID NO: 755841 - RNA, 13 nt, Homo sapiens
auggaacauaaaa

SEQ ID NO: 755842 - RNA, 13 nt, Homo sapiens
auggaagaguuaa

SEQ ID NO: 755843 - RNA, 15 nt, Homo sapiens
auggaaggccuuuug

SEQ ID NO: 755844 - RNA, 16 nt, Homo sapiens
auggaagugucugcca

SEQ ID NO: 755845 - RNA, 17 nt, Homo sapiens
auggaaugcuguguuaa

SEQ ID NO: 755846 - RNA, 20 nt, Homo sapiens
auggaauuucucccagucau

SEQ ID NO: 755847 - RNA, 18 nt, Homo sapiens
auggacaaaauugcagau

SEQ ID NO: 755848 - RNA, 15 nt, Homo sapiens
auggacaagauuacc

SEQ ID NO: 755849 - RNA, 18 nt, Homo sapiens
auggacauaagacagaca

SEQ ID NO: 755850 - RNA, 16 nt, Homo sapiens
auggaccagaagccaa

SEQ ID NO: 755851 - RNA, 23 nt, Homo sapiens
auggaccagugguuuccagucau

SEQ ID NO: 755852 - RNA, 22 nt, Homo sapiens
auggacgugugugaaugguugu

SEQ ID NO: 755853 - RNA, 12 nt, Homo sapiens
auggacucugca

SEQ ID NO: 755854 - RNA, 13 nt, Homo sapiens
auggacucugcac

SEQ ID NO: 755855 - RNA, 23 nt, Homo sapiens
auggagacguggugggacuccag

SEQ ID NO: 755856 - RNA, 18 nt, Homo sapiens
auggaggaaagugauauc

SEQ ID NO: 755857 - RNA, 15 nt, Homo sapiens
auggaggaacaguau

SEQ ID NO: 755858 - RNA, 20 nt, Homo sapiens
auggaggaagaacaacaaag

SEQ ID NO: 755859 - RNA, 17 nt, Homo sapiens
auggaggaauuucuuga

SEQ ID NO: 755860 - RNA, 21 nt, Homo sapiens
auggaggggagggaucuccug

SEQ ID NO: 755861 - RNA, 20 nt, Homo sapiens
auggagguuuccuuuuggaa

SEQ ID NO: 755862 - RNA, 16 nt, Homo sapiens
auggauagucugucca

SEQ ID NO: 755863 - RNA, 11 nt, Homo sapiens
auggaucacaa

SEQ ID NO: 755864 - RNA, 14 nt, Homo sapiens
auggauccuuccau

SEQ ID NO: 755865 - RNA, 15 nt, Homo sapiens
auggaugcaugcccu

SEQ ID NO: 755866 - RNA, 18 nt, Homo sapiens
auggaugcgacccaagac

SEQ ID NO: 755867 - RNA, 17 nt, Homo sapiens
auggaugggggaacuca

SEQ ID NO: 755868 - RNA, 21 nt, Homo sapiens
auggauugauaauugcauuca

SEQ ID NO: 755869 - RNA, 17 nt, Homo sapiens
auggauuguggaaaaug

SEQ ID NO: 755870 - RNA, 22 nt, Homo sapiens
auggauuuugggagugacucaa

SEQ ID NO: 755871 - RNA, 20 nt, Homo sapiens
auggauuuuucuuuaacugc

SEQ ID NO: 755872 - RNA, 17 nt, Homo sapiens
auggcaaagaauucaaa

SEQ ID NO: 755873 - RNA, 16 nt, Homo sapiens
auggcagaaccaaagc

SEQ ID NO: 755874 - RNA, 14 nt, Homo sapiens
auggcagaagggaa

SEQ ID NO: 755875 - RNA, 21 nt, Homo sapiens
auggcagaagggaauugcuca

SEQ ID NO: 755876 - RNA, 12 nt, Homo sapiens
auggcagggaua

SEQ ID NO: 755877 - RNA, 18 nt, Homo sapiens
auggcaguccagccagcu

SEQ ID NO: 755878 - RNA, 13 nt, Homo sapiens
auggcaucuucaa

SEQ ID NO: 755879 - RNA, 16 nt, Homo sapiens
auggcauuuggucuca

SEQ ID NO: 755880 - RNA, 23 nt, Homo sapiens
auggcauuuggucucaggcagca

SEQ ID NO: 755881 - RNA, 17 nt, Homo sapiens
auggccaauaacuuuuc

SEQ ID NO: 755882 - RNA, 19 nt, Homo sapiens
auggccacaacaugaaaac

SEQ ID NO: 755883 - RNA, 18 nt, Homo sapiens
auggccagugugauccca

SEQ ID NO: 755884 - RNA, 20 nt, Homo sapiens
auggccagugugaucccaag

SEQ ID NO: 755885 - RNA, 12 nt, Homo sapiens
auggccaugcag

SEQ ID NO: 755886 - RNA, 23 nt, Homo sapiens
auggcccaugggagccaggccca

SEQ ID NO: 755887 - RNA, 23 nt, Homo sapiens
auggccgaaaaggauaugcagua

SEQ ID NO: 755888 - RNA, 17 nt, Homo sapiens
auggccucauguggcug

SEQ ID NO: 755889 - RNA, 15 nt, Homo sapiens
auggccuggaaccca

SEQ ID NO: 755890 - RNA, 15 nt, Homo sapiens
auggccuggauucac

SEQ ID NO: 755891 - RNA, 22 nt, Homo sapiens
auggccuggggaagcugugaaa

SEQ ID NO: 755892 - RNA, 16 nt, Homo sapiens
auggcuaccaaaaaga

SEQ ID NO: 755893 - RNA, 14 nt, Homo sapiens
auggcucacuauga

SEQ ID NO: 755894 - RNA, 18 nt, Homo sapiens
auggcucaggcaagcccc

SEQ ID NO: 755895 - RNA, 15 nt, Homo sapiens
auggcucaugaccug

SEQ ID NO: 755896 - RNA, 17 nt, Homo sapiens
auggcucuggcacagug

SEQ ID NO: 755897 - RNA, 23 nt, Homo sapiens
auggcugaguuuauuaguacaug

SEQ ID NO: 755898 - RNA, 18 nt, Homo sapiens
auggcugcauaguauucc

SEQ ID NO: 755899 - RNA, 21 nt, Homo sapiens
auggcugguuaccaccagccu

SEQ ID NO: 755900 - RNA, 20 nt, Homo sapiens
auggcuuaggaucgacaaga

SEQ ID NO: 755901 - RNA, 16 nt, Homo sapiens
auggcuucacauucau

SEQ ID NO: 755902 - RNA, 19 nt, Homo sapiens
auggcuuuagcuaccucac

SEQ ID NO: 755903 - RNA, 15 nt, Homo sapiens
auggcuuugugauuc

SEQ ID NO: 755904 - RNA, 17 nt, Homo sapiens
augggaaccccuucauc

SEQ ID NO: 755905 - RNA, 17 nt, Homo sapiens
augggacccuguugaug

SEQ ID NO: 755906 - RNA, 18 nt, Homo sapiens
augggacuaaaugaacua

SEQ ID NO: 755907 - RNA, 21 nt, Homo sapiens
augggacugaugucaucuuga

SEQ ID NO: 755908 - RNA, 21 nt, Homo sapiens
augggagccuuuaccuuuuau

SEQ ID NO: 755909 - RNA, 15 nt, Homo sapiens
augggaggcugugau

SEQ ID NO: 755910 - RNA, 23 nt, Homo sapiens
augggcagacugaaccaguccag

SEQ ID NO: 755911 - RNA, 19 nt, Homo sapiens
augggccccucagccaggg

SEQ ID NO: 755912 - RNA, 17 nt, Homo sapiens
augggcuaucaacuuaa

SEQ ID NO: 755913 - RNA, 20 nt, Homo sapiens
augggcucuuccaacaagga

SEQ ID NO: 755914 - RNA, 16 nt, Homo sapiens
auggggaaaaaacugu

SEQ ID NO: 755915 - RNA, 13 nt, Homo sapiens
auggggacacaga

SEQ ID NO: 755916 - RNA, 20 nt, Homo sapiens
auggggauuccacuaucuca

SEQ ID NO: 755917 - RNA, 21 nt, Homo sapiens
auggggcagaaaucugaggaa

SEQ ID NO: 755918 - RNA, 19 nt, Homo sapiens
auggggucugugacuggau

SEQ ID NO: 755919 - RNA, 19 nt, Homo sapiens
auggguaugcucaggucaa

SEQ ID NO: 755920 - RNA, 13 nt, Homo sapiens
auggguccagggc

SEQ ID NO: 755921 - RNA, 18 nt, Homo sapiens
augggucccccucagcaa

SEQ ID NO: 755922 - RNA, 17 nt, Homo sapiens
auggguccuugaugcca

SEQ ID NO: 755923 - RNA, 22 nt, Homo sapiens
augggugauacuggagucuuau

SEQ ID NO: 755924 - RNA, 14 nt, Homo sapiens
auggguuaaaucaa

SEQ ID NO: 755925 - RNA, 18 nt, Homo sapiens
auggguuaaaucaaagau

SEQ ID NO: 755926 - RNA, 22 nt, Homo sapiens
auggguuaagagcucaccccag

SEQ ID NO: 755927 - RNA, 18 nt, Homo sapiens
augguaaaaccccaucuc

SEQ ID NO: 755928 - RNA, 14 nt, Homo sapiens
augguagaacuaaa

SEQ ID NO: 755929 - RNA, 20 nt, Homo sapiens
augguaggauaucuuggcuu

SEQ ID NO: 755930 - RNA, 20 nt, Homo sapiens
augguaucaauggauuuauc

SEQ ID NO: 755931 - RNA, 13 nt, Homo sapiens
augguaugaucaa

SEQ ID NO: 755932 - RNA, 22 nt, Homo sapiens
auggucaaguucccaacugagu

SEQ ID NO: 755933 - RNA, 20 nt, Homo sapiens
augguccuggggcucugugc

SEQ ID NO: 755934 - RNA, 16 nt, Homo sapiens
augguccuuucuggaa

SEQ ID NO: 755935 - RNA, 16 nt, Homo sapiens
auggugaaacccuguc

SEQ ID NO: 755936 - RNA, 20 nt, Homo sapiens
auggugaaaccucaucucua

SEQ ID NO: 755937 - RNA, 21 nt, Homo sapiens
auggugaaaccucaucucuac

SEQ ID NO: 755938 - RNA, 14 nt, Homo sapiens
auggugaagggaag

SEQ ID NO: 755939 - RNA, 13 nt, Homo sapiens
auggugagcucug

SEQ ID NO: 755940 - RNA, 19 nt, Homo sapiens
auggugcacugagcugcaa

SEQ ID NO: 755941 - RNA, 19 nt, Homo sapiens
auggugccuauaucugaga

SEQ ID NO: 755942 - RNA, 15 nt, Homo sapiens
auggugccugggcug

SEQ ID NO: 755943 - RNA, 18 nt, Homo sapiens
auggugcuggggagccaa

SEQ ID NO: 755944 - RNA, 20 nt, Homo sapiens
augguggcgcgcaccuguaa

SEQ ID NO: 755945 - RNA, 20 nt, Homo sapiens
augguuacuucuucucuuag

SEQ ID NO: 755946 - RNA, 15 nt, Homo sapiens
augguucccaauaaa

SEQ ID NO: 755947 - RNA, 21 nt, Homo sapiens
augguugcacaaaaccacuuu

SEQ ID NO: 755948 - RNA, 15 nt, Homo sapiens
augguugccaggacg

SEQ ID NO: 755949 - RNA, 13 nt, Homo sapiens
augguuucuccag

SEQ ID NO: 755950 - RNA, 16 nt, Homo sapiens
auguaaaacccuuuaa

SEQ ID NO: 755951 - RNA, 21 nt, Homo sapiens
auguaaaagaacuuacugauu

SEQ ID NO: 755952 - RNA, 20 nt, Homo sapiens
auguaaacauaauucuugua

SEQ ID NO: 755953 - RNA, 17 nt, Homo sapiens
auguaaacccucaaggg

SEQ ID NO: 755954 - RNA, 15 nt, Homo sapiens
auguaaagcacauca

SEQ ID NO: 755955 - RNA, 21 nt, Homo sapiens
auguaaauuaacucaccagau

SEQ ID NO: 755956 - RNA, 15 nt, Homo sapiens
auguaacgaauggua

SEQ ID NO: 755957 - RNA, 16 nt, Homo sapiens
auguaagaauucagaa

SEQ ID NO: 755958 - RNA, 19 nt, Homo sapiens
auguaagaguucagacuca

SEQ ID NO: 755959 - RNA, 18 nt, Homo sapiens
auguaagaucguucucug

SEQ ID NO: 755960 - RNA, 23 nt, Homo sapiens
auguaaugcauaggaaguauggc

SEQ ID NO: 755961 - RNA, 14 nt, Homo sapiens
auguaauuuaugca

SEQ ID NO: 755962 - RNA, 12 nt, Homo sapiens
auguacaaauag

SEQ ID NO: 755963 - RNA, 15 nt, Homo sapiens
auguacagacauaca

SEQ ID NO: 755964 - RNA, 18 nt, Homo sapiens
auguacaugaagaagcua

SEQ ID NO: 755965 - RNA, 16 nt, Homo sapiens
auguacccgagcacau

SEQ ID NO: 755966 - RNA, 18 nt, Homo sapiens
auguacuaaaucuaauca

SEQ ID NO: 755967 - RNA, 14 nt, Homo sapiens
auguacuaugucug

SEQ ID NO: 755968 - RNA, 20 nt, Homo sapiens
auguagaggcuuguuuaccu

SEQ ID NO: 755969 - RNA, 14 nt, Homo sapiens
auguagguguuugu

SEQ ID NO: 755970 - RNA, 21 nt, Homo sapiens
auguaguauuaaaaguugcau

SEQ ID NO: 755971 - RNA, 20 nt, Homo sapiens
auguaguuuuuauauguugu

SEQ ID NO: 755972 - RNA, 21 nt, Homo sapiens
auguaguuuuuauauguugua

SEQ ID NO: 755973 - RNA, 20 nt, Homo sapiens
auguauaaaaauuaucaaaa

SEQ ID NO: 755974 - RNA, 17 nt, Homo sapiens
auguauaaaacuaggaa

SEQ ID NO: 755975 - RNA, 14 nt, Homo sapiens
auguauacaugugc

SEQ ID NO: 755976 - RNA, 23 nt, Homo sapiens
auguauauaagccaguucacuua

SEQ ID NO: 755977 - RNA, 18 nt, Homo sapiens
auguauauauacacggua

SEQ ID NO: 755978 - RNA, 19 nt, Homo sapiens
auguauauauauauaugca

SEQ ID NO: 755979 - RNA, 17 nt, Homo sapiens
auguaucuauuuguaca

SEQ ID NO: 755980 - RNA, 19 nt, Homo sapiens
auguaucucaguaccccau

SEQ ID NO: 755981 - RNA, 15 nt, Homo sapiens
auguaugaguggcuu

SEQ ID NO: 755982 - RNA, 14 nt, Homo sapiens
auguaugcaccuca

SEQ ID NO: 755983 - RNA, 16 nt, Homo sapiens
auguauguacaauaca

SEQ ID NO: 755984 - RNA, 22 nt, Homo sapiens
auguaugucuuggacacuguac

SEQ ID NO: 755985 - RNA, 23 nt, Homo sapiens
auguauguguaaaacaaucuguu

SEQ ID NO: 755986 - RNA, 18 nt, Homo sapiens
auguauguuuacauauca

SEQ ID NO: 755987 - RNA, 20 nt, Homo sapiens
auguauguuuggcucugcuu

SEQ ID NO: 755988 - RNA, 16 nt, Homo sapiens
augucaacagagcaag

SEQ ID NO: 755989 - RNA, 20 nt, Homo sapiens
augucaacagagcaaggaga

SEQ ID NO: 755990 - RNA, 23 nt, Homo sapiens
augucaaguaccaaaauguuaau

SEQ ID NO: 755991 - RNA, 14 nt, Homo sapiens
augucaauagcauu

SEQ ID NO: 755992 - RNA, 15 nt, Homo sapiens
augucaauauuuagu

SEQ ID NO: 755993 - RNA, 15 nt, Homo sapiens
augucacauucuauu

SEQ ID NO: 755994 - RNA, 13 nt, Homo sapiens
augucaccaccuu

SEQ ID NO: 755995 - RNA, 12 nt, Homo sapiens
augucaccucag

SEQ ID NO: 755996 - RNA, 17 nt, Homo sapiens
augucagaaaccaguua

SEQ ID NO: 755997 - RNA, 19 nt, Homo sapiens
augucagacagaacuugaa

SEQ ID NO: 755998 - RNA, 16 nt, Homo sapiens
augucagcgcucuggu

SEQ ID NO: 755999 - RNA, 15 nt, Homo sapiens
augucaggguucugc

SEQ ID NO: 756000 - RNA, 21 nt, Homo sapiens
augucaguacuauucagguaa

SEQ ID NO: 756001 - RNA, 14 nt, Homo sapiens
augucauagccaaa

SEQ ID NO: 756002 - RNA, 20 nt, Homo sapiens
augucauugucuacuccuag

SEQ ID NO: 756003 - RNA, 20 nt, Homo sapiens
augucauuuuuaauguaucu

SEQ ID NO: 756004 - RNA, 21 nt, Homo sapiens
auguccaccaugaacuugaua

SEQ ID NO: 756005 - RNA, 22 nt, Homo sapiens
auguccagaagaauauucagga

SEQ ID NO: 756006 - RNA, 22 nt, Homo sapiens
auguccauuugucccaauagcu

SEQ ID NO: 756007 - RNA, 19 nt, Homo sapiens
auguccuaaggacacacua

SEQ ID NO: 756008 - RNA, 15 nt, Homo sapiens
auguccucagcauuu

SEQ ID NO: 756009 - RNA, 15 nt, Homo sapiens
auguccugccuuuua

SEQ ID NO: 756010 - RNA, 16 nt, Homo sapiens
auguccuuucauuugu

SEQ ID NO: 756011 - RNA, 20 nt, Homo sapiens
auguccuuuccaucugucca

SEQ ID NO: 756012 - RNA, 22 nt, Homo sapiens
augucuaccuggcagauacuca

SEQ ID NO: 756013 - RNA, 14 nt, Homo sapiens
augucuagcuuuca

SEQ ID NO: 756014 - RNA, 22 nt, Homo sapiens
augucuauaaucccagcacuuu

SEQ ID NO: 756015 - RNA, 13 nt, Homo sapiens
augucucauguca

SEQ ID NO: 756016 - RNA, 22 nt, Homo sapiens
augucuccuuugcucuugccaa

SEQ ID NO: 756017 - RNA, 23 nt, Homo sapiens
augucucucuugagcuacaguag

SEQ ID NO: 756018 - RNA, 14 nt, Homo sapiens
augucuguguaugu

SEQ ID NO: 756019 - RNA, 23 nt, Homo sapiens
augucuguuucaaugaccuguau

SEQ ID NO: 756020 - RNA, 19 nt, Homo sapiens
augucuuuuauuuacuuuu

SEQ ID NO: 756021 - RNA, 17 nt, Homo sapiens
augugaaaacaucucaa

SEQ ID NO: 756022 - RNA, 20 nt, Homo sapiens
augugaaacggaagcucaua

SEQ ID NO: 756023 - RNA, 16 nt, Homo sapiens
augugaacuugaagaa

SEQ ID NO: 756024 - RNA, 18 nt, Homo sapiens
augugaaguuuugcaaau

SEQ ID NO: 756025 - RNA, 20 nt, Homo sapiens
augugaauuauugacacuga

SEQ ID NO: 756026 - RNA, 15 nt, Homo sapiens
augugacuggcagua

SEQ ID NO: 756027 - RNA, 23 nt, Homo sapiens
augugacuuaaagucagaauagu

SEQ ID NO: 756028 - RNA, 21 nt, Homo sapiens
augugagcucuuccuaucccu

SEQ ID NO: 756029 - RNA, 17 nt, Homo sapiens
augugagucccugugau

SEQ ID NO: 756030 - RNA, 21 nt, Homo sapiens
augugagugccuuuugcagaa

SEQ ID NO: 756031 - RNA, 17 nt, Homo sapiens
augugauauaaggauuu

SEQ ID NO: 756032 - RNA, 15 nt, Homo sapiens
augugauguucuaag

SEQ ID NO: 756033 - RNA, 22 nt, Homo sapiens
augugauucaccucuucuuucc

SEQ ID NO: 756034 - RNA, 22 nt, Homo sapiens
augugauuuggaccauggcacu

SEQ ID NO: 756035 - RNA, 21 nt, Homo sapiens
augugcaaccuaauuguagca

SEQ ID NO: 756036 - RNA, 10 nt, Homo sapiens
augugcaaua

SEQ ID NO: 756037 - RNA, 13 nt, Homo sapiens
augugcacugccu

SEQ ID NO: 756038 - RNA, 14 nt, Homo sapiens
augugcaguacuua

SEQ ID NO: 756039 - RNA, 13 nt, Homo sapiens
augugcauuucac

SEQ ID NO: 756040 - RNA, 10 nt, Homo sapiens
augugccuuu

SEQ ID NO: 756041 - RNA, 20 nt, Homo sapiens
augugccuuucuuugccucu

SEQ ID NO: 756042 - RNA, 22 nt, Homo sapiens
augugcgcgcgugcaugugugc

SEQ ID NO: 756043 - RNA, 19 nt, Homo sapiens
augugcuauacacacacac

SEQ ID NO: 756044 - RNA, 15 nt, Homo sapiens
augugcugagcauuu

SEQ ID NO: 756045 - RNA, 13 nt, Homo sapiens
augugcuggucac

SEQ ID NO: 756046 - RNA, 17 nt, Homo sapiens
auguggaagaacuguga

SEQ ID NO: 756047 - RNA, 21 nt, Homo sapiens
auguggaagaacuuaggcauc

SEQ ID NO: 756048 - RNA, 12 nt, Homo sapiens
auguggauauca

SEQ ID NO: 756049 - RNA, 18 nt, Homo sapiens
auguggcaaagugcugua

SEQ ID NO: 756050 - RNA, 19 nt, Homo sapiens
auguggcccucuggaucca

SEQ ID NO: 756051 - RNA, 17 nt, Homo sapiens
augugguuacuuccuac

SEQ ID NO: 756052 - RNA, 13 nt, Homo sapiens
auguguacagucu

SEQ ID NO: 756053 - RNA, 15 nt, Homo sapiens
auguguacgugcaug

SEQ ID NO: 756054 - RNA, 15 nt, Homo sapiens
auguguaugauacua

SEQ ID NO: 756055 - RNA, 21 nt, Homo sapiens
augugucacuacucacagucu

SEQ ID NO: 756056 - RNA, 19 nt, Homo sapiens
augugucauuggaagccau

SEQ ID NO: 756057 - RNA, 15 nt, Homo sapiens
auguguccucaggga

SEQ ID NO: 756058 - RNA, 16 nt, Homo sapiens
augugugaaguaugca

SEQ ID NO: 756059 - RNA, 18 nt, Homo sapiens
augugugcauauuuagca

SEQ ID NO: 756060 - RNA, 13 nt, Homo sapiens
augugugugccaa

SEQ ID NO: 756061 - RNA, 19 nt, Homo sapiens
auguguguguauguuugca

SEQ ID NO: 756062 - RNA, 17 nt, Homo sapiens
auguguuauuacuuccu

SEQ ID NO: 756063 - RNA, 21 nt, Homo sapiens
auguguucauuaaagcaugaa

SEQ ID NO: 756064 - RNA, 21 nt, Homo sapiens
auguguuccauugccauagcu

SEQ ID NO: 756065 - RNA, 22 nt, Homo sapiens
auguguucuaagcaaugcaaau

SEQ ID NO: 756066 - RNA, 23 nt, Homo sapiens
auguguucuaagcaaugcaaaug

SEQ ID NO: 756067 - RNA, 15 nt, Homo sapiens
auguguugcuauccu

SEQ ID NO: 756068 - RNA, 17 nt, Homo sapiens
auguguuucaaaaccau

SEQ ID NO: 756069 - RNA, 17 nt, Homo sapiens
auguguuuggaagacaa

SEQ ID NO: 756070 - RNA, 21 nt, Homo sapiens
auguuaaagaugcacagaaua

SEQ ID NO: 756071 - RNA, 13 nt, Homo sapiens
auguuaaagggau

SEQ ID NO: 756072 - RNA, 18 nt, Homo sapiens
auuuuuauaaacuaccaa

SEQ ID NO: 756073 - RNA, 13 nt, Homo sapiens
auuuuuaugcaga

SEQ ID NO: 756074 - RNA, 15 nt, Homo sapiens
auuuuuccacuuaaa

SEQ ID NO: 756075 - RNA, 17 nt, Homo sapiens
auuuuuccugcauguuc

SEQ ID NO: 756076 - RNA, 20 nt, Homo sapiens
auuuuucuuagugugccaag

SEQ ID NO: 756077 - RNA, 15 nt, Homo sapiens
auuuuugaaaacugg

SEQ ID NO: 756078 - RNA, 16 nt, Homo sapiens
auuuuugagacagagu

SEQ ID NO: 756079 - RNA, 20 nt, Homo sapiens
auuuuugauuaacaauguau

SEQ ID NO: 756080 - RNA, 12 nt, Homo sapiens
auuuuuggugca

SEQ ID NO: 756081 - RNA, 19 nt, Homo sapiens
auuuuuggugggaauccaa

SEQ ID NO: 756082 - RNA, 16 nt, Homo sapiens
auuuuuguacauguuc

SEQ ID NO: 756083 - RNA, 21 nt, Homo sapiens
auuuuuguuagcaaagauuaa

SEQ ID NO: 756084 - RNA, 20 nt, Homo sapiens
auuuuuguuucuuccaaagc

SEQ ID NO: 756085 - RNA, 15 nt, Homo sapiens
auuuuuuaacuuucu

SEQ ID NO: 756086 - RNA, 17 nt, Homo sapiens
auuuuuuaaggaaacaa

SEQ ID NO: 756087 - RNA, 16 nt, Homo sapiens
auuuuuuaaggcaaua

SEQ ID NO: 756088 - RNA, 20 nt, Homo sapiens
auuuuuuaagguaacaaaua

SEQ ID NO: 756089 - RNA, 16 nt, Homo sapiens
auuuuuuacuacauaa

SEQ ID NO: 756090 - RNA, 14 nt, Homo sapiens
auuuuuuauacugu

SEQ ID NO: 756091 - RNA, 16 nt, Homo sapiens
auuuuuugaaaguuaa

SEQ ID NO: 756092 - RNA, 16 nt, Homo sapiens
auuuuuuuaaaacaca

SEQ ID NO: 756093 - RNA, 16 nt, Homo sapiens
auuuuuuuaauagugc

SEQ ID NO: 756094 - RNA, 20 nt, Homo sapiens
auuuuuuucuuuacuuaucu

SEQ ID NO: 756095 - RNA, 23 nt, Homo sapiens
auuuuuuuuuuuuaaauuaugca

SEQ ID NO: 756096 - RNA, 21 nt, Homo sapiens
caaaaaaaaaaaaaaaagccu

SEQ ID NO: 756097 - RNA, 13 nt, Homo sapiens
caaaaaaaaaagc

SEQ ID NO: 756098 - RNA, 19 nt, Homo sapiens
caaaaaaaaaauuugccaa

SEQ ID NO: 756099 - RNA, 21 nt, Homo sapiens
caaaaaaaaaauuugccaaga

SEQ ID NO: 756100 - RNA, 23 nt, Homo sapiens
caaaaaaaauacggcuuuuccaa

SEQ ID NO: 756101 - RNA, 14 nt, Homo sapiens
caaaaaaauugugc

SEQ ID NO: 756102 - RNA, 14 nt, Homo sapiens
caaaaaacuacuuc

SEQ ID NO: 756103 - RNA, 23 nt, Homo sapiens
caaaaaagcuuaauuaaguacaa

SEQ ID NO: 756104 - RNA, 18 nt, Homo sapiens
caaaaaauagcacacuuu

SEQ ID NO: 756105 - RNA, 17 nt, Homo sapiens
caaaaacagaauuugag

SEQ ID NO: 756106 - RNA, 22 nt, Homo sapiens
caaaaacauucuuacauuuuac

SEQ ID NO: 756107 - RNA, 14 nt, Homo sapiens
caaaaacuacacau

SEQ ID NO: 756108 - RNA, 15 nt, Homo sapiens
caaaaacuguacugu

SEQ ID NO: 756109 - RNA, 19 nt, Homo sapiens
caaaaacuguacuguguuu

SEQ ID NO: 756110 - RNA, 12 nt, Homo sapiens
caaaaacuuugg

SEQ ID NO: 756111 - RNA, 14 nt, Homo sapiens
caaaaaggcaaaua

SEQ ID NO: 756112 - RNA, 22 nt, Homo sapiens
caaaaagggauccguacauuca

SEQ ID NO: 756113 - RNA, 22 nt, Homo sapiens
caaaaaguuuaucacacagugu

SEQ ID NO: 756114 - RNA, 12 nt, Homo sapiens
caaaaauguaau

SEQ ID NO: 756115 - RNA, 13 nt, Homo sapiens
caaaaauguaaug

SEQ ID NO: 756116 - RNA, 17 nt, Homo sapiens
caaaacaaguuggaugc

SEQ ID NO: 756117 - RNA, 12 nt, Homo sapiens
caaaacacugug

SEQ ID NO: 756118 - RNA, 13 nt, Homo sapiens
caaaacacugugu

SEQ ID NO: 756119 - RNA, 16 nt, Homo sapiens
caaaacccacagaaga

SEQ ID NO: 756120 - RNA, 12 nt, Homo sapiens
caaaacccaggg

SEQ ID NO: 756121 - RNA, 22 nt, Homo sapiens
caaaaccuacacacauaccuuc

SEQ ID NO: 756122 - RNA, 22 nt, Homo sapiens
caaaaccuacgcacauaccuuc

SEQ ID NO: 756123 - RNA, 16 nt, Homo sapiens
caaaaccucaaaccag

SEQ ID NO: 756124 - RNA, 18 nt, Homo sapiens
caaaaccugauguuaaaa

SEQ ID NO: 756125 - RNA, 12 nt, Homo sapiens
caaaacuacuga

SEQ ID NO: 756126 - RNA, 22 nt, Homo sapiens
caaaacucuccuacacuuccau

SEQ ID NO: 756127 - RNA, 23 nt, Homo sapiens
caaaacugguuuaggauuacuua

SEQ ID NO: 756128 - RNA, 22 nt, Homo sapiens
caaaacuuuaaugaacuaacug

SEQ ID NO: 756129 - RNA, 16 nt, Homo sapiens
caaaagaaagaaccac

SEQ ID NO: 756130 - RNA, 20 nt, Homo sapiens
caaaagaagacaacauuucu

SEQ ID NO: 756131 - RNA, 18 nt, Homo sapiens
caaaagcaaagaugcauu

SEQ ID NO: 756132 - RNA, 22 nt, Homo sapiens
caaaagcaagacuguugcucaa

SEQ ID NO: 756133 - RNA, 17 nt, Homo sapiens
caaaaggaaaccaagug

SEQ ID NO: 756134 - RNA, 22 nt, Homo sapiens
caaaaggaacucuagaagacca

SEQ ID NO: 756135 - RNA, 14 nt, Homo sapiens
caaaagucagucuu

SEQ ID NO: 756136 - RNA, 18 nt, Homo sapiens
caaaauaaaaagugacac

SEQ ID NO: 756137 - RNA, 20 nt, Homo sapiens
caaaauaaaaagugacacag

SEQ ID NO: 756138 - RNA, 23 nt, Homo sapiens
caaaauaaauuggaaaugugaau

SEQ ID NO: 756139 - RNA, 21 nt, Homo sapiens
caaaauaagguuauaugagua

SEQ ID NO: 756140 - RNA, 24 nt, Homo sapiens
caaaauaagucccgcauauacuuu

SEQ ID NO: 756141 - RNA, 17 nt, Homo sapiens
caaaauagucuucucaa

SEQ ID NO: 756142 - RNA, 23 nt, Homo sapiens
caaaauagucuucucaaauuaga

SEQ ID NO: 756143 - RNA, 15 nt, Homo sapiens
caaaauauacauuca

SEQ ID NO: 756144 - RNA, 19 nt, Homo sapiens
caaaauauuaacauucuuu

SEQ ID NO: 756145 - RNA, 16 nt, Homo sapiens
caaaaucaagccugau

SEQ ID NO: 756146 - RNA, 19 nt, Homo sapiens
caaaaucacuggauuauaa

SEQ ID NO: 756147 - RNA, 14 nt, Homo sapiens
caaaaucauggcuu

SEQ ID NO: 756148 - RNA, 15 nt, Homo sapiens
caaaauccaaaaaga

SEQ ID NO: 756149 - RNA, 19 nt, Homo sapiens
caaaaucuuguuaauguca

SEQ ID NO: 756150 - RNA, 21 nt, Homo sapiens
caaaaucuuguuaaugucauu

SEQ ID NO: 756151 - RNA, 20 nt, Homo sapiens
caaaaugaacacaucuugag

SEQ ID NO: 756152 - RNA, 14 nt, Homo sapiens
caaaauguucacaa

SEQ ID NO: 756153 - RNA, 16 nt, Homo sapiens
caaaauguucuauuua

SEQ ID NO: 756154 - RNA, 17 nt, Homo sapiens
caaaauuaaguugucuu

SEQ ID NO: 756155 - RNA, 13 nt, Homo sapiens
caaaauucauuca

SEQ ID NO: 756156 - RNA, 14 nt, Homo sapiens
caaacaaauaugca

SEQ ID NO: 756157 - RNA, 15 nt, Homo sapiens
caaacaauaaaggga

SEQ ID NO: 756158 - RNA, 18 nt, Homo sapiens
caaacacaguuacacuug

SEQ ID NO: 756159 - RNA, 22 nt, Homo sapiens
caaacacuagcucuguauuaau

SEQ ID NO: 756160 - RNA, 22 nt, Homo sapiens
caaacacugccauauuguguaa

SEQ ID NO: 756161 - RNA, 16 nt, Homo sapiens
caaacacuuacagaau

SEQ ID NO: 756162 - RNA, 16 nt, Homo sapiens
caaacagccacacugu

SEQ ID NO: 756163 - RNA, 17 nt, Homo sapiens
caaacagccacacugug

SEQ ID NO: 756164 - RNA, 13 nt, Homo sapiens
caaacagguuguu

SEQ ID NO: 756165 - RNA, 16 nt, Homo sapiens
caaacagucucaggaa

SEQ ID NO: 756166 - RNA, 11 nt, Homo sapiens
caaacauauau

SEQ ID NO: 756167 - RNA, 23 nt, Homo sapiens
caaacauauccuuucaagacaga

SEQ ID NO: 756168 - RNA, 19 nt, Homo sapiens
caaacaucauuuuacucuu

SEQ ID NO: 756169 - RNA, 12 nt, Homo sapiens
caaacaucuaau

SEQ ID NO: 756170 - RNA, 13 nt, Homo sapiens
caaacaugcaaga

SEQ ID NO: 756171 - RNA, 20 nt, Homo sapiens
caaacauggagaaaucuacu

SEQ ID NO: 756172 - RNA, 14 nt, Homo sapiens
caaacauuugccaa

SEQ ID NO: 756173 - RNA, 21 nt, Homo sapiens
caaaccaaaccccguagcucc

SEQ ID NO: 756174 - RNA, 17 nt, Homo sapiens
caaaccgagugcaauga

SEQ ID NO: 756175 - RNA, 17 nt, Homo sapiens
caaaccugaccacagaa

SEQ ID NO: 756176 - RNA, 16 nt, Homo sapiens
caaaccugaguaucag

SEQ ID NO: 756177 - RNA, 14 nt, Homo sapiens
caaaccuguuuaaa

SEQ ID NO: 756178 - RNA, 19 nt, Homo sapiens
caaacgggcugcccugcca

SEQ ID NO: 756179 - RNA, 18 nt, Homo sapiens
caaacuacagaauaaugu

SEQ ID NO: 756180 - RNA, 14 nt, Homo sapiens
caaacuacauguaa

SEQ ID NO: 756181 - RNA, 15 nt, Homo sapiens
caaacuacauguaau

SEQ ID NO: 756182 - RNA, 16 nt, Homo sapiens
caaacuacauguaauc

SEQ ID NO: 756183 - RNA, 19 nt, Homo sapiens
caaacucaccuugucucau

SEQ ID NO: 756184 - RNA, 17 nt, Homo sapiens
caaacucacugcucaag

SEQ ID NO: 756185 - RNA, 21 nt, Homo sapiens
caaacucacugcucaagaaga

SEQ ID NO: 756186 - RNA, 21 nt, Homo sapiens
caaacuccugaccucaaguga

SEQ ID NO: 756187 - RNA, 20 nt, Homo sapiens
ucugaaucagccagucucag

SEQ ID NO: 756188 - RNA, 18 nt, Homo sapiens
ucugaaugggagccagaa

SEQ ID NO: 756189 - RNA, 14 nt, Homo sapiens
ucugaauugcacau

SEQ ID NO: 756190 - RNA, 17 nt, Homo sapiens
ucugaauuuugcaaugu

SEQ ID NO: 756191 - RNA, 12 nt, Homo sapiens
ucugacacugaa

SEQ ID NO: 756192 - RNA, 13 nt, Homo sapiens
ucugacaguacca

SEQ ID NO: 756193 - RNA, 18 nt, Homo sapiens
ucugaccauuucaggggu

SEQ ID NO: 756194 - RNA, 12 nt, Homo sapiens
ucugacccagug

SEQ ID NO: 756195 - RNA, 18 nt, Homo sapiens
ucugacuacuuguuguau

SEQ ID NO: 756196 - RNA, 21 nt, Homo sapiens
ucugacucauccccacagcug

SEQ ID NO: 756197 - RNA, 18 nt, Homo sapiens
ucugacugccaagccaga

SEQ ID NO: 756198 - RNA, 19 nt, Homo sapiens
ucugacuuaagcaaaagaa

SEQ ID NO: 756199 - RNA, 19 nt, Homo sapiens
ucugagaaacucuacaugu

SEQ ID NO: 756200 - RNA, 23 nt, Homo sapiens
ucugagaagacacaaggugauuu

SEQ ID NO: 756201 - RNA, 21 nt, Homo sapiens
ucugagaaucacggugguaaa

SEQ ID NO: 756202 - RNA, 18 nt, Homo sapiens
ucugagacagaaucucag

SEQ ID NO: 756203 - RNA, 14 nt, Homo sapiens
ucugagacagcagu

SEQ ID NO: 756204 - RNA, 23 nt, Homo sapiens
ucugagaccacuugggcgcuguu

SEQ ID NO: 756205 - RNA, 22 nt, Homo sapiens
ucugagacuccucauaccucag

SEQ ID NO: 756206 - RNA, 21 nt, Homo sapiens
ucugagcccccacugcuucua

SEQ ID NO: 756207 - RNA, 19 nt, Homo sapiens
ucugagccgucagagcagu

SEQ ID NO: 756208 - RNA, 20 nt, Homo sapiens
ucugagccgucagagcagug

SEQ ID NO: 756209 - RNA, 23 nt, Homo sapiens
ucugagcuguaauuucgccuuaa

SEQ ID NO: 756210 - RNA, 16 nt, Homo sapiens
ucugaggccugaguga

SEQ ID NO: 756211 - RNA, 17 nt, Homo sapiens
ucugagggggugggggu

SEQ ID NO: 756212 - RNA, 18 nt, Homo sapiens
ucugagggggugggggug

SEQ ID NO: 756213 - RNA, 20 nt, Homo sapiens
ucugagucuauguucaaaga

SEQ ID NO: 756214 - RNA, 19 nt, Homo sapiens
ucugagugggcccagcaca

SEQ ID NO: 756215 - RNA, 23 nt, Homo sapiens
ucugagugggcccagcacauggc

SEQ ID NO: 756216 - RNA, 15 nt, Homo sapiens
ucugauaacagaauu

SEQ ID NO: 756217 - RNA, 22 nt, Homo sapiens
ucugauaugcaguuuuccuuaa

SEQ ID NO: 756218 - RNA, 18 nt, Homo sapiens
ucugaucauguaugcauc

SEQ ID NO: 756219 - RNA, 14 nt, Homo sapiens
ucugaugucuccac

SEQ ID NO: 756220 - RNA, 14 nt, Homo sapiens
ucugauguuaacca

SEQ ID NO: 756221 - RNA, 15 nt, Homo sapiens
ucugauuacugucca

SEQ ID NO: 756222 - RNA, 17 nt, Homo sapiens
ucugauucuacagugau

SEQ ID NO: 756223 - RNA, 15 nt, Homo sapiens
ucugauuuacauuca

SEQ ID NO: 756224 - RNA, 20 nt, Homo sapiens
ucugauuuuggccaucagga

SEQ ID NO: 756225 - RNA, 21 nt, Homo sapiens
ucugcaagcacaucugcauuu

SEQ ID NO: 756226 - RNA, 18 nt, Homo sapiens
ucugcaaggucuuugguu

SEQ ID NO: 756227 - RNA, 16 nt, Homo sapiens
ucugcacacaaaacuc

SEQ ID NO: 756228 - RNA, 12 nt, Homo sapiens
ucugcacuucau

SEQ ID NO: 756229 - RNA, 17 nt, Homo sapiens
ucugcagaaacuacuga

SEQ ID NO: 756230 - RNA, 19 nt, Homo sapiens
ucugcagagucacucacac

SEQ ID NO: 756231 - RNA, 22 nt, Homo sapiens
ucugcagauagaaagcauuaca

SEQ ID NO: 756232 - RNA, 19 nt, Homo sapiens
ucugcagcacucuuaucua

SEQ ID NO: 756233 - RNA, 18 nt, Homo sapiens
ucugccaccacaccuggc

SEQ ID NO: 756234 - RNA, 16 nt, Homo sapiens
ucugccacccaguccu

SEQ ID NO: 756235 - RNA, 17 nt, Homo sapiens
ucugccacccuaccugu

SEQ ID NO: 756236 - RNA, 21 nt, Homo sapiens
ucugccacuugucaaagaagg

SEQ ID NO: 756237 - RNA, 18 nt, Homo sapiens
ucugccagccagcagcca

SEQ ID NO: 756238 - RNA, 20 nt, Homo sapiens
ucugcccagcuugggcccag

SEQ ID NO: 756239 - RNA, 13 nt, Homo sapiens
ucugcccaggugu

SEQ ID NO: 756240 - RNA, 15 nt, Homo sapiens
ucugcccaugggaag

SEQ ID NO: 756241 - RNA, 16 nt, Homo sapiens
ucugccccagcccaga

SEQ ID NO: 756242 - RNA, 15 nt, Homo sapiens
ucugccccagccugu

SEQ ID NO: 756243 - RNA, 21 nt, Homo sapiens
ucugcccccgcggguucuaga

SEQ ID NO: 756244 - RNA, 18 nt, Homo sapiens
ucugcccggcuacaucag

SEQ ID NO: 756245 - RNA, 19 nt, Homo sapiens
ucugcccuguguacuuccc

SEQ ID NO: 756246 - RNA, 14 nt, Homo sapiens
ucugcccuuguucc

SEQ ID NO: 756247 - RNA, 17 nt, Homo sapiens
ucugccuaacuuguaaa

SEQ ID NO: 756248 - RNA, 18 nt, Homo sapiens
ucugccuacaaaaccuca

SEQ ID NO: 756249 - RNA, 21 nt, Homo sapiens
ucugccuagaguguagccuaa

SEQ ID NO: 756250 - RNA, 16 nt, Homo sapiens
ucugccucccuagcuu

SEQ ID NO: 756251 - RNA, 15 nt, Homo sapiens
ucugccugaaccugg

SEQ ID NO: 756252 - RNA, 14 nt, Homo sapiens
ucugccugagauuc

SEQ ID NO: 756253 - RNA, 23 nt, Homo sapiens
ucugccuguggccuugcccgcca

SEQ ID NO: 756254 - RNA, 15 nt, Homo sapiens
ucugccuuuucacug

SEQ ID NO: 756255 - RNA, 14 nt, Homo sapiens
ucugcgcaccaagg

SEQ ID NO: 756256 - RNA, 13 nt, Homo sapiens
ucugcggaucuca

SEQ ID NO: 756257 - RNA, 14 nt, Homo sapiens
ucugcuaaauauca

SEQ ID NO: 756258 - RNA, 15 nt, Homo sapiens
ucugcuaaauaucac

SEQ ID NO: 756259 - RNA, 18 nt, Homo sapiens
ucugcuaccucacugggg

SEQ ID NO: 756260 - RNA, 13 nt, Homo sapiens
ucugcucacuuua

SEQ ID NO: 756261 - RNA, 13 nt, Homo sapiens
ucugcucccucug

SEQ ID NO: 756262 - RNA, 18 nt, Homo sapiens
ucugcugcauagcucuau

SEQ ID NO: 756263 - RNA, 16 nt, Homo sapiens
ucugcugggcucugcc

SEQ ID NO: 756264 - RNA, 23 nt, Homo sapiens
ucugcuggggauggccacuguga

SEQ ID NO: 756265 - RNA, 21 nt, Homo sapiens
ucugcugguaccuauuuguca

SEQ ID NO: 756266 - RNA, 15 nt, Homo sapiens
ucugcuucagugcag

SEQ ID NO: 756267 - RNA, 16 nt, Homo sapiens
ucugcuucagugcagu

SEQ ID NO: 756268 - RNA, 23 nt, Homo sapiens
ucuggaaaaauaaguacauauag

SEQ ID NO: 756269 - RNA, 18 nt, Homo sapiens
ucuggaaaagcuggggua

SEQ ID NO: 756270 - RNA, 14 nt, Homo sapiens
ucuggaacaacuug

SEQ ID NO: 756271 - RNA, 20 nt, Homo sapiens
ucuggaagccuggacucuaa

SEQ ID NO: 756272 - RNA, 14 nt, Homo sapiens
ucuggaagucaucu

SEQ ID NO: 756273 - RNA, 14 nt, Homo sapiens
ucuggaaguggagu

SEQ ID NO: 756274 - RNA, 22 nt, Homo sapiens
ucuggaaguuucuggugccauu

SEQ ID NO: 756275 - RNA, 21 nt, Homo sapiens
ucuggaggacggucaguccau

SEQ ID NO: 756276 - RNA, 16 nt, Homo sapiens
ucuggagucacaucag

SEQ ID NO: 756277 - RNA, 20 nt, Homo sapiens
ucuggauuagaaugccgguu

SEQ ID NO: 756278 - RNA, 22 nt, Homo sapiens
ucuggauuguuuuuaaaccucc

SEQ ID NO: 756279 - RNA, 18 nt, Homo sapiens
ucuggcaaauaacaguaa

SEQ ID NO: 756280 - RNA, 23 nt, Homo sapiens
ucuggcaauggaugaacugaaag

SEQ ID NO: 756281 - RNA, 19 nt, Homo sapiens
ucuggcagagucagcugcu

SEQ ID NO: 756282 - RNA, 12 nt, Homo sapiens
ucuggcaugaau

SEQ ID NO: 756283 - RNA, 18 nt, Homo sapiens
ucuggccaaaagcaguaa

SEQ ID NO: 756284 - RNA, 15 nt, Homo sapiens
ucuggccccugagag

SEQ ID NO: 756285 - RNA, 20 nt, Homo sapiens
ucuggcccuugcuuaccucu

SEQ ID NO: 756286 - RNA, 17 nt, Homo sapiens
ucuggccggagcugccu

SEQ ID NO: 756287 - RNA, 20 nt, Homo sapiens
ucuggccuugaaaccaccuu

SEQ ID NO: 756288 - RNA, 18 nt, Homo sapiens
ucuggcugaacccugugc

SEQ ID NO: 756289 - RNA, 23 nt, Homo sapiens
ucuggcugccccaaccugcugaa

SEQ ID NO: 756290 - RNA, 16 nt, Homo sapiens
ucuggcuuagugccac

SEQ ID NO: 756291 - RNA, 15 nt, Homo sapiens
ucugggagaaaauca

SEQ ID NO: 756292 - RNA, 18 nt, Homo sapiens
ucugggauuaagggcaaa

SEQ ID NO: 756293 - RNA, 15 nt, Homo sapiens
ucugggcaccaccuc

SEQ ID NO: 756294 - RNA, 17 nt, Homo sapiens
ucugggccacucaggcc

SEQ ID NO: 756295 - RNA, 18 nt, Homo sapiens
ucugggccagaaguccuc

SEQ ID NO: 756296 - RNA, 14 nt, Homo sapiens
ucugggcugucagc

SEQ ID NO: 756297 - RNA, 22 nt, Homo sapiens
ucugggcugucagcccaugugc

SEQ ID NO: 756298 - RNA, 23 nt, Homo sapiens
ucuggggaggcaggcauuccuga

SEQ ID NO: 756299 - RNA, 12 nt, Homo sapiens
ucuggggguccu

SEQ ID NO: 756300 - RNA, 17 nt, Homo sapiens
ucuggggugagggaguu

SEQ ID NO: 756301 - RNA, 13 nt, Homo sapiens
caaacucuucagu

SEQ ID NO: 756302 - RNA, 15 nt, Homo sapiens
caaacugaggaauuu

SEQ ID NO: 756303 - RNA, 21 nt, Homo sapiens
caaacugccuuggcuucaggg

SEQ ID NO: 756304 - RNA, 21 nt, Homo sapiens
caaacugcuuuuuccaacuca

SEQ ID NO: 756305 - RNA, 22 nt, Homo sapiens
caaacuggcugcuuuguucaau

SEQ ID NO: 756306 - RNA, 20 nt, Homo sapiens
caaacuguagaaaugaugau

SEQ ID NO: 756307 - RNA, 19 nt, Homo sapiens
caaacugugaaaauagugu

SEQ ID NO: 756308 - RNA, 15 nt, Homo sapiens
caaacuucaaagagg

SEQ ID NO: 756309 - RNA, 21 nt, Homo sapiens
caaacuugagaaaauaucuug

SEQ ID NO: 756310 - RNA, 14 nt, Homo sapiens
caaacuuguucaaa

SEQ ID NO: 756311 - RNA, 18 nt, Homo sapiens
caaacuuuagcaacaguu

SEQ ID NO: 756312 - RNA, 15 nt, Homo sapiens
caaacuuucacuuug

SEQ ID NO: 756313 - RNA, 20 nt, Homo sapiens
caaagaaauuccccaagcac

SEQ ID NO: 756314 - RNA, 22 nt, Homo sapiens
caaagaacaaacauccuugcaa

SEQ ID NO: 756315 - RNA, 14 nt, Homo sapiens
caaagaaugggcuu

SEQ ID NO: 756316 - RNA, 19 nt, Homo sapiens
caaagacauagaugugaaa

SEQ ID NO: 756317 - RNA, 18 nt, Homo sapiens
caaagacaucagucucca

SEQ ID NO: 756318 - RNA, 11 nt, Homo sapiens
caaagacugua

SEQ ID NO: 756319 - RNA, 12 nt, Homo sapiens
caaagacuguau

SEQ ID NO: 756320 - RNA, 22 nt, Homo sapiens
caaagagaaaaagaaaugcaaa

SEQ ID NO: 756321 - RNA, 19 nt, Homo sapiens
caaagagaaaucacagggg

SEQ ID NO: 756322 - RNA, 16 nt, Homo sapiens
caaagagagaaaguuu

SEQ ID NO: 756323 - RNA, 15 nt, Homo sapiens
caaagagguguacag

SEQ ID NO: 756324 - RNA, 13 nt, Homo sapiens
caaagaugcauuu

SEQ ID NO: 756325 - RNA, 20 nt, Homo sapiens
caaagaugcccccuccagga

SEQ ID NO: 756326 - RNA, 21 nt, Homo sapiens
caaagauuaaaugugucauug

SEQ ID NO: 756327 - RNA, 19 nt, Homo sapiens
caaagauuucucaguauca

SEQ ID NO: 756328 - RNA, 16 nt, Homo sapiens
caaagcacaguuugaa

SEQ ID NO: 756329 - RNA, 10 nt, Homo sapiens
caaagccaaa

SEQ ID NO: 756330 - RNA, 13 nt, Homo sapiens
caaagccaaaacc

SEQ ID NO: 756331 - RNA, 20 nt, Homo sapiens
caaagccacauuauuucuag

SEQ ID NO: 756332 - RNA, 20 nt, Homo sapiens
caaagccacccuaccaugaa

SEQ ID NO: 756333 - RNA, 14 nt, Homo sapiens
caaagccacuggaa

SEQ ID NO: 756334 - RNA, 18 nt, Homo sapiens
caaagcccauagcacugg

SEQ ID NO: 756335 - RNA, 14 nt, Homo sapiens
caaagccuuacaaa

SEQ ID NO: 756336 - RNA, 18 nt, Homo sapiens
caaaggacagaguaugaa

SEQ ID NO: 756337 - RNA, 20 nt, Homo sapiens
caaaggacagaguaugaaca

SEQ ID NO: 756338 - RNA, 15 nt, Homo sapiens
caaaggcacugaggc

SEQ ID NO: 756339 - RNA, 23 nt, Homo sapiens
caaaggcacugaggcccagggag

SEQ ID NO: 756340 - RNA, 17 nt, Homo sapiens
caaaggcauaucuucua

SEQ ID NO: 756341 - RNA, 17 nt, Homo sapiens
caaagggaacagugaau

SEQ ID NO: 756342 - RNA, 20 nt, Homo sapiens
caaagggaggaggugcacag

SEQ ID NO: 756343 - RNA, 14 nt, Homo sapiens
caaagggauguuca

SEQ ID NO: 756344 - RNA, 19 nt, Homo sapiens
caaagggauguucacugua

SEQ ID NO: 756345 - RNA, 15 nt, Homo sapiens
caaagggcaguuuug

SEQ ID NO: 756346 - RNA, 19 nt, Homo sapiens
caaagguuccaacuguaua

SEQ ID NO: 756347 - RNA, 17 nt, Homo sapiens
caaagguugcagugcug

SEQ ID NO: 756348 - RNA, 17 nt, Homo sapiens
caaaguaaauucuuagc

SEQ ID NO: 756349 - RNA, 15 nt, Homo sapiens
caaaguacauuguaa

SEQ ID NO: 756350 - RNA, 14 nt, Homo sapiens
caaaguacucuuua

SEQ ID NO: 756351 - RNA, 15 nt, Homo sapiens
caaaguagaagucuu

SEQ ID NO: 756352 - RNA, 15 nt, Homo sapiens
caaaguagcaauuuc

SEQ ID NO: 756353 - RNA, 24 nt, Homo sapiens
caaaguauaaccauaugauacuau

SEQ ID NO: 756354 - RNA, 13 nt, Homo sapiens
caaaguauuaagu

SEQ ID NO: 756355 - RNA, 14 nt, Homo sapiens
caaaguauuugcug

SEQ ID NO: 756356 - RNA, 18 nt, Homo sapiens
caaaguccucugcuccag

SEQ ID NO: 756357 - RNA, 17 nt, Homo sapiens
caaaguccugggauuac

SEQ ID NO: 756358 - RNA, 21 nt, Homo sapiens
caaagucgccagucacugcug

SEQ ID NO: 756359 - RNA, 12 nt, Homo sapiens
caaagugaggag

SEQ ID NO: 756360 - RNA, 21 nt, Homo sapiens
caaagugccagagucuaggcu

SEQ ID NO: 756361 - RNA, 18 nt, Homo sapiens
caaagugcugagauuaca

SEQ ID NO: 756362 - RNA, 19 nt, Homo sapiens
caaagugcugggauuacag

SEQ ID NO: 756363 - RNA, 23 nt, Homo sapiens
caaagugcugggauuacuggcau

SEQ ID NO: 756364 - RNA, 17 nt, Homo sapiens
caaagugugauauacaa

SEQ ID NO: 756365 - RNA, 18 nt, Homo sapiens
caaaguguuguguuccug

SEQ ID NO: 756366 - RNA, 22 nt, Homo sapiens
caaaguuacugauucacugcau

SEQ ID NO: 756367 - RNA, 12 nt, Homo sapiens
caaauaaacuca

SEQ ID NO: 756368 - RNA, 16 nt, Homo sapiens
caaauaaagauaaccc

SEQ ID NO: 756369 - RNA, 22 nt, Homo sapiens
caaauaaaucauccucaugucc

SEQ ID NO: 756370 - RNA, 15 nt, Homo sapiens
caaauaacagucuga

SEQ ID NO: 756371 - RNA, 17 nt, Homo sapiens
caaauaacugaugaagg

SEQ ID NO: 756372 - RNA, 13 nt, Homo sapiens
caaauaauagcaa

SEQ ID NO: 756373 - RNA, 14 nt, Homo sapiens
caaauaauagcaau

SEQ ID NO: 756374 - RNA, 14 nt, Homo sapiens
caaauaaugaauuu

SEQ ID NO: 756375 - RNA, 17 nt, Homo sapiens
caaauaauuccauucca

SEQ ID NO: 756376 - RNA, 12 nt, Homo sapiens
caaauacaauca

SEQ ID NO: 756377 - RNA, 16 nt, Homo sapiens
caaauacacauuugcu

SEQ ID NO: 756378 - RNA, 22 nt, Homo sapiens
caaauagaaccacuaugaagcu

SEQ ID NO: 756379 - RNA, 16 nt, Homo sapiens
caaauaguagacauuu

SEQ ID NO: 756380 - RNA, 13 nt, Homo sapiens
caaauaguuucaa

SEQ ID NO: 756381 - RNA, 18 nt, Homo sapiens
caaaucacauauuuuaaa

SEQ ID NO: 756382 - RNA, 15 nt, Homo sapiens
caaaucagcugcuac

SEQ ID NO: 756383 - RNA, 17 nt, Homo sapiens
caaauccucuaauugca

SEQ ID NO: 756384 - RNA, 22 nt, Homo sapiens
caaauccuucaaaauaaaaagu

SEQ ID NO: 756385 - RNA, 20 nt, Homo sapiens
caaaucuacgguuaugaagg

SEQ ID NO: 756386 - RNA, 21 nt, Homo sapiens
caaaucuacgguuaugaaggc

SEQ ID NO: 756387 - RNA, 13 nt, Homo sapiens
caaaucucucaua

SEQ ID NO: 756388 - RNA, 20 nt, Homo sapiens
caaaucucuuccacaugggu

SEQ ID NO: 756389 - RNA, 17 nt, Homo sapiens
caaaucugauggccuua

SEQ ID NO: 756390 - RNA, 21 nt, Homo sapiens
caaaucuggguaucuuuccag

SEQ ID NO: 756391 - RNA, 18 nt, Homo sapiens
caaaucuguaaucagcaa

SEQ ID NO: 756392 - RNA, 16 nt, Homo sapiens
caaaucuuaacuugaa

SEQ ID NO: 756393 - RNA, 14 nt, Homo sapiens
caaaucuuguuuac

SEQ ID NO: 756394 - RNA, 15 nt, Homo sapiens
caaaugaaauguaug

SEQ ID NO: 756395 - RNA, 17 nt, Homo sapiens
caaaugaaauucugccu

SEQ ID NO: 756396 - RNA, 18 nt, Homo sapiens
caaaugaugccacuuccc

SEQ ID NO: 756397 - RNA, 17 nt, Homo sapiens
caaaugauuuccacaaa

SEQ ID NO: 756398 - RNA, 21 nt, Homo sapiens
caaaugauuuccacaaacaga

SEQ ID NO: 756399 - RNA, 18 nt, Homo sapiens
caaaugcaaauucaucau

SEQ ID NO: 756400 - RNA, 19 nt, Homo sapiens
caaaugcaauuuccaacac

SEQ ID NO: 756401 - RNA, 14 nt, Homo sapiens
caaaugcacaucuc

SEQ ID NO: 756402 - RNA, 15 nt, Homo sapiens
caaaugcacaucuca

SEQ ID NO: 756403 - RNA, 16 nt, Homo sapiens
caaaugcacaucucau

SEQ ID NO: 756404 - RNA, 20 nt, Homo sapiens
caaaugcaguucauugcaga

SEQ ID NO: 756405 - RNA, 20 nt, Homo sapiens
caaaugcauacaaguuucau

SEQ ID NO: 756406 - RNA, 19 nt, Homo sapiens
caaaugccugguaccagag

SEQ ID NO: 756407 - RNA, 23 nt, Homo sapiens
caaaugcuucuaaauaugaagga

SEQ ID NO: 756408 - RNA, 15 nt, Homo sapiens
caaaugcuuuggacu

SEQ ID NO: 756409 - RNA, 16 nt, Homo sapiens
caaaugcuuuuccuca

SEQ ID NO: 756410 - RNA, 13 nt, Homo sapiens
caaauggacauag

SEQ ID NO: 756411 - RNA, 16 nt, Homo sapiens
caaauggcagaaccaa

SEQ ID NO: 756412 - RNA, 20 nt, Homo sapiens
caaauggggcaaacagucua

SEQ ID NO: 756413 - RNA, 20 nt, Homo sapiens
caaauguacagugguccuuu

SEQ ID NO: 756414 - RNA, 15 nt, Homo sapiens
caaauguauagacuu

SEQ ID NO: 756415 - RNA, 17 nt, Homo sapiens
caaaugucauugucuac

SEQ ID NO: 756416 - RNA, 16 nt, Homo sapiens
caaauguuaugcauaa

SEQ ID NO: 756417 - RNA, 16 nt, Homo sapiens
caaauuauucuaguca

SEQ ID NO: 756418 - RNA, 21 nt, Homo sapiens
caaauucauggugcacugagc

SEQ ID NO: 756419 - RNA, 19 nt, Homo sapiens
caaauucuguuucuugaga

SEQ ID NO: 756420 - RNA, 13 nt, Homo sapiens
caaauugcugcuu

SEQ ID NO: 756421 - RNA, 15 nt, Homo sapiens
caaauugcuuuacag

SEQ ID NO: 756422 - RNA, 18 nt, Homo sapiens
caaauuuggccuuaagaa

SEQ ID NO: 756423 - RNA, 20 nt, Homo sapiens
caaauuuuagaacuuuaccu

SEQ ID NO: 756424 - RNA, 16 nt, Homo sapiens
caaauuuugauccuaa

SEQ ID NO: 756425 - RNA, 17 nt, Homo sapiens
caaauuuuuacugagaa

SEQ ID NO: 756426 - RNA, 23 nt, Homo sapiens
caacaaaauggucauccaaacuc

SEQ ID NO: 756427 - RNA, 11 nt, Homo sapiens
caacaaaccau

SEQ ID NO: 756428 - RNA, 19 nt, Homo sapiens
caacaaaccauccagugac

SEQ ID NO: 756429 - RNA, 23 nt, Homo sapiens
caacaaagauugagaagccaugu

SEQ ID NO: 756430 - RNA, 19 nt, Homo sapiens
caacaaagcgagaucccau

SEQ ID NO: 756431 - RNA, 21 nt, Homo sapiens
caacaaaggcugaacuggauu

SEQ ID NO: 756432 - RNA, 22 nt, Homo sapiens
caacaaauuaacuagauacaga

SEQ ID NO: 756433 - RNA, 15 nt, Homo sapiens
caacaacaauaauaa

SEQ ID NO: 756434 - RNA, 15 nt, Homo sapiens
caacaagaauauugu

SEQ ID NO: 756435 - RNA, 21 nt, Homo sapiens
caacaagauccuuaaugcaga

SEQ ID NO: 756436 - RNA, 14 nt, Homo sapiens
caacaagccauagu

SEQ ID NO: 756437 - RNA, 17 nt, Homo sapiens
caacaauaaaguacuuu

SEQ ID NO: 756438 - RNA, 19 nt, Homo sapiens
caacaauacaugcugcuaa

SEQ ID NO: 756439 - RNA, 21 nt, Homo sapiens
caacaauccaucucucaagua

SEQ ID NO: 756440 - RNA, 18 nt, Homo sapiens
caacaaucucaauuccau

SEQ ID NO: 756441 - RNA, 14 nt, Homo sapiens
caacaaugacuuaa

SEQ ID NO: 756442 - RNA, 19 nt, Homo sapiens
caacaauggggugggccca

SEQ ID NO: 756443 - RNA, 20 nt, Homo sapiens
caacaauugugugaauuaau

SEQ ID NO: 756444 - RNA, 21 nt, Homo sapiens
caacacaguugggacccaaaa

SEQ ID NO: 756445 - RNA, 15 nt, Homo sapiens
caacaccacuaggaa

SEQ ID NO: 756446 - RNA, 17 nt, Homo sapiens
caacacugcuguccaca

SEQ ID NO: 756447 - RNA, 11 nt, Homo sapiens
caacacuggaa

SEQ ID NO: 756448 - RNA, 17 nt, Homo sapiens
caacacuuucugcacuu

SEQ ID NO: 756449 - RNA, 15 nt, Homo sapiens
caacagaaaccagaa

SEQ ID NO: 756450 - RNA, 20 nt, Homo sapiens
caacagaacuucacagugac

SEQ ID NO: 756451 - RNA, 13 nt, Homo sapiens
caacagacuugaa

SEQ ID NO: 756452 - RNA, 16 nt, Homo sapiens
caacagauuauuaccu

SEQ ID NO: 756453 - RNA, 16 nt, Homo sapiens
caacagcuucagucca

SEQ ID NO: 756454 - RNA, 23 nt, Homo sapiens
caacagcuuuucgucuucagugu

SEQ ID NO: 756455 - RNA, 19 nt, Homo sapiens
caacaggaaggaaccagaa

SEQ ID NO: 756456 - RNA, 16 nt, Homo sapiens
caacaggaaucucaga

SEQ ID NO: 756457 - RNA, 22 nt, Homo sapiens
caacaggcuguucugcacugaa

SEQ ID NO: 756458 - RNA, 23 nt, Homo sapiens
caacaggcuguucugcacugaaa

SEQ ID NO: 756459 - RNA, 15 nt, Homo sapiens
caacaguaugcacaa

SEQ ID NO: 756460 - RNA, 14 nt, Homo sapiens
caacaguuaucaca

SEQ ID NO: 756461 - RNA, 15 nt, Homo sapiens
caacaguucugagcu

SEQ ID NO: 756462 - RNA, 22 nt, Homo sapiens
caacauaauuaaauuuugaguu

SEQ ID NO: 756463 - RNA, 13 nt, Homo sapiens
caacaucauucca

SEQ ID NO: 756464 - RNA, 16 nt, Homo sapiens
caacauccuuaaguca

SEQ ID NO: 756465 - RNA, 21 nt, Homo sapiens
caacaucgugaaaccccaucu

SEQ ID NO: 756466 - RNA, 16 nt, Homo sapiens
caacaucucgagcccc

SEQ ID NO: 756467 - RNA, 16 nt, Homo sapiens
caacaugcacugaugu

SEQ ID NO: 756468 - RNA, 23 nt, Homo sapiens
caacauggucuaauuauuuacuc

SEQ ID NO: 756469 - RNA, 14 nt, Homo sapiens
caacauuaacauug

SEQ ID NO: 756470 - RNA, 13 nt, Homo sapiens
caacauucuuugc

SEQ ID NO: 756471 - RNA, 17 nt, Homo sapiens
caacauuuacauguauu

SEQ ID NO: 756472 - RNA, 22 nt, Homo sapiens
caaccaagaauguuaugugcaa

SEQ ID NO: 756473 - RNA, 18 nt, Homo sapiens
caaccaauuuacacugcc

SEQ ID NO: 756474 - RNA, 16 nt, Homo sapiens
caaccagagcagcuca

SEQ ID NO: 756475 - RNA, 16 nt, Homo sapiens
caaccaggaguaccug

SEQ ID NO: 756476 - RNA, 17 nt, Homo sapiens
caaccauagaacugucc

SEQ ID NO: 756477 - RNA, 21 nt, Homo sapiens
caaccauuagauaaacacagg

SEQ ID NO: 756478 - RNA, 14 nt, Homo sapiens
caacccccaucucc

SEQ ID NO: 756479 - RNA, 17 nt, Homo sapiens
caaccccccaccugcca

SEQ ID NO: 756480 - RNA, 22 nt, Homo sapiens
caacccgaguuaccacuuucca

SEQ ID NO: 756481 - RNA, 14 nt, Homo sapiens
caacccggcacugc

SEQ ID NO: 756482 - RNA, 22 nt, Homo sapiens
caacccgucuggcccaccaggg

SEQ ID NO: 756483 - RNA, 13 nt, Homo sapiens
caacccuaucucc

SEQ ID NO: 756484 - RNA, 19 nt, Homo sapiens
caacccugcccugccccac

SEQ ID NO: 756485 - RNA, 12 nt, Homo sapiens
caaccuacuguc

SEQ ID NO: 756486 - RNA, 18 nt, Homo sapiens
caaccucauuuuaacuca

SEQ ID NO: 756487 - RNA, 13 nt, Homo sapiens
caaccucccaucc

SEQ ID NO: 756488 - RNA, 21 nt, Homo sapiens
caaccugaaauuuauucacau

SEQ ID NO: 756489 - RNA, 18 nt, Homo sapiens
caaccugauuacagaaua

SEQ ID NO: 756490 - RNA, 23 nt, Homo sapiens
caaccuguuuuggucacaucacu

SEQ ID NO: 756491 - RNA, 14 nt, Homo sapiens
caaccuuccagcuc

SEQ ID NO: 756492 - RNA, 13 nt, Homo sapiens
caacgaagccgga

SEQ ID NO: 756493 - RNA, 19 nt, Homo sapiens
caacgagacacauugccuu

SEQ ID NO: 756494 - RNA, 21 nt, Homo sapiens
caacgcacaggaaaagguagc

SEQ ID NO: 756495 - RNA, 22 nt, Homo sapiens
caacguagcuucuaccaugaac

SEQ ID NO: 756496 - RNA, 16 nt, Homo sapiens
caacguggcccagaga

SEQ ID NO: 756497 - RNA, 13 nt, Homo sapiens
caacgugugaacu

SEQ ID NO: 756498 - RNA, 14 nt, Homo sapiens
caacgugugggcag

SEQ ID NO: 756499 - RNA, 14 nt, Homo sapiens
caacuaaugccuua

SEQ ID NO: 756500 - RNA, 15 nt, Homo sapiens
caacuaccauuccuu

SEQ ID NO: 756501 - RNA, 19 nt, Homo sapiens
caacuacccaccuggggau

SEQ ID NO: 756502 - RNA, 11 nt, Homo sapiens
caacuaccuga

SEQ ID NO: 756503 - RNA, 14 nt, Homo sapiens
caacuacuacuggu

SEQ ID NO: 756504 - RNA, 13 nt, Homo sapiens
caacuaggccuca

SEQ ID NO: 756505 - RNA, 21 nt, Homo sapiens
caacuaguagcuaaccaucac

SEQ ID NO: 756506 - RNA, 15 nt, Homo sapiens
caacucacagcuucu

SEQ ID NO: 756507 - RNA, 22 nt, Homo sapiens
caacuccaggauuuaggccuua

SEQ ID NO: 756508 - RNA, 15 nt, Homo sapiens
caacucgaacugcuu

SEQ ID NO: 756509 - RNA, 16 nt, Homo sapiens
caacucuucgaagccu

SEQ ID NO: 756510 - RNA, 12 nt, Homo sapiens
caacugacacag

SEQ ID NO: 756511 - RNA, 22 nt, Homo sapiens
caacugaccugaccccauuccu

SEQ ID NO: 756512 - RNA, 14 nt, Homo sapiens
caacugauugcaac

SEQ ID NO: 756513 - RNA, 15 nt, Homo sapiens
caacugauugcaaca

SEQ ID NO: 756514 - RNA, 17 nt, Homo sapiens
caacugcaaaaaaagcc

SEQ ID NO: 756515 - RNA, 19 nt, Homo sapiens
caacuggcugaaagguuaa

SEQ ID NO: 756516 - RNA, 13 nt, Homo sapiens
caacugugacugu

SEQ ID NO: 756517 - RNA, 21 nt, Homo sapiens
caacuuaagcugggauaauca

SEQ ID NO: 756518 - RNA, 19 nt, Homo sapiens
caacuuaaguugguccuuu

SEQ ID NO: 756519 - RNA, 17 nt, Homo sapiens
caacuuauuauaugacu

SEQ ID NO: 756520 - RNA, 18 nt, Homo sapiens
caacuuauuuuuguucau

SEQ ID NO: 756521 - RNA, 14 nt, Homo sapiens
caacuucaagggac

SEQ ID NO: 756522 - RNA, 14 nt, Homo sapiens
caacuucauuugac

SEQ ID NO: 756523 - RNA, 16 nt, Homo sapiens
caacuuggcauuucua

SEQ ID NO: 756524 - RNA, 19 nt, Homo sapiens
caacuugguucugcuucaa

SEQ ID NO: 756525 - RNA, 23 nt, Homo sapiens
caacuuguaacucuaugaacuua

SEQ ID NO: 756526 - RNA, 16 nt, Homo sapiens
caacuuguauuuccaa

SEQ ID NO: 756527 - RNA, 15 nt, Homo sapiens
caacuuuaagauaga

SEQ ID NO: 756528 - RNA, 16 nt, Homo sapiens
caagaaaaaaagggag

SEQ ID NO: 756529 - RNA, 15 nt, Homo sapiens
caagaaaacaacuuc

SEQ ID NO: 756530 - RNA, 14 nt, Homo sapiens
caagaaaaccuaga

SEQ ID NO: 756531 - RNA, 13 nt, Homo sapiens
auguuaacacuca

SEQ ID NO: 756532 - RNA, 20 nt, Homo sapiens
auguuaagggcuuuaauaca

SEQ ID NO: 756533 - RNA, 14 nt, Homo sapiens
auguuaaguuacag

SEQ ID NO: 756534 - RNA, 18 nt, Homo sapiens
auguuaauguuauaucau

SEQ ID NO: 756535 - RNA, 12 nt, Homo sapiens
auguuacagauu

SEQ ID NO: 756536 - RNA, 18 nt, Homo sapiens
auguuaccucugaauuua

SEQ ID NO: 756537 - RNA, 21 nt, Homo sapiens
auguuacuaaauuuucuaauu

SEQ ID NO: 756538 - RNA, 16 nt, Homo sapiens
auguuacugaccagca

SEQ ID NO: 756539 - RNA, 17 nt, Homo sapiens
auguuagacucugguca

SEQ ID NO: 756540 - RNA, 18 nt, Homo sapiens
auguuagcagacccagcu

SEQ ID NO: 756541 - RNA, 19 nt, Homo sapiens
auguuaggaaaauuucaca

SEQ ID NO: 756542 - RNA, 23 nt, Homo sapiens
auguuaggaaaauuucacauuaa

SEQ ID NO: 756543 - RNA, 20 nt, Homo sapiens
auguuaggccuaagaggcuu

SEQ ID NO: 756544 - RNA, 16 nt, Homo sapiens
auguuaguuaccuuau

SEQ ID NO: 756545 - RNA, 20 nt, Homo sapiens
auguuauacaauacagauca

SEQ ID NO: 756546 - RNA, 15 nt, Homo sapiens
auguuauucucucac

SEQ ID NO: 756547 - RNA, 13 nt, Homo sapiens
auguuauucuguu

SEQ ID NO: 756548 - RNA, 13 nt, Homo sapiens
auguucacuguga

SEQ ID NO: 756549 - RNA, 14 nt, Homo sapiens
auguucaugugauu

SEQ ID NO: 756550 - RNA, 15 nt, Homo sapiens
auguucaugugauua

SEQ ID NO: 756551 - RNA, 12 nt, Homo sapiens
auguuccaguga

SEQ ID NO: 756552 - RNA, 22 nt, Homo sapiens
auguuccccaucuggugcucuu

SEQ ID NO: 756553 - RNA, 14 nt, Homo sapiens
auguuccucaaaag

SEQ ID NO: 756554 - RNA, 19 nt, Homo sapiens
auguuccugaaaauugcaa

SEQ ID NO: 756555 - RNA, 16 nt, Homo sapiens
auguucugugacugaa

SEQ ID NO: 756556 - RNA, 22 nt, Homo sapiens
auguugauacuagcauacuuaa

SEQ ID NO: 756557 - RNA, 12 nt, Homo sapiens
auguugcuuaga

SEQ ID NO: 756558 - RNA, 20 nt, Homo sapiens
auguuggucugacaucaagg

SEQ ID NO: 756559 - RNA, 16 nt, Homo sapiens
auguuuaccaguguag

SEQ ID NO: 756560 - RNA, 21 nt, Homo sapiens
auguuuauaaaucuuaugcuc

SEQ ID NO: 756561 - RNA, 13 nt, Homo sapiens
auguuucaaaaaa

SEQ ID NO: 756562 - RNA, 15 nt, Homo sapiens
auguuucgcugauau

SEQ ID NO: 756563 - RNA, 19 nt, Homo sapiens
auguuucgcugauauaugu

SEQ ID NO: 756564 - RNA, 21 nt, Homo sapiens
auguuucucacauugcuguau

SEQ ID NO: 756565 - RNA, 18 nt, Homo sapiens
auguuucugcuagcuaua

SEQ ID NO: 756566 - RNA, 21 nt, Homo sapiens
auguuucugcuagcuauauau

SEQ ID NO: 756567 - RNA, 12 nt, Homo sapiens
auguuugcacac

SEQ ID NO: 756568 - RNA, 12 nt, Homo sapiens
auguuugcacuu

SEQ ID NO: 756569 - RNA, 18 nt, Homo sapiens
auguuugcacuugugcuu

SEQ ID NO: 756570 - RNA, 15 nt, Homo sapiens
auguuugcacuuugu

SEQ ID NO: 756571 - RNA, 18 nt, Homo sapiens
auguuuggaaaccacagu

SEQ ID NO: 756572 - RNA, 22 nt, Homo sapiens
auguuuggggaucgaugugcuc

SEQ ID NO: 756573 - RNA, 22 nt, Homo sapiens
auguuuguaaauuaauacuuca

SEQ ID NO: 756574 - RNA, 14 nt, Homo sapiens
auguuuuaacucuu

SEQ ID NO: 756575 - RNA, 19 nt, Homo sapiens
auguuuugagucagugcau

SEQ ID NO: 756576 - RNA, 21 nt, Homo sapiens
auguuuuuugccacagcuuuu

SEQ ID NO: 756577 - RNA, 14 nt, Homo sapiens
auuaaaaaacuuca

SEQ ID NO: 756578 - RNA, 20 nt, Homo sapiens
auuaaaacaauaaugcaauu

SEQ ID NO: 756579 - RNA, 13 nt, Homo sapiens
auuaaaauuccaa

SEQ ID NO: 756580 - RNA, 18 nt, Homo sapiens
auuaaaauuccaaauuca

SEQ ID NO: 756581 - RNA, 14 nt, Homo sapiens
auuaaacacaggga

SEQ ID NO: 756582 - RNA, 14 nt, Homo sapiens
auuaaacacuguaa

SEQ ID NO: 756583 - RNA, 20 nt, Homo sapiens
auuaaaccggaccaucucuc

SEQ ID NO: 756584 - RNA, 22 nt, Homo sapiens
auuaaaccggaccaucucucca

SEQ ID NO: 756585 - RNA, 23 nt, Homo sapiens
auuaaagaaagaaaaaugcugaa

SEQ ID NO: 756586 - RNA, 20 nt, Homo sapiens
auuaaagaugaccuacagug

SEQ ID NO: 756587 - RNA, 16 nt, Homo sapiens
auuaaagcauuuccua

SEQ ID NO: 756588 - RNA, 19 nt, Homo sapiens
auuaaagcauuuccuacca

SEQ ID NO: 756589 - RNA, 15 nt, Homo sapiens
auuaaauaaaucauu

SEQ ID NO: 756590 - RNA, 21 nt, Homo sapiens
auuaaauaccuauaugaauau

SEQ ID NO: 756591 - RNA, 13 nt, Homo sapiens
auuaaaugcauca

SEQ ID NO: 756592 - RNA, 19 nt, Homo sapiens
auuaacaaaugugcugcuu

SEQ ID NO: 756593 - RNA, 19 nt, Homo sapiens
auuaacaacaauaacacug

SEQ ID NO: 756594 - RNA, 14 nt, Homo sapiens
auuaacauggccau

SEQ ID NO: 756595 - RNA, 16 nt, Homo sapiens
auuaaccaccaaucca

SEQ ID NO: 756596 - RNA, 13 nt, Homo sapiens
auuaaccuaauca

SEQ ID NO: 756597 - RNA, 22 nt, Homo sapiens
auuaaccuuacuaauuauacua

SEQ ID NO: 756598 - RNA, 18 nt, Homo sapiens
auuaacgguggugaaaag

SEQ ID NO: 756599 - RNA, 21 nt, Homo sapiens
auuaacuacugaauaaugcua

SEQ ID NO: 756600 - RNA, 16 nt, Homo sapiens
auuaacugaacuuaau

SEQ ID NO: 756601 - RNA, 15 nt, Homo sapiens
auuaagaagcaauaa

SEQ ID NO: 756602 - RNA, 15 nt, Homo sapiens
auuaagacaguguac

SEQ ID NO: 756603 - RNA, 18 nt, Homo sapiens
auuaagacuuuauguagu

SEQ ID NO: 756604 - RNA, 19 nt, Homo sapiens
auuaagacuuuauguaguu

SEQ ID NO: 756605 - RNA, 17 nt, Homo sapiens
auuaagcaaauguuaaa

SEQ ID NO: 756606 - RNA, 14 nt, Homo sapiens
auuaagcacuuuaa

SEQ ID NO: 756607 - RNA, 21 nt, Homo sapiens
auuaagcagaaauccugcaau

SEQ ID NO: 756608 - RNA, 17 nt, Homo sapiens
auuaaguacaugugcca

SEQ ID NO: 756609 - RNA, 15 nt, Homo sapiens
auuaagucaagaaua

SEQ ID NO: 756610 - RNA, 13 nt, Homo sapiens
auuaagugccuga

SEQ ID NO: 756611 - RNA, 23 nt, Homo sapiens
auuaaguuguuauuucaguuuua

SEQ ID NO: 756612 - RNA, 16 nt, Homo sapiens
auuaauaaaugucauu

SEQ ID NO: 756613 - RNA, 21 nt, Homo sapiens
auuaauaguuauuauuuacug

SEQ ID NO: 756614 - RNA, 13 nt, Homo sapiens
auuaauaguucag

SEQ ID NO: 756615 - RNA, 17 nt, Homo sapiens
auuaauaguuugucuau

SEQ ID NO: 756616 - RNA, 24 nt, Homo sapiens
auuaauauauaguccagacacuua

SEQ ID NO: 756617 - RNA, 15 nt, Homo sapiens
auuaauaucauuuau

SEQ ID NO: 756618 - RNA, 18 nt, Homo sapiens
auuaauauccaagacuua

SEQ ID NO: 756619 - RNA, 13 nt, Homo sapiens
auuaauauuugcu

SEQ ID NO: 756620 - RNA, 14 nt, Homo sapiens
auuaaucaaaggca

SEQ ID NO: 756621 - RNA, 17 nt, Homo sapiens
auuaaucauacaaacuc

SEQ ID NO: 756622 - RNA, 22 nt, Homo sapiens
auuaauccugcauuugcagaug

SEQ ID NO: 756623 - RNA, 20 nt, Homo sapiens
auuaaucuaccuugcagugu

SEQ ID NO: 756624 - RNA, 14 nt, Homo sapiens
auuaaucucuaaaa

SEQ ID NO: 756625 - RNA, 18 nt, Homo sapiens
auuaaugagaauuccuua

SEQ ID NO: 756626 - RNA, 15 nt, Homo sapiens
auuaauggcacugau

SEQ ID NO: 756627 - RNA, 23 nt, Homo sapiens
auuaauguuaauucagcacugau

SEQ ID NO: 756628 - RNA, 20 nt, Homo sapiens
auuaauuacugugugugagc

SEQ ID NO: 756629 - RNA, 18 nt, Homo sapiens
auuaauuacuucacuaua

SEQ ID NO: 756630 - RNA, 21 nt, Homo sapiens
auuaauuacuucacuauacaa

SEQ ID NO: 756631 - RNA, 12 nt, Homo sapiens
auuaauucaccu

SEQ ID NO: 756632 - RNA, 18 nt, Homo sapiens
auuaauucauccaauacc

SEQ ID NO: 756633 - RNA, 18 nt, Homo sapiens
auuaauuuuuaaggaugu

SEQ ID NO: 756634 - RNA, 16 nt, Homo sapiens
auuaauuuuuccauaa

SEQ ID NO: 756635 - RNA, 14 nt, Homo sapiens
auuacaauguaucu

SEQ ID NO: 756636 - RNA, 20 nt, Homo sapiens
auuacaauguguaauggaaa

SEQ ID NO: 756637 - RNA, 14 nt, Homo sapiens
auuacaauugugag

SEQ ID NO: 756638 - RNA, 18 nt, Homo sapiens
auuacaauuuucuguaag

SEQ ID NO: 756639 - RNA, 18 nt, Homo sapiens
auuacagaauauacuuag

SEQ ID NO: 756640 - RNA, 17 nt, Homo sapiens
auuacaggcaugagcca

SEQ ID NO: 756641 - RNA, 19 nt, Homo sapiens
auuacaggcaugagccauu

SEQ ID NO: 756642 - RNA, 23 nt, Homo sapiens
auuacaggugugugccaccacac

SEQ ID NO: 756643 - RNA, 21 nt, Homo sapiens
auuacaguccaaaauacuguu

SEQ ID NO: 756644 - RNA, 18 nt, Homo sapiens
auuacauggggucuagaa

SEQ ID NO: 756645 - RNA, 14 nt, Homo sapiens
auuacauuggcaca

SEQ ID NO: 756646 - RNA, 17 nt, Homo sapiens
auuucugggcacuuuuu

SEQ ID NO: 756647 - RNA, 21 nt, Homo sapiens
auuucugggucuuucugacau

SEQ ID NO: 756648 - RNA, 15 nt, Homo sapiens
auuucugggugaccc

SEQ ID NO: 756649 - RNA, 13 nt, Homo sapiens
auuucugucaaau

SEQ ID NO: 756650 - RNA, 13 nt, Homo sapiens
auuucuguguugc

SEQ ID NO: 756651 - RNA, 23 nt, Homo sapiens
auuucuguucuuacaaaugugaa

SEQ ID NO: 756652 - RNA, 16 nt, Homo sapiens
auuucuguugucaaua

SEQ ID NO: 756653 - RNA, 15 nt, Homo sapiens
auuucuuaacuucuu

SEQ ID NO: 756654 - RNA, 21 nt, Homo sapiens
auuucuuagugcuucagaguu

SEQ ID NO: 756655 - RNA, 19 nt, Homo sapiens
auuucuuauuauuauaugu

SEQ ID NO: 756656 - RNA, 16 nt, Homo sapiens
auuucuuguugcucaa

SEQ ID NO: 756657 - RNA, 24 nt, Homo sapiens
auuucuuucuuugcaccaaagaca

SEQ ID NO: 756658 - RNA, 20 nt, Homo sapiens
auuucuuugauugugaaaca

SEQ ID NO: 756659 - RNA, 17 nt, Homo sapiens
auuucuuuucuggccaa

SEQ ID NO: 756660 - RNA, 18 nt, Homo sapiens
auuugaaaugaauuccuc

SEQ ID NO: 756661 - RNA, 19 nt, Homo sapiens
auuugaagcaucacauaaa

SEQ ID NO: 756662 - RNA, 21 nt, Homo sapiens
auuugaaugugguuacuuccu

SEQ ID NO: 756663 - RNA, 22 nt, Homo sapiens
auuugaaugugguuacuuccua

SEQ ID NO: 756664 - RNA, 17 nt, Homo sapiens
auuugacaacaauccaa

SEQ ID NO: 756665 - RNA, 19 nt, Homo sapiens
auuugacaacaauccaaaa

SEQ ID NO: 756666 - RNA, 18 nt, Homo sapiens
auuugaccggaucuacac

SEQ ID NO: 756667 - RNA, 19 nt, Homo sapiens
auuugagaauaaguucaua

SEQ ID NO: 756668 - RNA, 17 nt, Homo sapiens
auuugagauaaagucaa

SEQ ID NO: 756669 - RNA, 19 nt, Homo sapiens
auuugagauaaagucaaau

SEQ ID NO: 756670 - RNA, 21 nt, Homo sapiens
auuugauacauuuuuguacua

SEQ ID NO: 756671 - RNA, 15 nt, Homo sapiens
auuugaucacuacaa

SEQ ID NO: 756672 - RNA, 16 nt, Homo sapiens
auuugaucacuacaag

SEQ ID NO: 756673 - RNA, 16 nt, Homo sapiens
auuugcaaaugcacau

SEQ ID NO: 756674 - RNA, 23 nt, Homo sapiens
auuugcauuugcucuuucaucuc

SEQ ID NO: 756675 - RNA, 13 nt, Homo sapiens
auuugccaaaaac

SEQ ID NO: 756676 - RNA, 18 nt, Homo sapiens
auuugcuauuuauuaaau

SEQ ID NO: 756677 - RNA, 20 nt, Homo sapiens
auuugcuuuaaugagugcac

SEQ ID NO: 756678 - RNA, 22 nt, Homo sapiens
auuugcuuuaaugagugcaccu

SEQ ID NO: 756679 - RNA, 20 nt, Homo sapiens
auuuggagccugccaagagg

SEQ ID NO: 756680 - RNA, 14 nt, Homo sapiens
auuuggagugacca

SEQ ID NO: 756681 - RNA, 15 nt, Homo sapiens
auuuggauugcuaau

SEQ ID NO: 756682 - RNA, 15 nt, Homo sapiens
auuuggccugcacua

SEQ ID NO: 756683 - RNA, 15 nt, Homo sapiens
auuugggcagacccu

SEQ ID NO: 756684 - RNA, 23 nt, Homo sapiens
auuuggguugacuccugagcaua

SEQ ID NO: 756685 - RNA, 17 nt, Homo sapiens
auuuggugacuguguaa

SEQ ID NO: 756686 - RNA, 17 nt, Homo sapiens
auuuggugguacuuuau

SEQ ID NO: 756687 - RNA, 16 nt, Homo sapiens
auuuguaaaucugcca

SEQ ID NO: 756688 - RNA, 20 nt, Homo sapiens
auuuguaaauuuaugugaug

SEQ ID NO: 756689 - RNA, 17 nt, Homo sapiens
auuuguaauugaacuua

SEQ ID NO: 756690 - RNA, 11 nt, Homo sapiens
auuuguacaaa

SEQ ID NO: 756691 - RNA, 22 nt, Homo sapiens
auuuguauucaugaacuuggcu

SEQ ID NO: 756692 - RNA, 15 nt, Homo sapiens
auuuguauuccauug

SEQ ID NO: 756693 - RNA, 17 nt, Homo sapiens
auuuguccaauugagua

SEQ ID NO: 756694 - RNA, 21 nt, Homo sapiens
auuugucuguaaaaaauggag

SEQ ID NO: 756695 - RNA, 14 nt, Homo sapiens
auuuguuacuguau

SEQ ID NO: 756696 - RNA, 23 nt, Homo sapiens
auuuguuccugccacuguguacu

SEQ ID NO: 756697 - RNA, 20 nt, Homo sapiens
auuuguucguauuuagaaug

SEQ ID NO: 756698 - RNA, 17 nt, Homo sapiens
auuuuaaaacagaagaa

SEQ ID NO: 756699 - RNA, 19 nt, Homo sapiens
auuuuaaaaucagcuauuu

SEQ ID NO: 756700 - RNA, 22 nt, Homo sapiens
auuuuaacuuccuuggacucau

SEQ ID NO: 756701 - RNA, 14 nt, Homo sapiens
auuuuaaggacugc

SEQ ID NO: 756702 - RNA, 21 nt, Homo sapiens
auuuuaaguuucucugcagaa

SEQ ID NO: 756703 - RNA, 23 nt, Homo sapiens
auuuuaauagggaauauaucucu

SEQ ID NO: 756704 - RNA, 13 nt, Homo sapiens
auuuuaaugcauu

SEQ ID NO: 756705 - RNA, 16 nt, Homo sapiens
auuuuaauguuuccuu

SEQ ID NO: 756706 - RNA, 16 nt, Homo sapiens
auuuuaauuagcccaa

SEQ ID NO: 756707 - RNA, 14 nt, Homo sapiens
auuuuaauuaucuu

SEQ ID NO: 756708 - RNA, 17 nt, Homo sapiens
auuuuacccuuuagacu

SEQ ID NO: 756709 - RNA, 21 nt, Homo sapiens
auuuuacuuuuuccuggcuca

SEQ ID NO: 756710 - RNA, 19 nt, Homo sapiens
auuuuagaacaguccagca

SEQ ID NO: 756711 - RNA, 15 nt, Homo sapiens
auuuuagacuuccug

SEQ ID NO: 756712 - RNA, 18 nt, Homo sapiens
auuuuagacuuccuguag

SEQ ID NO: 756713 - RNA, 18 nt, Homo sapiens
auuuuauaacagaauuaa

SEQ ID NO: 756714 - RNA, 13 nt, Homo sapiens
auuuuauacccaa

SEQ ID NO: 756715 - RNA, 14 nt, Homo sapiens
auuuuauacugaca

SEQ ID NO: 756716 - RNA, 16 nt, Homo sapiens
auuuuauagacuacca

SEQ ID NO: 756717 - RNA, 22 nt, Homo sapiens
auuuuauagaugggcaacuggc

SEQ ID NO: 756718 - RNA, 16 nt, Homo sapiens
auuuuaugaucuuggc

SEQ ID NO: 756719 - RNA, 18 nt, Homo sapiens
auuuuauuacaucuuuca

SEQ ID NO: 756720 - RNA, 23 nt, Homo sapiens
auuuuauuguauaaaaaguuuca

SEQ ID NO: 756721 - RNA, 21 nt, Homo sapiens
auuuuauuuugcugaguuguu

SEQ ID NO: 756722 - RNA, 16 nt, Homo sapiens
auuuucaaagacuuaa

SEQ ID NO: 756723 - RNA, 22 nt, Homo sapiens
auuuucaagagucuaauagucu

SEQ ID NO: 756724 - RNA, 23 nt, Homo sapiens
auuuucaaugauguuagccugau

SEQ ID NO: 756725 - RNA, 20 nt, Homo sapiens
auuuucagaaaauauuaugu

SEQ ID NO: 756726 - RNA, 23 nt, Homo sapiens
auuuucaucccguaucacagugu

SEQ ID NO: 756727 - RNA, 18 nt, Homo sapiens
auuuucauuuguacaagg

SEQ ID NO: 756728 - RNA, 23 nt, Homo sapiens
auuuucccagucugugaagucaa

SEQ ID NO: 756729 - RNA, 22 nt, Homo sapiens
auuuucccccacuacugcagca

SEQ ID NO: 756730 - RNA, 22 nt, Homo sapiens
auuuucuaauguugacuuuaau

SEQ ID NO: 756731 - RNA, 13 nt, Homo sapiens
auuuucucuccau

SEQ ID NO: 756732 - RNA, 22 nt, Homo sapiens
auuuucucuuuguaugucuguu

SEQ ID NO: 756733 - RNA, 20 nt, Homo sapiens
auuuucuucucugcacuuau

SEQ ID NO: 756734 - RNA, 20 nt, Homo sapiens
auuuucuuuacaauuucacu

SEQ ID NO: 756735 - RNA, 23 nt, Homo sapiens
auuuugaguaaauauuuguuacu

SEQ ID NO: 756736 - RNA, 16 nt, Homo sapiens
auuuugaguauuccau

SEQ ID NO: 756737 - RNA, 15 nt, Homo sapiens
auuuugaguucuaca

SEQ ID NO: 756738 - RNA, 20 nt, Homo sapiens
auuuugauuuuuaauggaaa

SEQ ID NO: 756739 - RNA, 16 nt, Homo sapiens
auuuugcaaagauuua

SEQ ID NO: 756740 - RNA, 11 nt, Homo sapiens
auuuugcacug

SEQ ID NO: 756741 - RNA, 15 nt, Homo sapiens
auuuugcagcaguga

SEQ ID NO: 756742 - RNA, 17 nt, Homo sapiens
auuuugcauaguaccaa

SEQ ID NO: 756743 - RNA, 20 nt, Homo sapiens
auuuuggagaguuuccugaa

SEQ ID NO: 756744 - RNA, 16 nt, Homo sapiens
auuuuggaucuaucac

SEQ ID NO: 756745 - RNA, 23 nt, Homo sapiens
auuuuggaucuaucaccugucau

SEQ ID NO: 756746 - RNA, 15 nt, Homo sapiens
auuuuggccaaagug

SEQ ID NO: 756747 - RNA, 17 nt, Homo sapiens
auuuugggaaguugcau

SEQ ID NO: 756748 - RNA, 18 nt, Homo sapiens
auuuugggacuucuaccc

SEQ ID NO: 756749 - RNA, 21 nt, Homo sapiens
auuuugggagugacucaagaa

SEQ ID NO: 756750 - RNA, 13 nt, Homo sapiens
auuuuguaacuuu

SEQ ID NO: 756751 - RNA, 15 nt, Homo sapiens
auuuuguauguuaaa

SEQ ID NO: 756752 - RNA, 19 nt, Homo sapiens
auuuuguauucuuuuccaa

SEQ ID NO: 756753 - RNA, 14 nt, Homo sapiens
auuuuguccauguc

SEQ ID NO: 756754 - RNA, 16 nt, Homo sapiens
auuuuguugcuuucuu

SEQ ID NO: 756755 - RNA, 17 nt, Homo sapiens
auuuuguuuuguucagu

SEQ ID NO: 756756 - RNA, 16 nt, Homo sapiens
auuuuuaacaccaugg

SEQ ID NO: 756757 - RNA, 13 nt, Homo sapiens
auuuuuacuauca

SEQ ID NO: 756758 - RNA, 12 nt, Homo sapiens
auuuuuacuuca

SEQ ID NO: 756759 - RNA, 15 nt, Homo sapiens
auuuuuagcuuuuca

SEQ ID NO: 756760 - RNA, 19 nt, Homo sapiens
caaguauaacaacuuugaa

SEQ ID NO: 756761 - RNA, 20 nt, Homo sapiens
caaguauagccuauggcaga

SEQ ID NO: 756762 - RNA, 21 nt, Homo sapiens
caaguauguugagaguugcug

SEQ ID NO: 756763 - RNA, 17 nt, Homo sapiens
caaguauuauuuuacaa

SEQ ID NO: 756764 - RNA, 22 nt, Homo sapiens
caaguauuauuuuacaaucaac

SEQ ID NO: 756765 - RNA, 14 nt, Homo sapiens
caaguauuuugcca

SEQ ID NO: 756766 - RNA, 17 nt, Homo sapiens
caagucagccuagagac

SEQ ID NO: 756767 - RNA, 14 nt, Homo sapiens
caagucagcuccag

SEQ ID NO: 756768 - RNA, 12 nt, Homo sapiens
caaguccaagca

SEQ ID NO: 756769 - RNA, 23 nt, Homo sapiens
caagucccauugaaaaugaaugc

SEQ ID NO: 756770 - RNA, 17 nt, Homo sapiens
caagucuaacaguuaau

SEQ ID NO: 756771 - RNA, 19 nt, Homo sapiens
caagucuugaaacaagcaa

SEQ ID NO: 756772 - RNA, 17 nt, Homo sapiens
caagugaaaaacaucca

SEQ ID NO: 756773 - RNA, 17 nt, Homo sapiens
caagugagacaaaaagc

SEQ ID NO: 756774 - RNA, 18 nt, Homo sapiens
caagugauaucaccucuc

SEQ ID NO: 756775 - RNA, 20 nt, Homo sapiens
caagugcuucuccagccuca

SEQ ID NO: 756776 - RNA, 22 nt, Homo sapiens
caaguggaccuuaggccuuccu

SEQ ID NO: 756777 - RNA, 21 nt, Homo sapiens
caagugggcagcauaaaguca

SEQ ID NO: 756778 - RNA, 17 nt, Homo sapiens
caagugugcacuccagc

SEQ ID NO: 756779 - RNA, 13 nt, Homo sapiens
caagugugcucuc

SEQ ID NO: 756780 - RNA, 21 nt, Homo sapiens
caagugugggccacuguggug

SEQ ID NO: 756781 - RNA, 16 nt, Homo sapiens
caaguuagcucaggag

SEQ ID NO: 756782 - RNA, 16 nt, Homo sapiens
caaguuauucucuuca

SEQ ID NO: 756783 - RNA, 16 nt, Homo sapiens
caaguugcugucacug

SEQ ID NO: 756784 - RNA, 20 nt, Homo sapiens
caaguuggguucacuugcca

SEQ ID NO: 756785 - RNA, 20 nt, Homo sapiens
caaguuguaacuuauauuga

SEQ ID NO: 756786 - RNA, 17 nt, Homo sapiens
caaguuuuguggggcuu

SEQ ID NO: 756787 - RNA, 19 nt, Homo sapiens
caauaaaaguuuucuccaa

SEQ ID NO: 756788 - RNA, 17 nt, Homo sapiens
caauaaagauauuucca

SEQ ID NO: 756789 - RNA, 19 nt, Homo sapiens
caauaaaggcagcugccuc

SEQ ID NO: 756790 - RNA, 13 nt, Homo sapiens
caauaaaguacuu

SEQ ID NO: 756791 - RNA, 16 nt, Homo sapiens
caauaaaguacuuuac

SEQ ID NO: 756792 - RNA, 13 nt, Homo sapiens
caauaaaguuuac

SEQ ID NO: 756793 - RNA, 17 nt, Homo sapiens
caauaaauaaucuguac

SEQ ID NO: 756794 - RNA, 14 nt, Homo sapiens
caauaaaugaauga

SEQ ID NO: 756795 - RNA, 14 nt, Homo sapiens
caauaaauguuugu

SEQ ID NO: 756796 - RNA, 22 nt, Homo sapiens
caauaaauuauuagagauuuuc

SEQ ID NO: 756797 - RNA, 15 nt, Homo sapiens
caauaaauuuugcca

SEQ ID NO: 756798 - RNA, 14 nt, Homo sapiens
caauaacacugucu

SEQ ID NO: 756799 - RNA, 15 nt, Homo sapiens
caauaacacugucuc

SEQ ID NO: 756800 - RNA, 15 nt, Homo sapiens
caauaauacaaagca

SEQ ID NO: 756801 - RNA, 13 nt, Homo sapiens
caauaauauuuca

SEQ ID NO: 756802 - RNA, 15 nt, Homo sapiens
caauaaucucuauuu

SEQ ID NO: 756803 - RNA, 20 nt, Homo sapiens
caauacacggacacaaccaa

SEQ ID NO: 756804 - RNA, 20 nt, Homo sapiens
caauacagaucaucuuggaa

SEQ ID NO: 756805 - RNA, 22 nt, Homo sapiens
caauacaucucacuuguuucua

SEQ ID NO: 756806 - RNA, 16 nt, Homo sapiens
caauacaugcugcuaa

SEQ ID NO: 756807 - RNA, 18 nt, Homo sapiens
caauacaugcugcuaauu

SEQ ID NO: 756808 - RNA, 21 nt, Homo sapiens
caauacccuuuuaaguuuaaa

SEQ ID NO: 756809 - RNA, 19 nt, Homo sapiens
caauacucuugaaauguag

SEQ ID NO: 756810 - RNA, 21 nt, Homo sapiens
caauacuugcauuccagaguu

SEQ ID NO: 756811 - RNA, 14 nt, Homo sapiens
caauaggagucuua

SEQ ID NO: 756812 - RNA, 13 nt, Homo sapiens
caauaggugaucu

SEQ ID NO: 756813 - RNA, 18 nt, Homo sapiens
caauaguagucucuguga

SEQ ID NO: 756814 - RNA, 13 nt, Homo sapiens
caauauaagcaua

SEQ ID NO: 756815 - RNA, 16 nt, Homo sapiens
caauauauugaacuuu

SEQ ID NO: 756816 - RNA, 18 nt, Homo sapiens
caauauccaaaccaaaua

SEQ ID NO: 756817 - RNA, 16 nt, Homo sapiens
caauauguauuacaaa

SEQ ID NO: 756818 - RNA, 18 nt, Homo sapiens
caauauguggucaauuaa

SEQ ID NO: 756819 - RNA, 19 nt, Homo sapiens
caauauuaacacgcugccu

SEQ ID NO: 756820 - RNA, 14 nt, Homo sapiens
caauauuauacuga

SEQ ID NO: 756821 - RNA, 13 nt, Homo sapiens
caauauugccaug

SEQ ID NO: 756822 - RNA, 15 nt, Homo sapiens
caauauuuauuacac

SEQ ID NO: 756823 - RNA, 23 nt, Homo sapiens
caauauuuuuguauauacuuuua

SEQ ID NO: 756824 - RNA, 19 nt, Homo sapiens
caaucaaauauuugcugaa

SEQ ID NO: 756825 - RNA, 22 nt, Homo sapiens
caaucaauucauaucuauuuau

SEQ ID NO: 756826 - RNA, 13 nt, Homo sapiens
caaucacguggaa

SEQ ID NO: 756827 - RNA, 13 nt, Homo sapiens
caaucacugccaa

SEQ ID NO: 756828 - RNA, 14 nt, Homo sapiens
caaucagcacugaa

SEQ ID NO: 756829 - RNA, 15 nt, Homo sapiens
caaucagcacugaaa

SEQ ID NO: 756830 - RNA, 17 nt, Homo sapiens
caaucagccacauucua

SEQ ID NO: 756831 - RNA, 21 nt, Homo sapiens
caaucaggguuuuuagauuaa

SEQ ID NO: 756832 - RNA, 21 nt, Homo sapiens
caaucaucaacuaccauucua

SEQ ID NO: 756833 - RNA, 19 nt, Homo sapiens
caaucaugagcaagugaac

SEQ ID NO: 756834 - RNA, 19 nt, Homo sapiens
caaucccaacuacguaaua

SEQ ID NO: 756835 - RNA, 20 nt, Homo sapiens
caaucccacguacuuauaaa

SEQ ID NO: 756836 - RNA, 21 nt, Homo sapiens
caauccuagaaccaagcuuca

SEQ ID NO: 756837 - RNA, 13 nt, Homo sapiens
caauccugucaua

SEQ ID NO: 756838 - RNA, 15 nt, Homo sapiens
caauccugucauaua

SEQ ID NO: 756839 - RNA, 18 nt, Homo sapiens
caauccugucauauaaua

SEQ ID NO: 756840 - RNA, 14 nt, Homo sapiens
caaucgagauuugg

SEQ ID NO: 756841 - RNA, 18 nt, Homo sapiens
caaucuauguuugcacuu

SEQ ID NO: 756842 - RNA, 19 nt, Homo sapiens
caaucuggcuuagugccac

SEQ ID NO: 756843 - RNA, 20 nt, Homo sapiens
caaucuguccguucacaugu

SEQ ID NO: 756844 - RNA, 13 nt, Homo sapiens
caaucuuugccuu

SEQ ID NO: 756845 - RNA, 15 nt, Homo sapiens
caaucuuugccuuua

SEQ ID NO: 756846 - RNA, 20 nt, Homo sapiens
caaucuuugccuuuaucucu

SEQ ID NO: 756847 - RNA, 23 nt, Homo sapiens
caaucuuugcuguauacuuuuaa

SEQ ID NO: 756848 - RNA, 17 nt, Homo sapiens
caaugaauccccaauaa

SEQ ID NO: 756849 - RNA, 22 nt, Homo sapiens
caaugaccuguauuuugccaga

SEQ ID NO: 756850 - RNA, 20 nt, Homo sapiens
caaugacucguuaccugccg

SEQ ID NO: 756851 - RNA, 19 nt, Homo sapiens
caaugacuucccugcucca

SEQ ID NO: 756852 - RNA, 22 nt, Homo sapiens
caaugagaaugaugcacacuga

SEQ ID NO: 756853 - RNA, 17 nt, Homo sapiens
caaugaguaacaggaaa

SEQ ID NO: 756854 - RNA, 16 nt, Homo sapiens
caaugauggcaauuuu

SEQ ID NO: 756855 - RNA, 10 nt, Homo sapiens
caaugcacaa

SEQ ID NO: 756856 - RNA, 23 nt, Homo sapiens
caaugcaucacguaccccacugg

SEQ ID NO: 756857 - RNA, 15 nt, Homo sapiens
caaugccaugaacaa

SEQ ID NO: 756858 - RNA, 13 nt, Homo sapiens
caaugccugugaa

SEQ ID NO: 756859 - RNA, 14 nt, Homo sapiens
caaugccugugaag

SEQ ID NO: 756860 - RNA, 23 nt, Homo sapiens
caaugccuuuuugauuacagugu

SEQ ID NO: 756861 - RNA, 16 nt, Homo sapiens
caaugcuaucacuguc

SEQ ID NO: 756862 - RNA, 20 nt, Homo sapiens
caaugcuuauacccagugag

SEQ ID NO: 756863 - RNA, 16 nt, Homo sapiens
caauggagacugucuc

SEQ ID NO: 756864 - RNA, 19 nt, Homo sapiens
caauggaguggcugccaug

SEQ ID NO: 756865 - RNA, 19 nt, Homo sapiens
caauggccuuuaucaucua

SEQ ID NO: 756866 - RNA, 14 nt, Homo sapiens
caauggcggacuca

SEQ ID NO: 756867 - RNA, 21 nt, Homo sapiens
caaugggcacauuuaugacaa

SEQ ID NO: 756868 - RNA, 14 nt, Homo sapiens
caauggugcuuccc

SEQ ID NO: 756869 - RNA, 17 nt, Homo sapiens
caaugguuaacaucuuc

SEQ ID NO: 756870 - RNA, 20 nt, Homo sapiens
caauguacaggaaguaguuc

SEQ ID NO: 756871 - RNA, 23 nt, Homo sapiens
caauguauacuucagugcucacc

SEQ ID NO: 756872 - RNA, 15 nt, Homo sapiens
caauguauguacaau

SEQ ID NO: 756873 - RNA, 20 nt, Homo sapiens
caaugucacaaccucucuga

SEQ ID NO: 756874 - RNA, 19 nt, Homo sapiens
caaugucaggaacagaagg

SEQ ID NO: 756875 - RNA, 11 nt, Homo sapiens
caaugucuucc

SEQ ID NO: 756876 - RNA, 16 nt, Homo sapiens
caaugugacaccuaac

SEQ ID NO: 756877 - RNA, 14 nt, Homo sapiens
caaugugaguccca

SEQ ID NO: 756878 - RNA, 11 nt, Homo sapiens
caauguuccau

SEQ ID NO: 756879 - RNA, 15 nt, Homo sapiens
caauguuuaugcaag

SEQ ID NO: 756880 - RNA, 21 nt, Homo sapiens
caauguuuaugcaaggaagga

SEQ ID NO: 756881 - RNA, 22 nt, Homo sapiens
caauuaaaaaaaauuaaaacca

SEQ ID NO: 756882 - RNA, 23 nt, Homo sapiens
caauuaacaucgugggucacuac

SEQ ID NO: 756883 - RNA, 20 nt, Homo sapiens
caauuagacaaacagcauca

SEQ ID NO: 756884 - RNA, 20 nt, Homo sapiens
caauuauauaaaucauuuca

SEQ ID NO: 756885 - RNA, 14 nt, Homo sapiens
caauucacaguaug

SEQ ID NO: 756886 - RNA, 17 nt, Homo sapiens
caauucacuagaccaga

SEQ ID NO: 756887 - RNA, 23 nt, Homo sapiens
caauucacuagaccagaagugga

SEQ ID NO: 756888 - RNA, 13 nt, Homo sapiens
caauucauucauu

SEQ ID NO: 756889 - RNA, 14 nt, Homo sapiens
caauuccgcauuua

SEQ ID NO: 756890 - RNA, 18 nt, Homo sapiens
caauuccugugauuuaug

SEQ ID NO: 756891 - RNA, 22 nt, Homo sapiens
caauucguuggauuuuuguuua

SEQ ID NO: 756892 - RNA, 13 nt, Homo sapiens
caauucuucuucc

SEQ ID NO: 756893 - RNA, 18 nt, Homo sapiens
caauugacauaggcaaua

SEQ ID NO: 756894 - RNA, 20 nt, Homo sapiens
caauugacugucacuguucc

SEQ ID NO: 756895 - RNA, 22 nt, Homo sapiens
caauugagggcauuaguacuuu

SEQ ID NO: 756896 - RNA, 16 nt, Homo sapiens
caauugggagcugcca

SEQ ID NO: 756897 - RNA, 21 nt, Homo sapiens
caauugucauuuauaaaacca

SEQ ID NO: 756898 - RNA, 20 nt, Homo sapiens
caauugugcugccauuugau

SEQ ID NO: 756899 - RNA, 19 nt, Homo sapiens
caauuguguauaacuggau

SEQ ID NO: 756900 - RNA, 20 nt, Homo sapiens
caauuguuacaguacuguuc

SEQ ID NO: 756901 - RNA, 20 nt, Homo sapiens
caauuguuauguguuuagaa

SEQ ID NO: 756902 - RNA, 14 nt, Homo sapiens
caauuuacacugcc

SEQ ID NO: 756903 - RNA, 11 nt, Homo sapiens
caauuuaguuc

SEQ ID NO: 756904 - RNA, 16 nt, Homo sapiens
caauuuauuacugaaa

SEQ ID NO: 756905 - RNA, 22 nt, Homo sapiens
caauuucaccaccaaaugccaa

SEQ ID NO: 756906 - RNA, 19 nt, Homo sapiens
caauuucacuuagucugua

SEQ ID NO: 756907 - RNA, 14 nt, Homo sapiens
caauuucagacucc

SEQ ID NO: 756908 - RNA, 13 nt, Homo sapiens
caauuucccuuca

SEQ ID NO: 756909 - RNA, 21 nt, Homo sapiens
caauuucccuucauacuccuu

SEQ ID NO: 756910 - RNA, 13 nt, Homo sapiens
caauuuggagcau

SEQ ID NO: 756911 - RNA, 22 nt, Homo sapiens
caauuugguaaaaaugcugcuc

SEQ ID NO: 756912 - RNA, 23 nt, Homo sapiens
caauuuuaauugauuauucugau

SEQ ID NO: 756913 - RNA, 14 nt, Homo sapiens
caauuuuugaacaa

SEQ ID NO: 756914 - RNA, 14 nt, Homo sapiens
cacaaaauacacac

SEQ ID NO: 756915 - RNA, 16 nt, Homo sapiens
cacaaaaucuguccaa

SEQ ID NO: 756916 - RNA, 12 nt, Homo sapiens
cacaaaccacaa

SEQ ID NO: 756917 - RNA, 13 nt, Homo sapiens
cacaaaccaguau

SEQ ID NO: 756918 - RNA, 20 nt, Homo sapiens
cacaaagcccauagcacugg

SEQ ID NO: 756919 - RNA, 14 nt, Homo sapiens
cacaaaucugccaa

SEQ ID NO: 756920 - RNA, 19 nt, Homo sapiens
cacaaaugaagggauauaa

SEQ ID NO: 756921 - RNA, 22 nt, Homo sapiens
cacaaaugguggguacaaaaag

SEQ ID NO: 756922 - RNA, 12 nt, Homo sapiens
cacaaccaaaaa

SEQ ID NO: 756923 - RNA, 23 nt, Homo sapiens
cacaacccuucagauuugccuua

SEQ ID NO: 756924 - RNA, 19 nt, Homo sapiens
cacaacugacacaggaaac

SEQ ID NO: 756925 - RNA, 15 nt, Homo sapiens
cacaagcaugaagug

SEQ ID NO: 756926 - RNA, 14 nt, Homo sapiens
cacaagccagaccc

SEQ ID NO: 756927 - RNA, 21 nt, Homo sapiens
cacaaggcugaccaagagaga

SEQ ID NO: 756928 - RNA, 23 nt, Homo sapiens
cacaaggggaaggguacugaaaa

SEQ ID NO: 756929 - RNA, 21 nt, Homo sapiens
cacaaguaaaggcauugucca

SEQ ID NO: 756930 - RNA, 15 nt, Homo sapiens
cacaagucuuuccag

SEQ ID NO: 756931 - RNA, 16 nt, Homo sapiens
cacaaguggaccuuag

SEQ ID NO: 756932 - RNA, 14 nt, Homo sapiens
cacaauaaauguau

SEQ ID NO: 756933 - RNA, 13 nt, Homo sapiens
cacaauaaccaag

SEQ ID NO: 756934 - RNA, 14 nt, Homo sapiens
cacaauaccacuau

SEQ ID NO: 756935 - RNA, 20 nt, Homo sapiens
cacaauaugggcacuuuaaa

SEQ ID NO: 756936 - RNA, 18 nt, Homo sapiens
cacaaucaccgaugcaaa

SEQ ID NO: 756937 - RNA, 19 nt, Homo sapiens
cacaaucugucaguucuaa

SEQ ID NO: 756938 - RNA, 16 nt, Homo sapiens
cacaauguauacuuca

SEQ ID NO: 756939 - RNA, 21 nt, Homo sapiens
cacaaugucaugucugugauu

SEQ ID NO: 756940 - RNA, 16 nt, Homo sapiens
cacaauuccauuucca

SEQ ID NO: 756941 - RNA, 12 nt, Homo sapiens
cacaauucuguc

SEQ ID NO: 756942 - RNA, 17 nt, Homo sapiens
cacaauucuguuuuagg

SEQ ID NO: 756943 - RNA, 15 nt, Homo sapiens
cacaauuucccuuca

SEQ ID NO: 756944 - RNA, 15 nt, Homo sapiens
cacacaaggugcaaa

SEQ ID NO: 756945 - RNA, 13 nt, Homo sapiens
cacacacacuggc

SEQ ID NO: 756946 - RNA, 17 nt, Homo sapiens
cacacacagccuauauc

SEQ ID NO: 756947 - RNA, 14 nt, Homo sapiens
cacacacccacuaa

SEQ ID NO: 756948 - RNA, 21 nt, Homo sapiens
cacacacccagcuugugccug

SEQ ID NO: 756949 - RNA, 19 nt, Homo sapiens
cacacaccugccugcagag

SEQ ID NO: 756950 - RNA, 13 nt, Homo sapiens
cacacacgaugca

SEQ ID NO: 756951 - RNA, 14 nt, Homo sapiens
cacacagacuccac

SEQ ID NO: 756952 - RNA, 12 nt, Homo sapiens
cacacagcacuc

SEQ ID NO: 756953 - RNA, 13 nt, Homo sapiens
cacacagcacucu

SEQ ID NO: 756954 - RNA, 16 nt, Homo sapiens
cacacagcacucucua

SEQ ID NO: 756955 - RNA, 13 nt, Homo sapiens
cacacagcugccc

SEQ ID NO: 756956 - RNA, 15 nt, Homo sapiens
cacacagcugcccua

SEQ ID NO: 756957 - RNA, 16 nt, Homo sapiens
cacacagcugcccuag

SEQ ID NO: 756958 - RNA, 22 nt, Homo sapiens
cacacauccccuuuguguagaa

SEQ ID NO: 756959 - RNA, 12 nt, Homo sapiens
cacacaucucau

SEQ ID NO: 756960 - RNA, 18 nt, Homo sapiens
cacacaugaauaaagccu

SEQ ID NO: 756961 - RNA, 18 nt, Homo sapiens
cacaccaaguaccaguau

SEQ ID NO: 756962 - RNA, 12 nt, Homo sapiens
cacaccaucucc

SEQ ID NO: 756963 - RNA, 22 nt, Homo sapiens
cacaccauuauauuuaauucua

SEQ ID NO: 756964 - RNA, 19 nt, Homo sapiens
cacaccccaacacuuccag

SEQ ID NO: 756965 - RNA, 15 nt, Homo sapiens
cacaccccucaaaaa

SEQ ID NO: 756966 - RNA, 13 nt, Homo sapiens
cacacccuaccuu

SEQ ID NO: 756967 - RNA, 14 nt, Homo sapiens
cacacccuccccau

SEQ ID NO: 756968 - RNA, 20 nt, Homo sapiens
cacacccuggaggauuucau

SEQ ID NO: 756969 - RNA, 18 nt, Homo sapiens
cacaccucccaccugcau

SEQ ID NO: 756970 - RNA, 17 nt, Homo sapiens
cacaccuccugccuuua

SEQ ID NO: 756971 - RNA, 19 nt, Homo sapiens
cacaccucuccuuugugac

SEQ ID NO: 756972 - RNA, 19 nt, Homo sapiens
cacaccugugccuccucag

SEQ ID NO: 756973 - RNA, 14 nt, Homo sapiens
cacacgagcaaacc

SEQ ID NO: 756974 - RNA, 21 nt, Homo sapiens
cacacucauacacaugugcac

SEQ ID NO: 756975 - RNA, 15 nt, Homo sapiens
cacacucuucaguga

SEQ ID NO: 756976 - RNA, 21 nt, Homo sapiens
cacacugaaucucaccugcug

SEQ ID NO: 756977 - RNA, 16 nt, Homo sapiens
cacacuggccauucuu

SEQ ID NO: 756978 - RNA, 22 nt, Homo sapiens
cacacugggugcgucuccaguc

SEQ ID NO: 756979 - RNA, 21 nt, Homo sapiens
cacacuguagcauuacagugg

SEQ ID NO: 756980 - RNA, 18 nt, Homo sapiens
cacacuuuuccacauucc

SEQ ID NO: 756981 - RNA, 19 nt, Homo sapiens
cacacuuuuccacauucca

SEQ ID NO: 756982 - RNA, 21 nt, Homo sapiens
cacagaaagcuccuuccagac

SEQ ID NO: 756983 - RNA, 17 nt, Homo sapiens
cacagaaauacaugaaa

SEQ ID NO: 756984 - RNA, 12 nt, Homo sapiens
cacagaacugcu

SEQ ID NO: 756985 - RNA, 19 nt, Homo sapiens
cacagaaggaauaagguca

SEQ ID NO: 756986 - RNA, 13 nt, Homo sapiens
cacagaagggugu

SEQ ID NO: 756987 - RNA, 18 nt, Homo sapiens
cacagaaguggaauuuga

SEQ ID NO: 756988 - RNA, 23 nt, Homo sapiens
cacagaaugcaaccaagucacac

SEQ ID NO: 756989 - RNA, 15 nt, Homo sapiens
cacagacaaagugcu

SEQ ID NO: 756990 - RNA, 12 nt, Homo sapiens
caagcaccucca

SEQ ID NO: 756991 - RNA, 22 nt, Homo sapiens
caagcagaacuagguagaaaca

SEQ ID NO: 756992 - RNA, 15 nt, Homo sapiens
caagcagagcucaca

SEQ ID NO: 756993 - RNA, 12 nt, Homo sapiens
caagcagugcac

SEQ ID NO: 756994 - RNA, 23 nt, Homo sapiens
caagcaugaucuuguuacuguga

SEQ ID NO: 756995 - RNA, 20 nt, Homo sapiens
caagcauugcuucagaauga

SEQ ID NO: 756996 - RNA, 21 nt, Homo sapiens
caagcauuucaugaaaaagcu

SEQ ID NO: 756997 - RNA, 11 nt, Homo sapiens
caagccacaag

SEQ ID NO: 756998 - RNA, 18 nt, Homo sapiens
caagcccaauacagccau

SEQ ID NO: 756999 - RNA, 21 nt, Homo sapiens
caagcccuggcaacauaguga

SEQ ID NO: 757000 - RNA, 22 nt, Homo sapiens
caagccgagaugcccauucucu

SEQ ID NO: 757001 - RNA, 17 nt, Homo sapiens
caagcgcucauguugag

SEQ ID NO: 757002 - RNA, 22 nt, Homo sapiens
caagcuaaaauuagaugaacuc

SEQ ID NO: 757003 - RNA, 14 nt, Homo sapiens
caagcuauucucau

SEQ ID NO: 757004 - RNA, 21 nt, Homo sapiens
caagcucucagcaagugccca

SEQ ID NO: 757005 - RNA, 22 nt, Homo sapiens
caagcucucugcaucuacuccc

SEQ ID NO: 757006 - RNA, 23 nt, Homo sapiens
caagcugacucgacaccguguca

SEQ ID NO: 757007 - RNA, 12 nt, Homo sapiens
caagcugcauuu

SEQ ID NO: 757008 - RNA, 21 nt, Homo sapiens
caagcugccgaaccaaaagaa

SEQ ID NO: 757009 - RNA, 17 nt, Homo sapiens
caagcuucacauuugcg

SEQ ID NO: 757010 - RNA, 21 nt, Homo sapiens
caaggaaacccccaguguaau

SEQ ID NO: 757011 - RNA, 22 nt, Homo sapiens
caaggaaacccccaguguaaua

SEQ ID NO: 757012 - RNA, 16 nt, Homo sapiens
caaggaaagaaauaca

SEQ ID NO: 757013 - RNA, 20 nt, Homo sapiens
caaggaaagccccagcacua

SEQ ID NO: 757014 - RNA, 19 nt, Homo sapiens
caaggaaauaaagcguccu

SEQ ID NO: 757015 - RNA, 17 nt, Homo sapiens
caaggaagccaaaguuu

SEQ ID NO: 757016 - RNA, 15 nt, Homo sapiens
caaggaauaauucaa

SEQ ID NO: 757017 - RNA, 23 nt, Homo sapiens
caaggacgcuggcuacugucuau

SEQ ID NO: 757018 - RNA, 22 nt, Homo sapiens
caaggacguggaugacccuccc

SEQ ID NO: 757019 - RNA, 13 nt, Homo sapiens
caaggacugagca

SEQ ID NO: 757020 - RNA, 18 nt, Homo sapiens
caaggagaaaaaaggcag

SEQ ID NO: 757021 - RNA, 20 nt, Homo sapiens
caaggagagagugagugcau

SEQ ID NO: 757022 - RNA, 13 nt, Homo sapiens
caaggcaaacccu

SEQ ID NO: 757023 - RNA, 15 nt, Homo sapiens
caaggcacucuagau

SEQ ID NO: 757024 - RNA, 13 nt, Homo sapiens
caaggcacugacu

SEQ ID NO: 757025 - RNA, 17 nt, Homo sapiens
caaggcacugacugagc

SEQ ID NO: 757026 - RNA, 15 nt, Homo sapiens
caaggccagugcuaa

SEQ ID NO: 757027 - RNA, 22 nt, Homo sapiens
caaggcccauaucugugaaaug

SEQ ID NO: 757028 - RNA, 17 nt, Homo sapiens
caaggccugguguuucu

SEQ ID NO: 757029 - RNA, 18 nt, Homo sapiens
caaggccuugguggagca

SEQ ID NO: 757030 - RNA, 20 nt, Homo sapiens
caaggcuucagugagccaug

SEQ ID NO: 757031 - RNA, 20 nt, Homo sapiens
caagggggacugucuuucag

SEQ ID NO: 757032 - RNA, 23 nt, Homo sapiens
caagggguggccgggcacagugg

SEQ ID NO: 757033 - RNA, 14 nt, Homo sapiens
caaggucaagagau

SEQ ID NO: 757034 - RNA, 14 nt, Homo sapiens
caaggugacuggga

SEQ ID NO: 757035 - RNA, 16 nt, Homo sapiens
caaggugacugggaug

SEQ ID NO: 757036 - RNA, 14 nt, Homo sapiens
caaggugaguguga

SEQ ID NO: 757037 - RNA, 17 nt, Homo sapiens
caagguggucaguaaau

SEQ ID NO: 757038 - RNA, 19 nt, Homo sapiens
caagguguuuccauuucuc

SEQ ID NO: 757039 - RNA, 15 nt, Homo sapiens
caagguuauaugcac

SEQ ID NO: 757040 - RNA, 18 nt, Homo sapiens
caagguuggcgacuguca

SEQ ID NO: 757041 - RNA, 23 nt, Homo sapiens
caaguaaaaaggcuaaauggaag

SEQ ID NO: 757042 - RNA, 16 nt, Homo sapiens
caaguaaagugcuuaa

SEQ ID NO: 757043 - RNA, 17 nt, Homo sapiens
caaguaagaagacauga

SEQ ID NO: 757044 - RNA, 17 nt, Homo sapiens
caaguaaguuauagaag

SEQ ID NO: 757045 - RNA, 14 nt, Homo sapiens
caaguaauugugaa

SEQ ID NO: 757046 - RNA, 15 nt, Homo sapiens
caaguacacugagag

SEQ ID NO: 757047 - RNA, 19 nt, Homo sapiens
caaguacauggcuagcuuu

SEQ ID NO: 757048 - RNA, 15 nt, Homo sapiens
caaguagcacccugg

SEQ ID NO: 757049 - RNA, 17 nt, Homo sapiens
caaguagcugagacuac

SEQ ID NO: 757050 - RNA, 17 nt, Homo sapiens
agucaagaaucacuugc

SEQ ID NO: 757051 - RNA, 16 nt, Homo sapiens
agucaaggucacuuaa

SEQ ID NO: 757052 - RNA, 21 nt, Homo sapiens
agucaagucaccaugcugaau

SEQ ID NO: 757053 - RNA, 16 nt, Homo sapiens
agucaauccugucaua

SEQ ID NO: 757054 - RNA, 13 nt, Homo sapiens
agucaauuucuac

SEQ ID NO: 757055 - RNA, 13 nt, Homo sapiens
agucacacagugu

SEQ ID NO: 757056 - RNA, 13 nt, Homo sapiens
agucacacugugg

SEQ ID NO: 757057 - RNA, 20 nt, Homo sapiens
agucacacuguuacuccaca

SEQ ID NO: 757058 - RNA, 14 nt, Homo sapiens
agucacaggaagaa

SEQ ID NO: 757059 - RNA, 21 nt, Homo sapiens
agucacaguuagguagcuuua

SEQ ID NO: 757060 - RNA, 19 nt, Homo sapiens
agucacauggccuaugcac

SEQ ID NO: 757061 - RNA, 21 nt, Homo sapiens
agucacauggccuaugcacau

SEQ ID NO: 757062 - RNA, 17 nt, Homo sapiens
agucacccaaacacuuc

SEQ ID NO: 757063 - RNA, 18 nt, Homo sapiens
agucacgugaaacagagu

SEQ ID NO: 757064 - RNA, 15 nt, Homo sapiens
agucacucacacugg

SEQ ID NO: 757065 - RNA, 14 nt, Homo sapiens
agucacugcacagu

SEQ ID NO: 757066 - RNA, 12 nt, Homo sapiens
agucacuggcag

SEQ ID NO: 757067 - RNA, 21 nt, Homo sapiens
agucacuuugccagagccuga

SEQ ID NO: 757068 - RNA, 23 nt, Homo sapiens
agucagaaugugaaaaaggaaua

SEQ ID NO: 757069 - RNA, 14 nt, Homo sapiens
agucagacugucag

SEQ ID NO: 757070 - RNA, 16 nt, Homo sapiens
agucagacugucagaa

SEQ ID NO: 757071 - RNA, 21 nt, Homo sapiens
agucagaggagaagagacaug

SEQ ID NO: 757072 - RNA, 14 nt, Homo sapiens
agucagaggaggga

SEQ ID NO: 757073 - RNA, 19 nt, Homo sapiens
agucagcaaacuccacaaa

SEQ ID NO: 757074 - RNA, 16 nt, Homo sapiens
agucagcuuucagagc

SEQ ID NO: 757075 - RNA, 19 nt, Homo sapiens
agucagggacagcagccuc

SEQ ID NO: 757076 - RNA, 14 nt, Homo sapiens
agucaguauggucu

SEQ ID NO: 757077 - RNA, 14 nt, Homo sapiens
agucagugcaaaug

SEQ ID NO: 757078 - RNA, 15 nt, Homo sapiens
agucagugcucucag

SEQ ID NO: 757079 - RNA, 17 nt, Homo sapiens
agucaucaugaacuggc

SEQ ID NO: 757080 - RNA, 18 nt, Homo sapiens
agucaucaugaacuggcu

SEQ ID NO: 757081 - RNA, 15 nt, Homo sapiens
agucauccugccaac

SEQ ID NO: 757082 - RNA, 14 nt, Homo sapiens
agucaucuacuuaa

SEQ ID NO: 757083 - RNA, 14 nt, Homo sapiens
agucaucuauucaa

SEQ ID NO: 757084 - RNA, 15 nt, Homo sapiens
agucaucucauucca

SEQ ID NO: 757085 - RNA, 19 nt, Homo sapiens
agucauggcuaauuuaaca

SEQ ID NO: 757086 - RNA, 18 nt, Homo sapiens
agucauuggaauaaggca

SEQ ID NO: 757087 - RNA, 17 nt, Homo sapiens
aguccaaaccacuccac

SEQ ID NO: 757088 - RNA, 14 nt, Homo sapiens
aguccaacugucaa

SEQ ID NO: 757089 - RNA, 22 nt, Homo sapiens
aguccaagguuuaaagagucua

SEQ ID NO: 757090 - RNA, 16 nt, Homo sapiens
aguccacaaagcauuu

SEQ ID NO: 757091 - RNA, 17 nt, Homo sapiens
aguccaccucccauuac

SEQ ID NO: 757092 - RNA, 21 nt, Homo sapiens
aguccaccugaggaacugucu

SEQ ID NO: 757093 - RNA, 12 nt, Homo sapiens
aguccacuuuac

SEQ ID NO: 757094 - RNA, 19 nt, Homo sapiens
ucccauaauugcuuugcca

SEQ ID NO: 757095 - RNA, 15 nt, Homo sapiens
ucccaucacuucccu

SEQ ID NO: 757096 - RNA, 22 nt, Homo sapiens
ucccaucacuucccuacaugga

SEQ ID NO: 757097 - RNA, 23 nt, Homo sapiens
ucccauccuggggcagcacuccc

SEQ ID NO: 757098 - RNA, 14 nt, Homo sapiens
ucccauccuugaug

SEQ ID NO: 757099 - RNA, 16 nt, Homo sapiens
ucccaucgcugucaca

SEQ ID NO: 757100 - RNA, 17 nt, Homo sapiens
ucccauggcaccuucag

SEQ ID NO: 757101 - RNA, 19 nt, Homo sapiens
ucccauggguuaagagcuc

SEQ ID NO: 757102 - RNA, 22 nt, Homo sapiens
ucccauggguuguguguuuauu

SEQ ID NO: 757103 - RNA, 18 nt, Homo sapiens
ucccauguuagcuacaca

SEQ ID NO: 757104 - RNA, 14 nt, Homo sapiens
ucccauuacuuuga

SEQ ID NO: 757105 - RNA, 15 nt, Homo sapiens
ucccauuacuuugau

SEQ ID NO: 757106 - RNA, 13 nt, Homo sapiens
ucccauucacucu

SEQ ID NO: 757107 - RNA, 12 nt, Homo sapiens
ucccauugccau

SEQ ID NO: 757108 - RNA, 22 nt, Homo sapiens
ucccauuguggcuccuaucugu

SEQ ID NO: 757109 - RNA, 22 nt, Homo sapiens
ucccauuucaauuccugugauu

SEQ ID NO: 757110 - RNA, 14 nt, Homo sapiens
ucccauuucccaaa

SEQ ID NO: 757111 - RNA, 19 nt, Homo sapiens
uccccaacaagauugcuua

SEQ ID NO: 757112 - RNA, 20 nt, Homo sapiens
uccccaacaccccacugagc

SEQ ID NO: 757113 - RNA, 13 nt, Homo sapiens
uccccaagcaccu

SEQ ID NO: 757114 - RNA, 19 nt, Homo sapiens
uccccaaggacucuuccac

SEQ ID NO: 757115 - RNA, 13 nt, Homo sapiens
uccccacaaucug

SEQ ID NO: 757116 - RNA, 20 nt, Homo sapiens
uccccacaccucccuacucc

SEQ ID NO: 757117 - RNA, 14 nt, Homo sapiens
uccccacacugacc

SEQ ID NO: 757118 - RNA, 14 nt, Homo sapiens
uccccacaucccau

SEQ ID NO: 757119 - RNA, 18 nt, Homo sapiens
uccccacccugucuucca

SEQ ID NO: 757120 - RNA, 17 nt, Homo sapiens
uccccacgaacuggccu

SEQ ID NO: 757121 - RNA, 13 nt, Homo sapiens
uccccacucccuu

SEQ ID NO: 757122 - RNA, 12 nt, Homo sapiens
uccccacugcuc

SEQ ID NO: 757123 - RNA, 20 nt, Homo sapiens
uccccacuuacagaucuauc

SEQ ID NO: 757124 - RNA, 14 nt, Homo sapiens
uccccagaguguga

SEQ ID NO: 757125 - RNA, 23 nt, Homo sapiens
uccccagccuccccgugccaaaa

SEQ ID NO: 757126 - RNA, 19 nt, Homo sapiens
uccccagcucucaguaguu

SEQ ID NO: 757127 - RNA, 19 nt, Homo sapiens
uccccagcugguggcccug

SEQ ID NO: 757128 - RNA, 13 nt, Homo sapiens
uccccagggggca

SEQ ID NO: 757129 - RNA, 21 nt, Homo sapiens
uccccaguucauugcacuuug

SEQ ID NO: 757130 - RNA, 22 nt, Homo sapiens
ucccccaaagcaaugugagucc

SEQ ID NO: 757131 - RNA, 22 nt, Homo sapiens
ucccccacagccacuacugacu

SEQ ID NO: 757132 - RNA, 23 nt, Homo sapiens
ucccccaccagcuaaggacauuu

SEQ ID NO: 757133 - RNA, 20 nt, Homo sapiens
ucccccagcuuucccgacac

SEQ ID NO: 757134 - RNA, 12 nt, Homo sapiens
ucccccaugugc

SEQ ID NO: 757135 - RNA, 14 nt, Homo sapiens
uccccccauguugu

SEQ ID NO: 757136 - RNA, 12 nt, Homo sapiens
ucccccccaugc

SEQ ID NO: 757137 - RNA, 18 nt, Homo sapiens
ucccccucccaguacuag

SEQ ID NO: 757138 - RNA, 14 nt, Homo sapiens
ucccccugcugcug

SEQ ID NO: 757139 - RNA, 22 nt, Homo sapiens
ucccccuguagacuagugccgu

SEQ ID NO: 757140 - RNA, 19 nt, Homo sapiens
ucccccuuucacacuggau

SEQ ID NO: 757141 - RNA, 16 nt, Homo sapiens
uccccuagucacucau

SEQ ID NO: 757142 - RNA, 14 nt, Homo sapiens
uccccucaccuccu

SEQ ID NO: 757143 - RNA, 19 nt, Homo sapiens
uccccucagcgggggccuu

SEQ ID NO: 757144 - RNA, 22 nt, Homo sapiens
uccccucagggauacgacacau

SEQ ID NO: 757145 - RNA, 13 nt, Homo sapiens
uccccucccagau

SEQ ID NO: 757146 - RNA, 23 nt, Homo sapiens
uccccuccuuggcuuuaugcaaa

SEQ ID NO: 757147 - RNA, 20 nt, Homo sapiens
uccccugaaaaacugaucaa

SEQ ID NO: 757148 - RNA, 17 nt, Homo sapiens
uccccugaggauggccu

SEQ ID NO: 757149 - RNA, 16 nt, Homo sapiens
uccccugcacuguaaa

SEQ ID NO: 757150 - RNA, 18 nt, Homo sapiens
uccccugcacuguaaaau

SEQ ID NO: 757151 - RNA, 16 nt, Homo sapiens
uccccuggugguggaa

SEQ ID NO: 757152 - RNA, 21 nt, Homo sapiens
uccccuguagcagucacugac

SEQ ID NO: 757153 - RNA, 12 nt, Homo sapiens
uccccugucuac

SEQ ID NO: 757154 - RNA, 21 nt, Homo sapiens
uccccuguucaaagaugcauu

SEQ ID NO: 757155 - RNA, 20 nt, Homo sapiens
uccccuucucucaucucuua

SEQ ID NO: 757156 - RNA, 15 nt, Homo sapiens
uccccuuucacaggu

SEQ ID NO: 757157 - RNA, 21 nt, Homo sapiens
uccccuuuguguagaaagcca

SEQ ID NO: 757158 - RNA, 21 nt, Homo sapiens
ucccgacauaacauuguacug

SEQ ID NO: 757159 - RNA, 14 nt, Homo sapiens
ucccgaggaacucg

SEQ ID NO: 757160 - RNA, 20 nt, Homo sapiens
ucccgaguagcugggauuac

SEQ ID NO: 757161 - RNA, 19 nt, Homo sapiens
ucccgccuuccuccuccac

SEQ ID NO: 757162 - RNA, 19 nt, Homo sapiens
ucccgcgugaagaugucac

SEQ ID NO: 757163 - RNA, 19 nt, Homo sapiens
ucccggcgucccuaccucc

SEQ ID NO: 757164 - RNA, 18 nt, Homo sapiens
ucccggggccagcacuuc

SEQ ID NO: 757165 - RNA, 16 nt, Homo sapiens
ucccguaucacagugu

SEQ ID NO: 757166 - RNA, 23 nt, Homo sapiens
ucccguuucuuaaaaaacauaua

SEQ ID NO: 757167 - RNA, 22 nt, Homo sapiens
ucccuaauucucuucgcuguga

SEQ ID NO: 757168 - RNA, 23 nt, Homo sapiens
ucccuacaaaggauaugaacuca

SEQ ID NO: 757169 - RNA, 19 nt, Homo sapiens
ucccuacaucuaacucauc

SEQ ID NO: 757170 - RNA, 23 nt, Homo sapiens
ucccuaguguagagcaagccagu

SEQ ID NO: 757171 - RNA, 17 nt, Homo sapiens
ucccuaguuagcaucca

SEQ ID NO: 757172 - RNA, 17 nt, Homo sapiens
ucccucaaagcacacgu

SEQ ID NO: 757173 - RNA, 22 nt, Homo sapiens
ucccucaaaugcgcgugugcac

SEQ ID NO: 757174 - RNA, 23 nt, Homo sapiens
ucccucacaccgcgucuggugac

SEQ ID NO: 757175 - RNA, 23 nt, Homo sapiens
ucccucaccuuggcaccagacac

SEQ ID NO: 757176 - RNA, 18 nt, Homo sapiens
ucccucacuguugaauuu

SEQ ID NO: 757177 - RNA, 19 nt, Homo sapiens
ucccucaggccgaaggagg

SEQ ID NO: 757178 - RNA, 18 nt, Homo sapiens
ucccucagugaaguagca

SEQ ID NO: 757179 - RNA, 19 nt, Homo sapiens
ucccucagugaaguagcaa

SEQ ID NO: 757180 - RNA, 14 nt, Homo sapiens
ucccuccacauuuc

SEQ ID NO: 757181 - RNA, 13 nt, Homo sapiens
ucccuccaccagc

SEQ ID NO: 757182 - RNA, 16 nt, Homo sapiens
ucccuccccagugcaa

SEQ ID NO: 757183 - RNA, 14 nt, Homo sapiens
ucccucccuaucua

SEQ ID NO: 757184 - RNA, 14 nt, Homo sapiens
ucccuccggccaua

SEQ ID NO: 757185 - RNA, 21 nt, Homo sapiens
ucccuccuuggauuucugacc

SEQ ID NO: 757186 - RNA, 16 nt, Homo sapiens
ucccucgcaugucucc

SEQ ID NO: 757187 - RNA, 19 nt, Homo sapiens
ucccucguccgucugucuc

SEQ ID NO: 757188 - RNA, 22 nt, Homo sapiens
ucccucgucuucagcugcauuu

SEQ ID NO: 757189 - RNA, 20 nt, Homo sapiens
ucccucuaagcacauuccaa

SEQ ID NO: 757190 - RNA, 19 nt, Homo sapiens
ucccucuaauuuaucuugu

SEQ ID NO: 757191 - RNA, 20 nt, Homo sapiens
ucccucucccggcaacaucu

SEQ ID NO: 757192 - RNA, 19 nt, Homo sapiens
ucccucuccuauguggcag

SEQ ID NO: 757193 - RNA, 22 nt, Homo sapiens
ucccucucuuccccuucccuua

SEQ ID NO: 757194 - RNA, 14 nt, Homo sapiens
ucccucuggcccug

SEQ ID NO: 757195 - RNA, 17 nt, Homo sapiens
ucccucuucugugguca

SEQ ID NO: 757196 - RNA, 17 nt, Homo sapiens
ucccugaaaccuaguac

SEQ ID NO: 757197 - RNA, 14 nt, Homo sapiens
ucccugacuccucc

SEQ ID NO: 757198 - RNA, 14 nt, Homo sapiens
ucccugacuguaaa

SEQ ID NO: 757199 - RNA, 15 nt, Homo sapiens
ucccugacuguaaau

SEQ ID NO: 757200 - RNA, 17 nt, Homo sapiens
ucccugcagaugccacc

SEQ ID NO: 757201 - RNA, 23 nt, Homo sapiens
ucccugcagaugccacccuagcc

SEQ ID NO: 757202 - RNA, 22 nt, Homo sapiens
ucccugcccuccccugcuccca

SEQ ID NO: 757203 - RNA, 17 nt, Homo sapiens
ucccugccuucacugug

SEQ ID NO: 757204 - RNA, 16 nt, Homo sapiens
ucccugccuugcugac

SEQ ID NO: 757205 - RNA, 18 nt, Homo sapiens
ucccugcucuaacaccug

SEQ ID NO: 757206 - RNA, 15 nt, Homo sapiens
ucccugcugugccau

SEQ ID NO: 757207 - RNA, 14 nt, Homo sapiens
ucccugcuugcaca

SEQ ID NO: 757208 - RNA, 22 nt, Homo sapiens
aguccagacacuuaacucaauu

SEQ ID NO: 757209 - RNA, 16 nt, Homo sapiens
aguccaggacuggguc

SEQ ID NO: 757210 - RNA, 15 nt, Homo sapiens
aguccaggguggaug

SEQ ID NO: 757211 - RNA, 17 nt, Homo sapiens
aguccaguaaagccuua

SEQ ID NO: 757212 - RNA, 12 nt, Homo sapiens
aguccagucucu

SEQ ID NO: 757213 - RNA, 20 nt, Homo sapiens
agucccagaauuguaucuca

SEQ ID NO: 757214 - RNA, 22 nt, Homo sapiens
agucccagacaauuccauucaa

SEQ ID NO: 757215 - RNA, 16 nt, Homo sapiens
agucccagcuacucag

SEQ ID NO: 757216 - RNA, 13 nt, Homo sapiens
agucccggagccc

SEQ ID NO: 757217 - RNA, 21 nt, Homo sapiens
agucccucaugcaaaucaauu

SEQ ID NO: 757218 - RNA, 17 nt, Homo sapiens
agucccuccacauuucc

SEQ ID NO: 757219 - RNA, 19 nt, Homo sapiens
agucccugcagcccuuugc

SEQ ID NO: 757220 - RNA, 17 nt, Homo sapiens
agucccugccaucaugu

SEQ ID NO: 757221 - RNA, 12 nt, Homo sapiens
agucccugugaa

SEQ ID NO: 757222 - RNA, 19 nt, Homo sapiens
aguccgacccagacaucca

SEQ ID NO: 757223 - RNA, 18 nt, Homo sapiens
aguccgcagucuggccug

SEQ ID NO: 757224 - RNA, 20 nt, Homo sapiens
aguccuauuuuucaauggga

SEQ ID NO: 757225 - RNA, 16 nt, Homo sapiens
aguccuucugccauuu

SEQ ID NO: 757226 - RNA, 16 nt, Homo sapiens
aguccuuggcuugcca

SEQ ID NO: 757227 - RNA, 19 nt, Homo sapiens
aguccuugggcaguucuca

SEQ ID NO: 757228 - RNA, 22 nt, Homo sapiens
agucgaccccaaaggaacacug

SEQ ID NO: 757229 - RNA, 21 nt, Homo sapiens
agucgcaggauccgcugccac

SEQ ID NO: 757230 - RNA, 19 nt, Homo sapiens
agucggccccaucucucau

SEQ ID NO: 757231 - RNA, 18 nt, Homo sapiens
agucguggggugugcugg

SEQ ID NO: 757232 - RNA, 13 nt, Homo sapiens
agucuaaaacaca

SEQ ID NO: 757233 - RNA, 21 nt, Homo sapiens
agucuaaggaugcuaaaccuu

SEQ ID NO: 757234 - RNA, 18 nt, Homo sapiens
agucuaggcuaagcacuu

SEQ ID NO: 757235 - RNA, 19 nt, Homo sapiens
agucuauccuagucuucac

SEQ ID NO: 757236 - RNA, 23 nt, Homo sapiens
agucuauuaaagaaagaaaaaug

SEQ ID NO: 757237 - RNA, 15 nt, Homo sapiens
agucucacagagaag

SEQ ID NO: 757238 - RNA, 16 nt, Homo sapiens
agucucagagcacaga

SEQ ID NO: 757239 - RNA, 19 nt, Homo sapiens
agucucagcccugaccuuc

SEQ ID NO: 757240 - RNA, 14 nt, Homo sapiens
agucucagcugcug

SEQ ID NO: 757241 - RNA, 15 nt, Homo sapiens
agucucccacuaaaa

SEQ ID NO: 757242 - RNA, 23 nt, Homo sapiens
agucucuauaccaauaaagugac

SEQ ID NO: 757243 - RNA, 19 nt, Homo sapiens
agucucucugcaagacaga

SEQ ID NO: 757244 - RNA, 20 nt, Homo sapiens
agucucugaguccuuugcua

SEQ ID NO: 757245 - RNA, 13 nt, Homo sapiens
agucucugugaau

SEQ ID NO: 757246 - RNA, 17 nt, Homo sapiens
agucucuucuaagcaaa

SEQ ID NO: 757247 - RNA, 17 nt, Homo sapiens
agucucuuucucugaca

SEQ ID NO: 757248 - RNA, 18 nt, Homo sapiens
agucugaaugcugccaca

SEQ ID NO: 757249 - RNA, 23 nt, Homo sapiens
agucugaaugcugccacaaccag

SEQ ID NO: 757250 - RNA, 15 nt, Homo sapiens
agucugaguaaaauc

SEQ ID NO: 757251 - RNA, 15 nt, Homo sapiens
agucugcaguauuga

SEQ ID NO: 757252 - RNA, 10 nt, Homo sapiens
agucugcucc

SEQ ID NO: 757253 - RNA, 18 nt, Homo sapiens
agucuggcaacagagcaa

SEQ ID NO: 757254 - RNA, 22 nt, Homo sapiens
agucuguugugugucaugccag

SEQ ID NO: 757255 - RNA, 16 nt, Homo sapiens
agucuuaacuuuucac

SEQ ID NO: 757256 - RNA, 14 nt, Homo sapiens
agucuuugcaguuc

SEQ ID NO: 757257 - RNA, 17 nt, Homo sapiens
agugaaaaaggaaugau

SEQ ID NO: 757258 - RNA, 18 nt, Homo sapiens
agugaaaccccaucucua

SEQ ID NO: 757259 - RNA, 14 nt, Homo sapiens
agugaaacuaugau

SEQ ID NO: 757260 - RNA, 19 nt, Homo sapiens
agugaacacacacaaggga

SEQ ID NO: 757261 - RNA, 19 nt, Homo sapiens
agugaacacucuacuacau

SEQ ID NO: 757262 - RNA, 14 nt, Homo sapiens
agugaacuaugaag

SEQ ID NO: 757263 - RNA, 20 nt, Homo sapiens
agugaagaacacuacugcua

SEQ ID NO: 757264 - RNA, 17 nt, Homo sapiens
agugaagccaaagggac

SEQ ID NO: 757265 - RNA, 15 nt, Homo sapiens
agugaaguugugcaa

SEQ ID NO: 757266 - RNA, 14 nt, Homo sapiens
agugaauacauuaa

SEQ ID NO: 757267 - RNA, 23 nt, Homo sapiens
agugaauacauuaacggugcuaa

SEQ ID NO: 757268 - RNA, 14 nt, Homo sapiens
agugaaucuguauu

SEQ ID NO: 757269 - RNA, 13 nt, Homo sapiens
agugaauggucuc

SEQ ID NO: 757270 - RNA, 13 nt, Homo sapiens
agugacacuggac

SEQ ID NO: 757271 - RNA, 18 nt, Homo sapiens
agugacagagacccagau

SEQ ID NO: 757272 - RNA, 22 nt, Homo sapiens
agugacagagacccagaucuca

SEQ ID NO: 757273 - RNA, 12 nt, Homo sapiens
agugacauagcc

SEQ ID NO: 757274 - RNA, 22 nt, Homo sapiens
agugacauauauauguauauac

SEQ ID NO: 757275 - RNA, 23 nt, Homo sapiens
agugaccccugaccucacuguga

SEQ ID NO: 757276 - RNA, 16 nt, Homo sapiens
agugaccccuucccug

SEQ ID NO: 757277 - RNA, 21 nt, Homo sapiens
agugaccgaaagguuauguua

SEQ ID NO: 757278 - RNA, 13 nt, Homo sapiens
agugacugacccc

SEQ ID NO: 757279 - RNA, 18 nt, Homo sapiens
agugacuguaucugugua

SEQ ID NO: 757280 - RNA, 20 nt, Homo sapiens
agugacuuccaaacaacucu

SEQ ID NO: 757281 - RNA, 17 nt, Homo sapiens
agugacuuuacaggagg

SEQ ID NO: 757282 - RNA, 13 nt, Homo sapiens
agugagaaacuga

SEQ ID NO: 757283 - RNA, 13 nt, Homo sapiens
agugagaagccag

SEQ ID NO: 757284 - RNA, 22 nt, Homo sapiens
agugagacaaaaagcacuagua

SEQ ID NO: 757285 - RNA, 13 nt, Homo sapiens
agugagacuccac

SEQ ID NO: 757286 - RNA, 20 nt, Homo sapiens
agugagcacacccgugugca

SEQ ID NO: 757287 - RNA, 21 nt, Homo sapiens
agugagcacacccgugugcac

SEQ ID NO: 757288 - RNA, 21 nt, Homo sapiens
agugagcagagauguacugca

SEQ ID NO: 757289 - RNA, 11 nt, Homo sapiens
agugagccaug

SEQ ID NO: 757290 - RNA, 16 nt, Homo sapiens
agugagccaugaucau

SEQ ID NO: 757291 - RNA, 16 nt, Homo sapiens
agugagccgagaucac

SEQ ID NO: 757292 - RNA, 17 nt, Homo sapiens
agugagccgagaucaca

SEQ ID NO: 757293 - RNA, 16 nt, Homo sapiens
agugagcugagaucac

SEQ ID NO: 757294 - RNA, 19 nt, Homo sapiens
agugagcuguguucuugcc

SEQ ID NO: 757295 - RNA, 17 nt, Homo sapiens
agugagcuuugcugcua

SEQ ID NO: 757296 - RNA, 16 nt, Homo sapiens
agugagggcucacuca

SEQ ID NO: 757297 - RNA, 20 nt, Homo sapiens
agugagggcucacucagcca

SEQ ID NO: 757298 - RNA, 13 nt, Homo sapiens
agugagugaucac

SEQ ID NO: 757299 - RNA, 15 nt, Homo sapiens
agugagugaucacug

SEQ ID NO: 757300 - RNA, 19 nt, Homo sapiens
agugaguggccccaccugu

SEQ ID NO: 757301 - RNA, 18 nt, Homo sapiens
agugauagaaaagugugg

SEQ ID NO: 757302 - RNA, 22 nt, Homo sapiens
agugauaucccccagccucaag

SEQ ID NO: 757303 - RNA, 19 nt, Homo sapiens
agugauccuuccaccucag

SEQ ID NO: 757304 - RNA, 14 nt, Homo sapiens
agugauggucagag

SEQ ID NO: 757305 - RNA, 16 nt, Homo sapiens
agugaugugugagcua

SEQ ID NO: 757306 - RNA, 23 nt, Homo sapiens
agugauguuagcagacccagcuu

SEQ ID NO: 757307 - RNA, 15 nt, Homo sapiens
agugauucccaacuc

SEQ ID NO: 757308 - RNA, 19 nt, Homo sapiens
agugauucuccugccucag

SEQ ID NO: 757309 - RNA, 17 nt, Homo sapiens
agugauugacacacagc

SEQ ID NO: 757310 - RNA, 22 nt, Homo sapiens
agugauugauagaguguuauca

SEQ ID NO: 757311 - RNA, 14 nt, Homo sapiens
agugauugcagcuu

SEQ ID NO: 757312 - RNA, 23 nt, Homo sapiens
agugauugugucugcauuguuau

SEQ ID NO: 757313 - RNA, 22 nt, Homo sapiens
agugcaaaagugaaacauacaa

SEQ ID NO: 757314 - RNA, 21 nt, Homo sapiens
agugcaacccagucacacugu

SEQ ID NO: 757315 - RNA, 20 nt, Homo sapiens
agugcacaggcgcaucccag

SEQ ID NO: 757316 - RNA, 16 nt, Homo sapiens
agugcaccuacugcuu

SEQ ID NO: 757317 - RNA, 18 nt, Homo sapiens
agugcacuaaacaaauaa

SEQ ID NO: 757318 - RNA, 12 nt, Homo sapiens
agugcagugaau

SEQ ID NO: 757319 - RNA, 18 nt, Homo sapiens
agugcaguggcaucaucu

SEQ ID NO: 757320 - RNA, 20 nt, Homo sapiens
agugcaguggcaucaucuca

SEQ ID NO: 757321 - RNA, 22 nt, Homo sapiens
agugcaguggcaucaucucagc

SEQ ID NO: 757322 - RNA, 22 nt, Homo sapiens
agugcaguggcgcgaucucagc

SEQ ID NO: 757323 - RNA, 16 nt, Homo sapiens
ucccugcuugcacacu

SEQ ID NO: 757324 - RNA, 21 nt, Homo sapiens
ucccuggagaaggcauguucc

SEQ ID NO: 757325 - RNA, 21 nt, Homo sapiens
ucccuggaggagaaguauucc

SEQ ID NO: 757326 - RNA, 15 nt, Homo sapiens
ucccuggauguggau

SEQ ID NO: 757327 - RNA, 13 nt, Homo sapiens
ucccuggcuguga

SEQ ID NO: 757328 - RNA, 11 nt, Homo sapiens
ucccugggaag

SEQ ID NO: 757329 - RNA, 19 nt, Homo sapiens
ucccugguggggugugcau

SEQ ID NO: 757330 - RNA, 22 nt, Homo sapiens
ucccugguggggugugcaugcc

SEQ ID NO: 757331 - RNA, 21 nt, Homo sapiens
ucccuguaggguccaaccaga

SEQ ID NO: 757332 - RNA, 16 nt, Homo sapiens
ucccuguccuugcccu

SEQ ID NO: 757333 - RNA, 14 nt, Homo sapiens
ucccugugccagac

SEQ ID NO: 757334 - RNA, 19 nt, Homo sapiens
ucccuuaagagucauccag

SEQ ID NO: 757335 - RNA, 21 nt, Homo sapiens
ucccuugcuggaaaacccaaa

SEQ ID NO: 757336 - RNA, 14 nt, Homo sapiens
ucccuugcuguaug

SEQ ID NO: 757337 - RNA, 16 nt, Homo sapiens
ucccuugcuguaugcu

SEQ ID NO: 757338 - RNA, 23 nt, Homo sapiens
ucccuuggaaaucugccaugagc

SEQ ID NO: 757339 - RNA, 21 nt, Homo sapiens
ucccuugggaagggcagggaa

SEQ ID NO: 757340 - RNA, 17 nt, Homo sapiens
ucccuuuaucaguuuga

SEQ ID NO: 757341 - RNA, 19 nt, Homo sapiens
ucccuuuaugcagagccac

SEQ ID NO: 757342 - RNA, 18 nt, Homo sapiens
ucccuuuccuacucucag

SEQ ID NO: 757343 - RNA, 13 nt, Homo sapiens
ucccuuugccagu

SEQ ID NO: 757344 - RNA, 17 nt, Homo sapiens
ucccuuuguugcacacu

SEQ ID NO: 757345 - RNA, 21 nt, Homo sapiens
ucccuuuguugcacacucacu

SEQ ID NO: 757346 - RNA, 21 nt, Homo sapiens
ucccuuuugcuagagcugaca

SEQ ID NO: 757347 - RNA, 19 nt, Homo sapiens
ucccuuuuuuuacauuuca

SEQ ID NO: 757348 - RNA, 17 nt, Homo sapiens
uccgaggccgugcagug

SEQ ID NO: 757349 - RNA, 16 nt, Homo sapiens
uccgaggcugaggcag

SEQ ID NO: 757350 - RNA, 18 nt, Homo sapiens
uccgagugugauuugaau

SEQ ID NO: 757351 - RNA, 15 nt, Homo sapiens
uccgaucaacauuua

SEQ ID NO: 757352 - RNA, 23 nt, Homo sapiens
uccgcaauguggagcagcagcca

SEQ ID NO: 757353 - RNA, 15 nt, Homo sapiens
uccgcaccagcugcu

SEQ ID NO: 757354 - RNA, 21 nt, Homo sapiens
uccgcagaccugcugugauga

SEQ ID NO: 757355 - RNA, 22 nt, Homo sapiens
uccgcccccggauuugcucagg

SEQ ID NO: 757356 - RNA, 22 nt, Homo sapiens
uccgcugccaccacgucugcca

SEQ ID NO: 757357 - RNA, 21 nt, Homo sapiens
uccgcuuucucuugcugccac

SEQ ID NO: 757358 - RNA, 21 nt, Homo sapiens
uccggaagcugucgacuucau

SEQ ID NO: 757359 - RNA, 13 nt, Homo sapiens
uccggaauccuug

SEQ ID NO: 757360 - RNA, 17 nt, Homo sapiens
uccggaggcugaggcag

SEQ ID NO: 757361 - RNA, 20 nt, Homo sapiens
uccggagugagcaauggagu

SEQ ID NO: 757362 - RNA, 20 nt, Homo sapiens
uccggauuucuaacaguccu

SEQ ID NO: 757363 - RNA, 21 nt, Homo sapiens
uccggcaaugcccugugcaug

SEQ ID NO: 757364 - RNA, 22 nt, Homo sapiens
uccggcugaaggcugagugucc

SEQ ID NO: 757365 - RNA, 23 nt, Homo sapiens
uccggcugaaggcugaguguccg

SEQ ID NO: 757366 - RNA, 23 nt, Homo sapiens
uccgggaacuuugcagcauacca

SEQ ID NO: 757367 - RNA, 15 nt, Homo sapiens
uccgguuaucaagca

SEQ ID NO: 757368 - RNA, 18 nt, Homo sapiens
uccgguuugccauguugc

SEQ ID NO: 757369 - RNA, 13 nt, Homo sapiens
uccguacauucaa

SEQ ID NO: 757370 - RNA, 18 nt, Homo sapiens
uccguccaggagccugug

SEQ ID NO: 757371 - RNA, 17 nt, Homo sapiens
uccgucugucucgaugc

SEQ ID NO: 757372 - RNA, 13 nt, Homo sapiens
uccgugccuccac

SEQ ID NO: 757373 - RNA, 20 nt, Homo sapiens
uccguggcacugcauacaau

SEQ ID NO: 757374 - RNA, 23 nt, Homo sapiens
uccgugguggcaccgagaccaaa

SEQ ID NO: 757375 - RNA, 21 nt, Homo sapiens
uccgugugauugucuuugaau

SEQ ID NO: 757376 - RNA, 15 nt, Homo sapiens
uccguuaugccaccu

SEQ ID NO: 757377 - RNA, 20 nt, Homo sapiens
uccguucaauaagcauuuca

SEQ ID NO: 757378 - RNA, 24 nt, Homo sapiens
uccuaaagaaaaauaucuuggccu

SEQ ID NO: 757379 - RNA, 19 nt, Homo sapiens
uccuaaauuuuuacaucaa

SEQ ID NO: 757380 - RNA, 18 nt, Homo sapiens
uccuaagaagagugcugu

SEQ ID NO: 757381 - RNA, 17 nt, Homo sapiens
uccuaagcaacuaggcc

SEQ ID NO: 757382 - RNA, 16 nt, Homo sapiens
uccuaagcuauucagu

SEQ ID NO: 757383 - RNA, 19 nt, Homo sapiens
uccuaaggccuuagggguc

SEQ ID NO: 757384 - RNA, 21 nt, Homo sapiens
uccuaagggucgaaagcucua

SEQ ID NO: 757385 - RNA, 16 nt, Homo sapiens
uccuaagguccaacaa

SEQ ID NO: 757386 - RNA, 19 nt, Homo sapiens
uccuaagucucuuacaaaa

SEQ ID NO: 757387 - RNA, 14 nt, Homo sapiens
uccuaauacguauu

SEQ ID NO: 757388 - RNA, 22 nt, Homo sapiens
uccuaaucuuaucaauucugau

SEQ ID NO: 757389 - RNA, 16 nt, Homo sapiens
uccuaauuguccacau

SEQ ID NO: 757390 - RNA, 14 nt, Homo sapiens
uccuacccacuggu

SEQ ID NO: 757391 - RNA, 14 nt, Homo sapiens
uccuacccuuccag

SEQ ID NO: 757392 - RNA, 12 nt, Homo sapiens
uccuaccucagc

SEQ ID NO: 757393 - RNA, 16 nt, Homo sapiens
uccuaccucuggugau

SEQ ID NO: 757394 - RNA, 19 nt, Homo sapiens
uccuacgauacgcuacuau

SEQ ID NO: 757395 - RNA, 18 nt, Homo sapiens
uccuagaagugguuugua

SEQ ID NO: 757396 - RNA, 17 nt, Homo sapiens
uccuagccccgagacac

SEQ ID NO: 757397 - RNA, 20 nt, Homo sapiens
uccuaguaauaaagugaaau

SEQ ID NO: 757398 - RNA, 16 nt, Homo sapiens
uccuaguaauugccua

SEQ ID NO: 757399 - RNA, 15 nt, Homo sapiens
uccuagucuucacaa

SEQ ID NO: 757400 - RNA, 14 nt, Homo sapiens
uccuagugaaagag

SEQ ID NO: 757401 - RNA, 16 nt, Homo sapiens
uccuauaacacuguga

SEQ ID NO: 757402 - RNA, 15 nt, Homo sapiens
uccuauguaacugca

SEQ ID NO: 757403 - RNA, 14 nt, Homo sapiens
uccucaaagggaga

SEQ ID NO: 757404 - RNA, 22 nt, Homo sapiens
uccucaauucaauguggugaug

SEQ ID NO: 757405 - RNA, 23 nt, Homo sapiens
uccucacaucuuucacacuucca

SEQ ID NO: 757406 - RNA, 12 nt, Homo sapiens
uccucacgugca

SEQ ID NO: 757407 - RNA, 16 nt, Homo sapiens
uccucacuguauccag

SEQ ID NO: 757408 - RNA, 16 nt, Homo sapiens
uccucagaggacaguu

SEQ ID NO: 757409 - RNA, 19 nt, Homo sapiens
uccucagccuugccagaga

SEQ ID NO: 757410 - RNA, 21 nt, Homo sapiens
uccucagcugccaagcacucg

SEQ ID NO: 757411 - RNA, 24 nt, Homo sapiens
uccucagggacagagacaccugca

SEQ ID NO: 757412 - RNA, 19 nt, Homo sapiens
uccucauccccacaaucug

SEQ ID NO: 757413 - RNA, 13 nt, Homo sapiens
uccucauuccuga

SEQ ID NO: 757414 - RNA, 20 nt, Homo sapiens
uccucauugccuccuguucu

SEQ ID NO: 757415 - RNA, 13 nt, Homo sapiens
uccuccaacagcu

SEQ ID NO: 757416 - RNA, 14 nt, Homo sapiens
uccuccaagcuauu

SEQ ID NO: 757417 - RNA, 16 nt, Homo sapiens
uccuccacagugcugc

SEQ ID NO: 757418 - RNA, 22 nt, Homo sapiens
uccuccagcccagacccagugg

SEQ ID NO: 757419 - RNA, 13 nt, Homo sapiens
uccuccaggguga

SEQ ID NO: 757420 - RNA, 13 nt, Homo sapiens
uccuccaucccaa

SEQ ID NO: 757421 - RNA, 12 nt, Homo sapiens
uccucccaacaa

SEQ ID NO: 757422 - RNA, 22 nt, Homo sapiens
uccucccagugccuucugggaa

SEQ ID NO: 757423 - RNA, 21 nt, Homo sapiens
uccucccaucuccuuccccca

SEQ ID NO: 757424 - RNA, 11 nt, Homo sapiens
uccuccccaaa

SEQ ID NO: 757425 - RNA, 13 nt, Homo sapiens
uccuccccagcgc

SEQ ID NO: 757426 - RNA, 17 nt, Homo sapiens
uccuccccuauugcgcu

SEQ ID NO: 757427 - RNA, 14 nt, Homo sapiens
uccuccuacuuaca

SEQ ID NO: 757428 - RNA, 10 nt, Homo sapiens
uccuccucag

SEQ ID NO: 757429 - RNA, 19 nt, Homo sapiens
uccuccugcuucaugggaa

SEQ ID NO: 757430 - RNA, 14 nt, Homo sapiens
uccuccugugcuau

SEQ ID NO: 757431 - RNA, 22 nt, Homo sapiens
uccuccuuuaccuuucagugca

SEQ ID NO: 757432 - RNA, 17 nt, Homo sapiens
uccucuacuguuuaaca

SEQ ID NO: 757433 - RNA, 21 nt, Homo sapiens
uccucuagcccacucccugcc

SEQ ID NO: 757434 - RNA, 22 nt, Homo sapiens
uccucuaguaagaugcacugaa

SEQ ID NO: 757435 - RNA, 19 nt, Homo sapiens
uccucucaagcuagccaga

SEQ ID NO: 757436 - RNA, 13 nt, Homo sapiens
uccucuccacugc

SEQ ID NO: 757437 - RNA, 21 nt, Homo sapiens
agugcaguggcgugaucucag

SEQ ID NO: 757438 - RNA, 22 nt, Homo sapiens
agugcaguggcgugaucucagc

SEQ ID NO: 757439 - RNA, 20 nt, Homo sapiens
agugcaguggcgugaucucg

SEQ ID NO: 757440 - RNA, 20 nt, Homo sapiens
agugcaguggugugaucucg

SEQ ID NO: 757441 - RNA, 14 nt, Homo sapiens
agugcaguuuaaaa

SEQ ID NO: 757442 - RNA, 18 nt, Homo sapiens
agugcaucagauguaaca

SEQ ID NO: 757443 - RNA, 21 nt, Homo sapiens
agugccaagcacagugccugc

SEQ ID NO: 757444 - RNA, 18 nt, Homo sapiens
agugccaauauuucugau

SEQ ID NO: 757445 - RNA, 21 nt, Homo sapiens
agugccacccaccuuugccac

SEQ ID NO: 757446 - RNA, 19 nt, Homo sapiens
agugccacuugacauuccu

SEQ ID NO: 757447 - RNA, 17 nt, Homo sapiens
agugcccaacuguuaua

SEQ ID NO: 757448 - RNA, 14 nt, Homo sapiens
agugcccuacaaag

SEQ ID NO: 757449 - RNA, 16 nt, Homo sapiens
agugccguaacaacug

SEQ ID NO: 757450 - RNA, 14 nt, Homo sapiens
agugccugggaaug

SEQ ID NO: 757451 - RNA, 14 nt, Homo sapiens
agugccuucucuau

SEQ ID NO: 757452 - RNA, 18 nt, Homo sapiens
agugcggacaaguuuuaa

SEQ ID NO: 757453 - RNA, 20 nt, Homo sapiens
agugcgugguauaaucucca

SEQ ID NO: 757454 - RNA, 18 nt, Homo sapiens
agugcuaaacaaguaaga

SEQ ID NO: 757455 - RNA, 19 nt, Homo sapiens
agugcuauaaaugccagag

SEQ ID NO: 757456 - RNA, 14 nt, Homo sapiens
agugcucucagcug

SEQ ID NO: 757457 - RNA, 15 nt, Homo sapiens
agugcugaacagugg

SEQ ID NO: 757458 - RNA, 19 nt, Homo sapiens
agugcugaaggaauggaag

SEQ ID NO: 757459 - RNA, 22 nt, Homo sapiens
agugcugaauuaagcagcucac

SEQ ID NO: 757460 - RNA, 20 nt, Homo sapiens
agugcugcucucccaucucc

SEQ ID NO: 757461 - RNA, 21 nt, Homo sapiens
agugcugggauuacaggcaug

SEQ ID NO: 757462 - RNA, 19 nt, Homo sapiens
agugcugggauuacaggcg

SEQ ID NO: 757463 - RNA, 20 nt, Homo sapiens
agugcugggauuacaggugu

SEQ ID NO: 757464 - RNA, 17 nt, Homo sapiens
agugcuuaguguacuug

SEQ ID NO: 757465 - RNA, 15 nt, Homo sapiens
agugcuucagaguuu

SEQ ID NO: 757466 - RNA, 17 nt, Homo sapiens
agugcuucagaguuugu

SEQ ID NO: 757467 - RNA, 15 nt, Homo sapiens
agugcuucuccagcc

SEQ ID NO: 757468 - RNA, 22 nt, Homo sapiens
aguggacucagcagugaccaca

SEQ ID NO: 757469 - RNA, 14 nt, Homo sapiens
aguggagaugaagc

SEQ ID NO: 757470 - RNA, 13 nt, Homo sapiens
aguggagccaggu

SEQ ID NO: 757471 - RNA, 19 nt, Homo sapiens
aguggaguugaaacugcua

SEQ ID NO: 757472 - RNA, 14 nt, Homo sapiens
aguggaguugacuc

SEQ ID NO: 757473 - RNA, 15 nt, Homo sapiens
aguggauaauuccaa

SEQ ID NO: 757474 - RNA, 13 nt, Homo sapiens
aguggauucccag

SEQ ID NO: 757475 - RNA, 14 nt, Homo sapiens
aguggauuuuacau

SEQ ID NO: 757476 - RNA, 14 nt, Homo sapiens
aguggcaaaacacu

SEQ ID NO: 757477 - RNA, 15 nt, Homo sapiens
aguggcaagaccaaa

SEQ ID NO: 757478 - RNA, 18 nt, Homo sapiens
aguggcacaggagacucc

SEQ ID NO: 757479 - RNA, 20 nt, Homo sapiens
aguggcaggugggcugccug

SEQ ID NO: 757480 - RNA, 20 nt, Homo sapiens
aguggcaucaucucagcuca

SEQ ID NO: 757481 - RNA, 17 nt, Homo sapiens
aguggcauuacauugag

SEQ ID NO: 757482 - RNA, 15 nt, Homo sapiens
aguggcauuugucag

SEQ ID NO: 757483 - RNA, 14 nt, Homo sapiens
aguggccuggccag

SEQ ID NO: 757484 - RNA, 20 nt, Homo sapiens
aguggcgcaaucucggcuca

SEQ ID NO: 757485 - RNA, 16 nt, Homo sapiens
aguggcgcgaucucag

SEQ ID NO: 757486 - RNA, 15 nt, Homo sapiens
aguggcgugaucuca

SEQ ID NO: 757487 - RNA, 16 nt, Homo sapiens
aguggcgugaucucag

SEQ ID NO: 757488 - RNA, 20 nt, Homo sapiens
aguggcuaccuacauacaau

SEQ ID NO: 757489 - RNA, 21 nt, Homo sapiens
aguggcucacgccuaugaucc

SEQ ID NO: 757490 - RNA, 12 nt, Homo sapiens
aguggcuucucu

SEQ ID NO: 757491 - RNA, 19 nt, Homo sapiens
aguggcuugagcuucuggg

SEQ ID NO: 757492 - RNA, 19 nt, Homo sapiens
aguggcuuggccucaagag

SEQ ID NO: 757493 - RNA, 15 nt, Homo sapiens
agugggaacucugac

SEQ ID NO: 757494 - RNA, 13 nt, Homo sapiens
agugggacccaua

SEQ ID NO: 757495 - RNA, 14 nt, Homo sapiens
agugggacccauag

SEQ ID NO: 757496 - RNA, 17 nt, Homo sapiens
agugggagccagggcug

SEQ ID NO: 757497 - RNA, 22 nt, Homo sapiens
agugggauuuccagaaccacac

SEQ ID NO: 757498 - RNA, 20 nt, Homo sapiens
aguggggccuccuuguccag

SEQ ID NO: 757499 - RNA, 12 nt, Homo sapiens
aguggggugcug

SEQ ID NO: 757500 - RNA, 17 nt, Homo sapiens
agugguaaauacuguga

SEQ ID NO: 757501 - RNA, 14 nt, Homo sapiens
agugguagcaagaa

SEQ ID NO: 757502 - RNA, 13 nt, Homo sapiens
aguggucgaguga

SEQ ID NO: 757503 - RNA, 15 nt, Homo sapiens
aguggucgcuuacuu

SEQ ID NO: 757504 - RNA, 13 nt, Homo sapiens
aguggugccauca

SEQ ID NO: 757505 - RNA, 22 nt, Homo sapiens
aguggugccaucaccacggcuc

SEQ ID NO: 757506 - RNA, 22 nt, Homo sapiens
agugguggguaauuguacaaua

SEQ ID NO: 757507 - RNA, 15 nt, Homo sapiens
agugguggucuucaa

SEQ ID NO: 757508 - RNA, 16 nt, Homo sapiens
agugguggucuucaag

SEQ ID NO: 757509 - RNA, 20 nt, Homo sapiens
aguggugugaucucggcuca

SEQ ID NO: 757510 - RNA, 15 nt, Homo sapiens
agugguguucagcca

SEQ ID NO: 757511 - RNA, 19 nt, Homo sapiens
agugguucaagcacacugg

SEQ ID NO: 757512 - RNA, 20 nt, Homo sapiens
agugguugcuguccucucau

SEQ ID NO: 757513 - RNA, 23 nt, Homo sapiens
aguguaaaaaaugucucauguca

SEQ ID NO: 757514 - RNA, 22 nt, Homo sapiens
aguguaagcccugcuuagcuca

SEQ ID NO: 757515 - RNA, 17 nt, Homo sapiens
aguguaaugugacuuca

SEQ ID NO: 757516 - RNA, 13 nt, Homo sapiens
aguguacauguac

SEQ ID NO: 757517 - RNA, 16 nt, Homo sapiens
aguguaccacuacuua

SEQ ID NO: 757518 - RNA, 17 nt, Homo sapiens
aguguaugauuacuggc

SEQ ID NO: 757519 - RNA, 21 nt, Homo sapiens
aguguauucucuucacagugc

SEQ ID NO: 757520 - RNA, 23 nt, Homo sapiens
aguguauuuuauguguggcccaa

SEQ ID NO: 757521 - RNA, 18 nt, Homo sapiens
agugucacugagcugugu

SEQ ID NO: 757522 - RNA, 21 nt, Homo sapiens
agugucacuuaccuagauuua

SEQ ID NO: 757523 - RNA, 21 nt, Homo sapiens
agugucaugaagugcacagga

SEQ ID NO: 757524 - RNA, 16 nt, Homo sapiens
agugucuccaccuaca

SEQ ID NO: 757525 - RNA, 14 nt, Homo sapiens
agugucuguaccuc

SEQ ID NO: 757526 - RNA, 14 nt, Homo sapiens
agugucuuuugaca

SEQ ID NO: 757527 - RNA, 15 nt, Homo sapiens
agugucuuuugacau

SEQ ID NO: 757528 - RNA, 16 nt, Homo sapiens
agugugaacaaaagau

SEQ ID NO: 757529 - RNA, 14 nt, Homo sapiens
agugugagacccca

SEQ ID NO: 757530 - RNA, 16 nt, Homo sapiens
agugugauauacaaag

SEQ ID NO: 757531 - RNA, 14 nt, Homo sapiens
agugugcugcuauu

SEQ ID NO: 757532 - RNA, 17 nt, Homo sapiens
aguguggcagugaccau

SEQ ID NO: 757533 - RNA, 20 nt, Homo sapiens
aguguuaagcguucagugau

SEQ ID NO: 757534 - RNA, 18 nt, Homo sapiens
aguguucacaaacuguga

SEQ ID NO: 757535 - RNA, 20 nt, Homo sapiens
aguguuccccgauaccaugc

SEQ ID NO: 757536 - RNA, 12 nt, Homo sapiens
aguguugcccag

SEQ ID NO: 757537 - RNA, 21 nt, Homo sapiens
aguguuucuaauaaacuugga

SEQ ID NO: 757538 - RNA, 12 nt, Homo sapiens
aguguuucuaca

SEQ ID NO: 757539 - RNA, 19 nt, Homo sapiens
aguguuuggaugaaaaaag

SEQ ID NO: 757540 - RNA, 17 nt, Homo sapiens
aguguuuuuauugcucg

SEQ ID NO: 757541 - RNA, 18 nt, Homo sapiens
aguuaaaaguguugauua

SEQ ID NO: 757542 - RNA, 19 nt, Homo sapiens
aguuaaacauugaaguaau

SEQ ID NO: 757543 - RNA, 20 nt, Homo sapiens
aguuaaccccauguccucag

SEQ ID NO: 757544 - RNA, 16 nt, Homo sapiens
aguuaagcaacaucua

SEQ ID NO: 757545 - RNA, 19 nt, Homo sapiens
aguuaaggauuguuuuaaa

SEQ ID NO: 757546 - RNA, 12 nt, Homo sapiens
aguuaaggguua

SEQ ID NO: 757547 - RNA, 15 nt, Homo sapiens
aguuaaguaguacua

SEQ ID NO: 757548 - RNA, 16 nt, Homo sapiens
aguuaauccacaucuu

SEQ ID NO: 757549 - RNA, 18 nt, Homo sapiens
aguuacaguucugugguu

SEQ ID NO: 757550 - RNA, 21 nt, Homo sapiens
aguuaccuacaagaacaauga

SEQ ID NO: 757551 - RNA, 16 nt, Homo sapiens
aguuacuaccugucaa

SEQ ID NO: 757552 - RNA, 19 nt, Homo sapiens
uccucucuccccucugcaa

SEQ ID NO: 757553 - RNA, 13 nt, Homo sapiens
uccucucucucag

SEQ ID NO: 757554 - RNA, 14 nt, Homo sapiens
uccucucugaguca

SEQ ID NO: 757555 - RNA, 11 nt, Homo sapiens
uccucugacau

SEQ ID NO: 757556 - RNA, 15 nt, Homo sapiens
uccucugcauuuaca

SEQ ID NO: 757557 - RNA, 16 nt, Homo sapiens
uccucuggagcccuaa

SEQ ID NO: 757558 - RNA, 24 nt, Homo sapiens
uccucuguaccuagaauagucuca

SEQ ID NO: 757559 - RNA, 12 nt, Homo sapiens
uccucuguucac

SEQ ID NO: 757560 - RNA, 20 nt, Homo sapiens
uccucuuccauuaaccagug

SEQ ID NO: 757561 - RNA, 17 nt, Homo sapiens
uccucuucuuguugacc

SEQ ID NO: 757562 - RNA, 14 nt, Homo sapiens
uccucuugcucaaa

SEQ ID NO: 757563 - RNA, 21 nt, Homo sapiens
uccucuuggagaaaauaacaa

SEQ ID NO: 757564 - RNA, 14 nt, Homo sapiens
uccucuuggagcug

SEQ ID NO: 757565 - RNA, 14 nt, Homo sapiens
uccucuuguuuacg

SEQ ID NO: 757566 - RNA, 19 nt, Homo sapiens
uccugaacucuucugcaaa

SEQ ID NO: 757567 - RNA, 14 nt, Homo sapiens
uccugaagcugcug

SEQ ID NO: 757568 - RNA, 22 nt, Homo sapiens
uccugaaggaaaauaaacugac

SEQ ID NO: 757569 - RNA, 13 nt, Homo sapiens
uccugaccucagg

SEQ ID NO: 757570 - RNA, 15 nt, Homo sapiens
uccugaccucgugau

SEQ ID NO: 757571 - RNA, 12 nt, Homo sapiens
uccugacuuccc

SEQ ID NO: 757572 - RNA, 14 nt, Homo sapiens
uccugagaaaaucc

SEQ ID NO: 757573 - RNA, 17 nt, Homo sapiens
uccugagaagcauguaa

SEQ ID NO: 757574 - RNA, 16 nt, Homo sapiens
uccugagccaaggagg

SEQ ID NO: 757575 - RNA, 16 nt, Homo sapiens
uccugauuaggaauau

SEQ ID NO: 757576 - RNA, 16 nt, Homo sapiens
uccugcaacucaagga

SEQ ID NO: 757577 - RNA, 19 nt, Homo sapiens
uccugcagcaaacacucca

SEQ ID NO: 757578 - RNA, 20 nt, Homo sapiens
uccugcagccuccuccugac

SEQ ID NO: 757579 - RNA, 19 nt, Homo sapiens
uccugcauucacccagaca

SEQ ID NO: 757580 - RNA, 14 nt, Homo sapiens
uccugccacaugga

SEQ ID NO: 757581 - RNA, 16 nt, Homo sapiens
uccugccaccaagaug

SEQ ID NO: 757582 - RNA, 15 nt, Homo sapiens
uccugccacugccgc

SEQ ID NO: 757583 - RNA, 14 nt, Homo sapiens
uccugccaggguga

SEQ ID NO: 757584 - RNA, 14 nt, Homo sapiens
uccugccaguugaa

SEQ ID NO: 757585 - RNA, 18 nt, Homo sapiens
uccugccauucuucuggu

SEQ ID NO: 757586 - RNA, 20 nt, Homo sapiens
uccugcccucacaucuucca

SEQ ID NO: 757587 - RNA, 14 nt, Homo sapiens
uccugccuggccag

SEQ ID NO: 757588 - RNA, 17 nt, Homo sapiens
uccugcgaggcuaugag

SEQ ID NO: 757589 - RNA, 15 nt, Homo sapiens
uccugcuccaugacu

SEQ ID NO: 757590 - RNA, 17 nt, Homo sapiens
uccugcugccauccuca

SEQ ID NO: 757591 - RNA, 12 nt, Homo sapiens
uccugcuguauu

SEQ ID NO: 757592 - RNA, 16 nt, Homo sapiens
uccuggaaacagcaug

SEQ ID NO: 757593 - RNA, 12 nt, Homo sapiens
uccuggaaccaa

SEQ ID NO: 757594 - RNA, 23 nt, Homo sapiens
uccuggaaccaaucccgugaaag

SEQ ID NO: 757595 - RNA, 20 nt, Homo sapiens
uccuggaagcagagcaaaau

SEQ ID NO: 757596 - RNA, 19 nt, Homo sapiens
uccuggcacuaacguugag

SEQ ID NO: 757597 - RNA, 18 nt, Homo sapiens
uccuggccucaagugauc

SEQ ID NO: 757598 - RNA, 20 nt, Homo sapiens
uccuggccuucugaacucca

SEQ ID NO: 757599 - RNA, 19 nt, Homo sapiens
uccuggcuaacacggugaa

SEQ ID NO: 757600 - RNA, 15 nt, Homo sapiens
uccuggcugagagag

SEQ ID NO: 757601 - RNA, 12 nt, Homo sapiens
uccuggcugugc

SEQ ID NO: 757602 - RNA, 19 nt, Homo sapiens
uccugggauuacaggugug

SEQ ID NO: 757603 - RNA, 17 nt, Homo sapiens
uccuggucccuuuuuga

SEQ ID NO: 757604 - RNA, 19 nt, Homo sapiens
uccuggugagaacugagga

SEQ ID NO: 757605 - RNA, 18 nt, Homo sapiens
uccuggugccaauuucaa

SEQ ID NO: 757606 - RNA, 17 nt, Homo sapiens
uccuguacuuuuuccag

SEQ ID NO: 757607 - RNA, 22 nt, Homo sapiens
uccuguauucuacagcagauac

SEQ ID NO: 757608 - RNA, 20 nt, Homo sapiens
uccuguccaaccuaaccccu

SEQ ID NO: 757609 - RNA, 17 nt, Homo sapiens
uccugucuaacugcugu

SEQ ID NO: 757610 - RNA, 20 nt, Homo sapiens
uccugugaaugccacugccu

SEQ ID NO: 757611 - RNA, 11 nt, Homo sapiens
uccugugcaac

SEQ ID NO: 757612 - RNA, 13 nt, Homo sapiens
uccugugccacua

SEQ ID NO: 757613 - RNA, 16 nt, Homo sapiens
uccugugccagaggaa

SEQ ID NO: 757614 - RNA, 21 nt, Homo sapiens
uccuguggcauguugauuucu

SEQ ID NO: 757615 - RNA, 14 nt, Homo sapiens
uccuguguaccucu

SEQ ID NO: 757616 - RNA, 21 nt, Homo sapiens
uccuguguuaucugugguuuu

SEQ ID NO: 757617 - RNA, 19 nt, Homo sapiens
uccuguuagcauaauguga

SEQ ID NO: 757618 - RNA, 20 nt, Homo sapiens
uccuguuuaugcauucacaa

SEQ ID NO: 757619 - RNA, 16 nt, Homo sapiens
uccuguuucuccuuag

SEQ ID NO: 757620 - RNA, 21 nt, Homo sapiens
uccuuaaaaaucacacuguaa

SEQ ID NO: 757621 - RNA, 17 nt, Homo sapiens
uccuuaauaacaacaga

SEQ ID NO: 757622 - RNA, 12 nt, Homo sapiens
uccuuacauuuu

SEQ ID NO: 757623 - RNA, 13 nt, Homo sapiens
uccuuacuccauc

SEQ ID NO: 757624 - RNA, 13 nt, Homo sapiens
uccuuacucugag

SEQ ID NO: 757625 - RNA, 19 nt, Homo sapiens
uccuuacugauauuuauag

SEQ ID NO: 757626 - RNA, 16 nt, Homo sapiens
uccuuagagacaucaa

SEQ ID NO: 757627 - RNA, 15 nt, Homo sapiens
uccuuaucugucaca

SEQ ID NO: 757628 - RNA, 20 nt, Homo sapiens
uccuuaugacuccauucaaa

SEQ ID NO: 757629 - RNA, 15 nt, Homo sapiens
uccuuauuugccuuc

SEQ ID NO: 757630 - RNA, 14 nt, Homo sapiens
uccuucaaacaaug

SEQ ID NO: 757631 - RNA, 21 nt, Homo sapiens
uccuucauuaaugaugaucuu

SEQ ID NO: 757632 - RNA, 18 nt, Homo sapiens
uccuuccacaacugcugc

SEQ ID NO: 757633 - RNA, 13 nt, Homo sapiens
uccuuccauccau

SEQ ID NO: 757634 - RNA, 12 nt, Homo sapiens
uccuuccauccc

SEQ ID NO: 757635 - RNA, 19 nt, Homo sapiens
uccuuccccagcuuugcug

SEQ ID NO: 757636 - RNA, 18 nt, Homo sapiens
uccuucccuucuuugcug

SEQ ID NO: 757637 - RNA, 13 nt, Homo sapiens
uccuuccuaagaa

SEQ ID NO: 757638 - RNA, 23 nt, Homo sapiens
uccuuccugcuugaguucccaga

SEQ ID NO: 757639 - RNA, 14 nt, Homo sapiens
uccuuccuuaucac

SEQ ID NO: 757640 - RNA, 18 nt, Homo sapiens
uccuuccuugaccagcag

SEQ ID NO: 757641 - RNA, 18 nt, Homo sapiens
uccuucgcccugugcacc

SEQ ID NO: 757642 - RNA, 14 nt, Homo sapiens
uccuucgucuuugc

SEQ ID NO: 757643 - RNA, 13 nt, Homo sapiens
uccuucugagcuc

SEQ ID NO: 757644 - RNA, 15 nt, Homo sapiens
uccuucugcuggaua

SEQ ID NO: 757645 - RNA, 22 nt, Homo sapiens
uccuucugggacuggacagcuu

SEQ ID NO: 757646 - RNA, 14 nt, Homo sapiens
uccuucugugaaag

SEQ ID NO: 757647 - RNA, 17 nt, Homo sapiens
uccuucuugacauuuau

SEQ ID NO: 757648 - RNA, 11 nt, Homo sapiens
uccuucuugcu

SEQ ID NO: 757649 - RNA, 23 nt, Homo sapiens
uccuucuuucacaggcaucagga

SEQ ID NO: 757650 - RNA, 21 nt, Homo sapiens
uccuugaaaaacaaaguuucu

SEQ ID NO: 757651 - RNA, 13 nt, Homo sapiens
uccuugaaucuuc

SEQ ID NO: 757652 - RNA, 17 nt, Homo sapiens
uccuugacuccaagaaa

SEQ ID NO: 757653 - RNA, 17 nt, Homo sapiens
uccuugauacugcucau

SEQ ID NO: 757654 - RNA, 19 nt, Homo sapiens
uccuugauaucauucagca

SEQ ID NO: 757655 - RNA, 14 nt, Homo sapiens
uccuugcugcauug

SEQ ID NO: 757656 - RNA, 18 nt, Homo sapiens
uccuugcuuccugucuua

SEQ ID NO: 757657 - RNA, 19 nt, Homo sapiens
uccuuggaacacauaagaa

SEQ ID NO: 757658 - RNA, 22 nt, Homo sapiens
uccuuggcuuuaugcaaauaca

SEQ ID NO: 757659 - RNA, 18 nt, Homo sapiens
uccuugggaugaucuuga

SEQ ID NO: 757660 - RNA, 15 nt, Homo sapiens
uccuuguaaacaaua

SEQ ID NO: 757661 - RNA, 22 nt, Homo sapiens
uccuuguaauaccugauugauc

SEQ ID NO: 757662 - RNA, 20 nt, Homo sapiens
uccuuguauuuaaauauuaa

SEQ ID NO: 757663 - RNA, 23 nt, Homo sapiens
uccuuuaaaaaacuuagugacaa

SEQ ID NO: 757664 - RNA, 15 nt, Homo sapiens
uccuuuaaucacugc

SEQ ID NO: 757665 - RNA, 19 nt, Homo sapiens
uccuuuaccccucauccaa

SEQ ID NO: 757666 - RNA, 20 nt, Homo sapiens
uccuuuaccuuucagugcag

SEQ ID NO: 757667 - RNA, 23 nt, Homo sapiens
uccuuuaggucugguuguugcac

SEQ ID NO: 757668 - RNA, 12 nt, Homo sapiens
aguuacugugua

SEQ ID NO: 757669 - RNA, 17 nt, Homo sapiens
aguuagaacuagccaaa

SEQ ID NO: 757670 - RNA, 20 nt, Homo sapiens
aguuagcauaauacagaagu

SEQ ID NO: 757671 - RNA, 12 nt, Homo sapiens
aguuagcaucca

SEQ ID NO: 757672 - RNA, 15 nt, Homo sapiens
aguuagcucauuuga

SEQ ID NO: 757673 - RNA, 16 nt, Homo sapiens
aguuagcucauuugag

SEQ ID NO: 757674 - RNA, 15 nt, Homo sapiens
aguuagguagcuuua

SEQ ID NO: 757675 - RNA, 16 nt, Homo sapiens
aguuagguagcuuuag

SEQ ID NO: 757676 - RNA, 14 nt, Homo sapiens
aguuagucaauccu

SEQ ID NO: 757677 - RNA, 15 nt, Homo sapiens
aguuagucaauccug

SEQ ID NO: 757678 - RNA, 18 nt, Homo sapiens
aguuagucaauccuguca

SEQ ID NO: 757679 - RNA, 20 nt, Homo sapiens
aguuagucaauccugucaua

SEQ ID NO: 757680 - RNA, 14 nt, Homo sapiens
aguuauaaauacau

SEQ ID NO: 757681 - RNA, 21 nt, Homo sapiens
aguuaugauguaaucucucug

SEQ ID NO: 757682 - RNA, 17 nt, Homo sapiens
aguuauggcuucacauu

SEQ ID NO: 757683 - RNA, 19 nt, Homo sapiens
aguuauguaguuucuuguc

SEQ ID NO: 757684 - RNA, 19 nt, Homo sapiens
aguuauugauaaguucaua

SEQ ID NO: 757685 - RNA, 21 nt, Homo sapiens
aguuauugaugagagggaaaa

SEQ ID NO: 757686 - RNA, 17 nt, Homo sapiens
aguuauuuacuuuuacc

SEQ ID NO: 757687 - RNA, 20 nt, Homo sapiens
aguuauuuacuuuuaccacu

SEQ ID NO: 757688 - RNA, 21 nt, Homo sapiens
aguucaaaaaacucuugauau

SEQ ID NO: 757689 - RNA, 14 nt, Homo sapiens
aguucaacuguaua

SEQ ID NO: 757690 - RNA, 22 nt, Homo sapiens
aguucacuuuuuacagugcuau

SEQ ID NO: 757691 - RNA, 16 nt, Homo sapiens
aguucagagucuucag

SEQ ID NO: 757692 - RNA, 22 nt, Homo sapiens
aguucaguagaauuaccauuaa

SEQ ID NO: 757693 - RNA, 21 nt, Homo sapiens
aguucauacauuguacgaaga

SEQ ID NO: 757694 - RNA, 16 nt, Homo sapiens
aguucauaggucucca

SEQ ID NO: 757695 - RNA, 17 nt, Homo sapiens
aguucauaggucuccaa

SEQ ID NO: 757696 - RNA, 20 nt, Homo sapiens
aguucauaggucuccaagac

SEQ ID NO: 757697 - RNA, 16 nt, Homo sapiens
aguucauauguaccau

SEQ ID NO: 757698 - RNA, 17 nt, Homo sapiens
aguucauccgcacugua

SEQ ID NO: 757699 - RNA, 22 nt, Homo sapiens
aguucaucuauggcaguccagc

SEQ ID NO: 757700 - RNA, 14 nt, Homo sapiens
aguucaucucaugg

SEQ ID NO: 757701 - RNA, 18 nt, Homo sapiens
aguuccagaaacuuuaag

SEQ ID NO: 757702 - RNA, 17 nt, Homo sapiens
aguucccggagcacagc

SEQ ID NO: 757703 - RNA, 20 nt, Homo sapiens
aguuccuauaacacugugaa

SEQ ID NO: 757704 - RNA, 17 nt, Homo sapiens
aguuccuggcccaucaa

SEQ ID NO: 757705 - RNA, 15 nt, Homo sapiens
aguucguauacuucg

SEQ ID NO: 757706 - RNA, 21 nt, Homo sapiens
aguucguggaaggcuguauga

SEQ ID NO: 757707 - RNA, 18 nt, Homo sapiens
aguucuaacaaaacaagu

SEQ ID NO: 757708 - RNA, 18 nt, Homo sapiens
aguucuaguuugcauucc

SEQ ID NO: 757709 - RNA, 13 nt, Homo sapiens
aguucuaucagga

SEQ ID NO: 757710 - RNA, 18 nt, Homo sapiens
aguucuauuucuaucugc

SEQ ID NO: 757711 - RNA, 20 nt, Homo sapiens
aguucucagaauaacuaccu

SEQ ID NO: 757712 - RNA, 21 nt, Homo sapiens
aguucucauggguggcacuca

SEQ ID NO: 757713 - RNA, 14 nt, Homo sapiens
aguucucuguggaa

SEQ ID NO: 757714 - RNA, 19 nt, Homo sapiens
aguucuggcugaacacugg

SEQ ID NO: 757715 - RNA, 17 nt, Homo sapiens
aguucuggucagaugau

SEQ ID NO: 757716 - RNA, 21 nt, Homo sapiens
aguucuguaaaauauacuuaa

SEQ ID NO: 757717 - RNA, 21 nt, Homo sapiens
aguucuugagggccuccccac

SEQ ID NO: 757718 - RNA, 19 nt, Homo sapiens
aguucuugggcuggaccug

SEQ ID NO: 757719 - RNA, 16 nt, Homo sapiens
aguucuuugggccaga

SEQ ID NO: 757720 - RNA, 13 nt, Homo sapiens
aguugaaacaaga

SEQ ID NO: 757721 - RNA, 22 nt, Homo sapiens
aguugaaacugcuauagccuaa

SEQ ID NO: 757722 - RNA, 18 nt, Homo sapiens
aguugaagggaggggcug

SEQ ID NO: 757723 - RNA, 19 nt, Homo sapiens
aguugaauaaaagugcaca

SEQ ID NO: 757724 - RNA, 18 nt, Homo sapiens
aguugaauaguugcuuaa

SEQ ID NO: 757725 - RNA, 15 nt, Homo sapiens
aguugagucuccucu

SEQ ID NO: 757726 - RNA, 20 nt, Homo sapiens
aguugaucuacaaaggccau

SEQ ID NO: 757727 - RNA, 13 nt, Homo sapiens
aguugaucuggaa

SEQ ID NO: 757728 - RNA, 19 nt, Homo sapiens
aguugauguaacauuguag

SEQ ID NO: 757729 - RNA, 11 nt, Homo sapiens
aguugcaagac

SEQ ID NO: 757730 - RNA, 17 nt, Homo sapiens
aguugcaauugaauuaa

SEQ ID NO: 757731 - RNA, 18 nt, Homo sapiens
aguugcguggacucugca

SEQ ID NO: 757732 - RNA, 20 nt, Homo sapiens
aguugcguggacucugcaca

SEQ ID NO: 757733 - RNA, 15 nt, Homo sapiens
aguugcucaggacac

SEQ ID NO: 757734 - RNA, 17 nt, Homo sapiens
aguugcugaugaacucu

SEQ ID NO: 757735 - RNA, 17 nt, Homo sapiens
aguugcuuuucagcuga

SEQ ID NO: 757736 - RNA, 21 nt, Homo sapiens
aguuggaaaaacaaaugccau

SEQ ID NO: 757737 - RNA, 23 nt, Homo sapiens
aguuggaaaaacaaaugccauau

SEQ ID NO: 757738 - RNA, 17 nt, Homo sapiens
aguuggaccagaggaag

SEQ ID NO: 757739 - RNA, 20 nt, Homo sapiens
aguuggacuucagucuugcc

SEQ ID NO: 757740 - RNA, 13 nt, Homo sapiens
aguuggagaccag

SEQ ID NO: 757741 - RNA, 15 nt, Homo sapiens
aguuggagugcuugu

SEQ ID NO: 757742 - RNA, 14 nt, Homo sapiens
aguuggcucaggca

SEQ ID NO: 757743 - RNA, 22 nt, Homo sapiens
aguuggggccauugcuuaccuu

SEQ ID NO: 757744 - RNA, 15 nt, Homo sapiens
aguuggugacuggga

SEQ ID NO: 757745 - RNA, 22 nt, Homo sapiens
aguuggugcuuuugagaaccaa

SEQ ID NO: 757746 - RNA, 15 nt, Homo sapiens
aguuguauccauuaa

SEQ ID NO: 757747 - RNA, 16 nt, Homo sapiens
aguugucuuuugccau

SEQ ID NO: 757748 - RNA, 12 nt, Homo sapiens
aguugugcaacg

SEQ ID NO: 757749 - RNA, 22 nt, Homo sapiens
aguugugcaacggccaggguug

SEQ ID NO: 757750 - RNA, 22 nt, Homo sapiens
aguuguguuguuuuuuguucaa

SEQ ID NO: 757751 - RNA, 13 nt, Homo sapiens
aguuguucagcau

SEQ ID NO: 757752 - RNA, 15 nt, Homo sapiens
aguuguuucuaagag

SEQ ID NO: 757753 - RNA, 15 nt, Homo sapiens
aguuguuugcuucuu

SEQ ID NO: 757754 - RNA, 20 nt, Homo sapiens
aguuguuuguuuuugcuugu

SEQ ID NO: 757755 - RNA, 16 nt, Homo sapiens
aguuguuuugcuucuu

SEQ ID NO: 757756 - RNA, 15 nt, Homo sapiens
aguuuaaaucaagau

SEQ ID NO: 757757 - RNA, 17 nt, Homo sapiens
aguuuaacauuagcuaa

SEQ ID NO: 757758 - RNA, 13 nt, Homo sapiens
aguuuaaguaauu

SEQ ID NO: 757759 - RNA, 18 nt, Homo sapiens
aguuuaauagauguuacu

SEQ ID NO: 757760 - RNA, 24 nt, Homo sapiens
aguuuacagacgcugcugucacaa

SEQ ID NO: 757761 - RNA, 19 nt, Homo sapiens
aguuuacauuguccuguag

SEQ ID NO: 757762 - RNA, 14 nt, Homo sapiens
aguuuacccaugaa

SEQ ID NO: 757763 - RNA, 17 nt, Homo sapiens
aguuuacccaugaagau

SEQ ID NO: 757764 - RNA, 14 nt, Homo sapiens
aguuuagugugaua

SEQ ID NO: 757765 - RNA, 20 nt, Homo sapiens
aguuuauaaaugugaacuua

SEQ ID NO: 757766 - RNA, 15 nt, Homo sapiens
aguuuauaagacugg

SEQ ID NO: 757767 - RNA, 15 nt, Homo sapiens
aguuuaucacacagu

SEQ ID NO: 757768 - RNA, 16 nt, Homo sapiens
aguuuaucaugucagu

SEQ ID NO: 757769 - RNA, 16 nt, Homo sapiens
aguuuaugaugcaaau

SEQ ID NO: 757770 - RNA, 23 nt, Homo sapiens
aguuuaugaugcaaaucugccaa

SEQ ID NO: 757771 - RNA, 14 nt, Homo sapiens
aguuuaugauuuaa

SEQ ID NO: 757772 - RNA, 15 nt, Homo sapiens
aguuuauugacaaua

SEQ ID NO: 757773 - RNA, 17 nt, Homo sapiens
aguuuauugacaauaau

SEQ ID NO: 757774 - RNA, 20 nt, Homo sapiens
aguuuauuuuuauacuuuca

SEQ ID NO: 757775 - RNA, 14 nt, Homo sapiens
aguuucacauugca

SEQ ID NO: 757776 - RNA, 21 nt, Homo sapiens
aguuucagauuugccauucaa

SEQ ID NO: 757777 - RNA, 13 nt, Homo sapiens
aguuucagugaag

SEQ ID NO: 757778 - RNA, 17 nt, Homo sapiens
aguuucauuaacuggug

SEQ ID NO: 757779 - RNA, 17 nt, Homo sapiens
aguuucccguccaucuc

SEQ ID NO: 757780 - RNA, 15 nt, Homo sapiens
aguuucucaaacuga

SEQ ID NO: 757781 - RNA, 20 nt, Homo sapiens
aguuucuccuuuugaccaaa

SEQ ID NO: 757782 - RNA, 22 nt, Homo sapiens
aguuucuccuuuugaccaaaua

SEQ ID NO: 757783 - RNA, 18 nt, Homo sapiens
uccuuucacccgcuccua

SEQ ID NO: 757784 - RNA, 18 nt, Homo sapiens
uccuuuccccucccucag

SEQ ID NO: 757785 - RNA, 16 nt, Homo sapiens
uccuuuccuaucuucc

SEQ ID NO: 757786 - RNA, 15 nt, Homo sapiens
uccuuucuugcagau

SEQ ID NO: 757787 - RNA, 16 nt, Homo sapiens
uccuuuuaacugccaa

SEQ ID NO: 757788 - RNA, 15 nt, Homo sapiens
uccuuuuccacuuua

SEQ ID NO: 757789 - RNA, 16 nt, Homo sapiens
uccuuuugaccaaaua

SEQ ID NO: 757790 - RNA, 24 nt, Homo sapiens
uccuuuugaccaaauaaaguacca

SEQ ID NO: 757791 - RNA, 16 nt, Homo sapiens
uccuuuuucacuuuga

SEQ ID NO: 757792 - RNA, 17 nt, Homo sapiens
uccuuuuugacacugaa

SEQ ID NO: 757793 - RNA, 18 nt, Homo sapiens
ucgaaaccugggauucag

SEQ ID NO: 757794 - RNA, 15 nt, Homo sapiens
ucgaacuucacaacu

SEQ ID NO: 757795 - RNA, 19 nt, Homo sapiens
ucgaccaaacucaguucaa

SEQ ID NO: 757796 - RNA, 15 nt, Homo sapiens
ucgaccacaccagcc

SEQ ID NO: 757797 - RNA, 14 nt, Homo sapiens
ucgacccugugcag

SEQ ID NO: 757798 - RNA, 22 nt, Homo sapiens
ucgagagcuggccaaagagccu

SEQ ID NO: 757799 - RNA, 12 nt, Homo sapiens
ucgagaucucag

SEQ ID NO: 757800 - RNA, 20 nt, Homo sapiens
ucgagauggcagauucccac

SEQ ID NO: 757801 - RNA, 14 nt, Homo sapiens
ucgaggccugaagc

SEQ ID NO: 757802 - RNA, 13 nt, Homo sapiens
ucgagguggauca

SEQ ID NO: 757803 - RNA, 19 nt, Homo sapiens
ucgaguccuaaggccuuag

SEQ ID NO: 757804 - RNA, 19 nt, Homo sapiens
ucgauccuggauucacuca

SEQ ID NO: 757805 - RNA, 16 nt, Homo sapiens
ucgauguaagggauuc

SEQ ID NO: 757806 - RNA, 17 nt, Homo sapiens
ucgauguaggcauucug

SEQ ID NO: 757807 - RNA, 14 nt, Homo sapiens
ucgaugugcucagc

SEQ ID NO: 757808 - RNA, 14 nt, Homo sapiens
ucgauuaugugacu

SEQ ID NO: 757809 - RNA, 16 nt, Homo sapiens
ucgauucaaacugcuc

SEQ ID NO: 757810 - RNA, 22 nt, Homo sapiens
ucgcaacaggaaggaaccagaa

SEQ ID NO: 757811 - RNA, 13 nt, Homo sapiens
ucgcaugacuguu

SEQ ID NO: 757812 - RNA, 17 nt, Homo sapiens
ucgcaugacuguuacag

SEQ ID NO: 757813 - RNA, 22 nt, Homo sapiens
ucgccagugccuggaacagugu

SEQ ID NO: 757814 - RNA, 17 nt, Homo sapiens
ucgcccagacaccaugu

SEQ ID NO: 757815 - RNA, 21 nt, Homo sapiens
ucgcccaggcuggagugcaau

SEQ ID NO: 757816 - RNA, 13 nt, Homo sapiens
ucgccggccuugu

SEQ ID NO: 757817 - RNA, 21 nt, Homo sapiens
ucgcuaugugacuugcgcuua

SEQ ID NO: 757818 - RNA, 18 nt, Homo sapiens
ucgcuccagacuugggaa

SEQ ID NO: 757819 - RNA, 22 nt, Homo sapiens
ucgcuguguguuaguucccaac

SEQ ID NO: 757820 - RNA, 14 nt, Homo sapiens
ucgcuucuugccuc

SEQ ID NO: 757821 - RNA, 23 nt, Homo sapiens
ucggacaagacccccagcacuug

SEQ ID NO: 757822 - RNA, 23 nt, Homo sapiens
ucggacaugaaaggacccuguga

SEQ ID NO: 757823 - RNA, 19 nt, Homo sapiens
ucggacggccaauggugcu

SEQ ID NO: 757824 - RNA, 20 nt, Homo sapiens
ucggagaaacgggugagcug

SEQ ID NO: 757825 - RNA, 22 nt, Homo sapiens
ucggaggccauccugccagggg

SEQ ID NO: 757826 - RNA, 18 nt, Homo sapiens
ucggaguucagacucuca

SEQ ID NO: 757827 - RNA, 17 nt, Homo sapiens
ucggauacacacucgaa

SEQ ID NO: 757828 - RNA, 18 nt, Homo sapiens
ucggauacacacucgaau

SEQ ID NO: 757829 - RNA, 23 nt, Homo sapiens
ucggcacucccaggcugggagcu

SEQ ID NO: 757830 - RNA, 12 nt, Homo sapiens
ucggcaucuucu

SEQ ID NO: 757831 - RNA, 14 nt, Homo sapiens
ucggccaccacaga

SEQ ID NO: 757832 - RNA, 13 nt, Homo sapiens
ucggcucacugca

SEQ ID NO: 757833 - RNA, 20 nt, Homo sapiens
ucggcuccccauguguccug

SEQ ID NO: 757834 - RNA, 15 nt, Homo sapiens
ucggcugaccaugcu

SEQ ID NO: 757835 - RNA, 20 nt, Homo sapiens
ucggcuuccuacagccagca

SEQ ID NO: 757836 - RNA, 21 nt, Homo sapiens
ucgggccccgaaugucacugg

SEQ ID NO: 757837 - RNA, 21 nt, Homo sapiens
ucgguauccccccaucuugcu

SEQ ID NO: 757838 - RNA, 19 nt, Homo sapiens
ucggugugcugccaacuug

SEQ ID NO: 757839 - RNA, 19 nt, Homo sapiens
ucgguuguucuuuccucac

SEQ ID NO: 757840 - RNA, 14 nt, Homo sapiens
ucguaagucacuga

SEQ ID NO: 757841 - RNA, 18 nt, Homo sapiens
ucguagccuaaaagacaa

SEQ ID NO: 757842 - RNA, 16 nt, Homo sapiens
ucguccauguuucuca

SEQ ID NO: 757843 - RNA, 16 nt, Homo sapiens
ucgucucccuggugcc

SEQ ID NO: 757844 - RNA, 17 nt, Homo sapiens
ucgucuuuacuuccauc

SEQ ID NO: 757845 - RNA, 13 nt, Homo sapiens
ucgugacaacaug

SEQ ID NO: 757846 - RNA, 13 nt, Homo sapiens
ucgugcuguagag

SEQ ID NO: 757847 - RNA, 10 nt, Homo sapiens
ucgugcugug

SEQ ID NO: 757848 - RNA, 21 nt, Homo sapiens
ucguggguguguguagccaag

SEQ ID NO: 757849 - RNA, 20 nt, Homo sapiens
ucgugguuuuuacauucaau

SEQ ID NO: 757850 - RNA, 17 nt, Homo sapiens
ucgugugauuuccuaca

SEQ ID NO: 757851 - RNA, 18 nt, Homo sapiens
ucguuagaaugucugccu

SEQ ID NO: 757852 - RNA, 14 nt, Homo sapiens
ucuaaaaaauaacu

SEQ ID NO: 757853 - RNA, 20 nt, Homo sapiens
ucuaaaaagaaaaagagaua

SEQ ID NO: 757854 - RNA, 13 nt, Homo sapiens
ucuaaaacauucu

SEQ ID NO: 757855 - RNA, 12 nt, Homo sapiens
ucuaaaacugcc

SEQ ID NO: 757856 - RNA, 17 nt, Homo sapiens
ucuaaaauacaaaccca

SEQ ID NO: 757857 - RNA, 14 nt, Homo sapiens
ucuaaaaucaugaa

SEQ ID NO: 757858 - RNA, 21 nt, Homo sapiens
ucuaaaauugcuucuuuacca

SEQ ID NO: 757859 - RNA, 14 nt, Homo sapiens
ucuaaacagacuca

SEQ ID NO: 757860 - RNA, 12 nt, Homo sapiens
ucuaaaccuuac

SEQ ID NO: 757861 - RNA, 22 nt, Homo sapiens
ucuaaagauggaaaaaccaccc

SEQ ID NO: 757862 - RNA, 23 nt, Homo sapiens
ucuaaagauggaguuucuaaggu

SEQ ID NO: 757863 - RNA, 14 nt, Homo sapiens
ucuaaagauucuau

SEQ ID NO: 757864 - RNA, 22 nt, Homo sapiens
ucuaaagcagaggcaacacugg

SEQ ID NO: 757865 - RNA, 15 nt, Homo sapiens
ucuaaagguaccaaa

SEQ ID NO: 757866 - RNA, 20 nt, Homo sapiens
ucuaaagguggugaggcaau

SEQ ID NO: 757867 - RNA, 17 nt, Homo sapiens
ucuaaauacaugccaca

SEQ ID NO: 757868 - RNA, 23 nt, Homo sapiens
ucuaaauccgacuugaauauucc

SEQ ID NO: 757869 - RNA, 19 nt, Homo sapiens
ucuaaaugggaauucucag

SEQ ID NO: 757870 - RNA, 23 nt, Homo sapiens
ucuaaauuaaagagaaaauugag

SEQ ID NO: 757871 - RNA, 17 nt, Homo sapiens
ucuaacagcaaauaaca

SEQ ID NO: 757872 - RNA, 16 nt, Homo sapiens
ucuaacauguuaucaa

SEQ ID NO: 757873 - RNA, 13 nt, Homo sapiens
ucuaacgcuuuaa

SEQ ID NO: 757874 - RNA, 17 nt, Homo sapiens
ucuaacgggcauucaca

SEQ ID NO: 757875 - RNA, 12 nt, Homo sapiens
ucuaacugcugu

SEQ ID NO: 757876 - RNA, 18 nt, Homo sapiens
ucuaacuggacaugaagg

SEQ ID NO: 757877 - RNA, 21 nt, Homo sapiens
ucuaagacucaaauguucuaa

SEQ ID NO: 757878 - RNA, 17 nt, Homo sapiens
ucuaagauaguaacaau

SEQ ID NO: 757879 - RNA, 20 nt, Homo sapiens
ucuaagauaguaacaaugaa

SEQ ID NO: 757880 - RNA, 19 nt, Homo sapiens
ucuaagcaguuauggugau

SEQ ID NO: 757881 - RNA, 17 nt, Homo sapiens
ucuaagccuuuccauaa

SEQ ID NO: 757882 - RNA, 21 nt, Homo sapiens
ucuaaggccuaggauucuaaa

SEQ ID NO: 757883 - RNA, 20 nt, Homo sapiens
ucuaaguggaaaaaguauua

SEQ ID NO: 757884 - RNA, 19 nt, Homo sapiens
ucuaaguuaaacagucagu

SEQ ID NO: 757885 - RNA, 11 nt, Homo sapiens
ucuaaugaaga

SEQ ID NO: 757886 - RNA, 19 nt, Homo sapiens
ucuaauggggacacagauc

SEQ ID NO: 757887 - RNA, 15 nt, Homo sapiens
ucuaauuaaauguag

SEQ ID NO: 757888 - RNA, 16 nt, Homo sapiens
ucuaauuccuguugcu

SEQ ID NO: 757889 - RNA, 14 nt, Homo sapiens
ucuaauugcaaaga

SEQ ID NO: 757890 - RNA, 21 nt, Homo sapiens
ucuacaaacucccacuuguca

SEQ ID NO: 757891 - RNA, 12 nt, Homo sapiens
ucuacaacugau

SEQ ID NO: 757892 - RNA, 17 nt, Homo sapiens
ucuacaaucaguugacu

SEQ ID NO: 757893 - RNA, 21 nt, Homo sapiens
ucuacacagauggaaucucuu

SEQ ID NO: 757894 - RNA, 23 nt, Homo sapiens
ucuacacagugggaacucugaca

SEQ ID NO: 757895 - RNA, 19 nt, Homo sapiens
ucuacacccaccagaguga

SEQ ID NO: 757896 - RNA, 18 nt, Homo sapiens
ucuacaggaaucaaaaga

SEQ ID NO: 757897 - RNA, 21 nt, Homo sapiens
ucuacaguuaggguugaguua

SEQ ID NO: 757898 - RNA, 23 nt, Homo sapiens
aguuucuccuuuugaccaaauaa

SEQ ID NO: 757899 - RNA, 21 nt, Homo sapiens
aguuucugcggaagcugguga

SEQ ID NO: 757900 - RNA, 21 nt, Homo sapiens
aguuucuuaacccuuuccaga

SEQ ID NO: 757901 - RNA, 18 nt, Homo sapiens
aguuugaauuuguauuaa

SEQ ID NO: 757902 - RNA, 18 nt, Homo sapiens
aguuugaccucacaguga

SEQ ID NO: 757903 - RNA, 13 nt, Homo sapiens
aguuugcaaaaaa

SEQ ID NO: 757904 - RNA, 18 nt, Homo sapiens
aguuugcaguuaugcaga

SEQ ID NO: 757905 - RNA, 16 nt, Homo sapiens
aguuuggguaaaauac

SEQ ID NO: 757906 - RNA, 19 nt, Homo sapiens
aguuugguccuggggacca

SEQ ID NO: 757907 - RNA, 18 nt, Homo sapiens
aguuugucauauacugcu

SEQ ID NO: 757908 - RNA, 19 nt, Homo sapiens
aguuugucaucccugauga

SEQ ID NO: 757909 - RNA, 21 nt, Homo sapiens
aguuuguggaagcacaggcaa

SEQ ID NO: 757910 - RNA, 20 nt, Homo sapiens
aguuuguuuuagaaccagcc

SEQ ID NO: 757911 - RNA, 22 nt, Homo sapiens
aguuuuaccucuucucucucag

SEQ ID NO: 757912 - RNA, 20 nt, Homo sapiens
aguuuuagaaaugagaucua

SEQ ID NO: 757913 - RNA, 19 nt, Homo sapiens
aguuuuccuacacuugaga

SEQ ID NO: 757914 - RNA, 23 nt, Homo sapiens
aguuuuccuucucaucugugauu

SEQ ID NO: 757915 - RNA, 12 nt, Homo sapiens
aguuuugcacuu

SEQ ID NO: 757916 - RNA, 15 nt, Homo sapiens
aguuuugcacuuuua

SEQ ID NO: 757917 - RNA, 16 nt, Homo sapiens
aguuuugccuuucuaa

SEQ ID NO: 757918 - RNA, 18 nt, Homo sapiens
aguuuuguacauaacuua

SEQ ID NO: 757919 - RNA, 16 nt, Homo sapiens
aguuuuuaauuugaug

SEQ ID NO: 757920 - RNA, 20 nt, Homo sapiens
aguuuuuggcaaaaaacaac

SEQ ID NO: 757921 - RNA, 12 nt, Homo sapiens
auaaaaaacauc

SEQ ID NO: 757922 - RNA, 16 nt, Homo sapiens
auaaaaacccaauuca

SEQ ID NO: 757923 - RNA, 14 nt, Homo sapiens
auaaaaacccugua

SEQ ID NO: 757924 - RNA, 21 nt, Homo sapiens
auaaaaacccuguauggcacu

SEQ ID NO: 757925 - RNA, 19 nt, Homo sapiens
auaaaaacucauccauggc

SEQ ID NO: 757926 - RNA, 14 nt, Homo sapiens
auaaaaagcagaau

SEQ ID NO: 757927 - RNA, 20 nt, Homo sapiens
auaaaaagugacacagcagc

SEQ ID NO: 757928 - RNA, 14 nt, Homo sapiens
auaaaaaguucuca

SEQ ID NO: 757929 - RNA, 14 nt, Homo sapiens
auaaaaaugagugc

SEQ ID NO: 757930 - RNA, 21 nt, Homo sapiens
auaaaaauucauaaccaaaga

SEQ ID NO: 757931 - RNA, 16 nt, Homo sapiens
auaaaacacugcccuc

SEQ ID NO: 757932 - RNA, 14 nt, Homo sapiens
auaaaaccaaguuu

SEQ ID NO: 757933 - RNA, 21 nt, Homo sapiens
auaaaaccaucaaaaauauuc

SEQ ID NO: 757934 - RNA, 18 nt, Homo sapiens
auaaaacgaucuaaaggu

SEQ ID NO: 757935 - RNA, 13 nt, Homo sapiens
auaaaacggugcu

SEQ ID NO: 757936 - RNA, 16 nt, Homo sapiens
auaaaagacuauucua

SEQ ID NO: 757937 - RNA, 14 nt, Homo sapiens
auaaaagauuuaca

SEQ ID NO: 757938 - RNA, 22 nt, Homo sapiens
auaaaagugaagugaaucugau

SEQ ID NO: 757939 - RNA, 16 nt, Homo sapiens
auaaaagugcuuugca

SEQ ID NO: 757940 - RNA, 21 nt, Homo sapiens
auaaaagugcuuugcauugaa

SEQ ID NO: 757941 - RNA, 17 nt, Homo sapiens
auaaaauagaaacauuu

SEQ ID NO: 757942 - RNA, 23 nt, Homo sapiens
auaaaauauuuuuuuccuaugga

SEQ ID NO: 757943 - RNA, 23 nt, Homo sapiens
auaaaaucuuucugauaaugcau

SEQ ID NO: 757944 - RNA, 19 nt, Homo sapiens
auaaaauguguacagugaa

SEQ ID NO: 757945 - RNA, 20 nt, Homo sapiens
auaaaauguuucauuaugca

SEQ ID NO: 757946 - RNA, 16 nt, Homo sapiens
auaaaauuaugccaua

SEQ ID NO: 757947 - RNA, 20 nt, Homo sapiens
auaaaauuaugccauagcaa

SEQ ID NO: 757948 - RNA, 21 nt, Homo sapiens
auaaaauugaaaguucuggaa

SEQ ID NO: 757949 - RNA, 22 nt, Homo sapiens
auaaacaacuuaauguucugaa

SEQ ID NO: 757950 - RNA, 20 nt, Homo sapiens
auaaacacacccucugugcu

SEQ ID NO: 757951 - RNA, 15 nt, Homo sapiens
auaaacauccuucaa

SEQ ID NO: 757952 - RNA, 11 nt, Homo sapiens
auaaaccaaaa

SEQ ID NO: 757953 - RNA, 15 nt, Homo sapiens
auaaaccacugugcg

SEQ ID NO: 757954 - RNA, 19 nt, Homo sapiens
auaaaccacuugagccuau

SEQ ID NO: 757955 - RNA, 13 nt, Homo sapiens
auaaaccaguuga

SEQ ID NO: 757956 - RNA, 16 nt, Homo sapiens
auaaacuauaaacuua

SEQ ID NO: 757957 - RNA, 12 nt, Homo sapiens
auaaagaacaau

SEQ ID NO: 757958 - RNA, 19 nt, Homo sapiens
auaaagacaccugguugcu

SEQ ID NO: 757959 - RNA, 22 nt, Homo sapiens
auaaagaucaaacaugcaugga

SEQ ID NO: 757960 - RNA, 19 nt, Homo sapiens
auaaagcacagauuugcau

SEQ ID NO: 757961 - RNA, 21 nt, Homo sapiens
auaaagcaguauuuuucuuga

SEQ ID NO: 757962 - RNA, 13 nt, Homo sapiens
auaaagcauucuu

SEQ ID NO: 757963 - RNA, 15 nt, Homo sapiens
auaaagccacuucug

SEQ ID NO: 757964 - RNA, 20 nt, Homo sapiens
auaaagccuguauucucaaa

SEQ ID NO: 757965 - RNA, 15 nt, Homo sapiens
auaaaggcagcugcc

SEQ ID NO: 757966 - RNA, 14 nt, Homo sapiens
ucaaaugaauuugc

SEQ ID NO: 757967 - RNA, 21 nt, Homo sapiens
ucaaaugaguaacauuugcug

SEQ ID NO: 757968 - RNA, 12 nt, Homo sapiens
ucaaaugcacau

SEQ ID NO: 757969 - RNA, 12 nt, Homo sapiens
ucaaaugggcug

SEQ ID NO: 757970 - RNA, 14 nt, Homo sapiens
ucaaauugcugcuu

SEQ ID NO: 757971 - RNA, 15 nt, Homo sapiens
ucaaauugcugcuug

SEQ ID NO: 757972 - RNA, 17 nt, Homo sapiens
ucaacaaagaucauuua

SEQ ID NO: 757973 - RNA, 19 nt, Homo sapiens
ucaacaagauacaaucuca

SEQ ID NO: 757974 - RNA, 21 nt, Homo sapiens
ucaacaaguaacuuuguagaa

SEQ ID NO: 757975 - RNA, 16 nt, Homo sapiens
ucaacaccacuaggaa

SEQ ID NO: 757976 - RNA, 22 nt, Homo sapiens
ucaacaucuuggucagauuuga

SEQ ID NO: 757977 - RNA, 19 nt, Homo sapiens
ucaacaugccauaucucau

SEQ ID NO: 757978 - RNA, 16 nt, Homo sapiens
ucaacauuaacauuga

SEQ ID NO: 757979 - RNA, 18 nt, Homo sapiens
ucaacauuuacauguauu

SEQ ID NO: 757980 - RNA, 14 nt, Homo sapiens
ucaacauuuccaaa

SEQ ID NO: 757981 - RNA, 18 nt, Homo sapiens
ucaacccauuguugucaa

SEQ ID NO: 757982 - RNA, 18 nt, Homo sapiens
ucaacuaaaguuguacuu

SEQ ID NO: 757983 - RNA, 18 nt, Homo sapiens
ucaacuaaguucagggaa

SEQ ID NO: 757984 - RNA, 14 nt, Homo sapiens
ucaacucacagcuu

SEQ ID NO: 757985 - RNA, 21 nt, Homo sapiens
ucaacuccgugcuuaaccaaa

SEQ ID NO: 757986 - RNA, 19 nt, Homo sapiens
ucaacugaaaaaaacauau

SEQ ID NO: 757987 - RNA, 22 nt, Homo sapiens
ucaacugagguucuugggauac

SEQ ID NO: 757988 - RNA, 21 nt, Homo sapiens
ucaacuggaauggaugguaca

SEQ ID NO: 757989 - RNA, 20 nt, Homo sapiens
ucaacuguugauugcaggaa

SEQ ID NO: 757990 - RNA, 16 nt, Homo sapiens
ucaacuuuuccuuuca

SEQ ID NO: 757991 - RNA, 19 nt, Homo sapiens
ucaacuuuuucccucacua

SEQ ID NO: 757992 - RNA, 16 nt, Homo sapiens
ucaagaacaagcaaug

SEQ ID NO: 757993 - RNA, 17 nt, Homo sapiens
ucaagaacauucuacca

SEQ ID NO: 757994 - RNA, 21 nt, Homo sapiens
ucaagaaccgguuuccaaaga

SEQ ID NO: 757995 - RNA, 21 nt, Homo sapiens
ucaagaagcguuaugugcagu

SEQ ID NO: 757996 - RNA, 14 nt, Homo sapiens
ucaagaagcuguga

SEQ ID NO: 757997 - RNA, 21 nt, Homo sapiens
ucaagaaucuagaagaugugu

SEQ ID NO: 757998 - RNA, 10 nt, Homo sapiens
ucaagaaugc

SEQ ID NO: 757999 - RNA, 13 nt, Homo sapiens
ucaagaaugccag

SEQ ID NO: 758000 - RNA, 19 nt, Homo sapiens
ucaagaccauagugaccaa

SEQ ID NO: 758001 - RNA, 14 nt, Homo sapiens
ucaagaccugagua

SEQ ID NO: 758002 - RNA, 17 nt, Homo sapiens
ucaagagauagagacca

SEQ ID NO: 758003 - RNA, 22 nt, Homo sapiens
ucaagagaucuuucuuuccaaa

SEQ ID NO: 758004 - RNA, 16 nt, Homo sapiens
ucaagaggcagaguuc

SEQ ID NO: 758005 - RNA, 19 nt, Homo sapiens
ucaagaugaugaugaucuu

SEQ ID NO: 758006 - RNA, 17 nt, Homo sapiens
ucaagauucagacucca

SEQ ID NO: 758007 - RNA, 19 nt, Homo sapiens
ucaagauuuuuuuugucag

SEQ ID NO: 758008 - RNA, 18 nt, Homo sapiens
ucaagcaauugucugccu

SEQ ID NO: 758009 - RNA, 22 nt, Homo sapiens
ucaagcacuuacagcucuggcc

SEQ ID NO: 758010 - RNA, 20 nt, Homo sapiens
ucaagccccacgaugacugc

SEQ ID NO: 758011 - RNA, 16 nt, Homo sapiens
ucaagccugugcaaug

SEQ ID NO: 758012 - RNA, 20 nt, Homo sapiens
ucaagcgauucuccugucuc

SEQ ID NO: 758013 - RNA, 22 nt, Homo sapiens
ucaagcuauucucaugccucag

SEQ ID NO: 758014 - RNA, 23 nt, Homo sapiens
ucaagcucaucuguuaugcauag

SEQ ID NO: 758015 - RNA, 18 nt, Homo sapiens
ucaagcugcucugagcca

SEQ ID NO: 758016 - RNA, 19 nt, Homo sapiens
ucaccauuucuuggcauug

SEQ ID NO: 758017 - RNA, 19 nt, Homo sapiens
ucacccaaaagaauuauca

SEQ ID NO: 758018 - RNA, 22 nt, Homo sapiens
ucacccaccccugcacaguuga

SEQ ID NO: 758019 - RNA, 19 nt, Homo sapiens
ucacccaggcuggaguaca

SEQ ID NO: 758020 - RNA, 19 nt, Homo sapiens
ucacccaggcuggagugca

SEQ ID NO: 758021 - RNA, 19 nt, Homo sapiens
ucacccagguuggagugca

SEQ ID NO: 758022 - RNA, 21 nt, Homo sapiens
ucacccagguuggagugcagu

SEQ ID NO: 758023 - RNA, 16 nt, Homo sapiens
ucacccauuggugacc

SEQ ID NO: 758024 - RNA, 23 nt, Homo sapiens
ucaccccagguucucaccucagg

SEQ ID NO: 758025 - RNA, 18 nt, Homo sapiens
ucaccccuacacugugaa

SEQ ID NO: 758026 - RNA, 14 nt, Homo sapiens
ucaccccugcacuu

SEQ ID NO: 758027 - RNA, 17 nt, Homo sapiens
ucacccgacccgugcac

SEQ ID NO: 758028 - RNA, 14 nt, Homo sapiens
ucacccuaccugug

SEQ ID NO: 758029 - RNA, 19 nt, Homo sapiens
ucacccucuuccugugauc

SEQ ID NO: 758030 - RNA, 20 nt, Homo sapiens
ucacccugccuuaucuugca

SEQ ID NO: 758031 - RNA, 16 nt, Homo sapiens
ucacccuguauguuag

SEQ ID NO: 758032 - RNA, 18 nt, Homo sapiens
ucacccuguccaaacugc

SEQ ID NO: 758033 - RNA, 21 nt, Homo sapiens
ucacccuguccagaccuuuga

SEQ ID NO: 758034 - RNA, 16 nt, Homo sapiens
ucacccuuguccuuga

SEQ ID NO: 758035 - RNA, 16 nt, Homo sapiens
ucaccgacaacaugcu

SEQ ID NO: 758036 - RNA, 21 nt, Homo sapiens
ucaccguggcuaccauuguca

SEQ ID NO: 758037 - RNA, 14 nt, Homo sapiens
ucaccuaacuagag

SEQ ID NO: 758038 - RNA, 17 nt, Homo sapiens
ucaccuagaacgugcau

SEQ ID NO: 758039 - RNA, 15 nt, Homo sapiens
ucaccucauucugaa

SEQ ID NO: 758040 - RNA, 17 nt, Homo sapiens
ucaccucccgaagccac

SEQ ID NO: 758041 - RNA, 14 nt, Homo sapiens
ucaccucucaaggu

SEQ ID NO: 758042 - RNA, 16 nt, Homo sapiens
ucaccucugaggacag

SEQ ID NO: 758043 - RNA, 21 nt, Homo sapiens
ucaccuuuugaccauaacugu

SEQ ID NO: 758044 - RNA, 16 nt, Homo sapiens
ucacgcaggcugaguc

SEQ ID NO: 758045 - RNA, 18 nt, Homo sapiens
ucacgcaugugugcugca

SEQ ID NO: 758046 - RNA, 14 nt, Homo sapiens
ucacgccacugcac

SEQ ID NO: 758047 - RNA, 19 nt, Homo sapiens
ucacggcugcgcacugugu

SEQ ID NO: 758048 - RNA, 16 nt, Homo sapiens
ucacgggaacucucca

SEQ ID NO: 758049 - RNA, 20 nt, Homo sapiens
ucacuaaaacacacaggugc

SEQ ID NO: 758050 - RNA, 14 nt, Homo sapiens
ucacuaaacaagaa

SEQ ID NO: 758051 - RNA, 14 nt, Homo sapiens
ucacuaaauguaaa

SEQ ID NO: 758052 - RNA, 21 nt, Homo sapiens
ucacuaagcuguggcuggaau

SEQ ID NO: 758053 - RNA, 14 nt, Homo sapiens
ucacuaaugcucaa

SEQ ID NO: 758054 - RNA, 20 nt, Homo sapiens
ucacuacagggagaaaaucc

SEQ ID NO: 758055 - RNA, 24 nt, Homo sapiens
ucacuacugguguucuguuucaau

SEQ ID NO: 758056 - RNA, 19 nt, Homo sapiens
ucacuacuuaaagugcuau

SEQ ID NO: 758057 - RNA, 20 nt, Homo sapiens
ucacuagaagaaaagcccau

SEQ ID NO: 758058 - RNA, 22 nt, Homo sapiens
ucacuagccaugauaacugcaa

SEQ ID NO: 758059 - RNA, 19 nt, Homo sapiens
ucacuaggaugcagaugga

SEQ ID NO: 758060 - RNA, 15 nt, Homo sapiens
ucacucacacuggcc

SEQ ID NO: 758061 - RNA, 16 nt, Homo sapiens
ucacucacacuggcca

SEQ ID NO: 758062 - RNA, 12 nt, Homo sapiens
ucacucacagag

SEQ ID NO: 758063 - RNA, 14 nt, Homo sapiens
ucacucaccaucug

SEQ ID NO: 758064 - RNA, 16 nt, Homo sapiens
ucacucaccauuccca

SEQ ID NO: 758065 - RNA, 16 nt, Homo sapiens
ucacucauagccacuu

SEQ ID NO: 758066 - RNA, 20 nt, Homo sapiens
ucacucauuaaugaaucaca

SEQ ID NO: 758067 - RNA, 20 nt, Homo sapiens
ucacucauuccuucacucau

SEQ ID NO: 758068 - RNA, 16 nt, Homo sapiens
ucacucccaccugcau

SEQ ID NO: 758069 - RNA, 16 nt, Homo sapiens
ucacucucaaacuuca

SEQ ID NO: 758070 - RNA, 12 nt, Homo sapiens
ucacucugaauc

SEQ ID NO: 758071 - RNA, 16 nt, Homo sapiens
ucacucugaauccuca

SEQ ID NO: 758072 - RNA, 18 nt, Homo sapiens
ucacucuguaguuacugu

SEQ ID NO: 758073 - RNA, 16 nt, Homo sapiens
ucacugaaaccaggug

SEQ ID NO: 758074 - RNA, 11 nt, Homo sapiens
ucacugaacaa

SEQ ID NO: 758075 - RNA, 14 nt, Homo sapiens
ucacugacaguuaa

SEQ ID NO: 758076 - RNA, 18 nt, Homo sapiens
ucacugacucugacucau

SEQ ID NO: 758077 - RNA, 19 nt, Homo sapiens
ucacugagugauacuuuaa

SEQ ID NO: 758078 - RNA, 17 nt, Homo sapiens
ucacugaucuugucauu

SEQ ID NO: 758079 - RNA, 18 nt, Homo sapiens
ucacugaugcagaaagac

SEQ ID NO: 758080 - RNA, 13 nt, Homo sapiens
ucacugcacucca

SEQ ID NO: 758081 - RNA, 15 nt, Homo sapiens
ucacugcagccucag

SEQ ID NO: 758082 - RNA, 11 nt, Homo sapiens
uccccuaccca

SEQ ID NO: 758083 - RNA, 14 nt, Homo sapiens
uccccuacucccuc

SEQ ID NO: 758084 - RNA, 19 nt, Homo sapiens
uccccuagcuuacugauaa

SEQ ID NO: 758085 - RNA, 13 nt, Homo sapiens
uccccucccucag

SEQ ID NO: 758086 - RNA, 13 nt, Homo sapiens
uccccucggagaa

SEQ ID NO: 758087 - RNA, 16 nt, Homo sapiens
uccccucucagaacau

SEQ ID NO: 758088 - RNA, 17 nt, Homo sapiens
uccccugaaaaacugau

SEQ ID NO: 758089 - RNA, 23 nt, Homo sapiens
uccccugaaaaacugaucaaaaa

SEQ ID NO: 758090 - RNA, 23 nt, Homo sapiens
uccccugcccuuccuccugaugg

SEQ ID NO: 758091 - RNA, 12 nt, Homo sapiens
uccccuguguca

SEQ ID NO: 758092 - RNA, 14 nt, Homo sapiens
uccccuucucucau

SEQ ID NO: 758093 - RNA, 15 nt, Homo sapiens
uccccuucucucauc

SEQ ID NO: 758094 - RNA, 19 nt, Homo sapiens
uccccuugccuaaauacaa

SEQ ID NO: 758095 - RNA, 12 nt, Homo sapiens
ucccgacaccag

SEQ ID NO: 758096 - RNA, 19 nt, Homo sapiens
ucccgaguaacugagauua

SEQ ID NO: 758097 - RNA, 20 nt, Homo sapiens
ucccgaguaacugagauuac

SEQ ID NO: 758098 - RNA, 14 nt, Homo sapiens
ucccgcagggcuga

SEQ ID NO: 758099 - RNA, 14 nt, Homo sapiens
ucccgccaugcuca

SEQ ID NO: 758100 - RNA, 16 nt, Homo sapiens
ucccgcccccuuggcu

SEQ ID NO: 758101 - RNA, 21 nt, Homo sapiens
ucccgccccgccccucccacg

SEQ ID NO: 758102 - RNA, 23 nt, Homo sapiens
ucccggcaagcgcuucugcugaa

SEQ ID NO: 758103 - RNA, 21 nt, Homo sapiens
ucccggcgggugcucugaggc

SEQ ID NO: 758104 - RNA, 20 nt, Homo sapiens
ucccggcgucccuaccuccu

SEQ ID NO: 758105 - RNA, 16 nt, Homo sapiens
ucccggguguguacac

SEQ ID NO: 758106 - RNA, 22 nt, Homo sapiens
ucccggguucaagugauucucc

SEQ ID NO: 758107 - RNA, 21 nt, Homo sapiens
ucccuaccccauuugugguca

SEQ ID NO: 758108 - RNA, 12 nt, Homo sapiens
ucccuaccucag

SEQ ID NO: 758109 - RNA, 13 nt, Homo sapiens
ucccuaccuugcc

SEQ ID NO: 758110 - RNA, 14 nt, Homo sapiens
ucccuagcagugaa

SEQ ID NO: 758111 - RNA, 22 nt, Homo sapiens
ucccuagccagcacuuguauau

SEQ ID NO: 758112 - RNA, 15 nt, Homo sapiens
ucccuaggaaacuca

SEQ ID NO: 758113 - RNA, 16 nt, Homo sapiens
ucccuaggggacacuu

SEQ ID NO: 758114 - RNA, 10 nt, Homo sapiens
ucccuaucua

SEQ ID NO: 758115 - RNA, 13 nt, Homo sapiens
ucccuauuuuccu

SEQ ID NO: 758116 - RNA, 20 nt, Homo sapiens
ucccucagaaaaaggcagug

SEQ ID NO: 758117 - RNA, 14 nt, Homo sapiens
ucccucagcucucu

SEQ ID NO: 758118 - RNA, 20 nt, Homo sapiens
ucccucaggucccuugguca

SEQ ID NO: 758119 - RNA, 14 nt, Homo sapiens
ucccucauccauag

SEQ ID NO: 758120 - RNA, 20 nt, Homo sapiens
ucccuccaaagggcaguggg

SEQ ID NO: 758121 - RNA, 15 nt, Homo sapiens
ucccuccacauuucc

SEQ ID NO: 758122 - RNA, 23 nt, Homo sapiens
ucccucccagaggagccaccagu

SEQ ID NO: 758123 - RNA, 20 nt, Homo sapiens
ucccuccccaguucauugca

SEQ ID NO: 758124 - RNA, 17 nt, Homo sapiens
ucccucccccccaugca

SEQ ID NO: 758125 - RNA, 18 nt, Homo sapiens
ucccucccccccaugcac

SEQ ID NO: 758126 - RNA, 22 nt, Homo sapiens
ucccucccccccaugcacugug

SEQ ID NO: 758127 - RNA, 17 nt, Homo sapiens
ucccucgggugugcuau

SEQ ID NO: 758128 - RNA, 21 nt, Homo sapiens
ucccucuaagcacauuccaaa

SEQ ID NO: 758129 - RNA, 13 nt, Homo sapiens
ucccucucaggug

SEQ ID NO: 758130 - RNA, 15 nt, Homo sapiens
ucccucuccaacugc

SEQ ID NO: 758131 - RNA, 13 nt, Homo sapiens
ucccucugcagaa

SEQ ID NO: 758132 - RNA, 14 nt, Homo sapiens
ucccucuggucuac

SEQ ID NO: 758133 - RNA, 22 nt, Homo sapiens
ucccucuuuggcuccccuguac

SEQ ID NO: 758134 - RNA, 19 nt, Homo sapiens
ucccugaaaacccagagag

SEQ ID NO: 758135 - RNA, 23 nt, Homo sapiens
ucccugaaaauguuuuucugcca

SEQ ID NO: 758136 - RNA, 15 nt, Homo sapiens
ucccugagcagcuua

SEQ ID NO: 758137 - RNA, 19 nt, Homo sapiens
ucccugaggaaugaaaaag

SEQ ID NO: 758138 - RNA, 22 nt, Homo sapiens
ucccugcacagugacuucugag

SEQ ID NO: 758139 - RNA, 14 nt, Homo sapiens
ucccugcacccaug

SEQ ID NO: 758140 - RNA, 21 nt, Homo sapiens
ucccugcacccaugacaauca

SEQ ID NO: 758141 - RNA, 15 nt, Homo sapiens
ucccugcagaugcca

SEQ ID NO: 758142 - RNA, 20 nt, Homo sapiens
ucccugcuaaagaguguuca

SEQ ID NO: 758143 - RNA, 16 nt, Homo sapiens
ucccugcuauuucccu

SEQ ID NO: 758144 - RNA, 21 nt, Homo sapiens
ucccugcugggaaugcuccca

SEQ ID NO: 758145 - RNA, 18 nt, Homo sapiens
ucccuggacaggcagccu

SEQ ID NO: 758146 - RNA, 23 nt, Homo sapiens
ucccuggaggcacgcaccacugc

SEQ ID NO: 758147 - RNA, 21 nt, Homo sapiens
ucccuggauguggauuucaca

SEQ ID NO: 758148 - RNA, 22 nt, Homo sapiens
ucuacuucuggaagucaucuca

SEQ ID NO: 758149 - RNA, 21 nt, Homo sapiens
ucuacuugccucauuucccua

SEQ ID NO: 758150 - RNA, 17 nt, Homo sapiens
ucuacuuugauucugau

SEQ ID NO: 758151 - RNA, 15 nt, Homo sapiens
ucuacuuugcagaug

SEQ ID NO: 758152 - RNA, 13 nt, Homo sapiens
ucuagaagcacau

SEQ ID NO: 758153 - RNA, 13 nt, Homo sapiens
ucuagaagccaag

SEQ ID NO: 758154 - RNA, 23 nt, Homo sapiens
ucuagacauggagguucuaaggc

SEQ ID NO: 758155 - RNA, 22 nt, Homo sapiens
ucuagacugucucuguggaaua

SEQ ID NO: 758156 - RNA, 16 nt, Homo sapiens
ucuagagucacugaua

SEQ ID NO: 758157 - RNA, 14 nt, Homo sapiens
ucuagaugacauaa

SEQ ID NO: 758158 - RNA, 20 nt, Homo sapiens
ucuagcaaauaugcuguuau

SEQ ID NO: 758159 - RNA, 23 nt, Homo sapiens
ucuagcacacuuuuuuaaaugaa

SEQ ID NO: 758160 - RNA, 19 nt, Homo sapiens
ucuagccugggcaacaaca

SEQ ID NO: 758161 - RNA, 14 nt, Homo sapiens
ucuaggaugugaug

SEQ ID NO: 758162 - RNA, 18 nt, Homo sapiens
ucuaggcaucccagggga

SEQ ID NO: 758163 - RNA, 14 nt, Homo sapiens
ucuaggcuaagcac

SEQ ID NO: 758164 - RNA, 14 nt, Homo sapiens
ucuaggguuuucca

SEQ ID NO: 758165 - RNA, 22 nt, Homo sapiens
ucuagguaggggcccacuucac

SEQ ID NO: 758166 - RNA, 17 nt, Homo sapiens
ucuaguaagaugcacug

SEQ ID NO: 758167 - RNA, 13 nt, Homo sapiens
ucuagugaaugaa

SEQ ID NO: 758168 - RNA, 20 nt, Homo sapiens
ucuaguggguugaccuuuaa

SEQ ID NO: 758169 - RNA, 18 nt, Homo sapiens
ucuagugucuuuugccuu

SEQ ID NO: 758170 - RNA, 20 nt, Homo sapiens
ucuagugucuuuugccuuua

SEQ ID NO: 758171 - RNA, 20 nt, Homo sapiens
ucuaguuaaccuagaaguau

SEQ ID NO: 758172 - RNA, 15 nt, Homo sapiens
ucuaguuuugucaaa

SEQ ID NO: 758173 - RNA, 20 nt, Homo sapiens
ucuauaaagaagaacuugca

SEQ ID NO: 758174 - RNA, 21 nt, Homo sapiens
ucuauaaagaagaacuugcau

SEQ ID NO: 758175 - RNA, 19 nt, Homo sapiens
ucuauaaauagaugcugug

SEQ ID NO: 758176 - RNA, 20 nt, Homo sapiens
ucuauaaauucaacacuuau

SEQ ID NO: 758177 - RNA, 19 nt, Homo sapiens
ucuauacucagguaccucu

SEQ ID NO: 758178 - RNA, 19 nt, Homo sapiens
ucuauacuccuucccuuaa

SEQ ID NO: 758179 - RNA, 20 nt, Homo sapiens
ucuauauuagaucaaauagu

SEQ ID NO: 758180 - RNA, 18 nt, Homo sapiens
ucuaucaggggugcauuc

SEQ ID NO: 758181 - RNA, 19 nt, Homo sapiens
ucuaucaggggugcauucu

SEQ ID NO: 758182 - RNA, 19 nt, Homo sapiens
ucuaucuugucaaucccaa

SEQ ID NO: 758183 - RNA, 21 nt, Homo sapiens
ucuaugaagcccacccagaaa

SEQ ID NO: 758184 - RNA, 14 nt, Homo sapiens
ucuaugccaaagau

SEQ ID NO: 758185 - RNA, 14 nt, Homo sapiens
ucuaugguugacau

SEQ ID NO: 758186 - RNA, 18 nt, Homo sapiens
ucuaugguugacauugua

SEQ ID NO: 758187 - RNA, 11 nt, Homo sapiens
ucuauguuaau

SEQ ID NO: 758188 - RNA, 21 nt, Homo sapiens
ucuauguucaaagacugugaa

SEQ ID NO: 758189 - RNA, 13 nt, Homo sapiens
ucuauguuugcac

SEQ ID NO: 758190 - RNA, 22 nt, Homo sapiens
ucuauguuugcacuugugcuuu

SEQ ID NO: 758191 - RNA, 12 nt, Homo sapiens
ucuauuaaucaa

SEQ ID NO: 758192 - RNA, 16 nt, Homo sapiens
ucuauucaagcacuua

SEQ ID NO: 758193 - RNA, 18 nt, Homo sapiens
ucuauucuagccugcauu

SEQ ID NO: 758194 - RNA, 15 nt, Homo sapiens
uccauuugcuuuguc

SEQ ID NO: 758195 - RNA, 13 nt, Homo sapiens
uccauuuucaagc

SEQ ID NO: 758196 - RNA, 20 nt, Homo sapiens
uccauuuuuuucuuuacuua

SEQ ID NO: 758197 - RNA, 23 nt, Homo sapiens
uccauuuuuuucuuuacuuaucu

SEQ ID NO: 758198 - RNA, 19 nt, Homo sapiens
ucccaaaccuaaugaucau

SEQ ID NO: 758199 - RNA, 21 nt, Homo sapiens
ucccaaacuccucuccuggau

SEQ ID NO: 758200 - RNA, 14 nt, Homo sapiens
ucccaaagcacuuu

SEQ ID NO: 758201 - RNA, 14 nt, Homo sapiens
ucccaaagccagaa

SEQ ID NO: 758202 - RNA, 20 nt, Homo sapiens
ucccaaagugcugagauuac

SEQ ID NO: 758203 - RNA, 16 nt, Homo sapiens
ucccaaagugcuggga

SEQ ID NO: 758204 - RNA, 20 nt, Homo sapiens
ucccaaagugcugggauuaa

SEQ ID NO: 758205 - RNA, 20 nt, Homo sapiens
ucccaaagugcugggauuac

SEQ ID NO: 758206 - RNA, 21 nt, Homo sapiens
ucccaaauuucauaccuauca

SEQ ID NO: 758207 - RNA, 15 nt, Homo sapiens
ucccaacacuuugag

SEQ ID NO: 758208 - RNA, 21 nt, Homo sapiens
ucccaacccauucacuacagg

SEQ ID NO: 758209 - RNA, 15 nt, Homo sapiens
ucccaacgugcaaag

SEQ ID NO: 758210 - RNA, 19 nt, Homo sapiens
ucccaacgugcaaagccaa

SEQ ID NO: 758211 - RNA, 17 nt, Homo sapiens
ucccaacucuugcacag

SEQ ID NO: 758212 - RNA, 20 nt, Homo sapiens
ucccaaguagcugagacuac

SEQ ID NO: 758213 - RNA, 17 nt, Homo sapiens
ucccaaguaugccuuaa

SEQ ID NO: 758214 - RNA, 18 nt, Homo sapiens
ucccaaucagcacugaaa

SEQ ID NO: 758215 - RNA, 13 nt, Homo sapiens
ucccaauguuuga

SEQ ID NO: 758216 - RNA, 21 nt, Homo sapiens
ucccaauguuugggauauuaa

SEQ ID NO: 758217 - RNA, 20 nt, Homo sapiens
ucccaauuaagaaauuccau

SEQ ID NO: 758218 - RNA, 12 nt, Homo sapiens
ucccaauuagcu

SEQ ID NO: 758219 - RNA, 20 nt, Homo sapiens
ucccaauuagcuuggccuac

SEQ ID NO: 758220 - RNA, 13 nt, Homo sapiens
ucccacacaggcu

SEQ ID NO: 758221 - RNA, 22 nt, Homo sapiens
ucccaccaacucugcacuccau

SEQ ID NO: 758222 - RNA, 14 nt, Homo sapiens
ucccaccacaggca

SEQ ID NO: 758223 - RNA, 16 nt, Homo sapiens
ucccaccauuccugcc

SEQ ID NO: 758224 - RNA, 21 nt, Homo sapiens
ucccaccauuccugccuuuaa

SEQ ID NO: 758225 - RNA, 17 nt, Homo sapiens
ucccacccacacagcug

SEQ ID NO: 758226 - RNA, 23 nt, Homo sapiens
ucccacccacacagcugcccuag

SEQ ID NO: 758227 - RNA, 17 nt, Homo sapiens
ucccacccacaugugac

SEQ ID NO: 758228 - RNA, 19 nt, Homo sapiens
ucccacccacaugugacac

SEQ ID NO: 758229 - RNA, 20 nt, Homo sapiens
ucccacccacaugugacaca

SEQ ID NO: 758230 - RNA, 22 nt, Homo sapiens
ucccacccaccuguagggcuag

SEQ ID NO: 758231 - RNA, 15 nt, Homo sapiens
ucccacccagcuaaa

SEQ ID NO: 758232 - RNA, 17 nt, Homo sapiens
ucccacccggcugcaua

SEQ ID NO: 758233 - RNA, 23 nt, Homo sapiens
ucccacccuccccaacaccccac

SEQ ID NO: 758234 - RNA, 15 nt, Homo sapiens
ucccaccgaacacua

SEQ ID NO: 758235 - RNA, 21 nt, Homo sapiens
ucccaccuagugccccagacu

SEQ ID NO: 758236 - RNA, 15 nt, Homo sapiens
ucccacggugcccaa

SEQ ID NO: 758237 - RNA, 19 nt, Homo sapiens
ucccacggugcccaaacac

SEQ ID NO: 758238 - RNA, 16 nt, Homo sapiens
ucccacguccaaucau

SEQ ID NO: 758239 - RNA, 16 nt, Homo sapiens
ucccacuaaaacugca

SEQ ID NO: 758240 - RNA, 18 nt, Homo sapiens
ucccacuacuguagaaag

SEQ ID NO: 758241 - RNA, 17 nt, Homo sapiens
ucccacucaggugaaaa

SEQ ID NO: 758242 - RNA, 13 nt, Homo sapiens
ucccacuuucauc

SEQ ID NO: 758243 - RNA, 13 nt, Homo sapiens
ucccagaaccacu

SEQ ID NO: 758244 - RNA, 14 nt, Homo sapiens
ucccagacauucau

SEQ ID NO: 758245 - RNA, 13 nt, Homo sapiens
ucccagaccagga

SEQ ID NO: 758246 - RNA, 22 nt, Homo sapiens
ucccagagcauugcuauuuauc

SEQ ID NO: 758247 - RNA, 20 nt, Homo sapiens
ucccagaggagccaccaguu

SEQ ID NO: 758248 - RNA, 18 nt, Homo sapiens
ucccagauguuggaccaa

SEQ ID NO: 758249 - RNA, 17 nt, Homo sapiens
ucccagcaagaccucau

SEQ ID NO: 758250 - RNA, 13 nt, Homo sapiens
ucccagcacuuug

SEQ ID NO: 758251 - RNA, 22 nt, Homo sapiens
ucccagcacuuugggaggccaa

SEQ ID NO: 758252 - RNA, 13 nt, Homo sapiens
ucccagcaguggg

SEQ ID NO: 758253 - RNA, 17 nt, Homo sapiens
ucccagcguuaacacaa

SEQ ID NO: 758254 - RNA, 14 nt, Homo sapiens
ucccagcuacucag

SEQ ID NO: 758255 - RNA, 17 nt, Homo sapiens
ucccagcucacgucaca

SEQ ID NO: 758256 - RNA, 14 nt, Homo sapiens
ucccagcugccaug

SEQ ID NO: 758257 - RNA, 14 nt, Homo sapiens
ucccaggacccuga

SEQ ID NO: 758258 - RNA, 18 nt, Homo sapiens
ucccaggacccugaaggg

SEQ ID NO: 758259 - RNA, 19 nt, Homo sapiens
ucccaggagaaagaugaaa

SEQ ID NO: 758260 - RNA, 18 nt, Homo sapiens
acgcgcguacagaucucu

SEQ ID NO: 758261 - RNA, 18 nt, Homo sapiens
acgcugaaggcuuacuuc

SEQ ID NO: 758262 - RNA, 19 nt, Homo sapiens
acgcuugcuuuagcacagg

SEQ ID NO: 758263 - RNA, 16 nt, Homo sapiens
acgcuuuuaauucuca

SEQ ID NO: 758264 - RNA, 16 nt, Homo sapiens
acggacugucaguucu

SEQ ID NO: 758265 - RNA, 17 nt, Homo sapiens
acggagucuugcucugu

SEQ ID NO: 758266 - RNA, 17 nt, Homo sapiens
acggaugggcccuaugu

SEQ ID NO: 758267 - RNA, 13 nt, Homo sapiens
acggcaccucggg

SEQ ID NO: 758268 - RNA, 18 nt, Homo sapiens
acggccagggagaagcuc

SEQ ID NO: 758269 - RNA, 16 nt, Homo sapiens
acggcgcccccagugu

SEQ ID NO: 758270 - RNA, 19 nt, Homo sapiens
acggcguuucaccauguug

SEQ ID NO: 758271 - RNA, 20 nt, Homo sapiens
acggcucacgcuuaccucaa

SEQ ID NO: 758272 - RNA, 16 nt, Homo sapiens
acggcugcgcacugug

SEQ ID NO: 758273 - RNA, 13 nt, Homo sapiens
acggcuuacaugu

SEQ ID NO: 758274 - RNA, 17 nt, Homo sapiens
acggcuuccaucugccc

SEQ ID NO: 758275 - RNA, 19 nt, Homo sapiens
acgggaauucagacaagcu

SEQ ID NO: 758276 - RNA, 20 nt, Homo sapiens
acgggcccgugacaucccca

SEQ ID NO: 758277 - RNA, 20 nt, Homo sapiens
acggggcucuucucauuuca

SEQ ID NO: 758278 - RNA, 23 nt, Homo sapiens
acggggcugacuccugcucucug

SEQ ID NO: 758279 - RNA, 12 nt, Homo sapiens
acggggugucau

SEQ ID NO: 758280 - RNA, 16 nt, Homo sapiens
acgguaaguguucuca

SEQ ID NO: 758281 - RNA, 13 nt, Homo sapiens
acggucaguccau

SEQ ID NO: 758282 - RNA, 14 nt, Homo sapiens
acggugcugugagg

SEQ ID NO: 758283 - RNA, 14 nt, Homo sapiens
acggugggcauuug

SEQ ID NO: 758284 - RNA, 15 nt, Homo sapiens
acgguguuuugccau

SEQ ID NO: 758285 - RNA, 14 nt, Homo sapiens
acgguuaugaaggc

SEQ ID NO: 758286 - RNA, 14 nt, Homo sapiens
acguaaacuaugac

SEQ ID NO: 758287 - RNA, 15 nt, Homo sapiens
acguaaauaaacuaa

SEQ ID NO: 758288 - RNA, 12 nt, Homo sapiens
acguaacuauuu

SEQ ID NO: 758289 - RNA, 19 nt, Homo sapiens
acguaagcuccuugucugu

SEQ ID NO: 758290 - RNA, 16 nt, Homo sapiens
acguaccccacugggc

SEQ ID NO: 758291 - RNA, 13 nt, Homo sapiens
acguauacaauaa

SEQ ID NO: 758292 - RNA, 16 nt, Homo sapiens
acguaugguggcucau

SEQ ID NO: 758293 - RNA, 13 nt, Homo sapiens
acguauucauuca

SEQ ID NO: 758294 - RNA, 19 nt, Homo sapiens
acguauuuaugucccugac

SEQ ID NO: 758295 - RNA, 14 nt, Homo sapiens
acgucacugcacuc

SEQ ID NO: 758296 - RNA, 15 nt, Homo sapiens
acgucagacuuggcu

SEQ ID NO: 758297 - RNA, 22 nt, Homo sapiens
acgucauuaagguuaugcacug

SEQ ID NO: 758298 - RNA, 20 nt, Homo sapiens
acgugaaauacuucgaugau

SEQ ID NO: 758299 - RNA, 23 nt, Homo sapiens
acgugaaauacuucgaugaugau

SEQ ID NO: 758300 - RNA, 17 nt, Homo sapiens
acgugacuguggcacac

SEQ ID NO: 758301 - RNA, 20 nt, Homo sapiens
acgugauccucucaccucag

SEQ ID NO: 758302 - RNA, 15 nt, Homo sapiens
acgugcaaagccaag

SEQ ID NO: 758303 - RNA, 17 nt, Homo sapiens
acgugcaaagccaaggc

SEQ ID NO: 758304 - RNA, 14 nt, Homo sapiens
acgugcagccacac

SEQ ID NO: 758305 - RNA, 22 nt, Homo sapiens
acgugcaggacagcucuugauu

SEQ ID NO: 758306 - RNA, 13 nt, Homo sapiens
acgugcaguaucu

SEQ ID NO: 758307 - RNA, 19 nt, Homo sapiens
acgugcauccuuguaauac

SEQ ID NO: 758308 - RNA, 16 nt, Homo sapiens
acgugccagcucuagu

SEQ ID NO: 758309 - RNA, 14 nt, Homo sapiens
acgugccugugauc

SEQ ID NO: 758310 - RNA, 18 nt, Homo sapiens
acgugcgcucugccauuc

SEQ ID NO: 758311 - RNA, 18 nt, Homo sapiens
acgugcgugcgagcacac

SEQ ID NO: 758312 - RNA, 13 nt, Homo sapiens
acguggcacuggu

SEQ ID NO: 758313 - RNA, 13 nt, Homo sapiens
acgugggcauuuu

SEQ ID NO: 758314 - RNA, 19 nt, Homo sapiens
acgugggccuccagaguug

SEQ ID NO: 758315 - RNA, 16 nt, Homo sapiens
acgugugcaguuguag

SEQ ID NO: 758316 - RNA, 14 nt, Homo sapiens
acguucugcugcuu

SEQ ID NO: 758317 - RNA, 22 nt, Homo sapiens
acguugccuaauaaacauccuu

SEQ ID NO: 758318 - RNA, 16 nt, Homo sapiens
acguuuaacauacaau

SEQ ID NO: 758319 - RNA, 14 nt, Homo sapiens
acguuuugcacauu

SEQ ID NO: 758320 - RNA, 17 nt, Homo sapiens
acguuuuggucacauau

SEQ ID NO: 758321 - RNA, 17 nt, Homo sapiens
acuaaaaauaccaaaaa

SEQ ID NO: 758322 - RNA, 17 nt, Homo sapiens
acuaaaacacacaggug

SEQ ID NO: 758323 - RNA, 15 nt, Homo sapiens
acuaaaauucaaaaa

SEQ ID NO: 758324 - RNA, 23 nt, Homo sapiens
acuaaacaauaagcaagagacaa

SEQ ID NO: 758325 - RNA, 13 nt, Homo sapiens
acuaaagauuaaa

SEQ ID NO: 758326 - RNA, 22 nt, Homo sapiens
acuaaagcaaauuuuagaacuu

SEQ ID NO: 758327 - RNA, 23 nt, Homo sapiens
acuaaaucaaucugcaguuuaac

SEQ ID NO: 758328 - RNA, 18 nt, Homo sapiens
acuaaauguauuccugua

SEQ ID NO: 758329 - RNA, 13 nt, Homo sapiens
acuaacccaaugc

SEQ ID NO: 758330 - RNA, 16 nt, Homo sapiens
acuaacuagacuaaga

SEQ ID NO: 758331 - RNA, 14 nt, Homo sapiens
acuaagacaccuga

SEQ ID NO: 758332 - RNA, 18 nt, Homo sapiens
acuaagagaaugugcuca

SEQ ID NO: 758333 - RNA, 13 nt, Homo sapiens
acuaagauguuca

SEQ ID NO: 758334 - RNA, 21 nt, Homo sapiens
acuaagccagacgugguggcu

SEQ ID NO: 758335 - RNA, 19 nt, Homo sapiens
acuaaggcagcuaagacau

SEQ ID NO: 758336 - RNA, 18 nt, Homo sapiens
acuaagggguauguuccc

SEQ ID NO: 758337 - RNA, 17 nt, Homo sapiens
acuaaucgaaugaacaa

SEQ ID NO: 758338 - RNA, 16 nt, Homo sapiens
acuaaugaugcuuuua

SEQ ID NO: 758339 - RNA, 16 nt, Homo sapiens
acuaaugccucuucau

SEQ ID NO: 758340 - RNA, 15 nt, Homo sapiens
acuaaugcuaagaaa

SEQ ID NO: 758341 - RNA, 12 nt, Homo sapiens
acuaaugcuuua

SEQ ID NO: 758342 - RNA, 14 nt, Homo sapiens
acuaauggaaauau

SEQ ID NO: 758343 - RNA, 23 nt, Homo sapiens
acuaauuaggcaaggcuauguga

SEQ ID NO: 758344 - RNA, 14 nt, Homo sapiens
acuaauugguacuu

SEQ ID NO: 758345 - RNA, 16 nt, Homo sapiens
acuacaaagcuucuau

SEQ ID NO: 758346 - RNA, 21 nt, Homo sapiens
acuacagaauaauguguuaaa

SEQ ID NO: 758347 - RNA, 17 nt, Homo sapiens
acuacagguaugugcca

SEQ ID NO: 758348 - RNA, 16 nt, Homo sapiens
acuacaguaacuguga

SEQ ID NO: 758349 - RNA, 19 nt, Homo sapiens
acuacauuggaagcuuuga

SEQ ID NO: 758350 - RNA, 24 nt, Homo sapiens
acuacauuuuaaaaacugacuuaa

SEQ ID NO: 758351 - RNA, 19 nt, Homo sapiens
acuaccauugcuguucuac

SEQ ID NO: 758352 - RNA, 16 nt, Homo sapiens
acuaccucaaaggcca

SEQ ID NO: 758353 - RNA, 23 nt, Homo sapiens
acuacuccuguaauuccuaccuc

SEQ ID NO: 758354 - RNA, 15 nt, Homo sapiens
acuacuguccaauca

SEQ ID NO: 758355 - RNA, 18 nt, Homo sapiens
acuagaaugcuuuuguua

SEQ ID NO: 758356 - RNA, 18 nt, Homo sapiens
acuagagggauacacuga

SEQ ID NO: 758357 - RNA, 23 nt, Homo sapiens
acuagagucugaacagcuguaau

SEQ ID NO: 758358 - RNA, 13 nt, Homo sapiens
acuagauguuaag

SEQ ID NO: 758359 - RNA, 15 nt, Homo sapiens
acuagauucuuguca

SEQ ID NO: 758360 - RNA, 17 nt, Homo sapiens
acuagauucuugucaca

SEQ ID NO: 758361 - RNA, 16 nt, Homo sapiens
acuagccagacacucu

SEQ ID NO: 758362 - RNA, 21 nt, Homo sapiens
acuagcccaaugaaaugaauu

SEQ ID NO: 758363 - RNA, 14 nt, Homo sapiens
acuagccugugauu

SEQ ID NO: 758364 - RNA, 15 nt, Homo sapiens
acuagcucuguauua

SEQ ID NO: 758365 - RNA, 14 nt, Homo sapiens
acuagcuuacugag

SEQ ID NO: 758366 - RNA, 13 nt, Homo sapiens
acuaggccuucag

SEQ ID NO: 758367 - RNA, 15 nt, Homo sapiens
acuaggggagggggu

SEQ ID NO: 758368 - RNA, 20 nt, Homo sapiens
acuaguucagacacuuugga

SEQ ID NO: 758369 - RNA, 21 nt, Homo sapiens
acuaguucagacacuuuggaa

SEQ ID NO: 758370 - RNA, 15 nt, Homo sapiens
acuaguuuccagugg

SEQ ID NO: 758371 - RNA, 22 nt, Homo sapiens
acuaguuugcuuugcugaccaa

SEQ ID NO: 758372 - RNA, 22 nt, Homo sapiens
acuauaaauaauauucuauuca

SEQ ID NO: 758373 - RNA, 16 nt, Homo sapiens
acuauaaggugccuca

SEQ ID NO: 758374 - RNA, 18 nt, Homo sapiens
acuauaaguaauucucaa

SEQ ID NO: 758375 - RNA, 20 nt, Homo sapiens
acuauagaaugcaacuccau

SEQ ID NO: 758376 - RNA, 14 nt, Homo sapiens
ccaguaacccaaau

SEQ ID NO: 758377 - RNA, 16 nt, Homo sapiens
ccaguacgugcuaaca

SEQ ID NO: 758378 - RNA, 17 nt, Homo sapiens
ccaguaguggacaacag

SEQ ID NO: 758379 - RNA, 12 nt, Homo sapiens
ccaguaguggga

SEQ ID NO: 758380 - RNA, 20 nt, Homo sapiens
ccagucagagauaacaucca

SEQ ID NO: 758381 - RNA, 12 nt, Homo sapiens
ccaguccaugcu

SEQ ID NO: 758382 - RNA, 22 nt, Homo sapiens
ccagucuauuuccacugaacaa

SEQ ID NO: 758383 - RNA, 23 nt, Homo sapiens
ccagucuauuuccacugaacaaa

SEQ ID NO: 758384 - RNA, 15 nt, Homo sapiens
ccagucucaccuuca

SEQ ID NO: 758385 - RNA, 13 nt, Homo sapiens
ccagucucuggca

SEQ ID NO: 758386 - RNA, 23 nt, Homo sapiens
ccagucuggaaaacagaaaccau

SEQ ID NO: 758387 - RNA, 19 nt, Homo sapiens
ccagugaugaaaacauuca

SEQ ID NO: 758388 - RNA, 18 nt, Homo sapiens
ccagugaugugugagcua

SEQ ID NO: 758389 - RNA, 15 nt, Homo sapiens
ccagugcaaaugcau

SEQ ID NO: 758390 - RNA, 21 nt, Homo sapiens
ccagugcaaaugcaugcuucu

SEQ ID NO: 758391 - RNA, 11 nt, Homo sapiens
ccagugccuuc

SEQ ID NO: 758392 - RNA, 17 nt, Homo sapiens
ccagugccuucugggaa

SEQ ID NO: 758393 - RNA, 17 nt, Homo sapiens
ccagugcgguuccucau

SEQ ID NO: 758394 - RNA, 22 nt, Homo sapiens
ccagugcucaagguuacuggga

SEQ ID NO: 758395 - RNA, 15 nt, Homo sapiens
ccagugcuccaggca

SEQ ID NO: 758396 - RNA, 21 nt, Homo sapiens
ccaguggcuggaucugugagg

SEQ ID NO: 758397 - RNA, 21 nt, Homo sapiens
ccagugguggguaauuguaca

SEQ ID NO: 758398 - RNA, 23 nt, Homo sapiens
ccagugguggguaauuguacaau

SEQ ID NO: 758399 - RNA, 12 nt, Homo sapiens
ccaguguaauaa

SEQ ID NO: 758400 - RNA, 16 nt, Homo sapiens
cuccgcaacagccaag

SEQ ID NO: 758401 - RNA, 16 nt, Homo sapiens
cuccgcaagcaucauc

SEQ ID NO: 758402 - RNA, 16 nt, Homo sapiens
cuccgcgccuugccuc

SEQ ID NO: 758403 - RNA, 19 nt, Homo sapiens
cuccggggucugugcugug

SEQ ID NO: 758404 - RNA, 18 nt, Homo sapiens
cuccguuuggcagugcaa

SEQ ID NO: 758405 - RNA, 14 nt, Homo sapiens
cuccuaacaaaaga

SEQ ID NO: 758406 - RNA, 20 nt, Homo sapiens
cuccuaagcuggagugcagu

SEQ ID NO: 758407 - RNA, 23 nt, Homo sapiens
cuccuaaucuuaucaauucugau

SEQ ID NO: 758408 - RNA, 20 nt, Homo sapiens
cuccuacaggugcuguucag

SEQ ID NO: 758409 - RNA, 21 nt, Homo sapiens
cuccuacccuuccagugcccu

SEQ ID NO: 758410 - RNA, 20 nt, Homo sapiens
cuccuagaggugggcagcug

SEQ ID NO: 758411 - RNA, 14 nt, Homo sapiens
cuccuaucuguguu

SEQ ID NO: 758412 - RNA, 12 nt, Homo sapiens
cuccucaaaagc

SEQ ID NO: 758413 - RNA, 20 nt, Homo sapiens
cuccucacaguugccaugua

SEQ ID NO: 758414 - RNA, 19 nt, Homo sapiens
cuccucucuagaaccuccu

SEQ ID NO: 758415 - RNA, 13 nt, Homo sapiens
cuccucugagcag

SEQ ID NO: 758416 - RNA, 12 nt, Homo sapiens
cuccucugcacu

SEQ ID NO: 758417 - RNA, 11 nt, Homo sapiens
cuccucuguca

SEQ ID NO: 758418 - RNA, 22 nt, Homo sapiens
cuccucuugguggguguggcca

SEQ ID NO: 758419 - RNA, 20 nt, Homo sapiens
cuccugaccucaaguaaucc

SEQ ID NO: 758420 - RNA, 17 nt, Homo sapiens
cuccugaccucagguga

SEQ ID NO: 758421 - RNA, 12 nt, Homo sapiens
cuccugaccucg

SEQ ID NO: 758422 - RNA, 22 nt, Homo sapiens
cuccugagcauauuuaaaacaa

SEQ ID NO: 758423 - RNA, 20 nt, Homo sapiens
cuccugaguagcugggauua

SEQ ID NO: 758424 - RNA, 20 nt, Homo sapiens
cuccugauggagugugcaga

SEQ ID NO: 758425 - RNA, 21 nt, Homo sapiens
cuccugccucccaauaccagc

SEQ ID NO: 758426 - RNA, 15 nt, Homo sapiens
cuccugcuacuuccc

SEQ ID NO: 758427 - RNA, 12 nt, Homo sapiens
cuccugcuccuc

SEQ ID NO: 758428 - RNA, 23 nt, Homo sapiens
cuccuggaaaggcucagucucag

SEQ ID NO: 758429 - RNA, 19 nt, Homo sapiens
cuccuggccucaagugauc

SEQ ID NO: 758430 - RNA, 23 nt, Homo sapiens
cuccuguguucuagaccucuggg

SEQ ID NO: 758431 - RNA, 18 nt, Homo sapiens
cuccuguucugaaaccuu

SEQ ID NO: 758432 - RNA, 16 nt, Homo sapiens
cuccuguuuugcacag

SEQ ID NO: 758433 - RNA, 19 nt, Homo sapiens
cuccuuaagaacacaaagc

SEQ ID NO: 758434 - RNA, 22 nt, Homo sapiens
cuccuuacgcuuugucacacaa

SEQ ID NO: 758435 - RNA, 16 nt, Homo sapiens
cuccuuagagacauca

SEQ ID NO: 758436 - RNA, 19 nt, Homo sapiens
cuccuuagcaggcuaugaa

SEQ ID NO: 758437 - RNA, 22 nt, Homo sapiens
cuccuucccauuucucuacacu

SEQ ID NO: 758438 - RNA, 21 nt, Homo sapiens
cuccuugcccagacuacaggg

SEQ ID NO: 758439 - RNA, 18 nt, Homo sapiens
cuccuuggcugucugugg

SEQ ID NO: 758440 - RNA, 14 nt, Homo sapiens
cuccuugguauuuc

SEQ ID NO: 758441 - RNA, 14 nt, Homo sapiens
cuccuuggugccug

SEQ ID NO: 758442 - RNA, 18 nt, Homo sapiens
cuccuugucuuaaucguc

SEQ ID NO: 758443 - RNA, 16 nt, Homo sapiens
cuccuuuaauuaaugg

SEQ ID NO: 758444 - RNA, 21 nt, Homo sapiens
cuccuuuaccuuucagugcag

SEQ ID NO: 758445 - RNA, 13 nt, Homo sapiens
cuccuuuagccau

SEQ ID NO: 758446 - RNA, 17 nt, Homo sapiens
cuccuuuguucuguauu

SEQ ID NO: 758447 - RNA, 18 nt, Homo sapiens
cuccuuuucccaaagcau

SEQ ID NO: 758448 - RNA, 13 nt, Homo sapiens
cuccuuuugacca

SEQ ID NO: 758449 - RNA, 14 nt, Homo sapiens
cuccuuuugaccaa

SEQ ID NO: 758450 - RNA, 20 nt, Homo sapiens
cuccuuuuuugcaugugcaa

SEQ ID NO: 758451 - RNA, 17 nt, Homo sapiens
cucgacauuuggugaga

SEQ ID NO: 758452 - RNA, 21 nt, Homo sapiens
cucgcaagggaaguccuugca

SEQ ID NO: 758453 - RNA, 21 nt, Homo sapiens
cucgcacaccucugcaccuuu

SEQ ID NO: 758454 - RNA, 13 nt, Homo sapiens
cucgcacucuggu

SEQ ID NO: 758455 - RNA, 15 nt, Homo sapiens
cucgcugcguccuca

SEQ ID NO: 758456 - RNA, 19 nt, Homo sapiens
cucggagcuggcccagggg

SEQ ID NO: 758457 - RNA, 13 nt, Homo sapiens
cucgggaaacaca

SEQ ID NO: 758458 - RNA, 20 nt, Homo sapiens
cucgggaagccccauccaac

SEQ ID NO: 758459 - RNA, 21 nt, Homo sapiens
cucgggaagggaagauggaug

SEQ ID NO: 758460 - RNA, 17 nt, Homo sapiens
cucgggggccuguggug

SEQ ID NO: 758461 - RNA, 20 nt, Homo sapiens
cucggugagccggggccguc

SEQ ID NO: 758462 - RNA, 17 nt, Homo sapiens
cucgucuuccuuguuaa

SEQ ID NO: 758463 - RNA, 12 nt, Homo sapiens
cucgugugcaac

SEQ ID NO: 758464 - RNA, 14 nt, Homo sapiens
cucuaaacauuuca

SEQ ID NO: 758465 - RNA, 17 nt, Homo sapiens
cucuaacuccugccauu

SEQ ID NO: 758466 - RNA, 11 nt, Homo sapiens
cucuaacugga

SEQ ID NO: 758467 - RNA, 15 nt, Homo sapiens
cucuaagaucuuaga

SEQ ID NO: 758468 - RNA, 20 nt, Homo sapiens
cucuaagcacauuccaaacu

SEQ ID NO: 758469 - RNA, 22 nt, Homo sapiens
cucuaagugggcauugccaugu

SEQ ID NO: 758470 - RNA, 19 nt, Homo sapiens
cucuacaucuucugccuua

SEQ ID NO: 758471 - RNA, 14 nt, Homo sapiens
cucuacauguaacu

SEQ ID NO: 758472 - RNA, 17 nt, Homo sapiens
cucuacuaaaaacacaa

SEQ ID NO: 758473 - RNA, 17 nt, Homo sapiens
cucuacuaaaaauacaa

SEQ ID NO: 758474 - RNA, 21 nt, Homo sapiens
cucuacuaaaaauacaaaaau

SEQ ID NO: 758475 - RNA, 20 nt, Homo sapiens
cucuacuaaaaauacaaaau

SEQ ID NO: 758476 - RNA, 18 nt, Homo sapiens
cucuacuaaaacauacaa

SEQ ID NO: 758477 - RNA, 16 nt, Homo sapiens
cucuacuacaugugac

SEQ ID NO: 758478 - RNA, 17 nt, Homo sapiens
cucuacuccuaccucag

SEQ ID NO: 758479 - RNA, 21 nt, Homo sapiens
cucuacugaaaguacaaaaau

SEQ ID NO: 758480 - RNA, 18 nt, Homo sapiens
cucuacuguuuaacaaca

SEQ ID NO: 758481 - RNA, 15 nt, Homo sapiens
cucuacuuaauccaa

SEQ ID NO: 758482 - RNA, 21 nt, Homo sapiens
cucuagaacaugcacauuuau

SEQ ID NO: 758483 - RNA, 15 nt, Homo sapiens
cucuagaagaccaaa

SEQ ID NO: 758484 - RNA, 16 nt, Homo sapiens
cucuagagagccuuaa

SEQ ID NO: 758485 - RNA, 19 nt, Homo sapiens
cucuagccuggcaacagag

SEQ ID NO: 758486 - RNA, 17 nt, Homo sapiens
cucuagggccucuccag

SEQ ID NO: 758487 - RNA, 22 nt, Homo sapiens
cucuagguacgaugacaguguu

SEQ ID NO: 758488 - RNA, 12 nt, Homo sapiens
cucuauggugug

SEQ ID NO: 758489 - RNA, 23 nt, Homo sapiens
cucuauguuuacaaauggacaua

SEQ ID NO: 758490 - RNA, 17 nt, Homo sapiens
cucuauucucugcaauu

SEQ ID NO: 758491 - RNA, 14 nt, Homo sapiens
cucuauugcugcuc

SEQ ID NO: 758492 - RNA, 19 nt, Homo sapiens
cucuauugcugcucucuca

SEQ ID NO: 758493 - RNA, 14 nt, Homo sapiens
cucuauuguuaccu

SEQ ID NO: 758494 - RNA, 20 nt, Homo sapiens
cucucaaaagagaaaaacaa

SEQ ID NO: 758495 - RNA, 14 nt, Homo sapiens
cucucaaacuucac

SEQ ID NO: 758496 - RNA, 23 nt, Homo sapiens
cucucagcaagugcccaguggag

SEQ ID NO: 758497 - RNA, 15 nt, Homo sapiens
cucucaggccagcuc

SEQ ID NO: 758498 - RNA, 22 nt, Homo sapiens
cucucagugcuucuuacuauua

SEQ ID NO: 758499 - RNA, 11 nt, Homo sapiens
cucuccaaagg

SEQ ID NO: 758500 - RNA, 23 nt, Homo sapiens
cucuccaaccacugugccacuga

SEQ ID NO: 758501 - RNA, 15 nt, Homo sapiens
cucuccaagugccag

SEQ ID NO: 758502 - RNA, 17 nt, Homo sapiens
cucuccaauacucaggu

SEQ ID NO: 758503 - RNA, 22 nt, Homo sapiens
cucuccaguguuucuacaauca

SEQ ID NO: 758504 - RNA, 17 nt, Homo sapiens
cucucccaacucuugca

SEQ ID NO: 758505 - RNA, 18 nt, Homo sapiens
cucucccaacucuugcac

SEQ ID NO: 758506 - RNA, 20 nt, Homo sapiens
cucucccaacucuugcacag

SEQ ID NO: 758507 - RNA, 13 nt, Homo sapiens
cucucccagauuu

SEQ ID NO: 758508 - RNA, 13 nt, Homo sapiens
cucucccuaggcu

SEQ ID NO: 758509 - RNA, 22 nt, Homo sapiens
cucucccugucacgcucauguc

SEQ ID NO: 758510 - RNA, 15 nt, Homo sapiens
cucaucccucuguca

SEQ ID NO: 758511 - RNA, 13 nt, Homo sapiens
cucaucugugauu

SEQ ID NO: 758512 - RNA, 14 nt, Homo sapiens
cucaucuuacugua

SEQ ID NO: 758513 - RNA, 13 nt, Homo sapiens
cucaugacacugu

SEQ ID NO: 758514 - RNA, 16 nt, Homo sapiens
cucaugagaagccaag

SEQ ID NO: 758515 - RNA, 21 nt, Homo sapiens
cucaugauaccaccuuuacug

SEQ ID NO: 758516 - RNA, 14 nt, Homo sapiens
cucaugauauguca

SEQ ID NO: 758517 - RNA, 12 nt, Homo sapiens
cucaugccauca

SEQ ID NO: 758518 - RNA, 14 nt, Homo sapiens
cucauggaccagug

SEQ ID NO: 758519 - RNA, 23 nt, Homo sapiens
cucauggguggcacucagucucu

SEQ ID NO: 758520 - RNA, 20 nt, Homo sapiens
cucauguauaaaacuaggaa

SEQ ID NO: 758521 - RNA, 13 nt, Homo sapiens
cucauguccuuca

SEQ ID NO: 758522 - RNA, 19 nt, Homo sapiens
cucauuagugguacugggg

SEQ ID NO: 758523 - RNA, 21 nt, Homo sapiens
cucauuggugguagccaucaa

SEQ ID NO: 758524 - RNA, 18 nt, Homo sapiens
cucauuuaagaauuugaa

SEQ ID NO: 758525 - RNA, 21 nt, Homo sapiens
cucauuuagaacuugcagcug

SEQ ID NO: 758526 - RNA, 16 nt, Homo sapiens
cucauuucauucucac

SEQ ID NO: 758527 - RNA, 17 nt, Homo sapiens
cucauuuuuguuuucau

SEQ ID NO: 758528 - RNA, 14 nt, Homo sapiens
cuccaaacauuacu

SEQ ID NO: 758529 - RNA, 14 nt, Homo sapiens
cuccaaagagacca

SEQ ID NO: 758530 - RNA, 20 nt, Homo sapiens
cuccaaaggucugaugucuc

SEQ ID NO: 758531 - RNA, 18 nt, Homo sapiens
cuccaacaucacagccca

SEQ ID NO: 758532 - RNA, 22 nt, Homo sapiens
cuccaagcgcgguuacuauggc

SEQ ID NO: 758533 - RNA, 17 nt, Homo sapiens
cuccaaggacuaaggcc

SEQ ID NO: 758534 - RNA, 23 nt, Homo sapiens
cuccacaauagcagacaguguuu

SEQ ID NO: 758535 - RNA, 16 nt, Homo sapiens
cuccacagugcugcuu

SEQ ID NO: 758536 - RNA, 12 nt, Homo sapiens
cuccacauaccu

SEQ ID NO: 758537 - RNA, 22 nt, Homo sapiens
cuccacaucugccuuaaaacca

SEQ ID NO: 758538 - RNA, 17 nt, Homo sapiens
cuccaccuagacuguaa

SEQ ID NO: 758539 - RNA, 15 nt, Homo sapiens
cuccacucacuccag

SEQ ID NO: 758540 - RNA, 18 nt, Homo sapiens
cuccacucaguugcaacu

SEQ ID NO: 758541 - RNA, 22 nt, Homo sapiens
cuccacucaguugcaacuugga

SEQ ID NO: 758542 - RNA, 21 nt, Homo sapiens
cuccacucugauucaccucuu

SEQ ID NO: 758543 - RNA, 16 nt, Homo sapiens
cuccacugccuucgau

SEQ ID NO: 758544 - RNA, 17 nt, Homo sapiens
cuccacuguguccagag

SEQ ID NO: 758545 - RNA, 19 nt, Homo sapiens
cuccagaagaugccagcuu

SEQ ID NO: 758546 - RNA, 20 nt, Homo sapiens
cuccagauguuuccagacuu

SEQ ID NO: 758547 - RNA, 19 nt, Homo sapiens
cuccagauuagagccugua

SEQ ID NO: 758548 - RNA, 15 nt, Homo sapiens
cuccagcaacacagc

SEQ ID NO: 758549 - RNA, 16 nt, Homo sapiens
cuccagccagcaauga

SEQ ID NO: 758550 - RNA, 19 nt, Homo sapiens
cuccagcugcucugucuuc

SEQ ID NO: 758551 - RNA, 20 nt, Homo sapiens
cuccagcugggcucugcaau

SEQ ID NO: 758552 - RNA, 20 nt, Homo sapiens
cuccagcuugggcaacagag

SEQ ID NO: 758553 - RNA, 14 nt, Homo sapiens
cuccaggaaugccu

SEQ ID NO: 758554 - RNA, 13 nt, Homo sapiens
cuccagggcauug

SEQ ID NO: 758555 - RNA, 13 nt, Homo sapiens
cuccaggugcaga

SEQ ID NO: 758556 - RNA, 16 nt, Homo sapiens
cuccaguaacagccua

SEQ ID NO: 758557 - RNA, 21 nt, Homo sapiens
cuccaguaguaguauggcacu

SEQ ID NO: 758558 - RNA, 20 nt, Homo sapiens
cuccagucaacagauucaga

SEQ ID NO: 758559 - RNA, 19 nt, Homo sapiens
cuccagucuggcaacagag

SEQ ID NO: 758560 - RNA, 15 nt, Homo sapiens
cuccaguuugcauuu

SEQ ID NO: 758561 - RNA, 18 nt, Homo sapiens
cuccauaaaguacaaaug

SEQ ID NO: 758562 - RNA, 17 nt, Homo sapiens
cuccauacauaacuuga

SEQ ID NO: 758563 - RNA, 20 nt, Homo sapiens
cuccauacugggcuaaggaa

SEQ ID NO: 758564 - RNA, 18 nt, Homo sapiens
cuccauaucccuuugcag

SEQ ID NO: 758565 - RNA, 15 nt, Homo sapiens
cuccaucccaacagc

SEQ ID NO: 758566 - RNA, 19 nt, Homo sapiens
cuccaucccaacagccaug

SEQ ID NO: 758567 - RNA, 16 nt, Homo sapiens
cuccaucucuacugaa

SEQ ID NO: 758568 - RNA, 17 nt, Homo sapiens
cuccaucucucauccuc

SEQ ID NO: 758569 - RNA, 14 nt, Homo sapiens
cuccaucucugucu

SEQ ID NO: 758570 - RNA, 20 nt, Homo sapiens
cuccaucuuucuacagagau

SEQ ID NO: 758571 - RNA, 21 nt, Homo sapiens
cuccaugaugccccugagaug

SEQ ID NO: 758572 - RNA, 13 nt, Homo sapiens
cuccaugcaggcc

SEQ ID NO: 758573 - RNA, 13 nt, Homo sapiens
cuccauucauccu

SEQ ID NO: 758574 - RNA, 18 nt, Homo sapiens
cuccauucauccuuccau

SEQ ID NO: 758575 - RNA, 22 nt, Homo sapiens
cuccauucauccuuccauccau

SEQ ID NO: 758576 - RNA, 18 nt, Homo sapiens
cuccauugguguugacau

SEQ ID NO: 758577 - RNA, 15 nt, Homo sapiens
cuccauuuaccagua

SEQ ID NO: 758578 - RNA, 14 nt, Homo sapiens
cuccauuugcucuu

SEQ ID NO: 758579 - RNA, 15 nt, Homo sapiens
cucccaaagcucaga

SEQ ID NO: 758580 - RNA, 20 nt, Homo sapiens
cucccaagcaccugggauua

SEQ ID NO: 758581 - RNA, 14 nt, Homo sapiens
cucccaagcguucc

SEQ ID NO: 758582 - RNA, 13 nt, Homo sapiens
cucccaagcugcc

SEQ ID NO: 758583 - RNA, 14 nt, Homo sapiens
cucccaagguccuc

SEQ ID NO: 758584 - RNA, 19 nt, Homo sapiens
cucccaaguagcugagacu

SEQ ID NO: 758585 - RNA, 14 nt, Homo sapiens
cucccaaguccaca

SEQ ID NO: 758586 - RNA, 22 nt, Homo sapiens
cucccaccccggccuccacucc

SEQ ID NO: 758587 - RNA, 18 nt, Homo sapiens
cucccacuucacugcgaa

SEQ ID NO: 758588 - RNA, 15 nt, Homo sapiens
cucccagagaccuug

SEQ ID NO: 758589 - RNA, 15 nt, Homo sapiens
cucccagcagcucaa

SEQ ID NO: 758590 - RNA, 15 nt, Homo sapiens
cucccagccaagucc

SEQ ID NO: 758591 - RNA, 20 nt, Homo sapiens
cucccagcguuaacacaaaa

SEQ ID NO: 758592 - RNA, 20 nt, Homo sapiens
cucccaggccaacaguagcc

SEQ ID NO: 758593 - RNA, 22 nt, Homo sapiens
cucccaggguggacuucagugu

SEQ ID NO: 758594 - RNA, 23 nt, Homo sapiens
cucccaggguggacuucagugug

SEQ ID NO: 758595 - RNA, 16 nt, Homo sapiens
cucccagguaccagcu

SEQ ID NO: 758596 - RNA, 12 nt, Homo sapiens
cucccaguacua

SEQ ID NO: 758597 - RNA, 15 nt, Homo sapiens
cucccaugggcugag

SEQ ID NO: 758598 - RNA, 14 nt, Homo sapiens
cuccccacacucca

SEQ ID NO: 758599 - RNA, 20 nt, Homo sapiens
cuccccacuuguccgcuggg

SEQ ID NO: 758600 - RNA, 17 nt, Homo sapiens
cucccccugccagugcc

SEQ ID NO: 758601 - RNA, 15 nt, Homo sapiens
cuccccugcacugua

SEQ ID NO: 758602 - RNA, 17 nt, Homo sapiens
cuccccuuucuuugcaa

SEQ ID NO: 758603 - RNA, 13 nt, Homo sapiens
cuccccuuugccu

SEQ ID NO: 758604 - RNA, 22 nt, Homo sapiens
cuccccuuuuauaccugcucuu

SEQ ID NO: 758605 - RNA, 15 nt, Homo sapiens
cucccguccauucca

SEQ ID NO: 758606 - RNA, 17 nt, Homo sapiens
cucccgugggcaucuca

SEQ ID NO: 758607 - RNA, 15 nt, Homo sapiens
cucccuccaccuccu

SEQ ID NO: 758608 - RNA, 16 nt, Homo sapiens
cucccucucucuggga

SEQ ID NO: 758609 - RNA, 18 nt, Homo sapiens
cucccucugcuacuccau

SEQ ID NO: 758610 - RNA, 14 nt, Homo sapiens
cucccucuggucua

SEQ ID NO: 758611 - RNA, 16 nt, Homo sapiens
cucccugaagccuuug

SEQ ID NO: 758612 - RNA, 20 nt, Homo sapiens
cucccugacccacugugcug

SEQ ID NO: 758613 - RNA, 23 nt, Homo sapiens
cucccugaccuuagcguucugga

SEQ ID NO: 758614 - RNA, 18 nt, Homo sapiens
cucccugcucuaacaccu

SEQ ID NO: 758615 - RNA, 21 nt, Homo sapiens
cucccugcucuauccugaaua

SEQ ID NO: 758616 - RNA, 16 nt, Homo sapiens
cucccugcuugcacac

SEQ ID NO: 758617 - RNA, 14 nt, Homo sapiens
cucccuggcuguga

SEQ ID NO: 758618 - RNA, 15 nt, Homo sapiens
cucccuggcugugag

SEQ ID NO: 758619 - RNA, 19 nt, Homo sapiens
cucccugguguaguguauu

SEQ ID NO: 758620 - RNA, 15 nt, Homo sapiens
cgugccaaaaaucuu

SEQ ID NO: 758621 - RNA, 20 nt, Homo sapiens
cgugccccgccuccccgaaa

SEQ ID NO: 758622 - RNA, 17 nt, Homo sapiens
cgugccgccugcuccuc

SEQ ID NO: 758623 - RNA, 15 nt, Homo sapiens
cgugccuguguccug

SEQ ID NO: 758624 - RNA, 23 nt, Homo sapiens
cgugcugguccccuccucaguga

SEQ ID NO: 758625 - RNA, 13 nt, Homo sapiens
cguggacucugca

SEQ ID NO: 758626 - RNA, 21 nt, Homo sapiens
cguggagacugagaucacuga

SEQ ID NO: 758627 - RNA, 20 nt, Homo sapiens
cguggaugcgcagugccuug

SEQ ID NO: 758628 - RNA, 23 nt, Homo sapiens
cguggauguauggggaaucuaag

SEQ ID NO: 758629 - RNA, 13 nt, Homo sapiens
cguggcauuucaa

SEQ ID NO: 758630 - RNA, 13 nt, Homo sapiens
cgugggcaucuca

SEQ ID NO: 758631 - RNA, 21 nt, Homo sapiens
cgugggcaucucaagccccaa

SEQ ID NO: 758632 - RNA, 22 nt, Homo sapiens
cgugggucacuacagggagaaa

SEQ ID NO: 758633 - RNA, 18 nt, Homo sapiens
cguggucuccuugcacuu

SEQ ID NO: 758634 - RNA, 19 nt, Homo sapiens
cgugguuuuuacauucaau

SEQ ID NO: 758635 - RNA, 14 nt, Homo sapiens
cguguggacugugc

SEQ ID NO: 758636 - RNA, 18 nt, Homo sapiens
cguguguguucacguguu

SEQ ID NO: 758637 - RNA, 23 nt, Homo sapiens
cguguucaaagagcaauauucca

SEQ ID NO: 758638 - RNA, 17 nt, Homo sapiens
cguguuuggagcucuau

SEQ ID NO: 758639 - RNA, 23 nt, Homo sapiens
cguuaguguauuuuauguguggc

SEQ ID NO: 758640 - RNA, 15 nt, Homo sapiens
cguucaucaccugcu

SEQ ID NO: 758641 - RNA, 22 nt, Homo sapiens
cguugacaaguuuuguggggcu

SEQ ID NO: 758642 - RNA, 19 nt, Homo sapiens
cguuuaaucccagcacuuu

SEQ ID NO: 758643 - RNA, 21 nt, Homo sapiens
cguuucccagagucaucugau

SEQ ID NO: 758644 - RNA, 23 nt, Homo sapiens
cguuuccugagaagugucuaaaa

SEQ ID NO: 758645 - RNA, 21 nt, Homo sapiens
cguuugagaagaaaacaucua

SEQ ID NO: 758646 - RNA, 13 nt, Homo sapiens
cguuuuauuccag

SEQ ID NO: 758647 - RNA, 13 nt, Homo sapiens
cguuuuugcaaua

SEQ ID NO: 758648 - RNA, 14 nt, Homo sapiens
cuaaaaaacagagg

SEQ ID NO: 758649 - RNA, 22 nt, Homo sapiens
cuaaaaaacagaggccauggca

SEQ ID NO: 758650 - RNA, 17 nt, Homo sapiens
cuaaaaagaagccacag

SEQ ID NO: 758651 - RNA, 13 nt, Homo sapiens
cuaaaaauacaaa

SEQ ID NO: 758652 - RNA, 15 nt, Homo sapiens
cuaaaaaucugagaa

SEQ ID NO: 758653 - RNA, 18 nt, Homo sapiens
cuaaaaaugaaaauucua

SEQ ID NO: 758654 - RNA, 12 nt, Homo sapiens
cuaaaacuuaac

SEQ ID NO: 758655 - RNA, 18 nt, Homo sapiens
cuaaaacuuaacauucau

SEQ ID NO: 758656 - RNA, 18 nt, Homo sapiens
cuaaaagaaaaaggaacu

SEQ ID NO: 758657 - RNA, 16 nt, Homo sapiens
cuaaaaggaaaagguu

SEQ ID NO: 758658 - RNA, 17 nt, Homo sapiens
cuaaaaggaaaucucac

SEQ ID NO: 758659 - RNA, 16 nt, Homo sapiens
cuaaaagguaugcaau

SEQ ID NO: 758660 - RNA, 13 nt, Homo sapiens
cuaaaaguacaaa

SEQ ID NO: 758661 - RNA, 13 nt, Homo sapiens
cuaaaauguauuu

SEQ ID NO: 758662 - RNA, 14 nt, Homo sapiens
cuaaaauuaaguau

SEQ ID NO: 758663 - RNA, 23 nt, Homo sapiens
cuaaaauuauuauauauacaugg

SEQ ID NO: 758664 - RNA, 17 nt, Homo sapiens
cuaaacaacuaccuccu

SEQ ID NO: 758665 - RNA, 14 nt, Homo sapiens
cuaaacagauauaa

SEQ ID NO: 758666 - RNA, 19 nt, Homo sapiens
cuaaaccaguccuuagcaa

SEQ ID NO: 758667 - RNA, 21 nt, Homo sapiens
cuaaagaauguguucuaaaac

SEQ ID NO: 758668 - RNA, 19 nt, Homo sapiens
cuaaagacaauucauucau

SEQ ID NO: 758669 - RNA, 21 nt, Homo sapiens
cuaaagacccuaaaucugagg

SEQ ID NO: 758670 - RNA, 18 nt, Homo sapiens
cuaaagagagaugaacca

SEQ ID NO: 758671 - RNA, 22 nt, Homo sapiens
cuaaagagagugagcaugagcu

SEQ ID NO: 758672 - RNA, 17 nt, Homo sapiens
cuaaagagugaaugcca

SEQ ID NO: 758673 - RNA, 22 nt, Homo sapiens
cuaaagcagccagccgugagug

SEQ ID NO: 758674 - RNA, 18 nt, Homo sapiens
cuaaagcuauguuacaug

SEQ ID NO: 758675 - RNA, 22 nt, Homo sapiens
cuaaagcuuuaggaugacugua

SEQ ID NO: 758676 - RNA, 17 nt, Homo sapiens
cuaaagcuuuggacaag

SEQ ID NO: 758677 - RNA, 20 nt, Homo sapiens
cuaaaggaaaaaacuuugac

SEQ ID NO: 758678 - RNA, 14 nt, Homo sapiens
cuaaaggacuaaca

SEQ ID NO: 758679 - RNA, 20 nt, Homo sapiens
cuaaagguccacaggucuag

SEQ ID NO: 758680 - RNA, 21 nt, Homo sapiens
cuaaagguggugaggcaauaa

SEQ ID NO: 758681 - RNA, 22 nt, Homo sapiens
cuaaagguuuuaaccgcacaug

SEQ ID NO: 758682 - RNA, 16 nt, Homo sapiens
cuaaaguauacaacug

SEQ ID NO: 758683 - RNA, 16 nt, Homo sapiens
cuaaaguaucuguauu

SEQ ID NO: 758684 - RNA, 20 nt, Homo sapiens
cuaaaguuacaaacagacca

SEQ ID NO: 758685 - RNA, 21 nt, Homo sapiens
cuaaauaaauguaauagccaa

SEQ ID NO: 758686 - RNA, 20 nt, Homo sapiens
cuaaauaaauuucccaguua

SEQ ID NO: 758687 - RNA, 21 nt, Homo sapiens
cuaaauaauguuaucugugua

SEQ ID NO: 758688 - RNA, 18 nt, Homo sapiens
cuaaauacaacacugaua

SEQ ID NO: 758689 - RNA, 15 nt, Homo sapiens
cuaaaucaaucugca

SEQ ID NO: 758690 - RNA, 13 nt, Homo sapiens
cuaaauccaaaga

SEQ ID NO: 758691 - RNA, 18 nt, Homo sapiens
cuaaauccuuuacuguua

SEQ ID NO: 758692 - RNA, 16 nt, Homo sapiens
cuaaaugaacuaauga

SEQ ID NO: 758693 - RNA, 16 nt, Homo sapiens
cuaaaugagauacacu

SEQ ID NO: 758694 - RNA, 19 nt, Homo sapiens
cuaaaugagucacugagca

SEQ ID NO: 758695 - RNA, 16 nt, Homo sapiens
cuaaaugcagugaauu

SEQ ID NO: 758696 - RNA, 20 nt, Homo sapiens
cuaaauggguauuuguucaa

SEQ ID NO: 758697 - RNA, 23 nt, Homo sapiens
cuaaauguauuuuagacuuccug

SEQ ID NO: 758698 - RNA, 17 nt, Homo sapiens
cuaaauuuaaugcugcc

SEQ ID NO: 758699 - RNA, 22 nt, Homo sapiens
cuaaauuuuauaucuuguagcu

SEQ ID NO: 758700 - RNA, 16 nt, Homo sapiens
cuaaauuuucuaauua

SEQ ID NO: 758701 - RNA, 19 nt, Homo sapiens
cuaacaaagaacaagcauu

SEQ ID NO: 758702 - RNA, 12 nt, Homo sapiens
cuaacacaaaau

SEQ ID NO: 758703 - RNA, 14 nt, Homo sapiens
cuaacacauuucau

SEQ ID NO: 758704 - RNA, 14 nt, Homo sapiens
cuaacacggugcuc

SEQ ID NO: 758705 - RNA, 13 nt, Homo sapiens
cuaacacuggcau

SEQ ID NO: 758706 - RNA, 23 nt, Homo sapiens
cuaacauuuauuaagcacguauu

SEQ ID NO: 758707 - RNA, 22 nt, Homo sapiens
cuaacccaagacaugacauucu

SEQ ID NO: 758708 - RNA, 16 nt, Homo sapiens
cuaaccccuuccagau

SEQ ID NO: 758709 - RNA, 18 nt, Homo sapiens
cuaaccuugaaugcugcc

SEQ ID NO: 758710 - RNA, 18 nt, Homo sapiens
cuaacguccacuagcuua

SEQ ID NO: 758711 - RNA, 16 nt, Homo sapiens
cuaacuccugccauuc

SEQ ID NO: 758712 - RNA, 19 nt, Homo sapiens
cuaacugguuaaacauuaa

SEQ ID NO: 758713 - RNA, 19 nt, Homo sapiens
cuaacuuauccaucuuuga

SEQ ID NO: 758714 - RNA, 20 nt, Homo sapiens
cuaacuuauccaucuuugaa

SEQ ID NO: 758715 - RNA, 17 nt, Homo sapiens
cuaacuucaaggcccau

SEQ ID NO: 758716 - RNA, 13 nt, Homo sapiens
cuaagaaaaggca

SEQ ID NO: 758717 - RNA, 19 nt, Homo sapiens
cuaagaaauaugcacaaua

SEQ ID NO: 758718 - RNA, 18 nt, Homo sapiens
cuaagaaugcuuugccau

SEQ ID NO: 758719 - RNA, 17 nt, Homo sapiens
cuaagagaaacugugua

SEQ ID NO: 758720 - RNA, 19 nt, Homo sapiens
cuaagagacaguucucugu

SEQ ID NO: 758721 - RNA, 23 nt, Homo sapiens
cuaagagugucacugagcugugu

SEQ ID NO: 758722 - RNA, 17 nt, Homo sapiens
cuaagauaauuuacuua

SEQ ID NO: 758723 - RNA, 20 nt, Homo sapiens
cuaagaucucgguuugccaa

SEQ ID NO: 758724 - RNA, 19 nt, Homo sapiens
ccuuugcacagugguuaau

SEQ ID NO: 758725 - RNA, 19 nt, Homo sapiens
ccuuugccuuccaccccca

SEQ ID NO: 758726 - RNA, 16 nt, Homo sapiens
ccuuugcuucauucca

SEQ ID NO: 758727 - RNA, 18 nt, Homo sapiens
ccuuugggaggcugaggc

SEQ ID NO: 758728 - RNA, 16 nt, Homo sapiens
ccuuugugagucaaua

SEQ ID NO: 758729 - RNA, 18 nt, Homo sapiens
ccuuuguguauucaucuu

SEQ ID NO: 758730 - RNA, 13 nt, Homo sapiens
ccuuuguugucua

SEQ ID NO: 758731 - RNA, 14 nt, Homo sapiens
ccuuuuaaaaaccu

SEQ ID NO: 758732 - RNA, 14 nt, Homo sapiens
ccuuuuaacaccuu

SEQ ID NO: 758733 - RNA, 14 nt, Homo sapiens
ccuuuuaacugcca

SEQ ID NO: 758734 - RNA, 17 nt, Homo sapiens
ccuuuuacauacugcug

SEQ ID NO: 758735 - RNA, 14 nt, Homo sapiens
ccuuuuauaccugc

SEQ ID NO: 758736 - RNA, 23 nt, Homo sapiens
ccuuuuauuuuuuaagguaacaa

SEQ ID NO: 758737 - RNA, 13 nt, Homo sapiens
ccuuuucaugauu

SEQ ID NO: 758738 - RNA, 18 nt, Homo sapiens
ccuuuuccccagucccag

SEQ ID NO: 758739 - RNA, 17 nt, Homo sapiens
ccuuuuccuauccuuau

SEQ ID NO: 758740 - RNA, 22 nt, Homo sapiens
ccuuuucucacaaaaaggcaaa

SEQ ID NO: 758741 - RNA, 13 nt, Homo sapiens
ccuuuugaccaaa

SEQ ID NO: 758742 - RNA, 15 nt, Homo sapiens
ccuuuuguguaauaa

SEQ ID NO: 758743 - RNA, 15 nt, Homo sapiens
ccuuuuuaaaacaca

SEQ ID NO: 758744 - RNA, 22 nt, Homo sapiens
ccuuuuuauuuauauguacugu

SEQ ID NO: 758745 - RNA, 17 nt, Homo sapiens
ccuuuuuccauaguguu

SEQ ID NO: 758746 - RNA, 20 nt, Homo sapiens
ccuuuuugaaaguugccuuu

SEQ ID NO: 758747 - RNA, 15 nt, Homo sapiens
ccuuuuuguuauuag

SEQ ID NO: 758748 - RNA, 17 nt, Homo sapiens
ccuuuuuuauuccauaa

SEQ ID NO: 758749 - RNA, 18 nt, Homo sapiens
ccuuuuuuuacauuucau

SEQ ID NO: 758750 - RNA, 15 nt, Homo sapiens
ccuuuuuuucccaaa

SEQ ID NO: 758751 - RNA, 15 nt, Homo sapiens
cgaaaaggauaugca

SEQ ID NO: 758752 - RNA, 17 nt, Homo sapiens
cgaaaaggauaugcagu

SEQ ID NO: 758753 - RNA, 15 nt, Homo sapiens
cgaaaccccaucucu

SEQ ID NO: 758754 - RNA, 14 nt, Homo sapiens
cgaaaucaguuucu

SEQ ID NO: 758755 - RNA, 13 nt, Homo sapiens
cgaacagggacuu

SEQ ID NO: 758756 - RNA, 21 nt, Homo sapiens
cgaacuccuggccucaaguga

SEQ ID NO: 758757 - RNA, 24 nt, Homo sapiens
cgaagcucauucccaacgugcaaa

SEQ ID NO: 758758 - RNA, 15 nt, Homo sapiens
cgaaggauauuguca

SEQ ID NO: 758759 - RNA, 20 nt, Homo sapiens
cgaauguaauuggaaucuuc

SEQ ID NO: 758760 - RNA, 13 nt, Homo sapiens
cgacaaagccaaa

SEQ ID NO: 758761 - RNA, 22 nt, Homo sapiens
cgacaaagccaaacucugccag

SEQ ID NO: 758762 - RNA, 16 nt, Homo sapiens
cgacaacuuguaacuc

SEQ ID NO: 758763 - RNA, 18 nt, Homo sapiens
cgaccagaggagccuuuu

SEQ ID NO: 758764 - RNA, 13 nt, Homo sapiens
cgacggcugugac

SEQ ID NO: 758765 - RNA, 15 nt, Homo sapiens
cgacuacugcuccug

SEQ ID NO: 758766 - RNA, 21 nt, Homo sapiens
cgacuccugccugaguuucca

SEQ ID NO: 758767 - RNA, 17 nt, Homo sapiens
cgacuuagccugaguca

SEQ ID NO: 758768 - RNA, 17 nt, Homo sapiens
cgacuuuggaauuugca

SEQ ID NO: 758769 - RNA, 14 nt, Homo sapiens
cgagaacccugagc

SEQ ID NO: 758770 - RNA, 21 nt, Homo sapiens
cgagaucacgucacugcacuc

SEQ ID NO: 758771 - RNA, 21 nt, Homo sapiens
cgagaucgcgccacugcacuc

SEQ ID NO: 758772 - RNA, 21 nt, Homo sapiens
cgagauggcgcuauugcacuc

SEQ ID NO: 758773 - RNA, 19 nt, Homo sapiens
cgagcaccuccagccugaa

SEQ ID NO: 758774 - RNA, 16 nt, Homo sapiens
cgagcacugaacuuug

SEQ ID NO: 758775 - RNA, 22 nt, Homo sapiens
cgagcuaugaucgcgccacuac

SEQ ID NO: 758776 - RNA, 20 nt, Homo sapiens
cgagcuguuaccauucacaa

SEQ ID NO: 758777 - RNA, 23 nt, Homo sapiens
cgaggaaaagagaaggaaaguga

SEQ ID NO: 758778 - RNA, 16 nt, Homo sapiens
cgaggaacucgccuca

SEQ ID NO: 758779 - RNA, 22 nt, Homo sapiens
cgaggacuacaaccaauuuaca

SEQ ID NO: 758780 - RNA, 17 nt, Homo sapiens
cgaggaggcauucuucu

SEQ ID NO: 758781 - RNA, 12 nt, Homo sapiens
cgaggccugaag

SEQ ID NO: 758782 - RNA, 16 nt, Homo sapiens
cgaggcgcucaucagg

SEQ ID NO: 758783 - RNA, 21 nt, Homo sapiens
cgaggcugagaaucagacuga

SEQ ID NO: 758784 - RNA, 23 nt, Homo sapiens
cgagggcugauggaggaaaaagg

SEQ ID NO: 758785 - RNA, 14 nt, Homo sapiens
cgaggucaggagau

SEQ ID NO: 758786 - RNA, 20 nt, Homo sapiens
cgaggucuugugauauugcc

SEQ ID NO: 758787 - RNA, 14 nt, Homo sapiens
cgaguaacuccccu

SEQ ID NO: 758788 - RNA, 19 nt, Homo sapiens
cgaguaacuccccucaggg

SEQ ID NO: 758789 - RNA, 15 nt, Homo sapiens
cgagucacacucaag

SEQ ID NO: 758790 - RNA, 15 nt, Homo sapiens
cgagucauggcuaau

SEQ ID NO: 758791 - RNA, 23 nt, Homo sapiens
cgagucuugcucuucaaugcuac

SEQ ID NO: 758792 - RNA, 18 nt, Homo sapiens
cgaguuuucccucaguga

SEQ ID NO: 758793 - RNA, 12 nt, Homo sapiens
cgauaaagggau

SEQ ID NO: 758794 - RNA, 22 nt, Homo sapiens
cgauauacauuuauuuacacuc

SEQ ID NO: 758795 - RNA, 21 nt, Homo sapiens
cgaucaaguuguugacuguga

SEQ ID NO: 758796 - RNA, 22 nt, Homo sapiens
cgaucaaguuguugacugugau

SEQ ID NO: 758797 - RNA, 11 nt, Homo sapiens
cgauccuuaau

SEQ ID NO: 758798 - RNA, 13 nt, Homo sapiens
cgaucucagcuca

SEQ ID NO: 758799 - RNA, 16 nt, Homo sapiens
cgaucuccugaccucg

SEQ ID NO: 758800 - RNA, 20 nt, Homo sapiens
cgaugagauaauaugagauu

SEQ ID NO: 758801 - RNA, 22 nt, Homo sapiens
cgaugagauaauaugagauuuc

SEQ ID NO: 758802 - RNA, 23 nt, Homo sapiens
cgaugauguacagauucuuucag

SEQ ID NO: 758803 - RNA, 16 nt, Homo sapiens
cgaugcaaacauugga

SEQ ID NO: 758804 - RNA, 21 nt, Homo sapiens
cgauguuauuagauguuacaa

SEQ ID NO: 758805 - RNA, 20 nt, Homo sapiens
cgauucaucuacccugcuga

SEQ ID NO: 758806 - RNA, 21 nt, Homo sapiens
cgcaacccacguguaacuguc

SEQ ID NO: 758807 - RNA, 15 nt, Homo sapiens
cgcacaagccagacc

SEQ ID NO: 758808 - RNA, 21 nt, Homo sapiens
cgcacaaggcugaccaagaga

SEQ ID NO: 758809 - RNA, 16 nt, Homo sapiens
cgcaccacuguguauu

SEQ ID NO: 758810 - RNA, 14 nt, Homo sapiens
cgcaccauucuccu

SEQ ID NO: 758811 - RNA, 20 nt, Homo sapiens
cgcaccauucuccugccuca

SEQ ID NO: 758812 - RNA, 12 nt, Homo sapiens
cgcacccggcuc

SEQ ID NO: 758813 - RNA, 13 nt, Homo sapiens
cgcacgcacacac

SEQ ID NO: 758814 - RNA, 15 nt, Homo sapiens
cgcacuggagcugca

SEQ ID NO: 758815 - RNA, 17 nt, Homo sapiens
cgcaggcccggacucac

SEQ ID NO: 758816 - RNA, 16 nt, Homo sapiens
cgcaucaggccuggca

SEQ ID NO: 758817 - RNA, 16 nt, Homo sapiens
cgcaugugugcugcag

SEQ ID NO: 758818 - RNA, 19 nt, Homo sapiens
cgcauugagccaguggugc

SEQ ID NO: 758819 - RNA, 21 nt, Homo sapiens
cgcauugccacggaaacauac

SEQ ID NO: 758820 - RNA, 23 nt, Homo sapiens
cgcauuuuugacagguugcugaa

SEQ ID NO: 758821 - RNA, 16 nt, Homo sapiens
cgccacggccuggcug

SEQ ID NO: 758822 - RNA, 15 nt, Homo sapiens
cgccagcagcuguca

SEQ ID NO: 758823 - RNA, 15 nt, Homo sapiens
cgccagcucaguuuc

SEQ ID NO: 758824 - RNA, 18 nt, Homo sapiens
cgccaugaucagacauac

SEQ ID NO: 758825 - RNA, 18 nt, Homo sapiens
cgcccaaaagauugaacu

SEQ ID NO: 758826 - RNA, 15 nt, Homo sapiens
ccugcggcccagaag

SEQ ID NO: 758827 - RNA, 18 nt, Homo sapiens
ccugcgugggggccaguc

SEQ ID NO: 758828 - RNA, 12 nt, Homo sapiens
ccugcuaccugu

SEQ ID NO: 758829 - RNA, 14 nt, Homo sapiens
ccugcucaccugug

SEQ ID NO: 758830 - RNA, 24 nt, Homo sapiens
ccugcucagcccugcaccaugcug

SEQ ID NO: 758831 - RNA, 19 nt, Homo sapiens
ccugcucaucauauuccaa

SEQ ID NO: 758832 - RNA, 17 nt, Homo sapiens
ccugcucccagguugag

SEQ ID NO: 758833 - RNA, 18 nt, Homo sapiens
ccugcugaacacaguguc

SEQ ID NO: 758834 - RNA, 20 nt, Homo sapiens
ccugcugaggcagugugguu

SEQ ID NO: 758835 - RNA, 23 nt, Homo sapiens
ccugcugagggaccagccaagag

SEQ ID NO: 758836 - RNA, 17 nt, Homo sapiens
ccugcugcaaagccuuu

SEQ ID NO: 758837 - RNA, 18 nt, Homo sapiens
ccugcugcccagugcaaa

SEQ ID NO: 758838 - RNA, 16 nt, Homo sapiens
ccugcugccccagcug

SEQ ID NO: 758839 - RNA, 10 nt, Homo sapiens
ccugcuggag

SEQ ID NO: 758840 - RNA, 12 nt, Homo sapiens
ccuuaagccagg

SEQ ID NO: 758841 - RNA, 15 nt, Homo sapiens
ccuuaauauguuaac

SEQ ID NO: 758842 - RNA, 13 nt, Homo sapiens
ccuuaauauugag

SEQ ID NO: 758843 - RNA, 21 nt, Homo sapiens
ccuuacaacgccgagugcacu

SEQ ID NO: 758844 - RNA, 16 nt, Homo sapiens
ccuuacaaguuagaaa

SEQ ID NO: 758845 - RNA, 22 nt, Homo sapiens
ccuuaccacgcaguaacuaaag

SEQ ID NO: 758846 - RNA, 14 nt, Homo sapiens
ccuuaccgcucugu

SEQ ID NO: 758847 - RNA, 22 nt, Homo sapiens
ccuuacgcuuugucacacaaaa

SEQ ID NO: 758848 - RNA, 11 nt, Homo sapiens
ccuuacucuga

SEQ ID NO: 758849 - RNA, 22 nt, Homo sapiens
ccuuacuggcuuaccuccucau

SEQ ID NO: 758850 - RNA, 18 nt, Homo sapiens
ccuuagcccugucugcua

SEQ ID NO: 758851 - RNA, 23 nt, Homo sapiens
ccuuaggcuuuguaugacaguga

SEQ ID NO: 758852 - RNA, 15 nt, Homo sapiens
ccuuagucucaaggg

SEQ ID NO: 758853 - RNA, 17 nt, Homo sapiens
ccuuauccuaaugaugc

SEQ ID NO: 758854 - RNA, 14 nt, Homo sapiens
ccuuaucugucaca

SEQ ID NO: 758855 - RNA, 12 nt, Homo sapiens
ccuuaugacucc

SEQ ID NO: 758856 - RNA, 18 nt, Homo sapiens
ccuuauucuacaucauua

SEQ ID NO: 758857 - RNA, 21 nt, Homo sapiens
ccuuauuguaccucucuuaua

SEQ ID NO: 758858 - RNA, 23 nt, Homo sapiens
ccuuauuuugugugcuuucccag

SEQ ID NO: 758859 - RNA, 14 nt, Homo sapiens
ccuucaaaacacuc

SEQ ID NO: 758860 - RNA, 15 nt, Homo sapiens
ccuucaaaacacuca

SEQ ID NO: 758861 - RNA, 18 nt, Homo sapiens
ccuucaagguggcagcug

SEQ ID NO: 758862 - RNA, 13 nt, Homo sapiens
ccuucaagugcca

SEQ ID NO: 758863 - RNA, 19 nt, Homo sapiens
ccuucaaguuagcucagga

SEQ ID NO: 758864 - RNA, 15 nt, Homo sapiens
ccuucacaaauguca

SEQ ID NO: 758865 - RNA, 16 nt, Homo sapiens
ccuucacaaucuguca

SEQ ID NO: 758866 - RNA, 20 nt, Homo sapiens
ccuucacuggcgccuucucg

SEQ ID NO: 758867 - RNA, 15 nt, Homo sapiens
ccuucacugugcucc

SEQ ID NO: 758868 - RNA, 19 nt, Homo sapiens
ccuucacugugcuccaacc

SEQ ID NO: 758869 - RNA, 12 nt, Homo sapiens
ccuucacuuuac

SEQ ID NO: 758870 - RNA, 21 nt, Homo sapiens
ccuucacuuuucugaguucuu

SEQ ID NO: 758871 - RNA, 16 nt, Homo sapiens
ccuucagacacccuca

SEQ ID NO: 758872 - RNA, 13 nt, Homo sapiens
ccuucagagccag

SEQ ID NO: 758873 - RNA, 15 nt, Homo sapiens
ccuucagcaccugac

SEQ ID NO: 758874 - RNA, 16 nt, Homo sapiens
ccuucagcgauuauuu

SEQ ID NO: 758875 - RNA, 17 nt, Homo sapiens
ccuucagcuccagggaa

SEQ ID NO: 758876 - RNA, 22 nt, Homo sapiens
ccuucaggguuuaauagacuga

SEQ ID NO: 758877 - RNA, 23 nt, Homo sapiens
ccuucagucacaugcuagcagcu

SEQ ID NO: 758878 - RNA, 15 nt, Homo sapiens
ccuucagucugcucc

SEQ ID NO: 758879 - RNA, 10 nt, Homo sapiens
ccuucaguga

SEQ ID NO: 758880 - RNA, 17 nt, Homo sapiens
ccuucaguuuauuucca

SEQ ID NO: 758881 - RNA, 12 nt, Homo sapiens
ccuucaucggcc

SEQ ID NO: 758882 - RNA, 14 nt, Homo sapiens
ccuucauugccaca

SEQ ID NO: 758883 - RNA, 14 nt, Homo sapiens
ccuuccacagugaa

SEQ ID NO: 758884 - RNA, 19 nt, Homo sapiens
ccuuccacggauccaugua

SEQ ID NO: 758885 - RNA, 21 nt, Homo sapiens
ccuuccagcacccugcaaaau

SEQ ID NO: 758886 - RNA, 16 nt, Homo sapiens
ccuuccaucuucacac

SEQ ID NO: 758887 - RNA, 19 nt, Homo sapiens
ccuucccaauaggugaucu

SEQ ID NO: 758888 - RNA, 21 nt, Homo sapiens
ccuuccccagacuugcacugg

SEQ ID NO: 758889 - RNA, 15 nt, Homo sapiens
ccuuccccagccucu

SEQ ID NO: 758890 - RNA, 20 nt, Homo sapiens
ccuuccccagccucuucuag

SEQ ID NO: 758891 - RNA, 17 nt, Homo sapiens
ccuuccuaaacccaaug

SEQ ID NO: 758892 - RNA, 18 nt, Homo sapiens
ccuuccuaauaugcuuua

SEQ ID NO: 758893 - RNA, 19 nt, Homo sapiens
ccuuccucagaacuuucua

SEQ ID NO: 758894 - RNA, 23 nt, Homo sapiens
ccuuccugauuguuuacagucau

SEQ ID NO: 758895 - RNA, 15 nt, Homo sapiens
ccuuccugcugcugc

SEQ ID NO: 758896 - RNA, 18 nt, Homo sapiens
ccuucggagccaacaaga

SEQ ID NO: 758897 - RNA, 14 nt, Homo sapiens
ccuucucuacccau

SEQ ID NO: 758898 - RNA, 14 nt, Homo sapiens
ccuucucucaucuc

SEQ ID NO: 758899 - RNA, 20 nt, Homo sapiens
ccuucucugcuccaccacau

SEQ ID NO: 758900 - RNA, 17 nt, Homo sapiens
ccuucucugugcaguag

SEQ ID NO: 758901 - RNA, 16 nt, Homo sapiens
ccuucuggauccaugg

SEQ ID NO: 758902 - RNA, 19 nt, Homo sapiens
ccuucuguggcuuggagau

SEQ ID NO: 758903 - RNA, 13 nt, Homo sapiens
ccuugaaccaaua

SEQ ID NO: 758904 - RNA, 13 nt, Homo sapiens
ccuugaagccacu

SEQ ID NO: 758905 - RNA, 14 nt, Homo sapiens
ccuugaccaagaag

SEQ ID NO: 758906 - RNA, 14 nt, Homo sapiens
ccuugacuaaauuc

SEQ ID NO: 758907 - RNA, 11 nt, Homo sapiens
ccuugagaaac

SEQ ID NO: 758908 - RNA, 16 nt, Homo sapiens
ccuugagaagugggag

SEQ ID NO: 758909 - RNA, 17 nt, Homo sapiens
ccuugagagacccagcu

SEQ ID NO: 758910 - RNA, 20 nt, Homo sapiens
ccuugagugcucuugcuauu

SEQ ID NO: 758911 - RNA, 23 nt, Homo sapiens
ccuugcaagguuaagcaaggugg

SEQ ID NO: 758912 - RNA, 21 nt, Homo sapiens
ccuugcaaucuucuacuuuaa

SEQ ID NO: 758913 - RNA, 18 nt, Homo sapiens
ccuugcccccauuucacc

SEQ ID NO: 758914 - RNA, 19 nt, Homo sapiens
ccuugccucaaugccagua

SEQ ID NO: 758915 - RNA, 12 nt, Homo sapiens
ccuugccuuaau

SEQ ID NO: 758916 - RNA, 20 nt, Homo sapiens
ccuugcucuccucaucucca

SEQ ID NO: 758917 - RNA, 21 nt, Homo sapiens
ccuugcugccgucaccucucc

SEQ ID NO: 758918 - RNA, 21 nt, Homo sapiens
ccuuggaaaucugccaugagc

SEQ ID NO: 758919 - RNA, 14 nt, Homo sapiens
ccuuggcagaggca

SEQ ID NO: 758920 - RNA, 23 nt, Homo sapiens
ccuuggccucccaaagugcuagu

SEQ ID NO: 758921 - RNA, 17 nt, Homo sapiens
ccuuggcuucugugaug

SEQ ID NO: 758922 - RNA, 11 nt, Homo sapiens
ccuuggcuuua

SEQ ID NO: 758923 - RNA, 17 nt, Homo sapiens
ccuuggcuuuaugcaaa

SEQ ID NO: 758924 - RNA, 23 nt, Homo sapiens
ccuugggcacuuuuuaauucacc

SEQ ID NO: 758925 - RNA, 19 nt, Homo sapiens
ccuuggggcucagccacag

SEQ ID NO: 758926 - RNA, 18 nt, Homo sapiens
ccuuggucccaagccuga

SEQ ID NO: 758927 - RNA, 13 nt, Homo sapiens
ccuugucaucucu

SEQ ID NO: 758928 - RNA, 12 nt, Homo sapiens
ccuugucugcua

SEQ ID NO: 758929 - RNA, 21 nt, Homo sapiens
ccuuguguuuaggaucaucuc

SEQ ID NO: 758930 - RNA, 20 nt, Homo sapiens
ccuuguucaauaauuacugu

SEQ ID NO: 758931 - RNA, 22 nt, Homo sapiens
ccuuguucccuaggggacacuu

SEQ ID NO: 758932 - RNA, 14 nt, Homo sapiens
ccuuguugcagaug

SEQ ID NO: 758933 - RNA, 20 nt, Homo sapiens
ccuuguuguguuucuaucuc

SEQ ID NO: 758934 - RNA, 20 nt, Homo sapiens
ccuuuagaaacucaaaaacu

SEQ ID NO: 758935 - RNA, 16 nt, Homo sapiens
ccuuuagaaccuuaaa

SEQ ID NO: 758936 - RNA, 21 nt, Homo sapiens
ccuuuauaauauuucagugga

SEQ ID NO: 758937 - RNA, 14 nt, Homo sapiens
ccuuuaucaccuca

SEQ ID NO: 758938 - RNA, 19 nt, Homo sapiens
ccuuuauguggaaaacaga

SEQ ID NO: 758939 - RNA, 15 nt, Homo sapiens
ccuuucacacuggau

SEQ ID NO: 758940 - RNA, 20 nt, Homo sapiens
ccuuucagucauugucuuau

SEQ ID NO: 758941 - RNA, 17 nt, Homo sapiens
ccuuucagugcaguuuc

SEQ ID NO: 758942 - RNA, 15 nt, Homo sapiens
ccauuaucuauuuaa

SEQ ID NO: 758943 - RNA, 21 nt, Homo sapiens
ccauuauuauuucuguucuua

SEQ ID NO: 758944 - RNA, 15 nt, Homo sapiens
ccauucaacucggaa

SEQ ID NO: 758945 - RNA, 13 nt, Homo sapiens
ccauucacaccag

SEQ ID NO: 758946 - RNA, 14 nt, Homo sapiens
ccauucacagagcc

SEQ ID NO: 758947 - RNA, 15 nt, Homo sapiens
ccauucagagacugu

SEQ ID NO: 758948 - RNA, 20 nt, Homo sapiens
ccauucagagcuauggugcu

SEQ ID NO: 758949 - RNA, 15 nt, Homo sapiens
ccauucagaugaaua

SEQ ID NO: 758950 - RNA, 21 nt, Homo sapiens
ccauucauaaggauucaggga

SEQ ID NO: 758951 - RNA, 21 nt, Homo sapiens
ccauucauacccacacaccca

SEQ ID NO: 758952 - RNA, 22 nt, Homo sapiens
ccauucauauuaagacagugua

SEQ ID NO: 758953 - RNA, 18 nt, Homo sapiens
ccauucccagauguacca

SEQ ID NO: 758954 - RNA, 15 nt, Homo sapiens
ccauucccguggucu

SEQ ID NO: 758955 - RNA, 22 nt, Homo sapiens
ccauucccugccuugcugacaa

SEQ ID NO: 758956 - RNA, 18 nt, Homo sapiens
ccauuccucagcuucuuc

SEQ ID NO: 758957 - RNA, 10 nt, Homo sapiens
ccauuccucu

SEQ ID NO: 758958 - RNA, 21 nt, Homo sapiens
ccauucuacauacuauggaau

SEQ ID NO: 758959 - RNA, 11 nt, Homo sapiens
ccauucucuga

SEQ ID NO: 758960 - RNA, 19 nt, Homo sapiens
ccauucugccgcccccucc

SEQ ID NO: 758961 - RNA, 17 nt, Homo sapiens
ccauucugugugugacu

SEQ ID NO: 758962 - RNA, 12 nt, Homo sapiens
ccauugaacuca

SEQ ID NO: 758963 - RNA, 19 nt, Homo sapiens
ccauugaccucagcugcac

SEQ ID NO: 758964 - RNA, 15 nt, Homo sapiens
accugggcaugacau

SEQ ID NO: 758965 - RNA, 17 nt, Homo sapiens
accuggggacucgggug

SEQ ID NO: 758966 - RNA, 16 nt, Homo sapiens
accuggggaugaagcu

SEQ ID NO: 758967 - RNA, 15 nt, Homo sapiens
accugguaccuggac

SEQ ID NO: 758968 - RNA, 21 nt, Homo sapiens
accugguagaucaagcauuac

SEQ ID NO: 758969 - RNA, 16 nt, Homo sapiens
accuguaaucauauaa

SEQ ID NO: 758970 - RNA, 20 nt, Homo sapiens
accuguaaucccagcacuuu

SEQ ID NO: 758971 - RNA, 24 nt, Homo sapiens
accuguacauucuuccaucaucac

SEQ ID NO: 758972 - RNA, 16 nt, Homo sapiens
accuguagucccagcu

SEQ ID NO: 758973 - RNA, 22 nt, Homo sapiens
accuguagucccagcuacucag

SEQ ID NO: 758974 - RNA, 19 nt, Homo sapiens
accuguagucccaguuacu

SEQ ID NO: 758975 - RNA, 13 nt, Homo sapiens
accuguagugaga

SEQ ID NO: 758976 - RNA, 21 nt, Homo sapiens
accugucaucauggaggucau

SEQ ID NO: 758977 - RNA, 17 nt, Homo sapiens
accuguccccacccucc

SEQ ID NO: 758978 - RNA, 14 nt, Homo sapiens
accuguccuugcac

SEQ ID NO: 758979 - RNA, 16 nt, Homo sapiens
accuguccuugcacac

SEQ ID NO: 758980 - RNA, 22 nt, Homo sapiens
accugugacuaaacaacuaccu

SEQ ID NO: 758981 - RNA, 21 nt, Homo sapiens
accugugagcauccuucccag

SEQ ID NO: 758982 - RNA, 17 nt, Homo sapiens
accugugcccucaccac

SEQ ID NO: 758983 - RNA, 14 nt, Homo sapiens
accuguggugaccc

SEQ ID NO: 758984 - RNA, 21 nt, Homo sapiens
accuguguccccgaugcugac

SEQ ID NO: 758985 - RNA, 14 nt, Homo sapiens
accugugugcuugg

SEQ ID NO: 758986 - RNA, 15 nt, Homo sapiens
accuguucucuuuaa

SEQ ID NO: 758987 - RNA, 11 nt, Homo sapiens
accuguugaag

SEQ ID NO: 758988 - RNA, 19 nt, Homo sapiens
accuguugguuagauucaa

SEQ ID NO: 758989 - RNA, 15 nt, Homo sapiens
accuuaagacagagu

SEQ ID NO: 758990 - RNA, 12 nt, Homo sapiens
accuuacaggga

SEQ ID NO: 758991 - RNA, 13 nt, Homo sapiens
accuuagaauaca

SEQ ID NO: 758992 - RNA, 20 nt, Homo sapiens
accuuagagcaaccucugua

SEQ ID NO: 758993 - RNA, 21 nt, Homo sapiens
accuuauaguguuaauaucuu

SEQ ID NO: 758994 - RNA, 16 nt, Homo sapiens
accuuauucuacauca

SEQ ID NO: 758995 - RNA, 22 nt, Homo sapiens
accuucaaaauguucuauuuaa

SEQ ID NO: 758996 - RNA, 16 nt, Homo sapiens
accuucaagaucucau

SEQ ID NO: 758997 - RNA, 15 nt, Homo sapiens
accuucagagccagc

SEQ ID NO: 758998 - RNA, 18 nt, Homo sapiens
accuucaggcagccagug

SEQ ID NO: 758999 - RNA, 21 nt, Homo sapiens
accuucaggcagccaguguga

SEQ ID NO: 759000 - RNA, 16 nt, Homo sapiens
accuuccacucuggaa

SEQ ID NO: 759001 - RNA, 16 nt, Homo sapiens
accuuccgacauccca

SEQ ID NO: 759002 - RNA, 19 nt, Homo sapiens
accuuccuuaagccaggaa

SEQ ID NO: 759003 - RNA, 23 nt, Homo sapiens
accuuccuucccugggcugugcu

SEQ ID NO: 759004 - RNA, 16 nt, Homo sapiens
accuucguccuuuuaa

SEQ ID NO: 759005 - RNA, 15 nt, Homo sapiens
accuucuaaaagcca

SEQ ID NO: 759006 - RNA, 20 nt, Homo sapiens
accuucugggggaaagggaa

SEQ ID NO: 759007 - RNA, 20 nt, Homo sapiens
accuucuucuccuacauauc

SEQ ID NO: 759008 - RNA, 11 nt, Homo sapiens
accuugaacug

SEQ ID NO: 759009 - RNA, 15 nt, Homo sapiens
accuugaaugcugcc

SEQ ID NO: 759010 - RNA, 22 nt, Homo sapiens
accuugacuugauuagugccuu

SEQ ID NO: 759011 - RNA, 14 nt, Homo sapiens
accuugcaauguuc

SEQ ID NO: 759012 - RNA, 23 nt, Homo sapiens
accuuggaagggcguucuaggua

SEQ ID NO: 759013 - RNA, 17 nt, Homo sapiens
accuugggggaagacuu

SEQ ID NO: 759014 - RNA, 13 nt, Homo sapiens
accuugugccugg

SEQ ID NO: 759015 - RNA, 17 nt, Homo sapiens
accuugugucuguacac

SEQ ID NO: 759016 - RNA, 23 nt, Homo sapiens
accuuucacaagggcaaacuuuu

SEQ ID NO: 759017 - RNA, 17 nt, Homo sapiens
accuuucacccucauga

SEQ ID NO: 759018 - RNA, 21 nt, Homo sapiens
accuuucacgaacaugggcau

SEQ ID NO: 759019 - RNA, 13 nt, Homo sapiens
accuuuccagcca

SEQ ID NO: 759020 - RNA, 15 nt, Homo sapiens
accuuugcugaugcc

SEQ ID NO: 759021 - RNA, 19 nt, Homo sapiens
accuuuggaagucaugagc

SEQ ID NO: 759022 - RNA, 15 nt, Homo sapiens
accuuuggagcaaag

SEQ ID NO: 759023 - RNA, 17 nt, Homo sapiens
accuuuggagcaaagcu

SEQ ID NO: 759024 - RNA, 22 nt, Homo sapiens
accuuuuauacuuuugaccaaa

SEQ ID NO: 759025 - RNA, 19 nt, Homo sapiens
acgaagaguucccuugaaa

SEQ ID NO: 759026 - RNA, 22 nt, Homo sapiens
acgaagccuuauuucuagaagc

SEQ ID NO: 759027 - RNA, 22 nt, Homo sapiens
acgaauauagaggguuuugcuc

SEQ ID NO: 759028 - RNA, 17 nt, Homo sapiens
acgaauuccaucuugua

SEQ ID NO: 759029 - RNA, 22 nt, Homo sapiens
acgacaagauuuucuacuuuuu

SEQ ID NO: 759030 - RNA, 18 nt, Homo sapiens
acgacaagugcugaacag

SEQ ID NO: 759031 - RNA, 19 nt, Homo sapiens
acgacgucagccucuuacc

SEQ ID NO: 759032 - RNA, 14 nt, Homo sapiens
acgagcacgagcug

SEQ ID NO: 759033 - RNA, 22 nt, Homo sapiens
acgagcaggcuacugucagcuc

SEQ ID NO: 759034 - RNA, 13 nt, Homo sapiens
acgagguggcagu

SEQ ID NO: 759035 - RNA, 13 nt, Homo sapiens
acgauaaagggau

SEQ ID NO: 759036 - RNA, 13 nt, Homo sapiens
acgaugcauuuaa

SEQ ID NO: 759037 - RNA, 21 nt, Homo sapiens
acgauguucuguacaacuuaa

SEQ ID NO: 759038 - RNA, 18 nt, Homo sapiens
acgauuccgccacacauc

SEQ ID NO: 759039 - RNA, 15 nt, Homo sapiens
acgcagaccaacaga

SEQ ID NO: 759040 - RNA, 20 nt, Homo sapiens
acgcagacccaguacauccu

SEQ ID NO: 759041 - RNA, 13 nt, Homo sapiens
acgcaguaacuaa

SEQ ID NO: 759042 - RNA, 23 nt, Homo sapiens
acgcagucauggaggccaagaac

SEQ ID NO: 759043 - RNA, 19 nt, Homo sapiens
acgcagucugcuucagugc

SEQ ID NO: 759044 - RNA, 13 nt, Homo sapiens
acgcaugcagugu

SEQ ID NO: 759045 - RNA, 16 nt, Homo sapiens
acgcaugugugcugca

SEQ ID NO: 759046 - RNA, 21 nt, Homo sapiens
acgcccuugagcuacuucaaa

SEQ ID NO: 759047 - RNA, 22 nt, Homo sapiens
acgccuacuuaagagugcugug

SEQ ID NO: 759048 - RNA, 21 nt, Homo sapiens
acgccucacugaaacauggcu

SEQ ID NO: 759049 - RNA, 21 nt, Homo sapiens
acgccuguaaucccagcacuu

SEQ ID NO: 759050 - RNA, 14 nt, Homo sapiens
acgccuuguuccug

SEQ ID NO: 759051 - RNA, 15 nt, Homo sapiens
agcagcugguggaag

SEQ ID NO: 759052 - RNA, 14 nt, Homo sapiens
agcagcuuuaaaca

SEQ ID NO: 759053 - RNA, 22 nt, Homo sapiens
agcagcuuuagccaagugcagg

SEQ ID NO: 759054 - RNA, 18 nt, Homo sapiens
agcaggagagacugagca

SEQ ID NO: 759055 - RNA, 14 nt, Homo sapiens
agcaggagcagcug

SEQ ID NO: 759056 - RNA, 19 nt, Homo sapiens
agcaggagcagcugugcug

SEQ ID NO: 759057 - RNA, 21 nt, Homo sapiens
agcaggagcagcugugcugca

SEQ ID NO: 759058 - RNA, 17 nt, Homo sapiens
agcaggaggaguggaag

SEQ ID NO: 759059 - RNA, 12 nt, Homo sapiens
agcaggccacug

SEQ ID NO: 759060 - RNA, 15 nt, Homo sapiens
agcaggccacugggg

SEQ ID NO: 759061 - RNA, 16 nt, Homo sapiens
agcaggcuacugucag

SEQ ID NO: 759062 - RNA, 19 nt, Homo sapiens
agcagggauuaaccucugc

SEQ ID NO: 759063 - RNA, 17 nt, Homo sapiens
agcaggggcuuguugca

SEQ ID NO: 759064 - RNA, 17 nt, Homo sapiens
agcaggguccacagcug

SEQ ID NO: 759065 - RNA, 18 nt, Homo sapiens
agcagguggaauguguau

SEQ ID NO: 759066 - RNA, 16 nt, Homo sapiens
agcagguuaagaauuu

SEQ ID NO: 759067 - RNA, 14 nt, Homo sapiens
agcaguaguggcau

SEQ ID NO: 759068 - RNA, 19 nt, Homo sapiens
agcaguauguuuguuucau

SEQ ID NO: 759069 - RNA, 19 nt, Homo sapiens
agcagucuaucauugcagg

SEQ ID NO: 759070 - RNA, 21 nt, Homo sapiens
agcagugccuaaaacccaguu

SEQ ID NO: 759071 - RNA, 15 nt, Homo sapiens
agcagugucuuccau

SEQ ID NO: 759072 - RNA, 22 nt, Homo sapiens
agcagugucuuccauaauguau

SEQ ID NO: 759073 - RNA, 14 nt, Homo sapiens
agcaguguuuuaga

SEQ ID NO: 759074 - RNA, 22 nt, Homo sapiens
agcaguuugcuuuguaugcacu

SEQ ID NO: 759075 - RNA, 17 nt, Homo sapiens
agcauaaaacuuuggca

SEQ ID NO: 759076 - RNA, 17 nt, Homo sapiens
agcauaaagucacucau

SEQ ID NO: 759077 - RNA, 21 nt, Homo sapiens
agcauaccaauuacccauaaa

SEQ ID NO: 759078 - RNA, 21 nt, Homo sapiens
agcauacuggcuucaccauca

SEQ ID NO: 759079 - RNA, 20 nt, Homo sapiens
agcauaggaaaccacacaga

SEQ ID NO: 759080 - RNA, 15 nt, Homo sapiens
agcauaggaacaaua

SEQ ID NO: 759081 - RNA, 23 nt, Homo sapiens
agcauagggucacuuugccauua

SEQ ID NO: 759082 - RNA, 13 nt, Homo sapiens
agcauauacugaa

SEQ ID NO: 759083 - RNA, 17 nt, Homo sapiens
agcauauacugaagucu

SEQ ID NO: 759084 - RNA, 13 nt, Homo sapiens
agcauauggaauu

SEQ ID NO: 759085 - RNA, 19 nt, Homo sapiens
agcauauuuuaaugcaguu

SEQ ID NO: 759086 - RNA, 19 nt, Homo sapiens
agcaucaauacaaccagcc

SEQ ID NO: 759087 - RNA, 17 nt, Homo sapiens
agcaucaccucaggcca

SEQ ID NO: 759088 - RNA, 15 nt, Homo sapiens
agcaucccucagccu

SEQ ID NO: 759089 - RNA, 14 nt, Homo sapiens
agcaucgggagcac

SEQ ID NO: 759090 - RNA, 19 nt, Homo sapiens
agcaucgugcuguuugccu

SEQ ID NO: 759091 - RNA, 13 nt, Homo sapiens
agcaucuaaugaa

SEQ ID NO: 759092 - RNA, 12 nt, Homo sapiens
agcaucucagga

SEQ ID NO: 759093 - RNA, 17 nt, Homo sapiens
agcaucucccagcaaga

SEQ ID NO: 759094 - RNA, 12 nt, Homo sapiens
agcaucugacca

SEQ ID NO: 759095 - RNA, 16 nt, Homo sapiens
agcaucugaccaucug

SEQ ID NO: 759096 - RNA, 19 nt, Homo sapiens
agcaucugaccaucuguga

SEQ ID NO: 759097 - RNA, 16 nt, Homo sapiens
agcaucugcagccacu

SEQ ID NO: 759098 - RNA, 22 nt, Homo sapiens
agcaucuucacuucuaaaugca

SEQ ID NO: 759099 - RNA, 14 nt, Homo sapiens
agcaugaaagugga

SEQ ID NO: 759100 - RNA, 14 nt, Homo sapiens
agcaugacgugugg

SEQ ID NO: 759101 - RNA, 21 nt, Homo sapiens
agcaugagcucacuccaucac

SEQ ID NO: 759102 - RNA, 17 nt, Homo sapiens
agcaugaggacagacca

SEQ ID NO: 759103 - RNA, 21 nt, Homo sapiens
agcaugaucuuguuacuguga

SEQ ID NO: 759104 - RNA, 21 nt, Homo sapiens
agcaugcuuugcugcuaugaa

SEQ ID NO: 759105 - RNA, 15 nt, Homo sapiens
agcauggacauuuag

SEQ ID NO: 759106 - RNA, 17 nt, Homo sapiens
agcauggagagccucuu

SEQ ID NO: 759107 - RNA, 17 nt, Homo sapiens
agcauggccccagucca

SEQ ID NO: 759108 - RNA, 15 nt, Homo sapiens
agcaugggggcugcc

SEQ ID NO: 759109 - RNA, 20 nt, Homo sapiens
agcauggucacaagcacaaa

SEQ ID NO: 759110 - RNA, 13 nt, Homo sapiens
agcauguacucug

SEQ ID NO: 759111 - RNA, 22 nt, Homo sapiens
agcauguguauuuccagugcaa

SEQ ID NO: 759112 - RNA, 17 nt, Homo sapiens
agcauguuucacagugg

SEQ ID NO: 759113 - RNA, 15 nt, Homo sapiens
agcauuacagugggu

SEQ ID NO: 759114 - RNA, 14 nt, Homo sapiens
agcauuagguauau

SEQ ID NO: 759115 - RNA, 17 nt, Homo sapiens
agcauuagucacuuuga

SEQ ID NO: 759116 - RNA, 16 nt, Homo sapiens
agcauuccaugagcug

SEQ ID NO: 759117 - RNA, 11 nt, Homo sapiens
agcauucugug

SEQ ID NO: 759118 - RNA, 18 nt, Homo sapiens
agcauucuugucacaaua

SEQ ID NO: 759119 - RNA, 20 nt, Homo sapiens
agcauucuugucacaauaaa

SEQ ID NO: 759120 - RNA, 17 nt, Homo sapiens
agcauuggccucugugu

SEQ ID NO: 759121 - RNA, 18 nt, Homo sapiens
agcauuguaaaugugcuu

SEQ ID NO: 759122 - RNA, 23 nt, Homo sapiens
agcauuuaggagaauagcagaga

SEQ ID NO: 759123 - RNA, 17 nt, Homo sapiens
agcauuuagucuugcca

SEQ ID NO: 759124 - RNA, 22 nt, Homo sapiens
agcauuuccaacaccacagaca

SEQ ID NO: 759125 - RNA, 19 nt, Homo sapiens
agcauuucuugauguugcu

SEQ ID NO: 759126 - RNA, 20 nt, Homo sapiens
agcauuugaaaggugugcua

SEQ ID NO: 759127 - RNA, 19 nt, Homo sapiens
agcauuugauuaacauuug

SEQ ID NO: 759128 - RNA, 15 nt, Homo sapiens
agcauuugcuuuccu

SEQ ID NO: 759129 - RNA, 23 nt, Homo sapiens
agcauuugggcagacccugagca

SEQ ID NO: 759130 - RNA, 21 nt, Homo sapiens
agcauuuggugccuauuugaa

SEQ ID NO: 759131 - RNA, 20 nt, Homo sapiens
agccaaaaucccaccacugc

SEQ ID NO: 759132 - RNA, 21 nt, Homo sapiens
agccaaacugucuuugucacc

SEQ ID NO: 759133 - RNA, 13 nt, Homo sapiens
agccaaauguaau

SEQ ID NO: 759134 - RNA, 20 nt, Homo sapiens
agccaaauuuaaaacuguug

SEQ ID NO: 759135 - RNA, 15 nt, Homo sapiens
agccaacaacucugc

SEQ ID NO: 759136 - RNA, 17 nt, Homo sapiens
agccaacacccugucua

SEQ ID NO: 759137 - RNA, 14 nt, Homo sapiens
agccaaccuggacu

SEQ ID NO: 759138 - RNA, 16 nt, Homo sapiens
agccaagaacgcaggg

SEQ ID NO: 759139 - RNA, 23 nt, Homo sapiens
agccaagaagaauuuauuacaaa

SEQ ID NO: 759140 - RNA, 17 nt, Homo sapiens
agccaagcacugcucac

SEQ ID NO: 759141 - RNA, 20 nt, Homo sapiens
agccaaggccgagaccccau

SEQ ID NO: 759142 - RNA, 19 nt, Homo sapiens
agccaagggaaaggggugc

SEQ ID NO: 759143 - RNA, 17 nt, Homo sapiens
agccaaguggggugcug

SEQ ID NO: 759144 - RNA, 16 nt, Homo sapiens
agccacaaccaaaaaa

SEQ ID NO: 759145 - RNA, 12 nt, Homo sapiens
agccacacuggg

SEQ ID NO: 759146 - RNA, 15 nt, Homo sapiens
agccacacuguggga

SEQ ID NO: 759147 - RNA, 14 nt, Homo sapiens
agccacagaccacc

SEQ ID NO: 759148 - RNA, 11 nt, Homo sapiens
agccacagaug

SEQ ID NO: 759149 - RNA, 19 nt, Homo sapiens
agccacagcagguccucca

SEQ ID NO: 759150 - RNA, 15 nt, Homo sapiens
agccacagcugugca

SEQ ID NO: 759151 - RNA, 23 nt, Homo sapiens
agccacagcugugcaugcucagc

SEQ ID NO: 759152 - RNA, 12 nt, Homo sapiens
agccacaugccc

SEQ ID NO: 759153 - RNA, 14 nt, Homo sapiens
agccaccaguucuc

SEQ ID NO: 759154 - RNA, 24 nt, Homo sapiens
agccuacaguuauguucagucaca

SEQ ID NO: 759155 - RNA, 15 nt, Homo sapiens
agccuagcggagccc

SEQ ID NO: 759156 - RNA, 21 nt, Homo sapiens
agccuauaucaaacaugcaca

SEQ ID NO: 759157 - RNA, 16 nt, Homo sapiens
agccuauuuuuuuaga

SEQ ID NO: 759158 - RNA, 12 nt, Homo sapiens
agccucaagucu

SEQ ID NO: 759159 - RNA, 23 nt, Homo sapiens
agccucacguauuucacagagca

SEQ ID NO: 759160 - RNA, 13 nt, Homo sapiens
agccucaucucuu

SEQ ID NO: 759161 - RNA, 14 nt, Homo sapiens
agccuccacuuccc

SEQ ID NO: 759162 - RNA, 19 nt, Homo sapiens
agccuccagggcauugcuc

SEQ ID NO: 759163 - RNA, 20 nt, Homo sapiens
agccuccagggcauugcuca

SEQ ID NO: 759164 - RNA, 21 nt, Homo sapiens
agccuccagggcauugcucag

SEQ ID NO: 759165 - RNA, 16 nt, Homo sapiens
agccuccagguuuccu

SEQ ID NO: 759166 - RNA, 18 nt, Homo sapiens
agccucccccaaagcaau

SEQ ID NO: 759167 - RNA, 23 nt, Homo sapiens
agauuucggaggccauccugcca

SEQ ID NO: 759168 - RNA, 22 nt, Homo sapiens
agauuuggaugcacucauuuaa

SEQ ID NO: 759169 - RNA, 23 nt, Homo sapiens
agauuugugcaaacauggagaaa

SEQ ID NO: 759170 - RNA, 16 nt, Homo sapiens
agauuuguuacuguau

SEQ ID NO: 759171 - RNA, 16 nt, Homo sapiens
agauuuucuuuugccu

SEQ ID NO: 759172 - RNA, 18 nt, Homo sapiens
agauuuucuuuugccuuu

SEQ ID NO: 759173 - RNA, 13 nt, Homo sapiens
agauuuuugcaau

SEQ ID NO: 759174 - RNA, 15 nt, Homo sapiens
agauuuuuuccucug

SEQ ID NO: 759175 - RNA, 22 nt, Homo sapiens
agauuuuuuccucugcauuuac

SEQ ID NO: 759176 - RNA, 20 nt, Homo sapiens
agcaaaaaaauuauuuucuc

SEQ ID NO: 759177 - RNA, 16 nt, Homo sapiens
agcaaaaaguauugaa

SEQ ID NO: 759178 - RNA, 16 nt, Homo sapiens
agcaaaaaugacaaca

SEQ ID NO: 759179 - RNA, 12 nt, Homo sapiens
agcaaaaccaaa

SEQ ID NO: 759180 - RNA, 13 nt, Homo sapiens
agcaaaaccaaag

SEQ ID NO: 759181 - RNA, 17 nt, Homo sapiens
agcaaaacuccgucuca

SEQ ID NO: 759182 - RNA, 16 nt, Homo sapiens
agcaaaagaccaaauc

SEQ ID NO: 759183 - RNA, 18 nt, Homo sapiens
agcaaaagaugugcaaaa

SEQ ID NO: 759184 - RNA, 12 nt, Homo sapiens
agcaaaagccuc

SEQ ID NO: 759185 - RNA, 16 nt, Homo sapiens
agcaaaaggcugagaa

SEQ ID NO: 759186 - RNA, 17 nt, Homo sapiens
agcaaaagucagucuua

SEQ ID NO: 759187 - RNA, 17 nt, Homo sapiens
agcaaaaugcuucugca

SEQ ID NO: 759188 - RNA, 19 nt, Homo sapiens
agcaaaaugcuucugcaca

SEQ ID NO: 759189 - RNA, 18 nt, Homo sapiens
agcaaacuauuugcgacu

SEQ ID NO: 759190 - RNA, 14 nt, Homo sapiens
agcaaacucuugca

SEQ ID NO: 759191 - RNA, 18 nt, Homo sapiens
agcaaagauuauuuucau

SEQ ID NO: 759192 - RNA, 21 nt, Homo sapiens
agcaaagcaaaaggcugagaa

SEQ ID NO: 759193 - RNA, 22 nt, Homo sapiens
agcaaaucuacuucaacacuuc

SEQ ID NO: 759194 - RNA, 20 nt, Homo sapiens
agcaaauggcagaaccaaag

SEQ ID NO: 759195 - RNA, 11 nt, Homo sapiens
agcaacaaaga

SEQ ID NO: 759196 - RNA, 24 nt, Homo sapiens
agcaacagauggauagucugucca

SEQ ID NO: 759197 - RNA, 15 nt, Homo sapiens
agcaacaucucggga

SEQ ID NO: 759198 - RNA, 14 nt, Homo sapiens
agcaaccucuguau

SEQ ID NO: 759199 - RNA, 19 nt, Homo sapiens
agcaaccuguaacucacau

SEQ ID NO: 759200 - RNA, 14 nt, Homo sapiens
agcaacucagagaa

SEQ ID NO: 759201 - RNA, 17 nt, Homo sapiens
agcaacugcccuuccag

SEQ ID NO: 759202 - RNA, 13 nt, Homo sapiens
agcaacugugcaa

SEQ ID NO: 759203 - RNA, 24 nt, Homo sapiens
agcaacuucaaguauaacaacuuu

SEQ ID NO: 759204 - RNA, 18 nt, Homo sapiens
agcaagaccccaucucaa

SEQ ID NO: 759205 - RNA, 20 nt, Homo sapiens
agcaagacccuaaacaucca

SEQ ID NO: 759206 - RNA, 18 nt, Homo sapiens
agcaagacucugucucaa

SEQ ID NO: 759207 - RNA, 15 nt, Homo sapiens
agcaagagacaauaa

SEQ ID NO: 759208 - RNA, 18 nt, Homo sapiens
agcaagcucuucacugaa

SEQ ID NO: 759209 - RNA, 20 nt, Homo sapiens
agcaagggcaagaacccaag

SEQ ID NO: 759210 - RNA, 18 nt, Homo sapiens
agcaaguuacagugaugc

SEQ ID NO: 759211 - RNA, 15 nt, Homo sapiens
agcaaguuagaacua

SEQ ID NO: 759212 - RNA, 20 nt, Homo sapiens
agcaaguuccugagugcgug

SEQ ID NO: 759213 - RNA, 21 nt, Homo sapiens
agcaaguuugaagagaccaca

SEQ ID NO: 759214 - RNA, 16 nt, Homo sapiens
agcaaguuuucuucca

SEQ ID NO: 759215 - RNA, 13 nt, Homo sapiens
agcaauauuccag

SEQ ID NO: 759216 - RNA, 14 nt, Homo sapiens
agcaaucaagaaac

SEQ ID NO: 759217 - RNA, 14 nt, Homo sapiens
agcaaugccauuuc

SEQ ID NO: 759218 - RNA, 12 nt, Homo sapiens
agcaaugguggu

SEQ ID NO: 759219 - RNA, 15 nt, Homo sapiens
agcaaugguggugca

SEQ ID NO: 759220 - RNA, 20 nt, Homo sapiens
agcaauuagauuaguauuuu

SEQ ID NO: 759221 - RNA, 22 nt, Homo sapiens
agcaauuuaauauuuugcacag

SEQ ID NO: 759222 - RNA, 24 nt, Homo sapiens
agcaauuuaauauuuugcacaguu

SEQ ID NO: 759223 - RNA, 17 nt, Homo sapiens
agcacaaacacaccucu

SEQ ID NO: 759224 - RNA, 15 nt, Homo sapiens
agcacaaagcccaua

SEQ ID NO: 759225 - RNA, 13 nt, Homo sapiens
agcacaagccaca

SEQ ID NO: 759226 - RNA, 14 nt, Homo sapiens
agcacaauuugcac

SEQ ID NO: 759227 - RNA, 19 nt, Homo sapiens
agcacacacuucacaaagc

SEQ ID NO: 759228 - RNA, 15 nt, Homo sapiens
agcacaccaaguggc

SEQ ID NO: 759229 - RNA, 12 nt, Homo sapiens
agcacaccucag

SEQ ID NO: 759230 - RNA, 13 nt, Homo sapiens
agcacacuggaau

SEQ ID NO: 759231 - RNA, 13 nt, Homo sapiens
agcacacuuuucc

SEQ ID NO: 759232 - RNA, 15 nt, Homo sapiens
agcacacuuuuccac

SEQ ID NO: 759233 - RNA, 16 nt, Homo sapiens
agcacagaguggcuug

SEQ ID NO: 759234 - RNA, 16 nt, Homo sapiens
agcacagcuccugcca

SEQ ID NO: 759235 - RNA, 17 nt, Homo sapiens
agcacagcugcauuaaa

SEQ ID NO: 759236 - RNA, 20 nt, Homo sapiens
agcacagggggaagaagaag

SEQ ID NO: 759237 - RNA, 15 nt, Homo sapiens
agcacagugccugac

SEQ ID NO: 759238 - RNA, 13 nt, Homo sapiens
agcacaguuugaa

SEQ ID NO: 759239 - RNA, 16 nt, Homo sapiens
agcacaucaauuacaa

SEQ ID NO: 759240 - RNA, 12 nt, Homo sapiens
agcacaugaaua

SEQ ID NO: 759241 - RNA, 18 nt, Homo sapiens
agcacauggccauagagg

SEQ ID NO: 759242 - RNA, 17 nt, Homo sapiens
agcaccacagugaaucc

SEQ ID NO: 759243 - RNA, 21 nt, Homo sapiens
agcacccuucucggagaccca

SEQ ID NO: 759244 - RNA, 23 nt, Homo sapiens
agcacccuugcccggcugugauu

SEQ ID NO: 759245 - RNA, 22 nt, Homo sapiens
agcaccuucccucucaccaucc

SEQ ID NO: 759246 - RNA, 21 nt, Homo sapiens
agcaccuuugagccuuggccc

SEQ ID NO: 759247 - RNA, 14 nt, Homo sapiens
agcacgcugaaggc

SEQ ID NO: 759248 - RNA, 20 nt, Homo sapiens
agcacguggagcucuuggcu

SEQ ID NO: 759249 - RNA, 15 nt, Homo sapiens
agcacgugucucaga

SEQ ID NO: 759250 - RNA, 15 nt, Homo sapiens
agcacuaaagcagug

SEQ ID NO: 759251 - RNA, 19 nt, Homo sapiens
agcacucagccucauucag

SEQ ID NO: 759252 - RNA, 14 nt, Homo sapiens
agcacucauuccuu

SEQ ID NO: 759253 - RNA, 20 nt, Homo sapiens
agcacugacagauuuccauc

SEQ ID NO: 759254 - RNA, 10 nt, Homo sapiens
agcacugagg

SEQ ID NO: 759255 - RNA, 15 nt, Homo sapiens
agcacugaggaagaa

SEQ ID NO: 759256 - RNA, 20 nt, Homo sapiens
agcacugccauuagacugaa

SEQ ID NO: 759257 - RNA, 21 nt, Homo sapiens
agcacuguauuccugucauug

SEQ ID NO: 759258 - RNA, 18 nt, Homo sapiens
agcacugucccuugccuc

SEQ ID NO: 759259 - RNA, 11 nt, Homo sapiens
agcacugugag

SEQ ID NO: 759260 - RNA, 21 nt, Homo sapiens
agcacuguuggagcuacugca

SEQ ID NO: 759261 - RNA, 17 nt, Homo sapiens
agcacuguuuauacacu

SEQ ID NO: 759262 - RNA, 22 nt, Homo sapiens
agcacuuacagcucuggccaca

SEQ ID NO: 759263 - RNA, 23 nt, Homo sapiens
agcacuuugggaggccaaggugg

SEQ ID NO: 759264 - RNA, 14 nt, Homo sapiens
agcagaacacugca

SEQ ID NO: 759265 - RNA, 14 nt, Homo sapiens
agcagaauacuggu

SEQ ID NO: 759266 - RNA, 17 nt, Homo sapiens
agcagagacaugacuca

SEQ ID NO: 759267 - RNA, 18 nt, Homo sapiens
agcagagauguacugcaa

SEQ ID NO: 759268 - RNA, 23 nt, Homo sapiens
agcagagcaaaaugcucuugucc

SEQ ID NO: 759269 - RNA, 15 nt, Homo sapiens
agcagaugguuucca

SEQ ID NO: 759270 - RNA, 21 nt, Homo sapiens
agagcugugccugcucagcag

SEQ ID NO: 759271 - RNA, 13 nt, Homo sapiens
agagcuuggacua

SEQ ID NO: 759272 - RNA, 21 nt, Homo sapiens
agaggaaauucuccacugugc

SEQ ID NO: 759273 - RNA, 18 nt, Homo sapiens
agaggaacccagaugcuc

SEQ ID NO: 759274 - RNA, 19 nt, Homo sapiens
agaggacccuuacgugaga

SEQ ID NO: 759275 - RNA, 21 nt, Homo sapiens
agaggagaagagacauguacc

SEQ ID NO: 759276 - RNA, 14 nt, Homo sapiens
agaggaggggacca

SEQ ID NO: 759277 - RNA, 14 nt, Homo sapiens
agaggagugugaag

SEQ ID NO: 759278 - RNA, 14 nt, Homo sapiens
agaggaucuggaga

SEQ ID NO: 759279 - RNA, 20 nt, Homo sapiens
agaggcagcaagguggccac

SEQ ID NO: 759280 - RNA, 14 nt, Homo sapiens
agaggcaggggcuu

SEQ ID NO: 759281 - RNA, 19 nt, Homo sapiens
agaggcuaauucaguguca

SEQ ID NO: 759282 - RNA, 23 nt, Homo sapiens
agaggcugaggugagaggaucag

SEQ ID NO: 759283 - RNA, 18 nt, Homo sapiens
agaggcugccccucucac

SEQ ID NO: 759284 - RNA, 21 nt, Homo sapiens
agaggcugccccucucaccaa

SEQ ID NO: 759285 - RNA, 13 nt, Homo sapiens
agaggcuuuccaa

SEQ ID NO: 759286 - RNA, 17 nt, Homo sapiens
agagggauaaaaacaau

SEQ ID NO: 759287 - RNA, 15 nt, Homo sapiens
agagggcagggucca

SEQ ID NO: 759288 - RNA, 17 nt, Homo sapiens
agagggcccagcccaga

SEQ ID NO: 759289 - RNA, 15 nt, Homo sapiens
agagggcugguccuu

SEQ ID NO: 759290 - RNA, 18 nt, Homo sapiens
agaggggaaccucaacug

SEQ ID NO: 759291 - RNA, 16 nt, Homo sapiens
agaggggaagggccag

SEQ ID NO: 759292 - RNA, 15 nt, Homo sapiens
agaggggcagccgcu

SEQ ID NO: 759293 - RNA, 22 nt, Homo sapiens
agagggguggaguuuuaacugu

SEQ ID NO: 759294 - RNA, 15 nt, Homo sapiens
agagggugcagucca

SEQ ID NO: 759295 - RNA, 16 nt, Homo sapiens
agagggugcaguccag

SEQ ID NO: 759296 - RNA, 21 nt, Homo sapiens
agaggucucagguucuuucca

SEQ ID NO: 759297 - RNA, 13 nt, Homo sapiens
agaggucugagcc

SEQ ID NO: 759298 - RNA, 20 nt, Homo sapiens
agaggucuuaucuguucagu

SEQ ID NO: 759299 - RNA, 21 nt, Homo sapiens
agaggugcuucugccugugca

SEQ ID NO: 759300 - RNA, 19 nt, Homo sapiens
agagguggagguugcagug

SEQ ID NO: 759301 - RNA, 20 nt, Homo sapiens
agagguggagguugcaguga

SEQ ID NO: 759302 - RNA, 19 nt, Homo sapiens
agagguguaacacuuguca

SEQ ID NO: 759303 - RNA, 13 nt, Homo sapiens
agagguuucuuga

SEQ ID NO: 759304 - RNA, 20 nt, Homo sapiens
agaguaacacauaacauugu

SEQ ID NO: 759305 - RNA, 17 nt, Homo sapiens
agaguaacucaguaauu

SEQ ID NO: 759306 - RNA, 15 nt, Homo sapiens
agaguaaucugggac

SEQ ID NO: 759307 - RNA, 15 nt, Homo sapiens
agaguaucaucaacg

SEQ ID NO: 759308 - RNA, 15 nt, Homo sapiens
agaguauuaucacug

SEQ ID NO: 759309 - RNA, 18 nt, Homo sapiens
agaguauuaucacugcug

SEQ ID NO: 759310 - RNA, 14 nt, Homo sapiens
agagucacugauac

SEQ ID NO: 759311 - RNA, 22 nt, Homo sapiens
agagucagacccuucaauggaa

SEQ ID NO: 759312 - RNA, 12 nt, Homo sapiens
agagucagcucu

SEQ ID NO: 759313 - RNA, 21 nt, Homo sapiens
agagucuggccuggacccuga

SEQ ID NO: 759314 - RNA, 13 nt, Homo sapiens
agagugacaguca

SEQ ID NO: 759315 - RNA, 20 nt, Homo sapiens
agagugagacccugucucaa

SEQ ID NO: 759316 - RNA, 15 nt, Homo sapiens
agagugagacuccac

SEQ ID NO: 759317 - RNA, 20 nt, Homo sapiens
agagugagacuccaucucaa

SEQ ID NO: 759318 - RNA, 20 nt, Homo sapiens
agagugagacucccucucaa

SEQ ID NO: 759319 - RNA, 20 nt, Homo sapiens
agagugagagacaucaucaa

SEQ ID NO: 759320 - RNA, 19 nt, Homo sapiens
agagugcagaucugugcuc

SEQ ID NO: 759321 - RNA, 18 nt, Homo sapiens
agagugcccagaacugga

SEQ ID NO: 759322 - RNA, 19 nt, Homo sapiens
agagugcuccuguauugaa

SEQ ID NO: 759323 - RNA, 14 nt, Homo sapiens
agagugcuugggau

SEQ ID NO: 759324 - RNA, 22 nt, Homo sapiens
agaguggaaccaacacuaacau

SEQ ID NO: 759325 - RNA, 22 nt, Homo sapiens
agaguggaaucucuuggaugca

SEQ ID NO: 759326 - RNA, 16 nt, Homo sapiens
agaguggagucugagu

SEQ ID NO: 759327 - RNA, 13 nt, Homo sapiens
agaguggcccaag

SEQ ID NO: 759328 - RNA, 20 nt, Homo sapiens
agaguggcugcaccacuucc

SEQ ID NO: 759329 - RNA, 16 nt, Homo sapiens
agaguggguacuagaa

SEQ ID NO: 759330 - RNA, 16 nt, Homo sapiens
agaguggguuucacaa

SEQ ID NO: 759331 - RNA, 11 nt, Homo sapiens
agaguggugcu

SEQ ID NO: 759332 - RNA, 17 nt, Homo sapiens
agaguguagacuguggc

SEQ ID NO: 759333 - RNA, 15 nt, Homo sapiens
agaguguucccugac

SEQ ID NO: 759334 - RNA, 21 nt, Homo sapiens
agaguguuuaauuguacucaa

SEQ ID NO: 759335 - RNA, 15 nt, Homo sapiens
agaguuaaaucucaa

SEQ ID NO: 759336 - RNA, 17 nt, Homo sapiens
agaguucuauccccaag

SEQ ID NO: 759337 - RNA, 13 nt, Homo sapiens
agaguugccaaaa

SEQ ID NO: 759338 - RNA, 24 nt, Homo sapiens
agaguuuccugaaacaacuuggaa

SEQ ID NO: 759339 - RNA, 21 nt, Homo sapiens
agaguuucuccuuuugaccaa

SEQ ID NO: 759340 - RNA, 18 nt, Homo sapiens
agaguuugccuguucuau

SEQ ID NO: 759341 - RNA, 14 nt, Homo sapiens
agaguuugucauua

SEQ ID NO: 759342 - RNA, 18 nt, Homo sapiens
agaguuuguguguugucu

SEQ ID NO: 759343 - RNA, 17 nt, Homo sapiens
agaguuuugucauucag

SEQ ID NO: 759344 - RNA, 15 nt, Homo sapiens
agauaaaauguguaa

SEQ ID NO: 759345 - RNA, 21 nt, Homo sapiens
agauaaagucaaaugccaaac

SEQ ID NO: 759346 - RNA, 13 nt, Homo sapiens
agauaacuaggaa

SEQ ID NO: 759347 - RNA, 13 nt, Homo sapiens
agauaacucuccu

SEQ ID NO: 759348 - RNA, 21 nt, Homo sapiens
agauaacuugagcaccgucau

SEQ ID NO: 759349 - RNA, 13 nt, Homo sapiens
agauaaguguucu

SEQ ID NO: 759350 - RNA, 14 nt, Homo sapiens
agauaauaugagaa

SEQ ID NO: 759351 - RNA, 19 nt, Homo sapiens
agauaaucagugugucuaa

SEQ ID NO: 759352 - RNA, 17 nt, Homo sapiens
agauaauuauaauauac

SEQ ID NO: 759353 - RNA, 21 nt, Homo sapiens
agauacagagaugcaaugaua

SEQ ID NO: 759354 - RNA, 21 nt, Homo sapiens
agauacaugguugugaccuga

SEQ ID NO: 759355 - RNA, 21 nt, Homo sapiens
agauacgaaaucaguuucuca

SEQ ID NO: 759356 - RNA, 13 nt, Homo sapiens
agauacggcccau

SEQ ID NO: 759357 - RNA, 20 nt, Homo sapiens
agauacuaguuuugcugaaa

SEQ ID NO: 759358 - RNA, 12 nt, Homo sapiens
agauacucucag

SEQ ID NO: 759359 - RNA, 19 nt, Homo sapiens
agauacuuugucagcaaua

SEQ ID NO: 759360 - RNA, 18 nt, Homo sapiens
agauacuuuuguaaauaa

SEQ ID NO: 759361 - RNA, 21 nt, Homo sapiens
agauagaacacaaaacuugaa

SEQ ID NO: 759362 - RNA, 14 nt, Homo sapiens
agauagacggguug

SEQ ID NO: 759363 - RNA, 14 nt, Homo sapiens
agauagauuuggaa

SEQ ID NO: 759364 - RNA, 14 nt, Homo sapiens
agauagcagggcau

SEQ ID NO: 759365 - RNA, 23 nt, Homo sapiens
agauaggaaacugaagcauaaag

SEQ ID NO: 759366 - RNA, 18 nt, Homo sapiens
agauagguggugccagug

SEQ ID NO: 759367 - RNA, 22 nt, Homo sapiens
agauagguggugccaguggcuu

SEQ ID NO: 759368 - RNA, 20 nt, Homo sapiens
agauaguagcauacauuuau

SEQ ID NO: 759369 - RNA, 23 nt, Homo sapiens
agauaguuguguuuuuauuguua

SEQ ID NO: 759370 - RNA, 15 nt, Homo sapiens
agauauaugaauaug

SEQ ID NO: 759371 - RNA, 17 nt, Homo sapiens
agauauccacuuaccug

SEQ ID NO: 759372 - RNA, 17 nt, Homo sapiens
agauauuaggggggaaa

SEQ ID NO: 759373 - RNA, 17 nt, Homo sapiens
agauauucagaaguaua

SEQ ID NO: 759374 - RNA, 17 nt, Homo sapiens
agauauugauuacuauc

SEQ ID NO: 759375 - RNA, 21 nt, Homo sapiens
agacucagggccccagcacua

SEQ ID NO: 759376 - RNA, 19 nt, Homo sapiens
agacucagguuccagaaca

SEQ ID NO: 759377 - RNA, 17 nt, Homo sapiens
agacucaguuugucaga

SEQ ID NO: 759378 - RNA, 14 nt, Homo sapiens
agacucauaccaca

SEQ ID NO: 759379 - RNA, 17 nt, Homo sapiens
agacucaucuuacugua

SEQ ID NO: 759380 - RNA, 17 nt, Homo sapiens
agacuccagccugaaug

SEQ ID NO: 759381 - RNA, 13 nt, Homo sapiens
agacuccaucuca

SEQ ID NO: 759382 - RNA, 14 nt, Homo sapiens
agacuccaucucaa

SEQ ID NO: 759383 - RNA, 12 nt, Homo sapiens
agacucccugau

SEQ ID NO: 759384 - RNA, 16 nt, Homo sapiens
agacucccugauccca

SEQ ID NO: 759385 - RNA, 14 nt, Homo sapiens
agacuccgucucaa

SEQ ID NO: 759386 - RNA, 22 nt, Homo sapiens
agacucuauuuaagauucccaa

SEQ ID NO: 759387 - RNA, 10 nt, Homo sapiens
agacucugac

SEQ ID NO: 759388 - RNA, 21 nt, Homo sapiens
agacucugauucuacagugau

SEQ ID NO: 759389 - RNA, 18 nt, Homo sapiens
agacucugggcugucagc

SEQ ID NO: 759390 - RNA, 14 nt, Homo sapiens
agacucugguguuc

SEQ ID NO: 759391 - RNA, 17 nt, Homo sapiens
agacucuguaauugaau

SEQ ID NO: 759392 - RNA, 13 nt, Homo sapiens
agacucugucuca

SEQ ID NO: 759393 - RNA, 14 nt, Homo sapiens
agacugaacauguu

SEQ ID NO: 759394 - RNA, 16 nt, Homo sapiens
agacugaaccagucca

SEQ ID NO: 759395 - RNA, 13 nt, Homo sapiens
agacugaauuuaa

SEQ ID NO: 759396 - RNA, 23 nt, Homo sapiens
agacugacuuguuugucuuccau

SEQ ID NO: 759397 - RNA, 13 nt, Homo sapiens
agacugagcucaa

SEQ ID NO: 759398 - RNA, 22 nt, Homo sapiens
agacugauaacaaccuuuuaca

SEQ ID NO: 759399 - RNA, 12 nt, Homo sapiens
agacugcuuccc

SEQ ID NO: 759400 - RNA, 20 nt, Homo sapiens
agacuggggacccuggacau

SEQ ID NO: 759401 - RNA, 20 nt, Homo sapiens
agacugucagaaaaagcuag

SEQ ID NO: 759402 - RNA, 20 nt, Homo sapiens
agacuguggcuagugacaaa

SEQ ID NO: 759403 - RNA, 22 nt, Homo sapiens
agacuguggcugcuagcacuug

SEQ ID NO: 759404 - RNA, 18 nt, Homo sapiens
agacuguugccacuuaac

SEQ ID NO: 759405 - RNA, 15 nt, Homo sapiens
agacuguugcucaaa

SEQ ID NO: 759406 - RNA, 13 nt, Homo sapiens
agacuuaauucug

SEQ ID NO: 759407 - RNA, 16 nt, Homo sapiens
agacuucaccuaacua

SEQ ID NO: 759408 - RNA, 16 nt, Homo sapiens
agacuucccacuguuc

SEQ ID NO: 759409 - RNA, 11 nt, Homo sapiens
agacuucccag

SEQ ID NO: 759410 - RNA, 17 nt, Homo sapiens
agacuuccuguaggggg

SEQ ID NO: 759411 - RNA, 21 nt, Homo sapiens
agacuucuuccucuagacuug

SEQ ID NO: 759412 - RNA, 16 nt, Homo sapiens
agacuuggacuaugau

SEQ ID NO: 759413 - RNA, 13 nt, Homo sapiens
agacuuggcuuug

SEQ ID NO: 759414 - RNA, 13 nt, Homo sapiens
agacuugggaugg

SEQ ID NO: 759415 - RNA, 17 nt, Homo sapiens
agacuuuaaaauucuaa

SEQ ID NO: 759416 - RNA, 19 nt, Homo sapiens
agacuuuguauauuuguua

SEQ ID NO: 759417 - RNA, 15 nt, Homo sapiens
agagaaaagucuacc

SEQ ID NO: 759418 - RNA, 16 nt, Homo sapiens
agagaaacuagaaaca

SEQ ID NO: 759419 - RNA, 21 nt, Homo sapiens
agagaaacucaccacaguguu

SEQ ID NO: 759420 - RNA, 12 nt, Homo sapiens
agagaaacugug

SEQ ID NO: 759421 - RNA, 22 nt, Homo sapiens
agagaaacuuugaguacagaua

SEQ ID NO: 759422 - RNA, 16 nt, Homo sapiens
agagaaaugugucauc

SEQ ID NO: 759423 - RNA, 14 nt, Homo sapiens
agagaacaacuacu

SEQ ID NO: 759424 - RNA, 13 nt, Homo sapiens
agagaacaggcag

SEQ ID NO: 759425 - RNA, 14 nt, Homo sapiens
agagaacucuuuca

SEQ ID NO: 759426 - RNA, 13 nt, Homo sapiens
agagaacuggagg

SEQ ID NO: 759427 - RNA, 9 nt, Homo sapiens
agagaagau

SEQ ID NO: 759428 - RNA, 18 nt, Homo sapiens
agagaagcaaguaaaaag

SEQ ID NO: 759429 - RNA, 21 nt, Homo sapiens
agagaaggaccagaaaaugua

SEQ ID NO: 759430 - RNA, 12 nt, Homo sapiens
agagaaggcagg

SEQ ID NO: 759431 - RNA, 13 nt, Homo sapiens
agagaaucccagg

SEQ ID NO: 759432 - RNA, 14 nt, Homo sapiens
agagaauguauuug

SEQ ID NO: 759433 - RNA, 23 nt, Homo sapiens
agagaauguguguguguggcagg

SEQ ID NO: 759434 - RNA, 13 nt, Homo sapiens
agagacaccugca

SEQ ID NO: 759435 - RNA, 17 nt, Homo sapiens
agagacagggaaagguc

SEQ ID NO: 759436 - RNA, 11 nt, Homo sapiens
agagacagggu

SEQ ID NO: 759437 - RNA, 16 nt, Homo sapiens
agagaccauugcaaug

SEQ ID NO: 759438 - RNA, 16 nt, Homo sapiens
agagacccaagcugcc

SEQ ID NO: 759439 - RNA, 15 nt, Homo sapiens
agagacccagaucuc

SEQ ID NO: 759440 - RNA, 17 nt, Homo sapiens
agagaccugugugaacu

SEQ ID NO: 759441 - RNA, 18 nt, Homo sapiens
agagacuaucugauuucc

SEQ ID NO: 759442 - RNA, 15 nt, Homo sapiens
agagacuauggagcc

SEQ ID NO: 759443 - RNA, 14 nt, Homo sapiens
agagacucauuuca

SEQ ID NO: 759444 - RNA, 15 nt, Homo sapiens
agagacuccgucuca

SEQ ID NO: 759445 - RNA, 20 nt, Homo sapiens
agagagaaaguuucguuaua

SEQ ID NO: 759446 - RNA, 14 nt, Homo sapiens
agagagaagccagc

SEQ ID NO: 759447 - RNA, 14 nt, Homo sapiens
agagagagggagca

SEQ ID NO: 759448 - RNA, 13 nt, Homo sapiens
agagagcagcagc

SEQ ID NO: 759449 - RNA, 20 nt, Homo sapiens
agagagcagcagcagcaggu

SEQ ID NO: 759450 - RNA, 13 nt, Homo sapiens
agagagcugccau

SEQ ID NO: 759451 - RNA, 17 nt, Homo sapiens
agagaggaggggaccaa

SEQ ID NO: 759452 - RNA, 14 nt, Homo sapiens
agagagugcuauug

SEQ ID NO: 759453 - RNA, 19 nt, Homo sapiens
agagaucacaauacucaaa

SEQ ID NO: 759454 - RNA, 20 nt, Homo sapiens
agagaucagcgacccugagg

SEQ ID NO: 759455 - RNA, 22 nt, Homo sapiens
agagauccuuuagugcacccag

SEQ ID NO: 759456 - RNA, 21 nt, Homo sapiens
agagaucuuucuuuccaaaac

SEQ ID NO: 759457 - RNA, 22 nt, Homo sapiens
agagaucuuucuuuccaaaaca

SEQ ID NO: 759458 - RNA, 15 nt, Homo sapiens
agagaugacugucca

SEQ ID NO: 759459 - RNA, 16 nt, Homo sapiens
agagauggauauugaa

SEQ ID NO: 759460 - RNA, 14 nt, Homo sapiens
agagaugggacaag

SEQ ID NO: 759461 - RNA, 16 nt, Homo sapiens
agagaugggacuagga

SEQ ID NO: 759462 - RNA, 20 nt, Homo sapiens
agagauggggucucacagug

SEQ ID NO: 759463 - RNA, 16 nt, Homo sapiens
agagauguuuggaaac

SEQ ID NO: 759464 - RNA, 12 nt, Homo sapiens
agagauucugug

SEQ ID NO: 759465 - RNA, 21 nt, Homo sapiens
agagauucuguugcauagacu

SEQ ID NO: 759466 - RNA, 15 nt, Homo sapiens
agagauuuccuccau

SEQ ID NO: 759467 - RNA, 22 nt, Homo sapiens
agagcaacaauccaucucucaa

SEQ ID NO: 759468 - RNA, 17 nt, Homo sapiens
agagcaagaccccaucu

SEQ ID NO: 759469 - RNA, 20 nt, Homo sapiens
agagcaagaccccaucucaa

SEQ ID NO: 759470 - RNA, 15 nt, Homo sapiens
agagcaagacuccau

SEQ ID NO: 759471 - RNA, 19 nt, Homo sapiens
agagcaagacuccaucuca

SEQ ID NO: 759472 - RNA, 20 nt, Homo sapiens
agagcaagacucugucucaa

SEQ ID NO: 759473 - RNA, 19 nt, Homo sapiens
agagcacacuguagcauua

SEQ ID NO: 759474 - RNA, 11 nt, Homo sapiens
agagcacauuu

SEQ ID NO: 759475 - RNA, 12 nt, Homo sapiens
agagcagcucac

SEQ ID NO: 759476 - RNA, 21 nt, Homo sapiens
agagcagggccaaagcacagc

SEQ ID NO: 759477 - RNA, 14 nt, Homo sapiens
agagccacuuucaa

SEQ ID NO: 759478 - RNA, 12 nt, Homo sapiens
agagccagugaa

SEQ ID NO: 759479 - RNA, 13 nt, Homo sapiens
agagccagugaag

SEQ ID NO: 759480 - RNA, 17 nt, Homo sapiens
agagcccgcagggccau

SEQ ID NO: 759481 - RNA, 20 nt, Homo sapiens
agagcccggcgccccugcca

SEQ ID NO: 759482 - RNA, 21 nt, Homo sapiens
agagcccuucacugccaugau

SEQ ID NO: 759483 - RNA, 20 nt, Homo sapiens
agaaucuagaaauguucaca

SEQ ID NO: 759484 - RNA, 13 nt, Homo sapiens
agaaucucagucu

SEQ ID NO: 759485 - RNA, 15 nt, Homo sapiens
agaaugaagacuguu

SEQ ID NO: 759486 - RNA, 15 nt, Homo sapiens
agaaugagacaucca

SEQ ID NO: 759487 - RNA, 14 nt, Homo sapiens
agaaugagacugaa

SEQ ID NO: 759488 - RNA, 16 nt, Homo sapiens
agaaugagcaagaggc

SEQ ID NO: 759489 - RNA, 16 nt, Homo sapiens
agaaugauuaaucaaa

SEQ ID NO: 759490 - RNA, 14 nt, Homo sapiens
agaaugcauucccu

SEQ ID NO: 759491 - RNA, 15 nt, Homo sapiens
agaaugccaggaaua

SEQ ID NO: 759492 - RNA, 12 nt, Homo sapiens
agaauggaucac

SEQ ID NO: 759493 - RNA, 12 nt, Homo sapiens
agaauggccaaa

SEQ ID NO: 759494 - RNA, 13 nt, Homo sapiens
agaaugguuacaa

SEQ ID NO: 759495 - RNA, 23 nt, Homo sapiens
agaauguagacagguauaaugau

SEQ ID NO: 759496 - RNA, 19 nt, Homo sapiens
agaaugugaaaaaggaaua

SEQ ID NO: 759497 - RNA, 12 nt, Homo sapiens
agaaugugauuc

SEQ ID NO: 759498 - RNA, 17 nt, Homo sapiens
agaauguguuucaaaac

SEQ ID NO: 759499 - RNA, 16 nt, Homo sapiens
agaauguuaugugcaa

SEQ ID NO: 759500 - RNA, 14 nt, Homo sapiens
agaauguuguacuu

SEQ ID NO: 759501 - RNA, 19 nt, Homo sapiens
agaauuaaaacuaugaaau

SEQ ID NO: 759502 - RNA, 24 nt, Homo sapiens
agaauuaaguuuuaaauaaaccua

SEQ ID NO: 759503 - RNA, 13 nt, Homo sapiens
agaauuacuugug

SEQ ID NO: 759504 - RNA, 19 nt, Homo sapiens
agaauuacuuguguuacuu

SEQ ID NO: 759505 - RNA, 16 nt, Homo sapiens
agaauuagauuucuau

SEQ ID NO: 759506 - RNA, 15 nt, Homo sapiens
agaauuauaacugua

SEQ ID NO: 759507 - RNA, 13 nt, Homo sapiens
agaauuauucucu

SEQ ID NO: 759508 - RNA, 21 nt, Homo sapiens
agaauucaaaagugauuaucu

SEQ ID NO: 759509 - RNA, 23 nt, Homo sapiens
agaauucacuaggaggucaucaa

SEQ ID NO: 759510 - RNA, 12 nt, Homo sapiens
agaauucaguau

SEQ ID NO: 759511 - RNA, 23 nt, Homo sapiens
agaauuccuuuucuaacucuccc

SEQ ID NO: 759512 - RNA, 16 nt, Homo sapiens
agaauucuuacauguu

SEQ ID NO: 759513 - RNA, 17 nt, Homo sapiens
agaauugaaacugagua

SEQ ID NO: 759514 - RNA, 20 nt, Homo sapiens
agaauugacugaagcacagc

SEQ ID NO: 759515 - RNA, 19 nt, Homo sapiens
agaauuggccaucuuaaaa

SEQ ID NO: 759516 - RNA, 14 nt, Homo sapiens
agaauuguaucuca

SEQ ID NO: 759517 - RNA, 18 nt, Homo sapiens
agaauugugcaaccauca

SEQ ID NO: 759518 - RNA, 12 nt, Homo sapiens
agaauuuacuca

SEQ ID NO: 759519 - RNA, 15 nt, Homo sapiens
agaauuucacaagcu

SEQ ID NO: 759520 - RNA, 20 nt, Homo sapiens
agaauuucuuugucauucaa

SEQ ID NO: 759521 - RNA, 23 nt, Homo sapiens
agaauuuuauauuuaaauaaagg

SEQ ID NO: 759522 - RNA, 11 nt, Homo sapiens
agacaaaaaua

SEQ ID NO: 759523 - RNA, 19 nt, Homo sapiens
agacaaaaucuuaaaugcc

SEQ ID NO: 759524 - RNA, 20 nt, Homo sapiens
agacaaacuuguucaaaaga

SEQ ID NO: 759525 - RNA, 22 nt, Homo sapiens
agacaaaugggacugaugucau

SEQ ID NO: 759526 - RNA, 20 nt, Homo sapiens
agacaaauuagccauuucac

SEQ ID NO: 759527 - RNA, 18 nt, Homo sapiens
agacaacauuaugaucua

SEQ ID NO: 759528 - RNA, 19 nt, Homo sapiens
agacaacucugcuugcuca

SEQ ID NO: 759529 - RNA, 13 nt, Homo sapiens
agacaagauuuau

SEQ ID NO: 759530 - RNA, 12 nt, Homo sapiens
agacaagcacua

SEQ ID NO: 759531 - RNA, 23 nt, Homo sapiens
agacaaggaaacuucuauguaaa

SEQ ID NO: 759532 - RNA, 13 nt, Homo sapiens
agacaaggugcua

SEQ ID NO: 759533 - RNA, 16 nt, Homo sapiens
agacaagugacuguau

SEQ ID NO: 759534 - RNA, 24 nt, Homo sapiens
agacaagugacuguaucuguguag

SEQ ID NO: 759535 - RNA, 13 nt, Homo sapiens
agacaauuugcac

SEQ ID NO: 759536 - RNA, 20 nt, Homo sapiens
agacacaguguacuugucaa

SEQ ID NO: 759537 - RNA, 15 nt, Homo sapiens
agacaccaaacugcc

SEQ ID NO: 759538 - RNA, 16 nt, Homo sapiens
agacacccucuccuua

SEQ ID NO: 759539 - RNA, 15 nt, Homo sapiens
agacacuauuuaucu

SEQ ID NO: 759540 - RNA, 15 nt, Homo sapiens
agacacugaucuggc

SEQ ID NO: 759541 - RNA, 19 nt, Homo sapiens
agacacuggcguuacugcu

SEQ ID NO: 759542 - RNA, 18 nt, Homo sapiens
agacacuucauggaccaa

SEQ ID NO: 759543 - RNA, 21 nt, Homo sapiens
agacagaaccccuacaugaaa

SEQ ID NO: 759544 - RNA, 14 nt, Homo sapiens
agacagaagcuuaa

SEQ ID NO: 759545 - RNA, 15 nt, Homo sapiens
agacagaaucucagu

SEQ ID NO: 759546 - RNA, 14 nt, Homo sapiens
agacagauugcuga

SEQ ID NO: 759547 - RNA, 20 nt, Homo sapiens
agacaggaugguuacucuug

SEQ ID NO: 759548 - RNA, 20 nt, Homo sapiens
agacaggccaugugagccac

SEQ ID NO: 759549 - RNA, 20 nt, Homo sapiens
agacagggucucgcucuguu

SEQ ID NO: 759550 - RNA, 18 nt, Homo sapiens
agacaguauuuugacaaa

SEQ ID NO: 759551 - RNA, 15 nt, Homo sapiens
agacaguucaagaaa

SEQ ID NO: 759552 - RNA, 11 nt, Homo sapiens
agacauacucc

SEQ ID NO: 759553 - RNA, 21 nt, Homo sapiens
agacauacuugaagggccaga

SEQ ID NO: 759554 - RNA, 22 nt, Homo sapiens
agacaucagucuccaacauguu

SEQ ID NO: 759555 - RNA, 12 nt, Homo sapiens
agacaucaucaa

SEQ ID NO: 759556 - RNA, 22 nt, Homo sapiens
agacaucucaggauuucaccag

SEQ ID NO: 759557 - RNA, 19 nt, Homo sapiens
agacaucuuugggccuguc

SEQ ID NO: 759558 - RNA, 17 nt, Homo sapiens
agacauggagguucuaa

SEQ ID NO: 759559 - RNA, 16 nt, Homo sapiens
agacauuacaaugugu

SEQ ID NO: 759560 - RNA, 15 nt, Homo sapiens
agaccaaccuuccau

SEQ ID NO: 759561 - RNA, 20 nt, Homo sapiens
agaccaagacuuuugucuga

SEQ ID NO: 759562 - RNA, 21 nt, Homo sapiens
agaccacgcccguccugccug

SEQ ID NO: 759563 - RNA, 22 nt, Homo sapiens
agaccacgcccguccugccugu

SEQ ID NO: 759564 - RNA, 15 nt, Homo sapiens
agaccauaauguuac

SEQ ID NO: 759565 - RNA, 15 nt, Homo sapiens
agaccauagugacca

SEQ ID NO: 759566 - RNA, 13 nt, Homo sapiens
agaccauggauuu

SEQ ID NO: 759567 - RNA, 22 nt, Homo sapiens
agacccaacagcagugaucuca

SEQ ID NO: 759568 - RNA, 17 nt, Homo sapiens
agacccaacaggugcug

SEQ ID NO: 759569 - RNA, 17 nt, Homo sapiens
agacccaccacaccgca

SEQ ID NO: 759570 - RNA, 15 nt, Homo sapiens
agaccccagucguga

SEQ ID NO: 759571 - RNA, 13 nt, Homo sapiens
agaccccaucucu

SEQ ID NO: 759572 - RNA, 15 nt, Homo sapiens
agacccccagcacuu

SEQ ID NO: 759573 - RNA, 16 nt, Homo sapiens
agacccccagcacuug

SEQ ID NO: 759574 - RNA, 18 nt, Homo sapiens
agacccccugagccacag

SEQ ID NO: 759575 - RNA, 16 nt, Homo sapiens
agaccccggcuuccuu

SEQ ID NO: 759576 - RNA, 18 nt, Homo sapiens
agaccccuguucaugccg

SEQ ID NO: 759577 - RNA, 12 nt, Homo sapiens
agaccuacccuc

SEQ ID NO: 759578 - RNA, 13 nt, Homo sapiens
agaccuacccucc

SEQ ID NO: 759579 - RNA, 22 nt, Homo sapiens
agaccucagugccuuccuguuu

SEQ ID NO: 759580 - RNA, 23 nt, Homo sapiens
agaccucugggggauaagggagu

SEQ ID NO: 759581 - RNA, 15 nt, Homo sapiens
agaccugaaguaggc

SEQ ID NO: 759582 - RNA, 14 nt, Homo sapiens
agaccugacguccc

SEQ ID NO: 759583 - RNA, 12 nt, Homo sapiens
agaccugccugu

SEQ ID NO: 759584 - RNA, 18 nt, Homo sapiens
agaccugccugugugcuc

SEQ ID NO: 759585 - RNA, 20 nt, Homo sapiens
agaccuuggcauccugugcu

SEQ ID NO: 759586 - RNA, 16 nt, Homo sapiens
agacggagaugcaugg

SEQ ID NO: 759587 - RNA, 21 nt, Homo sapiens
agacggcacaggccuaggaga

SEQ ID NO: 759588 - RNA, 21 nt, Homo sapiens
agacggggccucacuauguug

SEQ ID NO: 759589 - RNA, 19 nt, Homo sapiens
agacggguugaaagacauc

SEQ ID NO: 759590 - RNA, 16 nt, Homo sapiens
agacguggacuccucu

SEQ ID NO: 759591 - RNA, 15 nt, Homo sapiens
cucucgacaguaucc

SEQ ID NO: 759592 - RNA, 23 nt, Homo sapiens
cucucgcaagggaaguccuugca

SEQ ID NO: 759593 - RNA, 18 nt, Homo sapiens
cucucgggugggggagcc

SEQ ID NO: 759594 - RNA, 21 nt, Homo sapiens
cucucuaaaucuuccuuguga

SEQ ID NO: 759595 - RNA, 15 nt, Homo sapiens
cucucuaccagucua

SEQ ID NO: 759596 - RNA, 11 nt, Homo sapiens
cucucuagcac

SEQ ID NO: 759597 - RNA, 13 nt, Homo sapiens
cucucucaugaua

SEQ ID NO: 759598 - RNA, 12 nt, Homo sapiens
cucucuccuuau

SEQ ID NO: 759599 - RNA, 14 nt, Homo sapiens
cucucucuacagag

SEQ ID NO: 759600 - RNA, 11 nt, Homo sapiens
cucucucucag

SEQ ID NO: 759601 - RNA, 23 nt, Homo sapiens
cucucugacgcuugugacagugc

SEQ ID NO: 759602 - RNA, 15 nt, Homo sapiens
cucucuucucuccag

SEQ ID NO: 759603 - RNA, 14 nt, Homo sapiens
cucucuugcuagac

SEQ ID NO: 759604 - RNA, 15 nt, Homo sapiens
cucugaaagaccuau

SEQ ID NO: 759605 - RNA, 21 nt, Homo sapiens
cucugaaagaccuaugagcaa

SEQ ID NO: 759606 - RNA, 19 nt, Homo sapiens
cucugaaaucucagaauuc

SEQ ID NO: 759607 - RNA, 16 nt, Homo sapiens
cucugaacuugccuua

SEQ ID NO: 759608 - RNA, 17 nt, Homo sapiens
cucugaacuugccuuaa

SEQ ID NO: 759609 - RNA, 23 nt, Homo sapiens
cucugaauaaauacccauugaac

SEQ ID NO: 759610 - RNA, 22 nt, Homo sapiens
cucugacaguccacaggggcca

SEQ ID NO: 759611 - RNA, 20 nt, Homo sapiens
cucugagacagcaguaucac

SEQ ID NO: 759612 - RNA, 17 nt, Homo sapiens
cucugagccuuggugua

SEQ ID NO: 759613 - RNA, 23 nt, Homo sapiens
cucugaggggugggggugccgcu

SEQ ID NO: 759614 - RNA, 19 nt, Homo sapiens
cucugauucaccucuuccu

SEQ ID NO: 759615 - RNA, 14 nt, Homo sapiens
cucugcacaugucu

SEQ ID NO: 759616 - RNA, 14 nt, Homo sapiens
cucugcacccagug

SEQ ID NO: 759617 - RNA, 16 nt, Homo sapiens
cucugcacuacugaca

SEQ ID NO: 759618 - RNA, 17 nt, Homo sapiens
cucugcacuacugacau

SEQ ID NO: 759619 - RNA, 20 nt, Homo sapiens
cucugcauuaucugagguca

SEQ ID NO: 759620 - RNA, 11 nt, Homo sapiens
cucugccagug

SEQ ID NO: 759621 - RNA, 23 nt, Homo sapiens
cucugcccagccgggcacagugg

SEQ ID NO: 759622 - RNA, 11 nt, Homo sapiens
cucugccccag

SEQ ID NO: 759623 - RNA, 21 nt, Homo sapiens
cucugccccaggcccuacuac

SEQ ID NO: 759624 - RNA, 15 nt, Homo sapiens
cucugcccugcccua

SEQ ID NO: 759625 - RNA, 20 nt, Homo sapiens
cucugccuacagaacuucag

SEQ ID NO: 759626 - RNA, 19 nt, Homo sapiens
cucugccugagacuuucag

SEQ ID NO: 759627 - RNA, 21 nt, Homo sapiens
cucugccuuaaacacacauug

SEQ ID NO: 759628 - RNA, 22 nt, Homo sapiens
cucugccuuaaacacacauugc

SEQ ID NO: 759629 - RNA, 11 nt, Homo sapiens
cucugccuucc

SEQ ID NO: 759630 - RNA, 16 nt, Homo sapiens
cucugccuuugcucug

SEQ ID NO: 759631 - RNA, 15 nt, Homo sapiens
cucugcuacuccauc

SEQ ID NO: 759632 - RNA, 14 nt, Homo sapiens
cucugcuccagcaa

SEQ ID NO: 759633 - RNA, 11 nt, Homo sapiens
cucugcucccu

SEQ ID NO: 759634 - RNA, 11 nt, Homo sapiens
cucugcuccuu

SEQ ID NO: 759635 - RNA, 15 nt, Homo sapiens
cucugcuguagcuua

SEQ ID NO: 759636 - RNA, 20 nt, Homo sapiens
cucuggaaccuuauuccagc

SEQ ID NO: 759637 - RNA, 16 nt, Homo sapiens
cucuggacgugaaaua

SEQ ID NO: 759638 - RNA, 20 nt, Homo sapiens
cucuggagcaauguugcuua

SEQ ID NO: 759639 - RNA, 17 nt, Homo sapiens
cucuggcaccaucagcc

SEQ ID NO: 759640 - RNA, 22 nt, Homo sapiens
cucuggcaucucuuucugcaaa

SEQ ID NO: 759641 - RNA, 15 nt, Homo sapiens
cucuggcgacaguuu

SEQ ID NO: 759642 - RNA, 22 nt, Homo sapiens
cucuggcggcuuccuguccacu

SEQ ID NO: 759643 - RNA, 17 nt, Homo sapiens
cucugguaugaauucac

SEQ ID NO: 759644 - RNA, 13 nt, Homo sapiens
cucugguccaguc

SEQ ID NO: 759645 - RNA, 15 nt, Homo sapiens
cucuguaaacuucca

SEQ ID NO: 759646 - RNA, 18 nt, Homo sapiens
cucuguaaguguagcuca

SEQ ID NO: 759647 - RNA, 19 nt, Homo sapiens
cucuguaaguguagcucaa

SEQ ID NO: 759648 - RNA, 15 nt, Homo sapiens
cucuguacuuuucau

SEQ ID NO: 759649 - RNA, 20 nt, Homo sapiens
cucuguauaaguugaaggaa

SEQ ID NO: 759650 - RNA, 12 nt, Homo sapiens
cucuguauuccg

SEQ ID NO: 759651 - RNA, 14 nt, Homo sapiens
cucugucaacauca

SEQ ID NO: 759652 - RNA, 10 nt, Homo sapiens
cucuguccac

SEQ ID NO: 759653 - RNA, 21 nt, Homo sapiens
cucugucuaggacugcagugu

SEQ ID NO: 759654 - RNA, 14 nt, Homo sapiens
cucugucucaaaaa

SEQ ID NO: 759655 - RNA, 13 nt, Homo sapiens
cucugugacuccc

SEQ ID NO: 759656 - RNA, 15 nt, Homo sapiens
cucugugccuugguc

SEQ ID NO: 759657 - RNA, 18 nt, Homo sapiens
cucugugggucucuggaa

SEQ ID NO: 759658 - RNA, 12 nt, Homo sapiens
cucuuaacaaga

SEQ ID NO: 759659 - RNA, 14 nt, Homo sapiens
cucuuaagaucuga

SEQ ID NO: 759660 - RNA, 12 nt, Homo sapiens
cucuuagcacac

SEQ ID NO: 759661 - RNA, 19 nt, Homo sapiens
cucuuagcuuucucagggg

SEQ ID NO: 759662 - RNA, 17 nt, Homo sapiens
cucuuauccaacaucaa

SEQ ID NO: 759663 - RNA, 18 nt, Homo sapiens
cucuuaugugugccuuug

SEQ ID NO: 759664 - RNA, 22 nt, Homo sapiens
cucuucaccccuacacugugaa

SEQ ID NO: 759665 - RNA, 19 nt, Homo sapiens
cucuucagaaaacccuuuu

SEQ ID NO: 759666 - RNA, 17 nt, Homo sapiens
cucuucagccccuagug

SEQ ID NO: 759667 - RNA, 20 nt, Homo sapiens
cucuucagccccuagugcua

SEQ ID NO: 759668 - RNA, 19 nt, Homo sapiens
cucuucagucucuauacca

SEQ ID NO: 759669 - RNA, 20 nt, Homo sapiens
cucuucagucucuauaccaa

SEQ ID NO: 759670 - RNA, 13 nt, Homo sapiens
cucuucaucccau

SEQ ID NO: 759671 - RNA, 14 nt, Homo sapiens
cucuucaucccauu

SEQ ID NO: 759672 - RNA, 21 nt, Homo sapiens
cucuucccuuucuacccagua

SEQ ID NO: 759673 - RNA, 11 nt, Homo sapiens
cucuuccucau

SEQ ID NO: 759674 - RNA, 14 nt, Homo sapiens
cucuuccugugauc

SEQ ID NO: 759675 - RNA, 17 nt, Homo sapiens
cucuucggaagaccucg

SEQ ID NO: 759676 - RNA, 13 nt, Homo sapiens
cucuucuaacaca

SEQ ID NO: 759677 - RNA, 23 nt, Homo sapiens
cucuucuggggcaggcugggcca

SEQ ID NO: 759678 - RNA, 14 nt, Homo sapiens
cucuucuuacuggu

SEQ ID NO: 759679 - RNA, 13 nt, Homo sapiens
cucuucuuuaugu

SEQ ID NO: 759680 - RNA, 22 nt, Homo sapiens
cucuucuuuuggcuuccaugau

SEQ ID NO: 759681 - RNA, 12 nt, Homo sapiens
cucuugacuacu

SEQ ID NO: 759682 - RNA, 17 nt, Homo sapiens
cucuugacucuugccug

SEQ ID NO: 759683 - RNA, 22 nt, Homo sapiens
cucuuggcugagauagcagagg

SEQ ID NO: 759684 - RNA, 13 nt, Homo sapiens
cucuuggguucaa

SEQ ID NO: 759685 - RNA, 19 nt, Homo sapiens
cucuuguaauaaaaugucu

SEQ ID NO: 759686 - RNA, 13 nt, Homo sapiens
cucuuguuauuau

SEQ ID NO: 759687 - RNA, 18 nt, Homo sapiens
cucuuguucccacacccc

SEQ ID NO: 759688 - RNA, 17 nt, Homo sapiens
cucuuguuuuugcauaa

SEQ ID NO: 759689 - RNA, 14 nt, Homo sapiens
cucuuuaaguauuu

SEQ ID NO: 759690 - RNA, 14 nt, Homo sapiens
cucuuuccuccugc

SEQ ID NO: 759691 - RNA, 20 nt, Homo sapiens
cucuuucucccagcuucaaa

SEQ ID NO: 759692 - RNA, 18 nt, Homo sapiens
cucuuucugcucugccau

SEQ ID NO: 759693 - RNA, 18 nt, Homo sapiens
cucuuugacaauuccuag

SEQ ID NO: 759694 - RNA, 22 nt, Homo sapiens
cucuuuggcuccccuguaccuu

SEQ ID NO: 759695 - RNA, 13 nt, Homo sapiens
cucuuuggggcua

SEQ ID NO: 759696 - RNA, 16 nt, Homo sapiens
cucuuuuccuccucca

SEQ ID NO: 759697 - RNA, 19 nt, Homo sapiens
cucuuuuuuugagugacag

SEQ ID NO: 759698 - RNA, 16 nt, Homo sapiens
cugaaaaaaacauauc

SEQ ID NO: 759699 - RNA, 18 nt, Homo sapiens
cugaaaaaaacauaucca

SEQ ID NO: 759700 - RNA, 15 nt, Homo sapiens
cugaaaaacauucca

SEQ ID NO: 759701 - RNA, 17 nt, Homo sapiens
cugaaaaaucacauccu

SEQ ID NO: 759702 - RNA, 17 nt, Homo sapiens
cugaaaaggacuucugg

SEQ ID NO: 759703 - RNA, 13 nt, Homo sapiens
cugaaaaucugga

SEQ ID NO: 759704 - RNA, 16 nt, Homo sapiens
acccucauuucugcca

SEQ ID NO: 759705 - RNA, 15 nt, Homo sapiens
acccuccacucagcu

SEQ ID NO: 759706 - RNA, 19 nt, Homo sapiens
acccuccagaauccugaug

SEQ ID NO: 759707 - RNA, 23 nt, Homo sapiens
acccuccccaacaccccacugag

SEQ ID NO: 759708 - RNA, 23 nt, Homo sapiens
acccuccuccccacacagacucc

SEQ ID NO: 759709 - RNA, 21 nt, Homo sapiens
acccugaaugguuccaugccu

SEQ ID NO: 759710 - RNA, 21 nt, Homo sapiens
acccugacacggacugugcau

SEQ ID NO: 759711 - RNA, 19 nt, Homo sapiens
acccugagcagaauacugg

SEQ ID NO: 759712 - RNA, 16 nt, Homo sapiens
acccugaguucaucca

SEQ ID NO: 759713 - RNA, 18 nt, Homo sapiens
acccugcaagaccacgga

SEQ ID NO: 759714 - RNA, 17 nt, Homo sapiens
acccugcaggacuugcc

SEQ ID NO: 759715 - RNA, 18 nt, Homo sapiens
acccugcaggacuugcca

SEQ ID NO: 759716 - RNA, 18 nt, Homo sapiens
acccugcuuuuugcuucu

SEQ ID NO: 759717 - RNA, 15 nt, Homo sapiens
acccuggaguucuug

SEQ ID NO: 759718 - RNA, 16 nt, Homo sapiens
acccuggauaggcaag

SEQ ID NO: 759719 - RNA, 20 nt, Homo sapiens
acccuggaucaguccuuuga

SEQ ID NO: 759720 - RNA, 14 nt, Homo sapiens
acccugggugccau

SEQ ID NO: 759721 - RNA, 13 nt, Homo sapiens
acccugugcucaa

SEQ ID NO: 759722 - RNA, 22 nt, Homo sapiens
acccuguuuuaccguugcuaag

SEQ ID NO: 759723 - RNA, 14 nt, Homo sapiens
acccuuaggccagc

SEQ ID NO: 759724 - RNA, 18 nt, Homo sapiens
acccuucaucuuccugug

SEQ ID NO: 759725 - RNA, 21 nt, Homo sapiens
acccuucccaaucagcacuga

SEQ ID NO: 759726 - RNA, 18 nt, Homo sapiens
acccuucccuugagcccu

SEQ ID NO: 759727 - RNA, 17 nt, Homo sapiens
acccuucgagaucauca

SEQ ID NO: 759728 - RNA, 15 nt, Homo sapiens
acccuugaaccaaua

SEQ ID NO: 759729 - RNA, 23 nt, Homo sapiens
acccuugaaccaauaaaggaaca

SEQ ID NO: 759730 - RNA, 11 nt, Homo sapiens
acccuuggcac

SEQ ID NO: 759731 - RNA, 15 nt, Homo sapiens
acccuugucaucucu

SEQ ID NO: 759732 - RNA, 15 nt, Homo sapiens
acccuuugcugugag

SEQ ID NO: 759733 - RNA, 19 nt, Homo sapiens
acccuuuuuugaaccaaca

SEQ ID NO: 759734 - RNA, 23 nt, Homo sapiens
acccuuuuuugaaccaacaucuu

SEQ ID NO: 759735 - RNA, 12 nt, Homo sapiens
accgaacacuac

SEQ ID NO: 759736 - RNA, 16 nt, Homo sapiens
accgagucucuucucc

SEQ ID NO: 759737 - RNA, 11 nt, Homo sapiens
accgcacucca

SEQ ID NO: 759738 - RNA, 17 nt, Homo sapiens
accgcccaucaggguuc

SEQ ID NO: 759739 - RNA, 17 nt, Homo sapiens
accgcugccagcacaga

SEQ ID NO: 759740 - RNA, 23 nt, Homo sapiens
accgcuucugccuuuucacugug

SEQ ID NO: 759741 - RNA, 16 nt, Homo sapiens
accgcuugguuugcaa

SEQ ID NO: 759742 - RNA, 18 nt, Homo sapiens
accggaucuacacccacc

SEQ ID NO: 759743 - RNA, 16 nt, Homo sapiens
accguacaucugcaau

SEQ ID NO: 759744 - RNA, 22 nt, Homo sapiens
accguccucgagcaacugcugu

SEQ ID NO: 759745 - RNA, 18 nt, Homo sapiens
accgugagugacauagcc

SEQ ID NO: 759746 - RNA, 22 nt, Homo sapiens
accgugcucauugcuaaccacu

SEQ ID NO: 759747 - RNA, 22 nt, Homo sapiens
accuaaaaacauuuacugacca

SEQ ID NO: 759748 - RNA, 22 nt, Homo sapiens
accuaaaagagauuucaagaga

SEQ ID NO: 759749 - RNA, 23 nt, Homo sapiens
accuaaaaggaaaucucacccca

SEQ ID NO: 759750 - RNA, 16 nt, Homo sapiens
accuaagcccugcccc

SEQ ID NO: 759751 - RNA, 17 nt, Homo sapiens
accuaagggcccaaagg

SEQ ID NO: 759752 - RNA, 22 nt, Homo sapiens
accuaaguccuuccaccugcca

SEQ ID NO: 759753 - RNA, 17 nt, Homo sapiens
accuaagucucugugaa

SEQ ID NO: 759754 - RNA, 19 nt, Homo sapiens
accuaagucucugugaauu

SEQ ID NO: 759755 - RNA, 18 nt, Homo sapiens
accuaauccaggcagauc

SEQ ID NO: 759756 - RNA, 15 nt, Homo sapiens
accuacacacuguca

SEQ ID NO: 759757 - RNA, 16 nt, Homo sapiens
accuaccaugcugcuu

SEQ ID NO: 759758 - RNA, 21 nt, Homo sapiens
accuacccuccacaggcacag

SEQ ID NO: 759759 - RNA, 19 nt, Homo sapiens
accuacgcacauaccuuca

SEQ ID NO: 759760 - RNA, 13 nt, Homo sapiens
accuacgugccac

SEQ ID NO: 759761 - RNA, 18 nt, Homo sapiens
accuagaacacuaacuca

SEQ ID NO: 759762 - RNA, 21 nt, Homo sapiens
accuaggccucagcugcacug

SEQ ID NO: 759763 - RNA, 23 nt, Homo sapiens
accuagggacacacaggcagcug

SEQ ID NO: 759764 - RNA, 14 nt, Homo sapiens
accuagggcacuuu

SEQ ID NO: 759765 - RNA, 16 nt, Homo sapiens
accuagggcacuuuaa

SEQ ID NO: 759766 - RNA, 23 nt, Homo sapiens
accuaguucuccccgauggggca

SEQ ID NO: 759767 - RNA, 16 nt, Homo sapiens
accuauaagaagccuu

SEQ ID NO: 759768 - RNA, 15 nt, Homo sapiens
accuaucuguggaaa

SEQ ID NO: 759769 - RNA, 16 nt, Homo sapiens
accuauuugucaugua

SEQ ID NO: 759770 - RNA, 15 nt, Homo sapiens
accuauuuuuuucuc

SEQ ID NO: 759771 - RNA, 21 nt, Homo sapiens
accuauuuuuuucucuauucu

SEQ ID NO: 759772 - RNA, 13 nt, Homo sapiens
accucaaaggcuc

SEQ ID NO: 759773 - RNA, 17 nt, Homo sapiens
accucaaguguccugaa

SEQ ID NO: 759774 - RNA, 20 nt, Homo sapiens
accucacaggccccaggaaa

SEQ ID NO: 759775 - RNA, 12 nt, Homo sapiens
accucacaguga

SEQ ID NO: 759776 - RNA, 12 nt, Homo sapiens
accucaccaaaa

SEQ ID NO: 759777 - RNA, 13 nt, Homo sapiens
accucaccaaaac

SEQ ID NO: 759778 - RNA, 13 nt, Homo sapiens
accucaccaagga

SEQ ID NO: 759779 - RNA, 21 nt, Homo sapiens
accucaccugggcagggauga

SEQ ID NO: 759780 - RNA, 16 nt, Homo sapiens
accucacuaugcugcu

SEQ ID NO: 759781 - RNA, 16 nt, Homo sapiens
accucacuccuguuac

SEQ ID NO: 759782 - RNA, 19 nt, Homo sapiens
accucacuguccugugaag

SEQ ID NO: 759783 - RNA, 13 nt, Homo sapiens
accucacugugac

SEQ ID NO: 759784 - RNA, 18 nt, Homo sapiens
accucagccccacugaca

SEQ ID NO: 759785 - RNA, 20 nt, Homo sapiens
accucagggguuaagagcuc

SEQ ID NO: 759786 - RNA, 21 nt, Homo sapiens
accucagggguuaagagcuca

SEQ ID NO: 759787 - RNA, 22 nt, Homo sapiens
accucagggguuaagagcucag

SEQ ID NO: 759788 - RNA, 21 nt, Homo sapiens
accucaguucccucuugcuca

SEQ ID NO: 759789 - RNA, 17 nt, Homo sapiens
accucaucagcugccua

SEQ ID NO: 759790 - RNA, 13 nt, Homo sapiens
accucauucugaa

SEQ ID NO: 759791 - RNA, 16 nt, Homo sapiens
accuccaaagaacaac

SEQ ID NO: 759792 - RNA, 20 nt, Homo sapiens
accuccaacaacgacacauu

SEQ ID NO: 759793 - RNA, 21 nt, Homo sapiens
accuccaaggacuaaggccuc

SEQ ID NO: 759794 - RNA, 12 nt, Homo sapiens
accuccacaccc

SEQ ID NO: 759795 - RNA, 20 nt, Homo sapiens
accuccauguggacuuagga

SEQ ID NO: 759796 - RNA, 13 nt, Homo sapiens
accucccacuccu

SEQ ID NO: 759797 - RNA, 14 nt, Homo sapiens
accucccauuacuu

SEQ ID NO: 759798 - RNA, 21 nt, Homo sapiens
accucccccuuccccuaccca

SEQ ID NO: 759799 - RNA, 17 nt, Homo sapiens
accuccgccucccgggu

SEQ ID NO: 759800 - RNA, 17 nt, Homo sapiens
accuccuggugguacca

SEQ ID NO: 759801 - RNA, 22 nt, Homo sapiens
accuccuuagcccugucugcua

SEQ ID NO: 759802 - RNA, 14 nt, Homo sapiens
accuccuuuaccag

SEQ ID NO: 759803 - RNA, 15 nt, Homo sapiens
accucuagagucacu

SEQ ID NO: 759804 - RNA, 20 nt, Homo sapiens
accucuccugcccugugaua

SEQ ID NO: 759805 - RNA, 19 nt, Homo sapiens
accucucuccuuugcugag

SEQ ID NO: 759806 - RNA, 15 nt, Homo sapiens
accucugccccagau

SEQ ID NO: 759807 - RNA, 20 nt, Homo sapiens
accucugggggauaagggag

SEQ ID NO: 759808 - RNA, 18 nt, Homo sapiens
accucuguuguccucccc

SEQ ID NO: 759809 - RNA, 22 nt, Homo sapiens
accucuucuggagauggaagcu

SEQ ID NO: 759810 - RNA, 15 nt, Homo sapiens
accucuugaaaauag

SEQ ID NO: 759811 - RNA, 18 nt, Homo sapiens
accucuugcgagauaaga

SEQ ID NO: 759812 - RNA, 17 nt, Homo sapiens
accucuuuacucucucc

SEQ ID NO: 759813 - RNA, 13 nt, Homo sapiens
accucuuugcuca

SEQ ID NO: 759814 - RNA, 22 nt, Homo sapiens
accucuuuugagacuuugccca

SEQ ID NO: 759815 - RNA, 21 nt, Homo sapiens
accucuuuuuucuaucugcca

SEQ ID NO: 759816 - RNA, 21 nt, Homo sapiens
accugaaaguuuuuuugguuu

SEQ ID NO: 759817 - RNA, 22 nt, Homo sapiens
accugaagguccccuggcagug

SEQ ID NO: 759818 - RNA, 19 nt, Homo sapiens
accaucugugacuauaaag

SEQ ID NO: 759819 - RNA, 19 nt, Homo sapiens
accaugagaccacuguuau

SEQ ID NO: 759820 - RNA, 21 nt, Homo sapiens
accaugagaccacuguuauca

SEQ ID NO: 759821 - RNA, 22 nt, Homo sapiens
accaugagaccacuguuaucaa

SEQ ID NO: 759822 - RNA, 22 nt, Homo sapiens
accaugcagccgcaccagagag

SEQ ID NO: 759823 - RNA, 12 nt, Homo sapiens
accaugcauggu

SEQ ID NO: 759824 - RNA, 14 nt, Homo sapiens
accauggcacuaca

SEQ ID NO: 759825 - RNA, 22 nt, Homo sapiens
accauguuggcuagacuagucu

SEQ ID NO: 759826 - RNA, 14 nt, Homo sapiens
accauucagaauau

SEQ ID NO: 759827 - RNA, 18 nt, Homo sapiens
accauucuccugccucag

SEQ ID NO: 759828 - RNA, 20 nt, Homo sapiens
acccaaacacuucugcuuuc

SEQ ID NO: 759829 - RNA, 15 nt, Homo sapiens
acccaaugccuguga

SEQ ID NO: 759830 - RNA, 17 nt, Homo sapiens
acccaaugccugugaag

SEQ ID NO: 759831 - RNA, 16 nt, Homo sapiens
acccaauuggcccaac

SEQ ID NO: 759832 - RNA, 19 nt, Homo sapiens
acccacccaauuggcccaa

SEQ ID NO: 759833 - RNA, 21 nt, Homo sapiens
acccacccagugucuuucgag

SEQ ID NO: 759834 - RNA, 18 nt, Homo sapiens
acccaccuucaagcagcu

SEQ ID NO: 759835 - RNA, 19 nt, Homo sapiens
acccaccuuugccacaaag

SEQ ID NO: 759836 - RNA, 14 nt, Homo sapiens
acccacuaacaaag

SEQ ID NO: 759837 - RNA, 22 nt, Homo sapiens
acccacucuguugguagcaauu

SEQ ID NO: 759838 - RNA, 22 nt, Homo sapiens
acccacugaaaugaccaagaca

SEQ ID NO: 759839 - RNA, 13 nt, Homo sapiens
acccacugggaca

SEQ ID NO: 759840 - RNA, 19 nt, Homo sapiens
acccagaaugagacaucca

SEQ ID NO: 759841 - RNA, 21 nt, Homo sapiens
acccagaaugagacauccagc

SEQ ID NO: 759842 - RNA, 15 nt, Homo sapiens
acccagagguggaug

SEQ ID NO: 759843 - RNA, 15 nt, Homo sapiens
acccagauuuccuaa

SEQ ID NO: 759844 - RNA, 15 nt, Homo sapiens
acccagccaugcaau

SEQ ID NO: 759845 - RNA, 16 nt, Homo sapiens
acccagcccagcuugc

SEQ ID NO: 759846 - RNA, 17 nt, Homo sapiens
acccagccucagaucca

SEQ ID NO: 759847 - RNA, 18 nt, Homo sapiens
acccagccucagauccag

SEQ ID NO: 759848 - RNA, 16 nt, Homo sapiens
acccagcuaugguucu

SEQ ID NO: 759849 - RNA, 15 nt, Homo sapiens
acccaggcaugggca

SEQ ID NO: 759850 - RNA, 19 nt, Homo sapiens
acccaggcccgcaccgcug

SEQ ID NO: 759851 - RNA, 22 nt, Homo sapiens
acccaggccucccugcagacuc

SEQ ID NO: 759852 - RNA, 16 nt, Homo sapiens
acccagggcuaugagg

SEQ ID NO: 759853 - RNA, 22 nt, Homo sapiens
acccagggugugaacauguucu

SEQ ID NO: 759854 - RNA, 21 nt, Homo sapiens
acccagguauuacacaagcca

SEQ ID NO: 759855 - RNA, 19 nt, Homo sapiens
acccagguuggagugcagu

SEQ ID NO: 759856 - RNA, 22 nt, Homo sapiens
acccagugaggaugcugcagug

SEQ ID NO: 759857 - RNA, 11 nt, Homo sapiens
acccagugcag

SEQ ID NO: 759858 - RNA, 18 nt, Homo sapiens
acccagugcugaauuucc

SEQ ID NO: 759859 - RNA, 14 nt, Homo sapiens
acccaguguagcau

SEQ ID NO: 759860 - RNA, 15 nt, Homo sapiens
acccaguguccuucc

SEQ ID NO: 759861 - RNA, 14 nt, Homo sapiens
acccaguugccaaa

SEQ ID NO: 759862 - RNA, 20 nt, Homo sapiens
acccaguuggugacugggaa

SEQ ID NO: 759863 - RNA, 21 nt, Homo sapiens
acccauccgcuccgugaccua

SEQ ID NO: 759864 - RNA, 16 nt, Homo sapiens
acccaucuguacucau

SEQ ID NO: 759865 - RNA, 21 nt, Homo sapiens
acccaucuguacucauguccu

SEQ ID NO: 759866 - RNA, 17 nt, Homo sapiens
acccaucuucauuaaag

SEQ ID NO: 759867 - RNA, 13 nt, Homo sapiens
acccaugacuuua

SEQ ID NO: 759868 - RNA, 15 nt, Homo sapiens
acccaugacuuuaua

SEQ ID NO: 759869 - RNA, 15 nt, Homo sapiens
acccaugaggcaaug

SEQ ID NO: 759870 - RNA, 18 nt, Homo sapiens
acccaugauacuccacuc

SEQ ID NO: 759871 - RNA, 19 nt, Homo sapiens
acccaugcaagcagaggac

SEQ ID NO: 759872 - RNA, 12 nt, Homo sapiens
acccaugccaga

SEQ ID NO: 759873 - RNA, 15 nt, Homo sapiens
acccaugccagagag

SEQ ID NO: 759874 - RNA, 21 nt, Homo sapiens
acccauuauccaggacuguuu

SEQ ID NO: 759875 - RNA, 16 nt, Homo sapiens
acccauuaucuggaau

SEQ ID NO: 759876 - RNA, 13 nt, Homo sapiens
accccaaacccca

SEQ ID NO: 759877 - RNA, 20 nt, Homo sapiens
accccaaacuuccagguucc

SEQ ID NO: 759878 - RNA, 21 nt, Homo sapiens
accccaauggaugaagacccc

SEQ ID NO: 759879 - RNA, 16 nt, Homo sapiens
accccaccagcaauac

SEQ ID NO: 759880 - RNA, 13 nt, Homo sapiens
accccagcauucc

SEQ ID NO: 759881 - RNA, 19 nt, Homo sapiens
accccagcugccaaggaaa

SEQ ID NO: 759882 - RNA, 21 nt, Homo sapiens
accccagguuuuucaucugaa

SEQ ID NO: 759883 - RNA, 17 nt, Homo sapiens
accccagucgugaugug

SEQ ID NO: 759884 - RNA, 17 nt, Homo sapiens
accccaguggauucuca

SEQ ID NO: 759885 - RNA, 11 nt, Homo sapiens
accccaucucu

SEQ ID NO: 759886 - RNA, 14 nt, Homo sapiens
accccauguccuca

SEQ ID NO: 759887 - RNA, 17 nt, Homo sapiens
accccauuuguggucac

SEQ ID NO: 759888 - RNA, 15 nt, Homo sapiens
acccccaguguaaua

SEQ ID NO: 759889 - RNA, 21 nt, Homo sapiens
acccccaucuuuacaaagaaa

SEQ ID NO: 759890 - RNA, 15 nt, Homo sapiens
accccccagaaccug

SEQ ID NO: 759891 - RNA, 22 nt, Homo sapiens
acccccccucccucucucugaa

SEQ ID NO: 759892 - RNA, 18 nt, Homo sapiens
accccccuccugcuccuc

SEQ ID NO: 759893 - RNA, 18 nt, Homo sapiens
acccccgccccugggcua

SEQ ID NO: 759894 - RNA, 14 nt, Homo sapiens
acccccuucagugc

SEQ ID NO: 759895 - RNA, 16 nt, Homo sapiens
accccggccugucuca

SEQ ID NO: 759896 - RNA, 20 nt, Homo sapiens
accccggggacccugugaca

SEQ ID NO: 759897 - RNA, 20 nt, Homo sapiens
accccgucucuacuaaaaau

SEQ ID NO: 759898 - RNA, 12 nt, Homo sapiens
accccuacagcc

SEQ ID NO: 759899 - RNA, 23 nt, Homo sapiens
accccuagagacagugaugccug

SEQ ID NO: 759900 - RNA, 14 nt, Homo sapiens
accccuaggagcaa

SEQ ID NO: 759901 - RNA, 19 nt, Homo sapiens
accccuccaccucucucuc

SEQ ID NO: 759902 - RNA, 14 nt, Homo sapiens
accccuccaggaau

SEQ ID NO: 759903 - RNA, 21 nt, Homo sapiens
accccucuuucgucuacugca

SEQ ID NO: 759904 - RNA, 13 nt, Homo sapiens
accccugaccuca

SEQ ID NO: 759905 - RNA, 18 nt, Homo sapiens
accccugaccucacugug

SEQ ID NO: 759906 - RNA, 14 nt, Homo sapiens
accccugacucauc

SEQ ID NO: 759907 - RNA, 13 nt, Homo sapiens
accccugcccagg

SEQ ID NO: 759908 - RNA, 23 nt, Homo sapiens
accccugcccugggauguccaca

SEQ ID NO: 759909 - RNA, 17 nt, Homo sapiens
accccugcuauauacua

SEQ ID NO: 759910 - RNA, 19 nt, Homo sapiens
accccuggaagagcccagu

SEQ ID NO: 759911 - RNA, 16 nt, Homo sapiens
accccugguucucauc

SEQ ID NO: 759912 - RNA, 17 nt, Homo sapiens
accccuguuucuggcac

SEQ ID NO: 759913 - RNA, 15 nt, Homo sapiens
accccuuagccuccc

SEQ ID NO: 759914 - RNA, 14 nt, Homo sapiens
acccgaugcugcuu

SEQ ID NO: 759915 - RNA, 17 nt, Homo sapiens
acccgccgccucccacg

SEQ ID NO: 759916 - RNA, 22 nt, Homo sapiens
acccgccgcugccaccaucucc

SEQ ID NO: 759917 - RNA, 16 nt, Homo sapiens
acccgcuccuacagcu

SEQ ID NO: 759918 - RNA, 16 nt, Homo sapiens
acccggagagugcucc

SEQ ID NO: 759919 - RNA, 22 nt, Homo sapiens
acccggccgccgccaggacugu

SEQ ID NO: 759920 - RNA, 20 nt, Homo sapiens
acccggcugcagaggccaga

SEQ ID NO: 759921 - RNA, 21 nt, Homo sapiens
acccgguuaccuuggccguga

SEQ ID NO: 759922 - RNA, 17 nt, Homo sapiens
acccgugaccugagaug

SEQ ID NO: 759923 - RNA, 15 nt, Homo sapiens
acccuaaacauccau

SEQ ID NO: 759924 - RNA, 15 nt, Homo sapiens
acccuaagaugaagc

SEQ ID NO: 759925 - RNA, 13 nt, Homo sapiens
acccuacuuucug

SEQ ID NO: 759926 - RNA, 12 nt, Homo sapiens
acccuacuuugc

SEQ ID NO: 759927 - RNA, 20 nt, Homo sapiens
acccuagccuugcuuguuaa

SEQ ID NO: 759928 - RNA, 20 nt, Homo sapiens
acccuaguuucccugaagga

SEQ ID NO: 759929 - RNA, 20 nt, Homo sapiens
acccuauucuauccaucucc

SEQ ID NO: 759930 - RNA, 21 nt, Homo sapiens
acccuauuuagaaauggauuu

SEQ ID NO: 759931 - RNA, 19 nt, Homo sapiens
acccucauucuacugaaaa

SEQ ID NO: 759932 - RNA, 22 nt, Homo sapiens
acccucauuggccugcccuuca

SEQ ID NO: 759933 - RNA, 12 nt, Homo sapiens
accaaccacagc

SEQ ID NO: 759934 - RNA, 19 nt, Homo sapiens
accaagaaagcucacugua

SEQ ID NO: 759935 - RNA, 17 nt, Homo sapiens
accaagaacauaagaau

SEQ ID NO: 759936 - RNA, 15 nt, Homo sapiens
accaagacucugaaa

SEQ ID NO: 759937 - RNA, 19 nt, Homo sapiens
accaagcauuccugcucaa

SEQ ID NO: 759938 - RNA, 18 nt, Homo sapiens
accaagcguuucccaguc

SEQ ID NO: 759939 - RNA, 15 nt, Homo sapiens
accaagcuuguccaa

SEQ ID NO: 759940 - RNA, 13 nt, Homo sapiens
accaaggaugaau

SEQ ID NO: 759941 - RNA, 23 nt, Homo sapiens
accaaggcaaggcaggugccucc

SEQ ID NO: 759942 - RNA, 17 nt, Homo sapiens
accaagggaucugccau

SEQ ID NO: 759943 - RNA, 21 nt, Homo sapiens
accaaguuccuuggccaugca

SEQ ID NO: 759944 - RNA, 18 nt, Homo sapiens
accaaguuuuauugucaa

SEQ ID NO: 759945 - RNA, 13 nt, Homo sapiens
accaauaaacagc

SEQ ID NO: 759946 - RNA, 20 nt, Homo sapiens
accaauaaagugacccuguu

SEQ ID NO: 759947 - RNA, 14 nt, Homo sapiens
accaauacauuugu

SEQ ID NO: 759948 - RNA, 20 nt, Homo sapiens
accaauauuaacacgcugcc

SEQ ID NO: 759949 - RNA, 16 nt, Homo sapiens
accaauccaacaucca

SEQ ID NO: 759950 - RNA, 18 nt, Homo sapiens
accaaugaagaagacaaa

SEQ ID NO: 759951 - RNA, 13 nt, Homo sapiens
accaaugcuguug

SEQ ID NO: 759952 - RNA, 19 nt, Homo sapiens
accaauggauuguggaaaa

SEQ ID NO: 759953 - RNA, 12 nt, Homo sapiens
accaauguagaa

SEQ ID NO: 759954 - RNA, 18 nt, Homo sapiens
accaauuccaaguuuuaa

SEQ ID NO: 759955 - RNA, 20 nt, Homo sapiens
accaauuccugacacuugau

SEQ ID NO: 759956 - RNA, 14 nt, Homo sapiens
accaauucuaacag

SEQ ID NO: 759957 - RNA, 19 nt, Homo sapiens
accaauucuggacagacag

SEQ ID NO: 759958 - RNA, 15 nt, Homo sapiens
accaauugugcugcc

SEQ ID NO: 759959 - RNA, 18 nt, Homo sapiens
accaauugugcugccauu

SEQ ID NO: 759960 - RNA, 22 nt, Homo sapiens
accacaccaaccaggccuucau

SEQ ID NO: 759961 - RNA, 21 nt, Homo sapiens
accacagagggcgugugcucg

SEQ ID NO: 759962 - RNA, 14 nt, Homo sapiens
accacaggcaucua

SEQ ID NO: 759963 - RNA, 11 nt, Homo sapiens
accacaggcuu

SEQ ID NO: 759964 - RNA, 15 nt, Homo sapiens
accacagucagugga

SEQ ID NO: 759965 - RNA, 17 nt, Homo sapiens
accacagugaauccaga

SEQ ID NO: 759966 - RNA, 14 nt, Homo sapiens
accaccaagccaag

SEQ ID NO: 759967 - RNA, 19 nt, Homo sapiens
accacccagaguggcccaa

SEQ ID NO: 759968 - RNA, 18 nt, Homo sapiens
accaccgucugucucaga

SEQ ID NO: 759969 - RNA, 15 nt, Homo sapiens
accaccuaauaucaa

SEQ ID NO: 759970 - RNA, 14 nt, Homo sapiens
accaccuaauccuu

SEQ ID NO: 759971 - RNA, 17 nt, Homo sapiens
accaccucugugggcac

SEQ ID NO: 759972 - RNA, 22 nt, Homo sapiens
accaccuggggagagccugcuu

SEQ ID NO: 759973 - RNA, 15 nt, Homo sapiens
accaccuucuucucc

SEQ ID NO: 759974 - RNA, 16 nt, Homo sapiens
accaccuuuccagcca

SEQ ID NO: 759975 - RNA, 13 nt, Homo sapiens
accaccuuuuuga

SEQ ID NO: 759976 - RNA, 22 nt, Homo sapiens
accacgccucuugaccaggcug

SEQ ID NO: 759977 - RNA, 13 nt, Homo sapiens
accacgugcagua

SEQ ID NO: 759978 - RNA, 18 nt, Homo sapiens
accacuacaugcagccca

SEQ ID NO: 759979 - RNA, 15 nt, Homo sapiens
accacucccaccaca

SEQ ID NO: 759980 - RNA, 22 nt, Homo sapiens
accacugaauucacuccaguca

SEQ ID NO: 759981 - RNA, 14 nt, Homo sapiens
accacugcacucca

SEQ ID NO: 759982 - RNA, 22 nt, Homo sapiens
accacugcacuucagucugugu

SEQ ID NO: 759983 - RNA, 12 nt, Homo sapiens
accacuggguac

SEQ ID NO: 759984 - RNA, 14 nt, Homo sapiens
accacugggugaga

SEQ ID NO: 759985 - RNA, 18 nt, Homo sapiens
accacugguacuuccuuu

SEQ ID NO: 759986 - RNA, 16 nt, Homo sapiens
accacuguguauuuaa

SEQ ID NO: 759987 - RNA, 23 nt, Homo sapiens
accagaagaaagggccuucacag

SEQ ID NO: 759988 - RNA, 15 nt, Homo sapiens
accagaagccaaaga

SEQ ID NO: 759989 - RNA, 19 nt, Homo sapiens
accagaaugaaaacuguaa

SEQ ID NO: 759990 - RNA, 20 nt, Homo sapiens
accagaaugaaaacuguaaa

SEQ ID NO: 759991 - RNA, 14 nt, Homo sapiens
accagaauuucuaa

SEQ ID NO: 759992 - RNA, 19 nt, Homo sapiens
accagagauaauaugagaa

SEQ ID NO: 759993 - RNA, 13 nt, Homo sapiens
accagagcauuuc

SEQ ID NO: 759994 - RNA, 17 nt, Homo sapiens
accagagccagaugcag

SEQ ID NO: 759995 - RNA, 20 nt, Homo sapiens
accagaucagggacuugaau

SEQ ID NO: 759996 - RNA, 13 nt, Homo sapiens
accagauuuacug

SEQ ID NO: 759997 - RNA, 19 nt, Homo sapiens
accagcagaucccagcuca

SEQ ID NO: 759998 - RNA, 21 nt, Homo sapiens
accagcagaucccagcucacg

SEQ ID NO: 759999 - RNA, 13 nt, Homo sapiens
accagcagcaugg

SEQ ID NO: 760000 - RNA, 18 nt, Homo sapiens
accagcaggagguucugg

SEQ ID NO: 760001 - RNA, 22 nt, Homo sapiens
accagccaagagggcugcaaaa

SEQ ID NO: 760002 - RNA, 14 nt, Homo sapiens
accagcccaaccau

SEQ ID NO: 760003 - RNA, 16 nt, Homo sapiens
accagccuacaagcug

SEQ ID NO: 760004 - RNA, 22 nt, Homo sapiens
accagccugcacuacucccuca

SEQ ID NO: 760005 - RNA, 23 nt, Homo sapiens
accagccugcacuacucccucaa

SEQ ID NO: 760006 - RNA, 21 nt, Homo sapiens
accagccuguccaacauggug

SEQ ID NO: 760007 - RNA, 22 nt, Homo sapiens
accagccuguccaacaugguga

SEQ ID NO: 760008 - RNA, 19 nt, Homo sapiens
accagcgcccgcugggcug

SEQ ID NO: 760009 - RNA, 15 nt, Homo sapiens
accagcucccagggu

SEQ ID NO: 760010 - RNA, 17 nt, Homo sapiens
accagcugggguccugu

SEQ ID NO: 760011 - RNA, 15 nt, Homo sapiens
accagcuuugcagug

SEQ ID NO: 760012 - RNA, 23 nt, Homo sapiens
accagcuuuugcggagauuuuga

SEQ ID NO: 760013 - RNA, 23 nt, Homo sapiens
accaggacacuacccugagaucu

SEQ ID NO: 760014 - RNA, 15 nt, Homo sapiens
accaggaccaguuca

SEQ ID NO: 760015 - RNA, 22 nt, Homo sapiens
accaggagcagcagccagcacc

SEQ ID NO: 760016 - RNA, 16 nt, Homo sapiens
accaggcuggacaccc

SEQ ID NO: 760017 - RNA, 13 nt, Homo sapiens
accagggaugcug

SEQ ID NO: 760018 - RNA, 22 nt, Homo sapiens
accaggguccgcaccagcugcu

SEQ ID NO: 760019 - RNA, 18 nt, Homo sapiens
accagguuugaugccugu

SEQ ID NO: 760020 - RNA, 22 nt, Homo sapiens
accaguaaaggcugcugcuaca

SEQ ID NO: 760021 - RNA, 15 nt, Homo sapiens
accaguauaagcauc

SEQ ID NO: 760022 - RNA, 23 nt, Homo sapiens
accagucuauuuccacugaacaa

SEQ ID NO: 760023 - RNA, 19 nt, Homo sapiens
accagucugucuacugugg

SEQ ID NO: 760024 - RNA, 21 nt, Homo sapiens
accaguguagcauuggaucaa

SEQ ID NO: 760025 - RNA, 21 nt, Homo sapiens
accaguguuauuaaugacaaa

SEQ ID NO: 760026 - RNA, 20 nt, Homo sapiens
accaguugaauaaaagugca

SEQ ID NO: 760027 - RNA, 17 nt, Homo sapiens
accaguugggagcacug

SEQ ID NO: 760028 - RNA, 16 nt, Homo sapiens
accaguuucagagaaa

SEQ ID NO: 760029 - RNA, 16 nt, Homo sapiens
accauaacaacuucau

SEQ ID NO: 760030 - RNA, 14 nt, Homo sapiens
accauaacuguuuc

SEQ ID NO: 760031 - RNA, 22 nt, Homo sapiens
accauaccgggucuugauucag

SEQ ID NO: 760032 - RNA, 17 nt, Homo sapiens
accauagugaaguguga

SEQ ID NO: 760033 - RNA, 19 nt, Homo sapiens
accauagugucacagagag

SEQ ID NO: 760034 - RNA, 15 nt, Homo sapiens
accauauaccaucuc

SEQ ID NO: 760035 - RNA, 18 nt, Homo sapiens
accauauucagcauuuga

SEQ ID NO: 760036 - RNA, 19 nt, Homo sapiens
accaucacugguugcacuu

SEQ ID NO: 760037 - RNA, 12 nt, Homo sapiens
accaucauagcu

SEQ ID NO: 760038 - RNA, 15 nt, Homo sapiens
accaucauagcucac

SEQ ID NO: 760039 - RNA, 15 nt, Homo sapiens
accauccagugacaa

SEQ ID NO: 760040 - RNA, 20 nt, Homo sapiens
accauccuggccaacauugu

SEQ ID NO: 760041 - RNA, 17 nt, Homo sapiens
accaucgaucaugaugu

SEQ ID NO: 760042 - RNA, 21 nt, Homo sapiens
accaucuccagcuauuuacac

SEQ ID NO: 760043 - RNA, 19 nt, Homo sapiens
accaucucuccaacucaac

SEQ ID NO: 760044 - RNA, 21 nt, Homo sapiens
accaucugaagaaacuuccca

SEQ ID NO: 760045 - RNA, 23 nt, Homo sapiens
accaucugagccgucagagcagu

SEQ ID NO: 760046 - RNA, 13 nt, Homo sapiens
accaucugauguu

SEQ ID NO: 760047 - RNA, 14 nt, Homo sapiens
accaucugugacua

SEQ ID NO: 760048 - RNA, 14 nt, Homo sapiens
acaugagucaaaac

SEQ ID NO: 760049 - RNA, 22 nt, Homo sapiens
acaugauggagcgcaccugccc

SEQ ID NO: 760050 - RNA, 23 nt, Homo sapiens
acaugcacacacacacaucucau

SEQ ID NO: 760051 - RNA, 14 nt, Homo sapiens
acaugcacauuuau

SEQ ID NO: 760052 - RNA, 23 nt, Homo sapiens
acaugcagcccagaauagcuuug

SEQ ID NO: 760053 - RNA, 20 nt, Homo sapiens
acaugcgaccgugaccagga

SEQ ID NO: 760054 - RNA, 22 nt, Homo sapiens
acaugcuggaaauaaaacagcu

SEQ ID NO: 760055 - RNA, 15 nt, Homo sapiens
acaugcugugcucuu

SEQ ID NO: 760056 - RNA, 17 nt, Homo sapiens
acaugcugugcucuuug

SEQ ID NO: 760057 - RNA, 22 nt, Homo sapiens
acaugcuuuucugccacuccau

SEQ ID NO: 760058 - RNA, 16 nt, Homo sapiens
acauggaacgcuuuca

SEQ ID NO: 760059 - RNA, 14 nt, Homo sapiens
acauggaacuuuag

SEQ ID NO: 760060 - RNA, 14 nt, Homo sapiens
acauggaaggugau

SEQ ID NO: 760061 - RNA, 21 nt, Homo sapiens
acauggaaucgaaguguuuau

SEQ ID NO: 760062 - RNA, 18 nt, Homo sapiens
acauggaucaacaaaauc

SEQ ID NO: 760063 - RNA, 14 nt, Homo sapiens
acauggccuaugca

SEQ ID NO: 760064 - RNA, 14 nt, Homo sapiens
acauggcuaaauac

SEQ ID NO: 760065 - RNA, 24 nt, Homo sapiens
acauggcuaaauacaauggguauc

SEQ ID NO: 760066 - RNA, 14 nt, Homo sapiens
acaugggagcucuu

SEQ ID NO: 760067 - RNA, 17 nt, Homo sapiens
acauggugaaacccugu

SEQ ID NO: 760068 - RNA, 20 nt, Homo sapiens
acauggugaaaccucaucuc

SEQ ID NO: 760069 - RNA, 13 nt, Homo sapiens
acauggugugagu

SEQ ID NO: 760070 - RNA, 18 nt, Homo sapiens
acauggugugaguccaaa

SEQ ID NO: 760071 - RNA, 14 nt, Homo sapiens
acaugguuugacuc

SEQ ID NO: 760072 - RNA, 14 nt, Homo sapiens
acauguaaaaucca

SEQ ID NO: 760073 - RNA, 15 nt, Homo sapiens
acauguaacauuaaa

SEQ ID NO: 760074 - RNA, 19 nt, Homo sapiens
acauguaagaaaauguuac

SEQ ID NO: 760075 - RNA, 18 nt, Homo sapiens
acauguaauaaauucaaa

SEQ ID NO: 760076 - RNA, 19 nt, Homo sapiens
acauguaauuaaguacuau

SEQ ID NO: 760077 - RNA, 13 nt, Homo sapiens
acauguacagaca

SEQ ID NO: 760078 - RNA, 20 nt, Homo sapiens
acauguacuacagcuauauu

SEQ ID NO: 760079 - RNA, 19 nt, Homo sapiens
acauguaugugcauuucaa

SEQ ID NO: 760080 - RNA, 13 nt, Homo sapiens
acaugucuuucag

SEQ ID NO: 760081 - RNA, 12 nt, Homo sapiens
acaugugcacac

SEQ ID NO: 760082 - RNA, 17 nt, Homo sapiens
acaugugcagucacugg

SEQ ID NO: 760083 - RNA, 13 nt, Homo sapiens
acaugugccaugc

SEQ ID NO: 760084 - RNA, 20 nt, Homo sapiens
acauguggcccaacacaauu

SEQ ID NO: 760085 - RNA, 13 nt, Homo sapiens
acaugugguggga

SEQ ID NO: 760086 - RNA, 19 nt, Homo sapiens
acauguguagccugugcau

SEQ ID NO: 760087 - RNA, 13 nt, Homo sapiens
acauguuaagaua

SEQ ID NO: 760088 - RNA, 15 nt, Homo sapiens
acauguuaucaaauc

SEQ ID NO: 760089 - RNA, 14 nt, Homo sapiens
acauuaaaucacuu

SEQ ID NO: 760090 - RNA, 16 nt, Homo sapiens
acauuaaaucuaugaa

SEQ ID NO: 760091 - RNA, 17 nt, Homo sapiens
acauuaaguaaaugcug

SEQ ID NO: 760092 - RNA, 18 nt, Homo sapiens
acauuaaugagaauuccu

SEQ ID NO: 760093 - RNA, 15 nt, Homo sapiens
acauuaguugcacua

SEQ ID NO: 760094 - RNA, 14 nt, Homo sapiens
acauuaucaucuga

SEQ ID NO: 760095 - RNA, 15 nt, Homo sapiens
acauuaucaucugaa

SEQ ID NO: 760096 - RNA, 12 nt, Homo sapiens
acauuaucucac

SEQ ID NO: 760097 - RNA, 13 nt, Homo sapiens
acauuaugaucua

SEQ ID NO: 760098 - RNA, 15 nt, Homo sapiens
acauuauuagcacuu

SEQ ID NO: 760099 - RNA, 16 nt, Homo sapiens
acauuauuagcacuuc

SEQ ID NO: 760100 - RNA, 15 nt, Homo sapiens
acauucacacacuca

SEQ ID NO: 760101 - RNA, 24 nt, Homo sapiens
acauuccuuagucucaagggcuag

SEQ ID NO: 760102 - RNA, 15 nt, Homo sapiens
acauucuaauuugca

SEQ ID NO: 760103 - RNA, 22 nt, Homo sapiens
acauucuagcugagaagcaaug

SEQ ID NO: 760104 - RNA, 19 nt, Homo sapiens
acauucuuaccauuucaca

SEQ ID NO: 760105 - RNA, 13 nt, Homo sapiens
acauucuuccaaa

SEQ ID NO: 760106 - RNA, 12 nt, Homo sapiens
acauucuuggcu

SEQ ID NO: 760107 - RNA, 21 nt, Homo sapiens
acauucuuguuuuaagugccu

SEQ ID NO: 760108 - RNA, 22 nt, Homo sapiens
acauucuuguuuuaagugccuu

SEQ ID NO: 760109 - RNA, 22 nt, Homo sapiens
acauucuuuuucuguugaaacu

SEQ ID NO: 760110 - RNA, 18 nt, Homo sapiens
acauugaugaugacuacg

SEQ ID NO: 760111 - RNA, 18 nt, Homo sapiens
acauugccuucuggagcu

SEQ ID NO: 760112 - RNA, 16 nt, Homo sapiens
acauugggagucugua

SEQ ID NO: 760113 - RNA, 16 nt, Homo sapiens
acauugguauucuggg

SEQ ID NO: 760114 - RNA, 15 nt, Homo sapiens
acauuguacuguaau

SEQ ID NO: 760115 - RNA, 13 nt, Homo sapiens
acauuguauauau

SEQ ID NO: 760116 - RNA, 21 nt, Homo sapiens
acauugugacuguguuugcau

SEQ ID NO: 760117 - RNA, 17 nt, Homo sapiens
acauugugagcucuggu

SEQ ID NO: 760118 - RNA, 12 nt, Homo sapiens
acauugugccuu

SEQ ID NO: 760119 - RNA, 17 nt, Homo sapiens
acauuguuggcacucaa

SEQ ID NO: 760120 - RNA, 19 nt, Homo sapiens
acauuuaaauguaacuuau

SEQ ID NO: 760121 - RNA, 20 nt, Homo sapiens
acauuuacugaccauguacu

SEQ ID NO: 760122 - RNA, 15 nt, Homo sapiens
acauuuagaugcacu

SEQ ID NO: 760123 - RNA, 20 nt, Homo sapiens
acauuuaucaaucaguauaa

SEQ ID NO: 760124 - RNA, 15 nt, Homo sapiens
acauuuaucacugaa

SEQ ID NO: 760125 - RNA, 16 nt, Homo sapiens
acauuucauaguuuca

SEQ ID NO: 760126 - RNA, 22 nt, Homo sapiens
acauuucauugucuuagucaaa

SEQ ID NO: 760127 - RNA, 17 nt, Homo sapiens
acauuucccccuagccu

SEQ ID NO: 760128 - RNA, 16 nt, Homo sapiens
acauuucuaaaccaga

SEQ ID NO: 760129 - RNA, 17 nt, Homo sapiens
acauuucuaugccaaac

SEQ ID NO: 760130 - RNA, 18 nt, Homo sapiens
acauuucucauaccuucc

SEQ ID NO: 760131 - RNA, 16 nt, Homo sapiens
acauuucuucuaguga

SEQ ID NO: 760132 - RNA, 14 nt, Homo sapiens
acauuucuuugcau

SEQ ID NO: 760133 - RNA, 19 nt, Homo sapiens
acauuucuuugcauuccag

SEQ ID NO: 760134 - RNA, 19 nt, Homo sapiens
acauuugauguacaugugu

SEQ ID NO: 760135 - RNA, 12 nt, Homo sapiens
acauuugcugaa

SEQ ID NO: 760136 - RNA, 19 nt, Homo sapiens
acauuugguuucugaauaa

SEQ ID NO: 760137 - RNA, 22 nt, Homo sapiens
acauuuguauuuugugaugaau

SEQ ID NO: 760138 - RNA, 15 nt, Homo sapiens
acauuugucagugau

SEQ ID NO: 760139 - RNA, 15 nt, Homo sapiens
acauuuguuccugga

SEQ ID NO: 760140 - RNA, 23 nt, Homo sapiens
acauuuguuuguauucauguuca

SEQ ID NO: 760141 - RNA, 23 nt, Homo sapiens
acauuuuaauuuuaguuucauga

SEQ ID NO: 760142 - RNA, 15 nt, Homo sapiens
acauuuuacuacuga

SEQ ID NO: 760143 - RNA, 23 nt, Homo sapiens
acauuuuacuuuuuccuggcuca

SEQ ID NO: 760144 - RNA, 16 nt, Homo sapiens
acauuuucauugauga

SEQ ID NO: 760145 - RNA, 14 nt, Homo sapiens
acauuuuccugaga

SEQ ID NO: 760146 - RNA, 20 nt, Homo sapiens
acauuuuccugagaccucaa

SEQ ID NO: 760147 - RNA, 14 nt, Homo sapiens
acauuuuguuauag

SEQ ID NO: 760148 - RNA, 19 nt, Homo sapiens
acauuuuuauaaaaaugag

SEQ ID NO: 760149 - RNA, 18 nt, Homo sapiens
acauuuuuuaacuuucua

SEQ ID NO: 760150 - RNA, 23 nt, Homo sapiens
acauuuuuuuuaacuacuauauu

SEQ ID NO: 760151 - RNA, 15 nt, Homo sapiens
accaaaaaugaugcg

SEQ ID NO: 760152 - RNA, 14 nt, Homo sapiens
accaaaacaugccg

SEQ ID NO: 760153 - RNA, 21 nt, Homo sapiens
accaaaacuauccugauucca

SEQ ID NO: 760154 - RNA, 13 nt, Homo sapiens
accaaacaaggaa

SEQ ID NO: 760155 - RNA, 19 nt, Homo sapiens
accaaacaaggaagccaaa

SEQ ID NO: 760156 - RNA, 13 nt, Homo sapiens
accaaaccccacu

SEQ ID NO: 760157 - RNA, 21 nt, Homo sapiens
accaaaggugugcccuguaca

SEQ ID NO: 760158 - RNA, 19 nt, Homo sapiens
accaaagucacaaaucauc

SEQ ID NO: 760159 - RNA, 14 nt, Homo sapiens
accaaauaccucaa

SEQ ID NO: 760160 - RNA, 23 nt, Homo sapiens
accaaaucuucuccuaugcauuu

SEQ ID NO: 760161 - RNA, 16 nt, Homo sapiens
accaaauuccuuggca

SEQ ID NO: 760162 - RNA, 14 nt, Homo sapiens
accaacauggagaa

SEQ ID NO: 760163 - RNA, 17 nt, Homo sapiens
aauuuaagugacacaga

SEQ ID NO: 760164 - RNA, 17 nt, Homo sapiens
aauuuaauauacugcau

SEQ ID NO: 760165 - RNA, 14 nt, Homo sapiens
aauuuaaugcugcc

SEQ ID NO: 760166 - RNA, 19 nt, Homo sapiens
aauuuaccuaagauuacaa

SEQ ID NO: 760167 - RNA, 19 nt, Homo sapiens
aauuuagaaauauaauuga

SEQ ID NO: 760168 - RNA, 19 nt, Homo sapiens
aauuuagcagucagauuag

SEQ ID NO: 760169 - RNA, 19 nt, Homo sapiens
aauuuagucuagacacaau

SEQ ID NO: 760170 - RNA, 19 nt, Homo sapiens
aauuuaucuuuaccaaaaa

SEQ ID NO: 760171 - RNA, 15 nt, Homo sapiens
aauuuaugcauuuca

SEQ ID NO: 760172 - RNA, 19 nt, Homo sapiens
aauuuaugcauuucauuca

SEQ ID NO: 760173 - RNA, 18 nt, Homo sapiens
aauuuauuaacuaaucaa

SEQ ID NO: 760174 - RNA, 19 nt, Homo sapiens
aauuuauuaacuaaucaag

SEQ ID NO: 760175 - RNA, 16 nt, Homo sapiens
aauuuauucacauaua

SEQ ID NO: 760176 - RNA, 20 nt, Homo sapiens
aauuuauucacauauaucaa

SEQ ID NO: 760177 - RNA, 20 nt, Homo sapiens
aauuuauugaguuuuuacaa

SEQ ID NO: 760178 - RNA, 17 nt, Homo sapiens
aauuuauuuauauuccg

SEQ ID NO: 760179 - RNA, 15 nt, Homo sapiens
aauuuauuucaaaaa

SEQ ID NO: 760180 - RNA, 19 nt, Homo sapiens
aauuuauuugaaaaugcau

SEQ ID NO: 760181 - RNA, 20 nt, Homo sapiens
aauuucaaaaauauaacuua

SEQ ID NO: 760182 - RNA, 17 nt, Homo sapiens
aauuucagaaccaaaag

SEQ ID NO: 760183 - RNA, 19 nt, Homo sapiens
aauuucauaccuaucaucu

SEQ ID NO: 760184 - RNA, 20 nt, Homo sapiens
aauuucauagcuguacuucu

SEQ ID NO: 760185 - RNA, 20 nt, Homo sapiens
aauuucauuaucaucaagca

SEQ ID NO: 760186 - RNA, 14 nt, Homo sapiens
aauuucauuuccag

SEQ ID NO: 760187 - RNA, 13 nt, Homo sapiens
aauuuccaggaaa

SEQ ID NO: 760188 - RNA, 20 nt, Homo sapiens
aauuuccuuuuugacacuga

SEQ ID NO: 760189 - RNA, 17 nt, Homo sapiens
aauuucuaaaaaacaga

SEQ ID NO: 760190 - RNA, 21 nt, Homo sapiens
aauuucuaucagccuugcuaa

SEQ ID NO: 760191 - RNA, 18 nt, Homo sapiens
aauuucugucaaaugcag

SEQ ID NO: 760192 - RNA, 14 nt, Homo sapiens
aauuugaauguggu

SEQ ID NO: 760193 - RNA, 18 nt, Homo sapiens
aauuugacaaaacccacu

SEQ ID NO: 760194 - RNA, 15 nt, Homo sapiens
aauuugagauucuac

SEQ ID NO: 760195 - RNA, 21 nt, Homo sapiens
aauuugauguuuacaggugga

SEQ ID NO: 760196 - RNA, 13 nt, Homo sapiens
aauuuggaguaaa

SEQ ID NO: 760197 - RNA, 20 nt, Homo sapiens
aauuugggugagcugcaccu

SEQ ID NO: 760198 - RNA, 12 nt, Homo sapiens
aauuuguacaua

SEQ ID NO: 760199 - RNA, 14 nt, Homo sapiens
aauuuguguucuca

SEQ ID NO: 760200 - RNA, 18 nt, Homo sapiens
aauuuuaaugcauuguua

SEQ ID NO: 760201 - RNA, 13 nt, Homo sapiens
aauuuuacuucca

SEQ ID NO: 760202 - RNA, 17 nt, Homo sapiens
aauuuuauaacagaauu

SEQ ID NO: 760203 - RNA, 20 nt, Homo sapiens
aauuuuauaacagaauuaaa

SEQ ID NO: 760204 - RNA, 20 nt, Homo sapiens
aauuuuauaugcuuacugau

SEQ ID NO: 760205 - RNA, 15 nt, Homo sapiens
aauuuugaguauucc

SEQ ID NO: 760206 - RNA, 14 nt, Homo sapiens
aauuuugccuuuaa

SEQ ID NO: 760207 - RNA, 17 nt, Homo sapiens
aauuuugcuugcugaag

SEQ ID NO: 760208 - RNA, 18 nt, Homo sapiens
aauuuugguuacuugaau

SEQ ID NO: 760209 - RNA, 17 nt, Homo sapiens
aauuuuguaaaguuucu

SEQ ID NO: 760210 - RNA, 20 nt, Homo sapiens
aauuuuuaaaacccauuuaa

SEQ ID NO: 760211 - RNA, 18 nt, Homo sapiens
aauuuuuaagcuacuuau

SEQ ID NO: 760212 - RNA, 17 nt, Homo sapiens
aauuuuuaagcugcaaa

SEQ ID NO: 760213 - RNA, 19 nt, Homo sapiens
aauuuuuaaggauguugcc

SEQ ID NO: 760214 - RNA, 17 nt, Homo sapiens
aauuuuucagacuuuaa

SEQ ID NO: 760215 - RNA, 15 nt, Homo sapiens
aauuuuucucuuuaa

SEQ ID NO: 760216 - RNA, 16 nt, Homo sapiens
aauuuuugaaaacugg

SEQ ID NO: 760217 - RNA, 20 nt, Homo sapiens
aauuuuugaacaacuguugg

SEQ ID NO: 760218 - RNA, 19 nt, Homo sapiens
aauuuuugcuaugcuguaa

SEQ ID NO: 760219 - RNA, 17 nt, Homo sapiens
aauuuuuuuuccuugcc

SEQ ID NO: 760220 - RNA, 19 nt, Homo sapiens
aauuuuuuuuccuugccug

SEQ ID NO: 760221 - RNA, 16 nt, Homo sapiens
acaaaaaaaccucuau

SEQ ID NO: 760222 - RNA, 16 nt, Homo sapiens
acaaaaaaagauuuaa

SEQ ID NO: 760223 - RNA, 23 nt, Homo sapiens
acaaaaaaauauauuuaaugaua

SEQ ID NO: 760224 - RNA, 13 nt, Homo sapiens
acaaaaaauacuu

SEQ ID NO: 760225 - RNA, 13 nt, Homo sapiens
acaaaaacacagc

SEQ ID NO: 760226 - RNA, 13 nt, Homo sapiens
acaaaaaggcaaa

SEQ ID NO: 760227 - RNA, 13 nt, Homo sapiens
acaaaaaugagcu

SEQ ID NO: 760228 - RNA, 14 nt, Homo sapiens
acaaaaauguuucc

SEQ ID NO: 760229 - RNA, 13 nt, Homo sapiens
acaaaaauuagcu

SEQ ID NO: 760230 - RNA, 22 nt, Homo sapiens
acaaaaauugagacauuuacau

SEQ ID NO: 760231 - RNA, 17 nt, Homo sapiens
acaaaacacagccaagg

SEQ ID NO: 760232 - RNA, 13 nt, Homo sapiens
acaaaacccacug

SEQ ID NO: 760233 - RNA, 20 nt, Homo sapiens
acaaaacccucagcacuguu

SEQ ID NO: 760234 - RNA, 16 nt, Homo sapiens
acaaaaccuaacuugc

SEQ ID NO: 760235 - RNA, 16 nt, Homo sapiens
acaaaaccuuguguaa

SEQ ID NO: 760236 - RNA, 14 nt, Homo sapiens
acaaaagauguauc

SEQ ID NO: 760237 - RNA, 21 nt, Homo sapiens
acaaaagcccaauguaaugca

SEQ ID NO: 760238 - RNA, 11 nt, Homo sapiens
acaaaagcuau

SEQ ID NO: 760239 - RNA, 23 nt, Homo sapiens
acaaaaguguguauaaaauguac

SEQ ID NO: 760240 - RNA, 16 nt, Homo sapiens
acaaaauaauaccuua

SEQ ID NO: 760241 - RNA, 9 nt, Homo sapiens
acaaaauac

SEQ ID NO: 760242 - RNA, 17 nt, Homo sapiens
acaaaauacacaccccu

SEQ ID NO: 760243 - RNA, 16 nt, Homo sapiens
acaaaauggucaucca

SEQ ID NO: 760244 - RNA, 20 nt, Homo sapiens
acaaaauggucauccaaacu

SEQ ID NO: 760245 - RNA, 13 nt, Homo sapiens
acaaaauguucac

SEQ ID NO: 760246 - RNA, 13 nt, Homo sapiens
acaaaauuaagca

SEQ ID NO: 760247 - RNA, 13 nt, Homo sapiens
acaaaauugcaga

SEQ ID NO: 760248 - RNA, 18 nt, Homo sapiens
acaaaauugcagauacca

SEQ ID NO: 760249 - RNA, 11 nt, Homo sapiens
acaaacagacc

SEQ ID NO: 760250 - RNA, 23 nt, Homo sapiens
acaaaccacaacugacacaggaa

SEQ ID NO: 760251 - RNA, 20 nt, Homo sapiens
acaaacccucuguagcuaua

SEQ ID NO: 760252 - RNA, 16 nt, Homo sapiens
acaaaccgagugcaau

SEQ ID NO: 760253 - RNA, 18 nt, Homo sapiens
acaaaccgagugcaauga

SEQ ID NO: 760254 - RNA, 21 nt, Homo sapiens
acaaaccgagugcaaugaaug

SEQ ID NO: 760255 - RNA, 15 nt, Homo sapiens
acaaaccuaccaaaa

SEQ ID NO: 760256 - RNA, 16 nt, Homo sapiens
acaaaccuaccaaaau

SEQ ID NO: 760257 - RNA, 14 nt, Homo sapiens
acaaacucacucag

SEQ ID NO: 760258 - RNA, 17 nt, Homo sapiens
acaaacucacucaguaa

SEQ ID NO: 760259 - RNA, 19 nt, Homo sapiens
acaaacucugaaagaccua

SEQ ID NO: 760260 - RNA, 23 nt, Homo sapiens
acaaacuggcugcuuuguucaau

SEQ ID NO: 760261 - RNA, 15 nt, Homo sapiens
acaaagaacaagcau

SEQ ID NO: 760262 - RNA, 12 nt, Homo sapiens
acaaagaagcua

SEQ ID NO: 760263 - RNA, 14 nt, Homo sapiens
acaaagaguaucau

SEQ ID NO: 760264 - RNA, 18 nt, Homo sapiens
acaaagauuauuugcacg

SEQ ID NO: 760265 - RNA, 19 nt, Homo sapiens
acaaagauugagaagccau

SEQ ID NO: 760266 - RNA, 19 nt, Homo sapiens
acaaagcaguuacuaauau

SEQ ID NO: 760267 - RNA, 22 nt, Homo sapiens
acaaagccacccuaccaugaau

SEQ ID NO: 760268 - RNA, 18 nt, Homo sapiens
acaaaggacagaguauga

SEQ ID NO: 760269 - RNA, 19 nt, Homo sapiens
acaaaguagaggaauccau

SEQ ID NO: 760270 - RNA, 21 nt, Homo sapiens
acaaagugcccaagucuuucc

SEQ ID NO: 760271 - RNA, 23 nt, Homo sapiens
acaaaguuacugauucacugcau

SEQ ID NO: 760272 - RNA, 16 nt, Homo sapiens
acaaauaaagugcagu

SEQ ID NO: 760273 - RNA, 21 nt, Homo sapiens
acaaauaaguggaaaccgugu

SEQ ID NO: 760274 - RNA, 22 nt, Homo sapiens
acaaauaauuuuuaaauauaag

SEQ ID NO: 760275 - RNA, 15 nt, Homo sapiens
acaaauaugucaguu

SEQ ID NO: 760276 - RNA, 15 nt, Homo sapiens
acaaaucauaaugua

SEQ ID NO: 760277 - RNA, 19 nt, Homo sapiens
acaaaucuuuccauaucca

SEQ ID NO: 760278 - RNA, 20 nt, Homo sapiens
aauuacccauaaacagcaca

SEQ ID NO: 760279 - RNA, 16 nt, Homo sapiens
aauuacugccuugaaa

SEQ ID NO: 760280 - RNA, 13 nt, Homo sapiens
aauuagaccuagg

SEQ ID NO: 760281 - RNA, 19 nt, Homo sapiens
aauuagauauauauauuca

SEQ ID NO: 760282 - RNA, 17 nt, Homo sapiens
aauuagcccaacuagaa

SEQ ID NO: 760283 - RNA, 20 nt, Homo sapiens
aauuagccggucaugguggu

SEQ ID NO: 760284 - RNA, 15 nt, Homo sapiens
aauuaggcuguaacu

SEQ ID NO: 760285 - RNA, 13 nt, Homo sapiens
aauuagugaacca

SEQ ID NO: 760286 - RNA, 15 nt, Homo sapiens
aauuaguucuccuau

SEQ ID NO: 760287 - RNA, 22 nt, Homo sapiens
aauuaguuuauauuacucucau

SEQ ID NO: 760288 - RNA, 17 nt, Homo sapiens
aauuauaaucuguggau

SEQ ID NO: 760289 - RNA, 21 nt, Homo sapiens
aauuauacuguagcugaugaa

SEQ ID NO: 760290 - RNA, 20 nt, Homo sapiens
aauuauauaaaucauuucaa

SEQ ID NO: 760291 - RNA, 21 nt, Homo sapiens
aauuauaucacuucacuguuc

SEQ ID NO: 760292 - RNA, 13 nt, Homo sapiens
aauuaugcuucca

SEQ ID NO: 760293 - RNA, 14 nt, Homo sapiens
aauuauggcauuuu

SEQ ID NO: 760294 - RNA, 16 nt, Homo sapiens
aauuaugguaguuauu

SEQ ID NO: 760295 - RNA, 20 nt, Homo sapiens
aauuauguaauauauuguac

SEQ ID NO: 760296 - RNA, 21 nt, Homo sapiens
aauuauuauuuauauauguau

SEQ ID NO: 760297 - RNA, 16 nt, Homo sapiens
aauuauugacacugaa

SEQ ID NO: 760298 - RNA, 16 nt, Homo sapiens
aauuauuuugguacuu

SEQ ID NO: 760299 - RNA, 15 nt, Homo sapiens
aauucaaaaguucca

SEQ ID NO: 760300 - RNA, 15 nt, Homo sapiens
aauucaagccagcau

SEQ ID NO: 760301 - RNA, 15 nt, Homo sapiens
aauucaagugacaca

SEQ ID NO: 760302 - RNA, 12 nt, Homo sapiens
aauucaauacag

SEQ ID NO: 760303 - RNA, 22 nt, Homo sapiens
aauucaaugccgcaacauauag

SEQ ID NO: 760304 - RNA, 14 nt, Homo sapiens
aauucacacaaaga

SEQ ID NO: 760305 - RNA, 20 nt, Homo sapiens
aauucacagugcucuuuucu

SEQ ID NO: 760306 - RNA, 22 nt, Homo sapiens
aauucagaagaccccugacuca

SEQ ID NO: 760307 - RNA, 18 nt, Homo sapiens
aauucagaaggaucuuca

SEQ ID NO: 760308 - RNA, 15 nt, Homo sapiens
aauucagaugcuguu

SEQ ID NO: 760309 - RNA, 13 nt, Homo sapiens
aauucagcacuga

SEQ ID NO: 760310 - RNA, 20 nt, Homo sapiens
aauucaggaugcugugauac

SEQ ID NO: 760311 - RNA, 16 nt, Homo sapiens
aauucaguccuaagaa

SEQ ID NO: 760312 - RNA, 21 nt, Homo sapiens
aauucauaaaaauaaccaaaa

SEQ ID NO: 760313 - RNA, 14 nt, Homo sapiens
aauucauccuuaca

SEQ ID NO: 760314 - RNA, 16 nt, Homo sapiens
aauucaucuucagucu

SEQ ID NO: 760315 - RNA, 21 nt, Homo sapiens
aauucauugagcaguuagcuc

SEQ ID NO: 760316 - RNA, 22 nt, Homo sapiens
aauucauugagcaguuagcuca

SEQ ID NO: 760317 - RNA, 18 nt, Homo sapiens
aauuccaaacacauacag

SEQ ID NO: 760318 - RNA, 14 nt, Homo sapiens
aauucccaagcuuu

SEQ ID NO: 760319 - RNA, 21 nt, Homo sapiens
aauucccuuuuaacccagugu

SEQ ID NO: 760320 - RNA, 13 nt, Homo sapiens
aauuccgcauuua

SEQ ID NO: 760321 - RNA, 15 nt, Homo sapiens
aauuccuaccucccu

SEQ ID NO: 760322 - RNA, 21 nt, Homo sapiens
aauuccuagaaguugagagag

SEQ ID NO: 760323 - RNA, 16 nt, Homo sapiens
aauuccuguacugugu

SEQ ID NO: 760324 - RNA, 22 nt, Homo sapiens
aauuccuguauucuacagcaga

SEQ ID NO: 760325 - RNA, 16 nt, Homo sapiens
aauuccuguuacuuua

SEQ ID NO: 760326 - RNA, 23 nt, Homo sapiens
aauuccuuagcuuagaccucagc

SEQ ID NO: 760327 - RNA, 15 nt, Homo sapiens
aauucgcugcaaccu

SEQ ID NO: 760328 - RNA, 22 nt, Homo sapiens
aauucgcugcaaccuguugaua

SEQ ID NO: 760329 - RNA, 22 nt, Homo sapiens
aauucuaaaaaugguuaucauu

SEQ ID NO: 760330 - RNA, 22 nt, Homo sapiens
aauucuaaaauacaaacccaug

SEQ ID NO: 760331 - RNA, 13 nt, Homo sapiens
aauucuacuuuga

SEQ ID NO: 760332 - RNA, 15 nt, Homo sapiens
aauucuagagccagc

SEQ ID NO: 760333 - RNA, 17 nt, Homo sapiens
aauucuaggcaucccag

SEQ ID NO: 760334 - RNA, 14 nt, Homo sapiens
aauucuagucauau

SEQ ID NO: 760335 - RNA, 16 nt, Homo sapiens
aauucuagucucugau

SEQ ID NO: 760336 - RNA, 21 nt, Homo sapiens
aauucuauaggaacauaugaa

SEQ ID NO: 760337 - RNA, 17 nt, Homo sapiens
aauucucaauauauuca

SEQ ID NO: 760338 - RNA, 14 nt, Homo sapiens
aauucucagagugu

SEQ ID NO: 760339 - RNA, 14 nt, Homo sapiens
aauucuccaacagc

SEQ ID NO: 760340 - RNA, 19 nt, Homo sapiens
aauucuccugccucagccu

SEQ ID NO: 760341 - RNA, 13 nt, Homo sapiens
aauucucugugga

SEQ ID NO: 760342 - RNA, 15 nt, Homo sapiens
aauucugaaaacuga

SEQ ID NO: 760343 - RNA, 15 nt, Homo sapiens
aauucugagccugau

SEQ ID NO: 760344 - RNA, 19 nt, Homo sapiens
aauucugaugagcauuacu

SEQ ID NO: 760345 - RNA, 14 nt, Homo sapiens
aauucugauguuuc

SEQ ID NO: 760346 - RNA, 20 nt, Homo sapiens
aauucugcaacuagccaagg

SEQ ID NO: 760347 - RNA, 11 nt, Homo sapiens
aauucugugac

SEQ ID NO: 760348 - RNA, 21 nt, Homo sapiens
aauucuguuuuuaaugcuauu

SEQ ID NO: 760349 - RNA, 18 nt, Homo sapiens
aauucuuagccaggugua

SEQ ID NO: 760350 - RNA, 17 nt, Homo sapiens
aauucuuagucacaaaa

SEQ ID NO: 760351 - RNA, 22 nt, Homo sapiens
aauucuuauuuuuuaaaaagcu

SEQ ID NO: 760352 - RNA, 12 nt, Homo sapiens
aauucuucaugc

SEQ ID NO: 760353 - RNA, 18 nt, Homo sapiens
aauucuuccuuagacuua

SEQ ID NO: 760354 - RNA, 22 nt, Homo sapiens
aauucuucuguccugagaagca

SEQ ID NO: 760355 - RNA, 18 nt, Homo sapiens
aauucuuuguauaugcau

SEQ ID NO: 760356 - RNA, 21 nt, Homo sapiens
aauucuuuucuuuuccauuua

SEQ ID NO: 760357 - RNA, 16 nt, Homo sapiens
aauugaacuaaaucca

SEQ ID NO: 760358 - RNA, 13 nt, Homo sapiens
aauugacaaugau

SEQ ID NO: 760359 - RNA, 15 nt, Homo sapiens
aauugacgacuucac

SEQ ID NO: 760360 - RNA, 13 nt, Homo sapiens
aauugacuaaaaa

SEQ ID NO: 760361 - RNA, 15 nt, Homo sapiens
aauugacuaaaaagu

SEQ ID NO: 760362 - RNA, 17 nt, Homo sapiens
aauugacugaagcacag

SEQ ID NO: 760363 - RNA, 15 nt, Homo sapiens
aauugagaccacagg

SEQ ID NO: 760364 - RNA, 12 nt, Homo sapiens
aauugauuucaa

SEQ ID NO: 760365 - RNA, 19 nt, Homo sapiens
aauugauuuuucucuucau

SEQ ID NO: 760366 - RNA, 22 nt, Homo sapiens
aauugccaagaaaaacaacuuu

SEQ ID NO: 760367 - RNA, 11 nt, Homo sapiens
aauugccugua

SEQ ID NO: 760368 - RNA, 14 nt, Homo sapiens
aauugccuguaaca

SEQ ID NO: 760369 - RNA, 10 nt, Homo sapiens
aauugcucaa

SEQ ID NO: 760370 - RNA, 14 nt, Homo sapiens
aauugcucagagaa

SEQ ID NO: 760371 - RNA, 22 nt, Homo sapiens
aauugcuccuauacuauugaag

SEQ ID NO: 760372 - RNA, 12 nt, Homo sapiens
aauugcugaaag

SEQ ID NO: 760373 - RNA, 15 nt, Homo sapiens
aauuggccaucuuaa

SEQ ID NO: 760374 - RNA, 15 nt, Homo sapiens
aauuggcucuaguca

SEQ ID NO: 760375 - RNA, 17 nt, Homo sapiens
aauuggcucuagucacu

SEQ ID NO: 760376 - RNA, 22 nt, Homo sapiens
aauuggcucuagucacuggcau

SEQ ID NO: 760377 - RNA, 17 nt, Homo sapiens
aauuggcuuccagauuu

SEQ ID NO: 760378 - RNA, 21 nt, Homo sapiens
aauugggcuucaaucacugua

SEQ ID NO: 760379 - RNA, 22 nt, Homo sapiens
aauuggggcacuuaauggucac

SEQ ID NO: 760380 - RNA, 11 nt, Homo sapiens
aauuguacaau

SEQ ID NO: 760381 - RNA, 12 nt, Homo sapiens
aauuguacaaua

SEQ ID NO: 760382 - RNA, 20 nt, Homo sapiens
aauuguaucucauuacuuau

SEQ ID NO: 760383 - RNA, 19 nt, Homo sapiens
aauugucgaaaagagucuu

SEQ ID NO: 760384 - RNA, 21 nt, Homo sapiens
aauugucuuuguucugugauu

SEQ ID NO: 760385 - RNA, 17 nt, Homo sapiens
aauugugaucagaccau

SEQ ID NO: 760386 - RNA, 20 nt, Homo sapiens
aauugugcaaccugauuaca

SEQ ID NO: 760387 - RNA, 18 nt, Homo sapiens
aauuguguauugaugcaa

SEQ ID NO: 760388 - RNA, 17 nt, Homo sapiens
aauuguuaaacuugcag

SEQ ID NO: 760389 - RNA, 14 nt, Homo sapiens
aauuguuuaugugu

SEQ ID NO: 760390 - RNA, 15 nt, Homo sapiens
aauuguuuugcacuu

SEQ ID NO: 760391 - RNA, 15 nt, Homo sapiens
aauuuaaacagucuc

SEQ ID NO: 760392 - RNA, 15 nt, Homo sapiens
aauuuaacugcauau

SEQ ID NO: 760393 - RNA, 13 nt, Homo sapiens
aauuuaacugugu

SEQ ID NO: 760394 - RNA, 21 nt, Homo sapiens
ccaagcaaaaacaaaugggaa

SEQ ID NO: 760395 - RNA, 21 nt, Homo sapiens
ccaagcacagugccugcaugu

SEQ ID NO: 760396 - RNA, 12 nt, Homo sapiens
ccaagcauuuca

SEQ ID NO: 760397 - RNA, 13 nt, Homo sapiens
ccaagcauuucau

SEQ ID NO: 760398 - RNA, 17 nt, Homo sapiens
ccaagcuucaacccuca

SEQ ID NO: 760399 - RNA, 21 nt, Homo sapiens
ccaaggaaacccccaguguaa

SEQ ID NO: 760400 - RNA, 15 nt, Homo sapiens
ccaaggaaaccgccu

SEQ ID NO: 760401 - RNA, 23 nt, Homo sapiens
ccaaggaaacuuugccaaauaua

SEQ ID NO: 760402 - RNA, 18 nt, Homo sapiens
ccaaggauggaccacaca

SEQ ID NO: 760403 - RNA, 18 nt, Homo sapiens
ccaaggcagcgaccccag

SEQ ID NO: 760404 - RNA, 15 nt, Homo sapiens
ccaagggaaaggggu

SEQ ID NO: 760405 - RNA, 17 nt, Homo sapiens
ccaagggaaaggggugc

SEQ ID NO: 760406 - RNA, 20 nt, Homo sapiens
ccaaggggaaucagaacuca

SEQ ID NO: 760407 - RNA, 20 nt, Homo sapiens
ccaagggguuaaugaaacaa

SEQ ID NO: 760408 - RNA, 17 nt, Homo sapiens
ccaagguauacaucuuc

SEQ ID NO: 760409 - RNA, 22 nt, Homo sapiens
ccaaggugcugaugucaaagug

SEQ ID NO: 760410 - RNA, 12 nt, Homo sapiens
ccaaggugggca

SEQ ID NO: 760411 - RNA, 17 nt, Homo sapiens
ccaaguagcugggacua

SEQ ID NO: 760412 - RNA, 16 nt, Homo sapiens
ccaaguaugccuuaag

SEQ ID NO: 760413 - RNA, 15 nt, Homo sapiens
ccaaguauuuugcca

SEQ ID NO: 760414 - RNA, 14 nt, Homo sapiens
ccaagucacuagaa

SEQ ID NO: 760415 - RNA, 14 nt, Homo sapiens
ccaaguccucauuu

SEQ ID NO: 760416 - RNA, 21 nt, Homo sapiens
ccaagugaacacuagccagac

SEQ ID NO: 760417 - RNA, 20 nt, Homo sapiens
ccaagugaagaaucuaauga

SEQ ID NO: 760418 - RNA, 20 nt, Homo sapiens
ccaaguuccuuggccaugca

SEQ ID NO: 760419 - RNA, 23 nt, Homo sapiens
ccaaguugaagggaaacaaagaa

SEQ ID NO: 760420 - RNA, 23 nt, Homo sapiens
ccaaguugagauuuuaauucugu

SEQ ID NO: 760421 - RNA, 14 nt, Homo sapiens
ccaaguuuauauac

SEQ ID NO: 760422 - RNA, 13 nt, Homo sapiens
ccaauaaagugac

SEQ ID NO: 760423 - RNA, 15 nt, Homo sapiens
ccaauaacuuuucac

SEQ ID NO: 760424 - RNA, 18 nt, Homo sapiens
ccaauacacggacacaac

SEQ ID NO: 760425 - RNA, 12 nt, Homo sapiens
ccaauaccuccu

SEQ ID NO: 760426 - RNA, 23 nt, Homo sapiens
ccaauacugccaaccagagcagc

SEQ ID NO: 760427 - RNA, 20 nt, Homo sapiens
ccaauagucucucugcaaga

SEQ ID NO: 760428 - RNA, 14 nt, Homo sapiens
ccaauauuguaauc

SEQ ID NO: 760429 - RNA, 14 nt, Homo sapiens
ccaauauuuugccu

SEQ ID NO: 760430 - RNA, 15 nt, Homo sapiens
ccaaucaacagcaug

SEQ ID NO: 760431 - RNA, 15 nt, Homo sapiens
ccaaucaguuuauac

SEQ ID NO: 760432 - RNA, 19 nt, Homo sapiens
ccaaucccaccaacccuca

SEQ ID NO: 760433 - RNA, 22 nt, Homo sapiens
ccaaugaagaagacaaagucua

SEQ ID NO: 760434 - RNA, 19 nt, Homo sapiens
ccaaugacacccaugccag

SEQ ID NO: 760435 - RNA, 20 nt, Homo sapiens
ccaaugagggaauccauuga

SEQ ID NO: 760436 - RNA, 14 nt, Homo sapiens
ccaaugauggucac

SEQ ID NO: 760437 - RNA, 12 nt, Homo sapiens
ccaaugccugug

SEQ ID NO: 760438 - RNA, 17 nt, Homo sapiens
ccaaugccugugaagca

SEQ ID NO: 760439 - RNA, 22 nt, Homo sapiens
ccaaugcuuucucaugucucaa

SEQ ID NO: 760440 - RNA, 22 nt, Homo sapiens
ccaaugggaugaggucacuuuu

SEQ ID NO: 760441 - RNA, 22 nt, Homo sapiens
ccaaugugaaguucaucuugca

SEQ ID NO: 760442 - RNA, 23 nt, Homo sapiens
ccaauguucuauuaaucaccucu

SEQ ID NO: 760443 - RNA, 18 nt, Homo sapiens
ccaauucaccaacacagu

SEQ ID NO: 760444 - RNA, 13 nt, Homo sapiens
ccaauuccugaca

SEQ ID NO: 760445 - RNA, 17 nt, Homo sapiens
ccaauuggcucuaguca

SEQ ID NO: 760446 - RNA, 19 nt, Homo sapiens
ccaauuggcucuagucacu

SEQ ID NO: 760447 - RNA, 23 nt, Homo sapiens
ccaauuuucuggaauacaugaaa

SEQ ID NO: 760448 - RNA, 23 nt, Homo sapiens
ccacaaagcacaguuugaacaaa

SEQ ID NO: 760449 - RNA, 17 nt, Homo sapiens
ccacaaaguaucuaaca

SEQ ID NO: 760450 - RNA, 23 nt, Homo sapiens
ccacaaaugguggguacaaaaag

SEQ ID NO: 760451 - RNA, 20 nt, Homo sapiens
ccacaaccuuccagcuccau

SEQ ID NO: 760452 - RNA, 15 nt, Homo sapiens
ccacaacugacacag

SEQ ID NO: 760453 - RNA, 19 nt, Homo sapiens
ccacaacugacacaggaaa

SEQ ID NO: 760454 - RNA, 20 nt, Homo sapiens
ccacaagcugcacugugaac

SEQ ID NO: 760455 - RNA, 18 nt, Homo sapiens
ccacaaguccuuguucca

SEQ ID NO: 760456 - RNA, 15 nt, Homo sapiens
ccacaagucuuccag

SEQ ID NO: 760457 - RNA, 21 nt, Homo sapiens
ccacaaucuggcuuagugcca

SEQ ID NO: 760458 - RNA, 22 nt, Homo sapiens
ccacaaucuggcuuagugccac

SEQ ID NO: 760459 - RNA, 17 nt, Homo sapiens
ccacaaugagauuccau

SEQ ID NO: 760460 - RNA, 15 nt, Homo sapiens
ccacacacacuggcc

SEQ ID NO: 760461 - RNA, 18 nt, Homo sapiens
ccacacauuaguacuuau

SEQ ID NO: 760462 - RNA, 15 nt, Homo sapiens
ccacaccagcugcug

SEQ ID NO: 760463 - RNA, 16 nt, Homo sapiens
ccacacccucacugcu

SEQ ID NO: 760464 - RNA, 23 nt, Homo sapiens
ccacacgcugcaccuaaagccua

SEQ ID NO: 760465 - RNA, 16 nt, Homo sapiens
ccacacggaggcaucu

SEQ ID NO: 760466 - RNA, 18 nt, Homo sapiens
ccacacggcugaccucau

SEQ ID NO: 760467 - RNA, 17 nt, Homo sapiens
ccacacuccacugacaa

SEQ ID NO: 760468 - RNA, 14 nt, Homo sapiens
ccacacucuccauc

SEQ ID NO: 760469 - RNA, 21 nt, Homo sapiens
ccacacugaaucucaccugcu

SEQ ID NO: 760470 - RNA, 12 nt, Homo sapiens
ccacacugaggc

SEQ ID NO: 760471 - RNA, 15 nt, Homo sapiens
ccacacuugguggga

SEQ ID NO: 760472 - RNA, 15 nt, Homo sapiens
ccacagaaauacaug

SEQ ID NO: 760473 - RNA, 20 nt, Homo sapiens
ccacagaccuaggauuucau

SEQ ID NO: 760474 - RNA, 19 nt, Homo sapiens
ccacagagugagccaguga

SEQ ID NO: 760475 - RNA, 21 nt, Homo sapiens
aaacccugaagccauuggaga

SEQ ID NO: 760476 - RNA, 15 nt, Homo sapiens
aaaccgagugcaaug

SEQ ID NO: 760477 - RNA, 15 nt, Homo sapiens
aaaccuaacuugcgc

SEQ ID NO: 760478 - RNA, 11 nt, Homo sapiens
aaaccuaccaa

SEQ ID NO: 760479 - RNA, 20 nt, Homo sapiens
aaaccucauuaauucugaaa

SEQ ID NO: 760480 - RNA, 14 nt, Homo sapiens
aaaccucuaugcaa

SEQ ID NO: 760481 - RNA, 12 nt, Homo sapiens
aaaccugugauc

SEQ ID NO: 760482 - RNA, 13 nt, Homo sapiens
aaaccugugccag

SEQ ID NO: 760483 - RNA, 15 nt, Homo sapiens
aaaccuuaguuucaa

SEQ ID NO: 760484 - RNA, 19 nt, Homo sapiens
aaaccuuauggaaaagggg

SEQ ID NO: 760485 - RNA, 20 nt, Homo sapiens
aaaccuuauuuuuucccaaa

SEQ ID NO: 760486 - RNA, 13 nt, Homo sapiens
aaaccuuugcaaa

SEQ ID NO: 760487 - RNA, 19 nt, Homo sapiens
aaacgccgcugacugccac

SEQ ID NO: 760488 - RNA, 13 nt, Homo sapiens
aaacgcuaccucu

SEQ ID NO: 760489 - RNA, 16 nt, Homo sapiens
aaacgcuuauugugua

SEQ ID NO: 760490 - RNA, 15 nt, Homo sapiens
aaacuaaaaagccau

SEQ ID NO: 760491 - RNA, 12 nt, Homo sapiens
aaacuacuucuu

SEQ ID NO: 760492 - RNA, 14 nt, Homo sapiens
aaacuauauucuca

SEQ ID NO: 760493 - RNA, 17 nt, Homo sapiens
aaacuaugguucccaau

SEQ ID NO: 760494 - RNA, 16 nt, Homo sapiens
aaacuauuugcgacuc

SEQ ID NO: 760495 - RNA, 20 nt, Homo sapiens
aaacucacagaacuauguac

SEQ ID NO: 760496 - RNA, 17 nt, Homo sapiens
aaacucaccuugucuca

SEQ ID NO: 760497 - RNA, 18 nt, Homo sapiens
aaacucagaucugaucaa

SEQ ID NO: 760498 - RNA, 14 nt, Homo sapiens
aaacucaguuccaa

SEQ ID NO: 760499 - RNA, 15 nt, Homo sapiens
aaacucauaacaguc

SEQ ID NO: 760500 - RNA, 19 nt, Homo sapiens
aaacuccacaucugccuua

SEQ ID NO: 760501 - RNA, 13 nt, Homo sapiens
aaacuccaucucu

SEQ ID NO: 760502 - RNA, 12 nt, Homo sapiens
aaacuccaugau

SEQ ID NO: 760503 - RNA, 18 nt, Homo sapiens
aaacugacuaaacuuaca

SEQ ID NO: 760504 - RNA, 21 nt, Homo sapiens
aaacugagaugugaacacauc

SEQ ID NO: 760505 - RNA, 22 nt, Homo sapiens
aaacugagaugugaacacauca

SEQ ID NO: 760506 - RNA, 21 nt, Homo sapiens
aaacugaggaauuucaccugu

SEQ ID NO: 760507 - RNA, 23 nt, Homo sapiens
aaacugcaauagagacuguagau

SEQ ID NO: 760508 - RNA, 19 nt, Homo sapiens
aaacugcacugucaagaug

SEQ ID NO: 760509 - RNA, 17 nt, Homo sapiens
aaacugccuuccacaau

SEQ ID NO: 760510 - RNA, 21 nt, Homo sapiens
aaacugccuuggcuucagggg

SEQ ID NO: 760511 - RNA, 20 nt, Homo sapiens
aaacugcucccaucauuccu

SEQ ID NO: 760512 - RNA, 13 nt, Homo sapiens
aaacugcuuugag

SEQ ID NO: 760513 - RNA, 23 nt, Homo sapiens
aaacugggauuaagaaaccuugc

SEQ ID NO: 760514 - RNA, 14 nt, Homo sapiens
aaacugucuugccc

SEQ ID NO: 760515 - RNA, 15 nt, Homo sapiens
aaacugugaagcauu

SEQ ID NO: 760516 - RNA, 23 nt, Homo sapiens
aaacuguucucuauuagacuuua

SEQ ID NO: 760517 - RNA, 15 nt, Homo sapiens
aaacuuaacauucau

SEQ ID NO: 760518 - RNA, 22 nt, Homo sapiens
aaacuuaagggaaaaguucucc

SEQ ID NO: 760519 - RNA, 13 nt, Homo sapiens
aaacuuacuuugg

SEQ ID NO: 760520 - RNA, 21 nt, Homo sapiens
aaacuuagcaucuaauuucaa

SEQ ID NO: 760521 - RNA, 17 nt, Homo sapiens
aaacuucacuaaugauc

SEQ ID NO: 760522 - RNA, 21 nt, Homo sapiens
aaacuucaguuucacagaaaa

SEQ ID NO: 760523 - RNA, 15 nt, Homo sapiens
aaacuuccagguucc

SEQ ID NO: 760524 - RNA, 23 nt, Homo sapiens
aaacuugaaguagguagcaacgu

SEQ ID NO: 760525 - RNA, 16 nt, Homo sapiens
aaacuugcaucacuua

SEQ ID NO: 760526 - RNA, 15 nt, Homo sapiens
aaacuuuaucacuua

SEQ ID NO: 760527 - RNA, 17 nt, Homo sapiens
aaacuuuaucacuuaaa

SEQ ID NO: 760528 - RNA, 22 nt, Homo sapiens
aaacuuucccuuggcuguuaag

SEQ ID NO: 760529 - RNA, 18 nt, Homo sapiens
aaacuuuggaaccagacu

SEQ ID NO: 760530 - RNA, 18 nt, Homo sapiens
aaacuuuggguacuuaua

SEQ ID NO: 760531 - RNA, 16 nt, Homo sapiens
aaacuuuuaacugaga

SEQ ID NO: 760532 - RNA, 17 nt, Homo sapiens
aaacuuuucugcugaua

SEQ ID NO: 760533 - RNA, 22 nt, Homo sapiens
aaacuuuuguuuagagcccucc

SEQ ID NO: 760534 - RNA, 19 nt, Homo sapiens
aaacuuuuuuucuguacca

SEQ ID NO: 760535 - RNA, 22 nt, Homo sapiens
cagugccuucucucagcuccca

SEQ ID NO: 760536 - RNA, 14 nt, Homo sapiens
cagugcugcucucc

SEQ ID NO: 760537 - RNA, 18 nt, Homo sapiens
cagugcugggaccagagc

SEQ ID NO: 760538 - RNA, 13 nt, Homo sapiens
cagugcuguccaa

SEQ ID NO: 760539 - RNA, 21 nt, Homo sapiens
cagugcuucccgagugagcau

SEQ ID NO: 760540 - RNA, 15 nt, Homo sapiens
caguggacucuucca

SEQ ID NO: 760541 - RNA, 17 nt, Homo sapiens
caguggauugcauuucu

SEQ ID NO: 760542 - RNA, 18 nt, Homo sapiens
caguggcagacaaacaga

SEQ ID NO: 760543 - RNA, 16 nt, Homo sapiens
caguggcgcaugccug

SEQ ID NO: 760544 - RNA, 16 nt, Homo sapiens
caguggcgcgaucuca

SEQ ID NO: 760545 - RNA, 16 nt, Homo sapiens
caguggcgugaucuca

SEQ ID NO: 760546 - RNA, 14 nt, Homo sapiens
caguggcuaccuac

SEQ ID NO: 760547 - RNA, 18 nt, Homo sapiens
caguggcuggaucuguga

SEQ ID NO: 760548 - RNA, 22 nt, Homo sapiens
cagugggcauagucagugucgu

SEQ ID NO: 760549 - RNA, 21 nt, Homo sapiens
cagugggcguugggagccuag

SEQ ID NO: 760550 - RNA, 21 nt, Homo sapiens
cagugguagagucauguuugc

SEQ ID NO: 760551 - RNA, 14 nt, Homo sapiens
caguggugccauca

SEQ ID NO: 760552 - RNA, 14 nt, Homo sapiens
caguggugcucaau

SEQ ID NO: 760553 - RNA, 22 nt, Homo sapiens
cagugguggugcccaccuguga

SEQ ID NO: 760554 - RNA, 13 nt, Homo sapiens
caguguacaugga

SEQ ID NO: 760555 - RNA, 14 nt, Homo sapiens
caguguacauggaa

SEQ ID NO: 760556 - RNA, 21 nt, Homo sapiens
caguguauguacuaagcagua

SEQ ID NO: 760557 - RNA, 14 nt, Homo sapiens
cagugucacucugu

SEQ ID NO: 760558 - RNA, 22 nt, Homo sapiens
cagugucguuuauauuguagca

SEQ ID NO: 760559 - RNA, 23 nt, Homo sapiens
cagugucguuuauauuguagcag

SEQ ID NO: 760560 - RNA, 22 nt, Homo sapiens
cagugucucgaugccauaauca

SEQ ID NO: 760561 - RNA, 13 nt, Homo sapiens
cagugugcaaggg

SEQ ID NO: 760562 - RNA, 22 nt, Homo sapiens
caguguggcccagggaagccaa

SEQ ID NO: 760563 - RNA, 20 nt, Homo sapiens
caguguuauuaaugacaaag

SEQ ID NO: 760564 - RNA, 12 nt, Homo sapiens
caguguuuacaa

SEQ ID NO: 760565 - RNA, 13 nt, Homo sapiens
caguuaaacugug

SEQ ID NO: 760566 - RNA, 19 nt, Homo sapiens
caguuaaagauuauuguga

SEQ ID NO: 760567 - RNA, 22 nt, Homo sapiens
caguuaaaguagaucaccuccu

SEQ ID NO: 760568 - RNA, 22 nt, Homo sapiens
caguuacagagugaacacucua

SEQ ID NO: 760569 - RNA, 18 nt, Homo sapiens
caguuauaaauacauaua

SEQ ID NO: 760570 - RNA, 17 nt, Homo sapiens
caguuauagaaaaucua

SEQ ID NO: 760571 - RNA, 15 nt, Homo sapiens
caguuaucacacuuu

SEQ ID NO: 760572 - RNA, 17 nt, Homo sapiens
caguucacuugcccuga

SEQ ID NO: 760573 - RNA, 11 nt, Homo sapiens
caguucagcuu

SEQ ID NO: 760574 - RNA, 17 nt, Homo sapiens
caguucagguaugugug

SEQ ID NO: 760575 - RNA, 23 nt, Homo sapiens
caguuccaccaagaaaugaacuu

SEQ ID NO: 760576 - RNA, 18 nt, Homo sapiens
caguucuuugggccagac

SEQ ID NO: 760577 - RNA, 21 nt, Homo sapiens
caguugagagggugcagucca

SEQ ID NO: 760578 - RNA, 14 nt, Homo sapiens
caguugcagaauug

SEQ ID NO: 760579 - RNA, 14 nt, Homo sapiens
caguugcugugaac

SEQ ID NO: 760580 - RNA, 19 nt, Homo sapiens
caguuggacucucagggau

SEQ ID NO: 760581 - RNA, 17 nt, Homo sapiens
caguuggcagaaaggau

SEQ ID NO: 760582 - RNA, 14 nt, Homo sapiens
caguugggacucag

SEQ ID NO: 760583 - RNA, 19 nt, Homo sapiens
caguuguccuuaaauuugu

SEQ ID NO: 760584 - RNA, 15 nt, Homo sapiens
caguuguguugacac

SEQ ID NO: 760585 - RNA, 12 nt, Homo sapiens
caguuguuaaaa

SEQ ID NO: 760586 - RNA, 19 nt, Homo sapiens
caguuguuaaaaugagcau

SEQ ID NO: 760587 - RNA, 21 nt, Homo sapiens
caguuguuugcuucuugccau

SEQ ID NO: 760588 - RNA, 19 nt, Homo sapiens
caguuguuuguuuuugcuu

SEQ ID NO: 760589 - RNA, 13 nt, Homo sapiens
caguuuaaugucu

SEQ ID NO: 760590 - RNA, 17 nt, Homo sapiens
caguuuauacccuaguu

SEQ ID NO: 760591 - RNA, 16 nt, Homo sapiens
caguuuauuuccacua

SEQ ID NO: 760592 - RNA, 19 nt, Homo sapiens
caguuucuaggcaccucag

SEQ ID NO: 760593 - RNA, 23 nt, Homo sapiens
caguuuuaccucuucucucucag

SEQ ID NO: 760594 - RNA, 14 nt, Homo sapiens
caguuuuuggcaaa

SEQ ID NO: 760595 - RNA, 20 nt, Homo sapiens
caguuuuuuucuuuguguag

SEQ ID NO: 760596 - RNA, 22 nt, Homo sapiens
cauaaaaaauaaaguaccacac

SEQ ID NO: 760597 - RNA, 17 nt, Homo sapiens
cauaaaaauaaccaaaa

SEQ ID NO: 760598 - RNA, 18 nt, Homo sapiens
cauaaaacaaaaccaagc

SEQ ID NO: 760599 - RNA, 13 nt, Homo sapiens
cauaaaacagcau

SEQ ID NO: 760600 - RNA, 14 nt, Homo sapiens
cauaaaaucuguga

SEQ ID NO: 760601 - RNA, 21 nt, Homo sapiens
cauaaacaacuuaauguucug

SEQ ID NO: 760602 - RNA, 13 nt, Homo sapiens
cauaaacugccaa

SEQ ID NO: 760603 - RNA, 15 nt, Homo sapiens
cauaaauacugucaa

SEQ ID NO: 760604 - RNA, 19 nt, Homo sapiens
cauaaaugaagcagcuuua

SEQ ID NO: 760605 - RNA, 16 nt, Homo sapiens
cauaaauugguauaau

SEQ ID NO: 760606 - RNA, 13 nt, Homo sapiens
cauaaccaaagag

SEQ ID NO: 760607 - RNA, 14 nt, Homo sapiens
cauaacccaugaag

SEQ ID NO: 760608 - RNA, 14 nt, Homo sapiens
cauaaccugucuca

SEQ ID NO: 760609 - RNA, 19 nt, Homo sapiens
cauaacuuagagacuuuag

SEQ ID NO: 760610 - RNA, 15 nt, Homo sapiens
cauaacuugcugaau

SEQ ID NO: 760611 - RNA, 19 nt, Homo sapiens
cauaacuugcugaauuuca

SEQ ID NO: 760612 - RNA, 14 nt, Homo sapiens
cauaagaaagcacu

SEQ ID NO: 760613 - RNA, 15 nt, Homo sapiens
cauaagaaagcacua

SEQ ID NO: 760614 - RNA, 16 nt, Homo sapiens
cauaagaaagcacuau

SEQ ID NO: 760615 - RNA, 21 nt, Homo sapiens
cauaagaauuuuuuauaagua

SEQ ID NO: 760616 - RNA, 17 nt, Homo sapiens
cauaagauaaaugugcu

SEQ ID NO: 760617 - RNA, 16 nt, Homo sapiens
cauaagcccaguucau

SEQ ID NO: 760618 - RNA, 16 nt, Homo sapiens
cauaaggauucaggga

SEQ ID NO: 760619 - RNA, 22 nt, Homo sapiens
cauaaggccggacgcaucucaa

SEQ ID NO: 760620 - RNA, 16 nt, Homo sapiens
cauaaggcuucaaaau

SEQ ID NO: 760621 - RNA, 11 nt, Homo sapiens
caggcauuugc

SEQ ID NO: 760622 - RNA, 17 nt, Homo sapiens
caggccaaggcuaugaa

SEQ ID NO: 760623 - RNA, 23 nt, Homo sapiens
caggccaccccgcugauggagcc

SEQ ID NO: 760624 - RNA, 17 nt, Homo sapiens
caggccacuggggacag

SEQ ID NO: 760625 - RNA, 14 nt, Homo sapiens
caggccagcccagc

SEQ ID NO: 760626 - RNA, 17 nt, Homo sapiens
caggccaugugagccac

SEQ ID NO: 760627 - RNA, 20 nt, Homo sapiens
caggccauugucccugaaga

SEQ ID NO: 760628 - RNA, 13 nt, Homo sapiens
caggcccaucuca

SEQ ID NO: 760629 - RNA, 17 nt, Homo sapiens
caggccccgcuugucca

SEQ ID NO: 760630 - RNA, 13 nt, Homo sapiens
caggcccuguggc

SEQ ID NO: 760631 - RNA, 23 nt, Homo sapiens
caggccgagagcagacaccagca

SEQ ID NO: 760632 - RNA, 17 nt, Homo sapiens
caggccgggguggagca

SEQ ID NO: 760633 - RNA, 18 nt, Homo sapiens
caggccuaagacauguga

SEQ ID NO: 760634 - RNA, 20 nt, Homo sapiens
caggccucucggugcuccau

SEQ ID NO: 760635 - RNA, 14 nt, Homo sapiens
caggccugaccuca

SEQ ID NO: 760636 - RNA, 16 nt, Homo sapiens
caggccugggacccag

SEQ ID NO: 760637 - RNA, 18 nt, Homo sapiens
caggccuuaccgcucugu

SEQ ID NO: 760638 - RNA, 16 nt, Homo sapiens
caggcggggugggcag

SEQ ID NO: 760639 - RNA, 16 nt, Homo sapiens
caggcgugguggcaca

SEQ ID NO: 760640 - RNA, 15 nt, Homo sapiens
caggcucaugccauc

SEQ ID NO: 760641 - RNA, 14 nt, Homo sapiens
caggcucucgcaca

SEQ ID NO: 760642 - RNA, 23 nt, Homo sapiens
caggcucugcccugcccuagcuc

SEQ ID NO: 760643 - RNA, 13 nt, Homo sapiens
caggcucuucucc

SEQ ID NO: 760644 - RNA, 18 nt, Homo sapiens
caggcugagugagccaca

SEQ ID NO: 760645 - RNA, 17 nt, Homo sapiens
caggcuggagugcaaug

SEQ ID NO: 760646 - RNA, 20 nt, Homo sapiens
caggcuggagugcaaugaca

SEQ ID NO: 760647 - RNA, 17 nt, Homo sapiens
caggcuggagugcagua

SEQ ID NO: 760648 - RNA, 23 nt, Homo sapiens
caggcuggagugcagugagcuau

SEQ ID NO: 760649 - RNA, 18 nt, Homo sapiens
caggcuggagugcagugc

SEQ ID NO: 760650 - RNA, 15 nt, Homo sapiens
caggcuggccagucc

SEQ ID NO: 760651 - RNA, 17 nt, Homo sapiens
caggcuggcuguuggcc

SEQ ID NO: 760652 - RNA, 19 nt, Homo sapiens
caggcugggcaucauagca

SEQ ID NO: 760653 - RNA, 19 nt, Homo sapiens
caggcugggccauguccaa

SEQ ID NO: 760654 - RNA, 23 nt, Homo sapiens
caggcugggccauguccaaagag

SEQ ID NO: 760655 - RNA, 19 nt, Homo sapiens
caggcuggucucaaacucc

SEQ ID NO: 760656 - RNA, 19 nt, Homo sapiens
caggcuguucugcacugaa

SEQ ID NO: 760657 - RNA, 15 nt, Homo sapiens
caggcuucugagcac

SEQ ID NO: 760658 - RNA, 23 nt, Homo sapiens
caggcuucugucaauuucauuau

SEQ ID NO: 760659 - RNA, 14 nt, Homo sapiens
caggcuuucucugg

SEQ ID NO: 760660 - RNA, 21 nt, Homo sapiens
caggcuuuuuuccagacucua

SEQ ID NO: 760661 - RNA, 18 nt, Homo sapiens
cagggaaagcccguguca

SEQ ID NO: 760662 - RNA, 15 nt, Homo sapiens
cagggaagcccagcu

SEQ ID NO: 760663 - RNA, 12 nt, Homo sapiens
cagggaagggag

SEQ ID NO: 760664 - RNA, 19 nt, Homo sapiens
cagggacacuaucacucau

SEQ ID NO: 760665 - RNA, 11 nt, Homo sapiens
cagggacccac

SEQ ID NO: 760666 - RNA, 17 nt, Homo sapiens
cagggacccacuucaca

SEQ ID NO: 760667 - RNA, 20 nt, Homo sapiens
cagggacuccaugcugccag

SEQ ID NO: 760668 - RNA, 22 nt, Homo sapiens
cagggagaaguagcuaguagca

SEQ ID NO: 760669 - RNA, 21 nt, Homo sapiens
cagggagacgguuuccaggga

SEQ ID NO: 760670 - RNA, 20 nt, Homo sapiens
cagggagaggucaccagcug

SEQ ID NO: 760671 - RNA, 22 nt, Homo sapiens
cagggagcucuggggacagcuu

SEQ ID NO: 760672 - RNA, 19 nt, Homo sapiens
cagggagugcacauaucca

SEQ ID NO: 760673 - RNA, 20 nt, Homo sapiens
cagggaugauggcagagcca

SEQ ID NO: 760674 - RNA, 21 nt, Homo sapiens
cagggauuaaccucugcacua

SEQ ID NO: 760675 - RNA, 19 nt, Homo sapiens
cagggauuuagcccaugac

SEQ ID NO: 760676 - RNA, 13 nt, Homo sapiens
cagggcacuacau

SEQ ID NO: 760677 - RNA, 14 nt, Homo sapiens
cagggcacuacaua

SEQ ID NO: 760678 - RNA, 23 nt, Homo sapiens
cagggcacuacauaauugcuguu

SEQ ID NO: 760679 - RNA, 16 nt, Homo sapiens
cagggcacugugccug

SEQ ID NO: 760680 - RNA, 17 nt, Homo sapiens
cagggcacugugccuga

SEQ ID NO: 760681 - RNA, 18 nt, Homo sapiens
cagggcagcagaucugua

SEQ ID NO: 760682 - RNA, 22 nt, Homo sapiens
cagggcagccuccaccuugcuc

SEQ ID NO: 760683 - RNA, 14 nt, Homo sapiens
cagggcauugcuca

SEQ ID NO: 760684 - RNA, 14 nt, Homo sapiens
cagggccacucaac

SEQ ID NO: 760685 - RNA, 19 nt, Homo sapiens
cagggccauggcucagggu

SEQ ID NO: 760686 - RNA, 14 nt, Homo sapiens
cagggcccaagucc

SEQ ID NO: 760687 - RNA, 13 nt, Homo sapiens
cagggcccaggca

SEQ ID NO: 760688 - RNA, 13 nt, Homo sapiens
cagggcucugcag

SEQ ID NO: 760689 - RNA, 14 nt, Homo sapiens
cagggcuggucuuu

SEQ ID NO: 760690 - RNA, 20 nt, Homo sapiens
cagggcuggucuuuuaggac

SEQ ID NO: 760691 - RNA, 23 nt, Homo sapiens
cagggcugucuucguauucccau

SEQ ID NO: 760692 - RNA, 11 nt, Homo sapiens
cagggcuguga

SEQ ID NO: 760693 - RNA, 12 nt, Homo sapiens
cagggcugugau

SEQ ID NO: 760694 - RNA, 18 nt, Homo sapiens
caggggaaaaugaagguu

SEQ ID NO: 760695 - RNA, 14 nt, Homo sapiens
caggggcaaagggc

SEQ ID NO: 760696 - RNA, 14 nt, Homo sapiens
caggggccugcaga

SEQ ID NO: 760697 - RNA, 18 nt, Homo sapiens
caggggggagaaguucuu

SEQ ID NO: 760698 - RNA, 23 nt, Homo sapiens
caggggggcugugccaaccuguu

SEQ ID NO: 760699 - RNA, 14 nt, Homo sapiens
caggggugcucacc

SEQ ID NO: 760700 - RNA, 17 nt, Homo sapiens
caggguaaaaggugcag

SEQ ID NO: 760701 - RNA, 13 nt, Homo sapiens
caggguaccucaa

SEQ ID NO: 760702 - RNA, 19 nt, Homo sapiens
caggguccagacccugaag

SEQ ID NO: 760703 - RNA, 18 nt, Homo sapiens
caggguccgcaccagcug

SEQ ID NO: 760704 - RNA, 20 nt, Homo sapiens
caggguccucuucugggccu

SEQ ID NO: 760705 - RNA, 15 nt, Homo sapiens
caggguccugugccu

SEQ ID NO: 760706 - RNA, 17 nt, Homo sapiens
cagggucucgcucuguu

SEQ ID NO: 760707 - RNA, 20 nt, Homo sapiens
cagggucucgcucuguugcc

SEQ ID NO: 760708 - RNA, 21 nt, Homo sapiens
cagggucucgcucuguugccc

SEQ ID NO: 760709 - RNA, 14 nt, Homo sapiens
cagggucugggaca

SEQ ID NO: 760710 - RNA, 15 nt, Homo sapiens
auccgaggcaggguc

SEQ ID NO: 760711 - RNA, 19 nt, Homo sapiens
auccgauuccccuguagca

SEQ ID NO: 760712 - RNA, 13 nt, Homo sapiens
auccgcacuguaa

SEQ ID NO: 760713 - RNA, 17 nt, Homo sapiens
auccgcugccagccuug

SEQ ID NO: 760714 - RNA, 18 nt, Homo sapiens
auccgggagacugacacg

SEQ ID NO: 760715 - RNA, 20 nt, Homo sapiens
auccgguggccuauuccagg

SEQ ID NO: 760716 - RNA, 20 nt, Homo sapiens
auccguacauucaauguuua

SEQ ID NO: 760717 - RNA, 17 nt, Homo sapiens
auccguaguucccugaa

SEQ ID NO: 760718 - RNA, 16 nt, Homo sapiens
auccuaaauaauguua

SEQ ID NO: 760719 - RNA, 15 nt, Homo sapiens
auccuaacacauuau

SEQ ID NO: 760720 - RNA, 13 nt, Homo sapiens
auccuaacauuca

SEQ ID NO: 760721 - RNA, 23 nt, Homo sapiens
auccuaagcgaagaugauuucag

SEQ ID NO: 760722 - RNA, 17 nt, Homo sapiens
auccuaguaauugccua

SEQ ID NO: 760723 - RNA, 18 nt, Homo sapiens
auccuaguaauugccuag

SEQ ID NO: 760724 - RNA, 13 nt, Homo sapiens
auccuagucuuca

SEQ ID NO: 760725 - RNA, 17 nt, Homo sapiens
auccucacccagcaccc

SEQ ID NO: 760726 - RNA, 13 nt, Homo sapiens
auccucacugugg

SEQ ID NO: 760727 - RNA, 15 nt, Homo sapiens
auccuccacagagag

SEQ ID NO: 760728 - RNA, 15 nt, Homo sapiens
auccuccaguaccuu

SEQ ID NO: 760729 - RNA, 16 nt, Homo sapiens
auccucccaccucagc

SEQ ID NO: 760730 - RNA, 21 nt, Homo sapiens
auccuccccagcgccaucugu

SEQ ID NO: 760731 - RNA, 23 nt, Homo sapiens
auccuccccagcgccaucugugu

SEQ ID NO: 760732 - RNA, 16 nt, Homo sapiens
auccucccuacuucca

SEQ ID NO: 760733 - RNA, 16 nt, Homo sapiens
auccuccuugucuuaa

SEQ ID NO: 760734 - RNA, 21 nt, Homo sapiens
auccucucccauggagacaag

SEQ ID NO: 760735 - RNA, 13 nt, Homo sapiens
auccugaccagcu

SEQ ID NO: 760736 - RNA, 23 nt, Homo sapiens
auccugagcagugccagcuuucu

SEQ ID NO: 760737 - RNA, 13 nt, Homo sapiens
auccugauuccuc

SEQ ID NO: 760738 - RNA, 15 nt, Homo sapiens
auccugcucuucugu

SEQ ID NO: 760739 - RNA, 19 nt, Homo sapiens
auccugcugaccucacugu

SEQ ID NO: 760740 - RNA, 14 nt, Homo sapiens
auccuggaaggaca

SEQ ID NO: 760741 - RNA, 20 nt, Homo sapiens
auccuggaaggacacaguga

SEQ ID NO: 760742 - RNA, 23 nt, Homo sapiens
auccuggaaggacacagugauga

SEQ ID NO: 760743 - RNA, 19 nt, Homo sapiens
auccuggggcagcacuccc

SEQ ID NO: 760744 - RNA, 22 nt, Homo sapiens
auccugggggacccaauguagg

SEQ ID NO: 760745 - RNA, 21 nt, Homo sapiens
auccuggguacugaaagccuu

SEQ ID NO: 760746 - RNA, 22 nt, Homo sapiens
auccugguuucauaacuuccug

SEQ ID NO: 760747 - RNA, 17 nt, Homo sapiens
auccugucucuaaaaag

SEQ ID NO: 760748 - RNA, 23 nt, Homo sapiens
auccugugcaauagacacauaca

SEQ ID NO: 760749 - RNA, 17 nt, Homo sapiens
auccuuaaaacaauucu

SEQ ID NO: 760750 - RNA, 22 nt, Homo sapiens
auccuuacagcuaucuguagaa

SEQ ID NO: 760751 - RNA, 13 nt, Homo sapiens
auccuuauuccuc

SEQ ID NO: 760752 - RNA, 13 nt, Homo sapiens
auccuuccaacau

SEQ ID NO: 760753 - RNA, 15 nt, Homo sapiens
auccuucuacuuguc

SEQ ID NO: 760754 - RNA, 14 nt, Homo sapiens
auccuugcaggugg

SEQ ID NO: 760755 - RNA, 13 nt, Homo sapiens
auccuuuacuguu

SEQ ID NO: 760756 - RNA, 15 nt, Homo sapiens
auccuuuacuguuag

SEQ ID NO: 760757 - RNA, 19 nt, Homo sapiens
auccuuuagugcacccagu

SEQ ID NO: 760758 - RNA, 14 nt, Homo sapiens
auccuuucaagaca

SEQ ID NO: 760759 - RNA, 20 nt, Homo sapiens
auccuuucaagacagaaaga

SEQ ID NO: 760760 - RNA, 11 nt, Homo sapiens
aucgacaagaa

SEQ ID NO: 760761 - RNA, 20 nt, Homo sapiens
aucgacaccauccuggcuaa

SEQ ID NO: 760762 - RNA, 13 nt, Homo sapiens
aucgagaccaucc

SEQ ID NO: 760763 - RNA, 22 nt, Homo sapiens
aucgagauguccauagucaaau

SEQ ID NO: 760764 - RNA, 14 nt, Homo sapiens
aucgaucaugaugu

SEQ ID NO: 760765 - RNA, 17 nt, Homo sapiens
aucgcugaugcagacac

SEQ ID NO: 760766 - RNA, 23 nt, Homo sapiens
aucggaacagcuccuuacucuga

SEQ ID NO: 760767 - RNA, 19 nt, Homo sapiens
aucggcuggggacugcuac

SEQ ID NO: 760768 - RNA, 16 nt, Homo sapiens
aucgggagcagugucu

SEQ ID NO: 760769 - RNA, 19 nt, Homo sapiens
aucggguaagaugcuccug

SEQ ID NO: 760770 - RNA, 19 nt, Homo sapiens
aucguccaccccagugugc

SEQ ID NO: 760771 - RNA, 20 nt, Homo sapiens
aucgugugugccuugggucu

SEQ ID NO: 760772 - RNA, 21 nt, Homo sapiens
aucguucugggucagcuugaa

SEQ ID NO: 760773 - RNA, 18 nt, Homo sapiens
aucuaaaauuuguaauau

SEQ ID NO: 760774 - RNA, 13 nt, Homo sapiens
aucuaaugaaugu

SEQ ID NO: 760775 - RNA, 17 nt, Homo sapiens
aucuaaugaauguucca

SEQ ID NO: 760776 - RNA, 18 nt, Homo sapiens
aucuacaaaaaacaacaa

SEQ ID NO: 760777 - RNA, 13 nt, Homo sapiens
aucuacacauguu

SEQ ID NO: 760778 - RNA, 13 nt, Homo sapiens
aucuacacccacc

SEQ ID NO: 760779 - RNA, 11 nt, Homo sapiens
aucuaccagca

SEQ ID NO: 760780 - RNA, 14 nt, Homo sapiens
aucuaccauugaag

SEQ ID NO: 760781 - RNA, 13 nt, Homo sapiens
aucuacccugcug

SEQ ID NO: 760782 - RNA, 15 nt, Homo sapiens
aucuaccugccucag

SEQ ID NO: 760783 - RNA, 21 nt, Homo sapiens
aucuacuacaaacuucaaaga

SEQ ID NO: 760784 - RNA, 14 nt, Homo sapiens
aucuagaagacugu

SEQ ID NO: 760785 - RNA, 15 nt, Homo sapiens
aucuagaagacuguc

SEQ ID NO: 760786 - RNA, 17 nt, Homo sapiens
aucuagagaaggcauuu

SEQ ID NO: 760787 - RNA, 17 nt, Homo sapiens
aucuagcucuaguucaa

SEQ ID NO: 760788 - RNA, 20 nt, Homo sapiens
aucuaguguguccugugaca

SEQ ID NO: 760789 - RNA, 17 nt, Homo sapiens
aucuaguuuacagaaaa

SEQ ID NO: 760790 - RNA, 18 nt, Homo sapiens
aucuauaaaauagauaua

SEQ ID NO: 760791 - RNA, 19 nt, Homo sapiens
aucuauaaagaagaacuug

SEQ ID NO: 760792 - RNA, 20 nt, Homo sapiens
aucuauauauguguauguac

SEQ ID NO: 760793 - RNA, 14 nt, Homo sapiens
aucuaucugcuuau

SEQ ID NO: 760794 - RNA, 19 nt, Homo sapiens
aucuaugagcugacaucuc

SEQ ID NO: 760795 - RNA, 15 nt, Homo sapiens
aucuauuauuacaca

SEQ ID NO: 760796 - RNA, 12 nt, Homo sapiens
aucuauugcuca

SEQ ID NO: 760797 - RNA, 18 nt, Homo sapiens
aucuauuuuugugugcug

SEQ ID NO: 760798 - RNA, 15 nt, Homo sapiens
aucucaaagaaggca

SEQ ID NO: 760799 - RNA, 18 nt, Homo sapiens
aucucaaguauaugucau

SEQ ID NO: 760800 - RNA, 15 nt, Homo sapiens
aucucaauaacaaac

SEQ ID NO: 760801 - RNA, 21 nt, Homo sapiens
aucucacuggaugcaaagaaa

SEQ ID NO: 760802 - RNA, 12 nt, Homo sapiens
aucucagaaaag

SEQ ID NO: 760803 - RNA, 16 nt, Homo sapiens
aucucagaaaagcccu

SEQ ID NO: 760804 - RNA, 22 nt, Homo sapiens
aucucagaaaauauuaaggaaa

SEQ ID NO: 760805 - RNA, 15 nt, Homo sapiens
aucucagccuaccau

SEQ ID NO: 760806 - RNA, 22 nt, Homo sapiens
aucucaggagcuugcaagaagc

SEQ ID NO: 760807 - RNA, 19 nt, Homo sapiens
aucucauacugucugggau

SEQ ID NO: 760808 - RNA, 15 nt, Homo sapiens
aucucauuccacugu

SEQ ID NO: 760809 - RNA, 23 nt, Homo sapiens
aucucauucccagagucagagga

SEQ ID NO: 760810 - RNA, 22 nt, Homo sapiens
aucucauuuuacacaaagggaa

SEQ ID NO: 760811 - RNA, 17 nt, Homo sapiens
aucuccaggcuuucaau

SEQ ID NO: 760812 - RNA, 22 nt, Homo sapiens
aucuccagggaguccccucccc

SEQ ID NO: 760813 - RNA, 15 nt, Homo sapiens
aucucccagcaagac

SEQ ID NO: 760814 - RNA, 13 nt, Homo sapiens
aucuccugacaga

SEQ ID NO: 760815 - RNA, 20 nt, Homo sapiens
aucucgccaccccuccuucc

SEQ ID NO: 760816 - RNA, 18 nt, Homo sapiens
aucucuacuaaaaacaca

SEQ ID NO: 760817 - RNA, 19 nt, Homo sapiens
aucucuacugaaaauacaa

SEQ ID NO: 760818 - RNA, 19 nt, Homo sapiens
aucucuacugaaaguacaa

SEQ ID NO: 760819 - RNA, 20 nt, Homo sapiens
aucucucaaaacaauauuac

SEQ ID NO: 760820 - RNA, 22 nt, Homo sapiens
aucucucagccccaaacaccca

SEQ ID NO: 760821 - RNA, 22 nt, Homo sapiens
aucucucccuccccugccauuu

SEQ ID NO: 760822 - RNA, 18 nt, Homo sapiens
aucucucugcagcugccg

SEQ ID NO: 760823 - RNA, 13 nt, Homo sapiens
aucucugacuuaa

SEQ ID NO: 760824 - RNA, 13 nt, Homo sapiens
aucucugccauau

SEQ ID NO: 760825 - RNA, 23 nt, Homo sapiens
caaagaucaaaauaaaaagugac

SEQ ID NO: 760826 - RNA, 17 nt, Homo sapiens
caaagauccccaaaaca

SEQ ID NO: 760827 - RNA, 22 nt, Homo sapiens
caaagaucuguccucagccuug

SEQ ID NO: 760828 - RNA, 23 nt, Homo sapiens
caaagauguuaugguguuuagau

SEQ ID NO: 760829 - RNA, 16 nt, Homo sapiens
caaagauuaaaugugu

SEQ ID NO: 760830 - RNA, 18 nt, Homo sapiens
caaagcaaauuucuauca

SEQ ID NO: 760831 - RNA, 12 nt, Homo sapiens
caaagcacuguu

SEQ ID NO: 760832 - RNA, 11 nt, Homo sapiens
caaagcacuuu

SEQ ID NO: 760833 - RNA, 16 nt, Homo sapiens
caaagcaggauuauua

SEQ ID NO: 760834 - RNA, 22 nt, Homo sapiens
caaagcaucccucuuagucuag

SEQ ID NO: 760835 - RNA, 18 nt, Homo sapiens
caaagccacugacugaga

SEQ ID NO: 760836 - RNA, 18 nt, Homo sapiens
caaagccuucauugccuu

SEQ ID NO: 760837 - RNA, 14 nt, Homo sapiens
caaagccuuuccag

SEQ ID NO: 760838 - RNA, 15 nt, Homo sapiens
caaagccuuuccaga

SEQ ID NO: 760839 - RNA, 20 nt, Homo sapiens
caaagcgagaucccaucucu

SEQ ID NO: 760840 - RNA, 22 nt, Homo sapiens
caaagcguuucuuuacuucuca

SEQ ID NO: 760841 - RNA, 14 nt, Homo sapiens
caaagcuaccugug

SEQ ID NO: 760842 - RNA, 23 nt, Homo sapiens
caaagcuuggugucuuggcacug

SEQ ID NO: 760843 - RNA, 15 nt, Homo sapiens
caaagcuuuccugcc

SEQ ID NO: 760844 - RNA, 18 nt, Homo sapiens
caaaggaacacugacauc

SEQ ID NO: 760845 - RNA, 18 nt, Homo sapiens
caaaggaaggacccugag

SEQ ID NO: 760846 - RNA, 18 nt, Homo sapiens
caaaggagaagcacagcu

SEQ ID NO: 760847 - RNA, 19 nt, Homo sapiens
caaaggcagagagucagac

SEQ ID NO: 760848 - RNA, 17 nt, Homo sapiens
caaagggauguucacug

SEQ ID NO: 760849 - RNA, 14 nt, Homo sapiens
caaaggguuaggac

SEQ ID NO: 760850 - RNA, 22 nt, Homo sapiens
caaaggugccucauagcauagc

SEQ ID NO: 760851 - RNA, 14 nt, Homo sapiens
caaaggugcuaaau

SEQ ID NO: 760852 - RNA, 15 nt, Homo sapiens
caaagguuacaugug

SEQ ID NO: 760853 - RNA, 16 nt, Homo sapiens
caaagguuacauguga

SEQ ID NO: 760854 - RNA, 14 nt, Homo sapiens
caaaguaucuaaca

SEQ ID NO: 760855 - RNA, 18 nt, Homo sapiens
caaaguccacuuuacuca

SEQ ID NO: 760856 - RNA, 19 nt, Homo sapiens
caaaguccucugcuccagc

SEQ ID NO: 760857 - RNA, 13 nt, Homo sapiens
caaaguccuuaac

SEQ ID NO: 760858 - RNA, 16 nt, Homo sapiens
caaagugacuauucag

SEQ ID NO: 760859 - RNA, 19 nt, Homo sapiens
caaagugcugagauuacag

SEQ ID NO: 760860 - RNA, 21 nt, Homo sapiens
caaagugcugcuggaaguaga

SEQ ID NO: 760861 - RNA, 21 nt, Homo sapiens
caaagugguaaauacugugaa

SEQ ID NO: 760862 - RNA, 19 nt, Homo sapiens
caaaguuuggauuguauca

SEQ ID NO: 760863 - RNA, 22 nt, Homo sapiens
caaauaaaacuagugacagcuu

SEQ ID NO: 760864 - RNA, 14 nt, Homo sapiens
caaauaaaugacaa

SEQ ID NO: 760865 - RNA, 20 nt, Homo sapiens
caaauaaaugauuauauuca

SEQ ID NO: 760866 - RNA, 13 nt, Homo sapiens
caaauaaguggaa

SEQ ID NO: 760867 - RNA, 12 nt, Homo sapiens
caaauaauagca

SEQ ID NO: 760868 - RNA, 21 nt, Homo sapiens
caaauaauagcaaugguggug

SEQ ID NO: 760869 - RNA, 18 nt, Homo sapiens
caaauaaugucucuguga

SEQ ID NO: 760870 - RNA, 23 nt, Homo sapiens
caaauacaaucagcccagugcaa

SEQ ID NO: 760871 - RNA, 13 nt, Homo sapiens
caaauagccacaa

SEQ ID NO: 760872 - RNA, 12 nt, Homo sapiens
caaauauguaug

SEQ ID NO: 760873 - RNA, 16 nt, Homo sapiens
caaauauuguugacaa

SEQ ID NO: 760874 - RNA, 18 nt, Homo sapiens
caaaucagaaacuuguga

SEQ ID NO: 760875 - RNA, 17 nt, Homo sapiens
caaaucauuuguuuaaa

SEQ ID NO: 760876 - RNA, 17 nt, Homo sapiens
caaauccucaccaucca

SEQ ID NO: 760877 - RNA, 18 nt, Homo sapiens
caaauccucccuacuucc

SEQ ID NO: 760878 - RNA, 19 nt, Homo sapiens
caaaucuaccacuguauga

SEQ ID NO: 760879 - RNA, 12 nt, Homo sapiens
caaaucucaguu

SEQ ID NO: 760880 - RNA, 14 nt, Homo sapiens
caaaucucuuccac

SEQ ID NO: 760881 - RNA, 20 nt, Homo sapiens
caaaucugagggagcugagu

SEQ ID NO: 760882 - RNA, 16 nt, Homo sapiens
caaaucugccaagaga

SEQ ID NO: 760883 - RNA, 17 nt, Homo sapiens
caaaucuggaagccaaa

SEQ ID NO: 760884 - RNA, 18 nt, Homo sapiens
caaaucuuaacuugaagg

SEQ ID NO: 760885 - RNA, 14 nt, Homo sapiens
caaaugaaacuuua

SEQ ID NO: 760886 - RNA, 18 nt, Homo sapiens
caaaugacaugcacugac

SEQ ID NO: 760887 - RNA, 19 nt, Homo sapiens
caaaugaugauuaugaguu

SEQ ID NO: 760888 - RNA, 13 nt, Homo sapiens
caaaugcaaaaau

SEQ ID NO: 760889 - RNA, 20 nt, Homo sapiens
caaaugcacaucucauggca

SEQ ID NO: 760890 - RNA, 21 nt, Homo sapiens
caaaugccuccaagccauuca

SEQ ID NO: 760891 - RNA, 20 nt, Homo sapiens
caaaugccugguaccagagg

SEQ ID NO: 760892 - RNA, 12 nt, Homo sapiens
caaaugcuauau

SEQ ID NO: 760893 - RNA, 20 nt, Homo sapiens
caaaugcuucuaaauaugaa

SEQ ID NO: 760894 - RNA, 20 nt, Homo sapiens
caaaugcuuuggacuuuuga

SEQ ID NO: 760895 - RNA, 19 nt, Homo sapiens
caaauggacauaagacaga

SEQ ID NO: 760896 - RNA, 23 nt, Homo sapiens
caaauggcagaaccaaagcucaa

SEQ ID NO: 760897 - RNA, 17 nt, Homo sapiens
caaauggccaguuuucu

SEQ ID NO: 760898 - RNA, 16 nt, Homo sapiens
caaaugggacugaugu

SEQ ID NO: 760899 - RNA, 23 nt, Homo sapiens
caaaugggggaaaaguuagucaa

SEQ ID NO: 760900 - RNA, 15 nt, Homo sapiens
caaauggugcugaau

SEQ ID NO: 760901 - RNA, 13 nt, Homo sapiens
caaaugucuaagg

SEQ ID NO: 760902 - RNA, 19 nt, Homo sapiens
caaaugucuaucaacuuua

SEQ ID NO: 760903 - RNA, 12 nt, Homo sapiens
caaaugucuauu

SEQ ID NO: 760904 - RNA, 14 nt, Homo sapiens
caaaugugcugcuu

SEQ ID NO: 760905 - RNA, 14 nt, Homo sapiens
caaauuacaaaagg

SEQ ID NO: 760906 - RNA, 15 nt, Homo sapiens
caaauuacaaaaggc

SEQ ID NO: 760907 - RNA, 16 nt, Homo sapiens
caaauuagccauuuca

SEQ ID NO: 760908 - RNA, 15 nt, Homo sapiens
caaauuagugaacca

SEQ ID NO: 760909 - RNA, 18 nt, Homo sapiens
caaauuagugaaccaaaa

SEQ ID NO: 760910 - RNA, 18 nt, Homo sapiens
caaauuauaaaaaccaug

SEQ ID NO: 760911 - RNA, 15 nt, Homo sapiens
caaauuauucuaguc

SEQ ID NO: 760912 - RNA, 18 nt, Homo sapiens
caaauucauauucugucu

SEQ ID NO: 760913 - RNA, 16 nt, Homo sapiens
caaauucauggugcac

SEQ ID NO: 760914 - RNA, 18 nt, Homo sapiens
caaauucuucugaacuca

SEQ ID NO: 760915 - RNA, 22 nt, Homo sapiens
caaauugaaagagauccaggga

SEQ ID NO: 760916 - RNA, 19 nt, Homo sapiens
caaauuucuagucaaugug

SEQ ID NO: 760917 - RNA, 18 nt, Homo sapiens
caaauuucuaucagccuu

SEQ ID NO: 760918 - RNA, 12 nt, Homo sapiens
caaauuuguaca

SEQ ID NO: 760919 - RNA, 15 nt, Homo sapiens
caacaaaaagaacaa

SEQ ID NO: 760920 - RNA, 20 nt, Homo sapiens
caacaaagaaugggcuugaa

SEQ ID NO: 760921 - RNA, 14 nt, Homo sapiens
caacaacaacaaua

SEQ ID NO: 760922 - RNA, 13 nt, Homo sapiens
caacaacgacaca

SEQ ID NO: 760923 - RNA, 15 nt, Homo sapiens
caacaacgcggccac

SEQ ID NO: 760924 - RNA, 15 nt, Homo sapiens
caacaagaccaccac

SEQ ID NO: 760925 - RNA, 15 nt, Homo sapiens
caacaagucuugaaa

SEQ ID NO: 760926 - RNA, 23 nt, Homo sapiens
caacaauaaaguacuuuaccuaa

SEQ ID NO: 760927 - RNA, 23 nt, Homo sapiens
caacaauaaauauguauuaccuc

SEQ ID NO: 760928 - RNA, 14 nt, Homo sapiens
augaagcucacugg

SEQ ID NO: 760929 - RNA, 16 nt, Homo sapiens
augaaggcagagccau

SEQ ID NO: 760930 - RNA, 20 nt, Homo sapiens
augaaggcaggggcucagug

SEQ ID NO: 760931 - RNA, 13 nt, Homo sapiens
augaagggaaauu

SEQ ID NO: 760932 - RNA, 22 nt, Homo sapiens
augaagguaacuagaaagugag

SEQ ID NO: 760933 - RNA, 14 nt, Homo sapiens
augaagguaauauu

SEQ ID NO: 760934 - RNA, 15 nt, Homo sapiens
augaagugauucuaa

SEQ ID NO: 760935 - RNA, 15 nt, Homo sapiens
augaauaaaacacuc

SEQ ID NO: 760936 - RNA, 15 nt, Homo sapiens
augaauagacuaucu

SEQ ID NO: 760937 - RNA, 22 nt, Homo sapiens
augaaucaaucaauucauaucu

SEQ ID NO: 760938 - RNA, 21 nt, Homo sapiens
augaaucucaagauucaguag

SEQ ID NO: 760939 - RNA, 19 nt, Homo sapiens
augaaugaggucccaggca

SEQ ID NO: 760940 - RNA, 16 nt, Homo sapiens
augaauggggaccaug

SEQ ID NO: 760941 - RNA, 19 nt, Homo sapiens
augaauugcauuuuacuuu

SEQ ID NO: 760942 - RNA, 21 nt, Homo sapiens
augaauuuaucuuuaccaaaa

SEQ ID NO: 760943 - RNA, 18 nt, Homo sapiens
augacaaaagauacaaaa

SEQ ID NO: 760944 - RNA, 18 nt, Homo sapiens
augacaauuaaugauuaa

SEQ ID NO: 760945 - RNA, 10 nt, Homo sapiens
augacacugu

SEQ ID NO: 760946 - RNA, 19 nt, Homo sapiens
augacagcucuucuaagga

SEQ ID NO: 760947 - RNA, 18 nt, Homo sapiens
augacauaugacuugauc

SEQ ID NO: 760948 - RNA, 15 nt, Homo sapiens
augacauuuauucaa

SEQ ID NO: 760949 - RNA, 23 nt, Homo sapiens
augaccaguaaaggcugcugcua

SEQ ID NO: 760950 - RNA, 19 nt, Homo sapiens
augaccauuugacuguuca

SEQ ID NO: 760951 - RNA, 14 nt, Homo sapiens
augacccuuuucau

SEQ ID NO: 760952 - RNA, 13 nt, Homo sapiens
augaccuggagca

SEQ ID NO: 760953 - RNA, 18 nt, Homo sapiens
augaccuguauuuugcca

SEQ ID NO: 760954 - RNA, 23 nt, Homo sapiens
augaccuguuauuaccauuagca

SEQ ID NO: 760955 - RNA, 22 nt, Homo sapiens
augacgguaaguguucucauga

SEQ ID NO: 760956 - RNA, 20 nt, Homo sapiens
augacuauguuucuauucua

SEQ ID NO: 760957 - RNA, 13 nt, Homo sapiens
augacucacauga

SEQ ID NO: 760958 - RNA, 15 nt, Homo sapiens
augacugauuacuca

SEQ ID NO: 760959 - RNA, 16 nt, Homo sapiens
augacugcaccaacau

SEQ ID NO: 760960 - RNA, 19 nt, Homo sapiens
augacugcaccaacaucau

SEQ ID NO: 760961 - RNA, 21 nt, Homo sapiens
augacuguccaagugccacau

SEQ ID NO: 760962 - RNA, 22 nt, Homo sapiens
augacuucacccacgcauauac

SEQ ID NO: 760963 - RNA, 13 nt, Homo sapiens
augacuucaucaa

SEQ ID NO: 760964 - RNA, 19 nt, Homo sapiens
augacuuuauccugagucc

SEQ ID NO: 760965 - RNA, 17 nt, Homo sapiens
augagaaaagaaauuag

SEQ ID NO: 760966 - RNA, 20 nt, Homo sapiens
augagaaaguucucauuuaa

SEQ ID NO: 760967 - RNA, 15 nt, Homo sapiens
augagaaaugaugaa

SEQ ID NO: 760968 - RNA, 13 nt, Homo sapiens
augagaacauucc

SEQ ID NO: 760969 - RNA, 15 nt, Homo sapiens
augagaaguacuugg

SEQ ID NO: 760970 - RNA, 17 nt, Homo sapiens
augagaccacuguuauc

SEQ ID NO: 760971 - RNA, 16 nt, Homo sapiens
augagacucagugcag

SEQ ID NO: 760972 - RNA, 15 nt, Homo sapiens
augagagaacuggag

SEQ ID NO: 760973 - RNA, 23 nt, Homo sapiens
augagcaagccuagguacgaaga

SEQ ID NO: 760974 - RNA, 15 nt, Homo sapiens
augagccacugugcc

SEQ ID NO: 760975 - RNA, 20 nt, Homo sapiens
augagccauaggaaggcacu

SEQ ID NO: 760976 - RNA, 19 nt, Homo sapiens
augagccaucacuagaaga

SEQ ID NO: 760977 - RNA, 12 nt, Homo sapiens
augagccuuagu

SEQ ID NO: 760978 - RNA, 22 nt, Homo sapiens
augagcuggggaugucucucau

SEQ ID NO: 760979 - RNA, 18 nt, Homo sapiens
augaggaaggacuugacu

SEQ ID NO: 760980 - RNA, 18 nt, Homo sapiens
augaggacagaccacaga

SEQ ID NO: 760981 - RNA, 20 nt, Homo sapiens
augaggcaaacagcaagagu

SEQ ID NO: 760982 - RNA, 22 nt, Homo sapiens
augaggcacuuaucagcaugaa

SEQ ID NO: 760983 - RNA, 19 nt, Homo sapiens
augaguaaacugagacuua

SEQ ID NO: 760984 - RNA, 20 nt, Homo sapiens
augaguaaacugagacuuaa

SEQ ID NO: 760985 - RNA, 16 nt, Homo sapiens
augaguaacaggaaaa

SEQ ID NO: 760986 - RNA, 16 nt, Homo sapiens
augaguaguguggaau

SEQ ID NO: 760987 - RNA, 14 nt, Homo sapiens
augaguccuugaaa

SEQ ID NO: 760988 - RNA, 21 nt, Homo sapiens
augagucuuuauuuuuuguua

SEQ ID NO: 760989 - RNA, 14 nt, Homo sapiens
augagugcuuaaac

SEQ ID NO: 760990 - RNA, 16 nt, Homo sapiens
augaguuaacugugaa

SEQ ID NO: 760991 - RNA, 16 nt, Homo sapiens
augaguuggacuucag

SEQ ID NO: 760992 - RNA, 13 nt, Homo sapiens
augaguugguucu

SEQ ID NO: 760993 - RNA, 16 nt, Homo sapiens
augauaacugcaauuu

SEQ ID NO: 760994 - RNA, 14 nt, Homo sapiens
augauaaugaaacu

SEQ ID NO: 760995 - RNA, 16 nt, Homo sapiens
augauacacaccuuuc

SEQ ID NO: 760996 - RNA, 15 nt, Homo sapiens
augauacacuaugaa

SEQ ID NO: 760997 - RNA, 13 nt, Homo sapiens
augauaccaccuu

SEQ ID NO: 760998 - RNA, 19 nt, Homo sapiens
augauacuuggaugcagcu

SEQ ID NO: 760999 - RNA, 19 nt, Homo sapiens
augauagaacuguacuguu

SEQ ID NO: 761000 - RNA, 22 nt, Homo sapiens
augauaguuuucuagaugacau

SEQ ID NO: 761001 - RNA, 15 nt, Homo sapiens
augauauauucuuga

SEQ ID NO: 761002 - RNA, 17 nt, Homo sapiens
augauaucuucaagccu

SEQ ID NO: 761003 - RNA, 16 nt, Homo sapiens
augaucaaaacaugcu

SEQ ID NO: 761004 - RNA, 20 nt, Homo sapiens
augaucacauucuuuccaaa

SEQ ID NO: 761005 - RNA, 13 nt, Homo sapiens
augaucaccaagc

SEQ ID NO: 761006 - RNA, 15 nt, Homo sapiens
augaucagacauaca

SEQ ID NO: 761007 - RNA, 19 nt, Homo sapiens
augaucagacauacagcug

SEQ ID NO: 761008 - RNA, 12 nt, Homo sapiens
augaucaugcca

SEQ ID NO: 761009 - RNA, 14 nt, Homo sapiens
augaucaugccacu

SEQ ID NO: 761010 - RNA, 20 nt, Homo sapiens
augaucaugccacugcacuc

SEQ ID NO: 761011 - RNA, 18 nt, Homo sapiens
augauccagaacaguggc

SEQ ID NO: 761012 - RNA, 16 nt, Homo sapiens
augauccuuguguuca

SEQ ID NO: 761013 - RNA, 15 nt, Homo sapiens
augaucucaaucucc

SEQ ID NO: 761014 - RNA, 20 nt, Homo sapiens
augaucucccucuaagcaca

SEQ ID NO: 761015 - RNA, 13 nt, Homo sapiens
augaucucccugc

SEQ ID NO: 761016 - RNA, 12 nt, Homo sapiens
augaucugccau

SEQ ID NO: 761017 - RNA, 21 nt, Homo sapiens
augaugaaaacuaaggauuuu

SEQ ID NO: 761018 - RNA, 14 nt, Homo sapiens
augaugaugaugau

SEQ ID NO: 761019 - RNA, 15 nt, Homo sapiens
augaugcauacaguu

SEQ ID NO: 761020 - RNA, 18 nt, Homo sapiens
augaugcccagaugcucu

SEQ ID NO: 761021 - RNA, 16 nt, Homo sapiens
augaugccccugagau

SEQ ID NO: 761022 - RNA, 21 nt, Homo sapiens
augaugcuagccagcaaagau

SEQ ID NO: 761023 - RNA, 22 nt, Homo sapiens
augauggaaaaaauacauugaa

SEQ ID NO: 761024 - RNA, 21 nt, Homo sapiens
augauggccuuacacugaaaa

SEQ ID NO: 761025 - RNA, 23 nt, Homo sapiens
augaugggggaaaaaaaguaauc

SEQ ID NO: 761026 - RNA, 14 nt, Homo sapiens
augauguaaucucu

SEQ ID NO: 761027 - RNA, 23 nt, Homo sapiens
augauguagagugugguuaugaa

SEQ ID NO: 761028 - RNA, 17 nt, Homo sapiens
augaugugaguauuuag

SEQ ID NO: 761029 - RNA, 23 nt, Homo sapiens
augauguggguguccugcagaag

SEQ ID NO: 761030 - RNA, 22 nt, Homo sapiens
augaugugugaguguaauucca

SEQ ID NO: 761031 - RNA, 11 nt, Homo sapiens
augauguuucg

SEQ ID NO: 761032 - RNA, 17 nt, Homo sapiens
augauuaaagacuguga

SEQ ID NO: 761033 - RNA, 18 nt, Homo sapiens
augauuacuauaugcaaa

SEQ ID NO: 761034 - RNA, 19 nt, Homo sapiens
augauucagaaauuuucau

SEQ ID NO: 761035 - RNA, 22 nt, Homo sapiens
augauucagaaauuuucauuca

SEQ ID NO: 761036 - RNA, 13 nt, Homo sapiens
augauuguucaaa

SEQ ID NO: 761037 - RNA, 20 nt, Homo sapiens
augauuguucaaagcacaga

SEQ ID NO: 761038 - RNA, 18 nt, Homo sapiens
augauuuaccuauacauu

SEQ ID NO: 761039 - RNA, 15 nt, Homo sapiens
augauuuaggcuucu

SEQ ID NO: 761040 - RNA, 17 nt, Homo sapiens
augauuucagcagggau

SEQ ID NO: 761041 - RNA, 15 nt, Homo sapiens
auugcauacuuugua

SEQ ID NO: 761042 - RNA, 13 nt, Homo sapiens
auugcaugcaauu

SEQ ID NO: 761043 - RNA, 18 nt, Homo sapiens
auugccuaaaucuccagu

SEQ ID NO: 761044 - RNA, 13 nt, Homo sapiens
auugccucugaaa

SEQ ID NO: 761045 - RNA, 24 nt, Homo sapiens
auugccuguucugcuucgaaguau

SEQ ID NO: 761046 - RNA, 17 nt, Homo sapiens
auugcuaaccacugucu

SEQ ID NO: 761047 - RNA, 18 nt, Homo sapiens
auugcuaaucaccaaagg

SEQ ID NO: 761048 - RNA, 15 nt, Homo sapiens
auugcuagauaaaag

SEQ ID NO: 761049 - RNA, 17 nt, Homo sapiens
auuuguauuaauaaagc

SEQ ID NO: 761050 - RNA, 21 nt, Homo sapiens
auuuguauuaauaaagcauuc

SEQ ID NO: 761051 - RNA, 23 nt, Homo sapiens
auuugucccagccuggggcuccc

SEQ ID NO: 761052 - RNA, 18 nt, Homo sapiens
auuuguccuuccuaagaa

SEQ ID NO: 761053 - RNA, 20 nt, Homo sapiens
auuugucuguaaaaaaugga

SEQ ID NO: 761054 - RNA, 20 nt, Homo sapiens
auuugugcuagaaauuuuca

SEQ ID NO: 761055 - RNA, 21 nt, Homo sapiens
auuuguggucacagccaugaa

SEQ ID NO: 761056 - RNA, 18 nt, Homo sapiens
auuugugugugugauaua

SEQ ID NO: 761057 - RNA, 18 nt, Homo sapiens
auuuguuaaaauuaucaa

SEQ ID NO: 761058 - RNA, 13 nt, Homo sapiens
auuuguucagaga

SEQ ID NO: 761059 - RNA, 15 nt, Homo sapiens
auuuguucagugacu

SEQ ID NO: 761060 - RNA, 14 nt, Homo sapiens
auuuguuucaaugg

SEQ ID NO: 761061 - RNA, 20 nt, Homo sapiens
auuuguuuucuucuguaugu

SEQ ID NO: 761062 - RNA, 14 nt, Homo sapiens
auuuuaaaaacaua

SEQ ID NO: 761063 - RNA, 17 nt, Homo sapiens
auuuuaagaauuucaca

SEQ ID NO: 761064 - RNA, 21 nt, Homo sapiens
auuuuaagaauuucacaagcu

SEQ ID NO: 761065 - RNA, 14 nt, Homo sapiens
auuuuaaguacuuu

SEQ ID NO: 761066 - RNA, 18 nt, Homo sapiens
auuuuaauguaaaauuca

SEQ ID NO: 761067 - RNA, 20 nt, Homo sapiens
auuuuaauugauuauucuga

SEQ ID NO: 761068 - RNA, 14 nt, Homo sapiens
auuuuacacacaca

SEQ ID NO: 761069 - RNA, 18 nt, Homo sapiens
auuuuacaggugcgaaug

SEQ ID NO: 761070 - RNA, 18 nt, Homo sapiens
auuuuacauguggcccaa

SEQ ID NO: 761071 - RNA, 18 nt, Homo sapiens
auuuuaccaaagcaucaa

SEQ ID NO: 761072 - RNA, 16 nt, Homo sapiens
auuuuacugaucucuu

SEQ ID NO: 761073 - RNA, 13 nt, Homo sapiens
auuuuacuuccau

SEQ ID NO: 761074 - RNA, 14 nt, Homo sapiens
auuuuagacuuccu

SEQ ID NO: 761075 - RNA, 17 nt, Homo sapiens
auuuuagacuuccugua

SEQ ID NO: 761076 - RNA, 18 nt, Homo sapiens
auuuuaguaagaagacua

SEQ ID NO: 761077 - RNA, 23 nt, Homo sapiens
auuuuaguauucauucugcauug

SEQ ID NO: 761078 - RNA, 20 nt, Homo sapiens
auuuuaguuaaacucugaca

SEQ ID NO: 761079 - RNA, 21 nt, Homo sapiens
auuuuauacacagauucugcc

SEQ ID NO: 761080 - RNA, 20 nt, Homo sapiens
auuuuauaugaugggggaaa

SEQ ID NO: 761081 - RNA, 14 nt, Homo sapiens
auuuuaugauagau

SEQ ID NO: 761082 - RNA, 19 nt, Homo sapiens
auuuuauucaagaaugcca

SEQ ID NO: 761083 - RNA, 15 nt, Homo sapiens
auuuucaaaccucaa

SEQ ID NO: 761084 - RNA, 24 nt, Homo sapiens
auuuucaagaauaaucacgcuuuc

SEQ ID NO: 761085 - RNA, 22 nt, Homo sapiens
auuuucaaggccuucaguuuau

SEQ ID NO: 761086 - RNA, 21 nt, Homo sapiens
auuuucacuagguuugaauga

SEQ ID NO: 761087 - RNA, 18 nt, Homo sapiens
auuuucaguauacugugu

SEQ ID NO: 761088 - RNA, 13 nt, Homo sapiens
auuuucaucaaaa

SEQ ID NO: 761089 - RNA, 19 nt, Homo sapiens
auuuucaucaaaaccaaga

SEQ ID NO: 761090 - RNA, 21 nt, Homo sapiens
auuuucaucaggggccugcag

SEQ ID NO: 761091 - RNA, 16 nt, Homo sapiens
auuuucauguauaugu

SEQ ID NO: 761092 - RNA, 22 nt, Homo sapiens
auuuuccccccacucuccccac

SEQ ID NO: 761093 - RNA, 19 nt, Homo sapiens
auuuuccgccagaccucaa

SEQ ID NO: 761094 - RNA, 14 nt, Homo sapiens
auuuuccucuuguc

SEQ ID NO: 761095 - RNA, 16 nt, Homo sapiens
auuuuccugaaagugu

SEQ ID NO: 761096 - RNA, 14 nt, Homo sapiens
auuuucuacaauua

SEQ ID NO: 761097 - RNA, 21 nt, Homo sapiens
auuuucuagauuuucuacuuu

SEQ ID NO: 761098 - RNA, 15 nt, Homo sapiens
auuuucugcuugaag

SEQ ID NO: 761099 - RNA, 22 nt, Homo sapiens
auuuucuuaccucucaguuguu

SEQ ID NO: 761100 - RNA, 21 nt, Homo sapiens
auuuucuuguauauuuugcua

SEQ ID NO: 761101 - RNA, 19 nt, Homo sapiens
auuuugaaaacugugcaau

SEQ ID NO: 761102 - RNA, 21 nt, Homo sapiens
auuuugaaauauaguaaacac

SEQ ID NO: 761103 - RNA, 15 nt, Homo sapiens
auuuugaagucagag

SEQ ID NO: 761104 - RNA, 17 nt, Homo sapiens
auuuugacaaagugccu

SEQ ID NO: 761105 - RNA, 23 nt, Homo sapiens
auuuugacaaagugccucaugca

SEQ ID NO: 761106 - RNA, 14 nt, Homo sapiens
auuuugacgucacu

SEQ ID NO: 761107 - RNA, 20 nt, Homo sapiens
auuuugaguucuacauaagu

SEQ ID NO: 761108 - RNA, 13 nt, Homo sapiens
auuuugcaaaaau

SEQ ID NO: 761109 - RNA, 23 nt, Homo sapiens
auuuugcuagcuaugagcuuuua

SEQ ID NO: 761110 - RNA, 20 nt, Homo sapiens
auuuugggacuucuacccag

SEQ ID NO: 761111 - RNA, 23 nt, Homo sapiens
auuuugggggguaaucagcauua

SEQ ID NO: 761112 - RNA, 15 nt, Homo sapiens
auuuugggggucauc

SEQ ID NO: 761113 - RNA, 18 nt, Homo sapiens
auuuugggguaagacuuu

SEQ ID NO: 761114 - RNA, 17 nt, Homo sapiens
auuuugguuuguguauc

SEQ ID NO: 761115 - RNA, 19 nt, Homo sapiens
auuuuguaaaacaaugcca

SEQ ID NO: 761116 - RNA, 16 nt, Homo sapiens
auuuuguaaaaguggc

SEQ ID NO: 761117 - RNA, 19 nt, Homo sapiens
auuuuguaagaaggcaaua

SEQ ID NO: 761118 - RNA, 15 nt, Homo sapiens
auuuuguaccagugg

SEQ ID NO: 761119 - RNA, 24 nt, Homo sapiens
auuuuguaugaaaaaucaauguca

SEQ ID NO: 761120 - RNA, 21 nt, Homo sapiens
auuuugugaugaaucuacauu

SEQ ID NO: 761121 - RNA, 13 nt, Homo sapiens
auuuugugcaaaa

SEQ ID NO: 761122 - RNA, 19 nt, Homo sapiens
auuuuguuauugacuaaca

SEQ ID NO: 761123 - RNA, 17 nt, Homo sapiens
auuuuguucauacauau

SEQ ID NO: 761124 - RNA, 13 nt, Homo sapiens
auuuuuaaacuug

SEQ ID NO: 761125 - RNA, 23 nt, Homo sapiens
auuuuuaaaggcauuagagucaa

SEQ ID NO: 761126 - RNA, 16 nt, Homo sapiens
auuuuuaacacuuaaa

SEQ ID NO: 761127 - RNA, 17 nt, Homo sapiens
auuuuuaagcugcaaau

SEQ ID NO: 761128 - RNA, 14 nt, Homo sapiens
auuuuuaauggaaa

SEQ ID NO: 761129 - RNA, 21 nt, Homo sapiens
auuuuuaauguuuguacacaa

SEQ ID NO: 761130 - RNA, 19 nt, Homo sapiens
auuuuuacaguucucccaa

SEQ ID NO: 761131 - RNA, 14 nt, Homo sapiens
auuuuuaccuaauc

SEQ ID NO: 761132 - RNA, 21 nt, Homo sapiens
auuuuuacuaucacacaugaa

SEQ ID NO: 761133 - RNA, 22 nt, Homo sapiens
auuuuuauaaaaaugagugcuu

SEQ ID NO: 761134 - RNA, 22 nt, Homo sapiens
auuuuuauaaauuacuaucugu

SEQ ID NO: 761135 - RNA, 14 nt, Homo sapiens
auuuuuauaaccug

SEQ ID NO: 761136 - RNA, 22 nt, Homo sapiens
auuuuuauaauucagaagacua

SEQ ID NO: 761137 - RNA, 16 nt, Homo sapiens
auuuuuauacuuucag

SEQ ID NO: 761138 - RNA, 17 nt, Homo sapiens
auuuuuauagacaaaua

SEQ ID NO: 761139 - RNA, 14 nt, Homo sapiens
auuuuuauuacaac

SEQ ID NO: 761140 - RNA, 22 nt, Homo sapiens
auuuuucaauauauugaacuuu

SEQ ID NO: 761141 - RNA, 15 nt, Homo sapiens
auuuuuccaacuacu

SEQ ID NO: 761142 - RNA, 20 nt, Homo sapiens
auuuuuccacuauuaaucuu

SEQ ID NO: 761143 - RNA, 16 nt, Homo sapiens
auuuuucuaucaaaua

SEQ ID NO: 761144 - RNA, 16 nt, Homo sapiens
auuuuucucuaacuca

SEQ ID NO: 761145 - RNA, 20 nt, Homo sapiens
auuuuugacagguugcugaa

SEQ ID NO: 761146 - RNA, 21 nt, Homo sapiens
auuuuuguagcacugacagau

SEQ ID NO: 761147 - RNA, 14 nt, Homo sapiens
auuuuugucuuaua

SEQ ID NO: 761148 - RNA, 17 nt, Homo sapiens
auuuuuguuagcaaaga

SEQ ID NO: 761149 - RNA, 22 nt, Homo sapiens
auuuuuguuuucauuaucucaa

SEQ ID NO: 761150 - RNA, 23 nt, Homo sapiens
auuuuuguuuuuguacaguuuuu

SEQ ID NO: 761151 - RNA, 15 nt, Homo sapiens
auuuuuuaaagcuac

SEQ ID NO: 761152 - RNA, 22 nt, Homo sapiens
cagcagaaaggagaacuaucca

SEQ ID NO: 761153 - RNA, 20 nt, Homo sapiens
cagcagaagauuuucaagaa

SEQ ID NO: 761154 - RNA, 16 nt, Homo sapiens
cagcagaggacagucu

SEQ ID NO: 761155 - RNA, 22 nt, Homo sapiens
cagcagaggcguacuacccagc

SEQ ID NO: 761156 - RNA, 17 nt, Homo sapiens
cagcagcaaauuuucag

SEQ ID NO: 761157 - RNA, 23 nt, Homo sapiens
cagcagcacagucacccauggaa

SEQ ID NO: 761158 - RNA, 20 nt, Homo sapiens
cagcagccgccuuaagcuga

SEQ ID NO: 761159 - RNA, 16 nt, Homo sapiens
cagcagccucccugaa

SEQ ID NO: 761160 - RNA, 19 nt, Homo sapiens
cagcagccucccugucacu

SEQ ID NO: 761161 - RNA, 22 nt, Homo sapiens
cagcagcucacacccuaccuuc

SEQ ID NO: 761162 - RNA, 13 nt, Homo sapiens
cagcagcucugag

SEQ ID NO: 761163 - RNA, 17 nt, Homo sapiens
cagcagcuucaccagag

SEQ ID NO: 761164 - RNA, 19 nt, Homo sapiens
cagcaggagagacugagca

SEQ ID NO: 761165 - RNA, 17 nt, Homo sapiens
cagcaggagcucugacu

SEQ ID NO: 761166 - RNA, 20 nt, Homo sapiens
cagcaggcacguuaacucga

SEQ ID NO: 761167 - RNA, 21 nt, Homo sapiens
cagcaggcccuucccauucug

SEQ ID NO: 761168 - RNA, 20 nt, Homo sapiens
cagcaggcuccuggcugugc

SEQ ID NO: 761169 - RNA, 15 nt, Homo sapiens
cagcagggcugugau

SEQ ID NO: 761170 - RNA, 17 nt, Homo sapiens
cagcaggggggcugugc

SEQ ID NO: 761171 - RNA, 15 nt, Homo sapiens
cagcaggugcucaau

SEQ ID NO: 761172 - RNA, 14 nt, Homo sapiens
cagcaguaucacag

SEQ ID NO: 761173 - RNA, 14 nt, Homo sapiens
cagcagugaguaau

SEQ ID NO: 761174 - RNA, 19 nt, Homo sapiens
cagcagugccuaaaaccca

SEQ ID NO: 761175 - RNA, 11 nt, Homo sapiens
cagcagugggg

SEQ ID NO: 761176 - RNA, 21 nt, Homo sapiens
cagcaguguccccugccccag

SEQ ID NO: 761177 - RNA, 18 nt, Homo sapiens
cagcagugucuguaccuc

SEQ ID NO: 761178 - RNA, 12 nt, Homo sapiens
cagcaucugacc

SEQ ID NO: 761179 - RNA, 14 nt, Homo sapiens
cagcaucugaccau

SEQ ID NO: 761180 - RNA, 14 nt, Homo sapiens
cagcaucuuuaaca

SEQ ID NO: 761181 - RNA, 16 nt, Homo sapiens
cagcauggguccuuga

SEQ ID NO: 761182 - RNA, 15 nt, Homo sapiens
cagcauguccaacau

SEQ ID NO: 761183 - RNA, 18 nt, Homo sapiens
cagcauuuagucuugcca

SEQ ID NO: 761184 - RNA, 22 nt, Homo sapiens
cagcauuugauauacaugcuca

SEQ ID NO: 761185 - RNA, 22 nt, Homo sapiens
cagcauuuuuauaaacuaccaa

SEQ ID NO: 761186 - RNA, 16 nt, Homo sapiens
cagccaacgagacaca

SEQ ID NO: 761187 - RNA, 12 nt, Homo sapiens
cagccacaacca

SEQ ID NO: 761188 - RNA, 16 nt, Homo sapiens
cagccacaaccaaaaa

SEQ ID NO: 761189 - RNA, 13 nt, Homo sapiens
cagccacaccacu

SEQ ID NO: 761190 - RNA, 22 nt, Homo sapiens
cagccacacugugggacucuuc

SEQ ID NO: 761191 - RNA, 20 nt, Homo sapiens
cagccaccauccuauugcaa

SEQ ID NO: 761192 - RNA, 22 nt, Homo sapiens
cagccacccguggggugcugcc

SEQ ID NO: 761193 - RNA, 23 nt, Homo sapiens
cagccaccuagucccccaaaggg

SEQ ID NO: 761194 - RNA, 18 nt, Homo sapiens
cagccacuccccggcaug

SEQ ID NO: 761195 - RNA, 18 nt, Homo sapiens
cagccagcccauggcccc

SEQ ID NO: 761196 - RNA, 21 nt, Homo sapiens
cagccagcgucccuuggugag

SEQ ID NO: 761197 - RNA, 14 nt, Homo sapiens
cagccaggccgaga

SEQ ID NO: 761198 - RNA, 15 nt, Homo sapiens
cagccagucuugccu

SEQ ID NO: 761199 - RNA, 18 nt, Homo sapiens
cagccauaagaaagcacu

SEQ ID NO: 761200 - RNA, 14 nt, Homo sapiens
cagccauacaaaua

SEQ ID NO: 761201 - RNA, 15 nt, Homo sapiens
cagccauagaccuac

SEQ ID NO: 761202 - RNA, 16 nt, Homo sapiens
cagcccaaaacccagg

SEQ ID NO: 761203 - RNA, 19 nt, Homo sapiens
cagcccaagcuucccucca

SEQ ID NO: 761204 - RNA, 19 nt, Homo sapiens
cagcccagacccaguggac

SEQ ID NO: 761205 - RNA, 21 nt, Homo sapiens
cagcccagagacuuuguagau

SEQ ID NO: 761206 - RNA, 15 nt, Homo sapiens
cagcccagcuggugg

SEQ ID NO: 761207 - RNA, 18 nt, Homo sapiens
cagcccauggcccccaau

SEQ ID NO: 761208 - RNA, 15 nt, Homo sapiens
cagcccauggcuuua

SEQ ID NO: 761209 - RNA, 17 nt, Homo sapiens
cagcccccaucacccaa

SEQ ID NO: 761210 - RNA, 19 nt, Homo sapiens
cagcccccuaaaagcacuc

SEQ ID NO: 761211 - RNA, 21 nt, Homo sapiens
cagccccuuauuugcacuuca

SEQ ID NO: 761212 - RNA, 15 nt, Homo sapiens
cagcccuuauggcca

SEQ ID NO: 761213 - RNA, 17 nt, Homo sapiens
cagcccuuuugugaacc

SEQ ID NO: 761214 - RNA, 19 nt, Homo sapiens
cagccgccugaaagccaca

SEQ ID NO: 761215 - RNA, 15 nt, Homo sapiens
cagccguccauagca

SEQ ID NO: 761216 - RNA, 22 nt, Homo sapiens
cagccguguguucaaauguaca

SEQ ID NO: 761217 - RNA, 19 nt, Homo sapiens
cagccuaagagacugguga

SEQ ID NO: 761218 - RNA, 21 nt, Homo sapiens
cagccucacuucuaccugccc

SEQ ID NO: 761219 - RNA, 15 nt, Homo sapiens
cagccuccaccuccu

SEQ ID NO: 761220 - RNA, 19 nt, Homo sapiens
cagccuccacuguguccag

SEQ ID NO: 761221 - RNA, 19 nt, Homo sapiens
cagccuccagggcauugcu

SEQ ID NO: 761222 - RNA, 20 nt, Homo sapiens
cagccuccagggcauugcuc

SEQ ID NO: 761223 - RNA, 16 nt, Homo sapiens
cagccucccccggcuc

SEQ ID NO: 761224 - RNA, 16 nt, Homo sapiens
cagccuccccgugcca

SEQ ID NO: 761225 - RNA, 16 nt, Homo sapiens
cagccuccuccugacc

SEQ ID NO: 761226 - RNA, 13 nt, Homo sapiens
cagccucuacagc

SEQ ID NO: 761227 - RNA, 12 nt, Homo sapiens
cagccucucugc

SEQ ID NO: 761228 - RNA, 22 nt, Homo sapiens
cagccucuucuagagccgugau

SEQ ID NO: 761229 - RNA, 22 nt, Homo sapiens
cagccugaaagauacaggggau

SEQ ID NO: 761230 - RNA, 22 nt, Homo sapiens
cagccugagcaacagagugaga

SEQ ID NO: 761231 - RNA, 19 nt, Homo sapiens
cagccugcagcaagugcuu

SEQ ID NO: 761232 - RNA, 17 nt, Homo sapiens
cagccugcucuaguggg

SEQ ID NO: 761233 - RNA, 20 nt, Homo sapiens
cagccugcucuagugggaca

SEQ ID NO: 761234 - RNA, 22 nt, Homo sapiens
cagccuggauucuuuccuguau

SEQ ID NO: 761235 - RNA, 17 nt, Homo sapiens
cagccuggccaacaugg

SEQ ID NO: 761236 - RNA, 19 nt, Homo sapiens
cagccuggccaacauggca

SEQ ID NO: 761237 - RNA, 21 nt, Homo sapiens
cagccuggccaacauggugaa

SEQ ID NO: 761238 - RNA, 22 nt, Homo sapiens
cagccuggcgaaaccccaucuc

SEQ ID NO: 761239 - RNA, 18 nt, Homo sapiens
cagccuggcgacaagagu

SEQ ID NO: 761240 - RNA, 19 nt, Homo sapiens
cagccugggcaacauagua

SEQ ID NO: 761241 - RNA, 19 nt, Homo sapiens
cagccugggcagcauagca

SEQ ID NO: 761242 - RNA, 15 nt, Homo sapiens
cagccuggggugacc

SEQ ID NO: 761243 - RNA, 19 nt, Homo sapiens
cagccugggugacagagca

SEQ ID NO: 761244 - RNA, 23 nt, Homo sapiens
cagagccuugagagacccagcug

SEQ ID NO: 761245 - RNA, 20 nt, Homo sapiens
cagagcgagacuccaucucu

SEQ ID NO: 761246 - RNA, 20 nt, Homo sapiens
cagagcgagacuccgucuca

SEQ ID NO: 761247 - RNA, 20 nt, Homo sapiens
cagagcgagagucugucuca

SEQ ID NO: 761248 - RNA, 20 nt, Homo sapiens
cagagcgaggaaaggauuuu

SEQ ID NO: 761249 - RNA, 22 nt, Homo sapiens
cagagcgugcacuugugauccu

SEQ ID NO: 761250 - RNA, 20 nt, Homo sapiens
cagagcuacaugguggagca

SEQ ID NO: 761251 - RNA, 17 nt, Homo sapiens
cagagcucacagcugga

SEQ ID NO: 761252 - RNA, 16 nt, Homo sapiens
cagagcuccucacuua

SEQ ID NO: 761253 - RNA, 19 nt, Homo sapiens
cagagcucuuuaccaagga

SEQ ID NO: 761254 - RNA, 16 nt, Homo sapiens
cagagcugagcccuca

SEQ ID NO: 761255 - RNA, 16 nt, Homo sapiens
cagagcuggaaggcag

SEQ ID NO: 761256 - RNA, 21 nt, Homo sapiens
cagagcuguggaggauugcua

SEQ ID NO: 761257 - RNA, 17 nt, Homo sapiens
cagaggaaaagacaccu

SEQ ID NO: 761258 - RNA, 20 nt, Homo sapiens
cagaggagaauaaaaaaugg

SEQ ID NO: 761259 - RNA, 17 nt, Homo sapiens
cagaggagaugugguca

SEQ ID NO: 761260 - RNA, 18 nt, Homo sapiens
cagaggagauguggucaa

SEQ ID NO: 761261 - RNA, 19 nt, Homo sapiens
cagaggagccaccaguucu

SEQ ID NO: 761262 - RNA, 21 nt, Homo sapiens
cagaggagccaccaguucuca

SEQ ID NO: 761263 - RNA, 16 nt, Homo sapiens
cagaggcaacacugga

SEQ ID NO: 761264 - RNA, 21 nt, Homo sapiens
cagaggccugcugccagugca

SEQ ID NO: 761265 - RNA, 23 nt, Homo sapiens
cagaggcuaauucagugucacau

SEQ ID NO: 761266 - RNA, 23 nt, Homo sapiens
cagaggcucuugaugguggacua

SEQ ID NO: 761267 - RNA, 20 nt, Homo sapiens
cagaggcugcugcugcugca

SEQ ID NO: 761268 - RNA, 20 nt, Homo sapiens
cagagggauaaaaacaauac

SEQ ID NO: 761269 - RNA, 21 nt, Homo sapiens
cagagggcaguggcccuccac

SEQ ID NO: 761270 - RNA, 15 nt, Homo sapiens
cagagggcccaggca

SEQ ID NO: 761271 - RNA, 19 nt, Homo sapiens
cagagggggaguagccaag

SEQ ID NO: 761272 - RNA, 15 nt, Homo sapiens
cagaggucucccaaa

SEQ ID NO: 761273 - RNA, 20 nt, Homo sapiens
cagaggugggcagguggugg

SEQ ID NO: 761274 - RNA, 18 nt, Homo sapiens
cagagguuuccucuuagg

SEQ ID NO: 761275 - RNA, 14 nt, Homo sapiens
cagagguuucuuga

SEQ ID NO: 761276 - RNA, 22 nt, Homo sapiens
cagagguuugcuuccucaguaa

SEQ ID NO: 761277 - RNA, 15 nt, Homo sapiens
cagaguagaaacuca

SEQ ID NO: 761278 - RNA, 17 nt, Homo sapiens
cagagucagcugcugac

SEQ ID NO: 761279 - RNA, 19 nt, Homo sapiens
cagagucuuccucugucuc

SEQ ID NO: 761280 - RNA, 19 nt, Homo sapiens
cagagugagacccugucuc

SEQ ID NO: 761281 - RNA, 20 nt, Homo sapiens
cagagugagacccugucuca

SEQ ID NO: 761282 - RNA, 19 nt, Homo sapiens
cagagugagggaaugguag

SEQ ID NO: 761283 - RNA, 17 nt, Homo sapiens
cagagugagugagacuc

SEQ ID NO: 761284 - RNA, 16 nt, Homo sapiens
cagagugcaacccagu

SEQ ID NO: 761285 - RNA, 18 nt, Homo sapiens
cagaguggaaacucagcc

SEQ ID NO: 761286 - RNA, 16 nt, Homo sapiens
cagaguggacucuucc

SEQ ID NO: 761287 - RNA, 13 nt, Homo sapiens
cagaguggagucu

SEQ ID NO: 761288 - RNA, 19 nt, Homo sapiens
cagaguggcugcaguuaaa

SEQ ID NO: 761289 - RNA, 20 nt, Homo sapiens
cagaguguuuaauuguacuc

SEQ ID NO: 761290 - RNA, 21 nt, Homo sapiens
cagaguuagguugucuccagg

SEQ ID NO: 761291 - RNA, 24 nt, Homo sapiens
cagaguugcuuuaaaguaccugua

SEQ ID NO: 761292 - RNA, 22 nt, Homo sapiens
cagaguuggacuucuagacuca

SEQ ID NO: 761293 - RNA, 17 nt, Homo sapiens
cagaguuguacacugug

SEQ ID NO: 761294 - RNA, 17 nt, Homo sapiens
cagaguuuacauucuaa

SEQ ID NO: 761295 - RNA, 15 nt, Homo sapiens
cagaguuuccaaaac

SEQ ID NO: 761296 - RNA, 18 nt, Homo sapiens
cagaguuuguguguauuu

SEQ ID NO: 761297 - RNA, 12 nt, Homo sapiens
cagaguuuucau

SEQ ID NO: 761298 - RNA, 23 nt, Homo sapiens
cagauaaauccuuaacauuucuc

SEQ ID NO: 761299 - RNA, 16 nt, Homo sapiens
cagauaacaccaaacc

SEQ ID NO: 761300 - RNA, 18 nt, Homo sapiens
cagauagagaaauaguga

SEQ ID NO: 761301 - RNA, 23 nt, Homo sapiens
cagauagguggugccaguggcuu

SEQ ID NO: 761302 - RNA, 22 nt, Homo sapiens
cagauauaagagaagucucauu

SEQ ID NO: 761303 - RNA, 23 nt, Homo sapiens
cagauaucuuggacaaaucacau

SEQ ID NO: 761304 - RNA, 21 nt, Homo sapiens
cagaucaagaaaaaaagggag

SEQ ID NO: 761305 - RNA, 14 nt, Homo sapiens
cagaucacugccac

SEQ ID NO: 761306 - RNA, 17 nt, Homo sapiens
cagauccagcagcugcu

SEQ ID NO: 761307 - RNA, 12 nt, Homo sapiens
cagauccaggga

SEQ ID NO: 761308 - RNA, 14 nt, Homo sapiens
cagaucccagcuca

SEQ ID NO: 761309 - RNA, 13 nt, Homo sapiens
cagaucugugcuc

SEQ ID NO: 761310 - RNA, 18 nt, Homo sapiens
cagaucuuccguggucag

SEQ ID NO: 761311 - RNA, 12 nt, Homo sapiens
cagaucuuucag

SEQ ID NO: 761312 - RNA, 15 nt, Homo sapiens
cagaugauacuucca

SEQ ID NO: 761313 - RNA, 22 nt, Homo sapiens
cagaugaucccagucacuccuc

SEQ ID NO: 761314 - RNA, 15 nt, Homo sapiens
cagaugcuccaagau

SEQ ID NO: 761315 - RNA, 15 nt, Homo sapiens
cagauggguauuaaa

SEQ ID NO: 761316 - RNA, 20 nt, Homo sapiens
cagaugguagaacuaaacaa

SEQ ID NO: 761317 - RNA, 14 nt, Homo sapiens
cagauggucaucca

SEQ ID NO: 761318 - RNA, 16 nt, Homo sapiens
cagauguaacagaaca

SEQ ID NO: 761319 - RNA, 22 nt, Homo sapiens
cagaugucuucugccuguuaua

SEQ ID NO: 761320 - RNA, 18 nt, Homo sapiens
cagauguuagaucagggg

SEQ ID NO: 761321 - RNA, 18 nt, Homo sapiens
cagauguuggaccaacac

SEQ ID NO: 761322 - RNA, 14 nt, Homo sapiens
cagauuaaacccuu

SEQ ID NO: 761323 - RNA, 21 nt, Homo sapiens
cagauuaccgacacugucacu

SEQ ID NO: 761324 - RNA, 22 nt, Homo sapiens
cagauuagguuugucccaguca

SEQ ID NO: 761325 - RNA, 15 nt, Homo sapiens
cagauucccagagca

SEQ ID NO: 761326 - RNA, 15 nt, Homo sapiens
cagauucuucagcuu

SEQ ID NO: 761327 - RNA, 20 nt, Homo sapiens
cagauuggcucacacugaga

SEQ ID NO: 761328 - RNA, 13 nt, Homo sapiens
cagauuucaggaa

SEQ ID NO: 761329 - RNA, 16 nt, Homo sapiens
cagauuuuacaaaaga

SEQ ID NO: 761330 - RNA, 15 nt, Homo sapiens
cagauuuucagcaaa

SEQ ID NO: 761331 - RNA, 16 nt, Homo sapiens
cagauuuucaugcaaa

SEQ ID NO: 761332 - RNA, 23 nt, Homo sapiens
cagcaaaagaagacaacauuucu

SEQ ID NO: 761333 - RNA, 13 nt, Homo sapiens
cagcaaaagacca

SEQ ID NO: 761334 - RNA, 14 nt, Homo sapiens
cagcaaaagaccaa

SEQ ID NO: 761335 - RNA, 16 nt, Homo sapiens
cagcaaaauguugaag

SEQ ID NO: 761336 - RNA, 11 nt, Homo sapiens
cagcaaaggga

SEQ ID NO: 761337 - RNA, 17 nt, Homo sapiens
caagaguucagugcuca

SEQ ID NO: 761338 - RNA, 17 nt, Homo sapiens
caagauccuuaaugcag

SEQ ID NO: 761339 - RNA, 16 nt, Homo sapiens
caagaucuuucaggaa

SEQ ID NO: 761340 - RNA, 12 nt, Homo sapiens
caagaugacagc

SEQ ID NO: 761341 - RNA, 17 nt, Homo sapiens
caagaugcaacuaggaa

SEQ ID NO: 761342 - RNA, 19 nt, Homo sapiens
caagaugcgcacugcauuc

SEQ ID NO: 761343 - RNA, 21 nt, Homo sapiens
caagaugcuggaugucugcca

SEQ ID NO: 761344 - RNA, 20 nt, Homo sapiens
caagauggacacgagccaca

SEQ ID NO: 761345 - RNA, 22 nt, Homo sapiens
caagauggaugcgacccaagac

SEQ ID NO: 761346 - RNA, 16 nt, Homo sapiens
caagauggguggcacc

SEQ ID NO: 761347 - RNA, 15 nt, Homo sapiens
caagcaaaaccaaag

SEQ ID NO: 761348 - RNA, 16 nt, Homo sapiens
caagcaaaaugucucu

SEQ ID NO: 761349 - RNA, 19 nt, Homo sapiens
caagcacaaagcucaagau

SEQ ID NO: 761350 - RNA, 20 nt, Homo sapiens
caagcacagugccugcaugu

SEQ ID NO: 761351 - RNA, 17 nt, Homo sapiens
caagcaccugggauuac

SEQ ID NO: 761352 - RNA, 13 nt, Homo sapiens
caagcacugcuca

SEQ ID NO: 761353 - RNA, 14 nt, Homo sapiens
caagcacugcucac

SEQ ID NO: 761354 - RNA, 11 nt, Homo sapiens
caagcauuaag

SEQ ID NO: 761355 - RNA, 15 nt, Homo sapiens
caagcauuccugcuc

SEQ ID NO: 761356 - RNA, 23 nt, Homo sapiens
caagcauuuugugaacuagggaa

SEQ ID NO: 761357 - RNA, 18 nt, Homo sapiens
caagccacaagucuucca

SEQ ID NO: 761358 - RNA, 24 nt, Homo sapiens
caagccagcccccuccagcucaug

SEQ ID NO: 761359 - RNA, 17 nt, Homo sapiens
caagcccaggcuuccug

SEQ ID NO: 761360 - RNA, 16 nt, Homo sapiens
caagccccugccucca

SEQ ID NO: 761361 - RNA, 17 nt, Homo sapiens
caagcccugcagucaca

SEQ ID NO: 761362 - RNA, 16 nt, Homo sapiens
caagccugccuaggaa

SEQ ID NO: 761363 - RNA, 16 nt, Homo sapiens
caagccugucuucaga

SEQ ID NO: 761364 - RNA, 18 nt, Homo sapiens
caagccugucuucagaga

SEQ ID NO: 761365 - RNA, 20 nt, Homo sapiens
caagccuucuuaaagccuua

SEQ ID NO: 761366 - RNA, 16 nt, Homo sapiens
caagcgggccgucucc

SEQ ID NO: 761367 - RNA, 15 nt, Homo sapiens
caagcucuucacuga

SEQ ID NO: 761368 - RNA, 12 nt, Homo sapiens
caagcugccucc

SEQ ID NO: 761369 - RNA, 20 nt, Homo sapiens
caagcuuuguauauaaauga

SEQ ID NO: 761370 - RNA, 20 nt, Homo sapiens
caaggaaacccccaguguaa

SEQ ID NO: 761371 - RNA, 23 nt, Homo sapiens
caaggaaacccccaguguaauaa

SEQ ID NO: 761372 - RNA, 22 nt, Homo sapiens
caaggagaccaaguccuggcua

SEQ ID NO: 761373 - RNA, 15 nt, Homo sapiens
caaggcaacugugag

SEQ ID NO: 761374 - RNA, 14 nt, Homo sapiens
caaggcaagaucua

SEQ ID NO: 761375 - RNA, 11 nt, Homo sapiens
caaggcauuua

SEQ ID NO: 761376 - RNA, 23 nt, Homo sapiens
caaggcauuugucuuuguaauau

SEQ ID NO: 761377 - RNA, 20 nt, Homo sapiens
caaggcccuuuccuuuggaa

SEQ ID NO: 761378 - RNA, 19 nt, Homo sapiens
caaggcggguggaucacaa

SEQ ID NO: 761379 - RNA, 15 nt, Homo sapiens
caaggcuaguuccuu

SEQ ID NO: 761380 - RNA, 14 nt, Homo sapiens
caaggcugcaguga

SEQ ID NO: 761381 - RNA, 19 nt, Homo sapiens
caaggcugcagugagccau

SEQ ID NO: 761382 - RNA, 20 nt, Homo sapiens
caaggcuuaggaaagugaua

SEQ ID NO: 761383 - RNA, 19 nt, Homo sapiens
caaggcuucagugagccau

SEQ ID NO: 761384 - RNA, 15 nt, Homo sapiens
caaggcuuuaucuca

SEQ ID NO: 761385 - RNA, 18 nt, Homo sapiens
caaggcuuugguuuccaa

SEQ ID NO: 761386 - RNA, 21 nt, Homo sapiens
caaggcuuugguuuccaaguc

SEQ ID NO: 761387 - RNA, 15 nt, Homo sapiens
caagggaaaggcaag

SEQ ID NO: 761388 - RNA, 13 nt, Homo sapiens
caagggacaguga

SEQ ID NO: 761389 - RNA, 16 nt, Homo sapiens
caagggagacaccagu

SEQ ID NO: 761390 - RNA, 19 nt, Homo sapiens
caagggcccuucucuacug

SEQ ID NO: 761391 - RNA, 19 nt, Homo sapiens
caagggggacugucuuuca

SEQ ID NO: 761392 - RNA, 16 nt, Homo sapiens
caagggggugacugga

SEQ ID NO: 761393 - RNA, 16 nt, Homo sapiens
caaggggugggccaca

SEQ ID NO: 761394 - RNA, 13 nt, Homo sapiens
caagguccaagau

SEQ ID NO: 761395 - RNA, 14 nt, Homo sapiens
caaggucuuugguu

SEQ ID NO: 761396 - RNA, 15 nt, Homo sapiens
caaggugacacauua

SEQ ID NO: 761397 - RNA, 16 nt, Homo sapiens
caaggugcugauguca

SEQ ID NO: 761398 - RNA, 23 nt, Homo sapiens
caaggugggccuugcuaccucaa

SEQ ID NO: 761399 - RNA, 12 nt, Homo sapiens
caagguguuucu

SEQ ID NO: 761400 - RNA, 23 nt, Homo sapiens
caagguucugguuccauuuuucc

SEQ ID NO: 761401 - RNA, 21 nt, Homo sapiens
caagguucuucccuuuuacau

SEQ ID NO: 761402 - RNA, 16 nt, Homo sapiens
caaguaaaaaggcuaa

SEQ ID NO: 761403 - RNA, 17 nt, Homo sapiens
caaguaaaacuguggua

SEQ ID NO: 761404 - RNA, 15 nt, Homo sapiens
caaguaacugaacca

SEQ ID NO: 761405 - RNA, 21 nt, Homo sapiens
caaguaagaaagugaagcaaa

SEQ ID NO: 761406 - RNA, 19 nt, Homo sapiens
caaguagaggcaaugcaaa

SEQ ID NO: 761407 - RNA, 13 nt, Homo sapiens
caaguagcuuucc

SEQ ID NO: 761408 - RNA, 21 nt, Homo sapiens
caaguauacuagggagccauu

SEQ ID NO: 761409 - RNA, 21 nt, Homo sapiens
caaguauguuuguacaguaug

SEQ ID NO: 761410 - RNA, 15 nt, Homo sapiens
caaguauuuugccac

SEQ ID NO: 761411 - RNA, 17 nt, Homo sapiens
caaguauuuugcuauau

SEQ ID NO: 761412 - RNA, 16 nt, Homo sapiens
caagucaccaugcuga

SEQ ID NO: 761413 - RNA, 17 nt, Homo sapiens
caagucaccggagcuuu

SEQ ID NO: 761414 - RNA, 13 nt, Homo sapiens
caagucaccugca

SEQ ID NO: 761415 - RNA, 18 nt, Homo sapiens
caaguccaagcauaccaa

SEQ ID NO: 761416 - RNA, 19 nt, Homo sapiens
caaguccauguuauucucu

SEQ ID NO: 761417 - RNA, 21 nt, Homo sapiens
caaguccauguuauucucuca

SEQ ID NO: 761418 - RNA, 22 nt, Homo sapiens
caaguccauguuauucucucac

SEQ ID NO: 761419 - RNA, 16 nt, Homo sapiens
caaguccuguucuguu

SEQ ID NO: 761420 - RNA, 15 nt, Homo sapiens
caagucuaaugaaga

SEQ ID NO: 761421 - RNA, 19 nt, Homo sapiens
caagucucacagauugcug

SEQ ID NO: 761422 - RNA, 14 nt, Homo sapiens
caagugacuuucua

SEQ ID NO: 761423 - RNA, 14 nt, Homo sapiens
caagugccaaacag

SEQ ID NO: 761424 - RNA, 11 nt, Homo sapiens
caagugcugca

SEQ ID NO: 761425 - RNA, 17 nt, Homo sapiens
caagugcugcacaaaag

SEQ ID NO: 761426 - RNA, 12 nt, Homo sapiens
caaguggcaugu

SEQ ID NO: 761427 - RNA, 12 nt, Homo sapiens
caagugugaaca

SEQ ID NO: 761428 - RNA, 14 nt, Homo sapiens
caagugugucuuac

SEQ ID NO: 761429 - RNA, 18 nt, Homo sapiens
caaguguuugugggacac

SEQ ID NO: 761430 - RNA, 23 nt, Homo sapiens
caaguuauaaaucaaugucacuu

SEQ ID NO: 761431 - RNA, 17 nt, Homo sapiens
caaguuauagauucaau

SEQ ID NO: 761432 - RNA, 14 nt, Homo sapiens
caaguuauguucuu

SEQ ID NO: 761433 - RNA, 21 nt, Homo sapiens
caaguucaugcagcuguggca

SEQ ID NO: 761434 - RNA, 23 nt, Homo sapiens
caaguuccccaucccugucauuu

SEQ ID NO: 761435 - RNA, 17 nt, Homo sapiens
caaguucuggaucuuau

SEQ ID NO: 761436 - RNA, 15 nt, Homo sapiens
caaguugcaucagaa

SEQ ID NO: 761437 - RNA, 18 nt, Homo sapiens
caaguuggguucacuugc

SEQ ID NO: 761438 - RNA, 16 nt, Homo sapiens
aaugcucuuuacuuca

SEQ ID NO: 761439 - RNA, 20 nt, Homo sapiens
aaugcucuuuacuucaugga

SEQ ID NO: 761440 - RNA, 19 nt, Homo sapiens
aaugcucuuuugcacaagg

SEQ ID NO: 761441 - RNA, 17 nt, Homo sapiens
aaugcugagguuaugaa

SEQ ID NO: 761442 - RNA, 21 nt, Homo sapiens
aaugcugcgcuucgcuuggug

SEQ ID NO: 761443 - RNA, 18 nt, Homo sapiens
aaugcugugguugauauu

SEQ ID NO: 761444 - RNA, 13 nt, Homo sapiens
aaugcuuccaagc

SEQ ID NO: 761445 - RNA, 19 nt, Homo sapiens
aaugcuuuucuaaugccuu

SEQ ID NO: 761446 - RNA, 18 nt, Homo sapiens
aauggaaaaaaaaaacuu

SEQ ID NO: 761447 - RNA, 17 nt, Homo sapiens
aauggaaaaaaugaugu

SEQ ID NO: 761448 - RNA, 15 nt, Homo sapiens
aauggaaacauuuac

SEQ ID NO: 761449 - RNA, 12 nt, Homo sapiens
aauggaaaccaa

SEQ ID NO: 761450 - RNA, 14 nt, Homo sapiens
aauggaaaccaagg

SEQ ID NO: 761451 - RNA, 14 nt, Homo sapiens
aauggaaagguccu

SEQ ID NO: 761452 - RNA, 23 nt, Homo sapiens
aauggacauugagauacuaucau

SEQ ID NO: 761453 - RNA, 17 nt, Homo sapiens
aauggacuaaaacauuu

SEQ ID NO: 761454 - RNA, 22 nt, Homo sapiens
aauggagaauuaaaaauaccaa

SEQ ID NO: 761455 - RNA, 17 nt, Homo sapiens
aauggagcucaguaaca

SEQ ID NO: 761456 - RNA, 23 nt, Homo sapiens
aauggaugggcagucauuuugca

SEQ ID NO: 761457 - RNA, 21 nt, Homo sapiens
aauggauucaacacugugcac

SEQ ID NO: 761458 - RNA, 21 nt, Homo sapiens
aauggcagggauacccaguga

SEQ ID NO: 761459 - RNA, 20 nt, Homo sapiens
aauggcaggugucauaugac

SEQ ID NO: 761460 - RNA, 23 nt, Homo sapiens
aauggcauaggcugacuuuugca

SEQ ID NO: 761461 - RNA, 13 nt, Homo sapiens
aauggccaugcag

SEQ ID NO: 761462 - RNA, 20 nt, Homo sapiens
aauggcucaugaccuggaaa

SEQ ID NO: 761463 - RNA, 15 nt, Homo sapiens
aaugggaaaucagug

SEQ ID NO: 761464 - RNA, 23 nt, Homo sapiens
aaugggaagauuaaaaagcacag

SEQ ID NO: 761465 - RNA, 14 nt, Homo sapiens
aaugggacugaugu

SEQ ID NO: 761466 - RNA, 15 nt, Homo sapiens
aaugggcucuuccaa

SEQ ID NO: 761467 - RNA, 22 nt, Homo sapiens
aauggggggcgggccagggugg

SEQ ID NO: 761468 - RNA, 16 nt, Homo sapiens
aaugguaauuguugcu

SEQ ID NO: 761469 - RNA, 17 nt, Homo sapiens
aauggucauccaaacuc

SEQ ID NO: 761470 - RNA, 17 nt, Homo sapiens
aauggucgcccaggaga

SEQ ID NO: 761471 - RNA, 17 nt, Homo sapiens
aauggucuuacauugga

SEQ ID NO: 761472 - RNA, 21 nt, Homo sapiens
aauggugccaccacucaagca

SEQ ID NO: 761473 - RNA, 21 nt, Homo sapiens
aaugguguagcuguccucuca

SEQ ID NO: 761474 - RNA, 21 nt, Homo sapiens
aaugguucagaauuaaacuuu

SEQ ID NO: 761475 - RNA, 20 nt, Homo sapiens
aaugguuugugucaaaacug

SEQ ID NO: 761476 - RNA, 23 nt, Homo sapiens
aaugguuuuaauguucuuuugac

SEQ ID NO: 761477 - RNA, 20 nt, Homo sapiens
aauguaaauuaaaauuucca

SEQ ID NO: 761478 - RNA, 15 nt, Homo sapiens
aauguaacugugcca

SEQ ID NO: 761479 - RNA, 15 nt, Homo sapiens
aauguaaucauuccu

SEQ ID NO: 761480 - RNA, 13 nt, Homo sapiens
aauguacaauuau

SEQ ID NO: 761481 - RNA, 14 nt, Homo sapiens
aauguacacugauu

SEQ ID NO: 761482 - RNA, 19 nt, Homo sapiens
aauguaggcaucaugcaug

SEQ ID NO: 761483 - RNA, 18 nt, Homo sapiens
aauguagugaagggaugu

SEQ ID NO: 761484 - RNA, 23 nt, Homo sapiens
aauguauaaggacuauagugauu

SEQ ID NO: 761485 - RNA, 20 nt, Homo sapiens
aauguaucuauuuguacaau

SEQ ID NO: 761486 - RNA, 15 nt, Homo sapiens
aauguaugauuacau

SEQ ID NO: 761487 - RNA, 21 nt, Homo sapiens
aauguaugcauucacauuuag

SEQ ID NO: 761488 - RNA, 14 nt, Homo sapiens
aauguaugugcucu

SEQ ID NO: 761489 - RNA, 18 nt, Homo sapiens
aauguauucaaauaccaa

SEQ ID NO: 761490 - RNA, 18 nt, Homo sapiens
aauguauuuagcuacagc

SEQ ID NO: 761491 - RNA, 20 nt, Homo sapiens
aauguauuuguuugcaauuu

SEQ ID NO: 761492 - RNA, 21 nt, Homo sapiens
aaugucaccagguacuugaga

SEQ ID NO: 761493 - RNA, 17 nt, Homo sapiens
aaugucaggaacagaag

SEQ ID NO: 761494 - RNA, 17 nt, Homo sapiens
aaugucaguauguggaa

SEQ ID NO: 761495 - RNA, 12 nt, Homo sapiens
aaugucauaaau

SEQ ID NO: 761496 - RNA, 18 nt, Homo sapiens
aaugucauagucuugaaa

SEQ ID NO: 761497 - RNA, 15 nt, Homo sapiens
aauguccaccaugaa

SEQ ID NO: 761498 - RNA, 13 nt, Homo sapiens
aauguccauuuau

SEQ ID NO: 761499 - RNA, 15 nt, Homo sapiens
aaugucucaugucaa

SEQ ID NO: 761500 - RNA, 13 nt, Homo sapiens
aaugucucuguga

SEQ ID NO: 761501 - RNA, 18 nt, Homo sapiens
aaugucuggucuguccac

SEQ ID NO: 761502 - RNA, 16 nt, Homo sapiens
aaugucuuacugugau

SEQ ID NO: 761503 - RNA, 20 nt, Homo sapiens
aaugucuuuugaauauuccc

SEQ ID NO: 761504 - RNA, 21 nt, Homo sapiens
aaugucuuuugaauauuccca

SEQ ID NO: 761505 - RNA, 20 nt, Homo sapiens
aaugugaagauggacuucau

SEQ ID NO: 761506 - RNA, 22 nt, Homo sapiens
aaugugacuucaugcuauauau

SEQ ID NO: 761507 - RNA, 21 nt, Homo sapiens
aaugugauauuugaagcauca

SEQ ID NO: 761508 - RNA, 23 nt, Homo sapiens
aaugugauucaccucuucuuucc

SEQ ID NO: 761509 - RNA, 21 nt, Homo sapiens
aaugugcuggugaacacugug

SEQ ID NO: 761510 - RNA, 21 nt, Homo sapiens
aauguggcugcugaaacucau

SEQ ID NO: 761511 - RNA, 22 nt, Homo sapiens
aauguguaauuguuuuggaaua

SEQ ID NO: 761512 - RNA, 16 nt, Homo sapiens
aauguguacagugaau

SEQ ID NO: 761513 - RNA, 23 nt, Homo sapiens
aaugugucaggugacccugauga

SEQ ID NO: 761514 - RNA, 11 nt, Homo sapiens
aaugugucauc

SEQ ID NO: 761515 - RNA, 23 nt, Homo sapiens
aauguguccuaucuaucuuccaa

SEQ ID NO: 761516 - RNA, 18 nt, Homo sapiens
aaugugugaauucaauac

SEQ ID NO: 761517 - RNA, 16 nt, Homo sapiens
aauguguucuuuucuc

SEQ ID NO: 761518 - RNA, 14 nt, Homo sapiens
aauguguuggcuca

SEQ ID NO: 761519 - RNA, 19 nt, Homo sapiens
aauguguuucaaaaccaug

SEQ ID NO: 761520 - RNA, 16 nt, Homo sapiens
aauguuaaagggauau

SEQ ID NO: 761521 - RNA, 16 nt, Homo sapiens
aauguuacaguaacaa

SEQ ID NO: 761522 - RNA, 22 nt, Homo sapiens
aauguuaccucugaauuuacuu

SEQ ID NO: 761523 - RNA, 17 nt, Homo sapiens
aauguuauuuccugaga

SEQ ID NO: 761524 - RNA, 13 nt, Homo sapiens
aauguuccugaaa

SEQ ID NO: 761525 - RNA, 21 nt, Homo sapiens
aauguucuauuuaacaacugg

SEQ ID NO: 761526 - RNA, 19 nt, Homo sapiens
aauguucuuuugacugaag

SEQ ID NO: 761527 - RNA, 21 nt, Homo sapiens
aauguuggacaccuuuagguu

SEQ ID NO: 761528 - RNA, 22 nt, Homo sapiens
aauguuggaguggaacauuggg

SEQ ID NO: 761529 - RNA, 15 nt, Homo sapiens
aauguuguaauucau

SEQ ID NO: 761530 - RNA, 16 nt, Homo sapiens
aauguuuaaagaucau

SEQ ID NO: 761531 - RNA, 20 nt, Homo sapiens
aauguuuaaagaucaugaca

SEQ ID NO: 761532 - RNA, 17 nt, Homo sapiens
aauguuucccucaagaa

SEQ ID NO: 761533 - RNA, 22 nt, Homo sapiens
aauguuucccucaagaacaaac

SEQ ID NO: 761534 - RNA, 19 nt, Homo sapiens
aauguuucuggaauucuuc

SEQ ID NO: 761535 - RNA, 18 nt, Homo sapiens
aauguuugguuucaggua

SEQ ID NO: 761536 - RNA, 19 nt, Homo sapiens
aauguuuucaaaagguauu

SEQ ID NO: 761537 - RNA, 17 nt, Homo sapiens
aauuaaaaaagcauacu

SEQ ID NO: 761538 - RNA, 12 nt, Homo sapiens
aauuaaaaccaa

SEQ ID NO: 761539 - RNA, 20 nt, Homo sapiens
aauuaaaauacagcugcacu

SEQ ID NO: 761540 - RNA, 15 nt, Homo sapiens
aauuaaaccaaugaa

SEQ ID NO: 761541 - RNA, 16 nt, Homo sapiens
aauuaaacuuccaaag

SEQ ID NO: 761542 - RNA, 11 nt, Homo sapiens
aauuaaagccc

SEQ ID NO: 761543 - RNA, 18 nt, Homo sapiens
aauuaaaguggaccaaua

SEQ ID NO: 761544 - RNA, 21 nt, Homo sapiens
aauuaaauccaacuuucacag

SEQ ID NO: 761545 - RNA, 14 nt, Homo sapiens
aauuaaaugaagcc

SEQ ID NO: 761546 - RNA, 16 nt, Homo sapiens
aauuaacucaccagau

SEQ ID NO: 761547 - RNA, 15 nt, Homo sapiens
aauuaacugaacuua

SEQ ID NO: 761548 - RNA, 14 nt, Homo sapiens
aauuaagacuuuau

SEQ ID NO: 761549 - RNA, 15 nt, Homo sapiens
aauuaagauuaugug

SEQ ID NO: 761550 - RNA, 19 nt, Homo sapiens
aauuaaugacagagccagu

SEQ ID NO: 761551 - RNA, 15 nt, Homo sapiens
aauuacaacagugag

SEQ ID NO: 761552 - RNA, 17 nt, Homo sapiens
aauauccaaaccaaaua

SEQ ID NO: 761553 - RNA, 12 nt, Homo sapiens
aauauccaagac

SEQ ID NO: 761554 - RNA, 13 nt, Homo sapiens
aauauccugugua

SEQ ID NO: 761555 - RNA, 17 nt, Homo sapiens
aauaucuugcuuucaaa

SEQ ID NO: 761556 - RNA, 20 nt, Homo sapiens
aauaucuuuuuuggaacuaa

SEQ ID NO: 761557 - RNA, 23 nt, Homo sapiens
aauaugaaccuauuuucauuugu

SEQ ID NO: 761558 - RNA, 20 nt, Homo sapiens
aauaugacggaagaacauag

SEQ ID NO: 761559 - RNA, 15 nt, Homo sapiens
aauaugauuacuuua

SEQ ID NO: 761560 - RNA, 18 nt, Homo sapiens
aauaugauuuuauuugac

SEQ ID NO: 761561 - RNA, 11 nt, Homo sapiens
aauaugcaucu

SEQ ID NO: 761562 - RNA, 22 nt, Homo sapiens
aauaugcaucuggcccaggaau

SEQ ID NO: 761563 - RNA, 22 nt, Homo sapiens
aauaugccuagcacaaguacca

SEQ ID NO: 761564 - RNA, 16 nt, Homo sapiens
aauaugggcacuuuaa

SEQ ID NO: 761565 - RNA, 20 nt, Homo sapiens
aauauggugggcacagaagu

SEQ ID NO: 761566 - RNA, 23 nt, Homo sapiens
aauaugguugauaguuuaccuga

SEQ ID NO: 761567 - RNA, 22 nt, Homo sapiens
aauauguagcucauccuuuaca

SEQ ID NO: 761568 - RNA, 14 nt, Homo sapiens
aauaugucuuggaa

SEQ ID NO: 761569 - RNA, 15 nt, Homo sapiens
aauauguuaagggcu

SEQ ID NO: 761570 - RNA, 20 nt, Homo sapiens
aauauguucuuuuaaaugau

SEQ ID NO: 761571 - RNA, 17 nt, Homo sapiens
aauauguugaguguuca

SEQ ID NO: 761572 - RNA, 13 nt, Homo sapiens
aauauuaaauaca

SEQ ID NO: 761573 - RNA, 11 nt, Homo sapiens
aauauuaacau

SEQ ID NO: 761574 - RNA, 14 nt, Homo sapiens
aauauuacagugaa

SEQ ID NO: 761575 - RNA, 14 nt, Homo sapiens
aauauuacucucaa

SEQ ID NO: 761576 - RNA, 17 nt, Homo sapiens
aauauuauguuccucaa

SEQ ID NO: 761577 - RNA, 11 nt, Homo sapiens
aauauucacuc

SEQ ID NO: 761578 - RNA, 19 nt, Homo sapiens
aauauucacucuccauuag

SEQ ID NO: 761579 - RNA, 18 nt, Homo sapiens
aauauucagccagcuuaa

SEQ ID NO: 761580 - RNA, 12 nt, Homo sapiens
aauauuccugaa

SEQ ID NO: 761581 - RNA, 16 nt, Homo sapiens
aauauucuguaacuau

SEQ ID NO: 761582 - RNA, 16 nt, Homo sapiens
aauauugaaaggcaaa

SEQ ID NO: 761583 - RNA, 22 nt, Homo sapiens
aauauugaaaggcaaacauuug

SEQ ID NO: 761584 - RNA, 16 nt, Homo sapiens
aauauuguaaaacuuu

SEQ ID NO: 761585 - RNA, 18 nt, Homo sapiens
aauauuguguugugaaug

SEQ ID NO: 761586 - RNA, 22 nt, Homo sapiens
aauauuguugacaacugugacu

SEQ ID NO: 761587 - RNA, 23 nt, Homo sapiens
aauauuguugacaacugugacug

SEQ ID NO: 761588 - RNA, 17 nt, Homo sapiens
aauauuuauuaccucug

SEQ ID NO: 761589 - RNA, 20 nt, Homo sapiens
aauauuucccauuugugcca

SEQ ID NO: 761590 - RNA, 20 nt, Homo sapiens
aauauuucccucaccuuucc

SEQ ID NO: 761591 - RNA, 20 nt, Homo sapiens
aauauuuccuuaaacugugu

SEQ ID NO: 761592 - RNA, 19 nt, Homo sapiens
aauacagaucaucuuggaa

SEQ ID NO: 761593 - RNA, 17 nt, Homo sapiens
aauacaguaagcauagu

SEQ ID NO: 761594 - RNA, 19 nt, Homo sapiens
aauacagugagcucuagca

SEQ ID NO: 761595 - RNA, 21 nt, Homo sapiens
aauacauaaaaaaguguuuac

SEQ ID NO: 761596 - RNA, 14 nt, Homo sapiens
aauacaucaaagag

SEQ ID NO: 761597 - RNA, 13 nt, Homo sapiens
aauacaugcacac

SEQ ID NO: 761598 - RNA, 20 nt, Homo sapiens
aauacaugcugcuaauucaa

SEQ ID NO: 761599 - RNA, 21 nt, Homo sapiens
aauacaugucuagaacugauc

SEQ ID NO: 761600 - RNA, 13 nt, Homo sapiens
aauaccaaaaauu

SEQ ID NO: 761601 - RNA, 13 nt, Homo sapiens
aauaccaauguuc

SEQ ID NO: 761602 - RNA, 17 nt, Homo sapiens
aauaccauuuaguaaga

SEQ ID NO: 761603 - RNA, 14 nt, Homo sapiens
aauacccaugcuuu

SEQ ID NO: 761604 - RNA, 19 nt, Homo sapiens
aauaccuuuucucacaaaa

SEQ ID NO: 761605 - RNA, 20 nt, Homo sapiens
aauaccuuuucucacaaaaa

SEQ ID NO: 761606 - RNA, 20 nt, Homo sapiens
aauacggcuuuuccaaugau

SEQ ID NO: 761607 - RNA, 20 nt, Homo sapiens
aauacuacugacguccuccc

SEQ ID NO: 761608 - RNA, 22 nt, Homo sapiens
aauacuaggauacagaaaugca

SEQ ID NO: 761609 - RNA, 18 nt, Homo sapiens
aauacuauuauuugcuac

SEQ ID NO: 761610 - RNA, 14 nt, Homo sapiens
aauacuccuaagac

SEQ ID NO: 761611 - RNA, 21 nt, Homo sapiens
aauacugaauuuugagucuau

SEQ ID NO: 761612 - RNA, 17 nt, Homo sapiens
aauacugcuacagcaau

SEQ ID NO: 761613 - RNA, 20 nt, Homo sapiens
aauacugugcauaagccauu

SEQ ID NO: 761614 - RNA, 16 nt, Homo sapiens
aauacuuaaauguuau

SEQ ID NO: 761615 - RNA, 11 nt, Homo sapiens
aauacuuucag

SEQ ID NO: 761616 - RNA, 17 nt, Homo sapiens
aauagaaaccauuuuca

SEQ ID NO: 761617 - RNA, 20 nt, Homo sapiens
aauagaagaacauccaagga

SEQ ID NO: 761618 - RNA, 19 nt, Homo sapiens
aauagaaggauguacauuu

SEQ ID NO: 761619 - RNA, 14 nt, Homo sapiens
aauagaauaaucua

SEQ ID NO: 761620 - RNA, 19 nt, Homo sapiens
aauagacacauacauguca

SEQ ID NO: 761621 - RNA, 19 nt, Homo sapiens
aauagaccuaacugaauac

SEQ ID NO: 761622 - RNA, 16 nt, Homo sapiens
aauagacuaucuagaa

SEQ ID NO: 761623 - RNA, 22 nt, Homo sapiens
aauagacuaucuagaacuugag

SEQ ID NO: 761624 - RNA, 17 nt, Homo sapiens
aauagacugagucagau

SEQ ID NO: 761625 - RNA, 19 nt, Homo sapiens
aauagacuuaauacaugca

SEQ ID NO: 761626 - RNA, 23 nt, Homo sapiens
aauagcacacuuuuccacauucc

SEQ ID NO: 761627 - RNA, 18 nt, Homo sapiens
aauagccuaaaugauggu

SEQ ID NO: 761628 - RNA, 20 nt, Homo sapiens
aauagcucuacugcccuccc

SEQ ID NO: 761629 - RNA, 20 nt, Homo sapiens
aauaggcggggcacgguggc

SEQ ID NO: 761630 - RNA, 19 nt, Homo sapiens
aauaggcuauuaaaaaagu

SEQ ID NO: 761631 - RNA, 16 nt, Homo sapiens
aauagguaaagcuaua

SEQ ID NO: 761632 - RNA, 16 nt, Homo sapiens
aauaggucaucaugaa

SEQ ID NO: 761633 - RNA, 23 nt, Homo sapiens
aauaguaaaagauaacaagaucu

SEQ ID NO: 761634 - RNA, 22 nt, Homo sapiens
aauaguacagacagaaggugcu

SEQ ID NO: 761635 - RNA, 17 nt, Homo sapiens
aauaguaccuucaauac

SEQ ID NO: 761636 - RNA, 12 nt, Homo sapiens
aauagucauucc

SEQ ID NO: 761637 - RNA, 15 nt, Homo sapiens
aauagucucacuguc

SEQ ID NO: 761638 - RNA, 16 nt, Homo sapiens
aauagucuuccacaaa

SEQ ID NO: 761639 - RNA, 13 nt, Homo sapiens
aauagucuucuca

SEQ ID NO: 761640 - RNA, 15 nt, Homo sapiens
aauagucuuugccag

SEQ ID NO: 761641 - RNA, 16 nt, Homo sapiens
aauaguucaguagaau

SEQ ID NO: 761642 - RNA, 19 nt, Homo sapiens
aauaguucuaaacuaucaa

SEQ ID NO: 761643 - RNA, 14 nt, Homo sapiens
aauaguucuguaua

SEQ ID NO: 761644 - RNA, 21 nt, Homo sapiens
aauauaaaacuguacuucacu

SEQ ID NO: 761645 - RNA, 16 nt, Homo sapiens
aauauaaaaguaaaua

SEQ ID NO: 761646 - RNA, 18 nt, Homo sapiens
aauauaaauuuaagcaaa

SEQ ID NO: 761647 - RNA, 22 nt, Homo sapiens
aauauaaauuuguguucucaaa

SEQ ID NO: 761648 - RNA, 19 nt, Homo sapiens
aauauaagaccucuggcau

SEQ ID NO: 761649 - RNA, 13 nt, Homo sapiens
aauauaagcauaa

SEQ ID NO: 761650 - RNA, 17 nt, Homo sapiens
aauauaauauuuacugu

SEQ ID NO: 761651 - RNA, 18 nt, Homo sapiens
aauauacauucaaacuua

SEQ ID NO: 761652 - RNA, 16 nt, Homo sapiens
aauauagcaagaccac

SEQ ID NO: 761653 - RNA, 17 nt, Homo sapiens
aauauaguuauugcaca

SEQ ID NO: 761654 - RNA, 17 nt, Homo sapiens
aauauauaaaaaagcca

SEQ ID NO: 761655 - RNA, 18 nt, Homo sapiens
aauauauaaaaaagccac

SEQ ID NO: 761656 - RNA, 21 nt, Homo sapiens
aauauauaguggguacaucaa

SEQ ID NO: 761657 - RNA, 18 nt, Homo sapiens
aauauauaucuacaauau

SEQ ID NO: 761658 - RNA, 16 nt, Homo sapiens
aauauauaugaugaaa

SEQ ID NO: 761659 - RNA, 20 nt, Homo sapiens
aauauauauuaagugugcca

SEQ ID NO: 761660 - RNA, 13 nt, Homo sapiens
aauauaucuggaa

SEQ ID NO: 761661 - RNA, 15 nt, Homo sapiens
aauauauucuuucaa

SEQ ID NO: 761662 - RNA, 19 nt, Homo sapiens
aauauauuuuuagacucau

SEQ ID NO: 761663 - RNA, 14 nt, Homo sapiens
aauaucaguauucu

SEQ ID NO: 761664 - RNA, 12 nt, Homo sapiens
aauaucagucac

SEQ ID NO: 761665 - RNA, 22 nt, Homo sapiens
aauaucaucuuuuagacacagc

SEQ ID NO: 761666 - RNA, 20 nt, Homo sapiens
aacaugccaggcucaagguc

SEQ ID NO: 761667 - RNA, 16 nt, Homo sapiens
aacaugcuggugaaua

SEQ ID NO: 761668 - RNA, 13 nt, Homo sapiens
aacaugcuuuaga

SEQ ID NO: 761669 - RNA, 19 nt, Homo sapiens
aacauggacuuucuugcau

SEQ ID NO: 761670 - RNA, 23 nt, Homo sapiens
aacauggcugaacgcguguguac

SEQ ID NO: 761671 - RNA, 16 nt, Homo sapiens
aacaugguaaaacccc

SEQ ID NO: 761672 - RNA, 24 nt, Homo sapiens
aacauggugaaaccucaucucuac

SEQ ID NO: 761673 - RNA, 23 nt, Homo sapiens
aacauggugaaacuccaucucua

SEQ ID NO: 761674 - RNA, 21 nt, Homo sapiens
aacauggugccuauaucugag

SEQ ID NO: 761675 - RNA, 23 nt, Homo sapiens
aacauguaauaaaaaguauaugu

SEQ ID NO: 761676 - RNA, 12 nt, Homo sapiens
aacauguacaaa

SEQ ID NO: 761677 - RNA, 16 nt, Homo sapiens
aacauguauguauaca

SEQ ID NO: 761678 - RNA, 19 nt, Homo sapiens
aacauguaugugcauuuca

SEQ ID NO: 761679 - RNA, 17 nt, Homo sapiens
aacauguccuaauucuu

SEQ ID NO: 761680 - RNA, 23 nt, Homo sapiens
aacauguuccccaucuggugcuc

SEQ ID NO: 761681 - RNA, 18 nt, Homo sapiens
aacauuaaacacuguaau

SEQ ID NO: 761682 - RNA, 18 nt, Homo sapiens
aacauuaugaucuaauaa

SEQ ID NO: 761683 - RNA, 22 nt, Homo sapiens
aacauuauguggcccucuggau

SEQ ID NO: 761684 - RNA, 12 nt, Homo sapiens
aacauucaggaa

SEQ ID NO: 761685 - RNA, 14 nt, Homo sapiens
aacauucaguuccc

SEQ ID NO: 761686 - RNA, 23 nt, Homo sapiens
aacauuccauuugaagcagugau

SEQ ID NO: 761687 - RNA, 17 nt, Homo sapiens
aacauuccuuagucuca

SEQ ID NO: 761688 - RNA, 14 nt, Homo sapiens
aacauugaccaaga

SEQ ID NO: 761689 - RNA, 20 nt, Homo sapiens
aacauugcaauaaauggcuu

SEQ ID NO: 761690 - RNA, 13 nt, Homo sapiens
aacauuguacugu

SEQ ID NO: 761691 - RNA, 16 nt, Homo sapiens
aacauuguauucagcu

SEQ ID NO: 761692 - RNA, 14 nt, Homo sapiens
aacauuuacaugua

SEQ ID NO: 761693 - RNA, 20 nt, Homo sapiens
aacauuuccaaaaguggcua

SEQ ID NO: 761694 - RNA, 16 nt, Homo sapiens
aacauuucucacugaa

SEQ ID NO: 761695 - RNA, 14 nt, Homo sapiens
aacauuucucucca

SEQ ID NO: 761696 - RNA, 15 nt, Homo sapiens
aacauuucucuccac

SEQ ID NO: 761697 - RNA, 20 nt, Homo sapiens
aacauuugagauauguugaa

SEQ ID NO: 761698 - RNA, 14 nt, Homo sapiens
aacauuugccaagu

SEQ ID NO: 761699 - RNA, 23 nt, Homo sapiens
aacauuugccaagugaguugaau

SEQ ID NO: 761700 - RNA, 21 nt, Homo sapiens
aacauuuggauuggugaaugg

SEQ ID NO: 761701 - RNA, 22 nt, Homo sapiens
aacauuuguuucccccacaguu

SEQ ID NO: 761702 - RNA, 14 nt, Homo sapiens
aacauuuuacuacu

SEQ ID NO: 761703 - RNA, 19 nt, Homo sapiens
aacauuuuuuagucuguaa

SEQ ID NO: 761704 - RNA, 13 nt, Homo sapiens
aaccaaaacagag

SEQ ID NO: 761705 - RNA, 23 nt, Homo sapiens
aaccaaauuuguauuuaagguau

SEQ ID NO: 761706 - RNA, 22 nt, Homo sapiens
aaccaacaaaaagaacaaauca

SEQ ID NO: 761707 - RNA, 20 nt, Homo sapiens
aaccaacaauaaauauguau

SEQ ID NO: 761708 - RNA, 14 nt, Homo sapiens
aaccaacacuaaca

SEQ ID NO: 761709 - RNA, 15 nt, Homo sapiens
aaccaauagcuuuaa

SEQ ID NO: 761710 - RNA, 16 nt, Homo sapiens
aaccacaaacggagcc

SEQ ID NO: 761711 - RNA, 15 nt, Homo sapiens
aaccacaacugacac

SEQ ID NO: 761712 - RNA, 13 nt, Homo sapiens
aaccacagcacuu

SEQ ID NO: 761713 - RNA, 14 nt, Homo sapiens
aaccaccaauccaa

SEQ ID NO: 761714 - RNA, 13 nt, Homo sapiens
aaccacuuucuaa

SEQ ID NO: 761715 - RNA, 16 nt, Homo sapiens
aaccagaaaagcaaua

SEQ ID NO: 761716 - RNA, 13 nt, Homo sapiens
aaccagagaggcu

SEQ ID NO: 761717 - RNA, 16 nt, Homo sapiens
aaccagagccacaggc

SEQ ID NO: 761718 - RNA, 17 nt, Homo sapiens
aaccagagccacaggcc

SEQ ID NO: 761719 - RNA, 23 nt, Homo sapiens
aaccagauguuagaucaggggag

SEQ ID NO: 761720 - RNA, 23 nt, Homo sapiens
aaccagcuucugauaaacacaau

SEQ ID NO: 761721 - RNA, 12 nt, Homo sapiens
aaccaguccagg

SEQ ID NO: 761722 - RNA, 20 nt, Homo sapiens
aaccaguuauaaauacauau

SEQ ID NO: 761723 - RNA, 16 nt, Homo sapiens
aaccaguuaugugaau

SEQ ID NO: 761724 - RNA, 17 nt, Homo sapiens
aaccauaguuacuguaa

SEQ ID NO: 761725 - RNA, 17 nt, Homo sapiens
aaccaucaccagaauua

SEQ ID NO: 761726 - RNA, 20 nt, Homo sapiens
aaccauccauaguaguauga

SEQ ID NO: 761727 - RNA, 22 nt, Homo sapiens
aaccaugagaccacuguuauca

SEQ ID NO: 761728 - RNA, 16 nt, Homo sapiens
aaccaugguaacaaua

SEQ ID NO: 761729 - RNA, 21 nt, Homo sapiens
aagucaucuguuuaauuuaca

SEQ ID NO: 761730 - RNA, 15 nt, Homo sapiens
aagucaucuugcuac

SEQ ID NO: 761731 - RNA, 14 nt, Homo sapiens
aagucaugccugag

SEQ ID NO: 761732 - RNA, 21 nt, Homo sapiens
aagucauggcccaaauccagu

SEQ ID NO: 761733 - RNA, 18 nt, Homo sapiens
aagucccagagcaccuca

SEQ ID NO: 761734 - RNA, 15 nt, Homo sapiens
aaguccccucuacuu

SEQ ID NO: 761735 - RNA, 20 nt, Homo sapiens
aagucccugucauuugaacc

SEQ ID NO: 761736 - RNA, 19 nt, Homo sapiens
aaguccuacaagcuaaaau

SEQ ID NO: 761737 - RNA, 21 nt, Homo sapiens
aaguccugcuggaucuugccu

SEQ ID NO: 761738 - RNA, 13 nt, Homo sapiens
aaguccuuuaugu

SEQ ID NO: 761739 - RNA, 17 nt, Homo sapiens
aagucuaaauaaaugaa

SEQ ID NO: 761740 - RNA, 14 nt, Homo sapiens
aagucuaagcaaga

SEQ ID NO: 761741 - RNA, 14 nt, Homo sapiens
aagucuacaacaua

SEQ ID NO: 761742 - RNA, 13 nt, Homo sapiens
aagucuccaugaa

SEQ ID NO: 761743 - RNA, 13 nt, Homo sapiens
aagucucucaccc

SEQ ID NO: 761744 - RNA, 18 nt, Homo sapiens
aagucucucguaguguua

SEQ ID NO: 761745 - RNA, 23 nt, Homo sapiens
aagucuucucccguccauuccag

SEQ ID NO: 761746 - RNA, 19 nt, Homo sapiens
aagucuuguagaaaucuca

SEQ ID NO: 761747 - RNA, 21 nt, Homo sapiens
aagucuuguagaaaucucaga

SEQ ID NO: 761748 - RNA, 17 nt, Homo sapiens
aagugaaaaacauccag

SEQ ID NO: 761749 - RNA, 14 nt, Homo sapiens
aagugaacuaugaa

SEQ ID NO: 761750 - RNA, 16 nt, Homo sapiens
aagugacccuguucuc

SEQ ID NO: 761751 - RNA, 13 nt, Homo sapiens
aagugacuauuca

SEQ ID NO: 761752 - RNA, 12 nt, Homo sapiens
aagugagcagaa

SEQ ID NO: 761753 - RNA, 22 nt, Homo sapiens
aagugaggagaaugaaauguau

SEQ ID NO: 761754 - RNA, 17 nt, Homo sapiens
aagugaguuuguaaaua

SEQ ID NO: 761755 - RNA, 17 nt, Homo sapiens
aagugauacuauccagu

SEQ ID NO: 761756 - RNA, 17 nt, Homo sapiens
aagugauaugcauuucc

SEQ ID NO: 761757 - RNA, 15 nt, Homo sapiens
aagugaucaaacuac

SEQ ID NO: 761758 - RNA, 22 nt, Homo sapiens
aagugauuuuuuuccacaagau

SEQ ID NO: 761759 - RNA, 15 nt, Homo sapiens
aagugcauauuuauc

SEQ ID NO: 761760 - RNA, 18 nt, Homo sapiens
aagugccugacacacuaa

SEQ ID NO: 761761 - RNA, 18 nt, Homo sapiens
aagugcugagauuacaca

SEQ ID NO: 761762 - RNA, 20 nt, Homo sapiens
aagugcugagauuacaggca

SEQ ID NO: 761763 - RNA, 23 nt, Homo sapiens
aagugcuggcauuacagguguga

SEQ ID NO: 761764 - RNA, 22 nt, Homo sapiens
aagugcugggauuacaggugug

SEQ ID NO: 761765 - RNA, 20 nt, Homo sapiens
aagugcugggauuacuggca

SEQ ID NO: 761766 - RNA, 16 nt, Homo sapiens
aagugcuguugggaua

SEQ ID NO: 761767 - RNA, 19 nt, Homo sapiens
aagugcuucuccagccuca

SEQ ID NO: 761768 - RNA, 12 nt, Homo sapiens
aaguggcagcuu

SEQ ID NO: 761769 - RNA, 16 nt, Homo sapiens
aagugggacauucaaa

SEQ ID NO: 761770 - RNA, 23 nt, Homo sapiens
aagugggauuugcauaaagugaa

SEQ ID NO: 761771 - RNA, 17 nt, Homo sapiens
aagugggcagcauaaag

SEQ ID NO: 761772 - RNA, 20 nt, Homo sapiens
aagugggcagcauaaaguca

SEQ ID NO: 761773 - RNA, 16 nt, Homo sapiens
aagugggcauugccau

SEQ ID NO: 761774 - RNA, 13 nt, Homo sapiens
aagugggugaaug

SEQ ID NO: 761775 - RNA, 16 nt, Homo sapiens
aaguguccuucuugcu

SEQ ID NO: 761776 - RNA, 17 nt, Homo sapiens
aagugucucugccuuga

SEQ ID NO: 761777 - RNA, 15 nt, Homo sapiens
aagugucuuuugaca

SEQ ID NO: 761778 - RNA, 23 nt, Homo sapiens
aaguguggguuugguuagaggaa

SEQ ID NO: 761779 - RNA, 16 nt, Homo sapiens
aaguguuagaagccua

SEQ ID NO: 761780 - RNA, 20 nt, Homo sapiens
aaguguucacaacagugaaa

SEQ ID NO: 761781 - RNA, 18 nt, Homo sapiens
aaguguugauuacauaau

SEQ ID NO: 761782 - RNA, 19 nt, Homo sapiens
aaguguuguguuccuggcu

SEQ ID NO: 761783 - RNA, 23 nt, Homo sapiens
aaguuaaaaguguugauuacaua

SEQ ID NO: 761784 - RNA, 15 nt, Homo sapiens
aaguuaaagugaaua

SEQ ID NO: 761785 - RNA, 20 nt, Homo sapiens
aaguuaccuacaagaacaau

SEQ ID NO: 761786 - RNA, 12 nt, Homo sapiens
aaguuacuuuau

SEQ ID NO: 761787 - RNA, 18 nt, Homo sapiens
aaguuagagauuuuacaa

SEQ ID NO: 761788 - RNA, 22 nt, Homo sapiens
aaguuagccuccaccacccuuu

SEQ ID NO: 761789 - RNA, 22 nt, Homo sapiens
aaguuagucaauccugucauau

SEQ ID NO: 761790 - RNA, 18 nt, Homo sapiens
aaguuauacuguggcuau

SEQ ID NO: 761791 - RNA, 21 nt, Homo sapiens
aaguuauaguauaucuggaca

SEQ ID NO: 761792 - RNA, 20 nt, Homo sapiens
aaguuauugaugagagggaa

SEQ ID NO: 761793 - RNA, 16 nt, Homo sapiens
aaguuauuuuuguaca

SEQ ID NO: 761794 - RNA, 20 nt, Homo sapiens
aaguucaggcagcacaucaa

SEQ ID NO: 761795 - RNA, 14 nt, Homo sapiens
aaguucaucuugca

SEQ ID NO: 761796 - RNA, 21 nt, Homo sapiens
aaguuccaaaauaaagcauaa

SEQ ID NO: 761797 - RNA, 12 nt, Homo sapiens
aaguuccaagag

SEQ ID NO: 761798 - RNA, 22 nt, Homo sapiens
aaguucccuaugaaaaaugugu

SEQ ID NO: 761799 - RNA, 15 nt, Homo sapiens
aaguucuaaguucau

SEQ ID NO: 761800 - RNA, 21 nt, Homo sapiens
aaguucuccagcuucagcuca

SEQ ID NO: 761801 - RNA, 12 nt, Homo sapiens
aaguucuggaga

SEQ ID NO: 761802 - RNA, 15 nt, Homo sapiens
aaguugaaaagccaa

SEQ ID NO: 761803 - RNA, 17 nt, Homo sapiens
aaguugaugguauucau

SEQ ID NO: 761804 - RNA, 13 nt, Homo sapiens
aaguugcugugaa

SEQ ID NO: 761805 - RNA, 15 nt, Homo sapiens
aaguugcugugaaua

SEQ ID NO: 761806 - RNA, 16 nt, Homo sapiens
aaguuguggauaucag

SEQ ID NO: 761807 - RNA, 20 nt, Homo sapiens
aaguuguuauuucaguuuua

SEQ ID NO: 761808 - RNA, 20 nt, Homo sapiens
aaguuguugacugugauuag

SEQ ID NO: 761809 - RNA, 16 nt, Homo sapiens
aaguuuacccaugaag

SEQ ID NO: 761810 - RNA, 20 nt, Homo sapiens
aaguuuauuuuuucuacaca

SEQ ID NO: 761811 - RNA, 13 nt, Homo sapiens
aaguuuucaggac

SEQ ID NO: 761812 - RNA, 14 nt, Homo sapiens
aauaaaaacugacu

SEQ ID NO: 761813 - RNA, 15 nt, Homo sapiens
aauaaaaaugucuca

SEQ ID NO: 761814 - RNA, 22 nt, Homo sapiens
aauaaaaauucauaaccaaaga

SEQ ID NO: 761815 - RNA, 12 nt, Homo sapiens
aauaaaacauca

SEQ ID NO: 761816 - RNA, 14 nt, Homo sapiens
aauaaaaccgaagg

SEQ ID NO: 761817 - RNA, 15 nt, Homo sapiens
aauaaaaguaaagac

SEQ ID NO: 761818 - RNA, 16 nt, Homo sapiens
aauaaaauauucacuc

SEQ ID NO: 761819 - RNA, 15 nt, Homo sapiens
aauaaaauguguaca

SEQ ID NO: 761820 - RNA, 19 nt, Homo sapiens
aauaaacagcuucaugccu

SEQ ID NO: 761821 - RNA, 13 nt, Homo sapiens
aauaaacaucagu

SEQ ID NO: 761822 - RNA, 12 nt, Homo sapiens
aauaaacugugc

SEQ ID NO: 761823 - RNA, 11 nt, Homo sapiens
aauaaagcaau

SEQ ID NO: 761824 - RNA, 13 nt, Homo sapiens
aauaaaggaugau

SEQ ID NO: 761825 - RNA, 17 nt, Homo sapiens
aauaaaggcugaagcuu

SEQ ID NO: 761826 - RNA, 15 nt, Homo sapiens
aauaaaguaccacac

SEQ ID NO: 761827 - RNA, 15 nt, Homo sapiens
aauaaaguaccauua

SEQ ID NO: 761828 - RNA, 20 nt, Homo sapiens
aauaaaguacccugugcuca

SEQ ID NO: 761829 - RNA, 19 nt, Homo sapiens
aauaaaguacuuuaccuaa

SEQ ID NO: 761830 - RNA, 14 nt, Homo sapiens
aauaaaguccugac

SEQ ID NO: 761831 - RNA, 16 nt, Homo sapiens
aauaaaguuacuugaa

SEQ ID NO: 761832 - RNA, 16 nt, Homo sapiens
aauaaauacucaguga

SEQ ID NO: 761833 - RNA, 13 nt, Homo sapiens
aauaaauauuaca

SEQ ID NO: 761834 - RNA, 16 nt, Homo sapiens
aauaaauauuuaauga

SEQ ID NO: 761835 - RNA, 18 nt, Homo sapiens
aauaaauauuuaaugaau

SEQ ID NO: 761836 - RNA, 17 nt, Homo sapiens
aauaaaucguccuccca

SEQ ID NO: 761837 - RNA, 20 nt, Homo sapiens
aauaaaucguccucccaggc

SEQ ID NO: 761838 - RNA, 12 nt, Homo sapiens
aauaaaugacaa

SEQ ID NO: 761839 - RNA, 16 nt, Homo sapiens
aauaaaugacaaugua

SEQ ID NO: 761840 - RNA, 22 nt, Homo sapiens
aauaaaugagagggaaucgacu

SEQ ID NO: 761841 - RNA, 12 nt, Homo sapiens
aauaaaugauua

SEQ ID NO: 761842 - RNA, 13 nt, Homo sapiens
aauaaaugauuau

SEQ ID NO: 761843 - RNA, 17 nt, Homo sapiens
aauaaaugucaccaggu

SEQ ID NO: 761844 - RNA, 12 nt, Homo sapiens
aauaaaugucau

SEQ ID NO: 761845 - RNA, 15 nt, Homo sapiens
aaccauuccaacuuc

SEQ ID NO: 761846 - RNA, 18 nt, Homo sapiens
aaccauuucagccaaacu

SEQ ID NO: 761847 - RNA, 20 nt, Homo sapiens
aaccauuucagccaaacugu

SEQ ID NO: 761848 - RNA, 14 nt, Homo sapiens
aacccaaaccauga

SEQ ID NO: 761849 - RNA, 15 nt, Homo sapiens
aacccaaaucuuguu

SEQ ID NO: 761850 - RNA, 15 nt, Homo sapiens
aacccacagccaaac

SEQ ID NO: 761851 - RNA, 22 nt, Homo sapiens
aacccacuagaagcaacuagga

SEQ ID NO: 761852 - RNA, 17 nt, Homo sapiens
aacccagagguggaugu

SEQ ID NO: 761853 - RNA, 20 nt, Homo sapiens
aacccaggagauggaaguug

SEQ ID NO: 761854 - RNA, 13 nt, Homo sapiens
aacccaguggcug

SEQ ID NO: 761855 - RNA, 22 nt, Homo sapiens
aacccauuccaguacaguauuc

SEQ ID NO: 761856 - RNA, 13 nt, Homo sapiens
aacccauuugucu

SEQ ID NO: 761857 - RNA, 19 nt, Homo sapiens
aacccauuugucucuacuu

SEQ ID NO: 761858 - RNA, 18 nt, Homo sapiens
aaccccaacgcacaggaa

SEQ ID NO: 761859 - RNA, 11 nt, Homo sapiens
aaccccacugc

SEQ ID NO: 761860 - RNA, 12 nt, Homo sapiens
aaccccagugga

SEQ ID NO: 761861 - RNA, 18 nt, Homo sapiens
aaccccaguggauucuca

SEQ ID NO: 761862 - RNA, 17 nt, Homo sapiens
aacccccaucucuacua

SEQ ID NO: 761863 - RNA, 17 nt, Homo sapiens
aacccccgccaccucag

SEQ ID NO: 761864 - RNA, 15 nt, Homo sapiens
aaccccugauguuug

SEQ ID NO: 761865 - RNA, 21 nt, Homo sapiens
aaccccuuccagaucacugcc

SEQ ID NO: 761866 - RNA, 16 nt, Homo sapiens
aacccgaggcugagaa

SEQ ID NO: 761867 - RNA, 18 nt, Homo sapiens
aacccgguuuaccaguuu

SEQ ID NO: 761868 - RNA, 20 nt, Homo sapiens
aacccgugacuguuacuuua

SEQ ID NO: 761869 - RNA, 19 nt, Homo sapiens
aacccuaaucuuucacuug

SEQ ID NO: 761870 - RNA, 17 nt, Homo sapiens
aacccuaucuccugaca

SEQ ID NO: 761871 - RNA, 20 nt, Homo sapiens
aacccucacaagcaugaagu

SEQ ID NO: 761872 - RNA, 17 nt, Homo sapiens
aacccucagcacuguua

SEQ ID NO: 761873 - RNA, 23 nt, Homo sapiens
aacccucugcuucuccuucaaaa

SEQ ID NO: 761874 - RNA, 20 nt, Homo sapiens
aacccugcugaacacagugu

SEQ ID NO: 761875 - RNA, 13 nt, Homo sapiens
aacccugcuucug

SEQ ID NO: 761876 - RNA, 21 nt, Homo sapiens
aacccuuacauuaugcuauga

SEQ ID NO: 761877 - RNA, 14 nt, Homo sapiens
aacccuuauacuca

SEQ ID NO: 761878 - RNA, 18 nt, Homo sapiens
aaccgaugguccucacaa

SEQ ID NO: 761879 - RNA, 16 nt, Homo sapiens
aaccguaacccacccc

SEQ ID NO: 761880 - RNA, 13 nt, Homo sapiens
aaccuaauauuca

SEQ ID NO: 761881 - RNA, 13 nt, Homo sapiens
aaccuaauucuug

SEQ ID NO: 761882 - RNA, 22 nt, Homo sapiens
aaccuaauucuuguagaugcau

SEQ ID NO: 761883 - RNA, 17 nt, Homo sapiens
aaccuacacacauaccu

SEQ ID NO: 761884 - RNA, 21 nt, Homo sapiens
aaccuagaaguauuuuugucu

SEQ ID NO: 761885 - RNA, 20 nt, Homo sapiens
aaccuagauugcaccauugc

SEQ ID NO: 761886 - RNA, 23 nt, Homo sapiens
aaccuaguacugccccccaugag

SEQ ID NO: 761887 - RNA, 15 nt, Homo sapiens
aaccuauccuuccag

SEQ ID NO: 761888 - RNA, 19 nt, Homo sapiens
aaccucaaauauaguauau

SEQ ID NO: 761889 - RNA, 21 nt, Homo sapiens
aaccucaacugccuacuccaa

SEQ ID NO: 761890 - RNA, 14 nt, Homo sapiens
aaccucacaaagua

SEQ ID NO: 761891 - RNA, 14 nt, Homo sapiens
aaccucacugagag

SEQ ID NO: 761892 - RNA, 23 nt, Homo sapiens
aaccucagguacggagaagaaua

SEQ ID NO: 761893 - RNA, 14 nt, Homo sapiens
aaccucaucuuucu

SEQ ID NO: 761894 - RNA, 21 nt, Homo sapiens
aaccucaugacagccagagcc

SEQ ID NO: 761895 - RNA, 15 nt, Homo sapiens
aaccucauuccccaa

SEQ ID NO: 761896 - RNA, 17 nt, Homo sapiens
aaccucuagagucacug

SEQ ID NO: 761897 - RNA, 15 nt, Homo sapiens
aaccucugcacuacu

SEQ ID NO: 761898 - RNA, 16 nt, Homo sapiens
aaccucugccuuccag

SEQ ID NO: 761899 - RNA, 15 nt, Homo sapiens
aaccucuuugcucaa

SEQ ID NO: 761900 - RNA, 21 nt, Homo sapiens
aaccugcagggacuccaugcu

SEQ ID NO: 761901 - RNA, 20 nt, Homo sapiens
aaccugggagguggagguug

SEQ ID NO: 761902 - RNA, 17 nt, Homo sapiens
aaccugggcauuguuga

SEQ ID NO: 761903 - RNA, 19 nt, Homo sapiens
aaccuguccuugcacacuc

SEQ ID NO: 761904 - RNA, 12 nt, Homo sapiens
aaccugucucac

SEQ ID NO: 761905 - RNA, 13 nt, Homo sapiens
aaccugugccagg

SEQ ID NO: 761906 - RNA, 16 nt, Homo sapiens
aaccuguuacacuggg

SEQ ID NO: 761907 - RNA, 22 nt, Homo sapiens
aaccuuacuaauuauacuacuu

SEQ ID NO: 761908 - RNA, 23 nt, Homo sapiens
aaccuuauguagguugccagcua

SEQ ID NO: 761909 - RNA, 12 nt, Homo sapiens
aaccuuauucca

SEQ ID NO: 761910 - RNA, 13 nt, Homo sapiens
aaccuuccaccca

SEQ ID NO: 761911 - RNA, 20 nt, Homo sapiens
aaccuuccacccagugcuga

SEQ ID NO: 761912 - RNA, 13 nt, Homo sapiens
aaccuuccagcuc

SEQ ID NO: 761913 - RNA, 17 nt, Homo sapiens
aaccuuccaucucgcca

SEQ ID NO: 761914 - RNA, 19 nt, Homo sapiens
aaccuuccuuccugcuuga

SEQ ID NO: 761915 - RNA, 23 nt, Homo sapiens
aaccuuggagaggagaguggcag

SEQ ID NO: 761916 - RNA, 23 nt, Homo sapiens
aacgacaaagccaaacucugcca

SEQ ID NO: 761917 - RNA, 17 nt, Homo sapiens
aacgagaagcagcauuu

SEQ ID NO: 761918 - RNA, 21 nt, Homo sapiens
aacggaauaauaaaaagcauu

SEQ ID NO: 761919 - RNA, 14 nt, Homo sapiens
aacggacacugaaa

SEQ ID NO: 761920 - RNA, 18 nt, Homo sapiens
aacgguuuaauucugucu

SEQ ID NO: 761921 - RNA, 14 nt, Homo sapiens
aacguaaauacaca

SEQ ID NO: 761922 - RNA, 22 nt, Homo sapiens
aacguagcuucuaccaugaaca

SEQ ID NO: 761923 - RNA, 22 nt, Homo sapiens
aacgucauguguuuugccaaag

SEQ ID NO: 761924 - RNA, 20 nt, Homo sapiens
aacgugaaauucuauugaaa

SEQ ID NO: 761925 - RNA, 14 nt, Homo sapiens
aacgugcaaagcca

SEQ ID NO: 761926 - RNA, 17 nt, Homo sapiens
aacuaagaaauaugcac

SEQ ID NO: 761927 - RNA, 19 nt, Homo sapiens
aacuaagaaauaugcacaa

SEQ ID NO: 761928 - RNA, 17 nt, Homo sapiens
aacuaauaaaagcauaa

SEQ ID NO: 761929 - RNA, 20 nt, Homo sapiens
aacuaaucuaauuacugaag

SEQ ID NO: 761930 - RNA, 17 nt, Homo sapiens
aacuacagaaguggaag

SEQ ID NO: 761931 - RNA, 21 nt, Homo sapiens
aacuacagaguuuaugauuua

SEQ ID NO: 761932 - RNA, 23 nt, Homo sapiens
aacuacauauuguaaagcccauu

SEQ ID NO: 761933 - RNA, 23 nt, Homo sapiens
aacuacccagguauuacacaagc

SEQ ID NO: 761934 - RNA, 14 nt, Homo sapiens
aacuaccuuccacu

SEQ ID NO: 761935 - RNA, 13 nt, Homo sapiens
aacuacugugauc

SEQ ID NO: 761936 - RNA, 12 nt, Homo sapiens
aacuacuucuuu

SEQ ID NO: 761937 - RNA, 14 nt, Homo sapiens
aacuagaagccuag

SEQ ID NO: 761938 - RNA, 16 nt, Homo sapiens
aacuagagcacagaag

SEQ ID NO: 761939 - RNA, 20 nt, Homo sapiens
aacuagagcacagaaggaau

SEQ ID NO: 761940 - RNA, 13 nt, Homo sapiens
aacuagcagauuu

SEQ ID NO: 761941 - RNA, 19 nt, Homo sapiens
aacuagcucuauguuuaca

SEQ ID NO: 761942 - RNA, 12 nt, Homo sapiens
aacuagugaaau

SEQ ID NO: 761943 - RNA, 16 nt, Homo sapiens
aacuagugaaauguuc

SEQ ID NO: 761944 - RNA, 18 nt, Homo sapiens
aacuauaagcccacuguu

SEQ ID NO: 761945 - RNA, 13 nt, Homo sapiens
aacuauaccugcu

SEQ ID NO: 761946 - RNA, 17 nt, Homo sapiens
aacuauauucauuucca

SEQ ID NO: 761947 - RNA, 13 nt, Homo sapiens
aacuauccaaaac

SEQ ID NO: 761948 - RNA, 16 nt, Homo sapiens
aacuauguacuuuaaa

SEQ ID NO: 761949 - RNA, 15 nt, Homo sapiens
aacuauuaaggccuu

SEQ ID NO: 761950 - RNA, 21 nt, Homo sapiens
aacuauuggagggugggagag

SEQ ID NO: 761951 - RNA, 20 nt, Homo sapiens
aacuauuucuacacaguggg

SEQ ID NO: 761952 - RNA, 19 nt, Homo sapiens
aacuauuuuauucuaaaca

SEQ ID NO: 761953 - RNA, 23 nt, Homo sapiens
aacucaaauggggccagauccag

SEQ ID NO: 761954 - RNA, 15 nt, Homo sapiens
aacucaaccuggaca

SEQ ID NO: 761955 - RNA, 15 nt, Homo sapiens
aacucaacuguauaa

SEQ ID NO: 761956 - RNA, 18 nt, Homo sapiens
aacucaaggacuuugcag

SEQ ID NO: 761957 - RNA, 22 nt, Homo sapiens
aacucaauuucuugguauuauu

SEQ ID NO: 761958 - RNA, 15 nt, Homo sapiens
aacucacagagcuuu

SEQ ID NO: 761959 - RNA, 17 nt, Homo sapiens
aacucacaguaaugugu

SEQ ID NO: 761960 - RNA, 23 nt, Homo sapiens
aaauauuuaugagaaaguucuca

SEQ ID NO: 761961 - RNA, 13 nt, Homo sapiens
aaauauuucccau

SEQ ID NO: 761962 - RNA, 12 nt, Homo sapiens
aaauauuuugcu

SEQ ID NO: 761963 - RNA, 12 nt, Homo sapiens
aaaucaaaaagg

SEQ ID NO: 761964 - RNA, 15 nt, Homo sapiens
aaaucaaauauucca

SEQ ID NO: 761965 - RNA, 15 nt, Homo sapiens
aaaucaacucagugg

SEQ ID NO: 761966 - RNA, 15 nt, Homo sapiens
aaaucaacuugugua

SEQ ID NO: 761967 - RNA, 13 nt, Homo sapiens
aaaucacaucucc

SEQ ID NO: 761968 - RNA, 14 nt, Homo sapiens
aaaucagagacaaa

SEQ ID NO: 761969 - RNA, 13 nt, Homo sapiens
aaaucaguauuug

SEQ ID NO: 761970 - RNA, 16 nt, Homo sapiens
aaaucaguugugaaua

SEQ ID NO: 761971 - RNA, 23 nt, Homo sapiens
aaaucauaguuuaaacugcauua

SEQ ID NO: 761972 - RNA, 18 nt, Homo sapiens
aaaucaugccaguauuuu

SEQ ID NO: 761973 - RNA, 15 nt, Homo sapiens
aaaucauuaagacaa

SEQ ID NO: 761974 - RNA, 19 nt, Homo sapiens
aaaucauuaauacucuucu

SEQ ID NO: 761975 - RNA, 21 nt, Homo sapiens
aaauccaacuuucacagugaa

SEQ ID NO: 761976 - RNA, 17 nt, Homo sapiens
aaauccagugaccucuc

SEQ ID NO: 761977 - RNA, 15 nt, Homo sapiens
aaauccagugguggg

SEQ ID NO: 761978 - RNA, 15 nt, Homo sapiens
aaauccauaucuuaa

SEQ ID NO: 761979 - RNA, 15 nt, Homo sapiens
aaaucccaugguugu

SEQ ID NO: 761980 - RNA, 23 nt, Homo sapiens
aaauccgugaagucacauuccac

SEQ ID NO: 761981 - RNA, 13 nt, Homo sapiens
aaauccuuccuaa

SEQ ID NO: 761982 - RNA, 21 nt, Homo sapiens
aaauccuuccuaaacccaaug

SEQ ID NO: 761983 - RNA, 11 nt, Homo sapiens
aaauccuugau

SEQ ID NO: 761984 - RNA, 23 nt, Homo sapiens
aaaucggaucuggggcucuggga

SEQ ID NO: 761985 - RNA, 13 nt, Homo sapiens
aaaucguccuccc

SEQ ID NO: 761986 - RNA, 14 nt, Homo sapiens
aaaucguccuccca

SEQ ID NO: 761987 - RNA, 16 nt, Homo sapiens
aaaucuagaagacugu

SEQ ID NO: 761988 - RNA, 17 nt, Homo sapiens
aaaucuagaagacuguc

SEQ ID NO: 761989 - RNA, 23 nt, Homo sapiens
aaaucucuucuuugcugcaguca

SEQ ID NO: 761990 - RNA, 15 nt, Homo sapiens
aaaucugacccagug

SEQ ID NO: 761991 - RNA, 16 nt, Homo sapiens
aaaucuguccucugua

SEQ ID NO: 761992 - RNA, 19 nt, Homo sapiens
aaaucuucccaugcauucu

SEQ ID NO: 761993 - RNA, 13 nt, Homo sapiens
aaaucuuccuugu

SEQ ID NO: 761994 - RNA, 15 nt, Homo sapiens
aaaucuuuagggaau

SEQ ID NO: 761995 - RNA, 19 nt, Homo sapiens
aaaucuuuggauuugauca

SEQ ID NO: 761996 - RNA, 19 nt, Homo sapiens
aaaugaaaaaucuguugau

SEQ ID NO: 761997 - RNA, 19 nt, Homo sapiens
aaaugaaacaaauaaucac

SEQ ID NO: 761998 - RNA, 19 nt, Homo sapiens
aaaugaaagggaaacuggg

SEQ ID NO: 761999 - RNA, 22 nt, Homo sapiens
aaaugaaagggaaacugggaaa

SEQ ID NO: 762000 - RNA, 16 nt, Homo sapiens
aaaugaaauccaguga

SEQ ID NO: 762001 - RNA, 24 nt, Homo sapiens
aaaugaauagccaggccugaccuc

SEQ ID NO: 762002 - RNA, 19 nt, Homo sapiens
aaaugaauauucaacagcu

SEQ ID NO: 762003 - RNA, 22 nt, Homo sapiens
aaaugaauauucaacagcucac

SEQ ID NO: 762004 - RNA, 14 nt, Homo sapiens
aaaugacaugcacu

SEQ ID NO: 762005 - RNA, 13 nt, Homo sapiens
aaaugaccaaaga

SEQ ID NO: 762006 - RNA, 22 nt, Homo sapiens
aaaugagaauuuuauauucuaa

SEQ ID NO: 762007 - RNA, 16 nt, Homo sapiens
aaaugagagugguuag

SEQ ID NO: 762008 - RNA, 20 nt, Homo sapiens
aaaugaggacuucuggaaca

SEQ ID NO: 762009 - RNA, 13 nt, Homo sapiens
aaaugaguauuuc

SEQ ID NO: 762010 - RNA, 20 nt, Homo sapiens
aaaugagugagagaguucag

SEQ ID NO: 762011 - RNA, 14 nt, Homo sapiens
aaaugagugcuuaa

SEQ ID NO: 762012 - RNA, 19 nt, Homo sapiens
aaaugauaaggcucugaaa

SEQ ID NO: 762013 - RNA, 17 nt, Homo sapiens
aaaugaugccacuuccc

SEQ ID NO: 762014 - RNA, 18 nt, Homo sapiens
aaaugauuauauucacag

SEQ ID NO: 762015 - RNA, 19 nt, Homo sapiens
aacaacuuaauguucugaa

SEQ ID NO: 762016 - RNA, 15 nt, Homo sapiens
aacaacuuacacuua

SEQ ID NO: 762017 - RNA, 14 nt, Homo sapiens
aacaacuuggcauu

SEQ ID NO: 762018 - RNA, 20 nt, Homo sapiens
aacaacuuuauacccagaaa

SEQ ID NO: 762019 - RNA, 14 nt, Homo sapiens
aacaagaacuuuaa

SEQ ID NO: 762020 - RNA, 22 nt, Homo sapiens
aacaagacuuuuuguacugaaa

SEQ ID NO: 762021 - RNA, 17 nt, Homo sapiens
aacaagauacaaucuca

SEQ ID NO: 762022 - RNA, 14 nt, Homo sapiens
aacaagaugcugga

SEQ ID NO: 762023 - RNA, 15 nt, Homo sapiens
aacaagccaaagagc

SEQ ID NO: 762024 - RNA, 21 nt, Homo sapiens
aacaaggucugcucugcuccu

SEQ ID NO: 762025 - RNA, 14 nt, Homo sapiens
aacaaggugucuuu

SEQ ID NO: 762026 - RNA, 14 nt, Homo sapiens
aacaaguuguuaaa

SEQ ID NO: 762027 - RNA, 18 nt, Homo sapiens
aacaauaaaugaaugaau

SEQ ID NO: 762028 - RNA, 19 nt, Homo sapiens
aacaauaaaugaaugaaua

SEQ ID NO: 762029 - RNA, 21 nt, Homo sapiens
aacaauauguuugcaaacuug

SEQ ID NO: 762030 - RNA, 13 nt, Homo sapiens
aacaaucacaaag

SEQ ID NO: 762031 - RNA, 14 nt, Homo sapiens
aacaauccaucucu

SEQ ID NO: 762032 - RNA, 20 nt, Homo sapiens
aacaaucuauggcuuauuuc

SEQ ID NO: 762033 - RNA, 10 nt, Homo sapiens
aacaaugccc

SEQ ID NO: 762034 - RNA, 17 nt, Homo sapiens
aacaaugguugaaugaa

SEQ ID NO: 762035 - RNA, 14 nt, Homo sapiens
aacaauuucaauaa

SEQ ID NO: 762036 - RNA, 23 nt, Homo sapiens
aacaauuuuaggaggaccagagc

SEQ ID NO: 762037 - RNA, 18 nt, Homo sapiens
aacaauuuuuuugaaucu

SEQ ID NO: 762038 - RNA, 21 nt, Homo sapiens
aacacaaaauccaugggcagu

SEQ ID NO: 762039 - RNA, 13 nt, Homo sapiens
aacacacacuguu

SEQ ID NO: 762040 - RNA, 20 nt, Homo sapiens
aacacacagcaacauccaga

SEQ ID NO: 762041 - RNA, 21 nt, Homo sapiens
aacacacaggugcaacagacu

SEQ ID NO: 762042 - RNA, 12 nt, Homo sapiens
aacacacaugca

SEQ ID NO: 762043 - RNA, 20 nt, Homo sapiens
aacacacgagcaaacccaga

SEQ ID NO: 762044 - RNA, 14 nt, Homo sapiens
aacacacuggccau

SEQ ID NO: 762045 - RNA, 22 nt, Homo sapiens
aacacacuuggaugcaggguuu

SEQ ID NO: 762046 - RNA, 18 nt, Homo sapiens
aacacagaacugaucuca

SEQ ID NO: 762047 - RNA, 22 nt, Homo sapiens
aacacagcgagacuccgucuca

SEQ ID NO: 762048 - RNA, 21 nt, Homo sapiens
aacacagcuuuacaacuucca

SEQ ID NO: 762049 - RNA, 17 nt, Homo sapiens
aacacagucuacucuuu

SEQ ID NO: 762050 - RNA, 11 nt, Homo sapiens
aacacagugag

SEQ ID NO: 762051 - RNA, 21 nt, Homo sapiens
aacacaguuuagugcuuuaca

SEQ ID NO: 762052 - RNA, 15 nt, Homo sapiens
aacacauaacauugu

SEQ ID NO: 762053 - RNA, 22 nt, Homo sapiens
aacacaucccggcacuguuuuc

SEQ ID NO: 762054 - RNA, 19 nt, Homo sapiens
aacacauguucugugccug

SEQ ID NO: 762055 - RNA, 23 nt, Homo sapiens
aacacauuuaaacaucaguauua

SEQ ID NO: 762056 - RNA, 17 nt, Homo sapiens
aacaccaaaaagggauc

SEQ ID NO: 762057 - RNA, 20 nt, Homo sapiens
aacaccaccaucaucugaga

SEQ ID NO: 762058 - RNA, 22 nt, Homo sapiens
aacaccagcagcacuggaacca

SEQ ID NO: 762059 - RNA, 19 nt, Homo sapiens
aacacccaaagcauggacu

SEQ ID NO: 762060 - RNA, 13 nt, Homo sapiens
aacaccccacuga

SEQ ID NO: 762061 - RNA, 15 nt, Homo sapiens
aacaccccacugagc

SEQ ID NO: 762062 - RNA, 20 nt, Homo sapiens
aacacccgacuccucaaaag

SEQ ID NO: 762063 - RNA, 20 nt, Homo sapiens
aacaccgucccagggcucug

SEQ ID NO: 762064 - RNA, 13 nt, Homo sapiens
aacaccuaugcaa

SEQ ID NO: 762065 - RNA, 13 nt, Homo sapiens
aacaccugccuag

SEQ ID NO: 762066 - RNA, 17 nt, Homo sapiens
aacacuacauuacuuua

SEQ ID NO: 762067 - RNA, 22 nt, Homo sapiens
aacacuacugcuaaauccucau

SEQ ID NO: 762068 - RNA, 14 nt, Homo sapiens
aacacucaucacac

SEQ ID NO: 762069 - RNA, 16 nt, Homo sapiens
aacacugcuguccaca

SEQ ID NO: 762070 - RNA, 13 nt, Homo sapiens
aacacugugcacg

SEQ ID NO: 762071 - RNA, 17 nt, Homo sapiens
aacacuuaguaugcagu

SEQ ID NO: 762072 - RNA, 19 nt, Homo sapiens
aacacuuauacugacuuuc

SEQ ID NO: 762073 - RNA, 18 nt, Homo sapiens
aacacuuauguuauacaa

SEQ ID NO: 762074 - RNA, 13 nt, Homo sapiens
aacacuuauuuuc

SEQ ID NO: 762075 - RNA, 17 nt, Homo sapiens
aacacuuccagcauuua

SEQ ID NO: 762076 - RNA, 13 nt, Homo sapiens
aacacuucugcuu

SEQ ID NO: 762077 - RNA, 12 nt, Homo sapiens
aaacacuguaau

SEQ ID NO: 762078 - RNA, 14 nt, Homo sapiens
aaacacuuacagaa

SEQ ID NO: 762079 - RNA, 19 nt, Homo sapiens
aaacacuugaagugagaag

SEQ ID NO: 762080 - RNA, 20 nt, Homo sapiens
aaacagaaagcauccuaaau

SEQ ID NO: 762081 - RNA, 15 nt, Homo sapiens
aaacagaccccuguu

SEQ ID NO: 762082 - RNA, 23 nt, Homo sapiens
aaacagacgggucugagacugaa

SEQ ID NO: 762083 - RNA, 18 nt, Homo sapiens
aaacaggcaccacugcuu

SEQ ID NO: 762084 - RNA, 22 nt, Homo sapiens
aaacagggcugccuucuggccu

SEQ ID NO: 762085 - RNA, 16 nt, Homo sapiens
aaacaggguaccucaa

SEQ ID NO: 762086 - RNA, 18 nt, Homo sapiens
aaacaguaaaccuuaaca

SEQ ID NO: 762087 - RNA, 14 nt, Homo sapiens
aaacauacgacuua

SEQ ID NO: 762088 - RNA, 17 nt, Homo sapiens
aaacauagcaucucagg

SEQ ID NO: 762089 - RNA, 21 nt, Homo sapiens
aaacauauuuuuauacuuuau

SEQ ID NO: 762090 - RNA, 16 nt, Homo sapiens
aaacauccagauacac

SEQ ID NO: 762091 - RNA, 22 nt, Homo sapiens
aaacaugaccacucuuggcuau

SEQ ID NO: 762092 - RNA, 19 nt, Homo sapiens
aaacaugaccuuccacaau

SEQ ID NO: 762093 - RNA, 17 nt, Homo sapiens
aaacaugauuguuuaca

SEQ ID NO: 762094 - RNA, 17 nt, Homo sapiens
aaacaugcuaaauaguu

SEQ ID NO: 762095 - RNA, 14 nt, Homo sapiens
aaacauguacuaca

SEQ ID NO: 762096 - RNA, 16 nt, Homo sapiens
aaacauguaugugcau

SEQ ID NO: 762097 - RNA, 21 nt, Homo sapiens
aaacauguuuaaauagccuaa

SEQ ID NO: 762098 - RNA, 20 nt, Homo sapiens
aaacauuauaaaaauugaca

SEQ ID NO: 762099 - RNA, 17 nt, Homo sapiens
aaacauucaaagagaca

SEQ ID NO: 762100 - RNA, 19 nt, Homo sapiens
aaacauucacacagggcuc

SEQ ID NO: 762101 - RNA, 15 nt, Homo sapiens
aaacauuccaggaaa

SEQ ID NO: 762102 - RNA, 23 nt, Homo sapiens
aaacauugauuauaagcauguau

SEQ ID NO: 762103 - RNA, 14 nt, Homo sapiens
aaacauuugccaag

SEQ ID NO: 762104 - RNA, 17 nt, Homo sapiens
aaacauuuuaucauuaa

SEQ ID NO: 762105 - RNA, 19 nt, Homo sapiens
aaacauuuuucacaucucu

SEQ ID NO: 762106 - RNA, 21 nt, Homo sapiens
aaaccaaccgcacaugcagau

SEQ ID NO: 762107 - RNA, 19 nt, Homo sapiens
aaaccaagugcgcuuugca

SEQ ID NO: 762108 - RNA, 21 nt, Homo sapiens
aaaccacaacugacacaggaa

SEQ ID NO: 762109 - RNA, 22 nt, Homo sapiens
aaaccacagcugggcaggguga

SEQ ID NO: 762110 - RNA, 18 nt, Homo sapiens
aaaccaccuaguucuccc

SEQ ID NO: 762111 - RNA, 16 nt, Homo sapiens
aaaccacuagaacucu

SEQ ID NO: 762112 - RNA, 11 nt, Homo sapiens
aaaccacuucu

SEQ ID NO: 762113 - RNA, 21 nt, Homo sapiens
aaaccacuuuuuuuuccccaa

SEQ ID NO: 762114 - RNA, 15 nt, Homo sapiens
aaaccaugagaauuu

SEQ ID NO: 762115 - RNA, 18 nt, Homo sapiens
aaaccaugagaauuugca

SEQ ID NO: 762116 - RNA, 16 nt, Homo sapiens
aaaccauuuucaaaag

SEQ ID NO: 762117 - RNA, 22 nt, Homo sapiens
aaaccauuuuugcugaauucau

SEQ ID NO: 762118 - RNA, 23 nt, Homo sapiens
aaacccaagugccuucagaggau

SEQ ID NO: 762119 - RNA, 16 nt, Homo sapiens
aaacccaagugcugca

SEQ ID NO: 762120 - RNA, 17 nt, Homo sapiens
aaacccaauucagucuc

SEQ ID NO: 762121 - RNA, 15 nt, Homo sapiens
aaaccccaaacuguu

SEQ ID NO: 762122 - RNA, 13 nt, Homo sapiens
aaaccccagggua

SEQ ID NO: 762123 - RNA, 19 nt, Homo sapiens
aaaccccaucucuacuaaa

SEQ ID NO: 762124 - RNA, 19 nt, Homo sapiens
aaaccccaucuuuacuaaa

SEQ ID NO: 762125 - RNA, 20 nt, Homo sapiens
aaaccccaucuuuacuaaaa

SEQ ID NO: 762126 - RNA, 14 nt, Homo sapiens
aaacccccagugua

SEQ ID NO: 762127 - RNA, 17 nt, Homo sapiens
aaacccccaguguaaua

SEQ ID NO: 762128 - RNA, 21 nt, Homo sapiens
aaaccccgguggaaucccacc

SEQ ID NO: 762129 - RNA, 16 nt, Homo sapiens
aaacccucagcacugu

SEQ ID NO: 762130 - RNA, 19 nt, Homo sapiens
aaagaugugcaaaaucacu

SEQ ID NO: 762131 - RNA, 14 nt, Homo sapiens
aaagauuaaaugug

SEQ ID NO: 762132 - RNA, 19 nt, Homo sapiens
aaagauuaaaugugucauu

SEQ ID NO: 762133 - RNA, 22 nt, Homo sapiens
aaagauuauuuucauuuaucca

SEQ ID NO: 762134 - RNA, 19 nt, Homo sapiens
aaagauucucaucacucaa

SEQ ID NO: 762135 - RNA, 13 nt, Homo sapiens
aaagauugagaag

SEQ ID NO: 762136 - RNA, 14 nt, Homo sapiens
aaagauuguacuua

SEQ ID NO: 762137 - RNA, 15 nt, Homo sapiens
aaagauuucaagaag

SEQ ID NO: 762138 - RNA, 18 nt, Homo sapiens
aaagauuugugaacugga

SEQ ID NO: 762139 - RNA, 20 nt, Homo sapiens
aaagauuugugaacuggaag

SEQ ID NO: 762140 - RNA, 18 nt, Homo sapiens
aaagauuuuuggcacuuu

SEQ ID NO: 762141 - RNA, 13 nt, Homo sapiens
aaagcaaaagaga

SEQ ID NO: 762142 - RNA, 13 nt, Homo sapiens
aaagcaaaagcaa

SEQ ID NO: 762143 - RNA, 19 nt, Homo sapiens
aaagcaaaaggcugagaag

SEQ ID NO: 762144 - RNA, 14 nt, Homo sapiens
aaagcaaagucacu

SEQ ID NO: 762145 - RNA, 13 nt, Homo sapiens
aaagcaaauguga

SEQ ID NO: 762146 - RNA, 21 nt, Homo sapiens
aaagcaacaaagauugagaag

SEQ ID NO: 762147 - RNA, 15 nt, Homo sapiens
aaagcaacaucuuca

SEQ ID NO: 762148 - RNA, 20 nt, Homo sapiens
aaagcaagacuguugcucaa

SEQ ID NO: 762149 - RNA, 18 nt, Homo sapiens
aaagcaagggaccuucau

SEQ ID NO: 762150 - RNA, 23 nt, Homo sapiens
aaagcaauucugacuguccagga

SEQ ID NO: 762151 - RNA, 10 nt, Homo sapiens
aaagcacagc

SEQ ID NO: 762152 - RNA, 15 nt, Homo sapiens
aaagcaccuuagcug

SEQ ID NO: 762153 - RNA, 23 nt, Homo sapiens
aaagcacgugucucagacugcau

SEQ ID NO: 762154 - RNA, 13 nt, Homo sapiens
aaagcacugagca

SEQ ID NO: 762155 - RNA, 12 nt, Homo sapiens
aaagcacuguug

SEQ ID NO: 762156 - RNA, 17 nt, Homo sapiens
aaagcaguaaauuugcu

SEQ ID NO: 762157 - RNA, 19 nt, Homo sapiens
aaagcaguucuuaacccag

SEQ ID NO: 762158 - RNA, 18 nt, Homo sapiens
aaagcauaaaaagguuuu

SEQ ID NO: 762159 - RNA, 17 nt, Homo sapiens
aaagcaucuaucucauc

SEQ ID NO: 762160 - RNA, 14 nt, Homo sapiens
aaagcaugcauucu

SEQ ID NO: 762161 - RNA, 13 nt, Homo sapiens
aaagcaugucuca

SEQ ID NO: 762162 - RNA, 20 nt, Homo sapiens
aaagcauguggcauguucau

SEQ ID NO: 762163 - RNA, 10 nt, Homo sapiens
aaagcauucu

SEQ ID NO: 762164 - RNA, 15 nt, Homo sapiens
aaagcauucuuuaac

SEQ ID NO: 762165 - RNA, 12 nt, Homo sapiens
aaagccaaaaac

SEQ ID NO: 762166 - RNA, 15 nt, Homo sapiens
aaagccaacagucaa

SEQ ID NO: 762167 - RNA, 22 nt, Homo sapiens
aaagccacaaugagaaugaugc

SEQ ID NO: 762168 - RNA, 21 nt, Homo sapiens
aaagccaccagacugacaaau

SEQ ID NO: 762169 - RNA, 20 nt, Homo sapiens
aaagccacuggaaggagcac

SEQ ID NO: 762170 - RNA, 12 nt, Homo sapiens
aaagccagaacc

SEQ ID NO: 762171 - RNA, 17 nt, Homo sapiens
aaagccagccaagcuuu

SEQ ID NO: 762172 - RNA, 22 nt, Homo sapiens
aaagccaggccugacgcauucu

SEQ ID NO: 762173 - RNA, 18 nt, Homo sapiens
aaagcccaaccuccugac

SEQ ID NO: 762174 - RNA, 14 nt, Homo sapiens
aaagcccaaggugc

SEQ ID NO: 762175 - RNA, 18 nt, Homo sapiens
aaagccucagaaagggau

SEQ ID NO: 762176 - RNA, 14 nt, Homo sapiens
aaagcgagauccca

SEQ ID NO: 762177 - RNA, 19 nt, Homo sapiens
aaagcgagaucccaucucu

SEQ ID NO: 762178 - RNA, 21 nt, Homo sapiens
aaagcguuucuuuacuucuca

SEQ ID NO: 762179 - RNA, 22 nt, Homo sapiens
aaagcuacaacaaauacuacag

SEQ ID NO: 762180 - RNA, 19 nt, Homo sapiens
aaagcuaguguaccuccuc

SEQ ID NO: 762181 - RNA, 17 nt, Homo sapiens
aaagcuauauaagacaa

SEQ ID NO: 762182 - RNA, 14 nt, Homo sapiens
aaagcugaagacca

SEQ ID NO: 762183 - RNA, 16 nt, Homo sapiens
aaagcugagccugcag

SEQ ID NO: 762184 - RNA, 17 nt, Homo sapiens
aaagcugauuacuguca

SEQ ID NO: 762185 - RNA, 13 nt, Homo sapiens
aaagcugccauuu

SEQ ID NO: 762186 - RNA, 13 nt, Homo sapiens
aaagcugccuguc

SEQ ID NO: 762187 - RNA, 13 nt, Homo sapiens
aaagcugcuguca

SEQ ID NO: 762188 - RNA, 15 nt, Homo sapiens
aaagcugcugucacu

SEQ ID NO: 762189 - RNA, 17 nt, Homo sapiens
ccgacuccucaaaagca

SEQ ID NO: 762190 - RNA, 16 nt, Homo sapiens
ccgacuggcugugaga

SEQ ID NO: 762191 - RNA, 23 nt, Homo sapiens
ccgagcccagcuacauuccucag

SEQ ID NO: 762192 - RNA, 17 nt, Homo sapiens
ccgagcucuggugcuuu

SEQ ID NO: 762193 - RNA, 17 nt, Homo sapiens
ccgaggccgugcagugg

SEQ ID NO: 762194 - RNA, 19 nt, Homo sapiens
ccgaggcugagaaucagac

SEQ ID NO: 762195 - RNA, 21 nt, Homo sapiens
ccgagucagacuuuguguuca

SEQ ID NO: 762196 - RNA, 13 nt, Homo sapiens
ccgagugcaauga

SEQ ID NO: 762197 - RNA, 16 nt, Homo sapiens
ccgaugcugaccucac

SEQ ID NO: 762198 - RNA, 16 nt, Homo sapiens
ccgcaacagccaagug

SEQ ID NO: 762199 - RNA, 20 nt, Homo sapiens
ccgcacccuggccugguccc

SEQ ID NO: 762200 - RNA, 14 nt, Homo sapiens
ccgcagaagcagac

SEQ ID NO: 762201 - RNA, 23 nt, Homo sapiens
ccgcagaagcccugauguguccu

SEQ ID NO: 762202 - RNA, 20 nt, Homo sapiens
ccgcagggagggcuguggug

SEQ ID NO: 762203 - RNA, 16 nt, Homo sapiens
ccgcagggccaugcag

SEQ ID NO: 762204 - RNA, 17 nt, Homo sapiens
ccgcaggugcugguccc

SEQ ID NO: 762205 - RNA, 18 nt, Homo sapiens
ccgcauuuggauuggaug

SEQ ID NO: 762206 - RNA, 23 nt, Homo sapiens
ccgccauccaccccguugcucaa

SEQ ID NO: 762207 - RNA, 18 nt, Homo sapiens
ccgccuccaaaugccaac

SEQ ID NO: 762208 - RNA, 22 nt, Homo sapiens
ccgccugaaagccacaaugaga

SEQ ID NO: 762209 - RNA, 11 nt, Homo sapiens
ccgccuuccaa

SEQ ID NO: 762210 - RNA, 22 nt, Homo sapiens
ccgccuuccuccuccacagugc

SEQ ID NO: 762211 - RNA, 14 nt, Homo sapiens
ccgcggugcucugg

SEQ ID NO: 762212 - RNA, 20 nt, Homo sapiens
ccgcucaggggccuggaggu

SEQ ID NO: 762213 - RNA, 14 nt, Homo sapiens
ccgcucucucugag

SEQ ID NO: 762214 - RNA, 15 nt, Homo sapiens
ccgcucucucugagg

SEQ ID NO: 762215 - RNA, 20 nt, Homo sapiens
ccgcugcuuccaggcugggc

SEQ ID NO: 762216 - RNA, 15 nt, Homo sapiens
ccgcuuucucugagg

SEQ ID NO: 762217 - RNA, 18 nt, Homo sapiens
ccgcuuugaaagaagcaa

SEQ ID NO: 762218 - RNA, 21 nt, Homo sapiens
ccggaaggaggccaaccagcc

SEQ ID NO: 762219 - RNA, 18 nt, Homo sapiens
ccggaggaaaagcagcuc

SEQ ID NO: 762220 - RNA, 15 nt, Homo sapiens
ccggauauauacaua

SEQ ID NO: 762221 - RNA, 22 nt, Homo sapiens
ccggauauauacauagcaugac

SEQ ID NO: 762222 - RNA, 15 nt, Homo sapiens
ccggccaccugagug

SEQ ID NO: 762223 - RNA, 23 nt, Homo sapiens
ccggcgaaauaaaaucagaguug

SEQ ID NO: 762224 - RNA, 18 nt, Homo sapiens
ccgggaaacauagccuca

SEQ ID NO: 762225 - RNA, 20 nt, Homo sapiens
ccgggaacagagaagugugg

SEQ ID NO: 762226 - RNA, 13 nt, Homo sapiens
ccgggaaggggaa

SEQ ID NO: 762227 - RNA, 19 nt, Homo sapiens
ccgggaccauugaccucag

SEQ ID NO: 762228 - RNA, 16 nt, Homo sapiens
ccggggcuccacugaa

SEQ ID NO: 762229 - RNA, 23 nt, Homo sapiens
ccgguuaaauuccauaugcucca

SEQ ID NO: 762230 - RNA, 13 nt, Homo sapiens
ccgguuugccaug

SEQ ID NO: 762231 - RNA, 14 nt, Homo sapiens
ccguaccaaucucu

SEQ ID NO: 762232 - RNA, 14 nt, Homo sapiens
ccguaucacagugu

SEQ ID NO: 762233 - RNA, 13 nt, Homo sapiens
ccgucagaucucu

SEQ ID NO: 762234 - RNA, 15 nt, Homo sapiens
ccgucagaucucugu

SEQ ID NO: 762235 - RNA, 23 nt, Homo sapiens
ccgucagccaaauguaauugaau

SEQ ID NO: 762236 - RNA, 15 nt, Homo sapiens
ccguccucacccauc

SEQ ID NO: 762237 - RNA, 21 nt, Homo sapiens
ccgugagugaaccaucauuau

SEQ ID NO: 762238 - RNA, 17 nt, Homo sapiens
ccgugagugacauagcc

SEQ ID NO: 762239 - RNA, 16 nt, Homo sapiens
ccgugcaguacaggca

SEQ ID NO: 762240 - RNA, 16 nt, Homo sapiens
ccgugcuuaaccaaag

SEQ ID NO: 762241 - RNA, 16 nt, Homo sapiens
ccguguggcccaagac

SEQ ID NO: 762242 - RNA, 15 nt, Homo sapiens
ccguuaaaaaaucaa

SEQ ID NO: 762243 - RNA, 13 nt, Homo sapiens
ccguuccagcuga

SEQ ID NO: 762244 - RNA, 16 nt, Homo sapiens
cccaaugccugugaag

SEQ ID NO: 762245 - RNA, 12 nt, Homo sapiens
cccacaaaauau

SEQ ID NO: 762246 - RNA, 22 nt, Homo sapiens
cccacaaucuggcuuagugcca

SEQ ID NO: 762247 - RNA, 23 nt, Homo sapiens
cccacaaucuggcuuagugccac

SEQ ID NO: 762248 - RNA, 12 nt, Homo sapiens
cccacagaguug

SEQ ID NO: 762249 - RNA, 21 nt, Homo sapiens
cccacagaguuggggagauaa

SEQ ID NO: 762250 - RNA, 13 nt, Homo sapiens
cccacagccauag

SEQ ID NO: 762251 - RNA, 19 nt, Homo sapiens
cccacagcuggcucugaca

SEQ ID NO: 762252 - RNA, 17 nt, Homo sapiens
cccacauccaacuccag

SEQ ID NO: 762253 - RNA, 23 nt, Homo sapiens
cccacaugugacacauaugcacc

SEQ ID NO: 762254 - RNA, 19 nt, Homo sapiens
cccaccacauagcaugcuu

SEQ ID NO: 762255 - RNA, 18 nt, Homo sapiens
cccaccagagugaugugu

SEQ ID NO: 762256 - RNA, 22 nt, Homo sapiens
cccaccagcuaaggacauuucc

SEQ ID NO: 762257 - RNA, 18 nt, Homo sapiens
cccaccauucccugccuu

SEQ ID NO: 762258 - RNA, 15 nt, Homo sapiens
cccacccaacuaauu

SEQ ID NO: 762259 - RNA, 19 nt, Homo sapiens
cccacccacagccauagac

SEQ ID NO: 762260 - RNA, 14 nt, Homo sapiens
cccacccagucuca

SEQ ID NO: 762261 - RNA, 15 nt, Homo sapiens
cccaccccacuccag

SEQ ID NO: 762262 - RNA, 14 nt, Homo sapiens
cccacccgcuccca

SEQ ID NO: 762263 - RNA, 18 nt, Homo sapiens
cccacccgggagugaugg

SEQ ID NO: 762264 - RNA, 16 nt, Homo sapiens
cccaccguuaggauuc

SEQ ID NO: 762265 - RNA, 15 nt, Homo sapiens
cccaccucacaguga

SEQ ID NO: 762266 - RNA, 20 nt, Homo sapiens
cccaccuuuggaaagcucug

SEQ ID NO: 762267 - RNA, 17 nt, Homo sapiens
cccacgaggauggccug

SEQ ID NO: 762268 - RNA, 18 nt, Homo sapiens
cccacuaaaacugcauuu

SEQ ID NO: 762269 - RNA, 17 nt, Homo sapiens
cccacugaaccuucuga

SEQ ID NO: 762270 - RNA, 19 nt, Homo sapiens
cccacugagcuguggaugg

SEQ ID NO: 762271 - RNA, 20 nt, Homo sapiens
cccacuguucugaaaggaga

SEQ ID NO: 762272 - RNA, 16 nt, Homo sapiens
cccacuguucuuguau

SEQ ID NO: 762273 - RNA, 19 nt, Homo sapiens
cccacuguuucucuugagc

SEQ ID NO: 762274 - RNA, 15 nt, Homo sapiens
cccacuucacuguga

SEQ ID NO: 762275 - RNA, 14 nt, Homo sapiens
cccacuuggcauca

SEQ ID NO: 762276 - RNA, 19 nt, Homo sapiens
cccacuuggcaucauucac

SEQ ID NO: 762277 - RNA, 11 nt, Homo sapiens
cccacuuugaa

SEQ ID NO: 762278 - RNA, 20 nt, Homo sapiens
cccagaaaaggcggugcuca

SEQ ID NO: 762279 - RNA, 12 nt, Homo sapiens
cccagaaggcag

SEQ ID NO: 762280 - RNA, 18 nt, Homo sapiens
cccagacaauuccauuca

SEQ ID NO: 762281 - RNA, 12 nt, Homo sapiens
cccagacugucu

SEQ ID NO: 762282 - RNA, 19 nt, Homo sapiens
cccagagacauacuugaag

SEQ ID NO: 762283 - RNA, 22 nt, Homo sapiens
cccagagacauacuugaagggc

SEQ ID NO: 762284 - RNA, 22 nt, Homo sapiens
cccagagauaacacgaugcgua

SEQ ID NO: 762285 - RNA, 23 nt, Homo sapiens
cccagagcgaggaaaggauuuua

SEQ ID NO: 762286 - RNA, 15 nt, Homo sapiens
cccagagguggaugu

SEQ ID NO: 762287 - RNA, 14 nt, Homo sapiens
cccagaguggcuca

SEQ ID NO: 762288 - RNA, 15 nt, Homo sapiens
cccagauacuuccca

SEQ ID NO: 762289 - RNA, 18 nt, Homo sapiens
cccagaugaucccaguca

SEQ ID NO: 762290 - RNA, 13 nt, Homo sapiens
cccagauuucagg

SEQ ID NO: 762291 - RNA, 21 nt, Homo sapiens
cccagcacuuugggaggccaa

SEQ ID NO: 762292 - RNA, 22 nt, Homo sapiens
cccagcagcagagaaccaucaa

SEQ ID NO: 762293 - RNA, 21 nt, Homo sapiens
cccagcaggcccagcaugcag

SEQ ID NO: 762294 - RNA, 18 nt, Homo sapiens
cccagcagguuaccugga

SEQ ID NO: 762295 - RNA, 14 nt, Homo sapiens
cccagcaugcaggu

SEQ ID NO: 762296 - RNA, 20 nt, Homo sapiens
cccagccaaucuagaggcaa

SEQ ID NO: 762297 - RNA, 14 nt, Homo sapiens
cccagccccuccaa

SEQ ID NO: 762298 - RNA, 19 nt, Homo sapiens
cccagccccuccaaagguc

SEQ ID NO: 762299 - RNA, 14 nt, Homo sapiens
cccagccccuucca

SEQ ID NO: 762300 - RNA, 18 nt, Homo sapiens
cccagccgaaaagcuuuu

SEQ ID NO: 762301 - RNA, 16 nt, Homo sapiens
cccagccgcacuggga

SEQ ID NO: 762302 - RNA, 21 nt, Homo sapiens
cccccuccccggccacaugcc

SEQ ID NO: 762303 - RNA, 19 nt, Homo sapiens
cccccuguagacuagugcc

SEQ ID NO: 762304 - RNA, 14 nt, Homo sapiens
cccccuucagugcc

SEQ ID NO: 762305 - RNA, 21 nt, Homo sapiens
ccccgacacccagcccagcuu

SEQ ID NO: 762306 - RNA, 13 nt, Homo sapiens
ccccgcaaagaca

SEQ ID NO: 762307 - RNA, 16 nt, Homo sapiens
ccccgcccagugcagu

SEQ ID NO: 762308 - RNA, 22 nt, Homo sapiens
ccccguguccucucccugccaa

SEQ ID NO: 762309 - RNA, 13 nt, Homo sapiens
ccccuacucccuc

SEQ ID NO: 762310 - RNA, 17 nt, Homo sapiens
ccccucagagacugaaa

SEQ ID NO: 762311 - RNA, 23 nt, Homo sapiens
ccccucauccgauuccccuguag

SEQ ID NO: 762312 - RNA, 21 nt, Homo sapiens
ccccuccucccccggcugggc

SEQ ID NO: 762313 - RNA, 21 nt, Homo sapiens
ccccuccuuggcuuuaugcaa

SEQ ID NO: 762314 - RNA, 22 nt, Homo sapiens
ccccuccuuggcuuuaugcaaa

SEQ ID NO: 762315 - RNA, 16 nt, Homo sapiens
ccccuccuugggcacu

SEQ ID NO: 762316 - RNA, 15 nt, Homo sapiens
ccccucggagaagag

SEQ ID NO: 762317 - RNA, 13 nt, Homo sapiens
ccccucucaccaa

SEQ ID NO: 762318 - RNA, 14 nt, Homo sapiens
ccccucucaccaaa

SEQ ID NO: 762319 - RNA, 15 nt, Homo sapiens
ccccucucugggcag

SEQ ID NO: 762320 - RNA, 21 nt, Homo sapiens
ccccucucugggcagucagaa

SEQ ID NO: 762321 - RNA, 17 nt, Homo sapiens
ccccucugucuugugaa

SEQ ID NO: 762322 - RNA, 20 nt, Homo sapiens
ccccucuuagcuuacaggaa

SEQ ID NO: 762323 - RNA, 14 nt, Homo sapiens
ccccugcacaguug

SEQ ID NO: 762324 - RNA, 18 nt, Homo sapiens
ccccugcuccaccagcag

SEQ ID NO: 762325 - RNA, 19 nt, Homo sapiens
ccccuggaucuaccagcau

SEQ ID NO: 762326 - RNA, 12 nt, Homo sapiens
ccccuggccuca

SEQ ID NO: 762327 - RNA, 23 nt, Homo sapiens
ccccuggcuccagagauggucac

SEQ ID NO: 762328 - RNA, 15 nt, Homo sapiens
ccccuggcucugggc

SEQ ID NO: 762329 - RNA, 16 nt, Homo sapiens
ccccugggauggcuca

SEQ ID NO: 762330 - RNA, 23 nt, Homo sapiens
ccccugggcaagagaugggacaa

SEQ ID NO: 762331 - RNA, 16 nt, Homo sapiens
ccccuggggcuguauu

SEQ ID NO: 762332 - RNA, 20 nt, Homo sapiens
ccccuguagacuagugccgu

SEQ ID NO: 762333 - RNA, 12 nt, Homo sapiens
ccccuucauccg

SEQ ID NO: 762334 - RNA, 16 nt, Homo sapiens
ccccuucucucaucuc

SEQ ID NO: 762335 - RNA, 18 nt, Homo sapiens
ccccuucugacugagcaa

SEQ ID NO: 762336 - RNA, 18 nt, Homo sapiens
ccccuugccagacaugug

SEQ ID NO: 762337 - RNA, 12 nt, Homo sapiens
ccccuuugcccu

SEQ ID NO: 762338 - RNA, 18 nt, Homo sapiens
cccgaggacaguggcaga

SEQ ID NO: 762339 - RNA, 22 nt, Homo sapiens
cccgcagugcugggaccagagc

SEQ ID NO: 762340 - RNA, 17 nt, Homo sapiens
cccgccaugcucaggag

SEQ ID NO: 762341 - RNA, 22 nt, Homo sapiens
cccgccuccacucuaguucuag

SEQ ID NO: 762342 - RNA, 14 nt, Homo sapiens
cccgcggguucuag

SEQ ID NO: 762343 - RNA, 14 nt, Homo sapiens
cccgcuagcauuag

SEQ ID NO: 762344 - RNA, 23 nt, Homo sapiens
cccgcugggauuucuucgcugcu

SEQ ID NO: 762345 - RNA, 22 nt, Homo sapiens
cccggccagcgggcacagggca

SEQ ID NO: 762346 - RNA, 18 nt, Homo sapiens
cccggcuacaucagccuu

SEQ ID NO: 762347 - RNA, 13 nt, Homo sapiens
cccggcugugauu

SEQ ID NO: 762348 - RNA, 14 nt, Homo sapiens
cccgggcugccugg

SEQ ID NO: 762349 - RNA, 19 nt, Homo sapiens
cccgggcugccugggcugu

SEQ ID NO: 762350 - RNA, 21 nt, Homo sapiens
cccggggcggcaggaaggggg

SEQ ID NO: 762351 - RNA, 18 nt, Homo sapiens
cccggugguuugccaugu

SEQ ID NO: 762352 - RNA, 14 nt, Homo sapiens
cccgucauguuccu

SEQ ID NO: 762353 - RNA, 20 nt, Homo sapiens
cccgucauguuccucaaaag

SEQ ID NO: 762354 - RNA, 22 nt, Homo sapiens
cccgucucuauaccaaccaaac

SEQ ID NO: 762355 - RNA, 20 nt, Homo sapiens
cccgugacgaggcucaaaaa

SEQ ID NO: 762356 - RNA, 11 nt, Homo sapiens
cccgugacugc

SEQ ID NO: 762357 - RNA, 22 nt, Homo sapiens
cccgugggcaucucaagcccca

SEQ ID NO: 762358 - RNA, 14 nt, Homo sapiens
cccuaaaaauucca

SEQ ID NO: 762359 - RNA, 21 nt, Homo sapiens
ccaucuggcuuuuucugccac

SEQ ID NO: 762360 - RNA, 22 nt, Homo sapiens
ccaucugucuugccagccagaa

SEQ ID NO: 762361 - RNA, 14 nt, Homo sapiens
ccaucugugcagua

SEQ ID NO: 762362 - RNA, 12 nt, Homo sapiens
ccaucuuuacaa

SEQ ID NO: 762363 - RNA, 17 nt, Homo sapiens
ccaugaagauaaacugu

SEQ ID NO: 762364 - RNA, 22 nt, Homo sapiens
ccaugacaagaacaaagccacu

SEQ ID NO: 762365 - RNA, 18 nt, Homo sapiens
ccaugaccuaguuuucca

SEQ ID NO: 762366 - RNA, 17 nt, Homo sapiens
ccaugaggcaaugucag

SEQ ID NO: 762367 - RNA, 19 nt, Homo sapiens
ccaugauaacugcaauuuu

SEQ ID NO: 762368 - RNA, 22 nt, Homo sapiens
ccaugauggcaacagaucugga

SEQ ID NO: 762369 - RNA, 22 nt, Homo sapiens
ccaugcagcggccugagcagua

SEQ ID NO: 762370 - RNA, 10 nt, Homo sapiens
ccaugccacc

SEQ ID NO: 762371 - RNA, 20 nt, Homo sapiens
ccaugccacccuguuuucag

SEQ ID NO: 762372 - RNA, 15 nt, Homo sapiens
ccaugcccagccugu

SEQ ID NO: 762373 - RNA, 23 nt, Homo sapiens
ccaugccugcucccugucugugu

SEQ ID NO: 762374 - RNA, 11 nt, Homo sapiens
ccaugccuguc

SEQ ID NO: 762375 - RNA, 17 nt, Homo sapiens
ccaugcguccuggucaa

SEQ ID NO: 762376 - RNA, 22 nt, Homo sapiens
ccaugcgugccgccugcuccuc

SEQ ID NO: 762377 - RNA, 17 nt, Homo sapiens
ccaugcucaaccacugu

SEQ ID NO: 762378 - RNA, 13 nt, Homo sapiens
ccaugcugugcug

SEQ ID NO: 762379 - RNA, 22 nt, Homo sapiens
ccaugcuguuuucccuuugcca

SEQ ID NO: 762380 - RNA, 18 nt, Homo sapiens
ccauggaagguucucugu

SEQ ID NO: 762381 - RNA, 22 nt, Homo sapiens
ccauggcaccuuuugcacauaa

SEQ ID NO: 762382 - RNA, 15 nt, Homo sapiens
ccauggcagcagcca

SEQ ID NO: 762383 - RNA, 18 nt, Homo sapiens
ccauggcccccaauaaag

SEQ ID NO: 762384 - RNA, 13 nt, Homo sapiens
ccauggggagcaa

SEQ ID NO: 762385 - RNA, 18 nt, Homo sapiens
ccauggguuaagagcuca

SEQ ID NO: 762386 - RNA, 17 nt, Homo sapiens
ccaugguaaucagaaau

SEQ ID NO: 762387 - RNA, 14 nt, Homo sapiens
ccauggugagcucu

SEQ ID NO: 762388 - RNA, 19 nt, Homo sapiens
ccauggugagcucugggaa

SEQ ID NO: 762389 - RNA, 19 nt, Homo sapiens
ccauggugcuggggagcca

SEQ ID NO: 762390 - RNA, 20 nt, Homo sapiens
ccaugguguauaugugccac

SEQ ID NO: 762391 - RNA, 14 nt, Homo sapiens
ccauguaaauugca

SEQ ID NO: 762392 - RNA, 18 nt, Homo sapiens
ccauguaucaauauucac

SEQ ID NO: 762393 - RNA, 13 nt, Homo sapiens
ccauguaucuuuu

SEQ ID NO: 762394 - RNA, 23 nt, Homo sapiens
ccauguaucuuuugaacuggcaa

SEQ ID NO: 762395 - RNA, 14 nt, Homo sapiens
ccauguauuuugua

SEQ ID NO: 762396 - RNA, 21 nt, Homo sapiens
ccaugucccuacaaaggauau

SEQ ID NO: 762397 - RNA, 13 nt, Homo sapiens
ccaugugaucuca

SEQ ID NO: 762398 - RNA, 20 nt, Homo sapiens
ccaugugcuagucacuggca

SEQ ID NO: 762399 - RNA, 17 nt, Homo sapiens
ccauguuauucucucac

SEQ ID NO: 762400 - RNA, 21 nt, Homo sapiens
ccauguuuagugaaugacuuu

SEQ ID NO: 762401 - RNA, 18 nt, Homo sapiens
ccauguuugguuguaaau

SEQ ID NO: 762402 - RNA, 17 nt, Homo sapiens
ccauuaaaaacuaccac

SEQ ID NO: 762403 - RNA, 13 nt, Homo sapiens
ccauuaccuguac

SEQ ID NO: 762404 - RNA, 22 nt, Homo sapiens
ccauuacuuugauaucugauca

SEQ ID NO: 762405 - RNA, 19 nt, Homo sapiens
ccauucaaaugacgccuga

SEQ ID NO: 762406 - RNA, 16 nt, Homo sapiens
ccauucaacucggaaa

SEQ ID NO: 762407 - RNA, 22 nt, Homo sapiens
ccauucacaauaaaagcuuaaa

SEQ ID NO: 762408 - RNA, 15 nt, Homo sapiens
ccauucacuacaggu

SEQ ID NO: 762409 - RNA, 15 nt, Homo sapiens
ccauucagagcuaug

SEQ ID NO: 762410 - RNA, 22 nt, Homo sapiens
ccauucauacccacacacccag

SEQ ID NO: 762411 - RNA, 19 nt, Homo sapiens
ccauucauccuuccaucca

SEQ ID NO: 762412 - RNA, 16 nt, Homo sapiens
ccauuccugaucccau

SEQ ID NO: 762413 - RNA, 18 nt, Homo sapiens
ccauucuaaaucaaggca

SEQ ID NO: 762414 - RNA, 21 nt, Homo sapiens
ccauucuaaaucaaggcauau

SEQ ID NO: 762415 - RNA, 18 nt, Homo sapiens
ccauucucaaaaacaaag

SEQ ID NO: 762416 - RNA, 13 nt, Homo sapiens
ccauucugaccau

SEQ ID NO: 762417 - RNA, 20 nt, Homo sapiens
ccauugauuuaauguaauag

SEQ ID NO: 762418 - RNA, 20 nt, Homo sapiens
ccauugccccagaccuggaa

SEQ ID NO: 762419 - RNA, 15 nt, Homo sapiens
ccauugguccaagau

SEQ ID NO: 762420 - RNA, 15 nt, Homo sapiens
ccauugguguugaca

SEQ ID NO: 762421 - RNA, 21 nt, Homo sapiens
ccauuuagaauggugauuuua

SEQ ID NO: 762422 - RNA, 13 nt, Homo sapiens
ccauuucaaagac

SEQ ID NO: 762423 - RNA, 22 nt, Homo sapiens
ccauuucacucucaaacuucac

SEQ ID NO: 762424 - RNA, 22 nt, Homo sapiens
ccauuuccuccuuuaccuuuca

SEQ ID NO: 762425 - RNA, 23 nt, Homo sapiens
ccauuucucagcaucgugcuguu

SEQ ID NO: 762426 - RNA, 19 nt, Homo sapiens
ccauuucugaacuguuaca

SEQ ID NO: 762427 - RNA, 15 nt, Homo sapiens
ccauuuguauucaaa

SEQ ID NO: 762428 - RNA, 23 nt, Homo sapiens
ccauuuuaauuuuaaagugcaaa

SEQ ID NO: 762429 - RNA, 21 nt, Homo sapiens
ccauuuucaacugcuuugaaa

SEQ ID NO: 762430 - RNA, 23 nt, Homo sapiens
ccauuuucuuauugcgcugcuac

SEQ ID NO: 762431 - RNA, 20 nt, Homo sapiens
ccauuuugguuuuccuuaac

SEQ ID NO: 762432 - RNA, 16 nt, Homo sapiens
ccauuuuuaaaauaca

SEQ ID NO: 762433 - RNA, 20 nt, Homo sapiens
ccauuuuuccucuguucaca

SEQ ID NO: 762434 - RNA, 15 nt, Homo sapiens
ccauuuuuugaacca

SEQ ID NO: 762435 - RNA, 17 nt, Homo sapiens
ccauuuuuuucuuuacu

SEQ ID NO: 762436 - RNA, 16 nt, Homo sapiens
cccaaaaaacuacuuc

SEQ ID NO: 762437 - RNA, 13 nt, Homo sapiens
cccaaaacacagg

SEQ ID NO: 762438 - RNA, 14 nt, Homo sapiens
cccaaaacugucau

SEQ ID NO: 762439 - RNA, 22 nt, Homo sapiens
cccaaaagaauuaucaucccaa

SEQ ID NO: 762440 - RNA, 21 nt, Homo sapiens
cccaaaccggcaggugcgauu

SEQ ID NO: 762441 - RNA, 13 nt, Homo sapiens
cccaaacuccucu

SEQ ID NO: 762442 - RNA, 12 nt, Homo sapiens
cccaaagcacuu

SEQ ID NO: 762443 - RNA, 17 nt, Homo sapiens
cccaaauggcagggaua

SEQ ID NO: 762444 - RNA, 20 nt, Homo sapiens
cccaaauuaagaaucuagga

SEQ ID NO: 762445 - RNA, 18 nt, Homo sapiens
cccaacaagauugcuuaa

SEQ ID NO: 762446 - RNA, 19 nt, Homo sapiens
cccaacacuuccagcauuu

SEQ ID NO: 762447 - RNA, 15 nt, Homo sapiens
cccaacacuuugaga

SEQ ID NO: 762448 - RNA, 14 nt, Homo sapiens
cccaacagcacuuu

SEQ ID NO: 762449 - RNA, 14 nt, Homo sapiens
cccaacaugcacug

SEQ ID NO: 762450 - RNA, 13 nt, Homo sapiens
cccaacccauuca

SEQ ID NO: 762451 - RNA, 13 nt, Homo sapiens
cccaacccuggcu

SEQ ID NO: 762452 - RNA, 22 nt, Homo sapiens
cccaaccuucacaucugucacg

SEQ ID NO: 762453 - RNA, 15 nt, Homo sapiens
cccaacucuugcaca

SEQ ID NO: 762454 - RNA, 16 nt, Homo sapiens
cccaacucuugcacag

SEQ ID NO: 762455 - RNA, 17 nt, Homo sapiens
cccaacuugagauguau

SEQ ID NO: 762456 - RNA, 23 nt, Homo sapiens
cccaagaggucaaggcugcagug

SEQ ID NO: 762457 - RNA, 17 nt, Homo sapiens
cccaagaugucaaaaca

SEQ ID NO: 762458 - RNA, 18 nt, Homo sapiens
cccaagccagcccggccg

SEQ ID NO: 762459 - RNA, 16 nt, Homo sapiens
cccaagcuggagugaa

SEQ ID NO: 762460 - RNA, 18 nt, Homo sapiens
cccaagcuggagugaagu

SEQ ID NO: 762461 - RNA, 23 nt, Homo sapiens
cccaagcuggccacuaucacaua

SEQ ID NO: 762462 - RNA, 17 nt, Homo sapiens
cccaaggacucuuccac

SEQ ID NO: 762463 - RNA, 19 nt, Homo sapiens
cccaagguucugguuccau

SEQ ID NO: 762464 - RNA, 15 nt, Homo sapiens
cccaaguaugccuua

SEQ ID NO: 762465 - RNA, 16 nt, Homo sapiens
cccaaguaugccuuaa

SEQ ID NO: 762466 - RNA, 21 nt, Homo sapiens
cccaaguaugccuuaagcaga

SEQ ID NO: 762467 - RNA, 23 nt, Homo sapiens
cccaagugauccuuccaccucag

SEQ ID NO: 762468 - RNA, 13 nt, Homo sapiens
cccaagugccuca

SEQ ID NO: 762469 - RNA, 17 nt, Homo sapiens
cccaauaaaagugacuc

SEQ ID NO: 762470 - RNA, 17 nt, Homo sapiens
cccaaucagcacugaaa

SEQ ID NO: 762471 - RNA, 12 nt, Homo sapiens
cccaaugaauua

SEQ ID NO: 762472 - RNA, 19 nt, Homo sapiens
cccaaugacacccaugcca

SEQ ID NO: 762473 - RNA, 16 nt, Homo sapiens
ccaggcuggucucaaa

SEQ ID NO: 762474 - RNA, 17 nt, Homo sapiens
ccaggcuuucaauguuu

SEQ ID NO: 762475 - RNA, 14 nt, Homo sapiens
ccagggaaacaaag

SEQ ID NO: 762476 - RNA, 22 nt, Homo sapiens
ccagggaaguuucguaugcacu

SEQ ID NO: 762477 - RNA, 23 nt, Homo sapiens
ccagggaaguuucguaugcacuc

SEQ ID NO: 762478 - RNA, 18 nt, Homo sapiens
ccagggcaacacagugag

SEQ ID NO: 762479 - RNA, 13 nt, Homo sapiens
ccagggccucagu

SEQ ID NO: 762480 - RNA, 16 nt, Homo sapiens
ccagggccuccagggc

SEQ ID NO: 762481 - RNA, 21 nt, Homo sapiens
ccagggccugggggcagugac

SEQ ID NO: 762482 - RNA, 21 nt, Homo sapiens
ccagggcugccccuaaucucu

SEQ ID NO: 762483 - RNA, 18 nt, Homo sapiens
ccaggggaaccugccaug

SEQ ID NO: 762484 - RNA, 20 nt, Homo sapiens
ccagggggugggcugucacu

SEQ ID NO: 762485 - RNA, 23 nt, Homo sapiens
ccaggguccacugaagggacccu

SEQ ID NO: 762486 - RNA, 21 nt, Homo sapiens
ccagggugauuuuaugaucag

SEQ ID NO: 762487 - RNA, 20 nt, Homo sapiens
ccagggugggaagagaagaa

SEQ ID NO: 762488 - RNA, 14 nt, Homo sapiens
ccagggugugaaca

SEQ ID NO: 762489 - RNA, 14 nt, Homo sapiens
ccaggguuuugccc

SEQ ID NO: 762490 - RNA, 21 nt, Homo sapiens
ccagguacaggagaggcagca

SEQ ID NO: 762491 - RNA, 16 nt, Homo sapiens
ccagguauuacacaag

SEQ ID NO: 762492 - RNA, 22 nt, Homo sapiens
ccaggucccuuucauuugcuau

SEQ ID NO: 762493 - RNA, 16 nt, Homo sapiens
ccaggucuugacucau

SEQ ID NO: 762494 - RNA, 16 nt, Homo sapiens
ccaggugagaagugag

SEQ ID NO: 762495 - RNA, 20 nt, Homo sapiens
ccagguggcccgguugaacu

SEQ ID NO: 762496 - RNA, 14 nt, Homo sapiens
ccagguggcgugag

SEQ ID NO: 762497 - RNA, 11 nt, Homo sapiens
ccaggugggaa

SEQ ID NO: 762498 - RNA, 14 nt, Homo sapiens
ccagguguucuaca

SEQ ID NO: 762499 - RNA, 19 nt, Homo sapiens
ccagguguugccauuucuc

SEQ ID NO: 762500 - RNA, 21 nt, Homo sapiens
ccagguucaagcuauucucau

SEQ ID NO: 762501 - RNA, 17 nt, Homo sapiens
ccagguuggagugcagu

SEQ ID NO: 762502 - RNA, 19 nt, Homo sapiens
ccagguuggagugcagugg

SEQ ID NO: 762503 - RNA, 19 nt, Homo sapiens
ccagguugggggcaguguu

SEQ ID NO: 762504 - RNA, 18 nt, Homo sapiens
ccagguuuuucaaaagga

SEQ ID NO: 762505 - RNA, 22 nt, Homo sapiens
ccaguaaaauacuauugccuca

SEQ ID NO: 762506 - RNA, 23 nt, Homo sapiens
ccaguaauggaaugaagguaaua

SEQ ID NO: 762507 - RNA, 23 nt, Homo sapiens
ccaguacugggagauacagccau

SEQ ID NO: 762508 - RNA, 13 nt, Homo sapiens
ccaguaucuccaa

SEQ ID NO: 762509 - RNA, 20 nt, Homo sapiens
ccaguaucucuucagucucu

SEQ ID NO: 762510 - RNA, 21 nt, Homo sapiens
ccaguaucucuucagucucua

SEQ ID NO: 762511 - RNA, 17 nt, Homo sapiens
ccagucacuuugccaga

SEQ ID NO: 762512 - RNA, 14 nt, Homo sapiens
ccaguccuguccua

SEQ ID NO: 762513 - RNA, 20 nt, Homo sapiens
ccaguccuguuugcagggaa

SEQ ID NO: 762514 - RNA, 18 nt, Homo sapiens
ccagucgaccccaaagga

SEQ ID NO: 762515 - RNA, 18 nt, Homo sapiens
ccagucggccccaucucu

SEQ ID NO: 762516 - RNA, 20 nt, Homo sapiens
ccagucgggggaacugaggc

SEQ ID NO: 762517 - RNA, 20 nt, Homo sapiens
ccagucucagagaccagcac

SEQ ID NO: 762518 - RNA, 16 nt, Homo sapiens
ccagucucucaaguga

SEQ ID NO: 762519 - RNA, 14 nt, Homo sapiens
ccagucucuggcag

SEQ ID NO: 762520 - RNA, 18 nt, Homo sapiens
ccagucugucuacugugg

SEQ ID NO: 762521 - RNA, 20 nt, Homo sapiens
ccagucugugaagucaagaa

SEQ ID NO: 762522 - RNA, 17 nt, Homo sapiens
ccagugacacccaguca

SEQ ID NO: 762523 - RNA, 17 nt, Homo sapiens
ccagugaguaccugcaa

SEQ ID NO: 762524 - RNA, 15 nt, Homo sapiens
ccagugcacugaaag

SEQ ID NO: 762525 - RNA, 19 nt, Homo sapiens
ccagugccuucugucugcu

SEQ ID NO: 762526 - RNA, 17 nt, Homo sapiens
ccagugcuuuaauggca

SEQ ID NO: 762527 - RNA, 13 nt, Homo sapiens
ccaguggacucuu

SEQ ID NO: 762528 - RNA, 18 nt, Homo sapiens
ccaguggaucauaagaca

SEQ ID NO: 762529 - RNA, 19 nt, Homo sapiens
ccaguggcagacaaacaga

SEQ ID NO: 762530 - RNA, 22 nt, Homo sapiens
ccaguggugcucaaugcaaaua

SEQ ID NO: 762531 - RNA, 17 nt, Homo sapiens
ccaguguaugucuugua

SEQ ID NO: 762532 - RNA, 16 nt, Homo sapiens
ccagugugagacccca

SEQ ID NO: 762533 - RNA, 13 nt, Homo sapiens
ccaguguucugca

SEQ ID NO: 762534 - RNA, 16 nt, Homo sapiens
ccaguuacguugugua

SEQ ID NO: 762535 - RNA, 22 nt, Homo sapiens
ccaguuagauagaagaauuuua

SEQ ID NO: 762536 - RNA, 18 nt, Homo sapiens
ccaguuuauuaacuugag

SEQ ID NO: 762537 - RNA, 23 nt, Homo sapiens
ccaguuucagagaaauacuuuca

SEQ ID NO: 762538 - RNA, 18 nt, Homo sapiens
ccaguuuuuguugcuuga

SEQ ID NO: 762539 - RNA, 19 nt, Homo sapiens
ccaguuuuuguuuuugcau

SEQ ID NO: 762540 - RNA, 15 nt, Homo sapiens
ccauaagauuugcaa

SEQ ID NO: 762541 - RNA, 12 nt, Homo sapiens
ccauaauacaua

SEQ ID NO: 762542 - RNA, 13 nt, Homo sapiens
ccauaauguuaca

SEQ ID NO: 762543 - RNA, 23 nt, Homo sapiens
ccauaauguucugcuaaauuuca

SEQ ID NO: 762544 - RNA, 19 nt, Homo sapiens
ccauaauugcuuugccaaa

SEQ ID NO: 762545 - RNA, 21 nt, Homo sapiens
ccauaauugcuuugccaaaau

SEQ ID NO: 762546 - RNA, 20 nt, Homo sapiens
ccauacauaauauaugacuu

SEQ ID NO: 762547 - RNA, 17 nt, Homo sapiens
ccauacauuauuucuuc

SEQ ID NO: 762548 - RNA, 13 nt, Homo sapiens
ccauacuucucuc

SEQ ID NO: 762549 - RNA, 19 nt, Homo sapiens
ccauagaaauguagguccu

SEQ ID NO: 762550 - RNA, 20 nt, Homo sapiens
ccauagaggcccaggcacca

SEQ ID NO: 762551 - RNA, 20 nt, Homo sapiens
ccauagauccccccacugag

SEQ ID NO: 762552 - RNA, 14 nt, Homo sapiens
ccauagcaccucca

SEQ ID NO: 762553 - RNA, 21 nt, Homo sapiens
ccauaggacauacugcaugua

SEQ ID NO: 762554 - RNA, 21 nt, Homo sapiens
ccauaguaguaugaugauaca

SEQ ID NO: 762555 - RNA, 20 nt, Homo sapiens
ccauagucaaauuuguaaau

SEQ ID NO: 762556 - RNA, 20 nt, Homo sapiens
ccauauauugggugugaguu

SEQ ID NO: 762557 - RNA, 13 nt, Homo sapiens
ccauaucagugaa

SEQ ID NO: 762558 - RNA, 22 nt, Homo sapiens
ccauaucuuaaagaaacagcuu

SEQ ID NO: 762559 - RNA, 19 nt, Homo sapiens
ccauauucagcauuugauu

SEQ ID NO: 762560 - RNA, 14 nt, Homo sapiens
ccauauugaugaag

SEQ ID NO: 762561 - RNA, 23 nt, Homo sapiens
ccauauuuuuuaugauggagcaa

SEQ ID NO: 762562 - RNA, 21 nt, Homo sapiens
ccaucaaacauaauucucuca

SEQ ID NO: 762563 - RNA, 20 nt, Homo sapiens
ccaucaaaccucacauuugu

SEQ ID NO: 762564 - RNA, 19 nt, Homo sapiens
ccaucaacaagucuugaaa

SEQ ID NO: 762565 - RNA, 14 nt, Homo sapiens
ccaucaagcacuuc

SEQ ID NO: 762566 - RNA, 18 nt, Homo sapiens
ccaucacccaagccacaa

SEQ ID NO: 762567 - RNA, 12 nt, Homo sapiens
ccaucacuuugg

SEQ ID NO: 762568 - RNA, 12 nt, Homo sapiens
ccaucagacugu

SEQ ID NO: 762569 - RNA, 15 nt, Homo sapiens
ccaucagacugucaa

SEQ ID NO: 762570 - RNA, 18 nt, Homo sapiens
ccaucaggccuaaucuca

SEQ ID NO: 762571 - RNA, 14 nt, Homo sapiens
ccauccagccagac

SEQ ID NO: 762572 - RNA, 20 nt, Homo sapiens
ccauccaggucuugacucau

SEQ ID NO: 762573 - RNA, 14 nt, Homo sapiens
ccauccaucuuucc

SEQ ID NO: 762574 - RNA, 17 nt, Homo sapiens
ccauccauuaccuccau

SEQ ID NO: 762575 - RNA, 21 nt, Homo sapiens
ccauccauucagaaagcauuu

SEQ ID NO: 762576 - RNA, 16 nt, Homo sapiens
ccauccccacccaguc

SEQ ID NO: 762577 - RNA, 23 nt, Homo sapiens
ccauccgguggccuauuccagga

SEQ ID NO: 762578 - RNA, 21 nt, Homo sapiens
ccauccuggccaacauuguaa

SEQ ID NO: 762579 - RNA, 16 nt, Homo sapiens
ccauccuggggcagca

SEQ ID NO: 762580 - RNA, 15 nt, Homo sapiens
ccauccuguuugaaa

SEQ ID NO: 762581 - RNA, 19 nt, Homo sapiens
ccaucggugaaacuaacag

SEQ ID NO: 762582 - RNA, 18 nt, Homo sapiens
ccaucgucucggccuuca

SEQ ID NO: 762583 - RNA, 15 nt, Homo sapiens
ccaucuaugucccuu

SEQ ID NO: 762584 - RNA, 15 nt, Homo sapiens
ccaucuccgccucca

SEQ ID NO: 762585 - RNA, 16 nt, Homo sapiens
ccaucucuuuaccucc

SEQ ID NO: 762586 - RNA, 15 nt, Homo sapiens
ccaucugauguuuca

SEQ ID NO: 762587 - RNA, 19 nt, Homo sapiens
ccagauagcagggcaugaa

SEQ ID NO: 762588 - RNA, 14 nt, Homo sapiens
ccagaucacugcca

SEQ ID NO: 762589 - RNA, 13 nt, Homo sapiens
ccagaucuuucag

SEQ ID NO: 762590 - RNA, 18 nt, Homo sapiens
ccagaugaucccagucac

SEQ ID NO: 762591 - RNA, 22 nt, Homo sapiens
ccagaugaucccagucacuccu

SEQ ID NO: 762592 - RNA, 23 nt, Homo sapiens
ccagaugccuccccaagacuguc

SEQ ID NO: 762593 - RNA, 23 nt, Homo sapiens
ccagauggucauccagacucaga

SEQ ID NO: 762594 - RNA, 15 nt, Homo sapiens
ccagauguugcuuuu

SEQ ID NO: 762595 - RNA, 18 nt, Homo sapiens
ccagauguuuccagacuu

SEQ ID NO: 762596 - RNA, 18 nt, Homo sapiens
ccagauugacgacaagug

SEQ ID NO: 762597 - RNA, 22 nt, Homo sapiens
ccagauuggauauggacucuuu

SEQ ID NO: 762598 - RNA, 14 nt, Homo sapiens
ccagauuggcucac

SEQ ID NO: 762599 - RNA, 13 nt, Homo sapiens
ccagcaacugccc

SEQ ID NO: 762600 - RNA, 19 nt, Homo sapiens
ccagcaagcacuguggucu

SEQ ID NO: 762601 - RNA, 21 nt, Homo sapiens
ccagcaccuggaggggcacca

SEQ ID NO: 762602 - RNA, 19 nt, Homo sapiens
ccagcacgaguggccaguu

SEQ ID NO: 762603 - RNA, 22 nt, Homo sapiens
ccagcacuuuagaucacuugag

SEQ ID NO: 762604 - RNA, 16 nt, Homo sapiens
ccagcacuuugggagg

SEQ ID NO: 762605 - RNA, 22 nt, Homo sapiens
ccagcaggcagguggacugacu

SEQ ID NO: 762606 - RNA, 12 nt, Homo sapiens
ccagcagucagu

SEQ ID NO: 762607 - RNA, 22 nt, Homo sapiens
ccagcauacccuuacucugcca

SEQ ID NO: 762608 - RNA, 15 nt, Homo sapiens
ccagcauauacugaa

SEQ ID NO: 762609 - RNA, 14 nt, Homo sapiens
ccagcaucccgcgc

SEQ ID NO: 762610 - RNA, 22 nt, Homo sapiens
ccagcauucagcacacacaaac

SEQ ID NO: 762611 - RNA, 22 nt, Homo sapiens
ccagcauuuaagugaccuucug

SEQ ID NO: 762612 - RNA, 20 nt, Homo sapiens
ccagccaagagggcugcaaa

SEQ ID NO: 762613 - RNA, 21 nt, Homo sapiens
ccagccagaggcaucugaggg

SEQ ID NO: 762614 - RNA, 23 nt, Homo sapiens
ccagccagggcaacacagugaga

SEQ ID NO: 762615 - RNA, 17 nt, Homo sapiens
ccagcccauggcuuuag

SEQ ID NO: 762616 - RNA, 13 nt, Homo sapiens
ccagcccauugcu

SEQ ID NO: 762617 - RNA, 15 nt, Homo sapiens
ccagcccauugcugc

SEQ ID NO: 762618 - RNA, 15 nt, Homo sapiens
ccagccccacugcca

SEQ ID NO: 762619 - RNA, 21 nt, Homo sapiens
ccagccccuccagcaccacuu

SEQ ID NO: 762620 - RNA, 15 nt, Homo sapiens
ccagccgauguggua

SEQ ID NO: 762621 - RNA, 15 nt, Homo sapiens
ccagccgcacuggga

SEQ ID NO: 762622 - RNA, 20 nt, Homo sapiens
ccagccgugaugcucaggcu

SEQ ID NO: 762623 - RNA, 14 nt, Homo sapiens
ccagccucaucucu

SEQ ID NO: 762624 - RNA, 22 nt, Homo sapiens
ccagccuccagggcauugcuca

SEQ ID NO: 762625 - RNA, 14 nt, Homo sapiens
ccagccucccacaa

SEQ ID NO: 762626 - RNA, 15 nt, Homo sapiens
ccagccuccugcuaa

SEQ ID NO: 762627 - RNA, 13 nt, Homo sapiens
ccagccuggaucu

SEQ ID NO: 762628 - RNA, 21 nt, Homo sapiens
ccagccuggccaacaugguga

SEQ ID NO: 762629 - RNA, 15 nt, Homo sapiens
ccagccugggcaaca

SEQ ID NO: 762630 - RNA, 20 nt, Homo sapiens
ccagccugggcaacagagca

SEQ ID NO: 762631 - RNA, 20 nt, Homo sapiens
ccagccugggcaacauagua

SEQ ID NO: 762632 - RNA, 20 nt, Homo sapiens
ccagccugggcagccaggcu

SEQ ID NO: 762633 - RNA, 15 nt, Homo sapiens
ccagccugggugaca

SEQ ID NO: 762634 - RNA, 20 nt, Homo sapiens
ccagccuggucaauauagca

SEQ ID NO: 762635 - RNA, 14 nt, Homo sapiens
ccagcgauggugcu

SEQ ID NO: 762636 - RNA, 19 nt, Homo sapiens
ccagcgcccgcugggcuga

SEQ ID NO: 762637 - RNA, 17 nt, Homo sapiens
ccagcggcccugucauc

SEQ ID NO: 762638 - RNA, 24 nt, Homo sapiens
ccagcggcccugucauccagcuca

SEQ ID NO: 762639 - RNA, 17 nt, Homo sapiens
ccagcuaaggacauuuc

SEQ ID NO: 762640 - RNA, 23 nt, Homo sapiens
ccagcuacauuccucagcugcca

SEQ ID NO: 762641 - RNA, 21 nt, Homo sapiens
ccagcuacucaagaggcugag

SEQ ID NO: 762642 - RNA, 12 nt, Homo sapiens
ccagcuacucag

SEQ ID NO: 762643 - RNA, 21 nt, Homo sapiens
ccagcuacucaggaggcugag

SEQ ID NO: 762644 - RNA, 17 nt, Homo sapiens
ccagcuacucaggaguc

SEQ ID NO: 762645 - RNA, 15 nt, Homo sapiens
ccagcuauuuacaca

SEQ ID NO: 762646 - RNA, 17 nt, Homo sapiens
ccagcucaccuuuuuau

SEQ ID NO: 762647 - RNA, 21 nt, Homo sapiens
ccagcucagucccaucagaga

SEQ ID NO: 762648 - RNA, 19 nt, Homo sapiens
ccagcuccaaccugcaaag

SEQ ID NO: 762649 - RNA, 16 nt, Homo sapiens
ccagcuccaaggggaa

SEQ ID NO: 762650 - RNA, 22 nt, Homo sapiens
ccagcucccacucccuuuccaa

SEQ ID NO: 762651 - RNA, 11 nt, Homo sapiens
ccagcucugac

SEQ ID NO: 762652 - RNA, 18 nt, Homo sapiens
ccagcucuggaguucucu

SEQ ID NO: 762653 - RNA, 16 nt, Homo sapiens
ccagcugcaccugcca

SEQ ID NO: 762654 - RNA, 22 nt, Homo sapiens
ccagcugcagaccaugccagac

SEQ ID NO: 762655 - RNA, 16 nt, Homo sapiens
ccagcugccaaggaaa

SEQ ID NO: 762656 - RNA, 18 nt, Homo sapiens
ccagcugcucugucuucu

SEQ ID NO: 762657 - RNA, 13 nt, Homo sapiens
ccagcugcugucu

SEQ ID NO: 762658 - RNA, 23 nt, Homo sapiens
ccagcugcugugccccaccacgu

SEQ ID NO: 762659 - RNA, 20 nt, Homo sapiens
ccagcugcuuuuugugauuu

SEQ ID NO: 762660 - RNA, 18 nt, Homo sapiens
ccagcuggggcgugggga

SEQ ID NO: 762661 - RNA, 17 nt, Homo sapiens
ccagcugggguccuguc

SEQ ID NO: 762662 - RNA, 22 nt, Homo sapiens
ccagcugugggacaauuaucug

SEQ ID NO: 762663 - RNA, 20 nt, Homo sapiens
ccagcuuaaaggcaguauuu

SEQ ID NO: 762664 - RNA, 18 nt, Homo sapiens
ccagcuuacuagcacuuu

SEQ ID NO: 762665 - RNA, 15 nt, Homo sapiens
ccagcuuugcaguga

SEQ ID NO: 762666 - RNA, 17 nt, Homo sapiens
ccagcuuugcagugaca

SEQ ID NO: 762667 - RNA, 20 nt, Homo sapiens
ccaggaaagguuuuccuuau

SEQ ID NO: 762668 - RNA, 19 nt, Homo sapiens
ccaggaauuagagaagcug

SEQ ID NO: 762669 - RNA, 21 nt, Homo sapiens
ccaggaauuagagaagcugaa

SEQ ID NO: 762670 - RNA, 13 nt, Homo sapiens
ccaggacagggaa

SEQ ID NO: 762671 - RNA, 21 nt, Homo sapiens
ccaggacucagugaucccugg

SEQ ID NO: 762672 - RNA, 20 nt, Homo sapiens
ccaggacugggucugaccug

SEQ ID NO: 762673 - RNA, 12 nt, Homo sapiens
ccaggacugugu

SEQ ID NO: 762674 - RNA, 23 nt, Homo sapiens
ccaggagacagacagagaaggca

SEQ ID NO: 762675 - RNA, 22 nt, Homo sapiens
ccaggagacagaccacuugcca

SEQ ID NO: 762676 - RNA, 16 nt, Homo sapiens
ccaggagcagcagcca

SEQ ID NO: 762677 - RNA, 15 nt, Homo sapiens
ccaggagcccggcuu

SEQ ID NO: 762678 - RNA, 14 nt, Homo sapiens
ccaggaggugcaga

SEQ ID NO: 762679 - RNA, 23 nt, Homo sapiens
ccaggagguggagguugcaguga

SEQ ID NO: 762680 - RNA, 18 nt, Homo sapiens
ccaggauaucugaaaaua

SEQ ID NO: 762681 - RNA, 23 nt, Homo sapiens
ccaggauauugacaagaauacac

SEQ ID NO: 762682 - RNA, 22 nt, Homo sapiens
ccaggaugcccagaugaacuga

SEQ ID NO: 762683 - RNA, 23 nt, Homo sapiens
ccaggaugcuaaagaugaugaug

SEQ ID NO: 762684 - RNA, 18 nt, Homo sapiens
ccaggauuuuaauuucag

SEQ ID NO: 762685 - RNA, 14 nt, Homo sapiens
ccaggcacagggcc

SEQ ID NO: 762686 - RNA, 13 nt, Homo sapiens
ccaggcaccacca

SEQ ID NO: 762687 - RNA, 12 nt, Homo sapiens
ccaggcacuguu

SEQ ID NO: 762688 - RNA, 13 nt, Homo sapiens
ccaggcagaucca

SEQ ID NO: 762689 - RNA, 22 nt, Homo sapiens
ccaggcaggauauuccaagggc

SEQ ID NO: 762690 - RNA, 16 nt, Homo sapiens
ccaggccagagugcag

SEQ ID NO: 762691 - RNA, 17 nt, Homo sapiens
ccaggccagagugcagu

SEQ ID NO: 762692 - RNA, 19 nt, Homo sapiens
ccaggccagagugcagugg

SEQ ID NO: 762693 - RNA, 23 nt, Homo sapiens
ccaggcccuacuacccauuguuc

SEQ ID NO: 762694 - RNA, 15 nt, Homo sapiens
ccaggccguccuccc

SEQ ID NO: 762695 - RNA, 19 nt, Homo sapiens
ccaggcugcacugcaguga

SEQ ID NO: 762696 - RNA, 14 nt, Homo sapiens
ccaggcugccugag

SEQ ID NO: 762697 - RNA, 22 nt, Homo sapiens
ccaggcugccuggucacugccc

SEQ ID NO: 762698 - RNA, 18 nt, Homo sapiens
ccaggcuggagugcaaug

SEQ ID NO: 762699 - RNA, 16 nt, Homo sapiens
ccaggcuggagugcag

SEQ ID NO: 762700 - RNA, 19 nt, Homo sapiens
ccaggcuggagugcagugg

SEQ ID NO: 762701 - RNA, 16 nt, Homo sapiens
cauggaggcaugccaa

SEQ ID NO: 762702 - RNA, 15 nt, Homo sapiens
cauggaggccaagaa

SEQ ID NO: 762703 - RNA, 14 nt, Homo sapiens
cauggaggccagug

SEQ ID NO: 762704 - RNA, 17 nt, Homo sapiens
cauggaguauagugcaa

SEQ ID NO: 762705 - RNA, 13 nt, Homo sapiens
cauggaucugauc

SEQ ID NO: 762706 - RNA, 18 nt, Homo sapiens
cauggauuucauggugau

SEQ ID NO: 762707 - RNA, 21 nt, Homo sapiens
cauggcaacauaauucacuuu

SEQ ID NO: 762708 - RNA, 19 nt, Homo sapiens
cauggcaccuuuugcacau

SEQ ID NO: 762709 - RNA, 20 nt, Homo sapiens
cauggcauauuuuucacaua

SEQ ID NO: 762710 - RNA, 12 nt, Homo sapiens
cauggcaucaga

SEQ ID NO: 762711 - RNA, 24 nt, Homo sapiens
cauggcaucuucaauaugaaucua

SEQ ID NO: 762712 - RNA, 19 nt, Homo sapiens
cauggccagcugccaguac

SEQ ID NO: 762713 - RNA, 21 nt, Homo sapiens
cauggccagguggccacucca

SEQ ID NO: 762714 - RNA, 21 nt, Homo sapiens
cauggcccccaggggcaggac

SEQ ID NO: 762715 - RNA, 23 nt, Homo sapiens
cauggccgggcccucuguagcuc

SEQ ID NO: 762716 - RNA, 19 nt, Homo sapiens
cauggccuaugcacauaug

SEQ ID NO: 762717 - RNA, 15 nt, Homo sapiens
cauggccugugcugg

SEQ ID NO: 762718 - RNA, 21 nt, Homo sapiens
cauggccuuccacgucuuccu

SEQ ID NO: 762719 - RNA, 18 nt, Homo sapiens
cauggcuaaauacaaugg

SEQ ID NO: 762720 - RNA, 18 nt, Homo sapiens
cauggcuggcacauuguu

SEQ ID NO: 762721 - RNA, 23 nt, Homo sapiens
cauggcugggauuuaaagccuuu

SEQ ID NO: 762722 - RNA, 15 nt, Homo sapiens
caugggaaaacagac

SEQ ID NO: 762723 - RNA, 20 nt, Homo sapiens
caugggacuaaaugaacuaa

SEQ ID NO: 762724 - RNA, 23 nt, Homo sapiens
caugggagggggcuugaagccaa

SEQ ID NO: 762725 - RNA, 14 nt, Homo sapiens
cauggguccagggc

SEQ ID NO: 762726 - RNA, 17 nt, Homo sapiens
cauggguuaagagcuca

SEQ ID NO: 762727 - RNA, 23 nt, Homo sapiens
caugguagucacuaacauauaua

SEQ ID NO: 762728 - RNA, 13 nt, Homo sapiens
cauggugagcucu

SEQ ID NO: 762729 - RNA, 22 nt, Homo sapiens
cauggugccccaggaccagcuc

SEQ ID NO: 762730 - RNA, 18 nt, Homo sapiens
cauggugugaguccaaag

SEQ ID NO: 762731 - RNA, 17 nt, Homo sapiens
caugguguguggugcua

SEQ ID NO: 762732 - RNA, 22 nt, Homo sapiens
caugguuauugaugaguuucuu

SEQ ID NO: 762733 - RNA, 20 nt, Homo sapiens
caugguuuaaauaugaauga

SEQ ID NO: 762734 - RNA, 16 nt, Homo sapiens
caugguuuugaaaugc

SEQ ID NO: 762735 - RNA, 15 nt, Homo sapiens
cauguaaaacaguua

SEQ ID NO: 762736 - RNA, 14 nt, Homo sapiens
cauguaaauugcaa

SEQ ID NO: 762737 - RNA, 16 nt, Homo sapiens
cauguaaauugcaaau

SEQ ID NO: 762738 - RNA, 20 nt, Homo sapiens
cauguaacuauuucuucaga

SEQ ID NO: 762739 - RNA, 17 nt, Homo sapiens
cauguaagccaagucau

SEQ ID NO: 762740 - RNA, 13 nt, Homo sapiens
cauguaagcucuu

SEQ ID NO: 762741 - RNA, 13 nt, Homo sapiens
cauguaauccuuu

SEQ ID NO: 762742 - RNA, 14 nt, Homo sapiens
cauguaauguguac

SEQ ID NO: 762743 - RNA, 11 nt, Homo sapiens
cauguacaaaa

SEQ ID NO: 762744 - RNA, 20 nt, Homo sapiens
cauguaccucagaucucucu

SEQ ID NO: 762745 - RNA, 18 nt, Homo sapiens
cauguacuacagcuauau

SEQ ID NO: 762746 - RNA, 15 nt, Homo sapiens
cauguaucucaguac

SEQ ID NO: 762747 - RNA, 22 nt, Homo sapiens
cauguauggaaucccacuguau

SEQ ID NO: 762748 - RNA, 21 nt, Homo sapiens
cauguaugucagaagugcaga

SEQ ID NO: 762749 - RNA, 16 nt, Homo sapiens
cauguauuuguuauau

SEQ ID NO: 762750 - RNA, 15 nt, Homo sapiens
caugucaugugagug

SEQ ID NO: 762751 - RNA, 22 nt, Homo sapiens
cauguccauacacuuuguugca

SEQ ID NO: 762752 - RNA, 20 nt, Homo sapiens
cauguccucuucaaagguga

SEQ ID NO: 762753 - RNA, 23 nt, Homo sapiens
caugucuacugcuuggauccaua

SEQ ID NO: 762754 - RNA, 15 nt, Homo sapiens
caugucucaauagua

SEQ ID NO: 762755 - RNA, 18 nt, Homo sapiens
caugucuccuacugagga

SEQ ID NO: 762756 - RNA, 16 nt, Homo sapiens
caugucugaaacagag

SEQ ID NO: 762757 - RNA, 12 nt, Homo sapiens
caugucuuucag

SEQ ID NO: 762758 - RNA, 16 nt, Homo sapiens
caugugagucccugug

SEQ ID NO: 762759 - RNA, 22 nt, Homo sapiens
caugugcaaaugugcuggucac

SEQ ID NO: 762760 - RNA, 19 nt, Homo sapiens
caugugcagucacuggugu

SEQ ID NO: 762761 - RNA, 18 nt, Homo sapiens
caugugcgcgcgugcaug

SEQ ID NO: 762762 - RNA, 15 nt, Homo sapiens
caugugcugccugca

SEQ ID NO: 762763 - RNA, 16 nt, Homo sapiens
cauguggaagcacuuu

SEQ ID NO: 762764 - RNA, 23 nt, Homo sapiens
cauguggacuggugcaaguugag

SEQ ID NO: 762765 - RNA, 20 nt, Homo sapiens
cauguggcauguucaucgua

SEQ ID NO: 762766 - RNA, 14 nt, Homo sapiens
caugugggcacgga

SEQ ID NO: 762767 - RNA, 19 nt, Homo sapiens
cauguggugggacagggac

SEQ ID NO: 762768 - RNA, 14 nt, Homo sapiens
cauguguaaagguu

SEQ ID NO: 762769 - RNA, 18 nt, Homo sapiens
cauguuaaugaacagugu

SEQ ID NO: 762770 - RNA, 14 nt, Homo sapiens
cauguucccagaaa

SEQ ID NO: 762771 - RNA, 14 nt, Homo sapiens
cauguuccucaaaa

SEQ ID NO: 762772 - RNA, 16 nt, Homo sapiens
cauguuccucaaaagc

SEQ ID NO: 762773 - RNA, 19 nt, Homo sapiens
cauguucugugacugaaga

SEQ ID NO: 762774 - RNA, 16 nt, Homo sapiens
cauguuguaaugcugc

SEQ ID NO: 762775 - RNA, 17 nt, Homo sapiens
cauguuguaaugcugca

SEQ ID NO: 762776 - RNA, 22 nt, Homo sapiens
cauguuguugaggcugucacag

SEQ ID NO: 762777 - RNA, 16 nt, Homo sapiens
cauguuuaaauagccu

SEQ ID NO: 762778 - RNA, 17 nt, Homo sapiens
cauguuucagugaagau

SEQ ID NO: 762779 - RNA, 19 nt, Homo sapiens
cauguuugcaccugugcau

SEQ ID NO: 762780 - RNA, 21 nt, Homo sapiens
cauguuugccuucugcacaua

SEQ ID NO: 762781 - RNA, 14 nt, Homo sapiens
cauguuuugagauu

SEQ ID NO: 762782 - RNA, 19 nt, Homo sapiens
cauguuuugauuuguagca

SEQ ID NO: 762783 - RNA, 22 nt, Homo sapiens
cauguuuugauuuguagcacug

SEQ ID NO: 762784 - RNA, 22 nt, Homo sapiens
cauguuuuguauguuaaauuca

SEQ ID NO: 762785 - RNA, 14 nt, Homo sapiens
cauguuuuuauaca

SEQ ID NO: 762786 - RNA, 13 nt, Homo sapiens
cauuaaacacugu

SEQ ID NO: 762787 - RNA, 15 nt, Homo sapiens
cauuaaacaugacau

SEQ ID NO: 762788 - RNA, 16 nt, Homo sapiens
cauuaaaucuaugaag

SEQ ID NO: 762789 - RNA, 13 nt, Homo sapiens
cauuaacacaaag

SEQ ID NO: 762790 - RNA, 20 nt, Homo sapiens
cauuaacugcacaaacaaua

SEQ ID NO: 762791 - RNA, 12 nt, Homo sapiens
cauuaagcacac

SEQ ID NO: 762792 - RNA, 19 nt, Homo sapiens
cauuaaggggaagaaugaa

SEQ ID NO: 762793 - RNA, 23 nt, Homo sapiens
cauuaaggggaagaaugaaagcu

SEQ ID NO: 762794 - RNA, 16 nt, Homo sapiens
cauuaauaaaguugcu

SEQ ID NO: 762795 - RNA, 14 nt, Homo sapiens
cauuaaucaguuca

SEQ ID NO: 762796 - RNA, 13 nt, Homo sapiens
cauuaauguuucu

SEQ ID NO: 762797 - RNA, 17 nt, Homo sapiens
cauuaccauggagacaa

SEQ ID NO: 762798 - RNA, 15 nt, Homo sapiens
cauuaccuccaucca

SEQ ID NO: 762799 - RNA, 14 nt, Homo sapiens
cauuacuauucacu

SEQ ID NO: 762800 - RNA, 22 nt, Homo sapiens
cauuacuuaugaugaugaaggg

SEQ ID NO: 762801 - RNA, 12 nt, Homo sapiens
cauuacuuugau

SEQ ID NO: 762802 - RNA, 12 nt, Homo sapiens
cauuagaccaag

SEQ ID NO: 762803 - RNA, 23 nt, Homo sapiens
cauuagauuuggaggcuaccuca

SEQ ID NO: 762804 - RNA, 15 nt, Homo sapiens
cauuagcagcaucuu

SEQ ID NO: 762805 - RNA, 18 nt, Homo sapiens
cauuagccggacucgaaa

SEQ ID NO: 762806 - RNA, 20 nt, Homo sapiens
cauuagcgauccauguaauc

SEQ ID NO: 762807 - RNA, 23 nt, Homo sapiens
cauuagcugcccaggaugcugcu

SEQ ID NO: 762808 - RNA, 20 nt, Homo sapiens
cauuaguaauaaguaaaaug

SEQ ID NO: 762809 - RNA, 14 nt, Homo sapiens
cauuauaugcaaau

SEQ ID NO: 762810 - RNA, 21 nt, Homo sapiens
cauuaucuggaauauugugau

SEQ ID NO: 762811 - RNA, 22 nt, Homo sapiens
cauuaugaucuaauaaacuuua

SEQ ID NO: 762812 - RNA, 21 nt, Homo sapiens
cauuauguaaaauguuuuagc

SEQ ID NO: 762813 - RNA, 12 nt, Homo sapiens
cauuauguauga

SEQ ID NO: 762814 - RNA, 19 nt, Homo sapiens
cauuauuaaauguuucuca

SEQ ID NO: 762815 - RNA, 13 nt, Homo sapiens
cauuauuagcacu

SEQ ID NO: 762816 - RNA, 20 nt, Homo sapiens
caucugugcaguaagccugu

SEQ ID NO: 762817 - RNA, 13 nt, Homo sapiens
caucugugccaga

SEQ ID NO: 762818 - RNA, 16 nt, Homo sapiens
caucugugccagagau

SEQ ID NO: 762819 - RNA, 18 nt, Homo sapiens
caucuguggaaugauuca

SEQ ID NO: 762820 - RNA, 15 nt, Homo sapiens
caucuuagaccucca

SEQ ID NO: 762821 - RNA, 19 nt, Homo sapiens
caucuucaaagcuugaaga

SEQ ID NO: 762822 - RNA, 16 nt, Homo sapiens
caucuucauagaugaa

SEQ ID NO: 762823 - RNA, 19 nt, Homo sapiens
caucuuccaacccacuggc

SEQ ID NO: 762824 - RNA, 18 nt, Homo sapiens
caucuuccuggaagcaga

SEQ ID NO: 762825 - RNA, 13 nt, Homo sapiens
caucuucuagaau

SEQ ID NO: 762826 - RNA, 15 nt, Homo sapiens
caucuucuccaucug

SEQ ID NO: 762827 - RNA, 19 nt, Homo sapiens
caucuugaauccuuccauu

SEQ ID NO: 762828 - RNA, 23 nt, Homo sapiens
caucuugaauccuuccauuccac

SEQ ID NO: 762829 - RNA, 18 nt, Homo sapiens
caucuugagccacaguca

SEQ ID NO: 762830 - RNA, 15 nt, Homo sapiens
caucuugcugcuaau

SEQ ID NO: 762831 - RNA, 13 nt, Homo sapiens
caucuuguuucau

SEQ ID NO: 762832 - RNA, 14 nt, Homo sapiens
caucuuuaacacag

SEQ ID NO: 762833 - RNA, 20 nt, Homo sapiens
caucuuuaucuguucuugcu

SEQ ID NO: 762834 - RNA, 21 nt, Homo sapiens
caucuuucuucuauuuuauuc

SEQ ID NO: 762835 - RNA, 17 nt, Homo sapiens
caucuuuuagcauguga

SEQ ID NO: 762836 - RNA, 14 nt, Homo sapiens
caucuuuucuugcc

SEQ ID NO: 762837 - RNA, 17 nt, Homo sapiens
caucuuuugaagcuuuc

SEQ ID NO: 762838 - RNA, 16 nt, Homo sapiens
caucuuuuuccacuuu

SEQ ID NO: 762839 - RNA, 18 nt, Homo sapiens
caugaaaaaaaugauccc

SEQ ID NO: 762840 - RNA, 18 nt, Homo sapiens
caugaaaguggacaagga

SEQ ID NO: 762841 - RNA, 14 nt, Homo sapiens
caugaaauaugcau

SEQ ID NO: 762842 - RNA, 19 nt, Homo sapiens
caugaaaucaacucagugg

SEQ ID NO: 762843 - RNA, 22 nt, Homo sapiens
caugaaaugucuggucugucca

SEQ ID NO: 762844 - RNA, 24 nt, Homo sapiens
caugaacaaauucuuuaguacuca

SEQ ID NO: 762845 - RNA, 22 nt, Homo sapiens
caugaacaucauggacugagcu

SEQ ID NO: 762846 - RNA, 22 nt, Homo sapiens
caugaacaucuuuaggagacua

SEQ ID NO: 762847 - RNA, 23 nt, Homo sapiens
caugaacaucuuuaggagacuaa

SEQ ID NO: 762848 - RNA, 16 nt, Homo sapiens
caugaagagcuugugu

SEQ ID NO: 762849 - RNA, 18 nt, Homo sapiens
caugaagcccaagugaaa

SEQ ID NO: 762850 - RNA, 17 nt, Homo sapiens
caugaaggcagagccau

SEQ ID NO: 762851 - RNA, 13 nt, Homo sapiens
caugaagugcaca

SEQ ID NO: 762852 - RNA, 15 nt, Homo sapiens
caugaauaaaacacu

SEQ ID NO: 762853 - RNA, 18 nt, Homo sapiens
caugaauaaaacacucau

SEQ ID NO: 762854 - RNA, 16 nt, Homo sapiens
caugaauuaguucucc

SEQ ID NO: 762855 - RNA, 16 nt, Homo sapiens
caugacaaaccuuaug

SEQ ID NO: 762856 - RNA, 14 nt, Homo sapiens
caugacaagaacaa

SEQ ID NO: 762857 - RNA, 19 nt, Homo sapiens
caugacaagaacaaagcca

SEQ ID NO: 762858 - RNA, 13 nt, Homo sapiens
caugacacugacc

SEQ ID NO: 762859 - RNA, 14 nt, Homo sapiens
caugacacugaccu

SEQ ID NO: 762860 - RNA, 17 nt, Homo sapiens
caugacagccagagccu

SEQ ID NO: 762861 - RNA, 16 nt, Homo sapiens
caugaccacucuuggc

SEQ ID NO: 762862 - RNA, 17 nt, Homo sapiens
caugaccacucuuggcu

SEQ ID NO: 762863 - RNA, 23 nt, Homo sapiens
caugaccacucuuggcuauugaa

SEQ ID NO: 762864 - RNA, 21 nt, Homo sapiens
caugacccagccugaaagaua

SEQ ID NO: 762865 - RNA, 18 nt, Homo sapiens
caugagaccacuguuauc

SEQ ID NO: 762866 - RNA, 19 nt, Homo sapiens
caugagaccacuguuauca

SEQ ID NO: 762867 - RNA, 19 nt, Homo sapiens
caugagauucauucaguua

SEQ ID NO: 762868 - RNA, 22 nt, Homo sapiens
caugagauuuauaagguuuuaa

SEQ ID NO: 762869 - RNA, 14 nt, Homo sapiens
caugagcugcucca

SEQ ID NO: 762870 - RNA, 17 nt, Homo sapiens
caugaggaaucugggag

SEQ ID NO: 762871 - RNA, 16 nt, Homo sapiens
caugagggacuccucc

SEQ ID NO: 762872 - RNA, 20 nt, Homo sapiens
caugagggcaggcacauguu

SEQ ID NO: 762873 - RNA, 19 nt, Homo sapiens
caugaucuuguuacuguga

SEQ ID NO: 762874 - RNA, 20 nt, Homo sapiens
caugauggccuuacacugaa

SEQ ID NO: 762875 - RNA, 21 nt, Homo sapiens
caugauggggaaggaguacaa

SEQ ID NO: 762876 - RNA, 15 nt, Homo sapiens
caugauguagagugu

SEQ ID NO: 762877 - RNA, 17 nt, Homo sapiens
caugauuagauugcaaa

SEQ ID NO: 762878 - RNA, 16 nt, Homo sapiens
caugauuucauuucaa

SEQ ID NO: 762879 - RNA, 17 nt, Homo sapiens
caugcaaacagguuguu

SEQ ID NO: 762880 - RNA, 19 nt, Homo sapiens
caugcaaguuacugcaguu

SEQ ID NO: 762881 - RNA, 13 nt, Homo sapiens
caugcaaugacau

SEQ ID NO: 762882 - RNA, 16 nt, Homo sapiens
caugcaaugccaaaua

SEQ ID NO: 762883 - RNA, 14 nt, Homo sapiens
caugcacacacaca

SEQ ID NO: 762884 - RNA, 13 nt, Homo sapiens
caugcacggugag

SEQ ID NO: 762885 - RNA, 21 nt, Homo sapiens
caugcagccagccaucaaaua

SEQ ID NO: 762886 - RNA, 16 nt, Homo sapiens
caugcaggcaccucuu

SEQ ID NO: 762887 - RNA, 15 nt, Homo sapiens
caugcagugcccuca

SEQ ID NO: 762888 - RNA, 20 nt, Homo sapiens
caugcauagguuuagcagua

SEQ ID NO: 762889 - RNA, 15 nt, Homo sapiens
caugccaaccccgcc

SEQ ID NO: 762890 - RNA, 14 nt, Homo sapiens
caugcccagcugcu

SEQ ID NO: 762891 - RNA, 16 nt, Homo sapiens
caugccccuggaccag

SEQ ID NO: 762892 - RNA, 18 nt, Homo sapiens
caugccccuggaccagua

SEQ ID NO: 762893 - RNA, 13 nt, Homo sapiens
caugcccucaauc

SEQ ID NO: 762894 - RNA, 16 nt, Homo sapiens
caugccgcgucccugc

SEQ ID NO: 762895 - RNA, 22 nt, Homo sapiens
caugccuguaaucucagcacuu

SEQ ID NO: 762896 - RNA, 17 nt, Homo sapiens
caugcgucgcaaacucu

SEQ ID NO: 762897 - RNA, 21 nt, Homo sapiens
caugcgugccgccugcuccuc

SEQ ID NO: 762898 - RNA, 16 nt, Homo sapiens
caugcuacaguuauua

SEQ ID NO: 762899 - RNA, 15 nt, Homo sapiens
caugcucaaccacug

SEQ ID NO: 762900 - RNA, 19 nt, Homo sapiens
caugcucaaccacuguggc

SEQ ID NO: 762901 - RNA, 15 nt, Homo sapiens
caugcucaccaagga

SEQ ID NO: 762902 - RNA, 13 nt, Homo sapiens
caugcugcaaagg

SEQ ID NO: 762903 - RNA, 20 nt, Homo sapiens
caugcugcccagccacucca

SEQ ID NO: 762904 - RNA, 20 nt, Homo sapiens
caugcugcuggggaagacag

SEQ ID NO: 762905 - RNA, 17 nt, Homo sapiens
caugcugcuuugccaag

SEQ ID NO: 762906 - RNA, 23 nt, Homo sapiens
caugcugcuuuuuguacuuggaa

SEQ ID NO: 762907 - RNA, 14 nt, Homo sapiens
caugcuggugcaua

SEQ ID NO: 762908 - RNA, 15 nt, Homo sapiens
caugcugugugcugg

SEQ ID NO: 762909 - RNA, 21 nt, Homo sapiens
caugcuuccuccuuugcucuu

SEQ ID NO: 762910 - RNA, 23 nt, Homo sapiens
caugcuugcauaagagcuuaaga

SEQ ID NO: 762911 - RNA, 21 nt, Homo sapiens
caugcuuugacaaauuacaaa

SEQ ID NO: 762912 - RNA, 20 nt, Homo sapiens
caugcuuugcugcuaugaaa

SEQ ID NO: 762913 - RNA, 14 nt, Homo sapiens
caugcuuuugccac

SEQ ID NO: 762914 - RNA, 19 nt, Homo sapiens
cauggaaaacccccuuccu

SEQ ID NO: 762915 - RNA, 18 nt, Homo sapiens
cauggaaacgcaaaugag

SEQ ID NO: 762916 - RNA, 21 nt, Homo sapiens
cauggaaauguauuuuaguua

SEQ ID NO: 762917 - RNA, 21 nt, Homo sapiens
cauggaacagcauuacccucc

SEQ ID NO: 762918 - RNA, 13 nt, Homo sapiens
cauggaaccacua

SEQ ID NO: 762919 - RNA, 17 nt, Homo sapiens
cauggaaucgaaguguu

SEQ ID NO: 762920 - RNA, 20 nt, Homo sapiens
cauggaauuucuaguaugag

SEQ ID NO: 762921 - RNA, 13 nt, Homo sapiens
cauggacacuuug

SEQ ID NO: 762922 - RNA, 12 nt, Homo sapiens
cauggacagugu

SEQ ID NO: 762923 - RNA, 13 nt, Homo sapiens
cauggacagugug

SEQ ID NO: 762924 - RNA, 23 nt, Homo sapiens
cauggaccaaaggguuuacuuga

SEQ ID NO: 762925 - RNA, 19 nt, Homo sapiens
cauggacuuucuugcauga

SEQ ID NO: 762926 - RNA, 20 nt, Homo sapiens
cauggacuuucuugcaugaa

SEQ ID NO: 762927 - RNA, 14 nt, Homo sapiens
cauggagaccaucu

SEQ ID NO: 762928 - RNA, 18 nt, Homo sapiens
cauggagaccaucuaccc

SEQ ID NO: 762929 - RNA, 17 nt, Homo sapiens
cauggagcugcacucua

SEQ ID NO: 762930 - RNA, 21 nt, Homo sapiens
cauggaggaacaguauuacag

SEQ ID NO: 762931 - RNA, 13 nt, Homo sapiens
caucaaauaguga

SEQ ID NO: 762932 - RNA, 13 nt, Homo sapiens
caucaacuuaaaa

SEQ ID NO: 762933 - RNA, 22 nt, Homo sapiens
caucaagaugagagaacuggag

SEQ ID NO: 762934 - RNA, 16 nt, Homo sapiens
caucaagcacuuccca

SEQ ID NO: 762935 - RNA, 17 nt, Homo sapiens
caucaauauuauauuca

SEQ ID NO: 762936 - RNA, 15 nt, Homo sapiens
caucacaacauuccu

SEQ ID NO: 762937 - RNA, 21 nt, Homo sapiens
caucacagcugaacuuguuga

SEQ ID NO: 762938 - RNA, 16 nt, Homo sapiens
caucacaggacacggg

SEQ ID NO: 762939 - RNA, 23 nt, Homo sapiens
caucacccgggaacuuuuuuaga

SEQ ID NO: 762940 - RNA, 16 nt, Homo sapiens
caucacccucuuccug

SEQ ID NO: 762941 - RNA, 20 nt, Homo sapiens
caucacccucuuccugugau

SEQ ID NO: 762942 - RNA, 22 nt, Homo sapiens
caucacgcugcaucccauugcu

SEQ ID NO: 762943 - RNA, 23 nt, Homo sapiens
caucacggauggugcaugggcuc

SEQ ID NO: 762944 - RNA, 16 nt, Homo sapiens
caucacguuagcuguc

SEQ ID NO: 762945 - RNA, 17 nt, Homo sapiens
caucacuuccuugcccc

SEQ ID NO: 762946 - RNA, 12 nt, Homo sapiens
caucacuuugac

SEQ ID NO: 762947 - RNA, 14 nt, Homo sapiens
caucacuuugccaa

SEQ ID NO: 762948 - RNA, 15 nt, Homo sapiens
caucagacagaugga

SEQ ID NO: 762949 - RNA, 19 nt, Homo sapiens
caucagaccugucuuccaa

SEQ ID NO: 762950 - RNA, 18 nt, Homo sapiens
caucagacuccugugcaa

SEQ ID NO: 762951 - RNA, 21 nt, Homo sapiens
caucagacuccugugcaacuu

SEQ ID NO: 762952 - RNA, 22 nt, Homo sapiens
caucagagaugguaaucuacag

SEQ ID NO: 762953 - RNA, 23 nt, Homo sapiens
caucagagccagucucaccuuca

SEQ ID NO: 762954 - RNA, 14 nt, Homo sapiens
caucagcaagacuu

SEQ ID NO: 762955 - RNA, 12 nt, Homo sapiens
caucagcauuug

SEQ ID NO: 762956 - RNA, 16 nt, Homo sapiens
caucagccugcuucuu

SEQ ID NO: 762957 - RNA, 18 nt, Homo sapiens
caucaggaaacaggaaga

SEQ ID NO: 762958 - RNA, 15 nt, Homo sapiens
caucaggacucugac

SEQ ID NO: 762959 - RNA, 20 nt, Homo sapiens
caucaggcuaagacccugug

SEQ ID NO: 762960 - RNA, 13 nt, Homo sapiens
caucagggcccag

SEQ ID NO: 762961 - RNA, 21 nt, Homo sapiens
caucagguuccaguugcuuga

SEQ ID NO: 762962 - RNA, 22 nt, Homo sapiens
caucaguacuuguuucuaugca

SEQ ID NO: 762963 - RNA, 21 nt, Homo sapiens
caucaguguccucuugcucaa

SEQ ID NO: 762964 - RNA, 22 nt, Homo sapiens
caucaguguccucuugcucaaa

SEQ ID NO: 762965 - RNA, 15 nt, Homo sapiens
caucaguucauugac

SEQ ID NO: 762966 - RNA, 13 nt, Homo sapiens
caucauagggaua

SEQ ID NO: 762967 - RNA, 18 nt, Homo sapiens
caucauccuccauugcuc

SEQ ID NO: 762968 - RNA, 13 nt, Homo sapiens
caucaucuauggc

SEQ ID NO: 762969 - RNA, 11 nt, Homo sapiens
caucaucucag

SEQ ID NO: 762970 - RNA, 21 nt, Homo sapiens
caucauggaaagacugggaca

SEQ ID NO: 762971 - RNA, 19 nt, Homo sapiens
caucauggaggucauacau

SEQ ID NO: 762972 - RNA, 23 nt, Homo sapiens
caucauggaggucauacaugcau

SEQ ID NO: 762973 - RNA, 19 nt, Homo sapiens
caucauuacuuaugaugau

SEQ ID NO: 762974 - RNA, 14 nt, Homo sapiens
caucauugcauaac

SEQ ID NO: 762975 - RNA, 17 nt, Homo sapiens
cauccaaaccuguaacc

SEQ ID NO: 762976 - RNA, 22 nt, Homo sapiens
cauccaaacuaaaaggaaguca

SEQ ID NO: 762977 - RNA, 17 nt, Homo sapiens
cauccaagccagaguuu

SEQ ID NO: 762978 - RNA, 21 nt, Homo sapiens
cauccaaggagaaacagagac

SEQ ID NO: 762979 - RNA, 15 nt, Homo sapiens
cauccacaaaacccu

SEQ ID NO: 762980 - RNA, 20 nt, Homo sapiens
cauccagguggagacccuga

SEQ ID NO: 762981 - RNA, 17 nt, Homo sapiens
cauccagugacaaacca

SEQ ID NO: 762982 - RNA, 10 nt, Homo sapiens
cauccagugg

SEQ ID NO: 762983 - RNA, 15 nt, Homo sapiens
cauccauccaaaggc

SEQ ID NO: 762984 - RNA, 22 nt, Homo sapiens
cauccaugagcugcuccaucac

SEQ ID NO: 762985 - RNA, 17 nt, Homo sapiens
caucccaacagccaaga

SEQ ID NO: 762986 - RNA, 15 nt, Homo sapiens
caucccaucaucuug

SEQ ID NO: 762987 - RNA, 19 nt, Homo sapiens
cauccccuuuguguagaaa

SEQ ID NO: 762988 - RNA, 17 nt, Homo sapiens
caucccuuuuucugcua

SEQ ID NO: 762989 - RNA, 13 nt, Homo sapiens
cauccgcacugua

SEQ ID NO: 762990 - RNA, 14 nt, Homo sapiens
cauccgcacuguaa

SEQ ID NO: 762991 - RNA, 14 nt, Homo sapiens
cauccgcgugugcc

SEQ ID NO: 762992 - RNA, 19 nt, Homo sapiens
cauccgguuugccauguug

SEQ ID NO: 762993 - RNA, 20 nt, Homo sapiens
cauccuacaacucacauuag

SEQ ID NO: 762994 - RNA, 17 nt, Homo sapiens
cauccuccacaauagca

SEQ ID NO: 762995 - RNA, 15 nt, Homo sapiens
cauccuccauugcuc

SEQ ID NO: 762996 - RNA, 23 nt, Homo sapiens
cauccuccccuagcuuagcuguc

SEQ ID NO: 762997 - RNA, 14 nt, Homo sapiens
cauccugaccagcu

SEQ ID NO: 762998 - RNA, 17 nt, Homo sapiens
cauccuggccaacauug

SEQ ID NO: 762999 - RNA, 18 nt, Homo sapiens
cauccuggccuggcacau

SEQ ID NO: 763000 - RNA, 20 nt, Homo sapiens
cauccuggcuaacacgugaa

SEQ ID NO: 763001 - RNA, 20 nt, Homo sapiens
cauccuguuuguaugaaauu

SEQ ID NO: 763002 - RNA, 22 nt, Homo sapiens
cauccuuauucacguugacagu

SEQ ID NO: 763003 - RNA, 11 nt, Homo sapiens
cauccuuccaa

SEQ ID NO: 763004 - RNA, 12 nt, Homo sapiens
cauccuugaugc

SEQ ID NO: 763005 - RNA, 14 nt, Homo sapiens
cauccuugcugcag

SEQ ID NO: 763006 - RNA, 22 nt, Homo sapiens
cauccuuuacaccaacuccuaa

SEQ ID NO: 763007 - RNA, 15 nt, Homo sapiens
cauccuuuacguguu

SEQ ID NO: 763008 - RNA, 15 nt, Homo sapiens
cauccuuucuuuuaa

SEQ ID NO: 763009 - RNA, 20 nt, Homo sapiens
caucgcaauaguuuuuuacu

SEQ ID NO: 763010 - RNA, 17 nt, Homo sapiens
caucggaaaaauaauca

SEQ ID NO: 763011 - RNA, 18 nt, Homo sapiens
caucggucuaaagcuuug

SEQ ID NO: 763012 - RNA, 20 nt, Homo sapiens
caucuaagucaguuucacau

SEQ ID NO: 763013 - RNA, 20 nt, Homo sapiens
caucuaccuuuucuggcaaa

SEQ ID NO: 763014 - RNA, 23 nt, Homo sapiens
caucuacucuaaagaaaaaugcc

SEQ ID NO: 763015 - RNA, 22 nt, Homo sapiens
caucuacuuuuuuuuuaauuaa

SEQ ID NO: 763016 - RNA, 18 nt, Homo sapiens
caucuaguaggugcuuga

SEQ ID NO: 763017 - RNA, 19 nt, Homo sapiens
caucuauaaagaagaacuu

SEQ ID NO: 763018 - RNA, 15 nt, Homo sapiens
caucuauuauuacac

SEQ ID NO: 763019 - RNA, 18 nt, Homo sapiens
caucuauucaagcacuua

SEQ ID NO: 763020 - RNA, 19 nt, Homo sapiens
caucuauuuggaacccaag

SEQ ID NO: 763021 - RNA, 22 nt, Homo sapiens
caucucaaaaauaaugcauaaa

SEQ ID NO: 763022 - RNA, 15 nt, Homo sapiens
caucucaauaacaaa

SEQ ID NO: 763023 - RNA, 13 nt, Homo sapiens
caucucacuuuau

SEQ ID NO: 763024 - RNA, 15 nt, Homo sapiens
caucucacuuuauga

SEQ ID NO: 763025 - RNA, 21 nt, Homo sapiens
caucucagaaaacucugguaa

SEQ ID NO: 763026 - RNA, 13 nt, Homo sapiens
caucucauuccaa

SEQ ID NO: 763027 - RNA, 16 nt, Homo sapiens
caucucauuccaacuu

SEQ ID NO: 763028 - RNA, 16 nt, Homo sapiens
caucucccaucuuccu

SEQ ID NO: 763029 - RNA, 14 nt, Homo sapiens
caucuccucuguaa

SEQ ID NO: 763030 - RNA, 23 nt, Homo sapiens
caucuccuucccccagcccaaua

SEQ ID NO: 763031 - RNA, 18 nt, Homo sapiens
caucucggggaccugcuu

SEQ ID NO: 763032 - RNA, 11 nt, Homo sapiens
caucucuacua

SEQ ID NO: 763033 - RNA, 12 nt, Homo sapiens
caucucuacuaa

SEQ ID NO: 763034 - RNA, 13 nt, Homo sapiens
caucucuauuuag

SEQ ID NO: 763035 - RNA, 23 nt, Homo sapiens
caucucucccuccccugccauuu

SEQ ID NO: 763036 - RNA, 21 nt, Homo sapiens
caucucucugccccacauaau

SEQ ID NO: 763037 - RNA, 21 nt, Homo sapiens
caucugaaaagaaaugcuaau

SEQ ID NO: 763038 - RNA, 22 nt, Homo sapiens
caucugaaucccgggcuaagaa

SEQ ID NO: 763039 - RNA, 18 nt, Homo sapiens
caucugaccaucugugac

SEQ ID NO: 763040 - RNA, 20 nt, Homo sapiens
caucugaccaucugugacua

SEQ ID NO: 763041 - RNA, 20 nt, Homo sapiens
caucugacugccaagccaga

SEQ ID NO: 763042 - RNA, 22 nt, Homo sapiens
caucugcucuagauucauaaau

SEQ ID NO: 763043 - RNA, 23 nt, Homo sapiens
caucugggcaaaacccacagaag

SEQ ID NO: 763044 - RNA, 13 nt, Homo sapiens
caucugugcagua

SEQ ID NO: 763045 - RNA, 18 nt, Homo sapiens
uauucucuuccucaucca

SEQ ID NO: 763046 - RNA, 14 nt, Homo sapiens
uauucugacaugua

SEQ ID NO: 763047 - RNA, 15 nt, Homo sapiens
uauucugcauggaaa

SEQ ID NO: 763048 - RNA, 15 nt, Homo sapiens
uauucuucauaacaa

SEQ ID NO: 763049 - RNA, 13 nt, Homo sapiens
uauucuucuagag

SEQ ID NO: 763050 - RNA, 15 nt, Homo sapiens
uauucuugugcuuuu

SEQ ID NO: 763051 - RNA, 15 nt, Homo sapiens
uauugaaaacacuua

SEQ ID NO: 763052 - RNA, 19 nt, Homo sapiens
uauugaaagccaacaacuc

SEQ ID NO: 763053 - RNA, 16 nt, Homo sapiens
uauugaagaugcugcc

SEQ ID NO: 763054 - RNA, 19 nt, Homo sapiens
uauugaaguuguuuaucaa

SEQ ID NO: 763055 - RNA, 20 nt, Homo sapiens
uauugaggcugcagcaggug

SEQ ID NO: 763056 - RNA, 14 nt, Homo sapiens
uauugauaugugaa

SEQ ID NO: 763057 - RNA, 16 nt, Homo sapiens
uauugcaagaguuuaa

SEQ ID NO: 763058 - RNA, 21 nt, Homo sapiens
uauugcagagacucauuucac

SEQ ID NO: 763059 - RNA, 16 nt, Homo sapiens
uauugcauaauuuaua

SEQ ID NO: 763060 - RNA, 20 nt, Homo sapiens
uauugccucugaaaugccuc

SEQ ID NO: 763061 - RNA, 23 nt, Homo sapiens
uauuggcgcaccaagaucuccaa

SEQ ID NO: 763062 - RNA, 23 nt, Homo sapiens
uauuguaaaacuuuggugcauug

SEQ ID NO: 763063 - RNA, 18 nt, Homo sapiens
ugccagacuuaaaucaca

SEQ ID NO: 763064 - RNA, 12 nt, Homo sapiens
ugccagagccaa

SEQ ID NO: 763065 - RNA, 17 nt, Homo sapiens
ugccagaggaugcucuu

SEQ ID NO: 763066 - RNA, 20 nt, Homo sapiens
ugccagaguagugaagcuaa

SEQ ID NO: 763067 - RNA, 18 nt, Homo sapiens
ugccagaugauuguucaa

SEQ ID NO: 763068 - RNA, 17 nt, Homo sapiens
ugccagaugcaauacaa

SEQ ID NO: 763069 - RNA, 20 nt, Homo sapiens
ugccagcaucugcagccacu

SEQ ID NO: 763070 - RNA, 14 nt, Homo sapiens
ugccagggccuguc

SEQ ID NO: 763071 - RNA, 22 nt, Homo sapiens
ugccaggucccuuucauuugcu

SEQ ID NO: 763072 - RNA, 16 nt, Homo sapiens
ugccagugccucucac

SEQ ID NO: 763073 - RNA, 16 nt, Homo sapiens
ugccagugcucaaggu

SEQ ID NO: 763074 - RNA, 20 nt, Homo sapiens
ugccaguuguuaaaaugagc

SEQ ID NO: 763075 - RNA, 23 nt, Homo sapiens
ugccauaaccacauuuaauggga

SEQ ID NO: 763076 - RNA, 15 nt, Homo sapiens
ugccauaucagugaa

SEQ ID NO: 763077 - RNA, 13 nt, Homo sapiens
ugccaucaugccu

SEQ ID NO: 763078 - RNA, 20 nt, Homo sapiens
ugccauccaugugcuaguca

SEQ ID NO: 763079 - RNA, 17 nt, Homo sapiens
ugccaucgcugugaugc

SEQ ID NO: 763080 - RNA, 17 nt, Homo sapiens
ugccaucuguagcuaua

SEQ ID NO: 763081 - RNA, 20 nt, Homo sapiens
ugccaugcuggugcgcugca

SEQ ID NO: 763082 - RNA, 18 nt, Homo sapiens
ugccaugucugcagugug

SEQ ID NO: 763083 - RNA, 13 nt, Homo sapiens
ugccaugugaaga

SEQ ID NO: 763084 - RNA, 23 nt, Homo sapiens
ugccauguggaaggcaagccagg

SEQ ID NO: 763085 - RNA, 16 nt, Homo sapiens
ugccauguuuugccac

SEQ ID NO: 763086 - RNA, 18 nt, Homo sapiens
ugccauuaaaacauuacc

SEQ ID NO: 763087 - RNA, 21 nt, Homo sapiens
ugccauuagacugaauuuaac

SEQ ID NO: 763088 - RNA, 18 nt, Homo sapiens
ugccauucaacucggaaa

SEQ ID NO: 763089 - RNA, 19 nt, Homo sapiens
ugccauuucugaacuguua

SEQ ID NO: 763090 - RNA, 15 nt, Homo sapiens
ugcccaaaacuguca

SEQ ID NO: 763091 - RNA, 19 nt, Homo sapiens
ugcccaaacaccagucacc

SEQ ID NO: 763092 - RNA, 18 nt, Homo sapiens
ugcccaagcuggagugaa

SEQ ID NO: 763093 - RNA, 13 nt, Homo sapiens
ugcccaaggagcc

SEQ ID NO: 763094 - RNA, 14 nt, Homo sapiens
ugcccaagucccag

SEQ ID NO: 763095 - RNA, 21 nt, Homo sapiens
ugcccaagucuuuccuaccuu

SEQ ID NO: 763096 - RNA, 18 nt, Homo sapiens
ugcccaaugagacucuag

SEQ ID NO: 763097 - RNA, 22 nt, Homo sapiens
ugcccaauuagggccuagccuu

SEQ ID NO: 763098 - RNA, 18 nt, Homo sapiens
ugcccaccguuaggauuc

SEQ ID NO: 763099 - RNA, 14 nt, Homo sapiens
ugcccaggagacag

SEQ ID NO: 763100 - RNA, 21 nt, Homo sapiens
ugcccaggcagucuuugcuca

SEQ ID NO: 763101 - RNA, 21 nt, Homo sapiens
ugcccaggccucuggcuuuuu

SEQ ID NO: 763102 - RNA, 20 nt, Homo sapiens
ugcccaggcuggagugcaau

SEQ ID NO: 763103 - RNA, 20 nt, Homo sapiens
ugcccaggcuggaguggagu

SEQ ID NO: 763104 - RNA, 17 nt, Homo sapiens
ugcccaggcuggucuca

SEQ ID NO: 763105 - RNA, 15 nt, Homo sapiens
ugcccagggcucagc

SEQ ID NO: 763106 - RNA, 20 nt, Homo sapiens
ugcccaucagggcccaggga

SEQ ID NO: 763107 - RNA, 14 nt, Homo sapiens
ugcccaugggcuau

SEQ ID NO: 763108 - RNA, 20 nt, Homo sapiens
ugccccaccccauccagcca

SEQ ID NO: 763109 - RNA, 23 nt, Homo sapiens
ugccccaccugccuggugcauug

SEQ ID NO: 763110 - RNA, 14 nt, Homo sapiens
cauaacuugcugaa

SEQ ID NO: 763111 - RNA, 20 nt, Homo sapiens
cauaagagcuuaagaaccau

SEQ ID NO: 763112 - RNA, 20 nt, Homo sapiens
cauaagaggaguaggcccug

SEQ ID NO: 763113 - RNA, 17 nt, Homo sapiens
cauaagcauuacuuuau

SEQ ID NO: 763114 - RNA, 14 nt, Homo sapiens
cauaagggcacuga

SEQ ID NO: 763115 - RNA, 18 nt, Homo sapiens
cauaaguuaacuuccaau

SEQ ID NO: 763116 - RNA, 20 nt, Homo sapiens
cauaaguuaugccucugaca

SEQ ID NO: 763117 - RNA, 16 nt, Homo sapiens
cauaauaaauaauuaa

SEQ ID NO: 763118 - RNA, 16 nt, Homo sapiens
cauaauaaauaucugu

SEQ ID NO: 763119 - RNA, 17 nt, Homo sapiens
cauaauaagcuaaagag

SEQ ID NO: 763120 - RNA, 12 nt, Homo sapiens
cauaauggacua

SEQ ID NO: 763121 - RNA, 16 nt, Homo sapiens
cauaauguuacauuau

SEQ ID NO: 763122 - RNA, 21 nt, Homo sapiens
cauaauguuacauuauuauca

SEQ ID NO: 763123 - RNA, 15 nt, Homo sapiens
cauaauucagcacuu

SEQ ID NO: 763124 - RNA, 15 nt, Homo sapiens
cauaauucuaaguua

SEQ ID NO: 763125 - RNA, 20 nt, Homo sapiens
cauaauugugauuagacaga

SEQ ID NO: 763126 - RNA, 22 nt, Homo sapiens
cauaauugugauuagacagaac

SEQ ID NO: 763127 - RNA, 17 nt, Homo sapiens
cauaauuuaaaagcaca

SEQ ID NO: 763128 - RNA, 13 nt, Homo sapiens
cauacaacagaaa

SEQ ID NO: 763129 - RNA, 18 nt, Homo sapiens
cauacaauuccaaacaca

SEQ ID NO: 763130 - RNA, 23 nt, Homo sapiens
cauacacccccaccuccugcaau

SEQ ID NO: 763131 - RNA, 12 nt, Homo sapiens
cauacagacugg

SEQ ID NO: 763132 - RNA, 16 nt, Homo sapiens
cauacagagacagaua

SEQ ID NO: 763133 - RNA, 12 nt, Homo sapiens
cauacaggccau

SEQ ID NO: 763134 - RNA, 15 nt, Homo sapiens
cauacauauuaucuc

SEQ ID NO: 763135 - RNA, 15 nt, Homo sapiens
cauacccaugcacag

SEQ ID NO: 763136 - RNA, 20 nt, Homo sapiens
cauacccuuacucugccaga

SEQ ID NO: 763137 - RNA, 17 nt, Homo sapiens
cauaccguguaccucag

SEQ ID NO: 763138 - RNA, 14 nt, Homo sapiens
cauaccucugacca

SEQ ID NO: 763139 - RNA, 22 nt, Homo sapiens
cauacuacaguaacugugacug

SEQ ID NO: 763140 - RNA, 22 nt, Homo sapiens
cauacuccuuuuaagcagugag

SEQ ID NO: 763141 - RNA, 22 nt, Homo sapiens
cauacuguuuccuaugacauua

SEQ ID NO: 763142 - RNA, 17 nt, Homo sapiens
cauacuugaagggccag

SEQ ID NO: 763143 - RNA, 12 nt, Homo sapiens
cauagaaaaacu

SEQ ID NO: 763144 - RNA, 23 nt, Homo sapiens
cauagaaaaauucagcaaaccau

SEQ ID NO: 763145 - RNA, 21 nt, Homo sapiens
cauagaaacaauaaaugaguu

SEQ ID NO: 763146 - RNA, 19 nt, Homo sapiens
cauagaaacaugacacuga

SEQ ID NO: 763147 - RNA, 15 nt, Homo sapiens
cauagaaauguaggu

SEQ ID NO: 763148 - RNA, 19 nt, Homo sapiens
cauagaaauguagguccuc

SEQ ID NO: 763149 - RNA, 19 nt, Homo sapiens
cauagaaauuguguuugcu

SEQ ID NO: 763150 - RNA, 22 nt, Homo sapiens
cauagagcuuuuuaauagcacu

SEQ ID NO: 763151 - RNA, 21 nt, Homo sapiens
cauagagucuuuauguccaua

SEQ ID NO: 763152 - RNA, 19 nt, Homo sapiens
cauagauuaauggcacuga

SEQ ID NO: 763153 - RNA, 17 nt, Homo sapiens
cauagcaagauugcuua

SEQ ID NO: 763154 - RNA, 21 nt, Homo sapiens
cauagcagaccacacagaagg

SEQ ID NO: 763155 - RNA, 14 nt, Homo sapiens
cauagcaugacauu

SEQ ID NO: 763156 - RNA, 19 nt, Homo sapiens
cauaggaaguauggcauga

SEQ ID NO: 763157 - RNA, 16 nt, Homo sapiens
cauaggacauacugca

SEQ ID NO: 763158 - RNA, 17 nt, Homo sapiens
cauaggcgcaggugcac

SEQ ID NO: 763159 - RNA, 15 nt, Homo sapiens
cauaggucacuggcu

SEQ ID NO: 763160 - RNA, 15 nt, Homo sapiens
cauaggucuccaaga

SEQ ID NO: 763161 - RNA, 14 nt, Homo sapiens
cauaggucuguaug

SEQ ID NO: 763162 - RNA, 20 nt, Homo sapiens
cauagguuaaaaaaaaaagu

SEQ ID NO: 763163 - RNA, 17 nt, Homo sapiens
cauaguaguaugaugau

SEQ ID NO: 763164 - RNA, 13 nt, Homo sapiens
cauaguccaaaaa

SEQ ID NO: 763165 - RNA, 13 nt, Homo sapiens
cauagugucacag

SEQ ID NO: 763166 - RNA, 18 nt, Homo sapiens
cauaguuuaaacugcauu

SEQ ID NO: 763167 - RNA, 15 nt, Homo sapiens
cauaguuuauuucaa

SEQ ID NO: 763168 - RNA, 18 nt, Homo sapiens
cauaguuucaaaucugua

SEQ ID NO: 763169 - RNA, 13 nt, Homo sapiens
cauauaaacucau

SEQ ID NO: 763170 - RNA, 13 nt, Homo sapiens
cauauaacaugca

SEQ ID NO: 763171 - RNA, 22 nt, Homo sapiens
cauauaacuaagacauaugcau

SEQ ID NO: 763172 - RNA, 19 nt, Homo sapiens
cauauaauguuguuauuua

SEQ ID NO: 763173 - RNA, 21 nt, Homo sapiens
cauauacuuuggggacuugua

SEQ ID NO: 763174 - RNA, 16 nt, Homo sapiens
cauauagaaugcagag

SEQ ID NO: 763175 - RNA, 19 nt, Homo sapiens
cauauaggacacacauaga

SEQ ID NO: 763176 - RNA, 20 nt, Homo sapiens
cauauaggccagaguugcaa

SEQ ID NO: 763177 - RNA, 21 nt, Homo sapiens
uauuguacucugcuuuaucaa

SEQ ID NO: 763178 - RNA, 17 nt, Homo sapiens
uauuguccgggcucaga

SEQ ID NO: 763179 - RNA, 18 nt, Homo sapiens
uauuguugacaacuguga

SEQ ID NO: 763180 - RNA, 15 nt, Homo sapiens
uauuuaaaacaaaga

SEQ ID NO: 763181 - RNA, 16 nt, Homo sapiens
uauuuaaaacaaagaa

SEQ ID NO: 763182 - RNA, 20 nt, Homo sapiens
uauuuaaagaaaauaaacac

SEQ ID NO: 763183 - RNA, 22 nt, Homo sapiens
uauuuaaagaagaaacgucuau

SEQ ID NO: 763184 - RNA, 18 nt, Homo sapiens
uauuuaaagacaaagaca

SEQ ID NO: 763185 - RNA, 22 nt, Homo sapiens
uauuuaaagccuccucaucccg

SEQ ID NO: 763186 - RNA, 23 nt, Homo sapiens
uauuuaauagcugugaucaguga

SEQ ID NO: 763187 - RNA, 23 nt, Homo sapiens
uauuuaaucaaacaguaaucuag

SEQ ID NO: 763188 - RNA, 17 nt, Homo sapiens
uauuuacaguuuccaga

SEQ ID NO: 763189 - RNA, 18 nt, Homo sapiens
uauuuaccuucuaccucu

SEQ ID NO: 763190 - RNA, 13 nt, Homo sapiens
uauuuauaacuca

SEQ ID NO: 763191 - RNA, 21 nt, Homo sapiens
uauuuauauauuuauaacuca

SEQ ID NO: 763192 - RNA, 15 nt, Homo sapiens
uauuuauauguacug

SEQ ID NO: 763193 - RNA, 21 nt, Homo sapiens
uauuuaugcacugugggaugu

SEQ ID NO: 763194 - RNA, 17 nt, Homo sapiens
uauuuaugccucuguau

SEQ ID NO: 763195 - RNA, 16 nt, Homo sapiens
uauuuauguguucaca

SEQ ID NO: 763196 - RNA, 23 nt, Homo sapiens
uauuuauuacuuccucauaccac

SEQ ID NO: 763197 - RNA, 19 nt, Homo sapiens
uauuuauugaguaccuacu

SEQ ID NO: 763198 - RNA, 13 nt, Homo sapiens
uauuuauuuucag

SEQ ID NO: 763199 - RNA, 21 nt, Homo sapiens
uauuucaacuaauauaucuau

SEQ ID NO: 763200 - RNA, 14 nt, Homo sapiens
uauuucaagcucug

SEQ ID NO: 763201 - RNA, 22 nt, Homo sapiens
uauuucaagugccuagacuguu

SEQ ID NO: 763202 - RNA, 19 nt, Homo sapiens
uauuucaauucuaaaauac

SEQ ID NO: 763203 - RNA, 14 nt, Homo sapiens
uauuucacagagca

SEQ ID NO: 763204 - RNA, 15 nt, Homo sapiens
uauuucagaaauaca

SEQ ID NO: 763205 - RNA, 15 nt, Homo sapiens
uauuucauaaacaac

SEQ ID NO: 763206 - RNA, 15 nt, Homo sapiens
uauuucauuauguaa

SEQ ID NO: 763207 - RNA, 12 nt, Homo sapiens
uauuuccacuga

SEQ ID NO: 763208 - RNA, 21 nt, Homo sapiens
uauuuccauagcuuuuggcug

SEQ ID NO: 763209 - RNA, 15 nt, Homo sapiens
uauuuccauagucaa

SEQ ID NO: 763210 - RNA, 18 nt, Homo sapiens
uauuucccucaccuuucc

SEQ ID NO: 763211 - RNA, 15 nt, Homo sapiens
uauuucuaaaguaau

SEQ ID NO: 763212 - RNA, 12 nt, Homo sapiens
uauuucugaaga

SEQ ID NO: 763213 - RNA, 14 nt, Homo sapiens
uauuucugauacug

SEQ ID NO: 763214 - RNA, 16 nt, Homo sapiens
uauuugaaucuacaaa

SEQ ID NO: 763215 - RNA, 17 nt, Homo sapiens
uauuugcacuucaccuu

SEQ ID NO: 763216 - RNA, 15 nt, Homo sapiens
uauuugcaguaugaa

SEQ ID NO: 763217 - RNA, 24 nt, Homo sapiens
uauuugcuuuuugcuaacaaugcu

SEQ ID NO: 763218 - RNA, 18 nt, Homo sapiens
uauuuguaaaucugccac

SEQ ID NO: 763219 - RNA, 15 nt, Homo sapiens
uauuuguacaaaaaa

SEQ ID NO: 763220 - RNA, 14 nt, Homo sapiens
uauuuguaucuguu

SEQ ID NO: 763221 - RNA, 20 nt, Homo sapiens
uauuuuaaaguaaaagucua

SEQ ID NO: 763222 - RNA, 19 nt, Homo sapiens
uauuuuaagaauuucacaa

SEQ ID NO: 763223 - RNA, 22 nt, Homo sapiens
uauuuuaagaauuucacaagcu

SEQ ID NO: 763224 - RNA, 14 nt, Homo sapiens
uauuuuaagaucca

SEQ ID NO: 763225 - RNA, 23 nt, Homo sapiens
uauuuuacacguaucucuuggua

SEQ ID NO: 763226 - RNA, 22 nt, Homo sapiens
uauuuuagacacuucccugcau

SEQ ID NO: 763227 - RNA, 18 nt, Homo sapiens
uauuuuaugaucuuggcu

SEQ ID NO: 763228 - RNA, 12 nt, Homo sapiens
uauuuucauaga

SEQ ID NO: 763229 - RNA, 12 nt, Homo sapiens
uauuuuccaaag

SEQ ID NO: 763230 - RNA, 13 nt, Homo sapiens
uauuuucuguuga

SEQ ID NO: 763231 - RNA, 13 nt, Homo sapiens
uauuuugaauuca

SEQ ID NO: 763232 - RNA, 17 nt, Homo sapiens
uauuuugagaagcucug

SEQ ID NO: 763233 - RNA, 13 nt, Homo sapiens
uauuuugcauucc

SEQ ID NO: 763234 - RNA, 16 nt, Homo sapiens
uauuuuggaacuauga

SEQ ID NO: 763235 - RNA, 22 nt, Homo sapiens
uauuuugguugcaguuuccaau

SEQ ID NO: 763236 - RNA, 23 nt, Homo sapiens
uauuuugugggcugguugcugua

SEQ ID NO: 763237 - RNA, 20 nt, Homo sapiens
uauuuuguguuguucauuga

SEQ ID NO: 763238 - RNA, 22 nt, Homo sapiens
uauuuuguugccuucaucuuca

SEQ ID NO: 763239 - RNA, 14 nt, Homo sapiens
uauuuuucucauga

SEQ ID NO: 763240 - RNA, 23 nt, Homo sapiens
uauuuuuggcugggggaguguga

SEQ ID NO: 763241 - RNA, 22 nt, Homo sapiens
uauuuuuguuucuuccaaagca

SEQ ID NO: 763242 - RNA, 19 nt, Homo sapiens
uauuuuuuacuacauaauu

SEQ ID NO: 763243 - RNA, 20 nt, Homo sapiens
uauuuuuucuugcaaauacc

SEQ ID NO: 763244 - RNA, 22 nt, Homo sapiens
ucaaaaaaaaaaaaaaaagccu

SEQ ID NO: 763245 - RNA, 17 nt, Homo sapiens
ucaaaaacgaccaccuc

SEQ ID NO: 763246 - RNA, 18 nt, Homo sapiens
ucaaaaagggaaugcauu

SEQ ID NO: 763247 - RNA, 17 nt, Homo sapiens
ucaaaaagugacuucca

SEQ ID NO: 763248 - RNA, 16 nt, Homo sapiens
ucaaaaauauuugcug

SEQ ID NO: 763249 - RNA, 15 nt, Homo sapiens
ucaaaaaucuguccg

SEQ ID NO: 763250 - RNA, 13 nt, Homo sapiens
ucaaaaauuugca

SEQ ID NO: 763251 - RNA, 16 nt, Homo sapiens
ucaaaacaagacuccu

SEQ ID NO: 763252 - RNA, 23 nt, Homo sapiens
ucaaaacacucaucuccucugua

SEQ ID NO: 763253 - RNA, 18 nt, Homo sapiens
ucaaaacauccuagggug

SEQ ID NO: 763254 - RNA, 14 nt, Homo sapiens
ucaaaaccagugaa

SEQ ID NO: 763255 - RNA, 13 nt, Homo sapiens
ucaaaaccugugc

SEQ ID NO: 763256 - RNA, 16 nt, Homo sapiens
ucaaaaccugugccag

SEQ ID NO: 763257 - RNA, 17 nt, Homo sapiens
ucaaaaccugugccagg

SEQ ID NO: 763258 - RNA, 20 nt, Homo sapiens
ucaaaacgcacaagccagac

SEQ ID NO: 763259 - RNA, 18 nt, Homo sapiens
ucaaaacuaaccaucuga

SEQ ID NO: 763260 - RNA, 17 nt, Homo sapiens
ucaaaacugcacuguca

SEQ ID NO: 763261 - RNA, 22 nt, Homo sapiens
ucaaaacuuucguuguuauuau

SEQ ID NO: 763262 - RNA, 18 nt, Homo sapiens
ucaaaagccagaugugaa

SEQ ID NO: 763263 - RNA, 16 nt, Homo sapiens
ucaaaagguagauccu

SEQ ID NO: 763264 - RNA, 12 nt, Homo sapiens
ucaaaaggugcc

SEQ ID NO: 763265 - RNA, 23 nt, Homo sapiens
ucaaaauaaaaaguaaugacuua

SEQ ID NO: 763266 - RNA, 18 nt, Homo sapiens
ucaaaauaaaaagugaca

SEQ ID NO: 763267 - RNA, 22 nt, Homo sapiens
ucaaaauaaaaaugagguacuc

SEQ ID NO: 763268 - RNA, 22 nt, Homo sapiens
ucaaaauaccaugccauuuaaa

SEQ ID NO: 763269 - RNA, 17 nt, Homo sapiens
ucaaaauauacauucaa

SEQ ID NO: 763270 - RNA, 22 nt, Homo sapiens
ucaaaaucauuuagucuaacaa

SEQ ID NO: 763271 - RNA, 14 nt, Homo sapiens
ucaaaauccaaaaa

SEQ ID NO: 763272 - RNA, 16 nt, Homo sapiens
ugagcuggcuugucca

SEQ ID NO: 763273 - RNA, 14 nt, Homo sapiens
ugagcuggggacuc

SEQ ID NO: 763274 - RNA, 17 nt, Homo sapiens
ugagcuggggaugucuc

SEQ ID NO: 763275 - RNA, 18 nt, Homo sapiens
ugagcuggggaugucucu

SEQ ID NO: 763276 - RNA, 22 nt, Homo sapiens
ugagcuggguacugacugagau

SEQ ID NO: 763277 - RNA, 15 nt, Homo sapiens
ugagcuucaauauaa

SEQ ID NO: 763278 - RNA, 20 nt, Homo sapiens
ugagcuucauauaccagcaa

SEQ ID NO: 763279 - RNA, 18 nt, Homo sapiens
ugagcuugauuaaaucaa

SEQ ID NO: 763280 - RNA, 19 nt, Homo sapiens
ugagcuuuccauguugcug

SEQ ID NO: 763281 - RNA, 13 nt, Homo sapiens
ugaggaacauuca

SEQ ID NO: 763282 - RNA, 24 nt, Homo sapiens
ugaggaacccugaucucucagccc

SEQ ID NO: 763283 - RNA, 14 nt, Homo sapiens
ugaggaacugucuc

SEQ ID NO: 763284 - RNA, 20 nt, Homo sapiens
ugaggaagaguuuauggcaa

SEQ ID NO: 763285 - RNA, 16 nt, Homo sapiens
ugaggaaggaacagca

SEQ ID NO: 763286 - RNA, 13 nt, Homo sapiens
ugaggaauccaaa

SEQ ID NO: 763287 - RNA, 12 nt, Homo sapiens
ugaggacacgug

SEQ ID NO: 763288 - RNA, 18 nt, Homo sapiens
ugaggacagaccacagag

SEQ ID NO: 763289 - RNA, 15 nt, Homo sapiens
ugaggagacagaaua

SEQ ID NO: 763290 - RNA, 18 nt, Homo sapiens
ugaggagcccugaggacc

SEQ ID NO: 763291 - RNA, 20 nt, Homo sapiens
ugaggagcuguuacugaaua

SEQ ID NO: 763292 - RNA, 15 nt, Homo sapiens
ugaggaggaggacac

SEQ ID NO: 763293 - RNA, 15 nt, Homo sapiens
ugaggauaaugggaa

SEQ ID NO: 763294 - RNA, 15 nt, Homo sapiens
ugaggaugagcugga

SEQ ID NO: 763295 - RNA, 14 nt, Homo sapiens
ugaggauugcugau

SEQ ID NO: 763296 - RNA, 22 nt, Homo sapiens
ugaggcagacagcagcucaggc

SEQ ID NO: 763297 - RNA, 18 nt, Homo sapiens
ugaggcagauagcacugg

SEQ ID NO: 763298 - RNA, 20 nt, Homo sapiens
ugaggcagauagcacugggu

SEQ ID NO: 763299 - RNA, 16 nt, Homo sapiens
ugaggcauuuccagac

SEQ ID NO: 763300 - RNA, 21 nt, Homo sapiens
ugaggccacccagaggcagca

SEQ ID NO: 763301 - RNA, 16 nt, Homo sapiens
ugaggccaucucagga

SEQ ID NO: 763302 - RNA, 11 nt, Homo sapiens
ugaggcccaag

SEQ ID NO: 763303 - RNA, 20 nt, Homo sapiens
ugaggcccugcccaaugaga

SEQ ID NO: 763304 - RNA, 13 nt, Homo sapiens
ugaggccucucau

SEQ ID NO: 763305 - RNA, 18 nt, Homo sapiens
ugaggccuggacuuuccu

SEQ ID NO: 763306 - RNA, 17 nt, Homo sapiens
ugaggccuuguguguca

SEQ ID NO: 763307 - RNA, 18 nt, Homo sapiens
ugaggcggcccugaccaa

SEQ ID NO: 763308 - RNA, 21 nt, Homo sapiens
ugaggcggguggaucacuuga

SEQ ID NO: 763309 - RNA, 22 nt, Homo sapiens
ugaggcugcgagagaaagggag

SEQ ID NO: 763310 - RNA, 23 nt, Homo sapiens
ugaggcugucgugagcuaugauu

SEQ ID NO: 763311 - RNA, 16 nt, Homo sapiens
ugaggcugugcaccua

SEQ ID NO: 763312 - RNA, 23 nt, Homo sapiens
ugaggcugugcaccuauucugua

SEQ ID NO: 763313 - RNA, 15 nt, Homo sapiens
ugagggaaaaugagu

SEQ ID NO: 763314 - RNA, 23 nt, Homo sapiens
ugagggaauccauugaacuggaa

SEQ ID NO: 763315 - RNA, 16 nt, Homo sapiens
ugagggaucacugcca

SEQ ID NO: 763316 - RNA, 15 nt, Homo sapiens
ugaggggcucucuca

SEQ ID NO: 763317 - RNA, 15 nt, Homo sapiens
uauauacauacugca

SEQ ID NO: 763318 - RNA, 13 nt, Homo sapiens
uauauacauagca

SEQ ID NO: 763319 - RNA, 15 nt, Homo sapiens
uauauacauggaauc

SEQ ID NO: 763320 - RNA, 21 nt, Homo sapiens
uauauacccccccaugcaguc

SEQ ID NO: 763321 - RNA, 13 nt, Homo sapiens
uauauacuuugaa

SEQ ID NO: 763322 - RNA, 23 nt, Homo sapiens
uauauagaaugaucuauugcuca

SEQ ID NO: 763323 - RNA, 18 nt, Homo sapiens
uauauaggauauugcuaa

SEQ ID NO: 763324 - RNA, 12 nt, Homo sapiens
uauauauacaua

SEQ ID NO: 763325 - RNA, 14 nt, Homo sapiens
uauauauauuuugg

SEQ ID NO: 763326 - RNA, 17 nt, Homo sapiens
uauauauguguaugcac

SEQ ID NO: 763327 - RNA, 15 nt, Homo sapiens
uauaucccauugaaa

SEQ ID NO: 763328 - RNA, 14 nt, Homo sapiens
uauaucuaugucua

SEQ ID NO: 763329 - RNA, 17 nt, Homo sapiens
uauaucuuguagcuuua

SEQ ID NO: 763330 - RNA, 19 nt, Homo sapiens
uauaugaugaaauucuuau

SEQ ID NO: 763331 - RNA, 15 nt, Homo sapiens
uauaugcuaugcugu

SEQ ID NO: 763332 - RNA, 15 nt, Homo sapiens
uauauuacucucauu

SEQ ID NO: 763333 - RNA, 21 nt, Homo sapiens
uacaaggguaaaauguuacca

SEQ ID NO: 763334 - RNA, 16 nt, Homo sapiens
uacaagucagcuccag

SEQ ID NO: 763335 - RNA, 19 nt, Homo sapiens
uacaagucagcuccagcuu

SEQ ID NO: 763336 - RNA, 18 nt, Homo sapiens
uacaaguuccaacaugca

SEQ ID NO: 763337 - RNA, 15 nt, Homo sapiens
uacaauacaauguac

SEQ ID NO: 763338 - RNA, 20 nt, Homo sapiens
uacaauaggugcuuauucuc

SEQ ID NO: 763339 - RNA, 16 nt, Homo sapiens
uacaauauguacauuu

SEQ ID NO: 763340 - RNA, 13 nt, Homo sapiens
guguucuaagcaa

SEQ ID NO: 763341 - RNA, 20 nt, Homo sapiens
guguucuaagcaaugcaaau

SEQ ID NO: 763342 - RNA, 14 nt, Homo sapiens
guguugaccacaga

SEQ ID NO: 763343 - RNA, 14 nt, Homo sapiens
guguugcaugcagc

SEQ ID NO: 763344 - RNA, 22 nt, Homo sapiens
guguuguguuccuggcugauga

SEQ ID NO: 763345 - RNA, 16 nt, Homo sapiens
guguuuaaaacaugca

SEQ ID NO: 763346 - RNA, 14 nt, Homo sapiens
guguuuauugcaau

SEQ ID NO: 763347 - RNA, 23 nt, Homo sapiens
guguuugcagcugugagaaguca

SEQ ID NO: 763348 - RNA, 21 nt, Homo sapiens
guguuugcauugucuaaugac

SEQ ID NO: 763349 - RNA, 18 nt, Homo sapiens
guguuuguagucuugucu

SEQ ID NO: 763350 - RNA, 22 nt, Homo sapiens
guguuugugauuguuugcucug

SEQ ID NO: 763351 - RNA, 22 nt, Homo sapiens
guguuuuaaacucuccuaguca

SEQ ID NO: 763352 - RNA, 18 nt, Homo sapiens
guguuuuucacauuugcg

SEQ ID NO: 763353 - RNA, 19 nt, Homo sapiens
guuaaaauguuuacuguaa

SEQ ID NO: 763354 - RNA, 18 nt, Homo sapiens
guuaaacagcagcacuuu

SEQ ID NO: 763355 - RNA, 24 nt, Homo sapiens
guuaaagggcauuuuacuaaggca

SEQ ID NO: 763356 - RNA, 14 nt, Homo sapiens
guuaaagugaauaa

SEQ ID NO: 763357 - RNA, 14 nt, Homo sapiens
guuaaauauuguca

SEQ ID NO: 763358 - RNA, 18 nt, Homo sapiens
guuaaauauuuugcuaac

SEQ ID NO: 763359 - RNA, 19 nt, Homo sapiens
guuaaccucagugucauuu

SEQ ID NO: 763360 - RNA, 15 nt, Homo sapiens
guuaagaaagcacuu

SEQ ID NO: 763361 - RNA, 11 nt, Homo sapiens
guuaagacuga

SEQ ID NO: 763362 - RNA, 13 nt, Homo sapiens
guuaagagcucac

SEQ ID NO: 763363 - RNA, 16 nt, Homo sapiens
guuaagagcucacccc

SEQ ID NO: 763364 - RNA, 23 nt, Homo sapiens
guuaagcaaaaugcuucugcaca

SEQ ID NO: 763365 - RNA, 21 nt, Homo sapiens
guuaaguccuuggcuugccau

SEQ ID NO: 763366 - RNA, 17 nt, Homo sapiens
guuaaucauguauuaaa

SEQ ID NO: 763367 - RNA, 18 nt, Homo sapiens
guuaaugucauugcuaaa

SEQ ID NO: 763368 - RNA, 19 nt, Homo sapiens
guuaauuuuauugcaaagu

SEQ ID NO: 763369 - RNA, 20 nt, Homo sapiens
guuacaagaaacagccacug

SEQ ID NO: 763370 - RNA, 12 nt, Homo sapiens
guuacagauuaa

SEQ ID NO: 763371 - RNA, 16 nt, Homo sapiens
guuacaguuugcacaa

SEQ ID NO: 763372 - RNA, 22 nt, Homo sapiens
guuacauaagauaaaugugcug

SEQ ID NO: 763373 - RNA, 17 nt, Homo sapiens
guuaccagagauuuacc

SEQ ID NO: 763374 - RNA, 16 nt, Homo sapiens
guuaccucugcaugga

SEQ ID NO: 763375 - RNA, 13 nt, Homo sapiens
guuacucaugacu

SEQ ID NO: 763376 - RNA, 18 nt, Homo sapiens
guuacugaucuuacucac

SEQ ID NO: 763377 - RNA, 16 nt, Homo sapiens
guuacugggcccugag

SEQ ID NO: 763378 - RNA, 20 nt, Homo sapiens
guuacuguggccaguauuuu

SEQ ID NO: 763379 - RNA, 21 nt, Homo sapiens
guuacuuuugacccaugugca

SEQ ID NO: 763380 - RNA, 22 nt, Homo sapiens
guuagaagcaaugaauguauau

SEQ ID NO: 763381 - RNA, 13 nt, Homo sapiens
guuagaccacuuu

SEQ ID NO: 763382 - RNA, 13 nt, Homo sapiens
guuagagauuuua

SEQ ID NO: 763383 - RNA, 14 nt, Homo sapiens
guuagcaguucugg

SEQ ID NO: 763384 - RNA, 19 nt, Homo sapiens
guuagcauauggugcuuaa

SEQ ID NO: 763385 - RNA, 17 nt, Homo sapiens
guuaggaaaauuucaca

SEQ ID NO: 763386 - RNA, 23 nt, Homo sapiens
guuaggaaaauuucacauuaaua

SEQ ID NO: 763387 - RNA, 13 nt, Homo sapiens
guuaggcauuaau

SEQ ID NO: 763388 - RNA, 20 nt, Homo sapiens
guuaggggaauggagggaau

SEQ ID NO: 763389 - RNA, 19 nt, Homo sapiens
guuaguggauuacugccau

SEQ ID NO: 763390 - RNA, 21 nt, Homo sapiens
guuaguuaccaagccugccau

SEQ ID NO: 763391 - RNA, 20 nt, Homo sapiens
guuauaaaucaaugucacuu

SEQ ID NO: 763392 - RNA, 19 nt, Homo sapiens
guuauaacucugcacuacu

SEQ ID NO: 763393 - RNA, 14 nt, Homo sapiens
guuauagacugcca

SEQ ID NO: 763394 - RNA, 14 nt, Homo sapiens
guuauagcuucagg

SEQ ID NO: 763395 - RNA, 19 nt, Homo sapiens
guuauagguaaaaucucug

SEQ ID NO: 763396 - RNA, 17 nt, Homo sapiens
guuauaucauauguaua

SEQ ID NO: 763397 - RNA, 13 nt, Homo sapiens
guuaucugugguu

SEQ ID NO: 763398 - RNA, 22 nt, Homo sapiens
guuaugccguauaggaugucag

SEQ ID NO: 763399 - RNA, 13 nt, Homo sapiens
guuaugugaauga

SEQ ID NO: 763400 - RNA, 19 nt, Homo sapiens
guuauuacagggcauucaa

SEQ ID NO: 763401 - RNA, 22 nt, Homo sapiens
guuauuaguccaaaugugauca

SEQ ID NO: 763402 - RNA, 15 nt, Homo sapiens
guuauucuuguuaua

SEQ ID NO: 763403 - RNA, 16 nt, Homo sapiens
guuauugaaucuuaau

SEQ ID NO: 763404 - RNA, 18 nt, Homo sapiens
guuauugauaaguucaua

SEQ ID NO: 763405 - RNA, 18 nt, Homo sapiens
guuauuuaaugagucagu

SEQ ID NO: 763406 - RNA, 15 nt, Homo sapiens
guuauuuacacuggu

SEQ ID NO: 763407 - RNA, 21 nt, Homo sapiens
guuauuuaucaauuuuuccca

SEQ ID NO: 763408 - RNA, 15 nt, Homo sapiens
guuauuuaugcacug

SEQ ID NO: 763409 - RNA, 15 nt, Homo sapiens
guuauuuuaauuauc

SEQ ID NO: 763410 - RNA, 21 nt, Homo sapiens
guucaaaagaacaucaacgug

SEQ ID NO: 763411 - RNA, 15 nt, Homo sapiens
guucaaagaugcauu

SEQ ID NO: 763412 - RNA, 22 nt, Homo sapiens
guucaaauucaaaccauuuuua

SEQ ID NO: 763413 - RNA, 16 nt, Homo sapiens
guucaaauucuucuga

SEQ ID NO: 763414 - RNA, 18 nt, Homo sapiens
guucaagacuuagcuccu

SEQ ID NO: 763415 - RNA, 20 nt, Homo sapiens
guucaauaaagcacugagca

SEQ ID NO: 763416 - RNA, 18 nt, Homo sapiens
guucaaugcuagaacaac

SEQ ID NO: 763417 - RNA, 21 nt, Homo sapiens
guucaccuccaagcauuucau

SEQ ID NO: 763418 - RNA, 22 nt, Homo sapiens
guucaccuucaaaauguucuau

SEQ ID NO: 763419 - RNA, 16 nt, Homo sapiens
guucacucccaaccug

SEQ ID NO: 763420 - RNA, 17 nt, Homo sapiens
guucacucuacuuagca

SEQ ID NO: 763421 - RNA, 17 nt, Homo sapiens
guucacuucagcuuaau

SEQ ID NO: 763422 - RNA, 16 nt, Homo sapiens
guucagacagguccaa

SEQ ID NO: 763423 - RNA, 17 nt, Homo sapiens
guucagaggugcagcug

SEQ ID NO: 763424 - RNA, 14 nt, Homo sapiens
guucagaugugcau

SEQ ID NO: 763425 - RNA, 15 nt, Homo sapiens
guucagccugacccc

SEQ ID NO: 763426 - RNA, 13 nt, Homo sapiens
guucagugaccug

SEQ ID NO: 763427 - RNA, 13 nt, Homo sapiens
guucagugccuuc

SEQ ID NO: 763428 - RNA, 19 nt, Homo sapiens
guucauauuggacugauaa

SEQ ID NO: 763429 - RNA, 19 nt, Homo sapiens
guucauauuuauacuuugc

SEQ ID NO: 763430 - RNA, 21 nt, Homo sapiens
guucauauuuauacuuugcaa

SEQ ID NO: 763431 - RNA, 21 nt, Homo sapiens
guucaucagacuccugugcaa

SEQ ID NO: 763432 - RNA, 23 nt, Homo sapiens
guucaucauccuaagcuauucag

SEQ ID NO: 763433 - RNA, 18 nt, Homo sapiens
guucauccgcacuguaaa

SEQ ID NO: 763434 - RNA, 19 nt, Homo sapiens
guucauuacuuuuucauau

SEQ ID NO: 763435 - RNA, 16 nt, Homo sapiens
guucauuauguaugaa

SEQ ID NO: 763436 - RNA, 16 nt, Homo sapiens
guucauugcacuuuga

SEQ ID NO: 763437 - RNA, 21 nt, Homo sapiens
guuccaaacccuccugggaag

SEQ ID NO: 763438 - RNA, 20 nt, Homo sapiens
guuccaaccuccugcucugg

SEQ ID NO: 763439 - RNA, 17 nt, Homo sapiens
guuccaaguauuuugcc

SEQ ID NO: 763440 - RNA, 19 nt, Homo sapiens
guuccacuuguuugcacug

SEQ ID NO: 763441 - RNA, 22 nt, Homo sapiens
guuccaggaauuuugugugauu

SEQ ID NO: 763442 - RNA, 13 nt, Homo sapiens
guuccaggccuga

SEQ ID NO: 763443 - RNA, 14 nt, Homo sapiens
guuccaguaccgcc

SEQ ID NO: 763444 - RNA, 21 nt, Homo sapiens
guuccaguaccgcccucgggg

SEQ ID NO: 763445 - RNA, 24 nt, Homo sapiens
guuccauaugugggugucagucag

SEQ ID NO: 763446 - RNA, 21 nt, Homo sapiens
guuccauccaccaccuugcca

SEQ ID NO: 763447 - RNA, 22 nt, Homo sapiens
guuccauuuuuccucuguucac

SEQ ID NO: 763448 - RNA, 23 nt, Homo sapiens
guuccauuuuuccucuguucaca

SEQ ID NO: 763449 - RNA, 14 nt, Homo sapiens
guucccaccauucc

SEQ ID NO: 763450 - RNA, 15 nt, Homo sapiens
guucccaccauuccc

SEQ ID NO: 763451 - RNA, 20 nt, Homo sapiens
guuccccacugacagccucc

SEQ ID NO: 763452 - RNA, 13 nt, Homo sapiens
guuccccagagaa

SEQ ID NO: 763453 - RNA, 23 nt, Homo sapiens
uaaauucuauaggaacauaugaa

SEQ ID NO: 763454 - RNA, 13 nt, Homo sapiens
uaaauugaacuaa

SEQ ID NO: 763455 - RNA, 12 nt, Homo sapiens
uaaauugcauca

SEQ ID NO: 763456 - RNA, 23 nt, Homo sapiens
uaaauugcuuuuguugugacuuu

SEQ ID NO: 763457 - RNA, 21 nt, Homo sapiens
uaaauugggcuucaaucacug

SEQ ID NO: 763458 - RNA, 18 nt, Homo sapiens
guaucucuucagucucua

SEQ ID NO: 763459 - RNA, 19 nt, Homo sapiens
guaucucuucagucucuau

SEQ ID NO: 763460 - RNA, 20 nt, Homo sapiens
guaucucuucagucucuaua

SEQ ID NO: 763461 - RNA, 20 nt, Homo sapiens
guaucucuuuugaauccaug

SEQ ID NO: 763462 - RNA, 22 nt, Homo sapiens
guaucugcucauuuugacaaag

SEQ ID NO: 763463 - RNA, 19 nt, Homo sapiens
guaucuuuugaacuggcaa

SEQ ID NO: 763464 - RNA, 23 nt, Homo sapiens
guaucuuuugaacuggcaauugu

SEQ ID NO: 763465 - RNA, 16 nt, Homo sapiens
guaugaaaaucagcau

SEQ ID NO: 763466 - RNA, 14 nt, Homo sapiens
guaugaaugcagug

SEQ ID NO: 763467 - RNA, 15 nt, Homo sapiens
guaugacugcacaug

SEQ ID NO: 763468 - RNA, 19 nt, Homo sapiens
guaugaguggcuucuggga

SEQ ID NO: 763469 - RNA, 16 nt, Homo sapiens
guaugaucaguacuga

SEQ ID NO: 763470 - RNA, 13 nt, Homo sapiens
guaugcacagggu

SEQ ID NO: 763471 - RNA, 22 nt, Homo sapiens
guaugcacaguaaaaauggaaa

SEQ ID NO: 763472 - RNA, 18 nt, Homo sapiens
guaugcauucacauuuag

SEQ ID NO: 763473 - RNA, 17 nt, Homo sapiens
guaugcuucuuuauaca

SEQ ID NO: 763474 - RNA, 19 nt, Homo sapiens
guauguaaguaauugcauu

SEQ ID NO: 763475 - RNA, 17 nt, Homo sapiens
guauguaauuuaugcaa

SEQ ID NO: 763476 - RNA, 18 nt, Homo sapiens
guauguacaauacaaugu

SEQ ID NO: 763477 - RNA, 15 nt, Homo sapiens
guauguauauauaca

SEQ ID NO: 763478 - RNA, 20 nt, Homo sapiens
guauguauuauuuacauuua

SEQ ID NO: 763479 - RNA, 20 nt, Homo sapiens
guauguccagcaaacucuug

SEQ ID NO: 763480 - RNA, 15 nt, Homo sapiens
guauguuauugcaua

SEQ ID NO: 763481 - RNA, 21 nt, Homo sapiens
guauguucccucuugucccuu

SEQ ID NO: 763482 - RNA, 12 nt, Homo sapiens
guauuaaacuug

SEQ ID NO: 763483 - RNA, 20 nt, Homo sapiens
guauuaacuuuauacacuug

SEQ ID NO: 763484 - RNA, 18 nt, Homo sapiens
guauuaauaaagcauucu

SEQ ID NO: 763485 - RNA, 22 nt, Homo sapiens
guauuaauaaagcauucuuuaa

SEQ ID NO: 763486 - RNA, 20 nt, Homo sapiens
guauuaauaguucaguguau

SEQ ID NO: 763487 - RNA, 24 nt, Homo sapiens
guauuacccuccuaauagucauac

SEQ ID NO: 763488 - RNA, 17 nt, Homo sapiens
guauuaucaaagggaua

SEQ ID NO: 763489 - RNA, 22 nt, Homo sapiens
guauuauuacggagacuuucaa

SEQ ID NO: 763490 - RNA, 21 nt, Homo sapiens
guauuauucuguuuugcacag

SEQ ID NO: 763491 - RNA, 22 nt, Homo sapiens
guauuauuuuacaaucaacaaa

SEQ ID NO: 763492 - RNA, 20 nt, Homo sapiens
guauucauuuuuucuacccu

SEQ ID NO: 763493 - RNA, 20 nt, Homo sapiens
guauuccaugagcugcucau

SEQ ID NO: 763494 - RNA, 21 nt, Homo sapiens
guauucuaaauuuuauaucuu

SEQ ID NO: 763495 - RNA, 20 nt, Homo sapiens
guauucuacagcagauacuu

SEQ ID NO: 763496 - RNA, 21 nt, Homo sapiens
guauucuagugaaugaaucuc

SEQ ID NO: 763497 - RNA, 18 nt, Homo sapiens
guauucucuucacagugc

SEQ ID NO: 763498 - RNA, 16 nt, Homo sapiens
guauucuuuaccucag

SEQ ID NO: 763499 - RNA, 21 nt, Homo sapiens
guauucuuuuccaagcuccuu

SEQ ID NO: 763500 - RNA, 14 nt, Homo sapiens
guauugacaacagu

SEQ ID NO: 763501 - RNA, 14 nt, Homo sapiens
guauugaucaaugc

SEQ ID NO: 763502 - RNA, 19 nt, Homo sapiens
guauugaucaaugcauguu

SEQ ID NO: 763503 - RNA, 21 nt, Homo sapiens
guauuuauuuuacagcucauu

SEQ ID NO: 763504 - RNA, 15 nt, Homo sapiens
guauuucacagagca

SEQ ID NO: 763505 - RNA, 21 nt, Homo sapiens
guauuucacagagcacgccug

SEQ ID NO: 763506 - RNA, 19 nt, Homo sapiens
guauuugagagacugccau

SEQ ID NO: 763507 - RNA, 12 nt, Homo sapiens
guauuuuagacu

SEQ ID NO: 763508 - RNA, 23 nt, Homo sapiens
guauuuucuuacacugugucauu

SEQ ID NO: 763509 - RNA, 12 nt, Homo sapiens
guauuuugccac

SEQ ID NO: 763510 - RNA, 19 nt, Homo sapiens
guauuuuguagaugugauu

SEQ ID NO: 763511 - RNA, 16 nt, Homo sapiens
guauuuuuaaaggcau

SEQ ID NO: 763512 - RNA, 12 nt, Homo sapiens
guauuuuuggca

SEQ ID NO: 763513 - RNA, 16 nt, Homo sapiens
gucaaaacuacugaca

SEQ ID NO: 763514 - RNA, 13 nt, Homo sapiens
gucaaagaagcuu

SEQ ID NO: 763515 - RNA, 12 nt, Homo sapiens
gucaaagcagua

SEQ ID NO: 763516 - RNA, 17 nt, Homo sapiens
gucaaagugaugaauau

SEQ ID NO: 763517 - RNA, 18 nt, Homo sapiens
gucaaagugguacaggaa

SEQ ID NO: 763518 - RNA, 16 nt, Homo sapiens
gucaaccuuguuucua

SEQ ID NO: 763519 - RNA, 19 nt, Homo sapiens
gucaacuucaacauuuaca

SEQ ID NO: 763520 - RNA, 20 nt, Homo sapiens
gucaagaagaggaaagggag

SEQ ID NO: 763521 - RNA, 17 nt, Homo sapiens
gucaagcugaaaacaaa

SEQ ID NO: 763522 - RNA, 21 nt, Homo sapiens
gucaaggcuucagugagccau

SEQ ID NO: 763523 - RNA, 18 nt, Homo sapiens
gucaauaaacaacagcug

SEQ ID NO: 763524 - RNA, 15 nt, Homo sapiens
gucaauccugucaua

SEQ ID NO: 763525 - RNA, 18 nt, Homo sapiens
gucaauccugucauauaa

SEQ ID NO: 763526 - RNA, 20 nt, Homo sapiens
gucaauguugguuacuaaau

SEQ ID NO: 763527 - RNA, 22 nt, Homo sapiens
gucaauuggaaagacuauccaa

SEQ ID NO: 763528 - RNA, 17 nt, Homo sapiens
gucacacucuucaguga

SEQ ID NO: 763529 - RNA, 15 nt, Homo sapiens
gucacagaagcagcu

SEQ ID NO: 763530 - RNA, 17 nt, Homo sapiens
gucacagaagcagcuaa

SEQ ID NO: 763531 - RNA, 18 nt, Homo sapiens
gucacagaagcagcuaaa

SEQ ID NO: 763532 - RNA, 18 nt, Homo sapiens
gucacaucagcaauuuca

SEQ ID NO: 763533 - RNA, 17 nt, Homo sapiens
gucacauggccuaugca

SEQ ID NO: 763534 - RNA, 19 nt, Homo sapiens
gucaccagcaacaucucga

SEQ ID NO: 763535 - RNA, 15 nt, Homo sapiens
gucaccauugcacaa

SEQ ID NO: 763536 - RNA, 16 nt, Homo sapiens
gucacccaaacacuuc

SEQ ID NO: 763537 - RNA, 17 nt, Homo sapiens
gucaccuacgugccacu

SEQ ID NO: 763538 - RNA, 16 nt, Homo sapiens
gucaccugcuccagaa

SEQ ID NO: 763539 - RNA, 18 nt, Homo sapiens
gucacuagaaguccugcu

SEQ ID NO: 763540 - RNA, 15 nt, Homo sapiens
gucacuccucucuag

SEQ ID NO: 763541 - RNA, 11 nt, Homo sapiens
gucacuccugg

SEQ ID NO: 763542 - RNA, 22 nt, Homo sapiens
gucacugaacaccuauugcacu

SEQ ID NO: 763543 - RNA, 16 nt, Homo sapiens
gucacugacaguuaau

SEQ ID NO: 763544 - RNA, 16 nt, Homo sapiens
gucacuucuccaucac

SEQ ID NO: 763545 - RNA, 17 nt, Homo sapiens
gucacuuuuauuugaaa

SEQ ID NO: 763546 - RNA, 19 nt, Homo sapiens
gucagaaagagauuuucac

SEQ ID NO: 763547 - RNA, 14 nt, Homo sapiens
gucagaaguucaag

SEQ ID NO: 763548 - RNA, 22 nt, Homo sapiens
gucagaaugugaaaaaggaaua

SEQ ID NO: 763549 - RNA, 17 nt, Homo sapiens
gucagauacaauguauu

SEQ ID NO: 763550 - RNA, 15 nt, Homo sapiens
gucagauacccuguu

SEQ ID NO: 763551 - RNA, 14 nt, Homo sapiens
gucagaugucacau

SEQ ID NO: 763552 - RNA, 19 nt, Homo sapiens
gucagcaucugaccaucug

SEQ ID NO: 763553 - RNA, 14 nt, Homo sapiens
gucagcccaugugc

SEQ ID NO: 763554 - RNA, 14 nt, Homo sapiens
gucagcugcucccu

SEQ ID NO: 763555 - RNA, 14 nt, Homo sapiens
gucaggagagugca

SEQ ID NO: 763556 - RNA, 23 nt, Homo sapiens
gucaggcccucugccugcacucc

SEQ ID NO: 763557 - RNA, 16 nt, Homo sapiens
gucagggagaggucac

SEQ ID NO: 763558 - RNA, 16 nt, Homo sapiens
gucagguaguugcaau

SEQ ID NO: 763559 - RNA, 12 nt, Homo sapiens
gucagucaggga

SEQ ID NO: 763560 - RNA, 14 nt, Homo sapiens
gucagucagggaca

SEQ ID NO: 763561 - RNA, 15 nt, Homo sapiens
gucaguuagcaucau

SEQ ID NO: 763562 - RNA, 17 nt, Homo sapiens
gucauaaauuacuguuu

SEQ ID NO: 763563 - RNA, 14 nt, Homo sapiens
gucauagcauucac

SEQ ID NO: 763564 - RNA, 15 nt, Homo sapiens
gucauagcauucacu

SEQ ID NO: 763565 - RNA, 14 nt, Homo sapiens
gucauaugacugau

SEQ ID NO: 763566 - RNA, 18 nt, Homo sapiens
guaauauuuuacuuugag

SEQ ID NO: 763567 - RNA, 15 nt, Homo sapiens
guaaucaucuaaguc

SEQ ID NO: 763568 - RNA, 15 nt, Homo sapiens
guaaucccagcacuu

SEQ ID NO: 763569 - RNA, 18 nt, Homo sapiens
guaaucccauuucccaaa

SEQ ID NO: 763570 - RNA, 18 nt, Homo sapiens
guaauccguucauagaaa

SEQ ID NO: 763571 - RNA, 14 nt, Homo sapiens
guaaucuacaccaa

SEQ ID NO: 763572 - RNA, 23 nt, Homo sapiens
guaaucucggaaggcugaggcag

SEQ ID NO: 763573 - RNA, 11 nt, Homo sapiens
guaaugcugca

SEQ ID NO: 763574 - RNA, 13 nt, Homo sapiens
guaauuccagcua

SEQ ID NO: 763575 - RNA, 19 nt, Homo sapiens
guaauuccuguuacuuuac

SEQ ID NO: 763576 - RNA, 20 nt, Homo sapiens
guaauuuaaaaagugcuaua

SEQ ID NO: 763577 - RNA, 19 nt, Homo sapiens
guaauuuaagugacacaga

SEQ ID NO: 763578 - RNA, 19 nt, Homo sapiens
guaauuuuuuuuccuugcc

SEQ ID NO: 763579 - RNA, 18 nt, Homo sapiens
guacaagagaugggaugc

SEQ ID NO: 763580 - RNA, 14 nt, Homo sapiens
guacagaaugcuau

SEQ ID NO: 763581 - RNA, 22 nt, Homo sapiens
guacagaauucugcuaccucac

SEQ ID NO: 763582 - RNA, 12 nt, Homo sapiens
guacagacacuc

SEQ ID NO: 763583 - RNA, 13 nt, Homo sapiens
guacagguauauu

SEQ ID NO: 763584 - RNA, 18 nt, Homo sapiens
guacaguagauuuuccaa

SEQ ID NO: 763585 - RNA, 20 nt, Homo sapiens
guacaguauguuuuacaugu

SEQ ID NO: 763586 - RNA, 16 nt, Homo sapiens
guacauaguaaaguau

SEQ ID NO: 763587 - RNA, 22 nt, Homo sapiens
guacauuuggcauuuguguuau

SEQ ID NO: 763588 - RNA, 21 nt, Homo sapiens
guacauuuuuuaacuuucuag

SEQ ID NO: 763589 - RNA, 15 nt, Homo sapiens
guaccaagugaaauu

SEQ ID NO: 763590 - RNA, 13 nt, Homo sapiens
guaccacacauau

SEQ ID NO: 763591 - RNA, 20 nt, Homo sapiens
guaccauauucagcauuuga

SEQ ID NO: 763592 - RNA, 21 nt, Homo sapiens
guaccauauucagcauuugau

SEQ ID NO: 763593 - RNA, 19 nt, Homo sapiens
guacccagggccagcccac

SEQ ID NO: 763594 - RNA, 15 nt, Homo sapiens
guaccccacugggcc

SEQ ID NO: 763595 - RNA, 16 nt, Homo sapiens
guaccgauuucugcua

SEQ ID NO: 763596 - RNA, 14 nt, Homo sapiens
guaccgucuucucc

SEQ ID NO: 763597 - RNA, 18 nt, Homo sapiens
guaccuauuugucaugua

SEQ ID NO: 763598 - RNA, 19 nt, Homo sapiens
guaccuauuugucauguau

SEQ ID NO: 763599 - RNA, 16 nt, Homo sapiens
guacgaagaguauuuu

SEQ ID NO: 763600 - RNA, 20 nt, Homo sapiens
guacgcugcugcaggacauu

SEQ ID NO: 763601 - RNA, 13 nt, Homo sapiens
guacggauuuguc

SEQ ID NO: 763602 - RNA, 18 nt, Homo sapiens
guacguaacuauuuccaa

SEQ ID NO: 763603 - RNA, 15 nt, Homo sapiens
guacguuuugcacau

SEQ ID NO: 763604 - RNA, 24 nt, Homo sapiens
guacuaagcaguaagcuaucuuca

SEQ ID NO: 763605 - RNA, 21 nt, Homo sapiens
guacuccagcccggcacucca

SEQ ID NO: 763606 - RNA, 22 nt, Homo sapiens
guacugauauaauuuaguucca

SEQ ID NO: 763607 - RNA, 16 nt, Homo sapiens
guacugauggacuuaa

SEQ ID NO: 763608 - RNA, 13 nt, Homo sapiens
guacugcauguga

SEQ ID NO: 763609 - RNA, 17 nt, Homo sapiens
guacuggaaaagcccuu

SEQ ID NO: 763610 - RNA, 21 nt, Homo sapiens
guacuggggugggaucuugga

SEQ ID NO: 763611 - RNA, 15 nt, Homo sapiens
guacuuagcagcuau

SEQ ID NO: 763612 - RNA, 21 nt, Homo sapiens
guacuuagcagcuaucucuca

SEQ ID NO: 763613 - RNA, 23 nt, Homo sapiens
guacuuauguugcacaaugagaa

SEQ ID NO: 763614 - RNA, 17 nt, Homo sapiens
guacuuguuugcuauga

SEQ ID NO: 763615 - RNA, 20 nt, Homo sapiens
guacuuugaguauaacauca

SEQ ID NO: 763616 - RNA, 21 nt, Homo sapiens
guacuuuuaaaaacauaacau

SEQ ID NO: 763617 - RNA, 19 nt, Homo sapiens
guacuuuuaugauguauau

SEQ ID NO: 763618 - RNA, 19 nt, Homo sapiens
guacuuuuuuuaaacugug

SEQ ID NO: 763619 - RNA, 13 nt, Homo sapiens
guagaaaaugagg

SEQ ID NO: 763620 - RNA, 16 nt, Homo sapiens
guagacauuugcuaug

SEQ ID NO: 763621 - RNA, 12 nt, Homo sapiens
guagacuguggc

SEQ ID NO: 763622 - RNA, 20 nt, Homo sapiens
guagagacgguguuuugcca

SEQ ID NO: 763623 - RNA, 22 nt, Homo sapiens
guagagggaguugucaagucuc

SEQ ID NO: 763624 - RNA, 15 nt, Homo sapiens
guagagucaucucca

SEQ ID NO: 763625 - RNA, 13 nt, Homo sapiens
guagaguggugcu

SEQ ID NO: 763626 - RNA, 17 nt, Homo sapiens
guagauaaaaaacauca

SEQ ID NO: 763627 - RNA, 22 nt, Homo sapiens
guagauacucucagcaccaaga

SEQ ID NO: 763628 - RNA, 15 nt, Homo sapiens
guagaugugauuaac

SEQ ID NO: 763629 - RNA, 21 nt, Homo sapiens
guagcacugacagauuuccau

SEQ ID NO: 763630 - RNA, 16 nt, Homo sapiens
guagcacuuacguaaa

SEQ ID NO: 763631 - RNA, 21 nt, Homo sapiens
guagcagagaaaggauugauu

SEQ ID NO: 763632 - RNA, 15 nt, Homo sapiens
guagcauacauuuau

SEQ ID NO: 763633 - RNA, 18 nt, Homo sapiens
guagcauuucuugauguu

SEQ ID NO: 763634 - RNA, 19 nt, Homo sapiens
guagccugggcucacugug

SEQ ID NO: 763635 - RNA, 18 nt, Homo sapiens
guagcuaaccaucacccc

SEQ ID NO: 763636 - RNA, 18 nt, Homo sapiens
guagcuagaugccacugc

SEQ ID NO: 763637 - RNA, 19 nt, Homo sapiens
guagcucuggaccugucuc

SEQ ID NO: 763638 - RNA, 12 nt, Homo sapiens
guagcugggauu

SEQ ID NO: 763639 - RNA, 20 nt, Homo sapiens
guagcugggauuacaggugu

SEQ ID NO: 763640 - RNA, 17 nt, Homo sapiens
guagcuuaccugacaca

SEQ ID NO: 763641 - RNA, 14 nt, Homo sapiens
guaggaacaagcau

SEQ ID NO: 763642 - RNA, 16 nt, Homo sapiens
guaggaugaaucauau

SEQ ID NO: 763643 - RNA, 14 nt, Homo sapiens
guagggaguaccug

SEQ ID NO: 763644 - RNA, 13 nt, Homo sapiens
guagggaugccuu

SEQ ID NO: 763645 - RNA, 15 nt, Homo sapiens
guagguugccagcua

SEQ ID NO: 763646 - RNA, 24 nt, Homo sapiens
guaguaauuuauugucugucuaca

SEQ ID NO: 763647 - RNA, 20 nt, Homo sapiens
guaguauuaaaaguugcauu

SEQ ID NO: 763648 - RNA, 21 nt, Homo sapiens
guagucauuuucaagacugaa

SEQ ID NO: 763649 - RNA, 15 nt, Homo sapiens
guagucgcuuugccu

SEQ ID NO: 763650 - RNA, 13 nt, Homo sapiens
guagucucaggac

SEQ ID NO: 763651 - RNA, 20 nt, Homo sapiens
guagugugugcuuacaguaa

SEQ ID NO: 763652 - RNA, 20 nt, Homo sapiens
guaguuagcaacuagggcua

SEQ ID NO: 763653 - RNA, 16 nt, Homo sapiens
guaguuauucugccuu

SEQ ID NO: 763654 - RNA, 19 nt, Homo sapiens
guaguuggaaacaaaucau

SEQ ID NO: 763655 - RNA, 20 nt, Homo sapiens
guaguuggcaggagcuccug

SEQ ID NO: 763656 - RNA, 11 nt, Homo sapiens
guaguuugugc

SEQ ID NO: 763657 - RNA, 16 nt, Homo sapiens
guaguuuucaaaacac

SEQ ID NO: 763658 - RNA, 14 nt, Homo sapiens
guauaaaaucugaa

SEQ ID NO: 763659 - RNA, 21 nt, Homo sapiens
guauaaaaucugaauuuugca

SEQ ID NO: 763660 - RNA, 19 nt, Homo sapiens
guauaacacaauaugaaua

SEQ ID NO: 763661 - RNA, 23 nt, Homo sapiens
guauaacuggauugcagacuguu

SEQ ID NO: 763662 - RNA, 14 nt, Homo sapiens
guauaagcaucugc

SEQ ID NO: 763663 - RNA, 14 nt, Homo sapiens
guauacaugugcca

SEQ ID NO: 763664 - RNA, 19 nt, Homo sapiens
guauacucuugaguguuua

SEQ ID NO: 763665 - RNA, 21 nt, Homo sapiens
guauacuuuuagcuuguaguu

SEQ ID NO: 763666 - RNA, 15 nt, Homo sapiens
guauagaccaaagca

SEQ ID NO: 763667 - RNA, 12 nt, Homo sapiens
guauauaaucca

SEQ ID NO: 763668 - RNA, 15 nt, Homo sapiens
guauauacaauaaca

SEQ ID NO: 763669 - RNA, 23 nt, Homo sapiens
guauauuuugacgucacugauau

SEQ ID NO: 763670 - RNA, 14 nt, Homo sapiens
guaucaaaaucacu

SEQ ID NO: 763671 - RNA, 12 nt, Homo sapiens
guaucacagugu

SEQ ID NO: 763672 - RNA, 22 nt, Homo sapiens
guaucagaucuaucuugucaau

SEQ ID NO: 763673 - RNA, 17 nt, Homo sapiens
guauccagaacaauaag

SEQ ID NO: 763674 - RNA, 14 nt, Homo sapiens
gguggugucuccaa

SEQ ID NO: 763675 - RNA, 21 nt, Homo sapiens
ggugguuuuauuucaaaggga

SEQ ID NO: 763676 - RNA, 22 nt, Homo sapiens
ggugguuuuauuucaaagggaa

SEQ ID NO: 763677 - RNA, 22 nt, Homo sapiens
gguguacagaccaccuuucaca

SEQ ID NO: 763678 - RNA, 24 nt, Homo sapiens
gguguacuuauauccacacugcac

SEQ ID NO: 763679 - RNA, 13 nt, Homo sapiens
gguguagcacuua

SEQ ID NO: 763680 - RNA, 22 nt, Homo sapiens
gguguagcuguccucucagaac

SEQ ID NO: 763681 - RNA, 13 nt, Homo sapiens
gguguaggggcca

SEQ ID NO: 763682 - RNA, 14 nt, Homo sapiens
gguguauguaugag

SEQ ID NO: 763683 - RNA, 16 nt, Homo sapiens
gguguauguaugagua

SEQ ID NO: 763684 - RNA, 16 nt, Homo sapiens
gguguccaccaucccc

SEQ ID NO: 763685 - RNA, 14 nt, Homo sapiens
gguguccauuuuau

SEQ ID NO: 763686 - RNA, 19 nt, Homo sapiens
ggugugagccaccacaucc

SEQ ID NO: 763687 - RNA, 22 nt, Homo sapiens
gguguguauacuuguauaacuu

SEQ ID NO: 763688 - RNA, 20 nt, Homo sapiens
ggugugugccacucagagac

SEQ ID NO: 763689 - RNA, 17 nt, Homo sapiens
gguguuaauuuugcuaa

SEQ ID NO: 763690 - RNA, 18 nt, Homo sapiens
gguguucuguuucaaugu

SEQ ID NO: 763691 - RNA, 16 nt, Homo sapiens
gguguucuucuuccca

SEQ ID NO: 763692 - RNA, 17 nt, Homo sapiens
gguguuguaugccuuua

SEQ ID NO: 763693 - RNA, 13 nt, Homo sapiens
gguguuuugccau

SEQ ID NO: 763694 - RNA, 19 nt, Homo sapiens
gguuaaaaaaaaaagucac

SEQ ID NO: 763695 - RNA, 20 nt, Homo sapiens
gguuaaacccacagccaaac

SEQ ID NO: 763696 - RNA, 23 nt, Homo sapiens
gguuaaggccagggccucuccaa

SEQ ID NO: 763697 - RNA, 15 nt, Homo sapiens
gguuaaggccugaau

SEQ ID NO: 763698 - RNA, 19 nt, Homo sapiens
gguuaccuuuguucccaaa

SEQ ID NO: 763699 - RNA, 15 nt, Homo sapiens
gguuauagacugcca

SEQ ID NO: 763700 - RNA, 20 nt, Homo sapiens
gguucaagcuauucucaugc

SEQ ID NO: 763701 - RNA, 13 nt, Homo sapiens
gguucaagugauu

SEQ ID NO: 763702 - RNA, 21 nt, Homo sapiens
gguucaauuucagaaguaaug

SEQ ID NO: 763703 - RNA, 14 nt, Homo sapiens
gguucacuugccau

SEQ ID NO: 763704 - RNA, 20 nt, Homo sapiens
gguucagacaccuguucaca

SEQ ID NO: 763705 - RNA, 14 nt, Homo sapiens
gguuccaacuguau

SEQ ID NO: 763706 - RNA, 22 nt, Homo sapiens
gguuccauuuuuccucuguuca

SEQ ID NO: 763707 - RNA, 15 nt, Homo sapiens
gguucccaccauucc

SEQ ID NO: 763708 - RNA, 15 nt, Homo sapiens
gguucgagacuccau

SEQ ID NO: 763709 - RNA, 23 nt, Homo sapiens
gguucucuuagcaacucagagaa

SEQ ID NO: 763710 - RNA, 22 nt, Homo sapiens
gguugaaaaauggcaaagaauu

SEQ ID NO: 763711 - RNA, 15 nt, Homo sapiens
gguugaaaaccacag

SEQ ID NO: 763712 - RNA, 19 nt, Homo sapiens
gguugaaaaccacagucag

SEQ ID NO: 763713 - RNA, 20 nt, Homo sapiens
gguugaacucugguggcaca

SEQ ID NO: 763714 - RNA, 21 nt, Homo sapiens
gguugaacucugguggcacag

SEQ ID NO: 763715 - RNA, 12 nt, Homo sapiens
gguugaaggcag

SEQ ID NO: 763716 - RNA, 12 nt, Homo sapiens
gguugacauuuu

SEQ ID NO: 763717 - RNA, 21 nt, Homo sapiens
gguugcagugagccaagauca

SEQ ID NO: 763718 - RNA, 18 nt, Homo sapiens
gguugcuuugguggcacg

SEQ ID NO: 763719 - RNA, 14 nt, Homo sapiens
gguuggagugcagu

SEQ ID NO: 763720 - RNA, 16 nt, Homo sapiens
gguuggagugcagugg

SEQ ID NO: 763721 - RNA, 21 nt, Homo sapiens
gguuggauggauggguggaug

SEQ ID NO: 763722 - RNA, 13 nt, Homo sapiens
gguuggcaaaaua

SEQ ID NO: 763723 - RNA, 18 nt, Homo sapiens
gguuggcccucacugcag

SEQ ID NO: 763724 - RNA, 15 nt, Homo sapiens
gguugggcagccaga

SEQ ID NO: 763725 - RNA, 15 nt, Homo sapiens
gguugggcuauagca

SEQ ID NO: 763726 - RNA, 18 nt, Homo sapiens
gguuggugcacagugauu

SEQ ID NO: 763727 - RNA, 19 nt, Homo sapiens
gguugucuuauugcaccau

SEQ ID NO: 763728 - RNA, 16 nt, Homo sapiens
gguugugcacauuucu

SEQ ID NO: 763729 - RNA, 15 nt, Homo sapiens
gguuucaaagugaua

SEQ ID NO: 763730 - RNA, 19 nt, Homo sapiens
gguuucaccguguuagcca

SEQ ID NO: 763731 - RNA, 19 nt, Homo sapiens
gguuucucugugcucugaa

SEQ ID NO: 763732 - RNA, 14 nt, Homo sapiens
gguuucuucaagag

SEQ ID NO: 763733 - RNA, 23 nt, Homo sapiens
gguuugucacacgauaaagggau

SEQ ID NO: 763734 - RNA, 20 nt, Homo sapiens
gguuuguccuggucaugcac

SEQ ID NO: 763735 - RNA, 20 nt, Homo sapiens
gguuuuaaccgcacaugcac

SEQ ID NO: 763736 - RNA, 21 nt, Homo sapiens
gguuuuauaaggcugauguca

SEQ ID NO: 763737 - RNA, 23 nt, Homo sapiens
gguuuuuauguaaaacauuuuua

SEQ ID NO: 763738 - RNA, 22 nt, Homo sapiens
guaaaaaaguaugcuuguuaau

SEQ ID NO: 763739 - RNA, 15 nt, Homo sapiens
guaaaaacuguucuc

SEQ ID NO: 763740 - RNA, 17 nt, Homo sapiens
guaaaaagggggcugca

SEQ ID NO: 763741 - RNA, 12 nt, Homo sapiens
guaaaacaaaga

SEQ ID NO: 763742 - RNA, 14 nt, Homo sapiens
guaaaacaaucugu

SEQ ID NO: 763743 - RNA, 14 nt, Homo sapiens
guaaaacaguuaca

SEQ ID NO: 763744 - RNA, 15 nt, Homo sapiens
guaaaacauaaugua

SEQ ID NO: 763745 - RNA, 12 nt, Homo sapiens
guaaaacaugcu

SEQ ID NO: 763746 - RNA, 14 nt, Homo sapiens
guaaaacauuuuua

SEQ ID NO: 763747 - RNA, 16 nt, Homo sapiens
guaaaacuauauucuc

SEQ ID NO: 763748 - RNA, 18 nt, Homo sapiens
guaaaagaugaaguuuua

SEQ ID NO: 763749 - RNA, 21 nt, Homo sapiens
guaaaaguucuuuuugcucua

SEQ ID NO: 763750 - RNA, 14 nt, Homo sapiens
guaaaauauacuua

SEQ ID NO: 763751 - RNA, 18 nt, Homo sapiens
guaaaauuuaaaucauau

SEQ ID NO: 763752 - RNA, 23 nt, Homo sapiens
guaaacacauguucugugccugc

SEQ ID NO: 763753 - RNA, 21 nt, Homo sapiens
guaaacagauggcacuuugaa

SEQ ID NO: 763754 - RNA, 15 nt, Homo sapiens
guaaacuguaucaaa

SEQ ID NO: 763755 - RNA, 20 nt, Homo sapiens
guaaagccuuaaguggcaga

SEQ ID NO: 763756 - RNA, 17 nt, Homo sapiens
guaaaggggcccagaaa

SEQ ID NO: 763757 - RNA, 17 nt, Homo sapiens
guaaauacaacacaucu

SEQ ID NO: 763758 - RNA, 13 nt, Homo sapiens
guaaauacuguga

SEQ ID NO: 763759 - RNA, 14 nt, Homo sapiens
guaaauaugaaucu

SEQ ID NO: 763760 - RNA, 21 nt, Homo sapiens
guaaauauucuacacauguaa

SEQ ID NO: 763761 - RNA, 19 nt, Homo sapiens
guaacaaauaaagugcagu

SEQ ID NO: 763762 - RNA, 13 nt, Homo sapiens
guaacaacugugg

SEQ ID NO: 763763 - RNA, 14 nt, Homo sapiens
guaacaacuguggu

SEQ ID NO: 763764 - RNA, 20 nt, Homo sapiens
guaacaaggugucuuuucca

SEQ ID NO: 763765 - RNA, 22 nt, Homo sapiens
guaacagauuuuguuggcauag

SEQ ID NO: 763766 - RNA, 20 nt, Homo sapiens
guaacagccaggaguguuaa

SEQ ID NO: 763767 - RNA, 23 nt, Homo sapiens
guaacauacuggccuggacuguu

SEQ ID NO: 763768 - RNA, 14 nt, Homo sapiens
guaacaucaaagau

SEQ ID NO: 763769 - RNA, 18 nt, Homo sapiens
guaacaucauaauuacau

SEQ ID NO: 763770 - RNA, 19 nt, Homo sapiens
guaacgaaugguacuacaa

SEQ ID NO: 763771 - RNA, 19 nt, Homo sapiens
guaacugugccaguucuuu

SEQ ID NO: 763772 - RNA, 22 nt, Homo sapiens
guaacugugccaguucuuucca

SEQ ID NO: 763773 - RNA, 23 nt, Homo sapiens
guaacuugcuuaaauuucuuaug

SEQ ID NO: 763774 - RNA, 12 nt, Homo sapiens
guaagaaaguga

SEQ ID NO: 763775 - RNA, 17 nt, Homo sapiens
guaagaaggcaauauua

SEQ ID NO: 763776 - RNA, 13 nt, Homo sapiens
guaagacaaucca

SEQ ID NO: 763777 - RNA, 14 nt, Homo sapiens
guaagacaggccag

SEQ ID NO: 763778 - RNA, 17 nt, Homo sapiens
guaagacagugcccuga

SEQ ID NO: 763779 - RNA, 18 nt, Homo sapiens
guaagagcuggugucuga

SEQ ID NO: 763780 - RNA, 14 nt, Homo sapiens
guaagaugcacuga

SEQ ID NO: 763781 - RNA, 15 nt, Homo sapiens
guaagaugcacugaa

SEQ ID NO: 763782 - RNA, 20 nt, Homo sapiens
guaagaugcuccugguggcu

SEQ ID NO: 763783 - RNA, 16 nt, Homo sapiens
guaagauuucauucug

SEQ ID NO: 763784 - RNA, 14 nt, Homo sapiens
guaaggacuguaaa

SEQ ID NO: 763785 - RNA, 20 nt, Homo sapiens
guaaggcaggcccauucaga

SEQ ID NO: 763786 - RNA, 17 nt, Homo sapiens
guaaguauaaaugaauu

SEQ ID NO: 763787 - RNA, 20 nt, Homo sapiens
guaaguauuuccauagucaa

SEQ ID NO: 763788 - RNA, 11 nt, Homo sapiens
guaagugcuuu

SEQ ID NO: 763789 - RNA, 18 nt, Homo sapiens
ugaggggcucucucauga

SEQ ID NO: 763790 - RNA, 18 nt, Homo sapiens
ugaggggcugacuucaau

SEQ ID NO: 763791 - RNA, 12 nt, Homo sapiens
ugaggggucccc

SEQ ID NO: 763792 - RNA, 15 nt, Homo sapiens
ugagggguugaggga

SEQ ID NO: 763793 - RNA, 19 nt, Homo sapiens
ugaggguaucugacaaugc

SEQ ID NO: 763794 - RNA, 20 nt, Homo sapiens
ugaggguaucugacaaugcu

SEQ ID NO: 763795 - RNA, 22 nt, Homo sapiens
ugagguacagcagaaaggagaa

SEQ ID NO: 763796 - RNA, 19 nt, Homo sapiens
ugagguauaaagacaagua

SEQ ID NO: 763797 - RNA, 18 nt, Homo sapiens
ugagguuugcuuguuacc

SEQ ID NO: 763798 - RNA, 16 nt, Homo sapiens
ugagguuuugaaagaa

SEQ ID NO: 763799 - RNA, 13 nt, Homo sapiens
ugaguaaaaucua

SEQ ID NO: 763800 - RNA, 18 nt, Homo sapiens
ugaguaauacaucaaaga

SEQ ID NO: 763801 - RNA, 16 nt, Homo sapiens
ugaguaaucauacuca

SEQ ID NO: 763802 - RNA, 19 nt, Homo sapiens
ugaguaaugguguagaaca

SEQ ID NO: 763803 - RNA, 14 nt, Homo sapiens
ugaguacaugcaca

SEQ ID NO: 763804 - RNA, 21 nt, Homo sapiens
ugaguagaugggacuacaggc

SEQ ID NO: 763805 - RNA, 15 nt, Homo sapiens
ugaguagcugggacu

SEQ ID NO: 763806 - RNA, 21 nt, Homo sapiens
ugaguagcugggacuacaggc

SEQ ID NO: 763807 - RNA, 13 nt, Homo sapiens
ugaguagggacuc

SEQ ID NO: 763808 - RNA, 16 nt, Homo sapiens
ugaguaguguggaauu

SEQ ID NO: 763809 - RNA, 13 nt, Homo sapiens
ugaguauaaucaa

SEQ ID NO: 763810 - RNA, 18 nt, Homo sapiens
ugaguaucuuaaguacug

SEQ ID NO: 763811 - RNA, 20 nt, Homo sapiens
ugaguauuccaugagcugcu

SEQ ID NO: 763812 - RNA, 13 nt, Homo sapiens
ugaguauuuagga

SEQ ID NO: 763813 - RNA, 15 nt, Homo sapiens
ugagucacacugcau

SEQ ID NO: 763814 - RNA, 16 nt, Homo sapiens
ugagucagacugucag

SEQ ID NO: 763815 - RNA, 15 nt, Homo sapiens
ugagucagcaccuug

SEQ ID NO: 763816 - RNA, 17 nt, Homo sapiens
ugagucagugcucucag

SEQ ID NO: 763817 - RNA, 15 nt, Homo sapiens
ugaguccccuacucc

SEQ ID NO: 763818 - RNA, 14 nt, Homo sapiens
ugaguccccuccag

SEQ ID NO: 763819 - RNA, 14 nt, Homo sapiens
ugagucccugugau

SEQ ID NO: 763820 - RNA, 15 nt, Homo sapiens
ugagucccugugaug

SEQ ID NO: 763821 - RNA, 18 nt, Homo sapiens
ugaguccgacccagacau

SEQ ID NO: 763822 - RNA, 22 nt, Homo sapiens
ugagucuauccuagucuucaca

SEQ ID NO: 763823 - RNA, 15 nt, Homo sapiens
ugagucuccugugcc

SEQ ID NO: 763824 - RNA, 17 nt, Homo sapiens
ugagucuuggugcuauc

SEQ ID NO: 763825 - RNA, 20 nt, Homo sapiens
ugagucuuugguucuaagga

SEQ ID NO: 763826 - RNA, 15 nt, Homo sapiens
ugagugagccacaga

SEQ ID NO: 763827 - RNA, 19 nt, Homo sapiens
ugagugcaccugccuccac

SEQ ID NO: 763828 - RNA, 17 nt, Homo sapiens
ugaguggaugauguuuc

SEQ ID NO: 763829 - RNA, 16 nt, Homo sapiens
ugaguggcagccaugc

SEQ ID NO: 763830 - RNA, 13 nt, Homo sapiens
ugaguggugccaa

SEQ ID NO: 763831 - RNA, 16 nt, Homo sapiens
ugagugucuagcaaag

SEQ ID NO: 763832 - RNA, 17 nt, Homo sapiens
ugagugucuuagcauau

SEQ ID NO: 763833 - RNA, 13 nt, Homo sapiens
ugaguuacccugg

SEQ ID NO: 763834 - RNA, 22 nt, Homo sapiens
ugaguuacuuccuaucaagcca

SEQ ID NO: 763835 - RNA, 20 nt, Homo sapiens
ugaguuaugauguaaucucu

SEQ ID NO: 763836 - RNA, 17 nt, Homo sapiens
ugaguucuauaauauaa

SEQ ID NO: 763837 - RNA, 21 nt, Homo sapiens
ugaguuggggccauugcuuac

SEQ ID NO: 763838 - RNA, 15 nt, Homo sapiens
ugaguuucucuccac

SEQ ID NO: 763839 - RNA, 23 nt, Homo sapiens
ugaguuucuguucucccugggaa

SEQ ID NO: 763840 - RNA, 20 nt, Homo sapiens
ugaguuuuugauagcuuuau

SEQ ID NO: 763841 - RNA, 21 nt, Homo sapiens
ugaguuuuugauagcuuuauu

SEQ ID NO: 763842 - RNA, 18 nt, Homo sapiens
ugauaaaagagaagccaa

SEQ ID NO: 763843 - RNA, 21 nt, Homo sapiens
ugauaaacauuaaacacugua

SEQ ID NO: 763844 - RNA, 18 nt, Homo sapiens
ugauaaagcaguauuugg

SEQ ID NO: 763845 - RNA, 16 nt, Homo sapiens
ugauaaaguuccuuaa

SEQ ID NO: 763846 - RNA, 14 nt, Homo sapiens
ugauaaggcucuga

SEQ ID NO: 763847 - RNA, 12 nt, Homo sapiens
ugauaaguaaau

SEQ ID NO: 763848 - RNA, 16 nt, Homo sapiens
ugauaaguuccaaaua

SEQ ID NO: 763849 - RNA, 23 nt, Homo sapiens
ugauaaguucuuaugccauguua

SEQ ID NO: 763850 - RNA, 15 nt, Homo sapiens
ugauacaaauuccac

SEQ ID NO: 763851 - RNA, 14 nt, Homo sapiens
ugauacacuaugaa

SEQ ID NO: 763852 - RNA, 21 nt, Homo sapiens
ugauacauuaaaaaaauucca

SEQ ID NO: 763853 - RNA, 17 nt, Homo sapiens
ugauacuggagucuuau

SEQ ID NO: 763854 - RNA, 16 nt, Homo sapiens
ugauagaaaagugugg

SEQ ID NO: 763855 - RNA, 17 nt, Homo sapiens
ugauagaacuguacugu

SEQ ID NO: 763856 - RNA, 16 nt, Homo sapiens
ugauagaauacaaaga

SEQ ID NO: 763857 - RNA, 16 nt, Homo sapiens
ugauauacuuacucau

SEQ ID NO: 763858 - RNA, 14 nt, Homo sapiens
ugauauauauaugc

SEQ ID NO: 763859 - RNA, 14 nt, Homo sapiens
ugauauauucuuga

SEQ ID NO: 763860 - RNA, 14 nt, Homo sapiens
ugauaucugaucaa

SEQ ID NO: 763861 - RNA, 15 nt, Homo sapiens
ugauaucugaucaaa

SEQ ID NO: 763862 - RNA, 15 nt, Homo sapiens
ugauaugaccaaaau

SEQ ID NO: 763863 - RNA, 14 nt, Homo sapiens
ugauaugggacuga

SEQ ID NO: 763864 - RNA, 23 nt, Homo sapiens
ugauaugucagggcgugggacau

SEQ ID NO: 763865 - RNA, 18 nt, Homo sapiens
ugauauuauggcaaguga

SEQ ID NO: 763866 - RNA, 19 nt, Homo sapiens
ugauauuuucacacuggua

SEQ ID NO: 763867 - RNA, 20 nt, Homo sapiens
ugauauuuuuuauacaguga

SEQ ID NO: 763868 - RNA, 17 nt, Homo sapiens
ugaucaaauauuucaac

SEQ ID NO: 763869 - RNA, 17 nt, Homo sapiens
ugaucaagaaugcaaua

SEQ ID NO: 763870 - RNA, 22 nt, Homo sapiens
ugaucacacaguguuagugcug

SEQ ID NO: 763871 - RNA, 14 nt, Homo sapiens
ugaucacauucuuc

SEQ ID NO: 763872 - RNA, 14 nt, Homo sapiens
ugaucacugugaac

SEQ ID NO: 763873 - RNA, 23 nt, Homo sapiens
ugaucagaaaaauaauuccauaa

SEQ ID NO: 763874 - RNA, 14 nt, Homo sapiens
ugaucaguaaguca

SEQ ID NO: 763875 - RNA, 13 nt, Homo sapiens
ugaucagugauuu

SEQ ID NO: 763876 - RNA, 19 nt, Homo sapiens
ugaucaugccacugcacuc

SEQ ID NO: 763877 - RNA, 23 nt, Homo sapiens
ugaucauuuuccccccacucucc

SEQ ID NO: 763878 - RNA, 18 nt, Homo sapiens
ugauccagagcacagauc

SEQ ID NO: 763879 - RNA, 19 nt, Homo sapiens
ugauccuaguaauugccua

SEQ ID NO: 763880 - RNA, 19 nt, Homo sapiens
ugauccugcuccagcagca

SEQ ID NO: 763881 - RNA, 20 nt, Homo sapiens
ugauccuggaggcccaguuc

SEQ ID NO: 763882 - RNA, 16 nt, Homo sapiens
ugauccuuccaccuca

SEQ ID NO: 763883 - RNA, 16 nt, Homo sapiens
ugauccuuggugcugu

SEQ ID NO: 763884 - RNA, 21 nt, Homo sapiens
ugaucgcgccacuacacucca

SEQ ID NO: 763885 - RNA, 23 nt, Homo sapiens
ugaucggagccuccucucucaaa

SEQ ID NO: 763886 - RNA, 17 nt, Homo sapiens
ugaucuaccugccucag

SEQ ID NO: 763887 - RNA, 13 nt, Homo sapiens
ugaucuauacaaa

SEQ ID NO: 763888 - RNA, 13 nt, Homo sapiens
ugaucucagggca

SEQ ID NO: 763889 - RNA, 20 nt, Homo sapiens
ugaucucccuuggucuucca

SEQ ID NO: 763890 - RNA, 13 nt, Homo sapiens
ugaucucugggag

SEQ ID NO: 763891 - RNA, 15 nt, Homo sapiens
ugaucuguaccauga

SEQ ID NO: 763892 - RNA, 13 nt, Homo sapiens
ugaucuuggcagu

SEQ ID NO: 763893 - RNA, 15 nt, Homo sapiens
ugaugaaaacauuca

SEQ ID NO: 763894 - RNA, 15 nt, Homo sapiens
ugaugaaauaucacu

SEQ ID NO: 763895 - RNA, 14 nt, Homo sapiens
ugaugaaggauuca

SEQ ID NO: 763896 - RNA, 18 nt, Homo sapiens
ugaugaauaaaaugaagg

SEQ ID NO: 763897 - RNA, 15 nt, Homo sapiens
ugaugacccucugac

SEQ ID NO: 763898 - RNA, 15 nt, Homo sapiens
ugaugacgacgacaa

SEQ ID NO: 763899 - RNA, 18 nt, Homo sapiens
ugaugacugcuuaacucc

SEQ ID NO: 763900 - RNA, 20 nt, Homo sapiens
ugaugagagaauggagacag

SEQ ID NO: 763901 - RNA, 23 nt, Homo sapiens
ugaugagagaauggagacagagu

SEQ ID NO: 763902 - RNA, 23 nt, Homo sapiens
ugaugagucgguccucuuuccag

SEQ ID NO: 763903 - RNA, 21 nt, Homo sapiens
ugaugaucaaaaccugugcca

SEQ ID NO: 763904 - RNA, 22 nt, Homo sapiens
caggagaggggcagaacagccg

SEQ ID NO: 763905 - RNA, 17 nt, Homo sapiens
caggagcagcugugcug

SEQ ID NO: 763906 - RNA, 19 nt, Homo sapiens
caggagcagcugugcugca

SEQ ID NO: 763907 - RNA, 18 nt, Homo sapiens
caggagcccggcuuccac

SEQ ID NO: 763908 - RNA, 22 nt, Homo sapiens
caggagccuacuucuagcugua

SEQ ID NO: 763909 - RNA, 11 nt, Homo sapiens
caggagcucuu

SEQ ID NO: 763910 - RNA, 23 nt, Homo sapiens
caggaggaucauuugagcucaug

SEQ ID NO: 763911 - RNA, 20 nt, Homo sapiens
caggaggcccccaucuauga

SEQ ID NO: 763912 - RNA, 15 nt, Homo sapiens
caggaggcugaggca

SEQ ID NO: 763913 - RNA, 17 nt, Homo sapiens
caggaggggcagcgcau

SEQ ID NO: 763914 - RNA, 21 nt, Homo sapiens
caggagggguuaaagcugccg

SEQ ID NO: 763915 - RNA, 17 nt, Homo sapiens
caggaggugcuaucgca

SEQ ID NO: 763916 - RNA, 23 nt, Homo sapiens
caggagguggagguugcagugag

SEQ ID NO: 763917 - RNA, 21 nt, Homo sapiens
caggagguugagguaggagaa

SEQ ID NO: 763918 - RNA, 19 nt, Homo sapiens
caggagguuguggaugcuc

SEQ ID NO: 763919 - RNA, 15 nt, Homo sapiens
caggaguaagacaag

SEQ ID NO: 763920 - RNA, 18 nt, Homo sapiens
caggagucccugccauca

SEQ ID NO: 763921 - RNA, 23 nt, Homo sapiens
caggaguguuaagcguucaguga

SEQ ID NO: 763922 - RNA, 17 nt, Homo sapiens
caggaguuagaggccag

SEQ ID NO: 763923 - RNA, 22 nt, Homo sapiens
caggaguuugaggcugcagcga

SEQ ID NO: 763924 - RNA, 23 nt, Homo sapiens
caggaugcugugauacacugaaa

SEQ ID NO: 763925 - RNA, 14 nt, Homo sapiens
caggaugucccuga

SEQ ID NO: 763926 - RNA, 18 nt, Homo sapiens
caggauuggcaacucuuc

SEQ ID NO: 763927 - RNA, 14 nt, Homo sapiens
caggcaaacuugca

SEQ ID NO: 763928 - RNA, 20 nt, Homo sapiens
caggcaaggggcauuucaca

SEQ ID NO: 763929 - RNA, 14 nt, Homo sapiens
caggcaauuucacc

SEQ ID NO: 763930 - RNA, 18 nt, Homo sapiens
caggcaccaccaggagca

SEQ ID NO: 763931 - RNA, 20 nt, Homo sapiens
caggcacccaccaccaugcc

SEQ ID NO: 763932 - RNA, 19 nt, Homo sapiens
caggcacccucccaguuac

SEQ ID NO: 763933 - RNA, 15 nt, Homo sapiens
caggcacugccugga

SEQ ID NO: 763934 - RNA, 13 nt, Homo sapiens
caggcacuguuca

SEQ ID NO: 763935 - RNA, 16 nt, Homo sapiens
caggcagaucugugcc

SEQ ID NO: 763936 - RNA, 13 nt, Homo sapiens
caggcagcucaag

SEQ ID NO: 763937 - RNA, 12 nt, Homo sapiens
caggcaggccac

SEQ ID NO: 763938 - RNA, 18 nt, Homo sapiens
caggcagguuugccagug

SEQ ID NO: 763939 - RNA, 19 nt, Homo sapiens
caggcaguaugcugucaug

SEQ ID NO: 763940 - RNA, 18 nt, Homo sapiens
caggcaguggaagcaguu

SEQ ID NO: 763941 - RNA, 13 nt, Homo sapiens
caggcaucaggaa

SEQ ID NO: 763942 - RNA, 22 nt, Homo sapiens
caggcauuuguucacugaaggu

SEQ ID NO: 763943 - RNA, 20 nt, Homo sapiens
caggccaccccgcugaugga

SEQ ID NO: 763944 - RNA, 23 nt, Homo sapiens
caggccacuugccucaccugcug

SEQ ID NO: 763945 - RNA, 16 nt, Homo sapiens
caggccagagggcagu

SEQ ID NO: 763946 - RNA, 17 nt, Homo sapiens
caggccagagugcagug

SEQ ID NO: 763947 - RNA, 17 nt, Homo sapiens
caggccaggugcagugg

SEQ ID NO: 763948 - RNA, 18 nt, Homo sapiens
caggccauugucccugaa

SEQ ID NO: 763949 - RNA, 13 nt, Homo sapiens
caggcccagagaa

SEQ ID NO: 763950 - RNA, 12 nt, Homo sapiens
caggcccauuca

SEQ ID NO: 763951 - RNA, 16 nt, Homo sapiens
caggccccaccggcca

SEQ ID NO: 763952 - RNA, 15 nt, Homo sapiens
caggccccaccuccu

SEQ ID NO: 763953 - RNA, 14 nt, Homo sapiens
caggcccuguggca

SEQ ID NO: 763954 - RNA, 21 nt, Homo sapiens
caggcccuuccucuccacugc

SEQ ID NO: 763955 - RNA, 17 nt, Homo sapiens
caggccgcagcuccauu

SEQ ID NO: 763956 - RNA, 19 nt, Homo sapiens
caggccgugugucugucag

SEQ ID NO: 763957 - RNA, 19 nt, Homo sapiens
caggccuaggagacuagga

SEQ ID NO: 763958 - RNA, 20 nt, Homo sapiens
caggccuaucuggaagccac

SEQ ID NO: 763959 - RNA, 20 nt, Homo sapiens
caggccucugcagaagccaa

SEQ ID NO: 763960 - RNA, 19 nt, Homo sapiens
caggcgauucuccugccuc

SEQ ID NO: 763961 - RNA, 18 nt, Homo sapiens
caggcgggggcugcucag

SEQ ID NO: 763962 - RNA, 17 nt, Homo sapiens
caggcuacugucagcuc

SEQ ID NO: 763963 - RNA, 16 nt, Homo sapiens
caggcuauuagagagu

SEQ ID NO: 763964 - RNA, 18 nt, Homo sapiens
caggcuccaugcaccucc

SEQ ID NO: 763965 - RNA, 23 nt, Homo sapiens
caggcugagaacucguucaccuc

SEQ ID NO: 763966 - RNA, 12 nt, Homo sapiens
caggcuggagcu

SEQ ID NO: 763967 - RNA, 16 nt, Homo sapiens
caggcuggagugcaau

SEQ ID NO: 763968 - RNA, 15 nt, Homo sapiens
caggcuggagugcag

SEQ ID NO: 763969 - RNA, 17 nt, Homo sapiens
caggcuggagugcagug

SEQ ID NO: 763970 - RNA, 21 nt, Homo sapiens
caggcuggcgcagccaaggcc

SEQ ID NO: 763971 - RNA, 22 nt, Homo sapiens
caggcugggccauguccaaaga

SEQ ID NO: 763972 - RNA, 23 nt, Homo sapiens
caggcuguuggaaaauccagaac

SEQ ID NO: 763973 - RNA, 22 nt, Homo sapiens
caggcuguuuggagauccucau

SEQ ID NO: 763974 - RNA, 22 nt, Homo sapiens
caggcuucugagcacagcugca

SEQ ID NO: 763975 - RNA, 15 nt, Homo sapiens
caggcuuuuuuccag

SEQ ID NO: 763976 - RNA, 16 nt, Homo sapiens
cagggaaaacugcaaa

SEQ ID NO: 763977 - RNA, 24 nt, Homo sapiens
cagggaaaugggcagacugaacca

SEQ ID NO: 763978 - RNA, 22 nt, Homo sapiens
cagggaaccgugauaagccuuu

SEQ ID NO: 763979 - RNA, 17 nt, Homo sapiens
cagggaagagggcagua

SEQ ID NO: 763980 - RNA, 20 nt, Homo sapiens
cagggaagccccacuugaag

SEQ ID NO: 763981 - RNA, 16 nt, Homo sapiens
cagggaccugagagca

SEQ ID NO: 763982 - RNA, 19 nt, Homo sapiens
cagggacuccaugcugcca

SEQ ID NO: 763983 - RNA, 12 nt, Homo sapiens
cagggagcaccu

SEQ ID NO: 763984 - RNA, 23 nt, Homo sapiens
cagggagcaguugcccucaggcc

SEQ ID NO: 763985 - RNA, 16 nt, Homo sapiens
cagggauaauacugug

SEQ ID NO: 763986 - RNA, 22 nt, Homo sapiens
cagggcaaaugacaugcacuga

SEQ ID NO: 763987 - RNA, 19 nt, Homo sapiens
cagggcacgcaggaccagu

SEQ ID NO: 763988 - RNA, 21 nt, Homo sapiens
cagggcagcaagggaccugcu

SEQ ID NO: 763989 - RNA, 23 nt, Homo sapiens
cagggcagcaagggaccugcuca

SEQ ID NO: 763990 - RNA, 18 nt, Homo sapiens
cagggcauuuugguccaa

SEQ ID NO: 763991 - RNA, 13 nt, Homo sapiens
cagggccacaacu

SEQ ID NO: 763992 - RNA, 20 nt, Homo sapiens
cagggccaccucuugcuugg

SEQ ID NO: 763993 - RNA, 18 nt, Homo sapiens
cagggccagcccacguca

SEQ ID NO: 763994 - RNA, 18 nt, Homo sapiens
cagggcccaagucccugu

SEQ ID NO: 763995 - RNA, 21 nt, Homo sapiens
cagggccccccaacuguggua

SEQ ID NO: 763996 - RNA, 20 nt, Homo sapiens
cagggcccugagcucggugg

SEQ ID NO: 763997 - RNA, 14 nt, Homo sapiens
cagggccucaaagu

SEQ ID NO: 763998 - RNA, 15 nt, Homo sapiens
cagggccuccagggc

SEQ ID NO: 763999 - RNA, 13 nt, Homo sapiens
cagggcuagugac

SEQ ID NO: 764000 - RNA, 18 nt, Homo sapiens
cagggcucagccuggugg

SEQ ID NO: 764001 - RNA, 19 nt, Homo sapiens
cagggcuccaaaucugccu

SEQ ID NO: 764002 - RNA, 22 nt, Homo sapiens
cagggcucucuguaucagucuu

SEQ ID NO: 764003 - RNA, 15 nt, Homo sapiens
caggggaccacaccu

SEQ ID NO: 764004 - RNA, 18 nt, Homo sapiens
caggggaggugauagcau

SEQ ID NO: 764005 - RNA, 15 nt, Homo sapiens
caggggaucauguua

SEQ ID NO: 764006 - RNA, 20 nt, Homo sapiens
cagggggcccgaacagggac

SEQ ID NO: 764007 - RNA, 21 nt, Homo sapiens
caggggucgucaccaccucuc

SEQ ID NO: 764008 - RNA, 21 nt, Homo sapiens
caggggucuuaccuugaacug

SEQ ID NO: 764009 - RNA, 13 nt, Homo sapiens
caggggugcugug

SEQ ID NO: 764010 - RNA, 22 nt, Homo sapiens
cagggguggcugccucauuuag

SEQ ID NO: 764011 - RNA, 20 nt, Homo sapiens
caggguaccucaagccccau

SEQ ID NO: 764012 - RNA, 16 nt, Homo sapiens
cagggucugcucuuuc

SEQ ID NO: 764013 - RNA, 20 nt, Homo sapiens
cagggucugcucuuucucug

SEQ ID NO: 764014 - RNA, 18 nt, Homo sapiens
caggguggaugaucucaa

SEQ ID NO: 764015 - RNA, 12 nt, Homo sapiens
cagggugggccu

SEQ ID NO: 764016 - RNA, 20 nt, Homo sapiens
caggguguguacugcacaag

SEQ ID NO: 764017 - RNA, 20 nt, Homo sapiens
caggguuaggaaucucuuca

SEQ ID NO: 764018 - RNA, 17 nt, Homo sapiens
ugaugaucauugcuggc

SEQ ID NO: 764019 - RNA, 14 nt, Homo sapiens
ugaugaugaugaua

SEQ ID NO: 764020 - RNA, 13 nt, Homo sapiens
ugaugaugucucu

SEQ ID NO: 764021 - RNA, 17 nt, Homo sapiens
ugaugauuaauucaccu

SEQ ID NO: 764022 - RNA, 23 nt, Homo sapiens
ugaugccagagggccagcaggcu

SEQ ID NO: 764023 - RNA, 17 nt, Homo sapiens
ugaugccuccuuggcca

SEQ ID NO: 764024 - RNA, 16 nt, Homo sapiens
ugaugcuauuuaugca

SEQ ID NO: 764025 - RNA, 17 nt, Homo sapiens
ugaugcuauuuaugcaa

SEQ ID NO: 764026 - RNA, 23 nt, Homo sapiens
ugaugcucccuccccugcccugg

SEQ ID NO: 764027 - RNA, 14 nt, Homo sapiens
ugaugcugugcuau

SEQ ID NO: 764028 - RNA, 21 nt, Homo sapiens
ugauggaaaauaaacaucagu

SEQ ID NO: 764029 - RNA, 21 nt, Homo sapiens
ugauggagauauuuacaugaa

SEQ ID NO: 764030 - RNA, 16 nt, Homo sapiens
ugauggagaugcaguc

SEQ ID NO: 764031 - RNA, 17 nt, Homo sapiens
ugauggggaauccgugu

SEQ ID NO: 764032 - RNA, 14 nt, Homo sapiens
ugaugguugccagg

SEQ ID NO: 764033 - RNA, 15 nt, Homo sapiens
ugauguuaaccaaug

SEQ ID NO: 764034 - RNA, 17 nt, Homo sapiens
ugauguuaaccaaugua

SEQ ID NO: 764035 - RNA, 14 nt, Homo sapiens
ugauguucuaaggc

SEQ ID NO: 764036 - RNA, 15 nt, Homo sapiens
ugauguuucugugaa

SEQ ID NO: 764037 - RNA, 20 nt, Homo sapiens
ugauguuuguggccucagaa

SEQ ID NO: 764038 - RNA, 17 nt, Homo sapiens
ugauuaaccgaggacag

SEQ ID NO: 764039 - RNA, 13 nt, Homo sapiens
ugauuaacuuauu

SEQ ID NO: 764040 - RNA, 17 nt, Homo sapiens
ugauuacuguccagcuu

SEQ ID NO: 764041 - RNA, 13 nt, Homo sapiens
ugauuauucaaca

SEQ ID NO: 764042 - RNA, 21 nt, Homo sapiens
ugauuauucuuguucagggag

SEQ ID NO: 764043 - RNA, 21 nt, Homo sapiens
ugauuauuuuuuauacuguau

SEQ ID NO: 764044 - RNA, 16 nt, Homo sapiens
ugauucaaauugcugc

SEQ ID NO: 764045 - RNA, 18 nt, Homo sapiens
ugauucaaauugcugcuu

SEQ ID NO: 764046 - RNA, 15 nt, Homo sapiens
ugauucacagugguc

SEQ ID NO: 764047 - RNA, 18 nt, Homo sapiens
ugauucacucaagaguuc

SEQ ID NO: 764048 - RNA, 23 nt, Homo sapiens
ugauucacugccuuccucucucu

SEQ ID NO: 764049 - RNA, 11 nt, Homo sapiens
ugauucccaac

SEQ ID NO: 764050 - RNA, 16 nt, Homo sapiens
ugauucccuccugcua

SEQ ID NO: 764051 - RNA, 18 nt, Homo sapiens
ugauucgaaggaugaaga

SEQ ID NO: 764052 - RNA, 22 nt, Homo sapiens
ugauucgcccaccucagccucc

SEQ ID NO: 764053 - RNA, 17 nt, Homo sapiens
ugauucuaugccuguau

SEQ ID NO: 764054 - RNA, 15 nt, Homo sapiens
ugauucucuaugaca

SEQ ID NO: 764055 - RNA, 21 nt, Homo sapiens
ugauugaguccuuucuuccau

SEQ ID NO: 764056 - RNA, 18 nt, Homo sapiens
ugauugaucacacagugu

SEQ ID NO: 764057 - RNA, 12 nt, Homo sapiens
ugauugcagcuu

SEQ ID NO: 764058 - RNA, 19 nt, Homo sapiens
ugauuggacauuuucuuca

SEQ ID NO: 764059 - RNA, 17 nt, Homo sapiens
ugauuggaccaggccau

SEQ ID NO: 764060 - RNA, 15 nt, Homo sapiens
ugauuggugauucaa

SEQ ID NO: 764061 - RNA, 16 nt, Homo sapiens
ugauuuaagacuauga

SEQ ID NO: 764062 - RNA, 14 nt, Homo sapiens
ugauuuacauucaa

SEQ ID NO: 764063 - RNA, 14 nt, Homo sapiens
ugauuuaccucaua

SEQ ID NO: 764064 - RNA, 12 nt, Homo sapiens
ugauuuacuuaa

SEQ ID NO: 764065 - RNA, 16 nt, Homo sapiens
ugauuuagugaucaaa

SEQ ID NO: 764066 - RNA, 19 nt, Homo sapiens
ugauuucaauagcuuugua

SEQ ID NO: 764067 - RNA, 15 nt, Homo sapiens
ugauuucagacugca

SEQ ID NO: 764068 - RNA, 19 nt, Homo sapiens
ugauuucuagaacccguga

SEQ ID NO: 764069 - RNA, 14 nt, Homo sapiens
ugauuucucugaac

SEQ ID NO: 764070 - RNA, 16 nt, Homo sapiens
ugauuuggugaccaac

SEQ ID NO: 764071 - RNA, 13 nt, Homo sapiens
ugauuugguggau

SEQ ID NO: 764072 - RNA, 16 nt, Homo sapiens
ugauuuguagcacuga

SEQ ID NO: 764073 - RNA, 20 nt, Homo sapiens
ugauuugucccagccugggg

SEQ ID NO: 764074 - RNA, 18 nt, Homo sapiens
ugauuugucccuaugcau

SEQ ID NO: 764075 - RNA, 21 nt, Homo sapiens
ugauuuuaaccaauguagcac

SEQ ID NO: 764076 - RNA, 14 nt, Homo sapiens
ugauuuuuacuuca

SEQ ID NO: 764077 - RNA, 15 nt, Homo sapiens
ugauuuuuuuccaca

SEQ ID NO: 764078 - RNA, 14 nt, Homo sapiens
ugcaaaaaaagccu

SEQ ID NO: 764079 - RNA, 15 nt, Homo sapiens
ugcaaaaauaaccaa

SEQ ID NO: 764080 - RNA, 16 nt, Homo sapiens
ugcaaaaauccaaaua

SEQ ID NO: 764081 - RNA, 19 nt, Homo sapiens
ugcaaaaaugaaauccagu

SEQ ID NO: 764082 - RNA, 16 nt, Homo sapiens
ugcaaaacacuaaaga

SEQ ID NO: 764083 - RNA, 17 nt, Homo sapiens
ugcaaaacacuaaagau

SEQ ID NO: 764084 - RNA, 23 nt, Homo sapiens
ugcaaaauauuugacuauucugu

SEQ ID NO: 764085 - RNA, 14 nt, Homo sapiens
ugcaaacaaaaucc

SEQ ID NO: 764086 - RNA, 22 nt, Homo sapiens
ugcaaacccugguugcuguauu

SEQ ID NO: 764087 - RNA, 18 nt, Homo sapiens
ugcaaauaacugaucuca

SEQ ID NO: 764088 - RNA, 14 nt, Homo sapiens
ugcaaauacaauca

SEQ ID NO: 764089 - RNA, 16 nt, Homo sapiens
ugcaaauacaaucagc

SEQ ID NO: 764090 - RNA, 23 nt, Homo sapiens
ugcaaauacaaucagcccagugc

SEQ ID NO: 764091 - RNA, 14 nt, Homo sapiens
ugcaaauaccuccu

SEQ ID NO: 764092 - RNA, 14 nt, Homo sapiens
ugcaaauacuguau

SEQ ID NO: 764093 - RNA, 10 nt, Homo sapiens
ugcaaaucag

SEQ ID NO: 764094 - RNA, 21 nt, Homo sapiens
ugcaaaugcaugcuucuucuc

SEQ ID NO: 764095 - RNA, 19 nt, Homo sapiens
ugcaaauucauuucauggu

SEQ ID NO: 764096 - RNA, 17 nt, Homo sapiens
ugcaaauugccugcaaa

SEQ ID NO: 764097 - RNA, 13 nt, Homo sapiens
ugcaacagacugu

SEQ ID NO: 764098 - RNA, 16 nt, Homo sapiens
ugcaaccaucaccaga

SEQ ID NO: 764099 - RNA, 19 nt, Homo sapiens
ugcaacccagucacacugu

SEQ ID NO: 764100 - RNA, 16 nt, Homo sapiens
ugcaaccuccaucucc

SEQ ID NO: 764101 - RNA, 14 nt, Homo sapiens
ugcaaccucugccu

SEQ ID NO: 764102 - RNA, 12 nt, Homo sapiens
ugcaacuaggaa

SEQ ID NO: 764103 - RNA, 20 nt, Homo sapiens
ugcaacucuuuuaagugccu

SEQ ID NO: 764104 - RNA, 18 nt, Homo sapiens
ugcaacuggaguuccuua

SEQ ID NO: 764105 - RNA, 19 nt, Homo sapiens
ugcaagaaaucagccauaa

SEQ ID NO: 764106 - RNA, 15 nt, Homo sapiens
ugcaagagugacagu

SEQ ID NO: 764107 - RNA, 18 nt, Homo sapiens
ugcaagagugauugcagc

SEQ ID NO: 764108 - RNA, 15 nt, Homo sapiens
ugcaagcacaucugc

SEQ ID NO: 764109 - RNA, 23 nt, Homo sapiens
ugcaagcuucuuuuaguuguauc

SEQ ID NO: 764110 - RNA, 19 nt, Homo sapiens
ugcaaggccugguguuucu

SEQ ID NO: 764111 - RNA, 19 nt, Homo sapiens
ugcaaggcuaagaaguacu

SEQ ID NO: 764112 - RNA, 22 nt, Homo sapiens
ugcaagguacucuggugaguca

SEQ ID NO: 764113 - RNA, 19 nt, Homo sapiens
ugcaauaaauggcuugauu

SEQ ID NO: 764114 - RNA, 14 nt, Homo sapiens
ugcaauacauuuca

SEQ ID NO: 764115 - RNA, 15 nt, Homo sapiens
ugcaauaccaauguu

SEQ ID NO: 764116 - RNA, 18 nt, Homo sapiens
ugcaauagacacauacau

SEQ ID NO: 764117 - RNA, 20 nt, Homo sapiens
ugcaauagugcaacaucucu

SEQ ID NO: 764118 - RNA, 12 nt, Homo sapiens
ugcaaucuucua

SEQ ID NO: 764119 - RNA, 16 nt, Homo sapiens
ugcaaugacacagucu

SEQ ID NO: 764120 - RNA, 12 nt, Homo sapiens
ugcaaugagcca

SEQ ID NO: 764121 - RNA, 16 nt, Homo sapiens
ugcaaugcuaucacug

SEQ ID NO: 764122 - RNA, 16 nt, Homo sapiens
ugcaauguaagcauac

SEQ ID NO: 764123 - RNA, 16 nt, Homo sapiens
ugcaauguagucaaua

SEQ ID NO: 764124 - RNA, 12 nt, Homo sapiens
ugcaaugucaaa

SEQ ID NO: 764125 - RNA, 22 nt, Homo sapiens
ugcaaugucacaaccucucuga

SEQ ID NO: 764126 - RNA, 13 nt, Homo sapiens
ugcaaugugcuac

SEQ ID NO: 764127 - RNA, 15 nt, Homo sapiens
ugcaauguggugaca

SEQ ID NO: 764128 - RNA, 21 nt, Homo sapiens
ugcaauuuuauuaaaugcauc

SEQ ID NO: 764129 - RNA, 22 nt, Homo sapiens
ugcacaaaagcagauacuugag

SEQ ID NO: 764130 - RNA, 15 nt, Homo sapiens
ugcacaaacaugaaa

SEQ ID NO: 764131 - RNA, 16 nt, Homo sapiens
ugcacaaggaaauaaa

SEQ ID NO: 764132 - RNA, 18 nt, Homo sapiens
ugcacaaggaaauaaagc

SEQ ID NO: 764133 - RNA, 23 nt, Homo sapiens
ugcacaaggaaauaaagcguccu

SEQ ID NO: 764134 - RNA, 15 nt, Homo sapiens
caggguuucucugaa

SEQ ID NO: 764135 - RNA, 13 nt, Homo sapiens
caggguuuuuaga

SEQ ID NO: 764136 - RNA, 15 nt, Homo sapiens
cagguaaaacagggc

SEQ ID NO: 764137 - RNA, 22 nt, Homo sapiens
cagguaaaugguaugaucaaua

SEQ ID NO: 764138 - RNA, 13 nt, Homo sapiens
cagguaaugugaa

SEQ ID NO: 764139 - RNA, 16 nt, Homo sapiens
cagguaccgugcucau

SEQ ID NO: 764140 - RNA, 21 nt, Homo sapiens
caggucaacuucagagacuau

SEQ ID NO: 764141 - RNA, 19 nt, Homo sapiens
caggucacccuuugcugug

SEQ ID NO: 764142 - RNA, 16 nt, Homo sapiens
caggucaguuguaaua

SEQ ID NO: 764143 - RNA, 23 nt, Homo sapiens
caggucccaggcuccuaugcaag

SEQ ID NO: 764144 - RNA, 12 nt, Homo sapiens
cagguccuccau

SEQ ID NO: 764145 - RNA, 19 nt, Homo sapiens
cagguccucuacuuaauga

SEQ ID NO: 764146 - RNA, 15 nt, Homo sapiens
caggucggagugccu

SEQ ID NO: 764147 - RNA, 14 nt, Homo sapiens
caggucuugacuca

SEQ ID NO: 764148 - RNA, 15 nt, Homo sapiens
caggucuugacucau

SEQ ID NO: 764149 - RNA, 22 nt, Homo sapiens
caggucuugacucauggcagcu

SEQ ID NO: 764150 - RNA, 14 nt, Homo sapiens
caggugaacagccu

SEQ ID NO: 764151 - RNA, 14 nt, Homo sapiens
caggugagcaauua

SEQ ID NO: 764152 - RNA, 18 nt, Homo sapiens
caggugauccgccuaccu

SEQ ID NO: 764153 - RNA, 19 nt, Homo sapiens
caggugaucuaccugccuc

SEQ ID NO: 764154 - RNA, 23 nt, Homo sapiens
caggugauuuguaugcucauuga

SEQ ID NO: 764155 - RNA, 22 nt, Homo sapiens
caggugccuccaggugugcacg

SEQ ID NO: 764156 - RNA, 17 nt, Homo sapiens
caggugccuucccagac

SEQ ID NO: 764157 - RNA, 23 nt, Homo sapiens
caggugccuuguccucagggcua

SEQ ID NO: 764158 - RNA, 17 nt, Homo sapiens
caggugcgcacuaccac

SEQ ID NO: 764159 - RNA, 23 nt, Homo sapiens
caggugcugggcuggacuggcca

SEQ ID NO: 764160 - RNA, 20 nt, Homo sapiens
caggugugagccacggugcc

SEQ ID NO: 764161 - RNA, 20 nt, Homo sapiens
caggugugggccacugcacc

SEQ ID NO: 764162 - RNA, 17 nt, Homo sapiens
caggugugguugcucac

SEQ ID NO: 764163 - RNA, 21 nt, Homo sapiens
cagguguuaacauuccaagac

SEQ ID NO: 764164 - RNA, 14 nt, Homo sapiens
cagguguugccaaa

SEQ ID NO: 764165 - RNA, 19 nt, Homo sapiens
cagguguugggaccugcug

SEQ ID NO: 764166 - RNA, 16 nt, Homo sapiens
cagguuauacuccucc

SEQ ID NO: 764167 - RNA, 22 nt, Homo sapiens
cagguucaugccaccauggcca

SEQ ID NO: 764168 - RNA, 15 nt, Homo sapiens
cagguucccccagca

SEQ ID NO: 764169 - RNA, 19 nt, Homo sapiens
cagguuccuuaucugucac

SEQ ID NO: 764170 - RNA, 20 nt, Homo sapiens
cagguuuucuguuucugugu

SEQ ID NO: 764171 - RNA, 15 nt, Homo sapiens
caguaaaaacuugua

SEQ ID NO: 764172 - RNA, 17 nt, Homo sapiens
caguaaaagaugaaguu

SEQ ID NO: 764173 - RNA, 16 nt, Homo sapiens
caguaaaauacuauuc

SEQ ID NO: 764174 - RNA, 16 nt, Homo sapiens
caguaaauaacuggaa

SEQ ID NO: 764175 - RNA, 17 nt, Homo sapiens
caguaaauaacuggaaa

SEQ ID NO: 764176 - RNA, 23 nt, Homo sapiens
caguaaauuugcuagcaguaaaa

SEQ ID NO: 764177 - RNA, 15 nt, Homo sapiens
caguaacuaaagcuu

SEQ ID NO: 764178 - RNA, 21 nt, Homo sapiens
caguaacugugacugaugacu

SEQ ID NO: 764179 - RNA, 22 nt, Homo sapiens
caguaagagguguuauuuggaa

SEQ ID NO: 764180 - RNA, 17 nt, Homo sapiens
caguaagcuaucuucaa

SEQ ID NO: 764181 - RNA, 16 nt, Homo sapiens
caguaaucccauuucc

SEQ ID NO: 764182 - RNA, 21 nt, Homo sapiens
caguacacccaguugccaaag

SEQ ID NO: 764183 - RNA, 12 nt, Homo sapiens
caguacauuuaa

SEQ ID NO: 764184 - RNA, 16 nt, Homo sapiens
caguaccuagcuggcu

SEQ ID NO: 764185 - RNA, 16 nt, Homo sapiens
caguaccuagcuguaa

SEQ ID NO: 764186 - RNA, 16 nt, Homo sapiens
caguacuaaugaagug

SEQ ID NO: 764187 - RNA, 19 nt, Homo sapiens
caguacuuguuucuaugca

SEQ ID NO: 764188 - RNA, 17 nt, Homo sapiens
caguacuuuauuguaca

SEQ ID NO: 764189 - RNA, 14 nt, Homo sapiens
caguagauuuucca

SEQ ID NO: 764190 - RNA, 23 nt, Homo sapiens
caguagcagguaaggaaagggcu

SEQ ID NO: 764191 - RNA, 22 nt, Homo sapiens
caguaggagacacgacagcaca

SEQ ID NO: 764192 - RNA, 19 nt, Homo sapiens
caguaggggcuacugugac

SEQ ID NO: 764193 - RNA, 22 nt, Homo sapiens
caguauaagcaucugccaucug

SEQ ID NO: 764194 - RNA, 17 nt, Homo sapiens
caguauauuuauaguca

SEQ ID NO: 764195 - RNA, 20 nt, Homo sapiens
caguauccacaauagcugac

SEQ ID NO: 764196 - RNA, 16 nt, Homo sapiens
caguaucccacaucca

SEQ ID NO: 764197 - RNA, 18 nt, Homo sapiens
caguaucccacauccaac

SEQ ID NO: 764198 - RNA, 12 nt, Homo sapiens
caguaucuccaa

SEQ ID NO: 764199 - RNA, 18 nt, Homo sapiens
caguaucucuucagucuc

SEQ ID NO: 764200 - RNA, 21 nt, Homo sapiens
caguaucuucaagguuuggaa

SEQ ID NO: 764201 - RNA, 15 nt, Homo sapiens
caguaucuugggcau

SEQ ID NO: 764202 - RNA, 12 nt, Homo sapiens
caguaugcuugg

SEQ ID NO: 764203 - RNA, 17 nt, Homo sapiens
caguaugggaucugaua

SEQ ID NO: 764204 - RNA, 20 nt, Homo sapiens
caguauguacuucagugcac

SEQ ID NO: 764205 - RNA, 12 nt, Homo sapiens
caguauuaugca

SEQ ID NO: 764206 - RNA, 13 nt, Homo sapiens
caguauuaugcau

SEQ ID NO: 764207 - RNA, 16 nt, Homo sapiens
caguauucugacaugu

SEQ ID NO: 764208 - RNA, 13 nt, Homo sapiens
caguauuuugaca

SEQ ID NO: 764209 - RNA, 14 nt, Homo sapiens
cagucacacuguua

SEQ ID NO: 764210 - RNA, 14 nt, Homo sapiens
cagucaccuaucca

SEQ ID NO: 764211 - RNA, 16 nt, Homo sapiens
cagucacugacaguua

SEQ ID NO: 764212 - RNA, 23 nt, Homo sapiens
cagucauagcaagcuuuugcuca

SEQ ID NO: 764213 - RNA, 21 nt, Homo sapiens
cagucauggcaccaaagccac

SEQ ID NO: 764214 - RNA, 23 nt, Homo sapiens
cagucauucuaggauguggagcu

SEQ ID NO: 764215 - RNA, 22 nt, Homo sapiens
caguccaaccagaaacaccccu

SEQ ID NO: 764216 - RNA, 16 nt, Homo sapiens
caguccaccugaggaa

SEQ ID NO: 764217 - RNA, 19 nt, Homo sapiens
caguccaugcuucuagccu

SEQ ID NO: 764218 - RNA, 15 nt, Homo sapiens
cagucccaucagaga

SEQ ID NO: 764219 - RNA, 14 nt, Homo sapiens
cagucccuggagcu

SEQ ID NO: 764220 - RNA, 22 nt, Homo sapiens
cagucccuuuaaagaaacaugg

SEQ ID NO: 764221 - RNA, 14 nt, Homo sapiens
caguccugcugacu

SEQ ID NO: 764222 - RNA, 22 nt, Homo sapiens
cagucucggguggcuagucaga

SEQ ID NO: 764223 - RNA, 16 nt, Homo sapiens
cagucucuauaccaau

SEQ ID NO: 764224 - RNA, 18 nt, Homo sapiens
cagucucuauaccaauaa

SEQ ID NO: 764225 - RNA, 21 nt, Homo sapiens
cagucucugagcaccagggag

SEQ ID NO: 764226 - RNA, 13 nt, Homo sapiens
cagucucuggaaa

SEQ ID NO: 764227 - RNA, 22 nt, Homo sapiens
cagucucuucgaggcuuuacag

SEQ ID NO: 764228 - RNA, 18 nt, Homo sapiens
cagucuggaucguuugac

SEQ ID NO: 764229 - RNA, 11 nt, Homo sapiens
cagucugugaa

SEQ ID NO: 764230 - RNA, 17 nt, Homo sapiens
cagucuguuaugcacug

SEQ ID NO: 764231 - RNA, 19 nt, Homo sapiens
cagucuucucucacuuuga

SEQ ID NO: 764232 - RNA, 15 nt, Homo sapiens
cagucuugcuuacaa

SEQ ID NO: 764233 - RNA, 15 nt, Homo sapiens
cagucuuugcaguuc

SEQ ID NO: 764234 - RNA, 14 nt, Homo sapiens
cagugaaagccaga

SEQ ID NO: 764235 - RNA, 15 nt, Homo sapiens
cagugaacauuccca

SEQ ID NO: 764236 - RNA, 16 nt, Homo sapiens
cagugaagacuugauu

SEQ ID NO: 764237 - RNA, 17 nt, Homo sapiens
cagugaagaugccagug

SEQ ID NO: 764238 - RNA, 17 nt, Homo sapiens
cagugaagcagcacugu

SEQ ID NO: 764239 - RNA, 20 nt, Homo sapiens
cagugaagcagcacugugag

SEQ ID NO: 764240 - RNA, 15 nt, Homo sapiens
cagugaaguacaccu

SEQ ID NO: 764241 - RNA, 23 nt, Homo sapiens
cagugacaaacauauccuuucaa

SEQ ID NO: 764242 - RNA, 14 nt, Homo sapiens
cagugaccauggca

SEQ ID NO: 764243 - RNA, 13 nt, Homo sapiens
cagugacccaucu

SEQ ID NO: 764244 - RNA, 15 nt, Homo sapiens
cagugaccccugacc

SEQ ID NO: 764245 - RNA, 12 nt, Homo sapiens
cagugacuggca

SEQ ID NO: 764246 - RNA, 20 nt, Homo sapiens
cagugagccaagauugcgcc

SEQ ID NO: 764247 - RNA, 13 nt, Homo sapiens
cagugagccauga

SEQ ID NO: 764248 - RNA, 14 nt, Homo sapiens
cagugagcccagau

SEQ ID NO: 764249 - RNA, 18 nt, Homo sapiens
ugcacacagaaugcucag

SEQ ID NO: 764250 - RNA, 12 nt, Homo sapiens
ugcacacaguga

SEQ ID NO: 764251 - RNA, 21 nt, Homo sapiens
ugcacacugccuggcccaaaa

SEQ ID NO: 764252 - RNA, 12 nt, Homo sapiens
ugcacagccacu

SEQ ID NO: 764253 - RNA, 15 nt, Homo sapiens
ugcacaggagccaaa

SEQ ID NO: 764254 - RNA, 21 nt, Homo sapiens
ugcacaggcagauguuugccu

SEQ ID NO: 764255 - RNA, 11 nt, Homo sapiens
ugcacaggccu

SEQ ID NO: 764256 - RNA, 14 nt, Homo sapiens
ugcacaggccucug

SEQ ID NO: 764257 - RNA, 19 nt, Homo sapiens
ugcacagggggaggccaua

SEQ ID NO: 764258 - RNA, 16 nt, Homo sapiens
ugcacaguaaaaaugg

SEQ ID NO: 764259 - RNA, 21 nt, Homo sapiens
ugcacaguacaauaauguacu

SEQ ID NO: 764260 - RNA, 20 nt, Homo sapiens
ugcacagucacugcucuuca

SEQ ID NO: 764261 - RNA, 22 nt, Homo sapiens
ugcacagugaagugcuggcaac

SEQ ID NO: 764262 - RNA, 20 nt, Homo sapiens
ugcacagugacuucugagau

SEQ ID NO: 764263 - RNA, 20 nt, Homo sapiens
ugcacaugccuuaagccagu

SEQ ID NO: 764264 - RNA, 20 nt, Homo sapiens
ugcacaugucuuguacaugu

SEQ ID NO: 764265 - RNA, 23 nt, Homo sapiens
ugcacaugucuuguacaugugua

SEQ ID NO: 764266 - RNA, 11 nt, Homo sapiens
ugcacaugugc

SEQ ID NO: 764267 - RNA, 21 nt, Homo sapiens
ugcacaugugccacacaguga

SEQ ID NO: 764268 - RNA, 13 nt, Homo sapiens
ugcacauugccug

SEQ ID NO: 764269 - RNA, 17 nt, Homo sapiens
ugcacauuugguaaugu

SEQ ID NO: 764270 - RNA, 18 nt, Homo sapiens
ugcacauuugucacugaa

SEQ ID NO: 764271 - RNA, 13 nt, Homo sapiens
ugcaccaaagaca

SEQ ID NO: 764272 - RNA, 20 nt, Homo sapiens
ugcaccaacaucuacaagau

SEQ ID NO: 764273 - RNA, 14 nt, Homo sapiens
ugcaccaccaagcc

SEQ ID NO: 764274 - RNA, 17 nt, Homo sapiens
ugcaccacuucaaguga

SEQ ID NO: 764275 - RNA, 19 nt, Homo sapiens
ugcaccagcgcccccagaa

SEQ ID NO: 764276 - RNA, 14 nt, Homo sapiens
ugcaccaugcugcu

SEQ ID NO: 764277 - RNA, 14 nt, Homo sapiens
ugcaccauugcacu

SEQ ID NO: 764278 - RNA, 18 nt, Homo sapiens
ugcacccagcagugucac

SEQ ID NO: 764279 - RNA, 20 nt, Homo sapiens
ugcaccccaaagcuuuccug

SEQ ID NO: 764280 - RNA, 18 nt, Homo sapiens
ugcaccccaccagcaaua

SEQ ID NO: 764281 - RNA, 17 nt, Homo sapiens
ugcaccccuccccauuc

SEQ ID NO: 764282 - RNA, 18 nt, Homo sapiens
ugcaccccuccccauuca

SEQ ID NO: 764283 - RNA, 22 nt, Homo sapiens
ugcaccccuccccauucacaga

SEQ ID NO: 764284 - RNA, 14 nt, Homo sapiens
ugcaccguccucag

SEQ ID NO: 764285 - RNA, 21 nt, Homo sapiens
ugcaccucuuguuacucccug

SEQ ID NO: 764286 - RNA, 16 nt, Homo sapiens
ugcaccugccagccug

SEQ ID NO: 764287 - RNA, 22 nt, Homo sapiens
ugcaccugggagaaagacuuug

SEQ ID NO: 764288 - RNA, 19 nt, Homo sapiens
ugcacgaccgccccaguuc

SEQ ID NO: 764289 - RNA, 19 nt, Homo sapiens
ugcacgcgcgcgugcacac

SEQ ID NO: 764290 - RNA, 17 nt, Homo sapiens
ugcacucaccucacugu

SEQ ID NO: 764291 - RNA, 16 nt, Homo sapiens
ugcacuccagccuggg

SEQ ID NO: 764292 - RNA, 21 nt, Homo sapiens
ugcacuccagccugggggaca

SEQ ID NO: 764293 - RNA, 15 nt, Homo sapiens
ugcacucccaccuga

SEQ ID NO: 764294 - RNA, 18 nt, Homo sapiens
ugcacucuagccuggcaa

SEQ ID NO: 764295 - RNA, 22 nt, Homo sapiens
ugcacugaggcagcgaccucaa

SEQ ID NO: 764296 - RNA, 11 nt, Homo sapiens
ugcacugcugu

SEQ ID NO: 764297 - RNA, 21 nt, Homo sapiens
ugcacuguauauagaagucua

SEQ ID NO: 764298 - RNA, 23 nt, Homo sapiens
ugcacugucugagaauuuccaaa

SEQ ID NO: 764299 - RNA, 15 nt, Homo sapiens
ugcacugugaaggac

SEQ ID NO: 764300 - RNA, 14 nt, Homo sapiens
ugcacuuacuugcu

SEQ ID NO: 764301 - RNA, 18 nt, Homo sapiens
ugcacuuaucuuuuggag

SEQ ID NO: 764302 - RNA, 15 nt, Homo sapiens
ugcacuuauucaaua

SEQ ID NO: 764303 - RNA, 23 nt, Homo sapiens
ugcacuuguggcaacagauaagu

SEQ ID NO: 764304 - RNA, 17 nt, Homo sapiens
ugcacuuuuaaaccucu

SEQ ID NO: 764305 - RNA, 15 nt, Homo sapiens
ugcagaaacuacuga

SEQ ID NO: 764306 - RNA, 14 nt, Homo sapiens
ugcagaagaagcug

SEQ ID NO: 764307 - RNA, 12 nt, Homo sapiens
ugcagaaguauu

SEQ ID NO: 764308 - RNA, 18 nt, Homo sapiens
ugcagaauccaaaguaaa

SEQ ID NO: 764309 - RNA, 23 nt, Homo sapiens
ugcagaaucucuauguauauucu

SEQ ID NO: 764310 - RNA, 14 nt, Homo sapiens
ugcagacaggccau

SEQ ID NO: 764311 - RNA, 21 nt, Homo sapiens
ugcagacuguucuuacuguaa

SEQ ID NO: 764312 - RNA, 15 nt, Homo sapiens
ugcagagcaugaccu

SEQ ID NO: 764313 - RNA, 16 nt, Homo sapiens
ugcagaguaaguauua

SEQ ID NO: 764314 - RNA, 20 nt, Homo sapiens
ugcagagucacucacaccgu

SEQ ID NO: 764315 - RNA, 16 nt, Homo sapiens
ugcagaguccauuucc

SEQ ID NO: 764316 - RNA, 16 nt, Homo sapiens
ugcagauagaaagcau

SEQ ID NO: 764317 - RNA, 14 nt, Homo sapiens
caguucugacacac

SEQ ID NO: 764318 - RNA, 22 nt, Homo sapiens
caguucuguguggauuugucug

SEQ ID NO: 764319 - RNA, 18 nt, Homo sapiens
caguucuuaacccagugu

SEQ ID NO: 764320 - RNA, 19 nt, Homo sapiens
caguucuuaacccaguguc

SEQ ID NO: 764321 - RNA, 17 nt, Homo sapiens
caguugaagcugacuca

SEQ ID NO: 764322 - RNA, 23 nt, Homo sapiens
caguugagcuucauauaccagca

SEQ ID NO: 764323 - RNA, 15 nt, Homo sapiens
caguugcauucauua

SEQ ID NO: 764324 - RNA, 16 nt, Homo sapiens
caguugcccucaggcc

SEQ ID NO: 764325 - RNA, 22 nt, Homo sapiens
caguugcucaaaaagaaaucaa

SEQ ID NO: 764326 - RNA, 15 nt, Homo sapiens
caguugcugaucccu

SEQ ID NO: 764327 - RNA, 14 nt, Homo sapiens
caguugcuuugcag

SEQ ID NO: 764328 - RNA, 14 nt, Homo sapiens
caguuggcuucuaa

SEQ ID NO: 764329 - RNA, 18 nt, Homo sapiens
caguugggauggaaaucu

SEQ ID NO: 764330 - RNA, 18 nt, Homo sapiens
caguugugaauacauucu

SEQ ID NO: 764331 - RNA, 21 nt, Homo sapiens
caguuguuaaaaugagcauug

SEQ ID NO: 764332 - RNA, 22 nt, Homo sapiens
caguuguuaaaaugagcauuga

SEQ ID NO: 764333 - RNA, 21 nt, Homo sapiens
caguuguuuguuuuugcuugu

SEQ ID NO: 764334 - RNA, 22 nt, Homo sapiens
caguuuaaugaacuaccaucug

SEQ ID NO: 764335 - RNA, 21 nt, Homo sapiens
caguuuauauggaaaugcaaa

SEQ ID NO: 764336 - RNA, 20 nt, Homo sapiens
caguuuauggauaugcugcu

SEQ ID NO: 764337 - RNA, 20 nt, Homo sapiens
caguuucagguguuuaguug

SEQ ID NO: 764338 - RNA, 18 nt, Homo sapiens
caguuucuaggcaccuca

SEQ ID NO: 764339 - RNA, 17 nt, Homo sapiens
caguuucucaaacugag

SEQ ID NO: 764340 - RNA, 15 nt, Homo sapiens
caguuugacuguggc

SEQ ID NO: 764341 - RNA, 15 nt, Homo sapiens
caguuugcaccuguc

SEQ ID NO: 764342 - RNA, 14 nt, Homo sapiens
caguuugcuugaua

SEQ ID NO: 764343 - RNA, 20 nt, Homo sapiens
caguuugcuuuguaugcacu

SEQ ID NO: 764344 - RNA, 20 nt, Homo sapiens
caguuuuaccucuucucucu

SEQ ID NO: 764345 - RNA, 23 nt, Homo sapiens
caguuuucaggaugauacacuau

SEQ ID NO: 764346 - RNA, 12 nt, Homo sapiens
caguuuuugccu

SEQ ID NO: 764347 - RNA, 16 nt, Homo sapiens
caguuuuuuucuuugu

SEQ ID NO: 764348 - RNA, 19 nt, Homo sapiens
cauaaaaaauaaaguacca

SEQ ID NO: 764349 - RNA, 16 nt, Homo sapiens
cauaaaaacaacuuua

SEQ ID NO: 764350 - RNA, 20 nt, Homo sapiens
cauaaaauccaauauuguaa

SEQ ID NO: 764351 - RNA, 16 nt, Homo sapiens
cauaaagacaaucacu

SEQ ID NO: 764352 - RNA, 13 nt, Homo sapiens
cauaaagcauuuu

SEQ ID NO: 764353 - RNA, 18 nt, Homo sapiens
cauaaagugaauguuuac

SEQ ID NO: 764354 - RNA, 16 nt, Homo sapiens
cauaaagugucuauaa

SEQ ID NO: 764355 - RNA, 12 nt, Homo sapiens
cauaaaucacaa

SEQ ID NO: 764356 - RNA, 13 nt, Homo sapiens
cauaaaucacaaa

SEQ ID NO: 764357 - RNA, 15 nt, Homo sapiens
cauaaaucacaaaua

SEQ ID NO: 764358 - RNA, 17 nt, Homo sapiens
cauaaaucugucugauu

SEQ ID NO: 764359 - RNA, 22 nt, Homo sapiens
cauaaauuagaggucuccaaaa

SEQ ID NO: 764360 - RNA, 20 nt, Homo sapiens
cauaaccucucugugccauc

SEQ ID NO: 764361 - RNA, 21 nt, Homo sapiens
cauaacugaaaaugugcuaua

SEQ ID NO: 764362 - RNA, 21 nt, Homo sapiens
cauaacugcuucuuggagcuu

SEQ ID NO: 764363 - RNA, 20 nt, Homo sapiens
ugcaguggcgcgaucucagc

SEQ ID NO: 764364 - RNA, 19 nt, Homo sapiens
ugcaguggcgugaucucag

SEQ ID NO: 764365 - RNA, 20 nt, Homo sapiens
ugcaguggcgugaucucagc

SEQ ID NO: 764366 - RNA, 18 nt, Homo sapiens
ugcaguggcgugaucucg

SEQ ID NO: 764367 - RNA, 14 nt, Homo sapiens
ugcaguggugccau

SEQ ID NO: 764368 - RNA, 18 nt, Homo sapiens
ugcaguggugugaucucg

SEQ ID NO: 764369 - RNA, 23 nt, Homo sapiens
ugcaguuauuucaaaaauuugca

SEQ ID NO: 764370 - RNA, 13 nt, Homo sapiens
ugcaguuuggccc

SEQ ID NO: 764371 - RNA, 13 nt, Homo sapiens
ugcauaaagccaa

SEQ ID NO: 764372 - RNA, 18 nt, Homo sapiens
ugcauacagagacagaua

SEQ ID NO: 764373 - RNA, 22 nt, Homo sapiens
ugcauacauauauauuuuuggc

SEQ ID NO: 764374 - RNA, 14 nt, Homo sapiens
ugcauaggaaguau

SEQ ID NO: 764375 - RNA, 13 nt, Homo sapiens
ugcauaucugccu

SEQ ID NO: 764376 - RNA, 23 nt, Homo sapiens
ugcauauguugaccuuugcaaaa

SEQ ID NO: 764377 - RNA, 17 nt, Homo sapiens
ugcaucaauauguauua

SEQ ID NO: 764378 - RNA, 22 nt, Homo sapiens
ugcaucacguaccccacugggc

SEQ ID NO: 764379 - RNA, 19 nt, Homo sapiens
ugcaucaguucauugaccu

SEQ ID NO: 764380 - RNA, 13 nt, Homo sapiens
ugcaucucuaaua

SEQ ID NO: 764381 - RNA, 21 nt, Homo sapiens
ugcaucuuuguuacuuccuua

SEQ ID NO: 764382 - RNA, 23 nt, Homo sapiens
ugcaucuuuguuacuuccuuaug

SEQ ID NO: 764383 - RNA, 16 nt, Homo sapiens
ugcaugacaaaccuua

SEQ ID NO: 764384 - RNA, 22 nt, Homo sapiens
ugcaugcugcccagccacucca

SEQ ID NO: 764385 - RNA, 14 nt, Homo sapiens
ugcaugcuugcaua

SEQ ID NO: 764386 - RNA, 21 nt, Homo sapiens
ugcauggauucagcaugucca

SEQ ID NO: 764387 - RNA, 17 nt, Homo sapiens
ugcauggccucuaagag

SEQ ID NO: 764388 - RNA, 11 nt, Homo sapiens
ugcaugggcuc

SEQ ID NO: 764389 - RNA, 15 nt, Homo sapiens
ugcauguaaaagccu

SEQ ID NO: 764390 - RNA, 15 nt, Homo sapiens
ugcauguaagccaag

SEQ ID NO: 764391 - RNA, 15 nt, Homo sapiens
ugcauguaugacuua

SEQ ID NO: 764392 - RNA, 17 nt, Homo sapiens
ugcauguauuagcucac

SEQ ID NO: 764393 - RNA, 21 nt, Homo sapiens
ugcauguuacauaagauaaau

SEQ ID NO: 764394 - RNA, 19 nt, Homo sapiens
ugcauuaaaacaaaggaag

SEQ ID NO: 764395 - RNA, 18 nt, Homo sapiens
ugcauuaguguugaacca

SEQ ID NO: 764396 - RNA, 14 nt, Homo sapiens
ugcauucucuccca

SEQ ID NO: 764397 - RNA, 17 nt, Homo sapiens
ugcauucuucugagcac

SEQ ID NO: 764398 - RNA, 20 nt, Homo sapiens
ugcauucuucugagcacugu

SEQ ID NO: 764399 - RNA, 17 nt, Homo sapiens
ugcauugccuguaacaa

SEQ ID NO: 764400 - RNA, 21 nt, Homo sapiens
ugcauuggaagaccccaccca

SEQ ID NO: 764401 - RNA, 16 nt, Homo sapiens
ugcauugugaggguua

SEQ ID NO: 764402 - RNA, 19 nt, Homo sapiens
ugcauuuauaugcgcuuaa

SEQ ID NO: 764403 - RNA, 11 nt, Homo sapiens
ugcauuucaac

SEQ ID NO: 764404 - RNA, 19 nt, Homo sapiens
ugcauuuucccagauacuu

SEQ ID NO: 764405 - RNA, 21 nt, Homo sapiens
ugcauuuucccagauacuucc

SEQ ID NO: 764406 - RNA, 14 nt, Homo sapiens
ugcauuuuccucuu

SEQ ID NO: 764407 - RNA, 14 nt, Homo sapiens
ugcauuuuuauuaa

SEQ ID NO: 764408 - RNA, 21 nt, Homo sapiens
ugccaaaaacuaaaauucaac

SEQ ID NO: 764409 - RNA, 15 nt, Homo sapiens
ugccaaaaaucuuuu

SEQ ID NO: 764410 - RNA, 15 nt, Homo sapiens
ugccaaaauaccuuc

SEQ ID NO: 764411 - RNA, 15 nt, Homo sapiens
ugccaaacagccaca

SEQ ID NO: 764412 - RNA, 21 nt, Homo sapiens
ugccaaagugucuacaugugc

SEQ ID NO: 764413 - RNA, 16 nt, Homo sapiens
ugccaaauauguccug

SEQ ID NO: 764414 - RNA, 15 nt, Homo sapiens
ugccaaauguuccau

SEQ ID NO: 764415 - RNA, 13 nt, Homo sapiens
ugccaaccagagc

SEQ ID NO: 764416 - RNA, 18 nt, Homo sapiens
ugccaaccuuauagggau

SEQ ID NO: 764417 - RNA, 17 nt, Homo sapiens
ugccaagacagugaagu

SEQ ID NO: 764418 - RNA, 17 nt, Homo sapiens
ugccaagcacagugccu

SEQ ID NO: 764419 - RNA, 23 nt, Homo sapiens
ugccaagggaggcggauuucccu

SEQ ID NO: 764420 - RNA, 15 nt, Homo sapiens
ugccaauuagcaauu

SEQ ID NO: 764421 - RNA, 13 nt, Homo sapiens
ugccacacugugg

SEQ ID NO: 764422 - RNA, 14 nt, Homo sapiens
ugccaccacccacc

SEQ ID NO: 764423 - RNA, 16 nt, Homo sapiens
ugccaccacucaagca

SEQ ID NO: 764424 - RNA, 19 nt, Homo sapiens
ugccaccaggcacugccug

SEQ ID NO: 764425 - RNA, 18 nt, Homo sapiens
ugccacccaccuuugcca

SEQ ID NO: 764426 - RNA, 23 nt, Homo sapiens
ugccacccaccuuugccacaaag

SEQ ID NO: 764427 - RNA, 15 nt, Homo sapiens
ugccaccccuuccuc

SEQ ID NO: 764428 - RNA, 16 nt, Homo sapiens
ugccacuaaacuacau

SEQ ID NO: 764429 - RNA, 18 nt, Homo sapiens
ugccacuguguacugugg

SEQ ID NO: 764430 - RNA, 19 nt, Homo sapiens
ugccacuguguacugugga

SEQ ID NO: 764431 - RNA, 18 nt, Homo sapiens
ggcugucaccacgugcag

SEQ ID NO: 764432 - RNA, 17 nt, Homo sapiens
ggcuguccauguauuca

SEQ ID NO: 764433 - RNA, 13 nt, Homo sapiens
ggcugugccaacc

SEQ ID NO: 764434 - RNA, 18 nt, Homo sapiens
ggcuguggaccguggaca

SEQ ID NO: 764435 - RNA, 17 nt, Homo sapiens
ggcuguguuaugaaaau

SEQ ID NO: 764436 - RNA, 15 nt, Homo sapiens
ggcuuaaaagcaagu

SEQ ID NO: 764437 - RNA, 13 nt, Homo sapiens
ggcuuaaagggau

SEQ ID NO: 764438 - RNA, 19 nt, Homo sapiens
ggcuuaagugagcagaaca

SEQ ID NO: 764439 - RNA, 16 nt, Homo sapiens
ggcuuaggacuuucca

SEQ ID NO: 764440 - RNA, 13 nt, Homo sapiens
ggcuucacauuca

SEQ ID NO: 764441 - RNA, 14 nt, Homo sapiens
ggcuuccaugccug

SEQ ID NO: 764442 - RNA, 14 nt, Homo sapiens
ggcuucugggagau

SEQ ID NO: 764443 - RNA, 13 nt, Homo sapiens
ggcuugaggccag

SEQ ID NO: 764444 - RNA, 20 nt, Homo sapiens
gcuaaggaccuuaagacaga

SEQ ID NO: 764445 - RNA, 21 nt, Homo sapiens
gcuaaggggaucggacaugaa

SEQ ID NO: 764446 - RNA, 20 nt, Homo sapiens
gcuaaguauuucccagcaca

SEQ ID NO: 764447 - RNA, 15 nt, Homo sapiens
gcuaauaagugcuuu

SEQ ID NO: 764448 - RNA, 19 nt, Homo sapiens
gcuaaucuucuuaugcaau

SEQ ID NO: 764449 - RNA, 14 nt, Homo sapiens
gcuaauguaauaac

SEQ ID NO: 764450 - RNA, 14 nt, Homo sapiens
gcuaauugagacca

SEQ ID NO: 764451 - RNA, 19 nt, Homo sapiens
gcuaauuuugaaugcccuc

SEQ ID NO: 764452 - RNA, 18 nt, Homo sapiens
gcuacaaauuuaugcauu

SEQ ID NO: 764453 - RNA, 23 nt, Homo sapiens
gcuacaguuauuaaucuggacau

SEQ ID NO: 764454 - RNA, 21 nt, Homo sapiens
gcuacauacuccaacugaaau

SEQ ID NO: 764455 - RNA, 22 nt, Homo sapiens
gcuacauugacgagcaugagcu

SEQ ID NO: 764456 - RNA, 14 nt, Homo sapiens
gcuaccacagacuu

SEQ ID NO: 764457 - RNA, 20 nt, Homo sapiens
gcuaccacagacuugcacug

SEQ ID NO: 764458 - RNA, 23 nt, Homo sapiens
gcuaccagguguucuacacucau

SEQ ID NO: 764459 - RNA, 17 nt, Homo sapiens
gcuacccaugacuuuau

SEQ ID NO: 764460 - RNA, 13 nt, Homo sapiens
gcuaccugugagc

SEQ ID NO: 764461 - RNA, 21 nt, Homo sapiens
gcuaccuguugguuagauuca

SEQ ID NO: 764462 - RNA, 19 nt, Homo sapiens
gcuacuaccuagggcacuu

SEQ ID NO: 764463 - RNA, 21 nt, Homo sapiens
gcuacugaugaaaucugcuag

SEQ ID NO: 764464 - RNA, 23 nt, Homo sapiens
gcuacugaugaaaucugcuagaa

SEQ ID NO: 764465 - RNA, 23 nt, Homo sapiens
gcuacuggaaugguguuuuguca

SEQ ID NO: 764466 - RNA, 17 nt, Homo sapiens
ggcacauugcccauggc

SEQ ID NO: 764467 - RNA, 17 nt, Homo sapiens
ggcaccaaccugcauuu

SEQ ID NO: 764468 - RNA, 18 nt, Homo sapiens
ggcaccagacacccagga

SEQ ID NO: 764469 - RNA, 22 nt, Homo sapiens
ggcacccauccgcuccgugacc

SEQ ID NO: 764470 - RNA, 16 nt, Homo sapiens
ggcaccuaauccaggc

SEQ ID NO: 764471 - RNA, 13 nt, Homo sapiens
ggcaccuguggug

SEQ ID NO: 764472 - RNA, 18 nt, Homo sapiens
ggcaccuguguuccagcc

SEQ ID NO: 764473 - RNA, 13 nt, Homo sapiens
ggcacucaggggg

SEQ ID NO: 764474 - RNA, 15 nt, Homo sapiens
ggcacuucauugaga

SEQ ID NO: 764475 - RNA, 19 nt, Homo sapiens
ggcagacugugaacuugac

SEQ ID NO: 764476 - RNA, 15 nt, Homo sapiens
ggcagagccaugggc

SEQ ID NO: 764477 - RNA, 22 nt, Homo sapiens
ggcagagccccuuaaagcugcu

SEQ ID NO: 764478 - RNA, 15 nt, Homo sapiens
ggcagaucacuggag

SEQ ID NO: 764479 - RNA, 17 nt, Homo sapiens
ggcagauuuucaugcaa

SEQ ID NO: 764480 - RNA, 13 nt, Homo sapiens
ggcagcagccagg

SEQ ID NO: 764481 - RNA, 11 nt, Homo sapiens
ggcagcauuuu

SEQ ID NO: 764482 - RNA, 10 nt, Homo sapiens
ggcagccacc

SEQ ID NO: 764483 - RNA, 16 nt, Homo sapiens
ggcagccaucaaagag

SEQ ID NO: 764484 - RNA, 20 nt, Homo sapiens
ggcagccucuccgacucugc

SEQ ID NO: 764485 - RNA, 23 nt, Homo sapiens
ggcagccugaacacucaguugca

SEQ ID NO: 764486 - RNA, 17 nt, Homo sapiens
ggcagcugagcagcuuu

SEQ ID NO: 764487 - RNA, 22 nt, Homo sapiens
ggcagcuggggggcuguccuga

SEQ ID NO: 764488 - RNA, 18 nt, Homo sapiens
ggcaggaacaaacagggc

SEQ ID NO: 764489 - RNA, 19 nt, Homo sapiens
ggcaggaccgccauggugc

SEQ ID NO: 764490 - RNA, 16 nt, Homo sapiens
ggcaggagaauggugu

SEQ ID NO: 764491 - RNA, 21 nt, Homo sapiens
ggcaggaggaucauuugagcu

SEQ ID NO: 764492 - RNA, 21 nt, Homo sapiens
ggcaggaggggugaguccccu

SEQ ID NO: 764493 - RNA, 22 nt, Homo sapiens
ggcaggaguauaugagcauccu

SEQ ID NO: 764494 - RNA, 20 nt, Homo sapiens
ggcaggcugggccaugucca

SEQ ID NO: 764495 - RNA, 17 nt, Homo sapiens
ggcagggcccacgugua

SEQ ID NO: 764496 - RNA, 21 nt, Homo sapiens
ggcagggcugaggccucucau

SEQ ID NO: 764497 - RNA, 21 nt, Homo sapiens
ggcaggggaauuuucucucca

SEQ ID NO: 764498 - RNA, 19 nt, Homo sapiens
ggcaggggugcuguggaca

SEQ ID NO: 764499 - RNA, 15 nt, Homo sapiens
ggcagguccacagag

SEQ ID NO: 764500 - RNA, 15 nt, Homo sapiens
ggcaggucugagaua

SEQ ID NO: 764501 - RNA, 19 nt, Homo sapiens
ggcaguauuuuguguccuc

SEQ ID NO: 764502 - RNA, 15 nt, Homo sapiens
ggcaguccagccagc

SEQ ID NO: 764503 - RNA, 20 nt, Homo sapiens
ggcagucugaacccuugugc

SEQ ID NO: 764504 - RNA, 21 nt, Homo sapiens
ggcagugguguggagaagcca

SEQ ID NO: 764505 - RNA, 15 nt, Homo sapiens
ggcaucucacuuuau

SEQ ID NO: 764506 - RNA, 16 nt, Homo sapiens
ggcaucuccugugcau

SEQ ID NO: 764507 - RNA, 17 nt, Homo sapiens
ggcaugagccacugagc

SEQ ID NO: 764508 - RNA, 20 nt, Homo sapiens
ggcaugagggaucacagggc

SEQ ID NO: 764509 - RNA, 21 nt, Homo sapiens
ggcaugauuagauugcaaagc

SEQ ID NO: 764510 - RNA, 19 nt, Homo sapiens
ggcaugccaaauguuccau

SEQ ID NO: 764511 - RNA, 13 nt, Homo sapiens
ggcauggcaccug

SEQ ID NO: 764512 - RNA, 23 nt, Homo sapiens
ggcauggcaccugucgcccagug

SEQ ID NO: 764513 - RNA, 14 nt, Homo sapiens
ggcauucucugaag

SEQ ID NO: 764514 - RNA, 19 nt, Homo sapiens
ggcauuguccaaaguuuau

SEQ ID NO: 764515 - RNA, 22 nt, Homo sapiens
ggccaacauggugaaacccugu

SEQ ID NO: 764516 - RNA, 22 nt, Homo sapiens
ggccaagcccagcuuaauggcu

SEQ ID NO: 764517 - RNA, 22 nt, Homo sapiens
ggccaaggugggauuuguaaag

SEQ ID NO: 764518 - RNA, 23 nt, Homo sapiens
ggccaauaacuuuucaccaauga

SEQ ID NO: 764519 - RNA, 14 nt, Homo sapiens
ggccacaacagggc

SEQ ID NO: 764520 - RNA, 17 nt, Homo sapiens
ggccacgggggcagugu

SEQ ID NO: 764521 - RNA, 22 nt, Homo sapiens
ggccacugggucucacuccuga

SEQ ID NO: 764522 - RNA, 17 nt, Homo sapiens
ggccacuguggccagag

SEQ ID NO: 764523 - RNA, 14 nt, Homo sapiens
ggccagagggcagu

SEQ ID NO: 764524 - RNA, 16 nt, Homo sapiens
ggccagccacagagca

SEQ ID NO: 764525 - RNA, 14 nt, Homo sapiens
ggccagcccagcca

SEQ ID NO: 764526 - RNA, 20 nt, Homo sapiens
ggccaggacgggccacacgu

SEQ ID NO: 764527 - RNA, 23 nt, Homo sapiens
ggccaggcaacgugcgugucucu

SEQ ID NO: 764528 - RNA, 15 nt, Homo sapiens
ggccaggccagggga

SEQ ID NO: 764529 - RNA, 20 nt, Homo sapiens
ggccaggcuggucuugaacu

SEQ ID NO: 764530 - RNA, 11 nt, Homo sapiens
ggccagggacc

SEQ ID NO: 764531 - RNA, 13 nt, Homo sapiens
ggccagguggcca

SEQ ID NO: 764532 - RNA, 23 nt, Homo sapiens
ggccaggugguugucuuauugca

SEQ ID NO: 764533 - RNA, 18 nt, Homo sapiens
ggccagugccagcaccug

SEQ ID NO: 764534 - RNA, 18 nt, Homo sapiens
ggccauaaagaucaaaca

SEQ ID NO: 764535 - RNA, 23 nt, Homo sapiens
ggccaugauggcaacagaucugg

SEQ ID NO: 764536 - RNA, 17 nt, Homo sapiens
ggccaugccacccuguu

SEQ ID NO: 764537 - RNA, 22 nt, Homo sapiens
ggccauggaagguucucugugc

SEQ ID NO: 764538 - RNA, 18 nt, Homo sapiens
ggccauggcucagggugg

SEQ ID NO: 764539 - RNA, 14 nt, Homo sapiens
ggccauguccaaag

SEQ ID NO: 764540 - RNA, 15 nt, Homo sapiens
ggccauguccaaaga

SEQ ID NO: 764541 - RNA, 17 nt, Homo sapiens
ggcccacuucaccguac

SEQ ID NO: 764542 - RNA, 12 nt, Homo sapiens
ggcccagaaaca

SEQ ID NO: 764543 - RNA, 20 nt, Homo sapiens
ggcccagcuguagccauggc

SEQ ID NO: 764544 - RNA, 16 nt, Homo sapiens
ggcccaggaccagcug

SEQ ID NO: 764545 - RNA, 12 nt, Homo sapiens
ggcccagugcau

SEQ ID NO: 764546 - RNA, 18 nt, Homo sapiens
ggcccaguucacccugau

SEQ ID NO: 764547 - RNA, 23 nt, Homo sapiens
ggccccacccgggagugaugguu

SEQ ID NO: 764548 - RNA, 17 nt, Homo sapiens
ggccccaccggggucua

SEQ ID NO: 764549 - RNA, 12 nt, Homo sapiens
ggccccaucucu

SEQ ID NO: 764550 - RNA, 22 nt, Homo sapiens
ggcccccaugcaaggugcccac

SEQ ID NO: 764551 - RNA, 13 nt, Homo sapiens
ggccccgggcugg

SEQ ID NO: 764552 - RNA, 17 nt, Homo sapiens
ggccccucccacaccca

SEQ ID NO: 764553 - RNA, 17 nt, Homo sapiens
ggcccgcaccccggccu

SEQ ID NO: 764554 - RNA, 15 nt, Homo sapiens
ggcccggacucacca

SEQ ID NO: 764555 - RNA, 23 nt, Homo sapiens
ggcccggccagcgggcacagggc

SEQ ID NO: 764556 - RNA, 14 nt, Homo sapiens
ggcccggccggccu

SEQ ID NO: 764557 - RNA, 23 nt, Homo sapiens
ggcccgugacauccccacccuug

SEQ ID NO: 764558 - RNA, 19 nt, Homo sapiens
ggcccuaaguuaagcaaaa

SEQ ID NO: 764559 - RNA, 14 nt, Homo sapiens
ggcccucagugaga

SEQ ID NO: 764560 - RNA, 18 nt, Homo sapiens
ggcccucccuuuucccau

SEQ ID NO: 764561 - RNA, 19 nt, Homo sapiens
ggcccucuguccacaugug

SEQ ID NO: 764562 - RNA, 15 nt, Homo sapiens
ggcccugagcucggu

SEQ ID NO: 764563 - RNA, 18 nt, Homo sapiens
ggcccugccguuuccccu

SEQ ID NO: 764564 - RNA, 13 nt, Homo sapiens
ggcccugcugagu

SEQ ID NO: 764565 - RNA, 20 nt, Homo sapiens
gcccuugggguaagccagag

SEQ ID NO: 764566 - RNA, 18 nt, Homo sapiens
gcccuuuccccccauguu

SEQ ID NO: 764567 - RNA, 16 nt, Homo sapiens
gccgacagcucuccaa

SEQ ID NO: 764568 - RNA, 19 nt, Homo sapiens
gccgagaccccaucuucca

SEQ ID NO: 764569 - RNA, 19 nt, Homo sapiens
gccgagccugcacuggggc

SEQ ID NO: 764570 - RNA, 17 nt, Homo sapiens
gccgccaggacuguguu

SEQ ID NO: 764571 - RNA, 14 nt, Homo sapiens
gccgccugcuccuc

SEQ ID NO: 764572 - RNA, 21 nt, Homo sapiens
gccggaaaaggcgcaucuaac

SEQ ID NO: 764573 - RNA, 14 nt, Homo sapiens
gccggaaucucagc

SEQ ID NO: 764574 - RNA, 13 nt, Homo sapiens
gccggacguggug

SEQ ID NO: 764575 - RNA, 19 nt, Homo sapiens
gccgggcaccaacuccaug

SEQ ID NO: 764576 - RNA, 15 nt, Homo sapiens
gccggucccccaugc

SEQ ID NO: 764577 - RNA, 22 nt, Homo sapiens
gccguguucaaagagcaauauu

SEQ ID NO: 764578 - RNA, 17 nt, Homo sapiens
gccuaaaucccaagaaa

SEQ ID NO: 764579 - RNA, 16 nt, Homo sapiens
gccuaacuaacuggca

SEQ ID NO: 764580 - RNA, 16 nt, Homo sapiens
gccuaccucagccucc

SEQ ID NO: 764581 - RNA, 16 nt, Homo sapiens
gccuacguuaacccau

SEQ ID NO: 764582 - RNA, 23 nt, Homo sapiens
gccuagauccacacacagaggaa

SEQ ID NO: 764583 - RNA, 16 nt, Homo sapiens
gccuagccgaccucag

SEQ ID NO: 764584 - RNA, 22 nt, Homo sapiens
gccuagcgaucucuccuggccu

SEQ ID NO: 764585 - RNA, 20 nt, Homo sapiens
gccuauaaucccagcuacug

SEQ ID NO: 764586 - RNA, 18 nt, Homo sapiens
gccuauaucaaacaugca

SEQ ID NO: 764587 - RNA, 16 nt, Homo sapiens
gccuaucagcauuuua

SEQ ID NO: 764588 - RNA, 15 nt, Homo sapiens
gccucaaugccagua

SEQ ID NO: 764589 - RNA, 15 nt, Homo sapiens
gccucagcuucucaa

SEQ ID NO: 764590 - RNA, 14 nt, Homo sapiens
gccucagugccacu

SEQ ID NO: 764591 - RNA, 15 nt, Homo sapiens
gccucauuugaaugu

SEQ ID NO: 764592 - RNA, 16 nt, Homo sapiens
gccuccaaaauauuaa

SEQ ID NO: 764593 - RNA, 16 nt, Homo sapiens
gccuccaaacacagau

SEQ ID NO: 764594 - RNA, 22 nt, Homo sapiens
gccuccaaggaaacuuugccaa

SEQ ID NO: 764595 - RNA, 16 nt, Homo sapiens
gccuccaccaccacug

SEQ ID NO: 764596 - RNA, 17 nt, Homo sapiens
gccuccaccgagccagc

SEQ ID NO: 764597 - RNA, 13 nt, Homo sapiens
gccuccacuuccc

SEQ ID NO: 764598 - RNA, 13 nt, Homo sapiens
gccuccagggcau

SEQ ID NO: 764599 - RNA, 20 nt, Homo sapiens
gccuccauggcagaagucaa

SEQ ID NO: 764600 - RNA, 14 nt, Homo sapiens
gccucccaagcacc

SEQ ID NO: 764601 - RNA, 17 nt, Homo sapiens
gccuccccgugccaaaa

SEQ ID NO: 764602 - RNA, 16 nt, Homo sapiens
gccucccuggggacca

SEQ ID NO: 764603 - RNA, 19 nt, Homo sapiens
gccuccggcgucuugccca

SEQ ID NO: 764604 - RNA, 21 nt, Homo sapiens
gccuccucacccaccucuuca

SEQ ID NO: 764605 - RNA, 22 nt, Homo sapiens
gccuccucccugggcagaaagu

SEQ ID NO: 764606 - RNA, 21 nt, Homo sapiens
gccuccucucucaaacugggg

SEQ ID NO: 764607 - RNA, 16 nt, Homo sapiens
gccuccugaguagaug

SEQ ID NO: 764608 - RNA, 17 nt, Homo sapiens
gccuccugcugccacaa

SEQ ID NO: 764609 - RNA, 18 nt, Homo sapiens
gccucgcagccuccggaa

SEQ ID NO: 764610 - RNA, 14 nt, Homo sapiens
gccucuacuuugau

SEQ ID NO: 764611 - RNA, 15 nt, Homo sapiens
gccucucccaucacu

SEQ ID NO: 764612 - RNA, 15 nt, Homo sapiens
gccucucucugccug

SEQ ID NO: 764613 - RNA, 16 nt, Homo sapiens
gccucugaaaugccuc

SEQ ID NO: 764614 - RNA, 15 nt, Homo sapiens
gccucugaacccccu

SEQ ID NO: 764615 - RNA, 16 nt, Homo sapiens
gccucugccugcauuc

SEQ ID NO: 764616 - RNA, 17 nt, Homo sapiens
gccucuucucugaugac

SEQ ID NO: 764617 - RNA, 13 nt, Homo sapiens
gccugaacacuca

SEQ ID NO: 764618 - RNA, 16 nt, Homo sapiens
gccugaacauccuucc

SEQ ID NO: 764619 - RNA, 21 nt, Homo sapiens
gccugaagucccagcauugau

SEQ ID NO: 764620 - RNA, 23 nt, Homo sapiens
gccugacauggacccacuacccu

SEQ ID NO: 764621 - RNA, 13 nt, Homo sapiens
gccugacgcauuc

SEQ ID NO: 764622 - RNA, 17 nt, Homo sapiens
gccugagcuggggccac

SEQ ID NO: 764623 - RNA, 13 nt, Homo sapiens
gccugagucaccu

SEQ ID NO: 764624 - RNA, 18 nt, Homo sapiens
gccugaucuccaggcaaa

SEQ ID NO: 764625 - RNA, 18 nt, Homo sapiens
gccugaugcucccucccc

SEQ ID NO: 764626 - RNA, 12 nt, Homo sapiens
gccugcacacac

SEQ ID NO: 764627 - RNA, 14 nt, Homo sapiens
gccugcaccuggug

SEQ ID NO: 764628 - RNA, 13 nt, Homo sapiens
gccugcacugaga

SEQ ID NO: 764629 - RNA, 15 nt, Homo sapiens
gccugcagagugcaa

SEQ ID NO: 764630 - RNA, 17 nt, Homo sapiens
gccugcccaacguggug

SEQ ID NO: 764631 - RNA, 17 nt, Homo sapiens
gccugccccgacaccca

SEQ ID NO: 764632 - RNA, 23 nt, Homo sapiens
gccugccgaaaacaggagcaaau

SEQ ID NO: 764633 - RNA, 13 nt, Homo sapiens
gccugccuugaag

SEQ ID NO: 764634 - RNA, 19 nt, Homo sapiens
gccugcuggcugcggcccc

SEQ ID NO: 764635 - RNA, 15 nt, Homo sapiens
gccugcuggggaccu

SEQ ID NO: 764636 - RNA, 23 nt, Homo sapiens
gccugcuuggcccggccggccug

SEQ ID NO: 764637 - RNA, 15 nt, Homo sapiens
gccuggaacaccagc

SEQ ID NO: 764638 - RNA, 14 nt, Homo sapiens
gccuggacugacca

SEQ ID NO: 764639 - RNA, 16 nt, Homo sapiens
gccuggacuuuccugc

SEQ ID NO: 764640 - RNA, 17 nt, Homo sapiens
gccuggacuuuccugca

SEQ ID NO: 764641 - RNA, 20 nt, Homo sapiens
gccuggagacaaggugcuaa

SEQ ID NO: 764642 - RNA, 20 nt, Homo sapiens
gccuggaguguaugacugca

SEQ ID NO: 764643 - RNA, 20 nt, Homo sapiens
gccuggauucauuuccugcc

SEQ ID NO: 764644 - RNA, 20 nt, Homo sapiens
gccuggcagccgugccuuca

SEQ ID NO: 764645 - RNA, 22 nt, Homo sapiens
gccuggcccaccuuccccagaa

SEQ ID NO: 764646 - RNA, 15 nt, Homo sapiens
gccuggcuggcacag

SEQ ID NO: 764647 - RNA, 14 nt, Homo sapiens
gccugggacccagc

SEQ ID NO: 764648 - RNA, 16 nt, Homo sapiens
gccugggcaacaacag

SEQ ID NO: 764649 - RNA, 22 nt, Homo sapiens
gccugggcugccgggaaccuca

SEQ ID NO: 764650 - RNA, 21 nt, Homo sapiens
gccuggggcgagcacugugag

SEQ ID NO: 764651 - RNA, 14 nt, Homo sapiens
gccugggugacaga

SEQ ID NO: 764652 - RNA, 22 nt, Homo sapiens
gccuguaaacuaaaaucuguua

SEQ ID NO: 764653 - RNA, 15 nt, Homo sapiens
gccuguaacaaugua

SEQ ID NO: 764654 - RNA, 15 nt, Homo sapiens
gccuguaacacuccu

SEQ ID NO: 764655 - RNA, 15 nt, Homo sapiens
cagcugagcagcuuu

SEQ ID NO: 764656 - RNA, 23 nt, Homo sapiens
cagcugagguucccgacaccaga

SEQ ID NO: 764657 - RNA, 15 nt, Homo sapiens
cagcugcaccugcca

SEQ ID NO: 764658 - RNA, 18 nt, Homo sapiens
cagcugcagaugccacac

SEQ ID NO: 764659 - RNA, 20 nt, Homo sapiens
cagcugcagucaacaguuca

SEQ ID NO: 764660 - RNA, 14 nt, Homo sapiens
cagcugccaaggaa

SEQ ID NO: 764661 - RNA, 22 nt, Homo sapiens
cagcugccccuggcaccugugu

SEQ ID NO: 764662 - RNA, 19 nt, Homo sapiens
cagcugccucugccacuga

SEQ ID NO: 764663 - RNA, 19 nt, Homo sapiens
cagcugccuuggacugugu

SEQ ID NO: 764664 - RNA, 22 nt, Homo sapiens
cagcugccuuuuaagaggucuu

SEQ ID NO: 764665 - RNA, 12 nt, Homo sapiens
cagcugcugaag

SEQ ID NO: 764666 - RNA, 12 nt, Homo sapiens
cagcugcugacu

SEQ ID NO: 764667 - RNA, 21 nt, Homo sapiens
cagcugcugggacccaccucc

SEQ ID NO: 764668 - RNA, 17 nt, Homo sapiens
cagcugcuuuugcauuu

SEQ ID NO: 764669 - RNA, 19 nt, Homo sapiens
cagcuggaagggucaacau

SEQ ID NO: 764670 - RNA, 16 nt, Homo sapiens
cagcuggaggcugcug

SEQ ID NO: 764671 - RNA, 14 nt, Homo sapiens
cagcuggcucugac

SEQ ID NO: 764672 - RNA, 13 nt, Homo sapiens
cagcugggagcac

SEQ ID NO: 764673 - RNA, 19 nt, Homo sapiens
cagcugggccagcaagcac

SEQ ID NO: 764674 - RNA, 11 nt, Homo sapiens
cagcugggcuc

SEQ ID NO: 764675 - RNA, 13 nt, Homo sapiens
cagcuggggagca

SEQ ID NO: 764676 - RNA, 21 nt, Homo sapiens
cagcuguauugucugaacuug

SEQ ID NO: 764677 - RNA, 20 nt, Homo sapiens
cagcuguccacugggccauu

SEQ ID NO: 764678 - RNA, 18 nt, Homo sapiens
cagcugugagaagucacu

SEQ ID NO: 764679 - RNA, 15 nt, Homo sapiens
cagcugugcacuuuc

SEQ ID NO: 764680 - RNA, 21 nt, Homo sapiens
cagcugugcacuuucuucucu

SEQ ID NO: 764681 - RNA, 18 nt, Homo sapiens
cagcugugggacaauuau

SEQ ID NO: 764682 - RNA, 12 nt, Homo sapiens
cagcuuaucucu

SEQ ID NO: 764683 - RNA, 16 nt, Homo sapiens
cagcuucaaaugcaaa

SEQ ID NO: 764684 - RNA, 21 nt, Homo sapiens
cagcuucaccagagcauuucc

SEQ ID NO: 764685 - RNA, 15 nt, Homo sapiens
cagcuucacucgaca

SEQ ID NO: 764686 - RNA, 22 nt, Homo sapiens
cagcuucuaaucccagcacuuu

SEQ ID NO: 764687 - RNA, 19 nt, Homo sapiens
cagcuucucucuccagggu

SEQ ID NO: 764688 - RNA, 12 nt, Homo sapiens
cagcuugcacau

SEQ ID NO: 764689 - RNA, 16 nt, Homo sapiens
cagcuugcucuucagu

SEQ ID NO: 764690 - RNA, 20 nt, Homo sapiens
cagcuuggggccaccaaagc

SEQ ID NO: 764691 - RNA, 17 nt, Homo sapiens
cagcuuucaagugccuu

SEQ ID NO: 764692 - RNA, 19 nt, Homo sapiens
cagcuuugcuaccaaagca

SEQ ID NO: 764693 - RNA, 18 nt, Homo sapiens
cagcuuugggguuccuuu

SEQ ID NO: 764694 - RNA, 16 nt, Homo sapiens
cagcuuuugcaacuua

SEQ ID NO: 764695 - RNA, 19 nt, Homo sapiens
cagcuuuuguuguuuauau

SEQ ID NO: 764696 - RNA, 22 nt, Homo sapiens
caggaaacaguugcauguagua

SEQ ID NO: 764697 - RNA, 17 nt, Homo sapiens
caggaaacuaauuuccu

SEQ ID NO: 764698 - RNA, 20 nt, Homo sapiens
caggaaagcuggugucugau

SEQ ID NO: 764699 - RNA, 21 nt, Homo sapiens
caggaaagcuggugucugauu

SEQ ID NO: 764700 - RNA, 20 nt, Homo sapiens
caggaaagcuguuaggcuca

SEQ ID NO: 764701 - RNA, 19 nt, Homo sapiens
caggaaauaaauuguaaaa

SEQ ID NO: 764702 - RNA, 17 nt, Homo sapiens
caggaacguuucugaac

SEQ ID NO: 764703 - RNA, 12 nt, Homo sapiens
caggaagccugu

SEQ ID NO: 764704 - RNA, 17 nt, Homo sapiens
caggaagcucucuuaaa

SEQ ID NO: 764705 - RNA, 21 nt, Homo sapiens
caggaagggcaggaaggagag

SEQ ID NO: 764706 - RNA, 23 nt, Homo sapiens
caggaagggggccgccacccucc

SEQ ID NO: 764707 - RNA, 21 nt, Homo sapiens
caggaagguagcccagcacug

SEQ ID NO: 764708 - RNA, 18 nt, Homo sapiens
caggaagugucuagagga

SEQ ID NO: 764709 - RNA, 14 nt, Homo sapiens
caggaauacauuug

SEQ ID NO: 764710 - RNA, 14 nt, Homo sapiens
caggaauacugaac

SEQ ID NO: 764711 - RNA, 16 nt, Homo sapiens
caggaauaugacacaa

SEQ ID NO: 764712 - RNA, 15 nt, Homo sapiens
caggaauauuuucca

SEQ ID NO: 764713 - RNA, 23 nt, Homo sapiens
caggaauuaugucguaagucacu

SEQ ID NO: 764714 - RNA, 23 nt, Homo sapiens
caggaauuucccaggacccugaa

SEQ ID NO: 764715 - RNA, 20 nt, Homo sapiens
caggacaacuuuacaaaaca

SEQ ID NO: 764716 - RNA, 17 nt, Homo sapiens
caggacacgacuuguaa

SEQ ID NO: 764717 - RNA, 21 nt, Homo sapiens
caggacacggggcaguggcaa

SEQ ID NO: 764718 - RNA, 16 nt, Homo sapiens
caggacagaaagaucu

SEQ ID NO: 764719 - RNA, 15 nt, Homo sapiens
caggaccaagccaca

SEQ ID NO: 764720 - RNA, 22 nt, Homo sapiens
caggaccaccacuuauagggua

SEQ ID NO: 764721 - RNA, 17 nt, Homo sapiens
caggaccacucaguuaa

SEQ ID NO: 764722 - RNA, 17 nt, Homo sapiens
caggaccagcucaggac

SEQ ID NO: 764723 - RNA, 15 nt, Homo sapiens
caggaccaguuugau

SEQ ID NO: 764724 - RNA, 14 nt, Homo sapiens
caggacccucagga

SEQ ID NO: 764725 - RNA, 19 nt, Homo sapiens
caggaccgccauggugcug

SEQ ID NO: 764726 - RNA, 15 nt, Homo sapiens
caggaccuacuagga

SEQ ID NO: 764727 - RNA, 15 nt, Homo sapiens
caggaccuugggcac

SEQ ID NO: 764728 - RNA, 19 nt, Homo sapiens
caggacucugacgucucuu

SEQ ID NO: 764729 - RNA, 22 nt, Homo sapiens
caggacugaguccccuccagga

SEQ ID NO: 764730 - RNA, 20 nt, Homo sapiens
caggacugggugguccaaag

SEQ ID NO: 764731 - RNA, 22 nt, Homo sapiens
caggacuguuuuauaaacugcu

SEQ ID NO: 764732 - RNA, 20 nt, Homo sapiens
caggacuugagaagaccuca

SEQ ID NO: 764733 - RNA, 20 nt, Homo sapiens
caggacuuggaaguggggac

SEQ ID NO: 764734 - RNA, 17 nt, Homo sapiens
caggacuuggucugauu

SEQ ID NO: 764735 - RNA, 16 nt, Homo sapiens
caggagaagaacaaga

SEQ ID NO: 764736 - RNA, 13 nt, Homo sapiens
caggagaaucacu

SEQ ID NO: 764737 - RNA, 18 nt, Homo sapiens
caggagaauggugugaac

SEQ ID NO: 764738 - RNA, 17 nt, Homo sapiens
caggagaauuacuugaa

SEQ ID NO: 764739 - RNA, 15 nt, Homo sapiens
caggagaauugcuug

SEQ ID NO: 764740 - RNA, 14 nt, Homo sapiens
caggagacauuggu

SEQ ID NO: 764741 - RNA, 19 nt, Homo sapiens
caggagacuccaaggagcu

SEQ ID NO: 764742 - RNA, 15 nt, Homo sapiens
cagcacuacucugug

SEQ ID NO: 764743 - RNA, 19 nt, Homo sapiens
cagcacucacgcaccggag

SEQ ID NO: 764744 - RNA, 19 nt, Homo sapiens
cagcacucuuaucuacaua

SEQ ID NO: 764745 - RNA, 20 nt, Homo sapiens
cagcacuggugaacugagcu

SEQ ID NO: 764746 - RNA, 11 nt, Homo sapiens
cagcacuuugg

SEQ ID NO: 764747 - RNA, 19 nt, Homo sapiens
cagcacuuugguaggcaaa

SEQ ID NO: 764748 - RNA, 16 nt, Homo sapiens
cagcagaaaaucuuuu

SEQ ID NO: 764749 - RNA, 18 nt, Homo sapiens
cagcagacugguuugcag

SEQ ID NO: 764750 - RNA, 15 nt, Homo sapiens
cagcagagcauucag

SEQ ID NO: 764751 - RNA, 17 nt, Homo sapiens
cagcagaucauuuagga

SEQ ID NO: 764752 - RNA, 16 nt, Homo sapiens
cagcagaucccagcuc

SEQ ID NO: 764753 - RNA, 13 nt, Homo sapiens
cagcagauuucca

SEQ ID NO: 764754 - RNA, 14 nt, Homo sapiens
cagcagcacuggaa

SEQ ID NO: 764755 - RNA, 15 nt, Homo sapiens
cagcagcacuguucu

SEQ ID NO: 764756 - RNA, 15 nt, Homo sapiens
cagcagcagcucaca

SEQ ID NO: 764757 - RNA, 23 nt, Homo sapiens
cagcagcccuaaggaucucucag

SEQ ID NO: 764758 - RNA, 21 nt, Homo sapiens
cagcagcucaggcacacuucu

SEQ ID NO: 764759 - RNA, 16 nt, Homo sapiens
cagcaggcccagcaug

SEQ ID NO: 764760 - RNA, 19 nt, Homo sapiens
cagcaggcuccuggcugug

SEQ ID NO: 764761 - RNA, 17 nt, Homo sapiens
cagcagguggaaugugu

SEQ ID NO: 764762 - RNA, 14 nt, Homo sapiens
cagcagugaaugcu

SEQ ID NO: 764763 - RNA, 17 nt, Homo sapiens
cagcagugaucucaggg

SEQ ID NO: 764764 - RNA, 17 nt, Homo sapiens
cagcagugucacucugu

SEQ ID NO: 764765 - RNA, 14 nt, Homo sapiens
cagcaguuguucca

SEQ ID NO: 764766 - RNA, 19 nt, Homo sapiens
cagcauacccuuacucugc

SEQ ID NO: 764767 - RNA, 13 nt, Homo sapiens
cagcauacgucag

SEQ ID NO: 764768 - RNA, 21 nt, Homo sapiens
cagcauagggucacuuugcca

SEQ ID NO: 764769 - RNA, 10 nt, Homo sapiens
cagcaucuga

SEQ ID NO: 764770 - RNA, 16 nt, Homo sapiens
cagcaucugaccaucu

SEQ ID NO: 764771 - RNA, 23 nt, Homo sapiens
cagcaugaggacagaccacagag

SEQ ID NO: 764772 - RNA, 16 nt, Homo sapiens
cagcauuauucuucag

SEQ ID NO: 764773 - RNA, 19 nt, Homo sapiens
cagcauuauucuucagaag

SEQ ID NO: 764774 - RNA, 18 nt, Homo sapiens
cagccaaacccugucuga

SEQ ID NO: 764775 - RNA, 15 nt, Homo sapiens
cagccaacuuuugca

SEQ ID NO: 764776 - RNA, 18 nt, Homo sapiens
cagccaaucuagaggcaa

SEQ ID NO: 764777 - RNA, 13 nt, Homo sapiens
cagccacacuggg

SEQ ID NO: 764778 - RNA, 15 nt, Homo sapiens
cagccacgacugcca

SEQ ID NO: 764779 - RNA, 16 nt, Homo sapiens
cagccacgacugccau

SEQ ID NO: 764780 - RNA, 13 nt, Homo sapiens
cagccacugaggg

SEQ ID NO: 764781 - RNA, 14 nt, Homo sapiens
cagccagacuggca

SEQ ID NO: 764782 - RNA, 16 nt, Homo sapiens
cagccagggcugccag

SEQ ID NO: 764783 - RNA, 19 nt, Homo sapiens
cagccauaagaaagcacua

SEQ ID NO: 764784 - RNA, 16 nt, Homo sapiens
cagcccaacagcacuu

SEQ ID NO: 764785 - RNA, 17 nt, Homo sapiens
cagcccaacagcacuuu

SEQ ID NO: 764786 - RNA, 14 nt, Homo sapiens
cagcccaaccuuca

SEQ ID NO: 764787 - RNA, 16 nt, Homo sapiens
cagcccacguucucuc

SEQ ID NO: 764788 - RNA, 17 nt, Homo sapiens
cagcccagagacuuugu

SEQ ID NO: 764789 - RNA, 13 nt, Homo sapiens
cagcccagugcaa

SEQ ID NO: 764790 - RNA, 14 nt, Homo sapiens
cagcccagugcaaa

SEQ ID NO: 764791 - RNA, 23 nt, Homo sapiens
cagcccauggugagcucugggaa

SEQ ID NO: 764792 - RNA, 11 nt, Homo sapiens
cagcccauucu

SEQ ID NO: 764793 - RNA, 13 nt, Homo sapiens
cagcccauugcug

SEQ ID NO: 764794 - RNA, 16 nt, Homo sapiens
cagcccauugcugcca

SEQ ID NO: 764795 - RNA, 19 nt, Homo sapiens
cagccccuuauuugcacuu

SEQ ID NO: 764796 - RNA, 16 nt, Homo sapiens
cagcccggcacuccag

SEQ ID NO: 764797 - RNA, 18 nt, Homo sapiens
cagcccgggucaucugua

SEQ ID NO: 764798 - RNA, 20 nt, Homo sapiens
cagcccucccuggcugugag

SEQ ID NO: 764799 - RNA, 21 nt, Homo sapiens
cagcccucccuggcugugagc

SEQ ID NO: 764800 - RNA, 13 nt, Homo sapiens
cagcccugcacca

SEQ ID NO: 764801 - RNA, 16 nt, Homo sapiens
cagcccugcaccaugc

SEQ ID NO: 764802 - RNA, 19 nt, Homo sapiens
cagcccuggcaacugcuaa

SEQ ID NO: 764803 - RNA, 15 nt, Homo sapiens
cagcccuugugaugu

SEQ ID NO: 764804 - RNA, 20 nt, Homo sapiens
cagccggcuaugaaagggag

SEQ ID NO: 764805 - RNA, 21 nt, Homo sapiens
cagccgucccgcguucaagac

SEQ ID NO: 764806 - RNA, 19 nt, Homo sapiens
cagccgugaucaagggaau

SEQ ID NO: 764807 - RNA, 23 nt, Homo sapiens
cagccucacuugaaugugucacu

SEQ ID NO: 764808 - RNA, 15 nt, Homo sapiens
cagccucagugccac

SEQ ID NO: 764809 - RNA, 19 nt, Homo sapiens
cagccucagugccacuuga

SEQ ID NO: 764810 - RNA, 15 nt, Homo sapiens
cagccucauccugag

SEQ ID NO: 764811 - RNA, 19 nt, Homo sapiens
cagccuccaccuugcucuu

SEQ ID NO: 764812 - RNA, 20 nt, Homo sapiens
cagccucccaaguagcugag

SEQ ID NO: 764813 - RNA, 19 nt, Homo sapiens
cagccuccccgugccaaaa

SEQ ID NO: 764814 - RNA, 18 nt, Homo sapiens
cagccucccugaagccuu

SEQ ID NO: 764815 - RNA, 20 nt, Homo sapiens
cagccuccugaguagcugga

SEQ ID NO: 764816 - RNA, 22 nt, Homo sapiens
cagccuccuuuguguguauuca

SEQ ID NO: 764817 - RNA, 19 nt, Homo sapiens
cagccucucgaagugcuga

SEQ ID NO: 764818 - RNA, 15 nt, Homo sapiens
cagccucucugcuau

SEQ ID NO: 764819 - RNA, 14 nt, Homo sapiens
cagccucugccagc

SEQ ID NO: 764820 - RNA, 14 nt, Homo sapiens
cagccugauggcca

SEQ ID NO: 764821 - RNA, 19 nt, Homo sapiens
cagccugcacacaccugcc

SEQ ID NO: 764822 - RNA, 19 nt, Homo sapiens
cagccuggccacgcagcca

SEQ ID NO: 764823 - RNA, 20 nt, Homo sapiens
cagccugggcaacacagcga

SEQ ID NO: 764824 - RNA, 18 nt, Homo sapiens
cagccugggcaacagagc

SEQ ID NO: 764825 - RNA, 16 nt, Homo sapiens
cagccuggggugaccu

SEQ ID NO: 764826 - RNA, 23 nt, Homo sapiens
cagccugggugacagugcaagac

SEQ ID NO: 764827 - RNA, 22 nt, Homo sapiens
cagccugugguuacagugcaga

SEQ ID NO: 764828 - RNA, 22 nt, Homo sapiens
auuucauuaucauaugaacuug

SEQ ID NO: 764829 - RNA, 13 nt, Homo sapiens
auuucauucugaa

SEQ ID NO: 764830 - RNA, 15 nt, Homo sapiens
auuucauuuccagca

SEQ ID NO: 764831 - RNA, 23 nt, Homo sapiens
auuuccaaaacuuuaaugaacua

SEQ ID NO: 764832 - RNA, 17 nt, Homo sapiens
auuuccaaauucacaag

SEQ ID NO: 764833 - RNA, 14 nt, Homo sapiens
auuuccaacaccac

SEQ ID NO: 764834 - RNA, 15 nt, Homo sapiens
auuuccaacaccaca

SEQ ID NO: 764835 - RNA, 18 nt, Homo sapiens
auuuccaacaccacagac

SEQ ID NO: 764836 - RNA, 23 nt, Homo sapiens
auuuccaagcacuuucaguccaa

SEQ ID NO: 764837 - RNA, 22 nt, Homo sapiens
auuuccagaaccacacuugaaa

SEQ ID NO: 764838 - RNA, 11 nt, Homo sapiens
auuuccagugg

SEQ ID NO: 764839 - RNA, 21 nt, Homo sapiens
auuuccaugggccccaccauu

SEQ ID NO: 764840 - RNA, 19 nt, Homo sapiens
auuucccauuugugccaga

SEQ ID NO: 764841 - RNA, 16 nt, Homo sapiens
auuuccccagccacag

SEQ ID NO: 764842 - RNA, 20 nt, Homo sapiens
auuuccccagccacaggcca

SEQ ID NO: 764843 - RNA, 20 nt, Homo sapiens
auuucccuucauacuccuuu

SEQ ID NO: 764844 - RNA, 20 nt, Homo sapiens
auuuccuacagaaauacugc

SEQ ID NO: 764845 - RNA, 22 nt, Homo sapiens
auuuccuauuguucacuuuauu

SEQ ID NO: 764846 - RNA, 22 nt, Homo sapiens
auuuccuccucccagugccuuc

SEQ ID NO: 764847 - RNA, 14 nt, Homo sapiens
auuuccuguucccu

SEQ ID NO: 764848 - RNA, 20 nt, Homo sapiens
auuuccuuacagaacuacuu

SEQ ID NO: 764849 - RNA, 21 nt, Homo sapiens
auuuccuuacagaacuacuuc

SEQ ID NO: 764850 - RNA, 13 nt, Homo sapiens
auuuccuugccuu

SEQ ID NO: 764851 - RNA, 22 nt, Homo sapiens
auuuccuuuguugucuacauua

SEQ ID NO: 764852 - RNA, 20 nt, Homo sapiens
auuuccuuuuugacacugaa

SEQ ID NO: 764853 - RNA, 16 nt, Homo sapiens
auuucuaccuaaguca

SEQ ID NO: 764854 - RNA, 13 nt, Homo sapiens
auuucuaucagcc

SEQ ID NO: 764855 - RNA, 18 nt, Homo sapiens
auuucucauaucaacuua

SEQ ID NO: 764856 - RNA, 14 nt, Homo sapiens
auuucuccaaagcc

SEQ ID NO: 764857 - RNA, 16 nt, Homo sapiens
auuucuccaaagccuu

SEQ ID NO: 764858 - RNA, 23 nt, Homo sapiens
auuucucccuguuauaagcagca

SEQ ID NO: 764859 - RNA, 16 nt, Homo sapiens
auuucugaacuguuac

SEQ ID NO: 764860 - RNA, 14 nt, Homo sapiens
auuucugacucuau

SEQ ID NO: 764861 - RNA, 17 nt, Homo sapiens
auuucugacucuaucau

SEQ ID NO: 764862 - RNA, 18 nt, Homo sapiens
auuucugaucuauacaaa

SEQ ID NO: 764863 - RNA, 11 nt, Homo sapiens
auuucugccag

SEQ ID NO: 764864 - RNA, 22 nt, Homo sapiens
auuucugucucuaaccauucaa

SEQ ID NO: 764865 - RNA, 22 nt, Homo sapiens
auuucuguuauggggacuuuau

SEQ ID NO: 764866 - RNA, 17 nt, Homo sapiens
auuucuguuuugcauau

SEQ ID NO: 764867 - RNA, 17 nt, Homo sapiens
auuucuuaugugacauu

SEQ ID NO: 764868 - RNA, 11 nt, Homo sapiens
auuucuuccca

SEQ ID NO: 764869 - RNA, 15 nt, Homo sapiens
auuucuucuacugcu

SEQ ID NO: 764870 - RNA, 17 nt, Homo sapiens
auuucuucuacugcuau

SEQ ID NO: 764871 - RNA, 16 nt, Homo sapiens
auuucuuggcauugga

SEQ ID NO: 764872 - RNA, 11 nt, Homo sapiens
auuucuuugca

SEQ ID NO: 764873 - RNA, 18 nt, Homo sapiens
auuucuuuuauguuaacu

SEQ ID NO: 764874 - RNA, 19 nt, Homo sapiens
auuugaacucuucaaucuc

SEQ ID NO: 764875 - RNA, 14 nt, Homo sapiens
auuugaagaagagu

SEQ ID NO: 764876 - RNA, 15 nt, Homo sapiens
auuugaagaagaguu

SEQ ID NO: 764877 - RNA, 15 nt, Homo sapiens
auuugaaguuugcca

SEQ ID NO: 764878 - RNA, 18 nt, Homo sapiens
auuugaauccaggccacu

SEQ ID NO: 764879 - RNA, 18 nt, Homo sapiens
auuugacauacaaaaagg

SEQ ID NO: 764880 - RNA, 19 nt, Homo sapiens
auuugaccacggacuccag

SEQ ID NO: 764881 - RNA, 22 nt, Homo sapiens
auuugagaauaaguucauacaa

SEQ ID NO: 764882 - RNA, 17 nt, Homo sapiens
auuugagaauacauaaa

SEQ ID NO: 764883 - RNA, 18 nt, Homo sapiens
auuugagagacugccaua

SEQ ID NO: 764884 - RNA, 23 nt, Homo sapiens
auuugaggacaagauaccaaggc

SEQ ID NO: 764885 - RNA, 23 nt, Homo sapiens
auuugauaguugguguucaaaaa

SEQ ID NO: 764886 - RNA, 22 nt, Homo sapiens
auuugcaaagaaaaguuucacc

SEQ ID NO: 764887 - RNA, 15 nt, Homo sapiens
auuugcaacagcuac

SEQ ID NO: 764888 - RNA, 16 nt, Homo sapiens
auuugcacuaaaucag

SEQ ID NO: 764889 - RNA, 18 nt, Homo sapiens
auuugcacuauuuccaca

SEQ ID NO: 764890 - RNA, 14 nt, Homo sapiens
auuugcagagacag

SEQ ID NO: 764891 - RNA, 14 nt, Homo sapiens
auuugcaguauuca

SEQ ID NO: 764892 - RNA, 13 nt, Homo sapiens
auuugcauuucag

SEQ ID NO: 764893 - RNA, 14 nt, Homo sapiens
auuugccauucaag

SEQ ID NO: 764894 - RNA, 15 nt, Homo sapiens
auuugcuagauuucu

SEQ ID NO: 764895 - RNA, 18 nt, Homo sapiens
auuugcucuuucaucucu

SEQ ID NO: 764896 - RNA, 21 nt, Homo sapiens
auuugcuguguaagcucacau

SEQ ID NO: 764897 - RNA, 15 nt, Homo sapiens
auuugcuuuuugcua

SEQ ID NO: 764898 - RNA, 14 nt, Homo sapiens
auuuggagccugcc

SEQ ID NO: 764899 - RNA, 18 nt, Homo sapiens
auuuggaggcuaccucac

SEQ ID NO: 764900 - RNA, 13 nt, Homo sapiens
auuguaagcauuc

SEQ ID NO: 764901 - RNA, 21 nt, Homo sapiens
auuguaauccuagcacuuugg

SEQ ID NO: 764902 - RNA, 16 nt, Homo sapiens
auuguacaauacuugc

SEQ ID NO: 764903 - RNA, 14 nt, Homo sapiens
auuguacucaaugg

SEQ ID NO: 764904 - RNA, 16 nt, Homo sapiens
auuguagaaacacagu

SEQ ID NO: 764905 - RNA, 19 nt, Homo sapiens
auuguauauuguaauuuaa

SEQ ID NO: 764906 - RNA, 21 nt, Homo sapiens
auuguauuuaccuucuaccuc

SEQ ID NO: 764907 - RNA, 20 nt, Homo sapiens
auugucacagaugaagacau

SEQ ID NO: 764908 - RNA, 13 nt, Homo sapiens
auugucagaaaag

SEQ ID NO: 764909 - RNA, 20 nt, Homo sapiens
auugucagaguucugcucua

SEQ ID NO: 764910 - RNA, 19 nt, Homo sapiens
auugucagcuacuaaugau

SEQ ID NO: 764911 - RNA, 23 nt, Homo sapiens
auugucauggggaucaauuuuca

SEQ ID NO: 764912 - RNA, 17 nt, Homo sapiens
auuguccgggcucagaa

SEQ ID NO: 764913 - RNA, 22 nt, Homo sapiens
auugucuagugaggaagacaag

SEQ ID NO: 764914 - RNA, 17 nt, Homo sapiens
auugugacuucacugua

SEQ ID NO: 764915 - RNA, 18 nt, Homo sapiens
auugugaucagaccauaa

SEQ ID NO: 764916 - RNA, 15 nt, Homo sapiens
auugugauuagacag

SEQ ID NO: 764917 - RNA, 18 nt, Homo sapiens
auuguggauuaaugucaa

SEQ ID NO: 764918 - RNA, 12 nt, Homo sapiens
auuguggcugca

SEQ ID NO: 764919 - RNA, 20 nt, Homo sapiens
auuguggucacaacuugaug

SEQ ID NO: 764920 - RNA, 12 nt, Homo sapiens
auugugugauau

SEQ ID NO: 764921 - RNA, 12 nt, Homo sapiens
auuguguucucu

SEQ ID NO: 764922 - RNA, 19 nt, Homo sapiens
auuguuacaguacuguucc

SEQ ID NO: 764923 - RNA, 16 nt, Homo sapiens
auuguuaucuaucaac

SEQ ID NO: 764924 - RNA, 18 nt, Homo sapiens
auuguuccugcgcugcaa

SEQ ID NO: 764925 - RNA, 17 nt, Homo sapiens
auuguugacaacuguga

SEQ ID NO: 764926 - RNA, 18 nt, Homo sapiens
auuguugacaacugugac

SEQ ID NO: 764927 - RNA, 19 nt, Homo sapiens
auuguugauuuuguucaca

SEQ ID NO: 764928 - RNA, 19 nt, Homo sapiens
auuguuguaagagugauuu

SEQ ID NO: 764929 - RNA, 13 nt, Homo sapiens
auuguugugcuua

SEQ ID NO: 764930 - RNA, 22 nt, Homo sapiens
auuguuuauguguuaugaacau

SEQ ID NO: 764931 - RNA, 23 nt, Homo sapiens
auuguuugaacccgggaggcaga

SEQ ID NO: 764932 - RNA, 16 nt, Homo sapiens
auuguuuggcuuccuc

SEQ ID NO: 764933 - RNA, 20 nt, Homo sapiens
auuguuugugacccugagaa

SEQ ID NO: 764934 - RNA, 16 nt, Homo sapiens
auuguuuuaccagcuc

SEQ ID NO: 764935 - RNA, 20 nt, Homo sapiens
auuguuuucccaaguguaau

SEQ ID NO: 764936 - RNA, 14 nt, Homo sapiens
auuuaaaaauaagu

SEQ ID NO: 764937 - RNA, 21 nt, Homo sapiens
auuuaaaacagacacuggcau

SEQ ID NO: 764938 - RNA, 15 nt, Homo sapiens
auuuaaaauucaauu

SEQ ID NO: 764939 - RNA, 16 nt, Homo sapiens
auuuaaacaccuccuc

SEQ ID NO: 764940 - RNA, 22 nt, Homo sapiens
auuuaaagaaaauaaacaccau

SEQ ID NO: 764941 - RNA, 15 nt, Homo sapiens
auuuaaagacaaaga

SEQ ID NO: 764942 - RNA, 15 nt, Homo sapiens
auuuaaagccuccuc

SEQ ID NO: 764943 - RNA, 15 nt, Homo sapiens
auuuaaauguaacuu

SEQ ID NO: 764944 - RNA, 23 nt, Homo sapiens
auuuaaauuacaauuuuaucugu

SEQ ID NO: 764945 - RNA, 20 nt, Homo sapiens
auuuaaauuuuuuuccuuac

SEQ ID NO: 764946 - RNA, 22 nt, Homo sapiens
auuuaacacccuuuagaaccuu

SEQ ID NO: 764947 - RNA, 16 nt, Homo sapiens
auuuaacuaaaguuaa

SEQ ID NO: 764948 - RNA, 14 nt, Homo sapiens
auuuaacugcauau

SEQ ID NO: 764949 - RNA, 15 nt, Homo sapiens
auuuaagcaaaggcu

SEQ ID NO: 764950 - RNA, 15 nt, Homo sapiens
auuuaagguacuuaa

SEQ ID NO: 764951 - RNA, 20 nt, Homo sapiens
auuuaauacccugcaaugua

SEQ ID NO: 764952 - RNA, 16 nt, Homo sapiens
auuuaauauacugcau

SEQ ID NO: 764953 - RNA, 13 nt, Homo sapiens
auuuaaugcugcc

SEQ ID NO: 764954 - RNA, 22 nt, Homo sapiens
auuuaauucuaguuucucucaa

SEQ ID NO: 764955 - RNA, 18 nt, Homo sapiens
auuuacagccucacuuga

SEQ ID NO: 764956 - RNA, 20 nt, Homo sapiens
auuuacagccucacuugaau

SEQ ID NO: 764957 - RNA, 14 nt, Homo sapiens
auuuaccaaagccu

SEQ ID NO: 764958 - RNA, 14 nt, Homo sapiens
auuuacccuuuucc

SEQ ID NO: 764959 - RNA, 18 nt, Homo sapiens
auuuaccuucuaccucuu

SEQ ID NO: 764960 - RNA, 14 nt, Homo sapiens
auuuacuaaaucaa

SEQ ID NO: 764961 - RNA, 17 nt, Homo sapiens
auuuacuggugcagaug

SEQ ID NO: 764962 - RNA, 24 nt, Homo sapiens
auuuacuguuuuuuucuguagcac

SEQ ID NO: 764963 - RNA, 21 nt, Homo sapiens
auuuacuuagcagaaccacau

SEQ ID NO: 764964 - RNA, 16 nt, Homo sapiens
auuuacuuccuugcau

SEQ ID NO: 764965 - RNA, 12 nt, Homo sapiens
auuuagaauuaa

SEQ ID NO: 764966 - RNA, 17 nt, Homo sapiens
auuuagauauaacacua

SEQ ID NO: 764967 - RNA, 18 nt, Homo sapiens
auuuagauauaacacuau

SEQ ID NO: 764968 - RNA, 14 nt, Homo sapiens
auuuagauaugcaa

SEQ ID NO: 764969 - RNA, 20 nt, Homo sapiens
auuuagauaugcaaaagcug

SEQ ID NO: 764970 - RNA, 17 nt, Homo sapiens
auuuagaugaugacuca

SEQ ID NO: 764971 - RNA, 17 nt, Homo sapiens
gcccaggcuggucuuga

SEQ ID NO: 764972 - RNA, 20 nt, Homo sapiens
gcccagggaagccaaaagau

SEQ ID NO: 764973 - RNA, 23 nt, Homo sapiens
gcccagggggagcuaucacugua

SEQ ID NO: 764974 - RNA, 16 nt, Homo sapiens
gcccaggguuuugccc

SEQ ID NO: 764975 - RNA, 13 nt, Homo sapiens
gcccagugcacug

SEQ ID NO: 764976 - RNA, 16 nt, Homo sapiens
gcccagugucccugag

SEQ ID NO: 764977 - RNA, 21 nt, Homo sapiens
gcccauacuuguaaucccagc

SEQ ID NO: 764978 - RNA, 22 nt, Homo sapiens
gcccauacuuguaaucccagcu

SEQ ID NO: 764979 - RNA, 21 nt, Homo sapiens
gcccauccccaggcaccucac

SEQ ID NO: 764980 - RNA, 15 nt, Homo sapiens
gcccaucgugaagaa

SEQ ID NO: 764981 - RNA, 20 nt, Homo sapiens
gcccauggugagcucuggga

SEQ ID NO: 764982 - RNA, 19 nt, Homo sapiens
gcccauucgcaugaggaau

SEQ ID NO: 764983 - RNA, 15 nt, Homo sapiens
gcccauugcugccaa

SEQ ID NO: 764984 - RNA, 15 nt, Homo sapiens
gccccagacugggcc

SEQ ID NO: 764985 - RNA, 23 nt, Homo sapiens
gccccagagcuguuuauggccuc

SEQ ID NO: 764986 - RNA, 14 nt, Homo sapiens
gccccaguccaugc

SEQ ID NO: 764987 - RNA, 16 nt, Homo sapiens
gccccaguccaugcuu

SEQ ID NO: 764988 - RNA, 15 nt, Homo sapiens
gccccaugccugucc

SEQ ID NO: 764989 - RNA, 20 nt, Homo sapiens
gcccccaauaaaggcagcug

SEQ ID NO: 764990 - RNA, 20 nt, Homo sapiens
gcccccagauacauggugau

SEQ ID NO: 764991 - RNA, 16 nt, Homo sapiens
gcccccagcccuggga

SEQ ID NO: 764992 - RNA, 19 nt, Homo sapiens
gcccccagggccuccaggg

SEQ ID NO: 764993 - RNA, 15 nt, Homo sapiens
gcccccaugcaaggu

SEQ ID NO: 764994 - RNA, 16 nt, Homo sapiens
gcccccuccucuagcu

SEQ ID NO: 764995 - RNA, 19 nt, Homo sapiens
gcccccugaugccaccgag

SEQ ID NO: 764996 - RNA, 13 nt, Homo sapiens
gcccccugcaucu

SEQ ID NO: 764997 - RNA, 17 nt, Homo sapiens
gcccccuguacauuugu

SEQ ID NO: 764998 - RNA, 16 nt, Homo sapiens
gcccccuuucagaugu

SEQ ID NO: 764999 - RNA, 19 nt, Homo sapiens
gccccuaaucccagcacuu

SEQ ID NO: 765000 - RNA, 11 nt, Homo sapiens
gccccuacccc

SEQ ID NO: 765001 - RNA, 20 nt, Homo sapiens
gccccuaggaaggugaaucu

SEQ ID NO: 765002 - RNA, 21 nt, Homo sapiens
gccccucaccugguaccugga

SEQ ID NO: 765003 - RNA, 21 nt, Homo sapiens
gccccucgcugcugcuacuac

SEQ ID NO: 765004 - RNA, 20 nt, Homo sapiens
gccccucugcacccuuauca

SEQ ID NO: 765005 - RNA, 15 nt, Homo sapiens
gccccucuuggagaa

SEQ ID NO: 765006 - RNA, 20 nt, Homo sapiens
gccccuggggcuguauuuau

SEQ ID NO: 765007 - RNA, 22 nt, Homo sapiens
gccccugggguggccaccagua

SEQ ID NO: 765008 - RNA, 22 nt, Homo sapiens
gccccuucuggggguggugggc

SEQ ID NO: 765009 - RNA, 15 nt, Homo sapiens
gccccuuuuacuuuu

SEQ ID NO: 765010 - RNA, 18 nt, Homo sapiens
gcccgacagccuggcaca

SEQ ID NO: 765011 - RNA, 16 nt, Homo sapiens
gcccgagcuguuguau

SEQ ID NO: 765012 - RNA, 17 nt, Homo sapiens
gcccgagggauggugcc

SEQ ID NO: 765013 - RNA, 21 nt, Homo sapiens
gcccgcucugcagacugcugc

SEQ ID NO: 765014 - RNA, 14 nt, Homo sapiens
gcccggcugugauu

SEQ ID NO: 765015 - RNA, 21 nt, Homo sapiens
gcccgggguggggugcacucg

SEQ ID NO: 765016 - RNA, 13 nt, Homo sapiens
gcccguucuugaa

SEQ ID NO: 765017 - RNA, 22 nt, Homo sapiens
gcccuaagagugucacugagcu

SEQ ID NO: 765018 - RNA, 15 nt, Homo sapiens
gcccuacauugugcu

SEQ ID NO: 765019 - RNA, 17 nt, Homo sapiens
gcccuacuccacugccc

SEQ ID NO: 765020 - RNA, 16 nt, Homo sapiens
gcccuaugucucagga

SEQ ID NO: 765021 - RNA, 20 nt, Homo sapiens
gcccuauucuuucuauucag

SEQ ID NO: 765022 - RNA, 12 nt, Homo sapiens
gcccucacagag

SEQ ID NO: 765023 - RNA, 17 nt, Homo sapiens
gcccucacaucuuccac

SEQ ID NO: 765024 - RNA, 14 nt, Homo sapiens
gcccucauacccau

SEQ ID NO: 765025 - RNA, 19 nt, Homo sapiens
gcccuccaccuuguuccug

SEQ ID NO: 765026 - RNA, 19 nt, Homo sapiens
gcccucccagcccauugcu

SEQ ID NO: 765027 - RNA, 17 nt, Homo sapiens
gcccuccuugacccuga

SEQ ID NO: 765028 - RNA, 11 nt, Homo sapiens
gcccucgcugc

SEQ ID NO: 765029 - RNA, 22 nt, Homo sapiens
gcccucgggcgagucacugccu

SEQ ID NO: 765030 - RNA, 23 nt, Homo sapiens
gcccucuaugguguggcaaagcc

SEQ ID NO: 765031 - RNA, 16 nt, Homo sapiens
gcccucucugcuccuu

SEQ ID NO: 765032 - RNA, 12 nt, Homo sapiens
gcccucugcucu

SEQ ID NO: 765033 - RNA, 14 nt, Homo sapiens
gcccucuguagcuc

SEQ ID NO: 765034 - RNA, 21 nt, Homo sapiens
caaaaaaaccucuaugcaauc

SEQ ID NO: 765035 - RNA, 21 nt, Homo sapiens
caaaaaaaguugaaggccuua

SEQ ID NO: 765036 - RNA, 15 nt, Homo sapiens
caaaaaaauugugcc

SEQ ID NO: 765037 - RNA, 13 nt, Homo sapiens
caaaaaacuacuu

SEQ ID NO: 765038 - RNA, 19 nt, Homo sapiens
caaaaaagaacaagcucau

SEQ ID NO: 765039 - RNA, 16 nt, Homo sapiens
caaaaaagucaagaac

SEQ ID NO: 765040 - RNA, 13 nt, Homo sapiens
caaaaacaagcaa

SEQ ID NO: 765041 - RNA, 14 nt, Homo sapiens
caaaaacaucacuc

SEQ ID NO: 765042 - RNA, 16 nt, Homo sapiens
caaaaacaucacuccc

SEQ ID NO: 765043 - RNA, 23 nt, Homo sapiens
caaaaacauguaugugcauuuca

SEQ ID NO: 765044 - RNA, 21 nt, Homo sapiens
caaaaacgaaacuccaucuca

SEQ ID NO: 765045 - RNA, 13 nt, Homo sapiens
caaaaacuuugga

SEQ ID NO: 765046 - RNA, 16 nt, Homo sapiens
caaaaagucacaguua

SEQ ID NO: 765047 - RNA, 21 nt, Homo sapiens
caaaaaguuuaucacacagug

SEQ ID NO: 765048 - RNA, 20 nt, Homo sapiens
caaaaauaaacuaguuucca

SEQ ID NO: 765049 - RNA, 14 nt, Homo sapiens
caaaaauauuccau

SEQ ID NO: 765050 - RNA, 21 nt, Homo sapiens
caaaaaugaaagcaugucuca

SEQ ID NO: 765051 - RNA, 19 nt, Homo sapiens
caaaaaugaaauccaguga

SEQ ID NO: 765052 - RNA, 20 nt, Homo sapiens
caaaaaugaaauccagugag

SEQ ID NO: 765053 - RNA, 22 nt, Homo sapiens
caaaaaugcacccaacuagcuc

SEQ ID NO: 765054 - RNA, 18 nt, Homo sapiens
caaaaauguaaugaucau

SEQ ID NO: 765055 - RNA, 16 nt, Homo sapiens
caaaaauuaauacaca

SEQ ID NO: 765056 - RNA, 17 nt, Homo sapiens
caaaacaaaaaaaaacu

SEQ ID NO: 765057 - RNA, 16 nt, Homo sapiens
caaaacaaucucucaa

SEQ ID NO: 765058 - RNA, 17 nt, Homo sapiens
caaaacacucaucuccu

SEQ ID NO: 765059 - RNA, 16 nt, Homo sapiens
caaaacagagauguga

SEQ ID NO: 765060 - RNA, 20 nt, Homo sapiens
caaaacagagggcugcauuc

SEQ ID NO: 765061 - RNA, 15 nt, Homo sapiens
caaaacaguuugaaa

SEQ ID NO: 765062 - RNA, 12 nt, Homo sapiens
caaaacaugccg

SEQ ID NO: 765063 - RNA, 18 nt, Homo sapiens
caaaaccacuagaacucu

SEQ ID NO: 765064 - RNA, 15 nt, Homo sapiens
caaaaccucaugaca

SEQ ID NO: 765065 - RNA, 12 nt, Homo sapiens
caaaaccugcuu

SEQ ID NO: 765066 - RNA, 14 nt, Homo sapiens
caaaaccuguauua

SEQ ID NO: 765067 - RNA, 23 nt, Homo sapiens
caaaacgaaaugcuaugacugua

SEQ ID NO: 765068 - RNA, 15 nt, Homo sapiens
caaaacuaauuuccu

SEQ ID NO: 765069 - RNA, 14 nt, Homo sapiens
caaaacuacugaca

SEQ ID NO: 765070 - RNA, 20 nt, Homo sapiens
caaaacucagagaaaugugu

SEQ ID NO: 765071 - RNA, 13 nt, Homo sapiens
caaaacucaguag

SEQ ID NO: 765072 - RNA, 14 nt, Homo sapiens
caaaacuccgucuc

SEQ ID NO: 765073 - RNA, 12 nt, Homo sapiens
caaaacucuccu

SEQ ID NO: 765074 - RNA, 23 nt, Homo sapiens
caaaacucucugguuuacuucaa

SEQ ID NO: 765075 - RNA, 20 nt, Homo sapiens
gcauacuccgugaggcugcu

SEQ ID NO: 765076 - RNA, 20 nt, Homo sapiens
gcauacuuucccucauccau

SEQ ID NO: 765077 - RNA, 20 nt, Homo sapiens
gcauagcaaaugacauaagc

SEQ ID NO: 765078 - RNA, 16 nt, Homo sapiens
gcauagcaagacacau

SEQ ID NO: 765079 - RNA, 19 nt, Homo sapiens
gcauagcuuugcacuucaa

SEQ ID NO: 765080 - RNA, 17 nt, Homo sapiens
gcauagguuuagcagua

SEQ ID NO: 765081 - RNA, 13 nt, Homo sapiens
gcauauacuuuaa

SEQ ID NO: 765082 - RNA, 24 nt, Homo sapiens
gcauauauaaguuuacaccuuuau

SEQ ID NO: 765083 - RNA, 16 nt, Homo sapiens
gcauaugcacagucaa

SEQ ID NO: 765084 - RNA, 14 nt, Homo sapiens
gcauaugcagccaa

SEQ ID NO: 765085 - RNA, 21 nt, Homo sapiens
gcauaugcagccaaccaagau

SEQ ID NO: 765086 - RNA, 20 nt, Homo sapiens
gcauaugggugggauuuugc

SEQ ID NO: 765087 - RNA, 18 nt, Homo sapiens
gcauauuaagcacuuuaa

SEQ ID NO: 765088 - RNA, 19 nt, Homo sapiens
gcauauuaagcacuuuaag

SEQ ID NO: 765089 - RNA, 20 nt, Homo sapiens
gcaucaagggagacaccagu

SEQ ID NO: 765090 - RNA, 21 nt, Homo sapiens
gcaucaauacaaccagcccaa

SEQ ID NO: 765091 - RNA, 14 nt, Homo sapiens
gcaucaauuuucaa

SEQ ID NO: 765092 - RNA, 13 nt, Homo sapiens
gcaucaccagggu

SEQ ID NO: 765093 - RNA, 20 nt, Homo sapiens
gcaucacguaccccacuggg

SEQ ID NO: 765094 - RNA, 23 nt, Homo sapiens
gcaucagcugcugaaacaacaaa

SEQ ID NO: 765095 - RNA, 15 nt, Homo sapiens
gcaucaguugcuaua

SEQ ID NO: 765096 - RNA, 19 nt, Homo sapiens
gcaucaucaaaaacuuugg

SEQ ID NO: 765097 - RNA, 15 nt, Homo sapiens
gcaucaucccuggau

SEQ ID NO: 765098 - RNA, 17 nt, Homo sapiens
gcauccaacuccaggau

SEQ ID NO: 765099 - RNA, 19 nt, Homo sapiens
gcaucccugagacagggag

SEQ ID NO: 765100 - RNA, 21 nt, Homo sapiens
gcaucccuguguccacugaga

SEQ ID NO: 765101 - RNA, 16 nt, Homo sapiens
gcauccugugcuucua

SEQ ID NO: 765102 - RNA, 20 nt, Homo sapiens
gcaucuacacagccuggacu

SEQ ID NO: 765103 - RNA, 18 nt, Homo sapiens
gcaucuagaaagcuuuga

SEQ ID NO: 765104 - RNA, 22 nt, Homo sapiens
gcaucuauucuuuguaccaucu

SEQ ID NO: 765105 - RNA, 13 nt, Homo sapiens
gcaucuccugugc

SEQ ID NO: 765106 - RNA, 12 nt, Homo sapiens
gcaucugacaca

SEQ ID NO: 765107 - RNA, 12 nt, Homo sapiens
gcaucugaccau

SEQ ID NO: 765108 - RNA, 18 nt, Homo sapiens
gcaucugaccaucuguga

SEQ ID NO: 765109 - RNA, 17 nt, Homo sapiens
gcaucugagugggccca

SEQ ID NO: 765110 - RNA, 16 nt, Homo sapiens
gcaucugcagccacuu

SEQ ID NO: 765111 - RNA, 22 nt, Homo sapiens
gcaucuggaaagggggggaaaa

SEQ ID NO: 765112 - RNA, 16 nt, Homo sapiens
gcaucuucccgcugag

SEQ ID NO: 765113 - RNA, 18 nt, Homo sapiens
gcaugaauaaaacacuca

SEQ ID NO: 765114 - RNA, 14 nt, Homo sapiens
gcaugacagucaca

SEQ ID NO: 765115 - RNA, 14 nt, Homo sapiens
gcaugaccugugac

SEQ ID NO: 765116 - RNA, 13 nt, Homo sapiens
gcaugagacuuuc

SEQ ID NO: 765117 - RNA, 20 nt, Homo sapiens
gcaugagagaauuguaucau

SEQ ID NO: 765118 - RNA, 22 nt, Homo sapiens
gcaugcagcuuugcaaacccau

SEQ ID NO: 765119 - RNA, 17 nt, Homo sapiens
gcaugcagugcccucac

SEQ ID NO: 765120 - RNA, 17 nt, Homo sapiens
gcaugccaaauguucca

SEQ ID NO: 765121 - RNA, 20 nt, Homo sapiens
gcaugcccuaagagugucac

SEQ ID NO: 765122 - RNA, 13 nt, Homo sapiens
gcaugcucuggaa

SEQ ID NO: 765123 - RNA, 16 nt, Homo sapiens
gcaugcuuugcugcua

SEQ ID NO: 765124 - RNA, 23 nt, Homo sapiens
gcauggaaaaaugguugauggaa

SEQ ID NO: 765125 - RNA, 20 nt, Homo sapiens
gcauggccccaguccaugcu

SEQ ID NO: 765126 - RNA, 16 nt, Homo sapiens
gcaugguaaugaagga

SEQ ID NO: 765127 - RNA, 17 nt, Homo sapiens
gcauguauuagcucacu

SEQ ID NO: 765128 - RNA, 13 nt, Homo sapiens
gcauguccuuugc

SEQ ID NO: 765129 - RNA, 22 nt, Homo sapiens
gcauguccuuugcgccugugac

SEQ ID NO: 765130 - RNA, 18 nt, Homo sapiens
gcaugucucccuccaguc

SEQ ID NO: 765131 - RNA, 21 nt, Homo sapiens
gcaugucucucugccaagauc

SEQ ID NO: 765132 - RNA, 14 nt, Homo sapiens
gcaugugcauauag

SEQ ID NO: 765133 - RNA, 11 nt, Homo sapiens
gcaugugccaa

SEQ ID NO: 765134 - RNA, 22 nt, Homo sapiens
gcaugugccaagauucuacucu

SEQ ID NO: 765135 - RNA, 16 nt, Homo sapiens
gcauguggagacacuc

SEQ ID NO: 765136 - RNA, 23 nt, Homo sapiens
gagagcuuucuguccuuuuggca

SEQ ID NO: 765137 - RNA, 21 nt, Homo sapiens
gagaggagggaugcugccuga

SEQ ID NO: 765138 - RNA, 16 nt, Homo sapiens
gagaggcaggcauaga

SEQ ID NO: 765139 - RNA, 22 nt, Homo sapiens
gagaggcccugggguucucccc

SEQ ID NO: 765140 - RNA, 21 nt, Homo sapiens
gagaggccuggagcccacaac

SEQ ID NO: 765141 - RNA, 14 nt, Homo sapiens
gagaggcuuuccaa

SEQ ID NO: 765142 - RNA, 18 nt, Homo sapiens
gagagggaagagugcauu

SEQ ID NO: 765143 - RNA, 18 nt, Homo sapiens
gagagggaggucacugga

SEQ ID NO: 765144 - RNA, 18 nt, Homo sapiens
gagaggggacucaaacag

SEQ ID NO: 765145 - RNA, 15 nt, Homo sapiens
gagaggggcgagaag

SEQ ID NO: 765146 - RNA, 20 nt, Homo sapiens
gagagggggcucuccaaagg

SEQ ID NO: 765147 - RNA, 23 nt, Homo sapiens
gagaggucucagguucuuuccau

SEQ ID NO: 765148 - RNA, 22 nt, Homo sapiens
gagaguagaugguuugagccug

SEQ ID NO: 765149 - RNA, 23 nt, Homo sapiens
gagagucagacccuucaauggaa

SEQ ID NO: 765150 - RNA, 22 nt, Homo sapiens
gagaguggcaggugggcugccu

SEQ ID NO: 765151 - RNA, 14 nt, Homo sapiens
gagagugugcucuc

SEQ ID NO: 765152 - RNA, 16 nt, Homo sapiens
gagauaaaccaauaaa

SEQ ID NO: 765153 - RNA, 13 nt, Homo sapiens
gagauauuuacau

SEQ ID NO: 765154 - RNA, 20 nt, Homo sapiens
gagaucacgucacugcacuc

SEQ ID NO: 765155 - RNA, 22 nt, Homo sapiens
gagaucacgucacugcacucca

SEQ ID NO: 765156 - RNA, 16 nt, Homo sapiens
gagaucgagaccaucc

SEQ ID NO: 765157 - RNA, 18 nt, Homo sapiens
gagaucgcuuuucucaga

SEQ ID NO: 765158 - RNA, 20 nt, Homo sapiens
gagaucgugcuacugcacuc

SEQ ID NO: 765159 - RNA, 12 nt, Homo sapiens
gagaucugcaca

SEQ ID NO: 765160 - RNA, 14 nt, Homo sapiens
gagaucuugaucca

SEQ ID NO: 765161 - RNA, 21 nt, Homo sapiens
gagaucuuucuuuccaaaaca

SEQ ID NO: 765162 - RNA, 17 nt, Homo sapiens
gagaugaauaugagcuc

SEQ ID NO: 765163 - RNA, 15 nt, Homo sapiens
gagaugaccagggau

SEQ ID NO: 765164 - RNA, 18 nt, Homo sapiens
gagaugcagcuacuggaa

SEQ ID NO: 765165 - RNA, 20 nt, Homo sapiens
gagaugcaggugaugccauu

SEQ ID NO: 765166 - RNA, 13 nt, Homo sapiens
gagauggaguucu

SEQ ID NO: 765167 - RNA, 22 nt, Homo sapiens
gagaugggaaagcggcgccaca

SEQ ID NO: 765168 - RNA, 13 nt, Homo sapiens
gagauguacugca

SEQ ID NO: 765169 - RNA, 15 nt, Homo sapiens
gagauguaugaaggc

SEQ ID NO: 765170 - RNA, 17 nt, Homo sapiens
gagauguugcccauuua

SEQ ID NO: 765171 - RNA, 18 nt, Homo sapiens
gagauuacuuugcugccu

SEQ ID NO: 765172 - RNA, 16 nt, Homo sapiens
gagauucugugaucuu

SEQ ID NO: 765173 - RNA, 20 nt, Homo sapiens
gagauugcaccauugcgcuc

SEQ ID NO: 765174 - RNA, 20 nt, Homo sapiens
gagauugcacuauugcacuc

SEQ ID NO: 765175 - RNA, 18 nt, Homo sapiens
gagauuucuuguugcuca

SEQ ID NO: 765176 - RNA, 23 nt, Homo sapiens
gagcaaaagccucagaaagggau

SEQ ID NO: 765177 - RNA, 13 nt, Homo sapiens
gagcaaaaugcuc

SEQ ID NO: 765178 - RNA, 19 nt, Homo sapiens
gagcaaagggaaggacuga

SEQ ID NO: 765179 - RNA, 19 nt, Homo sapiens
gagcaaauaaagaccugag

SEQ ID NO: 765180 - RNA, 14 nt, Homo sapiens
gagcaacagaguga

SEQ ID NO: 765181 - RNA, 21 nt, Homo sapiens
gagcaaccccuguacccagcu

SEQ ID NO: 765182 - RNA, 22 nt, Homo sapiens
gagcaagacuccaucucaaaaa

SEQ ID NO: 765183 - RNA, 22 nt, Homo sapiens
gagcaagacucugucucaaaaa

SEQ ID NO: 765184 - RNA, 21 nt, Homo sapiens
gagcaagucuuagacaucaua

SEQ ID NO: 765185 - RNA, 23 nt, Homo sapiens
gagcacaagccacaagucuucca

SEQ ID NO: 765186 - RNA, 23 nt, Homo sapiens
gagcacaauuucccuucauacuc

SEQ ID NO: 765187 - RNA, 23 nt, Homo sapiens
gagcacauacuaccuagaaguaa

SEQ ID NO: 765188 - RNA, 23 nt, Homo sapiens
gcaacuuaagcugggauaaucac

SEQ ID NO: 765189 - RNA, 14 nt, Homo sapiens
gcaacuuaauacuc

SEQ ID NO: 765190 - RNA, 18 nt, Homo sapiens
gcaagaaaucagccauaa

SEQ ID NO: 765191 - RNA, 15 nt, Homo sapiens
gcaagaacagugggc

SEQ ID NO: 765192 - RNA, 16 nt, Homo sapiens
gcaagaaggaaggagg

SEQ ID NO: 765193 - RNA, 17 nt, Homo sapiens
gcaagaauauugucccu

SEQ ID NO: 765194 - RNA, 15 nt, Homo sapiens
gcaagaccucaucuc

SEQ ID NO: 765195 - RNA, 17 nt, Homo sapiens
gcaagacuccaucucaa

SEQ ID NO: 765196 - RNA, 22 nt, Homo sapiens
gcaagagaaaauaagcaggaca

SEQ ID NO: 765197 - RNA, 18 nt, Homo sapiens
gcaagagaggaugacaca

SEQ ID NO: 765198 - RNA, 21 nt, Homo sapiens
gcaagauagucuucaguuuca

SEQ ID NO: 765199 - RNA, 15 nt, Homo sapiens
gcaagcacaucugca

SEQ ID NO: 765200 - RNA, 15 nt, Homo sapiens
gcaagcacugugguc

SEQ ID NO: 765201 - RNA, 13 nt, Homo sapiens
gcaagcagggaaa

SEQ ID NO: 765202 - RNA, 22 nt, Homo sapiens
gcaagccuugcuagacagccag

SEQ ID NO: 765203 - RNA, 15 nt, Homo sapiens
gcaagcuaacugcuu

SEQ ID NO: 765204 - RNA, 15 nt, Homo sapiens
gcaagggcagugaag

SEQ ID NO: 765205 - RNA, 23 nt, Homo sapiens
gcaaguaaaaaggcuaaauggaa

SEQ ID NO: 765206 - RNA, 17 nt, Homo sapiens
gcaaguacgcaagaaau

SEQ ID NO: 765207 - RNA, 14 nt, Homo sapiens
gcaaguagcacaug

SEQ ID NO: 765208 - RNA, 16 nt, Homo sapiens
gcaagucaugcugaau

SEQ ID NO: 765209 - RNA, 19 nt, Homo sapiens
gcaagugugcucuccuggg

SEQ ID NO: 765210 - RNA, 20 nt, Homo sapiens
gcaaguuagaacuagccaaa

SEQ ID NO: 765211 - RNA, 15 nt, Homo sapiens
gcaaguuagugaaac

SEQ ID NO: 765212 - RNA, 18 nt, Homo sapiens
gcaaguuuccaucaucua

SEQ ID NO: 765213 - RNA, 22 nt, Homo sapiens
gcaaguuuucccugaaguuaug

SEQ ID NO: 765214 - RNA, 14 nt, Homo sapiens
gcaauaaauaccag

SEQ ID NO: 765215 - RNA, 17 nt, Homo sapiens
gcaauaaauaccagaca

SEQ ID NO: 765216 - RNA, 19 nt, Homo sapiens
gcaauaaaucugacccagu

SEQ ID NO: 765217 - RNA, 12 nt, Homo sapiens
gcaauacaaaga

SEQ ID NO: 765218 - RNA, 15 nt, Homo sapiens
gcaauaccaauguuc

SEQ ID NO: 765219 - RNA, 15 nt, Homo sapiens
gcaauacuguaggaa

SEQ ID NO: 765220 - RNA, 15 nt, Homo sapiens
gcaauauauaauuga

SEQ ID NO: 765221 - RNA, 21 nt, Homo sapiens
gcaauauaucugaagagcuau

SEQ ID NO: 765222 - RNA, 20 nt, Homo sapiens
gcaauauucuguaacuauug

SEQ ID NO: 765223 - RNA, 16 nt, Homo sapiens
gcaaucacugaucuca

SEQ ID NO: 765224 - RNA, 18 nt, Homo sapiens
gcaaucaugagcaaguga

SEQ ID NO: 765225 - RNA, 17 nt, Homo sapiens
gcaaucuauguuugcac

SEQ ID NO: 765226 - RNA, 15 nt, Homo sapiens
gcaaucugacccuau

SEQ ID NO: 765227 - RNA, 23 nt, Homo sapiens
gcaaucuuugccuuuaucucuga

SEQ ID NO: 765228 - RNA, 22 nt, Homo sapiens
gcaaugaauccccaauaauugc

SEQ ID NO: 765229 - RNA, 22 nt, Homo sapiens
gcaaugccaaucuucaguauuu

SEQ ID NO: 765230 - RNA, 16 nt, Homo sapiens
gcaaugcccugugcau

SEQ ID NO: 765231 - RNA, 14 nt, Homo sapiens
gcaaugguggugca

SEQ ID NO: 765232 - RNA, 18 nt, Homo sapiens
gcaaugguuugugucaaa

SEQ ID NO: 765233 - RNA, 19 nt, Homo sapiens
gcaauguggagcagcagcc

SEQ ID NO: 765234 - RNA, 19 nt, Homo sapiens
gcaauuagauuaguauuuu

SEQ ID NO: 765235 - RNA, 21 nt, Homo sapiens
gcaauugaagguuguauguaa

SEQ ID NO: 765236 - RNA, 14 nt, Homo sapiens
gcaauugacuguca

SEQ ID NO: 765237 - RNA, 18 nt, Homo sapiens
gcaauuucagaaccaaaa

SEQ ID NO: 765238 - RNA, 17 nt, Homo sapiens
gcaauuuuguguaaauu

SEQ ID NO: 765239 - RNA, 20 nt, Homo sapiens
gcaauuuuucaagagcuccu

SEQ ID NO: 765240 - RNA, 21 nt, Homo sapiens
gcacaaaagcagauacuugag

SEQ ID NO: 765241 - RNA, 21 nt, Homo sapiens
gcacaaagcccauagcacugg

SEQ ID NO: 765242 - RNA, 22 nt, Homo sapiens
gcacaagccacaagucuuccag

SEQ ID NO: 765243 - RNA, 17 nt, Homo sapiens
gcagaucugugccccau

SEQ ID NO: 765244 - RNA, 19 nt, Homo sapiens
gcagaugccacccuagcca

SEQ ID NO: 765245 - RNA, 19 nt, Homo sapiens
gcagaugcuuuacagucaa

SEQ ID NO: 765246 - RNA, 21 nt, Homo sapiens
gcagcaaaacgacacugcgca

SEQ ID NO: 765247 - RNA, 21 nt, Homo sapiens
gcagcacagucacccauggaa

SEQ ID NO: 765248 - RNA, 18 nt, Homo sapiens
gcagcaccaaccacagca

SEQ ID NO: 765249 - RNA, 21 nt, Homo sapiens
gcagcaccuccuccaugcagg

SEQ ID NO: 765250 - RNA, 19 nt, Homo sapiens
gcagcacuggaaccaccug

SEQ ID NO: 765251 - RNA, 13 nt, Homo sapiens
gcagcagcucaca

SEQ ID NO: 765252 - RNA, 22 nt, Homo sapiens
gcagcagcucacacccuaccuu

SEQ ID NO: 765253 - RNA, 22 nt, Homo sapiens
gcagcaugcuugggcugaccca

SEQ ID NO: 765254 - RNA, 13 nt, Homo sapiens
gcagcauuuacua

SEQ ID NO: 765255 - RNA, 18 nt, Homo sapiens
gcagccaaacccaugagg

SEQ ID NO: 765256 - RNA, 19 nt, Homo sapiens
gcagccacaaccaaaaaau

SEQ ID NO: 765257 - RNA, 17 nt, Homo sapiens
gcagccacuuucugcca

SEQ ID NO: 765258 - RNA, 18 nt, Homo sapiens
gcagccacuuucugccag

SEQ ID NO: 765259 - RNA, 16 nt, Homo sapiens
gcagccagccaucaaa

SEQ ID NO: 765260 - RNA, 15 nt, Homo sapiens
gcagccagucucaga

SEQ ID NO: 765261 - RNA, 13 nt, Homo sapiens
gcagcccaugccc

SEQ ID NO: 765262 - RNA, 14 nt, Homo sapiens
gcagcccaugccca

SEQ ID NO: 765263 - RNA, 15 nt, Homo sapiens
gcagcccucuugccc

SEQ ID NO: 765264 - RNA, 16 nt, Homo sapiens
gcagcccucuugcccg

SEQ ID NO: 765265 - RNA, 21 nt, Homo sapiens
gcagccuaacacggugcucau

SEQ ID NO: 765266 - RNA, 10 nt, Homo sapiens
gcagccucac

SEQ ID NO: 765267 - RNA, 24 nt, Homo sapiens
gcagccucagaguggucgagugac

SEQ ID NO: 765268 - RNA, 17 nt, Homo sapiens
gcagccuccacuucccu

SEQ ID NO: 765269 - RNA, 18 nt, Homo sapiens
gcagcgccucaucuucaa

SEQ ID NO: 765270 - RNA, 22 nt, Homo sapiens
gcagcucaagaacacaugugca

SEQ ID NO: 765271 - RNA, 21 nt, Homo sapiens
gcagcugaugccugaauguau

SEQ ID NO: 765272 - RNA, 13 nt, Homo sapiens
gcagcugcagggg

SEQ ID NO: 765273 - RNA, 16 nt, Homo sapiens
gcagcuggcccacugc

SEQ ID NO: 765274 - RNA, 22 nt, Homo sapiens
gcagcuggugccccaccugccu

SEQ ID NO: 765275 - RNA, 19 nt, Homo sapiens
gcagcuuacuuaguaggcu

SEQ ID NO: 765276 - RNA, 15 nt, Homo sapiens
gcagcuucaccagag

SEQ ID NO: 765277 - RNA, 17 nt, Homo sapiens
gcagcuugaaacugaga

SEQ ID NO: 765278 - RNA, 21 nt, Homo sapiens
gcaggaaaguuuacccaugaa

SEQ ID NO: 765279 - RNA, 18 nt, Homo sapiens
gcaggaagcucugaugca

SEQ ID NO: 765280 - RNA, 23 nt, Homo sapiens
gcaggacaggaggcggcccggcc

SEQ ID NO: 765281 - RNA, 16 nt, Homo sapiens
gcaggagaagaacaag

SEQ ID NO: 765282 - RNA, 17 nt, Homo sapiens
gcaggagaaucgcuuga

SEQ ID NO: 765283 - RNA, 18 nt, Homo sapiens
gcaggagaauggugugaa

SEQ ID NO: 765284 - RNA, 17 nt, Homo sapiens
gcaggagaauugcuuga

SEQ ID NO: 765285 - RNA, 17 nt, Homo sapiens
gcaggagcagcugugcu

SEQ ID NO: 765286 - RNA, 18 nt, Homo sapiens
gcaggagcagcugugcug

SEQ ID NO: 765287 - RNA, 17 nt, Homo sapiens
gcaggaggauugcuuga

SEQ ID NO: 765288 - RNA, 14 nt, Homo sapiens
gcaggagguucugg

SEQ ID NO: 765289 - RNA, 13 nt, Homo sapiens
gcaggagugccag

SEQ ID NO: 765290 - RNA, 20 nt, Homo sapiens
gcaggccgugugucugucag

SEQ ID NO: 765291 - RNA, 17 nt, Homo sapiens
gcaggcgacaaaaucuc

SEQ ID NO: 765292 - RNA, 23 nt, Homo sapiens
gcaggcggagcgagagagggaga

SEQ ID NO: 765293 - RNA, 23 nt, Homo sapiens
gcaggcugggccauguccaaaga

SEQ ID NO: 765294 - RNA, 18 nt, Homo sapiens
gcagggaaggacaggacc

SEQ ID NO: 765295 - RNA, 14 nt, Homo sapiens
gcagggacccgggg

SEQ ID NO: 765296 - RNA, 17 nt, Homo sapiens
gcagggaugauggcaga

SEQ ID NO: 765297 - RNA, 15 nt, Homo sapiens
gcagggcaaaugaca

SEQ ID NO: 765298 - RNA, 18 nt, Homo sapiens
gcagggcacugugccuga

SEQ ID NO: 765299 - RNA, 16 nt, Homo sapiens
gcagggcagccgucac

SEQ ID NO: 765300 - RNA, 13 nt, Homo sapiens
gcagggcucugau

SEQ ID NO: 765301 - RNA, 22 nt, Homo sapiens
gcaggggaacaaaauaagggcc

SEQ ID NO: 765302 - RNA, 22 nt, Homo sapiens
gcaggggcuggagggaggcggg

SEQ ID NO: 765303 - RNA, 18 nt, Homo sapiens
gacaggauaagagggauu

SEQ ID NO: 765304 - RNA, 20 nt, Homo sapiens
gacaggcucugcuucuccaa

SEQ ID NO: 765305 - RNA, 20 nt, Homo sapiens
gacagggacaugcccugugu

SEQ ID NO: 765306 - RNA, 21 nt, Homo sapiens
gacagggacaugcccugugug

SEQ ID NO: 765307 - RNA, 19 nt, Homo sapiens
gacagguaaugaagcuauu

SEQ ID NO: 765308 - RNA, 17 nt, Homo sapiens
gacagucaccuauccac

SEQ ID NO: 765309 - RNA, 20 nt, Homo sapiens
gacaguccaaccuugagaau

SEQ ID NO: 765310 - RNA, 16 nt, Homo sapiens
gacagugaacauucug

SEQ ID NO: 765311 - RNA, 19 nt, Homo sapiens
gacagugaagcagcacugu

SEQ ID NO: 765312 - RNA, 17 nt, Homo sapiens
gacagugagacuguggc

SEQ ID NO: 765313 - RNA, 15 nt, Homo sapiens
gacagugccucuucc

SEQ ID NO: 765314 - RNA, 17 nt, Homo sapiens
gacaguguuuucuggga

SEQ ID NO: 765315 - RNA, 16 nt, Homo sapiens
gacaguugcagcccuu

SEQ ID NO: 765316 - RNA, 16 nt, Homo sapiens
gacauaaacccuugcc

SEQ ID NO: 765317 - RNA, 17 nt, Homo sapiens
gacauacauauuaucuc

SEQ ID NO: 765318 - RNA, 18 nt, Homo sapiens
gacauacauauuaucuca

SEQ ID NO: 765319 - RNA, 14 nt, Homo sapiens
gacauacauuucuc

SEQ ID NO: 765320 - RNA, 16 nt, Homo sapiens
gacauagaagagccaa

SEQ ID NO: 765321 - RNA, 13 nt, Homo sapiens
gacauagccucau

SEQ ID NO: 765322 - RNA, 21 nt, Homo sapiens
gacauaggacucaaaguuuca

SEQ ID NO: 765323 - RNA, 13 nt, Homo sapiens
gacauaugcagug

SEQ ID NO: 765324 - RNA, 23 nt, Homo sapiens
gacaucaaagugguaaauacugu

SEQ ID NO: 765325 - RNA, 19 nt, Homo sapiens
gacauccccacccuuggag

SEQ ID NO: 765326 - RNA, 20 nt, Homo sapiens
gacaucgcuggaaaugaaua

SEQ ID NO: 765327 - RNA, 14 nt, Homo sapiens
gacaugcacugacc

SEQ ID NO: 765328 - RNA, 17 nt, Homo sapiens
gacaugcccaaggccac

SEQ ID NO: 765329 - RNA, 16 nt, Homo sapiens
gacaugggccuggacg

SEQ ID NO: 765330 - RNA, 21 nt, Homo sapiens
gacauuacaauguguaaugga

SEQ ID NO: 765331 - RNA, 16 nt, Homo sapiens
gacauucggggugauc

SEQ ID NO: 765332 - RNA, 19 nt, Homo sapiens
gacauuggcaccuaaucca

SEQ ID NO: 765333 - RNA, 20 nt, Homo sapiens
gacauuuggugguacuuuau

SEQ ID NO: 765334 - RNA, 20 nt, Homo sapiens
gacauuuuuugcuauaauca

SEQ ID NO: 765335 - RNA, 14 nt, Homo sapiens
gaccaaaacaaaca

SEQ ID NO: 765336 - RNA, 21 nt, Homo sapiens
gaccaaaaugacaaugaugau

SEQ ID NO: 765337 - RNA, 23 nt, Homo sapiens
gaccaaacuggauagaaccacca

SEQ ID NO: 765338 - RNA, 22 nt, Homo sapiens
gaccaaagggaagugaggccca

SEQ ID NO: 765339 - RNA, 16 nt, Homo sapiens
gaccaaagugauaaau

SEQ ID NO: 765340 - RNA, 17 nt, Homo sapiens
gaccaaauaaaguacca

SEQ ID NO: 765341 - RNA, 18 nt, Homo sapiens
gaccaaauaaaguaccau

SEQ ID NO: 765342 - RNA, 20 nt, Homo sapiens
gaccaaaugcuuuuccucaa

SEQ ID NO: 765343 - RNA, 20 nt, Homo sapiens
gaccaagacuuuugucugau

SEQ ID NO: 765344 - RNA, 21 nt, Homo sapiens
gaccaagauggaugcgaccca

SEQ ID NO: 765345 - RNA, 23 nt, Homo sapiens
gaccaaugugugaaguaugcacu

SEQ ID NO: 765346 - RNA, 19 nt, Homo sapiens
gaccacauaagaaggcaau

SEQ ID NO: 765347 - RNA, 17 nt, Homo sapiens
gaccaccaccaggacug

SEQ ID NO: 765348 - RNA, 12 nt, Homo sapiens
gaccacuccugu

SEQ ID NO: 765349 - RNA, 14 nt, Homo sapiens
gaccagcccggcca

SEQ ID NO: 765350 - RNA, 21 nt, Homo sapiens
gaccagccugcccaacguggu

SEQ ID NO: 765351 - RNA, 17 nt, Homo sapiens
gaccaggccugagcaac

SEQ ID NO: 765352 - RNA, 12 nt, Homo sapiens
gaccagggccac

SEQ ID NO: 765353 - RNA, 20 nt, Homo sapiens
gaccaguugaagcugacuca

SEQ ID NO: 765354 - RNA, 15 nt, Homo sapiens
gaccaugcagccgca

SEQ ID NO: 765355 - RNA, 18 nt, Homo sapiens
gaccaugguauauuccua

SEQ ID NO: 765356 - RNA, 11 nt, Homo sapiens
gacccaaaaca

SEQ ID NO: 765357 - RNA, 13 nt, Homo sapiens
gacccaagcugcc

SEQ ID NO: 765358 - RNA, 13 nt, Homo sapiens
gacccacacugcc

SEQ ID NO: 765359 - RNA, 14 nt, Homo sapiens
gacccaccccaacu

SEQ ID NO: 765360 - RNA, 20 nt, Homo sapiens
gacccaccccugugcuccgu

SEQ ID NO: 765361 - RNA, 23 nt, Homo sapiens
gacccaggauaucugaaaauauu

SEQ ID NO: 765362 - RNA, 20 nt, Homo sapiens
gacccaggccuggccaguca

SEQ ID NO: 765363 - RNA, 12 nt, Homo sapiens
gacccagugcag

SEQ ID NO: 765364 - RNA, 11 nt, Homo sapiens
gaccccagugu

SEQ ID NO: 765365 - RNA, 20 nt, Homo sapiens
gacccccguggggcagggag

SEQ ID NO: 765366 - RNA, 18 nt, Homo sapiens
gaccccuaaugucagcuu

SEQ ID NO: 765367 - RNA, 11 nt, Homo sapiens
gacugugccug

SEQ ID NO: 765368 - RNA, 17 nt, Homo sapiens
gacuguggcacacgccu

SEQ ID NO: 765369 - RNA, 20 nt, Homo sapiens
gacuguggcugcuagcacuu

SEQ ID NO: 765370 - RNA, 19 nt, Homo sapiens
gacuuaaggacagcauguc

SEQ ID NO: 765371 - RNA, 23 nt, Homo sapiens
gacuuaauaaagguuuaaagcug

SEQ ID NO: 765372 - RNA, 23 nt, Homo sapiens
gacuuacuaugggauggggucca

SEQ ID NO: 765373 - RNA, 12 nt, Homo sapiens
gacuuaucaaca

SEQ ID NO: 765374 - RNA, 21 nt, Homo sapiens
gacuucaccuaacuagagaca

SEQ ID NO: 765375 - RNA, 23 nt, Homo sapiens
gacuucagaauaacagcacguga

SEQ ID NO: 765376 - RNA, 16 nt, Homo sapiens
gacuucagucuugccu

SEQ ID NO: 765377 - RNA, 20 nt, Homo sapiens
gacuucaugacaagcauuuu

SEQ ID NO: 765378 - RNA, 20 nt, Homo sapiens
gacuuccaucuagucacaaa

SEQ ID NO: 765379 - RNA, 19 nt, Homo sapiens
gacuuccauuugcuuuguc

SEQ ID NO: 765380 - RNA, 19 nt, Homo sapiens
gacuuccgagcuaugucag

SEQ ID NO: 765381 - RNA, 16 nt, Homo sapiens
gacuuccuggggcccc

SEQ ID NO: 765382 - RNA, 21 nt, Homo sapiens
gacuucuugcuggucuaguca

SEQ ID NO: 765383 - RNA, 23 nt, Homo sapiens
gacuugaaauucucaucagucca

SEQ ID NO: 765384 - RNA, 23 nt, Homo sapiens
gacuuggcaggugccuguugaau

SEQ ID NO: 765385 - RNA, 20 nt, Homo sapiens
gacuuggucugauuucagga

SEQ ID NO: 765386 - RNA, 23 nt, Homo sapiens
gacuuuagaaauaaauguaccug

SEQ ID NO: 765387 - RNA, 13 nt, Homo sapiens
gacuuugcugauu

SEQ ID NO: 765388 - RNA, 13 nt, Homo sapiens
gacuuuguguuca

SEQ ID NO: 765389 - RNA, 14 nt, Homo sapiens
gacuuuuaaucagu

SEQ ID NO: 765390 - RNA, 23 nt, Homo sapiens
gacuuuuauaugcuuuuucucag

SEQ ID NO: 765391 - RNA, 22 nt, Homo sapiens
gacuuuuguguaaaaagcaaag

SEQ ID NO: 765392 - RNA, 21 nt, Homo sapiens
gagaaaaaggugccaucucag

SEQ ID NO: 765393 - RNA, 15 nt, Homo sapiens
gagaaaaugccucaa

SEQ ID NO: 765394 - RNA, 21 nt, Homo sapiens
gagaaaauuggaacucuacuc

SEQ ID NO: 765395 - RNA, 22 nt, Homo sapiens
gagaaacaaguauuuugcuaua

SEQ ID NO: 765396 - RNA, 12 nt, Homo sapiens
gagaaacaggcc

SEQ ID NO: 765397 - RNA, 23 nt, Homo sapiens
gagaaaccagggagccccuuuga

SEQ ID NO: 765398 - RNA, 22 nt, Homo sapiens
gagaaaccuuauuguaccucuc

SEQ ID NO: 765399 - RNA, 22 nt, Homo sapiens
gagaaacucaccacaguguuuu

SEQ ID NO: 765400 - RNA, 19 nt, Homo sapiens
gagaaacuguagucucagg

SEQ ID NO: 765401 - RNA, 12 nt, Homo sapiens
gagaaacugugu

SEQ ID NO: 765402 - RNA, 19 nt, Homo sapiens
gagaaagagagaagccagc

SEQ ID NO: 765403 - RNA, 17 nt, Homo sapiens
gagaaagggagugcaug

SEQ ID NO: 765404 - RNA, 20 nt, Homo sapiens
gagaaaggggaaguggucca

SEQ ID NO: 765405 - RNA, 20 nt, Homo sapiens
gagaaauaaaaagccuguca

SEQ ID NO: 765406 - RNA, 22 nt, Homo sapiens
gagaaauccuuccuaaacccaa

SEQ ID NO: 765407 - RNA, 15 nt, Homo sapiens
gagaaaugacuuuga

SEQ ID NO: 765408 - RNA, 13 nt, Homo sapiens
gagaaauggccaa

SEQ ID NO: 765409 - RNA, 14 nt, Homo sapiens
gagaaauggccaaa

SEQ ID NO: 765410 - RNA, 14 nt, Homo sapiens
gagaaaugugucau

SEQ ID NO: 765411 - RNA, 21 nt, Homo sapiens
gagaacaccgagcacugaacu

SEQ ID NO: 765412 - RNA, 12 nt, Homo sapiens
gagaaccuucca

SEQ ID NO: 765413 - RNA, 23 nt, Homo sapiens
gagaacuauaccugcuucaguga

SEQ ID NO: 765414 - RNA, 21 nt, Homo sapiens
gagaacuuuuugcaugcuuau

SEQ ID NO: 765415 - RNA, 19 nt, Homo sapiens
gagaagaagguggucaucu

SEQ ID NO: 765416 - RNA, 17 nt, Homo sapiens
gagaagaauagaggucc

SEQ ID NO: 765417 - RNA, 15 nt, Homo sapiens
gagaagcagcauuug

SEQ ID NO: 765418 - RNA, 18 nt, Homo sapiens
agaccgccccagggcuau

SEQ ID NO: 765419 - RNA, 12 nt, Homo sapiens
agaccugaggga

SEQ ID NO: 765420 - RNA, 18 nt, Homo sapiens
agaccugcugugaugacu

SEQ ID NO: 765421 - RNA, 20 nt, Homo sapiens
agaccugguucccgccuccc

SEQ ID NO: 765422 - RNA, 11 nt, Homo sapiens
agaccuuccag

SEQ ID NO: 765423 - RNA, 17 nt, Homo sapiens
agaccuuuggagcaaag

SEQ ID NO: 765424 - RNA, 15 nt, Homo sapiens
agacgagguuucacu

SEQ ID NO: 765425 - RNA, 21 nt, Homo sapiens
agacgcccuauuucuauguca

SEQ ID NO: 765426 - RNA, 18 nt, Homo sapiens
agacgccuuccaggucag

SEQ ID NO: 765427 - RNA, 23 nt, Homo sapiens
agacgcugcugucacaaccaaga

SEQ ID NO: 765428 - RNA, 15 nt, Homo sapiens
agacggagucuugcu

SEQ ID NO: 765429 - RNA, 22 nt, Homo sapiens
agacggcggccaggcacagggc

SEQ ID NO: 765430 - RNA, 23 nt, Homo sapiens
agacggcggccaggcacagggcc

SEQ ID NO: 765431 - RNA, 17 nt, Homo sapiens
agacgguguuuugccau

SEQ ID NO: 765432 - RNA, 16 nt, Homo sapiens
agacgguuuccaggga

SEQ ID NO: 765433 - RNA, 16 nt, Homo sapiens
agacguccuccgucca

SEQ ID NO: 765434 - RNA, 21 nt, Homo sapiens
agacguccuccguccauauca

SEQ ID NO: 765435 - RNA, 18 nt, Homo sapiens
agacguuaggcauuuccu

SEQ ID NO: 765436 - RNA, 13 nt, Homo sapiens
agacuaagccaga

SEQ ID NO: 765437 - RNA, 13 nt, Homo sapiens
agacuaauugugu

SEQ ID NO: 765438 - RNA, 19 nt, Homo sapiens
agacuacuaaugacuuugu

SEQ ID NO: 765439 - RNA, 13 nt, Homo sapiens
agacuagugccgu

SEQ ID NO: 765440 - RNA, 14 nt, Homo sapiens
agacuauagccauc

SEQ ID NO: 765441 - RNA, 20 nt, Homo sapiens
agacuaugauuuaccuauac

SEQ ID NO: 765442 - RNA, 13 nt, Homo sapiens
agacuauggagcc

SEQ ID NO: 765443 - RNA, 20 nt, Homo sapiens
agacuauggagccuggcaca

SEQ ID NO: 765444 - RNA, 19 nt, Homo sapiens
agacuauuaggugcaauuu

SEQ ID NO: 765445 - RNA, 16 nt, Homo sapiens
agacuauucuaaugaa

SEQ ID NO: 765446 - RNA, 17 nt, Homo sapiens
agacuauuuuauaugau

SEQ ID NO: 765447 - RNA, 17 nt, Homo sapiens
agacucaaauguucuaa

SEQ ID NO: 765448 - RNA, 19 nt, Homo sapiens
agacucaccuguucucacu

SEQ ID NO: 765449 - RNA, 16 nt, Homo sapiens
agacuccagccugaau

SEQ ID NO: 765450 - RNA, 18 nt, Homo sapiens
agacucccuccauagcga

SEQ ID NO: 765451 - RNA, 15 nt, Homo sapiens
agacuccgcccuccu

SEQ ID NO: 765452 - RNA, 17 nt, Homo sapiens
agacuccucaucaugau

SEQ ID NO: 765453 - RNA, 17 nt, Homo sapiens
agacucgagaacuuuca

SEQ ID NO: 765454 - RNA, 15 nt, Homo sapiens
agacucuaguauuua

SEQ ID NO: 765455 - RNA, 21 nt, Homo sapiens
agacucucucugggaggccau

SEQ ID NO: 765456 - RNA, 12 nt, Homo sapiens
agacucugaccu

SEQ ID NO: 765457 - RNA, 21 nt, Homo sapiens
agacucuuaaugcagacucuu

SEQ ID NO: 765458 - RNA, 17 nt, Homo sapiens
agacugaaucuaccugc

SEQ ID NO: 765459 - RNA, 20 nt, Homo sapiens
agacugaccauauugugcuu

SEQ ID NO: 765460 - RNA, 22 nt, Homo sapiens
agacugacuuguuugucuucca

SEQ ID NO: 765461 - RNA, 13 nt, Homo sapiens
agacugagcucuc

SEQ ID NO: 765462 - RNA, 13 nt, Homo sapiens
agacugcaucuca

SEQ ID NO: 765463 - RNA, 16 nt, Homo sapiens
agacugccauacauaa

SEQ ID NO: 765464 - RNA, 10 nt, Homo sapiens
agacugcugc

SEQ ID NO: 765465 - RNA, 19 nt, Homo sapiens
agacuggaaugcagugaca

SEQ ID NO: 765466 - RNA, 14 nt, Homo sapiens
agacuggcuugccc

SEQ ID NO: 765467 - RNA, 17 nt, Homo sapiens
agacuggggacccugga

SEQ ID NO: 765468 - RNA, 19 nt, Homo sapiens
agacuggggcauccugugc

SEQ ID NO: 765469 - RNA, 20 nt, Homo sapiens
agacugggucucgcuuuguu

SEQ ID NO: 765470 - RNA, 21 nt, Homo sapiens
agacugggucucgcuuuguug

SEQ ID NO: 765471 - RNA, 20 nt, Homo sapiens
agacuggguuacauaugccu

SEQ ID NO: 765472 - RNA, 22 nt, Homo sapiens
agacugugcccugggagcucug

SEQ ID NO: 765473 - RNA, 19 nt, Homo sapiens
agacuguugaguuaugaua

SEQ ID NO: 765474 - RNA, 15 nt, Homo sapiens
agacuuaauucugau

SEQ ID NO: 765475 - RNA, 18 nt, Homo sapiens
agacuucaucuucaaaac

SEQ ID NO: 765476 - RNA, 16 nt, Homo sapiens
agacuucgacucagga

SEQ ID NO: 765477 - RNA, 15 nt, Homo sapiens
agacuucguaauuaa

SEQ ID NO: 765478 - RNA, 15 nt, Homo sapiens
agacuugaacauuug

SEQ ID NO: 765479 - RNA, 13 nt, Homo sapiens
agacuuggagcug

SEQ ID NO: 765480 - RNA, 14 nt, Homo sapiens
agacuugguuucaa

SEQ ID NO: 765481 - RNA, 20 nt, Homo sapiens
agacuuuauaauuccuucug

SEQ ID NO: 765482 - RNA, 13 nt, Homo sapiens
agacuuucuguua

SEQ ID NO: 765483 - RNA, 23 nt, Homo sapiens
agagaaaccgggagaaggcauga

SEQ ID NO: 765484 - RNA, 20 nt, Homo sapiens
agagaaaccguggagaucgc

SEQ ID NO: 765485 - RNA, 21 nt, Homo sapiens
agagaaacuguguauagcuua

SEQ ID NO: 765486 - RNA, 13 nt, Homo sapiens
agagaaaguguga

SEQ ID NO: 765487 - RNA, 20 nt, Homo sapiens
agagaaaguuucagauuugc

SEQ ID NO: 765488 - RNA, 13 nt, Homo sapiens
agagaaauguguc

SEQ ID NO: 765489 - RNA, 17 nt, Homo sapiens
agagaaccgagcaaaga

SEQ ID NO: 765490 - RNA, 15 nt, Homo sapiens
agagaaccucagauc

SEQ ID NO: 765491 - RNA, 22 nt, Homo sapiens
agagaaccucagaucaggugca

SEQ ID NO: 765492 - RNA, 20 nt, Homo sapiens
agagaaccucagguacggag

SEQ ID NO: 765493 - RNA, 20 nt, Homo sapiens
agagaagauagcagggcaug

SEQ ID NO: 765494 - RNA, 22 nt, Homo sapiens
agagaagccaaacagcaagaag

SEQ ID NO: 765495 - RNA, 12 nt, Homo sapiens
agagaagcugcu

SEQ ID NO: 765496 - RNA, 17 nt, Homo sapiens
agagaaguguggggaag

SEQ ID NO: 765497 - RNA, 21 nt, Homo sapiens
agagaaguuguaaaguaugua

SEQ ID NO: 765498 - RNA, 14 nt, Homo sapiens
agagaaucauacuu

SEQ ID NO: 765499 - RNA, 14 nt, Homo sapiens
agagaaucugauca

SEQ ID NO: 765500 - RNA, 20 nt, Homo sapiens
agagaauucucuuauccaac

SEQ ID NO: 765501 - RNA, 12 nt, Homo sapiens
agagacaucaaa

SEQ ID NO: 765502 - RNA, 14 nt, Homo sapiens
agagaccuauguaa

SEQ ID NO: 765503 - RNA, 14 nt, Homo sapiens
agagacuccgucuc

SEQ ID NO: 765504 - RNA, 18 nt, Homo sapiens
agagagaacaggugggcu

SEQ ID NO: 765505 - RNA, 20 nt, Homo sapiens
agagagaaccaccacugccu

SEQ ID NO: 765506 - RNA, 19 nt, Homo sapiens
agagagaagcaaguggugg

SEQ ID NO: 765507 - RNA, 16 nt, Homo sapiens
agagagaggcauuuag

SEQ ID NO: 765508 - RNA, 17 nt, Homo sapiens
agagagauguauguguc

SEQ ID NO: 765509 - RNA, 21 nt, Homo sapiens
agagagcagcuucagugacaa

SEQ ID NO: 765510 - RNA, 13 nt, Homo sapiens
agagaggaagagc

SEQ ID NO: 765511 - RNA, 23 nt, Homo sapiens
agagaggagguaguuaagggaug

SEQ ID NO: 765512 - RNA, 15 nt, Homo sapiens
acuccccugcacugg

SEQ ID NO: 765513 - RNA, 18 nt, Homo sapiens
acucccuaaguaauccca

SEQ ID NO: 765514 - RNA, 24 nt, Homo sapiens
acucccucuucacuguggccacag

SEQ ID NO: 765515 - RNA, 23 nt, Homo sapiens
acucccugaucccagaccugucg

SEQ ID NO: 765516 - RNA, 20 nt, Homo sapiens
acucccuguuuuaauucaac

SEQ ID NO: 765517 - RNA, 22 nt, Homo sapiens
acuccggccugggugacagagu

SEQ ID NO: 765518 - RNA, 20 nt, Homo sapiens
acuccgggaccauugaccuc

SEQ ID NO: 765519 - RNA, 18 nt, Homo sapiens
acuccuaagacuuaugua

SEQ ID NO: 765520 - RNA, 17 nt, Homo sapiens
acuccuauaugaugcag

SEQ ID NO: 765521 - RNA, 21 nt, Homo sapiens
acuccucauccccacaaucug

SEQ ID NO: 765522 - RNA, 20 nt, Homo sapiens
acuccucuccuggaucaaaa

SEQ ID NO: 765523 - RNA, 13 nt, Homo sapiens
acuccucuuggug

SEQ ID NO: 765524 - RNA, 12 nt, Homo sapiens
acuccugcaaaa

SEQ ID NO: 765525 - RNA, 21 nt, Homo sapiens
acuccugucccuguagcucag

SEQ ID NO: 765526 - RNA, 22 nt, Homo sapiens
acucgauguaagggauuccuug

SEQ ID NO: 765527 - RNA, 21 nt, Homo sapiens
acucgcuugagaugggaaagc

SEQ ID NO: 765528 - RNA, 21 nt, Homo sapiens
acucggaaacuauaaguaauu

SEQ ID NO: 765529 - RNA, 17 nt, Homo sapiens
acucggcgugcuccuuu

SEQ ID NO: 765530 - RNA, 17 nt, Homo sapiens
acucgucuuccuuguua

SEQ ID NO: 765531 - RNA, 21 nt, Homo sapiens
acucuaaagaaaaaugccugu

SEQ ID NO: 765532 - RNA, 22 nt, Homo sapiens
acucuaauuguccauucuugcu

SEQ ID NO: 765533 - RNA, 17 nt, Homo sapiens
acucuacucaacccauu

SEQ ID NO: 765534 - RNA, 15 nt, Homo sapiens
acucuagaaaaaagg

SEQ ID NO: 765535 - RNA, 17 nt, Homo sapiens
acucuagagagccuuaa

SEQ ID NO: 765536 - RNA, 18 nt, Homo sapiens
acucuagagagccuuaac

SEQ ID NO: 765537 - RNA, 13 nt, Homo sapiens
acucuagauucca

SEQ ID NO: 765538 - RNA, 21 nt, Homo sapiens
acucuaggggucaggcuccau

SEQ ID NO: 765539 - RNA, 18 nt, Homo sapiens
acucuaggguccagugga

SEQ ID NO: 765540 - RNA, 21 nt, Homo sapiens
acucuaugaguuggacuucag

SEQ ID NO: 765541 - RNA, 20 nt, Homo sapiens
acucuauuuaagauucccaa

SEQ ID NO: 765542 - RNA, 18 nt, Homo sapiens
acucucaagugucuuagg

SEQ ID NO: 765543 - RNA, 16 nt, Homo sapiens
acucucgugcauuuca

SEQ ID NO: 765544 - RNA, 19 nt, Homo sapiens
acucucucccuggucucug

SEQ ID NO: 765545 - RNA, 16 nt, Homo sapiens
acucugauucaccucu

SEQ ID NO: 765546 - RNA, 15 nt, Homo sapiens
acucugcacaugucu

SEQ ID NO: 765547 - RNA, 20 nt, Homo sapiens
acucugcacaugucuuguac

SEQ ID NO: 765548 - RNA, 19 nt, Homo sapiens
acucugccuacagaacuuc

SEQ ID NO: 765549 - RNA, 22 nt, Homo sapiens
acucugccuacuucugagcaaa

SEQ ID NO: 765550 - RNA, 17 nt, Homo sapiens
acucugccucuguauau

SEQ ID NO: 765551 - RNA, 17 nt, Homo sapiens
acucugcuagacuccuc

SEQ ID NO: 765552 - RNA, 17 nt, Homo sapiens
acucuggagcaaccuac

SEQ ID NO: 765553 - RNA, 23 nt, Homo sapiens
acucuggggagccugagccacaa

SEQ ID NO: 765554 - RNA, 19 nt, Homo sapiens
acucuguaauugaauauaa

SEQ ID NO: 765555 - RNA, 22 nt, Homo sapiens
acucuguaauugaauauaaaug

SEQ ID NO: 765556 - RNA, 17 nt, Homo sapiens
acucuguccaggccacu

SEQ ID NO: 765557 - RNA, 18 nt, Homo sapiens
acucuguugguagcaauu

SEQ ID NO: 765558 - RNA, 15 nt, Homo sapiens
acucuuaaagacauc

SEQ ID NO: 765559 - RNA, 14 nt, Homo sapiens
acucuuccaccucc

SEQ ID NO: 765560 - RNA, 18 nt, Homo sapiens
acucuuccagaaucccaa

SEQ ID NO: 765561 - RNA, 16 nt, Homo sapiens
acucuugaacugggcg

SEQ ID NO: 765562 - RNA, 19 nt, Homo sapiens
acucuugaauagacuucca

SEQ ID NO: 765563 - RNA, 15 nt, Homo sapiens
acucuugugaauuau

SEQ ID NO: 765564 - RNA, 23 nt, Homo sapiens
acucuuguuuucugguaaaacuu

SEQ ID NO: 765565 - RNA, 19 nt, Homo sapiens
acucuuucuggccugccuu

SEQ ID NO: 765566 - RNA, 18 nt, Homo sapiens
acugaaaacuuagccaga

SEQ ID NO: 765567 - RNA, 20 nt, Homo sapiens
acugaaaaugucacauucua

SEQ ID NO: 765568 - RNA, 15 nt, Homo sapiens
acugaaacauucaca

SEQ ID NO: 765569 - RNA, 15 nt, Homo sapiens
acugaaaccaggugg

SEQ ID NO: 765570 - RNA, 21 nt, Homo sapiens
acugaaacuguaugugcugua

SEQ ID NO: 765571 - RNA, 14 nt, Homo sapiens
acugaaacuucccu

SEQ ID NO: 765572 - RNA, 19 nt, Homo sapiens
acugaacaaaaccuacaca

SEQ ID NO: 765573 - RNA, 20 nt, Homo sapiens
acugaacaaaaccuacacac

SEQ ID NO: 765574 - RNA, 19 nt, Homo sapiens
acugaacaaaaccuacgca

SEQ ID NO: 765575 - RNA, 12 nt, Homo sapiens
acugaacauguu

SEQ ID NO: 765576 - RNA, 15 nt, Homo sapiens
acugaaccauuccaa

SEQ ID NO: 765577 - RNA, 12 nt, Homo sapiens
acugaacuccau

SEQ ID NO: 765578 - RNA, 20 nt, Homo sapiens
acugaacuuaauaacugugu

SEQ ID NO: 765579 - RNA, 17 nt, Homo sapiens
acugaagaagaugagcc

SEQ ID NO: 765580 - RNA, 12 nt, Homo sapiens
acugaagcacag

SEQ ID NO: 765581 - RNA, 13 nt, Homo sapiens
acugaaggcauau

SEQ ID NO: 765582 - RNA, 18 nt, Homo sapiens
acugaagugaacuaugaa

SEQ ID NO: 765583 - RNA, 16 nt, Homo sapiens
acugaauacagucuca

SEQ ID NO: 765584 - RNA, 13 nt, Homo sapiens
acugaauucacuc

SEQ ID NO: 765585 - RNA, 22 nt, Homo sapiens
acugaauuuggaggcuggagua

SEQ ID NO: 765586 - RNA, 21 nt, Homo sapiens
acugacacaagaauggucuuu

SEQ ID NO: 765587 - RNA, 18 nt, Homo sapiens
acugacacgaagccagca

SEQ ID NO: 765588 - RNA, 20 nt, Homo sapiens
acugacccuggucaccagag

SEQ ID NO: 765589 - RNA, 12 nt, Homo sapiens
acugaccuaccu

SEQ ID NO: 765590 - RNA, 18 nt, Homo sapiens
acugacggaguccugugu

SEQ ID NO: 765591 - RNA, 13 nt, Homo sapiens
acugacuccuuag

SEQ ID NO: 765592 - RNA, 17 nt, Homo sapiens
acugacugaaugcuguu

SEQ ID NO: 765593 - RNA, 20 nt, Homo sapiens
acugacuuguuugucuucca

SEQ ID NO: 765594 - RNA, 13 nt, Homo sapiens
acugagaucuguu

SEQ ID NO: 765595 - RNA, 13 nt, Homo sapiens
acugagcaugcag

SEQ ID NO: 765596 - RNA, 14 nt, Homo sapiens
acugagccuagcua

SEQ ID NO: 765597 - RNA, 14 nt, Homo sapiens
acugaggagacaga

SEQ ID NO: 765598 - RNA, 14 nt, Homo sapiens
acugaggcagacag

SEQ ID NO: 765599 - RNA, 19 nt, Homo sapiens
acugaggcagcgaccucaa

SEQ ID NO: 765600 - RNA, 20 nt, Homo sapiens
acugaggcagcgaccucaag

SEQ ID NO: 765601 - RNA, 14 nt, Homo sapiens
agccacugugaugc

SEQ ID NO: 765602 - RNA, 23 nt, Homo sapiens
agccacugugcccagcccggaua

SEQ ID NO: 765603 - RNA, 15 nt, Homo sapiens
agccagaaagcacua

SEQ ID NO: 765604 - RNA, 20 nt, Homo sapiens
agccagacuugcuuccugca

SEQ ID NO: 765605 - RNA, 16 nt, Homo sapiens
agccagaggcaucuga

SEQ ID NO: 765606 - RNA, 19 nt, Homo sapiens
agccagcaaccagcacauc

SEQ ID NO: 765607 - RNA, 21 nt, Homo sapiens
agccagcaaguaagcuagcca

SEQ ID NO: 765608 - RNA, 14 nt, Homo sapiens
agccagcacuugua

SEQ ID NO: 765609 - RNA, 15 nt, Homo sapiens
agccagcagccagcu

SEQ ID NO: 765610 - RNA, 19 nt, Homo sapiens
agccagcagccagcucuca

SEQ ID NO: 765611 - RNA, 17 nt, Homo sapiens
agccagcugcuuuuugu

SEQ ID NO: 765612 - RNA, 15 nt, Homo sapiens
agccagcuuaaaccc

SEQ ID NO: 765613 - RNA, 22 nt, Homo sapiens
agccaggccugaccucaagcaa

SEQ ID NO: 765614 - RNA, 22 nt, Homo sapiens
agccaggccugggggcagccuc

SEQ ID NO: 765615 - RNA, 18 nt, Homo sapiens
agccaggcugagugagcc

SEQ ID NO: 765616 - RNA, 16 nt, Homo sapiens
agccaggcugccaagg

SEQ ID NO: 765617 - RNA, 18 nt, Homo sapiens
agccagggcugucuucgu

SEQ ID NO: 765618 - RNA, 21 nt, Homo sapiens
agccaggguguggcccugcca

SEQ ID NO: 765619 - RNA, 21 nt, Homo sapiens
agccaggugagaaaaccaugg

SEQ ID NO: 765620 - RNA, 21 nt, Homo sapiens
agccaguggggaugaggucac

SEQ ID NO: 765621 - RNA, 17 nt, Homo sapiens
agccaguuguugccaac

SEQ ID NO: 765622 - RNA, 21 nt, Homo sapiens
agccaguuguugccaaccuua

SEQ ID NO: 765623 - RNA, 22 nt, Homo sapiens
agccaguuuggguaaaauacuu

SEQ ID NO: 765624 - RNA, 20 nt, Homo sapiens
agccauaagaaagcacuauu

SEQ ID NO: 765625 - RNA, 22 nt, Homo sapiens
agccauaagaaagcacuauuaa

SEQ ID NO: 765626 - RNA, 17 nt, Homo sapiens
agccauauguacauaau

SEQ ID NO: 765627 - RNA, 20 nt, Homo sapiens
agccaucccuuuuuuuacau

SEQ ID NO: 765628 - RNA, 23 nt, Homo sapiens
agccaucccuuuuuuuacauuuc

SEQ ID NO: 765629 - RNA, 15 nt, Homo sapiens
agccaucuaaugcuu

SEQ ID NO: 765630 - RNA, 17 nt, Homo sapiens
agccaugcaaugccaaa

SEQ ID NO: 765631 - RNA, 11 nt, Homo sapiens
agccaugccug

SEQ ID NO: 765632 - RNA, 17 nt, Homo sapiens
agccauuuuacauagca

SEQ ID NO: 765633 - RNA, 16 nt, Homo sapiens
agcccaacagcacuuu

SEQ ID NO: 765634 - RNA, 17 nt, Homo sapiens
agcccaacagcacuuuu

SEQ ID NO: 765635 - RNA, 19 nt, Homo sapiens
agcccaacuagaagccuag

SEQ ID NO: 765636 - RNA, 20 nt, Homo sapiens
agcccacuguuaauauucua

SEQ ID NO: 765637 - RNA, 18 nt, Homo sapiens
agcccagaauagcuuuga

SEQ ID NO: 765638 - RNA, 20 nt, Homo sapiens
agcccagcccuccucuguca

SEQ ID NO: 765639 - RNA, 19 nt, Homo sapiens
agcccagcucuugcucucu

SEQ ID NO: 765640 - RNA, 17 nt, Homo sapiens
agcccagcuugccaaug

SEQ ID NO: 765641 - RNA, 22 nt, Homo sapiens
agcccagcuuggcccuuuccuu

SEQ ID NO: 765642 - RNA, 20 nt, Homo sapiens
agcccaggaccaccacuuau

SEQ ID NO: 765643 - RNA, 13 nt, Homo sapiens
agcccagugcaaa

SEQ ID NO: 765644 - RNA, 14 nt, Homo sapiens
agcccagugcacug

SEQ ID NO: 765645 - RNA, 19 nt, Homo sapiens
agcccauaucuacaguacu

SEQ ID NO: 765646 - RNA, 19 nt, Homo sapiens
agcccauccugaccagcug

SEQ ID NO: 765647 - RNA, 22 nt, Homo sapiens
agcccaugcucaaccacugugg

SEQ ID NO: 765648 - RNA, 20 nt, Homo sapiens
agcccauggcccccaauaaa

SEQ ID NO: 765649 - RNA, 21 nt, Homo sapiens
agcccauggcccccaauaaag

SEQ ID NO: 765650 - RNA, 19 nt, Homo sapiens
agcccauggccucuggcca

SEQ ID NO: 765651 - RNA, 23 nt, Homo sapiens
agcccauggcuuuagcuaccuca

SEQ ID NO: 765652 - RNA, 22 nt, Homo sapiens
agcccauggugagcucugggaa

SEQ ID NO: 765653 - RNA, 15 nt, Homo sapiens
agccccaagcugggc

SEQ ID NO: 765654 - RNA, 12 nt, Homo sapiens
agccccacagac

SEQ ID NO: 765655 - RNA, 13 nt, Homo sapiens
agccccacccugg

SEQ ID NO: 765656 - RNA, 16 nt, Homo sapiens
agccccagaguggcuc

SEQ ID NO: 765657 - RNA, 15 nt, Homo sapiens
agccccaucagcucc

SEQ ID NO: 765658 - RNA, 13 nt, Homo sapiens
agccccccaugua

SEQ ID NO: 765659 - RNA, 20 nt, Homo sapiens
agcccccccaacacugugcc

SEQ ID NO: 765660 - RNA, 14 nt, Homo sapiens
agcccccucuuccu

SEQ ID NO: 765661 - RNA, 24 nt, Homo sapiens
agcccccuggaugggcauugggcu

SEQ ID NO: 765662 - RNA, 23 nt, Homo sapiens
agccccuccaaaggucugauguc

SEQ ID NO: 765663 - RNA, 17 nt, Homo sapiens
agccccuccucugagca

SEQ ID NO: 765664 - RNA, 23 nt, Homo sapiens
agccccuggccugugccuuccaa

SEQ ID NO: 765665 - RNA, 22 nt, Homo sapiens
agccccugggcccaguaccuag

SEQ ID NO: 765666 - RNA, 20 nt, Homo sapiens
agccccuuauuugcacuuca

SEQ ID NO: 765667 - RNA, 17 nt, Homo sapiens
agcccgacagugccauc

SEQ ID NO: 765668 - RNA, 19 nt, Homo sapiens
agcccgccugccgugcaug

SEQ ID NO: 765669 - RNA, 20 nt, Homo sapiens
agcccguuagccccagggau

SEQ ID NO: 765670 - RNA, 13 nt, Homo sapiens
agcccuaaucuca

SEQ ID NO: 765671 - RNA, 23 nt, Homo sapiens
agcccuacauugugcugcaccug

SEQ ID NO: 765672 - RNA, 17 nt, Homo sapiens
agcccuauuucaguuua

SEQ ID NO: 765673 - RNA, 20 nt, Homo sapiens
agcccucaugaucauucuca

SEQ ID NO: 765674 - RNA, 14 nt, Homo sapiens
agcccucauuuuua

SEQ ID NO: 765675 - RNA, 22 nt, Homo sapiens
agcccucauuuuuauaaccugg

SEQ ID NO: 765676 - RNA, 15 nt, Homo sapiens
agcccugaggugaaa

SEQ ID NO: 765677 - RNA, 18 nt, Homo sapiens
agcccugcuuagcucauc

SEQ ID NO: 765678 - RNA, 21 nt, Homo sapiens
agcccugggaaccacucccac

SEQ ID NO: 765679 - RNA, 18 nt, Homo sapiens
agcccugucgagacacuu

SEQ ID NO: 765680 - RNA, 14 nt, Homo sapiens
agcccugucugcua

SEQ ID NO: 765681 - RNA, 22 nt, Homo sapiens
agcccuguggccgccaccugag

SEQ ID NO: 765682 - RNA, 18 nt, Homo sapiens
agcccuuauggccaauaa

SEQ ID NO: 765683 - RNA, 19 nt, Homo sapiens
agcccuucccaggcuggau

SEQ ID NO: 765684 - RNA, 21 nt, Homo sapiens
agcccuucuauacccacccag

SEQ ID NO: 765685 - RNA, 12 nt, Homo sapiens
agccgaccucag

SEQ ID NO: 765686 - RNA, 18 nt, Homo sapiens
agccgagaucacaccacu

SEQ ID NO: 765687 - RNA, 20 nt, Homo sapiens
agccgagaucacaccacugu

SEQ ID NO: 765688 - RNA, 17 nt, Homo sapiens
agccgagaucgcgccac

SEQ ID NO: 765689 - RNA, 22 nt, Homo sapiens
agccgccguggcuauaccuggg

SEQ ID NO: 765690 - RNA, 18 nt, Homo sapiens
agccgccugaaagccaca

SEQ ID NO: 765691 - RNA, 12 nt, Homo sapiens
agcacuggguug

SEQ ID NO: 765692 - RNA, 17 nt, Homo sapiens
agcacugugagcaccug

SEQ ID NO: 765693 - RNA, 12 nt, Homo sapiens
agcacugugguc

SEQ ID NO: 765694 - RNA, 21 nt, Homo sapiens
agcacuguuuauacacugugu

SEQ ID NO: 765695 - RNA, 22 nt, Homo sapiens
agcacuguuuauacacugugua

SEQ ID NO: 765696 - RNA, 11 nt, Homo sapiens
agcacuuuauc

SEQ ID NO: 765697 - RNA, 21 nt, Homo sapiens
agcagaaaaaaaagugucuca

SEQ ID NO: 765698 - RNA, 23 nt, Homo sapiens
agcagaaaucuagaagacuguca

SEQ ID NO: 765699 - RNA, 18 nt, Homo sapiens
agcagaacaaauguguuu

SEQ ID NO: 765700 - RNA, 16 nt, Homo sapiens
agcagaacaccugagg

SEQ ID NO: 765701 - RNA, 20 nt, Homo sapiens
agcagaacacugcagucaga

SEQ ID NO: 765702 - RNA, 20 nt, Homo sapiens
agcagaacagaucuuuuacu

SEQ ID NO: 765703 - RNA, 15 nt, Homo sapiens
agcagaacugaaccg

SEQ ID NO: 765704 - RNA, 14 nt, Homo sapiens
agcagaaggccauc

SEQ ID NO: 765705 - RNA, 22 nt, Homo sapiens
agcagaccacacagaagggugu

SEQ ID NO: 765706 - RNA, 15 nt, Homo sapiens
agcagagaacuggaa

SEQ ID NO: 765707 - RNA, 13 nt, Homo sapiens
agcagagcaggca

SEQ ID NO: 765708 - RNA, 13 nt, Homo sapiens
agcagagcauuca

SEQ ID NO: 765709 - RNA, 20 nt, Homo sapiens
agcagaggaauaacaucacc

SEQ ID NO: 765710 - RNA, 20 nt, Homo sapiens
agcagaggaccagggccuuu

SEQ ID NO: 765711 - RNA, 15 nt, Homo sapiens
agcagaggucuccca

SEQ ID NO: 765712 - RNA, 21 nt, Homo sapiens
agcagaguguucccugacucc

SEQ ID NO: 765713 - RNA, 14 nt, Homo sapiens
agcagauacuugag

SEQ ID NO: 765714 - RNA, 18 nt, Homo sapiens
agcagaucucauguccuc

SEQ ID NO: 765715 - RNA, 21 nt, Homo sapiens
agcagauggacagcgaugagg

SEQ ID NO: 765716 - RNA, 16 nt, Homo sapiens
agcagauuguguaaca

SEQ ID NO: 765717 - RNA, 13 nt, Homo sapiens
agcagauuuaaca

SEQ ID NO: 765718 - RNA, 15 nt, Homo sapiens
agcagauuugcacug

SEQ ID NO: 765719 - RNA, 17 nt, Homo sapiens
agcagcaaaaacuacau

SEQ ID NO: 765720 - RNA, 20 nt, Homo sapiens
agcagcaccaaccacagcau

SEQ ID NO: 765721 - RNA, 13 nt, Homo sapiens
agcagcacuguga

SEQ ID NO: 765722 - RNA, 13 nt, Homo sapiens
agcagcagcacca

SEQ ID NO: 765723 - RNA, 18 nt, Homo sapiens
agcagcauaggaacaaua

SEQ ID NO: 765724 - RNA, 18 nt, Homo sapiens
agcagccacaaccaaaaa

SEQ ID NO: 765725 - RNA, 18 nt, Homo sapiens
agcagcccuaaggaucuc

SEQ ID NO: 765726 - RNA, 15 nt, Homo sapiens
agcagcccugucacg

SEQ ID NO: 765727 - RNA, 18 nt, Homo sapiens
agcagcggauugcucugg

SEQ ID NO: 765728 - RNA, 15 nt, Homo sapiens
agcagcuaucucuca

SEQ ID NO: 765729 - RNA, 23 nt, Homo sapiens
agcagcucuccccaggcauuugc

SEQ ID NO: 765730 - RNA, 18 nt, Homo sapiens
agcagcuuagacagcagg

SEQ ID NO: 765731 - RNA, 13 nt, Homo sapiens
agcaggacuccag

SEQ ID NO: 765732 - RNA, 14 nt, Homo sapiens
agcaggcacgggug

SEQ ID NO: 765733 - RNA, 13 nt, Homo sapiens
agcaggccaggga

SEQ ID NO: 765734 - RNA, 18 nt, Homo sapiens
agcaggccuaagacaugu

SEQ ID NO: 765735 - RNA, 23 nt, Homo sapiens
agcaggcggccuuuguugcucag

SEQ ID NO: 765736 - RNA, 18 nt, Homo sapiens
agcagggauuaaccucug

SEQ ID NO: 765737 - RNA, 18 nt, Homo sapiens
agcaggggaacaaaauaa

SEQ ID NO: 765738 - RNA, 19 nt, Homo sapiens
agcaggggggcugugccaa

SEQ ID NO: 765739 - RNA, 17 nt, Homo sapiens
agcaguaaauuugcuag

SEQ ID NO: 765740 - RNA, 19 nt, Homo sapiens
agcaguaagcuaucuucaa

SEQ ID NO: 765741 - RNA, 23 nt, Homo sapiens
agcaguaguuuguuguagguuuc

SEQ ID NO: 765742 - RNA, 12 nt, Homo sapiens
agcagucagggu

SEQ ID NO: 765743 - RNA, 16 nt, Homo sapiens
agcagugaucucaggg

SEQ ID NO: 765744 - RNA, 18 nt, Homo sapiens
agcagugaucucagggca

SEQ ID NO: 765745 - RNA, 17 nt, Homo sapiens
agcagugccuuccauaa

SEQ ID NO: 765746 - RNA, 17 nt, Homo sapiens
agcagugucuguaccuc

SEQ ID NO: 765747 - RNA, 17 nt, Homo sapiens
agcagugucuuccauaa

SEQ ID NO: 765748 - RNA, 18 nt, Homo sapiens
agcaguuagcucauuuga

SEQ ID NO: 765749 - RNA, 18 nt, Homo sapiens
agcaguuauggugaugac

SEQ ID NO: 765750 - RNA, 18 nt, Homo sapiens
agcauaaaacuuuggcaa

SEQ ID NO: 765751 - RNA, 13 nt, Homo sapiens
agcauaacuggag

SEQ ID NO: 765752 - RNA, 18 nt, Homo sapiens
agcauaaguuucugggac

SEQ ID NO: 765753 - RNA, 20 nt, Homo sapiens
agcauacccuuacucugcca

SEQ ID NO: 765754 - RNA, 15 nt, Homo sapiens
agcauagaaaccacu

SEQ ID NO: 765755 - RNA, 18 nt, Homo sapiens
agcauagauuugcagcuc

SEQ ID NO: 765756 - RNA, 16 nt, Homo sapiens
agcauagccagcauuc

SEQ ID NO: 765757 - RNA, 13 nt, Homo sapiens
agcauauacuggu

SEQ ID NO: 765758 - RNA, 22 nt, Homo sapiens
agcauauaggugauguuugcuc

SEQ ID NO: 765759 - RNA, 22 nt, Homo sapiens
agcauaugggugggauuuugca

SEQ ID NO: 765760 - RNA, 14 nt, Homo sapiens
agcauauuuugcug

SEQ ID NO: 765761 - RNA, 18 nt, Homo sapiens
agcaucaaaaacaucacu

SEQ ID NO: 765762 - RNA, 13 nt, Homo sapiens
agcaucaauacaa

SEQ ID NO: 765763 - RNA, 16 nt, Homo sapiens
agcaucaccucaggcc

SEQ ID NO: 765764 - RNA, 23 nt, Homo sapiens
agcaucagagguuugcuuccuca

SEQ ID NO: 765765 - RNA, 18 nt, Homo sapiens
agcauccucucucacaug

SEQ ID NO: 765766 - RNA, 19 nt, Homo sapiens
agcaucgggagcacccaga

SEQ ID NO: 765767 - RNA, 16 nt, Homo sapiens
agcaucuaaugaaugu

SEQ ID NO: 765768 - RNA, 23 nt, Homo sapiens
agcaucuaucucaucuaucucaa

SEQ ID NO: 765769 - RNA, 17 nt, Homo sapiens
agcaucucccaguucau

SEQ ID NO: 765770 - RNA, 13 nt, Homo sapiens
agcaucugaccau

SEQ ID NO: 765771 - RNA, 16 nt, Homo sapiens
agcaucuggcucuaau

SEQ ID NO: 765772 - RNA, 17 nt, Homo sapiens
agcaugaagacccugga

SEQ ID NO: 765773 - RNA, 21 nt, Homo sapiens
agcaugauacaaauuccacag

SEQ ID NO: 765774 - RNA, 11 nt, Homo sapiens
agcaugaucuu

SEQ ID NO: 765775 - RNA, 12 nt, Homo sapiens
agcaugcacaug

SEQ ID NO: 765776 - RNA, 15 nt, Homo sapiens
agcaugcagcuuugc

SEQ ID NO: 765777 - RNA, 21 nt, Homo sapiens
agcaugcugcuuuuuguacuu

SEQ ID NO: 765778 - RNA, 15 nt, Homo sapiens
agcauggacagugug

SEQ ID NO: 765779 - RNA, 22 nt, Homo sapiens
agcauggcauauuuuucacaua

SEQ ID NO: 765780 - RNA, 15 nt, Homo sapiens
agcaugguugcagau

SEQ ID NO: 765781 - RNA, 20 nt, Homo sapiens
agcaugugccaagauucuac

SEQ ID NO: 765782 - RNA, 15 nt, Homo sapiens
agcauguguauuucc

SEQ ID NO: 765783 - RNA, 19 nt, Homo sapiens
agcauguuugccuagacag

SEQ ID NO: 765784 - RNA, 20 nt, Homo sapiens
agauuagaagacaacaggca

SEQ ID NO: 765785 - RNA, 16 nt, Homo sapiens
agauuauaaacugacu

SEQ ID NO: 765786 - RNA, 22 nt, Homo sapiens
agauuauaauaugugccuuaag

SEQ ID NO: 765787 - RNA, 16 nt, Homo sapiens
agauuauagauucuaa

SEQ ID NO: 765788 - RNA, 18 nt, Homo sapiens
agauuauauauuauuucu

SEQ ID NO: 765789 - RNA, 12 nt, Homo sapiens
agauuaucuggg

SEQ ID NO: 765790 - RNA, 23 nt, Homo sapiens
agauuauuaucuauuaucucaau

SEQ ID NO: 765791 - RNA, 16 nt, Homo sapiens
agauuccccuguguca

SEQ ID NO: 765792 - RNA, 22 nt, Homo sapiens
agauuccugguuaaauuugaau

SEQ ID NO: 765793 - RNA, 15 nt, Homo sapiens
agauucuaaagauuc

SEQ ID NO: 765794 - RNA, 13 nt, Homo sapiens
agauucuaaugau

SEQ ID NO: 765795 - RNA, 16 nt, Homo sapiens
agauucuaaugaugau

SEQ ID NO: 765796 - RNA, 16 nt, Homo sapiens
agauucuauaguucua

SEQ ID NO: 765797 - RNA, 16 nt, Homo sapiens
agauucuccugugcua

SEQ ID NO: 765798 - RNA, 17 nt, Homo sapiens
agauucucugugucuaa

SEQ ID NO: 765799 - RNA, 20 nt, Homo sapiens
agauucuguuaacucuugaa

SEQ ID NO: 765800 - RNA, 20 nt, Homo sapiens
agauugacuaacucaaauac

SEQ ID NO: 765801 - RNA, 22 nt, Homo sapiens
agauugagaagccauguacuca

SEQ ID NO: 765802 - RNA, 21 nt, Homo sapiens
agauugggagguguaucugag

SEQ ID NO: 765803 - RNA, 12 nt, Homo sapiens
agauuguguucc

SEQ ID NO: 765804 - RNA, 19 nt, Homo sapiens
agauuguguuuguucauaa

SEQ ID NO: 765805 - RNA, 16 nt, Homo sapiens
agauuguuaaaauaac

SEQ ID NO: 765806 - RNA, 21 nt, Homo sapiens
agauuuaaaaaaagaacauaa

SEQ ID NO: 765807 - RNA, 17 nt, Homo sapiens
agauuuaacaauuccaa

SEQ ID NO: 765808 - RNA, 16 nt, Homo sapiens
agauuuacuaaaucaa

SEQ ID NO: 765809 - RNA, 12 nt, Homo sapiens
agauuucaagaa

SEQ ID NO: 765810 - RNA, 15 nt, Homo sapiens
agauuucaugucacu

SEQ ID NO: 765811 - RNA, 15 nt, Homo sapiens
agauuuccuaacucu

SEQ ID NO: 765812 - RNA, 14 nt, Homo sapiens
agauuucuauggua

SEQ ID NO: 765813 - RNA, 13 nt, Homo sapiens
agauuucuucucu

SEQ ID NO: 765814 - RNA, 15 nt, Homo sapiens
agauuugccaaaaac

SEQ ID NO: 765815 - RNA, 13 nt, Homo sapiens
agauuugccuuau

SEQ ID NO: 765816 - RNA, 19 nt, Homo sapiens
agauuuggaauaggaauaa

SEQ ID NO: 765817 - RNA, 20 nt, Homo sapiens
agauuuggaggcuaccucac

SEQ ID NO: 765818 - RNA, 15 nt, Homo sapiens
agauuuggaugcacu

SEQ ID NO: 765819 - RNA, 18 nt, Homo sapiens
agauuuggaugcacucau

SEQ ID NO: 765820 - RNA, 22 nt, Homo sapiens
agauuuuaacuaauaaugcugg

SEQ ID NO: 765821 - RNA, 15 nt, Homo sapiens
agauuuuaugcugcu

SEQ ID NO: 765822 - RNA, 16 nt, Homo sapiens
agauuuuaugcugcug

SEQ ID NO: 765823 - RNA, 15 nt, Homo sapiens
agauuuucuuuugcc

SEQ ID NO: 765824 - RNA, 16 nt, Homo sapiens
agcaaaaacauguaug

SEQ ID NO: 765825 - RNA, 19 nt, Homo sapiens
agcaaaacgacacugcgca

SEQ ID NO: 765826 - RNA, 19 nt, Homo sapiens
agcaaaauugauguguuua

SEQ ID NO: 765827 - RNA, 18 nt, Homo sapiens
agcaaagaugcauuuuca

SEQ ID NO: 765828 - RNA, 16 nt, Homo sapiens
agcaaagauuaaaugu

SEQ ID NO: 765829 - RNA, 13 nt, Homo sapiens
agcaaagcaaaag

SEQ ID NO: 765830 - RNA, 16 nt, Homo sapiens
agcaaagcugaugaca

SEQ ID NO: 765831 - RNA, 17 nt, Homo sapiens
agcaaaguuuuaccugu

SEQ ID NO: 765832 - RNA, 21 nt, Homo sapiens
agcaaauguuaaaaguuuuau

SEQ ID NO: 765833 - RNA, 18 nt, Homo sapiens
agcaaauguuaugcauaa

SEQ ID NO: 765834 - RNA, 16 nt, Homo sapiens
agcaaauugacaugcu

SEQ ID NO: 765835 - RNA, 16 nt, Homo sapiens
agcaacaagacugcca

SEQ ID NO: 765836 - RNA, 14 nt, Homo sapiens
agcaacaagccuca

SEQ ID NO: 765837 - RNA, 12 nt, Homo sapiens
agcaacaaugac

SEQ ID NO: 765838 - RNA, 21 nt, Homo sapiens
agcaaccuuguaagcuaucug

SEQ ID NO: 765839 - RNA, 23 nt, Homo sapiens
agcaacgccccuccaaaccucca

SEQ ID NO: 765840 - RNA, 12 nt, Homo sapiens
agcaacugcugu

SEQ ID NO: 765841 - RNA, 16 nt, Homo sapiens
agcaacuucaaguaua

SEQ ID NO: 765842 - RNA, 16 nt, Homo sapiens
agcaacuucauuugac

SEQ ID NO: 765843 - RNA, 20 nt, Homo sapiens
agcaacuucuucuccauccc

SEQ ID NO: 765844 - RNA, 17 nt, Homo sapiens
agcaagaagcuguuacc

SEQ ID NO: 765845 - RNA, 14 nt, Homo sapiens
agcaagacacaucc

SEQ ID NO: 765846 - RNA, 17 nt, Homo sapiens
agcaagacuccaucuca

SEQ ID NO: 765847 - RNA, 22 nt, Homo sapiens
agcaagauagucuucaguuuca

SEQ ID NO: 765848 - RNA, 17 nt, Homo sapiens
agcaagggacagugagg

SEQ ID NO: 765849 - RNA, 16 nt, Homo sapiens
agcaagugugcacucc

SEQ ID NO: 765850 - RNA, 22 nt, Homo sapiens
agcaaguguucacaacagugaa

SEQ ID NO: 765851 - RNA, 15 nt, Homo sapiens
agcaaguucugagag

SEQ ID NO: 765852 - RNA, 19 nt, Homo sapiens
agcaaguucugagagccag

SEQ ID NO: 765853 - RNA, 9 nt, Homo sapiens
agcaauacu

SEQ ID NO: 765854 - RNA, 16 nt, Homo sapiens
agcaauacuguuucca

SEQ ID NO: 765855 - RNA, 22 nt, Homo sapiens
agcaauauaucugaagagcuau

SEQ ID NO: 765856 - RNA, 19 nt, Homo sapiens
agcaaucaagguuauaauu

SEQ ID NO: 765857 - RNA, 15 nt, Homo sapiens
agcaaugucugugcu

SEQ ID NO: 765858 - RNA, 22 nt, Homo sapiens
agcaauuccaggcugagccaug

SEQ ID NO: 765859 - RNA, 20 nt, Homo sapiens
agcaauugacugucacuguu

SEQ ID NO: 765860 - RNA, 22 nt, Homo sapiens
agcaauuugauaaaauauacuu

SEQ ID NO: 765861 - RNA, 19 nt, Homo sapiens
agcacaagcagagugcaca

SEQ ID NO: 765862 - RNA, 22 nt, Homo sapiens
agcacaauggucuuacauugga

SEQ ID NO: 765863 - RNA, 23 nt, Homo sapiens
agcacacacuucacaaagccaag

SEQ ID NO: 765864 - RNA, 13 nt, Homo sapiens
agcacacuguagc

SEQ ID NO: 765865 - RNA, 19 nt, Homo sapiens
agcacagauuugcauuuca

SEQ ID NO: 765866 - RNA, 15 nt, Homo sapiens
agcacagcagcaucu

SEQ ID NO: 765867 - RNA, 15 nt, Homo sapiens
agcacagcugcauua

SEQ ID NO: 765868 - RNA, 18 nt, Homo sapiens
agcacauacuguguucca

SEQ ID NO: 765869 - RNA, 22 nt, Homo sapiens
agcacauauggaauuuugcaaa

SEQ ID NO: 765870 - RNA, 13 nt, Homo sapiens
agcacaucaccuc

SEQ ID NO: 765871 - RNA, 18 nt, Homo sapiens
agcacauguauugacaac

SEQ ID NO: 765872 - RNA, 23 nt, Homo sapiens
agcacauuccaaacuuuagcaac

SEQ ID NO: 765873 - RNA, 15 nt, Homo sapiens
agcaccacccuaguc

SEQ ID NO: 765874 - RNA, 13 nt, Homo sapiens
agcaccaccuaca

SEQ ID NO: 765875 - RNA, 21 nt, Homo sapiens
agcaccaucucuuuaccuccu

SEQ ID NO: 765876 - RNA, 15 nt, Homo sapiens
agcacccuacaggga

SEQ ID NO: 765877 - RNA, 19 nt, Homo sapiens
agcacccugcccaccaaga

SEQ ID NO: 765878 - RNA, 15 nt, Homo sapiens
agcaccggccucggg

SEQ ID NO: 765879 - RNA, 20 nt, Homo sapiens
agcaccgugucaagcugcuc

SEQ ID NO: 765880 - RNA, 20 nt, Homo sapiens
agcaccuccccgcugggaag

SEQ ID NO: 765881 - RNA, 20 nt, Homo sapiens
agcaccuuugagccuuggcc

SEQ ID NO: 765882 - RNA, 20 nt, Homo sapiens
agcacggacugucaguucuc

SEQ ID NO: 765883 - RNA, 21 nt, Homo sapiens
agcacggacugucaguucucu

SEQ ID NO: 765884 - RNA, 24 nt, Homo sapiens
agcacgugucucagacugcaugua

SEQ ID NO: 765885 - RNA, 17 nt, Homo sapiens
agcacguguggccuguu

SEQ ID NO: 765886 - RNA, 17 nt, Homo sapiens
agcacuaaagcagugga

SEQ ID NO: 765887 - RNA, 20 nt, Homo sapiens
agcacuagaauauuuaaaac

SEQ ID NO: 765888 - RNA, 17 nt, Homo sapiens
agcacuaggauugugau

SEQ ID NO: 765889 - RNA, 15 nt, Homo sapiens
agcacuauuaauacu

SEQ ID NO: 765890 - RNA, 23 nt, Homo sapiens
agcacuccccagagcugugccag

SEQ ID NO: 765891 - RNA, 19 nt, Homo sapiens
agcacugacagauuuccau

SEQ ID NO: 765892 - RNA, 21 nt, Homo sapiens
agcacugaggguggcacucaa

SEQ ID NO: 765893 - RNA, 18 nt, Homo sapiens
agcacuggaaccaccugg

SEQ ID NO: 765894 - RNA, 16 nt, Homo sapiens
agcacugggcucugau

SEQ ID NO: 765895 - RNA, 20 nt, Homo sapiens
agcacugggcucugauggcu

SEQ ID NO: 765896 - RNA, 17 nt, Homo sapiens
agcacuggggagucuuu

SEQ ID NO: 765897 - RNA, 15 nt, Homo sapiens
agcacugggugacca

SEQ ID NO: 765898 - RNA, 17 nt, Homo sapiens
agcacugggugaccagc

SEQ ID NO: 765899 - RNA, 16 nt, Homo sapiens
agauaaaccaguugaa

SEQ ID NO: 765900 - RNA, 12 nt, Homo sapiens
agauaaauuacu

SEQ ID NO: 765901 - RNA, 23 nt, Homo sapiens
agauaacauccaacuaacuccag

SEQ ID NO: 765902 - RNA, 18 nt, Homo sapiens
agauaagaaaugaucuuu

SEQ ID NO: 765903 - RNA, 22 nt, Homo sapiens
agauaaguuugcaguuggcuaa

SEQ ID NO: 765904 - RNA, 19 nt, Homo sapiens
agauaauaacugucuucug

SEQ ID NO: 765905 - RNA, 17 nt, Homo sapiens
agauaauaucugugagg

SEQ ID NO: 765906 - RNA, 13 nt, Homo sapiens
agauaauuggcaa

SEQ ID NO: 765907 - RNA, 20 nt, Homo sapiens
agauacaaaaccuuguguaa

SEQ ID NO: 765908 - RNA, 17 nt, Homo sapiens
agauacagaauaaugga

SEQ ID NO: 765909 - RNA, 14 nt, Homo sapiens
agauacagacauuc

SEQ ID NO: 765910 - RNA, 17 nt, Homo sapiens
agauacgaaaucaguuu

SEQ ID NO: 765911 - RNA, 14 nt, Homo sapiens
agauacuagcuauc

SEQ ID NO: 765912 - RNA, 19 nt, Homo sapiens
agauacugugagcuuacau

SEQ ID NO: 765913 - RNA, 17 nt, Homo sapiens
agauacuucccaaagcc

SEQ ID NO: 765914 - RNA, 15 nt, Homo sapiens
agauagaaagcauua

SEQ ID NO: 765915 - RNA, 14 nt, Homo sapiens
agauagacaaucac

SEQ ID NO: 765916 - RNA, 16 nt, Homo sapiens
agauagauauaugcuc

SEQ ID NO: 765917 - RNA, 16 nt, Homo sapiens
agauagcuacagugua

SEQ ID NO: 765918 - RNA, 16 nt, Homo sapiens
agauaggaaacugaag

SEQ ID NO: 765919 - RNA, 16 nt, Homo sapiens
agauaggaaccagcag

SEQ ID NO: 765920 - RNA, 21 nt, Homo sapiens
agauauguauucuuuucucag

SEQ ID NO: 765921 - RNA, 18 nt, Homo sapiens
agauauuaaaugauguuu

SEQ ID NO: 765922 - RNA, 13 nt, Homo sapiens
agauauuaauaga

SEQ ID NO: 765923 - RNA, 22 nt, Homo sapiens
agauauuaauagauaauaugaa

SEQ ID NO: 765924 - RNA, 24 nt, Homo sapiens
agauauucauuggcagcucaaaga

SEQ ID NO: 765925 - RNA, 15 nt, Homo sapiens
agauauuguacauaa

SEQ ID NO: 765926 - RNA, 22 nt, Homo sapiens
agauauugucagaguucugcuc

SEQ ID NO: 765927 - RNA, 19 nt, Homo sapiens
agauauugugaaguacaua

SEQ ID NO: 765928 - RNA, 17 nt, Homo sapiens
agauauuuuuaucccaa

SEQ ID NO: 765929 - RNA, 13 nt, Homo sapiens
agaucaacuggaa

SEQ ID NO: 765930 - RNA, 21 nt, Homo sapiens
agaucaacuggaauggauggu

SEQ ID NO: 765931 - RNA, 19 nt, Homo sapiens
agaucaagaaaucccugag

SEQ ID NO: 765932 - RNA, 18 nt, Homo sapiens
agaucacaccacuguacu

SEQ ID NO: 765933 - RNA, 16 nt, Homo sapiens
agaucacauauucuag

SEQ ID NO: 765934 - RNA, 16 nt, Homo sapiens
agaucacgagaucaag

SEQ ID NO: 765935 - RNA, 18 nt, Homo sapiens
agaucacgccacugcacu

SEQ ID NO: 765936 - RNA, 17 nt, Homo sapiens
agaucacugacucugac

SEQ ID NO: 765937 - RNA, 13 nt, Homo sapiens
agaucacugccac

SEQ ID NO: 765938 - RNA, 22 nt, Homo sapiens
agaucacuuguuguuuuacuaa

SEQ ID NO: 765939 - RNA, 19 nt, Homo sapiens
agaucagaugcuccaagau

SEQ ID NO: 765940 - RNA, 15 nt, Homo sapiens
agaucagcaaaggga

SEQ ID NO: 765941 - RNA, 17 nt, Homo sapiens
agaucagggacuugaau

SEQ ID NO: 765942 - RNA, 14 nt, Homo sapiens
agauccaguauuug

SEQ ID NO: 765943 - RNA, 22 nt, Homo sapiens
agauccccuguguggucuccau

SEQ ID NO: 765944 - RNA, 20 nt, Homo sapiens
agaucgauccuggauucacu

SEQ ID NO: 765945 - RNA, 21 nt, Homo sapiens
agaucgauccuggauucacuc

SEQ ID NO: 765946 - RNA, 21 nt, Homo sapiens
agaucgaugauaugaccagaa

SEQ ID NO: 765947 - RNA, 19 nt, Homo sapiens
agaucgcaccacugcacuc

SEQ ID NO: 765948 - RNA, 16 nt, Homo sapiens
agaucgcaguuugccu

SEQ ID NO: 765949 - RNA, 18 nt, Homo sapiens
agaucgcgccacugcacu

SEQ ID NO: 765950 - RNA, 22 nt, Homo sapiens
agaucgcuuuucucagacucac

SEQ ID NO: 765951 - RNA, 15 nt, Homo sapiens
agaucguuguuuaca

SEQ ID NO: 765952 - RNA, 20 nt, Homo sapiens
agaucuaaaaauaacuguaa

SEQ ID NO: 765953 - RNA, 14 nt, Homo sapiens
agaucuacacaugu

SEQ ID NO: 765954 - RNA, 14 nt, Homo sapiens
agaucuaugggaag

SEQ ID NO: 765955 - RNA, 14 nt, Homo sapiens
agaucuauguacug

SEQ ID NO: 765956 - RNA, 17 nt, Homo sapiens
agaucucgguuugccaa

SEQ ID NO: 765957 - RNA, 19 nt, Homo sapiens
agaucugcacucaccucac

SEQ ID NO: 765958 - RNA, 17 nt, Homo sapiens
agaucuguccucagccu

SEQ ID NO: 765959 - RNA, 22 nt, Homo sapiens
agaucugucuugaugugucauc

SEQ ID NO: 765960 - RNA, 23 nt, Homo sapiens
agaucuuucaggacucuaccuca

SEQ ID NO: 765961 - RNA, 16 nt, Homo sapiens
agaucuuucucuuccc

SEQ ID NO: 765962 - RNA, 18 nt, Homo sapiens
agaugaagacaacagcau

SEQ ID NO: 765963 - RNA, 14 nt, Homo sapiens
agaugaagacauca

SEQ ID NO: 765964 - RNA, 19 nt, Homo sapiens
agaugaaucauugauugaa

SEQ ID NO: 765965 - RNA, 15 nt, Homo sapiens
agaugacagggaaaa

SEQ ID NO: 765966 - RNA, 22 nt, Homo sapiens
agaugacagggaaaacugcaaa

SEQ ID NO: 765967 - RNA, 19 nt, Homo sapiens
agaugaccauuuucugcca

SEQ ID NO: 765968 - RNA, 17 nt, Homo sapiens
agaugaccucaaugccu

SEQ ID NO: 765969 - RNA, 13 nt, Homo sapiens
agaugacugucca

SEQ ID NO: 765970 - RNA, 15 nt, Homo sapiens
agaugagcagucaca

SEQ ID NO: 765971 - RNA, 19 nt, Homo sapiens
agaugagcagucacacugu

SEQ ID NO: 765972 - RNA, 22 nt, Homo sapiens
agaugagccccacguggagcuc

SEQ ID NO: 765973 - RNA, 16 nt, Homo sapiens
agaugagggguugagg

SEQ ID NO: 765974 - RNA, 14 nt, Homo sapiens
agaugagugucugg

SEQ ID NO: 765975 - RNA, 15 nt, Homo sapiens
agaugauacuuccaa

SEQ ID NO: 765976 - RNA, 20 nt, Homo sapiens
agaugauccacaacuugaga

SEQ ID NO: 765977 - RNA, 14 nt, Homo sapiens
agaugcaggugaug

SEQ ID NO: 765978 - RNA, 13 nt, Homo sapiens
agaugccacugcc

SEQ ID NO: 765979 - RNA, 15 nt, Homo sapiens
agaugccacuucuca

SEQ ID NO: 765980 - RNA, 20 nt, Homo sapiens
agaugccauggccugugcug

SEQ ID NO: 765981 - RNA, 15 nt, Homo sapiens
agaugcuaggaagcu

SEQ ID NO: 765982 - RNA, 20 nt, Homo sapiens
agaugcugguuuucuaccca

SEQ ID NO: 765983 - RNA, 16 nt, Homo sapiens
agauggaaaagaaauu

SEQ ID NO: 765984 - RNA, 21 nt, Homo sapiens
agauggaaaagggagauucag

SEQ ID NO: 765985 - RNA, 19 nt, Homo sapiens
agauggaaugcuguguuaa

SEQ ID NO: 765986 - RNA, 14 nt, Homo sapiens
agauggaguucuug

SEQ ID NO: 765987 - RNA, 19 nt, Homo sapiens
agauggauagucuguccaa

SEQ ID NO: 765988 - RNA, 19 nt, Homo sapiens
agauggcaaaaucaucuua

SEQ ID NO: 765989 - RNA, 12 nt, Homo sapiens
agauggccauau

SEQ ID NO: 765990 - RNA, 17 nt, Homo sapiens
agauggcgauguguuau

SEQ ID NO: 765991 - RNA, 16 nt, Homo sapiens
agauggcucuuucuau

SEQ ID NO: 765992 - RNA, 17 nt, Homo sapiens
agaugggagccuuuacc

SEQ ID NO: 765993 - RNA, 15 nt, Homo sapiens
agaugguccgugccc

SEQ ID NO: 765994 - RNA, 14 nt, Homo sapiens
agaugguucuagca

SEQ ID NO: 765995 - RNA, 21 nt, Homo sapiens
agaugguucuagcauggcaua

SEQ ID NO: 765996 - RNA, 22 nt, Homo sapiens
agauguaagaaauguucuugca

SEQ ID NO: 765997 - RNA, 17 nt, Homo sapiens
agauguauauauuuccu

SEQ ID NO: 765998 - RNA, 12 nt, Homo sapiens
agauguaugugu

SEQ ID NO: 765999 - RNA, 22 nt, Homo sapiens
agauguauuuuugauguauaua

SEQ ID NO: 766000 - RNA, 11 nt, Homo sapiens
agaugucaagc

SEQ ID NO: 766001 - RNA, 19 nt, Homo sapiens
agaugugaacacaucagcu

SEQ ID NO: 766002 - RNA, 21 nt, Homo sapiens
agaugugcuuugcugcacaaa

SEQ ID NO: 766003 - RNA, 13 nt, Homo sapiens
agauguguaaaca

SEQ ID NO: 766004 - RNA, 16 nt, Homo sapiens
agaugugucuauggcu

SEQ ID NO: 766005 - RNA, 19 nt, Homo sapiens
agauguguguucucaguga

SEQ ID NO: 766006 - RNA, 14 nt, Homo sapiens
agauguucaaauau

SEQ ID NO: 766007 - RNA, 14 nt, Homo sapiens
agauguuggaccaa

SEQ ID NO: 766008 - RNA, 17 nt, Homo sapiens
agauguuguguggcaau

SEQ ID NO: 766009 - RNA, 19 nt, Homo sapiens
agauguuugaggcuuucag

SEQ ID NO: 766010 - RNA, 19 nt, Homo sapiens
agauguuuggaaaccacag

SEQ ID NO: 766011 - RNA, 20 nt, Homo sapiens
agauguuuuauuuugccagu

SEQ ID NO: 766012 - RNA, 16 nt, Homo sapiens
agauuaauggcacuga

SEQ ID NO: 766013 - RNA, 16 nt, Homo sapiens
agauuagaaacuacca

SEQ ID NO: 766014 - RNA, 16 nt, Homo sapiens
aaaacuucaguaagua

SEQ ID NO: 766015 - RNA, 19 nt, Homo sapiens
aaaacuucaguaaguacgu

SEQ ID NO: 766016 - RNA, 17 nt, Homo sapiens
aaaacuugcugccugaa

SEQ ID NO: 766017 - RNA, 17 nt, Homo sapiens
aaaacuuuaaugaacua

SEQ ID NO: 766018 - RNA, 21 nt, Homo sapiens
aaaagaaagcaaacuuaagaa

SEQ ID NO: 766019 - RNA, 12 nt, Homo sapiens
aaaagaaaucca

SEQ ID NO: 766020 - RNA, 11 nt, Homo sapiens
aaaagaacaau

SEQ ID NO: 766021 - RNA, 15 nt, Homo sapiens
aaaagaagacucuga

SEQ ID NO: 766022 - RNA, 16 nt, Homo sapiens
aaaagaagacucugac

SEQ ID NO: 766023 - RNA, 15 nt, Homo sapiens
aaaagacaaaaauca

SEQ ID NO: 766024 - RNA, 15 nt, Homo sapiens
aaaagacacagaaca

SEQ ID NO: 766025 - RNA, 20 nt, Homo sapiens
aaaagacauuuuuauuuagu

SEQ ID NO: 766026 - RNA, 20 nt, Homo sapiens
aaaagacguucauuauguau

SEQ ID NO: 766027 - RNA, 15 nt, Homo sapiens
aaaagacuccaaaga

SEQ ID NO: 766028 - RNA, 12 nt, Homo sapiens
aaaagacugaau

SEQ ID NO: 766029 - RNA, 15 nt, Homo sapiens
aaaagacugaaucua

SEQ ID NO: 766030 - RNA, 20 nt, Homo sapiens
aaaagacugaaucuaccugc

SEQ ID NO: 766031 - RNA, 18 nt, Homo sapiens
aaaagagccacuuucaag

SEQ ID NO: 766032 - RNA, 20 nt, Homo sapiens
aaaagauacggcccaugcaa

SEQ ID NO: 766033 - RNA, 14 nt, Homo sapiens
aaaagcaaggcaca

SEQ ID NO: 766034 - RNA, 19 nt, Homo sapiens
aaaagcaagggaccuucau

SEQ ID NO: 766035 - RNA, 16 nt, Homo sapiens
aaaagcaauguuuaaa

SEQ ID NO: 766036 - RNA, 16 nt, Homo sapiens
aaaagcacaaguacuu

SEQ ID NO: 766037 - RNA, 20 nt, Homo sapiens
aaaagcacauguauugacaa

SEQ ID NO: 766038 - RNA, 13 nt, Homo sapiens
aaaagcaccugcc

SEQ ID NO: 766039 - RNA, 11 nt, Homo sapiens
aaaagcagcuc

SEQ ID NO: 766040 - RNA, 12 nt, Homo sapiens
aaaagcagcuca

SEQ ID NO: 766041 - RNA, 22 nt, Homo sapiens
aaaagcagcucaagaacacaug

SEQ ID NO: 766042 - RNA, 23 nt, Homo sapiens
aaaagcaggcgacaaaaucuccu

SEQ ID NO: 766043 - RNA, 20 nt, Homo sapiens
aaaagcugaauccagaucau

SEQ ID NO: 766044 - RNA, 18 nt, Homo sapiens
aaaagcugaccccaaaga

SEQ ID NO: 766045 - RNA, 12 nt, Homo sapiens
aaaagcuuuaaa

SEQ ID NO: 766046 - RNA, 21 nt, Homo sapiens
aaaagcuuuaaaugucugcau

SEQ ID NO: 766047 - RNA, 18 nt, Homo sapiens
aaaaggaaaaugaaacua

SEQ ID NO: 766048 - RNA, 23 nt, Homo sapiens
aaaaggauaugcaguaugcuuaa

SEQ ID NO: 766049 - RNA, 23 nt, Homo sapiens
aaaaggaucguuuuuuuuugcuu

SEQ ID NO: 766050 - RNA, 19 nt, Homo sapiens
aaaaggcuaagaauagugg

SEQ ID NO: 766051 - RNA, 17 nt, Homo sapiens
aaaaggcucccauguga

SEQ ID NO: 766052 - RNA, 21 nt, Homo sapiens
aaaagggauccguacauucaa

SEQ ID NO: 766053 - RNA, 11 nt, Homo sapiens
aaaaggguuca

SEQ ID NO: 766054 - RNA, 16 nt, Homo sapiens
aaaaggugccaucuca

SEQ ID NO: 766055 - RNA, 16 nt, Homo sapiens
aaaaggugucaacuuu

SEQ ID NO: 766056 - RNA, 22 nt, Homo sapiens
aaaagguuaaacccacagccaa

SEQ ID NO: 766057 - RNA, 20 nt, Homo sapiens
aaaagguuaaauauugucau

SEQ ID NO: 766058 - RNA, 22 nt, Homo sapiens
aaaaguaaguaccacucaggcc

SEQ ID NO: 766059 - RNA, 14 nt, Homo sapiens
aaaagucaguauca

SEQ ID NO: 766060 - RNA, 22 nt, Homo sapiens
aaaaguggcauuuccuggucag

SEQ ID NO: 766061 - RNA, 19 nt, Homo sapiens
aaaaguuacuaccugucaa

SEQ ID NO: 766062 - RNA, 12 nt, Homo sapiens
aaaaguuuacaa

SEQ ID NO: 766063 - RNA, 16 nt, Homo sapiens
aaaaguuuugaugaaa

SEQ ID NO: 766064 - RNA, 14 nt, Homo sapiens
aaaaguuuuugcuu

SEQ ID NO: 766065 - RNA, 22 nt, Homo sapiens
aaaauaaaguaccacacauauu

SEQ ID NO: 766066 - RNA, 15 nt, Homo sapiens
aaaauaaauguacau

SEQ ID NO: 766067 - RNA, 16 nt, Homo sapiens
agaagucggaauguca

SEQ ID NO: 766068 - RNA, 14 nt, Homo sapiens
agaagucucccugc

SEQ ID NO: 766069 - RNA, 23 nt, Homo sapiens
agaagucugucugucugaugaug

SEQ ID NO: 766070 - RNA, 14 nt, Homo sapiens
agaagucuugagaa

SEQ ID NO: 766071 - RNA, 14 nt, Homo sapiens
agaaguuaauccac

SEQ ID NO: 766072 - RNA, 22 nt, Homo sapiens
agaaguucuggcugaacacugg

SEQ ID NO: 766073 - RNA, 17 nt, Homo sapiens
agaaguugagagagcaa

SEQ ID NO: 766074 - RNA, 20 nt, Homo sapiens
agaaguuuggcugcugucau

SEQ ID NO: 766075 - RNA, 18 nt, Homo sapiens
agaauaaaaacuuccuuc

SEQ ID NO: 766076 - RNA, 20 nt, Homo sapiens
agaauaaaauuccuaucuca

SEQ ID NO: 766077 - RNA, 14 nt, Homo sapiens
agaauaaaguccaa

SEQ ID NO: 766078 - RNA, 14 nt, Homo sapiens
agaauaacuaccuc

SEQ ID NO: 766079 - RNA, 13 nt, Homo sapiens
agaauaagccuuc

SEQ ID NO: 766080 - RNA, 22 nt, Homo sapiens
agaauaaggaggaggagggaga

SEQ ID NO: 766081 - RNA, 20 nt, Homo sapiens
agaauaaggcuuuuucuucc

SEQ ID NO: 766082 - RNA, 13 nt, Homo sapiens
agaauaaguucau

SEQ ID NO: 766083 - RNA, 14 nt, Homo sapiens
agaauagucucacu

SEQ ID NO: 766084 - RNA, 13 nt, Homo sapiens
agaauauaaucuu

SEQ ID NO: 766085 - RNA, 19 nt, Homo sapiens
agaauaugaagacauagcu

SEQ ID NO: 766086 - RNA, 23 nt, Homo sapiens
agaauauugucccuuugagcaga

SEQ ID NO: 766087 - RNA, 20 nt, Homo sapiens
agaauauuuuagccacucaa

SEQ ID NO: 766088 - RNA, 19 nt, Homo sapiens
agaaucauaugauucugcu

SEQ ID NO: 766089 - RNA, 23 nt, Homo sapiens
agaauccauccaaaguucccuau

SEQ ID NO: 766090 - RNA, 19 nt, Homo sapiens
agaaucccacauuagcuug

SEQ ID NO: 766091 - RNA, 15 nt, Homo sapiens
agaaucccuuugcac

SEQ ID NO: 766092 - RNA, 23 nt, Homo sapiens
agaaucccuuugcaccugagacc

SEQ ID NO: 766093 - RNA, 16 nt, Homo sapiens
agaauccgaagggaau

SEQ ID NO: 766094 - RNA, 13 nt, Homo sapiens
agaaucuaaugaa

SEQ ID NO: 766095 - RNA, 17 nt, Homo sapiens
agaaucuagaaaaucag

SEQ ID NO: 766096 - RNA, 17 nt, Homo sapiens
agaaucucaacaugucu

SEQ ID NO: 766097 - RNA, 15 nt, Homo sapiens
agaaucugcugcaua

SEQ ID NO: 766098 - RNA, 23 nt, Homo sapiens
agaaucugcugcauagcucuauu

SEQ ID NO: 766099 - RNA, 19 nt, Homo sapiens
agaaugaaauguaugugcu

SEQ ID NO: 766100 - RNA, 15 nt, Homo sapiens
agaaugaacacuccc

SEQ ID NO: 766101 - RNA, 18 nt, Homo sapiens
agaaugaauaauaauuau

SEQ ID NO: 766102 - RNA, 13 nt, Homo sapiens
agaaugaauuuau

SEQ ID NO: 766103 - RNA, 15 nt, Homo sapiens
agaaugaauuuaucu

SEQ ID NO: 766104 - RNA, 24 nt, Homo sapiens
agaaugcacaagaauggaucacaa

SEQ ID NO: 766105 - RNA, 12 nt, Homo sapiens
agaaugcucagg

SEQ ID NO: 766106 - RNA, 22 nt, Homo sapiens
agaaugcugcaggacuugagaa

SEQ ID NO: 766107 - RNA, 16 nt, Homo sapiens
agaaugcuuugccaua

SEQ ID NO: 766108 - RNA, 21 nt, Homo sapiens
agaauggauucaacacugugc

SEQ ID NO: 766109 - RNA, 13 nt, Homo sapiens
agaauggugcugu

SEQ ID NO: 766110 - RNA, 16 nt, Homo sapiens
agaaugucugaucuaa

SEQ ID NO: 766111 - RNA, 20 nt, Homo sapiens
agaauguguuucaaaaccau

SEQ ID NO: 766112 - RNA, 15 nt, Homo sapiens
agaauguuccuacuc

SEQ ID NO: 766113 - RNA, 22 nt, Homo sapiens
agaauguuucuggaauucuuca

SEQ ID NO: 766114 - RNA, 23 nt, Homo sapiens
agaauuacuuguguuacuugcca

SEQ ID NO: 766115 - RNA, 22 nt, Homo sapiens
agaauuauaucacuucacuguu

SEQ ID NO: 766116 - RNA, 23 nt, Homo sapiens
agaauuauauuagucuguuugca

SEQ ID NO: 766117 - RNA, 17 nt, Homo sapiens
agaauuaucaucccaac

SEQ ID NO: 766118 - RNA, 14 nt, Homo sapiens
agaauuauguaaua

SEQ ID NO: 766119 - RNA, 17 nt, Homo sapiens
agaauucuagugcugcu

SEQ ID NO: 766120 - RNA, 15 nt, Homo sapiens
agaauugaaacugag

SEQ ID NO: 766121 - RNA, 13 nt, Homo sapiens
agaauugcucaaa

SEQ ID NO: 766122 - RNA, 22 nt, Homo sapiens
agaauugcucccuaccagcuga

SEQ ID NO: 766123 - RNA, 19 nt, Homo sapiens
agaauugcuugaacccagg

SEQ ID NO: 766124 - RNA, 23 nt, Homo sapiens
agaauuguaucucauacugucug

SEQ ID NO: 766125 - RNA, 14 nt, Homo sapiens
agaauuguauguca

SEQ ID NO: 766126 - RNA, 16 nt, Homo sapiens
agaauuguaugucaug

SEQ ID NO: 766127 - RNA, 24 nt, Homo sapiens
agaauuguuaccugucauuuugca

SEQ ID NO: 766128 - RNA, 16 nt, Homo sapiens
agaauuuuaagccuuu

SEQ ID NO: 766129 - RNA, 23 nt, Homo sapiens
agacaaaaaucaaagaacagaug

SEQ ID NO: 766130 - RNA, 16 nt, Homo sapiens
agacaacagaagucau

SEQ ID NO: 766131 - RNA, 15 nt, Homo sapiens
agacaacuagauuug

SEQ ID NO: 766132 - RNA, 12 nt, Homo sapiens
agacaagcauuu

SEQ ID NO: 766133 - RNA, 21 nt, Homo sapiens
agacaagcuuguccauguaau

SEQ ID NO: 766134 - RNA, 17 nt, Homo sapiens
agacaagugacuguauc

SEQ ID NO: 766135 - RNA, 21 nt, Homo sapiens
agacaauucauucauuugcau

SEQ ID NO: 766136 - RNA, 13 nt, Homo sapiens
agacacaagguga

SEQ ID NO: 766137 - RNA, 15 nt, Homo sapiens
agacacaaggugauu

SEQ ID NO: 766138 - RNA, 20 nt, Homo sapiens
agacacaauuucauuuccag

SEQ ID NO: 766139 - RNA, 17 nt, Homo sapiens
agacacauacagagugg

SEQ ID NO: 766140 - RNA, 22 nt, Homo sapiens
agacaccaaacugccaaaaaca

SEQ ID NO: 766141 - RNA, 17 nt, Homo sapiens
agacaccauccugagcc

SEQ ID NO: 766142 - RNA, 15 nt, Homo sapiens
agacacccucugggg

SEQ ID NO: 766143 - RNA, 12 nt, Homo sapiens
agacaccugguu

SEQ ID NO: 766144 - RNA, 23 nt, Homo sapiens
agacacucccacuuggcaucauu

SEQ ID NO: 766145 - RNA, 24 nt, Homo sapiens
agacacugaagaagucacugaaca

SEQ ID NO: 766146 - RNA, 18 nt, Homo sapiens
agacacugguuuacacuu

SEQ ID NO: 766147 - RNA, 15 nt, Homo sapiens
agacacuuaacucaa

SEQ ID NO: 766148 - RNA, 18 nt, Homo sapiens
agacacuucccugcauua

SEQ ID NO: 766149 - RNA, 14 nt, Homo sapiens
agacagaaucucag

SEQ ID NO: 766150 - RNA, 16 nt, Homo sapiens
agacagacuugagaac

SEQ ID NO: 766151 - RNA, 16 nt, Homo sapiens
agacaggacagaaugu

SEQ ID NO: 766152 - RNA, 16 nt, Homo sapiens
agacaggcccaagaga

SEQ ID NO: 766153 - RNA, 16 nt, Homo sapiens
agacaggcucuuagca

SEQ ID NO: 766154 - RNA, 21 nt, Homo sapiens
agacagggucucgcucuguug

SEQ ID NO: 766155 - RNA, 22 nt, Homo sapiens
agacagguccugauuucuagaa

SEQ ID NO: 766156 - RNA, 22 nt, Homo sapiens
agacaguauuuugacaaaauac

SEQ ID NO: 766157 - RNA, 22 nt, Homo sapiens
agacagucuucuaauuccucau

SEQ ID NO: 766158 - RNA, 21 nt, Homo sapiens
agacagugucgcuaagugcau

SEQ ID NO: 766159 - RNA, 16 nt, Homo sapiens
agacaguuauugcaag

SEQ ID NO: 766160 - RNA, 15 nt, Homo sapiens
agacauacauuucuc

SEQ ID NO: 766161 - RNA, 17 nt, Homo sapiens
agacauaggccaugaaa

SEQ ID NO: 766162 - RNA, 13 nt, Homo sapiens
agacaucaaugaa

SEQ ID NO: 766163 - RNA, 15 nt, Homo sapiens
agacaucaaugaaac

SEQ ID NO: 766164 - RNA, 17 nt, Homo sapiens
agacauccugagcagug

SEQ ID NO: 766165 - RNA, 16 nt, Homo sapiens
agacaugaaugcacac

SEQ ID NO: 766166 - RNA, 18 nt, Homo sapiens
agacauggagacuccugc

SEQ ID NO: 766167 - RNA, 18 nt, Homo sapiens
agacauuaaaucuaugaa

SEQ ID NO: 766168 - RNA, 23 nt, Homo sapiens
agacauuacaauguguaauggaa

SEQ ID NO: 766169 - RNA, 18 nt, Homo sapiens
agacauucauugucccug

SEQ ID NO: 766170 - RNA, 18 nt, Homo sapiens
agacauuggcaccuaauc

SEQ ID NO: 766171 - RNA, 21 nt, Homo sapiens
agacauuggcaccuaauccag

SEQ ID NO: 766172 - RNA, 14 nt, Homo sapiens
agacauuuacaaag

SEQ ID NO: 766173 - RNA, 19 nt, Homo sapiens
agacauuugcuaugagcug

SEQ ID NO: 766174 - RNA, 18 nt, Homo sapiens
agacauuuucacuggaag

SEQ ID NO: 766175 - RNA, 12 nt, Homo sapiens
agaccaaaauaa

SEQ ID NO: 766176 - RNA, 18 nt, Homo sapiens
agaccaaagcauugccug

SEQ ID NO: 766177 - RNA, 19 nt, Homo sapiens
agaccaauucuaacagcaa

SEQ ID NO: 766178 - RNA, 14 nt, Homo sapiens
agaccagaagugga

SEQ ID NO: 766179 - RNA, 12 nt, Homo sapiens
agaccagcuuug

SEQ ID NO: 766180 - RNA, 16 nt, Homo sapiens
agaccaggucuuguuu

SEQ ID NO: 766181 - RNA, 12 nt, Homo sapiens
acuacaaccucc

SEQ ID NO: 766182 - RNA, 14 nt, Homo sapiens
acuacacagcacac

SEQ ID NO: 766183 - RNA, 13 nt, Homo sapiens
acuacacuccagc

SEQ ID NO: 766184 - RNA, 22 nt, Homo sapiens
acuacagcaugacguaguauua

SEQ ID NO: 766185 - RNA, 20 nt, Homo sapiens
acuacaggcucaugccauca

SEQ ID NO: 766186 - RNA, 14 nt, Homo sapiens
acuacagggagaaa

SEQ ID NO: 766187 - RNA, 18 nt, Homo sapiens
acuacaguaacugugacu

SEQ ID NO: 766188 - RNA, 15 nt, Homo sapiens
acuacauauuguaaa

SEQ ID NO: 766189 - RNA, 18 nt, Homo sapiens
acuacaugaaauaaugca

SEQ ID NO: 766190 - RNA, 21 nt, Homo sapiens
acuacaugugacuggcaguau

SEQ ID NO: 766191 - RNA, 17 nt, Homo sapiens
acuaccaauuucuuuua

SEQ ID NO: 766192 - RNA, 16 nt, Homo sapiens
acuaccauugcuguuc

SEQ ID NO: 766193 - RNA, 16 nt, Homo sapiens
acuacccgagcccagc

SEQ ID NO: 766194 - RNA, 19 nt, Homo sapiens
acuacucccucaaagcaca

SEQ ID NO: 766195 - RNA, 21 nt, Homo sapiens
acuacuccucugcagugccuu

SEQ ID NO: 766196 - RNA, 15 nt, Homo sapiens
acuacugacaugugg

SEQ ID NO: 766197 - RNA, 21 nt, Homo sapiens
acuacugccuuguacuuuuca

SEQ ID NO: 766198 - RNA, 14 nt, Homo sapiens
acuacugugaucag

SEQ ID NO: 766199 - RNA, 17 nt, Homo sapiens
acuacuuaaacaguauu

SEQ ID NO: 766200 - RNA, 23 nt, Homo sapiens
acuagaagaaaagcccauuuuca

SEQ ID NO: 766201 - RNA, 16 nt, Homo sapiens
acuagaagggccaguc

SEQ ID NO: 766202 - RNA, 19 nt, Homo sapiens
acuagagucugaacagcug

SEQ ID NO: 766203 - RNA, 15 nt, Homo sapiens
acuagauugcaugcu

SEQ ID NO: 766204 - RNA, 10 nt, Homo sapiens
acuagcauua

SEQ ID NO: 766205 - RNA, 17 nt, Homo sapiens
acuagccagacacucug

SEQ ID NO: 766206 - RNA, 16 nt, Homo sapiens
acuagccugugcacgc

SEQ ID NO: 766207 - RNA, 18 nt, Homo sapiens
acuagggagccauuugag

SEQ ID NO: 766208 - RNA, 17 nt, Homo sapiens
acuagggcuagucuucc

SEQ ID NO: 766209 - RNA, 12 nt, Homo sapiens
acuaguaacaug

SEQ ID NO: 766210 - RNA, 16 nt, Homo sapiens
acuagugacagcuugu

SEQ ID NO: 766211 - RNA, 16 nt, Homo sapiens
acuaguuuucaaucau

SEQ ID NO: 766212 - RNA, 16 nt, Homo sapiens
acuauacaagaauuaa

SEQ ID NO: 766213 - RNA, 18 nt, Homo sapiens
acuaucaaacugaagcca

SEQ ID NO: 766214 - RNA, 16 nt, Homo sapiens
acuauccaguuacugc

SEQ ID NO: 766215 - RNA, 22 nt, Homo sapiens
acuaucgaaaugacgguguuaa

SEQ ID NO: 766216 - RNA, 19 nt, Homo sapiens
acuaugaagcuaccucaaa

SEQ ID NO: 766217 - RNA, 13 nt, Homo sapiens
acuaugaaucuau

SEQ ID NO: 766218 - RNA, 14 nt, Homo sapiens
acuaugaucucagg

SEQ ID NO: 766219 - RNA, 15 nt, Homo sapiens
acuaugauuuaccua

SEQ ID NO: 766220 - RNA, 12 nt, Homo sapiens
acuaugcugcuu

SEQ ID NO: 766221 - RNA, 17 nt, Homo sapiens
acuaugucugaacauag

SEQ ID NO: 766222 - RNA, 14 nt, Homo sapiens
acuauuaaagcaca

SEQ ID NO: 766223 - RNA, 16 nt, Homo sapiens
acuauuaauacucugc

SEQ ID NO: 766224 - RNA, 14 nt, Homo sapiens
acuauucacuaaaa

SEQ ID NO: 766225 - RNA, 16 nt, Homo sapiens
acuauugaaaucaagc

SEQ ID NO: 766226 - RNA, 20 nt, Homo sapiens
acuauugaaaucaagcuuau

SEQ ID NO: 766227 - RNA, 18 nt, Homo sapiens
acuauuuaaagccuccuc

SEQ ID NO: 766228 - RNA, 17 nt, Homo sapiens
acuauuuccacauggaa

SEQ ID NO: 766229 - RNA, 22 nt, Homo sapiens
acucaaaaucugucauaagcau

SEQ ID NO: 766230 - RNA, 18 nt, Homo sapiens
acucaaacgaugugcaau

SEQ ID NO: 766231 - RNA, 14 nt, Homo sapiens
acucaaacugagga

SEQ ID NO: 766232 - RNA, 19 nt, Homo sapiens
acucaaauggggccagauc

SEQ ID NO: 766233 - RNA, 24 nt, Homo sapiens
acucaaauuggugaacaguguaua

SEQ ID NO: 766234 - RNA, 15 nt, Homo sapiens
acucaagaaggaauu

SEQ ID NO: 766235 - RNA, 18 nt, Homo sapiens
acucaaggcuugagucac

SEQ ID NO: 766236 - RNA, 12 nt, Homo sapiens
acucaagggaaa

SEQ ID NO: 766237 - RNA, 16 nt, Homo sapiens
acucaagggaaaggca

SEQ ID NO: 766238 - RNA, 15 nt, Homo sapiens
acucaaguaccacca

SEQ ID NO: 766239 - RNA, 17 nt, Homo sapiens
acucaaguaccaccaag

SEQ ID NO: 766240 - RNA, 18 nt, Homo sapiens
acucaaugagcucuucca

SEQ ID NO: 766241 - RNA, 15 nt, Homo sapiens
acucaaugccaacuu

SEQ ID NO: 766242 - RNA, 17 nt, Homo sapiens
acucaaugguaucauua

SEQ ID NO: 766243 - RNA, 21 nt, Homo sapiens
acucaaugguaucauuacaau

SEQ ID NO: 766244 - RNA, 21 nt, Homo sapiens
acucacauauaacaugcaaac

SEQ ID NO: 766245 - RNA, 23 nt, Homo sapiens
acucacauucuauuaaaauuuag

SEQ ID NO: 766246 - RNA, 15 nt, Homo sapiens
acucaccaaacacaa

SEQ ID NO: 766247 - RNA, 19 nt, Homo sapiens
acucacccugggagccagu

SEQ ID NO: 766248 - RNA, 17 nt, Homo sapiens
acucaccugcacuaaca

SEQ ID NO: 766249 - RNA, 15 nt, Homo sapiens
acucaccuugucuca

SEQ ID NO: 766250 - RNA, 11 nt, Homo sapiens
acucacuccag

SEQ ID NO: 766251 - RNA, 21 nt, Homo sapiens
acucacugacucuucuaugca

SEQ ID NO: 766252 - RNA, 23 nt, Homo sapiens
acucacugaggguaucugacaau

SEQ ID NO: 766253 - RNA, 20 nt, Homo sapiens
acucagaacucuccagggag

SEQ ID NO: 766254 - RNA, 17 nt, Homo sapiens
acucagagaaacaaugg

SEQ ID NO: 766255 - RNA, 15 nt, Homo sapiens
acucagagacuucac

SEQ ID NO: 766256 - RNA, 20 nt, Homo sapiens
acucagagaugaacaucuaa

SEQ ID NO: 766257 - RNA, 18 nt, Homo sapiens
acucagaggcagugacag

SEQ ID NO: 766258 - RNA, 21 nt, Homo sapiens
acucagcacauucgggaccaa

SEQ ID NO: 766259 - RNA, 12 nt, Homo sapiens
acucagcauuug

SEQ ID NO: 766260 - RNA, 18 nt, Homo sapiens
acucagccacccugaguu

SEQ ID NO: 766261 - RNA, 21 nt, Homo sapiens
acucagccucauucagcaugg

SEQ ID NO: 766262 - RNA, 16 nt, Homo sapiens
acucaggagucugcca

SEQ ID NO: 766263 - RNA, 18 nt, Homo sapiens
acucaggccaacaagcca

SEQ ID NO: 766264 - RNA, 18 nt, Homo sapiens
acucaggccucugcagaa

SEQ ID NO: 766265 - RNA, 16 nt, Homo sapiens
acucagggagcauuua

SEQ ID NO: 766266 - RNA, 17 nt, Homo sapiens
acucaggggucauucau

SEQ ID NO: 766267 - RNA, 22 nt, Homo sapiens
acucagguaccucuuucagggu

SEQ ID NO: 766268 - RNA, 16 nt, Homo sapiens
acucagugcagcaaua

SEQ ID NO: 766269 - RNA, 17 nt, Homo sapiens
acucauagccacuuuua

SEQ ID NO: 766270 - RNA, 19 nt, Homo sapiens
acucaucaauggggccagu

SEQ ID NO: 766271 - RNA, 20 nt, Homo sapiens
acucaucaccccucuucccc

SEQ ID NO: 766272 - RNA, 14 nt, Homo sapiens
accuugucucauga

SEQ ID NO: 766273 - RNA, 15 nt, Homo sapiens
accuugugucuguac

SEQ ID NO: 766274 - RNA, 20 nt, Homo sapiens
accuuuaaaguaaaggccuc

SEQ ID NO: 766275 - RNA, 14 nt, Homo sapiens
accuuuauauuugg

SEQ ID NO: 766276 - RNA, 14 nt, Homo sapiens
accuuuccugaugc

SEQ ID NO: 766277 - RNA, 22 nt, Homo sapiens
accuuuguacgcuuugcucaaa

SEQ ID NO: 766278 - RNA, 20 nt, Homo sapiens
accuuuuacauugugacugu

SEQ ID NO: 766279 - RNA, 14 nt, Homo sapiens
accuuuuacucuuc

SEQ ID NO: 766280 - RNA, 20 nt, Homo sapiens
accuuuucccuugcuguacc

SEQ ID NO: 766281 - RNA, 15 nt, Homo sapiens
accuuuuuauuugca

SEQ ID NO: 766282 - RNA, 16 nt, Homo sapiens
accuuuuuauuugcau

SEQ ID NO: 766283 - RNA, 23 nt, Homo sapiens
accuuuuuuccuucuugacauuu

SEQ ID NO: 766284 - RNA, 20 nt, Homo sapiens
acgaaacuccaucucaaaac

SEQ ID NO: 766285 - RNA, 21 nt, Homo sapiens
acgaaaugcuaugacuguauc

SEQ ID NO: 766286 - RNA, 22 nt, Homo sapiens
acgaacgcucuuagcuuucuca

SEQ ID NO: 766287 - RNA, 12 nt, Homo sapiens
acgaacuggacu

SEQ ID NO: 766288 - RNA, 17 nt, Homo sapiens
acgaaucguacuucuuu

SEQ ID NO: 766289 - RNA, 18 nt, Homo sapiens
acgaaucucaucccucaa

SEQ ID NO: 766290 - RNA, 19 nt, Homo sapiens
acgaaugaaugaacagcca

SEQ ID NO: 766291 - RNA, 17 nt, Homo sapiens
acgacaacgaugaugcu

SEQ ID NO: 766292 - RNA, 18 nt, Homo sapiens
acgacuggccagggccac

SEQ ID NO: 766293 - RNA, 13 nt, Homo sapiens
acgagaagcagca

SEQ ID NO: 766294 - RNA, 17 nt, Homo sapiens
acgagacccccauccag

SEQ ID NO: 766295 - RNA, 19 nt, Homo sapiens
acgagcagcccagggccua

SEQ ID NO: 766296 - RNA, 20 nt, Homo sapiens
acgagcauaguccaaaaagc

SEQ ID NO: 766297 - RNA, 15 nt, Homo sapiens
acgaggcucaaaaac

SEQ ID NO: 766298 - RNA, 15 nt, Homo sapiens
acgagggucccgauc

SEQ ID NO: 766299 - RNA, 20 nt, Homo sapiens
acgagucaccugcaagcccc

SEQ ID NO: 766300 - RNA, 14 nt, Homo sapiens
acgaugacaguguu

SEQ ID NO: 766301 - RNA, 11 nt, Homo sapiens
acgaugcauuu

SEQ ID NO: 766302 - RNA, 18 nt, Homo sapiens
acgauucuucacuucuug

SEQ ID NO: 766303 - RNA, 13 nt, Homo sapiens
acgcacaggaaaa

SEQ ID NO: 766304 - RNA, 22 nt, Homo sapiens
acgcacaugcgaccccgaggaa

SEQ ID NO: 766305 - RNA, 16 nt, Homo sapiens
acgcacugguaugugu

SEQ ID NO: 766306 - RNA, 12 nt, Homo sapiens
acgcacuugccu

SEQ ID NO: 766307 - RNA, 17 nt, Homo sapiens
acgcagacacugagauc

SEQ ID NO: 766308 - RNA, 12 nt, Homo sapiens
acgcagccagga

SEQ ID NO: 766309 - RNA, 16 nt, Homo sapiens
acgcaguaacuaaagc

SEQ ID NO: 766310 - RNA, 21 nt, Homo sapiens
acgcagucugcuucagugcag

SEQ ID NO: 766311 - RNA, 22 nt, Homo sapiens
acgcagucugcuucagugcagu

SEQ ID NO: 766312 - RNA, 21 nt, Homo sapiens
acgcauuuuugacagguugcu

SEQ ID NO: 766313 - RNA, 15 nt, Homo sapiens
acgccacugcacucc

SEQ ID NO: 766314 - RNA, 15 nt, Homo sapiens
acgcccuccccagac

SEQ ID NO: 766315 - RNA, 15 nt, Homo sapiens
acgccuaugauccca

SEQ ID NO: 766316 - RNA, 15 nt, Homo sapiens
acgccuguaauccca

SEQ ID NO: 766317 - RNA, 17 nt, Homo sapiens
acgccuguaaucccagc

SEQ ID NO: 766318 - RNA, 13 nt, Homo sapiens
acgccuguagucc

SEQ ID NO: 766319 - RNA, 17 nt, Homo sapiens
acgccuuguucuuggcc

SEQ ID NO: 766320 - RNA, 17 nt, Homo sapiens
acgcuaaagagcccuug

SEQ ID NO: 766321 - RNA, 20 nt, Homo sapiens
acgcuccuauaggaccaaga

SEQ ID NO: 766322 - RNA, 23 nt, Homo sapiens
acgcuccuuugugugugugucag

SEQ ID NO: 766323 - RNA, 21 nt, Homo sapiens
acgcugggcuucacggcugcc

SEQ ID NO: 766324 - RNA, 21 nt, Homo sapiens
acgcuuugucacacaaaaagu

SEQ ID NO: 766325 - RNA, 19 nt, Homo sapiens
acgcuuuucuuuguuauac

SEQ ID NO: 766326 - RNA, 20 nt, Homo sapiens
acggaauaaugaguuagaac

SEQ ID NO: 766327 - RNA, 18 nt, Homo sapiens
acggaggcauccuacccu

SEQ ID NO: 766328 - RNA, 22 nt, Homo sapiens
acggagucuugcucuguagccc

SEQ ID NO: 766329 - RNA, 21 nt, Homo sapiens
acggaguuucacucuugucac

SEQ ID NO: 766330 - RNA, 16 nt, Homo sapiens
acggcacgcacuugcc

SEQ ID NO: 766331 - RNA, 21 nt, Homo sapiens
acggcucaagugaauuugaau

SEQ ID NO: 766332 - RNA, 18 nt, Homo sapiens
acggcuccuccuuaugac

SEQ ID NO: 766333 - RNA, 14 nt, Homo sapiens
acggcucuuagcac

SEQ ID NO: 766334 - RNA, 17 nt, Homo sapiens
acgggagaauauacaaa

SEQ ID NO: 766335 - RNA, 21 nt, Homo sapiens
acgggggccgcguggugccau

SEQ ID NO: 766336 - RNA, 23 nt, Homo sapiens
acgguaaguguucucaugaagca

SEQ ID NO: 766337 - RNA, 16 nt, Homo sapiens
acggucaguccauguc

SEQ ID NO: 766338 - RNA, 15 nt, Homo sapiens
acggugacucugucc

SEQ ID NO: 766339 - RNA, 14 nt, Homo sapiens
acgguucaccagcc

SEQ ID NO: 766340 - RNA, 17 nt, Homo sapiens
acgguuuaauucugucu

SEQ ID NO: 766341 - RNA, 21 nt, Homo sapiens
acguaaaaagaaaaaaaccau

SEQ ID NO: 766342 - RNA, 17 nt, Homo sapiens
acgugcaggacagcucu

SEQ ID NO: 766343 - RNA, 19 nt, Homo sapiens
acgugcaguaucucaagau

SEQ ID NO: 766344 - RNA, 16 nt, Homo sapiens
acgugcgcgaugugac

SEQ ID NO: 766345 - RNA, 14 nt, Homo sapiens
acgugcucccucag

SEQ ID NO: 766346 - RNA, 17 nt, Homo sapiens
acgugcucccucagcuc

SEQ ID NO: 766347 - RNA, 14 nt, Homo sapiens
acguggacuccucu

SEQ ID NO: 766348 - RNA, 17 nt, Homo sapiens
acguggccucuugagca

SEQ ID NO: 766349 - RNA, 23 nt, Homo sapiens
acgugggugcccucuccaaaggc

SEQ ID NO: 766350 - RNA, 13 nt, Homo sapiens
acgugucuccuca

SEQ ID NO: 766351 - RNA, 18 nt, Homo sapiens
acguucuggacugucuuc

SEQ ID NO: 766352 - RNA, 23 nt, Homo sapiens
acguuguuuugguuguacuuugg

SEQ ID NO: 766353 - RNA, 14 nt, Homo sapiens
acguuuuguaaaug

SEQ ID NO: 766354 - RNA, 17 nt, Homo sapiens
acuaaaacugcauuucc

SEQ ID NO: 766355 - RNA, 19 nt, Homo sapiens
acuaaaagguaugcaauca

SEQ ID NO: 766356 - RNA, 18 nt, Homo sapiens
acuaaacaacuaccuccu

SEQ ID NO: 766357 - RNA, 21 nt, Homo sapiens
acuaaacaacuaccuccucag

SEQ ID NO: 766358 - RNA, 19 nt, Homo sapiens
acuaaagagugaaugccau

SEQ ID NO: 766359 - RNA, 21 nt, Homo sapiens
acuaaagagugaaugccauuu

SEQ ID NO: 766360 - RNA, 13 nt, Homo sapiens
acuaaaggcaucc

SEQ ID NO: 766361 - RNA, 12 nt, Homo sapiens
acuaaaguuaac

SEQ ID NO: 766362 - RNA, 19 nt, Homo sapiens
accucagccuggccagaca

SEQ ID NO: 766363 - RNA, 12 nt, Homo sapiens
accucaggugau

SEQ ID NO: 766364 - RNA, 16 nt, Homo sapiens
accucagugcacgagc

SEQ ID NO: 766365 - RNA, 20 nt, Homo sapiens
accucaguucccucuugcuc

SEQ ID NO: 766366 - RNA, 12 nt, Homo sapiens
accucaucuuuc

SEQ ID NO: 766367 - RNA, 15 nt, Homo sapiens
accuccagggagcac

SEQ ID NO: 766368 - RNA, 13 nt, Homo sapiens
accuccauuuccc

SEQ ID NO: 766369 - RNA, 19 nt, Homo sapiens
accuccauuucccaaaguc

SEQ ID NO: 766370 - RNA, 18 nt, Homo sapiens
accuccauuucucuccag

SEQ ID NO: 766371 - RNA, 19 nt, Homo sapiens
accucccaccccacuccag

SEQ ID NO: 766372 - RNA, 21 nt, Homo sapiens
accuccccacccgcucccaca

SEQ ID NO: 766373 - RNA, 11 nt, Homo sapiens
accucccugac

SEQ ID NO: 766374 - RNA, 19 nt, Homo sapiens
accucccuucccaccuacu

SEQ ID NO: 766375 - RNA, 16 nt, Homo sapiens
accuccgccauccacc

SEQ ID NO: 766376 - RNA, 17 nt, Homo sapiens
accuccgccccugcccc

SEQ ID NO: 766377 - RNA, 22 nt, Homo sapiens
accuccuagaggugggcagcug

SEQ ID NO: 766378 - RNA, 11 nt, Homo sapiens
accuccucaug

SEQ ID NO: 766379 - RNA, 19 nt, Homo sapiens
accuccucccuaaugcuca

SEQ ID NO: 766380 - RNA, 21 nt, Homo sapiens
accuccucccuaaugcucacc

SEQ ID NO: 766381 - RNA, 13 nt, Homo sapiens
accuccucuccac

SEQ ID NO: 766382 - RNA, 13 nt, Homo sapiens
accuccucuguga

SEQ ID NO: 766383 - RNA, 22 nt, Homo sapiens
accuccuuucaucacacugggu

SEQ ID NO: 766384 - RNA, 19 nt, Homo sapiens
accucggccucccacagug

SEQ ID NO: 766385 - RNA, 20 nt, Homo sapiens
accucggcuguuuacagugu

SEQ ID NO: 766386 - RNA, 13 nt, Homo sapiens
accucguccuccc

SEQ ID NO: 766387 - RNA, 13 nt, Homo sapiens
accucuaugcaau

SEQ ID NO: 766388 - RNA, 13 nt, Homo sapiens
accucucugggcc

SEQ ID NO: 766389 - RNA, 16 nt, Homo sapiens
accucugaauuuacuu

SEQ ID NO: 766390 - RNA, 12 nt, Homo sapiens
accucugaccaa

SEQ ID NO: 766391 - RNA, 12 nt, Homo sapiens
accucugaggac

SEQ ID NO: 766392 - RNA, 14 nt, Homo sapiens
accucugcacuacu

SEQ ID NO: 766393 - RNA, 10 nt, Homo sapiens
accucugcau

SEQ ID NO: 766394 - RNA, 15 nt, Homo sapiens
accucuggugauggu

SEQ ID NO: 766395 - RNA, 23 nt, Homo sapiens
accucuguauuaguuuuugauca

SEQ ID NO: 766396 - RNA, 18 nt, Homo sapiens
accucugugggcacuggu

SEQ ID NO: 766397 - RNA, 17 nt, Homo sapiens
accucuguuguccuccc

SEQ ID NO: 766398 - RNA, 22 nt, Homo sapiens
accucuuccuccucgcugccag

SEQ ID NO: 766399 - RNA, 15 nt, Homo sapiens
accucuucuaugcaa

SEQ ID NO: 766400 - RNA, 14 nt, Homo sapiens
accugaaauuccaa

SEQ ID NO: 766401 - RNA, 20 nt, Homo sapiens
accugaaauuuauucacaua

SEQ ID NO: 766402 - RNA, 21 nt, Homo sapiens
accugaaauuuauucacauau

SEQ ID NO: 766403 - RNA, 20 nt, Homo sapiens
accugaaggaauaaaaugau

SEQ ID NO: 766404 - RNA, 15 nt, Homo sapiens
accugacucuugcag

SEQ ID NO: 766405 - RNA, 17 nt, Homo sapiens
accugagaaauggccaa

SEQ ID NO: 766406 - RNA, 13 nt, Homo sapiens
accugagaccucc

SEQ ID NO: 766407 - RNA, 15 nt, Homo sapiens
accugaggauaacuc

SEQ ID NO: 766408 - RNA, 21 nt, Homo sapiens
accugaggauaacucaauaua

SEQ ID NO: 766409 - RNA, 22 nt, Homo sapiens
accugauugaucacacaguguu

SEQ ID NO: 766410 - RNA, 17 nt, Homo sapiens
accugcaagccuucuaa

SEQ ID NO: 766411 - RNA, 23 nt, Homo sapiens
accugcaccuccccccacugcag

SEQ ID NO: 766412 - RNA, 13 nt, Homo sapiens
accugcaggccaa

SEQ ID NO: 766413 - RNA, 16 nt, Homo sapiens
accugcccugggccac

SEQ ID NO: 766414 - RNA, 17 nt, Homo sapiens
accugccgucuucacuu

SEQ ID NO: 766415 - RNA, 14 nt, Homo sapiens
accugccugcauuc

SEQ ID NO: 766416 - RNA, 18 nt, Homo sapiens
accugcguuuucauuugu

SEQ ID NO: 766417 - RNA, 23 nt, Homo sapiens
accugcuaaaggagauuuacaca

SEQ ID NO: 766418 - RNA, 19 nt, Homo sapiens
accugcucaucauauucca

SEQ ID NO: 766419 - RNA, 21 nt, Homo sapiens
accugcugcguccccacuccc

SEQ ID NO: 766420 - RNA, 15 nt, Homo sapiens
accugcuggggaccu

SEQ ID NO: 766421 - RNA, 17 nt, Homo sapiens
accugcuggggaccuca

SEQ ID NO: 766422 - RNA, 13 nt, Homo sapiens
accugcuggugag

SEQ ID NO: 766423 - RNA, 17 nt, Homo sapiens
accugcuuagcugccuu

SEQ ID NO: 766424 - RNA, 23 nt, Homo sapiens
accuggacacaacaccaaaaagg

SEQ ID NO: 766425 - RNA, 12 nt, Homo sapiens
accuggauccag

SEQ ID NO: 766426 - RNA, 20 nt, Homo sapiens
accuggauccagcacuggug

SEQ ID NO: 766427 - RNA, 18 nt, Homo sapiens
accuggccgccuccagga

SEQ ID NO: 766428 - RNA, 19 nt, Homo sapiens
accuggccgcuaaguugcu

SEQ ID NO: 766429 - RNA, 20 nt, Homo sapiens
accuggccugguugugugca

SEQ ID NO: 766430 - RNA, 14 nt, Homo sapiens
accuggcuuuuacu

SEQ ID NO: 766431 - RNA, 23 nt, Homo sapiens
accuggggauccaauugauguau

SEQ ID NO: 766432 - RNA, 19 nt, Homo sapiens
accuggggucaucgauuca

SEQ ID NO: 766433 - RNA, 19 nt, Homo sapiens
accugguacccuccuggcu

SEQ ID NO: 766434 - RNA, 22 nt, Homo sapiens
accuggugggagcaccugccag

SEQ ID NO: 766435 - RNA, 19 nt, Homo sapiens
accuguaaucccagcacuu

SEQ ID NO: 766436 - RNA, 20 nt, Homo sapiens
accuguacacugacuugaga

SEQ ID NO: 766437 - RNA, 21 nt, Homo sapiens
accuguaccuggccuggccuc

SEQ ID NO: 766438 - RNA, 16 nt, Homo sapiens
accuguauuuugccag

SEQ ID NO: 766439 - RNA, 16 nt, Homo sapiens
accugucauuuugcac

SEQ ID NO: 766440 - RNA, 13 nt, Homo sapiens
accuguccuugca

SEQ ID NO: 766441 - RNA, 19 nt, Homo sapiens
accuguccuugcacacucc

SEQ ID NO: 766442 - RNA, 16 nt, Homo sapiens
accugucucuaccuaa

SEQ ID NO: 766443 - RNA, 17 nt, Homo sapiens
accugucucuaccuaag

SEQ ID NO: 766444 - RNA, 15 nt, Homo sapiens
accugugcaccuacc

SEQ ID NO: 766445 - RNA, 17 nt, Homo sapiens
accugugccuccucaga

SEQ ID NO: 766446 - RNA, 22 nt, Homo sapiens
accuguugguuagauucaaggc

SEQ ID NO: 766447 - RNA, 19 nt, Homo sapiens
accuguuuaaauauuucaa

SEQ ID NO: 766448 - RNA, 21 nt, Homo sapiens
accuguuuuuuuuucauuuau

SEQ ID NO: 766449 - RNA, 14 nt, Homo sapiens
accuuaaaauguaa

SEQ ID NO: 766450 - RNA, 18 nt, Homo sapiens
accuuaagagacacucca

SEQ ID NO: 766451 - RNA, 17 nt, Homo sapiens
accaggccugagcaaca

SEQ ID NO: 766452 - RNA, 21 nt, Homo sapiens
accaggccuggccucugggca

SEQ ID NO: 766453 - RNA, 19 nt, Homo sapiens
accaggcugcucagggcug

SEQ ID NO: 766454 - RNA, 16 nt, Homo sapiens
accagggcucuucuca

SEQ ID NO: 766455 - RNA, 18 nt, Homo sapiens
accagggugguugggacg

SEQ ID NO: 766456 - RNA, 20 nt, Homo sapiens
accaggguuucucugaagaa

SEQ ID NO: 766457 - RNA, 19 nt, Homo sapiens
accagucagggacagcagc

SEQ ID NO: 766458 - RNA, 15 nt, Homo sapiens
accagucuauuucca

SEQ ID NO: 766459 - RNA, 20 nt, Homo sapiens
accagucuauuuccacugaa

SEQ ID NO: 766460 - RNA, 19 nt, Homo sapiens
accagugaaacuaugaucc

SEQ ID NO: 766461 - RNA, 18 nt, Homo sapiens
accagugaaagaagccac

SEQ ID NO: 766462 - RNA, 15 nt, Homo sapiens
accaguguagcauug

SEQ ID NO: 766463 - RNA, 13 nt, Homo sapiens
accaguguagccu

SEQ ID NO: 766464 - RNA, 22 nt, Homo sapiens
accaguguccuccccucaagga

SEQ ID NO: 766465 - RNA, 18 nt, Homo sapiens
accaguuaauuuuuccaa

SEQ ID NO: 766466 - RNA, 15 nt, Homo sapiens
accaguuaugugaau

SEQ ID NO: 766467 - RNA, 22 nt, Homo sapiens
accauauagagguguaacacuu

SEQ ID NO: 766468 - RNA, 23 nt, Homo sapiens
accauauugugcuucacaguaga

SEQ ID NO: 766469 - RNA, 17 nt, Homo sapiens
accauauuuuuuguaaa

SEQ ID NO: 766470 - RNA, 18 nt, Homo sapiens
accaucaaaaauauucca

SEQ ID NO: 766471 - RNA, 21 nt, Homo sapiens
accauccaccuucccuucuac

SEQ ID NO: 766472 - RNA, 21 nt, Homo sapiens
accauccuggcuaacacguga

SEQ ID NO: 766473 - RNA, 17 nt, Homo sapiens
accaucucuuuaccucc

SEQ ID NO: 766474 - RNA, 20 nt, Homo sapiens
accaucucuuuaccuccuaa

SEQ ID NO: 766475 - RNA, 17 nt, Homo sapiens
accaucuucuauucaaa

SEQ ID NO: 766476 - RNA, 16 nt, Homo sapiens
accaugaaauauccag

SEQ ID NO: 766477 - RNA, 13 nt, Homo sapiens
accaugcagaaca

SEQ ID NO: 766478 - RNA, 16 nt, Homo sapiens
acccuaaagugcaaaa

SEQ ID NO: 766479 - RNA, 22 nt, Homo sapiens
acccuaacacaguauaucccaa

SEQ ID NO: 766480 - RNA, 14 nt, Homo sapiens
acccuaccaugaau

SEQ ID NO: 766481 - RNA, 23 nt, Homo sapiens
acccuaccuuccccagacuugca

SEQ ID NO: 766482 - RNA, 23 nt, Homo sapiens
acccuacuuucuggaaguggagu

SEQ ID NO: 766483 - RNA, 20 nt, Homo sapiens
acccuagccaaugucuccuc

SEQ ID NO: 766484 - RNA, 20 nt, Homo sapiens
acccuaguucuaccucaggc

SEQ ID NO: 766485 - RNA, 19 nt, Homo sapiens
acccucacaagcaugaagu

SEQ ID NO: 766486 - RNA, 15 nt, Homo sapiens
acccucagcacuguu

SEQ ID NO: 766487 - RNA, 17 nt, Homo sapiens
acccucaggaauucagu

SEQ ID NO: 766488 - RNA, 17 nt, Homo sapiens
acccucauuucucaucu

SEQ ID NO: 766489 - RNA, 21 nt, Homo sapiens
acccuccacucagcuguccug

SEQ ID NO: 766490 - RNA, 20 nt, Homo sapiens
acccuccagaauccugaugg

SEQ ID NO: 766491 - RNA, 15 nt, Homo sapiens
acccucccaccacuc

SEQ ID NO: 766492 - RNA, 15 nt, Homo sapiens
acccuccccacagug

SEQ ID NO: 766493 - RNA, 15 nt, Homo sapiens
acccuccccugagga

SEQ ID NO: 766494 - RNA, 16 nt, Homo sapiens
acccuccccugaggau

SEQ ID NO: 766495 - RNA, 23 nt, Homo sapiens
acccuccguuuuucuacuagaua

SEQ ID NO: 766496 - RNA, 19 nt, Homo sapiens
acccuccuaauagucauac

SEQ ID NO: 766497 - RNA, 14 nt, Homo sapiens
acccuccuguaaau

SEQ ID NO: 766498 - RNA, 17 nt, Homo sapiens
acccucuuccugugauc

SEQ ID NO: 766499 - RNA, 20 nt, Homo sapiens
acccucuuucuuguuuguca

SEQ ID NO: 766500 - RNA, 20 nt, Homo sapiens
acccugaaaggaacacuggc

SEQ ID NO: 766501 - RNA, 20 nt, Homo sapiens
acccugagcagaauacuggu

SEQ ID NO: 766502 - RNA, 23 nt, Homo sapiens
acccugagccggccccaggcucg

SEQ ID NO: 766503 - RNA, 22 nt, Homo sapiens
acccugaucucucagccccaaa

SEQ ID NO: 766504 - RNA, 17 nt, Homo sapiens
acccugcaaaaugagac

SEQ ID NO: 766505 - RNA, 17 nt, Homo sapiens
acccugccccuugccau

SEQ ID NO: 766506 - RNA, 18 nt, Homo sapiens
acccugcccgcucccaac

SEQ ID NO: 766507 - RNA, 14 nt, Homo sapiens
acccugcccugggc

SEQ ID NO: 766508 - RNA, 18 nt, Homo sapiens
acccugccuuaucuugca

SEQ ID NO: 766509 - RNA, 19 nt, Homo sapiens
acccugccuuaucuugcac

SEQ ID NO: 766510 - RNA, 15 nt, Homo sapiens
acccugcgccuccag

SEQ ID NO: 766511 - RNA, 15 nt, Homo sapiens
acccugcugaccucc

SEQ ID NO: 766512 - RNA, 19 nt, Homo sapiens
acccugcugcuggugcaca

SEQ ID NO: 766513 - RNA, 20 nt, Homo sapiens
acccugcugcuggugcacag

SEQ ID NO: 766514 - RNA, 18 nt, Homo sapiens
acccuggaauucagcacc

SEQ ID NO: 766515 - RNA, 20 nt, Homo sapiens
acccuggcccagaugaucac

SEQ ID NO: 766516 - RNA, 16 nt, Homo sapiens
acccugggcaaacaga

SEQ ID NO: 766517 - RNA, 19 nt, Homo sapiens
acccuggucucaucagucc

SEQ ID NO: 766518 - RNA, 21 nt, Homo sapiens
acccuggugggccaacaaaga

SEQ ID NO: 766519 - RNA, 21 nt, Homo sapiens
acccuguccggcccagugcca

SEQ ID NO: 766520 - RNA, 19 nt, Homo sapiens
acccugucuaaaaaacaua

SEQ ID NO: 766521 - RNA, 15 nt, Homo sapiens
acccugucucaaaaa

SEQ ID NO: 766522 - RNA, 23 nt, Homo sapiens
acccuuauaaaauccugugcaau

SEQ ID NO: 766523 - RNA, 13 nt, Homo sapiens
acccuuccaucag

SEQ ID NO: 766524 - RNA, 13 nt, Homo sapiens
acccuugaaccaa

SEQ ID NO: 766525 - RNA, 20 nt, Homo sapiens
acccuuggcacaggugucca

SEQ ID NO: 766526 - RNA, 18 nt, Homo sapiens
acccuugguggcuuaugg

SEQ ID NO: 766527 - RNA, 20 nt, Homo sapiens
acccuuuggccccacuuuga

SEQ ID NO: 766528 - RNA, 21 nt, Homo sapiens
acccuuuggccccacuuugaa

SEQ ID NO: 766529 - RNA, 23 nt, Homo sapiens
accgaaucucaauguacauagac

SEQ ID NO: 766530 - RNA, 22 nt, Homo sapiens
accgacuagccaggaaguacuu

SEQ ID NO: 766531 - RNA, 22 nt, Homo sapiens
accgaggugcaaauucauuuca

SEQ ID NO: 766532 - RNA, 21 nt, Homo sapiens
accgagucucuucuccacugg

SEQ ID NO: 766533 - RNA, 17 nt, Homo sapiens
accgagucuugcucugu

SEQ ID NO: 766534 - RNA, 20 nt, Homo sapiens
accgagucuugcucuguuac

SEQ ID NO: 766535 - RNA, 12 nt, Homo sapiens
accgagugcaau

SEQ ID NO: 766536 - RNA, 13 nt, Homo sapiens
accgagugcaaug

SEQ ID NO: 766537 - RNA, 15 nt, Homo sapiens
accgaugguccucac

SEQ ID NO: 766538 - RNA, 18 nt, Homo sapiens
accgccacgucccagcau

SEQ ID NO: 766539 - RNA, 22 nt, Homo sapiens
accgcccaucaggguucucuua

SEQ ID NO: 766540 - RNA, 22 nt, Homo sapiens
accgcgcccagccuacauucac

SEQ ID NO: 766541 - RNA, 21 nt, Homo sapiens
accgcgcccagccucaucucu

SEQ ID NO: 766542 - RNA, 14 nt, Homo sapiens
accgguccagcugg

SEQ ID NO: 766543 - RNA, 22 nt, Homo sapiens
accgguugauugaaauaucagu

SEQ ID NO: 766544 - RNA, 15 nt, Homo sapiens
accgucccucaguga

SEQ ID NO: 766545 - RNA, 18 nt, Homo sapiens
accguguggcccaagacc

SEQ ID NO: 766546 - RNA, 13 nt, Homo sapiens
accguugcuaaga

SEQ ID NO: 766547 - RNA, 17 nt, Homo sapiens
accuaaaagagauuuca

SEQ ID NO: 766548 - RNA, 20 nt, Homo sapiens
accuaaauggccucaugugg

SEQ ID NO: 766549 - RNA, 22 nt, Homo sapiens
accuaauauuuggagcuaucag

SEQ ID NO: 766550 - RNA, 11 nt, Homo sapiens
accuaauccaa

SEQ ID NO: 766551 - RNA, 23 nt, Homo sapiens
accuaauuguagcaucuaaugaa

SEQ ID NO: 766552 - RNA, 19 nt, Homo sapiens
accuacacaggagucuuca

SEQ ID NO: 766553 - RNA, 20 nt, Homo sapiens
accuacacccuggcccagcu

SEQ ID NO: 766554 - RNA, 15 nt, Homo sapiens
accuacagugcugug

SEQ ID NO: 766555 - RNA, 14 nt, Homo sapiens
accuacauuaucuc

SEQ ID NO: 766556 - RNA, 15 nt, Homo sapiens
accuacauuaucuca

SEQ ID NO: 766557 - RNA, 16 nt, Homo sapiens
accuacauuaucucac

SEQ ID NO: 766558 - RNA, 12 nt, Homo sapiens
accuaccaaaau

SEQ ID NO: 766559 - RNA, 14 nt, Homo sapiens
accuaccccagcca

SEQ ID NO: 766560 - RNA, 14 nt, Homo sapiens
accuacgugccacu

SEQ ID NO: 766561 - RNA, 19 nt, Homo sapiens
accuacuuuucuuuccuca

SEQ ID NO: 766562 - RNA, 20 nt, Homo sapiens
accuacuuuucuuuccucag

SEQ ID NO: 766563 - RNA, 19 nt, Homo sapiens
accuagaaguauuuuuguc

SEQ ID NO: 766564 - RNA, 14 nt, Homo sapiens
accuagacuguaaa

SEQ ID NO: 766565 - RNA, 18 nt, Homo sapiens
acauuuuauuaagcuuuu

SEQ ID NO: 766566 - RNA, 14 nt, Homo sapiens
acauuuucauugau

SEQ ID NO: 766567 - RNA, 19 nt, Homo sapiens
acauuuuccugagaccuca

SEQ ID NO: 766568 - RNA, 23 nt, Homo sapiens
acauuuuccugagaccucaauga

SEQ ID NO: 766569 - RNA, 21 nt, Homo sapiens
acauuuucuauaacauaugau

SEQ ID NO: 766570 - RNA, 20 nt, Homo sapiens
acauuuugugugagacuuaa

SEQ ID NO: 766571 - RNA, 23 nt, Homo sapiens
acauuuuuauaaaaaugagugcu

SEQ ID NO: 766572 - RNA, 20 nt, Homo sapiens
acauuuuuauuuaguugaaa

SEQ ID NO: 766573 - RNA, 20 nt, Homo sapiens
accaaaacuuccaaggcccu

SEQ ID NO: 766574 - RNA, 15 nt, Homo sapiens
accaaaauccgacug

SEQ ID NO: 766575 - RNA, 14 nt, Homo sapiens
accaaacaaggaag

SEQ ID NO: 766576 - RNA, 13 nt, Homo sapiens
accaaagacugca

SEQ ID NO: 766577 - RNA, 15 nt, Homo sapiens
accaaagcaucaaua

SEQ ID NO: 766578 - RNA, 18 nt, Homo sapiens
accaaagcugcccacugu

SEQ ID NO: 766579 - RNA, 16 nt, Homo sapiens
accaaagucacaaauc

SEQ ID NO: 766580 - RNA, 14 nt, Homo sapiens
accaaaguuugcaa

SEQ ID NO: 766581 - RNA, 14 nt, Homo sapiens
accaaauaagacuu

SEQ ID NO: 766582 - RNA, 19 nt, Homo sapiens
accaaauagcaauacaaac

SEQ ID NO: 766583 - RNA, 17 nt, Homo sapiens
accaaaucagcugcuac

SEQ ID NO: 766584 - RNA, 18 nt, Homo sapiens
accaaaucguggcacgua

SEQ ID NO: 766585 - RNA, 21 nt, Homo sapiens
accaaauuagcaggugcaccu

SEQ ID NO: 766586 - RNA, 17 nt, Homo sapiens
accaaauuagugaacca

SEQ ID NO: 766587 - RNA, 13 nt, Homo sapiens
accaacaaaaaga

SEQ ID NO: 766588 - RNA, 18 nt, Homo sapiens
accaacaaaaagaacaaa

SEQ ID NO: 766589 - RNA, 15 nt, Homo sapiens
accaacacugcucac

SEQ ID NO: 766590 - RNA, 13 nt, Homo sapiens
accaacaugguga

SEQ ID NO: 766591 - RNA, 15 nt, Homo sapiens
accaaccacagcauc

SEQ ID NO: 766592 - RNA, 22 nt, Homo sapiens
acaucaauuucuaaauacuuuu

SEQ ID NO: 766593 - RNA, 20 nt, Homo sapiens
acaucagcagagaacuggaa

SEQ ID NO: 766594 - RNA, 19 nt, Homo sapiens
acaucaggagacugggcuc

SEQ ID NO: 766595 - RNA, 17 nt, Homo sapiens
acaucagucuccaacau

SEQ ID NO: 766596 - RNA, 15 nt, Homo sapiens
acaucauugcauaac

SEQ ID NO: 766597 - RNA, 19 nt, Homo sapiens
acauccgcgugugccugug

SEQ ID NO: 766598 - RNA, 17 nt, Homo sapiens
acauccucucaaguuag

SEQ ID NO: 766599 - RNA, 19 nt, Homo sapiens
acauccuggccuggcacau

SEQ ID NO: 766600 - RNA, 16 nt, Homo sapiens
acauccuucuguggcu

SEQ ID NO: 766601 - RNA, 14 nt, Homo sapiens
acauccuuggacug

SEQ ID NO: 766602 - RNA, 22 nt, Homo sapiens
acauccuuucuuuuaaugaugc

SEQ ID NO: 766603 - RNA, 23 nt, Homo sapiens
acauccuuucuuuuaaugaugcc

SEQ ID NO: 766604 - RNA, 15 nt, Homo sapiens
acaucuauucucucc

SEQ ID NO: 766605 - RNA, 22 nt, Homo sapiens
acaucuccaggcuuucaauguu

SEQ ID NO: 766606 - RNA, 16 nt, Homo sapiens
acaucucccucccaca

SEQ ID NO: 766607 - RNA, 20 nt, Homo sapiens
acaucucgggaguccucuag

SEQ ID NO: 766608 - RNA, 13 nt, Homo sapiens
acaucucugggaa

SEQ ID NO: 766609 - RNA, 20 nt, Homo sapiens
acaucugagagaugacaggg

SEQ ID NO: 766610 - RNA, 12 nt, Homo sapiens
acaucugcaaua

SEQ ID NO: 766611 - RNA, 20 nt, Homo sapiens
acaucugcaauaugaauuca

SEQ ID NO: 766612 - RNA, 15 nt, Homo sapiens
acaucugcauuuuca

SEQ ID NO: 766613 - RNA, 15 nt, Homo sapiens
acaucugcugugguc

SEQ ID NO: 766614 - RNA, 15 nt, Homo sapiens
acaucuggcccugac

SEQ ID NO: 766615 - RNA, 15 nt, Homo sapiens
acaucuuaaauucau

SEQ ID NO: 766616 - RNA, 16 nt, Homo sapiens
acaucuuaauccugaa

SEQ ID NO: 766617 - RNA, 21 nt, Homo sapiens
acaucuuucacacuuccacca

SEQ ID NO: 766618 - RNA, 13 nt, Homo sapiens
acaucuuucacau

SEQ ID NO: 766619 - RNA, 22 nt, Homo sapiens
acaucuuuucuaaucacagugu

SEQ ID NO: 766620 - RNA, 23 nt, Homo sapiens
acaugaaaaaaggacaauuucaa

SEQ ID NO: 766621 - RNA, 22 nt, Homo sapiens
acaugaaaggacccugugagcc

SEQ ID NO: 766622 - RNA, 12 nt, Homo sapiens
acaugaaaguuu

SEQ ID NO: 766623 - RNA, 22 nt, Homo sapiens
acaugaaauaaugcacugagua

SEQ ID NO: 766624 - RNA, 14 nt, Homo sapiens
acaugaagaagcua

SEQ ID NO: 766625 - RNA, 22 nt, Homo sapiens
acaugaagcuguugugugaggu

SEQ ID NO: 766626 - RNA, 15 nt, Homo sapiens
acaugaauaaagccu

SEQ ID NO: 766627 - RNA, 23 nt, Homo sapiens
acaugaauugcauuuuacuuuaa

SEQ ID NO: 766628 - RNA, 20 nt, Homo sapiens
acaugacccaggccuggcca

SEQ ID NO: 766629 - RNA, 23 nt, Homo sapiens
acaugagucaaaacaaagcagcu

SEQ ID NO: 766630 - RNA, 20 nt, Homo sapiens
acaugcaaagauccccaaaa

SEQ ID NO: 766631 - RNA, 16 nt, Homo sapiens
acaugcaaggcacuga

SEQ ID NO: 766632 - RNA, 21 nt, Homo sapiens
acaugcacacacacacaucuc

SEQ ID NO: 766633 - RNA, 15 nt, Homo sapiens
acaugcacugacccu

SEQ ID NO: 766634 - RNA, 14 nt, Homo sapiens
acaugccacaagga

SEQ ID NO: 766635 - RNA, 17 nt, Homo sapiens
acaugcccuccuggaca

SEQ ID NO: 766636 - RNA, 13 nt, Homo sapiens
acaugcccugugu

SEQ ID NO: 766637 - RNA, 18 nt, Homo sapiens
acaugcccuguguggcug

SEQ ID NO: 766638 - RNA, 23 nt, Homo sapiens
acaugccgcagggagggcugugg

SEQ ID NO: 766639 - RNA, 23 nt, Homo sapiens
acaugccgcgggcggccaggcaa

SEQ ID NO: 766640 - RNA, 18 nt, Homo sapiens
acaugcuauguucugucu

SEQ ID NO: 766641 - RNA, 23 nt, Homo sapiens
acaugcuauguucugucuuccca

SEQ ID NO: 766642 - RNA, 18 nt, Homo sapiens
acaugcugcuaauucaaa

SEQ ID NO: 766643 - RNA, 23 nt, Homo sapiens
acaugcuugaauaacugagcuua

SEQ ID NO: 766644 - RNA, 16 nt, Homo sapiens
acaugcuugcauuaua

SEQ ID NO: 766645 - RNA, 16 nt, Homo sapiens
acaugcuuugaaguuu

SEQ ID NO: 766646 - RNA, 18 nt, Homo sapiens
acauggaauaacauguaa

SEQ ID NO: 766647 - RNA, 17 nt, Homo sapiens
acauggacccacuaccc

SEQ ID NO: 766648 - RNA, 16 nt, Homo sapiens
acauggaccuacugca

SEQ ID NO: 766649 - RNA, 17 nt, Homo sapiens
acauggacugcuucauc

SEQ ID NO: 766650 - RNA, 17 nt, Homo sapiens
acauggaggaacaguau

SEQ ID NO: 766651 - RNA, 20 nt, Homo sapiens
acauggccagugugauccca

SEQ ID NO: 766652 - RNA, 16 nt, Homo sapiens
acauggccuaugcaca

SEQ ID NO: 766653 - RNA, 23 nt, Homo sapiens
acauggcuccggccucugccuuu

SEQ ID NO: 766654 - RNA, 17 nt, Homo sapiens
acaugggcucuucacua

SEQ ID NO: 766655 - RNA, 20 nt, Homo sapiens
acauggugaaaccccgucuc

SEQ ID NO: 766656 - RNA, 18 nt, Homo sapiens
acauggugaaacccuguc

SEQ ID NO: 766657 - RNA, 17 nt, Homo sapiens
acauggugaaacuccau

SEQ ID NO: 766658 - RNA, 18 nt, Homo sapiens
acauguauuuauggagug

SEQ ID NO: 766659 - RNA, 22 nt, Homo sapiens
acaugucuccuacugaggauau

SEQ ID NO: 766660 - RNA, 18 nt, Homo sapiens
acaugugacacauaugca

SEQ ID NO: 766661 - RNA, 12 nt, Homo sapiens
acaugugcacau

SEQ ID NO: 766662 - RNA, 14 nt, Homo sapiens
acaugugcagucac

SEQ ID NO: 766663 - RNA, 14 nt, Homo sapiens
acauguggcccaac

SEQ ID NO: 766664 - RNA, 17 nt, Homo sapiens
acauguggggccagguc

SEQ ID NO: 766665 - RNA, 21 nt, Homo sapiens
acauguggguggagaagggag

SEQ ID NO: 766666 - RNA, 23 nt, Homo sapiens
acauguuaagagaaugcuuugaa

SEQ ID NO: 766667 - RNA, 21 nt, Homo sapiens
acauguuaaugacaauauucc

SEQ ID NO: 766668 - RNA, 23 nt, Homo sapiens
acauguuaaugacaauauuccag

SEQ ID NO: 766669 - RNA, 18 nt, Homo sapiens
acauguuauucaauguga

SEQ ID NO: 766670 - RNA, 15 nt, Homo sapiens
acauguucugugccu

SEQ ID NO: 766671 - RNA, 18 nt, Homo sapiens
acauguuguacauuucac

SEQ ID NO: 766672 - RNA, 16 nt, Homo sapiens
acauuaaacacuguaa

SEQ ID NO: 766673 - RNA, 17 nt, Homo sapiens
acauuaaaucacuugaa

SEQ ID NO: 766674 - RNA, 14 nt, Homo sapiens
acauuaacggugcu

SEQ ID NO: 766675 - RNA, 20 nt, Homo sapiens
acauuaaggaccaauagcau

SEQ ID NO: 766676 - RNA, 22 nt, Homo sapiens
acauuaaguaaaugcuguagaa

SEQ ID NO: 766677 - RNA, 22 nt, Homo sapiens
acauuaucaucugaaaaucugg

SEQ ID NO: 766678 - RNA, 14 nt, Homo sapiens
acauuaugaucuaa

SEQ ID NO: 766679 - RNA, 21 nt, Homo sapiens
acauucaaggcauuucuauca

SEQ ID NO: 766680 - RNA, 14 nt, Homo sapiens
acauucagggcuau

SEQ ID NO: 766681 - RNA, 15 nt, Homo sapiens
acauucaucaauauc

SEQ ID NO: 766682 - RNA, 14 nt, Homo sapiens
acauucccacugcc

SEQ ID NO: 766683 - RNA, 16 nt, Homo sapiens
acauugaaaacagaua

SEQ ID NO: 766684 - RNA, 19 nt, Homo sapiens
acauugaaacuacacuaaa

SEQ ID NO: 766685 - RNA, 15 nt, Homo sapiens
acauugauaauucaa

SEQ ID NO: 766686 - RNA, 19 nt, Homo sapiens
acauugaucuuuugcuaau

SEQ ID NO: 766687 - RNA, 16 nt, Homo sapiens
acauuggaaagcacac

SEQ ID NO: 766688 - RNA, 18 nt, Homo sapiens
acauuggaagcuuugagu

SEQ ID NO: 766689 - RNA, 17 nt, Homo sapiens
acauuggagcugacugu

SEQ ID NO: 766690 - RNA, 19 nt, Homo sapiens
acauuggagcugacuguuc

SEQ ID NO: 766691 - RNA, 21 nt, Homo sapiens
acauuguccuguagcuuuaaa

SEQ ID NO: 766692 - RNA, 20 nt, Homo sapiens
acauuguuugucugucuuca

SEQ ID NO: 766693 - RNA, 22 nt, Homo sapiens
acauuuacauguauuauuucau

SEQ ID NO: 766694 - RNA, 20 nt, Homo sapiens
acauuuagaugcacuaccau

SEQ ID NO: 766695 - RNA, 17 nt, Homo sapiens
acauuuaugcacauuca

SEQ ID NO: 766696 - RNA, 13 nt, Homo sapiens
acauuucaccaug

SEQ ID NO: 766697 - RNA, 21 nt, Homo sapiens
acauuucauuagugagccaug

SEQ ID NO: 766698 - RNA, 22 nt, Homo sapiens
acauuucucauaccuuccccac

SEQ ID NO: 766699 - RNA, 16 nt, Homo sapiens
acauuucuguucucau

SEQ ID NO: 766700 - RNA, 22 nt, Homo sapiens
acauuucuguucucauuugauc

SEQ ID NO: 766701 - RNA, 12 nt, Homo sapiens
acauuugccaag

SEQ ID NO: 766702 - RNA, 15 nt, Homo sapiens
acauuugggcucagg

SEQ ID NO: 766703 - RNA, 16 nt, Homo sapiens
acauuugucuucauga

SEQ ID NO: 766704 - RNA, 18 nt, Homo sapiens
acauuuguuuguauucau

SEQ ID NO: 766705 - RNA, 21 nt, Homo sapiens
acauuuuaauuuuaguuucau

SEQ ID NO: 766706 - RNA, 16 nt, Homo sapiens
aaugagccaucacuag

SEQ ID NO: 766707 - RNA, 17 nt, Homo sapiens
aaugagccaucacuaga

SEQ ID NO: 766708 - RNA, 17 nt, Homo sapiens
aaugagccgagaucacg

SEQ ID NO: 766709 - RNA, 12 nt, Homo sapiens
aaugagccuuag

SEQ ID NO: 766710 - RNA, 13 nt, Homo sapiens
aaugagccuuagu

SEQ ID NO: 766711 - RNA, 13 nt, Homo sapiens
aaugaguaaaaac

SEQ ID NO: 766712 - RNA, 12 nt, Homo sapiens
aaugagugcacc

SEQ ID NO: 766713 - RNA, 14 nt, Homo sapiens
aaugagugcaccug

SEQ ID NO: 766714 - RNA, 22 nt, Homo sapiens
aaugauacuuaaccaguuagaa

SEQ ID NO: 766715 - RNA, 16 nt, Homo sapiens
aaugauagaacuguac

SEQ ID NO: 766716 - RNA, 13 nt, Homo sapiens
aaugaucacucca

SEQ ID NO: 766717 - RNA, 13 nt, Homo sapiens
aaugaugaucuuc

SEQ ID NO: 766718 - RNA, 15 nt, Homo sapiens
aaugaugccacuucc

SEQ ID NO: 766719 - RNA, 16 nt, Homo sapiens
aaugaugggacaauaa

SEQ ID NO: 766720 - RNA, 14 nt, Homo sapiens
aaugaugggucagu

SEQ ID NO: 766721 - RNA, 14 nt, Homo sapiens
aaugauguuuuccu

SEQ ID NO: 766722 - RNA, 23 nt, Homo sapiens
aaugauuaacaguuaugugguca

SEQ ID NO: 766723 - RNA, 13 nt, Homo sapiens
aaugcaaaaaucu

SEQ ID NO: 766724 - RNA, 15 nt, Homo sapiens
aaugcaaaacuuuag

SEQ ID NO: 766725 - RNA, 14 nt, Homo sapiens
aaugcaacaguuuu

SEQ ID NO: 766726 - RNA, 18 nt, Homo sapiens
aaugcaaccaagucacac

SEQ ID NO: 766727 - RNA, 18 nt, Homo sapiens
aaugcaauaacucuggga

SEQ ID NO: 766728 - RNA, 17 nt, Homo sapiens
aaugcaauuagcauuau

SEQ ID NO: 766729 - RNA, 17 nt, Homo sapiens
aaugcaauuuccaacac

SEQ ID NO: 766730 - RNA, 14 nt, Homo sapiens
aaugcacaucucau

SEQ ID NO: 766731 - RNA, 18 nt, Homo sapiens
aaugcagaauucuugagu

SEQ ID NO: 766732 - RNA, 18 nt, Homo sapiens
aaugcagacugcugcaaa

SEQ ID NO: 766733 - RNA, 20 nt, Homo sapiens
aaugcaguggcgccaucuca

SEQ ID NO: 766734 - RNA, 20 nt, Homo sapiens
aaugcauauuugccacaaaa

SEQ ID NO: 766735 - RNA, 18 nt, Homo sapiens
aaugcaucacauauucau

SEQ ID NO: 766736 - RNA, 19 nt, Homo sapiens
aaugcaucacguaccccac

SEQ ID NO: 766737 - RNA, 16 nt, Homo sapiens
aauguuucacuaguua

SEQ ID NO: 766738 - RNA, 20 nt, Homo sapiens
aauguuucuggacauucucu

SEQ ID NO: 766739 - RNA, 14 nt, Homo sapiens
aauguuugcauaaa

SEQ ID NO: 766740 - RNA, 20 nt, Homo sapiens
aauguuugguuucagguauu

SEQ ID NO: 766741 - RNA, 15 nt, Homo sapiens
aauguuuguucauua

SEQ ID NO: 766742 - RNA, 22 nt, Homo sapiens
aauuaaaaauaccaacuguaca

SEQ ID NO: 766743 - RNA, 15 nt, Homo sapiens
aauuaaaccggacca

SEQ ID NO: 766744 - RNA, 17 nt, Homo sapiens
aauuaaagaugguuuau

SEQ ID NO: 766745 - RNA, 21 nt, Homo sapiens
aauuaaaggaaaaaaauggaa

SEQ ID NO: 766746 - RNA, 17 nt, Homo sapiens
aauuaaaugccuuguau

SEQ ID NO: 766747 - RNA, 15 nt, Homo sapiens
aauuaaccuuacuaa

SEQ ID NO: 766748 - RNA, 16 nt, Homo sapiens
aauuaagauuauguga

SEQ ID NO: 766749 - RNA, 18 nt, Homo sapiens
aauuaauaauauguacua

SEQ ID NO: 766750 - RNA, 17 nt, Homo sapiens
aauuaaucuugcuucau

SEQ ID NO: 766751 - RNA, 13 nt, Homo sapiens
aauuaaugcagau

SEQ ID NO: 766752 - RNA, 20 nt, Homo sapiens
aauuaccauuaauuacauac

SEQ ID NO: 766753 - RNA, 14 nt, Homo sapiens
aauuacugcuauaa

SEQ ID NO: 766754 - RNA, 12 nt, Homo sapiens
aauuacuggaau

SEQ ID NO: 766755 - RNA, 11 nt, Homo sapiens
aauuacugugu

SEQ ID NO: 766756 - RNA, 12 nt, Homo sapiens
aauuacuuucag

SEQ ID NO: 766757 - RNA, 16 nt, Homo sapiens
aauuagaacccauaac

SEQ ID NO: 766758 - RNA, 18 nt, Homo sapiens
aauuagaauauccaugac

SEQ ID NO: 766759 - RNA, 13 nt, Homo sapiens
aauuagaugaacu

SEQ ID NO: 766760 - RNA, 23 nt, Homo sapiens
aauuagcaauugacugucacugu

SEQ ID NO: 766761 - RNA, 22 nt, Homo sapiens
aauuagccauuucacucucaaa

SEQ ID NO: 766762 - RNA, 19 nt, Homo sapiens
aauuagccggucauggugg

SEQ ID NO: 766763 - RNA, 20 nt, Homo sapiens
aauuagucuuuuguaauauc

SEQ ID NO: 766764 - RNA, 15 nt, Homo sapiens
aauuagugaguauaa

SEQ ID NO: 766765 - RNA, 18 nt, Homo sapiens
aauuaguuaacaguuuuu

SEQ ID NO: 766766 - RNA, 12 nt, Homo sapiens
aauuaguuucaa

SEQ ID NO: 766767 - RNA, 16 nt, Homo sapiens
aauuauaauguugccc

SEQ ID NO: 766768 - RNA, 13 nt, Homo sapiens
aauuauaucacuu

SEQ ID NO: 766769 - RNA, 15 nt, Homo sapiens
aauuauccacaugaa

SEQ ID NO: 766770 - RNA, 18 nt, Homo sapiens
aauuaucggaagcagugc

SEQ ID NO: 766771 - RNA, 18 nt, Homo sapiens
aauuauugcuguauguaa

SEQ ID NO: 766772 - RNA, 19 nt, Homo sapiens
aauuauuguuauacacagc

SEQ ID NO: 766773 - RNA, 19 nt, Homo sapiens
aauuauuuuguucauacau

SEQ ID NO: 766774 - RNA, 20 nt, Homo sapiens
aauucaaaaaaaaaagcaac

SEQ ID NO: 766775 - RNA, 12 nt, Homo sapiens
aauucaaaaaca

SEQ ID NO: 766776 - RNA, 13 nt, Homo sapiens
aauucaaaaguga

SEQ ID NO: 766777 - RNA, 13 nt, Homo sapiens
aauucaaacuggg

SEQ ID NO: 766778 - RNA, 12 nt, Homo sapiens
aauucaaccacu

SEQ ID NO: 766779 - RNA, 21 nt, Homo sapiens
aauucaacccagccaugcaau

SEQ ID NO: 766780 - RNA, 15 nt, Homo sapiens
aauucacacaaagac

SEQ ID NO: 766781 - RNA, 20 nt, Homo sapiens
aauucacccccuuuccugga

SEQ ID NO: 766782 - RNA, 14 nt, Homo sapiens
aauucagcacuuaa

SEQ ID NO: 766783 - RNA, 21 nt, Homo sapiens
aauucaggccgcaagcagcug

SEQ ID NO: 766784 - RNA, 20 nt, Homo sapiens
aauucaucauugggcucacu

SEQ ID NO: 766785 - RNA, 12 nt, Homo sapiens
aauucauguuuc

SEQ ID NO: 766786 - RNA, 15 nt, Homo sapiens
aauucauucauuuca

SEQ ID NO: 766787 - RNA, 17 nt, Homo sapiens
aauucauucauuugcau

SEQ ID NO: 766788 - RNA, 18 nt, Homo sapiens
aauucauuguuuugcaaa

SEQ ID NO: 766789 - RNA, 21 nt, Homo sapiens
aauuccaccaggauuaaucuc

SEQ ID NO: 766790 - RNA, 18 nt, Homo sapiens
aauuccaucccaucaucu

SEQ ID NO: 766791 - RNA, 15 nt, Homo sapiens
aauucccaagcuuuu

SEQ ID NO: 766792 - RNA, 21 nt, Homo sapiens
aauuccuacaacuuaauggaa

SEQ ID NO: 766793 - RNA, 22 nt, Homo sapiens
aauuccuauauccugugacugu

SEQ ID NO: 766794 - RNA, 14 nt, Homo sapiens
aauuccuaucucau

SEQ ID NO: 766795 - RNA, 20 nt, Homo sapiens
aauuccugauggaaaaugca

SEQ ID NO: 766796 - RNA, 15 nt, Homo sapiens
aauuccuguauucua

SEQ ID NO: 766797 - RNA, 23 nt, Homo sapiens
aauucuaaauaaauuucccaguu

SEQ ID NO: 766798 - RNA, 19 nt, Homo sapiens
aauucuaaguuauuuacuu

SEQ ID NO: 766799 - RNA, 11 nt, Homo sapiens
aauucuacugg

SEQ ID NO: 766800 - RNA, 14 nt, Homo sapiens
aauucuacuggaaa

SEQ ID NO: 766801 - RNA, 14 nt, Homo sapiens
aauucuacuuugag

SEQ ID NO: 766802 - RNA, 21 nt, Homo sapiens
aauucuauugaguggcagugu

SEQ ID NO: 766803 - RNA, 16 nt, Homo sapiens
aauucucagaaucuca

SEQ ID NO: 766804 - RNA, 22 nt, Homo sapiens
aauucucagucaguaauugcca

SEQ ID NO: 766805 - RNA, 16 nt, Homo sapiens
aauucucuagggcuag

SEQ ID NO: 766806 - RNA, 23 nt, Homo sapiens
aauucucucccccuauuuauuga

SEQ ID NO: 766807 - RNA, 14 nt, Homo sapiens
aauucucuuucaaa

SEQ ID NO: 766808 - RNA, 15 nt, Homo sapiens
aauucugaacuuuau

SEQ ID NO: 766809 - RNA, 20 nt, Homo sapiens
aauucugugacauacauauu

SEQ ID NO: 766810 - RNA, 16 nt, Homo sapiens
aauucuuagucaagga

SEQ ID NO: 766811 - RNA, 18 nt, Homo sapiens
aauucuucuguccugaga

SEQ ID NO: 766812 - RNA, 11 nt, Homo sapiens
aauucuugaua

SEQ ID NO: 766813 - RNA, 19 nt, Homo sapiens
aauucuuguagaugcauua

SEQ ID NO: 766814 - RNA, 14 nt, Homo sapiens
aauucuuuccccaa

SEQ ID NO: 766815 - RNA, 17 nt, Homo sapiens
aauucuuuguauaugca

SEQ ID NO: 766816 - RNA, 15 nt, Homo sapiens
aauugaaagaacuua

SEQ ID NO: 766817 - RNA, 17 nt, Homo sapiens
aauugaaaggcauucuc

SEQ ID NO: 766818 - RNA, 17 nt, Homo sapiens
aauugacaaugauuuau

SEQ ID NO: 766819 - RNA, 20 nt, Homo sapiens
aauugacugaagcacagcac

SEQ ID NO: 766820 - RNA, 13 nt, Homo sapiens
aauugacugucac

SEQ ID NO: 766821 - RNA, 15 nt, Homo sapiens
aauugauacuucagg

SEQ ID NO: 766822 - RNA, 14 nt, Homo sapiens
aauugauguugcug

SEQ ID NO: 766823 - RNA, 13 nt, Homo sapiens
aauugauuauucu

SEQ ID NO: 766824 - RNA, 21 nt, Homo sapiens
aauugauuauucugauuccac

SEQ ID NO: 766825 - RNA, 21 nt, Homo sapiens
aauugauucuuagacauugca

SEQ ID NO: 766826 - RNA, 14 nt, Homo sapiens
aauugauugaauua

SEQ ID NO: 766827 - RNA, 23 nt, Homo sapiens
aauugcaaauaaaccacuuucua

SEQ ID NO: 766828 - RNA, 20 nt, Homo sapiens
aauugcacuuuuaaaccucu

SEQ ID NO: 766829 - RNA, 19 nt, Homo sapiens
aauugcauacuacucucaa

SEQ ID NO: 766830 - RNA, 18 nt, Homo sapiens
aauugcuagucaggguga

SEQ ID NO: 766831 - RNA, 14 nt, Homo sapiens
aauugcucaugcau

SEQ ID NO: 766832 - RNA, 15 nt, Homo sapiens
aauugcuuugccaaa

SEQ ID NO: 766833 - RNA, 13 nt, Homo sapiens
aauuggaagggaa

SEQ ID NO: 766834 - RNA, 14 nt, Homo sapiens
aauuggaaucuuca

SEQ ID NO: 766835 - RNA, 13 nt, Homo sapiens
aauuggcucuagu

SEQ ID NO: 766836 - RNA, 19 nt, Homo sapiens
aauuggcucuagucacugg

SEQ ID NO: 766837 - RNA, 15 nt, Homo sapiens
aauugggcagucuua

SEQ ID NO: 766838 - RNA, 14 nt, Homo sapiens
aauugguuuuccag

SEQ ID NO: 766839 - RNA, 13 nt, Homo sapiens
aauuguaauugac

SEQ ID NO: 766840 - RNA, 17 nt, Homo sapiens
aauuguaauugcaugac

SEQ ID NO: 766841 - RNA, 12 nt, Homo sapiens
aauuguaggcag

SEQ ID NO: 766842 - RNA, 14 nt, Homo sapiens
aauugugcuuucac

SEQ ID NO: 766843 - RNA, 17 nt, Homo sapiens
aauuguuuuaccagcuc

SEQ ID NO: 766844 - RNA, 18 nt, Homo sapiens
aauuguuuucacuuguau

SEQ ID NO: 766845 - RNA, 16 nt, Homo sapiens
aauuuaaaauaauuau

SEQ ID NO: 766846 - RNA, 18 nt, Homo sapiens
aauuuaaagggaaaaccc

SEQ ID NO: 766847 - RNA, 12 nt, Homo sapiens
aauuuaacaaga

SEQ ID NO: 766848 - RNA, 19 nt, Homo sapiens
aauuuaauauacugcauau

SEQ ID NO: 766849 - RNA, 17 nt, Homo sapiens
aauuuaaucacuuucau

SEQ ID NO: 766850 - RNA, 14 nt, Homo sapiens
aauuuacacugcca

SEQ ID NO: 766851 - RNA, 17 nt, Homo sapiens
aauuuacccauuucuau

SEQ ID NO: 766852 - RNA, 21 nt, Homo sapiens
aauuuagagauaggaaacuga

SEQ ID NO: 766853 - RNA, 18 nt, Homo sapiens
aauuuaggacacauuuag

SEQ ID NO: 766854 - RNA, 22 nt, Homo sapiens
aauuuauaguuaaggcuaaaaa

SEQ ID NO: 766855 - RNA, 22 nt, Homo sapiens
aauuuaucuuugauaacaggga

SEQ ID NO: 766856 - RNA, 13 nt, Homo sapiens
aauuuauuacaaa

SEQ ID NO: 766857 - RNA, 15 nt, Homo sapiens
aauuuauuacugaaa

SEQ ID NO: 766858 - RNA, 18 nt, Homo sapiens
aauuuauucaauuccucu

SEQ ID NO: 766859 - RNA, 23 nt, Homo sapiens
aauuuauugucugucuacauuuc

SEQ ID NO: 766860 - RNA, 23 nt, Homo sapiens
aauuuauuugaaaaugcaucaca

SEQ ID NO: 766861 - RNA, 21 nt, Homo sapiens
aauuucaauuauagugucaug

SEQ ID NO: 766862 - RNA, 20 nt, Homo sapiens
aauuucauaccuaucaucuu

SEQ ID NO: 766863 - RNA, 22 nt, Homo sapiens
aauuuccacaagcauugcuuca

SEQ ID NO: 766864 - RNA, 15 nt, Homo sapiens
aauuuccaguaccuu

SEQ ID NO: 766865 - RNA, 14 nt, Homo sapiens
aauuuccucuccac

SEQ ID NO: 766866 - RNA, 20 nt, Homo sapiens
aauuucucccagucauuuaa

SEQ ID NO: 766867 - RNA, 19 nt, Homo sapiens
aauuucuccucccuuccuu

SEQ ID NO: 766868 - RNA, 17 nt, Homo sapiens
aauuucuggaaaacugc

SEQ ID NO: 766869 - RNA, 22 nt, Homo sapiens
aauuucuucuuuagaugccaaa

SEQ ID NO: 766870 - RNA, 14 nt, Homo sapiens
aauuugaaauuuag

SEQ ID NO: 766871 - RNA, 15 nt, Homo sapiens
aauuugacaaaaccc

SEQ ID NO: 766872 - RNA, 18 nt, Homo sapiens
aauuugagauucuacagu

SEQ ID NO: 766873 - RNA, 23 nt, Homo sapiens
aauuugaggacaagauaccaagg

SEQ ID NO: 766874 - RNA, 18 nt, Homo sapiens
aauuuggagcauaacugg

SEQ ID NO: 766875 - RNA, 16 nt, Homo sapiens
aauuuggguucugccu

SEQ ID NO: 766876 - RNA, 19 nt, Homo sapiens
aauuuguaacuuugcagcg

SEQ ID NO: 766877 - RNA, 16 nt, Homo sapiens
aauuugugccacuuua

SEQ ID NO: 766878 - RNA, 22 nt, Homo sapiens
aauuugugugacagacuccgaa

SEQ ID NO: 766879 - RNA, 18 nt, Homo sapiens
aauuuuaaguacuuugcu

SEQ ID NO: 766880 - RNA, 12 nt, Homo sapiens
aauuuuacccuu

SEQ ID NO: 766881 - RNA, 19 nt, Homo sapiens
aauuuuagaacaguccagc

SEQ ID NO: 766882 - RNA, 15 nt, Homo sapiens
aauuuuaguauucau

SEQ ID NO: 766883 - RNA, 14 nt, Homo sapiens
aauuuuauaucauu

SEQ ID NO: 766884 - RNA, 23 nt, Homo sapiens
aauuuuauaucuuguagcuuuau

SEQ ID NO: 766885 - RNA, 16 nt, Homo sapiens
aauuuucaauuugaga

SEQ ID NO: 766886 - RNA, 20 nt, Homo sapiens
aauuuucauuaaacuugaag

SEQ ID NO: 766887 - RNA, 17 nt, Homo sapiens
aauuuucuaauuaaaga

SEQ ID NO: 766888 - RNA, 21 nt, Homo sapiens
aauuuucuagauuuucuacuu

SEQ ID NO: 766889 - RNA, 22 nt, Homo sapiens
aauuuugagauuaagaaugcca

SEQ ID NO: 766890 - RNA, 20 nt, Homo sapiens
aauuuugaguauuccaugag

SEQ ID NO: 766891 - RNA, 21 nt, Homo sapiens
aauuuugccauaaagucaaau

SEQ ID NO: 766892 - RNA, 16 nt, Homo sapiens
aauuuugcuugcugaa

SEQ ID NO: 766893 - RNA, 17 nt, Homo sapiens
aauuuuguucucuggga

SEQ ID NO: 766894 - RNA, 18 nt, Homo sapiens
aauuuuuaagcugcaaau

SEQ ID NO: 766895 - RNA, 15 nt, Homo sapiens
aauuuuuacauucau

SEQ ID NO: 766896 - RNA, 14 nt, Homo sapiens
aauuuuuaccuaau

SEQ ID NO: 766897 - RNA, 14 nt, Homo sapiens
aauuuuuaccuguu

SEQ ID NO: 766898 - RNA, 14 nt, Homo sapiens
acaaaaaauuagcu

SEQ ID NO: 766899 - RNA, 22 nt, Homo sapiens
acaaaaagaacaaaucagcuua

SEQ ID NO: 766900 - RNA, 14 nt, Homo sapiens
acaaaaagagcuuu

SEQ ID NO: 766901 - RNA, 23 nt, Homo sapiens
acaaaaaggaaaugaauauucaa

SEQ ID NO: 766902 - RNA, 22 nt, Homo sapiens
acaaaaaugaaagcaugucuca

SEQ ID NO: 766903 - RNA, 14 nt, Homo sapiens
acaaaacacugugu

SEQ ID NO: 766904 - RNA, 23 nt, Homo sapiens
acaaaaccuacgcacauaccuuc

SEQ ID NO: 766905 - RNA, 20 nt, Homo sapiens
acaaaagaauaacauuuucu

SEQ ID NO: 766906 - RNA, 16 nt, Homo sapiens
acaaaagauuaaucuu

SEQ ID NO: 766907 - RNA, 22 nt, Homo sapiens
acaaaaggguguauaguguuca

SEQ ID NO: 766908 - RNA, 22 nt, Homo sapiens
acaaaauaacucuccaguaaca

SEQ ID NO: 766909 - RNA, 13 nt, Homo sapiens
acaaaauacacac

SEQ ID NO: 766910 - RNA, 19 nt, Homo sapiens
acaaaauagccuauccuua

SEQ ID NO: 766911 - RNA, 16 nt, Homo sapiens
acaaaauauauuuugu

SEQ ID NO: 766912 - RNA, 17 nt, Homo sapiens
acaaaauccaugaacaa

SEQ ID NO: 766913 - RNA, 15 nt, Homo sapiens
acaaaaugauuuuga

SEQ ID NO: 766914 - RNA, 16 nt, Homo sapiens
acaaaaugccaagggg

SEQ ID NO: 766915 - RNA, 22 nt, Homo sapiens
acaaaauggucauccaaacuca

SEQ ID NO: 766916 - RNA, 12 nt, Homo sapiens
acaaaauugcag

SEQ ID NO: 766917 - RNA, 15 nt, Homo sapiens
acaaaauugcagaua

SEQ ID NO: 766918 - RNA, 20 nt, Homo sapiens
acaaaauuugagaauacaua

SEQ ID NO: 766919 - RNA, 14 nt, Homo sapiens
acaaacaaacagaa

SEQ ID NO: 766920 - RNA, 16 nt, Homo sapiens
acaaacaagagaagcu

SEQ ID NO: 766921 - RNA, 18 nt, Homo sapiens
acaaacaagaggacugug

SEQ ID NO: 766922 - RNA, 11 nt, Homo sapiens
acaaacagggc

SEQ ID NO: 766923 - RNA, 16 nt, Homo sapiens
acaaacccaaaaaaga

SEQ ID NO: 766924 - RNA, 18 nt, Homo sapiens
acaaacggagccccugaa

SEQ ID NO: 766925 - RNA, 22 nt, Homo sapiens
acaaacuggcagguaccgugcu

SEQ ID NO: 766926 - RNA, 12 nt, Homo sapiens
acaaacugugaa

SEQ ID NO: 766927 - RNA, 14 nt, Homo sapiens
acaaacuucaaaga

SEQ ID NO: 766928 - RNA, 15 nt, Homo sapiens
acaaagacaguauuu

SEQ ID NO: 766929 - RNA, 14 nt, Homo sapiens
acaaagacuacuaa

SEQ ID NO: 766930 - RNA, 14 nt, Homo sapiens
acaaagauugagaa

SEQ ID NO: 766931 - RNA, 18 nt, Homo sapiens
acaaagauugagaagcca

SEQ ID NO: 766932 - RNA, 17 nt, Homo sapiens
acaaagcacaguuugaa

SEQ ID NO: 766933 - RNA, 19 nt, Homo sapiens
acaaagcccauagcacugg

SEQ ID NO: 766934 - RNA, 21 nt, Homo sapiens
acaaagcccauagcacugggc

SEQ ID NO: 766935 - RNA, 13 nt, Homo sapiens
acaaagcuucuau

SEQ ID NO: 766936 - RNA, 16 nt, Homo sapiens
acaaaggaaauaucaa

SEQ ID NO: 766937 - RNA, 22 nt, Homo sapiens
acaaagggauguucacuguaug

SEQ ID NO: 766938 - RNA, 14 nt, Homo sapiens
acaaaggugaaaau

SEQ ID NO: 766939 - RNA, 16 nt, Homo sapiens
aauaccuucugaacua

SEQ ID NO: 766940 - RNA, 22 nt, Homo sapiens
aauaccuucugaacuacacugc

SEQ ID NO: 766941 - RNA, 22 nt, Homo sapiens
aauaccuuggcugauguugcag

SEQ ID NO: 766942 - RNA, 23 nt, Homo sapiens
aauacuacugugugugcauugaa

SEQ ID NO: 766943 - RNA, 19 nt, Homo sapiens
aauacuauuuaagauguga

SEQ ID NO: 766944 - RNA, 21 nt, Homo sapiens
aauacucugcuauuucucuug

SEQ ID NO: 766945 - RNA, 22 nt, Homo sapiens
aauacugauguuccuagugaaa

SEQ ID NO: 766946 - RNA, 19 nt, Homo sapiens
aauacugcauuuacagugu

SEQ ID NO: 766947 - RNA, 23 nt, Homo sapiens
aauacugccaaccagagcagcuc

SEQ ID NO: 766948 - RNA, 16 nt, Homo sapiens
aauacuggucucaggc

SEQ ID NO: 766949 - RNA, 17 nt, Homo sapiens
aauacuguaggaacaag

SEQ ID NO: 766950 - RNA, 18 nt, Homo sapiens
aauacuguuauucuuugc

SEQ ID NO: 766951 - RNA, 14 nt, Homo sapiens
aauacuucauucuc

SEQ ID NO: 766952 - RNA, 18 nt, Homo sapiens
aauacuucucaaaccugu

SEQ ID NO: 766953 - RNA, 17 nt, Homo sapiens
aauacuuuuuaaaaggu

SEQ ID NO: 766954 - RNA, 21 nt, Homo sapiens
aauacuuuuuucuaguuucag

SEQ ID NO: 766955 - RNA, 16 nt, Homo sapiens
aauagaaacauuugua

SEQ ID NO: 766956 - RNA, 20 nt, Homo sapiens
aauagaaauaaauuccuaaa

SEQ ID NO: 766957 - RNA, 20 nt, Homo sapiens
aauagaagaagcuacugcau

SEQ ID NO: 766958 - RNA, 22 nt, Homo sapiens
aauagaaggauguacauuucca

SEQ ID NO: 766959 - RNA, 14 nt, Homo sapiens
aauagacaaaaagu

SEQ ID NO: 766960 - RNA, 13 nt, Homo sapiens
aauagacuaucua

SEQ ID NO: 766961 - RNA, 22 nt, Homo sapiens
aauagauacaaaugucuaucaa

SEQ ID NO: 766962 - RNA, 12 nt, Homo sapiens
aauagauaugaa

SEQ ID NO: 766963 - RNA, 10 nt, Homo sapiens
aauagaucuc

SEQ ID NO: 766964 - RNA, 13 nt, Homo sapiens
aauagauggaauu

SEQ ID NO: 766965 - RNA, 19 nt, Homo sapiens
aauagcaacguagcuucua

SEQ ID NO: 766966 - RNA, 23 nt, Homo sapiens
aauagcauacaucaauggugugu

SEQ ID NO: 766967 - RNA, 22 nt, Homo sapiens
aauagcugccuucaaggacugu

SEQ ID NO: 766968 - RNA, 18 nt, Homo sapiens
aauagcuguaguuuuccc

SEQ ID NO: 766969 - RNA, 17 nt, Homo sapiens
aauaggugcuuauucuc

SEQ ID NO: 766970 - RNA, 20 nt, Homo sapiens
aauaguaccuucaauacuua

SEQ ID NO: 766971 - RNA, 21 nt, Homo sapiens
aauaguauuugagaguucuaa

SEQ ID NO: 766972 - RNA, 14 nt, Homo sapiens
aauaguauuugcau

SEQ ID NO: 766973 - RNA, 18 nt, Homo sapiens
aauagucauuccaaauau

SEQ ID NO: 766974 - RNA, 23 nt, Homo sapiens
aauaguguugcuuuaaauugugc

SEQ ID NO: 766975 - RNA, 21 nt, Homo sapiens
aauaguucaguagaauuacca

SEQ ID NO: 766976 - RNA, 21 nt, Homo sapiens
aauaguucuauccuuuugccu

SEQ ID NO: 766977 - RNA, 16 nt, Homo sapiens
aauauaaaacagucau

SEQ ID NO: 766978 - RNA, 17 nt, Homo sapiens
aauauaaaacagucaug

SEQ ID NO: 766979 - RNA, 22 nt, Homo sapiens
aauauaaaaggcaaauguguac

SEQ ID NO: 766980 - RNA, 13 nt, Homo sapiens
aauauacauguuu

SEQ ID NO: 766981 - RNA, 14 nt, Homo sapiens
aauauacuaugaaa

SEQ ID NO: 766982 - RNA, 16 nt, Homo sapiens
aauauagaaugaaaga

SEQ ID NO: 766983 - RNA, 13 nt, Homo sapiens
aauauagugcaau

SEQ ID NO: 766984 - RNA, 17 nt, Homo sapiens
aauauauaauguugcca

SEQ ID NO: 766985 - RNA, 15 nt, Homo sapiens
aauauauaguccaga

SEQ ID NO: 766986 - RNA, 20 nt, Homo sapiens
aauauauauggucauauaca

SEQ ID NO: 766987 - RNA, 13 nt, Homo sapiens
aauauauuuccau

SEQ ID NO: 766988 - RNA, 20 nt, Homo sapiens
aauaucaaauaaaauaucau

SEQ ID NO: 766989 - RNA, 20 nt, Homo sapiens
aauaucagaaguauaucugu

SEQ ID NO: 766990 - RNA, 18 nt, Homo sapiens
aauaucagacaagcacua

SEQ ID NO: 766991 - RNA, 17 nt, Homo sapiens
aauaucagucacuguuc

SEQ ID NO: 766992 - RNA, 17 nt, Homo sapiens
aauauccacaguacuca

SEQ ID NO: 766993 - RNA, 20 nt, Homo sapiens
aauauccagcgagagaaaga

SEQ ID NO: 766994 - RNA, 17 nt, Homo sapiens
aauaucgagaacugcca

SEQ ID NO: 766995 - RNA, 20 nt, Homo sapiens
aauaucuggcacuguuaaua

SEQ ID NO: 766996 - RNA, 19 nt, Homo sapiens
aauaucuugaaacauagag

SEQ ID NO: 766997 - RNA, 22 nt, Homo sapiens
aauaugaaaaucuccaucucaa

SEQ ID NO: 766998 - RNA, 16 nt, Homo sapiens
aauaugaguaauacau

SEQ ID NO: 766999 - RNA, 22 nt, Homo sapiens
aauaugcuauauauuaggcaag

SEQ ID NO: 767000 - RNA, 17 nt, Homo sapiens
aauaugcuuauaaccua

SEQ ID NO: 767001 - RNA, 14 nt, Homo sapiens
aauaugggcacuuu

SEQ ID NO: 767002 - RNA, 21 nt, Homo sapiens
aauaugggcacuuuaaaugaa

SEQ ID NO: 767003 - RNA, 19 nt, Homo sapiens
aauaugggcucaagucacu

SEQ ID NO: 767004 - RNA, 22 nt, Homo sapiens
aauauguaauuucaaaauacau

SEQ ID NO: 767005 - RNA, 14 nt, Homo sapiens
aauaugucaguuug

SEQ ID NO: 767006 - RNA, 12 nt, Homo sapiens
aauaugucuugg

SEQ ID NO: 767007 - RNA, 17 nt, Homo sapiens
aauaugucuuggaagac

SEQ ID NO: 767008 - RNA, 15 nt, Homo sapiens
aauaugugccuuaag

SEQ ID NO: 767009 - RNA, 17 nt, Homo sapiens
aauauguuugugccuua

SEQ ID NO: 767010 - RNA, 18 nt, Homo sapiens
aauauuaaaaaacuucau

SEQ ID NO: 767011 - RNA, 19 nt, Homo sapiens
aauauuacuuugucuuuuc

SEQ ID NO: 767012 - RNA, 13 nt, Homo sapiens
aauauuagccagu

SEQ ID NO: 767013 - RNA, 16 nt, Homo sapiens
aauauuauguguuucc

SEQ ID NO: 767014 - RNA, 19 nt, Homo sapiens
aauauucagccagcuuaaa

SEQ ID NO: 767015 - RNA, 19 nt, Homo sapiens
aauauugauguuaacaaga

SEQ ID NO: 767016 - RNA, 19 nt, Homo sapiens
aauauugcugaacuacuuu

SEQ ID NO: 767017 - RNA, 17 nt, Homo sapiens
aauauuguaaauacugg

SEQ ID NO: 767018 - RNA, 14 nt, Homo sapiens
aauauuguugacaa

SEQ ID NO: 767019 - RNA, 20 nt, Homo sapiens
aauauuuaauggaaguguau

SEQ ID NO: 767020 - RNA, 23 nt, Homo sapiens
aauauuuacuaacuaaauaccau

SEQ ID NO: 767021 - RNA, 20 nt, Homo sapiens
aauauuuauuaccucugaua

SEQ ID NO: 767022 - RNA, 20 nt, Homo sapiens
aauauuuauuauuuucaccu

SEQ ID NO: 767023 - RNA, 15 nt, Homo sapiens
aauauuucaagcucu

SEQ ID NO: 767024 - RNA, 18 nt, Homo sapiens
aauauuuuaagaauuuca

SEQ ID NO: 767025 - RNA, 21 nt, Homo sapiens
aauauuuuuuuaaccuaauau

SEQ ID NO: 767026 - RNA, 17 nt, Homo sapiens
aauauuuuuuucuagcu

SEQ ID NO: 767027 - RNA, 16 nt, Homo sapiens
aaucaaaaccagugaa

SEQ ID NO: 767028 - RNA, 14 nt, Homo sapiens
aaucaaaagcuauu

SEQ ID NO: 767029 - RNA, 20 nt, Homo sapiens
aaucaaauaugcaaagcacu

SEQ ID NO: 767030 - RNA, 22 nt, Homo sapiens
aaucaacucagugggacauagc

SEQ ID NO: 767031 - RNA, 17 nt, Homo sapiens
aaucaagccugauucaa

SEQ ID NO: 767032 - RNA, 22 nt, Homo sapiens
aaucaaggaaaggcucauuuaa

SEQ ID NO: 767033 - RNA, 20 nt, Homo sapiens
aaucaauccugggcaaucag

SEQ ID NO: 767034 - RNA, 19 nt, Homo sapiens
aaucaaugcaagagugauu

SEQ ID NO: 767035 - RNA, 15 nt, Homo sapiens
aaucaauucuaguca

SEQ ID NO: 767036 - RNA, 15 nt, Homo sapiens
aaucacauccacaaa

SEQ ID NO: 767037 - RNA, 16 nt, Homo sapiens
aaucacauccacaaaa

SEQ ID NO: 767038 - RNA, 12 nt, Homo sapiens
aaucacaucucc

SEQ ID NO: 767039 - RNA, 14 nt, Homo sapiens
aaucaccucucugu

SEQ ID NO: 767040 - RNA, 12 nt, Homo sapiens
aaucacugugcu

SEQ ID NO: 767041 - RNA, 12 nt, Homo sapiens
aaucacuuugag

SEQ ID NO: 767042 - RNA, 14 nt, Homo sapiens
aaucagagacaaaa

SEQ ID NO: 767043 - RNA, 12 nt, Homo sapiens
aaucagcacuga

SEQ ID NO: 767044 - RNA, 15 nt, Homo sapiens
aaucagccacauucu

SEQ ID NO: 767045 - RNA, 23 nt, Homo sapiens
aaucagccauaagaaagcacuau

SEQ ID NO: 767046 - RNA, 17 nt, Homo sapiens
aaucagcccagugcaaa

SEQ ID NO: 767047 - RNA, 18 nt, Homo sapiens
aaucagcccagugcaaac

SEQ ID NO: 767048 - RNA, 22 nt, Homo sapiens
aaucagcuuaaaauccaaagug

SEQ ID NO: 767049 - RNA, 18 nt, Homo sapiens
aaucagguccucagagaa

SEQ ID NO: 767050 - RNA, 12 nt, Homo sapiens
aaucagugaaga

SEQ ID NO: 767051 - RNA, 22 nt, Homo sapiens
aaucaguuucucaaacugagcu

SEQ ID NO: 767052 - RNA, 19 nt, Homo sapiens
aaucauauaauaaauguac

SEQ ID NO: 767053 - RNA, 23 nt, Homo sapiens
aaucaucuauaaagaagaacuug

SEQ ID NO: 767054 - RNA, 15 nt, Homo sapiens
aaucaugaaaagggg

SEQ ID NO: 767055 - RNA, 15 nt, Homo sapiens
aaucaugaaucuuug

SEQ ID NO: 767056 - RNA, 16 nt, Homo sapiens
aaucaugcccugccuu

SEQ ID NO: 767057 - RNA, 21 nt, Homo sapiens
aaucauuuguuuacauuugau

SEQ ID NO: 767058 - RNA, 18 nt, Homo sapiens
aaucauuuucauuccuaa

SEQ ID NO: 767059 - RNA, 16 nt, Homo sapiens
aauccaaaucuguccu

SEQ ID NO: 767060 - RNA, 14 nt, Homo sapiens
aauccaacauccag

SEQ ID NO: 767061 - RNA, 13 nt, Homo sapiens
aauccaauacugc

SEQ ID NO: 767062 - RNA, 19 nt, Homo sapiens
aauccaauggguuuuuccc

SEQ ID NO: 767063 - RNA, 18 nt, Homo sapiens
aauccacaucuuuacuca

SEQ ID NO: 767064 - RNA, 21 nt, Homo sapiens
aauccagcaggucacacuggg

SEQ ID NO: 767065 - RNA, 19 nt, Homo sapiens
aauccagcuacgaauauag

SEQ ID NO: 767066 - RNA, 21 nt, Homo sapiens
aauccaggcgugguggcacac

SEQ ID NO: 767067 - RNA, 20 nt, Homo sapiens
aauccagugaccucucucuc

SEQ ID NO: 767068 - RNA, 22 nt, Homo sapiens
aauccauguaaauugcaaauaa

SEQ ID NO: 767069 - RNA, 14 nt, Homo sapiens
aauccauuccucuu

SEQ ID NO: 767070 - RNA, 20 nt, Homo sapiens
aauccauugaacuggaagaa

SEQ ID NO: 767071 - RNA, 20 nt, Homo sapiens
aaucccacauuagcuuguua

SEQ ID NO: 767072 - RNA, 23 nt, Homo sapiens
aaucccagauaugguugcacaaa

SEQ ID NO: 767073 - RNA, 14 nt, Homo sapiens
aaucccagcacuuu

SEQ ID NO: 767074 - RNA, 15 nt, Homo sapiens
aaucccagcuacuug

SEQ ID NO: 767075 - RNA, 18 nt, Homo sapiens
aauccccaacaugcacug

SEQ ID NO: 767076 - RNA, 20 nt, Homo sapiens
aauccccaauaauugcagaa

SEQ ID NO: 767077 - RNA, 13 nt, Homo sapiens
aauccccuguugu

SEQ ID NO: 767078 - RNA, 22 nt, Homo sapiens
aaucccggucaugcuuuugcca

SEQ ID NO: 767079 - RNA, 14 nt, Homo sapiens
aaucccgugaaaga

SEQ ID NO: 767080 - RNA, 14 nt, Homo sapiens
aauccuagcacuuu

SEQ ID NO: 767081 - RNA, 15 nt, Homo sapiens
aauccucccacuuca

SEQ ID NO: 767082 - RNA, 22 nt, Homo sapiens
aauccugagcucaaaucucugu

SEQ ID NO: 767083 - RNA, 13 nt, Homo sapiens
aauccugccauuu

SEQ ID NO: 767084 - RNA, 16 nt, Homo sapiens
aauaaaaagaucacuu

SEQ ID NO: 767085 - RNA, 20 nt, Homo sapiens
aauaaaaagugacacagcag

SEQ ID NO: 767086 - RNA, 18 nt, Homo sapiens
aauaaaacuuaugcuagu

SEQ ID NO: 767087 - RNA, 16 nt, Homo sapiens
aauaaaaugagcaaaa

SEQ ID NO: 767088 - RNA, 20 nt, Homo sapiens
aauaaaaugauuuguggaaa

SEQ ID NO: 767089 - RNA, 14 nt, Homo sapiens
aauaaacauguuuc

SEQ ID NO: 767090 - RNA, 12 nt, Homo sapiens
aauaaacauuaa

SEQ ID NO: 767091 - RNA, 13 nt, Homo sapiens
aauaaacauugag

SEQ ID NO: 767092 - RNA, 12 nt, Homo sapiens
aauaaaccacuu

SEQ ID NO: 767093 - RNA, 12 nt, Homo sapiens
aauaaaccuccu

SEQ ID NO: 767094 - RNA, 22 nt, Homo sapiens
aauaaacuaguuuccaguggau

SEQ ID NO: 767095 - RNA, 17 nt, Homo sapiens
aauaaacucaaugagcu

SEQ ID NO: 767096 - RNA, 16 nt, Homo sapiens
aauaaagacugcacag

SEQ ID NO: 767097 - RNA, 14 nt, Homo sapiens
aauaaagcauaaaa

SEQ ID NO: 767098 - RNA, 19 nt, Homo sapiens
aauaaagcauucuuuaaca

SEQ ID NO: 767099 - RNA, 13 nt, Homo sapiens
aauaaaggaagca

SEQ ID NO: 767100 - RNA, 13 nt, Homo sapiens
aauaaaggcagcu

SEQ ID NO: 767101 - RNA, 23 nt, Homo sapiens
aauaaaguaccacacauauugca

SEQ ID NO: 767102 - RNA, 16 nt, Homo sapiens
aauaaaguguaacaau

SEQ ID NO: 767103 - RNA, 22 nt, Homo sapiens
aauaaaguugcugugaauacuu

SEQ ID NO: 767104 - RNA, 17 nt, Homo sapiens
aauaaaguuuccauuag

SEQ ID NO: 767105 - RNA, 15 nt, Homo sapiens
aauaaauaaucugua

SEQ ID NO: 767106 - RNA, 15 nt, Homo sapiens
aauaaauauuacagu

SEQ ID NO: 767107 - RNA, 17 nt, Homo sapiens
aauaaaucugacccagu

SEQ ID NO: 767108 - RNA, 19 nt, Homo sapiens
aauaaaucugacccagugc

SEQ ID NO: 767109 - RNA, 22 nt, Homo sapiens
aauaaaugacaagugagacaaa

SEQ ID NO: 767110 - RNA, 23 nt, Homo sapiens
aauaaaugagagggaaucgacug

SEQ ID NO: 767111 - RNA, 16 nt, Homo sapiens
aauaaaugucauuuca

SEQ ID NO: 767112 - RNA, 20 nt, Homo sapiens
aauaaauuauuauuugacaa

SEQ ID NO: 767113 - RNA, 13 nt, Homo sapiens
aauaaauuccuaa

SEQ ID NO: 767114 - RNA, 15 nt, Homo sapiens
aauaaauuccuacaa

SEQ ID NO: 767115 - RNA, 13 nt, Homo sapiens
aauaaccaaaaaa

SEQ ID NO: 767116 - RNA, 20 nt, Homo sapiens
aauaacgucuuuuuauaucu

SEQ ID NO: 767117 - RNA, 23 nt, Homo sapiens
aauaacuaaaagguaugcaauca

SEQ ID NO: 767118 - RNA, 14 nt, Homo sapiens
aauaacuaccuccu

SEQ ID NO: 767119 - RNA, 17 nt, Homo sapiens
aauaacuauuuuuccuc

SEQ ID NO: 767120 - RNA, 13 nt, Homo sapiens
aauaacugugaag

SEQ ID NO: 767121 - RNA, 20 nt, Homo sapiens
aauaacuuuucaccaaugag

SEQ ID NO: 767122 - RNA, 16 nt, Homo sapiens
aauaagaaugaaucuc

SEQ ID NO: 767123 - RNA, 14 nt, Homo sapiens
aauaagacaagaga

SEQ ID NO: 767124 - RNA, 14 nt, Homo sapiens
aauaagagugauua

SEQ ID NO: 767125 - RNA, 13 nt, Homo sapiens
aauaagcaaucaa

SEQ ID NO: 767126 - RNA, 18 nt, Homo sapiens
aauaagcaaucaagguua

SEQ ID NO: 767127 - RNA, 15 nt, Homo sapiens
aauaagcuucaucuc

SEQ ID NO: 767128 - RNA, 15 nt, Homo sapiens
aauaaguacugugua

SEQ ID NO: 767129 - RNA, 21 nt, Homo sapiens
aauaaguauauaauccuguga

SEQ ID NO: 767130 - RNA, 18 nt, Homo sapiens
aauaaguauuuauugcau

SEQ ID NO: 767131 - RNA, 22 nt, Homo sapiens
aauaagugaagaauacaucaga

SEQ ID NO: 767132 - RNA, 17 nt, Homo sapiens
aauaagugcuuuccuua

SEQ ID NO: 767133 - RNA, 20 nt, Homo sapiens
aauaaguuugcuccuucaua

SEQ ID NO: 767134 - RNA, 19 nt, Homo sapiens
aauaauaaaucguccuccc

SEQ ID NO: 767135 - RNA, 20 nt, Homo sapiens
aauaauaaaucguccuccca

SEQ ID NO: 767136 - RNA, 15 nt, Homo sapiens
aauaauaagugaugu

SEQ ID NO: 767137 - RNA, 22 nt, Homo sapiens
aauaauaggccaggcacugugg

SEQ ID NO: 767138 - RNA, 18 nt, Homo sapiens
aauaauauguacuaagaa

SEQ ID NO: 767139 - RNA, 20 nt, Homo sapiens
aauaaucacgcuuuccugaa

SEQ ID NO: 767140 - RNA, 12 nt, Homo sapiens
aauaaucacuug

SEQ ID NO: 767141 - RNA, 16 nt, Homo sapiens
aauaaugaacacuaca

SEQ ID NO: 767142 - RNA, 20 nt, Homo sapiens
aauaaugcacugaguaugca

SEQ ID NO: 767143 - RNA, 19 nt, Homo sapiens
aauaauggaaaaugccaug

SEQ ID NO: 767144 - RNA, 16 nt, Homo sapiens
aauaauggcccuuaau

SEQ ID NO: 767145 - RNA, 15 nt, Homo sapiens
aauaauuaauuucau

SEQ ID NO: 767146 - RNA, 15 nt, Homo sapiens
aauacaaaaagcaaa

SEQ ID NO: 767147 - RNA, 18 nt, Homo sapiens
aauacaaaaagcaaaaau

SEQ ID NO: 767148 - RNA, 12 nt, Homo sapiens
aauacaaaaauu

SEQ ID NO: 767149 - RNA, 16 nt, Homo sapiens
aauacaaaaguggcuc

SEQ ID NO: 767150 - RNA, 13 nt, Homo sapiens
aauacaaccagcc

SEQ ID NO: 767151 - RNA, 22 nt, Homo sapiens
aauacaaucagcccagugcaaa

SEQ ID NO: 767152 - RNA, 23 nt, Homo sapiens
aauacaaucagcccagugcaaac

SEQ ID NO: 767153 - RNA, 16 nt, Homo sapiens
aauacacaacacacac

SEQ ID NO: 767154 - RNA, 19 nt, Homo sapiens
aauacacggacacaaccaa

SEQ ID NO: 767155 - RNA, 15 nt, Homo sapiens
aauacaggggugaaa

SEQ ID NO: 767156 - RNA, 19 nt, Homo sapiens
aauacaggggugaaagggg

SEQ ID NO: 767157 - RNA, 15 nt, Homo sapiens
aauacaguacuguuu

SEQ ID NO: 767158 - RNA, 14 nt, Homo sapiens
aauacauaacauuc

SEQ ID NO: 767159 - RNA, 22 nt, Homo sapiens
aauacauguauuuaaaaaaaca

SEQ ID NO: 767160 - RNA, 17 nt, Homo sapiens
aauacauuucaauuaua

SEQ ID NO: 767161 - RNA, 15 nt, Homo sapiens
aauaccaauguucua

SEQ ID NO: 767162 - RNA, 17 nt, Homo sapiens
aauaccgcucaguauuu

SEQ ID NO: 767163 - RNA, 18 nt, Homo sapiens
aauaccguguggcccaag

SEQ ID NO: 767164 - RNA, 20 nt, Homo sapiens
aauaccucaaccuaugguau

SEQ ID NO: 767165 - RNA, 10 nt, Homo sapiens
aauaccucac

SEQ ID NO: 767166 - RNA, 21 nt, Homo sapiens
aauaccucuuacuuugcuuga

SEQ ID NO: 767167 - RNA, 18 nt, Homo sapiens
gagggcauauacagugaa

SEQ ID NO: 767168 - RNA, 16 nt, Homo sapiens
gagggccauugaacuc

SEQ ID NO: 767169 - RNA, 17 nt, Homo sapiens
gagggccccucugccca

SEQ ID NO: 767170 - RNA, 19 nt, Homo sapiens
gagggccgugagggguccc

SEQ ID NO: 767171 - RNA, 23 nt, Homo sapiens
gagggcuuccucuagaagccaag

SEQ ID NO: 767172 - RNA, 21 nt, Homo sapiens
gaggggacuauuuaugaaggc

SEQ ID NO: 767173 - RNA, 19 nt, Homo sapiens
gaggggacucaaacagucu

SEQ ID NO: 767174 - RNA, 21 nt, Homo sapiens
gaggggcagcgcaugugugca

SEQ ID NO: 767175 - RNA, 18 nt, Homo sapiens
gagggggcuugaagccaa

SEQ ID NO: 767176 - RNA, 19 nt, Homo sapiens
gagggggcuugaagccaaa

SEQ ID NO: 767177 - RNA, 21 nt, Homo sapiens
gagggugggaggcaaacacgc

SEQ ID NO: 767178 - RNA, 17 nt, Homo sapiens
gauacacaccuuucaca

SEQ ID NO: 767179 - RNA, 12 nt, Homo sapiens
gauacacuguau

SEQ ID NO: 767180 - RNA, 16 nt, Homo sapiens
gauacagaaaugcaaa

SEQ ID NO: 767181 - RNA, 18 nt, Homo sapiens
gauacagacauucaauga

SEQ ID NO: 767182 - RNA, 21 nt, Homo sapiens
gauacauaaaagugcuuugca

SEQ ID NO: 767183 - RNA, 15 nt, Homo sapiens
gauacaugagccagu

SEQ ID NO: 767184 - RNA, 22 nt, Homo sapiens
gauacaugagccagugauuauu

SEQ ID NO: 767185 - RNA, 20 nt, Homo sapiens
gauacauggcaacgugugaa

SEQ ID NO: 767186 - RNA, 16 nt, Homo sapiens
gauacauguaauucua

SEQ ID NO: 767187 - RNA, 12 nt, Homo sapiens
gauacauuucau

SEQ ID NO: 767188 - RNA, 20 nt, Homo sapiens
gauacccaggaccaagccac

SEQ ID NO: 767189 - RNA, 21 nt, Homo sapiens
gauacccauagcuuccaugag

SEQ ID NO: 767190 - RNA, 21 nt, Homo sapiens
gauaccucaacccccauuucu

SEQ ID NO: 767191 - RNA, 18 nt, Homo sapiens
gauaccuggugagcucag

SEQ ID NO: 767192 - RNA, 16 nt, Homo sapiens
gauacgggggcuguga

SEQ ID NO: 767193 - RNA, 17 nt, Homo sapiens
gauacugcgacuuucug

SEQ ID NO: 767194 - RNA, 21 nt, Homo sapiens
gauagaacacaaaacuugaaa

SEQ ID NO: 767195 - RNA, 18 nt, Homo sapiens
gauagaacuguacuguuu

SEQ ID NO: 767196 - RNA, 13 nt, Homo sapiens
gauagacuuggga

SEQ ID NO: 767197 - RNA, 20 nt, Homo sapiens
gauagagagugaguacaugc

SEQ ID NO: 767198 - RNA, 16 nt, Homo sapiens
gauagaggaaagggau

SEQ ID NO: 767199 - RNA, 21 nt, Homo sapiens
gauagaguucuuuuaagccca

SEQ ID NO: 767200 - RNA, 20 nt, Homo sapiens
gauagauauaugcucugcau

SEQ ID NO: 767201 - RNA, 14 nt, Homo sapiens
gauagcauugcuuu

SEQ ID NO: 767202 - RNA, 14 nt, Homo sapiens
gauagcuacagugu

SEQ ID NO: 767203 - RNA, 16 nt, Homo sapiens
gauagguggugccagu

SEQ ID NO: 767204 - RNA, 14 nt, Homo sapiens
gauaguccaaagac

SEQ ID NO: 767205 - RNA, 18 nt, Homo sapiens
gauaguccauaauguucu

SEQ ID NO: 767206 - RNA, 16 nt, Homo sapiens
gauaguucuauaagaa

SEQ ID NO: 767207 - RNA, 12 nt, Homo sapiens
gauaguuuaccu

SEQ ID NO: 767208 - RNA, 16 nt, Homo sapiens
gauaguuuacugagaa

SEQ ID NO: 767209 - RNA, 22 nt, Homo sapiens
gauauaacauucaguucccacc

SEQ ID NO: 767210 - RNA, 19 nt, Homo sapiens
gauauacauuuauuuacac

SEQ ID NO: 767211 - RNA, 14 nt, Homo sapiens
gauauacuuacuca

SEQ ID NO: 767212 - RNA, 16 nt, Homo sapiens
gauauagaaacucuca

SEQ ID NO: 767213 - RNA, 13 nt, Homo sapiens
gauauaugcucug

SEQ ID NO: 767214 - RNA, 16 nt, Homo sapiens
gauaucaaaagcaaau

SEQ ID NO: 767215 - RNA, 16 nt, Homo sapiens
gauaucaccucucuuc

SEQ ID NO: 767216 - RNA, 14 nt, Homo sapiens
gauaucaugcaaau

SEQ ID NO: 767217 - RNA, 21 nt, Homo sapiens
gauaucaugccccuguacucc

SEQ ID NO: 767218 - RNA, 16 nt, Homo sapiens
gauauccacuuaccug

SEQ ID NO: 767219 - RNA, 21 nt, Homo sapiens
gauauccaggcuuaccaaagu

SEQ ID NO: 767220 - RNA, 14 nt, Homo sapiens
gauauccaugccac

SEQ ID NO: 767221 - RNA, 21 nt, Homo sapiens
gauaugcaacugcaguucauc

SEQ ID NO: 767222 - RNA, 19 nt, Homo sapiens
gauauggacacuggugcca

SEQ ID NO: 767223 - RNA, 14 nt, Homo sapiens
gauaugggacugag

SEQ ID NO: 767224 - RNA, 17 nt, Homo sapiens
gauauggugaagggaag

SEQ ID NO: 767225 - RNA, 20 nt, Homo sapiens
gauauguugaauuaacauaa

SEQ ID NO: 767226 - RNA, 21 nt, Homo sapiens
gauauuauucaguaguggaaa

SEQ ID NO: 767227 - RNA, 21 nt, Homo sapiens
gauauucauuggcagcucaaa

SEQ ID NO: 767228 - RNA, 15 nt, Homo sapiens
gauauuccaagggcu

SEQ ID NO: 767229 - RNA, 16 nt, Homo sapiens
gauauugaauguuaaa

SEQ ID NO: 767230 - RNA, 16 nt, Homo sapiens
gauauugucagucuuu

SEQ ID NO: 767231 - RNA, 24 nt, Homo sapiens
gaucaaaaaugaaucacuucugaa

SEQ ID NO: 767232 - RNA, 15 nt, Homo sapiens
gaucaaagaaauuca

SEQ ID NO: 767233 - RNA, 15 nt, Homo sapiens
gaucaaauauuucaa

SEQ ID NO: 767234 - RNA, 22 nt, Homo sapiens
gaucaaauugugcaguacuuug

SEQ ID NO: 767235 - RNA, 18 nt, Homo sapiens
gaucaagaaaaaaaggga

SEQ ID NO: 767236 - RNA, 21 nt, Homo sapiens
gaucaaguuguugacugugau

SEQ ID NO: 767237 - RNA, 20 nt, Homo sapiens
gaucaaugcauguuacccau

SEQ ID NO: 767238 - RNA, 13 nt, Homo sapiens
gaucacacagugu

SEQ ID NO: 767239 - RNA, 15 nt, Homo sapiens
gaucacacaguguua

SEQ ID NO: 767240 - RNA, 16 nt, Homo sapiens
gaucaccaagcaggaa

SEQ ID NO: 767241 - RNA, 19 nt, Homo sapiens
gaucacucaccauucccag

SEQ ID NO: 767242 - RNA, 12 nt, Homo sapiens
gaucacugccaa

SEQ ID NO: 767243 - RNA, 13 nt, Homo sapiens
gaucacugccaaa

SEQ ID NO: 767244 - RNA, 14 nt, Homo sapiens
gaucagaaagugac

SEQ ID NO: 767245 - RNA, 15 nt, Homo sapiens
gaucagcgacccuga

SEQ ID NO: 767246 - RNA, 21 nt, Homo sapiens
gaucagcuuucaaagcauuua

SEQ ID NO: 767247 - RNA, 22 nt, Homo sapiens
gaucagugauuuucaaaccuca

SEQ ID NO: 767248 - RNA, 20 nt, Homo sapiens
gaucaucuuuccuguuccag

SEQ ID NO: 767249 - RNA, 23 nt, Homo sapiens
gaucaucuuugccaccaccuggg

SEQ ID NO: 767250 - RNA, 15 nt, Homo sapiens
gaucauucucaguga

SEQ ID NO: 767251 - RNA, 22 nt, Homo sapiens
gaucauugcuggcaugaagcug

SEQ ID NO: 767252 - RNA, 21 nt, Homo sapiens
gaucauuuguuggaaugaauu

SEQ ID NO: 767253 - RNA, 22 nt, Homo sapiens
gauccaaaagaagcccccagcu

SEQ ID NO: 767254 - RNA, 23 nt, Homo sapiens
gauccaagaaggccuucauggcc

SEQ ID NO: 767255 - RNA, 21 nt, Homo sapiens
gauccaauggaauacugaaaa

SEQ ID NO: 767256 - RNA, 15 nt, Homo sapiens
gauccagccaugccu

SEQ ID NO: 767257 - RNA, 22 nt, Homo sapiens
gauccaguuuccggaaacaaaa

SEQ ID NO: 767258 - RNA, 14 nt, Homo sapiens
gauccauuaucuau

SEQ ID NO: 767259 - RNA, 18 nt, Homo sapiens
gauccauuaucuauuuaa

SEQ ID NO: 767260 - RNA, 16 nt, Homo sapiens
gauccccccacugagc

SEQ ID NO: 767261 - RNA, 21 nt, Homo sapiens
gauccccuggaaacccaccuc

SEQ ID NO: 767262 - RNA, 15 nt, Homo sapiens
gaucccguguugcca

SEQ ID NO: 767263 - RNA, 18 nt, Homo sapiens
gauccuaguaauugccua

SEQ ID NO: 767264 - RNA, 15 nt, Homo sapiens
gauccucccaccuca

SEQ ID NO: 767265 - RNA, 16 nt, Homo sapiens
gauccucccucauggc

SEQ ID NO: 767266 - RNA, 21 nt, Homo sapiens
gauccucugggaagcggcccg

SEQ ID NO: 767267 - RNA, 17 nt, Homo sapiens
gauccuguugggaaaga

SEQ ID NO: 767268 - RNA, 17 nt, Homo sapiens
gauccuucagcacagga

SEQ ID NO: 767269 - RNA, 16 nt, Homo sapiens
gauccuuccaccucag

SEQ ID NO: 767270 - RNA, 22 nt, Homo sapiens
gauccuuccaccucagucuccc

SEQ ID NO: 767271 - RNA, 20 nt, Homo sapiens
gauccuucgggugcuggaag

SEQ ID NO: 767272 - RNA, 18 nt, Homo sapiens
gaucgagccacugcacuc

SEQ ID NO: 767273 - RNA, 14 nt, Homo sapiens
gaucgcaccacugc

SEQ ID NO: 767274 - RNA, 20 nt, Homo sapiens
gaucgcaccacugcacucca

SEQ ID NO: 767275 - RNA, 18 nt, Homo sapiens
gaucgccaaccuuucccc

SEQ ID NO: 767276 - RNA, 20 nt, Homo sapiens
gaucgugcuacugcacucca

SEQ ID NO: 767277 - RNA, 22 nt, Homo sapiens
gaucguuuuuucccagggcaag

SEQ ID NO: 767278 - RNA, 19 nt, Homo sapiens
gaucuaagccuuuccauaa

SEQ ID NO: 767279 - RNA, 21 nt, Homo sapiens
uuugaaggaaaauuaaaccaa

SEQ ID NO: 767280 - RNA, 24 nt, Homo sapiens
uuugaaggaaaauuaaaccaauga

SEQ ID NO: 767281 - RNA, 18 nt, Homo sapiens
ggaauggcaggugucaua

SEQ ID NO: 767282 - RNA, 21 nt, Homo sapiens
ggaauggcugcaccuuuuugc

SEQ ID NO: 767283 - RNA, 11 nt, Homo sapiens
ggaaugucaua

SEQ ID NO: 767284 - RNA, 17 nt, Homo sapiens
ggaaugugcaacauucu

SEQ ID NO: 767285 - RNA, 21 nt, Homo sapiens
ggaauuacaaaacucagagaa

SEQ ID NO: 767286 - RNA, 16 nt, Homo sapiens
ggaauuaguugggaug

SEQ ID NO: 767287 - RNA, 11 nt, Homo sapiens
ggaauugccag

SEQ ID NO: 767288 - RNA, 12 nt, Homo sapiens
ggaauugucaaa

SEQ ID NO: 767289 - RNA, 14 nt, Homo sapiens
ggaauuuggaguga

SEQ ID NO: 767290 - RNA, 21 nt, Homo sapiens
ggaauuuggcucaacuucagu

SEQ ID NO: 767291 - RNA, 16 nt, Homo sapiens
ggacaaccucauuuua

SEQ ID NO: 767292 - RNA, 21 nt, Homo sapiens
ggacaagacccccagcacuug

SEQ ID NO: 767293 - RNA, 12 nt, Homo sapiens
ggacaagggauu

SEQ ID NO: 767294 - RNA, 20 nt, Homo sapiens
ggacaagugcuguugggaua

SEQ ID NO: 767295 - RNA, 20 nt, Homo sapiens
ggacacagaauuauagaugu

SEQ ID NO: 767296 - RNA, 17 nt, Homo sapiens
ggacaccauuaccaaaa

SEQ ID NO: 767297 - RNA, 22 nt, Homo sapiens
ggacaccuggccgccuccagga

SEQ ID NO: 767298 - RNA, 14 nt, Homo sapiens
ggacagaauucucc

SEQ ID NO: 767299 - RNA, 18 nt, Homo sapiens
ggacaggauaagagggau

SEQ ID NO: 767300 - RNA, 23 nt, Homo sapiens
ggacagugcccaugcaauggcuu

SEQ ID NO: 767301 - RNA, 18 nt, Homo sapiens
ggacauagccagcauuuu

SEQ ID NO: 767302 - RNA, 19 nt, Homo sapiens
ggacauagcccuaacuccu

SEQ ID NO: 767303 - RNA, 14 nt, Homo sapiens
ggacauaugcagug

SEQ ID NO: 767304 - RNA, 15 nt, Homo sapiens
ggacaucacagggug

SEQ ID NO: 767305 - RNA, 13 nt, Homo sapiens
ggacaucauucug

SEQ ID NO: 767306 - RNA, 15 nt, Homo sapiens
ggacaugcaugacac

SEQ ID NO: 767307 - RNA, 19 nt, Homo sapiens
ggacauuuaaaauucaauu

SEQ ID NO: 767308 - RNA, 17 nt, Homo sapiens
ggacauuugaacauguu

SEQ ID NO: 767309 - RNA, 23 nt, Homo sapiens
ggaccaaaggaaggaagcaagca

SEQ ID NO: 767310 - RNA, 16 nt, Homo sapiens
ggaccaagcagagcuc

SEQ ID NO: 767311 - RNA, 13 nt, Homo sapiens
ggaccaauaccuc

SEQ ID NO: 767312 - RNA, 23 nt, Homo sapiens
ggaccacacugauccuggagaaa

SEQ ID NO: 767313 - RNA, 14 nt, Homo sapiens
ggaccaccaaugga

SEQ ID NO: 767314 - RNA, 22 nt, Homo sapiens
ggaccagagccagaugcaggac

SEQ ID NO: 767315 - RNA, 22 nt, Homo sapiens
ggaccagccuguaccuugcugu

SEQ ID NO: 767316 - RNA, 14 nt, Homo sapiens
ggaccaggaugaca

SEQ ID NO: 767317 - RNA, 17 nt, Homo sapiens
ggaccaggccauucugc

SEQ ID NO: 767318 - RNA, 13 nt, Homo sapiens
ggacccagugcag

SEQ ID NO: 767319 - RNA, 14 nt, Homo sapiens
ggacccagugcaga

SEQ ID NO: 767320 - RNA, 22 nt, Homo sapiens
ggaccccagcauuuaagugacc

SEQ ID NO: 767321 - RNA, 13 nt, Homo sapiens
ggaccguccaggg

SEQ ID NO: 767322 - RNA, 21 nt, Homo sapiens
ggaccucuucuggagauggaa

SEQ ID NO: 767323 - RNA, 21 nt, Homo sapiens
ggaccugagagcaucucagga

SEQ ID NO: 767324 - RNA, 20 nt, Homo sapiens
ggaccuggggacucgggugc

SEQ ID NO: 767325 - RNA, 21 nt, Homo sapiens
ggaccuuuucccuugcuguac

SEQ ID NO: 767326 - RNA, 23 nt, Homo sapiens
ggacggcuguggaccguggacag

SEQ ID NO: 767327 - RNA, 18 nt, Homo sapiens
ggacuaacccaaugccug

SEQ ID NO: 767328 - RNA, 13 nt, Homo sapiens
ggacuacaaccaa

SEQ ID NO: 767329 - RNA, 19 nt, Homo sapiens
ggacuauuuaugaaggcaa

SEQ ID NO: 767330 - RNA, 14 nt, Homo sapiens
ggacucaaacugcc

SEQ ID NO: 767331 - RNA, 20 nt, Homo sapiens
ggacucaaaguuucagagac

SEQ ID NO: 767332 - RNA, 16 nt, Homo sapiens
ggacucucagggauuc

SEQ ID NO: 767333 - RNA, 19 nt, Homo sapiens
ggacugaccaaagacugca

SEQ ID NO: 767334 - RNA, 14 nt, Homo sapiens
ggacugauaaucuc

SEQ ID NO: 767335 - RNA, 21 nt, Homo sapiens
ggacuggacgugcucagacau

SEQ ID NO: 767336 - RNA, 14 nt, Homo sapiens
ggacuguaagggau

SEQ ID NO: 767337 - RNA, 14 nt, Homo sapiens
ggacuucagcucag

SEQ ID NO: 767338 - RNA, 16 nt, Homo sapiens
ggacuugauguuccuu

SEQ ID NO: 767339 - RNA, 11 nt, Homo sapiens
ggacuugccuc

SEQ ID NO: 767340 - RNA, 20 nt, Homo sapiens
ggacuuguuuagagagccug

SEQ ID NO: 767341 - RNA, 16 nt, Homo sapiens
ggacuuuccugcaacu

SEQ ID NO: 767342 - RNA, 19 nt, Homo sapiens
ggacuuuugauaguucuau

SEQ ID NO: 767343 - RNA, 22 nt, Homo sapiens
ggagaaaauaacaagaguuuua

SEQ ID NO: 767344 - RNA, 17 nt, Homo sapiens
ggagaaacgggugagcu

SEQ ID NO: 767345 - RNA, 13 nt, Homo sapiens
ggagaacuagaga

SEQ ID NO: 767346 - RNA, 17 nt, Homo sapiens
ggagaaguagcuaguag

SEQ ID NO: 767347 - RNA, 20 nt, Homo sapiens
ggagaaucauguuucuuuga

SEQ ID NO: 767348 - RNA, 17 nt, Homo sapiens
ggagaaugaagacuguu

SEQ ID NO: 767349 - RNA, 16 nt, Homo sapiens
ggagaauugcuugaac

SEQ ID NO: 767350 - RNA, 15 nt, Homo sapiens
ggagacagagccaag

SEQ ID NO: 767351 - RNA, 11 nt, Homo sapiens
ggagacagggu

SEQ ID NO: 767352 - RNA, 16 nt, Homo sapiens
ggagaccugcucuccg

SEQ ID NO: 767353 - RNA, 18 nt, Homo sapiens
ggagacugaagacucagc

SEQ ID NO: 767354 - RNA, 18 nt, Homo sapiens
guauugacaggaauacuu

SEQ ID NO: 767355 - RNA, 21 nt, Homo sapiens
guauugcaccuuugaaaugca

SEQ ID NO: 767356 - RNA, 16 nt, Homo sapiens
guauugugaccacuga

SEQ ID NO: 767357 - RNA, 15 nt, Homo sapiens
guauuguugaaaaag

SEQ ID NO: 767358 - RNA, 14 nt, Homo sapiens
guauuuaacucaua

SEQ ID NO: 767359 - RNA, 16 nt, Homo sapiens
guauuuaauucuucac

SEQ ID NO: 767360 - RNA, 18 nt, Homo sapiens
guauuuauuuauguacuu

SEQ ID NO: 767361 - RNA, 17 nt, Homo sapiens
guauuucaagucucuca

SEQ ID NO: 767362 - RNA, 19 nt, Homo sapiens
guauuuccagugcaauugu

SEQ ID NO: 767363 - RNA, 21 nt, Homo sapiens
guauuuguuccugccacugug

SEQ ID NO: 767364 - RNA, 16 nt, Homo sapiens
guauuuuacuuuucca

SEQ ID NO: 767365 - RNA, 15 nt, Homo sapiens
guauuuuaugaucuu

SEQ ID NO: 767366 - RNA, 21 nt, Homo sapiens
guauuuucaugaaaauaccau

SEQ ID NO: 767367 - RNA, 12 nt, Homo sapiens
guauuuuugccg

SEQ ID NO: 767368 - RNA, 12 nt, Homo sapiens
gucaaaccaaga

SEQ ID NO: 767369 - RNA, 14 nt, Homo sapiens
gucaaaccaagaag

SEQ ID NO: 767370 - RNA, 16 nt, Homo sapiens
gucaaacugaaauuca

SEQ ID NO: 767371 - RNA, 13 nt, Homo sapiens
gucaaagacugua

SEQ ID NO: 767372 - RNA, 22 nt, Homo sapiens
gucaaaguaaaacuugcugccu

SEQ ID NO: 767373 - RNA, 13 nt, Homo sapiens
gucaaaugccaaa

SEQ ID NO: 767374 - RNA, 14 nt, Homo sapiens
gucaaaugccaaac

SEQ ID NO: 767375 - RNA, 15 nt, Homo sapiens
gucaacaucaaagag

SEQ ID NO: 767376 - RNA, 21 nt, Homo sapiens
gucaaccuuguuucuacuguu

SEQ ID NO: 767377 - RNA, 14 nt, Homo sapiens
gucaacuaugauau

SEQ ID NO: 767378 - RNA, 17 nt, Homo sapiens
gucaacuuauucuuuga

SEQ ID NO: 767379 - RNA, 15 nt, Homo sapiens
gucaagaacaauuca

SEQ ID NO: 767380 - RNA, 15 nt, Homo sapiens
gucaaggcuucagug

SEQ ID NO: 767381 - RNA, 18 nt, Homo sapiens
gucaagucaccaugcuga

SEQ ID NO: 767382 - RNA, 22 nt, Homo sapiens
gucaaguucccaacugagucau

SEQ ID NO: 767383 - RNA, 22 nt, Homo sapiens
gucaaguuggguucacuugcca

SEQ ID NO: 767384 - RNA, 14 nt, Homo sapiens
gucaauccugucau

SEQ ID NO: 767385 - RNA, 15 nt, Homo sapiens
gucaaugaccauuca

SEQ ID NO: 767386 - RNA, 16 nt, Homo sapiens
gucaaugccugucuua

SEQ ID NO: 767387 - RNA, 15 nt, Homo sapiens
gucaauguguucuua

SEQ ID NO: 767388 - RNA, 21 nt, Homo sapiens
gucaauuuguauaucaugaaa

SEQ ID NO: 767389 - RNA, 19 nt, Homo sapiens
gucacagaagcagcuaaac

SEQ ID NO: 767390 - RNA, 16 nt, Homo sapiens
gucacagaucugggag

SEQ ID NO: 767391 - RNA, 13 nt, Homo sapiens
gucacagaugaag

SEQ ID NO: 767392 - RNA, 18 nt, Homo sapiens
gucacauggccuaugcac

SEQ ID NO: 767393 - RNA, 23 nt, Homo sapiens
gucacauggccuaugcacauaug

SEQ ID NO: 767394 - RNA, 22 nt, Homo sapiens
gucaccaaaucagcugcuacua

SEQ ID NO: 767395 - RNA, 16 nt, Homo sapiens
gucaccacgacuggcc

SEQ ID NO: 767396 - RNA, 15 nt, Homo sapiens
gucaccacgugcagu

SEQ ID NO: 767397 - RNA, 22 nt, Homo sapiens
gucaccacgugcaguaucucaa

SEQ ID NO: 767398 - RNA, 21 nt, Homo sapiens
gucacccaaacacuucugcuu

SEQ ID NO: 767399 - RNA, 21 nt, Homo sapiens
gucacccagguuggagugcag

SEQ ID NO: 767400 - RNA, 18 nt, Homo sapiens
gucaccucagcugauauu

SEQ ID NO: 767401 - RNA, 14 nt, Homo sapiens
gucacggguaaaaa

SEQ ID NO: 767402 - RNA, 18 nt, Homo sapiens
gucacguucuuggauccu

SEQ ID NO: 767403 - RNA, 22 nt, Homo sapiens
gucacuacgugacuguggcaca

SEQ ID NO: 767404 - RNA, 14 nt, Homo sapiens
gucacuagucucac

SEQ ID NO: 767405 - RNA, 14 nt, Homo sapiens
gucacucacacugg

SEQ ID NO: 767406 - RNA, 15 nt, Homo sapiens
gucacucauugcuga

SEQ ID NO: 767407 - RNA, 21 nt, Homo sapiens
gucacucuguaguuacugugg

SEQ ID NO: 767408 - RNA, 10 nt, Homo sapiens
gucacuggaa

SEQ ID NO: 767409 - RNA, 13 nt, Homo sapiens
gucacuggcagcc

SEQ ID NO: 767410 - RNA, 22 nt, Homo sapiens
gucacuucuucaccucuuccac

SEQ ID NO: 767411 - RNA, 21 nt, Homo sapiens
gucagaaaaagcuagcacuaa

SEQ ID NO: 767412 - RNA, 23 nt, Homo sapiens
guccagcaaacucuugcaugugg

SEQ ID NO: 767413 - RNA, 23 nt, Homo sapiens
guccagccgccauugccaccagg

SEQ ID NO: 767414 - RNA, 19 nt, Homo sapiens
guccaggaaggcagcugcu

SEQ ID NO: 767415 - RNA, 20 nt, Homo sapiens
guccaggacugggucugacc

SEQ ID NO: 767416 - RNA, 23 nt, Homo sapiens
guccaggacugggucugaccugg

SEQ ID NO: 767417 - RNA, 16 nt, Homo sapiens
guccaggguccucuag

SEQ ID NO: 767418 - RNA, 20 nt, Homo sapiens
guccaggguggaugaucuca

SEQ ID NO: 767419 - RNA, 21 nt, Homo sapiens
guccaggguggaugaucucaa

SEQ ID NO: 767420 - RNA, 15 nt, Homo sapiens
guccaguacugggag

SEQ ID NO: 767421 - RNA, 17 nt, Homo sapiens
guccaucagauucugug

SEQ ID NO: 767422 - RNA, 14 nt, Homo sapiens
guccauccauucag

SEQ ID NO: 767423 - RNA, 18 nt, Homo sapiens
guccaugccaugaaugag

SEQ ID NO: 767424 - RNA, 14 nt, Homo sapiens
guccaugcuucuag

SEQ ID NO: 767425 - RNA, 14 nt, Homo sapiens
gucccaaccccagu

SEQ ID NO: 767426 - RNA, 13 nt, Homo sapiens
gucccaccaacuc

SEQ ID NO: 767427 - RNA, 18 nt, Homo sapiens
gucccacuacuguagaaa

SEQ ID NO: 767428 - RNA, 11 nt, Homo sapiens
gucccagagag

SEQ ID NO: 767429 - RNA, 20 nt, Homo sapiens
gucccagagguuaucugccu

SEQ ID NO: 767430 - RNA, 17 nt, Homo sapiens
gucccagcuacucagga

SEQ ID NO: 767431 - RNA, 20 nt, Homo sapiens
gucccauuuuucucuugcca

SEQ ID NO: 767432 - RNA, 21 nt, Homo sapiens
guccccacccuccacucagcu

SEQ ID NO: 767433 - RNA, 16 nt, Homo sapiens
guccccagucagagau

SEQ ID NO: 767434 - RNA, 23 nt, Homo sapiens
gucccccagauuccaacauuucu

SEQ ID NO: 767435 - RNA, 14 nt, Homo sapiens
gucccccccagugc

SEQ ID NO: 767436 - RNA, 19 nt, Homo sapiens
gucccccugcuugucuuca

SEQ ID NO: 767437 - RNA, 16 nt, Homo sapiens
guccccuccucaguga

SEQ ID NO: 767438 - RNA, 23 nt, Homo sapiens
guccccugaaaaacugaucaaaa

SEQ ID NO: 767439 - RNA, 22 nt, Homo sapiens
guccccuuuucuuuucuacccu

SEQ ID NO: 767440 - RNA, 15 nt, Homo sapiens
gucccucagugauac

SEQ ID NO: 767441 - RNA, 16 nt, Homo sapiens
gucccuccaaagggca

SEQ ID NO: 767442 - RNA, 18 nt, Homo sapiens
gucccuccaccccacaga

SEQ ID NO: 767443 - RNA, 17 nt, Homo sapiens
gucccucgcgcccaaaa

SEQ ID NO: 767444 - RNA, 22 nt, Homo sapiens
gucccugaaaccuaguacugcc

SEQ ID NO: 767445 - RNA, 23 nt, Homo sapiens
gucccugguccuucacuggcgcc

SEQ ID NO: 767446 - RNA, 22 nt, Homo sapiens
gucccuuacagaggaccaugcu

SEQ ID NO: 767447 - RNA, 21 nt, Homo sapiens
gucccuucagcaccugacccu

SEQ ID NO: 767448 - RNA, 15 nt, Homo sapiens
guccgaucuuugacu

SEQ ID NO: 767449 - RNA, 21 nt, Homo sapiens
guccgccuggccggcuccagu

SEQ ID NO: 767450 - RNA, 18 nt, Homo sapiens
guccuaaauguaaucacg

SEQ ID NO: 767451 - RNA, 14 nt, Homo sapiens
guccuaggacuuaa

SEQ ID NO: 767452 - RNA, 20 nt, Homo sapiens
guccuaucuccagcggcccu

SEQ ID NO: 767453 - RNA, 13 nt, Homo sapiens
guccuaugcgcuc

SEQ ID NO: 767454 - RNA, 24 nt, Homo sapiens
guccucacaucuuucacacuucca

SEQ ID NO: 767455 - RNA, 18 nt, Homo sapiens
guccucacgcagacacac

SEQ ID NO: 767456 - RNA, 13 nt, Homo sapiens
guccucccuccca

SEQ ID NO: 767457 - RNA, 14 nt, Homo sapiens
guccuccugugcua

SEQ ID NO: 767458 - RNA, 21 nt, Homo sapiens
guccuccuuucuuauucugug

SEQ ID NO: 767459 - RNA, 16 nt, Homo sapiens
guccuccuuuucacuu

SEQ ID NO: 767460 - RNA, 19 nt, Homo sapiens
guccucgagcaacugcugu

SEQ ID NO: 767461 - RNA, 19 nt, Homo sapiens
guccucuacuuaaugagau

SEQ ID NO: 767462 - RNA, 11 nt, Homo sapiens
guccucucagu

SEQ ID NO: 767463 - RNA, 18 nt, Homo sapiens
guccucuuccaccacaga

SEQ ID NO: 767464 - RNA, 14 nt, Homo sapiens
guccugaagcugcu

SEQ ID NO: 767465 - RNA, 15 nt, Homo sapiens
guccugacacuauuc

SEQ ID NO: 767466 - RNA, 21 nt, Homo sapiens
guccugacacuauucauuuga

SEQ ID NO: 767467 - RNA, 14 nt, Homo sapiens
guccugagcaccug

SEQ ID NO: 767468 - RNA, 17 nt, Homo sapiens
guccugccucagccucc

SEQ ID NO: 767469 - RNA, 16 nt, Homo sapiens
guccuggcugcacucu

SEQ ID NO: 767470 - RNA, 14 nt, Homo sapiens
gugauguuugcucu

SEQ ID NO: 767471 - RNA, 16 nt, Homo sapiens
gugauuaacaucuaca

SEQ ID NO: 767472 - RNA, 22 nt, Homo sapiens
gugauuauuuuuuauacuguau

SEQ ID NO: 767473 - RNA, 14 nt, Homo sapiens
gugauuggaccagg

SEQ ID NO: 767474 - RNA, 23 nt, Homo sapiens
gugauuuuuuuuuucuuuuuacu

SEQ ID NO: 767475 - RNA, 13 nt, Homo sapiens
gugcaaaccacuu

SEQ ID NO: 767476 - RNA, 18 nt, Homo sapiens
gugcaaaugugcugguca

SEQ ID NO: 767477 - RNA, 16 nt, Homo sapiens
gugcaaccaucaccag

SEQ ID NO: 767478 - RNA, 22 nt, Homo sapiens
gugcaauaagauugguguucgu

SEQ ID NO: 767479 - RNA, 23 nt, Homo sapiens
gugcaauagacacauacauguca

SEQ ID NO: 767480 - RNA, 15 nt, Homo sapiens
gugcacagcacacgu

SEQ ID NO: 767481 - RNA, 14 nt, Homo sapiens
gugcacaguggcuu

SEQ ID NO: 767482 - RNA, 20 nt, Homo sapiens
gugcacauuucauaguuuca

SEQ ID NO: 767483 - RNA, 17 nt, Homo sapiens
gugcacauuucuuugca

SEQ ID NO: 767484 - RNA, 19 nt, Homo sapiens
gugcaccccuccccauuca

SEQ ID NO: 767485 - RNA, 18 nt, Homo sapiens
gugcacuccggucccaaa

SEQ ID NO: 767486 - RNA, 13 nt, Homo sapiens
gugcagccacaca

SEQ ID NO: 767487 - RNA, 17 nt, Homo sapiens
gugcagcgggugcugcu

SEQ ID NO: 767488 - RNA, 21 nt, Homo sapiens
gugcaggauauuugcacuauu

SEQ ID NO: 767489 - RNA, 18 nt, Homo sapiens
gugcagggauauugccuu

SEQ ID NO: 767490 - RNA, 15 nt, Homo sapiens
gugcagucacuggag

SEQ ID NO: 767491 - RNA, 12 nt, Homo sapiens
gugcagugauac

SEQ ID NO: 767492 - RNA, 19 nt, Homo sapiens
gugcagugccaccaucaua

SEQ ID NO: 767493 - RNA, 20 nt, Homo sapiens
gugcaguggcccccacagaa

SEQ ID NO: 767494 - RNA, 19 nt, Homo sapiens
gugcaguggcgcauucuag

SEQ ID NO: 767495 - RNA, 19 nt, Homo sapiens
gugcaguggcgcgaucuca

SEQ ID NO: 767496 - RNA, 19 nt, Homo sapiens
gugcaguggcgugaucuca

SEQ ID NO: 767497 - RNA, 19 nt, Homo sapiens
gugcaguggugccaucacc

SEQ ID NO: 767498 - RNA, 19 nt, Homo sapiens
gugcaguucuaguuugcau

SEQ ID NO: 767499 - RNA, 20 nt, Homo sapiens
gugcaguuguaggcauguag

SEQ ID NO: 767500 - RNA, 15 nt, Homo sapiens
gugcaguugugauuu

SEQ ID NO: 767501 - RNA, 14 nt, Homo sapiens
gugcauaucugccu

SEQ ID NO: 767502 - RNA, 20 nt, Homo sapiens
gugcaucuagaaagcuuuga

SEQ ID NO: 767503 - RNA, 22 nt, Homo sapiens
gugcaucuuugccucaacucca

SEQ ID NO: 767504 - RNA, 12 nt, Homo sapiens
gugcaugcaguu

SEQ ID NO: 767505 - RNA, 17 nt, Homo sapiens
gugcaugccgggaccau

SEQ ID NO: 767506 - RNA, 20 nt, Homo sapiens
gugcaugccuguagucucag

SEQ ID NO: 767507 - RNA, 18 nt, Homo sapiens
gugcaugugcgcgcgugc

SEQ ID NO: 767508 - RNA, 12 nt, Homo sapiens
gugccaaaaauc

SEQ ID NO: 767509 - RNA, 17 nt, Homo sapiens
gugccaauauuucugau

SEQ ID NO: 767510 - RNA, 12 nt, Homo sapiens
gugccacacagu

SEQ ID NO: 767511 - RNA, 19 nt, Homo sapiens
gugccacccaccuuugcca

SEQ ID NO: 767512 - RNA, 12 nt, Homo sapiens
gugccacccgca

SEQ ID NO: 767513 - RNA, 21 nt, Homo sapiens
gugccaguucuuuccauaaua

SEQ ID NO: 767514 - RNA, 18 nt, Homo sapiens
gugccccccuccuccagu

SEQ ID NO: 767515 - RNA, 14 nt, Homo sapiens
gugccccucuucuu

SEQ ID NO: 767516 - RNA, 14 nt, Homo sapiens
gugccccuuuccaa

SEQ ID NO: 767517 - RNA, 19 nt, Homo sapiens
gugcccuacaaaggcuaga

SEQ ID NO: 767518 - RNA, 19 nt, Homo sapiens
gugcccuagaugcacgugg

SEQ ID NO: 767519 - RNA, 15 nt, Homo sapiens
gugcccucaccacca

SEQ ID NO: 767520 - RNA, 15 nt, Homo sapiens
gugcccuccaaagag

SEQ ID NO: 767521 - RNA, 13 nt, Homo sapiens
gugcccucucagg

SEQ ID NO: 767522 - RNA, 15 nt, Homo sapiens
gugcccugguggaga

SEQ ID NO: 767523 - RNA, 14 nt, Homo sapiens
gugccgccugcucc

SEQ ID NO: 767524 - RNA, 17 nt, Homo sapiens
gugccgcucucucugag

SEQ ID NO: 767525 - RNA, 17 nt, Homo sapiens
gugccgcuuucucugag

SEQ ID NO: 767526 - RNA, 18 nt, Homo sapiens
gugccguaacaacugugg

SEQ ID NO: 767527 - RNA, 14 nt, Homo sapiens
gugccuagacuguu

SEQ ID NO: 767528 - RNA, 18 nt, Homo sapiens
uaauuaccaaccuguuac

SEQ ID NO: 767529 - RNA, 21 nt, Homo sapiens
uaauuacuaauguacgcugcu

SEQ ID NO: 767530 - RNA, 15 nt, Homo sapiens
uaauuacucuaacaa

SEQ ID NO: 767531 - RNA, 20 nt, Homo sapiens
uaauuacuuauuguauuuau

SEQ ID NO: 767532 - RNA, 17 nt, Homo sapiens
uaauuaguuaacaguuu

SEQ ID NO: 767533 - RNA, 23 nt, Homo sapiens
uaauuaguuuauauuacucucau

SEQ ID NO: 767534 - RNA, 22 nt, Homo sapiens
uaauuauauuuuaaauacccau

SEQ ID NO: 767535 - RNA, 21 nt, Homo sapiens
uaauuaucggaagcagugccu

SEQ ID NO: 767536 - RNA, 12 nt, Homo sapiens
uaauuauugcuu

SEQ ID NO: 767537 - RNA, 14 nt, Homo sapiens
uaauucaccaaagu

SEQ ID NO: 767538 - RNA, 19 nt, Homo sapiens
uaauucagcacugauuuca

SEQ ID NO: 767539 - RNA, 11 nt, Homo sapiens
uaauucauuaa

SEQ ID NO: 767540 - RNA, 19 nt, Homo sapiens
uaauuccaauuauaugaga

SEQ ID NO: 767541 - RNA, 13 nt, Homo sapiens
uaauucucuaggg

SEQ ID NO: 767542 - RNA, 15 nt, Homo sapiens
uaauucucuguggaa

SEQ ID NO: 767543 - RNA, 19 nt, Homo sapiens
uaauucucuguggaaugaa

SEQ ID NO: 767544 - RNA, 20 nt, Homo sapiens
uaauucucuucgcugugaug

SEQ ID NO: 767545 - RNA, 14 nt, Homo sapiens
uaauucucuuucaa

SEQ ID NO: 767546 - RNA, 19 nt, Homo sapiens
uaauugaccuacuuuggua

SEQ ID NO: 767547 - RNA, 21 nt, Homo sapiens
uaauugauuauucugauucca

SEQ ID NO: 767548 - RNA, 13 nt, Homo sapiens
uaauugauuucaa

SEQ ID NO: 767549 - RNA, 22 nt, Homo sapiens
uaauugcauuucugcucuucca

SEQ ID NO: 767550 - RNA, 22 nt, Homo sapiens
uaauugccuagaaauaucuuuc

SEQ ID NO: 767551 - RNA, 17 nt, Homo sapiens
uaauugcuguucugcug

SEQ ID NO: 767552 - RNA, 13 nt, Homo sapiens
uaauuguacaaua

SEQ ID NO: 767553 - RNA, 16 nt, Homo sapiens
uaauuguauugucaga

SEQ ID NO: 767554 - RNA, 21 nt, Homo sapiens
uaauugugugacuuuuucaga

SEQ ID NO: 767555 - RNA, 16 nt, Homo sapiens
uaauuuaaaagcacac

SEQ ID NO: 767556 - RNA, 17 nt, Homo sapiens
uaauuuaaacaccuccu

SEQ ID NO: 767557 - RNA, 14 nt, Homo sapiens
uaauuuacuuuaag

SEQ ID NO: 767558 - RNA, 20 nt, Homo sapiens
uaauuuagaccccauacaag

SEQ ID NO: 767559 - RNA, 22 nt, Homo sapiens
uaauuuaguggauggaauauca

SEQ ID NO: 767560 - RNA, 21 nt, Homo sapiens
uaauuuaucuugucucugggc

SEQ ID NO: 767561 - RNA, 17 nt, Homo sapiens
uaauuucaggaauugaa

SEQ ID NO: 767562 - RNA, 18 nt, Homo sapiens
uaauuucaugggacuaaa

SEQ ID NO: 767563 - RNA, 17 nt, Homo sapiens
uaauuuccucugacaug

SEQ ID NO: 767564 - RNA, 22 nt, Homo sapiens
uaauuuccuuuuugacacugaa

SEQ ID NO: 767565 - RNA, 20 nt, Homo sapiens
uaauuucuacucugucuuaa

SEQ ID NO: 767566 - RNA, 20 nt, Homo sapiens
uaauuugagagaaauaugaa

SEQ ID NO: 767567 - RNA, 19 nt, Homo sapiens
uaauuugcauugugucaga

SEQ ID NO: 767568 - RNA, 12 nt, Homo sapiens
uaauuugugugg

SEQ ID NO: 767569 - RNA, 17 nt, Homo sapiens
uaauuuugcuugcugaa

SEQ ID NO: 767570 - RNA, 14 nt, Homo sapiens
uaauuuuguuguuu

SEQ ID NO: 767571 - RNA, 19 nt, Homo sapiens
uaauuuuuaccuaaucucc

SEQ ID NO: 767572 - RNA, 19 nt, Homo sapiens
uaauuuuuccuauauugca

SEQ ID NO: 767573 - RNA, 17 nt, Homo sapiens
uaauuuuugaaaacugg

SEQ ID NO: 767574 - RNA, 17 nt, Homo sapiens
uaauuuuuuacuuucag

SEQ ID NO: 767575 - RNA, 19 nt, Homo sapiens
uaauuuuuuuuccuugccu

SEQ ID NO: 767576 - RNA, 16 nt, Homo sapiens
uacaaaaaaauacaaa

SEQ ID NO: 767577 - RNA, 20 nt, Homo sapiens
uacaaaaauuagccgggcau

SEQ ID NO: 767578 - RNA, 18 nt, Homo sapiens
uacaaaagauguauccuu

SEQ ID NO: 767579 - RNA, 16 nt, Homo sapiens
uacaaaagcuuugaau

SEQ ID NO: 767580 - RNA, 20 nt, Homo sapiens
uacaaaauccagcuaugaau

SEQ ID NO: 767581 - RNA, 23 nt, Homo sapiens
uacaaaccauuuuguuauugacu

SEQ ID NO: 767582 - RNA, 17 nt, Homo sapiens
uacaaacucccacuugu

SEQ ID NO: 767583 - RNA, 16 nt, Homo sapiens
uacaaacuucaaagag

SEQ ID NO: 767584 - RNA, 17 nt, Homo sapiens
uacaaagcaaauuucua

SEQ ID NO: 767585 - RNA, 17 nt, Homo sapiens
uacaaaggaaauaucaa

SEQ ID NO: 767586 - RNA, 22 nt, Homo sapiens
gucugugauugccuucuuacaa

SEQ ID NO: 767587 - RNA, 21 nt, Homo sapiens
gucugugugcgcucuguggau

SEQ ID NO: 767588 - RNA, 18 nt, Homo sapiens
gucuguuuggacugcaga

SEQ ID NO: 767589 - RNA, 20 nt, Homo sapiens
gucuuaacuuuucaccaggg

SEQ ID NO: 767590 - RNA, 14 nt, Homo sapiens
gucuuaaucguccu

SEQ ID NO: 767591 - RNA, 13 nt, Homo sapiens
gucuuacauugga

SEQ ID NO: 767592 - RNA, 14 nt, Homo sapiens
gucuuacugugauc

SEQ ID NO: 767593 - RNA, 19 nt, Homo sapiens
gucuuauuugaaggccagc

SEQ ID NO: 767594 - RNA, 14 nt, Homo sapiens
gucuucagacccag

SEQ ID NO: 767595 - RNA, 15 nt, Homo sapiens
gucuucagagcaaaa

SEQ ID NO: 767596 - RNA, 21 nt, Homo sapiens
gucuucaguuuccgaaucucu

SEQ ID NO: 767597 - RNA, 12 nt, Homo sapiens
gucuuccauaau

SEQ ID NO: 767598 - RNA, 14 nt, Homo sapiens
gucuucccuaccuc

SEQ ID NO: 767599 - RNA, 13 nt, Homo sapiens
gucuucccuguau

SEQ ID NO: 767600 - RNA, 18 nt, Homo sapiens
gucuuccugacacuuuaa

SEQ ID NO: 767601 - RNA, 21 nt, Homo sapiens
gucuuccugaguggugccaaa

SEQ ID NO: 767602 - RNA, 16 nt, Homo sapiens
gucuucguauucccau

SEQ ID NO: 767603 - RNA, 19 nt, Homo sapiens
gucuucuaauuucaaaaau

SEQ ID NO: 767604 - RNA, 19 nt, Homo sapiens
gucuucucccuacaccaag

SEQ ID NO: 767605 - RNA, 22 nt, Homo sapiens
gucuucuccuccaugaacauca

SEQ ID NO: 767606 - RNA, 15 nt, Homo sapiens
gucuugaaacaagca

SEQ ID NO: 767607 - RNA, 14 nt, Homo sapiens
gucuugagcucuaa

SEQ ID NO: 767608 - RNA, 15 nt, Homo sapiens
gucuugccagauuac

SEQ ID NO: 767609 - RNA, 16 nt, Homo sapiens
gucuugccagccagaa

SEQ ID NO: 767610 - RNA, 18 nt, Homo sapiens
gucuuggacacuguacaa

SEQ ID NO: 767611 - RNA, 18 nt, Homo sapiens
gucuuggggccacuuuca

SEQ ID NO: 767612 - RNA, 22 nt, Homo sapiens
gucuuuagggguugggcuggau

SEQ ID NO: 767613 - RNA, 15 nt, Homo sapiens
gucuuuaucaaagga

SEQ ID NO: 767614 - RNA, 13 nt, Homo sapiens
gucuuucugacau

SEQ ID NO: 767615 - RNA, 21 nt, Homo sapiens
gucuuuguaaugucaccaccu

SEQ ID NO: 767616 - RNA, 13 nt, Homo sapiens
gucuuuugaauau

SEQ ID NO: 767617 - RNA, 17 nt, Homo sapiens
gucuuuugagcuauuca

SEQ ID NO: 767618 - RNA, 12 nt, Homo sapiens
gugaaaauauga

SEQ ID NO: 767619 - RNA, 19 nt, Homo sapiens
gugaaaauuacaguccaaa

SEQ ID NO: 767620 - RNA, 21 nt, Homo sapiens
gugaaacccugucucuacuaa

SEQ ID NO: 767621 - RNA, 17 nt, Homo sapiens
gugaaaccucaucucua

SEQ ID NO: 767622 - RNA, 13 nt, Homo sapiens
gugaaacuaacag

SEQ ID NO: 767623 - RNA, 13 nt, Homo sapiens
gugaaacuggcac

SEQ ID NO: 767624 - RNA, 15 nt, Homo sapiens
gugaaagaggcagcu

SEQ ID NO: 767625 - RNA, 15 nt, Homo sapiens
gugaaaguacauuug

SEQ ID NO: 767626 - RNA, 19 nt, Homo sapiens
gugaaaugcuggcauuugc

SEQ ID NO: 767627 - RNA, 20 nt, Homo sapiens
gugaacagcuugcugucacu

SEQ ID NO: 767628 - RNA, 15 nt, Homo sapiens
gugaaccaucauuau

SEQ ID NO: 767629 - RNA, 17 nt, Homo sapiens
gugaaccuuaguaccua

SEQ ID NO: 767630 - RNA, 19 nt, Homo sapiens
gugaacuagggaagcucag

SEQ ID NO: 767631 - RNA, 21 nt, Homo sapiens
gugaacugucuuggcugugag

SEQ ID NO: 767632 - RNA, 14 nt, Homo sapiens
gugaacuuacacuu

SEQ ID NO: 767633 - RNA, 17 nt, Homo sapiens
gugaagaaaaauguauu

SEQ ID NO: 767634 - RNA, 21 nt, Homo sapiens
gugaagagcagugagcagggu

SEQ ID NO: 767635 - RNA, 23 nt, Homo sapiens
gugaagcauucuccccaguguau

SEQ ID NO: 767636 - RNA, 17 nt, Homo sapiens
gugaagccaaagggacu

SEQ ID NO: 767637 - RNA, 20 nt, Homo sapiens
gugaaggugguggggcugcc

SEQ ID NO: 767638 - RNA, 16 nt, Homo sapiens
gugaauaaccacuuaa

SEQ ID NO: 767639 - RNA, 22 nt, Homo sapiens
gugaauacauuaacggugcuaa

SEQ ID NO: 767640 - RNA, 19 nt, Homo sapiens
gugaauacauucuuugcua

SEQ ID NO: 767641 - RNA, 17 nt, Homo sapiens
gugaaugaaacacucag

SEQ ID NO: 767642 - RNA, 17 nt, Homo sapiens
gugaaugagaaaggugu

SEQ ID NO: 767643 - RNA, 16 nt, Homo sapiens
gugaauuaggcuguaa

SEQ ID NO: 767644 - RNA, 21 nt, Homo sapiens
uacaaagucagggcguucaua

SEQ ID NO: 767645 - RNA, 11 nt, Homo sapiens
uacaaauggac

SEQ ID NO: 767646 - RNA, 13 nt, Homo sapiens
uacaaauggacau

SEQ ID NO: 767647 - RNA, 19 nt, Homo sapiens
uacaaauuuaugcauuuca

SEQ ID NO: 767648 - RNA, 13 nt, Homo sapiens
uacaacagaauuu

SEQ ID NO: 767649 - RNA, 13 nt, Homo sapiens
uacaacaggcagu

SEQ ID NO: 767650 - RNA, 15 nt, Homo sapiens
uacaacagugagaaa

SEQ ID NO: 767651 - RNA, 12 nt, Homo sapiens
uacaacauguga

SEQ ID NO: 767652 - RNA, 15 nt, Homo sapiens
uacaaccaauuccaa

SEQ ID NO: 767653 - RNA, 14 nt, Homo sapiens
uacaaccagcccaa

SEQ ID NO: 767654 - RNA, 21 nt, Homo sapiens
uacaacgccgagugcacugca

SEQ ID NO: 767655 - RNA, 14 nt, Homo sapiens
uacaacucacauua

SEQ ID NO: 767656 - RNA, 21 nt, Homo sapiens
uacaagaacaaugacaccaca

SEQ ID NO: 767657 - RNA, 22 nt, Homo sapiens
uacaagaacaaugacaccacac

SEQ ID NO: 767658 - RNA, 12 nt, Homo sapiens
uacaagaucuca

SEQ ID NO: 767659 - RNA, 14 nt, Homo sapiens
uacaaggcuuuauc

SEQ ID NO: 767660 - RNA, 17 nt, Homo sapiens
uacaaguuucagacagg

SEQ ID NO: 767661 - RNA, 23 nt, Homo sapiens
uacaauaaauuuuuuuuggucaa

SEQ ID NO: 767662 - RNA, 14 nt, Homo sapiens
uacaauaauguacu

SEQ ID NO: 767663 - RNA, 14 nt, Homo sapiens
uacaauacaaugua

SEQ ID NO: 767664 - RNA, 19 nt, Homo sapiens
uacaaucagccacauucua

SEQ ID NO: 767665 - RNA, 17 nt, Homo sapiens
uacaaucugcacuuuaa

SEQ ID NO: 767666 - RNA, 17 nt, Homo sapiens
uacaauugaaaugacua

SEQ ID NO: 767667 - RNA, 13 nt, Homo sapiens
uacaauugucauu

SEQ ID NO: 767668 - RNA, 11 nt, Homo sapiens
uacaauuguga

SEQ ID NO: 767669 - RNA, 13 nt, Homo sapiens
uacaauugugagc

SEQ ID NO: 767670 - RNA, 22 nt, Homo sapiens
uacaauuuggagcauaacugga

SEQ ID NO: 767671 - RNA, 17 nt, Homo sapiens
uacacaaaaucaaauaa

SEQ ID NO: 767672 - RNA, 17 nt, Homo sapiens
uacacaagaaucuagaa

SEQ ID NO: 767673 - RNA, 17 nt, Homo sapiens
uacacaaggaaggcauu

SEQ ID NO: 767674 - RNA, 17 nt, Homo sapiens
uacacaauacaguauua

SEQ ID NO: 767675 - RNA, 23 nt, Homo sapiens
uacacaauccuccaagaauuuga

SEQ ID NO: 767676 - RNA, 21 nt, Homo sapiens
uacacacacacagacauauau

SEQ ID NO: 767677 - RNA, 19 nt, Homo sapiens
uacacacacacgcacacaa

SEQ ID NO: 767678 - RNA, 15 nt, Homo sapiens
uacacacgugagcaa

SEQ ID NO: 767679 - RNA, 16 nt, Homo sapiens
uacacauagcauguaa

SEQ ID NO: 767680 - RNA, 15 nt, Homo sapiens
uacaccacugcacuu

SEQ ID NO: 767681 - RNA, 14 nt, Homo sapiens
uacacccaccagag

SEQ ID NO: 767682 - RNA, 17 nt, Homo sapiens
uacacccaguugccaaa

SEQ ID NO: 767683 - RNA, 16 nt, Homo sapiens
uacaccgacuagccag

SEQ ID NO: 767684 - RNA, 22 nt, Homo sapiens
uacaccucgucaagagcaugca

SEQ ID NO: 767685 - RNA, 13 nt, Homo sapiens
uacacggcuguga

SEQ ID NO: 767686 - RNA, 12 nt, Homo sapiens
uacacucaggcu

SEQ ID NO: 767687 - RNA, 16 nt, Homo sapiens
uacacugacuugagac

SEQ ID NO: 767688 - RNA, 12 nt, Homo sapiens
uacacugugaac

SEQ ID NO: 767689 - RNA, 21 nt, Homo sapiens
uacacuuggagcccgugcagu

SEQ ID NO: 767690 - RNA, 16 nt, Homo sapiens
uacacuuugaaguauu

SEQ ID NO: 767691 - RNA, 17 nt, Homo sapiens
uacagaaaagacucuga

SEQ ID NO: 767692 - RNA, 20 nt, Homo sapiens
uacagaaaauuguugugcuu

SEQ ID NO: 767693 - RNA, 17 nt, Homo sapiens
uacagaaaucaauggua

SEQ ID NO: 767694 - RNA, 15 nt, Homo sapiens
uacagaacuucagaa

SEQ ID NO: 767695 - RNA, 23 nt, Homo sapiens
uacagacauacauuuaugcacau

SEQ ID NO: 767696 - RNA, 18 nt, Homo sapiens
uacagaccaccuuucaca

SEQ ID NO: 767697 - RNA, 14 nt, Homo sapiens
uacagacucugauu

SEQ ID NO: 767698 - RNA, 19 nt, Homo sapiens
uacagaguuuaugauuuaa

SEQ ID NO: 767699 - RNA, 19 nt, Homo sapiens
uacagauagaguuccauau

SEQ ID NO: 767700 - RNA, 15 nt, Homo sapiens
uacagauagauauau

SEQ ID NO: 767701 - RNA, 20 nt, Homo sapiens
uacagauagauauaugcucu

SEQ ID NO: 767702 - RNA, 10 nt, Homo sapiens
ucacugccaa

SEQ ID NO: 767703 - RNA, 18 nt, Homo sapiens
ucacugccccucucucag

SEQ ID NO: 767704 - RNA, 16 nt, Homo sapiens
ucacuggcuggccuga

SEQ ID NO: 767705 - RNA, 23 nt, Homo sapiens
ucacuguagaaugauuucaugcu

SEQ ID NO: 767706 - RNA, 13 nt, Homo sapiens
ucacugugucacc

SEQ ID NO: 767707 - RNA, 15 nt, Homo sapiens
ucacuucauaaucca

SEQ ID NO: 767708 - RNA, 15 nt, Homo sapiens
ucacuuccccacagg

SEQ ID NO: 767709 - RNA, 19 nt, Homo sapiens
ucacuucccguagcugcca

SEQ ID NO: 767710 - RNA, 13 nt, Homo sapiens
ucacuuccuacaa

SEQ ID NO: 767711 - RNA, 18 nt, Homo sapiens
ucacuugcuuuugaauug

SEQ ID NO: 767712 - RNA, 24 nt, Homo sapiens
ucacuuggcugucugaccagagaa

SEQ ID NO: 767713 - RNA, 15 nt, Homo sapiens
ucacuuguauugacu

SEQ ID NO: 767714 - RNA, 18 nt, Homo sapiens
ucacuuguuuuauugacu

SEQ ID NO: 767715 - RNA, 14 nt, Homo sapiens
ucagaaaacucugg

SEQ ID NO: 767716 - RNA, 19 nt, Homo sapiens
ucagaaaagagccacuuuc

SEQ ID NO: 767717 - RNA, 13 nt, Homo sapiens
ucagaaagucaua

SEQ ID NO: 767718 - RNA, 18 nt, Homo sapiens
ucagaaauguaguuugca

SEQ ID NO: 767719 - RNA, 13 nt, Homo sapiens
ucagaacaaacau

SEQ ID NO: 767720 - RNA, 18 nt, Homo sapiens
ucagaaccaaaagggagg

SEQ ID NO: 767721 - RNA, 19 nt, Homo sapiens
ucagaaccucuuccccaga

SEQ ID NO: 767722 - RNA, 14 nt, Homo sapiens
ucagaacuuucuag

SEQ ID NO: 767723 - RNA, 15 nt, Homo sapiens
ucagaagcucuucua

SEQ ID NO: 767724 - RNA, 22 nt, Homo sapiens
ucagaaggaauaagcauuccuu

SEQ ID NO: 767725 - RNA, 18 nt, Homo sapiens
ucagaaggccccagagag

SEQ ID NO: 767726 - RNA, 22 nt, Homo sapiens
ucagaaggcuucaucaccaaga

SEQ ID NO: 767727 - RNA, 19 nt, Homo sapiens
ucagaaguuaguuuguaua

SEQ ID NO: 767728 - RNA, 21 nt, Homo sapiens
ucagaauaggaaaacauugca

SEQ ID NO: 767729 - RNA, 23 nt, Homo sapiens
ucagaauaggaaaacauugcaau

SEQ ID NO: 767730 - RNA, 19 nt, Homo sapiens
ucagaaugggaggacucca

SEQ ID NO: 767731 - RNA, 21 nt, Homo sapiens
ucagaauuaagcagaacacug

SEQ ID NO: 767732 - RNA, 18 nt, Homo sapiens
ucagaauucggugugcug

SEQ ID NO: 767733 - RNA, 19 nt, Homo sapiens
ucagaauuucuuugucauu

SEQ ID NO: 767734 - RNA, 22 nt, Homo sapiens
ucagaauuucuuugucauucaa

SEQ ID NO: 767735 - RNA, 14 nt, Homo sapiens
ucagacaacauuau

SEQ ID NO: 767736 - RNA, 20 nt, Homo sapiens
ucagacaacauuaugaucua

SEQ ID NO: 767737 - RNA, 18 nt, Homo sapiens
ucagacacaugcuauguu

SEQ ID NO: 767738 - RNA, 13 nt, Homo sapiens
ucagacacuuugg

SEQ ID NO: 767739 - RNA, 16 nt, Homo sapiens
ucagacauuggcaccu

SEQ ID NO: 767740 - RNA, 20 nt, Homo sapiens
ucagacccuaccccaccacg

SEQ ID NO: 767741 - RNA, 20 nt, Homo sapiens
ucagaccugucuuccaagga

SEQ ID NO: 767742 - RNA, 16 nt, Homo sapiens
ucagacuccugugcaa

SEQ ID NO: 767743 - RNA, 19 nt, Homo sapiens
ucagacuccugugcaacuu

SEQ ID NO: 767744 - RNA, 22 nt, Homo sapiens
ucagacugcaugacagucacag

SEQ ID NO: 767745 - RNA, 21 nt, Homo sapiens
ucagacugcugggacuggcca

SEQ ID NO: 767746 - RNA, 22 nt, Homo sapiens
ucagacuggcccuuaagccaaa

SEQ ID NO: 767747 - RNA, 16 nt, Homo sapiens
ucagacuucaucuuca

SEQ ID NO: 767748 - RNA, 15 nt, Homo sapiens
ucagagaacuuuccc

SEQ ID NO: 767749 - RNA, 15 nt, Homo sapiens
ucagagaaggccuua

SEQ ID NO: 767750 - RNA, 17 nt, Homo sapiens
ucagagaccauugcaau

SEQ ID NO: 767751 - RNA, 20 nt, Homo sapiens
ucagagacuauguagcaaua

SEQ ID NO: 767752 - RNA, 20 nt, Homo sapiens
ucagagagcuaaauuacaau

SEQ ID NO: 767753 - RNA, 17 nt, Homo sapiens
ucagagcacucauuccu

SEQ ID NO: 767754 - RNA, 22 nt, Homo sapiens
ucagagccagccggcuaugaaa

SEQ ID NO: 767755 - RNA, 15 nt, Homo sapiens
ucagagcuaauaagu

SEQ ID NO: 767756 - RNA, 21 nt, Homo sapiens
ucagagcuaauaagugcuuuc

SEQ ID NO: 767757 - RNA, 18 nt, Homo sapiens
ucagaggacccuuuccag

SEQ ID NO: 767758 - RNA, 17 nt, Homo sapiens
ucagaggcccaggaauc

SEQ ID NO: 767759 - RNA, 16 nt, Homo sapiens
ucagaggggacucuga

SEQ ID NO: 767760 - RNA, 20 nt, Homo sapiens
ucagaggggacucugaccac

SEQ ID NO: 767761 - RNA, 22 nt, Homo sapiens
ucagagguuugcuuccucagua

SEQ ID NO: 767762 - RNA, 23 nt, Homo sapiens
ucagagugacuacacacaguacg

SEQ ID NO: 767763 - RNA, 22 nt, Homo sapiens
ucagaguggucgagugacacac

SEQ ID NO: 767764 - RNA, 22 nt, Homo sapiens
ucagaguuuguguguauuugua

SEQ ID NO: 767765 - RNA, 15 nt, Homo sapiens
ucagauauuugcacc

SEQ ID NO: 767766 - RNA, 20 nt, Homo sapiens
ucagauauuuuuucagaaau

SEQ ID NO: 767767 - RNA, 21 nt, Homo sapiens
ucagauauuuuuucagaaaua

SEQ ID NO: 767768 - RNA, 13 nt, Homo sapiens
ucagaucaugccc

SEQ ID NO: 767769 - RNA, 18 nt, Homo sapiens
ucagauccuguuacuugc

SEQ ID NO: 767770 - RNA, 16 nt, Homo sapiens
ucagaucugaacacag

SEQ ID NO: 767771 - RNA, 17 nt, Homo sapiens
ucagaucugaacacagu

SEQ ID NO: 767772 - RNA, 16 nt, Homo sapiens
ucagaugacucucucc

SEQ ID NO: 767773 - RNA, 21 nt, Homo sapiens
ucagaugauucagaaauuuuc

SEQ ID NO: 767774 - RNA, 14 nt, Homo sapiens
ucagauggggacac

SEQ ID NO: 767775 - RNA, 15 nt, Homo sapiens
ucagauggugaagca

SEQ ID NO: 767776 - RNA, 18 nt, Homo sapiens
ucagauuguuaucuauca

SEQ ID NO: 767777 - RNA, 22 nt, Homo sapiens
ucagauuguuaucuaucaacua

SEQ ID NO: 767778 - RNA, 18 nt, Homo sapiens
ucagcaaacuaaccagca

SEQ ID NO: 767779 - RNA, 16 nt, Homo sapiens
ucagcaacucgcuuua

SEQ ID NO: 767780 - RNA, 22 nt, Homo sapiens
ucagcaagaggaggacagaauu

SEQ ID NO: 767781 - RNA, 17 nt, Homo sapiens
ucagcaaugccauuuca

SEQ ID NO: 767782 - RNA, 19 nt, Homo sapiens
ucagcaccaagagcagcug

SEQ ID NO: 767783 - RNA, 11 nt, Homo sapiens
ucagcacugaa

SEQ ID NO: 767784 - RNA, 21 nt, Homo sapiens
ucagcacugucccuugccuca

SEQ ID NO: 767785 - RNA, 15 nt, Homo sapiens
ucagcagagaacugg

SEQ ID NO: 767786 - RNA, 22 nt, Homo sapiens
ucagcagcgugcacaucugcug

SEQ ID NO: 767787 - RNA, 18 nt, Homo sapiens
ucagcagcucugagacag

SEQ ID NO: 767788 - RNA, 18 nt, Homo sapiens
ucagcagguggaaugugu

SEQ ID NO: 767789 - RNA, 18 nt, Homo sapiens
ucagcaucugaccaucug

SEQ ID NO: 767790 - RNA, 21 nt, Homo sapiens
ucagcaucugaccaucuguga

SEQ ID NO: 767791 - RNA, 13 nt, Homo sapiens
ucagcauggcauc

SEQ ID NO: 767792 - RNA, 15 nt, Homo sapiens
ucagcauguccaaca

SEQ ID NO: 767793 - RNA, 16 nt, Homo sapiens
ucagcauuuggaccaa

SEQ ID NO: 767794 - RNA, 14 nt, Homo sapiens
ucagccaaacugua

SEQ ID NO: 767795 - RNA, 15 nt, Homo sapiens
ucagccaaacuguag

SEQ ID NO: 767796 - RNA, 14 nt, Homo sapiens
ucagccacugugau

SEQ ID NO: 767797 - RNA, 23 nt, Homo sapiens
ucagccagcccauggcccccaau

SEQ ID NO: 767798 - RNA, 21 nt, Homo sapiens
ucagccagcccguguguauaa

SEQ ID NO: 767799 - RNA, 22 nt, Homo sapiens
ucagcccagccccuccaaaggu

SEQ ID NO: 767800 - RNA, 13 nt, Homo sapiens
ucagccccacuga

SEQ ID NO: 767801 - RNA, 18 nt, Homo sapiens
ucagcccccaccagggga

SEQ ID NO: 767802 - RNA, 15 nt, Homo sapiens
ucagcccccaucacc

SEQ ID NO: 767803 - RNA, 21 nt, Homo sapiens
ucagcccgccaagguagccau

SEQ ID NO: 767804 - RNA, 17 nt, Homo sapiens
ucagcccguuucagaag

SEQ ID NO: 767805 - RNA, 14 nt, Homo sapiens
ucagcccucagaag

SEQ ID NO: 767806 - RNA, 17 nt, Homo sapiens
ucagcccugcaccaugc

SEQ ID NO: 767807 - RNA, 18 nt, Homo sapiens
ucagcccugcaccaugcu

SEQ ID NO: 767808 - RNA, 22 nt, Homo sapiens
ucagcccugcaccaugcugcug

SEQ ID NO: 767809 - RNA, 23 nt, Homo sapiens
ucagccuacuuucacacuaagaa

SEQ ID NO: 767810 - RNA, 18 nt, Homo sapiens
ucagccuagccgaccuca

SEQ ID NO: 767811 - RNA, 14 nt, Homo sapiens
ucagccucccaaag

SEQ ID NO: 767812 - RNA, 13 nt, Homo sapiens
ucagccucccaca

SEQ ID NO: 767813 - RNA, 18 nt, Homo sapiens
ucagccucccgaguagcu

SEQ ID NO: 767814 - RNA, 15 nt, Homo sapiens
ucagccuccugagua

SEQ ID NO: 767815 - RNA, 18 nt, Homo sapiens
ucagccuugccagagauc

SEQ ID NO: 767816 - RNA, 18 nt, Homo sapiens
ucagcgggggccuugaag

SEQ ID NO: 767817 - RNA, 16 nt, Homo sapiens
ucagcuacacaaggaa

SEQ ID NO: 767818 - RNA, 14 nt, Homo sapiens
ucagcucacugcaa

SEQ ID NO: 767819 - RNA, 19 nt, Homo sapiens
ucagcugcaagguacucug

SEQ ID NO: 767820 - RNA, 19 nt, Homo sapiens
ucagcugcauuucacaugc

SEQ ID NO: 767821 - RNA, 20 nt, Homo sapiens
ucagcugggucacauccauc

SEQ ID NO: 767822 - RNA, 13 nt, Homo sapiens
ucagcuugcacau

SEQ ID NO: 767823 - RNA, 19 nt, Homo sapiens
ucaggaaaaaugaggaauc

SEQ ID NO: 767824 - RNA, 14 nt, Homo sapiens
ucaggaaaacugac

SEQ ID NO: 767825 - RNA, 20 nt, Homo sapiens
ucaggaaaucaaauaugcaa

SEQ ID NO: 767826 - RNA, 19 nt, Homo sapiens
ucaggaaauguuuucuuaa

SEQ ID NO: 767827 - RNA, 20 nt, Homo sapiens
ucaggaaggcuauugcugag

SEQ ID NO: 767828 - RNA, 19 nt, Homo sapiens
ucaggaauacauuuggaaa

SEQ ID NO: 767829 - RNA, 14 nt, Homo sapiens
ucaggaauugucaa

SEQ ID NO: 767830 - RNA, 18 nt, Homo sapiens
ucaggacagaugccacac

SEQ ID NO: 767831 - RNA, 23 nt, Homo sapiens
ucaggagaggggcagaacagccg

SEQ ID NO: 767832 - RNA, 17 nt, Homo sapiens
ucaggagaucgagacca

SEQ ID NO: 767833 - RNA, 19 nt, Homo sapiens
ucaggaggcaucuggaaag

SEQ ID NO: 767834 - RNA, 18 nt, Homo sapiens
ucaggaguuccuaaccag

SEQ ID NO: 767835 - RNA, 19 nt, Homo sapiens
ucaggaucaagaaaguguu

SEQ ID NO: 767836 - RNA, 22 nt, Homo sapiens
ucaggauccaagcuaagcacug

SEQ ID NO: 767837 - RNA, 14 nt, Homo sapiens
ucaggcacacagcu

SEQ ID NO: 767838 - RNA, 21 nt, Homo sapiens
ucaggcagacaagagcugcug

SEQ ID NO: 767839 - RNA, 21 nt, Homo sapiens
ucaggcagcaccacacugggu

SEQ ID NO: 767840 - RNA, 20 nt, Homo sapiens
ucaggcagguuugccaguga

SEQ ID NO: 767841 - RNA, 21 nt, Homo sapiens
ucaggcagguuugccagugaa

SEQ ID NO: 767842 - RNA, 13 nt, Homo sapiens
ucaggccagccca

SEQ ID NO: 767843 - RNA, 16 nt, Homo sapiens
ucaggccagggcucac

SEQ ID NO: 767844 - RNA, 16 nt, Homo sapiens
ucaggcggggugcugu

SEQ ID NO: 767845 - RNA, 17 nt, Homo sapiens
ucaggcggggugggcag

SEQ ID NO: 767846 - RNA, 21 nt, Homo sapiens
ucagggacuugaaugcacuuu

SEQ ID NO: 767847 - RNA, 21 nt, Homo sapiens
ucagggagaggucaccagcug

SEQ ID NO: 767848 - RNA, 15 nt, Homo sapiens
ucagggagcauuuaa

SEQ ID NO: 767849 - RNA, 16 nt, Homo sapiens
ucagggccaugccugc

SEQ ID NO: 767850 - RNA, 14 nt, Homo sapiens
ucagggcugugauc

SEQ ID NO: 767851 - RNA, 14 nt, Homo sapiens
ucaggggacucagc

SEQ ID NO: 767852 - RNA, 19 nt, Homo sapiens
ucaggguccagacccugaa

SEQ ID NO: 767853 - RNA, 21 nt, Homo sapiens
ucaggguuuuuagauuaaaca

SEQ ID NO: 767854 - RNA, 12 nt, Homo sapiens
ucagguauuugu

SEQ ID NO: 767855 - RNA, 21 nt, Homo sapiens
ucaggugauccgccuaccuca

SEQ ID NO: 767856 - RNA, 18 nt, Homo sapiens
ucaggugccuuacaucuu

SEQ ID NO: 767857 - RNA, 14 nt, Homo sapiens
ucagguggaaaaac

SEQ ID NO: 767858 - RNA, 18 nt, Homo sapiens
ucaggugugacucuagca

SEQ ID NO: 767859 - RNA, 16 nt, Homo sapiens
ucagguguugccaaau

SEQ ID NO: 767860 - RNA, 12 nt, Homo sapiens
ucagguucucau

SEQ ID NO: 767861 - RNA, 18 nt, Homo sapiens
ucaguaaauaacuggaaa

SEQ ID NO: 767862 - RNA, 24 nt, Homo sapiens
ucaguaaauuguuuuuacugauga

SEQ ID NO: 767863 - RNA, 23 nt, Homo sapiens
ucaguaagucacaguuaucucca

SEQ ID NO: 767864 - RNA, 19 nt, Homo sapiens
ucaguaauaaaaccgguca

SEQ ID NO: 767865 - RNA, 20 nt, Homo sapiens
ucaguacugacuuucugauu

SEQ ID NO: 767866 - RNA, 22 nt, Homo sapiens
ucaguacugacuuucugauuac

SEQ ID NO: 767867 - RNA, 16 nt, Homo sapiens
ucaguagaccuaauga

SEQ ID NO: 767868 - RNA, 12 nt, Homo sapiens
ucaguaugugga

SEQ ID NO: 767869 - RNA, 21 nt, Homo sapiens
ucagucaacaacuuacacuua

SEQ ID NO: 767870 - RNA, 20 nt, Homo sapiens
ucagucacacacacauacaa

SEQ ID NO: 767871 - RNA, 22 nt, Homo sapiens
ucagucacuguucgucacucaa

SEQ ID NO: 767872 - RNA, 21 nt, Homo sapiens
ucagucaucaaagcagaaguc

SEQ ID NO: 767873 - RNA, 23 nt, Homo sapiens
ucagucuaaggucucaugcuguu

SEQ ID NO: 767874 - RNA, 18 nt, Homo sapiens
ucagucuuggugguucua

SEQ ID NO: 767875 - RNA, 18 nt, Homo sapiens
ucagucuuuaaucugaga

SEQ ID NO: 767876 - RNA, 16 nt, Homo sapiens
ucagugaaaacaaguc

SEQ ID NO: 767877 - RNA, 19 nt, Homo sapiens
ucagugaagccaaagggac

SEQ ID NO: 767878 - RNA, 17 nt, Homo sapiens
ucagugaaguacaccug

SEQ ID NO: 767879 - RNA, 23 nt, Homo sapiens
ucagugacagaguucacuauaaa

SEQ ID NO: 767880 - RNA, 16 nt, Homo sapiens
ucagugacuccugcug

SEQ ID NO: 767881 - RNA, 13 nt, Homo sapiens
ucagugcagugaa

SEQ ID NO: 767882 - RNA, 13 nt, Homo sapiens
ucagugcaguuuc

SEQ ID NO: 767883 - RNA, 22 nt, Homo sapiens
ucaguggaauagaugucucaaa

SEQ ID NO: 767884 - RNA, 16 nt, Homo sapiens
ucaguggcucugggua

SEQ ID NO: 767885 - RNA, 17 nt, Homo sapiens
ucagugggacauagcca

SEQ ID NO: 767886 - RNA, 20 nt, Homo sapiens
ucagugggacucggugagcc

SEQ ID NO: 767887 - RNA, 13 nt, Homo sapiens
ucaguggggacag

SEQ ID NO: 767888 - RNA, 12 nt, Homo sapiens
ucaguggugguc

SEQ ID NO: 767889 - RNA, 17 nt, Homo sapiens
ucagugguggucuucaa

SEQ ID NO: 767890 - RNA, 23 nt, Homo sapiens
ucagugguuagaagcaugucucu

SEQ ID NO: 767891 - RNA, 15 nt, Homo sapiens
ucaguguacauggaa

SEQ ID NO: 767892 - RNA, 19 nt, Homo sapiens
ucagugucguuuauauugu

SEQ ID NO: 767893 - RNA, 19 nt, Homo sapiens
ucaguguuuuugugaauug

SEQ ID NO: 767894 - RNA, 18 nt, Homo sapiens
ucaguuaauucuuagaua

SEQ ID NO: 767895 - RNA, 13 nt, Homo sapiens
ucaguugacuuua

SEQ ID NO: 767896 - RNA, 14 nt, Homo sapiens
ucaguuguacagug

SEQ ID NO: 767897 - RNA, 24 nt, Homo sapiens
ucaguuguuuguuuuugcuuguua

SEQ ID NO: 767898 - RNA, 20 nt, Homo sapiens
ucaguuucauuaacugguga

SEQ ID NO: 767899 - RNA, 19 nt, Homo sapiens
ucaguuucucaaacugagc

SEQ ID NO: 767900 - RNA, 22 nt, Homo sapiens
ucaguuuuaucuuuaaucuccu

SEQ ID NO: 767901 - RNA, 20 nt, Homo sapiens
ucauaaaaauaaccaaaaaa

SEQ ID NO: 767902 - RNA, 21 nt, Homo sapiens
ucauaaauuacuguuuugcca

SEQ ID NO: 767903 - RNA, 14 nt, Homo sapiens
ucauaacccaugaa

SEQ ID NO: 767904 - RNA, 17 nt, Homo sapiens
ucauaacuauacuugau

SEQ ID NO: 767905 - RNA, 21 nt, Homo sapiens
ucauaacuuggccauguucuc

SEQ ID NO: 767906 - RNA, 17 nt, Homo sapiens
ucauaaggauucaggga

SEQ ID NO: 767907 - RNA, 13 nt, Homo sapiens
ucauaauaccuca

SEQ ID NO: 767908 - RNA, 21 nt, Homo sapiens
ucauaaugugcaaagucauca

SEQ ID NO: 767909 - RNA, 17 nt, Homo sapiens
ucauaauucagcacuua

SEQ ID NO: 767910 - RNA, 22 nt, Homo sapiens
ucauacacaagucuaacaguua

SEQ ID NO: 767911 - RNA, 17 nt, Homo sapiens
ucauacacaugugcaca

SEQ ID NO: 767912 - RNA, 20 nt, Homo sapiens
ucauaccaguuguucauuga

SEQ ID NO: 767913 - RNA, 16 nt, Homo sapiens
ucauaccaucugcugc

SEQ ID NO: 767914 - RNA, 22 nt, Homo sapiens
ucauacugucugggauuaaggg

SEQ ID NO: 767915 - RNA, 17 nt, Homo sapiens
ucauagaaauauugacu

SEQ ID NO: 767916 - RNA, 17 nt, Homo sapiens
ucauagagacggagauc

SEQ ID NO: 767917 - RNA, 21 nt, Homo sapiens
ucauagaugcaggaggcucag

SEQ ID NO: 767918 - RNA, 16 nt, Homo sapiens
ucauagguuacuaccu

SEQ ID NO: 767919 - RNA, 15 nt, Homo sapiens
ucauaguaagauuga

SEQ ID NO: 767920 - RNA, 15 nt, Homo sapiens
ucauauacugccaug

SEQ ID NO: 767921 - RNA, 20 nt, Homo sapiens
ucauauaggccagaguugca

SEQ ID NO: 767922 - RNA, 20 nt, Homo sapiens
ucauauauuuuuaccaucug

SEQ ID NO: 767923 - RNA, 18 nt, Homo sapiens
ucauaucaacuuagucaa

SEQ ID NO: 767924 - RNA, 19 nt, Homo sapiens
ucauaugucaccuuugcua

SEQ ID NO: 767925 - RNA, 16 nt, Homo sapiens
ucaucaaaaagccuua

SEQ ID NO: 767926 - RNA, 19 nt, Homo sapiens
ucaucaaaucaucauuaau

SEQ ID NO: 767927 - RNA, 19 nt, Homo sapiens
ucaucaacuuauuauauga

SEQ ID NO: 767928 - RNA, 18 nt, Homo sapiens
ucaucaagcaggaauuau

SEQ ID NO: 767929 - RNA, 22 nt, Homo sapiens
ucaucagaagauaacuugagca

SEQ ID NO: 767930 - RNA, 17 nt, Homo sapiens
ucaucagaugccugcuu

SEQ ID NO: 767931 - RNA, 12 nt, Homo sapiens
ucaucaggccau

SEQ ID NO: 767932 - RNA, 14 nt, Homo sapiens
ucaucaggugcaua

SEQ ID NO: 767933 - RNA, 15 nt, Homo sapiens
ucaucaggugcauag

SEQ ID NO: 767934 - RNA, 18 nt, Homo sapiens
ucaucaggugcauagcaa

SEQ ID NO: 767935 - RNA, 22 nt, Homo sapiens
ucaucaguccauugcucuugag

SEQ ID NO: 767936 - RNA, 23 nt, Homo sapiens
ucaucaguguccucuugcucaaa

SEQ ID NO: 767937 - RNA, 21 nt, Homo sapiens
ucaucauaaaauaaaguauau

SEQ ID NO: 767938 - RNA, 14 nt, Homo sapiens
ucaucaugcuccac

SEQ ID NO: 767939 - RNA, 14 nt, Homo sapiens
ucauccaacuuaug

SEQ ID NO: 767940 - RNA, 22 nt, Homo sapiens
ucauccaauaccccuuuacuag

SEQ ID NO: 767941 - RNA, 22 nt, Homo sapiens
ucauccacucuacuaaugccuc

SEQ ID NO: 767942 - RNA, 20 nt, Homo sapiens
ucauccaggcccaacuguga

SEQ ID NO: 767943 - RNA, 19 nt, Homo sapiens
ucauccccaggggucccag

SEQ ID NO: 767944 - RNA, 16 nt, Homo sapiens
ucauccccccugcugc

SEQ ID NO: 767945 - RNA, 20 nt, Homo sapiens
ucaucccguaucacaguguu

SEQ ID NO: 767946 - RNA, 18 nt, Homo sapiens
ucaucccuuuuucugcua

SEQ ID NO: 767947 - RNA, 17 nt, Homo sapiens
ucauccuccauugcucc

SEQ ID NO: 767948 - RNA, 15 nt, Homo sapiens
ucauccugauacugu

SEQ ID NO: 767949 - RNA, 17 nt, Homo sapiens
ucauccuuccauccauc

SEQ ID NO: 767950 - RNA, 14 nt, Homo sapiens
ucaucgacuuagcc

SEQ ID NO: 767951 - RNA, 17 nt, Homo sapiens
ucaucuauaacaugcau

SEQ ID NO: 767952 - RNA, 20 nt, Homo sapiens
ucaucuauagaaagcuauau

SEQ ID NO: 767953 - RNA, 20 nt, Homo sapiens
ucaucucauuccaacuuccc

SEQ ID NO: 767954 - RNA, 13 nt, Homo sapiens
ucaucugcaaagg

SEQ ID NO: 767955 - RNA, 13 nt, Homo sapiens
ucaucuguacaua

SEQ ID NO: 767956 - RNA, 21 nt, Homo sapiens
ucaucuuccuguguccugaaa

SEQ ID NO: 767957 - RNA, 19 nt, Homo sapiens
ucaucuucuagaaucucgu

SEQ ID NO: 767958 - RNA, 16 nt, Homo sapiens
ucaucuuggaacugca

SEQ ID NO: 767959 - RNA, 20 nt, Homo sapiens
ucaucuuggaacugcauucu

SEQ ID NO: 767960 - RNA, 19 nt, Homo sapiens
ucaucuuggucacauacaa

SEQ ID NO: 767961 - RNA, 14 nt, Homo sapiens
ucaucuuuguggau

SEQ ID NO: 767962 - RNA, 15 nt, Homo sapiens
ucaugaaacugucca

SEQ ID NO: 767963 - RNA, 21 nt, Homo sapiens
ucaugaaacuguccaccaaga

SEQ ID NO: 767964 - RNA, 21 nt, Homo sapiens
ucaugaaacuuguuucacuga

SEQ ID NO: 767965 - RNA, 15 nt, Homo sapiens
ucaugaaauaugcau

SEQ ID NO: 767966 - RNA, 18 nt, Homo sapiens
ucaugaagaaaagaccuu

SEQ ID NO: 767967 - RNA, 18 nt, Homo sapiens
ucaugaagugcacaggag

SEQ ID NO: 767968 - RNA, 19 nt, Homo sapiens
ucaugagcguuagacugac

SEQ ID NO: 767969 - RNA, 21 nt, Homo sapiens
ucaugaguagugggcuaugca

SEQ ID NO: 767970 - RNA, 16 nt, Homo sapiens
ucaugauuucauuuca

SEQ ID NO: 767971 - RNA, 23 nt, Homo sapiens
ucaugccuguaaucucagcacuu

SEQ ID NO: 767972 - RNA, 15 nt, Homo sapiens
ucaugcgcaacugga

SEQ ID NO: 767973 - RNA, 14 nt, Homo sapiens
ucaugcuucacuua

SEQ ID NO: 767974 - RNA, 14 nt, Homo sapiens
ucaugcuugacaua

SEQ ID NO: 767975 - RNA, 20 nt, Homo sapiens
ucaugcuuuuucagccaugu

SEQ ID NO: 767976 - RNA, 14 nt, Homo sapiens
ucauggaacacuca

SEQ ID NO: 767977 - RNA, 22 nt, Homo sapiens
ucauggaggccaagaacuugca

SEQ ID NO: 767978 - RNA, 20 nt, Homo sapiens
ucauggaugggggaacucag

SEQ ID NO: 767979 - RNA, 17 nt, Homo sapiens
ucauggcaccaaagcca

SEQ ID NO: 767980 - RNA, 17 nt, Homo sapiens
ucauggcagcuaagcca

SEQ ID NO: 767981 - RNA, 15 nt, Homo sapiens
ucauggccagcugcc

SEQ ID NO: 767982 - RNA, 22 nt, Homo sapiens
ucauggccugagaugcagguga

SEQ ID NO: 767983 - RNA, 21 nt, Homo sapiens
ucaugggacuaaaugaacuaa

SEQ ID NO: 767984 - RNA, 19 nt, Homo sapiens
ucaugguacauuuaucacu

SEQ ID NO: 767985 - RNA, 15 nt, Homo sapiens
ucaugguuuccucca

SEQ ID NO: 767986 - RNA, 23 nt, Homo sapiens
ucaugguuuccuccagaggagac

SEQ ID NO: 767987 - RNA, 16 nt, Homo sapiens
ucauguagguugucua

SEQ ID NO: 767988 - RNA, 19 nt, Homo sapiens
ucauguauaaaacuaggaa

SEQ ID NO: 767989 - RNA, 20 nt, Homo sapiens
ucaugucgaggcuagaggca

SEQ ID NO: 767990 - RNA, 19 nt, Homo sapiens
ucaugugcugccugcaagc

SEQ ID NO: 767991 - RNA, 16 nt, Homo sapiens
ucaugugugcauguga

SEQ ID NO: 767992 - RNA, 18 nt, Homo sapiens
ucauguguugcagcuuua

SEQ ID NO: 767993 - RNA, 14 nt, Homo sapiens
ucauguuccucaaa

SEQ ID NO: 767994 - RNA, 15 nt, Homo sapiens
ucauguuccucaaaa

SEQ ID NO: 767995 - RNA, 18 nt, Homo sapiens
ucauguugaucauguacu

SEQ ID NO: 767996 - RNA, 13 nt, Homo sapiens
ucauuacaguucu

SEQ ID NO: 767997 - RNA, 18 nt, Homo sapiens
ucauuagauacaguagug

SEQ ID NO: 767998 - RNA, 20 nt, Homo sapiens
ucauuagcaguugcucacau

SEQ ID NO: 767999 - RNA, 22 nt, Homo sapiens
ucauuagggcuuuugauuuaua

SEQ ID NO: 768000 - RNA, 22 nt, Homo sapiens
ucauuauuuuuguuagcaaaga

SEQ ID NO: 768001 - RNA, 23 nt, Homo sapiens
ucauucaacucuccaauguucua

SEQ ID NO: 768002 - RNA, 23 nt, Homo sapiens
ucauucaccaaaugaugccacuu

SEQ ID NO: 768003 - RNA, 20 nt, Homo sapiens
ucauucagguauuuguaaua

SEQ ID NO: 768004 - RNA, 14 nt, Homo sapiens
ucauuccaaaaaga

SEQ ID NO: 768005 - RNA, 15 nt, Homo sapiens
ucauuccuaacacag

SEQ ID NO: 768006 - RNA, 21 nt, Homo sapiens
ucauuccugaaagaaacaguu

SEQ ID NO: 768007 - RNA, 22 nt, Homo sapiens
ucauuccugaaagaaacaguua

SEQ ID NO: 768008 - RNA, 15 nt, Homo sapiens
ucauuccuucacuca

SEQ ID NO: 768009 - RNA, 13 nt, Homo sapiens
ucauucuacugaa

SEQ ID NO: 768010 - RNA, 13 nt, Homo sapiens
ucauucucaguga

SEQ ID NO: 768011 - RNA, 16 nt, Homo sapiens
ucauucugcauugcua

SEQ ID NO: 768012 - RNA, 18 nt, Homo sapiens
ucauucuguuagauacua

SEQ ID NO: 768013 - RNA, 11 nt, Homo sapiens
ucauucuugcc

SEQ ID NO: 768014 - RNA, 14 nt, Homo sapiens
ucauugacuaucaa

SEQ ID NO: 768015 - RNA, 21 nt, Homo sapiens
ucauugacuuccugaacaacc

SEQ ID NO: 768016 - RNA, 23 nt, Homo sapiens
ucauugaugagcaagacauacuu

SEQ ID NO: 768017 - RNA, 14 nt, Homo sapiens
ucauugaugcugcu

SEQ ID NO: 768018 - RNA, 18 nt, Homo sapiens
ucauugauucguaugcca

SEQ ID NO: 768019 - RNA, 12 nt, Homo sapiens
ucauugcaccug

SEQ ID NO: 768020 - RNA, 14 nt, Homo sapiens
ucauugcacuuuga

SEQ ID NO: 768021 - RNA, 15 nt, Homo sapiens
ucauugccacacuug

SEQ ID NO: 768022 - RNA, 16 nt, Homo sapiens
ucauugcuguaccaca

SEQ ID NO: 768023 - RNA, 15 nt, Homo sapiens
ucauuggaagccauc

SEQ ID NO: 768024 - RNA, 17 nt, Homo sapiens
ucauuggccacugucuc

SEQ ID NO: 768025 - RNA, 23 nt, Homo sapiens
ucauuggccacugucuccacuca

SEQ ID NO: 768026 - RNA, 19 nt, Homo sapiens
ucauuguauuccuccugag

SEQ ID NO: 768027 - RNA, 20 nt, Homo sapiens
ucauuuagugacuuaauucu

SEQ ID NO: 768028 - RNA, 14 nt, Homo sapiens
ucauuuauauugca

SEQ ID NO: 768029 - RNA, 21 nt, Homo sapiens
ucauuuccuauguaacugcau

SEQ ID NO: 768030 - RNA, 19 nt, Homo sapiens
ucauuucugcagauggaaa

SEQ ID NO: 768031 - RNA, 14 nt, Homo sapiens
ucauuugagcucau

SEQ ID NO: 768032 - RNA, 12 nt, Homo sapiens
ucauuugcaguc

SEQ ID NO: 768033 - RNA, 18 nt, Homo sapiens
ucauuuguaguugccuua

SEQ ID NO: 768034 - RNA, 20 nt, Homo sapiens
ucauuuuaaaaaauggaaca

SEQ ID NO: 768035 - RNA, 23 nt, Homo sapiens
ucauuuuaacuuuaucacauuau

SEQ ID NO: 768036 - RNA, 23 nt, Homo sapiens
ucauuuugagcugaaaugcugca

SEQ ID NO: 768037 - RNA, 21 nt, Homo sapiens
ucauuuugccaaaaaggggua

SEQ ID NO: 768038 - RNA, 14 nt, Homo sapiens
ucauuuuguugcuu

SEQ ID NO: 768039 - RNA, 22 nt, Homo sapiens
ucauuuuuaaccucuagaguca

SEQ ID NO: 768040 - RNA, 18 nt, Homo sapiens
ucauuuuuuucacuggag

SEQ ID NO: 768041 - RNA, 13 nt, Homo sapiens
uccaaaaaugcac

SEQ ID NO: 768042 - RNA, 13 nt, Homo sapiens
uccaaaacauuuc

SEQ ID NO: 768043 - RNA, 14 nt, Homo sapiens
uccaaaacauuucu

SEQ ID NO: 768044 - RNA, 22 nt, Homo sapiens
gagguagaggggaaggaaaucu

SEQ ID NO: 768045 - RNA, 19 nt, Homo sapiens
gaggucaccagcugcugug

SEQ ID NO: 768046 - RNA, 23 nt, Homo sapiens
gaggucaggaguugaagaccagc

SEQ ID NO: 768047 - RNA, 15 nt, Homo sapiens
gaggucauacaugca

SEQ ID NO: 768048 - RNA, 14 nt, Homo sapiens
gaggucuaaucuag

SEQ ID NO: 768049 - RNA, 17 nt, Homo sapiens
gaggucuccaaacugau

SEQ ID NO: 768050 - RNA, 16 nt, Homo sapiens
gaggucucuugaggga

SEQ ID NO: 768051 - RNA, 12 nt, Homo sapiens
gaggugcagcug

SEQ ID NO: 768052 - RNA, 14 nt, Homo sapiens
gagguggagccaag

SEQ ID NO: 768053 - RNA, 15 nt, Homo sapiens
gaggugggaggugga

SEQ ID NO: 768054 - RNA, 17 nt, Homo sapiens
gaggugggcagguggug

SEQ ID NO: 768055 - RNA, 20 nt, Homo sapiens
gaggugggguacauuucucu

SEQ ID NO: 768056 - RNA, 14 nt, Homo sapiens
gagguguacaggua

SEQ ID NO: 768057 - RNA, 19 nt, Homo sapiens
gagguguuggcugcacgug

SEQ ID NO: 768058 - RNA, 12 nt, Homo sapiens
gaguaacacaua

SEQ ID NO: 768059 - RNA, 23 nt, Homo sapiens
gaguaagcccucaggagccucug

SEQ ID NO: 768060 - RNA, 23 nt, Homo sapiens
gaguaaucaauacagacaagguu

SEQ ID NO: 768061 - RNA, 16 nt, Homo sapiens
gaguagauaaaaaaca

SEQ ID NO: 768062 - RNA, 21 nt, Homo sapiens
gaguagccagaugaaauucaa

SEQ ID NO: 768063 - RNA, 13 nt, Homo sapiens
gaguagcucugcc

SEQ ID NO: 768064 - RNA, 17 nt, Homo sapiens
gaguagggacucagggc

SEQ ID NO: 768065 - RNA, 20 nt, Homo sapiens
gaguagggacucagggccau

SEQ ID NO: 768066 - RNA, 18 nt, Homo sapiens
gaguagguuuaccagaga

SEQ ID NO: 768067 - RNA, 18 nt, Homo sapiens
gaguaguauuaaaagcua

SEQ ID NO: 768068 - RNA, 12 nt, Homo sapiens
gaguauaugcac

SEQ ID NO: 768069 - RNA, 19 nt, Homo sapiens
gaguauguuaagcucuuua

SEQ ID NO: 768070 - RNA, 19 nt, Homo sapiens
gaguauuccaugagcugcu

SEQ ID NO: 768071 - RNA, 13 nt, Homo sapiens
gagucaaauccag

SEQ ID NO: 768072 - RNA, 13 nt, Homo sapiens
gagucaccaggaa

SEQ ID NO: 768073 - RNA, 13 nt, Homo sapiens
gagucacugccuc

SEQ ID NO: 768074 - RNA, 16 nt, Homo sapiens
gagucagcugcugacc

SEQ ID NO: 768075 - RNA, 22 nt, Homo sapiens
gagucaucuauucaagcacuua

SEQ ID NO: 768076 - RNA, 11 nt, Homo sapiens
gaguccaggga

SEQ ID NO: 768077 - RNA, 21 nt, Homo sapiens
gaguccaggguggaugaucuc

SEQ ID NO: 768078 - RNA, 16 nt, Homo sapiens
gaguccccuacucccu

SEQ ID NO: 768079 - RNA, 14 nt, Homo sapiens
gagucccugugaug

SEQ ID NO: 768080 - RNA, 20 nt, Homo sapiens
gaguccucguagccaucucu

SEQ ID NO: 768081 - RNA, 18 nt, Homo sapiens
gagucggagaagcuggaa

SEQ ID NO: 768082 - RNA, 22 nt, Homo sapiens
gagucuaggcuaagcacuuuau

SEQ ID NO: 768083 - RNA, 21 nt, Homo sapiens
gagucucacuuugacacccag

SEQ ID NO: 768084 - RNA, 23 nt, Homo sapiens
gagucugaauagucuucagagau

SEQ ID NO: 768085 - RNA, 15 nt, Homo sapiens
gagucugaggccuga

SEQ ID NO: 768086 - RNA, 16 nt, Homo sapiens
gagucugcacgggacc

SEQ ID NO: 768087 - RNA, 18 nt, Homo sapiens
gagucuucacuaaccuuu

SEQ ID NO: 768088 - RNA, 15 nt, Homo sapiens
gagucuuugcagaga

SEQ ID NO: 768089 - RNA, 15 nt, Homo sapiens
gagugaaugccauuu

SEQ ID NO: 768090 - RNA, 12 nt, Homo sapiens
gagugaauuuga

SEQ ID NO: 768091 - RNA, 21 nt, Homo sapiens
gagugacagagcgagacucca

SEQ ID NO: 768092 - RNA, 15 nt, Homo sapiens
gagugacagcuuucu

SEQ ID NO: 768093 - RNA, 19 nt, Homo sapiens
gagugagacccugucucaa

SEQ ID NO: 768094 - RNA, 20 nt, Homo sapiens
gagugagacuccaccucaaa

SEQ ID NO: 768095 - RNA, 21 nt, Homo sapiens
gagugagcacacccgugugca

SEQ ID NO: 768096 - RNA, 20 nt, Homo sapiens
gagugauuagagcugcauaa

SEQ ID NO: 768097 - RNA, 13 nt, Homo sapiens
gagugcacagcug

SEQ ID NO: 768098 - RNA, 20 nt, Homo sapiens
gagugcagaucugugcucau

SEQ ID NO: 768099 - RNA, 14 nt, Homo sapiens
gagugcagugccac

SEQ ID NO: 768100 - RNA, 19 nt, Homo sapiens
gagugcaguggugugaucu

SEQ ID NO: 768101 - RNA, 17 nt, Homo sapiens
gaguggaaucucuugga

SEQ ID NO: 768102 - RNA, 21 nt, Homo sapiens
gaguggcucacccuguccaga

SEQ ID NO: 768103 - RNA, 22 nt, Homo sapiens
gagugggccccgggcuggagaa

SEQ ID NO: 768104 - RNA, 20 nt, Homo sapiens
gagugggguagguugggaga

SEQ ID NO: 768105 - RNA, 19 nt, Homo sapiens
gaguggguauuugcugaca

SEQ ID NO: 768106 - RNA, 15 nt, Homo sapiens
gagugguuguugcca

SEQ ID NO: 768107 - RNA, 16 nt, Homo sapiens
gaguguagacuguggc

SEQ ID NO: 768108 - RNA, 14 nt, Homo sapiens
gagugugcugcuau

SEQ ID NO: 768109 - RNA, 13 nt, Homo sapiens
gaguguggugugu

SEQ ID NO: 768110 - RNA, 18 nt, Homo sapiens
gagugugguuaugaacuu

SEQ ID NO: 768111 - RNA, 21 nt, Homo sapiens
gagugugugauuagaagcuaa

SEQ ID NO: 768112 - RNA, 15 nt, Homo sapiens
gagugugugucuuuc

SEQ ID NO: 768113 - RNA, 22 nt, Homo sapiens
gaguguucauuuuagugacugu

SEQ ID NO: 768114 - RNA, 14 nt, Homo sapiens
gaguguuguguuaa

SEQ ID NO: 768115 - RNA, 15 nt, Homo sapiens
gaguguuguguuaaa

SEQ ID NO: 768116 - RNA, 15 nt, Homo sapiens
gaguuaaaucucaaa

SEQ ID NO: 768117 - RNA, 21 nt, Homo sapiens
gaguuaauauauagaagggua

SEQ ID NO: 768118 - RNA, 22 nt, Homo sapiens
gaguuaaugugcugagcauuuu

SEQ ID NO: 768119 - RNA, 17 nt, Homo sapiens
gaguuacuuccuaucaa

SEQ ID NO: 768120 - RNA, 18 nt, Homo sapiens
gaguuaggcuauucacaa

SEQ ID NO: 768121 - RNA, 13 nt, Homo sapiens
gaguuagugccau

SEQ ID NO: 768122 - RNA, 21 nt, Homo sapiens
gaguuauuuuuauuuauuuaa

SEQ ID NO: 768123 - RNA, 12 nt, Homo sapiens
gaguuccagacc

SEQ ID NO: 768124 - RNA, 15 nt, Homo sapiens
gaguuccuucucacu

SEQ ID NO: 768125 - RNA, 15 nt, Homo sapiens
gaguucuagaccucu

SEQ ID NO: 768126 - RNA, 23 nt, Homo sapiens
gaguucucucaucggaggcccau

SEQ ID NO: 768127 - RNA, 22 nt, Homo sapiens
gaguucuugugccauagucaca

SEQ ID NO: 768128 - RNA, 16 nt, Homo sapiens
gaguugacuucugaca

SEQ ID NO: 768129 - RNA, 15 nt, Homo sapiens
gaguugcuuugccag

SEQ ID NO: 768130 - RNA, 20 nt, Homo sapiens
gaguugugucuaggcuggaa

SEQ ID NO: 768131 - RNA, 22 nt, Homo sapiens
gaguuuaauuuuugaaaacugg

SEQ ID NO: 768132 - RNA, 14 nt, Homo sapiens
gaguuuacauucua

SEQ ID NO: 768133 - RNA, 14 nt, Homo sapiens
gaguuuagugugau

SEQ ID NO: 768134 - RNA, 21 nt, Homo sapiens
gaguuucuccuuuugaccaaa

SEQ ID NO: 768135 - RNA, 17 nt, Homo sapiens
gaguuugcaaugucaca

SEQ ID NO: 768136 - RNA, 18 nt, Homo sapiens
gaguuuugccaguucaag

SEQ ID NO: 768137 - RNA, 19 nt, Homo sapiens
gauaaaacacuaacuuaau

SEQ ID NO: 768138 - RNA, 13 nt, Homo sapiens
gauaaaacagaau

SEQ ID NO: 768139 - RNA, 12 nt, Homo sapiens
gauaaaccaguu

SEQ ID NO: 768140 - RNA, 15 nt, Homo sapiens
gauaaacgaccaaac

SEQ ID NO: 768141 - RNA, 13 nt, Homo sapiens
gauaaacucagaa

SEQ ID NO: 768142 - RNA, 11 nt, Homo sapiens
gauaaagccac

SEQ ID NO: 768143 - RNA, 13 nt, Homo sapiens
gauaaagggccaa

SEQ ID NO: 768144 - RNA, 18 nt, Homo sapiens
gauaaagucaaaugccaa

SEQ ID NO: 768145 - RNA, 20 nt, Homo sapiens
gauaaagucaaaugccaaac

SEQ ID NO: 768146 - RNA, 14 nt, Homo sapiens
gauaaaugacuguu

SEQ ID NO: 768147 - RNA, 19 nt, Homo sapiens
gaaaaagacuaagccagac

SEQ ID NO: 768148 - RNA, 16 nt, Homo sapiens
gaaaaagccugugaaa

SEQ ID NO: 768149 - RNA, 22 nt, Homo sapiens
gaaaaagcuuaaugauucugau

SEQ ID NO: 768150 - RNA, 23 nt, Homo sapiens
gaaaaauaguucuaaacuaucaa

SEQ ID NO: 768151 - RNA, 18 nt, Homo sapiens
gaaaaauaugagaaaaau

SEQ ID NO: 768152 - RNA, 23 nt, Homo sapiens
gaaaaauauugcugaacuacuuu

SEQ ID NO: 768153 - RNA, 14 nt, Homo sapiens
gaaaaaugaggaau

SEQ ID NO: 768154 - RNA, 12 nt, Homo sapiens
gaaaaaugccug

SEQ ID NO: 768155 - RNA, 22 nt, Homo sapiens
gaaaaaugggaaauagucugau

SEQ ID NO: 768156 - RNA, 17 nt, Homo sapiens
gaaaaaugguggucauu

SEQ ID NO: 768157 - RNA, 13 nt, Homo sapiens
gaaaaauuguuaa

SEQ ID NO: 768158 - RNA, 17 nt, Homo sapiens
gaaaacaaucaaauauu

SEQ ID NO: 768159 - RNA, 16 nt, Homo sapiens
gaaaacaucucaauaa

SEQ ID NO: 768160 - RNA, 14 nt, Homo sapiens
gaaaacauguacua

SEQ ID NO: 768161 - RNA, 11 nt, Homo sapiens
gaaaacauuca

SEQ ID NO: 768162 - RNA, 19 nt, Homo sapiens
gaaaaccacagucagugga

SEQ ID NO: 768163 - RNA, 21 nt, Homo sapiens
gaaaaccuagaucugcacuca

SEQ ID NO: 768164 - RNA, 18 nt, Homo sapiens
gaaaacuagcauuacauu

SEQ ID NO: 768165 - RNA, 16 nt, Homo sapiens
gaaaacucaaccagag

SEQ ID NO: 768166 - RNA, 16 nt, Homo sapiens
gaaaacugauucucua

SEQ ID NO: 768167 - RNA, 19 nt, Homo sapiens
gaaaacuuagagagguaca

SEQ ID NO: 768168 - RNA, 14 nt, Homo sapiens
gaaaagaaagugaa

SEQ ID NO: 768169 - RNA, 20 nt, Homo sapiens
gaaaagaaauugcaugcagu

SEQ ID NO: 768170 - RNA, 23 nt, Homo sapiens
gaaaagaagacucugaccuguac

SEQ ID NO: 768171 - RNA, 11 nt, Homo sapiens
gaaaagacucu

SEQ ID NO: 768172 - RNA, 15 nt, Homo sapiens
gaaaagcugccauuu

SEQ ID NO: 768173 - RNA, 18 nt, Homo sapiens
gaaaaggacuucuggcua

SEQ ID NO: 768174 - RNA, 14 nt, Homo sapiens
gaaaaggauaugca

SEQ ID NO: 768175 - RNA, 16 nt, Homo sapiens
gaaaaggcaagacuug

SEQ ID NO: 768176 - RNA, 15 nt, Homo sapiens
gaaaaggccauuaaa

SEQ ID NO: 768177 - RNA, 17 nt, Homo sapiens
gaaaaggcugcugugaa

SEQ ID NO: 768178 - RNA, 18 nt, Homo sapiens
gaaaaggucuuggugccu

SEQ ID NO: 768179 - RNA, 15 nt, Homo sapiens
gaaaagguugccuga

SEQ ID NO: 768180 - RNA, 16 nt, Homo sapiens
gaaaagguugccugaa

SEQ ID NO: 768181 - RNA, 19 nt, Homo sapiens
gaaaagucaaaguguugcu

SEQ ID NO: 768182 - RNA, 20 nt, Homo sapiens
gaaaagugcauauuuaucca

SEQ ID NO: 768183 - RNA, 19 nt, Homo sapiens
gaaaaguguccuucuugcu

SEQ ID NO: 768184 - RNA, 23 nt, Homo sapiens
gaaaaguguguauauauuuugug

SEQ ID NO: 768185 - RNA, 23 nt, Homo sapiens
gaaaaguuagucaauccugucau

SEQ ID NO: 768186 - RNA, 13 nt, Homo sapiens
gaaaaguucuccu

SEQ ID NO: 768187 - RNA, 15 nt, Homo sapiens
gaaaauaaacaccau

SEQ ID NO: 768188 - RNA, 15 nt, Homo sapiens
gaaaauaaaugucac

SEQ ID NO: 768189 - RNA, 19 nt, Homo sapiens
gaaaauagaaacuugcuua

SEQ ID NO: 768190 - RNA, 18 nt, Homo sapiens
gaaaauauagacauucuc

SEQ ID NO: 768191 - RNA, 16 nt, Homo sapiens
gaaaauauggguugca

SEQ ID NO: 768192 - RNA, 20 nt, Homo sapiens
gaaaauauugcugugucuuc

SEQ ID NO: 768193 - RNA, 17 nt, Homo sapiens
gaaaauccaggucaugc

SEQ ID NO: 768194 - RNA, 23 nt, Homo sapiens
gaaaaucuauauuugucuuccga

SEQ ID NO: 768195 - RNA, 16 nt, Homo sapiens
gaaaaugaaacuagaa

SEQ ID NO: 768196 - RNA, 18 nt, Homo sapiens
gaaaaugaauuuuuucca

SEQ ID NO: 768197 - RNA, 18 nt, Homo sapiens
gaaaauggagccaugaca

SEQ ID NO: 768198 - RNA, 14 nt, Homo sapiens
gaaaauggccaugc

SEQ ID NO: 768199 - RNA, 14 nt, Homo sapiens
gaaaauguacaaua

SEQ ID NO: 768200 - RNA, 17 nt, Homo sapiens
gaaaauguauugauuca

SEQ ID NO: 768201 - RNA, 20 nt, Homo sapiens
gaaaaugucagaaaccaguu

SEQ ID NO: 768202 - RNA, 13 nt, Homo sapiens
gaaaaugugaagc

SEQ ID NO: 768203 - RNA, 20 nt, Homo sapiens
gaaaauguuacggcaucaca

SEQ ID NO: 768204 - RNA, 18 nt, Homo sapiens
gaaaauguuuaccagugu

SEQ ID NO: 768205 - RNA, 15 nt, Homo sapiens
gaaaauuacagucca

SEQ ID NO: 768206 - RNA, 19 nt, Homo sapiens
gaaaauuagagaucaugaa

SEQ ID NO: 768207 - RNA, 21 nt, Homo sapiens
gaaaauuccuagaaauugaac

SEQ ID NO: 768208 - RNA, 12 nt, Homo sapiens
gaaaauugagag

SEQ ID NO: 768209 - RNA, 16 nt, Homo sapiens
gaaaauugcaauacau

SEQ ID NO: 768210 - RNA, 20 nt, Homo sapiens
gaaaauuguugggaggacag

SEQ ID NO: 768211 - RNA, 18 nt, Homo sapiens
gaaaauuguugugcuuag

SEQ ID NO: 768212 - RNA, 19 nt, Homo sapiens
gaaaauuuuuaaauauuca

SEQ ID NO: 768213 - RNA, 18 nt, Homo sapiens
gaaaauuuuuacauucau

SEQ ID NO: 768214 - RNA, 20 nt, Homo sapiens
gaaacaaaauccuuuucuca

SEQ ID NO: 768215 - RNA, 20 nt, Homo sapiens
gaaacaaguauuuugcuaua

SEQ ID NO: 768216 - RNA, 15 nt, Homo sapiens
gaaacaauggcuaag

SEQ ID NO: 768217 - RNA, 22 nt, Homo sapiens
gaaacacaaaccacaacugaca

SEQ ID NO: 768218 - RNA, 18 nt, Homo sapiens
gaaacacagcaacaauga

SEQ ID NO: 768219 - RNA, 18 nt, Homo sapiens
gaaacaccccucugucua

SEQ ID NO: 768220 - RNA, 21 nt, Homo sapiens
gaaacaccccucugucuagga

SEQ ID NO: 768221 - RNA, 16 nt, Homo sapiens
gaaacagaaauagacu

SEQ ID NO: 768222 - RNA, 14 nt, Homo sapiens
gaaacaugacacug

SEQ ID NO: 768223 - RNA, 18 nt, Homo sapiens
gaaacaugacacugaccu

SEQ ID NO: 768224 - RNA, 19 nt, Homo sapiens
gaaacaugacacugaccuu

SEQ ID NO: 768225 - RNA, 18 nt, Homo sapiens
gaaacauuuccuuugaac

SEQ ID NO: 768226 - RNA, 21 nt, Homo sapiens
gaaacauuuuguggucauuaa

SEQ ID NO: 768227 - RNA, 13 nt, Homo sapiens
gaaacccaaccuu

SEQ ID NO: 768228 - RNA, 17 nt, Homo sapiens
gaaacccccaguguaau

SEQ ID NO: 768229 - RNA, 14 nt, Homo sapiens
gaaaccccgucucu

SEQ ID NO: 768230 - RNA, 21 nt, Homo sapiens
gaaaccccuucuuuacuuccc

SEQ ID NO: 768231 - RNA, 18 nt, Homo sapiens
gaaaccuacacacuguca

SEQ ID NO: 768232 - RNA, 22 nt, Homo sapiens
gaaaccuacuuuuuaugugcua

SEQ ID NO: 768233 - RNA, 14 nt, Homo sapiens
gaaaccucugccuu

SEQ ID NO: 768234 - RNA, 18 nt, Homo sapiens
gaaaccugcccugccuga

SEQ ID NO: 768235 - RNA, 15 nt, Homo sapiens
gaaacggaagcucau

SEQ ID NO: 768236 - RNA, 15 nt, Homo sapiens
gaaacuauucaugaa

SEQ ID NO: 768237 - RNA, 16 nt, Homo sapiens
gaaacucaaaaauauu

SEQ ID NO: 768238 - RNA, 14 nt, Homo sapiens
gaaacucacacucc

SEQ ID NO: 768239 - RNA, 14 nt, Homo sapiens
gaaacucacaguaa

SEQ ID NO: 768240 - RNA, 12 nt, Homo sapiens
gaaacucaccac

SEQ ID NO: 768241 - RNA, 20 nt, Homo sapiens
gaaacucaccacaguguuuu

SEQ ID NO: 768242 - RNA, 14 nt, Homo sapiens
gaaacugaaacuca

SEQ ID NO: 768243 - RNA, 19 nt, Homo sapiens
gaaacugaaacucacagua

SEQ ID NO: 768244 - RNA, 17 nt, Homo sapiens
gaaacugagaccaaaga

SEQ ID NO: 768245 - RNA, 20 nt, Homo sapiens
gaaacuggaauaaguguuua

SEQ ID NO: 768246 - RNA, 14 nt, Homo sapiens
gaaacuggcacuga

SEQ ID NO: 768247 - RNA, 13 nt, Homo sapiens
gaaacuguaugaa

SEQ ID NO: 768248 - RNA, 17 nt, Homo sapiens
gaaacuguccaccaaga

SEQ ID NO: 768249 - RNA, 16 nt, Homo sapiens
gaaacuguuaucacuu

SEQ ID NO: 768250 - RNA, 14 nt, Homo sapiens
gaaacuuagaucau

SEQ ID NO: 768251 - RNA, 15 nt, Homo sapiens
gaaacuuauuucuca

SEQ ID NO: 768252 - RNA, 14 nt, Homo sapiens
gaaacuugaugcca

SEQ ID NO: 768253 - RNA, 20 nt, Homo sapiens
gaaacuugcauacagagaca

SEQ ID NO: 768254 - RNA, 19 nt, Homo sapiens
gaaacuugugaaguggaaa

SEQ ID NO: 768255 - RNA, 16 nt, Homo sapiens
gaaacuuuaauccaaa

SEQ ID NO: 768256 - RNA, 18 nt, Homo sapiens
gaaacuuuaauccaaaga

SEQ ID NO: 768257 - RNA, 14 nt, Homo sapiens
gaaacuuucaaaag

SEQ ID NO: 768258 - RNA, 14 nt, Homo sapiens
gaaacuuuuguacu

SEQ ID NO: 768259 - RNA, 16 nt, Homo sapiens
gaaagaaaaagcaaua

SEQ ID NO: 768260 - RNA, 23 nt, Homo sapiens
gaaagaaguccuuucucuuuauu

SEQ ID NO: 768261 - RNA, 15 nt, Homo sapiens
gaaagaaucagucuu

SEQ ID NO: 768262 - RNA, 22 nt, Homo sapiens
gcucuuucucugccagugacag

SEQ ID NO: 768263 - RNA, 17 nt, Homo sapiens
gcucuuuugcacaagga

SEQ ID NO: 768264 - RNA, 15 nt, Homo sapiens
gcugaaaaaacaccu

SEQ ID NO: 768265 - RNA, 14 nt, Homo sapiens
gcugaaaagggcac

SEQ ID NO: 768266 - RNA, 16 nt, Homo sapiens
gcugaagaacaucugg

SEQ ID NO: 768267 - RNA, 14 nt, Homo sapiens
gcugaagaaugaag

SEQ ID NO: 768268 - RNA, 15 nt, Homo sapiens
gcugaagugucacag

SEQ ID NO: 768269 - RNA, 23 nt, Homo sapiens
gcugaauguaugucagugcuaua

SEQ ID NO: 768270 - RNA, 15 nt, Homo sapiens
gcugaaugucauuuu

SEQ ID NO: 768271 - RNA, 11 nt, Homo sapiens
gcugacaauaa

SEQ ID NO: 768272 - RNA, 18 nt, Homo sapiens
gcugacaucuguguuuca

SEQ ID NO: 768273 - RNA, 23 nt, Homo sapiens
gcugacaugcucacacauuacaa

SEQ ID NO: 768274 - RNA, 18 nt, Homo sapiens
gcugacuagaagggccag

SEQ ID NO: 768275 - RNA, 16 nt, Homo sapiens
gcugagaauguggaau

SEQ ID NO: 768276 - RNA, 20 nt, Homo sapiens
gcugagaucacgccacugca

SEQ ID NO: 768277 - RNA, 13 nt, Homo sapiens
gcugagauuacag

SEQ ID NO: 768278 - RNA, 23 nt, Homo sapiens
gcugagauuacagacaugagccu

SEQ ID NO: 768279 - RNA, 14 nt, Homo sapiens
gcugagauuccugg

SEQ ID NO: 768280 - RNA, 23 nt, Homo sapiens
gcugagcagguguucuucauuac

SEQ ID NO: 768281 - RNA, 15 nt, Homo sapiens
gcugaggcaggagga

SEQ ID NO: 768282 - RNA, 20 nt, Homo sapiens
gcugaggcccccagcugccu

SEQ ID NO: 768283 - RNA, 15 nt, Homo sapiens
gcugaggccugugaa

SEQ ID NO: 768284 - RNA, 19 nt, Homo sapiens
gcugagguuugcacuuccu

SEQ ID NO: 768285 - RNA, 17 nt, Homo sapiens
gcugaguagcucugccu

SEQ ID NO: 768286 - RNA, 15 nt, Homo sapiens
gcugagucagacugu

SEQ ID NO: 768287 - RNA, 14 nt, Homo sapiens
gcugaguccuugcu

SEQ ID NO: 768288 - RNA, 22 nt, Homo sapiens
gcugagugcuagaguaggugca

SEQ ID NO: 768289 - RNA, 13 nt, Homo sapiens
gcugaucucaggg

SEQ ID NO: 768290 - RNA, 24 nt, Homo sapiens
gcugaugagugauugacacacagc

SEQ ID NO: 768291 - RNA, 17 nt, Homo sapiens
gcugaugaugucucuug

SEQ ID NO: 768292 - RNA, 17 nt, Homo sapiens
gcugaugccuccuuggc

SEQ ID NO: 768293 - RNA, 20 nt, Homo sapiens
gcugauuauuuaugaccuga

SEQ ID NO: 768294 - RNA, 17 nt, Homo sapiens
gcugcaaagccuuucca

SEQ ID NO: 768295 - RNA, 21 nt, Homo sapiens
gcugcaaauaaggacagcagc

SEQ ID NO: 768296 - RNA, 19 nt, Homo sapiens
gcugcaccacuuccagggu

SEQ ID NO: 768297 - RNA, 13 nt, Homo sapiens
gcugcagauuucc

SEQ ID NO: 768298 - RNA, 21 nt, Homo sapiens
gcugcagguguucugcugaua

SEQ ID NO: 768299 - RNA, 17 nt, Homo sapiens
gcugcaguauguugcca

SEQ ID NO: 768300 - RNA, 20 nt, Homo sapiens
gcugcagugacgugcaccug

SEQ ID NO: 768301 - RNA, 13 nt, Homo sapiens
gcugccaaggaaa

SEQ ID NO: 768302 - RNA, 15 nt, Homo sapiens
gcugccauccaugug

SEQ ID NO: 768303 - RNA, 22 nt, Homo sapiens
gcugccauccaugugcuaguca

SEQ ID NO: 768304 - RNA, 24 nt, Homo sapiens
gcugccauuucccuucuggacacu

SEQ ID NO: 768305 - RNA, 16 nt, Homo sapiens
gcugcccugucuggaa

SEQ ID NO: 768306 - RNA, 23 nt, Homo sapiens
gcugcccugucuggaacauggac

SEQ ID NO: 768307 - RNA, 19 nt, Homo sapiens
gcugccucccuggggacca

SEQ ID NO: 768308 - RNA, 20 nt, Homo sapiens
gcugccugguauauccaaaa

SEQ ID NO: 768309 - RNA, 13 nt, Homo sapiens
gcugcuaaugugu

SEQ ID NO: 768310 - RNA, 18 nt, Homo sapiens
gcugcuacuacuccugua

SEQ ID NO: 768311 - RNA, 15 nt, Homo sapiens
gcugcucaggcccau

SEQ ID NO: 768312 - RNA, 19 nt, Homo sapiens
gcugcuccaucaccugguu

SEQ ID NO: 768313 - RNA, 13 nt, Homo sapiens
gcugcuccgcccg

SEQ ID NO: 768314 - RNA, 22 nt, Homo sapiens
gcugcucuucaucccauuccag

SEQ ID NO: 768315 - RNA, 19 nt, Homo sapiens
gcugcugagggucugggau

SEQ ID NO: 768316 - RNA, 11 nt, Homo sapiens
gcugcugcuac

SEQ ID NO: 768317 - RNA, 12 nt, Homo sapiens
gcugcugcugcc

SEQ ID NO: 768318 - RNA, 23 nt, Homo sapiens
gcugcugcuuagcuugcaccuug

SEQ ID NO: 768319 - RNA, 13 nt, Homo sapiens
gcugcuggggaag

SEQ ID NO: 768320 - RNA, 12 nt, Homo sapiens
gcugcugugaac

SEQ ID NO: 768321 - RNA, 16 nt, Homo sapiens
gcugcuguggggacca

SEQ ID NO: 768322 - RNA, 14 nt, Homo sapiens
gcuggaaaugcuga

SEQ ID NO: 768323 - RNA, 13 nt, Homo sapiens
gcuggaagggaaa

SEQ ID NO: 768324 - RNA, 23 nt, Homo sapiens
gcuggaauuacaaaacucagaga

SEQ ID NO: 768325 - RNA, 17 nt, Homo sapiens
gcuggacuucuaccugc

SEQ ID NO: 768326 - RNA, 16 nt, Homo sapiens
gcuggagaggaaccca

SEQ ID NO: 768327 - RNA, 14 nt, Homo sapiens
gcuggagcagcgga

SEQ ID NO: 768328 - RNA, 16 nt, Homo sapiens
gcuggagucucagagc

SEQ ID NO: 768329 - RNA, 21 nt, Homo sapiens
gcuggagucucagagcacaga

SEQ ID NO: 768330 - RNA, 14 nt, Homo sapiens
gcuggagugcagua

SEQ ID NO: 768331 - RNA, 15 nt, Homo sapiens
gcuggagugcagugg

SEQ ID NO: 768332 - RNA, 20 nt, Homo sapiens
gcuggagugcaguggugcca

SEQ ID NO: 768333 - RNA, 17 nt, Homo sapiens
gcuggauaaaaugaggu

SEQ ID NO: 768334 - RNA, 22 nt, Homo sapiens
gcuggaucacuugaguucagga

SEQ ID NO: 768335 - RNA, 22 nt, Homo sapiens
gcuggauuacaggcaugugcca

SEQ ID NO: 768336 - RNA, 22 nt, Homo sapiens
gcuggccaaagagccuuuccaa

SEQ ID NO: 768337 - RNA, 17 nt, Homo sapiens
gcuggccaaauagcaaa

SEQ ID NO: 768338 - RNA, 16 nt, Homo sapiens
gcuggccagugcugcc

SEQ ID NO: 768339 - RNA, 17 nt, Homo sapiens
gcuggccccuucugggg

SEQ ID NO: 768340 - RNA, 13 nt, Homo sapiens
gcuggcccugccg

SEQ ID NO: 768341 - RNA, 20 nt, Homo sapiens
gcugggaaaaaaguuuugau

SEQ ID NO: 768342 - RNA, 16 nt, Homo sapiens
gcuugcaauguaguca

SEQ ID NO: 768343 - RNA, 15 nt, Homo sapiens
gcuugcaugcuugca

SEQ ID NO: 768344 - RNA, 22 nt, Homo sapiens
gcuuggaaaggaccaguaugcu

SEQ ID NO: 768345 - RNA, 11 nt, Homo sapiens
gcuuggaagaa

SEQ ID NO: 768346 - RNA, 14 nt, Homo sapiens
gcuuggaagccagg

SEQ ID NO: 768347 - RNA, 17 nt, Homo sapiens
gcuuggaagccagguac

SEQ ID NO: 768348 - RNA, 22 nt, Homo sapiens
gcuuggacugaagggguucuca

SEQ ID NO: 768349 - RNA, 16 nt, Homo sapiens
gcuuggaguucucuau

SEQ ID NO: 768350 - RNA, 19 nt, Homo sapiens
gcuuggggccaccaaagcu

SEQ ID NO: 768351 - RNA, 16 nt, Homo sapiens
gcuugggugugcugac

SEQ ID NO: 768352 - RNA, 13 nt, Homo sapiens
gcuugucaggggg

SEQ ID NO: 768353 - RNA, 19 nt, Homo sapiens
gcuuguccugcucucuuca

SEQ ID NO: 768354 - RNA, 20 nt, Homo sapiens
gcuugucuuaaaauaaugaa

SEQ ID NO: 768355 - RNA, 16 nt, Homo sapiens
gcuuguuuacagcacu

SEQ ID NO: 768356 - RNA, 17 nt, Homo sapiens
gcuuguuucuauacugu

SEQ ID NO: 768357 - RNA, 23 nt, Homo sapiens
gcuuuaaugagugcaccugccuc

SEQ ID NO: 768358 - RNA, 15 nt, Homo sapiens
gcuuuacugcaugaa

SEQ ID NO: 768359 - RNA, 14 nt, Homo sapiens
gcuuuagcacagga

SEQ ID NO: 768360 - RNA, 13 nt, Homo sapiens
gcuuuagggcaau

SEQ ID NO: 768361 - RNA, 12 nt, Homo sapiens
gcuuuagucacu

SEQ ID NO: 768362 - RNA, 15 nt, Homo sapiens
gcuuuagucacuaau

SEQ ID NO: 768363 - RNA, 12 nt, Homo sapiens
gcuuuaugcaaa

SEQ ID NO: 768364 - RNA, 15 nt, Homo sapiens
gcuuuaugcaaauac

SEQ ID NO: 768365 - RNA, 13 nt, Homo sapiens
gcuuuaugcacau

SEQ ID NO: 768366 - RNA, 21 nt, Homo sapiens
gcuuuauuuuuuaaguauuua

SEQ ID NO: 768367 - RNA, 14 nt, Homo sapiens
gcuuucaacacaca

SEQ ID NO: 768368 - RNA, 14 nt, Homo sapiens
gcuuucaagcucau

SEQ ID NO: 768369 - RNA, 15 nt, Homo sapiens
gcuuucaagcucauc

SEQ ID NO: 768370 - RNA, 20 nt, Homo sapiens
gcuuucauaaacuucaggga

SEQ ID NO: 768371 - RNA, 18 nt, Homo sapiens
gcuuuccaauguagcuca

SEQ ID NO: 768372 - RNA, 19 nt, Homo sapiens
gcuuuccguggcacugcau

SEQ ID NO: 768373 - RNA, 19 nt, Homo sapiens
gcuuucugaagcuuuacca

SEQ ID NO: 768374 - RNA, 15 nt, Homo sapiens
gcuuucuuaaugugu

SEQ ID NO: 768375 - RNA, 22 nt, Homo sapiens
gcuuugagagcaacgucacugg

SEQ ID NO: 768376 - RNA, 16 nt, Homo sapiens
gcuuugcccaccccuc

SEQ ID NO: 768377 - RNA, 14 nt, Homo sapiens
gcuuugccuauuga

SEQ ID NO: 768378 - RNA, 12 nt, Homo sapiens
gcuuugcucaaa

SEQ ID NO: 768379 - RNA, 17 nt, Homo sapiens
gcuuugcugcuaugaaa

SEQ ID NO: 768380 - RNA, 21 nt, Homo sapiens
uccaaaacuuuaaugaacuaa

SEQ ID NO: 768381 - RNA, 13 nt, Homo sapiens
uccaaaagcacau

SEQ ID NO: 768382 - RNA, 18 nt, Homo sapiens
uccaaaagugauagugug

SEQ ID NO: 768383 - RNA, 21 nt, Homo sapiens
uccaaacagaccccuguucau

SEQ ID NO: 768384 - RNA, 14 nt, Homo sapiens
uccaaacugccuaa

SEQ ID NO: 768385 - RNA, 22 nt, Homo sapiens
uccaaaguuauccccuccuuua

SEQ ID NO: 768386 - RNA, 19 nt, Homo sapiens
uccaacaacgacacauuca

SEQ ID NO: 768387 - RNA, 17 nt, Homo sapiens
uccaacagccagugugu

SEQ ID NO: 768388 - RNA, 18 nt, Homo sapiens
uccaacagccagugugug

SEQ ID NO: 768389 - RNA, 19 nt, Homo sapiens
uccaacauuucucacugaa

SEQ ID NO: 768390 - RNA, 21 nt, Homo sapiens
uccaacauuucucacugaaag

SEQ ID NO: 768391 - RNA, 15 nt, Homo sapiens
uccaacccacuggcc

SEQ ID NO: 768392 - RNA, 14 nt, Homo sapiens
uccaacccagccac

SEQ ID NO: 768393 - RNA, 22 nt, Homo sapiens
uccaacccagccacgacugcca

SEQ ID NO: 768394 - RNA, 19 nt, Homo sapiens
uccaaccccccaccugcca

SEQ ID NO: 768395 - RNA, 21 nt, Homo sapiens
uccaaccccccaccugccauu

SEQ ID NO: 768396 - RNA, 23 nt, Homo sapiens
uccaaccugaagguccccuggca

SEQ ID NO: 768397 - RNA, 22 nt, Homo sapiens
uccaaccugagaaauggccaaa

SEQ ID NO: 768398 - RNA, 15 nt, Homo sapiens
uccaaccuucccaaa

SEQ ID NO: 768399 - RNA, 16 nt, Homo sapiens
uccaacguggcccaga

SEQ ID NO: 768400 - RNA, 22 nt, Homo sapiens
uccaacucagauugagcccuac

SEQ ID NO: 768401 - RNA, 12 nt, Homo sapiens
uccaacuguaua

SEQ ID NO: 768402 - RNA, 16 nt, Homo sapiens
uccaacuucccaguuc

SEQ ID NO: 768403 - RNA, 18 nt, Homo sapiens
uccaacuuuaucauggaa

SEQ ID NO: 768404 - RNA, 20 nt, Homo sapiens
uccaagcaaaaacaaauggg

SEQ ID NO: 768405 - RNA, 14 nt, Homo sapiens
uccaagcauaccaa

SEQ ID NO: 768406 - RNA, 22 nt, Homo sapiens
uccaagccauucacuuccccaa

SEQ ID NO: 768407 - RNA, 20 nt, Homo sapiens
uccaagcgcgguuacuaugg

SEQ ID NO: 768408 - RNA, 22 nt, Homo sapiens
uccaagcgcgguuacuauggcc

SEQ ID NO: 768409 - RNA, 19 nt, Homo sapiens
uccaaggauggaccacaca

SEQ ID NO: 768410 - RNA, 17 nt, Homo sapiens
uccaagugccacaugcc

SEQ ID NO: 768411 - RNA, 21 nt, Homo sapiens
uccaaguuccccaucccuguc

SEQ ID NO: 768412 - RNA, 17 nt, Homo sapiens
uccaaguugcuaauaca

SEQ ID NO: 768413 - RNA, 11 nt, Homo sapiens
uccaauacugc

SEQ ID NO: 768414 - RNA, 11 nt, Homo sapiens
uccaaugucaa

SEQ ID NO: 768415 - RNA, 16 nt, Homo sapiens
uccaauuaguuuccuu

SEQ ID NO: 768416 - RNA, 19 nt, Homo sapiens
uccaauuuggaaucuucuc

SEQ ID NO: 768417 - RNA, 21 nt, Homo sapiens
uccacaaaugguggguacaaa

SEQ ID NO: 768418 - RNA, 17 nt, Homo sapiens
uccacaagagugaauuu

SEQ ID NO: 768419 - RNA, 20 nt, Homo sapiens
uccacaagauucccagagac

SEQ ID NO: 768420 - RNA, 15 nt, Homo sapiens
uccacaauagucaga

SEQ ID NO: 768421 - RNA, 22 nt, Homo sapiens
uccacaaugaugaugauuucag

SEQ ID NO: 768422 - RNA, 14 nt, Homo sapiens
uccacagaaauaca

SEQ ID NO: 768423 - RNA, 17 nt, Homo sapiens
uccacagccccaaccuc

SEQ ID NO: 768424 - RNA, 22 nt, Homo sapiens
uccacagcuuacagcaauuuga

SEQ ID NO: 768425 - RNA, 17 nt, Homo sapiens
uccacaggcaacgcaga

SEQ ID NO: 768426 - RNA, 21 nt, Homo sapiens
uccacaggcaacgcagaccaa

SEQ ID NO: 768427 - RNA, 14 nt, Homo sapiens
uccacagugcugcu

SEQ ID NO: 768428 - RNA, 16 nt, Homo sapiens
uccacaucuuuacuca

SEQ ID NO: 768429 - RNA, 21 nt, Homo sapiens
uccacauggaaucaaucuuua

SEQ ID NO: 768430 - RNA, 18 nt, Homo sapiens
uccaccaagaucaagcag

SEQ ID NO: 768431 - RNA, 16 nt, Homo sapiens
uccaccaccuugccaa

SEQ ID NO: 768432 - RNA, 17 nt, Homo sapiens
uccacccacaacaucua

SEQ ID NO: 768433 - RNA, 19 nt, Homo sapiens
uccacccacaguucagacc

SEQ ID NO: 768434 - RNA, 22 nt, Homo sapiens
uccacccuguuuaaagauuuca

SEQ ID NO: 768435 - RNA, 13 nt, Homo sapiens
uccacccuuggcc

SEQ ID NO: 768436 - RNA, 16 nt, Homo sapiens
uccaccgccacugggc

SEQ ID NO: 768437 - RNA, 16 nt, Homo sapiens
uccaccuagacuguaa

SEQ ID NO: 768438 - RNA, 21 nt, Homo sapiens
uccaccucaucacuggacugc

SEQ ID NO: 768439 - RNA, 17 nt, Homo sapiens
uccaccugaggaacugu

SEQ ID NO: 768440 - RNA, 12 nt, Homo sapiens
uccaccuuccau

SEQ ID NO: 768441 - RNA, 14 nt, Homo sapiens
uccacgauggugga

SEQ ID NO: 768442 - RNA, 16 nt, Homo sapiens
uccacgauucacucau

SEQ ID NO: 768443 - RNA, 17 nt, Homo sapiens
uccacgccucugcugua

SEQ ID NO: 768444 - RNA, 16 nt, Homo sapiens
uccacgucuuuucuca

SEQ ID NO: 768445 - RNA, 14 nt, Homo sapiens
uccacuacugcuac

SEQ ID NO: 768446 - RNA, 15 nt, Homo sapiens
uccacuauuaaucuu

SEQ ID NO: 768447 - RNA, 18 nt, Homo sapiens
uccacuauuuucaaagaa

SEQ ID NO: 768448 - RNA, 22 nt, Homo sapiens
uccacucagcuguccugcagca

SEQ ID NO: 768449 - RNA, 21 nt, Homo sapiens
uccacuggcuuuugccuguaa

SEQ ID NO: 768450 - RNA, 11 nt, Homo sapiens
uccacuuagaa

SEQ ID NO: 768451 - RNA, 16 nt, Homo sapiens
uccacuuauaaaggaa

SEQ ID NO: 768452 - RNA, 19 nt, Homo sapiens
uccacuuguuugcacugug

SEQ ID NO: 768453 - RNA, 18 nt, Homo sapiens
uccagaaaguaaagguga

SEQ ID NO: 768454 - RNA, 21 nt, Homo sapiens
uccagaaauugugugugcaag

SEQ ID NO: 768455 - RNA, 13 nt, Homo sapiens
uccagaacacaga

SEQ ID NO: 768456 - RNA, 14 nt, Homo sapiens
uccagaacacggcu

SEQ ID NO: 768457 - RNA, 20 nt, Homo sapiens
uccagaaccgacgcaugaag

SEQ ID NO: 768458 - RNA, 14 nt, Homo sapiens
uccagaagaugaga

SEQ ID NO: 768459 - RNA, 19 nt, Homo sapiens
uccagaagcuguacuuuua

SEQ ID NO: 768460 - RNA, 17 nt, Homo sapiens
uccagaauccugauggu

SEQ ID NO: 768461 - RNA, 22 nt, Homo sapiens
uccagaaucgcuagacuaagaa

SEQ ID NO: 768462 - RNA, 13 nt, Homo sapiens
uccagacacuuaa

SEQ ID NO: 768463 - RNA, 14 nt, Homo sapiens
uccagacacuuaac

SEQ ID NO: 768464 - RNA, 15 nt, Homo sapiens
uccagacauacgaaa

SEQ ID NO: 768465 - RNA, 14 nt, Homo sapiens
uccagaccuuauca

SEQ ID NO: 768466 - RNA, 21 nt, Homo sapiens
uccagacuugaaauucucauc

SEQ ID NO: 768467 - RNA, 23 nt, Homo sapiens
uccagagguauuccucucuuaaa

SEQ ID NO: 768468 - RNA, 15 nt, Homo sapiens
uccagaguaugcaac

SEQ ID NO: 768469 - RNA, 17 nt, Homo sapiens
uccagaucacugccaca

SEQ ID NO: 768470 - RNA, 14 nt, Homo sapiens
uccagaucagauuc

SEQ ID NO: 768471 - RNA, 13 nt, Homo sapiens
uccagcagucagu

SEQ ID NO: 768472 - RNA, 16 nt, Homo sapiens
uccagcauuuagcugg

SEQ ID NO: 768473 - RNA, 17 nt, Homo sapiens
uccagccgccauugcca

SEQ ID NO: 768474 - RNA, 22 nt, Homo sapiens
uccagccugaauguuauuuccu

SEQ ID NO: 768475 - RNA, 18 nt, Homo sapiens
uccagcucaugacacugu

SEQ ID NO: 768476 - RNA, 17 nt, Homo sapiens
uccagcucccacucccu

SEQ ID NO: 768477 - RNA, 21 nt, Homo sapiens
uccaggaauuuugugugauug

SEQ ID NO: 768478 - RNA, 16 nt, Homo sapiens
uccaggagagagccag

SEQ ID NO: 768479 - RNA, 17 nt, Homo sapiens
uccaggaggcaguggac

SEQ ID NO: 768480 - RNA, 14 nt, Homo sapiens
uccaggaggcccug

SEQ ID NO: 768481 - RNA, 19 nt, Homo sapiens
uccaggauuuuaauuucag

SEQ ID NO: 768482 - RNA, 15 nt, Homo sapiens
uccaggcagauccag

SEQ ID NO: 768483 - RNA, 14 nt, Homo sapiens
uccaggcaggccag

SEQ ID NO: 768484 - RNA, 18 nt, Homo sapiens
uccaggcccacggcucaa

SEQ ID NO: 768485 - RNA, 15 nt, Homo sapiens
uccagggacacuuuu

SEQ ID NO: 768486 - RNA, 21 nt, Homo sapiens
uccagggcuccaaaucugccu

SEQ ID NO: 768487 - RNA, 21 nt, Homo sapiens
uccaggguauggccauggagu

SEQ ID NO: 768488 - RNA, 18 nt, Homo sapiens
uccagggucccucugugu

SEQ ID NO: 768489 - RNA, 18 nt, Homo sapiens
uccaggguggaugaucuc

SEQ ID NO: 768490 - RNA, 21 nt, Homo sapiens
uccagguggagacccugagaa

SEQ ID NO: 768491 - RNA, 20 nt, Homo sapiens
uccagguggcgugagaggca

SEQ ID NO: 768492 - RNA, 21 nt, Homo sapiens
uccagguuauugcaauaaagu

SEQ ID NO: 768493 - RNA, 14 nt, Homo sapiens
uccaguacugggag

SEQ ID NO: 768494 - RNA, 20 nt, Homo sapiens
uccaguagugggaucaucca

SEQ ID NO: 768495 - RNA, 16 nt, Homo sapiens
ucugucacccagguug

SEQ ID NO: 768496 - RNA, 19 nt, Homo sapiens
ucuguccacgauucacuca

SEQ ID NO: 768497 - RNA, 12 nt, Homo sapiens
ucuguccaggcc

SEQ ID NO: 768498 - RNA, 19 nt, Homo sapiens
ucuguccccgcuccccuaa

SEQ ID NO: 768499 - RNA, 18 nt, Homo sapiens
ucuguccguuuacuccaa

SEQ ID NO: 768500 - RNA, 13 nt, Homo sapiens
ucugucugcauuu

SEQ ID NO: 768501 - RNA, 15 nt, Homo sapiens
ucugucuucuuugcc

SEQ ID NO: 768502 - RNA, 23 nt, Homo sapiens
ucugucuugaugugucaucuaau

SEQ ID NO: 768503 - RNA, 22 nt, Homo sapiens
ucugugaaaagggaucugcucc

SEQ ID NO: 768504 - RNA, 16 nt, Homo sapiens
ucugugaaauucucag

SEQ ID NO: 768505 - RNA, 17 nt, Homo sapiens
ucugugaaauucucaga

SEQ ID NO: 768506 - RNA, 18 nt, Homo sapiens
ucugugacccaucuguag

SEQ ID NO: 768507 - RNA, 21 nt, Homo sapiens
ucugugaggggcucucucaug

SEQ ID NO: 768508 - RNA, 22 nt, Homo sapiens
ucugugcaaauccuugauacug

SEQ ID NO: 768509 - RNA, 18 nt, Homo sapiens
ucugugcaguaagccugu

SEQ ID NO: 768510 - RNA, 14 nt, Homo sapiens
ucugugccugaaua

SEQ ID NO: 768511 - RNA, 19 nt, Homo sapiens
ucugugcucugaaugggag

SEQ ID NO: 768512 - RNA, 20 nt, Homo sapiens
ucugugcugaggccuuauca

SEQ ID NO: 768513 - RNA, 14 nt, Homo sapiens
ucuguggaaugauu

SEQ ID NO: 768514 - RNA, 17 nt, Homo sapiens
ucugugggcacuggugg

SEQ ID NO: 768515 - RNA, 19 nt, Homo sapiens
ucuguguguguguaugugg

SEQ ID NO: 768516 - RNA, 14 nt, Homo sapiens
ucuguguuaggggu

SEQ ID NO: 768517 - RNA, 20 nt, Homo sapiens
ucuguguuuuugaaauauua

SEQ ID NO: 768518 - RNA, 19 nt, Homo sapiens
ucuguuaacaucuagccua

SEQ ID NO: 768519 - RNA, 20 nt, Homo sapiens
ucuguuaauagucaucacau

SEQ ID NO: 768520 - RNA, 18 nt, Homo sapiens
ucuguuaugcugugacac

SEQ ID NO: 768521 - RNA, 13 nt, Homo sapiens
ucuguucacuuuu

SEQ ID NO: 768522 - RNA, 17 nt, Homo sapiens
ucuguugaaaagcacac

SEQ ID NO: 768523 - RNA, 12 nt, Homo sapiens
ucuguugauuga

SEQ ID NO: 768524 - RNA, 15 nt, Homo sapiens
ucuguugauugauga

SEQ ID NO: 768525 - RNA, 20 nt, Homo sapiens
ucuguuggauaauuagcagu

SEQ ID NO: 768526 - RNA, 13 nt, Homo sapiens
ucuguuuagugaa

SEQ ID NO: 768527 - RNA, 20 nt, Homo sapiens
ucuguuuauggccacauuua

SEQ ID NO: 768528 - RNA, 19 nt, Homo sapiens
ucuguuuauucuuccagaa

SEQ ID NO: 768529 - RNA, 19 nt, Homo sapiens
ucuguuucaaacugaauuu

SEQ ID NO: 768530 - RNA, 17 nt, Homo sapiens
ucuguuucaaagcacaa

SEQ ID NO: 768531 - RNA, 14 nt, Homo sapiens
ucuguuucaaugua

SEQ ID NO: 768532 - RNA, 15 nt, Homo sapiens
ucuguuucaauguau

SEQ ID NO: 768533 - RNA, 22 nt, Homo sapiens
ucuguuucuuaagggcacacac

SEQ ID NO: 768534 - RNA, 23 nt, Homo sapiens
ucuguuugaaauucuagagccag

SEQ ID NO: 768535 - RNA, 14 nt, Homo sapiens
ucuguuugagauuu

SEQ ID NO: 768536 - RNA, 14 nt, Homo sapiens
ucuguuuugcauau

SEQ ID NO: 768537 - RNA, 18 nt, Homo sapiens
ucuuaaaacacuuuucaa

SEQ ID NO: 768538 - RNA, 22 nt, Homo sapiens
ucuuaaauuuucuuccuuugaa

SEQ ID NO: 768539 - RNA, 14 nt, Homo sapiens
ucuuaacaaacucu

SEQ ID NO: 768540 - RNA, 14 nt, Homo sapiens
ucuuuaagaugugu

SEQ ID NO: 768541 - RNA, 24 nt, Homo sapiens
ucuuuaaguauuuguuccugccac

SEQ ID NO: 768542 - RNA, 17 nt, Homo sapiens
ucuuuacaaagaaaaaa

SEQ ID NO: 768543 - RNA, 21 nt, Homo sapiens
ucuuuacuauguuucucagau

SEQ ID NO: 768544 - RNA, 17 nt, Homo sapiens
ucuuuagcaugcuacag

SEQ ID NO: 768545 - RNA, 13 nt, Homo sapiens
ucuuuauaauucu

SEQ ID NO: 768546 - RNA, 12 nt, Homo sapiens
ucuuuaugaucu

SEQ ID NO: 768547 - RNA, 13 nt, Homo sapiens
ucuuuaugaucug

SEQ ID NO: 768548 - RNA, 16 nt, Homo sapiens
ucuuucaauucuucau

SEQ ID NO: 768549 - RNA, 12 nt, Homo sapiens
ucuuucacuuca

SEQ ID NO: 768550 - RNA, 12 nt, Homo sapiens
ucuuucagagag

SEQ ID NO: 768551 - RNA, 20 nt, Homo sapiens
ucuuucagcagaaaugaaau

SEQ ID NO: 768552 - RNA, 21 nt, Homo sapiens
ucuuucaguggcuaccuacau

SEQ ID NO: 768553 - RNA, 16 nt, Homo sapiens
ucuuuccucuuucugc

SEQ ID NO: 768554 - RNA, 17 nt, Homo sapiens
ucuuucgucuacugcaa

SEQ ID NO: 768555 - RNA, 12 nt, Homo sapiens
ucuuucuaccuc

SEQ ID NO: 768556 - RNA, 20 nt, Homo sapiens
ucuuucucaaagaaauauua

SEQ ID NO: 768557 - RNA, 20 nt, Homo sapiens
ucuuucucagauuccaugca

SEQ ID NO: 768558 - RNA, 17 nt, Homo sapiens
ucuuucuuguuugucag

SEQ ID NO: 768559 - RNA, 13 nt, Homo sapiens
ucuuucuuuccaa

SEQ ID NO: 768560 - RNA, 19 nt, Homo sapiens
ucuuucuuugcaccaaaga

SEQ ID NO: 768561 - RNA, 14 nt, Homo sapiens
ucuuugcaccaaag

SEQ ID NO: 768562 - RNA, 17 nt, Homo sapiens
ucuuugcaccaaagaca

SEQ ID NO: 768563 - RNA, 23 nt, Homo sapiens
ucuuugccagacaacuuguccug

SEQ ID NO: 768564 - RNA, 17 nt, Homo sapiens
ucuuugccagucauuca

SEQ ID NO: 768565 - RNA, 17 nt, Homo sapiens
ucuuugccuuuaucucu

SEQ ID NO: 768566 - RNA, 15 nt, Homo sapiens
ucuuugcucaacaga

SEQ ID NO: 768567 - RNA, 19 nt, Homo sapiens
ucuuugcucccugcaagaa

SEQ ID NO: 768568 - RNA, 18 nt, Homo sapiens
ucuuugcugccagccacu

SEQ ID NO: 768569 - RNA, 14 nt, Homo sapiens
ucuuugcugcugcu

SEQ ID NO: 768570 - RNA, 19 nt, Homo sapiens
ucuuuguaaugucaccacc

SEQ ID NO: 768571 - RNA, 16 nt, Homo sapiens
ucuuuguauaugcauu

SEQ ID NO: 768572 - RNA, 17 nt, Homo sapiens
ucuuuguauaugcauuc

SEQ ID NO: 768573 - RNA, 12 nt, Homo sapiens
ucuuuguggcag

SEQ ID NO: 768574 - RNA, 15 nt, Homo sapiens
ucuuuguuucugcuu

SEQ ID NO: 768575 - RNA, 14 nt, Homo sapiens
ucuuuuaacagccu

SEQ ID NO: 768576 - RNA, 15 nt, Homo sapiens
ucuuuuagcauguga

SEQ ID NO: 768577 - RNA, 23 nt, Homo sapiens
ucuuuuaggaggcacaacaguuc

SEQ ID NO: 768578 - RNA, 23 nt, Homo sapiens
ucuuuucuaaguggcgugugcau

SEQ ID NO: 768579 - RNA, 18 nt, Homo sapiens
ucuuuucuacccuagcca

SEQ ID NO: 768580 - RNA, 18 nt, Homo sapiens
ucuuuucuccuuuaccag

SEQ ID NO: 768581 - RNA, 18 nt, Homo sapiens
ucuuuucugaucugcagu

SEQ ID NO: 768582 - RNA, 21 nt, Homo sapiens
ucuuuucuggaauguaaucaa

SEQ ID NO: 768583 - RNA, 15 nt, Homo sapiens
ucuuuugaagcuuuc

SEQ ID NO: 768584 - RNA, 13 nt, Homo sapiens
ucuuuugccauua

SEQ ID NO: 768585 - RNA, 12 nt, Homo sapiens
ucuuuugccuuu

SEQ ID NO: 768586 - RNA, 11 nt, Homo sapiens
ucuuuugcucu

SEQ ID NO: 768587 - RNA, 16 nt, Homo sapiens
ucuuuugucccagaaa

SEQ ID NO: 768588 - RNA, 13 nt, Homo sapiens
ucuuuuguucucu

SEQ ID NO: 768589 - RNA, 21 nt, Homo sapiens
ucuuuuuuaaguugucaaaga

SEQ ID NO: 768590 - RNA, 23 nt, Homo sapiens
ucuuuuuuuuuaaggugaaccaa

SEQ ID NO: 768591 - RNA, 14 nt, Homo sapiens
ugaaaaaaaaaugg

SEQ ID NO: 768592 - RNA, 16 nt, Homo sapiens
ugaaaaaaaacagugg

SEQ ID NO: 768593 - RNA, 15 nt, Homo sapiens
ugaaaaaaacauauc

SEQ ID NO: 768594 - RNA, 16 nt, Homo sapiens
ugaaaaaaaugcauuu

SEQ ID NO: 768595 - RNA, 19 nt, Homo sapiens
ugaaaaaagcaguucuuaa

SEQ ID NO: 768596 - RNA, 23 nt, Homo sapiens
ugaaaaaagguuguguagcugug

SEQ ID NO: 768597 - RNA, 22 nt, Homo sapiens
ugaaaaacagaaagcauccuaa

SEQ ID NO: 768598 - RNA, 19 nt, Homo sapiens
ugaaaaacauuccaggaaa

SEQ ID NO: 768599 - RNA, 23 nt, Homo sapiens
ugaaaaaguauaaauaaaaugag

SEQ ID NO: 768600 - RNA, 20 nt, Homo sapiens
ugaaaaauguguuccauugc

SEQ ID NO: 768601 - RNA, 16 nt, Homo sapiens
ugaaaaauuacagcuu

SEQ ID NO: 768602 - RNA, 15 nt, Homo sapiens
ugaaaacaaguccuu

SEQ ID NO: 768603 - RNA, 12 nt, Homo sapiens
ugaaaacagaua

SEQ ID NO: 768604 - RNA, 12 nt, Homo sapiens
ugaaaacagcua

SEQ ID NO: 768605 - RNA, 13 nt, Homo sapiens
ugaaaacauucaa

SEQ ID NO: 768606 - RNA, 12 nt, Homo sapiens
ugaaaaccacag

SEQ ID NO: 768607 - RNA, 20 nt, Homo sapiens
ugaaaaccacagucagugga

SEQ ID NO: 768608 - RNA, 22 nt, Homo sapiens
ugaaaacugugcaauguauuaa

SEQ ID NO: 768609 - RNA, 18 nt, Homo sapiens
ugaaaaggagagauuaaa

SEQ ID NO: 768610 - RNA, 23 nt, Homo sapiens
uuuuuaaaaaacucuuuggugca

SEQ ID NO: 768611 - RNA, 14 nt, Homo sapiens
uuuuuaaaguaugu

SEQ ID NO: 768612 - RNA, 15 nt, Homo sapiens
uuuuuaaauuaugca

SEQ ID NO: 768613 - RNA, 15 nt, Homo sapiens
uuuuuaacugauucu

SEQ ID NO: 768614 - RNA, 14 nt, Homo sapiens
uuuuuaacugguga

SEQ ID NO: 768615 - RNA, 15 nt, Homo sapiens
uuuuuaacuggugaa

SEQ ID NO: 768616 - RNA, 18 nt, Homo sapiens
uuuuuacugcucugagaa

SEQ ID NO: 768617 - RNA, 18 nt, Homo sapiens
uuuuuagcucaucggcua

SEQ ID NO: 768618 - RNA, 20 nt, Homo sapiens
uuuuuagcugguggcaauaa

SEQ ID NO: 768619 - RNA, 22 nt, Homo sapiens
uuuuuauaaaaaugagugcuua

SEQ ID NO: 768620 - RNA, 13 nt, Homo sapiens
uuuuuauagguuu

SEQ ID NO: 768621 - RNA, 20 nt, Homo sapiens
uuuuuauggaggcuuugcau

SEQ ID NO: 768622 - RNA, 18 nt, Homo sapiens
uuuuuauuaugcauuaua

SEQ ID NO: 768623 - RNA, 21 nt, Homo sapiens
uuuuucacauaucuaguauga

SEQ ID NO: 768624 - RNA, 15 nt, Homo sapiens
uuuuuccccaaaguc

SEQ ID NO: 768625 - RNA, 14 nt, Homo sapiens
uuuuuccucugcau

SEQ ID NO: 768626 - RNA, 17 nt, Homo sapiens
uuuuuccuuuuaccuuu

SEQ ID NO: 768627 - RNA, 18 nt, Homo sapiens
uuuuucuaagcauauuca

SEQ ID NO: 768628 - RNA, 16 nt, Homo sapiens
uuuuucuaagguucuc

SEQ ID NO: 768629 - RNA, 23 nt, Homo sapiens
uuuuugacucugccuacuucuga

SEQ ID NO: 768630 - RNA, 12 nt, Homo sapiens
uuuuugcauaac

SEQ ID NO: 768631 - RNA, 21 nt, Homo sapiens
uuuuuggaccccuaaugucag

SEQ ID NO: 768632 - RNA, 21 nt, Homo sapiens
uuuuuggcuacacacaaacca

SEQ ID NO: 768633 - RNA, 21 nt, Homo sapiens
uuuuuguuucuuccaaagcac

SEQ ID NO: 768634 - RNA, 19 nt, Homo sapiens
uuuuuuaaauaaaagcagc

SEQ ID NO: 768635 - RNA, 13 nt, Homo sapiens
uuuuuucccccac

SEQ ID NO: 768636 - RNA, 17 nt, Homo sapiens
uuuuuucugccuaauag

SEQ ID NO: 768637 - RNA, 13 nt, Homo sapiens
uuuuuuuauacug

SEQ ID NO: 768638 - RNA, 20 nt, Homo sapiens
ugaccaauugugcugccauu

SEQ ID NO: 768639 - RNA, 16 nt, Homo sapiens
ugaccacaccuuggcc

SEQ ID NO: 768640 - RNA, 18 nt, Homo sapiens
ugaccacauaagaaggca

SEQ ID NO: 768641 - RNA, 17 nt, Homo sapiens
ugaccacugaauucacu

SEQ ID NO: 768642 - RNA, 22 nt, Homo sapiens
ugaccagaaauggugagaugua

SEQ ID NO: 768643 - RNA, 16 nt, Homo sapiens
ugaccagcaaauacuc

SEQ ID NO: 768644 - RNA, 16 nt, Homo sapiens
ugaccagccacucaaa

SEQ ID NO: 768645 - RNA, 22 nt, Homo sapiens
ugaccaggcauccuccacaaua

SEQ ID NO: 768646 - RNA, 12 nt, Homo sapiens
ugaccauggcac

SEQ ID NO: 768647 - RNA, 19 nt, Homo sapiens
ugacccaacugauccugcu

SEQ ID NO: 768648 - RNA, 16 nt, Homo sapiens
ugacccacacuuccau

SEQ ID NO: 768649 - RNA, 21 nt, Homo sapiens
ugacccacccuagaucuuccc

SEQ ID NO: 768650 - RNA, 21 nt, Homo sapiens
ugacccaggccuggccaguca

SEQ ID NO: 768651 - RNA, 13 nt, Homo sapiens
ugaccccaaagac

SEQ ID NO: 768652 - RNA, 12 nt, Homo sapiens
ugaccccagugu

SEQ ID NO: 768653 - RNA, 14 nt, Homo sapiens
ugaccccugcucag

SEQ ID NO: 768654 - RNA, 23 nt, Homo sapiens
ugaccccuguccccacacugacc

SEQ ID NO: 768655 - RNA, 16 nt, Homo sapiens
ugaccccuuucacuua

SEQ ID NO: 768656 - RNA, 22 nt, Homo sapiens
ugacccugaaaggaacacuggc

SEQ ID NO: 768657 - RNA, 19 nt, Homo sapiens
ugaccuaguagaguguaau

SEQ ID NO: 768658 - RNA, 20 nt, Homo sapiens
ugaccucaagugaucugccc

SEQ ID NO: 768659 - RNA, 12 nt, Homo sapiens
ugaccucagcug

SEQ ID NO: 768660 - RNA, 21 nt, Homo sapiens
ugaccucagcugcacauuccu

SEQ ID NO: 768661 - RNA, 14 nt, Homo sapiens
ugaccucaggugau

SEQ ID NO: 768662 - RNA, 18 nt, Homo sapiens
ugaccucauuuguaaaau

SEQ ID NO: 768663 - RNA, 16 nt, Homo sapiens
ugaccuccauuuccca

SEQ ID NO: 768664 - RNA, 14 nt, Homo sapiens
ugaccucccaguga

SEQ ID NO: 768665 - RNA, 16 nt, Homo sapiens
ugaccugugucacuac

SEQ ID NO: 768666 - RNA, 21 nt, Homo sapiens
ugaccuuggagagacacagcg

SEQ ID NO: 768667 - RNA, 19 nt, Homo sapiens
ugaccuugggguacaauug

SEQ ID NO: 768668 - RNA, 13 nt, Homo sapiens
ugacgaacuggcu

SEQ ID NO: 768669 - RNA, 17 nt, Homo sapiens
ugacgacuucacacuau

SEQ ID NO: 768670 - RNA, 15 nt, Homo sapiens
ugacgagcaugagcu

SEQ ID NO: 768671 - RNA, 21 nt, Homo sapiens
ugacggcgcccccagugugca

SEQ ID NO: 768672 - RNA, 22 nt, Homo sapiens
ugacgucacuggaccacugggc

SEQ ID NO: 768673 - RNA, 15 nt, Homo sapiens
ugacgucaucuuguc

SEQ ID NO: 768674 - RNA, 22 nt, Homo sapiens
ugacgugccuuuugcaccccuc

SEQ ID NO: 768675 - RNA, 22 nt, Homo sapiens
ugacuaaacaacuaccuccuca

SEQ ID NO: 768676 - RNA, 12 nt, Homo sapiens
ugacuaaagcua

SEQ ID NO: 768677 - RNA, 15 nt, Homo sapiens
ugacuauucuugaug

SEQ ID NO: 768678 - RNA, 19 nt, Homo sapiens
ugacucaacauguuacuga

SEQ ID NO: 768679 - RNA, 21 nt, Homo sapiens
ugacucacaccugaacugaac

SEQ ID NO: 768680 - RNA, 12 nt, Homo sapiens
ugacucaccuga

SEQ ID NO: 768681 - RNA, 16 nt, Homo sapiens
ugacuccuuucucuaa

SEQ ID NO: 768682 - RNA, 20 nt, Homo sapiens
ugacucgacaccgugucacc

SEQ ID NO: 768683 - RNA, 18 nt, Homo sapiens
ugacucgguguucugucc

SEQ ID NO: 768684 - RNA, 19 nt, Homo sapiens
uggguaccugcaagcagaa

SEQ ID NO: 768685 - RNA, 15 nt, Homo sapiens
uggguacuucuugaa

SEQ ID NO: 768686 - RNA, 14 nt, Homo sapiens
uggguaguaccugu

SEQ ID NO: 768687 - RNA, 15 nt, Homo sapiens
ugggucagcuugaau

SEQ ID NO: 768688 - RNA, 14 nt, Homo sapiens
ugggucaguuguau

SEQ ID NO: 768689 - RNA, 15 nt, Homo sapiens
ugggucaugacaaga

SEQ ID NO: 768690 - RNA, 16 nt, Homo sapiens
uggguccuucaaacaa

SEQ ID NO: 768691 - RNA, 17 nt, Homo sapiens
ugggucuaggacacagu

SEQ ID NO: 768692 - RNA, 17 nt, Homo sapiens
ugggucucagcugcuga

SEQ ID NO: 768693 - RNA, 20 nt, Homo sapiens
ugggucucauuuagaacuug

SEQ ID NO: 768694 - RNA, 23 nt, Homo sapiens
ugggucucauuuagaacuugcag

SEQ ID NO: 768695 - RNA, 18 nt, Homo sapiens
ugggucuuggggacuaac

SEQ ID NO: 768696 - RNA, 18 nt, Homo sapiens
ugggugcccucuccaaag

SEQ ID NO: 768697 - RNA, 16 nt, Homo sapiens
uggguguacaaacuca

SEQ ID NO: 768698 - RNA, 18 nt, Homo sapiens
uggguuagagauggaguu

SEQ ID NO: 768699 - RNA, 23 nt, Homo sapiens
uggguuaggguguguguucaccu

SEQ ID NO: 768700 - RNA, 15 nt, Homo sapiens
uggguucacuugcca

SEQ ID NO: 768701 - RNA, 12 nt, Homo sapiens
uggguuccagag

SEQ ID NO: 768702 - RNA, 20 nt, Homo sapiens
uggguuccuguaugguggaa

SEQ ID NO: 768703 - RNA, 20 nt, Homo sapiens
uggguugacuccugagcaua

SEQ ID NO: 768704 - RNA, 21 nt, Homo sapiens
uggguuggugcacagugauuu

SEQ ID NO: 768705 - RNA, 17 nt, Homo sapiens
uggguuuugugccuuug

SEQ ID NO: 768706 - RNA, 19 nt, Homo sapiens
ugguaccagaggaugguga

SEQ ID NO: 768707 - RNA, 17 nt, Homo sapiens
ugguacugaaaaugaga

SEQ ID NO: 768708 - RNA, 22 nt, Homo sapiens
ugguagaacguaaccacggaaa

SEQ ID NO: 768709 - RNA, 20 nt, Homo sapiens
ugguaguggaauagugaaua

SEQ ID NO: 768710 - RNA, 14 nt, Homo sapiens
ugguauccaaguua

SEQ ID NO: 768711 - RNA, 19 nt, Homo sapiens
ugguauccugugacaugua

SEQ ID NO: 768712 - RNA, 15 nt, Homo sapiens
ugguaucucagaaag

SEQ ID NO: 768713 - RNA, 20 nt, Homo sapiens
ugguaucugugaacauguua

SEQ ID NO: 768714 - RNA, 15 nt, Homo sapiens
uggucaacacuuaag

SEQ ID NO: 768715 - RNA, 18 nt, Homo sapiens
uggucacaagcacaaagc

SEQ ID NO: 768716 - RNA, 14 nt, Homo sapiens
uggucacacucuca

SEQ ID NO: 768717 - RNA, 19 nt, Homo sapiens
uggucacagccaugaaguc

SEQ ID NO: 768718 - RNA, 23 nt, Homo sapiens
uggucacaugaugugcauagaga

SEQ ID NO: 768719 - RNA, 15 nt, Homo sapiens
uggucagagugccac

SEQ ID NO: 768720 - RNA, 17 nt, Homo sapiens
uggucagagugccacug

SEQ ID NO: 768721 - RNA, 15 nt, Homo sapiens
uggucaggagccucu

SEQ ID NO: 768722 - RNA, 15 nt, Homo sapiens
ugguccccuccucag

SEQ ID NO: 768723 - RNA, 14 nt, Homo sapiens
ugguccgagucuca

SEQ ID NO: 768724 - RNA, 17 nt, Homo sapiens
ugguccuuccuaccucu

SEQ ID NO: 768725 - RNA, 18 nt, Homo sapiens
uggucuccuugcacuuuc

SEQ ID NO: 768726 - RNA, 18 nt, Homo sapiens
uggucuguuugcauuuga

SEQ ID NO: 768727 - RNA, 18 nt, Homo sapiens
uggucuugagaugucuuc

SEQ ID NO: 768728 - RNA, 20 nt, Homo sapiens
uggucuuguggaauugggag

SEQ ID NO: 768729 - RNA, 19 nt, Homo sapiens
uggucuuucugaauugcac

SEQ ID NO: 768730 - RNA, 19 nt, Homo sapiens
uggugaaaccucaucucua

SEQ ID NO: 768731 - RNA, 14 nt, Homo sapiens
uggugaauggaguc

SEQ ID NO: 768732 - RNA, 14 nt, Homo sapiens
uggugaauuucaca

SEQ ID NO: 768733 - RNA, 13 nt, Homo sapiens
uggcaccucucaa

SEQ ID NO: 768734 - RNA, 21 nt, Homo sapiens
uggcaccuguagucccagcua

SEQ ID NO: 768735 - RNA, 19 nt, Homo sapiens
uggcacgugccugugaucc

SEQ ID NO: 768736 - RNA, 19 nt, Homo sapiens
uggcacuuaagugcacuuu

SEQ ID NO: 768737 - RNA, 12 nt, Homo sapiens
uggcacuuugaa

SEQ ID NO: 768738 - RNA, 13 nt, Homo sapiens
uggcagaagucaa

SEQ ID NO: 768739 - RNA, 20 nt, Homo sapiens
uggcagaggcagggaagcuc

SEQ ID NO: 768740 - RNA, 20 nt, Homo sapiens
uggcagcagccagggacccc

SEQ ID NO: 768741 - RNA, 14 nt, Homo sapiens
uggcagcaugacuc

SEQ ID NO: 768742 - RNA, 17 nt, Homo sapiens
uggcaggaaucuaucca

SEQ ID NO: 768743 - RNA, 19 nt, Homo sapiens
uggcagggauaacaaagaa

SEQ ID NO: 768744 - RNA, 13 nt, Homo sapiens
uggcaggugcaga

SEQ ID NO: 768745 - RNA, 14 nt, Homo sapiens
uggcaggugccuug

SEQ ID NO: 768746 - RNA, 17 nt, Homo sapiens
uggcaguccagccagcu

SEQ ID NO: 768747 - RNA, 23 nt, Homo sapiens
uggcaguuguuaaguccuuggcu

SEQ ID NO: 768748 - RNA, 15 nt, Homo sapiens
uggcauaaccugucu

SEQ ID NO: 768749 - RNA, 18 nt, Homo sapiens
uggcaucaucucagcuca

SEQ ID NO: 768750 - RNA, 20 nt, Homo sapiens
uggcaucgaccacaccagcc

SEQ ID NO: 768751 - RNA, 18 nt, Homo sapiens
uggcaucucuuucugcaa

SEQ ID NO: 768752 - RNA, 21 nt, Homo sapiens
uggcaucugagugggcccagc

SEQ ID NO: 768753 - RNA, 14 nt, Homo sapiens
uggcaucuugccaa

SEQ ID NO: 768754 - RNA, 17 nt, Homo sapiens
uggcaugccuuccagca

SEQ ID NO: 768755 - RNA, 15 nt, Homo sapiens
uggcauugaucuuaa

SEQ ID NO: 768756 - RNA, 21 nt, Homo sapiens
uggcauugucuguaaugacaa

SEQ ID NO: 768757 - RNA, 14 nt, Homo sapiens
uggccaacauggug

SEQ ID NO: 768758 - RNA, 15 nt, Homo sapiens
uggccaccaguauga

SEQ ID NO: 768759 - RNA, 19 nt, Homo sapiens
uggccacccgcccacagcc

SEQ ID NO: 768760 - RNA, 23 nt, Homo sapiens
uggccacugggucucacuccuga

SEQ ID NO: 768761 - RNA, 19 nt, Homo sapiens
uggccagacuggucuugaa

SEQ ID NO: 768762 - RNA, 19 nt, Homo sapiens
uggccagcccggcugguuu

SEQ ID NO: 768763 - RNA, 17 nt, Homo sapiens
uggccagugugauccca

SEQ ID NO: 768764 - RNA, 18 nt, Homo sapiens
uggccagugugaucccaa

SEQ ID NO: 768765 - RNA, 22 nt, Homo sapiens
uggccaguuuucugguaggaag

SEQ ID NO: 768766 - RNA, 13 nt, Homo sapiens
uggccaucuguau

SEQ ID NO: 768767 - RNA, 13 nt, Homo sapiens
uggccauguucuc

SEQ ID NO: 768768 - RNA, 15 nt, Homo sapiens
uggccauguucucca

SEQ ID NO: 768769 - RNA, 15 nt, Homo sapiens
uggcccaaauccagu

SEQ ID NO: 768770 - RNA, 12 nt, Homo sapiens
uggcccaagacc

SEQ ID NO: 768771 - RNA, 13 nt, Homo sapiens
uggcccaagacuc

SEQ ID NO: 768772 - RNA, 17 nt, Homo sapiens
uggcccagagaagccaa

SEQ ID NO: 768773 - RNA, 16 nt, Homo sapiens
uggccccacuuugaag

SEQ ID NO: 768774 - RNA, 20 nt, Homo sapiens
uggcccccacccucugccac

SEQ ID NO: 768775 - RNA, 23 nt, Homo sapiens
uggcccccagcugguguccugcc

SEQ ID NO: 768776 - RNA, 15 nt, Homo sapiens
uggccccuauugaga

SEQ ID NO: 768777 - RNA, 22 nt, Homo sapiens
uggccccuucuggggguggugg

SEQ ID NO: 768778 - RNA, 17 nt, Homo sapiens
uggcccgccccucgcug

SEQ ID NO: 768779 - RNA, 23 nt, Homo sapiens
uggcccucaguuucccuaucucg

SEQ ID NO: 768780 - RNA, 18 nt, Homo sapiens
uggcccugccguuucccc

SEQ ID NO: 768781 - RNA, 23 nt, Homo sapiens
uggcccuuaauuauuaacaaagu

SEQ ID NO: 768782 - RNA, 17 nt, Homo sapiens
uggcccuugcuuaccuc

SEQ ID NO: 768783 - RNA, 23 nt, Homo sapiens
uggccgccacccccaucuuccac

SEQ ID NO: 768784 - RNA, 17 nt, Homo sapiens
uucaggcagcacaucaa

SEQ ID NO: 768785 - RNA, 18 nt, Homo sapiens
uucaggcagcagugucug

SEQ ID NO: 768786 - RNA, 18 nt, Homo sapiens
uucagggaauuucaggaa

SEQ ID NO: 768787 - RNA, 18 nt, Homo sapiens
uucagggcagggcucuga

SEQ ID NO: 768788 - RNA, 18 nt, Homo sapiens
uucagguauguguguaua

SEQ ID NO: 768789 - RNA, 19 nt, Homo sapiens
uucaggugugacucuagca

SEQ ID NO: 768790 - RNA, 13 nt, Homo sapiens
uucaguaugcaaa

SEQ ID NO: 768791 - RNA, 20 nt, Homo sapiens
uucaguauuagaugcacuua

SEQ ID NO: 768792 - RNA, 18 nt, Homo sapiens
uucagucucuauaccaau

SEQ ID NO: 768793 - RNA, 10 nt, Homo sapiens
uucagucuuc

SEQ ID NO: 768794 - RNA, 13 nt, Homo sapiens
uucagugcaccua

SEQ ID NO: 768795 - RNA, 19 nt, Homo sapiens
uucagugcaccuacugcuu

SEQ ID NO: 768796 - RNA, 13 nt, Homo sapiens
uucagugcuucuu

SEQ ID NO: 768797 - RNA, 22 nt, Homo sapiens
uucaguguacauggaauaacau

SEQ ID NO: 768798 - RNA, 23 nt, Homo sapiens
uucaguguuuugaaaaauacauc

SEQ ID NO: 768799 - RNA, 13 nt, Homo sapiens
uucaguugccaag

SEQ ID NO: 768800 - RNA, 17 nt, Homo sapiens
uucaguuuaaugucucc

SEQ ID NO: 768801 - RNA, 18 nt, Homo sapiens
uucaguuuuacucugcug

SEQ ID NO: 768802 - RNA, 18 nt, Homo sapiens
uucauaaggauucaggga

SEQ ID NO: 768803 - RNA, 18 nt, Homo sapiens
uucauaauaaacuacaca

SEQ ID NO: 768804 - RNA, 14 nt, Homo sapiens
uucauaauaccuca

SEQ ID NO: 768805 - RNA, 19 nt, Homo sapiens
uucauaauaucuaugcuga

SEQ ID NO: 768806 - RNA, 16 nt, Homo sapiens
uucauacagcauuaca

SEQ ID NO: 768807 - RNA, 12 nt, Homo sapiens
uucauacauauu

SEQ ID NO: 768808 - RNA, 16 nt, Homo sapiens
uucauacuccuuuuaa

SEQ ID NO: 768809 - RNA, 15 nt, Homo sapiens
uucauagaaaccucu

SEQ ID NO: 768810 - RNA, 14 nt, Homo sapiens
uucauaguguucau

SEQ ID NO: 768811 - RNA, 18 nt, Homo sapiens
uucauauuuauacuuugc

SEQ ID NO: 768812 - RNA, 14 nt, Homo sapiens
uucaucaaacauug

SEQ ID NO: 768813 - RNA, 16 nt, Homo sapiens
uucauccgcacuguaa

SEQ ID NO: 768814 - RNA, 18 nt, Homo sapiens
uucauccuuccauccauc

SEQ ID NO: 768815 - RNA, 15 nt, Homo sapiens
uucauccuugacuaa

SEQ ID NO: 768816 - RNA, 18 nt, Homo sapiens
uucaucuauuucugagaa

SEQ ID NO: 768817 - RNA, 18 nt, Homo sapiens
uucaucucucuaccucca

SEQ ID NO: 768818 - RNA, 11 nt, Homo sapiens
uucaucucuug

SEQ ID NO: 768819 - RNA, 18 nt, Homo sapiens
uucaucugacuaugacau

SEQ ID NO: 768820 - RNA, 18 nt, Homo sapiens
uucaucugcucuccuucc

SEQ ID NO: 768821 - RNA, 23 nt, Homo sapiens
uucaugaaacuguccaccaagau

SEQ ID NO: 768822 - RNA, 13 nt, Homo sapiens
uucuaacccugac

SEQ ID NO: 768823 - RNA, 11 nt, Homo sapiens
uucuaacucau

SEQ ID NO: 768824 - RNA, 21 nt, Homo sapiens
uucuaagagcgaacuucacau

SEQ ID NO: 768825 - RNA, 13 nt, Homo sapiens
uucuaagauucug

SEQ ID NO: 768826 - RNA, 17 nt, Homo sapiens
uucuaaggcucugagag

SEQ ID NO: 768827 - RNA, 21 nt, Homo sapiens
uucuaaggcucugagagucua

SEQ ID NO: 768828 - RNA, 22 nt, Homo sapiens
uucuaagguccgguguucuaag

SEQ ID NO: 768829 - RNA, 14 nt, Homo sapiens
uucuaagucuucca

SEQ ID NO: 768830 - RNA, 21 nt, Homo sapiens
uucuaaguggaaaaaguauua

SEQ ID NO: 768831 - RNA, 19 nt, Homo sapiens
uucuaauaacugcaguguu

SEQ ID NO: 768832 - RNA, 16 nt, Homo sapiens
uucuaaucacaguguu

SEQ ID NO: 768833 - RNA, 18 nt, Homo sapiens
uucuaaucccagcacuuu

SEQ ID NO: 768834 - RNA, 19 nt, Homo sapiens
uucuaaucccagcacuuug

SEQ ID NO: 768835 - RNA, 19 nt, Homo sapiens
uucuaauccuuuuccuuau

SEQ ID NO: 768836 - RNA, 15 nt, Homo sapiens
uucuaauuaaccuua

SEQ ID NO: 768837 - RNA, 21 nt, Homo sapiens
uucuacaauguagaaaaugag

SEQ ID NO: 768838 - RNA, 17 nt, Homo sapiens
uucuacagcagcacugu

SEQ ID NO: 768839 - RNA, 15 nt, Homo sapiens
uucuacaguguccua

SEQ ID NO: 768840 - RNA, 18 nt, Homo sapiens
uucuacugacccaacugg

SEQ ID NO: 768841 - RNA, 21 nt, Homo sapiens
uucuacuuuaagguuugcaga

SEQ ID NO: 768842 - RNA, 21 nt, Homo sapiens
uucuaggcacuguaguucuaa

SEQ ID NO: 768843 - RNA, 14 nt, Homo sapiens
uucuagucucugau

SEQ ID NO: 768844 - RNA, 14 nt, Homo sapiens
uucuagugcugcug

SEQ ID NO: 768845 - RNA, 24 nt, Homo sapiens
uucuaguuuugucaaacuguagaa

SEQ ID NO: 768846 - RNA, 12 nt, Homo sapiens
uucuauaacaua

SEQ ID NO: 768847 - RNA, 18 nt, Homo sapiens
uucuauacccacccagaa

SEQ ID NO: 768848 - RNA, 19 nt, Homo sapiens
uucuauccuuuugccugca

SEQ ID NO: 768849 - RNA, 14 nt, Homo sapiens
uucuaugccuuuag

SEQ ID NO: 768850 - RNA, 18 nt, Homo sapiens
uucuauucuagccugcau

SEQ ID NO: 768851 - RNA, 23 nt, Homo sapiens
uucuauuuaaugcuuccagggau

SEQ ID NO: 768852 - RNA, 16 nt, Homo sapiens
uucucacuccaccacc

SEQ ID NO: 768853 - RNA, 21 nt, Homo sapiens
uucucagaaucucaaauaacu

SEQ ID NO: 768854 - RNA, 22 nt, Homo sapiens
uucucagauguugaaacuuuga

SEQ ID NO: 768855 - RNA, 18 nt, Homo sapiens
uucucaguaucaguauuu

SEQ ID NO: 768856 - RNA, 17 nt, Homo sapiens
uucucagugaaauaacu

SEQ ID NO: 768857 - RNA, 18 nt, Homo sapiens
uucccaccagguucuccu

SEQ ID NO: 768858 - RNA, 13 nt, Homo sapiens
uucccacgaggaa

SEQ ID NO: 768859 - RNA, 15 nt, Homo sapiens
uucccacugcacucc

SEQ ID NO: 768860 - RNA, 14 nt, Homo sapiens
uucccagcaguggg

SEQ ID NO: 768861 - RNA, 14 nt, Homo sapiens
uucccagcuaggaa

SEQ ID NO: 768862 - RNA, 14 nt, Homo sapiens
uucccagcucuccc

SEQ ID NO: 768863 - RNA, 22 nt, Homo sapiens
uucccagcuucugccacauaaa

SEQ ID NO: 768864 - RNA, 13 nt, Homo sapiens
uucccagguguua

SEQ ID NO: 768865 - RNA, 23 nt, Homo sapiens
uucccaucacuggagcaccaggc

SEQ ID NO: 768866 - RNA, 17 nt, Homo sapiens
uucccauucuacauacu

SEQ ID NO: 768867 - RNA, 21 nt, Homo sapiens
uucccauuuguaauuuguaaa

SEQ ID NO: 768868 - RNA, 16 nt, Homo sapiens
uucccauuugugccag

SEQ ID NO: 768869 - RNA, 21 nt, Homo sapiens
uuccccaaagacgaccagcau

SEQ ID NO: 768870 - RNA, 12 nt, Homo sapiens
uuccccagagaa

SEQ ID NO: 768871 - RNA, 21 nt, Homo sapiens
uuccccuccuuggcuuuaugc

SEQ ID NO: 768872 - RNA, 19 nt, Homo sapiens
uuccccucugcggcuuuca

SEQ ID NO: 768873 - RNA, 22 nt, Homo sapiens
uuccccuuccuguguccaugug

SEQ ID NO: 768874 - RNA, 19 nt, Homo sapiens
uuccccuuuucccaaccug

SEQ ID NO: 768875 - RNA, 13 nt, Homo sapiens
uucccgacaccag

SEQ ID NO: 768876 - RNA, 22 nt, Homo sapiens
uucccgacacccggagcucuac

SEQ ID NO: 768877 - RNA, 23 nt, Homo sapiens
uucccgccucggcuagggguccu

SEQ ID NO: 768878 - RNA, 14 nt, Homo sapiens
uucccgccuuccaa

SEQ ID NO: 768879 - RNA, 14 nt, Homo sapiens
uucccuaaugaagu

SEQ ID NO: 768880 - RNA, 12 nt, Homo sapiens
uucccuagcuuu

SEQ ID NO: 768881 - RNA, 22 nt, Homo sapiens
uucccucucagcugcugggacg

SEQ ID NO: 768882 - RNA, 22 nt, Homo sapiens
uucccucucccggcaacaucuc

SEQ ID NO: 768883 - RNA, 22 nt, Homo sapiens
uucccucucccucucucuggga

SEQ ID NO: 768884 - RNA, 13 nt, Homo sapiens
uucccucugggcc

SEQ ID NO: 768885 - RNA, 19 nt, Homo sapiens
uucccucuugcucaguggg

SEQ ID NO: 768886 - RNA, 18 nt, Homo sapiens
uucccugaccucccucua

SEQ ID NO: 768887 - RNA, 17 nt, Homo sapiens
uucccugacuugcuuua

SEQ ID NO: 768888 - RNA, 22 nt, Homo sapiens
uucccugccuugcugacaauaa

SEQ ID NO: 768889 - RNA, 20 nt, Homo sapiens
uucccuguaugauuccuuga

SEQ ID NO: 768890 - RNA, 21 nt, Homo sapiens
uucccuguggugauaccuaua

SEQ ID NO: 768891 - RNA, 14 nt, Homo sapiens
uucccuuaaauaca

SEQ ID NO: 768892 - RNA, 22 nt, Homo sapiens
uucccuuaacucaaaccaugca

SEQ ID NO: 768893 - RNA, 17 nt, Homo sapiens
aguuaauuuugaguaau

SEQ ID NO: 768894 - RNA, 20 nt, Homo sapiens
aguuacaauuuggagcauaa

SEQ ID NO: 768895 - RNA, 23 nt, Homo sapiens
aguuacaguucugugguuucaug

SEQ ID NO: 768896 - RNA, 19 nt, Homo sapiens
aguuaccaaacauuacaaa

SEQ ID NO: 768897 - RNA, 22 nt, Homo sapiens
aguuaccuuauaguuacugugu

SEQ ID NO: 768898 - RNA, 23 nt, Homo sapiens
aguuaccuuauaguuacugugua

SEQ ID NO: 768899 - RNA, 23 nt, Homo sapiens
aguuacgaguuuucccucaguga

SEQ ID NO: 768900 - RNA, 22 nt, Homo sapiens
aguuacugaaggugauggaggu

SEQ ID NO: 768901 - RNA, 23 nt, Homo sapiens
aggcaacaggauugaucauucuu

SEQ ID NO: 768902 - RNA, 23 nt, Homo sapiens
aggcaacugaggcagacagcagc

SEQ ID NO: 768903 - RNA, 12 nt, Homo sapiens
aggcaagaucua

SEQ ID NO: 768904 - RNA, 13 nt, Homo sapiens
aggcaagcagcug

SEQ ID NO: 768905 - RNA, 17 nt, Homo sapiens
aggcaagccccucagcc

SEQ ID NO: 768906 - RNA, 19 nt, Homo sapiens
aggcaagcuugaggccaag

SEQ ID NO: 768907 - RNA, 19 nt, Homo sapiens
aggcaaggaugucugagac

SEQ ID NO: 768908 - RNA, 18 nt, Homo sapiens
aggcaaucaagucucaca

SEQ ID NO: 768909 - RNA, 13 nt, Homo sapiens
aggcacaacaguu

SEQ ID NO: 768910 - RNA, 18 nt, Homo sapiens
aggcacaacaguucucuu

SEQ ID NO: 768911 - RNA, 23 nt, Homo sapiens
aggcacagugggagcugagcugg

SEQ ID NO: 768912 - RNA, 22 nt, Homo sapiens
aggcacauguuguucucauuga

SEQ ID NO: 768913 - RNA, 23 nt, Homo sapiens
aggcaccaccaggagcagcagcc

SEQ ID NO: 768914 - RNA, 18 nt, Homo sapiens
aggcaccucuuccuugau

SEQ ID NO: 768915 - RNA, 20 nt, Homo sapiens
aggcacugcccuuuucagga

SEQ ID NO: 768916 - RNA, 16 nt, Homo sapiens
aggcacuguaguucua

SEQ ID NO: 768917 - RNA, 16 nt, Homo sapiens
aggcagagacaucuuu

SEQ ID NO: 768918 - RNA, 21 nt, Homo sapiens
aggcagagguugcagugagcu

SEQ ID NO: 768919 - RNA, 20 nt, Homo sapiens
aggcagcaccugauucucac

SEQ ID NO: 768920 - RNA, 15 nt, Homo sapiens
aggcagcagagcauu

SEQ ID NO: 768921 - RNA, 15 nt, Homo sapiens
aggcagccaguguga

SEQ ID NO: 768922 - RNA, 22 nt, Homo sapiens
aggcagcgcugcaguugcucag

SEQ ID NO: 768923 - RNA, 23 nt, Homo sapiens
aggcagcgcugcaguugcucagg

SEQ ID NO: 768924 - RNA, 19 nt, Homo sapiens
aggcagcugccucugcucc

SEQ ID NO: 768925 - RNA, 21 nt, Homo sapiens
aggcaggaacaaacagggcug

SEQ ID NO: 768926 - RNA, 17 nt, Homo sapiens
aggcaggagaauggugu

SEQ ID NO: 768927 - RNA, 19 nt, Homo sapiens
aggcaggaggaucauuuga

SEQ ID NO: 768928 - RNA, 15 nt, Homo sapiens
aggcaggcauuccug

SEQ ID NO: 768929 - RNA, 21 nt, Homo sapiens
aggcaggcgggggcugcucag

SEQ ID NO: 768930 - RNA, 17 nt, Homo sapiens
aggcagggcaaaugaca

SEQ ID NO: 768931 - RNA, 18 nt, Homo sapiens
aggcagguccacagagag

SEQ ID NO: 768932 - RNA, 11 nt, Homo sapiens
aggcaggugag

SEQ ID NO: 768933 - RNA, 13 nt, Homo sapiens
aggcaggugggcu

SEQ ID NO: 768934 - RNA, 15 nt, Homo sapiens
aggcagucauaucaa

SEQ ID NO: 768935 - RNA, 22 nt, Homo sapiens
aggcagugacagcagucaggga

SEQ ID NO: 768936 - RNA, 18 nt, Homo sapiens
aggcagugcugagaggga

SEQ ID NO: 768937 - RNA, 22 nt, Homo sapiens
aggcauaaagacuaauuagcaa

SEQ ID NO: 768938 - RNA, 19 nt, Homo sapiens
aggcauaggccugggugcu

SEQ ID NO: 768939 - RNA, 21 nt, Homo sapiens
aggcaucauacuaaacuucac

SEQ ID NO: 768940 - RNA, 19 nt, Homo sapiens
aggcauccaggccagggcu

SEQ ID NO: 768941 - RNA, 16 nt, Homo sapiens
aggcaucuaucugugc

SEQ ID NO: 768942 - RNA, 21 nt, Homo sapiens
aggcaugaaucacugugcuca

SEQ ID NO: 768943 - RNA, 22 nt, Homo sapiens
aggcaugagggaucacagggcc

SEQ ID NO: 768944 - RNA, 16 nt, Homo sapiens
aggcaugauguuaacc

SEQ ID NO: 768945 - RNA, 19 nt, Homo sapiens
aggcaugcuaucauggaau

SEQ ID NO: 768946 - RNA, 22 nt, Homo sapiens
aggcaugggcagcaaccccugc

SEQ ID NO: 768947 - RNA, 22 nt, Homo sapiens
aggcauggucccuuaaggcaca

SEQ ID NO: 768948 - RNA, 22 nt, Homo sapiens
aggcauguggccuuuaucucaa

SEQ ID NO: 768949 - RNA, 15 nt, Homo sapiens
aggcauucucugaag

SEQ ID NO: 768950 - RNA, 14 nt, Homo sapiens
aggcauuuccagac

SEQ ID NO: 768951 - RNA, 17 nt, Homo sapiens
aggcauuuccugcugaa

SEQ ID NO: 768952 - RNA, 14 nt, Homo sapiens
aggcauuucuauca

SEQ ID NO: 768953 - RNA, 14 nt, Homo sapiens
aggccaagaacuug

SEQ ID NO: 768954 - RNA, 12 nt, Homo sapiens
aguuucccugaa

SEQ ID NO: 768955 - RNA, 15 nt, Homo sapiens
aguuuccggaaacaa

SEQ ID NO: 768956 - RNA, 21 nt, Homo sapiens
aguuuccuaugggaacaauug

SEQ ID NO: 768957 - RNA, 15 nt, Homo sapiens
aguuucguaugcacu

SEQ ID NO: 768958 - RNA, 16 nt, Homo sapiens
aguuucuaagauucua

SEQ ID NO: 768959 - RNA, 16 nt, Homo sapiens
aguuucuaucucuaag

SEQ ID NO: 768960 - RNA, 13 nt, Homo sapiens
aguuucucuccac

SEQ ID NO: 768961 - RNA, 12 nt, Homo sapiens
aguuucugaguc

SEQ ID NO: 768962 - RNA, 19 nt, Homo sapiens
auaacuggaaaaagugaaa

SEQ ID NO: 768963 - RNA, 21 nt, Homo sapiens
auaacuggauugcagacuguu

SEQ ID NO: 768964 - RNA, 15 nt, Homo sapiens
auaacugucuuguuu

SEQ ID NO: 768965 - RNA, 21 nt, Homo sapiens
auaacuuaaaaaaaugacaga

SEQ ID NO: 768966 - RNA, 14 nt, Homo sapiens
auaacuuacuguau

SEQ ID NO: 768967 - RNA, 19 nt, Homo sapiens
auaacuuggggaggcaaga

SEQ ID NO: 768968 - RNA, 17 nt, Homo sapiens
auaagaaagaucaaaga

SEQ ID NO: 768969 - RNA, 18 nt, Homo sapiens
auaagaaagaucaaagac

SEQ ID NO: 768970 - RNA, 14 nt, Homo sapiens
auaagaaugaaucu

SEQ ID NO: 768971 - RNA, 13 nt, Homo sapiens
auaagacuuccac

SEQ ID NO: 768972 - RNA, 19 nt, Homo sapiens
auaagaggaguaggcccug

SEQ ID NO: 768973 - RNA, 14 nt, Homo sapiens
auaagaucuguuuu

SEQ ID NO: 768974 - RNA, 16 nt, Homo sapiens
auaagauuaaaggaag

SEQ ID NO: 768975 - RNA, 13 nt, Homo sapiens
auaagcaggacag

SEQ ID NO: 768976 - RNA, 20 nt, Homo sapiens
auaagcagucauccucagau

SEQ ID NO: 768977 - RNA, 18 nt, Homo sapiens
auaagcuaaagaggcuga

SEQ ID NO: 768978 - RNA, 19 nt, Homo sapiens
auaagcucaugagaugaca

SEQ ID NO: 768979 - RNA, 21 nt, Homo sapiens
auaagcucuaguucuuaacaa

SEQ ID NO: 768980 - RNA, 19 nt, Homo sapiens
auaaggaucagaacagcag

SEQ ID NO: 768981 - RNA, 15 nt, Homo sapiens
auaaggcauggcuca

SEQ ID NO: 768982 - RNA, 19 nt, Homo sapiens
auaaggccagaaacuccuu

SEQ ID NO: 768983 - RNA, 14 nt, Homo sapiens
auaagguaugugcu

SEQ ID NO: 768984 - RNA, 19 nt, Homo sapiens
auaaggugccucaguuuuc

SEQ ID NO: 768985 - RNA, 15 nt, Homo sapiens
auaaguaauacuuca

SEQ ID NO: 768986 - RNA, 13 nt, Homo sapiens
auaaguacauuau

SEQ ID NO: 768987 - RNA, 16 nt, Homo sapiens
auaaguagaaagaauu

SEQ ID NO: 768988 - RNA, 13 nt, Homo sapiens
auaagucuuucau

SEQ ID NO: 768989 - RNA, 20 nt, Homo sapiens
auaaguuauuuuuguacaug

SEQ ID NO: 768990 - RNA, 20 nt, Homo sapiens
auaaguucuuaugccauguu

SEQ ID NO: 768991 - RNA, 15 nt, Homo sapiens
auaauaauugaucaa

SEQ ID NO: 768992 - RNA, 21 nt, Homo sapiens
auaauacaaauaacugaugaa

SEQ ID NO: 768993 - RNA, 22 nt, Homo sapiens
auaauagcacuaaugcuuuaag

SEQ ID NO: 768994 - RNA, 19 nt, Homo sapiens
auaauaggccaggcacugu

SEQ ID NO: 768995 - RNA, 23 nt, Homo sapiens
auaauaugaaaaucuccaucuca

SEQ ID NO: 768996 - RNA, 20 nt, Homo sapiens
auaauaugaagaccaaauga

SEQ ID NO: 768997 - RNA, 16 nt, Homo sapiens
auaauaugcugccaaa

SEQ ID NO: 768998 - RNA, 16 nt, Homo sapiens
auaauauuagugauuc

SEQ ID NO: 768999 - RNA, 17 nt, Homo sapiens
auaaucaaaagcuauuu

SEQ ID NO: 769000 - RNA, 14 nt, Homo sapiens
auaaucacauugac

SEQ ID NO: 769001 - RNA, 15 nt, Homo sapiens
auaaucagaagauga

SEQ ID NO: 769002 - RNA, 13 nt, Homo sapiens
auaaucagugugu

SEQ ID NO: 769003 - RNA, 11 nt, Homo sapiens
auaaucccagc

SEQ ID NO: 769004 - RNA, 16 nt, Homo sapiens
auaaucccagcacuuu

SEQ ID NO: 769005 - RNA, 22 nt, Homo sapiens
auaaucucuuuaaauggcuuua

SEQ ID NO: 769006 - RNA, 16 nt, Homo sapiens
auaaugaaauaaucag

SEQ ID NO: 769007 - RNA, 15 nt, Homo sapiens
auaaugacucagaau

SEQ ID NO: 769008 - RNA, 14 nt, Homo sapiens
auaaugagcauguu

SEQ ID NO: 769009 - RNA, 12 nt, Homo sapiens
auaaugaugaug

SEQ ID NO: 769010 - RNA, 17 nt, Homo sapiens
auaaugcaauggaagaa

SEQ ID NO: 769011 - RNA, 18 nt, Homo sapiens
auaaugcucccaucuccu

SEQ ID NO: 769012 - RNA, 23 nt, Homo sapiens
auaaugcugaagaccccaaagau

SEQ ID NO: 769013 - RNA, 18 nt, Homo sapiens
auaaugcuguugccucau

SEQ ID NO: 769014 - RNA, 18 nt, Homo sapiens
auaaugguugacuggguu

SEQ ID NO: 769015 - RNA, 20 nt, Homo sapiens
auaaugguuuuuaacaccuu

SEQ ID NO: 769016 - RNA, 16 nt, Homo sapiens
auaauguuacauuauu

SEQ ID NO: 769017 - RNA, 17 nt, Homo sapiens
auaauguuacauuauua

SEQ ID NO: 769018 - RNA, 14 nt, Homo sapiens
auaauuaacacuua

SEQ ID NO: 769019 - RNA, 13 nt, Homo sapiens
auaauuaauuacu

SEQ ID NO: 769020 - RNA, 20 nt, Homo sapiens
auaauuauaauguugcccag

SEQ ID NO: 769021 - RNA, 15 nt, Homo sapiens
auaauucccuaucuu

SEQ ID NO: 769022 - RNA, 15 nt, Homo sapiens
auaauucuucaccua

SEQ ID NO: 769023 - RNA, 13 nt, Homo sapiens
auaauugcauuca

SEQ ID NO: 769024 - RNA, 16 nt, Homo sapiens
auaauuggcaugucuc

SEQ ID NO: 769025 - RNA, 20 nt, Homo sapiens
auaauuuagaccccauacaa

SEQ ID NO: 769026 - RNA, 14 nt, Homo sapiens
auaauuucuacucu

SEQ ID NO: 769027 - RNA, 20 nt, Homo sapiens
auaauuucuagaaacaaaca

SEQ ID NO: 769028 - RNA, 14 nt, Homo sapiens
auaauuuuugcaga

SEQ ID NO: 769029 - RNA, 17 nt, Homo sapiens
auacaaaaaaaauuuag

SEQ ID NO: 769030 - RNA, 17 nt, Homo sapiens
auacaaaaagcaaaaau

SEQ ID NO: 769031 - RNA, 20 nt, Homo sapiens
auacaaaaaugaauacugaa

SEQ ID NO: 769032 - RNA, 17 nt, Homo sapiens
auacaaaagggucuuga

SEQ ID NO: 769033 - RNA, 14 nt, Homo sapiens
auacaaaauauuua

SEQ ID NO: 769034 - RNA, 17 nt, Homo sapiens
auacaaaccuaccaaaa

SEQ ID NO: 769035 - RNA, 13 nt, Homo sapiens
auacaaacucuca

SEQ ID NO: 769036 - RNA, 15 nt, Homo sapiens
auacaaagcaguuua

SEQ ID NO: 769037 - RNA, 13 nt, Homo sapiens
auacaaauggauu

SEQ ID NO: 769038 - RNA, 15 nt, Homo sapiens
auacaacacaaagag

SEQ ID NO: 769039 - RNA, 21 nt, Homo sapiens
auacaacaccaaaaaauaucu

SEQ ID NO: 769040 - RNA, 14 nt, Homo sapiens
auacaacacugaua

SEQ ID NO: 769041 - RNA, 14 nt, Homo sapiens
auacaagguauaau

SEQ ID NO: 769042 - RNA, 14 nt, Homo sapiens
auacaauacagauc

SEQ ID NO: 769043 - RNA, 18 nt, Homo sapiens
auacaaucagcccagugc

SEQ ID NO: 769044 - RNA, 22 nt, Homo sapiens
auacacaaggacccuucaggug

SEQ ID NO: 769045 - RNA, 13 nt, Homo sapiens
auacacacacaca

SEQ ID NO: 769046 - RNA, 22 nt, Homo sapiens
auacacacacacagacauauau

SEQ ID NO: 769047 - RNA, 19 nt, Homo sapiens
auacaccaccucacuccug

SEQ ID NO: 769048 - RNA, 23 nt, Homo sapiens
auacacccccaccuccugcaaua

SEQ ID NO: 769049 - RNA, 11 nt, Homo sapiens
auacacugugu

SEQ ID NO: 769050 - RNA, 16 nt, Homo sapiens
auacacuuuguugcaa

SEQ ID NO: 769051 - RNA, 21 nt, Homo sapiens
auacacuuuuuaaaaucucaa

SEQ ID NO: 769052 - RNA, 14 nt, Homo sapiens
auacagaaaugcaa

SEQ ID NO: 769053 - RNA, 23 nt, Homo sapiens
auacagaaguccccucuacuuua

SEQ ID NO: 769054 - RNA, 16 nt, Homo sapiens
auacagauagauauau

SEQ ID NO: 769055 - RNA, 14 nt, Homo sapiens
auacagauuuuacc

SEQ ID NO: 769056 - RNA, 19 nt, Homo sapiens
auacagcuguauugucuga

SEQ ID NO: 769057 - RNA, 15 nt, Homo sapiens
auacaguacggauuu

SEQ ID NO: 769058 - RNA, 12 nt, Homo sapiens
auacaguggcag

SEQ ID NO: 769059 - RNA, 19 nt, Homo sapiens
auacauaaaaaaguguuua

SEQ ID NO: 769060 - RNA, 16 nt, Homo sapiens
auacauagcaugacau

SEQ ID NO: 769061 - RNA, 12 nt, Homo sapiens
auacaucaaaga

SEQ ID NO: 769062 - RNA, 19 nt, Homo sapiens
auacaugcuuugaaguuuc

SEQ ID NO: 769063 - RNA, 20 nt, Homo sapiens
auacauggaaacgcaaauga

SEQ ID NO: 769064 - RNA, 23 nt, Homo sapiens
auacauggaaucgaaguguuuau

SEQ ID NO: 769065 - RNA, 15 nt, Homo sapiens
auacauguacuccag

SEQ ID NO: 769066 - RNA, 14 nt, Homo sapiens
auacaugugccaug

SEQ ID NO: 769067 - RNA, 15 nt, Homo sapiens
auacauuuccaaaau

SEQ ID NO: 769068 - RNA, 19 nt, Homo sapiens
auacauuuuuuucucuuuc

SEQ ID NO: 769069 - RNA, 21 nt, Homo sapiens
auaccaacuguacaaaauaac

SEQ ID NO: 769070 - RNA, 22 nt, Homo sapiens
auaccagguuuuacacuugcau

SEQ ID NO: 769071 - RNA, 18 nt, Homo sapiens
agcuuguuuucuucacag

SEQ ID NO: 769072 - RNA, 17 nt, Homo sapiens
agcuuuacgcucaucac

SEQ ID NO: 769073 - RNA, 20 nt, Homo sapiens
agcuuuaggcagagccauaa

SEQ ID NO: 769074 - RNA, 14 nt, Homo sapiens
agcuuuauucuuca

SEQ ID NO: 769075 - RNA, 22 nt, Homo sapiens
agcuuucagagccagugaagga

SEQ ID NO: 769076 - RNA, 22 nt, Homo sapiens
agcuuucccugccucucaucaa

SEQ ID NO: 769077 - RNA, 16 nt, Homo sapiens
agcuuuccuacuugca

SEQ ID NO: 769078 - RNA, 15 nt, Homo sapiens
agcuuuccucaaaaa

SEQ ID NO: 769079 - RNA, 19 nt, Homo sapiens
agcuuuccucaucaggcca

SEQ ID NO: 769080 - RNA, 12 nt, Homo sapiens
agcuuugcucuu

SEQ ID NO: 769081 - RNA, 22 nt, Homo sapiens
agcuuugucucugucacaucag

SEQ ID NO: 769082 - RNA, 21 nt, Homo sapiens
agcuuuuagaaaaugcaguca

SEQ ID NO: 769083 - RNA, 19 nt, Homo sapiens
agcuuuuauugucacagau

SEQ ID NO: 769084 - RNA, 18 nt, Homo sapiens
agcuuuuccucaccagga

SEQ ID NO: 769085 - RNA, 22 nt, Homo sapiens
agcuuuucuuuuuuaauuucca

SEQ ID NO: 769086 - RNA, 15 nt, Homo sapiens
agcuuuugccaguau

SEQ ID NO: 769087 - RNA, 18 nt, Homo sapiens
agcuuuuggagggugaua

SEQ ID NO: 769088 - RNA, 21 nt, Homo sapiens
aggaaaaauucaauaguaaua

SEQ ID NO: 769089 - RNA, 17 nt, Homo sapiens
aggaaaacauugcaaua

SEQ ID NO: 769090 - RNA, 16 nt, Homo sapiens
aggaaaacuacugaua

SEQ ID NO: 769091 - RNA, 21 nt, Homo sapiens
aggaaaaggccccugcaaugu

SEQ ID NO: 769092 - RNA, 17 nt, Homo sapiens
aggaaaauaaacugaca

SEQ ID NO: 769093 - RNA, 18 nt, Homo sapiens
aggaaaauaaaugaacau

SEQ ID NO: 769094 - RNA, 19 nt, Homo sapiens
aggaaaauaggugaauaau

SEQ ID NO: 769095 - RNA, 13 nt, Homo sapiens
aggaaaaugccuc

SEQ ID NO: 769096 - RNA, 14 nt, Homo sapiens
aggaaacacuucua

SEQ ID NO: 769097 - RNA, 13 nt, Homo sapiens
aggaaacaguucu

SEQ ID NO: 769098 - RNA, 15 nt, Homo sapiens
aggaaaccacaguga

SEQ ID NO: 769099 - RNA, 13 nt, Homo sapiens
aggaaacgaugaa

SEQ ID NO: 769100 - RNA, 22 nt, Homo sapiens
aggaaagauuugugaacuggaa

SEQ ID NO: 769101 - RNA, 12 nt, Homo sapiens
aggaaagggauu

SEQ ID NO: 769102 - RNA, 13 nt, Homo sapiens
aggaaagugauuu

SEQ ID NO: 769103 - RNA, 13 nt, Homo sapiens
aggaaauaaagua

SEQ ID NO: 769104 - RNA, 15 nt, Homo sapiens
aggaaauaaaguaua

SEQ ID NO: 769105 - RNA, 15 nt, Homo sapiens
aggaacaaagacagg

SEQ ID NO: 769106 - RNA, 17 nt, Homo sapiens
aggaacaaauaaacuca

SEQ ID NO: 769107 - RNA, 12 nt, Homo sapiens
aggaacacugcu

SEQ ID NO: 769108 - RNA, 13 nt, Homo sapiens
aggaacagcacug

SEQ ID NO: 769109 - RNA, 21 nt, Homo sapiens
aggaacagccacaaaauacac

SEQ ID NO: 769110 - RNA, 19 nt, Homo sapiens
aggaacaguauuacagugu

SEQ ID NO: 769111 - RNA, 20 nt, Homo sapiens
aggaacauuccuuagucuca

SEQ ID NO: 769112 - RNA, 18 nt, Homo sapiens
aggaaccagagugcugaa

SEQ ID NO: 769113 - RNA, 23 nt, Homo sapiens
aggaaccucucgccaugaucaga

SEQ ID NO: 769114 - RNA, 17 nt, Homo sapiens
aggaacuagaaagaagg

SEQ ID NO: 769115 - RNA, 19 nt, Homo sapiens
aggaacucucaagugucuu

SEQ ID NO: 769116 - RNA, 22 nt, Homo sapiens
aggaacugggccaacucaccug

SEQ ID NO: 769117 - RNA, 22 nt, Homo sapiens
aggaagaaauucagguacagaa

SEQ ID NO: 769118 - RNA, 11 nt, Homo sapiens
aggaagacaca

SEQ ID NO: 769119 - RNA, 22 nt, Homo sapiens
aggaagacacacuggaugugau

SEQ ID NO: 769120 - RNA, 20 nt, Homo sapiens
aggaagacuugaagcacaga

SEQ ID NO: 769121 - RNA, 15 nt, Homo sapiens
aggaagagagaggga

SEQ ID NO: 769122 - RNA, 15 nt, Homo sapiens
aggaagaucuugaga

SEQ ID NO: 769123 - RNA, 15 nt, Homo sapiens
aggaaggaaccagaa

SEQ ID NO: 769124 - RNA, 16 nt, Homo sapiens
aggaaggccacagugc

SEQ ID NO: 769125 - RNA, 22 nt, Homo sapiens
aggaaggcucucggguggggga

SEQ ID NO: 769126 - RNA, 14 nt, Homo sapiens
aggaagggaucuga

SEQ ID NO: 769127 - RNA, 21 nt, Homo sapiens
aggaagguagaaauaucugaa

SEQ ID NO: 769128 - RNA, 13 nt, Homo sapiens
aggaaguaacuuu

SEQ ID NO: 769129 - RNA, 17 nt, Homo sapiens
aggaagucccuugccau

SEQ ID NO: 769130 - RNA, 16 nt, Homo sapiens
aggaaguucuccagcu

SEQ ID NO: 769131 - RNA, 15 nt, Homo sapiens
aggaauaaaaccauc

SEQ ID NO: 769132 - RNA, 19 nt, Homo sapiens
aggaauaacaucaccacug

SEQ ID NO: 769133 - RNA, 20 nt, Homo sapiens
aggaauaacaucaccacugu

SEQ ID NO: 769134 - RNA, 18 nt, Homo sapiens
aggaauauaugugugccu

SEQ ID NO: 769135 - RNA, 22 nt, Homo sapiens
aggaaucaacaauaguaacucu

SEQ ID NO: 769136 - RNA, 14 nt, Homo sapiens
aggaauccuuacug

SEQ ID NO: 769137 - RNA, 16 nt, Homo sapiens
aggaauucuaggcauc

SEQ ID NO: 769138 - RNA, 16 nt, Homo sapiens
aggaauucuauaguaa

SEQ ID NO: 769139 - RNA, 17 nt, Homo sapiens
aggaauucuauugagug

SEQ ID NO: 769140 - RNA, 21 nt, Homo sapiens
aggaauuuugucaacuaccca

SEQ ID NO: 769141 - RNA, 21 nt, Homo sapiens
aggacaaccauuccagacugc

SEQ ID NO: 769142 - RNA, 15 nt, Homo sapiens
aggacaagacacuga

SEQ ID NO: 769143 - RNA, 16 nt, Homo sapiens
aggacaauacuggggu

SEQ ID NO: 769144 - RNA, 21 nt, Homo sapiens
aggacacuagaagauuuugaa

SEQ ID NO: 769145 - RNA, 16 nt, Homo sapiens
aggacagaccacagag

SEQ ID NO: 769146 - RNA, 11 nt, Homo sapiens
aggacaucuua

SEQ ID NO: 769147 - RNA, 22 nt, Homo sapiens
aggacauucuggaaaagcaaaa

SEQ ID NO: 769148 - RNA, 14 nt, Homo sapiens
aggaccaauagcau

SEQ ID NO: 769149 - RNA, 14 nt, Homo sapiens
aggaccaauugacu

SEQ ID NO: 769150 - RNA, 13 nt, Homo sapiens
aggaccaccaaug

SEQ ID NO: 769151 - RNA, 21 nt, Homo sapiens
aggaccaguucacuugcccug

SEQ ID NO: 769152 - RNA, 17 nt, Homo sapiens
aggacccuaagaugaag

SEQ ID NO: 769153 - RNA, 11 nt, Homo sapiens
aggacccugaa

SEQ ID NO: 769154 - RNA, 19 nt, Homo sapiens
aggaccgccauggugcugg

SEQ ID NO: 769155 - RNA, 15 nt, Homo sapiens
aggaccuagggaugu

SEQ ID NO: 769156 - RNA, 16 nt, Homo sapiens
aggacggacucacuuc

SEQ ID NO: 769157 - RNA, 23 nt, Homo sapiens
aggacuaccagccauacaaauag

SEQ ID NO: 769158 - RNA, 15 nt, Homo sapiens
aggacucaccacugc

SEQ ID NO: 769159 - RNA, 16 nt, Homo sapiens
aggacucaccacugcc

SEQ ID NO: 769160 - RNA, 18 nt, Homo sapiens
aggacuccccaggagcac

SEQ ID NO: 769161 - RNA, 16 nt, Homo sapiens
aggacugaacuccauc

SEQ ID NO: 769162 - RNA, 21 nt, Homo sapiens
aggacuguuuuauaaacugcu

SEQ ID NO: 769163 - RNA, 16 nt, Homo sapiens
aggacuuccauuugcu

SEQ ID NO: 769164 - RNA, 17 nt, Homo sapiens
aggacuucugccugaac

SEQ ID NO: 769165 - RNA, 13 nt, Homo sapiens
aggacuucuggca

SEQ ID NO: 769166 - RNA, 17 nt, Homo sapiens
aggagaaaaagcuuaau

SEQ ID NO: 769167 - RNA, 15 nt, Homo sapiens
aggagaagggucuca

SEQ ID NO: 769168 - RNA, 15 nt, Homo sapiens
aggagaauaugauaa

SEQ ID NO: 769169 - RNA, 14 nt, Homo sapiens
aggagaccagcuca

SEQ ID NO: 769170 - RNA, 15 nt, Homo sapiens
aggagacucaccucu

SEQ ID NO: 769171 - RNA, 15 nt, Homo sapiens
aggagagagucccag

SEQ ID NO: 769172 - RNA, 18 nt, Homo sapiens
aggagagagugagugcau

SEQ ID NO: 769173 - RNA, 19 nt, Homo sapiens
aggagagcaaacugcucag

SEQ ID NO: 769174 - RNA, 23 nt, Homo sapiens
aggagagcaagccaggaggacau

SEQ ID NO: 769175 - RNA, 20 nt, Homo sapiens
aggagaggcccggugcagcu

SEQ ID NO: 769176 - RNA, 22 nt, Homo sapiens
aggagaggggcagaacagccgc

SEQ ID NO: 769177 - RNA, 13 nt, Homo sapiens
aggagagucccag

SEQ ID NO: 769178 - RNA, 14 nt, Homo sapiens
aggagagugagugc

SEQ ID NO: 769179 - RNA, 17 nt, Homo sapiens
aggagagugagugccuu

SEQ ID NO: 769180 - RNA, 13 nt, Homo sapiens
aggagaguggcag

SEQ ID NO: 769181 - RNA, 20 nt, Homo sapiens
aggagaucgacaccauccug

SEQ ID NO: 769182 - RNA, 20 nt, Homo sapiens
aggagauguggucaauggaa

SEQ ID NO: 769183 - RNA, 16 nt, Homo sapiens
aggagauuucaugccu

SEQ ID NO: 769184 - RNA, 13 nt, Homo sapiens
aggagcaacagcu

SEQ ID NO: 769185 - RNA, 15 nt, Homo sapiens
aggagcagaaaaccc

SEQ ID NO: 769186 - RNA, 15 nt, Homo sapiens
agcucccggggacga

SEQ ID NO: 769187 - RNA, 22 nt, Homo sapiens
agcucccggggacgacgcugac

SEQ ID NO: 769188 - RNA, 18 nt, Homo sapiens
agcucccuaggagaccaa

SEQ ID NO: 769189 - RNA, 16 nt, Homo sapiens
agcucccucgucuuca

SEQ ID NO: 769190 - RNA, 17 nt, Homo sapiens
agcucccucugccugaa

SEQ ID NO: 769191 - RNA, 15 nt, Homo sapiens
agcuccuccagugaa

SEQ ID NO: 769192 - RNA, 23 nt, Homo sapiens
agcuccuuccuagccuugcacuu

SEQ ID NO: 769193 - RNA, 15 nt, Homo sapiens
agcucgguggaccca

SEQ ID NO: 769194 - RNA, 14 nt, Homo sapiens
agcucuaguucaaa

SEQ ID NO: 769195 - RNA, 17 nt, Homo sapiens
agcucuccccuccugcu

SEQ ID NO: 769196 - RNA, 20 nt, Homo sapiens
agcucucgauggacaaugaa

SEQ ID NO: 769197 - RNA, 12 nt, Homo sapiens
agcucucuaggc

SEQ ID NO: 769198 - RNA, 19 nt, Homo sapiens
agcucucugacgcuuguga

SEQ ID NO: 769199 - RNA, 23 nt, Homo sapiens
agcucugccucccucuccauauc

SEQ ID NO: 769200 - RNA, 19 nt, Homo sapiens
agcucugguauauaaucca

SEQ ID NO: 769201 - RNA, 18 nt, Homo sapiens
agcucuggugacaccagc

SEQ ID NO: 769202 - RNA, 19 nt, Homo sapiens
agcucugguuauuuuucuc

SEQ ID NO: 769203 - RNA, 18 nt, Homo sapiens
agcucuguauggucagga

SEQ ID NO: 769204 - RNA, 14 nt, Homo sapiens
agcucuucuaagga

SEQ ID NO: 769205 - RNA, 16 nt, Homo sapiens
agcucuugugaacugu

SEQ ID NO: 769206 - RNA, 19 nt, Homo sapiens
agcucuugugaacugucuu

SEQ ID NO: 769207 - RNA, 15 nt, Homo sapiens
agcugaaaugcugca

SEQ ID NO: 769208 - RNA, 16 nt, Homo sapiens
agcugaaguugcugag

SEQ ID NO: 769209 - RNA, 15 nt, Homo sapiens
agcugacaucuugca

SEQ ID NO: 769210 - RNA, 17 nt, Homo sapiens
agcugagaagcaauggg

SEQ ID NO: 769211 - RNA, 22 nt, Homo sapiens
agcugagacuacaggcacacac

SEQ ID NO: 769212 - RNA, 21 nt, Homo sapiens
agcugagaucacgccacugca

SEQ ID NO: 769213 - RNA, 14 nt, Homo sapiens
agcugagaugagcc

SEQ ID NO: 769214 - RNA, 20 nt, Homo sapiens
agcugagauugcacuauugc

SEQ ID NO: 769215 - RNA, 19 nt, Homo sapiens
agcugagguuugcacuucc

SEQ ID NO: 769216 - RNA, 14 nt, Homo sapiens
agcugagugaaaaa

SEQ ID NO: 769217 - RNA, 20 nt, Homo sapiens
agcugaugccuccuuggcca

SEQ ID NO: 769218 - RNA, 21 nt, Homo sapiens
agcugaugccuccuuggccac

SEQ ID NO: 769219 - RNA, 14 nt, Homo sapiens
agcugcaauaggaa

SEQ ID NO: 769220 - RNA, 13 nt, Homo sapiens
agcugcaccugau

SEQ ID NO: 769221 - RNA, 19 nt, Homo sapiens
agcugcacugaugcugccc

SEQ ID NO: 769222 - RNA, 20 nt, Homo sapiens
agcugcagucaacaguucaa

SEQ ID NO: 769223 - RNA, 22 nt, Homo sapiens
agcugcagucaacaguucaaag

SEQ ID NO: 769224 - RNA, 13 nt, Homo sapiens
agcugcauaugau

SEQ ID NO: 769225 - RNA, 13 nt, Homo sapiens
agcugcauuucag

SEQ ID NO: 769226 - RNA, 11 nt, Homo sapiens
agcugccauuu

SEQ ID NO: 769227 - RNA, 18 nt, Homo sapiens
agcugcccuagcugaccc

SEQ ID NO: 769228 - RNA, 12 nt, Homo sapiens
agcugccuaccu

SEQ ID NO: 769229 - RNA, 19 nt, Homo sapiens
agcugccuucccuagcuuu

SEQ ID NO: 769230 - RNA, 18 nt, Homo sapiens
agcugcgggcacccaucc

SEQ ID NO: 769231 - RNA, 19 nt, Homo sapiens
agcugcuauccccaucucc

SEQ ID NO: 769232 - RNA, 23 nt, Homo sapiens
agcugcuccgaggacccaggaaa

SEQ ID NO: 769233 - RNA, 20 nt, Homo sapiens
agcugcucugaaaucuccuu

SEQ ID NO: 769234 - RNA, 14 nt, Homo sapiens
agcugcucuugcau

SEQ ID NO: 769235 - RNA, 23 nt, Homo sapiens
agcugcugacacgcagccugcuc

SEQ ID NO: 769236 - RNA, 20 nt, Homo sapiens
agcugcugcuggagauucaa

SEQ ID NO: 769237 - RNA, 16 nt, Homo sapiens
agcugcuggcuugcag

SEQ ID NO: 769238 - RNA, 13 nt, Homo sapiens
agcugcugucacu

SEQ ID NO: 769239 - RNA, 19 nt, Homo sapiens
agcugcugucuucuggaca

SEQ ID NO: 769240 - RNA, 17 nt, Homo sapiens
agcuggaaagugugaau

SEQ ID NO: 769241 - RNA, 13 nt, Homo sapiens
agcuggaaccaug

SEQ ID NO: 769242 - RNA, 14 nt, Homo sapiens
agcuggacugacca

SEQ ID NO: 769243 - RNA, 14 nt, Homo sapiens
agcuggaggggugg

SEQ ID NO: 769244 - RNA, 14 nt, Homo sapiens
agcuggagugcagu

SEQ ID NO: 769245 - RNA, 18 nt, Homo sapiens
agcuggccuggacaguau

SEQ ID NO: 769246 - RNA, 17 nt, Homo sapiens
agcuggccuguggcaca

SEQ ID NO: 769247 - RNA, 14 nt, Homo sapiens
agcugggagcacug

SEQ ID NO: 769248 - RNA, 16 nt, Homo sapiens
agcugggagcacuggu

SEQ ID NO: 769249 - RNA, 22 nt, Homo sapiens
agcugggauaaucacauuauca

SEQ ID NO: 769250 - RNA, 23 nt, Homo sapiens
agcugggauaaucacauuaucau

SEQ ID NO: 769251 - RNA, 18 nt, Homo sapiens
agcugggccccaccuacu

SEQ ID NO: 769252 - RNA, 20 nt, Homo sapiens
agcugggccccaugcucugc

SEQ ID NO: 769253 - RNA, 17 nt, Homo sapiens
agcugggcucugcaauu

SEQ ID NO: 769254 - RNA, 19 nt, Homo sapiens
agcuggggccgucugugug

SEQ ID NO: 769255 - RNA, 18 nt, Homo sapiens
agcuggggugggagcucc

SEQ ID NO: 769256 - RNA, 20 nt, Homo sapiens
agcuggugccccaccugccu

SEQ ID NO: 769257 - RNA, 21 nt, Homo sapiens
agcugguggcaauaaauauua

SEQ ID NO: 769258 - RNA, 19 nt, Homo sapiens
agcugguggcccugugccu

SEQ ID NO: 769259 - RNA, 20 nt, Homo sapiens
agcuguaacuuaacuauuaa

SEQ ID NO: 769260 - RNA, 16 nt, Homo sapiens
agcuguacaugaugau

SEQ ID NO: 769261 - RNA, 15 nt, Homo sapiens
agcuguacuuuuacc

SEQ ID NO: 769262 - RNA, 23 nt, Homo sapiens
agcugucccuugcuugccugcag

SEQ ID NO: 769263 - RNA, 12 nt, Homo sapiens
agcugucugcuc

SEQ ID NO: 769264 - RNA, 13 nt, Homo sapiens
agcugugacauau

SEQ ID NO: 769265 - RNA, 17 nt, Homo sapiens
agcugugcaugcucagc

SEQ ID NO: 769266 - RNA, 13 nt, Homo sapiens
agcugugcucaga

SEQ ID NO: 769267 - RNA, 17 nt, Homo sapiens
agcugugggacaauuau

SEQ ID NO: 769268 - RNA, 15 nt, Homo sapiens
agcuguuaccauuca

SEQ ID NO: 769269 - RNA, 18 nt, Homo sapiens
agcuguugcggacaucau

SEQ ID NO: 769270 - RNA, 11 nt, Homo sapiens
agcuguugcua

SEQ ID NO: 769271 - RNA, 14 nt, Homo sapiens
agcuguugggaaca

SEQ ID NO: 769272 - RNA, 15 nt, Homo sapiens
agcuguuucucauga

SEQ ID NO: 769273 - RNA, 14 nt, Homo sapiens
agcuguuuuaguca

SEQ ID NO: 769274 - RNA, 14 nt, Homo sapiens
agcuuaaacacauu

SEQ ID NO: 769275 - RNA, 14 nt, Homo sapiens
agcuuaaauugcuu

SEQ ID NO: 769276 - RNA, 23 nt, Homo sapiens
agcuuaauaaguauuuauugcau

SEQ ID NO: 769277 - RNA, 20 nt, Homo sapiens
agcuuacacugaggacugug

SEQ ID NO: 769278 - RNA, 17 nt, Homo sapiens
agcuuaccugacacaag

SEQ ID NO: 769279 - RNA, 16 nt, Homo sapiens
agcuuacuagcacuuu

SEQ ID NO: 769280 - RNA, 13 nt, Homo sapiens
agcuuagaccuca

SEQ ID NO: 769281 - RNA, 14 nt, Homo sapiens
agcuuauagaauaa

SEQ ID NO: 769282 - RNA, 14 nt, Homo sapiens
agcuucaacccuca

SEQ ID NO: 769283 - RNA, 23 nt, Homo sapiens
agcuucaacccucagccuugaaa

SEQ ID NO: 769284 - RNA, 14 nt, Homo sapiens
agcuucacaguacc

SEQ ID NO: 769285 - RNA, 15 nt, Homo sapiens
agcuucagaugguga

SEQ ID NO: 769286 - RNA, 21 nt, Homo sapiens
agcuucauauaccagcaauau

SEQ ID NO: 769287 - RNA, 12 nt, Homo sapiens
agcuucaugccu

SEQ ID NO: 769288 - RNA, 19 nt, Homo sapiens
agcuuccaaaugugucaga

SEQ ID NO: 769289 - RNA, 18 nt, Homo sapiens
agcuucccacaccugccu

SEQ ID NO: 769290 - RNA, 22 nt, Homo sapiens
agcuucccgaguaacugagauu

SEQ ID NO: 769291 - RNA, 21 nt, Homo sapiens
agcuucucugggcugaaugua

SEQ ID NO: 769292 - RNA, 14 nt, Homo sapiens
agcuucucugugaa

SEQ ID NO: 769293 - RNA, 21 nt, Homo sapiens
agcuugaauucauguuggucu

SEQ ID NO: 769294 - RNA, 22 nt, Homo sapiens
agcuugacucccaaguuuccau

SEQ ID NO: 769295 - RNA, 17 nt, Homo sapiens
agcuugcucuucagugg

SEQ ID NO: 769296 - RNA, 21 nt, Homo sapiens
agcuugcuugcagauggucug

SEQ ID NO: 769297 - RNA, 19 nt, Homo sapiens
agcuugggcaacagagcaa

SEQ ID NO: 769298 - RNA, 18 nt, Homo sapiens
agcuuggggccaccaaag

SEQ ID NO: 769299 - RNA, 20 nt, Homo sapiens
agcuugucaaugauuucaaa

SEQ ID NO: 769300 - RNA, 19 nt, Homo sapiens
agcuuguugaaaacccaga

SEQ ID NO: 769301 - RNA, 16 nt, Homo sapiens
agccgcugcacaucac

SEQ ID NO: 769302 - RNA, 15 nt, Homo sapiens
agccgggaaggggaa

SEQ ID NO: 769303 - RNA, 20 nt, Homo sapiens
agccgggcugggaaugggga

SEQ ID NO: 769304 - RNA, 18 nt, Homo sapiens
agccgugaauucaguugg

SEQ ID NO: 769305 - RNA, 13 nt, Homo sapiens
agccuaaaagaca

SEQ ID NO: 769306 - RNA, 17 nt, Homo sapiens
agccuacccuauucuau

SEQ ID NO: 769307 - RNA, 21 nt, Homo sapiens
agccuacuuucacacuaagaa

SEQ ID NO: 769308 - RNA, 22 nt, Homo sapiens
agccuacuuucacacuaagaaa

SEQ ID NO: 769309 - RNA, 20 nt, Homo sapiens
agccuagagaccauguugac

SEQ ID NO: 769310 - RNA, 17 nt, Homo sapiens
agccuagccaccuccca

SEQ ID NO: 769311 - RNA, 17 nt, Homo sapiens
agccuagccgaccucag

SEQ ID NO: 769312 - RNA, 16 nt, Homo sapiens
agccuagcggagccca

SEQ ID NO: 769313 - RNA, 20 nt, Homo sapiens
agccuauuugaacuacuuaa

SEQ ID NO: 769314 - RNA, 21 nt, Homo sapiens
agccuauuuuauaugcacaaa

SEQ ID NO: 769315 - RNA, 16 nt, Homo sapiens
agccucaagaugaagg

SEQ ID NO: 769316 - RNA, 12 nt, Homo sapiens
agccucaccaag

SEQ ID NO: 769317 - RNA, 16 nt, Homo sapiens
agccucagaaagggau

SEQ ID NO: 769318 - RNA, 14 nt, Homo sapiens
agccucagccuccc

SEQ ID NO: 769319 - RNA, 16 nt, Homo sapiens
agccucauccugagag

SEQ ID NO: 769320 - RNA, 12 nt, Homo sapiens
agccucaucucu

SEQ ID NO: 769321 - RNA, 19 nt, Homo sapiens
agccucaugccaacccugg

SEQ ID NO: 769322 - RNA, 21 nt, Homo sapiens
agccuccaaugcauuggccuc

SEQ ID NO: 769323 - RNA, 15 nt, Homo sapiens
agccuccacugccuc

SEQ ID NO: 769324 - RNA, 17 nt, Homo sapiens
agccuccccgugccaaa

SEQ ID NO: 769325 - RNA, 19 nt, Homo sapiens
aacuacugcuggaaaaagc

SEQ ID NO: 769326 - RNA, 11 nt, Homo sapiens
aacuacuucuu

SEQ ID NO: 769327 - RNA, 17 nt, Homo sapiens
aacuagaaaucugccaa

SEQ ID NO: 769328 - RNA, 21 nt, Homo sapiens
aacuagacuaagaagauuuag

SEQ ID NO: 769329 - RNA, 17 nt, Homo sapiens
aacuagcauuacauuau

SEQ ID NO: 769330 - RNA, 13 nt, Homo sapiens
aacuagcuuuugc

SEQ ID NO: 769331 - RNA, 15 nt, Homo sapiens
aacuaggaaaaucac

SEQ ID NO: 769332 - RNA, 23 nt, Homo sapiens
aacuagugagcgcccccugcccc

SEQ ID NO: 769333 - RNA, 17 nt, Homo sapiens
aacuauaacaaucacug

SEQ ID NO: 769334 - RNA, 12 nt, Homo sapiens
aacuauccugau

SEQ ID NO: 769335 - RNA, 22 nt, Homo sapiens
aacuaugaaaucaacugacaag

SEQ ID NO: 769336 - RNA, 24 nt, Homo sapiens
aacuauuaaucauccucugaguua

SEQ ID NO: 769337 - RNA, 19 nt, Homo sapiens
aacuauuuuaaauauccau

SEQ ID NO: 769338 - RNA, 16 nt, Homo sapiens
aacuauuuucaaagac

SEQ ID NO: 769339 - RNA, 19 nt, Homo sapiens
aacucaaaaauauuugcug

SEQ ID NO: 769340 - RNA, 14 nt, Homo sapiens
aacucaaaugagcc

SEQ ID NO: 769341 - RNA, 18 nt, Homo sapiens
aacucaaauggggccaga

SEQ ID NO: 769342 - RNA, 18 nt, Homo sapiens
aacucaaggauaccuucu

SEQ ID NO: 769343 - RNA, 13 nt, Homo sapiens
aacucacacuccc

SEQ ID NO: 769344 - RNA, 16 nt, Homo sapiens
aacucacagcuucucc

SEQ ID NO: 769345 - RNA, 16 nt, Homo sapiens
aacucacuccacugua

SEQ ID NO: 769346 - RNA, 14 nt, Homo sapiens
aacucacugagggu

SEQ ID NO: 769347 - RNA, 13 nt, Homo sapiens
aacucacugccua

SEQ ID NO: 769348 - RNA, 13 nt, Homo sapiens
aacucacuuuccc

SEQ ID NO: 769349 - RNA, 16 nt, Homo sapiens
aacucagaaacaucag

SEQ ID NO: 769350 - RNA, 18 nt, Homo sapiens
aacucagugggacauagc

SEQ ID NO: 769351 - RNA, 16 nt, Homo sapiens
aacucaguuccaaagu

SEQ ID NO: 769352 - RNA, 19 nt, Homo sapiens
aacucaugaggagggaaaa

SEQ ID NO: 769353 - RNA, 21 nt, Homo sapiens
aacucauggaccacaguaaca

SEQ ID NO: 769354 - RNA, 16 nt, Homo sapiens
aacuccacaugcuggu

SEQ ID NO: 769355 - RNA, 20 nt, Homo sapiens
aacuccagcaacuucuucuc

SEQ ID NO: 769356 - RNA, 19 nt, Homo sapiens
aacuccaugcaaaccaugc

SEQ ID NO: 769357 - RNA, 20 nt, Homo sapiens
aacuccgugcuuaaccaaag

SEQ ID NO: 769358 - RNA, 16 nt, Homo sapiens
aacuccuauaauuccc

SEQ ID NO: 769359 - RNA, 21 nt, Homo sapiens
aacuccugaccucaggugauu

SEQ ID NO: 769360 - RNA, 17 nt, Homo sapiens
aacuccuuucagccaca

SEQ ID NO: 769361 - RNA, 19 nt, Homo sapiens
aacuccuuuuccacuuuaa

SEQ ID NO: 769362 - RNA, 21 nt, Homo sapiens
aacucgguauuaauccaaagc

SEQ ID NO: 769363 - RNA, 20 nt, Homo sapiens
aacucuacccuggcacuaua

SEQ ID NO: 769364 - RNA, 17 nt, Homo sapiens
aacucuagagagccuua

SEQ ID NO: 769365 - RNA, 21 nt, Homo sapiens
aacucucaccaugaugugaag

SEQ ID NO: 769366 - RNA, 22 nt, Homo sapiens
aacucucaccaugaugugaaga

SEQ ID NO: 769367 - RNA, 19 nt, Homo sapiens
aacucuccuacacuuccau

SEQ ID NO: 769368 - RNA, 24 nt, Homo sapiens
aacucuccuuugcucucuggccac

SEQ ID NO: 769369 - RNA, 12 nt, Homo sapiens
aacucucuccac

SEQ ID NO: 769370 - RNA, 14 nt, Homo sapiens
aacucugacaaggg

SEQ ID NO: 769371 - RNA, 23 nt, Homo sapiens
aacucugcuugauuuuugccucu

SEQ ID NO: 769372 - RNA, 13 nt, Homo sapiens
aacucuggcucca

SEQ ID NO: 769373 - RNA, 19 nt, Homo sapiens
aacucugguaaaugaucac

SEQ ID NO: 769374 - RNA, 23 nt, Homo sapiens
aacucuucaguuaauucuuagau

SEQ ID NO: 769375 - RNA, 19 nt, Homo sapiens
aacucuugaagacuccagu

SEQ ID NO: 769376 - RNA, 16 nt, Homo sapiens
aacucuugaccucagg

SEQ ID NO: 769377 - RNA, 15 nt, Homo sapiens
aacucuugugaauua

SEQ ID NO: 769378 - RNA, 20 nt, Homo sapiens
aacucuuucuggccugccuu

SEQ ID NO: 769379 - RNA, 22 nt, Homo sapiens
aacucuuucuggccugccuucg

SEQ ID NO: 769380 - RNA, 14 nt, Homo sapiens
aacucuuuggugca

SEQ ID NO: 769381 - RNA, 17 nt, Homo sapiens
aacucuuuuaagugccu

SEQ ID NO: 769382 - RNA, 15 nt, Homo sapiens
aacugaaggcucaga

SEQ ID NO: 769383 - RNA, 14 nt, Homo sapiens
aacugacacaggaa

SEQ ID NO: 769384 - RNA, 18 nt, Homo sapiens
aacugacugccuugcuaa

SEQ ID NO: 769385 - RNA, 16 nt, Homo sapiens
aacugagcuacuagag

SEQ ID NO: 769386 - RNA, 23 nt, Homo sapiens
aacugaggacuguuugcaauuga

SEQ ID NO: 769387 - RNA, 18 nt, Homo sapiens
aacugaggguuaucuuug

SEQ ID NO: 769388 - RNA, 19 nt, Homo sapiens
aacugagguucuugggaua

SEQ ID NO: 769389 - RNA, 18 nt, Homo sapiens
aacugauuuuuagcuuua

SEQ ID NO: 769390 - RNA, 17 nt, Homo sapiens
aacugcaccugucauca

SEQ ID NO: 769391 - RNA, 14 nt, Homo sapiens
aacugcacugucaa

SEQ ID NO: 769392 - RNA, 15 nt, Homo sapiens
aacugcauggaccua

SEQ ID NO: 769393 - RNA, 21 nt, Homo sapiens
aacugcuucccuuacuuugcu

SEQ ID NO: 769394 - RNA, 20 nt, Homo sapiens
aacugcuuuuccacaaggaa

SEQ ID NO: 769395 - RNA, 19 nt, Homo sapiens
aacuggaaaggaucuguga

SEQ ID NO: 769396 - RNA, 19 nt, Homo sapiens
aacuggaagauacauaaaa

SEQ ID NO: 769397 - RNA, 16 nt, Homo sapiens
aacuggacaugaagga

SEQ ID NO: 769398 - RNA, 14 nt, Homo sapiens
aacuggacucagga

SEQ ID NO: 769399 - RNA, 22 nt, Homo sapiens
aacuggcccguggagacugaga

SEQ ID NO: 769400 - RNA, 20 nt, Homo sapiens
aacuggcuucugcuugucau

SEQ ID NO: 769401 - RNA, 20 nt, Homo sapiens
aacugggggcaaagguuuga

SEQ ID NO: 769402 - RNA, 22 nt, Homo sapiens
aacugguacacuucauuuaucc

SEQ ID NO: 769403 - RNA, 20 nt, Homo sapiens
aacugguauuuuaucuuuga

SEQ ID NO: 769404 - RNA, 20 nt, Homo sapiens
aacugguuuaggauuacuua

SEQ ID NO: 769405 - RNA, 16 nt, Homo sapiens
aacuguagcugccaug

SEQ ID NO: 769406 - RNA, 13 nt, Homo sapiens
aacuguagucuca

SEQ ID NO: 769407 - RNA, 14 nt, Homo sapiens
aacuguaugaaugu

SEQ ID NO: 769408 - RNA, 13 nt, Homo sapiens
aacuguccaccaa

SEQ ID NO: 769409 - RNA, 13 nt, Homo sapiens
aacugucuuggcu

SEQ ID NO: 769410 - RNA, 15 nt, Homo sapiens
aacugucuuguuuca

SEQ ID NO: 769411 - RNA, 18 nt, Homo sapiens
aacuguguauguacauau

SEQ ID NO: 769412 - RNA, 14 nt, Homo sapiens
aacuguguuuacuc

SEQ ID NO: 769413 - RNA, 11 nt, Homo sapiens
aacuguugcuc

SEQ ID NO: 769414 - RNA, 14 nt, Homo sapiens
aacuguuuccccag

SEQ ID NO: 769415 - RNA, 22 nt, Homo sapiens
aacuuaaaaaaaaaauucugcc

SEQ ID NO: 769416 - RNA, 17 nt, Homo sapiens
aacuuaaaaauauccau

SEQ ID NO: 769417 - RNA, 19 nt, Homo sapiens
aacuuaaaagucaguauca

SEQ ID NO: 769418 - RNA, 13 nt, Homo sapiens
aacuuaacauuca

SEQ ID NO: 769419 - RNA, 23 nt, Homo sapiens
aacuuagagacuuuagagucuaa

SEQ ID NO: 769420 - RNA, 16 nt, Homo sapiens
aacuuagagauugcau

SEQ ID NO: 769421 - RNA, 16 nt, Homo sapiens
aacuuaggcaugcaca

SEQ ID NO: 769422 - RNA, 15 nt, Homo sapiens
aacuucaauuuacuu

SEQ ID NO: 769423 - RNA, 20 nt, Homo sapiens
aacuucaccuacauuaucuc

SEQ ID NO: 769424 - RNA, 13 nt, Homo sapiens
aacuucagggauc

SEQ ID NO: 769425 - RNA, 16 nt, Homo sapiens
aacuucagguggauga

SEQ ID NO: 769426 - RNA, 14 nt, Homo sapiens
aacuucauuugaca

SEQ ID NO: 769427 - RNA, 12 nt, Homo sapiens
aacuuccaaagg

SEQ ID NO: 769428 - RNA, 19 nt, Homo sapiens
aacuuccacaagagugaau

SEQ ID NO: 769429 - RNA, 19 nt, Homo sapiens
aacuuccagguuccaucca

SEQ ID NO: 769430 - RNA, 16 nt, Homo sapiens
aacuucccgucccaua

SEQ ID NO: 769431 - RNA, 20 nt, Homo sapiens
aacuuccgccuccuguguuc

SEQ ID NO: 769432 - RNA, 11 nt, Homo sapiens
aacuuccucag

SEQ ID NO: 769433 - RNA, 22 nt, Homo sapiens
aacuuccuuggacucauuuuaa

SEQ ID NO: 769434 - RNA, 22 nt, Homo sapiens
aacuucugccucccaugcuuac

SEQ ID NO: 769435 - RNA, 18 nt, Homo sapiens
aacuugaaaccugggcau

SEQ ID NO: 769436 - RNA, 18 nt, Homo sapiens
aacuugaaugugucaggu

SEQ ID NO: 769437 - RNA, 14 nt, Homo sapiens
aacuugacccccuu

SEQ ID NO: 769438 - RNA, 22 nt, Homo sapiens
aacuugagcgugaaucuguauc

SEQ ID NO: 769439 - RNA, 13 nt, Homo sapiens
aacuugcaauacc

SEQ ID NO: 769440 - RNA, 14 nt, Homo sapiens
aaccagagugcuga

SEQ ID NO: 769441 - RNA, 14 nt, Homo sapiens
aaccagccaggcag

SEQ ID NO: 769442 - RNA, 15 nt, Homo sapiens
aaccagcccaaccau

SEQ ID NO: 769443 - RNA, 15 nt, Homo sapiens
aaccaggaaauggaa

SEQ ID NO: 769444 - RNA, 17 nt, Homo sapiens
aaccaggacccugucca

SEQ ID NO: 769445 - RNA, 19 nt, Homo sapiens
aaccaggccacuugccuca

SEQ ID NO: 769446 - RNA, 20 nt, Homo sapiens
aaccaguccccccacccuca

SEQ ID NO: 769447 - RNA, 18 nt, Homo sapiens
aaccagucucucaaguga

SEQ ID NO: 769448 - RNA, 14 nt, Homo sapiens
aaccaguuuaucca

SEQ ID NO: 769449 - RNA, 19 nt, Homo sapiens
aaccauauauauacauaua

SEQ ID NO: 769450 - RNA, 18 nt, Homo sapiens
aaccauaugauacuauca

SEQ ID NO: 769451 - RNA, 15 nt, Homo sapiens
aaccaucccugaugu

SEQ ID NO: 769452 - RNA, 17 nt, Homo sapiens
aaccaugaacucagcua

SEQ ID NO: 769453 - RNA, 22 nt, Homo sapiens
aaccaugcauggugcaucagca

SEQ ID NO: 769454 - RNA, 13 nt, Homo sapiens
aaccaugccuuuu

SEQ ID NO: 769455 - RNA, 21 nt, Homo sapiens
aaccauuuucaaaagcaauuc

SEQ ID NO: 769456 - RNA, 19 nt, Homo sapiens
aacccaaaaccucaugaca

SEQ ID NO: 769457 - RNA, 15 nt, Homo sapiens
aacccaccagccuaa

SEQ ID NO: 769458 - RNA, 19 nt, Homo sapiens
aacccaccccgcuuucgua

SEQ ID NO: 769459 - RNA, 14 nt, Homo sapiens
aacccacccggcug

SEQ ID NO: 769460 - RNA, 12 nt, Homo sapiens
aacccaccugcu

SEQ ID NO: 769461 - RNA, 21 nt, Homo sapiens
aacccacugaaccuucugagc

SEQ ID NO: 769462 - RNA, 17 nt, Homo sapiens
aacccaggggacagcug

SEQ ID NO: 769463 - RNA, 17 nt, Homo sapiens
aacccagggugugaaca

SEQ ID NO: 769464 - RNA, 23 nt, Homo sapiens
aacccauacaauguauguacaau

SEQ ID NO: 769465 - RNA, 17 nt, Homo sapiens
aacccauucccucucca

SEQ ID NO: 769466 - RNA, 23 nt, Homo sapiens
aaccccaacaauugugugaauua

SEQ ID NO: 769467 - RNA, 14 nt, Homo sapiens
aaccccaucucuac

SEQ ID NO: 769468 - RNA, 16 nt, Homo sapiens
aaccccaucucuacua

SEQ ID NO: 769469 - RNA, 19 nt, Homo sapiens
aaccccaucucuacugaaa

SEQ ID NO: 769470 - RNA, 13 nt, Homo sapiens
aacccccagugua

SEQ ID NO: 769471 - RNA, 17 nt, Homo sapiens
aacccccaguucaagac

SEQ ID NO: 769472 - RNA, 22 nt, Homo sapiens
aaccccucuuagcuuacaggaa

SEQ ID NO: 769473 - RNA, 18 nt, Homo sapiens
aaccccugaccuacccca

SEQ ID NO: 769474 - RNA, 18 nt, Homo sapiens
aaccccuugguacugaaa

SEQ ID NO: 769475 - RNA, 13 nt, Homo sapiens
aacccggcacugc

SEQ ID NO: 769476 - RNA, 16 nt, Homo sapiens
aacccggcacugcccu

SEQ ID NO: 769477 - RNA, 17 nt, Homo sapiens
aacccuacuuucuggaa

SEQ ID NO: 769478 - RNA, 22 nt, Homo sapiens
agaaagcuggacugaccaaaga

SEQ ID NO: 769479 - RNA, 21 nt, Homo sapiens
agaaaggccaaggugcuggac

SEQ ID NO: 769480 - RNA, 13 nt, Homo sapiens
agaaaggcucuau

SEQ ID NO: 769481 - RNA, 14 nt, Homo sapiens
agaaaguguauuug

SEQ ID NO: 769482 - RNA, 16 nt, Homo sapiens
agaaaguuaaccccau

SEQ ID NO: 769483 - RNA, 12 nt, Homo sapiens
agaaaguucuca

SEQ ID NO: 769484 - RNA, 18 nt, Homo sapiens
agaaaguucuuaaacuca

SEQ ID NO: 769485 - RNA, 15 nt, Homo sapiens
agaaauaaagaucuc

SEQ ID NO: 769486 - RNA, 19 nt, Homo sapiens
agaaauacaguacuguuuc

SEQ ID NO: 769487 - RNA, 19 nt, Homo sapiens
agaaauacccacuaacaaa

SEQ ID NO: 769488 - RNA, 13 nt, Homo sapiens
agaaauacuugug

SEQ ID NO: 769489 - RNA, 14 nt, Homo sapiens
agaaauagaauuau

SEQ ID NO: 769490 - RNA, 19 nt, Homo sapiens
agaaauaucugaaaaugua

SEQ ID NO: 769491 - RNA, 17 nt, Homo sapiens
agaaauccugcaaugaa

SEQ ID NO: 769492 - RNA, 16 nt, Homo sapiens
agaaaucuaagcugug

SEQ ID NO: 769493 - RNA, 18 nt, Homo sapiens
agaaaucuagaagacugu

SEQ ID NO: 769494 - RNA, 13 nt, Homo sapiens
agaaaucuggccc

SEQ ID NO: 769495 - RNA, 18 nt, Homo sapiens
agaaaugacugcauuuga

SEQ ID NO: 769496 - RNA, 14 nt, Homo sapiens
agaaaugacuuuga

SEQ ID NO: 769497 - RNA, 12 nt, Homo sapiens
agaaaugauuca

SEQ ID NO: 769498 - RNA, 22 nt, Homo sapiens
agaaaugcaauaacucugggag

SEQ ID NO: 769499 - RNA, 13 nt, Homo sapiens
agaaaugcugaaa

SEQ ID NO: 769500 - RNA, 18 nt, Homo sapiens
agaaauggcgucugcucu

SEQ ID NO: 769501 - RNA, 20 nt, Homo sapiens
acuguaugugcuguaauuua

SEQ ID NO: 769502 - RNA, 22 nt, Homo sapiens
acuguauguuuacuucucacca

SEQ ID NO: 769503 - RNA, 17 nt, Homo sapiens
acugucaaguacaagca

SEQ ID NO: 769504 - RNA, 16 nt, Homo sapiens
acugucccuugccuca

SEQ ID NO: 769505 - RNA, 15 nt, Homo sapiens
acugucuauuaaaau

SEQ ID NO: 769506 - RNA, 12 nt, Homo sapiens
acugucucaaga

SEQ ID NO: 769507 - RNA, 21 nt, Homo sapiens
acugucugggauuaagggcaa

SEQ ID NO: 769508 - RNA, 16 nt, Homo sapiens
acugucuuccucaaaa

SEQ ID NO: 769509 - RNA, 16 nt, Homo sapiens
acugucuucucccugc

SEQ ID NO: 769510 - RNA, 19 nt, Homo sapiens
acugugaaaauaguguaag

SEQ ID NO: 769511 - RNA, 19 nt, Homo sapiens
acugugcccugggagcucu

SEQ ID NO: 769512 - RNA, 18 nt, Homo sapiens
acugugccugagcucuga

SEQ ID NO: 769513 - RNA, 15 nt, Homo sapiens
acugugcucagccac

SEQ ID NO: 769514 - RNA, 16 nt, Homo sapiens
acuguggccugaaaua

SEQ ID NO: 769515 - RNA, 21 nt, Homo sapiens
acuguguaauuagugccacuu

SEQ ID NO: 769516 - RNA, 13 nt, Homo sapiens
acugugugccagg

SEQ ID NO: 769517 - RNA, 23 nt, Homo sapiens
acuguuacaacuuguauuuccaa

SEQ ID NO: 769518 - RNA, 15 nt, Homo sapiens
acuguucaaugauua

SEQ ID NO: 769519 - RNA, 15 nt, Homo sapiens
acuguucccaacuca

SEQ ID NO: 769520 - RNA, 21 nt, Homo sapiens
acuguucgucacucaaaugaa

SEQ ID NO: 769521 - RNA, 12 nt, Homo sapiens
acuguugaacuu

SEQ ID NO: 769522 - RNA, 17 nt, Homo sapiens
acuguugcuuuagucac

SEQ ID NO: 769523 - RNA, 19 nt, Homo sapiens
acuguuuaagcccagccaa

SEQ ID NO: 769524 - RNA, 18 nt, Homo sapiens
acuguuuauacacugugu

SEQ ID NO: 769525 - RNA, 23 nt, Homo sapiens
acugaggccuugugugucaggcc

SEQ ID NO: 769526 - RNA, 12 nt, Homo sapiens
acugagggccac

SEQ ID NO: 769527 - RNA, 19 nt, Homo sapiens
acugagguugggguguacu

SEQ ID NO: 769528 - RNA, 18 nt, Homo sapiens
acugaguccucguagcca

SEQ ID NO: 769529 - RNA, 16 nt, Homo sapiens
acugaguuaucaggug

SEQ ID NO: 769530 - RNA, 15 nt, Homo sapiens
acugauacacuugaa

SEQ ID NO: 769531 - RNA, 20 nt, Homo sapiens
acugaucacccaaugcauca

SEQ ID NO: 769532 - RNA, 23 nt, Homo sapiens
acugaucucaggggucuuaccuu

SEQ ID NO: 769533 - RNA, 17 nt, Homo sapiens
acugauggaaaauacca

SEQ ID NO: 769534 - RNA, 20 nt, Homo sapiens
acugauggaaaauaccagug

SEQ ID NO: 769535 - RNA, 12 nt, Homo sapiens
acugaugguuca

SEQ ID NO: 769536 - RNA, 20 nt, Homo sapiens
acugauguccggagagacag

SEQ ID NO: 769537 - RNA, 20 nt, Homo sapiens
acugauuauaguacugacag

SEQ ID NO: 769538 - RNA, 21 nt, Homo sapiens
acugauucucuaugacaugaa

SEQ ID NO: 769539 - RNA, 14 nt, Homo sapiens
acugauuucacaac

SEQ ID NO: 769540 - RNA, 12 nt, Homo sapiens
acugauuugcaa

SEQ ID NO: 769541 - RNA, 20 nt, Homo sapiens
acugauuuuuagcuuuacaa

SEQ ID NO: 769542 - RNA, 16 nt, Homo sapiens
acugcaaaaaaagccu

SEQ ID NO: 769543 - RNA, 21 nt, Homo sapiens
acugcaacaacgccuggugcc

SEQ ID NO: 769544 - RNA, 23 nt, Homo sapiens
acugcaaccucugccucccaggu

SEQ ID NO: 769545 - RNA, 16 nt, Homo sapiens
acugcaacuucugccu

SEQ ID NO: 769546 - RNA, 12 nt, Homo sapiens
acugcaagcucu

SEQ ID NO: 769547 - RNA, 16 nt, Homo sapiens
acugcaagcucugccu

SEQ ID NO: 769548 - RNA, 21 nt, Homo sapiens
acugcaaggaaaaaugaugac

SEQ ID NO: 769549 - RNA, 20 nt, Homo sapiens
acugcaaugucaaaguuuaa

SEQ ID NO: 769550 - RNA, 18 nt, Homo sapiens
acugcacagugcaucuca

SEQ ID NO: 769551 - RNA, 21 nt, Homo sapiens
acugcaccuggcccagaugau

SEQ ID NO: 769552 - RNA, 20 nt, Homo sapiens
acugcacuccagccugggug

SEQ ID NO: 769553 - RNA, 19 nt, Homo sapiens
acugcagcaggccacuggg

SEQ ID NO: 769554 - RNA, 16 nt, Homo sapiens
acugcagggcacugug

SEQ ID NO: 769555 - RNA, 20 nt, Homo sapiens
acugcauagcagaccacaca

SEQ ID NO: 769556 - RNA, 13 nt, Homo sapiens
acugcaucucaaa

SEQ ID NO: 769557 - RNA, 12 nt, Homo sapiens
acugcauuuuac

SEQ ID NO: 769558 - RNA, 16 nt, Homo sapiens
acugccaggcugccuc

SEQ ID NO: 769559 - RNA, 21 nt, Homo sapiens
acugccaucaagaugagagaa

SEQ ID NO: 769560 - RNA, 16 nt, Homo sapiens
acugccauuacccagu

SEQ ID NO: 769561 - RNA, 13 nt, Homo sapiens
acugcccuaagcc

SEQ ID NO: 769562 - RNA, 16 nt, Homo sapiens
acugcccuggcagcag

SEQ ID NO: 769563 - RNA, 13 nt, Homo sapiens
acugcccuuccag

SEQ ID NO: 769564 - RNA, 16 nt, Homo sapiens
acugcccuuccaggug

SEQ ID NO: 769565 - RNA, 16 nt, Homo sapiens
acugccgccuacugga

SEQ ID NO: 769566 - RNA, 23 nt, Homo sapiens
acugccgccuacuggacgcugcc

SEQ ID NO: 769567 - RNA, 13 nt, Homo sapiens
acugcgacuguga

SEQ ID NO: 769568 - RNA, 17 nt, Homo sapiens
acugcgaggacaucaaa

SEQ ID NO: 769569 - RNA, 22 nt, Homo sapiens
acugcuacagcaauuucuaauu

SEQ ID NO: 769570 - RNA, 21 nt, Homo sapiens
acugcucagaacuugcugcug

SEQ ID NO: 769571 - RNA, 19 nt, Homo sapiens
acugcucccaucauuccuu

SEQ ID NO: 769572 - RNA, 20 nt, Homo sapiens
acugcucuccuccaccucaa

SEQ ID NO: 769573 - RNA, 13 nt, Homo sapiens
acugcucugagaa

SEQ ID NO: 769574 - RNA, 14 nt, Homo sapiens
acugcucugagaau

SEQ ID NO: 769575 - RNA, 22 nt, Homo sapiens
acugcucugagaauuguugaga

SEQ ID NO: 769576 - RNA, 13 nt, Homo sapiens
acugcugcaaagc

SEQ ID NO: 769577 - RNA, 13 nt, Homo sapiens
acugcugcugcug

SEQ ID NO: 769578 - RNA, 20 nt, Homo sapiens
acugcuguagacauuugcua

SEQ ID NO: 769579 - RNA, 20 nt, Homo sapiens
acugcuuuaaaaaacaauua

SEQ ID NO: 769580 - RNA, 20 nt, Homo sapiens
acugcuuuccagccugggca

SEQ ID NO: 769581 - RNA, 17 nt, Homo sapiens
acugcuuuucauuagca

SEQ ID NO: 769582 - RNA, 21 nt, Homo sapiens
acuggaaaacagaacacuuau

SEQ ID NO: 769583 - RNA, 18 nt, Homo sapiens
acuggaaaaguguaauag

SEQ ID NO: 769584 - RNA, 17 nt, Homo sapiens
acuggaaagacauagcc

SEQ ID NO: 769585 - RNA, 22 nt, Homo sapiens
acuggaaccccagcuucccucc

SEQ ID NO: 769586 - RNA, 14 nt, Homo sapiens
acuggaacggugaa

SEQ ID NO: 769587 - RNA, 17 nt, Homo sapiens
acuggaagaaagcaaca

SEQ ID NO: 769588 - RNA, 21 nt, Homo sapiens
acuggaagaaagcaacaaaga

SEQ ID NO: 769589 - RNA, 13 nt, Homo sapiens
acuggacucagga

SEQ ID NO: 769590 - RNA, 13 nt, Homo sapiens
acuggacugugug

SEQ ID NO: 769591 - RNA, 12 nt, Homo sapiens
acuggagcugca

SEQ ID NO: 769592 - RNA, 20 nt, Homo sapiens
acuggaggggcccacccaca

SEQ ID NO: 769593 - RNA, 19 nt, Homo sapiens
acuggagguugaagccaag

SEQ ID NO: 769594 - RNA, 15 nt, Homo sapiens
acuggauagaaccac

SEQ ID NO: 769595 - RNA, 23 nt, Homo sapiens
acuggauagaaccaccauaguga

SEQ ID NO: 769596 - RNA, 20 nt, Homo sapiens
acuggauucuuaaccaagaa

SEQ ID NO: 769597 - RNA, 13 nt, Homo sapiens
acuggcagcaucu

SEQ ID NO: 769598 - RNA, 15 nt, Homo sapiens
acuggcagcuccucu

SEQ ID NO: 769599 - RNA, 18 nt, Homo sapiens
acuggcaguaaccuagug

SEQ ID NO: 769600 - RNA, 23 nt, Homo sapiens
acuggccagagagggcccagcug

SEQ ID NO: 769601 - RNA, 22 nt, Homo sapiens
acuggccugggucucccuggug

SEQ ID NO: 769602 - RNA, 21 nt, Homo sapiens
acuggcuucucuugagucaca

SEQ ID NO: 769603 - RNA, 18 nt, Homo sapiens
acugggagauacagccau

SEQ ID NO: 769604 - RNA, 19 nt, Homo sapiens
acugggcaaugauggcaau

SEQ ID NO: 769605 - RNA, 18 nt, Homo sapiens
acugggcugggccucgug

SEQ ID NO: 769606 - RNA, 20 nt, Homo sapiens
acuggggagucuuuguggau

SEQ ID NO: 769607 - RNA, 23 nt, Homo sapiens
acuggggccuccagaacucacug

SEQ ID NO: 769608 - RNA, 14 nt, Homo sapiens
acuggggugggggu

SEQ ID NO: 769609 - RNA, 17 nt, Homo sapiens
acugggucugacaugaa

SEQ ID NO: 769610 - RNA, 18 nt, Homo sapiens
acugggucugaccuggug

SEQ ID NO: 769611 - RNA, 20 nt, Homo sapiens
acugggugaaucuggcagga

SEQ ID NO: 769612 - RNA, 21 nt, Homo sapiens
acugguaaagccucauuugaa

SEQ ID NO: 769613 - RNA, 22 nt, Homo sapiens
acugguagaacguaaccacgga

SEQ ID NO: 769614 - RNA, 17 nt, Homo sapiens
acugguagguugggaca

SEQ ID NO: 769615 - RNA, 14 nt, Homo sapiens
acugguaguguuca

SEQ ID NO: 769616 - RNA, 16 nt, Homo sapiens
acugguauguguggau

SEQ ID NO: 769617 - RNA, 19 nt, Homo sapiens
acugguauuuuaucuuuga

SEQ ID NO: 769618 - RNA, 16 nt, Homo sapiens
acugguccagcucuga

SEQ ID NO: 769619 - RNA, 18 nt, Homo sapiens
acugguccagcucugaca

SEQ ID NO: 769620 - RNA, 22 nt, Homo sapiens
acugguccagcucugacauccc

SEQ ID NO: 769621 - RNA, 17 nt, Homo sapiens
acuggucuccuugcuuc

SEQ ID NO: 769622 - RNA, 16 nt, Homo sapiens
acugguucacauccua

SEQ ID NO: 769623 - RNA, 23 nt, Homo sapiens
acugguucauauuggacugauaa

SEQ ID NO: 769624 - RNA, 16 nt, Homo sapiens
acugguuguucuguua

SEQ ID NO: 769625 - RNA, 16 nt, Homo sapiens
acugguuuacacuuua

SEQ ID NO: 769626 - RNA, 14 nt, Homo sapiens
acugguuucucaga

SEQ ID NO: 769627 - RNA, 23 nt, Homo sapiens
acugguuucucagaauccaaaga

SEQ ID NO: 769628 - RNA, 19 nt, Homo sapiens
acugguuugcagugaauuu

SEQ ID NO: 769629 - RNA, 14 nt, Homo sapiens
acuguaacuacuuc

SEQ ID NO: 769630 - RNA, 14 nt, Homo sapiens
acuguacauuguga

SEQ ID NO: 769631 - RNA, 17 nt, Homo sapiens
acuguaccgacuuugau

SEQ ID NO: 769632 - RNA, 13 nt, Homo sapiens
acuguacuccucc

SEQ ID NO: 769633 - RNA, 23 nt, Homo sapiens
acuguagaaaugaugauguggaa

SEQ ID NO: 769634 - RNA, 17 nt, Homo sapiens
acuguaggaacaagcau

SEQ ID NO: 769635 - RNA, 14 nt, Homo sapiens
acuguagucucuga

SEQ ID NO: 769636 - RNA, 18 nt, Homo sapiens
acuguaguucacuguaga

SEQ ID NO: 769637 - RNA, 22 nt, Homo sapiens
acuguauauucaggacuugaaa

SEQ ID NO: 769638 - RNA, 16 nt, Homo sapiens
acuguaugugccaaag

SEQ ID NO: 769639 - RNA, 14 nt, Homo sapiens
acagaaacugcaug

SEQ ID NO: 769640 - RNA, 19 nt, Homo sapiens
acagaaagacugagcucaa

SEQ ID NO: 769641 - RNA, 21 nt, Homo sapiens
acagaaagagacuccgucuca

SEQ ID NO: 769642 - RNA, 21 nt, Homo sapiens
acagaaagcuccuuccagacc

SEQ ID NO: 769643 - RNA, 15 nt, Homo sapiens
acagaaaguucuuaa

SEQ ID NO: 769644 - RNA, 16 nt, Homo sapiens
acagaaauacaugaaa

SEQ ID NO: 769645 - RNA, 18 nt, Homo sapiens
acagaaauacugcucuga

SEQ ID NO: 769646 - RNA, 13 nt, Homo sapiens
acagaaauuguau

SEQ ID NO: 769647 - RNA, 15 nt, Homo sapiens
acagaaauuguauau

SEQ ID NO: 769648 - RNA, 17 nt, Homo sapiens
acagaacaccuaugcaa

SEQ ID NO: 769649 - RNA, 17 nt, Homo sapiens
acagaacucaacuguau

SEQ ID NO: 769650 - RNA, 13 nt, Homo sapiens
acagaacuucaga

SEQ ID NO: 769651 - RNA, 23 nt, Homo sapiens
acagaagagugacauguuuacaa

SEQ ID NO: 769652 - RNA, 22 nt, Homo sapiens
acagaagcuuaaaaucugugaa

SEQ ID NO: 769653 - RNA, 23 nt, Homo sapiens
acagaagcuucugcccaccuacu

SEQ ID NO: 769654 - RNA, 19 nt, Homo sapiens
acagaaggaaucugugcag

SEQ ID NO: 769655 - RNA, 19 nt, Homo sapiens
acagaaggaggaaguggaa

SEQ ID NO: 769656 - RNA, 15 nt, Homo sapiens
acagaaggauguccc

SEQ ID NO: 769657 - RNA, 14 nt, Homo sapiens
acagaauuugucag

SEQ ID NO: 769658 - RNA, 17 nt, Homo sapiens
acagaauuugucagaaa

SEQ ID NO: 769659 - RNA, 20 nt, Homo sapiens
acagaauuuuuuaaauugac

SEQ ID NO: 769660 - RNA, 16 nt, Homo sapiens
acagacagagaaggca

SEQ ID NO: 769661 - RNA, 13 nt, Homo sapiens
acagacaggaaag

SEQ ID NO: 769662 - RNA, 15 nt, Homo sapiens
acagacauacauuua

SEQ ID NO: 769663 - RNA, 20 nt, Homo sapiens
acagacauacauuuaugcac

SEQ ID NO: 769664 - RNA, 16 nt, Homo sapiens
acagacauacauuucu

SEQ ID NO: 769665 - RNA, 16 nt, Homo sapiens
acagacugauguguau

SEQ ID NO: 769666 - RNA, 12 nt, Homo sapiens
acagacugugag

SEQ ID NO: 769667 - RNA, 22 nt, Homo sapiens
acagucauaaauacugucaaac

SEQ ID NO: 769668 - RNA, 13 nt, Homo sapiens
acagucauuuaaa

SEQ ID NO: 769669 - RNA, 13 nt, Homo sapiens
acaguccacaggg

SEQ ID NO: 769670 - RNA, 15 nt, Homo sapiens
acaguccugggagaa

SEQ ID NO: 769671 - RNA, 22 nt, Homo sapiens
acaguccugggagaaccucagg

SEQ ID NO: 769672 - RNA, 19 nt, Homo sapiens
acagucuucuaauuccuca

SEQ ID NO: 769673 - RNA, 16 nt, Homo sapiens
acagucuuugcaguuc

SEQ ID NO: 769674 - RNA, 20 nt, Homo sapiens
acagugaaguuuuacugucu

SEQ ID NO: 769675 - RNA, 14 nt, Homo sapiens
acagugaauccaga

SEQ ID NO: 769676 - RNA, 17 nt, Homo sapiens
acagugacacuggacca

SEQ ID NO: 769677 - RNA, 20 nt, Homo sapiens
acagugagaccccuucucaa

SEQ ID NO: 769678 - RNA, 19 nt, Homo sapiens
acagugauauacuuacuca

SEQ ID NO: 769679 - RNA, 12 nt, Homo sapiens
acagugaugauu

SEQ ID NO: 769680 - RNA, 15 nt, Homo sapiens
acagugaugccugcc

SEQ ID NO: 769681 - RNA, 22 nt, Homo sapiens
acagugcagugaauuggaagac

SEQ ID NO: 769682 - RNA, 14 nt, Homo sapiens
acagugccacugca

SEQ ID NO: 769683 - RNA, 19 nt, Homo sapiens
acagugcccaccugcucuu

SEQ ID NO: 769684 - RNA, 21 nt, Homo sapiens
acagugcccaugcaauggcuu

SEQ ID NO: 769685 - RNA, 19 nt, Homo sapiens
acagugccucuuccaguga

SEQ ID NO: 769686 - RNA, 15 nt, Homo sapiens
acagugccugggaau

SEQ ID NO: 769687 - RNA, 21 nt, Homo sapiens
acagugcucuuuucuccucac

SEQ ID NO: 769688 - RNA, 10 nt, Homo sapiens
acaguggaau

SEQ ID NO: 769689 - RNA, 21 nt, Homo sapiens
acaguggaggaagagggacag

SEQ ID NO: 769690 - RNA, 15 nt, Homo sapiens
acaguguacucuaua

SEQ ID NO: 769691 - RNA, 14 nt, Homo sapiens
acaguguugcccag

SEQ ID NO: 769692 - RNA, 22 nt, Homo sapiens
acaguguuuuaauaaaugguuu

SEQ ID NO: 769693 - RNA, 19 nt, Homo sapiens
acaguguuuuuauugcucg

SEQ ID NO: 769694 - RNA, 19 nt, Homo sapiens
acaguguuuuuccuuggau

SEQ ID NO: 769695 - RNA, 13 nt, Homo sapiens
acaguuacaguug

SEQ ID NO: 769696 - RNA, 17 nt, Homo sapiens
acaguuagguagcuuua

SEQ ID NO: 769697 - RNA, 18 nt, Homo sapiens
acaguuagguagcuuuag

SEQ ID NO: 769698 - RNA, 21 nt, Homo sapiens
acaguucauguuugcuucaua

SEQ ID NO: 769699 - RNA, 21 nt, Homo sapiens
acaguucuuugggccagacau

SEQ ID NO: 769700 - RNA, 17 nt, Homo sapiens
acaguuggaacuuacau

SEQ ID NO: 769701 - RNA, 22 nt, Homo sapiens
acaguuuauuuuuauacuuuca

SEQ ID NO: 769702 - RNA, 23 nt, Homo sapiens
acaguuucguagcaugaguuuaa

SEQ ID NO: 769703 - RNA, 14 nt, Homo sapiens
acaguuuuaacugu

SEQ ID NO: 769704 - RNA, 16 nt, Homo sapiens
acaguuuucugagaaa

SEQ ID NO: 769705 - RNA, 17 nt, Homo sapiens
acaguuuuuccuggaau

SEQ ID NO: 769706 - RNA, 15 nt, Homo sapiens
acaguuuuuggcaaa

SEQ ID NO: 769707 - RNA, 18 nt, Homo sapiens
acaguuuuuuacauauua

SEQ ID NO: 769708 - RNA, 21 nt, Homo sapiens
acauaaaaaauaaaguaccac

SEQ ID NO: 769709 - RNA, 21 nt, Homo sapiens
acauaaaagaauuuuuuuguc

SEQ ID NO: 769710 - RNA, 14 nt, Homo sapiens
acauaaaagacaca

SEQ ID NO: 769711 - RNA, 17 nt, Homo sapiens
acauaaaauuuacauuu

SEQ ID NO: 769712 - RNA, 23 nt, Homo sapiens
acauaacccuagaauucuuaguc

SEQ ID NO: 769713 - RNA, 19 nt, Homo sapiens
acauaacuccugucccuuu

SEQ ID NO: 769714 - RNA, 21 nt, Homo sapiens
acauaagacagacagcaguuu

SEQ ID NO: 769715 - RNA, 13 nt, Homo sapiens
acauaagcacuga

SEQ ID NO: 769716 - RNA, 15 nt, Homo sapiens
acauaagcagcauuu

SEQ ID NO: 769717 - RNA, 20 nt, Homo sapiens
acauaagcucagaauccaag

SEQ ID NO: 769718 - RNA, 15 nt, Homo sapiens
acauaaguaauucaa

SEQ ID NO: 769719 - RNA, 21 nt, Homo sapiens
acauaauugugaccaauacau

SEQ ID NO: 769720 - RNA, 20 nt, Homo sapiens
acauacaauuccaaacacau

SEQ ID NO: 769721 - RNA, 20 nt, Homo sapiens
acauacauaagcagcauuuc

SEQ ID NO: 769722 - RNA, 17 nt, Homo sapiens
acauacauauuaucuca

SEQ ID NO: 769723 - RNA, 18 nt, Homo sapiens
acauacauauuaucucau

SEQ ID NO: 769724 - RNA, 16 nt, Homo sapiens
acauacauuucucaua

SEQ ID NO: 769725 - RNA, 21 nt, Homo sapiens
acauaccaggcaaccucccau

SEQ ID NO: 769726 - RNA, 16 nt, Homo sapiens
acauaccuaccaguau

SEQ ID NO: 769727 - RNA, 23 nt, Homo sapiens
acauaccuggcccugugccuugg

SEQ ID NO: 769728 - RNA, 19 nt, Homo sapiens
acauacgaaacacaaacca

SEQ ID NO: 769729 - RNA, 11 nt, Homo sapiens
acauacugcug

SEQ ID NO: 769730 - RNA, 18 nt, Homo sapiens
acauacuggccuggacug

SEQ ID NO: 769731 - RNA, 17 nt, Homo sapiens
acauagaaaacaaucaa

SEQ ID NO: 769732 - RNA, 22 nt, Homo sapiens
acauagaaacucgggcuugagu

SEQ ID NO: 769733 - RNA, 15 nt, Homo sapiens
acauagcaucucagg

SEQ ID NO: 769734 - RNA, 14 nt, Homo sapiens
acauagcaugacau

SEQ ID NO: 769735 - RNA, 23 nt, Homo sapiens
acauagugaaaccccaucucuac

SEQ ID NO: 769736 - RNA, 13 nt, Homo sapiens
acauauauauuac

SEQ ID NO: 769737 - RNA, 15 nt, Homo sapiens
acauauauauuacaa

SEQ ID NO: 769738 - RNA, 23 nt, Homo sapiens
acauauauucccauguaaugugu

SEQ ID NO: 769739 - RNA, 15 nt, Homo sapiens
acauaucccuuccag

SEQ ID NO: 769740 - RNA, 17 nt, Homo sapiens
acauaucccuuccagau

SEQ ID NO: 769741 - RNA, 17 nt, Homo sapiens
acauauccuuucaagac

SEQ ID NO: 769742 - RNA, 22 nt, Homo sapiens
acauaucuaaagucaucaugaa

SEQ ID NO: 769743 - RNA, 16 nt, Homo sapiens
acauaucuaguaugaa

SEQ ID NO: 769744 - RNA, 12 nt, Homo sapiens
acauaugcaccu

SEQ ID NO: 769745 - RNA, 22 nt, Homo sapiens
acauauguauacaugugccaug

SEQ ID NO: 769746 - RNA, 13 nt, Homo sapiens
acauauuaucuca

SEQ ID NO: 769747 - RNA, 21 nt, Homo sapiens
acauauuccaugggacuuucc

SEQ ID NO: 769748 - RNA, 18 nt, Homo sapiens
acauauuuuuauacuuua

SEQ ID NO: 769749 - RNA, 22 nt, Homo sapiens
acauauuuuuauacuuuauuga

SEQ ID NO: 769750 - RNA, 16 nt, Homo sapiens
acaucaaaacuaacca

SEQ ID NO: 769751 - RNA, 22 nt, Homo sapiens
acaucaaaacuaaccaucugaa

SEQ ID NO: 769752 - RNA, 11 nt, Homo sapiens
acaucaaagag

SEQ ID NO: 769753 - RNA, 23 nt, Homo sapiens
acaucaaagugguaaauacugug

SEQ ID NO: 769754 - RNA, 12 nt, Homo sapiens
acacaacacaga

SEQ ID NO: 769755 - RNA, 15 nt, Homo sapiens
acacaagacuggcag

SEQ ID NO: 769756 - RNA, 13 nt, Homo sapiens
acacaagcacuuu

SEQ ID NO: 769757 - RNA, 23 nt, Homo sapiens
acacaagcuugucaaugauuuca

SEQ ID NO: 769758 - RNA, 16 nt, Homo sapiens
acacaauacaguauua

SEQ ID NO: 769759 - RNA, 13 nt, Homo sapiens
acacacaauaaag

SEQ ID NO: 769760 - RNA, 12 nt, Homo sapiens
acacacacagcc

SEQ ID NO: 769761 - RNA, 16 nt, Homo sapiens
acacacacgaugcauu

SEQ ID NO: 769762 - RNA, 11 nt, Homo sapiens
acacacacugg

SEQ ID NO: 769763 - RNA, 13 nt, Homo sapiens
acacacacuggcc

SEQ ID NO: 769764 - RNA, 13 nt, Homo sapiens
acacacagcacuc

SEQ ID NO: 769765 - RNA, 16 nt, Homo sapiens
acacacauaccuucau

SEQ ID NO: 769766 - RNA, 23 nt, Homo sapiens
acacaccccucaaaaaaagccuu

SEQ ID NO: 769767 - RNA, 19 nt, Homo sapiens
acacacgagcaaacccaga

SEQ ID NO: 769768 - RNA, 15 nt, Homo sapiens
acacacgaugcauuu

SEQ ID NO: 769769 - RNA, 16 nt, Homo sapiens
acacacggaggcaucc

SEQ ID NO: 769770 - RNA, 15 nt, Homo sapiens
acacacguaccuuca

SEQ ID NO: 769771 - RNA, 16 nt, Homo sapiens
acacacguaccuucau

SEQ ID NO: 769772 - RNA, 11 nt, Homo sapiens
acacacuggcc

SEQ ID NO: 769773 - RNA, 12 nt, Homo sapiens
acacacuggcca

SEQ ID NO: 769774 - RNA, 13 nt, Homo sapiens
acacacuggccau

SEQ ID NO: 769775 - RNA, 15 nt, Homo sapiens
acacagacugcgauu

SEQ ID NO: 769776 - RNA, 20 nt, Homo sapiens
acacagagcuuuggucugug

SEQ ID NO: 769777 - RNA, 16 nt, Homo sapiens
acacagcaacaaugac

SEQ ID NO: 769778 - RNA, 19 nt, Homo sapiens
acacagcaacauccagaaa

SEQ ID NO: 769779 - RNA, 12 nt, Homo sapiens
acacagcacaag

SEQ ID NO: 769780 - RNA, 23 nt, Homo sapiens
acacagcacucucuaaaucuucc

SEQ ID NO: 769781 - RNA, 15 nt, Homo sapiens
acacagcaugugcca

SEQ ID NO: 769782 - RNA, 19 nt, Homo sapiens
acacagccguguguucaaa

SEQ ID NO: 769783 - RNA, 15 nt, Homo sapiens
aacuugcauauguca

SEQ ID NO: 769784 - RNA, 19 nt, Homo sapiens
aacuuguuugcugugaaca

SEQ ID NO: 769785 - RNA, 20 nt, Homo sapiens
aacuuuagacuucccacugu

SEQ ID NO: 769786 - RNA, 20 nt, Homo sapiens
aacuuuagcaacaguuauca

SEQ ID NO: 769787 - RNA, 16 nt, Homo sapiens
aacuuuaucauaugcu

SEQ ID NO: 769788 - RNA, 22 nt, Homo sapiens
aacuuucacagugaagugccuu

SEQ ID NO: 769789 - RNA, 14 nt, Homo sapiens
aacuuucacuuuga

SEQ ID NO: 769790 - RNA, 19 nt, Homo sapiens
aacuuuccucgccugacaa

SEQ ID NO: 769791 - RNA, 18 nt, Homo sapiens
aacuuugaggaacauuca

SEQ ID NO: 769792 - RNA, 15 nt, Homo sapiens
aacuuugccucaaga

SEQ ID NO: 769793 - RNA, 14 nt, Homo sapiens
aacuuuggugcauu

SEQ ID NO: 769794 - RNA, 17 nt, Homo sapiens
aacuuuucaccaaugag

SEQ ID NO: 769795 - RNA, 17 nt, Homo sapiens
aacuuuuugcaugcuua

SEQ ID NO: 769796 - RNA, 15 nt, Homo sapiens
aagaaaaaaaccaua

SEQ ID NO: 769797 - RNA, 15 nt, Homo sapiens
aagaaaaaaagggag

SEQ ID NO: 769798 - RNA, 14 nt, Homo sapiens
aagaaaaacaucuu

SEQ ID NO: 769799 - RNA, 15 nt, Homo sapiens
aagaaaaaggaacua

SEQ ID NO: 769800 - RNA, 17 nt, Homo sapiens
aagaaaaagguuugcau

SEQ ID NO: 769801 - RNA, 22 nt, Homo sapiens
aagaaaaaugagcauacaucuu

SEQ ID NO: 769802 - RNA, 14 nt, Homo sapiens
aagaaaaaugccug

SEQ ID NO: 769803 - RNA, 19 nt, Homo sapiens
aagaaaacaucuauucucu

SEQ ID NO: 769804 - RNA, 16 nt, Homo sapiens
aagaaaacuaggcaau

SEQ ID NO: 769805 - RNA, 11 nt, Homo sapiens
aagaaaacugg

SEQ ID NO: 769806 - RNA, 14 nt, Homo sapiens
aagaaaagaccuuu

SEQ ID NO: 769807 - RNA, 13 nt, Homo sapiens
aagaaaagccuaa

SEQ ID NO: 769808 - RNA, 22 nt, Homo sapiens
aagaaaaguagguuuacauuca

SEQ ID NO: 769809 - RNA, 13 nt, Homo sapiens
aagaaaaucacuu

SEQ ID NO: 769810 - RNA, 15 nt, Homo sapiens
aagaaacacuaagcu

SEQ ID NO: 769811 - RNA, 16 nt, Homo sapiens
aagaaacagcuuucaa

SEQ ID NO: 769812 - RNA, 22 nt, Homo sapiens
aagaaaccaccgaaaucccuca

SEQ ID NO: 769813 - RNA, 23 nt, Homo sapiens
aagaaagagcaacaauccaucuc

SEQ ID NO: 769814 - RNA, 11 nt, Homo sapiens
aagaaagcaaa

SEQ ID NO: 769815 - RNA, 13 nt, Homo sapiens
aagaaaucaaaga

SEQ ID NO: 769816 - RNA, 19 nt, Homo sapiens
aagaaauccaguuuguguu

SEQ ID NO: 769817 - RNA, 20 nt, Homo sapiens
aagaaaucuuucucccucaa

SEQ ID NO: 769818 - RNA, 12 nt, Homo sapiens
aagaaaugcaaa

SEQ ID NO: 769819 - RNA, 23 nt, Homo sapiens
aagaaauguaagggaaacugcca

SEQ ID NO: 769820 - RNA, 12 nt, Homo sapiens
acaacugugguc

SEQ ID NO: 769821 - RNA, 17 nt, Homo sapiens
acaacuguggucaaucc

SEQ ID NO: 769822 - RNA, 11 nt, Homo sapiens
acaacuuccuc

SEQ ID NO: 769823 - RNA, 18 nt, Homo sapiens
acaacuugaauaauacac

SEQ ID NO: 769824 - RNA, 16 nt, Homo sapiens
acaacuugcuacugac

SEQ ID NO: 769825 - RNA, 19 nt, Homo sapiens
acaacuuggguucuucuca

SEQ ID NO: 769826 - RNA, 19 nt, Homo sapiens
acaacuuguauuuccaaac

SEQ ID NO: 769827 - RNA, 21 nt, Homo sapiens
acaacuuugaaacuggaauaa

SEQ ID NO: 769828 - RNA, 15 nt, Homo sapiens
acaagaaaucugaca

SEQ ID NO: 769829 - RNA, 22 nt, Homo sapiens
acaagaagccacagaccuagga

SEQ ID NO: 769830 - RNA, 18 nt, Homo sapiens
acaagacccccagcacuu

SEQ ID NO: 769831 - RNA, 19 nt, Homo sapiens
acaagacccccagcacuug

SEQ ID NO: 769832 - RNA, 12 nt, Homo sapiens
acaagagcugcu

SEQ ID NO: 769833 - RNA, 22 nt, Homo sapiens
acaagaggccauuuaaguaucu

SEQ ID NO: 769834 - RNA, 22 nt, Homo sapiens
acaagagugagacuccaccuca

SEQ ID NO: 769835 - RNA, 23 nt, Homo sapiens
acaagauaccaaggcaaacccua

SEQ ID NO: 769836 - RNA, 18 nt, Homo sapiens
acaagauccuuaaugcag

SEQ ID NO: 769837 - RNA, 18 nt, Homo sapiens
acaagaucuguaauguua

SEQ ID NO: 769838 - RNA, 12 nt, Homo sapiens
acaagauuagaa

SEQ ID NO: 769839 - RNA, 12 nt, Homo sapiens
acaagauuuaug

SEQ ID NO: 769840 - RNA, 13 nt, Homo sapiens
acaagcaugaucu

SEQ ID NO: 769841 - RNA, 20 nt, Homo sapiens
acaagccaacauaugaauau

SEQ ID NO: 769842 - RNA, 20 nt, Homo sapiens
acaagccaacgacaaagcca

SEQ ID NO: 769843 - RNA, 17 nt, Homo sapiens
acaagccaacuuguaaa

SEQ ID NO: 769844 - RNA, 21 nt, Homo sapiens
acaagccccacagccccucaa

SEQ ID NO: 769845 - RNA, 14 nt, Homo sapiens
acaagccugagaac

SEQ ID NO: 769846 - RNA, 17 nt, Homo sapiens
acaagcuauucccucaa

SEQ ID NO: 769847 - RNA, 16 nt, Homo sapiens
acaagcugcacuguga

SEQ ID NO: 769848 - RNA, 17 nt, Homo sapiens
acaagcuuguccaugua

SEQ ID NO: 769849 - RNA, 21 nt, Homo sapiens
acaaggauuucucuaacccua

SEQ ID NO: 769850 - RNA, 17 nt, Homo sapiens
acaaggcuaacauccca

SEQ ID NO: 769851 - RNA, 15 nt, Homo sapiens
acaaggcugaccaag

SEQ ID NO: 769852 - RNA, 18 nt, Homo sapiens
acaaggcuuuaucucagg

SEQ ID NO: 769853 - RNA, 15 nt, Homo sapiens
acaagggcugaccug

SEQ ID NO: 769854 - RNA, 20 nt, Homo sapiens
acaagggcugcaaugcccuc

SEQ ID NO: 769855 - RNA, 13 nt, Homo sapiens
acaaggucaucau

SEQ ID NO: 769856 - RNA, 13 nt, Homo sapiens
acaaggugacaaa

SEQ ID NO: 769857 - RNA, 16 nt, Homo sapiens
acaaguaaaacugugg

SEQ ID NO: 769858 - RNA, 18 nt, Homo sapiens
acaaguaaaacuguggua

SEQ ID NO: 769859 - RNA, 18 nt, Homo sapiens
acaaguauggcuccucca

SEQ ID NO: 769860 - RNA, 21 nt, Homo sapiens
acaaguauuauuuuacaauca

SEQ ID NO: 769861 - RNA, 22 nt, Homo sapiens
acaaguauucauuuuuucuacc

SEQ ID NO: 769862 - RNA, 15 nt, Homo sapiens
acaaguauuuugcua

SEQ ID NO: 769863 - RNA, 15 nt, Homo sapiens
acaaguccuugaccu

SEQ ID NO: 769864 - RNA, 12 nt, Homo sapiens
acaagucuucca

SEQ ID NO: 769865 - RNA, 13 nt, Homo sapiens
acaagugacugua

SEQ ID NO: 769866 - RNA, 17 nt, Homo sapiens
acaagugagacaaaaag

SEQ ID NO: 769867 - RNA, 23 nt, Homo sapiens
acaagugccuccuggacuguuca

SEQ ID NO: 769868 - RNA, 15 nt, Homo sapiens
acaagugggugaaug

SEQ ID NO: 769869 - RNA, 20 nt, Homo sapiens
acaagugguguuuauugcaa

SEQ ID NO: 769870 - RNA, 17 nt, Homo sapiens
acaaguuaaaaaggucu

SEQ ID NO: 769871 - RNA, 19 nt, Homo sapiens
acaaguuagaaaacauaau

SEQ ID NO: 769872 - RNA, 15 nt, Homo sapiens
acaaguuucagacag

SEQ ID NO: 769873 - RNA, 23 nt, Homo sapiens
acaaguuucugauaccacugcac

SEQ ID NO: 769874 - RNA, 21 nt, Homo sapiens
acaauaaauauucugcaugga

SEQ ID NO: 769875 - RNA, 14 nt, Homo sapiens
acaauaaauguauu

SEQ ID NO: 769876 - RNA, 21 nt, Homo sapiens
acaauaaauguauucaaauac

SEQ ID NO: 769877 - RNA, 13 nt, Homo sapiens
acaauaaauuauu

SEQ ID NO: 769878 - RNA, 17 nt, Homo sapiens
acaauacaugcugcuaa

SEQ ID NO: 769879 - RNA, 21 nt, Homo sapiens
acaauacccaccucuguggau

SEQ ID NO: 769880 - RNA, 20 nt, Homo sapiens
acaauauauuuaguuguaaa

SEQ ID NO: 769881 - RNA, 16 nt, Homo sapiens
acaaucaaggccacug

SEQ ID NO: 769882 - RNA, 15 nt, Homo sapiens
acaaucagcccagug

SEQ ID NO: 769883 - RNA, 18 nt, Homo sapiens
acaaucagcccagugcaa

SEQ ID NO: 769884 - RNA, 19 nt, Homo sapiens
acaaucagcccagugcaaa

SEQ ID NO: 769885 - RNA, 23 nt, Homo sapiens
acaauccaucucucaaguagugu

SEQ ID NO: 769886 - RNA, 19 nt, Homo sapiens
acaaucuaagggucucuca

SEQ ID NO: 769887 - RNA, 20 nt, Homo sapiens
acaaucuaagggucucucau

SEQ ID NO: 769888 - RNA, 20 nt, Homo sapiens
acaaucuggcuuagugccac

SEQ ID NO: 769889 - RNA, 21 nt, Homo sapiens
acaaucuuugcuguauacuuu

SEQ ID NO: 769890 - RNA, 15 nt, Homo sapiens
acaaugaacacuuau

SEQ ID NO: 769891 - RNA, 18 nt, Homo sapiens
acaaugcugagguuauga

SEQ ID NO: 769892 - RNA, 12 nt, Homo sapiens
acaaugcugauu

SEQ ID NO: 769893 - RNA, 14 nt, Homo sapiens
acaauggaaacuga

SEQ ID NO: 769894 - RNA, 17 nt, Homo sapiens
acaaugguugaaugaau

SEQ ID NO: 769895 - RNA, 17 nt, Homo sapiens
acaaugguuuauuccca

SEQ ID NO: 769896 - RNA, 23 nt, Homo sapiens
acaauguauuuuaauaacauauc

SEQ ID NO: 769897 - RNA, 13 nt, Homo sapiens
acaaugucccuuc

SEQ ID NO: 769898 - RNA, 19 nt, Homo sapiens
acaauuaaaccgcauguga

SEQ ID NO: 769899 - RNA, 14 nt, Homo sapiens
acaauucauucauu

SEQ ID NO: 769900 - RNA, 23 nt, Homo sapiens
acaauucugugacauacauauua

SEQ ID NO: 769901 - RNA, 16 nt, Homo sapiens
acaauuugacauacaa

SEQ ID NO: 769902 - RNA, 13 nt, Homo sapiens
acaauuuggagca

SEQ ID NO: 769903 - RNA, 13 nt, Homo sapiens
acaauuuucugua

SEQ ID NO: 769904 - RNA, 17 nt, Homo sapiens
acacaaaggaaguccaa

SEQ ID NO: 769905 - RNA, 12 nt, Homo sapiens
acacaaagggaa

SEQ ID NO: 769906 - RNA, 11 nt, Homo sapiens
acacaaauaga

SEQ ID NO: 769907 - RNA, 19 nt, Homo sapiens
uguuuuaaaauacucucau

SEQ ID NO: 769908 - RNA, 23 nt, Homo sapiens
uguuuuaaagaauaugacuuuuu

SEQ ID NO: 769909 - RNA, 14 nt, Homo sapiens
uguuuuacauucca

SEQ ID NO: 769910 - RNA, 17 nt, Homo sapiens
uguuuuacccuugacug

SEQ ID NO: 769911 - RNA, 15 nt, Homo sapiens
uguuuucaccauuca

SEQ ID NO: 769912 - RNA, 17 nt, Homo sapiens
uguuuucacuuguauug

SEQ ID NO: 769913 - RNA, 13 nt, Homo sapiens
uguuuucagugaa

SEQ ID NO: 769914 - RNA, 15 nt, Homo sapiens
uguuuuccugcuggu

SEQ ID NO: 769915 - RNA, 19 nt, Homo sapiens
uguuuucucagaacagcug

SEQ ID NO: 769916 - RNA, 21 nt, Homo sapiens
uguuuucucuggaaugguaca

SEQ ID NO: 769917 - RNA, 22 nt, Homo sapiens
uguuuugauuuguagcacugag

SEQ ID NO: 769918 - RNA, 16 nt, Homo sapiens
uguuuugcucuuucag

SEQ ID NO: 769919 - RNA, 21 nt, Homo sapiens
uguuuuguaggagacuugcca

SEQ ID NO: 769920 - RNA, 19 nt, Homo sapiens
ugacagagugagacccugu

SEQ ID NO: 769921 - RNA, 20 nt, Homo sapiens
ugacagcaugguaaugaagg

SEQ ID NO: 769922 - RNA, 23 nt, Homo sapiens
ugacagccagagccugucuuuca

SEQ ID NO: 769923 - RNA, 23 nt, Homo sapiens
ugacagccccuuauuugcacuuc

SEQ ID NO: 769924 - RNA, 12 nt, Homo sapiens
ugacagccuccc

SEQ ID NO: 769925 - RNA, 16 nt, Homo sapiens
ugacagccugcagcag

SEQ ID NO: 769926 - RNA, 17 nt, Homo sapiens
ugacagggaaaacugca

SEQ ID NO: 769927 - RNA, 15 nt, Homo sapiens
ugacagguugcugaa

SEQ ID NO: 769928 - RNA, 23 nt, Homo sapiens
ugacagugaagcagcacugugag

SEQ ID NO: 769929 - RNA, 17 nt, Homo sapiens
ugacagugccugggaau

SEQ ID NO: 769930 - RNA, 16 nt, Homo sapiens
ugacauaauauauucu

SEQ ID NO: 769931 - RNA, 13 nt, Homo sapiens
ugacauaauuuca

SEQ ID NO: 769932 - RNA, 14 nt, Homo sapiens
ugacauagccucau

SEQ ID NO: 769933 - RNA, 18 nt, Homo sapiens
ugacauauauauguauau

SEQ ID NO: 769934 - RNA, 17 nt, Homo sapiens
ugacauccaaaucuagc

SEQ ID NO: 769935 - RNA, 16 nt, Homo sapiens
ugacauguaagaaaau

SEQ ID NO: 769936 - RNA, 17 nt, Homo sapiens
ugacauucuuagcugua

SEQ ID NO: 769937 - RNA, 20 nt, Homo sapiens
ugacauuuaucaccucugau

SEQ ID NO: 769938 - RNA, 19 nt, Homo sapiens
ugacauuucuuugugcuuu

SEQ ID NO: 769939 - RNA, 15 nt, Homo sapiens
ugacauuugguggua

SEQ ID NO: 769940 - RNA, 17 nt, Homo sapiens
ugaccaaagagcccuca

SEQ ID NO: 769941 - RNA, 18 nt, Homo sapiens
ugaccaaaggugugcccu

SEQ ID NO: 769942 - RNA, 12 nt, Homo sapiens
ugaccaaauggc

SEQ ID NO: 769943 - RNA, 24 nt, Homo sapiens
ugaccaaguuauaaaucaauguca

SEQ ID NO: 769944 - RNA, 16 nt, Homo sapiens
ugaccaaugggaugag

SEQ ID NO: 769945 - RNA, 10 nt, Homo sapiens
ugaccacaga

SEQ ID NO: 769946 - RNA, 21 nt, Homo sapiens
ugaccacugaagcaccacagg

SEQ ID NO: 769947 - RNA, 19 nt, Homo sapiens
ugaccagaaaucaaaaagg

SEQ ID NO: 769948 - RNA, 16 nt, Homo sapiens
ugaccagcaacuuguc

SEQ ID NO: 769949 - RNA, 17 nt, Homo sapiens
ugaccagcagaucccag

SEQ ID NO: 769950 - RNA, 21 nt, Homo sapiens
ugaccagcagaucccagcuca

SEQ ID NO: 769951 - RNA, 19 nt, Homo sapiens
ugaccagccacucaaagga

SEQ ID NO: 769952 - RNA, 19 nt, Homo sapiens
ugaccaucccaacuuuggu

SEQ ID NO: 769953 - RNA, 16 nt, Homo sapiens
ugaccaucugugacua

SEQ ID NO: 769954 - RNA, 17 nt, Homo sapiens
ugaccauuugacuguuc

SEQ ID NO: 769955 - RNA, 13 nt, Homo sapiens
ugacccacacugc

SEQ ID NO: 769956 - RNA, 22 nt, Homo sapiens
ugaccccuguccccacacugac

SEQ ID NO: 769957 - RNA, 21 nt, Homo sapiens
ugaccccuucccuguccuugc

SEQ ID NO: 769958 - RNA, 12 nt, Homo sapiens
ugacccugagaa

SEQ ID NO: 769959 - RNA, 15 nt, Homo sapiens
ugacccugaugaaaa

SEQ ID NO: 769960 - RNA, 22 nt, Homo sapiens
ugacccuuuucaugauuuuaag

SEQ ID NO: 769961 - RNA, 17 nt, Homo sapiens
ugaccgagaacuuuuaa

SEQ ID NO: 769962 - RNA, 22 nt, Homo sapiens
ugaccuaaauaaggaucaauug

SEQ ID NO: 769963 - RNA, 14 nt, Homo sapiens
ugaccuaaauuauu

SEQ ID NO: 769964 - RNA, 17 nt, Homo sapiens
ugaccuaccccagccag

SEQ ID NO: 769965 - RNA, 16 nt, Homo sapiens
ugaccucacugugacc

SEQ ID NO: 769966 - RNA, 17 nt, Homo sapiens
ugaccuccaaccaggag

SEQ ID NO: 769967 - RNA, 13 nt, Homo sapiens
ugaccuccacagc

SEQ ID NO: 769968 - RNA, 21 nt, Homo sapiens
ugaccucuauaaacuucagag

SEQ ID NO: 769969 - RNA, 19 nt, Homo sapiens
ugaccuggaaucagugaag

SEQ ID NO: 769970 - RNA, 21 nt, Homo sapiens
ugaccugucaccgugagcagc

SEQ ID NO: 769971 - RNA, 16 nt, Homo sapiens
ugaccuucagagccag

SEQ ID NO: 769972 - RNA, 18 nt, Homo sapiens
ugaccuucccacacaauc

SEQ ID NO: 769973 - RNA, 15 nt, Homo sapiens
ugaccuucugggaca

SEQ ID NO: 769974 - RNA, 14 nt, Homo sapiens
ugaccuugaucaag

SEQ ID NO: 769975 - RNA, 18 nt, Homo sapiens
ugaccuuggagagacaca

SEQ ID NO: 769976 - RNA, 18 nt, Homo sapiens
ugaccuugggguacaauu

SEQ ID NO: 769977 - RNA, 18 nt, Homo sapiens
ugaccuuuaaaugcaaca

SEQ ID NO: 769978 - RNA, 15 nt, Homo sapiens
ugacgacgacaacga

SEQ ID NO: 769979 - RNA, 22 nt, Homo sapiens
ugacgaguggguauuugcugac

SEQ ID NO: 769980 - RNA, 18 nt, Homo sapiens
ugacgcggcucaaaagga

SEQ ID NO: 769981 - RNA, 14 nt, Homo sapiens
ugacgcuugcuuag

SEQ ID NO: 769982 - RNA, 20 nt, Homo sapiens
ugacgcuugugacagugccu

SEQ ID NO: 769983 - RNA, 20 nt, Homo sapiens
ugacgucagcgcaccaaaac

SEQ ID NO: 769984 - RNA, 23 nt, Homo sapiens
ugacuaaguuuuuauaccagcuu

SEQ ID NO: 769985 - RNA, 13 nt, Homo sapiens
ugacuacaaagau

SEQ ID NO: 769986 - RNA, 20 nt, Homo sapiens
ugacuacauuggaagcuuug

SEQ ID NO: 769987 - RNA, 18 nt, Homo sapiens
ugacuauaaagcuguuau

SEQ ID NO: 769988 - RNA, 15 nt, Homo sapiens
ugacuaucaccccua

SEQ ID NO: 769989 - RNA, 19 nt, Homo sapiens
ugacuauggcuaccaaaaa

SEQ ID NO: 769990 - RNA, 22 nt, Homo sapiens
ugaaacgucccacacuuugaag

SEQ ID NO: 769991 - RNA, 23 nt, Homo sapiens
ugaaacuagaagagauuucuaaa

SEQ ID NO: 769992 - RNA, 19 nt, Homo sapiens
ugaaacucauagacacuga

SEQ ID NO: 769993 - RNA, 22 nt, Homo sapiens
ugaaacuuuaauucuuuuauca

SEQ ID NO: 769994 - RNA, 21 nt, Homo sapiens
ugaaagaaccaaaagagauca

SEQ ID NO: 769995 - RNA, 23 nt, Homo sapiens
ugaaagaaccaaaagagaucaca

SEQ ID NO: 769996 - RNA, 15 nt, Homo sapiens
ugaaagaaccagaga

SEQ ID NO: 769997 - RNA, 15 nt, Homo sapiens
ugaaagaagcaagac

SEQ ID NO: 769998 - RNA, 14 nt, Homo sapiens
ugaaagacaucaau

SEQ ID NO: 769999 - RNA, 17 nt, Homo sapiens
ugaaagagauuacuuaa

SEQ ID NO: 770000 - RNA, 17 nt, Homo sapiens
ugaaagauucagugacg

SEQ ID NO: 770001 - RNA, 14 nt, Homo sapiens
ugaaagcacaugaa

SEQ ID NO: 770002 - RNA, 15 nt, Homo sapiens
ugaaagcaguagcau

SEQ ID NO: 770003 - RNA, 14 nt, Homo sapiens
ugaaagccacaaug

SEQ ID NO: 770004 - RNA, 23 nt, Homo sapiens
ugaaaggagaugucuuggaacau

SEQ ID NO: 770005 - RNA, 21 nt, Homo sapiens
ugaaagggaaagucagcuuuc

SEQ ID NO: 770006 - RNA, 13 nt, Homo sapiens
ugaaagggcaaua

SEQ ID NO: 770007 - RNA, 16 nt, Homo sapiens
ugaaaggggacaccug

SEQ ID NO: 770008 - RNA, 18 nt, Homo sapiens
ugaaaggggacaccugua

SEQ ID NO: 770009 - RNA, 20 nt, Homo sapiens
ugaaaggggggaaccaguga

SEQ ID NO: 770010 - RNA, 21 nt, Homo sapiens
ugaaaggugugcuagaacaag

SEQ ID NO: 770011 - RNA, 20 nt, Homo sapiens
ugaaauaaaauuacacagua

SEQ ID NO: 770012 - RNA, 15 nt, Homo sapiens
ugaaauaaaugacaa

SEQ ID NO: 770013 - RNA, 15 nt, Homo sapiens
ugaaauaacuaccuu

SEQ ID NO: 770014 - RNA, 17 nt, Homo sapiens
ugaaauaagcugugauu

SEQ ID NO: 770015 - RNA, 19 nt, Homo sapiens
ugaaauaauguacaucugg

SEQ ID NO: 770016 - RNA, 19 nt, Homo sapiens
ugaaauaauuacagaauau

SEQ ID NO: 770017 - RNA, 23 nt, Homo sapiens
ugaaauacuauuuaaagccuccu

SEQ ID NO: 770018 - RNA, 23 nt, Homo sapiens
ugaaauauuuagaagugcuaauu

SEQ ID NO: 770019 - RNA, 13 nt, Homo sapiens
ugaaaucaacuca

SEQ ID NO: 770020 - RNA, 20 nt, Homo sapiens
ugaaaucgccguguuacugu

SEQ ID NO: 770021 - RNA, 15 nt, Homo sapiens
ugaaaucucagaauu

SEQ ID NO: 770022 - RNA, 13 nt, Homo sapiens
ugaaaucuuuuaa

SEQ ID NO: 770023 - RNA, 15 nt, Homo sapiens
ugaaaugaaaacaug

SEQ ID NO: 770024 - RNA, 14 nt, Homo sapiens
ugaaaugaaaggga

SEQ ID NO: 770025 - RNA, 23 nt, Homo sapiens
ugaaaugaaagggaaacugggaa

SEQ ID NO: 770026 - RNA, 15 nt, Homo sapiens
ugaaaugaccaagac

SEQ ID NO: 770027 - RNA, 15 nt, Homo sapiens
ugaaaugauaugacc

SEQ ID NO: 770028 - RNA, 20 nt, Homo sapiens
ugaaaugcucuuuugcacaa

SEQ ID NO: 770029 - RNA, 15 nt, Homo sapiens
ugaaaugcuggcauu

SEQ ID NO: 770030 - RNA, 16 nt, Homo sapiens
ugaaaugcuggcauuu

SEQ ID NO: 770031 - RNA, 18 nt, Homo sapiens
ugaaaugcuggcauuugc

SEQ ID NO: 770032 - RNA, 24 nt, Homo sapiens
ugaaauguaggcaucaugcauguc

SEQ ID NO: 770033 - RNA, 20 nt, Homo sapiens
ugaaaugucuggucugucca

SEQ ID NO: 770034 - RNA, 12 nt, Homo sapiens
ugaaauuacuua

SEQ ID NO: 770035 - RNA, 16 nt, Homo sapiens
ugaaauuauacagaua

SEQ ID NO: 770036 - RNA, 19 nt, Homo sapiens
ugaaauuauuugucauuca

SEQ ID NO: 770037 - RNA, 12 nt, Homo sapiens
ugaaauucucag

SEQ ID NO: 770038 - RNA, 15 nt, Homo sapiens
ugaaauucucagagu

SEQ ID NO: 770039 - RNA, 11 nt, Homo sapiens
ugaaauucugc

SEQ ID NO: 770040 - RNA, 13 nt, Homo sapiens
ugaaauuuauuca

SEQ ID NO: 770041 - RNA, 15 nt, Homo sapiens
ugaaauuuggcaaag

SEQ ID NO: 770042 - RNA, 22 nt, Homo sapiens
ugaacaaaaauugagacauuua

SEQ ID NO: 770043 - RNA, 22 nt, Homo sapiens
ugaacaaaaccuacacacauac

SEQ ID NO: 770044 - RNA, 22 nt, Homo sapiens
ugaacaaaaccuacgcacauac

SEQ ID NO: 770045 - RNA, 18 nt, Homo sapiens
ugaacaacuguugggaua

SEQ ID NO: 770046 - RNA, 20 nt, Homo sapiens
ugaacacaauugauacuuca

SEQ ID NO: 770047 - RNA, 14 nt, Homo sapiens
ugaacacagugucu

SEQ ID NO: 770048 - RNA, 14 nt, Homo sapiens
ugaacacaucagcu

SEQ ID NO: 770049 - RNA, 17 nt, Homo sapiens
ugaacaccuauugcacu

SEQ ID NO: 770050 - RNA, 15 nt, Homo sapiens
ugaacacuguucuac

SEQ ID NO: 770051 - RNA, 14 nt, Homo sapiens
ugaacagaggccac

SEQ ID NO: 770052 - RNA, 14 nt, Homo sapiens
ugaacaggcaugca

SEQ ID NO: 770053 - RNA, 19 nt, Homo sapiens
ugaacaguuuggggacuca

SEQ ID NO: 770054 - RNA, 11 nt, Homo sapiens
ugaacauaugu

SEQ ID NO: 770055 - RNA, 17 nt, Homo sapiens
ugaacaucauggacuga

SEQ ID NO: 770056 - RNA, 17 nt, Homo sapiens
ugaacauccuuccuucc

SEQ ID NO: 770057 - RNA, 12 nt, Homo sapiens
ugaacaucucuu

SEQ ID NO: 770058 - RNA, 18 nt, Homo sapiens
ugaacaugugaaguuaua

SEQ ID NO: 770059 - RNA, 18 nt, Homo sapiens
ugaacauguuuacagguu

SEQ ID NO: 770060 - RNA, 17 nt, Homo sapiens
ugaacauuuaucaauca

SEQ ID NO: 770061 - RNA, 23 nt, Homo sapiens
ugaaccacccagaguggcccaag

SEQ ID NO: 770062 - RNA, 16 nt, Homo sapiens
ugaaccgcacagcuca

SEQ ID NO: 770063 - RNA, 22 nt, Homo sapiens
ugaauuguuaauucacagaaua

SEQ ID NO: 770064 - RNA, 21 nt, Homo sapiens
ugaauuuaucagcguauuuca

SEQ ID NO: 770065 - RNA, 14 nt, Homo sapiens
ugaauuucaguaaa

SEQ ID NO: 770066 - RNA, 15 nt, Homo sapiens
ugaauuucuggaaga

SEQ ID NO: 770067 - RNA, 23 nt, Homo sapiens
ugaauuugaauacugcauuuaca

SEQ ID NO: 770068 - RNA, 21 nt, Homo sapiens
ugaauuuggccugcacuaauu

SEQ ID NO: 770069 - RNA, 14 nt, Homo sapiens
ugaauuuucccuga

SEQ ID NO: 770070 - RNA, 23 nt, Homo sapiens
ugaauuuuccgggaacuuugcag

SEQ ID NO: 770071 - RNA, 20 nt, Homo sapiens
ugaauuuuguguguaccugu

SEQ ID NO: 770072 - RNA, 19 nt, Homo sapiens
ugaauuuuuaagcugcaaa

SEQ ID NO: 770073 - RNA, 13 nt, Homo sapiens
ugacaaacuggca

SEQ ID NO: 770074 - RNA, 14 nt, Homo sapiens
ugacaaauuauuga

SEQ ID NO: 770075 - RNA, 17 nt, Homo sapiens
ugacaacaauccaaaaa

SEQ ID NO: 770076 - RNA, 21 nt, Homo sapiens
ugacaacaaucucaauuccau

SEQ ID NO: 770077 - RNA, 12 nt, Homo sapiens
ugacaacauguu

SEQ ID NO: 770078 - RNA, 20 nt, Homo sapiens
ugacaaccgaguggcuguca

SEQ ID NO: 770079 - RNA, 13 nt, Homo sapiens
ugacaagaacaaa

SEQ ID NO: 770080 - RNA, 18 nt, Homo sapiens
ugacaagaacaaagccac

SEQ ID NO: 770081 - RNA, 16 nt, Homo sapiens
ugacaagccuucuuaa

SEQ ID NO: 770082 - RNA, 23 nt, Homo sapiens
ugacaagcugacuuggcacuuaa

SEQ ID NO: 770083 - RNA, 13 nt, Homo sapiens
ugacaagugagac

SEQ ID NO: 770084 - RNA, 15 nt, Homo sapiens
ugacaagugagacaa

SEQ ID NO: 770085 - RNA, 16 nt, Homo sapiens
ugacaaucaacucuaa

SEQ ID NO: 770086 - RNA, 15 nt, Homo sapiens
ugacaauggcagcua

SEQ ID NO: 770087 - RNA, 20 nt, Homo sapiens
ugacaauuacucagguuuga

SEQ ID NO: 770088 - RNA, 15 nt, Homo sapiens
ugacacaaagcuucu

SEQ ID NO: 770089 - RNA, 15 nt, Homo sapiens
ugacacaagcacuuu

SEQ ID NO: 770090 - RNA, 18 nt, Homo sapiens
ugacacaaguggaccuua

SEQ ID NO: 770091 - RNA, 12 nt, Homo sapiens
ugacacacagca

SEQ ID NO: 770092 - RNA, 15 nt, Homo sapiens
ugacacacagcacuc

SEQ ID NO: 770093 - RNA, 13 nt, Homo sapiens
ugacacagucuug

SEQ ID NO: 770094 - RNA, 21 nt, Homo sapiens
ugacacauagaaaacaaucaa

SEQ ID NO: 770095 - RNA, 14 nt, Homo sapiens
ugacacauaugcac

SEQ ID NO: 770096 - RNA, 16 nt, Homo sapiens
ugacacauaugcaccu

SEQ ID NO: 770097 - RNA, 14 nt, Homo sapiens
ugacaccagccuuu

SEQ ID NO: 770098 - RNA, 19 nt, Homo sapiens
ugacacccaugccagagag

SEQ ID NO: 770099 - RNA, 21 nt, Homo sapiens
ugacaccgucccucagugaua

SEQ ID NO: 770100 - RNA, 22 nt, Homo sapiens
ugacaccgucccucagugauac

SEQ ID NO: 770101 - RNA, 23 nt, Homo sapiens
ugacaccgucccucagugauacg

SEQ ID NO: 770102 - RNA, 11 nt, Homo sapiens
ugacacuauuc

SEQ ID NO: 770103 - RNA, 22 nt, Homo sapiens
ugacacuggaccagguccugcu

SEQ ID NO: 770104 - RNA, 18 nt, Homo sapiens
ugacacuuuaauuaccaa

SEQ ID NO: 770105 - RNA, 17 nt, Homo sapiens
ugacagagcgagacucc

SEQ ID NO: 770106 - RNA, 17 nt, Homo sapiens
ccacccccgccaugcaa

SEQ ID NO: 770107 - RNA, 17 nt, Homo sapiens
ccacccccuucagugcc

SEQ ID NO: 770108 - RNA, 21 nt, Homo sapiens
ccacccuggugggccaacaaa

SEQ ID NO: 770109 - RNA, 14 nt, Homo sapiens
ccaccgcccagaga

SEQ ID NO: 770110 - RNA, 13 nt, Homo sapiens
ccaccuaauauca

SEQ ID NO: 770111 - RNA, 14 nt, Homo sapiens
ccaccuacacagga

SEQ ID NO: 770112 - RNA, 11 nt, Homo sapiens
ccaccuaccca

SEQ ID NO: 770113 - RNA, 24 nt, Homo sapiens
ccaccuagagguagguaggaucau

SEQ ID NO: 770114 - RNA, 14 nt, Homo sapiens
ccaccuagucugua

SEQ ID NO: 770115 - RNA, 16 nt, Homo sapiens
ccaccucuccuuuggc

SEQ ID NO: 770116 - RNA, 14 nt, Homo sapiens
ccaccucuucacuc

SEQ ID NO: 770117 - RNA, 16 nt, Homo sapiens
ccaccugacaauggca

SEQ ID NO: 770118 - RNA, 12 nt, Homo sapiens
ccaccugccauu

SEQ ID NO: 770119 - RNA, 15 nt, Homo sapiens
ccaccugcccaucac

SEQ ID NO: 770120 - RNA, 16 nt, Homo sapiens
ccaccugccugcaucu

SEQ ID NO: 770121 - RNA, 24 nt, Homo sapiens
ccaccugccugcaucugugaaaag

SEQ ID NO: 770122 - RNA, 12 nt, Homo sapiens
ccaccuggagag

SEQ ID NO: 770123 - RNA, 13 nt, Homo sapiens
ccaccugucucag

SEQ ID NO: 770124 - RNA, 10 nt, Homo sapiens
ccaccuguga

SEQ ID NO: 770125 - RNA, 12 nt, Homo sapiens
ccaccugugacc

SEQ ID NO: 770126 - RNA, 21 nt, Homo sapiens
ccaccuuccccagaaccaggg

SEQ ID NO: 770127 - RNA, 12 nt, Homo sapiens
ccaccuugccaa

SEQ ID NO: 770128 - RNA, 20 nt, Homo sapiens
ccaccuuuccagccauagag

SEQ ID NO: 770129 - RNA, 20 nt, Homo sapiens
ccacgagccugcuguuucca

SEQ ID NO: 770130 - RNA, 15 nt, Homo sapiens
ccacgcagcacccuu

SEQ ID NO: 770131 - RNA, 20 nt, Homo sapiens
ccacgcauacacacaugccc

SEQ ID NO: 770132 - RNA, 21 nt, Homo sapiens
ccacgcauacacacaugcccu

SEQ ID NO: 770133 - RNA, 16 nt, Homo sapiens
ccacgucaacagaauu

SEQ ID NO: 770134 - RNA, 15 nt, Homo sapiens
ccacuaaccaucccc

SEQ ID NO: 770135 - RNA, 13 nt, Homo sapiens
ccacuacuuagag

SEQ ID NO: 770136 - RNA, 16 nt, Homo sapiens
ccacuaggacucugag

SEQ ID NO: 770137 - RNA, 17 nt, Homo sapiens
ccacuauuuucaaagaa

SEQ ID NO: 770138 - RNA, 11 nt, Homo sapiens
ccacucaaugu

SEQ ID NO: 770139 - RNA, 23 nt, Homo sapiens
ccacucaccuuucuccacugggu

SEQ ID NO: 770140 - RNA, 22 nt, Homo sapiens
ccacucagaacucuccagggag

SEQ ID NO: 770141 - RNA, 17 nt, Homo sapiens
ccacucagcucaccucu

SEQ ID NO: 770142 - RNA, 15 nt, Homo sapiens
ccacucaggccaaca

SEQ ID NO: 770143 - RNA, 18 nt, Homo sapiens
ccacucaggggucauuca

SEQ ID NO: 770144 - RNA, 19 nt, Homo sapiens
ccacucaggggucauucau

SEQ ID NO: 770145 - RNA, 21 nt, Homo sapiens
ccacucccuucccaaguuccu

SEQ ID NO: 770146 - RNA, 13 nt, Homo sapiens
ccacucguccaag

SEQ ID NO: 770147 - RNA, 20 nt, Homo sapiens
ccacucuuggcuauugaaga

SEQ ID NO: 770148 - RNA, 22 nt, Homo sapiens
ccacugaaaauucgaaccagga

SEQ ID NO: 770149 - RNA, 21 nt, Homo sapiens
ccacugaauucacuccaguca

SEQ ID NO: 770150 - RNA, 20 nt, Homo sapiens
ccacugacacccaguguccu

SEQ ID NO: 770151 - RNA, 21 nt, Homo sapiens
ccacugacccuggucaccaga

SEQ ID NO: 770152 - RNA, 16 nt, Homo sapiens
ccacugagaagucaaa

SEQ ID NO: 770153 - RNA, 23 nt, Homo sapiens
ccacugaggagacagaaagccuc

SEQ ID NO: 770154 - RNA, 19 nt, Homo sapiens
ccacugcccccugcugcca

SEQ ID NO: 770155 - RNA, 22 nt, Homo sapiens
ccacugccuucgcuucuugccu

SEQ ID NO: 770156 - RNA, 19 nt, Homo sapiens
ccacugggaccaacccugg

SEQ ID NO: 770157 - RNA, 16 nt, Homo sapiens
ccacuggucugcuuaa

SEQ ID NO: 770158 - RNA, 17 nt, Homo sapiens
ccacugguuucucagaa

SEQ ID NO: 770159 - RNA, 14 nt, Homo sapiens
ccacuguaugagug

SEQ ID NO: 770160 - RNA, 16 nt, Homo sapiens
ccacugucuccacuca

SEQ ID NO: 770161 - RNA, 22 nt, Homo sapiens
ccacugugccucagagaccagg

SEQ ID NO: 770162 - RNA, 14 nt, Homo sapiens
ccacugugcugguu

SEQ ID NO: 770163 - RNA, 14 nt, Homo sapiens
ccacuguguacugu

SEQ ID NO: 770164 - RNA, 15 nt, Homo sapiens
ccacuguguauuuaa

SEQ ID NO: 770165 - RNA, 21 nt, Homo sapiens
ccacuguuucucuugagcugg

SEQ ID NO: 770166 - RNA, 14 nt, Homo sapiens
ugagaaguucucag

SEQ ID NO: 770167 - RNA, 15 nt, Homo sapiens
ugagaaucagacuga

SEQ ID NO: 770168 - RNA, 17 nt, Homo sapiens
ugagaaucaugcacuuu

SEQ ID NO: 770169 - RNA, 20 nt, Homo sapiens
ugagaauguggaauaccuaa

SEQ ID NO: 770170 - RNA, 14 nt, Homo sapiens
ugagacaacaguac

SEQ ID NO: 770171 - RNA, 23 nt, Homo sapiens
ugagacagcaguaucacaggcca

SEQ ID NO: 770172 - RNA, 15 nt, Homo sapiens
ugagacagucuugcu

SEQ ID NO: 770173 - RNA, 15 nt, Homo sapiens
ugagaccacaggcuu

SEQ ID NO: 770174 - RNA, 22 nt, Homo sapiens
ugagaccagccugggcagcaua

SEQ ID NO: 770175 - RNA, 15 nt, Homo sapiens
ugagacccugucuca

SEQ ID NO: 770176 - RNA, 19 nt, Homo sapiens
ugagacccuuuucucagga

SEQ ID NO: 770177 - RNA, 17 nt, Homo sapiens
ugagaccgagucuugcu

SEQ ID NO: 770178 - RNA, 16 nt, Homo sapiens
ugagaccuccacucca

SEQ ID NO: 770179 - RNA, 21 nt, Homo sapiens
ugagaccugggauuugagaua

SEQ ID NO: 770180 - RNA, 16 nt, Homo sapiens
ugagacucagugcaga

SEQ ID NO: 770181 - RNA, 15 nt, Homo sapiens
ugagacuccaucuca

SEQ ID NO: 770182 - RNA, 18 nt, Homo sapiens
ugagacuccucauaccuc

SEQ ID NO: 770183 - RNA, 23 nt, Homo sapiens
ugagacucuaggguccaguggau

SEQ ID NO: 770184 - RNA, 18 nt, Homo sapiens
ugagagaauaaaaacuuc

SEQ ID NO: 770185 - RNA, 14 nt, Homo sapiens
ugagagagacaaga

SEQ ID NO: 770186 - RNA, 22 nt, Homo sapiens
ugagagccagaugccuccccaa

SEQ ID NO: 770187 - RNA, 14 nt, Homo sapiens
ugagaggcaaugau

SEQ ID NO: 770188 - RNA, 18 nt, Homo sapiens
ugagagggcaguguuucc

SEQ ID NO: 770189 - RNA, 13 nt, Homo sapiens
ugagauaaaguca

SEQ ID NO: 770190 - RNA, 17 nt, Homo sapiens
ugagaucaacaacacua

SEQ ID NO: 770191 - RNA, 14 nt, Homo sapiens
ugagaucagucuuu

SEQ ID NO: 770192 - RNA, 22 nt, Homo sapiens
ugagaugcaggauuucuucaca

SEQ ID NO: 770193 - RNA, 22 nt, Homo sapiens
ugagauggguguacaaacucau

SEQ ID NO: 770194 - RNA, 20 nt, Homo sapiens
ugagaugugcuuugcugcac

SEQ ID NO: 770195 - RNA, 18 nt, Homo sapiens
ugagauuaagaaugccag

SEQ ID NO: 770196 - RNA, 15 nt, Homo sapiens
ugagauugcugugug

SEQ ID NO: 770197 - RNA, 18 nt, Homo sapiens
ugagauuucuuaaauaau

SEQ ID NO: 770198 - RNA, 15 nt, Homo sapiens
ugagcaagacauacu

SEQ ID NO: 770199 - RNA, 18 nt, Homo sapiens
ugagcaagacauacuuaa

SEQ ID NO: 770200 - RNA, 14 nt, Homo sapiens
ugagcaauggagug

SEQ ID NO: 770201 - RNA, 18 nt, Homo sapiens
ugagcaaugucugugcua

SEQ ID NO: 770202 - RNA, 18 nt, Homo sapiens
ugagcacagcugcauuaa

SEQ ID NO: 770203 - RNA, 19 nt, Homo sapiens
ugagcaccagccugaaugc

SEQ ID NO: 770204 - RNA, 17 nt, Homo sapiens
ugagcaccgucauggcu

SEQ ID NO: 770205 - RNA, 19 nt, Homo sapiens
ugagcacggacucucccag

SEQ ID NO: 770206 - RNA, 15 nt, Homo sapiens
ugagcacuguuuaua

SEQ ID NO: 770207 - RNA, 23 nt, Homo sapiens
ugagcacuguuuauacacugugu

SEQ ID NO: 770208 - RNA, 18 nt, Homo sapiens
ugagcagaaguggagcug

SEQ ID NO: 770209 - RNA, 15 nt, Homo sapiens
ugagcagaauacugg

SEQ ID NO: 770210 - RNA, 22 nt, Homo sapiens
ugagcagaauacuggucucagg

SEQ ID NO: 770211 - RNA, 17 nt, Homo sapiens
ugagcagagauguacug

SEQ ID NO: 770212 - RNA, 20 nt, Homo sapiens
ugagcagagauguacugcaa

SEQ ID NO: 770213 - RNA, 18 nt, Homo sapiens
ugagcagcuuuucucccc

SEQ ID NO: 770214 - RNA, 18 nt, Homo sapiens
ugagcaggguccacagcu

SEQ ID NO: 770215 - RNA, 19 nt, Homo sapiens
ugagcagugccagcuuucu

SEQ ID NO: 770216 - RNA, 20 nt, Homo sapiens
ugagcaguuagcucauuuga

SEQ ID NO: 770217 - RNA, 23 nt, Homo sapiens
ugagcauccucucucacauggaa

SEQ ID NO: 770218 - RNA, 17 nt, Homo sapiens
ugagccaagauugcacc

SEQ ID NO: 770219 - RNA, 19 nt, Homo sapiens
ugagccacagucacuggau

SEQ ID NO: 770220 - RNA, 18 nt, Homo sapiens
ugagccagucuaguuccu

SEQ ID NO: 770221 - RNA, 13 nt, Homo sapiens
ugagccagugauu

SEQ ID NO: 770222 - RNA, 21 nt, Homo sapiens
ugagcccccccaacacugugc

SEQ ID NO: 770223 - RNA, 23 nt, Homo sapiens
ugagcgggccgaggcgcucauca

SEQ ID NO: 770224 - RNA, 23 nt, Homo sapiens
ugagcgugaaucuguaucuugcc

SEQ ID NO: 770225 - RNA, 22 nt, Homo sapiens
ugagcuaccguggaucuccuuc

SEQ ID NO: 770226 - RNA, 20 nt, Homo sapiens
ugagcuacuucaaauguggu

SEQ ID NO: 770227 - RNA, 21 nt, Homo sapiens
ugagcuauaauguuucccuca

SEQ ID NO: 770228 - RNA, 23 nt, Homo sapiens
ugagcuaugauuacaccacugca

SEQ ID NO: 770229 - RNA, 14 nt, Homo sapiens
ugagcucaggaguu

SEQ ID NO: 770230 - RNA, 17 nt, Homo sapiens
ugagcucaggcauuuga

SEQ ID NO: 770231 - RNA, 21 nt, Homo sapiens
ugagcucgguggcucaugccu

SEQ ID NO: 770232 - RNA, 15 nt, Homo sapiens
ugagcucuucccuua

SEQ ID NO: 770233 - RNA, 15 nt, Homo sapiens
ugagcugacaucuca

SEQ ID NO: 770234 - RNA, 20 nt, Homo sapiens
ugagcugcucauuacaguuc

SEQ ID NO: 770235 - RNA, 20 nt, Homo sapiens
ccaaagggaagugaggccca

SEQ ID NO: 770236 - RNA, 21 nt, Homo sapiens
ccaaagggugaagcuauuuau

SEQ ID NO: 770237 - RNA, 18 nt, Homo sapiens
ccaaaggucauccuuaau

SEQ ID NO: 770238 - RNA, 22 nt, Homo sapiens
ccaaaggugugcccuguacaca

SEQ ID NO: 770239 - RNA, 14 nt, Homo sapiens
ccaaaguagggaug

SEQ ID NO: 770240 - RNA, 21 nt, Homo sapiens
ccaaaguccucugcuccagca

SEQ ID NO: 770241 - RNA, 18 nt, Homo sapiens
ccaaagucucuaauucua

SEQ ID NO: 770242 - RNA, 17 nt, Homo sapiens
ccaaagugcugggauua

SEQ ID NO: 770243 - RNA, 13 nt, Homo sapiens
ccaaaguguuaau

SEQ ID NO: 770244 - RNA, 12 nt, Homo sapiens
ccaaaguucuaa

SEQ ID NO: 770245 - RNA, 14 nt, Homo sapiens
ccaaaguuugcaac

SEQ ID NO: 770246 - RNA, 22 nt, Homo sapiens
ccaaauaggagggagacugugg

SEQ ID NO: 770247 - RNA, 16 nt, Homo sapiens
ccaaauauaaucucac

SEQ ID NO: 770248 - RNA, 15 nt, Homo sapiens
ccaaauauucugggg

SEQ ID NO: 770249 - RNA, 23 nt, Homo sapiens
ccaaauccagugugcaccccucc

SEQ ID NO: 770250 - RNA, 11 nt, Homo sapiens
ccaaaucucag

SEQ ID NO: 770251 - RNA, 12 nt, Homo sapiens
ccaaaucugccu

SEQ ID NO: 770252 - RNA, 17 nt, Homo sapiens
ccaaaucuuguuuacaa

SEQ ID NO: 770253 - RNA, 22 nt, Homo sapiens
ccaaaugauagaacuguacugu

SEQ ID NO: 770254 - RNA, 15 nt, Homo sapiens
ccaaaugcagggagg

SEQ ID NO: 770255 - RNA, 22 nt, Homo sapiens
ccaaaugcagggaggggaggca

SEQ ID NO: 770256 - RNA, 15 nt, Homo sapiens
ccaaauggacauaag

SEQ ID NO: 770257 - RNA, 17 nt, Homo sapiens
ccaaauguagcaggugu

SEQ ID NO: 770258 - RNA, 18 nt, Homo sapiens
ccaaauguagcaggugua

SEQ ID NO: 770259 - RNA, 15 nt, Homo sapiens
ccaaauguguaauau

SEQ ID NO: 770260 - RNA, 12 nt, Homo sapiens
ccaacaaaaaga

SEQ ID NO: 770261 - RNA, 16 nt, Homo sapiens
ccaacaccccacugag

SEQ ID NO: 770262 - RNA, 11 nt, Homo sapiens
ccaacauccag

SEQ ID NO: 770263 - RNA, 21 nt, Homo sapiens
ccaacauggugaaacccugua

SEQ ID NO: 770264 - RNA, 23 nt, Homo sapiens
ccaacauggugaaacuccaucuc

SEQ ID NO: 770265 - RNA, 21 nt, Homo sapiens
ccaacauuaaaagccaccccc

SEQ ID NO: 770266 - RNA, 13 nt, Homo sapiens
ccaaccccagugg

SEQ ID NO: 770267 - RNA, 17 nt, Homo sapiens
ccaaccccccaccugcc

SEQ ID NO: 770268 - RNA, 22 nt, Homo sapiens
ccaacccccgccaccucagggc

SEQ ID NO: 770269 - RNA, 19 nt, Homo sapiens
ccaaccccugaccuacccc

SEQ ID NO: 770270 - RNA, 10 nt, Homo sapiens
ccaaccucag

SEQ ID NO: 770271 - RNA, 15 nt, Homo sapiens
ccaacgacaaagcca

SEQ ID NO: 770272 - RNA, 21 nt, Homo sapiens
ccaacuaaugccuuacucuuc

SEQ ID NO: 770273 - RNA, 16 nt, Homo sapiens
ccaacuacuacuggug

SEQ ID NO: 770274 - RNA, 18 nt, Homo sapiens
ccaacuacuacuggugau

SEQ ID NO: 770275 - RNA, 21 nt, Homo sapiens
ccaacuagcucuauguuuaca

SEQ ID NO: 770276 - RNA, 15 nt, Homo sapiens
ccaacucugcacucc

SEQ ID NO: 770277 - RNA, 16 nt, Homo sapiens
ccaacucugcacucca

SEQ ID NO: 770278 - RNA, 20 nt, Homo sapiens
ccaacugcaaaaaaagccuc

SEQ ID NO: 770279 - RNA, 19 nt, Homo sapiens
ccaacuguauauauuccca

SEQ ID NO: 770280 - RNA, 14 nt, Homo sapiens
ccaacuugagaugu

SEQ ID NO: 770281 - RNA, 16 nt, Homo sapiens
ccaacuugauguucca

SEQ ID NO: 770282 - RNA, 13 nt, Homo sapiens
ccaacuuuugcau

SEQ ID NO: 770283 - RNA, 19 nt, Homo sapiens
ccaagaaagcucacuguag

SEQ ID NO: 770284 - RNA, 13 nt, Homo sapiens
ccaagaacugcau

SEQ ID NO: 770285 - RNA, 19 nt, Homo sapiens
ccaagaacugcauggaccu

SEQ ID NO: 770286 - RNA, 19 nt, Homo sapiens
ccaagaauccacauuucua

SEQ ID NO: 770287 - RNA, 20 nt, Homo sapiens
ccaagaauguuaugugcaag

SEQ ID NO: 770288 - RNA, 18 nt, Homo sapiens
uuaacuuuauaaauccag

SEQ ID NO: 770289 - RNA, 21 nt, Homo sapiens
uuaacuuuucuaacagaaagc

SEQ ID NO: 770290 - RNA, 21 nt, Homo sapiens
uuaagaaauacucaugugcaa

SEQ ID NO: 770291 - RNA, 23 nt, Homo sapiens
uuaagaagaaauacccacuaaca

SEQ ID NO: 770292 - RNA, 21 nt, Homo sapiens
uuaagaagcaguuguaccaag

SEQ ID NO: 770293 - RNA, 22 nt, Homo sapiens
uuaagaaugucgauuaaaauca

SEQ ID NO: 770294 - RNA, 22 nt, Homo sapiens
uuaagaauugaguaauggugua

SEQ ID NO: 770295 - RNA, 18 nt, Homo sapiens
uuaagaccuggcagcucu

SEQ ID NO: 770296 - RNA, 14 nt, Homo sapiens
uuaagagccauaua

SEQ ID NO: 770297 - RNA, 12 nt, Homo sapiens
uuaagagcucag

SEQ ID NO: 770298 - RNA, 13 nt, Homo sapiens
uuaagcacacaca

SEQ ID NO: 770299 - RNA, 21 nt, Homo sapiens
uuaagcagaggaauaacauca

SEQ ID NO: 770300 - RNA, 13 nt, Homo sapiens
uggaaggagcaca

SEQ ID NO: 770301 - RNA, 22 nt, Homo sapiens
uggaaggagcacauacuaccua

SEQ ID NO: 770302 - RNA, 15 nt, Homo sapiens
uggaagggcguucua

SEQ ID NO: 770303 - RNA, 12 nt, Homo sapiens
uggaagggucaa

SEQ ID NO: 770304 - RNA, 18 nt, Homo sapiens
uggaagugugggucugug

SEQ ID NO: 770305 - RNA, 19 nt, Homo sapiens
uggaaguguucaagaaaua

SEQ ID NO: 770306 - RNA, 20 nt, Homo sapiens
uggaauaacucuguggcauu

SEQ ID NO: 770307 - RNA, 17 nt, Homo sapiens
uggaauagaugucucaa

SEQ ID NO: 770308 - RNA, 14 nt, Homo sapiens
uggaauaggaauaa

SEQ ID NO: 770309 - RNA, 22 nt, Homo sapiens
uggaauauaaggaaagcaauaa

SEQ ID NO: 770310 - RNA, 16 nt, Homo sapiens
uggaauauugugauuc

SEQ ID NO: 770311 - RNA, 23 nt, Homo sapiens
uggaaucagauauuguaagcauu

SEQ ID NO: 770312 - RNA, 22 nt, Homo sapiens
uggaaucuaacgggcauucaca

SEQ ID NO: 770313 - RNA, 16 nt, Homo sapiens
uggaaugaagguaaua

SEQ ID NO: 770314 - RNA, 22 nt, Homo sapiens
uggaaugccgcugucucugagg

SEQ ID NO: 770315 - RNA, 16 nt, Homo sapiens
uggaaugguaggauau

SEQ ID NO: 770316 - RNA, 13 nt, Homo sapiens
uggaauguaauca

SEQ ID NO: 770317 - RNA, 13 nt, Homo sapiens
uggaauugcucaa

SEQ ID NO: 770318 - RNA, 17 nt, Homo sapiens
uggaauuuggacaagug

SEQ ID NO: 770319 - RNA, 18 nt, Homo sapiens
ugcugcccagccacucca

SEQ ID NO: 770320 - RNA, 15 nt, Homo sapiens
ugcugcccucccaca

SEQ ID NO: 770321 - RNA, 11 nt, Homo sapiens
ugcugccuuaa

SEQ ID NO: 770322 - RNA, 12 nt, Homo sapiens
ugcugccuucac

SEQ ID NO: 770323 - RNA, 13 nt, Homo sapiens
ugcugcuaugaaa

SEQ ID NO: 770324 - RNA, 14 nt, Homo sapiens
ugcugcucaucuga

SEQ ID NO: 770325 - RNA, 14 nt, Homo sapiens
ugcugcuccaugga

SEQ ID NO: 770326 - RNA, 17 nt, Homo sapiens
ugcugcuggaaguagaa

SEQ ID NO: 770327 - RNA, 14 nt, Homo sapiens
ugcuggaaagggag

SEQ ID NO: 770328 - RNA, 15 nt, Homo sapiens
ugcuggaaagggagg

SEQ ID NO: 770329 - RNA, 18 nt, Homo sapiens
ugcuggaagucuccauga

SEQ ID NO: 770330 - RNA, 13 nt, Homo sapiens
ugcuggacucugg

SEQ ID NO: 770331 - RNA, 14 nt, Homo sapiens
ugcuggagacacuc

SEQ ID NO: 770332 - RNA, 18 nt, Homo sapiens
ugcuggcaugaagcuguu

SEQ ID NO: 770333 - RNA, 18 nt, Homo sapiens
ugcugggauuacaggcau

SEQ ID NO: 770334 - RNA, 17 nt, Homo sapiens
ugcugggauuacuggca

SEQ ID NO: 770335 - RNA, 18 nt, Homo sapiens
ugcugggcugagugacac

SEQ ID NO: 770336 - RNA, 14 nt, Homo sapiens
ugcuggggaccuca

SEQ ID NO: 770337 - RNA, 14 nt, Homo sapiens
ugcugguagcacuu

SEQ ID NO: 770338 - RNA, 21 nt, Homo sapiens
ugcugguccccuccucaguga

SEQ ID NO: 770339 - RNA, 18 nt, Homo sapiens
ugcgcucaccucagagca

SEQ ID NO: 770340 - RNA, 14 nt, Homo sapiens
ugcgcucugccauu

SEQ ID NO: 770341 - RNA, 15 nt, Homo sapiens
ugcgcucugccauuc

SEQ ID NO: 770342 - RNA, 21 nt, Homo sapiens
ugcgcugcacccacuaaugug

SEQ ID NO: 770343 - RNA, 11 nt, Homo sapiens
ugcgcugcuaa

SEQ ID NO: 770344 - RNA, 14 nt, Homo sapiens
ugcgcuguguacaa

SEQ ID NO: 770345 - RNA, 15 nt, Homo sapiens
ugcgcuguguacaau

SEQ ID NO: 770346 - RNA, 13 nt, Homo sapiens
ugcggaagcccag

SEQ ID NO: 770347 - RNA, 22 nt, Homo sapiens
ugcggcaaaaggaaagcugugu

SEQ ID NO: 770348 - RNA, 23 nt, Homo sapiens
ugcggugcauacacccccaccuc

SEQ ID NO: 770349 - RNA, 12 nt, Homo sapiens
ugcgucuaccca

SEQ ID NO: 770350 - RNA, 22 nt, Homo sapiens
ugcgugaaguaggcauauauca

SEQ ID NO: 770351 - RNA, 15 nt, Homo sapiens
ugcguggacucugca

SEQ ID NO: 770352 - RNA, 13 nt, Homo sapiens
ugcguguaucuaa

SEQ ID NO: 770353 - RNA, 22 nt, Homo sapiens
ugcguguaucuaauucagcuga

SEQ ID NO: 770354 - RNA, 13 nt, Homo sapiens
ugcguguguuugu

SEQ ID NO: 770355 - RNA, 13 nt, Homo sapiens
ugcguuacuaauu

SEQ ID NO: 770356 - RNA, 15 nt, Homo sapiens
ugcguucuucauuca

SEQ ID NO: 770357 - RNA, 17 nt, Homo sapiens
ugcguuuuauaucuucc

SEQ ID NO: 770358 - RNA, 15 nt, Homo sapiens
ugcuaaaaaagcaua

SEQ ID NO: 770359 - RNA, 19 nt, Homo sapiens
ugccccagauagguggugc

SEQ ID NO: 770360 - RNA, 22 nt, Homo sapiens
ugccccagauuuacuaaaucaa

SEQ ID NO: 770361 - RNA, 14 nt, Homo sapiens
ugccccagccuguc

SEQ ID NO: 770362 - RNA, 19 nt, Homo sapiens
ugccccccagccucuggca

SEQ ID NO: 770363 - RNA, 13 nt, Homo sapiens
ugccccuaauccc

SEQ ID NO: 770364 - RNA, 16 nt, Homo sapiens
ugccccucaugccaac

SEQ ID NO: 770365 - RNA, 21 nt, Homo sapiens
ugccccucggccccagcacau

SEQ ID NO: 770366 - RNA, 14 nt, Homo sapiens
ugccccucucacca

SEQ ID NO: 770367 - RNA, 23 nt, Homo sapiens
ugccccucuucuucuuugccuuc

SEQ ID NO: 770368 - RNA, 12 nt, Homo sapiens
ugccccugagac

SEQ ID NO: 770369 - RNA, 15 nt, Homo sapiens
ugcccgaaaccagag

SEQ ID NO: 770370 - RNA, 21 nt, Homo sapiens
ugcccgccucgaccucucuca

SEQ ID NO: 770371 - RNA, 20 nt, Homo sapiens
ugcccggugguuugccaugu

SEQ ID NO: 770372 - RNA, 16 nt, Homo sapiens
ugcccguaaucccagc

SEQ ID NO: 770373 - RNA, 19 nt, Homo sapiens
ugcccucgggcgagucacu

SEQ ID NO: 770374 - RNA, 12 nt, Homo sapiens
ugcccucuccca

SEQ ID NO: 770375 - RNA, 22 nt, Homo sapiens
ugcccucuccuuccuuacccaa

SEQ ID NO: 770376 - RNA, 17 nt, Homo sapiens
ugcccugcccaugggag

SEQ ID NO: 770377 - RNA, 16 nt, Homo sapiens
ugcccugggaugucca

SEQ ID NO: 770378 - RNA, 18 nt, Homo sapiens
ugcccugggauguccaca

SEQ ID NO: 770379 - RNA, 14 nt, Homo sapiens
cugaugacaacuuc

SEQ ID NO: 770380 - RNA, 13 nt, Homo sapiens
cugaugacagugu

SEQ ID NO: 770381 - RNA, 15 nt, Homo sapiens
cugaugacuugcuua

SEQ ID NO: 770382 - RNA, 17 nt, Homo sapiens
cugaugagaaucaugca

SEQ ID NO: 770383 - RNA, 15 nt, Homo sapiens
cugaugagcacgguu

SEQ ID NO: 770384 - RNA, 12 nt, Homo sapiens
cugaugaucauu

SEQ ID NO: 770385 - RNA, 16 nt, Homo sapiens
cugaugcagccgucca

SEQ ID NO: 770386 - RNA, 14 nt, Homo sapiens
cugaugcagccugu

SEQ ID NO: 770387 - RNA, 18 nt, Homo sapiens
cugaugccccugacauca

SEQ ID NO: 770388 - RNA, 19 nt, Homo sapiens
cugaugcuuauuguaacuu

SEQ ID NO: 770389 - RNA, 16 nt, Homo sapiens
cugauggaaaauacca

SEQ ID NO: 770390 - RNA, 19 nt, Homo sapiens
cugauggagcucagaauuc

SEQ ID NO: 770391 - RNA, 17 nt, Homo sapiens
cugauguaguaugcuua

SEQ ID NO: 770392 - RNA, 18 nt, Homo sapiens
cugauguaguaugcuuaa

SEQ ID NO: 770393 - RNA, 18 nt, Homo sapiens
cugauguuucugugaaau

SEQ ID NO: 770394 - RNA, 16 nt, Homo sapiens
cugauuagagugcaaa

SEQ ID NO: 770395 - RNA, 16 nt, Homo sapiens
cugauuaggaauauga

SEQ ID NO: 770396 - RNA, 13 nt, Homo sapiens
cugauucaagaac

SEQ ID NO: 770397 - RNA, 20 nt, Homo sapiens
cugauucauaauaaauaucu

SEQ ID NO: 770398 - RNA, 15 nt, Homo sapiens
cugauuccacuuuua

SEQ ID NO: 770399 - RNA, 20 nt, Homo sapiens
cugauuccccuccaccaaac

SEQ ID NO: 770400 - RNA, 23 nt, Homo sapiens
cugauucccuguggugauaccua

SEQ ID NO: 770401 - RNA, 13 nt, Homo sapiens
cugauuggcaugu

SEQ ID NO: 770402 - RNA, 19 nt, Homo sapiens
cugauuuguggaaaggagg

SEQ ID NO: 770403 - RNA, 19 nt, Homo sapiens
cugauuuuuagcuuuacaa

SEQ ID NO: 770404 - RNA, 16 nt, Homo sapiens
cugcaaaaaaagccuc

SEQ ID NO: 770405 - RNA, 19 nt, Homo sapiens
cugcaaaaaugaaauccag

SEQ ID NO: 770406 - RNA, 19 nt, Homo sapiens
cugcaaaaauuaauacaca

SEQ ID NO: 770407 - RNA, 19 nt, Homo sapiens
cugcaaaggcgcagugcuu

SEQ ID NO: 770408 - RNA, 19 nt, Homo sapiens
cugcaaagucgccagucac

SEQ ID NO: 770409 - RNA, 15 nt, Homo sapiens
cugcaaauacuguau

SEQ ID NO: 770410 - RNA, 17 nt, Homo sapiens
cugcaaauugccugcaa

SEQ ID NO: 770411 - RNA, 14 nt, Homo sapiens
cugcaacacuuuga

SEQ ID NO: 770412 - RNA, 13 nt, Homo sapiens
cugcaacgcugcc

SEQ ID NO: 770413 - RNA, 14 nt, Homo sapiens
cugcaacucaagga

SEQ ID NO: 770414 - RNA, 21 nt, Homo sapiens
cugcaacuggagccaagaaga

SEQ ID NO: 770415 - RNA, 18 nt, Homo sapiens
cugcaagcagaacuucca

SEQ ID NO: 770416 - RNA, 18 nt, Homo sapiens
cugcaaguuagugaaaca

SEQ ID NO: 770417 - RNA, 23 nt, Homo sapiens
cugcaauucaggccgcaagcagc

SEQ ID NO: 770418 - RNA, 17 nt, Homo sapiens
cugcaauuuuaauugau

SEQ ID NO: 770419 - RNA, 14 nt, Homo sapiens
cugcacaaacaaua

SEQ ID NO: 770420 - RNA, 17 nt, Homo sapiens
cugcacaaacaauaugu

SEQ ID NO: 770421 - RNA, 16 nt, Homo sapiens
cugcacagcugguguc

SEQ ID NO: 770422 - RNA, 13 nt, Homo sapiens
cugcacagugaag

SEQ ID NO: 770423 - RNA, 18 nt, Homo sapiens
cugcacagugacuucuga

SEQ ID NO: 770424 - RNA, 22 nt, Homo sapiens
cugcacagugacuucugagauc

SEQ ID NO: 770425 - RNA, 18 nt, Homo sapiens
cugcacaugucuuguaca

SEQ ID NO: 770426 - RNA, 16 nt, Homo sapiens
cugcaccuuugcacgu

SEQ ID NO: 770427 - RNA, 19 nt, Homo sapiens
cugcaccuuuuugcaugau

SEQ ID NO: 770428 - RNA, 23 nt, Homo sapiens
cugcacuaauuugauguuuacag

SEQ ID NO: 770429 - RNA, 16 nt, Homo sapiens
cugcacuacuaugaga

SEQ ID NO: 770430 - RNA, 14 nt, Homo sapiens
cugcacuacugaca

SEQ ID NO: 770431 - RNA, 22 nt, Homo sapiens
cugcacugaggcagcgaccuca

SEQ ID NO: 770432 - RNA, 15 nt, Homo sapiens
cugcagaccaugcca

SEQ ID NO: 770433 - RNA, 17 nt, Homo sapiens
cugcagaccaugccaga

SEQ ID NO: 770434 - RNA, 15 nt, Homo sapiens
cugcagagcaggaaa

SEQ ID NO: 770435 - RNA, 18 nt, Homo sapiens
cugcagaggaaagacagg

SEQ ID NO: 770436 - RNA, 19 nt, Homo sapiens
cugcagauagaaagcauua

SEQ ID NO: 770437 - RNA, 21 nt, Homo sapiens
cugcagaugccacccuagcca

SEQ ID NO: 770438 - RNA, 12 nt, Homo sapiens
cugcagccagcu

SEQ ID NO: 770439 - RNA, 21 nt, Homo sapiens
cugcagccagcucacguccag

SEQ ID NO: 770440 - RNA, 21 nt, Homo sapiens
cugcagccccuccuccucggg

SEQ ID NO: 770441 - RNA, 20 nt, Homo sapiens
cugcagcugcuuuugcauuu

SEQ ID NO: 770442 - RNA, 14 nt, Homo sapiens
cugcaguccuggug

SEQ ID NO: 770443 - RNA, 18 nt, Homo sapiens
cugcaguuuuauugcuaa

SEQ ID NO: 770444 - RNA, 15 nt, Homo sapiens
cugcaguuuuuccca

SEQ ID NO: 770445 - RNA, 16 nt, Homo sapiens
cugcaucauccuugca

SEQ ID NO: 770446 - RNA, 15 nt, Homo sapiens
cugcaucugugaaaa

SEQ ID NO: 770447 - RNA, 21 nt, Homo sapiens
cugcauguaccauuugcaugg

SEQ ID NO: 770448 - RNA, 17 nt, Homo sapiens
cugcauuagucucaugu

SEQ ID NO: 770449 - RNA, 21 nt, Homo sapiens
cugcauucuucugagcacugu

SEQ ID NO: 770450 - RNA, 22 nt, Homo sapiens
cugcauucuucugagcacuguu

SEQ ID NO: 770451 - RNA, 13 nt, Homo sapiens
cugcauugcuaga

SEQ ID NO: 770452 - RNA, 15 nt, Homo sapiens
cugcauuuacagugu

SEQ ID NO: 770453 - RNA, 16 nt, Homo sapiens
cugcauuuacagugua

SEQ ID NO: 770454 - RNA, 16 nt, Homo sapiens
cugcauuugccuguca

SEQ ID NO: 770455 - RNA, 13 nt, Homo sapiens
cugccaaacacau

SEQ ID NO: 770456 - RNA, 20 nt, Homo sapiens
cugccaaccagagcagcuca

SEQ ID NO: 770457 - RNA, 19 nt, Homo sapiens
cugccaagagguacuguaa

SEQ ID NO: 770458 - RNA, 18 nt, Homo sapiens
cugccacuguguacugug

SEQ ID NO: 770459 - RNA, 12 nt, Homo sapiens
cugccagcaucu

SEQ ID NO: 770460 - RNA, 16 nt, Homo sapiens
cugccagcaucugcag

SEQ ID NO: 770461 - RNA, 17 nt, Homo sapiens
cugccagcaucugcagc

SEQ ID NO: 770462 - RNA, 16 nt, Homo sapiens
cugccagcugcacuga

SEQ ID NO: 770463 - RNA, 20 nt, Homo sapiens
cugccaguacucccugcuaa

SEQ ID NO: 770464 - RNA, 13 nt, Homo sapiens
cugccaugauagc

SEQ ID NO: 770465 - RNA, 14 nt, Homo sapiens
cugccauguugccc

SEQ ID NO: 770466 - RNA, 23 nt, Homo sapiens
cugccauuaaauccgcaaacagc

SEQ ID NO: 770467 - RNA, 12 nt, Homo sapiens
cugccauuuccc

SEQ ID NO: 770468 - RNA, 20 nt, Homo sapiens
cugcccaacccuucccucac

SEQ ID NO: 770469 - RNA, 13 nt, Homo sapiens
cugcccaaugaga

SEQ ID NO: 770470 - RNA, 21 nt, Homo sapiens
cugcccagaccccucuggcca

SEQ ID NO: 770471 - RNA, 22 nt, Homo sapiens
cugcccaggcagucuuugcuca

SEQ ID NO: 770472 - RNA, 22 nt, Homo sapiens
cugcccagucgaccccaaagga

SEQ ID NO: 770473 - RNA, 15 nt, Homo sapiens
cugccccagauuuac

SEQ ID NO: 770474 - RNA, 22 nt, Homo sapiens
cugccccucaugccaaccccgc

SEQ ID NO: 770475 - RNA, 16 nt, Homo sapiens
cugcccuagagcacac

SEQ ID NO: 770476 - RNA, 19 nt, Homo sapiens
cugcccucacaucuuccac

SEQ ID NO: 770477 - RNA, 17 nt, Homo sapiens
cugccgaaccaaaagaa

SEQ ID NO: 770478 - RNA, 19 nt, Homo sapiens
cugccgcccccuccugaac

SEQ ID NO: 770479 - RNA, 19 nt, Homo sapiens
cugccggucccccaugcca

SEQ ID NO: 770480 - RNA, 20 nt, Homo sapiens
cugccggucccccaugccac

SEQ ID NO: 770481 - RNA, 20 nt, Homo sapiens
cugccuacacacacagccua

SEQ ID NO: 770482 - RNA, 22 nt, Homo sapiens
cugccuaggaggcuggccaagg

SEQ ID NO: 770483 - RNA, 17 nt, Homo sapiens
cugccuauuaucuguca

SEQ ID NO: 770484 - RNA, 23 nt, Homo sapiens
cugccuccuuuccccucccucag

SEQ ID NO: 770485 - RNA, 21 nt, Homo sapiens
cugccucugccacugacugca

SEQ ID NO: 770486 - RNA, 20 nt, Homo sapiens
cugccucuggaauugcucaa

SEQ ID NO: 770487 - RNA, 17 nt, Homo sapiens
cugccugcauggcauca

SEQ ID NO: 770488 - RNA, 16 nt, Homo sapiens
cugccugcggcccaga

SEQ ID NO: 770489 - RNA, 16 nt, Homo sapiens
cugccugguauaucca

SEQ ID NO: 770490 - RNA, 12 nt, Homo sapiens
cugccuguaacu

SEQ ID NO: 770491 - RNA, 12 nt, Homo sapiens
cugccuguggag

SEQ ID NO: 770492 - RNA, 22 nt, Homo sapiens
cugccuguuauaacucugcacu

SEQ ID NO: 770493 - RNA, 19 nt, Homo sapiens
cugccuuaaaaccaaagag

SEQ ID NO: 770494 - RNA, 22 nt, Homo sapiens
cugacacaagaauggucuuucu

SEQ ID NO: 770495 - RNA, 15 nt, Homo sapiens
cugacacaagaggaa

SEQ ID NO: 770496 - RNA, 14 nt, Homo sapiens
cugacacauagaaa

SEQ ID NO: 770497 - RNA, 13 nt, Homo sapiens
cugacaccugcuu

SEQ ID NO: 770498 - RNA, 17 nt, Homo sapiens
cugacagaggugucauc

SEQ ID NO: 770499 - RNA, 21 nt, Homo sapiens
cugacaugcucacacauuaca

SEQ ID NO: 770500 - RNA, 17 nt, Homo sapiens
cugaccagagaaugcac

SEQ ID NO: 770501 - RNA, 19 nt, Homo sapiens
cugaccccaaguuauccac

SEQ ID NO: 770502 - RNA, 14 nt, Homo sapiens
cugaccccauuccu

SEQ ID NO: 770503 - RNA, 21 nt, Homo sapiens
cugaccccgccucaccaauac

SEQ ID NO: 770504 - RNA, 19 nt, Homo sapiens
cugacccugcuucaaauau

SEQ ID NO: 770505 - RNA, 22 nt, Homo sapiens
cugaccucaagcaaccaugaac

SEQ ID NO: 770506 - RNA, 15 nt, Homo sapiens
cugaccucacuguga

SEQ ID NO: 770507 - RNA, 19 nt, Homo sapiens
cugaccucaggugauccgc

SEQ ID NO: 770508 - RNA, 16 nt, Homo sapiens
cugaccuguguucccu

SEQ ID NO: 770509 - RNA, 23 nt, Homo sapiens
cugacuaauuuuuguauuuuuag

SEQ ID NO: 770510 - RNA, 14 nt, Homo sapiens
cugacuacugccca

SEQ ID NO: 770511 - RNA, 14 nt, Homo sapiens
cugacucugacuca

SEQ ID NO: 770512 - RNA, 13 nt, Homo sapiens
cugacucuugcag

SEQ ID NO: 770513 - RNA, 23 nt, Homo sapiens
cugacugaacauuaguugcacua

SEQ ID NO: 770514 - RNA, 18 nt, Homo sapiens
cugacuuaaguggcauua

SEQ ID NO: 770515 - RNA, 14 nt, Homo sapiens
cugacuuugcuugc

SEQ ID NO: 770516 - RNA, 17 nt, Homo sapiens
cugagaaaagccucucc

SEQ ID NO: 770517 - RNA, 22 nt, Homo sapiens
cugagaaaauguaaggauucug

SEQ ID NO: 770518 - RNA, 19 nt, Homo sapiens
cugagaaacccaccagccu

SEQ ID NO: 770519 - RNA, 13 nt, Homo sapiens
cugagaaaccucg

SEQ ID NO: 770520 - RNA, 22 nt, Homo sapiens
cugagaagaaugaaaaugcagu

SEQ ID NO: 770521 - RNA, 13 nt, Homo sapiens
cugagaaggcagu

SEQ ID NO: 770522 - RNA, 20 nt, Homo sapiens
cugagaagucaaacauuuca

SEQ ID NO: 770523 - RNA, 18 nt, Homo sapiens
cugagacaaagcaaugga

SEQ ID NO: 770524 - RNA, 13 nt, Homo sapiens
cugagacagcagu

SEQ ID NO: 770525 - RNA, 14 nt, Homo sapiens
cugagacagggauu

SEQ ID NO: 770526 - RNA, 14 nt, Homo sapiens
cugagaccaaagaa

SEQ ID NO: 770527 - RNA, 17 nt, Homo sapiens
cucucaauuucuggaaa

SEQ ID NO: 770528 - RNA, 14 nt, Homo sapiens
cucucacacugaau

SEQ ID NO: 770529 - RNA, 21 nt, Homo sapiens
cucucaccagauaaguccuuu

SEQ ID NO: 770530 - RNA, 23 nt, Homo sapiens
cucucaccuguacuauugcagac

SEQ ID NO: 770531 - RNA, 14 nt, Homo sapiens
cucucagaacauac

SEQ ID NO: 770532 - RNA, 15 nt, Homo sapiens
cucucagcauagccu

SEQ ID NO: 770533 - RNA, 20 nt, Homo sapiens
cucucaguaguuuaguacaa

SEQ ID NO: 770534 - RNA, 17 nt, Homo sapiens
cucucagugaacuguga

SEQ ID NO: 770535 - RNA, 18 nt, Homo sapiens
cucucagugaacugugag

SEQ ID NO: 770536 - RNA, 11 nt, Homo sapiens
cucucaucucu

SEQ ID NO: 770537 - RNA, 16 nt, Homo sapiens
cucuccagcugacuaa

SEQ ID NO: 770538 - RNA, 13 nt, Homo sapiens
cucuccaguguuu

SEQ ID NO: 770539 - RNA, 15 nt, Homo sapiens
cucuccaguguuucu

SEQ ID NO: 770540 - RNA, 13 nt, Homo sapiens
cucuccauauccc

SEQ ID NO: 770541 - RNA, 20 nt, Homo sapiens
cucucccaaaaaacuacuuc

SEQ ID NO: 770542 - RNA, 20 nt, Homo sapiens
cucucccaccccggccucca

SEQ ID NO: 770543 - RNA, 18 nt, Homo sapiens
cucuccccagcccagaga

SEQ ID NO: 770544 - RNA, 21 nt, Homo sapiens
cucuccccagccuccccgugc

SEQ ID NO: 770545 - RNA, 22 nt, Homo sapiens
cucuccccauccccacccaguc

SEQ ID NO: 770546 - RNA, 13 nt, Homo sapiens
cucuccuauguag

SEQ ID NO: 770547 - RNA, 16 nt, Homo sapiens
cucuccugaauccuuu

SEQ ID NO: 770548 - RNA, 14 nt, Homo sapiens
cucuccugcuuccu

SEQ ID NO: 770549 - RNA, 17 nt, Homo sapiens
cucuccugcuuccucuu

SEQ ID NO: 770550 - RNA, 21 nt, Homo sapiens
cucuccuuauagacacuugcu

SEQ ID NO: 770551 - RNA, 14 nt, Homo sapiens
cucuccuucuuagc

SEQ ID NO: 770552 - RNA, 16 nt, Homo sapiens
cucuccuuuggccauu

SEQ ID NO: 770553 - RNA, 19 nt, Homo sapiens
cucuccuuuggccauucca

SEQ ID NO: 770554 - RNA, 16 nt, Homo sapiens
cucucgacaguaucca

SEQ ID NO: 770555 - RNA, 22 nt, Homo sapiens
cucucgcacaccucugcaccuu

SEQ ID NO: 770556 - RNA, 21 nt, Homo sapiens
cucucuaagugggcauugcca

SEQ ID NO: 770557 - RNA, 22 nt, Homo sapiens
cucucuaagugggcauugccau

SEQ ID NO: 770558 - RNA, 14 nt, Homo sapiens
cucucuaccagucu

SEQ ID NO: 770559 - RNA, 21 nt, Homo sapiens
cucucuaccagucuauuucca

SEQ ID NO: 770560 - RNA, 14 nt, Homo sapiens
cucucuaccuccac

SEQ ID NO: 770561 - RNA, 13 nt, Homo sapiens
cucucucuguggg

SEQ ID NO: 770562 - RNA, 18 nt, Homo sapiens
cucucugagacugcuaag

SEQ ID NO: 770563 - RNA, 22 nt, Homo sapiens
cucucugagucaaauccagugg

SEQ ID NO: 770564 - RNA, 13 nt, Homo sapiens
cucucugcagcug

SEQ ID NO: 770565 - RNA, 16 nt, Homo sapiens
cucucugccugggaug

SEQ ID NO: 770566 - RNA, 13 nt, Homo sapiens
cucucugcuccuu

SEQ ID NO: 770567 - RNA, 11 nt, Homo sapiens
cucugaaguca

SEQ ID NO: 770568 - RNA, 22 nt, Homo sapiens
cucugaauauuuuguaauaaag

SEQ ID NO: 770569 - RNA, 17 nt, Homo sapiens
cucugaauuuacuuccu

SEQ ID NO: 770570 - RNA, 12 nt, Homo sapiens
cucugacagucc

SEQ ID NO: 770571 - RNA, 17 nt, Homo sapiens
cucugagucaaauccag

SEQ ID NO: 770572 - RNA, 16 nt, Homo sapiens
cucugauuuacauuca

SEQ ID NO: 770573 - RNA, 18 nt, Homo sapiens
cucugcacaugucuugua

SEQ ID NO: 770574 - RNA, 21 nt, Homo sapiens
cucugcacccagugaacacau

SEQ ID NO: 770575 - RNA, 16 nt, Homo sapiens
cucugcaccuuugcac

SEQ ID NO: 770576 - RNA, 21 nt, Homo sapiens
cucugcagcuuucaagcucau

SEQ ID NO: 770577 - RNA, 15 nt, Homo sapiens
cucugcauucuagua

SEQ ID NO: 770578 - RNA, 13 nt, Homo sapiens
cucugccagugac

SEQ ID NO: 770579 - RNA, 20 nt, Homo sapiens
cucugcccaaacauaaagag

SEQ ID NO: 770580 - RNA, 17 nt, Homo sapiens
cucugccccaggcccua

SEQ ID NO: 770581 - RNA, 19 nt, Homo sapiens
cucugccccaucauugcac

SEQ ID NO: 770582 - RNA, 15 nt, Homo sapiens
cucugcccgcuuuga

SEQ ID NO: 770583 - RNA, 17 nt, Homo sapiens
cucugccgcuaccuccc

SEQ ID NO: 770584 - RNA, 22 nt, Homo sapiens
cucugccggucccccaugccac

SEQ ID NO: 770585 - RNA, 18 nt, Homo sapiens
cucugccugaaccuucca

SEQ ID NO: 770586 - RNA, 18 nt, Homo sapiens
cucugccugggacacugc

SEQ ID NO: 770587 - RNA, 15 nt, Homo sapiens
cucugccugggaugg

SEQ ID NO: 770588 - RNA, 21 nt, Homo sapiens
cucugccuuuaugaugcuaag

SEQ ID NO: 770589 - RNA, 22 nt, Homo sapiens
cucugcuccugugguccagugg

SEQ ID NO: 770590 - RNA, 14 nt, Homo sapiens
cucugcuuccagca

SEQ ID NO: 770591 - RNA, 18 nt, Homo sapiens
cucugcuucuccaaggaa

SEQ ID NO: 770592 - RNA, 16 nt, Homo sapiens
cucuggaccauauacc

SEQ ID NO: 770593 - RNA, 17 nt, Homo sapiens
cucuggaccauauacca

SEQ ID NO: 770594 - RNA, 16 nt, Homo sapiens
cucuggagcaauguug

SEQ ID NO: 770595 - RNA, 23 nt, Homo sapiens
cucuggaggaaguucuccagcuu

SEQ ID NO: 770596 - RNA, 19 nt, Homo sapiens
cucuggaggucaucuggcg

SEQ ID NO: 770597 - RNA, 23 nt, Homo sapiens
cucuggcugcucccugacagcac

SEQ ID NO: 770598 - RNA, 14 nt, Homo sapiens
cucugggagacuuu

SEQ ID NO: 770599 - RNA, 21 nt, Homo sapiens
cucuggggucuuuuuaugcau

SEQ ID NO: 770600 - RNA, 18 nt, Homo sapiens
cucugguaaaugaucacu

SEQ ID NO: 770601 - RNA, 22 nt, Homo sapiens
cucugguaaaugaucacuccag

SEQ ID NO: 770602 - RNA, 17 nt, Homo sapiens
cucugguggagacaaau

SEQ ID NO: 770603 - RNA, 16 nt, Homo sapiens
cucuggugugugguga

SEQ ID NO: 770604 - RNA, 14 nt, Homo sapiens
cucuguaauugaau

SEQ ID NO: 770605 - RNA, 19 nt, Homo sapiens
cucuguauuccgauacaaa

SEQ ID NO: 770606 - RNA, 17 nt, Homo sapiens
ccuuucgagcucugcag

SEQ ID NO: 770607 - RNA, 17 nt, Homo sapiens
ccuuucucuaaaacugc

SEQ ID NO: 770608 - RNA, 18 nt, Homo sapiens
ccuuucuugacaaaaccu

SEQ ID NO: 770609 - RNA, 22 nt, Homo sapiens
ccuuugagcugcugacugccaa

SEQ ID NO: 770610 - RNA, 14 nt, Homo sapiens
ccuuugagguugau

SEQ ID NO: 770611 - RNA, 21 nt, Homo sapiens
ccuuugauaaauguauauaug

SEQ ID NO: 770612 - RNA, 16 nt, Homo sapiens
ccuuugaucaguauaa

SEQ ID NO: 770613 - RNA, 19 nt, Homo sapiens
ccuuugcucccuguugcug

SEQ ID NO: 770614 - RNA, 19 nt, Homo sapiens
ccuuuggauugacucugca

SEQ ID NO: 770615 - RNA, 20 nt, Homo sapiens
ccuuuggauugacucugcau

SEQ ID NO: 770616 - RNA, 19 nt, Homo sapiens
ccuuuggccccacuuugaa

SEQ ID NO: 770617 - RNA, 21 nt, Homo sapiens
ccuuuggcuucugauuuuucu

SEQ ID NO: 770618 - RNA, 19 nt, Homo sapiens
ccuuuguguagaaagccaa

SEQ ID NO: 770619 - RNA, 21 nt, Homo sapiens
ccuuuuagccuaguucaucca

SEQ ID NO: 770620 - RNA, 13 nt, Homo sapiens
ccuuuucauuuaa

SEQ ID NO: 770621 - RNA, 18 nt, Homo sapiens
ccuuuugaccaaauaaag

SEQ ID NO: 770622 - RNA, 20 nt, Homo sapiens
ccuuuugaccaaauaaagua

SEQ ID NO: 770623 - RNA, 11 nt, Homo sapiens
ccuuuugcccg

SEQ ID NO: 770624 - RNA, 17 nt, Homo sapiens
ccuuuuggaacauuucu

SEQ ID NO: 770625 - RNA, 12 nt, Homo sapiens
ccuuuugugcaa

SEQ ID NO: 770626 - RNA, 13 nt, Homo sapiens
ccuuuuucacuuu

SEQ ID NO: 770627 - RNA, 15 nt, Homo sapiens
ccuuuuugacacuga

SEQ ID NO: 770628 - RNA, 22 nt, Homo sapiens
ccuuuuuucaaaauccaaaaag

SEQ ID NO: 770629 - RNA, 14 nt, Homo sapiens
cgaaaccccaucuc

SEQ ID NO: 770630 - RNA, 21 nt, Homo sapiens
cgaaaccugggauucaggaau

SEQ ID NO: 770631 - RNA, 16 nt, Homo sapiens
cgaaccaggaaaugga

SEQ ID NO: 770632 - RNA, 13 nt, Homo sapiens
cgaacuccugacc

SEQ ID NO: 770633 - RNA, 13 nt, Homo sapiens
cgaacugcacugc

SEQ ID NO: 770634 - RNA, 12 nt, Homo sapiens
cgaacuuucaaa

SEQ ID NO: 770635 - RNA, 17 nt, Homo sapiens
cgaagggggucaaagga

SEQ ID NO: 770636 - RNA, 17 nt, Homo sapiens
cgaagugcugagauuac

SEQ ID NO: 770637 - RNA, 19 nt, Homo sapiens
cgaaguguuuauguaauag

SEQ ID NO: 770638 - RNA, 18 nt, Homo sapiens
cgaaugguuccauucucu

SEQ ID NO: 770639 - RNA, 12 nt, Homo sapiens
cgaaugucacug

SEQ ID NO: 770640 - RNA, 20 nt, Homo sapiens
cgacacugucacuugaccaa

SEQ ID NO: 770641 - RNA, 19 nt, Homo sapiens
cgaccacuuccaggggaac

SEQ ID NO: 770642 - RNA, 12 nt, Homo sapiens
cgacccaagacc

SEQ ID NO: 770643 - RNA, 14 nt, Homo sapiens
cgaccccaaaggaa

SEQ ID NO: 770644 - RNA, 16 nt, Homo sapiens
cgaccgccccaguucc

SEQ ID NO: 770645 - RNA, 18 nt, Homo sapiens
cgaccgcccccuccucua

SEQ ID NO: 770646 - RNA, 22 nt, Homo sapiens
cgaccuccccacccgcucccac

SEQ ID NO: 770647 - RNA, 16 nt, Homo sapiens
cgacgcugacugcccu

SEQ ID NO: 770648 - RNA, 14 nt, Homo sapiens
cgacugaaacugga

SEQ ID NO: 770649 - RNA, 22 nt, Homo sapiens
cgacugccugugaaguggaugg

SEQ ID NO: 770650 - RNA, 15 nt, Homo sapiens
cgacuggcugugaga

SEQ ID NO: 770651 - RNA, 13 nt, Homo sapiens
cgacugggcucaa

SEQ ID NO: 770652 - RNA, 18 nt, Homo sapiens
cgacuuucugccuggagu

SEQ ID NO: 770653 - RNA, 14 nt, Homo sapiens
cgagaacagggaaa

SEQ ID NO: 770654 - RNA, 15 nt, Homo sapiens
cgagaacccugagca

SEQ ID NO: 770655 - RNA, 15 nt, Homo sapiens
cgagacuccgucuca

SEQ ID NO: 770656 - RNA, 20 nt, Homo sapiens
cgagacuugguuucaaaaaa

SEQ ID NO: 770657 - RNA, 17 nt, Homo sapiens
cgagagcagacaccagc

SEQ ID NO: 770658 - RNA, 19 nt, Homo sapiens
cgagagcuuggacuacaca

SEQ ID NO: 770659 - RNA, 14 nt, Homo sapiens
cgagaucaagagau

SEQ ID NO: 770660 - RNA, 17 nt, Homo sapiens
cgagaucacaccacugu

SEQ ID NO: 770661 - RNA, 17 nt, Homo sapiens
cgagaucacgccacugc

SEQ ID NO: 770662 - RNA, 21 nt, Homo sapiens
cgagaucacgccacugcacuc

SEQ ID NO: 770663 - RNA, 21 nt, Homo sapiens
cgagcaccuccagccugaaca

SEQ ID NO: 770664 - RNA, 13 nt, Homo sapiens
cgagcacugugag

SEQ ID NO: 770665 - RNA, 15 nt, Homo sapiens
cgagcacugugagca

SEQ ID NO: 770666 - RNA, 13 nt, Homo sapiens
cgagcaugagcug

SEQ ID NO: 770667 - RNA, 19 nt, Homo sapiens
cgagcaugggggcugccag

SEQ ID NO: 770668 - RNA, 14 nt, Homo sapiens
cgagcccuggagag

SEQ ID NO: 770669 - RNA, 15 nt, Homo sapiens
cgagcggcaaaggcc

SEQ ID NO: 770670 - RNA, 23 nt, Homo sapiens
cgaggaaaggauuuuaccaaagc

SEQ ID NO: 770671 - RNA, 14 nt, Homo sapiens
cgaggacacagugg

SEQ ID NO: 770672 - RNA, 16 nt, Homo sapiens
cgaggacccaggaaag

SEQ ID NO: 770673 - RNA, 21 nt, Homo sapiens
cgaggagugccguguguugca

SEQ ID NO: 770674 - RNA, 21 nt, Homo sapiens
ccuccucagcgagaggcagca

SEQ ID NO: 770675 - RNA, 20 nt, Homo sapiens
ccuccucaggcacacagcua

SEQ ID NO: 770676 - RNA, 12 nt, Homo sapiens
ccuccucaguga

SEQ ID NO: 770677 - RNA, 17 nt, Homo sapiens
ccuccuccccuagggaa

SEQ ID NO: 770678 - RNA, 14 nt, Homo sapiens
ccuccucuagcugu

SEQ ID NO: 770679 - RNA, 21 nt, Homo sapiens
ccuccucuccuacuuugggac

SEQ ID NO: 770680 - RNA, 22 nt, Homo sapiens
ccuccucuucccuuagccucuc

SEQ ID NO: 770681 - RNA, 19 nt, Homo sapiens
ccuccucuucugacgugcc

SEQ ID NO: 770682 - RNA, 19 nt, Homo sapiens
ccuccugaaccgcacagcu

SEQ ID NO: 770683 - RNA, 13 nt, Homo sapiens
ccuccuggcagcc

SEQ ID NO: 770684 - RNA, 22 nt, Homo sapiens
ccuccugugcuauuuguacaaa

SEQ ID NO: 770685 - RNA, 14 nt, Homo sapiens
ccuccuucgggaca

SEQ ID NO: 770686 - RNA, 19 nt, Homo sapiens
ccuccuuggcuuuaugcaa

SEQ ID NO: 770687 - RNA, 16 nt, Homo sapiens
ccuccuuugccuucca

SEQ ID NO: 770688 - RNA, 14 nt, Homo sapiens
ccuccuuuucccaa

SEQ ID NO: 770689 - RNA, 15 nt, Homo sapiens
ccucggccucccaca

SEQ ID NO: 770690 - RNA, 18 nt, Homo sapiens
ccucgggggccuguggug

SEQ ID NO: 770691 - RNA, 17 nt, Homo sapiens
ccucgguacucccauaa

SEQ ID NO: 770692 - RNA, 15 nt, Homo sapiens
ccucuaagacaaagu

SEQ ID NO: 770693 - RNA, 18 nt, Homo sapiens
ccucuaagcacauuccaa

SEQ ID NO: 770694 - RNA, 13 nt, Homo sapiens
ccucuaagguugg

SEQ ID NO: 770695 - RNA, 12 nt, Homo sapiens
ccucuaaugaga

SEQ ID NO: 770696 - RNA, 19 nt, Homo sapiens
ccucuacuuugauucugau

SEQ ID NO: 770697 - RNA, 20 nt, Homo sapiens
ccucuaguaagaugcacuga

SEQ ID NO: 770698 - RNA, 22 nt, Homo sapiens
ccucuaguaagaugcacugaaa

SEQ ID NO: 770699 - RNA, 16 nt, Homo sapiens
ccucuauaccuguguc

SEQ ID NO: 770700 - RNA, 16 nt, Homo sapiens
ccucucagcauagccu

SEQ ID NO: 770701 - RNA, 18 nt, Homo sapiens
ccucucaggcucuugacu

SEQ ID NO: 770702 - RNA, 13 nt, Homo sapiens
ccucucagguggg

SEQ ID NO: 770703 - RNA, 16 nt, Homo sapiens
ccucucagguggguua

SEQ ID NO: 770704 - RNA, 15 nt, Homo sapiens
ccucuccaacugccu

SEQ ID NO: 770705 - RNA, 20 nt, Homo sapiens
ccucuccaggaaugccuccu

SEQ ID NO: 770706 - RNA, 13 nt, Homo sapiens
ccucuccauuugc

SEQ ID NO: 770707 - RNA, 23 nt, Homo sapiens
ccucuccccaagaagaugaaaga

SEQ ID NO: 770708 - RNA, 16 nt, Homo sapiens
ccucuccccuccagaa

SEQ ID NO: 770709 - RNA, 20 nt, Homo sapiens
ccucucccgucagggcccaa

SEQ ID NO: 770710 - RNA, 22 nt, Homo sapiens
ccucucccucccuaacagugaa

SEQ ID NO: 770711 - RNA, 14 nt, Homo sapiens
ccucucgcggcccu

SEQ ID NO: 770712 - RNA, 22 nt, Homo sapiens
ccucucucugggaccacugggu

SEQ ID NO: 770713 - RNA, 20 nt, Homo sapiens
ccucucucuuaccugggacc

SEQ ID NO: 770714 - RNA, 15 nt, Homo sapiens
ccucucugagucaaa

SEQ ID NO: 770715 - RNA, 23 nt, Homo sapiens
ccucucugcagacuucccagcua

SEQ ID NO: 770716 - RNA, 13 nt, Homo sapiens
ccucucugcuccu

SEQ ID NO: 770717 - RNA, 16 nt, Homo sapiens
ccucucuuaaaugcaa

SEQ ID NO: 770718 - RNA, 16 nt, Homo sapiens
ccucucuuauagaaua

SEQ ID NO: 770719 - RNA, 15 nt, Homo sapiens
ccucugaaaugccuc

SEQ ID NO: 770720 - RNA, 14 nt, Homo sapiens
ccucugaacccccu

SEQ ID NO: 770721 - RNA, 17 nt, Homo sapiens
ccucugaacuugccuua

SEQ ID NO: 770722 - RNA, 17 nt, Homo sapiens
ccucugcacuacugaca

SEQ ID NO: 770723 - RNA, 15 nt, Homo sapiens
ccucugccugcauuc

SEQ ID NO: 770724 - RNA, 18 nt, Homo sapiens
ccucugcuaagguguauu

SEQ ID NO: 770725 - RNA, 21 nt, Homo sapiens
ccucugcuacuccauccugaa

SEQ ID NO: 770726 - RNA, 15 nt, Homo sapiens
ccugucacucagcug

SEQ ID NO: 770727 - RNA, 15 nt, Homo sapiens
ccuguccagcuccaa

SEQ ID NO: 770728 - RNA, 15 nt, Homo sapiens
ccuguccaugccccu

SEQ ID NO: 770729 - RNA, 21 nt, Homo sapiens
ccugucccacccacacagcug

SEQ ID NO: 770730 - RNA, 23 nt, Homo sapiens
ccugucccagagguuaucugccu

SEQ ID NO: 770731 - RNA, 16 nt, Homo sapiens
ccuguccuugcccuuu

SEQ ID NO: 770732 - RNA, 17 nt, Homo sapiens
ccuguccuuucuugcag

SEQ ID NO: 770733 - RNA, 14 nt, Homo sapiens
ccugucuccagcug

SEQ ID NO: 770734 - RNA, 17 nt, Homo sapiens
ccugucuccagcugccu

SEQ ID NO: 770735 - RNA, 20 nt, Homo sapiens
ccugucugaaggacacuucc

SEQ ID NO: 770736 - RNA, 22 nt, Homo sapiens
ccugucugccagccagcagcca

SEQ ID NO: 770737 - RNA, 18 nt, Homo sapiens
ccugucuggccccugaga

SEQ ID NO: 770738 - RNA, 17 nt, Homo sapiens
ccugucuuaugguccag

SEQ ID NO: 770739 - RNA, 21 nt, Homo sapiens
ccugucuucugggcacagugg

SEQ ID NO: 770740 - RNA, 21 nt, Homo sapiens
ccugucuuggggccacuuuca

SEQ ID NO: 770741 - RNA, 16 nt, Homo sapiens
ccugugaagggacaca

SEQ ID NO: 770742 - RNA, 20 nt, Homo sapiens
ccugugacauguaacagcca

SEQ ID NO: 770743 - RNA, 11 nt, Homo sapiens
ccugugacugu

SEQ ID NO: 770744 - RNA, 21 nt, Homo sapiens
ccugugaggcagccuucugau

SEQ ID NO: 770745 - RNA, 22 nt, Homo sapiens
ccugugcacgcgcgcgugcaca

SEQ ID NO: 770746 - RNA, 11 nt, Homo sapiens
ccugugcagca

SEQ ID NO: 770747 - RNA, 22 nt, Homo sapiens
ccugugcccacccgucuucaau

SEQ ID NO: 770748 - RNA, 23 nt, Homo sapiens
ccugugccguuuucuugcucaaa

SEQ ID NO: 770749 - RNA, 15 nt, Homo sapiens
ccugugccuuuugcc

SEQ ID NO: 770750 - RNA, 14 nt, Homo sapiens
ccuguguaccucua

SEQ ID NO: 770751 - RNA, 22 nt, Homo sapiens
ccuguguccacugagacuuucc

SEQ ID NO: 770752 - RNA, 17 nt, Homo sapiens
ccuguguccagcagcug

SEQ ID NO: 770753 - RNA, 18 nt, Homo sapiens
ccuguguccgaugcugga

SEQ ID NO: 770754 - RNA, 16 nt, Homo sapiens
ccugugugcgugcgca

SEQ ID NO: 770755 - RNA, 14 nt, Homo sapiens
ccuguucacucuac

SEQ ID NO: 770756 - RNA, 12 nt, Homo sapiens
ccuguugaagcu

SEQ ID NO: 770757 - RNA, 22 nt, Homo sapiens
ccuguuuuaauucaacccagcc

SEQ ID NO: 770758 - RNA, 21 nt, Homo sapiens
ccuguuuuauaaugaacccau

SEQ ID NO: 770759 - RNA, 15 nt, Homo sapiens
ccuuaaaaaucacac

SEQ ID NO: 770760 - RNA, 15 nt, Homo sapiens
ccuuaaaacaauucu

SEQ ID NO: 770761 - RNA, 16 nt, Homo sapiens
ccuuaaaaccaaagag

SEQ ID NO: 770762 - RNA, 14 nt, Homo sapiens
ccuuaacauuucuc

SEQ ID NO: 770763 - RNA, 15 nt, Homo sapiens
ccuuaacgcuagaga

SEQ ID NO: 770764 - RNA, 19 nt, Homo sapiens
ccuuaagggguaucaugua

SEQ ID NO: 770765 - RNA, 17 nt, Homo sapiens
ccuuaagucaaaagaga

SEQ ID NO: 770766 - RNA, 18 nt, Homo sapiens
ccuuaauuauuaacaaag

SEQ ID NO: 770767 - RNA, 19 nt, Homo sapiens
ccuuaauuauuaacaaagu

SEQ ID NO: 770768 - RNA, 12 nt, Homo sapiens
ccuuacacugaa

SEQ ID NO: 770769 - RNA, 14 nt, Homo sapiens
ccuuacacugaaaa

SEQ ID NO: 770770 - RNA, 18 nt, Homo sapiens
ccuuacagaacuacuucu

SEQ ID NO: 770771 - RNA, 20 nt, Homo sapiens
ccuuacagaacuacuucuua

SEQ ID NO: 770772 - RNA, 17 nt, Homo sapiens
ccuuacagaggaccaug

SEQ ID NO: 770773 - RNA, 12 nt, Homo sapiens
ccuuacccaaac

SEQ ID NO: 770774 - RNA, 13 nt, Homo sapiens
ccuuacuccucuu

SEQ ID NO: 770775 - RNA, 19 nt, Homo sapiens
ccuuagaaaacaaguauug

SEQ ID NO: 770776 - RNA, 20 nt, Homo sapiens
ccuuagccaggaggccaggc

SEQ ID NO: 770777 - RNA, 22 nt, Homo sapiens
ccuuaguuacccugaucuggac

SEQ ID NO: 770778 - RNA, 12 nt, Homo sapiens
ccuuauaguguu

SEQ ID NO: 770779 - RNA, 13 nt, Homo sapiens
ccuuauggccaau

SEQ ID NO: 770780 - RNA, 16 nt, Homo sapiens
ccuuauucuacauuuc

SEQ ID NO: 770781 - RNA, 16 nt, Homo sapiens
ccuuauuguaccucuc

SEQ ID NO: 770782 - RNA, 16 nt, Homo sapiens
ccuuauuugcacuuca

SEQ ID NO: 770783 - RNA, 20 nt, Homo sapiens
ccuucaaaauaaaaaguaau

SEQ ID NO: 770784 - RNA, 22 nt, Homo sapiens
ccuucaaaauguucuauuuaac

SEQ ID NO: 770785 - RNA, 14 nt, Homo sapiens
ccuucaagugccaa

SEQ ID NO: 770786 - RNA, 15 nt, Homo sapiens
ccuucaagugccaaa

SEQ ID NO: 770787 - RNA, 16 nt, Homo sapiens
ccuucaagugccaaac

SEQ ID NO: 770788 - RNA, 15 nt, Homo sapiens
ccuucaauacuuaaa

SEQ ID NO: 770789 - RNA, 14 nt, Homo sapiens
ccuucacuuuacaa

SEQ ID NO: 770790 - RNA, 16 nt, Homo sapiens
ccuucagaaugcuccu

SEQ ID NO: 770791 - RNA, 21 nt, Homo sapiens
ccuucaguaaaugugauucac

SEQ ID NO: 770792 - RNA, 23 nt, Homo sapiens
ccuucaguuuguaaagucgguga

SEQ ID NO: 770793 - RNA, 20 nt, Homo sapiens
ccuucaucuucacugcaauu

SEQ ID NO: 770794 - RNA, 12 nt, Homo sapiens
ccuucaugcccu

SEQ ID NO: 770795 - RNA, 21 nt, Homo sapiens
ccuucauugccacacuuggug

SEQ ID NO: 770796 - RNA, 15 nt, Homo sapiens
ccuuccacaccccau

SEQ ID NO: 770797 - RNA, 13 nt, Homo sapiens
ccuuccaccucag

SEQ ID NO: 770798 - RNA, 16 nt, Homo sapiens
ccuuccacgucuuccu

SEQ ID NO: 770799 - RNA, 16 nt, Homo sapiens
ccuuccacucuggaac

SEQ ID NO: 770800 - RNA, 20 nt, Homo sapiens
ccuuccagaucacugccaca

SEQ ID NO: 770801 - RNA, 20 nt, Homo sapiens
ccuuccagcacccugcaaaa

SEQ ID NO: 770802 - RNA, 13 nt, Homo sapiens
ccuuccauuccac

SEQ ID NO: 770803 - RNA, 19 nt, Homo sapiens
ccuucccaaucagcacuga

SEQ ID NO: 770804 - RNA, 21 nt, Homo sapiens
ccuucccaaucagcacugaaa

SEQ ID NO: 770805 - RNA, 14 nt, Homo sapiens
ccuuccgaugacag

SEQ ID NO: 770806 - RNA, 15 nt, Homo sapiens
ccuuccucuuccugc

SEQ ID NO: 770807 - RNA, 18 nt, Homo sapiens
ccuuccuuaagccaggaa

SEQ ID NO: 770808 - RNA, 13 nt, Homo sapiens
ccuuccuuaccug

SEQ ID NO: 770809 - RNA, 20 nt, Homo sapiens
ccuuccuucuugcuucucau

SEQ ID NO: 770810 - RNA, 21 nt, Homo sapiens
ccuuccuuuaggucugguugu

SEQ ID NO: 770811 - RNA, 15 nt, Homo sapiens
ccuucgaguccagga

SEQ ID NO: 770812 - RNA, 17 nt, Homo sapiens
ccuucgcccugugcacc

SEQ ID NO: 770813 - RNA, 17 nt, Homo sapiens
ccuucguuaacugugua

SEQ ID NO: 770814 - RNA, 19 nt, Homo sapiens
ccuucuacauuugagggcc

SEQ ID NO: 770815 - RNA, 12 nt, Homo sapiens
ccuucuaccucu

SEQ ID NO: 770816 - RNA, 15 nt, Homo sapiens
ccuucuaggucacuu

SEQ ID NO: 770817 - RNA, 16 nt, Homo sapiens
ccuucuaguuaccaca

SEQ ID NO: 770818 - RNA, 15 nt, Homo sapiens
ccuucucaagacuuu

SEQ ID NO: 770819 - RNA, 16 nt, Homo sapiens
ccuucucaagacuuua

SEQ ID NO: 770820 - RNA, 18 nt, Homo sapiens
ccuucuccacacccacuu

SEQ ID NO: 770821 - RNA, 23 nt, Homo sapiens
ccuucugauugauggugcuauuu

SEQ ID NO: 770822 - RNA, 21 nt, Homo sapiens
ccuucuggacacugagagggc

SEQ ID NO: 770823 - RNA, 20 nt, Homo sapiens
ccuucuggccucugcugaau

SEQ ID NO: 770824 - RNA, 14 nt, Homo sapiens
ccuucuguggcuca

SEQ ID NO: 770825 - RNA, 17 nt, Homo sapiens
ccuucuuaaagccuuau

SEQ ID NO: 770826 - RNA, 21 nt, Homo sapiens
ccuucuucccucggggagcca

SEQ ID NO: 770827 - RNA, 14 nt, Homo sapiens
ccuucuugacauuu

SEQ ID NO: 770828 - RNA, 11 nt, Homo sapiens
ccuucuuucac

SEQ ID NO: 770829 - RNA, 19 nt, Homo sapiens
ccuucuuugcugcugcuuc

SEQ ID NO: 770830 - RNA, 13 nt, Homo sapiens
ccuugaagacaga

SEQ ID NO: 770831 - RNA, 22 nt, Homo sapiens
ccuugacguuucuucuuucuag

SEQ ID NO: 770832 - RNA, 18 nt, Homo sapiens
ccuugacuugaaaugcuc

SEQ ID NO: 770833 - RNA, 19 nt, Homo sapiens
ccuugacuugaaaugcucu

SEQ ID NO: 770834 - RNA, 17 nt, Homo sapiens
ccuugaggauuguggaa

SEQ ID NO: 770835 - RNA, 17 nt, Homo sapiens
ccuugaucuuaacaaag

SEQ ID NO: 770836 - RNA, 22 nt, Homo sapiens
ccuugauggagauauuuacaug

SEQ ID NO: 770837 - RNA, 15 nt, Homo sapiens
ccuugcagauaucug

SEQ ID NO: 770838 - RNA, 17 nt, Homo sapiens
ccuugcaggggccggag

SEQ ID NO: 770839 - RNA, 23 nt, Homo sapiens
ccuugcaggggccggaguaggag

SEQ ID NO: 770840 - RNA, 20 nt, Homo sapiens
ccuugcccagacuacagggc

SEQ ID NO: 770841 - RNA, 16 nt, Homo sapiens
aacuacuacuggugau

SEQ ID NO: 770842 - RNA, 17 nt, Homo sapiens
aacuacuucuuacuucu

SEQ ID NO: 770843 - RNA, 19 nt, Homo sapiens
aacuacuucuuacuucuuu

SEQ ID NO: 770844 - RNA, 13 nt, Homo sapiens
aacuagaagccua

SEQ ID NO: 770845 - RNA, 19 nt, Homo sapiens
aacuagaagccuagugugu

SEQ ID NO: 770846 - RNA, 21 nt, Homo sapiens
aacuagaaggcuucucuccac

SEQ ID NO: 770847 - RNA, 17 nt, Homo sapiens
aacuagaauuuauucaa

SEQ ID NO: 770848 - RNA, 19 nt, Homo sapiens
aacuagauaacauacuucu

SEQ ID NO: 770849 - RNA, 12 nt, Homo sapiens
aacuagccaaac

SEQ ID NO: 770850 - RNA, 18 nt, Homo sapiens
aacuagccaaaccaggac

SEQ ID NO: 770851 - RNA, 21 nt, Homo sapiens
aacuaggaaaaucacuugcca

SEQ ID NO: 770852 - RNA, 16 nt, Homo sapiens
aacuaguguugcuugg

SEQ ID NO: 770853 - RNA, 18 nt, Homo sapiens
aacuauaacaaucacugg

SEQ ID NO: 770854 - RNA, 14 nt, Homo sapiens
aacuauauucucag

SEQ ID NO: 770855 - RNA, 21 nt, Homo sapiens
aacuaugaucacagugacuuu

SEQ ID NO: 770856 - RNA, 18 nt, Homo sapiens
aacuaugcuuuagaacuu

SEQ ID NO: 770857 - RNA, 19 nt, Homo sapiens
aacuaugguucccaauaaa

SEQ ID NO: 770858 - RNA, 19 nt, Homo sapiens
aacuauugauaugugaaua

SEQ ID NO: 770859 - RNA, 19 nt, Homo sapiens
aacuauuucuacacagugg

SEQ ID NO: 770860 - RNA, 19 nt, Homo sapiens
aacuauuuucaaagacuua

SEQ ID NO: 770861 - RNA, 20 nt, Homo sapiens
aacucaaacgaugugcaaua

SEQ ID NO: 770862 - RNA, 21 nt, Homo sapiens
gcuccccacaccuuccagggc

SEQ ID NO: 770863 - RNA, 15 nt, Homo sapiens
gcuccccuguucaaa

SEQ ID NO: 770864 - RNA, 18 nt, Homo sapiens
gcucccgcccgugguguu

SEQ ID NO: 770865 - RNA, 21 nt, Homo sapiens
gcucccucuauuuauguuugc

SEQ ID NO: 770866 - RNA, 18 nt, Homo sapiens
gcucccugacagcaccug

SEQ ID NO: 770867 - RNA, 13 nt, Homo sapiens
gcuccuccaguga

SEQ ID NO: 770868 - RNA, 22 nt, Homo sapiens
gcuccuccccuuccucuugucu

SEQ ID NO: 770869 - RNA, 23 nt, Homo sapiens
gcuccuccucuuggagcugagau

SEQ ID NO: 770870 - RNA, 20 nt, Homo sapiens
gcuccuccuugcccagacua

SEQ ID NO: 770871 - RNA, 18 nt, Homo sapiens
gcuccugaauaucaguca

SEQ ID NO: 770872 - RNA, 15 nt, Homo sapiens
gcuccuggggcaaug

SEQ ID NO: 770873 - RNA, 13 nt, Homo sapiens
gcuccuuccagac

SEQ ID NO: 770874 - RNA, 21 nt, Homo sapiens
gcuccuuccuagccuugcacu

SEQ ID NO: 770875 - RNA, 17 nt, Homo sapiens
gcuccuuccugucuucc

SEQ ID NO: 770876 - RNA, 15 nt, Homo sapiens
gcucgagcaguccug

SEQ ID NO: 770877 - RNA, 15 nt, Homo sapiens
gcucuagauucauaa

SEQ ID NO: 770878 - RNA, 13 nt, Homo sapiens
gcucuaguucaaa

SEQ ID NO: 770879 - RNA, 13 nt, Homo sapiens
gcucuaucuuccu

SEQ ID NO: 770880 - RNA, 16 nt, Homo sapiens
gcucuauuaagauuuc

SEQ ID NO: 770881 - RNA, 19 nt, Homo sapiens
gcucucccaacucuugcac

SEQ ID NO: 770882 - RNA, 21 nt, Homo sapiens
gcucuccccaaacuugcuuua

SEQ ID NO: 770883 - RNA, 23 nt, Homo sapiens
gcucuccccaaacuugcuuuaug

SEQ ID NO: 770884 - RNA, 23 nt, Homo sapiens
gcucuccccaggcauuugccaag

SEQ ID NO: 770885 - RNA, 17 nt, Homo sapiens
gcucuccuccaccucaa

SEQ ID NO: 770886 - RNA, 13 nt, Homo sapiens
gcucuccuugcac

SEQ ID NO: 770887 - RNA, 16 nt, Homo sapiens
gcucucgcacaccucu

SEQ ID NO: 770888 - RNA, 12 nt, Homo sapiens
gcucucucugag

SEQ ID NO: 770889 - RNA, 21 nt, Homo sapiens
gcucucugacgcuugugacag

SEQ ID NO: 770890 - RNA, 13 nt, Homo sapiens
gcucucuguggug

SEQ ID NO: 770891 - RNA, 16 nt, Homo sapiens
gcucucuguggugaga

SEQ ID NO: 770892 - RNA, 20 nt, Homo sapiens
gcucugagaaaccucgggaa

SEQ ID NO: 770893 - RNA, 23 nt, Homo sapiens
gcucugagacccuuuucucagga

SEQ ID NO: 770894 - RNA, 22 nt, Homo sapiens
gcucugaggggaggcaccucca

SEQ ID NO: 770895 - RNA, 23 nt, Homo sapiens
gcucugcagcgagccccccaugu

SEQ ID NO: 770896 - RNA, 19 nt, Homo sapiens
gcucugcccccucccccau

SEQ ID NO: 770897 - RNA, 14 nt, Homo sapiens
gcucugcuugacaa

SEQ ID NO: 770898 - RNA, 10 nt, Homo sapiens
gcucugggaa

SEQ ID NO: 770899 - RNA, 19 nt, Homo sapiens
gcucugggagacuuugaag

SEQ ID NO: 770900 - RNA, 19 nt, Homo sapiens
gcucuggugcugcaguaug

SEQ ID NO: 770901 - RNA, 16 nt, Homo sapiens
gcucugguugaagcuu

SEQ ID NO: 770902 - RNA, 23 nt, Homo sapiens
gcucuguaguuuaugaugcaaau

SEQ ID NO: 770903 - RNA, 15 nt, Homo sapiens
gcucuguauuaaucc

SEQ ID NO: 770904 - RNA, 20 nt, Homo sapiens
gcucugucuucuuugcccac

SEQ ID NO: 770905 - RNA, 13 nt, Homo sapiens
gcucugugccuug

SEQ ID NO: 770906 - RNA, 14 nt, Homo sapiens
gcucugugccuugg

SEQ ID NO: 770907 - RNA, 18 nt, Homo sapiens
gcucuuaugugugccuuu

SEQ ID NO: 770908 - RNA, 20 nt, Homo sapiens
gcucuucaaaauaaaacauc

SEQ ID NO: 770909 - RNA, 13 nt, Homo sapiens
gcucuucauuuau

SEQ ID NO: 770910 - RNA, 21 nt, Homo sapiens
gcucuucuguggaccacugca

SEQ ID NO: 770911 - RNA, 11 nt, Homo sapiens
gcucuugcccu

SEQ ID NO: 770912 - RNA, 22 nt, Homo sapiens
gcucuugcucagugaagaggaa

SEQ ID NO: 770913 - RNA, 17 nt, Homo sapiens
gcucuuguucuacugag

SEQ ID NO: 770914 - RNA, 21 nt, Homo sapiens
gcucuuucagaacaaacauua

SEQ ID NO: 770915 - RNA, 13 nt, Homo sapiens
gcucuuucagaga

SEQ ID NO: 770916 - RNA, 18 nt, Homo sapiens
gcucuuucccuuuaucag

SEQ ID NO: 770917 - RNA, 17 nt, Homo sapiens
gcucuuuucaaugaaua

SEQ ID NO: 770918 - RNA, 14 nt, Homo sapiens
gcucuuuugcacaa

SEQ ID NO: 770919 - RNA, 17 nt, Homo sapiens
gcucuuuuguguagcuc

SEQ ID NO: 770920 - RNA, 22 nt, Homo sapiens
gcugaaaaaacaccuagcuuua

SEQ ID NO: 770921 - RNA, 19 nt, Homo sapiens
gcugaaaaaucauccaaga

SEQ ID NO: 770922 - RNA, 14 nt, Homo sapiens
gcugaaaaugcaaa

SEQ ID NO: 770923 - RNA, 22 nt, Homo sapiens
gcugaaauuuuagaaauauuca

SEQ ID NO: 770924 - RNA, 12 nt, Homo sapiens
gcugaacacugg

SEQ ID NO: 770925 - RNA, 18 nt, Homo sapiens
gcugaacugacaaugaag

SEQ ID NO: 770926 - RNA, 13 nt, Homo sapiens
gcugaacuggauu

SEQ ID NO: 770927 - RNA, 14 nt, Homo sapiens
gcugaagugucaca

SEQ ID NO: 770928 - RNA, 16 nt, Homo sapiens
gcugaauuucaggcau

SEQ ID NO: 770929 - RNA, 20 nt, Homo sapiens
gcugaauuucccucucucau

SEQ ID NO: 770930 - RNA, 19 nt, Homo sapiens
gcugacaguuuguggcauc

SEQ ID NO: 770931 - RNA, 14 nt, Homo sapiens
gcugacaucuugaa

SEQ ID NO: 770932 - RNA, 21 nt, Homo sapiens
gcugagaauguggaauaccua

SEQ ID NO: 770933 - RNA, 21 nt, Homo sapiens
gcugaggcaggaggaucgccu

SEQ ID NO: 770934 - RNA, 19 nt, Homo sapiens
gcugaggccacccacugac

SEQ ID NO: 770935 - RNA, 17 nt, Homo sapiens
gcugaggcccagugcau

SEQ ID NO: 770936 - RNA, 18 nt, Homo sapiens
gcugaggccucucauucc

SEQ ID NO: 770937 - RNA, 21 nt, Homo sapiens
gcugaggggaggaucacugga

SEQ ID NO: 770938 - RNA, 20 nt, Homo sapiens
gcugaguccagagcuugugc

SEQ ID NO: 770939 - RNA, 12 nt, Homo sapiens
gcugagugacac

SEQ ID NO: 770940 - RNA, 13 nt, Homo sapiens
gcugaguguccag

SEQ ID NO: 770941 - RNA, 23 nt, Homo sapiens
gcugaguuuauuaguacaugggc

SEQ ID NO: 770942 - RNA, 22 nt, Homo sapiens
gcugaguuucucuuggguauaa

SEQ ID NO: 770943 - RNA, 21 nt, Homo sapiens
gcugaugaacucuuaaucaaa

SEQ ID NO: 770944 - RNA, 18 nt, Homo sapiens
gcugauggguaguaccug

SEQ ID NO: 770945 - RNA, 15 nt, Homo sapiens
gcugcacauugccug

SEQ ID NO: 770946 - RNA, 23 nt, Homo sapiens
gcugcacauugccuguucugcuu

SEQ ID NO: 770947 - RNA, 16 nt, Homo sapiens
gcugcaccccaugugg

SEQ ID NO: 770948 - RNA, 16 nt, Homo sapiens
gcugcaccuggucaua

SEQ ID NO: 770949 - RNA, 12 nt, Homo sapiens
gcugcacugcau

SEQ ID NO: 770950 - RNA, 22 nt, Homo sapiens
gcugcagccucccuuccaugcc

SEQ ID NO: 770951 - RNA, 23 nt, Homo sapiens
gcugcagcucccauuucaucagc

SEQ ID NO: 770952 - RNA, 20 nt, Homo sapiens
gcugcagcugggccccaugc

SEQ ID NO: 770953 - RNA, 12 nt, Homo sapiens
gcugcagcugug

SEQ ID NO: 770954 - RNA, 17 nt, Homo sapiens
gcugcaggacuugagaa

SEQ ID NO: 770955 - RNA, 21 nt, Homo sapiens
gcuucagcccccaccagggga

SEQ ID NO: 770956 - RNA, 13 nt, Homo sapiens
gcuucagugaaau

SEQ ID NO: 770957 - RNA, 13 nt, Homo sapiens
gcuucagugacaa

SEQ ID NO: 770958 - RNA, 14 nt, Homo sapiens
gcuucagugcagug

SEQ ID NO: 770959 - RNA, 15 nt, Homo sapiens
gcuucaguucagcuu

SEQ ID NO: 770960 - RNA, 20 nt, Homo sapiens
gcuucauaaaugaagcagcu

SEQ ID NO: 770961 - RNA, 16 nt, Homo sapiens
gcuucauauaccagca

SEQ ID NO: 770962 - RNA, 22 nt, Homo sapiens
gcuuccaaaagugauagugugu

SEQ ID NO: 770963 - RNA, 15 nt, Homo sapiens
gcuucccuaaucuau

SEQ ID NO: 770964 - RNA, 19 nt, Homo sapiens
gcuucccuaaucuaugguc

SEQ ID NO: 770965 - RNA, 19 nt, Homo sapiens
gcuucccucuucugugguc

SEQ ID NO: 770966 - RNA, 23 nt, Homo sapiens
gcuuccgcccccggauuugcuca

SEQ ID NO: 770967 - RNA, 19 nt, Homo sapiens
gcuuccucuagaagccaag

SEQ ID NO: 770968 - RNA, 19 nt, Homo sapiens
gcuuccugaugcugggcaa

SEQ ID NO: 770969 - RNA, 21 nt, Homo sapiens
gcuuccugucccacuacugua

SEQ ID NO: 770970 - RNA, 18 nt, Homo sapiens
gcuucgucuacuccuuuc

SEQ ID NO: 770971 - RNA, 13 nt, Homo sapiens
gcuucuaacucau

SEQ ID NO: 770972 - RNA, 14 nt, Homo sapiens
gcuucuaccuggaa

SEQ ID NO: 770973 - RNA, 17 nt, Homo sapiens
gcuucuaugguugacau

SEQ ID NO: 770974 - RNA, 12 nt, Homo sapiens
gcuucucaaagu

SEQ ID NO: 770975 - RNA, 13 nt, Homo sapiens
gcuucuccugacc

SEQ ID NO: 770976 - RNA, 22 nt, Homo sapiens
aacuuucauuuuuuuccaggcu

SEQ ID NO: 770977 - RNA, 17 nt, Homo sapiens
aacuuugacuuugccca

SEQ ID NO: 770978 - RNA, 15 nt, Homo sapiens
aacuuuguaugucau

SEQ ID NO: 770979 - RNA, 16 nt, Homo sapiens
aacuuuucgacauauu

SEQ ID NO: 770980 - RNA, 17 nt, Homo sapiens
aacuuuucgacauauuu

SEQ ID NO: 770981 - RNA, 18 nt, Homo sapiens
aacuuuucuaacagaaag

SEQ ID NO: 770982 - RNA, 16 nt, Homo sapiens
aacuuuugugcucccc

SEQ ID NO: 770983 - RNA, 14 nt, Homo sapiens
aagaaaaaaucugc

SEQ ID NO: 770984 - RNA, 16 nt, Homo sapiens
aagaaaaacaccgcuu

SEQ ID NO: 770985 - RNA, 21 nt, Homo sapiens
aagaaaaacaccgcuucugcc

SEQ ID NO: 770986 - RNA, 18 nt, Homo sapiens
aagaaaaacaucuuuggc

SEQ ID NO: 770987 - RNA, 23 nt, Homo sapiens
aagaaaaagaccuaugagcacau

SEQ ID NO: 770988 - RNA, 14 nt, Homo sapiens
aagaaaaauaucuu

SEQ ID NO: 770989 - RNA, 21 nt, Homo sapiens
aagaaaacacuguuaucauuu

SEQ ID NO: 770990 - RNA, 12 nt, Homo sapiens
aagaaaacugau

SEQ ID NO: 770991 - RNA, 15 nt, Homo sapiens
aagaaaagcauucaa

SEQ ID NO: 770992 - RNA, 17 nt, Homo sapiens
aagaaaagcauuuucag

SEQ ID NO: 770993 - RNA, 21 nt, Homo sapiens
aagaaaagccugaacuauuua

SEQ ID NO: 770994 - RNA, 19 nt, Homo sapiens
aagaaaauauauucuuuca

SEQ ID NO: 770995 - RNA, 19 nt, Homo sapiens
aagaaaaucacauuuccag

SEQ ID NO: 770996 - RNA, 14 nt, Homo sapiens
aagaaaaugagaca

SEQ ID NO: 770997 - RNA, 13 nt, Homo sapiens
aagaaaauggauu

SEQ ID NO: 770998 - RNA, 12 nt, Homo sapiens
aagaaacauaac

SEQ ID NO: 770999 - RNA, 22 nt, Homo sapiens
aagaaaccccuguccccaguca

SEQ ID NO: 771000 - RNA, 23 nt, Homo sapiens
aagaaaccccuguccccagucag

SEQ ID NO: 771001 - RNA, 17 nt, Homo sapiens
aagaaacuuauuucuca

SEQ ID NO: 771002 - RNA, 23 nt, Homo sapiens
aagaaacuuauuucucauaucaa

SEQ ID NO: 771003 - RNA, 14 nt, Homo sapiens
aagaaagaucaaag

SEQ ID NO: 771004 - RNA, 15 nt, Homo sapiens
aagaaagaucaaaga

SEQ ID NO: 771005 - RNA, 14 nt, Homo sapiens
aagaaagauuacuu

SEQ ID NO: 771006 - RNA, 14 nt, Homo sapiens
aagaaagccuaaaa

SEQ ID NO: 771007 - RNA, 16 nt, Homo sapiens
aagaaagcugagaaga

SEQ ID NO: 771008 - RNA, 12 nt, Homo sapiens
aagaaaguguau

SEQ ID NO: 771009 - RNA, 14 nt, Homo sapiens
aagaaauaagcaug

SEQ ID NO: 771010 - RNA, 15 nt, Homo sapiens
aagaaaucccugaga

SEQ ID NO: 771011 - RNA, 17 nt, Homo sapiens
aagaaaugcccaaaaga

SEQ ID NO: 771012 - RNA, 14 nt, Homo sapiens
aagaacacaugugc

SEQ ID NO: 771013 - RNA, 19 nt, Homo sapiens
aagaacacaugugcaguca

SEQ ID NO: 771014 - RNA, 13 nt, Homo sapiens
aagaacacccucu

SEQ ID NO: 771015 - RNA, 20 nt, Homo sapiens
aagaacaguaacugccauca

SEQ ID NO: 771016 - RNA, 18 nt, Homo sapiens
aagaacauggacuuguau

SEQ ID NO: 771017 - RNA, 12 nt, Homo sapiens
aagaaccuggaa

SEQ ID NO: 771018 - RNA, 16 nt, Homo sapiens
aagaaccuugccugaa

SEQ ID NO: 771019 - RNA, 13 nt, Homo sapiens
aagaacugugaua

SEQ ID NO: 771020 - RNA, 18 nt, Homo sapiens
aagaagacucaguaugcu

SEQ ID NO: 771021 - RNA, 21 nt, Homo sapiens
aagaagacuguugccacuuaa

SEQ ID NO: 771022 - RNA, 22 nt, Homo sapiens
aagaagagcgagagaucaaaga

SEQ ID NO: 771023 - RNA, 23 nt, Homo sapiens
aagaagagggucugcauuuuccu

SEQ ID NO: 771024 - RNA, 20 nt, Homo sapiens
aagaagaguuucuccuuuug

SEQ ID NO: 771025 - RNA, 18 nt, Homo sapiens
aagaagcccauaucacau

SEQ ID NO: 771026 - RNA, 14 nt, Homo sapiens
aagaagcgagaugu

SEQ ID NO: 771027 - RNA, 18 nt, Homo sapiens
aagaagcguuaugugcag

SEQ ID NO: 771028 - RNA, 12 nt, Homo sapiens
aagaagcucucc

SEQ ID NO: 771029 - RNA, 13 nt, Homo sapiens
aagaagcucucca

SEQ ID NO: 771030 - RNA, 21 nt, Homo sapiens
aagaaggaauucuaggcaucc

SEQ ID NO: 771031 - RNA, 20 nt, Homo sapiens
aagaaggacugaacuccauc

SEQ ID NO: 771032 - RNA, 24 nt, Homo sapiens
aagaaggcaauuuuaguguauuaa

SEQ ID NO: 771033 - RNA, 19 nt, Homo sapiens
aagaaguguccgagaacua

SEQ ID NO: 771034 - RNA, 21 nt, Homo sapiens
aagaaguugcuaagugugcuu

SEQ ID NO: 771035 - RNA, 13 nt, Homo sapiens
aagaauaauucaa

SEQ ID NO: 771036 - RNA, 13 nt, Homo sapiens
aagaauacacaau

SEQ ID NO: 771037 - RNA, 16 nt, Homo sapiens
aagaauacacugugac

SEQ ID NO: 771038 - RNA, 19 nt, Homo sapiens
aagaauacacugugacuua

SEQ ID NO: 771039 - RNA, 22 nt, Homo sapiens
aagaauacacugugacuuaaga

SEQ ID NO: 771040 - RNA, 13 nt, Homo sapiens
aagaauacagaaa

SEQ ID NO: 771041 - RNA, 17 nt, Homo sapiens
aagaauagcugcuuccg

SEQ ID NO: 771042 - RNA, 19 nt, Homo sapiens
aagaauauuccauuuuccu

SEQ ID NO: 771043 - RNA, 16 nt, Homo sapiens
aagaaucacuugaacc

SEQ ID NO: 771044 - RNA, 13 nt, Homo sapiens
aagaaucagucuu

SEQ ID NO: 771045 - RNA, 14 nt, Homo sapiens
aagaaucagucuug

SEQ ID NO: 771046 - RNA, 21 nt, Homo sapiens
aagaaucuaaaccuuacaugu

SEQ ID NO: 771047 - RNA, 23 nt, Homo sapiens
aagaaucuaaaccuuacaugugu

SEQ ID NO: 771048 - RNA, 18 nt, Homo sapiens
aagaaucuagaagaugug

SEQ ID NO: 771049 - RNA, 22 nt, Homo sapiens
aagaaucuucugccccagcuuu

SEQ ID NO: 771050 - RNA, 16 nt, Homo sapiens
aagaaugaacacuccc

SEQ ID NO: 771051 - RNA, 23 nt, Homo sapiens
aagaaugagacugaacuguguga

SEQ ID NO: 771052 - RNA, 16 nt, Homo sapiens
aagaaugcaauaucau

SEQ ID NO: 771053 - RNA, 13 nt, Homo sapiens
aagaauggcuuuc

SEQ ID NO: 771054 - RNA, 15 nt, Homo sapiens
aagaauggcuuucaa

SEQ ID NO: 771055 - RNA, 17 nt, Homo sapiens
aagaauguccauggugg

SEQ ID NO: 771056 - RNA, 17 nt, Homo sapiens
aagaauguuaugugcaa

SEQ ID NO: 771057 - RNA, 22 nt, Homo sapiens
aagaauguuuggcacucucuaa

SEQ ID NO: 771058 - RNA, 23 nt, Homo sapiens
aagaauuaaugacuuacuuuaau

SEQ ID NO: 771059 - RNA, 21 nt, Homo sapiens
aagaauuauuuuauacacaga

SEQ ID NO: 771060 - RNA, 13 nt, Homo sapiens
aagaauuccacca

SEQ ID NO: 771061 - RNA, 14 nt, Homo sapiens
aagacaaacacugc

SEQ ID NO: 771062 - RNA, 18 nt, Homo sapiens
aagacaacagcauaacua

SEQ ID NO: 771063 - RNA, 13 nt, Homo sapiens
aagacaagcauuu

SEQ ID NO: 771064 - RNA, 22 nt, Homo sapiens
aagacaaggcuggcaaacccuc

SEQ ID NO: 771065 - RNA, 21 nt, Homo sapiens
aagacaauuugauacauaaua

SEQ ID NO: 771066 - RNA, 14 nt, Homo sapiens
aagacacagacugc

SEQ ID NO: 771067 - RNA, 11 nt, Homo sapiens
aagacagagca

SEQ ID NO: 771068 - RNA, 16 nt, Homo sapiens
aagacagaugccccag

SEQ ID NO: 771069 - RNA, 13 nt, Homo sapiens
aagacaguguaca

SEQ ID NO: 771070 - RNA, 16 nt, Homo sapiens
aauugcauuucugcuc

SEQ ID NO: 771071 - RNA, 18 nt, Homo sapiens
aauugccuguaacacaua

SEQ ID NO: 771072 - RNA, 17 nt, Homo sapiens
aauugcuggaugcauuu

SEQ ID NO: 771073 - RNA, 21 nt, Homo sapiens
aauugcuuugccaaaauacca

SEQ ID NO: 771074 - RNA, 13 nt, Homo sapiens
aauuggacagauu

SEQ ID NO: 771075 - RNA, 17 nt, Homo sapiens
aauuggccgcugucacu

SEQ ID NO: 771076 - RNA, 20 nt, Homo sapiens
aauugggcuucaaucacugu

SEQ ID NO: 771077 - RNA, 19 nt, Homo sapiens
aauuggggggaggugcugu

SEQ ID NO: 771078 - RNA, 13 nt, Homo sapiens
aauugggugugua

SEQ ID NO: 771079 - RNA, 23 nt, Homo sapiens
aauugguaaaaacagcagcucau

SEQ ID NO: 771080 - RNA, 23 nt, Homo sapiens
aauuguaacgacuucuccaucuc

SEQ ID NO: 771081 - RNA, 19 nt, Homo sapiens
aauuguacaaaauuaagca

SEQ ID NO: 771082 - RNA, 13 nt, Homo sapiens
aauuguacaauaa

SEQ ID NO: 771083 - RNA, 13 nt, Homo sapiens
aauuguacugaau

SEQ ID NO: 771084 - RNA, 14 nt, Homo sapiens
aauuguauaaguca

SEQ ID NO: 771085 - RNA, 18 nt, Homo sapiens
aauugucaaagacuguau

SEQ ID NO: 771086 - RNA, 21 nt, Homo sapiens
aauugucauuuauaaaaccau

SEQ ID NO: 771087 - RNA, 13 nt, Homo sapiens
aauuguccguguu

SEQ ID NO: 771088 - RNA, 14 nt, Homo sapiens
aauugugauuagac

SEQ ID NO: 771089 - RNA, 16 nt, Homo sapiens
aauugugcaguacuuu

SEQ ID NO: 771090 - RNA, 14 nt, Homo sapiens
aauugugugugcaa

SEQ ID NO: 771091 - RNA, 12 nt, Homo sapiens
aauuguguuucc

SEQ ID NO: 771092 - RNA, 21 nt, Homo sapiens
aauuguugacaguucugaaga

SEQ ID NO: 771093 - RNA, 11 nt, Homo sapiens
aauuguugcua

SEQ ID NO: 771094 - RNA, 21 nt, Homo sapiens
aauuguuucuugacaagcuga

SEQ ID NO: 771095 - RNA, 19 nt, Homo sapiens
gguuuguuauaucagggaa

SEQ ID NO: 771096 - RNA, 18 nt, Homo sapiens
gguuuuauuucaaaggga

SEQ ID NO: 771097 - RNA, 21 nt, Homo sapiens
gguuuuuccuacuguccucag

SEQ ID NO: 771098 - RNA, 15 nt, Homo sapiens
gguuuuuucaauuua

SEQ ID NO: 771099 - RNA, 17 nt, Homo sapiens
gguuuuuuccuuucauu

SEQ ID NO: 771100 - RNA, 18 nt, Homo sapiens
guaaaaaugcugcucuca

SEQ ID NO: 771101 - RNA, 12 nt, Homo sapiens
guaaaacagagc

SEQ ID NO: 771102 - RNA, 12 nt, Homo sapiens
guaaaacagggc

SEQ ID NO: 771103 - RNA, 22 nt, Homo sapiens
guaaaacauaauguaucaugaa

SEQ ID NO: 771104 - RNA, 16 nt, Homo sapiens
guaaaaccacagcagu

SEQ ID NO: 771105 - RNA, 21 nt, Homo sapiens
guaaaaccccaucucuacuaa

SEQ ID NO: 771106 - RNA, 12 nt, Homo sapiens
guaaaacuuugg

SEQ ID NO: 771107 - RNA, 13 nt, Homo sapiens
guaaaagugcuuu

SEQ ID NO: 771108 - RNA, 13 nt, Homo sapiens
guaaaauauuuau

SEQ ID NO: 771109 - RNA, 15 nt, Homo sapiens
guaaaauguucucuu

SEQ ID NO: 771110 - RNA, 18 nt, Homo sapiens
guaaaauguuuuagcaau

SEQ ID NO: 771111 - RNA, 13 nt, Homo sapiens
guaaaauugaaag

SEQ ID NO: 771112 - RNA, 14 nt, Homo sapiens
guaaacaaaccaca

SEQ ID NO: 771113 - RNA, 17 nt, Homo sapiens
guaaacaaauucuuuca

SEQ ID NO: 771114 - RNA, 13 nt, Homo sapiens
guaaacauuuuaa

SEQ ID NO: 771115 - RNA, 15 nt, Homo sapiens
guaaacuaugaccua

SEQ ID NO: 771116 - RNA, 13 nt, Homo sapiens
guaaagauuuguu

SEQ ID NO: 771117 - RNA, 22 nt, Homo sapiens
guaaagcauuagaagucuuccc

SEQ ID NO: 771118 - RNA, 20 nt, Homo sapiens
guaaagccguuguuuacuua

SEQ ID NO: 771119 - RNA, 14 nt, Homo sapiens
guaaaggaggaaua

SEQ ID NO: 771120 - RNA, 15 nt, Homo sapiens
guaaaggauauuaaa

SEQ ID NO: 771121 - RNA, 22 nt, Homo sapiens
guaaagguuuuuggaauuaugu

SEQ ID NO: 771122 - RNA, 12 nt, Homo sapiens
guaaagugcuua

SEQ ID NO: 771123 - RNA, 22 nt, Homo sapiens
guaaauaaaugugaaacaucuu

SEQ ID NO: 771124 - RNA, 13 nt, Homo sapiens
guaaauacaggua

SEQ ID NO: 771125 - RNA, 21 nt, Homo sapiens
guaaaucaauuacagauuaaa

SEQ ID NO: 771126 - RNA, 23 nt, Homo sapiens
guaaauccugagcucaaaucucu

SEQ ID NO: 771127 - RNA, 23 nt, Homo sapiens
guaaauccuuuuggaacauauag

SEQ ID NO: 771128 - RNA, 11 nt, Homo sapiens
guaaaugccuc

SEQ ID NO: 771129 - RNA, 20 nt, Homo sapiens
guaaaugcuagguuaauucc

SEQ ID NO: 771130 - RNA, 14 nt, Homo sapiens
guaaaugguguaca

SEQ ID NO: 771131 - RNA, 21 nt, Homo sapiens
guaaaugguguacauaaugua

SEQ ID NO: 771132 - RNA, 16 nt, Homo sapiens
guaaauguacugguaa

SEQ ID NO: 771133 - RNA, 18 nt, Homo sapiens
guaacaacuguggucaau

SEQ ID NO: 771134 - RNA, 19 nt, Homo sapiens
guaacaacuguggucaauc

SEQ ID NO: 771135 - RNA, 17 nt, Homo sapiens
guaacaauacaaaugga

SEQ ID NO: 771136 - RNA, 16 nt, Homo sapiens
guaacauacauauucc

SEQ ID NO: 771137 - RNA, 16 nt, Homo sapiens
guaacauccaagccag

SEQ ID NO: 771138 - RNA, 20 nt, Homo sapiens
guaacccgcucaucacugga

SEQ ID NO: 771139 - RNA, 11 nt, Homo sapiens
guaacuacuuc

SEQ ID NO: 771140 - RNA, 16 nt, Homo sapiens
guaacuccaccaaccc

SEQ ID NO: 771141 - RNA, 19 nt, Homo sapiens
guaacuccagcucugcucc

SEQ ID NO: 771142 - RNA, 19 nt, Homo sapiens
guaacuccccucagggaua

SEQ ID NO: 771143 - RNA, 16 nt, Homo sapiens
guaacuggcaguuuuc

SEQ ID NO: 771144 - RNA, 18 nt, Homo sapiens
guaacugguaguguucag

SEQ ID NO: 771145 - RNA, 20 nt, Homo sapiens
guaacuuauuuuaaauaugc

SEQ ID NO: 771146 - RNA, 22 nt, Homo sapiens
guaacuuccugcugcacccugc

SEQ ID NO: 771147 - RNA, 15 nt, Homo sapiens
guaagaaguuuuaaa

SEQ ID NO: 771148 - RNA, 15 nt, Homo sapiens
guaagacgaaugauu

SEQ ID NO: 771149 - RNA, 20 nt, Homo sapiens
guaagauguccuccuugaua

SEQ ID NO: 771150 - RNA, 19 nt, Homo sapiens
guaagauuuuccauuguau

SEQ ID NO: 771151 - RNA, 15 nt, Homo sapiens
guaagcgauuugaaa

SEQ ID NO: 771152 - RNA, 17 nt, Homo sapiens
guaagcuaucugugcag

SEQ ID NO: 771153 - RNA, 20 nt, Homo sapiens
guaaguaccacucaggccaa

SEQ ID NO: 771154 - RNA, 14 nt, Homo sapiens
guaaguacuuccac

SEQ ID NO: 771155 - RNA, 19 nt, Homo sapiens
guaaguuauagaagagaaa

SEQ ID NO: 771156 - RNA, 16 nt, Homo sapiens
guaaguuccuacuagg

SEQ ID NO: 771157 - RNA, 20 nt, Homo sapiens
guaauaaaagugguuugugg

SEQ ID NO: 771158 - RNA, 15 nt, Homo sapiens
guaauaacuucucug

SEQ ID NO: 771159 - RNA, 16 nt, Homo sapiens
guaauaccugauugau

SEQ ID NO: 771160 - RNA, 18 nt, Homo sapiens
guaauaccugauugauca

SEQ ID NO: 771161 - RNA, 19 nt, Homo sapiens
guaauacguagcucucuua

SEQ ID NO: 771162 - RNA, 23 nt, Homo sapiens
guaauaguucuauccuuuugccu

SEQ ID NO: 771163 - RNA, 19 nt, Homo sapiens
guaauauaguuauugcaca

SEQ ID NO: 771164 - RNA, 16 nt, Homo sapiens
guaaucaagggucauu

SEQ ID NO: 771165 - RNA, 15 nt, Homo sapiens
guaaucagauuuauu

SEQ ID NO: 771166 - RNA, 22 nt, Homo sapiens
guaaucagcaauaaaaauccua

SEQ ID NO: 771167 - RNA, 16 nt, Homo sapiens
guaaucaucuaaguca

SEQ ID NO: 771168 - RNA, 19 nt, Homo sapiens
guaauccaggcacagcuga

SEQ ID NO: 771169 - RNA, 16 nt, Homo sapiens
guaaucccagcacuuu

SEQ ID NO: 771170 - RNA, 18 nt, Homo sapiens
guaaucccagcuacucag

SEQ ID NO: 771171 - RNA, 14 nt, Homo sapiens
guaauccuauuaaa

SEQ ID NO: 771172 - RNA, 17 nt, Homo sapiens
guaaucuacaaaggaaa

SEQ ID NO: 771173 - RNA, 12 nt, Homo sapiens
guaaucuacacc

SEQ ID NO: 771174 - RNA, 15 nt, Homo sapiens
guaaucucagcacuu

SEQ ID NO: 771175 - RNA, 12 nt, Homo sapiens
guaaucucugau

SEQ ID NO: 771176 - RNA, 17 nt, Homo sapiens
guaaucuuuggcuguaa

SEQ ID NO: 771177 - RNA, 17 nt, Homo sapiens
guaaugaaggacaguga

SEQ ID NO: 771178 - RNA, 20 nt, Homo sapiens
guaauuaaguacuauguauc

SEQ ID NO: 771179 - RNA, 19 nt, Homo sapiens
guaauuuauauuccauuua

SEQ ID NO: 771180 - RNA, 19 nt, Homo sapiens
guaauuuauuaacuaauca

SEQ ID NO: 771181 - RNA, 16 nt, Homo sapiens
guaauuucgccuuaaa

SEQ ID NO: 771182 - RNA, 15 nt, Homo sapiens
guaauuuugauuucu

SEQ ID NO: 771183 - RNA, 19 nt, Homo sapiens
guacaaaaaaaaaguuuua

SEQ ID NO: 771184 - RNA, 16 nt, Homo sapiens
guacaaaacucuguau

SEQ ID NO: 771185 - RNA, 21 nt, Homo sapiens
acaauugucgaaaagagucuu

SEQ ID NO: 771186 - RNA, 16 nt, Homo sapiens
acaauuugauacauaa

SEQ ID NO: 771187 - RNA, 22 nt, Homo sapiens
acaauuuggagcauaacuggag

SEQ ID NO: 771188 - RNA, 18 nt, Homo sapiens
acaauuuuaaaguucuua

SEQ ID NO: 771189 - RNA, 16 nt, Homo sapiens
acaauuuucuguaaga

SEQ ID NO: 771190 - RNA, 15 nt, Homo sapiens
acacaaaacucucug

SEQ ID NO: 771191 - RNA, 21 nt, Homo sapiens
acacaaagcuguugaaauauu

SEQ ID NO: 771192 - RNA, 23 nt, Homo sapiens
acacaaaggaaguccaaccugag

SEQ ID NO: 771193 - RNA, 16 nt, Homo sapiens
acacaacacugaugug

SEQ ID NO: 771194 - RNA, 20 nt, Homo sapiens
acacaaggauagaugcuggc

SEQ ID NO: 771195 - RNA, 16 nt, Homo sapiens
acacaauccuccaaga

SEQ ID NO: 771196 - RNA, 14 nt, Homo sapiens
acacacacaucuca

SEQ ID NO: 771197 - RNA, 20 nt, Homo sapiens
acacacagacuuucugugac

SEQ ID NO: 771198 - RNA, 21 nt, Homo sapiens
acacacccacuaaggagaaag

SEQ ID NO: 771199 - RNA, 20 nt, Homo sapiens
acacacgcacacaaaccaca

SEQ ID NO: 771200 - RNA, 16 nt, Homo sapiens
acacacucaaaucaag

SEQ ID NO: 771201 - RNA, 18 nt, Homo sapiens
acacacuccauagauccc

SEQ ID NO: 771202 - RNA, 14 nt, Homo sapiens
acacacuggccauu

SEQ ID NO: 771203 - RNA, 13 nt, Homo sapiens
acacacuuuccau

SEQ ID NO: 771204 - RNA, 17 nt, Homo sapiens
acacacuuuccaucucu

SEQ ID NO: 771205 - RNA, 17 nt, Homo sapiens
acacagcaacaaugacu

SEQ ID NO: 771206 - RNA, 14 nt, Homo sapiens
acacagcacucucu

SEQ ID NO: 771207 - RNA, 17 nt, Homo sapiens
acacagcaugugccaag

SEQ ID NO: 771208 - RNA, 14 nt, Homo sapiens
acacagcauuguau

SEQ ID NO: 771209 - RNA, 22 nt, Homo sapiens
acacagcccgaggaaucaacaa

SEQ ID NO: 771210 - RNA, 16 nt, Homo sapiens
acacagccuauaucaa

SEQ ID NO: 771211 - RNA, 18 nt, Homo sapiens
guaugucuuuaucaaagg

SEQ ID NO: 771212 - RNA, 14 nt, Homo sapiens
guaugugcuguaau

SEQ ID NO: 771213 - RNA, 11 nt, Homo sapiens
guauguuaaag

SEQ ID NO: 771214 - RNA, 14 nt, Homo sapiens
guauguugccuuua

SEQ ID NO: 771215 - RNA, 15 nt, Homo sapiens
guauuaaacucuaau

SEQ ID NO: 771216 - RNA, 18 nt, Homo sapiens
guauuaaucaacauugua

SEQ ID NO: 771217 - RNA, 21 nt, Homo sapiens
guauuaccuccccuacucccu

SEQ ID NO: 771218 - RNA, 21 nt, Homo sapiens
guauuagagcgccagcuccuu

SEQ ID NO: 771219 - RNA, 21 nt, Homo sapiens
guauucaaauuugugucauac

SEQ ID NO: 771220 - RNA, 21 nt, Homo sapiens
guauucacacaccccucaaaa

SEQ ID NO: 771221 - RNA, 22 nt, Homo sapiens
guauucacacaccccucaaaaa

SEQ ID NO: 771222 - RNA, 11 nt, Homo sapiens
guauucauuca

SEQ ID NO: 771223 - RNA, 24 nt, Homo sapiens
guauuccaugguguauaugugcca

SEQ ID NO: 771224 - RNA, 22 nt, Homo sapiens
guauucccaaaaauuacuuugg

SEQ ID NO: 771225 - RNA, 19 nt, Homo sapiens
guauucccaccccuggacu

SEQ ID NO: 771226 - RNA, 17 nt, Homo sapiens
guauuccuccugagaua

SEQ ID NO: 771227 - RNA, 18 nt, Homo sapiens
guauuccuuuuguguaca

SEQ ID NO: 771228 - RNA, 15 nt, Homo sapiens
guauugaaaacacuu

SEQ ID NO: 771229 - RNA, 16 nt, Homo sapiens
guauugaaaacacuua

SEQ ID NO: 771230 - RNA, 22 nt, Homo sapiens
guauugcaccuuugaaaugcac

SEQ ID NO: 771231 - RNA, 18 nt, Homo sapiens
guauuguccgggcucaga

SEQ ID NO: 771232 - RNA, 21 nt, Homo sapiens
guauugucgguuaccucugca

SEQ ID NO: 771233 - RNA, 18 nt, Homo sapiens
guauuguggaacacugaa

SEQ ID NO: 771234 - RNA, 23 nt, Homo sapiens
guauuuaaaaaaacaaucccaag

SEQ ID NO: 771235 - RNA, 13 nt, Homo sapiens
guauuuagaucuc

SEQ ID NO: 771236 - RNA, 17 nt, Homo sapiens
guauuuaggcagauuga

SEQ ID NO: 771237 - RNA, 23 nt, Homo sapiens
guauuuccugcuucccuguugaa

SEQ ID NO: 771238 - RNA, 23 nt, Homo sapiens
guauuucuaauuccacaggucau

SEQ ID NO: 771239 - RNA, 19 nt, Homo sapiens
guauuugaaaacucacaga

SEQ ID NO: 771240 - RNA, 16 nt, Homo sapiens
guauuugaaauaagaa

SEQ ID NO: 771241 - RNA, 21 nt, Homo sapiens
guauuugcagaauacauucaa

SEQ ID NO: 771242 - RNA, 21 nt, Homo sapiens
guauuuguauuaauaaagcau

SEQ ID NO: 771243 - RNA, 17 nt, Homo sapiens
guauuuuagacuuccug

SEQ ID NO: 771244 - RNA, 16 nt, Homo sapiens
guauuuucaaccauaa

SEQ ID NO: 771245 - RNA, 11 nt, Homo sapiens
guauuuugcca

SEQ ID NO: 771246 - RNA, 22 nt, Homo sapiens
guauuuugugaugaaucuacau

SEQ ID NO: 771247 - RNA, 20 nt, Homo sapiens
guauuuuugccggcugguga

SEQ ID NO: 771248 - RNA, 18 nt, Homo sapiens
gucaaaaauuaaaccgga

SEQ ID NO: 771249 - RNA, 14 nt, Homo sapiens
gucaaaacuacuga

SEQ ID NO: 771250 - RNA, 16 nt, Homo sapiens
gucaaaaggacauuua

SEQ ID NO: 771251 - RNA, 14 nt, Homo sapiens
gucaaaaggugccu

SEQ ID NO: 771252 - RNA, 22 nt, Homo sapiens
gucaaagaagcuuccacaaaau

SEQ ID NO: 771253 - RNA, 15 nt, Homo sapiens
gucaacaacuuacac

SEQ ID NO: 771254 - RNA, 16 nt, Homo sapiens
gucaacagcgugcagg

SEQ ID NO: 771255 - RNA, 14 nt, Homo sapiens
gucaacaguucaaa

SEQ ID NO: 771256 - RNA, 12 nt, Homo sapiens
gucaacaucaaa

SEQ ID NO: 771257 - RNA, 22 nt, Homo sapiens
gucaacaucaaagagcacauuu

SEQ ID NO: 771258 - RNA, 15 nt, Homo sapiens
gucaacucacaccug

SEQ ID NO: 771259 - RNA, 16 nt, Homo sapiens
gucaacucacaccugc

SEQ ID NO: 771260 - RNA, 22 nt, Homo sapiens
gucaacuucagagacuaucuga

SEQ ID NO: 771261 - RNA, 22 nt, Homo sapiens
gucaagaagcguuaugugcagu

SEQ ID NO: 771262 - RNA, 23 nt, Homo sapiens
gucaagaagcguuaugugcagua

SEQ ID NO: 771263 - RNA, 14 nt, Homo sapiens
gucaaggccaccuc

SEQ ID NO: 771264 - RNA, 18 nt, Homo sapiens
gucaagguuuguguuacc

SEQ ID NO: 771265 - RNA, 21 nt, Homo sapiens
gucaauauuaaauacagacac

SEQ ID NO: 771266 - RNA, 18 nt, Homo sapiens
gucaauccgaaguaugag

SEQ ID NO: 771267 - RNA, 17 nt, Homo sapiens
gucaauccugucauaua

SEQ ID NO: 771268 - RNA, 13 nt, Homo sapiens
gucaauggaagaa

SEQ ID NO: 771269 - RNA, 14 nt, Homo sapiens
gucacaauccuaac

SEQ ID NO: 771270 - RNA, 19 nt, Homo sapiens
gucacagagugagacucca

SEQ ID NO: 771271 - RNA, 14 nt, Homo sapiens
gucacagccaugaa

SEQ ID NO: 771272 - RNA, 20 nt, Homo sapiens
gucacaggaagaaagcagaa

SEQ ID NO: 771273 - RNA, 18 nt, Homo sapiens
gucacauagagugaucuu

SEQ ID NO: 771274 - RNA, 11 nt, Homo sapiens
gucaccagagg

SEQ ID NO: 771275 - RNA, 17 nt, Homo sapiens
gucacccaucaggacca

SEQ ID NO: 771276 - RNA, 21 nt, Homo sapiens
gucaccgggaugaaccuaucc

SEQ ID NO: 771277 - RNA, 13 nt, Homo sapiens
gucaccugcagcc

SEQ ID NO: 771278 - RNA, 15 nt, Homo sapiens
gucacgcaugcagug

SEQ ID NO: 771279 - RNA, 20 nt, Homo sapiens
gucacggcugcgcacugugu

SEQ ID NO: 771280 - RNA, 19 nt, Homo sapiens
gucacuaccuucaugcaua

SEQ ID NO: 771281 - RNA, 15 nt, Homo sapiens
gucacuagucucacc

SEQ ID NO: 771282 - RNA, 16 nt, Homo sapiens
gucacucaaaugaauu

SEQ ID NO: 771283 - RNA, 15 nt, Homo sapiens
gucacucacacuggc

SEQ ID NO: 771284 - RNA, 19 nt, Homo sapiens
gucacugauacacagaaua

SEQ ID NO: 771285 - RNA, 16 nt, Homo sapiens
gucacuggcaucucac

SEQ ID NO: 771286 - RNA, 16 nt, Homo sapiens
gucacuggcucuccaa

SEQ ID NO: 771287 - RNA, 23 nt, Homo sapiens
gucacuguuuuuuucccaggugu

SEQ ID NO: 771288 - RNA, 21 nt, Homo sapiens
gucagaaaaaggaaaccacag

SEQ ID NO: 771289 - RNA, 18 nt, Homo sapiens
gucagacuuccaaauccu

SEQ ID NO: 771290 - RNA, 23 nt, Homo sapiens
gucagacuuuguguucauuucau

SEQ ID NO: 771291 - RNA, 15 nt, Homo sapiens
gucagagccacucua

SEQ ID NO: 771292 - RNA, 12 nt, Homo sapiens
gucagagcuaaa

SEQ ID NO: 771293 - RNA, 13 nt, Homo sapiens
gucagagcuaaac

SEQ ID NO: 771294 - RNA, 13 nt, Homo sapiens
gucagaguagaag

SEQ ID NO: 771295 - RNA, 15 nt, Homo sapiens
gucagccacacuggg

SEQ ID NO: 771296 - RNA, 17 nt, Homo sapiens
gucagcccaugugcacc

SEQ ID NO: 771297 - RNA, 21 nt, Homo sapiens
gucagcuacuaaugauguuuu

SEQ ID NO: 771298 - RNA, 16 nt, Homo sapiens
gucagcucucugcccu

SEQ ID NO: 771299 - RNA, 20 nt, Homo sapiens
gucgauuaguaaaagugcuu

SEQ ID NO: 771300 - RNA, 21 nt, Homo sapiens
gucgcccaggcuggagugcag

SEQ ID NO: 771301 - RNA, 22 nt, Homo sapiens
gucgcuaacuuaguaagugcuu

SEQ ID NO: 771302 - RNA, 16 nt, Homo sapiens
gucgggggcuguggau

SEQ ID NO: 771303 - RNA, 17 nt, Homo sapiens
gucguuuuagugucuga

SEQ ID NO: 771304 - RNA, 18 nt, Homo sapiens
gucuaaaaacaccaaaaa

SEQ ID NO: 771305 - RNA, 18 nt, Homo sapiens
gucuaaagcuuuggggga

SEQ ID NO: 771306 - RNA, 19 nt, Homo sapiens
gucuaacgcugaacugaca

SEQ ID NO: 771307 - RNA, 15 nt, Homo sapiens
gucuaagagugaagu

SEQ ID NO: 771308 - RNA, 21 nt, Homo sapiens
gucuacauagugacaugcaca

SEQ ID NO: 771309 - RNA, 22 nt, Homo sapiens
gucuacauugagcauuugaaag

SEQ ID NO: 771310 - RNA, 14 nt, Homo sapiens
gucuacccagacuc

SEQ ID NO: 771311 - RNA, 18 nt, Homo sapiens
gucuacccagacucagag

SEQ ID NO: 771312 - RNA, 20 nt, Homo sapiens
gucuaccuucuuuucuuccu

SEQ ID NO: 771313 - RNA, 22 nt, Homo sapiens
gucuagacuauuaggugcaauu

SEQ ID NO: 771314 - RNA, 15 nt, Homo sapiens
gucuaggacugcagu

SEQ ID NO: 771315 - RNA, 23 nt, Homo sapiens
gucuauaucauaacuauacuuga

SEQ ID NO: 771316 - RNA, 15 nt, Homo sapiens
gucuauuuuguauau

SEQ ID NO: 771317 - RNA, 21 nt, Homo sapiens
gucucaaacuccugaccucaa

SEQ ID NO: 771318 - RNA, 20 nt, Homo sapiens
gucucaaaggagcuuucuca

SEQ ID NO: 771319 - RNA, 15 nt, Homo sapiens
gucucaaaggccagg

SEQ ID NO: 771320 - RNA, 17 nt, Homo sapiens
gucucacagauugcugc

SEQ ID NO: 771321 - RNA, 12 nt, Homo sapiens
gucucaccagcc

SEQ ID NO: 771322 - RNA, 23 nt, Homo sapiens
gucucaccuggacuuaagcaucu

SEQ ID NO: 771323 - RNA, 23 nt, Homo sapiens
gucucacuacuugaccauucuca

SEQ ID NO: 771324 - RNA, 23 nt, Homo sapiens
gucucacugucccccguuugccu

SEQ ID NO: 771325 - RNA, 18 nt, Homo sapiens
gucuccaagaccacccuc

SEQ ID NO: 771326 - RNA, 23 nt, Homo sapiens
gucuccacggccugcccagucga

SEQ ID NO: 771327 - RNA, 17 nt, Homo sapiens
acagagcugaguccucu

SEQ ID NO: 771328 - RNA, 17 nt, Homo sapiens
acagaggagagucccag

SEQ ID NO: 771329 - RNA, 19 nt, Homo sapiens
acagaguagaaacucaaaa

SEQ ID NO: 771330 - RNA, 20 nt, Homo sapiens
acagagugagacuccaucuc

SEQ ID NO: 771331 - RNA, 18 nt, Homo sapiens
acagaguggggagcuccu

SEQ ID NO: 771332 - RNA, 22 nt, Homo sapiens
acagaguugccaggcacuuuga

SEQ ID NO: 771333 - RNA, 12 nt, Homo sapiens
acagauaaaaca

SEQ ID NO: 771334 - RNA, 18 nt, Homo sapiens
acagauaucagugucucc

SEQ ID NO: 771335 - RNA, 22 nt, Homo sapiens
acagaucaagaaaaaaagggag

SEQ ID NO: 771336 - RNA, 22 nt, Homo sapiens
acagaucacagcuucagccagg

SEQ ID NO: 771337 - RNA, 12 nt, Homo sapiens
acagaucuccug

SEQ ID NO: 771338 - RNA, 18 nt, Homo sapiens
acagaucuggaaccucag

SEQ ID NO: 771339 - RNA, 18 nt, Homo sapiens
acagaugccacacaagga

SEQ ID NO: 771340 - RNA, 16 nt, Homo sapiens
acagaugcguucagca

SEQ ID NO: 771341 - RNA, 16 nt, Homo sapiens
acagauggauuugccu

SEQ ID NO: 771342 - RNA, 14 nt, Homo sapiens
acagcaaacaggug

SEQ ID NO: 771343 - RNA, 18 nt, Homo sapiens
acagcaaauaacagucug

SEQ ID NO: 771344 - RNA, 13 nt, Homo sapiens
acagcaacaucca

SEQ ID NO: 771345 - RNA, 17 nt, Homo sapiens
acagcaccuccaugugg

SEQ ID NO: 771346 - RNA, 21 nt, Homo sapiens
acagcacuuuuccucuucuag

SEQ ID NO: 771347 - RNA, 18 nt, Homo sapiens
acagcagauacuuuguca

SEQ ID NO: 771348 - RNA, 23 nt, Homo sapiens
acagcagcaccuccuccaugcag

SEQ ID NO: 771349 - RNA, 15 nt, Homo sapiens
acagcagcacuguuc

SEQ ID NO: 771350 - RNA, 15 nt, Homo sapiens
acagcagcaucuuca

SEQ ID NO: 771351 - RNA, 15 nt, Homo sapiens
acagcagucagggac

SEQ ID NO: 771352 - RNA, 14 nt, Homo sapiens
acagcauguguauu

SEQ ID NO: 771353 - RNA, 12 nt, Homo sapiens
acagcauugcuu

SEQ ID NO: 771354 - RNA, 18 nt, Homo sapiens
acagccacaaaauacaca

SEQ ID NO: 771355 - RNA, 18 nt, Homo sapiens
acagccacacugugggac

SEQ ID NO: 771356 - RNA, 17 nt, Homo sapiens
acagccacuaaaacaca

SEQ ID NO: 771357 - RNA, 20 nt, Homo sapiens
acagccagacuggcacaguu

SEQ ID NO: 771358 - RNA, 19 nt, Homo sapiens
acagccagguuagccuuug

SEQ ID NO: 771359 - RNA, 21 nt, Homo sapiens
acagcccaggauacuggcaca

SEQ ID NO: 771360 - RNA, 23 nt, Homo sapiens
acagccccacccuggugggccaa

SEQ ID NO: 771361 - RNA, 18 nt, Homo sapiens
acagccccuuauuugcac

SEQ ID NO: 771362 - RNA, 15 nt, Homo sapiens
acagcccgcucucug

SEQ ID NO: 771363 - RNA, 17 nt, Homo sapiens
acagcccucaugaucau

SEQ ID NO: 771364 - RNA, 21 nt, Homo sapiens
acagcccuccuugacccugaa

SEQ ID NO: 771365 - RNA, 17 nt, Homo sapiens
acagccucuuacuugcc

SEQ ID NO: 771366 - RNA, 20 nt, Homo sapiens
acagccugcacacaccugcc

SEQ ID NO: 771367 - RNA, 11 nt, Homo sapiens
acagccuucag

SEQ ID NO: 771368 - RNA, 23 nt, Homo sapiens
acagccuucagcagcagcucaca

SEQ ID NO: 771369 - RNA, 15 nt, Homo sapiens
acagccuuugcccaa

SEQ ID NO: 771370 - RNA, 23 nt, Homo sapiens
acagccuuugcccaaaacuguca

SEQ ID NO: 771371 - RNA, 21 nt, Homo sapiens
acagcggaggagaccagcuca

SEQ ID NO: 771372 - RNA, 19 nt, Homo sapiens
acagcgucccuagcaguga

SEQ ID NO: 771373 - RNA, 21 nt, Homo sapiens
acagcguggaugucgaugacu

SEQ ID NO: 771374 - RNA, 17 nt, Homo sapiens
acagcguguaaacacau

SEQ ID NO: 771375 - RNA, 15 nt, Homo sapiens
acagcuacacagauc

SEQ ID NO: 771376 - RNA, 21 nt, Homo sapiens
acagcuauauuugauuaugua

SEQ ID NO: 771377 - RNA, 19 nt, Homo sapiens
acagcuaucgaacuucaca

SEQ ID NO: 771378 - RNA, 18 nt, Homo sapiens
acagcucagccacuguga

SEQ ID NO: 771379 - RNA, 21 nt, Homo sapiens
acagcuccuccucuuggagcu

SEQ ID NO: 771380 - RNA, 19 nt, Homo sapiens
acagcucuguaguuuauga

SEQ ID NO: 771381 - RNA, 16 nt, Homo sapiens
acagcucuucuaagga

SEQ ID NO: 771382 - RNA, 15 nt, Homo sapiens
acagcugcccuagcu

SEQ ID NO: 771383 - RNA, 13 nt, Homo sapiens
acagcuuccucac

SEQ ID NO: 771384 - RNA, 16 nt, Homo sapiens
acagcuugcugucacu

SEQ ID NO: 771385 - RNA, 20 nt, Homo sapiens
acagcuugcuucuuugccca

SEQ ID NO: 771386 - RNA, 22 nt, Homo sapiens
acagcuugggaauccugcuaaa

SEQ ID NO: 771387 - RNA, 18 nt, Homo sapiens
acaggaaggaaccagaag

SEQ ID NO: 771388 - RNA, 18 nt, Homo sapiens
acaggaagucccuugcca

SEQ ID NO: 771389 - RNA, 18 nt, Homo sapiens
acaggaauacuuaacuca

SEQ ID NO: 771390 - RNA, 16 nt, Homo sapiens
acaggacaacuuuaca

SEQ ID NO: 771391 - RNA, 19 nt, Homo sapiens
acaggagaaucaccugaac

SEQ ID NO: 771392 - RNA, 12 nt, Homo sapiens
acaggagccuag

SEQ ID NO: 771393 - RNA, 21 nt, Homo sapiens
acaggaggaagacaggcaaau

SEQ ID NO: 771394 - RNA, 23 nt, Homo sapiens
acaggaggcccccaucuaugagc

SEQ ID NO: 771395 - RNA, 16 nt, Homo sapiens
acaggauggugggcag

SEQ ID NO: 771396 - RNA, 19 nt, Homo sapiens
acaggauuauuggaaauuu

SEQ ID NO: 771397 - RNA, 12 nt, Homo sapiens
acaggauuucac

SEQ ID NO: 771398 - RNA, 16 nt, Homo sapiens
acaggcaaacugcaaa

SEQ ID NO: 771399 - RNA, 15 nt, Homo sapiens
acaggcaaauguacu

SEQ ID NO: 771400 - RNA, 21 nt, Homo sapiens
acaggcaacugaggcagacag

SEQ ID NO: 771401 - RNA, 16 nt, Homo sapiens
acaggcaccacugcuu

SEQ ID NO: 771402 - RNA, 20 nt, Homo sapiens
acaggcacccaccaccaugc

SEQ ID NO: 771403 - RNA, 21 nt, Homo sapiens
acaggcagauguuugccucau

SEQ ID NO: 771404 - RNA, 18 nt, Homo sapiens
acaggcaguuaggugcug

SEQ ID NO: 771405 - RNA, 19 nt, Homo sapiens
acaggcauuuguucacuga

SEQ ID NO: 771406 - RNA, 21 nt, Homo sapiens
acaggcccccuugaguggggu

SEQ ID NO: 771407 - RNA, 16 nt, Homo sapiens
acaggcccuuccucuc

SEQ ID NO: 771408 - RNA, 21 nt, Homo sapiens
acaggcccuuccucuccacug

SEQ ID NO: 771409 - RNA, 15 nt, Homo sapiens
acaggcgugagccac

SEQ ID NO: 771410 - RNA, 21 nt, Homo sapiens
acaggcuguucugcacugaaa

SEQ ID NO: 771411 - RNA, 22 nt, Homo sapiens
acaggcuguucugcacugaaaa

SEQ ID NO: 771412 - RNA, 13 nt, Homo sapiens
uaauaaacugugu

SEQ ID NO: 771413 - RNA, 15 nt, Homo sapiens
uaauaaagacagggu

SEQ ID NO: 771414 - RNA, 22 nt, Homo sapiens
uaauaaagaugaguugguucuc

SEQ ID NO: 771415 - RNA, 17 nt, Homo sapiens
uaauaaauacucaguga

SEQ ID NO: 771416 - RNA, 18 nt, Homo sapiens
uaauaaauauuuuugcca

SEQ ID NO: 771417 - RNA, 24 nt, Homo sapiens
uaauaaaucucuucuuugcugcag

SEQ ID NO: 771418 - RNA, 17 nt, Homo sapiens
uaauaacuguguacugu

SEQ ID NO: 771419 - RNA, 19 nt, Homo sapiens
uaauaagcaaucaagguua

SEQ ID NO: 771420 - RNA, 14 nt, Homo sapiens
uaauaaguacugug

SEQ ID NO: 771421 - RNA, 15 nt, Homo sapiens
uaauaauauguacua

SEQ ID NO: 771422 - RNA, 21 nt, Homo sapiens
uaauaauuauguauguuaugg

SEQ ID NO: 771423 - RNA, 15 nt, Homo sapiens
uaauaauuuuuaccu

SEQ ID NO: 771424 - RNA, 19 nt, Homo sapiens
uaauacaaaaagcaaaaau

SEQ ID NO: 771425 - RNA, 13 nt, Homo sapiens
uaauacauaacau

SEQ ID NO: 771426 - RNA, 17 nt, Homo sapiens
uaauacucugcagugau

SEQ ID NO: 771427 - RNA, 21 nt, Homo sapiens
uaauacuucauucucucucau

SEQ ID NO: 771428 - RNA, 18 nt, Homo sapiens
uaauacuugaugcaugca

SEQ ID NO: 771429 - RNA, 18 nt, Homo sapiens
uaauagaaauaaauuccu

SEQ ID NO: 771430 - RNA, 15 nt, Homo sapiens
uaauagacugaguca

SEQ ID NO: 771431 - RNA, 19 nt, Homo sapiens
uaauagacuuaauacaugc

SEQ ID NO: 771432 - RNA, 17 nt, Homo sapiens
uaauagcuacagugcau

SEQ ID NO: 771433 - RNA, 16 nt, Homo sapiens
uaauagucauuccaaa

SEQ ID NO: 771434 - RNA, 15 nt, Homo sapiens
uaauagugacaugca

SEQ ID NO: 771435 - RNA, 14 nt, Homo sapiens
uaauauaagccaua

SEQ ID NO: 771436 - RNA, 14 nt, Homo sapiens
uaauauacuauaug

SEQ ID NO: 771437 - RNA, 14 nt, Homo sapiens
uaauauauuguaca

SEQ ID NO: 771438 - RNA, 12 nt, Homo sapiens
uaauaucuguga

SEQ ID NO: 771439 - RNA, 14 nt, Homo sapiens
uaauaucugugagg

SEQ ID NO: 771440 - RNA, 14 nt, Homo sapiens
uaauaugcugccaa

SEQ ID NO: 771441 - RNA, 18 nt, Homo sapiens
uaauauuguaaauacugg

SEQ ID NO: 771442 - RNA, 18 nt, Homo sapiens
uaauauuucaagugccua

SEQ ID NO: 771443 - RNA, 19 nt, Homo sapiens
uaauauuuuccuaguagau

SEQ ID NO: 771444 - RNA, 15 nt, Homo sapiens
uaauauuuugcacag

SEQ ID NO: 771445 - RNA, 20 nt, Homo sapiens
uaauauuuuuguauuucucu

SEQ ID NO: 771446 - RNA, 13 nt, Homo sapiens
acugguugcacuu

SEQ ID NO: 771447 - RNA, 17 nt, Homo sapiens
acugguuguugccaaac

SEQ ID NO: 771448 - RNA, 13 nt, Homo sapiens
acuguaagggauu

SEQ ID NO: 771449 - RNA, 14 nt, Homo sapiens
acuguacccagucu

SEQ ID NO: 771450 - RNA, 14 nt, Homo sapiens
acuguacccucgca

SEQ ID NO: 771451 - RNA, 12 nt, Homo sapiens
acuguacugugu

SEQ ID NO: 771452 - RNA, 14 nt, Homo sapiens
acuguagcuuuuag

SEQ ID NO: 771453 - RNA, 19 nt, Homo sapiens
acuguauauaaacuccuua

SEQ ID NO: 771454 - RNA, 18 nt, Homo sapiens
acuguauauagaagucua

SEQ ID NO: 771455 - RNA, 16 nt, Homo sapiens
acuguauuaagaguga

SEQ ID NO: 771456 - RNA, 22 nt, Homo sapiens
acuguauuuaagaaaacaccau

SEQ ID NO: 771457 - RNA, 23 nt, Homo sapiens
acugucaagaagaggaaagggag

SEQ ID NO: 771458 - RNA, 12 nt, Homo sapiens
acugucacuguu

SEQ ID NO: 771459 - RNA, 20 nt, Homo sapiens
acugucaguguacacgucug

SEQ ID NO: 771460 - RNA, 13 nt, Homo sapiens
acugucaguucuc

SEQ ID NO: 771461 - RNA, 23 nt, Homo sapiens
acugucaucuuuuuccacuuuga

SEQ ID NO: 771462 - RNA, 23 nt, Homo sapiens
acugucauugccccuccgaugcu

SEQ ID NO: 771463 - RNA, 22 nt, Homo sapiens
acuguccaagugccacaugccu

SEQ ID NO: 771464 - RNA, 16 nt, Homo sapiens
acuguccccuugauau

SEQ ID NO: 771465 - RNA, 13 nt, Homo sapiens
acuguccugugaa

SEQ ID NO: 771466 - RNA, 14 nt, Homo sapiens
acugucucacuuaa

SEQ ID NO: 771467 - RNA, 14 nt, Homo sapiens
acugucuuccucaa

SEQ ID NO: 771468 - RNA, 15 nt, Homo sapiens
acugucuuccucaaa

SEQ ID NO: 771469 - RNA, 15 nt, Homo sapiens
acugugaagcauuua

SEQ ID NO: 771470 - RNA, 19 nt, Homo sapiens
acugugaggggaaggccuu

SEQ ID NO: 771471 - RNA, 12 nt, Homo sapiens
acugugauuaga

SEQ ID NO: 771472 - RNA, 14 nt, Homo sapiens
acugugccacaaug

SEQ ID NO: 771473 - RNA, 17 nt, Homo sapiens
acuguggcacuugccug

SEQ ID NO: 771474 - RNA, 21 nt, Homo sapiens
acuguggccuguuaacuggua

SEQ ID NO: 771475 - RNA, 22 nt, Homo sapiens
acugugggauguguucuucuuu

SEQ ID NO: 771476 - RNA, 16 nt, Homo sapiens
acuguguaacuuucuc

SEQ ID NO: 771477 - RNA, 21 nt, Homo sapiens
acuguguauagcuuaccugaa

SEQ ID NO: 771478 - RNA, 19 nt, Homo sapiens
acugugucuggcguucuca

SEQ ID NO: 771479 - RNA, 16 nt, Homo sapiens
acuguguggacuguga

SEQ ID NO: 771480 - RNA, 19 nt, Homo sapiens
acuguguggacugugaugc

SEQ ID NO: 771481 - RNA, 20 nt, Homo sapiens
acuguuagucauuugcugag

SEQ ID NO: 771482 - RNA, 13 nt, Homo sapiens
acuguucuaaagc

SEQ ID NO: 771483 - RNA, 23 nt, Homo sapiens
acuguucucuauuagacuuuaga

SEQ ID NO: 771484 - RNA, 15 nt, Homo sapiens
acuuaaaaacucuau

SEQ ID NO: 771485 - RNA, 16 nt, Homo sapiens
acuuaaaaauauccau

SEQ ID NO: 771486 - RNA, 17 nt, Homo sapiens
acuuaaaagaacaugua

SEQ ID NO: 771487 - RNA, 15 nt, Homo sapiens
acuuaaaauaucucu

SEQ ID NO: 771488 - RNA, 19 nt, Homo sapiens
acuuaacaugggcucuuca

SEQ ID NO: 771489 - RNA, 13 nt, Homo sapiens
acuuaacuaugag

SEQ ID NO: 771490 - RNA, 13 nt, Homo sapiens
acuuaacuauuaa

SEQ ID NO: 771491 - RNA, 18 nt, Homo sapiens
acuuaacuauuaaggccu

SEQ ID NO: 771492 - RNA, 15 nt, Homo sapiens
acuuaagacugugua

SEQ ID NO: 771493 - RNA, 19 nt, Homo sapiens
acuuaagcccagugcacug

SEQ ID NO: 771494 - RNA, 19 nt, Homo sapiens
acuuaaggauggagccagc

SEQ ID NO: 771495 - RNA, 23 nt, Homo sapiens
acuuaagggaacugaaucacuua

SEQ ID NO: 771496 - RNA, 19 nt, Homo sapiens
acuuaagguugggugcugc

SEQ ID NO: 771497 - RNA, 18 nt, Homo sapiens
acuuaagucuuccuuaaa

SEQ ID NO: 771498 - RNA, 21 nt, Homo sapiens
acuuaaguuuuagaaaugaga

SEQ ID NO: 771499 - RNA, 21 nt, Homo sapiens
acuuaauguuugguaacuuuu

SEQ ID NO: 771500 - RNA, 18 nt, Homo sapiens
acuuaauucagucucagc

SEQ ID NO: 771501 - RNA, 15 nt, Homo sapiens
acuuacagaucuauc

SEQ ID NO: 771502 - RNA, 19 nt, Homo sapiens
acuuacagaucuaucuccu

SEQ ID NO: 771503 - RNA, 15 nt, Homo sapiens
acuuacaucaugugu

SEQ ID NO: 771504 - RNA, 22 nt, Homo sapiens
acuuaccacucgugcaucccug

SEQ ID NO: 771505 - RNA, 18 nt, Homo sapiens
acuuaccuagauuuacag

SEQ ID NO: 771506 - RNA, 23 nt, Homo sapiens
acuuacuauaauuugacuugaau

SEQ ID NO: 771507 - RNA, 20 nt, Homo sapiens
acuuagaauccgaagggaau

SEQ ID NO: 771508 - RNA, 22 nt, Homo sapiens
acuuagcucaggugccuuacau

SEQ ID NO: 771509 - RNA, 23 nt, Homo sapiens
acuuaggaaauggcuuugugauu

SEQ ID NO: 771510 - RNA, 23 nt, Homo sapiens
acuuaguccuuuaucauccuuaa

SEQ ID NO: 771511 - RNA, 19 nt, Homo sapiens
acuuagugguaugucucuu

SEQ ID NO: 771512 - RNA, 16 nt, Homo sapiens
acuuaguugcguuaca

SEQ ID NO: 771513 - RNA, 22 nt, Homo sapiens
acuuauauugaagacaauuuga

SEQ ID NO: 771514 - RNA, 20 nt, Homo sapiens
acuuaucacgccuacuuaag

SEQ ID NO: 771515 - RNA, 18 nt, Homo sapiens
acuuaugauuucaugugc

SEQ ID NO: 771516 - RNA, 17 nt, Homo sapiens
acuuauuuucuguucag

SEQ ID NO: 771517 - RNA, 11 nt, Homo sapiens
acuucaaagag

SEQ ID NO: 771518 - RNA, 20 nt, Homo sapiens
acuucaaagaggaaccagga

SEQ ID NO: 771519 - RNA, 14 nt, Homo sapiens
acuucaaaguuaau

SEQ ID NO: 771520 - RNA, 16 nt, Homo sapiens
acuucaacauuuacau

SEQ ID NO: 771521 - RNA, 19 nt, Homo sapiens
acuucaagagccucuggca

SEQ ID NO: 771522 - RNA, 13 nt, Homo sapiens
acuucaagugcau

SEQ ID NO: 771523 - RNA, 13 nt, Homo sapiens
acuucaauaucca

SEQ ID NO: 771524 - RNA, 22 nt, Homo sapiens
acuucacagugacacuggacca

SEQ ID NO: 771525 - RNA, 20 nt, Homo sapiens
acuucaccuacauuaucuca

SEQ ID NO: 771526 - RNA, 21 nt, Homo sapiens
acuucacgggcaaucaugagc

SEQ ID NO: 771527 - RNA, 12 nt, Homo sapiens
acuuugcugauu

SEQ ID NO: 771528 - RNA, 23 nt, Homo sapiens
acuuugcugucaaaacuacugac

SEQ ID NO: 771529 - RNA, 15 nt, Homo sapiens
acuuuggaacaagau

SEQ ID NO: 771530 - RNA, 23 nt, Homo sapiens
acuuuggaaccagacucuugccu

SEQ ID NO: 771531 - RNA, 15 nt, Homo sapiens
acuuuggaggacaau

SEQ ID NO: 771532 - RNA, 21 nt, Homo sapiens
acuuuggaguccccucaccuc

SEQ ID NO: 771533 - RNA, 16 nt, Homo sapiens
acuuuggcaauuuccu

SEQ ID NO: 771534 - RNA, 17 nt, Homo sapiens
acuuuggcugaacuaca

SEQ ID NO: 771535 - RNA, 15 nt, Homo sapiens
acuuugggaggccaa

SEQ ID NO: 771536 - RNA, 17 nt, Homo sapiens
acuuugguacauggcca

SEQ ID NO: 771537 - RNA, 21 nt, Homo sapiens
acuuugguucucuccaggaag

SEQ ID NO: 771538 - RNA, 23 nt, Homo sapiens
acuuuguaauaccagaacucuaa

SEQ ID NO: 771539 - RNA, 15 nt, Homo sapiens
acuuuguauuuugau

SEQ ID NO: 771540 - RNA, 19 nt, Homo sapiens
acuuuguggcaaucugugg

SEQ ID NO: 771541 - RNA, 22 nt, Homo sapiens
acuuuuaaguugcugaugaacu

SEQ ID NO: 771542 - RNA, 22 nt, Homo sapiens
acuuuuaugugucucagaauau

SEQ ID NO: 771543 - RNA, 15 nt, Homo sapiens
acuuuucaccaauga

SEQ ID NO: 771544 - RNA, 11 nt, Homo sapiens
acuuuuccaca

SEQ ID NO: 771545 - RNA, 19 nt, Homo sapiens
acuuuuccauugaccagcu

SEQ ID NO: 771546 - RNA, 18 nt, Homo sapiens
acuuuucggucuuuccca

SEQ ID NO: 771547 - RNA, 20 nt, Homo sapiens
acuuuucuaacauaugucua

SEQ ID NO: 771548 - RNA, 21 nt, Homo sapiens
acuuuucuuuccucagaucau

SEQ ID NO: 771549 - RNA, 14 nt, Homo sapiens
acuuuugaccaaaa

SEQ ID NO: 771550 - RNA, 17 nt, Homo sapiens
acuuuugcaugaaaaua

SEQ ID NO: 771551 - RNA, 16 nt, Homo sapiens
acuuuuguguaaugaa

SEQ ID NO: 771552 - RNA, 18 nt, Homo sapiens
acuuuuuacagugcuauu

SEQ ID NO: 771553 - RNA, 11 nt, Homo sapiens
acuuuuuccag

SEQ ID NO: 771554 - RNA, 17 nt, Homo sapiens
acuuuuugguacaggua

SEQ ID NO: 771555 - RNA, 20 nt, Homo sapiens
acuuuuuuagaaaugcaaaa

SEQ ID NO: 771556 - RNA, 18 nt, Homo sapiens
acuuuuuuuuaacacuuu

SEQ ID NO: 771557 - RNA, 22 nt, Homo sapiens
acuuuuuuuuuuucugccugag

SEQ ID NO: 771558 - RNA, 17 nt, Homo sapiens
agaaaaaaaauguaccc

SEQ ID NO: 771559 - RNA, 18 nt, Homo sapiens
agaaaaacacaaacauuc

SEQ ID NO: 771560 - RNA, 16 nt, Homo sapiens
uacaaucagcccagug

SEQ ID NO: 771561 - RNA, 17 nt, Homo sapiens
uacaaucagcccagugc

SEQ ID NO: 771562 - RNA, 19 nt, Homo sapiens
uacaaucagcccagugcaa

SEQ ID NO: 771563 - RNA, 20 nt, Homo sapiens
uacaaucagcccagugcaaa

SEQ ID NO: 771564 - RNA, 13 nt, Homo sapiens
uacaauguacaau

SEQ ID NO: 771565 - RNA, 14 nt, Homo sapiens
uacaauguacaauu

SEQ ID NO: 771566 - RNA, 17 nt, Homo sapiens
uacaauuaauaguuugu

SEQ ID NO: 771567 - RNA, 19 nt, Homo sapiens
uacaauucauuguuuugca

SEQ ID NO: 771568 - RNA, 17 nt, Homo sapiens
uacaauugcacugcugu

SEQ ID NO: 771569 - RNA, 12 nt, Homo sapiens
uacaauuucacu

SEQ ID NO: 771570 - RNA, 20 nt, Homo sapiens
uacaauuuuuuaucaugcau

SEQ ID NO: 771571 - RNA, 22 nt, Homo sapiens
uacaauuuuuuaucaugcaugu

SEQ ID NO: 771572 - RNA, 19 nt, Homo sapiens
uacacaaggaaggcauuug

SEQ ID NO: 771573 - RNA, 20 nt, Homo sapiens
uacacacauauauauuacaa

SEQ ID NO: 771574 - RNA, 16 nt, Homo sapiens
uacacagaucacagcu

SEQ ID NO: 771575 - RNA, 17 nt, Homo sapiens
uacacagaucacagcuu

SEQ ID NO: 771576 - RNA, 15 nt, Homo sapiens
uacacagcccaagag

SEQ ID NO: 771577 - RNA, 17 nt, Homo sapiens
uacacaggagucuucag

SEQ ID NO: 771578 - RNA, 18 nt, Homo sapiens
uacacaguaagucauuua

SEQ ID NO: 771579 - RNA, 19 nt, Homo sapiens
uacacaguaagucauuuaa

SEQ ID NO: 771580 - RNA, 20 nt, Homo sapiens
uacacaguucugguguuccu

SEQ ID NO: 771581 - RNA, 14 nt, Homo sapiens
uacacaugugcaca

SEQ ID NO: 771582 - RNA, 15 nt, Homo sapiens
uacacaugugcacac

SEQ ID NO: 771583 - RNA, 14 nt, Homo sapiens
uacacauugcauuu

SEQ ID NO: 771584 - RNA, 15 nt, Homo sapiens
uacacccaccagagu

SEQ ID NO: 771585 - RNA, 18 nt, Homo sapiens
uacacccuuucuugacaa

SEQ ID NO: 771586 - RNA, 18 nt, Homo sapiens
uacaccucgucaagagca

SEQ ID NO: 771587 - RNA, 12 nt, Homo sapiens
uacacgggacca

SEQ ID NO: 771588 - RNA, 18 nt, Homo sapiens
uacacgggacugacgcaa

SEQ ID NO: 771589 - RNA, 15 nt, Homo sapiens
uacacguguccugua

SEQ ID NO: 771590 - RNA, 21 nt, Homo sapiens
uacacuaaaaccacaugugca

SEQ ID NO: 771591 - RNA, 21 nt, Homo sapiens
uacacuaaaaggugaccaaug

SEQ ID NO: 771592 - RNA, 21 nt, Homo sapiens
uacacuccacuugaagcacuu

SEQ ID NO: 771593 - RNA, 17 nt, Homo sapiens
uacacucuugauucuac

SEQ ID NO: 771594 - RNA, 18 nt, Homo sapiens
uacacugaaaaugucaca

SEQ ID NO: 771595 - RNA, 15 nt, Homo sapiens
uacacugauacacuu

SEQ ID NO: 771596 - RNA, 13 nt, Homo sapiens
uacacugccaucu

SEQ ID NO: 771597 - RNA, 16 nt, Homo sapiens
uacacugugaacucaa

SEQ ID NO: 771598 - RNA, 21 nt, Homo sapiens
uacacuguguaaauacccaua

SEQ ID NO: 771599 - RNA, 20 nt, Homo sapiens
uacacuuauuuuacuaguuu

SEQ ID NO: 771600 - RNA, 22 nt, Homo sapiens
uacacuuuaugccggaugugcu

SEQ ID NO: 771601 - RNA, 14 nt, Homo sapiens
uacacuuuguugca

SEQ ID NO: 771602 - RNA, 20 nt, Homo sapiens
uacagaaaagacucugacca

SEQ ID NO: 771603 - RNA, 19 nt, Homo sapiens
uacagaaagaaaaaugcau

SEQ ID NO: 771604 - RNA, 22 nt, Homo sapiens
uacagaaagagcgucauguccu

SEQ ID NO: 771605 - RNA, 20 nt, Homo sapiens
uacagaaauacugcucugaa

SEQ ID NO: 771606 - RNA, 23 nt, Homo sapiens
uacagaaguccccucuacuuuaa

SEQ ID NO: 771607 - RNA, 23 nt, Homo sapiens
uacagaaucacagcccucaugau

SEQ ID NO: 771608 - RNA, 21 nt, Homo sapiens
uacagacacucccacuuggca

SEQ ID NO: 771609 - RNA, 12 nt, Homo sapiens
uacagacauaca

SEQ ID NO: 771610 - RNA, 16 nt, Homo sapiens
uacagacauucaauga

SEQ ID NO: 771611 - RNA, 16 nt, Homo sapiens
uacagaccaccuuuca

SEQ ID NO: 771612 - RNA, 13 nt, Homo sapiens
uacagacucugau

SEQ ID NO: 771613 - RNA, 17 nt, Homo sapiens
uacagacucugauucua

SEQ ID NO: 771614 - RNA, 12 nt, Homo sapiens
uacagagccaca

SEQ ID NO: 771615 - RNA, 15 nt, Homo sapiens
uacagauacugugag

SEQ ID NO: 771616 - RNA, 21 nt, Homo sapiens
uacagauagaaaauaugauau

SEQ ID NO: 771617 - RNA, 13 nt, Homo sapiens
uacagaugggcaa

SEQ ID NO: 771618 - RNA, 18 nt, Homo sapiens
uacagauuuaguuuacca

SEQ ID NO: 771619 - RNA, 16 nt, Homo sapiens
uacagcagcacuguuc

SEQ ID NO: 771620 - RNA, 17 nt, Homo sapiens
uacagcagugucaucag

SEQ ID NO: 771621 - RNA, 20 nt, Homo sapiens
uacagcuaacccucacaagc

SEQ ID NO: 771622 - RNA, 22 nt, Homo sapiens
uacagcuaaucagcauucucac

SEQ ID NO: 771623 - RNA, 14 nt, Homo sapiens
uacagcugcacuga

SEQ ID NO: 771624 - RNA, 14 nt, Homo sapiens
uacaggcacaggcc

SEQ ID NO: 771625 - RNA, 20 nt, Homo sapiens
uacaggcaguuaggugcuga

SEQ ID NO: 771626 - RNA, 14 nt, Homo sapiens
uacaggcauaaaau

SEQ ID NO: 771627 - RNA, 15 nt, Homo sapiens
uacaggcucaugcca

SEQ ID NO: 771628 - RNA, 22 nt, Homo sapiens
uacagggagccggcggccucuc

SEQ ID NO: 771629 - RNA, 18 nt, Homo sapiens
uacagggcauucaaaugg

SEQ ID NO: 771630 - RNA, 18 nt, Homo sapiens
uacagguaugugccacca

SEQ ID NO: 771631 - RNA, 23 nt, Homo sapiens
uacaguaacaaauaaagugcagu

SEQ ID NO: 771632 - RNA, 16 nt, Homo sapiens
uacaguaacugugacu

SEQ ID NO: 771633 - RNA, 21 nt, Homo sapiens
uacaguaccuuguugcagaug

SEQ ID NO: 771634 - RNA, 14 nt, Homo sapiens
uacaguagcugcua

SEQ ID NO: 771635 - RNA, 16 nt, Homo sapiens
uacaguagugucauca

SEQ ID NO: 771636 - RNA, 15 nt, Homo sapiens
uacagucugucauga

SEQ ID NO: 771637 - RNA, 22 nt, Homo sapiens
uacagugagccaagauugcacc

SEQ ID NO: 771638 - RNA, 12 nt, Homo sapiens
uacagugauaua

SEQ ID NO: 771639 - RNA, 16 nt, Homo sapiens
uacaguguauguacua

SEQ ID NO: 771640 - RNA, 12 nt, Homo sapiens
uacaguguuauu

SEQ ID NO: 771641 - RNA, 20 nt, Homo sapiens
uacaguucugggguacaugu

SEQ ID NO: 771642 - RNA, 15 nt, Homo sapiens
ucaaaagcaccagca

SEQ ID NO: 771643 - RNA, 15 nt, Homo sapiens
ucaaaaggaaaccaa

SEQ ID NO: 771644 - RNA, 16 nt, Homo sapiens
ucaaaaggaaaccaag

SEQ ID NO: 771645 - RNA, 22 nt, Homo sapiens
ucaaaagguauuauacauguga

SEQ ID NO: 771646 - RNA, 22 nt, Homo sapiens
ucaaaagguuaauaaaguaauu

SEQ ID NO: 771647 - RNA, 16 nt, Homo sapiens
ucaaaauccuacagau

SEQ ID NO: 771648 - RNA, 16 nt, Homo sapiens
ucaaacauaauucucu

SEQ ID NO: 771649 - RNA, 17 nt, Homo sapiens
ucaaacauaauucucuc

SEQ ID NO: 771650 - RNA, 11 nt, Homo sapiens
ucaaaccaaga

SEQ ID NO: 771651 - RNA, 12 nt, Homo sapiens
ucaaaccaagaa

SEQ ID NO: 771652 - RNA, 13 nt, Homo sapiens
ucaaaccaagaag

SEQ ID NO: 771653 - RNA, 15 nt, Homo sapiens
ucaaacccauucccu

SEQ ID NO: 771654 - RNA, 18 nt, Homo sapiens
ucaaacgaugugcaauac

SEQ ID NO: 771655 - RNA, 14 nt, Homo sapiens
ucaaagaacaaaca

SEQ ID NO: 771656 - RNA, 14 nt, Homo sapiens
ucaaagaaguacuu

SEQ ID NO: 771657 - RNA, 20 nt, Homo sapiens
ucaaagaauuacaguacaca

SEQ ID NO: 771658 - RNA, 22 nt, Homo sapiens
ucaaagcaggaauugguggcag

SEQ ID NO: 771659 - RNA, 17 nt, Homo sapiens
ucaaagcccaacugugg

SEQ ID NO: 771660 - RNA, 21 nt, Homo sapiens
ucaaagcccugccucugugua

SEQ ID NO: 771661 - RNA, 21 nt, Homo sapiens
ucaaagcuaaauuccacacua

SEQ ID NO: 771662 - RNA, 20 nt, Homo sapiens
ucaaagcuuugacucuauaa

SEQ ID NO: 771663 - RNA, 18 nt, Homo sapiens
ucaaaggagcuuucucaa

SEQ ID NO: 771664 - RNA, 19 nt, Homo sapiens
ucaaaggccagguugcuaa

SEQ ID NO: 771665 - RNA, 22 nt, Homo sapiens
ucaaagggagagagugcuauug

SEQ ID NO: 771666 - RNA, 15 nt, Homo sapiens
ucaaagguucuaggu

SEQ ID NO: 771667 - RNA, 21 nt, Homo sapiens
ucaaagugguaaauacuguga

SEQ ID NO: 771668 - RNA, 13 nt, Homo sapiens
ucaaaguguaaca

SEQ ID NO: 771669 - RNA, 15 nt, Homo sapiens
ucaaaguguuuuuca

SEQ ID NO: 771670 - RNA, 14 nt, Homo sapiens
ucaaauaaacucaa

SEQ ID NO: 771671 - RNA, 19 nt, Homo sapiens
ucaaauagauggauuugua

SEQ ID NO: 771672 - RNA, 14 nt, Homo sapiens
ucaaauagcauaag

SEQ ID NO: 771673 - RNA, 19 nt, Homo sapiens
ucaaauaucaguuacccac

SEQ ID NO: 771674 - RNA, 14 nt, Homo sapiens
ucaaauauuugcug

SEQ ID NO: 771675 - RNA, 14 nt, Homo sapiens
ucaaaucucuacaa

SEQ ID NO: 771676 - RNA, 17 nt, Homo sapiens
ucaaaugaagugaguca

SEQ ID NO: 771677 - RNA, 15 nt, Homo sapiens
ucaaaugagccccuu

SEQ ID NO: 771678 - RNA, 17 nt, Homo sapiens
ucaaaugcacaucucau

SEQ ID NO: 771679 - RNA, 19 nt, Homo sapiens
ucaaaugcccuuccagugg

SEQ ID NO: 771680 - RNA, 20 nt, Homo sapiens
ucaaauggggccagauccag

SEQ ID NO: 771681 - RNA, 19 nt, Homo sapiens
ucaaauguacagugguccu

SEQ ID NO: 771682 - RNA, 22 nt, Homo sapiens
agccucccaaagugcugagauu

SEQ ID NO: 771683 - RNA, 15 nt, Homo sapiens
agccuccccgugcca

SEQ ID NO: 771684 - RNA, 20 nt, Homo sapiens
agccuccccgugccaaaaau

SEQ ID NO: 771685 - RNA, 17 nt, Homo sapiens
agccucccucugaccug

SEQ ID NO: 771686 - RNA, 14 nt, Homo sapiens
agccucccuuccau

SEQ ID NO: 771687 - RNA, 15 nt, Homo sapiens
agccuccuccugacc

SEQ ID NO: 771688 - RNA, 15 nt, Homo sapiens
agccuccucucccua

SEQ ID NO: 771689 - RNA, 17 nt, Homo sapiens
agccucucaaguaauau

SEQ ID NO: 771690 - RNA, 18 nt, Homo sapiens
agccucuccgacucugca

SEQ ID NO: 771691 - RNA, 19 nt, Homo sapiens
agccucucgaagugcugag

SEQ ID NO: 771692 - RNA, 21 nt, Homo sapiens
agccucucucggucaacagca

SEQ ID NO: 771693 - RNA, 14 nt, Homo sapiens
agccucugcugcca

SEQ ID NO: 771694 - RNA, 16 nt, Homo sapiens
agccucuggcauuaga

SEQ ID NO: 771695 - RNA, 16 nt, Homo sapiens
agccucuggcuagagg

SEQ ID NO: 771696 - RNA, 18 nt, Homo sapiens
agccucuguccgccuuua

SEQ ID NO: 771697 - RNA, 18 nt, Homo sapiens
agccugaaaaggacuucu

SEQ ID NO: 771698 - RNA, 23 nt, Homo sapiens
agccugaaacucauagacacuga

SEQ ID NO: 771699 - RNA, 21 nt, Homo sapiens
agccugaaugucuuacuguga

SEQ ID NO: 771700 - RNA, 13 nt, Homo sapiens
agccugagccaca

SEQ ID NO: 771701 - RNA, 16 nt, Homo sapiens
agccugagucacuggu

SEQ ID NO: 771702 - RNA, 14 nt, Homo sapiens
agccugauccagcc

SEQ ID NO: 771703 - RNA, 19 nt, Homo sapiens
agccugcacuacucccuca

SEQ ID NO: 771704 - RNA, 18 nt, Homo sapiens
agccugcccucacucccu

SEQ ID NO: 771705 - RNA, 16 nt, Homo sapiens
agccugccucccaagg

SEQ ID NO: 771706 - RNA, 19 nt, Homo sapiens
agccugcucuagugggaca

SEQ ID NO: 771707 - RNA, 14 nt, Homo sapiens
agccugcugcaugg

SEQ ID NO: 771708 - RNA, 14 nt, Homo sapiens
agccuggcacagga

SEQ ID NO: 771709 - RNA, 18 nt, Homo sapiens
agccuggccaacauggug

SEQ ID NO: 771710 - RNA, 19 nt, Homo sapiens
agccuggccaacaugguga

SEQ ID NO: 771711 - RNA, 22 nt, Homo sapiens
agccuggcucccaggacacgac

SEQ ID NO: 771712 - RNA, 15 nt, Homo sapiens
agccuggcuggagag

SEQ ID NO: 771713 - RNA, 18 nt, Homo sapiens
agccugggcagcauagca

SEQ ID NO: 771714 - RNA, 19 nt, Homo sapiens
agccugggcucacugugcu

SEQ ID NO: 771715 - RNA, 15 nt, Homo sapiens
agccuggggacccca

SEQ ID NO: 771716 - RNA, 18 nt, Homo sapiens
agccugggucacagagug

SEQ ID NO: 771717 - RNA, 17 nt, Homo sapiens
agccugggugguaccca

SEQ ID NO: 771718 - RNA, 12 nt, Homo sapiens
agccuguaccuu

SEQ ID NO: 771719 - RNA, 22 nt, Homo sapiens
agccugucaccagagcuucucu

SEQ ID NO: 771720 - RNA, 22 nt, Homo sapiens
agccugucucccccaacacccc

SEQ ID NO: 771721 - RNA, 12 nt, Homo sapiens
agccugugauua

SEQ ID NO: 771722 - RNA, 22 nt, Homo sapiens
agccuuaggaaggccuucagga

SEQ ID NO: 771723 - RNA, 23 nt, Homo sapiens
agccuuauguggaagaacuguga

SEQ ID NO: 771724 - RNA, 16 nt, Homo sapiens
agccuucaagugccaa

SEQ ID NO: 771725 - RNA, 14 nt, Homo sapiens
agccuucagucaca

SEQ ID NO: 771726 - RNA, 22 nt, Homo sapiens
agccuuccugaguuucucucuc

SEQ ID NO: 771727 - RNA, 12 nt, Homo sapiens
agccuugcuugu

SEQ ID NO: 771728 - RNA, 18 nt, Homo sapiens
agccuuggcucuacccug

SEQ ID NO: 771729 - RNA, 17 nt, Homo sapiens
agccuugggaacaugcg

SEQ ID NO: 771730 - RNA, 21 nt, Homo sapiens
agccuuuccaagucacuagaa

SEQ ID NO: 771731 - RNA, 14 nt, Homo sapiens
agccuuuguuuuuc

SEQ ID NO: 771732 - RNA, 14 nt, Homo sapiens
agccuuuugcucuc

SEQ ID NO: 771733 - RNA, 19 nt, Homo sapiens
agcgaacuuguauacuuau

SEQ ID NO: 771734 - RNA, 21 nt, Homo sapiens
agcgacguuuauuucaucucu

SEQ ID NO: 771735 - RNA, 16 nt, Homo sapiens
agcgagcuaugaucgc

SEQ ID NO: 771736 - RNA, 14 nt, Homo sapiens
agcgagugcucuca

SEQ ID NO: 771737 - RNA, 20 nt, Homo sapiens
agcgaguuuucugaccagcu

SEQ ID NO: 771738 - RNA, 18 nt, Homo sapiens
agcgauucuccugucuca

SEQ ID NO: 771739 - RNA, 19 nt, Homo sapiens
agcggagagagccaagacg

SEQ ID NO: 771740 - RNA, 21 nt, Homo sapiens
agcggccuccggcgucuugcc

SEQ ID NO: 771741 - RNA, 22 nt, Homo sapiens
agcggccuccggcgucuugccc

SEQ ID NO: 771742 - RNA, 14 nt, Homo sapiens
agcgggacucuguc

SEQ ID NO: 771743 - RNA, 17 nt, Homo sapiens
agcgggcggaggggauc

SEQ ID NO: 771744 - RNA, 14 nt, Homo sapiens
agcguagcagcuca

SEQ ID NO: 771745 - RNA, 15 nt, Homo sapiens
agcguagcuaaguga

SEQ ID NO: 771746 - RNA, 19 nt, Homo sapiens
agcgucauguccuuggcag

SEQ ID NO: 771747 - RNA, 14 nt, Homo sapiens
agcguuaacacaaa

SEQ ID NO: 771748 - RNA, 16 nt, Homo sapiens
agcguuagggcugcuu

SEQ ID NO: 771749 - RNA, 21 nt, Homo sapiens
agcuaaaaaauuguuaaacuu

SEQ ID NO: 771750 - RNA, 21 nt, Homo sapiens
agcuaaaccaaggacugagca

SEQ ID NO: 771751 - RNA, 16 nt, Homo sapiens
agcuaaacuccuuccu

SEQ ID NO: 771752 - RNA, 16 nt, Homo sapiens
agcuaagacauauuca

SEQ ID NO: 771753 - RNA, 23 nt, Homo sapiens
agcuaaggagucccugguucauu

SEQ ID NO: 771754 - RNA, 23 nt, Homo sapiens
agcuaaggucacauugugccuuu

SEQ ID NO: 771755 - RNA, 20 nt, Homo sapiens
agcuaaguucuaaguucaug

SEQ ID NO: 771756 - RNA, 16 nt, Homo sapiens
agcuaauaagugcuuu

SEQ ID NO: 771757 - RNA, 18 nt, Homo sapiens
ucaccuuggcaccagaca

SEQ ID NO: 771758 - RNA, 17 nt, Homo sapiens
ucaccuugguguuucuc

SEQ ID NO: 771759 - RNA, 21 nt, Homo sapiens
ucacgaggaaaagagaaggaa

SEQ ID NO: 771760 - RNA, 19 nt, Homo sapiens
ucacgccuguaaucccagc

SEQ ID NO: 771761 - RNA, 14 nt, Homo sapiens
ucacggcugcgcac

SEQ ID NO: 771762 - RNA, 22 nt, Homo sapiens
ucacguacaaaacucuguauaa

SEQ ID NO: 771763 - RNA, 15 nt, Homo sapiens
ucacgucacacuugg

SEQ ID NO: 771764 - RNA, 23 nt, Homo sapiens
ucacuaaagcaguagaaauaaua

SEQ ID NO: 771765 - RNA, 15 nt, Homo sapiens
ucacuaaagcaugaa

SEQ ID NO: 771766 - RNA, 19 nt, Homo sapiens
ucacuaaugaucacauucu

SEQ ID NO: 771767 - RNA, 14 nt, Homo sapiens
ucacuacaaccucc

SEQ ID NO: 771768 - RNA, 18 nt, Homo sapiens
ucacuaccuucaugcaua

SEQ ID NO: 771769 - RNA, 20 nt, Homo sapiens
ucacuacugaacacaugugu

SEQ ID NO: 771770 - RNA, 18 nt, Homo sapiens
ucacuaggaggucaucaa

SEQ ID NO: 771771 - RNA, 22 nt, Homo sapiens
ucacuaggcccccacuugccuc

SEQ ID NO: 771772 - RNA, 21 nt, Homo sapiens
ucacuaugaagguaaagggag

SEQ ID NO: 771773 - RNA, 14 nt, Homo sapiens
ucacuauugaugca

SEQ ID NO: 771774 - RNA, 18 nt, Homo sapiens
ucacucaaaugaauuugc

SEQ ID NO: 771775 - RNA, 14 nt, Homo sapiens
ucacucaaccuuau

SEQ ID NO: 771776 - RNA, 13 nt, Homo sapiens
ucacucacacugg

SEQ ID NO: 771777 - RNA, 16 nt, Homo sapiens
ucacucacagagucaa

SEQ ID NO: 771778 - RNA, 17 nt, Homo sapiens
ucacucaccaucuggaa

SEQ ID NO: 771779 - RNA, 15 nt, Homo sapiens
ucacucacucauucc

SEQ ID NO: 771780 - RNA, 14 nt, Homo sapiens
ucacucauccaucc

SEQ ID NO: 771781 - RNA, 18 nt, Homo sapiens
ucacuccccacaucccau

SEQ ID NO: 771782 - RNA, 21 nt, Homo sapiens
ucacucccucugccuucaggc

SEQ ID NO: 771783 - RNA, 23 nt, Homo sapiens
ucacuccuuuuuugcaugugcaa

SEQ ID NO: 771784 - RNA, 23 nt, Homo sapiens
ucacucuguaguuacugugguca

SEQ ID NO: 771785 - RNA, 11 nt, Homo sapiens
ucacucuguca

SEQ ID NO: 771786 - RNA, 16 nt, Homo sapiens
ucacugaaucuucacg

SEQ ID NO: 771787 - RNA, 16 nt, Homo sapiens
ucacugcaaccuccac

SEQ ID NO: 771788 - RNA, 14 nt, Homo sapiens
ucacugcaaccucu

SEQ ID NO: 771789 - RNA, 18 nt, Homo sapiens
ucacugcaacuucugccu

SEQ ID NO: 771790 - RNA, 17 nt, Homo sapiens
ucacugcaaugucaaag

SEQ ID NO: 771791 - RNA, 21 nt, Homo sapiens
ucacugcugcaaauacuguau

SEQ ID NO: 771792 - RNA, 18 nt, Homo sapiens
ucacugcuggcugccuua

SEQ ID NO: 771793 - RNA, 17 nt, Homo sapiens
ucacuggaccacugggc

SEQ ID NO: 771794 - RNA, 12 nt, Homo sapiens
ucacuguacugc

SEQ ID NO: 771795 - RNA, 21 nt, Homo sapiens
ucacuuagaauccgaagggaa

SEQ ID NO: 771796 - RNA, 20 nt, Homo sapiens
ucacuuauuucauaaacaac

SEQ ID NO: 771797 - RNA, 15 nt, Homo sapiens
ucacuucauagcuca

SEQ ID NO: 771798 - RNA, 17 nt, Homo sapiens
agcuucaccagagcauu

SEQ ID NO: 771799 - RNA, 23 nt, Homo sapiens
agcuucaccuuuuugucuuggcu

SEQ ID NO: 771800 - RNA, 21 nt, Homo sapiens
agcuucaggagggaaccagcu

SEQ ID NO: 771801 - RNA, 22 nt, Homo sapiens
agcuucaggagggaaccagcuu

SEQ ID NO: 771802 - RNA, 17 nt, Homo sapiens
agcuuccaaauguguca

SEQ ID NO: 771803 - RNA, 16 nt, Homo sapiens
agcuucccuguauuac

SEQ ID NO: 771804 - RNA, 14 nt, Homo sapiens
agcuucgaugaugu

SEQ ID NO: 771805 - RNA, 16 nt, Homo sapiens
agcuucuaccuggaaa

SEQ ID NO: 771806 - RNA, 16 nt, Homo sapiens
agcuucuaucccagga

SEQ ID NO: 771807 - RNA, 21 nt, Homo sapiens
agcuucucaaaguacugggau

SEQ ID NO: 771808 - RNA, 18 nt, Homo sapiens
agcuucugcccaccuacu

SEQ ID NO: 771809 - RNA, 22 nt, Homo sapiens
agcuucuggagcagaacuuucc

SEQ ID NO: 771810 - RNA, 14 nt, Homo sapiens
agcuugaagcccaa

SEQ ID NO: 771811 - RNA, 17 nt, Homo sapiens
agcuugagcugcucugc

SEQ ID NO: 771812 - RNA, 13 nt, Homo sapiens
agcuugaggccaa

SEQ ID NO: 771813 - RNA, 20 nt, Homo sapiens
agcuugcugucacuucuuca

SEQ ID NO: 771814 - RNA, 22 nt, Homo sapiens
agcuuggaguucucuauacuca

SEQ ID NO: 771815 - RNA, 18 nt, Homo sapiens
agcuuggccuacagucau

SEQ ID NO: 771816 - RNA, 20 nt, Homo sapiens
agcuuguggccccuuuuacu

SEQ ID NO: 771817 - RNA, 12 nt, Homo sapiens
agcuuguugaaa

SEQ ID NO: 771818 - RNA, 18 nt, Homo sapiens
agcuuuaaaaccacagcu

SEQ ID NO: 771819 - RNA, 22 nt, Homo sapiens
agcuuuaccagguuguccucaa

SEQ ID NO: 771820 - RNA, 14 nt, Homo sapiens
agcuuuacuacugu

SEQ ID NO: 771821 - RNA, 15 nt, Homo sapiens
agcuuucaagcucau

SEQ ID NO: 771822 - RNA, 21 nt, Homo sapiens
agcuuuccuuucuccaugugu

SEQ ID NO: 771823 - RNA, 12 nt, Homo sapiens
agcuuucugucc

SEQ ID NO: 771824 - RNA, 21 nt, Homo sapiens
agcuuugaaugcagaagcaaa

SEQ ID NO: 771825 - RNA, 20 nt, Homo sapiens
agcuuugaugauaaacacug

SEQ ID NO: 771826 - RNA, 12 nt, Homo sapiens
agcuuugcacuu

SEQ ID NO: 771827 - RNA, 23 nt, Homo sapiens
agcuuugcuccgcucccaccgcc

SEQ ID NO: 771828 - RNA, 16 nt, Homo sapiens
agcuuugcugccugag

SEQ ID NO: 771829 - RNA, 20 nt, Homo sapiens
agcuuuggaauauuuuaucc

SEQ ID NO: 771830 - RNA, 19 nt, Homo sapiens
agcuuuggaccuaauccaa

SEQ ID NO: 771831 - RNA, 18 nt, Homo sapiens
agcuuugggugaccagcc

SEQ ID NO: 771832 - RNA, 22 nt, Homo sapiens
agcuuugugcuugucauuccag

SEQ ID NO: 771833 - RNA, 23 nt, Homo sapiens
agcuuugugcuugucauuccaga

SEQ ID NO: 771834 - RNA, 14 nt, Homo sapiens
agcuuugugucguc

SEQ ID NO: 771835 - RNA, 20 nt, Homo sapiens
agcuuuuagaaaaugcaguc

SEQ ID NO: 771836 - RNA, 23 nt, Homo sapiens
agcuuuuuaauuaaaugaagcca

SEQ ID NO: 771837 - RNA, 18 nt, Homo sapiens
aggaaaaaaagcaaaaag

SEQ ID NO: 771838 - RNA, 15 nt, Homo sapiens
aggaaaaaaaugacu

SEQ ID NO: 771839 - RNA, 23 nt, Homo sapiens
aggaaaaaagaaaaaagcaauua

SEQ ID NO: 771840 - RNA, 15 nt, Homo sapiens
aggaaaaauaaucaa

SEQ ID NO: 771841 - RNA, 19 nt, Homo sapiens
aggaaaaaugaggaaucca

SEQ ID NO: 771842 - RNA, 13 nt, Homo sapiens
aggaaaaauugau

SEQ ID NO: 771843 - RNA, 19 nt, Homo sapiens
aggaaaacacuauuuccaa

SEQ ID NO: 771844 - RNA, 17 nt, Homo sapiens
aggaaaaggcugguaca

SEQ ID NO: 771845 - RNA, 17 nt, Homo sapiens
aggaaaagguugaauaa

SEQ ID NO: 771846 - RNA, 17 nt, Homo sapiens
aggaaaaucacaucucc

SEQ ID NO: 771847 - RNA, 16 nt, Homo sapiens
aggaaaaugauacgca

SEQ ID NO: 771848 - RNA, 13 nt, Homo sapiens
aggaaaaugggua

SEQ ID NO: 771849 - RNA, 22 nt, Homo sapiens
aggaaacaaggggucugaggau

SEQ ID NO: 771850 - RNA, 17 nt, Homo sapiens
aggaaacccccagugua

SEQ ID NO: 771851 - RNA, 22 nt, Homo sapiens
aggaaacccccaguguaauaau

SEQ ID NO: 771852 - RNA, 16 nt, Homo sapiens
aggaaagcagcauucu

SEQ ID NO: 771853 - RNA, 23 nt, Homo sapiens
aggaaaggaugguagauucuguu

SEQ ID NO: 771854 - RNA, 18 nt, Homo sapiens
aggaaagggauaguccaa

SEQ ID NO: 771855 - RNA, 23 nt, Homo sapiens
aggaaagggauaguccaaagacu

SEQ ID NO: 771856 - RNA, 21 nt, Homo sapiens
aggaaaggggcgagcacccac

SEQ ID NO: 771857 - RNA, 20 nt, Homo sapiens
aggaaauaccaaaugcauug

SEQ ID NO: 771858 - RNA, 18 nt, Homo sapiens
aggaaauauauaugugug

SEQ ID NO: 771859 - RNA, 17 nt, Homo sapiens
aggaaauaucaaagugu

SEQ ID NO: 771860 - RNA, 22 nt, Homo sapiens
aggaaauuaucaacauaccuug

SEQ ID NO: 771861 - RNA, 14 nt, Homo sapiens
aggaacaaagacag

SEQ ID NO: 771862 - RNA, 18 nt, Homo sapiens
aggaacaaauaaacucau

SEQ ID NO: 771863 - RNA, 13 nt, Homo sapiens
aggaacauuccuu

SEQ ID NO: 771864 - RNA, 15 nt, Homo sapiens
aggaaccacaauguu

SEQ ID NO: 771865 - RNA, 19 nt, Homo sapiens
aggaacguggucaacucac

SEQ ID NO: 771866 - RNA, 14 nt, Homo sapiens
aggaacuaagucag

SEQ ID NO: 771867 - RNA, 15 nt, Homo sapiens
aggaacuagaaagaa

SEQ ID NO: 771868 - RNA, 23 nt, Homo sapiens
aggaacuauguucacaagaacaa

SEQ ID NO: 771869 - RNA, 12 nt, Homo sapiens
aggaacuguaca

SEQ ID NO: 771870 - RNA, 18 nt, Homo sapiens
aggaagaaaagcugccau

SEQ ID NO: 771871 - RNA, 13 nt, Homo sapiens
cucaucacuggau

SEQ ID NO: 771872 - RNA, 14 nt, Homo sapiens
cucaucaggccauu

SEQ ID NO: 771873 - RNA, 23 nt, Homo sapiens
cucaucaggccauugucccugaa

SEQ ID NO: 771874 - RNA, 22 nt, Homo sapiens
cucaucauagcaauaacauucc

SEQ ID NO: 771875 - RNA, 14 nt, Homo sapiens
cucaucauuccuug

SEQ ID NO: 771876 - RNA, 22 nt, Homo sapiens
cucaaugcaguuagcugaagaa

SEQ ID NO: 771877 - RNA, 14 nt, Homo sapiens
cucaauucacauag

SEQ ID NO: 771878 - RNA, 21 nt, Homo sapiens
cucaauucuuuguauaugcau

SEQ ID NO: 771879 - RNA, 23 nt, Homo sapiens
cucaauuuaguuuguuauuuauc

SEQ ID NO: 771880 - RNA, 21 nt, Homo sapiens
cucaauuuugucuguacucau

SEQ ID NO: 771881 - RNA, 23 nt, Homo sapiens
cucaauuuugucuguacucaugu

SEQ ID NO: 771882 - RNA, 19 nt, Homo sapiens
cuacugcuggaaaaagccc

SEQ ID NO: 771883 - RNA, 15 nt, Homo sapiens
cuacuggaauggugu

SEQ ID NO: 771884 - RNA, 23 nt, Homo sapiens
cuacugucuauuaaaauucugau

SEQ ID NO: 771885 - RNA, 12 nt, Homo sapiens
cuacuguucuaa

SEQ ID NO: 771886 - RNA, 15 nt, Homo sapiens
cuacuuaaugagaua

SEQ ID NO: 771887 - RNA, 21 nt, Homo sapiens
cuacuuagagauauguaucau

SEQ ID NO: 771888 - RNA, 19 nt, Homo sapiens
cuacuuauuuaaugauaaa

SEQ ID NO: 771889 - RNA, 20 nt, Homo sapiens
cuacuugggaggcugaggca

SEQ ID NO: 771890 - RNA, 20 nt, Homo sapiens
acaguugggacccaaaacac

SEQ ID NO: 771891 - RNA, 18 nt, Homo sapiens
acaguugguucaucccuu

SEQ ID NO: 771892 - RNA, 22 nt, Homo sapiens
acaguuuagugcuuuacaugcu

SEQ ID NO: 771893 - RNA, 18 nt, Homo sapiens
acaguuucuugcuuggaa

SEQ ID NO: 771894 - RNA, 17 nt, Homo sapiens
acaguuuuaacugugga

SEQ ID NO: 771895 - RNA, 16 nt, Homo sapiens
acauaaaaacaacuuu

SEQ ID NO: 771896 - RNA, 20 nt, Homo sapiens
acauaaaacaaaaccaagcc

SEQ ID NO: 771897 - RNA, 21 nt, Homo sapiens
acauaaaauaagagauccuuu

SEQ ID NO: 771898 - RNA, 13 nt, Homo sapiens
acauaacauucaa

SEQ ID NO: 771899 - RNA, 13 nt, Homo sapiens
acauaacuugaua

SEQ ID NO: 771900 - RNA, 21 nt, Homo sapiens
acauaaguguugguagcacuu

SEQ ID NO: 771901 - RNA, 17 nt, Homo sapiens
acauaaucuaguuuaca

SEQ ID NO: 771902 - RNA, 16 nt, Homo sapiens
acauaauugugaccaa

SEQ ID NO: 771903 - RNA, 19 nt, Homo sapiens
acauaauugugaccaauac

SEQ ID NO: 771904 - RNA, 22 nt, Homo sapiens
acauacaccucgucaagagcau

SEQ ID NO: 771905 - RNA, 19 nt, Homo sapiens
acauacaggccauacuuua

SEQ ID NO: 771906 - RNA, 22 nt, Homo sapiens
acauaccuggcccugugccuug

SEQ ID NO: 771907 - RNA, 14 nt, Homo sapiens
acauaccuucaugu

SEQ ID NO: 771908 - RNA, 16 nt, Homo sapiens
acauacuccuuccauc

SEQ ID NO: 771909 - RNA, 21 nt, Homo sapiens
acauacucugcuuagaauuug

SEQ ID NO: 771910 - RNA, 18 nt, Homo sapiens
acauagaugucccuuucu

SEQ ID NO: 771911 - RNA, 19 nt, Homo sapiens
acauagauuaauggcacug

SEQ ID NO: 771912 - RNA, 13 nt, Homo sapiens
acauagugaaaau

SEQ ID NO: 771913 - RNA, 12 nt, Homo sapiens
acauagugagac

SEQ ID NO: 771914 - RNA, 22 nt, Homo sapiens
acauaguuuauuucaacuauuu

SEQ ID NO: 771915 - RNA, 22 nt, Homo sapiens
acauauaaaauguaauuacuua

SEQ ID NO: 771916 - RNA, 13 nt, Homo sapiens
acauauaacaugc

SEQ ID NO: 771917 - RNA, 21 nt, Homo sapiens
acauauauaagguaugugcua

SEQ ID NO: 771918 - RNA, 22 nt, Homo sapiens
acauauauacccacauguacag

SEQ ID NO: 771919 - RNA, 18 nt, Homo sapiens
acauauauauuaauacug

SEQ ID NO: 771920 - RNA, 17 nt, Homo sapiens
acauauaucaaagugag

SEQ ID NO: 771921 - RNA, 20 nt, Homo sapiens
acauaucaccucauggccua

SEQ ID NO: 771922 - RNA, 18 nt, Homo sapiens
acauaucuaguaugaaau

SEQ ID NO: 771923 - RNA, 17 nt, Homo sapiens
acauauggacucugcac

SEQ ID NO: 771924 - RNA, 20 nt, Homo sapiens
acauauguaauucuuuccau

SEQ ID NO: 771925 - RNA, 17 nt, Homo sapiens
acauauguauacaugug

SEQ ID NO: 771926 - RNA, 16 nt, Homo sapiens
acauauguugcaagac

SEQ ID NO: 771927 - RNA, 23 nt, Homo sapiens
acauauuacuguugcauuuacuu

SEQ ID NO: 771928 - RNA, 22 nt, Homo sapiens
acauauuccaugggacuuuccu

SEQ ID NO: 771929 - RNA, 23 nt, Homo sapiens
acauauucuaguguaacacugca

SEQ ID NO: 771930 - RNA, 18 nt, Homo sapiens
acauauuguaaagcccau

SEQ ID NO: 771931 - RNA, 23 nt, Homo sapiens
acauauuuuuauacuuuauugaa

SEQ ID NO: 771932 - RNA, 15 nt, Homo sapiens
acaucaaaccugagu

SEQ ID NO: 771933 - RNA, 19 nt, Homo sapiens
acaucaaagccuggccuaa

SEQ ID NO: 771934 - RNA, 19 nt, Homo sapiens
acaucaaagugguaaauac

SEQ ID NO: 771935 - RNA, 21 nt, Homo sapiens
acaucaaguaugguaggggag

SEQ ID NO: 771936 - RNA, 20 nt, Homo sapiens
acaucacuuguacaaaauaa

SEQ ID NO: 771937 - RNA, 18 nt, Homo sapiens
acaucagaccugucuucc

SEQ ID NO: 771938 - RNA, 15 nt, Homo sapiens
acaucagcaagacuu

SEQ ID NO: 771939 - RNA, 24 nt, Homo sapiens
acaucagcaagacuuuauaauucc

SEQ ID NO: 771940 - RNA, 14 nt, Homo sapiens
acaucagcagagaa

SEQ ID NO: 771941 - RNA, 15 nt, Homo sapiens
acaucaggaguucaa

SEQ ID NO: 771942 - RNA, 12 nt, Homo sapiens
acaucauggacu

SEQ ID NO: 771943 - RNA, 22 nt, Homo sapiens
acaucauuagaacaaaggacag

SEQ ID NO: 771944 - RNA, 17 nt, Homo sapiens
acauccaacuccagcaa

SEQ ID NO: 771945 - RNA, 15 nt, Homo sapiens
acauccaucccucca

SEQ ID NO: 771946 - RNA, 13 nt, Homo sapiens
acaucccacagug

SEQ ID NO: 771947 - RNA, 22 nt, Homo sapiens
acaucccaguccaccugaggaa

SEQ ID NO: 771948 - RNA, 16 nt, Homo sapiens
acaucccauugcccug

SEQ ID NO: 771949 - RNA, 20 nt, Homo sapiens
acauccccuuuguguagaaa

SEQ ID NO: 771950 - RNA, 22 nt, Homo sapiens
acauccuaccccuuugcacuug

SEQ ID NO: 771951 - RNA, 20 nt, Homo sapiens
acauccuccagauaguguag

SEQ ID NO: 771952 - RNA, 17 nt, Homo sapiens
acaucgucuacaaggag

SEQ ID NO: 771953 - RNA, 19 nt, Homo sapiens
acaucuaaaagaugaaguu

SEQ ID NO: 771954 - RNA, 20 nt, Homo sapiens
acaucucaaggagggagaac

SEQ ID NO: 771955 - RNA, 18 nt, Homo sapiens
acaucucgggaguccucu

SEQ ID NO: 771956 - RNA, 18 nt, Homo sapiens
acaucugagagaugacag

SEQ ID NO: 771957 - RNA, 13 nt, Homo sapiens
acaucugcaauau

SEQ ID NO: 771958 - RNA, 19 nt, Homo sapiens
acaucuugaauccuuccau

SEQ ID NO: 771959 - RNA, 23 nt, Homo sapiens
acaucuuggucagauuugaacuc

SEQ ID NO: 771960 - RNA, 16 nt, Homo sapiens
acaucuuguaacuuaa

SEQ ID NO: 771961 - RNA, 20 nt, Homo sapiens
acaucuuuagugucugagcu

SEQ ID NO: 771962 - RNA, 16 nt, Homo sapiens
acaucuuucacacuuc

SEQ ID NO: 771963 - RNA, 18 nt, Homo sapiens
acaucuuucacacuucca

SEQ ID NO: 771964 - RNA, 17 nt, Homo sapiens
acaucuuuuacauucug

SEQ ID NO: 771965 - RNA, 19 nt, Homo sapiens
acaugaaaggacccuguga

SEQ ID NO: 771966 - RNA, 15 nt, Homo sapiens
acaugaaaguuuugc

SEQ ID NO: 771967 - RNA, 23 nt, Homo sapiens
acaugaaucccacccacauguga

SEQ ID NO: 771968 - RNA, 21 nt, Homo sapiens
acaugacauucuuagcuguaa

SEQ ID NO: 771969 - RNA, 22 nt, Homo sapiens
acaugagauguguggacugugg

SEQ ID NO: 771970 - RNA, 16 nt, Homo sapiens
acaugaggccaucuca

SEQ ID NO: 771971 - RNA, 12 nt, Homo sapiens
ccguacauucaa

SEQ ID NO: 771972 - RNA, 16 nt, Homo sapiens
ccguaccccacccuca

SEQ ID NO: 771973 - RNA, 17 nt, Homo sapiens
ccgucagagcagugacc

SEQ ID NO: 771974 - RNA, 12 nt, Homo sapiens
ccguccacccuu

SEQ ID NO: 771975 - RNA, 22 nt, Homo sapiens
ccgucgucucuucugggcaccc

SEQ ID NO: 771976 - RNA, 12 nt, Homo sapiens
ccgucucaagga

SEQ ID NO: 771977 - RNA, 23 nt, Homo sapiens
ccgucuuggcuuauccacuuuga

SEQ ID NO: 771978 - RNA, 13 nt, Homo sapiens
ccgugacugcaau

SEQ ID NO: 771979 - RNA, 14 nt, Homo sapiens
ccgugggcaucuca

SEQ ID NO: 771980 - RNA, 17 nt, Homo sapiens
ccguguccagcacagaa

SEQ ID NO: 771981 - RNA, 14 nt, Homo sapiens
ccguguggacugug

SEQ ID NO: 771982 - RNA, 19 nt, Homo sapiens
ccguguucaaagagcaaua

SEQ ID NO: 771983 - RNA, 19 nt, Homo sapiens
ccguuuccucuuuaacuga

SEQ ID NO: 771984 - RNA, 20 nt, Homo sapiens
ccguuuuuuucuuuccugua

SEQ ID NO: 771985 - RNA, 17 nt, Homo sapiens
ccuaaaauuguaugaaa

SEQ ID NO: 771986 - RNA, 21 nt, Homo sapiens
ccuaaaauuguaugaaaaucc

SEQ ID NO: 771987 - RNA, 15 nt, Homo sapiens
ccuaaagacuguaua

SEQ ID NO: 771988 - RNA, 13 nt, Homo sapiens
ccuaaagcagcca

SEQ ID NO: 771989 - RNA, 16 nt, Homo sapiens
ccuaaauaaaugagcu

SEQ ID NO: 771990 - RNA, 22 nt, Homo sapiens
cccugagauacuucccaaagcc

SEQ ID NO: 771991 - RNA, 13 nt, Homo sapiens
cccugagcaaugu

SEQ ID NO: 771992 - RNA, 21 nt, Homo sapiens
cccugaggauggccuggauuc

SEQ ID NO: 771993 - RNA, 16 nt, Homo sapiens
cccugaguucauccag

SEQ ID NO: 771994 - RNA, 14 nt, Homo sapiens
cccugaucaaguca

SEQ ID NO: 771995 - RNA, 19 nt, Homo sapiens
cccugauuguguauauuca

SEQ ID NO: 771996 - RNA, 18 nt, Homo sapiens
cccugcaccaugcugcug

SEQ ID NO: 771997 - RNA, 15 nt, Homo sapiens
cccugcccaccaaga

SEQ ID NO: 771998 - RNA, 17 nt, Homo sapiens
cccugccccguggagcc

SEQ ID NO: 771999 - RNA, 15 nt, Homo sapiens
cccugccccugccuu

SEQ ID NO: 772000 - RNA, 16 nt, Homo sapiens
cccugccuccugccac

SEQ ID NO: 772001 - RNA, 19 nt, Homo sapiens
cccugcuaaggaguucuca

SEQ ID NO: 772002 - RNA, 15 nt, Homo sapiens
cccugcucauccacu

SEQ ID NO: 772003 - RNA, 16 nt, Homo sapiens
cccugcucccauuccu

SEQ ID NO: 772004 - RNA, 13 nt, Homo sapiens
cccugcugaccuc

SEQ ID NO: 772005 - RNA, 22 nt, Homo sapiens
cccugcugaccucccagugacc

SEQ ID NO: 772006 - RNA, 16 nt, Homo sapiens
cccugcugcuggugca

SEQ ID NO: 772007 - RNA, 22 nt, Homo sapiens
cccugcuuuuugcuucuugagu

SEQ ID NO: 772008 - RNA, 22 nt, Homo sapiens
cccuggcccugccucauccacc

SEQ ID NO: 772009 - RNA, 19 nt, Homo sapiens
cccuggccuccccugccac

SEQ ID NO: 772010 - RNA, 14 nt, Homo sapiens
cccugggacaucag

SEQ ID NO: 772011 - RNA, 21 nt, Homo sapiens
cccugggaggagagaaggggg

SEQ ID NO: 772012 - RNA, 17 nt, Homo sapiens
cccuggggaaggagcca

SEQ ID NO: 772013 - RNA, 18 nt, Homo sapiens
cccuggguguccccgcug

SEQ ID NO: 772014 - RNA, 20 nt, Homo sapiens
cccuggugccucugugcaca

SEQ ID NO: 772015 - RNA, 21 nt, Homo sapiens
cccuggugccucugugcacag

SEQ ID NO: 772016 - RNA, 22 nt, Homo sapiens
cccugguggagaaagcacugac

SEQ ID NO: 772017 - RNA, 19 nt, Homo sapiens
cccugguggggugugcaug

SEQ ID NO: 772018 - RNA, 21 nt, Homo sapiens
cccuguaggguccaaccagac

SEQ ID NO: 772019 - RNA, 22 nt, Homo sapiens
cccugucccuucgaguccagga

SEQ ID NO: 772020 - RNA, 20 nt, Homo sapiens
cccugucucggggcuugccc

SEQ ID NO: 772021 - RNA, 17 nt, Homo sapiens
cccugucucuacaaaaa

SEQ ID NO: 772022 - RNA, 17 nt, Homo sapiens
cccugucucuacuaaaa

SEQ ID NO: 772023 - RNA, 14 nt, Homo sapiens
cccugucugaagga

SEQ ID NO: 772024 - RNA, 12 nt, Homo sapiens
cccugucuugcu

SEQ ID NO: 772025 - RNA, 19 nt, Homo sapiens
cccugugcaggagcuaguu

SEQ ID NO: 772026 - RNA, 20 nt, Homo sapiens
cccugugccagaccucaaaa

SEQ ID NO: 772027 - RNA, 12 nt, Homo sapiens
cccugugccugg

SEQ ID NO: 772028 - RNA, 14 nt, Homo sapiens
cccuguggcacuca

SEQ ID NO: 772029 - RNA, 21 nt, Homo sapiens
cccuguggccaacugcaaaaa

SEQ ID NO: 772030 - RNA, 22 nt, Homo sapiens
cccuguggccaacugcaaaaaa

SEQ ID NO: 772031 - RNA, 13 nt, Homo sapiens
cccugugggucaa

SEQ ID NO: 772032 - RNA, 16 nt, Homo sapiens
cccuguuagugcacug

SEQ ID NO: 772033 - RNA, 20 nt, Homo sapiens
cccuguucaaagaugcauuu

SEQ ID NO: 772034 - RNA, 14 nt, Homo sapiens
cccuguucaugccg

SEQ ID NO: 772035 - RNA, 23 nt, Homo sapiens
cccuguuuaaagauuucaagaag

SEQ ID NO: 772036 - RNA, 19 nt, Homo sapiens
cccuguuucucuugaagaa

SEQ ID NO: 772037 - RNA, 23 nt, Homo sapiens
cccuguuuucugagcccgggcug

SEQ ID NO: 772038 - RNA, 20 nt, Homo sapiens
cccuuaauuauuaacaaagu

SEQ ID NO: 772039 - RNA, 17 nt, Homo sapiens
cccuuacccucccacca

SEQ ID NO: 772040 - RNA, 17 nt, Homo sapiens
cccuuacuaugaucuca

SEQ ID NO: 772041 - RNA, 16 nt, Homo sapiens
cccuuauuuucaagaa

SEQ ID NO: 772042 - RNA, 20 nt, Homo sapiens
cccuucauccgccugugggc

SEQ ID NO: 772043 - RNA, 17 nt, Homo sapiens
cccuuccaugugccuuu

SEQ ID NO: 772044 - RNA, 19 nt, Homo sapiens
cccuuccuaccucugguga

SEQ ID NO: 772045 - RNA, 21 nt, Homo sapiens
cccuuccucagaacuuucuag

SEQ ID NO: 772046 - RNA, 17 nt, Homo sapiens
cccuucuggacacugag

SEQ ID NO: 772047 - RNA, 13 nt, Homo sapiens
cccuugcagcuag

SEQ ID NO: 772048 - RNA, 23 nt, Homo sapiens
cccuugccauccuaaaagccacc

SEQ ID NO: 772049 - RNA, 13 nt, Homo sapiens
cccuugcugcuuu

SEQ ID NO: 772050 - RNA, 12 nt, Homo sapiens
cccuugcuguac

SEQ ID NO: 772051 - RNA, 23 nt, Homo sapiens
cccuuggagagagaggcugccuc

SEQ ID NO: 772052 - RNA, 16 nt, Homo sapiens
cccuuggcccaucugu

SEQ ID NO: 772053 - RNA, 18 nt, Homo sapiens
cccuuggcuucugugaug

SEQ ID NO: 772054 - RNA, 16 nt, Homo sapiens
cccuugguacugaaaa

SEQ ID NO: 772055 - RNA, 14 nt, Homo sapiens
cccuugucaucucu

SEQ ID NO: 772056 - RNA, 15 nt, Homo sapiens
cccuuuaacucauga

SEQ ID NO: 772057 - RNA, 22 nt, Homo sapiens
cccuuuauuacaagaaggaaca

SEQ ID NO: 772058 - RNA, 21 nt, Homo sapiens
cccuuuccuccucaggcacac

SEQ ID NO: 772059 - RNA, 12 nt, Homo sapiens
cccuuuuacuuu

SEQ ID NO: 772060 - RNA, 19 nt, Homo sapiens
ccgaaaaggauaugcagua

SEQ ID NO: 772061 - RNA, 12 nt, Homo sapiens
ccgaacaccauu

SEQ ID NO: 772062 - RNA, 18 nt, Homo sapiens
ccgaacuuuaauuucagg

SEQ ID NO: 772063 - RNA, 18 nt, Homo sapiens
ccgaaggguuuugcuaca

SEQ ID NO: 772064 - RNA, 15 nt, Homo sapiens
ccgaaguaaacugau

SEQ ID NO: 772065 - RNA, 12 nt, Homo sapiens
ccgaauccacag

SEQ ID NO: 772066 - RNA, 22 nt, Homo sapiens
ccgacggugggcauuugugagg

SEQ ID NO: 772067 - RNA, 13 nt, Homo sapiens
ccgacugccugug

SEQ ID NO: 772068 - RNA, 12 nt, Homo sapiens
ccgagcaaagau

SEQ ID NO: 772069 - RNA, 17 nt, Homo sapiens
ccgaggaaccuacugcc

SEQ ID NO: 772070 - RNA, 17 nt, Homo sapiens
ccgaggacaguggcaga

SEQ ID NO: 772071 - RNA, 16 nt, Homo sapiens
ccgagucuugcucugu

SEQ ID NO: 772072 - RNA, 13 nt, Homo sapiens
ccgagugcacugc

SEQ ID NO: 772073 - RNA, 22 nt, Homo sapiens
ccgauaccgggacacagaauua

SEQ ID NO: 772074 - RNA, 14 nt, Homo sapiens
ccgaugguccucac

SEQ ID NO: 772075 - RNA, 14 nt, Homo sapiens
ccgcaaagacauca

SEQ ID NO: 772076 - RNA, 21 nt, Homo sapiens
ccgcacugucccaguagccaa

SEQ ID NO: 772077 - RNA, 18 nt, Homo sapiens
ccgcagugggaagugaau

SEQ ID NO: 772078 - RNA, 12 nt, Homo sapiens
ccgccaccucag

SEQ ID NO: 772079 - RNA, 14 nt, Homo sapiens
ccgccagaccucaa

SEQ ID NO: 772080 - RNA, 17 nt, Homo sapiens
ccgccagcgaacuugac

SEQ ID NO: 772081 - RNA, 12 nt, Homo sapiens
ccgccauccacc

SEQ ID NO: 772082 - RNA, 21 nt, Homo sapiens
ccgccauggugcuggggagcc

SEQ ID NO: 772083 - RNA, 15 nt, Homo sapiens
ccgcccgcacagcuc

SEQ ID NO: 772084 - RNA, 11 nt, Homo sapiens
ccgccucacac

SEQ ID NO: 772085 - RNA, 16 nt, Homo sapiens
ccgccuuccaaaaccu

SEQ ID NO: 772086 - RNA, 14 nt, Homo sapiens
ccgcugucucugag

SEQ ID NO: 772087 - RNA, 14 nt, Homo sapiens
ccgcuuguacccag

SEQ ID NO: 772088 - RNA, 14 nt, Homo sapiens
ccgcuuucucugag

SEQ ID NO: 772089 - RNA, 19 nt, Homo sapiens
ccggaaggaaugucagggc

SEQ ID NO: 772090 - RNA, 21 nt, Homo sapiens
ccggaguucugcccaugggaa

SEQ ID NO: 772091 - RNA, 14 nt, Homo sapiens
ccggcgucuugccc

SEQ ID NO: 772092 - RNA, 16 nt, Homo sapiens
ccggcgucuugcccag

SEQ ID NO: 772093 - RNA, 22 nt, Homo sapiens
ccggcgucuugcccagcagcuc

SEQ ID NO: 772094 - RNA, 16 nt, Homo sapiens
ccggcugaggccugag

SEQ ID NO: 772095 - RNA, 18 nt, Homo sapiens
ccggcuuccacuccccac

SEQ ID NO: 772096 - RNA, 16 nt, Homo sapiens
ccgggcugcugcugau

SEQ ID NO: 772097 - RNA, 19 nt, Homo sapiens
ccgggcuggccugugccua

SEQ ID NO: 772098 - RNA, 15 nt, Homo sapiens
ccggggaaaggcaag

SEQ ID NO: 772099 - RNA, 15 nt, Homo sapiens
ccggggccagcacuu

SEQ ID NO: 772100 - RNA, 20 nt, Homo sapiens
ccgggucaucuguaccucug

SEQ ID NO: 772101 - RNA, 14 nt, Homo sapiens
ccggugugccugug

SEQ ID NO: 772102 - RNA, 17 nt, Homo sapiens
ccgguucaggaccacuu

SEQ ID NO: 772103 - RNA, 12 nt, Homo sapiens
ccguaacaacug

SEQ ID NO: 772104 - RNA, 17 nt, Homo sapiens
ccguaacaacugugguc

SEQ ID NO: 772105 - RNA, 15 nt, Homo sapiens
aagcauucuuuaaca

SEQ ID NO: 772106 - RNA, 20 nt, Homo sapiens
aagcauuugcaacagcuaca

SEQ ID NO: 772107 - RNA, 21 nt, Homo sapiens
aagcauuugcaacagcuacag

SEQ ID NO: 772108 - RNA, 11 nt, Homo sapiens
aagccaaagaa

SEQ ID NO: 772109 - RNA, 23 nt, Homo sapiens
aagccaauaccguguggcccaag

SEQ ID NO: 772110 - RNA, 21 nt, Homo sapiens
aagccacauuauuucuagucc

SEQ ID NO: 772111 - RNA, 16 nt, Homo sapiens
aagccaggauuguguu

SEQ ID NO: 772112 - RNA, 22 nt, Homo sapiens
aagccauaguggagagaacuga

SEQ ID NO: 772113 - RNA, 23 nt, Homo sapiens
aagccauaguggagagaacugaa

SEQ ID NO: 772114 - RNA, 12 nt, Homo sapiens
aagccaugugcu

SEQ ID NO: 772115 - RNA, 22 nt, Homo sapiens
aagcccagcacuugaauuguua

SEQ ID NO: 772116 - RNA, 14 nt, Homo sapiens
aagcccagcuccag

SEQ ID NO: 772117 - RNA, 22 nt, Homo sapiens
aagcccaggguccacugaaggg

SEQ ID NO: 772118 - RNA, 14 nt, Homo sapiens
aagcccaguucauc

SEQ ID NO: 772119 - RNA, 23 nt, Homo sapiens
aagccccuuacuaugaucucagg

SEQ ID NO: 772120 - RNA, 23 nt, Homo sapiens
aagcccugauguguccucaggga

SEQ ID NO: 772121 - RNA, 20 nt, Homo sapiens
aagcccuuccuaccucuggu

SEQ ID NO: 772122 - RNA, 21 nt, Homo sapiens
aagccuaaagauuuugaucuc

SEQ ID NO: 772123 - RNA, 17 nt, Homo sapiens
aagccucagaaagggau

SEQ ID NO: 772124 - RNA, 15 nt, Homo sapiens
aagccuccaaggguu

SEQ ID NO: 772125 - RNA, 13 nt, Homo sapiens
aagccucucucuc

SEQ ID NO: 772126 - RNA, 22 nt, Homo sapiens
aagccucuggucacauggcugu

SEQ ID NO: 772127 - RNA, 21 nt, Homo sapiens
aagccugccgaaaacaggagc

SEQ ID NO: 772128 - RNA, 13 nt, Homo sapiens
aagccuugccuaa

SEQ ID NO: 772129 - RNA, 20 nt, Homo sapiens
aagcgagaucccaucucuac

SEQ ID NO: 772130 - RNA, 13 nt, Homo sapiens
aagcguccucuca

SEQ ID NO: 772131 - RNA, 13 nt, Homo sapiens
aagcuaaauuaca

SEQ ID NO: 772132 - RNA, 13 nt, Homo sapiens
aagcuaucugugc

SEQ ID NO: 772133 - RNA, 23 nt, Homo sapiens
aagcucacuggccacaauaccca

SEQ ID NO: 772134 - RNA, 18 nt, Homo sapiens
aagcucauaaacugccaa

SEQ ID NO: 772135 - RNA, 15 nt, Homo sapiens
aagcucaugagauga

SEQ ID NO: 772136 - RNA, 16 nt, Homo sapiens
aagcucuacauuugca

SEQ ID NO: 772137 - RNA, 12 nt, Homo sapiens
aagcucuaguuc

SEQ ID NO: 772138 - RNA, 19 nt, Homo sapiens
aagcucuaguucuuaacaa

SEQ ID NO: 772139 - RNA, 17 nt, Homo sapiens
aagcucuauuaagauuu

SEQ ID NO: 772140 - RNA, 15 nt, Homo sapiens
aagcucugaccacuu

SEQ ID NO: 772141 - RNA, 20 nt, Homo sapiens
aagcucuggugacaccagcc

SEQ ID NO: 772142 - RNA, 21 nt, Homo sapiens
aagcucuggugacaccagccu

SEQ ID NO: 772143 - RNA, 22 nt, Homo sapiens
aagcucuggugacaccagccuu

SEQ ID NO: 772144 - RNA, 21 nt, Homo sapiens
aagcucuucacugaaacuggu

SEQ ID NO: 772145 - RNA, 19 nt, Homo sapiens
aagcucuuuaugacuguuu

SEQ ID NO: 772146 - RNA, 20 nt, Homo sapiens
aagcugaagaccauggauuu

SEQ ID NO: 772147 - RNA, 16 nt, Homo sapiens
aagcugaccccaaaga

SEQ ID NO: 772148 - RNA, 15 nt, Homo sapiens
aagcugcacaugugc

SEQ ID NO: 772149 - RNA, 23 nt, Homo sapiens
aagcugcacaugugccacacagu

SEQ ID NO: 772150 - RNA, 14 nt, Homo sapiens
aagcugccauauau

SEQ ID NO: 772151 - RNA, 22 nt, Homo sapiens
aagcugcuggagcccgcacugu

SEQ ID NO: 772152 - RNA, 16 nt, Homo sapiens
aagcuggaacauuuga

SEQ ID NO: 772153 - RNA, 23 nt, Homo sapiens
aagcuggaagaagugagcagugu

SEQ ID NO: 772154 - RNA, 16 nt, Homo sapiens
aagcuggagugcagug

SEQ ID NO: 772155 - RNA, 17 nt, Homo sapiens
aagcuggagugcagugg

SEQ ID NO: 772156 - RNA, 20 nt, Homo sapiens
aagcuggagugcaguggcau

SEQ ID NO: 772157 - RNA, 16 nt, Homo sapiens
aagcuggcuuuuccca

SEQ ID NO: 772158 - RNA, 22 nt, Homo sapiens
aagcuggugccccacugaauuu

SEQ ID NO: 772159 - RNA, 23 nt, Homo sapiens
aagcuguguccuugcaccugcau

SEQ ID NO: 772160 - RNA, 16 nt, Homo sapiens
aagcuguuaggcucac

SEQ ID NO: 772161 - RNA, 19 nt, Homo sapiens
aagcuguuauuucuucccu

SEQ ID NO: 772162 - RNA, 18 nt, Homo sapiens
aagcuuaauuaaguacaa

SEQ ID NO: 772163 - RNA, 16 nt, Homo sapiens
aagcuucauguuugau

SEQ ID NO: 772164 - RNA, 16 nt, Homo sapiens
aagcuugaggccaaga

SEQ ID NO: 772165 - RNA, 14 nt, Homo sapiens
aagcuugucaaaga

SEQ ID NO: 772166 - RNA, 20 nt, Homo sapiens
aagcuuuaggaugacuguau

SEQ ID NO: 772167 - RNA, 14 nt, Homo sapiens
aagcuuuggacaag

SEQ ID NO: 772168 - RNA, 23 nt, Homo sapiens
aagcuuuucuuuuuuaauuucca

SEQ ID NO: 772169 - RNA, 22 nt, Homo sapiens
aagcuuuuggagggugauauaa

SEQ ID NO: 772170 - RNA, 21 nt, Homo sapiens
aagcuuuuuauuccuccugcu

SEQ ID NO: 772171 - RNA, 14 nt, Homo sapiens
aaggaaaagcaaga

SEQ ID NO: 772172 - RNA, 18 nt, Homo sapiens
aaggaaaccaagugguca

SEQ ID NO: 772173 - RNA, 19 nt, Homo sapiens
aaggaaaccgcugccuuua

SEQ ID NO: 772174 - RNA, 15 nt, Homo sapiens
aaggaaacgaugaaa

SEQ ID NO: 772175 - RNA, 15 nt, Homo sapiens
aaggaaacuuugcca

SEQ ID NO: 772176 - RNA, 19 nt, Homo sapiens
aaggaaagauuugugaacu

SEQ ID NO: 772177 - RNA, 23 nt, Homo sapiens
aaggaaagcuauaucuauuugag

SEQ ID NO: 772178 - RNA, 12 nt, Homo sapiens
aaggaaagcuca

SEQ ID NO: 772179 - RNA, 21 nt, Homo sapiens
aaggaaauaguaccuucaaua

SEQ ID NO: 772180 - RNA, 15 nt, Homo sapiens
aaggaaaucucaccc

SEQ ID NO: 772181 - RNA, 21 nt, Homo sapiens
aaggaacauuccuuagucuca

SEQ ID NO: 772182 - RNA, 23 nt, Homo sapiens
aaggaagucauccagucuauuca

SEQ ID NO: 772183 - RNA, 21 nt, Homo sapiens
aaggaaugauauauucuugaa

SEQ ID NO: 772184 - RNA, 17 nt, Homo sapiens
aaggacaagacacugag

SEQ ID NO: 772185 - RNA, 20 nt, Homo sapiens
aaggacaccuuuuaacucac

SEQ ID NO: 772186 - RNA, 18 nt, Homo sapiens
aaggacacuagaagauuu

SEQ ID NO: 772187 - RNA, 14 nt, Homo sapiens
aaggacgugggcag

SEQ ID NO: 772188 - RNA, 17 nt, Homo sapiens
aaggacucuuccaccuc

SEQ ID NO: 772189 - RNA, 17 nt, Homo sapiens
aaggacuuaaggacagc

SEQ ID NO: 772190 - RNA, 16 nt, Homo sapiens
aaggagaaucauguuu

SEQ ID NO: 772191 - RNA, 23 nt, Homo sapiens
aaggagacucaccucugccucaa

SEQ ID NO: 772192 - RNA, 23 nt, Homo sapiens
aaggagacugaggggcuuuguaa

SEQ ID NO: 772193 - RNA, 19 nt, Homo sapiens
aaggagagagugagugcau

SEQ ID NO: 772194 - RNA, 17 nt, Homo sapiens
aaggagcacaagccaca

SEQ ID NO: 772195 - RNA, 17 nt, Homo sapiens
aaggaggaaucaagaag

SEQ ID NO: 772196 - RNA, 21 nt, Homo sapiens
aaggaggcuuaggacuuucca

SEQ ID NO: 772197 - RNA, 18 nt, Homo sapiens
aaggagucaagaacaauu

SEQ ID NO: 772198 - RNA, 17 nt, Homo sapiens
aaggaguccuugcauca

SEQ ID NO: 772199 - RNA, 19 nt, Homo sapiens
aaggauaagugaacaccca

SEQ ID NO: 772200 - RNA, 14 nt, Homo sapiens
aaggauacuuuaca

SEQ ID NO: 772201 - RNA, 15 nt, Homo sapiens
aaggauaugauuaau

SEQ ID NO: 772202 - RNA, 12 nt, Homo sapiens
aaggauccucau

SEQ ID NO: 772203 - RNA, 12 nt, Homo sapiens
aaggaugaauga

SEQ ID NO: 772204 - RNA, 16 nt, Homo sapiens
aaggauuacucuccau

SEQ ID NO: 772205 - RNA, 21 nt, Homo sapiens
aaggauuguacacgcugauga

SEQ ID NO: 772206 - RNA, 14 nt, Homo sapiens
aaggauugugauau

SEQ ID NO: 772207 - RNA, 16 nt, Homo sapiens
aaggauuuuaccaaag

SEQ ID NO: 772208 - RNA, 17 nt, Homo sapiens
aaggauuuuaccaaagc

SEQ ID NO: 772209 - RNA, 18 nt, Homo sapiens
aaggauuuuaccaaagca

SEQ ID NO: 772210 - RNA, 12 nt, Homo sapiens
aaggcaaaaaga

SEQ ID NO: 772211 - RNA, 14 nt, Homo sapiens
aaggcaacugugag

SEQ ID NO: 772212 - RNA, 12 nt, Homo sapiens
aaggcacaugcc

SEQ ID NO: 772213 - RNA, 19 nt, Homo sapiens
aaggcacccaucugucugc

SEQ ID NO: 772214 - RNA, 17 nt, Homo sapiens
aaggcacugacugagca

SEQ ID NO: 772215 - RNA, 19 nt, Homo sapiens
aaggcagccugaacacuca

SEQ ID NO: 772216 - RNA, 16 nt, Homo sapiens
aaggcagcugccucug

SEQ ID NO: 772217 - RNA, 17 nt, Homo sapiens
aaggcaggugccuccag

SEQ ID NO: 772218 - RNA, 23 nt, Homo sapiens
aaggcaguaguuuucaaaacaca

SEQ ID NO: 772219 - RNA, 17 nt, Homo sapiens
aagagcgucauguccuu

SEQ ID NO: 772220 - RNA, 18 nt, Homo sapiens
aagagcuuuccuucucca

SEQ ID NO: 772221 - RNA, 23 nt, Homo sapiens
aagagcuuugugauauacugguu

SEQ ID NO: 772222 - RNA, 21 nt, Homo sapiens
aagaggaaugugcaacauucu

SEQ ID NO: 772223 - RNA, 13 nt, Homo sapiens
aagaggacugugu

SEQ ID NO: 772224 - RNA, 16 nt, Homo sapiens
aagaggcagcuugaaa

SEQ ID NO: 772225 - RNA, 17 nt, Homo sapiens
aagagggagaagggaug

SEQ ID NO: 772226 - RNA, 14 nt, Homo sapiens
aagaggucugagcc

SEQ ID NO: 772227 - RNA, 17 nt, Homo sapiens
aagaguaagcaguguua

SEQ ID NO: 772228 - RNA, 16 nt, Homo sapiens
aagaguaugagucuuc

SEQ ID NO: 772229 - RNA, 19 nt, Homo sapiens
aagagucuggccuggaccc

SEQ ID NO: 772230 - RNA, 15 nt, Homo sapiens
aagagugaaugccau

SEQ ID NO: 772231 - RNA, 15 nt, Homo sapiens
aagagugagagggca

SEQ ID NO: 772232 - RNA, 14 nt, Homo sapiens
aagaguggaaccaa

SEQ ID NO: 772233 - RNA, 18 nt, Homo sapiens
aagaguuaaaacauuucu

SEQ ID NO: 772234 - RNA, 18 nt, Homo sapiens
aagauaaaagaauggcca

SEQ ID NO: 772235 - RNA, 19 nt, Homo sapiens
aagauaaagacuguggaaa

SEQ ID NO: 772236 - RNA, 14 nt, Homo sapiens
aagauaacuaggaa

SEQ ID NO: 772237 - RNA, 22 nt, Homo sapiens
aagauaauauugucugucucua

SEQ ID NO: 772238 - RNA, 20 nt, Homo sapiens
aagauaauuuguugggccau

SEQ ID NO: 772239 - RNA, 15 nt, Homo sapiens
aagauacaaguuuca

SEQ ID NO: 772240 - RNA, 14 nt, Homo sapiens
aagauacauaaaag

SEQ ID NO: 772241 - RNA, 15 nt, Homo sapiens
aagauagcagggcau

SEQ ID NO: 772242 - RNA, 18 nt, Homo sapiens
aagauagucuucaguuuc

SEQ ID NO: 772243 - RNA, 17 nt, Homo sapiens
aagauaucagagcucuu

SEQ ID NO: 772244 - RNA, 24 nt, Homo sapiens
aagauauucagguggccagaagag

SEQ ID NO: 772245 - RNA, 15 nt, Homo sapiens
aagauauuccugagu

SEQ ID NO: 772246 - RNA, 13 nt, Homo sapiens
aagauauuguaca

SEQ ID NO: 772247 - RNA, 13 nt, Homo sapiens
aagauauuuccaa

SEQ ID NO: 772248 - RNA, 16 nt, Homo sapiens
aagauauuuccaagaa

SEQ ID NO: 772249 - RNA, 15 nt, Homo sapiens
aagaucaccuuguau

SEQ ID NO: 772250 - RNA, 14 nt, Homo sapiens
aagaucaucuccca

SEQ ID NO: 772251 - RNA, 22 nt, Homo sapiens
aagauccuagauccuaaggguc

SEQ ID NO: 772252 - RNA, 18 nt, Homo sapiens
aagauccuccugcugcag

SEQ ID NO: 772253 - RNA, 18 nt, Homo sapiens
aagaucucgguuugccaa

SEQ ID NO: 772254 - RNA, 17 nt, Homo sapiens
aagaugaagacaacagc

SEQ ID NO: 772255 - RNA, 16 nt, Homo sapiens
aagaugaaggcaucaa

SEQ ID NO: 772256 - RNA, 14 nt, Homo sapiens
aagaugaaguuuua

SEQ ID NO: 772257 - RNA, 13 nt, Homo sapiens
aagaugaauacaa

SEQ ID NO: 772258 - RNA, 19 nt, Homo sapiens
aagaugacggaugccuaga

SEQ ID NO: 772259 - RNA, 20 nt, Homo sapiens
aagaugauuucaguucauca

SEQ ID NO: 772260 - RNA, 14 nt, Homo sapiens
aagaugcacugaaa

SEQ ID NO: 772261 - RNA, 12 nt, Homo sapiens
aagaugcagugg

SEQ ID NO: 772262 - RNA, 11 nt, Homo sapiens
aagaugcauuu

SEQ ID NO: 772263 - RNA, 21 nt, Homo sapiens
aagaugccagugaaacuucaa

SEQ ID NO: 772264 - RNA, 17 nt, Homo sapiens
aagauggaacaggcuca

SEQ ID NO: 772265 - RNA, 23 nt, Homo sapiens
aagauggaaugcuugcagagcau

SEQ ID NO: 772266 - RNA, 13 nt, Homo sapiens
aagauggagacac

SEQ ID NO: 772267 - RNA, 20 nt, Homo sapiens
aagauggaugcgacccaaga

SEQ ID NO: 772268 - RNA, 17 nt, Homo sapiens
aagauggauuugaaaau

SEQ ID NO: 772269 - RNA, 15 nt, Homo sapiens
aagaugggagccuuu

SEQ ID NO: 772270 - RNA, 14 nt, Homo sapiens
aagauuaaaugugu

SEQ ID NO: 772271 - RNA, 18 nt, Homo sapiens
aagauuaugaugaguaaa

SEQ ID NO: 772272 - RNA, 15 nt, Homo sapiens
aagauuauuugcacg

SEQ ID NO: 772273 - RNA, 19 nt, Homo sapiens
aagauucacaccugacucu

SEQ ID NO: 772274 - RNA, 14 nt, Homo sapiens
aagauucuaucaaa

SEQ ID NO: 772275 - RNA, 16 nt, Homo sapiens
aagauucucugcccag

SEQ ID NO: 772276 - RNA, 12 nt, Homo sapiens
aagauucuugac

SEQ ID NO: 772277 - RNA, 13 nt, Homo sapiens
aagauucuugacu

SEQ ID NO: 772278 - RNA, 13 nt, Homo sapiens
aagauugauacuu

SEQ ID NO: 772279 - RNA, 21 nt, Homo sapiens
aagauuuaaaugccauagaaa

SEQ ID NO: 772280 - RNA, 15 nt, Homo sapiens
aagauuuaugaugca

SEQ ID NO: 772281 - RNA, 17 nt, Homo sapiens
aagauuugugaacugga

SEQ ID NO: 772282 - RNA, 19 nt, Homo sapiens
aagauuugugaacuggaag

SEQ ID NO: 772283 - RNA, 23 nt, Homo sapiens
aagauuuuccauuguauccucuu

SEQ ID NO: 772284 - RNA, 17 nt, Homo sapiens
aagauuuuuggcacuuu

SEQ ID NO: 772285 - RNA, 21 nt, Homo sapiens
aagauuuuuuaaauugucaua

SEQ ID NO: 772286 - RNA, 10 nt, Homo sapiens
aagcaaaaag

SEQ ID NO: 772287 - RNA, 18 nt, Homo sapiens
aagcaaaacaauaaacua

SEQ ID NO: 772288 - RNA, 14 nt, Homo sapiens
aagcaaaagcaagg

SEQ ID NO: 772289 - RNA, 22 nt, Homo sapiens
aagcaaacacuuacagaauuau

SEQ ID NO: 772290 - RNA, 11 nt, Homo sapiens
aagcaaauaga

SEQ ID NO: 772291 - RNA, 21 nt, Homo sapiens
aagcaaauagacacagucaua

SEQ ID NO: 772292 - RNA, 17 nt, Homo sapiens
aagcaacagauggauag

SEQ ID NO: 772293 - RNA, 20 nt, Homo sapiens
aagcaagacuguugcucaaa

SEQ ID NO: 772294 - RNA, 16 nt, Homo sapiens
aagcaaggugucccug

SEQ ID NO: 772295 - RNA, 15 nt, Homo sapiens
aagcaagugguggga

SEQ ID NO: 772296 - RNA, 14 nt, Homo sapiens
aagcaaguuuucuu

SEQ ID NO: 772297 - RNA, 16 nt, Homo sapiens
aagcaauaaccucaaa

SEQ ID NO: 772298 - RNA, 21 nt, Homo sapiens
aagcaaugggucacucauuaa

SEQ ID NO: 772299 - RNA, 16 nt, Homo sapiens
aagcaauucugacugu

SEQ ID NO: 772300 - RNA, 15 nt, Homo sapiens
aagcacaaagccauu

SEQ ID NO: 772301 - RNA, 17 nt, Homo sapiens
aagcacaaguacuuuug

SEQ ID NO: 772302 - RNA, 14 nt, Homo sapiens
aagcacacuggaau

SEQ ID NO: 772303 - RNA, 15 nt, Homo sapiens
aagcacaguuugaac

SEQ ID NO: 772304 - RNA, 13 nt, Homo sapiens
aagcacaucugca

SEQ ID NO: 772305 - RNA, 23 nt, Homo sapiens
aagcacaugaauaauuucacuua

SEQ ID NO: 772306 - RNA, 15 nt, Homo sapiens
aagcacauguauuga

SEQ ID NO: 772307 - RNA, 18 nt, Homo sapiens
aagcaccccagucacuag

SEQ ID NO: 772308 - RNA, 21 nt, Homo sapiens
aagcacucgugugcaacagac

SEQ ID NO: 772309 - RNA, 13 nt, Homo sapiens
aagcacugcucac

SEQ ID NO: 772310 - RNA, 22 nt, Homo sapiens
aagcagaaauccugcaaugaaa

SEQ ID NO: 772311 - RNA, 18 nt, Homo sapiens
aagcagaacuuccaaaga

SEQ ID NO: 772312 - RNA, 20 nt, Homo sapiens
aagcagaggcaacacuggaa

SEQ ID NO: 772313 - RNA, 23 nt, Homo sapiens
aagcagaggcuaauucaguguca

SEQ ID NO: 772314 - RNA, 14 nt, Homo sapiens
aagcagcacuguga

SEQ ID NO: 772315 - RNA, 15 nt, Homo sapiens
aagcagcucaagaac

SEQ ID NO: 772316 - RNA, 14 nt, Homo sapiens
aagcaggugcuaca

SEQ ID NO: 772317 - RNA, 22 nt, Homo sapiens
aagcaggugcuacaacauguga

SEQ ID NO: 772318 - RNA, 15 nt, Homo sapiens
aagcagguucuugau

SEQ ID NO: 772319 - RNA, 13 nt, Homo sapiens
aagcagguuuguu

SEQ ID NO: 772320 - RNA, 20 nt, Homo sapiens
aagcaguaagcuaucuucaa

SEQ ID NO: 772321 - RNA, 20 nt, Homo sapiens
aagcagucgugccugugucc

SEQ ID NO: 772322 - RNA, 17 nt, Homo sapiens
aagcagugcacauuuca

SEQ ID NO: 772323 - RNA, 20 nt, Homo sapiens
aagcaguuacuaauaugccu

SEQ ID NO: 772324 - RNA, 19 nt, Homo sapiens
aagcaguucaugucugaaa

SEQ ID NO: 772325 - RNA, 19 nt, Homo sapiens
aagcauacaaagcaguuua

SEQ ID NO: 772326 - RNA, 13 nt, Homo sapiens
aagcauacuucua

SEQ ID NO: 772327 - RNA, 14 nt, Homo sapiens
aagcauacuuugua

SEQ ID NO: 772328 - RNA, 23 nt, Homo sapiens
aagcaucucagccuaccaugaga

SEQ ID NO: 772329 - RNA, 15 nt, Homo sapiens
aagcaugaaaaagca

SEQ ID NO: 772330 - RNA, 22 nt, Homo sapiens
aagcaugucucucugccaagau

SEQ ID NO: 772331 - RNA, 14 nt, Homo sapiens
aagcauuacuuuau

SEQ ID NO: 772332 - RNA, 17 nt, Homo sapiens
aagcauuccugcucaag

SEQ ID NO: 772333 - RNA, 18 nt, Homo sapiens
aagcauucuccccagugu

SEQ ID NO: 772334 - RNA, 22 nt, Homo sapiens
aagcauucuuguguaauacuuc

SEQ ID NO: 772335 - RNA, 21 nt, Homo sapiens
acaagagaucuacacauguug

SEQ ID NO: 772336 - RNA, 21 nt, Homo sapiens
acaagagaugggaugcuccga

SEQ ID NO: 772337 - RNA, 13 nt, Homo sapiens
acaagagcgagac

SEQ ID NO: 772338 - RNA, 19 nt, Homo sapiens
acaagagcugcuguccuuu

SEQ ID NO: 772339 - RNA, 19 nt, Homo sapiens
acaagagugaauuugaccu

SEQ ID NO: 772340 - RNA, 12 nt, Homo sapiens
acaagauaccaa

SEQ ID NO: 772341 - RNA, 21 nt, Homo sapiens
acaagauggauggaaagggag

SEQ ID NO: 772342 - RNA, 18 nt, Homo sapiens
acaagaugguucuagcau

SEQ ID NO: 772343 - RNA, 11 nt, Homo sapiens
acaagauuccc

SEQ ID NO: 772344 - RNA, 12 nt, Homo sapiens
acaagauugaaa

SEQ ID NO: 772345 - RNA, 20 nt, Homo sapiens
acaagauuugcugcauuucc

SEQ ID NO: 772346 - RNA, 16 nt, Homo sapiens
acaagcaacaaaccuc

SEQ ID NO: 772347 - RNA, 19 nt, Homo sapiens
acaagccacaagucuucca

SEQ ID NO: 772348 - RNA, 20 nt, Homo sapiens
acaagccacaagucuuccag

SEQ ID NO: 772349 - RNA, 14 nt, Homo sapiens
acaagccauagugg

SEQ ID NO: 772350 - RNA, 15 nt, Homo sapiens
acaagcugcauuuca

SEQ ID NO: 772351 - RNA, 15 nt, Homo sapiens
acaagcuuacaaaga

SEQ ID NO: 772352 - RNA, 13 nt, Homo sapiens
acaaggaagccaa

SEQ ID NO: 772353 - RNA, 15 nt, Homo sapiens
acaaggaagccaaag

SEQ ID NO: 772354 - RNA, 17 nt, Homo sapiens
acaaggaagccaaaguu

SEQ ID NO: 772355 - RNA, 23 nt, Homo sapiens
acaaggugagugugacuucccuu

SEQ ID NO: 772356 - RNA, 22 nt, Homo sapiens
acaaggugucuuuuccacuccu

SEQ ID NO: 772357 - RNA, 18 nt, Homo sapiens
acaaguauguugagaguu

SEQ ID NO: 772358 - RNA, 14 nt, Homo sapiens
acaagucuuuccag

SEQ ID NO: 772359 - RNA, 22 nt, Homo sapiens
acaaguucaauaaaaaucugcu

SEQ ID NO: 772360 - RNA, 18 nt, Homo sapiens
acaaguuuuaauccagaa

SEQ ID NO: 772361 - RNA, 17 nt, Homo sapiens
acaauaaaugaaugaau

SEQ ID NO: 772362 - RNA, 20 nt, Homo sapiens
acaauaaauuuuuuuugguc

SEQ ID NO: 772363 - RNA, 21 nt, Homo sapiens
acaauaauauuucaagugccu

SEQ ID NO: 772364 - RNA, 12 nt, Homo sapiens
acaauacaguaa

SEQ ID NO: 772365 - RNA, 13 nt, Homo sapiens
acaauacuugcau

SEQ ID NO: 772366 - RNA, 13 nt, Homo sapiens
acaauauggccau

SEQ ID NO: 772367 - RNA, 16 nt, Homo sapiens
acaauauguggucaau

SEQ ID NO: 772368 - RNA, 23 nt, Homo sapiens
acaaucaacucuaauagugcuua

SEQ ID NO: 772369 - RNA, 16 nt, Homo sapiens
acaaucagcccagugc

SEQ ID NO: 772370 - RNA, 20 nt, Homo sapiens
acaaucagcccagugcaaac

SEQ ID NO: 772371 - RNA, 16 nt, Homo sapiens
acaauccaucucucaa

SEQ ID NO: 772372 - RNA, 24 nt, Homo sapiens
acaauccaucucucaaguagugua

SEQ ID NO: 772373 - RNA, 22 nt, Homo sapiens
acaauccuccaagaauuugacu

SEQ ID NO: 772374 - RNA, 16 nt, Homo sapiens
acaaucucaauuccau

SEQ ID NO: 772375 - RNA, 12 nt, Homo sapiens
acaaugcagaua

SEQ ID NO: 772376 - RNA, 15 nt, Homo sapiens
acaaugcuuugcccc

SEQ ID NO: 772377 - RNA, 16 nt, Homo sapiens
acaauguauguacaau

SEQ ID NO: 772378 - RNA, 20 nt, Homo sapiens
acaaugucaugucugugauu

SEQ ID NO: 772379 - RNA, 19 nt, Homo sapiens
acaauguuuauaaaggcca

SEQ ID NO: 772380 - RNA, 19 nt, Homo sapiens
acaauguuucuucauuucu

SEQ ID NO: 772381 - RNA, 18 nt, Homo sapiens
acaauuacuaaauuguau

SEQ ID NO: 772382 - RNA, 12 nt, Homo sapiens
acaauuccauga

SEQ ID NO: 772383 - RNA, 20 nt, Homo sapiens
acaauuccauuuccaguuca

SEQ ID NO: 772384 - RNA, 20 nt, Homo sapiens
acaauuguguauaacuggau

SEQ ID NO: 772385 - RNA, 17 nt, Homo sapiens
acaauuguuacaguacu

SEQ ID NO: 772386 - RNA, 15 nt, Homo sapiens
acaauuuaugaauug

SEQ ID NO: 772387 - RNA, 14 nt, Homo sapiens
acaauuucaauaaa

SEQ ID NO: 772388 - RNA, 15 nt, Homo sapiens
acaauuucauucagu

SEQ ID NO: 772389 - RNA, 17 nt, Homo sapiens
acaauuugauacauaau

SEQ ID NO: 772390 - RNA, 13 nt, Homo sapiens
acacaaagacauu

SEQ ID NO: 772391 - RNA, 18 nt, Homo sapiens
acacaaagacauugauuc

SEQ ID NO: 772392 - RNA, 16 nt, Homo sapiens
acacaaagacuccuug

SEQ ID NO: 772393 - RNA, 15 nt, Homo sapiens
acacaaauuuguaaa

SEQ ID NO: 772394 - RNA, 18 nt, Homo sapiens
acacaaggugcaaaucaa

SEQ ID NO: 772395 - RNA, 12 nt, Homo sapiens
acacacaaaaac

SEQ ID NO: 772396 - RNA, 14 nt, Homo sapiens
acacacaaccuccu

SEQ ID NO: 772397 - RNA, 13 nt, Homo sapiens
acacacacaccaa

SEQ ID NO: 772398 - RNA, 11 nt, Homo sapiens
acacacacagu

SEQ ID NO: 772399 - RNA, 18 nt, Homo sapiens
acacacacccacuaagga

SEQ ID NO: 772400 - RNA, 19 nt, Homo sapiens
acacacacgaugcauuuaa

SEQ ID NO: 772401 - RNA, 17 nt, Homo sapiens
acacacacgcacucucc

SEQ ID NO: 772402 - RNA, 12 nt, Homo sapiens
acacacaguacg

SEQ ID NO: 772403 - RNA, 10 nt, Homo sapiens
acacacaguc

SEQ ID NO: 772404 - RNA, 17 nt, Homo sapiens
acacacauacaaaaugu

SEQ ID NO: 772405 - RNA, 22 nt, Homo sapiens
acacacauaccuucaugugguu

SEQ ID NO: 772406 - RNA, 12 nt, Homo sapiens
acacacauggaa

SEQ ID NO: 772407 - RNA, 16 nt, Homo sapiens
acacacauugcagcuu

SEQ ID NO: 772408 - RNA, 13 nt, Homo sapiens
acacacgcuuucu

SEQ ID NO: 772409 - RNA, 20 nt, Homo sapiens
acacacgugagcaacugugc

SEQ ID NO: 772410 - RNA, 18 nt, Homo sapiens
acacacgugcugugggcc

SEQ ID NO: 772411 - RNA, 18 nt, Homo sapiens
acacagacuccacccucc

SEQ ID NO: 772412 - RNA, 23 nt, Homo sapiens
acacagauuauguuccugcugua

SEQ ID NO: 772413 - RNA, 16 nt, Homo sapiens
acacagcacaagggca

SEQ ID NO: 772414 - RNA, 23 nt, Homo sapiens
acacagcugcccuagcugacccc

SEQ ID NO: 772415 - RNA, 16 nt, Homo sapiens
acacagcuuuaugaua

SEQ ID NO: 772416 - RNA, 14 nt, Homo sapiens
acagagugugcugc

SEQ ID NO: 772417 - RNA, 14 nt, Homo sapiens
acagaguucacuau

SEQ ID NO: 772418 - RNA, 16 nt, Homo sapiens
acagauaaaacuugag

SEQ ID NO: 772419 - RNA, 16 nt, Homo sapiens
acagaugauacuucca

SEQ ID NO: 772420 - RNA, 20 nt, Homo sapiens
acagaugccauggccugugc

SEQ ID NO: 772421 - RNA, 20 nt, Homo sapiens
acagauggauagucugucca

SEQ ID NO: 772422 - RNA, 14 nt, Homo sapiens
acagauucuuucag

SEQ ID NO: 772423 - RNA, 19 nt, Homo sapiens
acagauuuccauccuaguc

SEQ ID NO: 772424 - RNA, 18 nt, Homo sapiens
acagcaaaacuccaucuc

SEQ ID NO: 772425 - RNA, 19 nt, Homo sapiens
acagcaaaacuccaucuca

SEQ ID NO: 772426 - RNA, 14 nt, Homo sapiens
acagcaaaagaaga

SEQ ID NO: 772427 - RNA, 13 nt, Homo sapiens
acagcaaaggaac

SEQ ID NO: 772428 - RNA, 13 nt, Homo sapiens
acagcaacaauga

SEQ ID NO: 772429 - RNA, 20 nt, Homo sapiens
acagcaagggugaugggaaa

SEQ ID NO: 772430 - RNA, 20 nt, Homo sapiens
acagcaaguacgcaagaaau

SEQ ID NO: 772431 - RNA, 21 nt, Homo sapiens
acagcacuggggagucuuugu

SEQ ID NO: 772432 - RNA, 20 nt, Homo sapiens
acagcagcacuguucugucc

SEQ ID NO: 772433 - RNA, 18 nt, Homo sapiens
acagcagugaucucaggg

SEQ ID NO: 772434 - RNA, 18 nt, Homo sapiens
acagcaugaauaaaacac

SEQ ID NO: 772435 - RNA, 13 nt, Homo sapiens
acagcauguguau

SEQ ID NO: 772436 - RNA, 22 nt, Homo sapiens
acagccaccguuucuuccugcc

SEQ ID NO: 772437 - RNA, 21 nt, Homo sapiens
acagcccucaugaucauucuc

SEQ ID NO: 772438 - RNA, 22 nt, Homo sapiens
acagcccucaugaucauucuca

SEQ ID NO: 772439 - RNA, 23 nt, Homo sapiens
acagcccuccacuccagcucuga

SEQ ID NO: 772440 - RNA, 18 nt, Homo sapiens
acagcccuuaugcgguua

SEQ ID NO: 772441 - RNA, 18 nt, Homo sapiens
acagcccuuuugugaacc

SEQ ID NO: 772442 - RNA, 18 nt, Homo sapiens
acagccuggcacagggca

SEQ ID NO: 772443 - RNA, 14 nt, Homo sapiens
acagccuuugccca

SEQ ID NO: 772444 - RNA, 18 nt, Homo sapiens
acagcgagggcagcugcu

SEQ ID NO: 772445 - RNA, 15 nt, Homo sapiens
acagcgucugcucau

SEQ ID NO: 772446 - RNA, 18 nt, Homo sapiens
acagcuacacagaucaca

SEQ ID NO: 772447 - RNA, 19 nt, Homo sapiens
acagcuacacagaucacag

SEQ ID NO: 772448 - RNA, 12 nt, Homo sapiens
acagcuacucuc

SEQ ID NO: 772449 - RNA, 21 nt, Homo sapiens
acagcuacucuccccacgagg

SEQ ID NO: 772450 - RNA, 22 nt, Homo sapiens
acagcuagaaagcugcacuggu

SEQ ID NO: 772451 - RNA, 20 nt, Homo sapiens
acagcuaucgaacuucacaa

SEQ ID NO: 772452 - RNA, 21 nt, Homo sapiens
acagcucaagucuucccugau

SEQ ID NO: 772453 - RNA, 21 nt, Homo sapiens
acagcucaccaacuacagaaa

SEQ ID NO: 772454 - RNA, 21 nt, Homo sapiens
acagcugacucucgugcauuu

SEQ ID NO: 772455 - RNA, 12 nt, Homo sapiens
acagcuggacag

SEQ ID NO: 772456 - RNA, 22 nt, Homo sapiens
acagcuguaguaccccaagaag

SEQ ID NO: 772457 - RNA, 19 nt, Homo sapiens
acagcugucuucacaugua

SEQ ID NO: 772458 - RNA, 14 nt, Homo sapiens
acagcuuauauuaa

SEQ ID NO: 772459 - RNA, 23 nt, Homo sapiens
acaggaaaaaaaaaaaucuaucc

SEQ ID NO: 772460 - RNA, 19 nt, Homo sapiens
acaggaaaaagacuaagcc

SEQ ID NO: 772461 - RNA, 22 nt, Homo sapiens
acaggaagccugcaguccugga

SEQ ID NO: 772462 - RNA, 17 nt, Homo sapiens
acaggaaggaaccagaa

SEQ ID NO: 772463 - RNA, 21 nt, Homo sapiens
acaggaauacuuaacucaaua

SEQ ID NO: 772464 - RNA, 21 nt, Homo sapiens
acaggaauccuuacugauauu

SEQ ID NO: 772465 - RNA, 16 nt, Homo sapiens
acaggacuguaaagau

SEQ ID NO: 772466 - RNA, 18 nt, Homo sapiens
acaggacuuaaaaugaca

SEQ ID NO: 772467 - RNA, 22 nt, Homo sapiens
acaggagguuguggaugcucca

SEQ ID NO: 772468 - RNA, 18 nt, Homo sapiens
acaggcaacgcagaccaa

SEQ ID NO: 772469 - RNA, 13 nt, Homo sapiens
acaggcacuccaa

SEQ ID NO: 772470 - RNA, 21 nt, Homo sapiens
acaggcaugaaucacugugcu

SEQ ID NO: 772471 - RNA, 22 nt, Homo sapiens
acaggcccuuccucuccacugc

SEQ ID NO: 772472 - RNA, 20 nt, Homo sapiens
acaggccgagugaaggugcu

SEQ ID NO: 772473 - RNA, 17 nt, Homo sapiens
acaggccugagauuuca

SEQ ID NO: 772474 - RNA, 14 nt, Homo sapiens
acaggcgaggaccc

SEQ ID NO: 772475 - RNA, 21 nt, Homo sapiens
acaggcucaugccaucaugcc

SEQ ID NO: 772476 - RNA, 20 nt, Homo sapiens
acaggcugagaacucguuca

SEQ ID NO: 772477 - RNA, 18 nt, Homo sapiens
acagggaaggaugacaaa

SEQ ID NO: 772478 - RNA, 14 nt, Homo sapiens
acagggagaaaauc

SEQ ID NO: 772479 - RNA, 23 nt, Homo sapiens
acagggagaaguagcuaguagca

SEQ ID NO: 772480 - RNA, 15 nt, Homo sapiens
acagggcauggccag

SEQ ID NO: 772481 - RNA, 17 nt, Homo sapiens
acagggcugauacaucc

SEQ ID NO: 772482 - RNA, 22 nt, Homo sapiens
acagggugugguaugagggggu

SEQ ID NO: 772483 - RNA, 18 nt, Homo sapiens
acagguaaugaagcuauu

SEQ ID NO: 772484 - RNA, 20 nt, Homo sapiens
acagguaauuauaaacccac

SEQ ID NO: 772485 - RNA, 14 nt, Homo sapiens
acagguaccaucuu

SEQ ID NO: 772486 - RNA, 15 nt, Homo sapiens
acaggucaaccaugg

SEQ ID NO: 772487 - RNA, 18 nt, Homo sapiens
acaggugcgguuccucau

SEQ ID NO: 772488 - RNA, 15 nt, Homo sapiens
acaggugugagccac

SEQ ID NO: 772489 - RNA, 18 nt, Homo sapiens
acagguuauaacaguguu

SEQ ID NO: 772490 - RNA, 17 nt, Homo sapiens
acaguaaaaggacagag

SEQ ID NO: 772491 - RNA, 13 nt, Homo sapiens
acaguaacuguga

SEQ ID NO: 772492 - RNA, 13 nt, Homo sapiens
acaguaauguguc

SEQ ID NO: 772493 - RNA, 15 nt, Homo sapiens
acaguacagaaggca

SEQ ID NO: 772494 - RNA, 18 nt, Homo sapiens
acaguacccaaacugcuu

SEQ ID NO: 772495 - RNA, 19 nt, Homo sapiens
acaguacuguucccaacuc

SEQ ID NO: 772496 - RNA, 16 nt, Homo sapiens
acaguacuuuccagca

SEQ ID NO: 772497 - RNA, 18 nt, Homo sapiens
aagaaguugauuccuuca

SEQ ID NO: 772498 - RNA, 22 nt, Homo sapiens
aagaaguugcuaagugugcuua

SEQ ID NO: 772499 - RNA, 19 nt, Homo sapiens
aagaaguuuuucuuugugu

SEQ ID NO: 772500 - RNA, 21 nt, Homo sapiens
aagaauaaaauugcacuuuua

SEQ ID NO: 772501 - RNA, 21 nt, Homo sapiens
aagaauaaggcuuuuucuucc

SEQ ID NO: 772502 - RNA, 12 nt, Homo sapiens
aagaauaauuca

SEQ ID NO: 772503 - RNA, 15 nt, Homo sapiens
aagaauacacuguga

SEQ ID NO: 772504 - RNA, 13 nt, Homo sapiens
aagaauaccugag

SEQ ID NO: 772505 - RNA, 13 nt, Homo sapiens
aagaauagucaua

SEQ ID NO: 772506 - RNA, 13 nt, Homo sapiens
aagaauauuguau

SEQ ID NO: 772507 - RNA, 21 nt, Homo sapiens
aagaaucagaaacaggugcau

SEQ ID NO: 772508 - RNA, 18 nt, Homo sapiens
aagaaucuaaaccuuaca

SEQ ID NO: 772509 - RNA, 15 nt, Homo sapiens
aagaaugcuuugcca

SEQ ID NO: 772510 - RNA, 14 nt, Homo sapiens
aagaauuacaguac

SEQ ID NO: 772511 - RNA, 17 nt, Homo sapiens
aagaauuauuuuauaca

SEQ ID NO: 772512 - RNA, 14 nt, Homo sapiens
aagaauugaggaau

SEQ ID NO: 772513 - RNA, 13 nt, Homo sapiens
aagaauuggccag

SEQ ID NO: 772514 - RNA, 16 nt, Homo sapiens
aagaauuggccaucuu

SEQ ID NO: 772515 - RNA, 17 nt, Homo sapiens
aagaauuucacaagcua

SEQ ID NO: 772516 - RNA, 13 nt, Homo sapiens
aagaauuucuuca

SEQ ID NO: 772517 - RNA, 13 nt, Homo sapiens
aagaauuuugcuu

SEQ ID NO: 772518 - RNA, 23 nt, Homo sapiens
aagacaaauuagccauuucacuc

SEQ ID NO: 772519 - RNA, 14 nt, Homo sapiens
aagacaaauucugu

SEQ ID NO: 772520 - RNA, 14 nt, Homo sapiens
aagacaacauuucu

SEQ ID NO: 772521 - RNA, 16 nt, Homo sapiens
aagacaacauuucuca

SEQ ID NO: 772522 - RNA, 21 nt, Homo sapiens
aagacaauaauucuacauguu

SEQ ID NO: 772523 - RNA, 13 nt, Homo sapiens
aagacacugccug

SEQ ID NO: 772524 - RNA, 23 nt, Homo sapiens
aagacagacaucuguggaaugau

SEQ ID NO: 772525 - RNA, 21 nt, Homo sapiens
aagacagagaagaccaaagca

SEQ ID NO: 772526 - RNA, 21 nt, Homo sapiens
aagacagucuucuaauuccuc

SEQ ID NO: 772527 - RNA, 15 nt, Homo sapiens
aagacaucagucucc

SEQ ID NO: 772528 - RNA, 21 nt, Homo sapiens
aagacauccugagcagugcca

SEQ ID NO: 772529 - RNA, 15 nt, Homo sapiens
aagacauucuuccaa

SEQ ID NO: 772530 - RNA, 11 nt, Homo sapiens
aagacauuucu

SEQ ID NO: 772531 - RNA, 21 nt, Homo sapiens
aagaccacacuugguguuacc

SEQ ID NO: 772532 - RNA, 21 nt, Homo sapiens
aagaccagcuuugcagugaca

SEQ ID NO: 772533 - RNA, 24 nt, Homo sapiens
aagaccagucacucccucugccuu

SEQ ID NO: 772534 - RNA, 14 nt, Homo sapiens
aagacccaggaggc

SEQ ID NO: 772535 - RNA, 19 nt, Homo sapiens
aagacccccagcacuuggg

SEQ ID NO: 772536 - RNA, 17 nt, Homo sapiens
aagaccgccccagggcu

SEQ ID NO: 772537 - RNA, 13 nt, Homo sapiens
aagaccuggaccg

SEQ ID NO: 772538 - RNA, 12 nt, Homo sapiens
aagaccuuccag

SEQ ID NO: 772539 - RNA, 13 nt, Homo sapiens
aagacuagccugg

SEQ ID NO: 772540 - RNA, 14 nt, Homo sapiens
aagacuauggugcu

SEQ ID NO: 772541 - RNA, 20 nt, Homo sapiens
aagacuauucaaacagucuc

SEQ ID NO: 772542 - RNA, 13 nt, Homo sapiens
aagacuccaaaga

SEQ ID NO: 772543 - RNA, 14 nt, Homo sapiens
aagacucuuuauga

SEQ ID NO: 772544 - RNA, 21 nt, Homo sapiens
aagacucuuuggguccauuca

SEQ ID NO: 772545 - RNA, 23 nt, Homo sapiens
aagacugaaucuaccugcccuaa

SEQ ID NO: 772546 - RNA, 21 nt, Homo sapiens
aagacugaauuccaaacaugg

SEQ ID NO: 772547 - RNA, 22 nt, Homo sapiens
aagacugacaaagucauccucc

SEQ ID NO: 772548 - RNA, 18 nt, Homo sapiens
aagacugucagcuuccaa

SEQ ID NO: 772549 - RNA, 21 nt, Homo sapiens
aagacuuaagcccagugcacu

SEQ ID NO: 772550 - RNA, 23 nt, Homo sapiens
aagacuuaagcccagugcacuga

SEQ ID NO: 772551 - RNA, 16 nt, Homo sapiens
aagacuuccacucgau

SEQ ID NO: 772552 - RNA, 19 nt, Homo sapiens
aagagaaaauuccuagaaa

SEQ ID NO: 772553 - RNA, 14 nt, Homo sapiens
aagagaaacuucaa

SEQ ID NO: 772554 - RNA, 14 nt, Homo sapiens
aagagaaguuguaa

SEQ ID NO: 772555 - RNA, 21 nt, Homo sapiens
aagagaaugaaauugcugaaa

SEQ ID NO: 772556 - RNA, 15 nt, Homo sapiens
aagagagaagccagc

SEQ ID NO: 772557 - RNA, 14 nt, Homo sapiens
aagagauccaggga

SEQ ID NO: 772558 - RNA, 15 nt, Homo sapiens
aagagaucuacacau

SEQ ID NO: 772559 - RNA, 16 nt, Homo sapiens
aagagaucuuucuuuc

SEQ ID NO: 772560 - RNA, 13 nt, Homo sapiens
aagagcaaaacuc

SEQ ID NO: 772561 - RNA, 13 nt, Homo sapiens
aagagcaacaauc

SEQ ID NO: 772562 - RNA, 13 nt, Homo sapiens
aagagcacuggag

SEQ ID NO: 772563 - RNA, 13 nt, Homo sapiens
aagagccaaagaa

SEQ ID NO: 772564 - RNA, 20 nt, Homo sapiens
aagagccauauaaguuugaa

SEQ ID NO: 772565 - RNA, 18 nt, Homo sapiens
agaaucacuugaacccgg

SEQ ID NO: 772566 - RNA, 17 nt, Homo sapiens
agaaucacuugcacucc

SEQ ID NO: 772567 - RNA, 13 nt, Homo sapiens
agaaucagaauuu

SEQ ID NO: 772568 - RNA, 13 nt, Homo sapiens
agaaucauaugau

SEQ ID NO: 772569 - RNA, 11 nt, Homo sapiens
agaauccaaag

SEQ ID NO: 772570 - RNA, 16 nt, Homo sapiens
agaauccacaaggacc

SEQ ID NO: 772571 - RNA, 11 nt, Homo sapiens
agaaucccaag

SEQ ID NO: 772572 - RNA, 16 nt, Homo sapiens
acuuugacuacaaaga

SEQ ID NO: 772573 - RNA, 18 nt, Homo sapiens
acuuugagcacacuuuac

SEQ ID NO: 772574 - RNA, 17 nt, Homo sapiens
acuuugcuuaguauuga

SEQ ID NO: 772575 - RNA, 20 nt, Homo sapiens
acuuugcuugcucauaugca

SEQ ID NO: 772576 - RNA, 17 nt, Homo sapiens
acuuugcuugcuuugaa

SEQ ID NO: 772577 - RNA, 21 nt, Homo sapiens
cacuaccguaaauguccauuu

SEQ ID NO: 772578 - RNA, 23 nt, Homo sapiens
cacuaccuucaugcauagguuua

SEQ ID NO: 772579 - RNA, 21 nt, Homo sapiens
cacuacucccucaaagcacac

SEQ ID NO: 772580 - RNA, 22 nt, Homo sapiens
cacuacucgagcccacccagca

SEQ ID NO: 772581 - RNA, 14 nt, Homo sapiens
cacuacugcuaaau

SEQ ID NO: 772582 - RNA, 12 nt, Homo sapiens
cacuagccagac

SEQ ID NO: 772583 - RNA, 12 nt, Homo sapiens
cacuagccugug

SEQ ID NO: 772584 - RNA, 18 nt, Homo sapiens
cacuagggcagccgagug

SEQ ID NO: 772585 - RNA, 17 nt, Homo sapiens
cacuagucacauucuug

SEQ ID NO: 772586 - RNA, 19 nt, Homo sapiens
cacuauaauguaagcucua

SEQ ID NO: 772587 - RNA, 12 nt, Homo sapiens
cacuaugcugcu

SEQ ID NO: 772588 - RNA, 21 nt, Homo sapiens
cacuauguuuauuuacuaauu

SEQ ID NO: 772589 - RNA, 16 nt, Homo sapiens
cacuauucuugaauua

SEQ ID NO: 772590 - RNA, 16 nt, Homo sapiens
cacuauugaugcauuu

SEQ ID NO: 772591 - RNA, 14 nt, Homo sapiens
cacuauuuacauac

SEQ ID NO: 772592 - RNA, 15 nt, Homo sapiens
cacuauuuccaaaag

SEQ ID NO: 772593 - RNA, 14 nt, Homo sapiens
cacuauuuccacau

SEQ ID NO: 772594 - RNA, 17 nt, Homo sapiens
cacucacagauguuuga

SEQ ID NO: 772595 - RNA, 22 nt, Homo sapiens
cacucacucucccccuccucuu

SEQ ID NO: 772596 - RNA, 17 nt, Homo sapiens
cacucagggagcauuua

SEQ ID NO: 772597 - RNA, 14 nt, Homo sapiens
cacucaggugaaaa

SEQ ID NO: 772598 - RNA, 12 nt, Homo sapiens
cacucagucucu

SEQ ID NO: 772599 - RNA, 17 nt, Homo sapiens
cacucauacacaugugc

SEQ ID NO: 772600 - RNA, 18 nt, Homo sapiens
cacucauuccuucacuca

SEQ ID NO: 772601 - RNA, 22 nt, Homo sapiens
cacuccaccacccaaaagucaa

SEQ ID NO: 772602 - RNA, 22 nt, Homo sapiens
cacuccacugccuuuggaaggg

SEQ ID NO: 772603 - RNA, 14 nt, Homo sapiens
cacuccacuggccu

SEQ ID NO: 772604 - RNA, 16 nt, Homo sapiens
cacuccagucuggcaa

SEQ ID NO: 772605 - RNA, 20 nt, Homo sapiens
cacucccucugccuucaggc

SEQ ID NO: 772606 - RNA, 14 nt, Homo sapiens
cacucccugccuac

SEQ ID NO: 772607 - RNA, 14 nt, Homo sapiens
cacucccuugagga

SEQ ID NO: 772608 - RNA, 20 nt, Homo sapiens
cacuccgcgccgaugccacc

SEQ ID NO: 772609 - RNA, 14 nt, Homo sapiens
cacacagaaugcaa

SEQ ID NO: 772610 - RNA, 19 nt, Homo sapiens
cacacagaaugcaaccaag

SEQ ID NO: 772611 - RNA, 19 nt, Homo sapiens
cacacagacuuucugugac

SEQ ID NO: 772612 - RNA, 11 nt, Homo sapiens
cacacaguguu

SEQ ID NO: 772613 - RNA, 14 nt, Homo sapiens
cacacaucucauuu

SEQ ID NO: 772614 - RNA, 14 nt, Homo sapiens
cacacauugcagcu

SEQ ID NO: 772615 - RNA, 13 nt, Homo sapiens
cacaccaacagug

SEQ ID NO: 772616 - RNA, 19 nt, Homo sapiens
cacacccacagaaggacac

SEQ ID NO: 772617 - RNA, 18 nt, Homo sapiens
cacaccgcuggucccugc

SEQ ID NO: 772618 - RNA, 19 nt, Homo sapiens
cacaccuacaccucuugaa

SEQ ID NO: 772619 - RNA, 21 nt, Homo sapiens
cacaccucccacccccuguau

SEQ ID NO: 772620 - RNA, 17 nt, Homo sapiens
cacaccugaacuugccu

SEQ ID NO: 772621 - RNA, 21 nt, Homo sapiens
cacaccuggcccuugcaaucu

SEQ ID NO: 772622 - RNA, 15 nt, Homo sapiens
cacaccuggccuuaa

SEQ ID NO: 772623 - RNA, 15 nt, Homo sapiens
cacaccugggcauuu

SEQ ID NO: 772624 - RNA, 23 nt, Homo sapiens
cacaccuuuguccacugucaggg

SEQ ID NO: 772625 - RNA, 15 nt, Homo sapiens
cacacgaugcauuua

SEQ ID NO: 772626 - RNA, 16 nt, Homo sapiens
cacacgaugcauuuaa

SEQ ID NO: 772627 - RNA, 17 nt, Homo sapiens
cacacgaugcauuuaau

SEQ ID NO: 772628 - RNA, 15 nt, Homo sapiens
cacacguuccacgac

SEQ ID NO: 772629 - RNA, 22 nt, Homo sapiens
cacacguuuaaucccagcacuu

SEQ ID NO: 772630 - RNA, 17 nt, Homo sapiens
cacacuaagagggcaga

SEQ ID NO: 772631 - RNA, 20 nt, Homo sapiens
cacacuccacucugauucac

SEQ ID NO: 772632 - RNA, 18 nt, Homo sapiens
cacacuccccugcacugg

SEQ ID NO: 772633 - RNA, 22 nt, Homo sapiens
cacacuccccugcacuggaguc

SEQ ID NO: 772634 - RNA, 13 nt, Homo sapiens
cacacucuucagu

SEQ ID NO: 772635 - RNA, 18 nt, Homo sapiens
cacacugccagaagagaa

SEQ ID NO: 772636 - RNA, 10 nt, Homo sapiens
cacacugucu

SEQ ID NO: 772637 - RNA, 14 nt, Homo sapiens
cacacuuggaugca

SEQ ID NO: 772638 - RNA, 17 nt, Homo sapiens
cacacuuuacacaagaa

SEQ ID NO: 772639 - RNA, 16 nt, Homo sapiens
cacacuuuccaucucu

SEQ ID NO: 772640 - RNA, 19 nt, Homo sapiens
cacagaaagacugagcuca

SEQ ID NO: 772641 - RNA, 16 nt, Homo sapiens
cacagaaauuuucaau

SEQ ID NO: 772642 - RNA, 22 nt, Homo sapiens
cacagaagcuuccugagcuuca

SEQ ID NO: 772643 - RNA, 12 nt, Homo sapiens
cacagaaguagc

SEQ ID NO: 772644 - RNA, 17 nt, Homo sapiens
cacagaauagcacaaac

SEQ ID NO: 772645 - RNA, 22 nt, Homo sapiens
cacagaauauuuuuauauuucc

SEQ ID NO: 772646 - RNA, 20 nt, Homo sapiens
cacagacuauuuuuagauuu

SEQ ID NO: 772647 - RNA, 16 nt, Homo sapiens
cacagacugauuggaa

SEQ ID NO: 772648 - RNA, 16 nt, Homo sapiens
cacagagaacaggcag

SEQ ID NO: 772649 - RNA, 18 nt, Homo sapiens
cacagagauucuggaucu

SEQ ID NO: 772650 - RNA, 23 nt, Homo sapiens
cacagagugcauugugaggguua

SEQ ID NO: 772651 - RNA, 14 nt, Homo sapiens
cacagauauuucca

SEQ ID NO: 772652 - RNA, 21 nt, Homo sapiens
cacagauccccuggaaaccca

SEQ ID NO: 772653 - RNA, 18 nt, Homo sapiens
cacagaugauacuuccaa

SEQ ID NO: 772654 - RNA, 17 nt, Homo sapiens
cacagauuugcauuuca

SEQ ID NO: 772655 - RNA, 15 nt, Homo sapiens
cacagcaacuauaua

SEQ ID NO: 772656 - RNA, 21 nt, Homo sapiens
cacagcaagggugaugggaaa

SEQ ID NO: 772657 - RNA, 21 nt, Homo sapiens
cacagcaccuccauguggacu

SEQ ID NO: 772658 - RNA, 18 nt, Homo sapiens
cacagcagauaccuggug

SEQ ID NO: 772659 - RNA, 22 nt, Homo sapiens
cacagcagguccuccaucccaa

SEQ ID NO: 772660 - RNA, 17 nt, Homo sapiens
cacagcaucgggagcac

SEQ ID NO: 772661 - RNA, 16 nt, Homo sapiens
cacagcaugugccaag

SEQ ID NO: 772662 - RNA, 18 nt, Homo sapiens
cacagcauguguauuucc

SEQ ID NO: 772663 - RNA, 17 nt, Homo sapiens
cacagccaacgagacac

SEQ ID NO: 772664 - RNA, 11 nt, Homo sapiens
cacagccauag

SEQ ID NO: 772665 - RNA, 13 nt, Homo sapiens
cacagcccaagag

SEQ ID NO: 772666 - RNA, 14 nt, Homo sapiens
cacagcccaagagg

SEQ ID NO: 772667 - RNA, 18 nt, Homo sapiens
cacagccccaaccuccca

SEQ ID NO: 772668 - RNA, 23 nt, Homo sapiens
cacagccgcagccucccucugac

SEQ ID NO: 772669 - RNA, 15 nt, Homo sapiens
cacagccucuagugu

SEQ ID NO: 772670 - RNA, 20 nt, Homo sapiens
cacagcggaggagaccagcu

SEQ ID NO: 772671 - RNA, 23 nt, Homo sapiens
cacagcgucccuagcagugaacu

SEQ ID NO: 772672 - RNA, 15 nt, Homo sapiens
cacagcuacacagau

SEQ ID NO: 772673 - RNA, 15 nt, Homo sapiens
cacagcuacucagug

SEQ ID NO: 772674 - RNA, 20 nt, Homo sapiens
cacagcugaguuaugaugua

SEQ ID NO: 772675 - RNA, 21 nt, Homo sapiens
cacagcugcagcugggcccca

SEQ ID NO: 772676 - RNA, 15 nt, Homo sapiens
cacagcugcauuaaa

SEQ ID NO: 772677 - RNA, 16 nt, Homo sapiens
cacagcugcuggagaa

SEQ ID NO: 772678 - RNA, 17 nt, Homo sapiens
cacagcuggcucugaca

SEQ ID NO: 772679 - RNA, 21 nt, Homo sapiens
cacagcuucuccaagcaucac

SEQ ID NO: 772680 - RNA, 18 nt, Homo sapiens
cacagcuuuaugauauca

SEQ ID NO: 772681 - RNA, 19 nt, Homo sapiens
cacaggaagccugcagucc

SEQ ID NO: 772682 - RNA, 18 nt, Homo sapiens
cacaggcaaaacucagua

SEQ ID NO: 772683 - RNA, 18 nt, Homo sapiens
cacaggcagauguuugcc

SEQ ID NO: 772684 - RNA, 19 nt, Homo sapiens
cacaggcaucuacacagcc

SEQ ID NO: 772685 - RNA, 23 nt, Homo sapiens
cacaggcuggcgcucggcuccac

SEQ ID NO: 772686 - RNA, 23 nt, Homo sapiens
cacagggagaauugaaacugagu

SEQ ID NO: 772687 - RNA, 13 nt, Homo sapiens
cacaggggcccca

SEQ ID NO: 772688 - RNA, 18 nt, Homo sapiens
cacaguaauacucauucc

SEQ ID NO: 772689 - RNA, 21 nt, Homo sapiens
gauuauuggaaauuuguuaua

SEQ ID NO: 772690 - RNA, 22 nt, Homo sapiens
gauucaaaguguuguguuccug

SEQ ID NO: 772691 - RNA, 19 nt, Homo sapiens
gauucaacugcaucuccaa

SEQ ID NO: 772692 - RNA, 19 nt, Homo sapiens
gauucaagaacaagcaaug

SEQ ID NO: 772693 - RNA, 14 nt, Homo sapiens
gauucaagucugca

SEQ ID NO: 772694 - RNA, 14 nt, Homo sapiens
gauucaccaaaaua

SEQ ID NO: 772695 - RNA, 18 nt, Homo sapiens
gauucaccucuuccucug

SEQ ID NO: 772696 - RNA, 15 nt, Homo sapiens
gauucaccucuucuu

SEQ ID NO: 772697 - RNA, 21 nt, Homo sapiens
gauucacgcccucuuguuucc

SEQ ID NO: 772698 - RNA, 22 nt, Homo sapiens
gauucauuuuccuguucaguga

SEQ ID NO: 772699 - RNA, 19 nt, Homo sapiens
gauuccugguuugacucag

SEQ ID NO: 772700 - RNA, 19 nt, Homo sapiens
gauuccuuuguaucagggu

SEQ ID NO: 772701 - RNA, 23 nt, Homo sapiens
gauucgcccuccucccugucaua

SEQ ID NO: 772702 - RNA, 15 nt, Homo sapiens
gauucuaaagcucaa

SEQ ID NO: 772703 - RNA, 15 nt, Homo sapiens
gauucuacagugaug

SEQ ID NO: 772704 - RNA, 16 nt, Homo sapiens
gauucuccugccucag

SEQ ID NO: 772705 - RNA, 18 nt, Homo sapiens
gauucucugugucuaaga

SEQ ID NO: 772706 - RNA, 15 nt, Homo sapiens
gauucugaaucucaa

SEQ ID NO: 772707 - RNA, 15 nt, Homo sapiens
gauucugcagcaccg

SEQ ID NO: 772708 - RNA, 23 nt, Homo sapiens
gauucugugaucuuuuaaagugu

SEQ ID NO: 772709 - RNA, 14 nt, Homo sapiens
gauucuguugcaua

SEQ ID NO: 772710 - RNA, 20 nt, Homo sapiens
gauucuucucuuaauuucau

SEQ ID NO: 772711 - RNA, 16 nt, Homo sapiens
gauugaaagaaccaga

SEQ ID NO: 772712 - RNA, 13 nt, Homo sapiens
gauugaggccagg

SEQ ID NO: 772713 - RNA, 23 nt, Homo sapiens
gauugauagaaaauccuucagcu

SEQ ID NO: 772714 - RNA, 19 nt, Homo sapiens
gauugauagaguguuauca

SEQ ID NO: 772715 - RNA, 11 nt, Homo sapiens
gauugcaaugc

SEQ ID NO: 772716 - RNA, 23 nt, Homo sapiens
gauugcagcuuuauguucauuug

SEQ ID NO: 772717 - RNA, 16 nt, Homo sapiens
gauuguuuacagucau

SEQ ID NO: 772718 - RNA, 18 nt, Homo sapiens
gauuguuuccucuuccaa

SEQ ID NO: 772719 - RNA, 14 nt, Homo sapiens
gauuguuugacaca

SEQ ID NO: 772720 - RNA, 18 nt, Homo sapiens
gauuuaaaaaaagaacau

SEQ ID NO: 772721 - RNA, 17 nt, Homo sapiens
gauuuaaaaacuggaac

SEQ ID NO: 772722 - RNA, 17 nt, Homo sapiens
gauuuaaaguggcagcu

SEQ ID NO: 772723 - RNA, 16 nt, Homo sapiens
gauuuaauccaguuau

SEQ ID NO: 772724 - RNA, 15 nt, Homo sapiens
gauuuagauaugcaa

SEQ ID NO: 772725 - RNA, 19 nt, Homo sapiens
gauuuagcaaguucuagaa

SEQ ID NO: 772726 - RNA, 16 nt, Homo sapiens
gauuuaugaucacuug

SEQ ID NO: 772727 - RNA, 19 nt, Homo sapiens
gauuuaugaucacuuggaa

SEQ ID NO: 772728 - RNA, 16 nt, Homo sapiens
gauuuaugaugcacuu

SEQ ID NO: 772729 - RNA, 22 nt, Homo sapiens
gauuuaugaugcacuuauucaa

SEQ ID NO: 772730 - RNA, 20 nt, Homo sapiens
gauuucacuguguuagccag

SEQ ID NO: 772731 - RNA, 22 nt, Homo sapiens
gauuucaggauacucugucaga

SEQ ID NO: 772732 - RNA, 23 nt, Homo sapiens
gauuucaugccuggugcuuccaa

SEQ ID NO: 772733 - RNA, 20 nt, Homo sapiens
gauuucaugucacuaaacaa

SEQ ID NO: 772734 - RNA, 21 nt, Homo sapiens
gauuucccacugcacuccagc

SEQ ID NO: 772735 - RNA, 17 nt, Homo sapiens
gauuucugguuguuaug

SEQ ID NO: 772736 - RNA, 15 nt, Homo sapiens
gauuucuuaguucau

SEQ ID NO: 772737 - RNA, 21 nt, Homo sapiens
gauuucuuccagaaggcaaaa

SEQ ID NO: 772738 - RNA, 12 nt, Homo sapiens
gauuugaacccc

SEQ ID NO: 772739 - RNA, 14 nt, Homo sapiens
gauuugccaaaaac

SEQ ID NO: 772740 - RNA, 12 nt, Homo sapiens
gauuugcucagg

SEQ ID NO: 772741 - RNA, 20 nt, Homo sapiens
gauuuggggcagagggacag

SEQ ID NO: 772742 - RNA, 18 nt, Homo sapiens
gauuuggucacacucuca

SEQ ID NO: 772743 - RNA, 18 nt, Homo sapiens
gauuugguggaugugaug

SEQ ID NO: 772744 - RNA, 18 nt, Homo sapiens
gauuugugaacuggaaga

SEQ ID NO: 772745 - RNA, 21 nt, Homo sapiens
auguugugauguauucuagcu

SEQ ID NO: 772746 - RNA, 22 nt, Homo sapiens
auguuguguuuuuaacauguca

SEQ ID NO: 772747 - RNA, 16 nt, Homo sapiens
auguuuaaauagccua

SEQ ID NO: 772748 - RNA, 23 nt, Homo sapiens
auguuucaaacuuuggaacaaga

SEQ ID NO: 772749 - RNA, 21 nt, Homo sapiens
auguuucaagaaaauggauuu

SEQ ID NO: 772750 - RNA, 19 nt, Homo sapiens
auguuucuggacauucucu

SEQ ID NO: 772751 - RNA, 11 nt, Homo sapiens
auguuugcacu

SEQ ID NO: 772752 - RNA, 14 nt, Homo sapiens
auguuugcacuuug

SEQ ID NO: 772753 - RNA, 21 nt, Homo sapiens
auguuuggaaaaaacucugaa

SEQ ID NO: 772754 - RNA, 21 nt, Homo sapiens
auguuuggaaaccacagucag

SEQ ID NO: 772755 - RNA, 18 nt, Homo sapiens
auguuuggaauaaaguca

SEQ ID NO: 772756 - RNA, 19 nt, Homo sapiens
auguuuuaaauaguugcaa

SEQ ID NO: 772757 - RNA, 14 nt, Homo sapiens
auguuuucuaguca

SEQ ID NO: 772758 - RNA, 14 nt, Homo sapiens
auuaaaaacuacca

SEQ ID NO: 772759 - RNA, 12 nt, Homo sapiens
auuaaaaagccu

SEQ ID NO: 772760 - RNA, 17 nt, Homo sapiens
auuaaaacacagcuuua

SEQ ID NO: 772761 - RNA, 13 nt, Homo sapiens
auuaaaacacuua

SEQ ID NO: 772762 - RNA, 13 nt, Homo sapiens
auuaaaaccaauu

SEQ ID NO: 772763 - RNA, 17 nt, Homo sapiens
auuaaaacuaagcacaa

SEQ ID NO: 772764 - RNA, 23 nt, Homo sapiens
auuaaaacucauuuuuguuuuca

SEQ ID NO: 772765 - RNA, 17 nt, Homo sapiens
auuaaaagcaaaucauu

SEQ ID NO: 772766 - RNA, 22 nt, Homo sapiens
auuaaaaugucggauuuaucuu

SEQ ID NO: 772767 - RNA, 12 nt, Homo sapiens
auuaaacacugu

SEQ ID NO: 772768 - RNA, 19 nt, Homo sapiens
auuaaacuugucagaauuu

SEQ ID NO: 772769 - RNA, 19 nt, Homo sapiens
auuaaagaauguuuuggaa

SEQ ID NO: 772770 - RNA, 17 nt, Homo sapiens
auuaaagguauuccuug

SEQ ID NO: 772771 - RNA, 11 nt, Homo sapiens
auuaaagucag

SEQ ID NO: 772772 - RNA, 14 nt, Homo sapiens
auuaaaucugguca

SEQ ID NO: 772773 - RNA, 15 nt, Homo sapiens
auuaaaugcaucaau

SEQ ID NO: 772774 - RNA, 12 nt, Homo sapiens
auuaaauggugc

SEQ ID NO: 772775 - RNA, 14 nt, Homo sapiens
auuaaauguugcuu

SEQ ID NO: 772776 - RNA, 19 nt, Homo sapiens
auuaaauucugagccugau

SEQ ID NO: 772777 - RNA, 15 nt, Homo sapiens
auuaacaaagugcca

SEQ ID NO: 772778 - RNA, 13 nt, Homo sapiens
auuaacaaaugug

SEQ ID NO: 772779 - RNA, 19 nt, Homo sapiens
auuaacucaccagauuuac

SEQ ID NO: 772780 - RNA, 14 nt, Homo sapiens
auuaacuccuccug

SEQ ID NO: 772781 - RNA, 13 nt, Homo sapiens
auuaacugaacuu

SEQ ID NO: 772782 - RNA, 20 nt, Homo sapiens
auuaacugcacaaacaauau

SEQ ID NO: 772783 - RNA, 12 nt, Homo sapiens
auuaacugguga

SEQ ID NO: 772784 - RNA, 18 nt, Homo sapiens
auuaacuuuaauucucuu

SEQ ID NO: 772785 - RNA, 21 nt, Homo sapiens
auuaagaaaccuugcucuccu

SEQ ID NO: 772786 - RNA, 16 nt, Homo sapiens
auuaagaaauacucau

SEQ ID NO: 772787 - RNA, 14 nt, Homo sapiens
auuaagaaugccag

SEQ ID NO: 772788 - RNA, 17 nt, Homo sapiens
auuaagagauugccauu

SEQ ID NO: 772789 - RNA, 18 nt, Homo sapiens
auuaagcaaacacuugaa

SEQ ID NO: 772790 - RNA, 24 nt, Homo sapiens
auuaaggccuuuuccacacgcauu

SEQ ID NO: 772791 - RNA, 19 nt, Homo sapiens
auucacaaagguuaaguua

SEQ ID NO: 772792 - RNA, 21 nt, Homo sapiens
auucacaauagaaacucacca

SEQ ID NO: 772793 - RNA, 20 nt, Homo sapiens
auucacauauaucaaaguga

SEQ ID NO: 772794 - RNA, 19 nt, Homo sapiens
auucacccuucaacauaaa

SEQ ID NO: 772795 - RNA, 23 nt, Homo sapiens
auucaccuugguguuucucucug

SEQ ID NO: 772796 - RNA, 13 nt, Homo sapiens
auucacuacaggu

SEQ ID NO: 772797 - RNA, 14 nt, Homo sapiens
auucacuuacugac

SEQ ID NO: 772798 - RNA, 16 nt, Homo sapiens
auucacuucauaaucc

SEQ ID NO: 772799 - RNA, 19 nt, Homo sapiens
auucagaacugagggcucu

SEQ ID NO: 772800 - RNA, 22 nt, Homo sapiens
auucagacaacauuaugaucua

SEQ ID NO: 772801 - RNA, 12 nt, Homo sapiens
auucagacacuu

SEQ ID NO: 772802 - RNA, 19 nt, Homo sapiens
auucagagcaaguuccuga

SEQ ID NO: 772803 - RNA, 23 nt, Homo sapiens
auucagagcuauggugcuugcug

SEQ ID NO: 772804 - RNA, 16 nt, Homo sapiens
auucagcacacacaaa

SEQ ID NO: 772805 - RNA, 15 nt, Homo sapiens
auucagcauguccaa

SEQ ID NO: 772806 - RNA, 15 nt, Homo sapiens
auucagccagcuuaa

SEQ ID NO: 772807 - RNA, 16 nt, Homo sapiens
auucagccagcuuaaa

SEQ ID NO: 772808 - RNA, 22 nt, Homo sapiens
auucagcucuggagaacagugg

SEQ ID NO: 772809 - RNA, 16 nt, Homo sapiens
auucagguaacacuag

SEQ ID NO: 772810 - RNA, 23 nt, Homo sapiens
auucagguauguugccuuuaugg

SEQ ID NO: 772811 - RNA, 15 nt, Homo sapiens
auucaguaguggaaa

SEQ ID NO: 772812 - RNA, 19 nt, Homo sapiens
auucaguauuagcaaugga

SEQ ID NO: 772813 - RNA, 16 nt, Homo sapiens
auucagucacauggca

SEQ ID NO: 772814 - RNA, 21 nt, Homo sapiens
auucagucucagcugcugaaa

SEQ ID NO: 772815 - RNA, 16 nt, Homo sapiens
auucaguuuucaggau

SEQ ID NO: 772816 - RNA, 15 nt, Homo sapiens
auucauaaaaauaac

SEQ ID NO: 772817 - RNA, 22 nt, Homo sapiens
auucauauuuacuucuuauaca

SEQ ID NO: 772818 - RNA, 18 nt, Homo sapiens
auucauccuuccauccau

SEQ ID NO: 772819 - RNA, 22 nt, Homo sapiens
auucaucugggaggcagaacag

SEQ ID NO: 772820 - RNA, 22 nt, Homo sapiens
auucaugccagggacugacaaa

SEQ ID NO: 772821 - RNA, 22 nt, Homo sapiens
auucauugaucaaauauuucaa

SEQ ID NO: 772822 - RNA, 14 nt, Homo sapiens
auucauuguucaaa

SEQ ID NO: 772823 - RNA, 17 nt, Homo sapiens
auucauuuggugacugu

SEQ ID NO: 772824 - RNA, 23 nt, Homo sapiens
auucauuuuucuuucugauguca

SEQ ID NO: 772825 - RNA, 13 nt, Homo sapiens
auuccaaaaacau

SEQ ID NO: 772826 - RNA, 13 nt, Homo sapiens
auuccaaacuuua

SEQ ID NO: 772827 - RNA, 13 nt, Homo sapiens
auuccaaagucuc

SEQ ID NO: 772828 - RNA, 16 nt, Homo sapiens
auuccaacauuucuca

SEQ ID NO: 772829 - RNA, 21 nt, Homo sapiens
auuccaacauuucucacugaa

SEQ ID NO: 772830 - RNA, 14 nt, Homo sapiens
auuccaacuucaau

SEQ ID NO: 772831 - RNA, 18 nt, Homo sapiens
auuccacacagaaugcaa

SEQ ID NO: 772832 - RNA, 13 nt, Homo sapiens
auuccacuggacu

SEQ ID NO: 772833 - RNA, 18 nt, Homo sapiens
auuccacuuuuauucauu

SEQ ID NO: 772834 - RNA, 22 nt, Homo sapiens
auuccagagugcugaggccagg

SEQ ID NO: 772835 - RNA, 18 nt, Homo sapiens
auuccagcaguuguucca

SEQ ID NO: 772836 - RNA, 15 nt, Homo sapiens
auuccagcugucacu

SEQ ID NO: 772837 - RNA, 16 nt, Homo sapiens
auuccagucuacuuga

SEQ ID NO: 772838 - RNA, 20 nt, Homo sapiens
auuccauguggauaucaguu

SEQ ID NO: 772839 - RNA, 22 nt, Homo sapiens
auuccauuacuaagaaacacau

SEQ ID NO: 772840 - RNA, 14 nt, Homo sapiens
auucccaagcuuuu

SEQ ID NO: 772841 - RNA, 16 nt, Homo sapiens
auuccccugugucauc

SEQ ID NO: 772842 - RNA, 12 nt, Homo sapiens
auucccuuguau

SEQ ID NO: 772843 - RNA, 21 nt, Homo sapiens
auuccggaaacuaguguacau

SEQ ID NO: 772844 - RNA, 20 nt, Homo sapiens
auuccggauccuaagcaucu

SEQ ID NO: 772845 - RNA, 20 nt, Homo sapiens
auuccgucaccacgacuggc

SEQ ID NO: 772846 - RNA, 15 nt, Homo sapiens
auuccuagaaguuga

SEQ ID NO: 772847 - RNA, 19 nt, Homo sapiens
auuccuauauccugugacu

SEQ ID NO: 772848 - RNA, 20 nt, Homo sapiens
auuccuauuggaaacagaga

SEQ ID NO: 772849 - RNA, 12 nt, Homo sapiens
auuccuauuuaa

SEQ ID NO: 772850 - RNA, 20 nt, Homo sapiens
auuccugauaauaauugauc

SEQ ID NO: 772851 - RNA, 16 nt, Homo sapiens
auuccugaugaccaau

SEQ ID NO: 772852 - RNA, 21 nt, Homo sapiens
auuccugauggaaaaugcaaa

SEQ ID NO: 772853 - RNA, 16 nt, Homo sapiens
auuccuggcucuaccc

SEQ ID NO: 772854 - RNA, 20 nt, Homo sapiens
auuccugggccuguccccca

SEQ ID NO: 772855 - RNA, 14 nt, Homo sapiens
auuccuguaggggg

SEQ ID NO: 772856 - RNA, 18 nt, Homo sapiens
auuccuguuacuuuacag

SEQ ID NO: 772857 - RNA, 17 nt, Homo sapiens
auuccuguugcucuguu

SEQ ID NO: 772858 - RNA, 20 nt, Homo sapiens
auuccuuagcuuagaccuca

SEQ ID NO: 772859 - RNA, 21 nt, Homo sapiens
auuccuucgaaaggccuucag

SEQ ID NO: 772860 - RNA, 15 nt, Homo sapiens
auuccuugguaauau

SEQ ID NO: 772861 - RNA, 18 nt, Homo sapiens
gaucguucucugccucac

SEQ ID NO: 772862 - RNA, 19 nt, Homo sapiens
gaucuaacaaaauaagguu

SEQ ID NO: 772863 - RNA, 14 nt, Homo sapiens
gaucuaauuuacau

SEQ ID NO: 772864 - RNA, 20 nt, Homo sapiens
gaucucagcagugaaguaua

SEQ ID NO: 772865 - RNA, 20 nt, Homo sapiens
gaucuccaacagccagugug

SEQ ID NO: 772866 - RNA, 15 nt, Homo sapiens
gaucuccccacucua

SEQ ID NO: 772867 - RNA, 20 nt, Homo sapiens
gaucucgccacugcacucca

SEQ ID NO: 772868 - RNA, 20 nt, Homo sapiens
gaucugagcucccaccuccc

SEQ ID NO: 772869 - RNA, 15 nt, Homo sapiens
gaucugcaaacaaug

SEQ ID NO: 772870 - RNA, 14 nt, Homo sapiens
gaucugcaguuuuu

SEQ ID NO: 772871 - RNA, 18 nt, Homo sapiens
gaucugcaguuuuugccu

SEQ ID NO: 772872 - RNA, 16 nt, Homo sapiens
gaucugcuagugcugu

SEQ ID NO: 772873 - RNA, 12 nt, Homo sapiens
gaucugugcuca

SEQ ID NO: 772874 - RNA, 18 nt, Homo sapiens
gaucuuaacaaagccuuu

SEQ ID NO: 772875 - RNA, 18 nt, Homo sapiens
gaucuuccagaagcugua

SEQ ID NO: 772876 - RNA, 14 nt, Homo sapiens
gaucuugguucacu

SEQ ID NO: 772877 - RNA, 19 nt, Homo sapiens
gaucuuucuuuccaaaaca

SEQ ID NO: 772878 - RNA, 20 nt, Homo sapiens
gaugaauagaugugaucacu

SEQ ID NO: 772879 - RNA, 19 nt, Homo sapiens
gaugaauuuuaucagccau

SEQ ID NO: 772880 - RNA, 16 nt, Homo sapiens
gaugacaacaaucuca

SEQ ID NO: 772881 - RNA, 17 nt, Homo sapiens
gaugaccauacucagac

SEQ ID NO: 772882 - RNA, 18 nt, Homo sapiens
gaugaccauuuucugcca

SEQ ID NO: 772883 - RNA, 18 nt, Homo sapiens
gaugacgugucuccucac

SEQ ID NO: 772884 - RNA, 16 nt, Homo sapiens
gaugagaaucaugcac

SEQ ID NO: 772885 - RNA, 14 nt, Homo sapiens
gaugagagggaaaa

SEQ ID NO: 772886 - RNA, 18 nt, Homo sapiens
gaugaggucaccagggga

SEQ ID NO: 772887 - RNA, 17 nt, Homo sapiens
gaugaguuaacugugaa

SEQ ID NO: 772888 - RNA, 18 nt, Homo sapiens
gaugaguuuaucauguca

SEQ ID NO: 772889 - RNA, 23 nt, Homo sapiens
gaugauacuuggaugcagcucuu

SEQ ID NO: 772890 - RNA, 17 nt, Homo sapiens
gaugauauaauuuaacu

SEQ ID NO: 772891 - RNA, 21 nt, Homo sapiens
gaugaucuggauccaccaaga

SEQ ID NO: 772892 - RNA, 12 nt, Homo sapiens
gaugauuucccu

SEQ ID NO: 772893 - RNA, 14 nt, Homo sapiens
gaugcaagugcaac

SEQ ID NO: 772894 - RNA, 22 nt, Homo sapiens
gaugcacuaccauugcuguucu

SEQ ID NO: 772895 - RNA, 16 nt, Homo sapiens
gaugcaggauuucuuc

SEQ ID NO: 772896 - RNA, 20 nt, Homo sapiens
gaugccaauuuccucuccac

SEQ ID NO: 772897 - RNA, 19 nt, Homo sapiens
gaugccagcauauacugaa

SEQ ID NO: 772898 - RNA, 18 nt, Homo sapiens
gaugccuccccaagacug

SEQ ID NO: 772899 - RNA, 16 nt, Homo sapiens
gaugcuauuuaugcaa

SEQ ID NO: 772900 - RNA, 15 nt, Homo sapiens
gaugcucaaguccaa

SEQ ID NO: 772901 - RNA, 23 nt, Homo sapiens
gaugcuccuaguuugaccucaca

SEQ ID NO: 772902 - RNA, 22 nt, Homo sapiens
gaugcugaccucaccugguccu

SEQ ID NO: 772903 - RNA, 16 nt, Homo sapiens
gaugcugccauuuaac

SEQ ID NO: 772904 - RNA, 15 nt, Homo sapiens
gaugcugcuccgccc

SEQ ID NO: 772905 - RNA, 13 nt, Homo sapiens
gauggaagcuugu

SEQ ID NO: 772906 - RNA, 12 nt, Homo sapiens
gauggaauauca

SEQ ID NO: 772907 - RNA, 16 nt, Homo sapiens
gauggacuccugacca

SEQ ID NO: 772908 - RNA, 14 nt, Homo sapiens
gauggacucugaaa

SEQ ID NO: 772909 - RNA, 11 nt, Homo sapiens
gauggagacac

SEQ ID NO: 772910 - RNA, 18 nt, Homo sapiens
gauggagagcagccagca

SEQ ID NO: 772911 - RNA, 16 nt, Homo sapiens
gauggagcgcaccugc

SEQ ID NO: 772912 - RNA, 17 nt, Homo sapiens
gauggaggggugguccu

SEQ ID NO: 772913 - RNA, 19 nt, Homo sapiens
gauggaggucacacuggua

SEQ ID NO: 772914 - RNA, 13 nt, Homo sapiens
gauggauguuggg

SEQ ID NO: 772915 - RNA, 21 nt, Homo sapiens
gauggcagauucccacugccg

SEQ ID NO: 772916 - RNA, 23 nt, Homo sapiens
gauggccacccgcccacagccag

SEQ ID NO: 772917 - RNA, 10 nt, Homo sapiens
gauggcccaa

SEQ ID NO: 772918 - RNA, 17 nt, Homo sapiens
ggaauuccacagggacc

SEQ ID NO: 772919 - RNA, 18 nt, Homo sapiens
ggaauucuuucuguugaa

SEQ ID NO: 772920 - RNA, 13 nt, Homo sapiens
ggaauugcucaga

SEQ ID NO: 772921 - RNA, 20 nt, Homo sapiens
ggaauuuccucuauugaugu

SEQ ID NO: 772922 - RNA, 18 nt, Homo sapiens
ggaauuucuuaacuucuu

SEQ ID NO: 772923 - RNA, 17 nt, Homo sapiens
ggacaaaacacuguguc

SEQ ID NO: 772924 - RNA, 24 nt, Homo sapiens
ggacaaaagggguuaauguuacuu

SEQ ID NO: 772925 - RNA, 19 nt, Homo sapiens
ggacaaagaaauuccccaa

SEQ ID NO: 772926 - RNA, 15 nt, Homo sapiens
ggacaacauccuuaa

SEQ ID NO: 772927 - RNA, 14 nt, Homo sapiens
ggacaagacacuga

SEQ ID NO: 772928 - RNA, 22 nt, Homo sapiens
ggacaaggagugugaccacuga

SEQ ID NO: 772929 - RNA, 23 nt, Homo sapiens
ggacacagcgcgguuuuuuccac

SEQ ID NO: 772930 - RNA, 15 nt, Homo sapiens
ggacaccaagccuug

SEQ ID NO: 772931 - RNA, 18 nt, Homo sapiens
ggacaccuuuuaacucac

SEQ ID NO: 772932 - RNA, 11 nt, Homo sapiens
ggacacugaga

SEQ ID NO: 772933 - RNA, 21 nt, Homo sapiens
ggacagagauuaagaucagca

SEQ ID NO: 772934 - RNA, 15 nt, Homo sapiens
ggacaggcacuccaa

SEQ ID NO: 772935 - RNA, 23 nt, Homo sapiens
ggacaguaucccacauccaacuc

SEQ ID NO: 772936 - RNA, 14 nt, Homo sapiens
ggacaguggugaca

SEQ ID NO: 772937 - RNA, 13 nt, Homo sapiens
ggacauaagacag

SEQ ID NO: 772938 - RNA, 17 nt, Homo sapiens
ggacauucucuuugaua

SEQ ID NO: 772939 - RNA, 20 nt, Homo sapiens
ggacauugagauacuaucau

SEQ ID NO: 772940 - RNA, 20 nt, Homo sapiens
ggacauuuggguugguucca

SEQ ID NO: 772941 - RNA, 18 nt, Homo sapiens
ggaccaaggggugggcca

SEQ ID NO: 772942 - RNA, 14 nt, Homo sapiens
ggaccacaguaaca

SEQ ID NO: 772943 - RNA, 14 nt, Homo sapiens
ggaccacauuuuau

SEQ ID NO: 772944 - RNA, 16 nt, Homo sapiens
ggaccaccaauggauu

SEQ ID NO: 772945 - RNA, 17 nt, Homo sapiens
ggaccauucauacccac

SEQ ID NO: 772946 - RNA, 19 nt, Homo sapiens
ggaccauugaccucagcug

SEQ ID NO: 772947 - RNA, 20 nt, Homo sapiens
ggacccaccccaacucuccc

SEQ ID NO: 772948 - RNA, 14 nt, Homo sapiens
ggacccuguccaau

SEQ ID NO: 772949 - RNA, 15 nt, Homo sapiens
ggaccgccauggugc

SEQ ID NO: 772950 - RNA, 22 nt, Homo sapiens
ggaccucgccugcuggggaccu

SEQ ID NO: 772951 - RNA, 22 nt, Homo sapiens
ggaccucggaugaccauacuca

SEQ ID NO: 772952 - RNA, 23 nt, Homo sapiens
ggaccuggcgugcucagacccaa

SEQ ID NO: 772953 - RNA, 17 nt, Homo sapiens
ggaccuuggcugcugga

SEQ ID NO: 772954 - RNA, 21 nt, Homo sapiens
ggacgaagcggagagagccaa

SEQ ID NO: 772955 - RNA, 19 nt, Homo sapiens
ggacgagacccuacaggag

SEQ ID NO: 772956 - RNA, 19 nt, Homo sapiens
ggacgaggaguaauggcau

SEQ ID NO: 772957 - RNA, 21 nt, Homo sapiens
ggacgaggaguaauggcauuu

SEQ ID NO: 772958 - RNA, 17 nt, Homo sapiens
ggacuaacccaaugccu

SEQ ID NO: 772959 - RNA, 23 nt, Homo sapiens
ggacuaacccaaugccugugaag

SEQ ID NO: 772960 - RNA, 22 nt, Homo sapiens
ggacuaaccccaacgcacagga

SEQ ID NO: 772961 - RNA, 23 nt, Homo sapiens
ggacuaaccccaacgcacaggaa

SEQ ID NO: 772962 - RNA, 22 nt, Homo sapiens
ggacuacaggcucaugccauca

SEQ ID NO: 772963 - RNA, 10 nt, Homo sapiens
ggacuauuau

SEQ ID NO: 772964 - RNA, 14 nt, Homo sapiens
ggacucaagggaaa

SEQ ID NO: 772965 - RNA, 23 nt, Homo sapiens
ggacucagguugucugaagucac

SEQ ID NO: 772966 - RNA, 21 nt, Homo sapiens
ggacuccagaaucuaaagcca

SEQ ID NO: 772967 - RNA, 22 nt, Homo sapiens
ggacuccaucucucauccucca

SEQ ID NO: 772968 - RNA, 19 nt, Homo sapiens
ggacucuuccaccucccaa

SEQ ID NO: 772969 - RNA, 20 nt, Homo sapiens
ggacuggaaggggaagggac

SEQ ID NO: 772970 - RNA, 11 nt, Homo sapiens
ggacugugauu

SEQ ID NO: 772971 - RNA, 13 nt, Homo sapiens
ggacugugccuga

SEQ ID NO: 772972 - RNA, 19 nt, Homo sapiens
ggacuguggcacuugccug

SEQ ID NO: 772973 - RNA, 23 nt, Homo sapiens
ggacuuaagacuuaucaugccaa

SEQ ID NO: 772974 - RNA, 18 nt, Homo sapiens
ggacuuccuguccagcuc

SEQ ID NO: 772975 - RNA, 17 nt, Homo sapiens
ggacuucuggcagggaa

SEQ ID NO: 772976 - RNA, 18 nt, Homo sapiens
ggacuucuggcagggaag

SEQ ID NO: 772977 - RNA, 22 nt, Homo sapiens
ggacuugccacccccaguuccu

SEQ ID NO: 772978 - RNA, 22 nt, Homo sapiens
ggacuugguuuguuauaucagg

SEQ ID NO: 772979 - RNA, 14 nt, Homo sapiens
ggacuuugagcaca

SEQ ID NO: 772980 - RNA, 17 nt, Homo sapiens
ggacuuuuauuuuggca

SEQ ID NO: 772981 - RNA, 22 nt, Homo sapiens
ggagaaauaugguacucauuaa

SEQ ID NO: 772982 - RNA, 16 nt, Homo sapiens
ggagaacugggguuca

SEQ ID NO: 772983 - RNA, 17 nt, Homo sapiens
ggagaagcaugaaaaag

SEQ ID NO: 772984 - RNA, 19 nt, Homo sapiens
ggagaagggaggguggcca

SEQ ID NO: 772985 - RNA, 18 nt, Homo sapiens
ggagaaucacuugcacuc

SEQ ID NO: 772986 - RNA, 19 nt, Homo sapiens
ggagaaugaauacugggaa

SEQ ID NO: 772987 - RNA, 15 nt, Homo sapiens
ggagaauuacuugaa

SEQ ID NO: 772988 - RNA, 22 nt, Homo sapiens
ggagaauugacugaagcacagc

SEQ ID NO: 772989 - RNA, 16 nt, Homo sapiens
ggagacaaggugcuaa

SEQ ID NO: 772990 - RNA, 23 nt, Homo sapiens
ggagacacuauuuaucugugcaa

SEQ ID NO: 772991 - RNA, 13 nt, Homo sapiens
ggagacccauugc

SEQ ID NO: 772992 - RNA, 21 nt, Homo sapiens
ggagacucaccucugccucaa

SEQ ID NO: 772993 - RNA, 17 nt, Homo sapiens
ggagacugacacgaagc

SEQ ID NO: 772994 - RNA, 13 nt, Homo sapiens
ggagacugagauc

SEQ ID NO: 772995 - RNA, 16 nt, Homo sapiens
ggagacugucucaaga

SEQ ID NO: 772996 - RNA, 21 nt, Homo sapiens
ggagagaaguuaauccacauc

SEQ ID NO: 772997 - RNA, 13 nt, Homo sapiens
ggagagauguuug

SEQ ID NO: 772998 - RNA, 15 nt, Homo sapiens
ggagaggcauggcug

SEQ ID NO: 772999 - RNA, 14 nt, Homo sapiens
ggagaggggggcca

SEQ ID NO: 773000 - RNA, 11 nt, Homo sapiens
ggagaggucau

SEQ ID NO: 773001 - RNA, 19 nt, Homo sapiens
ggagaguagcaacaaaagg

SEQ ID NO: 773002 - RNA, 21 nt, Homo sapiens
ggagauauuuuccaacagcuu

SEQ ID NO: 773003 - RNA, 20 nt, Homo sapiens
ggagaucagcagcgugcaca

SEQ ID NO: 773004 - RNA, 20 nt, Homo sapiens
ggagauuccagucuacuuga

SEQ ID NO: 773005 - RNA, 16 nt, Homo sapiens
ggagcacggacuguca

SEQ ID NO: 773006 - RNA, 19 nt, Homo sapiens
ggagcagauuuuugcaaua

SEQ ID NO: 773007 - RNA, 19 nt, Homo sapiens
ggagcagcagccagcacca

SEQ ID NO: 773008 - RNA, 14 nt, Homo sapiens
ggagcagcugagau

SEQ ID NO: 773009 - RNA, 21 nt, Homo sapiens
ggagcaggaccuacuaggaga

SEQ ID NO: 773010 - RNA, 20 nt, Homo sapiens
ggagcagguuccccaagggc

SEQ ID NO: 773011 - RNA, 18 nt, Homo sapiens
ggagccaaaaucucaaga

SEQ ID NO: 773012 - RNA, 12 nt, Homo sapiens
ggagcccaguga

SEQ ID NO: 773013 - RNA, 17 nt, Homo sapiens
ggagccccagugccaag

SEQ ID NO: 773014 - RNA, 23 nt, Homo sapiens
caccucagggguuaagagcucag

SEQ ID NO: 773015 - RNA, 23 nt, Homo sapiens
caccuccaggcuuucccacuucc

SEQ ID NO: 773016 - RNA, 12 nt, Homo sapiens
caccuccaugug

SEQ ID NO: 773017 - RNA, 22 nt, Homo sapiens
caccuccauuucucuccaggaa

SEQ ID NO: 773018 - RNA, 13 nt, Homo sapiens
caccuccauuugc

SEQ ID NO: 773019 - RNA, 20 nt, Homo sapiens
caccucccaccccacuccag

SEQ ID NO: 773020 - RNA, 16 nt, Homo sapiens
caccuccucauguaca

SEQ ID NO: 773021 - RNA, 17 nt, Homo sapiens
caccuccucugugauuu

SEQ ID NO: 773022 - RNA, 18 nt, Homo sapiens
caccucgcccuucagccc

SEQ ID NO: 773023 - RNA, 18 nt, Homo sapiens
caccucucuguaguuuau

SEQ ID NO: 773024 - RNA, 21 nt, Homo sapiens
caccucugugggcacuggugg

SEQ ID NO: 773025 - RNA, 14 nt, Homo sapiens
caccucuuccuuga

SEQ ID NO: 773026 - RNA, 22 nt, Homo sapiens
caccugcaggcuuagguccuca

SEQ ID NO: 773027 - RNA, 12 nt, Homo sapiens
caccugcagugc

SEQ ID NO: 773028 - RNA, 16 nt, Homo sapiens
caccugccauuugcac

SEQ ID NO: 773029 - RNA, 16 nt, Homo sapiens
caccugccgcaugcuc

SEQ ID NO: 773030 - RNA, 16 nt, Homo sapiens
caccugccgucuucac

SEQ ID NO: 773031 - RNA, 22 nt, Homo sapiens
caccugccugcaucugugaaaa

SEQ ID NO: 773032 - RNA, 22 nt, Homo sapiens
caccugcguguccccgugcagu

SEQ ID NO: 773033 - RNA, 15 nt, Homo sapiens
caccugcuaaucaca

SEQ ID NO: 773034 - RNA, 23 nt, Homo sapiens
caccuggacacaacaccaaaaag

SEQ ID NO: 773035 - RNA, 20 nt, Homo sapiens
caccugggcuccugcauccu

SEQ ID NO: 773036 - RNA, 15 nt, Homo sapiens
caccuggggauuuua

SEQ ID NO: 773037 - RNA, 17 nt, Homo sapiens
caccugguacugaccca

SEQ ID NO: 773038 - RNA, 23 nt, Homo sapiens
caccugguggauaccugguugag

SEQ ID NO: 773039 - RNA, 14 nt, Homo sapiens
caccuguacauucu

SEQ ID NO: 773040 - RNA, 20 nt, Homo sapiens
caccuguagucccagcuacu

SEQ ID NO: 773041 - RNA, 14 nt, Homo sapiens
caccuguggugacc

SEQ ID NO: 773042 - RNA, 16 nt, Homo sapiens
caccuguguccaagaa

SEQ ID NO: 773043 - RNA, 16 nt, Homo sapiens
caccuucagacuuugc

SEQ ID NO: 773044 - RNA, 20 nt, Homo sapiens
caccuuccuaauaugcuuua

SEQ ID NO: 773045 - RNA, 16 nt, Homo sapiens
caccuugcccuuuacg

SEQ ID NO: 773046 - RNA, 20 nt, Homo sapiens
caccuuggcuuguuauugcc

SEQ ID NO: 773047 - RNA, 16 nt, Homo sapiens
caccuugucauguacc

SEQ ID NO: 773048 - RNA, 13 nt, Homo sapiens
caccuugugccug

SEQ ID NO: 773049 - RNA, 13 nt, Homo sapiens
caccuuugcacgu

SEQ ID NO: 773050 - RNA, 19 nt, Homo sapiens
caccuuuggaaagcucuga

SEQ ID NO: 773051 - RNA, 21 nt, Homo sapiens
caccuuuggugcagagguuuc

SEQ ID NO: 773052 - RNA, 23 nt, Homo sapiens
cacgaauugauuuaaagugaaca

SEQ ID NO: 773053 - RNA, 16 nt, Homo sapiens
cacgaccauuugauag

SEQ ID NO: 773054 - RNA, 15 nt, Homo sapiens
cacgacugccaugua

SEQ ID NO: 773055 - RNA, 20 nt, Homo sapiens
cacgagagagggcuuucuca

SEQ ID NO: 773056 - RNA, 12 nt, Homo sapiens
cacgagaucaag

SEQ ID NO: 773057 - RNA, 16 nt, Homo sapiens
cacgagaucaagagau

SEQ ID NO: 773058 - RNA, 14 nt, Homo sapiens
cacgagcaaaccca

SEQ ID NO: 773059 - RNA, 23 nt, Homo sapiens
cacgagcuagcuucugcaauguu

SEQ ID NO: 773060 - RNA, 18 nt, Homo sapiens
cacgagugggaaggacuu

SEQ ID NO: 773061 - RNA, 15 nt, Homo sapiens
cacgaucucaguuca

SEQ ID NO: 773062 - RNA, 21 nt, Homo sapiens
cacgaucucggcucacugcac

SEQ ID NO: 773063 - RNA, 11 nt, Homo sapiens
cacgaugcauu

SEQ ID NO: 773064 - RNA, 20 nt, Homo sapiens
cacgauuuaaaucuuuucaa

SEQ ID NO: 773065 - RNA, 20 nt, Homo sapiens
cacgcacacacacaaacaca

SEQ ID NO: 773066 - RNA, 19 nt, Homo sapiens
cacgcaccggaguucugcc

SEQ ID NO: 773067 - RNA, 20 nt, Homo sapiens
cacgcagggccauccacugu

SEQ ID NO: 773068 - RNA, 22 nt, Homo sapiens
cacgcagucugcuucagugcag

SEQ ID NO: 773069 - RNA, 23 nt, Homo sapiens
cacgcagucugcuucagugcagu

SEQ ID NO: 773070 - RNA, 20 nt, Homo sapiens
cacgcagugcggauccggga

SEQ ID NO: 773071 - RNA, 14 nt, Homo sapiens
cacgcccuccucag

SEQ ID NO: 773072 - RNA, 21 nt, Homo sapiens
cacgcugaaggcuuacuucag

SEQ ID NO: 773073 - RNA, 16 nt, Homo sapiens
cacggcuucacugacc

SEQ ID NO: 773074 - RNA, 24 nt, Homo sapiens
cacgggaaagccgccgaccuguga

SEQ ID NO: 773075 - RNA, 12 nt, Homo sapiens
cacggggcacag

SEQ ID NO: 773076 - RNA, 16 nt, Homo sapiens
cacgguggcucaggcc

SEQ ID NO: 773077 - RNA, 20 nt, Homo sapiens
cacguaggacgcaugaaggu

SEQ ID NO: 773078 - RNA, 20 nt, Homo sapiens
cacgucacugcacuccagcu

SEQ ID NO: 773079 - RNA, 22 nt, Homo sapiens
cacgugaauauuuugcuaaaaa

SEQ ID NO: 773080 - RNA, 15 nt, Homo sapiens
cacgugccugugauc

SEQ ID NO: 773081 - RNA, 17 nt, Homo sapiens
cacguggcagaccguga

SEQ ID NO: 773082 - RNA, 15 nt, Homo sapiens
cacguguccguccac

SEQ ID NO: 773083 - RNA, 16 nt, Homo sapiens
cacgugucucagacug

SEQ ID NO: 773084 - RNA, 19 nt, Homo sapiens
cacguucuggacugucuuc

SEQ ID NO: 773085 - RNA, 22 nt, Homo sapiens
cacuaaagagugaaugccauuu

SEQ ID NO: 773086 - RNA, 12 nt, Homo sapiens
cacuaaccaaug

SEQ ID NO: 773087 - RNA, 12 nt, Homo sapiens
cacuaaugcuuu

SEQ ID NO: 773088 - RNA, 15 nt, Homo sapiens
cacuaaugcuuuaag

SEQ ID NO: 773089 - RNA, 19 nt, Homo sapiens
cacuaauuuaaguacuuga

SEQ ID NO: 773090 - RNA, 18 nt, Homo sapiens
cacuacaccuugccuugc

SEQ ID NO: 773091 - RNA, 19 nt, Homo sapiens
cacuacacuccagccugag

SEQ ID NO: 773092 - RNA, 23 nt, Homo sapiens
cacuacauaauugcuguucugcu

SEQ ID NO: 773093 - RNA, 13 nt, Homo sapiens
cacuaccacauua

SEQ ID NO: 773094 - RNA, 14 nt, Homo sapiens
cacuaccauugcug

SEQ ID NO: 773095 - RNA, 14 nt, Homo sapiens
gcuggagugcagug

SEQ ID NO: 773096 - RNA, 20 nt, Homo sapiens
gcuggagugcaguggcauga

SEQ ID NO: 773097 - RNA, 20 nt, Homo sapiens
gcuggaugucuccaucucug

SEQ ID NO: 773098 - RNA, 18 nt, Homo sapiens
gcuggcaaccacuaagaa

SEQ ID NO: 773099 - RNA, 16 nt, Homo sapiens
gcuggcagaaagcaaa

SEQ ID NO: 773100 - RNA, 19 nt, Homo sapiens
gcuggcaugcagugcccuc

SEQ ID NO: 773101 - RNA, 16 nt, Homo sapiens
gcuggccucucuagca

SEQ ID NO: 773102 - RNA, 15 nt, Homo sapiens
gcuggcucaccuggg

SEQ ID NO: 773103 - RNA, 19 nt, Homo sapiens
gcugggaauaagugccagg

SEQ ID NO: 773104 - RNA, 12 nt, Homo sapiens
gcugggagacaa

SEQ ID NO: 773105 - RNA, 13 nt, Homo sapiens
gcugggauuacag

SEQ ID NO: 773106 - RNA, 16 nt, Homo sapiens
gcugggauuacaggug

SEQ ID NO: 773107 - RNA, 22 nt, Homo sapiens
gcugggauuacaggugugggcc

SEQ ID NO: 773108 - RNA, 22 nt, Homo sapiens
gcugggauuacaggugugugcc

SEQ ID NO: 773109 - RNA, 22 nt, Homo sapiens
gcuggggaccagcagucugccu

SEQ ID NO: 773110 - RNA, 15 nt, Homo sapiens
gcugggucaccagaa

SEQ ID NO: 773111 - RNA, 19 nt, Homo sapiens
gcuggucacucugcccucu

SEQ ID NO: 773112 - RNA, 21 nt, Homo sapiens
gcuggucagagagaccucauc

SEQ ID NO: 773113 - RNA, 23 nt, Homo sapiens
gcuggucccggggccagcacuuc

SEQ ID NO: 773114 - RNA, 18 nt, Homo sapiens
gcuggucucaaacuccug

SEQ ID NO: 773115 - RNA, 20 nt, Homo sapiens
gcuuggagcaaucagaacuu

SEQ ID NO: 773116 - RNA, 23 nt, Homo sapiens
gcuuggccuacagucaucugcca

SEQ ID NO: 773117 - RNA, 22 nt, Homo sapiens
gcuuguaacuccaccaacccau

SEQ ID NO: 773118 - RNA, 11 nt, Homo sapiens
gcuuguguuaa

SEQ ID NO: 773119 - RNA, 15 nt, Homo sapiens
gcuuuacagacaaaa

SEQ ID NO: 773120 - RNA, 12 nt, Homo sapiens
gcuuuagcauua

SEQ ID NO: 773121 - RNA, 19 nt, Homo sapiens
gcuuuaggcagagccauaa

SEQ ID NO: 773122 - RNA, 13 nt, Homo sapiens
gcuuuaugcaaau

SEQ ID NO: 773123 - RNA, 20 nt, Homo sapiens
gcuuuaugcaaauacaauca

SEQ ID NO: 773124 - RNA, 22 nt, Homo sapiens
gcuuuaugcaaauacaaucagc

SEQ ID NO: 773125 - RNA, 17 nt, Homo sapiens
gcuuucaaagcauuuac

SEQ ID NO: 773126 - RNA, 16 nt, Homo sapiens
gcuuucgguacuguaa

SEQ ID NO: 773127 - RNA, 22 nt, Homo sapiens
gcuuucguccauguuucucaca

SEQ ID NO: 773128 - RNA, 12 nt, Homo sapiens
gcuuucucugag

SEQ ID NO: 773129 - RNA, 22 nt, Homo sapiens
gcuuucugccaucuagccagcc

SEQ ID NO: 773130 - RNA, 23 nt, Homo sapiens
gcuuucuguugauguuaacugag

SEQ ID NO: 773131 - RNA, 22 nt, Homo sapiens
gcuuucuuuaaaguucuucuaa

SEQ ID NO: 773132 - RNA, 18 nt, Homo sapiens
gcuuugaaacuugccugg

SEQ ID NO: 773133 - RNA, 17 nt, Homo sapiens
gcuuugcacuucaaaaa

SEQ ID NO: 773134 - RNA, 12 nt, Homo sapiens
gcuuugcaguga

SEQ ID NO: 773135 - RNA, 12 nt, Homo sapiens
gcuuugccaaaa

SEQ ID NO: 773136 - RNA, 12 nt, Homo sapiens
gcuuugcccauu

SEQ ID NO: 773137 - RNA, 15 nt, Homo sapiens
gcuuugcucuauuaa

SEQ ID NO: 773138 - RNA, 19 nt, Homo sapiens
gcuuugggaacacuggccu

SEQ ID NO: 773139 - RNA, 15 nt, Homo sapiens
gcuuugggugccuuu

SEQ ID NO: 773140 - RNA, 14 nt, Homo sapiens
gcuuugguggcacg

SEQ ID NO: 773141 - RNA, 14 nt, Homo sapiens
gcuuugugcuuguc

SEQ ID NO: 773142 - RNA, 23 nt, Homo sapiens
gcuuuguuaucuuccacuggaaa

SEQ ID NO: 773143 - RNA, 14 nt, Homo sapiens
gcuuuguugcccag

SEQ ID NO: 773144 - RNA, 22 nt, Homo sapiens
gcuuuguuuuuugugcuauuag

SEQ ID NO: 773145 - RNA, 16 nt, Homo sapiens
gcuuuuaaaugaccaa

SEQ ID NO: 773146 - RNA, 15 nt, Homo sapiens
gcuuuuaccaugccc

SEQ ID NO: 773147 - RNA, 19 nt, Homo sapiens
gcuuuucaaacugcaguuu

SEQ ID NO: 773148 - RNA, 21 nt, Homo sapiens
gcuuuuccacugccugggaug

SEQ ID NO: 773149 - RNA, 13 nt, Homo sapiens
gcuuuuccucacc

SEQ ID NO: 773150 - RNA, 22 nt, Homo sapiens
gcuuuugccaguauuaugcaua

SEQ ID NO: 773151 - RNA, 15 nt, Homo sapiens
gcuuuuuguucagaa

SEQ ID NO: 773152 - RNA, 19 nt, Homo sapiens
ggaaaaaccaauagcuuua

SEQ ID NO: 773153 - RNA, 16 nt, Homo sapiens
ggaaaacagggugcua

SEQ ID NO: 773154 - RNA, 22 nt, Homo sapiens
ggaaaagaagaaacuuugccuc

SEQ ID NO: 773155 - RNA, 16 nt, Homo sapiens
ggaaaaguuagucaau

SEQ ID NO: 773156 - RNA, 24 nt, Homo sapiens
ggaaaauaaacugacacuuauuaa

SEQ ID NO: 773157 - RNA, 18 nt, Homo sapiens
ggaaaaucacaucuccag

SEQ ID NO: 773158 - RNA, 12 nt, Homo sapiens
ggaaaaugagua

SEQ ID NO: 773159 - RNA, 16 nt, Homo sapiens
ggaaaauggccaugca

SEQ ID NO: 773160 - RNA, 15 nt, Homo sapiens
ggaaaaugucuuaaa

SEQ ID NO: 773161 - RNA, 12 nt, Homo sapiens
ggaaaccacagu

SEQ ID NO: 773162 - RNA, 15 nt, Homo sapiens
ggaaacugcucccau

SEQ ID NO: 773163 - RNA, 15 nt, Homo sapiens
ggaaagaaauacagu

SEQ ID NO: 773164 - RNA, 16 nt, Homo sapiens
ggaaagagacugucau

SEQ ID NO: 773165 - RNA, 22 nt, Homo sapiens
ggaaagaugguguggguguccu

SEQ ID NO: 773166 - RNA, 23 nt, Homo sapiens
ggaaaggccuguggggagccgag

SEQ ID NO: 773167 - RNA, 21 nt, Homo sapiens
ggaaagggagacgcccuuuca

SEQ ID NO: 773168 - RNA, 17 nt, Homo sapiens
ggaaagggauaguccaa

SEQ ID NO: 773169 - RNA, 17 nt, Homo sapiens
ggaaaguguacacuauu

SEQ ID NO: 773170 - RNA, 22 nt, Homo sapiens
ggaaauaaaauuuaggaccaau

SEQ ID NO: 773171 - RNA, 18 nt, Homo sapiens
ggaaauguaaaagcacau

SEQ ID NO: 773172 - RNA, 17 nt, Homo sapiens
ggaaauuaagacuuuau

SEQ ID NO: 773173 - RNA, 23 nt, Homo sapiens
ggaaauucaaaacaauuggcaaa

SEQ ID NO: 773174 - RNA, 17 nt, Homo sapiens
ggaaauuguuuaugugu

SEQ ID NO: 773175 - RNA, 16 nt, Homo sapiens
ggaacaagaugguucu

SEQ ID NO: 773176 - RNA, 13 nt, Homo sapiens
ggaacacacuugg

SEQ ID NO: 773177 - RNA, 22 nt, Homo sapiens
ggaacacccgacuccucaaaag

SEQ ID NO: 773178 - RNA, 16 nt, Homo sapiens
ggaacacugaaacugu

SEQ ID NO: 773179 - RNA, 23 nt, Homo sapiens
ggaacagcacuggggagucuuug

SEQ ID NO: 773180 - RNA, 22 nt, Homo sapiens
ggaacauguaaaacaguuacaa

SEQ ID NO: 773181 - RNA, 11 nt, Homo sapiens
ggaacauuucu

SEQ ID NO: 773182 - RNA, 22 nt, Homo sapiens
ggaaccacgucugcuaacuugg

SEQ ID NO: 773183 - RNA, 16 nt, Homo sapiens
ggaacccagacucaga

SEQ ID NO: 773184 - RNA, 18 nt, Homo sapiens
ggaacccagacucagaca

SEQ ID NO: 773185 - RNA, 20 nt, Homo sapiens
ggaacccccaucucuacuaa

SEQ ID NO: 773186 - RNA, 13 nt, Homo sapiens
ggaacuacuguac

SEQ ID NO: 773187 - RNA, 16 nt, Homo sapiens
ggaacucagauccagg

SEQ ID NO: 773188 - RNA, 23 nt, Homo sapiens
ggaacuccagagaugagugucug

SEQ ID NO: 773189 - RNA, 16 nt, Homo sapiens
ggaacuccuggccuuu

SEQ ID NO: 773190 - RNA, 17 nt, Homo sapiens
ggaagaaagaaugcaag

SEQ ID NO: 773191 - RNA, 17 nt, Homo sapiens
ggaagaagauagaucca

SEQ ID NO: 773192 - RNA, 16 nt, Homo sapiens
ggaagacaagcauuuu

SEQ ID NO: 773193 - RNA, 20 nt, Homo sapiens
ggaagaccagcuuugcagug

SEQ ID NO: 773194 - RNA, 21 nt, Homo sapiens
ggaagacgugcgcgaugugac

SEQ ID NO: 773195 - RNA, 17 nt, Homo sapiens
ggaagacugugcagaag

SEQ ID NO: 773196 - RNA, 22 nt, Homo sapiens
ggaagagccaaagaauauucca

SEQ ID NO: 773197 - RNA, 20 nt, Homo sapiens
ggaagcaaguuuucuuccau

SEQ ID NO: 773198 - RNA, 15 nt, Homo sapiens
ggaagcacaggcaag

SEQ ID NO: 773199 - RNA, 16 nt, Homo sapiens
ggaagcacugccauua

SEQ ID NO: 773200 - RNA, 12 nt, Homo sapiens
ggaagccaaagg

SEQ ID NO: 773201 - RNA, 18 nt, Homo sapiens
ggaagccagugggguccc

SEQ ID NO: 773202 - RNA, 23 nt, Homo sapiens
ggaagcccaggcucggaggaccc

SEQ ID NO: 773203 - RNA, 11 nt, Homo sapiens
ggaagcucucc

SEQ ID NO: 773204 - RNA, 14 nt, Homo sapiens
ggaaggaacaaaga

SEQ ID NO: 773205 - RNA, 17 nt, Homo sapiens
ggaaggcuucuguguca

SEQ ID NO: 773206 - RNA, 22 nt, Homo sapiens
ggaaggguuagggguucauucu

SEQ ID NO: 773207 - RNA, 19 nt, Homo sapiens
ggaaggucuccccaugugc

SEQ ID NO: 773208 - RNA, 15 nt, Homo sapiens
ggaagguuaucagug

SEQ ID NO: 773209 - RNA, 14 nt, Homo sapiens
ggaagguucucugu

SEQ ID NO: 773210 - RNA, 19 nt, Homo sapiens
ggaaguuucguaugcacuc

SEQ ID NO: 773211 - RNA, 15 nt, Homo sapiens
ggagcccgugcagua

SEQ ID NO: 773212 - RNA, 23 nt, Homo sapiens
ggagcccugaggaccucucagca

SEQ ID NO: 773213 - RNA, 13 nt, Homo sapiens
ggagcgcuaccca

SEQ ID NO: 773214 - RNA, 19 nt, Homo sapiens
ggagcucuggggacagcuu

SEQ ID NO: 773215 - RNA, 23 nt, Homo sapiens
ggagcucuucaggccucccucuc

SEQ ID NO: 773216 - RNA, 20 nt, Homo sapiens
ggagcugaaaaagauggaau

SEQ ID NO: 773217 - RNA, 12 nt, Homo sapiens
ggagcugccaca

SEQ ID NO: 773218 - RNA, 21 nt, Homo sapiens
ggagcugccgugccugugucc

SEQ ID NO: 773219 - RNA, 21 nt, Homo sapiens
ggagcugccuuggcucagaca

SEQ ID NO: 773220 - RNA, 20 nt, Homo sapiens
ggagcuggcccagggggccu

SEQ ID NO: 773221 - RNA, 20 nt, Homo sapiens
ggagcugggcagaaggccaa

SEQ ID NO: 773222 - RNA, 23 nt, Homo sapiens
ggagcugggcccgacauggcucc

SEQ ID NO: 773223 - RNA, 14 nt, Homo sapiens
ggagcuugcaguga

SEQ ID NO: 773224 - RNA, 16 nt, Homo sapiens
ggaggaaagcuugaag

SEQ ID NO: 773225 - RNA, 22 nt, Homo sapiens
ggaggaagcccacauauucuau

SEQ ID NO: 773226 - RNA, 15 nt, Homo sapiens
ggaggacccuggaaa

SEQ ID NO: 773227 - RNA, 19 nt, Homo sapiens
ggaggacgguuaacuugua

SEQ ID NO: 773228 - RNA, 22 nt, Homo sapiens
ggaggagcuggccuguggcaca

SEQ ID NO: 773229 - RNA, 12 nt, Homo sapiens
ggaggaggugac

SEQ ID NO: 773230 - RNA, 13 nt, Homo sapiens
ggaggaggugucu

SEQ ID NO: 773231 - RNA, 20 nt, Homo sapiens
ggaggcagaggcugcauuga

SEQ ID NO: 773232 - RNA, 22 nt, Homo sapiens
ggaggcagagguugcagugaac

SEQ ID NO: 773233 - RNA, 19 nt, Homo sapiens
ggaggccaagaacuugcaa

SEQ ID NO: 773234 - RNA, 17 nt, Homo sapiens
ggaggccaccucuccaa

SEQ ID NO: 773235 - RNA, 23 nt, Homo sapiens
ggaggccgggagaggaugucuuu

SEQ ID NO: 773236 - RNA, 16 nt, Homo sapiens
ggaggccuauuccugc

SEQ ID NO: 773237 - RNA, 14 nt, Homo sapiens
ggaggccugaugcu

SEQ ID NO: 773238 - RNA, 20 nt, Homo sapiens
ggaggcggagguugcaauga

SEQ ID NO: 773239 - RNA, 13 nt, Homo sapiens
ggaggcugcugug

SEQ ID NO: 773240 - RNA, 10 nt, Homo sapiens
ggaggcuugg

SEQ ID NO: 773241 - RNA, 22 nt, Homo sapiens
ggaggcuuuggguggcucacua

SEQ ID NO: 773242 - RNA, 15 nt, Homo sapiens
ggagggagaucuuuc

SEQ ID NO: 773243 - RNA, 14 nt, Homo sapiens
ggagggagcucuga

SEQ ID NO: 773244 - RNA, 14 nt, Homo sapiens
ggagggcaguuuuc

SEQ ID NO: 773245 - RNA, 17 nt, Homo sapiens
ggagggccagcgcugug

SEQ ID NO: 773246 - RNA, 15 nt, Homo sapiens
ggagggccugcagug

SEQ ID NO: 773247 - RNA, 14 nt, Homo sapiens
ggaggggugguccu

SEQ ID NO: 773248 - RNA, 20 nt, Homo sapiens
ggagggugguucaacaaaga

SEQ ID NO: 773249 - RNA, 21 nt, Homo sapiens
ggaggucugguccgagucuca

SEQ ID NO: 773250 - RNA, 20 nt, Homo sapiens
ggagguggagauugcaguga

SEQ ID NO: 773251 - RNA, 19 nt, Homo sapiens
ggagguggagguugcagug

SEQ ID NO: 773252 - RNA, 15 nt, Homo sapiens
ggagguugaagccaa

SEQ ID NO: 773253 - RNA, 14 nt, Homo sapiens
ggagguugcaguga

SEQ ID NO: 773254 - RNA, 20 nt, Homo sapiens
ggagguugcagugagccaag

SEQ ID NO: 773255 - RNA, 22 nt, Homo sapiens
ggaguaacaauacaaauggauu

SEQ ID NO: 773256 - RNA, 13 nt, Homo sapiens
ggagucucagagc

SEQ ID NO: 773257 - RNA, 21 nt, Homo sapiens
ggagucuucagacccagagaa

SEQ ID NO: 773258 - RNA, 16 nt, Homo sapiens
ggagucuuuucuguua

SEQ ID NO: 773259 - RNA, 17 nt, Homo sapiens
ggagugaagaggggcag

SEQ ID NO: 773260 - RNA, 22 nt, Homo sapiens
ggagugcaguggcgugaucucg

SEQ ID NO: 773261 - RNA, 22 nt, Homo sapiens
ggagugcucaccgccucacuca

SEQ ID NO: 773262 - RNA, 18 nt, Homo sapiens
ggaguggcguggggccaa

SEQ ID NO: 773263 - RNA, 20 nt, Homo sapiens
ggaguucgaggcugcaguca

SEQ ID NO: 773264 - RNA, 13 nt, Homo sapiens
ggaguugccugac

SEQ ID NO: 773265 - RNA, 14 nt, Homo sapiens
ggauaaagccacuu

SEQ ID NO: 773266 - RNA, 23 nt, Homo sapiens
ggauacgcaucagacagauggaa

SEQ ID NO: 773267 - RNA, 13 nt, Homo sapiens
ggauacuggcaca

SEQ ID NO: 773268 - RNA, 16 nt, Homo sapiens
ggauagaggaaaggga

SEQ ID NO: 773269 - RNA, 20 nt, Homo sapiens
ggauaguccaaagacuuaac

SEQ ID NO: 773270 - RNA, 14 nt, Homo sapiens
ggauagucugucca

SEQ ID NO: 773271 - RNA, 23 nt, Homo sapiens
ggauagugggcaccccacugcaa

SEQ ID NO: 773272 - RNA, 19 nt, Homo sapiens
ggauauaaaaauaauguca

SEQ ID NO: 773273 - RNA, 24 nt, Homo sapiens
ggauaugcugcuuuaaacuuggaa

SEQ ID NO: 773274 - RNA, 16 nt, Homo sapiens
ggauauuaaauguugc

SEQ ID NO: 773275 - RNA, 21 nt, Homo sapiens
ggauauuuacugcucuuuauu

SEQ ID NO: 773276 - RNA, 14 nt, Homo sapiens
ggaucacacgagcu

SEQ ID NO: 773277 - RNA, 22 nt, Homo sapiens
ggaucacucaccauucccagau

SEQ ID NO: 773278 - RNA, 23 nt, Homo sapiens
ggaucagcaacccuuccugcugc

SEQ ID NO: 773279 - RNA, 11 nt, Homo sapiens
ggaucaucucu

SEQ ID NO: 773280 - RNA, 16 nt, Homo sapiens
ggaucaugguacauuu

SEQ ID NO: 773281 - RNA, 13 nt, Homo sapiens
ggauccagccacu

SEQ ID NO: 773282 - RNA, 17 nt, Homo sapiens
ggauccuccacagagag

SEQ ID NO: 773283 - RNA, 21 nt, Homo sapiens
ggauccuguguggagagggaa

SEQ ID NO: 773284 - RNA, 13 nt, Homo sapiens
ggaucuaccagca

SEQ ID NO: 773285 - RNA, 14 nt, Homo sapiens
ggaucuaguccagc

SEQ ID NO: 773286 - RNA, 14 nt, Homo sapiens
ggaucucaagccag

SEQ ID NO: 773287 - RNA, 21 nt, Homo sapiens
ggaucugauaaggaucuagga

SEQ ID NO: 773288 - RNA, 10 nt, Homo sapiens
ggaucuucau

SEQ ID NO: 773289 - RNA, 14 nt, Homo sapiens
ggaucuuugcuacu

SEQ ID NO: 773290 - RNA, 19 nt, Homo sapiens
ggaugaggucaccagggga

SEQ ID NO: 773291 - RNA, 15 nt, Homo sapiens
ggaugauaguggaau

SEQ ID NO: 773292 - RNA, 14 nt, Homo sapiens
ggaugauaguugaa

SEQ ID NO: 773293 - RNA, 20 nt, Homo sapiens
ggaugauguuguacgcacug

SEQ ID NO: 773294 - RNA, 13 nt, Homo sapiens
ggaugauguuucg

SEQ ID NO: 773295 - RNA, 22 nt, Homo sapiens
ggaugauuucaucuucuggaau

SEQ ID NO: 773296 - RNA, 22 nt, Homo sapiens
ggaugcaggguuugagaauguu

SEQ ID NO: 773297 - RNA, 14 nt, Homo sapiens
ggaugggggggcca

SEQ ID NO: 773298 - RNA, 18 nt, Homo sapiens
ggaugguuuuaucuuccc

SEQ ID NO: 773299 - RNA, 14 nt, Homo sapiens
ggauguccacagau

SEQ ID NO: 773300 - RNA, 16 nt, Homo sapiens
ggauguguggggcaug

SEQ ID NO: 773301 - RNA, 16 nt, Homo sapiens
ggauguguuuugcacg

SEQ ID NO: 773302 - RNA, 13 nt, Homo sapiens
ggauguugcucag

SEQ ID NO: 773303 - RNA, 20 nt, Homo sapiens
ggauguuuugucccauuucc

SEQ ID NO: 773304 - RNA, 12 nt, Homo sapiens
ggauuaaucucu

SEQ ID NO: 773305 - RNA, 19 nt, Homo sapiens
ggauuaugggucacaggaa

SEQ ID NO: 773306 - RNA, 23 nt, Homo sapiens
ggauucuuuucaucaaaaagccu

SEQ ID NO: 773307 - RNA, 16 nt, Homo sapiens
ggauugcuaugaauga

SEQ ID NO: 773308 - RNA, 16 nt, Homo sapiens
ggauuguuacagcuuc

SEQ ID NO: 773309 - RNA, 14 nt, Homo sapiens
ggauuuaguguuuc

SEQ ID NO: 773310 - RNA, 16 nt, Homo sapiens
ggauuucauacuguaa

SEQ ID NO: 773311 - RNA, 15 nt, Homo sapiens
ggauuucauggugau

SEQ ID NO: 773312 - RNA, 20 nt, Homo sapiens
ggauuugaugcuguuugaca

SEQ ID NO: 773313 - RNA, 15 nt, Homo sapiens
ggauuuuaccaaagc

SEQ ID NO: 773314 - RNA, 17 nt, Homo sapiens
ggauuuuaccaaagcau

SEQ ID NO: 773315 - RNA, 15 nt, Homo sapiens
ggauuuucacauucu

SEQ ID NO: 773316 - RNA, 18 nt, Homo sapiens
ggauuuuuaaaaugucaa

SEQ ID NO: 773317 - RNA, 20 nt, Homo sapiens
ggcaaaaccacuagaacucu

SEQ ID NO: 773318 - RNA, 22 nt, Homo sapiens
ggcaaagauuuuuggcacuuug

SEQ ID NO: 773319 - RNA, 18 nt, Homo sapiens
ggcaaauggcugagaugg

SEQ ID NO: 773320 - RNA, 15 nt, Homo sapiens
ggcaaauggggugca

SEQ ID NO: 773321 - RNA, 20 nt, Homo sapiens
ggcaacacugcuguccacau

SEQ ID NO: 773322 - RNA, 19 nt, Homo sapiens
ggcaacagagcaagacucc

SEQ ID NO: 773323 - RNA, 18 nt, Homo sapiens
ggcaacauaguaagaccc

SEQ ID NO: 773324 - RNA, 19 nt, Homo sapiens
ggcaacauucauugccaag

SEQ ID NO: 773325 - RNA, 18 nt, Homo sapiens
ggcaacuuagagauugca

SEQ ID NO: 773326 - RNA, 21 nt, Homo sapiens
cuucuaagguagcugcagaua

SEQ ID NO: 773327 - RNA, 12 nt, Homo sapiens
cuucuacuuuua

SEQ ID NO: 773328 - RNA, 15 nt, Homo sapiens
cuucuagacagaguu

SEQ ID NO: 773329 - RNA, 14 nt, Homo sapiens
cuucuaguuugcaa

SEQ ID NO: 773330 - RNA, 19 nt, Homo sapiens
cuucuauaauuuugccuuu

SEQ ID NO: 773331 - RNA, 17 nt, Homo sapiens
cuucuauucaaaugaag

SEQ ID NO: 773332 - RNA, 11 nt, Homo sapiens
cuucucaagac

SEQ ID NO: 773333 - RNA, 11 nt, Homo sapiens
cuucucaggaa

SEQ ID NO: 773334 - RNA, 15 nt, Homo sapiens
cuucucaugauccaa

SEQ ID NO: 773335 - RNA, 14 nt, Homo sapiens
cuucuccacuggau

SEQ ID NO: 773336 - RNA, 15 nt, Homo sapiens
cuucuccaucuccug

SEQ ID NO: 773337 - RNA, 19 nt, Homo sapiens
cuucuccccacucccaucu

SEQ ID NO: 773338 - RNA, 21 nt, Homo sapiens
cuucucccuugcccucccuuu

SEQ ID NO: 773339 - RNA, 14 nt, Homo sapiens
cuucuccuacauau

SEQ ID NO: 773340 - RNA, 16 nt, Homo sapiens
cuucuccuccaugaac

SEQ ID NO: 773341 - RNA, 22 nt, Homo sapiens
cuucucuauugggcacagccua

SEQ ID NO: 773342 - RNA, 17 nt, Homo sapiens
cuucucucacuguguua

SEQ ID NO: 773343 - RNA, 14 nt, Homo sapiens
cuucucucagcucc

SEQ ID NO: 773344 - RNA, 18 nt, Homo sapiens
cuucucuccacaguguug

SEQ ID NO: 773345 - RNA, 14 nt, Homo sapiens
cuucucuccagugu

SEQ ID NO: 773346 - RNA, 13 nt, Homo sapiens
cuucucucuucaa

SEQ ID NO: 773347 - RNA, 16 nt, Homo sapiens
cuucucugcacuuaua

SEQ ID NO: 773348 - RNA, 16 nt, Homo sapiens
cuucucuugagucaca

SEQ ID NO: 773349 - RNA, 19 nt, Homo sapiens
cuucugaacuacacugcau

SEQ ID NO: 773350 - RNA, 16 nt, Homo sapiens
cuucugauaaacacaa

SEQ ID NO: 773351 - RNA, 14 nt, Homo sapiens
cuucugcaacaucu

SEQ ID NO: 773352 - RNA, 14 nt, Homo sapiens
cuucugcacacaaa

SEQ ID NO: 773353 - RNA, 16 nt, Homo sapiens
cuucugcacccuccac

SEQ ID NO: 773354 - RNA, 18 nt, Homo sapiens
cuucugcccccguuccag

SEQ ID NO: 773355 - RNA, 16 nt, Homo sapiens
cuucugcuuucacuua

SEQ ID NO: 773356 - RNA, 15 nt, Homo sapiens
cuucugggacugugc

SEQ ID NO: 773357 - RNA, 16 nt, Homo sapiens
cuucugggcacagugg

SEQ ID NO: 773358 - RNA, 19 nt, Homo sapiens
cuucuggggguagaucuca

SEQ ID NO: 773359 - RNA, 20 nt, Homo sapiens
cuucuggggguagaucucaa

SEQ ID NO: 773360 - RNA, 15 nt, Homo sapiens
cuucuggggguggug

SEQ ID NO: 773361 - RNA, 13 nt, Homo sapiens
cuucuguaaaggu

SEQ ID NO: 773362 - RNA, 17 nt, Homo sapiens
cuucuguaguacuccuu

SEQ ID NO: 773363 - RNA, 18 nt, Homo sapiens
cuucuguauucauaagau

SEQ ID NO: 773364 - RNA, 12 nt, Homo sapiens
cuucuguguuca

SEQ ID NO: 773365 - RNA, 20 nt, Homo sapiens
cuucuuaaaaucaaauguaa

SEQ ID NO: 773366 - RNA, 12 nt, Homo sapiens
cuucuuacugga

SEQ ID NO: 773367 - RNA, 15 nt, Homo sapiens
cuucuuagcugucac

SEQ ID NO: 773368 - RNA, 14 nt, Homo sapiens
cuucuuaugguggu

SEQ ID NO: 773369 - RNA, 14 nt, Homo sapiens
cuucuucagaagac

SEQ ID NO: 773370 - RNA, 20 nt, Homo sapiens
cuucuucccuuaacuccaag

SEQ ID NO: 773371 - RNA, 16 nt, Homo sapiens
cuucuuccuuaauuca

SEQ ID NO: 773372 - RNA, 20 nt, Homo sapiens
cuucuugccucugugcugug

SEQ ID NO: 773373 - RNA, 19 nt, Homo sapiens
cuucuugguuuggggagaa

SEQ ID NO: 773374 - RNA, 16 nt, Homo sapiens
cuucuuuauacaugcu

SEQ ID NO: 773375 - RNA, 21 nt, Homo sapiens
cuucuuuuguggugucuucca

SEQ ID NO: 773376 - RNA, 15 nt, Homo sapiens
cuucuuuuuaaucuu

SEQ ID NO: 773377 - RNA, 18 nt, Homo sapiens
cuugaaaaaaaacagugg

SEQ ID NO: 773378 - RNA, 18 nt, Homo sapiens
cuugaaacaagcaacaga

SEQ ID NO: 773379 - RNA, 21 nt, Homo sapiens
cuugaaaggaagagcuaauaa

SEQ ID NO: 773380 - RNA, 22 nt, Homo sapiens
cuugaaaugcucuuuugcacaa

SEQ ID NO: 773381 - RNA, 18 nt, Homo sapiens
cuugaaauguaggcauca

SEQ ID NO: 773382 - RNA, 21 nt, Homo sapiens
cuugaaauucucaucagucca

SEQ ID NO: 773383 - RNA, 14 nt, Homo sapiens
cuugaacacugggg

SEQ ID NO: 773384 - RNA, 13 nt, Homo sapiens
cuugaacccaaga

SEQ ID NO: 773385 - RNA, 13 nt, Homo sapiens
cuugaaccccuua

SEQ ID NO: 773386 - RNA, 20 nt, Homo sapiens
cuugaacucuugaccucagg

SEQ ID NO: 773387 - RNA, 13 nt, Homo sapiens
cuugaagaacuga

SEQ ID NO: 773388 - RNA, 17 nt, Homo sapiens
cuugaagacucccugau

SEQ ID NO: 773389 - RNA, 13 nt, Homo sapiens
cuugaagcacaga

SEQ ID NO: 773390 - RNA, 13 nt, Homo sapiens
cuugaagcacuua

SEQ ID NO: 773391 - RNA, 21 nt, Homo sapiens
cuugaagcauuucaaagcccu

SEQ ID NO: 773392 - RNA, 11 nt, Homo sapiens
cuugaagccaa

SEQ ID NO: 773393 - RNA, 12 nt, Homo sapiens
cuugaagccaaa

SEQ ID NO: 773394 - RNA, 15 nt, Homo sapiens
cuugaauacaaguuu

SEQ ID NO: 773395 - RNA, 19 nt, Homo sapiens
cuugaauauguagcucauc

SEQ ID NO: 773396 - RNA, 14 nt, Homo sapiens
cuugaauauuccug

SEQ ID NO: 773397 - RNA, 17 nt, Homo sapiens
cuugaaugcugccagug

SEQ ID NO: 773398 - RNA, 23 nt, Homo sapiens
cuugaauguuuguauacauguua

SEQ ID NO: 773399 - RNA, 22 nt, Homo sapiens
cuugaauuccauggaauuucua

SEQ ID NO: 773400 - RNA, 13 nt, Homo sapiens
cuugaauuucaaa

SEQ ID NO: 773401 - RNA, 21 nt, Homo sapiens
cuugacaacaucccacagugg

SEQ ID NO: 773402 - RNA, 12 nt, Homo sapiens
cuugacaccacu

SEQ ID NO: 773403 - RNA, 14 nt, Homo sapiens
cuugacaccugucu

SEQ ID NO: 773404 - RNA, 12 nt, Homo sapiens
cuugacauuuau

SEQ ID NO: 773405 - RNA, 22 nt, Homo sapiens
cuugaccauucucacccuguga

SEQ ID NO: 773406 - RNA, 18 nt, Homo sapiens
cuugacccccuugagggu

SEQ ID NO: 773407 - RNA, 21 nt, Homo sapiens
cuugaccccgacgccacagcc

SEQ ID NO: 773408 - RNA, 15 nt, Homo sapiens
cuugaccuguuucuc

SEQ ID NO: 773409 - RNA, 16 nt, Homo sapiens
cuugacucuacuauua

SEQ ID NO: 773410 - RNA, 22 nt, Homo sapiens
cuugacugcuuuuaaaugacca

SEQ ID NO: 773411 - RNA, 14 nt, Homo sapiens
cuugagaccuggaa

SEQ ID NO: 773412 - RNA, 20 nt, Homo sapiens
cuugagccacagucacugga

SEQ ID NO: 773413 - RNA, 20 nt, Homo sapiens
cuugagccagccaggcccug

SEQ ID NO: 773414 - RNA, 20 nt, Homo sapiens
cuugagccaguaauuggucc

SEQ ID NO: 773415 - RNA, 20 nt, Homo sapiens
cuugagccgggccccugggc

SEQ ID NO: 773416 - RNA, 21 nt, Homo sapiens
cuugaguagauccaguauuug

SEQ ID NO: 773417 - RNA, 16 nt, Homo sapiens
cuugaguugccugaug

SEQ ID NO: 773418 - RNA, 19 nt, Homo sapiens
cuugaguugccugaugcuc

SEQ ID NO: 773419 - RNA, 20 nt, Homo sapiens
cuugaguuggaguacuauau

SEQ ID NO: 773420 - RNA, 18 nt, Homo sapiens
cuugauaaagggccaaua

SEQ ID NO: 773421 - RNA, 22 nt, Homo sapiens
cuugauaaugggaugaauggaa

SEQ ID NO: 773422 - RNA, 15 nt, Homo sapiens
cuugauaugaccugu

SEQ ID NO: 773423 - RNA, 22 nt, Homo sapiens
cuugauauguaaguacuuccac

SEQ ID NO: 773424 - RNA, 15 nt, Homo sapiens
cuugaugcaugcaca

SEQ ID NO: 773425 - RNA, 20 nt, Homo sapiens
cuugaugccagagggccagc

SEQ ID NO: 773426 - RNA, 24 nt, Homo sapiens
cuugaugcgggucaacauuuccaa

SEQ ID NO: 773427 - RNA, 18 nt, Homo sapiens
cuugauguauugggguca

SEQ ID NO: 773428 - RNA, 15 nt, Homo sapiens
cuugauuaacuccuc

SEQ ID NO: 773429 - RNA, 16 nt, Homo sapiens
cuugauucagucacau

SEQ ID NO: 773430 - RNA, 14 nt, Homo sapiens
cuugauugucuccu

SEQ ID NO: 773431 - RNA, 14 nt, Homo sapiens
cuugauuucacugg

SEQ ID NO: 773432 - RNA, 23 nt, Homo sapiens
cuugauuuuuuucauuuugccaa

SEQ ID NO: 773433 - RNA, 13 nt, Homo sapiens
cuugcaaagauuu

SEQ ID NO: 773434 - RNA, 17 nt, Homo sapiens
cuugcaaagauuucuca

SEQ ID NO: 773435 - RNA, 22 nt, Homo sapiens
cuugcaaauaccuccucccuaa

SEQ ID NO: 773436 - RNA, 21 nt, Homo sapiens
cuugcaauaccaauguucuaa

SEQ ID NO: 773437 - RNA, 20 nt, Homo sapiens
cuugcaccccaaagcuuucc

SEQ ID NO: 773438 - RNA, 15 nt, Homo sapiens
cuugcaccguccuca

SEQ ID NO: 773439 - RNA, 17 nt, Homo sapiens
cuugcaguugcucugac

SEQ ID NO: 773440 - RNA, 15 nt, Homo sapiens
cuugcauagucaaua

SEQ ID NO: 773441 - RNA, 14 nt, Homo sapiens
cuuuaaguauacaa

SEQ ID NO: 773442 - RNA, 14 nt, Homo sapiens
cuuuaaugaacuaa

SEQ ID NO: 773443 - RNA, 11 nt, Homo sapiens
cuuuaauuuca

SEQ ID NO: 773444 - RNA, 19 nt, Homo sapiens
cuuuaauuuuuuacuauuu

SEQ ID NO: 773445 - RNA, 21 nt, Homo sapiens
cuuuacaaaccauuaccugua

SEQ ID NO: 773446 - RNA, 21 nt, Homo sapiens
cuuuacaaucugcacuuuaac

SEQ ID NO: 773447 - RNA, 16 nt, Homo sapiens
cuuuacaauuucacuu

SEQ ID NO: 773448 - RNA, 14 nt, Homo sapiens
cuuuacaccaacuc

SEQ ID NO: 773449 - RNA, 18 nt, Homo sapiens
cuuuaccugagaccaguu

SEQ ID NO: 773450 - RNA, 15 nt, Homo sapiens
cuuuacguaucugcu

SEQ ID NO: 773451 - RNA, 14 nt, Homo sapiens
cuuuagaacaggga

SEQ ID NO: 773452 - RNA, 20 nt, Homo sapiens
cuuuagagccagcccauggc

SEQ ID NO: 773453 - RNA, 14 nt, Homo sapiens
cuuuagaugccaaa

SEQ ID NO: 773454 - RNA, 18 nt, Homo sapiens
cuuuagcaagugugcacu

SEQ ID NO: 773455 - RNA, 16 nt, Homo sapiens
cuuuagccaagugcag

SEQ ID NO: 773456 - RNA, 19 nt, Homo sapiens
cuuuagcgggacucaguga

SEQ ID NO: 773457 - RNA, 14 nt, Homo sapiens
cuuuagcuaccuca

SEQ ID NO: 773458 - RNA, 21 nt, Homo sapiens
cuuuagcuaccucacuaugcu

SEQ ID NO: 773459 - RNA, 23 nt, Homo sapiens
cuuuagcuuggguccaccaugca

SEQ ID NO: 773460 - RNA, 16 nt, Homo sapiens
cuuuaggagauuuauu

SEQ ID NO: 773461 - RNA, 13 nt, Homo sapiens
cuuuaggccaggc

SEQ ID NO: 773462 - RNA, 20 nt, Homo sapiens
cuuuaguacucaauguuucu

SEQ ID NO: 773463 - RNA, 19 nt, Homo sapiens
cuuuagucucccacuaaaa

SEQ ID NO: 773464 - RNA, 18 nt, Homo sapiens
cuuuagugucugagcuuc

SEQ ID NO: 773465 - RNA, 21 nt, Homo sapiens
cuuuauaaauguaccagagag

SEQ ID NO: 773466 - RNA, 15 nt, Homo sapiens
cuuuauaagguuguc

SEQ ID NO: 773467 - RNA, 21 nt, Homo sapiens
cuuuauauuuuuaacuuuaag

SEQ ID NO: 773468 - RNA, 14 nt, Homo sapiens
cuuuaucaccucau

SEQ ID NO: 773469 - RNA, 17 nt, Homo sapiens
cuuuaucaccucauucu

SEQ ID NO: 773470 - RNA, 15 nt, Homo sapiens
cuuuaugcaaauaca

SEQ ID NO: 773471 - RNA, 17 nt, Homo sapiens
cuuuaugcaaauacaau

SEQ ID NO: 773472 - RNA, 18 nt, Homo sapiens
cuuuaugcagagccacag

SEQ ID NO: 773473 - RNA, 21 nt, Homo sapiens
cuuuaugccggaugugcuuuu

SEQ ID NO: 773474 - RNA, 20 nt, Homo sapiens
cuuuauugcccuaacaauuu

SEQ ID NO: 773475 - RNA, 15 nt, Homo sapiens
cuuucaaaagggaag

SEQ ID NO: 773476 - RNA, 20 nt, Homo sapiens
cuuucaagcagucgugccug

SEQ ID NO: 773477 - RNA, 19 nt, Homo sapiens
cuuucaagcugcacugaca

SEQ ID NO: 773478 - RNA, 15 nt, Homo sapiens
cuuucacccucauga

SEQ ID NO: 773479 - RNA, 19 nt, Homo sapiens
cuuucagccaaaacagauc

SEQ ID NO: 773480 - RNA, 16 nt, Homo sapiens
cuuucaggccaaggcu

SEQ ID NO: 773481 - RNA, 23 nt, Homo sapiens
cuuucaguauguccccauaagac

SEQ ID NO: 773482 - RNA, 20 nt, Homo sapiens
cuuucauaaacuucagggau

SEQ ID NO: 773483 - RNA, 21 nt, Homo sapiens
cuuucauaccacuugaauuua

SEQ ID NO: 773484 - RNA, 23 nt, Homo sapiens
cuuucaucccucgggugugcuau

SEQ ID NO: 773485 - RNA, 20 nt, Homo sapiens
cuuucaucucucuaccucca

SEQ ID NO: 773486 - RNA, 19 nt, Homo sapiens
cuuucaucuuaaacuaaua

SEQ ID NO: 773487 - RNA, 16 nt, Homo sapiens
cuuucaucuuugugga

SEQ ID NO: 773488 - RNA, 11 nt, Homo sapiens
cuuucauguca

SEQ ID NO: 773489 - RNA, 21 nt, Homo sapiens
cuuucauuauuaguacugcuc

SEQ ID NO: 773490 - RNA, 15 nt, Homo sapiens
cuuuccagcuuagaa

SEQ ID NO: 773491 - RNA, 16 nt, Homo sapiens
cuuuccagggauccag

SEQ ID NO: 773492 - RNA, 18 nt, Homo sapiens
cuuucccaaccccaggaa

SEQ ID NO: 773493 - RNA, 14 nt, Homo sapiens
cuuucccaguccca

SEQ ID NO: 773494 - RNA, 22 nt, Homo sapiens
cuuucccagucccauuccucag

SEQ ID NO: 773495 - RNA, 23 nt, Homo sapiens
cuuucccauucuguuuggaucua

SEQ ID NO: 773496 - RNA, 16 nt, Homo sapiens
cuuuccccccauguug

SEQ ID NO: 773497 - RNA, 19 nt, Homo sapiens
cuuucccuuuaucaguuug

SEQ ID NO: 773498 - RNA, 19 nt, Homo sapiens
cuuuccucagaucauccag

SEQ ID NO: 773499 - RNA, 16 nt, Homo sapiens
cuuuccucaucaggcc

SEQ ID NO: 773500 - RNA, 16 nt, Homo sapiens
cuuuccucgccugaca

SEQ ID NO: 773501 - RNA, 16 nt, Homo sapiens
cuuuccugaauccaaa

SEQ ID NO: 773502 - RNA, 17 nt, Homo sapiens
cuuuccugaauccaaac

SEQ ID NO: 773503 - RNA, 20 nt, Homo sapiens
cuuucgagguggguuuguac

SEQ ID NO: 773504 - RNA, 13 nt, Homo sapiens
cuuucuaagcccu

SEQ ID NO: 773505 - RNA, 20 nt, Homo sapiens
cuuucuaaguaggaugaauc

SEQ ID NO: 773506 - RNA, 15 nt, Homo sapiens
cuuucuaauguuucu

SEQ ID NO: 773507 - RNA, 16 nt, Homo sapiens
cuuucuagagccagca

SEQ ID NO: 773508 - RNA, 23 nt, Homo sapiens
cuuucuaggagggagacacuggc

SEQ ID NO: 773509 - RNA, 22 nt, Homo sapiens
cuuucucccaggccaggcuccu

SEQ ID NO: 773510 - RNA, 17 nt, Homo sapiens
cuuucucugacacugug

SEQ ID NO: 773511 - RNA, 13 nt, Homo sapiens
cuuucucugaggg

SEQ ID NO: 773512 - RNA, 18 nt, Homo sapiens
cuuucucugccagugaca

SEQ ID NO: 773513 - RNA, 22 nt, Homo sapiens
cuuucucugccagugacagaca

SEQ ID NO: 773514 - RNA, 22 nt, Homo sapiens
cuuucucuuuuaggaggcacaa

SEQ ID NO: 773515 - RNA, 18 nt, Homo sapiens
cuuucugaaauuagggcc

SEQ ID NO: 773516 - RNA, 15 nt, Homo sapiens
cuuucugaauugcac

SEQ ID NO: 773517 - RNA, 22 nt, Homo sapiens
cuuucugggaugucacagucca

SEQ ID NO: 773518 - RNA, 15 nt, Homo sapiens
cuuucugggccaagu

SEQ ID NO: 773519 - RNA, 21 nt, Homo sapiens
cuuucuguagguuucucucuu

SEQ ID NO: 773520 - RNA, 20 nt, Homo sapiens
cuuucuguugaaaagcacac

SEQ ID NO: 773521 - RNA, 21 nt, Homo sapiens
cuuucuguugaaaagcacaca

SEQ ID NO: 773522 - RNA, 15 nt, Homo sapiens
cuuucuguugccaca

SEQ ID NO: 773523 - RNA, 22 nt, Homo sapiens
cuuucuuacauuagcaguuugc

SEQ ID NO: 773524 - RNA, 19 nt, Homo sapiens
cuuucuuaccaucugagcc

SEQ ID NO: 773525 - RNA, 13 nt, Homo sapiens
cuuucuucauuca

SEQ ID NO: 773526 - RNA, 23 nt, Homo sapiens
cuuucuuguuugucagcaucuga

SEQ ID NO: 773527 - RNA, 17 nt, Homo sapiens
cuuucuuuaccugagac

SEQ ID NO: 773528 - RNA, 22 nt, Homo sapiens
cuuucuuuagaauuuuuaccca

SEQ ID NO: 773529 - RNA, 18 nt, Homo sapiens
cuuucuuugcaccaaaga

SEQ ID NO: 773530 - RNA, 20 nt, Homo sapiens
cuuugaaauguguuucugua

SEQ ID NO: 773531 - RNA, 17 nt, Homo sapiens
cuuugaagaccaguccu

SEQ ID NO: 773532 - RNA, 15 nt, Homo sapiens
cuuugacuccuuuga

SEQ ID NO: 773533 - RNA, 15 nt, Homo sapiens
cuuugacuuugccca

SEQ ID NO: 773534 - RNA, 21 nt, Homo sapiens
cuuugagaagccuucagcucc

SEQ ID NO: 773535 - RNA, 17 nt, Homo sapiens
cuuugagcgagcccauu

SEQ ID NO: 773536 - RNA, 17 nt, Homo sapiens
cuuugaggaacauucaa

SEQ ID NO: 773537 - RNA, 21 nt, Homo sapiens
cuuugaguacagauacuguga

SEQ ID NO: 773538 - RNA, 21 nt, Homo sapiens
cuuugaguugacuucugacaa

SEQ ID NO: 773539 - RNA, 14 nt, Homo sapiens
cuuugaucaguaua

SEQ ID NO: 773540 - RNA, 21 nt, Homo sapiens
cuuugauccuucugagcucca

SEQ ID NO: 773541 - RNA, 16 nt, Homo sapiens
cuuugauuaugcagac

SEQ ID NO: 773542 - RNA, 20 nt, Homo sapiens
cuuugauucuccaguauucc

SEQ ID NO: 773543 - RNA, 13 nt, Homo sapiens
cuuugcaaagacc

SEQ ID NO: 773544 - RNA, 14 nt, Homo sapiens
cuuugcaauccaaa

SEQ ID NO: 773545 - RNA, 15 nt, Homo sapiens
cuuugcaccaaagac

SEQ ID NO: 773546 - RNA, 16 nt, Homo sapiens
cuuugcacuucaaaaa

SEQ ID NO: 773547 - RNA, 17 nt, Homo sapiens
cuuugcagccccacaga

SEQ ID NO: 773548 - RNA, 18 nt, Homo sapiens
cuuugcagccccacagac

SEQ ID NO: 773549 - RNA, 17 nt, Homo sapiens
cuuugcagucaguucau

SEQ ID NO: 773550 - RNA, 19 nt, Homo sapiens
cuuugcaguuggacucuca

SEQ ID NO: 773551 - RNA, 19 nt, Homo sapiens
cuuugcauguaagcucuuu

SEQ ID NO: 773552 - RNA, 21 nt, Homo sapiens
cuuugccacaagaccuagccu

SEQ ID NO: 773553 - RNA, 14 nt, Homo sapiens
cuuugccacacaca

SEQ ID NO: 773554 - RNA, 21 nt, Homo sapiens
cuuugcccacaaugcuuugcc

SEQ ID NO: 773555 - RNA, 19 nt, Homo sapiens
gaaaaaaguuccuuccuaa

SEQ ID NO: 773556 - RNA, 19 nt, Homo sapiens
gaaaaaaguuuugaugaaa

SEQ ID NO: 773557 - RNA, 16 nt, Homo sapiens
gaaaaacaagucuuua

SEQ ID NO: 773558 - RNA, 14 nt, Homo sapiens
gaaaaacauuauuu

SEQ ID NO: 773559 - RNA, 20 nt, Homo sapiens
gaaaaagaccuaugagcaca

SEQ ID NO: 773560 - RNA, 18 nt, Homo sapiens
gaaaaagacuaagccaga

SEQ ID NO: 773561 - RNA, 19 nt, Homo sapiens
gaaaaaguuaaacauugaa

SEQ ID NO: 773562 - RNA, 19 nt, Homo sapiens
gaaaaaugaggaauccaaa

SEQ ID NO: 773563 - RNA, 13 nt, Homo sapiens
gaaaaauuauagu

SEQ ID NO: 773564 - RNA, 16 nt, Homo sapiens
gaaaaauugucugcau

SEQ ID NO: 773565 - RNA, 18 nt, Homo sapiens
gaaaacaacuuggcauuu

SEQ ID NO: 773566 - RNA, 16 nt, Homo sapiens
gaaaacaucuauucuc

SEQ ID NO: 773567 - RNA, 13 nt, Homo sapiens
gaaaacauuugcu

SEQ ID NO: 773568 - RNA, 14 nt, Homo sapiens
gaaaaccuagaucu

SEQ ID NO: 773569 - RNA, 21 nt, Homo sapiens
gaaaacuaggcaauguacucu

SEQ ID NO: 773570 - RNA, 18 nt, Homo sapiens
gaaaacucaaccagaguc

SEQ ID NO: 773571 - RNA, 23 nt, Homo sapiens
gaaaacucaaccagagucaccca

SEQ ID NO: 773572 - RNA, 22 nt, Homo sapiens
gaaaacugauucucuaugacau

SEQ ID NO: 773573 - RNA, 23 nt, Homo sapiens
gaaaacugccuuuuaucugccca

SEQ ID NO: 773574 - RNA, 21 nt, Homo sapiens
gaaaacuuugaggaacauuca

SEQ ID NO: 773575 - RNA, 14 nt, Homo sapiens
gaaaagaagacucu

SEQ ID NO: 773576 - RNA, 20 nt, Homo sapiens
gaaaagagaaggaaagugau

SEQ ID NO: 773577 - RNA, 15 nt, Homo sapiens
gaaaagagucuucca

SEQ ID NO: 773578 - RNA, 21 nt, Homo sapiens
gaaaagcaauacuguuuccau

SEQ ID NO: 773579 - RNA, 19 nt, Homo sapiens
gaaaagcaguggcuccauu

SEQ ID NO: 773580 - RNA, 11 nt, Homo sapiens
gaaaagccuaa

SEQ ID NO: 773581 - RNA, 22 nt, Homo sapiens
gaaaagcuaguguaccuccucu

SEQ ID NO: 773582 - RNA, 18 nt, Homo sapiens
gaaaagcugccauuuccc

SEQ ID NO: 773583 - RNA, 21 nt, Homo sapiens
gaaaaggacuauaagaauaau

SEQ ID NO: 773584 - RNA, 16 nt, Homo sapiens
gaaaaggagagcuguu

SEQ ID NO: 773585 - RNA, 20 nt, Homo sapiens
gaaaaggagucaagaacaau

SEQ ID NO: 773586 - RNA, 16 nt, Homo sapiens
gaaaagggauggagcu

SEQ ID NO: 773587 - RNA, 21 nt, Homo sapiens
gaaaagguagcuuaccugaca

SEQ ID NO: 773588 - RNA, 23 nt, Homo sapiens
gaaaagguuguuguuaaugaaua

SEQ ID NO: 773589 - RNA, 23 nt, Homo sapiens
gaaaaguguccuucuugcucccc

SEQ ID NO: 773590 - RNA, 14 nt, Homo sapiens
gaaaaguuagucaa

SEQ ID NO: 773591 - RNA, 14 nt, Homo sapiens
gaaaaguucaggga

SEQ ID NO: 773592 - RNA, 16 nt, Homo sapiens
gaaaauaaacaucagu

SEQ ID NO: 773593 - RNA, 18 nt, Homo sapiens
gaaaauaccaucaggccu

SEQ ID NO: 773594 - RNA, 14 nt, Homo sapiens
gaaaauagaacaac

SEQ ID NO: 773595 - RNA, 17 nt, Homo sapiens
gaaaauaugucccagaa

SEQ ID NO: 773596 - RNA, 16 nt, Homo sapiens
gaaaaucacaucucca

SEQ ID NO: 773597 - RNA, 14 nt, Homo sapiens
gaaaaucauguuga

SEQ ID NO: 773598 - RNA, 15 nt, Homo sapiens
gaaaauccaucucau

SEQ ID NO: 773599 - RNA, 15 nt, Homo sapiens
aaacaauaugcuccu

SEQ ID NO: 773600 - RNA, 20 nt, Homo sapiens
aaacaauuguaaauuucuuu

SEQ ID NO: 773601 - RNA, 17 nt, Homo sapiens
aaacacaaauagaacau

SEQ ID NO: 773602 - RNA, 14 nt, Homo sapiens
aaacacacauacac

SEQ ID NO: 773603 - RNA, 21 nt, Homo sapiens
aaacacagcaacaaugacuua

SEQ ID NO: 773604 - RNA, 23 nt, Homo sapiens
aaacacaguuacacuugugcacc

SEQ ID NO: 773605 - RNA, 13 nt, Homo sapiens
aaacacauauuca

SEQ ID NO: 773606 - RNA, 22 nt, Homo sapiens
aaacacauucuuauugacaauu

SEQ ID NO: 773607 - RNA, 13 nt, Homo sapiens
aaacacauuuacc

SEQ ID NO: 773608 - RNA, 16 nt, Homo sapiens
aaacaccagucaccuc

SEQ ID NO: 773609 - RNA, 21 nt, Homo sapiens
aaacacccgacgucauguauu

SEQ ID NO: 773610 - RNA, 13 nt, Homo sapiens
aaacacuaccucu

SEQ ID NO: 773611 - RNA, 15 nt, Homo sapiens
aaacacuauuuccaa

SEQ ID NO: 773612 - RNA, 14 nt, Homo sapiens
aaacacucaucucc

SEQ ID NO: 773613 - RNA, 16 nt, Homo sapiens
aaacacucaucuccuc

SEQ ID NO: 773614 - RNA, 23 nt, Homo sapiens
aaacacucuugaauagacuucca

SEQ ID NO: 773615 - RNA, 18 nt, Homo sapiens
aaacacugccauauugug

SEQ ID NO: 773616 - RNA, 13 nt, Homo sapiens
aaacacuucucau

SEQ ID NO: 773617 - RNA, 20 nt, Homo sapiens
aaacacuucugcuuucacuu

SEQ ID NO: 773618 - RNA, 17 nt, Homo sapiens
aaacacuuggcauacaa

SEQ ID NO: 773619 - RNA, 17 nt, Homo sapiens
aaacagcagcacuuuuu

SEQ ID NO: 773620 - RNA, 19 nt, Homo sapiens
aaacaggccgagugaaggu

SEQ ID NO: 773621 - RNA, 17 nt, Homo sapiens
aaacaucaccuauuuaa

SEQ ID NO: 773622 - RNA, 22 nt, Homo sapiens
aaacaucaguuacucugaaggg

SEQ ID NO: 773623 - RNA, 15 nt, Homo sapiens
aaacaugcacgguga

SEQ ID NO: 773624 - RNA, 19 nt, Homo sapiens
aaacaugcuaaauaguucu

SEQ ID NO: 773625 - RNA, 24 nt, Homo sapiens
aaacaugcuaaauaguucuaucag

SEQ ID NO: 773626 - RNA, 14 nt, Homo sapiens
aaacauggugccua

SEQ ID NO: 773627 - RNA, 20 nt, Homo sapiens
aaacaugguuugacucuggu

SEQ ID NO: 773628 - RNA, 17 nt, Homo sapiens
aaacauguaugugcauu

SEQ ID NO: 773629 - RNA, 14 nt, Homo sapiens
aaacaugugcccuc

SEQ ID NO: 773630 - RNA, 19 nt, Homo sapiens
aaacauguuaaugacaaua

SEQ ID NO: 773631 - RNA, 20 nt, Homo sapiens
aaacauguuguacauuucac

SEQ ID NO: 773632 - RNA, 15 nt, Homo sapiens
aaacauucuuuaaca

SEQ ID NO: 773633 - RNA, 18 nt, Homo sapiens
aaacauucuuuaacauac

SEQ ID NO: 773634 - RNA, 21 nt, Homo sapiens
aaacauuggauuuuuccuuaa

SEQ ID NO: 773635 - RNA, 15 nt, Homo sapiens
aaacauuugccaagu

SEQ ID NO: 773636 - RNA, 22 nt, Homo sapiens
aaacauuuuaauuuuaguuuca

SEQ ID NO: 773637 - RNA, 19 nt, Homo sapiens
aaacauuuugaaggaaaau

SEQ ID NO: 773638 - RNA, 18 nt, Homo sapiens
aaaccaaagagggcuucc

SEQ ID NO: 773639 - RNA, 11 nt, Homo sapiens
aaaccaagaag

SEQ ID NO: 773640 - RNA, 15 nt, Homo sapiens
aaaccaauucaccaa

SEQ ID NO: 773641 - RNA, 13 nt, Homo sapiens
aaaccacagucag

SEQ ID NO: 773642 - RNA, 15 nt, Homo sapiens
aaaccaccucagaaa

SEQ ID NO: 773643 - RNA, 23 nt, Homo sapiens
aaaccacgccucuugaccaggcu

SEQ ID NO: 773644 - RNA, 21 nt, Homo sapiens
aaaccacuagaacucuccauc

SEQ ID NO: 773645 - RNA, 21 nt, Homo sapiens
aaaccacuucuccaugcugca

SEQ ID NO: 773646 - RNA, 17 nt, Homo sapiens
aaaccagaaaagcaaua

SEQ ID NO: 773647 - RNA, 24 nt, Homo sapiens
aaaccaggguagaauuguuuggca

SEQ ID NO: 773648 - RNA, 15 nt, Homo sapiens
aaaccauuaccugua

SEQ ID NO: 773649 - RNA, 21 nt, Homo sapiens
aaaccauuuuugcugaauuca

SEQ ID NO: 773650 - RNA, 18 nt, Homo sapiens
aaacccagagcggaagga

SEQ ID NO: 773651 - RNA, 14 nt, Homo sapiens
aaacccagucuccu

SEQ ID NO: 773652 - RNA, 13 nt, Homo sapiens
aaaccccaucucu

SEQ ID NO: 773653 - RNA, 20 nt, Homo sapiens
aaaccccaucucuacuaaaa

SEQ ID NO: 773654 - RNA, 18 nt, Homo sapiens
aaaccccuucuuuacuuc

SEQ ID NO: 773655 - RNA, 15 nt, Homo sapiens
aaacccugcugaaca

SEQ ID NO: 773656 - RNA, 16 nt, Homo sapiens
aaacccuuauacucac

SEQ ID NO: 773657 - RNA, 14 nt, Homo sapiens
aaaccucaagccag

SEQ ID NO: 773658 - RNA, 12 nt, Homo sapiens
aaaccucugccu

SEQ ID NO: 773659 - RNA, 12 nt, Homo sapiens
aaaccuguaacc

SEQ ID NO: 773660 - RNA, 17 nt, Homo sapiens
aaaccugugugccauuu

SEQ ID NO: 773661 - RNA, 21 nt, Homo sapiens
aaaccuuaguacugaguuaca

SEQ ID NO: 773662 - RNA, 18 nt, Homo sapiens
aaaccuuauuuuuuccca

SEQ ID NO: 773663 - RNA, 19 nt, Homo sapiens
aaaccuucaguuaugauuu

SEQ ID NO: 773664 - RNA, 18 nt, Homo sapiens
aaaccuugcucuccucau

SEQ ID NO: 773665 - RNA, 19 nt, Homo sapiens
aaacgaaacuccaucucaa

SEQ ID NO: 773666 - RNA, 15 nt, Homo sapiens
aaacgagauuugcca

SEQ ID NO: 773667 - RNA, 17 nt, Homo sapiens
aaacgagggcugaugga

SEQ ID NO: 773668 - RNA, 18 nt, Homo sapiens
aaacggagugcgucaugc

SEQ ID NO: 773669 - RNA, 14 nt, Homo sapiens
aaacggcaguauca

SEQ ID NO: 773670 - RNA, 18 nt, Homo sapiens
aaacuaaccagcauuccc

SEQ ID NO: 773671 - RNA, 23 nt, Homo sapiens
aaacuaaucuuaacccugugcug

SEQ ID NO: 773672 - RNA, 21 nt, Homo sapiens
aaacuaauuuuuggugcugau

SEQ ID NO: 773673 - RNA, 13 nt, Homo sapiens
aaacuacuucuuu

SEQ ID NO: 773674 - RNA, 18 nt, Homo sapiens
aaacuauucaugaauauu

SEQ ID NO: 773675 - RNA, 16 nt, Homo sapiens
aaacuauuuauaucac

SEQ ID NO: 773676 - RNA, 17 nt, Homo sapiens
aaacucaguuccaaagu

SEQ ID NO: 773677 - RNA, 13 nt, Homo sapiens
aaacuccaucuca

SEQ ID NO: 773678 - RNA, 18 nt, Homo sapiens
aaacuccugggcucaggc

SEQ ID NO: 773679 - RNA, 19 nt, Homo sapiens
aaacuccuguuucuccuua

SEQ ID NO: 773680 - RNA, 20 nt, Homo sapiens
aaacucucugguuuacuuca

SEQ ID NO: 773681 - RNA, 12 nt, Homo sapiens
aaacucuguaua

SEQ ID NO: 773682 - RNA, 23 nt, Homo sapiens
aaacucuguccacgauucacuca

SEQ ID NO: 773683 - RNA, 12 nt, Homo sapiens
aaacucuucccu

SEQ ID NO: 773684 - RNA, 21 nt, Homo sapiens
aaacucuucgggagacauguu

SEQ ID NO: 773685 - RNA, 16 nt, Homo sapiens
aaacucuuuggugcac

SEQ ID NO: 773686 - RNA, 16 nt, Homo sapiens
aaacugaaugucaaga

SEQ ID NO: 773687 - RNA, 22 nt, Homo sapiens
aaacugacuuaaugcucuucaa

SEQ ID NO: 773688 - RNA, 20 nt, Homo sapiens
aaacugagaaauuuacuaca

SEQ ID NO: 773689 - RNA, 22 nt, Homo sapiens
aaacugauguacugaauuccau

SEQ ID NO: 773690 - RNA, 20 nt, Homo sapiens
aaacugauuuuuagcuuuac

SEQ ID NO: 773691 - RNA, 23 nt, Homo sapiens
aaacugcaggaagcucugaugca

SEQ ID NO: 773692 - RNA, 20 nt, Homo sapiens
aaacugcgaggacaucaaag

SEQ ID NO: 773693 - RNA, 23 nt, Homo sapiens
aaacugcuuuuuuuuuuccagca

SEQ ID NO: 773694 - RNA, 21 nt, Homo sapiens
aaacuggcugcuuuguucaau

SEQ ID NO: 773695 - RNA, 21 nt, Homo sapiens
aaacugggggcucuguauaua

SEQ ID NO: 773696 - RNA, 17 nt, Homo sapiens
aaacuguagucucagga

SEQ ID NO: 773697 - RNA, 19 nt, Homo sapiens
aaacugugcuagugcugac

SEQ ID NO: 773698 - RNA, 17 nt, Homo sapiens
aaacuuacaaacuuugu

SEQ ID NO: 773699 - RNA, 16 nt, Homo sapiens
aaacuuacuagcuuua

SEQ ID NO: 773700 - RNA, 13 nt, Homo sapiens
aaacuuagaucau

SEQ ID NO: 773701 - RNA, 19 nt, Homo sapiens
aaacuuagaucaucaguca

SEQ ID NO: 773702 - RNA, 13 nt, Homo sapiens
aaacuuagccaga

SEQ ID NO: 773703 - RNA, 22 nt, Homo sapiens
aaacuuaucacgccuacuuaag

SEQ ID NO: 773704 - RNA, 18 nt, Homo sapiens
aaacuuaugcuaguuuau

SEQ ID NO: 773705 - RNA, 13 nt, Homo sapiens
aaacuucaaagag

SEQ ID NO: 773706 - RNA, 21 nt, Homo sapiens
aaacuuccacaagagugaauu

SEQ ID NO: 773707 - RNA, 13 nt, Homo sapiens
aaacuugaucaca

SEQ ID NO: 773708 - RNA, 15 nt, Homo sapiens
aaacuugcuuaucaa

SEQ ID NO: 773709 - RNA, 19 nt, Homo sapiens
aaacuuguaaaugcuguca

SEQ ID NO: 773710 - RNA, 22 nt, Homo sapiens
aaacuuguuagaucaaccucca

SEQ ID NO: 773711 - RNA, 16 nt, Homo sapiens
aaacuuuaaugaacua

SEQ ID NO: 773712 - RNA, 15 nt, Homo sapiens
aaacuuuagcaacag

SEQ ID NO: 773713 - RNA, 21 nt, Homo sapiens
aaauuaugcaaaagcagcuaa

SEQ ID NO: 773714 - RNA, 19 nt, Homo sapiens
aaauuauuacuaaugaugc

SEQ ID NO: 773715 - RNA, 21 nt, Homo sapiens
aaauuauuacuaaugaugcuu

SEQ ID NO: 773716 - RNA, 19 nt, Homo sapiens
aaauuauugcuguauguaa

SEQ ID NO: 773717 - RNA, 15 nt, Homo sapiens
aaauucaacuuugua

SEQ ID NO: 773718 - RNA, 11 nt, Homo sapiens
aaauucacugu

SEQ ID NO: 773719 - RNA, 20 nt, Homo sapiens
aaauucagaaagucauagau

SEQ ID NO: 773720 - RNA, 23 nt, Homo sapiens
aaauucagaacagccugccuguc

SEQ ID NO: 773721 - RNA, 17 nt, Homo sapiens
aaauucauaaccaaaga

SEQ ID NO: 773722 - RNA, 13 nt, Homo sapiens
aaauucauuauuc

SEQ ID NO: 773723 - RNA, 16 nt, Homo sapiens
aaauucauuucuagac

SEQ ID NO: 773724 - RNA, 19 nt, Homo sapiens
aaauuccaaauucauggca

SEQ ID NO: 773725 - RNA, 19 nt, Homo sapiens
aaauuccacacuaccacau

SEQ ID NO: 773726 - RNA, 20 nt, Homo sapiens
aaauuccacacuaccacauu

SEQ ID NO: 773727 - RNA, 22 nt, Homo sapiens
aaauuccccaagcaccuucccc

SEQ ID NO: 773728 - RNA, 18 nt, Homo sapiens
aaauuccuacaacuuaau

SEQ ID NO: 773729 - RNA, 15 nt, Homo sapiens
aaauuccuaucucau

SEQ ID NO: 773730 - RNA, 17 nt, Homo sapiens
aaauucgacaacuugua

SEQ ID NO: 773731 - RNA, 15 nt, Homo sapiens
aaauucuaagccaua

SEQ ID NO: 773732 - RNA, 14 nt, Homo sapiens
aaauucuagucucu

SEQ ID NO: 773733 - RNA, 12 nt, Homo sapiens
aaauucugauga

SEQ ID NO: 773734 - RNA, 17 nt, Homo sapiens
aaauucugaugagcauu

SEQ ID NO: 773735 - RNA, 21 nt, Homo sapiens
aaauucugaugagcauuacua

SEQ ID NO: 773736 - RNA, 24 nt, Homo sapiens
aaauucugaugagcauuacuauuc

SEQ ID NO: 773737 - RNA, 15 nt, Homo sapiens
aaauucuuuaguacu

SEQ ID NO: 773738 - RNA, 12 nt, Homo sapiens
aaauucuuucag

SEQ ID NO: 773739 - RNA, 14 nt, Homo sapiens
aaauugaacaaaga

SEQ ID NO: 773740 - RNA, 20 nt, Homo sapiens
aaauugaacuaaauccaaac

SEQ ID NO: 773741 - RNA, 19 nt, Homo sapiens
aaauugagaccugagugaa

SEQ ID NO: 773742 - RNA, 23 nt, Homo sapiens
aaauugcagaauucaaaagugau

SEQ ID NO: 773743 - RNA, 12 nt, Homo sapiens
aaauugcagaua

SEQ ID NO: 773744 - RNA, 18 nt, Homo sapiens
aaauugcagauaccauuu

SEQ ID NO: 773745 - RNA, 14 nt, Homo sapiens
aaauugccaagaaa

SEQ ID NO: 773746 - RNA, 20 nt, Homo sapiens
aaauugcuucuuuaccaagg

SEQ ID NO: 773747 - RNA, 16 nt, Homo sapiens
aaauugcuuuacaguu

SEQ ID NO: 773748 - RNA, 16 nt, Homo sapiens
aaauugggcagucuua

SEQ ID NO: 773749 - RNA, 19 nt, Homo sapiens
aaauugggcuucaaucacu

SEQ ID NO: 773750 - RNA, 22 nt, Homo sapiens
aaauuguauacauuuuguuaua

SEQ ID NO: 773751 - RNA, 17 nt, Homo sapiens
aaauuguauggugauaa

SEQ ID NO: 773752 - RNA, 11 nt, Homo sapiens
aaauugucaaa

SEQ ID NO: 773753 - RNA, 15 nt, Homo sapiens
aaauuuaaaugacau

SEQ ID NO: 773754 - RNA, 20 nt, Homo sapiens
aaauuuacaguuacugccua

SEQ ID NO: 773755 - RNA, 17 nt, Homo sapiens
aaauuuauucacauaua

SEQ ID NO: 773756 - RNA, 19 nt, Homo sapiens
aaauuucuagucaaugugu

SEQ ID NO: 773757 - RNA, 14 nt, Homo sapiens
aaauuugauuuuga

SEQ ID NO: 773758 - RNA, 12 nt, Homo sapiens
aaauuugcacug

SEQ ID NO: 773759 - RNA, 23 nt, Homo sapiens
aaauuuguaccucuaaguacaua

SEQ ID NO: 773760 - RNA, 14 nt, Homo sapiens
aaauuugugugaca

SEQ ID NO: 773761 - RNA, 14 nt, Homo sapiens
aaauuuuaaccuau

SEQ ID NO: 773762 - RNA, 21 nt, Homo sapiens
aaauuuuaauguaaaauucau

SEQ ID NO: 773763 - RNA, 12 nt, Homo sapiens
aaauuuuacuuc

SEQ ID NO: 773764 - RNA, 20 nt, Homo sapiens
aaauuuuagaacuuuaccua

SEQ ID NO: 773765 - RNA, 17 nt, Homo sapiens
aaauuuuauaucuugua

SEQ ID NO: 773766 - RNA, 23 nt, Homo sapiens
aaauuuucuuuuuauacuauuaa

SEQ ID NO: 773767 - RNA, 15 nt, Homo sapiens
aaauuuugagauuaa

SEQ ID NO: 773768 - RNA, 21 nt, Homo sapiens
aaauuuugaguucuacauaag

SEQ ID NO: 773769 - RNA, 19 nt, Homo sapiens
aaauuuuuaaauauucaca

SEQ ID NO: 773770 - RNA, 17 nt, Homo sapiens
aaauuuuuacaucaaaa

SEQ ID NO: 773771 - RNA, 22 nt, Homo sapiens
aaauuuuuauguaaaacccuuu

SEQ ID NO: 773772 - RNA, 22 nt, Homo sapiens
aacaaaacccucagcacuguua

SEQ ID NO: 773773 - RNA, 23 nt, Homo sapiens
aacaaacuacauguaauccauca

SEQ ID NO: 773774 - RNA, 13 nt, Homo sapiens
aacaaagaagcua

SEQ ID NO: 773775 - RNA, 12 nt, Homo sapiens
aacaaagacagg

SEQ ID NO: 773776 - RNA, 12 nt, Homo sapiens
aacaaagcccuu

SEQ ID NO: 773777 - RNA, 13 nt, Homo sapiens
aacaaagcccuua

SEQ ID NO: 773778 - RNA, 13 nt, Homo sapiens
aacaaaguccaca

SEQ ID NO: 773779 - RNA, 22 nt, Homo sapiens
aacaaaguuucagaguauauug

SEQ ID NO: 773780 - RNA, 13 nt, Homo sapiens
aacaaauaugcaa

SEQ ID NO: 773781 - RNA, 15 nt, Homo sapiens
aacaaauuauguuac

SEQ ID NO: 773782 - RNA, 20 nt, Homo sapiens
aacaaauucauauucugucu

SEQ ID NO: 773783 - RNA, 15 nt, Homo sapiens
aacaaauugaugcaa

SEQ ID NO: 773784 - RNA, 20 nt, Homo sapiens
aacaacaaagccaacaguca

SEQ ID NO: 773785 - RNA, 16 nt, Homo sapiens
aacaacagaucugcag

SEQ ID NO: 773786 - RNA, 12 nt, Homo sapiens
aacaacauaucu

SEQ ID NO: 773787 - RNA, 14 nt, Homo sapiens
aacaacauaucuca

SEQ ID NO: 773788 - RNA, 14 nt, Homo sapiens
aacaacauguucua

SEQ ID NO: 773789 - RNA, 13 nt, Homo sapiens
aacaacuaccuga

SEQ ID NO: 773790 - RNA, 12 nt, Homo sapiens
aacaacuguggu

SEQ ID NO: 773791 - RNA, 12 nt, Homo sapiens
aacaacuuugaa

SEQ ID NO: 773792 - RNA, 14 nt, Homo sapiens
aacaagaguuuuaa

SEQ ID NO: 773793 - RNA, 14 nt, Homo sapiens
aacaaggucugcuc

SEQ ID NO: 773794 - RNA, 19 nt, Homo sapiens
aacaaggugucuuuuccac

SEQ ID NO: 773795 - RNA, 17 nt, Homo sapiens
aacaauaaaugaaugaa

SEQ ID NO: 773796 - RNA, 18 nt, Homo sapiens
aacaauaacgauacaaau

SEQ ID NO: 773797 - RNA, 21 nt, Homo sapiens
aacaauacaugcugcuaauuc

SEQ ID NO: 773798 - RNA, 22 nt, Homo sapiens
aacaauaguucuuagcuuugaa

SEQ ID NO: 773799 - RNA, 12 nt, Homo sapiens
aacaaucacugg

SEQ ID NO: 773800 - RNA, 20 nt, Homo sapiens
aacaaucuaagggucucuca

SEQ ID NO: 773801 - RNA, 21 nt, Homo sapiens
aacaaucuaagggucucucau

SEQ ID NO: 773802 - RNA, 13 nt, Homo sapiens
aacaaucucucaa

SEQ ID NO: 773803 - RNA, 17 nt, Homo sapiens
aacaaucuuugcuguau

SEQ ID NO: 773804 - RNA, 13 nt, Homo sapiens
aacaaugaagaua

SEQ ID NO: 773805 - RNA, 15 nt, Homo sapiens
aacaaugaagauaaa

SEQ ID NO: 773806 - RNA, 17 nt, Homo sapiens
aacaaugccaugaacaa

SEQ ID NO: 773807 - RNA, 20 nt, Homo sapiens
aacaaugcugauuuggugac

SEQ ID NO: 773808 - RNA, 23 nt, Homo sapiens
aacaauuaauggauucaguauua

SEQ ID NO: 773809 - RNA, 18 nt, Homo sapiens
aacaauugaaguaaacuu

SEQ ID NO: 773810 - RNA, 22 nt, Homo sapiens
aacaauugcuuuugaggcucag

SEQ ID NO: 773811 - RNA, 22 nt, Homo sapiens
aacaauugggagauuaucuuuc

SEQ ID NO: 773812 - RNA, 16 nt, Homo sapiens
aacacaaaacuugaaa

SEQ ID NO: 773813 - RNA, 21 nt, Homo sapiens
aacacaaaguccuuaacaugc

SEQ ID NO: 773814 - RNA, 22 nt, Homo sapiens
aacacaacuuuauugauugaau

SEQ ID NO: 773815 - RNA, 14 nt, Homo sapiens
aacacaauaugaau

SEQ ID NO: 773816 - RNA, 19 nt, Homo sapiens
aacacaauucuucuuccaa

SEQ ID NO: 773817 - RNA, 14 nt, Homo sapiens
aacacacaugcaca

SEQ ID NO: 773818 - RNA, 18 nt, Homo sapiens
aacacagacaaagugcua

SEQ ID NO: 773819 - RNA, 18 nt, Homo sapiens
aacacagcaugugccaag

SEQ ID NO: 773820 - RNA, 14 nt, Homo sapiens
aacacaggaaguca

SEQ ID NO: 773821 - RNA, 19 nt, Homo sapiens
aacacagugccuucaauaa

SEQ ID NO: 773822 - RNA, 14 nt, Homo sapiens
aacacauacaggaa

SEQ ID NO: 773823 - RNA, 19 nt, Homo sapiens
aacacaugugcagucacug

SEQ ID NO: 773824 - RNA, 20 nt, Homo sapiens
aacacaugugcagucacugg

SEQ ID NO: 773825 - RNA, 18 nt, Homo sapiens
aacacauuacgugcuccc

SEQ ID NO: 773826 - RNA, 20 nt, Homo sapiens
aacacauucuuauugacaau

SEQ ID NO: 773827 - RNA, 18 nt, Homo sapiens
aacaccaacauguuggga

SEQ ID NO: 773828 - RNA, 13 nt, Homo sapiens
aauguagcacuua

SEQ ID NO: 773829 - RNA, 11 nt, Homo sapiens
aauguauauau

SEQ ID NO: 773830 - RNA, 16 nt, Homo sapiens
aauguaucauagaaau

SEQ ID NO: 773831 - RNA, 14 nt, Homo sapiens
aauguauguacaau

SEQ ID NO: 773832 - RNA, 16 nt, Homo sapiens
aauguauguacaauac

SEQ ID NO: 773833 - RNA, 19 nt, Homo sapiens
aaugucaagacagggaagg

SEQ ID NO: 773834 - RNA, 19 nt, Homo sapiens
aaugucacaaccucucuga

SEQ ID NO: 773835 - RNA, 11 nt, Homo sapiens
aaugucacugg

SEQ ID NO: 773836 - RNA, 15 nt, Homo sapiens
aaugucagggccagg

SEQ ID NO: 773837 - RNA, 16 nt, Homo sapiens
aaugucaggguucugc

SEQ ID NO: 773838 - RNA, 19 nt, Homo sapiens
aaugucuccuuugcucuug

SEQ ID NO: 773839 - RNA, 14 nt, Homo sapiens
aaugucugcagcuc

SEQ ID NO: 773840 - RNA, 16 nt, Homo sapiens
aaugucuggucugucc

SEQ ID NO: 773841 - RNA, 13 nt, Homo sapiens
aaugucuguuuca

SEQ ID NO: 773842 - RNA, 14 nt, Homo sapiens
aaugugaaacggaa

SEQ ID NO: 773843 - RNA, 12 nt, Homo sapiens
aaugugaacuua

SEQ ID NO: 773844 - RNA, 20 nt, Homo sapiens
aaugugaaguucaucuugca

SEQ ID NO: 773845 - RNA, 20 nt, Homo sapiens
aaugugaauaaguaaagaau

SEQ ID NO: 773846 - RNA, 18 nt, Homo sapiens
aaugugaggaacucacau

SEQ ID NO: 773847 - RNA, 16 nt, Homo sapiens
aaugugcugagcauuu

SEQ ID NO: 773848 - RNA, 22 nt, Homo sapiens
aaugugcuggugaacacuguga

SEQ ID NO: 773849 - RNA, 17 nt, Homo sapiens
aauguggaagucaguac

SEQ ID NO: 773850 - RNA, 14 nt, Homo sapiens
aauguggauuugau

SEQ ID NO: 773851 - RNA, 20 nt, Homo sapiens
aauguggguauugaguguga

SEQ ID NO: 773852 - RNA, 18 nt, Homo sapiens
aaugugguaguacccagg

SEQ ID NO: 773853 - RNA, 16 nt, Homo sapiens
aaugugguuacuuccu

SEQ ID NO: 773854 - RNA, 13 nt, Homo sapiens
aauguguauucau

SEQ ID NO: 773855 - RNA, 17 nt, Homo sapiens
aauguguuaagugcagg

SEQ ID NO: 773856 - RNA, 17 nt, Homo sapiens
aauguguuugaacaugu

SEQ ID NO: 773857 - RNA, 14 nt, Homo sapiens
aauguuaauguuau

SEQ ID NO: 773858 - RNA, 18 nt, Homo sapiens
aauguuaauguuauauca

SEQ ID NO: 773859 - RNA, 16 nt, Homo sapiens
aauguuacauuauuau

SEQ ID NO: 773860 - RNA, 13 nt, Homo sapiens
aauguuagcaguu

SEQ ID NO: 773861 - RNA, 14 nt, Homo sapiens
aauguuccugaaaa

SEQ ID NO: 773862 - RNA, 20 nt, Homo sapiens
aauguucuauuuaacaacug

SEQ ID NO: 773863 - RNA, 22 nt, Homo sapiens
aauguucuauuuaacaacuggg

SEQ ID NO: 773864 - RNA, 12 nt, Homo sapiens
aauguugccagc

SEQ ID NO: 773865 - RNA, 13 nt, Homo sapiens
aauguuguucucu

SEQ ID NO: 773866 - RNA, 12 nt, Homo sapiens
aauguuucacua

SEQ ID NO: 773867 - RNA, 22 nt, Homo sapiens
aauguuuguuauuuacacuggu

SEQ ID NO: 773868 - RNA, 16 nt, Homo sapiens
aauguuuuaacucuuu

SEQ ID NO: 773869 - RNA, 22 nt, Homo sapiens
aauguuuucuagucacuuccuc

SEQ ID NO: 773870 - RNA, 13 nt, Homo sapiens
aauuaaaaccaau

SEQ ID NO: 773871 - RNA, 16 nt, Homo sapiens
aauuaaaaccaauuua

SEQ ID NO: 773872 - RNA, 23 nt, Homo sapiens
aauuaaaacuaagcacaaagcca

SEQ ID NO: 773873 - RNA, 11 nt, Homo sapiens
aauuaaaggaa

SEQ ID NO: 773874 - RNA, 17 nt, Homo sapiens
aauuaaaggaacagagu

SEQ ID NO: 773875 - RNA, 15 nt, Homo sapiens
aauuaauaaauguca

SEQ ID NO: 773876 - RNA, 17 nt, Homo sapiens
aauuaauaaaugucauu

SEQ ID NO: 773877 - RNA, 18 nt, Homo sapiens
aauuaauauucauauuau

SEQ ID NO: 773878 - RNA, 16 nt, Homo sapiens
aauuacaaaacucaga

SEQ ID NO: 773879 - RNA, 14 nt, Homo sapiens
aauuacaagcugua

SEQ ID NO: 773880 - RNA, 16 nt, Homo sapiens
aauuacaguacacauc

SEQ ID NO: 773881 - RNA, 18 nt, Homo sapiens
aauuaccaugcuucacaa

SEQ ID NO: 773882 - RNA, 21 nt, Homo sapiens
aauuaccgugagugacauagc

SEQ ID NO: 773883 - RNA, 21 nt, Homo sapiens
aauuacuggcaaaaacaaaac

SEQ ID NO: 773884 - RNA, 19 nt, Homo sapiens
aauuacuuauuguauuuau

SEQ ID NO: 773885 - RNA, 17 nt, Homo sapiens
aauuacuuguguuacuu

SEQ ID NO: 773886 - RNA, 19 nt, Homo sapiens
aauuaggagaggcagagau

SEQ ID NO: 773887 - RNA, 21 nt, Homo sapiens
aauuaggagaggcagagauag

SEQ ID NO: 773888 - RNA, 14 nt, Homo sapiens
aauuagggcccaau

SEQ ID NO: 773889 - RNA, 17 nt, Homo sapiens
aauuagugaaccaaaaa

SEQ ID NO: 773890 - RNA, 19 nt, Homo sapiens
aauuaguuuauauuacucu

SEQ ID NO: 773891 - RNA, 23 nt, Homo sapiens
aauuauaauguugcccaguguga

SEQ ID NO: 773892 - RNA, 22 nt, Homo sapiens
aauuauacagauagaguuccau

SEQ ID NO: 773893 - RNA, 22 nt, Homo sapiens
aauuauacuguagcugaugaaa

SEQ ID NO: 773894 - RNA, 13 nt, Homo sapiens
aauuauacuuacu

SEQ ID NO: 773895 - RNA, 16 nt, Homo sapiens
aauuauacuuacuucu

SEQ ID NO: 773896 - RNA, 21 nt, Homo sapiens
aauuauauaacuguauuugaa

SEQ ID NO: 773897 - RNA, 15 nt, Homo sapiens
aauuauauagcugcu

SEQ ID NO: 773898 - RNA, 15 nt, Homo sapiens
aauuauaucacuuca

SEQ ID NO: 773899 - RNA, 15 nt, Homo sapiens
aauuauaugaccaua

SEQ ID NO: 773900 - RNA, 16 nt, Homo sapiens
aauuauaugaccauau

SEQ ID NO: 773901 - RNA, 17 nt, Homo sapiens
aauuauauuuuguugcu

SEQ ID NO: 773902 - RNA, 16 nt, Homo sapiens
aauuaucaaaaagcua

SEQ ID NO: 773903 - RNA, 22 nt, Homo sapiens
aauuaucaugcguuuuauaucu

SEQ ID NO: 773904 - RNA, 19 nt, Homo sapiens
aauuaucccuuacagacuu

SEQ ID NO: 773905 - RNA, 18 nt, Homo sapiens
aauuaucgggaacagugu

SEQ ID NO: 773906 - RNA, 15 nt, Homo sapiens
aauuaugggaucuca

SEQ ID NO: 773907 - RNA, 15 nt, Homo sapiens
aauuauguaaugcaa

SEQ ID NO: 773908 - RNA, 22 nt, Homo sapiens
aauuaugucucuugagcaucaa

SEQ ID NO: 773909 - RNA, 21 nt, Homo sapiens
aauuauguuuccgaggcacug

SEQ ID NO: 773910 - RNA, 22 nt, Homo sapiens
aauuauuauauacauacugcau

SEQ ID NO: 773911 - RNA, 16 nt, Homo sapiens
aauuauuauauauaca

SEQ ID NO: 773912 - RNA, 14 nt, Homo sapiens
aauuauucuaguca

SEQ ID NO: 773913 - RNA, 15 nt, Homo sapiens
aauuauugacacuga

SEQ ID NO: 773914 - RNA, 20 nt, Homo sapiens
aauuauugacacugaacuua

SEQ ID NO: 773915 - RNA, 19 nt, Homo sapiens
aauuauuuuuacaguucuc

SEQ ID NO: 773916 - RNA, 17 nt, Homo sapiens
aauucaaaaaaaaaagc

SEQ ID NO: 773917 - RNA, 14 nt, Homo sapiens
aauucaaacugggg

SEQ ID NO: 773918 - RNA, 14 nt, Homo sapiens
aauucaagccuuag

SEQ ID NO: 773919 - RNA, 20 nt, Homo sapiens
aauucaagugacacauuaau

SEQ ID NO: 773920 - RNA, 16 nt, Homo sapiens
aauucaauccuacuuu

SEQ ID NO: 773921 - RNA, 10 nt, Homo sapiens
aauucaccuu

SEQ ID NO: 773922 - RNA, 20 nt, Homo sapiens
aauucacuccagucaacaga

SEQ ID NO: 773923 - RNA, 22 nt, Homo sapiens
aauucacuccagucaacagauu

SEQ ID NO: 773924 - RNA, 13 nt, Homo sapiens
aauucacucccac

SEQ ID NO: 773925 - RNA, 17 nt, Homo sapiens
aauucagaacaagcaau

SEQ ID NO: 773926 - RNA, 17 nt, Homo sapiens
aauucagacaagcugca

SEQ ID NO: 773927 - RNA, 19 nt, Homo sapiens
aauucagcacugauuucac

SEQ ID NO: 773928 - RNA, 12 nt, Homo sapiens
aauucagucuca

SEQ ID NO: 773929 - RNA, 22 nt, Homo sapiens
aauucauaaaaauaaccaaaaa

SEQ ID NO: 773930 - RNA, 17 nt, Homo sapiens
aauucauaaccaaagag

SEQ ID NO: 773931 - RNA, 16 nt, Homo sapiens
aauucauaaucacucu

SEQ ID NO: 773932 - RNA, 19 nt, Homo sapiens
aauucauagcauccugauu

SEQ ID NO: 773933 - RNA, 16 nt, Homo sapiens
aauucauucauuucau

SEQ ID NO: 773934 - RNA, 23 nt, Homo sapiens
aauucauucucugugguauccaa

SEQ ID NO: 773935 - RNA, 21 nt, Homo sapiens
aauucauuucuagacucaaaa

SEQ ID NO: 773936 - RNA, 19 nt, Homo sapiens
aauucauuuuuuaaauucc

SEQ ID NO: 773937 - RNA, 20 nt, Homo sapiens
aauucauuuuuuucacugga

SEQ ID NO: 773938 - RNA, 11 nt, Homo sapiens
aauuccagcua

SEQ ID NO: 773939 - RNA, 18 nt, Homo sapiens
aauuccauuuccaguuca

SEQ ID NO: 773940 - RNA, 18 nt, Homo sapiens
aauucccauuuugcaaaa

SEQ ID NO: 773941 - RNA, 13 nt, Homo sapiens
aauucccuugaau

SEQ ID NO: 773942 - RNA, 20 nt, Homo sapiens
aauucccuuuuaacccagug

SEQ ID NO: 773943 - RNA, 16 nt, Homo sapiens
acacuaccacauuaaa

SEQ ID NO: 773944 - RNA, 14 nt, Homo sapiens
acacuacugcuaaa

SEQ ID NO: 773945 - RNA, 12 nt, Homo sapiens
acacucaucaca

SEQ ID NO: 773946 - RNA, 22 nt, Homo sapiens
acacucaucacacuucauugua

SEQ ID NO: 773947 - RNA, 20 nt, Homo sapiens
acacuccacuugaagcacuu

SEQ ID NO: 773948 - RNA, 16 nt, Homo sapiens
acacuccccugcacug

SEQ ID NO: 773949 - RNA, 18 nt, Homo sapiens
acacucuacuacauguga

SEQ ID NO: 773950 - RNA, 22 nt, Homo sapiens
acacucuggcugcucccugaca

SEQ ID NO: 773951 - RNA, 23 nt, Homo sapiens
acacugaaacuguaugugcugua

SEQ ID NO: 773952 - RNA, 14 nt, Homo sapiens
acacugaacuuaau

SEQ ID NO: 773953 - RNA, 14 nt, Homo sapiens
acacugacuugaga

SEQ ID NO: 773954 - RNA, 23 nt, Homo sapiens
acacugagagggcaaucuuugcc

SEQ ID NO: 773955 - RNA, 21 nt, Homo sapiens
acacugaggcccaauggccuu

SEQ ID NO: 773956 - RNA, 18 nt, Homo sapiens
acacugcacacagugacu

SEQ ID NO: 773957 - RNA, 21 nt, Homo sapiens
acacugcacagggaaaauugc

SEQ ID NO: 773958 - RNA, 19 nt, Homo sapiens
acacugcaguuuccuggaa

SEQ ID NO: 773959 - RNA, 19 nt, Homo sapiens
acacugcgcaucaccuacc

SEQ ID NO: 773960 - RNA, 23 nt, Homo sapiens
acacuggaauauaaaacagucau

SEQ ID NO: 773961 - RNA, 18 nt, Homo sapiens
acacuggcguuacugcuu

SEQ ID NO: 773962 - RNA, 21 nt, Homo sapiens
acacuggcguuacugcuugac

SEQ ID NO: 773963 - RNA, 22 nt, Homo sapiens
acacuguaccgacuuugauaga

SEQ ID NO: 773964 - RNA, 19 nt, Homo sapiens
acacugugcccagcccgga

SEQ ID NO: 773965 - RNA, 20 nt, Homo sapiens
acacuguguaaauacccaua

SEQ ID NO: 773966 - RNA, 13 nt, Homo sapiens
acacuguguaaga

SEQ ID NO: 773967 - RNA, 14 nt, Homo sapiens
acacuuaacagaug

SEQ ID NO: 773968 - RNA, 15 nt, Homo sapiens
acacuuacacuuuau

SEQ ID NO: 773969 - RNA, 16 nt, Homo sapiens
acacuuaugggccaag

SEQ ID NO: 773970 - RNA, 20 nt, Homo sapiens
acacuuaugggccaagccca

SEQ ID NO: 773971 - RNA, 16 nt, Homo sapiens
acacuuccagcauuua

SEQ ID NO: 773972 - RNA, 24 nt, Homo sapiens
acacuugcucccaacccauucacu

SEQ ID NO: 773973 - RNA, 15 nt, Homo sapiens
acacuugcugucaau

SEQ ID NO: 773974 - RNA, 16 nt, Homo sapiens
acacuuggaugcaggg

SEQ ID NO: 773975 - RNA, 18 nt, Homo sapiens
acacuuguuguccaguug

SEQ ID NO: 773976 - RNA, 12 nt, Homo sapiens
acacuuugccau

SEQ ID NO: 773977 - RNA, 14 nt, Homo sapiens
acacuuuuccacau

SEQ ID NO: 773978 - RNA, 17 nt, Homo sapiens
acacuuuugaugacgau

SEQ ID NO: 773979 - RNA, 18 nt, Homo sapiens
acagaaaacaucccacug

SEQ ID NO: 773980 - RNA, 20 nt, Homo sapiens
acagaaaauuguugugcuua

SEQ ID NO: 773981 - RNA, 16 nt, Homo sapiens
acagaaaccaagccau

SEQ ID NO: 773982 - RNA, 20 nt, Homo sapiens
acagaaaccagaaaagcaau

SEQ ID NO: 773983 - RNA, 15 nt, Homo sapiens
acagaaaccuuuuau

SEQ ID NO: 773984 - RNA, 15 nt, Homo sapiens
acagaaacgcaucca

SEQ ID NO: 773985 - RNA, 13 nt, Homo sapiens
acagaacacuuau

SEQ ID NO: 773986 - RNA, 17 nt, Homo sapiens
acagaacauauguugca

SEQ ID NO: 773987 - RNA, 19 nt, Homo sapiens
acagaaccaaaucguggca

SEQ ID NO: 773988 - RNA, 14 nt, Homo sapiens
acagaacuucacag

SEQ ID NO: 773989 - RNA, 22 nt, Homo sapiens
acagaagcuuuagcaagugugc

SEQ ID NO: 773990 - RNA, 20 nt, Homo sapiens
acagaaggaggaaguggaag

SEQ ID NO: 773991 - RNA, 16 nt, Homo sapiens
acagaaggaugaauga

SEQ ID NO: 773992 - RNA, 18 nt, Homo sapiens
acagaaggcaaaguuuac

SEQ ID NO: 773993 - RNA, 21 nt, Homo sapiens
acagaaguccccucuacuuua

SEQ ID NO: 773994 - RNA, 18 nt, Homo sapiens
acagaauaauguguuaaa

SEQ ID NO: 773995 - RNA, 13 nt, Homo sapiens
acagaauauacuu

SEQ ID NO: 773996 - RNA, 13 nt, Homo sapiens
acagaaucucagu

SEQ ID NO: 773997 - RNA, 16 nt, Homo sapiens
acagaaucucagucug

SEQ ID NO: 773998 - RNA, 23 nt, Homo sapiens
acagaauuuuuuaaauugacagu

SEQ ID NO: 773999 - RNA, 13 nt, Homo sapiens
acagaccacagag

SEQ ID NO: 774000 - RNA, 18 nt, Homo sapiens
acagaccacaucuuuauc

SEQ ID NO: 774001 - RNA, 15 nt, Homo sapiens
acagaccaccugcuu

SEQ ID NO: 774002 - RNA, 16 nt, Homo sapiens
acagaccacuugccac

SEQ ID NO: 774003 - RNA, 22 nt, Homo sapiens
acagacgcugcugucacaacca

SEQ ID NO: 774004 - RNA, 15 nt, Homo sapiens
acagacucauuacaa

SEQ ID NO: 774005 - RNA, 17 nt, Homo sapiens
acagacuccacccuccu

SEQ ID NO: 774006 - RNA, 24 nt, Homo sapiens
acagacucugauucuacagugaug

SEQ ID NO: 774007 - RNA, 17 nt, Homo sapiens
acagacuucuccagacc

SEQ ID NO: 774008 - RNA, 15 nt, Homo sapiens
acagacuucuuggua

SEQ ID NO: 774009 - RNA, 19 nt, Homo sapiens
acagagaaguuuguagcca

SEQ ID NO: 774010 - RNA, 17 nt, Homo sapiens
acagagacaggcccaag

SEQ ID NO: 774011 - RNA, 20 nt, Homo sapiens
acagagagacagacuugaga

SEQ ID NO: 774012 - RNA, 19 nt, Homo sapiens
acagagagcuugcugugac

SEQ ID NO: 774013 - RNA, 21 nt, Homo sapiens
acagagcaagaccccaucuca

SEQ ID NO: 774014 - RNA, 19 nt, Homo sapiens
acagagccaagcacugcuc

SEQ ID NO: 774015 - RNA, 20 nt, Homo sapiens
acagagcgagagucugucuc

SEQ ID NO: 774016 - RNA, 15 nt, Homo sapiens
acagaggaccaugcu

SEQ ID NO: 774017 - RNA, 22 nt, Homo sapiens
acagaggagaugccacuucuca

SEQ ID NO: 774018 - RNA, 20 nt, Homo sapiens
acagaggccgggguccaggc

SEQ ID NO: 774019 - RNA, 15 nt, Homo sapiens
acagagucucacuuu

SEQ ID NO: 774020 - RNA, 19 nt, Homo sapiens
acagagugaacacucuacu

SEQ ID NO: 774021 - RNA, 13 nt, Homo sapiens
acagagugcauug

SEQ ID NO: 774022 - RNA, 21 nt, Homo sapiens
acagaguggucuuucuggaga

SEQ ID NO: 774023 - RNA, 20 nt, Homo sapiens
acagaguugccaggcacuuu

SEQ ID NO: 774024 - RNA, 19 nt, Homo sapiens
acagaguuggggagauaaa

SEQ ID NO: 774025 - RNA, 15 nt, Homo sapiens
acagauaucaguguc

SEQ ID NO: 774026 - RNA, 17 nt, Homo sapiens
acagaucaucuuggaac

SEQ ID NO: 774027 - RNA, 18 nt, Homo sapiens
acagaucaucuuggaacu

SEQ ID NO: 774028 - RNA, 13 nt, Homo sapiens
acagaugccccag

SEQ ID NO: 774029 - RNA, 12 nt, Homo sapiens
acagaugcugag

SEQ ID NO: 774030 - RNA, 19 nt, Homo sapiens
acagauggggucugugacu

SEQ ID NO: 774031 - RNA, 20 nt, Homo sapiens
acagauggggucugugacug

SEQ ID NO: 774032 - RNA, 22 nt, Homo sapiens
acagauuuaagaauaccugaga

SEQ ID NO: 774033 - RNA, 16 nt, Homo sapiens
acagauuuuauuugua

SEQ ID NO: 774034 - RNA, 19 nt, Homo sapiens
acagcaacaggaaucucag

SEQ ID NO: 774035 - RNA, 19 nt, Homo sapiens
acagcaacaugugacaaca

SEQ ID NO: 774036 - RNA, 17 nt, Homo sapiens
acagcaauggugucagu

SEQ ID NO: 774037 - RNA, 16 nt, Homo sapiens
acagcacuggggaguc

SEQ ID NO: 774038 - RNA, 13 nt, Homo sapiens
acagcagcacugu

SEQ ID NO: 774039 - RNA, 14 nt, Homo sapiens
acagcauacuucaa

SEQ ID NO: 774040 - RNA, 22 nt, Homo sapiens
acagcaugggccucaccuccuc

SEQ ID NO: 774041 - RNA, 15 nt, Homo sapiens
acagcauucuuguca

SEQ ID NO: 774042 - RNA, 17 nt, Homo sapiens
acagcauucuugucaca

SEQ ID NO: 774043 - RNA, 18 nt, Homo sapiens
acagccaaaaaggaccaa

SEQ ID NO: 774044 - RNA, 15 nt, Homo sapiens
acagccaagcaccuc

SEQ ID NO: 774045 - RNA, 13 nt, Homo sapiens
acagccagugugu

SEQ ID NO: 774046 - RNA, 22 nt, Homo sapiens
acagccccuuauuugcacuuca

SEQ ID NO: 774047 - RNA, 18 nt, Homo sapiens
acagcccuccgacccuca

SEQ ID NO: 774048 - RNA, 20 nt, Homo sapiens
acagccgcuccugucugcca

SEQ ID NO: 774049 - RNA, 17 nt, Homo sapiens
acagccguguguucaaa

SEQ ID NO: 774050 - RNA, 23 nt, Homo sapiens
acagccucccacccccaucucuc

SEQ ID NO: 774051 - RNA, 14 nt, Homo sapiens
acagccuggcacag

SEQ ID NO: 774052 - RNA, 20 nt, Homo sapiens
acagccuucuagcacacuuu

SEQ ID NO: 774053 - RNA, 21 nt, Homo sapiens
acagccuuucguucugcugac

SEQ ID NO: 774054 - RNA, 20 nt, Homo sapiens
acagcgagacuccgucucaa

SEQ ID NO: 774055 - RNA, 17 nt, Homo sapiens
acagcgcuaaggauggu

SEQ ID NO: 774056 - RNA, 17 nt, Homo sapiens
acagcucaccacugugc

SEQ ID NO: 774057 - RNA, 13 nt, Homo sapiens
accagcaagaaua

SEQ ID NO: 774058 - RNA, 16 nt, Homo sapiens
accagcaauacaaaga

SEQ ID NO: 774059 - RNA, 13 nt, Homo sapiens
accagcacugucu

SEQ ID NO: 774060 - RNA, 14 nt, Homo sapiens
accagccccucccc

SEQ ID NO: 774061 - RNA, 18 nt, Homo sapiens
accagcccugaccccagu

SEQ ID NO: 774062 - RNA, 22 nt, Homo sapiens
accagccuggccaacaugguga

SEQ ID NO: 774063 - RNA, 16 nt, Homo sapiens
accaggacuagggcug

SEQ ID NO: 774064 - RNA, 20 nt, Homo sapiens
accaggacucccuccucacc

SEQ ID NO: 774065 - RNA, 15 nt, Homo sapiens
accaggaggacaaga

SEQ ID NO: 774066 - RNA, 13 nt, Homo sapiens
accaggcacugcc

SEQ ID NO: 774067 - RNA, 14 nt, Homo sapiens
accaggcugcucag

SEQ ID NO: 774068 - RNA, 15 nt, Homo sapiens
accaggggugcucac

SEQ ID NO: 774069 - RNA, 22 nt, Homo sapiens
accaggguccuuuugacacugc

SEQ ID NO: 774070 - RNA, 22 nt, Homo sapiens
accaguacucccccagcuuucc

SEQ ID NO: 774071 - RNA, 22 nt, Homo sapiens
accaguaucgcucauagaucag

SEQ ID NO: 774072 - RNA, 18 nt, Homo sapiens
accagucccacaccgcug

SEQ ID NO: 774073 - RNA, 19 nt, Homo sapiens
accagucuauuuccacuga

SEQ ID NO: 774074 - RNA, 12 nt, Homo sapiens
accagugaaagg

SEQ ID NO: 774075 - RNA, 17 nt, Homo sapiens
accaguggugcguuuau

SEQ ID NO: 774076 - RNA, 19 nt, Homo sapiens
accaguugggagcacugga

SEQ ID NO: 774077 - RNA, 14 nt, Homo sapiens
accauaauguuaca

SEQ ID NO: 774078 - RNA, 14 nt, Homo sapiens
accauacugaggga

SEQ ID NO: 774079 - RNA, 16 nt, Homo sapiens
accauauaccaucucc

SEQ ID NO: 774080 - RNA, 19 nt, Homo sapiens
accauauugugcuucacag

SEQ ID NO: 774081 - RNA, 22 nt, Homo sapiens
accaucauuauaaacgugauga

SEQ ID NO: 774082 - RNA, 11 nt, Homo sapiens
accauccacag

SEQ ID NO: 774083 - RNA, 20 nt, Homo sapiens
accauccuggcuaacacggu

SEQ ID NO: 774084 - RNA, 14 nt, Homo sapiens
accaucguccuucc

SEQ ID NO: 774085 - RNA, 13 nt, Homo sapiens
accaucugauuaa

SEQ ID NO: 774086 - RNA, 14 nt, Homo sapiens
accaucugucuugc

SEQ ID NO: 774087 - RNA, 13 nt, Homo sapiens
accaucugugacu

SEQ ID NO: 774088 - RNA, 14 nt, Homo sapiens
accaugacccuaca

SEQ ID NO: 774089 - RNA, 14 nt, Homo sapiens
accaugccauuuaa

SEQ ID NO: 774090 - RNA, 20 nt, Homo sapiens
accaugccccugagcaaugu

SEQ ID NO: 774091 - RNA, 12 nt, Homo sapiens
accaugcugcug

SEQ ID NO: 774092 - RNA, 22 nt, Homo sapiens
accaugcugcuggggaagacag

SEQ ID NO: 774093 - RNA, 14 nt, Homo sapiens
accaugcuucacaa

SEQ ID NO: 774094 - RNA, 19 nt, Homo sapiens
accauggcaugguuauuga

SEQ ID NO: 774095 - RNA, 22 nt, Homo sapiens
accauggcaugguuauugauga

SEQ ID NO: 774096 - RNA, 14 nt, Homo sapiens
accauggccagcua

SEQ ID NO: 774097 - RNA, 20 nt, Homo sapiens
accauguacaugaagaagcu

SEQ ID NO: 774098 - RNA, 21 nt, Homo sapiens
accauguggcagaagggauaa

SEQ ID NO: 774099 - RNA, 20 nt, Homo sapiens
accauguugacuuuccucau

SEQ ID NO: 774100 - RNA, 14 nt, Homo sapiens
accauguugcccag

SEQ ID NO: 774101 - RNA, 22 nt, Homo sapiens
accauuagauaaacacaggcag

SEQ ID NO: 774102 - RNA, 16 nt, Homo sapiens
accauuccaacuucaa

SEQ ID NO: 774103 - RNA, 22 nt, Homo sapiens
accauuccugccuuuaagccaa

SEQ ID NO: 774104 - RNA, 12 nt, Homo sapiens
accauucucacc

SEQ ID NO: 774105 - RNA, 13 nt, Homo sapiens
accauucucaccc

SEQ ID NO: 774106 - RNA, 19 nt, Homo sapiens
accauugaccucagcugca

SEQ ID NO: 774107 - RNA, 18 nt, Homo sapiens
accauugcuguucuacuu

SEQ ID NO: 774108 - RNA, 16 nt, Homo sapiens
accauuucaagacaga

SEQ ID NO: 774109 - RNA, 19 nt, Homo sapiens
accauuucucagcaucgug

SEQ ID NO: 774110 - RNA, 23 nt, Homo sapiens
accauuuguaauaaaguauauaa

SEQ ID NO: 774111 - RNA, 21 nt, Homo sapiens
accauuuuauagacuaccaau

SEQ ID NO: 774112 - RNA, 16 nt, Homo sapiens
accauuuuuuaaggaa

SEQ ID NO: 774113 - RNA, 17 nt, Homo sapiens
accauuuuuuaaggaaa

SEQ ID NO: 774114 - RNA, 20 nt, Homo sapiens
acccaaagggcuuauugacu

SEQ ID NO: 774115 - RNA, 14 nt, Homo sapiens
acccaaaguaucag

SEQ ID NO: 774116 - RNA, 13 nt, Homo sapiens
acccaacagcagu

SEQ ID NO: 774117 - RNA, 13 nt, Homo sapiens
acccaagccacaa

SEQ ID NO: 774118 - RNA, 22 nt, Homo sapiens
acccaagccugauccagccuuu

SEQ ID NO: 774119 - RNA, 20 nt, Homo sapiens
acccaagugccucaccucga

SEQ ID NO: 774120 - RNA, 18 nt, Homo sapiens
acccaagugcugcacaaa

SEQ ID NO: 774121 - RNA, 21 nt, Homo sapiens
acccaauuugauuugaauauu

SEQ ID NO: 774122 - RNA, 19 nt, Homo sapiens
acccacaacgaaugaauga

SEQ ID NO: 774123 - RNA, 16 nt, Homo sapiens
acccacacagcugccc

SEQ ID NO: 774124 - RNA, 11 nt, Homo sapiens
acccacacugc

SEQ ID NO: 774125 - RNA, 18 nt, Homo sapiens
acccacagccccugcugg

SEQ ID NO: 774126 - RNA, 14 nt, Homo sapiens
acccacaugcucca

SEQ ID NO: 774127 - RNA, 14 nt, Homo sapiens
acccaccccugugc

SEQ ID NO: 774128 - RNA, 14 nt, Homo sapiens
acccacccuguggc

SEQ ID NO: 774129 - RNA, 20 nt, Homo sapiens
acccaccuagaacacuaacu

SEQ ID NO: 774130 - RNA, 12 nt, Homo sapiens
acccaccucagc

SEQ ID NO: 774131 - RNA, 21 nt, Homo sapiens
acccacguauucauucaguga

SEQ ID NO: 774132 - RNA, 12 nt, Homo sapiens
acccacuacccu

SEQ ID NO: 774133 - RNA, 14 nt, Homo sapiens
acccacuuugucca

SEQ ID NO: 774134 - RNA, 16 nt, Homo sapiens
acccagacagcucccu

SEQ ID NO: 774135 - RNA, 20 nt, Homo sapiens
acccagacguggaguggagu

SEQ ID NO: 774136 - RNA, 14 nt, Homo sapiens
acccagaugcucuc

SEQ ID NO: 774137 - RNA, 19 nt, Homo sapiens
acccagauuuccuaacucu

SEQ ID NO: 774138 - RNA, 15 nt, Homo sapiens
acccagcaucuccca

SEQ ID NO: 774139 - RNA, 12 nt, Homo sapiens
acccagccaggc

SEQ ID NO: 774140 - RNA, 18 nt, Homo sapiens
acccagcccagcuugcca

SEQ ID NO: 774141 - RNA, 15 nt, Homo sapiens
acccagcuacucugu

SEQ ID NO: 774142 - RNA, 23 nt, Homo sapiens
acccagcugcagaccaugccaga

SEQ ID NO: 774143 - RNA, 20 nt, Homo sapiens
acccagcuugugccuguggu

SEQ ID NO: 774144 - RNA, 20 nt, Homo sapiens
acccaggacuuccauuugcu

SEQ ID NO: 774145 - RNA, 16 nt, Homo sapiens
acccaggcaugggcag

SEQ ID NO: 774146 - RNA, 16 nt, Homo sapiens
acccaggcugccugag

SEQ ID NO: 774147 - RNA, 20 nt, Homo sapiens
acccaggcuggagugcagug

SEQ ID NO: 774148 - RNA, 16 nt, Homo sapiens
acccagggugugaaca

SEQ ID NO: 774149 - RNA, 12 nt, Homo sapiens
acccagucucau

SEQ ID NO: 774150 - RNA, 13 nt, Homo sapiens
acccagugcagaa

SEQ ID NO: 774151 - RNA, 17 nt, Homo sapiens
acccaguguccuuccau

SEQ ID NO: 774152 - RNA, 14 nt, Homo sapiens
acccauaaccauac

SEQ ID NO: 774153 - RNA, 23 nt, Homo sapiens
acccauaauaagagaauguuccu

SEQ ID NO: 774154 - RNA, 21 nt, Homo sapiens
acccauccgguuugccauguu

SEQ ID NO: 774155 - RNA, 23 nt, Homo sapiens
acccaucggguaagaugcuccug

SEQ ID NO: 774156 - RNA, 23 nt, Homo sapiens
acccaucguccaccccagugugc

SEQ ID NO: 774157 - RNA, 18 nt, Homo sapiens
acccaugagauucauuca

SEQ ID NO: 774158 - RNA, 17 nt, Homo sapiens
acccaugcacaguacaa

SEQ ID NO: 774159 - RNA, 15 nt, Homo sapiens
accccaaagcuuucc

SEQ ID NO: 774160 - RNA, 19 nt, Homo sapiens
accccaaaggaacacugac

SEQ ID NO: 774161 - RNA, 20 nt, Homo sapiens
accccaaaggaacacugaca

SEQ ID NO: 774162 - RNA, 15 nt, Homo sapiens
accccaacacuucca

SEQ ID NO: 774163 - RNA, 14 nt, Homo sapiens
accccaacucuccc

SEQ ID NO: 774164 - RNA, 19 nt, Homo sapiens
accccacacacacuggccu

SEQ ID NO: 774165 - RNA, 20 nt, Homo sapiens
accccacaccugcagugcca

SEQ ID NO: 774166 - RNA, 14 nt, Homo sapiens
accccacauuuuuc

SEQ ID NO: 774167 - RNA, 15 nt, Homo sapiens
accccacgcugacca

SEQ ID NO: 774168 - RNA, 12 nt, Homo sapiens
accccacugagc

SEQ ID NO: 774169 - RNA, 18 nt, Homo sapiens
accccaguggauucucau

SEQ ID NO: 774170 - RNA, 22 nt, Homo sapiens
accccagugguauccugugaca

SEQ ID NO: 774171 - RNA, 12 nt, Homo sapiens
accccaguuuuu

SEQ ID NO: 774172 - RNA, 19 nt, Homo sapiens
acuaauuuauaacuauuau

SEQ ID NO: 774173 - RNA, 15 nt, Homo sapiens
acuaauuuuacaugu

SEQ ID NO: 774174 - RNA, 14 nt, Homo sapiens
acuacaagucagcu

SEQ ID NO: 774175 - RNA, 17 nt, Homo sapiens
acuacaggcucaugcca

SEQ ID NO: 774176 - RNA, 17 nt, Homo sapiens
acuacaguaacugugac

SEQ ID NO: 774177 - RNA, 16 nt, Homo sapiens
acuacauaucuaaagc

SEQ ID NO: 774178 - RNA, 19 nt, Homo sapiens
acuacauuugugaacaaaa

SEQ ID NO: 774179 - RNA, 23 nt, Homo sapiens
acuaccauuccuucuuuaaacac

SEQ ID NO: 774180 - RNA, 18 nt, Homo sapiens
acuaccauucuauuccau

SEQ ID NO: 774181 - RNA, 16 nt, Homo sapiens
acuaccuucaugcaua

SEQ ID NO: 774182 - RNA, 22 nt, Homo sapiens
acuaccuucaugcauagguuua

SEQ ID NO: 774183 - RNA, 14 nt, Homo sapiens
acuacgaaguauaa

SEQ ID NO: 774184 - RNA, 19 nt, Homo sapiens
acuacgguugaucuugcaa

SEQ ID NO: 774185 - RNA, 17 nt, Homo sapiens
acuacuaaugacuuugu

SEQ ID NO: 774186 - RNA, 22 nt, Homo sapiens
acuacuccucugcagugccuug

SEQ ID NO: 774187 - RNA, 21 nt, Homo sapiens
acuacugacauguggggccag

SEQ ID NO: 774188 - RNA, 18 nt, Homo sapiens
acuacugcccacaccaac

SEQ ID NO: 774189 - RNA, 13 nt, Homo sapiens
acuacugcuccug

SEQ ID NO: 774190 - RNA, 17 nt, Homo sapiens
acuacuuuuggugcuua

SEQ ID NO: 774191 - RNA, 15 nt, Homo sapiens
acuagaacucuccau

SEQ ID NO: 774192 - RNA, 17 nt, Homo sapiens
acuagaagcaacuagga

SEQ ID NO: 774193 - RNA, 14 nt, Homo sapiens
acuagaaggcuucu

SEQ ID NO: 774194 - RNA, 16 nt, Homo sapiens
acuagagcggcucuau

SEQ ID NO: 774195 - RNA, 18 nt, Homo sapiens
acuagaggcuugcauaau

SEQ ID NO: 774196 - RNA, 16 nt, Homo sapiens
acuagagucugaacag

SEQ ID NO: 774197 - RNA, 14 nt, Homo sapiens
acuagcauacuuaa

SEQ ID NO: 774198 - RNA, 21 nt, Homo sapiens
acuagccagacaaaauuugag

SEQ ID NO: 774199 - RNA, 22 nt, Homo sapiens
acuagccaggaaguacuuccac

SEQ ID NO: 774200 - RNA, 15 nt, Homo sapiens
acuagccugugauua

SEQ ID NO: 774201 - RNA, 14 nt, Homo sapiens
acuagcuuuugcca

SEQ ID NO: 774202 - RNA, 21 nt, Homo sapiens
acuagcuuuugccaguauuau

SEQ ID NO: 774203 - RNA, 17 nt, Homo sapiens
acuaggcauacacugua

SEQ ID NO: 774204 - RNA, 16 nt, Homo sapiens
acuagggagccauuug

SEQ ID NO: 774205 - RNA, 14 nt, Homo sapiens
acuaggucaaucag

SEQ ID NO: 774206 - RNA, 19 nt, Homo sapiens
acuagucacauucuuguuu

SEQ ID NO: 774207 - RNA, 12 nt, Homo sapiens
acuaguuuccag

SEQ ID NO: 774208 - RNA, 17 nt, Homo sapiens
acuaguuuuuauuccuu

SEQ ID NO: 774209 - RNA, 16 nt, Homo sapiens
acuauaaagcuguuau

SEQ ID NO: 774210 - RNA, 17 nt, Homo sapiens
acuauaaagcuguuauu

SEQ ID NO: 774211 - RNA, 17 nt, Homo sapiens
acuauaacaaucacugg

SEQ ID NO: 774212 - RNA, 12 nt, Homo sapiens
acuauaaguaau

SEQ ID NO: 774213 - RNA, 18 nt, Homo sapiens
acuauaauguaagcucua

SEQ ID NO: 774214 - RNA, 17 nt, Homo sapiens
acuauaauuugacuuga

SEQ ID NO: 774215 - RNA, 16 nt, Homo sapiens
acuauaccugcuucag

SEQ ID NO: 774216 - RNA, 12 nt, Homo sapiens
acuauacuugau

SEQ ID NO: 774217 - RNA, 16 nt, Homo sapiens
acuauauucucagugu

SEQ ID NO: 774218 - RNA, 21 nt, Homo sapiens
acuaucaauaauacaaagcaa

SEQ ID NO: 774219 - RNA, 22 nt, Homo sapiens
acuaucaauaauacaaagcaaa

SEQ ID NO: 774220 - RNA, 15 nt, Homo sapiens
acuaucccaaucaaa

SEQ ID NO: 774221 - RNA, 17 nt, Homo sapiens
acuauccugauuccaaa

SEQ ID NO: 774222 - RNA, 21 nt, Homo sapiens
acuaucugaagauuuccauuu

SEQ ID NO: 774223 - RNA, 15 nt, Homo sapiens
acuaucuuugcugca

SEQ ID NO: 774224 - RNA, 22 nt, Homo sapiens
acuaucuuuuugaaagcaauau

SEQ ID NO: 774225 - RNA, 23 nt, Homo sapiens
acuaugagccaggcaucauacua

SEQ ID NO: 774226 - RNA, 13 nt, Homo sapiens
acuaugaucacag

SEQ ID NO: 774227 - RNA, 14 nt, Homo sapiens
acuauggagccugg

SEQ ID NO: 774228 - RNA, 21 nt, Homo sapiens
acuauggagcugagcaggugu

SEQ ID NO: 774229 - RNA, 17 nt, Homo sapiens
acuaugguucccaauaa

SEQ ID NO: 774230 - RNA, 21 nt, Homo sapiens
acuauguggcugaaaaugcaa

SEQ ID NO: 774231 - RNA, 22 nt, Homo sapiens
acuauguuucucagauuccuuu

SEQ ID NO: 774232 - RNA, 20 nt, Homo sapiens
acuauuaagcaagaaugcag

SEQ ID NO: 774233 - RNA, 15 nt, Homo sapiens
acuauucaaacaguc

SEQ ID NO: 774234 - RNA, 16 nt, Homo sapiens
acuauucacugaugca

SEQ ID NO: 774235 - RNA, 21 nt, Homo sapiens
acuauugaaguugcagauuca

SEQ ID NO: 774236 - RNA, 18 nt, Homo sapiens
acuauuuagauauaacac

SEQ ID NO: 774237 - RNA, 15 nt, Homo sapiens
acuauuuaguggaac

SEQ ID NO: 774238 - RNA, 22 nt, Homo sapiens
acuauuuauaucacacaauaua

SEQ ID NO: 774239 - RNA, 15 nt, Homo sapiens
acuauuuucaaagaa

SEQ ID NO: 774240 - RNA, 18 nt, Homo sapiens
acuauuuucaaagacuua

SEQ ID NO: 774241 - RNA, 21 nt, Homo sapiens
acucaaaaauccuaacauuca

SEQ ID NO: 774242 - RNA, 14 nt, Homo sapiens
acucaaaagagaga

SEQ ID NO: 774243 - RNA, 17 nt, Homo sapiens
acucaaacagucuuucu

SEQ ID NO: 774244 - RNA, 19 nt, Homo sapiens
acucaacccauuguuguca

SEQ ID NO: 774245 - RNA, 12 nt, Homo sapiens
acucaacuuuca

SEQ ID NO: 774246 - RNA, 19 nt, Homo sapiens
acucaagaggcugaggcag

SEQ ID NO: 774247 - RNA, 17 nt, Homo sapiens
acucaaggcuugaguca

SEQ ID NO: 774248 - RNA, 11 nt, Homo sapiens
acucacacugg

SEQ ID NO: 774249 - RNA, 16 nt, Homo sapiens
acucacacuggccaca

SEQ ID NO: 774250 - RNA, 15 nt, Homo sapiens
acucacagucucuuu

SEQ ID NO: 774251 - RNA, 18 nt, Homo sapiens
acucacauggacccaaga

SEQ ID NO: 774252 - RNA, 16 nt, Homo sapiens
acucaccaacuugcca

SEQ ID NO: 774253 - RNA, 21 nt, Homo sapiens
acucaccagccccacugccag

SEQ ID NO: 774254 - RNA, 12 nt, Homo sapiens
acucacccaagc

SEQ ID NO: 774255 - RNA, 15 nt, Homo sapiens
acucaccccuagccc

SEQ ID NO: 774256 - RNA, 19 nt, Homo sapiens
acucacccucauaccaucu

SEQ ID NO: 774257 - RNA, 16 nt, Homo sapiens
acucaccugcacuaac

SEQ ID NO: 774258 - RNA, 15 nt, Homo sapiens
acucacuaugaaggu

SEQ ID NO: 774259 - RNA, 23 nt, Homo sapiens
acucacuaugaagguaaagggag

SEQ ID NO: 774260 - RNA, 23 nt, Homo sapiens
acucacugcugcaaauacuguau

SEQ ID NO: 774261 - RNA, 20 nt, Homo sapiens
acucacuuaucccaagagaa

SEQ ID NO: 774262 - RNA, 17 nt, Homo sapiens
acucacuucucuuuuua

SEQ ID NO: 774263 - RNA, 18 nt, Homo sapiens
acucagaaacuccaugau

SEQ ID NO: 774264 - RNA, 20 nt, Homo sapiens
acucagaaauguaguuugca

SEQ ID NO: 774265 - RNA, 19 nt, Homo sapiens
acucagaacucuccaggga

SEQ ID NO: 774266 - RNA, 14 nt, Homo sapiens
acucagagacuuca

SEQ ID NO: 774267 - RNA, 15 nt, Homo sapiens
acucagagcagauga

SEQ ID NO: 774268 - RNA, 17 nt, Homo sapiens
acucagagcucucucua

SEQ ID NO: 774269 - RNA, 16 nt, Homo sapiens
acucagaucugaucaa

SEQ ID NO: 774270 - RNA, 21 nt, Homo sapiens
acucagauuuaagccuuacaa

SEQ ID NO: 774271 - RNA, 16 nt, Homo sapiens
acucagcaguugacau

SEQ ID NO: 774272 - RNA, 14 nt, Homo sapiens
acucagcccagcug

SEQ ID NO: 774273 - RNA, 17 nt, Homo sapiens
acucaggcuuucacuau

SEQ ID NO: 774274 - RNA, 17 nt, Homo sapiens
acucagggagcauuuaa

SEQ ID NO: 774275 - RNA, 16 nt, Homo sapiens
acucaguaauuucaaa

SEQ ID NO: 774276 - RNA, 18 nt, Homo sapiens
acucagucucucuucucu

SEQ ID NO: 774277 - RNA, 11 nt, Homo sapiens
acucagugcag

SEQ ID NO: 774278 - RNA, 17 nt, Homo sapiens
acucagugcagcaauau

SEQ ID NO: 774279 - RNA, 12 nt, Homo sapiens
acucagugcuaa

SEQ ID NO: 774280 - RNA, 11 nt, Homo sapiens
acucaguucca

SEQ ID NO: 774281 - RNA, 17 nt, Homo sapiens
acucaguucgaccaaac

SEQ ID NO: 774282 - RNA, 22 nt, Homo sapiens
acucaguuugucagacuuuaaa

SEQ ID NO: 774283 - RNA, 20 nt, Homo sapiens
acucauacacaugugcacac

SEQ ID NO: 774284 - RNA, 16 nt, Homo sapiens
acucauauucugggcu

SEQ ID NO: 774285 - RNA, 21 nt, Homo sapiens
acucaucaauggggccaguca

SEQ ID NO: 774286 - RNA, 17 nt, Homo sapiens
acucaucuuagugccug

SEQ ID NO: 774287 - RNA, 16 nt, Homo sapiens
agcccugcaccaugcu

SEQ ID NO: 774288 - RNA, 17 nt, Homo sapiens
agcccugcaccaugcug

SEQ ID NO: 774289 - RNA, 14 nt, Homo sapiens
agcccugcagugug

SEQ ID NO: 774290 - RNA, 21 nt, Homo sapiens
agcccugggccccaccaccua

SEQ ID NO: 774291 - RNA, 16 nt, Homo sapiens
agcccuguguguguca

SEQ ID NO: 774292 - RNA, 17 nt, Homo sapiens
agcccuuauguuuaauc

SEQ ID NO: 774293 - RNA, 18 nt, Homo sapiens
agcccuucacugccauga

SEQ ID NO: 774294 - RNA, 21 nt, Homo sapiens
agcccuuccuaccucugguga

SEQ ID NO: 774295 - RNA, 16 nt, Homo sapiens
agcccuucuauaccca

SEQ ID NO: 774296 - RNA, 20 nt, Homo sapiens
agcccuuuuuguacugauau

SEQ ID NO: 774297 - RNA, 15 nt, Homo sapiens
agccgaaaagcuuuu

SEQ ID NO: 774298 - RNA, 13 nt, Homo sapiens
agccgaccucagc

SEQ ID NO: 774299 - RNA, 21 nt, Homo sapiens
agccgagauugcgccacugca

SEQ ID NO: 774300 - RNA, 16 nt, Homo sapiens
agccgaggccuacccc

SEQ ID NO: 774301 - RNA, 15 nt, Homo sapiens
agccgccauugccac

SEQ ID NO: 774302 - RNA, 21 nt, Homo sapiens
agccgcgggcgcucgcucagg

SEQ ID NO: 774303 - RNA, 15 nt, Homo sapiens
agccggccacuuugg

SEQ ID NO: 774304 - RNA, 18 nt, Homo sapiens
agccgggcacaguggcgc

SEQ ID NO: 774305 - RNA, 20 nt, Homo sapiens
agccgguggugcccgugccc

SEQ ID NO: 774306 - RNA, 14 nt, Homo sapiens
agccgugaugcuca

SEQ ID NO: 774307 - RNA, 20 nt, Homo sapiens
agccuaaaguauacaacugc

SEQ ID NO: 774308 - RNA, 18 nt, Homo sapiens
agccuaaaugauggugcu

SEQ ID NO: 774309 - RNA, 12 nt, Homo sapiens
agccuaacacgg

SEQ ID NO: 774310 - RNA, 21 nt, Homo sapiens
agccuaagaauaugaucaggu

SEQ ID NO: 774311 - RNA, 14 nt, Homo sapiens
agccuaaggcugua

SEQ ID NO: 774312 - RNA, 15 nt, Homo sapiens
agccuacagaugaac

SEQ ID NO: 774313 - RNA, 13 nt, Homo sapiens
agccuacauucac

SEQ ID NO: 774314 - RNA, 16 nt, Homo sapiens
agccuagccgaccuca

SEQ ID NO: 774315 - RNA, 18 nt, Homo sapiens
agccuagccgaccucagc

SEQ ID NO: 774316 - RNA, 20 nt, Homo sapiens
agccucagaagaaaacaaag

SEQ ID NO: 774317 - RNA, 15 nt, Homo sapiens
agccucagugccacu

SEQ ID NO: 774318 - RNA, 12 nt, Homo sapiens
agccucauuuga

SEQ ID NO: 774319 - RNA, 12 nt, Homo sapiens
agccuccacugc

SEQ ID NO: 774320 - RNA, 23 nt, Homo sapiens
agccuccagcaccuucccucuca

SEQ ID NO: 774321 - RNA, 19 nt, Homo sapiens
agccucccaaguagcugag

SEQ ID NO: 774322 - RNA, 19 nt, Homo sapiens
agccuccccgugccaaaaa

SEQ ID NO: 774323 - RNA, 16 nt, Homo sapiens
agccucccgaaugaag

SEQ ID NO: 774324 - RNA, 21 nt, Homo sapiens
agccucguuggagagcagcag

SEQ ID NO: 774325 - RNA, 12 nt, Homo sapiens
agccucugccag

SEQ ID NO: 774326 - RNA, 18 nt, Homo sapiens
agccucuucucugaugac

SEQ ID NO: 774327 - RNA, 22 nt, Homo sapiens
agccucuugacgcuggaagugu

SEQ ID NO: 774328 - RNA, 13 nt, Homo sapiens
agccugaacacuc

SEQ ID NO: 774329 - RNA, 17 nt, Homo sapiens
agccugagcagagacau

SEQ ID NO: 774330 - RNA, 17 nt, Homo sapiens
agccugauauugauaug

SEQ ID NO: 774331 - RNA, 12 nt, Homo sapiens
agccugcacagu

SEQ ID NO: 774332 - RNA, 13 nt, Homo sapiens
agccugcacuggg

SEQ ID NO: 774333 - RNA, 18 nt, Homo sapiens
agccugcagaauccagcu

SEQ ID NO: 774334 - RNA, 13 nt, Homo sapiens
agccugcagggaa

SEQ ID NO: 774335 - RNA, 12 nt, Homo sapiens
agccugccaaau

SEQ ID NO: 774336 - RNA, 12 nt, Homo sapiens
agccugccaaga

SEQ ID NO: 774337 - RNA, 18 nt, Homo sapiens
agccugcucuaaggcagu

SEQ ID NO: 774338 - RNA, 15 nt, Homo sapiens
agccugcuguuucca

SEQ ID NO: 774339 - RNA, 21 nt, Homo sapiens
agccuggaaaaaaacaucaga

SEQ ID NO: 774340 - RNA, 15 nt, Homo sapiens
agccuggacugcuac

SEQ ID NO: 774341 - RNA, 13 nt, Homo sapiens
agccuggccagac

SEQ ID NO: 774342 - RNA, 20 nt, Homo sapiens
agccuggccagacacaggcc

SEQ ID NO: 774343 - RNA, 16 nt, Homo sapiens
agccugggcaacaaga

SEQ ID NO: 774344 - RNA, 19 nt, Homo sapiens
agccuggggaacagagcaa

SEQ ID NO: 774345 - RNA, 22 nt, Homo sapiens
agccuggggugaccucuagagc

SEQ ID NO: 774346 - RNA, 12 nt, Homo sapiens
agccuggugggc

SEQ ID NO: 774347 - RNA, 16 nt, Homo sapiens
agccugugcaaugcau

SEQ ID NO: 774348 - RNA, 15 nt, Homo sapiens
agccuuaauuugcac

SEQ ID NO: 774349 - RNA, 20 nt, Homo sapiens
agccuuaauuugcacagugu

SEQ ID NO: 774350 - RNA, 21 nt, Homo sapiens
agccuuagccaggaggccagg

SEQ ID NO: 774351 - RNA, 21 nt, Homo sapiens
agccuuauuucuagaagcaca

SEQ ID NO: 774352 - RNA, 17 nt, Homo sapiens
agccuucaagugccaaa

SEQ ID NO: 774353 - RNA, 19 nt, Homo sapiens
agccuucagcagcagcuca

SEQ ID NO: 774354 - RNA, 15 nt, Homo sapiens
agccuuccacaguga

SEQ ID NO: 774355 - RNA, 16 nt, Homo sapiens
agccuugagagaccca

SEQ ID NO: 774356 - RNA, 17 nt, Homo sapiens
agccuugcugggccagg

SEQ ID NO: 774357 - RNA, 15 nt, Homo sapiens
agccuuggccucaga

SEQ ID NO: 774358 - RNA, 22 nt, Homo sapiens
agccuugucuucuuagcuguca

SEQ ID NO: 774359 - RNA, 21 nt, Homo sapiens
agccuuuuuaaaacacauguu

SEQ ID NO: 774360 - RNA, 24 nt, Homo sapiens
agcgaagaugauuucaguucauca

SEQ ID NO: 774361 - RNA, 14 nt, Homo sapiens
agcgaaucucugcc

SEQ ID NO: 774362 - RNA, 18 nt, Homo sapiens
agcgaugaauuuggagac

SEQ ID NO: 774363 - RNA, 14 nt, Homo sapiens
agcgcaugugugca

SEQ ID NO: 774364 - RNA, 20 nt, Homo sapiens
agcgcauugagccaguggug

SEQ ID NO: 774365 - RNA, 21 nt, Homo sapiens
agcgccaaaacaagccaaaga

SEQ ID NO: 774366 - RNA, 19 nt, Homo sapiens
agcgccuuuccugccaugu

SEQ ID NO: 774367 - RNA, 11 nt, Homo sapiens
agcgcucuccu

SEQ ID NO: 774368 - RNA, 20 nt, Homo sapiens
agcgcuucugcaccaacuca

SEQ ID NO: 774369 - RNA, 15 nt, Homo sapiens
agcggauugcucugg

SEQ ID NO: 774370 - RNA, 22 nt, Homo sapiens
agcggccccccgcacagccacc

SEQ ID NO: 774371 - RNA, 22 nt, Homo sapiens
agcggcccugucauccagcuca

SEQ ID NO: 774372 - RNA, 19 nt, Homo sapiens
agcggcuguuuacugcuuu

SEQ ID NO: 774373 - RNA, 15 nt, Homo sapiens
agcgggcacagggca

SEQ ID NO: 774374 - RNA, 17 nt, Homo sapiens
agcguagcuaagugaaa

SEQ ID NO: 774375 - RNA, 15 nt, Homo sapiens
agcgucaagacauuu

SEQ ID NO: 774376 - RNA, 15 nt, Homo sapiens
agcgucccagucucu

SEQ ID NO: 774377 - RNA, 18 nt, Homo sapiens
agcgucccuagcagugaa

SEQ ID NO: 774378 - RNA, 12 nt, Homo sapiens
agcgucuuggcu

SEQ ID NO: 774379 - RNA, 20 nt, Homo sapiens
agcgugggacccuucagcca

SEQ ID NO: 774380 - RNA, 16 nt, Homo sapiens
agcguguggagcagag

SEQ ID NO: 774381 - RNA, 14 nt, Homo sapiens
agcuaaaaaugaac

SEQ ID NO: 774382 - RNA, 19 nt, Homo sapiens
agcuaaaauguuacucccu

SEQ ID NO: 774383 - RNA, 20 nt, Homo sapiens
agcuaaccccaagcugccuc

SEQ ID NO: 774384 - RNA, 20 nt, Homo sapiens
agcuaacccucacaagcaug

SEQ ID NO: 774385 - RNA, 18 nt, Homo sapiens
agcuaagccacauggcug

SEQ ID NO: 774386 - RNA, 15 nt, Homo sapiens
agcuaauguaauaac

SEQ ID NO: 774387 - RNA, 22 nt, Homo sapiens
agcuaauguaauaacugugaag

SEQ ID NO: 774388 - RNA, 17 nt, Homo sapiens
agcuaauuaaacacauu

SEQ ID NO: 774389 - RNA, 16 nt, Homo sapiens
agcuacaggacauuuu

SEQ ID NO: 774390 - RNA, 21 nt, Homo sapiens
agcuacagucuaaaauugcuu

SEQ ID NO: 774391 - RNA, 23 nt, Homo sapiens
agcuaccagguguucuacacuca

SEQ ID NO: 774392 - RNA, 21 nt, Homo sapiens
agcuaccucaaacuuccaguc

SEQ ID NO: 774393 - RNA, 22 nt, Homo sapiens
agcuaccugcucagcccugcac

SEQ ID NO: 774394 - RNA, 13 nt, Homo sapiens
agcuacuaaugau

SEQ ID NO: 774395 - RNA, 14 nt, Homo sapiens
agcuacucucccca

SEQ ID NO: 774396 - RNA, 19 nt, Homo sapiens
agcuacuucaaauguggua

SEQ ID NO: 774397 - RNA, 22 nt, Homo sapiens
agcuacuugggaggcugagcca

SEQ ID NO: 774398 - RNA, 23 nt, Homo sapiens
agcuagaggacuucuggcaggga

SEQ ID NO: 774399 - RNA, 18 nt, Homo sapiens
agcuagcacuaacucgug

SEQ ID NO: 774400 - RNA, 20 nt, Homo sapiens
agcuaggaagagcaggacuc

SEQ ID NO: 774401 - RNA, 13 nt, Homo sapiens
agcuagugccuuu

SEQ ID NO: 774402 - RNA, 16 nt, Homo sapiens
aggauauuuucuucca

SEQ ID NO: 774403 - RNA, 19 nt, Homo sapiens
aggaucaguugaggccagg

SEQ ID NO: 774404 - RNA, 12 nt, Homo sapiens
aggaucaucucu

SEQ ID NO: 774405 - RNA, 16 nt, Homo sapiens
aggaucuuugacugaa

SEQ ID NO: 774406 - RNA, 17 nt, Homo sapiens
aggaugacaaaauggaa

SEQ ID NO: 774407 - RNA, 12 nt, Homo sapiens
aggaugagcugg

SEQ ID NO: 774408 - RNA, 12 nt, Homo sapiens
aggaugcacauu

SEQ ID NO: 774409 - RNA, 23 nt, Homo sapiens
aggaugcggaaggauugcaaugc

SEQ ID NO: 774410 - RNA, 18 nt, Homo sapiens
aggauggccuggaaccca

SEQ ID NO: 774411 - RNA, 14 nt, Homo sapiens
aggauggcucagac

SEQ ID NO: 774412 - RNA, 13 nt, Homo sapiens
aggauggcuugag

SEQ ID NO: 774413 - RNA, 23 nt, Homo sapiens
aggaugguagaaguuuggcugcu

SEQ ID NO: 774414 - RNA, 17 nt, Homo sapiens
aggauuaaaucugguca

SEQ ID NO: 774415 - RNA, 22 nt, Homo sapiens
aggauuaauaaagauggcacuu

SEQ ID NO: 774416 - RNA, 21 nt, Homo sapiens
aggauucauaaucacaaauau

SEQ ID NO: 774417 - RNA, 22 nt, Homo sapiens
aggauugaaaauguccaggaaa

SEQ ID NO: 774418 - RNA, 13 nt, Homo sapiens
aggauugcaaugc

SEQ ID NO: 774419 - RNA, 14 nt, Homo sapiens
aggauuuuaccaaa

SEQ ID NO: 774420 - RNA, 19 nt, Homo sapiens
aggcaaaguacauuguaaa

SEQ ID NO: 774421 - RNA, 19 nt, Homo sapiens
aggcaaaguuuacagaugu

SEQ ID NO: 774422 - RNA, 12 nt, Homo sapiens
aggcaacacugg

SEQ ID NO: 774423 - RNA, 15 nt, Homo sapiens
aggcaaccagaggaa

SEQ ID NO: 774424 - RNA, 21 nt, Homo sapiens
aggcaacugugaguccgggaa

SEQ ID NO: 774425 - RNA, 19 nt, Homo sapiens
aggcaagccccucagcccu

SEQ ID NO: 774426 - RNA, 20 nt, Homo sapiens
aggcaagcugaaauuuuaga

SEQ ID NO: 774427 - RNA, 15 nt, Homo sapiens
aggcaaggaugucug

SEQ ID NO: 774428 - RNA, 22 nt, Homo sapiens
aggcaagguuggcgacugucau

SEQ ID NO: 774429 - RNA, 19 nt, Homo sapiens
aggcaagguuuacacugcg

SEQ ID NO: 774430 - RNA, 15 nt, Homo sapiens
aggcaauguacucuu

SEQ ID NO: 774431 - RNA, 21 nt, Homo sapiens
aggcaauuucaccaccaaaug

SEQ ID NO: 774432 - RNA, 13 nt, Homo sapiens
aggcaccaggaag

SEQ ID NO: 774433 - RNA, 19 nt, Homo sapiens
aggcacccaccaccaugcc

SEQ ID NO: 774434 - RNA, 23 nt, Homo sapiens
aggcacccgcccuuuccuugccu

SEQ ID NO: 774435 - RNA, 13 nt, Homo sapiens
aggcacucauggg

SEQ ID NO: 774436 - RNA, 20 nt, Homo sapiens
aggcacuguaguucuaagac

SEQ ID NO: 774437 - RNA, 16 nt, Homo sapiens
aggcagacuugcagag

SEQ ID NO: 774438 - RNA, 16 nt, Homo sapiens
aggcagagaaucauac

SEQ ID NO: 774439 - RNA, 13 nt, Homo sapiens
aggcagagccuga

SEQ ID NO: 774440 - RNA, 12 nt, Homo sapiens
aggcagaucugu

SEQ ID NO: 774441 - RNA, 14 nt, Homo sapiens
aggcagcaccugau

SEQ ID NO: 774442 - RNA, 20 nt, Homo sapiens
aggcagcagugagcuaugau

SEQ ID NO: 774443 - RNA, 20 nt, Homo sapiens
aggcagcagugucuguaccu

SEQ ID NO: 774444 - RNA, 19 nt, Homo sapiens
aggcagcuggaugagacuu

SEQ ID NO: 774445 - RNA, 18 nt, Homo sapiens
aggcagcugucacugcug

SEQ ID NO: 774446 - RNA, 17 nt, Homo sapiens
aggcaggagaaucucuu

SEQ ID NO: 774447 - RNA, 20 nt, Homo sapiens
aggcaggaggauugcuugag

SEQ ID NO: 774448 - RNA, 18 nt, Homo sapiens
aggcagggagugucugca

SEQ ID NO: 774449 - RNA, 18 nt, Homo sapiens
aggcagggcaaaugacau

SEQ ID NO: 774450 - RNA, 15 nt, Homo sapiens
aggcaggugggcucg

SEQ ID NO: 774451 - RNA, 12 nt, Homo sapiens
aggcaguggcaa

SEQ ID NO: 774452 - RNA, 20 nt, Homo sapiens
aggcaucauacuaaacuuca

SEQ ID NO: 774453 - RNA, 14 nt, Homo sapiens
aggcauccaggcca

SEQ ID NO: 774454 - RNA, 16 nt, Homo sapiens
aggcaucuacacagcc

SEQ ID NO: 774455 - RNA, 23 nt, Homo sapiens
aggcaugauggcccauacuugua

SEQ ID NO: 774456 - RNA, 21 nt, Homo sapiens
aggcauggcuggggugggggu

SEQ ID NO: 774457 - RNA, 15 nt, Homo sapiens
aggcaugggugcaag

SEQ ID NO: 774458 - RNA, 11 nt, Homo sapiens
aggcauucucu

SEQ ID NO: 774459 - RNA, 18 nt, Homo sapiens
aggcauuuggucucacua

SEQ ID NO: 774460 - RNA, 20 nt, Homo sapiens
aggccaagcccaauacagcc

SEQ ID NO: 774461 - RNA, 15 nt, Homo sapiens
aggccaccuaugcca

SEQ ID NO: 774462 - RNA, 14 nt, Homo sapiens
aggccaccucugcc

SEQ ID NO: 774463 - RNA, 14 nt, Homo sapiens
aggccacugugagc

SEQ ID NO: 774464 - RNA, 16 nt, Homo sapiens
aggccagcaggggcuu

SEQ ID NO: 774465 - RNA, 20 nt, Homo sapiens
aggccaggcacuguggcuca

SEQ ID NO: 774466 - RNA, 20 nt, Homo sapiens
aggccaggugcaguggcuca

SEQ ID NO: 774467 - RNA, 17 nt, Homo sapiens
aggccaguaugauuuau

SEQ ID NO: 774468 - RNA, 14 nt, Homo sapiens
aggccagugccagc

SEQ ID NO: 774469 - RNA, 19 nt, Homo sapiens
aggccagugccagcaccug

SEQ ID NO: 774470 - RNA, 17 nt, Homo sapiens
aggccagugggacccca

SEQ ID NO: 774471 - RNA, 21 nt, Homo sapiens
aggccagugggaccccacaga

SEQ ID NO: 774472 - RNA, 17 nt, Homo sapiens
aggcccaaaugauggau

SEQ ID NO: 774473 - RNA, 14 nt, Homo sapiens
aggcccaacauuaa

SEQ ID NO: 774474 - RNA, 14 nt, Homo sapiens
aggcccaacuguga

SEQ ID NO: 774475 - RNA, 12 nt, Homo sapiens
aggcccaucuca

SEQ ID NO: 774476 - RNA, 19 nt, Homo sapiens
aggccccagccucccugaa

SEQ ID NO: 774477 - RNA, 16 nt, Homo sapiens
aggcccccacuugccu

SEQ ID NO: 774478 - RNA, 17 nt, Homo sapiens
aggcccccacuugccuc

SEQ ID NO: 774479 - RNA, 20 nt, Homo sapiens
aggcccuugucgugggaugg

SEQ ID NO: 774480 - RNA, 23 nt, Homo sapiens
aggccggaaaaggcgcaucuaac

SEQ ID NO: 774481 - RNA, 22 nt, Homo sapiens
aggccgggcgcaguggcucacg

SEQ ID NO: 774482 - RNA, 20 nt, Homo sapiens
aggccgggcgcgguggcuca

SEQ ID NO: 774483 - RNA, 23 nt, Homo sapiens
aggccgugcaguggcugugccac

SEQ ID NO: 774484 - RNA, 13 nt, Homo sapiens
aggccgugugucu

SEQ ID NO: 774485 - RNA, 22 nt, Homo sapiens
aggccguugguugucugaagag

SEQ ID NO: 774486 - RNA, 12 nt, Homo sapiens
aggccucaagaa

SEQ ID NO: 774487 - RNA, 16 nt, Homo sapiens
aggccucaagaacaaa

SEQ ID NO: 774488 - RNA, 20 nt, Homo sapiens
aggccuccagccccaugugu

SEQ ID NO: 774489 - RNA, 22 nt, Homo sapiens
aggccuccagccccauguguga

SEQ ID NO: 774490 - RNA, 23 nt, Homo sapiens
aggccugagauuucaucugcucu

SEQ ID NO: 774491 - RNA, 19 nt, Homo sapiens
aggccugagcgagugucca

SEQ ID NO: 774492 - RNA, 15 nt, Homo sapiens
aggccugaggaugag

SEQ ID NO: 774493 - RNA, 14 nt, Homo sapiens
aggccuggacuuuc

SEQ ID NO: 774494 - RNA, 13 nt, Homo sapiens
aggccugugcugc

SEQ ID NO: 774495 - RNA, 16 nt, Homo sapiens
aggccuguggggagcc

SEQ ID NO: 774496 - RNA, 18 nt, Homo sapiens
aggccuuaacuuucccau

SEQ ID NO: 774497 - RNA, 17 nt, Homo sapiens
aggcgccuauaauccca

SEQ ID NO: 774498 - RNA, 16 nt, Homo sapiens
aggcggggcccagcgc

SEQ ID NO: 774499 - RNA, 22 nt, Homo sapiens
aggcggucaugugugcauguga

SEQ ID NO: 774500 - RNA, 15 nt, Homo sapiens
aggcgucaccaucca

SEQ ID NO: 774501 - RNA, 17 nt, Homo sapiens
aggcgugggacgugguc

SEQ ID NO: 774502 - RNA, 14 nt, Homo sapiens
aggcguucuucgag

SEQ ID NO: 774503 - RNA, 22 nt, Homo sapiens
aggcuaaaacaccuuggcuugu

SEQ ID NO: 774504 - RNA, 12 nt, Homo sapiens
aggcuaagcaug

SEQ ID NO: 774505 - RNA, 13 nt, Homo sapiens
aggcuaccucaag

SEQ ID NO: 774506 - RNA, 15 nt, Homo sapiens
aggcuaccucaagac

SEQ ID NO: 774507 - RNA, 17 nt, Homo sapiens
aggcuaccucaccuggg

SEQ ID NO: 774508 - RNA, 19 nt, Homo sapiens
aggcuacuaccuagggcac

SEQ ID NO: 774509 - RNA, 20 nt, Homo sapiens
aggcuacucauucaguccca

SEQ ID NO: 774510 - RNA, 21 nt, Homo sapiens
aggcuagaacacuacagggga

SEQ ID NO: 774511 - RNA, 19 nt, Homo sapiens
aggcuaugggguaggagaa

SEQ ID NO: 774512 - RNA, 21 nt, Homo sapiens
aggcuauguaaacaaaccaca

SEQ ID NO: 774513 - RNA, 15 nt, Homo sapiens
aggcucacacugugc

SEQ ID NO: 774514 - RNA, 19 nt, Homo sapiens
aggcucacugcaacuucug

SEQ ID NO: 774515 - RNA, 21 nt, Homo sapiens
aggcucggaggacccuggaaa

SEQ ID NO: 774516 - RNA, 16 nt, Homo sapiens
aggcucuagaucauaa

SEQ ID NO: 774517 - RNA, 16 nt, Homo sapiens
aguaugguauuacaaa

SEQ ID NO: 774518 - RNA, 21 nt, Homo sapiens
aguauguccccauaagacaaa

SEQ ID NO: 774519 - RNA, 19 nt, Homo sapiens
aguauguuuguacaguaug

SEQ ID NO: 774520 - RNA, 13 nt, Homo sapiens
aguauuacagugu

SEQ ID NO: 774521 - RNA, 16 nt, Homo sapiens
aguauuaucacugcug

SEQ ID NO: 774522 - RNA, 16 nt, Homo sapiens
aguauuccuaaccugu

SEQ ID NO: 774523 - RNA, 18 nt, Homo sapiens
aguauucuuaguuguuca

SEQ ID NO: 774524 - RNA, 16 nt, Homo sapiens
aguauugguguaugua

SEQ ID NO: 774525 - RNA, 17 nt, Homo sapiens
aguauugucgguuaccu

SEQ ID NO: 774526 - RNA, 16 nt, Homo sapiens
aguauuuagaagccaa

SEQ ID NO: 774527 - RNA, 20 nt, Homo sapiens
aguauuuagaagccaacuau

SEQ ID NO: 774528 - RNA, 22 nt, Homo sapiens
aguauuuauugcaggauggugu

SEQ ID NO: 774529 - RNA, 14 nt, Homo sapiens
aguauuucucagga

SEQ ID NO: 774530 - RNA, 22 nt, Homo sapiens
aguauuugcugaauggggaccu

SEQ ID NO: 774531 - RNA, 23 nt, Homo sapiens
aguauuuggaauuagaacccuug

SEQ ID NO: 774532 - RNA, 20 nt, Homo sapiens
aguauuuuccuaagcacaaa

SEQ ID NO: 774533 - RNA, 15 nt, Homo sapiens
aguauuuuucuugac

SEQ ID NO: 774534 - RNA, 15 nt, Homo sapiens
aguauuuuuucaagu

SEQ ID NO: 774535 - RNA, 22 nt, Homo sapiens
agucaaaacagagaugugauaa

SEQ ID NO: 774536 - RNA, 16 nt, Homo sapiens
agucaacgccucggug

SEQ ID NO: 774537 - RNA, 15 nt, Homo sapiens
agucaauuucuacuu

SEQ ID NO: 774538 - RNA, 20 nt, Homo sapiens
agucacacacacauacaaaa

SEQ ID NO: 774539 - RNA, 16 nt, Homo sapiens
agucacagcuacacag

SEQ ID NO: 774540 - RNA, 22 nt, Homo sapiens
agucacauggccuaugcacaua

SEQ ID NO: 774541 - RNA, 12 nt, Homo sapiens
agucaccaaaua

SEQ ID NO: 774542 - RNA, 21 nt, Homo sapiens
agucacccggcccccaugcaa

SEQ ID NO: 774543 - RNA, 22 nt, Homo sapiens
agucaccuauccacccucugca

SEQ ID NO: 774544 - RNA, 23 nt, Homo sapiens
agucaccuauccacccucugcau

SEQ ID NO: 774545 - RNA, 16 nt, Homo sapiens
agucacgcaugcagug

SEQ ID NO: 774546 - RNA, 21 nt, Homo sapiens
agucacggcugcgcacugugu

SEQ ID NO: 774547 - RNA, 16 nt, Homo sapiens
agucacugaacaaaac

SEQ ID NO: 774548 - RNA, 23 nt, Homo sapiens
agucacuggagguugaagccaag

SEQ ID NO: 774549 - RNA, 16 nt, Homo sapiens
agucacuuauugucca

SEQ ID NO: 774550 - RNA, 22 nt, Homo sapiens
agucagacuuuguguucauuuc

SEQ ID NO: 774551 - RNA, 21 nt, Homo sapiens
agucagauccuguuacuugcu

SEQ ID NO: 774552 - RNA, 19 nt, Homo sapiens
agucagcccuuauggccaa

SEQ ID NO: 774553 - RNA, 15 nt, Homo sapiens
agucaggcuucucuu

SEQ ID NO: 774554 - RNA, 23 nt, Homo sapiens
agucaggggucaggugucaggcc

SEQ ID NO: 774555 - RNA, 13 nt, Homo sapiens
agucagucucuug

SEQ ID NO: 774556 - RNA, 17 nt, Homo sapiens
agucagugacagccccu

SEQ ID NO: 774557 - RNA, 18 nt, Homo sapiens
agucagugaggaguaaaa

SEQ ID NO: 774558 - RNA, 13 nt, Homo sapiens
agucaucaaagau

SEQ ID NO: 774559 - RNA, 16 nt, Homo sapiens
agucaucucauuccac

SEQ ID NO: 774560 - RNA, 15 nt, Homo sapiens
agucaugcaucucag

SEQ ID NO: 774561 - RNA, 17 nt, Homo sapiens
agucauggcuaauuuaa

SEQ ID NO: 774562 - RNA, 19 nt, Homo sapiens
agucauuaugagaggcaau

SEQ ID NO: 774563 - RNA, 13 nt, Homo sapiens
agucauucuagga

SEQ ID NO: 774564 - RNA, 19 nt, Homo sapiens
agucauuugcugagcaugu

SEQ ID NO: 774565 - RNA, 21 nt, Homo sapiens
aguccaagaggguccuuuagu

SEQ ID NO: 774566 - RNA, 23 nt, Homo sapiens
aguccaccucccauuacuuugau

SEQ ID NO: 774567 - RNA, 16 nt, Homo sapiens
aguccaccugaggaac

SEQ ID NO: 774568 - RNA, 21 nt, Homo sapiens
aguccacuuguucuguacuug

SEQ ID NO: 774569 - RNA, 15 nt, Homo sapiens
aguccaggacugggu

SEQ ID NO: 774570 - RNA, 20 nt, Homo sapiens
aguccaggguggaugaucuc

SEQ ID NO: 774571 - RNA, 17 nt, Homo sapiens
agucccagagcaccuca

SEQ ID NO: 774572 - RNA, 15 nt, Homo sapiens
agucccagcuacuug

SEQ ID NO: 774573 - RNA, 17 nt, Homo sapiens
aguccccuuuccucuaa

SEQ ID NO: 774574 - RNA, 19 nt, Homo sapiens
agucccgucccugcccaga

SEQ ID NO: 774575 - RNA, 22 nt, Homo sapiens
agucccuuacagaggaccaugc

SEQ ID NO: 774576 - RNA, 23 nt, Homo sapiens
agucccuuuaugcagagccacag

SEQ ID NO: 774577 - RNA, 13 nt, Homo sapiens
aguccucugcucc

SEQ ID NO: 774578 - RNA, 19 nt, Homo sapiens
aguccugacacuauucauu

SEQ ID NO: 774579 - RNA, 20 nt, Homo sapiens
aguccugcuggaucuugccu

SEQ ID NO: 774580 - RNA, 19 nt, Homo sapiens
aguccuugggguuaagucu

SEQ ID NO: 774581 - RNA, 19 nt, Homo sapiens
aguccuuucuaaguauuuu

SEQ ID NO: 774582 - RNA, 14 nt, Homo sapiens
agucggaaugucau

SEQ ID NO: 774583 - RNA, 19 nt, Homo sapiens
agucggcuuguucuugcag

SEQ ID NO: 774584 - RNA, 15 nt, Homo sapiens
agucguucccagugu

SEQ ID NO: 774585 - RNA, 19 nt, Homo sapiens
agucuaagaaaaugaucuu

SEQ ID NO: 774586 - RNA, 15 nt, Homo sapiens
agucuaagcauacgu

SEQ ID NO: 774587 - RNA, 19 nt, Homo sapiens
agucuaccccugcuaagga

SEQ ID NO: 774588 - RNA, 19 nt, Homo sapiens
agucuauguauguguaaaa

SEQ ID NO: 774589 - RNA, 17 nt, Homo sapiens
agucuauguucaaagac

SEQ ID NO: 774590 - RNA, 21 nt, Homo sapiens
agucucaaagguaauucugaa

SEQ ID NO: 774591 - RNA, 13 nt, Homo sapiens
agucucaccagcc

SEQ ID NO: 774592 - RNA, 15 nt, Homo sapiens
agucucauagguuaa

SEQ ID NO: 774593 - RNA, 18 nt, Homo sapiens
agucucauuacagauuua

SEQ ID NO: 774594 - RNA, 23 nt, Homo sapiens
agucuccucucugagacugcuaa

SEQ ID NO: 774595 - RNA, 13 nt, Homo sapiens
agucucucaccac

SEQ ID NO: 774596 - RNA, 12 nt, Homo sapiens
agucucugugaa

SEQ ID NO: 774597 - RNA, 15 nt, Homo sapiens
agucucugugaauug

SEQ ID NO: 774598 - RNA, 21 nt, Homo sapiens
agucucuuacaaaagcuuuga

SEQ ID NO: 774599 - RNA, 20 nt, Homo sapiens
agucucuucuaagcaaaauu

SEQ ID NO: 774600 - RNA, 13 nt, Homo sapiens
agucugaacagcu

SEQ ID NO: 774601 - RNA, 20 nt, Homo sapiens
agucugaauagucuucagag

SEQ ID NO: 774602 - RNA, 15 nt, Homo sapiens
agucugagcuucuuu

SEQ ID NO: 774603 - RNA, 17 nt, Homo sapiens
agucugaggcaggagaa

SEQ ID NO: 774604 - RNA, 21 nt, Homo sapiens
agucugaggccccuuaacuca

SEQ ID NO: 774605 - RNA, 21 nt, Homo sapiens
agucugauuuuaaugaaauca

SEQ ID NO: 774606 - RNA, 16 nt, Homo sapiens
agucugcagauagaaa

SEQ ID NO: 774607 - RNA, 17 nt, Homo sapiens
agucugcagauagaaag

SEQ ID NO: 774608 - RNA, 22 nt, Homo sapiens
agucugcagauagaaagcauua

SEQ ID NO: 774609 - RNA, 21 nt, Homo sapiens
agucugccacuugucaaagaa

SEQ ID NO: 774610 - RNA, 12 nt, Homo sapiens
agucuggcaaca

SEQ ID NO: 774611 - RNA, 18 nt, Homo sapiens
agucuguaauacacucca

SEQ ID NO: 774612 - RNA, 16 nt, Homo sapiens
agucuguacuucauca

SEQ ID NO: 774613 - RNA, 16 nt, Homo sapiens
agucugucuacugugg

SEQ ID NO: 774614 - RNA, 19 nt, Homo sapiens
agucugucugucugaugau

SEQ ID NO: 774615 - RNA, 20 nt, Homo sapiens
agucuuaauaaaacauugaa

SEQ ID NO: 774616 - RNA, 15 nt, Homo sapiens
agucuucacaacuuu

SEQ ID NO: 774617 - RNA, 15 nt, Homo sapiens
agucuuccaguuuaa

SEQ ID NO: 774618 - RNA, 22 nt, Homo sapiens
agucuuccaguuuaaugaacua

SEQ ID NO: 774619 - RNA, 13 nt, Homo sapiens
agucuucccugau

SEQ ID NO: 774620 - RNA, 14 nt, Homo sapiens
agucuucuccucca

SEQ ID NO: 774621 - RNA, 12 nt, Homo sapiens
agucuucuggau

SEQ ID NO: 774622 - RNA, 16 nt, Homo sapiens
agucuucuguaauuca

SEQ ID NO: 774623 - RNA, 15 nt, Homo sapiens
agucuucuucacuuc

SEQ ID NO: 774624 - RNA, 20 nt, Homo sapiens
agucuugaaaugaaagggaa

SEQ ID NO: 774625 - RNA, 19 nt, Homo sapiens
agucuugcaguuaucuuag

SEQ ID NO: 774626 - RNA, 20 nt, Homo sapiens
agucuugcucuucaaugcua

SEQ ID NO: 774627 - RNA, 17 nt, Homo sapiens
agucuuuagggguuggg

SEQ ID NO: 774628 - RNA, 22 nt, Homo sapiens
agucuuuauguccauaagcuac

SEQ ID NO: 774629 - RNA, 19 nt, Homo sapiens
agucuuucuugagcagaug

SEQ ID NO: 774630 - RNA, 13 nt, Homo sapiens
agugaaaaaucug

SEQ ID NO: 774631 - RNA, 16 nt, Homo sapiens
auacagcuucauaaau

SEQ ID NO: 774632 - RNA, 15 nt, Homo sapiens
auacaggucauauua

SEQ ID NO: 774633 - RNA, 16 nt, Homo sapiens
auacauaacauucaau

SEQ ID NO: 774634 - RNA, 18 nt, Homo sapiens
auacauaagcagcauuuc

SEQ ID NO: 774635 - RNA, 20 nt, Homo sapiens
auacauaagcagcauuucau

SEQ ID NO: 774636 - RNA, 23 nt, Homo sapiens
auacauaagcggcguaaguuuaa

SEQ ID NO: 774637 - RNA, 20 nt, Homo sapiens
auacauagacugauugauua

SEQ ID NO: 774638 - RNA, 15 nt, Homo sapiens
auacauagugaaaau

SEQ ID NO: 774639 - RNA, 14 nt, Homo sapiens
auacauauuaucuc

SEQ ID NO: 774640 - RNA, 18 nt, Homo sapiens
auacaugcugcuaauuca

SEQ ID NO: 774641 - RNA, 16 nt, Homo sapiens
auacauguguacauau

SEQ ID NO: 774642 - RNA, 16 nt, Homo sapiens
auacauucugcuuuca

SEQ ID NO: 774643 - RNA, 20 nt, Homo sapiens
auacauuucaauuauacuaa

SEQ ID NO: 774644 - RNA, 15 nt, Homo sapiens
auacauuugauaaag

SEQ ID NO: 774645 - RNA, 22 nt, Homo sapiens
auacauuuuuuaggacaucuua

SEQ ID NO: 774646 - RNA, 13 nt, Homo sapiens
auaccaccuuuac

SEQ ID NO: 774647 - RNA, 16 nt, Homo sapiens
auaccaccuuuacugu

SEQ ID NO: 774648 - RNA, 20 nt, Homo sapiens
auaccacuaauuuucgcuua

SEQ ID NO: 774649 - RNA, 16 nt, Homo sapiens
auaccagaaagcucua

SEQ ID NO: 774650 - RNA, 21 nt, Homo sapiens
auaccagguuuuacacuugca

SEQ ID NO: 774651 - RNA, 17 nt, Homo sapiens
auaccauucacuacuca

SEQ ID NO: 774652 - RNA, 19 nt, Homo sapiens
auaccauuuuuuaaggaaa

SEQ ID NO: 774653 - RNA, 17 nt, Homo sapiens
auacccugaauuuggcc

SEQ ID NO: 774654 - RNA, 15 nt, Homo sapiens
auaccuaauugugga

SEQ ID NO: 774655 - RNA, 14 nt, Homo sapiens
auaccuaucaucuu

SEQ ID NO: 774656 - RNA, 23 nt, Homo sapiens
auaccugauugaucacacagugu

SEQ ID NO: 774657 - RNA, 14 nt, Homo sapiens
auaccugcucuugu

SEQ ID NO: 774658 - RNA, 15 nt, Homo sapiens
auaccuggcuuuuac

SEQ ID NO: 774659 - RNA, 16 nt, Homo sapiens
auaccuguguccgaug

SEQ ID NO: 774660 - RNA, 15 nt, Homo sapiens
auaccuuccccacau

SEQ ID NO: 774661 - RNA, 19 nt, Homo sapiens
auaccuucuuaaguuuuca

SEQ ID NO: 774662 - RNA, 17 nt, Homo sapiens
auacgcucaccuuacag

SEQ ID NO: 774663 - RNA, 19 nt, Homo sapiens
auacgcucaggugguugug

SEQ ID NO: 774664 - RNA, 18 nt, Homo sapiens
auacggcccaugcaauuu

SEQ ID NO: 774665 - RNA, 21 nt, Homo sapiens
auacggcccaugcaauuuuau

SEQ ID NO: 774666 - RNA, 23 nt, Homo sapiens
auacgggggcugugacucugggc

SEQ ID NO: 774667 - RNA, 15 nt, Homo sapiens
auacguagcucucuu

SEQ ID NO: 774668 - RNA, 18 nt, Homo sapiens
auacuaaaccagcauacc

SEQ ID NO: 774669 - RNA, 19 nt, Homo sapiens
auacuaacauuuucauuga

SEQ ID NO: 774670 - RNA, 19 nt, Homo sapiens
auacuacaguaacugugac

SEQ ID NO: 774671 - RNA, 22 nt, Homo sapiens
auacuacugugugugcauugaa

SEQ ID NO: 774672 - RNA, 16 nt, Homo sapiens
auacuagcauacuuaa

SEQ ID NO: 774673 - RNA, 16 nt, Homo sapiens
auacuagggagccauu

SEQ ID NO: 774674 - RNA, 17 nt, Homo sapiens
auacucaaaagagagag

SEQ ID NO: 774675 - RNA, 14 nt, Homo sapiens
auacucaccaaaau

SEQ ID NO: 774676 - RNA, 14 nt, Homo sapiens
auacucacugaguc

SEQ ID NO: 774677 - RNA, 23 nt, Homo sapiens
auacucagguaccucuuucaggg

SEQ ID NO: 774678 - RNA, 12 nt, Homo sapiens
auacuccuugcu

SEQ ID NO: 774679 - RNA, 18 nt, Homo sapiens
auacugcauuuacagugu

SEQ ID NO: 774680 - RNA, 15 nt, Homo sapiens
auacugcccaaggau

SEQ ID NO: 774681 - RNA, 15 nt, Homo sapiens
auacugccuuugcag

SEQ ID NO: 774682 - RNA, 15 nt, Homo sapiens
auacuggacucagga

SEQ ID NO: 774683 - RNA, 15 nt, Homo sapiens
auacuggucucaggc

SEQ ID NO: 774684 - RNA, 18 nt, Homo sapiens
auacuguauauucaggac

SEQ ID NO: 774685 - RNA, 12 nt, Homo sapiens
auacugugaaau

SEQ ID NO: 774686 - RNA, 12 nt, Homo sapiens
auacugugcaua

SEQ ID NO: 774687 - RNA, 18 nt, Homo sapiens
auacuguggccugaaaua

SEQ ID NO: 774688 - RNA, 19 nt, Homo sapiens
auacuguuuccuaugacau

SEQ ID NO: 774689 - RNA, 14 nt, Homo sapiens
auacuuagugguau

SEQ ID NO: 774690 - RNA, 21 nt, Homo sapiens
auacuugauaguuuggcuaua

SEQ ID NO: 774691 - RNA, 17 nt, Homo sapiens
auacuuguaaucccagc

SEQ ID NO: 774692 - RNA, 14 nt, Homo sapiens
auacuuucagucaa

SEQ ID NO: 774693 - RNA, 17 nt, Homo sapiens
auacuuugacaaggaaa

SEQ ID NO: 774694 - RNA, 22 nt, Homo sapiens
auacuuuuaaagccuauucacu

SEQ ID NO: 774695 - RNA, 19 nt, Homo sapiens
auacuuuuggcuccucuag

SEQ ID NO: 774696 - RNA, 15 nt, Homo sapiens
auacuuuugugaaca

SEQ ID NO: 774697 - RNA, 17 nt, Homo sapiens
auacuuuuuguuuauuu

SEQ ID NO: 774698 - RNA, 13 nt, Homo sapiens
auagaaagcuaua

SEQ ID NO: 774699 - RNA, 17 nt, Homo sapiens
auagaaauauugacuca

SEQ ID NO: 774700 - RNA, 23 nt, Homo sapiens
auagaaauguaaaaguacucuga

SEQ ID NO: 774701 - RNA, 15 nt, Homo sapiens
auagaacacaguuug

SEQ ID NO: 774702 - RNA, 15 nt, Homo sapiens
auagaaccacuauga

SEQ ID NO: 774703 - RNA, 20 nt, Homo sapiens
auagaacucugggcugccau

SEQ ID NO: 774704 - RNA, 18 nt, Homo sapiens
auagaagagaaaugcugc

SEQ ID NO: 774705 - RNA, 18 nt, Homo sapiens
auagaauaaaggcaguuu

SEQ ID NO: 774706 - RNA, 16 nt, Homo sapiens
auagaauucagaaaau

SEQ ID NO: 774707 - RNA, 17 nt, Homo sapiens
auagacacuugcuccca

SEQ ID NO: 774708 - RNA, 21 nt, Homo sapiens
auagacggguugaaagacauc

SEQ ID NO: 774709 - RNA, 23 nt, Homo sapiens
auagacggguugaaagacaucaa

SEQ ID NO: 774710 - RNA, 19 nt, Homo sapiens
auagacucugguguucuau

SEQ ID NO: 774711 - RNA, 19 nt, Homo sapiens
auagagaauuccuauuuaa

SEQ ID NO: 774712 - RNA, 21 nt, Homo sapiens
auagagauagcuacaguguaa

SEQ ID NO: 774713 - RNA, 21 nt, Homo sapiens
auagagugguacagcacuguu

SEQ ID NO: 774714 - RNA, 19 nt, Homo sapiens
auagauaaagcugauuugu

SEQ ID NO: 774715 - RNA, 18 nt, Homo sapiens
auagauauuacuggaaac

SEQ ID NO: 774716 - RNA, 21 nt, Homo sapiens
auagauggauuuguaucaaua

SEQ ID NO: 774717 - RNA, 20 nt, Homo sapiens
auagaugucuagguacuuca

SEQ ID NO: 774718 - RNA, 16 nt, Homo sapiens
auagaugugaucacug

SEQ ID NO: 774719 - RNA, 18 nt, Homo sapiens
auagauuaauggcacuga

SEQ ID NO: 774720 - RNA, 21 nt, Homo sapiens
auagauuauuauaaacuauaa

SEQ ID NO: 774721 - RNA, 19 nt, Homo sapiens
auagauuucuacacugagg

SEQ ID NO: 774722 - RNA, 14 nt, Homo sapiens
auagauuugcagcu

SEQ ID NO: 774723 - RNA, 13 nt, Homo sapiens
auagcaagacaca

SEQ ID NO: 774724 - RNA, 19 nt, Homo sapiens
auagcacacuuuuccacau

SEQ ID NO: 774725 - RNA, 22 nt, Homo sapiens
auagcacguggagcucuuggcu

SEQ ID NO: 774726 - RNA, 22 nt, Homo sapiens
auagcagagagccaaaucugac

SEQ ID NO: 774727 - RNA, 18 nt, Homo sapiens
auagcagaugguuuccac

SEQ ID NO: 774728 - RNA, 18 nt, Homo sapiens
auagcagauuguguaaca

SEQ ID NO: 774729 - RNA, 18 nt, Homo sapiens
auagcaguugaaacaaga

SEQ ID NO: 774730 - RNA, 23 nt, Homo sapiens
auagcaguugaaacaagaagcca

SEQ ID NO: 774731 - RNA, 13 nt, Homo sapiens
auagccagcauuu

SEQ ID NO: 774732 - RNA, 14 nt, Homo sapiens
auagccagcauuuu

SEQ ID NO: 774733 - RNA, 23 nt, Homo sapiens
auagcucuggggugggcaguuuu

SEQ ID NO: 774734 - RNA, 21 nt, Homo sapiens
auagcugccuucaaggacugu

SEQ ID NO: 774735 - RNA, 14 nt, Homo sapiens
auagcuuccaugag

SEQ ID NO: 774736 - RNA, 15 nt, Homo sapiens
auagcuugaagccca

SEQ ID NO: 774737 - RNA, 17 nt, Homo sapiens
auaggaaagcauaugca

SEQ ID NO: 774738 - RNA, 21 nt, Homo sapiens
auaggaacaaucuuugcugua

SEQ ID NO: 774739 - RNA, 20 nt, Homo sapiens
auaggaauguccaccaugaa

SEQ ID NO: 774740 - RNA, 20 nt, Homo sapiens
auaggacucuagacggcauc

SEQ ID NO: 774741 - RNA, 15 nt, Homo sapiens
auaggagugaauaca

SEQ ID NO: 774742 - RNA, 17 nt, Homo sapiens
auaggcaaaaucugaca

SEQ ID NO: 774743 - RNA, 18 nt, Homo sapiens
auaggcauuaacacaaag

SEQ ID NO: 774744 - RNA, 17 nt, Homo sapiens
auaggccaggcacugug

SEQ ID NO: 774745 - RNA, 20 nt, Homo sapiens
auuccaagacucuagagucc

SEQ ID NO: 774746 - RNA, 15 nt, Homo sapiens
auuccacacccucac

SEQ ID NO: 774747 - RNA, 14 nt, Homo sapiens
auuccacacuacca

SEQ ID NO: 774748 - RNA, 18 nt, Homo sapiens
auuccacacuaccacauu

SEQ ID NO: 774749 - RNA, 17 nt, Homo sapiens
auuccaccugcaaucaa

SEQ ID NO: 774750 - RNA, 21 nt, Homo sapiens
auuccagugguucugcuucaa

SEQ ID NO: 774751 - RNA, 17 nt, Homo sapiens
auuccauacuucucuca

SEQ ID NO: 774752 - RNA, 15 nt, Homo sapiens
auuccaugagcugcu

SEQ ID NO: 774753 - RNA, 15 nt, Homo sapiens
auuccaugcaaugga

SEQ ID NO: 774754 - RNA, 18 nt, Homo sapiens
auuccauuuccaguucau

SEQ ID NO: 774755 - RNA, 23 nt, Homo sapiens
auucccaaaccuaaugaucaucu

SEQ ID NO: 774756 - RNA, 17 nt, Homo sapiens
auucccaacgugcaaag

SEQ ID NO: 774757 - RNA, 14 nt, Homo sapiens
auucccacugccag

SEQ ID NO: 774758 - RNA, 21 nt, Homo sapiens
auuccccuguagcagucacug

SEQ ID NO: 774759 - RNA, 21 nt, Homo sapiens
auuccguuaggaauaacacug

SEQ ID NO: 774760 - RNA, 22 nt, Homo sapiens
auuccugaccuccgccauccac

SEQ ID NO: 774761 - RNA, 16 nt, Homo sapiens
auuccugaucuuccca

SEQ ID NO: 774762 - RNA, 22 nt, Homo sapiens
auuccugccuuuaagccaaaga

SEQ ID NO: 774763 - RNA, 22 nt, Homo sapiens
auuccugguggauacuguagaa

SEQ ID NO: 774764 - RNA, 18 nt, Homo sapiens
auuccugguuugacucag

SEQ ID NO: 774765 - RNA, 21 nt, Homo sapiens
auuccugguuugacucaguuc

SEQ ID NO: 774766 - RNA, 16 nt, Homo sapiens
auuccuguuacuuuac

SEQ ID NO: 774767 - RNA, 14 nt, Homo sapiens
auuccuguuuccau

SEQ ID NO: 774768 - RNA, 14 nt, Homo sapiens
auuccuuagucuca

SEQ ID NO: 774769 - RNA, 18 nt, Homo sapiens
auuccuucacucauccag

SEQ ID NO: 774770 - RNA, 13 nt, Homo sapiens
auuccuucauuca

SEQ ID NO: 774771 - RNA, 21 nt, Homo sapiens
auuccuucuuucacaggcauc

SEQ ID NO: 774772 - RNA, 23 nt, Homo sapiens
auuccuuggcaugccuuccagca

SEQ ID NO: 774773 - RNA, 23 nt, Homo sapiens
auuccuugucaccagcaacaucu

SEQ ID NO: 774774 - RNA, 22 nt, Homo sapiens
auuccuuuacuacgaaguauaa

SEQ ID NO: 774775 - RNA, 16 nt, Homo sapiens
auuccuuugucuucaa

SEQ ID NO: 774776 - RNA, 23 nt, Homo sapiens
auuccuuugucuucaaacuguga

SEQ ID NO: 774777 - RNA, 21 nt, Homo sapiens
auucgaccuauaagaagccuu

SEQ ID NO: 774778 - RNA, 15 nt, Homo sapiens
auucgcccaccucag

SEQ ID NO: 774779 - RNA, 15 nt, Homo sapiens
auucggauuugccau

SEQ ID NO: 774780 - RNA, 18 nt, Homo sapiens
auucgggugugagucuuu

SEQ ID NO: 774781 - RNA, 14 nt, Homo sapiens
auucggugugcugc

SEQ ID NO: 774782 - RNA, 22 nt, Homo sapiens
auucuaaauaaauuucccaguu

SEQ ID NO: 774783 - RNA, 20 nt, Homo sapiens
auucuaaaugaauguuuaca

SEQ ID NO: 774784 - RNA, 18 nt, Homo sapiens
auucuaacccaagacaug

SEQ ID NO: 774785 - RNA, 22 nt, Homo sapiens
auucuaacccagguauccaaaa

SEQ ID NO: 774786 - RNA, 12 nt, Homo sapiens
auucuaagccag

SEQ ID NO: 774787 - RNA, 15 nt, Homo sapiens
auucuaagucuucca

SEQ ID NO: 774788 - RNA, 13 nt, Homo sapiens
auucuaagugaaa

SEQ ID NO: 774789 - RNA, 17 nt, Homo sapiens
auucuaaguuauuuacu

SEQ ID NO: 774790 - RNA, 18 nt, Homo sapiens
auucuaaguuauuuacuu

SEQ ID NO: 774791 - RNA, 21 nt, Homo sapiens
auucuacaaaaaaccaggaug

SEQ ID NO: 774792 - RNA, 19 nt, Homo sapiens
auucuagcugagaagcaau

SEQ ID NO: 774793 - RNA, 16 nt, Homo sapiens
auucuagucucugauu

SEQ ID NO: 774794 - RNA, 21 nt, Homo sapiens
auucuauugaaaacagugucu

SEQ ID NO: 774795 - RNA, 16 nt, Homo sapiens
auucucaaagcaggaa

SEQ ID NO: 774796 - RNA, 14 nt, Homo sapiens
auucucacuccuac

SEQ ID NO: 774797 - RNA, 21 nt, Homo sapiens
auucucagugagggcucugga

SEQ ID NO: 774798 - RNA, 14 nt, Homo sapiens
auucucaucacuca

SEQ ID NO: 774799 - RNA, 18 nt, Homo sapiens
auucucaucaguccauug

SEQ ID NO: 774800 - RNA, 17 nt, Homo sapiens
auucucauuuguucuca

SEQ ID NO: 774801 - RNA, 19 nt, Homo sapiens
auucucauuuguucucaca

SEQ ID NO: 774802 - RNA, 17 nt, Homo sapiens
auucucccuuucacuaa

SEQ ID NO: 774803 - RNA, 15 nt, Homo sapiens
auucuccugccucag

SEQ ID NO: 774804 - RNA, 18 nt, Homo sapiens
auucuccugccucagccu

SEQ ID NO: 774805 - RNA, 21 nt, Homo sapiens
auucucuaggagaaacuuaga

SEQ ID NO: 774806 - RNA, 20 nt, Homo sapiens
auucucucucauuauugaga

SEQ ID NO: 774807 - RNA, 20 nt, Homo sapiens
auucucuuuuuuucuugucc

SEQ ID NO: 774808 - RNA, 11 nt, Homo sapiens
auucugaccau

SEQ ID NO: 774809 - RNA, 18 nt, Homo sapiens
auucugauaaugcucacu

SEQ ID NO: 774810 - RNA, 14 nt, Homo sapiens
auucugaugcauac

SEQ ID NO: 774811 - RNA, 15 nt, Homo sapiens
auucugcauugcuag

SEQ ID NO: 774812 - RNA, 17 nt, Homo sapiens
auucugcauugcuagau

SEQ ID NO: 774813 - RNA, 16 nt, Homo sapiens
auucugccuagagugu

SEQ ID NO: 774814 - RNA, 17 nt, Homo sapiens
auucugccuagagugua

SEQ ID NO: 774815 - RNA, 22 nt, Homo sapiens
auucugccuccauucugaccau

SEQ ID NO: 774816 - RNA, 15 nt, Homo sapiens
auucuguaguugcag

SEQ ID NO: 774817 - RNA, 19 nt, Homo sapiens
auucuguaucauugauuca

SEQ ID NO: 774818 - RNA, 17 nt, Homo sapiens
auucuguuaaaacucaa

SEQ ID NO: 774819 - RNA, 19 nt, Homo sapiens
auucuguuugcguacuugu

SEQ ID NO: 774820 - RNA, 18 nt, Homo sapiens
auucuguuuuuaaugcua

SEQ ID NO: 774821 - RNA, 22 nt, Homo sapiens
auucuuacaauugcacugcugu

SEQ ID NO: 774822 - RNA, 22 nt, Homo sapiens
auucuucagauacaaacugcag

SEQ ID NO: 774823 - RNA, 13 nt, Homo sapiens
auucuuccagaau

SEQ ID NO: 774824 - RNA, 20 nt, Homo sapiens
auucuuccaucaucacugua

SEQ ID NO: 774825 - RNA, 22 nt, Homo sapiens
auucuuccuaaugucagaacag

SEQ ID NO: 774826 - RNA, 13 nt, Homo sapiens
auucuucuuccaa

SEQ ID NO: 774827 - RNA, 21 nt, Homo sapiens
auucuucuuugguggagauaa

SEQ ID NO: 774828 - RNA, 14 nt, Homo sapiens
auucuugaaugagg

SEQ ID NO: 774829 - RNA, 13 nt, Homo sapiens
auucuugacuuau

SEQ ID NO: 774830 - RNA, 14 nt, Homo sapiens
auucuugacuuaua

SEQ ID NO: 774831 - RNA, 17 nt, Homo sapiens
auucuugauguaaaauc

SEQ ID NO: 774832 - RNA, 15 nt, Homo sapiens
auucuugcuugacuc

SEQ ID NO: 774833 - RNA, 15 nt, Homo sapiens
auucuugucacaaua

SEQ ID NO: 774834 - RNA, 18 nt, Homo sapiens
auucuuuauucuuuuacu

SEQ ID NO: 774835 - RNA, 19 nt, Homo sapiens
auucuuuccuguauggccu

SEQ ID NO: 774836 - RNA, 18 nt, Homo sapiens
auucuuuguauaugcauu

SEQ ID NO: 774837 - RNA, 19 nt, Homo sapiens
auucuuuuucaguuuuacc

SEQ ID NO: 774838 - RNA, 15 nt, Homo sapiens
auucuuuuuuaugca

SEQ ID NO: 774839 - RNA, 21 nt, Homo sapiens
auugaaaauuuuuaaauauuc

SEQ ID NO: 774840 - RNA, 22 nt, Homo sapiens
auugaaaauuuuuaaauauuca

SEQ ID NO: 774841 - RNA, 14 nt, Homo sapiens
auugaaacugagua

SEQ ID NO: 774842 - RNA, 17 nt, Homo sapiens
auugaaagaaccagaga

SEQ ID NO: 774843 - RNA, 21 nt, Homo sapiens
auugaaaggcauucucugaag

SEQ ID NO: 774844 - RNA, 18 nt, Homo sapiens
auugaacuuuuguacuga

SEQ ID NO: 774845 - RNA, 12 nt, Homo sapiens
auugaagacauu

SEQ ID NO: 774846 - RNA, 15 nt, Homo sapiens
auugaagaugcugcc

SEQ ID NO: 774847 - RNA, 17 nt, Homo sapiens
auugaaggaaagcuaua

SEQ ID NO: 774848 - RNA, 16 nt, Homo sapiens
auugaaguauuuugcu

SEQ ID NO: 774849 - RNA, 15 nt, Homo sapiens
auugaaguguauaau

SEQ ID NO: 774850 - RNA, 13 nt, Homo sapiens
auugaauuaucuu

SEQ ID NO: 774851 - RNA, 14 nt, Homo sapiens
auugacacacagca

SEQ ID NO: 774852 - RNA, 20 nt, Homo sapiens
auugacacacagcacucucu

SEQ ID NO: 774853 - RNA, 21 nt, Homo sapiens
auugacacacagcacucucua

SEQ ID NO: 774854 - RNA, 22 nt, Homo sapiens
auugacagcuucaacagaaagg

SEQ ID NO: 774855 - RNA, 12 nt, Homo sapiens
auugaccaaaua

SEQ ID NO: 774856 - RNA, 20 nt, Homo sapiens
auugaccuauuuccagaaau

SEQ ID NO: 774857 - RNA, 23 nt, Homo sapiens
auugaccucagcugcacauuccu

SEQ ID NO: 774858 - RNA, 14 nt, Homo sapiens
auugacgaacuggc

SEQ ID NO: 774859 - RNA, 17 nt, Homo sapiens
auuuuucaagagcuccu

SEQ ID NO: 774860 - RNA, 21 nt, Homo sapiens
auuuuucaaugggaagacuca

SEQ ID NO: 774861 - RNA, 16 nt, Homo sapiens
auuuuucacauaucua

SEQ ID NO: 774862 - RNA, 16 nt, Homo sapiens
auuuuucaccugagaa

SEQ ID NO: 774863 - RNA, 17 nt, Homo sapiens
auuuuucaugcuaucaa

SEQ ID NO: 774864 - RNA, 13 nt, Homo sapiens
auuuuucuaucaa

SEQ ID NO: 774865 - RNA, 16 nt, Homo sapiens
auuuuugcugaauuca

SEQ ID NO: 774866 - RNA, 18 nt, Homo sapiens
auuuuuguagcacugaca

SEQ ID NO: 774867 - RNA, 22 nt, Homo sapiens
auuuuuguaggaaauguaagau

SEQ ID NO: 774868 - RNA, 18 nt, Homo sapiens
auuuuugugaaguauuca

SEQ ID NO: 774869 - RNA, 15 nt, Homo sapiens
auuuuuguuuaugua

SEQ ID NO: 774870 - RNA, 14 nt, Homo sapiens
auuuuuucccccac

SEQ ID NO: 774871 - RNA, 13 nt, Homo sapiens
auuuuuugacuuu

SEQ ID NO: 774872 - RNA, 14 nt, Homo sapiens
auuuuuugcuacuu

SEQ ID NO: 774873 - RNA, 18 nt, Homo sapiens
auuuuuuguaugcuuaaa

SEQ ID NO: 774874 - RNA, 18 nt, Homo sapiens
auuuuuuuaaaucaagga

SEQ ID NO: 774875 - RNA, 14 nt, Homo sapiens
auuuuuuucuacau

SEQ ID NO: 774876 - RNA, 18 nt, Homo sapiens
auuuuuuugcaugcaugc

SEQ ID NO: 774877 - RNA, 19 nt, Homo sapiens
auuuuuuuugagaccgagu

SEQ ID NO: 774878 - RNA, 14 nt, Homo sapiens
auuuuuuuuuggau

SEQ ID NO: 774879 - RNA, 23 nt, Homo sapiens
caaaaaaaaaaaaaaaaaagaga

SEQ ID NO: 774880 - RNA, 16 nt, Homo sapiens
caaaaaaagagaacac

SEQ ID NO: 774881 - RNA, 19 nt, Homo sapiens
caaaaaacaacacagucua

SEQ ID NO: 774882 - RNA, 15 nt, Homo sapiens
caaaaaacuacuucu

SEQ ID NO: 774883 - RNA, 17 nt, Homo sapiens
caaaaaaucugaccaaa

SEQ ID NO: 774884 - RNA, 14 nt, Homo sapiens
caaaaacagaauuu

SEQ ID NO: 774885 - RNA, 18 nt, Homo sapiens
caaaaaccauguugcguu

SEQ ID NO: 774886 - RNA, 19 nt, Homo sapiens
caaaaacuacauuuugcaa

SEQ ID NO: 774887 - RNA, 16 nt, Homo sapiens
caaaaagaaaugaugu

SEQ ID NO: 774888 - RNA, 14 nt, Homo sapiens
caaaaauaguauuc

SEQ ID NO: 774889 - RNA, 17 nt, Homo sapiens
caaaaauauuuacacuu

SEQ ID NO: 774890 - RNA, 19 nt, Homo sapiens
caaaaaucguuuugcccga

SEQ ID NO: 774891 - RNA, 20 nt, Homo sapiens
caaaaaucuguguaacugua

SEQ ID NO: 774892 - RNA, 22 nt, Homo sapiens
caaaaaucuguguaacuguaaa

SEQ ID NO: 774893 - RNA, 21 nt, Homo sapiens
caaaaaugaagcugcucugaa

SEQ ID NO: 774894 - RNA, 19 nt, Homo sapiens
caaaaauggauauuauuag

SEQ ID NO: 774895 - RNA, 20 nt, Homo sapiens
caaaaauguguaagaacaac

SEQ ID NO: 774896 - RNA, 23 nt, Homo sapiens
caaaaauguuguauuggcuauga

SEQ ID NO: 774897 - RNA, 17 nt, Homo sapiens
caaaaauuaauacacaa

SEQ ID NO: 774898 - RNA, 14 nt, Homo sapiens
caaaacaaaaagau

SEQ ID NO: 774899 - RNA, 15 nt, Homo sapiens
caaaacacauaguua

SEQ ID NO: 774900 - RNA, 15 nt, Homo sapiens
caaaacacucaucuc

SEQ ID NO: 774901 - RNA, 18 nt, Homo sapiens
caaaacagagaugugaua

SEQ ID NO: 774902 - RNA, 16 nt, Homo sapiens
caaaacaucucugcag

SEQ ID NO: 774903 - RNA, 18 nt, Homo sapiens
caaaacaucucugcaguu

SEQ ID NO: 774904 - RNA, 15 nt, Homo sapiens
caaaacccacagaag

SEQ ID NO: 774905 - RNA, 18 nt, Homo sapiens
caaaacccucagcacugu

SEQ ID NO: 774906 - RNA, 17 nt, Homo sapiens
caaaacccugaagccau

SEQ ID NO: 774907 - RNA, 21 nt, Homo sapiens
caaaaccucauuuaaguaaaa

SEQ ID NO: 774908 - RNA, 17 nt, Homo sapiens
caaaaccugauguuaaa

SEQ ID NO: 774909 - RNA, 14 nt, Homo sapiens
caaaacgacacugc

SEQ ID NO: 774910 - RNA, 17 nt, Homo sapiens
caaaacuaaccaucuga

SEQ ID NO: 774911 - RNA, 20 nt, Homo sapiens
caaaacuauccugauuccaa

SEQ ID NO: 774912 - RNA, 21 nt, Homo sapiens
caaaacuauccugauuccaaa

SEQ ID NO: 774913 - RNA, 12 nt, Homo sapiens
caaaacugccau

SEQ ID NO: 774914 - RNA, 13 nt, Homo sapiens
caaaacugccuca

SEQ ID NO: 774915 - RNA, 23 nt, Homo sapiens
caaaacuuaucacgccuacuuaa

SEQ ID NO: 774916 - RNA, 16 nt, Homo sapiens
caaaacuugcaucuaa

SEQ ID NO: 774917 - RNA, 23 nt, Homo sapiens
caaaagaagacaacauuucucaa

SEQ ID NO: 774918 - RNA, 19 nt, Homo sapiens
caaaagagaaaaacaaaac

SEQ ID NO: 774919 - RNA, 22 nt, Homo sapiens
caaaagcaaagaugcauuuuca

SEQ ID NO: 774920 - RNA, 13 nt, Homo sapiens
caaaagcaaggga

SEQ ID NO: 774921 - RNA, 15 nt, Homo sapiens
caaaagcacauauau

SEQ ID NO: 774922 - RNA, 17 nt, Homo sapiens
caaaagcagauacuuga

SEQ ID NO: 774923 - RNA, 14 nt, Homo sapiens
caaaagcaguaaau

SEQ ID NO: 774924 - RNA, 13 nt, Homo sapiens
caaaagcccaaug

SEQ ID NO: 774925 - RNA, 21 nt, Homo sapiens
caaaagcccaauguaaugcau

SEQ ID NO: 774926 - RNA, 15 nt, Homo sapiens
caaaagcuuuuuacu

SEQ ID NO: 774927 - RNA, 14 nt, Homo sapiens
caaaaggcugagaa

SEQ ID NO: 774928 - RNA, 18 nt, Homo sapiens
caaaaggguguauagugu

SEQ ID NO: 774929 - RNA, 24 nt, Homo sapiens
caaaauacgaaguggagauuuaca

SEQ ID NO: 774930 - RNA, 22 nt, Homo sapiens
caaaauaguucuauuucuaucu

SEQ ID NO: 774931 - RNA, 17 nt, Homo sapiens
caaaauauuuaagugaa

SEQ ID NO: 774932 - RNA, 14 nt, Homo sapiens
caaaaucaagagau

SEQ ID NO: 774933 - RNA, 20 nt, Homo sapiens
caaaaucaagagauggcuua

SEQ ID NO: 774934 - RNA, 13 nt, Homo sapiens
caaaauccaaaaa

SEQ ID NO: 774935 - RNA, 19 nt, Homo sapiens
caaaauccaagauucugcu

SEQ ID NO: 774936 - RNA, 14 nt, Homo sapiens
caaaauccaaggca

SEQ ID NO: 774937 - RNA, 15 nt, Homo sapiens
caaaaucguuuuuaa

SEQ ID NO: 774938 - RNA, 21 nt, Homo sapiens
caaaaucuccuggcuuuacag

SEQ ID NO: 774939 - RNA, 12 nt, Homo sapiens
caaaaucucuac

SEQ ID NO: 774940 - RNA, 15 nt, Homo sapiens
caaaaucuuguuaau

SEQ ID NO: 774941 - RNA, 15 nt, Homo sapiens
caaaaugauuuugaa

SEQ ID NO: 774942 - RNA, 19 nt, Homo sapiens
caaaaugcuucugcacaca

SEQ ID NO: 774943 - RNA, 19 nt, Homo sapiens
caaaaugucuaagauagua

SEQ ID NO: 774944 - RNA, 22 nt, Homo sapiens
caaaaugucucuuguggcccau

SEQ ID NO: 774945 - RNA, 23 nt, Homo sapiens
caaaauguguuucauaguauucu

SEQ ID NO: 774946 - RNA, 20 nt, Homo sapiens
caaaauucuaaaaauuugca

SEQ ID NO: 774947 - RNA, 12 nt, Homo sapiens
caaaauugcuaa

SEQ ID NO: 774948 - RNA, 21 nt, Homo sapiens
caaaauuguuuucacuuguau

SEQ ID NO: 774949 - RNA, 15 nt, Homo sapiens
caaaauuuccaguac

SEQ ID NO: 774950 - RNA, 14 nt, Homo sapiens
caaacaaccugccc

SEQ ID NO: 774951 - RNA, 17 nt, Homo sapiens
caaacaauaugcuccug

SEQ ID NO: 774952 - RNA, 13 nt, Homo sapiens
caaacacaccucu

SEQ ID NO: 774953 - RNA, 17 nt, Homo sapiens
caaacacuagcucugua

SEQ ID NO: 774954 - RNA, 18 nt, Homo sapiens
caaacagaccccuguuca

SEQ ID NO: 774955 - RNA, 22 nt, Homo sapiens
caaacagaccccuguucaugcc

SEQ ID NO: 774956 - RNA, 14 nt, Homo sapiens
caaacauaaagaga

SEQ ID NO: 774957 - RNA, 22 nt, Homo sapiens
caaacauauccuuucaagacag

SEQ ID NO: 774958 - RNA, 11 nt, Homo sapiens
caaacauuuga

SEQ ID NO: 774959 - RNA, 16 nt, Homo sapiens
caaacauuugccaagu

SEQ ID NO: 774960 - RNA, 18 nt, Homo sapiens
caaacauuugccaaguga

SEQ ID NO: 774961 - RNA, 19 nt, Homo sapiens
caaaccaaccgcacaugca

SEQ ID NO: 774962 - RNA, 13 nt, Homo sapiens
caaaccaagcaaa

SEQ ID NO: 774963 - RNA, 24 nt, Homo sapiens
caaaccacgccucuugaccaggcu

SEQ ID NO: 774964 - RNA, 19 nt, Homo sapiens
caaacccuagauuggggua

SEQ ID NO: 774965 - RNA, 20 nt, Homo sapiens
caaacccuagccuugcuugu

SEQ ID NO: 774966 - RNA, 15 nt, Homo sapiens
caaaccgagugcaau

SEQ ID NO: 774967 - RNA, 17 nt, Homo sapiens
caaaccggacccggccg

SEQ ID NO: 774968 - RNA, 21 nt, Homo sapiens
caaaccuaaaaucuguuuuuc

SEQ ID NO: 774969 - RNA, 15 nt, Homo sapiens
caaaccuaccaaaau

SEQ ID NO: 774970 - RNA, 20 nt, Homo sapiens
caaaccucacauuugugaac

SEQ ID NO: 774971 - RNA, 16 nt, Homo sapiens
caaaccugaccacaga

SEQ ID NO: 774972 - RNA, 17 nt, Homo sapiens
caaacgcccuuuccucc

SEQ ID NO: 774973 - RNA, 13 nt, Homo sapiens
caaacgcugaaaa

SEQ ID NO: 774974 - RNA, 23 nt, Homo sapiens
caaguauucauuuuuucuacccu

SEQ ID NO: 774975 - RNA, 21 nt, Homo sapiens
caaguauugucgguuaccucu

SEQ ID NO: 774976 - RNA, 16 nt, Homo sapiens
caagucacacgcuuuu

SEQ ID NO: 774977 - RNA, 19 nt, Homo sapiens
caagucacacgcuuuugaa

SEQ ID NO: 774978 - RNA, 17 nt, Homo sapiens
caagucaccaugcugaa

SEQ ID NO: 774979 - RNA, 18 nt, Homo sapiens
caagucaccaugcugaau

SEQ ID NO: 774980 - RNA, 18 nt, Homo sapiens
caagucaugugcauuucc

SEQ ID NO: 774981 - RNA, 21 nt, Homo sapiens
caaguccuugaccucuauaaa

SEQ ID NO: 774982 - RNA, 12 nt, Homo sapiens
caagucuucccu

SEQ ID NO: 774983 - RNA, 21 nt, Homo sapiens
caagugagcagagauguacug

SEQ ID NO: 774984 - RNA, 21 nt, Homo sapiens
caagugauccuuccaccucag

SEQ ID NO: 774985 - RNA, 21 nt, Homo sapiens
caagugaucugcccaccucag

SEQ ID NO: 774986 - RNA, 19 nt, Homo sapiens
caaguggcaugugcuguga

SEQ ID NO: 774987 - RNA, 20 nt, Homo sapiens
caagugguguuuauugcaau

SEQ ID NO: 774988 - RNA, 23 nt, Homo sapiens
caaguguucuuagguuuacugug

SEQ ID NO: 774989 - RNA, 13 nt, Homo sapiens
caaguuacaguga

SEQ ID NO: 774990 - RNA, 21 nt, Homo sapiens
caaguuagaaaacauaaucuu

SEQ ID NO: 774991 - RNA, 22 nt, Homo sapiens
caaguuagaaaacauaaucuuc

SEQ ID NO: 774992 - RNA, 15 nt, Homo sapiens
caaguucuaagauuc

SEQ ID NO: 774993 - RNA, 18 nt, Homo sapiens
caaguucuagaaggucuc

SEQ ID NO: 774994 - RNA, 13 nt, Homo sapiens
caaguucucccca

SEQ ID NO: 774995 - RNA, 18 nt, Homo sapiens
caaguucuggaucuuaua

SEQ ID NO: 774996 - RNA, 18 nt, Homo sapiens
caaguugcuuuuaccuga

SEQ ID NO: 774997 - RNA, 16 nt, Homo sapiens
caaguuguguuugaua

SEQ ID NO: 774998 - RNA, 14 nt, Homo sapiens
caaguuucagugaa

SEQ ID NO: 774999 - RNA, 18 nt, Homo sapiens
caaguuucuagcuagaaa

SEQ ID NO: 775000 - RNA, 23 nt, Homo sapiens
caaguuucugauaccacugcacu

SEQ ID NO: 775001 - RNA, 19 nt, Homo sapiens
caauaaaagugacucucag

SEQ ID NO: 775002 - RNA, 14 nt, Homo sapiens
caauaaaaguguga

SEQ ID NO: 775003 - RNA, 21 nt, Homo sapiens
caauaaagauauuuccaagaa

SEQ ID NO: 775004 - RNA, 17 nt, Homo sapiens
caauaaagcacugagca

SEQ ID NO: 775005 - RNA, 18 nt, Homo sapiens
caauaaagcacugagcaa

SEQ ID NO: 775006 - RNA, 18 nt, Homo sapiens
caauaaaggcagcugccu

SEQ ID NO: 775007 - RNA, 17 nt, Homo sapiens
caauaaagugacccugu

SEQ ID NO: 775008 - RNA, 19 nt, Homo sapiens
caauaaauaccagacacgu

SEQ ID NO: 775009 - RNA, 16 nt, Homo sapiens
caauaaaucuuuggaa

SEQ ID NO: 775010 - RNA, 17 nt, Homo sapiens
caauaaaugaaugaaua

SEQ ID NO: 775011 - RNA, 13 nt, Homo sapiens
caauaacaaacug

SEQ ID NO: 775012 - RNA, 13 nt, Homo sapiens
caauaacauuccc

SEQ ID NO: 775013 - RNA, 16 nt, Homo sapiens
caauaacuauuuuucc

SEQ ID NO: 775014 - RNA, 20 nt, Homo sapiens
caauaacuuuucaccaauga

SEQ ID NO: 775015 - RNA, 23 nt, Homo sapiens
caauaauauuucaagugccuaga

SEQ ID NO: 775016 - RNA, 13 nt, Homo sapiens
caauaaucucuau

SEQ ID NO: 775017 - RNA, 14 nt, Homo sapiens
caauaauuacugua

SEQ ID NO: 775018 - RNA, 17 nt, Homo sapiens
caauaauugcagaacua

SEQ ID NO: 775019 - RNA, 23 nt, Homo sapiens
caauacauuuguauuuugugaug

SEQ ID NO: 775020 - RNA, 14 nt, Homo sapiens
caauaccagugaca

SEQ ID NO: 775021 - RNA, 15 nt, Homo sapiens
caauaccagugacac

SEQ ID NO: 775022 - RNA, 14 nt, Homo sapiens
caauacccaccucu

SEQ ID NO: 775023 - RNA, 12 nt, Homo sapiens
caauacuacuga

SEQ ID NO: 775024 - RNA, 21 nt, Homo sapiens
caauacuguaggaacaagcau

SEQ ID NO: 775025 - RNA, 20 nt, Homo sapiens
caauacuguuuccauuuuaa

SEQ ID NO: 775026 - RNA, 18 nt, Homo sapiens
caauagaguugggacaau

SEQ ID NO: 775027 - RNA, 14 nt, Homo sapiens
caauagauauuuac

SEQ ID NO: 775028 - RNA, 22 nt, Homo sapiens
caauaggugagagaauguauuu

SEQ ID NO: 775029 - RNA, 23 nt, Homo sapiens
caauagucucucugcaagacaga

SEQ ID NO: 775030 - RNA, 21 nt, Homo sapiens
caauagugaaaugccacaccu

SEQ ID NO: 775031 - RNA, 23 nt, Homo sapiens
caauaucuaauauauaugaauaa

SEQ ID NO: 775032 - RNA, 13 nt, Homo sapiens
caauaucuugcca

SEQ ID NO: 775033 - RNA, 18 nt, Homo sapiens
caauaugggcucaaguca

SEQ ID NO: 775034 - RNA, 16 nt, Homo sapiens
caauauuaaauacaga

SEQ ID NO: 775035 - RNA, 21 nt, Homo sapiens
caauauuccaguaaaugcaga

SEQ ID NO: 775036 - RNA, 16 nt, Homo sapiens
caauauuucugauaua

SEQ ID NO: 775037 - RNA, 17 nt, Homo sapiens
caauauuugguauuuca

SEQ ID NO: 775038 - RNA, 13 nt, Homo sapiens
caauauuuugccu

SEQ ID NO: 775039 - RNA, 14 nt, Homo sapiens
caaucagcccagug

SEQ ID NO: 775040 - RNA, 18 nt, Homo sapiens
caaucagcccagugcaaa

SEQ ID NO: 775041 - RNA, 15 nt, Homo sapiens
caaucagugcaguga

SEQ ID NO: 775042 - RNA, 15 nt, Homo sapiens
caaucaguugacuuu

SEQ ID NO: 775043 - RNA, 17 nt, Homo sapiens
caaucauuuauucauug

SEQ ID NO: 775044 - RNA, 22 nt, Homo sapiens
caaucccugaggacugauuuca

SEQ ID NO: 775045 - RNA, 18 nt, Homo sapiens
caauccgaaguaugaggg

SEQ ID NO: 775046 - RNA, 16 nt, Homo sapiens
caauccugucauauaa

SEQ ID NO: 775047 - RNA, 17 nt, Homo sapiens
caauccugucauauaau

SEQ ID NO: 775048 - RNA, 19 nt, Homo sapiens
caaucuaagggucucucau

SEQ ID NO: 775049 - RNA, 15 nt, Homo sapiens
caaucuauguuugca

SEQ ID NO: 775050 - RNA, 20 nt, Homo sapiens
caaucucccacagggugcug

SEQ ID NO: 775051 - RNA, 19 nt, Homo sapiens
caaucucggcucacugcaa

SEQ ID NO: 775052 - RNA, 21 nt, Homo sapiens
caaucugagccagugcuuuaa

SEQ ID NO: 775053 - RNA, 12 nt, Homo sapiens
caaucuguaaac

SEQ ID NO: 775054 - RNA, 13 nt, Homo sapiens
caaucuguucaau

SEQ ID NO: 775055 - RNA, 17 nt, Homo sapiens
caaucuguucaauguuu

SEQ ID NO: 775056 - RNA, 19 nt, Homo sapiens
caaucuuaaaacaaauuca

SEQ ID NO: 775057 - RNA, 17 nt, Homo sapiens
caaugaagaauuaugua

SEQ ID NO: 775058 - RNA, 17 nt, Homo sapiens
caaugacacccaugcca

SEQ ID NO: 775059 - RNA, 15 nt, Homo sapiens
caaugaccuggagca

SEQ ID NO: 775060 - RNA, 13 nt, Homo sapiens
caaugaccuguau

SEQ ID NO: 775061 - RNA, 19 nt, Homo sapiens
caaugacuuaaccauauaa

SEQ ID NO: 775062 - RNA, 14 nt, Homo sapiens
caaugaugaaauau

SEQ ID NO: 775063 - RNA, 19 nt, Homo sapiens
caaugaugaaauauaauca

SEQ ID NO: 775064 - RNA, 19 nt, Homo sapiens
caaugcaaagauucacaua

SEQ ID NO: 775065 - RNA, 17 nt, Homo sapiens
caaugcaaaguaaaaaa

SEQ ID NO: 775066 - RNA, 14 nt, Homo sapiens
caaugccauuucag

SEQ ID NO: 775067 - RNA, 15 nt, Homo sapiens
caaugcuaucacugu

SEQ ID NO: 775068 - RNA, 14 nt, Homo sapiens
caaugcucaacucc

SEQ ID NO: 775069 - RNA, 21 nt, Homo sapiens
caauggaguggcugccaugga

SEQ ID NO: 775070 - RNA, 21 nt, Homo sapiens
caauggggccagucaggccca

SEQ ID NO: 775071 - RNA, 13 nt, Homo sapiens
caaugguggugca

SEQ ID NO: 775072 - RNA, 16 nt, Homo sapiens
caaugguggugcacca

SEQ ID NO: 775073 - RNA, 14 nt, Homo sapiens
caaugguguagcug

SEQ ID NO: 775074 - RNA, 23 nt, Homo sapiens
caauggugucaguauccaggcuu

SEQ ID NO: 775075 - RNA, 23 nt, Homo sapiens
caaugguuugugucaaaacuggu

SEQ ID NO: 775076 - RNA, 19 nt, Homo sapiens
caauguacaauuaugucuc

SEQ ID NO: 775077 - RNA, 13 nt, Homo sapiens
caauguaucuuua

SEQ ID NO: 775078 - RNA, 12 nt, Homo sapiens
caaugucauguc

SEQ ID NO: 775079 - RNA, 17 nt, Homo sapiens
caaugucuuuugacagg

SEQ ID NO: 775080 - RNA, 12 nt, Homo sapiens
caaugugcugcu

SEQ ID NO: 775081 - RNA, 17 nt, Homo sapiens
caauguuccauucuucg

SEQ ID NO: 775082 - RNA, 18 nt, Homo sapiens
caauguuuuuaaaaaucu

SEQ ID NO: 775083 - RNA, 19 nt, Homo sapiens
caauguuuuuaaaaaucug

SEQ ID NO: 775084 - RNA, 20 nt, Homo sapiens
caauuaaaacuaagcacaaa

SEQ ID NO: 775085 - RNA, 18 nt, Homo sapiens
caauuacaacagugagaa

SEQ ID NO: 775086 - RNA, 21 nt, Homo sapiens
caauuagcauuauguuuugca

SEQ ID NO: 775087 - RNA, 21 nt, Homo sapiens
caauuauagugucaugcagag

SEQ ID NO: 775088 - RNA, 15 nt, Homo sapiens
cacagaaacacugcc

SEQ ID NO: 775089 - RNA, 20 nt, Homo sapiens
cacagaaagacugagcucaa

SEQ ID NO: 775090 - RNA, 22 nt, Homo sapiens
cacagacacacacacgcacgca

SEQ ID NO: 775091 - RNA, 16 nt, Homo sapiens
cacagaccaccugcuu

SEQ ID NO: 775092 - RNA, 21 nt, Homo sapiens
cacagagacaaggagggcaca

SEQ ID NO: 775093 - RNA, 18 nt, Homo sapiens
cacagagcaggaagccga

SEQ ID NO: 775094 - RNA, 18 nt, Homo sapiens
cacagagcugaguccucu

SEQ ID NO: 775095 - RNA, 14 nt, Homo sapiens
cacagagugcauug

SEQ ID NO: 775096 - RNA, 17 nt, Homo sapiens
cacagagugugcugcua

SEQ ID NO: 775097 - RNA, 15 nt, Homo sapiens
cacagaucacagcuu

SEQ ID NO: 775098 - RNA, 17 nt, Homo sapiens
cacagaucacagcuuca

SEQ ID NO: 775099 - RNA, 17 nt, Homo sapiens
cacagaugauacuucca

SEQ ID NO: 775100 - RNA, 13 nt, Homo sapiens
cacagcacuugag

SEQ ID NO: 775101 - RNA, 13 nt, Homo sapiens
cacagcacuuugg

SEQ ID NO: 775102 - RNA, 11 nt, Homo sapiens
cacagccaaac

SEQ ID NO: 775103 - RNA, 20 nt, Homo sapiens
cacagccagacuugcuuccu

SEQ ID NO: 775104 - RNA, 16 nt, Homo sapiens
cacagcccccuccuca

SEQ ID NO: 775105 - RNA, 23 nt, Homo sapiens
cacagcccucaugaucauucuca

SEQ ID NO: 775106 - RNA, 22 nt, Homo sapiens
cacagccugacacagugcucga

SEQ ID NO: 775107 - RNA, 20 nt, Homo sapiens
cacagcgagacuccgucuca

SEQ ID NO: 775108 - RNA, 17 nt, Homo sapiens
cacagcgcuaugcaauu

SEQ ID NO: 775109 - RNA, 21 nt, Homo sapiens
cacagcggaggagaccagcuc

SEQ ID NO: 775110 - RNA, 15 nt, Homo sapiens
cacagcgugggaacu

SEQ ID NO: 775111 - RNA, 17 nt, Homo sapiens
cacagcucagcugccca

SEQ ID NO: 775112 - RNA, 17 nt, Homo sapiens
cacagcucuucauucca

SEQ ID NO: 775113 - RNA, 16 nt, Homo sapiens
cacagcugaacuauuu

SEQ ID NO: 775114 - RNA, 16 nt, Homo sapiens
cacagcugaacuuguu

SEQ ID NO: 775115 - RNA, 19 nt, Homo sapiens
cacagcugcagcugaucca

SEQ ID NO: 775116 - RNA, 13 nt, Homo sapiens
cacagcugcccua

SEQ ID NO: 775117 - RNA, 15 nt, Homo sapiens
cacagcuggacaggu

SEQ ID NO: 775118 - RNA, 16 nt, Homo sapiens
cacagcuggcucugac

SEQ ID NO: 775119 - RNA, 22 nt, Homo sapiens
cacagcuguaguaccccaagaa

SEQ ID NO: 775120 - RNA, 19 nt, Homo sapiens
cacagcuuagaagugcuau

SEQ ID NO: 775121 - RNA, 21 nt, Homo sapiens
cacagcuuagaagugcuauaa

SEQ ID NO: 775122 - RNA, 18 nt, Homo sapiens
cacagcuucuccaagcau

SEQ ID NO: 775123 - RNA, 12 nt, Homo sapiens
cacagcuuuaug

SEQ ID NO: 775124 - RNA, 22 nt, Homo sapiens
cacaggaaaccaacacccaaag

SEQ ID NO: 775125 - RNA, 20 nt, Homo sapiens
cacaggaacaacagcaucuu

SEQ ID NO: 775126 - RNA, 16 nt, Homo sapiens
cacaggaauucucaag

SEQ ID NO: 775127 - RNA, 14 nt, Homo sapiens
cacaggccugagau

SEQ ID NO: 775128 - RNA, 19 nt, Homo sapiens
cacaggccugagauuucau

SEQ ID NO: 775129 - RNA, 20 nt, Homo sapiens
cacaggcuaucaacauguua

SEQ ID NO: 775130 - RNA, 17 nt, Homo sapiens
cacagggcccgcagugc

SEQ ID NO: 775131 - RNA, 19 nt, Homo sapiens
cacagggcccgcagugcug

SEQ ID NO: 775132 - RNA, 15 nt, Homo sapiens
cacagggucugcucu

SEQ ID NO: 775133 - RNA, 23 nt, Homo sapiens
cacaggguuuuguauucuuuacu

SEQ ID NO: 775134 - RNA, 12 nt, Homo sapiens
cacaggugggag

SEQ ID NO: 775135 - RNA, 16 nt, Homo sapiens
cacagguucaugccac

SEQ ID NO: 775136 - RNA, 16 nt, Homo sapiens
cacaguaagucauuua

SEQ ID NO: 775137 - RNA, 20 nt, Homo sapiens
cacaguacaauaauguacuc

SEQ ID NO: 775138 - RNA, 18 nt, Homo sapiens
cacaguaccggauucucu

SEQ ID NO: 775139 - RNA, 14 nt, Homo sapiens
cacagugaauccag

SEQ ID NO: 775140 - RNA, 14 nt, Homo sapiens
cacagugacuuccu

SEQ ID NO: 775141 - RNA, 21 nt, Homo sapiens
cacagugagaccccuucucaa

SEQ ID NO: 775142 - RNA, 16 nt, Homo sapiens
cacagugccacccaug

SEQ ID NO: 775143 - RNA, 20 nt, Homo sapiens
cacaguggcggcaacauuga

SEQ ID NO: 775144 - RNA, 18 nt, Homo sapiens
cacaguuagguagcuuua

SEQ ID NO: 775145 - RNA, 15 nt, Homo sapiens
cacaguugccaugua

SEQ ID NO: 775146 - RNA, 22 nt, Homo sapiens
cacaguugugguacugucauug

SEQ ID NO: 775147 - RNA, 22 nt, Homo sapiens
cacaguuuuaauaagaacagau

SEQ ID NO: 775148 - RNA, 20 nt, Homo sapiens
cacauaaaagacacagaaca

SEQ ID NO: 775149 - RNA, 17 nt, Homo sapiens
cacauaauucuguuacu

SEQ ID NO: 775150 - RNA, 19 nt, Homo sapiens
cacauacaugucacauuua

SEQ ID NO: 775151 - RNA, 23 nt, Homo sapiens
cacauaccuggcccugugccuug

SEQ ID NO: 775152 - RNA, 14 nt, Homo sapiens
cacauacgugcaca

SEQ ID NO: 775153 - RNA, 17 nt, Homo sapiens
cacauauaucaaaguga

SEQ ID NO: 775154 - RNA, 22 nt, Homo sapiens
cacauauaucaaagugagaaaa

SEQ ID NO: 775155 - RNA, 17 nt, Homo sapiens
cacauauggacucugca

SEQ ID NO: 775156 - RNA, 15 nt, Homo sapiens
cacauccaucagcac

SEQ ID NO: 775157 - RNA, 21 nt, Homo sapiens
cacaucccauugggacuccau

SEQ ID NO: 775158 - RNA, 13 nt, Homo sapiens
cacaucugucacg

SEQ ID NO: 775159 - RNA, 13 nt, Homo sapiens
cacaucuguuuca

SEQ ID NO: 775160 - RNA, 15 nt, Homo sapiens
cacaucuuguaacuu

SEQ ID NO: 775161 - RNA, 16 nt, Homo sapiens
cacaucuuguaacuua

SEQ ID NO: 775162 - RNA, 19 nt, Homo sapiens
cacaugaaaccuacacacu

SEQ ID NO: 775163 - RNA, 17 nt, Homo sapiens
cacaugaauaauuucac

SEQ ID NO: 775164 - RNA, 14 nt, Homo sapiens
cacaugaggccauc

SEQ ID NO: 775165 - RNA, 16 nt, Homo sapiens
cacaugcccaugauga

SEQ ID NO: 775166 - RNA, 15 nt, Homo sapiens
cacaugccuugcaau

SEQ ID NO: 775167 - RNA, 13 nt, Homo sapiens
cacaugcuauguu

SEQ ID NO: 775168 - RNA, 14 nt, Homo sapiens
cacauggaacuuua

SEQ ID NO: 775169 - RNA, 15 nt, Homo sapiens
cacauggccuaugca

SEQ ID NO: 775170 - RNA, 22 nt, Homo sapiens
cacaugggcagaaaaauggugg

SEQ ID NO: 775171 - RNA, 17 nt, Homo sapiens
cacauggugugagucca

SEQ ID NO: 775172 - RNA, 19 nt, Homo sapiens
cacauguauugacaacagu

SEQ ID NO: 775173 - RNA, 19 nt, Homo sapiens
cacaugucuuguacaugug

SEQ ID NO: 775174 - RNA, 19 nt, Homo sapiens
cacaugugacacauaugca

SEQ ID NO: 775175 - RNA, 15 nt, Homo sapiens
cacauguggggacag

SEQ ID NO: 775176 - RNA, 13 nt, Homo sapiens
cacauuagcuugu

SEQ ID NO: 775177 - RNA, 21 nt, Homo sapiens
cacauuaguacuuauguugca

SEQ ID NO: 775178 - RNA, 20 nt, Homo sapiens
cacauuaucgggagcagugu

SEQ ID NO: 775179 - RNA, 13 nt, Homo sapiens
cacauuccaaacu

SEQ ID NO: 775180 - RNA, 22 nt, Homo sapiens
cacauucuauuuuggguauuaa

SEQ ID NO: 775181 - RNA, 12 nt, Homo sapiens
cacauugccuuc

SEQ ID NO: 775182 - RNA, 13 nt, Homo sapiens
cacauugcuguau

SEQ ID NO: 775183 - RNA, 15 nt, Homo sapiens
cacauuuaccaguau

SEQ ID NO: 775184 - RNA, 20 nt, Homo sapiens
cacauuucuuugcauuccag

SEQ ID NO: 775185 - RNA, 20 nt, Homo sapiens
cacauuuuuaaaagaacaau

SEQ ID NO: 775186 - RNA, 15 nt, Homo sapiens
caccaaaaagggauc

SEQ ID NO: 775187 - RNA, 15 nt, Homo sapiens
caccaaccugcauuu

SEQ ID NO: 775188 - RNA, 21 nt, Homo sapiens
caccaacgagcuguacaugau

SEQ ID NO: 775189 - RNA, 19 nt, Homo sapiens
caccaacuugccacauguu

SEQ ID NO: 775190 - RNA, 15 nt, Homo sapiens
caccaaguaccagua

SEQ ID NO: 775191 - RNA, 20 nt, Homo sapiens
caccaauggauuguggaaaa

SEQ ID NO: 775192 - RNA, 14 nt, Homo sapiens
caccacagacacac

SEQ ID NO: 775193 - RNA, 13 nt, Homo sapiens
caccacaguguuu

SEQ ID NO: 775194 - RNA, 13 nt, Homo sapiens
caccaccaaucac

SEQ ID NO: 775195 - RNA, 16 nt, Homo sapiens
caccaccacacuacac

SEQ ID NO: 775196 - RNA, 14 nt, Homo sapiens
caccaccaccggcc

SEQ ID NO: 775197 - RNA, 19 nt, Homo sapiens
caccacggcguuguaccug

SEQ ID NO: 775198 - RNA, 22 nt, Homo sapiens
caccacugaaacccugcacuua

SEQ ID NO: 775199 - RNA, 20 nt, Homo sapiens
caccagagagagauucuucc

SEQ ID NO: 775200 - RNA, 20 nt, Homo sapiens
caccagagauaauaugagaa

SEQ ID NO: 775201 - RNA, 16 nt, Homo sapiens
caccagaggcugcaau

SEQ ID NO: 775202 - RNA, 12 nt, Homo sapiens
caccagcuccac

SEQ ID NO: 775203 - RNA, 22 nt, Homo sapiens
caugcaaguuacugcaguucau

SEQ ID NO: 775204 - RNA, 22 nt, Homo sapiens
caugcacacacacacaucucau

SEQ ID NO: 775205 - RNA, 14 nt, Homo sapiens
caugcacacggcug

SEQ ID NO: 775206 - RNA, 14 nt, Homo sapiens
caugcacacgggaa

SEQ ID NO: 775207 - RNA, 23 nt, Homo sapiens
caugcacacgggaaagccuuaaa

SEQ ID NO: 775208 - RNA, 13 nt, Homo sapiens
caugcacugaccc

SEQ ID NO: 775209 - RNA, 13 nt, Homo sapiens
caugcacugaugu

SEQ ID NO: 775210 - RNA, 18 nt, Homo sapiens
caugcaggaucagcucca

SEQ ID NO: 775211 - RNA, 18 nt, Homo sapiens
caugcaguugugggaccg

SEQ ID NO: 775212 - RNA, 18 nt, Homo sapiens
caugcaugacacuuccaa

SEQ ID NO: 775213 - RNA, 18 nt, Homo sapiens
caugcauguccuguaaag

SEQ ID NO: 775214 - RNA, 17 nt, Homo sapiens
caugcaugugcauauag

SEQ ID NO: 775215 - RNA, 16 nt, Homo sapiens
caugcauguuugguua

SEQ ID NO: 775216 - RNA, 11 nt, Homo sapiens
caugcauuuga

SEQ ID NO: 775217 - RNA, 19 nt, Homo sapiens
caugccacccuguuuucag

SEQ ID NO: 775218 - RNA, 18 nt, Homo sapiens
caugccccuaaucccagc

SEQ ID NO: 775219 - RNA, 18 nt, Homo sapiens
caugccgacgcuugcacg

SEQ ID NO: 775220 - RNA, 16 nt, Homo sapiens
caugccuauuucugaa

SEQ ID NO: 775221 - RNA, 20 nt, Homo sapiens
caugccucugauaugggacu

SEQ ID NO: 775222 - RNA, 22 nt, Homo sapiens
caugccugccccccucaucuca

SEQ ID NO: 775223 - RNA, 21 nt, Homo sapiens
caugcucacacauuacaacag

SEQ ID NO: 775224 - RNA, 21 nt, Homo sapiens
caugcugcuggggaagacagu

SEQ ID NO: 775225 - RNA, 13 nt, Homo sapiens
caugcuggggcaa

SEQ ID NO: 775226 - RNA, 21 nt, Homo sapiens
caugcugugugcuggagacac

SEQ ID NO: 775227 - RNA, 22 nt, Homo sapiens
caugcuguuuucccuuugccac

SEQ ID NO: 775228 - RNA, 14 nt, Homo sapiens
caugcuugacauac

SEQ ID NO: 775229 - RNA, 22 nt, Homo sapiens
caugcuugcauuauauuuguaa

SEQ ID NO: 775230 - RNA, 23 nt, Homo sapiens
caugcuuuagauuauauauuccg

SEQ ID NO: 775231 - RNA, 17 nt, Homo sapiens
cauggaaagacugggac

SEQ ID NO: 775232 - RNA, 23 nt, Homo sapiens
cauggaacucauuccugccuguc

SEQ ID NO: 775233 - RNA, 18 nt, Homo sapiens
cauggaaguuuauuucca

SEQ ID NO: 775234 - RNA, 15 nt, Homo sapiens
cauggaauauuucca

SEQ ID NO: 775235 - RNA, 16 nt, Homo sapiens
cauggaaucgaagugu

SEQ ID NO: 775236 - RNA, 18 nt, Homo sapiens
cauggaauggcagguguc

SEQ ID NO: 775237 - RNA, 19 nt, Homo sapiens
cauggaccaagaaugagcu

SEQ ID NO: 775238 - RNA, 20 nt, Homo sapiens
cauggagacguggugggacu

SEQ ID NO: 775239 - RNA, 21 nt, Homo sapiens
cauggagacguggugggacuc

SEQ ID NO: 775240 - RNA, 17 nt, Homo sapiens
cauggaggaacaguauu

SEQ ID NO: 775241 - RNA, 22 nt, Homo sapiens
cauggaggccaagaacuugcaa

SEQ ID NO: 775242 - RNA, 23 nt, Homo sapiens
cauggaggccaagaacuugcaau

SEQ ID NO: 775243 - RNA, 16 nt, Homo sapiens
cauggaggucauacau

SEQ ID NO: 775244 - RNA, 19 nt, Homo sapiens
cauggauucagcaugucca

SEQ ID NO: 775245 - RNA, 20 nt, Homo sapiens
cauggcaccugucgcccagu

SEQ ID NO: 775246 - RNA, 23 nt, Homo sapiens
cauggcagaguuuguguguuguc

SEQ ID NO: 775247 - RNA, 15 nt, Homo sapiens
cauggcagccaucaa

SEQ ID NO: 775248 - RNA, 18 nt, Homo sapiens
cauggcagcuguuucuca

SEQ ID NO: 775249 - RNA, 22 nt, Homo sapiens
cauggcagcuguuucucaugaa

SEQ ID NO: 775250 - RNA, 19 nt, Homo sapiens
cauggccaccccgugccac

SEQ ID NO: 775251 - RNA, 21 nt, Homo sapiens
cauggcccccaauaaaggcag

SEQ ID NO: 775252 - RNA, 21 nt, Homo sapiens
cauggcccuucaaauuggaau

SEQ ID NO: 775253 - RNA, 20 nt, Homo sapiens
cauggccgggcccucuguag

SEQ ID NO: 775254 - RNA, 15 nt, Homo sapiens
cauggccuaugcaca

SEQ ID NO: 775255 - RNA, 17 nt, Homo sapiens
cauggcgaggcugaggu

SEQ ID NO: 775256 - RNA, 15 nt, Homo sapiens
caugggggcacuuga

SEQ ID NO: 775257 - RNA, 17 nt, Homo sapiens
cauggguggaaagugcu

SEQ ID NO: 775258 - RNA, 21 nt, Homo sapiens
caugguaaugaaggacaguga

SEQ ID NO: 775259 - RNA, 20 nt, Homo sapiens
cauggucuaauuauuuacuc

SEQ ID NO: 775260 - RNA, 15 nt, Homo sapiens
cauggugcacugagc

SEQ ID NO: 775261 - RNA, 23 nt, Homo sapiens
cauggugcuggggagccaaaggc

SEQ ID NO: 775262 - RNA, 20 nt, Homo sapiens
caugguggcgcaugccugua

SEQ ID NO: 775263 - RNA, 21 nt, Homo sapiens
cauggugggagagacugugag

SEQ ID NO: 775264 - RNA, 22 nt, Homo sapiens
caugguguauaugugccacauu

SEQ ID NO: 775265 - RNA, 20 nt, Homo sapiens
cauggugugaguccaaagaa

SEQ ID NO: 775266 - RNA, 22 nt, Homo sapiens
caugguuuugugccaucuguag

SEQ ID NO: 775267 - RNA, 15 nt, Homo sapiens
cauguaauauauuuc

SEQ ID NO: 775268 - RNA, 17 nt, Homo sapiens
cauguaaucagauuuau

SEQ ID NO: 775269 - RNA, 14 nt, Homo sapiens
cauguaauccuuuu

SEQ ID NO: 775270 - RNA, 20 nt, Homo sapiens
cauguacagacauacauuua

SEQ ID NO: 775271 - RNA, 16 nt, Homo sapiens
cauguacauacccugg

SEQ ID NO: 775272 - RNA, 12 nt, Homo sapiens
cauguacaugaa

SEQ ID NO: 775273 - RNA, 15 nt, Homo sapiens
cauguaccaucaaua

SEQ ID NO: 775274 - RNA, 20 nt, Homo sapiens
cauguacucaaguaccacca

SEQ ID NO: 775275 - RNA, 12 nt, Homo sapiens
cauguagcuguu

SEQ ID NO: 775276 - RNA, 20 nt, Homo sapiens
cauguaucuuuugaacuggc

SEQ ID NO: 775277 - RNA, 18 nt, Homo sapiens
cauguaugcaaaccucau

SEQ ID NO: 775278 - RNA, 21 nt, Homo sapiens
cauguauggacgugugugaau

SEQ ID NO: 775279 - RNA, 17 nt, Homo sapiens
cauguaugucuuggaca

SEQ ID NO: 775280 - RNA, 13 nt, Homo sapiens
caugucacauuua

SEQ ID NO: 775281 - RNA, 12 nt, Homo sapiens
caugucaccuca

SEQ ID NO: 775282 - RNA, 13 nt, Homo sapiens
caugucaccucag

SEQ ID NO: 775283 - RNA, 23 nt, Homo sapiens
caugucaccucagcugauauuau

SEQ ID NO: 775284 - RNA, 15 nt, Homo sapiens
cauguccuaauucuu

SEQ ID NO: 775285 - RNA, 16 nt, Homo sapiens
caugucuauucagcuu

SEQ ID NO: 775286 - RNA, 14 nt, Homo sapiens
caugugaagagaau

SEQ ID NO: 775287 - RNA, 16 nt, Homo sapiens
caugugaaguguauau

SEQ ID NO: 775288 - RNA, 18 nt, Homo sapiens
caugugagucccugugau

SEQ ID NO: 775289 - RNA, 12 nt, Homo sapiens
caugugcacauu

SEQ ID NO: 775290 - RNA, 21 nt, Homo sapiens
caugugccaagauucuacucu

SEQ ID NO: 775291 - RNA, 14 nt, Homo sapiens
caugugccugucac

SEQ ID NO: 775292 - RNA, 11 nt, Homo sapiens
caugugccuuu

SEQ ID NO: 775293 - RNA, 19 nt, Homo sapiens
caugugcgcgcgugcaugu

SEQ ID NO: 775294 - RNA, 21 nt, Homo sapiens
caugugcggggaucaucugcc

SEQ ID NO: 775295 - RNA, 17 nt, Homo sapiens
caugugcuagucacugg

SEQ ID NO: 775296 - RNA, 16 nt, Homo sapiens
caugugcuggguggua

SEQ ID NO: 775297 - RNA, 15 nt, Homo sapiens
cauguggacuggugc

SEQ ID NO: 775298 - RNA, 19 nt, Homo sapiens
cauguggccuuuaucucaa

SEQ ID NO: 775299 - RNA, 11 nt, Homo sapiens
cauguguuucu

SEQ ID NO: 775300 - RNA, 22 nt, Homo sapiens
cauguuaagauaacuuacugua

SEQ ID NO: 775301 - RNA, 21 nt, Homo sapiens
cauguuaaugaacaguguacc

SEQ ID NO: 775302 - RNA, 17 nt, Homo sapiens
cauguuacugaccagca

SEQ ID NO: 775303 - RNA, 22 nt, Homo sapiens
cauguuacuuuauucagagcua

SEQ ID NO: 775304 - RNA, 22 nt, Homo sapiens
cauguuggccaggcuggucuca

SEQ ID NO: 775305 - RNA, 24 nt, Homo sapiens
cauguuggccaggcuggucucaaa

SEQ ID NO: 775306 - RNA, 16 nt, Homo sapiens
cauguuguacauuuca

SEQ ID NO: 775307 - RNA, 22 nt, Homo sapiens
cauguuuauuuauuuccagugg

SEQ ID NO: 775308 - RNA, 15 nt, Homo sapiens
cauguuugcaccugu

SEQ ID NO: 775309 - RNA, 13 nt, Homo sapiens
cauguuuuaggga

SEQ ID NO: 775310 - RNA, 23 nt, Homo sapiens
cauguuuugccacccccugugag

SEQ ID NO: 775311 - RNA, 22 nt, Homo sapiens
cauuaaaauauagagacaggac

SEQ ID NO: 775312 - RNA, 18 nt, Homo sapiens
cauuaaaucuugaacuuu

SEQ ID NO: 775313 - RNA, 13 nt, Homo sapiens
cauuaaaugacaa

SEQ ID NO: 775314 - RNA, 15 nt, Homo sapiens
cauuaacugcacaaa

SEQ ID NO: 775315 - RNA, 22 nt, Homo sapiens
cauuaacuggugaauggaguca

SEQ ID NO: 775316 - RNA, 18 nt, Homo sapiens
cauuaagguuaugcacug

SEQ ID NO: 775317 - RNA, 14 nt, Homo sapiens
ccagaggugcuucu

SEQ ID NO: 775318 - RNA, 16 nt, Homo sapiens
ccagaguggagucuga

SEQ ID NO: 775319 - RNA, 20 nt, Homo sapiens
ccagaguugcugggagcuga

SEQ ID NO: 775320 - RNA, 17 nt, Homo sapiens
ccagaguuuacauucua

SEQ ID NO: 775321 - RNA, 22 nt, Homo sapiens
ccagauaacuuucggcagguuc

SEQ ID NO: 775322 - RNA, 18 nt, Homo sapiens
ccagauauaacugucuug

SEQ ID NO: 775323 - RNA, 17 nt, Homo sapiens
ccagaucacugccacac

SEQ ID NO: 775324 - RNA, 22 nt, Homo sapiens
ccagaucacugccacacucucc

SEQ ID NO: 775325 - RNA, 19 nt, Homo sapiens
ccagaucgcaccacugcac

SEQ ID NO: 775326 - RNA, 21 nt, Homo sapiens
ccagaugaacugacugaagga

SEQ ID NO: 775327 - RNA, 18 nt, Homo sapiens
ccagaugagaagucugcu

SEQ ID NO: 775328 - RNA, 19 nt, Homo sapiens
ccagaugagaagucugcua

SEQ ID NO: 775329 - RNA, 13 nt, Homo sapiens
ccagaugauccca

SEQ ID NO: 775330 - RNA, 19 nt, Homo sapiens
ccagaugugaaaacaucuc

SEQ ID NO: 775331 - RNA, 15 nt, Homo sapiens
ccagauguuggacca

SEQ ID NO: 775332 - RNA, 16 nt, Homo sapiens
ccagauguuggaccaa

SEQ ID NO: 775333 - RNA, 16 nt, Homo sapiens
ccagauguuguuccug

SEQ ID NO: 775334 - RNA, 19 nt, Homo sapiens
ccagauuggcucacacuga

SEQ ID NO: 775335 - RNA, 22 nt, Homo sapiens
ccagauuggcucacacugagaa

SEQ ID NO: 775336 - RNA, 21 nt, Homo sapiens
ccagauuguaguuauacuuuu

SEQ ID NO: 775337 - RNA, 17 nt, Homo sapiens
ccagauuucauucucag

SEQ ID NO: 775338 - RNA, 16 nt, Homo sapiens
ccagcaaccagcacau

SEQ ID NO: 775339 - RNA, 15 nt, Homo sapiens
ccagcaccaccuaca

SEQ ID NO: 775340 - RNA, 21 nt, Homo sapiens
ccagcacccaccugguacuga

SEQ ID NO: 775341 - RNA, 12 nt, Homo sapiens
ccagcacccaga

SEQ ID NO: 775342 - RNA, 17 nt, Homo sapiens
ccagcacccugcaaaau

SEQ ID NO: 775343 - RNA, 10 nt, Homo sapiens
ccagcacuuc

SEQ ID NO: 775344 - RNA, 19 nt, Homo sapiens
ccagcacuuugguaggcaa

SEQ ID NO: 775345 - RNA, 17 nt, Homo sapiens
ccagcagcagagaacca

SEQ ID NO: 775346 - RNA, 20 nt, Homo sapiens
ccagcaggagcucugacuaa

SEQ ID NO: 775347 - RNA, 18 nt, Homo sapiens
ccagcagggccucaaagu

SEQ ID NO: 775348 - RNA, 12 nt, Homo sapiens
ccagcaucugca

SEQ ID NO: 775349 - RNA, 18 nt, Homo sapiens
ccagcaugguugcagaua

SEQ ID NO: 775350 - RNA, 16 nt, Homo sapiens
ccagcauuuaaccaac

SEQ ID NO: 775351 - RNA, 22 nt, Homo sapiens
ccagcauuugguuuuacacagg

SEQ ID NO: 775352 - RNA, 23 nt, Homo sapiens
ccagcauuugguuuuacacagga

SEQ ID NO: 775353 - RNA, 23 nt, Homo sapiens
ccagcauuuuuauaaacuaccaa

SEQ ID NO: 775354 - RNA, 22 nt, Homo sapiens
ccagccaagagggcugcaaaag

SEQ ID NO: 775355 - RNA, 22 nt, Homo sapiens
ccagccaccccgggcucucugc

SEQ ID NO: 775356 - RNA, 22 nt, Homo sapiens
ccagccaucaaauagugaaugg

SEQ ID NO: 775357 - RNA, 10 nt, Homo sapiens
ccagcccaga

SEQ ID NO: 775358 - RNA, 15 nt, Homo sapiens
ccagcccagagccac

SEQ ID NO: 775359 - RNA, 14 nt, Homo sapiens
ccagcccaggaguu

SEQ ID NO: 775360 - RNA, 21 nt, Homo sapiens
ccagcccauggcccccaauaa

SEQ ID NO: 775361 - RNA, 23 nt, Homo sapiens
ccagcccauugcugccaaggugg

SEQ ID NO: 775362 - RNA, 17 nt, Homo sapiens
ccagccccacugccagc

SEQ ID NO: 775363 - RNA, 21 nt, Homo sapiens
ccagccccacugccagcagca

SEQ ID NO: 775364 - RNA, 17 nt, Homo sapiens
ccagccguauuuuacau

SEQ ID NO: 775365 - RNA, 20 nt, Homo sapiens
ccagccguauuuuacaugaa

SEQ ID NO: 775366 - RNA, 15 nt, Homo sapiens
ccagccucagaucca

SEQ ID NO: 775367 - RNA, 18 nt, Homo sapiens
ccagccugcccaacgugg

SEQ ID NO: 775368 - RNA, 22 nt, Homo sapiens
ccagccuggccaacauggugaa

SEQ ID NO: 775369 - RNA, 22 nt, Homo sapiens
ccagccugggacucccagugaa

SEQ ID NO: 775370 - RNA, 20 nt, Homo sapiens
ccagccugggcagcauagca

SEQ ID NO: 775371 - RNA, 23 nt, Homo sapiens
ccagccugugcgccgggggaccu

SEQ ID NO: 775372 - RNA, 23 nt, Homo sapiens
ccagccugugguuacagugcaga

SEQ ID NO: 775373 - RNA, 21 nt, Homo sapiens
ccagccuuccucugcagcuga

SEQ ID NO: 775374 - RNA, 16 nt, Homo sapiens
ccagcgggcacagggc

SEQ ID NO: 775375 - RNA, 16 nt, Homo sapiens
ccagcguggcgcagug

SEQ ID NO: 775376 - RNA, 15 nt, Homo sapiens
ccagcguuaacacaa

SEQ ID NO: 775377 - RNA, 18 nt, Homo sapiens
ccagcuaagaaccuggaa

SEQ ID NO: 775378 - RNA, 14 nt, Homo sapiens
ccagcuacauuccu

SEQ ID NO: 775379 - RNA, 18 nt, Homo sapiens
ccagcuacucaggagucu

SEQ ID NO: 775380 - RNA, 21 nt, Homo sapiens
ccagcuacuugggaggcugag

SEQ ID NO: 775381 - RNA, 12 nt, Homo sapiens
ccagcuaugaau

SEQ ID NO: 775382 - RNA, 23 nt, Homo sapiens
ccagcucaggacagaugccacac

SEQ ID NO: 775383 - RNA, 18 nt, Homo sapiens
ccagcucugacaucccuu

SEQ ID NO: 775384 - RNA, 13 nt, Homo sapiens
ccagcucuggagu

SEQ ID NO: 775385 - RNA, 18 nt, Homo sapiens
ccagcugcaccugccagc

SEQ ID NO: 775386 - RNA, 13 nt, Homo sapiens
ccagcugcacuga

SEQ ID NO: 775387 - RNA, 18 nt, Homo sapiens
ccagcugcacugaugcug

SEQ ID NO: 775388 - RNA, 19 nt, Homo sapiens
ccagcugccaaggaaaccc

SEQ ID NO: 775389 - RNA, 14 nt, Homo sapiens
ccagcugccgcacc

SEQ ID NO: 775390 - RNA, 20 nt, Homo sapiens
ccagcugccuuggacugugu

SEQ ID NO: 775391 - RNA, 18 nt, Homo sapiens
ccagcugcugcuggagau

SEQ ID NO: 775392 - RNA, 21 nt, Homo sapiens
ccagcuggccuggacaguauc

SEQ ID NO: 775393 - RNA, 16 nt, Homo sapiens
ccagcuguagccaugg

SEQ ID NO: 775394 - RNA, 19 nt, Homo sapiens
ccagcugugcacuuucuuc

SEQ ID NO: 775395 - RNA, 15 nt, Homo sapiens
ccagcuuaaaacacu

SEQ ID NO: 775396 - RNA, 13 nt, Homo sapiens
ccagcuuacuagc

SEQ ID NO: 775397 - RNA, 17 nt, Homo sapiens
ccagcuugggcccagcu

SEQ ID NO: 775398 - RNA, 19 nt, Homo sapiens
ccagcuuucccugccucuc

SEQ ID NO: 775399 - RNA, 14 nt, Homo sapiens
ccaggaaaggccca

SEQ ID NO: 775400 - RNA, 12 nt, Homo sapiens
ccaggaaggcag

SEQ ID NO: 775401 - RNA, 13 nt, Homo sapiens
ccaggaaugccuc

SEQ ID NO: 775402 - RNA, 15 nt, Homo sapiens
ccaggaccaagccac

SEQ ID NO: 775403 - RNA, 21 nt, Homo sapiens
ccaggacuauauuugggccug

SEQ ID NO: 775404 - RNA, 16 nt, Homo sapiens
ccaggacucacccuca

SEQ ID NO: 775405 - RNA, 14 nt, Homo sapiens
ccaggacucaguga

SEQ ID NO: 775406 - RNA, 18 nt, Homo sapiens
ccaggagaagcucagcug

SEQ ID NO: 775407 - RNA, 21 nt, Homo sapiens
ccaggagauggaaguugcagu

SEQ ID NO: 775408 - RNA, 19 nt, Homo sapiens
ccaggagcugaggauaaag

SEQ ID NO: 775409 - RNA, 22 nt, Homo sapiens
ccaggaggcccugguccuggcc

SEQ ID NO: 775410 - RNA, 22 nt, Homo sapiens
ccaggaguaccuggaccugucc

SEQ ID NO: 775411 - RNA, 14 nt, Homo sapiens
ccaggauucagcua

SEQ ID NO: 775412 - RNA, 19 nt, Homo sapiens
ccaggcacuguucaucuca

SEQ ID NO: 775413 - RNA, 14 nt, Homo sapiens
ccaggcaggggugg

SEQ ID NO: 775414 - RNA, 16 nt, Homo sapiens
ccaggcagucgggggc

SEQ ID NO: 775415 - RNA, 23 nt, Homo sapiens
ccaggcaugaaauucuuccuaau

SEQ ID NO: 775416 - RNA, 14 nt, Homo sapiens
ccaggcaugcacaa

SEQ ID NO: 775417 - RNA, 12 nt, Homo sapiens
ccaggcauuugc

SEQ ID NO: 775418 - RNA, 17 nt, Homo sapiens
ccaggccaacagcaccu

SEQ ID NO: 775419 - RNA, 18 nt, Homo sapiens
ccaggccaacaguagcca

SEQ ID NO: 775420 - RNA, 18 nt, Homo sapiens
ccaggccagagggcagug

SEQ ID NO: 775421 - RNA, 19 nt, Homo sapiens
ccaggcccaccaucaccac

SEQ ID NO: 775422 - RNA, 12 nt, Homo sapiens
ccaggcccagau

SEQ ID NO: 775423 - RNA, 17 nt, Homo sapiens
ccaggcccuacuaccca

SEQ ID NO: 775424 - RNA, 22 nt, Homo sapiens
ccaggcccugggucuugccaug

SEQ ID NO: 775425 - RNA, 18 nt, Homo sapiens
ccaggccgggguggagca

SEQ ID NO: 775426 - RNA, 16 nt, Homo sapiens
ccaggccugaccucaa

SEQ ID NO: 775427 - RNA, 15 nt, Homo sapiens
ccaggccugagcaac

SEQ ID NO: 775428 - RNA, 14 nt, Homo sapiens
ccaggcgggcucaa

SEQ ID NO: 775429 - RNA, 20 nt, Homo sapiens
ccaggcucucgcacaccucu

SEQ ID NO: 775430 - RNA, 19 nt, Homo sapiens
ccaggcugcccaucagggc

SEQ ID NO: 775431 - RNA, 17 nt, Homo sapiens
cccagauucuucagcuu

SEQ ID NO: 775432 - RNA, 12 nt, Homo sapiens
cccagauuuccu

SEQ ID NO: 775433 - RNA, 13 nt, Homo sapiens
cccagcacauggc

SEQ ID NO: 775434 - RNA, 17 nt, Homo sapiens
cccagcaccugcuccca

SEQ ID NO: 775435 - RNA, 11 nt, Homo sapiens
cccagcacuuu

SEQ ID NO: 775436 - RNA, 18 nt, Homo sapiens
cccagcacuuuagaucac

SEQ ID NO: 775437 - RNA, 12 nt, Homo sapiens
cccagcacuuuu

SEQ ID NO: 775438 - RNA, 16 nt, Homo sapiens
cccagcaucagccugu

SEQ ID NO: 775439 - RNA, 11 nt, Homo sapiens
cccagccacag

SEQ ID NO: 775440 - RNA, 14 nt, Homo sapiens
cccagccaccgaag

SEQ ID NO: 775441 - RNA, 18 nt, Homo sapiens
cccagccacgacugccau

SEQ ID NO: 775442 - RNA, 19 nt, Homo sapiens
cccagccaugcaaugccaa

SEQ ID NO: 775443 - RNA, 15 nt, Homo sapiens
cccagcccagagaca

SEQ ID NO: 775444 - RNA, 20 nt, Homo sapiens
cccagcccugggaaccacuc

SEQ ID NO: 775445 - RNA, 23 nt, Homo sapiens
cccagcccugggaaccacuccca

SEQ ID NO: 775446 - RNA, 16 nt, Homo sapiens
cccagccuacauucac

SEQ ID NO: 775447 - RNA, 16 nt, Homo sapiens
cccagccucagaucca

SEQ ID NO: 775448 - RNA, 15 nt, Homo sapiens
cccagccuucacuga

SEQ ID NO: 775449 - RNA, 18 nt, Homo sapiens
cccagcuaagaaccugga

SEQ ID NO: 775450 - RNA, 15 nt, Homo sapiens
cccagcuacucagga

SEQ ID NO: 775451 - RNA, 20 nt, Homo sapiens
cccagcuacucaggagguug

SEQ ID NO: 775452 - RNA, 13 nt, Homo sapiens
cccagcucgcugg

SEQ ID NO: 775453 - RNA, 14 nt, Homo sapiens
cccagcugcucagu

SEQ ID NO: 775454 - RNA, 23 nt, Homo sapiens
cccagcuucaaaugcaaauucau

SEQ ID NO: 775455 - RNA, 12 nt, Homo sapiens
cccagcuuccug

SEQ ID NO: 775456 - RNA, 22 nt, Homo sapiens
cccagcuuuuagaaaaugcagu

SEQ ID NO: 775457 - RNA, 13 nt, Homo sapiens
cccaggacacgac

SEQ ID NO: 775458 - RNA, 14 nt, Homo sapiens
cccaggaccagcuc

SEQ ID NO: 775459 - RNA, 14 nt, Homo sapiens
cccaggacccugaa

SEQ ID NO: 775460 - RNA, 13 nt, Homo sapiens
cccaggacugggc

SEQ ID NO: 775461 - RNA, 13 nt, Homo sapiens
cccaggaggucug

SEQ ID NO: 775462 - RNA, 14 nt, Homo sapiens
cccaggcaggucug

SEQ ID NO: 775463 - RNA, 19 nt, Homo sapiens
cccaggccagagugcagug

SEQ ID NO: 775464 - RNA, 18 nt, Homo sapiens
cccaggcccuuggcugca

SEQ ID NO: 775465 - RNA, 14 nt, Homo sapiens
cccaggcugcacug

SEQ ID NO: 775466 - RNA, 19 nt, Homo sapiens
cccaggcugcacugcagug

SEQ ID NO: 775467 - RNA, 19 nt, Homo sapiens
cccaggcuggagugcaaug

SEQ ID NO: 775468 - RNA, 18 nt, Homo sapiens
cccaggcuggagugcagu

SEQ ID NO: 775469 - RNA, 23 nt, Homo sapiens
cccaggcuggagugcaguagcac

SEQ ID NO: 775470 - RNA, 19 nt, Homo sapiens
cccaggcuggagugcagug

SEQ ID NO: 775471 - RNA, 15 nt, Homo sapiens
cccaggcugggaacu

SEQ ID NO: 775472 - RNA, 22 nt, Homo sapiens
cccaggcuucacccugaauggu

SEQ ID NO: 775473 - RNA, 17 nt, Homo sapiens
cccagggaagccaaaag

SEQ ID NO: 775474 - RNA, 15 nt, Homo sapiens
cccagggaucacugg

SEQ ID NO: 775475 - RNA, 14 nt, Homo sapiens
cccagggcaacaag

SEQ ID NO: 775476 - RNA, 24 nt, Homo sapiens
cccagggcacuacauaauugcugu

SEQ ID NO: 775477 - RNA, 12 nt, Homo sapiens
cccagggggaga

SEQ ID NO: 775478 - RNA, 13 nt, Homo sapiens
cccagggggcaug

SEQ ID NO: 775479 - RNA, 15 nt, Homo sapiens
cccaggguuuugccc

SEQ ID NO: 775480 - RNA, 23 nt, Homo sapiens
cccagguggcccuaaaggacucu

SEQ ID NO: 775481 - RNA, 18 nt, Homo sapiens
cccagguggcugacccag

SEQ ID NO: 775482 - RNA, 15 nt, Homo sapiens
cccagguguggcugu

SEQ ID NO: 775483 - RNA, 14 nt, Homo sapiens
cccaguaacugcac

SEQ ID NO: 775484 - RNA, 18 nt, Homo sapiens
cccaguccaccugaggaa

SEQ ID NO: 775485 - RNA, 11 nt, Homo sapiens
cccagucccau

SEQ ID NO: 775486 - RNA, 15 nt, Homo sapiens
cccagugccaagcac

SEQ ID NO: 775487 - RNA, 21 nt, Homo sapiens
cccaguucaucaccauuuccu

SEQ ID NO: 775488 - RNA, 19 nt, Homo sapiens
cccaguucauugcacuuug

SEQ ID NO: 775489 - RNA, 19 nt, Homo sapiens
cccauaauuauuauuucca

SEQ ID NO: 775490 - RNA, 21 nt, Homo sapiens
cccauagaaacaugacacuga

SEQ ID NO: 775491 - RNA, 21 nt, Homo sapiens
cccauagacuuauaagucuaa

SEQ ID NO: 775492 - RNA, 14 nt, Homo sapiens
cccauagcuuccau

SEQ ID NO: 775493 - RNA, 22 nt, Homo sapiens
cccaucacccaagccacaagcu

SEQ ID NO: 775494 - RNA, 20 nt, Homo sapiens
cccaucacgccugugcagug

SEQ ID NO: 775495 - RNA, 22 nt, Homo sapiens
cccaucauuacugguaaagccu

SEQ ID NO: 775496 - RNA, 11 nt, Homo sapiens
cccauccagcc

SEQ ID NO: 775497 - RNA, 21 nt, Homo sapiens
cccaucggguaagaugcuccu

SEQ ID NO: 775498 - RNA, 19 nt, Homo sapiens
cccaucgucucggccuuca

SEQ ID NO: 775499 - RNA, 22 nt, Homo sapiens
cccaucucuacaaaaauaaaga

SEQ ID NO: 775500 - RNA, 16 nt, Homo sapiens
cccaugaacacacugu

SEQ ID NO: 775501 - RNA, 18 nt, Homo sapiens
cccaugaacacacugugu

SEQ ID NO: 775502 - RNA, 17 nt, Homo sapiens
cccaugcacugugaagg

SEQ ID NO: 775503 - RNA, 13 nt, Homo sapiens
cccauggccacuu

SEQ ID NO: 775504 - RNA, 18 nt, Homo sapiens
cccauggggagacaguug

SEQ ID NO: 775505 - RNA, 19 nt, Homo sapiens
cccaugugagucccuguga

SEQ ID NO: 775506 - RNA, 18 nt, Homo sapiens
cccauguuggccaggcug

SEQ ID NO: 775507 - RNA, 14 nt, Homo sapiens
cccauuacuuugau

SEQ ID NO: 775508 - RNA, 17 nt, Homo sapiens
cccauucagacacuuca

SEQ ID NO: 775509 - RNA, 24 nt, Homo sapiens
cccauuccaggcagccucugucag

SEQ ID NO: 775510 - RNA, 22 nt, Homo sapiens
cccauugaaacaaaacauugau

SEQ ID NO: 775511 - RNA, 13 nt, Homo sapiens
cccauugcugcca

SEQ ID NO: 775512 - RNA, 17 nt, Homo sapiens
cccauuucaauuccugu

SEQ ID NO: 775513 - RNA, 21 nt, Homo sapiens
cccauuucuauacaacaggca

SEQ ID NO: 775514 - RNA, 14 nt, Homo sapiens
cccauuuugcaaaa

SEQ ID NO: 775515 - RNA, 16 nt, Homo sapiens
ccccaaagcaauguga

SEQ ID NO: 775516 - RNA, 18 nt, Homo sapiens
ccccaacaccccacugag

SEQ ID NO: 775517 - RNA, 16 nt, Homo sapiens
ccccaacaugcacuga

SEQ ID NO: 775518 - RNA, 19 nt, Homo sapiens
ccccaagcagccagccagu

SEQ ID NO: 775519 - RNA, 12 nt, Homo sapiens
ccccaaguccug

SEQ ID NO: 775520 - RNA, 21 nt, Homo sapiens
ccccaaguccuggugucucca

SEQ ID NO: 775521 - RNA, 14 nt, Homo sapiens
ccccacacagggca

SEQ ID NO: 775522 - RNA, 23 nt, Homo sapiens
ccccacacuggagccaucucuuc

SEQ ID NO: 775523 - RNA, 15 nt, Homo sapiens
ccccaccacauagca

SEQ ID NO: 775524 - RNA, 19 nt, Homo sapiens
ccccaccacuguuggucca

SEQ ID NO: 775525 - RNA, 23 nt, Homo sapiens
ccccaccuguguccccgaugcug

SEQ ID NO: 775526 - RNA, 11 nt, Homo sapiens
ccccacugaca

SEQ ID NO: 775527 - RNA, 22 nt, Homo sapiens
ccccacugacacccaguguccu

SEQ ID NO: 775528 - RNA, 19 nt, Homo sapiens
ccccacugccugucccaga

SEQ ID NO: 775529 - RNA, 14 nt, Homo sapiens
ccccagagcuguuu

SEQ ID NO: 775530 - RNA, 15 nt, Homo sapiens
ccccagaucugcucc

SEQ ID NO: 775531 - RNA, 22 nt, Homo sapiens
ccccagcacacgaguuccagac

SEQ ID NO: 775532 - RNA, 11 nt, Homo sapiens
ccccagcacuu

SEQ ID NO: 775533 - RNA, 14 nt, Homo sapiens
ccccagcccagaga

SEQ ID NO: 775534 - RNA, 15 nt, Homo sapiens
ccccagcccagagcc

SEQ ID NO: 775535 - RNA, 22 nt, Homo sapiens
ccccagcucuggcuuccagaaa

SEQ ID NO: 775536 - RNA, 13 nt, Homo sapiens
ccccagcuuugca

SEQ ID NO: 775537 - RNA, 22 nt, Homo sapiens
ccccaggaaggccacagugcug

SEQ ID NO: 775538 - RNA, 20 nt, Homo sapiens
ccccaggcaaggaugucuga

SEQ ID NO: 775539 - RNA, 20 nt, Homo sapiens
ccccaggccggagcccagau

SEQ ID NO: 775540 - RNA, 16 nt, Homo sapiens
ccccaggccuguccac

SEQ ID NO: 775541 - RNA, 23 nt, Homo sapiens
ccccaggccuuuuccacuuugag

SEQ ID NO: 775542 - RNA, 19 nt, Homo sapiens
ccccaggggacaagggauu

SEQ ID NO: 775543 - RNA, 15 nt, Homo sapiens
ccccaucauugcacc

SEQ ID NO: 775544 - RNA, 22 nt, Homo sapiens
ccccaucuagagucuagacaga

SEQ ID NO: 775545 - RNA, 13 nt, Homo sapiens
ccccaugcacugu

SEQ ID NO: 775546 - RNA, 23 nt, Homo sapiens
cucacagaguuaaauaugcaucu

SEQ ID NO: 775547 - RNA, 20 nt, Homo sapiens
cucacagaugugacuguaua

SEQ ID NO: 775548 - RNA, 20 nt, Homo sapiens
cucacagcaacaugugacaa

SEQ ID NO: 775549 - RNA, 18 nt, Homo sapiens
cucacaggccccaggaaa

SEQ ID NO: 775550 - RNA, 19 nt, Homo sapiens
cucacaggugucuccauac

SEQ ID NO: 775551 - RNA, 19 nt, Homo sapiens
cucacauaagcccaguuca

SEQ ID NO: 775552 - RNA, 18 nt, Homo sapiens
cucacauauaacaugcaa

SEQ ID NO: 775553 - RNA, 13 nt, Homo sapiens
cucacauuucauu

SEQ ID NO: 775554 - RNA, 18 nt, Homo sapiens
cucaccaaaauauaguua

SEQ ID NO: 775555 - RNA, 14 nt, Homo sapiens
cucaccaaacacaa

SEQ ID NO: 775556 - RNA, 15 nt, Homo sapiens
cucaccaacuuuuaa

SEQ ID NO: 775557 - RNA, 13 nt, Homo sapiens
cucaccaagguga

SEQ ID NO: 775558 - RNA, 19 nt, Homo sapiens
cucacccaccccugcacag

SEQ ID NO: 775559 - RNA, 23 nt, Homo sapiens
cucacccccagcuuugcuaccaa

SEQ ID NO: 775560 - RNA, 19 nt, Homo sapiens
cucaccccugcccugggau

SEQ ID NO: 775561 - RNA, 20 nt, Homo sapiens
cucaccugcuggggaccuca

SEQ ID NO: 775562 - RNA, 23 nt, Homo sapiens
cucacgcagacacacccacagaa

SEQ ID NO: 775563 - RNA, 18 nt, Homo sapiens
cucacgccuaugauccca

SEQ ID NO: 775564 - RNA, 12 nt, Homo sapiens
cucacgccugua

SEQ ID NO: 775565 - RNA, 20 nt, Homo sapiens
cucacgccuguaaucccagc

SEQ ID NO: 775566 - RNA, 21 nt, Homo sapiens
cucacgccuguaauucuagca

SEQ ID NO: 775567 - RNA, 22 nt, Homo sapiens
cucacuaggcccccacuugccu

SEQ ID NO: 775568 - RNA, 12 nt, Homo sapiens
cucacuaugaau

SEQ ID NO: 775569 - RNA, 17 nt, Homo sapiens
cucacuauugaugcauu

SEQ ID NO: 775570 - RNA, 14 nt, Homo sapiens
cucacuccacugua

SEQ ID NO: 775571 - RNA, 15 nt, Homo sapiens
cucacucccaaggga

SEQ ID NO: 775572 - RNA, 17 nt, Homo sapiens
cucacucccaccugcau

SEQ ID NO: 775573 - RNA, 15 nt, Homo sapiens
cucacugaaacaugg

SEQ ID NO: 775574 - RNA, 18 nt, Homo sapiens
cucacugaaaccaggugg

SEQ ID NO: 775575 - RNA, 21 nt, Homo sapiens
cucacugaggguaucugacaa

SEQ ID NO: 775576 - RNA, 15 nt, Homo sapiens
cucacuggaggagca

SEQ ID NO: 775577 - RNA, 18 nt, Homo sapiens
cucacuggaggagcagcu

SEQ ID NO: 775578 - RNA, 15 nt, Homo sapiens
cucacuguccuguga

SEQ ID NO: 775579 - RNA, 14 nt, Homo sapiens
cucacuguugcagu

SEQ ID NO: 775580 - RNA, 17 nt, Homo sapiens
cucacuguugcaguggc

SEQ ID NO: 775581 - RNA, 16 nt, Homo sapiens
cucacuuaguccuuua

SEQ ID NO: 775582 - RNA, 20 nt, Homo sapiens
cucacuugaaugugucacua

SEQ ID NO: 775583 - RNA, 17 nt, Homo sapiens
cucagaaacuccaugau

SEQ ID NO: 775584 - RNA, 17 nt, Homo sapiens
cucagaacauacugauu

SEQ ID NO: 775585 - RNA, 20 nt, Homo sapiens
cucagaacuugcugcugucu

SEQ ID NO: 775586 - RNA, 23 nt, Homo sapiens
cucagaacuuucuaguugcccuc

SEQ ID NO: 775587 - RNA, 17 nt, Homo sapiens
cucagaaggccccagag

SEQ ID NO: 775588 - RNA, 19 nt, Homo sapiens
cucagaaggccccagagag

SEQ ID NO: 775589 - RNA, 16 nt, Homo sapiens
cucagaauccaaagau

SEQ ID NO: 775590 - RNA, 20 nt, Homo sapiens
cucagaauccaaagaucaca

SEQ ID NO: 775591 - RNA, 20 nt, Homo sapiens
cucagaauugaucauuuucc

SEQ ID NO: 775592 - RNA, 23 nt, Homo sapiens
cucagacagaaccccuacaugaa

SEQ ID NO: 775593 - RNA, 14 nt, Homo sapiens
cucagacccaacag

SEQ ID NO: 775594 - RNA, 12 nt, Homo sapiens
cucagaccugaa

SEQ ID NO: 775595 - RNA, 23 nt, Homo sapiens
cucagagaauuucuaccauuuca

SEQ ID NO: 775596 - RNA, 18 nt, Homo sapiens
cucagagaccagcacuca

SEQ ID NO: 775597 - RNA, 16 nt, Homo sapiens
cucagaggacaauaaa

SEQ ID NO: 775598 - RNA, 21 nt, Homo sapiens
cucagaguguggguccuucaa

SEQ ID NO: 775599 - RNA, 21 nt, Homo sapiens
cucagaguucagacaggucca

SEQ ID NO: 775600 - RNA, 18 nt, Homo sapiens
cucagaucugaacacagu

SEQ ID NO: 775601 - RNA, 23 nt, Homo sapiens
cucagauggauugauaauugcau

SEQ ID NO: 775602 - RNA, 11 nt, Homo sapiens
cucagcacugu

SEQ ID NO: 775603 - RNA, 21 nt, Homo sapiens
cucagcaguccacaaagcauu

SEQ ID NO: 775604 - RNA, 20 nt, Homo sapiens
cucagcauagggucacuuug

SEQ ID NO: 775605 - RNA, 16 nt, Homo sapiens
cucagcaucgugcugu

SEQ ID NO: 775606 - RNA, 22 nt, Homo sapiens
cucagcauuugauuaacauuug

SEQ ID NO: 775607 - RNA, 21 nt, Homo sapiens
cucagccacacccaggcacuu

SEQ ID NO: 775608 - RNA, 18 nt, Homo sapiens
cucagccacagccugaca

SEQ ID NO: 775609 - RNA, 11 nt, Homo sapiens
cucagcccagc

SEQ ID NO: 775610 - RNA, 14 nt, Homo sapiens
cucagccccacuga

SEQ ID NO: 775611 - RNA, 16 nt, Homo sapiens
cucagccccacugaca

SEQ ID NO: 775612 - RNA, 13 nt, Homo sapiens
cucagcccugugc

SEQ ID NO: 775613 - RNA, 18 nt, Homo sapiens
cucagccuguuccaugaa

SEQ ID NO: 775614 - RNA, 23 nt, Homo sapiens
cucagcuaugcccggaccuccau

SEQ ID NO: 775615 - RNA, 13 nt, Homo sapiens
cucagcucagugc

SEQ ID NO: 775616 - RNA, 17 nt, Homo sapiens
cucagcugcacauuccu

SEQ ID NO: 775617 - RNA, 18 nt, Homo sapiens
cucagcuguccugcagca

SEQ ID NO: 775618 - RNA, 23 nt, Homo sapiens
cucagcuucuucacaggcacucc

SEQ ID NO: 775619 - RNA, 16 nt, Homo sapiens
cucaggaauucagugc

SEQ ID NO: 775620 - RNA, 15 nt, Homo sapiens
cucaggcuugaaaug

SEQ ID NO: 775621 - RNA, 14 nt, Homo sapiens
cucagggcagccuc

SEQ ID NO: 775622 - RNA, 17 nt, Homo sapiens
cucagggcagccucccc

SEQ ID NO: 775623 - RNA, 14 nt, Homo sapiens
cucaggugaucuac

SEQ ID NO: 775624 - RNA, 12 nt, Homo sapiens
cucaggugggag

SEQ ID NO: 775625 - RNA, 18 nt, Homo sapiens
cucaggugugggugggag

SEQ ID NO: 775626 - RNA, 21 nt, Homo sapiens
cucaguaaacgggaacaugcc

SEQ ID NO: 775627 - RNA, 22 nt, Homo sapiens
cucaguaaacgggaacaugccc

SEQ ID NO: 775628 - RNA, 16 nt, Homo sapiens
cucaguaaguuggcaa

SEQ ID NO: 775629 - RNA, 13 nt, Homo sapiens
cucaguaccccau

SEQ ID NO: 775630 - RNA, 21 nt, Homo sapiens
cucagucugggugggacuuau

SEQ ID NO: 775631 - RNA, 13 nt, Homo sapiens
cucagugaaggcu

SEQ ID NO: 775632 - RNA, 19 nt, Homo sapiens
cucagugagggcucuggau

SEQ ID NO: 775633 - RNA, 13 nt, Homo sapiens
cucaguggcucug

SEQ ID NO: 775634 - RNA, 14 nt, Homo sapiens
cucaguuccaaagu

SEQ ID NO: 775635 - RNA, 17 nt, Homo sapiens
cucaguucuacacugau

SEQ ID NO: 775636 - RNA, 20 nt, Homo sapiens
cucaguucuacacugauaca

SEQ ID NO: 775637 - RNA, 23 nt, Homo sapiens
cucaguuggaaucauugcuaaua

SEQ ID NO: 775638 - RNA, 22 nt, Homo sapiens
cucaguuguuugcuucuugcca

SEQ ID NO: 775639 - RNA, 18 nt, Homo sapiens
cucaguuucccuaucucg

SEQ ID NO: 775640 - RNA, 16 nt, Homo sapiens
cucaguuucuaggcac

SEQ ID NO: 775641 - RNA, 21 nt, Homo sapiens
cucaguuugucagacuuuaaa

SEQ ID NO: 775642 - RNA, 18 nt, Homo sapiens
cucaguuugugugucuua

SEQ ID NO: 775643 - RNA, 19 nt, Homo sapiens
cucaguuugugugucuuaa

SEQ ID NO: 775644 - RNA, 15 nt, Homo sapiens
cucauaaacugccaa

SEQ ID NO: 775645 - RNA, 16 nt, Homo sapiens
cucauacccaugcaca

SEQ ID NO: 775646 - RNA, 22 nt, Homo sapiens
cucauacccaugcacaguacaa

SEQ ID NO: 775647 - RNA, 18 nt, Homo sapiens
cucauacugucugggauu

SEQ ID NO: 775648 - RNA, 21 nt, Homo sapiens
cucaucaauggggccagucag

SEQ ID NO: 775649 - RNA, 21 nt, Homo sapiens
cucaucauagcaauaacauuc

SEQ ID NO: 775650 - RNA, 22 nt, Homo sapiens
cucaucauuaauaagugaagaa

SEQ ID NO: 775651 - RNA, 13 nt, Homo sapiens
cucauccaaaguu

SEQ ID NO: 775652 - RNA, 20 nt, Homo sapiens
cucauccucuuuuaauggca

SEQ ID NO: 775653 - RNA, 12 nt, Homo sapiens
cucauccuggca

SEQ ID NO: 775654 - RNA, 17 nt, Homo sapiens
cucauccuuaccgcaca

SEQ ID NO: 775655 - RNA, 17 nt, Homo sapiens
cucaucucuacuaaaau

SEQ ID NO: 775656 - RNA, 16 nt, Homo sapiens
cucaucucuuagcucc

SEQ ID NO: 775657 - RNA, 13 nt, Homo sapiens
cucaucugggcaa

SEQ ID NO: 775658 - RNA, 21 nt, Homo sapiens
cucaucuguggagcugccaca

SEQ ID NO: 775659 - RNA, 19 nt, Homo sapiens
cucaucuguuauccugcua

SEQ ID NO: 775660 - RNA, 21 nt, Homo sapiens
cucugguggagacaaaugagg

SEQ ID NO: 775661 - RNA, 19 nt, Homo sapiens
cucuguaggucauuggcca

SEQ ID NO: 775662 - RNA, 13 nt, Homo sapiens
cucuguauguacu

SEQ ID NO: 775663 - RNA, 13 nt, Homo sapiens
cucuguccaacaa

SEQ ID NO: 775664 - RNA, 20 nt, Homo sapiens
cucuguccacgauucacuca

SEQ ID NO: 775665 - RNA, 23 nt, Homo sapiens
cucuguccuucgcccugugcacc

SEQ ID NO: 775666 - RNA, 18 nt, Homo sapiens
cucugugaauugaaaugu

SEQ ID NO: 775667 - RNA, 15 nt, Homo sapiens
cucugugcucugaau

SEQ ID NO: 775668 - RNA, 15 nt, Homo sapiens
cucuguuaacaucua

SEQ ID NO: 775669 - RNA, 14 nt, Homo sapiens
cucuguucacaaac

SEQ ID NO: 775670 - RNA, 14 nt, Homo sapiens
cucuguugcccaag

SEQ ID NO: 775671 - RNA, 13 nt, Homo sapiens
cucuuacaaaagc

SEQ ID NO: 775672 - RNA, 15 nt, Homo sapiens
cucuuacacauagca

SEQ ID NO: 775673 - RNA, 16 nt, Homo sapiens
cucuuagacccacaga

SEQ ID NO: 775674 - RNA, 14 nt, Homo sapiens
cucuuagcaaaaac

SEQ ID NO: 775675 - RNA, 20 nt, Homo sapiens
cucuuaguuauugcugaaga

SEQ ID NO: 775676 - RNA, 13 nt, Homo sapiens
cucuuaugcacac

SEQ ID NO: 775677 - RNA, 15 nt, Homo sapiens
cucuucaaguacugu

SEQ ID NO: 775678 - RNA, 16 nt, Homo sapiens
cucuucaaucucuugc

SEQ ID NO: 775679 - RNA, 16 nt, Homo sapiens
cucuucagaacacaca

SEQ ID NO: 775680 - RNA, 14 nt, Homo sapiens
cucuucagaugcca

SEQ ID NO: 775681 - RNA, 20 nt, Homo sapiens
cucuucagccauaguggauc

SEQ ID NO: 775682 - RNA, 22 nt, Homo sapiens
cucuucagguucuuagugucac

SEQ ID NO: 775683 - RNA, 17 nt, Homo sapiens
cucuucaugcuugacau

SEQ ID NO: 775684 - RNA, 16 nt, Homo sapiens
cucuucccgcaaauca

SEQ ID NO: 775685 - RNA, 22 nt, Homo sapiens
cucuuccuacccaaccacucaa

SEQ ID NO: 775686 - RNA, 22 nt, Homo sapiens
cucuuccuccucgcugccagau

SEQ ID NO: 775687 - RNA, 15 nt, Homo sapiens
cucuuccugugaucc

SEQ ID NO: 775688 - RNA, 14 nt, Homo sapiens
cucuucuaacacaa

SEQ ID NO: 775689 - RNA, 18 nt, Homo sapiens
cucuucuaacacaaaaua

SEQ ID NO: 775690 - RNA, 15 nt, Homo sapiens
cucuucucauuucac

SEQ ID NO: 775691 - RNA, 14 nt, Homo sapiens
cucuucuccacugg

SEQ ID NO: 775692 - RNA, 12 nt, Homo sapiens
cucuucugcuaa

SEQ ID NO: 775693 - RNA, 17 nt, Homo sapiens
cucuucugggaacuucc

SEQ ID NO: 775694 - RNA, 20 nt, Homo sapiens
cucuucugggaacuuccuca

SEQ ID NO: 775695 - RNA, 19 nt, Homo sapiens
cucuugaaaauagaacaac

SEQ ID NO: 775696 - RNA, 14 nt, Homo sapiens
cucuugaccaggcu

SEQ ID NO: 775697 - RNA, 13 nt, Homo sapiens
cucuugagcauca

SEQ ID NO: 775698 - RNA, 22 nt, Homo sapiens
cucuugagcaucaaucuuguua

SEQ ID NO: 775699 - RNA, 22 nt, Homo sapiens
cucuugccaaaaaauagcacac

SEQ ID NO: 775700 - RNA, 14 nt, Homo sapiens
cucuugcucaguga

SEQ ID NO: 775701 - RNA, 22 nt, Homo sapiens
cucuuggaugcagcuucaagaa

SEQ ID NO: 775702 - RNA, 16 nt, Homo sapiens
cucuugggaagaccag

SEQ ID NO: 775703 - RNA, 22 nt, Homo sapiens
cucuuguaagucaucuacuuaa

SEQ ID NO: 775704 - RNA, 21 nt, Homo sapiens
cucuuguauaugaugaucugg

SEQ ID NO: 775705 - RNA, 17 nt, Homo sapiens
cucuuguugagugccag

SEQ ID NO: 775706 - RNA, 18 nt, Homo sapiens
cucuuguugagugccagc

SEQ ID NO: 775707 - RNA, 19 nt, Homo sapiens
cucuuguuuacgacgugau

SEQ ID NO: 775708 - RNA, 20 nt, Homo sapiens
cucuuguuucuuuucacaua

SEQ ID NO: 775709 - RNA, 13 nt, Homo sapiens
cucuuuaccuccu

SEQ ID NO: 775710 - RNA, 12 nt, Homo sapiens
cucuuuagccag

SEQ ID NO: 775711 - RNA, 21 nt, Homo sapiens
cucuuuaguauaauugaccua

SEQ ID NO: 775712 - RNA, 14 nt, Homo sapiens
cucuuuaguguucu

SEQ ID NO: 775713 - RNA, 15 nt, Homo sapiens
cucuuucaaagcuaa

SEQ ID NO: 775714 - RNA, 16 nt, Homo sapiens
cucuuucgcuuggcag

SEQ ID NO: 775715 - RNA, 17 nt, Homo sapiens
cucuuucucugccagug

SEQ ID NO: 775716 - RNA, 15 nt, Homo sapiens
cucuuucuucauuca

SEQ ID NO: 775717 - RNA, 16 nt, Homo sapiens
cucuuucuucauucag

SEQ ID NO: 775718 - RNA, 13 nt, Homo sapiens
cucuuucuuguuu

SEQ ID NO: 775719 - RNA, 19 nt, Homo sapiens
cucuuuggugcacaaguaa

SEQ ID NO: 775720 - RNA, 18 nt, Homo sapiens
cucuuuugaauccaugcu

SEQ ID NO: 775721 - RNA, 19 nt, Homo sapiens
cucuuuugaauccaugcuu

SEQ ID NO: 775722 - RNA, 13 nt, Homo sapiens
cucuuuugcacaa

SEQ ID NO: 775723 - RNA, 22 nt, Homo sapiens
cucuuuuggguaaaaucuguaa

SEQ ID NO: 775724 - RNA, 20 nt, Homo sapiens
cucuuuuuuaaaaacaaaca

SEQ ID NO: 775725 - RNA, 14 nt, Homo sapiens
cugaaaaacugauc

SEQ ID NO: 775726 - RNA, 16 nt, Homo sapiens
cugaaaaagauggaau

SEQ ID NO: 775727 - RNA, 22 nt, Homo sapiens
cugaaaagaucugaagguccca

SEQ ID NO: 775728 - RNA, 14 nt, Homo sapiens
cugaaaaugcaaag

SEQ ID NO: 775729 - RNA, 13 nt, Homo sapiens
cugaaacagagaa

SEQ ID NO: 775730 - RNA, 20 nt, Homo sapiens
cugaaacauucacacagggc

SEQ ID NO: 775731 - RNA, 20 nt, Homo sapiens
cugaaagaccuaugagcaaa

SEQ ID NO: 775732 - RNA, 16 nt, Homo sapiens
cugaaagauacagggg

SEQ ID NO: 775733 - RNA, 15 nt, Homo sapiens
cugaaagaugaucau

SEQ ID NO: 775734 - RNA, 15 nt, Homo sapiens
cugaaaggaugaucc

SEQ ID NO: 775735 - RNA, 12 nt, Homo sapiens
cugaaauccaua

SEQ ID NO: 775736 - RNA, 20 nt, Homo sapiens
cugaaauugaaaaguuauuu

SEQ ID NO: 775737 - RNA, 22 nt, Homo sapiens
cugaacagaagcucuuacucuu

SEQ ID NO: 775738 - RNA, 12 nt, Homo sapiens
cugaacagugga

SEQ ID NO: 775739 - RNA, 18 nt, Homo sapiens
cugaaccaucccugaugu

SEQ ID NO: 775740 - RNA, 15 nt, Homo sapiens
cugaaccauguggca

SEQ ID NO: 775741 - RNA, 13 nt, Homo sapiens
cugaacccugugc

SEQ ID NO: 775742 - RNA, 15 nt, Homo sapiens
cugaaccuuccaucu

SEQ ID NO: 775743 - RNA, 15 nt, Homo sapiens
cugaaccuugagcaa

SEQ ID NO: 775744 - RNA, 18 nt, Homo sapiens
cugaacgcguguguacac

SEQ ID NO: 775745 - RNA, 19 nt, Homo sapiens
cugaacuaaucugauguua

SEQ ID NO: 775746 - RNA, 15 nt, Homo sapiens
cugaacuacacugca

SEQ ID NO: 775747 - RNA, 20 nt, Homo sapiens
cugaacucccagaaccacua

SEQ ID NO: 775748 - RNA, 17 nt, Homo sapiens
cugaacuccugccauag

SEQ ID NO: 775749 - RNA, 16 nt, Homo sapiens
cugaacugacaaugaa

SEQ ID NO: 775750 - RNA, 19 nt, Homo sapiens
cugaacugacaaugaaggg

SEQ ID NO: 775751 - RNA, 21 nt, Homo sapiens
cugaacuuuaucuguucuguu

SEQ ID NO: 775752 - RNA, 14 nt, Homo sapiens
cugaagaagaugag

SEQ ID NO: 775753 - RNA, 22 nt, Homo sapiens
cugaagagcuauuauauaaaaa

SEQ ID NO: 775754 - RNA, 11 nt, Homo sapiens
cugaagcccua

SEQ ID NO: 775755 - RNA, 18 nt, Homo sapiens
cugaagcguuuuucucaa

SEQ ID NO: 775756 - RNA, 22 nt, Homo sapiens
cugaaggaaaaacacaagcaaa

SEQ ID NO: 775757 - RNA, 16 nt, Homo sapiens
cugaaggacacuuccu

SEQ ID NO: 775758 - RNA, 19 nt, Homo sapiens
cugaaggacacuuccugcc

SEQ ID NO: 775759 - RNA, 18 nt, Homo sapiens
cugaaggcagucauauca

SEQ ID NO: 775760 - RNA, 17 nt, Homo sapiens
cugaagggcaucaugca

SEQ ID NO: 775761 - RNA, 18 nt, Homo sapiens
cugaaggggcacaccacu

SEQ ID NO: 775762 - RNA, 15 nt, Homo sapiens
cugaagggguucuca

SEQ ID NO: 775763 - RNA, 15 nt, Homo sapiens
cugaaggucccaccu

SEQ ID NO: 775764 - RNA, 20 nt, Homo sapiens
cugaaguacuuaaacuucca

SEQ ID NO: 775765 - RNA, 18 nt, Homo sapiens
cugaaguagccugaucuu

SEQ ID NO: 775766 - RNA, 18 nt, Homo sapiens
cugaaguagugugcaguu

SEQ ID NO: 775767 - RNA, 16 nt, Homo sapiens
cugaagucacaucaca

SEQ ID NO: 775768 - RNA, 22 nt, Homo sapiens
cugaagucuucuccuccaugaa

SEQ ID NO: 775769 - RNA, 16 nt, Homo sapiens
cugaagugucacagcc

SEQ ID NO: 775770 - RNA, 18 nt, Homo sapiens
cugaagugucacagccug

SEQ ID NO: 775771 - RNA, 18 nt, Homo sapiens
cugaaguguucucuagaa

SEQ ID NO: 775772 - RNA, 22 nt, Homo sapiens
cugaaguugcugagcaguauuc

SEQ ID NO: 775773 - RNA, 17 nt, Homo sapiens
cugaauaaaugauuaaa

SEQ ID NO: 775774 - RNA, 20 nt, Homo sapiens
cugaauacauucugcuuuca

SEQ ID NO: 775775 - RNA, 14 nt, Homo sapiens
cugucuuuguggga

SEQ ID NO: 775776 - RNA, 13 nt, Homo sapiens
cugugaaauacca

SEQ ID NO: 775777 - RNA, 17 nt, Homo sapiens
cugugaaauaccacaag

SEQ ID NO: 775778 - RNA, 18 nt, Homo sapiens
cugugaaauucacaguaa

SEQ ID NO: 775779 - RNA, 16 nt, Homo sapiens
cugugaacccacugaa

SEQ ID NO: 775780 - RNA, 18 nt, Homo sapiens
cugugaacuuucauguca

SEQ ID NO: 775781 - RNA, 13 nt, Homo sapiens
cugugaagcauuu

SEQ ID NO: 775782 - RNA, 21 nt, Homo sapiens
cugugaagucaagaaucacuu

SEQ ID NO: 775783 - RNA, 22 nt, Homo sapiens
cugugaauugccuguaacacau

SEQ ID NO: 775784 - RNA, 21 nt, Homo sapiens
cugugacauacauauuaucuc

SEQ ID NO: 775785 - RNA, 13 nt, Homo sapiens
cugugaccauuua

SEQ ID NO: 775786 - RNA, 15 nt, Homo sapiens
cugugagcagggauu

SEQ ID NO: 775787 - RNA, 21 nt, Homo sapiens
cugugaggggcucucucauga

SEQ ID NO: 775788 - RNA, 20 nt, Homo sapiens
cugugauauuuuaaauaucc

SEQ ID NO: 775789 - RNA, 12 nt, Homo sapiens
cugugaucccag

SEQ ID NO: 775790 - RNA, 20 nt, Homo sapiens
cugugaucccagcuacucag

SEQ ID NO: 775791 - RNA, 22 nt, Homo sapiens
cugugaucccagcuacuuggga

SEQ ID NO: 775792 - RNA, 21 nt, Homo sapiens
cugugauuucuuucuuugcac

SEQ ID NO: 775793 - RNA, 19 nt, Homo sapiens
cugugcaacggucuccuga

SEQ ID NO: 775794 - RNA, 22 nt, Homo sapiens
cugugcacgcgcgcgugcacac

SEQ ID NO: 775795 - RNA, 18 nt, Homo sapiens
cugugcagagaugacugu

SEQ ID NO: 775796 - RNA, 18 nt, Homo sapiens
cugugcagcgggugcugc

SEQ ID NO: 775797 - RNA, 22 nt, Homo sapiens
cugugcaguggcccccacagaa

SEQ ID NO: 775798 - RNA, 20 nt, Homo sapiens
cugugcauacuuucccucau

SEQ ID NO: 775799 - RNA, 13 nt, Homo sapiens
cugugccaguucu

SEQ ID NO: 775800 - RNA, 16 nt, Homo sapiens
cugugcccuccaaaga

SEQ ID NO: 775801 - RNA, 10 nt, Homo sapiens
cugugccuga

SEQ ID NO: 775802 - RNA, 13 nt, Homo sapiens
cugugccugcuca

SEQ ID NO: 775803 - RNA, 22 nt, Homo sapiens
cugugcuucuauuucuuggaau

SEQ ID NO: 775804 - RNA, 13 nt, Homo sapiens
cuguggagccauc

SEQ ID NO: 775805 - RNA, 12 nt, Homo sapiens
cuguggaugcuu

SEQ ID NO: 775806 - RNA, 13 nt, Homo sapiens
cuguggaugcuuc

SEQ ID NO: 775807 - RNA, 16 nt, Homo sapiens
cuguggauuauuucau

SEQ ID NO: 775808 - RNA, 14 nt, Homo sapiens
cuguggauucuaua

SEQ ID NO: 775809 - RNA, 15 nt, Homo sapiens
cuguggcacuugccu

SEQ ID NO: 775810 - RNA, 14 nt, Homo sapiens
cuguggccugggca

SEQ ID NO: 775811 - RNA, 16 nt, Homo sapiens
cuguggcggugccugg

SEQ ID NO: 775812 - RNA, 16 nt, Homo sapiens
cugugggcaagccuaa

SEQ ID NO: 775813 - RNA, 22 nt, Homo sapiens
cugugggcauggucaaaggcuc

SEQ ID NO: 775814 - RNA, 21 nt, Homo sapiens
cuguggggcccuugggccacg

SEQ ID NO: 775815 - RNA, 19 nt, Homo sapiens
cugugguacugauggacuu

SEQ ID NO: 775816 - RNA, 17 nt, Homo sapiens
cugugguuaacaucuca

SEQ ID NO: 775817 - RNA, 23 nt, Homo sapiens
cuguguaacuguaaaacauugaa

SEQ ID NO: 775818 - RNA, 15 nt, Homo sapiens
cuguguaacuuucuc

SEQ ID NO: 775819 - RNA, 21 nt, Homo sapiens
cuguguacagaauucugcuac

SEQ ID NO: 775820 - RNA, 18 nt, Homo sapiens
cuguguagacuauuugcu

SEQ ID NO: 775821 - RNA, 15 nt, Homo sapiens
cuguguauucuaguu

SEQ ID NO: 775822 - RNA, 21 nt, Homo sapiens
cuguguauuuaacugccuugu

SEQ ID NO: 775823 - RNA, 20 nt, Homo sapiens
cugugucaaggugaagcaca

SEQ ID NO: 775824 - RNA, 16 nt, Homo sapiens
cugugucaaugccugu

SEQ ID NO: 775825 - RNA, 15 nt, Homo sapiens
cugugucguagccaa

SEQ ID NO: 775826 - RNA, 18 nt, Homo sapiens
cugugucuggcguucuca

SEQ ID NO: 775827 - RNA, 14 nt, Homo sapiens
cugugucuuggaau

SEQ ID NO: 775828 - RNA, 23 nt, Homo sapiens
cugugugaccucaggccagugug

SEQ ID NO: 775829 - RNA, 22 nt, Homo sapiens
cuguguggacugugaugccaca

SEQ ID NO: 775830 - RNA, 23 nt, Homo sapiens
cuguguggacugugaugccacac

SEQ ID NO: 775831 - RNA, 17 nt, Homo sapiens
cugugugucuguccuga

SEQ ID NO: 775832 - RNA, 13 nt, Homo sapiens
cuguguguggaag

SEQ ID NO: 775833 - RNA, 19 nt, Homo sapiens
cuguguuuucaaugcacaa

SEQ ID NO: 775834 - RNA, 13 nt, Homo sapiens
cuguuaaaaugca

SEQ ID NO: 775835 - RNA, 21 nt, Homo sapiens
cuguuaauacacaguacuuua

SEQ ID NO: 775836 - RNA, 13 nt, Homo sapiens
cuguuaauaguca

SEQ ID NO: 775837 - RNA, 13 nt, Homo sapiens
cuguuacccaggc

SEQ ID NO: 775838 - RNA, 17 nt, Homo sapiens
cuguuacugaauauuaa

SEQ ID NO: 775839 - RNA, 16 nt, Homo sapiens
cuguuacuuuggcaau

SEQ ID NO: 775840 - RNA, 22 nt, Homo sapiens
cuguuauuagcugggaagacca

SEQ ID NO: 775841 - RNA, 19 nt, Homo sapiens
cuguuauuauauuugacau

SEQ ID NO: 775842 - RNA, 13 nt, Homo sapiens
cuguuauucuugu

SEQ ID NO: 775843 - RNA, 15 nt, Homo sapiens
cuguuauucuuguua

SEQ ID NO: 775844 - RNA, 18 nt, Homo sapiens
cuguucaaagaugcauuu

SEQ ID NO: 775845 - RNA, 22 nt, Homo sapiens
cuguuccccaaggacucuucca

SEQ ID NO: 775846 - RNA, 23 nt, Homo sapiens
cuguuccccaaggacucuuccac

SEQ ID NO: 775847 - RNA, 15 nt, Homo sapiens
cuguuccccagagaa

SEQ ID NO: 775848 - RNA, 18 nt, Homo sapiens
cuguucccuugcaggggu

SEQ ID NO: 775849 - RNA, 22 nt, Homo sapiens
cuguucggaagggguuccucaa

SEQ ID NO: 775850 - RNA, 20 nt, Homo sapiens
cuguucugaaaggagacauu

SEQ ID NO: 775851 - RNA, 21 nt, Homo sapiens
cuguucuguuuggcacuugua

SEQ ID NO: 775852 - RNA, 20 nt, Homo sapiens
cuguucuuacaaaugugaaa

SEQ ID NO: 775853 - RNA, 22 nt, Homo sapiens
cuguucuuagaguguagcugua

SEQ ID NO: 775854 - RNA, 18 nt, Homo sapiens
cuguugaaucugagcugc

SEQ ID NO: 775855 - RNA, 20 nt, Homo sapiens
cuguugaccugugcaccuac

SEQ ID NO: 775856 - RNA, 19 nt, Homo sapiens
cuguugagacugauucaga

SEQ ID NO: 775857 - RNA, 23 nt, Homo sapiens
cuguugaucccacuucacuguga

SEQ ID NO: 775858 - RNA, 12 nt, Homo sapiens
cuguugcuauuu

SEQ ID NO: 775859 - RNA, 12 nt, Homo sapiens
cuguugcugaaa

SEQ ID NO: 775860 - RNA, 14 nt, Homo sapiens
cuguugcuuuacag

SEQ ID NO: 775861 - RNA, 22 nt, Homo sapiens
cuguuggaagaaaagaaucaca

SEQ ID NO: 775862 - RNA, 17 nt, Homo sapiens
cuguuggggaccucacc

SEQ ID NO: 775863 - RNA, 21 nt, Homo sapiens
cuguuggggaccucaccugcu

SEQ ID NO: 775864 - RNA, 14 nt, Homo sapiens
cuguuggucugucc

SEQ ID NO: 775865 - RNA, 13 nt, Homo sapiens
cuguuuaacauuu

SEQ ID NO: 775866 - RNA, 23 nt, Homo sapiens
cuguuuacaaaagcccaauguaa

SEQ ID NO: 775867 - RNA, 14 nt, Homo sapiens
cuguuucaaagcac

SEQ ID NO: 775868 - RNA, 18 nt, Homo sapiens
cuguuucaaugaccugua

SEQ ID NO: 775869 - RNA, 16 nt, Homo sapiens
cuguuucaauguauaa

SEQ ID NO: 775870 - RNA, 21 nt, Homo sapiens
cuguuucagugugagucagaa

SEQ ID NO: 775871 - RNA, 16 nt, Homo sapiens
cuguuuccuagcugug

SEQ ID NO: 775872 - RNA, 16 nt, Homo sapiens
cuguuucucaugaagc

SEQ ID NO: 775873 - RNA, 17 nt, Homo sapiens
cuguuuggcacuuguau

SEQ ID NO: 775874 - RNA, 16 nt, Homo sapiens
cuguuugucugaacaa

SEQ ID NO: 775875 - RNA, 17 nt, Homo sapiens
cuguuugucugaacaaa

SEQ ID NO: 775876 - RNA, 15 nt, Homo sapiens
cuguuuucucucggc

SEQ ID NO: 775877 - RNA, 20 nt, Homo sapiens
cuguuuucuggaagugugca

SEQ ID NO: 775878 - RNA, 15 nt, Homo sapiens
cuguuuugcauauga

SEQ ID NO: 775879 - RNA, 14 nt, Homo sapiens
cuguuuuguuguuu

SEQ ID NO: 775880 - RNA, 18 nt, Homo sapiens
cuguuuuuacaguggaau

SEQ ID NO: 775881 - RNA, 18 nt, Homo sapiens
cuguuuuuuuugcugcua

SEQ ID NO: 775882 - RNA, 16 nt, Homo sapiens
cuuaaaaaacauauau

SEQ ID NO: 775883 - RNA, 19 nt, Homo sapiens
cuuaaaacaauucugugac

SEQ ID NO: 775884 - RNA, 16 nt, Homo sapiens
cuuaaaacauggugcc

SEQ ID NO: 775885 - RNA, 19 nt, Homo sapiens
cuuaaaagguuaaauuuca

SEQ ID NO: 775886 - RNA, 19 nt, Homo sapiens
cuuaaaauuaauaaaucau

SEQ ID NO: 775887 - RNA, 14 nt, Homo sapiens
cuuaaacacacauu

SEQ ID NO: 775888 - RNA, 11 nt, Homo sapiens
cuuaaacacau

SEQ ID NO: 775889 - RNA, 19 nt, Homo sapiens
cuuaaacuaauacgugcca

SEQ ID NO: 775890 - RNA, 19 nt, Homo sapiens
cuugggcuacuggcagcuc

SEQ ID NO: 775891 - RNA, 22 nt, Homo sapiens
cuuggggaaaauggccaugcag

SEQ ID NO: 775892 - RNA, 23 nt, Homo sapiens
cuuggggacuaacccaaugccug

SEQ ID NO: 775893 - RNA, 15 nt, Homo sapiens
cuuggggcccagugc

SEQ ID NO: 775894 - RNA, 15 nt, Homo sapiens
cuugggggucagggg

SEQ ID NO: 775895 - RNA, 16 nt, Homo sapiens
cuugggggucaggggg

SEQ ID NO: 775896 - RNA, 17 nt, Homo sapiens
cuuggguucaagugauu

SEQ ID NO: 775897 - RNA, 18 nt, Homo sapiens
cuuggucacauacaauua

SEQ ID NO: 775898 - RNA, 19 nt, Homo sapiens
cuuggucuugaagucugua

SEQ ID NO: 775899 - RNA, 18 nt, Homo sapiens
cuuggugccucugcagua

SEQ ID NO: 775900 - RNA, 21 nt, Homo sapiens
cuugguggcgcgcaccuguag

SEQ ID NO: 775901 - RNA, 15 nt, Homo sapiens
cuugguguaauuuga

SEQ ID NO: 775902 - RNA, 14 nt, Homo sapiens
cuugguguuuguga

SEQ ID NO: 775903 - RNA, 19 nt, Homo sapiens
cuugguuagacgccuucca

SEQ ID NO: 775904 - RNA, 16 nt, Homo sapiens
cuugguucacugcaac

SEQ ID NO: 775905 - RNA, 15 nt, Homo sapiens
cuugguucaucagug

SEQ ID NO: 775906 - RNA, 21 nt, Homo sapiens
cuuguaauaccugauugauca

SEQ ID NO: 775907 - RNA, 17 nt, Homo sapiens
cuuguacccagcgcuaa

SEQ ID NO: 775908 - RNA, 19 nt, Homo sapiens
cuuguagaaaucucagaaa

SEQ ID NO: 775909 - RNA, 17 nt, Homo sapiens
cuuguagaguggugcug

SEQ ID NO: 775910 - RNA, 12 nt, Homo sapiens
cuuguauacuua

SEQ ID NO: 775911 - RNA, 16 nt, Homo sapiens
cuuguaucaacacugu

SEQ ID NO: 775912 - RNA, 17 nt, Homo sapiens
cuuguauuuccaaaccu

SEQ ID NO: 775913 - RNA, 17 nt, Homo sapiens
cuugucacgaauuccau

SEQ ID NO: 775914 - RNA, 13 nt, Homo sapiens
cuugucagaauuu

SEQ ID NO: 775915 - RNA, 14 nt, Homo sapiens
cuugucagauguau

SEQ ID NO: 775916 - RNA, 20 nt, Homo sapiens
cuugucccuuucccuaccuu

SEQ ID NO: 775917 - RNA, 16 nt, Homo sapiens
cuugucucacuugugc

SEQ ID NO: 775918 - RNA, 20 nt, Homo sapiens
cuugucugguaaguggcuuc

SEQ ID NO: 775919 - RNA, 16 nt, Homo sapiens
cuugucugucuaguua

SEQ ID NO: 775920 - RNA, 15 nt, Homo sapiens
cuugugaaaaugugu

SEQ ID NO: 775921 - RNA, 15 nt, Homo sapiens
cuugugaauuauucu

SEQ ID NO: 775922 - RNA, 18 nt, Homo sapiens
cuugugaauuauucugau

SEQ ID NO: 775923 - RNA, 20 nt, Homo sapiens
cuugugacaaacuggcaggu

SEQ ID NO: 775924 - RNA, 16 nt, Homo sapiens
cuugugacgugcacug

SEQ ID NO: 775925 - RNA, 11 nt, Homo sapiens
cuugugccaua

SEQ ID NO: 775926 - RNA, 19 nt, Homo sapiens
cuugugcuucuucacuuac

SEQ ID NO: 775927 - RNA, 19 nt, Homo sapiens
cuugugguugaaaaccaca

SEQ ID NO: 775928 - RNA, 20 nt, Homo sapiens
cuugugguugaaaaccacag

SEQ ID NO: 775929 - RNA, 12 nt, Homo sapiens
cuugugucuccc

SEQ ID NO: 775930 - RNA, 20 nt, Homo sapiens
cuugugugauguuuuacaca

SEQ ID NO: 775931 - RNA, 13 nt, Homo sapiens
cuugugugugaug

SEQ ID NO: 775932 - RNA, 18 nt, Homo sapiens
cuugugugugggcuguga

SEQ ID NO: 775933 - RNA, 21 nt, Homo sapiens
cuuguuaaugucauugcuaaa

SEQ ID NO: 775934 - RNA, 15 nt, Homo sapiens
cuuguuaguaaugcu

SEQ ID NO: 775935 - RNA, 20 nt, Homo sapiens
cuuguuauugccucuacuuu

SEQ ID NO: 775936 - RNA, 21 nt, Homo sapiens
cuuguuauuuaacccauuugu

SEQ ID NO: 775937 - RNA, 20 nt, Homo sapiens
cuuguucaauaauuacugua

SEQ ID NO: 775938 - RNA, 13 nt, Homo sapiens
cuuguucccacac

SEQ ID NO: 775939 - RNA, 13 nt, Homo sapiens
cuuguucuacuga

SEQ ID NO: 775940 - RNA, 16 nt, Homo sapiens
cuuguucuacugagaa

SEQ ID NO: 775941 - RNA, 20 nt, Homo sapiens
cuuguugagauccccguguu

SEQ ID NO: 775942 - RNA, 15 nt, Homo sapiens
cuuguugagugccag

SEQ ID NO: 775943 - RNA, 16 nt, Homo sapiens
cuuguuguuucuugcc

SEQ ID NO: 775944 - RNA, 18 nt, Homo sapiens
cuuguuguuucuugccug

SEQ ID NO: 775945 - RNA, 20 nt, Homo sapiens
cuuguuuagagagccuguca

SEQ ID NO: 775946 - RNA, 22 nt, Homo sapiens
cuuguuugaggcaaaucuaaaa

SEQ ID NO: 775947 - RNA, 16 nt, Homo sapiens
cuuguuugcacugugu

SEQ ID NO: 775948 - RNA, 20 nt, Homo sapiens
cuuguuugucagcaucugac

SEQ ID NO: 775949 - RNA, 14 nt, Homo sapiens
cuuguuuucuugcc

SEQ ID NO: 775950 - RNA, 18 nt, Homo sapiens
cuuuaaaaagcaguccuc

SEQ ID NO: 775951 - RNA, 14 nt, Homo sapiens
cuuuaaaaugccaa

SEQ ID NO: 775952 - RNA, 22 nt, Homo sapiens
cuuuaaacacucuucagagaaa

SEQ ID NO: 775953 - RNA, 21 nt, Homo sapiens
cuuuaaaguuacuauucugua

SEQ ID NO: 775954 - RNA, 22 nt, Homo sapiens
cuuuaaauacuauuauuugcua

SEQ ID NO: 775955 - RNA, 14 nt, Homo sapiens
cuuuaaaucuguga

SEQ ID NO: 775956 - RNA, 16 nt, Homo sapiens
cuuuaaccauggugcu

SEQ ID NO: 775957 - RNA, 15 nt, Homo sapiens
cuuuaacucauaaaa

SEQ ID NO: 775958 - RNA, 22 nt, Homo sapiens
cuuuaagccuucaaaacuauag

SEQ ID NO: 775959 - RNA, 19 nt, Homo sapiens
cuuuaaucacugcauuuca

SEQ ID NO: 775960 - RNA, 21 nt, Homo sapiens
cuuuaaugaacuaacugacag

SEQ ID NO: 775961 - RNA, 15 nt, Homo sapiens
cuuuacaaauauguc

SEQ ID NO: 775962 - RNA, 20 nt, Homo sapiens
cuuuacaggagguuguggau

SEQ ID NO: 775963 - RNA, 19 nt, Homo sapiens
cuuuaccccucauccaaag

SEQ ID NO: 775964 - RNA, 19 nt, Homo sapiens
cuuuacuaauaaacugugu

SEQ ID NO: 775965 - RNA, 21 nt, Homo sapiens
cuuuacuccaucauggcugcu

SEQ ID NO: 775966 - RNA, 18 nt, Homo sapiens
cuuuacuguuagucauuu

SEQ ID NO: 775967 - RNA, 16 nt, Homo sapiens
cuuuagaacagggaaa

SEQ ID NO: 775968 - RNA, 19 nt, Homo sapiens
cuuuagaccuauuuuugaa

SEQ ID NO: 775969 - RNA, 23 nt, Homo sapiens
cuuuagaguagcaugagagaauu

SEQ ID NO: 775970 - RNA, 19 nt, Homo sapiens
cuuuagcaacaguuaucac

SEQ ID NO: 775971 - RNA, 19 nt, Homo sapiens
cuuuaggagacuaauggaa

SEQ ID NO: 775972 - RNA, 16 nt, Homo sapiens
cuuuaggaugacugua

SEQ ID NO: 775973 - RNA, 18 nt, Homo sapiens
cuuuaggcagcagcuuuu

SEQ ID NO: 775974 - RNA, 16 nt, Homo sapiens
cuuuaguggagccagg

SEQ ID NO: 775975 - RNA, 17 nt, Homo sapiens
cuuuauaaauccaguga

SEQ ID NO: 775976 - RNA, 22 nt, Homo sapiens
cuuuauaaauuuuuauaauuca

SEQ ID NO: 775977 - RNA, 20 nt, Homo sapiens
cuuuauauacuuagcuauau

SEQ ID NO: 775978 - RNA, 18 nt, Homo sapiens
cuuuauauggaugauuca

SEQ ID NO: 775979 - RNA, 14 nt, Homo sapiens
cuuuaucauaugcu

SEQ ID NO: 775980 - RNA, 16 nt, Homo sapiens
cuuuaucauggaauuu

SEQ ID NO: 775981 - RNA, 18 nt, Homo sapiens
cuuuaucuaauaccucug

SEQ ID NO: 775982 - RNA, 19 nt, Homo sapiens
cuuuaugcaaauacaauca

SEQ ID NO: 775983 - RNA, 17 nt, Homo sapiens
cuuuaugguuucuccag

SEQ ID NO: 775984 - RNA, 13 nt, Homo sapiens
cuuuauguggaaa

SEQ ID NO: 775985 - RNA, 14 nt, Homo sapiens
cuuuauuaaguaaa

SEQ ID NO: 775986 - RNA, 14 nt, Homo sapiens
cuuuauugcagaau

SEQ ID NO: 775987 - RNA, 16 nt, Homo sapiens
cuuuauuucugaucua

SEQ ID NO: 775988 - RNA, 14 nt, Homo sapiens
cuuucacacuucca

SEQ ID NO: 775989 - RNA, 21 nt, Homo sapiens
cuuucacacuuccaccagccu

SEQ ID NO: 775990 - RNA, 17 nt, Homo sapiens
cuuucacccucaugaaa

SEQ ID NO: 775991 - RNA, 15 nt, Homo sapiens
cuuucagagccagcc

SEQ ID NO: 775992 - RNA, 18 nt, Homo sapiens
cuuuccaauguagcucag

SEQ ID NO: 775993 - RNA, 17 nt, Homo sapiens
cuuuccaccaagcguuu

SEQ ID NO: 775994 - RNA, 13 nt, Homo sapiens
cuuuccagggauc

SEQ ID NO: 775995 - RNA, 21 nt, Homo sapiens
cuuuccauccauuaccuccau

SEQ ID NO: 775996 - RNA, 15 nt, Homo sapiens
cuuuccauguugcug

SEQ ID NO: 775997 - RNA, 15 nt, Homo sapiens
cuuucccagucccau

SEQ ID NO: 775998 - RNA, 16 nt, Homo sapiens
cuuucccaucuuccaa

SEQ ID NO: 775999 - RNA, 14 nt, Homo sapiens
cuuucccaugguca

SEQ ID NO: 776000 - RNA, 14 nt, Homo sapiens
cuuuccccaaagac

SEQ ID NO: 776001 - RNA, 21 nt, Homo sapiens
cuuuccccuccccuggcaugg

SEQ ID NO: 776002 - RNA, 16 nt, Homo sapiens
cuuuccccucccucag

SEQ ID NO: 776003 - RNA, 14 nt, Homo sapiens
cuuucccucaucca

SEQ ID NO: 776004 - RNA, 21 nt, Homo sapiens
cuuucccuccuuuucccaaag

SEQ ID NO: 776005 - RNA, 16 nt, Homo sapiens
gagcucccucgcugua

SEQ ID NO: 776006 - RNA, 17 nt, Homo sapiens
gagcuccuuagccuuug

SEQ ID NO: 776007 - RNA, 21 nt, Homo sapiens
gagcucuucgguuucugagca

SEQ ID NO: 776008 - RNA, 19 nt, Homo sapiens
gagcugaaaaaucacaucc

SEQ ID NO: 776009 - RNA, 21 nt, Homo sapiens
gagcugaguaggaggccucca

SEQ ID NO: 776010 - RNA, 16 nt, Homo sapiens
gagcugauacuuugac

SEQ ID NO: 776011 - RNA, 21 nt, Homo sapiens
gagcugauacuuugacagugu

SEQ ID NO: 776012 - RNA, 15 nt, Homo sapiens
gagcugcacugauca

SEQ ID NO: 776013 - RNA, 22 nt, Homo sapiens
gagcugcacugaucacccaaug

SEQ ID NO: 776014 - RNA, 16 nt, Homo sapiens
gagcugccucugagau

SEQ ID NO: 776015 - RNA, 16 nt, Homo sapiens
gagcugcuccaucacc

SEQ ID NO: 776016 - RNA, 17 nt, Homo sapiens
gagcugcucucucauga

SEQ ID NO: 776017 - RNA, 21 nt, Homo sapiens
gagcugcugagggaccuugga

SEQ ID NO: 776018 - RNA, 14 nt, Homo sapiens
gagcugcugaguga

SEQ ID NO: 776019 - RNA, 22 nt, Homo sapiens
gagcuggccucucuagcacaau

SEQ ID NO: 776020 - RNA, 22 nt, Homo sapiens
gagcuggggguccacacaucuc

SEQ ID NO: 776021 - RNA, 16 nt, Homo sapiens
gagcuguuaccauuca

SEQ ID NO: 776022 - RNA, 19 nt, Homo sapiens
gagcuuaaacagaagcagc

SEQ ID NO: 776023 - RNA, 19 nt, Homo sapiens
gagcuuaauuuucugugga

SEQ ID NO: 776024 - RNA, 20 nt, Homo sapiens
gagcuuauuacuuauuugug

SEQ ID NO: 776025 - RNA, 18 nt, Homo sapiens
gagcuucaaggugaucaa

SEQ ID NO: 776026 - RNA, 18 nt, Homo sapiens
gagcuucauauaccagca

SEQ ID NO: 776027 - RNA, 18 nt, Homo sapiens
gagcuuccuucugugaaa

SEQ ID NO: 776028 - RNA, 15 nt, Homo sapiens
gagcuucucccagug

SEQ ID NO: 776029 - RNA, 13 nt, Homo sapiens
gagcuugauuaaa

SEQ ID NO: 776030 - RNA, 19 nt, Homo sapiens
gagcuugcaugcuugcaua

SEQ ID NO: 776031 - RNA, 23 nt, Homo sapiens
gagcuuggcguuuggacccaguu

SEQ ID NO: 776032 - RNA, 17 nt, Homo sapiens
gagcuugggugugcuga

SEQ ID NO: 776033 - RNA, 16 nt, Homo sapiens
gagcuuucaucauuca

SEQ ID NO: 776034 - RNA, 17 nt, Homo sapiens
gagcuuucucaaugucu

SEQ ID NO: 776035 - RNA, 20 nt, Homo sapiens
gagcuuuuaaaaauguccug

SEQ ID NO: 776036 - RNA, 18 nt, Homo sapiens
gagcuuuugaugccaggu

SEQ ID NO: 776037 - RNA, 14 nt, Homo sapiens
gaggaaaaauggga

SEQ ID NO: 776038 - RNA, 24 nt, Homo sapiens
gaggaaauguuggaacucugugca

SEQ ID NO: 776039 - RNA, 13 nt, Homo sapiens
gaggaacaguauu

SEQ ID NO: 776040 - RNA, 15 nt, Homo sapiens
gaggaacucucaagu

SEQ ID NO: 776041 - RNA, 14 nt, Homo sapiens
gaggaagauggagg

SEQ ID NO: 776042 - RNA, 21 nt, Homo sapiens
gaggaauuuacuuucuucacc

SEQ ID NO: 776043 - RNA, 17 nt, Homo sapiens
gaggacacucgcuugcc

SEQ ID NO: 776044 - RNA, 16 nt, Homo sapiens
gaggacaguggcagac

SEQ ID NO: 776045 - RNA, 22 nt, Homo sapiens
gaggacaugcaugacacuucca

SEQ ID NO: 776046 - RNA, 14 nt, Homo sapiens
gaggacccuggaaa

SEQ ID NO: 776047 - RNA, 20 nt, Homo sapiens
gaggacuuaguuugugaugu

SEQ ID NO: 776048 - RNA, 23 nt, Homo sapiens
gaggacuuuauucggaccaagca

SEQ ID NO: 776049 - RNA, 12 nt, Homo sapiens
gaggagccucag

SEQ ID NO: 776050 - RNA, 13 nt, Homo sapiens
gaggagccucaga

SEQ ID NO: 776051 - RNA, 18 nt, Homo sapiens
gaggagggcgugacucac

SEQ ID NO: 776052 - RNA, 14 nt, Homo sapiens
gaggaggggaccaa

SEQ ID NO: 776053 - RNA, 20 nt, Homo sapiens
gaggaucguaguguguuuaa

SEQ ID NO: 776054 - RNA, 15 nt, Homo sapiens
gaggaugggcagcug

SEQ ID NO: 776055 - RNA, 22 nt, Homo sapiens
gaggcaggagaaucgcuugaac

SEQ ID NO: 776056 - RNA, 18 nt, Homo sapiens
gaggcaggagaauugcuu

SEQ ID NO: 776057 - RNA, 20 nt, Homo sapiens
gaggcaggaggauugcuuga

SEQ ID NO: 776058 - RNA, 19 nt, Homo sapiens
gaggcaggggacaagggag

SEQ ID NO: 776059 - RNA, 17 nt, Homo sapiens
gaggcaggggcucugcu

SEQ ID NO: 776060 - RNA, 17 nt, Homo sapiens
gaggcagggguccugca

SEQ ID NO: 776061 - RNA, 11 nt, Homo sapiens
gaggcaucuga

SEQ ID NO: 776062 - RNA, 13 nt, Homo sapiens
gaggcauuauuug

SEQ ID NO: 776063 - RNA, 17 nt, Homo sapiens
gaggccaccuaugccag

SEQ ID NO: 776064 - RNA, 14 nt, Homo sapiens
gaggccauccugcc

SEQ ID NO: 776065 - RNA, 10 nt, Homo sapiens
gaggcccaaa

SEQ ID NO: 776066 - RNA, 17 nt, Homo sapiens
gaggcccaggcugggaa

SEQ ID NO: 776067 - RNA, 17 nt, Homo sapiens
gaggccgaguggcugcc

SEQ ID NO: 776068 - RNA, 12 nt, Homo sapiens
gaggccuguccu

SEQ ID NO: 776069 - RNA, 15 nt, Homo sapiens
gaggcggauuucccu

SEQ ID NO: 776070 - RNA, 14 nt, Homo sapiens
gaggcucaaaaacu

SEQ ID NO: 776071 - RNA, 22 nt, Homo sapiens
gaggcucaaaaacuugaucaca

SEQ ID NO: 776072 - RNA, 14 nt, Homo sapiens
gaggcucacacugu

SEQ ID NO: 776073 - RNA, 18 nt, Homo sapiens
gaggcuccugcuuauuua

SEQ ID NO: 776074 - RNA, 16 nt, Homo sapiens
gaggcugagcuggauc

SEQ ID NO: 776075 - RNA, 21 nt, Homo sapiens
gaggcugagcuggaucacuug

SEQ ID NO: 776076 - RNA, 16 nt, Homo sapiens
gaggcugaggcaagag

SEQ ID NO: 776077 - RNA, 14 nt, Homo sapiens
gaggcugcaugcuc

SEQ ID NO: 776078 - RNA, 16 nt, Homo sapiens
gaggcugcaugcucug

SEQ ID NO: 776079 - RNA, 20 nt, Homo sapiens
gaggcugccccucucaccaa

SEQ ID NO: 776080 - RNA, 12 nt, Homo sapiens
gaggcugucaca

SEQ ID NO: 776081 - RNA, 13 nt, Homo sapiens
gaggcugucuucu

SEQ ID NO: 776082 - RNA, 18 nt, Homo sapiens
gaggcugucuucucaggc

SEQ ID NO: 776083 - RNA, 20 nt, Homo sapiens
gaggcugucuucucaggcuc

SEQ ID NO: 776084 - RNA, 20 nt, Homo sapiens
gaggcuugccccacccaaca

SEQ ID NO: 776085 - RNA, 15 nt, Homo sapiens
gaggcuuuucccacc

SEQ ID NO: 776086 - RNA, 18 nt, Homo sapiens
gagggaaaagauugacug

SEQ ID NO: 776087 - RNA, 16 nt, Homo sapiens
gagggaaaucuguaaa

SEQ ID NO: 776088 - RNA, 13 nt, Homo sapiens
gagggacacuccu

SEQ ID NO: 776089 - RNA, 17 nt, Homo sapiens
gagggaggucacuggaa

SEQ ID NO: 776090 - RNA, 14 nt, Homo sapiens
gagggcaaacccaa

SEQ ID NO: 776091 - RNA, 20 nt, Homo sapiens
gagggcaaacccaaaaccuc

SEQ ID NO: 776092 - RNA, 20 nt, Homo sapiens
gagggcaacauuccacagcu

SEQ ID NO: 776093 - RNA, 16 nt, Homo sapiens
gagggcagacuggggc

SEQ ID NO: 776094 - RNA, 17 nt, Homo sapiens
gagggccauugaacucu

SEQ ID NO: 776095 - RNA, 23 nt, Homo sapiens
gagggccauugaacucugagaga

SEQ ID NO: 776096 - RNA, 16 nt, Homo sapiens
gagggcccagcccaga

SEQ ID NO: 776097 - RNA, 17 nt, Homo sapiens
gagggccccgcccagug

SEQ ID NO: 776098 - RNA, 18 nt, Homo sapiens
gagggccccgcccagugc

SEQ ID NO: 776099 - RNA, 16 nt, Homo sapiens
gagggccccugcgugg

SEQ ID NO: 776100 - RNA, 18 nt, Homo sapiens
gagggcgccaugcagcgg

SEQ ID NO: 776101 - RNA, 15 nt, Homo sapiens
gagggcuguggugcc

SEQ ID NO: 776102 - RNA, 15 nt, Homo sapiens
gaggggaagggccag

SEQ ID NO: 776103 - RNA, 19 nt, Homo sapiens
gagggugcagcccucuugc

SEQ ID NO: 776104 - RNA, 15 nt, Homo sapiens
gagggugcaguccag

SEQ ID NO: 776105 - RNA, 15 nt, Homo sapiens
gaggguuuugcucuu

SEQ ID NO: 776106 - RNA, 13 nt, Homo sapiens
gagguacucuccu

SEQ ID NO: 776107 - RNA, 18 nt, Homo sapiens
gagguagagguugcacug

SEQ ID NO: 776108 - RNA, 20 nt, Homo sapiens
gagguaggagaauugcuuga

SEQ ID NO: 776109 - RNA, 13 nt, Homo sapiens
gaggucacuggaa

SEQ ID NO: 776110 - RNA, 23 nt, Homo sapiens
gaggucaggaguucgaaaccagc

SEQ ID NO: 776111 - RNA, 18 nt, Homo sapiens
gaggucaggaguugaaga

SEQ ID NO: 776112 - RNA, 22 nt, Homo sapiens
gaggucagugcuucgugccucg

SEQ ID NO: 776113 - RNA, 15 nt, Homo sapiens
gaggucucccaaacg

SEQ ID NO: 776114 - RNA, 13 nt, Homo sapiens
gaggucuggcuga

SEQ ID NO: 776115 - RNA, 21 nt, Homo sapiens
gaggucugguccgagucucag

SEQ ID NO: 776116 - RNA, 14 nt, Homo sapiens
gaggugagccucac

SEQ ID NO: 776117 - RNA, 14 nt, Homo sapiens
gaggugcagcugga

SEQ ID NO: 776118 - RNA, 22 nt, Homo sapiens
gaggugcaggggaagaccaaag

SEQ ID NO: 776119 - RNA, 22 nt, Homo sapiens
gagguggauguuaugaacagcu

SEQ ID NO: 776120 - RNA, 20 nt, Homo sapiens
gauuucauagcgaguuuucu

SEQ ID NO: 776121 - RNA, 21 nt, Homo sapiens
gauuucaucugcucuccuucc

SEQ ID NO: 776122 - RNA, 12 nt, Homo sapiens
gauuuccauuug

SEQ ID NO: 776123 - RNA, 22 nt, Homo sapiens
gauuuccuacagaaauacugcu

SEQ ID NO: 776124 - RNA, 16 nt, Homo sapiens
gauuuccuuaaccuua

SEQ ID NO: 776125 - RNA, 15 nt, Homo sapiens
gauuucggaggccau

SEQ ID NO: 776126 - RNA, 11 nt, Homo sapiens
gauuucuggga

SEQ ID NO: 776127 - RNA, 18 nt, Homo sapiens
gauuucugggcacuuuuu

SEQ ID NO: 776128 - RNA, 19 nt, Homo sapiens
gauuucugguugauuugua

SEQ ID NO: 776129 - RNA, 23 nt, Homo sapiens
gauuucuuucuuugcaccaaaga

SEQ ID NO: 776130 - RNA, 11 nt, Homo sapiens
gauuugcaaua

SEQ ID NO: 776131 - RNA, 16 nt, Homo sapiens
gauuugcauaaaguga

SEQ ID NO: 776132 - RNA, 12 nt, Homo sapiens
gauuugcauuuc

SEQ ID NO: 776133 - RNA, 18 nt, Homo sapiens
gauuuggaggcuaccuca

SEQ ID NO: 776134 - RNA, 21 nt, Homo sapiens
gauuuggggcuaaagacugau

SEQ ID NO: 776135 - RNA, 16 nt, Homo sapiens
gauuuguagcacugag

SEQ ID NO: 776136 - RNA, 12 nt, Homo sapiens
gauuuguggaaa

SEQ ID NO: 776137 - RNA, 14 nt, Homo sapiens
gauuuuaauuagcc

SEQ ID NO: 776138 - RNA, 20 nt, Homo sapiens
gauuuuacauguggcccaac

SEQ ID NO: 776139 - RNA, 13 nt, Homo sapiens
gauuuuaccaaag

SEQ ID NO: 776140 - RNA, 16 nt, Homo sapiens
gauuuuauuugacaaa

SEQ ID NO: 776141 - RNA, 23 nt, Homo sapiens
gauuuuggccaucaggacucuga

SEQ ID NO: 776142 - RNA, 14 nt, Homo sapiens
gauuuuucucuuca

SEQ ID NO: 776143 - RNA, 16 nt, Homo sapiens
gauuuuucucuucauu

SEQ ID NO: 776144 - RNA, 23 nt, Homo sapiens
gauuuuuggugcaaguagcacau

SEQ ID NO: 776145 - RNA, 23 nt, Homo sapiens
gauuuuuuguuauguuugcacuu

SEQ ID NO: 776146 - RNA, 19 nt, Homo sapiens
gauuuuuuuaauagugcuu

SEQ ID NO: 776147 - RNA, 21 nt, Homo sapiens
gcaaaaaaauuaaauuauuua

SEQ ID NO: 776148 - RNA, 15 nt, Homo sapiens
gcaaaaaaauuauuu

SEQ ID NO: 776149 - RNA, 22 nt, Homo sapiens
gcaaaaacauguaugugcauuu

SEQ ID NO: 776150 - RNA, 23 nt, Homo sapiens
gcaaaaaugaguugucacagaaa

SEQ ID NO: 776151 - RNA, 12 nt, Homo sapiens
gcaaaaccaaag

SEQ ID NO: 776152 - RNA, 15 nt, Homo sapiens
gcaaaacgacacugc

SEQ ID NO: 776153 - RNA, 19 nt, Homo sapiens
gcaaaaucucuacugcuuu

SEQ ID NO: 776154 - RNA, 16 nt, Homo sapiens
gcaaaaucuuguuaau

SEQ ID NO: 776155 - RNA, 17 nt, Homo sapiens
gcaaaaugcucuugucc

SEQ ID NO: 776156 - RNA, 17 nt, Homo sapiens
gcaaaauugggcuguga

SEQ ID NO: 776157 - RNA, 24 nt, Homo sapiens
gcaaacuuucuuaaaacauuauga

SEQ ID NO: 776158 - RNA, 20 nt, Homo sapiens
gcaaagauuauuuucauuua

SEQ ID NO: 776159 - RNA, 22 nt, Homo sapiens
gcaaagauuuuuggcacuuugu

SEQ ID NO: 776160 - RNA, 18 nt, Homo sapiens
gcaaagcaaaaggcugag

SEQ ID NO: 776161 - RNA, 11 nt, Homo sapiens
gcaaagccaaa

SEQ ID NO: 776162 - RNA, 15 nt, Homo sapiens
gcaaagccaaaaccu

SEQ ID NO: 776163 - RNA, 17 nt, Homo sapiens
gcaaagccuucauugcc

SEQ ID NO: 776164 - RNA, 18 nt, Homo sapiens
gcaaagccuuuccagaaa

SEQ ID NO: 776165 - RNA, 20 nt, Homo sapiens
gcaaagcugaugacaacuuc

SEQ ID NO: 776166 - RNA, 16 nt, Homo sapiens
gcaaaggcgucugaau

SEQ ID NO: 776167 - RNA, 21 nt, Homo sapiens
gcaaaggggacagcuguguga

SEQ ID NO: 776168 - RNA, 15 nt, Homo sapiens
gcaaaggugccucau

SEQ ID NO: 776169 - RNA, 22 nt, Homo sapiens
gcaaagucccagccgcacuggg

SEQ ID NO: 776170 - RNA, 23 nt, Homo sapiens
gcaaagugcugcuggaaguagaa

SEQ ID NO: 776171 - RNA, 12 nt, Homo sapiens
gcaaaguggaau

SEQ ID NO: 776172 - RNA, 19 nt, Homo sapiens
gcaaagugugucagacgag

SEQ ID NO: 776173 - RNA, 17 nt, Homo sapiens
gcaaaguuuacagaugu

SEQ ID NO: 776174 - RNA, 18 nt, Homo sapiens
gcaaauaaagaccugaga

SEQ ID NO: 776175 - RNA, 14 nt, Homo sapiens
gcaaauacaaucag

SEQ ID NO: 776176 - RNA, 14 nt, Homo sapiens
gcaaauagccacaa

SEQ ID NO: 776177 - RNA, 18 nt, Homo sapiens
gcaaaucaacacuuucug

SEQ ID NO: 776178 - RNA, 15 nt, Homo sapiens
gcaaaugacaugcac

SEQ ID NO: 776179 - RNA, 19 nt, Homo sapiens
gcaaaugccuccaagccau

SEQ ID NO: 776180 - RNA, 19 nt, Homo sapiens
gcaaauggcagaaccaaag

SEQ ID NO: 776181 - RNA, 16 nt, Homo sapiens
gcaaauguccccuuga

SEQ ID NO: 776182 - RNA, 16 nt, Homo sapiens
gcaaauguuaugcaua

SEQ ID NO: 776183 - RNA, 15 nt, Homo sapiens
gcaacaagacugcca

SEQ ID NO: 776184 - RNA, 20 nt, Homo sapiens
gcaacaauaaaguacuuuac

SEQ ID NO: 776185 - RNA, 15 nt, Homo sapiens
gcaacaauauccuuu

SEQ ID NO: 776186 - RNA, 20 nt, Homo sapiens
gcaacagaagugguuuccca

SEQ ID NO: 776187 - RNA, 24 nt, Homo sapiens
gcaacagauggauagucuguccaa

SEQ ID NO: 776188 - RNA, 22 nt, Homo sapiens
gcaacaggaaucucagagacag

SEQ ID NO: 776189 - RNA, 12 nt, Homo sapiens
gcaacaguuuuu

SEQ ID NO: 776190 - RNA, 21 nt, Homo sapiens
gcaacccacguguaacuguca

SEQ ID NO: 776191 - RNA, 22 nt, Homo sapiens
gcaaccucuuugcucaacagaa

SEQ ID NO: 776192 - RNA, 13 nt, Homo sapiens
gcaacgcugccuu

SEQ ID NO: 776193 - RNA, 24 nt, Homo sapiens
gcaacggccaggguugugcuuucu

SEQ ID NO: 776194 - RNA, 22 nt, Homo sapiens
gcaacguagcuucuaccaugaa

SEQ ID NO: 776195 - RNA, 18 nt, Homo sapiens
gcaacuaggccuucagua

SEQ ID NO: 776196 - RNA, 14 nt, Homo sapiens
gcaacuagggcuag

SEQ ID NO: 776197 - RNA, 15 nt, Homo sapiens
gcaacuccauuuacc

SEQ ID NO: 776198 - RNA, 17 nt, Homo sapiens
gcaacuggaguuccuua

SEQ ID NO: 776199 - RNA, 18 nt, Homo sapiens
gcaacuucuucuccaucc

SEQ ID NO: 776200 - RNA, 14 nt, Homo sapiens
gcaagaaacaguuu

SEQ ID NO: 776201 - RNA, 16 nt, Homo sapiens
gcaagaccagucacuc

SEQ ID NO: 776202 - RNA, 17 nt, Homo sapiens
gcaagaccuaguccccu

SEQ ID NO: 776203 - RNA, 13 nt, Homo sapiens
gcaagacuugaac

SEQ ID NO: 776204 - RNA, 17 nt, Homo sapiens
gcaagaucuugucucca

SEQ ID NO: 776205 - RNA, 12 nt, Homo sapiens
gcaagccagcuu

SEQ ID NO: 776206 - RNA, 15 nt, Homo sapiens
gcaagcuauucaaug

SEQ ID NO: 776207 - RNA, 23 nt, Homo sapiens
gcaagcugggacuggcaggaaau

SEQ ID NO: 776208 - RNA, 20 nt, Homo sapiens
gcaaggacaccauaguguca

SEQ ID NO: 776209 - RNA, 16 nt, Homo sapiens
gcaaggccugugcugc

SEQ ID NO: 776210 - RNA, 17 nt, Homo sapiens
gcaaggccugugcugca

SEQ ID NO: 776211 - RNA, 20 nt, Homo sapiens
gcaagguuauaugcacuuuc

SEQ ID NO: 776212 - RNA, 21 nt, Homo sapiens
gcaagguuggcgacugucaug

SEQ ID NO: 776213 - RNA, 14 nt, Homo sapiens
gcaaguaaguuaua

SEQ ID NO: 776214 - RNA, 17 nt, Homo sapiens
gcaaguaaguuauagaa

SEQ ID NO: 776215 - RNA, 22 nt, Homo sapiens
gcaagugauugaaaauaguaaa

SEQ ID NO: 776216 - RNA, 14 nt, Homo sapiens
gcaaguuucaguga

SEQ ID NO: 776217 - RNA, 21 nt, Homo sapiens
gcaauaaaucugacccagugc

SEQ ID NO: 776218 - RNA, 19 nt, Homo sapiens
gcaauaaccucaaagugac

SEQ ID NO: 776219 - RNA, 15 nt, Homo sapiens
gcaauaccagugaca

SEQ ID NO: 776220 - RNA, 13 nt, Homo sapiens
gcaauagaacccu

SEQ ID NO: 776221 - RNA, 16 nt, Homo sapiens
gcaauauaagcauaaa

SEQ ID NO: 776222 - RNA, 21 nt, Homo sapiens
gcaauauggaagcaaccagca

SEQ ID NO: 776223 - RNA, 17 nt, Homo sapiens
gcaauauuaaugaagua

SEQ ID NO: 776224 - RNA, 22 nt, Homo sapiens
gcaauccucccacuucagccuc

SEQ ID NO: 776225 - RNA, 20 nt, Homo sapiens
gcaaucucggcucauagcaa

SEQ ID NO: 776226 - RNA, 17 nt, Homo sapiens
gcaaucuucuacuuuaa

SEQ ID NO: 776227 - RNA, 13 nt, Homo sapiens
gcaaugcacugaa

SEQ ID NO: 776228 - RNA, 20 nt, Homo sapiens
gcaaugcauuugauggccac

SEQ ID NO: 776229 - RNA, 12 nt, Homo sapiens
gcaauggaagaa

SEQ ID NO: 776230 - RNA, 16 nt, Homo sapiens
gcaaugguuuguguca

SEQ ID NO: 776231 - RNA, 23 nt, Homo sapiens
gcaaugguuugugucaaaacugg

SEQ ID NO: 776232 - RNA, 23 nt, Homo sapiens
gcaauguacucuuccgauguuug

SEQ ID NO: 776233 - RNA, 12 nt, Homo sapiens
gcaaugucacaa

SEQ ID NO: 776234 - RNA, 15 nt, Homo sapiens
gccacacguuguaua

SEQ ID NO: 776235 - RNA, 20 nt, Homo sapiens
gccacaggccugagauuuca

SEQ ID NO: 776236 - RNA, 17 nt, Homo sapiens
gccacagugucacuggu

SEQ ID NO: 776237 - RNA, 21 nt, Homo sapiens
gccacaugccgcgucccugcc

SEQ ID NO: 776238 - RNA, 20 nt, Homo sapiens
gccaccagaccaugggccaa

SEQ ID NO: 776239 - RNA, 18 nt, Homo sapiens
gccaccagacugacaaau

SEQ ID NO: 776240 - RNA, 15 nt, Homo sapiens
gccaccauccugcag

SEQ ID NO: 776241 - RNA, 13 nt, Homo sapiens
gccaccaucugga

SEQ ID NO: 776242 - RNA, 13 nt, Homo sapiens
gccacccacugac

SEQ ID NO: 776243 - RNA, 14 nt, Homo sapiens
gccacccuagccaa

SEQ ID NO: 776244 - RNA, 16 nt, Homo sapiens
gccaccgcccagagac

SEQ ID NO: 776245 - RNA, 23 nt, Homo sapiens
gccaccucucuccuuugcugagg

SEQ ID NO: 776246 - RNA, 19 nt, Homo sapiens
gccaccuggcaaaggaccc

SEQ ID NO: 776247 - RNA, 23 nt, Homo sapiens
gccacgcacugggccacggagga

SEQ ID NO: 776248 - RNA, 18 nt, Homo sapiens
gccacgcuccaaacccca

SEQ ID NO: 776249 - RNA, 24 nt, Homo sapiens
gccacguaugguggcucaugucua

SEQ ID NO: 776250 - RNA, 14 nt, Homo sapiens
gccacuaaaacaca

SEQ ID NO: 776251 - RNA, 17 nt, Homo sapiens
gccacuaucacauaugc

SEQ ID NO: 776252 - RNA, 13 nt, Homo sapiens
gccacucaaagga

SEQ ID NO: 776253 - RNA, 19 nt, Homo sapiens
gccacucaggggucauuca

SEQ ID NO: 776254 - RNA, 13 nt, Homo sapiens
gccacugcacucc

SEQ ID NO: 776255 - RNA, 18 nt, Homo sapiens
gccacugguuucucagaa

SEQ ID NO: 776256 - RNA, 22 nt, Homo sapiens
gccacugugucuuaugaggaau

SEQ ID NO: 776257 - RNA, 16 nt, Homo sapiens
gccacuugccucaccu

SEQ ID NO: 776258 - RNA, 23 nt, Homo sapiens
gccagaccagcaggcuggccuau

SEQ ID NO: 776259 - RNA, 18 nt, Homo sapiens
gccagacgugguggcuca

SEQ ID NO: 776260 - RNA, 13 nt, Homo sapiens
gccagagugcagu

SEQ ID NO: 776261 - RNA, 19 nt, Homo sapiens
gccagaguggccuggccag

SEQ ID NO: 776262 - RNA, 17 nt, Homo sapiens
gccagauuucauucuca

SEQ ID NO: 776263 - RNA, 12 nt, Homo sapiens
gccagcacagaa

SEQ ID NO: 776264 - RNA, 21 nt, Homo sapiens
gccagcagcacagucacccau

SEQ ID NO: 776265 - RNA, 22 nt, Homo sapiens
gccagcccucccuggcugugag

SEQ ID NO: 776266 - RNA, 16 nt, Homo sapiens
gccagccuccagcacc

SEQ ID NO: 776267 - RNA, 16 nt, Homo sapiens
gccagcucagucccau

SEQ ID NO: 776268 - RNA, 19 nt, Homo sapiens
gccagcucccucgucuuca

SEQ ID NO: 776269 - RNA, 21 nt, Homo sapiens
gccagcucuaaacaagucccu

SEQ ID NO: 776270 - RNA, 15 nt, Homo sapiens
gccagcugcacugau

SEQ ID NO: 776271 - RNA, 17 nt, Homo sapiens
gccagcugugcacuuuc

SEQ ID NO: 776272 - RNA, 23 nt, Homo sapiens
gccagcuuaaacccauacaaugu

SEQ ID NO: 776273 - RNA, 22 nt, Homo sapiens
gccagcuuggggccaccaaagc

SEQ ID NO: 776274 - RNA, 17 nt, Homo sapiens
gccaggaaguacuucca

SEQ ID NO: 776275 - RNA, 13 nt, Homo sapiens
gccaggacugugu

SEQ ID NO: 776276 - RNA, 16 nt, Homo sapiens
gccaggagaagcucag

SEQ ID NO: 776277 - RNA, 20 nt, Homo sapiens
gccaggagcuggacaccuac

SEQ ID NO: 776278 - RNA, 19 nt, Homo sapiens
gccaggagucugugcucuu

SEQ ID NO: 776279 - RNA, 22 nt, Homo sapiens
gccaggauggucucgaucuccu

SEQ ID NO: 776280 - RNA, 15 nt, Homo sapiens
gccaggcacuguggc

SEQ ID NO: 776281 - RNA, 16 nt, Homo sapiens
gccaggcacuguucau

SEQ ID NO: 776282 - RNA, 13 nt, Homo sapiens
gccaggcacuuug

SEQ ID NO: 776283 - RNA, 15 nt, Homo sapiens
gccaggcacuuugag

SEQ ID NO: 776284 - RNA, 19 nt, Homo sapiens
gccaggccagagggcagug

SEQ ID NO: 776285 - RNA, 21 nt, Homo sapiens
gccaggcccugggucuugcca

SEQ ID NO: 776286 - RNA, 14 nt, Homo sapiens
gccaggccuguaug

SEQ ID NO: 776287 - RNA, 21 nt, Homo sapiens
gccaggcugaauuacagugaa

SEQ ID NO: 776288 - RNA, 20 nt, Homo sapiens
gccaggcugccaaggccaga

SEQ ID NO: 776289 - RNA, 23 nt, Homo sapiens
gccaggcugccucggacuccaug

SEQ ID NO: 776290 - RNA, 16 nt, Homo sapiens
gccaggcuggagugca

SEQ ID NO: 776291 - RNA, 20 nt, Homo sapiens
gccaggcuggagugcagugg

SEQ ID NO: 776292 - RNA, 14 nt, Homo sapiens
gccagggaaacaaa

SEQ ID NO: 776293 - RNA, 23 nt, Homo sapiens
gccagggaaagcccgugucaaug

SEQ ID NO: 776294 - RNA, 12 nt, Homo sapiens
gccagggaccca

SEQ ID NO: 776295 - RNA, 18 nt, Homo sapiens
gccagggcccugcagagg

SEQ ID NO: 776296 - RNA, 17 nt, Homo sapiens
gccaggggcugguggga

SEQ ID NO: 776297 - RNA, 21 nt, Homo sapiens
gccagggggaugccacuccuc

SEQ ID NO: 776298 - RNA, 23 nt, Homo sapiens
gccaggucacccuuugcugugag

SEQ ID NO: 776299 - RNA, 21 nt, Homo sapiens
gccaggucccuuucauuugcu

SEQ ID NO: 776300 - RNA, 13 nt, Homo sapiens
gccaggugcagug

SEQ ID NO: 776301 - RNA, 19 nt, Homo sapiens
gccagguugcagcugcucu

SEQ ID NO: 776302 - RNA, 15 nt, Homo sapiens
gccaguauuaugcau

SEQ ID NO: 776303 - RNA, 16 nt, Homo sapiens
gccagucacugcugca

SEQ ID NO: 776304 - RNA, 19 nt, Homo sapiens
gccaguccugccuggccag

SEQ ID NO: 776305 - RNA, 11 nt, Homo sapiens
gccagugacag

SEQ ID NO: 776306 - RNA, 14 nt, Homo sapiens
gccagugccucuca

SEQ ID NO: 776307 - RNA, 13 nt, Homo sapiens
gccaguggugcua

SEQ ID NO: 776308 - RNA, 17 nt, Homo sapiens
gccaguuguugccaacc

SEQ ID NO: 776309 - RNA, 14 nt, Homo sapiens
gccauaacagacca

SEQ ID NO: 776310 - RNA, 16 nt, Homo sapiens
gccauaaccacauuua

SEQ ID NO: 776311 - RNA, 22 nt, Homo sapiens
gccauaagaggugaucucuggg

SEQ ID NO: 776312 - RNA, 18 nt, Homo sapiens
gccauacugccuuugcag

SEQ ID NO: 776313 - RNA, 14 nt, Homo sapiens
gccauagaggccca

SEQ ID NO: 776314 - RNA, 21 nt, Homo sapiens
gccauagaggcccaggcacca

SEQ ID NO: 776315 - RNA, 14 nt, Homo sapiens
gccauagccccaua

SEQ ID NO: 776316 - RNA, 19 nt, Homo sapiens
gccaucaacuaaaguugua

SEQ ID NO: 776317 - RNA, 19 nt, Homo sapiens
gccaucauccuccauugcu

SEQ ID NO: 776318 - RNA, 13 nt, Homo sapiens
gccauccaugugc

SEQ ID NO: 776319 - RNA, 15 nt, Homo sapiens
gccauccaugugcua

SEQ ID NO: 776320 - RNA, 20 nt, Homo sapiens
gccauccauuugugcaaaau

SEQ ID NO: 776321 - RNA, 14 nt, Homo sapiens
gccauccucaccca

SEQ ID NO: 776322 - RNA, 20 nt, Homo sapiens
gccaucucagcucacugcaa

SEQ ID NO: 776323 - RNA, 15 nt, Homo sapiens
gccaucucuuccuca

SEQ ID NO: 776324 - RNA, 16 nt, Homo sapiens
gccaucucuuccucau

SEQ ID NO: 776325 - RNA, 15 nt, Homo sapiens
gccaucuuucuuugg

SEQ ID NO: 776326 - RNA, 22 nt, Homo sapiens
gccaugaguuccagaaaguaaa

SEQ ID NO: 776327 - RNA, 22 nt, Homo sapiens
gccaugauaacugcaauuuuaa

SEQ ID NO: 776328 - RNA, 22 nt, Homo sapiens
gccaugcagaccucaugcccag

SEQ ID NO: 776329 - RNA, 20 nt, Homo sapiens
gccaugcaggaagaggccca

SEQ ID NO: 776330 - RNA, 16 nt, Homo sapiens
gccauggccugugcug

SEQ ID NO: 776331 - RNA, 14 nt, Homo sapiens
gccauguccaaaga

SEQ ID NO: 776332 - RNA, 22 nt, Homo sapiens
gccauguggaaggcaagccagg

SEQ ID NO: 776333 - RNA, 21 nt, Homo sapiens
gccauucacuucauaauccag

SEQ ID NO: 776334 - RNA, 14 nt, Homo sapiens
gccauucucuugca

SEQ ID NO: 776335 - RNA, 13 nt, Homo sapiens
gccauugaacuca

SEQ ID NO: 776336 - RNA, 24 nt, Homo sapiens
gccauuuaauacccugcaauguaa

SEQ ID NO: 776337 - RNA, 22 nt, Homo sapiens
gccauuuuggguuuugggucuu

SEQ ID NO: 776338 - RNA, 18 nt, Homo sapiens
gcccaaaaacaagcaaaa

SEQ ID NO: 776339 - RNA, 17 nt, Homo sapiens
gcccaaauggcagggau

SEQ ID NO: 776340 - RNA, 14 nt, Homo sapiens
gcccaagaauagau

SEQ ID NO: 776341 - RNA, 16 nt, Homo sapiens
gcccaagagaugaaga

SEQ ID NO: 776342 - RNA, 16 nt, Homo sapiens
gcccaagaggacugag

SEQ ID NO: 776343 - RNA, 22 nt, Homo sapiens
gcccaagcuucccuccaucccc

SEQ ID NO: 776344 - RNA, 18 nt, Homo sapiens
gcccaaggagcuuaccca

SEQ ID NO: 776345 - RNA, 20 nt, Homo sapiens
gcccaaguaccacgcagugc

SEQ ID NO: 776346 - RNA, 22 nt, Homo sapiens
gcccaaucucugccauaucagu

SEQ ID NO: 776347 - RNA, 13 nt, Homo sapiens
gcccacaccaacg

SEQ ID NO: 776348 - RNA, 16 nt, Homo sapiens
gcucaguaauuccugu

SEQ ID NO: 776349 - RNA, 12 nt, Homo sapiens
gcucaguauuuu

SEQ ID NO: 776350 - RNA, 17 nt, Homo sapiens
gcucauaaacugccaag

SEQ ID NO: 776351 - RNA, 17 nt, Homo sapiens
gcucauagggaagaccu

SEQ ID NO: 776352 - RNA, 14 nt, Homo sapiens
gcucaucacuggau

SEQ ID NO: 776353 - RNA, 20 nt, Homo sapiens
gcucaucuguuaugcauagc

SEQ ID NO: 776354 - RNA, 18 nt, Homo sapiens
gcucaugagcgucugugg

SEQ ID NO: 776355 - RNA, 10 nt, Homo sapiens
gcucaugccc

SEQ ID NO: 776356 - RNA, 15 nt, Homo sapiens
gcucauugaacuuua

SEQ ID NO: 776357 - RNA, 16 nt, Homo sapiens
gcuccaaccugcaaag

SEQ ID NO: 776358 - RNA, 21 nt, Homo sapiens
gcuccaagugauacuucugcc

SEQ ID NO: 776359 - RNA, 21 nt, Homo sapiens
gcuccacacccucucccagga

SEQ ID NO: 776360 - RNA, 20 nt, Homo sapiens
gcuccacgcagucugcuuca

SEQ ID NO: 776361 - RNA, 13 nt, Homo sapiens
gcuccacugaaca

SEQ ID NO: 776362 - RNA, 20 nt, Homo sapiens
gcuccagcaacugcccuucc

SEQ ID NO: 776363 - RNA, 17 nt, Homo sapiens
gcuccagcgauggugcu

SEQ ID NO: 776364 - RNA, 22 nt, Homo sapiens
gcuccaggaucuuugacugaaa

SEQ ID NO: 776365 - RNA, 21 nt, Homo sapiens
gcuccaugagggcaggcacau

SEQ ID NO: 776366 - RNA, 19 nt, Homo sapiens
gcucccagacggucaggaa

SEQ ID NO: 776367 - RNA, 14 nt, Homo sapiens
gcucccauucacuc

SEQ ID NO: 776368 - RNA, 16 nt, Homo sapiens
gcuccccucacucugu

SEQ ID NO: 776369 - RNA, 21 nt, Homo sapiens
gcucccggcgggugcucugag

SEQ ID NO: 776370 - RNA, 14 nt, Homo sapiens
gcucccuccuccag

SEQ ID NO: 776371 - RNA, 22 nt, Homo sapiens
gcucccucuauuuauguuugca

SEQ ID NO: 776372 - RNA, 15 nt, Homo sapiens
gcuccgggaucagca

SEQ ID NO: 776373 - RNA, 22 nt, Homo sapiens
gcuccgggcaaauggcugagau

SEQ ID NO: 776374 - RNA, 13 nt, Homo sapiens
gcuccggggccag

SEQ ID NO: 776375 - RNA, 22 nt, Homo sapiens
gcuccuccguguggacugugcc

SEQ ID NO: 776376 - RNA, 17 nt, Homo sapiens
gcuccuccuuaugacuc

SEQ ID NO: 776377 - RNA, 22 nt, Homo sapiens
gcuccucggacucugcuuuaug

SEQ ID NO: 776378 - RNA, 20 nt, Homo sapiens
gcuccucuccccagcccaga

SEQ ID NO: 776379 - RNA, 20 nt, Homo sapiens
gcuccucuccuuacuccauc

SEQ ID NO: 776380 - RNA, 15 nt, Homo sapiens
gcuccugaggggcau

SEQ ID NO: 776381 - RNA, 23 nt, Homo sapiens
gcuccuguguucuagaccucugg

SEQ ID NO: 776382 - RNA, 13 nt, Homo sapiens
gcucgagugaauu

SEQ ID NO: 776383 - RNA, 15 nt, Homo sapiens
gcucgcucaggugau

SEQ ID NO: 776384 - RNA, 16 nt, Homo sapiens
gcucguggacugugcu

SEQ ID NO: 776385 - RNA, 21 nt, Homo sapiens
gcucuaaacaagucccuuuau

SEQ ID NO: 776386 - RNA, 20 nt, Homo sapiens
gcucuaauucacagugcucu

SEQ ID NO: 776387 - RNA, 22 nt, Homo sapiens
gcucuacuaccuacguuugcac

SEQ ID NO: 776388 - RNA, 20 nt, Homo sapiens
gcucuagagaaaagucuacc

SEQ ID NO: 776389 - RNA, 22 nt, Homo sapiens
gcucuagagaaaagucuacccc

SEQ ID NO: 776390 - RNA, 21 nt, Homo sapiens
gcucuagauucauaaauacaa

SEQ ID NO: 776391 - RNA, 21 nt, Homo sapiens
gcucuagccugggcaacaaca

SEQ ID NO: 776392 - RNA, 16 nt, Homo sapiens
gcucuagggaaucugg

SEQ ID NO: 776393 - RNA, 13 nt, Homo sapiens
gcucuagucacug

SEQ ID NO: 776394 - RNA, 13 nt, Homo sapiens
gcucuaguuuuca

SEQ ID NO: 776395 - RNA, 22 nt, Homo sapiens
gcucuaucuuuuccuucaguga

SEQ ID NO: 776396 - RNA, 15 nt, Homo sapiens
gcucucaagaccaga

SEQ ID NO: 776397 - RNA, 16 nt, Homo sapiens
gcucucaggccagcuc

SEQ ID NO: 776398 - RNA, 16 nt, Homo sapiens
gcucucccaacucuug

SEQ ID NO: 776399 - RNA, 13 nt, Homo sapiens
gcucucgacagua

SEQ ID NO: 776400 - RNA, 19 nt, Homo sapiens
gcucucuguaucagucuuu

SEQ ID NO: 776401 - RNA, 18 nt, Homo sapiens
gcucucuugugacgugca

SEQ ID NO: 776402 - RNA, 16 nt, Homo sapiens
gcucugaauguccuga

SEQ ID NO: 776403 - RNA, 15 nt, Homo sapiens
gcucugacaagaugg

SEQ ID NO: 776404 - RNA, 19 nt, Homo sapiens
gcucugccacccuaccugu

SEQ ID NO: 776405 - RNA, 23 nt, Homo sapiens
gcucugcguggcgcaggugccau

SEQ ID NO: 776406 - RNA, 17 nt, Homo sapiens
gcucugggauagcugac

SEQ ID NO: 776407 - RNA, 17 nt, Homo sapiens
gcucuggguugugcaca

SEQ ID NO: 776408 - RNA, 20 nt, Homo sapiens
gcucuguaggucauuggcca

SEQ ID NO: 776409 - RNA, 17 nt, Homo sapiens
gcucuguauggucagga

SEQ ID NO: 776410 - RNA, 20 nt, Homo sapiens
gcucugugcagucacuggag

SEQ ID NO: 776411 - RNA, 19 nt, Homo sapiens
gcucuguugcccaagcugg

SEQ ID NO: 776412 - RNA, 21 nt, Homo sapiens
gcucuuagcagcuuccagauu

SEQ ID NO: 776413 - RNA, 22 nt, Homo sapiens
gcucuuaggugcuucuucacuu

SEQ ID NO: 776414 - RNA, 20 nt, Homo sapiens
gcucuuaugugugccuuugu

SEQ ID NO: 776415 - RNA, 11 nt, Homo sapiens
gcucuucacau

SEQ ID NO: 776416 - RNA, 22 nt, Homo sapiens
gcucuucagaugccacuucuaa

SEQ ID NO: 776417 - RNA, 17 nt, Homo sapiens
gcucuucccccaugugc

SEQ ID NO: 776418 - RNA, 14 nt, Homo sapiens
gcucuucuaaggaa

SEQ ID NO: 776419 - RNA, 21 nt, Homo sapiens
gcucuucucuccaguguuucu

SEQ ID NO: 776420 - RNA, 18 nt, Homo sapiens
gcucuugaggcauuucca

SEQ ID NO: 776421 - RNA, 11 nt, Homo sapiens
gcucuugcagu

SEQ ID NO: 776422 - RNA, 19 nt, Homo sapiens
gcucuugggaagaccagcu

SEQ ID NO: 776423 - RNA, 22 nt, Homo sapiens
gcucuugugaacugucuuggcu

SEQ ID NO: 776424 - RNA, 15 nt, Homo sapiens
gcucuuuaccaagga

SEQ ID NO: 776425 - RNA, 18 nt, Homo sapiens
gcucuuucagaacaaaca

SEQ ID NO: 776426 - RNA, 23 nt, Homo sapiens
gcucuuucagagaggucucaggu

SEQ ID NO: 776427 - RNA, 21 nt, Homo sapiens
gcucuuucaucucugcuugga

SEQ ID NO: 776428 - RNA, 17 nt, Homo sapiens
gcucuuucccuuuauca

SEQ ID NO: 776429 - RNA, 18 nt, Homo sapiens
gcucuuuugcacaaggaa

SEQ ID NO: 776430 - RNA, 21 nt, Homo sapiens
gcucuuuugcacaaggaaaua

SEQ ID NO: 776431 - RNA, 17 nt, Homo sapiens
gcugaaaaaucauccaa

SEQ ID NO: 776432 - RNA, 15 nt, Homo sapiens
gcugaaacucauuug

SEQ ID NO: 776433 - RNA, 21 nt, Homo sapiens
gcugaaacugaaauaagcuaa

SEQ ID NO: 776434 - RNA, 17 nt, Homo sapiens
gcugaacaauaggcugu

SEQ ID NO: 776435 - RNA, 17 nt, Homo sapiens
gcugaacugacaaugaa

SEQ ID NO: 776436 - RNA, 21 nt, Homo sapiens
gcugaaggcaguggcagggga

SEQ ID NO: 776437 - RNA, 15 nt, Homo sapiens
gcugaauucacuuaa

SEQ ID NO: 776438 - RNA, 23 nt, Homo sapiens
gcugacaugaagcuguuguguga

SEQ ID NO: 776439 - RNA, 19 nt, Homo sapiens
gcugaccccucuggugugu

SEQ ID NO: 776440 - RNA, 16 nt, Homo sapiens
gcugaccucccaguga

SEQ ID NO: 776441 - RNA, 18 nt, Homo sapiens
gcugacuguacuccuccc

SEQ ID NO: 776442 - RNA, 13 nt, Homo sapiens
gcugacuuuggga

SEQ ID NO: 776443 - RNA, 14 nt, Homo sapiens
gcugagagacccaa

SEQ ID NO: 776444 - RNA, 16 nt, Homo sapiens
gcugaggcaagagaau

SEQ ID NO: 776445 - RNA, 21 nt, Homo sapiens
gcugaguagcucugccuuugc

SEQ ID NO: 776446 - RNA, 19 nt, Homo sapiens
gcugaguagggacucaggg

SEQ ID NO: 776447 - RNA, 16 nt, Homo sapiens
gcugagucaccuccuc

SEQ ID NO: 776448 - RNA, 18 nt, Homo sapiens
gcugagugaaugaacaaa

SEQ ID NO: 776449 - RNA, 16 nt, Homo sapiens
gcugagugcaccacuu

SEQ ID NO: 776450 - RNA, 22 nt, Homo sapiens
gcugaguguccagcacaccugc

SEQ ID NO: 776451 - RNA, 19 nt, Homo sapiens
gcugauccagagcacagau

SEQ ID NO: 776452 - RNA, 12 nt, Homo sapiens
gcugauccaguu

SEQ ID NO: 776453 - RNA, 17 nt, Homo sapiens
gcugaugagaaucaugc

SEQ ID NO: 776454 - RNA, 15 nt, Homo sapiens
gcugaugcagacaca

SEQ ID NO: 776455 - RNA, 13 nt, Homo sapiens
gcugauggcagcu

SEQ ID NO: 776456 - RNA, 15 nt, Homo sapiens
gcugauucagcagug

SEQ ID NO: 776457 - RNA, 19 nt, Homo sapiens
gcugauucagcagugccua

SEQ ID NO: 776458 - RNA, 20 nt, Homo sapiens
gcugauuuucaucaaaacca

SEQ ID NO: 776459 - RNA, 21 nt, Homo sapiens
gcugcaacggaauuaggaaga

SEQ ID NO: 776460 - RNA, 12 nt, Homo sapiens
gcugcaaugccc

SEQ ID NO: 776461 - RNA, 13 nt, Homo sapiens
gcugcacauuccu

SEQ ID NO: 776462 - RNA, 16 nt, Homo sapiens
guacgguggcacgugc

SEQ ID NO: 776463 - RNA, 20 nt, Homo sapiens
guacuaacuagcauuguaaa

SEQ ID NO: 776464 - RNA, 15 nt, Homo sapiens
guacuaguccaucau

SEQ ID NO: 776465 - RNA, 18 nt, Homo sapiens
guacuauauuugugaaua

SEQ ID NO: 776466 - RNA, 23 nt, Homo sapiens
guacucaaguaccaccaagggau

SEQ ID NO: 776467 - RNA, 12 nt, Homo sapiens
guacucaaugga

SEQ ID NO: 776468 - RNA, 14 nt, Homo sapiens
guacucacauauaa

SEQ ID NO: 776469 - RNA, 15 nt, Homo sapiens
guacucucugcucua

SEQ ID NO: 776470 - RNA, 17 nt, Homo sapiens
guacucuuuaacauaca

SEQ ID NO: 776471 - RNA, 17 nt, Homo sapiens
guacugauucaagaaca

SEQ ID NO: 776472 - RNA, 15 nt, Homo sapiens
guacugcacaaggac

SEQ ID NO: 776473 - RNA, 22 nt, Homo sapiens
guacugcacccagcagugucac

SEQ ID NO: 776474 - RNA, 23 nt, Homo sapiens
guacuggcaauaagauacacagc

SEQ ID NO: 776475 - RNA, 17 nt, Homo sapiens
guacugugucucaugga

SEQ ID NO: 776476 - RNA, 19 nt, Homo sapiens
guacuuagcagcuaucucu

SEQ ID NO: 776477 - RNA, 16 nt, Homo sapiens
guacuuauguugcaca

SEQ ID NO: 776478 - RNA, 15 nt, Homo sapiens
guacuucucacccag

SEQ ID NO: 776479 - RNA, 20 nt, Homo sapiens
guacuuguagaguggugcug

SEQ ID NO: 776480 - RNA, 14 nt, Homo sapiens
guacuuguuugcaa

SEQ ID NO: 776481 - RNA, 15 nt, Homo sapiens
guacuuguuugcuau

SEQ ID NO: 776482 - RNA, 13 nt, Homo sapiens
guacuuuaccuaa

SEQ ID NO: 776483 - RNA, 19 nt, Homo sapiens
guagaaacacaguuuugaa

SEQ ID NO: 776484 - RNA, 15 nt, Homo sapiens
guagaaaucucagaa

SEQ ID NO: 776485 - RNA, 22 nt, Homo sapiens
guagaaggggaggacacuggug

SEQ ID NO: 776486 - RNA, 20 nt, Homo sapiens
guagaagguaacucuuugca

SEQ ID NO: 776487 - RNA, 22 nt, Homo sapiens
guagaauuaccauuaauuacau

SEQ ID NO: 776488 - RNA, 20 nt, Homo sapiens
guagaauuguuuggcaaugc

SEQ ID NO: 776489 - RNA, 17 nt, Homo sapiens
guagacuagugccguag

SEQ ID NO: 776490 - RNA, 15 nt, Homo sapiens
guagagaagcaagua

SEQ ID NO: 776491 - RNA, 19 nt, Homo sapiens
guagaggcugggggcucca

SEQ ID NO: 776492 - RNA, 19 nt, Homo sapiens
guagagguauguuugugaa

SEQ ID NO: 776493 - RNA, 12 nt, Homo sapiens
guagaguggugc

SEQ ID NO: 776494 - RNA, 15 nt, Homo sapiens
guagauacuagcuau

SEQ ID NO: 776495 - RNA, 20 nt, Homo sapiens
guagauauuguuuucuguaa

SEQ ID NO: 776496 - RNA, 12 nt, Homo sapiens
guagaugugauu

SEQ ID NO: 776497 - RNA, 12 nt, Homo sapiens
guagcacugagg

SEQ ID NO: 776498 - RNA, 13 nt, Homo sapiens
guagcagcuauau

SEQ ID NO: 776499 - RNA, 17 nt, Homo sapiens
guagcauuggucaggga

SEQ ID NO: 776500 - RNA, 19 nt, Homo sapiens
guagcauuggucagggaaa

SEQ ID NO: 776501 - RNA, 17 nt, Homo sapiens
guagcccagcacuguga

SEQ ID NO: 776502 - RNA, 16 nt, Homo sapiens
guagcccauccuuccc

SEQ ID NO: 776503 - RNA, 16 nt, Homo sapiens
guagccugugcaugua

SEQ ID NO: 776504 - RNA, 20 nt, Homo sapiens
guagcuaagugaaaagguca

SEQ ID NO: 776505 - RNA, 10 nt, Homo sapiens
guagcucucc

SEQ ID NO: 776506 - RNA, 16 nt, Homo sapiens
guagcucucccuaggc

SEQ ID NO: 776507 - RNA, 21 nt, Homo sapiens
guagcuuaccagaagcuucca

SEQ ID NO: 776508 - RNA, 19 nt, Homo sapiens
guaggaaagaggaagcaaa

SEQ ID NO: 776509 - RNA, 18 nt, Homo sapiens
guaggaaagucacccaaa

SEQ ID NO: 776510 - RNA, 13 nt, Homo sapiens
guaggacauacca

SEQ ID NO: 776511 - RNA, 15 nt, Homo sapiens
guaggagacuugcca

SEQ ID NO: 776512 - RNA, 15 nt, Homo sapiens
guaggagcugccuug

SEQ ID NO: 776513 - RNA, 21 nt, Homo sapiens
guaggagcugccuuggcucag

SEQ ID NO: 776514 - RNA, 17 nt, Homo sapiens
guaggcacaagaccaag

SEQ ID NO: 776515 - RNA, 22 nt, Homo sapiens
guaggcauucugagcaggggaa

SEQ ID NO: 776516 - RNA, 23 nt, Homo sapiens
guaggcccugguuccugcugucc

SEQ ID NO: 776517 - RNA, 14 nt, Homo sapiens
guaggggcagggag

SEQ ID NO: 776518 - RNA, 15 nt, Homo sapiens
guaggggcagugaug

SEQ ID NO: 776519 - RNA, 11 nt, Homo sapiens
guaggggccac

SEQ ID NO: 776520 - RNA, 17 nt, Homo sapiens
guaggggcccacuucac

SEQ ID NO: 776521 - RNA, 15 nt, Homo sapiens
guagguaauguuccu

SEQ ID NO: 776522 - RNA, 17 nt, Homo sapiens
guaggugucugccuuca

SEQ ID NO: 776523 - RNA, 16 nt, Homo sapiens
guaggugugacuugaa

SEQ ID NO: 776524 - RNA, 16 nt, Homo sapiens
guagguuaacacugaa

SEQ ID NO: 776525 - RNA, 16 nt, Homo sapiens
guagguuucucucuuc

SEQ ID NO: 776526 - RNA, 18 nt, Homo sapiens
guaguagcgaacugcacu

SEQ ID NO: 776527 - RNA, 13 nt, Homo sapiens
guaguccaucacc

SEQ ID NO: 776528 - RNA, 19 nt, Homo sapiens
guagucccagcuacucagg

SEQ ID NO: 776529 - RNA, 12 nt, Homo sapiens
guagucuugucu

SEQ ID NO: 776530 - RNA, 20 nt, Homo sapiens
guagugaaauuauacagaua

SEQ ID NO: 776531 - RNA, 21 nt, Homo sapiens
guaguguauucucuaaaagcu

SEQ ID NO: 776532 - RNA, 16 nt, Homo sapiens
guaguuagccaucuaa

SEQ ID NO: 776533 - RNA, 21 nt, Homo sapiens
guaguuuaguacaauaaucuc

SEQ ID NO: 776534 - RNA, 19 nt, Homo sapiens
guaguuuaugaugcaaauc

SEQ ID NO: 776535 - RNA, 13 nt, Homo sapiens
guaguuuguuuua

SEQ ID NO: 776536 - RNA, 19 nt, Homo sapiens
guauaaaaauuaucaaaaa

SEQ ID NO: 776537 - RNA, 19 nt, Homo sapiens
guauaaacaguuuuuggca

SEQ ID NO: 776538 - RNA, 21 nt, Homo sapiens
guauaaaggcuaaaagggaaa

SEQ ID NO: 776539 - RNA, 14 nt, Homo sapiens
guauaacaacuuug

SEQ ID NO: 776540 - RNA, 22 nt, Homo sapiens
guauaacaagccaaacauucuu

SEQ ID NO: 776541 - RNA, 22 nt, Homo sapiens
guauaacuggauugcagacugu

SEQ ID NO: 776542 - RNA, 22 nt, Homo sapiens
guauaaggacuauagugauuua

SEQ ID NO: 776543 - RNA, 18 nt, Homo sapiens
guauaaguaauacuucag

SEQ ID NO: 776544 - RNA, 15 nt, Homo sapiens
guauaaguauucaag

SEQ ID NO: 776545 - RNA, 19 nt, Homo sapiens
guauaaugcaguacauuaa

SEQ ID NO: 776546 - RNA, 14 nt, Homo sapiens
guauaauugaccua

SEQ ID NO: 776547 - RNA, 18 nt, Homo sapiens
guauacguauaaauauca

SEQ ID NO: 776548 - RNA, 17 nt, Homo sapiens
guauacuucagugcuca

SEQ ID NO: 776549 - RNA, 21 nt, Homo sapiens
guauacuuguauaacuuugua

SEQ ID NO: 776550 - RNA, 22 nt, Homo sapiens
guauacuuuaguagacauuuau

SEQ ID NO: 776551 - RNA, 15 nt, Homo sapiens
guauaguacuggcau

SEQ ID NO: 776552 - RNA, 18 nt, Homo sapiens
guauaguuuuauuuacuu

SEQ ID NO: 776553 - RNA, 16 nt, Homo sapiens
guauauagaacacaag

SEQ ID NO: 776554 - RNA, 15 nt, Homo sapiens
guauauagaagucua

SEQ ID NO: 776555 - RNA, 17 nt, Homo sapiens
guauauaguaugaaugc

SEQ ID NO: 776556 - RNA, 19 nt, Homo sapiens
guauauauguguaugcaca

SEQ ID NO: 776557 - RNA, 15 nt, Homo sapiens
guauaugauucucuu

SEQ ID NO: 776558 - RNA, 17 nt, Homo sapiens
guauaugucuuuuaccc

SEQ ID NO: 776559 - RNA, 20 nt, Homo sapiens
guauauuuguaaacuacaaa

SEQ ID NO: 776560 - RNA, 21 nt, Homo sapiens
guauauuuugacgucacugau

SEQ ID NO: 776561 - RNA, 15 nt, Homo sapiens
guaucaacacuguua

SEQ ID NO: 776562 - RNA, 16 nt, Homo sapiens
guaucaacacuguuac

SEQ ID NO: 776563 - RNA, 23 nt, Homo sapiens
guaucaaguggcaugugcuguga

SEQ ID NO: 776564 - RNA, 15 nt, Homo sapiens
guaucacaguguuuu

SEQ ID NO: 776565 - RNA, 21 nt, Homo sapiens
guaucagaucuaucuugucaa

SEQ ID NO: 776566 - RNA, 23 nt, Homo sapiens
guauccagagauacuacaauauu

SEQ ID NO: 776567 - RNA, 12 nt, Homo sapiens
guauccaugcau

SEQ ID NO: 776568 - RNA, 16 nt, Homo sapiens
guaucccugcucugcu

SEQ ID NO: 776569 - RNA, 16 nt, Homo sapiens
guauccugcccagugu

SEQ ID NO: 776570 - RNA, 13 nt, Homo sapiens
guauccugugaca

SEQ ID NO: 776571 - RNA, 17 nt, Homo sapiens
guauccugugacaugua

SEQ ID NO: 776572 - RNA, 13 nt, Homo sapiens
guaucgcugagac

SEQ ID NO: 776573 - RNA, 17 nt, Homo sapiens
guaucucaagauauuca

SEQ ID NO: 776574 - RNA, 20 nt, Homo sapiens
guaucugacaaugcugaggu

SEQ ID NO: 776575 - RNA, 15 nt, Homo sapiens
guaucuggcuucccu

SEQ ID NO: 776576 - RNA, 13 nt, Homo sapiens
guaucugugaaca

SEQ ID NO: 776577 - RNA, 15 nt, Homo sapiens
gugagucaccacuuc

SEQ ID NO: 776578 - RNA, 19 nt, Homo sapiens
gugaguccgggaaucucuu

SEQ ID NO: 776579 - RNA, 16 nt, Homo sapiens
gugagucuugguucua

SEQ ID NO: 776580 - RNA, 20 nt, Homo sapiens
gugaguucuuucaucucccu

SEQ ID NO: 776581 - RNA, 18 nt, Homo sapiens
gugauaaguuccaaauau

SEQ ID NO: 776582 - RNA, 15 nt, Homo sapiens
gugauauaugccuau

SEQ ID NO: 776583 - RNA, 14 nt, Homo sapiens
gugauaucaccucu

SEQ ID NO: 776584 - RNA, 19 nt, Homo sapiens
gugauauggugaagggaag

SEQ ID NO: 776585 - RNA, 21 nt, Homo sapiens
gugauauuuucacacugguaa

SEQ ID NO: 776586 - RNA, 22 nt, Homo sapiens
gugaucacugagacagccacuu

SEQ ID NO: 776587 - RNA, 14 nt, Homo sapiens
gugauccuguucug

SEQ ID NO: 776588 - RNA, 18 nt, Homo sapiens
gugaugaaucuacauuug

SEQ ID NO: 776589 - RNA, 22 nt, Homo sapiens
gugaugacuuagcgucaagaca

SEQ ID NO: 776590 - RNA, 15 nt, Homo sapiens
gugaugcuguacaca

SEQ ID NO: 776591 - RNA, 23 nt, Homo sapiens
gugauggccaggccaggggaccc

SEQ ID NO: 776592 - RNA, 12 nt, Homo sapiens
gugauguucuaa

SEQ ID NO: 776593 - RNA, 14 nt, Homo sapiens
gugauucaccucuu

SEQ ID NO: 776594 - RNA, 23 nt, Homo sapiens
gugauucccuccugcuacucugu

SEQ ID NO: 776595 - RNA, 18 nt, Homo sapiens
gugauucgcccaccucag

SEQ ID NO: 776596 - RNA, 22 nt, Homo sapiens
gugauucuguuuauucuuccag

SEQ ID NO: 776597 - RNA, 14 nt, Homo sapiens
gugauugcugccau

SEQ ID NO: 776598 - RNA, 14 nt, Homo sapiens
gugauuuacauuuc

SEQ ID NO: 776599 - RNA, 18 nt, Homo sapiens
gugauuucuuucuuugca

SEQ ID NO: 776600 - RNA, 16 nt, Homo sapiens
gugcaaaaucuguuau

SEQ ID NO: 776601 - RNA, 20 nt, Homo sapiens
gugcaacgcuuuuugggaga

SEQ ID NO: 776602 - RNA, 19 nt, Homo sapiens
gugcacagggggaggccau

SEQ ID NO: 776603 - RNA, 23 nt, Homo sapiens
gugcacauuucuuugcauuccag

SEQ ID NO: 776604 - RNA, 17 nt, Homo sapiens
gugcagaccuuggggga

SEQ ID NO: 776605 - RNA, 18 nt, Homo sapiens
gugcagagagaucaucac

SEQ ID NO: 776606 - RNA, 17 nt, Homo sapiens
gugcagccacacacaga

SEQ ID NO: 776607 - RNA, 22 nt, Homo sapiens
gugcagggaggaaaagugcaag

SEQ ID NO: 776608 - RNA, 13 nt, Homo sapiens
gugcaguacuuaa

SEQ ID NO: 776609 - RNA, 22 nt, Homo sapiens
gugcaguacuuugugcauucug

SEQ ID NO: 776610 - RNA, 14 nt, Homo sapiens
gugcaguaucucaa

SEQ ID NO: 776611 - RNA, 19 nt, Homo sapiens
gugcaguggcaucaucuca

SEQ ID NO: 776612 - RNA, 20 nt, Homo sapiens
gugcaguggcaucaucucag

SEQ ID NO: 776613 - RNA, 20 nt, Homo sapiens
gugcaguggcgcgaucucag

SEQ ID NO: 776614 - RNA, 19 nt, Homo sapiens
gugcaguggcgugaucucg

SEQ ID NO: 776615 - RNA, 19 nt, Homo sapiens
gugcaguggcgugaucuug

SEQ ID NO: 776616 - RNA, 21 nt, Homo sapiens
gugcaucacggauggugcaug

SEQ ID NO: 776617 - RNA, 15 nt, Homo sapiens
gugcauuucuaggac

SEQ ID NO: 776618 - RNA, 11 nt, Homo sapiens
gugcauuuuau

SEQ ID NO: 776619 - RNA, 20 nt, Homo sapiens
gugccaccaacauaaaacaa

SEQ ID NO: 776620 - RNA, 12 nt, Homo sapiens
gugccaccauca

SEQ ID NO: 776621 - RNA, 16 nt, Homo sapiens
gugccauugcacucca

SEQ ID NO: 776622 - RNA, 22 nt, Homo sapiens
gugcccauguguacauucugcc

SEQ ID NO: 776623 - RNA, 13 nt, Homo sapiens
gugccccaugccu

SEQ ID NO: 776624 - RNA, 17 nt, Homo sapiens
gugccccccuccuccag

SEQ ID NO: 776625 - RNA, 10 nt, Homo sapiens
gugcccucca

SEQ ID NO: 776626 - RNA, 21 nt, Homo sapiens
gugcccuuuucauauacuuau

SEQ ID NO: 776627 - RNA, 22 nt, Homo sapiens
gugccgaggacaugcaugacac

SEQ ID NO: 776628 - RNA, 17 nt, Homo sapiens
gugccgcugucucugag

SEQ ID NO: 776629 - RNA, 23 nt, Homo sapiens
gugccuagacuguuacuuuggca

SEQ ID NO: 776630 - RNA, 21 nt, Homo sapiens
gugccuccaccaccacuggcc

SEQ ID NO: 776631 - RNA, 22 nt, Homo sapiens
gugccuccaggugugcacgugg

SEQ ID NO: 776632 - RNA, 11 nt, Homo sapiens
gugccugagac

SEQ ID NO: 776633 - RNA, 18 nt, Homo sapiens
gugccuggccuggcacac

SEQ ID NO: 776634 - RNA, 15 nt, Homo sapiens
gugccugggguguua

SEQ ID NO: 776635 - RNA, 12 nt, Homo sapiens
gugccugugauc

SEQ ID NO: 776636 - RNA, 16 nt, Homo sapiens
gugcgcucugccauuc

SEQ ID NO: 776637 - RNA, 15 nt, Homo sapiens
gugcguguguguaug

SEQ ID NO: 776638 - RNA, 13 nt, Homo sapiens
gugcuacaaaaac

SEQ ID NO: 776639 - RNA, 22 nt, Homo sapiens
gugcuauaaaugccagagccaa

SEQ ID NO: 776640 - RNA, 13 nt, Homo sapiens
gugcucauuuaag

SEQ ID NO: 776641 - RNA, 16 nt, Homo sapiens
gugcucgaccuugaua

SEQ ID NO: 776642 - RNA, 14 nt, Homo sapiens
gugcucgagacaca

SEQ ID NO: 776643 - RNA, 18 nt, Homo sapiens
gugcugaaggaauggaag

SEQ ID NO: 776644 - RNA, 15 nt, Homo sapiens
gugcugcacaaaagc

SEQ ID NO: 776645 - RNA, 20 nt, Homo sapiens
gugcugcucucccaucuccc

SEQ ID NO: 776646 - RNA, 16 nt, Homo sapiens
gugcuggauuugauga

SEQ ID NO: 776647 - RNA, 18 nt, Homo sapiens
gugcugggauuacaggug

SEQ ID NO: 776648 - RNA, 19 nt, Homo sapiens
gugcugggugggcaucuca

SEQ ID NO: 776649 - RNA, 15 nt, Homo sapiens
gugcugugcagcucu

SEQ ID NO: 776650 - RNA, 22 nt, Homo sapiens
gugcuucagaguuuguguguau

SEQ ID NO: 776651 - RNA, 19 nt, Homo sapiens
gugcuuccgagcugggaug

SEQ ID NO: 776652 - RNA, 20 nt, Homo sapiens
gugcuucgagugacugaccc

SEQ ID NO: 776653 - RNA, 14 nt, Homo sapiens
gugcuucuucacuu

SEQ ID NO: 776654 - RNA, 19 nt, Homo sapiens
gugcuuggucuguuugacu

SEQ ID NO: 776655 - RNA, 15 nt, Homo sapiens
gugcuugucauucca

SEQ ID NO: 776656 - RNA, 16 nt, Homo sapiens
gugcuugucauuccag

SEQ ID NO: 776657 - RNA, 22 nt, Homo sapiens
gugcuuucccagucccauuccu

SEQ ID NO: 776658 - RNA, 16 nt, Homo sapiens
guggaaauaauuugaa

SEQ ID NO: 776659 - RNA, 17 nt, Homo sapiens
guggaagaacugugaua

SEQ ID NO: 776660 - RNA, 20 nt, Homo sapiens
guggaaggcaucagucccua

SEQ ID NO: 776661 - RNA, 19 nt, Homo sapiens
guggaauagccucccugua

SEQ ID NO: 776662 - RNA, 22 nt, Homo sapiens
guggaaugccgcugucucugag

SEQ ID NO: 776663 - RNA, 18 nt, Homo sapiens
guggacaggaugaggaca

SEQ ID NO: 776664 - RNA, 19 nt, Homo sapiens
guggacauguggguggaga

SEQ ID NO: 776665 - RNA, 20 nt, Homo sapiens
guggaccacaggcaucuaca

SEQ ID NO: 776666 - RNA, 23 nt, Homo sapiens
guggacccugucuucugggcaca

SEQ ID NO: 776667 - RNA, 19 nt, Homo sapiens
guggacugcagucggcaug

SEQ ID NO: 776668 - RNA, 17 nt, Homo sapiens
guggagaaacuguaguc

SEQ ID NO: 776669 - RNA, 16 nt, Homo sapiens
guggagaaagcacuga

SEQ ID NO: 776670 - RNA, 23 nt, Homo sapiens
guggagaaaggggaaguggucca

SEQ ID NO: 776671 - RNA, 22 nt, Homo sapiens
guggagaagaucgcauggcaga

SEQ ID NO: 776672 - RNA, 21 nt, Homo sapiens
guggagaagggaggguggcca

SEQ ID NO: 776673 - RNA, 13 nt, Homo sapiens
guggaggcuuccu

SEQ ID NO: 776674 - RNA, 22 nt, Homo sapiens
guggaggguggggggcgcugag

SEQ ID NO: 776675 - RNA, 15 nt, Homo sapiens
guggagguugcagug

SEQ ID NO: 776676 - RNA, 17 nt, Homo sapiens
guggaucacgaggucag

SEQ ID NO: 776677 - RNA, 17 nt, Homo sapiens
guggaucccagcuuggu

SEQ ID NO: 776678 - RNA, 15 nt, Homo sapiens
guggaugauguuucg

SEQ ID NO: 776679 - RNA, 12 nt, Homo sapiens
guggauguauaa

SEQ ID NO: 776680 - RNA, 23 nt, Homo sapiens
guggcaccgccuccccaccucca

SEQ ID NO: 776681 - RNA, 16 nt, Homo sapiens
guggcacucagucucu

SEQ ID NO: 776682 - RNA, 20 nt, Homo sapiens
guggcacuugccugggucac

SEQ ID NO: 776683 - RNA, 17 nt, Homo sapiens
guggcagccgucccagg

SEQ ID NO: 776684 - RNA, 17 nt, Homo sapiens
guggcauuaaacauuug

SEQ ID NO: 776685 - RNA, 13 nt, Homo sapiens
guggcccaagacu

SEQ ID NO: 776686 - RNA, 18 nt, Homo sapiens
guggcccagagaagccaa

SEQ ID NO: 776687 - RNA, 16 nt, Homo sapiens
guggccuauuccagga

SEQ ID NO: 776688 - RNA, 12 nt, Homo sapiens
guggccucagaa

SEQ ID NO: 776689 - RNA, 13 nt, Homo sapiens
guggccugggauc

SEQ ID NO: 776690 - RNA, 13 nt, Homo sapiens
guggcucacagug

SEQ ID NO: 776691 - RNA, 15 nt, Homo sapiens
guugaucccaagaca

SEQ ID NO: 776692 - RNA, 22 nt, Homo sapiens
guugauggaaaauaaacaucag

SEQ ID NO: 776693 - RNA, 14 nt, Homo sapiens
guugcaagacucga

SEQ ID NO: 776694 - RNA, 15 nt, Homo sapiens
guugcacugaugucc

SEQ ID NO: 776695 - RNA, 21 nt, Homo sapiens
guugccaggcuggagugcagu

SEQ ID NO: 776696 - RNA, 20 nt, Homo sapiens
guugcccucuaccugacucc

SEQ ID NO: 776697 - RNA, 20 nt, Homo sapiens
guugcguggacucugcacau

SEQ ID NO: 776698 - RNA, 21 nt, Homo sapiens
guugcucuguuucuuccuuuc

SEQ ID NO: 776699 - RNA, 16 nt, Homo sapiens
guugcugcuacugucu

SEQ ID NO: 776700 - RNA, 15 nt, Homo sapiens
guugcuggacuguca

SEQ ID NO: 776701 - RNA, 11 nt, Homo sapiens
guugcuucccg

SEQ ID NO: 776702 - RNA, 19 nt, Homo sapiens
guuggaaaucaguugugaa

SEQ ID NO: 776703 - RNA, 22 nt, Homo sapiens
guuggaaccguguccagcacag

SEQ ID NO: 776704 - RNA, 10 nt, Homo sapiens
guuggaagag

SEQ ID NO: 776705 - RNA, 21 nt, Homo sapiens
guuggacaaaccgagugcaau

SEQ ID NO: 776706 - RNA, 12 nt, Homo sapiens
guuggacagccc

SEQ ID NO: 776707 - RNA, 16 nt, Homo sapiens
guuggagcuacugcaa

SEQ ID NO: 776708 - RNA, 14 nt, Homo sapiens
guuggcacaugccu

SEQ ID NO: 776709 - RNA, 18 nt, Homo sapiens
guuggccaggauggucuc

SEQ ID NO: 776710 - RNA, 20 nt, Homo sapiens
guuggcuagacuagucucaa

SEQ ID NO: 776711 - RNA, 23 nt, Homo sapiens
guugggggcaguguuguggcccu

SEQ ID NO: 776712 - RNA, 15 nt, Homo sapiens
guuggugacaccuca

SEQ ID NO: 776713 - RNA, 16 nt, Homo sapiens
guuggugacaccucac

SEQ ID NO: 776714 - RNA, 14 nt, Homo sapiens
guuguaaaaagccc

SEQ ID NO: 776715 - RNA, 14 nt, Homo sapiens
guuguagaagacaa

SEQ ID NO: 776716 - RNA, 14 nt, Homo sapiens
guuguagcauuuaa

SEQ ID NO: 776717 - RNA, 16 nt, Homo sapiens
guugugcuuucuagca

SEQ ID NO: 776718 - RNA, 14 nt, Homo sapiens
guuguguagucaag

SEQ ID NO: 776719 - RNA, 14 nt, Homo sapiens
guugugucuaggcu

SEQ ID NO: 776720 - RNA, 16 nt, Homo sapiens
guuguguggacuuuga

SEQ ID NO: 776721 - RNA, 21 nt, Homo sapiens
guuguguuauagggcacacau

SEQ ID NO: 776722 - RNA, 14 nt, Homo sapiens
guuguguugacaca

SEQ ID NO: 776723 - RNA, 14 nt, Homo sapiens
guuguuauuauuca

SEQ ID NO: 776724 - RNA, 15 nt, Homo sapiens
guuguugacugugau

SEQ ID NO: 776725 - RNA, 14 nt, Homo sapiens
guuguuuaaaguau

SEQ ID NO: 776726 - RNA, 21 nt, Homo sapiens
guuguuuauauacaguacaca

SEQ ID NO: 776727 - RNA, 13 nt, Homo sapiens
guuguuucuugcc

SEQ ID NO: 776728 - RNA, 14 nt, Homo sapiens
guuguuuguuuaaa

SEQ ID NO: 776729 - RNA, 14 nt, Homo sapiens
guuguuuguuugau

SEQ ID NO: 776730 - RNA, 18 nt, Homo sapiens
guuguuuuauauguugcu

SEQ ID NO: 776731 - RNA, 24 nt, Homo sapiens
guuguuuucagacucagacuccau

SEQ ID NO: 776732 - RNA, 20 nt, Homo sapiens
guuuaaaaagaaaaaaugca

SEQ ID NO: 776733 - RNA, 18 nt, Homo sapiens
guuuaaaugauacaguau

SEQ ID NO: 776734 - RNA, 20 nt, Homo sapiens
guuuaagcccagccaaguaa

SEQ ID NO: 776735 - RNA, 20 nt, Homo sapiens
guuuaaguaauugccuacaa

SEQ ID NO: 776736 - RNA, 18 nt, Homo sapiens
guuuaaucccagcacuuu

SEQ ID NO: 776737 - RNA, 18 nt, Homo sapiens
guuuaauggguaugcuca

SEQ ID NO: 776738 - RNA, 19 nt, Homo sapiens
guuuaauggguaugcucag

SEQ ID NO: 776739 - RNA, 15 nt, Homo sapiens
guuuaauuguacuca

SEQ ID NO: 776740 - RNA, 17 nt, Homo sapiens
guuuaauuucaugugua

SEQ ID NO: 776741 - RNA, 14 nt, Homo sapiens
guuuacaaauggac

SEQ ID NO: 776742 - RNA, 20 nt, Homo sapiens
guuuacagacgcugcuguca

SEQ ID NO: 776743 - RNA, 14 nt, Homo sapiens
guuuacagacugug

SEQ ID NO: 776744 - RNA, 16 nt, Homo sapiens
guuuacagcacuacuc

SEQ ID NO: 776745 - RNA, 23 nt, Homo sapiens
guuuacauuguaaauaguauuug

SEQ ID NO: 776746 - RNA, 14 nt, Homo sapiens
guuuacuugacaaa

SEQ ID NO: 776747 - RNA, 15 nt, Homo sapiens
guuuagagagccugu

SEQ ID NO: 776748 - RNA, 17 nt, Homo sapiens
guuuauacacuguguaa

SEQ ID NO: 776749 - RNA, 14 nt, Homo sapiens
guuuaugagccaga

SEQ ID NO: 776750 - RNA, 19 nt, Homo sapiens
guuuauggccacauuuaau

SEQ ID NO: 776751 - RNA, 15 nt, Homo sapiens
guuuauuaacuugag

SEQ ID NO: 776752 - RNA, 14 nt, Homo sapiens
guuuauuacaauuu

SEQ ID NO: 776753 - RNA, 13 nt, Homo sapiens
guuuauucuucca

SEQ ID NO: 776754 - RNA, 18 nt, Homo sapiens
guuuauuucaacuauuua

SEQ ID NO: 776755 - RNA, 19 nt, Homo sapiens
guuuauuuuuauacuuuca

SEQ ID NO: 776756 - RNA, 20 nt, Homo sapiens
guuuauuuuuauacuuucag

SEQ ID NO: 776757 - RNA, 17 nt, Homo sapiens
guuucaaaaaaucugac

SEQ ID NO: 776758 - RNA, 14 nt, Homo sapiens
guuucaaaaccaug

SEQ ID NO: 776759 - RNA, 19 nt, Homo sapiens
guuucaccauguuggccag

SEQ ID NO: 776760 - RNA, 14 nt, Homo sapiens
guuucagaugugca

SEQ ID NO: 776761 - RNA, 16 nt, Homo sapiens
guuuccagccugcuag

SEQ ID NO: 776762 - RNA, 19 nt, Homo sapiens
guuuccaucagguuccauc

SEQ ID NO: 776763 - RNA, 17 nt, Homo sapiens
guuucccauaauuuucu

SEQ ID NO: 776764 - RNA, 21 nt, Homo sapiens
guuucccaucagacugucaag

SEQ ID NO: 776765 - RNA, 20 nt, Homo sapiens
guuucccccuucuacauuuc

SEQ ID NO: 776766 - RNA, 19 nt, Homo sapiens
guuucccgguucaggacca

SEQ ID NO: 776767 - RNA, 14 nt, Homo sapiens
guuucccuaucucg

SEQ ID NO: 776768 - RNA, 23 nt, Homo sapiens
guuuccgaaggguuuugcuacau

SEQ ID NO: 776769 - RNA, 13 nt, Homo sapiens
guuuccuggucag

SEQ ID NO: 776770 - RNA, 21 nt, Homo sapiens
guuucguaacacagcauugua

SEQ ID NO: 776771 - RNA, 20 nt, Homo sapiens
guuucuauucuaaguaauuc

SEQ ID NO: 776772 - RNA, 20 nt, Homo sapiens
guuucuccuuuugaccaaau

SEQ ID NO: 776773 - RNA, 21 nt, Homo sapiens
guuucuccuuuugaccaaaua

SEQ ID NO: 776774 - RNA, 12 nt, Homo sapiens
guuucucuucac

SEQ ID NO: 776775 - RNA, 22 nt, Homo sapiens
guuucucuugaagaacugacua

SEQ ID NO: 776776 - RNA, 23 nt, Homo sapiens
guuucucuuggguauaaaggcua

SEQ ID NO: 776777 - RNA, 17 nt, Homo sapiens
guuucuugcauuuauua

SEQ ID NO: 776778 - RNA, 19 nt, Homo sapiens
guuucuuguuuaccaaaga

SEQ ID NO: 776779 - RNA, 15 nt, Homo sapiens
guuugaacucuguaa

SEQ ID NO: 776780 - RNA, 17 nt, Homo sapiens
guuugaagacacagccu

SEQ ID NO: 776781 - RNA, 17 nt, Homo sapiens
guuugaaucuacauuca

SEQ ID NO: 776782 - RNA, 13 nt, Homo sapiens
guuugagaccagc

SEQ ID NO: 776783 - RNA, 15 nt, Homo sapiens
guuugagaccagccu

SEQ ID NO: 776784 - RNA, 17 nt, Homo sapiens
guuugagaccgaccagc

SEQ ID NO: 776785 - RNA, 23 nt, Homo sapiens
guuugauugaggagcugcacuga

SEQ ID NO: 776786 - RNA, 20 nt, Homo sapiens
guuugcacuccacacaucuu

SEQ ID NO: 776787 - RNA, 13 nt, Homo sapiens
guuugcacuuccu

SEQ ID NO: 776788 - RNA, 11 nt, Homo sapiens
guuugccaugu

SEQ ID NO: 776789 - RNA, 22 nt, Homo sapiens
guuugcgggggucugagucuau

SEQ ID NO: 776790 - RNA, 21 nt, Homo sapiens
guuugcuauugacaagucauu

SEQ ID NO: 776791 - RNA, 14 nt, Homo sapiens
guuugcuuauaugu

SEQ ID NO: 776792 - RNA, 15 nt, Homo sapiens
guuugcuucuugcca

SEQ ID NO: 776793 - RNA, 21 nt, Homo sapiens
guuuggaaaccacagucagug

SEQ ID NO: 776794 - RNA, 21 nt, Homo sapiens
guuuggacccaguucagugag

SEQ ID NO: 776795 - RNA, 17 nt, Homo sapiens
guuuggacccaugguca

SEQ ID NO: 776796 - RNA, 18 nt, Homo sapiens
guuuggcaaugcacugaa

SEQ ID NO: 776797 - RNA, 15 nt, Homo sapiens
guuuggcuucagugu

SEQ ID NO: 776798 - RNA, 22 nt, Homo sapiens
guuugggaauauccauguacuu

SEQ ID NO: 776799 - RNA, 18 nt, Homo sapiens
guuuggggacaugugauu

SEQ ID NO: 776800 - RNA, 14 nt, Homo sapiens
guuuguaugagaug

SEQ ID NO: 776801 - RNA, 16 nt, Homo sapiens
guuugucagacuuuaa

SEQ ID NO: 776802 - RNA, 18 nt, Homo sapiens
guuugucagcaucugacc

SEQ ID NO: 776803 - RNA, 14 nt, Homo sapiens
guuuguccugagau

SEQ ID NO: 776804 - RNA, 18 nt, Homo sapiens
guuugucuguuuguuuca

SEQ ID NO: 776805 - RNA, 14 nt, Homo sapiens
guuuguggccucag

SEQ ID NO: 776806 - RNA, 14 nt, Homo sapiens
uaacuauuucuuca

SEQ ID NO: 776807 - RNA, 20 nt, Homo sapiens
uaacuauuuuaaauauccau

SEQ ID NO: 776808 - RNA, 20 nt, Homo sapiens
uaacucaccagccccacugc

SEQ ID NO: 776809 - RNA, 15 nt, Homo sapiens
uaacucacugccuag

SEQ ID NO: 776810 - RNA, 23 nt, Homo sapiens
uaacucagaaacaucaguuacuc

SEQ ID NO: 776811 - RNA, 15 nt, Homo sapiens
uaacucagaauuauu

SEQ ID NO: 776812 - RNA, 14 nt, Homo sapiens
uaacucccagugau

SEQ ID NO: 776813 - RNA, 14 nt, Homo sapiens
uaacuccugccauu

SEQ ID NO: 776814 - RNA, 17 nt, Homo sapiens
uaacugaaccauuccaa

SEQ ID NO: 776815 - RNA, 22 nt, Homo sapiens
uaacugaaccauuccaacuuca

SEQ ID NO: 776816 - RNA, 20 nt, Homo sapiens
uaacugacaagccaucuuga

SEQ ID NO: 776817 - RNA, 14 nt, Homo sapiens
uaacugagauuaca

SEQ ID NO: 776818 - RNA, 18 nt, Homo sapiens
uaacugaggacuguuugc

SEQ ID NO: 776819 - RNA, 22 nt, Homo sapiens
uaacugaggacuguuugcaauu

SEQ ID NO: 776820 - RNA, 23 nt, Homo sapiens
uaacugaguuauauuggaauuau

SEQ ID NO: 776821 - RNA, 16 nt, Homo sapiens
uaacugccaauccuua

SEQ ID NO: 776822 - RNA, 19 nt, Homo sapiens
uaacugcucaguguuucau

SEQ ID NO: 776823 - RNA, 12 nt, Homo sapiens
uaacugcuucuu

SEQ ID NO: 776824 - RNA, 19 nt, Homo sapiens
uaacugcuucuuggagcuu

SEQ ID NO: 776825 - RNA, 19 nt, Homo sapiens
uaacuggaaggccuuccac

SEQ ID NO: 776826 - RNA, 15 nt, Homo sapiens
uaacuggacaugaag

SEQ ID NO: 776827 - RNA, 22 nt, Homo sapiens
uaacugugaaauaccacaagcc

SEQ ID NO: 776828 - RNA, 14 nt, Homo sapiens
uaacugugaaguuu

SEQ ID NO: 776829 - RNA, 14 nt, Homo sapiens
uaacuguucccuua

SEQ ID NO: 776830 - RNA, 18 nt, Homo sapiens
uaacuuagagacuuuaga

SEQ ID NO: 776831 - RNA, 13 nt, Homo sapiens
uaacuuccugcug

SEQ ID NO: 776832 - RNA, 15 nt, Homo sapiens
uaacuuggcugcauu

SEQ ID NO: 776833 - RNA, 22 nt, Homo sapiens
uaacuuguuugguaguuagcca

SEQ ID NO: 776834 - RNA, 16 nt, Homo sapiens
uaacuuuaacuuuuga

SEQ ID NO: 776835 - RNA, 22 nt, Homo sapiens
uaacuuucauaccacuugaauu

SEQ ID NO: 776836 - RNA, 19 nt, Homo sapiens
uaacuuuucggucuuuccc

SEQ ID NO: 776837 - RNA, 16 nt, Homo sapiens
uaagaaaaacauguca

SEQ ID NO: 776838 - RNA, 17 nt, Homo sapiens
uaagaaaaaugagcaua

SEQ ID NO: 776839 - RNA, 20 nt, Homo sapiens
uaagaaaagccuaaucacag

SEQ ID NO: 776840 - RNA, 20 nt, Homo sapiens
uaagaaaauacaauaaacua

SEQ ID NO: 776841 - RNA, 14 nt, Homo sapiens
uaagaaaaugaucu

SEQ ID NO: 776842 - RNA, 21 nt, Homo sapiens
uaagaaacuagcagauuugua

SEQ ID NO: 776843 - RNA, 13 nt, Homo sapiens
uaagaaagacuau

SEQ ID NO: 776844 - RNA, 13 nt, Homo sapiens
uaagaaagcacua

SEQ ID NO: 776845 - RNA, 16 nt, Homo sapiens
uaagaaagcacuauua

SEQ ID NO: 776846 - RNA, 14 nt, Homo sapiens
uaagaaagcacuua

SEQ ID NO: 776847 - RNA, 13 nt, Homo sapiens
uaagaaauacuca

SEQ ID NO: 776848 - RNA, 14 nt, Homo sapiens
uaagaaccugaaua

SEQ ID NO: 776849 - RNA, 19 nt, Homo sapiens
uaagaaccuugccugaaca

SEQ ID NO: 776850 - RNA, 18 nt, Homo sapiens
uaagaacuuuuucacuuc

SEQ ID NO: 776851 - RNA, 18 nt, Homo sapiens
uaagaagagacugggaag

SEQ ID NO: 776852 - RNA, 16 nt, Homo sapiens
uaagaagagauuucuc

SEQ ID NO: 776853 - RNA, 20 nt, Homo sapiens
uaagaagaggagccucagaa

SEQ ID NO: 776854 - RNA, 22 nt, Homo sapiens
uaagaagccuuaauuugcacag

SEQ ID NO: 776855 - RNA, 21 nt, Homo sapiens
uaagaaugaaguucugcuaca

SEQ ID NO: 776856 - RNA, 23 nt, Homo sapiens
uaagaauggagcaguacauggga

SEQ ID NO: 776857 - RNA, 12 nt, Homo sapiens
uaagaauguuca

SEQ ID NO: 776858 - RNA, 14 nt, Homo sapiens
uaagaauguucaua

SEQ ID NO: 776859 - RNA, 14 nt, Homo sapiens
uaagaauuucacaa

SEQ ID NO: 776860 - RNA, 14 nt, Homo sapiens
uaagacaaacacug

SEQ ID NO: 776861 - RNA, 19 nt, Homo sapiens
uaagacauuuguauauugu

SEQ ID NO: 776862 - RNA, 13 nt, Homo sapiens
uaagaccuggcag

SEQ ID NO: 776863 - RNA, 16 nt, Homo sapiens
uaagacgaaugauuua

SEQ ID NO: 776864 - RNA, 14 nt, Homo sapiens
uaagacuacuauac

SEQ ID NO: 776865 - RNA, 13 nt, Homo sapiens
uaagacucugcca

SEQ ID NO: 776866 - RNA, 15 nt, Homo sapiens
uaagagaaugaauua

SEQ ID NO: 776867 - RNA, 19 nt, Homo sapiens
uaagagacacuccaaaccu

SEQ ID NO: 776868 - RNA, 13 nt, Homo sapiens
uaagagagucaua

SEQ ID NO: 776869 - RNA, 15 nt, Homo sapiens
uaagagagucauaaa

SEQ ID NO: 776870 - RNA, 14 nt, Homo sapiens
uaagagaugggacu

SEQ ID NO: 776871 - RNA, 23 nt, Homo sapiens
uaagagcaaaucaauucuaguca

SEQ ID NO: 776872 - RNA, 17 nt, Homo sapiens
uaagagcagaacagauc

SEQ ID NO: 776873 - RNA, 17 nt, Homo sapiens
uaagagccauuuagggg

SEQ ID NO: 776874 - RNA, 15 nt, Homo sapiens
uaagaggcugacuuu

SEQ ID NO: 776875 - RNA, 17 nt, Homo sapiens
uaagaggcuuucuccag

SEQ ID NO: 776876 - RNA, 18 nt, Homo sapiens
uaagaguaaaauuccucu

SEQ ID NO: 776877 - RNA, 17 nt, Homo sapiens
uaagagucauccagcuc

SEQ ID NO: 776878 - RNA, 19 nt, Homo sapiens
uaagagugccguaacaacu

SEQ ID NO: 776879 - RNA, 19 nt, Homo sapiens
uaagaguguuuaauggcaa

SEQ ID NO: 776880 - RNA, 22 nt, Homo sapiens
uaagauacuggacuccucuucc

SEQ ID NO: 776881 - RNA, 18 nt, Homo sapiens
uaagauauauacauggaa

SEQ ID NO: 776882 - RNA, 14 nt, Homo sapiens
uaagauccacaaau

SEQ ID NO: 776883 - RNA, 22 nt, Homo sapiens
uaagauccagaaauacuuaaca

SEQ ID NO: 776884 - RNA, 21 nt, Homo sapiens
uaagaugugauauucuaagac

SEQ ID NO: 776885 - RNA, 22 nt, Homo sapiens
uaagauguguuaggaaugucaa

SEQ ID NO: 776886 - RNA, 18 nt, Homo sapiens
uaagauguucacuguggc

SEQ ID NO: 776887 - RNA, 11 nt, Homo sapiens
uaagauucuaa

SEQ ID NO: 776888 - RNA, 18 nt, Homo sapiens
uaagauuuccaagugcca

SEQ ID NO: 776889 - RNA, 19 nt, Homo sapiens
uaagcaaauugcuuuuuuc

SEQ ID NO: 776890 - RNA, 15 nt, Homo sapiens
uaagcaacagcauaa

SEQ ID NO: 776891 - RNA, 13 nt, Homo sapiens
uaagcaacaucua

SEQ ID NO: 776892 - RNA, 15 nt, Homo sapiens
uaagcaagagacaau

SEQ ID NO: 776893 - RNA, 15 nt, Homo sapiens
uaagcacuugcuuag

SEQ ID NO: 776894 - RNA, 13 nt, Homo sapiens
uaagcaguggcau

SEQ ID NO: 776895 - RNA, 21 nt, Homo sapiens
uaagcaucugccaucugcuuu

SEQ ID NO: 776896 - RNA, 15 nt, Homo sapiens
uaagcaugacagaaa

SEQ ID NO: 776897 - RNA, 17 nt, Homo sapiens
uaagcauguuuucacua

SEQ ID NO: 776898 - RNA, 22 nt, Homo sapiens
uaagccacauggcugggauuua

SEQ ID NO: 776899 - RNA, 18 nt, Homo sapiens
uaagccagaauccagaag

SEQ ID NO: 776900 - RNA, 18 nt, Homo sapiens
uaagccagacgugguggc

SEQ ID NO: 776901 - RNA, 17 nt, Homo sapiens
uaagcccagugcacuga

SEQ ID NO: 776902 - RNA, 14 nt, Homo sapiens
uaagcccucaggag

SEQ ID NO: 776903 - RNA, 22 nt, Homo sapiens
uaagccuguuggauaaagaccu

SEQ ID NO: 776904 - RNA, 19 nt, Homo sapiens
uaagcuagccagaguuuuc

SEQ ID NO: 776905 - RNA, 23 nt, Homo sapiens
uaagcucacguccugagaaagcu

SEQ ID NO: 776906 - RNA, 14 nt, Homo sapiens
uaagcucgagugaa

SEQ ID NO: 776907 - RNA, 17 nt, Homo sapiens
uaagcucgagugaauuu

SEQ ID NO: 776908 - RNA, 20 nt, Homo sapiens
uaagcugggauaaucacauu

SEQ ID NO: 776909 - RNA, 20 nt, Homo sapiens
uaagcuucaaagcugcuuua

SEQ ID NO: 776910 - RNA, 14 nt, Homo sapiens
uaaggaaaaaagca

SEQ ID NO: 776911 - RNA, 21 nt, Homo sapiens
uaaggaccaauagcaucugug

SEQ ID NO: 776912 - RNA, 17 nt, Homo sapiens
uaaggacggacucacuu

SEQ ID NO: 776913 - RNA, 14 nt, Homo sapiens
uaaggauguugcca

SEQ ID NO: 776914 - RNA, 15 nt, Homo sapiens
uaaggauugugauau

SEQ ID NO: 776915 - RNA, 14 nt, Homo sapiens
uaaggauuuuucaa

SEQ ID NO: 776916 - RNA, 18 nt, Homo sapiens
uaaggcucugugccuugg

SEQ ID NO: 776917 - RNA, 16 nt, Homo sapiens
uaaggcuuuuucuucc

SEQ ID NO: 776918 - RNA, 17 nt, Homo sapiens
uaagggaaaaguucucc

SEQ ID NO: 776919 - RNA, 14 nt, Homo sapiens
uaagggcagugccc

SEQ ID NO: 776920 - RNA, 23 nt, Homo sapiens
uaagggcuuuaauacaaaaagca

SEQ ID NO: 776921 - RNA, 21 nt, Homo sapiens
ucaagguuuuaaaacagucua

SEQ ID NO: 776922 - RNA, 11 nt, Homo sapiens
ucaaguaauaa

SEQ ID NO: 776923 - RNA, 13 nt, Homo sapiens
ucaaguaauccac

SEQ ID NO: 776924 - RNA, 20 nt, Homo sapiens
ucaaguaguguaucacagua

SEQ ID NO: 776925 - RNA, 16 nt, Homo sapiens
ucaaguauuugaucag

SEQ ID NO: 776926 - RNA, 19 nt, Homo sapiens
ucaaguccuacaagcuaaa

SEQ ID NO: 776927 - RNA, 16 nt, Homo sapiens
ucaagucucucacccu

SEQ ID NO: 776928 - RNA, 21 nt, Homo sapiens
ucaagugaucugccgccucag

SEQ ID NO: 776929 - RNA, 18 nt, Homo sapiens
ucaagugauucuccugcc

SEQ ID NO: 776930 - RNA, 21 nt, Homo sapiens
ucaagugccuagacuguuacu

SEQ ID NO: 776931 - RNA, 20 nt, Homo sapiens
ucaaguggcaugugcuguga

SEQ ID NO: 776932 - RNA, 13 nt, Homo sapiens
ucaaguguccuga

SEQ ID NO: 776933 - RNA, 13 nt, Homo sapiens
ucaagugucuuag

SEQ ID NO: 776934 - RNA, 15 nt, Homo sapiens
ucaaguugugcuugu

SEQ ID NO: 776935 - RNA, 20 nt, Homo sapiens
ucaaguugugcuuguuuaca

SEQ ID NO: 776936 - RNA, 18 nt, Homo sapiens
ucaaguuugaacucugua

SEQ ID NO: 776937 - RNA, 14 nt, Homo sapiens
ucaauaauuacugu

SEQ ID NO: 776938 - RNA, 16 nt, Homo sapiens
ucaauaccgcucagua

SEQ ID NO: 776939 - RNA, 19 nt, Homo sapiens
ucaauaccgcucaguauuu

SEQ ID NO: 776940 - RNA, 12 nt, Homo sapiens
ucaauagcauug

SEQ ID NO: 776941 - RNA, 13 nt, Homo sapiens
ucaauagcuugaa

SEQ ID NO: 776942 - RNA, 22 nt, Homo sapiens
ucaauauaagaagcaaucuuug

SEQ ID NO: 776943 - RNA, 17 nt, Homo sapiens
ucaauauuaaauacaga

SEQ ID NO: 776944 - RNA, 21 nt, Homo sapiens
ucaauauuugguauuucaaua

SEQ ID NO: 776945 - RNA, 18 nt, Homo sapiens
ucaaucagugcagugaua

SEQ ID NO: 776946 - RNA, 19 nt, Homo sapiens
ucaaucagugcagugauac

SEQ ID NO: 776947 - RNA, 16 nt, Homo sapiens
ucaauccgaaguauga

SEQ ID NO: 776948 - RNA, 21 nt, Homo sapiens
ucaauccugauuccucucuaa

SEQ ID NO: 776949 - RNA, 21 nt, Homo sapiens
ucaauccugggcaaucagaca

SEQ ID NO: 776950 - RNA, 18 nt, Homo sapiens
ucaauccugucauauaau

SEQ ID NO: 776951 - RNA, 17 nt, Homo sapiens
ucaaucucuguucugcu

SEQ ID NO: 776952 - RNA, 21 nt, Homo sapiens
ucaaucugcaguuuaacaaaa

SEQ ID NO: 776953 - RNA, 14 nt, Homo sapiens
ucaaucuucuacuu

SEQ ID NO: 776954 - RNA, 17 nt, Homo sapiens
ucaaucuuuaacaaccu

SEQ ID NO: 776955 - RNA, 12 nt, Homo sapiens
ucaaugaccugu

SEQ ID NO: 776956 - RNA, 14 nt, Homo sapiens
ucaaugaccuguau

SEQ ID NO: 776957 - RNA, 23 nt, Homo sapiens
ucaaugcaagagugauugcagcu

SEQ ID NO: 776958 - RNA, 15 nt, Homo sapiens
ucaaugccugucuua

SEQ ID NO: 776959 - RNA, 15 nt, Homo sapiens
ucaauggacuggaag

SEQ ID NO: 776960 - RNA, 14 nt, Homo sapiens
ucaauggauuugau

SEQ ID NO: 776961 - RNA, 20 nt, Homo sapiens
ucaaugggcucuuccaacaa

SEQ ID NO: 776962 - RNA, 13 nt, Homo sapiens
ucaauguacauag

SEQ ID NO: 776963 - RNA, 14 nt, Homo sapiens
ucaaugucuuaggu

SEQ ID NO: 776964 - RNA, 22 nt, Homo sapiens
ucaaugugacaccuaacucuuu

SEQ ID NO: 776965 - RNA, 19 nt, Homo sapiens
ucaaugugccuuugcauaa

SEQ ID NO: 776966 - RNA, 20 nt, Homo sapiens
ucaauguuuguucauuacuu

SEQ ID NO: 776967 - RNA, 20 nt, Homo sapiens
ucaauuacuugaaguugcuu

SEQ ID NO: 776968 - RNA, 15 nt, Homo sapiens
ucaauuauuugcaua

SEQ ID NO: 776969 - RNA, 18 nt, Homo sapiens
ucaauucccaccuaugag

SEQ ID NO: 776970 - RNA, 22 nt, Homo sapiens
ucaauucccacguagacucuua

SEQ ID NO: 776971 - RNA, 12 nt, Homo sapiens
ucaauuuacuua

SEQ ID NO: 776972 - RNA, 18 nt, Homo sapiens
ucaauuuauuacugaaaa

SEQ ID NO: 776973 - RNA, 15 nt, Homo sapiens
ucaauuuugacuuaa

SEQ ID NO: 776974 - RNA, 18 nt, Homo sapiens
ucaauuuugucuguacuc

SEQ ID NO: 776975 - RNA, 16 nt, Homo sapiens
ucaauuuuucccagua

SEQ ID NO: 776976 - RNA, 14 nt, Homo sapiens
ucacaaacugugaa

SEQ ID NO: 776977 - RNA, 23 nt, Homo sapiens
ucacaaaguagaggaauccaugu

SEQ ID NO: 776978 - RNA, 16 nt, Homo sapiens
ucacaaauaaaagcca

SEQ ID NO: 776979 - RNA, 14 nt, Homo sapiens
ucacaacagaucaa

SEQ ID NO: 776980 - RNA, 15 nt, Homo sapiens
ucacaacagugaaaa

SEQ ID NO: 776981 - RNA, 18 nt, Homo sapiens
ucacaaccccugcuccag

SEQ ID NO: 776982 - RNA, 19 nt, Homo sapiens
ucacaaccguacaguuucu

SEQ ID NO: 776983 - RNA, 13 nt, Homo sapiens
ucacaagcaugaa

SEQ ID NO: 776984 - RNA, 20 nt, Homo sapiens
ucacaagcaugaagugcugu

SEQ ID NO: 776985 - RNA, 12 nt, Homo sapiens
ucacaagcuauu

SEQ ID NO: 776986 - RNA, 20 nt, Homo sapiens
ucacaauaccucaugcuuca

SEQ ID NO: 776987 - RNA, 18 nt, Homo sapiens
ucacaauagauuucucaa

SEQ ID NO: 776988 - RNA, 24 nt, Homo sapiens
ucacaaugucccuucagcaccuga

SEQ ID NO: 776989 - RNA, 18 nt, Homo sapiens
ucacacagggcucuuuga

SEQ ID NO: 776990 - RNA, 18 nt, Homo sapiens
ucacacauccgcuucaua

SEQ ID NO: 776991 - RNA, 15 nt, Homo sapiens
ucacaccaacagugu

SEQ ID NO: 776992 - RNA, 20 nt, Homo sapiens
ucacaccugacucugaaauc

SEQ ID NO: 776993 - RNA, 17 nt, Homo sapiens
ucacacgauaaagggau

SEQ ID NO: 776994 - RNA, 14 nt, Homo sapiens
ucacacgcuuuuga

SEQ ID NO: 776995 - RNA, 13 nt, Homo sapiens
ucacacugugcuc

SEQ ID NO: 776996 - RNA, 16 nt, Homo sapiens
ucacacuuccaccagc

SEQ ID NO: 776997 - RNA, 14 nt, Homo sapiens
ucacacuuugccau

SEQ ID NO: 776998 - RNA, 20 nt, Homo sapiens
ucacacuuuguaauuugcaa

SEQ ID NO: 776999 - RNA, 21 nt, Homo sapiens
ucacacuuuguaauuugcaaa

SEQ ID NO: 777000 - RNA, 17 nt, Homo sapiens
ucacagaauagcacaaa

SEQ ID NO: 777001 - RNA, 19 nt, Homo sapiens
ucacagagacccaccuuca

SEQ ID NO: 777002 - RNA, 18 nt, Homo sapiens
ucacagaguagaaacuca

SEQ ID NO: 777003 - RNA, 14 nt, Homo sapiens
ucacagcuacacag

SEQ ID NO: 777004 - RNA, 16 nt, Homo sapiens
ucacagcuacacagau

SEQ ID NO: 777005 - RNA, 14 nt, Homo sapiens
ucacagcugcagcu

SEQ ID NO: 777006 - RNA, 22 nt, Homo sapiens
ucacaggacauuaaggaccaau

SEQ ID NO: 777007 - RNA, 17 nt, Homo sapiens
ucacaggccccaggaaa

SEQ ID NO: 777008 - RNA, 23 nt, Homo sapiens
ucacaggugggaucggcacucag

SEQ ID NO: 777009 - RNA, 22 nt, Homo sapiens
ucacaguaaugugucauaucau

SEQ ID NO: 777010 - RNA, 12 nt, Homo sapiens
ucacaguacuuu

SEQ ID NO: 777011 - RNA, 18 nt, Homo sapiens
ucacagugggagccaggg

SEQ ID NO: 777012 - RNA, 16 nt, Homo sapiens
ucacaguguugcccag

SEQ ID NO: 777013 - RNA, 16 nt, Homo sapiens
ucacaguucauugcag

SEQ ID NO: 777014 - RNA, 17 nt, Homo sapiens
ucacaguucauugcagc

SEQ ID NO: 777015 - RNA, 14 nt, Homo sapiens
ucacauacauaagc

SEQ ID NO: 777016 - RNA, 19 nt, Homo sapiens
ucacauacauaagcagcau

SEQ ID NO: 777017 - RNA, 17 nt, Homo sapiens
ucacauauaacaugcaa

SEQ ID NO: 777018 - RNA, 22 nt, Homo sapiens
ucacauauucauauuguucaau

SEQ ID NO: 777019 - RNA, 13 nt, Homo sapiens
ucacaucugucac

SEQ ID NO: 777020 - RNA, 19 nt, Homo sapiens
ucacaugaggaauguacuu

SEQ ID NO: 777021 - RNA, 15 nt, Homo sapiens
ucacaugagucaaaa

SEQ ID NO: 777022 - RNA, 18 nt, Homo sapiens
ucacauuaauauuugcug

SEQ ID NO: 777023 - RNA, 18 nt, Homo sapiens
ucacauuccucugcccuu

SEQ ID NO: 777024 - RNA, 15 nt, Homo sapiens
ucacauucuuuccaa

SEQ ID NO: 777025 - RNA, 19 nt, Homo sapiens
ucacauuuagaaaagugaa

SEQ ID NO: 777026 - RNA, 16 nt, Homo sapiens
ucacauuucuaugcca

SEQ ID NO: 777027 - RNA, 16 nt, Homo sapiens
ucacauuugcguguau

SEQ ID NO: 777028 - RNA, 23 nt, Homo sapiens
ucacauuugggguuuguguuuga

SEQ ID NO: 777029 - RNA, 20 nt, Homo sapiens
ucacauuuuacgacaaggau

SEQ ID NO: 777030 - RNA, 19 nt, Homo sapiens
ucacauuuuuuuaugcucu

SEQ ID NO: 777031 - RNA, 18 nt, Homo sapiens
ucaccaaaucagcugcua

SEQ ID NO: 777032 - RNA, 19 nt, Homo sapiens
ucaccaagcucacaguucc

SEQ ID NO: 777033 - RNA, 21 nt, Homo sapiens
ucaccaaggaaacgcuaccuc

SEQ ID NO: 777034 - RNA, 16 nt, Homo sapiens
ucaccaaugagccuua

SEQ ID NO: 777035 - RNA, 15 nt, Homo sapiens
ucaccacgugcagua

SEQ ID NO: 777036 - RNA, 17 nt, Homo sapiens
ucauccccacaaucugg

SEQ ID NO: 777037 - RNA, 23 nt, Homo sapiens
ucauccccacagcuggcucugac

SEQ ID NO: 777038 - RNA, 19 nt, Homo sapiens
ucaucccuuuccaguuaag

SEQ ID NO: 777039 - RNA, 22 nt, Homo sapiens
ucauccuggcacgcccuacucc

SEQ ID NO: 777040 - RNA, 23 nt, Homo sapiens
ucauccuggcacgcccuacucca

SEQ ID NO: 777041 - RNA, 15 nt, Homo sapiens
ucauccuuaccgcac

SEQ ID NO: 777042 - RNA, 19 nt, Homo sapiens
ucaucuaauucucugugga

SEQ ID NO: 777043 - RNA, 16 nt, Homo sapiens
ucaucuauaacaugca

SEQ ID NO: 777044 - RNA, 21 nt, Homo sapiens
ucaucuauuuuuggcagucug

SEQ ID NO: 777045 - RNA, 15 nt, Homo sapiens
ucaucucucuaccuc

SEQ ID NO: 777046 - RNA, 16 nt, Homo sapiens
ucaucucucugcccaa

SEQ ID NO: 777047 - RNA, 14 nt, Homo sapiens
ucaucucugcaggu

SEQ ID NO: 777048 - RNA, 16 nt, Homo sapiens
ucaucugaaaaucugg

SEQ ID NO: 777049 - RNA, 13 nt, Homo sapiens
ucaucugggcaaa

SEQ ID NO: 777050 - RNA, 13 nt, Homo sapiens
ucaucuguagaua

SEQ ID NO: 777051 - RNA, 23 nt, Homo sapiens
ucaucuguagauacuagcuaucu

SEQ ID NO: 777052 - RNA, 17 nt, Homo sapiens
ucaucuguggagcugcc

SEQ ID NO: 777053 - RNA, 18 nt, Homo sapiens
ucaucuguggagcugcca

SEQ ID NO: 777054 - RNA, 20 nt, Homo sapiens
ucaucuguggagcugccaca

SEQ ID NO: 777055 - RNA, 14 nt, Homo sapiens
ucaucuucacugca

SEQ ID NO: 777056 - RNA, 15 nt, Homo sapiens
ucaucuucacugcaa

SEQ ID NO: 777057 - RNA, 18 nt, Homo sapiens
ucaucuuccuguguccug

SEQ ID NO: 777058 - RNA, 13 nt, Homo sapiens
ucaucuucuggaa

SEQ ID NO: 777059 - RNA, 17 nt, Homo sapiens
ucaucuugaaguuuuuc

SEQ ID NO: 777060 - RNA, 20 nt, Homo sapiens
ucaucuugcagcauuuacua

SEQ ID NO: 777061 - RNA, 19 nt, Homo sapiens
ucaucuuugccaccaccug

SEQ ID NO: 777062 - RNA, 16 nt, Homo sapiens
ucaugaaaacacacau

SEQ ID NO: 777063 - RNA, 14 nt, Homo sapiens
ucaugaaacugucc

SEQ ID NO: 777064 - RNA, 10 nt, Homo sapiens
ucaugaaauu

SEQ ID NO: 777065 - RNA, 21 nt, Homo sapiens
ucaugaagaauguuucuggaa

SEQ ID NO: 777066 - RNA, 21 nt, Homo sapiens
ucaugaagcagauuugcacug

SEQ ID NO: 777067 - RNA, 13 nt, Homo sapiens
ucaugacacuguu

SEQ ID NO: 777068 - RNA, 14 nt, Homo sapiens
ucaugagcaaguga

SEQ ID NO: 777069 - RNA, 14 nt, Homo sapiens
ucaugagccugcug

SEQ ID NO: 777070 - RNA, 12 nt, Homo sapiens
ucaugaucauuc

SEQ ID NO: 777071 - RNA, 16 nt, Homo sapiens
ucaugaucauucucag

SEQ ID NO: 777072 - RNA, 23 nt, Homo sapiens
ucaugccaccauggccagccaac

SEQ ID NO: 777073 - RNA, 23 nt, Homo sapiens
ucaugcccugccuugucccucuc

SEQ ID NO: 777074 - RNA, 18 nt, Homo sapiens
ucaugccgacgcuugcac

SEQ ID NO: 777075 - RNA, 20 nt, Homo sapiens
ucaugcuacagaaagcugcu

SEQ ID NO: 777076 - RNA, 15 nt, Homo sapiens
ucauggaaagacugg

SEQ ID NO: 777077 - RNA, 15 nt, Homo sapiens
ucauggacacuuuga

SEQ ID NO: 777078 - RNA, 20 nt, Homo sapiens
ucauggcagcuaagccacau

SEQ ID NO: 777079 - RNA, 11 nt, Homo sapiens
ucauggcauau

SEQ ID NO: 777080 - RNA, 17 nt, Homo sapiens
ucauggcuaauuuaaca

SEQ ID NO: 777081 - RNA, 20 nt, Homo sapiens
ucauggggucccugcugcaa

SEQ ID NO: 777082 - RNA, 15 nt, Homo sapiens
ucaugguacauuuau

SEQ ID NO: 777083 - RNA, 15 nt, Homo sapiens
ucauggugcacugag

SEQ ID NO: 777084 - RNA, 23 nt, Homo sapiens
ucauggugguggacaccuguaau

SEQ ID NO: 777085 - RNA, 17 nt, Homo sapiens
ucauguaaauuugguuu

SEQ ID NO: 777086 - RNA, 14 nt, Homo sapiens
ucauguaccaucaa

SEQ ID NO: 777087 - RNA, 23 nt, Homo sapiens
ucaugucuauaaucccagcacuu

SEQ ID NO: 777088 - RNA, 23 nt, Homo sapiens
ucaugucugaaacagagaaccaa

SEQ ID NO: 777089 - RNA, 19 nt, Homo sapiens
ucauguguaauaugcacaa

SEQ ID NO: 777090 - RNA, 14 nt, Homo sapiens
ucaugugugcaugu

SEQ ID NO: 777091 - RNA, 17 nt, Homo sapiens
ucaugugugcaugugag

SEQ ID NO: 777092 - RNA, 13 nt, Homo sapiens
ucauguuacucag

SEQ ID NO: 777093 - RNA, 15 nt, Homo sapiens
ucauguucaugugau

SEQ ID NO: 777094 - RNA, 18 nt, Homo sapiens
ucauuaagguuaugcacu

SEQ ID NO: 777095 - RNA, 21 nt, Homo sapiens
ucauuagcuuugggugccuuu

SEQ ID NO: 777096 - RNA, 13 nt, Homo sapiens
ucauuauguauga

SEQ ID NO: 777097 - RNA, 15 nt, Homo sapiens
ucauuauuugcagag

SEQ ID NO: 777098 - RNA, 16 nt, Homo sapiens
ucauucaagccuguga

SEQ ID NO: 777099 - RNA, 22 nt, Homo sapiens
ucauucaauauugacauuugua

SEQ ID NO: 777100 - RNA, 21 nt, Homo sapiens
ucauucagcaucuacucuaaa

SEQ ID NO: 777101 - RNA, 14 nt, Homo sapiens
ucauucauucacuc

SEQ ID NO: 777102 - RNA, 17 nt, Homo sapiens
ucauucauuucauugug

SEQ ID NO: 777103 - RNA, 12 nt, Homo sapiens
ucauucauuugc

SEQ ID NO: 777104 - RNA, 13 nt, Homo sapiens
ucauucauuugca

SEQ ID NO: 777105 - RNA, 23 nt, Homo sapiens
ucauucccauuuuguuacauuuc

SEQ ID NO: 777106 - RNA, 20 nt, Homo sapiens
ucauuccccuuugcacugua

SEQ ID NO: 777107 - RNA, 17 nt, Homo sapiens
ucauuccugccugucuc

SEQ ID NO: 777108 - RNA, 15 nt, Homo sapiens
ucauucuaaaccaaa

SEQ ID NO: 777109 - RNA, 22 nt, Homo sapiens
ucauucuuacaauugcacugcu

SEQ ID NO: 777110 - RNA, 15 nt, Homo sapiens
ucauugcacuuugau

SEQ ID NO: 777111 - RNA, 19 nt, Homo sapiens
ucauugcccgaaaccagag

SEQ ID NO: 777112 - RNA, 20 nt, Homo sapiens
ucauugcuaaccacugucug

SEQ ID NO: 777113 - RNA, 17 nt, Homo sapiens
ucauugcugagccucug

SEQ ID NO: 777114 - RNA, 19 nt, Homo sapiens
ucauugcuguaccacaucu

SEQ ID NO: 777115 - RNA, 23 nt, Homo sapiens
ucauuggaugauauguugaucag

SEQ ID NO: 777116 - RNA, 22 nt, Homo sapiens
ucauugucccugaaugcuccau

SEQ ID NO: 777117 - RNA, 18 nt, Homo sapiens
ucauugucuuauaugcuu

SEQ ID NO: 777118 - RNA, 23 nt, Homo sapiens
ucauugugagauugcaguucugu

SEQ ID NO: 777119 - RNA, 20 nt, Homo sapiens
ucauuguuuauuaacaaauu

SEQ ID NO: 777120 - RNA, 17 nt, Homo sapiens
ucauuuauaaaaccauc

SEQ ID NO: 777121 - RNA, 15 nt, Homo sapiens
ucauuuauucaagua

SEQ ID NO: 777122 - RNA, 18 nt, Homo sapiens
ucauuucucagcuguccu

SEQ ID NO: 777123 - RNA, 12 nt, Homo sapiens
ucauuugaacaa

SEQ ID NO: 777124 - RNA, 14 nt, Homo sapiens
ucauuugaugcuaa

SEQ ID NO: 777125 - RNA, 19 nt, Homo sapiens
ucauuuguuuacauuugau

SEQ ID NO: 777126 - RNA, 15 nt, Homo sapiens
ucauuuuacagagaa

SEQ ID NO: 777127 - RNA, 18 nt, Homo sapiens
ucauuuuuguaucuacau

SEQ ID NO: 777128 - RNA, 17 nt, Homo sapiens
ucauuuuuuucacugga

SEQ ID NO: 777129 - RNA, 23 nt, Homo sapiens
ucauuuuuuucacuggaguuaca

SEQ ID NO: 777130 - RNA, 15 nt, Homo sapiens
uccaaaacaaaaaga

SEQ ID NO: 777131 - RNA, 14 nt, Homo sapiens
uccaaaacuuuaau

SEQ ID NO: 777132 - RNA, 18 nt, Homo sapiens
uccaaacauuaaugcaau

SEQ ID NO: 777133 - RNA, 16 nt, Homo sapiens
uccaaagaaagauuaa

SEQ ID NO: 777134 - RNA, 21 nt, Homo sapiens
uccaaagagaagggcacugua

SEQ ID NO: 777135 - RNA, 12 nt, Homo sapiens
uccaaagaggcu

SEQ ID NO: 777136 - RNA, 15 nt, Homo sapiens
uccaaagaggcugcc

SEQ ID NO: 777137 - RNA, 19 nt, Homo sapiens
uccaaagcgagcaagagaa

SEQ ID NO: 777138 - RNA, 13 nt, Homo sapiens
uccaaagucagau

SEQ ID NO: 777139 - RNA, 16 nt, Homo sapiens
uccaaauauuguuaag

SEQ ID NO: 777140 - RNA, 17 nt, Homo sapiens
uccaaauauuguugaca

SEQ ID NO: 777141 - RNA, 15 nt, Homo sapiens
uccaaauguccucca

SEQ ID NO: 777142 - RNA, 17 nt, Homo sapiens
uccaacaccacagacac

SEQ ID NO: 777143 - RNA, 17 nt, Homo sapiens
uccaaccaggagcugau

SEQ ID NO: 777144 - RNA, 19 nt, Homo sapiens
uccaaccccccagcacuga

SEQ ID NO: 777145 - RNA, 17 nt, Homo sapiens
uccaaccugcaaagauc

SEQ ID NO: 777146 - RNA, 14 nt, Homo sapiens
uccaacuccaggau

SEQ ID NO: 777147 - RNA, 18 nt, Homo sapiens
uccaacucuugguauuac

SEQ ID NO: 777148 - RNA, 13 nt, Homo sapiens
uccaacuuaacau

SEQ ID NO: 777149 - RNA, 21 nt, Homo sapiens
uccaagaaggccuucauggcc

SEQ ID NO: 777150 - RNA, 13 nt, Homo sapiens
uccaagaauuuga

SEQ ID NO: 777151 - RNA, 22 nt, Homo sapiens
uccuguuugaaagccucugcgu

SEQ ID NO: 777152 - RNA, 16 nt, Homo sapiens
uccuuaaaaaucacac

SEQ ID NO: 777153 - RNA, 23 nt, Homo sapiens
uccuuaaagcauuugcaacagcu

SEQ ID NO: 777154 - RNA, 14 nt, Homo sapiens
uccuuaagcaucug

SEQ ID NO: 777155 - RNA, 15 nt, Homo sapiens
uccuuacucugagga

SEQ ID NO: 777156 - RNA, 22 nt, Homo sapiens
uccuuagccuuugucccagaau

SEQ ID NO: 777157 - RNA, 19 nt, Homo sapiens
uccuuagcuuagaccucag

SEQ ID NO: 777158 - RNA, 14 nt, Homo sapiens
uccuuauuugccuu

SEQ ID NO: 777159 - RNA, 21 nt, Homo sapiens
uccuucaaaacacucaucucc

SEQ ID NO: 777160 - RNA, 15 nt, Homo sapiens
uccuucaaucuucau

SEQ ID NO: 777161 - RNA, 22 nt, Homo sapiens
uccuucacaggcagugcaugug

SEQ ID NO: 777162 - RNA, 17 nt, Homo sapiens
uccuucauccaaugcag

SEQ ID NO: 777163 - RNA, 15 nt, Homo sapiens
uccuuccaccucagu

SEQ ID NO: 777164 - RNA, 12 nt, Homo sapiens
uccuuccaucaa

SEQ ID NO: 777165 - RNA, 16 nt, Homo sapiens
uccuuccaucccuacc

SEQ ID NO: 777166 - RNA, 15 nt, Homo sapiens
uccuuccauuccaca

SEQ ID NO: 777167 - RNA, 19 nt, Homo sapiens
uccuucccauuucucuaca

SEQ ID NO: 777168 - RNA, 20 nt, Homo sapiens
uccuucccugcucuugcagu

SEQ ID NO: 777169 - RNA, 21 nt, Homo sapiens
uccuuccuaaacccaaugacu

SEQ ID NO: 777170 - RNA, 15 nt, Homo sapiens
uccuuccucuuggcu

SEQ ID NO: 777171 - RNA, 18 nt, Homo sapiens
uccuuccugucuuccugc

SEQ ID NO: 777172 - RNA, 14 nt, Homo sapiens
uccuuccuucaggg

SEQ ID NO: 777173 - RNA, 14 nt, Homo sapiens
uccuuccuucccug

SEQ ID NO: 777174 - RNA, 17 nt, Homo sapiens
uccuucgggugcuggaa

SEQ ID NO: 777175 - RNA, 18 nt, Homo sapiens
uccuucuguauucauaag

SEQ ID NO: 777176 - RNA, 11 nt, Homo sapiens
uccuugcaaau

SEQ ID NO: 777177 - RNA, 14 nt, Homo sapiens
uccuugcaccugca

SEQ ID NO: 777178 - RNA, 14 nt, Homo sapiens
uccuuggaacacau

SEQ ID NO: 777179 - RNA, 15 nt, Homo sapiens
uccuuggauguaguc

SEQ ID NO: 777180 - RNA, 17 nt, Homo sapiens
uccuuggcucccauuca

SEQ ID NO: 777181 - RNA, 18 nt, Homo sapiens
uccuuggggagcacuugu

SEQ ID NO: 777182 - RNA, 21 nt, Homo sapiens
uccuuggggagcacuugucca

SEQ ID NO: 777183 - RNA, 20 nt, Homo sapiens
uccuugucuuguaauugugg

SEQ ID NO: 777184 - RNA, 19 nt, Homo sapiens
uccuugugaagaugauaua

SEQ ID NO: 777185 - RNA, 15 nt, Homo sapiens
uccuugugcaauugu

SEQ ID NO: 777186 - RNA, 20 nt, Homo sapiens
uccuuuauacacaguggauu

SEQ ID NO: 777187 - RNA, 15 nt, Homo sapiens
uccuuucacaaccuu

SEQ ID NO: 777188 - RNA, 23 nt, Homo sapiens
uccuuucacccgcuccuacagcu

SEQ ID NO: 777189 - RNA, 21 nt, Homo sapiens
uccuuuccccucccucaggcc

SEQ ID NO: 777190 - RNA, 16 nt, Homo sapiens
uccuuucuccagccag

SEQ ID NO: 777191 - RNA, 14 nt, Homo sapiens
uccuuucuccugau

SEQ ID NO: 777192 - RNA, 14 nt, Homo sapiens
uccuuucugugcau

SEQ ID NO: 777193 - RNA, 16 nt, Homo sapiens
uccuuugccugauccu

SEQ ID NO: 777194 - RNA, 16 nt, Homo sapiens
uccuuuggccauucca

SEQ ID NO: 777195 - RNA, 22 nt, Homo sapiens
uccuuuggccauuccaacagcu

SEQ ID NO: 777196 - RNA, 17 nt, Homo sapiens
uccuuuuaaccauuuua

SEQ ID NO: 777197 - RNA, 16 nt, Homo sapiens
uccuuuuaauuuuccu

SEQ ID NO: 777198 - RNA, 18 nt, Homo sapiens
uccuuuucacuuuauugc

SEQ ID NO: 777199 - RNA, 19 nt, Homo sapiens
uccuuuuccuaauucacac

SEQ ID NO: 777200 - RNA, 18 nt, Homo sapiens
uccuuuucuacaugaugc

SEQ ID NO: 777201 - RNA, 17 nt, Homo sapiens
uccuuuugaccaaauaa

SEQ ID NO: 777202 - RNA, 16 nt, Homo sapiens
uccuuuuugacacuga

SEQ ID NO: 777203 - RNA, 14 nt, Homo sapiens
uccuuuuuuauucc

SEQ ID NO: 777204 - RNA, 23 nt, Homo sapiens
uccuuuuuucaaaauccaaaaag

SEQ ID NO: 777205 - RNA, 17 nt, Homo sapiens
uccuuuuuugcaugugc

SEQ ID NO: 777206 - RNA, 18 nt, Homo sapiens
uccuuuuuugcaugugca

SEQ ID NO: 777207 - RNA, 15 nt, Homo sapiens
ucgaaagcucuagaa

SEQ ID NO: 777208 - RNA, 14 nt, Homo sapiens
ucgaaagugaggag

SEQ ID NO: 777209 - RNA, 20 nt, Homo sapiens
ucgaaccaaggcagccucca

SEQ ID NO: 777210 - RNA, 23 nt, Homo sapiens
ucgaacuauuuucaaagacuuaa

SEQ ID NO: 777211 - RNA, 17 nt, Homo sapiens
ucgaauucucacaagga

SEQ ID NO: 777212 - RNA, 19 nt, Homo sapiens
ucgaauucucacaaggaaa

SEQ ID NO: 777213 - RNA, 23 nt, Homo sapiens
ucgaccauaaaggguguaggggc

SEQ ID NO: 777214 - RNA, 15 nt, Homo sapiens
ucgacggcacgcacu

SEQ ID NO: 777215 - RNA, 15 nt, Homo sapiens
ucgagagcuggccaa

SEQ ID NO: 777216 - RNA, 15 nt, Homo sapiens
ucgaggagugccgug

SEQ ID NO: 777217 - RNA, 18 nt, Homo sapiens
ucgaggcuagaggcauuu

SEQ ID NO: 777218 - RNA, 22 nt, Homo sapiens
ucgaggcugcagucagcccuga

SEQ ID NO: 777219 - RNA, 17 nt, Homo sapiens
ucgaugcagugcuucca

SEQ ID NO: 777220 - RNA, 11 nt, Homo sapiens
ucgaugugcuc

SEQ ID NO: 777221 - RNA, 20 nt, Homo sapiens
ucgcaaaaacguaucuccua

SEQ ID NO: 777222 - RNA, 16 nt, Homo sapiens
ucgcaaggccugugcu

SEQ ID NO: 777223 - RNA, 15 nt, Homo sapiens
ucgcaccacugcacu

SEQ ID NO: 777224 - RNA, 14 nt, Homo sapiens
ucgcaccuuuccaa

SEQ ID NO: 777225 - RNA, 19 nt, Homo sapiens
ucgcauggcagaaaggggg

SEQ ID NO: 777226 - RNA, 14 nt, Homo sapiens
ucgcauuugucaau

SEQ ID NO: 777227 - RNA, 16 nt, Homo sapiens
ucgccacugcacucca

SEQ ID NO: 777228 - RNA, 21 nt, Homo sapiens
ucgccagcugaaguugcugag

SEQ ID NO: 777229 - RNA, 23 nt, Homo sapiens
ucgccaucuucuucccuuaacuc

SEQ ID NO: 777230 - RNA, 15 nt, Homo sapiens
ucgccauuguucacc

SEQ ID NO: 777231 - RNA, 17 nt, Homo sapiens
ucgcccaggagacaucc

SEQ ID NO: 777232 - RNA, 23 nt, Homo sapiens
ucgccguguuacuguugcacuga

SEQ ID NO: 777233 - RNA, 21 nt, Homo sapiens
ucgccuguuggggaccucacc

SEQ ID NO: 777234 - RNA, 21 nt, Homo sapiens
ucgcgauuaagagacagagaa

SEQ ID NO: 777235 - RNA, 20 nt, Homo sapiens
ucgcuaugugacuugcgcuu

SEQ ID NO: 777236 - RNA, 21 nt, Homo sapiens
ucgcuauugauuuuuacuuca

SEQ ID NO: 777237 - RNA, 23 nt, Homo sapiens
ucgcuauugauuuuuacuucaau

SEQ ID NO: 777238 - RNA, 15 nt, Homo sapiens
ucgcugccagaugau

SEQ ID NO: 777239 - RNA, 19 nt, Homo sapiens
ucgcugcccucucugccag

SEQ ID NO: 777240 - RNA, 15 nt, Homo sapiens
ucgcuugaaccuggg

SEQ ID NO: 777241 - RNA, 16 nt, Homo sapiens
ucgcuuuguugcccag

SEQ ID NO: 777242 - RNA, 22 nt, Homo sapiens
ucggaucucacaggcugagaac

SEQ ID NO: 777243 - RNA, 19 nt, Homo sapiens
ucggauuugccauagccuu

SEQ ID NO: 777244 - RNA, 16 nt, Homo sapiens
ucggccccagcacaug

SEQ ID NO: 777245 - RNA, 18 nt, Homo sapiens
ucggcccuguuccccaag

SEQ ID NO: 777246 - RNA, 18 nt, Homo sapiens
ucggccucccacagugcu

SEQ ID NO: 777247 - RNA, 11 nt, Homo sapiens
ucggccuucac

SEQ ID NO: 777248 - RNA, 15 nt, Homo sapiens
ucggggaacuccugg

SEQ ID NO: 777249 - RNA, 22 nt, Homo sapiens
ucggggaacuccuggaaauauc

SEQ ID NO: 777250 - RNA, 10 nt, Homo sapiens
ucggggagcu

SEQ ID NO: 777251 - RNA, 13 nt, Homo sapiens
ucggggugcuccu

SEQ ID NO: 777252 - RNA, 16 nt, Homo sapiens
ucgguggcucaugccu

SEQ ID NO: 777253 - RNA, 15 nt, Homo sapiens
ucggugugcugccaa

SEQ ID NO: 777254 - RNA, 10 nt, Homo sapiens
ucguagccaa

SEQ ID NO: 777255 - RNA, 19 nt, Homo sapiens
ucguaggggauguggagug

SEQ ID NO: 777256 - RNA, 18 nt, Homo sapiens
ucguaugaucaguacuga

SEQ ID NO: 777257 - RNA, 23 nt, Homo sapiens
ucgucacgagcacaauggucuua

SEQ ID NO: 777258 - RNA, 16 nt, Homo sapiens
ucguccugcugcugcu

SEQ ID NO: 777259 - RNA, 18 nt, Homo sapiens
ucgugaaaccccaucucu

SEQ ID NO: 777260 - RNA, 20 nt, Homo sapiens
ucguggguguguguagccaa

SEQ ID NO: 777261 - RNA, 15 nt, Homo sapiens
ucguucucugccuca

SEQ ID NO: 777262 - RNA, 21 nt, Homo sapiens
ucguuuaaaaacaaaggaaua

SEQ ID NO: 777263 - RNA, 16 nt, Homo sapiens
ucguuuggaucuguga

SEQ ID NO: 777264 - RNA, 22 nt, Homo sapiens
ucguuuugcccgauuccguauu

SEQ ID NO: 777265 - RNA, 17 nt, Homo sapiens
ucuaaaacugccuucca

SEQ ID NO: 777266 - RNA, 16 nt, Homo sapiens
ugcaggccuggcugca

SEQ ID NO: 777267 - RNA, 22 nt, Homo sapiens
ugcagggaagccccacuugaag

SEQ ID NO: 777268 - RNA, 13 nt, Homo sapiens
ugcagggacucca

SEQ ID NO: 777269 - RNA, 13 nt, Homo sapiens
ugcagggccagac

SEQ ID NO: 777270 - RNA, 18 nt, Homo sapiens
ugcagggccuccauuccu

SEQ ID NO: 777271 - RNA, 13 nt, Homo sapiens
ugcaggggucccc

SEQ ID NO: 777272 - RNA, 20 nt, Homo sapiens
ugcaggguguguacugcaca

SEQ ID NO: 777273 - RNA, 15 nt, Homo sapiens
ugcaggugaugccau

SEQ ID NO: 777274 - RNA, 21 nt, Homo sapiens
ugcagguuccuuaucugucac

SEQ ID NO: 777275 - RNA, 14 nt, Homo sapiens
ugcaguagccguuu

SEQ ID NO: 777276 - RNA, 15 nt, Homo sapiens
ugcaguagccguuug

SEQ ID NO: 777277 - RNA, 22 nt, Homo sapiens
ugcaguaggggcuacugugacc

SEQ ID NO: 777278 - RNA, 13 nt, Homo sapiens
ugcaguaguauuu

SEQ ID NO: 777279 - RNA, 16 nt, Homo sapiens
ugcaguaucucaagau

SEQ ID NO: 777280 - RNA, 23 nt, Homo sapiens
ugcagucaaaggaacgccuuccc

SEQ ID NO: 777281 - RNA, 20 nt, Homo sapiens
ugcagucacagcuacacaga

SEQ ID NO: 777282 - RNA, 22 nt, Homo sapiens
ugcagucauuaugagaggcaau

SEQ ID NO: 777283 - RNA, 20 nt, Homo sapiens
ugcagucggugguaccugag

SEQ ID NO: 777284 - RNA, 17 nt, Homo sapiens
ugcagugagcugagauu

SEQ ID NO: 777285 - RNA, 15 nt, Homo sapiens
ugcagugagcugugu

SEQ ID NO: 777286 - RNA, 13 nt, Homo sapiens
ugcagugcuucca

SEQ ID NO: 777287 - RNA, 18 nt, Homo sapiens
ugcaguggcaucaucuca

SEQ ID NO: 777288 - RNA, 20 nt, Homo sapiens
ugcaguggcaucaucucagc

SEQ ID NO: 777289 - RNA, 23 nt, Homo sapiens
ugcaguggcgcgaucucagcuca

SEQ ID NO: 777290 - RNA, 16 nt, Homo sapiens
ugcaguggugccauca

SEQ ID NO: 777291 - RNA, 18 nt, Homo sapiens
ugcaguggugccaucacc

SEQ ID NO: 777292 - RNA, 19 nt, Homo sapiens
ugcaguucaccugcacuua

SEQ ID NO: 777293 - RNA, 21 nt, Homo sapiens
ugcaguucaccugcacuuaag

SEQ ID NO: 777294 - RNA, 15 nt, Homo sapiens
ugcaguucugagcac

SEQ ID NO: 777295 - RNA, 16 nt, Homo sapiens
ugcaguuggacucuca

SEQ ID NO: 777296 - RNA, 21 nt, Homo sapiens
ugcaguuguaggcauguagcu

SEQ ID NO: 777297 - RNA, 20 nt, Homo sapiens
ugcaguuuuuaucagccuug

SEQ ID NO: 777298 - RNA, 22 nt, Homo sapiens
ugcaguuuuugccuggguccca

SEQ ID NO: 777299 - RNA, 18 nt, Homo sapiens
ugcauaauaagcuaaaga

SEQ ID NO: 777300 - RNA, 21 nt, Homo sapiens
ugcauaauucuaagucuucca

SEQ ID NO: 777301 - RNA, 16 nt, Homo sapiens
ugcauacuacucucaa

SEQ ID NO: 777302 - RNA, 16 nt, Homo sapiens
ugcauaucugccuccc

SEQ ID NO: 777303 - RNA, 21 nt, Homo sapiens
ugcaucaauauguauuacaaa

SEQ ID NO: 777304 - RNA, 12 nt, Homo sapiens
ugcaucacauga

SEQ ID NO: 777305 - RNA, 22 nt, Homo sapiens
ugcaucacuuaacggaccaaag

SEQ ID NO: 777306 - RNA, 12 nt, Homo sapiens
ugcaucagaaag

SEQ ID NO: 777307 - RNA, 15 nt, Homo sapiens
ugcaucagcugcuga

SEQ ID NO: 777308 - RNA, 16 nt, Homo sapiens
ugcauccaaaccugua

SEQ ID NO: 777309 - RNA, 18 nt, Homo sapiens
ugcauccguaguucccug

SEQ ID NO: 777310 - RNA, 16 nt, Homo sapiens
ugcauccucacugugg

SEQ ID NO: 777311 - RNA, 15 nt, Homo sapiens
ugcaucuguacucac

SEQ ID NO: 777312 - RNA, 14 nt, Homo sapiens
ugcaucuguuacuu

SEQ ID NO: 777313 - RNA, 16 nt, Homo sapiens
ugcaucuuguuucaua

SEQ ID NO: 777314 - RNA, 22 nt, Homo sapiens
ugcaugagcucccucgcuguau

SEQ ID NO: 777315 - RNA, 20 nt, Homo sapiens
ugcaugccuguagucucagc

SEQ ID NO: 777316 - RNA, 16 nt, Homo sapiens
ugcaugcuguagcugc

SEQ ID NO: 777317 - RNA, 16 nt, Homo sapiens
ugcaugcuucuucuca

SEQ ID NO: 777318 - RNA, 21 nt, Homo sapiens
ugcauguaccauuugcauggc

SEQ ID NO: 777319 - RNA, 24 nt, Homo sapiens
ugcauguagucacuuuauaaguca

SEQ ID NO: 777320 - RNA, 22 nt, Homo sapiens
ugcauguccggcugaaggcuga

SEQ ID NO: 777321 - RNA, 15 nt, Homo sapiens
ugcaugugugugaug

SEQ ID NO: 777322 - RNA, 18 nt, Homo sapiens
ugcauguuacccauucaa

SEQ ID NO: 777323 - RNA, 13 nt, Homo sapiens
ugcauucuggcca

SEQ ID NO: 777324 - RNA, 18 nt, Homo sapiens
ugcauugagaacugcaua

SEQ ID NO: 777325 - RNA, 15 nt, Homo sapiens
ugcauugucuaauga

SEQ ID NO: 777326 - RNA, 16 nt, Homo sapiens
ugcauuucaccuguga

SEQ ID NO: 777327 - RNA, 18 nt, Homo sapiens
ugcauuucaccugugaca

SEQ ID NO: 777328 - RNA, 18 nt, Homo sapiens
ugcauuuuauagaauagu

SEQ ID NO: 777329 - RNA, 21 nt, Homo sapiens
ugcauuuuuauuaaagcauuu

SEQ ID NO: 777330 - RNA, 16 nt, Homo sapiens
ugcauuuuugugaaau

SEQ ID NO: 777331 - RNA, 16 nt, Homo sapiens
ugccaaaccaagcaaa

SEQ ID NO: 777332 - RNA, 22 nt, Homo sapiens
ugccaaagcuuuacuacugugg

SEQ ID NO: 777333 - RNA, 18 nt, Homo sapiens
ugccaaagggaaauauca

SEQ ID NO: 777334 - RNA, 16 nt, Homo sapiens
ugccaagaauauaguu

SEQ ID NO: 777335 - RNA, 17 nt, Homo sapiens
ugccaaggcaagaucua

SEQ ID NO: 777336 - RNA, 20 nt, Homo sapiens
ugccaagggggugacuggaa

SEQ ID NO: 777337 - RNA, 18 nt, Homo sapiens
ugccaagggguuaaugaa

SEQ ID NO: 777338 - RNA, 18 nt, Homo sapiens
ugccaauugagggcauua

SEQ ID NO: 777339 - RNA, 22 nt, Homo sapiens
ugccacaaugcaguucugagca

SEQ ID NO: 777340 - RNA, 20 nt, Homo sapiens
ugccacagaugauacuucca

SEQ ID NO: 777341 - RNA, 19 nt, Homo sapiens
ugccaccacaccuggcuaa

SEQ ID NO: 777342 - RNA, 18 nt, Homo sapiens
ugccaccaucauagcuca

SEQ ID NO: 777343 - RNA, 20 nt, Homo sapiens
ugccaccauggccagccaac

SEQ ID NO: 777344 - RNA, 21 nt, Homo sapiens
ugccacccugccccuugccau

SEQ ID NO: 777345 - RNA, 17 nt, Homo sapiens
ugccacggaaacauaca

SEQ ID NO: 777346 - RNA, 20 nt, Homo sapiens
ugccacguucuggacugucu

SEQ ID NO: 777347 - RNA, 11 nt, Homo sapiens
ugccacuaauu

SEQ ID NO: 777348 - RNA, 15 nt, Homo sapiens
ugccacuacacucaa

SEQ ID NO: 777349 - RNA, 16 nt, Homo sapiens
ugccacuguguacugu

SEQ ID NO: 777350 - RNA, 22 nt, Homo sapiens
ugccacuuccuuuuaacugcca

SEQ ID NO: 777351 - RNA, 17 nt, Homo sapiens
ugccacuugucaaagaa

SEQ ID NO: 777352 - RNA, 20 nt, Homo sapiens
ugccagaauacuggguucuu

SEQ ID NO: 777353 - RNA, 12 nt, Homo sapiens
ugccagacaugu

SEQ ID NO: 777354 - RNA, 19 nt, Homo sapiens
ugccagaggaugcucuuuc

SEQ ID NO: 777355 - RNA, 17 nt, Homo sapiens
ugccagccgugaugcuc

SEQ ID NO: 777356 - RNA, 14 nt, Homo sapiens
ugccaggcacuguu

SEQ ID NO: 777357 - RNA, 14 nt, Homo sapiens
ugccaggcacuuug

SEQ ID NO: 777358 - RNA, 19 nt, Homo sapiens
ugccaggccagagggcagu

SEQ ID NO: 777359 - RNA, 15 nt, Homo sapiens
ugccaggccuggcaa

SEQ ID NO: 777360 - RNA, 22 nt, Homo sapiens
ugccaggcugaauuacagugaa

SEQ ID NO: 777361 - RNA, 19 nt, Homo sapiens
ugccagggccugucucuga

SEQ ID NO: 777362 - RNA, 23 nt, Homo sapiens
ugccaggugcaaucuacuggaaa

SEQ ID NO: 777363 - RNA, 15 nt, Homo sapiens
ugccagguuccugua

SEQ ID NO: 777364 - RNA, 20 nt, Homo sapiens
ugccagucagcaaccuguaa

SEQ ID NO: 777365 - RNA, 11 nt, Homo sapiens
ugccagugaaa

SEQ ID NO: 777366 - RNA, 15 nt, Homo sapiens
ugccagugacagaca

SEQ ID NO: 777367 - RNA, 17 nt, Homo sapiens
ugccaguucaagaauuu

SEQ ID NO: 777368 - RNA, 21 nt, Homo sapiens
ugccauaaugacucagaauau

SEQ ID NO: 777369 - RNA, 18 nt, Homo sapiens
ugccauaguuugugaauc

SEQ ID NO: 777370 - RNA, 13 nt, Homo sapiens
ugccauaucagug

SEQ ID NO: 777371 - RNA, 14 nt, Homo sapiens
ugccauccaugugc

SEQ ID NO: 777372 - RNA, 20 nt, Homo sapiens
ugccaugccaggaaccuguc

SEQ ID NO: 777373 - RNA, 17 nt, Homo sapiens
ugccauggccugugcug

SEQ ID NO: 777374 - RNA, 11 nt, Homo sapiens
ugccaugucug

SEQ ID NO: 777375 - RNA, 12 nt, Homo sapiens
ugccaugugaag

SEQ ID NO: 777376 - RNA, 22 nt, Homo sapiens
ugccauuaugcaaauggagaua

SEQ ID NO: 777377 - RNA, 21 nt, Homo sapiens
ugcccaaggagcccccugaga

SEQ ID NO: 777378 - RNA, 18 nt, Homo sapiens
ugcccacacacacccacu

SEQ ID NO: 777379 - RNA, 18 nt, Homo sapiens
ugcccacacacuuuccau

SEQ ID NO: 777380 - RNA, 20 nt, Homo sapiens
uggaagaaagcaacaaagau

SEQ ID NO: 777381 - RNA, 16 nt, Homo sapiens
uggaagaacugugaua

SEQ ID NO: 777382 - RNA, 12 nt, Homo sapiens
uggaagauggca

SEQ ID NO: 777383 - RNA, 12 nt, Homo sapiens
uggaagauuugu

SEQ ID NO: 777384 - RNA, 11 nt, Homo sapiens
uggaagcagag

SEQ ID NO: 777385 - RNA, 14 nt, Homo sapiens
uggaagcauacaaa

SEQ ID NO: 777386 - RNA, 12 nt, Homo sapiens
uggaagcucucc

SEQ ID NO: 777387 - RNA, 14 nt, Homo sapiens
uggaagcuggaaga

SEQ ID NO: 777388 - RNA, 18 nt, Homo sapiens
uggaaggacacagugaug

SEQ ID NO: 777389 - RNA, 22 nt, Homo sapiens
uggaaguaaccauuugcacugg

SEQ ID NO: 777390 - RNA, 14 nt, Homo sapiens
uggaagucaucuca

SEQ ID NO: 777391 - RNA, 16 nt, Homo sapiens
uggaagucuccaugaa

SEQ ID NO: 777392 - RNA, 15 nt, Homo sapiens
uggaagugcuugaua

SEQ ID NO: 777393 - RNA, 22 nt, Homo sapiens
uggaaguuuauuuccaucugua

SEQ ID NO: 777394 - RNA, 13 nt, Homo sapiens
uggaauaaaguca

SEQ ID NO: 777395 - RNA, 12 nt, Homo sapiens
uggaauaaggca

SEQ ID NO: 777396 - RNA, 23 nt, Homo sapiens
uggaauacauuucuccuuugaua

SEQ ID NO: 777397 - RNA, 16 nt, Homo sapiens
uggaauaccuaaggau

SEQ ID NO: 777398 - RNA, 19 nt, Homo sapiens
uggaaucuuuguaccaaaa

SEQ ID NO: 777399 - RNA, 14 nt, Homo sapiens
uggaaugaaaacuu

SEQ ID NO: 777400 - RNA, 17 nt, Homo sapiens
uggaaugaagguaauau

SEQ ID NO: 777401 - RNA, 22 nt, Homo sapiens
uggaaugagacuggcuugcccu

SEQ ID NO: 777402 - RNA, 13 nt, Homo sapiens
uggaaugcaguga

SEQ ID NO: 777403 - RNA, 19 nt, Homo sapiens
uggaauuaauaaaugucau

SEQ ID NO: 777404 - RNA, 22 nt, Homo sapiens
uggaauuacaaaacucagagaa

SEQ ID NO: 777405 - RNA, 19 nt, Homo sapiens
uggaauuccacagggacca

SEQ ID NO: 777406 - RNA, 14 nt, Homo sapiens
uggaauucuacugg

SEQ ID NO: 777407 - RNA, 16 nt, Homo sapiens
uggaauucuacuggaa

SEQ ID NO: 777408 - RNA, 14 nt, Homo sapiens
uggaauuuugcaaa

SEQ ID NO: 777409 - RNA, 20 nt, Homo sapiens
uggacaaaccgagugcaaug

SEQ ID NO: 777410 - RNA, 12 nt, Homo sapiens
uggacaaaucac

SEQ ID NO: 777411 - RNA, 17 nt, Homo sapiens
uggacaacauuuuacua

SEQ ID NO: 777412 - RNA, 20 nt, Homo sapiens
uggacaaggagugugaccac

SEQ ID NO: 777413 - RNA, 21 nt, Homo sapiens
uggacaagugcuguugggaua

SEQ ID NO: 777414 - RNA, 19 nt, Homo sapiens
uggacaccccugcuauaua

SEQ ID NO: 777415 - RNA, 17 nt, Homo sapiens
uggacagauugccuguu

SEQ ID NO: 777416 - RNA, 16 nt, Homo sapiens
uggacagccugaguca

SEQ ID NO: 777417 - RNA, 17 nt, Homo sapiens
uggacagcuuuucccaa

SEQ ID NO: 777418 - RNA, 17 nt, Homo sapiens
uggacaggcagccuccu

SEQ ID NO: 777419 - RNA, 15 nt, Homo sapiens
uggacauaagacaga

SEQ ID NO: 777420 - RNA, 15 nt, Homo sapiens
uggacauccccagaa

SEQ ID NO: 777421 - RNA, 22 nt, Homo sapiens
uggaccaaaggaaggaagcaag

SEQ ID NO: 777422 - RNA, 21 nt, Homo sapiens
uggaccaauagggcugagcuc

SEQ ID NO: 777423 - RNA, 22 nt, Homo sapiens
uggaccaauagggcugagcucu

SEQ ID NO: 777424 - RNA, 23 nt, Homo sapiens
uggaccagaaugaaaacuguaaa

SEQ ID NO: 777425 - RNA, 14 nt, Homo sapiens
uggaccaggccauu

SEQ ID NO: 777426 - RNA, 14 nt, Homo sapiens
uggacgugcucaga

SEQ ID NO: 777427 - RNA, 12 nt, Homo sapiens
uggacuacacaa

SEQ ID NO: 777428 - RNA, 14 nt, Homo sapiens
uggacuacacaaua

SEQ ID NO: 777429 - RNA, 21 nt, Homo sapiens
uggacuacacccaagccugau

SEQ ID NO: 777430 - RNA, 15 nt, Homo sapiens
uggacucugcacaug

SEQ ID NO: 777431 - RNA, 17 nt, Homo sapiens
uggacucugcacauguc

SEQ ID NO: 777432 - RNA, 16 nt, Homo sapiens
uggacugauaaucucu

SEQ ID NO: 777433 - RNA, 19 nt, Homo sapiens
uggacugccuuauugcugu

SEQ ID NO: 777434 - RNA, 21 nt, Homo sapiens
uggacuguggcacuugccugg

SEQ ID NO: 777435 - RNA, 15 nt, Homo sapiens
uggacugugugcaac

SEQ ID NO: 777436 - RNA, 21 nt, Homo sapiens
uggacuucacauaagcucaga

SEQ ID NO: 777437 - RNA, 22 nt, Homo sapiens
uggacuuguauauuuguacaaa

SEQ ID NO: 777438 - RNA, 20 nt, Homo sapiens
uggacuuuugaaaagcuuuu

SEQ ID NO: 777439 - RNA, 16 nt, Homo sapiens
uggacuuuugaagucc

SEQ ID NO: 777440 - RNA, 23 nt, Homo sapiens
uggacuuuugaaguccacuuguu

SEQ ID NO: 777441 - RNA, 19 nt, Homo sapiens
uggagaaaagggauggagc

SEQ ID NO: 777442 - RNA, 22 nt, Homo sapiens
uggagaacccaggggacagcug

SEQ ID NO: 777443 - RNA, 23 nt, Homo sapiens
uggagaagccacaggccugagau

SEQ ID NO: 777444 - RNA, 16 nt, Homo sapiens
uggagaaggaguuuca

SEQ ID NO: 777445 - RNA, 18 nt, Homo sapiens
uggagaaggguucugccc

SEQ ID NO: 777446 - RNA, 17 nt, Homo sapiens
uggagaaucugcugcau

SEQ ID NO: 777447 - RNA, 22 nt, Homo sapiens
uggagaauuuuuggauggugau

SEQ ID NO: 777448 - RNA, 17 nt, Homo sapiens
uggagacaaggugcuaa

SEQ ID NO: 777449 - RNA, 20 nt, Homo sapiens
uggagacaaggugcuaacau

SEQ ID NO: 777450 - RNA, 22 nt, Homo sapiens
uggagacacaacuauuuuucca

SEQ ID NO: 777451 - RNA, 22 nt, Homo sapiens
uggagacacccucugggggucc

SEQ ID NO: 777452 - RNA, 12 nt, Homo sapiens
uggagacagggu

SEQ ID NO: 777453 - RNA, 22 nt, Homo sapiens
uggagagauguuuggaaaccac

SEQ ID NO: 777454 - RNA, 19 nt, Homo sapiens
uggagagcagcaggugcug

SEQ ID NO: 777455 - RNA, 14 nt, Homo sapiens
uggagaggaaccca

SEQ ID NO: 777456 - RNA, 18 nt, Homo sapiens
uggagaggagaguggcag

SEQ ID NO: 777457 - RNA, 19 nt, Homo sapiens
uggagagggaaugugaaau

SEQ ID NO: 777458 - RNA, 13 nt, Homo sapiens
uggagaugaagcc

SEQ ID NO: 777459 - RNA, 19 nt, Homo sapiens
uggagauggaagcuuguug

SEQ ID NO: 777460 - RNA, 17 nt, Homo sapiens
uggagcaaccuacuguc

SEQ ID NO: 777461 - RNA, 16 nt, Homo sapiens
uggagcacaaaauuca

SEQ ID NO: 777462 - RNA, 22 nt, Homo sapiens
uggagcagaacuuuccagggau

SEQ ID NO: 777463 - RNA, 14 nt, Homo sapiens
uggagcagccagag

SEQ ID NO: 777464 - RNA, 19 nt, Homo sapiens
uggagcaggagccccgcca

SEQ ID NO: 777465 - RNA, 17 nt, Homo sapiens
uggagcauggacagugu

SEQ ID NO: 777466 - RNA, 22 nt, Homo sapiens
uggagccagcaaccagcacauc

SEQ ID NO: 777467 - RNA, 20 nt, Homo sapiens
uggagccagcagggcuguga

SEQ ID NO: 777468 - RNA, 15 nt, Homo sapiens
uggagccauccuccu

SEQ ID NO: 777469 - RNA, 23 nt, Homo sapiens
uggagcccaggaguuugaggcug

SEQ ID NO: 777470 - RNA, 17 nt, Homo sapiens
uggagccccaggggaca

SEQ ID NO: 777471 - RNA, 17 nt, Homo sapiens
uggagcccgaagcucuu

SEQ ID NO: 777472 - RNA, 21 nt, Homo sapiens
uggagcccuaaccccuuccag

SEQ ID NO: 777473 - RNA, 14 nt, Homo sapiens
uggagcugggcuaa

SEQ ID NO: 777474 - RNA, 17 nt, Homo sapiens
uggaggaaguucuccag

SEQ ID NO: 777475 - RNA, 14 nt, Homo sapiens
uggaggauugcuau

SEQ ID NO: 777476 - RNA, 19 nt, Homo sapiens
uggaggccggaaucucagc

SEQ ID NO: 777477 - RNA, 23 nt, Homo sapiens
uggaggcucuucugugauuuuga

SEQ ID NO: 777478 - RNA, 18 nt, Homo sapiens
uggaggcugucuucucag

SEQ ID NO: 777479 - RNA, 16 nt, Homo sapiens
uggagggaaugcucag

SEQ ID NO: 777480 - RNA, 20 nt, Homo sapiens
uggagggguguggcuccuuc

SEQ ID NO: 777481 - RNA, 20 nt, Homo sapiens
uggaggucauacaugcauac

SEQ ID NO: 777482 - RNA, 20 nt, Homo sapiens
uggagguugcagugagccaa

SEQ ID NO: 777483 - RNA, 19 nt, Homo sapiens
uggaguacuauauuuacaa

SEQ ID NO: 777484 - RNA, 20 nt, Homo sapiens
uggaguagccauucuuuauu

SEQ ID NO: 777485 - RNA, 21 nt, Homo sapiens
uggaguauagugcaaauucau

SEQ ID NO: 777486 - RNA, 16 nt, Homo sapiens
uggaguauuggggucu

SEQ ID NO: 777487 - RNA, 18 nt, Homo sapiens
uggagucacaucagugag

SEQ ID NO: 777488 - RNA, 11 nt, Homo sapiens
uggagugcagu

SEQ ID NO: 777489 - RNA, 13 nt, Homo sapiens
uggagugcagugg

SEQ ID NO: 777490 - RNA, 18 nt, Homo sapiens
uggagugcaguggcauga

SEQ ID NO: 777491 - RNA, 17 nt, Homo sapiens
uggagugcuucuggaac

SEQ ID NO: 777492 - RNA, 14 nt, Homo sapiens
uggaguuccugcuc

SEQ ID NO: 777493 - RNA, 14 nt, Homo sapiens
uggaguucucucau

SEQ ID NO: 777494 - RNA, 22 nt, Homo sapiens
ugggcagacugaaccaguccag

SEQ ID NO: 777495 - RNA, 18 nt, Homo sapiens
ugggcagagcugcaucau

SEQ ID NO: 777496 - RNA, 22 nt, Homo sapiens
ugggcagcaaaacgacacugcg

SEQ ID NO: 777497 - RNA, 21 nt, Homo sapiens
ugggcaggcaggagcagggga

SEQ ID NO: 777498 - RNA, 22 nt, Homo sapiens
ugggcagggucuguuuggacug

SEQ ID NO: 777499 - RNA, 21 nt, Homo sapiens
ugggcaggugguggcacugag

SEQ ID NO: 777500 - RNA, 16 nt, Homo sapiens
ugggcaugccauuaca

SEQ ID NO: 777501 - RNA, 13 nt, Homo sapiens
ugggcauuucaau

SEQ ID NO: 777502 - RNA, 18 nt, Homo sapiens
ugggcauuuucccagaug

SEQ ID NO: 777503 - RNA, 19 nt, Homo sapiens
ugggccagacaugccacaa

SEQ ID NO: 777504 - RNA, 17 nt, Homo sapiens
ugggccauguccaaaga

SEQ ID NO: 777505 - RNA, 21 nt, Homo sapiens
ugggcccacccggugggaccc

SEQ ID NO: 777506 - RNA, 22 nt, Homo sapiens
ugggcccacccggugggacccc

SEQ ID NO: 777507 - RNA, 16 nt, Homo sapiens
ugggccccaccaccua

SEQ ID NO: 777508 - RNA, 15 nt, Homo sapiens
ugggcccuaugucuc

SEQ ID NO: 777509 - RNA, 21 nt, Homo sapiens
ugggccggcugaguggcagca

SEQ ID NO: 777510 - RNA, 15 nt, Homo sapiens
ugggccuccaugccc

SEQ ID NO: 777511 - RNA, 19 nt, Homo sapiens
ugggcgcucucccuaccuu

SEQ ID NO: 777512 - RNA, 23 nt, Homo sapiens
ugggcucacuucuaauaacugca

SEQ ID NO: 777513 - RNA, 23 nt, Homo sapiens
ugggcucugugcagucacuggag

SEQ ID NO: 777514 - RNA, 13 nt, Homo sapiens
ugggcucuuccaa

SEQ ID NO: 777515 - RNA, 23 nt, Homo sapiens
ugggcuguaacguggcacuggua

SEQ ID NO: 777516 - RNA, 21 nt, Homo sapiens
ugggcugucagcccaugugca

SEQ ID NO: 777517 - RNA, 19 nt, Homo sapiens
ugggcugugggcaagccua

SEQ ID NO: 777518 - RNA, 16 nt, Homo sapiens
ugggcuguggggcccu

SEQ ID NO: 777519 - RNA, 15 nt, Homo sapiens
ugggcuuccugauga

SEQ ID NO: 777520 - RNA, 13 nt, Homo sapiens
ugggcuugaccag

SEQ ID NO: 777521 - RNA, 20 nt, Homo sapiens
uggggaaacagaugccucag

SEQ ID NO: 777522 - RNA, 18 nt, Homo sapiens
uggggaagaagacacaga

SEQ ID NO: 777523 - RNA, 19 nt, Homo sapiens
uggggaagaguggucuuga

SEQ ID NO: 777524 - RNA, 15 nt, Homo sapiens
uggggaaguguucca

SEQ ID NO: 777525 - RNA, 16 nt, Homo sapiens
uggggaaguguuccag

SEQ ID NO: 777526 - RNA, 20 nt, Homo sapiens
uggggaaguguuccagauag

SEQ ID NO: 777527 - RNA, 16 nt, Homo sapiens
uggggacauugcucuc

SEQ ID NO: 777528 - RNA, 16 nt, Homo sapiens
uggggaccucaccugc

SEQ ID NO: 777529 - RNA, 15 nt, Homo sapiens
uggggagauggaguu

SEQ ID NO: 777530 - RNA, 16 nt, Homo sapiens
uggggaggagggggcc

SEQ ID NO: 777531 - RNA, 20 nt, Homo sapiens
uggggaggccuauuccugcu

SEQ ID NO: 777532 - RNA, 19 nt, Homo sapiens
uggggagggagagccauca

SEQ ID NO: 777533 - RNA, 21 nt, Homo sapiens
uggggauccccgccuggccag

SEQ ID NO: 777534 - RNA, 16 nt, Homo sapiens
uggggaugaagcucac

SEQ ID NO: 777535 - RNA, 16 nt, Homo sapiens
uggggaugucucucau

SEQ ID NO: 777536 - RNA, 18 nt, Homo sapiens
uggggaugucucucauga

SEQ ID NO: 777537 - RNA, 15 nt, Homo sapiens
uggggauuguacacg

SEQ ID NO: 777538 - RNA, 19 nt, Homo sapiens
uggggcaggcugggccaug

SEQ ID NO: 777539 - RNA, 19 nt, Homo sapiens
uggggcagucucugcccaa

SEQ ID NO: 777540 - RNA, 12 nt, Homo sapiens
uggggcucucuc

SEQ ID NO: 777541 - RNA, 15 nt, Homo sapiens
uggggcugggguccu

SEQ ID NO: 777542 - RNA, 23 nt, Homo sapiens
ugggggaagacuuuaaaccaccu

SEQ ID NO: 777543 - RNA, 14 nt, Homo sapiens
ugggggacacccgg

SEQ ID NO: 777544 - RNA, 18 nt, Homo sapiens
ugggggacgugggcauuu

SEQ ID NO: 777545 - RNA, 18 nt, Homo sapiens
ugggggagggaagaccag

SEQ ID NO: 777546 - RNA, 19 nt, Homo sapiens
ugggggagguccaagcaga

SEQ ID NO: 777547 - RNA, 20 nt, Homo sapiens
ugggggagugugaguuuugc

SEQ ID NO: 777548 - RNA, 23 nt, Homo sapiens
uggggggggguccuaaauguaau

SEQ ID NO: 777549 - RNA, 13 nt, Homo sapiens
ugggggucagggg

SEQ ID NO: 777550 - RNA, 17 nt, Homo sapiens
ugggggugccgcugucu

SEQ ID NO: 777551 - RNA, 21 nt, Homo sapiens
ugggggugccgcugucucuga

SEQ ID NO: 777552 - RNA, 22 nt, Homo sapiens
ugggggugccgcugucucugag

SEQ ID NO: 777553 - RNA, 21 nt, Homo sapiens
ugggggugccgcuuucucuga

SEQ ID NO: 777554 - RNA, 15 nt, Homo sapiens
ugggggugcucucuc

SEQ ID NO: 777555 - RNA, 17 nt, Homo sapiens
ugggguauaggucucau

SEQ ID NO: 777556 - RNA, 17 nt, Homo sapiens
uggggucuguucuugaa

SEQ ID NO: 777557 - RNA, 21 nt, Homo sapiens
ugggguggggggggguccuaa

SEQ ID NO: 777558 - RNA, 23 nt, Homo sapiens
ugggguuacucgauguaagggau

SEQ ID NO: 777559 - RNA, 18 nt, Homo sapiens
uggguaaauuaacugaac

SEQ ID NO: 777560 - RNA, 22 nt, Homo sapiens
uggguaauaaccaagauggagu

SEQ ID NO: 777561 - RNA, 16 nt, Homo sapiens
uggguacaucaagucc

SEQ ID NO: 777562 - RNA, 13 nt, Homo sapiens
uggguacccugag

SEQ ID NO: 777563 - RNA, 23 nt, Homo sapiens
uggguacugaaagccuuagggaa

SEQ ID NO: 777564 - RNA, 14 nt, Homo sapiens
uggguacugacuga

SEQ ID NO: 777565 - RNA, 17 nt, Homo sapiens
uggguacugacugagau

SEQ ID NO: 777566 - RNA, 19 nt, Homo sapiens
uggguacuggagcuuuuaa

SEQ ID NO: 777567 - RNA, 21 nt, Homo sapiens
uggguaucgcugagacuaagu

SEQ ID NO: 777568 - RNA, 14 nt, Homo sapiens
ugggucagcccagc

SEQ ID NO: 777569 - RNA, 15 nt, Homo sapiens
uggguccaccaugca

SEQ ID NO: 777570 - RNA, 22 nt, Homo sapiens
ugggucccuccucucaccucuc

SEQ ID NO: 777571 - RNA, 18 nt, Homo sapiens
uggguccuugaugccaga

SEQ ID NO: 777572 - RNA, 19 nt, Homo sapiens
ugggucuaccacucagaga

SEQ ID NO: 777573 - RNA, 15 nt, Homo sapiens
ugggucucagcugcu

SEQ ID NO: 777574 - RNA, 21 nt, Homo sapiens
ugggucucagcugcugacacg

SEQ ID NO: 777575 - RNA, 15 nt, Homo sapiens
ugggucuugccaugu

SEQ ID NO: 777576 - RNA, 19 nt, Homo sapiens
ugggugcuccucuucugcc

SEQ ID NO: 777577 - RNA, 19 nt, Homo sapiens
ugggugggaggggcccaca

SEQ ID NO: 777578 - RNA, 21 nt, Homo sapiens
uggguggggcugcuccuccag

SEQ ID NO: 777579 - RNA, 17 nt, Homo sapiens
uggguuggacaaccuca

SEQ ID NO: 777580 - RNA, 20 nt, Homo sapiens
uggguuuugggucuuugaac

SEQ ID NO: 777581 - RNA, 15 nt, Homo sapiens
uggguuuuuuaguug

SEQ ID NO: 777582 - RNA, 14 nt, Homo sapiens
ugguaaaauacuuc

SEQ ID NO: 777583 - RNA, 23 nt, Homo sapiens
ugguaaacaguuuggaaaagugg

SEQ ID NO: 777584 - RNA, 15 nt, Homo sapiens
ugguaaauacuguga

SEQ ID NO: 777585 - RNA, 16 nt, Homo sapiens
ugguaaauacugugaa

SEQ ID NO: 777586 - RNA, 21 nt, Homo sapiens
ugguaaggccucuggacuggc

SEQ ID NO: 777587 - RNA, 14 nt, Homo sapiens
ugguaaguugagau

SEQ ID NO: 777588 - RNA, 19 nt, Homo sapiens
ugguaaugaaggacaguga

SEQ ID NO: 777589 - RNA, 14 nt, Homo sapiens
ugguacagcacugu

SEQ ID NO: 777590 - RNA, 23 nt, Homo sapiens
ugguacccaggcuuuagcauuau

SEQ ID NO: 777591 - RNA, 18 nt, Homo sapiens
ugguacuguagcagggga

SEQ ID NO: 777592 - RNA, 15 nt, Homo sapiens
ugguagaaaggcagu

SEQ ID NO: 777593 - RNA, 19 nt, Homo sapiens
ugguagaaaggcaguucag

SEQ ID NO: 777594 - RNA, 18 nt, Homo sapiens
ugguagcaagaagugauu

SEQ ID NO: 777595 - RNA, 15 nt, Homo sapiens
ugguauaauugugua

SEQ ID NO: 777596 - RNA, 15 nt, Homo sapiens
ugguauacuuuugcu

SEQ ID NO: 777597 - RNA, 17 nt, Homo sapiens
ugguaugucucuuuaag

SEQ ID NO: 777598 - RNA, 18 nt, Homo sapiens
ugguauuuucaaccauaa

SEQ ID NO: 777599 - RNA, 20 nt, Homo sapiens
uggucaacuaaguucaggga

SEQ ID NO: 777600 - RNA, 21 nt, Homo sapiens
uggucaagauuuugaaugcuu

SEQ ID NO: 777601 - RNA, 15 nt, Homo sapiens
uggucaagugaugaa

SEQ ID NO: 777602 - RNA, 13 nt, Homo sapiens
uggucaccaaauc

SEQ ID NO: 777603 - RNA, 22 nt, Homo sapiens
uggucaccaaaucagcugcuac

SEQ ID NO: 777604 - RNA, 14 nt, Homo sapiens
uggucagagugaau

SEQ ID NO: 777605 - RNA, 12 nt, Homo sapiens
uggucagaugau

SEQ ID NO: 777606 - RNA, 19 nt, Homo sapiens
uggucagguuauacuccuc

SEQ ID NO: 777607 - RNA, 20 nt, Homo sapiens
uggucagugguggucuucaa

SEQ ID NO: 777608 - RNA, 16 nt, Homo sapiens
ugugaccugugucacu

SEQ ID NO: 777609 - RNA, 13 nt, Homo sapiens
ugugaccuugacu

SEQ ID NO: 777610 - RNA, 16 nt, Homo sapiens
ugugacgagguggcag

SEQ ID NO: 777611 - RNA, 22 nt, Homo sapiens
ugugacuugaacuagauugcau

SEQ ID NO: 777612 - RNA, 18 nt, Homo sapiens
ugugacuuucaaggacau

SEQ ID NO: 777613 - RNA, 22 nt, Homo sapiens
ugugagaagucacucacacugg

SEQ ID NO: 777614 - RNA, 16 nt, Homo sapiens
ugugagccaccacguc

SEQ ID NO: 777615 - RNA, 17 nt, Homo sapiens
ugugaguguaaguguga

SEQ ID NO: 777616 - RNA, 19 nt, Homo sapiens
ugugauacacugaaaggaa

SEQ ID NO: 777617 - RNA, 18 nt, Homo sapiens
ugugauacgaugcuucaa

SEQ ID NO: 777618 - RNA, 14 nt, Homo sapiens
ugugauauaugcau

SEQ ID NO: 777619 - RNA, 19 nt, Homo sapiens
ugugauauuuuuacuugca

SEQ ID NO: 777620 - RNA, 16 nt, Homo sapiens
ugugaugcaugagcuc

SEQ ID NO: 777621 - RNA, 16 nt, Homo sapiens
ugugauguuuguccug

SEQ ID NO: 777622 - RNA, 15 nt, Homo sapiens
ugugauuacaaggcu

SEQ ID NO: 777623 - RNA, 17 nt, Homo sapiens
ugugauuagacagaaca

SEQ ID NO: 777624 - RNA, 16 nt, Homo sapiens
ugugauuagaucacau

SEQ ID NO: 777625 - RNA, 14 nt, Homo sapiens
ugugauuagugucu

SEQ ID NO: 777626 - RNA, 23 nt, Homo sapiens
ugugauugaaggugauaagggaa

SEQ ID NO: 777627 - RNA, 22 nt, Homo sapiens
ugugcaaacauggagaaaucua

SEQ ID NO: 777628 - RNA, 15 nt, Homo sapiens
ugugcaaaugugcug

SEQ ID NO: 777629 - RNA, 13 nt, Homo sapiens
ugugcaacauucu

SEQ ID NO: 777630 - RNA, 22 nt, Homo sapiens
ugugcacacccaugcacacuca

SEQ ID NO: 777631 - RNA, 14 nt, Homo sapiens
ugugcacauugugc

SEQ ID NO: 777632 - RNA, 23 nt, Homo sapiens
ugugcacgcgcgcgugcacacac

SEQ ID NO: 777633 - RNA, 22 nt, Homo sapiens
ugugcacugccugcaugagcug

SEQ ID NO: 777634 - RNA, 20 nt, Homo sapiens
ugugcagguuuugaaaaugu

SEQ ID NO: 777635 - RNA, 15 nt, Homo sapiens
ugugcauaucugccu

SEQ ID NO: 777636 - RNA, 16 nt, Homo sapiens
ugugcaucaaccagga

SEQ ID NO: 777637 - RNA, 14 nt, Homo sapiens
ugugcaugcucagc

SEQ ID NO: 777638 - RNA, 15 nt, Homo sapiens
ugugcaugugagcac

SEQ ID NO: 777639 - RNA, 17 nt, Homo sapiens
ugugccaaagugcauag

SEQ ID NO: 777640 - RNA, 15 nt, Homo sapiens
ugugccacacaguga

SEQ ID NO: 777641 - RNA, 20 nt, Homo sapiens
ugugccaccaccccuugacc

SEQ ID NO: 777642 - RNA, 21 nt, Homo sapiens
ugugccaggcugaauuacagu

SEQ ID NO: 777643 - RNA, 15 nt, Homo sapiens
ugugcccagcaggcc

SEQ ID NO: 777644 - RNA, 13 nt, Homo sapiens
ugugcccgugugu

SEQ ID NO: 777645 - RNA, 21 nt, Homo sapiens
ugugccugcucagcagccagu

SEQ ID NO: 777646 - RNA, 18 nt, Homo sapiens
ugugccuuggugugcugu

SEQ ID NO: 777647 - RNA, 22 nt, Homo sapiens
ugugcgcucuguggaugccagg

SEQ ID NO: 777648 - RNA, 23 nt, Homo sapiens
ugugcguccauauuuaacaugua

SEQ ID NO: 777649 - RNA, 23 nt, Homo sapiens
ugugcuaccccuuugauuaugca

SEQ ID NO: 777650 - RNA, 17 nt, Homo sapiens
ugugcuauacacacaca

SEQ ID NO: 777651 - RNA, 18 nt, Homo sapiens
ugugcuccgugccuccac

SEQ ID NO: 777652 - RNA, 16 nt, Homo sapiens
ugugcuggugaacacu

SEQ ID NO: 777653 - RNA, 20 nt, Homo sapiens
ugugcuggugaacacuguga

SEQ ID NO: 777654 - RNA, 14 nt, Homo sapiens
ugugcugguguccu

SEQ ID NO: 777655 - RNA, 14 nt, Homo sapiens
ugugcuuguuuaca

SEQ ID NO: 777656 - RNA, 23 nt, Homo sapiens
ugugcuuuuuuguuuugugcuaa

SEQ ID NO: 777657 - RNA, 19 nt, Homo sapiens
uguggacuguggcacuugc

SEQ ID NO: 777658 - RNA, 20 nt, Homo sapiens
uguggagagagaggcuucaa

SEQ ID NO: 777659 - RNA, 19 nt, Homo sapiens
uguggagaucagaaaguga

SEQ ID NO: 777660 - RNA, 20 nt, Homo sapiens
uguggaggcuaucaacaaag

SEQ ID NO: 777661 - RNA, 17 nt, Homo sapiens
uguggaggggagauaua

SEQ ID NO: 777662 - RNA, 14 nt, Homo sapiens
uguggagugagaac

SEQ ID NO: 777663 - RNA, 21 nt, Homo sapiens
uguggaucaaccaucgcuuua

SEQ ID NO: 777664 - RNA, 16 nt, Homo sapiens
uguggauggucauugc

SEQ ID NO: 777665 - RNA, 20 nt, Homo sapiens
uguggcaaagccuucauugc

SEQ ID NO: 777666 - RNA, 13 nt, Homo sapiens
uguggcacacacc

SEQ ID NO: 777667 - RNA, 17 nt, Homo sapiens
uguggcaucuugccaag

SEQ ID NO: 777668 - RNA, 20 nt, Homo sapiens
uguggcauuuccaaacaucc

SEQ ID NO: 777669 - RNA, 17 nt, Homo sapiens
uguggccaacugcaaaa

SEQ ID NO: 777670 - RNA, 15 nt, Homo sapiens
uguggcccaagacaa

SEQ ID NO: 777671 - RNA, 16 nt, Homo sapiens
uguggccccaacacaa

SEQ ID NO: 777672 - RNA, 17 nt, Homo sapiens
uguggcccggagcgucu

SEQ ID NO: 777673 - RNA, 17 nt, Homo sapiens
uguggcugucaggacac

SEQ ID NO: 777674 - RNA, 13 nt, Homo sapiens
ugugggacugaga

SEQ ID NO: 777675 - RNA, 16 nt, Homo sapiens
ugugggagaccgagga

SEQ ID NO: 777676 - RNA, 18 nt, Homo sapiens
ugugggcgcauacuacag

SEQ ID NO: 777677 - RNA, 14 nt, Homo sapiens
ugugggcugugagu

SEQ ID NO: 777678 - RNA, 15 nt, Homo sapiens
ugugggucaaaccaa

SEQ ID NO: 777679 - RNA, 17 nt, Homo sapiens
ugugggucaaaccaaga

SEQ ID NO: 777680 - RNA, 15 nt, Homo sapiens
ugugggucucuggaa

SEQ ID NO: 777681 - RNA, 16 nt, Homo sapiens
ugugggugucagucag

SEQ ID NO: 777682 - RNA, 18 nt, Homo sapiens
ugugguacuggcaauaag

SEQ ID NO: 777683 - RNA, 13 nt, Homo sapiens
uguggucaauccg

SEQ ID NO: 777684 - RNA, 14 nt, Homo sapiens
uguggugaggggcu

SEQ ID NO: 777685 - RNA, 14 nt, Homo sapiens
ugugguuccucugc

SEQ ID NO: 777686 - RNA, 21 nt, Homo sapiens
ugugguugaaaaccacaguca

SEQ ID NO: 777687 - RNA, 19 nt, Homo sapiens
ugugguuguuagguucaca

SEQ ID NO: 777688 - RNA, 18 nt, Homo sapiens
uguguaauaagaaaguau

SEQ ID NO: 777689 - RNA, 16 nt, Homo sapiens
uguguaauuagugcca

SEQ ID NO: 777690 - RNA, 22 nt, Homo sapiens
uguguaauuuuuuuuccuugcc

SEQ ID NO: 777691 - RNA, 22 nt, Homo sapiens
uguguacaccugcggggccacc

SEQ ID NO: 777692 - RNA, 22 nt, Homo sapiens
uguguacucuuuauuucuagca

SEQ ID NO: 777693 - RNA, 15 nt, Homo sapiens
uguguacugauucaa

SEQ ID NO: 777694 - RNA, 16 nt, Homo sapiens
uguguaguaucuugaa

SEQ ID NO: 777695 - RNA, 12 nt, Homo sapiens
uguguagucaag

SEQ ID NO: 777696 - RNA, 19 nt, Homo sapiens
uguguauagcuuaccugaa

SEQ ID NO: 777697 - RNA, 23 nt, Homo sapiens
uguguauauaguaugaaugcagu

SEQ ID NO: 777698 - RNA, 14 nt, Homo sapiens
ugugucaaaacugg

SEQ ID NO: 777699 - RNA, 16 nt, Homo sapiens
ugugucaaaagccaga

SEQ ID NO: 777700 - RNA, 14 nt, Homo sapiens
ugugucaugccagu

SEQ ID NO: 777701 - RNA, 11 nt, Homo sapiens
uguguccaaaa

SEQ ID NO: 777702 - RNA, 18 nt, Homo sapiens
uguguccuaugcgcucau

SEQ ID NO: 777703 - RNA, 15 nt, Homo sapiens
uguguccucagggag

SEQ ID NO: 777704 - RNA, 21 nt, Homo sapiens
uguguccucuuccaccacaga

SEQ ID NO: 777705 - RNA, 16 nt, Homo sapiens
uguguccuugcauggc

SEQ ID NO: 777706 - RNA, 16 nt, Homo sapiens
ugugucuaagauucua

SEQ ID NO: 777707 - RNA, 23 nt, Homo sapiens
ugugucugggauaaccucggcug

SEQ ID NO: 777708 - RNA, 13 nt, Homo sapiens
ugugucuguacac

SEQ ID NO: 777709 - RNA, 16 nt, Homo sapiens
ugugugcaugugcugu

SEQ ID NO: 777710 - RNA, 19 nt, Homo sapiens
ugugugccuuuguuuccca

SEQ ID NO: 777711 - RNA, 16 nt, Homo sapiens
uguguggcagagccag

SEQ ID NO: 777712 - RNA, 18 nt, Homo sapiens
uguguguauguuugcaca

SEQ ID NO: 777713 - RNA, 19 nt, Homo sapiens
uguguguauguuugcacac

SEQ ID NO: 777714 - RNA, 12 nt, Homo sapiens
ugugugugauau

SEQ ID NO: 777715 - RNA, 13 nt, Homo sapiens
ugugugugcacau

SEQ ID NO: 777716 - RNA, 12 nt, Homo sapiens
ugugugugccuc

SEQ ID NO: 777717 - RNA, 12 nt, Homo sapiens
uguguguggcag

SEQ ID NO: 777718 - RNA, 13 nt, Homo sapiens
ugugugugucacc

SEQ ID NO: 777719 - RNA, 21 nt, Homo sapiens
uguguuacugcuuugcaaaga

SEQ ID NO: 777720 - RNA, 19 nt, Homo sapiens
uguguuauuuaaugaguca

SEQ ID NO: 777721 - RNA, 23 nt, Homo sapiens
uguguucacaaaggcagagaguc

SEQ ID NO: 777722 - RNA, 23 nt, Homo sapiens
uguguuccacggaaaaugcuauc

SEQ ID NO: 777723 - RNA, 22 nt, Homo sapiens
uugcaugauaucuucaagccug

SEQ ID NO: 777724 - RNA, 14 nt, Homo sapiens
uugcauuccagaau

SEQ ID NO: 777725 - RNA, 23 nt, Homo sapiens
uugcauugugacaagaauuguua

SEQ ID NO: 777726 - RNA, 11 nt, Homo sapiens
uugccaaaaac

SEQ ID NO: 777727 - RNA, 21 nt, Homo sapiens
uugccaaauugcugcauauuu

SEQ ID NO: 777728 - RNA, 22 nt, Homo sapiens
uugccaacauggugaaacucca

SEQ ID NO: 777729 - RNA, 18 nt, Homo sapiens
uugccaaggcaagaucua

SEQ ID NO: 777730 - RNA, 21 nt, Homo sapiens
uugccacagaugauacuucca

SEQ ID NO: 777731 - RNA, 12 nt, Homo sapiens
uugccacuuaac

SEQ ID NO: 777732 - RNA, 22 nt, Homo sapiens
uugccagcgauuuuaguucaau

SEQ ID NO: 777733 - RNA, 19 nt, Homo sapiens
uugccauuaaacuuaccug

SEQ ID NO: 777734 - RNA, 21 nt, Homo sapiens
uugccauuucucugcuuaccc

SEQ ID NO: 777735 - RNA, 19 nt, Homo sapiens
uugcccacuugauugagaa

SEQ ID NO: 777736 - RNA, 21 nt, Homo sapiens
uugcccaggcuggagugcaau

SEQ ID NO: 777737 - RNA, 17 nt, Homo sapiens
uugcccaguguucuccu

SEQ ID NO: 777738 - RNA, 19 nt, Homo sapiens
uugccccacccaacaagcc

SEQ ID NO: 777739 - RNA, 20 nt, Homo sapiens
uugccccugagacaaaugga

SEQ ID NO: 777740 - RNA, 17 nt, Homo sapiens
uugcccuucacaguguu

SEQ ID NO: 777741 - RNA, 23 nt, Homo sapiens
uugccuaaggugcguaguccaac

SEQ ID NO: 777742 - RNA, 21 nt, Homo sapiens
uugccuagacagcuuuucuca

SEQ ID NO: 777743 - RNA, 19 nt, Homo sapiens
uugccucaaugccaguaac

SEQ ID NO: 777744 - RNA, 13 nt, Homo sapiens
uugccucaccugc

SEQ ID NO: 777745 - RNA, 14 nt, Homo sapiens
uugccuccaggugc

SEQ ID NO: 777746 - RNA, 13 nt, Homo sapiens
uugccuccaugcc

SEQ ID NO: 777747 - RNA, 13 nt, Homo sapiens
uugccuccucacc

SEQ ID NO: 777748 - RNA, 17 nt, Homo sapiens
uugccuccucacccacc

SEQ ID NO: 777749 - RNA, 15 nt, Homo sapiens
uugccucugugcugu

SEQ ID NO: 777750 - RNA, 21 nt, Homo sapiens
uugccucuucuuugugccuuu

SEQ ID NO: 777751 - RNA, 13 nt, Homo sapiens
uugccugcaaaaa

SEQ ID NO: 777752 - RNA, 14 nt, Homo sapiens
uugccugcaaaaau

SEQ ID NO: 777753 - RNA, 13 nt, Homo sapiens
uugccugcagauu

SEQ ID NO: 777754 - RNA, 15 nt, Homo sapiens
uugccuucucugccc

SEQ ID NO: 777755 - RNA, 17 nt, Homo sapiens
uugcgauggcgugggcu

SEQ ID NO: 777756 - RNA, 13 nt, Homo sapiens
uugcguacacaga

SEQ ID NO: 777757 - RNA, 17 nt, Homo sapiens
uugcguggacucugcac

SEQ ID NO: 777758 - RNA, 14 nt, Homo sapiens
uugcuaaagcacuu

SEQ ID NO: 777759 - RNA, 16 nt, Homo sapiens
uugcuaagugugcuua

SEQ ID NO: 777760 - RNA, 17 nt, Homo sapiens
uugcuaagugugcuuag

SEQ ID NO: 777761 - RNA, 15 nt, Homo sapiens
uugcuaaugcaauua

SEQ ID NO: 777762 - RNA, 14 nt, Homo sapiens
uugcuacauucuaa

SEQ ID NO: 777763 - RNA, 13 nt, Homo sapiens
uugcuaccaguau

SEQ ID NO: 777764 - RNA, 11 nt, Homo sapiens
uugcuacugac

SEQ ID NO: 777765 - RNA, 18 nt, Homo sapiens
uugcuauaauaaagaagu

SEQ ID NO: 777766 - RNA, 14 nt, Homo sapiens
uugcucaaagggaa

SEQ ID NO: 777767 - RNA, 20 nt, Homo sapiens
uugcucaacagaacauaugu

SEQ ID NO: 777768 - RNA, 17 nt, Homo sapiens
uugcucacaguuauuac

SEQ ID NO: 777769 - RNA, 20 nt, Homo sapiens
uugcuccagauucugaugca

SEQ ID NO: 777770 - RNA, 19 nt, Homo sapiens
uugcucuacaaugacacac

SEQ ID NO: 777771 - RNA, 12 nt, Homo sapiens
uugcucugccac

SEQ ID NO: 777772 - RNA, 19 nt, Homo sapiens
uugcucuucagaugccacu

SEQ ID NO: 777773 - RNA, 17 nt, Homo sapiens
uugcucuugccaaaaaa

SEQ ID NO: 777774 - RNA, 23 nt, Homo sapiens
uugcugacaaccauuaaagucag

SEQ ID NO: 777775 - RNA, 22 nt, Homo sapiens
uugcugaguccaacaauguugu

SEQ ID NO: 777776 - RNA, 12 nt, Homo sapiens
uugcugccacau

SEQ ID NO: 777777 - RNA, 14 nt, Homo sapiens
uugcuggacuguca

SEQ ID NO: 777778 - RNA, 16 nt, Homo sapiens
uugcuggucuagucac

SEQ ID NO: 777779 - RNA, 23 nt, Homo sapiens
uugcuguagaaacacauaacaaa

SEQ ID NO: 777780 - RNA, 21 nt, Homo sapiens
uugcugucauaagaaugaaua

SEQ ID NO: 777781 - RNA, 14 nt, Homo sapiens
uugcuguccucuca

SEQ ID NO: 777782 - RNA, 20 nt, Homo sapiens
uugcugucuucagucucaca

SEQ ID NO: 777783 - RNA, 18 nt, Homo sapiens
uugcuuaaaauagacucc

SEQ ID NO: 777784 - RNA, 17 nt, Homo sapiens
uugcuuacuuuggaaua

SEQ ID NO: 777785 - RNA, 13 nt, Homo sapiens
uugcuugagcuca

SEQ ID NO: 777786 - RNA, 13 nt, Homo sapiens
uugcuugcaaugu

SEQ ID NO: 777787 - RNA, 12 nt, Homo sapiens
uugcuugcugaa

SEQ ID NO: 777788 - RNA, 14 nt, Homo sapiens
uugcuuuaaaguac

SEQ ID NO: 777789 - RNA, 20 nt, Homo sapiens
uugcuuuagguaucacugga

SEQ ID NO: 777790 - RNA, 18 nt, Homo sapiens
uuggaaaccacagucagu

SEQ ID NO: 777791 - RNA, 20 nt, Homo sapiens
uuggaagacuuaauucugau

SEQ ID NO: 777792 - RNA, 18 nt, Homo sapiens
uuggaaguguucccugag

SEQ ID NO: 777793 - RNA, 21 nt, Homo sapiens
uuggacaaguccuugaccucu

SEQ ID NO: 777794 - RNA, 11 nt, Homo sapiens
uuggacacuug

SEQ ID NO: 777795 - RNA, 13 nt, Homo sapiens
uuggacagcugcu

SEQ ID NO: 777796 - RNA, 16 nt, Homo sapiens
uuggacggaauggagg

SEQ ID NO: 777797 - RNA, 23 nt, Homo sapiens
uuggacuaugauuaucuacagaa

SEQ ID NO: 777798 - RNA, 18 nt, Homo sapiens
uuggacuguaagggauug

SEQ ID NO: 777799 - RNA, 13 nt, Homo sapiens
uuggacugucuau

SEQ ID NO: 777800 - RNA, 12 nt, Homo sapiens
uuggagcacucu

SEQ ID NO: 777801 - RNA, 18 nt, Homo sapiens
uuggagcucuauccauau

SEQ ID NO: 777802 - RNA, 20 nt, Homo sapiens
uuggagggguauuuuugccc

SEQ ID NO: 777803 - RNA, 23 nt, Homo sapiens
uuggaggugggagcuucccacac

SEQ ID NO: 777804 - RNA, 13 nt, Homo sapiens
uuggagugcagug

SEQ ID NO: 777805 - RNA, 21 nt, Homo sapiens
uuggauaaaauaaaugcaauu

SEQ ID NO: 777806 - RNA, 20 nt, Homo sapiens
uuggauaucaaaagcaaaua

SEQ ID NO: 777807 - RNA, 16 nt, Homo sapiens
uuggaugcagcuucaa

SEQ ID NO: 777808 - RNA, 19 nt, Homo sapiens
uuggaugcggccauucaag

SEQ ID NO: 777809 - RNA, 16 nt, Homo sapiens
uuggauucucugagaa

SEQ ID NO: 777810 - RNA, 13 nt, Homo sapiens
uuggcaccagaca

SEQ ID NO: 777811 - RNA, 13 nt, Homo sapiens
uuggcaccuguag

SEQ ID NO: 777812 - RNA, 16 nt, Homo sapiens
uuggcauccugugcuu

SEQ ID NO: 777813 - RNA, 12 nt, Homo sapiens
uuggcaugccuu

SEQ ID NO: 777814 - RNA, 15 nt, Homo sapiens
uuggcaugccuucca

SEQ ID NO: 777815 - RNA, 22 nt, Homo sapiens
uuggcauuggaauucuacugga

SEQ ID NO: 777816 - RNA, 16 nt, Homo sapiens
uuggccauguucucca

SEQ ID NO: 777817 - RNA, 16 nt, Homo sapiens
uuggcccucacugcag

SEQ ID NO: 777818 - RNA, 16 nt, Homo sapiens
uuggccgugaggacac

SEQ ID NO: 777819 - RNA, 17 nt, Homo sapiens
uuggccugacucaggaa

SEQ ID NO: 777820 - RNA, 17 nt, Homo sapiens
uuggcguuuggacccag

SEQ ID NO: 777821 - RNA, 22 nt, Homo sapiens
uuggcuacacacaaaccaguau

SEQ ID NO: 777822 - RNA, 12 nt, Homo sapiens
uuggcuauugaa

SEQ ID NO: 777823 - RNA, 16 nt, Homo sapiens
uuggcucacacugaga

SEQ ID NO: 777824 - RNA, 22 nt, Homo sapiens
uuggcucugcuuuuaacuuuau

SEQ ID NO: 777825 - RNA, 16 nt, Homo sapiens
uuggcugaacuacaag

SEQ ID NO: 777826 - RNA, 21 nt, Homo sapiens
uuggcugaauagcacagguga

SEQ ID NO: 777827 - RNA, 13 nt, Homo sapiens
uuggcugcuggag

SEQ ID NO: 777828 - RNA, 15 nt, Homo sapiens
uuggcugugugacag

SEQ ID NO: 777829 - RNA, 14 nt, Homo sapiens
uuggcuucccaaag

SEQ ID NO: 777830 - RNA, 13 nt, Homo sapiens
uuggcuucccuga

SEQ ID NO: 777831 - RNA, 24 nt, Homo sapiens
uuggcuucugugaugagcugaucu

SEQ ID NO: 777832 - RNA, 21 nt, Homo sapiens
uuggcuuuaugcaaauacaau

SEQ ID NO: 777833 - RNA, 21 nt, Homo sapiens
uugggaaaauacguugaggga

SEQ ID NO: 777834 - RNA, 13 nt, Homo sapiens
uugggaagaccag

SEQ ID NO: 777835 - RNA, 17 nt, Homo sapiens
uugggaagggcagggaa

SEQ ID NO: 777836 - RNA, 12 nt, Homo sapiens
uugggaggugua

SEQ ID NO: 777837 - RNA, 20 nt, Homo sapiens
uugggauuuugguuucuucc

SEQ ID NO: 777838 - RNA, 13 nt, Homo sapiens
uuugcauugucua

SEQ ID NO: 777839 - RNA, 19 nt, Homo sapiens
uuugcauuucagaauauua

SEQ ID NO: 777840 - RNA, 17 nt, Homo sapiens
uuugccaaaauucauuu

SEQ ID NO: 777841 - RNA, 13 nt, Homo sapiens
uuugccagugccu

SEQ ID NO: 777842 - RNA, 22 nt, Homo sapiens
uuugcccugcccucucccaaaa

SEQ ID NO: 777843 - RNA, 14 nt, Homo sapiens
uuugccuucugcac

SEQ ID NO: 777844 - RNA, 15 nt, Homo sapiens
uuugccuucugcaca

SEQ ID NO: 777845 - RNA, 16 nt, Homo sapiens
uuugccuucugcacau

SEQ ID NO: 777846 - RNA, 16 nt, Homo sapiens
uuugcgcugcuaagaa

SEQ ID NO: 777847 - RNA, 14 nt, Homo sapiens
uuugcuaacugguu

SEQ ID NO: 777848 - RNA, 12 nt, Homo sapiens
uuugcuacaaau

SEQ ID NO: 777849 - RNA, 20 nt, Homo sapiens
uuugcuccgcucccaccgcc

SEQ ID NO: 777850 - RNA, 14 nt, Homo sapiens
uuugcucucuggcc

SEQ ID NO: 777851 - RNA, 16 nt, Homo sapiens
uuugcuguacucuugc

SEQ ID NO: 777852 - RNA, 18 nt, Homo sapiens
uuugcuguauacuuuuaa

SEQ ID NO: 777853 - RNA, 17 nt, Homo sapiens
uuugcuuaguauuguga

SEQ ID NO: 777854 - RNA, 16 nt, Homo sapiens
uuugcuugcaauguag

SEQ ID NO: 777855 - RNA, 22 nt, Homo sapiens
uuugcuuuccucugagauucua

SEQ ID NO: 777856 - RNA, 21 nt, Homo sapiens
uuuggaaguguucccugagaa

SEQ ID NO: 777857 - RNA, 15 nt, Homo sapiens
uuuggaaguuuugcu

SEQ ID NO: 777858 - RNA, 22 nt, Homo sapiens
uuuggaaucuucucuuugacaa

SEQ ID NO: 777859 - RNA, 21 nt, Homo sapiens
uuuggauaucaaaagcaaaua

SEQ ID NO: 777860 - RNA, 16 nt, Homo sapiens
uuuggaugucuuugcu

SEQ ID NO: 777861 - RNA, 22 nt, Homo sapiens
uuuggauucuaaauacaugcca

SEQ ID NO: 777862 - RNA, 20 nt, Homo sapiens
uuuggcaggcuuuuuuccag

SEQ ID NO: 777863 - RNA, 13 nt, Homo sapiens
uuugggaugacca

SEQ ID NO: 777864 - RNA, 14 nt, Homo sapiens
uuugggcagugcca

SEQ ID NO: 777865 - RNA, 12 nt, Homo sapiens
uuugggcugugg

SEQ ID NO: 777866 - RNA, 16 nt, Homo sapiens
uuuggggaggggggua

SEQ ID NO: 777867 - RNA, 11 nt, Homo sapiens
uuuggggcuca

SEQ ID NO: 777868 - RNA, 11 nt, Homo sapiens
uuugggguccu

SEQ ID NO: 777869 - RNA, 23 nt, Homo sapiens
uuuggguaaaaucuguaauugau

SEQ ID NO: 777870 - RNA, 19 nt, Homo sapiens
uuugguagaugcaugacuu

SEQ ID NO: 777871 - RNA, 23 nt, Homo sapiens
uuugguaguggaauagugaauac

SEQ ID NO: 777872 - RNA, 15 nt, Homo sapiens
uuugguaugugcuag

SEQ ID NO: 777873 - RNA, 14 nt, Homo sapiens
uuuggucacacucu

SEQ ID NO: 777874 - RNA, 15 nt, Homo sapiens
uuuggucacauauca

SEQ ID NO: 777875 - RNA, 20 nt, Homo sapiens
uuuggucuguuuugccuuca

SEQ ID NO: 777876 - RNA, 13 nt, Homo sapiens
uuuggugaacugu

SEQ ID NO: 777877 - RNA, 22 nt, Homo sapiens
uuuggugacuguguaacuuucu

SEQ ID NO: 777878 - RNA, 20 nt, Homo sapiens
uuuggugagagaaguacaaa

SEQ ID NO: 777879 - RNA, 18 nt, Homo sapiens
uuugguguuacacagccc

SEQ ID NO: 777880 - RNA, 18 nt, Homo sapiens
uuugguucucuccaggaa

SEQ ID NO: 777881 - RNA, 19 nt, Homo sapiens
uuugguucucuccaggaag

SEQ ID NO: 777882 - RNA, 21 nt, Homo sapiens
uuugguuggcagcauuccaug

SEQ ID NO: 777883 - RNA, 16 nt, Homo sapiens
uuugguuucuucauuc

SEQ ID NO: 777884 - RNA, 21 nt, Homo sapiens
uuugguuuguuuccagguuug

SEQ ID NO: 777885 - RNA, 19 nt, Homo sapiens
uuuguaaaaauguccccac

SEQ ID NO: 777886 - RNA, 21 nt, Homo sapiens
uuuguaaaacaaugccaugaa

SEQ ID NO: 777887 - RNA, 20 nt, Homo sapiens
uuuguaaauuaauacuucau

SEQ ID NO: 777888 - RNA, 17 nt, Homo sapiens
uuuguaagacuuacaaa

SEQ ID NO: 777889 - RNA, 15 nt, Homo sapiens
uuuguaagaugcugg

SEQ ID NO: 777890 - RNA, 18 nt, Homo sapiens
uuuguaauauuuuccaua

SEQ ID NO: 777891 - RNA, 16 nt, Homo sapiens
uuuguaaugcugcaca

SEQ ID NO: 777892 - RNA, 20 nt, Homo sapiens
uuuguaaugcugcacagaaa

SEQ ID NO: 777893 - RNA, 22 nt, Homo sapiens
uuuguaaugggaacugccucuu

SEQ ID NO: 777894 - RNA, 18 nt, Homo sapiens
uuuguagagacaggguuu

SEQ ID NO: 777895 - RNA, 17 nt, Homo sapiens
uuuguagccuuccucca

SEQ ID NO: 777896 - RNA, 20 nt, Homo sapiens
uuuguaggagacuugccaga

SEQ ID NO: 777897 - RNA, 21 nt, Homo sapiens
uuuguagguaauguuccugaa

SEQ ID NO: 777898 - RNA, 17 nt, Homo sapiens
uuuguauaaaaguguga

SEQ ID NO: 777899 - RNA, 14 nt, Homo sapiens
uuuguauauacuuu

SEQ ID NO: 777900 - RNA, 19 nt, Homo sapiens
uuuguauuaauaaagcauu

SEQ ID NO: 777901 - RNA, 16 nt, Homo sapiens
uuuguauuuauuucca

SEQ ID NO: 777902 - RNA, 23 nt, Homo sapiens
uuuguauuuauuuccagaccaau

SEQ ID NO: 777903 - RNA, 22 nt, Homo sapiens
uuuguauuuuaagauccagaaa

SEQ ID NO: 777904 - RNA, 23 nt, Homo sapiens
uuugucagaggcacaaaaggguu

SEQ ID NO: 777905 - RNA, 22 nt, Homo sapiens
uuuguccaucuugagaugguga

SEQ ID NO: 777906 - RNA, 20 nt, Homo sapiens
uuuguccuggucaugcacau

SEQ ID NO: 777907 - RNA, 22 nt, Homo sapiens
uuugucucuuagaaauacuugu

SEQ ID NO: 777908 - RNA, 23 nt, Homo sapiens
uuugucugagacagaaucucagu

SEQ ID NO: 777909 - RNA, 14 nt, Homo sapiens
uuugucugcuagua

SEQ ID NO: 777910 - RNA, 19 nt, Homo sapiens
uuugucuuaaguguuucuc

SEQ ID NO: 777911 - RNA, 12 nt, Homo sapiens
uuugugaacugg

SEQ ID NO: 777912 - RNA, 18 nt, Homo sapiens
uuugugaaguauucacaa

SEQ ID NO: 777913 - RNA, 15 nt, Homo sapiens
uuugugcagcacagu

SEQ ID NO: 777914 - RNA, 23 nt, Homo sapiens
uuugugccagaggaauccuggca

SEQ ID NO: 777915 - RNA, 19 nt, Homo sapiens
uuugugcuugucauuccag

SEQ ID NO: 777916 - RNA, 13 nt, Homo sapiens
uuuguggccucag

SEQ ID NO: 777917 - RNA, 22 nt, Homo sapiens
uuuguggccuuggcugacauga

SEQ ID NO: 777918 - RNA, 22 nt, Homo sapiens
uuugugugaucauacaguuaug

SEQ ID NO: 777919 - RNA, 13 nt, Homo sapiens
uuugugugauuga

SEQ ID NO: 777920 - RNA, 15 nt, Homo sapiens
uuugugugugugaua

SEQ ID NO: 777921 - RNA, 14 nt, Homo sapiens
uuuguuagcaaaga

SEQ ID NO: 777922 - RNA, 15 nt, Homo sapiens
uuuguugagcaugac

SEQ ID NO: 777923 - RNA, 12 nt, Homo sapiens
uuuguugcucag

SEQ ID NO: 777924 - RNA, 12 nt, Homo sapiens
uuuguuguaaaa

SEQ ID NO: 777925 - RNA, 24 nt, Homo sapiens
uuuguuuaaacccaagugcugcac

SEQ ID NO: 777926 - RNA, 21 nt, Homo sapiens
uuuguuucagguucaguauua

SEQ ID NO: 777927 - RNA, 17 nt, Homo sapiens
uuuguuugccaggacau

SEQ ID NO: 777928 - RNA, 21 nt, Homo sapiens
uuuguuuuaauaaacaguaua

SEQ ID NO: 777929 - RNA, 18 nt, Homo sapiens
uuuguuuucagcacugau

SEQ ID NO: 777930 - RNA, 16 nt, Homo sapiens
uuuguuuuuacaaaau

SEQ ID NO: 777931 - RNA, 22 nt, Homo sapiens
uuuuaaaaaacucuuuggugca

SEQ ID NO: 777932 - RNA, 23 nt, Homo sapiens
uuuuaaaaacuccuuuugguuua

SEQ ID NO: 777933 - RNA, 12 nt, Homo sapiens
uuuuaaaacaca

SEQ ID NO: 777934 - RNA, 17 nt, Homo sapiens
uuuuaaaacccauuuaa

SEQ ID NO: 777935 - RNA, 18 nt, Homo sapiens
uuuuaaaagccuuggccu

SEQ ID NO: 777936 - RNA, 16 nt, Homo sapiens
uuuuaaauaauugcau

SEQ ID NO: 777937 - RNA, 22 nt, Homo sapiens
uuuuaaauuaaugaacauaugu

SEQ ID NO: 777938 - RNA, 14 nt, Homo sapiens
uuuuaaauucuuac

SEQ ID NO: 777939 - RNA, 18 nt, Homo sapiens
uuuuaaauuuuaugucau

SEQ ID NO: 777940 - RNA, 19 nt, Homo sapiens
uuuuaacaacugugcuuuu

SEQ ID NO: 777941 - RNA, 15 nt, Homo sapiens
uuuuaacauuccuca

SEQ ID NO: 777942 - RNA, 23 nt, Homo sapiens
uuuuaaccucuagagucacugau

SEQ ID NO: 777943 - RNA, 18 nt, Homo sapiens
uuuuaaggguacaguuug

SEQ ID NO: 777944 - RNA, 21 nt, Homo sapiens
uuuuaauaacuuaucuauaaa

SEQ ID NO: 777945 - RNA, 15 nt, Homo sapiens
uuuuaauagcacuaa

SEQ ID NO: 777946 - RNA, 20 nt, Homo sapiens
uuuuaaugaaacuucaaaua

SEQ ID NO: 777947 - RNA, 12 nt, Homo sapiens
uuuuaaugggau

SEQ ID NO: 777948 - RNA, 15 nt, Homo sapiens
uuuuaauuuacuugu

SEQ ID NO: 777949 - RNA, 17 nt, Homo sapiens
uuuuacagugcuauuua

SEQ ID NO: 777950 - RNA, 20 nt, Homo sapiens
uuuuacaucaaaaucuggca

SEQ ID NO: 777951 - RNA, 12 nt, Homo sapiens
uuuuacauuuca

SEQ ID NO: 777952 - RNA, 12 nt, Homo sapiens
gaacauguaagg

SEQ ID NO: 777953 - RNA, 18 nt, Homo sapiens
gaaccaaaagagaucaca

SEQ ID NO: 777954 - RNA, 21 nt, Homo sapiens
gaaccaaaucuggaagccaaa

SEQ ID NO: 777955 - RNA, 18 nt, Homo sapiens
gaaccaaggcagccucca

SEQ ID NO: 777956 - RNA, 21 nt, Homo sapiens
gaaccaaggcagccuccagag

SEQ ID NO: 777957 - RNA, 14 nt, Homo sapiens
gaaccaccccggcc

SEQ ID NO: 777958 - RNA, 16 nt, Homo sapiens
gaaccacgucugcuaa

SEQ ID NO: 777959 - RNA, 20 nt, Homo sapiens
gaaccacucauugucuuuga

SEQ ID NO: 777960 - RNA, 12 nt, Homo sapiens
gaaccacuccca

SEQ ID NO: 777961 - RNA, 16 nt, Homo sapiens
gaaccaggaaauggaa

SEQ ID NO: 777962 - RNA, 22 nt, Homo sapiens
gaacccaugucagucucucacc

SEQ ID NO: 777963 - RNA, 15 nt, Homo sapiens
gaacccuuguccucc

SEQ ID NO: 777964 - RNA, 22 nt, Homo sapiens
gaacccuuucgcuggcuuucca

SEQ ID NO: 777965 - RNA, 21 nt, Homo sapiens
gaaccgagcaauuuucugcua

SEQ ID NO: 777966 - RNA, 24 nt, Homo sapiens
gaaccuaacaugcuggugaauauu

SEQ ID NO: 777967 - RNA, 18 nt, Homo sapiens
gaaccucauugcuaccac

SEQ ID NO: 777968 - RNA, 22 nt, Homo sapiens
gaaccucucguaguccaucacc

SEQ ID NO: 777969 - RNA, 15 nt, Homo sapiens
gaaccuggaacuugg

SEQ ID NO: 777970 - RNA, 15 nt, Homo sapiens
gaacgcagaagaaag

SEQ ID NO: 777971 - RNA, 23 nt, Homo sapiens
gaacguggggugagggaucacug

SEQ ID NO: 777972 - RNA, 13 nt, Homo sapiens
gaacuaacaugca

SEQ ID NO: 777973 - RNA, 14 nt, Homo sapiens
gaacuaaugaggau

SEQ ID NO: 777974 - RNA, 21 nt, Homo sapiens
gaacuacaaagcuucuauccc

SEQ ID NO: 777975 - RNA, 19 nt, Homo sapiens
gaacuacuuuuggugcuua

SEQ ID NO: 777976 - RNA, 16 nt, Homo sapiens
gaacuaugaacuacaa

SEQ ID NO: 777977 - RNA, 20 nt, Homo sapiens
gaacuauuucuacacagugg

SEQ ID NO: 777978 - RNA, 20 nt, Homo sapiens
gaacuauuuucaaagacuua

SEQ ID NO: 777979 - RNA, 21 nt, Homo sapiens
gaacucaaacgaugugcaaua

SEQ ID NO: 777980 - RNA, 19 nt, Homo sapiens
gaacucagcugaggccuug

SEQ ID NO: 777981 - RNA, 23 nt, Homo sapiens
gaacucauucucuucuugcuaua

SEQ ID NO: 777982 - RNA, 22 nt, Homo sapiens
gaacuccacaugcuggugcaua

SEQ ID NO: 777983 - RNA, 18 nt, Homo sapiens
gaacucuacuucagucaa

SEQ ID NO: 777984 - RNA, 14 nt, Homo sapiens
gaacucucuccacc

SEQ ID NO: 777985 - RNA, 22 nt, Homo sapiens
gaacucuggggagccugagcca

SEQ ID NO: 777986 - RNA, 21 nt, Homo sapiens
gaacucugugcaggugcugcc

SEQ ID NO: 777987 - RNA, 22 nt, Homo sapiens
gaacugaauaaacaggaaaaug

SEQ ID NO: 777988 - RNA, 19 nt, Homo sapiens
gaacugaggagcggacuca

SEQ ID NO: 777989 - RNA, 23 nt, Homo sapiens
gaacugaggccuugugugucagg

SEQ ID NO: 777990 - RNA, 17 nt, Homo sapiens
gaacugcacgguacaaa

SEQ ID NO: 777991 - RNA, 16 nt, Homo sapiens
gaacugcacugcuguu

SEQ ID NO: 777992 - RNA, 17 nt, Homo sapiens
gaacugcauauguuucg

SEQ ID NO: 777993 - RNA, 19 nt, Homo sapiens
gaacuggaggaguuccuug

SEQ ID NO: 777994 - RNA, 16 nt, Homo sapiens
gaacuggauucuuaac

SEQ ID NO: 777995 - RNA, 16 nt, Homo sapiens
gaacuggcaauugucu

SEQ ID NO: 777996 - RNA, 17 nt, Homo sapiens
gaacuguguacgccauu

SEQ ID NO: 777997 - RNA, 18 nt, Homo sapiens
gaacuguuggagcccgaa

SEQ ID NO: 777998 - RNA, 17 nt, Homo sapiens
gaacuuaaccuugcaaa

SEQ ID NO: 777999 - RNA, 17 nt, Homo sapiens
gaacuugaauuucugga

SEQ ID NO: 778000 - RNA, 11 nt, Homo sapiens
gaacuugcaau

SEQ ID NO: 778001 - RNA, 20 nt, Homo sapiens
gaacuugcaauaccaauguu

SEQ ID NO: 778002 - RNA, 14 nt, Homo sapiens
gaacuuuuguacug

SEQ ID NO: 778003 - RNA, 20 nt, Homo sapiens
gaacuuuuuuagaaaugcaa

SEQ ID NO: 778004 - RNA, 22 nt, Homo sapiens
gaagaaaacaguacagaaggca

SEQ ID NO: 778005 - RNA, 14 nt, Homo sapiens
gaagaaacuuugcc

SEQ ID NO: 778006 - RNA, 20 nt, Homo sapiens
gaagaaagagcaacaaucca

SEQ ID NO: 778007 - RNA, 19 nt, Homo sapiens
gaagaaaucuuucucccuc

SEQ ID NO: 778008 - RNA, 15 nt, Homo sapiens
gaagaaauucuguca

SEQ ID NO: 778009 - RNA, 22 nt, Homo sapiens
gaagaacacagcaugugccaag

SEQ ID NO: 778010 - RNA, 13 nt, Homo sapiens
gaagaacaggccu

SEQ ID NO: 778011 - RNA, 13 nt, Homo sapiens
gaagaacaguaac

SEQ ID NO: 778012 - RNA, 20 nt, Homo sapiens
gaagaacaguaacugccauc

SEQ ID NO: 778013 - RNA, 13 nt, Homo sapiens
gaagaacauagaa

SEQ ID NO: 778014 - RNA, 20 nt, Homo sapiens
gaagaacggggcucuucuca

SEQ ID NO: 778015 - RNA, 13 nt, Homo sapiens
gaagaagcuacug

SEQ ID NO: 778016 - RNA, 21 nt, Homo sapiens
gaagaagucuaagagugaagu

SEQ ID NO: 778017 - RNA, 23 nt, Homo sapiens
gaagaauaggcggggcacggugg

SEQ ID NO: 778018 - RNA, 15 nt, Homo sapiens
gaagaaucuaaugaa

SEQ ID NO: 778019 - RNA, 16 nt, Homo sapiens
gaagaauggcuuucaa

SEQ ID NO: 778020 - RNA, 16 nt, Homo sapiens
gaagaauucuguuuag

SEQ ID NO: 778021 - RNA, 17 nt, Homo sapiens
gaagaauuggccaucuu

SEQ ID NO: 778022 - RNA, 16 nt, Homo sapiens
gaagacaucaggaaac

SEQ ID NO: 778023 - RNA, 16 nt, Homo sapiens
gaagacauccugagca

SEQ ID NO: 778024 - RNA, 17 nt, Homo sapiens
gaagaccagcuuugcag

SEQ ID NO: 778025 - RNA, 21 nt, Homo sapiens
gaagaccaguccuguuugcag

SEQ ID NO: 778026 - RNA, 13 nt, Homo sapiens
gaagaccuggacc

SEQ ID NO: 778027 - RNA, 17 nt, Homo sapiens
gaagaccuguuauguag

SEQ ID NO: 778028 - RNA, 18 nt, Homo sapiens
gaagacgaagaagcaagg

SEQ ID NO: 778029 - RNA, 18 nt, Homo sapiens
gaagacguggacuccucu

SEQ ID NO: 778030 - RNA, 21 nt, Homo sapiens
gaagacuauggugcugccuug

SEQ ID NO: 778031 - RNA, 16 nt, Homo sapiens
gaagacucaguaugcu

SEQ ID NO: 778032 - RNA, 18 nt, Homo sapiens
gaagacuugaagcacaga

SEQ ID NO: 778033 - RNA, 17 nt, Homo sapiens
gaagagaaagcacgugu

SEQ ID NO: 778034 - RNA, 17 nt, Homo sapiens
gaagagaaaggacucag

SEQ ID NO: 778035 - RNA, 14 nt, Homo sapiens
gaagagaccaagac

SEQ ID NO: 778036 - RNA, 23 nt, Homo sapiens
gaagagcccgcagggccaugcag

SEQ ID NO: 778037 - RNA, 17 nt, Homo sapiens
gaagagccuuucuucca

SEQ ID NO: 778038 - RNA, 19 nt, Homo sapiens
gaagagcguagacaggugu

SEQ ID NO: 778039 - RNA, 17 nt, Homo sapiens
gaagagcuuauuacuua

SEQ ID NO: 778040 - RNA, 18 nt, Homo sapiens
gaagagguauuacugaca

SEQ ID NO: 778041 - RNA, 20 nt, Homo sapiens
gaagauaacuugagcaccgu

SEQ ID NO: 778042 - RNA, 16 nt, Homo sapiens
gaagaugggguuugua

SEQ ID NO: 778043 - RNA, 18 nt, Homo sapiens
gaagauuaguuaccauug

SEQ ID NO: 778044 - RNA, 18 nt, Homo sapiens
gaagauucuccugugcua

SEQ ID NO: 778045 - RNA, 17 nt, Homo sapiens
gaagauuuaugaugcac

SEQ ID NO: 778046 - RNA, 14 nt, Homo sapiens
gaagauuucagagg

SEQ ID NO: 778047 - RNA, 17 nt, Homo sapiens
gaagcaacuaggaaaau

SEQ ID NO: 778048 - RNA, 18 nt, Homo sapiens
gaagcacagcuccugcca

SEQ ID NO: 778049 - RNA, 16 nt, Homo sapiens
gaagcagaaauguacu

SEQ ID NO: 778050 - RNA, 15 nt, Homo sapiens
gaagcagcacuguga

SEQ ID NO: 778051 - RNA, 22 nt, Homo sapiens
gaagcaggugcuacaacaugug

SEQ ID NO: 778052 - RNA, 14 nt, Homo sapiens
gaagcauacaaagc

SEQ ID NO: 778053 - RNA, 20 nt, Homo sapiens
gaagcauugccuggacugac

SEQ ID NO: 778054 - RNA, 22 nt, Homo sapiens
gaagcauugccuggacugacca

SEQ ID NO: 778055 - RNA, 23 nt, Homo sapiens
gaagcauugccuggacugaccac

SEQ ID NO: 778056 - RNA, 22 nt, Homo sapiens
gaagccaaaguuuucaaacugc

SEQ ID NO: 778057 - RNA, 15 nt, Homo sapiens
gaagccaccuuccca

SEQ ID NO: 778058 - RNA, 16 nt, Homo sapiens
gaagccacuuucuaca

SEQ ID NO: 778059 - RNA, 18 nt, Homo sapiens
gaagcccccagcccuaau

SEQ ID NO: 778060 - RNA, 19 nt, Homo sapiens
gaagcccugauguguccuc

SEQ ID NO: 778061 - RNA, 16 nt, Homo sapiens
gaagccucuggcuaga

SEQ ID NO: 778062 - RNA, 19 nt, Homo sapiens
gaagccuggacucuaagcu

SEQ ID NO: 778063 - RNA, 23 nt, Homo sapiens
gaagccuuagccaggaggccagg

SEQ ID NO: 778064 - RNA, 13 nt, Homo sapiens
gaagccuugccua

SEQ ID NO: 778065 - RNA, 17 nt, Homo sapiens
gaagcggagagagccaa

SEQ ID NO: 778066 - RNA, 15 nt, Homo sapiens
uuuuaagcugcaaau

SEQ ID NO: 778067 - RNA, 15 nt, Homo sapiens
uuuuaaggauguugc

SEQ ID NO: 778068 - RNA, 20 nt, Homo sapiens
uuuuaaggcuaaaacuuaac

SEQ ID NO: 778069 - RNA, 15 nt, Homo sapiens
uuuuaagugccuuua

SEQ ID NO: 778070 - RNA, 14 nt, Homo sapiens
uuuuaaguugucaa

SEQ ID NO: 778071 - RNA, 16 nt, Homo sapiens
uuuuaauaacauaucu

SEQ ID NO: 778072 - RNA, 14 nt, Homo sapiens
uuuuaauaugacaa

SEQ ID NO: 778073 - RNA, 12 nt, Homo sapiens
uuuuaauggugu

SEQ ID NO: 778074 - RNA, 20 nt, Homo sapiens
uuuuaauuaaugaaauaucu

SEQ ID NO: 778075 - RNA, 18 nt, Homo sapiens
uuuuaauuaugggaauaa

SEQ ID NO: 778076 - RNA, 12 nt, Homo sapiens
uuuuaauugauu

SEQ ID NO: 778077 - RNA, 21 nt, Homo sapiens
uuuuaauuuaaacaccuccuc

SEQ ID NO: 778078 - RNA, 22 nt, Homo sapiens
uuuuacagagaggauacauuua

SEQ ID NO: 778079 - RNA, 16 nt, Homo sapiens
uuuuacauacugcugu

SEQ ID NO: 778080 - RNA, 17 nt, Homo sapiens
uuuuacauguggcccaa

SEQ ID NO: 778081 - RNA, 22 nt, Homo sapiens
uuuuaccaaagcaucaauacaa

SEQ ID NO: 778082 - RNA, 22 nt, Homo sapiens
uuuuaccaccgucugucucaga

SEQ ID NO: 778083 - RNA, 15 nt, Homo sapiens
uuuuaccuaaucucc

SEQ ID NO: 778084 - RNA, 16 nt, Homo sapiens
uuuuacucugccuaca

SEQ ID NO: 778085 - RNA, 17 nt, Homo sapiens
uuuuacucuuaugauca

SEQ ID NO: 778086 - RNA, 18 nt, Homo sapiens
uuuuacucuuaugaucaa

SEQ ID NO: 778087 - RNA, 17 nt, Homo sapiens
uuuuacugcucugagaa

SEQ ID NO: 778088 - RNA, 21 nt, Homo sapiens
uuuuacuuuuuuuuaugauca

SEQ ID NO: 778089 - RNA, 13 nt, Homo sapiens
uuuuagacuuccu

SEQ ID NO: 778090 - RNA, 16 nt, Homo sapiens
uuuuagagcuuccaaa

SEQ ID NO: 778091 - RNA, 22 nt, Homo sapiens
uuuuagauuauuccaagccuua

SEQ ID NO: 778092 - RNA, 12 nt, Homo sapiens
uuuuagcccagu

SEQ ID NO: 778093 - RNA, 11 nt, Homo sapiens
uuuuagcucau

SEQ ID NO: 778094 - RNA, 12 nt, Homo sapiens
uuuuagcuguga

SEQ ID NO: 778095 - RNA, 14 nt, Homo sapiens
uuuuagcuuuacaa

SEQ ID NO: 778096 - RNA, 18 nt, Homo sapiens
uuuuagggagaacgggaa

SEQ ID NO: 778097 - RNA, 18 nt, Homo sapiens
uuuuaguagagacagggu

SEQ ID NO: 778098 - RNA, 20 nt, Homo sapiens
uuuuaguagagacaggguuu

SEQ ID NO: 778099 - RNA, 22 nt, Homo sapiens
uuuuaguauaaguacauuauug

SEQ ID NO: 778100 - RNA, 16 nt, Homo sapiens
uuuuagugacuguaau

SEQ ID NO: 778101 - RNA, 20 nt, Homo sapiens
uuuuagugacuguaauuaau

SEQ ID NO: 778102 - RNA, 20 nt, Homo sapiens
uuuuauaaaauuaagcaaug

SEQ ID NO: 778103 - RNA, 14 nt, Homo sapiens
uuuuauaauacaaa

SEQ ID NO: 778104 - RNA, 21 nt, Homo sapiens
uuuuauacuuuugaccaaaua

SEQ ID NO: 778105 - RNA, 21 nt, Homo sapiens
uuuuauaugcuuacugauaua

SEQ ID NO: 778106 - RNA, 23 nt, Homo sapiens
uuuuauaugucuaauaucuuaau

SEQ ID NO: 778107 - RNA, 15 nt, Homo sapiens
uuuuaucuugcacuu

SEQ ID NO: 778108 - RNA, 21 nt, Homo sapiens
uuuuaucuuuaaucuccucuu

SEQ ID NO: 778109 - RNA, 18 nt, Homo sapiens
uuuuaugauuugucucug

SEQ ID NO: 778110 - RNA, 20 nt, Homo sapiens
uuuuaugcagacagucuguu

SEQ ID NO: 778111 - RNA, 23 nt, Homo sapiens
uuuuauggaggcuuugcauagau

SEQ ID NO: 778112 - RNA, 23 nt, Homo sapiens
uuuuauguguggcccaagacaau

SEQ ID NO: 778113 - RNA, 15 nt, Homo sapiens
uuuuauuaugcauua

SEQ ID NO: 778114 - RNA, 19 nt, Homo sapiens
uuuuauucaaagacagaga

SEQ ID NO: 778115 - RNA, 22 nt, Homo sapiens
uuuuauugcuucuuuuuggaga

SEQ ID NO: 778116 - RNA, 15 nt, Homo sapiens
uuuucaaaaaguaaa

SEQ ID NO: 778117 - RNA, 18 nt, Homo sapiens
uuuucaaaauucaaaaaa

SEQ ID NO: 778118 - RNA, 14 nt, Homo sapiens
uuuucaagaugcuu

SEQ ID NO: 778119 - RNA, 16 nt, Homo sapiens
uuuucaauaccaggga

SEQ ID NO: 778120 - RNA, 23 nt, Homo sapiens
uuuucaauuuugaaaacucuaau

SEQ ID NO: 778121 - RNA, 16 nt, Homo sapiens
uuuucacacugguaaa

SEQ ID NO: 778122 - RNA, 13 nt, Homo sapiens
uuuucacaucucu

SEQ ID NO: 778123 - RNA, 23 nt, Homo sapiens
uuuucacgggaacucuccaaaua

SEQ ID NO: 778124 - RNA, 21 nt, Homo sapiens
uuuucacugcuggcugccuua

SEQ ID NO: 778125 - RNA, 15 nt, Homo sapiens
uuuucagaccccagc

SEQ ID NO: 778126 - RNA, 20 nt, Homo sapiens
uuuucagacuucaucuucaa

SEQ ID NO: 778127 - RNA, 19 nt, Homo sapiens
uuuucaucccguaucacag

SEQ ID NO: 778128 - RNA, 22 nt, Homo sapiens
uuuucaucccguaucacagugu

SEQ ID NO: 778129 - RNA, 13 nt, Homo sapiens
uuuucaugcaaaa

SEQ ID NO: 778130 - RNA, 12 nt, Homo sapiens
uuuuccaaauaa

SEQ ID NO: 778131 - RNA, 23 nt, Homo sapiens
uuuuccauuuuuauuucaaaaua

SEQ ID NO: 778132 - RNA, 16 nt, Homo sapiens
uuuucccagcuuuuga

SEQ ID NO: 778133 - RNA, 23 nt, Homo sapiens
uuuucccccuugaggauugugga

SEQ ID NO: 778134 - RNA, 21 nt, Homo sapiens
uuuucccugcaccacucucuu

SEQ ID NO: 778135 - RNA, 17 nt, Homo sapiens
uuuucccuuugccuuca

SEQ ID NO: 778136 - RNA, 18 nt, Homo sapiens
uuuuccuguucagugaga

SEQ ID NO: 778137 - RNA, 23 nt, Homo sapiens
uuuucggccccauguaucucagu

SEQ ID NO: 778138 - RNA, 17 nt, Homo sapiens
uuuucguauuucaaaua

SEQ ID NO: 778139 - RNA, 21 nt, Homo sapiens
uuuucuaauuaaagaugguuu

SEQ ID NO: 778140 - RNA, 14 nt, Homo sapiens
uuuucucaauugua

SEQ ID NO: 778141 - RNA, 14 nt, Homo sapiens
uuuucugccaggga

SEQ ID NO: 778142 - RNA, 19 nt, Homo sapiens
uuuucuggaauacaugaaa

SEQ ID NO: 778143 - RNA, 20 nt, Homo sapiens
uuuucuguagcaccagagaa

SEQ ID NO: 778144 - RNA, 13 nt, Homo sapiens
uuuucuucauuca

SEQ ID NO: 778145 - RNA, 14 nt, Homo sapiens
uuuucuuuggcugc

SEQ ID NO: 778146 - RNA, 23 nt, Homo sapiens
uuuucuuuuuuaaagacaggguc

SEQ ID NO: 778147 - RNA, 18 nt, Homo sapiens
uuuugaaaaauacaucuu

SEQ ID NO: 778148 - RNA, 13 nt, Homo sapiens
uuuugaaagaagc

SEQ ID NO: 778149 - RNA, 14 nt, Homo sapiens
uuuugacauaacua

SEQ ID NO: 778150 - RNA, 14 nt, Homo sapiens
uuuugaccaaaaaa

SEQ ID NO: 778151 - RNA, 21 nt, Homo sapiens
uuuugaccaaaaaaauugugc

SEQ ID NO: 778152 - RNA, 22 nt, Homo sapiens
uuuugaccaaauaaaguaccau

SEQ ID NO: 778153 - RNA, 13 nt, Homo sapiens
uuuugacugugau

SEQ ID NO: 778154 - RNA, 22 nt, Homo sapiens
uuuugaugugaaaaucaugaaa

SEQ ID NO: 778155 - RNA, 18 nt, Homo sapiens
uuuugcacaguuagcaaa

SEQ ID NO: 778156 - RNA, 21 nt, Homo sapiens
uuuugcacauuuuguggcugu

SEQ ID NO: 778157 - RNA, 23 nt, Homo sapiens
uuuugcagaauuaacuauaacaa

SEQ ID NO: 778158 - RNA, 17 nt, Homo sapiens
uuuugccucaccuaaua

SEQ ID NO: 778159 - RNA, 21 nt, Homo sapiens
uuuugcuauuccaaucuacaa

SEQ ID NO: 778160 - RNA, 16 nt, Homo sapiens
uuuugcuuuaauucca

SEQ ID NO: 778161 - RNA, 21 nt, Homo sapiens
uuuuggaauuaugucugcuga

SEQ ID NO: 778162 - RNA, 13 nt, Homo sapiens
uuuuggccaaagu

SEQ ID NO: 778163 - RNA, 14 nt, Homo sapiens
uuuuggguauuaau

SEQ ID NO: 778164 - RNA, 11 nt, Homo sapiens
uuuuggucaaa

SEQ ID NO: 778165 - RNA, 15 nt, Homo sapiens
uuuuguaaacuguau

SEQ ID NO: 778166 - RNA, 13 nt, Homo sapiens
uuuuguagccuuc

SEQ ID NO: 778167 - RNA, 22 nt, Homo sapiens
uuuugugggggugaagucuugc

SEQ ID NO: 778168 - RNA, 22 nt, Homo sapiens
uuuugugucaaaaggacauuua

SEQ ID NO: 778169 - RNA, 13 nt, Homo sapiens
uuuuguuaccuuu

SEQ ID NO: 778170 - RNA, 15 nt, Homo sapiens
uuuuguuauugggca

SEQ ID NO: 778171 - RNA, 10 nt, Homo sapiens
uuuuguucau

SEQ ID NO: 778172 - RNA, 19 nt, Homo sapiens
uuuuguucucaacuucaaa

SEQ ID NO: 778173 - RNA, 14 nt, Homo sapiens
uuuuguugcucagu

SEQ ID NO: 778174 - RNA, 19 nt, Homo sapiens
uuuuguuuuuucuugccag

SEQ ID NO: 778175 - RNA, 21 nt, Homo sapiens
uuuuuaaaauauauugcugca

SEQ ID NO: 778176 - RNA, 17 nt, Homo sapiens
uuuuuaacugcauaaua

SEQ ID NO: 778177 - RNA, 18 nt, Homo sapiens
uuuuuaauauaaagccug

SEQ ID NO: 778178 - RNA, 14 nt, Homo sapiens
uuuuuacagcaaaa

SEQ ID NO: 778179 - RNA, 22 nt, Homo sapiens
uuggagagagaggcugccucag

SEQ ID NO: 778180 - RNA, 21 nt, Homo sapiens
uuggagagcagcaggugcugu

SEQ ID NO: 778181 - RNA, 16 nt, Homo sapiens
uuggagaguuugccug

SEQ ID NO: 778182 - RNA, 16 nt, Homo sapiens
uuggagccacuccugu

SEQ ID NO: 778183 - RNA, 15 nt, Homo sapiens
uuggagcuacugcaa

SEQ ID NO: 778184 - RNA, 17 nt, Homo sapiens
uuggagcucauucuguc

SEQ ID NO: 778185 - RNA, 22 nt, Homo sapiens
uuggagcucauucugucucuuu

SEQ ID NO: 778186 - RNA, 14 nt, Homo sapiens
uuggaggccuuccc

SEQ ID NO: 778187 - RNA, 23 nt, Homo sapiens
uuggagggguauuuuugcccuga

SEQ ID NO: 778188 - RNA, 17 nt, Homo sapiens
uuggagguuaaggcaua

SEQ ID NO: 778189 - RNA, 22 nt, Homo sapiens
uuggaguaaauauauaugucaa

SEQ ID NO: 778190 - RNA, 23 nt, Homo sapiens
uuggagucccaggggcagccaca

SEQ ID NO: 778191 - RNA, 12 nt, Homo sapiens
uuggagugcagu

SEQ ID NO: 778192 - RNA, 18 nt, Homo sapiens
uuggauaaguuucuauuc

SEQ ID NO: 778193 - RNA, 17 nt, Homo sapiens
uuggaugagaagugucu

SEQ ID NO: 778194 - RNA, 18 nt, Homo sapiens
uuggauuauucauuuaaa

SEQ ID NO: 778195 - RNA, 15 nt, Homo sapiens
uuggcaaacuuugua

SEQ ID NO: 778196 - RNA, 23 nt, Homo sapiens
uuggcaacagaagugguuuccca

SEQ ID NO: 778197 - RNA, 14 nt, Homo sapiens
uuggcaaugcacug

SEQ ID NO: 778198 - RNA, 14 nt, Homo sapiens
uuggcaccagacac

SEQ ID NO: 778199 - RNA, 21 nt, Homo sapiens
uuggcagcucaaagacuucca

SEQ ID NO: 778200 - RNA, 16 nt, Homo sapiens
uuggcagcucuacucu

SEQ ID NO: 778201 - RNA, 18 nt, Homo sapiens
uuggcaggcuggccaguc

SEQ ID NO: 778202 - RNA, 20 nt, Homo sapiens
uuggcaggcuuuuuuccaga

SEQ ID NO: 778203 - RNA, 17 nt, Homo sapiens
uuggcauaauagucaau

SEQ ID NO: 778204 - RNA, 15 nt, Homo sapiens
uuggcauggcuuuau

SEQ ID NO: 778205 - RNA, 16 nt, Homo sapiens
uuggccccacuuugaa

SEQ ID NO: 778206 - RNA, 15 nt, Homo sapiens
uuggccugcugugau

SEQ ID NO: 778207 - RNA, 17 nt, Homo sapiens
uuggccuucagaaccau

SEQ ID NO: 778208 - RNA, 20 nt, Homo sapiens
uuggcgcaccaagaucucca

SEQ ID NO: 778209 - RNA, 15 nt, Homo sapiens
uuggcuacacacaaa

SEQ ID NO: 778210 - RNA, 17 nt, Homo sapiens
uuggcucacacugagaa

SEQ ID NO: 778211 - RNA, 16 nt, Homo sapiens
uuggcucuagucacug

SEQ ID NO: 778212 - RNA, 14 nt, Homo sapiens
uuggcugaccccuc

SEQ ID NO: 778213 - RNA, 18 nt, Homo sapiens
uuggcugauguugcagcc

SEQ ID NO: 778214 - RNA, 15 nt, Homo sapiens
uuggcuuaucauggg

SEQ ID NO: 778215 - RNA, 15 nt, Homo sapiens
uuggcuuccaugaug

SEQ ID NO: 778216 - RNA, 10 nt, Homo sapiens
uuggcuugac

SEQ ID NO: 778217 - RNA, 14 nt, Homo sapiens
uuggcuuuaugcaa

SEQ ID NO: 778218 - RNA, 17 nt, Homo sapiens
uugggaaaacauuugcu

SEQ ID NO: 778219 - RNA, 17 nt, Homo sapiens
uugggaacaugcuggaa

SEQ ID NO: 778220 - RNA, 13 nt, Homo sapiens
uugggagcacugg

SEQ ID NO: 778221 - RNA, 22 nt, Homo sapiens
uugggaggcugaggcaagagaa

SEQ ID NO: 778222 - RNA, 22 nt, Homo sapiens
uugggaggcugaggcaggagaa

SEQ ID NO: 778223 - RNA, 15 nt, Homo sapiens
uugggauaguguucu

SEQ ID NO: 778224 - RNA, 15 nt, Homo sapiens
uugggccugcuccag

SEQ ID NO: 778225 - RNA, 15 nt, Homo sapiens
uugggcuugacaccu

SEQ ID NO: 778226 - RNA, 14 nt, Homo sapiens
uuggggacuaaccc

SEQ ID NO: 778227 - RNA, 22 nt, Homo sapiens
uuggggacuaacccaaugccug

SEQ ID NO: 778228 - RNA, 16 nt, Homo sapiens
uuggggcccagugcau

SEQ ID NO: 778229 - RNA, 15 nt, Homo sapiens
uuggggugcuuccuu

SEQ ID NO: 778230 - RNA, 19 nt, Homo sapiens
uuggguccaccaugcagaa

SEQ ID NO: 778231 - RNA, 13 nt, Homo sapiens
uugggucuugggg

SEQ ID NO: 778232 - RNA, 13 nt, Homo sapiens
uugggucuuugaa

SEQ ID NO: 778233 - RNA, 18 nt, Homo sapiens
uugguaaaaaugcugcuc

SEQ ID NO: 778234 - RNA, 21 nt, Homo sapiens
uugguacuacuagaugucuuu

SEQ ID NO: 778235 - RNA, 12 nt, Homo sapiens
uugguacugaaa

SEQ ID NO: 778236 - RNA, 19 nt, Homo sapiens
uugguacuuauuacugcua

SEQ ID NO: 778237 - RNA, 21 nt, Homo sapiens
uugguacuuauuacugcuaag

SEQ ID NO: 778238 - RNA, 14 nt, Homo sapiens
uuggucacauauca

SEQ ID NO: 778239 - RNA, 16 nt, Homo sapiens
uugguccaagauuccg

SEQ ID NO: 778240 - RNA, 14 nt, Homo sapiens
uuggugaauuucac

SEQ ID NO: 778241 - RNA, 15 nt, Homo sapiens
uuggugaauuucaca

SEQ ID NO: 778242 - RNA, 16 nt, Homo sapiens
uuggugaauuucacaa

SEQ ID NO: 778243 - RNA, 19 nt, Homo sapiens
uuggugacaccucaccuca

SEQ ID NO: 778244 - RNA, 15 nt, Homo sapiens
uuggugacucugucc

SEQ ID NO: 778245 - RNA, 11 nt, Homo sapiens
uuggugccacu

SEQ ID NO: 778246 - RNA, 13 nt, Homo sapiens
uuggugcuagaaa

SEQ ID NO: 778247 - RNA, 13 nt, Homo sapiens
uugguggauguga

SEQ ID NO: 778248 - RNA, 13 nt, Homo sapiens
uugguuggcagaa

SEQ ID NO: 778249 - RNA, 18 nt, Homo sapiens
uugguuugcaaccucuuu

SEQ ID NO: 778250 - RNA, 13 nt, Homo sapiens
uuguaaaaagccc

SEQ ID NO: 778251 - RNA, 19 nt, Homo sapiens
uuguaaaagaugcagagua

SEQ ID NO: 778252 - RNA, 17 nt, Homo sapiens
uuguaaaauuauuucau

SEQ ID NO: 778253 - RNA, 20 nt, Homo sapiens
uuguaaagauuucuguucag

SEQ ID NO: 778254 - RNA, 20 nt, Homo sapiens
uuguaaauacacauagcaug

SEQ ID NO: 778255 - RNA, 12 nt, Homo sapiens
uuguaaauauuc

SEQ ID NO: 778256 - RNA, 14 nt, Homo sapiens
uuguaaauguacug

SEQ ID NO: 778257 - RNA, 17 nt, Homo sapiens
uuguaaauguacuggua

SEQ ID NO: 778258 - RNA, 18 nt, Homo sapiens
uuguaaccugcugugaua

SEQ ID NO: 778259 - RNA, 20 nt, Homo sapiens
uuguaacgaagacacagacu

SEQ ID NO: 778260 - RNA, 12 nt, Homo sapiens
uuguaacuaaua

SEQ ID NO: 778261 - RNA, 13 nt, Homo sapiens
uuguaacuccacc

SEQ ID NO: 778262 - RNA, 14 nt, Homo sapiens
uuguaagacauuuc

SEQ ID NO: 778263 - RNA, 20 nt, Homo sapiens
uuguaagaguggaaccaaca

SEQ ID NO: 778264 - RNA, 22 nt, Homo sapiens
uuguaagugagagagacaagaa

SEQ ID NO: 778265 - RNA, 23 nt, Homo sapiens
uuguaaguggucgcuuacuuuga

SEQ ID NO: 778266 - RNA, 19 nt, Homo sapiens
uuguaauauuuuccauaaa

SEQ ID NO: 778267 - RNA, 23 nt, Homo sapiens
uuguaaucauguuaccauuacaa

SEQ ID NO: 778268 - RNA, 16 nt, Homo sapiens
uuguaaugucaccacc

SEQ ID NO: 778269 - RNA, 13 nt, Homo sapiens
uuguaauugcuua

SEQ ID NO: 778270 - RNA, 19 nt, Homo sapiens
uuguacaaauguaagcaaa

SEQ ID NO: 778271 - RNA, 14 nt, Homo sapiens
uuguacacugugua

SEQ ID NO: 778272 - RNA, 15 nt, Homo sapiens
uuguacaggacugua

SEQ ID NO: 778273 - RNA, 13 nt, Homo sapiens
uuguacauuucac

SEQ ID NO: 778274 - RNA, 22 nt, Homo sapiens
uuguacuuuucauuuuggcuca

SEQ ID NO: 778275 - RNA, 17 nt, Homo sapiens
uuguagacaaaguacau

SEQ ID NO: 778276 - RNA, 18 nt, Homo sapiens
uuguagccagguacugca

SEQ ID NO: 778277 - RNA, 21 nt, Homo sapiens
uuguagugguauagaguacug

SEQ ID NO: 778278 - RNA, 20 nt, Homo sapiens
uuguauaggggcaacuguau

SEQ ID NO: 778279 - RNA, 14 nt, Homo sapiens
uuguauaucaugaa

SEQ ID NO: 778280 - RNA, 16 nt, Homo sapiens
uuguauauuauggaag

SEQ ID NO: 778281 - RNA, 19 nt, Homo sapiens
uuguaucaacacuguuacu

SEQ ID NO: 778282 - RNA, 23 nt, Homo sapiens
uuguaucucauacugucugggau

SEQ ID NO: 778283 - RNA, 20 nt, Homo sapiens
uuguaucuuucuuucucuaa

SEQ ID NO: 778284 - RNA, 14 nt, Homo sapiens
uuguauuacuagaa

SEQ ID NO: 778285 - RNA, 19 nt, Homo sapiens
uuguauuccuccugagaua

SEQ ID NO: 778286 - RNA, 16 nt, Homo sapiens
uuguauuuauuuccag

SEQ ID NO: 778287 - RNA, 18 nt, Homo sapiens
uuguauuucucuuguccu

SEQ ID NO: 778288 - RNA, 18 nt, Homo sapiens
uugaugauaaacacugag

SEQ ID NO: 778289 - RNA, 11 nt, Homo sapiens
uugauggaccc

SEQ ID NO: 778290 - RNA, 14 nt, Homo sapiens
uugaugguauucau

SEQ ID NO: 778291 - RNA, 13 nt, Homo sapiens
uugauucuugauu

SEQ ID NO: 778292 - RNA, 22 nt, Homo sapiens
uugauugggaaaacauuugcug

SEQ ID NO: 778293 - RNA, 14 nt, Homo sapiens
uugauuucacugga

SEQ ID NO: 778294 - RNA, 21 nt, Homo sapiens
uugauuuuauuuuuucucugu

SEQ ID NO: 778295 - RNA, 22 nt, Homo sapiens
uugcaaacccugguugcuguau

SEQ ID NO: 778296 - RNA, 21 nt, Homo sapiens
uugcaaauaccuccucccuaa

SEQ ID NO: 778297 - RNA, 17 nt, Homo sapiens
uugcaaccacugcaacg

SEQ ID NO: 778298 - RNA, 20 nt, Homo sapiens
uugcaagaugugaauuauug

SEQ ID NO: 778299 - RNA, 14 nt, Homo sapiens
uugcaauguaguca

SEQ ID NO: 778300 - RNA, 22 nt, Homo sapiens
uugcaauguucaacauuaacau

SEQ ID NO: 778301 - RNA, 19 nt, Homo sapiens
uugcacaaggaaauaaagc

SEQ ID NO: 778302 - RNA, 14 nt, Homo sapiens
uugcacagccaaau

SEQ ID NO: 778303 - RNA, 23 nt, Homo sapiens
uugcacagcucuccggucucucu

SEQ ID NO: 778304 - RNA, 19 nt, Homo sapiens
uugcacagugugugacuua

SEQ ID NO: 778305 - RNA, 22 nt, Homo sapiens
uugcacauuuuguggcuguuga

SEQ ID NO: 778306 - RNA, 17 nt, Homo sapiens
uugcacuuaugauuuca

SEQ ID NO: 778307 - RNA, 16 nt, Homo sapiens
uugcagcugugagaag

SEQ ID NO: 778308 - RNA, 13 nt, Homo sapiens
uugcagggguccc

SEQ ID NO: 778309 - RNA, 23 nt, Homo sapiens
uugcagguggggguugcuguaua

SEQ ID NO: 778310 - RNA, 15 nt, Homo sapiens
uugcaguugcucuga

SEQ ID NO: 778311 - RNA, 17 nt, Homo sapiens
uugcauacccaaaccag

SEQ ID NO: 778312 - RNA, 20 nt, Homo sapiens
uugcauaguaccaaucauuu

SEQ ID NO: 778313 - RNA, 21 nt, Homo sapiens
uugcauaucuuaaaacuaaau

SEQ ID NO: 778314 - RNA, 12 nt, Homo sapiens
uugcaugaaauu

SEQ ID NO: 778315 - RNA, 16 nt, Homo sapiens
uugcauguaugacuua

SEQ ID NO: 778316 - RNA, 14 nt, Homo sapiens
uugcauuaaucuaa

SEQ ID NO: 778317 - RNA, 20 nt, Homo sapiens
uugccaaacagccacacugu

SEQ ID NO: 778318 - RNA, 16 nt, Homo sapiens
uugccacaacccuguu

SEQ ID NO: 778319 - RNA, 18 nt, Homo sapiens
uugccacagaugauacuu

SEQ ID NO: 778320 - RNA, 18 nt, Homo sapiens
uugccacggaaacauaca

SEQ ID NO: 778321 - RNA, 19 nt, Homo sapiens
uugccacggaaacauacag

SEQ ID NO: 778322 - RNA, 23 nt, Homo sapiens
uugccagauuaccgacacuguca

SEQ ID NO: 778323 - RNA, 15 nt, Homo sapiens
uugccauaaagucaa

SEQ ID NO: 778324 - RNA, 13 nt, Homo sapiens
uugccauguguuu

SEQ ID NO: 778325 - RNA, 12 nt, Homo sapiens
uugccauucaag

SEQ ID NO: 778326 - RNA, 17 nt, Homo sapiens
uugcccagagaugccuc

SEQ ID NO: 778327 - RNA, 20 nt, Homo sapiens
uugcccaggcuggucucaaa

SEQ ID NO: 778328 - RNA, 14 nt, Homo sapiens
uugcccagugugag

SEQ ID NO: 778329 - RNA, 14 nt, Homo sapiens
uugccccaccuccc

SEQ ID NO: 778330 - RNA, 23 nt, Homo sapiens
uugcccccagauacauggugaug

SEQ ID NO: 778331 - RNA, 19 nt, Homo sapiens
uugcccccgacggcuguga

SEQ ID NO: 778332 - RNA, 23 nt, Homo sapiens
uugccccuaggaaggugaaucug

SEQ ID NO: 778333 - RNA, 15 nt, Homo sapiens
uugccccugagacaa

SEQ ID NO: 778334 - RNA, 23 nt, Homo sapiens
uugcccggcugugauugcugcca

SEQ ID NO: 778335 - RNA, 14 nt, Homo sapiens
uugccuaaauccaa

SEQ ID NO: 778336 - RNA, 17 nt, Homo sapiens
uugccuaaauccaaaga

SEQ ID NO: 778337 - RNA, 13 nt, Homo sapiens
uugccucaagacu

SEQ ID NO: 778338 - RNA, 14 nt, Homo sapiens
uugccucaccuaau

SEQ ID NO: 778339 - RNA, 22 nt, Homo sapiens
uugccucuacuuugauucugau

SEQ ID NO: 778340 - RNA, 12 nt, Homo sapiens
uugccugcaaaa

SEQ ID NO: 778341 - RNA, 20 nt, Homo sapiens
uugccugggggcuuuugcca

SEQ ID NO: 778342 - RNA, 21 nt, Homo sapiens
uugccugggggcuuuugccac

SEQ ID NO: 778343 - RNA, 19 nt, Homo sapiens
uugccuggggucugagcau

SEQ ID NO: 778344 - RNA, 15 nt, Homo sapiens
uugccuuaaccaguc

SEQ ID NO: 778345 - RNA, 21 nt, Homo sapiens
uugccuuaaccagucucucaa

SEQ ID NO: 778346 - RNA, 16 nt, Homo sapiens
uugccuucuaggucac

SEQ ID NO: 778347 - RNA, 18 nt, Homo sapiens
uugccuucucuguucccu

SEQ ID NO: 778348 - RNA, 13 nt, Homo sapiens
uugccuuuuacuu

SEQ ID NO: 778349 - RNA, 20 nt, Homo sapiens
uugcgagccucgcagccucc

SEQ ID NO: 778350 - RNA, 20 nt, Homo sapiens
uugcgccauugcacuccagc

SEQ ID NO: 778351 - RNA, 16 nt, Homo sapiens
uugcgcucucaagacc

SEQ ID NO: 778352 - RNA, 22 nt, Homo sapiens
uugcgcucucaagaccagagac

SEQ ID NO: 778353 - RNA, 19 nt, Homo sapiens
uugcguuuguauauccaaa

SEQ ID NO: 778354 - RNA, 23 nt, Homo sapiens
uugcuaaaagauuauagaaguag

SEQ ID NO: 778355 - RNA, 22 nt, Homo sapiens
uugcuaagaagcgagcacugac

SEQ ID NO: 778356 - RNA, 23 nt, Homo sapiens
uugcuacccauuuacaaauaaga

SEQ ID NO: 778357 - RNA, 13 nt, Homo sapiens
uugcuagauuucu

SEQ ID NO: 778358 - RNA, 18 nt, Homo sapiens
uugcuaugagguuugcuu

SEQ ID NO: 778359 - RNA, 13 nt, Homo sapiens
uugcuauggaaac

SEQ ID NO: 778360 - RNA, 23 nt, Homo sapiens
uugcucagugggggcagagccac

SEQ ID NO: 778361 - RNA, 13 nt, Homo sapiens
uugcucccugcaa

SEQ ID NO: 778362 - RNA, 23 nt, Homo sapiens
uugcucgcccagacaccaugugc

SEQ ID NO: 778363 - RNA, 20 nt, Homo sapiens
uugcucuaggaagacauuuu

SEQ ID NO: 778364 - RNA, 20 nt, Homo sapiens
uugcucuaugucugccuucg

SEQ ID NO: 778365 - RNA, 19 nt, Homo sapiens
uugcucucgacaguaucca

SEQ ID NO: 778366 - RNA, 13 nt, Homo sapiens
uugcucuuuggua

SEQ ID NO: 778367 - RNA, 14 nt, Homo sapiens
uugcugaacucagc

SEQ ID NO: 778368 - RNA, 20 nt, Homo sapiens
uugcugauggguaguaccug

SEQ ID NO: 778369 - RNA, 20 nt, Homo sapiens
uugcugcacaaacaugaaaa

SEQ ID NO: 778370 - RNA, 15 nt, Homo sapiens
uugcuggaguacuua

SEQ ID NO: 778371 - RNA, 15 nt, Homo sapiens
uugcuggaugcauuu

SEQ ID NO: 778372 - RNA, 16 nt, Homo sapiens
uugcugguagcacuug

SEQ ID NO: 778373 - RNA, 17 nt, Homo sapiens
uugcugugcguggaaug

SEQ ID NO: 778374 - RNA, 15 nt, Homo sapiens
uugcuucccugcuau

SEQ ID NO: 778375 - RNA, 18 nt, Homo sapiens
uugcuuccugcuauaagu

SEQ ID NO: 778376 - RNA, 18 nt, Homo sapiens
uugcuucuccagugguga

SEQ ID NO: 778377 - RNA, 13 nt, Homo sapiens
uugcuucuugcca

SEQ ID NO: 778378 - RNA, 19 nt, Homo sapiens
uugcuuggaagccagguac

SEQ ID NO: 778379 - RNA, 12 nt, Homo sapiens
uugcuuuacucu

SEQ ID NO: 778380 - RNA, 22 nt, Homo sapiens
uugcuuuagcacaggacaacuu

SEQ ID NO: 778381 - RNA, 18 nt, Homo sapiens
uuggaaaaagccugugaa

SEQ ID NO: 778382 - RNA, 12 nt, Homo sapiens
uuggaaaccaca

SEQ ID NO: 778383 - RNA, 14 nt, Homo sapiens
uuggaaaccacagu

SEQ ID NO: 778384 - RNA, 17 nt, Homo sapiens
uuggaaagcaucaccuc

SEQ ID NO: 778385 - RNA, 19 nt, Homo sapiens
uuggaaaggaccaguaugc

SEQ ID NO: 778386 - RNA, 14 nt, Homo sapiens
uuggaaaguacucc

SEQ ID NO: 778387 - RNA, 14 nt, Homo sapiens
uuggaaaucugcca

SEQ ID NO: 778388 - RNA, 14 nt, Homo sapiens
uuggaaaugugaau

SEQ ID NO: 778389 - RNA, 12 nt, Homo sapiens
uuggaacccaag

SEQ ID NO: 778390 - RNA, 21 nt, Homo sapiens
uuggaagaggaacagcacugg

SEQ ID NO: 778391 - RNA, 14 nt, Homo sapiens
uuggaagauggcau

SEQ ID NO: 778392 - RNA, 22 nt, Homo sapiens
uuggaagccagguacaggagag

SEQ ID NO: 778393 - RNA, 20 nt, Homo sapiens
uuggaaguguucccugagaa

SEQ ID NO: 778394 - RNA, 14 nt, Homo sapiens
uuggaauaaucacu

SEQ ID NO: 778395 - RNA, 19 nt, Homo sapiens
uuggaauauuuuauccugu

SEQ ID NO: 778396 - RNA, 18 nt, Homo sapiens
uuggaaucuucaccucag

SEQ ID NO: 778397 - RNA, 21 nt, Homo sapiens
uugaaagaaauuuggcuauaa

SEQ ID NO: 778398 - RNA, 13 nt, Homo sapiens
uugaaagaaccag

SEQ ID NO: 778399 - RNA, 14 nt, Homo sapiens
uugaaagaaccaga

SEQ ID NO: 778400 - RNA, 15 nt, Homo sapiens
uugaaagaaccagag

SEQ ID NO: 778401 - RNA, 21 nt, Homo sapiens
uugaaagaacuuaagucucga

SEQ ID NO: 778402 - RNA, 13 nt, Homo sapiens
uugaaagacauca

SEQ ID NO: 778403 - RNA, 15 nt, Homo sapiens
uugaaagacaucaau

SEQ ID NO: 778404 - RNA, 14 nt, Homo sapiens
uugaaagaugcagu

SEQ ID NO: 778405 - RNA, 17 nt, Homo sapiens
uugaaagcccaaggugc

SEQ ID NO: 778406 - RNA, 21 nt, Homo sapiens
uugaaaggagaugucuuggaa

SEQ ID NO: 778407 - RNA, 22 nt, Homo sapiens
uugaaaggccaacagcaagugu

SEQ ID NO: 778408 - RNA, 17 nt, Homo sapiens
uugaaauaaaugacaau

SEQ ID NO: 778409 - RNA, 23 nt, Homo sapiens
uugaaauaauaaaucugguagaa

SEQ ID NO: 778410 - RNA, 20 nt, Homo sapiens
uugaaauauaguaaacacuu

SEQ ID NO: 778411 - RNA, 14 nt, Homo sapiens
uugaaauaucaugu

SEQ ID NO: 778412 - RNA, 21 nt, Homo sapiens
uugaaaucaaugcaagaguga

SEQ ID NO: 778413 - RNA, 22 nt, Homo sapiens
uugaaaugaguaaaaacuagaa

SEQ ID NO: 778414 - RNA, 18 nt, Homo sapiens
uugaaaugcucuuuugca

SEQ ID NO: 778415 - RNA, 20 nt, Homo sapiens
uugaaaugcucuuuugcaca

SEQ ID NO: 778416 - RNA, 21 nt, Homo sapiens
uugaaauguaggcaucaugca

SEQ ID NO: 778417 - RNA, 17 nt, Homo sapiens
uugaacaaagacuacua

SEQ ID NO: 778418 - RNA, 21 nt, Homo sapiens
uugaacauguuuaauggguau

SEQ ID NO: 778419 - RNA, 13 nt, Homo sapiens
uugaacauuugca

SEQ ID NO: 778420 - RNA, 19 nt, Homo sapiens
uugaacuucugacuacuug

SEQ ID NO: 778421 - RNA, 17 nt, Homo sapiens
uugaacuugauugccua

SEQ ID NO: 778422 - RNA, 19 nt, Homo sapiens
uugaacuuuaagaagcagu

SEQ ID NO: 778423 - RNA, 11 nt, Homo sapiens
uugaagaccag

SEQ ID NO: 778424 - RNA, 14 nt, Homo sapiens
uugaagagauuuua

SEQ ID NO: 778425 - RNA, 18 nt, Homo sapiens
uugaagagugaaauacca

SEQ ID NO: 778426 - RNA, 22 nt, Homo sapiens
uugaagauuuaugaugcacuua

SEQ ID NO: 778427 - RNA, 12 nt, Homo sapiens
uugaagcacuua

SEQ ID NO: 778428 - RNA, 14 nt, Homo sapiens
uugaagcacuuaag

SEQ ID NO: 778429 - RNA, 14 nt, Homo sapiens
uugaagccaaagaa

SEQ ID NO: 778430 - RNA, 22 nt, Homo sapiens
uugaagcucuggugacaccagc

SEQ ID NO: 778431 - RNA, 16 nt, Homo sapiens
uugaagcuguugcuau

SEQ ID NO: 778432 - RNA, 19 nt, Homo sapiens
uugaaggcccugcugaguc

SEQ ID NO: 778433 - RNA, 13 nt, Homo sapiens
uugaaggcuuuag

SEQ ID NO: 778434 - RNA, 20 nt, Homo sapiens
uugaaggugcugacggccag

SEQ ID NO: 778435 - RNA, 13 nt, Homo sapiens
uugaagucuuuaa

SEQ ID NO: 778436 - RNA, 19 nt, Homo sapiens
uugaaguguuugcuuuucu

SEQ ID NO: 778437 - RNA, 21 nt, Homo sapiens
uugaaguuuuagcggucaauu

SEQ ID NO: 778438 - RNA, 23 nt, Homo sapiens
uugaauauuccuggacuuacaaa

SEQ ID NO: 778439 - RNA, 22 nt, Homo sapiens
uugaaucuucucccuuguccug

SEQ ID NO: 778440 - RNA, 18 nt, Homo sapiens
uugaaugaacacuaugca

SEQ ID NO: 778441 - RNA, 22 nt, Homo sapiens
uugaauggagcuggugagauca

SEQ ID NO: 778442 - RNA, 21 nt, Homo sapiens
uugaauggguccauuuugccc

SEQ ID NO: 778443 - RNA, 15 nt, Homo sapiens
uugaauggguuugcu

SEQ ID NO: 778444 - RNA, 12 nt, Homo sapiens
uugaaugucaca

SEQ ID NO: 778445 - RNA, 14 nt, Homo sapiens
uugaaugugucagg

SEQ ID NO: 778446 - RNA, 15 nt, Homo sapiens
uugaauuccauggaa

SEQ ID NO: 778447 - RNA, 16 nt, Homo sapiens
uugaauucuugauaaa

SEQ ID NO: 778448 - RNA, 15 nt, Homo sapiens
uugaauugcacugaa

SEQ ID NO: 778449 - RNA, 14 nt, Homo sapiens
uugaauuugggaua

SEQ ID NO: 778450 - RNA, 18 nt, Homo sapiens
uugacaacaauccaaaaa

SEQ ID NO: 778451 - RNA, 13 nt, Homo sapiens
uugacaacauguu

SEQ ID NO: 778452 - RNA, 18 nt, Homo sapiens
uugacaauugggagcugc

SEQ ID NO: 778453 - RNA, 19 nt, Homo sapiens
uugacaccugucuugaaua

SEQ ID NO: 778454 - RNA, 11 nt, Homo sapiens
uugacacugaa

SEQ ID NO: 778455 - RNA, 14 nt, Homo sapiens
uugacauaacacua

SEQ ID NO: 778456 - RNA, 15 nt, Homo sapiens
uugacauucggggug

SEQ ID NO: 778457 - RNA, 11 nt, Homo sapiens
uugaccaaaga

SEQ ID NO: 778458 - RNA, 11 nt, Homo sapiens
uugaccacaga

SEQ ID NO: 778459 - RNA, 19 nt, Homo sapiens
uugaccagugaaacuauga

SEQ ID NO: 778460 - RNA, 18 nt, Homo sapiens
uugaccggaucuacaccc

SEQ ID NO: 778461 - RNA, 20 nt, Homo sapiens
uugaccuccgaaggauccuc

SEQ ID NO: 778462 - RNA, 17 nt, Homo sapiens
uugaccucgugauccac

SEQ ID NO: 778463 - RNA, 16 nt, Homo sapiens
uugacuaacaagaaug

SEQ ID NO: 778464 - RNA, 16 nt, Homo sapiens
uugacucaaaccauau

SEQ ID NO: 778465 - RNA, 14 nt, Homo sapiens
uugacucauggcag

SEQ ID NO: 778466 - RNA, 19 nt, Homo sapiens
uugacucuaaaugcaguuu

SEQ ID NO: 778467 - RNA, 15 nt, Homo sapiens
uugacucuacugauc

SEQ ID NO: 778468 - RNA, 17 nt, Homo sapiens
uugacucucacacugaa

SEQ ID NO: 778469 - RNA, 14 nt, Homo sapiens
uugacucugcauuu

SEQ ID NO: 778470 - RNA, 22 nt, Homo sapiens
uugacuggguuucucuguauag

SEQ ID NO: 778471 - RNA, 14 nt, Homo sapiens
uugacuucugacaa

SEQ ID NO: 778472 - RNA, 23 nt, Homo sapiens
uugacuuucugauuggugauuca

SEQ ID NO: 778473 - RNA, 22 nt, Homo sapiens
uugagaagccuucagcuccagg

SEQ ID NO: 778474 - RNA, 17 nt, Homo sapiens
uugagacaggaugguua

SEQ ID NO: 778475 - RNA, 15 nt, Homo sapiens
uugagacauuuacau

SEQ ID NO: 778476 - RNA, 15 nt, Homo sapiens
uugagacugauucag

SEQ ID NO: 778477 - RNA, 16 nt, Homo sapiens
uugagagcaacgucac

SEQ ID NO: 778478 - RNA, 16 nt, Homo sapiens
uugagaggcugaggug

SEQ ID NO: 778479 - RNA, 23 nt, Homo sapiens
uugagauaaagucaaaugccaaa

SEQ ID NO: 778480 - RNA, 12 nt, Homo sapiens
uugagauccaaa

SEQ ID NO: 778481 - RNA, 16 nt, Homo sapiens
uugagauccagugcag

SEQ ID NO: 778482 - RNA, 20 nt, Homo sapiens
uugagauguuguguggcaau

SEQ ID NO: 778483 - RNA, 17 nt, Homo sapiens
uugagcacacuuuacac

SEQ ID NO: 778484 - RNA, 19 nt, Homo sapiens
uugagcacacuuuacacaa

SEQ ID NO: 778485 - RNA, 18 nt, Homo sapiens
uugagcaccgucauggcu

SEQ ID NO: 778486 - RNA, 16 nt, Homo sapiens
uugagcaguuagcuca

SEQ ID NO: 778487 - RNA, 19 nt, Homo sapiens
uugagccaacaacucugau

SEQ ID NO: 778488 - RNA, 23 nt, Homo sapiens
uugagccaagcuucaacccucag

SEQ ID NO: 778489 - RNA, 19 nt, Homo sapiens
uugagcugcucugcaagag

SEQ ID NO: 778490 - RNA, 18 nt, Homo sapiens
uugagcugcugacugcca

SEQ ID NO: 778491 - RNA, 14 nt, Homo sapiens
uugagcuucugggg

SEQ ID NO: 778492 - RNA, 16 nt, Homo sapiens
uugaggauuguggaaa

SEQ ID NO: 778493 - RNA, 20 nt, Homo sapiens
uugaggauuguggaaaacca

SEQ ID NO: 778494 - RNA, 19 nt, Homo sapiens
uugaggcauuuccagacuu

SEQ ID NO: 778495 - RNA, 18 nt, Homo sapiens
uugaggcugcagauuucc

SEQ ID NO: 778496 - RNA, 13 nt, Homo sapiens
uugaguacagaua

SEQ ID NO: 778497 - RNA, 19 nt, Homo sapiens
uugaguacagauacuguga

SEQ ID NO: 778498 - RNA, 13 nt, Homo sapiens
uugaguagaucca

SEQ ID NO: 778499 - RNA, 16 nt, Homo sapiens
uugaguagccagauga

SEQ ID NO: 778500 - RNA, 17 nt, Homo sapiens
uugaguagccagaugaa

SEQ ID NO: 778501 - RNA, 21 nt, Homo sapiens
uugagugacagcuuucuggga

SEQ ID NO: 778502 - RNA, 19 nt, Homo sapiens
uugaguugacuucugacaa

SEQ ID NO: 778503 - RNA, 22 nt, Homo sapiens
uugauaagaggaauuugguaua

SEQ ID NO: 778504 - RNA, 16 nt, Homo sapiens
uugauaauugcauuca

SEQ ID NO: 778505 - RNA, 23 nt, Homo sapiens
ugucccugccuucacugugcucc

SEQ ID NO: 778506 - RNA, 23 nt, Homo sapiens
ugucccuuucuuggccaguuauc

SEQ ID NO: 778507 - RNA, 20 nt, Homo sapiens
ugucccuuugcucccggcaa

SEQ ID NO: 778508 - RNA, 19 nt, Homo sapiens
uguccuaaggcccauuuga

SEQ ID NO: 778509 - RNA, 22 nt, Homo sapiens
uguccucagccuugccagagau

SEQ ID NO: 778510 - RNA, 22 nt, Homo sapiens
uguccuccaccaugcacucacc

SEQ ID NO: 778511 - RNA, 18 nt, Homo sapiens
uguccuccaccugccuuc

SEQ ID NO: 778512 - RNA, 17 nt, Homo sapiens
uguccucccuuguggcu

SEQ ID NO: 778513 - RNA, 22 nt, Homo sapiens
uguccugggccugccccugugu

SEQ ID NO: 778514 - RNA, 15 nt, Homo sapiens
uguccuucauccaau

SEQ ID NO: 778515 - RNA, 20 nt, Homo sapiens
uguccuucauccaaugcagg

SEQ ID NO: 778516 - RNA, 15 nt, Homo sapiens
uguccuuucuugcag

SEQ ID NO: 778517 - RNA, 21 nt, Homo sapiens
uguccuuuuggcacugagaua

SEQ ID NO: 778518 - RNA, 18 nt, Homo sapiens
ugucgguuaccucugcau

SEQ ID NO: 778519 - RNA, 17 nt, Homo sapiens
uucucuuugguguuaca

SEQ ID NO: 778520 - RNA, 15 nt, Homo sapiens
uucugaaaaaguauc

SEQ ID NO: 778521 - RNA, 13 nt, Homo sapiens
uucugaauucaua

SEQ ID NO: 778522 - RNA, 23 nt, Homo sapiens
uucugaauucauaaaaauaacca

SEQ ID NO: 778523 - RNA, 23 nt, Homo sapiens
uucugacgucagcgcaccaaaac

SEQ ID NO: 778524 - RNA, 22 nt, Homo sapiens
uucugagaguuggcucaggcag

SEQ ID NO: 778525 - RNA, 17 nt, Homo sapiens
uucugagaucuguugau

SEQ ID NO: 778526 - RNA, 14 nt, Homo sapiens
uucugagcacuguu

SEQ ID NO: 778527 - RNA, 20 nt, Homo sapiens
uucugauaaaagauggccau

SEQ ID NO: 778528 - RNA, 18 nt, Homo sapiens
uucugauaaaguuccuua

SEQ ID NO: 778529 - RNA, 16 nt, Homo sapiens
uucugauaccacugca

SEQ ID NO: 778530 - RNA, 19 nt, Homo sapiens
uucugauggccagcaaaug

SEQ ID NO: 778531 - RNA, 17 nt, Homo sapiens
uucugauuggugauuca

SEQ ID NO: 778532 - RNA, 15 nt, Homo sapiens
uucugcaccaacuca

SEQ ID NO: 778533 - RNA, 11 nt, Homo sapiens
uucugcacuga

SEQ ID NO: 778534 - RNA, 14 nt, Homo sapiens
uucugccacuccau

SEQ ID NO: 778535 - RNA, 15 nt, Homo sapiens
uucugcccaugggaa

SEQ ID NO: 778536 - RNA, 14 nt, Homo sapiens
uucugccugagauu

SEQ ID NO: 778537 - RNA, 19 nt, Homo sapiens
uucugccuucucaugaucc

SEQ ID NO: 778538 - RNA, 15 nt, Homo sapiens
uucugcguguguaua

SEQ ID NO: 778539 - RNA, 18 nt, Homo sapiens
uucugcuaugaccaugac

SEQ ID NO: 778540 - RNA, 14 nt, Homo sapiens
uucugcucugccau

SEQ ID NO: 778541 - RNA, 23 nt, Homo sapiens
uucugcuguuuuuuuugcugcua

SEQ ID NO: 778542 - RNA, 21 nt, Homo sapiens
uucuggacauucucuuugaua

SEQ ID NO: 778543 - RNA, 16 nt, Homo sapiens
uucuggaccugggcau

SEQ ID NO: 778544 - RNA, 22 nt, Homo sapiens
uucuggacuacacccaagccug

SEQ ID NO: 778545 - RNA, 21 nt, Homo sapiens
uucuggacucccacucuuuga

SEQ ID NO: 778546 - RNA, 17 nt, Homo sapiens
uucuggagugagcacuc

SEQ ID NO: 778547 - RNA, 23 nt, Homo sapiens
uucuggauugugguuccaugcag

SEQ ID NO: 778548 - RNA, 20 nt, Homo sapiens
uucuggauuucauacuguaa

SEQ ID NO: 778549 - RNA, 21 nt, Homo sapiens
uucuggcaaacguuucucaaa

SEQ ID NO: 778550 - RNA, 16 nt, Homo sapiens
uucuggccggugcugg

SEQ ID NO: 778551 - RNA, 20 nt, Homo sapiens
uucuggcuucagcccccacc

SEQ ID NO: 778552 - RNA, 17 nt, Homo sapiens
uucugggcuucaucugg

SEQ ID NO: 778553 - RNA, 20 nt, Homo sapiens
uucuggggaaagacacugcc

SEQ ID NO: 778554 - RNA, 16 nt, Homo sapiens
uucuggguccugaaga

SEQ ID NO: 778555 - RNA, 15 nt, Homo sapiens
uucugggugugucca

SEQ ID NO: 778556 - RNA, 22 nt, Homo sapiens
uucuggucuggcggcugugcau

SEQ ID NO: 778557 - RNA, 14 nt, Homo sapiens
uucuggugccauuu

SEQ ID NO: 778558 - RNA, 15 nt, Homo sapiens
uucuggugggacaau

SEQ ID NO: 778559 - RNA, 16 nt, Homo sapiens
uucuguaaaacagguu

SEQ ID NO: 778560 - RNA, 14 nt, Homo sapiens
uucuguaguacucc

SEQ ID NO: 778561 - RNA, 21 nt, Homo sapiens
uucugucagggguuucuucaa

SEQ ID NO: 778562 - RNA, 21 nt, Homo sapiens
uucuguccuuuuggcacugag

SEQ ID NO: 778563 - RNA, 16 nt, Homo sapiens
uucugucuggagugac

SEQ ID NO: 778564 - RNA, 13 nt, Homo sapiens
uucugucuuccua

SEQ ID NO: 778565 - RNA, 18 nt, Homo sapiens
uucugucuuuauaaucua

SEQ ID NO: 778566 - RNA, 16 nt, Homo sapiens
uucugugacugaagaa

SEQ ID NO: 778567 - RNA, 17 nt, Homo sapiens
uucugugcagagaugac

SEQ ID NO: 778568 - RNA, 23 nt, Homo sapiens
uucugugcagagaugacugucca

SEQ ID NO: 778569 - RNA, 12 nt, Homo sapiens
uucuguggcuca

SEQ ID NO: 778570 - RNA, 17 nt, Homo sapiens
uucuguucucauuugau

SEQ ID NO: 778571 - RNA, 14 nt, Homo sapiens
uucuguuguuccau

SEQ ID NO: 778572 - RNA, 18 nt, Homo sapiens
uucuuaaaaaacauauau

SEQ ID NO: 778573 - RNA, 17 nt, Homo sapiens
uucuuaaagaguucuua

SEQ ID NO: 778574 - RNA, 13 nt, Homo sapiens
uucuuaaccaaga

SEQ ID NO: 778575 - RNA, 13 nt, Homo sapiens
uucuuaagacaug

SEQ ID NO: 778576 - RNA, 18 nt, Homo sapiens
uucuuaauccaguucugc

SEQ ID NO: 778577 - RNA, 19 nt, Homo sapiens
uucuuacaauugcacugcu

SEQ ID NO: 778578 - RNA, 19 nt, Homo sapiens
uucuuacccuguccuccac

SEQ ID NO: 778579 - RNA, 20 nt, Homo sapiens
uucuuagauacacuaaaaau

SEQ ID NO: 778580 - RNA, 18 nt, Homo sapiens
uucuuagguuuacuguga

SEQ ID NO: 778581 - RNA, 22 nt, Homo sapiens
uucuuauagaaccccuucugac

SEQ ID NO: 778582 - RNA, 14 nt, Homo sapiens
uucuuauugacaau

SEQ ID NO: 778583 - RNA, 17 nt, Homo sapiens
uucuuauuuugcauucc

SEQ ID NO: 778584 - RNA, 11 nt, Homo sapiens
uucuuccaaaa

SEQ ID NO: 778585 - RNA, 21 nt, Homo sapiens
uucuuccaucaucacuguaaa

SEQ ID NO: 778586 - RNA, 23 nt, Homo sapiens
uucuucccccacuuccccuccaa

SEQ ID NO: 778587 - RNA, 21 nt, Homo sapiens
uucuucugaagaucagaacau

SEQ ID NO: 778588 - RNA, 19 nt, Homo sapiens
uucuugaaauuuuaaccua

SEQ ID NO: 778589 - RNA, 14 nt, Homo sapiens
uucuugaagacauc

SEQ ID NO: 778590 - RNA, 21 nt, Homo sapiens
uucuugccugaacuccugcca

SEQ ID NO: 778591 - RNA, 19 nt, Homo sapiens
uucuugcuggucuagucac

SEQ ID NO: 778592 - RNA, 19 nt, Homo sapiens
uucuuggagcuuuggaaua

SEQ ID NO: 778593 - RNA, 17 nt, Homo sapiens
uucuugguaacugauua

SEQ ID NO: 778594 - RNA, 17 nt, Homo sapiens
uucuuguagaugcauua

SEQ ID NO: 778595 - RNA, 22 nt, Homo sapiens
uucuuguugugccccuuuccaa

SEQ ID NO: 778596 - RNA, 21 nt, Homo sapiens
uucuuguuugucagcaucuga

SEQ ID NO: 778597 - RNA, 13 nt, Homo sapiens
uucuuuaccucag

SEQ ID NO: 778598 - RNA, 23 nt, Homo sapiens
uucuuuacuaaagauaucagagc

SEQ ID NO: 778599 - RNA, 21 nt, Homo sapiens
uucuuuacuuaucucucaaaa

SEQ ID NO: 778600 - RNA, 22 nt, Homo sapiens
uucuuuagaauuuuuacccaau

SEQ ID NO: 778601 - RNA, 15 nt, Homo sapiens
uucuuuaucuugaca

SEQ ID NO: 778602 - RNA, 13 nt, Homo sapiens
uucuuucaaagga

SEQ ID NO: 778603 - RNA, 14 nt, Homo sapiens
uucuuuccauaaua

SEQ ID NO: 778604 - RNA, 16 nt, Homo sapiens
uucuuucuuaguccag

SEQ ID NO: 778605 - RNA, 20 nt, Homo sapiens
uucuuugacauuugguggua

SEQ ID NO: 778606 - RNA, 18 nt, Homo sapiens
uucuuugacuuaaugucu

SEQ ID NO: 778607 - RNA, 16 nt, Homo sapiens
uucuuugcaccaaaga

SEQ ID NO: 778608 - RNA, 12 nt, Homo sapiens
uucuuugcccac

SEQ ID NO: 778609 - RNA, 16 nt, Homo sapiens
uucuuugcugcaguca

SEQ ID NO: 778610 - RNA, 14 nt, Homo sapiens
uucuuuggaggcag

SEQ ID NO: 778611 - RNA, 20 nt, Homo sapiens
uucuuugggauugcuaugaa

SEQ ID NO: 778612 - RNA, 17 nt, Homo sapiens
uucuuuguaccaucugu

SEQ ID NO: 778613 - RNA, 21 nt, Homo sapiens
uucuuuguuuggauugcagca

SEQ ID NO: 778614 - RNA, 17 nt, Homo sapiens
uucuuuuaaugaugcca

SEQ ID NO: 778615 - RNA, 19 nt, Homo sapiens
uucuuuuauacugacacaa

SEQ ID NO: 778616 - RNA, 14 nt, Homo sapiens
uucuuuuugcucua

SEQ ID NO: 778617 - RNA, 15 nt, Homo sapiens
uucuuuuugcucuaa

SEQ ID NO: 778618 - RNA, 15 nt, Homo sapiens
uucuuuuuguacuuu

SEQ ID NO: 778619 - RNA, 17 nt, Homo sapiens
uugaaaaaauagaucca

SEQ ID NO: 778620 - RNA, 17 nt, Homo sapiens
uugaaaaacugaguauu

SEQ ID NO: 778621 - RNA, 18 nt, Homo sapiens
uugaaaaauggcaaagaa

SEQ ID NO: 778622 - RNA, 13 nt, Homo sapiens
uugaaaacacuua

SEQ ID NO: 778623 - RNA, 12 nt, Homo sapiens
uugaaaaccugg

SEQ ID NO: 778624 - RNA, 13 nt, Homo sapiens
uugaaaaccuggc

SEQ ID NO: 778625 - RNA, 21 nt, Homo sapiens
uugaaaaggcgguacuaguuc

SEQ ID NO: 778626 - RNA, 19 nt, Homo sapiens
cuugcuuugggcuuugcag

SEQ ID NO: 778627 - RNA, 17 nt, Homo sapiens
cuuggaaagcugaugau

SEQ ID NO: 778628 - RNA, 17 nt, Homo sapiens
cuuggaacacauaagaa

SEQ ID NO: 778629 - RNA, 18 nt, Homo sapiens
cuuggaaccucauugcua

SEQ ID NO: 778630 - RNA, 16 nt, Homo sapiens
cuuggaauacguucuc

SEQ ID NO: 778631 - RNA, 17 nt, Homo sapiens
cuuggacguuggggcaa

SEQ ID NO: 778632 - RNA, 13 nt, Homo sapiens
cuuggacuugucc

SEQ ID NO: 778633 - RNA, 22 nt, Homo sapiens
cuuggagaaaauggguuuauuc

SEQ ID NO: 778634 - RNA, 21 nt, Homo sapiens
cuuggagaaugugagaagcca

SEQ ID NO: 778635 - RNA, 17 nt, Homo sapiens
cuuggagcccgugcagu

SEQ ID NO: 778636 - RNA, 13 nt, Homo sapiens
cuuggagcugucc

SEQ ID NO: 778637 - RNA, 19 nt, Homo sapiens
cuuggaggcugucuucuca

SEQ ID NO: 778638 - RNA, 23 nt, Homo sapiens
cuuggaggcugucuucucaggcu

SEQ ID NO: 778639 - RNA, 16 nt, Homo sapiens
cuuggauucucuaacc

SEQ ID NO: 778640 - RNA, 20 nt, Homo sapiens
cuuggcaccagacacccagg

SEQ ID NO: 778641 - RNA, 21 nt, Homo sapiens
cuuggcaccagacacccagga

SEQ ID NO: 778642 - RNA, 14 nt, Homo sapiens
cuuggcacuguuag

SEQ ID NO: 778643 - RNA, 19 nt, Homo sapiens
cuuggcagaggcagggaag

SEQ ID NO: 778644 - RNA, 21 nt, Homo sapiens
cuuggcauacaaaauauuuaa

SEQ ID NO: 778645 - RNA, 19 nt, Homo sapiens
cuuggcaugccuuccagca

SEQ ID NO: 778646 - RNA, 21 nt, Homo sapiens
cuuggcccacacugaggcuua

SEQ ID NO: 778647 - RNA, 24 nt, Homo sapiens
cuuggccccagacgcauagacuga

SEQ ID NO: 778648 - RNA, 17 nt, Homo sapiens
cuuggccuacagucauc

SEQ ID NO: 778649 - RNA, 13 nt, Homo sapiens
cuuggcugcauuu

SEQ ID NO: 778650 - RNA, 16 nt, Homo sapiens
cuuggcuuuaugcaaa

SEQ ID NO: 778651 - RNA, 19 nt, Homo sapiens
cuuggcuuuaugcaaauac

SEQ ID NO: 778652 - RNA, 21 nt, Homo sapiens
cuuggcuuuaugcaaauacaa

SEQ ID NO: 778653 - RNA, 21 nt, Homo sapiens
cuugggaaacuauucaugaau

SEQ ID NO: 778654 - RNA, 18 nt, Homo sapiens
cuugggagaccuguaauc

SEQ ID NO: 778655 - RNA, 21 nt, Homo sapiens
cuugggaugaugccucaugau

SEQ ID NO: 778656 - RNA, 21 nt, Homo sapiens
cuugggcacuuuuuaauucac

SEQ ID NO: 778657 - RNA, 20 nt, Homo sapiens
cuuggggagauggaguucuu

SEQ ID NO: 778658 - RNA, 17 nt, Homo sapiens
cuugggguaagccagag

SEQ ID NO: 778659 - RNA, 15 nt, Homo sapiens
cuuggggucacuccu

SEQ ID NO: 778660 - RNA, 12 nt, Homo sapiens
cuugguacccac

SEQ ID NO: 778661 - RNA, 20 nt, Homo sapiens
cuuggucuaugugcucugua

SEQ ID NO: 778662 - RNA, 17 nt, Homo sapiens
cuugguuaaaauggcua

SEQ ID NO: 778663 - RNA, 22 nt, Homo sapiens
cuugguuaaaauggcuacacuc

SEQ ID NO: 778664 - RNA, 16 nt, Homo sapiens
cuugguuccuucugcc

SEQ ID NO: 778665 - RNA, 20 nt, Homo sapiens
cuugguugucuggcaaggac

SEQ ID NO: 778666 - RNA, 17 nt, Homo sapiens
cuugguuuucccuuugc

SEQ ID NO: 778667 - RNA, 21 nt, Homo sapiens
cuugguuuuuauaccauucag

SEQ ID NO: 778668 - RNA, 21 nt, Homo sapiens
cuugguuuuuggcucuuucag

SEQ ID NO: 778669 - RNA, 15 nt, Homo sapiens
cuuguaaagacugua

SEQ ID NO: 778670 - RNA, 19 nt, Homo sapiens
cuuguaacuuaauauacua

SEQ ID NO: 778671 - RNA, 13 nt, Homo sapiens
cuuguaaguuauu

SEQ ID NO: 778672 - RNA, 15 nt, Homo sapiens
cuuguaauuguggau

SEQ ID NO: 778673 - RNA, 17 nt, Homo sapiens
cuugucaaagaaggugc

SEQ ID NO: 778674 - RNA, 15 nt, Homo sapiens
cuugucaaucccaac

SEQ ID NO: 778675 - RNA, 14 nt, Homo sapiens
cuugucaccuuuca

SEQ ID NO: 778676 - RNA, 14 nt, Homo sapiens
cuugucauccaccu

SEQ ID NO: 778677 - RNA, 14 nt, Homo sapiens
cuugucauguguau

SEQ ID NO: 778678 - RNA, 13 nt, Homo sapiens
cuugucauuccag

SEQ ID NO: 778679 - RNA, 15 nt, Homo sapiens
cuugucauuccagag

SEQ ID NO: 778680 - RNA, 22 nt, Homo sapiens
cuugucauuuuuaauauuacug

SEQ ID NO: 778681 - RNA, 15 nt, Homo sapiens
cuuguccauguaaua

SEQ ID NO: 778682 - RNA, 23 nt, Homo sapiens
cuuguccgcugggugguacccuc

SEQ ID NO: 778683 - RNA, 16 nt, Homo sapiens
cuuguccucauucuug

SEQ ID NO: 778684 - RNA, 21 nt, Homo sapiens
cuugucgggguggggguggga

SEQ ID NO: 778685 - RNA, 23 nt, Homo sapiens
cuugucuaaauaaguuugcaauu

SEQ ID NO: 778686 - RNA, 13 nt, Homo sapiens
cuugucugcuaaa

SEQ ID NO: 778687 - RNA, 14 nt, Homo sapiens
cuugucugcuaaau

SEQ ID NO: 778688 - RNA, 21 nt, Homo sapiens
cuugucuuuugagcuauucac

SEQ ID NO: 778689 - RNA, 19 nt, Homo sapiens
cuuguggaugacucuguaa

SEQ ID NO: 778690 - RNA, 16 nt, Homo sapiens
cuugugggagacagca

SEQ ID NO: 778691 - RNA, 23 nt, Homo sapiens
cuugugguugaaaaccacaguca

SEQ ID NO: 778692 - RNA, 19 nt, Homo sapiens
cuugugucaagacauuucu

SEQ ID NO: 778693 - RNA, 15 nt, Homo sapiens
cuugugucccaugau

SEQ ID NO: 778694 - RNA, 22 nt, Homo sapiens
cuugugucugcggggaucagag

SEQ ID NO: 778695 - RNA, 19 nt, Homo sapiens
cuugugugugggcugugag

SEQ ID NO: 778696 - RNA, 21 nt, Homo sapiens
cuugugugugggcugugagug

SEQ ID NO: 778697 - RNA, 19 nt, Homo sapiens
cuuguguuauuuaaugagu

SEQ ID NO: 778698 - RNA, 16 nt, Homo sapiens
cuuguuccccacugac

SEQ ID NO: 778699 - RNA, 23 nt, Homo sapiens
cuuguuccccacugacagccucc

SEQ ID NO: 778700 - RNA, 17 nt, Homo sapiens
cuuguucuguacuugua

SEQ ID NO: 778701 - RNA, 11 nt, Homo sapiens
cuuguucuguc

SEQ ID NO: 778702 - RNA, 16 nt, Homo sapiens
cuuguuguaaaaagcc

SEQ ID NO: 778703 - RNA, 17 nt, Homo sapiens
cuuguuguuauugaugu

SEQ ID NO: 778704 - RNA, 22 nt, Homo sapiens
cuuguuguugaacauggcuaaa

SEQ ID NO: 778705 - RNA, 16 nt, Homo sapiens
cuuguuuacagcacua

SEQ ID NO: 778706 - RNA, 24 nt, Homo sapiens
cuuguuuacagcacuacucugugc

SEQ ID NO: 778707 - RNA, 23 nt, Homo sapiens
cuuguuucacacuagucacauuc

SEQ ID NO: 778708 - RNA, 13 nt, Homo sapiens
cuuguuucacuga

SEQ ID NO: 778709 - RNA, 20 nt, Homo sapiens
cuuguuugguaguuagccau

SEQ ID NO: 778710 - RNA, 15 nt, Homo sapiens
cuuguuugucuucca

SEQ ID NO: 778711 - RNA, 16 nt, Homo sapiens
cuuguuugucuuccau

SEQ ID NO: 778712 - RNA, 19 nt, Homo sapiens
cuuguuuuaaguugcuuua

SEQ ID NO: 778713 - RNA, 22 nt, Homo sapiens
cuuguuuuacccuauacaucca

SEQ ID NO: 778714 - RNA, 20 nt, Homo sapiens
cuuguuuuauauaccuggcu

SEQ ID NO: 778715 - RNA, 15 nt, Homo sapiens
cuuuaaaaagauauu

SEQ ID NO: 778716 - RNA, 20 nt, Homo sapiens
cuuuaaaauauaucuggaac

SEQ ID NO: 778717 - RNA, 16 nt, Homo sapiens
cuuuaaacaaauucau

SEQ ID NO: 778718 - RNA, 16 nt, Homo sapiens
cuuuaaaggcaucuac

SEQ ID NO: 778719 - RNA, 13 nt, Homo sapiens
uguagccagguac

SEQ ID NO: 778720 - RNA, 10 nt, Homo sapiens
uguagccaug

SEQ ID NO: 778721 - RNA, 17 nt, Homo sapiens
uguagcuguaagggcag

SEQ ID NO: 778722 - RNA, 20 nt, Homo sapiens
uguagcuuuaaaaccacagc

SEQ ID NO: 778723 - RNA, 15 nt, Homo sapiens
uguagcuuugcucuu

SEQ ID NO: 778724 - RNA, 20 nt, Homo sapiens
uguaggaaauguaagauuuc

SEQ ID NO: 778725 - RNA, 18 nt, Homo sapiens
uguaggguccaaccagac

SEQ ID NO: 778726 - RNA, 13 nt, Homo sapiens
uguagguccucag

SEQ ID NO: 778727 - RNA, 16 nt, Homo sapiens
uguaggugucugccuu

SEQ ID NO: 778728 - RNA, 21 nt, Homo sapiens
uguagucccagcuacuuggga

SEQ ID NO: 778729 - RNA, 13 nt, Homo sapiens
uguagugagccaa

SEQ ID NO: 778730 - RNA, 14 nt, Homo sapiens
uguaguuuaguucu

SEQ ID NO: 778731 - RNA, 18 nt, Homo sapiens
uguauaaagauuguacuu

SEQ ID NO: 778732 - RNA, 20 nt, Homo sapiens
uguauaaguugaaggaaaau

SEQ ID NO: 778733 - RNA, 17 nt, Homo sapiens
uguauacuccugucacc

SEQ ID NO: 778734 - RNA, 22 nt, Homo sapiens
uguauaguuuuauuuacuucug

SEQ ID NO: 778735 - RNA, 15 nt, Homo sapiens
uguauauacauauau

SEQ ID NO: 778736 - RNA, 15 nt, Homo sapiens
uguauauacuuuuaa

SEQ ID NO: 778737 - RNA, 18 nt, Homo sapiens
uguauauagaguggaauc

SEQ ID NO: 778738 - RNA, 13 nt, Homo sapiens
uguauauguauuc

SEQ ID NO: 778739 - RNA, 16 nt, Homo sapiens
uguauauuacauacau

SEQ ID NO: 778740 - RNA, 15 nt, Homo sapiens
uguauauuuguacaa

SEQ ID NO: 778741 - RNA, 15 nt, Homo sapiens
uguaucaaguggcau

SEQ ID NO: 778742 - RNA, 13 nt, Homo sapiens
uguauccaugcac

SEQ ID NO: 778743 - RNA, 17 nt, Homo sapiens
uguaucggagacaguga

SEQ ID NO: 778744 - RNA, 17 nt, Homo sapiens
uguaugaaaaguaacug

SEQ ID NO: 778745 - RNA, 19 nt, Homo sapiens
uguaugaaagagcaaguga

SEQ ID NO: 778746 - RNA, 14 nt, Homo sapiens
uguaugacagugaa

SEQ ID NO: 778747 - RNA, 15 nt, Homo sapiens
uguaugagcuucuaa

SEQ ID NO: 778748 - RNA, 20 nt, Homo sapiens
uguauggaaucccacuguau

SEQ ID NO: 778749 - RNA, 14 nt, Homo sapiens
uguaugguuccaaa

SEQ ID NO: 778750 - RNA, 17 nt, Homo sapiens
uguauguguguagacaa

SEQ ID NO: 778751 - RNA, 19 nt, Homo sapiens
uguauuaauaaagcauucu

SEQ ID NO: 778752 - RNA, 19 nt, Homo sapiens
uguauuaauccccaucauu

SEQ ID NO: 778753 - RNA, 13 nt, Homo sapiens
uguauuacugcuu

SEQ ID NO: 778754 - RNA, 13 nt, Homo sapiens
uguauugagcaag

SEQ ID NO: 778755 - RNA, 13 nt, Homo sapiens
uguauugauucaa

SEQ ID NO: 778756 - RNA, 18 nt, Homo sapiens
uguauuggcuaugauggu

SEQ ID NO: 778757 - RNA, 15 nt, Homo sapiens
uguauuguggaacac

SEQ ID NO: 778758 - RNA, 17 nt, Homo sapiens
uguauuuuagacuuccu

SEQ ID NO: 778759 - RNA, 17 nt, Homo sapiens
uguauuuuauuacaucu

SEQ ID NO: 778760 - RNA, 23 nt, Homo sapiens
uguauuuuauuacaucuuucaca

SEQ ID NO: 778761 - RNA, 17 nt, Homo sapiens
ugucaaaagccagaugu

SEQ ID NO: 778762 - RNA, 14 nt, Homo sapiens
ugucaacagaauuu

SEQ ID NO: 778763 - RNA, 22 nt, Homo sapiens
ugucaacaucaaagagcacauu

SEQ ID NO: 778764 - RNA, 13 nt, Homo sapiens
ugucaacuaccca

SEQ ID NO: 778765 - RNA, 22 nt, Homo sapiens
ugucaagaagcguuaugugcag

SEQ ID NO: 778766 - RNA, 20 nt, Homo sapiens
ugucaagcugaaaacaaaca

SEQ ID NO: 778767 - RNA, 20 nt, Homo sapiens
ugucaagcugcucugagcca

SEQ ID NO: 778768 - RNA, 22 nt, Homo sapiens
ugucaagcugcucugagccaca

SEQ ID NO: 778769 - RNA, 16 nt, Homo sapiens
ugucaaugacaguuuc

SEQ ID NO: 778770 - RNA, 18 nt, Homo sapiens
ugucaaugccugucuuag

SEQ ID NO: 778771 - RNA, 13 nt, Homo sapiens
ugucaaugugaac

SEQ ID NO: 778772 - RNA, 12 nt, Homo sapiens
ugucacacaaaa

SEQ ID NO: 778773 - RNA, 12 nt, Homo sapiens
ugucacagccug

SEQ ID NO: 778774 - RNA, 20 nt, Homo sapiens
ugucacauagagugaucuuu

SEQ ID NO: 778775 - RNA, 14 nt, Homo sapiens
ugucaccagcaaca

SEQ ID NO: 778776 - RNA, 22 nt, Homo sapiens
ugucaccuacgugccacuccug

SEQ ID NO: 778777 - RNA, 16 nt, Homo sapiens
ugucacuaaacugaaa

SEQ ID NO: 778778 - RNA, 15 nt, Homo sapiens
ugucacuagucucac

SEQ ID NO: 778779 - RNA, 16 nt, Homo sapiens
ugucacucugugccuu

SEQ ID NO: 778780 - RNA, 20 nt, Homo sapiens
ugucagacugcucuuucaua

SEQ ID NO: 778781 - RNA, 13 nt, Homo sapiens
ugucagcaucuga

SEQ ID NO: 778782 - RNA, 16 nt, Homo sapiens
ugucagcaucugacca

SEQ ID NO: 778783 - RNA, 17 nt, Homo sapiens
ugucagcaucugaccau

SEQ ID NO: 778784 - RNA, 20 nt, Homo sapiens
ugucagcaucugaccaucug

SEQ ID NO: 778785 - RNA, 14 nt, Homo sapiens
ugucaggacaccag

SEQ ID NO: 778786 - RNA, 19 nt, Homo sapiens
ugucaguaguggacauugu

SEQ ID NO: 778787 - RNA, 19 nt, Homo sapiens
ugucauaccagaaagcucu

SEQ ID NO: 778788 - RNA, 20 nt, Homo sapiens
ugucauagaaagugccagaa

SEQ ID NO: 778789 - RNA, 15 nt, Homo sapiens
ugucauagagcugca

SEQ ID NO: 778790 - RNA, 20 nt, Homo sapiens
ugucauagccaaagccaggc

SEQ ID NO: 778791 - RNA, 12 nt, Homo sapiens
ugucaugaagaa

SEQ ID NO: 778792 - RNA, 14 nt, Homo sapiens
ugucaugcagagua

SEQ ID NO: 778793 - RNA, 14 nt, Homo sapiens
ugucauuccagagu

SEQ ID NO: 778794 - RNA, 22 nt, Homo sapiens
ugucauuccccuuugcacugua

SEQ ID NO: 778795 - RNA, 20 nt, Homo sapiens
ugucauugcgaccauuucuc

SEQ ID NO: 778796 - RNA, 21 nt, Homo sapiens
ugucauugcgaccauuucuca

SEQ ID NO: 778797 - RNA, 18 nt, Homo sapiens
ugucauugucuacuccua

SEQ ID NO: 778798 - RNA, 16 nt, Homo sapiens
ugucauuuugcacugu

SEQ ID NO: 778799 - RNA, 18 nt, Homo sapiens
ugucauuuuuaacagcau

SEQ ID NO: 778800 - RNA, 11 nt, Homo sapiens
uguccaaagag

SEQ ID NO: 778801 - RNA, 17 nt, Homo sapiens
uguccaaagaggcugcc

SEQ ID NO: 778802 - RNA, 23 nt, Homo sapiens
uguccaaauggacauaagacaga

SEQ ID NO: 778803 - RNA, 14 nt, Homo sapiens
uguccaacauggug

SEQ ID NO: 778804 - RNA, 14 nt, Homo sapiens
uguccaagugccac

SEQ ID NO: 778805 - RNA, 20 nt, Homo sapiens
uguccacaugaccuccauuu

SEQ ID NO: 778806 - RNA, 13 nt, Homo sapiens
uguccagcagcug

SEQ ID NO: 778807 - RNA, 22 nt, Homo sapiens
uguccagccaagggcugagugu

SEQ ID NO: 778808 - RNA, 19 nt, Homo sapiens
uguccagcuuauagucuuc

SEQ ID NO: 778809 - RNA, 14 nt, Homo sapiens
uguccaggcagcuc

SEQ ID NO: 778810 - RNA, 16 nt, Homo sapiens
uguccaggguccucua

SEQ ID NO: 778811 - RNA, 17 nt, Homo sapiens
uguccaggguccucuag

SEQ ID NO: 778812 - RNA, 17 nt, Homo sapiens
ugucccaaccccagugg

SEQ ID NO: 778813 - RNA, 18 nt, Homo sapiens
ugucccaccaacuuaaaa

SEQ ID NO: 778814 - RNA, 17 nt, Homo sapiens
ugucccagaaaugucau

SEQ ID NO: 778815 - RNA, 18 nt, Homo sapiens
ugucccagaaugccuccu

SEQ ID NO: 778816 - RNA, 12 nt, Homo sapiens
ugucccagagag

SEQ ID NO: 778817 - RNA, 15 nt, Homo sapiens
ugucccauucuagau

SEQ ID NO: 778818 - RNA, 18 nt, Homo sapiens
ugucccccaacuugagau

SEQ ID NO: 778819 - RNA, 16 nt, Homo sapiens
ugucccucacuguuga

SEQ ID NO: 778820 - RNA, 21 nt, Homo sapiens
ugucccucuccuauguggcag

SEQ ID NO: 778821 - RNA, 20 nt, Homo sapiens
aaauauucuacacauguaaa

SEQ ID NO: 778822 - RNA, 22 nt, Homo sapiens
aaauauuguauaaagcauuugu

SEQ ID NO: 778823 - RNA, 12 nt, Homo sapiens
aaauauugucau

SEQ ID NO: 778824 - RNA, 20 nt, Homo sapiens
aaauauugucauaggauuaa

SEQ ID NO: 778825 - RNA, 19 nt, Homo sapiens
aaauauuucaagacauuaa

SEQ ID NO: 778826 - RNA, 23 nt, Homo sapiens
aaauauuucccauuugugccaga

SEQ ID NO: 778827 - RNA, 15 nt, Homo sapiens
aaauauuucccucac

SEQ ID NO: 778828 - RNA, 18 nt, Homo sapiens
aaauauuugcuaugaagc

SEQ ID NO: 778829 - RNA, 17 nt, Homo sapiens
aaauauuuuaaaaucag

SEQ ID NO: 778830 - RNA, 13 nt, Homo sapiens
aaauauuuugcua

SEQ ID NO: 778831 - RNA, 13 nt, Homo sapiens
aaaucaacacuuu

SEQ ID NO: 778832 - RNA, 19 nt, Homo sapiens
aaaucacaaggcaacugug

SEQ ID NO: 778833 - RNA, 16 nt, Homo sapiens
aaaucaccacaaccaa

SEQ ID NO: 778834 - RNA, 13 nt, Homo sapiens
aaaucacucucag

SEQ ID NO: 778835 - RNA, 16 nt, Homo sapiens
aaaucacucucagugc

SEQ ID NO: 778836 - RNA, 21 nt, Homo sapiens
aaaucagacgggcacaguggu

SEQ ID NO: 778837 - RNA, 23 nt, Homo sapiens
aaaucagcaugcccgccuaguua

SEQ ID NO: 778838 - RNA, 16 nt, Homo sapiens
aaaucagccauaagaa

SEQ ID NO: 778839 - RNA, 14 nt, Homo sapiens
aaaucaguuacuaa

SEQ ID NO: 778840 - RNA, 14 nt, Homo sapiens
gccagugcacuccg

SEQ ID NO: 778841 - RNA, 18 nt, Homo sapiens
gccagugccagcaccugc

SEQ ID NO: 778842 - RNA, 21 nt, Homo sapiens
gccagugggacccucucagaa

SEQ ID NO: 778843 - RNA, 16 nt, Homo sapiens
gccauaagaaagcacu

SEQ ID NO: 778844 - RNA, 14 nt, Homo sapiens
gccauaagagguga

SEQ ID NO: 778845 - RNA, 16 nt, Homo sapiens
gccauaaugacucaga

SEQ ID NO: 778846 - RNA, 13 nt, Homo sapiens
gccauaauguugc

SEQ ID NO: 778847 - RNA, 17 nt, Homo sapiens
gccauaauucuaaguua

SEQ ID NO: 778848 - RNA, 13 nt, Homo sapiens
gccauacugccuu

SEQ ID NO: 778849 - RNA, 14 nt, Homo sapiens
gccauacuuuacaa

SEQ ID NO: 778850 - RNA, 20 nt, Homo sapiens
gccauaguggaucacucacc

SEQ ID NO: 778851 - RNA, 14 nt, Homo sapiens
gccauauuaccccu

SEQ ID NO: 778852 - RNA, 19 nt, Homo sapiens
gccauauuguguaauuuaa

SEQ ID NO: 778853 - RNA, 21 nt, Homo sapiens
gccaucaaagaguccuggacg

SEQ ID NO: 778854 - RNA, 14 nt, Homo sapiens
gccaucaagcacuu

SEQ ID NO: 778855 - RNA, 18 nt, Homo sapiens
gccaucacuagaagaaaa

SEQ ID NO: 778856 - RNA, 15 nt, Homo sapiens
gccaucagccuggau

SEQ ID NO: 778857 - RNA, 14 nt, Homo sapiens
gccauccaugugcu

SEQ ID NO: 778858 - RNA, 23 nt, Homo sapiens
gccaucccuuuuuuuacauuuca

SEQ ID NO: 778859 - RNA, 18 nt, Homo sapiens
gccauccuaaaagccacc

SEQ ID NO: 778860 - RNA, 17 nt, Homo sapiens
gccauccucacccagca

SEQ ID NO: 778861 - RNA, 17 nt, Homo sapiens
gccauccucccaagggg

SEQ ID NO: 778862 - RNA, 22 nt, Homo sapiens
gccaucugacugccaagccaga

SEQ ID NO: 778863 - RNA, 23 nt, Homo sapiens
gccaucuuuaucaugaagcacau

SEQ ID NO: 778864 - RNA, 19 nt, Homo sapiens
gccaugaggagcguggacu

SEQ ID NO: 778865 - RNA, 20 nt, Homo sapiens
gccaugaucaugccacugca

SEQ ID NO: 778866 - RNA, 21 nt, Homo sapiens
gccaugcaacgggauugaagg

SEQ ID NO: 778867 - RNA, 13 nt, Homo sapiens
gccaugccaggaa

SEQ ID NO: 778868 - RNA, 23 nt, Homo sapiens
gccaugccaggccagagggcagu

SEQ ID NO: 778869 - RNA, 18 nt, Homo sapiens
gccauguaucaauauuca

SEQ ID NO: 778870 - RNA, 15 nt, Homo sapiens
gccauguccaaagag

SEQ ID NO: 778871 - RNA, 23 nt, Homo sapiens
gccauguuucaagaaaauggauu

SEQ ID NO: 778872 - RNA, 20 nt, Homo sapiens
gccauuaugcaaauggagau

SEQ ID NO: 778873 - RNA, 12 nt, Homo sapiens
gccauucauuca

SEQ ID NO: 778874 - RNA, 15 nt, Homo sapiens
gccauugcuuaccuu

SEQ ID NO: 778875 - RNA, 22 nt, Homo sapiens
gccauuuaaguaucuugugcuu

SEQ ID NO: 778876 - RNA, 16 nt, Homo sapiens
gcccaaauucuuucag

SEQ ID NO: 778877 - RNA, 23 nt, Homo sapiens
gcccaagugauccuuccaccuca

SEQ ID NO: 778878 - RNA, 21 nt, Homo sapiens
gcccacacacuuuccaucucu

SEQ ID NO: 778879 - RNA, 13 nt, Homo sapiens
gcccacacccagg

SEQ ID NO: 778880 - RNA, 21 nt, Homo sapiens
gcccacauguguccaucccag

SEQ ID NO: 778881 - RNA, 20 nt, Homo sapiens
gcccacccgucuucaaucuc

SEQ ID NO: 778882 - RNA, 19 nt, Homo sapiens
gcccaccugugaucccagc

SEQ ID NO: 778883 - RNA, 20 nt, Homo sapiens
gcccaccugugaucccagcu

SEQ ID NO: 778884 - RNA, 18 nt, Homo sapiens
gcccacggcucaagugaa

SEQ ID NO: 778885 - RNA, 19 nt, Homo sapiens
gcccacuguuaauauucua

SEQ ID NO: 778886 - RNA, 20 nt, Homo sapiens
gcccagacaccaugugcaau

SEQ ID NO: 778887 - RNA, 19 nt, Homo sapiens
gcccagaccacugucucca

SEQ ID NO: 778888 - RNA, 14 nt, Homo sapiens
gcccagacccagug

SEQ ID NO: 778889 - RNA, 22 nt, Homo sapiens
gcccagacgcagcugagucgga

SEQ ID NO: 778890 - RNA, 20 nt, Homo sapiens
gcccagagaagccaaaagau

SEQ ID NO: 778891 - RNA, 14 nt, Homo sapiens
gcccagagcccggu

SEQ ID NO: 778892 - RNA, 15 nt, Homo sapiens
gcccagagccuggcu

SEQ ID NO: 778893 - RNA, 21 nt, Homo sapiens
gcccagaguugcugugccgug

SEQ ID NO: 778894 - RNA, 14 nt, Homo sapiens
gcccagaugaucac

SEQ ID NO: 778895 - RNA, 12 nt, Homo sapiens
gcccagcacuug

SEQ ID NO: 778896 - RNA, 21 nt, Homo sapiens
gcccagcaggcccagcaugca

SEQ ID NO: 778897 - RNA, 20 nt, Homo sapiens
gcccagcagggccucaaagu

SEQ ID NO: 778898 - RNA, 17 nt, Homo sapiens
gcccagcaugcaggugg

SEQ ID NO: 778899 - RNA, 22 nt, Homo sapiens
gcccagccaggccaacagcacc

SEQ ID NO: 778900 - RNA, 20 nt, Homo sapiens
gcccagccauuaccauggag

SEQ ID NO: 778901 - RNA, 13 nt, Homo sapiens
gcccagcccagcu

SEQ ID NO: 778902 - RNA, 16 nt, Homo sapiens
gcccagccucaucucu

SEQ ID NO: 778903 - RNA, 13 nt, Homo sapiens
gcccagccuggga

SEQ ID NO: 778904 - RNA, 22 nt, Homo sapiens
gcccagcggccccucccacaca

SEQ ID NO: 778905 - RNA, 15 nt, Homo sapiens
gcccagcugcaccug

SEQ ID NO: 778906 - RNA, 16 nt, Homo sapiens
gcccagcuugggccca

SEQ ID NO: 778907 - RNA, 22 nt, Homo sapiens
gcccagcuuuuagaaaaugcag

SEQ ID NO: 778908 - RNA, 17 nt, Homo sapiens
gcccaggaaacaagggg

SEQ ID NO: 778909 - RNA, 15 nt, Homo sapiens
gcccaggcaggccac

SEQ ID NO: 778910 - RNA, 14 nt, Homo sapiens
gcccaggcagucuu

SEQ ID NO: 778911 - RNA, 19 nt, Homo sapiens
gcccaggccagagugcagu

SEQ ID NO: 778912 - RNA, 20 nt, Homo sapiens
gcccaggcuggagugcaaug

SEQ ID NO: 778913 - RNA, 18 nt, Homo sapiens
gcccaggcuggagugcag

SEQ ID NO: 778914 - RNA, 20 nt, Homo sapiens
gcccaggcuggagugcagug

SEQ ID NO: 778915 - RNA, 16 nt, Homo sapiens
gcccagggaagccaaa

SEQ ID NO: 778916 - RNA, 15 nt, Homo sapiens
gcccagggcaucuug

SEQ ID NO: 778917 - RNA, 20 nt, Homo sapiens
gcccagggccacucugccuc

SEQ ID NO: 778918 - RNA, 12 nt, Homo sapiens
gcccagggccag

SEQ ID NO: 778919 - RNA, 16 nt, Homo sapiens
gcccaggguguuugca

SEQ ID NO: 778920 - RNA, 15 nt, Homo sapiens
gcccaggugugcagg

SEQ ID NO: 778921 - RNA, 16 nt, Homo sapiens
gcccagugcauaugca

SEQ ID NO: 778922 - RNA, 12 nt, Homo sapiens
gcccagugcaug

SEQ ID NO: 778923 - RNA, 16 nt, Homo sapiens
gcccauagcacugggc

SEQ ID NO: 778924 - RNA, 14 nt, Homo sapiens
gcccauaucuguga

SEQ ID NO: 778925 - RNA, 22 nt, Homo sapiens
gcccaucacaggguugggccca

SEQ ID NO: 778926 - RNA, 14 nt, Homo sapiens
gcccaucacuguau

SEQ ID NO: 778927 - RNA, 21 nt, Homo sapiens
gcccaucagggcccagggagc

SEQ ID NO: 778928 - RNA, 18 nt, Homo sapiens
gcccaucucaggugccac

SEQ ID NO: 778929 - RNA, 19 nt, Homo sapiens
gcccaugcccaccugccca

SEQ ID NO: 778930 - RNA, 16 nt, Homo sapiens
gcccaugugcaccugc

SEQ ID NO: 778931 - RNA, 22 nt, Homo sapiens
gcccauugucuuauuggcacau

SEQ ID NO: 778932 - RNA, 16 nt, Homo sapiens
gcccauuuaauguggu

SEQ ID NO: 778933 - RNA, 16 nt, Homo sapiens
gccccaaccugcugaa

SEQ ID NO: 778934 - RNA, 16 nt, Homo sapiens
gccccaacucuuuauc

SEQ ID NO: 778935 - RNA, 20 nt, Homo sapiens
gccuccauucugaccauuuc

SEQ ID NO: 778936 - RNA, 21 nt, Homo sapiens
gccucccaaagugcugggauu

SEQ ID NO: 778937 - RNA, 14 nt, Homo sapiens
gccucccaccagag

SEQ ID NO: 778938 - RNA, 19 nt, Homo sapiens
gccucccacccgaugcugc

SEQ ID NO: 778939 - RNA, 19 nt, Homo sapiens
gccuccccacaggagcccu

SEQ ID NO: 778940 - RNA, 18 nt, Homo sapiens
gccuccccgugccaaaaa

SEQ ID NO: 778941 - RNA, 19 nt, Homo sapiens
gccuccccugccucaccag

SEQ ID NO: 778942 - RNA, 19 nt, Homo sapiens
gccucccuccccagugcaa

SEQ ID NO: 778943 - RNA, 21 nt, Homo sapiens
gccucccuccccagugcaaau

SEQ ID NO: 778944 - RNA, 21 nt, Homo sapiens
gccuccgcugggcuucauucc

SEQ ID NO: 778945 - RNA, 17 nt, Homo sapiens
gccucgcagccuccgga

SEQ ID NO: 778946 - RNA, 15 nt, Homo sapiens
gccucgguaucuggc

SEQ ID NO: 778947 - RNA, 20 nt, Homo sapiens
gccucuacuuugauucugau

SEQ ID NO: 778948 - RNA, 17 nt, Homo sapiens
gccucuccaguuugcac

SEQ ID NO: 778949 - RNA, 18 nt, Homo sapiens
gccucuccuacuaugcaa

SEQ ID NO: 778950 - RNA, 17 nt, Homo sapiens
gccucugccuuugcacc

SEQ ID NO: 778951 - RNA, 16 nt, Homo sapiens
gccucugcuguagcuu

SEQ ID NO: 778952 - RNA, 10 nt, Homo sapiens
gccucugugc

SEQ ID NO: 778953 - RNA, 14 nt, Homo sapiens
gccucugugccuuc

SEQ ID NO: 778954 - RNA, 19 nt, Homo sapiens
gccucuuguugagugccag

SEQ ID NO: 778955 - RNA, 14 nt, Homo sapiens
aaauuccuaucuca

SEQ ID NO: 778956 - RNA, 19 nt, Homo sapiens
aaauucuagagccagcugu

SEQ ID NO: 778957 - RNA, 21 nt, Homo sapiens
aaauucuauaggaacauauga

SEQ ID NO: 778958 - RNA, 24 nt, Homo sapiens
aaauucucagucaguaauugccaa

SEQ ID NO: 778959 - RNA, 18 nt, Homo sapiens
aaauucugaugagcauua

SEQ ID NO: 778960 - RNA, 16 nt, Homo sapiens
aaauucugucaggggu

SEQ ID NO: 778961 - RNA, 19 nt, Homo sapiens
aaauucuucuaauugcugu

SEQ ID NO: 778962 - RNA, 17 nt, Homo sapiens
aaauucuugaaguucau

SEQ ID NO: 778963 - RNA, 11 nt, Homo sapiens
aaauugaacaa

SEQ ID NO: 778964 - RNA, 16 nt, Homo sapiens
aaauugacgacuucac

SEQ ID NO: 778965 - RNA, 17 nt, Homo sapiens
aaauugagacauuuaca

SEQ ID NO: 778966 - RNA, 20 nt, Homo sapiens
aaauugagaccugagugaag

SEQ ID NO: 778967 - RNA, 14 nt, Homo sapiens
aaauugcagaauuc

SEQ ID NO: 778968 - RNA, 23 nt, Homo sapiens
aaauugccaagaaaaacaacuuu

SEQ ID NO: 778969 - RNA, 14 nt, Homo sapiens
aaauugccugcaaa

SEQ ID NO: 778970 - RNA, 12 nt, Homo sapiens
aaauugcugcug

SEQ ID NO: 778971 - RNA, 12 nt, Homo sapiens
aaauugcugcuu

SEQ ID NO: 778972 - RNA, 16 nt, Homo sapiens
aaauugggcaugccau

SEQ ID NO: 778973 - RNA, 22 nt, Homo sapiens
aaauuguacaagauaaguucca

SEQ ID NO: 778974 - RNA, 13 nt, Homo sapiens
aaauuguguuucc

SEQ ID NO: 778975 - RNA, 14 nt, Homo sapiens
aaauuuaagcuuaa

SEQ ID NO: 778976 - RNA, 14 nt, Homo sapiens
aaauuuaauaccag

SEQ ID NO: 778977 - RNA, 18 nt, Homo sapiens
aaauuuaauaccagauac

SEQ ID NO: 778978 - RNA, 23 nt, Homo sapiens
aaauuuccaguaccuuugucaca

SEQ ID NO: 778979 - RNA, 16 nt, Homo sapiens
aaauuugaauuucagu

SEQ ID NO: 778980 - RNA, 19 nt, Homo sapiens
aaauuugcaugcaaaauau

SEQ ID NO: 778981 - RNA, 18 nt, Homo sapiens
aaauuuggaaaggaccaa

SEQ ID NO: 778982 - RNA, 20 nt, Homo sapiens
aaauuuggaaaggaccaaau

SEQ ID NO: 778983 - RNA, 15 nt, Homo sapiens
aaauuuggccuuaag

SEQ ID NO: 778984 - RNA, 14 nt, Homo sapiens
aaauuuuacaauag

SEQ ID NO: 778985 - RNA, 20 nt, Homo sapiens
aaauuuuaggcaaccuucua

SEQ ID NO: 778986 - RNA, 15 nt, Homo sapiens
aaauuuuggucauag

SEQ ID NO: 778987 - RNA, 17 nt, Homo sapiens
aacaaacaaacaaacug

SEQ ID NO: 778988 - RNA, 13 nt, Homo sapiens
aacaaacagggcu

SEQ ID NO: 778989 - RNA, 18 nt, Homo sapiens
aacaaacauccuugcaaa

SEQ ID NO: 778990 - RNA, 18 nt, Homo sapiens
aacaaaccucacugagag

SEQ ID NO: 778991 - RNA, 15 nt, Homo sapiens
aacaaacuacaugua

SEQ ID NO: 778992 - RNA, 15 nt, Homo sapiens
aacaaacuuacuguc

SEQ ID NO: 778993 - RNA, 19 nt, Homo sapiens
aacaaagaaauaauggucu

SEQ ID NO: 778994 - RNA, 17 nt, Homo sapiens
aacaaagaacaagcauu

SEQ ID NO: 778995 - RNA, 21 nt, Homo sapiens
aacaaagauucaugauuuaua

SEQ ID NO: 778996 - RNA, 21 nt, Homo sapiens
aacaaagggauguucacugua

SEQ ID NO: 778997 - RNA, 22 nt, Homo sapiens
aacaaagggauguucacuguau

SEQ ID NO: 778998 - RNA, 14 nt, Homo sapiens
aacaaauacugaac

SEQ ID NO: 778999 - RNA, 23 nt, Homo sapiens
aacaaauucauauucugucugga

SEQ ID NO: 779000 - RNA, 14 nt, Homo sapiens
aacaacaaagacau

SEQ ID NO: 779001 - RNA, 22 nt, Homo sapiens
aacaacuaggcuucagcauauu

SEQ ID NO: 779002 - RNA, 21 nt, Homo sapiens
aacaacuauuuuucacauaau

SEQ ID NO: 779003 - RNA, 14 nt, Homo sapiens
aacaacuugcuacu

SEQ ID NO: 779004 - RNA, 15 nt, Homo sapiens
aacaacuuguagcag

SEQ ID NO: 779005 - RNA, 18 nt, Homo sapiens
aacaagaaugcauucccu

SEQ ID NO: 779006 - RNA, 14 nt, Homo sapiens
aacaagaauuggaa

SEQ ID NO: 779007 - RNA, 23 nt, Homo sapiens
aacaagauuuuaaagacauguag

SEQ ID NO: 779008 - RNA, 17 nt, Homo sapiens
aacaagcaaaaccaaag

SEQ ID NO: 779009 - RNA, 22 nt, Homo sapiens
aacaagccaacgacaaagccaa

SEQ ID NO: 779010 - RNA, 23 nt, Homo sapiens
aacaagcccguuagccccaggga

SEQ ID NO: 779011 - RNA, 20 nt, Homo sapiens
aacaagggcugcaaugcccu

SEQ ID NO: 779012 - RNA, 22 nt, Homo sapiens
aacaaggugcccuuuagccaga

SEQ ID NO: 779013 - RNA, 17 nt, Homo sapiens
aacaagucccuuuaugc

SEQ ID NO: 779014 - RNA, 22 nt, Homo sapiens
aacaauaaaguacuuuaccuaa

SEQ ID NO: 779015 - RNA, 16 nt, Homo sapiens
aacaauaacgauacaa

SEQ ID NO: 779016 - RNA, 14 nt, Homo sapiens
aacaauaagaacaa

SEQ ID NO: 779017 - RNA, 13 nt, Homo sapiens
aacaauauuacuu

SEQ ID NO: 779018 - RNA, 14 nt, Homo sapiens
aacaaucacuggcu

SEQ ID NO: 779019 - RNA, 12 nt, Homo sapiens
aacaauccaaaa

SEQ ID NO: 779020 - RNA, 15 nt, Homo sapiens
aacaaucucucaaca

SEQ ID NO: 779021 - RNA, 13 nt, Homo sapiens
aacaaugacuuaa

SEQ ID NO: 779022 - RNA, 19 nt, Homo sapiens
aacaaugguugaaugaaua

SEQ ID NO: 779023 - RNA, 21 nt, Homo sapiens
aacaauguauaaagauuguac

SEQ ID NO: 779024 - RNA, 21 nt, Homo sapiens
aacaauguuguccaacaauaa

SEQ ID NO: 779025 - RNA, 22 nt, Homo sapiens
aacaauuccaaaggaaucucca

SEQ ID NO: 779026 - RNA, 15 nt, Homo sapiens
aacaauucugugaca

SEQ ID NO: 779027 - RNA, 16 nt, Homo sapiens
aacacaaacaucauuu

SEQ ID NO: 779028 - RNA, 17 nt, Homo sapiens
aacacaauucuucuucc

SEQ ID NO: 779029 - RNA, 19 nt, Homo sapiens
aacacacacuguucugaaa

SEQ ID NO: 779030 - RNA, 11 nt, Homo sapiens
aacacacuggc

SEQ ID NO: 779031 - RNA, 13 nt, Homo sapiens
aacacacuggcca

SEQ ID NO: 779032 - RNA, 19 nt, Homo sapiens
aacacagcaacaaugacuu

SEQ ID NO: 779033 - RNA, 20 nt, Homo sapiens
aacacagcaacaaugacuua

SEQ ID NO: 779034 - RNA, 17 nt, Homo sapiens
aacacagcaugugccaa

SEQ ID NO: 779035 - RNA, 21 nt, Homo sapiens
aacacagcauguguauuucca

SEQ ID NO: 779036 - RNA, 21 nt, Homo sapiens
aacacagucuacucuuucugc

SEQ ID NO: 779037 - RNA, 15 nt, Homo sapiens
aacacauaguggcuu

SEQ ID NO: 779038 - RNA, 22 nt, Homo sapiens
aacaccaaaaaugaugcgcauc

SEQ ID NO: 779039 - RNA, 16 nt, Homo sapiens
aacaccaaacucuuaa

SEQ ID NO: 779040 - RNA, 16 nt, Homo sapiens
aacaccagcagcacug

SEQ ID NO: 779041 - RNA, 19 nt, Homo sapiens
aacaccagcagcacuggaa

SEQ ID NO: 779042 - RNA, 15 nt, Homo sapiens
aacacccgacgucau

SEQ ID NO: 779043 - RNA, 19 nt, Homo sapiens
aacacccgacuccucaaaa

SEQ ID NO: 779044 - RNA, 18 nt, Homo sapiens
aacaccgcuucugccuuu

SEQ ID NO: 779045 - RNA, 19 nt, Homo sapiens
aacaccgcuucugccuuuu

SEQ ID NO: 779046 - RNA, 15 nt, Homo sapiens
aacaccuagcuuuau

SEQ ID NO: 779047 - RNA, 21 nt, Homo sapiens
aacaccuagcuuuauucuuca

SEQ ID NO: 779048 - RNA, 13 nt, Homo sapiens
aacaccuccucau

SEQ ID NO: 779049 - RNA, 21 nt, Homo sapiens
aacacgagcaggcuacuguca

SEQ ID NO: 779050 - RNA, 17 nt, Homo sapiens
aagauugcgguuuacag

SEQ ID NO: 779051 - RNA, 16 nt, Homo sapiens
aagauuuuaugcugcu

SEQ ID NO: 779052 - RNA, 15 nt, Homo sapiens
aagauuuucagaaaa

SEQ ID NO: 779053 - RNA, 19 nt, Homo sapiens
aagauuuugaaugcuuccu

SEQ ID NO: 779054 - RNA, 14 nt, Homo sapiens
aagcaaaaccaaag

SEQ ID NO: 779055 - RNA, 14 nt, Homo sapiens
aagcaaaaugcuuc

SEQ ID NO: 779056 - RNA, 14 nt, Homo sapiens
aagcaaaaugucuc

SEQ ID NO: 779057 - RNA, 22 nt, Homo sapiens
aagcaaagauuauuuucauuua

SEQ ID NO: 779058 - RNA, 14 nt, Homo sapiens
aagcaaauggggga

SEQ ID NO: 779059 - RNA, 20 nt, Homo sapiens
aagcaaauuucuaucagccu

SEQ ID NO: 779060 - RNA, 12 nt, Homo sapiens
aagcaacaaaga

SEQ ID NO: 779061 - RNA, 13 nt, Homo sapiens
aagcaacaucuag

SEQ ID NO: 779062 - RNA, 16 nt, Homo sapiens
aagcaagaaugcagua

SEQ ID NO: 779063 - RNA, 18 nt, Homo sapiens
aagcaaggcuuuaaauga

SEQ ID NO: 779064 - RNA, 22 nt, Homo sapiens
aagcaaggugucccugccuuca

SEQ ID NO: 779065 - RNA, 17 nt, Homo sapiens
aagcaaguuuucuucca

SEQ ID NO: 779066 - RNA, 18 nt, Homo sapiens
aagcaaguuuucuuccau

SEQ ID NO: 779067 - RNA, 20 nt, Homo sapiens
aagcaauuagguagcacagc

SEQ ID NO: 779068 - RNA, 20 nt, Homo sapiens
aagcacaagcagagugcaca

SEQ ID NO: 779069 - RNA, 13 nt, Homo sapiens
aagcacagaauau

SEQ ID NO: 779070 - RNA, 24 nt, Homo sapiens
aagcacagaguggcuuggccucaa

SEQ ID NO: 779071 - RNA, 13 nt, Homo sapiens
aagcacagugccu

SEQ ID NO: 779072 - RNA, 17 nt, Homo sapiens
aagcaccugccgaccuc

SEQ ID NO: 779073 - RNA, 23 nt, Homo sapiens
ggaacugaaagaauaagaacuuu

SEQ ID NO: 779074 - RNA, 14 nt, Homo sapiens
ggaagaaacuuucu

SEQ ID NO: 779075 - RNA, 13 nt, Homo sapiens
ggaagacuugaag

SEQ ID NO: 779076 - RNA, 19 nt, Homo sapiens
ggaagagagagacccucac

SEQ ID NO: 779077 - RNA, 14 nt, Homo sapiens
ggaagagauguuua

SEQ ID NO: 779078 - RNA, 15 nt, Homo sapiens
ggaagagcauuagcu

SEQ ID NO: 779079 - RNA, 12 nt, Homo sapiens
ggaagagcuaau

SEQ ID NO: 779080 - RNA, 18 nt, Homo sapiens
ggaagagcugcaacggaa

SEQ ID NO: 779081 - RNA, 19 nt, Homo sapiens
ggaagagcugcaacggaau

SEQ ID NO: 779082 - RNA, 21 nt, Homo sapiens
ggaagaggaacagcacugggg

SEQ ID NO: 779083 - RNA, 13 nt, Homo sapiens
ggaagcacaggca

SEQ ID NO: 779084 - RNA, 20 nt, Homo sapiens
ggaagccaccucaccaagga

SEQ ID NO: 779085 - RNA, 21 nt, Homo sapiens
ggaagcccauccugaccagcu

SEQ ID NO: 779086 - RNA, 20 nt, Homo sapiens
ggaagccccugggcccagua

SEQ ID NO: 779087 - RNA, 16 nt, Homo sapiens
ggaagcccucaaagaa

SEQ ID NO: 779088 - RNA, 19 nt, Homo sapiens
ggaagcggagcuugcagug

SEQ ID NO: 779089 - RNA, 18 nt, Homo sapiens
ggaaggagcacauacuac

SEQ ID NO: 779090 - RNA, 14 nt, Homo sapiens
ggaaggcuugcagu

SEQ ID NO: 779091 - RNA, 16 nt, Homo sapiens
ggaagggggcugugug

SEQ ID NO: 779092 - RNA, 22 nt, Homo sapiens
ggaaguacugcacccagcagug

SEQ ID NO: 779093 - RNA, 23 nt, Homo sapiens
ggaagucaucucauuccacuguu

SEQ ID NO: 779094 - RNA, 23 nt, Homo sapiens
ggaagugaagagggagaagggau

SEQ ID NO: 779095 - RNA, 16 nt, Homo sapiens
ggaagugaggcccaag

SEQ ID NO: 779096 - RNA, 21 nt, Homo sapiens
ggaagugguccagaaacaaaa

SEQ ID NO: 779097 - RNA, 17 nt, Homo sapiens
ggaagugucugccagcu

SEQ ID NO: 779098 - RNA, 17 nt, Homo sapiens
ggaauaaaaacauuucu

SEQ ID NO: 779099 - RNA, 13 nt, Homo sapiens
ggaauaagcauuc

SEQ ID NO: 779100 - RNA, 23 nt, Homo sapiens
ggaauaagcucuaguucuuaaca

SEQ ID NO: 779101 - RNA, 17 nt, Homo sapiens
ggaauauaaaacaguca

SEQ ID NO: 779102 - RNA, 21 nt, Homo sapiens
ggaauauaaggaaagcaauaa

SEQ ID NO: 779103 - RNA, 13 nt, Homo sapiens
ggaauauuuccau

SEQ ID NO: 779104 - RNA, 23 nt, Homo sapiens
ggaaucagaacucaaauggggcc

SEQ ID NO: 779105 - RNA, 23 nt, Homo sapiens
ggaaucagugaagccaaagggac

SEQ ID NO: 779106 - RNA, 13 nt, Homo sapiens
ggaauccgugugu

SEQ ID NO: 779107 - RNA, 20 nt, Homo sapiens
ggaauccuuuggugccaacu

SEQ ID NO: 779108 - RNA, 21 nt, Homo sapiens
ggaaucucuuggaugcagcuu

SEQ ID NO: 779109 - RNA, 15 nt, Homo sapiens
ggaaucuucaccuca

SEQ ID NO: 779110 - RNA, 18 nt, Homo sapiens
ggaaucuuuguaccaaaa

SEQ ID NO: 779111 - RNA, 19 nt, Homo sapiens
ggaaugcagaggucuccaa

SEQ ID NO: 779112 - RNA, 21 nt, Homo sapiens
ggaauggaaagcggaguuccu

SEQ ID NO: 779113 - RNA, 21 nt, Homo sapiens
ggaauugcuggaggaaccaga

SEQ ID NO: 779114 - RNA, 14 nt, Homo sapiens
ggacaagaccccca

SEQ ID NO: 779115 - RNA, 18 nt, Homo sapiens
ggacaauggguggugaau

SEQ ID NO: 779116 - RNA, 18 nt, Homo sapiens
ggacaauuaucuguguca

SEQ ID NO: 779117 - RNA, 19 nt, Homo sapiens
ggacacgguguccaccauc

SEQ ID NO: 779118 - RNA, 14 nt, Homo sapiens
ggacacuggugcca

SEQ ID NO: 779119 - RNA, 11 nt, Homo sapiens
ggacacuguac

SEQ ID NO: 779120 - RNA, 21 nt, Homo sapiens
ggacacugugcccagcccgga

SEQ ID NO: 779121 - RNA, 20 nt, Homo sapiens
ggacacuguggagacuuucu

SEQ ID NO: 779122 - RNA, 21 nt, Homo sapiens
ggacacuuccguagacuguuu

SEQ ID NO: 779123 - RNA, 15 nt, Homo sapiens
ggacagaccacagag

SEQ ID NO: 779124 - RNA, 12 nt, Homo sapiens
ggacagagggug

SEQ ID NO: 779125 - RNA, 17 nt, Homo sapiens
ggacagaugaaugccgu

SEQ ID NO: 779126 - RNA, 14 nt, Homo sapiens
ggacagauugccug

SEQ ID NO: 779127 - RNA, 19 nt, Homo sapiens
ggacaggcuggugcuaaca

SEQ ID NO: 779128 - RNA, 21 nt, Homo sapiens
ggacagggcccccggccacgc

SEQ ID NO: 779129 - RNA, 20 nt, Homo sapiens
ggacaguaucguuuguuuau

SEQ ID NO: 779130 - RNA, 14 nt, Homo sapiens
ggacagucaccuau

SEQ ID NO: 779131 - RNA, 17 nt, Homo sapiens
ggacaguccugggagaa

SEQ ID NO: 779132 - RNA, 15 nt, Homo sapiens
ggacaucauucugca

SEQ ID NO: 779133 - RNA, 10 nt, Homo sapiens
ggacaugccc

SEQ ID NO: 779134 - RNA, 20 nt, Homo sapiens
ggacauuguaugcagggagc

SEQ ID NO: 779135 - RNA, 22 nt, Homo sapiens
ggaccaaaggaaggaagcaagc

SEQ ID NO: 779136 - RNA, 16 nt, Homo sapiens
ggaccaccuagucugu

SEQ ID NO: 779137 - RNA, 15 nt, Homo sapiens
ggaccagcucaggac

SEQ ID NO: 779138 - RNA, 18 nt, Homo sapiens
ggaccagggcaagugcau

SEQ ID NO: 779139 - RNA, 22 nt, Homo sapiens
ggaccccugccaguucucugug

SEQ ID NO: 779140 - RNA, 23 nt, Homo sapiens
ggaccgcugauaagcauugacuu

SEQ ID NO: 779141 - RNA, 22 nt, Homo sapiens
ggaccucaccugcuggggaccu

SEQ ID NO: 779142 - RNA, 17 nt, Homo sapiens
ggaccugcccugggcca

SEQ ID NO: 779143 - RNA, 15 nt, Homo sapiens
ggaccugcucaucau

SEQ ID NO: 779144 - RNA, 18 nt, Homo sapiens
ggaccuggcgugcucaga

SEQ ID NO: 779145 - RNA, 14 nt, Homo sapiens
ggaccuuggcgcuu

SEQ ID NO: 779146 - RNA, 20 nt, Homo sapiens
ggacgaggaguaauggcauu

SEQ ID NO: 779147 - RNA, 18 nt, Homo sapiens
ggacgcaauugugggaug

SEQ ID NO: 779148 - RNA, 18 nt, Homo sapiens
ggacgcuggcuacugucu

SEQ ID NO: 779149 - RNA, 14 nt, Homo sapiens
ggacuaacccaaug

SEQ ID NO: 779150 - RNA, 21 nt, Homo sapiens
ggacuacacaauacaguauua

SEQ ID NO: 779151 - RNA, 20 nt, Homo sapiens
ggacuagugagucagcaccu

SEQ ID NO: 779152 - RNA, 19 nt, Homo sapiens
ggacuauauuugggccugc

SEQ ID NO: 779153 - RNA, 23 nt, Homo sapiens
ggacuaucaacaccacuaggaau

SEQ ID NO: 779154 - RNA, 11 nt, Homo sapiens
ggacucaaggg

SEQ ID NO: 779155 - RNA, 20 nt, Homo sapiens
ggacuccauccaccucauca

SEQ ID NO: 779156 - RNA, 12 nt, Homo sapiens
ggacuccaugcu

SEQ ID NO: 779157 - RNA, 15 nt, Homo sapiens
ggacuccaugcuccu

SEQ ID NO: 779158 - RNA, 20 nt, Homo sapiens
ggacucuccacucaaugucu

SEQ ID NO: 779159 - RNA, 23 nt, Homo sapiens
ggacucugcuagacuccucagga

SEQ ID NO: 779160 - RNA, 13 nt, Homo sapiens
ggacucuuccacc

SEQ ID NO: 779161 - RNA, 18 nt, Homo sapiens
ggacugaccaaagacugc

SEQ ID NO: 779162 - RNA, 18 nt, Homo sapiens
ggacugagcugggggaag

SEQ ID NO: 779163 - RNA, 13 nt, Homo sapiens
ggacugaugucau

SEQ ID NO: 779164 - RNA, 21 nt, Homo sapiens
aaggguuauagacugccaugc

SEQ ID NO: 779165 - RNA, 20 nt, Homo sapiens
aaggguucagagacucaggg

SEQ ID NO: 779166 - RNA, 21 nt, Homo sapiens
aaggguucugcccugccugag

SEQ ID NO: 779167 - RNA, 23 nt, Homo sapiens
aaggguuucgacugguccagcuc

SEQ ID NO: 779168 - RNA, 13 nt, Homo sapiens
aagguagcccagc

SEQ ID NO: 779169 - RNA, 19 nt, Homo sapiens
aagguauuagcaaagcaaa

SEQ ID NO: 779170 - RNA, 18 nt, Homo sapiens
aaggucaagggaaaaccc

SEQ ID NO: 779171 - RNA, 18 nt, Homo sapiens
aaggucacauugugccuu

SEQ ID NO: 779172 - RNA, 17 nt, Homo sapiens
aaggucagcccguuuca

SEQ ID NO: 779173 - RNA, 21 nt, Homo sapiens
aaggucauaagggagcaugau

SEQ ID NO: 779174 - RNA, 19 nt, Homo sapiens
aagguccacaggucuagac

SEQ ID NO: 779175 - RNA, 18 nt, Homo sapiens
aaggucuaucuuaagaag

SEQ ID NO: 779176 - RNA, 13 nt, Homo sapiens
aaggucucuggag

SEQ ID NO: 779177 - RNA, 14 nt, Homo sapiens
aaggucugaugucu

SEQ ID NO: 779178 - RNA, 19 nt, Homo sapiens
aaggucugugggccaaaga

SEQ ID NO: 779179 - RNA, 16 nt, Homo sapiens
aaggugaaagugcagu

SEQ ID NO: 779180 - RNA, 14 nt, Homo sapiens
aaggugaaccaaag

SEQ ID NO: 779181 - RNA, 12 nt, Homo sapiens
aaggugaaucug

SEQ ID NO: 779182 - RNA, 12 nt, Homo sapiens
aaggugccucau

SEQ ID NO: 779183 - RNA, 14 nt, Homo sapiens
aagguggacggggu

SEQ ID NO: 779184 - RNA, 22 nt, Homo sapiens
aagguggauuuucaucaggggc

SEQ ID NO: 779185 - RNA, 20 nt, Homo sapiens
aaggugggcagaucacugga

SEQ ID NO: 779186 - RNA, 19 nt, Homo sapiens
aagguguuuuccugaagaa

SEQ ID NO: 779187 - RNA, 15 nt, Homo sapiens
ggauccuccacagag

SEQ ID NO: 779188 - RNA, 14 nt, Homo sapiens
ggauccucccucau

SEQ ID NO: 779189 - RNA, 15 nt, Homo sapiens
ggauccugggucaaa

SEQ ID NO: 779190 - RNA, 17 nt, Homo sapiens
ggauccuuugcugcuga

SEQ ID NO: 779191 - RNA, 20 nt, Homo sapiens
ggaucgaggcauggggcaug

SEQ ID NO: 779192 - RNA, 17 nt, Homo sapiens
ggaucuaccagcauaaa

SEQ ID NO: 779193 - RNA, 18 nt, Homo sapiens
ggaucuuggagaauguga

SEQ ID NO: 779194 - RNA, 22 nt, Homo sapiens
ggaucuuguaauccagugcccu

SEQ ID NO: 779195 - RNA, 15 nt, Homo sapiens
ggaugaacaauuaua

SEQ ID NO: 779196 - RNA, 16 nt, Homo sapiens
ggaugacaaaauggaa

SEQ ID NO: 779197 - RNA, 21 nt, Homo sapiens
ggaugauacuuggaugcagcu

SEQ ID NO: 779198 - RNA, 19 nt, Homo sapiens
ggaugccacagcccagcuu

SEQ ID NO: 779199 - RNA, 15 nt, Homo sapiens
ggaugcgcagugccu

SEQ ID NO: 779200 - RNA, 22 nt, Homo sapiens
ggauggaaagacaaacugcaca

SEQ ID NO: 779201 - RNA, 17 nt, Homo sapiens
ggauggguccucacgca

SEQ ID NO: 779202 - RNA, 21 nt, Homo sapiens
ggauguacgacauuuugugac

SEQ ID NO: 779203 - RNA, 17 nt, Homo sapiens
ggaugucaauagcauug

SEQ ID NO: 779204 - RNA, 22 nt, Homo sapiens
ggaugucuccaucucugucuca

SEQ ID NO: 779205 - RNA, 19 nt, Homo sapiens
ggauguugaacuggucauu

SEQ ID NO: 779206 - RNA, 21 nt, Homo sapiens
ggauguuuuuucccuguuuaa

SEQ ID NO: 779207 - RNA, 21 nt, Homo sapiens
ggauuaagaaaccuugcucuc

SEQ ID NO: 779208 - RNA, 21 nt, Homo sapiens
ggauuaauguuuuguacaauu

SEQ ID NO: 779209 - RNA, 21 nt, Homo sapiens
ggauuacaggugugggccacu

SEQ ID NO: 779210 - RNA, 23 nt, Homo sapiens
ggauuaccagggacuaucuuugc

SEQ ID NO: 779211 - RNA, 22 nt, Homo sapiens
ggauuagguguucaggccagua

SEQ ID NO: 779212 - RNA, 14 nt, Homo sapiens
ggauuauucauuua

SEQ ID NO: 779213 - RNA, 16 nt, Homo sapiens
ggauucagcaugucca

SEQ ID NO: 779214 - RNA, 20 nt, Homo sapiens
ggauucaggcagcagugucu

SEQ ID NO: 779215 - RNA, 19 nt, Homo sapiens
ggauuccgucuucucucau

SEQ ID NO: 779216 - RNA, 22 nt, Homo sapiens
ggauucuccacucaguugcaac

SEQ ID NO: 779217 - RNA, 14 nt, Homo sapiens
ggauugacucugca

SEQ ID NO: 779218 - RNA, 17 nt, Homo sapiens
ggauugauugaggccaa

SEQ ID NO: 779219 - RNA, 19 nt, Homo sapiens
ggauugcuaaucaccaaag

SEQ ID NO: 779220 - RNA, 18 nt, Homo sapiens
ggauuuaacagucauuua

SEQ ID NO: 779221 - RNA, 20 nt, Homo sapiens
ggauuucacaccccauucuc

SEQ ID NO: 779222 - RNA, 21 nt, Homo sapiens
ggauuucacaccccauucuca

SEQ ID NO: 779223 - RNA, 17 nt, Homo sapiens
ggauuugccugugccac

SEQ ID NO: 779224 - RNA, 16 nt, Homo sapiens
ggcaaaaaaauuaaau

SEQ ID NO: 779225 - RNA, 18 nt, Homo sapiens
ggcaaaaacuuccaucac

SEQ ID NO: 779226 - RNA, 15 nt, Homo sapiens
ggcaaaacucaguag

SEQ ID NO: 779227 - RNA, 23 nt, Homo sapiens
ggcaaacccaaaaccucaugaca

SEQ ID NO: 779228 - RNA, 17 nt, Homo sapiens
ggcaaagccuucauugc

SEQ ID NO: 779229 - RNA, 14 nt, Homo sapiens
ggcaaagugcugua

SEQ ID NO: 779230 - RNA, 15 nt, Homo sapiens
ggcaaauaacaguaa

SEQ ID NO: 779231 - RNA, 22 nt, Homo sapiens
ggcaaaugacaugcacugaccc

SEQ ID NO: 779232 - RNA, 21 nt, Homo sapiens
ggcaacaagagcgagacuccg

SEQ ID NO: 779233 - RNA, 20 nt, Homo sapiens
ggcaacacagcgagacuccg

SEQ ID NO: 779234 - RNA, 18 nt, Homo sapiens
ggcaacagagcaagaucc

SEQ ID NO: 779235 - RNA, 20 nt, Homo sapiens
ggcaacauaguaagacccca

SEQ ID NO: 779236 - RNA, 22 nt, Homo sapiens
ggcaaccuugucucuaugccag

SEQ ID NO: 779237 - RNA, 21 nt, Homo sapiens
ggcaagccugucuucagagaa

SEQ ID NO: 779238 - RNA, 13 nt, Homo sapiens
ggcaaucuuugcc

SEQ ID NO: 779239 - RNA, 11 nt, Homo sapiens
ggcaauuccuc

SEQ ID NO: 779240 - RNA, 14 nt, Homo sapiens
ggcacacucccucu

SEQ ID NO: 779241 - RNA, 13 nt, Homo sapiens
ggcacaguggacu

SEQ ID NO: 779242 - RNA, 14 nt, Homo sapiens
ggcaccaaccugca

SEQ ID NO: 779243 - RNA, 12 nt, Homo sapiens
ggcaccagacac

SEQ ID NO: 779244 - RNA, 19 nt, Homo sapiens
ggcaccagacacccaggac

SEQ ID NO: 779245 - RNA, 22 nt, Homo sapiens
ggcacccacaaauaaaugacaa

SEQ ID NO: 779246 - RNA, 20 nt, Homo sapiens
ggcaccuuccgacaucccag

SEQ ID NO: 779247 - RNA, 14 nt, Homo sapiens
ggcacgguggcuca

SEQ ID NO: 779248 - RNA, 15 nt, Homo sapiens
ggcacuacaugaaau

SEQ ID NO: 779249 - RNA, 14 nt, Homo sapiens
ggcacucagucucu

SEQ ID NO: 779250 - RNA, 20 nt, Homo sapiens
ggcacuccuggagauaugaa

SEQ ID NO: 779251 - RNA, 21 nt, Homo sapiens
ggcacugaauuaaucaucuau

SEQ ID NO: 779252 - RNA, 11 nt, Homo sapiens
ggcacugccug

SEQ ID NO: 779253 - RNA, 13 nt, Homo sapiens
ggcacuucauuga

SEQ ID NO: 779254 - RNA, 11 nt, Homo sapiens
ggcacuuguau

SEQ ID NO: 779255 - RNA, 18 nt, Homo sapiens
ggcacuuuaagucaguga

SEQ ID NO: 779256 - RNA, 11 nt, Homo sapiens
ggcacuuugaa

SEQ ID NO: 779257 - RNA, 17 nt, Homo sapiens
ggcagaaaauugcacaa

SEQ ID NO: 779258 - RNA, 17 nt, Homo sapiens
ggcagacucgggaccaa

SEQ ID NO: 779259 - RNA, 21 nt, Homo sapiens
ggcagagcaauuccaggcuga

SEQ ID NO: 779260 - RNA, 22 nt, Homo sapiens
ggcagagccaccugacucuugc

SEQ ID NO: 779261 - RNA, 12 nt, Homo sapiens
ggcagagccaug

SEQ ID NO: 779262 - RNA, 18 nt, Homo sapiens
ggcagagguugcagugaa

SEQ ID NO: 779263 - RNA, 12 nt, Homo sapiens
ggcagauccagg

SEQ ID NO: 779264 - RNA, 23 nt, Homo sapiens
ggcagcaaaacgacacugcgcau

SEQ ID NO: 779265 - RNA, 17 nt, Homo sapiens
ggcagcagagcauucag

SEQ ID NO: 779266 - RNA, 18 nt, Homo sapiens
ggcagcauagcaagacac

SEQ ID NO: 779267 - RNA, 14 nt, Homo sapiens
ggcagcaucuucac

SEQ ID NO: 779268 - RNA, 16 nt, Homo sapiens
ggcagccacccaagcc

SEQ ID NO: 779269 - RNA, 19 nt, Homo sapiens
ggcagcccaacagcacuuu

SEQ ID NO: 779270 - RNA, 13 nt, Homo sapiens
ggcagcgacccca

SEQ ID NO: 779271 - RNA, 16 nt, Homo sapiens
ggcagcuagugccuuu

SEQ ID NO: 779272 - RNA, 22 nt, Homo sapiens
ggcagcugacaguuuguggcau

SEQ ID NO: 779273 - RNA, 15 nt, Homo sapiens
ggcagcuucacucga

SEQ ID NO: 779274 - RNA, 13 nt, Homo sapiens
ggcagcuugcccc

SEQ ID NO: 779275 - RNA, 19 nt, Homo sapiens
ggcaggagaaucgcuugaa

SEQ ID NO: 779276 - RNA, 20 nt, Homo sapiens
ggcaggagaaucucuugaac

SEQ ID NO: 779277 - RNA, 20 nt, Homo sapiens
ggcaggagaauuacuugaac

SEQ ID NO: 779278 - RNA, 12 nt, Homo sapiens
aauacaugucua

SEQ ID NO: 779279 - RNA, 22 nt, Homo sapiens
aauacauuguuguaagagugau

SEQ ID NO: 779280 - RNA, 20 nt, Homo sapiens
aauacauuucaauuauacua

SEQ ID NO: 779281 - RNA, 18 nt, Homo sapiens
aauaccacagcucagcca

SEQ ID NO: 779282 - RNA, 18 nt, Homo sapiens
aauaccauuaaaacugcu

SEQ ID NO: 779283 - RNA, 14 nt, Homo sapiens
aauacccauauguc

SEQ ID NO: 779284 - RNA, 19 nt, Homo sapiens
aauaccuccuccagaucag

SEQ ID NO: 779285 - RNA, 14 nt, Homo sapiens
aauaccuucugaac

SEQ ID NO: 779286 - RNA, 18 nt, Homo sapiens
aauaccuuggucucaccu

SEQ ID NO: 779287 - RNA, 15 nt, Homo sapiens
aauaccuuuucucac

SEQ ID NO: 779288 - RNA, 16 nt, Homo sapiens
aauacucaaaagagag

SEQ ID NO: 779289 - RNA, 20 nt, Homo sapiens
aauacuccagagacagggaa

SEQ ID NO: 779290 - RNA, 16 nt, Homo sapiens
aauacucugcagugau

SEQ ID NO: 779291 - RNA, 11 nt, Homo sapiens
aauacugaugu

SEQ ID NO: 779292 - RNA, 18 nt, Homo sapiens
aauacugccaaccagagc

SEQ ID NO: 779293 - RNA, 21 nt, Homo sapiens
aauacuuacuauaauuugacu

SEQ ID NO: 779294 - RNA, 13 nt, Homo sapiens
aauacuuacuucu

SEQ ID NO: 779295 - RNA, 19 nt, Homo sapiens
aauacuucagugagauuaa

SEQ ID NO: 779296 - RNA, 20 nt, Homo sapiens
aauacuucauucucucucau

SEQ ID NO: 779297 - RNA, 18 nt, Homo sapiens
aauacuuuacaaaccauu

SEQ ID NO: 779298 - RNA, 21 nt, Homo sapiens
aauacuuuuuuuuuaaagcca

SEQ ID NO: 779299 - RNA, 16 nt, Homo sapiens
aauagaaccacuauga

SEQ ID NO: 779300 - RNA, 20 nt, Homo sapiens
aauagaaccacuaugaagcu

SEQ ID NO: 779301 - RNA, 21 nt, Homo sapiens
ggcgagcacugugagcaccug

SEQ ID NO: 779302 - RNA, 17 nt, Homo sapiens
ggcgagccgcgggcgcu

SEQ ID NO: 779303 - RNA, 21 nt, Homo sapiens
ggcgcagacaggcggggccca

SEQ ID NO: 779304 - RNA, 22 nt, Homo sapiens
ggcgcucucccuaccuugccuc

SEQ ID NO: 779305 - RNA, 15 nt, Homo sapiens
ggcggcccacaccca

SEQ ID NO: 779306 - RNA, 22 nt, Homo sapiens
ggcggcccggccagcgggcaca

SEQ ID NO: 779307 - RNA, 22 nt, Homo sapiens
ggcgggguauucccacucacca

SEQ ID NO: 779308 - RNA, 15 nt, Homo sapiens
ggcguccauguuuau

SEQ ID NO: 779309 - RNA, 14 nt, Homo sapiens
ggcgucccuaccuc

SEQ ID NO: 779310 - RNA, 19 nt, Homo sapiens
ggcgugagaggcaaugacu

SEQ ID NO: 779311 - RNA, 12 nt, Homo sapiens
ggcgugaucuug

SEQ ID NO: 779312 - RNA, 14 nt, Homo sapiens
ggcgugguggcaca

SEQ ID NO: 779313 - RNA, 19 nt, Homo sapiens
ggcuaaccuguuacacugg

SEQ ID NO: 779314 - RNA, 20 nt, Homo sapiens
ggcuaaccuguuacacuggg

SEQ ID NO: 779315 - RNA, 20 nt, Homo sapiens
ggcuacacucaucugacuca

SEQ ID NO: 779316 - RNA, 12 nt, Homo sapiens
ggcuaccaucug

SEQ ID NO: 779317 - RNA, 17 nt, Homo sapiens
ggcuacccuaaagggag

SEQ ID NO: 779318 - RNA, 22 nt, Homo sapiens
ggcuaccucaagacucaccuca

SEQ ID NO: 779319 - RNA, 22 nt, Homo sapiens
ggcuacuaccuagggcacuuua

SEQ ID NO: 779320 - RNA, 14 nt, Homo sapiens
ggcuagcuucugcu

SEQ ID NO: 779321 - RNA, 16 nt, Homo sapiens
ggcuagguaucauuca

SEQ ID NO: 779322 - RNA, 23 nt, Homo sapiens
ggcuagucuucccuuaccucaaa

SEQ ID NO: 779323 - RNA, 19 nt, Homo sapiens
ggcuaguuaaggugugcaa

SEQ ID NO: 779324 - RNA, 13 nt, Homo sapiens
ggcuauaccuggg

SEQ ID NO: 779325 - RNA, 16 nt, Homo sapiens
ggcuaugacaugagca

SEQ ID NO: 779326 - RNA, 19 nt, Homo sapiens
ggcuaugaggauaauggga

SEQ ID NO: 779327 - RNA, 19 nt, Homo sapiens
ggcuauugaagaugcugcc

SEQ ID NO: 779328 - RNA, 15 nt, Homo sapiens
ggcuauuucuguguc

SEQ ID NO: 779329 - RNA, 15 nt, Homo sapiens
ggcuauuugaagaau

SEQ ID NO: 779330 - RNA, 14 nt, Homo sapiens
ggcucacugcagcc

SEQ ID NO: 779331 - RNA, 17 nt, Homo sapiens
ggcucagaucucauggg

SEQ ID NO: 779332 - RNA, 12 nt, Homo sapiens
ggcucaggguug

SEQ ID NO: 779333 - RNA, 21 nt, Homo sapiens
ggcucaggguuggccauuugc

SEQ ID NO: 779334 - RNA, 16 nt, Homo sapiens
ggcucagucucaggag

SEQ ID NO: 779335 - RNA, 19 nt, Homo sapiens
ggcuccacucuugaucucu

SEQ ID NO: 779336 - RNA, 16 nt, Homo sapiens
ggcuccagccaucuca

SEQ ID NO: 779337 - RNA, 14 nt, Homo sapiens
ggcucccaugacca

SEQ ID NO: 779338 - RNA, 14 nt, Homo sapiens
ggcuccccaaaggg

SEQ ID NO: 779339 - RNA, 12 nt, Homo sapiens
ggcuccuaccug

SEQ ID NO: 779340 - RNA, 14 nt, Homo sapiens
ggcuccuccuuaug

SEQ ID NO: 779341 - RNA, 17 nt, Homo sapiens
ggcuccuucccaucgcu

SEQ ID NO: 779342 - RNA, 22 nt, Homo sapiens
ggcucgcccauacccgugacag

SEQ ID NO: 779343 - RNA, 21 nt, Homo sapiens
ggcucuaauucacagugcucu

SEQ ID NO: 779344 - RNA, 20 nt, Homo sapiens
ggcucugcuucuccaaggaa

SEQ ID NO: 779345 - RNA, 22 nt, Homo sapiens
ggcucugggagacuuugaagac

SEQ ID NO: 779346 - RNA, 19 nt, Homo sapiens
ggcucugguaugaauucac

SEQ ID NO: 779347 - RNA, 19 nt, Homo sapiens
ggcucuuagcagcuuccag

SEQ ID NO: 779348 - RNA, 15 nt, Homo sapiens
ggcucuucucauuuc

SEQ ID NO: 779349 - RNA, 16 nt, Homo sapiens
ggcucuugacuacuug

SEQ ID NO: 779350 - RNA, 14 nt, Homo sapiens
ggcugaacccugug

SEQ ID NO: 779351 - RNA, 23 nt, Homo sapiens
ggcugacaccuaccaugcugcuu

SEQ ID NO: 779352 - RNA, 15 nt, Homo sapiens
ggcugaggauuucaa

SEQ ID NO: 779353 - RNA, 15 nt, Homo sapiens
ggcugagggugcccu

SEQ ID NO: 779354 - RNA, 15 nt, Homo sapiens
ggcugaucucaggga

SEQ ID NO: 779355 - RNA, 13 nt, Homo sapiens
ggcugcagguguu

SEQ ID NO: 779356 - RNA, 14 nt, Homo sapiens
ggcugcagguguuc

SEQ ID NO: 779357 - RNA, 19 nt, Homo sapiens
ggcugccccaaccugcuga

SEQ ID NO: 779358 - RNA, 18 nt, Homo sapiens
ggcugccccucucaccaa

SEQ ID NO: 779359 - RNA, 19 nt, Homo sapiens
ggcugccgcccugcuccac

SEQ ID NO: 779360 - RNA, 17 nt, Homo sapiens
ggcugccugagcaccuc

SEQ ID NO: 779361 - RNA, 22 nt, Homo sapiens
ggcugcuucuccaccuccccca

SEQ ID NO: 779362 - RNA, 15 nt, Homo sapiens
ggcuggagugcaaug

SEQ ID NO: 779363 - RNA, 14 nt, Homo sapiens
ggcuggagugcagu

SEQ ID NO: 779364 - RNA, 16 nt, Homo sapiens
ggcuggagugcagugg

SEQ ID NO: 779365 - RNA, 19 nt, Homo sapiens
ggcuggagugcaguggcgu

SEQ ID NO: 779366 - RNA, 20 nt, Homo sapiens
ggcuggagugcaguggugca

SEQ ID NO: 779367 - RNA, 23 nt, Homo sapiens
ggcuggagugcaguggugcaauc

SEQ ID NO: 779368 - RNA, 19 nt, Homo sapiens
ggcuggaugugguggcaua

SEQ ID NO: 779369 - RNA, 18 nt, Homo sapiens
ggcuggcugaguggaaug

SEQ ID NO: 779370 - RNA, 13 nt, Homo sapiens
ggcugggccaugu

SEQ ID NO: 779371 - RNA, 18 nt, Homo sapiens
ggcuggucuuggugaaca

SEQ ID NO: 779372 - RNA, 13 nt, Homo sapiens
ggcugucagccca

SEQ ID NO: 779373 - RNA, 22 nt, Homo sapiens
ggcugucaggauucuucaagga

SEQ ID NO: 779374 - RNA, 18 nt, Homo sapiens
ggcugucaucagccugug

SEQ ID NO: 779375 - RNA, 20 nt, Homo sapiens
ggcugugcggaucucuggag

SEQ ID NO: 779376 - RNA, 18 nt, Homo sapiens
ggcugugggcaagccuaa

SEQ ID NO: 779377 - RNA, 16 nt, Homo sapiens
ggcuguguuuccaucu

SEQ ID NO: 779378 - RNA, 17 nt, Homo sapiens
ggcuguuccagacucag

SEQ ID NO: 779379 - RNA, 19 nt, Homo sapiens
ggcuguucuagacacagug

SEQ ID NO: 779380 - RNA, 13 nt, Homo sapiens
ggcuguucugcac

SEQ ID NO: 779381 - RNA, 21 nt, Homo sapiens
ggcuguugagggccacuuuuu

SEQ ID NO: 779382 - RNA, 13 nt, Homo sapiens
ggcuuagugccac

SEQ ID NO: 779383 - RNA, 19 nt, Homo sapiens
ggcuuauauuaagcaaaca

SEQ ID NO: 779384 - RNA, 15 nt, Homo sapiens
ggcuucaaguggcag

SEQ ID NO: 779385 - RNA, 16 nt, Homo sapiens
ggcuucagugagccau

SEQ ID NO: 779386 - RNA, 14 nt, Homo sapiens
ggcuucaguguuuu

SEQ ID NO: 779387 - RNA, 15 nt, Homo sapiens
ggcuuccaucugccc

SEQ ID NO: 779388 - RNA, 19 nt, Homo sapiens
ggcuuccccagguggccug

SEQ ID NO: 779389 - RNA, 23 nt, Homo sapiens
ggcuucccuucuccccagccaga

SEQ ID NO: 779390 - RNA, 22 nt, Homo sapiens
ggcuucggacagugcccaugca

SEQ ID NO: 779391 - RNA, 16 nt, Homo sapiens
ggcuucuaguuugcaa

SEQ ID NO: 779392 - RNA, 11 nt, Homo sapiens
ggcuucucacg

SEQ ID NO: 779393 - RNA, 12 nt, Homo sapiens
gggccucuccag

SEQ ID NO: 779394 - RNA, 15 nt, Homo sapiens
gggccugcaggugag

SEQ ID NO: 779395 - RNA, 16 nt, Homo sapiens
gggccugcuccagacc

SEQ ID NO: 779396 - RNA, 16 nt, Homo sapiens
gggccuguaaucccag

SEQ ID NO: 779397 - RNA, 16 nt, Homo sapiens
gggccugucgugccag

SEQ ID NO: 779398 - RNA, 22 nt, Homo sapiens
gggccuuaucgggcuccagcca

SEQ ID NO: 779399 - RNA, 18 nt, Homo sapiens
gggccuuggaucgcuaag

SEQ ID NO: 779400 - RNA, 17 nt, Homo sapiens
gggcgagucacugccuc

SEQ ID NO: 779401 - RNA, 17 nt, Homo sapiens
gggcgcaagucaaagag

SEQ ID NO: 779402 - RNA, 18 nt, Homo sapiens
gggcgcauacuacaguaa

SEQ ID NO: 779403 - RNA, 13 nt, Homo sapiens
gggcggccagugc

SEQ ID NO: 779404 - RNA, 22 nt, Homo sapiens
gggcggggcguguagccagcca

SEQ ID NO: 779405 - RNA, 12 nt, Homo sapiens
gggcggucacag

SEQ ID NO: 779406 - RNA, 21 nt, Homo sapiens
gggcgugaaccaccaugccca

SEQ ID NO: 779407 - RNA, 17 nt, Homo sapiens
gggcguugggagccuag

SEQ ID NO: 779408 - RNA, 12 nt, Homo sapiens
gggcuagggagg

SEQ ID NO: 779409 - RNA, 22 nt, Homo sapiens
gggcucaccagcugggguccug

SEQ ID NO: 779410 - RNA, 15 nt, Homo sapiens
gggcuccagccaucu

SEQ ID NO: 779411 - RNA, 16 nt, Homo sapiens
gggcucccaggggucu

SEQ ID NO: 779412 - RNA, 22 nt, Homo sapiens
gggcuccugcauccucacugug

SEQ ID NO: 779413 - RNA, 18 nt, Homo sapiens
gggcucuagggacugcca

SEQ ID NO: 779414 - RNA, 19 nt, Homo sapiens
gggcucucucaugauagaa

SEQ ID NO: 779415 - RNA, 18 nt, Homo sapiens
gggcucugacccaagugg

SEQ ID NO: 779416 - RNA, 19 nt, Homo sapiens
gggcugaaagaacauggac

SEQ ID NO: 779417 - RNA, 15 nt, Homo sapiens
aauccagaacucaaa

SEQ ID NO: 779418 - RNA, 16 nt, Homo sapiens
aauccaggcagaucca

SEQ ID NO: 779419 - RNA, 19 nt, Homo sapiens
aauccagugagcacuagaa

SEQ ID NO: 779420 - RNA, 15 nt, Homo sapiens
aauccaguggugggu

SEQ ID NO: 779421 - RNA, 23 nt, Homo sapiens
aauccaucacuagccaugauaac

SEQ ID NO: 779422 - RNA, 19 nt, Homo sapiens
aauccaugcuucucaucug

SEQ ID NO: 779423 - RNA, 13 nt, Homo sapiens
aauccauuuucua

SEQ ID NO: 779424 - RNA, 17 nt, Homo sapiens
aaucccaagaaauggaa

SEQ ID NO: 779425 - RNA, 16 nt, Homo sapiens
aaucccaccacugcac

SEQ ID NO: 779426 - RNA, 15 nt, Homo sapiens
aaucccagcacuuug

SEQ ID NO: 779427 - RNA, 17 nt, Homo sapiens
aaucccagcuacucaag

SEQ ID NO: 779428 - RNA, 20 nt, Homo sapiens
aaucccucccugacccacug

SEQ ID NO: 779429 - RNA, 20 nt, Homo sapiens
aaucccuguacucugaccca

SEQ ID NO: 779430 - RNA, 19 nt, Homo sapiens
aauccggagcgcggcagua

SEQ ID NO: 779431 - RNA, 14 nt, Homo sapiens
aauccgugaaguca

SEQ ID NO: 779432 - RNA, 20 nt, Homo sapiens
aauccuauuuaucagacucu

SEQ ID NO: 779433 - RNA, 18 nt, Homo sapiens
aauccucccuacuuccaa

SEQ ID NO: 779434 - RNA, 15 nt, Homo sapiens
aauccugcaaugaaa

SEQ ID NO: 779435 - RNA, 18 nt, Homo sapiens
aauccugcauuugcagau

SEQ ID NO: 779436 - RNA, 20 nt, Homo sapiens
aauccugucauauaauaaaa

SEQ ID NO: 779437 - RNA, 15 nt, Homo sapiens
aauccuuuacuguua

SEQ ID NO: 779438 - RNA, 19 nt, Homo sapiens
aauccuuuacuguuaguca

SEQ ID NO: 779439 - RNA, 22 nt, Homo sapiens
aaucgacuguauucgugcauuu

SEQ ID NO: 779440 - RNA, 23 nt, Homo sapiens
aaucgauucugcagcaccggccu

SEQ ID NO: 779441 - RNA, 20 nt, Homo sapiens
aaucuaaaccuuacaugugu

SEQ ID NO: 779442 - RNA, 13 nt, Homo sapiens
aaucuaaucucuu

SEQ ID NO: 779443 - RNA, 13 nt, Homo sapiens
aaucuacauucac

SEQ ID NO: 779444 - RNA, 20 nt, Homo sapiens
aaucuaccugcccuaaggga

SEQ ID NO: 779445 - RNA, 21 nt, Homo sapiens
aaucuagagaaggcauuucau

SEQ ID NO: 779446 - RNA, 17 nt, Homo sapiens
aaucuaggaagcucaga

SEQ ID NO: 779447 - RNA, 18 nt, Homo sapiens
aaucuauauuugucuucc

SEQ ID NO: 779448 - RNA, 15 nt, Homo sapiens
aaucucagccagccu

SEQ ID NO: 779449 - RNA, 18 nt, Homo sapiens
aaucucagccagccucca

SEQ ID NO: 779450 - RNA, 21 nt, Homo sapiens
aaucucaguuguuugcuucuu

SEQ ID NO: 779451 - RNA, 13 nt, Homo sapiens
aaucuccagugga

SEQ ID NO: 779452 - RNA, 15 nt, Homo sapiens
aaucuccaucucaaa

SEQ ID NO: 779453 - RNA, 22 nt, Homo sapiens
aaucucccagugacaacaucgc

SEQ ID NO: 779454 - RNA, 18 nt, Homo sapiens
aaucucguuucuccucuu

SEQ ID NO: 779455 - RNA, 19 nt, Homo sapiens
aaucucuacugcuuuggau

SEQ ID NO: 779456 - RNA, 19 nt, Homo sapiens
aaucucuauguauauucua

SEQ ID NO: 779457 - RNA, 16 nt, Homo sapiens
aaucucucaacaugau

SEQ ID NO: 779458 - RNA, 17 nt, Homo sapiens
aaucucuucaugcuuga

SEQ ID NO: 779459 - RNA, 16 nt, Homo sapiens
aaucucuugcacucaa

SEQ ID NO: 779460 - RNA, 19 nt, Homo sapiens
aaucugaccguucuauugu

SEQ ID NO: 779461 - RNA, 17 nt, Homo sapiens
aaucugagaaacucuac

SEQ ID NO: 779462 - RNA, 23 nt, Homo sapiens
aaucugagaggccacagugcaau

SEQ ID NO: 779463 - RNA, 20 nt, Homo sapiens
aaucugagccagugcuuuaa

SEQ ID NO: 779464 - RNA, 16 nt, Homo sapiens
aaucugagcugcaggu

SEQ ID NO: 779465 - RNA, 16 nt, Homo sapiens
aaucugcucacuuuaa

SEQ ID NO: 779466 - RNA, 21 nt, Homo sapiens
aaucuggcaggaaucuaucca

SEQ ID NO: 779467 - RNA, 17 nt, Homo sapiens
aaucuggcuuagugcca

SEQ ID NO: 779468 - RNA, 19 nt, Homo sapiens
aaucuggguaucuuuccag

SEQ ID NO: 779469 - RNA, 16 nt, Homo sapiens
aaucugugccugcacu

SEQ ID NO: 779470 - RNA, 19 nt, Homo sapiens
aaucuguuaccauucugau

SEQ ID NO: 779471 - RNA, 17 nt, Homo sapiens
aaucuuaaacaauguau

SEQ ID NO: 779472 - RNA, 22 nt, Homo sapiens
aaucuuaucuuugcucccugca

SEQ ID NO: 779473 - RNA, 13 nt, Homo sapiens
aaucuuaugcucu

SEQ ID NO: 779474 - RNA, 22 nt, Homo sapiens
aaucuuauuccgagcauuccag

SEQ ID NO: 779475 - RNA, 15 nt, Homo sapiens
aaucuucaccucaga

SEQ ID NO: 779476 - RNA, 22 nt, Homo sapiens
aaucuucuacuuuuaacuaaua

SEQ ID NO: 779477 - RNA, 17 nt, Homo sapiens
aaucuugcucugcuuga

SEQ ID NO: 779478 - RNA, 19 nt, Homo sapiens
aaucuuucuuuaccugaga

SEQ ID NO: 779479 - RNA, 20 nt, Homo sapiens
aaucuuuggguaacuucaaa

SEQ ID NO: 779480 - RNA, 16 nt, Homo sapiens
aaucuuuguaccaaaa

SEQ ID NO: 779481 - RNA, 19 nt, Homo sapiens
aaucuuuuugcuucuacuu

SEQ ID NO: 779482 - RNA, 14 nt, Homo sapiens
aaugaaaaugcagu

SEQ ID NO: 779483 - RNA, 13 nt, Homo sapiens
aaugaaacuuuaa

SEQ ID NO: 779484 - RNA, 24 nt, Homo sapiens
aaugaaagcauguggcauguucau

SEQ ID NO: 779485 - RNA, 21 nt, Homo sapiens
aaugaaagggaaacugggaaa

SEQ ID NO: 779486 - RNA, 17 nt, Homo sapiens
aaugaaaucccagguaa

SEQ ID NO: 779487 - RNA, 17 nt, Homo sapiens
aaugaaauguaugugcu

SEQ ID NO: 779488 - RNA, 21 nt, Homo sapiens
aaugaacaaaccugugaucua

SEQ ID NO: 779489 - RNA, 18 nt, Homo sapiens
aaugaacaucucuugaaa

SEQ ID NO: 779490 - RNA, 22 nt, Homo sapiens
aaugaaccuucugcaacaucuu

SEQ ID NO: 779491 - RNA, 16 nt, Homo sapiens
aaugaacuaacugaca

SEQ ID NO: 779492 - RNA, 17 nt, Homo sapiens
aaugaacuaccaucuga

SEQ ID NO: 779493 - RNA, 13 nt, Homo sapiens
aaugaagacuguu

SEQ ID NO: 779494 - RNA, 15 nt, Homo sapiens
aaugaagaugucuaa

SEQ ID NO: 779495 - RNA, 16 nt, Homo sapiens
aaugaagcagcuuuaa

SEQ ID NO: 779496 - RNA, 16 nt, Homo sapiens
aaugaagcguugccau

SEQ ID NO: 779497 - RNA, 13 nt, Homo sapiens
aaugaagcugcca

SEQ ID NO: 779498 - RNA, 19 nt, Homo sapiens
aaugaauuccucauuugga

SEQ ID NO: 779499 - RNA, 20 nt, Homo sapiens
aaugacacagucuuggcuca

SEQ ID NO: 779500 - RNA, 23 nt, Homo sapiens
aaugacaccacacucugccugaa

SEQ ID NO: 779501 - RNA, 21 nt, Homo sapiens
aaugacacccaugccagagag

SEQ ID NO: 779502 - RNA, 22 nt, Homo sapiens
aaugacacuagcuaauaucaau

SEQ ID NO: 779503 - RNA, 12 nt, Homo sapiens
aaugacagaucc

SEQ ID NO: 779504 - RNA, 17 nt, Homo sapiens
aaugacaugcacugacc

SEQ ID NO: 779505 - RNA, 18 nt, Homo sapiens
aaugacaugcacugaccc

SEQ ID NO: 779506 - RNA, 19 nt, Homo sapiens
aaugacauucaguauauaa

SEQ ID NO: 779507 - RNA, 21 nt, Homo sapiens
gguucacacccuguuuuauaa

SEQ ID NO: 779508 - RNA, 23 nt, Homo sapiens
gguucacguacaaaacucuguau

SEQ ID NO: 779509 - RNA, 14 nt, Homo sapiens
gguucagugccuuc

SEQ ID NO: 779510 - RNA, 22 nt, Homo sapiens
gguucccaauaaaagugacucu

SEQ ID NO: 779511 - RNA, 19 nt, Homo sapiens
gguucucagguguugccaa

SEQ ID NO: 779512 - RNA, 12 nt, Homo sapiens
gguucugcccug

SEQ ID NO: 779513 - RNA, 20 nt, Homo sapiens
gguucuuaaaaaggaacaaa

SEQ ID NO: 779514 - RNA, 21 nt, Homo sapiens
gguugcacaaaaccacuuuuu

SEQ ID NO: 779515 - RNA, 21 nt, Homo sapiens
gguugccaaauugcugcauau

SEQ ID NO: 779516 - RNA, 22 nt, Homo sapiens
gguugcuguauuuguucaguga

SEQ ID NO: 779517 - RNA, 22 nt, Homo sapiens
gguugcuguccucucauuugca

SEQ ID NO: 779518 - RNA, 19 nt, Homo sapiens
gguuggacuguaagggauu

SEQ ID NO: 779519 - RNA, 17 nt, Homo sapiens
gguuggagcgagcaucc

SEQ ID NO: 779520 - RNA, 14 nt, Homo sapiens
gguuggcagcauuc

SEQ ID NO: 779521 - RNA, 18 nt, Homo sapiens
gguuggcccccaaagaua

SEQ ID NO: 779522 - RNA, 18 nt, Homo sapiens
gguuguacguuuugcaca

SEQ ID NO: 779523 - RNA, 15 nt, Homo sapiens
gguugugcagggugu

SEQ ID NO: 779524 - RNA, 16 nt, Homo sapiens
gguuuccaaagacagu

SEQ ID NO: 779525 - RNA, 21 nt, Homo sapiens
gguuuccaagucccgggucuc

SEQ ID NO: 779526 - RNA, 15 nt, Homo sapiens
gguuuccuuccuugg

SEQ ID NO: 779527 - RNA, 16 nt, Homo sapiens
gguuucggagcacgua

SEQ ID NO: 779528 - RNA, 17 nt, Homo sapiens
gguuugucagaggcuaa

SEQ ID NO: 779529 - RNA, 21 nt, Homo sapiens
gguuuguccuggucaugcaca

SEQ ID NO: 779530 - RNA, 23 nt, Homo sapiens
gguuugucgggcaccagccagcg

SEQ ID NO: 779531 - RNA, 20 nt, Homo sapiens
aauguucuaaaguuuugcaa

SEQ ID NO: 779532 - RNA, 16 nt, Homo sapiens
aauguuguacuugaaa

SEQ ID NO: 779533 - RNA, 15 nt, Homo sapiens
aauguuuaccagugu

SEQ ID NO: 779534 - RNA, 21 nt, Homo sapiens
aauguuuauuaaaugcuucau

SEQ ID NO: 779535 - RNA, 18 nt, Homo sapiens
aauguuuguauacauguu

SEQ ID NO: 779536 - RNA, 22 nt, Homo sapiens
aauguuugucuggauuggcuau

SEQ ID NO: 779537 - RNA, 21 nt, Homo sapiens
aauguuuuacauuccauuuca

SEQ ID NO: 779538 - RNA, 22 nt, Homo sapiens
aauguuuuacugugaaacuggc

SEQ ID NO: 779539 - RNA, 20 nt, Homo sapiens
aauuaaaaaaaaaacuucau

SEQ ID NO: 779540 - RNA, 16 nt, Homo sapiens
aauuaaaaaagcauac

SEQ ID NO: 779541 - RNA, 15 nt, Homo sapiens
aauuaaaaaccugau

SEQ ID NO: 779542 - RNA, 21 nt, Homo sapiens
aauuaaaauucguuuuugcaa

SEQ ID NO: 779543 - RNA, 19 nt, Homo sapiens
aauuaaauccaacuuucac

SEQ ID NO: 779544 - RNA, 20 nt, Homo sapiens
aauuaaauccaacuuucaca

SEQ ID NO: 779545 - RNA, 13 nt, Homo sapiens
aauuaaaugccuu

SEQ ID NO: 779546 - RNA, 22 nt, Homo sapiens
aauuaacuauaacaaucacugg

SEQ ID NO: 779547 - RNA, 13 nt, Homo sapiens
aauuaagcagcuc

SEQ ID NO: 779548 - RNA, 12 nt, Homo sapiens
aauuaagcauuu

SEQ ID NO: 779549 - RNA, 18 nt, Homo sapiens
aauuaaugcagauuucuc

SEQ ID NO: 779550 - RNA, 22 nt, Homo sapiens
aauuacacaguaagucauuuaa

SEQ ID NO: 779551 - RNA, 21 nt, Homo sapiens
aauuacagaauauacuuagaa

SEQ ID NO: 779552 - RNA, 13 nt, Homo sapiens
aauuacagacucu

SEQ ID NO: 779553 - RNA, 21 nt, Homo sapiens
aauuacaguaaucccauuucc

SEQ ID NO: 779554 - RNA, 21 nt, Homo sapiens
aauuacauagacuuaggcauu

SEQ ID NO: 779555 - RNA, 11 nt, Homo sapiens
aauuaccaugc

SEQ ID NO: 779556 - RNA, 21 nt, Homo sapiens
aauuaccauuaauuacauaca

SEQ ID NO: 779557 - RNA, 14 nt, Homo sapiens
aauuaccuguggau

SEQ ID NO: 779558 - RNA, 20 nt, Homo sapiens
aauuacuauauucuuacccu

SEQ ID NO: 779559 - RNA, 15 nt, Homo sapiens
aauuacucuaacaaa

SEQ ID NO: 779560 - RNA, 16 nt, Homo sapiens
aauuagaaaguagcca

SEQ ID NO: 779561 - RNA, 14 nt, Homo sapiens
aauuagaugaacuc

SEQ ID NO: 779562 - RNA, 12 nt, Homo sapiens
aauuagcaauug

SEQ ID NO: 779563 - RNA, 12 nt, Homo sapiens
aauuagccagau

SEQ ID NO: 779564 - RNA, 21 nt, Homo sapiens
aauuagcugugugaaauacca

SEQ ID NO: 779565 - RNA, 16 nt, Homo sapiens
aauuagguagcacagc

SEQ ID NO: 779566 - RNA, 15 nt, Homo sapiens
aauuaguaagccaug

SEQ ID NO: 779567 - RNA, 12 nt, Homo sapiens
aauuaguucucc

SEQ ID NO: 779568 - RNA, 15 nt, Homo sapiens
aauuauaauguugcc

SEQ ID NO: 779569 - RNA, 16 nt, Homo sapiens
aauuauacuacuuugu

SEQ ID NO: 779570 - RNA, 14 nt, Homo sapiens
aauuaucaagcuuu

SEQ ID NO: 779571 - RNA, 21 nt, Homo sapiens
aauuaucaucuuuugaucuuu

SEQ ID NO: 779572 - RNA, 23 nt, Homo sapiens
aauuauccacaugaaaauaaaga

SEQ ID NO: 779573 - RNA, 20 nt, Homo sapiens
aauuaucggaagcagugccu

SEQ ID NO: 779574 - RNA, 13 nt, Homo sapiens
aauuaugaccaug

SEQ ID NO: 779575 - RNA, 12 nt, Homo sapiens
aauuaugccaua

SEQ ID NO: 779576 - RNA, 16 nt, Homo sapiens
aauuaugucugcugaa

SEQ ID NO: 779577 - RNA, 18 nt, Homo sapiens
aauuauuuuguucauaca

SEQ ID NO: 779578 - RNA, 19 nt, Homo sapiens
aauucaaaaguuccaagag

SEQ ID NO: 779579 - RNA, 13 nt, Homo sapiens
aauucaacccagc

SEQ ID NO: 779580 - RNA, 13 nt, Homo sapiens
aauucaacuuugu

SEQ ID NO: 779581 - RNA, 20 nt, Homo sapiens
aauucaaucagagcuccagu

SEQ ID NO: 779582 - RNA, 20 nt, Homo sapiens
aauucacagaauagcacaaa

SEQ ID NO: 779583 - RNA, 16 nt, Homo sapiens
aauucaccaacacagu

SEQ ID NO: 779584 - RNA, 22 nt, Homo sapiens
aauucagacaagcugcauuuca

SEQ ID NO: 779585 - RNA, 14 nt, Homo sapiens
aauucagcaccagu

SEQ ID NO: 779586 - RNA, 13 nt, Homo sapiens
aauucagcacuua

SEQ ID NO: 779587 - RNA, 13 nt, Homo sapiens
aauucagugaaga

SEQ ID NO: 779588 - RNA, 16 nt, Homo sapiens
aauucauaaccaaaga

SEQ ID NO: 779589 - RNA, 11 nt, Homo sapiens
aauucauuugu

SEQ ID NO: 779590 - RNA, 13 nt, Homo sapiens
aauuccugugauu

SEQ ID NO: 779591 - RNA, 20 nt, Homo sapiens
aauuccuguuacuuuacaga

SEQ ID NO: 779592 - RNA, 13 nt, Homo sapiens
aauuccuuugugu

SEQ ID NO: 779593 - RNA, 16 nt, Homo sapiens
aauucguuuuugcaau

SEQ ID NO: 779594 - RNA, 22 nt, Homo sapiens
aauucuaccaaggucuucuuaa

SEQ ID NO: 779595 - RNA, 11 nt, Homo sapiens
aauucuaguuu

SEQ ID NO: 779596 - RNA, 14 nt, Homo sapiens
aauucuauaguaag

SEQ ID NO: 779597 - RNA, 12 nt, Homo sapiens
aauucuauuaca

SEQ ID NO: 779598 - RNA, 22 nt, Homo sapiens
aauucucccagcguuaacacaa

SEQ ID NO: 779599 - RNA, 15 nt, Homo sapiens
aauucucuagauuua

SEQ ID NO: 779600 - RNA, 23 nt, Homo sapiens
aauucucucacaaaguccacuuu

SEQ ID NO: 779601 - RNA, 21 nt, Homo sapiens
aauucucuuauccaacaucaa

SEQ ID NO: 779602 - RNA, 18 nt, Homo sapiens
aauucugauugauuugau

SEQ ID NO: 779603 - RNA, 22 nt, Homo sapiens
aauucugcagaguuuccaaaac

SEQ ID NO: 779604 - RNA, 22 nt, Homo sapiens
aauucugugacauacauauuau

SEQ ID NO: 779605 - RNA, 16 nt, Homo sapiens
aauucuugaaguucau

SEQ ID NO: 779606 - RNA, 19 nt, Homo sapiens
aauucuuucaauucuucau

SEQ ID NO: 779607 - RNA, 15 nt, Homo sapiens
aauucuuucaguggc

SEQ ID NO: 779608 - RNA, 18 nt, Homo sapiens
aauucuuuccccaaagac

SEQ ID NO: 779609 - RNA, 16 nt, Homo sapiens
aauucuuucuguugaa

SEQ ID NO: 779610 - RNA, 16 nt, Homo sapiens
aauugaaaaguuauuu

SEQ ID NO: 779611 - RNA, 14 nt, Homo sapiens
aauugaaagaacuu

SEQ ID NO: 779612 - RNA, 19 nt, Homo sapiens
aauugaaagagauccaggg

SEQ ID NO: 779613 - RNA, 14 nt, Homo sapiens
aauugaacuaacaa

SEQ ID NO: 779614 - RNA, 13 nt, Homo sapiens
aauugacaggauu

SEQ ID NO: 779615 - RNA, 18 nt, Homo sapiens
aauugacugaagcacagc

SEQ ID NO: 779616 - RNA, 23 nt, Homo sapiens
aauugauguugcuggacugucau

SEQ ID NO: 779617 - RNA, 16 nt, Homo sapiens
aauugcaaaacccaac

SEQ ID NO: 779618 - RNA, 18 nt, Homo sapiens
aauugcaaauaaaccacu

SEQ ID NO: 779619 - RNA, 12 nt, Homo sapiens
aauugcaauaca

SEQ ID NO: 779620 - RNA, 23 nt, Homo sapiens
aauugcacacacucagugcagca

SEQ ID NO: 779621 - RNA, 22 nt, Homo sapiens
aauugcagguauuggggaacag

SEQ ID NO: 779622 - RNA, 11 nt, Homo sapiens
acaucugucac

SEQ ID NO: 779623 - RNA, 14 nt, Homo sapiens
acaucuuucacauu

SEQ ID NO: 779624 - RNA, 13 nt, Homo sapiens
acaucuuuuacau

SEQ ID NO: 779625 - RNA, 19 nt, Homo sapiens
acaucuuuuacauucugca

SEQ ID NO: 779626 - RNA, 20 nt, Homo sapiens
acaugaaacugaauaaggag

SEQ ID NO: 779627 - RNA, 19 nt, Homo sapiens
acaugaacacuuuuuauca

SEQ ID NO: 779628 - RNA, 18 nt, Homo sapiens
acaugaaucccacccaca

SEQ ID NO: 779629 - RNA, 13 nt, Homo sapiens
acaugaaugcaca

SEQ ID NO: 779630 - RNA, 20 nt, Homo sapiens
acaugacauucuuagcugua

SEQ ID NO: 779631 - RNA, 18 nt, Homo sapiens
acaugaucuucuuuauaa

SEQ ID NO: 779632 - RNA, 21 nt, Homo sapiens
acaugauggagcgcaccugcc

SEQ ID NO: 779633 - RNA, 18 nt, Homo sapiens
acaugcaacagaagugac

SEQ ID NO: 779634 - RNA, 13 nt, Homo sapiens
acaugcacacggg

SEQ ID NO: 779635 - RNA, 13 nt, Homo sapiens
acaugcacugacc

SEQ ID NO: 779636 - RNA, 17 nt, Homo sapiens
acaugcagcccaugccc

SEQ ID NO: 779637 - RNA, 15 nt, Homo sapiens
acaugccagugacac

SEQ ID NO: 779638 - RNA, 15 nt, Homo sapiens
acaugcgaccgugac

SEQ ID NO: 779639 - RNA, 17 nt, Homo sapiens
acaugcuaccacuggua

SEQ ID NO: 779640 - RNA, 19 nt, Homo sapiens
acaugcucacacauuacaa

SEQ ID NO: 779641 - RNA, 14 nt, Homo sapiens
acaugcuggugcau

SEQ ID NO: 779642 - RNA, 17 nt, Homo sapiens
acauggccuaugcacau

SEQ ID NO: 779643 - RNA, 15 nt, Homo sapiens
acauggcuagccuuu

SEQ ID NO: 779644 - RNA, 18 nt, Homo sapiens
acauggucaaaauuucac

SEQ ID NO: 779645 - RNA, 23 nt, Homo sapiens
acaugguggaaaacgaagcucau

SEQ ID NO: 779646 - RNA, 13 nt, Homo sapiens
acaugguggacag

SEQ ID NO: 779647 - RNA, 23 nt, Homo sapiens
acauggugugaguccaaagaagg

SEQ ID NO: 779648 - RNA, 15 nt, Homo sapiens
acauguaauuugaug

SEQ ID NO: 779649 - RNA, 13 nt, Homo sapiens
acauguaugugca

SEQ ID NO: 779650 - RNA, 18 nt, Homo sapiens
acauguaugugcauuuca

SEQ ID NO: 779651 - RNA, 19 nt, Homo sapiens
acaugucuccuauccuggu

SEQ ID NO: 779652 - RNA, 20 nt, Homo sapiens
gugacuuuuuagccagugac

SEQ ID NO: 779653 - RNA, 17 nt, Homo sapiens
gugagaaaaugccucaa

SEQ ID NO: 779654 - RNA, 23 nt, Homo sapiens
gugagaaauuugccuuguucaau

SEQ ID NO: 779655 - RNA, 17 nt, Homo sapiens
gugagcaagggggccca

SEQ ID NO: 779656 - RNA, 21 nt, Homo sapiens
gugagcacacccgugugcaca

SEQ ID NO: 779657 - RNA, 15 nt, Homo sapiens
gugagcacuagaaua

SEQ ID NO: 779658 - RNA, 21 nt, Homo sapiens
gugagcagggucaagccucuu

SEQ ID NO: 779659 - RNA, 12 nt, Homo sapiens
gugaggcucucu

SEQ ID NO: 779660 - RNA, 20 nt, Homo sapiens
gugauacacugaaaggaaaa

SEQ ID NO: 779661 - RNA, 23 nt, Homo sapiens
gugauauacugguucacauccua

SEQ ID NO: 779662 - RNA, 19 nt, Homo sapiens
gugaucaagguuaacaaag

SEQ ID NO: 779663 - RNA, 18 nt, Homo sapiens
gugauccgccuaccucag

SEQ ID NO: 779664 - RNA, 18 nt, Homo sapiens
gugauccuuccaccucag

SEQ ID NO: 779665 - RNA, 13 nt, Homo sapiens
gugaucuaccugc

SEQ ID NO: 779666 - RNA, 17 nt, Homo sapiens
gugaucugccgccucag

SEQ ID NO: 779667 - RNA, 21 nt, Homo sapiens
gugauggagaugcagucacuu

SEQ ID NO: 779668 - RNA, 13 nt, Homo sapiens
gugauggggcaag

SEQ ID NO: 779669 - RNA, 16 nt, Homo sapiens
gugauuagaagcuaaa

SEQ ID NO: 779670 - RNA, 23 nt, Homo sapiens
gugauucucuugacguuuacaua

SEQ ID NO: 779671 - RNA, 21 nt, Homo sapiens
gugauucuguuuauucuucca

SEQ ID NO: 779672 - RNA, 21 nt, Homo sapiens
gugauugacacacagcacucu

SEQ ID NO: 779673 - RNA, 15 nt, Homo sapiens
gugauugguugcauc

SEQ ID NO: 779674 - RNA, 18 nt, Homo sapiens
gugauuucuguggauccc

SEQ ID NO: 779675 - RNA, 19 nt, Homo sapiens
gugauuucuuucuuugcac

SEQ ID NO: 779676 - RNA, 14 nt, Homo sapiens
gugcaaaaucuguu

SEQ ID NO: 779677 - RNA, 16 nt, Homo sapiens
gugcaacccagucaca

SEQ ID NO: 779678 - RNA, 21 nt, Homo sapiens
gugcaacgcuuuuugggagaa

SEQ ID NO: 779679 - RNA, 14 nt, Homo sapiens
gugcaaugaaugau

SEQ ID NO: 779680 - RNA, 17 nt, Homo sapiens
gugcacaggccucugcc

SEQ ID NO: 779681 - RNA, 19 nt, Homo sapiens
gugcacaggccucugccug

SEQ ID NO: 779682 - RNA, 18 nt, Homo sapiens
gugcacaggcgcauccca

SEQ ID NO: 779683 - RNA, 21 nt, Homo sapiens
gugcacauuucauaguuucaa

SEQ ID NO: 779684 - RNA, 22 nt, Homo sapiens
gugcacauuucuuugcauucca

SEQ ID NO: 779685 - RNA, 23 nt, Homo sapiens
gugcaccccuccccauucacaga

SEQ ID NO: 779686 - RNA, 20 nt, Homo sapiens
gugcaccugccuccaccagc

SEQ ID NO: 779687 - RNA, 14 nt, Homo sapiens
gugcacucugcuaa

SEQ ID NO: 779688 - RNA, 21 nt, Homo sapiens
gugcagaauuggggcacuuaa

SEQ ID NO: 779689 - RNA, 18 nt, Homo sapiens
gugcagacacuugcucuc

SEQ ID NO: 779690 - RNA, 23 nt, Homo sapiens
gugcagaugagcagucacacugu

SEQ ID NO: 779691 - RNA, 16 nt, Homo sapiens
gugcagaugggcuguu

SEQ ID NO: 779692 - RNA, 17 nt, Homo sapiens
gugcagcccucuugccc

SEQ ID NO: 779693 - RNA, 19 nt, Homo sapiens
gugcaggauauuugcacua

SEQ ID NO: 779694 - RNA, 23 nt, Homo sapiens
gugcaguaagccuguuggauaaa

SEQ ID NO: 779695 - RNA, 13 nt, Homo sapiens
gugcagugauaca

SEQ ID NO: 779696 - RNA, 18 nt, Homo sapiens
gugcaguugugauuucug

SEQ ID NO: 779697 - RNA, 21 nt, Homo sapiens
gugcauaccggacuugucaca

SEQ ID NO: 779698 - RNA, 14 nt, Homo sapiens
gugcaucaaccagg

SEQ ID NO: 779699 - RNA, 15 nt, Homo sapiens
gugcaucccugagac

SEQ ID NO: 779700 - RNA, 12 nt, Homo sapiens
gugcaugcucuc

SEQ ID NO: 779701 - RNA, 14 nt, Homo sapiens
gugcaugugcugug

SEQ ID NO: 779702 - RNA, 11 nt, Homo sapiens
gugccaaaaau

SEQ ID NO: 779703 - RNA, 13 nt, Homo sapiens
gugccaagcacag

SEQ ID NO: 779704 - RNA, 17 nt, Homo sapiens
gugccacccaugcagcu

SEQ ID NO: 779705 - RNA, 14 nt, Homo sapiens
gugccacucagaga

SEQ ID NO: 779706 - RNA, 18 nt, Homo sapiens
gugccacuugacauuccu

SEQ ID NO: 779707 - RNA, 22 nt, Homo sapiens
gugccacuuuaauccuuccacu

SEQ ID NO: 779708 - RNA, 19 nt, Homo sapiens
gugccagacauugcucuca

SEQ ID NO: 779709 - RNA, 15 nt, Homo sapiens
gugccagcaccugcc

SEQ ID NO: 779710 - RNA, 17 nt, Homo sapiens
gugccaguuauggcuau

SEQ ID NO: 779711 - RNA, 12 nt, Homo sapiens
gugccaguuccu

SEQ ID NO: 779712 - RNA, 21 nt, Homo sapiens
gugccauuuuaagaguuacuu

SEQ ID NO: 779713 - RNA, 22 nt, Homo sapiens
gugcccacccgucuucaaucuc

SEQ ID NO: 779714 - RNA, 16 nt, Homo sapiens
gugccccagcaccaac

SEQ ID NO: 779715 - RNA, 19 nt, Homo sapiens
gugccccaugccuguccag

SEQ ID NO: 779716 - RNA, 17 nt, Homo sapiens
gugcccuuugggguccc

SEQ ID NO: 779717 - RNA, 18 nt, Homo sapiens
gugccuccaccaccacug

SEQ ID NO: 779718 - RNA, 23 nt, Homo sapiens
gugccugacacauagaaaacaau

SEQ ID NO: 779719 - RNA, 14 nt, Homo sapiens
gugccugagacacc

SEQ ID NO: 779720 - RNA, 18 nt, Homo sapiens
gugccugagacacccggu

SEQ ID NO: 779721 - RNA, 22 nt, Homo sapiens
gugccuucccuucucuggucuc

SEQ ID NO: 779722 - RNA, 18 nt, Homo sapiens
gugccuuggugugcugua

SEQ ID NO: 779723 - RNA, 15 nt, Homo sapiens
gugcgcgcgugcaug

SEQ ID NO: 779724 - RNA, 19 nt, Homo sapiens
gugcgugaaguaggcauau

SEQ ID NO: 779725 - RNA, 15 nt, Homo sapiens
gugcuagaugugcaa

SEQ ID NO: 779726 - RNA, 16 nt, Homo sapiens
gugcuagucacuggca

SEQ ID NO: 779727 - RNA, 21 nt, Homo sapiens
gugcuaugaauuuucaaguaa

SEQ ID NO: 779728 - RNA, 15 nt, Homo sapiens
gugcucaaugcaaau

SEQ ID NO: 779729 - RNA, 14 nt, Homo sapiens
gugcucagccaaau

SEQ ID NO: 779730 - RNA, 22 nt, Homo sapiens
gugcucauacguaucugcucau

SEQ ID NO: 779731 - RNA, 13 nt, Homo sapiens
gugcuccaucucc

SEQ ID NO: 779732 - RNA, 23 nt, Homo sapiens
gugcuccugugggagaucuucac

SEQ ID NO: 779733 - RNA, 14 nt, Homo sapiens
gugcucugugucaa

SEQ ID NO: 779734 - RNA, 18 nt, Homo sapiens
gugcucuuggcugacccc

SEQ ID NO: 779735 - RNA, 20 nt, Homo sapiens
gugcugacaacuuagcucag

SEQ ID NO: 779736 - RNA, 13 nt, Homo sapiens
accaaccuguuac

SEQ ID NO: 779737 - RNA, 15 nt, Homo sapiens
accaacuacagaaag

SEQ ID NO: 779738 - RNA, 18 nt, Homo sapiens
accaacugggcccaagac

SEQ ID NO: 779739 - RNA, 15 nt, Homo sapiens
accaacuguacaaaa

SEQ ID NO: 779740 - RNA, 14 nt, Homo sapiens
accaagcuucagag

SEQ ID NO: 779741 - RNA, 18 nt, Homo sapiens
accaaggaagcagccuca

SEQ ID NO: 779742 - RNA, 15 nt, Homo sapiens
accaaggacugagca

SEQ ID NO: 779743 - RNA, 20 nt, Homo sapiens
accaaggcaaacccuagauu

SEQ ID NO: 779744 - RNA, 14 nt, Homo sapiens
accaaggcagccuc

SEQ ID NO: 779745 - RNA, 21 nt, Homo sapiens
accaaggcgggagcaucucuu

SEQ ID NO: 779746 - RNA, 13 nt, Homo sapiens
accaagguauaca

SEQ ID NO: 779747 - RNA, 14 nt, Homo sapiens
accaagguauacau

SEQ ID NO: 779748 - RNA, 11 nt, Homo sapiens
accaaggugac

SEQ ID NO: 779749 - RNA, 20 nt, Homo sapiens
accaaguccuccgaaggcau

SEQ ID NO: 779750 - RNA, 12 nt, Homo sapiens
accaagugcaau

SEQ ID NO: 779751 - RNA, 23 nt, Homo sapiens
accaaguuauaaaucaaugucac

SEQ ID NO: 779752 - RNA, 19 nt, Homo sapiens
accaauaaagugacccugu

SEQ ID NO: 779753 - RNA, 14 nt, Homo sapiens
accaauacuacuga

SEQ ID NO: 779754 - RNA, 19 nt, Homo sapiens
accaauagcaucugugcca

SEQ ID NO: 779755 - RNA, 13 nt, Homo sapiens
accaauagcuuua

SEQ ID NO: 779756 - RNA, 20 nt, Homo sapiens
accaauagucucucugcaag

SEQ ID NO: 779757 - RNA, 15 nt, Homo sapiens
accaaugagccuuag

SEQ ID NO: 779758 - RNA, 13 nt, Homo sapiens
accaaugugugaa

SEQ ID NO: 779759 - RNA, 22 nt, Homo sapiens
accaaugugugaaguaugcacu

SEQ ID NO: 779760 - RNA, 20 nt, Homo sapiens
accaauucuggacagacaga

SEQ ID NO: 779761 - RNA, 16 nt, Homo sapiens
accaauugugcugcca

SEQ ID NO: 779762 - RNA, 18 nt, Homo sapiens
accacaaacggagccccu

SEQ ID NO: 779763 - RNA, 20 nt, Homo sapiens
accacaacugacacaggaaa

SEQ ID NO: 779764 - RNA, 12 nt, Homo sapiens
accacaccagcc

SEQ ID NO: 779765 - RNA, 16 nt, Homo sapiens
accacaccucccugaa

SEQ ID NO: 779766 - RNA, 20 nt, Homo sapiens
accacaccuggcccuugcaa

SEQ ID NO: 779767 - RNA, 13 nt, Homo sapiens
accacagcugcug

SEQ ID NO: 779768 - RNA, 20 nt, Homo sapiens
guggauuggcuuugugcuug

SEQ ID NO: 779769 - RNA, 16 nt, Homo sapiens
guggcaacaaugcccc

SEQ ID NO: 779770 - RNA, 16 nt, Homo sapiens
guggcaccaaccuugc

SEQ ID NO: 779771 - RNA, 16 nt, Homo sapiens
guggcaccgagaccaa

SEQ ID NO: 779772 - RNA, 16 nt, Homo sapiens
guggcagauuuaguga

SEQ ID NO: 779773 - RNA, 21 nt, Homo sapiens
guggcagcuggggagcagcug

SEQ ID NO: 779774 - RNA, 23 nt, Homo sapiens
guggcagcuggggagcagcugag

SEQ ID NO: 779775 - RNA, 17 nt, Homo sapiens
guggcaugaggaggucc

SEQ ID NO: 779776 - RNA, 14 nt, Homo sapiens
guggccaacccucu

SEQ ID NO: 779777 - RNA, 14 nt, Homo sapiens
guggccacagcagg

SEQ ID NO: 779778 - RNA, 13 nt, Homo sapiens
guggccaguauuu

SEQ ID NO: 779779 - RNA, 13 nt, Homo sapiens
guggcccaagacc

SEQ ID NO: 779780 - RNA, 18 nt, Homo sapiens
guggcccagggaagccaa

SEQ ID NO: 779781 - RNA, 19 nt, Homo sapiens
guggcccagggaagccaaa

SEQ ID NO: 779782 - RNA, 22 nt, Homo sapiens
guggcccaucuuacuggaagag

SEQ ID NO: 779783 - RNA, 15 nt, Homo sapiens
guggccccaacacaa

SEQ ID NO: 779784 - RNA, 22 nt, Homo sapiens
guggccuuccccuuuugccugg

SEQ ID NO: 779785 - RNA, 14 nt, Homo sapiens
guggcgacucugca

SEQ ID NO: 779786 - RNA, 22 nt, Homo sapiens
guggcgagaaauaaaguuugcu

SEQ ID NO: 779787 - RNA, 14 nt, Homo sapiens
guggcgugaucuca

SEQ ID NO: 779788 - RNA, 16 nt, Homo sapiens
guggcucaacauugug

SEQ ID NO: 779789 - RNA, 14 nt, Homo sapiens
guggcuccuaucug

SEQ ID NO: 779790 - RNA, 20 nt, Homo sapiens
guggcugggugcccucucag

SEQ ID NO: 779791 - RNA, 14 nt, Homo sapiens
guggcugugccacc

SEQ ID NO: 779792 - RNA, 18 nt, Homo sapiens
guggcuucccgcucagcc

SEQ ID NO: 779793 - RNA, 18 nt, Homo sapiens
guggcuuggccucaagag

SEQ ID NO: 779794 - RNA, 14 nt, Homo sapiens
gugggaacggcuga

SEQ ID NO: 779795 - RNA, 17 nt, Homo sapiens
gugggaagaauuggaag

SEQ ID NO: 779796 - RNA, 20 nt, Homo sapiens
gugggacaauggguggugaa

SEQ ID NO: 779797 - RNA, 17 nt, Homo sapiens
gugggacccuucagcca

SEQ ID NO: 779798 - RNA, 17 nt, Homo sapiens
gugggauccucccucau

SEQ ID NO: 779799 - RNA, 21 nt, Homo sapiens
gugggauggcauuuggucuca

SEQ ID NO: 779800 - RNA, 12 nt, Homo sapiens
gugggcacuggu

SEQ ID NO: 779801 - RNA, 18 nt, Homo sapiens
gugggcagagccuuccac

SEQ ID NO: 779802 - RNA, 15 nt, Homo sapiens
gugggcagguggugg

SEQ ID NO: 779803 - RNA, 13 nt, Homo sapiens
gugggcaucucaa

SEQ ID NO: 779804 - RNA, 21 nt, Homo sapiens
gugggcaucucaguuaggaga

SEQ ID NO: 779805 - RNA, 11 nt, Homo sapiens
gugggccacag

SEQ ID NO: 779806 - RNA, 13 nt, Homo sapiens
gugggccugugaa

SEQ ID NO: 779807 - RNA, 21 nt, Homo sapiens
gugggcgcaaaggugccucau

SEQ ID NO: 779808 - RNA, 15 nt, Homo sapiens
guggggauuggggga

SEQ ID NO: 779809 - RNA, 23 nt, Homo sapiens
gugggggugccgcuuucucugag

SEQ ID NO: 779810 - RNA, 21 nt, Homo sapiens
gugggguaaccaaauguuggc

SEQ ID NO: 779811 - RNA, 13 nt, Homo sapiens
guggggugcacuc

SEQ ID NO: 779812 - RNA, 19 nt, Homo sapiens
gugggguuuguaacacauu

SEQ ID NO: 779813 - RNA, 19 nt, Homo sapiens
gugggucucugggcuguca

SEQ ID NO: 779814 - RNA, 18 nt, Homo sapiens
guggguguggccagcaca

SEQ ID NO: 779815 - RNA, 15 nt, Homo sapiens
gugguauaaucucca

SEQ ID NO: 779816 - RNA, 24 nt, Homo sapiens
guggucaguaaauaacaggcauuu

SEQ ID NO: 779817 - RNA, 12 nt, Homo sapiens
gugguccagcuc

SEQ ID NO: 779818 - RNA, 14 nt, Homo sapiens
guggucccugagga

SEQ ID NO: 779819 - RNA, 20 nt, Homo sapiens
gugguggcacacaccuguag

SEQ ID NO: 779820 - RNA, 16 nt, Homo sapiens
gugguuaacaucucag

SEQ ID NO: 779821 - RNA, 19 nt, Homo sapiens
gugguuacuuccuacugua

SEQ ID NO: 779822 - RNA, 21 nt, Homo sapiens
gugguuauuuagggaacugcu

SEQ ID NO: 779823 - RNA, 16 nt, Homo sapiens
gugguugaaaaccaca

SEQ ID NO: 779824 - RNA, 19 nt, Homo sapiens
gugguuuguagacuuccuu

SEQ ID NO: 779825 - RNA, 20 nt, Homo sapiens
gugguuuuauuucaaaggga

SEQ ID NO: 779826 - RNA, 17 nt, Homo sapiens
guguaacacuugucaag

SEQ ID NO: 779827 - RNA, 14 nt, Homo sapiens
guguaacaggucuc

SEQ ID NO: 779828 - RNA, 23 nt, Homo sapiens
guguaaugugacuucaugcuaua

SEQ ID NO: 779829 - RNA, 14 nt, Homo sapiens
guguacauuucuau

SEQ ID NO: 779830 - RNA, 15 nt, Homo sapiens
guguaccuccucuca

SEQ ID NO: 779831 - RNA, 15 nt, Homo sapiens
guguaguaucuugaa

SEQ ID NO: 779832 - RNA, 17 nt, Homo sapiens
guguauauuuauucaua

SEQ ID NO: 779833 - RNA, 13 nt, Homo sapiens
guguauccaugca

SEQ ID NO: 779834 - RNA, 17 nt, Homo sapiens
guguaucuaauucagcu

SEQ ID NO: 779835 - RNA, 18 nt, Homo sapiens
guguauggguuaaaucaa

SEQ ID NO: 779836 - RNA, 20 nt, Homo sapiens
guguauucuagugaaugaau

SEQ ID NO: 779837 - RNA, 22 nt, Homo sapiens
guguauuuucgauauuucagga

SEQ ID NO: 779838 - RNA, 13 nt, Homo sapiens
gugucacccuuag

SEQ ID NO: 779839 - RNA, 21 nt, Homo sapiens
gugucacuacucacagucucu

SEQ ID NO: 779840 - RNA, 11 nt, Homo sapiens
gugucacuggc

SEQ ID NO: 779841 - RNA, 17 nt, Homo sapiens
gugucagacgagcagug

SEQ ID NO: 779842 - RNA, 16 nt, Homo sapiens
gugucagucagggaca

SEQ ID NO: 779843 - RNA, 15 nt, Homo sapiens
gugucaugccaguga

SEQ ID NO: 779844 - RNA, 23 nt, Homo sapiens
guguccaccauccccagcuggug

SEQ ID NO: 779845 - RNA, 19 nt, Homo sapiens
guguccagcugaguuucuc

SEQ ID NO: 779846 - RNA, 17 nt, Homo sapiens
guguccaggguccucua

SEQ ID NO: 779847 - RNA, 20 nt, Homo sapiens
guguccaggguccucuagcc

SEQ ID NO: 779848 - RNA, 13 nt, Homo sapiens
gugucccauagaa

SEQ ID NO: 779849 - RNA, 22 nt, Homo sapiens
guguccccacggucauccagug

SEQ ID NO: 779850 - RNA, 18 nt, Homo sapiens
gugucccugagcagcuua

SEQ ID NO: 779851 - RNA, 19 nt, Homo sapiens
guuauacuuauuuguauau

SEQ ID NO: 779852 - RNA, 20 nt, Homo sapiens
guuauagacagucguuccca

SEQ ID NO: 779853 - RNA, 15 nt, Homo sapiens
guuauagacugccau

SEQ ID NO: 779854 - RNA, 21 nt, Homo sapiens
guuauagcccugcccucccaa

SEQ ID NO: 779855 - RNA, 16 nt, Homo sapiens
guuauaguaacaucaa

SEQ ID NO: 779856 - RNA, 20 nt, Homo sapiens
guuauaguaacaucaaagau

SEQ ID NO: 779857 - RNA, 15 nt, Homo sapiens
guuauauucagugug

SEQ ID NO: 779858 - RNA, 19 nt, Homo sapiens
guuaucuguguagcaagcu

SEQ ID NO: 779859 - RNA, 15 nt, Homo sapiens
guuaugcacugccug

SEQ ID NO: 779860 - RNA, 17 nt, Homo sapiens
guuauggcuuaaaagca

SEQ ID NO: 779861 - RNA, 19 nt, Homo sapiens
guuaugugcaaguuuauca

SEQ ID NO: 779862 - RNA, 16 nt, Homo sapiens
guuauuauuuugcacu

SEQ ID NO: 779863 - RNA, 18 nt, Homo sapiens
guuauuauuuugcacugu

SEQ ID NO: 779864 - RNA, 12 nt, Homo sapiens
guuauucuugca

SEQ ID NO: 779865 - RNA, 16 nt, Homo sapiens
guuauugcacaaguuc

SEQ ID NO: 779866 - RNA, 14 nt, Homo sapiens
guuauugccucuac

SEQ ID NO: 779867 - RNA, 17 nt, Homo sapiens
guuauugccucuacuuu

SEQ ID NO: 779868 - RNA, 21 nt, Homo sapiens
guuauuggacuccaggccuga

SEQ ID NO: 779869 - RNA, 13 nt, Homo sapiens
guuauuguuugau

SEQ ID NO: 779870 - RNA, 17 nt, Homo sapiens
guuauuuaugcacugug

SEQ ID NO: 779871 - RNA, 19 nt, Homo sapiens
guuauuuaugccucuguau

SEQ ID NO: 779872 - RNA, 23 nt, Homo sapiens
guuauuuuuuaaaugaggauuca

SEQ ID NO: 779873 - RNA, 14 nt, Homo sapiens
guucaaagacugug

SEQ ID NO: 779874 - RNA, 16 nt, Homo sapiens
guucaaagacugugaa

SEQ ID NO: 779875 - RNA, 21 nt, Homo sapiens
guucaaagagcaauauuccag

SEQ ID NO: 779876 - RNA, 16 nt, Homo sapiens
guucaaaguguauauu

SEQ ID NO: 779877 - RNA, 17 nt, Homo sapiens
guucaaauccucaccau

SEQ ID NO: 779878 - RNA, 12 nt, Homo sapiens
guucaacaaagg

SEQ ID NO: 779879 - RNA, 15 nt, Homo sapiens
guucaacuuccaaag

SEQ ID NO: 779880 - RNA, 19 nt, Homo sapiens
guucaagcgauucuccugu

SEQ ID NO: 779881 - RNA, 22 nt, Homo sapiens
guucaagugauucuccugccuc

SEQ ID NO: 779882 - RNA, 20 nt, Homo sapiens
guucaaguuauagauucaau

SEQ ID NO: 779883 - RNA, 20 nt, Homo sapiens
accccaacaauugugugaau

SEQ ID NO: 779884 - RNA, 14 nt, Homo sapiens
accccaagcugccu

SEQ ID NO: 779885 - RNA, 17 nt, Homo sapiens
accccacaccugcagug

SEQ ID NO: 779886 - RNA, 16 nt, Homo sapiens
accccagcucaugccc

SEQ ID NO: 779887 - RNA, 11 nt, Homo sapiens
accccagcugg

SEQ ID NO: 779888 - RNA, 23 nt, Homo sapiens
accccagugguauccugugacau

SEQ ID NO: 779889 - RNA, 15 nt, Homo sapiens
accccaucucuacua

SEQ ID NO: 779890 - RNA, 17 nt, Homo sapiens
accccaucuuuacuaaa

SEQ ID NO: 779891 - RNA, 12 nt, Homo sapiens
accccauucuca

SEQ ID NO: 779892 - RNA, 17 nt, Homo sapiens
acccccaccauccaggu

SEQ ID NO: 779893 - RNA, 20 nt, Homo sapiens
acccccacccccagcucaau

SEQ ID NO: 779894 - RNA, 15 nt, Homo sapiens
acccccaguuccuau

SEQ ID NO: 779895 - RNA, 13 nt, Homo sapiens
acccccauccagc

SEQ ID NO: 779896 - RNA, 16 nt, Homo sapiens
acccccaucucuacua

SEQ ID NO: 779897 - RNA, 17 nt, Homo sapiens
acccccgccacggccac

SEQ ID NO: 779898 - RNA, 18 nt, Homo sapiens
accccgagaagugcucuu

SEQ ID NO: 779899 - RNA, 23 nt, Homo sapiens
accccgauauauuuuagcauuuu

SEQ ID NO: 779900 - RNA, 22 nt, Homo sapiens
accccgccugccuccuggcuca

SEQ ID NO: 779901 - RNA, 14 nt, Homo sapiens
accccgggcucucu

SEQ ID NO: 779902 - RNA, 19 nt, Homo sapiens
accccuacagccugcacac

SEQ ID NO: 779903 - RNA, 13 nt, Homo sapiens
accccuagcccug

SEQ ID NO: 779904 - RNA, 15 nt, Homo sapiens
accccucucuuagag

SEQ ID NO: 779905 - RNA, 14 nt, Homo sapiens
accccugcacaguu

SEQ ID NO: 779906 - RNA, 23 nt, Homo sapiens
accccugcccccagccccggggu

SEQ ID NO: 779907 - RNA, 19 nt, Homo sapiens
accccugccuuuucauugc

SEQ ID NO: 779908 - RNA, 22 nt, Homo sapiens
accccugcucaguaaagcacuu

SEQ ID NO: 779909 - RNA, 15 nt, Homo sapiens
accccugguucucau

SEQ ID NO: 779910 - RNA, 21 nt, Homo sapiens
accccugugcuccccugccac

SEQ ID NO: 779911 - RNA, 18 nt, Homo sapiens
accccuugguacugaaaa

SEQ ID NO: 779912 - RNA, 14 nt, Homo sapiens
accccuuucacuua

SEQ ID NO: 779913 - RNA, 13 nt, Homo sapiens
accccuuugcacu

SEQ ID NO: 779914 - RNA, 19 nt, Homo sapiens
acccgagcccagcuacauu

SEQ ID NO: 779915 - RNA, 23 nt, Homo sapiens
acccggagcucuacgugcuccuc

SEQ ID NO: 779916 - RNA, 21 nt, Homo sapiens
acccgggaggcagagguugca

SEQ ID NO: 779917 - RNA, 12 nt, Homo sapiens
acccuaaaaaga

SEQ ID NO: 779918 - RNA, 13 nt, Homo sapiens
acccuaaagggag

SEQ ID NO: 779919 - RNA, 16 nt, Homo sapiens
acccuagggauuugca

SEQ ID NO: 779920 - RNA, 13 nt, Homo sapiens
acccuagucccuu

SEQ ID NO: 779921 - RNA, 17 nt, Homo sapiens
acccuaguuucccugaa

SEQ ID NO: 779922 - RNA, 13 nt, Homo sapiens
acccucacauggg

SEQ ID NO: 779923 - RNA, 14 nt, Homo sapiens
acccucagcacugu

SEQ ID NO: 779924 - RNA, 16 nt, Homo sapiens
acccucaucacuagga

SEQ ID NO: 779925 - RNA, 19 nt, Homo sapiens
acccuccacucagcugucc

SEQ ID NO: 779926 - RNA, 14 nt, Homo sapiens
acccucccaccacu

SEQ ID NO: 779927 - RNA, 18 nt, Homo sapiens
acccuccccacagugcca

SEQ ID NO: 779928 - RNA, 15 nt, Homo sapiens
acccuccccuaguca

SEQ ID NO: 779929 - RNA, 23 nt, Homo sapiens
acccuccggccagcgagugguca

SEQ ID NO: 779930 - RNA, 14 nt, Homo sapiens
acccucgaugaagc

SEQ ID NO: 779931 - RNA, 16 nt, Homo sapiens
acccucgcaugacugu

SEQ ID NO: 779932 - RNA, 19 nt, Homo sapiens
acccucgcaugacuguuac

SEQ ID NO: 779933 - RNA, 20 nt, Homo sapiens
acccucuaucccaauaggca

SEQ ID NO: 779934 - RNA, 17 nt, Homo sapiens
acccucuccuccagugu

SEQ ID NO: 779935 - RNA, 16 nt, Homo sapiens
acccucuuccugugau

SEQ ID NO: 779936 - RNA, 15 nt, Homo sapiens
acccucuuugcugca

SEQ ID NO: 779937 - RNA, 23 nt, Homo sapiens
acccugaagcuuaggacuaccag

SEQ ID NO: 779938 - RNA, 13 nt, Homo sapiens
acccugaguucau

SEQ ID NO: 779939 - RNA, 15 nt, Homo sapiens
acccugcaagaccac

SEQ ID NO: 779940 - RNA, 16 nt, Homo sapiens
acccugccccuugcca

SEQ ID NO: 779941 - RNA, 21 nt, Homo sapiens
acccugcucauccacucuacu

SEQ ID NO: 779942 - RNA, 22 nt, Homo sapiens
acccugcugaccucccagugac

SEQ ID NO: 779943 - RNA, 15 nt, Homo sapiens
acccuggaaaacaga

SEQ ID NO: 779944 - RNA, 18 nt, Homo sapiens
acccuggccuagaccagc

SEQ ID NO: 779945 - RNA, 17 nt, Homo sapiens
acccuggucucaucagu

SEQ ID NO: 779946 - RNA, 23 nt, Homo sapiens
acccugguucccaccauucccug

SEQ ID NO: 779947 - RNA, 19 nt, Homo sapiens
acccuguccuccaccugcc

SEQ ID NO: 779948 - RNA, 21 nt, Homo sapiens
acccuguccucccgagcuccu

SEQ ID NO: 779949 - RNA, 18 nt, Homo sapiens
acccuguuuucagcuaaa

SEQ ID NO: 779950 - RNA, 22 nt, Homo sapiens
acccuuaggccagcaccaucuc

SEQ ID NO: 779951 - RNA, 17 nt, Homo sapiens
acccuucagauuugccu

SEQ ID NO: 779952 - RNA, 10 nt, Homo sapiens
acccuuccag

SEQ ID NO: 779953 - RNA, 22 nt, Homo sapiens
acccuucccaaucagcacugaa

SEQ ID NO: 779954 - RNA, 20 nt, Homo sapiens
acccuucccgccucccucuc

SEQ ID NO: 779955 - RNA, 13 nt, Homo sapiens
acccuucccucac

SEQ ID NO: 779956 - RNA, 19 nt, Homo sapiens
acccuucuacuuugcagau

SEQ ID NO: 779957 - RNA, 17 nt, Homo sapiens
acccuucuuuugaagga

SEQ ID NO: 779958 - RNA, 20 nt, Homo sapiens
acccuugaucuuaacaaagc

SEQ ID NO: 779959 - RNA, 16 nt, Homo sapiens
acccuugucaucucuc

SEQ ID NO: 779960 - RNA, 19 nt, Homo sapiens
acccuuguuuacacauacc

SEQ ID NO: 779961 - RNA, 23 nt, Homo sapiens
acccuuuaagauauccaucuuuu

SEQ ID NO: 779962 - RNA, 22 nt, Homo sapiens
acccuuuucccccuucccauuu

SEQ ID NO: 779963 - RNA, 15 nt, Homo sapiens
accgaaaucccucag

SEQ ID NO: 779964 - RNA, 16 nt, Homo sapiens
accgaagccacuuucu

SEQ ID NO: 779965 - RNA, 14 nt, Homo sapiens
accgacuagccagg

SEQ ID NO: 779966 - RNA, 13 nt, Homo sapiens
ugggcaugacauc

SEQ ID NO: 779967 - RNA, 14 nt, Homo sapiens
ugggccacagccau

SEQ ID NO: 779968 - RNA, 15 nt, Homo sapiens
ugggccauguccaaa

SEQ ID NO: 779969 - RNA, 17 nt, Homo sapiens
ugggcccugcacagaua

SEQ ID NO: 779970 - RNA, 12 nt, Homo sapiens
ugggccgugugg

SEQ ID NO: 779971 - RNA, 22 nt, Homo sapiens
ugggccucuccugcccucugcu

SEQ ID NO: 779972 - RNA, 14 nt, Homo sapiens
ugggccugcuccag

SEQ ID NO: 779973 - RNA, 17 nt, Homo sapiens
ugggcgugugugacacu

SEQ ID NO: 779974 - RNA, 13 nt, Homo sapiens
ugggcuacuggca

SEQ ID NO: 779975 - RNA, 23 nt, Homo sapiens
ugggcuauugcugcugccccuua

SEQ ID NO: 779976 - RNA, 22 nt, Homo sapiens
ugggcuccggaggacucaccac

SEQ ID NO: 779977 - RNA, 23 nt, Homo sapiens
ugggcucugccuuaaacacacau

SEQ ID NO: 779978 - RNA, 16 nt, Homo sapiens
ugggcuggacuggcca

SEQ ID NO: 779979 - RNA, 16 nt, Homo sapiens
ugggcugggaaaaacu

SEQ ID NO: 779980 - RNA, 12 nt, Homo sapiens
uggaugaucucc

SEQ ID NO: 779981 - RNA, 13 nt, Homo sapiens
uggaugauucaga

SEQ ID NO: 779982 - RNA, 20 nt, Homo sapiens
uggaugauucagaaauugga

SEQ ID NO: 779983 - RNA, 11 nt, Homo sapiens
uggaugcauuu

SEQ ID NO: 779984 - RNA, 18 nt, Homo sapiens
uggaugcgacccaagacc

SEQ ID NO: 779985 - RNA, 17 nt, Homo sapiens
uggaugcggccauucaa

SEQ ID NO: 779986 - RNA, 15 nt, Homo sapiens
uggauggaaagggag

SEQ ID NO: 779987 - RNA, 14 nt, Homo sapiens
uggauguagucagu

SEQ ID NO: 779988 - RNA, 13 nt, Homo sapiens
uggauuacuauug

SEQ ID NO: 779989 - RNA, 13 nt, Homo sapiens
uggauuauugcuu

SEQ ID NO: 779990 - RNA, 13 nt, Homo sapiens
uggauuauuucau

SEQ ID NO: 779991 - RNA, 15 nt, Homo sapiens
uggauucacucacuc

SEQ ID NO: 779992 - RNA, 15 nt, Homo sapiens
uggauucgugacaac

SEQ ID NO: 779993 - RNA, 15 nt, Homo sapiens
uggauucucauugcc

SEQ ID NO: 779994 - RNA, 15 nt, Homo sapiens
uggauugacucugca

SEQ ID NO: 779995 - RNA, 17 nt, Homo sapiens
uggauugcagacuguuc

SEQ ID NO: 779996 - RNA, 20 nt, Homo sapiens
uggauuuaauaccauuuuca

SEQ ID NO: 779997 - RNA, 18 nt, Homo sapiens
uggauuuauagcuaugaa

SEQ ID NO: 779998 - RNA, 23 nt, Homo sapiens
uggauuuaucccccgcaaagaca

SEQ ID NO: 779999 - RNA, 23 nt, Homo sapiens
uggcguuacugcuugaccaaaga

SEQ ID NO: 780000 - RNA, 21 nt, Homo sapiens
uggcuauaacaugucuuucag

SEQ ID NO: 780001 - RNA, 20 nt, Homo sapiens
uggcuauugaccaugugguu

SEQ ID NO: 780002 - RNA, 15 nt, Homo sapiens
uggcucacacugaga

SEQ ID NO: 780003 - RNA, 16 nt, Homo sapiens
uggcucacgccuguaa

SEQ ID NO: 780004 - RNA, 23 nt, Homo sapiens
uggcucacugcaagcucugccuc

SEQ ID NO: 780005 - RNA, 16 nt, Homo sapiens
uggcucagugccuucc

SEQ ID NO: 780006 - RNA, 12 nt, Homo sapiens
uggcucaucucu

SEQ ID NO: 780007 - RNA, 13 nt, Homo sapiens
uggcucaucucuu

SEQ ID NO: 780008 - RNA, 21 nt, Homo sapiens
uggcucaugccuguaaucuca

SEQ ID NO: 780009 - RNA, 21 nt, Homo sapiens
uggcuccggccucugccuuug

SEQ ID NO: 780010 - RNA, 14 nt, Homo sapiens
uggcuccuaucugu

SEQ ID NO: 780011 - RNA, 16 nt, Homo sapiens
uggcuccuaucugugu

SEQ ID NO: 780012 - RNA, 16 nt, Homo sapiens
uggcuccuccuaggaa

SEQ ID NO: 780013 - RNA, 16 nt, Homo sapiens
uggcucuguuggcaga

SEQ ID NO: 780014 - RNA, 14 nt, Homo sapiens
uggcugaaaaugca

SEQ ID NO: 780015 - RNA, 15 nt, Homo sapiens
uggcugaaaaugcaa

SEQ ID NO: 780016 - RNA, 20 nt, Homo sapiens
uggcugaacgcguguguaca

SEQ ID NO: 780017 - RNA, 15 nt, Homo sapiens
uggcugaacuacaag

SEQ ID NO: 780018 - RNA, 11 nt, Homo sapiens
uggcugaugau

SEQ ID NO: 780019 - RNA, 12 nt, Homo sapiens
uggcugcaguga

SEQ ID NO: 780020 - RNA, 15 nt, Homo sapiens
uggcugcuagcacuu

SEQ ID NO: 780021 - RNA, 17 nt, Homo sapiens
uggcugcuuuguucaau

SEQ ID NO: 780022 - RNA, 17 nt, Homo sapiens
uggcuggaaggggucca

SEQ ID NO: 780023 - RNA, 12 nt, Homo sapiens
uggcuggcacag

SEQ ID NO: 780024 - RNA, 15 nt, Homo sapiens
uggcugggccuucac

SEQ ID NO: 780025 - RNA, 19 nt, Homo sapiens
uggcugucucaaaccaagc

SEQ ID NO: 780026 - RNA, 13 nt, Homo sapiens
uggcugugagcag

SEQ ID NO: 780027 - RNA, 22 nt, Homo sapiens
uggcuguuggccccucugcugu

SEQ ID NO: 780028 - RNA, 14 nt, Homo sapiens
uggcuuaaagggau

SEQ ID NO: 780029 - RNA, 15 nt, Homo sapiens
uggcuuacaaaaaga

SEQ ID NO: 780030 - RNA, 17 nt, Homo sapiens
uggcuuagggcuggaag

SEQ ID NO: 780031 - RNA, 24 nt, Homo sapiens
uggcuuauuucuaugacaaauuca

SEQ ID NO: 780032 - RNA, 21 nt, Homo sapiens
uggcuucugugcacuagccug

SEQ ID NO: 780033 - RNA, 14 nt, Homo sapiens
uggcuugccauuuu

SEQ ID NO: 780034 - RNA, 13 nt, Homo sapiens
uggcuuuaugcaa

SEQ ID NO: 780035 - RNA, 15 nt, Homo sapiens
uggcuuuaugcaaau

SEQ ID NO: 780036 - RNA, 15 nt, Homo sapiens
uggcuuuuucuccuu

SEQ ID NO: 780037 - RNA, 22 nt, Homo sapiens
ugggaaaaauucagagaguuag

SEQ ID NO: 780038 - RNA, 16 nt, Homo sapiens
ugggaaaacacugcca

SEQ ID NO: 780039 - RNA, 18 nt, Homo sapiens
ugggaaacugcuuuucca

SEQ ID NO: 780040 - RNA, 20 nt, Homo sapiens
ugggaaaguauucuguacuc

SEQ ID NO: 780041 - RNA, 18 nt, Homo sapiens
ugggaaaucaguguuuua

SEQ ID NO: 780042 - RNA, 23 nt, Homo sapiens
ugggaacaguaaagaaagcagaa

SEQ ID NO: 780043 - RNA, 15 nt, Homo sapiens
ugggaaccacuccca

SEQ ID NO: 780044 - RNA, 21 nt, Homo sapiens
ugggaaccauuucaagacaga

SEQ ID NO: 780045 - RNA, 11 nt, Homo sapiens
ugggaacucac

SEQ ID NO: 780046 - RNA, 19 nt, Homo sapiens
ugggaagaaagaaugcaag

SEQ ID NO: 780047 - RNA, 21 nt, Homo sapiens
ugggaagaccagcuuugcagu

SEQ ID NO: 780048 - RNA, 15 nt, Homo sapiens
ugggaagacuauggu

SEQ ID NO: 780049 - RNA, 21 nt, Homo sapiens
ugggaauagggagacagggua

SEQ ID NO: 780050 - RNA, 19 nt, Homo sapiens
ugggaaugaaauuaacaca

SEQ ID NO: 780051 - RNA, 17 nt, Homo sapiens
ugggacacaacacagau

SEQ ID NO: 780052 - RNA, 19 nt, Homo sapiens
ugggaccacuggguacaag

SEQ ID NO: 780053 - RNA, 20 nt, Homo sapiens
ugggacccaaaacacaggaa

SEQ ID NO: 780054 - RNA, 18 nt, Homo sapiens
ugggaccccacagaguug

SEQ ID NO: 780055 - RNA, 22 nt, Homo sapiens
ugggacccuucagccacuacaa

SEQ ID NO: 780056 - RNA, 14 nt, Homo sapiens
ugggaccgugacua

SEQ ID NO: 780057 - RNA, 19 nt, Homo sapiens
ugggaccugauuuauugaa

SEQ ID NO: 780058 - RNA, 12 nt, Homo sapiens
ugggacugagau

SEQ ID NO: 780059 - RNA, 17 nt, Homo sapiens
ugggacugaugucaucu

SEQ ID NO: 780060 - RNA, 17 nt, Homo sapiens
ugggagaaugucaguau

SEQ ID NO: 780061 - RNA, 14 nt, Homo sapiens
ugggagacuuugaa

SEQ ID NO: 780062 - RNA, 16 nt, Homo sapiens
ugggagagacugugag

SEQ ID NO: 780063 - RNA, 17 nt, Homo sapiens
ugggagagcugauugca

SEQ ID NO: 780064 - RNA, 17 nt, Homo sapiens
ugggagauguucuuccu

SEQ ID NO: 780065 - RNA, 14 nt, Homo sapiens
ugggagcugccaag

SEQ ID NO: 780066 - RNA, 21 nt, Homo sapiens
ugggagcuucccacaccugcc

SEQ ID NO: 780067 - RNA, 21 nt, Homo sapiens
ugggaggcaagaaaaggacaa

SEQ ID NO: 780068 - RNA, 15 nt, Homo sapiens
ugggaggcugugauu

SEQ ID NO: 780069 - RNA, 21 nt, Homo sapiens
ugggagggggcuugaagccaa

SEQ ID NO: 780070 - RNA, 17 nt, Homo sapiens
ugggauaaggaaacacu

SEQ ID NO: 780071 - RNA, 14 nt, Homo sapiens
ugggauaaucacau

SEQ ID NO: 780072 - RNA, 21 nt, Homo sapiens
ugggauauuaaaacacaaagu

SEQ ID NO: 780073 - RNA, 14 nt, Homo sapiens
ugggauauucccaa

SEQ ID NO: 780074 - RNA, 19 nt, Homo sapiens
ugggaucuuucugggagcu

SEQ ID NO: 780075 - RNA, 18 nt, Homo sapiens
ugggaugaugccucauga

SEQ ID NO: 780076 - RNA, 14 nt, Homo sapiens
ugggaugggcuccc

SEQ ID NO: 780077 - RNA, 14 nt, Homo sapiens
ugggauguacuguu

SEQ ID NO: 780078 - RNA, 17 nt, Homo sapiens
ugggauguucagcacug

SEQ ID NO: 780079 - RNA, 13 nt, Homo sapiens
ugggauuacaggc

SEQ ID NO: 780080 - RNA, 14 nt, Homo sapiens
ugggauuacaggga

SEQ ID NO: 780081 - RNA, 23 nt, Homo sapiens
ugggauuucucccucucagugga

SEQ ID NO: 780082 - RNA, 17 nt, Homo sapiens
ugggauuugagauacca

SEQ ID NO: 780083 - RNA, 21 nt, Homo sapiens
ugggauuuggggccucaagaa

SEQ ID NO: 780084 - RNA, 15 nt, Homo sapiens
ugggcaacagaugaa

SEQ ID NO: 780085 - RNA, 17 nt, Homo sapiens
ugggcaacauagugaga

SEQ ID NO: 780086 - RNA, 20 nt, Homo sapiens
ugggcaagagaugggacaag

SEQ ID NO: 780087 - RNA, 11 nt, Homo sapiens
ugggcacagug

SEQ ID NO: 780088 - RNA, 15 nt, Homo sapiens
ugggcacaucugcug

SEQ ID NO: 780089 - RNA, 21 nt, Homo sapiens
ugggcaccuuccuaauaugcu

SEQ ID NO: 780090 - RNA, 24 nt, Homo sapiens
ugggcacuuuuuaacauugcugau

SEQ ID NO: 780091 - RNA, 15 nt, Homo sapiens
ugggcagaaggccaa

SEQ ID NO: 780092 - RNA, 18 nt, Homo sapiens
ugggcagcauagcaagac

SEQ ID NO: 780093 - RNA, 21 nt, Homo sapiens
ugggcagcccaacagcacuuu

SEQ ID NO: 780094 - RNA, 16 nt, Homo sapiens
ugggcaggaagugaag

SEQ ID NO: 780095 - RNA, 12 nt, Homo sapiens
ugggcagggaug

SEQ ID NO: 780096 - RNA, 14 nt, Homo sapiens
ugggcauagucagu

SEQ ID NO: 780097 - RNA, 22 nt, Homo sapiens
ugggcaucauagcaagaccuca

SEQ ID NO: 780098 - RNA, 17 nt, Homo sapiens
cuguuugacaacauguu

SEQ ID NO: 780099 - RNA, 14 nt, Homo sapiens
cuguuugaugcuau

SEQ ID NO: 780100 - RNA, 21 nt, Homo sapiens
cuguuugaugcuauuuaugca

SEQ ID NO: 780101 - RNA, 20 nt, Homo sapiens
cuguuugcguacuuguaaua

SEQ ID NO: 780102 - RNA, 18 nt, Homo sapiens
cuguuuggagauccucau

SEQ ID NO: 780103 - RNA, 18 nt, Homo sapiens
cuguuuucugaaacacac

SEQ ID NO: 780104 - RNA, 23 nt, Homo sapiens
cuguuuucuggaagugugcaggu

SEQ ID NO: 780105 - RNA, 17 nt, Homo sapiens
cuguuuuuguaguggua

SEQ ID NO: 780106 - RNA, 23 nt, Homo sapiens
cuguuuuuuuugcugcuaaagaa

SEQ ID NO: 780107 - RNA, 21 nt, Homo sapiens
cuuaaaaauuagcaugcugcu

SEQ ID NO: 780108 - RNA, 14 nt, Homo sapiens
cuuaaaacuaaaug

SEQ ID NO: 780109 - RNA, 22 nt, Homo sapiens
cuuaaaauaagcagguggaucu

SEQ ID NO: 780110 - RNA, 23 nt, Homo sapiens
cuuaaaauaaugaauacauuucc

SEQ ID NO: 780111 - RNA, 15 nt, Homo sapiens
cuuaaaaucugugaa

SEQ ID NO: 780112 - RNA, 18 nt, Homo sapiens
cuuaaaaugggaucucau

SEQ ID NO: 780113 - RNA, 16 nt, Homo sapiens
cuuaaacccauacaau

SEQ ID NO: 780114 - RNA, 16 nt, Homo sapiens
cuuaaaccuaccuccc

SEQ ID NO: 780115 - RNA, 22 nt, Homo sapiens
cuuaaacgaagaguucccuuga

SEQ ID NO: 780116 - RNA, 22 nt, Homo sapiens
cuuaaacuaugaaccuucuuaa

SEQ ID NO: 780117 - RNA, 21 nt, Homo sapiens
cuuaaacucuggacacucuau

SEQ ID NO: 780118 - RNA, 20 nt, Homo sapiens
cuuaaagaaacagcuuucaa

SEQ ID NO: 780119 - RNA, 20 nt, Homo sapiens
cuuaaagaauaauacuuaga

SEQ ID NO: 780120 - RNA, 14 nt, Homo sapiens
cuuaaagauuuauc

SEQ ID NO: 780121 - RNA, 19 nt, Homo sapiens
cuuaaagcacagucugaug

SEQ ID NO: 780122 - RNA, 17 nt, Homo sapiens
cuucaauuguauuauau

SEQ ID NO: 780123 - RNA, 18 nt, Homo sapiens
cuucacagugacacugga

SEQ ID NO: 780124 - RNA, 13 nt, Homo sapiens
cuucacaguguuu

SEQ ID NO: 780125 - RNA, 23 nt, Homo sapiens
cuucacauaggaagggaucugag

SEQ ID NO: 780126 - RNA, 14 nt, Homo sapiens
cuucacaucuguca

SEQ ID NO: 780127 - RNA, 12 nt, Homo sapiens
cuucacauucau

SEQ ID NO: 780128 - RNA, 15 nt, Homo sapiens
cuucaccaagugcaa

SEQ ID NO: 780129 - RNA, 20 nt, Homo sapiens
cuucaccaggaccaguucac

SEQ ID NO: 780130 - RNA, 15 nt, Homo sapiens
cuucacccugaaugg

SEQ ID NO: 780131 - RNA, 17 nt, Homo sapiens
cuucaccuaagucucug

SEQ ID NO: 780132 - RNA, 21 nt, Homo sapiens
cuucaccuuugucgcuggguc

SEQ ID NO: 780133 - RNA, 13 nt, Homo sapiens
cuucaccuuuuga

SEQ ID NO: 780134 - RNA, 19 nt, Homo sapiens
cuucacucgacauuuggug

SEQ ID NO: 780135 - RNA, 10 nt, Homo sapiens
cuucacugac

SEQ ID NO: 780136 - RNA, 16 nt, Homo sapiens
cuucagaagacacugc

SEQ ID NO: 780137 - RNA, 16 nt, Homo sapiens
cuucagaauagaaacu

SEQ ID NO: 780138 - RNA, 12 nt, Homo sapiens
cuucagagccag

SEQ ID NO: 780139 - RNA, 20 nt, Homo sapiens
cuucagaggccuggcaucuu

SEQ ID NO: 780140 - RNA, 18 nt, Homo sapiens
cuucagaguuugugugua

SEQ ID NO: 780141 - RNA, 13 nt, Homo sapiens
cuucagccauagu

SEQ ID NO: 780142 - RNA, 20 nt, Homo sapiens
cuucagccccuagugcuauu

SEQ ID NO: 780143 - RNA, 12 nt, Homo sapiens
cuucagcccuaa

SEQ ID NO: 780144 - RNA, 21 nt, Homo sapiens
cuucaggaucaaguccuaguu

SEQ ID NO: 780145 - RNA, 18 nt, Homo sapiens
cuucaggcagccagugug

SEQ ID NO: 780146 - RNA, 13 nt, Homo sapiens
cuucagggccaga

SEQ ID NO: 780147 - RNA, 21 nt, Homo sapiens
cuucaggguuuaauagacuga

SEQ ID NO: 780148 - RNA, 13 nt, Homo sapiens
cuucagguggaug

SEQ ID NO: 780149 - RNA, 17 nt, Homo sapiens
cuucagguucucaugau

SEQ ID NO: 780150 - RNA, 20 nt, Homo sapiens
cuucagguucucaugauacc

SEQ ID NO: 780151 - RNA, 21 nt, Homo sapiens
cuucaguaaaugugauucacc

SEQ ID NO: 780152 - RNA, 24 nt, Homo sapiens
cuucaguaauaauuauguauguua

SEQ ID NO: 780153 - RNA, 17 nt, Homo sapiens
cuucagucucuauacca

SEQ ID NO: 780154 - RNA, 20 nt, Homo sapiens
cuucagucucuauaccaaua

SEQ ID NO: 780155 - RNA, 10 nt, Homo sapiens
cuucagucuu

SEQ ID NO: 780156 - RNA, 11 nt, Homo sapiens
cuucagucuuc

SEQ ID NO: 780157 - RNA, 15 nt, Homo sapiens
cuucagugcagugaa

SEQ ID NO: 780158 - RNA, 18 nt, Homo sapiens
cuucaguuuuacucugcu

SEQ ID NO: 780159 - RNA, 21 nt, Homo sapiens
cuucauaugucaccuuugcua

SEQ ID NO: 780160 - RNA, 23 nt, Homo sapiens
cuucaucauucccucucaucuca

SEQ ID NO: 780161 - RNA, 18 nt, Homo sapiens
cuucaucuucacugcaau

SEQ ID NO: 780162 - RNA, 19 nt, Homo sapiens
cuucaugcuugacauaccu

SEQ ID NO: 780163 - RNA, 21 nt, Homo sapiens
cuucauguggcucagugccuu

SEQ ID NO: 780164 - RNA, 22 nt, Homo sapiens
cuucauuagcuuugggugccuu

SEQ ID NO: 780165 - RNA, 21 nt, Homo sapiens
cuucauucacuucgccauuca

SEQ ID NO: 780166 - RNA, 10 nt, Homo sapiens
cuucauucua

SEQ ID NO: 780167 - RNA, 16 nt, Homo sapiens
cuucauucuaaaccaa

SEQ ID NO: 780168 - RNA, 14 nt, Homo sapiens
cuucauucugcaag

SEQ ID NO: 780169 - RNA, 14 nt, Homo sapiens
cuucauugccuuaa

SEQ ID NO: 780170 - RNA, 13 nt, Homo sapiens
cuuccaacccacu

SEQ ID NO: 780171 - RNA, 18 nt, Homo sapiens
cuuccaacccacuggccc

SEQ ID NO: 780172 - RNA, 18 nt, Homo sapiens
cuuccaacguggcccaga

SEQ ID NO: 780173 - RNA, 19 nt, Homo sapiens
cuuccaaggguacuaagga

SEQ ID NO: 780174 - RNA, 20 nt, Homo sapiens
cuuccacaacugcugcaugu

SEQ ID NO: 780175 - RNA, 18 nt, Homo sapiens
cuuccacaagagugaauu

SEQ ID NO: 780176 - RNA, 19 nt, Homo sapiens
cuuccacaauucacuagac

SEQ ID NO: 780177 - RNA, 20 nt, Homo sapiens
cuuccagugcccuaggccug

SEQ ID NO: 780178 - RNA, 14 nt, Homo sapiens
cuuccagugguuug

SEQ ID NO: 780179 - RNA, 20 nt, Homo sapiens
cuuccauaaugcuacugucu

SEQ ID NO: 780180 - RNA, 18 nt, Homo sapiens
cuuccaucuagucacaaa

SEQ ID NO: 780181 - RNA, 19 nt, Homo sapiens
cuuccaugguacuguagca

SEQ ID NO: 780182 - RNA, 15 nt, Homo sapiens
cuuccaugugccuuu

SEQ ID NO: 780183 - RNA, 16 nt, Homo sapiens
cuuccaugugccuuuc

SEQ ID NO: 780184 - RNA, 24 nt, Homo sapiens
cuuccauuaacuuagcauguguug

SEQ ID NO: 780185 - RNA, 12 nt, Homo sapiens
cuuccauuccau

SEQ ID NO: 780186 - RNA, 20 nt, Homo sapiens
cuucccaaucagcacugaaa

SEQ ID NO: 780187 - RNA, 13 nt, Homo sapiens
cuucccagaccag

SEQ ID NO: 780188 - RNA, 22 nt, Homo sapiens
cuucccagcucugacccuucua

SEQ ID NO: 780189 - RNA, 12 nt, Homo sapiens
cuucccauucug

SEQ ID NO: 780190 - RNA, 21 nt, Homo sapiens
cuuccccagguccuuccuuua

SEQ ID NO: 780191 - RNA, 15 nt, Homo sapiens
cuucccccaccacca

SEQ ID NO: 780192 - RNA, 18 nt, Homo sapiens
cuucccgaguaacugaga

SEQ ID NO: 780193 - RNA, 22 nt, Homo sapiens
cuucccgaguaacugagauuac

SEQ ID NO: 780194 - RNA, 22 nt, Homo sapiens
cuucccgcaaaucaacacuuuc

SEQ ID NO: 780195 - RNA, 19 nt, Homo sapiens
cuucccuucuuugcugcug

SEQ ID NO: 780196 - RNA, 22 nt, Homo sapiens
cuucccuugcuggaaaacccaa

SEQ ID NO: 780197 - RNA, 20 nt, Homo sapiens
cuucccuuucugcuuguguu

SEQ ID NO: 780198 - RNA, 18 nt, Homo sapiens
cuuccguccauccauuca

SEQ ID NO: 780199 - RNA, 21 nt, Homo sapiens
cuuccguggucagagugccac

SEQ ID NO: 780200 - RNA, 23 nt, Homo sapiens
cuuccguggucagagugccacug

SEQ ID NO: 780201 - RNA, 19 nt, Homo sapiens
cuuccuccccacacuccac

SEQ ID NO: 780202 - RNA, 18 nt, Homo sapiens
cuuccuccucgcugccag

SEQ ID NO: 780203 - RNA, 18 nt, Homo sapiens
cuuccucuagaagccaag

SEQ ID NO: 780204 - RNA, 15 nt, Homo sapiens
cuuccucuccacugc

SEQ ID NO: 780205 - RNA, 19 nt, Homo sapiens
cuuccugaacaaccagcug

SEQ ID NO: 780206 - RNA, 20 nt, Homo sapiens
cuuccugagcuucaagguga

SEQ ID NO: 780207 - RNA, 17 nt, Homo sapiens
cuuccugaguggugcca

SEQ ID NO: 780208 - RNA, 19 nt, Homo sapiens
cuuccugccagcaggggug

SEQ ID NO: 780209 - RNA, 14 nt, Homo sapiens
cuuccuggugagaa

SEQ ID NO: 780210 - RNA, 12 nt, Homo sapiens
cuuccugugauc

SEQ ID NO: 780211 - RNA, 20 nt, Homo sapiens
cuuccugugauccacccaac

SEQ ID NO: 780212 - RNA, 15 nt, Homo sapiens
cuuccuguguaccuc

SEQ ID NO: 780213 - RNA, 21 nt, Homo sapiens
cuggcacucuuguucccacac

SEQ ID NO: 780214 - RNA, 19 nt, Homo sapiens
cuggcacuuagcccaagag

SEQ ID NO: 780215 - RNA, 22 nt, Homo sapiens
cuggcagguaggucggcacuug

SEQ ID NO: 780216 - RNA, 16 nt, Homo sapiens
cuggcagguggaacuu

SEQ ID NO: 780217 - RNA, 21 nt, Homo sapiens
cuggcaguaaccuagugaauu

SEQ ID NO: 780218 - RNA, 17 nt, Homo sapiens
cuggcaucucacuuuau

SEQ ID NO: 780219 - RNA, 20 nt, Homo sapiens
cuggcaugagccacugugcc

SEQ ID NO: 780220 - RNA, 13 nt, Homo sapiens
cuggccacaagga

SEQ ID NO: 780221 - RNA, 16 nt, Homo sapiens
cuggccaccugaggug

SEQ ID NO: 780222 - RNA, 20 nt, Homo sapiens
cuggcccagaugaucacuga

SEQ ID NO: 780223 - RNA, 14 nt, Homo sapiens
cuggcccagccaaa

SEQ ID NO: 780224 - RNA, 15 nt, Homo sapiens
cuggcccucacucaa

SEQ ID NO: 780225 - RNA, 15 nt, Homo sapiens
cuggcccugccguuu

SEQ ID NO: 780226 - RNA, 16 nt, Homo sapiens
cuggcccuuaagccaa

SEQ ID NO: 780227 - RNA, 13 nt, Homo sapiens
cuggcccuugcaa

SEQ ID NO: 780228 - RNA, 19 nt, Homo sapiens
cuggccgcuccucccucag

SEQ ID NO: 780229 - RNA, 16 nt, Homo sapiens
cuggccgucacacgua

SEQ ID NO: 780230 - RNA, 17 nt, Homo sapiens
cuggccuugaguagaaa

SEQ ID NO: 780231 - RNA, 16 nt, Homo sapiens
cuggcgagaauacagc

SEQ ID NO: 780232 - RNA, 21 nt, Homo sapiens
cuggcgauuuuacucauuguc

SEQ ID NO: 780233 - RNA, 17 nt, Homo sapiens
cuggcgcauauuaagca

SEQ ID NO: 780234 - RNA, 18 nt, Homo sapiens
cuggcgcaucauaugcag

SEQ ID NO: 780235 - RNA, 13 nt, Homo sapiens
cuggcucaucucu

SEQ ID NO: 780236 - RNA, 14 nt, Homo sapiens
cuggcucccaggac

SEQ ID NO: 780237 - RNA, 21 nt, Homo sapiens
cuggcucccccacaccuccca

SEQ ID NO: 780238 - RNA, 15 nt, Homo sapiens
cuggcucucagagga

SEQ ID NO: 780239 - RNA, 15 nt, Homo sapiens
cuggcugcaauugca

SEQ ID NO: 780240 - RNA, 19 nt, Homo sapiens
cuggcugcccuggcccuga

SEQ ID NO: 780241 - RNA, 13 nt, Homo sapiens
cuggcuggcacag

SEQ ID NO: 780242 - RNA, 20 nt, Homo sapiens
cuggcugggaacaacuucag

SEQ ID NO: 780243 - RNA, 17 nt, Homo sapiens
cuguaccgacuuugaua

SEQ ID NO: 780244 - RNA, 16 nt, Homo sapiens
cuguaccuguuccuua

SEQ ID NO: 780245 - RNA, 22 nt, Homo sapiens
cuguacuauccuguaaauauau

SEQ ID NO: 780246 - RNA, 13 nt, Homo sapiens
cuguacucaggag

SEQ ID NO: 780247 - RNA, 18 nt, Homo sapiens
cuguacucuugaauacaa

SEQ ID NO: 780248 - RNA, 23 nt, Homo sapiens
cuguagaaaugaugauguggaag

SEQ ID NO: 780249 - RNA, 21 nt, Homo sapiens
cuguagacauuugcuaugagc

SEQ ID NO: 780250 - RNA, 20 nt, Homo sapiens
cuguagaccaccuaauauca

SEQ ID NO: 780251 - RNA, 22 nt, Homo sapiens
cuguagaccaccuaauaucaau

SEQ ID NO: 780252 - RNA, 17 nt, Homo sapiens
cuguagacuagugccgu

SEQ ID NO: 780253 - RNA, 18 nt, Homo sapiens
cuguagacuagugccgua

SEQ ID NO: 780254 - RNA, 20 nt, Homo sapiens
cuguagaucagguuugccca

SEQ ID NO: 780255 - RNA, 21 nt, Homo sapiens
cuguagcaccagagaauccau

SEQ ID NO: 780256 - RNA, 16 nt, Homo sapiens
cuguaggaacaagcau

SEQ ID NO: 780257 - RNA, 22 nt, Homo sapiens
cuguagggggcgauauacuaaa

SEQ ID NO: 780258 - RNA, 19 nt, Homo sapiens
cuguagucccagcuacuca

SEQ ID NO: 780259 - RNA, 18 nt, Homo sapiens
cuguagucccagcuacuu

SEQ ID NO: 780260 - RNA, 21 nt, Homo sapiens
cuguagucccagcuacuuggg

SEQ ID NO: 780261 - RNA, 14 nt, Homo sapiens
cuguagucucagga

SEQ ID NO: 780262 - RNA, 15 nt, Homo sapiens
cuguagucucaggac

SEQ ID NO: 780263 - RNA, 17 nt, Homo sapiens
cuguagugagaaacuga

SEQ ID NO: 780264 - RNA, 20 nt, Homo sapiens
cuguaguugcagcugaugcc

SEQ ID NO: 780265 - RNA, 22 nt, Homo sapiens
cuguaguugcguggacucugca

SEQ ID NO: 780266 - RNA, 12 nt, Homo sapiens
cuguaucccuac

SEQ ID NO: 780267 - RNA, 17 nt, Homo sapiens
cuguaucccuacaucua

SEQ ID NO: 780268 - RNA, 18 nt, Homo sapiens
cuguaucggagacaguga

SEQ ID NO: 780269 - RNA, 18 nt, Homo sapiens
cuguaugaaugucugugg

SEQ ID NO: 780270 - RNA, 18 nt, Homo sapiens
cuguaugccucugagcag

SEQ ID NO: 780271 - RNA, 22 nt, Homo sapiens
cuguauguaaacuguuacugaa

SEQ ID NO: 780272 - RNA, 13 nt, Homo sapiens
cuguauuaccucc

SEQ ID NO: 780273 - RNA, 21 nt, Homo sapiens
cuguauuaguuuuugaucaag

SEQ ID NO: 780274 - RNA, 21 nt, Homo sapiens
cuguauuccgauacaaagugu

SEQ ID NO: 780275 - RNA, 12 nt, Homo sapiens
cuguauucuggc

SEQ ID NO: 780276 - RNA, 15 nt, Homo sapiens
cugucaaagcuguca

SEQ ID NO: 780277 - RNA, 16 nt, Homo sapiens
cugucaacaucaaaga

SEQ ID NO: 780278 - RNA, 12 nt, Homo sapiens
cugucaagaaga

SEQ ID NO: 780279 - RNA, 20 nt, Homo sapiens
cugucacaucagcaauuuca

SEQ ID NO: 780280 - RNA, 12 nt, Homo sapiens
cugucaccaccc

SEQ ID NO: 780281 - RNA, 23 nt, Homo sapiens
cugucaccacccugcucauccac

SEQ ID NO: 780282 - RNA, 22 nt, Homo sapiens
cugucaccacgugcaguaucuc

SEQ ID NO: 780283 - RNA, 21 nt, Homo sapiens
cugucacguucuccacacggg

SEQ ID NO: 780284 - RNA, 18 nt, Homo sapiens
cugucaucagccugugua

SEQ ID NO: 780285 - RNA, 24 nt, Homo sapiens
cugucaugaaaucagcaagagagg

SEQ ID NO: 780286 - RNA, 14 nt, Homo sapiens
cugucauugcacau

SEQ ID NO: 780287 - RNA, 15 nt, Homo sapiens
cugucauuuugcacu

SEQ ID NO: 780288 - RNA, 18 nt, Homo sapiens
cugucauuuugcacugua

SEQ ID NO: 780289 - RNA, 19 nt, Homo sapiens
cugucauuuugcacuguaa

SEQ ID NO: 780290 - RNA, 15 nt, Homo sapiens
cuguccacaugaccu

SEQ ID NO: 780291 - RNA, 18 nt, Homo sapiens
cuguccacaugaccucca

SEQ ID NO: 780292 - RNA, 17 nt, Homo sapiens
cuguccaccaagaucaa

SEQ ID NO: 780293 - RNA, 17 nt, Homo sapiens
cuguccacugggccauu

SEQ ID NO: 780294 - RNA, 16 nt, Homo sapiens
cuguccaggagcuaau

SEQ ID NO: 780295 - RNA, 16 nt, Homo sapiens
cuguccccacacugac

SEQ ID NO: 780296 - RNA, 17 nt, Homo sapiens
cuguccccacacugacc

SEQ ID NO: 780297 - RNA, 17 nt, Homo sapiens
cuguccccuucucucau

SEQ ID NO: 780298 - RNA, 21 nt, Homo sapiens
cugucccgccuuccuccucca

SEQ ID NO: 780299 - RNA, 19 nt, Homo sapiens
cugucccuugcuguaugcu

SEQ ID NO: 780300 - RNA, 22 nt, Homo sapiens
cuguccguucacauguguggua

SEQ ID NO: 780301 - RNA, 20 nt, Homo sapiens
cuguccucagccuugccaga

SEQ ID NO: 780302 - RNA, 20 nt, Homo sapiens
cuguccugaccugucucacc

SEQ ID NO: 780303 - RNA, 14 nt, Homo sapiens
cuguccuugcacac

SEQ ID NO: 780304 - RNA, 14 nt, Homo sapiens
cugucuagacuggc

SEQ ID NO: 780305 - RNA, 17 nt, Homo sapiens
cugucuagagcaacuuu

SEQ ID NO: 780306 - RNA, 13 nt, Homo sapiens
cugucucaaaaaa

SEQ ID NO: 780307 - RNA, 14 nt, Homo sapiens
cugucucagagaua

SEQ ID NO: 780308 - RNA, 14 nt, Homo sapiens
cugucucagccucc

SEQ ID NO: 780309 - RNA, 13 nt, Homo sapiens
cugucucuaaaaa

SEQ ID NO: 780310 - RNA, 14 nt, Homo sapiens
cugucucugagggg

SEQ ID NO: 780311 - RNA, 19 nt, Homo sapiens
cugucugaauauucuagaa

SEQ ID NO: 780312 - RNA, 20 nt, Homo sapiens
cugucugagaauuuccaaaa

SEQ ID NO: 780313 - RNA, 17 nt, Homo sapiens
cugucuggaacauggac

SEQ ID NO: 780314 - RNA, 17 nt, Homo sapiens
cugucuggccccugaga

SEQ ID NO: 780315 - RNA, 20 nt, Homo sapiens
cugucugggauuaagggcaa

SEQ ID NO: 780316 - RNA, 21 nt, Homo sapiens
cugucugggauuaagggcaaa

SEQ ID NO: 780317 - RNA, 19 nt, Homo sapiens
cugucuuacuauuauagca

SEQ ID NO: 780318 - RNA, 21 nt, Homo sapiens
cugucuuagaugucaagcuga

SEQ ID NO: 780319 - RNA, 20 nt, Homo sapiens
cugucuucccaaacccaguc

SEQ ID NO: 780320 - RNA, 18 nt, Homo sapiens
cugucuuuauaacccaua

SEQ ID NO: 780321 - RNA, 14 nt, Homo sapiens
cugucuuugcugag

SEQ ID NO: 780322 - RNA, 13 nt, Homo sapiens
cugugaaacuggc

SEQ ID NO: 780323 - RNA, 20 nt, Homo sapiens
cugugaaagaaccaaaagag

SEQ ID NO: 780324 - RNA, 14 nt, Homo sapiens
cugugaaauucuca

SEQ ID NO: 780325 - RNA, 20 nt, Homo sapiens
cugugaauaaaaacccugua

SEQ ID NO: 780326 - RNA, 19 nt, Homo sapiens
cugugaauugccuguaaca

SEQ ID NO: 780327 - RNA, 22 nt, Homo sapiens
cugugacauacauauuaucuca

SEQ ID NO: 780328 - RNA, 16 nt, Homo sapiens
cugugacccaucugua

SEQ ID NO: 780329 - RNA, 20 nt, Homo sapiens
cugugaccuuacagccauuu

SEQ ID NO: 780330 - RNA, 12 nt, Homo sapiens
cugccuucacaa

SEQ ID NO: 780331 - RNA, 19 nt, Homo sapiens
cugccuucacaaaugucau

SEQ ID NO: 780332 - RNA, 23 nt, Homo sapiens
cugccuuuuaucugcccagaauu

SEQ ID NO: 780333 - RNA, 17 nt, Homo sapiens
cugccuuuucaucuaau

SEQ ID NO: 780334 - RNA, 20 nt, Homo sapiens
cugcgacaaaacauuuugaa

SEQ ID NO: 780335 - RNA, 15 nt, Homo sapiens
cugcgcaccaaggaa

SEQ ID NO: 780336 - RNA, 19 nt, Homo sapiens
cugcggaagccaaaggcag

SEQ ID NO: 780337 - RNA, 18 nt, Homo sapiens
cugcggaccccucgucau

SEQ ID NO: 780338 - RNA, 19 nt, Homo sapiens
cugcggggggcaccagagg

SEQ ID NO: 780339 - RNA, 21 nt, Homo sapiens
cugcgugcacuucccagagca

SEQ ID NO: 780340 - RNA, 15 nt, Homo sapiens
cugcuaacuccuagc

SEQ ID NO: 780341 - RNA, 15 nt, Homo sapiens
cugcuaaugugugau

SEQ ID NO: 780342 - RNA, 12 nt, Homo sapiens
cugcuaccucac

SEQ ID NO: 780343 - RNA, 17 nt, Homo sapiens
cugcuaccucacugggg

SEQ ID NO: 780344 - RNA, 20 nt, Homo sapiens
cugcuacugucuuacuauua

SEQ ID NO: 780345 - RNA, 16 nt, Homo sapiens
cugcucaagaagacau

SEQ ID NO: 780346 - RNA, 22 nt, Homo sapiens
cugcucaucuguacauacuguu

SEQ ID NO: 780347 - RNA, 13 nt, Homo sapiens
cugcuccacccuu

SEQ ID NO: 780348 - RNA, 19 nt, Homo sapiens
cugcuccauggaugcaugc

SEQ ID NO: 780349 - RNA, 19 nt, Homo sapiens
cugcucccagagaccuugc

SEQ ID NO: 780350 - RNA, 15 nt, Homo sapiens
cugcucccaucauuc

SEQ ID NO: 780351 - RNA, 23 nt, Homo sapiens
cugcucccugcacccaugacaau

SEQ ID NO: 780352 - RNA, 14 nt, Homo sapiens
cugcuccgcugccu

SEQ ID NO: 780353 - RNA, 17 nt, Homo sapiens
cugcuccgcugccugga

SEQ ID NO: 780354 - RNA, 22 nt, Homo sapiens
cugcuccuccccuuucacaggu

SEQ ID NO: 780355 - RNA, 14 nt, Homo sapiens
cugcucucuucagg

SEQ ID NO: 780356 - RNA, 13 nt, Homo sapiens
cugcucugagcca

SEQ ID NO: 780357 - RNA, 22 nt, Homo sapiens
cugcucuguaggucauuggcca

SEQ ID NO: 780358 - RNA, 22 nt, Homo sapiens
cugcucugucuucuuugcccac

SEQ ID NO: 780359 - RNA, 14 nt, Homo sapiens
cugcucuuccucag

SEQ ID NO: 780360 - RNA, 12 nt, Homo sapiens
cugcucuugcag

SEQ ID NO: 780361 - RNA, 16 nt, Homo sapiens
cucaagacucaccuca

SEQ ID NO: 780362 - RNA, 12 nt, Homo sapiens
cucaagacuuua

SEQ ID NO: 780363 - RNA, 19 nt, Homo sapiens
cucaaggacuuugcagccg

SEQ ID NO: 780364 - RNA, 16 nt, Homo sapiens
cucaaggcugugcagg

SEQ ID NO: 780365 - RNA, 18 nt, Homo sapiens
cucaaggucaucaaacau

SEQ ID NO: 780366 - RNA, 16 nt, Homo sapiens
cucaagguuacuggga

SEQ ID NO: 780367 - RNA, 17 nt, Homo sapiens
cucaagucuucccugau

SEQ ID NO: 780368 - RNA, 21 nt, Homo sapiens
cucaaguguccugaaagcuua

SEQ ID NO: 780369 - RNA, 19 nt, Homo sapiens
cucaaguucuaagauucua

SEQ ID NO: 780370 - RNA, 22 nt, Homo sapiens
cucaauauauucaguaaugaag

SEQ ID NO: 780371 - RNA, 20 nt, Homo sapiens
cucaauggauuugaugcugu

SEQ ID NO: 780372 - RNA, 20 nt, Homo sapiens
cucaauucuuuguauaugca

SEQ ID NO: 780373 - RNA, 22 nt, Homo sapiens
cucaauucuuuguauaugcauu

SEQ ID NO: 780374 - RNA, 14 nt, Homo sapiens
cucaauuugcagua

SEQ ID NO: 780375 - RNA, 17 nt, Homo sapiens
cucaauuuuauguauuc

SEQ ID NO: 780376 - RNA, 16 nt, Homo sapiens
cucacaaaaaggcaaa

SEQ ID NO: 780377 - RNA, 18 nt, Homo sapiens
cucacaaaccaugcaaau

SEQ ID NO: 780378 - RNA, 23 nt, Homo sapiens
cucacaacuuggguucuucucag

SEQ ID NO: 780379 - RNA, 16 nt, Homo sapiens
cucacaagcaugaagu

SEQ ID NO: 780380 - RNA, 19 nt, Homo sapiens
cucacaccuguaaucccag

SEQ ID NO: 780381 - RNA, 12 nt, Homo sapiens
cucacacuggcc

SEQ ID NO: 780382 - RNA, 15 nt, Homo sapiens
cucacacuuugccau

SEQ ID NO: 780383 - RNA, 20 nt, Homo sapiens
cucacagagacccaccuuca

SEQ ID NO: 780384 - RNA, 19 nt, Homo sapiens
cucacagagugcauuguga

SEQ ID NO: 780385 - RNA, 20 nt, Homo sapiens
cucacagagugcauugugag

SEQ ID NO: 780386 - RNA, 14 nt, Homo sapiens
cucacagcuguaau

SEQ ID NO: 780387 - RNA, 15 nt, Homo sapiens
cucacaggugucucc

SEQ ID NO: 780388 - RNA, 14 nt, Homo sapiens
cucacaguguugcc

SEQ ID NO: 780389 - RNA, 20 nt, Homo sapiens
cucacauaagcccaguucau

SEQ ID NO: 780390 - RNA, 15 nt, Homo sapiens
cucacauugcuguau

SEQ ID NO: 780391 - RNA, 17 nt, Homo sapiens
cucaccaacuacagaaa

SEQ ID NO: 780392 - RNA, 15 nt, Homo sapiens
cucaccacuaccagc

SEQ ID NO: 780393 - RNA, 19 nt, Homo sapiens
cucaccagccccacugcca

SEQ ID NO: 780394 - RNA, 20 nt, Homo sapiens
cucaccagccccacugccag

SEQ ID NO: 780395 - RNA, 16 nt, Homo sapiens
cucaccauccaguggg

SEQ ID NO: 780396 - RNA, 20 nt, Homo sapiens
cucacccagucuucuacaca

SEQ ID NO: 780397 - RNA, 18 nt, Homo sapiens
cucacccuguaccacaaa

SEQ ID NO: 780398 - RNA, 17 nt, Homo sapiens
cucaccucucccucgau

SEQ ID NO: 780399 - RNA, 19 nt, Homo sapiens
cucacgcccuaagcgcaca

SEQ ID NO: 780400 - RNA, 13 nt, Homo sapiens
cucacuagacuca

SEQ ID NO: 780401 - RNA, 19 nt, Homo sapiens
cuaccagucuauuuccacu

SEQ ID NO: 780402 - RNA, 19 nt, Homo sapiens
cuaccauaagugacaccaa

SEQ ID NO: 780403 - RNA, 17 nt, Homo sapiens
cuacccaugacuuuaua

SEQ ID NO: 780404 - RNA, 16 nt, Homo sapiens
cuacccauuguucccu

SEQ ID NO: 780405 - RNA, 9 nt, Homo sapiens
cuaccccag

SEQ ID NO: 780406 - RNA, 18 nt, Homo sapiens
cuacccuggcccagauga

SEQ ID NO: 780407 - RNA, 17 nt, Homo sapiens
cuacccuuuucugggga

SEQ ID NO: 780408 - RNA, 16 nt, Homo sapiens
cuaccgcaaggaccug

SEQ ID NO: 780409 - RNA, 16 nt, Homo sapiens
cuaccuagggcacuuu

SEQ ID NO: 780410 - RNA, 16 nt, Homo sapiens
cuaccucaagacucac

SEQ ID NO: 780411 - RNA, 22 nt, Homo sapiens
cuaccucaagacucaccucauc

SEQ ID NO: 780412 - RNA, 19 nt, Homo sapiens
cuaccucacuaugcugcuu

SEQ ID NO: 780413 - RNA, 15 nt, Homo sapiens
cuaccucuggugaug

SEQ ID NO: 780414 - RNA, 13 nt, Homo sapiens
cuaccucuuggcu

SEQ ID NO: 780415 - RNA, 16 nt, Homo sapiens
cuaccugagcuaaaua

SEQ ID NO: 780416 - RNA, 18 nt, Homo sapiens
cuaccuggcagauacuca

SEQ ID NO: 780417 - RNA, 20 nt, Homo sapiens
cuaccuuagaaaacaaguau

SEQ ID NO: 780418 - RNA, 17 nt, Homo sapiens
cuaccuucucuacccau

SEQ ID NO: 780419 - RNA, 23 nt, Homo sapiens
cuacgaggccauccaguccuucg

SEQ ID NO: 780420 - RNA, 14 nt, Homo sapiens
cuacgcacauaccu

SEQ ID NO: 780421 - RNA, 14 nt, Homo sapiens
cuacguuaacccau

SEQ ID NO: 780422 - RNA, 14 nt, Homo sapiens
cuacuacccauugu

SEQ ID NO: 780423 - RNA, 22 nt, Homo sapiens
cuacuagagucugaacagcugu

SEQ ID NO: 780424 - RNA, 13 nt, Homo sapiens
cuacuauauugau

SEQ ID NO: 780425 - RNA, 20 nt, Homo sapiens
cuacucaggaggcugaggca

SEQ ID NO: 780426 - RNA, 12 nt, Homo sapiens
cuacucauucag

SEQ ID NO: 780427 - RNA, 19 nt, Homo sapiens
cuacucccucaaagcacac

SEQ ID NO: 780428 - RNA, 21 nt, Homo sapiens
cuacuccucugcagugccuug

SEQ ID NO: 780429 - RNA, 16 nt, Homo sapiens
cuacucucaugcugca

SEQ ID NO: 780430 - RNA, 23 nt, Homo sapiens
cuacucucuccuuuuugcuuccu

SEQ ID NO: 780431 - RNA, 14 nt, Homo sapiens
cuacucugugccag

SEQ ID NO: 780432 - RNA, 20 nt, Homo sapiens
cuacucuuucugcuuacaaa

SEQ ID NO: 780433 - RNA, 21 nt, Homo sapiens
cuacugacuggacuucucuca

SEQ ID NO: 780434 - RNA, 17 nt, Homo sapiens
cuacugcuaaauccuca

SEQ ID NO: 780435 - RNA, 12 nt, Homo sapiens
cuacugcuccug

SEQ ID NO: 780436 - RNA, 16 nt, Homo sapiens
cuacugcuuacuguug

SEQ ID NO: 780437 - RNA, 13 nt, Homo sapiens
cuacuggcagcuc

SEQ ID NO: 780438 - RNA, 15 nt, Homo sapiens
cuacugucucacuga

SEQ ID NO: 780439 - RNA, 15 nt, Homo sapiens
cuacuuaaugcacag

SEQ ID NO: 780440 - RNA, 16 nt, Homo sapiens
cuacuuacaacccagg

SEQ ID NO: 780441 - RNA, 13 nt, Homo sapiens
cuacuucccuucc

SEQ ID NO: 780442 - RNA, 14 nt, Homo sapiens
cuacuucugagcaa

SEQ ID NO: 780443 - RNA, 17 nt, Homo sapiens
cuacuucuuuugcucuu

SEQ ID NO: 780444 - RNA, 12 nt, Homo sapiens
cuacuugaguua

SEQ ID NO: 780445 - RNA, 15 nt, Homo sapiens
cuacuuucaucuuaa

SEQ ID NO: 780446 - RNA, 21 nt, Homo sapiens
cuacuuugguuucugucugua

SEQ ID NO: 780447 - RNA, 18 nt, Homo sapiens
cuacuuuuugcaccuuau

SEQ ID NO: 780448 - RNA, 21 nt, Homo sapiens
cuagaaaaauguucuuuaaag

SEQ ID NO: 780449 - RNA, 13 nt, Homo sapiens
cuagaaacaaaca

SEQ ID NO: 780450 - RNA, 22 nt, Homo sapiens
cuagaaagcugcacuggugcua

SEQ ID NO: 780451 - RNA, 13 nt, Homo sapiens
cuagaaaucuguu

SEQ ID NO: 780452 - RNA, 19 nt, Homo sapiens
cuagaacaguaaaagccuu

SEQ ID NO: 780453 - RNA, 19 nt, Homo sapiens
cuagaagaaccaaauaccu

SEQ ID NO: 780454 - RNA, 20 nt, Homo sapiens
cuagaagcacauguguauuu

SEQ ID NO: 780455 - RNA, 13 nt, Homo sapiens
cuagaaggacuca

SEQ ID NO: 780456 - RNA, 21 nt, Homo sapiens
cuagaauguggauuugauuca

SEQ ID NO: 780457 - RNA, 14 nt, Homo sapiens
cuagaauucuagug

SEQ ID NO: 780458 - RNA, 17 nt, Homo sapiens
cuagacuccucaggaga

SEQ ID NO: 780459 - RNA, 20 nt, Homo sapiens
cuagacuggccuaggggcca

SEQ ID NO: 780460 - RNA, 13 nt, Homo sapiens
cuagagacaguga

SEQ ID NO: 780461 - RNA, 23 nt, Homo sapiens
cuagagucacugauacacagaau

SEQ ID NO: 780462 - RNA, 12 nt, Homo sapiens
cuagauacugga

SEQ ID NO: 780463 - RNA, 13 nt, Homo sapiens
cuagaugcacgug

SEQ ID NO: 780464 - RNA, 20 nt, Homo sapiens
cuagaugugcaaaugcaagc

SEQ ID NO: 780465 - RNA, 20 nt, Homo sapiens
cuagauguguucuaagcaau

SEQ ID NO: 780466 - RNA, 20 nt, Homo sapiens
cuagauuuauuaguccuaau

SEQ ID NO: 780467 - RNA, 16 nt, Homo sapiens
cuagauuuucuacuuu

SEQ ID NO: 780468 - RNA, 23 nt, Homo sapiens
cuagcacaauuugcacuaaauca

SEQ ID NO: 780469 - RNA, 23 nt, Homo sapiens
cuagcaggccuaagacaugugag

SEQ ID NO: 780470 - RNA, 13 nt, Homo sapiens
cuagcauugcacu

SEQ ID NO: 780471 - RNA, 21 nt, Homo sapiens
cuagccaccucccaccccacu

SEQ ID NO: 780472 - RNA, 13 nt, Homo sapiens
cuagccagaguuu

SEQ ID NO: 780473 - RNA, 20 nt, Homo sapiens
cuagccaggaaguacuucca

SEQ ID NO: 780474 - RNA, 22 nt, Homo sapiens
cuagccaugauaacugcaauuu

SEQ ID NO: 780475 - RNA, 18 nt, Homo sapiens
cuagccccgagacaccau

SEQ ID NO: 780476 - RNA, 14 nt, Homo sapiens
cuagccuugcacuu

SEQ ID NO: 780477 - RNA, 14 nt, Homo sapiens
cuagccuugcuugu

SEQ ID NO: 780478 - RNA, 16 nt, Homo sapiens
cuagcuaauguaauaa

SEQ ID NO: 780479 - RNA, 16 nt, Homo sapiens
cuagcuuacugauaaa

SEQ ID NO: 780480 - RNA, 18 nt, Homo sapiens
cuaggaagacauuuuucc

SEQ ID NO: 780481 - RNA, 13 nt, Homo sapiens
cuaggagaccaag

SEQ ID NO: 780482 - RNA, 19 nt, Homo sapiens
cuaggagcugggaggaaaa

SEQ ID NO: 780483 - RNA, 18 nt, Homo sapiens
cuaggccacaccaucucc

SEQ ID NO: 780484 - RNA, 21 nt, Homo sapiens
cuaggccacuccuccaaagga

SEQ ID NO: 780485 - RNA, 18 nt, Homo sapiens
cuaggccucaauuguucc

SEQ ID NO: 780486 - RNA, 19 nt, Homo sapiens
cuaggcgauuuugucuacc

SEQ ID NO: 780487 - RNA, 20 nt, Homo sapiens
cuaggcuaccucaagacuca

SEQ ID NO: 780488 - RNA, 16 nt, Homo sapiens
cuagggacacacaggc

SEQ ID NO: 780489 - RNA, 16 nt, Homo sapiens
cuagggagccauuuga

SEQ ID NO: 780490 - RNA, 20 nt, Homo sapiens
cuagggcacuuuaagucagu

SEQ ID NO: 780491 - RNA, 22 nt, Homo sapiens
cuagggcacuuuaagucaguga

SEQ ID NO: 780492 - RNA, 22 nt, Homo sapiens
cuagggucuugggggucagggg

SEQ ID NO: 780493 - RNA, 23 nt, Homo sapiens
cuagguacgaagagggguggugg

SEQ ID NO: 780494 - RNA, 15 nt, Homo sapiens
cuagguaggggccca

SEQ ID NO: 780495 - RNA, 17 nt, Homo sapiens
cuaggucuccucagggu

SEQ ID NO: 780496 - RNA, 20 nt, Homo sapiens
cuagguucuaaaaauuguga

SEQ ID NO: 780497 - RNA, 15 nt, Homo sapiens
cuagguuucaaagau

SEQ ID NO: 780498 - RNA, 17 nt, Homo sapiens
cuagguuuuauucauac

SEQ ID NO: 780499 - RNA, 20 nt, Homo sapiens
cuaguagaacuggaucccaa

SEQ ID NO: 780500 - RNA, 22 nt, Homo sapiens
cuagucacuaccuucaugcaua

SEQ ID NO: 780501 - RNA, 22 nt, Homo sapiens
cuagucacucauccauccccug

SEQ ID NO: 780502 - RNA, 15 nt, Homo sapiens
cuagucucaccagcc

SEQ ID NO: 780503 - RNA, 14 nt, Homo sapiens
cuagucuguaacuc

SEQ ID NO: 780504 - RNA, 22 nt, Homo sapiens
cuagugaaagaggcagcuugaa

SEQ ID NO: 780505 - RNA, 22 nt, Homo sapiens
cuagugccccagacugagcucu

SEQ ID NO: 780506 - RNA, 17 nt, Homo sapiens
cuagugcugcugaagau

SEQ ID NO: 780507 - RNA, 18 nt, Homo sapiens
cuaguguaccuccucuca

SEQ ID NO: 780508 - RNA, 20 nt, Homo sapiens
cuaguguagagcaagccagu

SEQ ID NO: 780509 - RNA, 22 nt, Homo sapiens
cuaguguguccugugacaacac

SEQ ID NO: 780510 - RNA, 22 nt, Homo sapiens
cuaguguuccugcaccaaaccu

SEQ ID NO: 780511 - RNA, 14 nt, Homo sapiens
cuaguguugcuugg

SEQ ID NO: 780512 - RNA, 22 nt, Homo sapiens
cuaguuaauguuuauuguucaa

SEQ ID NO: 780513 - RNA, 14 nt, Homo sapiens
cuaguuucccugaa

SEQ ID NO: 780514 - RNA, 21 nt, Homo sapiens
cuaguuucucucaaugaauaa

SEQ ID NO: 780515 - RNA, 15 nt, Homo sapiens
cuaguuugaccucau

SEQ ID NO: 780516 - RNA, 12 nt, Homo sapiens
cuaaauguauuu

SEQ ID NO: 780517 - RNA, 11 nt, Homo sapiens
cuaaauuugaa

SEQ ID NO: 780518 - RNA, 15 nt, Homo sapiens
cuaacaccaacauaa

SEQ ID NO: 780519 - RNA, 12 nt, Homo sapiens
cuaacauuuccu

SEQ ID NO: 780520 - RNA, 16 nt, Homo sapiens
cuaaccagccugguca

SEQ ID NO: 780521 - RNA, 14 nt, Homo sapiens
cuaaccccuuccag

SEQ ID NO: 780522 - RNA, 17 nt, Homo sapiens
cuaacgacuucagggca

SEQ ID NO: 780523 - RNA, 17 nt, Homo sapiens
cuaacuagcauuguaaa

SEQ ID NO: 780524 - RNA, 21 nt, Homo sapiens
cuaacuaugcauggugcccca

SEQ ID NO: 780525 - RNA, 19 nt, Homo sapiens
cuaacucauuguauuccuc

SEQ ID NO: 780526 - RNA, 15 nt, Homo sapiens
cuaacugcagaccau

SEQ ID NO: 780527 - RNA, 17 nt, Homo sapiens
cuaacuggacaugaagg

SEQ ID NO: 780528 - RNA, 13 nt, Homo sapiens
cuaacuguucccu

SEQ ID NO: 780529 - RNA, 19 nt, Homo sapiens
cuaacuuaauguguauuca

SEQ ID NO: 780530 - RNA, 14 nt, Homo sapiens
cuaacuuauccauc

SEQ ID NO: 780531 - RNA, 22 nt, Homo sapiens
cuaacuuuguauccguucaaua

SEQ ID NO: 780532 - RNA, 14 nt, Homo sapiens
cuaagaaaaggcaa

SEQ ID NO: 780533 - RNA, 15 nt, Homo sapiens
cuaagaaauaagcau

SEQ ID NO: 780534 - RNA, 17 nt, Homo sapiens
cuaagaagagauuucuc

SEQ ID NO: 780535 - RNA, 20 nt, Homo sapiens
cuaagaagcgagcacugacc

SEQ ID NO: 780536 - RNA, 21 nt, Homo sapiens
cuaagagaaugugcucaugca

SEQ ID NO: 780537 - RNA, 19 nt, Homo sapiens
cuaagagacuggugacauc

SEQ ID NO: 780538 - RNA, 16 nt, Homo sapiens
cuaagauacugaugac

SEQ ID NO: 780539 - RNA, 15 nt, Homo sapiens
cuaagauaguaacaa

SEQ ID NO: 780540 - RNA, 21 nt, Homo sapiens
cuaagauauagaaacucucau

SEQ ID NO: 780541 - RNA, 13 nt, Homo sapiens
cuaagauuaccuu

SEQ ID NO: 780542 - RNA, 16 nt, Homo sapiens
cuaagauucuaaaggu

SEQ ID NO: 780543 - RNA, 22 nt, Homo sapiens
cuaagcaaaauugcuaaagaga

SEQ ID NO: 780544 - RNA, 15 nt, Homo sapiens
cuaagcaaugcaaau

SEQ ID NO: 780545 - RNA, 16 nt, Homo sapiens
cuaagcaaugcaaaug

SEQ ID NO: 780546 - RNA, 12 nt, Homo sapiens
cuaagcacaaag

SEQ ID NO: 780547 - RNA, 14 nt, Homo sapiens
cuaagcacauucca

SEQ ID NO: 780548 - RNA, 21 nt, Homo sapiens
cuaagcaguuauggugaugac

SEQ ID NO: 780549 - RNA, 15 nt, Homo sapiens
cuaagccaacuuuaa

SEQ ID NO: 780550 - RNA, 21 nt, Homo sapiens
cuaagcccuguucuccugucc

SEQ ID NO: 780551 - RNA, 11 nt, Homo sapiens
cuaagccuuuc

SEQ ID NO: 780552 - RNA, 15 nt, Homo sapiens
cuaagcgcacauuca

SEQ ID NO: 780553 - RNA, 16 nt, Homo sapiens
cuaagcgcacauucau

SEQ ID NO: 780554 - RNA, 16 nt, Homo sapiens
cuaagcuggagugcag

SEQ ID NO: 780555 - RNA, 17 nt, Homo sapiens
cuaagcuggagugcagu

SEQ ID NO: 780556 - RNA, 13 nt, Homo sapiens
cuaaggaaccuuc

SEQ ID NO: 780557 - RNA, 21 nt, Homo sapiens
cuaaggagcugauacuuugac

SEQ ID NO: 780558 - RNA, 19 nt, Homo sapiens
cuaaggcaggagaaucacu

SEQ ID NO: 780559 - RNA, 18 nt, Homo sapiens
cuaaguaaaaccacagca

SEQ ID NO: 780560 - RNA, 13 nt, Homo sapiens
cuaaguauauuaa

SEQ ID NO: 780561 - RNA, 17 nt, Homo sapiens
cuaaguccaguguuucu

SEQ ID NO: 780562 - RNA, 20 nt, Homo sapiens
cuaaguccuuccaccugcca

SEQ ID NO: 780563 - RNA, 16 nt, Homo sapiens
cuaagucucugugaau

SEQ ID NO: 780564 - RNA, 13 nt, Homo sapiens
cuaagugcauuuc

SEQ ID NO: 780565 - RNA, 23 nt, Homo sapiens
cuaaguuaaacagucaguaugca

SEQ ID NO: 780566 - RNA, 19 nt, Homo sapiens
cuaaguuauuuacuuuuac

SEQ ID NO: 780567 - RNA, 14 nt, Homo sapiens
cuaauaaacugugu

SEQ ID NO: 780568 - RNA, 13 nt, Homo sapiens
cuaauaauuauuc

SEQ ID NO: 780569 - RNA, 18 nt, Homo sapiens
cuaauagggccacagucc

SEQ ID NO: 780570 - RNA, 22 nt, Homo sapiens
cuaaucagcauucucacuccua

SEQ ID NO: 780571 - RNA, 15 nt, Homo sapiens
cuaaucccagcacuu

SEQ ID NO: 780572 - RNA, 12 nt, Homo sapiens
cuaaucucucac

SEQ ID NO: 780573 - RNA, 23 nt, Homo sapiens
cuaaucuuaacccugugcuguca

SEQ ID NO: 780574 - RNA, 21 nt, Homo sapiens
cuaaucuucuuaugcaauuuc

SEQ ID NO: 780575 - RNA, 16 nt, Homo sapiens
cuaaugagacugacca

SEQ ID NO: 780576 - RNA, 12 nt, Homo sapiens
cuaaugcucaac

SEQ ID NO: 780577 - RNA, 11 nt, Homo sapiens
cuaaugcucac

SEQ ID NO: 780578 - RNA, 20 nt, Homo sapiens
cuaaugcuucaaguguugcu

SEQ ID NO: 780579 - RNA, 13 nt, Homo sapiens
cuaaugcuuuaag

SEQ ID NO: 780580 - RNA, 16 nt, Homo sapiens
cuaauggggacacaga

SEQ ID NO: 780581 - RNA, 11 nt, Homo sapiens
cuaaugugcag

SEQ ID NO: 780582 - RNA, 15 nt, Homo sapiens
cuaauguugacuuua

SEQ ID NO: 780583 - RNA, 13 nt, Homo sapiens
cuaauuaaacaca

SEQ ID NO: 780584 - RNA, 18 nt, Homo sapiens
cuaauuauacuacuuugu

SEQ ID NO: 780585 - RNA, 19 nt, Homo sapiens
cuaauuauuuacucaaaga

SEQ ID NO: 780586 - RNA, 15 nt, Homo sapiens
cuaauuccacacccu

SEQ ID NO: 780587 - RNA, 17 nt, Homo sapiens
cuaauuccacacccuca

SEQ ID NO: 780588 - RNA, 23 nt, Homo sapiens
cuaauucggauuugccauagccu

SEQ ID NO: 780589 - RNA, 19 nt, Homo sapiens
cuaauucuucuguccugag

SEQ ID NO: 780590 - RNA, 21 nt, Homo sapiens
cuaauucuuugcaaaaaucca

SEQ ID NO: 780591 - RNA, 16 nt, Homo sapiens
cuaauuguaagugaaa

SEQ ID NO: 780592 - RNA, 22 nt, Homo sapiens
cuaauuguccacauacguggaa

SEQ ID NO: 780593 - RNA, 17 nt, Homo sapiens
cuaauuuaaguacauuu

SEQ ID NO: 780594 - RNA, 21 nt, Homo sapiens
cuaauuuauccugaaauuuca

SEQ ID NO: 780595 - RNA, 16 nt, Homo sapiens
cuaauuuuaguauuca

SEQ ID NO: 780596 - RNA, 19 nt, Homo sapiens
cuaauuuuaguauucauuc

SEQ ID NO: 780597 - RNA, 16 nt, Homo sapiens
cuaauuuuuaagaauu

SEQ ID NO: 780598 - RNA, 15 nt, Homo sapiens
cuacaaaaaacaaca

SEQ ID NO: 780599 - RNA, 13 nt, Homo sapiens
cuacaaauuugag

SEQ ID NO: 780600 - RNA, 14 nt, Homo sapiens
cuacaacaaaagga

SEQ ID NO: 780601 - RNA, 13 nt, Homo sapiens
cuacaacauguga

SEQ ID NO: 780602 - RNA, 13 nt, Homo sapiens
cuacaaguauuau

SEQ ID NO: 780603 - RNA, 19 nt, Homo sapiens
cuacaaguauuauuuuaca

SEQ ID NO: 780604 - RNA, 18 nt, Homo sapiens
cuacaaucgcuaccugac

SEQ ID NO: 780605 - RNA, 18 nt, Homo sapiens
cuacacaauacaguauua

SEQ ID NO: 780606 - RNA, 14 nt, Homo sapiens
cuacacacauaccu

SEQ ID NO: 780607 - RNA, 14 nt, Homo sapiens
cuacacacugucau

SEQ ID NO: 780608 - RNA, 13 nt, Homo sapiens
cuacacagccugg

SEQ ID NO: 780609 - RNA, 22 nt, Homo sapiens
cuacacagugggaacucugaca

SEQ ID NO: 780610 - RNA, 11 nt, Homo sapiens
cuacacauguu

SEQ ID NO: 780611 - RNA, 16 nt, Homo sapiens
cuacacccaccagagu

SEQ ID NO: 780612 - RNA, 16 nt, Homo sapiens
cuacacugauacacuu

SEQ ID NO: 780613 - RNA, 17 nt, Homo sapiens
cuacagaaagagcguca

SEQ ID NO: 780614 - RNA, 23 nt, Homo sapiens
cuacagaccuggcucucagagga

SEQ ID NO: 780615 - RNA, 14 nt, Homo sapiens
cuacagaugaguca

SEQ ID NO: 780616 - RNA, 15 nt, Homo sapiens
cuacagcagcacugu

SEQ ID NO: 780617 - RNA, 21 nt, Homo sapiens
cuacagcauccuggacaacaa

SEQ ID NO: 780618 - RNA, 14 nt, Homo sapiens
cuacaguacuucca

SEQ ID NO: 780619 - RNA, 12 nt, Homo sapiens
cuacaguuauua

SEQ ID NO: 780620 - RNA, 13 nt, Homo sapiens
cuacaguucugug

SEQ ID NO: 780621 - RNA, 23 nt, Homo sapiens
cuacaucuucugccuuagucuca

SEQ ID NO: 780622 - RNA, 18 nt, Homo sapiens
cuacaugaaauaaugcac

SEQ ID NO: 780623 - RNA, 13 nt, Homo sapiens
cuacauucacuuu

SEQ ID NO: 780624 - RNA, 21 nt, Homo sapiens
cuacauugacgagcaugagcu

SEQ ID NO: 780625 - RNA, 20 nt, Homo sapiens
cuacauuuaaaaauacuucu

SEQ ID NO: 780626 - RNA, 22 nt, Homo sapiens
cuacauuuaaaaauacuucucu

SEQ ID NO: 780627 - RNA, 14 nt, Homo sapiens
cuaccaaaacaguu

SEQ ID NO: 780628 - RNA, 21 nt, Homo sapiens
cuaccaauuucuuuuauguua

SEQ ID NO: 780629 - RNA, 13 nt, Homo sapiens
cuaccagagcucu

SEQ ID NO: 780630 - RNA, 13 nt, Homo sapiens
cuaccagcauaaa

SEQ ID NO: 780631 - RNA, 15 nt, Homo sapiens
cuaccaggaugcuaa

SEQ ID NO: 780632 - RNA, 12 nt, Homo sapiens
cggggugggggu

SEQ ID NO: 780633 - RNA, 19 nt, Homo sapiens
cgggguugucgagaucuca

SEQ ID NO: 780634 - RNA, 13 nt, Homo sapiens
cggguaccugaag

SEQ ID NO: 780635 - RNA, 23 nt, Homo sapiens
cgggucucucacuguugcagugg

SEQ ID NO: 780636 - RNA, 15 nt, Homo sapiens
cggguggaucaccug

SEQ ID NO: 780637 - RNA, 20 nt, Homo sapiens
cggguggaucaccugagguc

SEQ ID NO: 780638 - RNA, 13 nt, Homo sapiens
cggguguguacac

SEQ ID NO: 780639 - RNA, 18 nt, Homo sapiens
cgguaccuggcaauguuu

SEQ ID NO: 780640 - RNA, 22 nt, Homo sapiens
cgguacuaguucagacacuuug

SEQ ID NO: 780641 - RNA, 23 nt, Homo sapiens
cgguccgcagaagcagaccucau

SEQ ID NO: 780642 - RNA, 16 nt, Homo sapiens
cggugagaacucugcc

SEQ ID NO: 780643 - RNA, 14 nt, Homo sapiens
cggugagccggggc

SEQ ID NO: 780644 - RNA, 22 nt, Homo sapiens
cggugaugaggaaggacuugac

SEQ ID NO: 780645 - RNA, 22 nt, Homo sapiens
cgguguucugucccagugcggu

SEQ ID NO: 780646 - RNA, 20 nt, Homo sapiens
cgguuugaaaauaugccugc

SEQ ID NO: 780647 - RNA, 15 nt, Homo sapiens
cguaacaacuguggu

SEQ ID NO: 780648 - RNA, 23 nt, Homo sapiens
cguaacagauuuuguuggcauag

SEQ ID NO: 780649 - RNA, 16 nt, Homo sapiens
cguaaugaaagccaca

SEQ ID NO: 780650 - RNA, 23 nt, Homo sapiens
cguaaugcauugccuguaacaau

SEQ ID NO: 780651 - RNA, 14 nt, Homo sapiens
cguagacuugacaa

SEQ ID NO: 780652 - RNA, 15 nt, Homo sapiens
cguauacuguaacuu

SEQ ID NO: 780653 - RNA, 14 nt, Homo sapiens
cguaucacaguguu

SEQ ID NO: 780654 - RNA, 21 nt, Homo sapiens
cguaucugcucuuaggugcuu

SEQ ID NO: 780655 - RNA, 17 nt, Homo sapiens
cgucaaagcaguaguca

SEQ ID NO: 780656 - RNA, 14 nt, Homo sapiens
cgucaccaccaccg

SEQ ID NO: 780657 - RNA, 16 nt, Homo sapiens
cgucagagcagugacc

SEQ ID NO: 780658 - RNA, 23 nt, Homo sapiens
cgucagggagaggucaccagcug

SEQ ID NO: 780659 - RNA, 17 nt, Homo sapiens
cgucccccaaacauguu

SEQ ID NO: 780660 - RNA, 13 nt, Homo sapiens
cgucccuaccucc

SEQ ID NO: 780661 - RNA, 20 nt, Homo sapiens
cguccgcgcgccagcacaga

SEQ ID NO: 780662 - RNA, 12 nt, Homo sapiens
cguccuggucaa

SEQ ID NO: 780663 - RNA, 18 nt, Homo sapiens
cgucuacugcaagagcca

SEQ ID NO: 780664 - RNA, 22 nt, Homo sapiens
cgucuucacuuccccacaggcu

SEQ ID NO: 780665 - RNA, 18 nt, Homo sapiens
cgugaaucuguaucuugc

SEQ ID NO: 780666 - RNA, 16 nt, Homo sapiens
cgugaccuugcaaugu

SEQ ID NO: 780667 - RNA, 17 nt, Homo sapiens
cgugaccuugcaauguu

SEQ ID NO: 780668 - RNA, 18 nt, Homo sapiens
cgugacgaggcucaaaaa

SEQ ID NO: 780669 - RNA, 20 nt, Homo sapiens
cgugacuguuacuuuauaca

SEQ ID NO: 780670 - RNA, 14 nt, Homo sapiens
cgugagacccagug

SEQ ID NO: 780671 - RNA, 18 nt, Homo sapiens
cgugagagaaucugccug

SEQ ID NO: 780672 - RNA, 12 nt, Homo sapiens
cgugaguggucu

SEQ ID NO: 780673 - RNA, 16 nt, Homo sapiens
cgugaguggucuucaa

SEQ ID NO: 780674 - RNA, 20 nt, Homo sapiens
cgugccaaaaaucuuuucau

SEQ ID NO: 780675 - RNA, 21 nt, Homo sapiens
cgugcugagaggcgagcuccu

SEQ ID NO: 780676 - RNA, 20 nt, Homo sapiens
cguggagcaugcaacacauc

SEQ ID NO: 780677 - RNA, 16 nt, Homo sapiens
cguggauugcacgugg

SEQ ID NO: 780678 - RNA, 21 nt, Homo sapiens
cguggcaaaaugaacacaucu

SEQ ID NO: 780679 - RNA, 23 nt, Homo sapiens
cgugggcagcaaaacgacacugc

SEQ ID NO: 780680 - RNA, 23 nt, Homo sapiens
cgugguaugucugccauguugcc

SEQ ID NO: 780681 - RNA, 12 nt, Homo sapiens
cguggucccuga

SEQ ID NO: 780682 - RNA, 13 nt, Homo sapiens
cguggucccugag

SEQ ID NO: 780683 - RNA, 20 nt, Homo sapiens
cguggucuccuugcacuuuc

SEQ ID NO: 780684 - RNA, 18 nt, Homo sapiens
cguggugaccuuucacga

SEQ ID NO: 780685 - RNA, 18 nt, Homo sapiens
cguguauaggacucucag

SEQ ID NO: 780686 - RNA, 16 nt, Homo sapiens
cguguccagcacagaa

SEQ ID NO: 780687 - RNA, 16 nt, Homo sapiens
cgugugaacugcaaca

SEQ ID NO: 780688 - RNA, 16 nt, Homo sapiens
cguguggcccaagacc

SEQ ID NO: 780689 - RNA, 14 nt, Homo sapiens
cgugugucugucag

SEQ ID NO: 780690 - RNA, 18 nt, Homo sapiens
cguguguguuauuucccc

SEQ ID NO: 780691 - RNA, 18 nt, Homo sapiens
cguguuacuguugcacug

SEQ ID NO: 780692 - RNA, 11 nt, Homo sapiens
cguuaccagag

SEQ ID NO: 780693 - RNA, 17 nt, Homo sapiens
cguuaggguuugagaga

SEQ ID NO: 780694 - RNA, 20 nt, Homo sapiens
cguucaccuccaagcauuuc

SEQ ID NO: 780695 - RNA, 13 nt, Homo sapiens
cguucacucccaa

SEQ ID NO: 780696 - RNA, 15 nt, Homo sapiens
cguucagaggugcag

SEQ ID NO: 780697 - RNA, 20 nt, Homo sapiens
cguuccaaguauuuugccac

SEQ ID NO: 780698 - RNA, 11 nt, Homo sapiens
cguuccagugg

SEQ ID NO: 780699 - RNA, 15 nt, Homo sapiens
cguucucacacccac

SEQ ID NO: 780700 - RNA, 17 nt, Homo sapiens
cguugggagccuagcuc

SEQ ID NO: 780701 - RNA, 12 nt, Homo sapiens
cguuucuggaac

SEQ ID NO: 780702 - RNA, 14 nt, Homo sapiens
cguuucuguauaca

SEQ ID NO: 780703 - RNA, 22 nt, Homo sapiens
cguuuguccuuuuucacuuuga

SEQ ID NO: 780704 - RNA, 12 nt, Homo sapiens
cuaaaaaagcau

SEQ ID NO: 780705 - RNA, 13 nt, Homo sapiens
cuaaaaauccaga

SEQ ID NO: 780706 - RNA, 17 nt, Homo sapiens
cuaaaaaugcaucacau

SEQ ID NO: 780707 - RNA, 19 nt, Homo sapiens
cuaaaaccacaugugcaac

SEQ ID NO: 780708 - RNA, 14 nt, Homo sapiens
cuaaaacugcauuu

SEQ ID NO: 780709 - RNA, 14 nt, Homo sapiens
cuaaaacuuaacau

SEQ ID NO: 780710 - RNA, 17 nt, Homo sapiens
cuaaaacuuaacauuca

SEQ ID NO: 780711 - RNA, 12 nt, Homo sapiens
cuaaaagcuuuc

SEQ ID NO: 780712 - RNA, 16 nt, Homo sapiens
cuaaaaguguaagaaa

SEQ ID NO: 780713 - RNA, 15 nt, Homo sapiens
cuaaaauauuacaaa

SEQ ID NO: 780714 - RNA, 12 nt, Homo sapiens
cuaaaaucauga

SEQ ID NO: 780715 - RNA, 20 nt, Homo sapiens
cuaaaaucuguuaccauucu

SEQ ID NO: 780716 - RNA, 20 nt, Homo sapiens
cuaaaaucuuauaguucuag

SEQ ID NO: 780717 - RNA, 22 nt, Homo sapiens
cuaaaaugacaagccuucuuaa

SEQ ID NO: 780718 - RNA, 23 nt, Homo sapiens
cuaaaaugacaagccuucuuaaa

SEQ ID NO: 780719 - RNA, 19 nt, Homo sapiens
cuaaaauuagaugaacuca

SEQ ID NO: 780720 - RNA, 14 nt, Homo sapiens
cuaaacaacccaga

SEQ ID NO: 780721 - RNA, 20 nt, Homo sapiens
cuaaacaaugcugauuuggu

SEQ ID NO: 780722 - RNA, 12 nt, Homo sapiens
cuaaacauccau

SEQ ID NO: 780723 - RNA, 12 nt, Homo sapiens
cuaaacauuuca

SEQ ID NO: 780724 - RNA, 17 nt, Homo sapiens
cuaaacuaucaauaaua

SEQ ID NO: 780725 - RNA, 16 nt, Homo sapiens
cuaaacucagaggcag

SEQ ID NO: 780726 - RNA, 16 nt, Homo sapiens
cuaaacucauuuauaa

SEQ ID NO: 780727 - RNA, 22 nt, Homo sapiens
cuaaacuggcaucugcucuaga

SEQ ID NO: 780728 - RNA, 15 nt, Homo sapiens
cuaaacuguuuucau

SEQ ID NO: 780729 - RNA, 21 nt, Homo sapiens
cuaaagaaaaauaucuuggcc

SEQ ID NO: 780730 - RNA, 16 nt, Homo sapiens
cuaaagacugaucuca

SEQ ID NO: 780731 - RNA, 17 nt, Homo sapiens
cuaaagagagugagcau

SEQ ID NO: 780732 - RNA, 12 nt, Homo sapiens
cuaaagcacuuu

SEQ ID NO: 780733 - RNA, 20 nt, Homo sapiens
cuaaagccaaggguauccaa

SEQ ID NO: 780734 - RNA, 16 nt, Homo sapiens
cuaaaggacucuccag

SEQ ID NO: 780735 - RNA, 11 nt, Homo sapiens
cuaaagggcag

SEQ ID NO: 780736 - RNA, 22 nt, Homo sapiens
cuaaagucaucaugaacuggcu

SEQ ID NO: 780737 - RNA, 13 nt, Homo sapiens
cuaaagugcaaaa

SEQ ID NO: 780738 - RNA, 12 nt, Homo sapiens
cuaaaguuuuag

SEQ ID NO: 780739 - RNA, 17 nt, Homo sapiens
cuaaaguuuugcaacaa

SEQ ID NO: 780740 - RNA, 17 nt, Homo sapiens
cuaaauaaaaauaugua

SEQ ID NO: 780741 - RNA, 18 nt, Homo sapiens
cuaaauaaaugagcuguu

SEQ ID NO: 780742 - RNA, 14 nt, Homo sapiens
cuaaauaggagaua

SEQ ID NO: 780743 - RNA, 11 nt, Homo sapiens
cuaaauaugau

SEQ ID NO: 780744 - RNA, 23 nt, Homo sapiens
cuaaaucacuuugagccugggaa

SEQ ID NO: 780745 - RNA, 13 nt, Homo sapiens
cuaaaucagagac

SEQ ID NO: 780746 - RNA, 18 nt, Homo sapiens
cuaaaucagagacaaaau

SEQ ID NO: 780747 - RNA, 15 nt, Homo sapiens
cuaaaugcaccaaga

SEQ ID NO: 780748 - RNA, 14 nt, Homo sapiens
cgagggcagcugcu

SEQ ID NO: 780749 - RNA, 23 nt, Homo sapiens
cgagguauggcagaggugcaaga

SEQ ID NO: 780750 - RNA, 15 nt, Homo sapiens
cgaguaacugagauu

SEQ ID NO: 780751 - RNA, 22 nt, Homo sapiens
cgaguguccagccaagggcuga

SEQ ID NO: 780752 - RNA, 14 nt, Homo sapiens
cgaguuaagaacau

SEQ ID NO: 780753 - RNA, 16 nt, Homo sapiens
cgaguuuucugaccag

SEQ ID NO: 780754 - RNA, 15 nt, Homo sapiens
cgauacaaaguguug

SEQ ID NO: 780755 - RNA, 15 nt, Homo sapiens
cgauaccgggacaca

SEQ ID NO: 780756 - RNA, 18 nt, Homo sapiens
cgauccuggauucacuca

SEQ ID NO: 780757 - RNA, 19 nt, Homo sapiens
cgaugaaguuaugcuguca

SEQ ID NO: 780758 - RNA, 14 nt, Homo sapiens
cgaugacaguguuc

SEQ ID NO: 780759 - RNA, 14 nt, Homo sapiens
cgaugcugaccuca

SEQ ID NO: 780760 - RNA, 22 nt, Homo sapiens
cgaugcuggaggcccucgagga

SEQ ID NO: 780761 - RNA, 18 nt, Homo sapiens
cgauuaaaaucacucuca

SEQ ID NO: 780762 - RNA, 15 nt, Homo sapiens
cgcaaagacaucaaa

SEQ ID NO: 780763 - RNA, 16 nt, Homo sapiens
cgcaaaucaacacuuu

SEQ ID NO: 780764 - RNA, 14 nt, Homo sapiens
cgcaaauucgcaaa

SEQ ID NO: 780765 - RNA, 15 nt, Homo sapiens
cgcaaggccugugcu

SEQ ID NO: 780766 - RNA, 20 nt, Homo sapiens
cgcaaucucggcucacugca

SEQ ID NO: 780767 - RNA, 22 nt, Homo sapiens
cgcaaugcuucuagaguuuuau

SEQ ID NO: 780768 - RNA, 17 nt, Homo sapiens
cgcacaaggcugaccaa

SEQ ID NO: 780769 - RNA, 15 nt, Homo sapiens
cgcaccaagaucucc

SEQ ID NO: 780770 - RNA, 14 nt, Homo sapiens
cgcaccacugcacu

SEQ ID NO: 780771 - RNA, 11 nt, Homo sapiens
cgcaccugccc

SEQ ID NO: 780772 - RNA, 23 nt, Homo sapiens
cgcacugggagccauggggagca

SEQ ID NO: 780773 - RNA, 19 nt, Homo sapiens
cgcaggccucagcaucucc

SEQ ID NO: 780774 - RNA, 19 nt, Homo sapiens
cgcagggaugucgcugggg

SEQ ID NO: 780775 - RNA, 15 nt, Homo sapiens
cgcagggccaugcag

SEQ ID NO: 780776 - RNA, 21 nt, Homo sapiens
cgcagucugcuucagugcagu

SEQ ID NO: 780777 - RNA, 12 nt, Homo sapiens
cgcaguggcuca

SEQ ID NO: 780778 - RNA, 18 nt, Homo sapiens
cgcaguggcucacaccug

SEQ ID NO: 780779 - RNA, 14 nt, Homo sapiens
cgcaucauaugcag

SEQ ID NO: 780780 - RNA, 23 nt, Homo sapiens
cgcaucguggccuugaccuccaa

SEQ ID NO: 780781 - RNA, 14 nt, Homo sapiens
cgcaucuugccucc

SEQ ID NO: 780782 - RNA, 20 nt, Homo sapiens
cgcaugcccucaaucccagc

SEQ ID NO: 780783 - RNA, 13 nt, Homo sapiens
cgcauucccugag

SEQ ID NO: 780784 - RNA, 19 nt, Homo sapiens
cgccaaucccgccaugcuc

SEQ ID NO: 780785 - RNA, 20 nt, Homo sapiens
cgccagacagauugcugaua

SEQ ID NO: 780786 - RNA, 13 nt, Homo sapiens
cgccagacuguua

SEQ ID NO: 780787 - RNA, 14 nt, Homo sapiens
cgccaggcgcugca

SEQ ID NO: 780788 - RNA, 16 nt, Homo sapiens
cgccaggcgcugcagg

SEQ ID NO: 780789 - RNA, 21 nt, Homo sapiens
cgcccacguggcagaccguga

SEQ ID NO: 780790 - RNA, 22 nt, Homo sapiens
cgccccagggcacuacauaauu

SEQ ID NO: 780791 - RNA, 21 nt, Homo sapiens
cgcccccagaacauacacugu

SEQ ID NO: 780792 - RNA, 19 nt, Homo sapiens
cgcccuuggcuucugugau

SEQ ID NO: 780793 - RNA, 20 nt, Homo sapiens
cgcccuuggcuucugugaug

SEQ ID NO: 780794 - RNA, 15 nt, Homo sapiens
cgccgcugacugcca

SEQ ID NO: 780795 - RNA, 19 nt, Homo sapiens
cgccguggcuauaccuggg

SEQ ID NO: 780796 - RNA, 20 nt, Homo sapiens
cgccucacaccccaguggau

SEQ ID NO: 780797 - RNA, 21 nt, Homo sapiens
cgccuguaaucccagcacuuu

SEQ ID NO: 780798 - RNA, 20 nt, Homo sapiens
cgcgcaccuguaaucccagc

SEQ ID NO: 780799 - RNA, 13 nt, Homo sapiens
cgcgcaccuguag

SEQ ID NO: 780800 - RNA, 18 nt, Homo sapiens
cgcgggaggcaccagcuc

SEQ ID NO: 780801 - RNA, 19 nt, Homo sapiens
cgcuacccaccuccaggga

SEQ ID NO: 780802 - RNA, 17 nt, Homo sapiens
cgcucaccucagagcag

SEQ ID NO: 780803 - RNA, 13 nt, Homo sapiens
cgcucaggugauc

SEQ ID NO: 780804 - RNA, 15 nt, Homo sapiens
cgcuccaguaucucc

SEQ ID NO: 780805 - RNA, 22 nt, Homo sapiens
cgcucugccauucaacucggaa

SEQ ID NO: 780806 - RNA, 14 nt, Homo sapiens
cgcugacugcacca

SEQ ID NO: 780807 - RNA, 16 nt, Homo sapiens
cgcugacugccaccca

SEQ ID NO: 780808 - RNA, 16 nt, Homo sapiens
cgcuggcuggugggcc

SEQ ID NO: 780809 - RNA, 14 nt, Homo sapiens
cgcugggugguacc

SEQ ID NO: 780810 - RNA, 20 nt, Homo sapiens
cgcuucugccuuuucacugu

SEQ ID NO: 780811 - RNA, 21 nt, Homo sapiens
cggaaacuaguguacauuucu

SEQ ID NO: 780812 - RNA, 18 nt, Homo sapiens
cggaagcugucgacuuca

SEQ ID NO: 780813 - RNA, 17 nt, Homo sapiens
cggaaggauugcaaugc

SEQ ID NO: 780814 - RNA, 17 nt, Homo sapiens
cggaagggguuccucaa

SEQ ID NO: 780815 - RNA, 16 nt, Homo sapiens
cggacacaaccaaauc

SEQ ID NO: 780816 - RNA, 14 nt, Homo sapiens
cggacagugcccau

SEQ ID NO: 780817 - RNA, 18 nt, Homo sapiens
cggaccuccaucagagcc

SEQ ID NO: 780818 - RNA, 13 nt, Homo sapiens
cggacucacuucu

SEQ ID NO: 780819 - RNA, 20 nt, Homo sapiens
cggagaaacgggugagcuga

SEQ ID NO: 780820 - RNA, 21 nt, Homo sapiens
cggagacuuucaaacauauau

SEQ ID NO: 780821 - RNA, 17 nt, Homo sapiens
cggagagagccaagacg

SEQ ID NO: 780822 - RNA, 18 nt, Homo sapiens
cggagccccugaaagccu

SEQ ID NO: 780823 - RNA, 17 nt, Homo sapiens
cggagccuccucucuca

SEQ ID NO: 780824 - RNA, 16 nt, Homo sapiens
cggagcuugcagugag

SEQ ID NO: 780825 - RNA, 15 nt, Homo sapiens
cggagucuugcucug

SEQ ID NO: 780826 - RNA, 18 nt, Homo sapiens
cggagugagcaauggagu

SEQ ID NO: 780827 - RNA, 12 nt, Homo sapiens
cggauccugcug

SEQ ID NO: 780828 - RNA, 20 nt, Homo sapiens
cggaugggcccuaugucuca

SEQ ID NO: 780829 - RNA, 22 nt, Homo sapiens
cggauugcucuggagcagccaa

SEQ ID NO: 780830 - RNA, 23 nt, Homo sapiens
cggauuugcucaggccugggaau

SEQ ID NO: 780831 - RNA, 12 nt, Homo sapiens
cggcacauuccc

SEQ ID NO: 780832 - RNA, 18 nt, Homo sapiens
cggcacccugauccucac

SEQ ID NO: 780833 - RNA, 17 nt, Homo sapiens
cggcaccucuccgagcc

SEQ ID NO: 780834 - RNA, 23 nt, Homo sapiens
cggcacgguuuccagauguaaua

SEQ ID NO: 780835 - RNA, 15 nt, Homo sapiens
cggccacagggcggu

SEQ ID NO: 780836 - RNA, 22 nt, Homo sapiens
cggccacaugccgcgucccugc

SEQ ID NO: 780837 - RNA, 15 nt, Homo sapiens
cggccacgucccugc

SEQ ID NO: 780838 - RNA, 16 nt, Homo sapiens
cggcccaacgcaaauu

SEQ ID NO: 780839 - RNA, 14 nt, Homo sapiens
cggccgacugccug

SEQ ID NO: 780840 - RNA, 19 nt, Homo sapiens
cggccuugaagacagagca

SEQ ID NO: 780841 - RNA, 17 nt, Homo sapiens
cggccuuuguugcucag

SEQ ID NO: 780842 - RNA, 17 nt, Homo sapiens
cggcucuauucucuaaa

SEQ ID NO: 780843 - RNA, 21 nt, Homo sapiens
cggcugagucaugaucucccu

SEQ ID NO: 780844 - RNA, 18 nt, Homo sapiens
cggcugcggggggcacca

SEQ ID NO: 780845 - RNA, 16 nt, Homo sapiens
cggcuuccaucugccc

SEQ ID NO: 780846 - RNA, 13 nt, Homo sapiens
cgggaacaguguu

SEQ ID NO: 780847 - RNA, 19 nt, Homo sapiens
cgggacccccucaccaucc

SEQ ID NO: 780848 - RNA, 20 nt, Homo sapiens
cgggagcugcggaagcccag

SEQ ID NO: 780849 - RNA, 22 nt, Homo sapiens
cgggagcuuugggugaccagcc

SEQ ID NO: 780850 - RNA, 15 nt, Homo sapiens
cgggaugggggaaaa

SEQ ID NO: 780851 - RNA, 16 nt, Homo sapiens
cgggauuuaugugcac

SEQ ID NO: 780852 - RNA, 19 nt, Homo sapiens
cgggcacagugguggugcc

SEQ ID NO: 780853 - RNA, 21 nt, Homo sapiens
cgggcaccaacuccauguuug

SEQ ID NO: 780854 - RNA, 13 nt, Homo sapiens
cgggccagggugg

SEQ ID NO: 780855 - RNA, 16 nt, Homo sapiens
cgggccccauccucau

SEQ ID NO: 780856 - RNA, 16 nt, Homo sapiens
cgggcuuaccagguga

SEQ ID NO: 780857 - RNA, 21 nt, Homo sapiens
cggggaggcagggguccugca

SEQ ID NO: 780858 - RNA, 20 nt, Homo sapiens
cggggaggcuccugccugag

SEQ ID NO: 780859 - RNA, 15 nt, Homo sapiens
cggggcuccacugaa

SEQ ID NO: 780860 - RNA, 15 nt, Homo sapiens
cgggggccuguggug

SEQ ID NO: 780861 - RNA, 23 nt, Homo sapiens
cgggguauucccacucaccagcc

SEQ ID NO: 780862 - RNA, 15 nt, Homo sapiens
cggggugcuguggug

SEQ ID NO: 780863 - RNA, 21 nt, Homo sapiens
ccucagcaguccacaaagcau

SEQ ID NO: 780864 - RNA, 15 nt, Homo sapiens
ccucagccccacuga

SEQ ID NO: 780865 - RNA, 23 nt, Homo sapiens
ccucagcccgccaagguagccau

SEQ ID NO: 780866 - RNA, 17 nt, Homo sapiens
ccucagccucccaaagu

SEQ ID NO: 780867 - RNA, 12 nt, Homo sapiens
ccucagccugau

SEQ ID NO: 780868 - RNA, 18 nt, Homo sapiens
ccucagccuugccagaga

SEQ ID NO: 780869 - RNA, 20 nt, Homo sapiens
ccucagcguccugggcucaa

SEQ ID NO: 780870 - RNA, 17 nt, Homo sapiens
ccucagcucaaugcagu

SEQ ID NO: 780871 - RNA, 18 nt, Homo sapiens
ccucagcucucugggacc

SEQ ID NO: 780872 - RNA, 14 nt, Homo sapiens
ccucagcuucucaa

SEQ ID NO: 780873 - RNA, 19 nt, Homo sapiens
ccucaggccaggugcagug

SEQ ID NO: 780874 - RNA, 15 nt, Homo sapiens
ccucaggcggggugg

SEQ ID NO: 780875 - RNA, 15 nt, Homo sapiens
ccucagggacagaga

SEQ ID NO: 780876 - RNA, 18 nt, Homo sapiens
ccucagggagcagggaag

SEQ ID NO: 780877 - RNA, 11 nt, Homo sapiens
ccucagggugg

SEQ ID NO: 780878 - RNA, 21 nt, Homo sapiens
ccucagguggccccaguucaa

SEQ ID NO: 780879 - RNA, 23 nt, Homo sapiens
ccucaguaaauguacaacugcac

SEQ ID NO: 780880 - RNA, 20 nt, Homo sapiens
ccucaguucccucuugcuca

SEQ ID NO: 780881 - RNA, 21 nt, Homo sapiens
ccucaguuucauuaacuggug

SEQ ID NO: 780882 - RNA, 15 nt, Homo sapiens
ccucauacccaugca

SEQ ID NO: 780883 - RNA, 19 nt, Homo sapiens
ccucaugaaaacacacaua

SEQ ID NO: 780884 - RNA, 13 nt, Homo sapiens
ccucaugcccagc

SEQ ID NO: 780885 - RNA, 13 nt, Homo sapiens
ccucauuccugaa

SEQ ID NO: 780886 - RNA, 15 nt, Homo sapiens
ccucauucuacugaa

SEQ ID NO: 780887 - RNA, 22 nt, Homo sapiens
ccucauuuaaguaaaagguuag

SEQ ID NO: 780888 - RNA, 13 nt, Homo sapiens
ccuccaaaugcca

SEQ ID NO: 780889 - RNA, 16 nt, Homo sapiens
ccuccaaaugccaacu

SEQ ID NO: 780890 - RNA, 13 nt, Homo sapiens
ccuccaaccagga

SEQ ID NO: 780891 - RNA, 12 nt, Homo sapiens
ccuccaccaaac

SEQ ID NO: 780892 - RNA, 16 nt, Homo sapiens
ccuccaccccccagaa

SEQ ID NO: 780893 - RNA, 19 nt, Homo sapiens
ccuccacugccucuggaau

SEQ ID NO: 780894 - RNA, 16 nt, Homo sapiens
ccuccagaagcugcuc

SEQ ID NO: 780895 - RNA, 15 nt, Homo sapiens
ccuccagaggaugac

SEQ ID NO: 780896 - RNA, 15 nt, Homo sapiens
ccuccagcauuuaaa

SEQ ID NO: 780897 - RNA, 18 nt, Homo sapiens
ccuccagcuaaacaccaa

SEQ ID NO: 780898 - RNA, 16 nt, Homo sapiens
ccuccaucagagccag

SEQ ID NO: 780899 - RNA, 20 nt, Homo sapiens
ccuccaugaacaucauggac

SEQ ID NO: 780900 - RNA, 19 nt, Homo sapiens
ccuccauggcagaagucaa

SEQ ID NO: 780901 - RNA, 15 nt, Homo sapiens
ccuccauucugacca

SEQ ID NO: 780902 - RNA, 22 nt, Homo sapiens
ccuccauuugcaauugaccucu

SEQ ID NO: 780903 - RNA, 20 nt, Homo sapiens
ccucccaaagugcugggauu

SEQ ID NO: 780904 - RNA, 17 nt, Homo sapiens
ccucccaacagcgcuuu

SEQ ID NO: 780905 - RNA, 20 nt, Homo sapiens
ccucccacagugcugggauu

SEQ ID NO: 780906 - RNA, 23 nt, Homo sapiens
ccucccagugaccccugaccuca

SEQ ID NO: 780907 - RNA, 16 nt, Homo sapiens
ccucccauaauuucau

SEQ ID NO: 780908 - RNA, 24 nt, Homo sapiens
ccucccauuacuuugauaucugau

SEQ ID NO: 780909 - RNA, 14 nt, Homo sapiens
ccuccccaacuccc

SEQ ID NO: 780910 - RNA, 13 nt, Homo sapiens
ccuccccaguuca

SEQ ID NO: 780911 - RNA, 16 nt, Homo sapiens
ccucccccaguguccc

SEQ ID NO: 780912 - RNA, 22 nt, Homo sapiens
ccuccccuggguuaacaaauga

SEQ ID NO: 780913 - RNA, 15 nt, Homo sapiens
ccucccuaaugcuca

SEQ ID NO: 780914 - RNA, 13 nt, Homo sapiens
ccucccucaggcc

SEQ ID NO: 780915 - RNA, 10 nt, Homo sapiens
ccucccugaa

SEQ ID NO: 780916 - RNA, 17 nt, Homo sapiens
ccucccugcuugcacac

SEQ ID NO: 780917 - RNA, 23 nt, Homo sapiens
ccucccuggggaccaggagcuag

SEQ ID NO: 780918 - RNA, 15 nt, Homo sapiens
ccucccuggucccuu

SEQ ID NO: 780919 - RNA, 19 nt, Homo sapiens
ccucccuguuccccagaga

SEQ ID NO: 780920 - RNA, 13 nt, Homo sapiens
ccucccuucccag

SEQ ID NO: 780921 - RNA, 17 nt, Homo sapiens
ccuccgcgccuugccuc

SEQ ID NO: 780922 - RNA, 17 nt, Homo sapiens
ccuccgugauccaucca

SEQ ID NO: 780923 - RNA, 21 nt, Homo sapiens
ccuccuagaggugggcagcug

SEQ ID NO: 780924 - RNA, 17 nt, Homo sapiens
uagcuuagcaucagagg

SEQ ID NO: 780925 - RNA, 18 nt, Homo sapiens
uagcuuagcaucagaggu

SEQ ID NO: 780926 - RNA, 19 nt, Homo sapiens
uagcuugcaccuugucaca

SEQ ID NO: 780927 - RNA, 23 nt, Homo sapiens
uagcuuggguccaccaugcagaa

SEQ ID NO: 780928 - RNA, 20 nt, Homo sapiens
uagcuuguuaguaaugcucu

SEQ ID NO: 780929 - RNA, 17 nt, Homo sapiens
uagcuuuaaaaccacag

SEQ ID NO: 780930 - RNA, 17 nt, Homo sapiens
uagcuuugggugccuuu

SEQ ID NO: 780931 - RNA, 18 nt, Homo sapiens
uaggaaaaaaauaguaaa

SEQ ID NO: 780932 - RNA, 15 nt, Homo sapiens
uaggaaaacauugca

SEQ ID NO: 780933 - RNA, 16 nt, Homo sapiens
uaggaaaacauugcaa

SEQ ID NO: 780934 - RNA, 17 nt, Homo sapiens
uaggaaagcauaugcag

SEQ ID NO: 780935 - RNA, 23 nt, Homo sapiens
uaggaaagucacccaaacacuuc

SEQ ID NO: 780936 - RNA, 12 nt, Homo sapiens
uaggaacaagca

SEQ ID NO: 780937 - RNA, 18 nt, Homo sapiens
uaggaaccuaugaaacua

SEQ ID NO: 780938 - RNA, 16 nt, Homo sapiens
uaggaagaccaagaca

SEQ ID NO: 780939 - RNA, 16 nt, Homo sapiens
uaggaaggcacuacau

SEQ ID NO: 780940 - RNA, 22 nt, Homo sapiens
uaggaaggcacuacaugaaaua

SEQ ID NO: 780941 - RNA, 16 nt, Homo sapiens
uaggaaggugaaucug

SEQ ID NO: 780942 - RNA, 20 nt, Homo sapiens
uaggaaguauggcaugaaca

SEQ ID NO: 780943 - RNA, 16 nt, Homo sapiens
uaggaauaaauaaaaa

SEQ ID NO: 780944 - RNA, 23 nt, Homo sapiens
uaggaauaagcucuaguucuuaa

SEQ ID NO: 780945 - RNA, 13 nt, Homo sapiens
uaggaauaugacc

SEQ ID NO: 780946 - RNA, 19 nt, Homo sapiens
uaggaauguccaccaugaa

SEQ ID NO: 780947 - RNA, 16 nt, Homo sapiens
uaggacucugaggcuc

SEQ ID NO: 780948 - RNA, 19 nt, Homo sapiens
uaggagaaaccagcuuuua

SEQ ID NO: 780949 - RNA, 21 nt, Homo sapiens
uaggagacagagccaagcacu

SEQ ID NO: 780950 - RNA, 17 nt, Homo sapiens
uaggagauagaagaaga

SEQ ID NO: 780951 - RNA, 17 nt, Homo sapiens
uaggagggagacacugg

SEQ ID NO: 780952 - RNA, 20 nt, Homo sapiens
uaggagggcuggcaacuuag

SEQ ID NO: 780953 - RNA, 13 nt, Homo sapiens
uaggagugagaag

SEQ ID NO: 780954 - RNA, 14 nt, Homo sapiens
uaggauaucuuggc

SEQ ID NO: 780955 - RNA, 13 nt, Homo sapiens
uaggaucaucucu

SEQ ID NO: 780956 - RNA, 15 nt, Homo sapiens
uaggauuacuuagau

SEQ ID NO: 780957 - RNA, 22 nt, Homo sapiens
uaggauucaggcagcagugucu

SEQ ID NO: 780958 - RNA, 23 nt, Homo sapiens
uaggauugacguaccgugcaucu

SEQ ID NO: 780959 - RNA, 21 nt, Homo sapiens
uaggcacuguaguucuaagac

SEQ ID NO: 780960 - RNA, 23 nt, Homo sapiens
uaggcagagccauaauggacuaa

SEQ ID NO: 780961 - RNA, 16 nt, Homo sapiens
uaggcaggaagcccaa

SEQ ID NO: 780962 - RNA, 15 nt, Homo sapiens
uaggcauauaucacu

SEQ ID NO: 780963 - RNA, 16 nt, Homo sapiens
uaggcauuaacacaaa

SEQ ID NO: 780964 - RNA, 23 nt, Homo sapiens
uaggcauuuggucucacuacuug

SEQ ID NO: 780965 - RNA, 20 nt, Homo sapiens
uaggccagcaccaucucuuu

SEQ ID NO: 780966 - RNA, 17 nt, Homo sapiens
uaggcgcaggugcacag

SEQ ID NO: 780967 - RNA, 12 nt, Homo sapiens
uaggcucugcac

SEQ ID NO: 780968 - RNA, 15 nt, Homo sapiens
uagggaaaacuuaau

SEQ ID NO: 780969 - RNA, 14 nt, Homo sapiens
uagggaagcucagg

SEQ ID NO: 780970 - RNA, 15 nt, Homo sapiens
uagggaguaccugcu

SEQ ID NO: 780971 - RNA, 24 nt, Homo sapiens
uagggauuuuuggcuacacacaaa

SEQ ID NO: 780972 - RNA, 16 nt, Homo sapiens
uagggcaacaauacau

SEQ ID NO: 780973 - RNA, 22 nt, Homo sapiens
uagggcagccgaguggaggaaa

SEQ ID NO: 780974 - RNA, 16 nt, Homo sapiens
uagggccgacgcugug

SEQ ID NO: 780975 - RNA, 21 nt, Homo sapiens
uaggggauguggagugagaac

SEQ ID NO: 780976 - RNA, 15 nt, Homo sapiens
uagggggaagacaga

SEQ ID NO: 780977 - RNA, 16 nt, Homo sapiens
uagggguuaagacuga

SEQ ID NO: 780978 - RNA, 19 nt, Homo sapiens
uagggucacuuugccauua

SEQ ID NO: 780979 - RNA, 16 nt, Homo sapiens
uaggguggcccuugca

SEQ ID NO: 780980 - RNA, 17 nt, Homo sapiens
uaggguguguguucacc

SEQ ID NO: 780981 - RNA, 22 nt, Homo sapiens
uaggguuacagagaccuaugua

SEQ ID NO: 780982 - RNA, 22 nt, Homo sapiens
uaggguuauuaguccaaaugug

SEQ ID NO: 780983 - RNA, 20 nt, Homo sapiens
uaggguuuuccaaugugacu

SEQ ID NO: 780984 - RNA, 17 nt, Homo sapiens
uagguaccaggugucag

SEQ ID NO: 780985 - RNA, 12 nt, Homo sapiens
uagguagcuuua

SEQ ID NO: 780986 - RNA, 23 nt, Homo sapiens
uagguauaucucccagugcuauc

SEQ ID NO: 780987 - RNA, 16 nt, Homo sapiens
uaggucauuggccacu

SEQ ID NO: 780988 - RNA, 16 nt, Homo sapiens
uaggucuccucagggu

SEQ ID NO: 780989 - RNA, 16 nt, Homo sapiens
uaggugugacuugaac

SEQ ID NO: 780990 - RNA, 15 nt, Homo sapiens
uagguguggcuguga

SEQ ID NO: 780991 - RNA, 18 nt, Homo sapiens
uagguuucagcaacaaga

SEQ ID NO: 780992 - RNA, 15 nt, Homo sapiens
uagguuucucucuuc

SEQ ID NO: 780993 - RNA, 23 nt, Homo sapiens
uagguuuuuccuacuguccucag

SEQ ID NO: 780994 - RNA, 15 nt, Homo sapiens
uaguaaaugcgugcu

SEQ ID NO: 780995 - RNA, 12 nt, Homo sapiens
uaguaacaacuc

SEQ ID NO: 780996 - RNA, 17 nt, Homo sapiens
uaguaauaagauggcug

SEQ ID NO: 780997 - RNA, 13 nt, Homo sapiens
uaguaauuacucu

SEQ ID NO: 780998 - RNA, 17 nt, Homo sapiens
uaguaccuucaauacuu

SEQ ID NO: 780999 - RNA, 11 nt, Homo sapiens
uaguacuaagc

SEQ ID NO: 781000 - RNA, 13 nt, Homo sapiens
uaguagaacugga

SEQ ID NO: 781001 - RNA, 17 nt, Homo sapiens
uaguauauuuauacucu

SEQ ID NO: 781002 - RNA, 12 nt, Homo sapiens
uaguaucuguau

SEQ ID NO: 781003 - RNA, 16 nt, Homo sapiens
uaguauuaugauugca

SEQ ID NO: 781004 - RNA, 21 nt, Homo sapiens
uaguauuccuaaccugucaga

SEQ ID NO: 781005 - RNA, 16 nt, Homo sapiens
uaguauuucucaggaa

SEQ ID NO: 781006 - RNA, 18 nt, Homo sapiens
uaguauuucucaggaaga

SEQ ID NO: 781007 - RNA, 20 nt, Homo sapiens
uagucaaggaggaaagggau

SEQ ID NO: 781008 - RNA, 19 nt, Homo sapiens
uagucaauaacuaaacuaa

SEQ ID NO: 781009 - RNA, 22 nt, Homo sapiens
uagucaauauuugguauuucaa

SEQ ID NO: 781010 - RNA, 17 nt, Homo sapiens
uagucaauccugucaua

SEQ ID NO: 781011 - RNA, 20 nt, Homo sapiens
uagucaauccugucauauaa

SEQ ID NO: 781012 - RNA, 23 nt, Homo sapiens
uagucaauccugucauauaauaa

SEQ ID NO: 781013 - RNA, 13 nt, Homo sapiens
uagucacaaagac

SEQ ID NO: 781014 - RNA, 12 nt, Homo sapiens
uaguccaaaaag

SEQ ID NO: 781015 - RNA, 17 nt, Homo sapiens
uagucccagcuacuccg

SEQ ID NO: 781016 - RNA, 18 nt, Homo sapiens
uaguccccaaggccucuc

SEQ ID NO: 781017 - RNA, 23 nt, Homo sapiens
uaguccccguacuagguuggaca

SEQ ID NO: 781018 - RNA, 18 nt, Homo sapiens
uaguccccuuuccucuaa

SEQ ID NO: 781019 - RNA, 22 nt, Homo sapiens
uagucccugcacagugacuucu

SEQ ID NO: 781020 - RNA, 19 nt, Homo sapiens
uaguccgcuuucucuugcu

SEQ ID NO: 781021 - RNA, 14 nt, Homo sapiens
uagucucaccagcc

SEQ ID NO: 781022 - RNA, 17 nt, Homo sapiens
uagucugccuucccagg

SEQ ID NO: 781023 - RNA, 19 nt, Homo sapiens
uagucugugggagugagag

SEQ ID NO: 781024 - RNA, 21 nt, Homo sapiens
uagucuugaaaugaaagggaa

SEQ ID NO: 781025 - RNA, 12 nt, Homo sapiens
cccuaaccaagu

SEQ ID NO: 781026 - RNA, 21 nt, Homo sapiens
cccuaaugccuaucugaccaa

SEQ ID NO: 781027 - RNA, 13 nt, Homo sapiens
cccuacaccaagu

SEQ ID NO: 781028 - RNA, 20 nt, Homo sapiens
cccuacucccucuucacugu

SEQ ID NO: 781029 - RNA, 13 nt, Homo sapiens
cccuacugcugug

SEQ ID NO: 781030 - RNA, 23 nt, Homo sapiens
cccuacuuugcuuccgccacuca

SEQ ID NO: 781031 - RNA, 16 nt, Homo sapiens
cccuagaugcacgugg

SEQ ID NO: 781032 - RNA, 13 nt, Homo sapiens
cccuagcagugaa

SEQ ID NO: 781033 - RNA, 13 nt, Homo sapiens
cccuagcugaccc

SEQ ID NO: 781034 - RNA, 22 nt, Homo sapiens
cccuaguuaguguuuugccuca

SEQ ID NO: 781035 - RNA, 16 nt, Homo sapiens
cccuauccacccagcc

SEQ ID NO: 781036 - RNA, 22 nt, Homo sapiens
cccuaugaaaaauguguuccau

SEQ ID NO: 781037 - RNA, 14 nt, Homo sapiens
cccuaugcugguag

SEQ ID NO: 781038 - RNA, 12 nt, Homo sapiens
cccuaugucuca

SEQ ID NO: 781039 - RNA, 14 nt, Homo sapiens
cccuauucuaucca

SEQ ID NO: 781040 - RNA, 19 nt, Homo sapiens
cccuauuucuaugucauuu

SEQ ID NO: 781041 - RNA, 19 nt, Homo sapiens
cccucaaaaaaagccuuua

SEQ ID NO: 781042 - RNA, 21 nt, Homo sapiens
cccucaaucccagcuacucaa

SEQ ID NO: 781043 - RNA, 13 nt, Homo sapiens
cccucacucuuga

SEQ ID NO: 781044 - RNA, 11 nt, Homo sapiens
cccucagcacu

SEQ ID NO: 781045 - RNA, 10 nt, Homo sapiens
cccucaggcc

SEQ ID NO: 781046 - RNA, 11 nt, Homo sapiens
cccucaugcaa

SEQ ID NO: 781047 - RNA, 18 nt, Homo sapiens
cccuccaaaccuccagcc

SEQ ID NO: 781048 - RNA, 10 nt, Homo sapiens
cccuccaaag

SEQ ID NO: 781049 - RNA, 11 nt, Homo sapiens
cccuccaaaga

SEQ ID NO: 781050 - RNA, 16 nt, Homo sapiens
cccuccagacaaugcc

SEQ ID NO: 781051 - RNA, 14 nt, Homo sapiens
cccucccagcccau

SEQ ID NO: 781052 - RNA, 13 nt, Homo sapiens
cccucccauggca

SEQ ID NO: 781053 - RNA, 13 nt, Homo sapiens
cccuccccauuca

SEQ ID NO: 781054 - RNA, 15 nt, Homo sapiens
cccucccugaggcag

SEQ ID NO: 781055 - RNA, 21 nt, Homo sapiens
cccuccgguuaucaagcaaaa

SEQ ID NO: 781056 - RNA, 13 nt, Homo sapiens
cccuccucaguga

SEQ ID NO: 781057 - RNA, 13 nt, Homo sapiens
cccuccuccagua

SEQ ID NO: 781058 - RNA, 19 nt, Homo sapiens
cccucggcucuggaggcaa

SEQ ID NO: 781059 - RNA, 19 nt, Homo sapiens
cccucgggccccauccuca

SEQ ID NO: 781060 - RNA, 20 nt, Homo sapiens
cccucuaagcacauuccaaa

SEQ ID NO: 781061 - RNA, 12 nt, Homo sapiens
cccucucacuuu

SEQ ID NO: 781062 - RNA, 18 nt, Homo sapiens
cccucuccaacugccuaa

SEQ ID NO: 781063 - RNA, 14 nt, Homo sapiens
cccucucucugggc

SEQ ID NO: 781064 - RNA, 10 nt, Homo sapiens
cccucuguag

SEQ ID NO: 781065 - RNA, 19 nt, Homo sapiens
cccucugucauccucagga

SEQ ID NO: 781066 - RNA, 22 nt, Homo sapiens
cccucuguggcucacauuucau

SEQ ID NO: 781067 - RNA, 14 nt, Homo sapiens
cccucuuugcugca

SEQ ID NO: 781068 - RNA, 18 nt, Homo sapiens
cccugacaucaucauucu

SEQ ID NO: 781069 - RNA, 22 nt, Homo sapiens
cccugaccuucugggacauggu

SEQ ID NO: 781070 - RNA, 15 nt, Homo sapiens
cccugacucaucauu

SEQ ID NO: 781071 - RNA, 22 nt, Homo sapiens
cccugacucucugugaccugcc

SEQ ID NO: 781072 - RNA, 19 nt, Homo sapiens
cccugagcagaauacuggu

SEQ ID NO: 781073 - RNA, 16 nt, Homo sapiens
cccugaugcagccugu

SEQ ID NO: 781074 - RNA, 17 nt, Homo sapiens
cccugcaaaaugagacc

SEQ ID NO: 781075 - RNA, 13 nt, Homo sapiens
cccugcaaccaac

SEQ ID NO: 781076 - RNA, 14 nt, Homo sapiens
cccugcaccaugcu

SEQ ID NO: 781077 - RNA, 23 nt, Homo sapiens
cccugcagaugccacccuagcca

SEQ ID NO: 781078 - RNA, 12 nt, Homo sapiens
cccugcaugcug

SEQ ID NO: 781079 - RNA, 17 nt, Homo sapiens
cccugcccucucccaaa

SEQ ID NO: 781080 - RNA, 21 nt, Homo sapiens
cccugccugccccgacaccca

SEQ ID NO: 781081 - RNA, 23 nt, Homo sapiens
cccugccuguuaaggaaacuuua

SEQ ID NO: 781082 - RNA, 16 nt, Homo sapiens
cccugcgccuccagag

SEQ ID NO: 781083 - RNA, 15 nt, Homo sapiens
ccuaaaagcacuccu

SEQ ID NO: 781084 - RNA, 21 nt, Homo sapiens
ccuaaaagccaccccacuucu

SEQ ID NO: 781085 - RNA, 13 nt, Homo sapiens
ccuaaaaucacag

SEQ ID NO: 781086 - RNA, 16 nt, Homo sapiens
ccuaaaauuguaugaa

SEQ ID NO: 781087 - RNA, 12 nt, Homo sapiens
ccuaaacccaau

SEQ ID NO: 781088 - RNA, 18 nt, Homo sapiens
ccuaaacccagugcugcu

SEQ ID NO: 781089 - RNA, 18 nt, Homo sapiens
ccuaaauaaaugagcugu

SEQ ID NO: 781090 - RNA, 12 nt, Homo sapiens
ccuaaaugaugg

SEQ ID NO: 781091 - RNA, 23 nt, Homo sapiens
ccuaaauguaaucacgaguaaga

SEQ ID NO: 781092 - RNA, 19 nt, Homo sapiens
ccuaaauuuuuacaucaaa

SEQ ID NO: 781093 - RNA, 13 nt, Homo sapiens
ccuaacaaaagaa

SEQ ID NO: 781094 - RNA, 21 nt, Homo sapiens
ccuaacauucgaucucauuca

SEQ ID NO: 781095 - RNA, 21 nt, Homo sapiens
ccuaacuguucccuuaucugu

SEQ ID NO: 781096 - RNA, 12 nt, Homo sapiens
ccuaacuuguaa

SEQ ID NO: 781097 - RNA, 14 nt, Homo sapiens
ccuaagaaaaggca

SEQ ID NO: 781098 - RNA, 17 nt, Homo sapiens
ccuaagacuuauguauu

SEQ ID NO: 781099 - RNA, 22 nt, Homo sapiens
ccuaagagacugcguucugcaa

SEQ ID NO: 781100 - RNA, 13 nt, Homo sapiens
ccuaagaguggag

SEQ ID NO: 781101 - RNA, 21 nt, Homo sapiens
ccuaagaucucgguuugccaa

SEQ ID NO: 781102 - RNA, 14 nt, Homo sapiens
ccuaagaugaagcu

SEQ ID NO: 781103 - RNA, 22 nt, Homo sapiens
ccuaagcccuccgccauucuca

SEQ ID NO: 781104 - RNA, 22 nt, Homo sapiens
ccuaagcgggggugaaagagga

SEQ ID NO: 781105 - RNA, 16 nt, Homo sapiens
ccuaaggaaccuuccu

SEQ ID NO: 781106 - RNA, 18 nt, Homo sapiens
ccuaaggacacacuaauc

SEQ ID NO: 781107 - RNA, 19 nt, Homo sapiens
ccuaaggcacccacaaaua

SEQ ID NO: 781108 - RNA, 14 nt, Homo sapiens
ccuaaggugucuga

SEQ ID NO: 781109 - RNA, 16 nt, Homo sapiens
ccuaaguccuuuaugu

SEQ ID NO: 781110 - RNA, 18 nt, Homo sapiens
ccuaaguuuacuucucua

SEQ ID NO: 781111 - RNA, 16 nt, Homo sapiens
ccuaauaggcugggag

SEQ ID NO: 781112 - RNA, 19 nt, Homo sapiens
ccuaauccaggcagaucca

SEQ ID NO: 781113 - RNA, 20 nt, Homo sapiens
ccuaauccaggcagauccag

SEQ ID NO: 781114 - RNA, 16 nt, Homo sapiens
ccuaaucucauaccuc

SEQ ID NO: 781115 - RNA, 20 nt, Homo sapiens
ccuaaugcucaccuuuauca

SEQ ID NO: 781116 - RNA, 23 nt, Homo sapiens
ccuaauucucuucgcugugaugc

SEQ ID NO: 781117 - RNA, 22 nt, Homo sapiens
ccuaauucuuguagaugcauua

SEQ ID NO: 781118 - RNA, 12 nt, Homo sapiens
ccuacagccagc

SEQ ID NO: 781119 - RNA, 19 nt, Homo sapiens
ccuacagcuacauugagau

SEQ ID NO: 781120 - RNA, 20 nt, Homo sapiens
ccuacagcuacauugagaua

SEQ ID NO: 781121 - RNA, 21 nt, Homo sapiens
ccuacagggacacuaucacuc

SEQ ID NO: 781122 - RNA, 22 nt, Homo sapiens
ccuacagugcuguguacccugg

SEQ ID NO: 781123 - RNA, 14 nt, Homo sapiens
ccuacauuaucuca

SEQ ID NO: 781124 - RNA, 15 nt, Homo sapiens
ccuacauuaucucac

SEQ ID NO: 781125 - RNA, 15 nt, Homo sapiens
ccuaccaaaauggaa

SEQ ID NO: 781126 - RNA, 13 nt, Homo sapiens
ccuacccccugaa

SEQ ID NO: 781127 - RNA, 15 nt, Homo sapiens
ccuacccuuggcagu

SEQ ID NO: 781128 - RNA, 15 nt, Homo sapiens
ccuaccucuggugau

SEQ ID NO: 781129 - RNA, 14 nt, Homo sapiens
ccuacggagucagc

SEQ ID NO: 781130 - RNA, 16 nt, Homo sapiens
ccuacucuucaggguc

SEQ ID NO: 781131 - RNA, 15 nt, Homo sapiens
ccuacugaaugcucu

SEQ ID NO: 781132 - RNA, 13 nt, Homo sapiens
ccuacuguccuca

SEQ ID NO: 781133 - RNA, 13 nt, Homo sapiens
ccuacuuuagcca

SEQ ID NO: 781134 - RNA, 22 nt, Homo sapiens
ccuagaaagcugcugugauccc

SEQ ID NO: 781135 - RNA, 17 nt, Homo sapiens
ccuagaacacuaacuca

SEQ ID NO: 781136 - RNA, 16 nt, Homo sapiens
ccuagaacugugccua

SEQ ID NO: 781137 - RNA, 14 nt, Homo sapiens
ccuagagacaguga

SEQ ID NO: 781138 - RNA, 22 nt, Homo sapiens
ccuagauuagguagacuuugcu

SEQ ID NO: 781139 - RNA, 17 nt, Homo sapiens
ccuagcagccucaaaac

SEQ ID NO: 781140 - RNA, 18 nt, Homo sapiens
ccuagccaaugucuccuc

SEQ ID NO: 781141 - RNA, 19 nt, Homo sapiens
ccuagccagcacuuguaua

SEQ ID NO: 781142 - RNA, 15 nt, Homo sapiens
ccuagcccugggaca

SEQ ID NO: 781143 - RNA, 19 nt, Homo sapiens
cccaugacuugaugcaguu

SEQ ID NO: 781144 - RNA, 12 nt, Homo sapiens
cccaugagauuc

SEQ ID NO: 781145 - RNA, 22 nt, Homo sapiens
cccauggcccccaauaaaggca

SEQ ID NO: 781146 - RNA, 21 nt, Homo sapiens
cccauggcuuuagcuaccuca

SEQ ID NO: 781147 - RNA, 20 nt, Homo sapiens
cccauggguuaagagcucac

SEQ ID NO: 781148 - RNA, 20 nt, Homo sapiens
cccauguugaucuuucucaa

SEQ ID NO: 781149 - RNA, 18 nt, Homo sapiens
cccauuccucccuccggc

SEQ ID NO: 781150 - RNA, 19 nt, Homo sapiens
cccauucuuguucagauua

SEQ ID NO: 781151 - RNA, 19 nt, Homo sapiens
cccauugcugccaaggugg

SEQ ID NO: 781152 - RNA, 15 nt, Homo sapiens
cccauuucacccaug

SEQ ID NO: 781153 - RNA, 20 nt, Homo sapiens
cccauuugugccagaggaau

SEQ ID NO: 781154 - RNA, 22 nt, Homo sapiens
ccccaaaccuggcaagucaccu

SEQ ID NO: 781155 - RNA, 20 nt, Homo sapiens
ccccaacaaaccauccagug

SEQ ID NO: 781156 - RNA, 22 nt, Homo sapiens
ccccaacaaugugagggguccc

SEQ ID NO: 781157 - RNA, 21 nt, Homo sapiens
ccccaagaagaugaaagauuc

SEQ ID NO: 781158 - RNA, 23 nt, Homo sapiens
ccccacagaaccuucaacccagu

SEQ ID NO: 781159 - RNA, 18 nt, Homo sapiens
ccccacagacaacaguug

SEQ ID NO: 781160 - RNA, 23 nt, Homo sapiens
ccccacaggagcccugcagugug

SEQ ID NO: 781161 - RNA, 23 nt, Homo sapiens
ccccacccaacagccaccaagcc

SEQ ID NO: 781162 - RNA, 20 nt, Homo sapiens
ccccacccuggccuagacca

SEQ ID NO: 781163 - RNA, 22 nt, Homo sapiens
ccccaccugccauuugcacccu

SEQ ID NO: 781164 - RNA, 18 nt, Homo sapiens
ccccaccugccuggugca

SEQ ID NO: 781165 - RNA, 14 nt, Homo sapiens
ccccacgcugacca

SEQ ID NO: 781166 - RNA, 13 nt, Homo sapiens
ccccacuccagcc

SEQ ID NO: 781167 - RNA, 11 nt, Homo sapiens
ccccacuuuga

SEQ ID NO: 781168 - RNA, 19 nt, Homo sapiens
ccccagaaauucuggccca

SEQ ID NO: 781169 - RNA, 17 nt, Homo sapiens
ccccagagcaggagcuu

SEQ ID NO: 781170 - RNA, 20 nt, Homo sapiens
ccccagauuuaaaaaaagaa

SEQ ID NO: 781171 - RNA, 17 nt, Homo sapiens
ccccagcaagagcacaa

SEQ ID NO: 781172 - RNA, 19 nt, Homo sapiens
ccccagcccagagacauac

SEQ ID NO: 781173 - RNA, 16 nt, Homo sapiens
ccccagccucuucuag

SEQ ID NO: 781174 - RNA, 12 nt, Homo sapiens
ccccagcucaau

SEQ ID NO: 781175 - RNA, 15 nt, Homo sapiens
ccccagcuuggcuca

SEQ ID NO: 781176 - RNA, 17 nt, Homo sapiens
ccccaggggucccagcc

SEQ ID NO: 781177 - RNA, 21 nt, Homo sapiens
ccccaguaucucuucagucuc

SEQ ID NO: 781178 - RNA, 16 nt, Homo sapiens
ccccaguggauucuca

SEQ ID NO: 781179 - RNA, 20 nt, Homo sapiens
ccccaucauaagggcacuga

SEQ ID NO: 781180 - RNA, 17 nt, Homo sapiens
ccccauccaacacugga

SEQ ID NO: 781181 - RNA, 15 nt, Homo sapiens
ccccauccagccaga

SEQ ID NO: 781182 - RNA, 22 nt, Homo sapiens
ccccauccagccuccagggcau

SEQ ID NO: 781183 - RNA, 14 nt, Homo sapiens
ccccauccuguguu

SEQ ID NO: 781184 - RNA, 15 nt, Homo sapiens
ccccaucuuccaacc

SEQ ID NO: 781185 - RNA, 15 nt, Homo sapiens
ccccaucuuuacaaa

SEQ ID NO: 781186 - RNA, 15 nt, Homo sapiens
ccccaugccugucca

SEQ ID NO: 781187 - RNA, 23 nt, Homo sapiens
ccccauggguuuugcuuaggcac

SEQ ID NO: 781188 - RNA, 20 nt, Homo sapiens
ccccauuuccccgauguccc

SEQ ID NO: 781189 - RNA, 17 nt, Homo sapiens
cccccaaauugccuuca

SEQ ID NO: 781190 - RNA, 14 nt, Homo sapiens
cccccagagcucuu

SEQ ID NO: 781191 - RNA, 12 nt, Homo sapiens
cccccagcacuu

SEQ ID NO: 781192 - RNA, 22 nt, Homo sapiens
cccccaguccuguccuaucacu

SEQ ID NO: 781193 - RNA, 13 nt, Homo sapiens
cccccaguguaau

SEQ ID NO: 781194 - RNA, 14 nt, Homo sapiens
cccccaguguaaua

SEQ ID NO: 781195 - RNA, 16 nt, Homo sapiens
cccccaucccucggga

SEQ ID NO: 781196 - RNA, 18 nt, Homo sapiens
cccccaugugccugucac

SEQ ID NO: 781197 - RNA, 13 nt, Homo sapiens
ccccccacugagc

SEQ ID NO: 781198 - RNA, 15 nt, Homo sapiens
ccccccagugugcaa

SEQ ID NO: 781199 - RNA, 18 nt, Homo sapiens
cccccgcggguucuagac

SEQ ID NO: 781200 - RNA, 22 nt, Homo sapiens
ucaaagugagaaaaugccucaa

SEQ ID NO: 781201 - RNA, 12 nt, Homo sapiens
ucaaagugcugg

SEQ ID NO: 781202 - RNA, 17 nt, Homo sapiens
ucaaagugguacaggaa

SEQ ID NO: 781203 - RNA, 14 nt, Homo sapiens
ucaaauaacuaaaa

SEQ ID NO: 781204 - RNA, 21 nt, Homo sapiens
ucaaauaugcaaagcacugac

SEQ ID NO: 781205 - RNA, 14 nt, Homo sapiens
ucaaauauuucaac

SEQ ID NO: 781206 - RNA, 21 nt, Homo sapiens
ucaaaucacauggcuuuccac

SEQ ID NO: 781207 - RNA, 15 nt, Homo sapiens
ucaaaucguccagcg

SEQ ID NO: 781208 - RNA, 17 nt, Homo sapiens
ucaaaucuauucagaca

SEQ ID NO: 781209 - RNA, 15 nt, Homo sapiens
ucaaaucucuuccac

SEQ ID NO: 781210 - RNA, 22 nt, Homo sapiens
ucaaaucuguaaucagcaauaa

SEQ ID NO: 781211 - RNA, 14 nt, Homo sapiens
ucaaaugaguuuaa

SEQ ID NO: 781212 - RNA, 16 nt, Homo sapiens
ucaaauguuguucucu

SEQ ID NO: 781213 - RNA, 22 nt, Homo sapiens
ucaaauuguccuauugugacuc

SEQ ID NO: 781214 - RNA, 21 nt, Homo sapiens
ucaacaaaauggucauccaaa

SEQ ID NO: 781215 - RNA, 16 nt, Homo sapiens
ucaacaaugguugaau

SEQ ID NO: 781216 - RNA, 15 nt, Homo sapiens
ucaacaauuuaucca

SEQ ID NO: 781217 - RNA, 14 nt, Homo sapiens
ucaacacauuggaa

SEQ ID NO: 781218 - RNA, 12 nt, Homo sapiens
ucaacagaauug

SEQ ID NO: 781219 - RNA, 16 nt, Homo sapiens
ucaacaguucaaagaa

SEQ ID NO: 781220 - RNA, 14 nt, Homo sapiens
ucaacauaccuugg

SEQ ID NO: 781221 - RNA, 19 nt, Homo sapiens
ucaacaucuuuuacauucu

SEQ ID NO: 781222 - RNA, 22 nt, Homo sapiens
ucaacauggaaaugauuuucau

SEQ ID NO: 781223 - RNA, 13 nt, Homo sapiens
ucaaccacugugg

SEQ ID NO: 781224 - RNA, 15 nt, Homo sapiens
ucaacucacaccugc

SEQ ID NO: 781225 - RNA, 20 nt, Homo sapiens
ucaacucacagcuucuccaa

SEQ ID NO: 781226 - RNA, 16 nt, Homo sapiens
ucaacuccgugcuuaa

SEQ ID NO: 781227 - RNA, 24 nt, Homo sapiens
ucaacuccgugcuuaaccaaagaa

SEQ ID NO: 781228 - RNA, 19 nt, Homo sapiens
ucaacucguuuuuauauua

SEQ ID NO: 781229 - RNA, 23 nt, Homo sapiens
ucaacucuccaauguucuauuaa

SEQ ID NO: 781230 - RNA, 17 nt, Homo sapiens
ucaacugaaaagacuca

SEQ ID NO: 781231 - RNA, 22 nt, Homo sapiens
ucaacugaaaagacucaguguu

SEQ ID NO: 781232 - RNA, 17 nt, Homo sapiens
ucaacugaaugagguca

SEQ ID NO: 781233 - RNA, 23 nt, Homo sapiens
ucaacuggagacacuauuuaucu

SEQ ID NO: 781234 - RNA, 16 nt, Homo sapiens
ucaacuuaagguauau

SEQ ID NO: 781235 - RNA, 20 nt, Homo sapiens
ucaacuuagucaauaagaaa

SEQ ID NO: 781236 - RNA, 19 nt, Homo sapiens
ucaacuucagagacuaucu

SEQ ID NO: 781237 - RNA, 14 nt, Homo sapiens
ucaacuuccaaagg

SEQ ID NO: 781238 - RNA, 22 nt, Homo sapiens
ucaacuuuagcuaguaucuuca

SEQ ID NO: 781239 - RNA, 20 nt, Homo sapiens
ucaacuuuggugaacaguuu

SEQ ID NO: 781240 - RNA, 17 nt, Homo sapiens
ucaagaaaaaaagggag

SEQ ID NO: 781241 - RNA, 17 nt, Homo sapiens
ucaagaaaagaauuaca

SEQ ID NO: 781242 - RNA, 14 nt, Homo sapiens
ucaagaaaauggau

SEQ ID NO: 781243 - RNA, 13 nt, Homo sapiens
ucaagaaagcccu

SEQ ID NO: 781244 - RNA, 19 nt, Homo sapiens
ucaagaacaauucacagua

SEQ ID NO: 781245 - RNA, 14 nt, Homo sapiens
ucaagaacauucua

SEQ ID NO: 781246 - RNA, 19 nt, Homo sapiens
ucaagaagaggaaagggag

SEQ ID NO: 781247 - RNA, 15 nt, Homo sapiens
ucaagaauaaucacg

SEQ ID NO: 781248 - RNA, 19 nt, Homo sapiens
ucaagaauauaauauguga

SEQ ID NO: 781249 - RNA, 14 nt, Homo sapiens
ucaagaaucacuug

SEQ ID NO: 781250 - RNA, 18 nt, Homo sapiens
ucaagaaugcaauaucau

SEQ ID NO: 781251 - RNA, 17 nt, Homo sapiens
ucaagacauuugcugaa

SEQ ID NO: 781252 - RNA, 20 nt, Homo sapiens
ucaagaccagccugggcaac

SEQ ID NO: 781253 - RNA, 15 nt, Homo sapiens
ucaagaccauaguga

SEQ ID NO: 781254 - RNA, 16 nt, Homo sapiens
ucaagagcuccuugac

SEQ ID NO: 781255 - RNA, 20 nt, Homo sapiens
ucaagaguccggauuucuaa

SEQ ID NO: 781256 - RNA, 14 nt, Homo sapiens
ucaagagugagcua

SEQ ID NO: 781257 - RNA, 13 nt, Homo sapiens
ucaagaguucagu

SEQ ID NO: 781258 - RNA, 21 nt, Homo sapiens
ucaagauuuucauacuuuuac

SEQ ID NO: 781259 - RNA, 14 nt, Homo sapiens
ucaagcacacugga

SEQ ID NO: 781260 - RNA, 15 nt, Homo sapiens
ucaagcacacuggaa

SEQ ID NO: 781261 - RNA, 17 nt, Homo sapiens
ucaagcacuuacagcuc

SEQ ID NO: 781262 - RNA, 21 nt, Homo sapiens
ucaagcccugcagucacagcu

SEQ ID NO: 781263 - RNA, 21 nt, Homo sapiens
ucaagccuagcaucucgggga

SEQ ID NO: 781264 - RNA, 15 nt, Homo sapiens
ucaagcuagccagag

SEQ ID NO: 781265 - RNA, 17 nt, Homo sapiens
ucaagcuauucucaugc

SEQ ID NO: 781266 - RNA, 21 nt, Homo sapiens
ucaagcuggaagaagugagca

SEQ ID NO: 781267 - RNA, 14 nt, Homo sapiens
ucaaggaauuugca

SEQ ID NO: 781268 - RNA, 19 nt, Homo sapiens
ucaaggcaguagaacucca

SEQ ID NO: 781269 - RNA, 21 nt, Homo sapiens
ucaagggaacuugagcgugaa

SEQ ID NO: 781270 - RNA, 21 nt, Homo sapiens
ucaaggucagcaugaggacag

SEQ ID NO: 781271 - RNA, 23 nt, Homo sapiens
ucaaggugggccuugcuaccuca

SEQ ID NO: 781272 - RNA, 17 nt, Homo sapiens
ucaagguggucaguaaa

SEQ ID NO: 781273 - RNA, 19 nt, Homo sapiens
ucaagguuuuagguucuaa

SEQ ID NO: 781274 - RNA, 21 nt, Homo sapiens
ucaaguaauccaccugccucg

SEQ ID NO: 781275 - RNA, 13 nt, Homo sapiens
ucaaguacucaaa

SEQ ID NO: 781276 - RNA, 19 nt, Homo sapiens
ucaaguagacuacuguuca

SEQ ID NO: 781277 - RNA, 15 nt, Homo sapiens
ucaaguagaggcaau

SEQ ID NO: 781278 - RNA, 20 nt, Homo sapiens
ucaaguauaacaacuuugaa

SEQ ID NO: 781279 - RNA, 13 nt, Homo sapiens
ucaagucucucac

SEQ ID NO: 781280 - RNA, 19 nt, Homo sapiens
ucaagugauucuccugccu

SEQ ID NO: 781281 - RNA, 13 nt, Homo sapiens
ucaagugccaaac

SEQ ID NO: 781282 - RNA, 23 nt, Homo sapiens
ucaagugccucuuguugcagaga

SEQ ID NO: 781283 - RNA, 18 nt, Homo sapiens
ucaaguggagagaaauca

SEQ ID NO: 781284 - RNA, 17 nt, Homo sapiens
ucaaguuaacaaggaau

SEQ ID NO: 781285 - RNA, 13 nt, Homo sapiens
ucaaguucauuga

SEQ ID NO: 781286 - RNA, 17 nt, Homo sapiens
ucaauaaaaaucugcuc

SEQ ID NO: 781287 - RNA, 21 nt, Homo sapiens
ucaauaaaaguaaagacugua

SEQ ID NO: 781288 - RNA, 22 nt, Homo sapiens
ucaauaaacaacagcugaagca

SEQ ID NO: 781289 - RNA, 18 nt, Homo sapiens
ucaauaaagcacugagca

SEQ ID NO: 781290 - RNA, 15 nt, Homo sapiens
ucaauacaaccagcc

SEQ ID NO: 781291 - RNA, 19 nt, Homo sapiens
ucaauacaaccagcccaac

SEQ ID NO: 781292 - RNA, 22 nt, Homo sapiens
ucaauacgugaucucuguuaca

SEQ ID NO: 781293 - RNA, 21 nt, Homo sapiens
ucaauacuuaaaaauagucuu

SEQ ID NO: 781294 - RNA, 15 nt, Homo sapiens
cccagccucaucucu

SEQ ID NO: 781295 - RNA, 13 nt, Homo sapiens
cccagccucuggc

SEQ ID NO: 781296 - RNA, 22 nt, Homo sapiens
cccagccuucagucacaugcua

SEQ ID NO: 781297 - RNA, 18 nt, Homo sapiens
cccagcgacgaacuuucc

SEQ ID NO: 781298 - RNA, 17 nt, Homo sapiens
cccagcgguucacacag

SEQ ID NO: 781299 - RNA, 21 nt, Homo sapiens
cccagcuaauugagaccacag

SEQ ID NO: 781300 - RNA, 13 nt, Homo sapiens
cccagcuacucag

SEQ ID NO: 781301 - RNA, 16 nt, Homo sapiens
cccagcucuggaugaa

SEQ ID NO: 781302 - RNA, 19 nt, Homo sapiens
cccagcucuucucuuccua

SEQ ID NO: 781303 - RNA, 18 nt, Homo sapiens
cccagcugcucagugcaa

SEQ ID NO: 781304 - RNA, 22 nt, Homo sapiens
cccagcuguugggaacagcaug

SEQ ID NO: 781305 - RNA, 18 nt, Homo sapiens
cccagcuugguuccagga

SEQ ID NO: 781306 - RNA, 16 nt, Homo sapiens
cccaggaacugggcca

SEQ ID NO: 781307 - RNA, 20 nt, Homo sapiens
cccaggaaggccacagugcu

SEQ ID NO: 781308 - RNA, 13 nt, Homo sapiens
cccaggaccagcu

SEQ ID NO: 781309 - RNA, 17 nt, Homo sapiens
cccaggauacuggcaca

SEQ ID NO: 781310 - RNA, 14 nt, Homo sapiens
cccaggcacugggc

SEQ ID NO: 781311 - RNA, 19 nt, Homo sapiens
cccaggccaacaguagcca

SEQ ID NO: 781312 - RNA, 13 nt, Homo sapiens
cccaggccaggga

SEQ ID NO: 781313 - RNA, 18 nt, Homo sapiens
cccaggcccaccaucacc

SEQ ID NO: 781314 - RNA, 21 nt, Homo sapiens
cccaggcccugcucuuccuca

SEQ ID NO: 781315 - RNA, 17 nt, Homo sapiens
cccaggccuccagccuc

SEQ ID NO: 781316 - RNA, 19 nt, Homo sapiens
cccaggcuggaaugcagug

SEQ ID NO: 781317 - RNA, 20 nt, Homo sapiens
cccaggcuggaaugcagugg

SEQ ID NO: 781318 - RNA, 20 nt, Homo sapiens
cccaggcuggagugcaauga

SEQ ID NO: 781319 - RNA, 20 nt, Homo sapiens
cccaggcuggagugcaaugc

SEQ ID NO: 781320 - RNA, 19 nt, Homo sapiens
cccaggcuggagugcagua

SEQ ID NO: 781321 - RNA, 20 nt, Homo sapiens
cccaggcuggagugcaguga

SEQ ID NO: 781322 - RNA, 15 nt, Homo sapiens
cccagggacaaaaca

SEQ ID NO: 781323 - RNA, 14 nt, Homo sapiens
cccagggcucugca

SEQ ID NO: 781324 - RNA, 18 nt, Homo sapiens
cccaggggacaagggauu

SEQ ID NO: 781325 - RNA, 15 nt, Homo sapiens
cccaggguccacuga

SEQ ID NO: 781326 - RNA, 19 nt, Homo sapiens
cccaggucucuccacugcu

SEQ ID NO: 781327 - RNA, 17 nt, Homo sapiens
cccaguaccuccaagca

SEQ ID NO: 781328 - RNA, 20 nt, Homo sapiens
cccaguaucucuucagucuc

SEQ ID NO: 781329 - RNA, 11 nt, Homo sapiens
cccaguauuuu

SEQ ID NO: 781330 - RNA, 19 nt, Homo sapiens
cccaguauuuuuauacgga

SEQ ID NO: 781331 - RNA, 19 nt, Homo sapiens
cccagugacaacaucgcaa

SEQ ID NO: 781332 - RNA, 10 nt, Homo sapiens
cccagugcac

SEQ ID NO: 781333 - RNA, 19 nt, Homo sapiens
cccagugggcauagucagu

SEQ ID NO: 781334 - RNA, 13 nt, Homo sapiens
cccaguguaauaa

SEQ ID NO: 781335 - RNA, 14 nt, Homo sapiens
cccaguguccuucc

SEQ ID NO: 781336 - RNA, 13 nt, Homo sapiens
cccaguguucucc

SEQ ID NO: 781337 - RNA, 22 nt, Homo sapiens
cccaguuaauacuccagagaca

SEQ ID NO: 781338 - RNA, 12 nt, Homo sapiens
cccauaaggcca

SEQ ID NO: 781339 - RNA, 21 nt, Homo sapiens
cccauacaauguauguacaau

SEQ ID NO: 781340 - RNA, 23 nt, Homo sapiens
cccauacaauguauguacaauac

SEQ ID NO: 781341 - RNA, 12 nt, Homo sapiens
cccauacugguu

SEQ ID NO: 781342 - RNA, 18 nt, Homo sapiens
cccauagcacugggcucu

SEQ ID NO: 781343 - RNA, 20 nt, Homo sapiens
cccauagcacugggcucuga

SEQ ID NO: 781344 - RNA, 17 nt, Homo sapiens
cccauaucuacaguacu

SEQ ID NO: 781345 - RNA, 14 nt, Homo sapiens
cccauaucugugaa

SEQ ID NO: 781346 - RNA, 15 nt, Homo sapiens
cccauaucugugaaa

SEQ ID NO: 781347 - RNA, 15 nt, Homo sapiens
cccauccagccagac

SEQ ID NO: 781348 - RNA, 19 nt, Homo sapiens
cccaucgugaagaagccug

SEQ ID NO: 781349 - RNA, 22 nt, Homo sapiens
cccaucuuacuggaagagaguu

SEQ ID NO: 781350 - RNA, 16 nt, Homo sapiens
cccaucuuuacaaaga

SEQ ID NO: 781351 - RNA, 21 nt, Homo sapiens
uaaucuagguguggcugugaa

SEQ ID NO: 781352 - RNA, 14 nt, Homo sapiens
uaaucucagcacuu

SEQ ID NO: 781353 - RNA, 20 nt, Homo sapiens
uaaucuccacuuuuuucaua

SEQ ID NO: 781354 - RNA, 16 nt, Homo sapiens
uaaucucucugcagcu

SEQ ID NO: 781355 - RNA, 19 nt, Homo sapiens
uaaucuuccauacuucuuc

SEQ ID NO: 781356 - RNA, 21 nt, Homo sapiens
uaaucuucugccuucucauga

SEQ ID NO: 781357 - RNA, 17 nt, Homo sapiens
uaaucuugcuucauugu

SEQ ID NO: 781358 - RNA, 15 nt, Homo sapiens
uaaucuuuaaacugg

SEQ ID NO: 781359 - RNA, 15 nt, Homo sapiens
uaaugaaaacauuaa

SEQ ID NO: 781360 - RNA, 22 nt, Homo sapiens
uaaugaaauaauguacaucugg

SEQ ID NO: 781361 - RNA, 14 nt, Homo sapiens
uaaugaacuaccau

SEQ ID NO: 781362 - RNA, 20 nt, Homo sapiens
uaaugaacuaccaucugaug

SEQ ID NO: 781363 - RNA, 19 nt, Homo sapiens
uaaugaaguuaagaaccug

SEQ ID NO: 781364 - RNA, 16 nt, Homo sapiens
uaaugacaaaugcccu

SEQ ID NO: 781365 - RNA, 13 nt, Homo sapiens
uaaugacauuccc

SEQ ID NO: 781366 - RNA, 19 nt, Homo sapiens
uaaugacuuuauguauuau

SEQ ID NO: 781367 - RNA, 16 nt, Homo sapiens
uaaugagaauuccuua

SEQ ID NO: 781368 - RNA, 15 nt, Homo sapiens
uaaugagacaugaau

SEQ ID NO: 781369 - RNA, 16 nt, Homo sapiens
uaaugagccaucacua

SEQ ID NO: 781370 - RNA, 18 nt, Homo sapiens
uaaugaggaaauguguug

SEQ ID NO: 781371 - RNA, 13 nt, Homo sapiens
uaaugaucagaug

SEQ ID NO: 781372 - RNA, 14 nt, Homo sapiens
uaaugaugaucuuc

SEQ ID NO: 781373 - RNA, 16 nt, Homo sapiens
uaaugcagaaguauuc

SEQ ID NO: 781374 - RNA, 19 nt, Homo sapiens
uaaugcagacucuucuuaa

SEQ ID NO: 781375 - RNA, 20 nt, Homo sapiens
uaaugcuacugucucacuga

SEQ ID NO: 781376 - RNA, 14 nt, Homo sapiens
uaaugcuucauuca

SEQ ID NO: 781377 - RNA, 16 nt, Homo sapiens
uaaugcuuuguuaaau

SEQ ID NO: 781378 - RNA, 21 nt, Homo sapiens
uaauggaaacauuuacaauaa

SEQ ID NO: 781379 - RNA, 14 nt, Homo sapiens
uaauggaaugaagg

SEQ ID NO: 781380 - RNA, 16 nt, Homo sapiens
uaaugguugacugggu

SEQ ID NO: 781381 - RNA, 14 nt, Homo sapiens
uaauguaagcucua

SEQ ID NO: 781382 - RNA, 20 nt, Homo sapiens
uaauguacacauugcauuuu

SEQ ID NO: 781383 - RNA, 15 nt, Homo sapiens
uaaugucaccaccuu

SEQ ID NO: 781384 - RNA, 16 nt, Homo sapiens
uaaugucauuuaauaa

SEQ ID NO: 781385 - RNA, 19 nt, Homo sapiens
uaaugugaggaacucacau

SEQ ID NO: 781386 - RNA, 23 nt, Homo sapiens
uaauguggccuuggcauuucuuc

SEQ ID NO: 781387 - RNA, 19 nt, Homo sapiens
uaaugugugugccaauggu

SEQ ID NO: 781388 - RNA, 13 nt, Homo sapiens
uaauguuacauua

SEQ ID NO: 781389 - RNA, 17 nt, Homo sapiens
uaauguuagcaguucug

SEQ ID NO: 781390 - RNA, 16 nt, Homo sapiens
uaauguuauuuccacu

SEQ ID NO: 781391 - RNA, 22 nt, Homo sapiens
uaauguuccugaaaauugcaau

SEQ ID NO: 781392 - RNA, 19 nt, Homo sapiens
uaauguuguaucauacucu

SEQ ID NO: 781393 - RNA, 18 nt, Homo sapiens
uaauguuuauuguucaau

SEQ ID NO: 781394 - RNA, 15 nt, Homo sapiens
uaauuaauugucauu

SEQ ID NO: 781395 - RNA, 12 nt, Homo sapiens
uaauuaauuuca

SEQ ID NO: 781396 - RNA, 13 nt, Homo sapiens
uaauuacaccaua

SEQ ID NO: 781397 - RNA, 12 nt, Homo sapiens
uaauuaccaugc

SEQ ID NO: 781398 - RNA, 13 nt, Homo sapiens
uaauuacugugug

SEQ ID NO: 781399 - RNA, 17 nt, Homo sapiens
uaauuagggguugcuaa

SEQ ID NO: 781400 - RNA, 22 nt, Homo sapiens
uaauuauuguuauacacagcuu

SEQ ID NO: 781401 - RNA, 16 nt, Homo sapiens
uaauucacacaaagac

SEQ ID NO: 781402 - RNA, 14 nt, Homo sapiens
uaauucagcacuga

SEQ ID NO: 781403 - RNA, 13 nt, Homo sapiens
uaauucagcacuu

SEQ ID NO: 781404 - RNA, 20 nt, Homo sapiens
uaauucauaaaucacaaaua

SEQ ID NO: 781405 - RNA, 19 nt, Homo sapiens
uaauucauaaucacucuaa

SEQ ID NO: 781406 - RNA, 17 nt, Homo sapiens
uaauuccuguugcucug

SEQ ID NO: 781407 - RNA, 15 nt, Homo sapiens
uaauucuagcacuuu

SEQ ID NO: 781408 - RNA, 22 nt, Homo sapiens
uaauucuaguuucucucaauga

SEQ ID NO: 781409 - RNA, 17 nt, Homo sapiens
uaauugaccuacuuugg

SEQ ID NO: 781410 - RNA, 19 nt, Homo sapiens
uaauugaucaaauucauuu

SEQ ID NO: 781411 - RNA, 19 nt, Homo sapiens
uaauugccuaaaucuccag

SEQ ID NO: 781412 - RNA, 21 nt, Homo sapiens
uaauugcuccuauacuauuga

SEQ ID NO: 781413 - RNA, 14 nt, Homo sapiens
uaauugcuuugcca

SEQ ID NO: 781414 - RNA, 20 nt, Homo sapiens
uaauugcuuuuucacaguca

SEQ ID NO: 781415 - RNA, 21 nt, Homo sapiens
uaauuggaaucuucaccucag

SEQ ID NO: 781416 - RNA, 18 nt, Homo sapiens
uaauugguuuaguucuua

SEQ ID NO: 781417 - RNA, 15 nt, Homo sapiens
uaauuguaaucugaa

SEQ ID NO: 781418 - RNA, 15 nt, Homo sapiens
uaauuguacaauaaa

SEQ ID NO: 781419 - RNA, 19 nt, Homo sapiens
uaauuuaaaaagugcuaua

SEQ ID NO: 781420 - RNA, 16 nt, Homo sapiens
uaauuuaaguacuuga

SEQ ID NO: 781421 - RNA, 16 nt, Homo sapiens
uaauuuacagaaauca

SEQ ID NO: 781422 - RNA, 16 nt, Homo sapiens
uaauuuacagcuuuca

SEQ ID NO: 781423 - RNA, 15 nt, Homo sapiens
uaauuuauaaauaca

SEQ ID NO: 781424 - RNA, 18 nt, Homo sapiens
uaauuuauacaggucaua

SEQ ID NO: 781425 - RNA, 21 nt, Homo sapiens
uaauuuauacaggucauauua

SEQ ID NO: 781426 - RNA, 22 nt, Homo sapiens
uaauuucgccuuaaacucugga

SEQ ID NO: 781427 - RNA, 18 nt, Homo sapiens
uaauuucugucaaaugca

SEQ ID NO: 781428 - RNA, 13 nt, Homo sapiens
uaauuugaugaaa

SEQ ID NO: 781429 - RNA, 13 nt, Homo sapiens
uaauuuucgcuua

SEQ ID NO: 781430 - RNA, 19 nt, Homo sapiens
uaauuuucuagauuuucua

SEQ ID NO: 781431 - RNA, 16 nt, Homo sapiens
uaauuuuuaacuuauu

SEQ ID NO: 781432 - RNA, 20 nt, Homo sapiens
uaauuuuuaaggauguugcc

SEQ ID NO: 781433 - RNA, 15 nt, Homo sapiens
uaauuuuuaccuaau

SEQ ID NO: 781434 - RNA, 19 nt, Homo sapiens
uaauuuuuuguacuuuuag

SEQ ID NO: 781435 - RNA, 19 nt, Homo sapiens
uacaaaaaauuagccagau

SEQ ID NO: 781436 - RNA, 16 nt, Homo sapiens
uacaaaaacacagcaa

SEQ ID NO: 781437 - RNA, 19 nt, Homo sapiens
uacaaaaauagcugggcau

SEQ ID NO: 781438 - RNA, 14 nt, Homo sapiens
uacaaaaaugaaua

SEQ ID NO: 781439 - RNA, 15 nt, Homo sapiens
uacaaaauccagcua

SEQ ID NO: 781440 - RNA, 23 nt, Homo sapiens
uacaaacaauggaaacugaaugc

SEQ ID NO: 781441 - RNA, 16 nt, Homo sapiens
uacaaaccuaccaaaa

SEQ ID NO: 781442 - RNA, 11 nt, Homo sapiens
uacaaacucau

SEQ ID NO: 781443 - RNA, 14 nt, Homo sapiens
uacaaacugcaaua

SEQ ID NO: 781444 - RNA, 17 nt, Homo sapiens
uacaaagaaaaagccaa

SEQ ID NO: 781445 - RNA, 19 nt, Homo sapiens
uacaaagguugcagugcug

SEQ ID NO: 781446 - RNA, 14 nt, Homo sapiens
uacaaaguauuugc

SEQ ID NO: 781447 - RNA, 18 nt, Homo sapiens
uacaaaugugaaacggaa

SEQ ID NO: 781448 - RNA, 17 nt, Homo sapiens
uacaaauuuaugcauuu

SEQ ID NO: 781449 - RNA, 20 nt, Homo sapiens
uacaaauuuggccuuaagaa

SEQ ID NO: 781450 - RNA, 15 nt, Homo sapiens
uacaacacacacugu

SEQ ID NO: 781451 - RNA, 21 nt, Homo sapiens
uacaacauaaucuaguuuaca

SEQ ID NO: 781452 - RNA, 20 nt, Homo sapiens
uacaacauuguggaugugua

SEQ ID NO: 781453 - RNA, 21 nt, Homo sapiens
uacaaccaaccaccuuuccag

SEQ ID NO: 781454 - RNA, 11 nt, Homo sapiens
uacaaccagcc

SEQ ID NO: 781455 - RNA, 14 nt, Homo sapiens
uacaacccuacccu

SEQ ID NO: 781456 - RNA, 20 nt, Homo sapiens
uacaacuggaagauacauaa

SEQ ID NO: 781457 - RNA, 18 nt, Homo sapiens
uacaaggacuuagugcau

SEQ ID NO: 781458 - RNA, 20 nt, Homo sapiens
uacaaggcuuuaucucaggg

SEQ ID NO: 781459 - RNA, 17 nt, Homo sapiens
uaaagaucaugacauau

SEQ ID NO: 781460 - RNA, 21 nt, Homo sapiens
uaaagauggaguuucuaaggu

SEQ ID NO: 781461 - RNA, 15 nt, Homo sapiens
uaaagauggcacuuu

SEQ ID NO: 781462 - RNA, 17 nt, Homo sapiens
uaaagauguuuauuuca

SEQ ID NO: 781463 - RNA, 16 nt, Homo sapiens
uaaagauuucuaguag

SEQ ID NO: 781464 - RNA, 19 nt, Homo sapiens
uaaagcacuuugcacuuaa

SEQ ID NO: 781465 - RNA, 23 nt, Homo sapiens
uaaagcagacaggugugcagauu

SEQ ID NO: 781466 - RNA, 13 nt, Homo sapiens
uaaagcauaaaaa

SEQ ID NO: 781467 - RNA, 20 nt, Homo sapiens
uaaagcccaaccuccugacc

SEQ ID NO: 781468 - RNA, 17 nt, Homo sapiens
uaaagccuacccuauuc

SEQ ID NO: 781469 - RNA, 18 nt, Homo sapiens
uaaagccuacccuauucu

SEQ ID NO: 781470 - RNA, 15 nt, Homo sapiens
uaaagccucaagguu

SEQ ID NO: 781471 - RNA, 19 nt, Homo sapiens
uaaagccuuauuuuucaaa

SEQ ID NO: 781472 - RNA, 19 nt, Homo sapiens
uaaagcguccucucaguaa

SEQ ID NO: 781473 - RNA, 14 nt, Homo sapiens
uaaagcuauuuccu

SEQ ID NO: 781474 - RNA, 21 nt, Homo sapiens
uaaagcuggaacauuugauau

SEQ ID NO: 781475 - RNA, 21 nt, Homo sapiens
uaaaggaguaagaaccuugcc

SEQ ID NO: 781476 - RNA, 20 nt, Homo sapiens
uaaaggcagcugccucugcu

SEQ ID NO: 781477 - RNA, 14 nt, Homo sapiens
uaaaggccuggaac

SEQ ID NO: 781478 - RNA, 21 nt, Homo sapiens
uaaagggagaaggaagggcag

SEQ ID NO: 781479 - RNA, 18 nt, Homo sapiens
uaaagggcauuuuacuaa

SEQ ID NO: 781480 - RNA, 24 nt, Homo sapiens
uaaagguacgauuauacuugagau

SEQ ID NO: 781481 - RNA, 13 nt, Homo sapiens
uaaagguaugaaa

SEQ ID NO: 781482 - RNA, 13 nt, Homo sapiens
uaaaggucccuua

SEQ ID NO: 781483 - RNA, 23 nt, Homo sapiens
uaaagguuucauguucacuguga

SEQ ID NO: 781484 - RNA, 14 nt, Homo sapiens
uaaaguaagacauc

SEQ ID NO: 781485 - RNA, 14 nt, Homo sapiens
uaaaguaccacaca

SEQ ID NO: 781486 - RNA, 16 nt, Homo sapiens
uaaaguaccacacaua

SEQ ID NO: 781487 - RNA, 18 nt, Homo sapiens
uaaaguauaauguuuauu

SEQ ID NO: 781488 - RNA, 19 nt, Homo sapiens
uaaaguauaugugcagucu

SEQ ID NO: 781489 - RNA, 19 nt, Homo sapiens
uaaaguauauuuaacucau

SEQ ID NO: 781490 - RNA, 19 nt, Homo sapiens
uaaaguauguuauugcaua

SEQ ID NO: 781491 - RNA, 15 nt, Homo sapiens
uaaagucacagaauu

SEQ ID NO: 781492 - RNA, 16 nt, Homo sapiens
uaaagucacagaauua

SEQ ID NO: 781493 - RNA, 20 nt, Homo sapiens
uaaaguccaaagucagaucu

SEQ ID NO: 781494 - RNA, 16 nt, Homo sapiens
uaaagucucucugacu

SEQ ID NO: 781495 - RNA, 13 nt, Homo sapiens
uaaagugacccug

SEQ ID NO: 781496 - RNA, 15 nt, Homo sapiens
uaaagugcuaagguu

SEQ ID NO: 781497 - RNA, 22 nt, Homo sapiens
uaaagugcuaagguucuaaggc

SEQ ID NO: 781498 - RNA, 12 nt, Homo sapiens
uaaagugcuuaa

SEQ ID NO: 781499 - RNA, 16 nt, Homo sapiens
uaaaguguucugccag

SEQ ID NO: 781500 - RNA, 17 nt, Homo sapiens
uaaaguuacuugaauuu

SEQ ID NO: 781501 - RNA, 20 nt, Homo sapiens
uaaaguugguucacuucaaa

SEQ ID NO: 781502 - RNA, 20 nt, Homo sapiens
uaaaguuuugcaacaauaaa

SEQ ID NO: 781503 - RNA, 15 nt, Homo sapiens
uaaaguuuugucaga

SEQ ID NO: 781504 - RNA, 18 nt, Homo sapiens
uaaauaaaccacugugcg

SEQ ID NO: 781505 - RNA, 22 nt, Homo sapiens
uaaauaaagaagaaaauaaccu

SEQ ID NO: 781506 - RNA, 18 nt, Homo sapiens
uaaauaaaguuacuugaa

SEQ ID NO: 781507 - RNA, 16 nt, Homo sapiens
uaaauaaauguaaaua

SEQ ID NO: 781508 - RNA, 21 nt, Homo sapiens
uaaauaacuggaaaacagaac

SEQ ID NO: 781509 - RNA, 13 nt, Homo sapiens
uaaauaaucacac

SEQ ID NO: 781510 - RNA, 19 nt, Homo sapiens
uaaauaauguuaucugugu

SEQ ID NO: 781511 - RNA, 17 nt, Homo sapiens
uaaauaccagacacgua

SEQ ID NO: 781512 - RNA, 16 nt, Homo sapiens
uaaauaccauucacua

SEQ ID NO: 781513 - RNA, 15 nt, Homo sapiens
uaaauagaguuugcu

SEQ ID NO: 781514 - RNA, 22 nt, Homo sapiens
uaaauaguauuugagaguucua

SEQ ID NO: 781515 - RNA, 23 nt, Homo sapiens
uaaauaguauuugagaguucuaa

SEQ ID NO: 781516 - RNA, 23 nt, Homo sapiens
uaaauagugucauauaaacucau

SEQ ID NO: 781517 - RNA, 18 nt, Homo sapiens
uaaauauacaucugugua

SEQ ID NO: 781518 - RNA, 17 nt, Homo sapiens
uaaauaugauuacuuua

SEQ ID NO: 781519 - RNA, 21 nt, Homo sapiens
uaaauaugccuaaaauacuua

SEQ ID NO: 781520 - RNA, 19 nt, Homo sapiens
uaaauaugccuaguaacac

SEQ ID NO: 781521 - RNA, 17 nt, Homo sapiens
uaaauauuagaagccug

SEQ ID NO: 781522 - RNA, 18 nt, Homo sapiens
uaaauauuuuucacauaa

SEQ ID NO: 781523 - RNA, 19 nt, Homo sapiens
uaaaucaaugucacuuaaa

SEQ ID NO: 781524 - RNA, 14 nt, Homo sapiens
uaaaucaugaugcu

SEQ ID NO: 781525 - RNA, 23 nt, Homo sapiens
uaaaucauguugaucauguacuu

SEQ ID NO: 781526 - RNA, 13 nt, Homo sapiens
uaaauccccucac

SEQ ID NO: 781527 - RNA, 21 nt, Homo sapiens
uaaauccuuguuaccuaucuc

SEQ ID NO: 781528 - RNA, 21 nt, Homo sapiens
uaaauccuuugcuucauucca

SEQ ID NO: 781529 - RNA, 14 nt, Homo sapiens
uaaaucguccuccc

SEQ ID NO: 781530 - RNA, 16 nt, Homo sapiens
uaaaucguccucccag

SEQ ID NO: 781531 - RNA, 18 nt, Homo sapiens
uaaaucuaauaauuauuc

SEQ ID NO: 781532 - RNA, 13 nt, Homo sapiens
uaaaucuaugaag

SEQ ID NO: 781533 - RNA, 21 nt, Homo sapiens
uaaaucugucugauucuaugc

SEQ ID NO: 781534 - RNA, 11 nt, Homo sapiens
uaaaugaaaua

SEQ ID NO: 781535 - RNA, 14 nt, Homo sapiens
uaaaugaagugauu

SEQ ID NO: 781536 - RNA, 15 nt, Homo sapiens
uaaaugaccaaagau

SEQ ID NO: 781537 - RNA, 21 nt, Homo sapiens
uaaaugaccaaagaugaccug

SEQ ID NO: 781538 - RNA, 13 nt, Homo sapiens
uaaaugacuugga

SEQ ID NO: 781539 - RNA, 17 nt, Homo sapiens
uaaaugacuuuucuuaa

SEQ ID NO: 781540 - RNA, 22 nt, Homo sapiens
uaaaugagagggaaucgacugu

SEQ ID NO: 781541 - RNA, 18 nt, Homo sapiens
uaaaugagcuguuggaag

SEQ ID NO: 781542 - RNA, 14 nt, Homo sapiens
uaaaugaggauuca

SEQ ID NO: 781543 - RNA, 22 nt, Homo sapiens
uaaaugauuaaaaaaucagaga

SEQ ID NO: 781544 - RNA, 17 nt, Homo sapiens
uaaaugauuauauucac

SEQ ID NO: 781545 - RNA, 16 nt, Homo sapiens
uaaaugcaccaagaaa

SEQ ID NO: 781546 - RNA, 17 nt, Homo sapiens
uaaaugcucuaacugga

SEQ ID NO: 781547 - RNA, 18 nt, Homo sapiens
uaaaugcucuaacuggac

SEQ ID NO: 781548 - RNA, 14 nt, Homo sapiens
uaaaugcuguagaa

SEQ ID NO: 781549 - RNA, 22 nt, Homo sapiens
uaaaugcuucauuuguauguca

SEQ ID NO: 781550 - RNA, 22 nt, Homo sapiens
uaaaugguaguaaucacaguug

SEQ ID NO: 781551 - RNA, 20 nt, Homo sapiens
uaaauguaaaauauuugaga

SEQ ID NO: 781552 - RNA, 14 nt, Homo sapiens
uaaauguacauuaa

SEQ ID NO: 781553 - RNA, 19 nt, Homo sapiens
uaaauguaucuuauucaca

SEQ ID NO: 781554 - RNA, 22 nt, Homo sapiens
uaaauguauuuuagacuuccug

SEQ ID NO: 781555 - RNA, 19 nt, Homo sapiens
uaaaugugaaacaucuucu

SEQ ID NO: 781556 - RNA, 14 nt, Homo sapiens
uaaaugugaacuua

SEQ ID NO: 781557 - RNA, 14 nt, Homo sapiens
uaaaugugcuuaug

SEQ ID NO: 781558 - RNA, 20 nt, Homo sapiens
uaaauguggagaaacuguag

SEQ ID NO: 781559 - RNA, 22 nt, Homo sapiens
uaaauuaaagagaaaauugaga

SEQ ID NO: 781560 - RNA, 13 nt, Homo sapiens
uaaauuaagcaug

SEQ ID NO: 781561 - RNA, 16 nt, Homo sapiens
uaaauuauggcauuuu

SEQ ID NO: 781562 - RNA, 19 nt, Homo sapiens
uaaauuauuagagauuuuc

SEQ ID NO: 781563 - RNA, 16 nt, Homo sapiens
uaaauuauuuacugca

SEQ ID NO: 781564 - RNA, 13 nt, Homo sapiens
uaaauucagacaa

SEQ ID NO: 781565 - RNA, 13 nt, Homo sapiens
uaaauuccacacu

SEQ ID NO: 781566 - RNA, 22 nt, Homo sapiens
uaaauuccacacuaccacauua

SEQ ID NO: 781567 - RNA, 15 nt, Homo sapiens
uaaauucuaagccau

SEQ ID NO: 781568 - RNA, 22 nt, Homo sapiens
uaaaacauuuuuuagucuguaa

SEQ ID NO: 781569 - RNA, 22 nt, Homo sapiens
uaaaaccaacaaaaagaacaaa

SEQ ID NO: 781570 - RNA, 14 nt, Homo sapiens
uaaaaccacagcag

SEQ ID NO: 781571 - RNA, 22 nt, Homo sapiens
uaaaaccccaucucuacuaaaa

SEQ ID NO: 781572 - RNA, 18 nt, Homo sapiens
uaaaaccugugugccauu

SEQ ID NO: 781573 - RNA, 16 nt, Homo sapiens
uaaaacuaagcacaaa

SEQ ID NO: 781574 - RNA, 19 nt, Homo sapiens
uaaaacuaugguucccaau

SEQ ID NO: 781575 - RNA, 23 nt, Homo sapiens
uaaaagaaccgagcaauuuucug

SEQ ID NO: 781576 - RNA, 15 nt, Homo sapiens
uaaaagacacagaac

SEQ ID NO: 781577 - RNA, 12 nt, Homo sapiens
uaaaagacauua

SEQ ID NO: 781578 - RNA, 16 nt, Homo sapiens
uaaaagagauuucaag

SEQ ID NO: 781579 - RNA, 22 nt, Homo sapiens
uaaaagccccaaauggugguaa

SEQ ID NO: 781580 - RNA, 22 nt, Homo sapiens
uaaaagccccagcuuggcucac

SEQ ID NO: 781581 - RNA, 20 nt, Homo sapiens
uaaaagccuuauucuaaggu

SEQ ID NO: 781582 - RNA, 14 nt, Homo sapiens
uaaaagccuuggcc

SEQ ID NO: 781583 - RNA, 18 nt, Homo sapiens
uaaaaggacagagauuaa

SEQ ID NO: 781584 - RNA, 15 nt, Homo sapiens
uaaaaggggcccaag

SEQ ID NO: 781585 - RNA, 20 nt, Homo sapiens
uaaaagguauuuugaauacc

SEQ ID NO: 781586 - RNA, 13 nt, Homo sapiens
uaaaagucuacca

SEQ ID NO: 781587 - RNA, 15 nt, Homo sapiens
uaaaagugacucuca

SEQ ID NO: 781588 - RNA, 16 nt, Homo sapiens
uaaaagugaucuacau

SEQ ID NO: 781589 - RNA, 13 nt, Homo sapiens
uaaaagugcuuuc

SEQ ID NO: 781590 - RNA, 21 nt, Homo sapiens
uaaaaguuuuuuauuaugcau

SEQ ID NO: 781591 - RNA, 22 nt, Homo sapiens
uaaaaguuuuuuauuaugcauu

SEQ ID NO: 781592 - RNA, 17 nt, Homo sapiens
uaaaauaaaaguuuaca

SEQ ID NO: 781593 - RNA, 19 nt, Homo sapiens
uaaaauaaaguugagcuua

SEQ ID NO: 781594 - RNA, 14 nt, Homo sapiens
uaaaauaacuugca

SEQ ID NO: 781595 - RNA, 14 nt, Homo sapiens
uaaaauaagagauc

SEQ ID NO: 781596 - RNA, 16 nt, Homo sapiens
uaaaauaauaacaauc

SEQ ID NO: 781597 - RNA, 15 nt, Homo sapiens
uaaaauacacacuca

SEQ ID NO: 781598 - RNA, 17 nt, Homo sapiens
uaaaauacacacucaaa

SEQ ID NO: 781599 - RNA, 19 nt, Homo sapiens
uaaaauacuauugccucau

SEQ ID NO: 781600 - RNA, 12 nt, Homo sapiens
uaaaauacucag

SEQ ID NO: 781601 - RNA, 20 nt, Homo sapiens
uaaaauacuuuuacucugcc

SEQ ID NO: 781602 - RNA, 22 nt, Homo sapiens
uaaaauagaaacauuuguaugg

SEQ ID NO: 781603 - RNA, 19 nt, Homo sapiens
uaaaauagaguguaguuua

SEQ ID NO: 781604 - RNA, 22 nt, Homo sapiens
uaaaauaggaaccuaugaaacu

SEQ ID NO: 781605 - RNA, 14 nt, Homo sapiens
uaaaauaguagcau

SEQ ID NO: 781606 - RNA, 17 nt, Homo sapiens
uaaaauauaagaucuga

SEQ ID NO: 781607 - RNA, 22 nt, Homo sapiens
uaaaauauguaguugugucuua

SEQ ID NO: 781608 - RNA, 14 nt, Homo sapiens
uaaaauauuauuua

SEQ ID NO: 781609 - RNA, 13 nt, Homo sapiens
uaaaauauucacu

SEQ ID NO: 781610 - RNA, 14 nt, Homo sapiens
uaaaauauucacuc

SEQ ID NO: 781611 - RNA, 22 nt, Homo sapiens
uaaaauauuuuguaaugcugca

SEQ ID NO: 781612 - RNA, 21 nt, Homo sapiens
uaaaaucuuauaguucuaggc

SEQ ID NO: 781613 - RNA, 19 nt, Homo sapiens
uaaaaugaaauuacuacaa

SEQ ID NO: 781614 - RNA, 15 nt, Homo sapiens
uaaaaugaacaucuc

SEQ ID NO: 781615 - RNA, 14 nt, Homo sapiens
uaaaaugacagauc

SEQ ID NO: 781616 - RNA, 14 nt, Homo sapiens
uaaaaugacauuca

SEQ ID NO: 781617 - RNA, 14 nt, Homo sapiens
uaaaaugcauuuaa

SEQ ID NO: 781618 - RNA, 17 nt, Homo sapiens
uaaaaugucaagacagg

SEQ ID NO: 781619 - RNA, 22 nt, Homo sapiens
uaaaaugugauguucuaaggcu

SEQ ID NO: 781620 - RNA, 19 nt, Homo sapiens
uaaaauguuaccacuacuu

SEQ ID NO: 781621 - RNA, 15 nt, Homo sapiens
uaaaauuacauucua

SEQ ID NO: 781622 - RNA, 18 nt, Homo sapiens
uaaaauuagaugaacuca

SEQ ID NO: 781623 - RNA, 13 nt, Homo sapiens
uaaaauuauuuca

SEQ ID NO: 781624 - RNA, 12 nt, Homo sapiens
uaaaauucauuu

SEQ ID NO: 781625 - RNA, 16 nt, Homo sapiens
uaaaauugaguuugua

SEQ ID NO: 781626 - RNA, 15 nt, Homo sapiens
uaaaauugcacuuuu

SEQ ID NO: 781627 - RNA, 19 nt, Homo sapiens
uaaaauugcuucuuuacca

SEQ ID NO: 781628 - RNA, 15 nt, Homo sapiens
uaaaauuguaugaaa

SEQ ID NO: 781629 - RNA, 14 nt, Homo sapiens
uaaaauugugaugu

SEQ ID NO: 781630 - RNA, 14 nt, Homo sapiens
uaaacaaacaaaca

SEQ ID NO: 781631 - RNA, 12 nt, Homo sapiens
uaaacaaaccac

SEQ ID NO: 781632 - RNA, 22 nt, Homo sapiens
uaaacaagaaaucugacaauag

SEQ ID NO: 781633 - RNA, 20 nt, Homo sapiens
uaaacaagggucaauucaaa

SEQ ID NO: 781634 - RNA, 13 nt, Homo sapiens
uaaacacagucca

SEQ ID NO: 781635 - RNA, 19 nt, Homo sapiens
uaaacacauguucugugcc

SEQ ID NO: 781636 - RNA, 17 nt, Homo sapiens
uaaacagauggcacuuu

SEQ ID NO: 781637 - RNA, 20 nt, Homo sapiens
uaaacagcuucaugccuuug

SEQ ID NO: 781638 - RNA, 15 nt, Homo sapiens
uaaacaggcaaaaca

SEQ ID NO: 781639 - RNA, 19 nt, Homo sapiens
uaaacagguguuugccuua

SEQ ID NO: 781640 - RNA, 20 nt, Homo sapiens
uaaacagugagccugaauuu

SEQ ID NO: 781641 - RNA, 14 nt, Homo sapiens
uaaacauccuucaa

SEQ ID NO: 781642 - RNA, 21 nt, Homo sapiens
uaaacauccuucaagaacucu

SEQ ID NO: 781643 - RNA, 14 nt, Homo sapiens
uaaacaugcuugca

SEQ ID NO: 781644 - RNA, 22 nt, Homo sapiens
uaaacauuaaguaaaugcugua

SEQ ID NO: 781645 - RNA, 19 nt, Homo sapiens
uaaaccaaggacugagcac

SEQ ID NO: 781646 - RNA, 16 nt, Homo sapiens
uaaaccaagugaucaa

SEQ ID NO: 781647 - RNA, 13 nt, Homo sapiens
uaaaccaccaucu

SEQ ID NO: 781648 - RNA, 14 nt, Homo sapiens
uaaacccauacaau

SEQ ID NO: 781649 - RNA, 20 nt, Homo sapiens
uaaaccuagaguuuuaucaa

SEQ ID NO: 781650 - RNA, 22 nt, Homo sapiens
uaaaccucaguuauuacaugua

SEQ ID NO: 781651 - RNA, 13 nt, Homo sapiens
uaaaccuccauac

SEQ ID NO: 781652 - RNA, 15 nt, Homo sapiens
uaaaccuuacaugug

SEQ ID NO: 781653 - RNA, 15 nt, Homo sapiens
uaaacgggaacaugc

SEQ ID NO: 781654 - RNA, 22 nt, Homo sapiens
uaaacuaagagaaacuguguau

SEQ ID NO: 781655 - RNA, 18 nt, Homo sapiens
uaaacuaucaauaauaca

SEQ ID NO: 781656 - RNA, 20 nt, Homo sapiens
uaaacuaucaauaauacaaa

SEQ ID NO: 781657 - RNA, 18 nt, Homo sapiens
uaaacuauuagaguauuu

SEQ ID NO: 781658 - RNA, 15 nt, Homo sapiens
uaaacucagaucuga

SEQ ID NO: 781659 - RNA, 20 nt, Homo sapiens
uaaacucauuuaacuaaagu

SEQ ID NO: 781660 - RNA, 23 nt, Homo sapiens
uaaacuccuuccuggccugagag

SEQ ID NO: 781661 - RNA, 23 nt, Homo sapiens
uaaacucuguccacgauucacuc

SEQ ID NO: 781662 - RNA, 21 nt, Homo sapiens
uaaacucuuuuaucuccugaa

SEQ ID NO: 781663 - RNA, 19 nt, Homo sapiens
uaaacuggcaucugcucua

SEQ ID NO: 781664 - RNA, 22 nt, Homo sapiens
uaaacuggcuggcccagaguuu

SEQ ID NO: 781665 - RNA, 23 nt, Homo sapiens
uaaacugguauuuuaucuuugau

SEQ ID NO: 781666 - RNA, 21 nt, Homo sapiens
uaaacuguaucaaaucuguau

SEQ ID NO: 781667 - RNA, 11 nt, Homo sapiens
uaaacuugaau

SEQ ID NO: 781668 - RNA, 22 nt, Homo sapiens
uaaacuuggauucucuaaccuu

SEQ ID NO: 781669 - RNA, 16 nt, Homo sapiens
uaaacuuuaucacuua

SEQ ID NO: 781670 - RNA, 17 nt, Homo sapiens
uaaagaaaaaaauacua

SEQ ID NO: 781671 - RNA, 17 nt, Homo sapiens
uaaagaaaaauaugaua

SEQ ID NO: 781672 - RNA, 13 nt, Homo sapiens
uaaagaaacuggu

SEQ ID NO: 781673 - RNA, 15 nt, Homo sapiens
uaaagaaaggaacua

SEQ ID NO: 781674 - RNA, 13 nt, Homo sapiens
uaaagaagccagc

SEQ ID NO: 781675 - RNA, 22 nt, Homo sapiens
uaaagaagguuggugaauuuca

SEQ ID NO: 781676 - RNA, 19 nt, Homo sapiens
uaaagaauccuuaucuaua

SEQ ID NO: 781677 - RNA, 13 nt, Homo sapiens
uaaagaauuacuu

SEQ ID NO: 781678 - RNA, 22 nt, Homo sapiens
guuuccccuccuuggcuuuaug

SEQ ID NO: 781679 - RNA, 22 nt, Homo sapiens
guuuccgaggcacuguuuuauc

SEQ ID NO: 781680 - RNA, 21 nt, Homo sapiens
guuuccuauuugcaguuacuu

SEQ ID NO: 781681 - RNA, 16 nt, Homo sapiens
guuuccucauuccuga

SEQ ID NO: 781682 - RNA, 16 nt, Homo sapiens
guuucgacugguccag

SEQ ID NO: 781683 - RNA, 19 nt, Homo sapiens
guuucuaaaguguuggcaa

SEQ ID NO: 781684 - RNA, 13 nt, Homo sapiens
guuucuacauuca

SEQ ID NO: 781685 - RNA, 17 nt, Homo sapiens
guuucuaggcaccucag

SEQ ID NO: 781686 - RNA, 19 nt, Homo sapiens
guuucuccuuaguuggcug

SEQ ID NO: 781687 - RNA, 15 nt, Homo sapiens
guuucucucaaugaa

SEQ ID NO: 781688 - RNA, 21 nt, Homo sapiens
guuucucuugaagaacugacu

SEQ ID NO: 781689 - RNA, 23 nt, Homo sapiens
guuucugagcauaaugcucccau

SEQ ID NO: 781690 - RNA, 17 nt, Homo sapiens
guuucugauaccacugc

SEQ ID NO: 781691 - RNA, 20 nt, Homo sapiens
guuucugauaccacugcacu

SEQ ID NO: 781692 - RNA, 23 nt, Homo sapiens
guuucuggauuucauacuguaac

SEQ ID NO: 781693 - RNA, 14 nt, Homo sapiens
guuucuggcucuug

SEQ ID NO: 781694 - RNA, 14 nt, Homo sapiens
guuucugucuguaa

SEQ ID NO: 781695 - RNA, 18 nt, Homo sapiens
guuucugugaaauucuca

SEQ ID NO: 781696 - RNA, 19 nt, Homo sapiens
guuucuguucucccuggga

SEQ ID NO: 781697 - RNA, 19 nt, Homo sapiens
guuucuuaaaaaacauaua

SEQ ID NO: 781698 - RNA, 11 nt, Homo sapiens
guuucuuccaa

SEQ ID NO: 781699 - RNA, 21 nt, Homo sapiens
guuucuugcucccagaccaag

SEQ ID NO: 781700 - RNA, 23 nt, Homo sapiens
guuucuugcucccagaccaaggc

SEQ ID NO: 781701 - RNA, 22 nt, Homo sapiens
guuucuuguaagccaucagaag

SEQ ID NO: 781702 - RNA, 16 nt, Homo sapiens
guuucuuuuugcucgc

SEQ ID NO: 781703 - RNA, 20 nt, Homo sapiens
guuugaagacacagccuccc

SEQ ID NO: 781704 - RNA, 15 nt, Homo sapiens
guuugacauuugucu

SEQ ID NO: 781705 - RNA, 16 nt, Homo sapiens
guuugauauaccaaau

SEQ ID NO: 781706 - RNA, 16 nt, Homo sapiens
guuugauuuuugacca

SEQ ID NO: 781707 - RNA, 14 nt, Homo sapiens
guuugcaccgccug

SEQ ID NO: 781708 - RNA, 19 nt, Homo sapiens
guuugcacuuggcaaaaag

SEQ ID NO: 781709 - RNA, 12 nt, Homo sapiens
guuugcacuuug

SEQ ID NO: 781710 - RNA, 18 nt, Homo sapiens
guuugcagaaaagcaccu

SEQ ID NO: 781711 - RNA, 20 nt, Homo sapiens
guuugcaguuggcuaagaga

SEQ ID NO: 781712 - RNA, 14 nt, Homo sapiens
guuugcuagcagaa

SEQ ID NO: 781713 - RNA, 19 nt, Homo sapiens
guuuggaaaccacagucag

SEQ ID NO: 781714 - RNA, 17 nt, Homo sapiens
guuuggaauaaagucaa

SEQ ID NO: 781715 - RNA, 16 nt, Homo sapiens
guuuggaugaaaaaag

SEQ ID NO: 781716 - RNA, 20 nt, Homo sapiens
guuuggcaaugcuaauucaa

SEQ ID NO: 781717 - RNA, 21 nt, Homo sapiens
guuuggcuagguaucauucaa

SEQ ID NO: 781718 - RNA, 20 nt, Homo sapiens
guuuggcuauaagugcucaa

SEQ ID NO: 781719 - RNA, 13 nt, Homo sapiens
guuuggggagaaa

SEQ ID NO: 781720 - RNA, 13 nt, Homo sapiens
guuuggggagcag

SEQ ID NO: 781721 - RNA, 19 nt, Homo sapiens
guuugguuguaaaugcucg

SEQ ID NO: 781722 - RNA, 22 nt, Homo sapiens
guuugguuuguuuauaauguua

SEQ ID NO: 781723 - RNA, 14 nt, Homo sapiens
guuuguaaauaaga

SEQ ID NO: 781724 - RNA, 15 nt, Homo sapiens
guuuguaaaugccuc

SEQ ID NO: 781725 - RNA, 17 nt, Homo sapiens
guuuguauuuugcauac

SEQ ID NO: 781726 - RNA, 18 nt, Homo sapiens
guuugucgagcauuucuu

SEQ ID NO: 781727 - RNA, 17 nt, Homo sapiens
guuuguuauaucaggga

SEQ ID NO: 781728 - RNA, 21 nt, Homo sapiens
guuuguuucaagaaccuggaa

SEQ ID NO: 781729 - RNA, 18 nt, Homo sapiens
guuuuaaauaaaccuaua

SEQ ID NO: 781730 - RNA, 13 nt, Homo sapiens
guuuuaacugaau

SEQ ID NO: 781731 - RNA, 12 nt, Homo sapiens
guuuuaacugua

SEQ ID NO: 781732 - RNA, 20 nt, Homo sapiens
guuuuaagaaacuagcagau

SEQ ID NO: 781733 - RNA, 19 nt, Homo sapiens
guuuuaauuuucuuguaua

SEQ ID NO: 781734 - RNA, 13 nt, Homo sapiens
guuuuacacagga

SEQ ID NO: 781735 - RNA, 23 nt, Homo sapiens
guuuuaccaucugcauccagccu

SEQ ID NO: 781736 - RNA, 21 nt, Homo sapiens
guuuuagcggucaauuugccu

SEQ ID NO: 781737 - RNA, 17 nt, Homo sapiens
guuuuaggguacaguuu

SEQ ID NO: 781738 - RNA, 21 nt, Homo sapiens
guuuuaggguacaugugcaca

SEQ ID NO: 781739 - RNA, 16 nt, Homo sapiens
guuuucaacacuuuuu

SEQ ID NO: 781740 - RNA, 11 nt, Homo sapiens
guuuucacuaa

SEQ ID NO: 781741 - RNA, 19 nt, Homo sapiens
guuuuccuaaaugcaguga

SEQ ID NO: 781742 - RNA, 15 nt, Homo sapiens
guuuucuagaauuua

SEQ ID NO: 781743 - RNA, 14 nt, Homo sapiens
guuuucuucacuau

SEQ ID NO: 781744 - RNA, 16 nt, Homo sapiens
guuuucuugccaauga

SEQ ID NO: 781745 - RNA, 15 nt, Homo sapiens
guuuugaaaugauau

SEQ ID NO: 781746 - RNA, 17 nt, Homo sapiens
guuuugcacuucuguaa

SEQ ID NO: 781747 - RNA, 22 nt, Homo sapiens
guuuugccaguucaagaauuua

SEQ ID NO: 781748 - RNA, 15 nt, Homo sapiens
guuuugcuacauucu

SEQ ID NO: 781749 - RNA, 15 nt, Homo sapiens
guuuugcuuaggcac

SEQ ID NO: 781750 - RNA, 20 nt, Homo sapiens
guuuuguaaauguacuggua

SEQ ID NO: 781751 - RNA, 16 nt, Homo sapiens
guuuugucaaacugua

SEQ ID NO: 781752 - RNA, 23 nt, Homo sapiens
guuuugucucgcuauacugcacu

SEQ ID NO: 781753 - RNA, 13 nt, Homo sapiens
guuuuguuucauc

SEQ ID NO: 781754 - RNA, 23 nt, Homo sapiens
guuuuuaaagaaaagcauucaag

SEQ ID NO: 781755 - RNA, 15 nt, Homo sapiens
guuuuuaagcuguuu

SEQ ID NO: 781756 - RNA, 20 nt, Homo sapiens
guuuuuagauuaaacaaaca

SEQ ID NO: 781757 - RNA, 17 nt, Homo sapiens
guuuuucugaagacagu

SEQ ID NO: 781758 - RNA, 17 nt, Homo sapiens
guuuuugcuuguuauau

SEQ ID NO: 781759 - RNA, 20 nt, Homo sapiens
guuuuuguuaguucacuuca

SEQ ID NO: 781760 - RNA, 13 nt, Homo sapiens
guuuuuuugcaga

SEQ ID NO: 781761 - RNA, 20 nt, Homo sapiens
uaaaaaaaaaaaccaaaacu

SEQ ID NO: 781762 - RNA, 22 nt, Homo sapiens
uaaaaaaaagaaucaccaaauc

SEQ ID NO: 781763 - RNA, 13 nt, Homo sapiens
uaaaaaaacugga

SEQ ID NO: 781764 - RNA, 22 nt, Homo sapiens
uaaaaaaacuggauauuucaau

SEQ ID NO: 781765 - RNA, 18 nt, Homo sapiens
uaaaaaaagaacauaaaa

SEQ ID NO: 781766 - RNA, 15 nt, Homo sapiens
uaaaaaaauuaguga

SEQ ID NO: 781767 - RNA, 18 nt, Homo sapiens
uaaaaaauaaaguaccac

SEQ ID NO: 781768 - RNA, 15 nt, Homo sapiens
uaaaaaaucaugcca

SEQ ID NO: 781769 - RNA, 14 nt, Homo sapiens
uaaaaaaucuuaau

SEQ ID NO: 781770 - RNA, 15 nt, Homo sapiens
uaaaaaauggagcuc

SEQ ID NO: 781771 - RNA, 20 nt, Homo sapiens
uaaaaacaccaaaaagggau

SEQ ID NO: 781772 - RNA, 23 nt, Homo sapiens
uaaaaacucuauaaccucagcuu

SEQ ID NO: 781773 - RNA, 13 nt, Homo sapiens
uaaaaacuggccc

SEQ ID NO: 781774 - RNA, 12 nt, Homo sapiens
uaaaaaggaaua

SEQ ID NO: 781775 - RNA, 22 nt, Homo sapiens
uaaaaagggcagggcaucuccu

SEQ ID NO: 781776 - RNA, 19 nt, Homo sapiens
uaaaaagguccucacaggu

SEQ ID NO: 781777 - RNA, 13 nt, Homo sapiens
uaaaaaguucaua

SEQ ID NO: 781778 - RNA, 22 nt, Homo sapiens
uaaaaauaaaucccauggaaua

SEQ ID NO: 781779 - RNA, 14 nt, Homo sapiens
uaaaaauaaauuca

SEQ ID NO: 781780 - RNA, 17 nt, Homo sapiens
uaaaaaugagugcuuaa

SEQ ID NO: 781781 - RNA, 15 nt, Homo sapiens
uaaaaaugcugcucu

SEQ ID NO: 781782 - RNA, 21 nt, Homo sapiens
uaaaaauggauagcucauuaa

SEQ ID NO: 781783 - RNA, 16 nt, Homo sapiens
uaaaaaugucaucuca

SEQ ID NO: 781784 - RNA, 14 nt, Homo sapiens
uaaaaauugucauu

SEQ ID NO: 781785 - RNA, 15 nt, Homo sapiens
uaaaaauugugauca

SEQ ID NO: 781786 - RNA, 19 nt, Homo sapiens
uaaaacaauaaaugaauga

SEQ ID NO: 781787 - RNA, 12 nt, Homo sapiens
uaaaacacagcu

SEQ ID NO: 781788 - RNA, 15 nt, Homo sapiens
uaaaacacauauuca

SEQ ID NO: 781789 - RNA, 22 nt, Homo sapiens
guucccugacuccuccaaggaa

SEQ ID NO: 781790 - RNA, 19 nt, Homo sapiens
guucccuugcagggguccc

SEQ ID NO: 781791 - RNA, 16 nt, Homo sapiens
guucccuuggccucag

SEQ ID NO: 781792 - RNA, 14 nt, Homo sapiens
guuccuccuacuua

SEQ ID NO: 781793 - RNA, 18 nt, Homo sapiens
guuccucuuggugucaua

SEQ ID NO: 781794 - RNA, 19 nt, Homo sapiens
guuccuguagaacugagaa

SEQ ID NO: 781795 - RNA, 16 nt, Homo sapiens
guuccuuaucugucac

SEQ ID NO: 781796 - RNA, 12 nt, Homo sapiens
guuccuugcuag

SEQ ID NO: 781797 - RNA, 13 nt, Homo sapiens
guucgaagcuccg

SEQ ID NO: 781798 - RNA, 20 nt, Homo sapiens
guucgagaccagccuggcca

SEQ ID NO: 781799 - RNA, 14 nt, Homo sapiens
guucgagacuccau

SEQ ID NO: 781800 - RNA, 15 nt, Homo sapiens
guucgcauggcagcc

SEQ ID NO: 781801 - RNA, 22 nt, Homo sapiens
guucuaaacuaucaauaauaca

SEQ ID NO: 781802 - RNA, 14 nt, Homo sapiens
guucuaacagugaa

SEQ ID NO: 781803 - RNA, 12 nt, Homo sapiens
guucuacaugag

SEQ ID NO: 781804 - RNA, 17 nt, Homo sapiens
guucuagacuuccccau

SEQ ID NO: 781805 - RNA, 19 nt, Homo sapiens
guucuagcauggcauauuu

SEQ ID NO: 781806 - RNA, 21 nt, Homo sapiens
guucuaucaggggugcauucu

SEQ ID NO: 781807 - RNA, 16 nt, Homo sapiens
guucucacagugggag

SEQ ID NO: 781808 - RNA, 17 nt, Homo sapiens
guucuccucugaccugc

SEQ ID NO: 781809 - RNA, 13 nt, Homo sapiens
guucucuauacuc

SEQ ID NO: 781810 - RNA, 22 nt, Homo sapiens
guucucuauugcugcucucuca

SEQ ID NO: 781811 - RNA, 18 nt, Homo sapiens
guucucuuugguguuaca

SEQ ID NO: 781812 - RNA, 14 nt, Homo sapiens
guucugaguguuuu

SEQ ID NO: 781813 - RNA, 22 nt, Homo sapiens
guucugcaagcaucaguucuac

SEQ ID NO: 781814 - RNA, 15 nt, Homo sapiens
guucugcccauggga

SEQ ID NO: 781815 - RNA, 24 nt, Homo sapiens
guucugcuucaauaaaucuuugga

SEQ ID NO: 781816 - RNA, 19 nt, Homo sapiens
guucuuaugccauguuaau

SEQ ID NO: 781817 - RNA, 16 nt, Homo sapiens
guucuucauuaccuca

SEQ ID NO: 781818 - RNA, 15 nt, Homo sapiens
guucuuucaucuccc

SEQ ID NO: 781819 - RNA, 20 nt, Homo sapiens
guucuuucaucucccuccuc

SEQ ID NO: 781820 - RNA, 18 nt, Homo sapiens
guucuuuucuccuuuacc

SEQ ID NO: 781821 - RNA, 20 nt, Homo sapiens
guucuuuucuccuuuaccag

SEQ ID NO: 781822 - RNA, 20 nt, Homo sapiens
guugaaacacacgugcugug

SEQ ID NO: 781823 - RNA, 14 nt, Homo sapiens
guugaaacugcuau

SEQ ID NO: 781824 - RNA, 15 nt, Homo sapiens
guugaaagaucaaaa

SEQ ID NO: 781825 - RNA, 14 nt, Homo sapiens
guugaauaaaugaa

SEQ ID NO: 781826 - RNA, 22 nt, Homo sapiens
guugaauccacccaaaucuauu

SEQ ID NO: 781827 - RNA, 18 nt, Homo sapiens
guugagauccagugcagu

SEQ ID NO: 781828 - RNA, 17 nt, Homo sapiens
guugaguaaaacacaua

SEQ ID NO: 781829 - RNA, 12 nt, Homo sapiens
guugagugccag

SEQ ID NO: 781830 - RNA, 16 nt, Homo sapiens
guugaguguguggucu

SEQ ID NO: 781831 - RNA, 20 nt, Homo sapiens
guugauccuccuauucucuu

SEQ ID NO: 781832 - RNA, 16 nt, Homo sapiens
guugcaagaugugaau

SEQ ID NO: 781833 - RNA, 22 nt, Homo sapiens
guugcagcccuugugaugugau

SEQ ID NO: 781834 - RNA, 11 nt, Homo sapiens
guugcagugag

SEQ ID NO: 781835 - RNA, 18 nt, Homo sapiens
guugccugacuccugggu

SEQ ID NO: 781836 - RNA, 16 nt, Homo sapiens
guugccuucugugcau

SEQ ID NO: 781837 - RNA, 12 nt, Homo sapiens
guugcuauaaua

SEQ ID NO: 781838 - RNA, 16 nt, Homo sapiens
guugcuauaauaaaga

SEQ ID NO: 781839 - RNA, 22 nt, Homo sapiens
guugcucaaaucuauucagaca

SEQ ID NO: 781840 - RNA, 19 nt, Homo sapiens
guugcucacagcuguaaua

SEQ ID NO: 781841 - RNA, 11 nt, Homo sapiens
guugcucugac

SEQ ID NO: 781842 - RNA, 22 nt, Homo sapiens
guugcuguuauuauauuugaca

SEQ ID NO: 781843 - RNA, 16 nt, Homo sapiens
guugcuuaucauuuga

SEQ ID NO: 781844 - RNA, 15 nt, Homo sapiens
guugcuuuagucacu

SEQ ID NO: 781845 - RNA, 12 nt, Homo sapiens
guugcuuuucag

SEQ ID NO: 781846 - RNA, 23 nt, Homo sapiens
guuggacuucagucuugccuagg

SEQ ID NO: 781847 - RNA, 15 nt, Homo sapiens
guuggagagcagcag

SEQ ID NO: 781848 - RNA, 16 nt, Homo sapiens
guuggccccucugcug

SEQ ID NO: 781849 - RNA, 21 nt, Homo sapiens
guuggccgugguccagcucuu

SEQ ID NO: 781850 - RNA, 18 nt, Homo sapiens
guuggccugcacuggugu

SEQ ID NO: 781851 - RNA, 19 nt, Homo sapiens
guuggcuagacuagucuca

SEQ ID NO: 781852 - RNA, 17 nt, Homo sapiens
guugggcuuccaugccu

SEQ ID NO: 781853 - RNA, 14 nt, Homo sapiens
guuggggaccucac

SEQ ID NO: 781854 - RNA, 19 nt, Homo sapiens
guuggggucuguucuugaa

SEQ ID NO: 781855 - RNA, 22 nt, Homo sapiens
guugguucguucuguacuguua

SEQ ID NO: 781856 - RNA, 21 nt, Homo sapiens
guugguuguuuuuuccuuugc

SEQ ID NO: 781857 - RNA, 12 nt, Homo sapiens
guugguuugugu

SEQ ID NO: 781858 - RNA, 17 nt, Homo sapiens
guuguaauaaaacuuau

SEQ ID NO: 781859 - RNA, 14 nt, Homo sapiens
guuguaaugcugca

SEQ ID NO: 781860 - RNA, 18 nt, Homo sapiens
guuguagaaauuaacaaa

SEQ ID NO: 781861 - RNA, 18 nt, Homo sapiens
guuguaggguuacagaga

SEQ ID NO: 781862 - RNA, 19 nt, Homo sapiens
guuguauauagaguggaau

SEQ ID NO: 781863 - RNA, 19 nt, Homo sapiens
guuguaucaaagugugaua

SEQ ID NO: 781864 - RNA, 19 nt, Homo sapiens
guugucucuagagcaggga

SEQ ID NO: 781865 - RNA, 15 nt, Homo sapiens
guugugagcuuugaa

SEQ ID NO: 781866 - RNA, 16 nt, Homo sapiens
guuguuaaaaauguca

SEQ ID NO: 781867 - RNA, 13 nt, Homo sapiens
guuguuaaaggca

SEQ ID NO: 781868 - RNA, 19 nt, Homo sapiens
guuguucaguugccaagga

SEQ ID NO: 781869 - RNA, 23 nt, Homo sapiens
guuguucauugaugggauuuuug

SEQ ID NO: 781870 - RNA, 18 nt, Homo sapiens
guuguugaggcugucaca

SEQ ID NO: 781871 - RNA, 18 nt, Homo sapiens
guuuaaacccaagugcug

SEQ ID NO: 781872 - RNA, 16 nt, Homo sapiens
guuuaacauacaauca

SEQ ID NO: 781873 - RNA, 19 nt, Homo sapiens
guuuaacaucauugcauaa

SEQ ID NO: 781874 - RNA, 17 nt, Homo sapiens
guuuaacauuuccucag

SEQ ID NO: 781875 - RNA, 21 nt, Homo sapiens
guuuacaaaauauucguggua

SEQ ID NO: 781876 - RNA, 22 nt, Homo sapiens
guuuacaauaggaguggugauu

SEQ ID NO: 781877 - RNA, 15 nt, Homo sapiens
guuuacagcacuacu

SEQ ID NO: 781878 - RNA, 18 nt, Homo sapiens
guuuacuauugcuaucuu

SEQ ID NO: 781879 - RNA, 21 nt, Homo sapiens
guuuacuucucaccauuugag

SEQ ID NO: 781880 - RNA, 22 nt, Homo sapiens
guuuagaucccaugucaccuca

SEQ ID NO: 781881 - RNA, 13 nt, Homo sapiens
guuuagcaguaua

SEQ ID NO: 781882 - RNA, 13 nt, Homo sapiens
guuuagugauauu

SEQ ID NO: 781883 - RNA, 15 nt, Homo sapiens
guuuauacacugugu

SEQ ID NO: 781884 - RNA, 13 nt, Homo sapiens
guuuaucacacag

SEQ ID NO: 781885 - RNA, 22 nt, Homo sapiens
guuuaucaguaaauaacuggaa

SEQ ID NO: 781886 - RNA, 22 nt, Homo sapiens
guuuauccacccacaacaucua

SEQ ID NO: 781887 - RNA, 13 nt, Homo sapiens
guuuaucucugag

SEQ ID NO: 781888 - RNA, 15 nt, Homo sapiens
guuuaugaugcaaau

SEQ ID NO: 781889 - RNA, 22 nt, Homo sapiens
guuuauguguuaugaacaucca

SEQ ID NO: 781890 - RNA, 16 nt, Homo sapiens
guuuauuguucaauau

SEQ ID NO: 781891 - RNA, 19 nt, Homo sapiens
guuuauuuaucagugacag

SEQ ID NO: 781892 - RNA, 21 nt, Homo sapiens
guuuauuuuuuuaaaacacaa

SEQ ID NO: 781893 - RNA, 23 nt, Homo sapiens
guuucaaaaaaucugaccaaaac

SEQ ID NO: 781894 - RNA, 12 nt, Homo sapiens
guuucaacagag

SEQ ID NO: 781895 - RNA, 17 nt, Homo sapiens
guuucaacugugcucuu

SEQ ID NO: 781896 - RNA, 23 nt, Homo sapiens
guuucaaguuauucaaauuugua

SEQ ID NO: 781897 - RNA, 17 nt, Homo sapiens
guuucacacuagucaca

SEQ ID NO: 781898 - RNA, 18 nt, Homo sapiens
guuucacagaaaauaagg

SEQ ID NO: 781899 - RNA, 13 nt, Homo sapiens
guuucacauauuu

SEQ ID NO: 781900 - RNA, 19 nt, Homo sapiens
guuucaccguguuagccag

SEQ ID NO: 781901 - RNA, 16 nt, Homo sapiens
ggucagggaaauauga

SEQ ID NO: 781902 - RNA, 14 nt, Homo sapiens
ggucauagcauuca

SEQ ID NO: 781903 - RNA, 22 nt, Homo sapiens
ggucauauuaauauauuuccau

SEQ ID NO: 781904 - RNA, 15 nt, Homo sapiens
ggucauccaaacuca

SEQ ID NO: 781905 - RNA, 19 nt, Homo sapiens
ggucaucucggcuguuccu

SEQ ID NO: 781906 - RNA, 11 nt, Homo sapiens
ggucaucugcc

SEQ ID NO: 781907 - RNA, 16 nt, Homo sapiens
ggucaugcacaugccu

SEQ ID NO: 781908 - RNA, 21 nt, Homo sapiens
ggucauuggccacugucucca

SEQ ID NO: 781909 - RNA, 13 nt, Homo sapiens
gguccaccuggag

SEQ ID NO: 781910 - RNA, 22 nt, Homo sapiens
gguccagcuugcucuucagugg

SEQ ID NO: 781911 - RNA, 15 nt, Homo sapiens
gguccauucucugag

SEQ ID NO: 781912 - RNA, 17 nt, Homo sapiens
ggucccccgacugccug

SEQ ID NO: 781913 - RNA, 20 nt, Homo sapiens
ggucccggggccagcacuuc

SEQ ID NO: 781914 - RNA, 21 nt, Homo sapiens
ggucccuccucucaccucucc

SEQ ID NO: 781915 - RNA, 21 nt, Homo sapiens
ggucccugaggaugggucaga

SEQ ID NO: 781916 - RNA, 14 nt, Homo sapiens
ggucccugguccuu

SEQ ID NO: 781917 - RNA, 19 nt, Homo sapiens
gguccuggccgucccuaag

SEQ ID NO: 781918 - RNA, 15 nt, Homo sapiens
gguccuggcuccuga

SEQ ID NO: 781919 - RNA, 17 nt, Homo sapiens
gguccuguucccuaccc

SEQ ID NO: 781920 - RNA, 19 nt, Homo sapiens
gguccuuuucaaaauucaa

SEQ ID NO: 781921 - RNA, 17 nt, Homo sapiens
ggucuaauuauuuacuc

SEQ ID NO: 781922 - RNA, 23 nt, Homo sapiens
ggucuagacuauuaggugcaauu

SEQ ID NO: 781923 - RNA, 15 nt, Homo sapiens
ggucuaggacacagu

SEQ ID NO: 781924 - RNA, 17 nt, Homo sapiens
ggucuauuacgugggug

SEQ ID NO: 781925 - RNA, 11 nt, Homo sapiens
ggucucaaagu

SEQ ID NO: 781926 - RNA, 20 nt, Homo sapiens
ggucucacaguguugcccag

SEQ ID NO: 781927 - RNA, 13 nt, Homo sapiens
ggucuccaagacc

SEQ ID NO: 781928 - RNA, 15 nt, Homo sapiens
ggucuccuugcacuu

SEQ ID NO: 781929 - RNA, 20 nt, Homo sapiens
ggucucgcuuuguugcccag

SEQ ID NO: 781930 - RNA, 21 nt, Homo sapiens
ggucucuggcccuucuugccu

SEQ ID NO: 781931 - RNA, 23 nt, Homo sapiens
ggucugacaccaaaacaugccgc

SEQ ID NO: 781932 - RNA, 21 nt, Homo sapiens
ggucugagucuauguucaaag

SEQ ID NO: 781933 - RNA, 23 nt, Homo sapiens
ggucugagucuauguucaaagac

SEQ ID NO: 781934 - RNA, 16 nt, Homo sapiens
ggucugcucuuucucu

SEQ ID NO: 781935 - RNA, 23 nt, Homo sapiens
ggucugcucuuucucugccagug

SEQ ID NO: 781936 - RNA, 12 nt, Homo sapiens
ggucuguaauau

SEQ ID NO: 781937 - RNA, 15 nt, Homo sapiens
ggucuguuggggucu

SEQ ID NO: 781938 - RNA, 15 nt, Homo sapiens
ggucuuaucuguuca

SEQ ID NO: 781939 - RNA, 12 nt, Homo sapiens
ggucuucaagac

SEQ ID NO: 781940 - RNA, 11 nt, Homo sapiens
ggucuugacuc

SEQ ID NO: 781941 - RNA, 15 nt, Homo sapiens
ggucuugccaugugc

SEQ ID NO: 781942 - RNA, 12 nt, Homo sapiens
ggucuuugcucc

SEQ ID NO: 781943 - RNA, 14 nt, Homo sapiens
ggucuuugcuccag

SEQ ID NO: 781944 - RNA, 15 nt, Homo sapiens
ggucuuuucuagucu

SEQ ID NO: 781945 - RNA, 18 nt, Homo sapiens
ggugaaaccccgucucua

SEQ ID NO: 781946 - RNA, 19 nt, Homo sapiens
ggugaaaccucaucucuac

SEQ ID NO: 781947 - RNA, 22 nt, Homo sapiens
ggugaaacuaacagauaagcaa

SEQ ID NO: 781948 - RNA, 20 nt, Homo sapiens
ggugaaccuuaguaccuaaa

SEQ ID NO: 781949 - RNA, 14 nt, Homo sapiens
ggugacagagcaag

SEQ ID NO: 781950 - RNA, 20 nt, Homo sapiens
ggugacaguccaaaccacuc

SEQ ID NO: 781951 - RNA, 17 nt, Homo sapiens
ggugaccugcggcagua

SEQ ID NO: 781952 - RNA, 19 nt, Homo sapiens
ggugacuguguaacuuucu

SEQ ID NO: 781953 - RNA, 14 nt, Homo sapiens
ggugagaaagggau

SEQ ID NO: 781954 - RNA, 22 nt, Homo sapiens
ggugagaagcuagaugccccug

SEQ ID NO: 781955 - RNA, 23 nt, Homo sapiens
ggugagaauaagagagucauaaa

SEQ ID NO: 781956 - RNA, 16 nt, Homo sapiens
ggugagagaaguacaa

SEQ ID NO: 781957 - RNA, 19 nt, Homo sapiens
ggugagcagaaguggagcu

SEQ ID NO: 781958 - RNA, 16 nt, Homo sapiens
ggugaggguuggcgcu

SEQ ID NO: 781959 - RNA, 17 nt, Homo sapiens
ggugaguccccuacucc

SEQ ID NO: 781960 - RNA, 14 nt, Homo sapiens
ggugauacccaagu

SEQ ID NO: 781961 - RNA, 19 nt, Homo sapiens
ggugaucuaccugccucag

SEQ ID NO: 781962 - RNA, 17 nt, Homo sapiens
ggugcaagaccuagucc

SEQ ID NO: 781963 - RNA, 20 nt, Homo sapiens
ggugcaggggaagaccaaag

SEQ ID NO: 781964 - RNA, 12 nt, Homo sapiens
ggugcaguccag

SEQ ID NO: 781965 - RNA, 19 nt, Homo sapiens
ggugcauagcaagugaaag

SEQ ID NO: 781966 - RNA, 19 nt, Homo sapiens
ggugccacucccugagcuu

SEQ ID NO: 781967 - RNA, 16 nt, Homo sapiens
ggugcccguauccaga

SEQ ID NO: 781968 - RNA, 19 nt, Homo sapiens
ggugcccuuuggggucccg

SEQ ID NO: 781969 - RNA, 17 nt, Homo sapiens
ggugccgcucucucuga

SEQ ID NO: 781970 - RNA, 18 nt, Homo sapiens
ggugccgcucucucugag

SEQ ID NO: 781971 - RNA, 17 nt, Homo sapiens
ggugccgcugucucuga

SEQ ID NO: 781972 - RNA, 18 nt, Homo sapiens
ggugccgcuuucucugag

SEQ ID NO: 781973 - RNA, 19 nt, Homo sapiens
ggugcgcucaccucagagc

SEQ ID NO: 781974 - RNA, 12 nt, Homo sapiens
ggugcguggcug

SEQ ID NO: 781975 - RNA, 20 nt, Homo sapiens
ggugcuaucgcaccacugug

SEQ ID NO: 781976 - RNA, 14 nt, Homo sapiens
ggugcuccaucucc

SEQ ID NO: 781977 - RNA, 14 nt, Homo sapiens
ggugcucucucuga

SEQ ID NO: 781978 - RNA, 17 nt, Homo sapiens
ggugcucuuucccuuua

SEQ ID NO: 781979 - RNA, 20 nt, Homo sapiens
ggugcuggaagucuccauga

SEQ ID NO: 781980 - RNA, 16 nt, Homo sapiens
gguggaagaccuggac

SEQ ID NO: 781981 - RNA, 22 nt, Homo sapiens
gguggaaugccgcugucucuga

SEQ ID NO: 781982 - RNA, 22 nt, Homo sapiens
gguggacuucaguguguguauu

SEQ ID NO: 781983 - RNA, 18 nt, Homo sapiens
gguggagaagaucgcaug

SEQ ID NO: 781984 - RNA, 17 nt, Homo sapiens
gguggagauugcaguga

SEQ ID NO: 781985 - RNA, 19 nt, Homo sapiens
gguggagccaaguggucca

SEQ ID NO: 781986 - RNA, 23 nt, Homo sapiens
gguggagggaaggauaaagccac

SEQ ID NO: 781987 - RNA, 20 nt, Homo sapiens
gguggaggguggggggcgcu

SEQ ID NO: 781988 - RNA, 17 nt, Homo sapiens
gguggagguugcaguga

SEQ ID NO: 781989 - RNA, 21 nt, Homo sapiens
gguggaugaggagacagaaua

SEQ ID NO: 781990 - RNA, 12 nt, Homo sapiens
gguggcaauaaa

SEQ ID NO: 781991 - RNA, 19 nt, Homo sapiens
gguggcacucaacucugag

SEQ ID NO: 781992 - RNA, 13 nt, Homo sapiens
gguggcagccagg

SEQ ID NO: 781993 - RNA, 18 nt, Homo sapiens
gguggcccgguugaacuc

SEQ ID NO: 781994 - RNA, 15 nt, Homo sapiens
gguggcccugugccu

SEQ ID NO: 781995 - RNA, 17 nt, Homo sapiens
gguggcccuugcaguuc

SEQ ID NO: 781996 - RNA, 19 nt, Homo sapiens
gguggccgcugaguggcag

SEQ ID NO: 781997 - RNA, 14 nt, Homo sapiens
gguggccugggauc

SEQ ID NO: 781998 - RNA, 15 nt, Homo sapiens
gguggcgcgcaccug

SEQ ID NO: 781999 - RNA, 20 nt, Homo sapiens
gguggcgguggaccaaagga

SEQ ID NO: 782000 - RNA, 22 nt, Homo sapiens
gguggcugccucauuuagagag

SEQ ID NO: 782001 - RNA, 16 nt, Homo sapiens
ggugggacuccagcuc

SEQ ID NO: 782002 - RNA, 16 nt, Homo sapiens
ggugggggugcucucu

SEQ ID NO: 782003 - RNA, 19 nt, Homo sapiens
ggugggggugcugcucucu

SEQ ID NO: 782004 - RNA, 20 nt, Homo sapiens
ggugguauguaauuuaugca

SEQ ID NO: 782005 - RNA, 16 nt, Homo sapiens
gguggugcaccacugu

SEQ ID NO: 782006 - RNA, 15 nt, Homo sapiens
uauauucucagugua

SEQ ID NO: 782007 - RNA, 22 nt, Homo sapiens
uauauugggugugaguucaggu

SEQ ID NO: 782008 - RNA, 23 nt, Homo sapiens
uauauugugaacccuagcugugu

SEQ ID NO: 782009 - RNA, 19 nt, Homo sapiens
uauauuguuuucaguguac

SEQ ID NO: 782010 - RNA, 18 nt, Homo sapiens
uauauuuaaauaaaggaa

SEQ ID NO: 782011 - RNA, 20 nt, Homo sapiens
uauauuuauucaucugggag

SEQ ID NO: 782012 - RNA, 14 nt, Homo sapiens
uauauuuguacaaa

SEQ ID NO: 782013 - RNA, 20 nt, Homo sapiens
uauauuugugugugugauau

SEQ ID NO: 782014 - RNA, 16 nt, Homo sapiens
uaucaaaaucacuauc

SEQ ID NO: 782015 - RNA, 11 nt, Homo sapiens
uaucaaagugu

SEQ ID NO: 782016 - RNA, 21 nt, Homo sapiens
uaucaaagugugauauacaaa

SEQ ID NO: 782017 - RNA, 21 nt, Homo sapiens
uaucaaaucagucagugcaaa

SEQ ID NO: 782018 - RNA, 21 nt, Homo sapiens
uaucaaaucuguauauguugu

SEQ ID NO: 782019 - RNA, 15 nt, Homo sapiens
uaucaacauguuauu

SEQ ID NO: 782020 - RNA, 16 nt, Homo sapiens
uaucaaucaguauaau

SEQ ID NO: 782021 - RNA, 18 nt, Homo sapiens
uaucaauuacaacaguga

SEQ ID NO: 782022 - RNA, 16 nt, Homo sapiens
uaucaauuuuucccag

SEQ ID NO: 782023 - RNA, 15 nt, Homo sapiens
uaucaccucauggcc

SEQ ID NO: 782024 - RNA, 19 nt, Homo sapiens
uaucaccucuuaugcacac

SEQ ID NO: 782025 - RNA, 19 nt, Homo sapiens
uaucacuuaaacuugcauc

SEQ ID NO: 782026 - RNA, 15 nt, Homo sapiens
uaucagaauucucag

SEQ ID NO: 782027 - RNA, 16 nt, Homo sapiens
uaucagacaagcacua

SEQ ID NO: 782028 - RNA, 16 nt, Homo sapiens
uaucagagcucuuaau

SEQ ID NO: 782029 - RNA, 17 nt, Homo sapiens
uaucagccuugcuuugg

SEQ ID NO: 782030 - RNA, 14 nt, Homo sapiens
uaucaggggugcau

SEQ ID NO: 782031 - RNA, 20 nt, Homo sapiens
uaucaguauucugacaugua

SEQ ID NO: 782032 - RNA, 20 nt, Homo sapiens
uaucagucuuucuugagcag

SEQ ID NO: 782033 - RNA, 17 nt, Homo sapiens
uaucauaacuauacuug

SEQ ID NO: 782034 - RNA, 19 nt, Homo sapiens
uaucaugaaacacuucuca

SEQ ID NO: 782035 - RNA, 15 nt, Homo sapiens
uaucaugaagcacau

SEQ ID NO: 782036 - RNA, 13 nt, Homo sapiens
uaucauugcuaaa

SEQ ID NO: 782037 - RNA, 19 nt, Homo sapiens
uaucauuuauccuuacauu

SEQ ID NO: 782038 - RNA, 19 nt, Homo sapiens
uauccaaaauaaugaggaa

SEQ ID NO: 782039 - RNA, 13 nt, Homo sapiens
uauccaagacuua

SEQ ID NO: 782040 - RNA, 14 nt, Homo sapiens
uauccaaguuggac

SEQ ID NO: 782041 - RNA, 22 nt, Homo sapiens
uauccacccagcccauucucuc

SEQ ID NO: 782042 - RNA, 15 nt, Homo sapiens
uauccacccucugca

SEQ ID NO: 782043 - RNA, 17 nt, Homo sapiens
uauccagaacaauaagc

SEQ ID NO: 782044 - RNA, 12 nt, Homo sapiens
uauccagaugac

SEQ ID NO: 782045 - RNA, 13 nt, Homo sapiens
uauccaugcaccu

SEQ ID NO: 782046 - RNA, 13 nt, Homo sapiens
uauccaugcaugu

SEQ ID NO: 782047 - RNA, 15 nt, Homo sapiens
uauccaugcaugugc

SEQ ID NO: 782048 - RNA, 21 nt, Homo sapiens
uaucccauggaaccacuaaaa

SEQ ID NO: 782049 - RNA, 15 nt, Homo sapiens
uauccgaacuuuaau

SEQ ID NO: 782050 - RNA, 15 nt, Homo sapiens
uauccuauacugguu

SEQ ID NO: 782051 - RNA, 17 nt, Homo sapiens
uauccuccuguucugaa

SEQ ID NO: 782052 - RNA, 18 nt, Homo sapiens
uauccuccuguucugaaa

SEQ ID NO: 782053 - RNA, 20 nt, Homo sapiens
uauccugcuagcuguagaaa

SEQ ID NO: 782054 - RNA, 13 nt, Homo sapiens
uaucgaucucuua

SEQ ID NO: 782055 - RNA, 22 nt, Homo sapiens
uaucggagacagugaucuccau

SEQ ID NO: 782056 - RNA, 15 nt, Homo sapiens
uaucuaaaaucugcu

SEQ ID NO: 782057 - RNA, 21 nt, Homo sapiens
uaucuaacccucccauggcac

SEQ ID NO: 782058 - RNA, 13 nt, Homo sapiens
uaucuaagacuca

SEQ ID NO: 782059 - RNA, 19 nt, Homo sapiens
uaucuacaguacuuccaga

SEQ ID NO: 782060 - RNA, 15 nt, Homo sapiens
uaucuacauaaggau

SEQ ID NO: 782061 - RNA, 12 nt, Homo sapiens
uaucuaccccag

SEQ ID NO: 782062 - RNA, 19 nt, Homo sapiens
uaucuaguaugaaauuaua

SEQ ID NO: 782063 - RNA, 16 nt, Homo sapiens
uaucuaguguguccug

SEQ ID NO: 782064 - RNA, 19 nt, Homo sapiens
uaucuaguguguccuguga

SEQ ID NO: 782065 - RNA, 14 nt, Homo sapiens
uaucuauuaucuca

SEQ ID NO: 782066 - RNA, 19 nt, Homo sapiens
uaucuauuaucucaauuua

SEQ ID NO: 782067 - RNA, 22 nt, Homo sapiens
uaucucaggggccaacuaggca

SEQ ID NO: 782068 - RNA, 23 nt, Homo sapiens
uaucucauuuuacacaaagggaa

SEQ ID NO: 782069 - RNA, 16 nt, Homo sapiens
uaucuccagugcauua

SEQ ID NO: 782070 - RNA, 23 nt, Homo sapiens
uaucuccugacagaaggugccac

SEQ ID NO: 782071 - RNA, 16 nt, Homo sapiens
uaucugaaaugugaua

SEQ ID NO: 782072 - RNA, 22 nt, Homo sapiens
uaucugugaaaugcuggcauuu

SEQ ID NO: 782073 - RNA, 14 nt, Homo sapiens
uaucugugaacaug

SEQ ID NO: 782074 - RNA, 21 nt, Homo sapiens
uaucuguuuuuauuagccaau

SEQ ID NO: 782075 - RNA, 17 nt, Homo sapiens
uaucuucaaacuuucac

SEQ ID NO: 782076 - RNA, 20 nt, Homo sapiens
uaucuuccagaaacuacaug

SEQ ID NO: 782077 - RNA, 14 nt, Homo sapiens
uaucuucuacugua

SEQ ID NO: 782078 - RNA, 22 nt, Homo sapiens
uaucuugaaacauagagaucua

SEQ ID NO: 782079 - RNA, 16 nt, Homo sapiens
uaucuugcaccccaaa

SEQ ID NO: 782080 - RNA, 17 nt, Homo sapiens
uaucuuggacaaaucac

SEQ ID NO: 782081 - RNA, 15 nt, Homo sapiens
uaucuuguagcuuua

SEQ ID NO: 782082 - RNA, 14 nt, Homo sapiens
uaucuuucgugaua

SEQ ID NO: 782083 - RNA, 19 nt, Homo sapiens
uaugaaaaaucaaugucaa

SEQ ID NO: 782084 - RNA, 20 nt, Homo sapiens
uaugaaaacagcuaucucac

SEQ ID NO: 782085 - RNA, 16 nt, Homo sapiens
uaugaaaacuagcauu

SEQ ID NO: 782086 - RNA, 19 nt, Homo sapiens
uaugaaaauacaacuuaaa

SEQ ID NO: 782087 - RNA, 15 nt, Homo sapiens
uaugaaaaucuccau

SEQ ID NO: 782088 - RNA, 20 nt, Homo sapiens
uaugaaaaucuccaucucaa

SEQ ID NO: 782089 - RNA, 23 nt, Homo sapiens
uaugaaccuauuuucauuuguac

SEQ ID NO: 782090 - RNA, 17 nt, Homo sapiens
uaugaagaaaaaguaca

SEQ ID NO: 782091 - RNA, 21 nt, Homo sapiens
uaugaaggauuacucuccaua

SEQ ID NO: 782092 - RNA, 22 nt, Homo sapiens
uaugaaguugcaaugcuucaca

SEQ ID NO: 782093 - RNA, 21 nt, Homo sapiens
uaugaaugaacaaaccuguga

SEQ ID NO: 782094 - RNA, 19 nt, Homo sapiens
uaugacacugagcaagauc

SEQ ID NO: 782095 - RNA, 16 nt, Homo sapiens
uaugacauuacuguau

SEQ ID NO: 782096 - RNA, 16 nt, Homo sapiens
uaugacuccauucaaa

SEQ ID NO: 782097 - RNA, 14 nt, Homo sapiens
uaugacugcaccaa

SEQ ID NO: 782098 - RNA, 19 nt, Homo sapiens
uaugacuguaucuugauau

SEQ ID NO: 782099 - RNA, 22 nt, Homo sapiens
uaugacuguuuuuguaguggua

SEQ ID NO: 782100 - RNA, 17 nt, Homo sapiens
uaugagaauauaccuua

SEQ ID NO: 782101 - RNA, 23 nt, Homo sapiens
uaugagacguuuuuggaagagua

SEQ ID NO: 782102 - RNA, 22 nt, Homo sapiens
uaugagaugguuaaaaaggcca

SEQ ID NO: 782103 - RNA, 18 nt, Homo sapiens
uaugagccaggcaucaua

SEQ ID NO: 782104 - RNA, 18 nt, Homo sapiens
caaauacaaucagcccag

SEQ ID NO: 782105 - RNA, 21 nt, Homo sapiens
caaauacuguauauucaggac

SEQ ID NO: 782106 - RNA, 20 nt, Homo sapiens
caaauaggagggagacugug

SEQ ID NO: 782107 - RNA, 21 nt, Homo sapiens
caaauaggagggagacugugg

SEQ ID NO: 782108 - RNA, 16 nt, Homo sapiens
caaauauauuuuggaa

SEQ ID NO: 782109 - RNA, 21 nt, Homo sapiens
caaauaugcaaagcacugacu

SEQ ID NO: 782110 - RNA, 21 nt, Homo sapiens
caaauauggggaaaaaacugu

SEQ ID NO: 782111 - RNA, 17 nt, Homo sapiens
caaauauucuccauggg

SEQ ID NO: 782112 - RNA, 20 nt, Homo sapiens
caaauauuguaaaacuuugg

SEQ ID NO: 782113 - RNA, 17 nt, Homo sapiens
caaauauuucugauacu

SEQ ID NO: 782114 - RNA, 20 nt, Homo sapiens
caaaucagaccuggcugcuu

SEQ ID NO: 782115 - RNA, 21 nt, Homo sapiens
caaaucagcugcuacuacucc

SEQ ID NO: 782116 - RNA, 12 nt, Homo sapiens
caaauccagugg

SEQ ID NO: 782117 - RNA, 22 nt, Homo sapiens
caaaucccaagcaucauaucau

SEQ ID NO: 782118 - RNA, 17 nt, Homo sapiens
caaauccucccuacuuc

SEQ ID NO: 782119 - RNA, 23 nt, Homo sapiens
caaauccuggaaggacacaguga

SEQ ID NO: 782120 - RNA, 22 nt, Homo sapiens
caaaucguccagcgaccuuccu

SEQ ID NO: 782121 - RNA, 22 nt, Homo sapiens
caaaucguggcacguauugcug

SEQ ID NO: 782122 - RNA, 22 nt, Homo sapiens
caaaucuaaaauuuaaaauuaa

SEQ ID NO: 782123 - RNA, 19 nt, Homo sapiens
caaaucuguaaucagcaau

SEQ ID NO: 782124 - RNA, 20 nt, Homo sapiens
caaaucuguccucuguagua

SEQ ID NO: 782125 - RNA, 11 nt, Homo sapiens
caaaugagauc

SEQ ID NO: 782126 - RNA, 20 nt, Homo sapiens
caaaugagccauccccaggg

SEQ ID NO: 782127 - RNA, 18 nt, Homo sapiens
caaaugcacaucucaugg

SEQ ID NO: 782128 - RNA, 20 nt, Homo sapiens
caaaugccaaaauucauuca

SEQ ID NO: 782129 - RNA, 22 nt, Homo sapiens
caaaugccaaacacuagcucug

SEQ ID NO: 782130 - RNA, 18 nt, Homo sapiens
caaaugcuuucaguaaua

SEQ ID NO: 782131 - RNA, 13 nt, Homo sapiens
caaauggacauaa

SEQ ID NO: 782132 - RNA, 19 nt, Homo sapiens
caaauggacauaggacuca

SEQ ID NO: 782133 - RNA, 13 nt, Homo sapiens
caaauggggccag

SEQ ID NO: 782134 - RNA, 19 nt, Homo sapiens
caaauggggccagauccag

SEQ ID NO: 782135 - RNA, 15 nt, Homo sapiens
caaaugggugcccgu

SEQ ID NO: 782136 - RNA, 20 nt, Homo sapiens
caaaugguggguacaaaaag

SEQ ID NO: 782137 - RNA, 11 nt, Homo sapiens
caaaugugcug

SEQ ID NO: 782138 - RNA, 13 nt, Homo sapiens
caaaugugcugcu

SEQ ID NO: 782139 - RNA, 20 nt, Homo sapiens
caaaugugcuggucacccuu

SEQ ID NO: 782140 - RNA, 17 nt, Homo sapiens
caaauguuuugacauga

SEQ ID NO: 782141 - RNA, 19 nt, Homo sapiens
caaauguuuugacaugaaa

SEQ ID NO: 782142 - RNA, 20 nt, Homo sapiens
caaauuaaaacaaauauaca

SEQ ID NO: 782143 - RNA, 19 nt, Homo sapiens
caaauuaacuagauacaga

SEQ ID NO: 782144 - RNA, 15 nt, Homo sapiens
caaauuaaggcauaa

SEQ ID NO: 782145 - RNA, 16 nt, Homo sapiens
caaauuauugauuaau

SEQ ID NO: 782146 - RNA, 13 nt, Homo sapiens
caaauucauggca

SEQ ID NO: 782147 - RNA, 22 nt, Homo sapiens
caaauucauuuuuuucacugga

SEQ ID NO: 782148 - RNA, 22 nt, Homo sapiens
caaauucgcugcaaccuguuga

SEQ ID NO: 782149 - RNA, 18 nt, Homo sapiens
caaauucuuuaguacuca

SEQ ID NO: 782150 - RNA, 14 nt, Homo sapiens
caaauugcuuuaca

SEQ ID NO: 782151 - RNA, 23 nt, Homo sapiens
caaauuggaauggaacuacugua

SEQ ID NO: 782152 - RNA, 19 nt, Homo sapiens
caaauuggugaacagugua

SEQ ID NO: 782153 - RNA, 20 nt, Homo sapiens
caaauuuaugcauuucauuc

SEQ ID NO: 782154 - RNA, 11 nt, Homo sapiens
caaauuugaug

SEQ ID NO: 782155 - RNA, 16 nt, Homo sapiens
caaauuuuucuaucaa

SEQ ID NO: 782156 - RNA, 14 nt, Homo sapiens
caacaaaaagaaca

SEQ ID NO: 782157 - RNA, 21 nt, Homo sapiens
caacaaagauugagaagccau

SEQ ID NO: 782158 - RNA, 19 nt, Homo sapiens
caacaaagccaacagucaa

SEQ ID NO: 782159 - RNA, 16 nt, Homo sapiens
caacaacaaaaaaccu

SEQ ID NO: 782160 - RNA, 13 nt, Homo sapiens
caacaacucugau

SEQ ID NO: 782161 - RNA, 21 nt, Homo sapiens
caacaaggaagagcugcucac

SEQ ID NO: 782162 - RNA, 14 nt, Homo sapiens
caacaauccaaaaa

SEQ ID NO: 782163 - RNA, 17 nt, Homo sapiens
caacaauccaucucuca

SEQ ID NO: 782164 - RNA, 21 nt, Homo sapiens
caacaaugugaggggucccua

SEQ ID NO: 782165 - RNA, 21 nt, Homo sapiens
caacacaauucuucuuccaac

SEQ ID NO: 782166 - RNA, 21 nt, Homo sapiens
caacacagagcugaguccucu

SEQ ID NO: 782167 - RNA, 12 nt, Homo sapiens
caacacccaaag

SEQ ID NO: 782168 - RNA, 17 nt, Homo sapiens
caacacccaaagcaugg

SEQ ID NO: 782169 - RNA, 15 nt, Homo sapiens
caacaccccacugag

SEQ ID NO: 782170 - RNA, 16 nt, Homo sapiens
caacaccccacugagc

SEQ ID NO: 782171 - RNA, 17 nt, Homo sapiens
caacaccccacugagcc

SEQ ID NO: 782172 - RNA, 22 nt, Homo sapiens
caacacgagcaggcuacuguca

SEQ ID NO: 782173 - RNA, 14 nt, Homo sapiens
caacacucaucaca

SEQ ID NO: 782174 - RNA, 15 nt, Homo sapiens
caacacugcugucca

SEQ ID NO: 782175 - RNA, 17 nt, Homo sapiens
caacacuguacacauaa

SEQ ID NO: 782176 - RNA, 14 nt, Homo sapiens
caacacugugcacg

SEQ ID NO: 782177 - RNA, 19 nt, Homo sapiens
caacacuguuacuuucgua

SEQ ID NO: 782178 - RNA, 18 nt, Homo sapiens
caacagaaaccagaaaag

SEQ ID NO: 782179 - RNA, 23 nt, Homo sapiens
ggcccuuccucuccacugccuuc

SEQ ID NO: 782180 - RNA, 23 nt, Homo sapiens
ggcccuuccucuuugguggcaug

SEQ ID NO: 782181 - RNA, 22 nt, Homo sapiens
ggccgccagcguguggagcaga

SEQ ID NO: 782182 - RNA, 22 nt, Homo sapiens
ggccggaguaggagcacugggg

SEQ ID NO: 782183 - RNA, 16 nt, Homo sapiens
ggccggcccugugugc

SEQ ID NO: 782184 - RNA, 18 nt, Homo sapiens
ggccgggcugcugcugau

SEQ ID NO: 782185 - RNA, 22 nt, Homo sapiens
ggccggggcccugcaccugugc

SEQ ID NO: 782186 - RNA, 13 nt, Homo sapiens
ggccgugcagugg

SEQ ID NO: 782187 - RNA, 14 nt, Homo sapiens
ggccuacagcuuug

SEQ ID NO: 782188 - RNA, 24 nt, Homo sapiens
ggccuaggcuaccucaagacucac

SEQ ID NO: 782189 - RNA, 13 nt, Homo sapiens
ggccuaugcacau

SEQ ID NO: 782190 - RNA, 17 nt, Homo sapiens
ggccuccaaacacagau

SEQ ID NO: 782191 - RNA, 15 nt, Homo sapiens
ggccuccauguccuc

SEQ ID NO: 782192 - RNA, 18 nt, Homo sapiens
ggcuugagucaccaugcc

SEQ ID NO: 782193 - RNA, 16 nt, Homo sapiens
ggcuugauauuuucca

SEQ ID NO: 782194 - RNA, 22 nt, Homo sapiens
ggcuuuaauacaaaaagcaaaa

SEQ ID NO: 782195 - RNA, 20 nt, Homo sapiens
ggcuuuaauagucaccuuca

SEQ ID NO: 782196 - RNA, 9 nt, Homo sapiens
ggcuuuaug

SEQ ID NO: 782197 - RNA, 13 nt, Homo sapiens
ggcuuuaugcaaa

SEQ ID NO: 782198 - RNA, 15 nt, Homo sapiens
ggcuuucagagccag

SEQ ID NO: 782199 - RNA, 14 nt, Homo sapiens
ggcuuuccugguuc

SEQ ID NO: 782200 - RNA, 22 nt, Homo sapiens
ggcuuugcuacccauuuacaaa

SEQ ID NO: 782201 - RNA, 19 nt, Homo sapiens
ggcuuuguaugacagugaa

SEQ ID NO: 782202 - RNA, 15 nt, Homo sapiens
ggcuuuucacacggg

SEQ ID NO: 782203 - RNA, 15 nt, Homo sapiens
ggcuuuucacauggg

SEQ ID NO: 782204 - RNA, 18 nt, Homo sapiens
ggcuuuuccaaugaugaa

SEQ ID NO: 782205 - RNA, 21 nt, Homo sapiens
gggaaaaguuagucaauccug

SEQ ID NO: 782206 - RNA, 16 nt, Homo sapiens
gggaaacacacaagca

SEQ ID NO: 782207 - RNA, 22 nt, Homo sapiens
gggaaaccaguguagccuugcc

SEQ ID NO: 782208 - RNA, 18 nt, Homo sapiens
gggaaagcuucauucucc

SEQ ID NO: 782209 - RNA, 18 nt, Homo sapiens
gggaaaggaaucagagag

SEQ ID NO: 782210 - RNA, 13 nt, Homo sapiens
gggaaccauuuca

SEQ ID NO: 782211 - RNA, 20 nt, Homo sapiens
gggaaccggcagcaucccag

SEQ ID NO: 782212 - RNA, 22 nt, Homo sapiens
gggaacgaggggaaaguucuca

SEQ ID NO: 782213 - RNA, 13 nt, Homo sapiens
gggaacucuccaa

SEQ ID NO: 782214 - RNA, 23 nt, Homo sapiens
gggaacuuuuuuagaaaugcaaa

SEQ ID NO: 782215 - RNA, 14 nt, Homo sapiens
gggaagaaacacuc

SEQ ID NO: 782216 - RNA, 14 nt, Homo sapiens
gggaagacuguggc

SEQ ID NO: 782217 - RNA, 21 nt, Homo sapiens
gggaagaguggucuugagggg

SEQ ID NO: 782218 - RNA, 16 nt, Homo sapiens
gggaagcagccagcuc

SEQ ID NO: 782219 - RNA, 20 nt, Homo sapiens
gggaagcggagcuugcagug

SEQ ID NO: 782220 - RNA, 23 nt, Homo sapiens
gggaagcuggcuuucuggcugcu

SEQ ID NO: 782221 - RNA, 22 nt, Homo sapiens
gggaagggggcuguguguccuu

SEQ ID NO: 782222 - RNA, 14 nt, Homo sapiens
gggaaguaacagac

SEQ ID NO: 782223 - RNA, 13 nt, Homo sapiens
gggacacagcagu

SEQ ID NO: 782224 - RNA, 18 nt, Homo sapiens
gggacacugcgggacaga

SEQ ID NO: 782225 - RNA, 18 nt, Homo sapiens
gggacauagccagcauuu

SEQ ID NO: 782226 - RNA, 16 nt, Homo sapiens
gggaccacaccucccu

SEQ ID NO: 782227 - RNA, 13 nt, Homo sapiens
gggaccacugggu

SEQ ID NO: 782228 - RNA, 17 nt, Homo sapiens
gggaccucacccuggag

SEQ ID NO: 782229 - RNA, 21 nt, Homo sapiens
gggaccucaccugcuggggac

SEQ ID NO: 782230 - RNA, 21 nt, Homo sapiens
gggaccucgccugcuggggac

SEQ ID NO: 782231 - RNA, 15 nt, Homo sapiens
gggacuaggaccuga

SEQ ID NO: 782232 - RNA, 15 nt, Homo sapiens
gggacuugggucuca

SEQ ID NO: 782233 - RNA, 13 nt, Homo sapiens
gggagaacgggaa

SEQ ID NO: 782234 - RNA, 14 nt, Homo sapiens
gggagaaggcauga

SEQ ID NO: 782235 - RNA, 20 nt, Homo sapiens
gggagacacuggccccucaa

SEQ ID NO: 782236 - RNA, 23 nt, Homo sapiens
gggagacugacacgaagccagca

SEQ ID NO: 782237 - RNA, 17 nt, Homo sapiens
gggagacugcaucucaa

SEQ ID NO: 782238 - RNA, 16 nt, Homo sapiens
gggagagacugugagg

SEQ ID NO: 782239 - RNA, 19 nt, Homo sapiens
gggagccaaaggcauccag

SEQ ID NO: 782240 - RNA, 20 nt, Homo sapiens
gggagccuaaggaagcgugg

SEQ ID NO: 782241 - RNA, 18 nt, Homo sapiens
gggagcgacacuugaaug

SEQ ID NO: 782242 - RNA, 21 nt, Homo sapiens
gggaggaggccaccucuccaa

SEQ ID NO: 782243 - RNA, 17 nt, Homo sapiens
gggaggcacacuuucug

SEQ ID NO: 782244 - RNA, 16 nt, Homo sapiens
gggaggucagugcuuc

SEQ ID NO: 782245 - RNA, 15 nt, Homo sapiens
gggaguccagggugg

SEQ ID NO: 782246 - RNA, 24 nt, Homo sapiens
gggaguccaggguggaugaucuca

SEQ ID NO: 782247 - RNA, 18 nt, Homo sapiens
gggagugcucaccgccuc

SEQ ID NO: 782248 - RNA, 15 nt, Homo sapiens
gggaguguggcuccu

SEQ ID NO: 782249 - RNA, 14 nt, Homo sapiens
gggaguguguaauu

SEQ ID NO: 782250 - RNA, 23 nt, Homo sapiens
gggauacuuagugguaugucucu

SEQ ID NO: 782251 - RNA, 17 nt, Homo sapiens
gggauccguacauucaa

SEQ ID NO: 782252 - RNA, 20 nt, Homo sapiens
gggaugaggucaccagggga

SEQ ID NO: 782253 - RNA, 20 nt, Homo sapiens
gggaugcagggggaggcagc

SEQ ID NO: 782254 - RNA, 20 nt, Homo sapiens
gggaugcugggcugggcccu

SEQ ID NO: 782255 - RNA, 14 nt, Homo sapiens
gggauguugaacug

SEQ ID NO: 782256 - RNA, 23 nt, Homo sapiens
gggauucacaaggugaagaacug

SEQ ID NO: 782257 - RNA, 15 nt, Homo sapiens
gggauucaggcugcu

SEQ ID NO: 782258 - RNA, 16 nt, Homo sapiens
gggcaagucccugacu

SEQ ID NO: 782259 - RNA, 11 nt, Homo sapiens
gggcacggugg

SEQ ID NO: 782260 - RNA, 22 nt, Homo sapiens
gggcacugagcccuucccaggc

SEQ ID NO: 782261 - RNA, 13 nt, Homo sapiens
gggcacugguggc

SEQ ID NO: 782262 - RNA, 22 nt, Homo sapiens
gggcacuuuaagucagugacag

SEQ ID NO: 782263 - RNA, 15 nt, Homo sapiens
gggcagaucaccaga

SEQ ID NO: 782264 - RNA, 20 nt, Homo sapiens
gggcagcaaaacgacacugc

SEQ ID NO: 782265 - RNA, 17 nt, Homo sapiens
gggcagcauagcaagac

SEQ ID NO: 782266 - RNA, 16 nt, Homo sapiens
gggcagccgccaagag

SEQ ID NO: 782267 - RNA, 14 nt, Homo sapiens
gggcagcuugcccc

SEQ ID NO: 782268 - RNA, 20 nt, Homo sapiens
gggcaggagggcccuaccug

SEQ ID NO: 782269 - RNA, 22 nt, Homo sapiens
gggcaggcaagguuuacacugc

SEQ ID NO: 782270 - RNA, 16 nt, Homo sapiens
gggcaggcugggccau

SEQ ID NO: 782271 - RNA, 16 nt, Homo sapiens
gggcagggcccacgug

SEQ ID NO: 782272 - RNA, 22 nt, Homo sapiens
gggcagggcuggcaccucucaa

SEQ ID NO: 782273 - RNA, 11 nt, Homo sapiens
gggcaggguga

SEQ ID NO: 782274 - RNA, 22 nt, Homo sapiens
gggcauagaucagaagacuaca

SEQ ID NO: 782275 - RNA, 19 nt, Homo sapiens
gggcauccugugccacuaa

SEQ ID NO: 782276 - RNA, 11 nt, Homo sapiens
gggcaucucaa

SEQ ID NO: 782277 - RNA, 18 nt, Homo sapiens
gggcaugaagcugcauau

SEQ ID NO: 782278 - RNA, 15 nt, Homo sapiens
gggcaugccaugucu

SEQ ID NO: 782279 - RNA, 16 nt, Homo sapiens
gggccaaagcacagcu

SEQ ID NO: 782280 - RNA, 14 nt, Homo sapiens
gggccacccagcca

SEQ ID NO: 782281 - RNA, 22 nt, Homo sapiens
gggccacucaggggucauucau

SEQ ID NO: 782282 - RNA, 12 nt, Homo sapiens
gggccagcacuu

SEQ ID NO: 782283 - RNA, 24 nt, Homo sapiens
gggccaugcagaccucaugcccag

SEQ ID NO: 782284 - RNA, 14 nt, Homo sapiens
gggccauguccaaa

SEQ ID NO: 782285 - RNA, 21 nt, Homo sapiens
gggcccaaauucuuucagugg

SEQ ID NO: 782286 - RNA, 14 nt, Homo sapiens
gggcccacguguau

SEQ ID NO: 782287 - RNA, 18 nt, Homo sapiens
gggcccagaccacugucu

SEQ ID NO: 782288 - RNA, 18 nt, Homo sapiens
gggccccgaaugucacug

SEQ ID NO: 782289 - RNA, 15 nt, Homo sapiens
gggcccuuucaucuu

SEQ ID NO: 782290 - RNA, 22 nt, Homo sapiens
gggccgaauccccucccuguca

SEQ ID NO: 782291 - RNA, 15 nt, Homo sapiens
gggccggaaggaaug

SEQ ID NO: 782292 - RNA, 14 nt, Homo sapiens
gggccucugcauuu

SEQ ID NO: 782293 - RNA, 16 nt, Homo sapiens
gggccugcagaaggaa

SEQ ID NO: 782294 - RNA, 23 nt, Homo sapiens
gcucguuuccccacacaugccua

SEQ ID NO: 782295 - RNA, 15 nt, Homo sapiens
gcucuaaaguagcaa

SEQ ID NO: 782296 - RNA, 19 nt, Homo sapiens
gcucuacccugaguucaua

SEQ ID NO: 782297 - RNA, 23 nt, Homo sapiens
gcucuaugggguucguuaugcca

SEQ ID NO: 782298 - RNA, 15 nt, Homo sapiens
gcucuauguuuacaa

SEQ ID NO: 782299 - RNA, 22 nt, Homo sapiens
gcucuccaccacccaacccaaa

SEQ ID NO: 782300 - RNA, 18 nt, Homo sapiens
gcucucccaacucuugca

SEQ ID NO: 782301 - RNA, 21 nt, Homo sapiens
gcucuccccaggcauuugcca

SEQ ID NO: 782302 - RNA, 14 nt, Homo sapiens
gcucucccuaccuu

SEQ ID NO: 782303 - RNA, 22 nt, Homo sapiens
gcucucuaaaugggaauucuca

SEQ ID NO: 782304 - RNA, 15 nt, Homo sapiens
gcucucucucgcugc

SEQ ID NO: 782305 - RNA, 21 nt, Homo sapiens
gcucucugggccuggguucca

SEQ ID NO: 782306 - RNA, 17 nt, Homo sapiens
gcucucuguaucagucu

SEQ ID NO: 782307 - RNA, 20 nt, Homo sapiens
gcucugagacccuuuucuca

SEQ ID NO: 782308 - RNA, 21 nt, Homo sapiens
gcucugagacccuuuucucag

SEQ ID NO: 782309 - RNA, 21 nt, Homo sapiens
gcucugagagucuagauucuc

SEQ ID NO: 782310 - RNA, 19 nt, Homo sapiens
gcucugcaggccacuguga

SEQ ID NO: 782311 - RNA, 22 nt, Homo sapiens
gcucugcccugcccuagcucca

SEQ ID NO: 782312 - RNA, 16 nt, Homo sapiens
gcucugccuguggagu

SEQ ID NO: 782313 - RNA, 19 nt, Homo sapiens
gcucuggcaccaucagccu

SEQ ID NO: 782314 - RNA, 13 nt, Homo sapiens
gcucugggccuga

SEQ ID NO: 782315 - RNA, 23 nt, Homo sapiens
caacagaaaccagaaaagcaaua

SEQ ID NO: 782316 - RNA, 15 nt, Homo sapiens
caacagacuguugag

SEQ ID NO: 782317 - RNA, 22 nt, Homo sapiens
caacagagaggaccaacaucca

SEQ ID NO: 782318 - RNA, 13 nt, Homo sapiens
caacagagcaaga

SEQ ID NO: 782319 - RNA, 21 nt, Homo sapiens
caacagagcaagacuccaucu

SEQ ID NO: 782320 - RNA, 19 nt, Homo sapiens
caacagagcgagauuccau

SEQ ID NO: 782321 - RNA, 14 nt, Homo sapiens
caacagaucugcag

SEQ ID NO: 782322 - RNA, 14 nt, Homo sapiens
caacagauucagaa

SEQ ID NO: 782323 - RNA, 14 nt, Homo sapiens
caacagcaaaggaa

SEQ ID NO: 782324 - RNA, 22 nt, Homo sapiens
caacagccaugcccgcauuagc

SEQ ID NO: 782325 - RNA, 16 nt, Homo sapiens
caacagcgcuuuaaaa

SEQ ID NO: 782326 - RNA, 19 nt, Homo sapiens
caacagcuacagucuaaaa

SEQ ID NO: 782327 - RNA, 11 nt, Homo sapiens
caacaggaaau

SEQ ID NO: 782328 - RNA, 14 nt, Homo sapiens
caacaggaaggaac

SEQ ID NO: 782329 - RNA, 22 nt, Homo sapiens
caacaggcaguggaagcaguuu

SEQ ID NO: 782330 - RNA, 18 nt, Homo sapiens
caacaguggaauucaccu

SEQ ID NO: 782331 - RNA, 20 nt, Homo sapiens
caacauauauuuauugagua

SEQ ID NO: 782332 - RNA, 16 nt, Homo sapiens
caacaucgcaauaguu

SEQ ID NO: 782333 - RNA, 15 nt, Homo sapiens
caacauggcuuucuu

SEQ ID NO: 782334 - RNA, 23 nt, Homo sapiens
caacauggugaaaccucaucucu

SEQ ID NO: 782335 - RNA, 20 nt, Homo sapiens
caacauguuacugaccagca

SEQ ID NO: 782336 - RNA, 17 nt, Homo sapiens
caacauuaaacacaaag

SEQ ID NO: 782337 - RNA, 16 nt, Homo sapiens
caacauuccacagcug

SEQ ID NO: 782338 - RNA, 19 nt, Homo sapiens
caacauuccacagcugccc

SEQ ID NO: 782339 - RNA, 19 nt, Homo sapiens
caacauuucucacugaaag

SEQ ID NO: 782340 - RNA, 18 nt, Homo sapiens
caacauuuguuccaugag

SEQ ID NO: 782341 - RNA, 14 nt, Homo sapiens
caaccaagucacac

SEQ ID NO: 782342 - RNA, 20 nt, Homo sapiens
caaccaauuccaaguuuuaa

SEQ ID NO: 782343 - RNA, 21 nt, Homo sapiens
caaccacuguaaaaugaaauu

SEQ ID NO: 782344 - RNA, 12 nt, Homo sapiens
caaccacugugg

SEQ ID NO: 782345 - RNA, 14 nt, Homo sapiens
caaccagagcagcu

SEQ ID NO: 782346 - RNA, 20 nt, Homo sapiens
caaccagccuuuggguccug

SEQ ID NO: 782347 - RNA, 14 nt, Homo sapiens
caaccaggccuuca

SEQ ID NO: 782348 - RNA, 22 nt, Homo sapiens
caaccaguuuauccaccaagaa

SEQ ID NO: 782349 - RNA, 20 nt, Homo sapiens
caaccauaaaauugucauaa

SEQ ID NO: 782350 - RNA, 13 nt, Homo sapiens
caacccaaaccau

SEQ ID NO: 782351 - RNA, 18 nt, Homo sapiens
caacccagccaugcaaug

SEQ ID NO: 782352 - RNA, 12 nt, Homo sapiens
caaccccagugg

SEQ ID NO: 782353 - RNA, 17 nt, Homo sapiens
caaccccugcuccaguc

SEQ ID NO: 782354 - RNA, 18 nt, Homo sapiens
caacccuaucuccugaca

SEQ ID NO: 782355 - RNA, 22 nt, Homo sapiens
caacccuuccugcugcugcuac

SEQ ID NO: 782356 - RNA, 21 nt, Homo sapiens
caaccgaaucucaauguacau

SEQ ID NO: 782357 - RNA, 20 nt, Homo sapiens
caaccucaaugcccugccau

SEQ ID NO: 782358 - RNA, 16 nt, Homo sapiens
caaccuuccauucaca

SEQ ID NO: 782359 - RNA, 20 nt, Homo sapiens
caaccuugagaauagcuuua

SEQ ID NO: 782360 - RNA, 15 nt, Homo sapiens
caaccuuguuucuac

SEQ ID NO: 782361 - RNA, 16 nt, Homo sapiens
caacggccgacugccu

SEQ ID NO: 782362 - RNA, 16 nt, Homo sapiens
caacggcuuagacuuc

SEQ ID NO: 782363 - RNA, 17 nt, Homo sapiens
caacgugcgugucucug

SEQ ID NO: 782364 - RNA, 12 nt, Homo sapiens
caacuacccacc

SEQ ID NO: 782365 - RNA, 13 nt, Homo sapiens
caacuacuaauag

SEQ ID NO: 782366 - RNA, 22 nt, Homo sapiens
caacuacuacuggugaugccua

SEQ ID NO: 782367 - RNA, 14 nt, Homo sapiens
caacuagaagccua

SEQ ID NO: 782368 - RNA, 17 nt, Homo sapiens
caacuauauuaucaugc

SEQ ID NO: 782369 - RNA, 14 nt, Homo sapiens
caacuauuuuucca

SEQ ID NO: 782370 - RNA, 20 nt, Homo sapiens
caacuauuuuuccaaaauaa

SEQ ID NO: 782371 - RNA, 15 nt, Homo sapiens
caacucaagggcaca

SEQ ID NO: 782372 - RNA, 20 nt, Homo sapiens
caacucaagggcacauagaa

SEQ ID NO: 782373 - RNA, 20 nt, Homo sapiens
caacucaaugaaaauuuaaa

SEQ ID NO: 782374 - RNA, 19 nt, Homo sapiens
caacuccauguuugguguu

SEQ ID NO: 782375 - RNA, 12 nt, Homo sapiens
caacuccuggaa

SEQ ID NO: 782376 - RNA, 20 nt, Homo sapiens
caacuccugucuaacugcug

SEQ ID NO: 782377 - RNA, 16 nt, Homo sapiens
caacucuccaauguuc

SEQ ID NO: 782378 - RNA, 18 nt, Homo sapiens
caacucuccaauguucua

SEQ ID NO: 782379 - RNA, 17 nt, Homo sapiens
caacucugccuuuauga

SEQ ID NO: 782380 - RNA, 22 nt, Homo sapiens
caacucugccuuuaugaugcua

SEQ ID NO: 782381 - RNA, 22 nt, Homo sapiens
caacucuguaaauauguaugua

SEQ ID NO: 782382 - RNA, 13 nt, Homo sapiens
caacucuugcaca

SEQ ID NO: 782383 - RNA, 22 nt, Homo sapiens
caacucuugugaauuauucuga

SEQ ID NO: 782384 - RNA, 18 nt, Homo sapiens
caacucuuuuaagugccu

SEQ ID NO: 782385 - RNA, 12 nt, Homo sapiens
caacugcaaaaa

SEQ ID NO: 782386 - RNA, 21 nt, Homo sapiens
caacugcaucuccaaacauua

SEQ ID NO: 782387 - RNA, 21 nt, Homo sapiens
caacugcccccgccacaaccc

SEQ ID NO: 782388 - RNA, 15 nt, Homo sapiens
caacugcgacuguga

SEQ ID NO: 782389 - RNA, 21 nt, Homo sapiens
caacugcugcaugucccugug

SEQ ID NO: 782390 - RNA, 22 nt, Homo sapiens
caacugcuguucauguuacuca

SEQ ID NO: 782391 - RNA, 16 nt, Homo sapiens
caacuguggucaaucc

SEQ ID NO: 782392 - RNA, 23 nt, Homo sapiens
caacuguuuuaauaaaagauuua

SEQ ID NO: 782393 - RNA, 16 nt, Homo sapiens
caacuuagagauugca

SEQ ID NO: 782394 - RNA, 17 nt, Homo sapiens
caacuuauuuugcuuua

SEQ ID NO: 782395 - RNA, 17 nt, Homo sapiens
caacuucaguugagagg

SEQ ID NO: 782396 - RNA, 17 nt, Homo sapiens
caacuuccaaaggguua

SEQ ID NO: 782397 - RNA, 21 nt, Homo sapiens
caacuucuuucuguugagaga

SEQ ID NO: 782398 - RNA, 20 nt, Homo sapiens
caacuugaauaauacaccag

SEQ ID NO: 782399 - RNA, 15 nt, Homo sapiens
caacuuuguuuucca

SEQ ID NO: 782400 - RNA, 22 nt, Homo sapiens
caacuuuucuaagaaaagcauu

SEQ ID NO: 782401 - RNA, 14 nt, Homo sapiens
caacuuuugugcuc

SEQ ID NO: 782402 - RNA, 17 nt, Homo sapiens
caacuuuuuguuacaga

SEQ ID NO: 782403 - RNA, 21 nt, Homo sapiens
caacuuuuuguuacagauuaa

SEQ ID NO: 782404 - RNA, 15 nt, Homo sapiens
caagaaaaacaacuu

SEQ ID NO: 782405 - RNA, 17 nt, Homo sapiens
caagaaaaacaucuuug

SEQ ID NO: 782406 - RNA, 23 nt, Homo sapiens
caagaaaacaacuucaauaucca

SEQ ID NO: 782407 - RNA, 22 nt, Homo sapiens
caagaaaaccuagaucugcacu

SEQ ID NO: 782408 - RNA, 19 nt, Homo sapiens
caagaaaaguugaagaaga

SEQ ID NO: 782409 - RNA, 14 nt, Homo sapiens
caagaaagcucacu

SEQ ID NO: 782410 - RNA, 22 nt, Homo sapiens
caagaaagcucacuguagcuuu

SEQ ID NO: 782411 - RNA, 13 nt, Homo sapiens
caagaaaucccug

SEQ ID NO: 782412 - RNA, 16 nt, Homo sapiens
caagaacaaacacugc

SEQ ID NO: 782413 - RNA, 13 nt, Homo sapiens
caagaacacugga

SEQ ID NO: 782414 - RNA, 16 nt, Homo sapiens
caagaaccgguuucca

SEQ ID NO: 782415 - RNA, 21 nt, Homo sapiens
caagaaccuggaaaaauucca

SEQ ID NO: 782416 - RNA, 21 nt, Homo sapiens
caagaacgagaagcagcauuu

SEQ ID NO: 782417 - RNA, 15 nt, Homo sapiens
caagaacucuaacca

SEQ ID NO: 782418 - RNA, 20 nt, Homo sapiens
caagaagcguuaugugcagu

SEQ ID NO: 782419 - RNA, 16 nt, Homo sapiens
caagaaguacugccaa

SEQ ID NO: 782420 - RNA, 18 nt, Homo sapiens
caagaauguuaugugcaa

SEQ ID NO: 782421 - RNA, 20 nt, Homo sapiens
caagacaagacuauaccuua

SEQ ID NO: 782422 - RNA, 22 nt, Homo sapiens
caagacaauucuucuucuucca

SEQ ID NO: 782423 - RNA, 18 nt, Homo sapiens
caagacacaucccuacaa

SEQ ID NO: 782424 - RNA, 22 nt, Homo sapiens
caagacagugccuauacugccu

SEQ ID NO: 782425 - RNA, 18 nt, Homo sapiens
caagacccccagcacuug

SEQ ID NO: 782426 - RNA, 19 nt, Homo sapiens
caagaccucaucucuacua

SEQ ID NO: 782427 - RNA, 15 nt, Homo sapiens
caagacuccaucuca

SEQ ID NO: 782428 - RNA, 19 nt, Homo sapiens
caagacucccagaucagcu

SEQ ID NO: 782429 - RNA, 17 nt, Homo sapiens
gccauaagaaagcacua

SEQ ID NO: 782430 - RNA, 18 nt, Homo sapiens
gccauaagaaagcacuau

SEQ ID NO: 782431 - RNA, 19 nt, Homo sapiens
gccauaauucuaaguuauu

SEQ ID NO: 782432 - RNA, 19 nt, Homo sapiens
gccauagaccuacagaccu

SEQ ID NO: 782433 - RNA, 21 nt, Homo sapiens
gccauauaaguuugaaggaaa

SEQ ID NO: 782434 - RNA, 22 nt, Homo sapiens
gccaucaaacauaauucucuca

SEQ ID NO: 782435 - RNA, 15 nt, Homo sapiens
gccaucaagcacuuc

SEQ ID NO: 782436 - RNA, 14 nt, Homo sapiens
gccaucacuagaag

SEQ ID NO: 782437 - RNA, 14 nt, Homo sapiens
gccauccaccuuca

SEQ ID NO: 782438 - RNA, 20 nt, Homo sapiens
gccauccaugugcuagucac

SEQ ID NO: 782439 - RNA, 16 nt, Homo sapiens
gccauccccaccuuca

SEQ ID NO: 782440 - RNA, 15 nt, Homo sapiens
gccaucgccaaguaa

SEQ ID NO: 782441 - RNA, 23 nt, Homo sapiens
gccaugcagcggccugagcagua

SEQ ID NO: 782442 - RNA, 15 nt, Homo sapiens
gccaugcugggccac

SEQ ID NO: 782443 - RNA, 15 nt, Homo sapiens
gccauguggacuggu

SEQ ID NO: 782444 - RNA, 12 nt, Homo sapiens
gccauguucucc

SEQ ID NO: 782445 - RNA, 16 nt, Homo sapiens
gccauuaugccuggcu

SEQ ID NO: 782446 - RNA, 13 nt, Homo sapiens
gccauuguucacc

SEQ ID NO: 782447 - RNA, 16 nt, Homo sapiens
gccauuucacucucaa

SEQ ID NO: 782448 - RNA, 16 nt, Homo sapiens
gccauuuucagaauca

SEQ ID NO: 782449 - RNA, 15 nt, Homo sapiens
gccauuuuucugggg

SEQ ID NO: 782450 - RNA, 13 nt, Homo sapiens
gcccaaacauaaa

SEQ ID NO: 782451 - RNA, 21 nt, Homo sapiens
gcccaaaugucaggguucugc

SEQ ID NO: 782452 - RNA, 15 nt, Homo sapiens
gcccaacgcaaauuc

SEQ ID NO: 782453 - RNA, 15 nt, Homo sapiens
gcccaagaggucuga

SEQ ID NO: 782454 - RNA, 17 nt, Homo sapiens
gcccaagcuggagugaa

SEQ ID NO: 782455 - RNA, 18 nt, Homo sapiens
gcccaauauaaaaggcaa

SEQ ID NO: 782456 - RNA, 15 nt, Homo sapiens
gcccaauguaaugca

SEQ ID NO: 782457 - RNA, 15 nt, Homo sapiens
gcccacacccaggcc

SEQ ID NO: 782458 - RNA, 22 nt, Homo sapiens
gcccacagcugagaauguggaa

SEQ ID NO: 782459 - RNA, 15 nt, Homo sapiens
gcccacauauucuau

SEQ ID NO: 782460 - RNA, 21 nt, Homo sapiens
gcccacaucccacaugcggcu

SEQ ID NO: 782461 - RNA, 20 nt, Homo sapiens
gcccaccacccuggcaggcu

SEQ ID NO: 782462 - RNA, 15 nt, Homo sapiens
gcccacccccaggaa

SEQ ID NO: 782463 - RNA, 22 nt, Homo sapiens
gcccaccuuccccagaaccagg

SEQ ID NO: 782464 - RNA, 13 nt, Homo sapiens
gcccacgaucccc

SEQ ID NO: 782465 - RNA, 18 nt, Homo sapiens
gcccacugcuggcugcag

SEQ ID NO: 782466 - RNA, 18 nt, Homo sapiens
gcccacuuuccugagcug

SEQ ID NO: 782467 - RNA, 21 nt, Homo sapiens
gcccagacaccaugugcaaua

SEQ ID NO: 782468 - RNA, 15 nt, Homo sapiens
gcccagacccagugg

SEQ ID NO: 782469 - RNA, 16 nt, Homo sapiens
gcccagaggguggcaa

SEQ ID NO: 782470 - RNA, 21 nt, Homo sapiens
gcccagccaaucuagaggcaa

SEQ ID NO: 782471 - RNA, 23 nt, Homo sapiens
gcccagccccuacugcugugaac

SEQ ID NO: 782472 - RNA, 14 nt, Homo sapiens
gcccagcgcggcca

SEQ ID NO: 782473 - RNA, 19 nt, Homo sapiens
gcccagcgguucacacagg

SEQ ID NO: 782474 - RNA, 22 nt, Homo sapiens
gcccagcuuauugugugcgcug

SEQ ID NO: 782475 - RNA, 20 nt, Homo sapiens
gcccaggauggcuuugaaug

SEQ ID NO: 782476 - RNA, 15 nt, Homo sapiens
gcccaggcuggagcu

SEQ ID NO: 782477 - RNA, 18 nt, Homo sapiens
gcccaggcuggagugcaa

SEQ ID NO: 782478 - RNA, 19 nt, Homo sapiens
gcccaggcuggagugcaau

SEQ ID NO: 782479 - RNA, 20 nt, Homo sapiens
gcccaggcuggagugcagua

SEQ ID NO: 782480 - RNA, 20 nt, Homo sapiens
gcccaggcugggaacucauc

SEQ ID NO: 782481 - RNA, 20 nt, Homo sapiens
auuuagcccuaaaaugacaa

SEQ ID NO: 782482 - RNA, 21 nt, Homo sapiens
auuuaggaaaugggcagugaa

SEQ ID NO: 782483 - RNA, 18 nt, Homo sapiens
auuuaguaaagcuuuucu

SEQ ID NO: 782484 - RNA, 19 nt, Homo sapiens
auuuagugaaguugugcaa

SEQ ID NO: 782485 - RNA, 21 nt, Homo sapiens
auuuaguuuguagcucauuaa

SEQ ID NO: 782486 - RNA, 20 nt, Homo sapiens
auuuaguuuuuaacaaucua

SEQ ID NO: 782487 - RNA, 19 nt, Homo sapiens
auuuauaauguuaguagaa

SEQ ID NO: 782488 - RNA, 16 nt, Homo sapiens
auuuauacaggucaua

SEQ ID NO: 782489 - RNA, 21 nt, Homo sapiens
auuuauacuaaauguauuccu

SEQ ID NO: 782490 - RNA, 23 nt, Homo sapiens
auuuauauaaaauguuuaaucuc

SEQ ID NO: 782491 - RNA, 16 nt, Homo sapiens
auuuauauauauaugu

SEQ ID NO: 782492 - RNA, 17 nt, Homo sapiens
auuuauaucacacaaua

SEQ ID NO: 782493 - RNA, 12 nt, Homo sapiens
auuuaucaagga

SEQ ID NO: 782494 - RNA, 14 nt, Homo sapiens
auuuaucugugcaa

SEQ ID NO: 782495 - RNA, 21 nt, Homo sapiens
auuuaugagaaauauuugaag

SEQ ID NO: 782496 - RNA, 21 nt, Homo sapiens
auuuaugucccugacuguaaa

SEQ ID NO: 782497 - RNA, 16 nt, Homo sapiens
auuuauuaacuaauca

SEQ ID NO: 782498 - RNA, 17 nt, Homo sapiens
auuuauuaacuaaucaa

SEQ ID NO: 782499 - RNA, 17 nt, Homo sapiens
auuuauuaccucugaua

SEQ ID NO: 782500 - RNA, 19 nt, Homo sapiens
auuuauucacauauaucaa

SEQ ID NO: 782501 - RNA, 22 nt, Homo sapiens
auuuauugguuuugcagaagaa

SEQ ID NO: 782502 - RNA, 21 nt, Homo sapiens
auuuauugugcuucgagugac

SEQ ID NO: 782503 - RNA, 16 nt, Homo sapiens
auuuauuuauggagga

SEQ ID NO: 782504 - RNA, 16 nt, Homo sapiens
auuuauuuuguguugu

SEQ ID NO: 782505 - RNA, 14 nt, Homo sapiens
auuucaaagacuca

SEQ ID NO: 782506 - RNA, 12 nt, Homo sapiens
auuucaaaggga

SEQ ID NO: 782507 - RNA, 21 nt, Homo sapiens
auuucaagacagauugugaag

SEQ ID NO: 782508 - RNA, 20 nt, Homo sapiens
auuucaaggaacagccacaa

SEQ ID NO: 782509 - RNA, 13 nt, Homo sapiens
auuucacaagcua

SEQ ID NO: 782510 - RNA, 15 nt, Homo sapiens
auuucacaagcuauu

SEQ ID NO: 782511 - RNA, 18 nt, Homo sapiens
auuucacucucaaacuuc

SEQ ID NO: 782512 - RNA, 23 nt, Homo sapiens
auuucacuugaugauacaaugaa

SEQ ID NO: 782513 - RNA, 20 nt, Homo sapiens
auuucagaaguuaguuugua

SEQ ID NO: 782514 - RNA, 19 nt, Homo sapiens
auuucaggaagacugacag

SEQ ID NO: 782515 - RNA, 19 nt, Homo sapiens
auuucaggagaaccuaaca

SEQ ID NO: 782516 - RNA, 23 nt, Homo sapiens
auuucagguuuuguaaagaugcc

SEQ ID NO: 782517 - RNA, 17 nt, Homo sapiens
auuucagugguucagau

SEQ ID NO: 782518 - RNA, 20 nt, Homo sapiens
auuucauaaauaaaggugua

SEQ ID NO: 782519 - RNA, 14 nt, Homo sapiens
auuucauacuguaa

SEQ ID NO: 782520 - RNA, 14 nt, Homo sapiens
auuucauagcugua

SEQ ID NO: 782521 - RNA, 22 nt, Homo sapiens
auuucaugggacuaaaugaacu

SEQ ID NO: 782522 - RNA, 20 nt, Homo sapiens
auuucaugugucaacuucaa

SEQ ID NO: 782523 - RNA, 17 nt, Homo sapiens
auugccuggacugacca

SEQ ID NO: 782524 - RNA, 21 nt, Homo sapiens
auugccuucuuacaacagaga

SEQ ID NO: 782525 - RNA, 13 nt, Homo sapiens
auugcgcucucaa

SEQ ID NO: 782526 - RNA, 14 nt, Homo sapiens
auugcuaaccacug

SEQ ID NO: 782527 - RNA, 19 nt, Homo sapiens
auugcuagguuuugcuaca

SEQ ID NO: 782528 - RNA, 14 nt, Homo sapiens
auugcuaugaauga

SEQ ID NO: 782529 - RNA, 17 nt, Homo sapiens
auugcuaugaaugauac

SEQ ID NO: 782530 - RNA, 22 nt, Homo sapiens
auugcuaugaaugauacccuga

SEQ ID NO: 782531 - RNA, 17 nt, Homo sapiens
auugcucagagaaggaa

SEQ ID NO: 782532 - RNA, 21 nt, Homo sapiens
auugcucagcccgcuuggcca

SEQ ID NO: 782533 - RNA, 17 nt, Homo sapiens
auugcugccaaggugga

SEQ ID NO: 782534 - RNA, 16 nt, Homo sapiens
auugcuggaugcauuu

SEQ ID NO: 782535 - RNA, 13 nt, Homo sapiens
auugcuggcugcc

SEQ ID NO: 782536 - RNA, 21 nt, Homo sapiens
auugcuguccuggaggggcug

SEQ ID NO: 782537 - RNA, 18 nt, Homo sapiens
auugcuuaccugaucuca

SEQ ID NO: 782538 - RNA, 14 nt, Homo sapiens
auugcuugagcuca

SEQ ID NO: 782539 - RNA, 15 nt, Homo sapiens
auugcuugagcucag

SEQ ID NO: 782540 - RNA, 12 nt, Homo sapiens
auugcuuugcca

SEQ ID NO: 782541 - RNA, 13 nt, Homo sapiens
auugcuuugccaa

SEQ ID NO: 782542 - RNA, 18 nt, Homo sapiens
auuggaaauuuguuauaa

SEQ ID NO: 782543 - RNA, 19 nt, Homo sapiens
auuggaacagaauguuuua

SEQ ID NO: 782544 - RNA, 17 nt, Homo sapiens
auuggaagauuauugag

SEQ ID NO: 782545 - RNA, 17 nt, Homo sapiens
auuggaagcauacaaag

SEQ ID NO: 782546 - RNA, 21 nt, Homo sapiens
auuggaaguguucaagaaaua

SEQ ID NO: 782547 - RNA, 15 nt, Homo sapiens
auuggacuccaggcc

SEQ ID NO: 782548 - RNA, 19 nt, Homo sapiens
auuggagaguaaaaacuga

SEQ ID NO: 782549 - RNA, 23 nt, Homo sapiens
auuggagucacugccaagucaua

SEQ ID NO: 782550 - RNA, 21 nt, Homo sapiens
auuggcaaacuuuguauuaau

SEQ ID NO: 782551 - RNA, 13 nt, Homo sapiens
auuggcaugucuc

SEQ ID NO: 782552 - RNA, 17 nt, Homo sapiens
auuggcuaugaugguga

SEQ ID NO: 782553 - RNA, 13 nt, Homo sapiens
auuggcucagccc

SEQ ID NO: 782554 - RNA, 18 nt, Homo sapiens
auuggcucuagucacugg

SEQ ID NO: 782555 - RNA, 13 nt, Homo sapiens
auuggcugagaua

SEQ ID NO: 782556 - RNA, 17 nt, Homo sapiens
auugggaaaacauuugc

SEQ ID NO: 782557 - RNA, 18 nt, Homo sapiens
auuggggaagacuguggc

SEQ ID NO: 782558 - RNA, 13 nt, Homo sapiens
auugguccaagau

SEQ ID NO: 782559 - RNA, 21 nt, Homo sapiens
auugguccgaucuuugacucu

SEQ ID NO: 782560 - RNA, 19 nt, Homo sapiens
auuggugaacaguguauag

SEQ ID NO: 782561 - RNA, 18 nt, Homo sapiens
auugguuauucaaguauu

SEQ ID NO: 782562 - RNA, 16 nt, Homo sapiens
auugguuuaguucuua

SEQ ID NO: 782563 - RNA, 21 nt, Homo sapiens
auugguuuugguuuugacuca

SEQ ID NO: 782564 - RNA, 14 nt, Homo sapiens
auuguaaaacccca

SEQ ID NO: 782565 - RNA, 17 nt, Homo sapiens
auuguaaauacuggacu

SEQ ID NO: 782566 - RNA, 20 nt, Homo sapiens
auuguaacuaauacuacugu

SEQ ID NO: 782567 - RNA, 14 nt, Homo sapiens
auggccagcugcca

SEQ ID NO: 782568 - RNA, 19 nt, Homo sapiens
auggccccaucuggaugua

SEQ ID NO: 782569 - RNA, 14 nt, Homo sapiens
auggccucuggcca

SEQ ID NO: 782570 - RNA, 18 nt, Homo sapiens
auggccucuggccaggca

SEQ ID NO: 782571 - RNA, 22 nt, Homo sapiens
auggccugagaugcaggugaug

SEQ ID NO: 782572 - RNA, 14 nt, Homo sapiens
auggccuggaaccc

SEQ ID NO: 782573 - RNA, 20 nt, Homo sapiens
auggccuuccacgucuuccu

SEQ ID NO: 782574 - RNA, 16 nt, Homo sapiens
auggccuuugcuuaug

SEQ ID NO: 782575 - RNA, 16 nt, Homo sapiens
auggcgauguguuaua

SEQ ID NO: 782576 - RNA, 19 nt, Homo sapiens
auggcuagccuuucuugua

SEQ ID NO: 782577 - RNA, 16 nt, Homo sapiens
auggcucacuaugaau

SEQ ID NO: 782578 - RNA, 14 nt, Homo sapiens
auggcucagggugg

SEQ ID NO: 782579 - RNA, 14 nt, Homo sapiens
auggcuccagaaau

SEQ ID NO: 782580 - RNA, 18 nt, Homo sapiens
auggcugaguuuauuagu

SEQ ID NO: 782581 - RNA, 19 nt, Homo sapiens
auggcugcccaggagacag

SEQ ID NO: 782582 - RNA, 22 nt, Homo sapiens
auggcuggaagggguccagccu

SEQ ID NO: 782583 - RNA, 23 nt, Homo sapiens
auggcuggggccgcugggguccg

SEQ ID NO: 782584 - RNA, 16 nt, Homo sapiens
auggcuguguuugcag

SEQ ID NO: 782585 - RNA, 17 nt, Homo sapiens
auggcuuaaaagcaagu

SEQ ID NO: 782586 - RNA, 19 nt, Homo sapiens
auggcuuugugauucaauc

SEQ ID NO: 782587 - RNA, 22 nt, Homo sapiens
augggaaacuauugugcacaag

SEQ ID NO: 782588 - RNA, 15 nt, Homo sapiens
augggaaaguauucu

SEQ ID NO: 782589 - RNA, 20 nt, Homo sapiens
augggaaaugagaacauucc

SEQ ID NO: 782590 - RNA, 14 nt, Homo sapiens
augggacuacaggc

SEQ ID NO: 782591 - RNA, 13 nt, Homo sapiens
augggacugaugu

SEQ ID NO: 782592 - RNA, 12 nt, Homo sapiens
augggagccagg

SEQ ID NO: 782593 - RNA, 23 nt, Homo sapiens
augggagggggcuugaagccaaa

SEQ ID NO: 782594 - RNA, 20 nt, Homo sapiens
augggcaaauuaaggcauaa

SEQ ID NO: 782595 - RNA, 23 nt, Homo sapiens
auggggauaaaggagaaggcaug

SEQ ID NO: 782596 - RNA, 16 nt, Homo sapiens
auggggcagacacaac

SEQ ID NO: 782597 - RNA, 15 nt, Homo sapiens
auggggugcaugaua

SEQ ID NO: 782598 - RNA, 18 nt, Homo sapiens
auggggugggguagggcu

SEQ ID NO: 782599 - RNA, 16 nt, Homo sapiens
augggguucuggaaau

SEQ ID NO: 782600 - RNA, 12 nt, Homo sapiens
auggguccaggg

SEQ ID NO: 782601 - RNA, 14 nt, Homo sapiens
augggucuaggaca

SEQ ID NO: 782602 - RNA, 17 nt, Homo sapiens
auggguuaagagcucac

SEQ ID NO: 782603 - RNA, 16 nt, Homo sapiens
augguaaauccuuuug

SEQ ID NO: 782604 - RNA, 16 nt, Homo sapiens
augguaauaagcacug

SEQ ID NO: 782605 - RNA, 14 nt, Homo sapiens
augguaaucagaaa

SEQ ID NO: 782606 - RNA, 16 nt, Homo sapiens
augguacaaaccaaau

SEQ ID NO: 782607 - RNA, 17 nt, Homo sapiens
augguacccuguguuag

SEQ ID NO: 782608 - RNA, 15 nt, Homo sapiens
augguacuacaacca

SEQ ID NO: 782609 - RNA, 14 nt, Homo sapiens
augguagucacuaa

SEQ ID NO: 782610 - RNA, 14 nt, Homo sapiens
augguaucaaugga

SEQ ID NO: 782611 - RNA, 19 nt, Homo sapiens
augguaugcacaauuccau

SEQ ID NO: 782612 - RNA, 22 nt, Homo sapiens
augguaugcacaauuccaugac

SEQ ID NO: 782613 - RNA, 20 nt, Homo sapiens
augguauggaacucucucca

SEQ ID NO: 782614 - RNA, 15 nt, Homo sapiens
auggucacaagcaca

SEQ ID NO: 782615 - RNA, 22 nt, Homo sapiens
auggucacaagcacaaagcuca

SEQ ID NO: 782616 - RNA, 16 nt, Homo sapiens
auggucauugcaggaa

SEQ ID NO: 782617 - RNA, 14 nt, Homo sapiens
augguccagaaacu

SEQ ID NO: 782618 - RNA, 19 nt, Homo sapiens
auggucccuuaaggcacag

SEQ ID NO: 782619 - RNA, 19 nt, Homo sapiens
auggugaaaccucaucucu

SEQ ID NO: 782620 - RNA, 12 nt, Homo sapiens
auggugagcucu

SEQ ID NO: 782621 - RNA, 18 nt, Homo sapiens
auggugauuccagcaagu

SEQ ID NO: 782622 - RNA, 20 nt, Homo sapiens
auggugcaaauccuacugaa

SEQ ID NO: 782623 - RNA, 17 nt, Homo sapiens
augguggaucuuugcua

SEQ ID NO: 782624 - RNA, 19 nt, Homo sapiens
augguggcgcaugccugua

SEQ ID NO: 782625 - RNA, 20 nt, Homo sapiens
augguggcgcaugccuguag

SEQ ID NO: 782626 - RNA, 18 nt, Homo sapiens
auggugggcaggaucuca

SEQ ID NO: 782627 - RNA, 18 nt, Homo sapiens
augguggguacaaaaagu

SEQ ID NO: 782628 - RNA, 21 nt, Homo sapiens
augguggguacaaaaagucaa

SEQ ID NO: 782629 - RNA, 15 nt, Homo sapiens
auggugguauuguga

SEQ ID NO: 782630 - RNA, 19 nt, Homo sapiens
augguggugugugccugua

SEQ ID NO: 782631 - RNA, 14 nt, Homo sapiens
augguguagcuguc

SEQ ID NO: 782632 - RNA, 22 nt, Homo sapiens
augguguccauuuuauuuagca

SEQ ID NO: 782633 - RNA, 15 nt, Homo sapiens
auggugugaguccaa

SEQ ID NO: 782634 - RNA, 17 nt, Homo sapiens
augguguggguguccug

SEQ ID NO: 782635 - RNA, 14 nt, Homo sapiens
augguguguuaaag

SEQ ID NO: 782636 - RNA, 15 nt, Homo sapiens
augguuccauucucu

SEQ ID NO: 782637 - RNA, 19 nt, Homo sapiens
augguuccauucucucucc

SEQ ID NO: 782638 - RNA, 15 nt, Homo sapiens
augguugauggaaaa

SEQ ID NO: 782639 - RNA, 20 nt, Homo sapiens
augguuugugucaaaacugg

SEQ ID NO: 782640 - RNA, 14 nt, Homo sapiens
augguuuuacucau

SEQ ID NO: 782641 - RNA, 20 nt, Homo sapiens
augguuuuugaaggcuuuag

SEQ ID NO: 782642 - RNA, 15 nt, Homo sapiens
auguaaaagcacaug

SEQ ID NO: 782643 - RNA, 18 nt, Homo sapiens
auguaaaauauuugagaa

SEQ ID NO: 782644 - RNA, 22 nt, Homo sapiens
auguaaaauuuggaguaaauau

SEQ ID NO: 782645 - RNA, 21 nt, Homo sapiens
auguaacgaaugguacuacaa

SEQ ID NO: 782646 - RNA, 12 nt, Homo sapiens
auguaagcacuc

SEQ ID NO: 782647 - RNA, 15 nt, Homo sapiens
auguaagcucuacug

SEQ ID NO: 782648 - RNA, 16 nt, Homo sapiens
auguaaguacuuccac

SEQ ID NO: 782649 - RNA, 15 nt, Homo sapiens
auguaagugggccca

SEQ ID NO: 782650 - RNA, 17 nt, Homo sapiens
auguaauagugacagca

SEQ ID NO: 782651 - RNA, 19 nt, Homo sapiens
auguaauauauuguacaaa

SEQ ID NO: 782652 - RNA, 23 nt, Homo sapiens
auguaauauauuguacaaaugua

SEQ ID NO: 782653 - RNA, 19 nt, Homo sapiens
auguaauauuaauaguuau

SEQ ID NO: 782654 - RNA, 14 nt, Homo sapiens
auguaauucuacca

SEQ ID NO: 782655 - RNA, 14 nt, Homo sapiens
auguacaacugcac

SEQ ID NO: 782656 - RNA, 16 nt, Homo sapiens
auguacauagcuugau

SEQ ID NO: 782657 - RNA, 18 nt, Homo sapiens
auguacaucagccugaaa

SEQ ID NO: 782658 - RNA, 19 nt, Homo sapiens
auguacaucuggccuugaa

SEQ ID NO: 782659 - RNA, 14 nt, Homo sapiens
auguaccagcaucu

SEQ ID NO: 782660 - RNA, 18 nt, Homo sapiens
auguaccccucucagucu

SEQ ID NO: 782661 - RNA, 17 nt, Homo sapiens
auguaccugaugcuaug

SEQ ID NO: 782662 - RNA, 23 nt, Homo sapiens
auguacucacauauaacaugcaa

SEQ ID NO: 782663 - RNA, 18 nt, Homo sapiens
auguacuuagcuguacua

SEQ ID NO: 782664 - RNA, 18 nt, Homo sapiens
auguacuucagugcaccu

SEQ ID NO: 782665 - RNA, 16 nt, Homo sapiens
auguacuuguuugcaa

SEQ ID NO: 782666 - RNA, 23 nt, Homo sapiens
auguagaauaggcagggggcccu

SEQ ID NO: 782667 - RNA, 13 nt, Homo sapiens
auguagcacuuac

SEQ ID NO: 782668 - RNA, 18 nt, Homo sapiens
auguagcucaguaauucc

SEQ ID NO: 782669 - RNA, 18 nt, Homo sapiens
auguaggcaucaugcaug

SEQ ID NO: 782670 - RNA, 22 nt, Homo sapiens
auguagggguuaacuuggucag

SEQ ID NO: 782671 - RNA, 16 nt, Homo sapiens
auguaguuugcacuua

SEQ ID NO: 782672 - RNA, 16 nt, Homo sapiens
auguauagacuuggcu

SEQ ID NO: 782673 - RNA, 17 nt, Homo sapiens
auguauauuuuugcuag

SEQ ID NO: 782674 - RNA, 17 nt, Homo sapiens
auguaucaguguccuuu

SEQ ID NO: 782675 - RNA, 19 nt, Homo sapiens
auguaucuauuuguacaau

SEQ ID NO: 782676 - RNA, 22 nt, Homo sapiens
auguaugcaaaccucaucuuuc

SEQ ID NO: 782677 - RNA, 15 nt, Homo sapiens
auguaugcaccucaa

SEQ ID NO: 782678 - RNA, 21 nt, Homo sapiens
auguauggaaucccacuguau

SEQ ID NO: 782679 - RNA, 13 nt, Homo sapiens
auguauuccugua

SEQ ID NO: 782680 - RNA, 20 nt, Homo sapiens
auguauuuguuugcaauuuu

SEQ ID NO: 782681 - RNA, 14 nt, Homo sapiens
augucaaagcuuug

SEQ ID NO: 782682 - RNA, 23 nt, Homo sapiens
augcauggugccccaggaccagc

SEQ ID NO: 782683 - RNA, 17 nt, Homo sapiens
augcauuauaucaaauc

SEQ ID NO: 782684 - RNA, 12 nt, Homo sapiens
augcauuauuaa

SEQ ID NO: 782685 - RNA, 22 nt, Homo sapiens
augcauuauugacgaacuggcu

SEQ ID NO: 782686 - RNA, 19 nt, Homo sapiens
augcauugccuguaacaau

SEQ ID NO: 782687 - RNA, 18 nt, Homo sapiens
augcauuguuauaauuac

SEQ ID NO: 782688 - RNA, 18 nt, Homo sapiens
augcauuuugaguguuua

SEQ ID NO: 782689 - RNA, 19 nt, Homo sapiens
augcauuuuuaauaugaca

SEQ ID NO: 782690 - RNA, 19 nt, Homo sapiens
augccaaacacuagcucug

SEQ ID NO: 782691 - RNA, 21 nt, Homo sapiens
augccaaagaaugaauuucaa

SEQ ID NO: 782692 - RNA, 20 nt, Homo sapiens
augccaaaguagcugaugua

SEQ ID NO: 782693 - RNA, 22 nt, Homo sapiens
augccaaagugucuacaugugc

SEQ ID NO: 782694 - RNA, 20 nt, Homo sapiens
augccaauaaaguuugccca

SEQ ID NO: 782695 - RNA, 21 nt, Homo sapiens
augccaauaauaaaugcccuc

SEQ ID NO: 782696 - RNA, 23 nt, Homo sapiens
augccacaaggacuuccugucca

SEQ ID NO: 782697 - RNA, 21 nt, Homo sapiens
augccaccaacacugcucaca

SEQ ID NO: 782698 - RNA, 17 nt, Homo sapiens
augccacccugcaauaa

SEQ ID NO: 782699 - RNA, 14 nt, Homo sapiens
augccacuucccag

SEQ ID NO: 782700 - RNA, 13 nt, Homo sapiens
augccacuuccuu

SEQ ID NO: 782701 - RNA, 23 nt, Homo sapiens
augccacuuccuuuuaacugcca

SEQ ID NO: 782702 - RNA, 22 nt, Homo sapiens
augccagcucagucccaucaga

SEQ ID NO: 782703 - RNA, 19 nt, Homo sapiens
augccagcuucucucucca

SEQ ID NO: 782704 - RNA, 22 nt, Homo sapiens
augccagugaaacuucaagcaa

SEQ ID NO: 782705 - RNA, 13 nt, Homo sapiens
augccauuacaga

SEQ ID NO: 782706 - RNA, 14 nt, Homo sapiens
augccauucugccu

SEQ ID NO: 782707 - RNA, 22 nt, Homo sapiens
augcccucauacccaugcacag

SEQ ID NO: 782708 - RNA, 21 nt, Homo sapiens
augcccuccacuccacugccu

SEQ ID NO: 782709 - RNA, 18 nt, Homo sapiens
augccgcagggagggcug

SEQ ID NO: 782710 - RNA, 20 nt, Homo sapiens
augccgggcgcaguggcuca

SEQ ID NO: 782711 - RNA, 20 nt, Homo sapiens
augccguauaggaugucaga

SEQ ID NO: 782712 - RNA, 13 nt, Homo sapiens
augccguggauug

SEQ ID NO: 782713 - RNA, 16 nt, Homo sapiens
augccucaauucacau

SEQ ID NO: 782714 - RNA, 14 nt, Homo sapiens
augccugcaaucug

SEQ ID NO: 782715 - RNA, 14 nt, Homo sapiens
augccugcuugaua

SEQ ID NO: 782716 - RNA, 14 nt, Homo sapiens
augccuguaaucuc

SEQ ID NO: 782717 - RNA, 15 nt, Homo sapiens
augccuguaaucuca

SEQ ID NO: 782718 - RNA, 19 nt, Homo sapiens
augccuucacuuuacaaau

SEQ ID NO: 782719 - RNA, 18 nt, Homo sapiens
augccuuuaaaucuguga

SEQ ID NO: 782720 - RNA, 15 nt, Homo sapiens
augcgcagugccuug

SEQ ID NO: 782721 - RNA, 19 nt, Homo sapiens
augcguacguuuccugaga

SEQ ID NO: 782722 - RNA, 16 nt, Homo sapiens
augcgucaggggccua

SEQ ID NO: 782723 - RNA, 21 nt, Homo sapiens
augcuaaaccuuaguacugag

SEQ ID NO: 782724 - RNA, 20 nt, Homo sapiens
augcuaaauaguucuaucag

SEQ ID NO: 782725 - RNA, 22 nt, Homo sapiens
augcuaggcugucugcgaagaa

SEQ ID NO: 782726 - RNA, 13 nt, Homo sapiens
augcuauauugca

SEQ ID NO: 782727 - RNA, 14 nt, Homo sapiens
augcucagggucaa

SEQ ID NO: 782728 - RNA, 18 nt, Homo sapiens
augcucagggucacugaa

SEQ ID NO: 782729 - RNA, 21 nt, Homo sapiens
augcuccagcaacacagccug

SEQ ID NO: 782730 - RNA, 16 nt, Homo sapiens
augcucugcauguuac

SEQ ID NO: 782731 - RNA, 17 nt, Homo sapiens
augcucuugucccuguc

SEQ ID NO: 782732 - RNA, 16 nt, Homo sapiens
augcucuuuacuucau

SEQ ID NO: 782733 - RNA, 15 nt, Homo sapiens
augcucuuuugcaca

SEQ ID NO: 782734 - RNA, 19 nt, Homo sapiens
augcugaaaaaucauccaa

SEQ ID NO: 782735 - RNA, 17 nt, Homo sapiens
augcugaaacaaugccu

SEQ ID NO: 782736 - RNA, 16 nt, Homo sapiens
augcugaauacuccuc

SEQ ID NO: 782737 - RNA, 13 nt, Homo sapiens
augcugacuguac

SEQ ID NO: 782738 - RNA, 12 nt, Homo sapiens
augcugagcuca

SEQ ID NO: 782739 - RNA, 22 nt, Homo sapiens
augcugaggccacccacugacc

SEQ ID NO: 782740 - RNA, 22 nt, Homo sapiens
augcugcagguguuugaccucc

SEQ ID NO: 782741 - RNA, 17 nt, Homo sapiens
augcugcucauccaaag

SEQ ID NO: 782742 - RNA, 22 nt, Homo sapiens
augcugcuggggaagacagugg

SEQ ID NO: 782743 - RNA, 20 nt, Homo sapiens
augcuggacggcauuccugc

SEQ ID NO: 782744 - RNA, 22 nt, Homo sapiens
augcuguauauccuuucuaaca

SEQ ID NO: 782745 - RNA, 16 nt, Homo sapiens
augcuguuauguccag

SEQ ID NO: 782746 - RNA, 15 nt, Homo sapiens
augcuguugccucau

SEQ ID NO: 782747 - RNA, 20 nt, Homo sapiens
augcuguuugacaaaguuac

SEQ ID NO: 782748 - RNA, 15 nt, Homo sapiens
augcuucagauauua

SEQ ID NO: 782749 - RNA, 14 nt, Homo sapiens
augcuugauuccag

SEQ ID NO: 782750 - RNA, 15 nt, Homo sapiens
augcuugauuccagu

SEQ ID NO: 782751 - RNA, 19 nt, Homo sapiens
augcuuugccauaaccaca

SEQ ID NO: 782752 - RNA, 15 nt, Homo sapiens
augcuuuugccacuu

SEQ ID NO: 782753 - RNA, 18 nt, Homo sapiens
augcuuuugcuugcaaug

SEQ ID NO: 782754 - RNA, 16 nt, Homo sapiens
auggaaaaaaauuaca

SEQ ID NO: 782755 - RNA, 13 nt, Homo sapiens
auggaaaccaagc

SEQ ID NO: 782756 - RNA, 17 nt, Homo sapiens
auggaaagguccugcug

SEQ ID NO: 782757 - RNA, 20 nt, Homo sapiens
auggaacagcauuacccucc

SEQ ID NO: 782758 - RNA, 15 nt, Homo sapiens
auggaacucagagau

SEQ ID NO: 782759 - RNA, 21 nt, Homo sapiens
auggaaggaagaaaagcugcc

SEQ ID NO: 782760 - RNA, 16 nt, Homo sapiens
auggaagggcaaguuu

SEQ ID NO: 782761 - RNA, 21 nt, Homo sapiens
auggaaguuuauuuccaucug

SEQ ID NO: 782762 - RNA, 20 nt, Homo sapiens
auggaauauuccccuaucuc

SEQ ID NO: 782763 - RNA, 18 nt, Homo sapiens
auggaauggcagguguca

SEQ ID NO: 782764 - RNA, 14 nt, Homo sapiens
auggaauuacaugu

SEQ ID NO: 782765 - RNA, 14 nt, Homo sapiens
auggacaacucaau

SEQ ID NO: 782766 - RNA, 12 nt, Homo sapiens
auggacaacuua

SEQ ID NO: 782767 - RNA, 19 nt, Homo sapiens
auggacaguggagaugaag

SEQ ID NO: 782768 - RNA, 18 nt, Homo sapiens
auggaccagugguuucca

SEQ ID NO: 782769 - RNA, 22 nt, Homo sapiens
auggacguuauccucucagauu

SEQ ID NO: 782770 - RNA, 22 nt, Homo sapiens
auggacucagaaacuccaugau

SEQ ID NO: 782771 - RNA, 21 nt, Homo sapiens
auggagacaagggcaucaucu

SEQ ID NO: 782772 - RNA, 17 nt, Homo sapiens
auggagcaugaauggua

SEQ ID NO: 782773 - RNA, 15 nt, Homo sapiens
auggagccaugacaa

SEQ ID NO: 782774 - RNA, 18 nt, Homo sapiens
auggagggaaugcucaga

SEQ ID NO: 782775 - RNA, 16 nt, Homo sapiens
auggagggagaagcua

SEQ ID NO: 782776 - RNA, 17 nt, Homo sapiens
auggagggcaacauucc

SEQ ID NO: 782777 - RNA, 23 nt, Homo sapiens
auggagggcgacgaggaggacag

SEQ ID NO: 782778 - RNA, 18 nt, Homo sapiens
auggaguucuugugccau

SEQ ID NO: 782779 - RNA, 19 nt, Homo sapiens
auggaugaaacuauaacuu

SEQ ID NO: 782780 - RNA, 19 nt, Homo sapiens
auggaugggggaacucaga

SEQ ID NO: 782781 - RNA, 22 nt, Homo sapiens
auggauucuccacucaguugca

SEQ ID NO: 782782 - RNA, 14 nt, Homo sapiens
auggauugauucag

SEQ ID NO: 782783 - RNA, 19 nt, Homo sapiens
auggauuugaaguuugcca

SEQ ID NO: 782784 - RNA, 23 nt, Homo sapiens
auggcaaaaccccaucuuuacua

SEQ ID NO: 782785 - RNA, 23 nt, Homo sapiens
auggcaacagaucuggaaccuca

SEQ ID NO: 782786 - RNA, 13 nt, Homo sapiens
auggcaaggcagc

SEQ ID NO: 782787 - RNA, 15 nt, Homo sapiens
auggcaccuuuugca

SEQ ID NO: 782788 - RNA, 16 nt, Homo sapiens
auggcaccuuuugcac

SEQ ID NO: 782789 - RNA, 15 nt, Homo sapiens
auggcagaaccaaag

SEQ ID NO: 782790 - RNA, 18 nt, Homo sapiens
auggcaggggcaaagggc

SEQ ID NO: 782791 - RNA, 18 nt, Homo sapiens
auggcaguccuggaggca

SEQ ID NO: 782792 - RNA, 18 nt, Homo sapiens
auggcauauauguucaaa

SEQ ID NO: 782793 - RNA, 16 nt, Homo sapiens
auggccaauaacuuuu

SEQ ID NO: 782794 - RNA, 19 nt, Homo sapiens
auggccaauaacuuuucac

SEQ ID NO: 782795 - RNA, 13 nt, Homo sapiens
auggccacuacuu

SEQ ID NO: 782796 - RNA, 19 nt, Homo sapiens
augaccuugggguacaauu

SEQ ID NO: 782797 - RNA, 22 nt, Homo sapiens
augacuacgucccgugucucca

SEQ ID NO: 782798 - RNA, 13 nt, Homo sapiens
augacucaguaag

SEQ ID NO: 782799 - RNA, 17 nt, Homo sapiens
augacucguuaccugcc

SEQ ID NO: 782800 - RNA, 14 nt, Homo sapiens
augacucucuccaa

SEQ ID NO: 782801 - RNA, 12 nt, Homo sapiens
augacugauuac

SEQ ID NO: 782802 - RNA, 13 nt, Homo sapiens
augacugcacaug

SEQ ID NO: 782803 - RNA, 17 nt, Homo sapiens
augacugcaccaacauc

SEQ ID NO: 782804 - RNA, 17 nt, Homo sapiens
augacuguaucuugaua

SEQ ID NO: 782805 - RNA, 18 nt, Homo sapiens
augacuguuacagcuuuc

SEQ ID NO: 782806 - RNA, 19 nt, Homo sapiens
augacuuagcgucaagaca

SEQ ID NO: 782807 - RNA, 21 nt, Homo sapiens
augacuugacuggcugcucuu

SEQ ID NO: 782808 - RNA, 16 nt, Homo sapiens
augacuugaugcaguu

SEQ ID NO: 782809 - RNA, 14 nt, Homo sapiens
augagaaucaugca

SEQ ID NO: 782810 - RNA, 13 nt, Homo sapiens
augagacauuagg

SEQ ID NO: 782811 - RNA, 16 nt, Homo sapiens
augagaccacuguuau

SEQ ID NO: 782812 - RNA, 17 nt, Homo sapiens
augagaguuccuucuca

SEQ ID NO: 782813 - RNA, 13 nt, Homo sapiens
augagauuggcau

SEQ ID NO: 782814 - RNA, 18 nt, Homo sapiens
augagcauccucucucac

SEQ ID NO: 782815 - RNA, 15 nt, Homo sapiens
augagcauuacuauu

SEQ ID NO: 782816 - RNA, 14 nt, Homo sapiens
augagccacugagc

SEQ ID NO: 782817 - RNA, 17 nt, Homo sapiens
augagccaucacuagaa

SEQ ID NO: 782818 - RNA, 16 nt, Homo sapiens
augagcgccaccucuu

SEQ ID NO: 782819 - RNA, 16 nt, Homo sapiens
augagcucccucgcug

SEQ ID NO: 782820 - RNA, 22 nt, Homo sapiens
augagcugaucugcggaucuca

SEQ ID NO: 782821 - RNA, 23 nt, Homo sapiens
augagcuggggaugucucucaug

SEQ ID NO: 782822 - RNA, 16 nt, Homo sapiens
augagcuggguacuga

SEQ ID NO: 782823 - RNA, 22 nt, Homo sapiens
augagcuguggacuagcaauau

SEQ ID NO: 782824 - RNA, 13 nt, Homo sapiens
augagcuuccuuc

SEQ ID NO: 782825 - RNA, 22 nt, Homo sapiens
augaggacuugugucucugugc

SEQ ID NO: 782826 - RNA, 20 nt, Homo sapiens
augaggagaaaggggcccca

SEQ ID NO: 782827 - RNA, 18 nt, Homo sapiens
augaggauaaugggaaga

SEQ ID NO: 782828 - RNA, 17 nt, Homo sapiens
augaggcagauagcacu

SEQ ID NO: 782829 - RNA, 14 nt, Homo sapiens
augaggccaucuca

SEQ ID NO: 782830 - RNA, 16 nt, Homo sapiens
augagggugacuguca

SEQ ID NO: 782831 - RNA, 16 nt, Homo sapiens
augaguaacauuugcu

SEQ ID NO: 782832 - RNA, 17 nt, Homo sapiens
augaguaauacaucaaa

SEQ ID NO: 782833 - RNA, 20 nt, Homo sapiens
augaguaauacaucaaagag

SEQ ID NO: 782834 - RNA, 13 nt, Homo sapiens
augagugcuuaaa

SEQ ID NO: 782835 - RNA, 12 nt, Homo sapiens
augaguggcuuc

SEQ ID NO: 782836 - RNA, 17 nt, Homo sapiens
augaguuuaucauguca

SEQ ID NO: 782837 - RNA, 20 nt, Homo sapiens
augaguuucacuguacugca

SEQ ID NO: 782838 - RNA, 21 nt, Homo sapiens
augaguuucacuguacugcau

SEQ ID NO: 782839 - RNA, 19 nt, Homo sapiens
augaguuucuuaacccuuu

SEQ ID NO: 782840 - RNA, 22 nt, Homo sapiens
augaguuuuugauagcuuuauu

SEQ ID NO: 782841 - RNA, 13 nt, Homo sapiens
augauacaguauu

SEQ ID NO: 782842 - RNA, 22 nt, Homo sapiens
augauacuuggaugcagcucuu

SEQ ID NO: 782843 - RNA, 16 nt, Homo sapiens
augauagaacuguacu

SEQ ID NO: 782844 - RNA, 16 nt, Homo sapiens
augauagaugacaaau

SEQ ID NO: 782845 - RNA, 14 nt, Homo sapiens
augauaugaccaaa

SEQ ID NO: 782846 - RNA, 20 nt, Homo sapiens
augaucaaaaccugugccag

SEQ ID NO: 782847 - RNA, 15 nt, Homo sapiens
augaucaccauguau

SEQ ID NO: 782848 - RNA, 21 nt, Homo sapiens
augaucaucugaaucccgggc

SEQ ID NO: 782849 - RNA, 17 nt, Homo sapiens
augauccagaacagugg

SEQ ID NO: 782850 - RNA, 20 nt, Homo sapiens
augaucccagucacuccucu

SEQ ID NO: 782851 - RNA, 20 nt, Homo sapiens
augaucccuguguugucucu

SEQ ID NO: 782852 - RNA, 22 nt, Homo sapiens
augaucgcgccacuacacucca

SEQ ID NO: 782853 - RNA, 12 nt, Homo sapiens
augaucucagga

SEQ ID NO: 782854 - RNA, 20 nt, Homo sapiens
augaugaaaacuaaggauuu

SEQ ID NO: 782855 - RNA, 14 nt, Homo sapiens
augaugacuccucu

SEQ ID NO: 782856 - RNA, 16 nt, Homo sapiens
augaugauaaugauga

SEQ ID NO: 782857 - RNA, 14 nt, Homo sapiens
augaugaugaucuu

SEQ ID NO: 782858 - RNA, 15 nt, Homo sapiens
augaugccauggcaa

SEQ ID NO: 782859 - RNA, 18 nt, Homo sapiens
augaugccucaugauaug

SEQ ID NO: 782860 - RNA, 18 nt, Homo sapiens
augaugcuagccagcaaa

SEQ ID NO: 782861 - RNA, 20 nt, Homo sapiens
augauuaaauaagauucuaa

SEQ ID NO: 782862 - RNA, 14 nt, Homo sapiens
augauuauauucac

SEQ ID NO: 782863 - RNA, 14 nt, Homo sapiens
augauucucugugg

SEQ ID NO: 782864 - RNA, 21 nt, Homo sapiens
augauuggauuauucauuuaa

SEQ ID NO: 782865 - RNA, 21 nt, Homo sapiens
augauuguuugacacaccauu

SEQ ID NO: 782866 - RNA, 19 nt, Homo sapiens
augauuucaugcuaucucu

SEQ ID NO: 782867 - RNA, 14 nt, Homo sapiens
augauuuguggaaa

SEQ ID NO: 782868 - RNA, 16 nt, Homo sapiens
augcaaacaaaaucca

SEQ ID NO: 782869 - RNA, 15 nt, Homo sapiens
augcaaauacaauca

SEQ ID NO: 782870 - RNA, 17 nt, Homo sapiens
augcaaauacaaucagc

SEQ ID NO: 782871 - RNA, 15 nt, Homo sapiens
augcaaaucaauuac

SEQ ID NO: 782872 - RNA, 20 nt, Homo sapiens
augcaaaugccuccaagcca

SEQ ID NO: 782873 - RNA, 15 nt, Homo sapiens
augcaaauuucauga

SEQ ID NO: 782874 - RNA, 14 nt, Homo sapiens
augcaagccagcuu

SEQ ID NO: 782875 - RNA, 19 nt, Homo sapiens
augcaagguauuucuccag

SEQ ID NO: 782876 - RNA, 13 nt, Homo sapiens
augcaaguauucu

SEQ ID NO: 782877 - RNA, 14 nt, Homo sapiens
augcaaugugcuac

SEQ ID NO: 782878 - RNA, 22 nt, Homo sapiens
augcaauuuuauuaaaugcauc

SEQ ID NO: 782879 - RNA, 17 nt, Homo sapiens
augcacaagaauggauc

SEQ ID NO: 782880 - RNA, 17 nt, Homo sapiens
augcacaauuccaugac

SEQ ID NO: 782881 - RNA, 14 nt, Homo sapiens
augcacauauggac

SEQ ID NO: 782882 - RNA, 20 nt, Homo sapiens
augcacauauggacucugca

SEQ ID NO: 782883 - RNA, 13 nt, Homo sapiens
augcaccaagaaa

SEQ ID NO: 782884 - RNA, 19 nt, Homo sapiens
augcaccucaaggucauca

SEQ ID NO: 782885 - RNA, 18 nt, Homo sapiens
augcaccuugugucugua

SEQ ID NO: 782886 - RNA, 12 nt, Homo sapiens
augcacugugaa

SEQ ID NO: 782887 - RNA, 22 nt, Homo sapiens
augcacuuggccugacucagga

SEQ ID NO: 782888 - RNA, 18 nt, Homo sapiens
augcagaaagcaucccuc

SEQ ID NO: 782889 - RNA, 20 nt, Homo sapiens
augcagaacaccaauauuaa

SEQ ID NO: 782890 - RNA, 19 nt, Homo sapiens
augcagaccucaugcccag

SEQ ID NO: 782891 - RNA, 17 nt, Homo sapiens
augcagaguaaguauua

SEQ ID NO: 782892 - RNA, 15 nt, Homo sapiens
augcagaguugacau

SEQ ID NO: 782893 - RNA, 17 nt, Homo sapiens
augcagaguugacauga

SEQ ID NO: 782894 - RNA, 22 nt, Homo sapiens
augcagccaaccaagaugcaaa

SEQ ID NO: 782895 - RNA, 20 nt, Homo sapiens
augcagccagccaucaaaua

SEQ ID NO: 782896 - RNA, 15 nt, Homo sapiens
augcagcccaugccc

SEQ ID NO: 782897 - RNA, 15 nt, Homo sapiens
augcagcuacuggaa

SEQ ID NO: 782898 - RNA, 16 nt, Homo sapiens
augcaguuccaaucaa

SEQ ID NO: 782899 - RNA, 15 nt, Homo sapiens
augcaguucugagca

SEQ ID NO: 782900 - RNA, 16 nt, Homo sapiens
augcaguuuuccuuaa

SEQ ID NO: 782901 - RNA, 13 nt, Homo sapiens
augcauaaagcca

SEQ ID NO: 782902 - RNA, 14 nt, Homo sapiens
augcauaaagccaa

SEQ ID NO: 782903 - RNA, 15 nt, Homo sapiens
augcauaaagccaaa

SEQ ID NO: 782904 - RNA, 17 nt, Homo sapiens
augcauacaaguuucau

SEQ ID NO: 782905 - RNA, 17 nt, Homo sapiens
augcauagcuuugcacu

SEQ ID NO: 782906 - RNA, 20 nt, Homo sapiens
augcauaggaaguauggcau

SEQ ID NO: 782907 - RNA, 22 nt, Homo sapiens
augcaugagcucccucgcugua

SEQ ID NO: 782908 - RNA, 20 nt, Homo sapiens
augcauggaaacauggagga

SEQ ID NO: 782909 - RNA, 14 nt, Homo sapiens
augcauggugcauc

SEQ ID NO: 782910 - RNA, 22 nt, Homo sapiens
augcauggugccccaggaccag

SEQ ID NO: 782911 - RNA, 14 nt, Homo sapiens
gcaugugucaugaa

SEQ ID NO: 782912 - RNA, 21 nt, Homo sapiens
gcauuaaaaaaaaaaucaaug

SEQ ID NO: 782913 - RNA, 17 nt, Homo sapiens
gcauuacauuguuuaaa

SEQ ID NO: 782914 - RNA, 16 nt, Homo sapiens
gcauuacuauucacug

SEQ ID NO: 782915 - RNA, 17 nt, Homo sapiens
gcauuacuauucacuga

SEQ ID NO: 782916 - RNA, 18 nt, Homo sapiens
gcauuacuauucacugau

SEQ ID NO: 782917 - RNA, 14 nt, Homo sapiens
gcauucacauuuag

SEQ ID NO: 782918 - RNA, 12 nt, Homo sapiens
gcauucacccag

SEQ ID NO: 782919 - RNA, 15 nt, Homo sapiens
gcauucagcacacac

SEQ ID NO: 782920 - RNA, 17 nt, Homo sapiens
gcauuccagcugucacu

SEQ ID NO: 782921 - RNA, 17 nt, Homo sapiens
gcauuccugaugaccaa

SEQ ID NO: 782922 - RNA, 20 nt, Homo sapiens
gcauucuuaacaaacucuuc

SEQ ID NO: 782923 - RNA, 21 nt, Homo sapiens
gcauucuuaacaaacucuuca

SEQ ID NO: 782924 - RNA, 22 nt, Homo sapiens
gcauucuuguugguagcaugua

SEQ ID NO: 782925 - RNA, 12 nt, Homo sapiens
gcauugcucagc

SEQ ID NO: 782926 - RNA, 23 nt, Homo sapiens
gcauugcugugugaauccaggag

SEQ ID NO: 782927 - RNA, 14 nt, Homo sapiens
gcauugcuuuccac

SEQ ID NO: 782928 - RNA, 22 nt, Homo sapiens
gcauuuauggucaacacuuaag

SEQ ID NO: 782929 - RNA, 20 nt, Homo sapiens
gcauuucacaugccuugcaa

SEQ ID NO: 782930 - RNA, 17 nt, Homo sapiens
gcauuucucuuccuaaa

SEQ ID NO: 782931 - RNA, 19 nt, Homo sapiens
gcauuucuuuucuggccaa

SEQ ID NO: 782932 - RNA, 15 nt, Homo sapiens
gcauuugauuuccau

SEQ ID NO: 782933 - RNA, 16 nt, Homo sapiens
gcauuuucacugcaau

SEQ ID NO: 782934 - RNA, 23 nt, Homo sapiens
gcauuuuuuuuuuaugauuuguc

SEQ ID NO: 782935 - RNA, 17 nt, Homo sapiens
gccaaaacaagccaaag

SEQ ID NO: 782936 - RNA, 14 nt, Homo sapiens
gccaaacaauaugc

SEQ ID NO: 782937 - RNA, 18 nt, Homo sapiens
gccaaaccacaagacucu

SEQ ID NO: 782938 - RNA, 13 nt, Homo sapiens
gccaaaccaggac

SEQ ID NO: 782939 - RNA, 20 nt, Homo sapiens
gccaaacccaugaggcaaug

SEQ ID NO: 782940 - RNA, 15 nt, Homo sapiens
gccaaacucugccag

SEQ ID NO: 782941 - RNA, 14 nt, Homo sapiens
gccaaagacuguaa

SEQ ID NO: 782942 - RNA, 14 nt, Homo sapiens
gccaaagaucacuu

SEQ ID NO: 782943 - RNA, 17 nt, Homo sapiens
gccaaauuuugauccua

SEQ ID NO: 782944 - RNA, 15 nt, Homo sapiens
gccaacaacucugau

SEQ ID NO: 782945 - RNA, 22 nt, Homo sapiens
gccaacccucucucuuaccugg

SEQ ID NO: 782946 - RNA, 19 nt, Homo sapiens
gccaaccucuggagcaaug

SEQ ID NO: 782947 - RNA, 15 nt, Homo sapiens
gccaacucaacuuuc

SEQ ID NO: 782948 - RNA, 15 nt, Homo sapiens
gccaacuuguaaaua

SEQ ID NO: 782949 - RNA, 12 nt, Homo sapiens
gccaacuuuguu

SEQ ID NO: 782950 - RNA, 12 nt, Homo sapiens
gccaagaacuug

SEQ ID NO: 782951 - RNA, 17 nt, Homo sapiens
gccaagaauacuugaag

SEQ ID NO: 782952 - RNA, 16 nt, Homo sapiens
gccaagagaauauccg

SEQ ID NO: 782953 - RNA, 20 nt, Homo sapiens
gccaagcccaauacagccau

SEQ ID NO: 782954 - RNA, 20 nt, Homo sapiens
gccaaggcagcgaccccagg

SEQ ID NO: 782955 - RNA, 14 nt, Homo sapiens
gccaagguccugcu

SEQ ID NO: 782956 - RNA, 15 nt, Homo sapiens
gccaagucauagcca

SEQ ID NO: 782957 - RNA, 17 nt, Homo sapiens
gccaagugaguugaaua

SEQ ID NO: 782958 - RNA, 16 nt, Homo sapiens
gccaaguggggugcug

SEQ ID NO: 782959 - RNA, 11 nt, Homo sapiens
gccacaaccaa

SEQ ID NO: 782960 - RNA, 20 nt, Homo sapiens
gccacacacaguuacagagu

SEQ ID NO: 782961 - RNA, 18 nt, Homo sapiens
gccacaccugagcgcugu

SEQ ID NO: 782962 - RNA, 15 nt, Homo sapiens
gccacagagaaguuu

SEQ ID NO: 782963 - RNA, 18 nt, Homo sapiens
gccacagcagguccucca

SEQ ID NO: 782964 - RNA, 20 nt, Homo sapiens
gcacuaccacgccaagcuaa

SEQ ID NO: 782965 - RNA, 16 nt, Homo sapiens
gcacuaccauugcugu

SEQ ID NO: 782966 - RNA, 13 nt, Homo sapiens
gcacuacucugug

SEQ ID NO: 782967 - RNA, 15 nt, Homo sapiens
gcacuagaauauuua

SEQ ID NO: 782968 - RNA, 16 nt, Homo sapiens
gcacuccauggccacc

SEQ ID NO: 782969 - RNA, 23 nt, Homo sapiens
gcacugaaaucacuuuaccugca

SEQ ID NO: 782970 - RNA, 22 nt, Homo sapiens
gcacugacugauagcuuacacu

SEQ ID NO: 782971 - RNA, 23 nt, Homo sapiens
gcacugagcccccccaacacugu

SEQ ID NO: 782972 - RNA, 18 nt, Homo sapiens
gcacugaggguggcacuc

SEQ ID NO: 782973 - RNA, 13 nt, Homo sapiens
gcacugaugcugc

SEQ ID NO: 782974 - RNA, 18 nt, Homo sapiens
gcacugcccgaaaagcau

SEQ ID NO: 782975 - RNA, 22 nt, Homo sapiens
gcacuggggagcccgucucagu

SEQ ID NO: 782976 - RNA, 21 nt, Homo sapiens
gcacuggugguuuuugcucuc

SEQ ID NO: 782977 - RNA, 15 nt, Homo sapiens
gcacuguucacauca

SEQ ID NO: 782978 - RNA, 15 nt, Homo sapiens
gcacuguucaucuca

SEQ ID NO: 782979 - RNA, 14 nt, Homo sapiens
gcacuucaccuuuu

SEQ ID NO: 782980 - RNA, 23 nt, Homo sapiens
gcacuugauguguagacauguca

SEQ ID NO: 782981 - RNA, 21 nt, Homo sapiens
gcacuuggccugacucaggaa

SEQ ID NO: 782982 - RNA, 17 nt, Homo sapiens
gcacuuuaaaugaagcu

SEQ ID NO: 782983 - RNA, 15 nt, Homo sapiens
gcacuuuaacugacu

SEQ ID NO: 782984 - RNA, 20 nt, Homo sapiens
gcacuuuaagucagugacag

SEQ ID NO: 782985 - RNA, 19 nt, Homo sapiens
gcacuuuagaucacuugag

SEQ ID NO: 782986 - RNA, 20 nt, Homo sapiens
gcacuuugagaggcugaggu

SEQ ID NO: 782987 - RNA, 18 nt, Homo sapiens
gcacuuuucaaacaauca

SEQ ID NO: 782988 - RNA, 17 nt, Homo sapiens
gcagaaaggguuccaaa

SEQ ID NO: 782989 - RNA, 15 nt, Homo sapiens
gcagaaauguacuua

SEQ ID NO: 782990 - RNA, 19 nt, Homo sapiens
gcagaaauuuaucuuucaa

SEQ ID NO: 782991 - RNA, 22 nt, Homo sapiens
gcagaacagaucuuuuacuuug

SEQ ID NO: 782992 - RNA, 17 nt, Homo sapiens
gcagaaccaaagcucaa

SEQ ID NO: 782993 - RNA, 14 nt, Homo sapiens
gcagaagaaggcau

SEQ ID NO: 782994 - RNA, 21 nt, Homo sapiens
gcagaagaauugaacccagga

SEQ ID NO: 782995 - RNA, 17 nt, Homo sapiens
gcagaagagggagacuc

SEQ ID NO: 782996 - RNA, 16 nt, Homo sapiens
gcagaagcccugaugu

SEQ ID NO: 782997 - RNA, 13 nt, Homo sapiens
gcagaauaaucuu

SEQ ID NO: 782998 - RNA, 14 nt, Homo sapiens
gcagaauccagcua

SEQ ID NO: 782999 - RNA, 18 nt, Homo sapiens
gcagaauugagagugauu

SEQ ID NO: 783000 - RNA, 16 nt, Homo sapiens
gcagacaggugugcag

SEQ ID NO: 783001 - RNA, 15 nt, Homo sapiens
gcagacauccucauc

SEQ ID NO: 783002 - RNA, 19 nt, Homo sapiens
gcagacugaaccaguccag

SEQ ID NO: 783003 - RNA, 19 nt, Homo sapiens
gcagagaaacuuaagcaaa

SEQ ID NO: 783004 - RNA, 18 nt, Homo sapiens
gcagagaaccaucaaggc

SEQ ID NO: 783005 - RNA, 19 nt, Homo sapiens
gcagagaugacuguccaag

SEQ ID NO: 783006 - RNA, 22 nt, Homo sapiens
gcagagcaaaaugcucuugucc

SEQ ID NO: 783007 - RNA, 18 nt, Homo sapiens
gcagagcaaagugcggug

SEQ ID NO: 783008 - RNA, 15 nt, Homo sapiens
gcagagcaugaccug

SEQ ID NO: 783009 - RNA, 15 nt, Homo sapiens
gcagagcauucagac

SEQ ID NO: 783010 - RNA, 13 nt, Homo sapiens
gcagaggcaccuc

SEQ ID NO: 783011 - RNA, 16 nt, Homo sapiens
gcagagggcaggggug

SEQ ID NO: 783012 - RNA, 18 nt, Homo sapiens
gcagagucagcugcugac

SEQ ID NO: 783013 - RNA, 18 nt, Homo sapiens
gcagaguggcugcaguua

SEQ ID NO: 783014 - RNA, 17 nt, Homo sapiens
gcagauagaaagcauua

SEQ ID NO: 783015 - RNA, 19 nt, Homo sapiens
gcagauaucugcauguguc

SEQ ID NO: 783016 - RNA, 21 nt, Homo sapiens
gcagauaucugcaugugucau

SEQ ID NO: 783017 - RNA, 23 nt, Homo sapiens
gcagaucaagaaaucccugagac

SEQ ID NO: 783018 - RNA, 16 nt, Homo sapiens
gagcacauagagcuuu

SEQ ID NO: 783019 - RNA, 21 nt, Homo sapiens
gagcacuggguugacuuucag

SEQ ID NO: 783020 - RNA, 12 nt, Homo sapiens
gagcacugugag

SEQ ID NO: 783021 - RNA, 18 nt, Homo sapiens
gagcacuugcguccugca

SEQ ID NO: 783022 - RNA, 21 nt, Homo sapiens
gagcagaauguuguacuugaa

SEQ ID NO: 783023 - RNA, 15 nt, Homo sapiens
gagcagaugaugcca

SEQ ID NO: 783024 - RNA, 17 nt, Homo sapiens
gagcagcuucagugaca

SEQ ID NO: 783025 - RNA, 15 nt, Homo sapiens
gagcaggagccugca

SEQ ID NO: 783026 - RNA, 16 nt, Homo sapiens
gagcaggcuacuguca

SEQ ID NO: 783027 - RNA, 15 nt, Homo sapiens
gagcagucagggugg

SEQ ID NO: 783028 - RNA, 18 nt, Homo sapiens
gagcagucuaucauugca

SEQ ID NO: 783029 - RNA, 19 nt, Homo sapiens
gagcaguuagcucauuuga

SEQ ID NO: 783030 - RNA, 14 nt, Homo sapiens
gagcaguucagagu

SEQ ID NO: 783031 - RNA, 15 nt, Homo sapiens
gagcauacaucuuaa

SEQ ID NO: 783032 - RNA, 18 nt, Homo sapiens
gagcaucacuagugacaa

SEQ ID NO: 783033 - RNA, 22 nt, Homo sapiens
gagcaucccccaaaguucacaa

SEQ ID NO: 783034 - RNA, 14 nt, Homo sapiens
gagcaugcacaugc

SEQ ID NO: 783035 - RNA, 15 nt, Homo sapiens
gagccaaaaucucaa

SEQ ID NO: 783036 - RNA, 22 nt, Homo sapiens
gagccaacaacucugauuaacu

SEQ ID NO: 783037 - RNA, 22 nt, Homo sapiens
gagccaagaucgcaccacugca

SEQ ID NO: 783038 - RNA, 15 nt, Homo sapiens
gagccaaguuccaaa

SEQ ID NO: 783039 - RNA, 23 nt, Homo sapiens
gagccacagcugugcaugcucag

SEQ ID NO: 783040 - RNA, 20 nt, Homo sapiens
gagccaccacguccagcugg

SEQ ID NO: 783041 - RNA, 15 nt, Homo sapiens
gagccagcaacucca

SEQ ID NO: 783042 - RNA, 16 nt, Homo sapiens
gagccagcacccugau

SEQ ID NO: 783043 - RNA, 22 nt, Homo sapiens
gagccagcugcuuuuugugauu

SEQ ID NO: 783044 - RNA, 21 nt, Homo sapiens
gagccagcuuggggccaccaa

SEQ ID NO: 783045 - RNA, 17 nt, Homo sapiens
gagccagucuaguuccu

SEQ ID NO: 783046 - RNA, 13 nt, Homo sapiens
gagccagucucac

SEQ ID NO: 783047 - RNA, 21 nt, Homo sapiens
gagccauauguacauaaucua

SEQ ID NO: 783048 - RNA, 19 nt, Homo sapiens
gagccaugaaaucaacuca

SEQ ID NO: 783049 - RNA, 18 nt, Homo sapiens
gagcccagagaagcugga

SEQ ID NO: 783050 - RNA, 15 nt, Homo sapiens
gagccccacccagac

SEQ ID NO: 783051 - RNA, 16 nt, Homo sapiens
gagccccagcuacccu

SEQ ID NO: 783052 - RNA, 20 nt, Homo sapiens
gagcccgcagggccaugcag

SEQ ID NO: 783053 - RNA, 20 nt, Homo sapiens
gagcccuaaaaauccagacu

SEQ ID NO: 783054 - RNA, 22 nt, Homo sapiens
gagcccucuaugguguggcaaa

SEQ ID NO: 783055 - RNA, 16 nt, Homo sapiens
gagcccuggcaggaug

SEQ ID NO: 783056 - RNA, 19 nt, Homo sapiens
gagccgcaccuugucaugu

SEQ ID NO: 783057 - RNA, 21 nt, Homo sapiens
gagccgggccgcagacuugac

SEQ ID NO: 783058 - RNA, 15 nt, Homo sapiens
gagccgugaugccuc

SEQ ID NO: 783059 - RNA, 17 nt, Homo sapiens
gagccuagcuccugcca

SEQ ID NO: 783060 - RNA, 17 nt, Homo sapiens
gagccuccacugccucu

SEQ ID NO: 783061 - RNA, 17 nt, Homo sapiens
gagccugcaaacucacu

SEQ ID NO: 783062 - RNA, 20 nt, Homo sapiens
gagccugcaggguggugcug

SEQ ID NO: 783063 - RNA, 21 nt, Homo sapiens
gagccugccaagagguacugu

SEQ ID NO: 783064 - RNA, 16 nt, Homo sapiens
gagccugcugcauggg

SEQ ID NO: 783065 - RNA, 16 nt, Homo sapiens
gagccuggcacaggac

SEQ ID NO: 783066 - RNA, 19 nt, Homo sapiens
gagccuucaagugccaaac

SEQ ID NO: 783067 - RNA, 15 nt, Homo sapiens
gagccuuuaccuuuu

SEQ ID NO: 783068 - RNA, 16 nt, Homo sapiens
gagccuuuggccagaa

SEQ ID NO: 783069 - RNA, 19 nt, Homo sapiens
gagcgagacuccgucucaa

SEQ ID NO: 783070 - RNA, 13 nt, Homo sapiens
gagcgagauucca

SEQ ID NO: 783071 - RNA, 13 nt, Homo sapiens
gagcgcacaggga

SEQ ID NO: 783072 - RNA, 14 nt, Homo sapiens
gagcggcuggagaa

SEQ ID NO: 783073 - RNA, 14 nt, Homo sapiens
gagcgguaugcucu

SEQ ID NO: 783074 - RNA, 17 nt, Homo sapiens
gagcgugaaucuguauc

SEQ ID NO: 783075 - RNA, 16 nt, Homo sapiens
gagcgugaccuugcaa

SEQ ID NO: 783076 - RNA, 12 nt, Homo sapiens
gagcguuugcac

SEQ ID NO: 783077 - RNA, 17 nt, Homo sapiens
gagcuauggcccagaaa

SEQ ID NO: 783078 - RNA, 17 nt, Homo sapiens
gagcucacagcuggaca

SEQ ID NO: 783079 - RNA, 22 nt, Homo sapiens
cuggcauuacaggugugagcca

SEQ ID NO: 783080 - RNA, 12 nt, Homo sapiens
cuggccaaaagc

SEQ ID NO: 783081 - RNA, 17 nt, Homo sapiens
cuggcccuccacuccuc

SEQ ID NO: 783082 - RNA, 22 nt, Homo sapiens
cuggccgccacccccaucuucc

SEQ ID NO: 783083 - RNA, 16 nt, Homo sapiens
cuggccuggcacauca

SEQ ID NO: 783084 - RNA, 12 nt, Homo sapiens
cuggccuggucc

SEQ ID NO: 783085 - RNA, 16 nt, Homo sapiens
cuggccuguggcacag

SEQ ID NO: 783086 - RNA, 18 nt, Homo sapiens
cuggccuugagcuucuaa

SEQ ID NO: 783087 - RNA, 17 nt, Homo sapiens
cuggccuugugucacug

SEQ ID NO: 783088 - RNA, 18 nt, Homo sapiens
cuggccuugugucacugg

SEQ ID NO: 783089 - RNA, 16 nt, Homo sapiens
cuggcguucucaagaa

SEQ ID NO: 783090 - RNA, 21 nt, Homo sapiens
cuggcuaauuuuuuguacuuu

SEQ ID NO: 783091 - RNA, 20 nt, Homo sapiens
cuggcucacuggcaggugug

SEQ ID NO: 783092 - RNA, 12 nt, Homo sapiens
cuggcucuccaa

SEQ ID NO: 783093 - RNA, 12 nt, Homo sapiens
cuggcucugaga

SEQ ID NO: 783094 - RNA, 20 nt, Homo sapiens
cuggcucugcccccuccccc

SEQ ID NO: 783095 - RNA, 15 nt, Homo sapiens
cuggcucuguuugau

SEQ ID NO: 783096 - RNA, 18 nt, Homo sapiens
cuggcugagguuccucug

SEQ ID NO: 783097 - RNA, 13 nt, Homo sapiens
cuggcugcaguga

SEQ ID NO: 783098 - RNA, 22 nt, Homo sapiens
cuggcugcuuuguucaaugcua

SEQ ID NO: 783099 - RNA, 20 nt, Homo sapiens
cuggcugucaguaugacauu

SEQ ID NO: 783100 - RNA, 20 nt, Homo sapiens
cuggcugucugucugcagug

SEQ ID NO: 783101 - RNA, 13 nt, Homo sapiens
cuggcugugagca

SEQ ID NO: 783102 - RNA, 17 nt, Homo sapiens
cuggcuuuacagacaaa

SEQ ID NO: 783103 - RNA, 18 nt, Homo sapiens
cuggcuuuggugaacugu

SEQ ID NO: 783104 - RNA, 23 nt, Homo sapiens
cugggaaaaaaguuuugaugaaa

SEQ ID NO: 783105 - RNA, 18 nt, Homo sapiens
cugggaaacugaaacuca

SEQ ID NO: 783106 - RNA, 13 nt, Homo sapiens
cugggaaacuggg

SEQ ID NO: 783107 - RNA, 16 nt, Homo sapiens
cugggaacuuccucag

SEQ ID NO: 783108 - RNA, 17 nt, Homo sapiens
cugggaaggagggagcu

SEQ ID NO: 783109 - RNA, 23 nt, Homo sapiens
cugggaaggagggagcugcucag

SEQ ID NO: 783110 - RNA, 16 nt, Homo sapiens
cugggaaucaagacaa

SEQ ID NO: 783111 - RNA, 15 nt, Homo sapiens
cugggaaugcuccca

SEQ ID NO: 783112 - RNA, 20 nt, Homo sapiens
gagaagccagcuuuccucau

SEQ ID NO: 783113 - RNA, 22 nt, Homo sapiens
gagaagccuucagcuccaggga

SEQ ID NO: 783114 - RNA, 15 nt, Homo sapiens
gagaaggaaagugau

SEQ ID NO: 783115 - RNA, 19 nt, Homo sapiens
gagaaggaaggagacucac

SEQ ID NO: 783116 - RNA, 20 nt, Homo sapiens
gagaaggcgggguauuccca

SEQ ID NO: 783117 - RNA, 15 nt, Homo sapiens
gagaagggagggugg

SEQ ID NO: 783118 - RNA, 21 nt, Homo sapiens
gagaagggaggguggccagca

SEQ ID NO: 783119 - RNA, 17 nt, Homo sapiens
gagaagggggcucugcc

SEQ ID NO: 783120 - RNA, 22 nt, Homo sapiens
gagaagguauuagcaaagcaaa

SEQ ID NO: 783121 - RNA, 20 nt, Homo sapiens
gagaagucacucacacuggc

SEQ ID NO: 783122 - RNA, 21 nt, Homo sapiens
gagaaguuuguagccagguac

SEQ ID NO: 783123 - RNA, 20 nt, Homo sapiens
gagaauaaaauuccuaucuc

SEQ ID NO: 783124 - RNA, 18 nt, Homo sapiens
gagaauaccuuggucuca

SEQ ID NO: 783125 - RNA, 13 nt, Homo sapiens
gagaaucacuuca

SEQ ID NO: 783126 - RNA, 13 nt, Homo sapiens
gagaaucccacau

SEQ ID NO: 783127 - RNA, 18 nt, Homo sapiens
gagaauccucccuuccca

SEQ ID NO: 783128 - RNA, 15 nt, Homo sapiens
gagaauguacuggcg

SEQ ID NO: 783129 - RNA, 22 nt, Homo sapiens
gagaauuccuuuuucuucuuua

SEQ ID NO: 783130 - RNA, 21 nt, Homo sapiens
gagaauuuccaaaacuuuaau

SEQ ID NO: 783131 - RNA, 13 nt, Homo sapiens
gagacaaauggag

SEQ ID NO: 783132 - RNA, 21 nt, Homo sapiens
gagacacaacuauuuuuccaa

SEQ ID NO: 783133 - RNA, 16 nt, Homo sapiens
gagacacauugccuuc

SEQ ID NO: 783134 - RNA, 21 nt, Homo sapiens
gagacacccucuggggguccu

SEQ ID NO: 783135 - RNA, 20 nt, Homo sapiens
gagacagacagagaaggcag

SEQ ID NO: 783136 - RNA, 19 nt, Homo sapiens
gagacagagacaaguaauu

SEQ ID NO: 783137 - RNA, 14 nt, Homo sapiens
gagacagauaacuc

SEQ ID NO: 783138 - RNA, 22 nt, Homo sapiens
gagacagguggccuagcaggca

SEQ ID NO: 783139 - RNA, 14 nt, Homo sapiens
gagacauacuugaa

SEQ ID NO: 783140 - RNA, 23 nt, Homo sapiens
gagacauacuugaagggccagag

SEQ ID NO: 783141 - RNA, 19 nt, Homo sapiens
gagacauguaccuugacca

SEQ ID NO: 783142 - RNA, 13 nt, Homo sapiens
gagacauuggcuu

SEQ ID NO: 783143 - RNA, 20 nt, Homo sapiens
gagaccauguugacuuuccu

SEQ ID NO: 783144 - RNA, 22 nt, Homo sapiens
gagaccccaucuuccagccacc

SEQ ID NO: 783145 - RNA, 20 nt, Homo sapiens
gagacccucguggccuuccc

SEQ ID NO: 783146 - RNA, 19 nt, Homo sapiens
gagacccugucucaaaaaa

SEQ ID NO: 783147 - RNA, 16 nt, Homo sapiens
gagaccuggaaccaga

SEQ ID NO: 783148 - RNA, 20 nt, Homo sapiens
gagacggguuucaccauguu

SEQ ID NO: 783149 - RNA, 18 nt, Homo sapiens
gagacgguguuuugccau

SEQ ID NO: 783150 - RNA, 16 nt, Homo sapiens
gagacuauggagccug

SEQ ID NO: 783151 - RNA, 23 nt, Homo sapiens
gagacucagggccccagcacuaa

SEQ ID NO: 783152 - RNA, 14 nt, Homo sapiens
gagacucagugcag

SEQ ID NO: 783153 - RNA, 15 nt, Homo sapiens
gagacucagugcaga

SEQ ID NO: 783154 - RNA, 13 nt, Homo sapiens
gagacuccgucuc

SEQ ID NO: 783155 - RNA, 16 nt, Homo sapiens
gagacuccgucucaag

SEQ ID NO: 783156 - RNA, 18 nt, Homo sapiens
gagacucuaggguccagu

SEQ ID NO: 783157 - RNA, 18 nt, Homo sapiens
gagacugcaucucaaaaa

SEQ ID NO: 783158 - RNA, 19 nt, Homo sapiens
gagacugccauacauaaua

SEQ ID NO: 783159 - RNA, 18 nt, Homo sapiens
gagacugcguucugcaag

SEQ ID NO: 783160 - RNA, 24 nt, Homo sapiens
gagacuggaccgcugacugcacca

SEQ ID NO: 783161 - RNA, 14 nt, Homo sapiens
gagacugggagcca

SEQ ID NO: 783162 - RNA, 19 nt, Homo sapiens
gagacuucacgggcaauca

SEQ ID NO: 783163 - RNA, 12 nt, Homo sapiens
gagagaacugaa

SEQ ID NO: 783164 - RNA, 19 nt, Homo sapiens
gagagaauagaagaagcua

SEQ ID NO: 783165 - RNA, 16 nt, Homo sapiens
gagagacccugucuca

SEQ ID NO: 783166 - RNA, 12 nt, Homo sapiens
gagagauguuuu

SEQ ID NO: 783167 - RNA, 15 nt, Homo sapiens
gagagauucuucccc

SEQ ID NO: 783168 - RNA, 20 nt, Homo sapiens
gagagcaaauaaagaccuga

SEQ ID NO: 783169 - RNA, 22 nt, Homo sapiens
gagagcccggcgccccugccac

SEQ ID NO: 783170 - RNA, 14 nt, Homo sapiens
gagagcgaaggggg

SEQ ID NO: 783171 - RNA, 23 nt, Homo sapiens
gagagcuaaauuacaauugucau

SEQ ID NO: 783172 - RNA, 13 nt, Homo sapiens
gagagcuggccaa

SEQ ID NO: 783173 - RNA, 17 nt, Homo sapiens
gaaccgcacagcucagg

SEQ ID NO: 783174 - RNA, 16 nt, Homo sapiens
gaaccgugauaagccu

SEQ ID NO: 783175 - RNA, 20 nt, Homo sapiens
gaaccuagauugcaccauug

SEQ ID NO: 783176 - RNA, 15 nt, Homo sapiens
gaaccucacugaaaa

SEQ ID NO: 783177 - RNA, 22 nt, Homo sapiens
gaaccuguccuaaggaaccuuc

SEQ ID NO: 783178 - RNA, 16 nt, Homo sapiens
gaaccuguccuugcac

SEQ ID NO: 783179 - RNA, 20 nt, Homo sapiens
gaaccuguccuugcacacuc

SEQ ID NO: 783180 - RNA, 19 nt, Homo sapiens
gaacgagaagcagcauuug

SEQ ID NO: 783181 - RNA, 13 nt, Homo sapiens
gaacgcucuuagc

SEQ ID NO: 783182 - RNA, 13 nt, Homo sapiens
gaacggggagaaa

SEQ ID NO: 783183 - RNA, 16 nt, Homo sapiens
gaacuaaaauucuguc

SEQ ID NO: 783184 - RNA, 15 nt, Homo sapiens
gaacuagagaaggac

SEQ ID NO: 783185 - RNA, 17 nt, Homo sapiens
gaacuaggacugaacua

SEQ ID NO: 783186 - RNA, 12 nt, Homo sapiens
gaacuaggcucu

SEQ ID NO: 783187 - RNA, 16 nt, Homo sapiens
gaacuaggguaaggug

SEQ ID NO: 783188 - RNA, 13 nt, Homo sapiens
gaacucagaucca

SEQ ID NO: 783189 - RNA, 23 nt, Homo sapiens
gaacucagcacauucgggaccaa

SEQ ID NO: 783190 - RNA, 22 nt, Homo sapiens
gaacucaugucuuucucagagg

SEQ ID NO: 783191 - RNA, 16 nt, Homo sapiens
gaacuccauacagccu

SEQ ID NO: 783192 - RNA, 17 nt, Homo sapiens
gaacucugcccaggugu

SEQ ID NO: 783193 - RNA, 21 nt, Homo sapiens
gaacucuucaaucucuugcac

SEQ ID NO: 783194 - RNA, 17 nt, Homo sapiens
gaacugacaaugaaggg

SEQ ID NO: 783195 - RNA, 15 nt, Homo sapiens
gaacugcuucuaaga

SEQ ID NO: 783196 - RNA, 19 nt, Homo sapiens
gaacuggaagaaagcaaca

SEQ ID NO: 783197 - RNA, 15 nt, Homo sapiens
gaacuggacucagga

SEQ ID NO: 783198 - RNA, 15 nt, Homo sapiens
gaacuggacugugug

SEQ ID NO: 783199 - RNA, 13 nt, Homo sapiens
gaacugucccaca

SEQ ID NO: 783200 - RNA, 17 nt, Homo sapiens
gaacugugcaucaacca

SEQ ID NO: 783201 - RNA, 11 nt, Homo sapiens
gaacuguuaca

SEQ ID NO: 783202 - RNA, 21 nt, Homo sapiens
gaacuguugaaagaaaauaua

SEQ ID NO: 783203 - RNA, 22 nt, Homo sapiens
gaacuguuggcugcuccccacc

SEQ ID NO: 783204 - RNA, 14 nt, Homo sapiens
gaacuuauuuacac

SEQ ID NO: 783205 - RNA, 14 nt, Homo sapiens
gaacuucacaguga

SEQ ID NO: 783206 - RNA, 20 nt, Homo sapiens
gaacuucacagugacacugg

SEQ ID NO: 783207 - RNA, 15 nt, Homo sapiens
gaacuucccuuaaga

SEQ ID NO: 783208 - RNA, 16 nt, Homo sapiens
gaacuugcaauaccaa

SEQ ID NO: 783209 - RNA, 18 nt, Homo sapiens
gaacuuuaagaagcagug

SEQ ID NO: 783210 - RNA, 17 nt, Homo sapiens
gaacuuuaagucucacc

SEQ ID NO: 783211 - RNA, 14 nt, Homo sapiens
gaacuuucuggucc

SEQ ID NO: 783212 - RNA, 22 nt, Homo sapiens
gaacuuuuuuagaaaugcaaaa

SEQ ID NO: 783213 - RNA, 19 nt, Homo sapiens
gaagaaaaaguacaaugaa

SEQ ID NO: 783214 - RNA, 14 nt, Homo sapiens
gaagaaaacaucua

SEQ ID NO: 783215 - RNA, 14 nt, Homo sapiens
gaagaaaacuuuug

SEQ ID NO: 783216 - RNA, 23 nt, Homo sapiens
gaagaaaagaaucacaguacuuu

SEQ ID NO: 783217 - RNA, 20 nt, Homo sapiens
gaagaaacuuugccucaaga

SEQ ID NO: 783218 - RNA, 13 nt, Homo sapiens
gaagaaagcaaca

SEQ ID NO: 783219 - RNA, 19 nt, Homo sapiens
gaagaacaguaacugccau

SEQ ID NO: 783220 - RNA, 17 nt, Homo sapiens
gaagaaccaaauaccuc

SEQ ID NO: 783221 - RNA, 11 nt, Homo sapiens
gaagaacugac

SEQ ID NO: 783222 - RNA, 12 nt, Homo sapiens
gaagaacugacu

SEQ ID NO: 783223 - RNA, 17 nt, Homo sapiens
gaagaacugacuaguga

SEQ ID NO: 783224 - RNA, 21 nt, Homo sapiens
gaagaacuggaaccccagcuu

SEQ ID NO: 783225 - RNA, 13 nt, Homo sapiens
gaagaacuugcau

SEQ ID NO: 783226 - RNA, 22 nt, Homo sapiens
gaagaagggagacgaaaaucca

SEQ ID NO: 783227 - RNA, 13 nt, Homo sapiens
gaagaaugaaaau

SEQ ID NO: 783228 - RNA, 22 nt, Homo sapiens
gaagaaugcacaagaauggauc

SEQ ID NO: 783229 - RNA, 22 nt, Homo sapiens
gaagacaacagcauaacuaaau

SEQ ID NO: 783230 - RNA, 12 nt, Homo sapiens
gaagacacugca

SEQ ID NO: 783231 - RNA, 15 nt, Homo sapiens
gaagacacugcaaag

SEQ ID NO: 783232 - RNA, 14 nt, Homo sapiens
gaagaccaaaugau

SEQ ID NO: 783233 - RNA, 21 nt, Homo sapiens
gaagaccaagacacagaucac

SEQ ID NO: 783234 - RNA, 20 nt, Homo sapiens
gaagaccagcuuugcaguga

SEQ ID NO: 783235 - RNA, 17 nt, Homo sapiens
gaagacccacgugcuag

SEQ ID NO: 783236 - RNA, 19 nt, Homo sapiens
gaagacccacgugcuaggg

SEQ ID NO: 783237 - RNA, 21 nt, Homo sapiens
gaagacguggacuccucuugg

SEQ ID NO: 783238 - RNA, 15 nt, Homo sapiens
gaagacuauggugcu

SEQ ID NO: 783239 - RNA, 14 nt, Homo sapiens
gaagacucaguaug

SEQ ID NO: 783240 - RNA, 12 nt, Homo sapiens
gaagacuguggc

SEQ ID NO: 783241 - RNA, 15 nt, Homo sapiens
gaagacuugccugcu

SEQ ID NO: 783242 - RNA, 20 nt, Homo sapiens
gaagacuuuaaaccaccuag

SEQ ID NO: 783243 - RNA, 15 nt, Homo sapiens
gaagacuuuaucaug

SEQ ID NO: 783244 - RNA, 16 nt, Homo sapiens
gaagagaaaugcugcu

SEQ ID NO: 783245 - RNA, 16 nt, Homo sapiens
gaagagaagcugcuga

SEQ ID NO: 783246 - RNA, 20 nt, Homo sapiens
gaagagaagcugcugaccaa

SEQ ID NO: 783247 - RNA, 13 nt, Homo sapiens
gaagagaagggca

SEQ ID NO: 783248 - RNA, 17 nt, Homo sapiens
gaagagauccuucugua

SEQ ID NO: 783249 - RNA, 13 nt, Homo sapiens
gaagagcuugugu

SEQ ID NO: 783250 - RNA, 15 nt, Homo sapiens
gaagaggaaagggag

SEQ ID NO: 783251 - RNA, 22 nt, Homo sapiens
gaagagggaccagggugggaga

SEQ ID NO: 783252 - RNA, 13 nt, Homo sapiens
gaagagggucccu

SEQ ID NO: 783253 - RNA, 21 nt, Homo sapiens
gaagaguauuuuugacagaau

SEQ ID NO: 783254 - RNA, 17 nt, Homo sapiens
gaagaguuuacagacaa

SEQ ID NO: 783255 - RNA, 20 nt, Homo sapiens
gaagaguuucuccuuuugac

SEQ ID NO: 783256 - RNA, 23 nt, Homo sapiens
gaagauacagagaugcaaugaua

SEQ ID NO: 783257 - RNA, 16 nt, Homo sapiens
gaagaucgcauggcag

SEQ ID NO: 783258 - RNA, 20 nt, Homo sapiens
gaagaugaaagauucaguga

SEQ ID NO: 783259 - RNA, 21 nt, Homo sapiens
gaagaugaauggucuggcaau

SEQ ID NO: 783260 - RNA, 22 nt, Homo sapiens
gaagaugaauggucuggcaaua

SEQ ID NO: 783261 - RNA, 12 nt, Homo sapiens
gaagaugcugcc

SEQ ID NO: 783262 - RNA, 14 nt, Homo sapiens
gaagauggagacac

SEQ ID NO: 783263 - RNA, 14 nt, Homo sapiens
gaagauggauguaa

SEQ ID NO: 783264 - RNA, 13 nt, Homo sapiens
gaagaugugaagg

SEQ ID NO: 783265 - RNA, 16 nt, Homo sapiens
gaagauguguaaacag

SEQ ID NO: 783266 - RNA, 22 nt, Homo sapiens
gaagauuuuauucuuauuucau

SEQ ID NO: 783267 - RNA, 15 nt, Homo sapiens
gaagcaaacaagcuu

SEQ ID NO: 783268 - RNA, 21 nt, Homo sapiens
gaagcaauaaagcucuucccu

SEQ ID NO: 783269 - RNA, 14 nt, Homo sapiens
gaagcacagcuccu

SEQ ID NO: 783270 - RNA, 16 nt, Homo sapiens
gaagcacauguguauu

SEQ ID NO: 783271 - RNA, 20 nt, Homo sapiens
gaagcagaaauauagugcaa

SEQ ID NO: 783272 - RNA, 13 nt, Homo sapiens
gaagcagcacugu

SEQ ID NO: 783273 - RNA, 16 nt, Homo sapiens
gaagcaguuucagaga

SEQ ID NO: 783274 - RNA, 19 nt, Homo sapiens
gaagcauacaaagcaguuu

SEQ ID NO: 783275 - RNA, 19 nt, Homo sapiens
gaagcaugcuuugcugcua

SEQ ID NO: 783276 - RNA, 15 nt, Homo sapiens
gaagcauucucccca

SEQ ID NO: 783277 - RNA, 17 nt, Homo sapiens
gaagccacagugcccac

SEQ ID NO: 783278 - RNA, 17 nt, Homo sapiens
gaagccagcuuuccuca

SEQ ID NO: 783279 - RNA, 23 nt, Homo sapiens
gaagcccugauguguccucaggg

SEQ ID NO: 783280 - RNA, 15 nt, Homo sapiens
gaagccggcggccca

SEQ ID NO: 783281 - RNA, 19 nt, Homo sapiens
gaagccuguggugugcgga

SEQ ID NO: 783282 - RNA, 22 nt, Homo sapiens
gaagccuuagccaggaggccag

SEQ ID NO: 783283 - RNA, 19 nt, Homo sapiens
gaagccuucagcuccaggg

SEQ ID NO: 783284 - RNA, 22 nt, Homo sapiens
gaagccuucuuuuucugagaca

SEQ ID NO: 783285 - RNA, 18 nt, Homo sapiens
gaagcggagagagccaag

SEQ ID NO: 783286 - RNA, 19 nt, Homo sapiens
gaagcggagcuugcaguga

SEQ ID NO: 783287 - RNA, 18 nt, Homo sapiens
gaagcguuaugugcagua

SEQ ID NO: 783288 - RNA, 14 nt, Homo sapiens
gaccccugccaguu

SEQ ID NO: 783289 - RNA, 17 nt, Homo sapiens
gacccuaaaucugagga

SEQ ID NO: 783290 - RNA, 18 nt, Homo sapiens
gacccuagggauuugcac

SEQ ID NO: 783291 - RNA, 20 nt, Homo sapiens
gacccucugacccuagcucu

SEQ ID NO: 783292 - RNA, 20 nt, Homo sapiens
gacccugagcagaauacugg

SEQ ID NO: 783293 - RNA, 12 nt, Homo sapiens
gacccuggucuc

SEQ ID NO: 783294 - RNA, 17 nt, Homo sapiens
gacccugucuucugggc

SEQ ID NO: 783295 - RNA, 17 nt, Homo sapiens
gacccuugucaucucuc

SEQ ID NO: 783296 - RNA, 17 nt, Homo sapiens
gacccuuuucucaggac

SEQ ID NO: 783297 - RNA, 21 nt, Homo sapiens
gaccgagcccagcagaucuca

SEQ ID NO: 783298 - RNA, 18 nt, Homo sapiens
gaccgaggacacagugga

SEQ ID NO: 783299 - RNA, 15 nt, Homo sapiens
gaccuacagugcugu

SEQ ID NO: 783300 - RNA, 19 nt, Homo sapiens
gaccuaccugcagugggaa

SEQ ID NO: 783301 - RNA, 15 nt, Homo sapiens
gaccuaggauuucau

SEQ ID NO: 783302 - RNA, 18 nt, Homo sapiens
gaccuaguauaucaguga

SEQ ID NO: 783303 - RNA, 17 nt, Homo sapiens
gaccuaugagcacauag

SEQ ID NO: 783304 - RNA, 13 nt, Homo sapiens
gaccuauuuccag

SEQ ID NO: 783305 - RNA, 11 nt, Homo sapiens
gaccucacccu

SEQ ID NO: 783306 - RNA, 14 nt, Homo sapiens
gaccucacuguccu

SEQ ID NO: 783307 - RNA, 20 nt, Homo sapiens
gaccucacuguccugugaag

SEQ ID NO: 783308 - RNA, 15 nt, Homo sapiens
gaccuccaaagaaca

SEQ ID NO: 783309 - RNA, 21 nt, Homo sapiens
gaccuccagcuaaacaccaac

SEQ ID NO: 783310 - RNA, 15 nt, Homo sapiens
gaccucgccugcugg

SEQ ID NO: 783311 - RNA, 21 nt, Homo sapiens
gaccucgccugcuggggaccu

SEQ ID NO: 783312 - RNA, 23 nt, Homo sapiens
gaccucuuccuccucgcugccag

SEQ ID NO: 783313 - RNA, 14 nt, Homo sapiens
gaccugagaaccuu

SEQ ID NO: 783314 - RNA, 20 nt, Homo sapiens
gaccugauucccugugguga

SEQ ID NO: 783315 - RNA, 16 nt, Homo sapiens
gaccugccuccugccu

SEQ ID NO: 783316 - RNA, 20 nt, Homo sapiens
gaccuggaaccagagccaca

SEQ ID NO: 783317 - RNA, 19 nt, Homo sapiens
gaccuggugggagcaccug

SEQ ID NO: 783318 - RNA, 22 nt, Homo sapiens
gaccugugaccagcacugucuc

SEQ ID NO: 783319 - RNA, 17 nt, Homo sapiens
gaccuuaggccuuccuc

SEQ ID NO: 783320 - RNA, 13 nt, Homo sapiens
gaccuucaugccc

SEQ ID NO: 783321 - RNA, 15 nt, Homo sapiens
gaccuuccucaucca

SEQ ID NO: 783322 - RNA, 15 nt, Homo sapiens
gaccuuggcagccca

SEQ ID NO: 783323 - RNA, 15 nt, Homo sapiens
gaccuugggccaaga

SEQ ID NO: 783324 - RNA, 14 nt, Homo sapiens
gacgacaagugcug

SEQ ID NO: 783325 - RNA, 20 nt, Homo sapiens
gacgcaacuuaagcugggau

SEQ ID NO: 783326 - RNA, 17 nt, Homo sapiens
gacgcaucucaaaacag

SEQ ID NO: 783327 - RNA, 15 nt, Homo sapiens
gacgcggcucccggg

SEQ ID NO: 783328 - RNA, 21 nt, Homo sapiens
gacgcugcccugcaugcugcc

SEQ ID NO: 783329 - RNA, 15 nt, Homo sapiens
gacggaguccugugu

SEQ ID NO: 783330 - RNA, 17 nt, Homo sapiens
gacggagucuugcucug

SEQ ID NO: 783331 - RNA, 22 nt, Homo sapiens
gacggcgugccuggacacugua

SEQ ID NO: 783332 - RNA, 21 nt, Homo sapiens
gacgguaacuuggcugcauuu

SEQ ID NO: 783333 - RNA, 17 nt, Homo sapiens
gacgguaaguguucuca

SEQ ID NO: 783334 - RNA, 15 nt, Homo sapiens
gacgguucaccagcc

SEQ ID NO: 783335 - RNA, 19 nt, Homo sapiens
gacgucagacuuggcucag

SEQ ID NO: 783336 - RNA, 19 nt, Homo sapiens
gacguccucccugauccca

SEQ ID NO: 783337 - RNA, 15 nt, Homo sapiens
gacgugcagccacac

SEQ ID NO: 783338 - RNA, 14 nt, Homo sapiens
gacguguggugugc

SEQ ID NO: 783339 - RNA, 18 nt, Homo sapiens
cuuacuagaccuguaacu

SEQ ID NO: 783340 - RNA, 18 nt, Homo sapiens
cuuacuccaucgugugug

SEQ ID NO: 783341 - RNA, 19 nt, Homo sapiens
cuuacuccucuuuccuucc

SEQ ID NO: 783342 - RNA, 18 nt, Homo sapiens
cuuacuucuggcauaacu

SEQ ID NO: 783343 - RNA, 15 nt, Homo sapiens
cuuacuucuuagcac

SEQ ID NO: 783344 - RNA, 14 nt, Homo sapiens
cuuacuuugcuuga

SEQ ID NO: 783345 - RNA, 20 nt, Homo sapiens
cuuagaaaucauuguagaaa

SEQ ID NO: 783346 - RNA, 18 nt, Homo sapiens
cuuagaaauugcauuucc

SEQ ID NO: 783347 - RNA, 19 nt, Homo sapiens
cuuagaauggagggcaaca

SEQ ID NO: 783348 - RNA, 19 nt, Homo sapiens
cuuagaauuugggggaaaa

SEQ ID NO: 783349 - RNA, 17 nt, Homo sapiens
cuuagaguguagcugua

SEQ ID NO: 783350 - RNA, 22 nt, Homo sapiens
cuuagaugagggugacugucaa

SEQ ID NO: 783351 - RNA, 18 nt, Homo sapiens
cuuagcacacucacagau

SEQ ID NO: 783352 - RNA, 19 nt, Homo sapiens
cuuagcagcuaucucucag

SEQ ID NO: 783353 - RNA, 21 nt, Homo sapiens
cuuagcauagauuugcagcuc

SEQ ID NO: 783354 - RNA, 18 nt, Homo sapiens
cuuagcccuguguccuga

SEQ ID NO: 783355 - RNA, 14 nt, Homo sapiens
cuuagccucuggau

SEQ ID NO: 783356 - RNA, 21 nt, Homo sapiens
cuuagcuaguuuuauucuugg

SEQ ID NO: 783357 - RNA, 12 nt, Homo sapiens
cuuagcugucac

SEQ ID NO: 783358 - RNA, 16 nt, Homo sapiens
cuuagcugucugcuca

SEQ ID NO: 783359 - RNA, 18 nt, Homo sapiens
cuuaggauucuguucccu

SEQ ID NO: 783360 - RNA, 15 nt, Homo sapiens
cuuaggccagcacca

SEQ ID NO: 783361 - RNA, 23 nt, Homo sapiens
cuuagggcagauuuucaugcaaa

SEQ ID NO: 783362 - RNA, 16 nt, Homo sapiens
cuuagggcaggaaaga

SEQ ID NO: 783363 - RNA, 17 nt, Homo sapiens
cuuagucccucaugcaa

SEQ ID NO: 783364 - RNA, 16 nt, Homo sapiens
cuuaguuauugcugaa

SEQ ID NO: 783365 - RNA, 13 nt, Homo sapiens
cuuaguucuugga

SEQ ID NO: 783366 - RNA, 17 nt, Homo sapiens
cuuauaagaguucuaga

SEQ ID NO: 783367 - RNA, 14 nt, Homo sapiens
cuuauacauuugau

SEQ ID NO: 783368 - RNA, 15 nt, Homo sapiens
cuuauacauuugaua

SEQ ID NO: 783369 - RNA, 18 nt, Homo sapiens
cuuaucaacuaaugauuu

SEQ ID NO: 783370 - RNA, 23 nt, Homo sapiens
cuuauccauaggcgcaggugcac

SEQ ID NO: 783371 - RNA, 15 nt, Homo sapiens
cuuaucccaagagaa

SEQ ID NO: 783372 - RNA, 23 nt, Homo sapiens
cuuaucgggcuccagccaucuca

SEQ ID NO: 783373 - RNA, 15 nt, Homo sapiens
cuuaucucucaaaac

SEQ ID NO: 783374 - RNA, 16 nt, Homo sapiens
cuuaugcaaucuaugu

SEQ ID NO: 783375 - RNA, 15 nt, Homo sapiens
cuuaugcaugaaaug

SEQ ID NO: 783376 - RNA, 14 nt, Homo sapiens
cuuaugccauauaa

SEQ ID NO: 783377 - RNA, 23 nt, Homo sapiens
cuuauggauucauauaggccaga

SEQ ID NO: 783378 - RNA, 22 nt, Homo sapiens
cuuaugggucccccucagcaag

SEQ ID NO: 783379 - RNA, 14 nt, Homo sapiens
cuuauguuauacaa

SEQ ID NO: 783380 - RNA, 14 nt, Homo sapiens
cuuauuaugcauaa

SEQ ID NO: 783381 - RNA, 19 nt, Homo sapiens
cuuauuaugcauaaagcca

SEQ ID NO: 783382 - RNA, 20 nt, Homo sapiens
cuuauuaugcauaaagccaa

SEQ ID NO: 783383 - RNA, 21 nt, Homo sapiens
cuuauucuuugaguaauguga

SEQ ID NO: 783384 - RNA, 15 nt, Homo sapiens
cuuauuucauaaaca

SEQ ID NO: 783385 - RNA, 17 nt, Homo sapiens
cuuauuucuaacuauua

SEQ ID NO: 783386 - RNA, 13 nt, Homo sapiens
cuuauuucuauga

SEQ ID NO: 783387 - RNA, 20 nt, Homo sapiens
cuuauuuuauuuuuuaccau

SEQ ID NO: 783388 - RNA, 14 nt, Homo sapiens
cuuauuuuucucca

SEQ ID NO: 783389 - RNA, 17 nt, Homo sapiens
cuuauuuuugacagugu

SEQ ID NO: 783390 - RNA, 16 nt, Homo sapiens
cuuauuuuuguucaua

SEQ ID NO: 783391 - RNA, 23 nt, Homo sapiens
cuucaaaagcuuuuuacucaaag

SEQ ID NO: 783392 - RNA, 19 nt, Homo sapiens
cuucaaaguuaaugggaug

SEQ ID NO: 783393 - RNA, 14 nt, Homo sapiens
cuucaaauguggua

SEQ ID NO: 783394 - RNA, 16 nt, Homo sapiens
cuucaagaacucuggg

SEQ ID NO: 783395 - RNA, 22 nt, Homo sapiens
cuucaaggcccauaucugugaa

SEQ ID NO: 783396 - RNA, 20 nt, Homo sapiens
cuucaagggacaaguauuaa

SEQ ID NO: 783397 - RNA, 19 nt, Homo sapiens
cuucaaguuaaagugaaua

SEQ ID NO: 783398 - RNA, 19 nt, Homo sapiens
cuucaaguuagcucaggag

SEQ ID NO: 783399 - RNA, 15 nt, Homo sapiens
cuucaaucacuguaa

SEQ ID NO: 783400 - RNA, 16 nt, Homo sapiens
cuucaaucuuaaaaca

SEQ ID NO: 783401 - RNA, 21 nt, Homo sapiens
cuucaaucuucauuuuggagg

SEQ ID NO: 783402 - RNA, 18 nt, Homo sapiens
cuucaaugggcucuucca

SEQ ID NO: 783403 - RNA, 13 nt, Homo sapiens
cuucacaacuagg

SEQ ID NO: 783404 - RNA, 17 nt, Homo sapiens
cuucacagugacacugg

SEQ ID NO: 783405 - RNA, 14 nt, Homo sapiens
cuucacaguguuuc

SEQ ID NO: 783406 - RNA, 19 nt, Homo sapiens
cuucacauaagcucagaau

SEQ ID NO: 783407 - RNA, 13 nt, Homo sapiens
cuucacauuugcg

SEQ ID NO: 783408 - RNA, 23 nt, Homo sapiens
cuucaccagucugucuacugugg

SEQ ID NO: 783409 - RNA, 11 nt, Homo sapiens
cuucaccucag

SEQ ID NO: 783410 - RNA, 14 nt, Homo sapiens
cuucaccucuucca

SEQ ID NO: 783411 - RNA, 12 nt, Homo sapiens
cuucacugacag

SEQ ID NO: 783412 - RNA, 20 nt, Homo sapiens
cuucacuuacccauuagcca

SEQ ID NO: 783413 - RNA, 21 nt, Homo sapiens
cuucacuucaguugcuuugca

SEQ ID NO: 783414 - RNA, 13 nt, Homo sapiens
cuucacuuuacaa

SEQ ID NO: 783415 - RNA, 20 nt, Homo sapiens
gaaaggauugauuugaacuu

SEQ ID NO: 783416 - RNA, 17 nt, Homo sapiens
gaaaggauuuuaccaaa

SEQ ID NO: 783417 - RNA, 16 nt, Homo sapiens
gaaaggcauucucuga

SEQ ID NO: 783418 - RNA, 13 nt, Homo sapiens
gaaaggccuucag

SEQ ID NO: 783419 - RNA, 21 nt, Homo sapiens
gaaaggcuauuuucagaugaa

SEQ ID NO: 783420 - RNA, 16 nt, Homo sapiens
gaaaggcucauuuaaa

SEQ ID NO: 783421 - RNA, 16 nt, Homo sapiens
gaaagggauaguccaa

SEQ ID NO: 783422 - RNA, 18 nt, Homo sapiens
gaaagggauugcuuugca

SEQ ID NO: 783423 - RNA, 15 nt, Homo sapiens
gaaaggggaaugugg

SEQ ID NO: 783424 - RNA, 13 nt, Homo sapiens
gaaaggggugcuu

SEQ ID NO: 783425 - RNA, 16 nt, Homo sapiens
gaaagguuauguuagc

SEQ ID NO: 783426 - RNA, 20 nt, Homo sapiens
gaaaguaaaaaguugcuucu

SEQ ID NO: 783427 - RNA, 20 nt, Homo sapiens
gaaagugagagccagcagca

SEQ ID NO: 783428 - RNA, 14 nt, Homo sapiens
gaaagugcugauaa

SEQ ID NO: 783429 - RNA, 19 nt, Homo sapiens
gaaaguguuuaacuuguca

SEQ ID NO: 783430 - RNA, 19 nt, Homo sapiens
gaaauaaagcguccucuca

SEQ ID NO: 783431 - RNA, 15 nt, Homo sapiens
gaaauaaauguaccu

SEQ ID NO: 783432 - RNA, 22 nt, Homo sapiens
gaaauaaauguaccugauguac

SEQ ID NO: 783433 - RNA, 22 nt, Homo sapiens
gaaauaaauucugacuuaugaa

SEQ ID NO: 783434 - RNA, 23 nt, Homo sapiens
gaaauaagaauucagacaucuga

SEQ ID NO: 783435 - RNA, 16 nt, Homo sapiens
gaaauaagcugugauu

SEQ ID NO: 783436 - RNA, 18 nt, Homo sapiens
gaaauacaguacuguuuc

SEQ ID NO: 783437 - RNA, 22 nt, Homo sapiens
gaaauaccacagcucagccacu

SEQ ID NO: 783438 - RNA, 13 nt, Homo sapiens
gaaauagugacau

SEQ ID NO: 783439 - RNA, 16 nt, Homo sapiens
gaaauaguucugugac

SEQ ID NO: 783440 - RNA, 14 nt, Homo sapiens
gaaauauauuacuu

SEQ ID NO: 783441 - RNA, 19 nt, Homo sapiens
gaaauauccagaacauacu

SEQ ID NO: 783442 - RNA, 19 nt, Homo sapiens
gaaauauuuuacaguuuuu

SEQ ID NO: 783443 - RNA, 16 nt, Homo sapiens
gaaaucaaaaagggaa

SEQ ID NO: 783444 - RNA, 17 nt, Homo sapiens
gaaaucaaaaagggaau

SEQ ID NO: 783445 - RNA, 22 nt, Homo sapiens
gaaaucauaccaguuguucauu

SEQ ID NO: 783446 - RNA, 17 nt, Homo sapiens
gaaauccauaucuuaaa

SEQ ID NO: 783447 - RNA, 21 nt, Homo sapiens
gaaauccuuccuaaacccaau

SEQ ID NO: 783448 - RNA, 19 nt, Homo sapiens
gaaaucuagaagacuguca

SEQ ID NO: 783449 - RNA, 12 nt, Homo sapiens
gaaaucugacaa

SEQ ID NO: 783450 - RNA, 16 nt, Homo sapiens
gaaaucuuaaaccuua

SEQ ID NO: 783451 - RNA, 13 nt, Homo sapiens
gaaaugaacuugg

SEQ ID NO: 783452 - RNA, 14 nt, Homo sapiens
gaaaugaauagacu

SEQ ID NO: 783453 - RNA, 13 nt, Homo sapiens
gaaaugaauauuc

SEQ ID NO: 783454 - RNA, 14 nt, Homo sapiens
gaaaugacuuugaa

SEQ ID NO: 783455 - RNA, 9 nt, Homo sapiens
gaaaugcaa

SEQ ID NO: 783456 - RNA, 21 nt, Homo sapiens
gaaaugcccaucuaugucccu

SEQ ID NO: 783457 - RNA, 23 nt, Homo sapiens
gaaaugcccaucuaugucccuug

SEQ ID NO: 783458 - RNA, 20 nt, Homo sapiens
gaaaugcucuuuugcacaag

SEQ ID NO: 783459 - RNA, 16 nt, Homo sapiens
gaaauggccacuacuu

SEQ ID NO: 783460 - RNA, 15 nt, Homo sapiens
cugggaauggggaca

SEQ ID NO: 783461 - RNA, 16 nt, Homo sapiens
cugggaccaacccugg

SEQ ID NO: 783462 - RNA, 13 nt, Homo sapiens
cugggaccacugg

SEQ ID NO: 783463 - RNA, 17 nt, Homo sapiens
cugggacccgaggauuu

SEQ ID NO: 783464 - RNA, 18 nt, Homo sapiens
cugggacccgaggauuuc

SEQ ID NO: 783465 - RNA, 14 nt, Homo sapiens
cugggacuacagau

SEQ ID NO: 783466 - RNA, 15 nt, Homo sapiens
cugggagaaccucag

SEQ ID NO: 783467 - RNA, 21 nt, Homo sapiens
cugggagacuuugaagaccag

SEQ ID NO: 783468 - RNA, 18 nt, Homo sapiens
cugggagauacagccauc

SEQ ID NO: 783469 - RNA, 19 nt, Homo sapiens
cugggagcccagaacccac

SEQ ID NO: 783470 - RNA, 16 nt, Homo sapiens
cugggagucacacagu

SEQ ID NO: 783471 - RNA, 18 nt, Homo sapiens
cugggauauggcugccca

SEQ ID NO: 783472 - RNA, 16 nt, Homo sapiens
cugggaugggcuccca

SEQ ID NO: 783473 - RNA, 22 nt, Homo sapiens
cugggauuacaauugugagcca

SEQ ID NO: 783474 - RNA, 23 nt, Homo sapiens
cugggauuacaggcgugagccac

SEQ ID NO: 783475 - RNA, 21 nt, Homo sapiens
cugggcaacagaugaagaccc

SEQ ID NO: 783476 - RNA, 14 nt, Homo sapiens
cugggcagcauagc

SEQ ID NO: 783477 - RNA, 15 nt, Homo sapiens
cugggcauacuuucu

SEQ ID NO: 783478 - RNA, 20 nt, Homo sapiens
cugggccaaguuccucuagu

SEQ ID NO: 783479 - RNA, 13 nt, Homo sapiens
cugggccaugucc

SEQ ID NO: 783480 - RNA, 19 nt, Homo sapiens
cugggccccaugcucugcc

SEQ ID NO: 783481 - RNA, 16 nt, Homo sapiens
cugggccgcugccacg

SEQ ID NO: 783482 - RNA, 15 nt, Homo sapiens
cugggccugaccaaa

SEQ ID NO: 783483 - RNA, 18 nt, Homo sapiens
cugggccugcuuuuccag

SEQ ID NO: 783484 - RNA, 12 nt, Homo sapiens
cugggcuauauu

SEQ ID NO: 783485 - RNA, 16 nt, Homo sapiens
cugggcucagccugag

SEQ ID NO: 783486 - RNA, 13 nt, Homo sapiens
cugggcucucacc

SEQ ID NO: 783487 - RNA, 23 nt, Homo sapiens
cugggcuguaacguggcacuggu

SEQ ID NO: 783488 - RNA, 19 nt, Homo sapiens
cuggggaaacaacauuuau

SEQ ID NO: 783489 - RNA, 15 nt, Homo sapiens
cuggggaaaggggac

SEQ ID NO: 783490 - RNA, 16 nt, Homo sapiens
cuggggaagacagugg

SEQ ID NO: 783491 - RNA, 15 nt, Homo sapiens
cuggggacucaggga

SEQ ID NO: 783492 - RNA, 15 nt, Homo sapiens
cuggggagcucagga

SEQ ID NO: 783493 - RNA, 21 nt, Homo sapiens
cuggggaucuucccacaggag

SEQ ID NO: 783494 - RNA, 15 nt, Homo sapiens
cuggggcaaugggag

SEQ ID NO: 783495 - RNA, 20 nt, Homo sapiens
cuggggccuacagcuuugau

SEQ ID NO: 783496 - RNA, 16 nt, Homo sapiens
cuggggggacccagug

SEQ ID NO: 783497 - RNA, 19 nt, Homo sapiens
cuggggguccucucugagu

SEQ ID NO: 783498 - RNA, 17 nt, Homo sapiens
cuggggugggcaguuuu

SEQ ID NO: 783499 - RNA, 23 nt, Homo sapiens
cugggguggggguggggagaccu

SEQ ID NO: 783500 - RNA, 19 nt, Homo sapiens
cuggguacugacugagaua

SEQ ID NO: 783501 - RNA, 20 nt, Homo sapiens
cugggucuugccaugugcug

SEQ ID NO: 783502 - RNA, 22 nt, Homo sapiens
cugggucuuucugacaucagca

SEQ ID NO: 783503 - RNA, 12 nt, Homo sapiens
cugggugcaaag

SEQ ID NO: 783504 - RNA, 20 nt, Homo sapiens
cugggugggcaucucaguua

SEQ ID NO: 783505 - RNA, 15 nt, Homo sapiens
cuggguggguggugg

SEQ ID NO: 783506 - RNA, 17 nt, Homo sapiens
cuggguuucucuguaua

SEQ ID NO: 783507 - RNA, 20 nt, Homo sapiens
cugguaauuuaagauuccag

SEQ ID NO: 783508 - RNA, 13 nt, Homo sapiens
cugguagcacuug

SEQ ID NO: 783509 - RNA, 15 nt, Homo sapiens
cugguauauacauau

SEQ ID NO: 783510 - RNA, 15 nt, Homo sapiens
cugguauguguggau

SEQ ID NO: 783511 - RNA, 14 nt, Homo sapiens
cuggucaccagagg

SEQ ID NO: 783512 - RNA, 16 nt, Homo sapiens
cuggucagaugauaua

SEQ ID NO: 783513 - RNA, 22 nt, Homo sapiens
cuggucccggggccagcacuuc

SEQ ID NO: 783514 - RNA, 11 nt, Homo sapiens
cuggucccugc

SEQ ID NO: 783515 - RNA, 15 nt, Homo sapiens
cuggucucaaacucc

SEQ ID NO: 783516 - RNA, 18 nt, Homo sapiens
cuggucucaaacuccuga

SEQ ID NO: 783517 - RNA, 18 nt, Homo sapiens
cuggugaacacugugacc

SEQ ID NO: 783518 - RNA, 20 nt, Homo sapiens
cuggugagaucaacaacacu

SEQ ID NO: 783519 - RNA, 16 nt, Homo sapiens
cuggugcaaauucaga

SEQ ID NO: 783520 - RNA, 18 nt, Homo sapiens
cuggugcagucauuauga

SEQ ID NO: 783521 - RNA, 12 nt, Homo sapiens
cuggugccauuu

SEQ ID NO: 783522 - RNA, 13 nt, Homo sapiens
cuggugccauuuc

SEQ ID NO: 783523 - RNA, 18 nt, Homo sapiens
cuggugccucugugcaca

SEQ ID NO: 783524 - RNA, 14 nt, Homo sapiens
cuggugcugcagua

SEQ ID NO: 783525 - RNA, 15 nt, Homo sapiens
cugguggaccacagg

SEQ ID NO: 783526 - RNA, 23 nt, Homo sapiens
cugguggcugggcccagcagggg

SEQ ID NO: 783527 - RNA, 15 nt, Homo sapiens
cugguguagcacuua

SEQ ID NO: 783528 - RNA, 12 nt, Homo sapiens
cugguguccuga

SEQ ID NO: 783529 - RNA, 13 nt, Homo sapiens
cugguuagguaga

SEQ ID NO: 783530 - RNA, 19 nt, Homo sapiens
cugguucccaccauucccu

SEQ ID NO: 783531 - RNA, 13 nt, Homo sapiens
cugguugcuguag

SEQ ID NO: 783532 - RNA, 13 nt, Homo sapiens
cugguugcuguau

SEQ ID NO: 783533 - RNA, 16 nt, Homo sapiens
cugguugugugcacaa

SEQ ID NO: 783534 - RNA, 22 nt, Homo sapiens
cugguuguugccaaacagccac

SEQ ID NO: 783535 - RNA, 19 nt, Homo sapiens
cugguuucucagaauccaa

SEQ ID NO: 783536 - RNA, 21 nt, Homo sapiens
cugguuuugacaucagcauua

SEQ ID NO: 783537 - RNA, 21 nt, Homo sapiens
cugguuuuuguagccuuccuc

SEQ ID NO: 783538 - RNA, 16 nt, Homo sapiens
cuguaaaaaauggagc

SEQ ID NO: 783539 - RNA, 18 nt, Homo sapiens
cuguaaaaaauggagcuc

SEQ ID NO: 783540 - RNA, 16 nt, Homo sapiens
cuguaaaacagguuau

SEQ ID NO: 783541 - RNA, 23 nt, Homo sapiens
cugugcaauagacacauacaugu

SEQ ID NO: 783542 - RNA, 17 nt, Homo sapiens
cugugcaguagccguuu

SEQ ID NO: 783543 - RNA, 13 nt, Homo sapiens
cugugcaugccau

SEQ ID NO: 783544 - RNA, 17 nt, Homo sapiens
cugugccacaaugcagu

SEQ ID NO: 783545 - RNA, 18 nt, Homo sapiens
cugugccagacauugcuc

SEQ ID NO: 783546 - RNA, 19 nt, Homo sapiens
cugugccagacauugcucu

SEQ ID NO: 783547 - RNA, 13 nt, Homo sapiens
cugugccagagau

SEQ ID NO: 783548 - RNA, 14 nt, Homo sapiens
cugugccccaccac

SEQ ID NO: 783549 - RNA, 14 nt, Homo sapiens
cugugccgugucca

SEQ ID NO: 783550 - RNA, 16 nt, Homo sapiens
cugugccuaucaccuc

SEQ ID NO: 783551 - RNA, 20 nt, Homo sapiens
cugugccugcucagcagcca

SEQ ID NO: 783552 - RNA, 22 nt, Homo sapiens
cugugccugggcccugggcuga

SEQ ID NO: 783553 - RNA, 20 nt, Homo sapiens
cugugccuuggugugcugua

SEQ ID NO: 783554 - RNA, 19 nt, Homo sapiens
cugugcuccgugccuccac

SEQ ID NO: 783555 - RNA, 14 nt, Homo sapiens
cugugcugcaugcg

SEQ ID NO: 783556 - RNA, 19 nt, Homo sapiens
cugugcugguguccugacc

SEQ ID NO: 783557 - RNA, 11 nt, Homo sapiens
cugugcugguu

SEQ ID NO: 783558 - RNA, 17 nt, Homo sapiens
cugugcuucgacuacug

SEQ ID NO: 783559 - RNA, 20 nt, Homo sapiens
cugugcuucgacuacugcuc

SEQ ID NO: 783560 - RNA, 17 nt, Homo sapiens
cuguggaccacugcaug

SEQ ID NO: 783561 - RNA, 10 nt, Homo sapiens
cuguggcauu

SEQ ID NO: 783562 - RNA, 17 nt, Homo sapiens
cuguggccaacugcaaa

SEQ ID NO: 783563 - RNA, 24 nt, Homo sapiens
cuguggccacucgagugcccaagg

SEQ ID NO: 783564 - RNA, 20 nt, Homo sapiens
cuguggccugugucccauga

SEQ ID NO: 783565 - RNA, 17 nt, Homo sapiens
cuguggcgacucugcag

SEQ ID NO: 783566 - RNA, 21 nt, Homo sapiens
cuguggcugcuagcacuugga

SEQ ID NO: 783567 - RNA, 12 nt, Homo sapiens
cuguggggagcc

SEQ ID NO: 783568 - RNA, 19 nt, Homo sapiens
cuguggggaucucaggggc

SEQ ID NO: 783569 - RNA, 15 nt, Homo sapiens
cuguggguaaauuaa

SEQ ID NO: 783570 - RNA, 21 nt, Homo sapiens
cugugggucugggagucacac

SEQ ID NO: 783571 - RNA, 21 nt, Homo sapiens
cugugguuucagaugugcaau

SEQ ID NO: 783572 - RNA, 15 nt, Homo sapiens
cuguguauucuagug

SEQ ID NO: 783573 - RNA, 16 nt, Homo sapiens
cugugucaaaagccag

SEQ ID NO: 783574 - RNA, 14 nt, Homo sapiens
cugugucccaugac

SEQ ID NO: 783575 - RNA, 21 nt, Homo sapiens
cugugugaacuaacaugcaaa

SEQ ID NO: 783576 - RNA, 12 nt, Homo sapiens
cugugugccauu

SEQ ID NO: 783577 - RNA, 21 nt, Homo sapiens
auccuuggggagcacuugucc

SEQ ID NO: 783578 - RNA, 21 nt, Homo sapiens
auccuuuagugcacccaguga

SEQ ID NO: 783579 - RNA, 20 nt, Homo sapiens
auccuuugagaaugugauuc

SEQ ID NO: 783580 - RNA, 17 nt, Homo sapiens
auccuuugcuucauucc

SEQ ID NO: 783581 - RNA, 20 nt, Homo sapiens
aucgacuuagccugagucau

SEQ ID NO: 783582 - RNA, 21 nt, Homo sapiens
aucgacuuguuuuugcacaug

SEQ ID NO: 783583 - RNA, 16 nt, Homo sapiens
aucgauauuagaagcu

SEQ ID NO: 783584 - RNA, 20 nt, Homo sapiens
aucgauccuggauucacuca

SEQ ID NO: 783585 - RNA, 17 nt, Homo sapiens
aucgaugcagugcuucc

SEQ ID NO: 783586 - RNA, 18 nt, Homo sapiens
aucgcaaggccugugcug

SEQ ID NO: 783587 - RNA, 15 nt, Homo sapiens
aucgcaccacugcac

SEQ ID NO: 783588 - RNA, 16 nt, Homo sapiens
aucgcaccacugcacu

SEQ ID NO: 783589 - RNA, 19 nt, Homo sapiens
aucgcaccacugcacucca

SEQ ID NO: 783590 - RNA, 23 nt, Homo sapiens
aucgccugaguugcuuuuacuuc

SEQ ID NO: 783591 - RNA, 15 nt, Homo sapiens
aucgcuagacuaaga

SEQ ID NO: 783592 - RNA, 21 nt, Homo sapiens
aucgcugaugcagacacagau

SEQ ID NO: 783593 - RNA, 16 nt, Homo sapiens
aucgcuugaaccuggg

SEQ ID NO: 783594 - RNA, 14 nt, Homo sapiens
aucgggaagcagaa

SEQ ID NO: 783595 - RNA, 13 nt, Homo sapiens
aucgguaggcaaa

SEQ ID NO: 783596 - RNA, 19 nt, Homo sapiens
aucgugaaaccccaucucu

SEQ ID NO: 783597 - RNA, 19 nt, Homo sapiens
aucguggccuugaccucca

SEQ ID NO: 783598 - RNA, 20 nt, Homo sapiens
aucguuccaguucccacuug

SEQ ID NO: 783599 - RNA, 14 nt, Homo sapiens
aucguuuugcccga

SEQ ID NO: 783600 - RNA, 17 nt, Homo sapiens
aucguuuuuguuuacug

SEQ ID NO: 783601 - RNA, 15 nt, Homo sapiens
aucuaaaaucugcua

SEQ ID NO: 783602 - RNA, 18 nt, Homo sapiens
aucuaaauguauucugca

SEQ ID NO: 783603 - RNA, 23 nt, Homo sapiens
aucuaacgcuuuaaauggcuacu

SEQ ID NO: 783604 - RNA, 18 nt, Homo sapiens
aucuaagccuuuccauaa

SEQ ID NO: 783605 - RNA, 22 nt, Homo sapiens
auaauucuuuucuuuuccauuu

SEQ ID NO: 783606 - RNA, 15 nt, Homo sapiens
auaauugcuuugcca

SEQ ID NO: 783607 - RNA, 19 nt, Homo sapiens
auaauugcuuugccaaaau

SEQ ID NO: 783608 - RNA, 23 nt, Homo sapiens
auaauugcuuuuucacagucacu

SEQ ID NO: 783609 - RNA, 16 nt, Homo sapiens
auaauuuaacuguguu

SEQ ID NO: 783610 - RNA, 20 nt, Homo sapiens
auacaaacuacagaguuuau

SEQ ID NO: 783611 - RNA, 21 nt, Homo sapiens
auacaaaguguaccaacauaa

SEQ ID NO: 783612 - RNA, 17 nt, Homo sapiens
auacaaauaacugauga

SEQ ID NO: 783613 - RNA, 18 nt, Homo sapiens
auacaaauuuggccuuaa

SEQ ID NO: 783614 - RNA, 20 nt, Homo sapiens
auacaaucagcccagugcaa

SEQ ID NO: 783615 - RNA, 22 nt, Homo sapiens
auacaauguauguacaauacaa

SEQ ID NO: 783616 - RNA, 19 nt, Homo sapiens
auacaauuauuuuuacagu

SEQ ID NO: 783617 - RNA, 13 nt, Homo sapiens
auacaauuccaaa

SEQ ID NO: 783618 - RNA, 15 nt, Homo sapiens
auacacacaugcccu

SEQ ID NO: 783619 - RNA, 18 nt, Homo sapiens
auacacuaaaaaucugag

SEQ ID NO: 783620 - RNA, 15 nt, Homo sapiens
auacacuaugaagau

SEQ ID NO: 783621 - RNA, 22 nt, Homo sapiens
auacacuccacuugaagcacuu

SEQ ID NO: 783622 - RNA, 23 nt, Homo sapiens
auacacuccacuugaagcacuua

SEQ ID NO: 783623 - RNA, 22 nt, Homo sapiens
auacacugaaguuaacagagac

SEQ ID NO: 783624 - RNA, 12 nt, Homo sapiens
auacacuugaag

SEQ ID NO: 783625 - RNA, 21 nt, Homo sapiens
auacagauagaguuccauaua

SEQ ID NO: 783626 - RNA, 22 nt, Homo sapiens
auacaggaggcagacaaugacc

SEQ ID NO: 783627 - RNA, 21 nt, Homo sapiens
auacaggggccaaagccaggc

SEQ ID NO: 783628 - RNA, 18 nt, Homo sapiens
auacaguaagcugcucua

SEQ ID NO: 783629 - RNA, 14 nt, Homo sapiens
auaaagaccuucca

SEQ ID NO: 783630 - RNA, 15 nt, Homo sapiens
auaaagagaacucug

SEQ ID NO: 783631 - RNA, 15 nt, Homo sapiens
auaaagauuucuagu

SEQ ID NO: 783632 - RNA, 12 nt, Homo sapiens
auaaagcacaga

SEQ ID NO: 783633 - RNA, 14 nt, Homo sapiens
auaaagcauguuca

SEQ ID NO: 783634 - RNA, 16 nt, Homo sapiens
auaaagcauucuuuaa

SEQ ID NO: 783635 - RNA, 14 nt, Homo sapiens
auaaagccaaauuu

SEQ ID NO: 783636 - RNA, 22 nt, Homo sapiens
auaaagccaaauuuccaguuua

SEQ ID NO: 783637 - RNA, 14 nt, Homo sapiens
auaaagccacugaa

SEQ ID NO: 783638 - RNA, 14 nt, Homo sapiens
auaaagcguccucu

SEQ ID NO: 783639 - RNA, 16 nt, Homo sapiens
auaaagcguccucuca

SEQ ID NO: 783640 - RNA, 18 nt, Homo sapiens
auaaagcguccucucagu

SEQ ID NO: 783641 - RNA, 22 nt, Homo sapiens
auaaagcguccucucaguaaug

SEQ ID NO: 783642 - RNA, 13 nt, Homo sapiens
auaaagcuaaaau

SEQ ID NO: 783643 - RNA, 22 nt, Homo sapiens
auaaaggacaggcuggugcuaa

SEQ ID NO: 783644 - RNA, 14 nt, Homo sapiens
auaaaguaccacac

SEQ ID NO: 783645 - RNA, 12 nt, Homo sapiens
auaaaguaccau

SEQ ID NO: 783646 - RNA, 18 nt, Homo sapiens
auaaaguaguccugugaa

SEQ ID NO: 783647 - RNA, 13 nt, Homo sapiens
auaaagugaaugu

SEQ ID NO: 783648 - RNA, 13 nt, Homo sapiens
auaaagugcaguu

SEQ ID NO: 783649 - RNA, 16 nt, Homo sapiens
auaaaguuacuugaau

SEQ ID NO: 783650 - RNA, 18 nt, Homo sapiens
auaaaguuuuuuuccaaa

SEQ ID NO: 783651 - RNA, 21 nt, Homo sapiens
auaaauaaagaagaaaauaac

SEQ ID NO: 783652 - RNA, 18 nt, Homo sapiens
auaaauacucagugauga

SEQ ID NO: 783653 - RNA, 21 nt, Homo sapiens
aguugaucuggaacccagacu

SEQ ID NO: 783654 - RNA, 22 nt, Homo sapiens
aguugauuaaaaaugcuuuuag

SEQ ID NO: 783655 - RNA, 18 nt, Homo sapiens
aguugauuuuacaauuga

SEQ ID NO: 783656 - RNA, 20 nt, Homo sapiens
aguugcaccauugcacucca

SEQ ID NO: 783657 - RNA, 20 nt, Homo sapiens
aguugcagauguuagauauu

SEQ ID NO: 783658 - RNA, 19 nt, Homo sapiens
aguugcaguccagcucuuu

SEQ ID NO: 783659 - RNA, 16 nt, Homo sapiens
aguugccaggcacuuu

SEQ ID NO: 783660 - RNA, 11 nt, Homo sapiens
aguugccugau

SEQ ID NO: 783661 - RNA, 19 nt, Homo sapiens
aguugcguggacucugcac

SEQ ID NO: 783662 - RNA, 17 nt, Homo sapiens
aguugcucacaugucuu

SEQ ID NO: 783663 - RNA, 16 nt, Homo sapiens
aguugcuuuucagcug

SEQ ID NO: 783664 - RNA, 17 nt, Homo sapiens
aguuggacuuguuuuaa

SEQ ID NO: 783665 - RNA, 14 nt, Homo sapiens
aguuggaguacuau

SEQ ID NO: 783666 - RNA, 15 nt, Homo sapiens
aguuggaucucuaca

SEQ ID NO: 783667 - RNA, 16 nt, Homo sapiens
aguuggccaagcagaa

SEQ ID NO: 783668 - RNA, 20 nt, Homo sapiens
aguugguuuguaucuugccu

SEQ ID NO: 783669 - RNA, 19 nt, Homo sapiens
aguuguaccaagugaaauu

SEQ ID NO: 783670 - RNA, 11 nt, Homo sapiens
aguuguauuag

SEQ ID NO: 783671 - RNA, 13 nt, Homo sapiens
aguuguguugaca

SEQ ID NO: 783672 - RNA, 15 nt, Homo sapiens
aguuguugacuguga

SEQ ID NO: 783673 - RNA, 17 nt, Homo sapiens
aguuguugacugugauu

SEQ ID NO: 783674 - RNA, 18 nt, Homo sapiens
aguuuaaugaacuaccau

SEQ ID NO: 783675 - RNA, 13 nt, Homo sapiens
aguuuaaugauua

SEQ ID NO: 783676 - RNA, 20 nt, Homo sapiens
agugaaaauuuuuacauuca

SEQ ID NO: 783677 - RNA, 13 nt, Homo sapiens
agugaaacagcug

SEQ ID NO: 783678 - RNA, 17 nt, Homo sapiens
agugaaacuaugauccc

SEQ ID NO: 783679 - RNA, 19 nt, Homo sapiens
agugaaagaagccacagcu

SEQ ID NO: 783680 - RNA, 12 nt, Homo sapiens
agugaaccaaaa

SEQ ID NO: 783681 - RNA, 17 nt, Homo sapiens
agugaaccuagauugca

SEQ ID NO: 783682 - RNA, 23 nt, Homo sapiens
agugaacuauuucuacacagugg

SEQ ID NO: 783683 - RNA, 15 nt, Homo sapiens
agugaagacuucuug

SEQ ID NO: 783684 - RNA, 18 nt, Homo sapiens
agugaagcagcacuguga

SEQ ID NO: 783685 - RNA, 21 nt, Homo sapiens
agugaagcuaauuaaacacau

SEQ ID NO: 783686 - RNA, 14 nt, Homo sapiens
agugaaggugcugg

SEQ ID NO: 783687 - RNA, 24 nt, Homo sapiens
agugaagugguacaaucuggcuca

SEQ ID NO: 783688 - RNA, 19 nt, Homo sapiens
agugaaugaaacacucagu

SEQ ID NO: 783689 - RNA, 14 nt, Homo sapiens
agugaaugccauuu

SEQ ID NO: 783690 - RNA, 15 nt, Homo sapiens
agugaaugugucugg

SEQ ID NO: 783691 - RNA, 16 nt, Homo sapiens
agugacaaaccaucca

SEQ ID NO: 783692 - RNA, 20 nt, Homo sapiens
agugacagagcaagacccca

SEQ ID NO: 783693 - RNA, 19 nt, Homo sapiens
agugacagcuuucugggau

SEQ ID NO: 783694 - RNA, 21 nt, Homo sapiens
agugacagcuuucugggaugu

SEQ ID NO: 783695 - RNA, 12 nt, Homo sapiens
agugacagucau

SEQ ID NO: 783696 - RNA, 16 nt, Homo sapiens
agugaccaucauuuca

SEQ ID NO: 783697 - RNA, 14 nt, Homo sapiens
aggggcuggcugga

SEQ ID NO: 783698 - RNA, 19 nt, Homo sapiens
aggggcuuaaaagaaacua

SEQ ID NO: 783699 - RNA, 17 nt, Homo sapiens
agggggaagaagaagag

SEQ ID NO: 783700 - RNA, 18 nt, Homo sapiens
agggggugacgcugaaga

SEQ ID NO: 783701 - RNA, 12 nt, Homo sapiens
agggggugacug

SEQ ID NO: 783702 - RNA, 13 nt, Homo sapiens
agggggugugcgu

SEQ ID NO: 783703 - RNA, 18 nt, Homo sapiens
agggggugugucugcuca

SEQ ID NO: 783704 - RNA, 20 nt, Homo sapiens
aggggguuacaaacugcaau

SEQ ID NO: 783705 - RNA, 14 nt, Homo sapiens
aggggucuuaccuu

SEQ ID NO: 783706 - RNA, 22 nt, Homo sapiens
aggggugaaaggggggaaccag

SEQ ID NO: 783707 - RNA, 13 nt, Homo sapiens
aggggugcauucu

SEQ ID NO: 783708 - RNA, 13 nt, Homo sapiens
agggguuccucaa

SEQ ID NO: 783709 - RNA, 19 nt, Homo sapiens
agggguugagggaagguuc

SEQ ID NO: 783710 - RNA, 23 nt, Homo sapiens
aggguaaauaaaccacugugcgu

SEQ ID NO: 783711 - RNA, 18 nt, Homo sapiens
aggguacaugugcacauu

SEQ ID NO: 783712 - RNA, 20 nt, Homo sapiens
agggucccuuaaagauuuuc

SEQ ID NO: 783713 - RNA, 16 nt, Homo sapiens
agggucuaagcaccuu

SEQ ID NO: 783714 - RNA, 23 nt, Homo sapiens
agggucugcucuuucucugccag

SEQ ID NO: 783715 - RNA, 18 nt, Homo sapiens
agggucuucccuaccuca

SEQ ID NO: 783716 - RNA, 21 nt, Homo sapiens
agccagaguuuuuaaagccuu

SEQ ID NO: 783717 - RNA, 22 nt, Homo sapiens
agccagaugugaaaacaucuca

SEQ ID NO: 783718 - RNA, 18 nt, Homo sapiens
agccagcaaccagcacau

SEQ ID NO: 783719 - RNA, 22 nt, Homo sapiens
agccagcacaccgggccaagug

SEQ ID NO: 783720 - RNA, 18 nt, Homo sapiens
agccagcagccagcucuc

SEQ ID NO: 783721 - RNA, 16 nt, Homo sapiens
agccagccaagcuuua

SEQ ID NO: 783722 - RNA, 21 nt, Homo sapiens
agccagcccccuccagcucau

SEQ ID NO: 783723 - RNA, 16 nt, Homo sapiens
agccagccggugccug

SEQ ID NO: 783724 - RNA, 14 nt, Homo sapiens
agccagccugggac

SEQ ID NO: 783725 - RNA, 16 nt, Homo sapiens
agccagccuugcuccu

SEQ ID NO: 783726 - RNA, 16 nt, Homo sapiens
agccagcucugcauua

SEQ ID NO: 783727 - RNA, 14 nt, Homo sapiens
agccagcugcuuga

SEQ ID NO: 783728 - RNA, 15 nt, Homo sapiens
agccagcugugcacu

SEQ ID NO: 783729 - RNA, 20 nt, Homo sapiens
agccagcuuacuagcacuuu

SEQ ID NO: 783730 - RNA, 22 nt, Homo sapiens
agccagcuuacuagcacuuuga

SEQ ID NO: 783731 - RNA, 23 nt, Homo sapiens
agccagcuuggggccaccaaagc

SEQ ID NO: 783732 - RNA, 16 nt, Homo sapiens
agccagcuuugcucag

SEQ ID NO: 783733 - RNA, 19 nt, Homo sapiens
agccaggagaagcucagcu

SEQ ID NO: 783734 - RNA, 18 nt, Homo sapiens
agccaggcaugguggcac

SEQ ID NO: 783735 - RNA, 14 nt, Homo sapiens
agccagggcugcca

SEQ ID NO: 783736 - RNA, 22 nt, Homo sapiens
agccaggguggucuugaucucc

SEQ ID NO: 783737 - RNA, 15 nt, Homo sapiens
agccagguaauguga

SEQ ID NO: 783738 - RNA, 16 nt, Homo sapiens
agccagguaaugugaa

SEQ ID NO: 783739 - RNA, 16 nt, Homo sapiens
agccagugagggcagu

SEQ ID NO: 783740 - RNA, 16 nt, Homo sapiens
agccaguggugcuaaa

SEQ ID NO: 783741 - RNA, 23 nt, Homo sapiens
agccaguuggcuucuaagccaaa

SEQ ID NO: 783742 - RNA, 19 nt, Homo sapiens
agccauaagaaagcacuau

SEQ ID NO: 783743 - RNA, 21 nt, Homo sapiens
agccauaagaaagcacuauua

SEQ ID NO: 783744 - RNA, 15 nt, Homo sapiens
agccauagagauuuu

SEQ ID NO: 783745 - RNA, 23 nt, Homo sapiens
agccauaguggagagaacugaau

SEQ ID NO: 783746 - RNA, 23 nt, Homo sapiens
agccaucaccuugauaaugggau

SEQ ID NO: 783747 - RNA, 21 nt, Homo sapiens
agccaucuaaugcuuguuuau

SEQ ID NO: 783748 - RNA, 21 nt, Homo sapiens
agccaugaucgagccacugca

SEQ ID NO: 783749 - RNA, 14 nt, Homo sapiens
agccauggggagca

SEQ ID NO: 783750 - RNA, 20 nt, Homo sapiens
agccauguaaucagauuuau

SEQ ID NO: 783751 - RNA, 17 nt, Homo sapiens
agccauuucacucucaa

SEQ ID NO: 783752 - RNA, 22 nt, Homo sapiens
agccauuucacucucaaacuuc

SEQ ID NO: 783753 - RNA, 20 nt, Homo sapiens
agccauuucccccuccucag

SEQ ID NO: 783754 - RNA, 19 nt, Homo sapiens
agccauuuuuaaugaucuc

SEQ ID NO: 783755 - RNA, 16 nt, Homo sapiens
agcccaagaggacuga

SEQ ID NO: 783756 - RNA, 18 nt, Homo sapiens
agcccaagcuucccucca

SEQ ID NO: 783757 - RNA, 16 nt, Homo sapiens
agcccaagguuaaaaa

SEQ ID NO: 783758 - RNA, 22 nt, Homo sapiens
agcccacaucccacaugcggcu

SEQ ID NO: 783759 - RNA, 14 nt, Homo sapiens
agcccagaacccac

SEQ ID NO: 783760 - RNA, 20 nt, Homo sapiens
agcccagagacauacuugaa

SEQ ID NO: 783761 - RNA, 14 nt, Homo sapiens
agcccagagccacc

SEQ ID NO: 783762 - RNA, 16 nt, Homo sapiens
agcccagcacuugaau

SEQ ID NO: 783763 - RNA, 16 nt, Homo sapiens
agcccagcagaucuca

SEQ ID NO: 783764 - RNA, 14 nt, Homo sapiens
agcccagccauuac

SEQ ID NO: 783765 - RNA, 17 nt, Homo sapiens
agcccagugcacugaaa

SEQ ID NO: 783766 - RNA, 14 nt, Homo sapiens
agcccagugucccu

SEQ ID NO: 783767 - RNA, 19 nt, Homo sapiens
agcccaugcucaaccacug

SEQ ID NO: 783768 - RNA, 14 nt, Homo sapiens
agcccaugugcacc

SEQ ID NO: 783769 - RNA, 15 nt, Homo sapiens
agccccaaaucucuc

SEQ ID NO: 783770 - RNA, 13 nt, Homo sapiens
agccccacugcca

SEQ ID NO: 783771 - RNA, 14 nt, Homo sapiens
agccccacuugaag

SEQ ID NO: 783772 - RNA, 16 nt, Homo sapiens
agccccaggggacaag

SEQ ID NO: 783773 - RNA, 13 nt, Homo sapiens
agccccaucagcu

SEQ ID NO: 783774 - RNA, 17 nt, Homo sapiens
agcccccaguaucucuu

SEQ ID NO: 783775 - RNA, 17 nt, Homo sapiens
agccccccuugccccac

SEQ ID NO: 783776 - RNA, 15 nt, Homo sapiens
agccccgagacacca

SEQ ID NO: 783777 - RNA, 12 nt, Homo sapiens
agccccuagugc

SEQ ID NO: 783778 - RNA, 22 nt, Homo sapiens
agccccuccccccaggcucagg

SEQ ID NO: 783779 - RNA, 20 nt, Homo sapiens
agccccuccucccccggcug

SEQ ID NO: 783780 - RNA, 11 nt, Homo sapiens
agccccugaaa

SEQ ID NO: 783781 - RNA, 21 nt, Homo sapiens
agccccuuacuaugaucucag

SEQ ID NO: 783782 - RNA, 23 nt, Homo sapiens
agccccuuacuaugaucucagga

SEQ ID NO: 783783 - RNA, 16 nt, Homo sapiens
agccccuuauuugcac

SEQ ID NO: 783784 - RNA, 21 nt, Homo sapiens
agccccuuauuugcacuucac

SEQ ID NO: 783785 - RNA, 20 nt, Homo sapiens
agcccgacagugccaucccc

SEQ ID NO: 783786 - RNA, 21 nt, Homo sapiens
agcccgaggcaccaguguccu

SEQ ID NO: 783787 - RNA, 23 nt, Homo sapiens
agcccgcuuuuguucuuccccac

SEQ ID NO: 783788 - RNA, 15 nt, Homo sapiens
agcccggcacuccag

SEQ ID NO: 783789 - RNA, 16 nt, Homo sapiens
agcccgucuuggcuua

SEQ ID NO: 783790 - RNA, 18 nt, Homo sapiens
agcccuaaccccuuccag

SEQ ID NO: 783791 - RNA, 23 nt, Homo sapiens
agcccuagaaagcugcugugauc

SEQ ID NO: 783792 - RNA, 20 nt, Homo sapiens
agcccucccuggcugugagc

SEQ ID NO: 783793 - RNA, 19 nt, Homo sapiens
agcccuccgccauucucaa

SEQ ID NO: 783794 - RNA, 16 nt, Homo sapiens
agcccuccucugucaa

SEQ ID NO: 783795 - RNA, 18 nt, Homo sapiens
agcccugauguguccuca

SEQ ID NO: 783796 - RNA, 19 nt, Homo sapiens
agcccugcaccaugcugcu

SEQ ID NO: 783797 - RNA, 18 nt, Homo sapiens
agcccugcagucacagcu

SEQ ID NO: 783798 - RNA, 19 nt, Homo sapiens
agcccugcagucacagcua

SEQ ID NO: 783799 - RNA, 22 nt, Homo sapiens
agcccuuacccucccaccacuc

SEQ ID NO: 783800 - RNA, 22 nt, Homo sapiens
agcccuuauggccaauaacuuu

SEQ ID NO: 783801 - RNA, 14 nt, Homo sapiens
agcccuuugcucug

SEQ ID NO: 783802 - RNA, 16 nt, Homo sapiens
agcccuuuuuguacug

SEQ ID NO: 783803 - RNA, 21 nt, Homo sapiens
agcccuuuuuguacugauaua

SEQ ID NO: 783804 - RNA, 14 nt, Homo sapiens
agccgaaguugcac

SEQ ID NO: 783805 - RNA, 21 nt, Homo sapiens
agccgagacucgacucugugc

SEQ ID NO: 783806 - RNA, 20 nt, Homo sapiens
agccgauggaaaauaccuaa

SEQ ID NO: 783807 - RNA, 20 nt, Homo sapiens
agccgcuggcaacaacagcu

SEQ ID NO: 783808 - RNA, 19 nt, Homo sapiens
agccgggcaugauggugca

SEQ ID NO: 783809 - RNA, 19 nt, Homo sapiens
agccggggccgucugugug

SEQ ID NO: 783810 - RNA, 15 nt, Homo sapiens
agccgguaacugucc

SEQ ID NO: 783811 - RNA, 15 nt, Homo sapiens
agccguauuuuacau

SEQ ID NO: 783812 - RNA, 15 nt, Homo sapiens
agccguccauggcac

SEQ ID NO: 783813 - RNA, 13 nt, Homo sapiens
agccgugaugccu

SEQ ID NO: 783814 - RNA, 15 nt, Homo sapiens
agccgugaugcucag

SEQ ID NO: 783815 - RNA, 17 nt, Homo sapiens
agccgugaugcucaggc

SEQ ID NO: 783816 - RNA, 23 nt, Homo sapiens
agccguuugagaagaaaacaucu

SEQ ID NO: 783817 - RNA, 14 nt, Homo sapiens
agcuaugaauauag

SEQ ID NO: 783818 - RNA, 16 nt, Homo sapiens
agcuaugaucgcgcca

SEQ ID NO: 783819 - RNA, 19 nt, Homo sapiens
agcuaugcccggaccucca

SEQ ID NO: 783820 - RNA, 21 nt, Homo sapiens
agcuauuaagaaaaucacauu

SEQ ID NO: 783821 - RNA, 16 nt, Homo sapiens
agcuauuuaaugacac

SEQ ID NO: 783822 - RNA, 17 nt, Homo sapiens
agcucaacucacagcuu

SEQ ID NO: 783823 - RNA, 20 nt, Homo sapiens
agcucaagaacacaugugca

SEQ ID NO: 783824 - RNA, 17 nt, Homo sapiens
agcucacacuccagugg

SEQ ID NO: 783825 - RNA, 17 nt, Homo sapiens
agcucaccaacuacaga

SEQ ID NO: 783826 - RNA, 15 nt, Homo sapiens
agcucaccacugugc

SEQ ID NO: 783827 - RNA, 19 nt, Homo sapiens
agcucaccacugugccuac

SEQ ID NO: 783828 - RNA, 19 nt, Homo sapiens
agcucaccccagguucuca

SEQ ID NO: 783829 - RNA, 22 nt, Homo sapiens
agcucaccccagguucucaccu

SEQ ID NO: 783830 - RNA, 19 nt, Homo sapiens
agaucaugacauaugacuu

SEQ ID NO: 783831 - RNA, 19 nt, Homo sapiens
agaucauuuggagcucuug

SEQ ID NO: 783832 - RNA, 14 nt, Homo sapiens
agauccagcagcug

SEQ ID NO: 783833 - RNA, 21 nt, Homo sapiens
agaucccagcucacgucacac

SEQ ID NO: 783834 - RNA, 19 nt, Homo sapiens
agauccgggagacugacac

SEQ ID NO: 783835 - RNA, 21 nt, Homo sapiens
agauccucaucuuggagcuuu

SEQ ID NO: 783836 - RNA, 16 nt, Homo sapiens
agauccuggguacuga

SEQ ID NO: 783837 - RNA, 20 nt, Homo sapiens
agaucgagaccauccuggcc

SEQ ID NO: 783838 - RNA, 19 nt, Homo sapiens
agaucgaggcuacagugag

SEQ ID NO: 783839 - RNA, 14 nt, Homo sapiens
agaucgcaccacug

SEQ ID NO: 783840 - RNA, 15 nt, Homo sapiens
agaucgcaccacugc

SEQ ID NO: 783841 - RNA, 16 nt, Homo sapiens
agaucgcaccacugca

SEQ ID NO: 783842 - RNA, 17 nt, Homo sapiens
agaucgcaccacugcac

SEQ ID NO: 783843 - RNA, 15 nt, Homo sapiens
agaucuacacauguu

SEQ ID NO: 783844 - RNA, 17 nt, Homo sapiens
agaucuaucuugucaau

SEQ ID NO: 783845 - RNA, 18 nt, Homo sapiens
agaucucauguccucuau

SEQ ID NO: 783846 - RNA, 20 nt, Homo sapiens
agaucuccaacagccagugu

SEQ ID NO: 783847 - RNA, 13 nt, Homo sapiens
agaucuuccccaa

SEQ ID NO: 783848 - RNA, 17 nt, Homo sapiens
agaucuugagagcugcu

SEQ ID NO: 783849 - RNA, 17 nt, Homo sapiens
agaucuuucaggaaaga

SEQ ID NO: 783850 - RNA, 13 nt, Homo sapiens
agaugaaccacau

SEQ ID NO: 783851 - RNA, 22 nt, Homo sapiens
agaugaaccugcagcaagcagc

SEQ ID NO: 783852 - RNA, 17 nt, Homo sapiens
agaugaacugacugaag

SEQ ID NO: 783853 - RNA, 16 nt, Homo sapiens
agaugaagacaacagc

SEQ ID NO: 783854 - RNA, 17 nt, Homo sapiens
agaugaagacaacagca

SEQ ID NO: 783855 - RNA, 17 nt, Homo sapiens
agaugaaguuuuauaca

SEQ ID NO: 783856 - RNA, 16 nt, Homo sapiens
agaugaauagauggaa

SEQ ID NO: 783857 - RNA, 19 nt, Homo sapiens
agaugacagggaaaacugc

SEQ ID NO: 783858 - RNA, 18 nt, Homo sapiens
agaugacauaaaauuuac

SEQ ID NO: 783859 - RNA, 21 nt, Homo sapiens
agaugaccuacagugcugugu

SEQ ID NO: 783860 - RNA, 11 nt, Homo sapiens
agaugaccuca

SEQ ID NO: 783861 - RNA, 15 nt, Homo sapiens
agaugaccuguggua

SEQ ID NO: 783862 - RNA, 12 nt, Homo sapiens
agaugaggcaaa

SEQ ID NO: 783863 - RNA, 16 nt, Homo sapiens
agaugaggcacuggaa

SEQ ID NO: 783864 - RNA, 16 nt, Homo sapiens
agaugagggugacugu

SEQ ID NO: 783865 - RNA, 21 nt, Homo sapiens
agaugaucacugaucuuguca

SEQ ID NO: 783866 - RNA, 21 nt, Homo sapiens
agaugaucguagacacaggga

SEQ ID NO: 783867 - RNA, 14 nt, Homo sapiens
agaugauuguucaa

SEQ ID NO: 783868 - RNA, 15 nt, Homo sapiens
agaugauuguucaaa

SEQ ID NO: 783869 - RNA, 22 nt, Homo sapiens
agaugauuucaauagcuuugua

SEQ ID NO: 783870 - RNA, 14 nt, Homo sapiens
agaugauuugguca

SEQ ID NO: 783871 - RNA, 18 nt, Homo sapiens
agaugauuuuuuaaggag

SEQ ID NO: 783872 - RNA, 17 nt, Homo sapiens
agaugcaauugcuccca

SEQ ID NO: 783873 - RNA, 18 nt, Homo sapiens
agaugcagcuacuggaau

SEQ ID NO: 783874 - RNA, 21 nt, Homo sapiens
agaugcaugacuuguguguga

SEQ ID NO: 783875 - RNA, 11 nt, Homo sapiens
agaugccaaac

SEQ ID NO: 783876 - RNA, 21 nt, Homo sapiens
agaugccagcauauacugaag

SEQ ID NO: 783877 - RNA, 16 nt, Homo sapiens
agaugccagcuucucu

SEQ ID NO: 783878 - RNA, 22 nt, Homo sapiens
agaugccauuuuguacauguau

SEQ ID NO: 783879 - RNA, 15 nt, Homo sapiens
agaugcccauucucu

SEQ ID NO: 783880 - RNA, 18 nt, Homo sapiens
agaugccccagagcuguu

SEQ ID NO: 783881 - RNA, 18 nt, Homo sapiens
agaugcccccuccaggag

SEQ ID NO: 783882 - RNA, 20 nt, Homo sapiens
agaugcguuguuacaggaag

SEQ ID NO: 783883 - RNA, 22 nt, Homo sapiens
agauggacacgagccacaagcu

SEQ ID NO: 783884 - RNA, 16 nt, Homo sapiens
agauggacagcgauga

SEQ ID NO: 783885 - RNA, 12 nt, Homo sapiens
agauggauguaa

SEQ ID NO: 783886 - RNA, 14 nt, Homo sapiens
agauggauucucca

SEQ ID NO: 783887 - RNA, 22 nt, Homo sapiens
agauggcaaaaucaucuuacau

SEQ ID NO: 783888 - RNA, 14 nt, Homo sapiens
agauggcacuuuga

SEQ ID NO: 783889 - RNA, 21 nt, Homo sapiens
agauggcagauucccacugcc

SEQ ID NO: 783890 - RNA, 20 nt, Homo sapiens
agauggcgcuauugcacucc

SEQ ID NO: 783891 - RNA, 13 nt, Homo sapiens
agauggucaucca

SEQ ID NO: 783892 - RNA, 14 nt, Homo sapiens
agaugguccauuug

SEQ ID NO: 783893 - RNA, 18 nt, Homo sapiens
agaugguguggguguccu

SEQ ID NO: 783894 - RNA, 14 nt, Homo sapiens
agaugguuaaguca

SEQ ID NO: 783895 - RNA, 17 nt, Homo sapiens
agaugguuucuugcaag

SEQ ID NO: 783896 - RNA, 21 nt, Homo sapiens
agauguacaaaacaguuugaa

SEQ ID NO: 783897 - RNA, 13 nt, Homo sapiens
agauguacugcaa

SEQ ID NO: 783898 - RNA, 16 nt, Homo sapiens
agauguauauauuucc

SEQ ID NO: 783899 - RNA, 12 nt, Homo sapiens
agauguauuaaa

SEQ ID NO: 783900 - RNA, 12 nt, Homo sapiens
agaugucaaaac

SEQ ID NO: 783901 - RNA, 18 nt, Homo sapiens
agaugugaaaacaucuca

SEQ ID NO: 783902 - RNA, 22 nt, Homo sapiens
agaugugaauuauugacacuga

SEQ ID NO: 783903 - RNA, 19 nt, Homo sapiens
agaugugauauucuaagac

SEQ ID NO: 783904 - RNA, 17 nt, Homo sapiens
agaugugaucacugaga

SEQ ID NO: 783905 - RNA, 17 nt, Homo sapiens
agaugugcuuugcugca

SEQ ID NO: 783906 - RNA, 19 nt, Homo sapiens
agauguggcaaagugcugu

SEQ ID NO: 783907 - RNA, 12 nt, Homo sapiens
agaugugguggc

SEQ ID NO: 783908 - RNA, 15 nt, Homo sapiens
agauguguguucuca

SEQ ID NO: 783909 - RNA, 16 nt, Homo sapiens
agauguguguucucag

SEQ ID NO: 783910 - RNA, 19 nt, Homo sapiens
agauguguuaggaauguca

SEQ ID NO: 783911 - RNA, 18 nt, Homo sapiens
agauguguuuuugggaag

SEQ ID NO: 783912 - RNA, 16 nt, Homo sapiens
agauguuuggaaacca

SEQ ID NO: 783913 - RNA, 21 nt, Homo sapiens
agauguuuggaaaccacaguc

SEQ ID NO: 783914 - RNA, 19 nt, Homo sapiens
agauguuuuggggacucau

SEQ ID NO: 783915 - RNA, 16 nt, Homo sapiens
agauuaaacaaacaaa

SEQ ID NO: 783916 - RNA, 12 nt, Homo sapiens
agauuaacaaca

SEQ ID NO: 783917 - RNA, 23 nt, Homo sapiens
agauuaagagauggguuugacaa

SEQ ID NO: 783918 - RNA, 18 nt, Homo sapiens
agauuaagaguugccaaa

SEQ ID NO: 783919 - RNA, 21 nt, Homo sapiens
agauuaaucuaccuugcagug

SEQ ID NO: 783920 - RNA, 13 nt, Homo sapiens
agauuaauggcac

SEQ ID NO: 783921 - RNA, 19 nt, Homo sapiens
agauuaccgacacugucac

SEQ ID NO: 783922 - RNA, 17 nt, Homo sapiens
agauuagguagacuuug

SEQ ID NO: 783923 - RNA, 22 nt, Homo sapiens
agauuauagaaguagcaaaaag

SEQ ID NO: 783924 - RNA, 21 nt, Homo sapiens
agauuauugugacuucacugu

SEQ ID NO: 783925 - RNA, 23 nt, Homo sapiens
agauuauugugacuucacuguau

SEQ ID NO: 783926 - RNA, 22 nt, Homo sapiens
agauucaaggccccgagcuguu

SEQ ID NO: 783927 - RNA, 15 nt, Homo sapiens
agauuccggauccua

SEQ ID NO: 783928 - RNA, 19 nt, Homo sapiens
agauucuaaugaugaucaa

SEQ ID NO: 783929 - RNA, 17 nt, Homo sapiens
agauucuauaguucuag

SEQ ID NO: 783930 - RNA, 16 nt, Homo sapiens
agauucuugacuuaua

SEQ ID NO: 783931 - RNA, 14 nt, Homo sapiens
agauugacuuugaa

SEQ ID NO: 783932 - RNA, 15 nt, Homo sapiens
agauugcaccacugc

SEQ ID NO: 783933 - RNA, 17 nt, Homo sapiens
agauugcaccacugcuc

SEQ ID NO: 783934 - RNA, 15 nt, Homo sapiens
agcagauuuuugcaa

SEQ ID NO: 783935 - RNA, 13 nt, Homo sapiens
agcagcacuggaa

SEQ ID NO: 783936 - RNA, 14 nt, Homo sapiens
agcagcacugugag

SEQ ID NO: 783937 - RNA, 23 nt, Homo sapiens
agcagcacuguucuguccucaag

SEQ ID NO: 783938 - RNA, 23 nt, Homo sapiens
agcagcacuuuuuaguucccuaa

SEQ ID NO: 783939 - RNA, 16 nt, Homo sapiens
agcagccacaaccaaa

SEQ ID NO: 783940 - RNA, 14 nt, Homo sapiens
agcagccagucuca

SEQ ID NO: 783941 - RNA, 16 nt, Homo sapiens
agcagccagucucaga

SEQ ID NO: 783942 - RNA, 18 nt, Homo sapiens
agcagccuaacacggugc

SEQ ID NO: 783943 - RNA, 14 nt, Homo sapiens
agcagccucgcaca

SEQ ID NO: 783944 - RNA, 23 nt, Homo sapiens
agcagccugccaagaauuuuauu

SEQ ID NO: 783945 - RNA, 16 nt, Homo sapiens
agcagcugguaaucuu

SEQ ID NO: 783946 - RNA, 23 nt, Homo sapiens
cugaggguugggguggggaagca

SEQ ID NO: 783947 - RNA, 21 nt, Homo sapiens
cugaaaaugucacauucuauu

SEQ ID NO: 783948 - RNA, 16 nt, Homo sapiens
cugaaacaacuuggaa

SEQ ID NO: 783949 - RNA, 22 nt, Homo sapiens
cuaagcaguaagcuaucuucaa

SEQ ID NO: 783950 - RNA, 14 nt, Homo sapiens
cuaagcaugugucc

SEQ ID NO: 783951 - RNA, 17 nt, Homo sapiens
cuaagccuuuccauaag

SEQ ID NO: 783952 - RNA, 18 nt, Homo sapiens
cuaagcuggagugcagug

SEQ ID NO: 783953 - RNA, 14 nt, Homo sapiens
cuaaggacauuucc

SEQ ID NO: 783954 - RNA, 16 nt, Homo sapiens
cuaagggcccaaaggc

SEQ ID NO: 783955 - RNA, 22 nt, Homo sapiens
cuaagguccaacaagaaugcau

SEQ ID NO: 783956 - RNA, 18 nt, Homo sapiens
cuaaggugaagaaucuuu

SEQ ID NO: 783957 - RNA, 22 nt, Homo sapiens
cuaaguaaaaccacagcaguug

SEQ ID NO: 783958 - RNA, 12 nt, Homo sapiens
cgucuuuaguuu

SEQ ID NO: 783959 - RNA, 18 nt, Homo sapiens
cgugaaauucuauugaaa

SEQ ID NO: 783960 - RNA, 14 nt, Homo sapiens
cgugacaacaugcg

SEQ ID NO: 783961 - RNA, 18 nt, Homo sapiens
cgugaccuugcaauguuc

SEQ ID NO: 783962 - RNA, 16 nt, Homo sapiens
cgugacuguggcacac

SEQ ID NO: 783963 - RNA, 17 nt, Homo sapiens
cgugagcagcuuuggaa

SEQ ID NO: 783964 - RNA, 14 nt, Homo sapiens
cgugaucucagcuc

SEQ ID NO: 783965 - RNA, 22 nt, Homo sapiens
cgugaucuuggcucacugcaac

SEQ ID NO: 783966 - RNA, 23 nt, Homo sapiens
cgugcaguaggggcuacugugac

SEQ ID NO: 783967 - RNA, 20 nt, Homo sapiens
cgugcauuuuuggaucauuu

SEQ ID NO: 783968 - RNA, 18 nt, Homo sapiens
ccuguuaacgucaucuca

SEQ ID NO: 783969 - RNA, 15 nt, Homo sapiens
ccuguuagacguccu

SEQ ID NO: 783970 - RNA, 20 nt, Homo sapiens
ccuguuccccaaggacucuu

SEQ ID NO: 783971 - RNA, 16 nt, Homo sapiens
ccuguucuaugccuuu

SEQ ID NO: 783972 - RNA, 21 nt, Homo sapiens
ccuguuggauaaagaccuucc

SEQ ID NO: 783973 - RNA, 17 nt, Homo sapiens
ccuguuggggaccucac

SEQ ID NO: 783974 - RNA, 19 nt, Homo sapiens
ccuguuuuaccguugcuaa

SEQ ID NO: 783975 - RNA, 21 nt, Homo sapiens
ccuguuuuuagagcuuccaaa

SEQ ID NO: 783976 - RNA, 22 nt, Homo sapiens
ccuuaaaaauauccuugaugua

SEQ ID NO: 783977 - RNA, 22 nt, Homo sapiens
ccuuaaaauaaugaauacauuu

SEQ ID NO: 783978 - RNA, 22 nt, Homo sapiens
ccuuaaaccucuucuauugcua

SEQ ID NO: 783979 - RNA, 16 nt, Homo sapiens
ccuuaacacacuggcc

SEQ ID NO: 783980 - RNA, 13 nt, Homo sapiens
ccuuaagagucau

SEQ ID NO: 783981 - RNA, 13 nt, Homo sapiens
cgcgcccagccuu

SEQ ID NO: 783982 - RNA, 14 nt, Homo sapiens
cgcgcccuccccca

SEQ ID NO: 783983 - RNA, 13 nt, Homo sapiens
cgcguguguacac

SEQ ID NO: 783984 - RNA, 17 nt, Homo sapiens
cgcuaauucaaggaauu

SEQ ID NO: 783985 - RNA, 22 nt, Homo sapiens
cgcuagagauugcuacaaaucu

SEQ ID NO: 783986 - RNA, 12 nt, Homo sapiens
cgcuagcauuag

SEQ ID NO: 783987 - RNA, 20 nt, Homo sapiens
cgcuaugugacuugcgcuua

SEQ ID NO: 783988 - RNA, 18 nt, Homo sapiens
cgcucccagguuccccca

SEQ ID NO: 783989 - RNA, 19 nt, Homo sapiens
cgcucuucccccaugugcc

SEQ ID NO: 783990 - RNA, 18 nt, Homo sapiens
cgcugcaccuaaagccua

SEQ ID NO: 783991 - RNA, 22 nt, Homo sapiens
cgcugcagcuguguguccuucu

SEQ ID NO: 783992 - RNA, 18 nt, Homo sapiens
cgcugcccgcucagccca

SEQ ID NO: 783993 - RNA, 18 nt, Homo sapiens
cgcugcuaagaagcuaaa

SEQ ID NO: 783994 - RNA, 20 nt, Homo sapiens
cgcugcugugcucuggggau

SEQ ID NO: 783995 - RNA, 19 nt, Homo sapiens
cgcugucucugaggggugg

SEQ ID NO: 783996 - RNA, 19 nt, Homo sapiens
cgcuucugccuuuucacug

SEQ ID NO: 783997 - RNA, 21 nt, Homo sapiens
cggaacuugauuaacuccucc

SEQ ID NO: 783998 - RNA, 14 nt, Homo sapiens
cggaagccaaaggc

SEQ ID NO: 783999 - RNA, 20 nt, Homo sapiens
cggaagcuggugaaagcucg

SEQ ID NO: 784000 - RNA, 13 nt, Homo sapiens
cggacaucauucu

SEQ ID NO: 784001 - RNA, 15 nt, Homo sapiens
cggaccaaagcaaga

SEQ ID NO: 784002 - RNA, 19 nt, Homo sapiens
cggacucaccaacuugcca

SEQ ID NO: 784003 - RNA, 17 nt, Homo sapiens
cggacugucaguucucu

SEQ ID NO: 784004 - RNA, 20 nt, Homo sapiens
cggagaagagcuguucacag

SEQ ID NO: 784005 - RNA, 20 nt, Homo sapiens
cggagcuugcagugagccga

SEQ ID NO: 784006 - RNA, 12 nt, Homo sapiens
cggagcuuucaa

SEQ ID NO: 784007 - RNA, 22 nt, Homo sapiens
cggagggccccugcgugggggc

SEQ ID NO: 784008 - RNA, 15 nt, Homo sapiens
cggagguuccaguga

SEQ ID NO: 784009 - RNA, 15 nt, Homo sapiens
cggaguccccggggu

SEQ ID NO: 784010 - RNA, 21 nt, Homo sapiens
cggaguucugcccaugggaag

SEQ ID NO: 784011 - RNA, 18 nt, Homo sapiens
cggauauauacauagcau

SEQ ID NO: 784012 - RNA, 14 nt, Homo sapiens
cggcaacaucucug

SEQ ID NO: 784013 - RNA, 19 nt, Homo sapiens
cggcacccugauccucacc

SEQ ID NO: 784014 - RNA, 21 nt, Homo sapiens
cggcagcgggcggaggggauc

SEQ ID NO: 784015 - RNA, 21 nt, Homo sapiens
cggcaucuccccuagcucacc

SEQ ID NO: 784016 - RNA, 14 nt, Homo sapiens
cggccaccugagug

SEQ ID NO: 784017 - RNA, 19 nt, Homo sapiens
cggccccucccacacccaa

SEQ ID NO: 784018 - RNA, 22 nt, Homo sapiens
cggcccuucugacuguuuauuu

SEQ ID NO: 784019 - RNA, 16 nt, Homo sapiens
cggccgccgccaggac

SEQ ID NO: 784020 - RNA, 16 nt, Homo sapiens
cggccucccacagugc

SEQ ID NO: 784021 - RNA, 22 nt, Homo sapiens
cggccuccggcgucuugcccag

SEQ ID NO: 784022 - RNA, 18 nt, Homo sapiens
cggccuccugucccucau

SEQ ID NO: 784023 - RNA, 23 nt, Homo sapiens
cggccuggcggggcgcagugcug

SEQ ID NO: 784024 - RNA, 13 nt, Homo sapiens
cggcucacugaaa

SEQ ID NO: 784025 - RNA, 14 nt, Homo sapiens
cggcucacugcaac

SEQ ID NO: 784026 - RNA, 19 nt, Homo sapiens
cggcuccucggacucugcu

SEQ ID NO: 784027 - RNA, 17 nt, Homo sapiens
cggcugcauacccgggc

SEQ ID NO: 784028 - RNA, 14 nt, Homo sapiens
cggcugccaagaca

SEQ ID NO: 784029 - RNA, 23 nt, Homo sapiens
cggcugguuuuguaagaugcugg

SEQ ID NO: 784030 - RNA, 19 nt, Homo sapiens
cggcuuccuacagccagca

SEQ ID NO: 784031 - RNA, 21 nt, Homo sapiens
cgggaagcgaugaauuuggag

SEQ ID NO: 784032 - RNA, 19 nt, Homo sapiens
cgggacacagaacuaguga

SEQ ID NO: 784033 - RNA, 18 nt, Homo sapiens
cgggaccaauacuacuga

SEQ ID NO: 784034 - RNA, 16 nt, Homo sapiens
cgggagaccugugcua

SEQ ID NO: 784035 - RNA, 21 nt, Homo sapiens
cgggaugguucuucuccaguu

SEQ ID NO: 784036 - RNA, 20 nt, Homo sapiens
cgggcacagugguggugccc

SEQ ID NO: 784037 - RNA, 16 nt, Homo sapiens
cgggcccugcugagga

SEQ ID NO: 784038 - RNA, 15 nt, Homo sapiens
cggggcucuucucau

SEQ ID NO: 784039 - RNA, 13 nt, Homo sapiens
cgggggaagggag

SEQ ID NO: 784040 - RNA, 12 nt, Homo sapiens
cggggugcuccu

SEQ ID NO: 784041 - RNA, 13 nt, Homo sapiens
cggggugcuccug

SEQ ID NO: 784042 - RNA, 16 nt, Homo sapiens
cgggguugucugcagg

SEQ ID NO: 784043 - RNA, 17 nt, Homo sapiens
cgggucucaacuuuaag

SEQ ID NO: 784044 - RNA, 16 nt, Homo sapiens
cgggucucucacuguu

SEQ ID NO: 784045 - RNA, 20 nt, Homo sapiens
cgggucuugauucagucaca

SEQ ID NO: 784046 - RNA, 12 nt, Homo sapiens
cgggugugcuau

SEQ ID NO: 784047 - RNA, 16 nt, Homo sapiens
cggucccugucccucu

SEQ ID NO: 784048 - RNA, 23 nt, Homo sapiens
cggugagccggggccgucugugu

SEQ ID NO: 784049 - RNA, 16 nt, Homo sapiens
cgguggacccagggau

SEQ ID NO: 784050 - RNA, 13 nt, Homo sapiens
cgguucaccagcc

SEQ ID NO: 784051 - RNA, 14 nt, Homo sapiens
cgguuuaauucugu

SEQ ID NO: 784052 - RNA, 22 nt, Homo sapiens
cgguuuacagcuaucgaacuuc

SEQ ID NO: 784053 - RNA, 18 nt, Homo sapiens
cgguuuggauaaucuuaa

SEQ ID NO: 784054 - RNA, 12 nt, Homo sapiens
cgguuuuagcuu

SEQ ID NO: 784055 - RNA, 16 nt, Homo sapiens
cguaaauaaacuaaua

SEQ ID NO: 784056 - RNA, 14 nt, Homo sapiens
cguaacaacugugg

SEQ ID NO: 784057 - RNA, 16 nt, Homo sapiens
cguacaucugcaauau

SEQ ID NO: 784058 - RNA, 17 nt, Homo sapiens
cguaccuucaugugauu

SEQ ID NO: 784059 - RNA, 20 nt, Homo sapiens
cguagaaagauccuucgggu

SEQ ID NO: 784060 - RNA, 16 nt, Homo sapiens
cguagacacagggaug

SEQ ID NO: 784061 - RNA, 13 nt, Homo sapiens
cguagacuugaca

SEQ ID NO: 784062 - RNA, 19 nt, Homo sapiens
cguagcuucuaccaugaac

SEQ ID NO: 784063 - RNA, 14 nt, Homo sapiens
cguaggcaaaucuc

SEQ ID NO: 784064 - RNA, 16 nt, Homo sapiens
cguaguccgcuuucuc

SEQ ID NO: 784065 - RNA, 21 nt, Homo sapiens
cguauuuggcacacagcagag

SEQ ID NO: 784066 - RNA, 13 nt, Homo sapiens
cgucaagacauuu

SEQ ID NO: 784067 - RNA, 15 nt, Homo sapiens
cgucagagcagugac

SEQ ID NO: 784068 - RNA, 15 nt, Homo sapiens
cgucagcugcucccu

SEQ ID NO: 784069 - RNA, 22 nt, Homo sapiens
cgucagggagaggucaccagcu

SEQ ID NO: 784070 - RNA, 22 nt, Homo sapiens
cgucaguaguuugagaccagcc

SEQ ID NO: 784071 - RNA, 17 nt, Homo sapiens
cgucaucaucacauuca

SEQ ID NO: 784072 - RNA, 17 nt, Homo sapiens
cgucauguguuuugcca

SEQ ID NO: 784073 - RNA, 14 nt, Homo sapiens
cgucauguuucuuc

SEQ ID NO: 784074 - RNA, 18 nt, Homo sapiens
cgucauuuccggacucuc

SEQ ID NO: 784075 - RNA, 14 nt, Homo sapiens
cguccaccucagug

SEQ ID NO: 784076 - RNA, 20 nt, Homo sapiens
cguccagcuggaagggucaa

SEQ ID NO: 784077 - RNA, 14 nt, Homo sapiens
cguccauggcacca

SEQ ID NO: 784078 - RNA, 13 nt, Homo sapiens
cguccugacuaca

SEQ ID NO: 784079 - RNA, 13 nt, Homo sapiens
cgucuacuccuuu

SEQ ID NO: 784080 - RNA, 16 nt, Homo sapiens
cgucuauccuguguag

SEQ ID NO: 784081 - RNA, 17 nt, Homo sapiens
cgucuccggaauccuug

SEQ ID NO: 784082 - RNA, 15 nt, Homo sapiens
cgucuguccuccuuu

SEQ ID NO: 784083 - RNA, 23 nt, Homo sapiens
cgucuuccugaguggugccaaac

SEQ ID NO: 784084 - RNA, 18 nt, Homo sapiens
cgucuugcccagcagcuc

SEQ ID NO: 784085 - RNA, 16 nt, Homo sapiens
ccucuuccaccacaga

SEQ ID NO: 784086 - RNA, 19 nt, Homo sapiens
ccucuucuuugugccuuug

SEQ ID NO: 784087 - RNA, 10 nt, Homo sapiens
ccucuugccc

SEQ ID NO: 784088 - RNA, 23 nt, Homo sapiens
ccucuuuucugcaucaucuguag

SEQ ID NO: 784089 - RNA, 17 nt, Homo sapiens
ccucuuuuuagggcuaa

SEQ ID NO: 784090 - RNA, 20 nt, Homo sapiens
ccucuuuuuucuaucugcca

SEQ ID NO: 784091 - RNA, 23 nt, Homo sapiens
ccugaaaagggcggaagaguuac

SEQ ID NO: 784092 - RNA, 15 nt, Homo sapiens
ccugaaaauugcaau

SEQ ID NO: 784093 - RNA, 19 nt, Homo sapiens
ccugaaagccacaaugaga

SEQ ID NO: 784094 - RNA, 18 nt, Homo sapiens
ccugaaauuuauucacau

SEQ ID NO: 784095 - RNA, 21 nt, Homo sapiens
ccugaacguuuucuucuuucc

SEQ ID NO: 784096 - RNA, 16 nt, Homo sapiens
ccugaacuaaucugau

SEQ ID NO: 784097 - RNA, 21 nt, Homo sapiens
ccugaagaacaguaacugcca

SEQ ID NO: 784098 - RNA, 12 nt, Homo sapiens
ccugaagaacca

SEQ ID NO: 784099 - RNA, 14 nt, Homo sapiens
ccugaagcaguuca

SEQ ID NO: 784100 - RNA, 15 nt, Homo sapiens
ccugaagcaguucag

SEQ ID NO: 784101 - RNA, 11 nt, Homo sapiens
ccugaagggaa

SEQ ID NO: 784102 - RNA, 18 nt, Homo sapiens
ccugaagucccagcauug

SEQ ID NO: 784103 - RNA, 23 nt, Homo sapiens
ccugaagucuucuccuccaugaa

SEQ ID NO: 784104 - RNA, 18 nt, Homo sapiens
ccugaauacaagccuaug

SEQ ID NO: 784105 - RNA, 18 nt, Homo sapiens
ccugaaugguuccaugcc

SEQ ID NO: 784106 - RNA, 19 nt, Homo sapiens
ccugaauuaucuauuucau

SEQ ID NO: 784107 - RNA, 17 nt, Homo sapiens
ccugaauuuuguugcug

SEQ ID NO: 784108 - RNA, 17 nt, Homo sapiens
ccugacaaaaguuccau

SEQ ID NO: 784109 - RNA, 12 nt, Homo sapiens
ccugacaccccc

SEQ ID NO: 784110 - RNA, 13 nt, Homo sapiens
ccugacaccugcu

SEQ ID NO: 784111 - RNA, 17 nt, Homo sapiens
ccugacacggacugugc

SEQ ID NO: 784112 - RNA, 18 nt, Homo sapiens
ccugacacggacugugca

SEQ ID NO: 784113 - RNA, 20 nt, Homo sapiens
ccugacagaggugucaucca

SEQ ID NO: 784114 - RNA, 12 nt, Homo sapiens
ccugaccccagu

SEQ ID NO: 784115 - RNA, 16 nt, Homo sapiens
ccugaccuaccccagc

SEQ ID NO: 784116 - RNA, 22 nt, Homo sapiens
ccugaccucaggugauccaccc

SEQ ID NO: 784117 - RNA, 23 nt, Homo sapiens
ccugaccuccuuuaugguuaaua

SEQ ID NO: 784118 - RNA, 12 nt, Homo sapiens
ccugaccuguca

SEQ ID NO: 784119 - RNA, 21 nt, Homo sapiens
ccugacggagaggcagaucaa

SEQ ID NO: 784120 - RNA, 14 nt, Homo sapiens
ccugacuggccaaa

SEQ ID NO: 784121 - RNA, 16 nt, Homo sapiens
ccugacuggugcugca

SEQ ID NO: 784122 - RNA, 14 nt, Homo sapiens
ccugagaaggcaaa

SEQ ID NO: 784123 - RNA, 13 nt, Homo sapiens
ccugagagugggu

SEQ ID NO: 784124 - RNA, 13 nt, Homo sapiens
ccugagaugauuu

SEQ ID NO: 784125 - RNA, 19 nt, Homo sapiens
ccugagauucagaugucau

SEQ ID NO: 784126 - RNA, 16 nt, Homo sapiens
ccugagauuucaucug

SEQ ID NO: 784127 - RNA, 17 nt, Homo sapiens
ccugagauuucaucugc

SEQ ID NO: 784128 - RNA, 17 nt, Homo sapiens
ccugagcagaauacugg

SEQ ID NO: 784129 - RNA, 12 nt, Homo sapiens
ccugagcagcuu

SEQ ID NO: 784130 - RNA, 21 nt, Homo sapiens
ccugagcgaguguccagccaa

SEQ ID NO: 784131 - RNA, 20 nt, Homo sapiens
ccugagcucgguggacccag

SEQ ID NO: 784132 - RNA, 13 nt, Homo sapiens
ccugagcucugac

SEQ ID NO: 784133 - RNA, 17 nt, Homo sapiens
ccugagcuggggaagcc

SEQ ID NO: 784134 - RNA, 19 nt, Homo sapiens
ccugaggaggaggacacag

SEQ ID NO: 784135 - RNA, 15 nt, Homo sapiens
ccugaggauaacuca

SEQ ID NO: 784136 - RNA, 17 nt, Homo sapiens
ccugaggaugggucaga

SEQ ID NO: 784137 - RNA, 21 nt, Homo sapiens
ccugaggugaaagggagcuau

SEQ ID NO: 784138 - RNA, 22 nt, Homo sapiens
ccugagucggccccacauggga

SEQ ID NO: 784139 - RNA, 17 nt, Homo sapiens
ccugaguuggagcucau

SEQ ID NO: 784140 - RNA, 14 nt, Homo sapiens
ccugaguuucucuc

SEQ ID NO: 784141 - RNA, 13 nt, Homo sapiens
ccugauccucacc

SEQ ID NO: 784142 - RNA, 19 nt, Homo sapiens
ccugaucgccaaccuuucc

SEQ ID NO: 784143 - RNA, 17 nt, Homo sapiens
ccugaucuggacccuug

SEQ ID NO: 784144 - RNA, 16 nt, Homo sapiens
ccugaugcuaugguca

SEQ ID NO: 784145 - RNA, 16 nt, Homo sapiens
ccugauggagugugca

SEQ ID NO: 784146 - RNA, 20 nt, Homo sapiens
ccugauggcuggcaggcagu

SEQ ID NO: 784147 - RNA, 13 nt, Homo sapiens
ccugaugucuuaa

SEQ ID NO: 784148 - RNA, 12 nt, Homo sapiens
ccugauguuaaa

SEQ ID NO: 784149 - RNA, 20 nt, Homo sapiens
ccugauugaucacacagugu

SEQ ID NO: 784150 - RNA, 19 nt, Homo sapiens
ccugauuuagauaugcaaa

SEQ ID NO: 784151 - RNA, 19 nt, Homo sapiens
ccugauuuaggagaagcca

SEQ ID NO: 784152 - RNA, 19 nt, Homo sapiens
ccugcacagugacuucuga

SEQ ID NO: 784153 - RNA, 15 nt, Homo sapiens
ccugcaccaugcugc

SEQ ID NO: 784154 - RNA, 18 nt, Homo sapiens
ccugcacgaaguggcuga

SEQ ID NO: 784155 - RNA, 15 nt, Homo sapiens
ccugcacuguaaaau

SEQ ID NO: 784156 - RNA, 19 nt, Homo sapiens
ccugcagaggaaagacagg

SEQ ID NO: 784157 - RNA, 19 nt, Homo sapiens
ccugcagaggucugugcug

SEQ ID NO: 784158 - RNA, 13 nt, Homo sapiens
ccugcagaugcca

SEQ ID NO: 784159 - RNA, 18 nt, Homo sapiens
ccugcagcaaacacucca

SEQ ID NO: 784160 - RNA, 17 nt, Homo sapiens
ccugcagcccaugguga

SEQ ID NO: 784161 - RNA, 16 nt, Homo sapiens
ccugcaggacuugcca

SEQ ID NO: 784162 - RNA, 12 nt, Homo sapiens
ccugcagguccu

SEQ ID NO: 784163 - RNA, 19 nt, Homo sapiens
ccugcaucccgauaccuca

SEQ ID NO: 784164 - RNA, 15 nt, Homo sapiens
ccugcaucugugaaa

SEQ ID NO: 784165 - RNA, 13 nt, Homo sapiens
ccugcauguucug

SEQ ID NO: 784166 - RNA, 21 nt, Homo sapiens
ccugcauuggccuggccucca

SEQ ID NO: 784167 - RNA, 16 nt, Homo sapiens
ccugcauuugcagaug

SEQ ID NO: 784168 - RNA, 15 nt, Homo sapiens
ccugccaacugauuu

SEQ ID NO: 784169 - RNA, 13 nt, Homo sapiens
ccugccacuucaa

SEQ ID NO: 784170 - RNA, 14 nt, Homo sapiens
ccugccagggugag

SEQ ID NO: 784171 - RNA, 14 nt, Homo sapiens
ccugcccaaugaga

SEQ ID NO: 784172 - RNA, 16 nt, Homo sapiens
ccugcccaccaagaag

SEQ ID NO: 784173 - RNA, 18 nt, Homo sapiens
ccugcccaggagcagcuu

SEQ ID NO: 784174 - RNA, 10 nt, Homo sapiens
ccugccccaa

SEQ ID NO: 784175 - RNA, 19 nt, Homo sapiens
ccugccccagauuuacuaa

SEQ ID NO: 784176 - RNA, 12 nt, Homo sapiens
ccugccccggga

SEQ ID NO: 784177 - RNA, 17 nt, Homo sapiens
ccugccccucucccgcc

SEQ ID NO: 784178 - RNA, 14 nt, Homo sapiens
ccugcccuagcucc

SEQ ID NO: 784179 - RNA, 15 nt, Homo sapiens
ccugcccuuccucag

SEQ ID NO: 784180 - RNA, 20 nt, Homo sapiens
ccugccugagcccaggagcu

SEQ ID NO: 784181 - RNA, 12 nt, Homo sapiens
ccugccugcauu

SEQ ID NO: 784182 - RNA, 13 nt, Homo sapiens
ccugccugcauuc

SEQ ID NO: 784183 - RNA, 18 nt, Homo sapiens
ccugccuuuucauugccc

SEQ ID NO: 784184 - RNA, 16 nt, Homo sapiens
ccugcgagacgcacac

SEQ ID NO: 784185 - RNA, 20 nt, Homo sapiens
ccugcgccaccgcccagaga

SEQ ID NO: 784186 - RNA, 16 nt, Homo sapiens
accugaccccauuccu

SEQ ID NO: 784187 - RNA, 14 nt, Homo sapiens
accugagauggagg

SEQ ID NO: 784188 - RNA, 12 nt, Homo sapiens
accugagcauga

SEQ ID NO: 784189 - RNA, 21 nt, Homo sapiens
accugauguaccugaugcuau

SEQ ID NO: 784190 - RNA, 13 nt, Homo sapiens
accugauucucac

SEQ ID NO: 784191 - RNA, 19 nt, Homo sapiens
accugauucucacagcaac

SEQ ID NO: 784192 - RNA, 13 nt, Homo sapiens
accugauuuacua

SEQ ID NO: 784193 - RNA, 21 nt, Homo sapiens
accugcagcccauggugagcu

SEQ ID NO: 784194 - RNA, 19 nt, Homo sapiens
accugccaggcaggggugg

SEQ ID NO: 784195 - RNA, 13 nt, Homo sapiens
accugccaugcca

SEQ ID NO: 784196 - RNA, 19 nt, Homo sapiens
accugccccccagccuuca

SEQ ID NO: 784197 - RNA, 15 nt, Homo sapiens
accugcccugccuga

SEQ ID NO: 784198 - RNA, 20 nt, Homo sapiens
accugccugcaucugugaaa

SEQ ID NO: 784199 - RNA, 18 nt, Homo sapiens
accugccuuccauuuuga

SEQ ID NO: 784200 - RNA, 18 nt, Homo sapiens
accugcuaaucacaucca

SEQ ID NO: 784201 - RNA, 18 nt, Homo sapiens
accugcugagggaccagc

SEQ ID NO: 784202 - RNA, 15 nt, Homo sapiens
accugcugcuugccc

SEQ ID NO: 784203 - RNA, 14 nt, Homo sapiens
accugcugugauga

SEQ ID NO: 784204 - RNA, 16 nt, Homo sapiens
accugcuuagcugccu

SEQ ID NO: 784205 - RNA, 14 nt, Homo sapiens
accugcuucaguga

SEQ ID NO: 784206 - RNA, 16 nt, Homo sapiens
accugcuuccuuccag

SEQ ID NO: 784207 - RNA, 14 nt, Homo sapiens
accuggaaccagag

SEQ ID NO: 784208 - RNA, 14 nt, Homo sapiens
accuggacggugcg

SEQ ID NO: 784209 - RNA, 19 nt, Homo sapiens
accuggagaguacauuugc

SEQ ID NO: 784210 - RNA, 17 nt, Homo sapiens
accuggauccagcacug

SEQ ID NO: 784211 - RNA, 19 nt, Homo sapiens
accuggcccuugcaaucuu

SEQ ID NO: 784212 - RNA, 14 nt, Homo sapiens
accugggaccucac

SEQ ID NO: 784213 - RNA, 17 nt, Homo sapiens
accugggcaucuuagga

SEQ ID NO: 784214 - RNA, 21 nt, Homo sapiens
ccucaccaauacacggacaca

SEQ ID NO: 784215 - RNA, 14 nt, Homo sapiens
ccucaccaccacac

SEQ ID NO: 784216 - RNA, 14 nt, Homo sapiens
ccucacccauccua

SEQ ID NO: 784217 - RNA, 16 nt, Homo sapiens
ccucacccgaaucucc

SEQ ID NO: 784218 - RNA, 22 nt, Homo sapiens
ccucaccuagccugaugagauu

SEQ ID NO: 784219 - RNA, 14 nt, Homo sapiens
ccucaccugggcag

SEQ ID NO: 784220 - RNA, 17 nt, Homo sapiens
ccucaccugguaccugg

SEQ ID NO: 784221 - RNA, 14 nt, Homo sapiens
ccucaccugguccu

SEQ ID NO: 784222 - RNA, 13 nt, Homo sapiens
ccucacucuagag

SEQ ID NO: 784223 - RNA, 22 nt, Homo sapiens
ccucacucuguuuccuggucag

SEQ ID NO: 784224 - RNA, 11 nt, Homo sapiens
ccucacugaga

SEQ ID NO: 784225 - RNA, 22 nt, Homo sapiens
ccucacugcuguagacauuugc

SEQ ID NO: 784226 - RNA, 12 nt, Homo sapiens
ccucacugggug

SEQ ID NO: 784227 - RNA, 16 nt, Homo sapiens
ccucagaggacaguuu

SEQ ID NO: 784228 - RNA, 16 nt, Homo sapiens
ccucagccaguggcac

SEQ ID NO: 784229 - RNA, 17 nt, Homo sapiens
ccucagccccacugaca

SEQ ID NO: 784230 - RNA, 21 nt, Homo sapiens
ccucagccuccugaguagcua

SEQ ID NO: 784231 - RNA, 21 nt, Homo sapiens
ccucagccucucaaguagcug

SEQ ID NO: 784232 - RNA, 19 nt, Homo sapiens
ccucagccuggccagacac

SEQ ID NO: 784233 - RNA, 19 nt, Homo sapiens
ccucagccuugccagagau

SEQ ID NO: 784234 - RNA, 18 nt, Homo sapiens
ccucagcuucuucacagg

SEQ ID NO: 784235 - RNA, 14 nt, Homo sapiens
ccucaggcagcuca

SEQ ID NO: 784236 - RNA, 15 nt, Homo sapiens
ccucaggugcugucc

SEQ ID NO: 784237 - RNA, 18 nt, Homo sapiens
ccucaguccuauucugua

SEQ ID NO: 784238 - RNA, 23 nt, Homo sapiens
ccucagugccacuugacauuccu

SEQ ID NO: 784239 - RNA, 17 nt, Homo sapiens
ccucaguggcucugggu

SEQ ID NO: 784240 - RNA, 17 nt, Homo sapiens
ccucaguuuuaucauuu

SEQ ID NO: 784241 - RNA, 20 nt, Homo sapiens
ccucaguuuuaucauuuuca

SEQ ID NO: 784242 - RNA, 18 nt, Homo sapiens
ccucauagaacacacuuu

SEQ ID NO: 784243 - RNA, 14 nt, Homo sapiens
ccucauccauagca

SEQ ID NO: 784244 - RNA, 19 nt, Homo sapiens
ccucauccaugcugugcug

SEQ ID NO: 784245 - RNA, 18 nt, Homo sapiens
ccucaucugagaggcucu

SEQ ID NO: 784246 - RNA, 17 nt, Homo sapiens
ccucaugaucauucuca

SEQ ID NO: 784247 - RNA, 22 nt, Homo sapiens
ccucaugaucauucucagugag

SEQ ID NO: 784248 - RNA, 20 nt, Homo sapiens
ccucauuccccaaccacuuc

SEQ ID NO: 784249 - RNA, 16 nt, Homo sapiens
ccucauugaauccuca

SEQ ID NO: 784250 - RNA, 21 nt, Homo sapiens
ccucauugcuaccacagacuu

SEQ ID NO: 784251 - RNA, 21 nt, Homo sapiens
ccuccaacaacgacacauuca

SEQ ID NO: 784252 - RNA, 22 nt, Homo sapiens
ccuccaaggacuaaggccucca

SEQ ID NO: 784253 - RNA, 23 nt, Homo sapiens
ccuccacagagaggaggggacca

SEQ ID NO: 784254 - RNA, 13 nt, Homo sapiens
ccuccacauuucc

SEQ ID NO: 784255 - RNA, 12 nt, Homo sapiens
ccuccaccagcc

SEQ ID NO: 784256 - RNA, 12 nt, Homo sapiens
ccuccaccucaa

SEQ ID NO: 784257 - RNA, 17 nt, Homo sapiens
ccuccaccuccuaggcu

SEQ ID NO: 784258 - RNA, 13 nt, Homo sapiens
ccuccagaacuca

SEQ ID NO: 784259 - RNA, 20 nt, Homo sapiens
ccuccagcucaugacacugu

SEQ ID NO: 784260 - RNA, 21 nt, Homo sapiens
ccuccaggaagaagcaggggg

SEQ ID NO: 784261 - RNA, 17 nt, Homo sapiens
ccuccaggcccaucuca

SEQ ID NO: 784262 - RNA, 10 nt, Homo sapiens
ccuccagggc

SEQ ID NO: 784263 - RNA, 23 nt, Homo sapiens
ccuccaggugugcacguggcaug

SEQ ID NO: 784264 - RNA, 17 nt, Homo sapiens
ccuccaugcaggccuua

SEQ ID NO: 784265 - RNA, 14 nt, Homo sapiens
ccuccauuccccac

SEQ ID NO: 784266 - RNA, 12 nt, Homo sapiens
ccuccauucuga

SEQ ID NO: 784267 - RNA, 17 nt, Homo sapiens
ccuccauucugaccauu

SEQ ID NO: 784268 - RNA, 20 nt, Homo sapiens
ccuccauuucucuccaggaa

SEQ ID NO: 784269 - RNA, 15 nt, Homo sapiens
ccucccaaguagcug

SEQ ID NO: 784270 - RNA, 14 nt, Homo sapiens
ccucccaccagagc

SEQ ID NO: 784271 - RNA, 16 nt, Homo sapiens
ccucccagguugacac

SEQ ID NO: 784272 - RNA, 13 nt, Homo sapiens
ccuccccacagga

SEQ ID NO: 784273 - RNA, 15 nt, Homo sapiens
ccucccccaugggcu

SEQ ID NO: 784274 - RNA, 20 nt, Homo sapiens
ccucccccuuucacacugga

SEQ ID NO: 784275 - RNA, 20 nt, Homo sapiens
ccucccgaguagcugggauu

SEQ ID NO: 784276 - RNA, 20 nt, Homo sapiens
ccucccggguucgcaccauu

SEQ ID NO: 784277 - RNA, 14 nt, Homo sapiens
ccucccuaaauaua

SEQ ID NO: 784278 - RNA, 17 nt, Homo sapiens
ccucccugccaccaggc

SEQ ID NO: 784279 - RNA, 20 nt, Homo sapiens
ccucccuuccccuuuuccca

SEQ ID NO: 784280 - RNA, 13 nt, Homo sapiens
ccucccuuugaug

SEQ ID NO: 784281 - RNA, 17 nt, Homo sapiens
ccuccggcgucuugccc

SEQ ID NO: 784282 - RNA, 13 nt, Homo sapiens
ccuccguccagcc

SEQ ID NO: 784283 - RNA, 14 nt, Homo sapiens
ccuccuccugacca

SEQ ID NO: 784284 - RNA, 19 nt, Homo sapiens
ccuccuccuuuguuuaaua

SEQ ID NO: 784285 - RNA, 14 nt, Homo sapiens
ccuccucuugacuu

SEQ ID NO: 784286 - RNA, 20 nt, Homo sapiens
ccuccugaguagcugggacu

SEQ ID NO: 784287 - RNA, 13 nt, Homo sapiens
ccuccugcuccuc

SEQ ID NO: 784288 - RNA, 23 nt, Homo sapiens
ccuccuggaacuugaguuauuaa

SEQ ID NO: 784289 - RNA, 15 nt, Homo sapiens
ccuccuguaaauggu

SEQ ID NO: 784290 - RNA, 22 nt, Homo sapiens
ccuccuguaaaugguguacaua

SEQ ID NO: 784291 - RNA, 16 nt, Homo sapiens
ccuccuguauuccuga

SEQ ID NO: 784292 - RNA, 15 nt, Homo sapiens
ccuccugucccucau

SEQ ID NO: 784293 - RNA, 18 nt, Homo sapiens
ccuccugucccucaucca

SEQ ID NO: 784294 - RNA, 13 nt, Homo sapiens
ccuccugugcuau

SEQ ID NO: 784295 - RNA, 14 nt, Homo sapiens
ccuccugugcuauu

SEQ ID NO: 784296 - RNA, 18 nt, Homo sapiens
ccuccuuagaccugaggg

SEQ ID NO: 784297 - RNA, 20 nt, Homo sapiens
ccuccuuggcuuuaugcaaa

SEQ ID NO: 784298 - RNA, 20 nt, Homo sapiens
ccucgaauuuuaucugugga

SEQ ID NO: 784299 - RNA, 15 nt, Homo sapiens
ccucgcaugacuguu

SEQ ID NO: 784300 - RNA, 23 nt, Homo sapiens
ccucgcaugucucccuccagucc

SEQ ID NO: 784301 - RNA, 20 nt, Homo sapiens
ccucggagagcagcagcacc

SEQ ID NO: 784302 - RNA, 18 nt, Homo sapiens
ccucggccccucccacac

SEQ ID NO: 784303 - RNA, 19 nt, Homo sapiens
ccucggccucccaaagugc

SEQ ID NO: 784304 - RNA, 13 nt, Homo sapiens
ccucgggaagcag

SEQ ID NO: 784305 - RNA, 16 nt, Homo sapiens
ccucguagccaucucu

SEQ ID NO: 784306 - RNA, 19 nt, Homo sapiens
ccucuaagacuuuguauau

SEQ ID NO: 784307 - RNA, 14 nt, Homo sapiens
ccucuaagcacauu

SEQ ID NO: 784308 - RNA, 15 nt, Homo sapiens
ccucuaauaaacacu

SEQ ID NO: 784309 - RNA, 18 nt, Homo sapiens
ccucuacuuaaugagaua

SEQ ID NO: 784310 - RNA, 14 nt, Homo sapiens
ccucuagaagccaa

SEQ ID NO: 784311 - RNA, 14 nt, Homo sapiens
ccucuagaauccca

SEQ ID NO: 784312 - RNA, 15 nt, Homo sapiens
ccucuaggaggagcu

SEQ ID NO: 784313 - RNA, 13 nt, Homo sapiens
ccucuaguguccg

SEQ ID NO: 784314 - RNA, 13 nt, Homo sapiens
ccucuauaaacuu

SEQ ID NO: 784315 - RNA, 12 nt, Homo sapiens
ccucucaccaaa

SEQ ID NO: 784316 - RNA, 17 nt, Homo sapiens
ccucucaguuguugaaa

SEQ ID NO: 784317 - RNA, 17 nt, Homo sapiens
ccucucauuugcaguca

SEQ ID NO: 784318 - RNA, 15 nt, Homo sapiens
ccucuccuccagugu

SEQ ID NO: 784319 - RNA, 20 nt, Homo sapiens
ccucucggugcuccaucucc

SEQ ID NO: 784320 - RNA, 11 nt, Homo sapiens
ccucucuagca

SEQ ID NO: 784321 - RNA, 23 nt, Homo sapiens
ccucucuagcacaauuugcacua

SEQ ID NO: 784322 - RNA, 16 nt, Homo sapiens
ccucucucagugucaa

SEQ ID NO: 784323 - RNA, 21 nt, Homo sapiens
ccucucucucccaggucccag

SEQ ID NO: 784324 - RNA, 19 nt, Homo sapiens
ccucucugggcagucagaa

SEQ ID NO: 784325 - RNA, 17 nt, Homo sapiens
ccucucuuaaaugcaag

SEQ ID NO: 784326 - RNA, 15 nt, Homo sapiens
ccucucuuucucugg

SEQ ID NO: 784327 - RNA, 23 nt, Homo sapiens
ccucugaauuuacuuccuugcau

SEQ ID NO: 784328 - RNA, 17 nt, Homo sapiens
ccucugaccugccugua

SEQ ID NO: 784329 - RNA, 15 nt, Homo sapiens
ccucugaguuaaaua

SEQ ID NO: 784330 - RNA, 18 nt, Homo sapiens
ccaccucccauuacuuug

SEQ ID NO: 784331 - RNA, 22 nt, Homo sapiens
ccaccucccugacccgucuaau

SEQ ID NO: 784332 - RNA, 23 nt, Homo sapiens
ccaccucggccucccacagugcu

SEQ ID NO: 784333 - RNA, 16 nt, Homo sapiens
ccaccugacacaccag

SEQ ID NO: 784334 - RNA, 16 nt, Homo sapiens
ccaccugacucuugca

SEQ ID NO: 784335 - RNA, 23 nt, Homo sapiens
ccaccugccgcaugcucccuccu

SEQ ID NO: 784336 - RNA, 22 nt, Homo sapiens
ccaccugccugcaucugugaaa

SEQ ID NO: 784337 - RNA, 18 nt, Homo sapiens
ccaccugcuaaucacauc

SEQ ID NO: 784338 - RNA, 19 nt, Homo sapiens
ccaccuggacacaacacca

SEQ ID NO: 784339 - RNA, 21 nt, Homo sapiens
ccaccugugaucccagcuacu

SEQ ID NO: 784340 - RNA, 15 nt, Homo sapiens
ccaccuuccccagaa

SEQ ID NO: 784341 - RNA, 18 nt, Homo sapiens
ccaccuugucugcuaaau

SEQ ID NO: 784342 - RNA, 16 nt, Homo sapiens
ccaccuuugccacaaa

SEQ ID NO: 784343 - RNA, 19 nt, Homo sapiens
ccaccuuugccacaaagcu

SEQ ID NO: 784344 - RNA, 20 nt, Homo sapiens
ccacgaccuuugaagagcuu

SEQ ID NO: 784345 - RNA, 14 nt, Homo sapiens
ccacgacugccaug

SEQ ID NO: 784346 - RNA, 18 nt, Homo sapiens
ccacgccucuugaccagg

SEQ ID NO: 784347 - RNA, 13 nt, Homo sapiens
ccacgcugaccau

SEQ ID NO: 784348 - RNA, 16 nt, Homo sapiens
ccacggagcaguucag

SEQ ID NO: 784349 - RNA, 20 nt, Homo sapiens
ccacguauucauucagugag

SEQ ID NO: 784350 - RNA, 23 nt, Homo sapiens
ccacgucauuaagguuaugcacu

SEQ ID NO: 784351 - RNA, 22 nt, Homo sapiens
ccacguccagcuggaaggguca

SEQ ID NO: 784352 - RNA, 16 nt, Homo sapiens
ccacgucucuaaauaa

SEQ ID NO: 784353 - RNA, 20 nt, Homo sapiens
ccacgucugcuaacuuggag

SEQ ID NO: 784354 - RNA, 20 nt, Homo sapiens
ccacgugagagaaucugccu

SEQ ID NO: 784355 - RNA, 21 nt, Homo sapiens
ccacgugcaguaucucaagau

SEQ ID NO: 784356 - RNA, 19 nt, Homo sapiens
ccacguggguccucuucaa

SEQ ID NO: 784357 - RNA, 20 nt, Homo sapiens
ccacguucucucugccugug

SEQ ID NO: 784358 - RNA, 22 nt, Homo sapiens
ccacguucucucugccugugag

SEQ ID NO: 784359 - RNA, 20 nt, Homo sapiens
ccacuaaagagugaaugcca

SEQ ID NO: 784360 - RNA, 19 nt, Homo sapiens
ccacuaccguaaaugucca

SEQ ID NO: 784361 - RNA, 12 nt, Homo sapiens
ccacuacugcag

SEQ ID NO: 784362 - RNA, 14 nt, Homo sapiens
ccacuacugcagca

SEQ ID NO: 784363 - RNA, 12 nt, Homo sapiens
ccacuacugcua

SEQ ID NO: 784364 - RNA, 16 nt, Homo sapiens
ccacuauugugcuguc

SEQ ID NO: 784365 - RNA, 17 nt, Homo sapiens
ccacuauuuaaguuauc

SEQ ID NO: 784366 - RNA, 22 nt, Homo sapiens
ccacucacaaccccugcuccag

SEQ ID NO: 784367 - RNA, 23 nt, Homo sapiens
ccacucaccgaagccacuuucua

SEQ ID NO: 784368 - RNA, 14 nt, Homo sapiens
ccacuccuguacac

SEQ ID NO: 784369 - RNA, 22 nt, Homo sapiens
ccacucuaugaguuggacuuca

SEQ ID NO: 784370 - RNA, 18 nt, Homo sapiens
ccacucucugggacucuc

SEQ ID NO: 784371 - RNA, 23 nt, Homo sapiens
ccacucugccucugccugcauuc

SEQ ID NO: 784372 - RNA, 19 nt, Homo sapiens
ccacugaaaugaccaagac

SEQ ID NO: 784373 - RNA, 14 nt, Homo sapiens
ccacugcaaaacac

SEQ ID NO: 784374 - RNA, 17 nt, Homo sapiens
ccacugccacacccucc

SEQ ID NO: 784375 - RNA, 14 nt, Homo sapiens
ccacugcucgugga

SEQ ID NO: 784376 - RNA, 15 nt, Homo sapiens
ccacuggauugcuga

SEQ ID NO: 784377 - RNA, 20 nt, Homo sapiens
ccacuggcaaauguaacugu

SEQ ID NO: 784378 - RNA, 20 nt, Homo sapiens
ccacugggccauuguggugu

SEQ ID NO: 784379 - RNA, 13 nt, Homo sapiens
ccacuggggacuu

SEQ ID NO: 784380 - RNA, 19 nt, Homo sapiens
ccacugucuagagcaacuu

SEQ ID NO: 784381 - RNA, 14 nt, Homo sapiens
ccacuguguauaga

SEQ ID NO: 784382 - RNA, 14 nt, Homo sapiens
ccacuguuuugaau

SEQ ID NO: 784383 - RNA, 22 nt, Homo sapiens
ccacuuacagaucuaucuccuc

SEQ ID NO: 784384 - RNA, 18 nt, Homo sapiens
ccacuucucacucaccac

SEQ ID NO: 784385 - RNA, 19 nt, Homo sapiens
ccacuucuccaugcugcaa

SEQ ID NO: 784386 - RNA, 21 nt, Homo sapiens
ccacuucuggguggggcagug

SEQ ID NO: 784387 - RNA, 15 nt, Homo sapiens
ccacuuucugccagc

SEQ ID NO: 784388 - RNA, 21 nt, Homo sapiens
ccacuuucugccagcaucugc

SEQ ID NO: 784389 - RNA, 23 nt, Homo sapiens
ccagaaaagauggaaaagaaauu

SEQ ID NO: 784390 - RNA, 22 nt, Homo sapiens
ccagaaaauguaaggcaaugcu

SEQ ID NO: 784391 - RNA, 13 nt, Homo sapiens
ccagaaacaaaaa

SEQ ID NO: 784392 - RNA, 14 nt, Homo sapiens
ccagaaacuuuaag

SEQ ID NO: 784393 - RNA, 13 nt, Homo sapiens
ccagaaaugucua

SEQ ID NO: 784394 - RNA, 18 nt, Homo sapiens
ccagaagacuugccugcu

SEQ ID NO: 784395 - RNA, 23 nt, Homo sapiens
ccagaaggagggcagagccaugg

SEQ ID NO: 784396 - RNA, 12 nt, Homo sapiens
ccagaaugcugc

SEQ ID NO: 784397 - RNA, 17 nt, Homo sapiens
ccagaauggagccugcu

SEQ ID NO: 784398 - RNA, 20 nt, Homo sapiens
ccagacaacuuguccugacu

SEQ ID NO: 784399 - RNA, 15 nt, Homo sapiens
ccagacaauuccauu

SEQ ID NO: 784400 - RNA, 19 nt, Homo sapiens
ccagacaccaugugcaaua

SEQ ID NO: 784401 - RNA, 22 nt, Homo sapiens
ccagacagcucccucugccuga

SEQ ID NO: 784402 - RNA, 14 nt, Homo sapiens
ccagacagcuugac

SEQ ID NO: 784403 - RNA, 21 nt, Homo sapiens
ccagacagcuugacugcuuuu

SEQ ID NO: 784404 - RNA, 13 nt, Homo sapiens
ccagacauggugu

SEQ ID NO: 784405 - RNA, 18 nt, Homo sapiens
ccagaccagccugggcaa

SEQ ID NO: 784406 - RNA, 12 nt, Homo sapiens
ccagacccagug

SEQ ID NO: 784407 - RNA, 14 nt, Homo sapiens
ccagacggucagga

SEQ ID NO: 784408 - RNA, 14 nt, Homo sapiens
ccagacggugugca

SEQ ID NO: 784409 - RNA, 17 nt, Homo sapiens
ccagacucuugccuguu

SEQ ID NO: 784410 - RNA, 12 nt, Homo sapiens
aaaauaaauucc

SEQ ID NO: 784411 - RNA, 14 nt, Homo sapiens
aaaauaaauuugca

SEQ ID NO: 784412 - RNA, 17 nt, Homo sapiens
aaaauaacaaagcccuu

SEQ ID NO: 784413 - RNA, 14 nt, Homo sapiens
aaaauacauaguga

SEQ ID NO: 784414 - RNA, 13 nt, Homo sapiens
aaaauacauugua

SEQ ID NO: 784415 - RNA, 16 nt, Homo sapiens
aaaauaccacuguaau

SEQ ID NO: 784416 - RNA, 21 nt, Homo sapiens
aaaauacuauuuaagauguga

SEQ ID NO: 784417 - RNA, 19 nt, Homo sapiens
aaaauacuuuuacucugcc

SEQ ID NO: 784418 - RNA, 13 nt, Homo sapiens
aaaauaguuaccu

SEQ ID NO: 784419 - RNA, 16 nt, Homo sapiens
aaaauaucugcucaaa

SEQ ID NO: 784420 - RNA, 20 nt, Homo sapiens
aaaauauuucagauaucaaa

SEQ ID NO: 784421 - RNA, 21 nt, Homo sapiens
aaaauauuuccugacuugagu

SEQ ID NO: 784422 - RNA, 22 nt, Homo sapiens
aaaauauuucuaagcuuauuuc

SEQ ID NO: 784423 - RNA, 18 nt, Homo sapiens
aaaaucacaggacauuaa

SEQ ID NO: 784424 - RNA, 18 nt, Homo sapiens
aaaaucacauccuggccu

SEQ ID NO: 784425 - RNA, 19 nt, Homo sapiens
aaaaucacucucagugcuu

SEQ ID NO: 784426 - RNA, 19 nt, Homo sapiens
aaaaucagagaacuuuccc

SEQ ID NO: 784427 - RNA, 16 nt, Homo sapiens
aaaaucauggaaagac

SEQ ID NO: 784428 - RNA, 16 nt, Homo sapiens
aaaaucaugggccaga

SEQ ID NO: 784429 - RNA, 17 nt, Homo sapiens
aaaauccagaacucaaa

SEQ ID NO: 784430 - RNA, 20 nt, Homo sapiens
aaaauccaugggcaguauga

SEQ ID NO: 784431 - RNA, 11 nt, Homo sapiens
aaaauccauuu

SEQ ID NO: 784432 - RNA, 17 nt, Homo sapiens
aaaaucccaccuuccca

SEQ ID NO: 784433 - RNA, 16 nt, Homo sapiens
aaaauccuaacauuca

SEQ ID NO: 784434 - RNA, 14 nt, Homo sapiens
aaaaucguuuugcc

SEQ ID NO: 784435 - RNA, 13 nt, Homo sapiens
aaaaucuccaucu

SEQ ID NO: 784436 - RNA, 22 nt, Homo sapiens
aaaaucugcucuuuguaugaca

SEQ ID NO: 784437 - RNA, 15 nt, Homo sapiens
aaaaugaaacagaac

SEQ ID NO: 784438 - RNA, 11 nt, Homo sapiens
aaaaugaaggu

SEQ ID NO: 784439 - RNA, 17 nt, Homo sapiens
aaaaugacaaugaugau

SEQ ID NO: 784440 - RNA, 17 nt, Homo sapiens
aaaaugaggaauccaaa

SEQ ID NO: 784441 - RNA, 13 nt, Homo sapiens
aaaaugagugcuu

SEQ ID NO: 784442 - RNA, 19 nt, Homo sapiens
aaaaugauuggccccaguc

SEQ ID NO: 784443 - RNA, 19 nt, Homo sapiens
aaaaugcaguccugaggag

SEQ ID NO: 784444 - RNA, 21 nt, Homo sapiens
aaaaugcaucacaugaugaaa

SEQ ID NO: 784445 - RNA, 13 nt, Homo sapiens
aaaauggcagugg

SEQ ID NO: 784446 - RNA, 18 nt, Homo sapiens
aaaaugguaauuguugcu

SEQ ID NO: 784447 - RNA, 16 nt, Homo sapiens
aaaauggucucuaaca

SEQ ID NO: 784448 - RNA, 15 nt, Homo sapiens
aaaauguaaugauca

SEQ ID NO: 784449 - RNA, 16 nt, Homo sapiens
aaaauguaauuacuua

SEQ ID NO: 784450 - RNA, 22 nt, Homo sapiens
aaaauguccucccuuguggcuu

SEQ ID NO: 784451 - RNA, 15 nt, Homo sapiens
aaaauguccugccuu

SEQ ID NO: 784452 - RNA, 17 nt, Homo sapiens
aaaauguccugccuuuu

SEQ ID NO: 784453 - RNA, 19 nt, Homo sapiens
aaaaugugcuauacugcau

SEQ ID NO: 784454 - RNA, 16 nt, Homo sapiens
aaaauguuauucuguu

SEQ ID NO: 784455 - RNA, 11 nt, Homo sapiens
aaaauguucuc

SEQ ID NO: 784456 - RNA, 14 nt, Homo sapiens
aaaauguucucuua

SEQ ID NO: 784457 - RNA, 20 nt, Homo sapiens
aaaauuaaaccggaccaucu

SEQ ID NO: 784458 - RNA, 23 nt, Homo sapiens
aaaauuagccagaugugguggca

SEQ ID NO: 784459 - RNA, 13 nt, Homo sapiens
aaaauuagccagg

SEQ ID NO: 784460 - RNA, 21 nt, Homo sapiens
aaaauuagccgggcauggugg

SEQ ID NO: 784461 - RNA, 18 nt, Homo sapiens
aaaauuagugaguauaaa

SEQ ID NO: 784462 - RNA, 14 nt, Homo sapiens
aaaauuaugaccau

SEQ ID NO: 784463 - RNA, 14 nt, Homo sapiens
aaaauuaugccaua

SEQ ID NO: 784464 - RNA, 20 nt, Homo sapiens
aaaauuauuauauauacaug

SEQ ID NO: 784465 - RNA, 19 nt, Homo sapiens
aaaauucauaaccaaagag

SEQ ID NO: 784466 - RNA, 15 nt, Homo sapiens
aaaauugcacuuuua

SEQ ID NO: 784467 - RNA, 17 nt, Homo sapiens
aaaauugcuauguuacu

SEQ ID NO: 784468 - RNA, 22 nt, Homo sapiens
aaaauugcuucuuuaccaagga

SEQ ID NO: 784469 - RNA, 20 nt, Homo sapiens
aaaauuuaaaggguguacuu

SEQ ID NO: 784470 - RNA, 20 nt, Homo sapiens
aaacucaaugagcucuucca

SEQ ID NO: 784471 - RNA, 15 nt, Homo sapiens
aaacucacugcucaa

SEQ ID NO: 784472 - RNA, 13 nt, Homo sapiens
aaacucagugcaa

SEQ ID NO: 784473 - RNA, 16 nt, Homo sapiens
aaacuccugaccucaa

SEQ ID NO: 784474 - RNA, 12 nt, Homo sapiens
aaacucucacca

SEQ ID NO: 784475 - RNA, 22 nt, Homo sapiens
aaacucuguccacgauucacuc

SEQ ID NO: 784476 - RNA, 18 nt, Homo sapiens
aaacugaccaaacgcuua

SEQ ID NO: 784477 - RNA, 14 nt, Homo sapiens
aaacugaugacuua

SEQ ID NO: 784478 - RNA, 23 nt, Homo sapiens
aaacugauucucuaugacaugaa

SEQ ID NO: 784479 - RNA, 20 nt, Homo sapiens
aaacugcauuuccuuucuac

SEQ ID NO: 784480 - RNA, 12 nt, Homo sapiens
aaacugccauua

SEQ ID NO: 784481 - RNA, 21 nt, Homo sapiens
aaacugccuuucugguggcuu

SEQ ID NO: 784482 - RNA, 15 nt, Homo sapiens
aaacugcuuuuccac

SEQ ID NO: 784483 - RNA, 20 nt, Homo sapiens
aaacugggcuccugcuuuau

SEQ ID NO: 784484 - RNA, 21 nt, Homo sapiens
aaacuggguuugggcuuugcu

SEQ ID NO: 784485 - RNA, 21 nt, Homo sapiens
aaacugguuuaggauuacuua

SEQ ID NO: 784486 - RNA, 15 nt, Homo sapiens
aaacuguaugugcug

SEQ ID NO: 784487 - RNA, 18 nt, Homo sapiens
aaacugucuuuaaaagag

SEQ ID NO: 784488 - RNA, 21 nt, Homo sapiens
aaacugugaagcauuuacaga

SEQ ID NO: 784489 - RNA, 15 nt, Homo sapiens
aaacuguuacugaaa

SEQ ID NO: 784490 - RNA, 19 nt, Homo sapiens
aaacuguuccaaucaugaa

SEQ ID NO: 784491 - RNA, 20 nt, Homo sapiens
aaacuguuccaaucaugaaa

SEQ ID NO: 784492 - RNA, 17 nt, Homo sapiens
aaacuuaggcaugcaca

SEQ ID NO: 784493 - RNA, 19 nt, Homo sapiens
aaacuuagugacaaaauag

SEQ ID NO: 784494 - RNA, 13 nt, Homo sapiens
aaacuucagggau

SEQ ID NO: 784495 - RNA, 13 nt, Homo sapiens
aaacuuccaguca

SEQ ID NO: 784496 - RNA, 11 nt, Homo sapiens
aaacuugcauc

SEQ ID NO: 784497 - RNA, 22 nt, Homo sapiens
aaacuugccuggggucugagca

SEQ ID NO: 784498 - RNA, 15 nt, Homo sapiens
aaacuugcugguccu

SEQ ID NO: 784499 - RNA, 23 nt, Homo sapiens
aaacuuggcucgaaucucugugc

SEQ ID NO: 784500 - RNA, 17 nt, Homo sapiens
aaacuuguuacuaaaga

SEQ ID NO: 784501 - RNA, 15 nt, Homo sapiens
aaacuuguucaaaag

SEQ ID NO: 784502 - RNA, 16 nt, Homo sapiens
aaacuuuaagaacaaa

SEQ ID NO: 784503 - RNA, 17 nt, Homo sapiens
aaacuuuaagaacaaac

SEQ ID NO: 784504 - RNA, 17 nt, Homo sapiens
aaacuuuagaguagcau

SEQ ID NO: 784505 - RNA, 21 nt, Homo sapiens
aaacuuuagaguagcaugaga

SEQ ID NO: 784506 - RNA, 12 nt, Homo sapiens
aaacuuugcaga

SEQ ID NO: 784507 - RNA, 23 nt, Homo sapiens
aaacuuugccaaauauaaucuca

SEQ ID NO: 784508 - RNA, 17 nt, Homo sapiens
aaacuuuggcuuauaaa

SEQ ID NO: 784509 - RNA, 19 nt, Homo sapiens
aaacuuuggguacuuauac

SEQ ID NO: 784510 - RNA, 23 nt, Homo sapiens
aaacuuuuguuuagagcccuccc

SEQ ID NO: 784511 - RNA, 19 nt, Homo sapiens
aaagaaaaauaucuuggcc

SEQ ID NO: 784512 - RNA, 15 nt, Homo sapiens
aaagaaaaguuucac

SEQ ID NO: 784513 - RNA, 18 nt, Homo sapiens
aaagaaaggaacuaaguc

SEQ ID NO: 784514 - RNA, 16 nt, Homo sapiens
aaagaaauuccccaag

SEQ ID NO: 784515 - RNA, 13 nt, Homo sapiens
aaagaaccagaga

SEQ ID NO: 784516 - RNA, 22 nt, Homo sapiens
aaagaagaaacgucuaugugua

SEQ ID NO: 784517 - RNA, 13 nt, Homo sapiens
aaagaagcucucc

SEQ ID NO: 784518 - RNA, 17 nt, Homo sapiens
aaagaagggaucccuaa

SEQ ID NO: 784519 - RNA, 18 nt, Homo sapiens
aaagaagggaucccuaac

SEQ ID NO: 784520 - RNA, 22 nt, Homo sapiens
aaagaagggaucccuaacuguu

SEQ ID NO: 784521 - RNA, 20 nt, Homo sapiens
aaagaagguguuuuccugaa

SEQ ID NO: 784522 - RNA, 15 nt, Homo sapiens
aaagaauguuuggca

SEQ ID NO: 784523 - RNA, 23 nt, Homo sapiens
aaagaauuuuuuaagaacuguau

SEQ ID NO: 784524 - RNA, 14 nt, Homo sapiens
aaagacaacauaac

SEQ ID NO: 784525 - RNA, 18 nt, Homo sapiens
aaagacaccuacugagug

SEQ ID NO: 784526 - RNA, 9 nt, Homo sapiens
aaagacaga

SEQ ID NO: 784527 - RNA, 11 nt, Homo sapiens
aaagacaucaa

SEQ ID NO: 784528 - RNA, 12 nt, Homo sapiens
aaagacaucaaa

SEQ ID NO: 784529 - RNA, 11 nt, Homo sapiens
aagguucucug

SEQ ID NO: 784530 - RNA, 20 nt, Homo sapiens
aagguuuuagacccauagca

SEQ ID NO: 784531 - RNA, 23 nt, Homo sapiens
aagguuuuauaaggcugauguca

SEQ ID NO: 784532 - RNA, 13 nt, Homo sapiens
aaguaaaaccaca

SEQ ID NO: 784533 - RNA, 20 nt, Homo sapiens
aaguaaaacuugcugccuga

SEQ ID NO: 784534 - RNA, 21 nt, Homo sapiens
aaguaacugaaccauuccaac

SEQ ID NO: 784535 - RNA, 18 nt, Homo sapiens
aaguaacugaauuauuuc

SEQ ID NO: 784536 - RNA, 12 nt, Homo sapiens
aaguaacuuuau

SEQ ID NO: 784537 - RNA, 11 nt, Homo sapiens
aaguaagcaac

SEQ ID NO: 784538 - RNA, 14 nt, Homo sapiens
aaguaaucaucuaa

SEQ ID NO: 784539 - RNA, 18 nt, Homo sapiens
aaguaauccaccugccuc

SEQ ID NO: 784540 - RNA, 15 nt, Homo sapiens
aaguaauugccuaca

SEQ ID NO: 784541 - RNA, 20 nt, Homo sapiens
aaguaauugccuacaauaaa

SEQ ID NO: 784542 - RNA, 19 nt, Homo sapiens
aaguacaucucuacuaaaa

SEQ ID NO: 784543 - RNA, 16 nt, Homo sapiens
aaguaccaaugcuguu

SEQ ID NO: 784544 - RNA, 14 nt, Homo sapiens
aaguaccacacaua

SEQ ID NO: 784545 - RNA, 16 nt, Homo sapiens
aaguaccacacauauu

SEQ ID NO: 784546 - RNA, 13 nt, Homo sapiens
aaguacccuuuug

SEQ ID NO: 784547 - RNA, 22 nt, Homo sapiens
aaguaccuuauucuacaucauu

SEQ ID NO: 784548 - RNA, 18 nt, Homo sapiens
aaguacuuaaacuuccac

SEQ ID NO: 784549 - RNA, 20 nt, Homo sapiens
aaguacuugagacucuugaa

SEQ ID NO: 784550 - RNA, 16 nt, Homo sapiens
aaguagaggaauccau

SEQ ID NO: 784551 - RNA, 15 nt, Homo sapiens
aaguagauugccagc

SEQ ID NO: 784552 - RNA, 17 nt, Homo sapiens
aaguagguuuacauuca

SEQ ID NO: 784553 - RNA, 18 nt, Homo sapiens
aaguagguuuacauucau

SEQ ID NO: 784554 - RNA, 19 nt, Homo sapiens
aaguaguccagccuuccag

SEQ ID NO: 784555 - RNA, 19 nt, Homo sapiens
aaguauaaagucacuucca

SEQ ID NO: 784556 - RNA, 15 nt, Homo sapiens
aaguauaacaacuuu

SEQ ID NO: 784557 - RNA, 18 nt, Homo sapiens
aaguauaacaacuuugaa

SEQ ID NO: 784558 - RNA, 21 nt, Homo sapiens
aaguaugaauauuacucucaa

SEQ ID NO: 784559 - RNA, 13 nt, Homo sapiens
aaguaugagggaa

SEQ ID NO: 784560 - RNA, 16 nt, Homo sapiens
aaguaugagggaaaau

SEQ ID NO: 784561 - RNA, 17 nt, Homo sapiens
aaguaugagggaaaaug

SEQ ID NO: 784562 - RNA, 20 nt, Homo sapiens
aaggaaacccccaguguaau

SEQ ID NO: 784563 - RNA, 19 nt, Homo sapiens
aaggaaagaaaacaucuuu

SEQ ID NO: 784564 - RNA, 18 nt, Homo sapiens
aaggaaaggcucauuuaa

SEQ ID NO: 784565 - RNA, 18 nt, Homo sapiens
aaggaaauaaagcguccu

SEQ ID NO: 784566 - RNA, 17 nt, Homo sapiens
aaggaacacuggcuuga

SEQ ID NO: 784567 - RNA, 22 nt, Homo sapiens
aaggaacauuccuuagucucaa

SEQ ID NO: 784568 - RNA, 13 nt, Homo sapiens
aaggaagacuuga

SEQ ID NO: 784569 - RNA, 19 nt, Homo sapiens
aaggaagcaagcaucuccg

SEQ ID NO: 784570 - RNA, 13 nt, Homo sapiens
aaggaaugauaua

SEQ ID NO: 784571 - RNA, 18 nt, Homo sapiens
aaggacagcccuccuuga

SEQ ID NO: 784572 - RNA, 21 nt, Homo sapiens
aaggacauuuaaaauucaauu

SEQ ID NO: 784573 - RNA, 15 nt, Homo sapiens
aaggaccuuggaaga

SEQ ID NO: 784574 - RNA, 20 nt, Homo sapiens
aaggacuuccuguccagcuc

SEQ ID NO: 784575 - RNA, 15 nt, Homo sapiens
aaggacuuugcagcc

SEQ ID NO: 784576 - RNA, 15 nt, Homo sapiens
aaggagcuuucucaa

SEQ ID NO: 784577 - RNA, 16 nt, Homo sapiens
aaggaggaaguggaag

SEQ ID NO: 784578 - RNA, 19 nt, Homo sapiens
aaggaggaaucaagaagcu

SEQ ID NO: 784579 - RNA, 17 nt, Homo sapiens
aaggaggggaaccagau

SEQ ID NO: 784580 - RNA, 22 nt, Homo sapiens
aaggaggucaggccccacuccu

SEQ ID NO: 784581 - RNA, 22 nt, Homo sapiens
aaggaguauaguaaaugccuca

SEQ ID NO: 784582 - RNA, 17 nt, Homo sapiens
aaggauaaugaaauaau

SEQ ID NO: 784583 - RNA, 23 nt, Homo sapiens
aaggauauuuaagaaaauacaau

SEQ ID NO: 784584 - RNA, 15 nt, Homo sapiens
aaggauauuuacaga

SEQ ID NO: 784585 - RNA, 20 nt, Homo sapiens
aaggauauuuacuacuuuug

SEQ ID NO: 784586 - RNA, 15 nt, Homo sapiens
aaggaucucucagga

SEQ ID NO: 784587 - RNA, 16 nt, Homo sapiens
aaggaugacaaaaugg

SEQ ID NO: 784588 - RNA, 23 nt, Homo sapiens
aaggauggagccagcucugcauu

SEQ ID NO: 784589 - RNA, 15 nt, Homo sapiens
aaggcaaacauuuga

SEQ ID NO: 784590 - RNA, 16 nt, Homo sapiens
aaggcaaauauaagcu

SEQ ID NO: 784591 - RNA, 23 nt, Homo sapiens
aaggcaauuccugauggaaaaug

SEQ ID NO: 784592 - RNA, 12 nt, Homo sapiens
aaggcacacaga

SEQ ID NO: 784593 - RNA, 20 nt, Homo sapiens
aaggcagcugccucugcucc

SEQ ID NO: 784594 - RNA, 16 nt, Homo sapiens
aaggcaggacagagaa

SEQ ID NO: 784595 - RNA, 14 nt, Homo sapiens
aaauuuucuaauua

SEQ ID NO: 784596 - RNA, 16 nt, Homo sapiens
aaauuuugaaaacugu

SEQ ID NO: 784597 - RNA, 23 nt, Homo sapiens
aaauuuugucuuuaacucauaaa

SEQ ID NO: 784598 - RNA, 15 nt, Homo sapiens
aaauuuuuaccuguu

SEQ ID NO: 784599 - RNA, 15 nt, Homo sapiens
aaauuuuuauguaaa

SEQ ID NO: 784600 - RNA, 21 nt, Homo sapiens
aaauuuuucuucucuuuucaa

SEQ ID NO: 784601 - RNA, 21 nt, Homo sapiens
aacaaaaaaaccucuaugcaa

SEQ ID NO: 784602 - RNA, 16 nt, Homo sapiens
aacaaaaacagaauuu

SEQ ID NO: 784603 - RNA, 23 nt, Homo sapiens
aacaaaaaucuguguaacuguaa

SEQ ID NO: 784604 - RNA, 20 nt, Homo sapiens
aacaaaaauguaaugaucau

SEQ ID NO: 784605 - RNA, 22 nt, Homo sapiens
aacaaaaccuacacacauaccu

SEQ ID NO: 784606 - RNA, 22 nt, Homo sapiens
aacaaaaccuacgcacauaccu

SEQ ID NO: 784607 - RNA, 19 nt, Homo sapiens
aacaaaagcgacccauuca

SEQ ID NO: 784608 - RNA, 13 nt, Homo sapiens
aacaaacaagaga

SEQ ID NO: 784609 - RNA, 23 nt, Homo sapiens
aacaaacuggcugcuuuguucaa

SEQ ID NO: 784610 - RNA, 13 nt, Homo sapiens
aacaaagaagaca

SEQ ID NO: 784611 - RNA, 12 nt, Homo sapiens
aacaaauaugca

SEQ ID NO: 784612 - RNA, 19 nt, Homo sapiens
aacaaauuaacuagauaca

SEQ ID NO: 784613 - RNA, 14 nt, Homo sapiens
aacaacaaauaauu

SEQ ID NO: 784614 - RNA, 20 nt, Homo sapiens
aacaacauggggaccaguca

SEQ ID NO: 784615 - RNA, 18 nt, Homo sapiens
aacaaccaugucauuuca

SEQ ID NO: 784616 - RNA, 21 nt, Homo sapiens
aacaaccguuggaaacauaac

SEQ ID NO: 784617 - RNA, 17 nt, Homo sapiens
aacaacuguggucaauc

SEQ ID NO: 784618 - RNA, 16 nt, Homo sapiens
aacaacuuacacuuau

SEQ ID NO: 784619 - RNA, 15 nt, Homo sapiens
aacaacuucagucca

SEQ ID NO: 784620 - RNA, 20 nt, Homo sapiens
aacaagacuccucaucauga

SEQ ID NO: 784621 - RNA, 12 nt, Homo sapiens
aacaagaucugc

SEQ ID NO: 784622 - RNA, 18 nt, Homo sapiens
aacaagcaaguucugaga

SEQ ID NO: 784623 - RNA, 12 nt, Homo sapiens
aacaagcugugc

SEQ ID NO: 784624 - RNA, 18 nt, Homo sapiens
aacaauaaaguacuuuac

SEQ ID NO: 784625 - RNA, 15 nt, Homo sapiens
aacaauaaauaugua

SEQ ID NO: 784626 - RNA, 23 nt, Homo sapiens
aacaauauuacuuugucuuuuca

SEQ ID NO: 784627 - RNA, 13 nt, Homo sapiens
aacaaugcauuuu

SEQ ID NO: 784628 - RNA, 18 nt, Homo sapiens
aacaaugguugaaugaau

SEQ ID NO: 784629 - RNA, 21 nt, Homo sapiens
aacaauguaaaccaccaucuu

SEQ ID NO: 784630 - RNA, 14 nt, Homo sapiens
aacaauucugugac

SEQ ID NO: 784631 - RNA, 22 nt, Homo sapiens
aacacaaaccacaacugacaca

SEQ ID NO: 784632 - RNA, 13 nt, Homo sapiens
aacacaagcaaaa

SEQ ID NO: 784633 - RNA, 15 nt, Homo sapiens
aacacacagcaacau

SEQ ID NO: 784634 - RNA, 15 nt, Homo sapiens
aacacacgugcugug

SEQ ID NO: 784635 - RNA, 12 nt, Homo sapiens
aacacacuggcc

SEQ ID NO: 784636 - RNA, 15 nt, Homo sapiens
aacacacuggccauu

SEQ ID NO: 784637 - RNA, 13 nt, Homo sapiens
aacacagaggcag

SEQ ID NO: 784638 - RNA, 21 nt, Homo sapiens
aacacagcuacaacccuaccc

SEQ ID NO: 784639 - RNA, 21 nt, Homo sapiens
aacacaggcagguacugucug

SEQ ID NO: 784640 - RNA, 13 nt, Homo sapiens
aacacaguccaga

SEQ ID NO: 784641 - RNA, 21 nt, Homo sapiens
aacacaugugcagucacuggu

SEQ ID NO: 784642 - RNA, 23 nt, Homo sapiens
aacaccaaagaauuguaggcagu

SEQ ID NO: 784643 - RNA, 20 nt, Homo sapiens
aacaccaucgaucaugaugu

SEQ ID NO: 784644 - RNA, 14 nt, Homo sapiens
aacaccccacugag

SEQ ID NO: 784645 - RNA, 16 nt, Homo sapiens
aacaccccacugagcc

SEQ ID NO: 784646 - RNA, 14 nt, Homo sapiens
aacaccuaugcaaa

SEQ ID NO: 784647 - RNA, 15 nt, Homo sapiens
aacaccuauugcacu

SEQ ID NO: 784648 - RNA, 20 nt, Homo sapiens
aacacgccuuguuccugcuc

SEQ ID NO: 784649 - RNA, 13 nt, Homo sapiens
aacacgcugccug

SEQ ID NO: 784650 - RNA, 14 nt, Homo sapiens
aacacggugcucau

SEQ ID NO: 784651 - RNA, 15 nt, Homo sapiens
aacacuaagcucucu

SEQ ID NO: 784652 - RNA, 19 nt, Homo sapiens
aacacuaguuuugugccag

SEQ ID NO: 784653 - RNA, 14 nt, Homo sapiens
aacacucaguccac

SEQ ID NO: 784654 - RNA, 15 nt, Homo sapiens
aacacucaugaagca

SEQ ID NO: 784655 - RNA, 12 nt, Homo sapiens
aacacuccucua

SEQ ID NO: 784656 - RNA, 20 nt, Homo sapiens
aacacugcagcccucuccac

SEQ ID NO: 784657 - RNA, 11 nt, Homo sapiens
aacacuguuau

SEQ ID NO: 784658 - RNA, 17 nt, Homo sapiens
aacacuuauguuauaca

SEQ ID NO: 784659 - RNA, 16 nt, Homo sapiens
aacacuuggcauacaa

SEQ ID NO: 784660 - RNA, 14 nt, Homo sapiens
aacacuugucaaga

SEQ ID NO: 784661 - RNA, 18 nt, Homo sapiens
aacacuuucugcacuuau

SEQ ID NO: 784662 - RNA, 22 nt, Homo sapiens
aacacuuuggacuucucugaaa

SEQ ID NO: 784663 - RNA, 13 nt, Homo sapiens
aacagaacuugac

SEQ ID NO: 784664 - RNA, 17 nt, Homo sapiens
aacagaauuaaguggau

SEQ ID NO: 784665 - RNA, 13 nt, Homo sapiens
aacagacaacaga

SEQ ID NO: 784666 - RNA, 19 nt, Homo sapiens
aaaugagccccuucauccg

SEQ ID NO: 784667 - RNA, 15 nt, Homo sapiens
aaaugagugcuuaaa

SEQ ID NO: 784668 - RNA, 13 nt, Homo sapiens
aaaugauacagua

SEQ ID NO: 784669 - RNA, 13 nt, Homo sapiens
aaaugaucuuuac

SEQ ID NO: 784670 - RNA, 19 nt, Homo sapiens
aaaugaugcgcaucaaugu

SEQ ID NO: 784671 - RNA, 18 nt, Homo sapiens
aaaugcacauuugucacu

SEQ ID NO: 784672 - RNA, 17 nt, Homo sapiens
aaaugcaguugucuugu

SEQ ID NO: 784673 - RNA, 20 nt, Homo sapiens
aaaugcauauccugagccau

SEQ ID NO: 784674 - RNA, 16 nt, Homo sapiens
aaaugcaucacaugau

SEQ ID NO: 784675 - RNA, 19 nt, Homo sapiens
aaaugcucuaacuggacau

SEQ ID NO: 784676 - RNA, 16 nt, Homo sapiens
aaaugcucuuuugcac

SEQ ID NO: 784677 - RNA, 17 nt, Homo sapiens
aaaugcucuuuugcaca

SEQ ID NO: 784678 - RNA, 11 nt, Homo sapiens
aaaugcugcuc

SEQ ID NO: 784679 - RNA, 16 nt, Homo sapiens
aaaugcuuacagggcu

SEQ ID NO: 784680 - RNA, 16 nt, Homo sapiens
aaaugcuuuuagaaug

SEQ ID NO: 784681 - RNA, 15 nt, Homo sapiens
aaaugcuuuuccuca

SEQ ID NO: 784682 - RNA, 16 nt, Homo sapiens
aaaugcuuuuccucaa

SEQ ID NO: 784683 - RNA, 21 nt, Homo sapiens
aaauggaaauuuaaaugacau

SEQ ID NO: 784684 - RNA, 15 nt, Homo sapiens
aaauggcagaaccaa

SEQ ID NO: 784685 - RNA, 21 nt, Homo sapiens
aaauggcagggauacccagug

SEQ ID NO: 784686 - RNA, 16 nt, Homo sapiens
aaauggcagugguggc

SEQ ID NO: 784687 - RNA, 18 nt, Homo sapiens
aaaugggacugaugucau

SEQ ID NO: 784688 - RNA, 19 nt, Homo sapiens
aaaugggagacagccucuu

SEQ ID NO: 784689 - RNA, 17 nt, Homo sapiens
aaaugggcagugaaggc

SEQ ID NO: 784690 - RNA, 19 nt, Homo sapiens
aaaugggcucgugacccaa

SEQ ID NO: 784691 - RNA, 19 nt, Homo sapiens
aaauggggcaaacagucua

SEQ ID NO: 784692 - RNA, 23 nt, Homo sapiens
aaauggguauuuguucaaaauaa

SEQ ID NO: 784693 - RNA, 15 nt, Homo sapiens
aaauggguuuauuca

SEQ ID NO: 784694 - RNA, 21 nt, Homo sapiens
aaauggucucuaacauuuccu

SEQ ID NO: 784695 - RNA, 11 nt, Homo sapiens
aaauggugguc

SEQ ID NO: 784696 - RNA, 10 nt, Homo sapiens
aaaugguugu

SEQ ID NO: 784697 - RNA, 23 nt, Homo sapiens
aaaugguugucaccucucucuga

SEQ ID NO: 784698 - RNA, 22 nt, Homo sapiens
aaauguacaacugcaccuguca

SEQ ID NO: 784699 - RNA, 11 nt, Homo sapiens
aaauguacaau

SEQ ID NO: 784700 - RNA, 23 nt, Homo sapiens
aaauguaccccucucagucugca

SEQ ID NO: 784701 - RNA, 12 nt, Homo sapiens
aaauguaugugc

SEQ ID NO: 784702 - RNA, 14 nt, Homo sapiens
aaauguaugugcuc

SEQ ID NO: 784703 - RNA, 15 nt, Homo sapiens
aaauguauuccugua

SEQ ID NO: 784704 - RNA, 14 nt, Homo sapiens
aaaugucaugagau

SEQ ID NO: 784705 - RNA, 13 nt, Homo sapiens
aaauguccaugau

SEQ ID NO: 784706 - RNA, 17 nt, Homo sapiens
aaaugucuaagguagua

SEQ ID NO: 784707 - RNA, 19 nt, Homo sapiens
aaaugucuaagguaguaac

SEQ ID NO: 784708 - RNA, 18 nt, Homo sapiens
aaaugucuggucugucca

SEQ ID NO: 784709 - RNA, 19 nt, Homo sapiens
aaaugucuggucuguccac

SEQ ID NO: 784710 - RNA, 18 nt, Homo sapiens
aaaugugaccugugucac

SEQ ID NO: 784711 - RNA, 14 nt, Homo sapiens
aaaugugccuucau

SEQ ID NO: 784712 - RNA, 22 nt, Homo sapiens
aaauguggaggcuaucaacaaa

SEQ ID NO: 784713 - RNA, 22 nt, Homo sapiens
aaauguguaauuuuguuuauau

SEQ ID NO: 784714 - RNA, 21 nt, Homo sapiens
aaaugugucauuggaagccau

SEQ ID NO: 784715 - RNA, 19 nt, Homo sapiens
aaauguguuccauugccau

SEQ ID NO: 784716 - RNA, 15 nt, Homo sapiens
aaauguguugcccuc

SEQ ID NO: 784717 - RNA, 19 nt, Homo sapiens
aaauguucaagucaugccu

SEQ ID NO: 784718 - RNA, 15 nt, Homo sapiens
aaauguuggagugga

SEQ ID NO: 784719 - RNA, 18 nt, Homo sapiens
aaauguuuguuauuuaca

SEQ ID NO: 784720 - RNA, 16 nt, Homo sapiens
aaauguuuuacucaga

SEQ ID NO: 784721 - RNA, 20 nt, Homo sapiens
aaauuaaccucucacaguua

SEQ ID NO: 784722 - RNA, 17 nt, Homo sapiens
aaauuaagaaaucauuc

SEQ ID NO: 784723 - RNA, 14 nt, Homo sapiens
aaauuaagacuuua

SEQ ID NO: 784724 - RNA, 20 nt, Homo sapiens
aaauuaagauguugucuugc

SEQ ID NO: 784725 - RNA, 12 nt, Homo sapiens
aaauuaagcauu

SEQ ID NO: 784726 - RNA, 17 nt, Homo sapiens
aaauuaaucuugcuuca

SEQ ID NO: 784727 - RNA, 16 nt, Homo sapiens
aaauuacaauugucau

SEQ ID NO: 784728 - RNA, 21 nt, Homo sapiens
aaauuaccaaaugcuucuaaa

SEQ ID NO: 784729 - RNA, 12 nt, Homo sapiens
aaauuacuaauu

SEQ ID NO: 784730 - RNA, 15 nt, Homo sapiens
aaauuagauuuggca

SEQ ID NO: 784731 - RNA, 17 nt, Homo sapiens
aaauuagcaugcugcuu

SEQ ID NO: 784732 - RNA, 16 nt, Homo sapiens
aaauuagccauuucac

SEQ ID NO: 784733 - RNA, 23 nt, Homo sapiens
aaauuagcuugagcaaccuggcu

SEQ ID NO: 784734 - RNA, 18 nt, Homo sapiens
aaagccaaacucugccag

SEQ ID NO: 784735 - RNA, 15 nt, Homo sapiens
aaagccaaauuucca

SEQ ID NO: 784736 - RNA, 21 nt, Homo sapiens
aaagccaaccagccuuugggu

SEQ ID NO: 784737 - RNA, 16 nt, Homo sapiens
aaagccacccuaccau

SEQ ID NO: 784738 - RNA, 12 nt, Homo sapiens
aaagccacuucu

SEQ ID NO: 784739 - RNA, 19 nt, Homo sapiens
aaagccauuauuaugaugu

SEQ ID NO: 784740 - RNA, 18 nt, Homo sapiens
aaagcccagcacuugaau

SEQ ID NO: 784741 - RNA, 18 nt, Homo sapiens
aaagccccaaaugguggu

SEQ ID NO: 784742 - RNA, 17 nt, Homo sapiens
aaagcccuaauagcaga

SEQ ID NO: 784743 - RNA, 23 nt, Homo sapiens
aaagccuacccuauucuauccau

SEQ ID NO: 784744 - RNA, 12 nt, Homo sapiens
aaagccuagaca

SEQ ID NO: 784745 - RNA, 17 nt, Homo sapiens
aaagccuccucaucccg

SEQ ID NO: 784746 - RNA, 17 nt, Homo sapiens
aaagccucuucaaaaag

SEQ ID NO: 784747 - RNA, 13 nt, Homo sapiens
aaagccuuaggga

SEQ ID NO: 784748 - RNA, 17 nt, Homo sapiens
aaagccuucauugccuu

SEQ ID NO: 784749 - RNA, 22 nt, Homo sapiens
aaagccuugugugaacucacca

SEQ ID NO: 784750 - RNA, 15 nt, Homo sapiens
aaagcuaaauuccac

SEQ ID NO: 784751 - RNA, 17 nt, Homo sapiens
aaagcuaaggaccuuaa

SEQ ID NO: 784752 - RNA, 23 nt, Homo sapiens
aaagcuaaggaccuuaagacaga

SEQ ID NO: 784753 - RNA, 18 nt, Homo sapiens
aaagcuaaugugcaggga

SEQ ID NO: 784754 - RNA, 18 nt, Homo sapiens
aaagcuagauacuggaaa

SEQ ID NO: 784755 - RNA, 22 nt, Homo sapiens
aaagcuaguguaccuccucuca

SEQ ID NO: 784756 - RNA, 15 nt, Homo sapiens
aaagcucacuguagc

SEQ ID NO: 784757 - RNA, 17 nt, Homo sapiens
aaagcucuacauuugca

SEQ ID NO: 784758 - RNA, 16 nt, Homo sapiens
aaagcugaacacauuu

SEQ ID NO: 784759 - RNA, 23 nt, Homo sapiens
aaagcugagaagaaugaaaaugc

SEQ ID NO: 784760 - RNA, 11 nt, Homo sapiens
aaagcugccau

SEQ ID NO: 784761 - RNA, 15 nt, Homo sapiens
aaagcugcccacugu

SEQ ID NO: 784762 - RNA, 20 nt, Homo sapiens
aaagcuggacugaccaaaga

SEQ ID NO: 784763 - RNA, 23 nt, Homo sapiens
aaagcuuggagggaagccgugaa

SEQ ID NO: 784764 - RNA, 11 nt, Homo sapiens
aaagcuuuacu

SEQ ID NO: 784765 - RNA, 20 nt, Homo sapiens
aaagcuuuauacaguugaau

SEQ ID NO: 784766 - RNA, 18 nt, Homo sapiens
aaagcuuuggcugagacc

SEQ ID NO: 784767 - RNA, 17 nt, Homo sapiens
aaaggaaaaauaaucaa

SEQ ID NO: 784768 - RNA, 23 nt, Homo sapiens
aaaggaaaauaaaugaacauaug

SEQ ID NO: 784769 - RNA, 19 nt, Homo sapiens
aaaggaaaauaguaauguu

SEQ ID NO: 784770 - RNA, 19 nt, Homo sapiens
aaaggaaaaucacaucucc

SEQ ID NO: 784771 - RNA, 20 nt, Homo sapiens
aaaggaaaaugaaacuagaa

SEQ ID NO: 784772 - RNA, 22 nt, Homo sapiens
aaaggaaagauuugccaauuga

SEQ ID NO: 784773 - RNA, 22 nt, Homo sapiens
aaaggaaauguaaaagcacaug

SEQ ID NO: 784774 - RNA, 21 nt, Homo sapiens
aaaggaacauugguugcuuug

SEQ ID NO: 784775 - RNA, 22 nt, Homo sapiens
aaaggaacuauguucacaagaa

SEQ ID NO: 784776 - RNA, 14 nt, Homo sapiens
aaaggaagacuaga

SEQ ID NO: 784777 - RNA, 16 nt, Homo sapiens
aaaggaagacuugaag

SEQ ID NO: 784778 - RNA, 22 nt, Homo sapiens
aaaggaaggcuucugugucaau

SEQ ID NO: 784779 - RNA, 20 nt, Homo sapiens
aaaggaauaaaaaauacugu

SEQ ID NO: 784780 - RNA, 13 nt, Homo sapiens
aaaggaaucucca

SEQ ID NO: 784781 - RNA, 18 nt, Homo sapiens
aaaggacaacaguucuga

SEQ ID NO: 784782 - RNA, 16 nt, Homo sapiens
aaaggacucuccagcc

SEQ ID NO: 784783 - RNA, 18 nt, Homo sapiens
aaaggagaacuauccaaa

SEQ ID NO: 784784 - RNA, 12 nt, Homo sapiens
aaaggagggaga

SEQ ID NO: 784785 - RNA, 15 nt, Homo sapiens
aaaggauuuuaccaa

SEQ ID NO: 784786 - RNA, 18 nt, Homo sapiens
aaaggauuuuaccaaagc

SEQ ID NO: 784787 - RNA, 23 nt, Homo sapiens
aaaggcagcugccucugcucccu

SEQ ID NO: 784788 - RNA, 13 nt, Homo sapiens
aaaggcaguuuuc

SEQ ID NO: 784789 - RNA, 16 nt, Homo sapiens
aaaggccucaucuccu

SEQ ID NO: 784790 - RNA, 16 nt, Homo sapiens
aaaggcuaaaagggaa

SEQ ID NO: 784791 - RNA, 14 nt, Homo sapiens
aaaggcucccaugu

SEQ ID NO: 784792 - RNA, 14 nt, Homo sapiens
aaaggcugaaaaga

SEQ ID NO: 784793 - RNA, 16 nt, Homo sapiens
aaaggcugcugugaac

SEQ ID NO: 784794 - RNA, 21 nt, Homo sapiens
aaagggaaggugacugaaggc

SEQ ID NO: 784795 - RNA, 22 nt, Homo sapiens
aaagggaggaggugcacagcac

SEQ ID NO: 784796 - RNA, 15 nt, Homo sapiens
agugagcugauauca

SEQ ID NO: 784797 - RNA, 19 nt, Homo sapiens
agugaggaacccugaucuc

SEQ ID NO: 784798 - RNA, 18 nt, Homo sapiens
agugaggcaggagaagaa

SEQ ID NO: 784799 - RNA, 22 nt, Homo sapiens
agugagggucuucuuacaugca

SEQ ID NO: 784800 - RNA, 14 nt, Homo sapiens
agugagugaucacu

SEQ ID NO: 784801 - RNA, 22 nt, Homo sapiens
agugaguggccccaccuguguc

SEQ ID NO: 784802 - RNA, 19 nt, Homo sapiens
agugauacauguacuccag

SEQ ID NO: 784803 - RNA, 14 nt, Homo sapiens
agugauaugcauuu

SEQ ID NO: 784804 - RNA, 19 nt, Homo sapiens
agugaucaaacuacauauu

SEQ ID NO: 784805 - RNA, 21 nt, Homo sapiens
agugauccuguccuuuuaaca

SEQ ID NO: 784806 - RNA, 12 nt, Homo sapiens
agucacuggcau

SEQ ID NO: 784807 - RNA, 21 nt, Homo sapiens
agucacuggcaucucacuuua

SEQ ID NO: 784808 - RNA, 20 nt, Homo sapiens
agucacuggucuguuugcau

SEQ ID NO: 784809 - RNA, 15 nt, Homo sapiens
agucacuuccagugu

SEQ ID NO: 784810 - RNA, 15 nt, Homo sapiens
agucagaugaggcaa

SEQ ID NO: 784811 - RNA, 23 nt, Homo sapiens
agucagccaguggcuagcgcaag

SEQ ID NO: 784812 - RNA, 18 nt, Homo sapiens
agucagcucugaucacau

SEQ ID NO: 784813 - RNA, 16 nt, Homo sapiens
agucaguaauugccaa

SEQ ID NO: 784814 - RNA, 18 nt, Homo sapiens
agucagugucguuuauau

SEQ ID NO: 784815 - RNA, 15 nt, Homo sapiens
agucaguugcucaaa

SEQ ID NO: 784816 - RNA, 15 nt, Homo sapiens
agucauacugucacu

SEQ ID NO: 784817 - RNA, 21 nt, Homo sapiens
agucaucacauuucuaugcca

SEQ ID NO: 784818 - RNA, 13 nt, Homo sapiens
agucauccucaga

SEQ ID NO: 784819 - RNA, 21 nt, Homo sapiens
agucaucuguuuaauuuacac

SEQ ID NO: 784820 - RNA, 22 nt, Homo sapiens
agguuuuuuccuuucauuuuau

SEQ ID NO: 784821 - RNA, 17 nt, Homo sapiens
aguaaaaacacuaccuc

SEQ ID NO: 784822 - RNA, 16 nt, Homo sapiens
aguaaaaauacaagca

SEQ ID NO: 784823 - RNA, 18 nt, Homo sapiens
aguaaaaccacagcaguu

SEQ ID NO: 784824 - RNA, 22 nt, Homo sapiens
aguaaaagaucagguuauacuu

SEQ ID NO: 784825 - RNA, 17 nt, Homo sapiens
aguaaaaggacagagau

SEQ ID NO: 784826 - RNA, 17 nt, Homo sapiens
aguaaaagugcuuucca

SEQ ID NO: 784827 - RNA, 13 nt, Homo sapiens
aguaaaauacuau

SEQ ID NO: 784828 - RNA, 19 nt, Homo sapiens
aguaaaggccucaucuccu

SEQ ID NO: 784829 - RNA, 17 nt, Homo sapiens
aguaaauaacaggcauu

SEQ ID NO: 784830 - RNA, 15 nt, Homo sapiens
aguaaauagugucau

SEQ ID NO: 784831 - RNA, 14 nt, Homo sapiens
aguaaaugccucau

SEQ ID NO: 784832 - RNA, 14 nt, Homo sapiens
aguaaaugcgugcu

SEQ ID NO: 784833 - RNA, 23 nt, Homo sapiens
aguaacaaauaaagugcaguuua

SEQ ID NO: 784834 - RNA, 14 nt, Homo sapiens
aguaacaguuguga

SEQ ID NO: 784835 - RNA, 22 nt, Homo sapiens
aguaacccaaaucuuguuuaca

SEQ ID NO: 784836 - RNA, 13 nt, Homo sapiens
aguaaccuaguga

SEQ ID NO: 784837 - RNA, 17 nt, Homo sapiens
aguaacgcgucuuccug

SEQ ID NO: 784838 - RNA, 23 nt, Homo sapiens
aguaacugguuaaaaaacaaaug

SEQ ID NO: 784839 - RNA, 23 nt, Homo sapiens
aguaacugugagaacccaguuuc

SEQ ID NO: 784840 - RNA, 21 nt, Homo sapiens
aguaagaaccuugccugaaca

SEQ ID NO: 784841 - RNA, 15 nt, Homo sapiens
aguaagauaucucaa

SEQ ID NO: 784842 - RNA, 21 nt, Homo sapiens
aguaaguaccacucaggccaa

SEQ ID NO: 784843 - RNA, 22 nt, Homo sapiens
aguaauagagcaaaauugaugu

SEQ ID NO: 784844 - RNA, 21 nt, Homo sapiens
aguaaucuuuggcuguaaggc

SEQ ID NO: 784845 - RNA, 21 nt, Homo sapiens
aguaaugaauuuuuaugauau

SEQ ID NO: 784846 - RNA, 15 nt, Homo sapiens
aguaaugagcaugau

SEQ ID NO: 784847 - RNA, 16 nt, Homo sapiens
aguaaugauacugugu

SEQ ID NO: 784848 - RNA, 20 nt, Homo sapiens
aguaauugccuagaaauauc

SEQ ID NO: 784849 - RNA, 22 nt, Homo sapiens
aguacaaagguugcagugcuga

SEQ ID NO: 784850 - RNA, 15 nt, Homo sapiens
aguacacagauaccu

SEQ ID NO: 784851 - RNA, 14 nt, Homo sapiens
aguacagacagaag

SEQ ID NO: 784852 - RNA, 12 nt, Homo sapiens
aguacaucucua

SEQ ID NO: 784853 - RNA, 15 nt, Homo sapiens
aguacaucucuacua

SEQ ID NO: 784854 - RNA, 18 nt, Homo sapiens
aguaccuacaucagucaa

SEQ ID NO: 784855 - RNA, 21 nt, Homo sapiens
aguaccuagcuggcucuguga

SEQ ID NO: 784856 - RNA, 11 nt, Homo sapiens
aguaccugcug

SEQ ID NO: 784857 - RNA, 14 nt, Homo sapiens
aguaccuucaauac

SEQ ID NO: 784858 - RNA, 17 nt, Homo sapiens
aguacgaaccuacaguu

SEQ ID NO: 784859 - RNA, 17 nt, Homo sapiens
aguacuggcaugguacg

SEQ ID NO: 784860 - RNA, 17 nt, Homo sapiens
aguacuuaaacuuccac

SEQ ID NO: 784861 - RNA, 14 nt, Homo sapiens
aguacuuuaccuaa

SEQ ID NO: 784862 - RNA, 14 nt, Homo sapiens
aguacuuuauugca

SEQ ID NO: 784863 - RNA, 15 nt, Homo sapiens
aguacuuuauuguac

SEQ ID NO: 784864 - RNA, 15 nt, Homo sapiens
aguacuuugugcauu

SEQ ID NO: 784865 - RNA, 15 nt, Homo sapiens
aguagaaaaggaucu

SEQ ID NO: 784866 - RNA, 22 nt, Homo sapiens
aguagaagauuuuaugcugcug

SEQ ID NO: 784867 - RNA, 13 nt, Homo sapiens
aguagaagggaaa

SEQ ID NO: 784868 - RNA, 16 nt, Homo sapiens
aguagaauaagccuuc

SEQ ID NO: 784869 - RNA, 15 nt, Homo sapiens
aguagaauuaccauu

SEQ ID NO: 784870 - RNA, 19 nt, Homo sapiens
aguagagacaggauuucac

SEQ ID NO: 784871 - RNA, 16 nt, Homo sapiens
aguagagacaggguuu

SEQ ID NO: 784872 - RNA, 19 nt, Homo sapiens
aguagagacggguuucacc

SEQ ID NO: 784873 - RNA, 16 nt, Homo sapiens
aguagaggcuauggac

SEQ ID NO: 784874 - RNA, 21 nt, Homo sapiens
aguagauucuuacaaggcccu

SEQ ID NO: 784875 - RNA, 23 nt, Homo sapiens
aguagcuuaccagaagcuuccau

SEQ ID NO: 784876 - RNA, 15 nt, Homo sapiens
aguaggaggccucca

SEQ ID NO: 784877 - RNA, 13 nt, Homo sapiens
aguagguuuacau

SEQ ID NO: 784878 - RNA, 22 nt, Homo sapiens
aguagguuuacauucaucucau

SEQ ID NO: 784879 - RNA, 18 nt, Homo sapiens
aguaguaauaauagcagc

SEQ ID NO: 784880 - RNA, 16 nt, Homo sapiens
aguaguaugaugauac

SEQ ID NO: 784881 - RNA, 20 nt, Homo sapiens
aguagucauacucccuggug

SEQ ID NO: 784882 - RNA, 19 nt, Homo sapiens
aguaguugguuuccuucac

SEQ ID NO: 784883 - RNA, 22 nt, Homo sapiens
aguauaaauaaaaugagcaaaa

SEQ ID NO: 784884 - RNA, 14 nt, Homo sapiens
aguauaacaacuuu

SEQ ID NO: 784885 - RNA, 18 nt, Homo sapiens
aguauaagcaucugccau

SEQ ID NO: 784886 - RNA, 18 nt, Homo sapiens
aguauaaugcaguacauu

SEQ ID NO: 784887 - RNA, 17 nt, Homo sapiens
aguauaauguuuauuaa

SEQ ID NO: 784888 - RNA, 12 nt, Homo sapiens
aguauacugugu

SEQ ID NO: 784889 - RNA, 16 nt, Homo sapiens
aguauauuaauaucau

SEQ ID NO: 784890 - RNA, 20 nt, Homo sapiens
aguauauucuuugguuguga

SEQ ID NO: 784891 - RNA, 17 nt, Homo sapiens
aguauauugauaaccuu

SEQ ID NO: 784892 - RNA, 17 nt, Homo sapiens
aguaucacgauuugcag

SEQ ID NO: 784893 - RNA, 15 nt, Homo sapiens
aguauccaggcuuug

SEQ ID NO: 784894 - RNA, 16 nt, Homo sapiens
aguauccaggcuuugu

SEQ ID NO: 784895 - RNA, 19 nt, Homo sapiens
aguaucuaacaaaaccaau

SEQ ID NO: 784896 - RNA, 11 nt, Homo sapiens
aguaucuauau

SEQ ID NO: 784897 - RNA, 16 nt, Homo sapiens
aguaucuccaagggua

SEQ ID NO: 784898 - RNA, 17 nt, Homo sapiens
aguaucucuucagucuc

SEQ ID NO: 784899 - RNA, 18 nt, Homo sapiens
aguaucucuucagucucu

SEQ ID NO: 784900 - RNA, 21 nt, Homo sapiens
aguaucucuucagucucuaua

SEQ ID NO: 784901 - RNA, 14 nt, Homo sapiens
aguaucuugggugu

SEQ ID NO: 784902 - RNA, 15 nt, Homo sapiens
aguaugaaugcagug

SEQ ID NO: 784903 - RNA, 22 nt, Homo sapiens
aguaugcuuaaugguagcaacu

SEQ ID NO: 784904 - RNA, 23 nt, Homo sapiens
aguaugguucucagaucuugaca

SEQ ID NO: 784905 - RNA, 22 nt, Homo sapiens
aguauguauuauuuacauuuaa

SEQ ID NO: 784906 - RNA, 17 nt, Homo sapiens
aguauguuaagcucuuu

SEQ ID NO: 784907 - RNA, 16 nt, Homo sapiens
aguauuccaugagcug

SEQ ID NO: 784908 - RNA, 15 nt, Homo sapiens
aguauuguggcugca

SEQ ID NO: 784909 - RNA, 20 nt, Homo sapiens
aguauuuacauacagcuuau

SEQ ID NO: 784910 - RNA, 17 nt, Homo sapiens
aguauuuaggaaauggg

SEQ ID NO: 784911 - RNA, 12 nt, Homo sapiens
aguauuucccag

SEQ ID NO: 784912 - RNA, 17 nt, Homo sapiens
aguauuucccagcacau

SEQ ID NO: 784913 - RNA, 21 nt, Homo sapiens
aguauuuuguguccuccagga

SEQ ID NO: 784914 - RNA, 14 nt, Homo sapiens
aguauuuuugacag

SEQ ID NO: 784915 - RNA, 15 nt, Homo sapiens
agucaaaacagagau

SEQ ID NO: 784916 - RNA, 16 nt, Homo sapiens
agucaaaucugggcuc

SEQ ID NO: 784917 - RNA, 14 nt, Homo sapiens
agucaacaaacuau

SEQ ID NO: 784918 - RNA, 14 nt, Homo sapiens
agucaacaguucaa

SEQ ID NO: 784919 - RNA, 23 nt, Homo sapiens
agucaauccccucauucaggaaa

SEQ ID NO: 784920 - RNA, 15 nt, Homo sapiens
agucaauccugucau

SEQ ID NO: 784921 - RNA, 18 nt, Homo sapiens
agucaauccugucauaua

SEQ ID NO: 784922 - RNA, 16 nt, Homo sapiens
agucaauguguucuua

SEQ ID NO: 784923 - RNA, 23 nt, Homo sapiens
agucaauucuguuaaaacucaag

SEQ ID NO: 784924 - RNA, 12 nt, Homo sapiens
agucacacagug

SEQ ID NO: 784925 - RNA, 19 nt, Homo sapiens
agucacacuuuaaauuaag

SEQ ID NO: 784926 - RNA, 19 nt, Homo sapiens
agucaccaaauagugugaa

SEQ ID NO: 784927 - RNA, 23 nt, Homo sapiens
agucaccuccuccacucacucca

SEQ ID NO: 784928 - RNA, 19 nt, Homo sapiens
agucacggcugcgcacugu

SEQ ID NO: 784929 - RNA, 20 nt, Homo sapiens
agucacggcugcgcacugug

SEQ ID NO: 784930 - RNA, 22 nt, Homo sapiens
agucacggcugcgcacuguguc

SEQ ID NO: 784931 - RNA, 17 nt, Homo sapiens
agucacugacaguuaau

SEQ ID NO: 784932 - RNA, 15 nt, Homo sapiens
agucacugagcauca

SEQ ID NO: 784933 - RNA, 12 nt, Homo sapiens
agucacugccug

SEQ ID NO: 784934 - RNA, 16 nt, Homo sapiens
agucacugcucuucag

SEQ ID NO: 784935 - RNA, 15 nt, Homo sapiens
aggcccgcucuacau

SEQ ID NO: 784936 - RNA, 13 nt, Homo sapiens
aggcccucaguga

SEQ ID NO: 784937 - RNA, 16 nt, Homo sapiens
aggcccuggaggucuc

SEQ ID NO: 784938 - RNA, 16 nt, Homo sapiens
aggcccuggggagcuu

SEQ ID NO: 784939 - RNA, 22 nt, Homo sapiens
aggcccuuccucuccacugccu

SEQ ID NO: 784940 - RNA, 23 nt, Homo sapiens
aggccuagacucugucuaccugg

SEQ ID NO: 784941 - RNA, 16 nt, Homo sapiens
aggccuaggauucuaa

SEQ ID NO: 784942 - RNA, 22 nt, Homo sapiens
aggccuauaaccccagcucccu

SEQ ID NO: 784943 - RNA, 15 nt, Homo sapiens
aggccucaagaacaa

SEQ ID NO: 784944 - RNA, 22 nt, Homo sapiens
aggccucaagaacaaacacugc

SEQ ID NO: 784945 - RNA, 17 nt, Homo sapiens
aggccucgccccaacac

SEQ ID NO: 784946 - RNA, 23 nt, Homo sapiens
aggccucucggugcuccaucucc

SEQ ID NO: 784947 - RNA, 13 nt, Homo sapiens
aggccucugagaa

SEQ ID NO: 784948 - RNA, 10 nt, Homo sapiens
aggccugaag

SEQ ID NO: 784949 - RNA, 12 nt, Homo sapiens
aggccugagauu

SEQ ID NO: 784950 - RNA, 16 nt, Homo sapiens
aggccugagauuucau

SEQ ID NO: 784951 - RNA, 17 nt, Homo sapiens
aggccugcugccagugc

SEQ ID NO: 784952 - RNA, 21 nt, Homo sapiens
aggccugggccgcugccacgu

SEQ ID NO: 784953 - RNA, 15 nt, Homo sapiens
aggccuguacagaug

SEQ ID NO: 784954 - RNA, 20 nt, Homo sapiens
aggccugucccuugccucug

SEQ ID NO: 784955 - RNA, 17 nt, Homo sapiens
aggccuuaacacacugg

SEQ ID NO: 784956 - RNA, 18 nt, Homo sapiens
aggccuuaacacacuggc

SEQ ID NO: 784957 - RNA, 23 nt, Homo sapiens
aggccuucaguuuauuuccacua

SEQ ID NO: 784958 - RNA, 19 nt, Homo sapiens
aggcgauccaccugucuca

SEQ ID NO: 784959 - RNA, 18 nt, Homo sapiens
aggcgauggggcaagaca

SEQ ID NO: 784960 - RNA, 21 nt, Homo sapiens
aggcgccccuucccccuccaa

SEQ ID NO: 784961 - RNA, 23 nt, Homo sapiens
aggcgcccuuggcuucugugaug

SEQ ID NO: 784962 - RNA, 16 nt, Homo sapiens
aggcgccugccaucau

SEQ ID NO: 784963 - RNA, 20 nt, Homo sapiens
aggcgccugccaucaugccu

SEQ ID NO: 784964 - RNA, 16 nt, Homo sapiens
aggcggaagaaucacu

SEQ ID NO: 784965 - RNA, 17 nt, Homo sapiens
aggcgggagcaucucuu

SEQ ID NO: 784966 - RNA, 20 nt, Homo sapiens
aggcgggagcaucucuugag

SEQ ID NO: 784967 - RNA, 18 nt, Homo sapiens
aggcggguggaucaccug

SEQ ID NO: 784968 - RNA, 21 nt, Homo sapiens
aggcgugccccccuccuccag

SEQ ID NO: 784969 - RNA, 23 nt, Homo sapiens
aggcguuuguuauauaaaaauac

SEQ ID NO: 784970 - RNA, 13 nt, Homo sapiens
aggcuaaaugcac

SEQ ID NO: 784971 - RNA, 18 nt, Homo sapiens
aggcuauacuugucuugu

SEQ ID NO: 784972 - RNA, 20 nt, Homo sapiens
aggcuauguaaacaaaccac

SEQ ID NO: 784973 - RNA, 18 nt, Homo sapiens
aggcucacacugugcuca

SEQ ID NO: 784974 - RNA, 16 nt, Homo sapiens
aggcucugaaauggaa

SEQ ID NO: 784975 - RNA, 16 nt, Homo sapiens
aggcucugcuucucca

SEQ ID NO: 784976 - RNA, 13 nt, Homo sapiens
aggcucugugccu

SEQ ID NO: 784977 - RNA, 15 nt, Homo sapiens
aggcucuuccuugaa

SEQ ID NO: 784978 - RNA, 19 nt, Homo sapiens
aggcucuuccuugaaucuu

SEQ ID NO: 784979 - RNA, 15 nt, Homo sapiens
aggcugaacuggauu

SEQ ID NO: 784980 - RNA, 20 nt, Homo sapiens
aggcugacaugcucacacau

SEQ ID NO: 784981 - RNA, 16 nt, Homo sapiens
aggcugaccaagagag

SEQ ID NO: 784982 - RNA, 14 nt, Homo sapiens
aggcugagaaggaa

SEQ ID NO: 784983 - RNA, 17 nt, Homo sapiens
aggcugagacaggagaa

SEQ ID NO: 784984 - RNA, 19 nt, Homo sapiens
aggcugagugagccacaga

SEQ ID NO: 784985 - RNA, 15 nt, Homo sapiens
aggcugcaccaggag

SEQ ID NO: 784986 - RNA, 13 nt, Homo sapiens
aggcugcaccuac

SEQ ID NO: 784987 - RNA, 14 nt, Homo sapiens
aggcugcaccuacu

SEQ ID NO: 784988 - RNA, 15 nt, Homo sapiens
aggcugcacugcagu

SEQ ID NO: 784989 - RNA, 12 nt, Homo sapiens
aggcugcagauu

SEQ ID NO: 784990 - RNA, 22 nt, Homo sapiens
aggcugccccaggccggagccc

SEQ ID NO: 784991 - RNA, 17 nt, Homo sapiens
aggcugcuagauguagg

SEQ ID NO: 784992 - RNA, 19 nt, Homo sapiens
aggcuggagugcaaugcac

SEQ ID NO: 784993 - RNA, 15 nt, Homo sapiens
aggcuggagugcagu

SEQ ID NO: 784994 - RNA, 17 nt, Homo sapiens
aggcuggagugcagugg

SEQ ID NO: 784995 - RNA, 20 nt, Homo sapiens
aggcuggagugcaguggcau

SEQ ID NO: 784996 - RNA, 15 nt, Homo sapiens
aggcugggaggaaca

SEQ ID NO: 784997 - RNA, 21 nt, Homo sapiens
aggcugggccauguccaaaga

SEQ ID NO: 784998 - RNA, 17 nt, Homo sapiens
aggcuguaauuccauca

SEQ ID NO: 784999 - RNA, 15 nt, Homo sapiens
aggcugucacagucc

SEQ ID NO: 785000 - RNA, 19 nt, Homo sapiens
aggcugugcaccuauucug

SEQ ID NO: 785001 - RNA, 17 nt, Homo sapiens
aggcuguuguuggcuua

SEQ ID NO: 785002 - RNA, 14 nt, Homo sapiens
aggcuuaccaaagu

SEQ ID NO: 785003 - RNA, 17 nt, Homo sapiens
aggcuucaucaccaaga

SEQ ID NO: 785004 - RNA, 19 nt, Homo sapiens
aggcuucuacagacuguag

SEQ ID NO: 785005 - RNA, 12 nt, Homo sapiens
aggcuucuucag

SEQ ID NO: 785006 - RNA, 19 nt, Homo sapiens
aggcuuguuuaccuuucuc

SEQ ID NO: 785007 - RNA, 20 nt, Homo sapiens
aggcuuuguacagagugcuu

SEQ ID NO: 785008 - RNA, 20 nt, Homo sapiens
aggcuuuuaagaaacacagg

SEQ ID NO: 785009 - RNA, 12 nt, Homo sapiens
agggaaaacugc

SEQ ID NO: 785010 - RNA, 22 nt, Homo sapiens
agggaaaaggaguagggaguuc

SEQ ID NO: 785011 - RNA, 13 nt, Homo sapiens
agggaaagccucu

SEQ ID NO: 785012 - RNA, 23 nt, Homo sapiens
agggaaaguuaaaaguguugauu

SEQ ID NO: 785013 - RNA, 22 nt, Homo sapiens
agggaaauuguuuauguguuau

SEQ ID NO: 785014 - RNA, 19 nt, Homo sapiens
agggaaccgugauaagccu

SEQ ID NO: 785015 - RNA, 15 nt, Homo sapiens
agggaaccugugucc

SEQ ID NO: 785016 - RNA, 18 nt, Homo sapiens
agggaacuagagguguua

SEQ ID NO: 785017 - RNA, 21 nt, Homo sapiens
agggaacucuccccauuggca

SEQ ID NO: 785018 - RNA, 18 nt, Homo sapiens
agggaacugaaucacuua

SEQ ID NO: 785019 - RNA, 19 nt, Homo sapiens
agggaagauggagacaccc

SEQ ID NO: 785020 - RNA, 21 nt, Homo sapiens
agggaagauggagacacccuc

SEQ ID NO: 785021 - RNA, 15 nt, Homo sapiens
agggaagcucagggg

SEQ ID NO: 785022 - RNA, 19 nt, Homo sapiens
agggaagcuccuccaguga

SEQ ID NO: 785023 - RNA, 19 nt, Homo sapiens
agggaagcuggccgagggu

SEQ ID NO: 785024 - RNA, 22 nt, Homo sapiens
agggaagcugucccucacuguu

SEQ ID NO: 785025 - RNA, 17 nt, Homo sapiens
agggaaggaugacaaaa

SEQ ID NO: 785026 - RNA, 23 nt, Homo sapiens
agggaaggcuguuugagaaccau

SEQ ID NO: 785027 - RNA, 13 nt, Homo sapiens
agggaagggagca

SEQ ID NO: 785028 - RNA, 22 nt, Homo sapiens
agggaaguggggaguauuugaa

SEQ ID NO: 785029 - RNA, 13 nt, Homo sapiens
agggaaugcauua

SEQ ID NO: 785030 - RNA, 19 nt, Homo sapiens
agggacaaaacacuguguc

SEQ ID NO: 785031 - RNA, 18 nt, Homo sapiens
aucaguccauugcucuug

SEQ ID NO: 785032 - RNA, 10 nt, Homo sapiens
aucagucuuu

SEQ ID NO: 785033 - RNA, 15 nt, Homo sapiens
auaguuacuguguaa

SEQ ID NO: 785034 - RNA, 17 nt, Homo sapiens
auaguucuaaacuauca

SEQ ID NO: 785035 - RNA, 18 nt, Homo sapiens
auaguucuaucaggaaaa

SEQ ID NO: 785036 - RNA, 14 nt, Homo sapiens
auaguucugugacu

SEQ ID NO: 785037 - RNA, 18 nt, Homo sapiens
cauuuguucucacaccaa

SEQ ID NO: 785038 - RNA, 21 nt, Homo sapiens
cauuuguucucacaccaacag

SEQ ID NO: 785039 - RNA, 19 nt, Homo sapiens
cauuuuaauuuuaaccaaa

SEQ ID NO: 785040 - RNA, 16 nt, Homo sapiens
cauuuuacauagcaca

SEQ ID NO: 785041 - RNA, 22 nt, Homo sapiens
cauuuuauacccaaaacccuga

SEQ ID NO: 785042 - RNA, 22 nt, Homo sapiens
cauuuuaucccauggaaccacu

SEQ ID NO: 785043 - RNA, 18 nt, Homo sapiens
cauuuuaugauagauuug

SEQ ID NO: 785044 - RNA, 14 nt, Homo sapiens
cauuuuaugcagaa

SEQ ID NO: 785045 - RNA, 17 nt, Homo sapiens
cauuuuaugucauuaaa

SEQ ID NO: 785046 - RNA, 17 nt, Homo sapiens
cauuuuauuaagcuuuu

SEQ ID NO: 785047 - RNA, 16 nt, Homo sapiens
cauuuuauucuuuaag

SEQ ID NO: 785048 - RNA, 12 nt, Homo sapiens
cauuuucaauga

SEQ ID NO: 785049 - RNA, 14 nt, Homo sapiens
cauuuucaccccac

SEQ ID NO: 785050 - RNA, 14 nt, Homo sapiens
cauuuucauuacca

SEQ ID NO: 785051 - RNA, 22 nt, Homo sapiens
cauuuuccugugcccuguggua

SEQ ID NO: 785052 - RNA, 18 nt, Homo sapiens
cauuuuccuguucaguga

SEQ ID NO: 785053 - RNA, 15 nt, Homo sapiens
cauuuucuuucaugg

SEQ ID NO: 785054 - RNA, 22 nt, Homo sapiens
cauuuugagcugaaaugcugca

SEQ ID NO: 785055 - RNA, 13 nt, Homo sapiens
cauuuugcaaaau

SEQ ID NO: 785056 - RNA, 10 nt, Homo sapiens
cauuuugcca

SEQ ID NO: 785057 - RNA, 11 nt, Homo sapiens
cauuuugccaa

SEQ ID NO: 785058 - RNA, 21 nt, Homo sapiens
cauuuuguugcuuuugugaac

SEQ ID NO: 785059 - RNA, 15 nt, Homo sapiens
cauuuuuaacagcau

SEQ ID NO: 785060 - RNA, 21 nt, Homo sapiens
cauuuuuaagauagaacacaa

SEQ ID NO: 785061 - RNA, 16 nt, Homo sapiens
cauuuuuaauguaucu

SEQ ID NO: 785062 - RNA, 17 nt, Homo sapiens
cauuuuuuaaaaaagca

SEQ ID NO: 785063 - RNA, 17 nt, Homo sapiens
ccaaaaauaugguugau

SEQ ID NO: 785064 - RNA, 24 nt, Homo sapiens
ccaaaacuuuaaugaacuaacuga

SEQ ID NO: 785065 - RNA, 22 nt, Homo sapiens
ccaaaagggccauguuucaaga

SEQ ID NO: 785066 - RNA, 14 nt, Homo sapiens
ccaaaaguuauuaa

SEQ ID NO: 785067 - RNA, 18 nt, Homo sapiens
ccaaaauaaaaccagcuc

SEQ ID NO: 785068 - RNA, 13 nt, Homo sapiens
ccaaaauccgacu

SEQ ID NO: 785069 - RNA, 18 nt, Homo sapiens
ccaaaaucggaucugggg

SEQ ID NO: 785070 - RNA, 12 nt, Homo sapiens
ccaaaaucucaa

SEQ ID NO: 785071 - RNA, 23 nt, Homo sapiens
ccaaaauggucucuaacauuucc

SEQ ID NO: 785072 - RNA, 13 nt, Homo sapiens
ccaaaauguuaau

SEQ ID NO: 785073 - RNA, 14 nt, Homo sapiens
ccaaacaccaguca

SEQ ID NO: 785074 - RNA, 18 nt, Homo sapiens
ccaaacucauaacagucu

SEQ ID NO: 785075 - RNA, 19 nt, Homo sapiens
ccaaacugauccaguauaa

SEQ ID NO: 785076 - RNA, 14 nt, Homo sapiens
ccaaacugccucaa

SEQ ID NO: 785077 - RNA, 15 nt, Homo sapiens
ccaaacugucuuugu

SEQ ID NO: 785078 - RNA, 19 nt, Homo sapiens
ccaaacuuuagcaacaguu

SEQ ID NO: 785079 - RNA, 19 nt, Homo sapiens
ccaaagaaauguaagggaa

SEQ ID NO: 785080 - RNA, 17 nt, Homo sapiens
ccaaagaaugaauuuca

SEQ ID NO: 785081 - RNA, 19 nt, Homo sapiens
ccaaagaauuguaggcagu

SEQ ID NO: 785082 - RNA, 21 nt, Homo sapiens
ccaaagacagucuucuaauuc

SEQ ID NO: 785083 - RNA, 19 nt, Homo sapiens
ccaaagacgaccagcauuu

SEQ ID NO: 785084 - RNA, 21 nt, Homo sapiens
ccaaagagaagggcacuguaa

SEQ ID NO: 785085 - RNA, 19 nt, Homo sapiens
ccaaagagggcuuccucua

SEQ ID NO: 785086 - RNA, 16 nt, Homo sapiens
ccaaagaguguggugu

SEQ ID NO: 785087 - RNA, 13 nt, Homo sapiens
ccaaagcaucaau

SEQ ID NO: 785088 - RNA, 22 nt, Homo sapiens
ccaaagcauggacuaaccccaa

SEQ ID NO: 785089 - RNA, 13 nt, Homo sapiens
ccaaagcauugcc

SEQ ID NO: 785090 - RNA, 23 nt, Homo sapiens
ccaaaggauagugcgauguuuca

SEQ ID NO: 785091 - RNA, 10 nt, Homo sapiens
ccaaagggac

SEQ ID NO: 785092 - RNA, 10 nt, Homo sapiens
ccaaaggggc

SEQ ID NO: 785093 - RNA, 14 nt, Homo sapiens
ccaaaguaaauguc

SEQ ID NO: 785094 - RNA, 18 nt, Homo sapiens
ccaaaguaacugaauuau

SEQ ID NO: 785095 - RNA, 16 nt, Homo sapiens
ccaaaguacagaauuu

SEQ ID NO: 785096 - RNA, 17 nt, Homo sapiens
ccaaaguccucugcucc

SEQ ID NO: 785097 - RNA, 18 nt, Homo sapiens
ccaaaguccucugcucca

SEQ ID NO: 785098 - RNA, 19 nt, Homo sapiens
ccaaaguucccacuccuuc

SEQ ID NO: 785099 - RNA, 16 nt, Homo sapiens
ccaaauaaaguaccau

SEQ ID NO: 785100 - RNA, 14 nt, Homo sapiens
ccaaauaguuauuu

SEQ ID NO: 785101 - RNA, 15 nt, Homo sapiens
ccaaauaugagaugc

SEQ ID NO: 785102 - RNA, 22 nt, Homo sapiens
ccaaaucuuguuuacaaaauau

SEQ ID NO: 785103 - RNA, 18 nt, Homo sapiens
ccaaaugaugccacuucc

SEQ ID NO: 785104 - RNA, 15 nt, Homo sapiens
ccaaaugcuucuaaa

SEQ ID NO: 785105 - RNA, 16 nt, Homo sapiens
ccaaauggcagggaua

SEQ ID NO: 785106 - RNA, 12 nt, Homo sapiens
ccaaauguucau

SEQ ID NO: 785107 - RNA, 17 nt, Homo sapiens
ccaacaaaaagaacaaa

SEQ ID NO: 785108 - RNA, 13 nt, Homo sapiens
ccaacaccacaga

SEQ ID NO: 785109 - RNA, 15 nt, Homo sapiens
ccaacacccugucua

SEQ ID NO: 785110 - RNA, 21 nt, Homo sapiens
ccaacacugucacuagucuca

SEQ ID NO: 785111 - RNA, 13 nt, Homo sapiens
ccaacacuuugag

SEQ ID NO: 785112 - RNA, 14 nt, Homo sapiens
ccaacagauuuuau

SEQ ID NO: 785113 - RNA, 13 nt, Homo sapiens
ccaacagcacuuu

SEQ ID NO: 785114 - RNA, 18 nt, Homo sapiens
ccaacagcagugaucuca

SEQ ID NO: 785115 - RNA, 23 nt, Homo sapiens
ccaacaggcuguucugcacugaa

SEQ ID NO: 785116 - RNA, 20 nt, Homo sapiens
ccaacaucaacaucuugguc

SEQ ID NO: 785117 - RNA, 11 nt, Homo sapiens
ccaacaucuuu

SEQ ID NO: 785118 - RNA, 15 nt, Homo sapiens
ccaacaugcacugau

SEQ ID NO: 785119 - RNA, 13 nt, Homo sapiens
ccaacauggugaa

SEQ ID NO: 785120 - RNA, 14 nt, Homo sapiens
ccaacccacuggcc

SEQ ID NO: 785121 - RNA, 22 nt, Homo sapiens
caggugauccacccaccuuggc

SEQ ID NO: 785122 - RNA, 14 nt, Homo sapiens
caggugcauagcaa

SEQ ID NO: 785123 - RNA, 20 nt, Homo sapiens
caggugccaugccugcuccc

SEQ ID NO: 785124 - RNA, 17 nt, Homo sapiens
caggugcgguuccucau

SEQ ID NO: 785125 - RNA, 15 nt, Homo sapiens
caggugcuuguucug

SEQ ID NO: 785126 - RNA, 16 nt, Homo sapiens
cagguggaauguguau

SEQ ID NO: 785127 - RNA, 16 nt, Homo sapiens
cagguggagggcacag

SEQ ID NO: 785128 - RNA, 22 nt, Homo sapiens
cagguggccccaguucaaucuc

SEQ ID NO: 785129 - RNA, 15 nt, Homo sapiens
cagguggccuagcag

SEQ ID NO: 785130 - RNA, 19 nt, Homo sapiens
caggugggcucgcuaggcg

SEQ ID NO: 785131 - RNA, 13 nt, Homo sapiens
caggugggcugua

SEQ ID NO: 785132 - RNA, 15 nt, Homo sapiens
caggugguggcacug

SEQ ID NO: 785133 - RNA, 17 nt, Homo sapiens
caggugguggcacugag

SEQ ID NO: 785134 - RNA, 13 nt, Homo sapiens
caggugguugugg

SEQ ID NO: 785135 - RNA, 15 nt, Homo sapiens
cagguguguauuuac

SEQ ID NO: 785136 - RNA, 19 nt, Homo sapiens
caggugugugccaccacac

SEQ ID NO: 785137 - RNA, 20 nt, Homo sapiens
cagguuaacuuagcuacuuu

SEQ ID NO: 785138 - RNA, 15 nt, Homo sapiens
cagguuaaugcugaa

SEQ ID NO: 785139 - RNA, 17 nt, Homo sapiens
cagguuauaacaguguu

SEQ ID NO: 785140 - RNA, 20 nt, Homo sapiens
cagguuccuuaucugucaca

SEQ ID NO: 785141 - RNA, 21 nt, Homo sapiens
cagguuccuuaucugucacac

SEQ ID NO: 785142 - RNA, 15 nt, Homo sapiens
cagguucucaccuca

SEQ ID NO: 785143 - RNA, 12 nt, Homo sapiens
cagguucuuagg

SEQ ID NO: 785144 - RNA, 15 nt, Homo sapiens
cagguugcagcugcu

SEQ ID NO: 785145 - RNA, 16 nt, Homo sapiens
cagguuggagugcagu

SEQ ID NO: 785146 - RNA, 12 nt, Homo sapiens
cagguuugccag

SEQ ID NO: 785147 - RNA, 19 nt, Homo sapiens
cagguuuugaaaauguaca

SEQ ID NO: 785148 - RNA, 16 nt, Homo sapiens
caguaaaaacuuguac

SEQ ID NO: 785149 - RNA, 15 nt, Homo sapiens
caguaaaaauggaaa

SEQ ID NO: 785150 - RNA, 22 nt, Homo sapiens
caguaaaaauggaaacuauauu

SEQ ID NO: 785151 - RNA, 12 nt, Homo sapiens
caguaaaccuua

SEQ ID NO: 785152 - RNA, 15 nt, Homo sapiens
caguaaaccuuaaca

SEQ ID NO: 785153 - RNA, 20 nt, Homo sapiens
caguaaacgggaacaugccc

SEQ ID NO: 785154 - RNA, 21 nt, Homo sapiens
caguaaacuuuggcuuauaaa

SEQ ID NO: 785155 - RNA, 18 nt, Homo sapiens
caguaaaggcugcugcua

SEQ ID NO: 785156 - RNA, 14 nt, Homo sapiens
caguaaauguacaa

SEQ ID NO: 785157 - RNA, 19 nt, Homo sapiens
caguaaauguacaacugca

SEQ ID NO: 785158 - RNA, 20 nt, Homo sapiens
caguaaaugugauucaccuc

SEQ ID NO: 785159 - RNA, 21 nt, Homo sapiens
caguaacauuucuguucucau

SEQ ID NO: 785160 - RNA, 21 nt, Homo sapiens
caguaacauuuuucucagugc

SEQ ID NO: 785161 - RNA, 17 nt, Homo sapiens
caguaacuaaagcuuua

SEQ ID NO: 785162 - RNA, 12 nt, Homo sapiens
caguaacugaca

SEQ ID NO: 785163 - RNA, 17 nt, Homo sapiens
caguaacugcaccaacg

SEQ ID NO: 785164 - RNA, 17 nt, Homo sapiens
caguaacugugacugau

SEQ ID NO: 785165 - RNA, 14 nt, Homo sapiens
caguaacuuuaugu

SEQ ID NO: 785166 - RNA, 18 nt, Homo sapiens
caguaaucccauuuccca

SEQ ID NO: 785167 - RNA, 14 nt, Homo sapiens
caguaauggaauga

SEQ ID NO: 785168 - RNA, 15 nt, Homo sapiens
caguaauggaaugaa

SEQ ID NO: 785169 - RNA, 16 nt, Homo sapiens
caguacacucuggcca

SEQ ID NO: 785170 - RNA, 21 nt, Homo sapiens
caguaccaaaguaacugaauu

SEQ ID NO: 785171 - RNA, 16 nt, Homo sapiens
caguacuugugaaaca

SEQ ID NO: 785172 - RNA, 16 nt, Homo sapiens
caguacuuguuucuau

SEQ ID NO: 785173 - RNA, 19 nt, Homo sapiens
caguagccaaggcccgggg

SEQ ID NO: 785174 - RNA, 20 nt, Homo sapiens
caguagggaggucagugcuu

SEQ ID NO: 785175 - RNA, 18 nt, Homo sapiens
caguaguauaugguguuc

SEQ ID NO: 785176 - RNA, 13 nt, Homo sapiens
caguagucauuuu

SEQ ID NO: 785177 - RNA, 22 nt, Homo sapiens
caguagucccugcacagugacu

SEQ ID NO: 785178 - RNA, 17 nt, Homo sapiens
caguaguuuaguacaau

SEQ ID NO: 785179 - RNA, 13 nt, Homo sapiens
caguauacugugu

SEQ ID NO: 785180 - RNA, 18 nt, Homo sapiens
caguaucaguauuuacau

SEQ ID NO: 785181 - RNA, 20 nt, Homo sapiens
caguauccaggcuuuguaca

SEQ ID NO: 785182 - RNA, 17 nt, Homo sapiens
caguaucccacauccaa

SEQ ID NO: 785183 - RNA, 21 nt, Homo sapiens
caguaucuauauauguguaug

SEQ ID NO: 785184 - RNA, 18 nt, Homo sapiens
caguauguugccaagagc

SEQ ID NO: 785185 - RNA, 18 nt, Homo sapiens
caguauucugacauguaa

SEQ ID NO: 785186 - RNA, 16 nt, Homo sapiens
cagucaacaguucaaa

SEQ ID NO: 785187 - RNA, 19 nt, Homo sapiens
cagucaccgacaacaugcu

SEQ ID NO: 785188 - RNA, 20 nt, Homo sapiens
cagucagcccuuauggccaa

SEQ ID NO: 785189 - RNA, 18 nt, Homo sapiens
cagucaggcccaggcacu

SEQ ID NO: 785190 - RNA, 11 nt, Homo sapiens
cagucaucucc

SEQ ID NO: 785191 - RNA, 15 nt, Homo sapiens
caguccaugcuccag

SEQ ID NO: 785192 - RNA, 17 nt, Homo sapiens
cagucccagacaauucc

SEQ ID NO: 785193 - RNA, 22 nt, Homo sapiens
cagucccuggagcuguccuuca

SEQ ID NO: 785194 - RNA, 22 nt, Homo sapiens
caguccuagcucuuacacauag

SEQ ID NO: 785195 - RNA, 19 nt, Homo sapiens
caguccuauuuuucaaugg

SEQ ID NO: 785196 - RNA, 19 nt, Homo sapiens
caguccugccucagccucc

SEQ ID NO: 785197 - RNA, 18 nt, Homo sapiens
cagucuaguguaauggau

SEQ ID NO: 785198 - RNA, 19 nt, Homo sapiens
cagucugcuucagugcagu

SEQ ID NO: 785199 - RNA, 15 nt, Homo sapiens
cagucugucuacugu

SEQ ID NO: 785200 - RNA, 19 nt, Homo sapiens
cagucugucuacuguggug

SEQ ID NO: 785201 - RNA, 14 nt, Homo sapiens
cagucuugccuagg

SEQ ID NO: 785202 - RNA, 19 nt, Homo sapiens
cagucuuggcucacugcaa

SEQ ID NO: 785203 - RNA, 23 nt, Homo sapiens
cagugaaggcuaagaaccuggug

SEQ ID NO: 785204 - RNA, 20 nt, Homo sapiens
cagugaaguaaaauugagug

SEQ ID NO: 785205 - RNA, 22 nt, Homo sapiens
cagugaagugccuuuuuccuag

SEQ ID NO: 785206 - RNA, 14 nt, Homo sapiens
cagugacaaacaua

SEQ ID NO: 785207 - RNA, 19 nt, Homo sapiens
cagugacaacaucgcaaua

SEQ ID NO: 785208 - RNA, 22 nt, Homo sapiens
auuuaguugcaguccagcucuu

SEQ ID NO: 785209 - RNA, 19 nt, Homo sapiens
auuuauaacagcauucuug

SEQ ID NO: 785210 - RNA, 14 nt, Homo sapiens
auuuauaccucagu

SEQ ID NO: 785211 - RNA, 21 nt, Homo sapiens
auuuauacuuugcaauccaaa

SEQ ID NO: 785212 - RNA, 22 nt, Homo sapiens
auuuauacuuugcaauccaaau

SEQ ID NO: 785213 - RNA, 19 nt, Homo sapiens
auuuaugagaaaguucuca

SEQ ID NO: 785214 - RNA, 23 nt, Homo sapiens
auuuaugaguuuuugauagcuuu

SEQ ID NO: 785215 - RNA, 23 nt, Homo sapiens
auuuaugcugcucauccaaaguu

SEQ ID NO: 785216 - RNA, 17 nt, Homo sapiens
cacugcccgaaaagcau

SEQ ID NO: 785217 - RNA, 14 nt, Homo sapiens
cacugcucaagaag

SEQ ID NO: 785218 - RNA, 19 nt, Homo sapiens
cacuggaaggagcacauac

SEQ ID NO: 785219 - RNA, 17 nt, Homo sapiens
cacuggagcugcacugc

SEQ ID NO: 785220 - RNA, 19 nt, Homo sapiens
cacuggagcugcacugcau

SEQ ID NO: 785221 - RNA, 23 nt, Homo sapiens
cacuggauccaucuugagccaca

SEQ ID NO: 785222 - RNA, 22 nt, Homo sapiens
cacuggcagccugcaccuggug

SEQ ID NO: 785223 - RNA, 17 nt, Homo sapiens
cacuggccaccaggcug

SEQ ID NO: 785224 - RNA, 22 nt, Homo sapiens
cacuggggaagagaaaagccca

SEQ ID NO: 785225 - RNA, 18 nt, Homo sapiens
cacuggggugggggugga

SEQ ID NO: 785226 - RNA, 16 nt, Homo sapiens
cacugguauuaacuuu

SEQ ID NO: 785227 - RNA, 19 nt, Homo sapiens
cacugguauuaacuuuaua

SEQ ID NO: 785228 - RNA, 13 nt, Homo sapiens
cacuggugccaug

SEQ ID NO: 785229 - RNA, 22 nt, Homo sapiens
cacuggugggccauuagauuug

SEQ ID NO: 785230 - RNA, 23 nt, Homo sapiens
cacuguaaauaugaaucugcuca

SEQ ID NO: 785231 - RNA, 20 nt, Homo sapiens
cacuguacaagguaccccuu

SEQ ID NO: 785232 - RNA, 18 nt, Homo sapiens
cacuguaccgacuuugau

SEQ ID NO: 785233 - RNA, 13 nt, Homo sapiens
cacuguacugcau

SEQ ID NO: 785234 - RNA, 23 nt, Homo sapiens
cacuguacuuguagaguggugcu

SEQ ID NO: 785235 - RNA, 14 nt, Homo sapiens
cacuguaguucuaa

SEQ ID NO: 785236 - RNA, 17 nt, Homo sapiens
cacuguaguucuaagac

SEQ ID NO: 785237 - RNA, 19 nt, Homo sapiens
cacuguaugccucugagca

SEQ ID NO: 785238 - RNA, 15 nt, Homo sapiens
cacuguauguuuacu

SEQ ID NO: 785239 - RNA, 16 nt, Homo sapiens
cacuguauuccuguca

SEQ ID NO: 785240 - RNA, 22 nt, Homo sapiens
cacugucaccacccugcucauc

SEQ ID NO: 785241 - RNA, 19 nt, Homo sapiens
cacugucccccguuugccu

SEQ ID NO: 785242 - RNA, 18 nt, Homo sapiens
cacugucccuugccucaa

SEQ ID NO: 785243 - RNA, 19 nt, Homo sapiens
cacugucuccuuucucuua

SEQ ID NO: 785244 - RNA, 19 nt, Homo sapiens
cacugucuugccagauuac

SEQ ID NO: 785245 - RNA, 22 nt, Homo sapiens
cacugugaaggguacagauuag

SEQ ID NO: 785246 - RNA, 15 nt, Homo sapiens
cacugugagcaccug

SEQ ID NO: 785247 - RNA, 17 nt, Homo sapiens
cacugugcucagauucc

SEQ ID NO: 785248 - RNA, 15 nt, Homo sapiens
cacuguguuacugcu

SEQ ID NO: 785249 - RNA, 23 nt, Homo sapiens
cacuguuacuuucguacauuggc

SEQ ID NO: 785250 - RNA, 18 nt, Homo sapiens
cacuguuuuaucucugug

SEQ ID NO: 785251 - RNA, 22 nt, Homo sapiens
cacuguuuuuuucccagguguu

SEQ ID NO: 785252 - RNA, 22 nt, Homo sapiens
cacuuaaacuugcaucacuuaa

SEQ ID NO: 785253 - RNA, 20 nt, Homo sapiens
cacuuaacuccuuuuccacu

SEQ ID NO: 785254 - RNA, 18 nt, Homo sapiens
cacuuacacuuuaugcac

SEQ ID NO: 785255 - RNA, 15 nt, Homo sapiens
cacuuacagaauuau

SEQ ID NO: 785256 - RNA, 20 nt, Homo sapiens
cacuuacagcucuggccaca

SEQ ID NO: 785257 - RNA, 17 nt, Homo sapiens
cacuuaguagagugauu

SEQ ID NO: 785258 - RNA, 18 nt, Homo sapiens
cacuuagucuguacuuca

SEQ ID NO: 785259 - RNA, 17 nt, Homo sapiens
cacuuaucccaagagaa

SEQ ID NO: 785260 - RNA, 14 nt, Homo sapiens
cacuuaugauuuca

SEQ ID NO: 785261 - RNA, 18 nt, Homo sapiens
cacuuauguuauacaaua

SEQ ID NO: 785262 - RNA, 23 nt, Homo sapiens
cacuucagcugggucacauccau

SEQ ID NO: 785263 - RNA, 16 nt, Homo sapiens
cacuucauggaccaag

SEQ ID NO: 785264 - RNA, 15 nt, Homo sapiens
cacuuccagcauuua

SEQ ID NO: 785265 - RNA, 12 nt, Homo sapiens
cacuuccagggg

SEQ ID NO: 785266 - RNA, 12 nt, Homo sapiens
cacuuccagugu

SEQ ID NO: 785267 - RNA, 14 nt, Homo sapiens
cacuuccaugagaa

SEQ ID NO: 785268 - RNA, 18 nt, Homo sapiens
cacuucccguuuccucuu

SEQ ID NO: 785269 - RNA, 16 nt, Homo sapiens
cacuucccuacaugga

SEQ ID NO: 785270 - RNA, 13 nt, Homo sapiens
cacuuccuugccc

SEQ ID NO: 785271 - RNA, 22 nt, Homo sapiens
cacuuccuugcccccauuucac

SEQ ID NO: 785272 - RNA, 16 nt, Homo sapiens
cacuucuaaaugcaua

SEQ ID NO: 785273 - RNA, 19 nt, Homo sapiens
cacuucuaagaaaagccua

SEQ ID NO: 785274 - RNA, 21 nt, Homo sapiens
cacuucuaauaacugcagugu

SEQ ID NO: 785275 - RNA, 13 nt, Homo sapiens
cacuucuaugcaa

SEQ ID NO: 785276 - RNA, 17 nt, Homo sapiens
cacuucuggcuucagcc

SEQ ID NO: 785277 - RNA, 14 nt, Homo sapiens
cacuugaagcacuu

SEQ ID NO: 785278 - RNA, 14 nt, Homo sapiens
cacuugacauuccu

SEQ ID NO: 785279 - RNA, 14 nt, Homo sapiens
cacuugaggccuga

SEQ ID NO: 785280 - RNA, 20 nt, Homo sapiens
cacuugaguuggggccauug

SEQ ID NO: 785281 - RNA, 19 nt, Homo sapiens
cacuugauguuuccuggaa

SEQ ID NO: 785282 - RNA, 16 nt, Homo sapiens
cacuugccaugcagga

SEQ ID NO: 785283 - RNA, 20 nt, Homo sapiens
cacuugcucccaacccauuc

SEQ ID NO: 785284 - RNA, 13 nt, Homo sapiens
cacuuggaugcag

SEQ ID NO: 785285 - RNA, 22 nt, Homo sapiens
cacuuggauuucauuuguaacu

SEQ ID NO: 785286 - RNA, 23 nt, Homo sapiens
cacuuggggguaaaggucugugg

SEQ ID NO: 785287 - RNA, 22 nt, Homo sapiens
cacuuguuguuuuacuaaagaa

SEQ ID NO: 785288 - RNA, 15 nt, Homo sapiens
cacuuguuugcacug

SEQ ID NO: 785289 - RNA, 23 nt, Homo sapiens
cacuuuaucuauaucucauuuca

SEQ ID NO: 785290 - RNA, 14 nt, Homo sapiens
cacuuuauggaaga

SEQ ID NO: 785291 - RNA, 13 nt, Homo sapiens
cacuuucugccag

SEQ ID NO: 785292 - RNA, 20 nt, Homo sapiens
cacuuucugccagcaucugc

SEQ ID NO: 785293 - RNA, 17 nt, Homo sapiens
cacuuugagaagcugag

SEQ ID NO: 785294 - RNA, 22 nt, Homo sapiens
cacuuuggacuucucugaaaua

SEQ ID NO: 785295 - RNA, 20 nt, Homo sapiens
cacuuuggcuucuccuguga

SEQ ID NO: 785296 - RNA, 15 nt, Homo sapiens
cacuuuguccauuug

SEQ ID NO: 785297 - RNA, 17 nt, Homo sapiens
cacuuuugggaggucaa

SEQ ID NO: 785298 - RNA, 18 nt, Homo sapiens
cacuuuuuaaaaucucaa

SEQ ID NO: 785299 - RNA, 22 nt, Homo sapiens
cacuuuuuaguucccuaaacuu

SEQ ID NO: 785300 - RNA, 15 nt, Homo sapiens
cagaaaaacaaucuu

SEQ ID NO: 785301 - RNA, 16 nt, Homo sapiens
cagaaaaacucuggga

SEQ ID NO: 785302 - RNA, 18 nt, Homo sapiens
cagaaaaaugguggucau

SEQ ID NO: 785303 - RNA, 14 nt, Homo sapiens
cagaaaacaaaaaa

SEQ ID NO: 785304 - RNA, 20 nt, Homo sapiens
cagaaaacaagaugagauug

SEQ ID NO: 785305 - RNA, 16 nt, Homo sapiens
cagaaaagcccugcuu

SEQ ID NO: 785306 - RNA, 19 nt, Homo sapiens
cagaaaaggcugcugugaa

SEQ ID NO: 785307 - RNA, 15 nt, Homo sapiens
cagaaaagugccuga

SEQ ID NO: 785308 - RNA, 14 nt, Homo sapiens
cagaaacaaaaagc

SEQ ID NO: 785309 - RNA, 22 nt, Homo sapiens
cagaaacagaggagagucccag

SEQ ID NO: 785310 - RNA, 19 nt, Homo sapiens
cagaaaccgugccaaaaga

SEQ ID NO: 785311 - RNA, 18 nt, Homo sapiens
cagaaacuacaugauuaa

SEQ ID NO: 785312 - RNA, 19 nt, Homo sapiens
cagccuggucaauauagca

SEQ ID NO: 785313 - RNA, 21 nt, Homo sapiens
cagccuguagcuccccugcug

SEQ ID NO: 785314 - RNA, 20 nt, Homo sapiens
cagccugugguuacagugca

SEQ ID NO: 785315 - RNA, 15 nt, Homo sapiens
cagccuuagcucucc

SEQ ID NO: 785316 - RNA, 22 nt, Homo sapiens
cagccuuuccaagucacuagaa

SEQ ID NO: 785317 - RNA, 21 nt, Homo sapiens
cagccuuucguucugcugacc

SEQ ID NO: 785318 - RNA, 22 nt, Homo sapiens
cagcgaccucaaguguccugaa

SEQ ID NO: 785319 - RNA, 19 nt, Homo sapiens
cagcgaccuuccucaucca

SEQ ID NO: 785320 - RNA, 22 nt, Homo sapiens
cagcgcaugugugcaugugcug

SEQ ID NO: 785321 - RNA, 13 nt, Homo sapiens
cagcgcugcaguu

SEQ ID NO: 785322 - RNA, 15 nt, Homo sapiens
cagcggaggagacca

SEQ ID NO: 785323 - RNA, 17 nt, Homo sapiens
cagcgggcacagggcac

SEQ ID NO: 785324 - RNA, 15 nt, Homo sapiens
cagcgucccagucuc

SEQ ID NO: 785325 - RNA, 17 nt, Homo sapiens
cagcuaagacauauuca

SEQ ID NO: 785326 - RNA, 15 nt, Homo sapiens
cagcuacauuccuca

SEQ ID NO: 785327 - RNA, 22 nt, Homo sapiens
cagcuacauuccucagcugcca

SEQ ID NO: 785328 - RNA, 22 nt, Homo sapiens
cagcuacccaggaggcugaggu

SEQ ID NO: 785329 - RNA, 13 nt, Homo sapiens
cagcuacuggaau

SEQ ID NO: 785330 - RNA, 17 nt, Homo sapiens
cagcuagggacuacuua

SEQ ID NO: 785331 - RNA, 20 nt, Homo sapiens
cagcucaaugaccuggagca

SEQ ID NO: 785332 - RNA, 22 nt, Homo sapiens
cagcucaaugcaguuagcugaa

SEQ ID NO: 785333 - RNA, 18 nt, Homo sapiens
cagcucaccaacuacaga

SEQ ID NO: 785334 - RNA, 20 nt, Homo sapiens
caacaggaaucucagagaca

SEQ ID NO: 785335 - RNA, 18 nt, Homo sapiens
caacagguaaaacagggc

SEQ ID NO: 785336 - RNA, 15 nt, Homo sapiens
caacauaugaauaua

SEQ ID NO: 785337 - RNA, 17 nt, Homo sapiens
caacaucacagcccagc

SEQ ID NO: 785338 - RNA, 18 nt, Homo sapiens
caacaucgaauguguaca

SEQ ID NO: 785339 - RNA, 22 nt, Homo sapiens
caacaucuucauagaugaauga

SEQ ID NO: 785340 - RNA, 11 nt, Homo sapiens
caacaugagga

SEQ ID NO: 785341 - RNA, 12 nt, Homo sapiens
caacaugcaaua

SEQ ID NO: 785342 - RNA, 15 nt, Homo sapiens
caacaugcacugaug

SEQ ID NO: 785343 - RNA, 16 nt, Homo sapiens
caacaugcgaccguga

SEQ ID NO: 785344 - RNA, 23 nt, Homo sapiens
caacauggugaaaccccgucucu

SEQ ID NO: 785345 - RNA, 18 nt, Homo sapiens
caacauggugaaacccug

SEQ ID NO: 785346 - RNA, 21 nt, Homo sapiens
caacauggugaaacuccaucu

SEQ ID NO: 785347 - RNA, 23 nt, Homo sapiens
caacauguuauucaaugugacac

SEQ ID NO: 785348 - RNA, 15 nt, Homo sapiens
caacauuaaacacaa

SEQ ID NO: 785349 - RNA, 16 nt, Homo sapiens
caacauuaugaucuaa

SEQ ID NO: 785350 - RNA, 11 nt, Homo sapiens
caacauugugu

SEQ ID NO: 785351 - RNA, 16 nt, Homo sapiens
caacauuucucacuga

SEQ ID NO: 785352 - RNA, 24 nt, Homo sapiens
caaccaacggccgacugccuguga

SEQ ID NO: 785353 - RNA, 18 nt, Homo sapiens
caaccaagucaugugcau

SEQ ID NO: 785354 - RNA, 13 nt, Homo sapiens
caaccacaugcag

SEQ ID NO: 785355 - RNA, 19 nt, Homo sapiens
caaccaccuuuccagccau

SEQ ID NO: 785356 - RNA, 15 nt, Homo sapiens
caaccacucauucaa

SEQ ID NO: 785357 - RNA, 22 nt, Homo sapiens
caaccaggaagaguucuauccc

SEQ ID NO: 785358 - RNA, 19 nt, Homo sapiens
caaccaggcuccugugaua

SEQ ID NO: 785359 - RNA, 22 nt, Homo sapiens
caaccaguuaaagccacagaug

SEQ ID NO: 785360 - RNA, 15 nt, Homo sapiens
caaccaugucauuuc

SEQ ID NO: 785361 - RNA, 21 nt, Homo sapiens
caacccacagcucagcugccc

SEQ ID NO: 785362 - RNA, 18 nt, Homo sapiens
caacccagggugugaaca

SEQ ID NO: 785363 - RNA, 17 nt, Homo sapiens
caaccccccagcacuga

SEQ ID NO: 785364 - RNA, 19 nt, Homo sapiens
caaccccccagcacugagg

SEQ ID NO: 785365 - RNA, 20 nt, Homo sapiens
caaccccccuccugcuccuc

SEQ ID NO: 785366 - RNA, 21 nt, Homo sapiens
caaccccugaccuaccccagc

SEQ ID NO: 785367 - RNA, 22 nt, Homo sapiens
caaccccuguacccagcuccuu

SEQ ID NO: 785368 - RNA, 14 nt, Homo sapiens
caacccuucccuca

SEQ ID NO: 785369 - RNA, 15 nt, Homo sapiens
caacccuuugcccca

SEQ ID NO: 785370 - RNA, 22 nt, Homo sapiens
caacccuuugccccaccuuuau

SEQ ID NO: 785371 - RNA, 19 nt, Homo sapiens
caaccgaguggcugucauc

SEQ ID NO: 785372 - RNA, 23 nt, Homo sapiens
caaccgguaaccaaagucacaaa

SEQ ID NO: 785373 - RNA, 17 nt, Homo sapiens
caaccuaaccccuuucc

SEQ ID NO: 785374 - RNA, 22 nt, Homo sapiens
caaccuaauuguagcaucuaau

SEQ ID NO: 785375 - RNA, 13 nt, Homo sapiens
caaccuaugguau

SEQ ID NO: 785376 - RNA, 19 nt, Homo sapiens
caaccucaaugcccugcca

SEQ ID NO: 785377 - RNA, 16 nt, Homo sapiens
caaccuccaacaacga

SEQ ID NO: 785378 - RNA, 14 nt, Homo sapiens
caaccucugccucc

SEQ ID NO: 785379 - RNA, 13 nt, Homo sapiens
caaccucuuugcu

SEQ ID NO: 785380 - RNA, 22 nt, Homo sapiens
caaccugcugaagggcagaggu

SEQ ID NO: 785381 - RNA, 18 nt, Homo sapiens
caaccuucacaucuguca

SEQ ID NO: 785382 - RNA, 13 nt, Homo sapiens
caaccuuccagcu

SEQ ID NO: 785383 - RNA, 14 nt, Homo sapiens
caaccuuccauuca

SEQ ID NO: 785384 - RNA, 19 nt, Homo sapiens
caaccuuuuacauugugac

SEQ ID NO: 785385 - RNA, 21 nt, Homo sapiens
caacgacccuggacagugacg

SEQ ID NO: 785386 - RNA, 14 nt, Homo sapiens
caacgaugaugcuu

SEQ ID NO: 785387 - RNA, 14 nt, Homo sapiens
caacgcucccagac

SEQ ID NO: 785388 - RNA, 16 nt, Homo sapiens
caacgugcaaagccaa

SEQ ID NO: 785389 - RNA, 14 nt, Homo sapiens
caacuaacuccaga

SEQ ID NO: 785390 - RNA, 16 nt, Homo sapiens
caacuaaguucaggga

SEQ ID NO: 785391 - RNA, 21 nt, Homo sapiens
caacuaaugagggaaaucugu

SEQ ID NO: 785392 - RNA, 13 nt, Homo sapiens
caacuacccaccu

SEQ ID NO: 785393 - RNA, 20 nt, Homo sapiens
caacuauauuaucaugcaaa

SEQ ID NO: 785394 - RNA, 16 nt, Homo sapiens
caacucacagcuucuc

SEQ ID NO: 785395 - RNA, 12 nt, Homo sapiens
caacucacauua

SEQ ID NO: 785396 - RNA, 11 nt, Homo sapiens
caacucagguu

SEQ ID NO: 785397 - RNA, 19 nt, Homo sapiens
caacuccuuucagccacau

SEQ ID NO: 785398 - RNA, 15 nt, Homo sapiens
caacucugaagcuaa

SEQ ID NO: 785399 - RNA, 21 nt, Homo sapiens
caacucuucgaagccuugccu

SEQ ID NO: 785400 - RNA, 22 nt, Homo sapiens
caacugaaaaaaacauauccaa

SEQ ID NO: 785401 - RNA, 20 nt, Homo sapiens
caacugaaaagacucagugu

SEQ ID NO: 785402 - RNA, 23 nt, Homo sapiens
caacugaccugaccccauuccug

SEQ ID NO: 785403 - RNA, 17 nt, Homo sapiens
caacugauccugcucca

SEQ ID NO: 785404 - RNA, 20 nt, Homo sapiens
caacugcagaaaauguccuc

SEQ ID NO: 785405 - RNA, 21 nt, Homo sapiens
caacuuaaaagucaguaucau

SEQ ID NO: 785406 - RNA, 14 nt, Homo sapiens
caacuuaacucacu

SEQ ID NO: 785407 - RNA, 21 nt, Homo sapiens
caacuucauuugaugcuaaau

SEQ ID NO: 785408 - RNA, 11 nt, Homo sapiens
caacuugagau

SEQ ID NO: 785409 - RNA, 23 nt, Homo sapiens
caacuuuaauugcuuaaaagaca

SEQ ID NO: 785410 - RNA, 13 nt, Homo sapiens
caacuuuacugua

SEQ ID NO: 785411 - RNA, 12 nt, Homo sapiens
caacuuugacaa

SEQ ID NO: 785412 - RNA, 15 nt, Homo sapiens
caagaaacacauucu

SEQ ID NO: 785413 - RNA, 16 nt, Homo sapiens
caagaaacugagacca

SEQ ID NO: 785414 - RNA, 19 nt, Homo sapiens
caagaaauaaaaaucaacu

SEQ ID NO: 785415 - RNA, 12 nt, Homo sapiens
caagaaaucuga

SEQ ID NO: 785416 - RNA, 12 nt, Homo sapiens
caagaaauggau

SEQ ID NO: 785417 - RNA, 20 nt, Homo sapiens
caagaacagaaaacaagaag

SEQ ID NO: 785418 - RNA, 15 nt, Homo sapiens
caagaacauaguuua

SEQ ID NO: 785419 - RNA, 18 nt, Homo sapiens
caagaacugcauggaccu

SEQ ID NO: 785420 - RNA, 18 nt, Homo sapiens
caagaagaggaaagggag

SEQ ID NO: 785421 - RNA, 17 nt, Homo sapiens
caagaaggaaagauuug

SEQ ID NO: 785422 - RNA, 17 nt, Homo sapiens
caagaagucaaaguaaa

SEQ ID NO: 785423 - RNA, 17 nt, Homo sapiens
caagaagugggugcccu

SEQ ID NO: 785424 - RNA, 22 nt, Homo sapiens
caagaauaaauuuuucuucucu

SEQ ID NO: 785425 - RNA, 13 nt, Homo sapiens
caagaauaauuca

SEQ ID NO: 785426 - RNA, 20 nt, Homo sapiens
caagaauauuguauguuaaa

SEQ ID NO: 785427 - RNA, 13 nt, Homo sapiens
caagaaugcauuc

SEQ ID NO: 785428 - RNA, 14 nt, Homo sapiens
caagaaugcauucc

SEQ ID NO: 785429 - RNA, 16 nt, Homo sapiens
caagaauguaacucca

SEQ ID NO: 785430 - RNA, 16 nt, Homo sapiens
caagacaauaauuaca

SEQ ID NO: 785431 - RNA, 18 nt, Homo sapiens
caagacacugaggagaua

SEQ ID NO: 785432 - RNA, 20 nt, Homo sapiens
caagacauuaaaucuaugaa

SEQ ID NO: 785433 - RNA, 22 nt, Homo sapiens
caagacauuucucuaacuccug

SEQ ID NO: 785434 - RNA, 17 nt, Homo sapiens
caagacccccagcacuu

SEQ ID NO: 785435 - RNA, 16 nt, Homo sapiens
caagaccuucucccca

SEQ ID NO: 785436 - RNA, 15 nt, Homo sapiens
auuuaugucccugac

SEQ ID NO: 785437 - RNA, 12 nt, Homo sapiens
auuuaugugcac

SEQ ID NO: 785438 - RNA, 13 nt, Homo sapiens
auuuaugugcacu

SEQ ID NO: 785439 - RNA, 19 nt, Homo sapiens
auuuauuaguccuaauuca

SEQ ID NO: 785440 - RNA, 19 nt, Homo sapiens
auuuauucagccuugguca

SEQ ID NO: 785441 - RNA, 22 nt, Homo sapiens
auuuauucaucugggaggcaga

SEQ ID NO: 785442 - RNA, 18 nt, Homo sapiens
auuuauugcuguguaaca

SEQ ID NO: 785443 - RNA, 22 nt, Homo sapiens
auuuauuuuuuguuuguuuauu

SEQ ID NO: 785444 - RNA, 14 nt, Homo sapiens
auuucaaagcaagu

SEQ ID NO: 785445 - RNA, 16 nt, Homo sapiens
auuucaagugccuaga

SEQ ID NO: 785446 - RNA, 18 nt, Homo sapiens
auuucaauaaaaguaaag

SEQ ID NO: 785447 - RNA, 16 nt, Homo sapiens
auuucaauuccuggcc

SEQ ID NO: 785448 - RNA, 16 nt, Homo sapiens
auuucacaagcuauuu

SEQ ID NO: 785449 - RNA, 16 nt, Homo sapiens
auuucacaugccuugc

SEQ ID NO: 785450 - RNA, 17 nt, Homo sapiens
auuucaccugugacaaa

SEQ ID NO: 785451 - RNA, 22 nt, Homo sapiens
auuucacgcuuuuaauucucau

SEQ ID NO: 785452 - RNA, 20 nt, Homo sapiens
auuucacuaggacucagaaa

SEQ ID NO: 785453 - RNA, 22 nt, Homo sapiens
auuucagaauauuagccaguac

SEQ ID NO: 785454 - RNA, 12 nt, Homo sapiens
auuucagacucc

SEQ ID NO: 785455 - RNA, 22 nt, Homo sapiens
auuucagauaaacaacaaauaa

SEQ ID NO: 785456 - RNA, 18 nt, Homo sapiens
auuucaggaagacugaca

SEQ ID NO: 785457 - RNA, 23 nt, Homo sapiens
auuucauacaacagaaaccagaa

SEQ ID NO: 785458 - RNA, 15 nt, Homo sapiens
auuucauacuguaac

SEQ ID NO: 785459 - RNA, 17 nt, Homo sapiens
auuucaugucacuaaac

SEQ ID NO: 785460 - RNA, 22 nt, Homo sapiens
auuucaugugcggggaucaucu

SEQ ID NO: 785461 - RNA, 21 nt, Homo sapiens
auuuccaaaacuuuaaugaac

SEQ ID NO: 785462 - RNA, 16 nt, Homo sapiens
auuuccaaacauccaa

SEQ ID NO: 785463 - RNA, 16 nt, Homo sapiens
auuuccaaauucacaa

SEQ ID NO: 785464 - RNA, 16 nt, Homo sapiens
auuuccaacaccacag

SEQ ID NO: 785465 - RNA, 13 nt, Homo sapiens
auuuccacuauuu

SEQ ID NO: 785466 - RNA, 12 nt, Homo sapiens
auuuccacugaa

SEQ ID NO: 785467 - RNA, 16 nt, Homo sapiens
auuuccacugaacaaa

SEQ ID NO: 785468 - RNA, 18 nt, Homo sapiens
auuuccagaaauacaauu

SEQ ID NO: 785469 - RNA, 22 nt, Homo sapiens
auuuccaggaaaaaauaaaaag

SEQ ID NO: 785470 - RNA, 20 nt, Homo sapiens
auuuccauugcuuauuaugu

SEQ ID NO: 785471 - RNA, 16 nt, Homo sapiens
auuucccagcacauga

SEQ ID NO: 785472 - RNA, 23 nt, Homo sapiens
auuucccauuugugccagaggaa

SEQ ID NO: 785473 - RNA, 13 nt, Homo sapiens
auuucccuaaaaa

SEQ ID NO: 785474 - RNA, 23 nt, Homo sapiens
auuucccuuccaaagagggaugu

SEQ ID NO: 785475 - RNA, 21 nt, Homo sapiens
auuucccuuuagcuguguuau

SEQ ID NO: 785476 - RNA, 17 nt, Homo sapiens
auuuccuaauacuguca

SEQ ID NO: 785477 - RNA, 16 nt, Homo sapiens
auuuccuaaugucaga

SEQ ID NO: 785478 - RNA, 19 nt, Homo sapiens
auuuccucagcuuaucucu

SEQ ID NO: 785479 - RNA, 13 nt, Homo sapiens
auuuccucugggc

SEQ ID NO: 785480 - RNA, 15 nt, Homo sapiens
auuuccugacuugag

SEQ ID NO: 785481 - RNA, 18 nt, Homo sapiens
auuuccugauaacauuau

SEQ ID NO: 785482 - RNA, 11 nt, Homo sapiens
auuucuaaucc

SEQ ID NO: 785483 - RNA, 17 nt, Homo sapiens
auuucuacaaguucaga

SEQ ID NO: 785484 - RNA, 15 nt, Homo sapiens
auuucuacacagugg

SEQ ID NO: 785485 - RNA, 14 nt, Homo sapiens
auuucuacacugag

SEQ ID NO: 785486 - RNA, 16 nt, Homo sapiens
auuucuaccugaguga

SEQ ID NO: 785487 - RNA, 18 nt, Homo sapiens
auuucuagaacccgugac

SEQ ID NO: 785488 - RNA, 17 nt, Homo sapiens
auuucuagaagcacaug

SEQ ID NO: 785489 - RNA, 20 nt, Homo sapiens
auuucuagaagcacaugugu

SEQ ID NO: 785490 - RNA, 13 nt, Homo sapiens
auuucuagcagag

SEQ ID NO: 785491 - RNA, 16 nt, Homo sapiens
auuucuagcagaguga

SEQ ID NO: 785492 - RNA, 15 nt, Homo sapiens
auuucuaguccaaaa

SEQ ID NO: 785493 - RNA, 15 nt, Homo sapiens
auuucuauacaacag

SEQ ID NO: 785494 - RNA, 21 nt, Homo sapiens
auuucucuugcuggaacuguu

SEQ ID NO: 785495 - RNA, 16 nt, Homo sapiens
auuucugauacugcug

SEQ ID NO: 785496 - RNA, 21 nt, Homo sapiens
auuucugauauaacaaacuac

SEQ ID NO: 785497 - RNA, 19 nt, Homo sapiens
auuucugaucuauacaaau

SEQ ID NO: 785498 - RNA, 18 nt, Homo sapiens
auuucugcuaaauaucac

SEQ ID NO: 785499 - RNA, 18 nt, Homo sapiens
auuucuggaaaacugccu

SEQ ID NO: 785500 - RNA, 16 nt, Homo sapiens
auuucugucacucaca

SEQ ID NO: 785501 - RNA, 23 nt, Homo sapiens
auuucugucuccacgauggugga

SEQ ID NO: 785502 - RNA, 18 nt, Homo sapiens
auuucuguucacuuugua

SEQ ID NO: 785503 - RNA, 22 nt, Homo sapiens
auuucuguucuuacaaauguga

SEQ ID NO: 785504 - RNA, 14 nt, Homo sapiens
auuucuucaaauaa

SEQ ID NO: 785505 - RNA, 23 nt, Homo sapiens
auuucuucuucuaagaagacauu

SEQ ID NO: 785506 - RNA, 15 nt, Homo sapiens
auuucuugcauucau

SEQ ID NO: 785507 - RNA, 15 nt, Homo sapiens
auuucuuuuauguua

SEQ ID NO: 785508 - RNA, 22 nt, Homo sapiens
auuucuuuucuggccaaaagca

SEQ ID NO: 785509 - RNA, 22 nt, Homo sapiens
auuugaacuacuuaaacaguau

SEQ ID NO: 785510 - RNA, 13 nt, Homo sapiens
auuugaaugauuu

SEQ ID NO: 785511 - RNA, 18 nt, Homo sapiens
auuugacaaaacuaaccu

SEQ ID NO: 785512 - RNA, 18 nt, Homo sapiens
auuugaccacggacucca

SEQ ID NO: 785513 - RNA, 22 nt, Homo sapiens
auuugaccggaucuacacccac

SEQ ID NO: 785514 - RNA, 13 nt, Homo sapiens
auuugacuauucu

SEQ ID NO: 785515 - RNA, 18 nt, Homo sapiens
auuugacuguucaaugau

SEQ ID NO: 785516 - RNA, 17 nt, Homo sapiens
auuugagagcuaacuau

SEQ ID NO: 785517 - RNA, 16 nt, Homo sapiens
auuugagcaugcacag

SEQ ID NO: 785518 - RNA, 21 nt, Homo sapiens
auuugagcaugcacagcugcu

SEQ ID NO: 785519 - RNA, 20 nt, Homo sapiens
auuugaguuuaggguucugg

SEQ ID NO: 785520 - RNA, 16 nt, Homo sapiens
auuugauaaacauucc

SEQ ID NO: 785521 - RNA, 20 nt, Homo sapiens
auuugcaaagaaaaguuuca

SEQ ID NO: 785522 - RNA, 24 nt, Homo sapiens
auuugcacaaacuugugagcauca

SEQ ID NO: 785523 - RNA, 23 nt, Homo sapiens
auuugcacuucaccuuuugacca

SEQ ID NO: 785524 - RNA, 15 nt, Homo sapiens
auuugcagacuagaa

SEQ ID NO: 785525 - RNA, 16 nt, Homo sapiens
auuugcagauguucaa

SEQ ID NO: 785526 - RNA, 16 nt, Homo sapiens
auuugcauaaagugaa

SEQ ID NO: 785527 - RNA, 12 nt, Homo sapiens
auuugcauuuca

SEQ ID NO: 785528 - RNA, 18 nt, Homo sapiens
auuugcauuucagaauau

SEQ ID NO: 785529 - RNA, 15 nt, Homo sapiens
auuugcuagcaguaa

SEQ ID NO: 785530 - RNA, 13 nt, Homo sapiens
auuugcuaugagc

SEQ ID NO: 785531 - RNA, 13 nt, Homo sapiens
auuugcuauuuau

SEQ ID NO: 785532 - RNA, 16 nt, Homo sapiens
auuugcucauugcugu

SEQ ID NO: 785533 - RNA, 17 nt, Homo sapiens
auuugcuguuuuaaaca

SEQ ID NO: 785534 - RNA, 13 nt, Homo sapiens
auuuggaaauuca

SEQ ID NO: 785535 - RNA, 17 nt, Homo sapiens
auuuggacaagugcugu

SEQ ID NO: 785536 - RNA, 20 nt, Homo sapiens
auuuggagcuaucagugcuu

SEQ ID NO: 785537 - RNA, 14 nt, Homo sapiens
auuuggcauugauc

SEQ ID NO: 785538 - RNA, 13 nt, Homo sapiens
auuugggacauca

SEQ ID NO: 785539 - RNA, 15 nt, Homo sapiens
auuugggauggagaa

SEQ ID NO: 785540 - RNA, 22 nt, Homo sapiens
auuugggcuacccuaaagggag

SEQ ID NO: 785541 - RNA, 20 nt, Homo sapiens
auuugguaaaaaugcugcuc

SEQ ID NO: 785542 - RNA, 21 nt, Homo sapiens
caaagaccugccugugugcuc

SEQ ID NO: 785543 - RNA, 13 nt, Homo sapiens
caaagacuacuaa

SEQ ID NO: 785544 - RNA, 21 nt, Homo sapiens
caaagacuacuaaugacuuug

SEQ ID NO: 785545 - RNA, 15 nt, Homo sapiens
caaagacuuaacugg

SEQ ID NO: 785546 - RNA, 14 nt, Homo sapiens
caaagagaccagcc

SEQ ID NO: 785547 - RNA, 17 nt, Homo sapiens
caaagagcaauauucca

SEQ ID NO: 785548 - RNA, 16 nt, Homo sapiens
caaagagcacauuuac

SEQ ID NO: 785549 - RNA, 17 nt, Homo sapiens
caaagaggcugccccuc

SEQ ID NO: 785550 - RNA, 14 nt, Homo sapiens
caaagagguauuua

SEQ ID NO: 785551 - RNA, 19 nt, Homo sapiens
caaagaguauauguucccu

SEQ ID NO: 785552 - RNA, 17 nt, Homo sapiens
caaagaguaucaucaac

SEQ ID NO: 785553 - RNA, 21 nt, Homo sapiens
caaagauaugugggugcuccu

SEQ ID NO: 785554 - RNA, 14 nt, Homo sapiens
augcaaaagcacau

SEQ ID NO: 785555 - RNA, 15 nt, Homo sapiens
augcaaaguaaaaaa

SEQ ID NO: 785556 - RNA, 22 nt, Homo sapiens
augcaaaguaaaaaaauaugaa

SEQ ID NO: 785557 - RNA, 16 nt, Homo sapiens
augcaacagaagugac

SEQ ID NO: 785558 - RNA, 22 nt, Homo sapiens
augcaaccgggcccucucucug

SEQ ID NO: 785559 - RNA, 14 nt, Homo sapiens
augcaagaugaacc

SEQ ID NO: 785560 - RNA, 16 nt, Homo sapiens
augcaauuuuucaaga

SEQ ID NO: 785561 - RNA, 17 nt, Homo sapiens
augcaauuuuucaagag

SEQ ID NO: 785562 - RNA, 18 nt, Homo sapiens
augcacaaaucugccaaa

SEQ ID NO: 785563 - RNA, 20 nt, Homo sapiens
augcacacacacacaucuca

SEQ ID NO: 785564 - RNA, 22 nt, Homo sapiens
augcacacgggaaagccuuaaa

SEQ ID NO: 785565 - RNA, 18 nt, Homo sapiens
augcacacucaugcacac

SEQ ID NO: 785566 - RNA, 14 nt, Homo sapiens
augcacaguacaau

SEQ ID NO: 785567 - RNA, 16 nt, Homo sapiens
augcacagugcauuau

SEQ ID NO: 785568 - RNA, 20 nt, Homo sapiens
augcacucgugugagacaag

SEQ ID NO: 785569 - RNA, 19 nt, Homo sapiens
augcacugaaaacuuagcc

SEQ ID NO: 785570 - RNA, 20 nt, Homo sapiens
augcacugugggauguguuc

SEQ ID NO: 785571 - RNA, 20 nt, Homo sapiens
augcagaagcauauuuugcu

SEQ ID NO: 785572 - RNA, 20 nt, Homo sapiens
augcagaaguauucuuuuca

SEQ ID NO: 785573 - RNA, 14 nt, Homo sapiens
augcagagccacag

SEQ ID NO: 785574 - RNA, 17 nt, Homo sapiens
augcagcaggaaggaac

SEQ ID NO: 785575 - RNA, 22 nt, Homo sapiens
augcagcaggaaggaacaaaga

SEQ ID NO: 785576 - RNA, 18 nt, Homo sapiens
augcagccagccaucaaa

SEQ ID NO: 785577 - RNA, 13 nt, Homo sapiens
augcagcuuugca

SEQ ID NO: 785578 - RNA, 16 nt, Homo sapiens
augcagucuauuccag

SEQ ID NO: 785579 - RNA, 14 nt, Homo sapiens
augcagugcccuca

SEQ ID NO: 785580 - RNA, 22 nt, Homo sapiens
augcagugccggcugccaagac

SEQ ID NO: 785581 - RNA, 13 nt, Homo sapiens
augcauaaacuau

SEQ ID NO: 785582 - RNA, 22 nt, Homo sapiens
augcauaaagccaaauuuccag

SEQ ID NO: 785583 - RNA, 18 nt, Homo sapiens
augcauauccugagccau

SEQ ID NO: 785584 - RNA, 20 nt, Homo sapiens
augcauauuguauuacuaga

SEQ ID NO: 785585 - RNA, 21 nt, Homo sapiens
augcauauuguauuacuagaa

SEQ ID NO: 785586 - RNA, 13 nt, Homo sapiens
augcaucaauaug

SEQ ID NO: 785587 - RNA, 21 nt, Homo sapiens
augcaucaauauguauuacaa

SEQ ID NO: 785588 - RNA, 15 nt, Homo sapiens
augcaucacaugaug

SEQ ID NO: 785589 - RNA, 18 nt, Homo sapiens
augcaucacaugaugaaa

SEQ ID NO: 785590 - RNA, 15 nt, Homo sapiens
augcaucuggcccag

SEQ ID NO: 785591 - RNA, 18 nt, Homo sapiens
augcaucuggcccaggaa

SEQ ID NO: 785592 - RNA, 13 nt, Homo sapiens
augcaucuuguuu

SEQ ID NO: 785593 - RNA, 22 nt, Homo sapiens
augcauggaggacucuccucuu

SEQ ID NO: 785594 - RNA, 16 nt, Homo sapiens
augcaugugcauauag

SEQ ID NO: 785595 - RNA, 22 nt, Homo sapiens
augcauuugauggccaccagcu

SEQ ID NO: 785596 - RNA, 21 nt, Homo sapiens
augccaaacaggaacaaucca

SEQ ID NO: 785597 - RNA, 21 nt, Homo sapiens
augccaaccccgcccuaggcc

SEQ ID NO: 785598 - RNA, 21 nt, Homo sapiens
augccaagggggugacuggaa

SEQ ID NO: 785599 - RNA, 12 nt, Homo sapiens
augccaccaccc

SEQ ID NO: 785600 - RNA, 15 nt, Homo sapiens
augccacccugcaau

SEQ ID NO: 785601 - RNA, 14 nt, Homo sapiens
augccacuucucac

SEQ ID NO: 785602 - RNA, 18 nt, Homo sapiens
augccagcauauacugaa

SEQ ID NO: 785603 - RNA, 14 nt, Homo sapiens
augccagcuacuuc

SEQ ID NO: 785604 - RNA, 17 nt, Homo sapiens
augccagugaaacuuca

SEQ ID NO: 785605 - RNA, 14 nt, Homo sapiens
augccagugcucaa

SEQ ID NO: 785606 - RNA, 15 nt, Homo sapiens
augccauagcaagau

SEQ ID NO: 785607 - RNA, 13 nt, Homo sapiens
augccaucuguuu

SEQ ID NO: 785608 - RNA, 21 nt, Homo sapiens
augccccccucaaaccuccuc

SEQ ID NO: 785609 - RNA, 17 nt, Homo sapiens
augccccuaaucccagc

SEQ ID NO: 785610 - RNA, 18 nt, Homo sapiens
augccccugacaucauca

SEQ ID NO: 785611 - RNA, 20 nt, Homo sapiens
augcccucauacccaugcac

SEQ ID NO: 785612 - RNA, 13 nt, Homo sapiens
augcccugugugg

SEQ ID NO: 785613 - RNA, 18 nt, Homo sapiens
augccgguuaaauuccau

SEQ ID NO: 785614 - RNA, 15 nt, Homo sapiens
augccuagaguuuac

SEQ ID NO: 785615 - RNA, 19 nt, Homo sapiens
augccucagccuacuuuca

SEQ ID NO: 785616 - RNA, 18 nt, Homo sapiens
augccuccaagccauuca

SEQ ID NO: 785617 - RNA, 13 nt, Homo sapiens
augccugcucccu

SEQ ID NO: 785618 - RNA, 17 nt, Homo sapiens
augccugguaccagagg

SEQ ID NO: 785619 - RNA, 15 nt, Homo sapiens
augccuguaauccca

SEQ ID NO: 785620 - RNA, 17 nt, Homo sapiens
augccuguaaucccaga

SEQ ID NO: 785621 - RNA, 12 nt, Homo sapiens
augccuuacucu

SEQ ID NO: 785622 - RNA, 18 nt, Homo sapiens
augccuuuauauacuuag

SEQ ID NO: 785623 - RNA, 22 nt, Homo sapiens
augccuuucuaguccuauucua

SEQ ID NO: 785624 - RNA, 20 nt, Homo sapiens
augcggaaggauugcaaugc

SEQ ID NO: 785625 - RNA, 20 nt, Homo sapiens
augcggcccaggauggcuuu

SEQ ID NO: 785626 - RNA, 16 nt, Homo sapiens
augcuaaacugugaaa

SEQ ID NO: 785627 - RNA, 22 nt, Homo sapiens
augcuaccacugguacuuccuu

SEQ ID NO: 785628 - RNA, 23 nt, Homo sapiens
augcuagaacaacgccugucaca

SEQ ID NO: 785629 - RNA, 22 nt, Homo sapiens
augcuaguuugaccucauuugu

SEQ ID NO: 785630 - RNA, 14 nt, Homo sapiens
augcuauuaauaca

SEQ ID NO: 785631 - RNA, 19 nt, Homo sapiens
augcuauugucagucagca

SEQ ID NO: 785632 - RNA, 13 nt, Homo sapiens
augcucaccaagg

SEQ ID NO: 785633 - RNA, 20 nt, Homo sapiens
augcucaggagccaccagca

SEQ ID NO: 785634 - RNA, 16 nt, Homo sapiens
augcuccagauuagag

SEQ ID NO: 785635 - RNA, 15 nt, Homo sapiens
augcucuaacuggac

SEQ ID NO: 785636 - RNA, 16 nt, Homo sapiens
augcucuuucccagga

SEQ ID NO: 785637 - RNA, 18 nt, Homo sapiens
augcucuuuugcacaagg

SEQ ID NO: 785638 - RNA, 22 nt, Homo sapiens
augcugaaaaaucauccaagac

SEQ ID NO: 785639 - RNA, 22 nt, Homo sapiens
augcugaauguacacugauucc

SEQ ID NO: 785640 - RNA, 13 nt, Homo sapiens
augcugccagccu

SEQ ID NO: 785641 - RNA, 18 nt, Homo sapiens
augcugcccgcucugcag

SEQ ID NO: 785642 - RNA, 15 nt, Homo sapiens
augcugcuaauucaa

SEQ ID NO: 785643 - RNA, 15 nt, Homo sapiens
augcugggcaaugag

SEQ ID NO: 785644 - RNA, 19 nt, Homo sapiens
augcugguuuucuacccaa

SEQ ID NO: 785645 - RNA, 16 nt, Homo sapiens
augcuguacacauauu

SEQ ID NO: 785646 - RNA, 17 nt, Homo sapiens
augcuguacacauauuu

SEQ ID NO: 785647 - RNA, 16 nt, Homo sapiens
augcugucaugguccu

SEQ ID NO: 785648 - RNA, 22 nt, Homo sapiens
augcugucauuaguauuucaca

SEQ ID NO: 785649 - RNA, 19 nt, Homo sapiens
augcuuagucccucaugca

SEQ ID NO: 785650 - RNA, 20 nt, Homo sapiens
augcuucacaucucuucacu

SEQ ID NO: 785651 - RNA, 14 nt, Homo sapiens
augcuucaugugcu

SEQ ID NO: 785652 - RNA, 15 nt, Homo sapiens
augcuucaugugcug

SEQ ID NO: 785653 - RNA, 18 nt, Homo sapiens
augcuuguauuuuacuuu

SEQ ID NO: 785654 - RNA, 23 nt, Homo sapiens
augcuuguauuuuacuuuuccau

SEQ ID NO: 785655 - RNA, 14 nt, Homo sapiens
augcuuucccugag

SEQ ID NO: 785656 - RNA, 21 nt, Homo sapiens
augcuuugccccugagacaaa

SEQ ID NO: 785657 - RNA, 20 nt, Homo sapiens
augcuuuucugccacuccau

SEQ ID NO: 785658 - RNA, 15 nt, Homo sapiens
augcuuuugcuugca

SEQ ID NO: 785659 - RNA, 20 nt, Homo sapiens
augcuuuugcuugcaaugua

SEQ ID NO: 785660 - RNA, 17 nt, Homo sapiens
auggaaaaacugaggcu

SEQ ID NO: 785661 - RNA, 16 nt, Homo sapiens
auggaaacagacucau

SEQ ID NO: 785662 - RNA, 19 nt, Homo sapiens
auggaaacagacucauacc

SEQ ID NO: 785663 - RNA, 18 nt, Homo sapiens
auggaaacugaaugcucc

SEQ ID NO: 785664 - RNA, 16 nt, Homo sapiens
auggaaauucugaaaa

SEQ ID NO: 785665 - RNA, 18 nt, Homo sapiens
auggaacaggcucagauc

SEQ ID NO: 785666 - RNA, 15 nt, Homo sapiens
auggaaccacuaaaa

SEQ ID NO: 785667 - RNA, 16 nt, Homo sapiens
auggaacucauuccug

SEQ ID NO: 785668 - RNA, 20 nt, Homo sapiens
auggaagcaaccagcaaauu

SEQ ID NO: 785669 - RNA, 21 nt, Homo sapiens
gagagugguuagaaggcuucu

SEQ ID NO: 785670 - RNA, 19 nt, Homo sapiens
gagaguuugccuguucuau

SEQ ID NO: 785671 - RNA, 15 nt, Homo sapiens
gagauacuucccaaa

SEQ ID NO: 785672 - RNA, 16 nt, Homo sapiens
gagauaggaaacugaa

SEQ ID NO: 785673 - RNA, 20 nt, Homo sapiens
gagaucacgccacugcacuc

SEQ ID NO: 785674 - RNA, 11 nt, Homo sapiens
gagauccuccu

SEQ ID NO: 785675 - RNA, 23 nt, Homo sapiens
gagauccuuuagugcacccagug

SEQ ID NO: 785676 - RNA, 19 nt, Homo sapiens
gagaucgugcuacugcacu

SEQ ID NO: 785677 - RNA, 21 nt, Homo sapiens
gagaucguuguuuacagugua

SEQ ID NO: 785678 - RNA, 16 nt, Homo sapiens
gagaucugcacaguca

SEQ ID NO: 785679 - RNA, 18 nt, Homo sapiens
gagaucuguguggcuccu

SEQ ID NO: 785680 - RNA, 16 nt, Homo sapiens
gagaucuguugauuga

SEQ ID NO: 785681 - RNA, 16 nt, Homo sapiens
gagaucuuucccaggc

SEQ ID NO: 785682 - RNA, 18 nt, Homo sapiens
gagaugaaccacauuaua

SEQ ID NO: 785683 - RNA, 17 nt, Homo sapiens
gagaugaagccuaagaa

SEQ ID NO: 785684 - RNA, 17 nt, Homo sapiens
gagaugaaucaaaacca

SEQ ID NO: 785685 - RNA, 20 nt, Homo sapiens
gagaugagccccacguggag

SEQ ID NO: 785686 - RNA, 23 nt, Homo sapiens
gagaugagccccacguggagcuc

SEQ ID NO: 785687 - RNA, 13 nt, Homo sapiens
gagaugcagcuac

SEQ ID NO: 785688 - RNA, 21 nt, Homo sapiens
gagaugcaggauuucuucaca

SEQ ID NO: 785689 - RNA, 16 nt, Homo sapiens
gagaugcagucacuua

SEQ ID NO: 785690 - RNA, 22 nt, Homo sapiens
gagaugccacuucucacucacc

SEQ ID NO: 785691 - RNA, 17 nt, Homo sapiens
gagaugcccauucucuu

SEQ ID NO: 785692 - RNA, 20 nt, Homo sapiens
gagauggcgcuauugcacuc

SEQ ID NO: 785693 - RNA, 13 nt, Homo sapiens
gagauggguccug

SEQ ID NO: 785694 - RNA, 12 nt, Homo sapiens
gagauggucaca

SEQ ID NO: 785695 - RNA, 19 nt, Homo sapiens
gagauggucacaugaccca

SEQ ID NO: 785696 - RNA, 12 nt, Homo sapiens
gagaugucuucu

SEQ ID NO: 785697 - RNA, 17 nt, Homo sapiens
gagauguggucaaugga

SEQ ID NO: 785698 - RNA, 19 nt, Homo sapiens
gagauuccagucuacuuga

SEQ ID NO: 785699 - RNA, 21 nt, Homo sapiens
gagauugcaccauugcgcucu

SEQ ID NO: 785700 - RNA, 12 nt, Homo sapiens
gagauugugcuc

SEQ ID NO: 785701 - RNA, 18 nt, Homo sapiens
gagauuguuguuugccau

SEQ ID NO: 785702 - RNA, 17 nt, Homo sapiens
gagauuucaucugcucu

SEQ ID NO: 785703 - RNA, 16 nt, Homo sapiens
gagauuucaugccugg

SEQ ID NO: 785704 - RNA, 16 nt, Homo sapiens
gagauuugccaaaaac

SEQ ID NO: 785705 - RNA, 18 nt, Homo sapiens
gagcaaaaaucugagaaa

SEQ ID NO: 785706 - RNA, 22 nt, Homo sapiens
gagcaaaacuccgucucaaaaa

SEQ ID NO: 785707 - RNA, 21 nt, Homo sapiens
gagcaaaagacuugagccauc

SEQ ID NO: 785708 - RNA, 19 nt, Homo sapiens
gagcaaaaucgaugcagug

SEQ ID NO: 785709 - RNA, 15 nt, Homo sapiens
gagcaaaaugcucuu

SEQ ID NO: 785710 - RNA, 19 nt, Homo sapiens
gagcaaaaugcucuugucc

SEQ ID NO: 785711 - RNA, 23 nt, Homo sapiens
gagcaaacuaacuugacuuuuaa

SEQ ID NO: 785712 - RNA, 16 nt, Homo sapiens
gagcaaacugcucagc

SEQ ID NO: 785713 - RNA, 16 nt, Homo sapiens
gagcaaagagccagca

SEQ ID NO: 785714 - RNA, 13 nt, Homo sapiens
gagcaagacucca

SEQ ID NO: 785715 - RNA, 15 nt, Homo sapiens
gagcaagacugucuc

SEQ ID NO: 785716 - RNA, 15 nt, Homo sapiens
gagcaagggggccca

SEQ ID NO: 785717 - RNA, 19 nt, Homo sapiens
gagcacaauggucuuacau

SEQ ID NO: 785718 - RNA, 20 nt, Homo sapiens
gagcacacccgugugcacac

SEQ ID NO: 785719 - RNA, 16 nt, Homo sapiens
gagcacagcugcauua

SEQ ID NO: 785720 - RNA, 16 nt, Homo sapiens
gagcaccagcggucca

SEQ ID NO: 785721 - RNA, 14 nt, Homo sapiens
gagcacccugccca

SEQ ID NO: 785722 - RNA, 21 nt, Homo sapiens
gagcacccugcccaccaagaa

SEQ ID NO: 785723 - RNA, 22 nt, Homo sapiens
gagcacccuugcccggcuguga

SEQ ID NO: 785724 - RNA, 21 nt, Homo sapiens
gagcacuguuuauacacugug

SEQ ID NO: 785725 - RNA, 23 nt, Homo sapiens
gagcagagcucuccccuccugcu

SEQ ID NO: 785726 - RNA, 15 nt, Homo sapiens
gagcagcagccagca

SEQ ID NO: 785727 - RNA, 15 nt, Homo sapiens
gagcagccacaacca

SEQ ID NO: 785728 - RNA, 19 nt, Homo sapiens
gagcagccacaaccaaaaa

SEQ ID NO: 785729 - RNA, 13 nt, Homo sapiens
gagcagccagcug

SEQ ID NO: 785730 - RNA, 15 nt, Homo sapiens
gagcaggaacaauga

SEQ ID NO: 785731 - RNA, 15 nt, Homo sapiens
gagcaggaagccgau

SEQ ID NO: 785732 - RNA, 11 nt, Homo sapiens
gagcagggauu

SEQ ID NO: 785733 - RNA, 16 nt, Homo sapiens
gagcaggggaggcuca

SEQ ID NO: 785734 - RNA, 22 nt, Homo sapiens
gagcagggguuggucaaggcca

SEQ ID NO: 785735 - RNA, 17 nt, Homo sapiens
gagcaguccugccucag

SEQ ID NO: 785736 - RNA, 13 nt, Homo sapiens
gagcagugaccca

SEQ ID NO: 785737 - RNA, 19 nt, Homo sapiens
gagcaguucaugacccagg

SEQ ID NO: 785738 - RNA, 23 nt, Homo sapiens
gagcaucaaucuuguuacugcug

SEQ ID NO: 785739 - RNA, 14 nt, Homo sapiens
gagcaucucaggag

SEQ ID NO: 785740 - RNA, 18 nt, Homo sapiens
gagcaugacagccugcag

SEQ ID NO: 785741 - RNA, 13 nt, Homo sapiens
gagcaugaccuga

SEQ ID NO: 785742 - RNA, 12 nt, Homo sapiens
gagcauuuccaa

SEQ ID NO: 785743 - RNA, 19 nt, Homo sapiens
gagcauuugaaaggugugc

SEQ ID NO: 785744 - RNA, 15 nt, Homo sapiens
gagccaaagaauauu

SEQ ID NO: 785745 - RNA, 14 nt, Homo sapiens
gagccaagcuucaa

SEQ ID NO: 785746 - RNA, 17 nt, Homo sapiens
gagccaagcuucaaccc

SEQ ID NO: 785747 - RNA, 13 nt, Homo sapiens
gagccaaggguuc

SEQ ID NO: 785748 - RNA, 15 nt, Homo sapiens
gagccaccaguucuc

SEQ ID NO: 785749 - RNA, 19 nt, Homo sapiens
gagccaccugacucuugca

SEQ ID NO: 785750 - RNA, 20 nt, Homo sapiens
gagccagcuuggggccacca

SEQ ID NO: 785751 - RNA, 20 nt, Homo sapiens
gagccagucuaguuccugau

SEQ ID NO: 785752 - RNA, 17 nt, Homo sapiens
gagccagugagggcagu

SEQ ID NO: 785753 - RNA, 14 nt, Homo sapiens
gagccauauaggca

SEQ ID NO: 785754 - RNA, 18 nt, Homo sapiens
gagccaugacaagaacaa

SEQ ID NO: 785755 - RNA, 19 nt, Homo sapiens
gagccaugaucaugccacu

SEQ ID NO: 785756 - RNA, 13 nt, Homo sapiens
gagccaugucaug

SEQ ID NO: 785757 - RNA, 19 nt, Homo sapiens
gagcccaaaaacaagcaaa

SEQ ID NO: 785758 - RNA, 17 nt, Homo sapiens
gagcccagcagaucuca

SEQ ID NO: 785759 - RNA, 21 nt, Homo sapiens
gagcccaugcucaaccacugu

SEQ ID NO: 785760 - RNA, 15 nt, Homo sapiens
gagcccauucccacc

SEQ ID NO: 785761 - RNA, 18 nt, Homo sapiens
gagccccacgcuguugac

SEQ ID NO: 785762 - RNA, 21 nt, Homo sapiens
gagccccaggggacaagggau

SEQ ID NO: 785763 - RNA, 18 nt, Homo sapiens
gagcccgaggcaccagug

SEQ ID NO: 785764 - RNA, 13 nt, Homo sapiens
gagcccgcacugu

SEQ ID NO: 785765 - RNA, 22 nt, Homo sapiens
gagcccuaagcauugacuucuc

SEQ ID NO: 785766 - RNA, 18 nt, Homo sapiens
gagcccugguggaucuug

SEQ ID NO: 785767 - RNA, 21 nt, Homo sapiens
gagccgagaucacaccacugu

SEQ ID NO: 785768 - RNA, 18 nt, Homo sapiens
gagccgucagagcaguga

SEQ ID NO: 785769 - RNA, 22 nt, Homo sapiens
gagccucagaagaaaacaaagu

SEQ ID NO: 785770 - RNA, 16 nt, Homo sapiens
gagccuccacugccuc

SEQ ID NO: 785771 - RNA, 22 nt, Homo sapiens
gagccuccccuggguuaacaaa

SEQ ID NO: 785772 - RNA, 12 nt, Homo sapiens
gagccugaguga

SEQ ID NO: 785773 - RNA, 14 nt, Homo sapiens
gagccugcagggaa

SEQ ID NO: 785774 - RNA, 15 nt, Homo sapiens
gagccugcagggaag

SEQ ID NO: 785775 - RNA, 18 nt, Homo sapiens
gagccuugcugggccagg

SEQ ID NO: 785776 - RNA, 19 nt, Homo sapiens
gagccuuggcccacacuga

SEQ ID NO: 785777 - RNA, 14 nt, Homo sapiens
gagcgagacuuggu

SEQ ID NO: 785778 - RNA, 14 nt, Homo sapiens
gagcggcaaaggcc

SEQ ID NO: 785779 - RNA, 16 nt, Homo sapiens
gagcuaaacuccuucc

SEQ ID NO: 785780 - RNA, 16 nt, Homo sapiens
gagcuacaugguggag

SEQ ID NO: 785781 - RNA, 14 nt, Homo sapiens
gagcuacugaugaa

SEQ ID NO: 785782 - RNA, 14 nt, Homo sapiens
gagcuagcccaguc

SEQ ID NO: 785783 - RNA, 19 nt, Homo sapiens
gagcuagcuucugcaaugu

SEQ ID NO: 785784 - RNA, 17 nt, Homo sapiens
gagaggaagagcugcaa

SEQ ID NO: 785785 - RNA, 15 nt, Homo sapiens
gagaggauacauuua

SEQ ID NO: 785786 - RNA, 13 nt, Homo sapiens
gagaggccagcug

SEQ ID NO: 785787 - RNA, 19 nt, Homo sapiens
gagaggcccggugcagcug

SEQ ID NO: 785788 - RNA, 22 nt, Homo sapiens
gagagucagacccuucaaugga

SEQ ID NO: 785789 - RNA, 17 nt, Homo sapiens
gagagugcagaucugug

SEQ ID NO: 785790 - RNA, 16 nt, Homo sapiens
gagaguggcuccuccc

SEQ ID NO: 785791 - RNA, 21 nt, Homo sapiens
gaagcggagagagccaagacg

SEQ ID NO: 785792 - RNA, 21 nt, Homo sapiens
gacuucaucuucaaaacugcc

SEQ ID NO: 785793 - RNA, 22 nt, Homo sapiens
gacuucaugacaagcauuuugu

SEQ ID NO: 785794 - RNA, 16 nt, Homo sapiens
gacuucuggcagggaa

SEQ ID NO: 785795 - RNA, 17 nt, Homo sapiens
gacuucugucuucacaa

SEQ ID NO: 785796 - RNA, 23 nt, Homo sapiens
gacuucuugguacccagucaccu

SEQ ID NO: 785797 - RNA, 22 nt, Homo sapiens
caucccuuccuggaaacagcau

SEQ ID NO: 785798 - RNA, 18 nt, Homo sapiens
caucccuuuuucugcuaa

SEQ ID NO: 785799 - RNA, 16 nt, Homo sapiens
caucccuuuuuuuaca

SEQ ID NO: 785800 - RNA, 15 nt, Homo sapiens
cauccggcagccugg

SEQ ID NO: 785801 - RNA, 14 nt, Homo sapiens
cauccugacugaaa

SEQ ID NO: 785802 - RNA, 18 nt, Homo sapiens
cauccugauuuuuacuau

SEQ ID NO: 785803 - RNA, 18 nt, Homo sapiens
cauccuggagggcuuucu

SEQ ID NO: 785804 - RNA, 13 nt, Homo sapiens
cauccugugccac

SEQ ID NO: 785805 - RNA, 23 nt, Homo sapiens
cauccuuacagcuaucuguagaa

SEQ ID NO: 785806 - RNA, 18 nt, Homo sapiens
cauccuuuacaccaacuc

SEQ ID NO: 785807 - RNA, 17 nt, Homo sapiens
caucgaccacaccagcc

SEQ ID NO: 785808 - RNA, 17 nt, Homo sapiens
caucgauucaaacugcu

SEQ ID NO: 785809 - RNA, 15 nt, Homo sapiens
caucgcgaugucgca

SEQ ID NO: 785810 - RNA, 22 nt, Homo sapiens
caucgcuuuauuggcugagaua

SEQ ID NO: 785811 - RNA, 20 nt, Homo sapiens
caucggguaagaugcuccug

SEQ ID NO: 785812 - RNA, 19 nt, Homo sapiens
caucuaagucaguuucaca

SEQ ID NO: 785813 - RNA, 15 nt, Homo sapiens
caucuaauguauuau

SEQ ID NO: 785814 - RNA, 18 nt, Homo sapiens
caucuaauguauuaugag

SEQ ID NO: 785815 - RNA, 14 nt, Homo sapiens
caucuacaaucagu

SEQ ID NO: 785816 - RNA, 21 nt, Homo sapiens
caucuacccugcugaccuccc

SEQ ID NO: 785817 - RNA, 21 nt, Homo sapiens
caucuagggaguaugaagaau

SEQ ID NO: 785818 - RNA, 14 nt, Homo sapiens
caucuagucacaaa

SEQ ID NO: 785819 - RNA, 20 nt, Homo sapiens
caucuagucacaaagacucc

SEQ ID NO: 785820 - RNA, 22 nt, Homo sapiens
caucuauaaagaagaacuugca

SEQ ID NO: 785821 - RNA, 16 nt, Homo sapiens
caucuauuauuacaca

SEQ ID NO: 785822 - RNA, 23 nt, Homo sapiens
caucucaaaaaaaaacaacuauu

SEQ ID NO: 785823 - RNA, 17 nt, Homo sapiens
caucucaaaaagaaaag

SEQ ID NO: 785824 - RNA, 21 nt, Homo sapiens
caucucaaagaaggcauuugc

SEQ ID NO: 785825 - RNA, 20 nt, Homo sapiens
caucuccgccuccacacuga

SEQ ID NO: 785826 - RNA, 15 nt, Homo sapiens
caucucuacugaaaa

SEQ ID NO: 785827 - RNA, 20 nt, Homo sapiens
caucucuacugaaaguacaa

SEQ ID NO: 785828 - RNA, 17 nt, Homo sapiens
caucucugcaguuuuuc

SEQ ID NO: 785829 - RNA, 15 nt, Homo sapiens
caucucugucucaaa

SEQ ID NO: 785830 - RNA, 23 nt, Homo sapiens
caucucuuuaccuccuaauucca

SEQ ID NO: 785831 - RNA, 16 nt, Homo sapiens
caucugaagcuuuacc

SEQ ID NO: 785832 - RNA, 13 nt, Homo sapiens
caucugaccaucu

SEQ ID NO: 785833 - RNA, 14 nt, Homo sapiens
caucugaccaucug

SEQ ID NO: 785834 - RNA, 15 nt, Homo sapiens
caucugacuaugaca

SEQ ID NO: 785835 - RNA, 21 nt, Homo sapiens
caucugagccgucagagcagu

SEQ ID NO: 785836 - RNA, 23 nt, Homo sapiens
caucugagugcagccguuugaga

SEQ ID NO: 785837 - RNA, 19 nt, Homo sapiens
caucugcagccacuuucug

SEQ ID NO: 785838 - RNA, 18 nt, Homo sapiens
caucugcaugucuacuca

SEQ ID NO: 785839 - RNA, 15 nt, Homo sapiens
caucuggccccaucu

SEQ ID NO: 785840 - RNA, 18 nt, Homo sapiens
caucuggcuuuuucugcc

SEQ ID NO: 785841 - RNA, 18 nt, Homo sapiens
caucugggugcccugaaa

SEQ ID NO: 785842 - RNA, 12 nt, Homo sapiens
caucuguacuca

SEQ ID NO: 785843 - RNA, 23 nt, Homo sapiens
caucuguagauacuagcuaucua

SEQ ID NO: 785844 - RNA, 14 nt, Homo sapiens
caucugugccagag

SEQ ID NO: 785845 - RNA, 16 nt, Homo sapiens
caucuucacugcaauu

SEQ ID NO: 785846 - RNA, 17 nt, Homo sapiens
caucuucacugcaauuu

SEQ ID NO: 785847 - RNA, 18 nt, Homo sapiens
caucuucaggcccagcca

SEQ ID NO: 785848 - RNA, 11 nt, Homo sapiens
caucuuccaag

SEQ ID NO: 785849 - RNA, 13 nt, Homo sapiens
caucuucuauuca

SEQ ID NO: 785850 - RNA, 14 nt, Homo sapiens
caucuugaguauuu

SEQ ID NO: 785851 - RNA, 16 nt, Homo sapiens
caucuugcuaccagua

SEQ ID NO: 785852 - RNA, 14 nt, Homo sapiens
caucuuggagcuuu

SEQ ID NO: 785853 - RNA, 15 nt, Homo sapiens
caucuuuaacacagc

SEQ ID NO: 785854 - RNA, 12 nt, Homo sapiens
caucuuucacau

SEQ ID NO: 785855 - RNA, 23 nt, Homo sapiens
caucuuuccuucggguuggcaaa

SEQ ID NO: 785856 - RNA, 18 nt, Homo sapiens
caucuuuuacauucugca

SEQ ID NO: 785857 - RNA, 20 nt, Homo sapiens
caucuuuuauagacgcucuu

SEQ ID NO: 785858 - RNA, 13 nt, Homo sapiens
caucuuuucaagg

SEQ ID NO: 785859 - RNA, 18 nt, Homo sapiens
caucuuuugaagcuuucu

SEQ ID NO: 785860 - RNA, 15 nt, Homo sapiens
caucuuuuuccacuu

SEQ ID NO: 785861 - RNA, 20 nt, Homo sapiens
caucuuuuuccacuuugacu

SEQ ID NO: 785862 - RNA, 18 nt, Homo sapiens
caugaaaauaaacuugaa

SEQ ID NO: 785863 - RNA, 15 nt, Homo sapiens
caugaaacacuucuc

SEQ ID NO: 785864 - RNA, 21 nt, Homo sapiens
caugaaacuuguuucacugaa

SEQ ID NO: 785865 - RNA, 16 nt, Homo sapiens
caugaaauucuuccua

SEQ ID NO: 785866 - RNA, 15 nt, Homo sapiens
caugaaccaagugga

SEQ ID NO: 785867 - RNA, 17 nt, Homo sapiens
cauguacauacccuggc

SEQ ID NO: 785868 - RNA, 18 nt, Homo sapiens
cauguacucuguugagua

SEQ ID NO: 785869 - RNA, 21 nt, Homo sapiens
cauguagcccccuggccucug

SEQ ID NO: 785870 - RNA, 22 nt, Homo sapiens
cauguaguuggggcaccauaca

SEQ ID NO: 785871 - RNA, 13 nt, Homo sapiens
cauguaugaaauu

SEQ ID NO: 785872 - RNA, 13 nt, Homo sapiens
cauguaugucuug

SEQ ID NO: 785873 - RNA, 22 nt, Homo sapiens
cauguaugucuuggacacugua

SEQ ID NO: 785874 - RNA, 18 nt, Homo sapiens
cauguauuagcucacuga

SEQ ID NO: 785875 - RNA, 23 nt, Homo sapiens
cauguauuuaauaaguacaacua

SEQ ID NO: 785876 - RNA, 15 nt, Homo sapiens
caugucagacuguac

SEQ ID NO: 785877 - RNA, 19 nt, Homo sapiens
caugucauuucagaaguua

SEQ ID NO: 785878 - RNA, 18 nt, Homo sapiens
caugucccacccucccua

SEQ ID NO: 785879 - RNA, 17 nt, Homo sapiens
cauguccuaauucuucu

SEQ ID NO: 785880 - RNA, 18 nt, Homo sapiens
caugugacacauaugcac

SEQ ID NO: 785881 - RNA, 19 nt, Homo sapiens
caugugacacauaugcacc

SEQ ID NO: 785882 - RNA, 22 nt, Homo sapiens
caugugacacauaugcaccuug

SEQ ID NO: 785883 - RNA, 19 nt, Homo sapiens
caugugacuggcaguauua

SEQ ID NO: 785884 - RNA, 16 nt, Homo sapiens
caugugagcaugucac

SEQ ID NO: 785885 - RNA, 17 nt, Homo sapiens
caugugagcaugucacu

SEQ ID NO: 785886 - RNA, 17 nt, Homo sapiens
caugugagccaccgcug

SEQ ID NO: 785887 - RNA, 15 nt, Homo sapiens
caugugcaaaugugc

SEQ ID NO: 785888 - RNA, 19 nt, Homo sapiens
caugugcaaaugugcuggu

SEQ ID NO: 785889 - RNA, 13 nt, Homo sapiens
caugugcaccugc

SEQ ID NO: 785890 - RNA, 21 nt, Homo sapiens
caugugcaccuuugcacagug

SEQ ID NO: 785891 - RNA, 13 nt, Homo sapiens
caugugcauauag

SEQ ID NO: 785892 - RNA, 22 nt, Homo sapiens
caugugcgcgcgugcaugugug

SEQ ID NO: 785893 - RNA, 21 nt, Homo sapiens
caugugcguccauauuuaaca

SEQ ID NO: 785894 - RNA, 18 nt, Homo sapiens
caugugcuagucacuggc

SEQ ID NO: 785895 - RNA, 15 nt, Homo sapiens
caugugcugugacca

SEQ ID NO: 785896 - RNA, 21 nt, Homo sapiens
cauguggagaaaggagugaaa

SEQ ID NO: 785897 - RNA, 18 nt, Homo sapiens
cauguggccuuuaucuca

SEQ ID NO: 785898 - RNA, 18 nt, Homo sapiens
cauguguaauaugcacaa

SEQ ID NO: 785899 - RNA, 17 nt, Homo sapiens
cauguguacauucugcc

SEQ ID NO: 785900 - RNA, 21 nt, Homo sapiens
cauguuaaugacaauauucca

SEQ ID NO: 785901 - RNA, 15 nt, Homo sapiens
cauguuacccauuca

SEQ ID NO: 785902 - RNA, 17 nt, Homo sapiens
cauguuacucaguguua

SEQ ID NO: 785903 - RNA, 16 nt, Homo sapiens
cauguuacucaugacu

SEQ ID NO: 785904 - RNA, 14 nt, Homo sapiens
cauguuaguuaccu

SEQ ID NO: 785905 - RNA, 13 nt, Homo sapiens
cauguucacugug

SEQ ID NO: 785906 - RNA, 14 nt, Homo sapiens
cauguucacuguga

SEQ ID NO: 785907 - RNA, 20 nt, Homo sapiens
cauguuccuguuuaugcauu

SEQ ID NO: 785908 - RNA, 17 nt, Homo sapiens
cauguuguucucauuga

SEQ ID NO: 785909 - RNA, 22 nt, Homo sapiens
ucuguuggcaggcuggccaguc

SEQ ID NO: 785910 - RNA, 21 nt, Homo sapiens
ucuguuuccuggucagcaugu

SEQ ID NO: 785911 - RNA, 17 nt, Homo sapiens
ucuguuugcguacuugu

SEQ ID NO: 785912 - RNA, 19 nt, Homo sapiens
ucuguuugcguacuuguaa

SEQ ID NO: 785913 - RNA, 17 nt, Homo sapiens
ucuguuugucugaacaa

SEQ ID NO: 785914 - RNA, 16 nt, Homo sapiens
ucuguuuucuaccucc

SEQ ID NO: 785915 - RNA, 14 nt, Homo sapiens
ucuguuuugcacag

SEQ ID NO: 785916 - RNA, 16 nt, Homo sapiens
ucuuaaaaaacauaua

SEQ ID NO: 785917 - RNA, 17 nt, Homo sapiens
ucuuaaaaaacauauau

SEQ ID NO: 785918 - RNA, 22 nt, Homo sapiens
ucuuaaaauauaagaccucugg

SEQ ID NO: 785919 - RNA, 23 nt, Homo sapiens
ucuuaaaaucacucagcacucca

SEQ ID NO: 785920 - RNA, 21 nt, Homo sapiens
ucuuaaacuaaaugugcaaua

SEQ ID NO: 785921 - RNA, 22 nt, Homo sapiens
ucuuaaacuaaaugugcaauag

SEQ ID NO: 785922 - RNA, 19 nt, Homo sapiens
ucuuaacccccuagaaaga

SEQ ID NO: 785923 - RNA, 12 nt, Homo sapiens
ucuuaauacugu

SEQ ID NO: 785924 - RNA, 17 nt, Homo sapiens
ucuuaauuuacuuuaag

SEQ ID NO: 785925 - RNA, 17 nt, Homo sapiens
ucuuacaauugcacugc

SEQ ID NO: 785926 - RNA, 14 nt, Homo sapiens
ucuuacagcacauc

SEQ ID NO: 785927 - RNA, 16 nt, Homo sapiens
ucuuacaugcauuuga

SEQ ID NO: 785928 - RNA, 19 nt, Homo sapiens
ucuuaccuguaugucucca

SEQ ID NO: 785929 - RNA, 18 nt, Homo sapiens
ucuuaccuugaacugaag

SEQ ID NO: 785930 - RNA, 20 nt, Homo sapiens
ucuuacuucccuaaugaagu

SEQ ID NO: 785931 - RNA, 18 nt, Homo sapiens
ucuuagaaauacuuguga

SEQ ID NO: 785932 - RNA, 21 nt, Homo sapiens
ucuuagauguauauauuuccu

SEQ ID NO: 785933 - RNA, 16 nt, Homo sapiens
ucuuagcugucugcuc

SEQ ID NO: 785934 - RNA, 17 nt, Homo sapiens
ucuuagcuuacaggaag

SEQ ID NO: 785935 - RNA, 12 nt, Homo sapiens
ucuuagcuuucu

SEQ ID NO: 785936 - RNA, 14 nt, Homo sapiens
ucuuaguuguucag

SEQ ID NO: 785937 - RNA, 14 nt, Homo sapiens
ucuuauauauguga

SEQ ID NO: 785938 - RNA, 17 nt, Homo sapiens
ucuuaucaauucugaug

SEQ ID NO: 785939 - RNA, 15 nt, Homo sapiens
ucuuauguugaauau

SEQ ID NO: 785940 - RNA, 15 nt, Homo sapiens
ucuuauuccaggaga

SEQ ID NO: 785941 - RNA, 19 nt, Homo sapiens
ucuuauucuuuuguaauau

SEQ ID NO: 785942 - RNA, 16 nt, Homo sapiens
ucuuauuuaaugaaag

SEQ ID NO: 785943 - RNA, 16 nt, Homo sapiens
ucuuauuuauaccuca

SEQ ID NO: 785944 - RNA, 21 nt, Homo sapiens
ucuuauuuauaccucaguuug

SEQ ID NO: 785945 - RNA, 18 nt, Homo sapiens
ucuuauuugaaggccagc

SEQ ID NO: 785946 - RNA, 14 nt, Homo sapiens
ucuuauuuuagaca

SEQ ID NO: 785947 - RNA, 16 nt, Homo sapiens
ucuuauuuugcauucc

SEQ ID NO: 785948 - RNA, 16 nt, Homo sapiens
ucuucaaaacugccau

SEQ ID NO: 785949 - RNA, 19 nt, Homo sapiens
ucuucaaaggugacuucag

SEQ ID NO: 785950 - RNA, 22 nt, Homo sapiens
ucuucaagacgacagcucugua

SEQ ID NO: 785951 - RNA, 12 nt, Homo sapiens
ucuucaagagcu

SEQ ID NO: 785952 - RNA, 12 nt, Homo sapiens
ucuucacaggca

SEQ ID NO: 785953 - RNA, 12 nt, Homo sapiens
ucuucaccucag

SEQ ID NO: 785954 - RNA, 16 nt, Homo sapiens
ucuucagaagacacug

SEQ ID NO: 785955 - RNA, 13 nt, Homo sapiens
ucuucagagacag

SEQ ID NO: 785956 - RNA, 17 nt, Homo sapiens
ucuucagucucuauacc

SEQ ID NO: 785957 - RNA, 18 nt, Homo sapiens
ucuucagucucuauacca

SEQ ID NO: 785958 - RNA, 19 nt, Homo sapiens
ucuucauauucagcuugca

SEQ ID NO: 785959 - RNA, 21 nt, Homo sapiens
ucuucauauucuaaaaccauu

SEQ ID NO: 785960 - RNA, 11 nt, Homo sapiens
ucuucauccca

SEQ ID NO: 785961 - RNA, 21 nt, Homo sapiens
ucuucaucugacuaugacaua

SEQ ID NO: 785962 - RNA, 17 nt, Homo sapiens
ucuucaugcgugcccuu

SEQ ID NO: 785963 - RNA, 18 nt, Homo sapiens
ucuucaugguguccauuu

SEQ ID NO: 785964 - RNA, 20 nt, Homo sapiens
ucuucaugguguccauuuua

SEQ ID NO: 785965 - RNA, 13 nt, Homo sapiens
ucuuccaaaaaga

SEQ ID NO: 785966 - RNA, 23 nt, Homo sapiens
ucuuccacuggaaaaguguaaua

SEQ ID NO: 785967 - RNA, 15 nt, Homo sapiens
ucuuccagaaggcaa

SEQ ID NO: 785968 - RNA, 13 nt, Homo sapiens
ucuuccagcccau

SEQ ID NO: 785969 - RNA, 14 nt, Homo sapiens
ucuucccauguccc

SEQ ID NO: 785970 - RNA, 15 nt, Homo sapiens
ucuucccccaccacc

SEQ ID NO: 785971 - RNA, 15 nt, Homo sapiens
ucuucccccaugugc

SEQ ID NO: 785972 - RNA, 22 nt, Homo sapiens
ucuucccgcaaaucaacacuuu

SEQ ID NO: 785973 - RNA, 23 nt, Homo sapiens
ucuucccuguaugauuccuugau

SEQ ID NO: 785974 - RNA, 22 nt, Homo sapiens
ucuuccguggucagagugccac

SEQ ID NO: 785975 - RNA, 14 nt, Homo sapiens
ucuuccugcccuug

SEQ ID NO: 785976 - RNA, 23 nt, Homo sapiens
ucuucgcugugaugcaugagcuc

SEQ ID NO: 785977 - RNA, 19 nt, Homo sapiens
ucuucguauucccauuaga

SEQ ID NO: 785978 - RNA, 15 nt, Homo sapiens
ucuucuaaauggcaa

SEQ ID NO: 785979 - RNA, 14 nt, Homo sapiens
ucuucuaacacaaa

SEQ ID NO: 785980 - RNA, 15 nt, Homo sapiens
ucuucuaauuccuca

SEQ ID NO: 785981 - RNA, 14 nt, Homo sapiens
ucuucuacugcuau

SEQ ID NO: 785982 - RNA, 23 nt, Homo sapiens
ucuucucaaguucuaagauucua

SEQ ID NO: 785983 - RNA, 20 nt, Homo sapiens
ucuucuccuaaaacuuuaaa

SEQ ID NO: 785984 - RNA, 18 nt, Homo sapiens
ucuucugauuugucccua

SEQ ID NO: 785985 - RNA, 20 nt, Homo sapiens
ucuucugcaaaaauggauau

SEQ ID NO: 785986 - RNA, 16 nt, Homo sapiens
ucuucuggauuagaau

SEQ ID NO: 785987 - RNA, 18 nt, Homo sapiens
ccagccugggcaacagau

SEQ ID NO: 785988 - RNA, 20 nt, Homo sapiens
ccagccugggugacagagca

SEQ ID NO: 785989 - RNA, 17 nt, Homo sapiens
ccagccuuccucugcag

SEQ ID NO: 785990 - RNA, 14 nt, Homo sapiens
ccagcgcaccuguu

SEQ ID NO: 785991 - RNA, 13 nt, Homo sapiens
ccagcgggcacag

SEQ ID NO: 785992 - RNA, 17 nt, Homo sapiens
ccagcgggcacagggca

SEQ ID NO: 785993 - RNA, 18 nt, Homo sapiens
ccagcgucacuccagugc

SEQ ID NO: 785994 - RNA, 13 nt, Homo sapiens
ccagcguggcgca

SEQ ID NO: 785995 - RNA, 15 nt, Homo sapiens
ccagcguguggagca

SEQ ID NO: 785996 - RNA, 13 nt, Homo sapiens
ccagcuacauucc

SEQ ID NO: 785997 - RNA, 21 nt, Homo sapiens
ccagcuauugggaaggaugag

SEQ ID NO: 785998 - RNA, 18 nt, Homo sapiens
ccagcucacgucacacuu

SEQ ID NO: 785999 - RNA, 20 nt, Homo sapiens
ccagcuccaaccugcaaaga

SEQ ID NO: 786000 - RNA, 21 nt, Homo sapiens
ccagcuccaaccugcaaagau

SEQ ID NO: 786001 - RNA, 17 nt, Homo sapiens
ccagcuccaugcuccag

SEQ ID NO: 786002 - RNA, 15 nt, Homo sapiens
ccagcuccugggcag

SEQ ID NO: 786003 - RNA, 11 nt, Homo sapiens
ccagcugccag

SEQ ID NO: 786004 - RNA, 13 nt, Homo sapiens
ccagcuggcagac

SEQ ID NO: 786005 - RNA, 12 nt, Homo sapiens
ccagcugucacu

SEQ ID NO: 786006 - RNA, 16 nt, Homo sapiens
ccagcugugcacuuuc

SEQ ID NO: 786007 - RNA, 22 nt, Homo sapiens
ccagcugugcacuuucuucucu

SEQ ID NO: 786008 - RNA, 16 nt, Homo sapiens
ccagcuuagaguucuu

SEQ ID NO: 786009 - RNA, 17 nt, Homo sapiens
ccagcuucaaaugcaaa

SEQ ID NO: 786010 - RNA, 14 nt, Homo sapiens
ccagcuucaggcag

SEQ ID NO: 786011 - RNA, 14 nt, Homo sapiens
ccagcuuccugugu

SEQ ID NO: 786012 - RNA, 20 nt, Homo sapiens
ccagcuucucucuccagggu

SEQ ID NO: 786013 - RNA, 19 nt, Homo sapiens
ccagcuugggcccagcugg

SEQ ID NO: 786014 - RNA, 17 nt, Homo sapiens
ccagcuuuccucaucag

SEQ ID NO: 786015 - RNA, 18 nt, Homo sapiens
ccagcuuuggcugcugaa

SEQ ID NO: 786016 - RNA, 20 nt, Homo sapiens
ccaggaacguuucugaacaa

SEQ ID NO: 786017 - RNA, 21 nt, Homo sapiens
ccaggaaggaagcuguugcuu

SEQ ID NO: 786018 - RNA, 18 nt, Homo sapiens
ccaggacacgacuuguaa

SEQ ID NO: 786019 - RNA, 23 nt, Homo sapiens
ccaggaccagccuguaccuugcu

SEQ ID NO: 786020 - RNA, 14 nt, Homo sapiens
ccaggaccagcugg

SEQ ID NO: 786021 - RNA, 22 nt, Homo sapiens
ccaggacccugaaggggccaug

SEQ ID NO: 786022 - RNA, 20 nt, Homo sapiens
ccaggacggaugggcccuau

SEQ ID NO: 786023 - RNA, 13 nt, Homo sapiens
ccaggacugggcc

SEQ ID NO: 786024 - RNA, 19 nt, Homo sapiens
ccauccuguuuguaugaaa

SEQ ID NO: 786025 - RNA, 18 nt, Homo sapiens
ccauccuucccuuuggag

SEQ ID NO: 786026 - RNA, 22 nt, Homo sapiens
ccaucucuacugaaaguacaaa

SEQ ID NO: 786027 - RNA, 13 nt, Homo sapiens
ccaucucuuuacc

SEQ ID NO: 786028 - RNA, 14 nt, Homo sapiens
ccaucugauuuacu

SEQ ID NO: 786029 - RNA, 21 nt, Homo sapiens
ccaucugauuuacuuaauuca

SEQ ID NO: 786030 - RNA, 18 nt, Homo sapiens
ccaucugcuugguuggcu

SEQ ID NO: 786031 - RNA, 15 nt, Homo sapiens
ccaucuucuauucaa

SEQ ID NO: 786032 - RNA, 21 nt, Homo sapiens
ccaucuuguaaaggauauuaa

SEQ ID NO: 786033 - RNA, 17 nt, Homo sapiens
ccaucuugugguaacuu

SEQ ID NO: 786034 - RNA, 23 nt, Homo sapiens
ccaucuugugguaacuugcugcu

SEQ ID NO: 786035 - RNA, 12 nt, Homo sapiens
ccaugaacauca

SEQ ID NO: 786036 - RNA, 23 nt, Homo sapiens
ccaugaacaucuuuagugucuga

SEQ ID NO: 786037 - RNA, 17 nt, Homo sapiens
ccaugaauuaguucucc

SEQ ID NO: 786038 - RNA, 19 nt, Homo sapiens
ccaugacguguuucuugaa

SEQ ID NO: 786039 - RNA, 23 nt, Homo sapiens
ccaugacuggcugucugccugua

SEQ ID NO: 786040 - RNA, 20 nt, Homo sapiens
ccaugaggaaggaacagcaa

SEQ ID NO: 786041 - RNA, 22 nt, Homo sapiens
ccaugauggccuuacacugaaa

SEQ ID NO: 786042 - RNA, 22 nt, Homo sapiens
ccaugcaggggucagugcagca

SEQ ID NO: 786043 - RNA, 21 nt, Homo sapiens
ccaugccacugccaggcaccu

SEQ ID NO: 786044 - RNA, 21 nt, Homo sapiens
ccaugccaggaaccuguccua

SEQ ID NO: 786045 - RNA, 17 nt, Homo sapiens
ccaugccccuggaccag

SEQ ID NO: 786046 - RNA, 20 nt, Homo sapiens
ccaugcugggccacugggga

SEQ ID NO: 786047 - RNA, 21 nt, Homo sapiens
ccauggaggccagugccagca

SEQ ID NO: 786048 - RNA, 16 nt, Homo sapiens
ccauggauugauucag

SEQ ID NO: 786049 - RNA, 22 nt, Homo sapiens
ccauggauugauucagucuucu

SEQ ID NO: 786050 - RNA, 22 nt, Homo sapiens
ccauggcccccaauaaaggcag

SEQ ID NO: 786051 - RNA, 23 nt, Homo sapiens
ccauggcccccaauaaaggcagc

SEQ ID NO: 786052 - RNA, 15 nt, Homo sapiens
ccauggccugugcug

SEQ ID NO: 786053 - RNA, 16 nt, Homo sapiens
ccauggugacauugug

SEQ ID NO: 786054 - RNA, 13 nt, Homo sapiens
ccaugguuuuacu

SEQ ID NO: 786055 - RNA, 17 nt, Homo sapiens
ccauguaaauugcaaau

SEQ ID NO: 786056 - RNA, 17 nt, Homo sapiens
ccauguaagguugugca

SEQ ID NO: 786057 - RNA, 14 nt, Homo sapiens
ccauguaaugugua

SEQ ID NO: 786058 - RNA, 16 nt, Homo sapiens
ccauguacaugaagaa

SEQ ID NO: 786059 - RNA, 13 nt, Homo sapiens
ccauguccaaaga

SEQ ID NO: 786060 - RNA, 14 nt, Homo sapiens
ccauguccaaagag

SEQ ID NO: 786061 - RNA, 21 nt, Homo sapiens
ccauguccaaagaggcugccc

SEQ ID NO: 786062 - RNA, 14 nt, Homo sapiens
ccaugugaacagca

SEQ ID NO: 786063 - RNA, 12 nt, Homo sapiens
ccaugugcaaua

SEQ ID NO: 786064 - RNA, 20 nt, Homo sapiens
ccaugugccugcaccaggag

SEQ ID NO: 786065 - RNA, 12 nt, Homo sapiens
ccaugugccuuu

SEQ ID NO: 786066 - RNA, 20 nt, Homo sapiens
ccaugugccuuucuuugccu

SEQ ID NO: 786067 - RNA, 18 nt, Homo sapiens
ccaugugcuagucacugg

SEQ ID NO: 786068 - RNA, 23 nt, Homo sapiens
ccauguggcugaagacauuccaa

SEQ ID NO: 786069 - RNA, 20 nt, Homo sapiens
ccauguucauuauaaucuca

SEQ ID NO: 786070 - RNA, 13 nt, Homo sapiens
ccauguugcugcc

SEQ ID NO: 786071 - RNA, 21 nt, Homo sapiens
ccauguugcugccaaccauac

SEQ ID NO: 786072 - RNA, 17 nt, Homo sapiens
ccauguuguaaugcugc

SEQ ID NO: 786073 - RNA, 19 nt, Homo sapiens
ccauguuguaaugcugcac

SEQ ID NO: 786074 - RNA, 15 nt, Homo sapiens
ccauuaauuacauac

SEQ ID NO: 786075 - RNA, 16 nt, Homo sapiens
ccauuacagagguauu

SEQ ID NO: 786076 - RNA, 12 nt, Homo sapiens
ccauuaccaaaa

SEQ ID NO: 786077 - RNA, 16 nt, Homo sapiens
ccauuaccuccaucca

SEQ ID NO: 786078 - RNA, 15 nt, Homo sapiens
ccauuagaccaagcu

SEQ ID NO: 786079 - RNA, 13 nt, Homo sapiens
ccauuaugccugg

SEQ ID NO: 786080 - RNA, 19 nt, Homo sapiens
ccauuauguaauagugaca

SEQ ID NO: 786081 - RNA, 10 nt, Homo sapiens
ccauuauuca

SEQ ID NO: 786082 - RNA, 14 nt, Homo sapiens
ccauucacuacuca

SEQ ID NO: 786083 - RNA, 18 nt, Homo sapiens
ccauucagaaagcauuua

SEQ ID NO: 786084 - RNA, 23 nt, Homo sapiens
ccauucagaugaauagauggaau

SEQ ID NO: 786085 - RNA, 17 nt, Homo sapiens
ccauuccagacugcuuc

SEQ ID NO: 786086 - RNA, 23 nt, Homo sapiens
ccauucuguuuggaucuauagaa

SEQ ID NO: 786087 - RNA, 15 nt, Homo sapiens
ccauugaacucugag

SEQ ID NO: 786088 - RNA, 14 nt, Homo sapiens
ccauugaccagcuc

SEQ ID NO: 786089 - RNA, 17 nt, Homo sapiens
ccauuggauuuuuucca

SEQ ID NO: 786090 - RNA, 16 nt, Homo sapiens
ccauugucagcucaau

SEQ ID NO: 786091 - RNA, 14 nt, Homo sapiens
ccauuuaaguaucu

SEQ ID NO: 786092 - RNA, 14 nt, Homo sapiens
ccauuuacaaauaa

SEQ ID NO: 786093 - RNA, 21 nt, Homo sapiens
ccauuuauaauguuaguagaa

SEQ ID NO: 786094 - RNA, 13 nt, Homo sapiens
ccauuuaucuuuu

SEQ ID NO: 786095 - RNA, 13 nt, Homo sapiens
ccauuuguaauaa

SEQ ID NO: 786096 - RNA, 15 nt, Homo sapiens
ccauuugugccagag

SEQ ID NO: 786097 - RNA, 17 nt, Homo sapiens
ccauuuguuuaaauuca

SEQ ID NO: 786098 - RNA, 23 nt, Homo sapiens
ccauuuugaagugggauguuaau

SEQ ID NO: 786099 - RNA, 18 nt, Homo sapiens
cccaaaaaagucaagaac

SEQ ID NO: 786100 - RNA, 18 nt, Homo sapiens
cccaaaacccugaagcca

SEQ ID NO: 786101 - RNA, 19 nt, Homo sapiens
cccaaaacccugaagccau

SEQ ID NO: 786102 - RNA, 16 nt, Homo sapiens
ugaaaacccagacugu

SEQ ID NO: 786103 - RNA, 21 nt, Homo sapiens
ugaaaacuuagagagguacaa

SEQ ID NO: 786104 - RNA, 16 nt, Homo sapiens
ugaaaagaauuugaug

SEQ ID NO: 786105 - RNA, 22 nt, Homo sapiens
ugaaaagauucuucuguguuua

SEQ ID NO: 786106 - RNA, 19 nt, Homo sapiens
ugaaaaggacuucuggcua

SEQ ID NO: 786107 - RNA, 20 nt, Homo sapiens
ugaaaaguagagaaauggau

SEQ ID NO: 786108 - RNA, 15 nt, Homo sapiens
ugaaaauaaaaagag

SEQ ID NO: 786109 - RNA, 17 nt, Homo sapiens
ugaaaauaaaaagagaa

SEQ ID NO: 786110 - RNA, 18 nt, Homo sapiens
ugaaaauauagacauucu

SEQ ID NO: 786111 - RNA, 20 nt, Homo sapiens
ugaaaauauuuuguugccuu

SEQ ID NO: 786112 - RNA, 16 nt, Homo sapiens
ugaaaaugaauaucua

SEQ ID NO: 786113 - RNA, 19 nt, Homo sapiens
ugaaaaugagcaucagaga

SEQ ID NO: 786114 - RNA, 21 nt, Homo sapiens
ugaaaaugucagaaaccaguu

SEQ ID NO: 786115 - RNA, 13 nt, Homo sapiens
ugaaaauguguuc

SEQ ID NO: 786116 - RNA, 19 nt, Homo sapiens
ugaaaauguuuuucugcca

SEQ ID NO: 786117 - RNA, 17 nt, Homo sapiens
ugaaaauuagagaucau

SEQ ID NO: 786118 - RNA, 20 nt, Homo sapiens
ugaaaauuauuuuguucaua

SEQ ID NO: 786119 - RNA, 20 nt, Homo sapiens
ugaaaauucgaaccaggaaa

SEQ ID NO: 786120 - RNA, 16 nt, Homo sapiens
ugaaaauugcaauaca

SEQ ID NO: 786121 - RNA, 20 nt, Homo sapiens
ugaaaauugggcaugccauu

SEQ ID NO: 786122 - RNA, 15 nt, Homo sapiens
ugaaaauuguagggu

SEQ ID NO: 786123 - RNA, 16 nt, Homo sapiens
ugaaacacacgugcug

SEQ ID NO: 786124 - RNA, 16 nt, Homo sapiens
ugaaacauggcugugu

SEQ ID NO: 786125 - RNA, 20 nt, Homo sapiens
ugaaaccauacagcuucaua

SEQ ID NO: 786126 - RNA, 20 nt, Homo sapiens
ugaaaccccaucucuacuaa

SEQ ID NO: 786127 - RNA, 20 nt, Homo sapiens
ugaaaccccaucucuacuga

SEQ ID NO: 786128 - RNA, 16 nt, Homo sapiens
ugaaacccccaucucu

SEQ ID NO: 786129 - RNA, 22 nt, Homo sapiens
ugaaacccuuguauaaguaaua

SEQ ID NO: 786130 - RNA, 19 nt, Homo sapiens
ugaaaccuacacacuguca

SEQ ID NO: 786131 - RNA, 15 nt, Homo sapiens
ugaaaccucaucucu

SEQ ID NO: 786132 - RNA, 17 nt, Homo sapiens
ugaaacgucauguguuu

SEQ ID NO: 786133 - RNA, 16 nt, Homo sapiens
ugaaacguuuaugcuu

SEQ ID NO: 786134 - RNA, 14 nt, Homo sapiens
ugaaacuaacagau

SEQ ID NO: 786135 - RNA, 21 nt, Homo sapiens
ugaaacucauagacacugauc

SEQ ID NO: 786136 - RNA, 12 nt, Homo sapiens
ugaaacugaaag

SEQ ID NO: 786137 - RNA, 23 nt, Homo sapiens
ugaaacugagaugugaacacauc

SEQ ID NO: 786138 - RNA, 22 nt, Homo sapiens
ugaauaaacugaaaauggaccu

SEQ ID NO: 786139 - RNA, 15 nt, Homo sapiens
ugaauaaaguguaag

SEQ ID NO: 786140 - RNA, 21 nt, Homo sapiens
ugaauaaaguguaaguucaca

SEQ ID NO: 786141 - RNA, 14 nt, Homo sapiens
ugaauaacugagcu

SEQ ID NO: 786142 - RNA, 13 nt, Homo sapiens
ugaauacauuucc

SEQ ID NO: 786143 - RNA, 21 nt, Homo sapiens
ugaauacugcauuuacagugu

SEQ ID NO: 786144 - RNA, 22 nt, Homo sapiens
ugaauacugcauuuacagugua

SEQ ID NO: 786145 - RNA, 14 nt, Homo sapiens
ugaauacuugcuau

SEQ ID NO: 786146 - RNA, 16 nt, Homo sapiens
ugaauaggaauauuca

SEQ ID NO: 786147 - RNA, 15 nt, Homo sapiens
ugaauaggaugauuc

SEQ ID NO: 786148 - RNA, 15 nt, Homo sapiens
ugaauagugaggcug

SEQ ID NO: 786149 - RNA, 19 nt, Homo sapiens
ugaauaucaggcuauuauu

SEQ ID NO: 786150 - RNA, 13 nt, Homo sapiens
ugaauauguagcu

SEQ ID NO: 786151 - RNA, 22 nt, Homo sapiens
ugaauauuccuggacuuacaaa

SEQ ID NO: 786152 - RNA, 13 nt, Homo sapiens
ugaauauuucaua

SEQ ID NO: 786153 - RNA, 14 nt, Homo sapiens
ugaauauuugccac

SEQ ID NO: 786154 - RNA, 18 nt, Homo sapiens
ugaaucaaaucucuucca

SEQ ID NO: 786155 - RNA, 23 nt, Homo sapiens
ugaaucacauuuuuuuaugcucu

SEQ ID NO: 786156 - RNA, 21 nt, Homo sapiens
ugaaucagauguguguucuca

SEQ ID NO: 786157 - RNA, 20 nt, Homo sapiens
ugaaucauauucauaugcag

SEQ ID NO: 786158 - RNA, 18 nt, Homo sapiens
ugaauccaaacuaaucca

SEQ ID NO: 786159 - RNA, 17 nt, Homo sapiens
ugaauccucaugaggcu

SEQ ID NO: 786160 - RNA, 15 nt, Homo sapiens
ugaaucuacauucac

SEQ ID NO: 786161 - RNA, 14 nt, Homo sapiens
ugaaucuacauuug

SEQ ID NO: 786162 - RNA, 17 nt, Homo sapiens
ugaaucuauuauacugu

SEQ ID NO: 786163 - RNA, 23 nt, Homo sapiens
ugaaucucaccugcuggggaccu

SEQ ID NO: 786164 - RNA, 16 nt, Homo sapiens
ugaaugagagguuccu

SEQ ID NO: 786165 - RNA, 15 nt, Homo sapiens
ugaaugcagaagcaa

SEQ ID NO: 786166 - RNA, 20 nt, Homo sapiens
ugaaugccguggauugcacg

SEQ ID NO: 786167 - RNA, 21 nt, Homo sapiens
ugaaugccucgcucccuucaa

SEQ ID NO: 786168 - RNA, 13 nt, Homo sapiens
ugaaugcugccag

SEQ ID NO: 786169 - RNA, 17 nt, Homo sapiens
ugaauggaaaacacaug

SEQ ID NO: 786170 - RNA, 15 nt, Homo sapiens
ugaauggccugccuu

SEQ ID NO: 786171 - RNA, 18 nt, Homo sapiens
ugaauggggucucaaagu

SEQ ID NO: 786172 - RNA, 17 nt, Homo sapiens
ugaaugucuuacuguga

SEQ ID NO: 786173 - RNA, 23 nt, Homo sapiens
ugaaugugguuacuuccuacugu

SEQ ID NO: 786174 - RNA, 13 nt, Homo sapiens
ugaaugugucacu

SEQ ID NO: 786175 - RNA, 20 nt, Homo sapiens
ugaauguuacuaaauuuucu

SEQ ID NO: 786176 - RNA, 18 nt, Homo sapiens
ugaauuaaaagucuacag

SEQ ID NO: 786177 - RNA, 14 nt, Homo sapiens
ugaauuacagugaa

SEQ ID NO: 786178 - RNA, 16 nt, Homo sapiens
ugaauuaugcuuccac

SEQ ID NO: 786179 - RNA, 18 nt, Homo sapiens
ugaauuauucugauucuu

SEQ ID NO: 786180 - RNA, 18 nt, Homo sapiens
ugaauuauugacacugaa

SEQ ID NO: 786181 - RNA, 13 nt, Homo sapiens
ugaauucaagaaa

SEQ ID NO: 786182 - RNA, 13 nt, Homo sapiens
ugaauucacuuaa

SEQ ID NO: 786183 - RNA, 22 nt, Homo sapiens
ugaauucggaacuguccuuucc

SEQ ID NO: 786184 - RNA, 15 nt, Homo sapiens
ugaauucuaacauua

SEQ ID NO: 786185 - RNA, 15 nt, Homo sapiens
ugaauugaaauguuc

SEQ ID NO: 786186 - RNA, 18 nt, Homo sapiens
ugaauugaguuuguaauu

SEQ ID NO: 786187 - RNA, 12 nt, Homo sapiens
ugaauugcacau

SEQ ID NO: 786188 - RNA, 22 nt, Homo sapiens
ugaauuucaacgccugccuuug

SEQ ID NO: 786189 - RNA, 14 nt, Homo sapiens
ugaauuucaucuca

SEQ ID NO: 786190 - RNA, 15 nt, Homo sapiens
ugaauuucuaaaaaa

SEQ ID NO: 786191 - RNA, 15 nt, Homo sapiens
ugaauuucugaaaga

SEQ ID NO: 786192 - RNA, 21 nt, Homo sapiens
ugaauuuggucuguauagucu

SEQ ID NO: 786193 - RNA, 21 nt, Homo sapiens
ugaauuuucaaguaauuguga

SEQ ID NO: 786194 - RNA, 13 nt, Homo sapiens
ugacaaacauauc

SEQ ID NO: 786195 - RNA, 12 nt, Homo sapiens
ugacaaaccauc

SEQ ID NO: 786196 - RNA, 16 nt, Homo sapiens
ugacaacaucgcaaua

SEQ ID NO: 786197 - RNA, 12 nt, Homo sapiens
ugacaaccucuu

SEQ ID NO: 786198 - RNA, 12 nt, Homo sapiens
ugacaacuguga

SEQ ID NO: 786199 - RNA, 22 nt, Homo sapiens
ugacaacugugacuguacccaa

SEQ ID NO: 786200 - RNA, 16 nt, Homo sapiens
ugacaacuuagcucag

SEQ ID NO: 786201 - RNA, 15 nt, Homo sapiens
ugacaagaauuguua

SEQ ID NO: 786202 - RNA, 20 nt, Homo sapiens
ugacaagcugacuuggcacu

SEQ ID NO: 786203 - RNA, 20 nt, Homo sapiens
ugacaagugagacaaaaagc

SEQ ID NO: 786204 - RNA, 19 nt, Homo sapiens
ugacaauugggagcugcca

SEQ ID NO: 786205 - RNA, 23 nt, Homo sapiens
ugacacaaagguggaauaaacau

SEQ ID NO: 786206 - RNA, 21 nt, Homo sapiens
ugacacaaucucggcucacug

SEQ ID NO: 786207 - RNA, 16 nt, Homo sapiens
ugacacacagcacucu

SEQ ID NO: 786208 - RNA, 15 nt, Homo sapiens
ugacacauaugaaca

SEQ ID NO: 786209 - RNA, 14 nt, Homo sapiens
ugacacauuacaaa

SEQ ID NO: 786210 - RNA, 15 nt, Homo sapiens
ugacacauuacaaag

SEQ ID NO: 786211 - RNA, 20 nt, Homo sapiens
ugacaccagccuuucuccca

SEQ ID NO: 786212 - RNA, 21 nt, Homo sapiens
ugacaccauucuccugccuca

SEQ ID NO: 786213 - RNA, 14 nt, Homo sapiens
ugacacccaugcca

SEQ ID NO: 786214 - RNA, 22 nt, Homo sapiens
ugacacccuggccugaacugag

SEQ ID NO: 786215 - RNA, 20 nt, Homo sapiens
ugacaccgucccucagugau

SEQ ID NO: 786216 - RNA, 19 nt, Homo sapiens
ugacacuagcuaauaucaa

SEQ ID NO: 786217 - RNA, 16 nt, Homo sapiens
cccagucucaaaggcc

SEQ ID NO: 786218 - RNA, 12 nt, Homo sapiens
cccagugcaaac

SEQ ID NO: 786219 - RNA, 20 nt, Homo sapiens
cccagugcaaaugcaugcuu

SEQ ID NO: 786220 - RNA, 19 nt, Homo sapiens
cccagugccuagaugcaug

SEQ ID NO: 786221 - RNA, 12 nt, Homo sapiens
cccagugccuuc

SEQ ID NO: 786222 - RNA, 15 nt, Homo sapiens
cccaguggauuugga

SEQ ID NO: 786223 - RNA, 19 nt, Homo sapiens
cccaguguaugucuuguau

SEQ ID NO: 786224 - RNA, 15 nt, Homo sapiens
cccaguguccuucca

SEQ ID NO: 786225 - RNA, 14 nt, Homo sapiens
cccaguucaucacc

SEQ ID NO: 786226 - RNA, 21 nt, Homo sapiens
cccaguucauugcacuuugau

SEQ ID NO: 786227 - RNA, 15 nt, Homo sapiens
cccauaaccauacac

SEQ ID NO: 786228 - RNA, 17 nt, Homo sapiens
cccauaauuuucuucau

SEQ ID NO: 786229 - RNA, 17 nt, Homo sapiens
cccauagaaacaugaca

SEQ ID NO: 786230 - RNA, 21 nt, Homo sapiens
cccauagcacugggcucugau

SEQ ID NO: 786231 - RNA, 22 nt, Homo sapiens
cccauaucuacaguacuuccag

SEQ ID NO: 786232 - RNA, 17 nt, Homo sapiens
cccauaucugugaaaug

SEQ ID NO: 786233 - RNA, 20 nt, Homo sapiens
cccaucagacugucaagaag

SEQ ID NO: 786234 - RNA, 16 nt, Homo sapiens
cccaucagcuccagcu

SEQ ID NO: 786235 - RNA, 19 nt, Homo sapiens
cccaucagggcccagggag

SEQ ID NO: 786236 - RNA, 23 nt, Homo sapiens
cccauccauuaggccagcaacgc

SEQ ID NO: 786237 - RNA, 15 nt, Homo sapiens
cccaucccugucauu

SEQ ID NO: 786238 - RNA, 13 nt, Homo sapiens
cccauccuagugg

SEQ ID NO: 786239 - RNA, 19 nt, Homo sapiens
cccaucgguaggcaaagga

SEQ ID NO: 786240 - RNA, 16 nt, Homo sapiens
cccaucucuacuaaaa

SEQ ID NO: 786241 - RNA, 14 nt, Homo sapiens
cccaucuggaugua

SEQ ID NO: 786242 - RNA, 13 nt, Homo sapiens
cccaucugggagu

SEQ ID NO: 786243 - RNA, 15 nt, Homo sapiens
cccaucugugcagua

SEQ ID NO: 786244 - RNA, 16 nt, Homo sapiens
cccaucuuacuggaag

SEQ ID NO: 786245 - RNA, 23 nt, Homo sapiens
cccaucuuccaacccacuggccc

SEQ ID NO: 786246 - RNA, 23 nt, Homo sapiens
cccaucuuguuucacacuaguca

SEQ ID NO: 786247 - RNA, 18 nt, Homo sapiens
cccaugagguacagcaga

SEQ ID NO: 786248 - RNA, 16 nt, Homo sapiens
cccaugaguccuugaa

SEQ ID NO: 786249 - RNA, 16 nt, Homo sapiens
cccaugcgugcugaga

SEQ ID NO: 786250 - RNA, 18 nt, Homo sapiens
cccaugcucaaccacugu

SEQ ID NO: 786251 - RNA, 20 nt, Homo sapiens
cccaugcucaaccacugugg

SEQ ID NO: 786252 - RNA, 21 nt, Homo sapiens
cccauggaaagagacugucau

SEQ ID NO: 786253 - RNA, 15 nt, Homo sapiens
cccauggaagcaaua

SEQ ID NO: 786254 - RNA, 22 nt, Homo sapiens
cccaugggcuaucaacuuaaua

SEQ ID NO: 786255 - RNA, 19 nt, Homo sapiens
cccauggguuaagagcuca

SEQ ID NO: 786256 - RNA, 10 nt, Homo sapiens
cccauguauu

SEQ ID NO: 786257 - RNA, 18 nt, Homo sapiens
cccauguccucagcauuu

SEQ ID NO: 786258 - RNA, 22 nt, Homo sapiens
cccaugugagucccugugaugg

SEQ ID NO: 786259 - RNA, 17 nt, Homo sapiens
cccauuauuauuucugu

SEQ ID NO: 786260 - RNA, 20 nt, Homo sapiens
cccauucucaaaaacaaaga

SEQ ID NO: 786261 - RNA, 21 nt, Homo sapiens
cccauuucaauuccugugauu

SEQ ID NO: 786262 - RNA, 9 nt, Homo sapiens
cccauuucu

SEQ ID NO: 786263 - RNA, 15 nt, Homo sapiens
cccauuucuauuuau

SEQ ID NO: 786264 - RNA, 18 nt, Homo sapiens
cccauuuguaauuuguaa

SEQ ID NO: 786265 - RNA, 21 nt, Homo sapiens
cccauuuucaacugcuuugaa

SEQ ID NO: 786266 - RNA, 15 nt, Homo sapiens
ccccaaacccugcuu

SEQ ID NO: 786267 - RNA, 13 nt, Homo sapiens
ccccaaagaucuc

SEQ ID NO: 786268 - RNA, 23 nt, Homo sapiens
ccccaacaucucccucccacauu

SEQ ID NO: 786269 - RNA, 12 nt, Homo sapiens
ccccaaccugcu

SEQ ID NO: 786270 - RNA, 17 nt, Homo sapiens
ccccaacuaguagcuaa

SEQ ID NO: 786271 - RNA, 12 nt, Homo sapiens
ccccaacuugag

SEQ ID NO: 786272 - RNA, 12 nt, Homo sapiens
ccccaagaauga

SEQ ID NO: 786273 - RNA, 18 nt, Homo sapiens
ccccaagauacucuuugu

SEQ ID NO: 786274 - RNA, 20 nt, Homo sapiens
ccccaaggacugagggcagu

SEQ ID NO: 786275 - RNA, 18 nt, Homo sapiens
ccccaauaaaggcagcug

SEQ ID NO: 786276 - RNA, 22 nt, Homo sapiens
ccccaaugacacccaugccaga

SEQ ID NO: 786277 - RNA, 21 nt, Homo sapiens
ccccacaccucccaccugcau

SEQ ID NO: 786278 - RNA, 16 nt, Homo sapiens
ccccacaccugcagug

SEQ ID NO: 786279 - RNA, 21 nt, Homo sapiens
ccccacaggcuggcgcucggc

SEQ ID NO: 786280 - RNA, 11 nt, Homo sapiens
ccccaccuacu

SEQ ID NO: 786281 - RNA, 12 nt, Homo sapiens
ccccacugacca

SEQ ID NO: 786282 - RNA, 14 nt, Homo sapiens
ccccacugcucucu

SEQ ID NO: 786283 - RNA, 12 nt, Homo sapiens
ccccacuuugaa

SEQ ID NO: 786284 - RNA, 23 nt, Homo sapiens
ccccagaaccuguccuugcacac

SEQ ID NO: 786285 - RNA, 13 nt, Homo sapiens
ccccagaguguga

SEQ ID NO: 786286 - RNA, 19 nt, Homo sapiens
ccccagauacauggugaug

SEQ ID NO: 786287 - RNA, 14 nt, Homo sapiens
ccccagcauuccag

SEQ ID NO: 786288 - RNA, 17 nt, Homo sapiens
ccccagcccuaaucuca

SEQ ID NO: 786289 - RNA, 23 nt, Homo sapiens
ccccaggcccaccaucaccaccg

SEQ ID NO: 786290 - RNA, 19 nt, Homo sapiens
ccccagguucuagucaugu

SEQ ID NO: 786291 - RNA, 14 nt, Homo sapiens
ccccaguccaugcu

SEQ ID NO: 786292 - RNA, 23 nt, Homo sapiens
ccccagugcagggaaccgugaua

SEQ ID NO: 786293 - RNA, 18 nt, Homo sapiens
ccccaucauuacugguaa

SEQ ID NO: 786294 - RNA, 15 nt, Homo sapiens
ccccaucuuccagcc

SEQ ID NO: 786295 - RNA, 18 nt, Homo sapiens
ccccaugccuguccagcc

SEQ ID NO: 786296 - RNA, 19 nt, Homo sapiens
ccccauucuauaaauucaa

SEQ ID NO: 786297 - RNA, 11 nt, Homo sapiens
cccccaaagcc

SEQ ID NO: 786298 - RNA, 20 nt, Homo sapiens
cccccaaagggccuccucac

SEQ ID NO: 786299 - RNA, 17 nt, Homo sapiens
cccccaaaguucacaau

SEQ ID NO: 786300 - RNA, 12 nt, Homo sapiens
cccccacugagc

SEQ ID NO: 786301 - RNA, 20 nt, Homo sapiens
cccccagaacauacacugug

SEQ ID NO: 786302 - RNA, 17 nt, Homo sapiens
cccccagccugccaaau

SEQ ID NO: 786303 - RNA, 22 nt, Homo sapiens
cccccaggaaggccacagugcu

SEQ ID NO: 786304 - RNA, 12 nt, Homo sapiens
cccccaguguaa

SEQ ID NO: 786305 - RNA, 15 nt, Homo sapiens
cccccagugugcaag

SEQ ID NO: 786306 - RNA, 17 nt, Homo sapiens
cccccaucauaagggca

SEQ ID NO: 786307 - RNA, 18 nt, Homo sapiens
cccccauucacuuuguca

SEQ ID NO: 786308 - RNA, 17 nt, Homo sapiens
ccccccaacacugugcc

SEQ ID NO: 786309 - RNA, 14 nt, Homo sapiens
cccccgccaccuca

SEQ ID NO: 786310 - RNA, 23 nt, Homo sapiens
cccccucaaaccuccucuucuga

SEQ ID NO: 786311 - RNA, 21 nt, Homo sapiens
cccccugucccauucuagauc

SEQ ID NO: 786312 - RNA, 12 nt, Homo sapiens
cccccuugaggg

SEQ ID NO: 786313 - RNA, 16 nt, Homo sapiens
cccccuuguuguaaaa

SEQ ID NO: 786314 - RNA, 17 nt, Homo sapiens
cccccuuguuguaaaaa

SEQ ID NO: 786315 - RNA, 15 nt, Homo sapiens
ccccgaaugucacug

SEQ ID NO: 786316 - RNA, 12 nt, Homo sapiens
ccccgacuuccu

SEQ ID NO: 786317 - RNA, 22 nt, Homo sapiens
ccccgauugaaagaaccagaga

SEQ ID NO: 786318 - RNA, 19 nt, Homo sapiens
ccccgccuccacucuaguu

SEQ ID NO: 786319 - RNA, 22 nt, Homo sapiens
ccccgcgcucgcccagcaggag

SEQ ID NO: 786320 - RNA, 23 nt, Homo sapiens
ccccgcucccaccuagugcccca

SEQ ID NO: 786321 - RNA, 12 nt, Homo sapiens
ccccguagcucc

SEQ ID NO: 786322 - RNA, 22 nt, Homo sapiens
ccccuaaugccuaucugaccaa

SEQ ID NO: 786323 - RNA, 15 nt, Homo sapiens
ccccuacacugugaa

SEQ ID NO: 786324 - RNA, 15 nt, Homo sapiens
ccccuacugcuguga

SEQ ID NO: 786325 - RNA, 22 nt, Homo sapiens
ccccuagugcuauucuguguug

SEQ ID NO: 786326 - RNA, 17 nt, Homo sapiens
ccccucacacuuugcca

SEQ ID NO: 786327 - RNA, 13 nt, Homo sapiens
ccccucaucucau

SEQ ID NO: 786328 - RNA, 15 nt, Homo sapiens
ccccuccaggaauga

SEQ ID NO: 786329 - RNA, 16 nt, Homo sapiens
ccccuccuccacucuc

SEQ ID NO: 786330 - RNA, 20 nt, Homo sapiens
ccccuccuccagccgcuggc

SEQ ID NO: 786331 - RNA, 20 nt, Homo sapiens
ccccuccugcugugcuggaa

SEQ ID NO: 786332 - RNA, 12 nt, Homo sapiens
ugacacuauuca

SEQ ID NO: 786333 - RNA, 12 nt, Homo sapiens
ugacacugauga

SEQ ID NO: 786334 - RNA, 11 nt, Homo sapiens
ugacacuggac

SEQ ID NO: 786335 - RNA, 18 nt, Homo sapiens
ugacagaagcuucugccc

SEQ ID NO: 786336 - RNA, 15 nt, Homo sapiens
ugacagaaggaacac

SEQ ID NO: 786337 - RNA, 12 nt, Homo sapiens
ugacagagccag

SEQ ID NO: 786338 - RNA, 22 nt, Homo sapiens
ugacagagcucuggguugugca

SEQ ID NO: 786339 - RNA, 18 nt, Homo sapiens
ugacagaguucacuauaa

SEQ ID NO: 786340 - RNA, 14 nt, Homo sapiens
ugacagauuuccau

SEQ ID NO: 786341 - RNA, 21 nt, Homo sapiens
ugacagcccugaacgugagca

SEQ ID NO: 786342 - RNA, 21 nt, Homo sapiens
ugacagccuccgucagacucc

SEQ ID NO: 786343 - RNA, 20 nt, Homo sapiens
ugacagcuucaugaaacugu

SEQ ID NO: 786344 - RNA, 20 nt, Homo sapiens
ugacagggacaugcccugug

SEQ ID NO: 786345 - RNA, 19 nt, Homo sapiens
ugacaggugccuguccuug

SEQ ID NO: 786346 - RNA, 21 nt, Homo sapiens
ugacaguauauuugaaacugu

SEQ ID NO: 786347 - RNA, 21 nt, Homo sapiens
ugacagucauaaauacuguca

SEQ ID NO: 786348 - RNA, 22 nt, Homo sapiens
ugacaguuaauaaaccuuugca

SEQ ID NO: 786349 - RNA, 17 nt, Homo sapiens
ugacaguugcagcccuu

SEQ ID NO: 786350 - RNA, 12 nt, Homo sapiens
ugacaguuuaca

SEQ ID NO: 786351 - RNA, 17 nt, Homo sapiens
ugacauaggcaauaaua

SEQ ID NO: 786352 - RNA, 20 nt, Homo sapiens
ugacaucaaagccuggccua

SEQ ID NO: 786353 - RNA, 14 nt, Homo sapiens
ugacaucacuugua

SEQ ID NO: 786354 - RNA, 19 nt, Homo sapiens
ugacaucccuuccuggaaa

SEQ ID NO: 786355 - RNA, 13 nt, Homo sapiens
ugacaugcacuga

SEQ ID NO: 786356 - RNA, 14 nt, Homo sapiens
ugacaugcacugac

SEQ ID NO: 786357 - RNA, 14 nt, Homo sapiens
ugacauuacuguau

SEQ ID NO: 786358 - RNA, 21 nt, Homo sapiens
ugacauugcuuuacugucaaa

SEQ ID NO: 786359 - RNA, 23 nt, Homo sapiens
ugacauuugucagugauguugcc

SEQ ID NO: 786360 - RNA, 20 nt, Homo sapiens
ugaccaaauaaaguaccauu

SEQ ID NO: 786361 - RNA, 14 nt, Homo sapiens
ugaccaagcaucuu

SEQ ID NO: 786362 - RNA, 15 nt, Homo sapiens
ugaccaaugugugaa

SEQ ID NO: 786363 - RNA, 22 nt, Homo sapiens
ugaccaaugugugaaguaugca

SEQ ID NO: 786364 - RNA, 19 nt, Homo sapiens
ugaccaauugugcugccau

SEQ ID NO: 786365 - RNA, 15 nt, Homo sapiens
ugaccacucuuggcu

SEQ ID NO: 786366 - RNA, 18 nt, Homo sapiens
ugaccacuugaggccuga

SEQ ID NO: 786367 - RNA, 15 nt, Homo sapiens
ugaccagcucucuuc

SEQ ID NO: 786368 - RNA, 18 nt, Homo sapiens
ccgagauccccagggcag

SEQ ID NO: 786369 - RNA, 20 nt, Homo sapiens
ccgaggacaguggcagacag

SEQ ID NO: 786370 - RNA, 14 nt, Homo sapiens
ccgaggacuuugau

SEQ ID NO: 786371 - RNA, 22 nt, Homo sapiens
ccgaggccugcauguccggcug

SEQ ID NO: 786372 - RNA, 15 nt, Homo sapiens
ccgagggauggugcc

SEQ ID NO: 786373 - RNA, 19 nt, Homo sapiens
ccgagguucgagucuugcu

SEQ ID NO: 786374 - RNA, 16 nt, Homo sapiens
ccgaguaacugagauu

SEQ ID NO: 786375 - RNA, 20 nt, Homo sapiens
ccgagucucuucuccacugg

SEQ ID NO: 786376 - RNA, 16 nt, Homo sapiens
ccgaugaacaaguuua

SEQ ID NO: 786377 - RNA, 22 nt, Homo sapiens
ccgaugcugaccucaccugguc

SEQ ID NO: 786378 - RNA, 15 nt, Homo sapiens
ccgaugguacuauuu

SEQ ID NO: 786379 - RNA, 13 nt, Homo sapiens
ccgcaagcagcug

SEQ ID NO: 786380 - RNA, 13 nt, Homo sapiens
ccgcaauacugua

SEQ ID NO: 786381 - RNA, 14 nt, Homo sapiens
ccgcacaugcacac

SEQ ID NO: 786382 - RNA, 16 nt, Homo sapiens
ccgcagacgggcacag

SEQ ID NO: 786383 - RNA, 17 nt, Homo sapiens
ccgcagcacccugcaga

SEQ ID NO: 786384 - RNA, 16 nt, Homo sapiens
ccgcagguuaugucag

SEQ ID NO: 786385 - RNA, 22 nt, Homo sapiens
ccgcagguuaugucagcagcuc

SEQ ID NO: 786386 - RNA, 12 nt, Homo sapiens
ccgcagugcaua

SEQ ID NO: 786387 - RNA, 22 nt, Homo sapiens
ccgcaucguggccuugaccucc

SEQ ID NO: 786388 - RNA, 14 nt, Homo sapiens
ccgcaugugaucuc

SEQ ID NO: 786389 - RNA, 20 nt, Homo sapiens
ccgccaccacgcccggcuaa

SEQ ID NO: 786390 - RNA, 22 nt, Homo sapiens
ccgccagcgaacuugacaauug

SEQ ID NO: 786391 - RNA, 21 nt, Homo sapiens
ccgccauugccaccaggagaa

SEQ ID NO: 786392 - RNA, 15 nt, Homo sapiens
ccgccugccugccac

SEQ ID NO: 786393 - RNA, 16 nt, Homo sapiens
ccgcucacugaacucc

SEQ ID NO: 786394 - RNA, 19 nt, Homo sapiens
ccgcucugcagacugcugc

SEQ ID NO: 786395 - RNA, 14 nt, Homo sapiens
ccgcugacugccac

SEQ ID NO: 786396 - RNA, 19 nt, Homo sapiens
ccgcugcgggcccagcuga

SEQ ID NO: 786397 - RNA, 15 nt, Homo sapiens
ccgcugucucugagg

SEQ ID NO: 786398 - RNA, 17 nt, Homo sapiens
ccggagagacagugaca

SEQ ID NO: 786399 - RNA, 19 nt, Homo sapiens
ccggcaacaucucugggaa

SEQ ID NO: 786400 - RNA, 18 nt, Homo sapiens
ccggcaccuacaucccca

SEQ ID NO: 786401 - RNA, 15 nt, Homo sapiens
ccggcccugugugca

SEQ ID NO: 786402 - RNA, 21 nt, Homo sapiens
ccggccucagggcgcucagac

SEQ ID NO: 786403 - RNA, 19 nt, Homo sapiens
ccggccuccugucccucau

SEQ ID NO: 786404 - RNA, 16 nt, Homo sapiens
ccggcugaaggcugag

SEQ ID NO: 786405 - RNA, 21 nt, Homo sapiens
ccggcugagggugggaggcaa

SEQ ID NO: 786406 - RNA, 11 nt, Homo sapiens
ccggcugugau

SEQ ID NO: 786407 - RNA, 13 nt, Homo sapiens
ccgggaagggugg

SEQ ID NO: 786408 - RNA, 14 nt, Homo sapiens
ccgggacacagaau

SEQ ID NO: 786409 - RNA, 23 nt, Homo sapiens
ccgggcaccaacuccauguuugg

SEQ ID NO: 786410 - RNA, 21 nt, Homo sapiens
ccgggcgugguggcacaugcc

SEQ ID NO: 786411 - RNA, 15 nt, Homo sapiens
ccggguccccagcuc

SEQ ID NO: 786412 - RNA, 17 nt, Homo sapiens
ccggucaugguggugga

SEQ ID NO: 786413 - RNA, 20 nt, Homo sapiens
ccggucguggggaaaucuca

SEQ ID NO: 786414 - RNA, 18 nt, Homo sapiens
ccgguucaggaccacuuu

SEQ ID NO: 786415 - RNA, 18 nt, Homo sapiens
ccguaacaacugugguca

SEQ ID NO: 786416 - RNA, 15 nt, Homo sapiens
ccguaucacaguguu

SEQ ID NO: 786417 - RNA, 13 nt, Homo sapiens
ccguccauuccag

SEQ ID NO: 786418 - RNA, 22 nt, Homo sapiens
ccgucucuacuaaaaauacaaa

SEQ ID NO: 786419 - RNA, 11 nt, Homo sapiens
ccgucuucucc

SEQ ID NO: 786420 - RNA, 20 nt, Homo sapiens
ccgugaagggauuucuuaau

SEQ ID NO: 786421 - RNA, 13 nt, Homo sapiens
ccgugaccaucuu

SEQ ID NO: 786422 - RNA, 14 nt, Homo sapiens
ccgugagaacauca

SEQ ID NO: 786423 - RNA, 21 nt, Homo sapiens
ccgugccaaaaaucuuuucau

SEQ ID NO: 786424 - RNA, 14 nt, Homo sapiens
ccgugccaaaagac

SEQ ID NO: 786425 - RNA, 17 nt, Homo sapiens
ccguggagacugagauc

SEQ ID NO: 786426 - RNA, 16 nt, Homo sapiens
ccguggagcaugcaac

SEQ ID NO: 786427 - RNA, 12 nt, Homo sapiens
ccguggagccuu

SEQ ID NO: 786428 - RNA, 19 nt, Homo sapiens
ccguguuacuguugcacug

SEQ ID NO: 786429 - RNA, 14 nt, Homo sapiens
ccguguucaaagag

SEQ ID NO: 786430 - RNA, 12 nt, Homo sapiens
ccguuaaucucu

SEQ ID NO: 786431 - RNA, 13 nt, Homo sapiens
ccuaaaggacucu

SEQ ID NO: 786432 - RNA, 23 nt, Homo sapiens
ccuaaagggcagggcccacgugu

SEQ ID NO: 786433 - RNA, 15 nt, Homo sapiens
ccuaaaucacuuuga

SEQ ID NO: 786434 - RNA, 15 nt, Homo sapiens
ccuaaaucccaagaa

SEQ ID NO: 786435 - RNA, 15 nt, Homo sapiens
ccuaaccucauuccc

SEQ ID NO: 786436 - RNA, 18 nt, Homo sapiens
ccuaagagaugggacuag

SEQ ID NO: 786437 - RNA, 21 nt, Homo sapiens
ccuaagagaugggacuaggac

SEQ ID NO: 786438 - RNA, 18 nt, Homo sapiens
ccuaagcuggagugcagu

SEQ ID NO: 786439 - RNA, 19 nt, Homo sapiens
ccuaaggacaagacacuga

SEQ ID NO: 786440 - RNA, 15 nt, Homo sapiens
ccuaauaucaauuug

SEQ ID NO: 786441 - RNA, 14 nt, Homo sapiens
ccuaauguuuauag

SEQ ID NO: 786442 - RNA, 23 nt, Homo sapiens
ccuaauucacacaaagacuccuu

SEQ ID NO: 786443 - RNA, 21 nt, Homo sapiens
ccuaauucucuucgcugugau

SEQ ID NO: 786444 - RNA, 18 nt, Homo sapiens
ccuacaacucacauuaga

SEQ ID NO: 786445 - RNA, 14 nt, Homo sapiens
ccuacaagauuuag

SEQ ID NO: 786446 - RNA, 23 nt, Homo sapiens
ccuacauugugcugcaccugguc

SEQ ID NO: 786447 - RNA, 14 nt, Homo sapiens
ccuaccacaguguc

SEQ ID NO: 786448 - RNA, 15 nt, Homo sapiens
ccuacccacuggucu

SEQ ID NO: 786449 - RNA, 15 nt, Homo sapiens
ugaggcuuccaggcu

SEQ ID NO: 786450 - RNA, 15 nt, Homo sapiens
ugaggcuucucagcc

SEQ ID NO: 786451 - RNA, 18 nt, Homo sapiens
ugagggaaauugcuauuu

SEQ ID NO: 786452 - RNA, 14 nt, Homo sapiens
ugagggagacugca

SEQ ID NO: 786453 - RNA, 21 nt, Homo sapiens
ugagggaggaagaaggcagug

SEQ ID NO: 786454 - RNA, 15 nt, Homo sapiens
ugagggccugcugga

SEQ ID NO: 786455 - RNA, 18 nt, Homo sapiens
ugagggcucacucagcca

SEQ ID NO: 786456 - RNA, 16 nt, Homo sapiens
ugaggggcuccuggaa

SEQ ID NO: 786457 - RNA, 16 nt, Homo sapiens
ugaggggcucucucau

SEQ ID NO: 786458 - RNA, 14 nt, Homo sapiens
ugagggggagcuga

SEQ ID NO: 786459 - RNA, 18 nt, Homo sapiens
ugagggugcugacuggcu

SEQ ID NO: 786460 - RNA, 21 nt, Homo sapiens
ugaggguguuucuuccugcac

SEQ ID NO: 786461 - RNA, 14 nt, Homo sapiens
ugagguacagcaga

SEQ ID NO: 786462 - RNA, 20 nt, Homo sapiens
ugaggugacugcagucugau

SEQ ID NO: 786463 - RNA, 22 nt, Homo sapiens
ugagguuuuguaaaacuguuau

SEQ ID NO: 786464 - RNA, 15 nt, Homo sapiens
ugaguacaugcacac

SEQ ID NO: 786465 - RNA, 20 nt, Homo sapiens
ugaguagauccaguauuuga

SEQ ID NO: 786466 - RNA, 17 nt, Homo sapiens
ugaguagggacucaggg

SEQ ID NO: 786467 - RNA, 18 nt, Homo sapiens
ugaguagggacucagggc

SEQ ID NO: 786468 - RNA, 19 nt, Homo sapiens
ugaguaucuguauguauau

SEQ ID NO: 786469 - RNA, 18 nt, Homo sapiens
ugaguauuccaugagcug

SEQ ID NO: 786470 - RNA, 13 nt, Homo sapiens
ugagucccuguga

SEQ ID NO: 786471 - RNA, 16 nt, Homo sapiens
ugaguccugguuuccu

SEQ ID NO: 786472 - RNA, 19 nt, Homo sapiens
ugagucuauguucaaagac

SEQ ID NO: 786473 - RNA, 22 nt, Homo sapiens
ugagugaaaauuuuuacauuca

SEQ ID NO: 786474 - RNA, 15 nt, Homo sapiens
ugaguggccugcuaa

SEQ ID NO: 786475 - RNA, 21 nt, Homo sapiens
ugaguuaacucacugagggua

SEQ ID NO: 786476 - RNA, 17 nt, Homo sapiens
ugaguuagaggagaaaa

SEQ ID NO: 786477 - RNA, 16 nt, Homo sapiens
ugaguucgaggacuac

SEQ ID NO: 786478 - RNA, 14 nt, Homo sapiens
ugaguucuacauaa

SEQ ID NO: 786479 - RNA, 22 nt, Homo sapiens
ugaguugcacuuauugaccauu

SEQ ID NO: 786480 - RNA, 19 nt, Homo sapiens
ugaguugcccaucuuguuu

SEQ ID NO: 786481 - RNA, 15 nt, Homo sapiens
ugaguugcuuuucag

SEQ ID NO: 786482 - RNA, 18 nt, Homo sapiens
ugaguugcuuuucagcug

SEQ ID NO: 786483 - RNA, 19 nt, Homo sapiens
cggagccaaugaacagcuc

SEQ ID NO: 786484 - RNA, 24 nt, Homo sapiens
cggagucuccucucuuggcaucga

SEQ ID NO: 786485 - RNA, 17 nt, Homo sapiens
cggagucuugcucuguu

SEQ ID NO: 786486 - RNA, 15 nt, Homo sapiens
cggagugccuggagu

SEQ ID NO: 786487 - RNA, 18 nt, Homo sapiens
cggaguucagacucucag

SEQ ID NO: 786488 - RNA, 15 nt, Homo sapiens
cggauacacacucga

SEQ ID NO: 786489 - RNA, 15 nt, Homo sapiens
cggcauggugccugg

SEQ ID NO: 786490 - RNA, 14 nt, Homo sapiens
cggccacgcacugg

SEQ ID NO: 786491 - RNA, 12 nt, Homo sapiens
cggccaggguug

SEQ ID NO: 786492 - RNA, 17 nt, Homo sapiens
cggcccagaaguuuccc

SEQ ID NO: 786493 - RNA, 16 nt, Homo sapiens
cggccccaucucucau

SEQ ID NO: 786494 - RNA, 18 nt, Homo sapiens
cggccccucccccugaga

SEQ ID NO: 786495 - RNA, 18 nt, Homo sapiens
cggcccgccaccugugac

SEQ ID NO: 786496 - RNA, 14 nt, Homo sapiens
cggcccugaccaau

SEQ ID NO: 786497 - RNA, 19 nt, Homo sapiens
cggcccugcugaagcugcu

SEQ ID NO: 786498 - RNA, 14 nt, Homo sapiens
cggccucccaaagu

SEQ ID NO: 786499 - RNA, 21 nt, Homo sapiens
cggccuccucuccuacuuugg

SEQ ID NO: 786500 - RNA, 18 nt, Homo sapiens
cggccucucaguucuuga

SEQ ID NO: 786501 - RNA, 17 nt, Homo sapiens
cggccucugccuuugca

SEQ ID NO: 786502 - RNA, 23 nt, Homo sapiens
cggccuggggcgagcacugugag

SEQ ID NO: 786503 - RNA, 21 nt, Homo sapiens
cggcgccacagaccccggguc

SEQ ID NO: 786504 - RNA, 14 nt, Homo sapiens
cggcgccaccaucc

SEQ ID NO: 786505 - RNA, 22 nt, Homo sapiens
cggcgugagccaccaugccugg

SEQ ID NO: 786506 - RNA, 21 nt, Homo sapiens
cggcuccuccuuaugacucca

SEQ ID NO: 786507 - RNA, 18 nt, Homo sapiens
cggcugaggccugagcga

SEQ ID NO: 786508 - RNA, 22 nt, Homo sapiens
cggcuguuccccucacccaaaa

SEQ ID NO: 786509 - RNA, 14 nt, Homo sapiens
cggcuucaccugcg

SEQ ID NO: 786510 - RNA, 12 nt, Homo sapiens
cggcuuuaccaa

SEQ ID NO: 786511 - RNA, 13 nt, Homo sapiens
cgggaaacacaca

SEQ ID NO: 786512 - RNA, 17 nt, Homo sapiens
cgggaaacacacaagca

SEQ ID NO: 786513 - RNA, 20 nt, Homo sapiens
cgggaaccucaucugccugg

SEQ ID NO: 786514 - RNA, 20 nt, Homo sapiens
cgggagcucuguauggucag

SEQ ID NO: 786515 - RNA, 20 nt, Homo sapiens
cgggaucucguaucuuuaaa

SEQ ID NO: 786516 - RNA, 18 nt, Homo sapiens
cgggcuccagccaucuca

SEQ ID NO: 786517 - RNA, 17 nt, Homo sapiens
cgggcugugcccgggga

SEQ ID NO: 786518 - RNA, 18 nt, Homo sapiens
cggggacuuuaccugcug

SEQ ID NO: 786519 - RNA, 15 nt, Homo sapiens
cggggcccacgcacg

SEQ ID NO: 786520 - RNA, 15 nt, Homo sapiens
cggggcccuguguag

SEQ ID NO: 786521 - RNA, 13 nt, Homo sapiens
cggggcugucacc

SEQ ID NO: 786522 - RNA, 18 nt, Homo sapiens
cgggggaccccuuugccc

SEQ ID NO: 786523 - RNA, 20 nt, Homo sapiens
cggggguucauaggucacug

SEQ ID NO: 786524 - RNA, 20 nt, Homo sapiens
cgggguugucgagaucucag

SEQ ID NO: 786525 - RNA, 15 nt, Homo sapiens
cgggucugagacuga

SEQ ID NO: 786526 - RNA, 14 nt, Homo sapiens
cggguggaucacaa

SEQ ID NO: 786527 - RNA, 20 nt, Homo sapiens
cgggugguccgggaagugag

SEQ ID NO: 786528 - RNA, 18 nt, Homo sapiens
cggguucaccauguugcc

SEQ ID NO: 786529 - RNA, 11 nt, Homo sapiens
cgguccagcug

SEQ ID NO: 786530 - RNA, 13 nt, Homo sapiens
cggugagaacucu

SEQ ID NO: 786531 - RNA, 16 nt, Homo sapiens
cggugcagcugagguu

SEQ ID NO: 786532 - RNA, 23 nt, Homo sapiens
cggugcauacacccccaccuccu

SEQ ID NO: 786533 - RNA, 14 nt, Homo sapiens
cggugcuccaucuc

SEQ ID NO: 786534 - RNA, 15 nt, Homo sapiens
cggugcuccaucucc

SEQ ID NO: 786535 - RNA, 15 nt, Homo sapiens
cgguggcucaugccu

SEQ ID NO: 786536 - RNA, 21 nt, Homo sapiens
cgguggggcguagacuugaca

SEQ ID NO: 786537 - RNA, 19 nt, Homo sapiens
cggugguucacgccuguaa

SEQ ID NO: 786538 - RNA, 20 nt, Homo sapiens
cgguguuuggcaaugcuaau

SEQ ID NO: 786539 - RNA, 18 nt, Homo sapiens
cgguuaagaaagcacuua

SEQ ID NO: 786540 - RNA, 17 nt, Homo sapiens
cgguuaccucugcaugg

SEQ ID NO: 786541 - RNA, 22 nt, Homo sapiens
cgguuuuuuauuuucuuuacaa

SEQ ID NO: 786542 - RNA, 11 nt, Homo sapiens
cguaaacuaug

SEQ ID NO: 786543 - RNA, 20 nt, Homo sapiens
cguaauuaaaggaacagagu

SEQ ID NO: 786544 - RNA, 15 nt, Homo sapiens
cguaauuaaauccaa

SEQ ID NO: 786545 - RNA, 22 nt, Homo sapiens
cguaauuaaauccaacuuucac

SEQ ID NO: 786546 - RNA, 12 nt, Homo sapiens
cguacauucaau

SEQ ID NO: 786547 - RNA, 18 nt, Homo sapiens
cguaggguggcacuggga

SEQ ID NO: 786548 - RNA, 23 nt, Homo sapiens
cguagguauuagugcuagucuca

SEQ ID NO: 786549 - RNA, 20 nt, Homo sapiens
cguaugguggcucaugucua

SEQ ID NO: 786550 - RNA, 22 nt, Homo sapiens
cgucauuuccggacucucugcu

SEQ ID NO: 786551 - RNA, 14 nt, Homo sapiens
cguccccaguugcc

SEQ ID NO: 786552 - RNA, 12 nt, Homo sapiens
cgucccuaagca

SEQ ID NO: 786553 - RNA, 12 nt, Homo sapiens
cgucccuaccuc

SEQ ID NO: 786554 - RNA, 19 nt, Homo sapiens
cguccucagcaguccacaa

SEQ ID NO: 786555 - RNA, 13 nt, Homo sapiens
cguccuccgucca

SEQ ID NO: 786556 - RNA, 18 nt, Homo sapiens
cguccuccguccauauca

SEQ ID NO: 786557 - RNA, 14 nt, Homo sapiens
cguccucucaguaa

SEQ ID NO: 786558 - RNA, 16 nt, Homo sapiens
cguccucucaguaaug

SEQ ID NO: 786559 - RNA, 13 nt, Homo sapiens
cguccuuccucuc

SEQ ID NO: 786560 - RNA, 15 nt, Homo sapiens
cgucuccucccucag

SEQ ID NO: 786561 - RNA, 20 nt, Homo sapiens
cgucucuacuaaaaauacaa

SEQ ID NO: 786562 - RNA, 16 nt, Homo sapiens
cgugaaagcagaugag

SEQ ID NO: 786563 - RNA, 17 nt, Homo sapiens
cgugagacccagugcac

SEQ ID NO: 786564 - RNA, 20 nt, Homo sapiens
cgugagugacauagccucau

SEQ ID NO: 786565 - RNA, 19 nt, Homo sapiens
cgugcaggcacacucagcg

SEQ ID NO: 786566 - RNA, 20 nt, Homo sapiens
cgugccagcucuaguuuuca

SEQ ID NO: 786567 - RNA, 19 nt, Homo sapiens
cgugcuacugcacuccagc

SEQ ID NO: 786568 - RNA, 14 nt, Homo sapiens
uggaaaaggaagac

SEQ ID NO: 786569 - RNA, 13 nt, Homo sapiens
uggaaaaguuuga

SEQ ID NO: 786570 - RNA, 19 nt, Homo sapiens
uggaaaaugccaugaauua

SEQ ID NO: 786571 - RNA, 12 nt, Homo sapiens
uggaaacagcau

SEQ ID NO: 786572 - RNA, 17 nt, Homo sapiens
uggaaacagcaugaaua

SEQ ID NO: 786573 - RNA, 22 nt, Homo sapiens
uggaaacauggaggaacaguau

SEQ ID NO: 786574 - RNA, 22 nt, Homo sapiens
uggaaaccaaggaaagugaaac

SEQ ID NO: 786575 - RNA, 14 nt, Homo sapiens
uggaaacugaaugc

SEQ ID NO: 786576 - RNA, 13 nt, Homo sapiens
uggaaacugcaaa

SEQ ID NO: 786577 - RNA, 18 nt, Homo sapiens
uggaaagcaucaccucag

SEQ ID NO: 786578 - RNA, 22 nt, Homo sapiens
uggaaagcaucaccucaggcca

SEQ ID NO: 786579 - RNA, 20 nt, Homo sapiens
uggaaagccucugcugccau

SEQ ID NO: 786580 - RNA, 14 nt, Homo sapiens
uggaaagcugcuuc

SEQ ID NO: 786581 - RNA, 22 nt, Homo sapiens
uggaaaggcucagucucaggag

SEQ ID NO: 786582 - RNA, 13 nt, Homo sapiens
uggaaagguccug

SEQ ID NO: 786583 - RNA, 17 nt, Homo sapiens
uggaaauaaacugugca

SEQ ID NO: 786584 - RNA, 21 nt, Homo sapiens
uggaaauaaagucagauggaa

SEQ ID NO: 786585 - RNA, 17 nt, Homo sapiens
uggaaaucaacccucuc

SEQ ID NO: 786586 - RNA, 13 nt, Homo sapiens
uggaaaucugcca

SEQ ID NO: 786587 - RNA, 12 nt, Homo sapiens
uggaaaugucug

SEQ ID NO: 786588 - RNA, 17 nt, Homo sapiens
uggaacaagacagccuu

SEQ ID NO: 786589 - RNA, 20 nt, Homo sapiens
uggaacaccuuggggucccu

SEQ ID NO: 786590 - RNA, 13 nt, Homo sapiens
uggaacauggacu

SEQ ID NO: 786591 - RNA, 23 nt, Homo sapiens
uggaaccaacacuaacauauaau

SEQ ID NO: 786592 - RNA, 17 nt, Homo sapiens
uggaacccaagccucau

SEQ ID NO: 786593 - RNA, 15 nt, Homo sapiens
uggaacccagacuca

SEQ ID NO: 786594 - RNA, 19 nt, Homo sapiens
uggaaccuuguuuuggaca

SEQ ID NO: 786595 - RNA, 15 nt, Homo sapiens
uggaacuaaagcaaa

SEQ ID NO: 786596 - RNA, 16 nt, Homo sapiens
uggaacuuacauacau

SEQ ID NO: 786597 - RNA, 13 nt, Homo sapiens
uggaagaccccac

SEQ ID NO: 786598 - RNA, 14 nt, Homo sapiens
uggccuggccauuu

SEQ ID NO: 786599 - RNA, 18 nt, Homo sapiens
uggccuggccauuuccaa

SEQ ID NO: 786600 - RNA, 22 nt, Homo sapiens
uggccuggucccuguuuuccca

SEQ ID NO: 786601 - RNA, 13 nt, Homo sapiens
uggccuguggcac

SEQ ID NO: 786602 - RNA, 21 nt, Homo sapiens
uggccuuaaaaggggcccaag

SEQ ID NO: 786603 - RNA, 16 nt, Homo sapiens
uggccuuacacugaaa

SEQ ID NO: 786604 - RNA, 15 nt, Homo sapiens
uggccuuaugaccag

SEQ ID NO: 786605 - RNA, 19 nt, Homo sapiens
uggccuuccacgucuuccu

SEQ ID NO: 786606 - RNA, 23 nt, Homo sapiens
uggccuuccccagccucuucuag

SEQ ID NO: 786607 - RNA, 20 nt, Homo sapiens
uggccuuccccuuuugccug

SEQ ID NO: 786608 - RNA, 19 nt, Homo sapiens
uggccuucugaacuccaua

SEQ ID NO: 786609 - RNA, 18 nt, Homo sapiens
uggccuugaaaccaccuu

SEQ ID NO: 786610 - RNA, 16 nt, Homo sapiens
uggcgaagauggucuc

SEQ ID NO: 786611 - RNA, 15 nt, Homo sapiens
uggcgcaucauaugc

SEQ ID NO: 786612 - RNA, 22 nt, Homo sapiens
uggcgccccuuccuaggucaug

SEQ ID NO: 786613 - RNA, 19 nt, Homo sapiens
uggcgcuuagagaggacaa

SEQ ID NO: 786614 - RNA, 23 nt, Homo sapiens
uggcggcccuucugacuguuuau

SEQ ID NO: 786615 - RNA, 16 nt, Homo sapiens
uggcgggcaccuguag

SEQ ID NO: 786616 - RNA, 15 nt, Homo sapiens
uggcgugaucucagc

SEQ ID NO: 786617 - RNA, 20 nt, Homo sapiens
uggcguuuggacccaguuca

SEQ ID NO: 786618 - RNA, 21 nt, Homo sapiens
uggcuaaagagcuuugugaua

SEQ ID NO: 786619 - RNA, 21 nt, Homo sapiens
uggcuacacacaaaccaguau

SEQ ID NO: 786620 - RNA, 15 nt, Homo sapiens
uggcuaccauuguca

SEQ ID NO: 786621 - RNA, 20 nt, Homo sapiens
uggcuacuucccuuccuccc

SEQ ID NO: 786622 - RNA, 12 nt, Homo sapiens
uggcuagccuuu

SEQ ID NO: 786623 - RNA, 16 nt, Homo sapiens
uggcuauaaucuuauc

SEQ ID NO: 786624 - RNA, 13 nt, Homo sapiens
uggcuaugcaaca

SEQ ID NO: 786625 - RNA, 12 nt, Homo sapiens
uggcucaccugg

SEQ ID NO: 786626 - RNA, 15 nt, Homo sapiens
uggcucagugccuuc

SEQ ID NO: 786627 - RNA, 16 nt, Homo sapiens
uggcucaugccuguaa

SEQ ID NO: 786628 - RNA, 22 nt, Homo sapiens
uggcucaugccuguaaucucag

SEQ ID NO: 786629 - RNA, 18 nt, Homo sapiens
uggcucccaggacacgac

SEQ ID NO: 786630 - RNA, 15 nt, Homo sapiens
uggcucccaugacca

SEQ ID NO: 786631 - RNA, 14 nt, Homo sapiens
uggcucuaucuucc

SEQ ID NO: 786632 - RNA, 15 nt, Homo sapiens
uggcucucagaaggu

SEQ ID NO: 786633 - RNA, 14 nt, Homo sapiens
uggcucucagagga

SEQ ID NO: 786634 - RNA, 12 nt, Homo sapiens
uggcucugggcc

SEQ ID NO: 786635 - RNA, 21 nt, Homo sapiens
uggcucuggguaccugcaagc

SEQ ID NO: 786636 - RNA, 14 nt, Homo sapiens
uggcugaagaauga

SEQ ID NO: 786637 - RNA, 20 nt, Homo sapiens
uggcugaauagcacagguga

SEQ ID NO: 786638 - RNA, 17 nt, Homo sapiens
uggcugagguuccucug

SEQ ID NO: 786639 - RNA, 20 nt, Homo sapiens
uggcugcaccuuuuugcaug

SEQ ID NO: 786640 - RNA, 14 nt, Homo sapiens
uggcugcauuugcc

SEQ ID NO: 786641 - RNA, 17 nt, Homo sapiens
uggcugcuagauuuuaa

SEQ ID NO: 786642 - RNA, 17 nt, Homo sapiens
uggcugcuccacugggu

SEQ ID NO: 786643 - RNA, 23 nt, Homo sapiens
uggcugcuguugcuuaaaccacu

SEQ ID NO: 786644 - RNA, 16 nt, Homo sapiens
uggcugcuuuguucaa

SEQ ID NO: 786645 - RNA, 15 nt, Homo sapiens
uggcuggaucuguga

SEQ ID NO: 786646 - RNA, 16 nt, Homo sapiens
uggcuggccugagcaa

SEQ ID NO: 786647 - RNA, 23 nt, Homo sapiens
uggcuggcuuguuugauuucaac

SEQ ID NO: 786648 - RNA, 18 nt, Homo sapiens
uggcugucugaccagaga

SEQ ID NO: 786649 - RNA, 11 nt, Homo sapiens
uggcugugaga

SEQ ID NO: 786650 - RNA, 22 nt, Homo sapiens
uggcuguguuuucaaugcacaa

SEQ ID NO: 786651 - RNA, 20 nt, Homo sapiens
uggcuucagcccccaccagg

SEQ ID NO: 786652 - RNA, 23 nt, Homo sapiens
uggcuucaggcuaagaagagauu

SEQ ID NO: 786653 - RNA, 13 nt, Homo sapiens
uggcuucagggga

SEQ ID NO: 786654 - RNA, 14 nt, Homo sapiens
uggcuugacuggau

SEQ ID NO: 786655 - RNA, 10 nt, Homo sapiens
uggcuuuaug

SEQ ID NO: 786656 - RNA, 19 nt, Homo sapiens
uggcuuuaugcaaauacaa

SEQ ID NO: 786657 - RNA, 16 nt, Homo sapiens
uggcuuucagagccag

SEQ ID NO: 786658 - RNA, 16 nt, Homo sapiens
uggcuuucuggcugcu

SEQ ID NO: 786659 - RNA, 21 nt, Homo sapiens
ugggaaaaaaguuuugaugaa

SEQ ID NO: 786660 - RNA, 16 nt, Homo sapiens
ugggaaaacauuugcu

SEQ ID NO: 786661 - RNA, 20 nt, Homo sapiens
ugggaaaagcagaagaggga

SEQ ID NO: 786662 - RNA, 14 nt, Homo sapiens
ugggaaagcauugu

SEQ ID NO: 786663 - RNA, 22 nt, Homo sapiens
ugggaacagggacgggggagcu

SEQ ID NO: 786664 - RNA, 15 nt, Homo sapiens
ugggaacuccacucu

SEQ ID NO: 786665 - RNA, 22 nt, Homo sapiens
ugggaauagggagacaggguag

SEQ ID NO: 786666 - RNA, 19 nt, Homo sapiens
ugggaaucaacagcauauu

SEQ ID NO: 786667 - RNA, 16 nt, Homo sapiens
ugggacugaugucauc

SEQ ID NO: 786668 - RNA, 22 nt, Homo sapiens
ugggacuggacagcuuugcucc

SEQ ID NO: 786669 - RNA, 15 nt, Homo sapiens
ugggacuguguuucc

SEQ ID NO: 786670 - RNA, 15 nt, Homo sapiens
ugggagacuggaaaa

SEQ ID NO: 786671 - RNA, 19 nt, Homo sapiens
ugggagaucuucacucugg

SEQ ID NO: 786672 - RNA, 22 nt, Homo sapiens
ugggagccaguccuccacucga

SEQ ID NO: 786673 - RNA, 17 nt, Homo sapiens
ugggaggcuguggagcc

SEQ ID NO: 786674 - RNA, 17 nt, Homo sapiens
ugggaggucaaggugag

SEQ ID NO: 786675 - RNA, 17 nt, Homo sapiens
ugggagucacacagugu

SEQ ID NO: 786676 - RNA, 21 nt, Homo sapiens
ugggaguuauaggucauggga

SEQ ID NO: 786677 - RNA, 18 nt, Homo sapiens
ugggaguucuaacaaaac

SEQ ID NO: 786678 - RNA, 19 nt, Homo sapiens
ugggauagcacguggagcu

SEQ ID NO: 786679 - RNA, 17 nt, Homo sapiens
ugggauaguguucugcu

SEQ ID NO: 786680 - RNA, 13 nt, Homo sapiens
ugggaucauuuga

SEQ ID NO: 786681 - RNA, 14 nt, Homo sapiens
ugggaucuggcaca

SEQ ID NO: 786682 - RNA, 14 nt, Homo sapiens
ugggauggggacau

SEQ ID NO: 786683 - RNA, 21 nt, Homo sapiens
ugggauguccacagaugccuc

SEQ ID NO: 786684 - RNA, 20 nt, Homo sapiens
cuagaaggggcuaugcauau

SEQ ID NO: 786685 - RNA, 18 nt, Homo sapiens
cuagaauagucucacugu

SEQ ID NO: 786686 - RNA, 21 nt, Homo sapiens
cuagaauauuauguuccucaa

SEQ ID NO: 786687 - RNA, 24 nt, Homo sapiens
cuagaauauuuaaaacaucauuac

SEQ ID NO: 786688 - RNA, 23 nt, Homo sapiens
cuagaauggauucaacacugugc

SEQ ID NO: 786689 - RNA, 19 nt, Homo sapiens
cuagaauguggauuugauu

SEQ ID NO: 786690 - RNA, 13 nt, Homo sapiens
cuagacagguguu

SEQ ID NO: 786691 - RNA, 15 nt, Homo sapiens
cuagacuccucagga

SEQ ID NO: 786692 - RNA, 17 nt, Homo sapiens
cuagagaaaagucuacc

SEQ ID NO: 786693 - RNA, 19 nt, Homo sapiens
cuagagaaggacccggagg

SEQ ID NO: 786694 - RNA, 15 nt, Homo sapiens
cuagagacaggcaaa

SEQ ID NO: 786695 - RNA, 23 nt, Homo sapiens
cuagagauauggcagcgaaagga

SEQ ID NO: 786696 - RNA, 15 nt, Homo sapiens
cuagagccagcagua

SEQ ID NO: 786697 - RNA, 17 nt, Homo sapiens
cuagagccgaggggaga

SEQ ID NO: 786698 - RNA, 20 nt, Homo sapiens
cuagagcugacagcuuuguu

SEQ ID NO: 786699 - RNA, 22 nt, Homo sapiens
cuagaggcuugcauaauaagcu

SEQ ID NO: 786700 - RNA, 14 nt, Homo sapiens
cuagaguccucacu

SEQ ID NO: 786701 - RNA, 23 nt, Homo sapiens
cuagauggagaaaguaacacaaa

SEQ ID NO: 786702 - RNA, 19 nt, Homo sapiens
cuagauuuucuacuuuauu

SEQ ID NO: 786703 - RNA, 17 nt, Homo sapiens
cuagcaaauaugcuguu

SEQ ID NO: 786704 - RNA, 23 nt, Homo sapiens
cuagcaaauggcagaaccaaagc

SEQ ID NO: 786705 - RNA, 12 nt, Homo sapiens
cuagcacuuugg

SEQ ID NO: 786706 - RNA, 14 nt, Homo sapiens
cuagcagaaaucua

SEQ ID NO: 786707 - RNA, 23 nt, Homo sapiens
cuagcagauacauggcaacgugu

SEQ ID NO: 786708 - RNA, 17 nt, Homo sapiens
cuagcaggcacaggaca

SEQ ID NO: 786709 - RNA, 15 nt, Homo sapiens
cuagcauuacauuau

SEQ ID NO: 786710 - RNA, 14 nt, Homo sapiens
cuagccagcaaaga

SEQ ID NO: 786711 - RNA, 14 nt, Homo sapiens
cuagcccugggaca

SEQ ID NO: 786712 - RNA, 18 nt, Homo sapiens
cuauucaauucuuuuaac

SEQ ID NO: 786713 - RNA, 14 nt, Homo sapiens
cuauucagaauuga

SEQ ID NO: 786714 - RNA, 15 nt, Homo sapiens
cuauucaguuuucag

SEQ ID NO: 786715 - RNA, 14 nt, Homo sapiens
cuauuccaaaaagg

SEQ ID NO: 786716 - RNA, 17 nt, Homo sapiens
cuauucuaaguaauucc

SEQ ID NO: 786717 - RNA, 16 nt, Homo sapiens
cuauucuauccaucuc

SEQ ID NO: 786718 - RNA, 21 nt, Homo sapiens
cuauucucggggcccugugua

SEQ ID NO: 786719 - RNA, 16 nt, Homo sapiens
cuauucucuccaaaaa

SEQ ID NO: 786720 - RNA, 16 nt, Homo sapiens
cuauucugagaaaaca

SEQ ID NO: 786721 - RNA, 17 nt, Homo sapiens
cuauucuugauguaaaa

SEQ ID NO: 786722 - RNA, 18 nt, Homo sapiens
cuauugcugcucucucac

SEQ ID NO: 786723 - RNA, 14 nt, Homo sapiens
cuauuuaacaacug

SEQ ID NO: 786724 - RNA, 12 nt, Homo sapiens
cuauuuaugcaa

SEQ ID NO: 786725 - RNA, 18 nt, Homo sapiens
cuauuuauugacuuugac

SEQ ID NO: 786726 - RNA, 23 nt, Homo sapiens
cuauuuccacugaacaaaaccua

SEQ ID NO: 786727 - RNA, 17 nt, Homo sapiens
cuauuucuacacagugg

SEQ ID NO: 786728 - RNA, 17 nt, Homo sapiens
cuauuugaacaugugcc

SEQ ID NO: 786729 - RNA, 16 nt, Homo sapiens
cuauuuggaacccaag

SEQ ID NO: 786730 - RNA, 20 nt, Homo sapiens
cuauuuguaaaucugccaca

SEQ ID NO: 786731 - RNA, 15 nt, Homo sapiens
cuauuuguucagaga

SEQ ID NO: 786732 - RNA, 15 nt, Homo sapiens
cuauuuuauucccuu

SEQ ID NO: 786733 - RNA, 17 nt, Homo sapiens
cuauuuugcaugcugaa

SEQ ID NO: 786734 - RNA, 14 nt, Homo sapiens
cuauuuuugaggaa

SEQ ID NO: 786735 - RNA, 21 nt, Homo sapiens
cuauuuuuuacuacauaauua

SEQ ID NO: 786736 - RNA, 17 nt, Homo sapiens
cucaaaaauaaugcaua

SEQ ID NO: 786737 - RNA, 16 nt, Homo sapiens
cucaaaaggaaaccaa

SEQ ID NO: 786738 - RNA, 17 nt, Homo sapiens
cucaaacuccugaccuc

SEQ ID NO: 786739 - RNA, 23 nt, Homo sapiens
cucaaacuccugaccuugugauu

SEQ ID NO: 786740 - RNA, 13 nt, Homo sapiens
cucaaacuugaga

SEQ ID NO: 786741 - RNA, 16 nt, Homo sapiens
cucaaacuugagaaaa

SEQ ID NO: 786742 - RNA, 15 nt, Homo sapiens
cucaaagaucugaau

SEQ ID NO: 786743 - RNA, 13 nt, Homo sapiens
cucaaagcacugu

SEQ ID NO: 786744 - RNA, 22 nt, Homo sapiens
cucaaaggaacuuucugguccc

SEQ ID NO: 786745 - RNA, 18 nt, Homo sapiens
cucaaaggcccucaguga

SEQ ID NO: 786746 - RNA, 11 nt, Homo sapiens
cucaaagggaa

SEQ ID NO: 786747 - RNA, 17 nt, Homo sapiens
cucaaaguacugggauu

SEQ ID NO: 786748 - RNA, 15 nt, Homo sapiens
cucaaauaacuaaaa

SEQ ID NO: 786749 - RNA, 20 nt, Homo sapiens
cucaaauauuugcuaugaag

SEQ ID NO: 786750 - RNA, 13 nt, Homo sapiens
cucaaaugaauuu

SEQ ID NO: 786751 - RNA, 21 nt, Homo sapiens
cucaaaugcacaucucauggc

SEQ ID NO: 786752 - RNA, 23 nt, Homo sapiens
cucaacauuguguucccauuuca

SEQ ID NO: 786753 - RNA, 16 nt, Homo sapiens
cucaacuaccauuccu

SEQ ID NO: 786754 - RNA, 19 nt, Homo sapiens
cucaacugccuacuccaaa

SEQ ID NO: 786755 - RNA, 18 nt, Homo sapiens
cucaacugggugacaagg

SEQ ID NO: 786756 - RNA, 20 nt, Homo sapiens
cucaacugggugacaagggu

SEQ ID NO: 786757 - RNA, 23 nt, Homo sapiens
cucaagaccagagacccaacagc

SEQ ID NO: 786758 - RNA, 20 nt, Homo sapiens
cucaagagacaccccuuccu

SEQ ID NO: 786759 - RNA, 23 nt, Homo sapiens
cucaagauauucagguggccaga

SEQ ID NO: 786760 - RNA, 14 nt, Homo sapiens
cucaagauucagua

SEQ ID NO: 786761 - RNA, 16 nt, Homo sapiens
cucaagcaaccaugaa

SEQ ID NO: 786762 - RNA, 14 nt, Homo sapiens
cucaagcaauauua

SEQ ID NO: 786763 - RNA, 20 nt, Homo sapiens
cucaagccggaaacucggca

SEQ ID NO: 786764 - RNA, 19 nt, Homo sapiens
cucaagguuuuagguucua

SEQ ID NO: 786765 - RNA, 15 nt, Homo sapiens
cucaaguaccaccaa

SEQ ID NO: 786766 - RNA, 12 nt, Homo sapiens
cucaaguucuaa

SEQ ID NO: 786767 - RNA, 13 nt, Homo sapiens
cucaauagcuuga

SEQ ID NO: 786768 - RNA, 23 nt, Homo sapiens
cucaaucucccgugggcaucuca

SEQ ID NO: 786769 - RNA, 23 nt, Homo sapiens
cucaaugaaaauuuaaagggaaa

SEQ ID NO: 786770 - RNA, 14 nt, Homo sapiens
cucaaugccaguaa

SEQ ID NO: 786771 - RNA, 15 nt, Homo sapiens
cucaaugccaguaac

SEQ ID NO: 786772 - RNA, 22 nt, Homo sapiens
cucaauguuucuggacauucuc

SEQ ID NO: 786773 - RNA, 18 nt, Homo sapiens
cucacaaaguccacuuua

SEQ ID NO: 786774 - RNA, 15 nt, Homo sapiens
cucacaagcaugaag

SEQ ID NO: 786775 - RNA, 16 nt, Homo sapiens
cucacacccuaccuuc

SEQ ID NO: 786776 - RNA, 19 nt, Homo sapiens
cucacacuggccacaagga

SEQ ID NO: 786777 - RNA, 18 nt, Homo sapiens
cucacagaagaauaugac

SEQ ID NO: 786778 - RNA, 16 nt, Homo sapiens
cucacaguguacucua

SEQ ID NO: 786779 - RNA, 14 nt, Homo sapiens
cucacauaagccca

SEQ ID NO: 786780 - RNA, 22 nt, Homo sapiens
cucacauacauaagcagcauuu

SEQ ID NO: 786781 - RNA, 22 nt, Homo sapiens
cucacauacugacuucaguggg

SEQ ID NO: 786782 - RNA, 12 nt, Homo sapiens
cucaccaaaacg

SEQ ID NO: 786783 - RNA, 23 nt, Homo sapiens
cucaccagcccugaccccagugu

SEQ ID NO: 786784 - RNA, 17 nt, Homo sapiens
cucaccaugaugugaag

SEQ ID NO: 786785 - RNA, 12 nt, Homo sapiens
cucacccaugca

SEQ ID NO: 786786 - RNA, 23 nt, Homo sapiens
cucacccccagguguugccauuu

SEQ ID NO: 786787 - RNA, 14 nt, Homo sapiens
cucacccguaggca

SEQ ID NO: 786788 - RNA, 16 nt, Homo sapiens
cucaccguggauuuuc

SEQ ID NO: 786789 - RNA, 19 nt, Homo sapiens
cucaccucccgaagccacc

SEQ ID NO: 786790 - RNA, 15 nt, Homo sapiens
cucaccucuugccuu

SEQ ID NO: 786791 - RNA, 23 nt, Homo sapiens
cucaccugucuaggucuccucag

SEQ ID NO: 786792 - RNA, 22 nt, Homo sapiens
cucacggaaccguagacuagga

SEQ ID NO: 786793 - RNA, 11 nt, Homo sapiens
cucacuacuga

SEQ ID NO: 786794 - RNA, 15 nt, Homo sapiens
cucacuaugcugcuu

SEQ ID NO: 786795 - RNA, 15 nt, Homo sapiens
cucacucccagucca

SEQ ID NO: 786796 - RNA, 21 nt, Homo sapiens
cucacucuugaaguccaggac

SEQ ID NO: 786797 - RNA, 18 nt, Homo sapiens
cucacugaggguaucuga

SEQ ID NO: 786798 - RNA, 23 nt, Homo sapiens
cucacugagucuuaacuuuucac

SEQ ID NO: 786799 - RNA, 21 nt, Homo sapiens
ugguagaacuaaacaauaagc

SEQ ID NO: 786800 - RNA, 20 nt, Homo sapiens
ugguagccaucaagcacuuc

SEQ ID NO: 786801 - RNA, 22 nt, Homo sapiens
ugguaggaucaccugaggucag

SEQ ID NO: 786802 - RNA, 21 nt, Homo sapiens
ugguagucacuaacauauaua

SEQ ID NO: 786803 - RNA, 19 nt, Homo sapiens
ugguaguggaauagugaau

SEQ ID NO: 786804 - RNA, 22 nt, Homo sapiens
ugguaugcacaauuccaugaca

SEQ ID NO: 786805 - RNA, 19 nt, Homo sapiens
ugguauguaauuuaugcaa

SEQ ID NO: 786806 - RNA, 12 nt, Homo sapiens
ugguaugugcua

SEQ ID NO: 786807 - RNA, 17 nt, Homo sapiens
ugguauuucuaauucca

SEQ ID NO: 786808 - RNA, 22 nt, Homo sapiens
uggucacaacuugauggcugcg

SEQ ID NO: 786809 - RNA, 14 nt, Homo sapiens
uggucagauuugaa

SEQ ID NO: 786810 - RNA, 17 nt, Homo sapiens
uggucagggcagggcuc

SEQ ID NO: 786811 - RNA, 23 nt, Homo sapiens
uggucaguaaauaacaggcauuu

SEQ ID NO: 786812 - RNA, 18 nt, Homo sapiens
uggucauagaaacaauaa

SEQ ID NO: 786813 - RNA, 13 nt, Homo sapiens
uggucauccaaac

SEQ ID NO: 786814 - RNA, 21 nt, Homo sapiens
uggucccggggccagcacuuc

SEQ ID NO: 786815 - RNA, 16 nt, Homo sapiens
uggucccuaugggcuu

SEQ ID NO: 786816 - RNA, 14 nt, Homo sapiens
ugguccgaucuuug

SEQ ID NO: 786817 - RNA, 20 nt, Homo sapiens
ugguccugacucaacauguu

SEQ ID NO: 786818 - RNA, 15 nt, Homo sapiens
uggucuccaugcuca

SEQ ID NO: 786819 - RNA, 13 nt, Homo sapiens
uggucuggcaaua

SEQ ID NO: 786820 - RNA, 18 nt, Homo sapiens
uggucugggcaccaccuc

SEQ ID NO: 786821 - RNA, 17 nt, Homo sapiens
uggucuguuugacuuua

SEQ ID NO: 786822 - RNA, 23 nt, Homo sapiens
uggugaaaccccaucucuacuaa

SEQ ID NO: 786823 - RNA, 21 nt, Homo sapiens
uggugaacaguguauaggaag

SEQ ID NO: 786824 - RNA, 19 nt, Homo sapiens
uggugagaucacaguucau

SEQ ID NO: 786825 - RNA, 18 nt, Homo sapiens
uggugaggcgaaggccag

SEQ ID NO: 786826 - RNA, 16 nt, Homo sapiens
cuccaucucaaaaaag

SEQ ID NO: 786827 - RNA, 22 nt, Homo sapiens
cuccaucuuauuuucauguaua

SEQ ID NO: 786828 - RNA, 15 nt, Homo sapiens
cuccaugagguacug

SEQ ID NO: 786829 - RNA, 12 nt, Homo sapiens
cuccaugcugca

SEQ ID NO: 786830 - RNA, 14 nt, Homo sapiens
cuccaugcugcaaa

SEQ ID NO: 786831 - RNA, 12 nt, Homo sapiens
cuccauguguuu

SEQ ID NO: 786832 - RNA, 22 nt, Homo sapiens
cuccauugguguugacauacau

SEQ ID NO: 786833 - RNA, 21 nt, Homo sapiens
cuccauuugcaauugaccucu

SEQ ID NO: 786834 - RNA, 22 nt, Homo sapiens
cuccauuugcucuucagaugcc

SEQ ID NO: 786835 - RNA, 14 nt, Homo sapiens
cuccauuuuagccc

SEQ ID NO: 786836 - RNA, 15 nt, Homo sapiens
cucccaaacuccucu

SEQ ID NO: 786837 - RNA, 16 nt, Homo sapiens
cucccaaagugcuagu

SEQ ID NO: 786838 - RNA, 19 nt, Homo sapiens
cucccaaagugcugggauu

SEQ ID NO: 786839 - RNA, 14 nt, Homo sapiens
cucccaacucuugc

SEQ ID NO: 786840 - RNA, 21 nt, Homo sapiens
cucccacaugaggccaucuca

SEQ ID NO: 786841 - RNA, 22 nt, Homo sapiens
cucccacauugucaccauuuca

SEQ ID NO: 786842 - RNA, 17 nt, Homo sapiens
cucccaccaccagugag

SEQ ID NO: 786843 - RNA, 20 nt, Homo sapiens
cucccacccacagccauaga

SEQ ID NO: 786844 - RNA, 23 nt, Homo sapiens
cucccacuaaagggguuccaaau

SEQ ID NO: 786845 - RNA, 20 nt, Homo sapiens
cucccagaaugcuggguuua

SEQ ID NO: 786846 - RNA, 20 nt, Homo sapiens
cucccaggcccgagauguga

SEQ ID NO: 786847 - RNA, 20 nt, Homo sapiens
cucccagguucccccagcaa

SEQ ID NO: 786848 - RNA, 15 nt, Homo sapiens
cucccagucauuuaa

SEQ ID NO: 786849 - RNA, 22 nt, Homo sapiens
cucccagugaccccugaccuca

SEQ ID NO: 786850 - RNA, 16 nt, Homo sapiens
cucccagugaugcugu

SEQ ID NO: 786851 - RNA, 14 nt, Homo sapiens
cucccagugccuuc

SEQ ID NO: 786852 - RNA, 21 nt, Homo sapiens
cucccauccuugaugcaagug

SEQ ID NO: 786853 - RNA, 16 nt, Homo sapiens
cucccauuucucucuu

SEQ ID NO: 786854 - RNA, 19 nt, Homo sapiens
cuccccacacagacuccac

SEQ ID NO: 786855 - RNA, 16 nt, Homo sapiens
cuccccacacuaaccu

SEQ ID NO: 786856 - RNA, 20 nt, Homo sapiens
cuccccaccccacacacacu

SEQ ID NO: 786857 - RNA, 13 nt, Homo sapiens
cuccccaccucca

SEQ ID NO: 786858 - RNA, 20 nt, Homo sapiens
cuccccacgacaaccccacu

SEQ ID NO: 786859 - RNA, 16 nt, Homo sapiens
cuccccagcccagaga

SEQ ID NO: 786860 - RNA, 19 nt, Homo sapiens
cuccccagugcaaaugcau

SEQ ID NO: 786861 - RNA, 22 nt, Homo sapiens
cuccccauucacagagccuuuu

SEQ ID NO: 786862 - RNA, 19 nt, Homo sapiens
cuccccauuugggacauca

SEQ ID NO: 786863 - RNA, 14 nt, Homo sapiens
cuccccccacugca

SEQ ID NO: 786864 - RNA, 15 nt, Homo sapiens
cuccccccagacccc

SEQ ID NO: 786865 - RNA, 20 nt, Homo sapiens
cuccccuagggggagaagaa

SEQ ID NO: 786866 - RNA, 14 nt, Homo sapiens
cuccccucccugcc

SEQ ID NO: 786867 - RNA, 18 nt, Homo sapiens
cuccccugccacacugau

SEQ ID NO: 786868 - RNA, 19 nt, Homo sapiens
cucccgaguagcugggauu

SEQ ID NO: 786869 - RNA, 16 nt, Homo sapiens
cucccuaggagaccaa

SEQ ID NO: 786870 - RNA, 20 nt, Homo sapiens
cucccucaaagcacacguca

SEQ ID NO: 786871 - RNA, 15 nt, Homo sapiens
cucccuccaccagcc

SEQ ID NO: 786872 - RNA, 15 nt, Homo sapiens
cucccucgcuguaug

SEQ ID NO: 786873 - RNA, 17 nt, Homo sapiens
cucccucuccauaucuc

SEQ ID NO: 786874 - RNA, 20 nt, Homo sapiens
cucccucuuucucaguuccu

SEQ ID NO: 786875 - RNA, 22 nt, Homo sapiens
cucccugggcagugcuccuccg

SEQ ID NO: 786876 - RNA, 15 nt, Homo sapiens
cucccuguaacucca

SEQ ID NO: 786877 - RNA, 20 nt, Homo sapiens
cucccugucauagagcugca

SEQ ID NO: 786878 - RNA, 14 nt, Homo sapiens
cucccuuccucacc

SEQ ID NO: 786879 - RNA, 18 nt, Homo sapiens
cucccuuccucaccucca

SEQ ID NO: 786880 - RNA, 14 nt, Homo sapiens
cucccuucucucuc

SEQ ID NO: 786881 - RNA, 20 nt, Homo sapiens
cucccuuggugguggggaca

SEQ ID NO: 786882 - RNA, 13 nt, Homo sapiens
cuccgacucugca

SEQ ID NO: 786883 - RNA, 13 nt, Homo sapiens
cuccgcaacagcc

SEQ ID NO: 786884 - RNA, 14 nt, Homo sapiens
cuccgcaacagcca

SEQ ID NO: 786885 - RNA, 15 nt, Homo sapiens
cuccgcgccuacccu

SEQ ID NO: 786886 - RNA, 16 nt, Homo sapiens
cuccggcgucuugccc

SEQ ID NO: 786887 - RNA, 22 nt, Homo sapiens
cuccgggcaaauggcugagaug

SEQ ID NO: 786888 - RNA, 23 nt, Homo sapiens
cuccgguuugggcugucuuacca

SEQ ID NO: 786889 - RNA, 21 nt, Homo sapiens
cuccgugaggcugcugccauc

SEQ ID NO: 786890 - RNA, 20 nt, Homo sapiens
cuccgugcuuaaccaaagaa

SEQ ID NO: 786891 - RNA, 16 nt, Homo sapiens
cuccuaaagcuuuuau

SEQ ID NO: 786892 - RNA, 18 nt, Homo sapiens
cuccuaagcaacuaggcc

SEQ ID NO: 786893 - RNA, 15 nt, Homo sapiens
cuccuaaugcuuuau

SEQ ID NO: 786894 - RNA, 18 nt, Homo sapiens
cuccuagaagaaccaaau

SEQ ID NO: 786895 - RNA, 18 nt, Homo sapiens
cuccuaggaaaccagcuc

SEQ ID NO: 786896 - RNA, 17 nt, Homo sapiens
cuccuauacuauugaag

SEQ ID NO: 786897 - RNA, 22 nt, Homo sapiens
cuccucacaguugccauguaga

SEQ ID NO: 786898 - RNA, 22 nt, Homo sapiens
cuccucacuggaggagcagcuu

SEQ ID NO: 786899 - RNA, 21 nt, Homo sapiens
cuccucaggcacacagcuacu

SEQ ID NO: 786900 - RNA, 13 nt, Homo sapiens
cuccucagugaca

SEQ ID NO: 786901 - RNA, 15 nt, Homo sapiens
cuccucaucuccaag

SEQ ID NO: 786902 - RNA, 12 nt, Homo sapiens
cuccuccaugca

SEQ ID NO: 786903 - RNA, 19 nt, Homo sapiens
cuccucccaggaacugggc

SEQ ID NO: 786904 - RNA, 15 nt, Homo sapiens
cuccucccugucaua

SEQ ID NO: 786905 - RNA, 18 nt, Homo sapiens
cuccuccguguggacugu

SEQ ID NO: 786906 - RNA, 12 nt, Homo sapiens
cuccucuaguaa

SEQ ID NO: 786907 - RNA, 15 nt, Homo sapiens
cuccucucugagacu

SEQ ID NO: 786908 - RNA, 22 nt, Homo sapiens
cuccucuggacggcaggcucac

SEQ ID NO: 786909 - RNA, 22 nt, Homo sapiens
cuccucuucagaggagaaagaa

SEQ ID NO: 786910 - RNA, 12 nt, Homo sapiens
cuccucuugacu

SEQ ID NO: 786911 - RNA, 20 nt, Homo sapiens
cuccugaaccgcacagcuca

SEQ ID NO: 786912 - RNA, 19 nt, Homo sapiens
cuccugaguagcuggauua

SEQ ID NO: 786913 - RNA, 16 nt, Homo sapiens
cuccugauagucuuuc

SEQ ID NO: 786914 - RNA, 22 nt, Homo sapiens
ugucacuucuucaccucuucca

SEQ ID NO: 786915 - RNA, 23 nt, Homo sapiens
ugucagaaaagagccacuuucaa

SEQ ID NO: 786916 - RNA, 17 nt, Homo sapiens
ugucagcccaugugcac

SEQ ID NO: 786917 - RNA, 16 nt, Homo sapiens
ugucagcuacuaauga

SEQ ID NO: 786918 - RNA, 17 nt, Homo sapiens
ugucaguuauucuugca

SEQ ID NO: 786919 - RNA, 11 nt, Homo sapiens
ugucaguucuc

SEQ ID NO: 786920 - RNA, 20 nt, Homo sapiens
ugucaguuuuaucuucagaa

SEQ ID NO: 786921 - RNA, 14 nt, Homo sapiens
ugucauaacaucca

SEQ ID NO: 786922 - RNA, 23 nt, Homo sapiens
ugucauaggauuaagcaguuuaa

SEQ ID NO: 786923 - RNA, 22 nt, Homo sapiens
ugucauauaauaaaaaaauuag

SEQ ID NO: 786924 - RNA, 23 nt, Homo sapiens
ugucaucccauauaacuaagaca

SEQ ID NO: 786925 - RNA, 14 nt, Homo sapiens
ugucauccugugaa

SEQ ID NO: 786926 - RNA, 12 nt, Homo sapiens
ugucaucucucu

SEQ ID NO: 786927 - RNA, 21 nt, Homo sapiens
ugucaucuuccuggaagcaga

SEQ ID NO: 786928 - RNA, 23 nt, Homo sapiens
ugucauuaaauggggcucacaaa

SEQ ID NO: 786929 - RNA, 20 nt, Homo sapiens
ugucauucagaaaccugaag

SEQ ID NO: 786930 - RNA, 16 nt, Homo sapiens
ugucauuccaguuuga

SEQ ID NO: 786931 - RNA, 15 nt, Homo sapiens
ugucauuuugcacug

SEQ ID NO: 786932 - RNA, 17 nt, Homo sapiens
ugucauuuugcacugua

SEQ ID NO: 786933 - RNA, 18 nt, Homo sapiens
uguccaaaacugccucag

SEQ ID NO: 786934 - RNA, 16 nt, Homo sapiens
uguccacagaugccuc

SEQ ID NO: 786935 - RNA, 17 nt, Homo sapiens
uguccacgauucacuca

SEQ ID NO: 786936 - RNA, 14 nt, Homo sapiens
uguccagcaccuug

SEQ ID NO: 786937 - RNA, 15 nt, Homo sapiens
uguccaggagcuaau

SEQ ID NO: 786938 - RNA, 18 nt, Homo sapiens
uguccauaagcuacgggu

SEQ ID NO: 786939 - RNA, 14 nt, Homo sapiens
uguccaucccagcg

SEQ ID NO: 786940 - RNA, 15 nt, Homo sapiens
cuccuuggccacaga

SEQ ID NO: 786941 - RNA, 18 nt, Homo sapiens
cuccuuggcuuuaugcaa

SEQ ID NO: 786942 - RNA, 19 nt, Homo sapiens
cuccuuguaaagacuguag

SEQ ID NO: 786943 - RNA, 14 nt, Homo sapiens
cuccuuugcaggcu

SEQ ID NO: 786944 - RNA, 17 nt, Homo sapiens
cuccuuuggccauucca

SEQ ID NO: 786945 - RNA, 19 nt, Homo sapiens
cuccuuuguguguguguca

SEQ ID NO: 786946 - RNA, 17 nt, Homo sapiens
cuccuuuuccacuuuaa

SEQ ID NO: 786947 - RNA, 16 nt, Homo sapiens
cuccuuuugaccaaau

SEQ ID NO: 786948 - RNA, 17 nt, Homo sapiens
cuccuuuugaccaaaua

SEQ ID NO: 786949 - RNA, 14 nt, Homo sapiens
cuccuuuugaggcu

SEQ ID NO: 786950 - RNA, 22 nt, Homo sapiens
cucgaacuauuuucaaagacuu

SEQ ID NO: 786951 - RNA, 21 nt, Homo sapiens
cucgaauaaaaucugcugcac

SEQ ID NO: 786952 - RNA, 14 nt, Homo sapiens
cucgagauguaucc

SEQ ID NO: 786953 - RNA, 15 nt, Homo sapiens
cucgaucauauuucc

SEQ ID NO: 786954 - RNA, 14 nt, Homo sapiens
cucgcagccugaag

SEQ ID NO: 786955 - RNA, 13 nt, Homo sapiens
cucgcaugacugu

SEQ ID NO: 786956 - RNA, 21 nt, Homo sapiens
cucgcccagacaccaugugca

SEQ ID NO: 786957 - RNA, 20 nt, Homo sapiens
cucgccuguuggggaccuca

SEQ ID NO: 786958 - RNA, 12 nt, Homo sapiens
cucgcucaggug

SEQ ID NO: 786959 - RNA, 17 nt, Homo sapiens
cucgcuuuguugcccag

SEQ ID NO: 786960 - RNA, 22 nt, Homo sapiens
cucggagaaacgggugagcuga

SEQ ID NO: 786961 - RNA, 21 nt, Homo sapiens
cucggagaagagcuguucaca

SEQ ID NO: 786962 - RNA, 14 nt, Homo sapiens
cucggccuucacaa

SEQ ID NO: 786963 - RNA, 19 nt, Homo sapiens
cucgggguccagugcauuu

SEQ ID NO: 786964 - RNA, 21 nt, Homo sapiens
cucguaucccaaaucugucag

SEQ ID NO: 786965 - RNA, 11 nt, Homo sapiens
cucguccuccc

SEQ ID NO: 786966 - RNA, 21 nt, Homo sapiens
cucgugggccguguggcacac

SEQ ID NO: 786967 - RNA, 14 nt, Homo sapiens
cucguggugaggcu

SEQ ID NO: 786968 - RNA, 15 nt, Homo sapiens
cucgugugauuuccu

SEQ ID NO: 786969 - RNA, 15 nt, Homo sapiens
cucuaaacauuucau

SEQ ID NO: 786970 - RNA, 14 nt, Homo sapiens
cucuaaaucuuccu

SEQ ID NO: 786971 - RNA, 14 nt, Homo sapiens
cucuaaaugcaguu

SEQ ID NO: 786972 - RNA, 22 nt, Homo sapiens
cucuaaccaguguacaggucac

SEQ ID NO: 786973 - RNA, 13 nt, Homo sapiens
cucuaaccauuca

SEQ ID NO: 786974 - RNA, 14 nt, Homo sapiens
cucuaaccauucaa

SEQ ID NO: 786975 - RNA, 16 nt, Homo sapiens
cucuaacuccugccau

SEQ ID NO: 786976 - RNA, 19 nt, Homo sapiens
cucuaagcacauuccaaac

SEQ ID NO: 786977 - RNA, 17 nt, Homo sapiens
cucuaaggcaguagaau

SEQ ID NO: 786978 - RNA, 12 nt, Homo sapiens
cucuaccagucu

SEQ ID NO: 786979 - RNA, 15 nt, Homo sapiens
cucuacccuauacaa

SEQ ID NO: 786980 - RNA, 20 nt, Homo sapiens
cucuacuaaaaauacaaaaa

SEQ ID NO: 786981 - RNA, 21 nt, Homo sapiens
cucuacuaaaaauaccaaaaa

SEQ ID NO: 786982 - RNA, 20 nt, Homo sapiens
cucuacucuggagguuuguu

SEQ ID NO: 786983 - RNA, 16 nt, Homo sapiens
cucuacuuaaugagau

SEQ ID NO: 786984 - RNA, 23 nt, Homo sapiens
cucuagaggcaucaccugggacc

SEQ ID NO: 786985 - RNA, 20 nt, Homo sapiens
cucuagcaggccuaagacau

SEQ ID NO: 786986 - RNA, 20 nt, Homo sapiens
cucuagccugggccagagaa

SEQ ID NO: 786987 - RNA, 20 nt, Homo sapiens
cucuaguaagaugcacugaa

SEQ ID NO: 786988 - RNA, 21 nt, Homo sapiens
cucuagugucuuuugccuuua

SEQ ID NO: 786989 - RNA, 22 nt, Homo sapiens
cucuaucuuccuccuugugauc

SEQ ID NO: 786990 - RNA, 20 nt, Homo sapiens
cucuaugaaaauuauaucuc

SEQ ID NO: 786991 - RNA, 21 nt, Homo sapiens
cucuauuuagcaacagaauua

SEQ ID NO: 786992 - RNA, 15 nt, Homo sapiens
cucuauuugagaaua

SEQ ID NO: 786993 - RNA, 20 nt, Homo sapiens
cucuauuuuaauuacugcua

SEQ ID NO: 786994 - RNA, 23 nt, Homo sapiens
cucucaccccaacuaguagcuaa

SEQ ID NO: 786995 - RNA, 18 nt, Homo sapiens
cucucaguucuacacuga

SEQ ID NO: 786996 - RNA, 22 nt, Homo sapiens
cucuccaccacccaacccaaac

SEQ ID NO: 786997 - RNA, 20 nt, Homo sapiens
cucuccacugcuggacauga

SEQ ID NO: 786998 - RNA, 16 nt, Homo sapiens
cucuccccucugcaac

SEQ ID NO: 786999 - RNA, 18 nt, Homo sapiens
cucucccgccagacuguu

SEQ ID NO: 787000 - RNA, 22 nt, Homo sapiens
cucucccgucagggcccaaguc

SEQ ID NO: 787001 - RNA, 14 nt, Homo sapiens
cucucccuaccuug

SEQ ID NO: 787002 - RNA, 20 nt, Homo sapiens
cucucccucccuaacaguga

SEQ ID NO: 787003 - RNA, 15 nt, Homo sapiens
cucucccugccaagu

SEQ ID NO: 787004 - RNA, 16 nt, Homo sapiens
cucucccugccaaguc

SEQ ID NO: 787005 - RNA, 23 nt, Homo sapiens
cucuccuuucugugcauucaugc

SEQ ID NO: 787006 - RNA, 18 nt, Homo sapiens
cucuccuuuuugcuuccu

SEQ ID NO: 787007 - RNA, 18 nt, Homo sapiens
cucucgccuguaaucuca

SEQ ID NO: 787008 - RNA, 22 nt, Homo sapiens
cucucuaacguccacuagcuua

SEQ ID NO: 787009 - RNA, 23 nt, Homo sapiens
cucucuaccuccacccugcauuu

SEQ ID NO: 787010 - RNA, 15 nt, Homo sapiens
cucucuccacccuau

SEQ ID NO: 787011 - RNA, 13 nt, Homo sapiens
cucucucgcugcg

SEQ ID NO: 787012 - RNA, 13 nt, Homo sapiens
cucucucuaccag

SEQ ID NO: 787013 - RNA, 15 nt, Homo sapiens
cucucucucucacac

SEQ ID NO: 787014 - RNA, 12 nt, Homo sapiens
cucucucugagg

SEQ ID NO: 787015 - RNA, 14 nt, Homo sapiens
cucucucugagggg

SEQ ID NO: 787016 - RNA, 10 nt, Homo sapiens
cucucugagg

SEQ ID NO: 787017 - RNA, 18 nt, Homo sapiens
cucucugagucaaaucca

SEQ ID NO: 787018 - RNA, 23 nt, Homo sapiens
cucucugagucaaauccaguggu

SEQ ID NO: 787019 - RNA, 14 nt, Homo sapiens
cucucugccaagau

SEQ ID NO: 787020 - RNA, 17 nt, Homo sapiens
cucucugggacucuccu

SEQ ID NO: 787021 - RNA, 18 nt, Homo sapiens
cucucugguuuacuucaa

SEQ ID NO: 787022 - RNA, 15 nt, Homo sapiens
cucucuguagacuga

SEQ ID NO: 787023 - RNA, 19 nt, Homo sapiens
cucucuguaggcacagagc

SEQ ID NO: 787024 - RNA, 15 nt, Homo sapiens
cucucuguggugaga

SEQ ID NO: 787025 - RNA, 14 nt, Homo sapiens
cucucuucaaucuc

SEQ ID NO: 787026 - RNA, 14 nt, Homo sapiens
cucucuuuaacccu

SEQ ID NO: 787027 - RNA, 21 nt, Homo sapiens
cucugaagaagagggucugca

SEQ ID NO: 787028 - RNA, 22 nt, Homo sapiens
cucugaagaguggguuucacaa

SEQ ID NO: 787029 - RNA, 19 nt, Homo sapiens
ugugaccaauacauuugua

SEQ ID NO: 787030 - RNA, 15 nt, Homo sapiens
ugugaccauuuauaa

SEQ ID NO: 787031 - RNA, 17 nt, Homo sapiens
ugugacccuugucaucu

SEQ ID NO: 787032 - RNA, 22 nt, Homo sapiens
ugugacgcagacagaggggaug

SEQ ID NO: 787033 - RNA, 21 nt, Homo sapiens
ugugacuaggaaaaaauugcu

SEQ ID NO: 787034 - RNA, 12 nt, Homo sapiens
ugugacuauaaa

SEQ ID NO: 787035 - RNA, 20 nt, Homo sapiens
ugugacuauaaagcuguuau

SEQ ID NO: 787036 - RNA, 20 nt, Homo sapiens
ugugacucccccucuuucac

SEQ ID NO: 787037 - RNA, 15 nt, Homo sapiens
ugugacuggcaguau

SEQ ID NO: 787038 - RNA, 15 nt, Homo sapiens
ugugacuucacugua

SEQ ID NO: 787039 - RNA, 23 nt, Homo sapiens
ugugagacucgagaacuuucauu

SEQ ID NO: 787040 - RNA, 15 nt, Homo sapiens
ugugagagauucugu

SEQ ID NO: 787041 - RNA, 12 nt, Homo sapiens
ugugagcaccug

SEQ ID NO: 787042 - RNA, 18 nt, Homo sapiens
ugugagcuaugcaaacaa

SEQ ID NO: 787043 - RNA, 20 nt, Homo sapiens
ugugagcuucagauggugaa

SEQ ID NO: 787044 - RNA, 19 nt, Homo sapiens
ugugagguucgcuuaucaa

SEQ ID NO: 787045 - RNA, 15 nt, Homo sapiens
ugugaguccaaagaa

SEQ ID NO: 787046 - RNA, 20 nt, Homo sapiens
ugugaguuuugccuuucuaa

SEQ ID NO: 787047 - RNA, 16 nt, Homo sapiens
ugugauauacaaagug

SEQ ID NO: 787048 - RNA, 19 nt, Homo sapiens
ugugaucagugauuuucaa

SEQ ID NO: 787049 - RNA, 16 nt, Homo sapiens
ugugauggcaaagaag

SEQ ID NO: 787050 - RNA, 20 nt, Homo sapiens
ugugauguaccaguuugucc

SEQ ID NO: 787051 - RNA, 18 nt, Homo sapiens
ugugauuaaagcuaagga

SEQ ID NO: 787052 - RNA, 19 nt, Homo sapiens
ugugauuauuucacuuuag

SEQ ID NO: 787053 - RNA, 15 nt, Homo sapiens
ugugauucacugccu

SEQ ID NO: 787054 - RNA, 17 nt, Homo sapiens
uucagaagguugcucua

SEQ ID NO: 787055 - RNA, 22 nt, Homo sapiens
uucagaaugaaguucuggagaa

SEQ ID NO: 787056 - RNA, 18 nt, Homo sapiens
uucagacuccaaacagac

SEQ ID NO: 787057 - RNA, 18 nt, Homo sapiens
uucagacuuggacuauga

SEQ ID NO: 787058 - RNA, 19 nt, Homo sapiens
uucagacuuuaaaauucua

SEQ ID NO: 787059 - RNA, 19 nt, Homo sapiens
uucagagaccauugcaaug

SEQ ID NO: 787060 - RNA, 16 nt, Homo sapiens
uucagaggauaaauau

SEQ ID NO: 787061 - RNA, 20 nt, Homo sapiens
uucagaucgaaauuggacug

SEQ ID NO: 787062 - RNA, 20 nt, Homo sapiens
uucagaugcuguuaguaccu

SEQ ID NO: 787063 - RNA, 17 nt, Homo sapiens
uucagcagcagcucaca

SEQ ID NO: 787064 - RNA, 19 nt, Homo sapiens
uucagcccccaccagggga

SEQ ID NO: 787065 - RNA, 21 nt, Homo sapiens
uucagccuagccgaccucagc

SEQ ID NO: 787066 - RNA, 15 nt, Homo sapiens
uucagccugaggcug

SEQ ID NO: 787067 - RNA, 19 nt, Homo sapiens
uucaggaagcucucuuaaa

SEQ ID NO: 787068 - RNA, 17 nt, Homo sapiens
uucaggaaggucuucaa

SEQ ID NO: 787069 - RNA, 20 nt, Homo sapiens
uucaggacuuaacggcucca

SEQ ID NO: 787070 - RNA, 17 nt, Homo sapiens
uucaggaugcugugaua

SEQ ID NO: 787071 - RNA, 23 nt, Homo sapiens
uucaggccauucuccugccucag

SEQ ID NO: 787072 - RNA, 23 nt, Homo sapiens
uucaggcgauucuccugccucag

SEQ ID NO: 787073 - RNA, 20 nt, Homo sapiens
uucaggugcuuuugauguga

SEQ ID NO: 787074 - RNA, 15 nt, Homo sapiens
uucaguaagucucau

SEQ ID NO: 787075 - RNA, 22 nt, Homo sapiens
uucaguacacccaguugccaaa

SEQ ID NO: 787076 - RNA, 14 nt, Homo sapiens
uucaguacuuguga

SEQ ID NO: 787077 - RNA, 14 nt, Homo sapiens
uucaguagaauuac

SEQ ID NO: 787078 - RNA, 13 nt, Homo sapiens
uucaguauacugu

SEQ ID NO: 787079 - RNA, 20 nt, Homo sapiens
uucagucacacacacauaca

SEQ ID NO: 787080 - RNA, 14 nt, Homo sapiens
uucaguccuaagaa

SEQ ID NO: 787081 - RNA, 14 nt, Homo sapiens
uucagucucacaga

SEQ ID NO: 787082 - RNA, 17 nt, Homo sapiens
uucagucucuauaccaa

SEQ ID NO: 787083 - RNA, 20 nt, Homo sapiens
uucagucucuauaccaauaa

SEQ ID NO: 787084 - RNA, 15 nt, Homo sapiens
uucagucuuguagug

SEQ ID NO: 787085 - RNA, 23 nt, Homo sapiens
uucagucuuguagugugugcuua

SEQ ID NO: 787086 - RNA, 16 nt, Homo sapiens
uucagugauguggggu

SEQ ID NO: 787087 - RNA, 23 nt, Homo sapiens
uucagugcaguuucuuuucacau

SEQ ID NO: 787088 - RNA, 13 nt, Homo sapiens
uucagugguucag

SEQ ID NO: 787089 - RNA, 14 nt, Homo sapiens
uucaguguuuucau

SEQ ID NO: 787090 - RNA, 15 nt, Homo sapiens
uucaguuaauucuua

SEQ ID NO: 787091 - RNA, 16 nt, Homo sapiens
uucaguuagcaaagag

SEQ ID NO: 787092 - RNA, 21 nt, Homo sapiens
uucauaaaaauaaccaaaaaa

SEQ ID NO: 787093 - RNA, 16 nt, Homo sapiens
uucauagcauccugau

SEQ ID NO: 787094 - RNA, 23 nt, Homo sapiens
uucauaggaauugguaaggccuc

SEQ ID NO: 787095 - RNA, 18 nt, Homo sapiens
uucauagguuacuaccua

SEQ ID NO: 787096 - RNA, 19 nt, Homo sapiens
uucauagguuacuaccuau

SEQ ID NO: 787097 - RNA, 22 nt, Homo sapiens
uucauauaggccagaguugcaa

SEQ ID NO: 787098 - RNA, 14 nt, Homo sapiens
uucauauguacuug

SEQ ID NO: 787099 - RNA, 13 nt, Homo sapiens
uucaucacacugg

SEQ ID NO: 787100 - RNA, 12 nt, Homo sapiens
uucaucaggggc

SEQ ID NO: 787101 - RNA, 14 nt, Homo sapiens
uucaucaugacaac

SEQ ID NO: 787102 - RNA, 21 nt, Homo sapiens
uucauccaggcccaacuguga

SEQ ID NO: 787103 - RNA, 22 nt, Homo sapiens
uucaucgacuuagccugaguca

SEQ ID NO: 787104 - RNA, 20 nt, Homo sapiens
uucaucguguuaaccaggau

SEQ ID NO: 787105 - RNA, 19 nt, Homo sapiens
uucaucuacccugcugacc

SEQ ID NO: 787106 - RNA, 16 nt, Homo sapiens
uucaucugacuaugac

SEQ ID NO: 787107 - RNA, 16 nt, Homo sapiens
uucaucugcucuccuu

SEQ ID NO: 787108 - RNA, 15 nt, Homo sapiens
uucaugaaacugucc

SEQ ID NO: 787109 - RNA, 17 nt, Homo sapiens
uucaugaaacuguccac

SEQ ID NO: 787110 - RNA, 19 nt, Homo sapiens
uucaugcuugacauaccua

SEQ ID NO: 787111 - RNA, 19 nt, Homo sapiens
uucauggcugaagucaccu

SEQ ID NO: 787112 - RNA, 20 nt, Homo sapiens
uucaugugaaguguauauga

SEQ ID NO: 787113 - RNA, 21 nt, Homo sapiens
uucauguggcucagugccuuc

SEQ ID NO: 787114 - RNA, 23 nt, Homo sapiens
uucauguggcucagugccuuccu

SEQ ID NO: 787115 - RNA, 23 nt, Homo sapiens
uucauguguauggaauauauucu

SEQ ID NO: 787116 - RNA, 16 nt, Homo sapiens
uucauucugaugucca

SEQ ID NO: 787117 - RNA, 13 nt, Homo sapiens
uucauucugcauu

SEQ ID NO: 787118 - RNA, 22 nt, Homo sapiens
uucauucugcauugcuagauaa

SEQ ID NO: 787119 - RNA, 20 nt, Homo sapiens
uucauugagcaguuagcuca

SEQ ID NO: 787120 - RNA, 13 nt, Homo sapiens
uucauugcacuuu

SEQ ID NO: 787121 - RNA, 22 nt, Homo sapiens
uucauugucuacauagugacau

SEQ ID NO: 787122 - RNA, 22 nt, Homo sapiens
uucauugugagauugcaguucu

SEQ ID NO: 787123 - RNA, 23 nt, Homo sapiens
uucauugugagauugcaguucug

SEQ ID NO: 787124 - RNA, 22 nt, Homo sapiens
uucauuuaauggggauuccacu

SEQ ID NO: 787125 - RNA, 14 nt, Homo sapiens
uucauuuauaucgc

SEQ ID NO: 787126 - RNA, 19 nt, Homo sapiens
uucauuucagauaaacaac

SEQ ID NO: 787127 - RNA, 23 nt, Homo sapiens
uucauuucagauaaacaacaaau

SEQ ID NO: 787128 - RNA, 16 nt, Homo sapiens
uucauuucuagacuca

SEQ ID NO: 787129 - RNA, 20 nt, Homo sapiens
uucauuucuuuccuuaucac

SEQ ID NO: 787130 - RNA, 12 nt, Homo sapiens
uucauuuguaug

SEQ ID NO: 787131 - RNA, 17 nt, Homo sapiens
uucauuuugagaucaag

SEQ ID NO: 787132 - RNA, 12 nt, Homo sapiens
uucauuuugcca

SEQ ID NO: 787133 - RNA, 15 nt, Homo sapiens
uuccaaacacauaca

SEQ ID NO: 787134 - RNA, 19 nt, Homo sapiens
uuccaaacacauacaggaa

SEQ ID NO: 787135 - RNA, 21 nt, Homo sapiens
uuccaaaccugacagauguca

SEQ ID NO: 787136 - RNA, 17 nt, Homo sapiens
uuccaaacucuucccuc

SEQ ID NO: 787137 - RNA, 11 nt, Homo sapiens
uuccaaagaca

SEQ ID NO: 787138 - RNA, 19 nt, Homo sapiens
uuccaaagacucccuccau

SEQ ID NO: 787139 - RNA, 20 nt, Homo sapiens
uuccaaagcagccugugaag

SEQ ID NO: 787140 - RNA, 12 nt, Homo sapiens
uuccaaauucau

SEQ ID NO: 787141 - RNA, 23 nt, Homo sapiens
uuccaacaauggggugggcccau

SEQ ID NO: 787142 - RNA, 22 nt, Homo sapiens
uuccaacagcaacacagccacu

SEQ ID NO: 787143 - RNA, 19 nt, Homo sapiens
uuccaacguggcccagaga

SEQ ID NO: 787144 - RNA, 16 nt, Homo sapiens
uuccaacugggcauuu

SEQ ID NO: 787145 - RNA, 14 nt, Homo sapiens
uuccaacuugucug

SEQ ID NO: 787146 - RNA, 17 nt, Homo sapiens
cuggguuucuaagcagu

SEQ ID NO: 787147 - RNA, 21 nt, Homo sapiens
cugguaaaaagauccagggau

SEQ ID NO: 787148 - RNA, 21 nt, Homo sapiens
cugguaacaguucauguuugc

SEQ ID NO: 787149 - RNA, 17 nt, Homo sapiens
cugguacgaaucucauc

SEQ ID NO: 787150 - RNA, 20 nt, Homo sapiens
cugguagaaaggcaguucag

SEQ ID NO: 787151 - RNA, 19 nt, Homo sapiens
cugguauuaacuuuauaca

SEQ ID NO: 787152 - RNA, 17 nt, Homo sapiens
cuggucagaugauauaa

SEQ ID NO: 787153 - RNA, 21 nt, Homo sapiens
cuggucagcauguacuccccu

SEQ ID NO: 787154 - RNA, 21 nt, Homo sapiens
cugguccccuccucagugaca

SEQ ID NO: 787155 - RNA, 15 nt, Homo sapiens
cuggucccuugcagc

SEQ ID NO: 787156 - RNA, 16 nt, Homo sapiens
cugguccuggagacaa

SEQ ID NO: 787157 - RNA, 23 nt, Homo sapiens
cuggucuagucacgcaugcagug

SEQ ID NO: 787158 - RNA, 22 nt, Homo sapiens
cuggucugugaagagccggugg

SEQ ID NO: 787159 - RNA, 14 nt, Homo sapiens
cuggugacaccagc

SEQ ID NO: 787160 - RNA, 15 nt, Homo sapiens
cuggugagaggugca

SEQ ID NO: 787161 - RNA, 11 nt, Homo sapiens
cuggugcacag

SEQ ID NO: 787162 - RNA, 17 nt, Homo sapiens
cuggugccccacugaau

SEQ ID NO: 787163 - RNA, 17 nt, Homo sapiens
cuggugcuacuccaugc

SEQ ID NO: 787164 - RNA, 15 nt, Homo sapiens
cugguggcacaggag

SEQ ID NO: 787165 - RNA, 19 nt, Homo sapiens
cugguggcccgacagccug

SEQ ID NO: 787166 - RNA, 13 nt, Homo sapiens
cuggugggacagu

SEQ ID NO: 787167 - RNA, 15 nt, Homo sapiens
cuggugggacagugg

SEQ ID NO: 787168 - RNA, 15 nt, Homo sapiens
cuuaaaaaaugucca

SEQ ID NO: 787169 - RNA, 15 nt, Homo sapiens
cuuaaaacaaauuca

SEQ ID NO: 787170 - RNA, 22 nt, Homo sapiens
cuuaaaacaaauucauuauucu

SEQ ID NO: 787171 - RNA, 22 nt, Homo sapiens
cuuaaaacuaaauguaauuuau

SEQ ID NO: 787172 - RNA, 22 nt, Homo sapiens
cuuaaaagaaacuauaaaguuu

SEQ ID NO: 787173 - RNA, 18 nt, Homo sapiens
cuuaaaagaacauguaua

SEQ ID NO: 787174 - RNA, 22 nt, Homo sapiens
cuuaaaagcaaguuucagugaa

SEQ ID NO: 787175 - RNA, 20 nt, Homo sapiens
cuuaaaauaaugaauacauu

SEQ ID NO: 787176 - RNA, 14 nt, Homo sapiens
cuuaaaauguuaac

SEQ ID NO: 787177 - RNA, 14 nt, Homo sapiens
cuuaaaauugauau

SEQ ID NO: 787178 - RNA, 14 nt, Homo sapiens
cuuaaacaauguau

SEQ ID NO: 787179 - RNA, 15 nt, Homo sapiens
cuuaaacccauacaa

SEQ ID NO: 787180 - RNA, 18 nt, Homo sapiens
cuuaaacuaugaaccuuc

SEQ ID NO: 787181 - RNA, 20 nt, Homo sapiens
cuuaaacucuggacacucua

SEQ ID NO: 787182 - RNA, 23 nt, Homo sapiens
cuuaaacuguguggacugugaug

SEQ ID NO: 787183 - RNA, 12 nt, Homo sapiens
cuuaaagcugcu

SEQ ID NO: 787184 - RNA, 23 nt, Homo sapiens
cuuaaaggccuggaaccagggag

SEQ ID NO: 787185 - RNA, 20 nt, Homo sapiens
cuuaaagggcccaaugaauu

SEQ ID NO: 787186 - RNA, 23 nt, Homo sapiens
cuuaaauaaaaauaaaaauucau

SEQ ID NO: 787187 - RNA, 23 nt, Homo sapiens
cuuaaauaacaaaacugugccaa

SEQ ID NO: 787188 - RNA, 21 nt, Homo sapiens
cuuaaauauauaauguugcca

SEQ ID NO: 787189 - RNA, 13 nt, Homo sapiens
cuuaaaugccaau

SEQ ID NO: 787190 - RNA, 15 nt, Homo sapiens
cuuaacaaaccaaca

SEQ ID NO: 787191 - RNA, 15 nt, Homo sapiens
cuuaacacacuggcc

SEQ ID NO: 787192 - RNA, 16 nt, Homo sapiens
cuuaacacacuggcca

SEQ ID NO: 787193 - RNA, 23 nt, Homo sapiens
cuuaacacacuggccauucuuau

SEQ ID NO: 787194 - RNA, 17 nt, Homo sapiens
cuuaacagaugcaaugu

SEQ ID NO: 787195 - RNA, 18 nt, Homo sapiens
cuuaacaugggcucuuca

SEQ ID NO: 787196 - RNA, 12 nt, Homo sapiens
cuuaacauucau

SEQ ID NO: 787197 - RNA, 15 nt, Homo sapiens
cuuaacauucauaga

SEQ ID NO: 787198 - RNA, 21 nt, Homo sapiens
cuuaaccagucucucaaguga

SEQ ID NO: 787199 - RNA, 23 nt, Homo sapiens
cuuaaccagucucucaagugaug

SEQ ID NO: 787200 - RNA, 17 nt, Homo sapiens
cuuaacccugugcuguc

SEQ ID NO: 787201 - RNA, 19 nt, Homo sapiens
cuuaaccuuugcuauguaa

SEQ ID NO: 787202 - RNA, 19 nt, Homo sapiens
cuuaacggaccaaagcaag

SEQ ID NO: 787203 - RNA, 14 nt, Homo sapiens
cuuaacuauuucac

SEQ ID NO: 787204 - RNA, 23 nt, Homo sapiens
cuuaacucacuggcgagaauaca

SEQ ID NO: 787205 - RNA, 20 nt, Homo sapiens
cuuaacuuguuugguaguua

SEQ ID NO: 787206 - RNA, 19 nt, Homo sapiens
cuuaacuuucccaugguca

SEQ ID NO: 787207 - RNA, 22 nt, Homo sapiens
cuuaagcaaaggggacagcugu

SEQ ID NO: 787208 - RNA, 19 nt, Homo sapiens
cuuaagcccagugcacuga

SEQ ID NO: 787209 - RNA, 16 nt, Homo sapiens
cuuaaguacuguagaa

SEQ ID NO: 787210 - RNA, 20 nt, Homo sapiens
cuuaagugcccacauuugau

SEQ ID NO: 787211 - RNA, 21 nt, Homo sapiens
cuuaaguuuuagucuuuagaa

SEQ ID NO: 787212 - RNA, 19 nt, Homo sapiens
cuuaauaaauuguguuucc

SEQ ID NO: 787213 - RNA, 15 nt, Homo sapiens
cuuaauaaguauuua

SEQ ID NO: 787214 - RNA, 20 nt, Homo sapiens
cuuaauaauuuuuaccuaau

SEQ ID NO: 787215 - RNA, 14 nt, Homo sapiens
cuuaauauguuaac

SEQ ID NO: 787216 - RNA, 14 nt, Homo sapiens
cuuaauauguucuu

SEQ ID NO: 787217 - RNA, 17 nt, Homo sapiens
cuuaauccauuucuuga

SEQ ID NO: 787218 - RNA, 18 nt, Homo sapiens
cuuaaugcuacaugugag

SEQ ID NO: 787219 - RNA, 19 nt, Homo sapiens
cuuaauguugaaugcugcu

SEQ ID NO: 787220 - RNA, 21 nt, Homo sapiens
cuuaauucagucucagcugcu

SEQ ID NO: 787221 - RNA, 18 nt, Homo sapiens
cuuaauuuauuucuuaac

SEQ ID NO: 787222 - RNA, 21 nt, Homo sapiens
cuuaauuucauagauuguguu

SEQ ID NO: 787223 - RNA, 14 nt, Homo sapiens
cuuaauuugcacag

SEQ ID NO: 787224 - RNA, 13 nt, Homo sapiens
cuuacaacccagg

SEQ ID NO: 787225 - RNA, 16 nt, Homo sapiens
cuuacagaacuacuuc

SEQ ID NO: 787226 - RNA, 17 nt, Homo sapiens
cuuacauguguaaaggu

SEQ ID NO: 787227 - RNA, 22 nt, Homo sapiens
cuuacauuuuccugagaccuca

SEQ ID NO: 787228 - RNA, 22 nt, Homo sapiens
cuuacauuuuucagacuucauc

SEQ ID NO: 787229 - RNA, 21 nt, Homo sapiens
cuuaccagggccucaguuuca

SEQ ID NO: 787230 - RNA, 18 nt, Homo sapiens
cuuaccuaucuguggaaa

SEQ ID NO: 787231 - RNA, 16 nt, Homo sapiens
cuuaccucacagugau

SEQ ID NO: 787232 - RNA, 16 nt, Homo sapiens
cuuaccugggaccuca

SEQ ID NO: 787233 - RNA, 17 nt, Homo sapiens
cuuaccuuuccugaugc

SEQ ID NO: 787234 - RNA, 11 nt, Homo sapiens
cuuacuccauc

SEQ ID NO: 787235 - RNA, 16 nt, Homo sapiens
cuuacucuaagaucuu

SEQ ID NO: 787236 - RNA, 13 nt, Homo sapiens
cuuacuggugcua

SEQ ID NO: 787237 - RNA, 21 nt, Homo sapiens
cuuacuucccuaaugaaguua

SEQ ID NO: 787238 - RNA, 14 nt, Homo sapiens
cuuacuuugaguua

SEQ ID NO: 787239 - RNA, 18 nt, Homo sapiens
cuuagaaaacaaguauug

SEQ ID NO: 787240 - RNA, 23 nt, Homo sapiens
cuuagaaacaaaaagagcuuucc

SEQ ID NO: 787241 - RNA, 14 nt, Homo sapiens
cuuagaaauuguaa

SEQ ID NO: 787242 - RNA, 16 nt, Homo sapiens
cuuagaagugcuauaa

SEQ ID NO: 787243 - RNA, 18 nt, Homo sapiens
cuuagaauugaccaaaua

SEQ ID NO: 787244 - RNA, 23 nt, Homo sapiens
cuuagaauuuuggguauuguaau

SEQ ID NO: 787245 - RNA, 16 nt, Homo sapiens
cuuagacuucgacuca

SEQ ID NO: 787246 - RNA, 16 nt, Homo sapiens
cuuagcagcuaucucu

SEQ ID NO: 787247 - RNA, 18 nt, Homo sapiens
cuuagcagcuaucucuca

SEQ ID NO: 787248 - RNA, 18 nt, Homo sapiens
cuuagcccaagaggucug

SEQ ID NO: 787249 - RNA, 15 nt, Homo sapiens
cuuagccuacagaug

SEQ ID NO: 787250 - RNA, 22 nt, Homo sapiens
cuuagcuauccuuggcuuucag

SEQ ID NO: 787251 - RNA, 15 nt, Homo sapiens
cuuagcuuacaggaa

SEQ ID NO: 787252 - RNA, 17 nt, Homo sapiens
cuuagcuuagaccucag

SEQ ID NO: 787253 - RNA, 15 nt, Homo sapiens
cuuaggaaggaguau

SEQ ID NO: 787254 - RNA, 20 nt, Homo sapiens
cuuaggaaggccuucaggag

SEQ ID NO: 787255 - RNA, 14 nt, Homo sapiens
cuuagguugcugac

SEQ ID NO: 787256 - RNA, 16 nt, Homo sapiens
cuuaguaagugcuuuu

SEQ ID NO: 787257 - RNA, 22 nt, Homo sapiens
cuuaguaagugcuuuucuuaua

SEQ ID NO: 787258 - RNA, 18 nt, Homo sapiens
cuuaguauuucucaggaa

SEQ ID NO: 787259 - RNA, 12 nt, Homo sapiens
cuuagugacaaa

SEQ ID NO: 787260 - RNA, 18 nt, Homo sapiens
cuuaguuauuuaccaaag

SEQ ID NO: 787261 - RNA, 21 nt, Homo sapiens
uuccaagacagagucuugcuc

SEQ ID NO: 787262 - RNA, 14 nt, Homo sapiens
uuccaagugccaau

SEQ ID NO: 787263 - RNA, 14 nt, Homo sapiens
uuccaaguguaaaa

SEQ ID NO: 787264 - RNA, 11 nt, Homo sapiens
uuccacaaaau

SEQ ID NO: 787265 - RNA, 17 nt, Homo sapiens
uuccacacagaaugcaa

SEQ ID NO: 787266 - RNA, 23 nt, Homo sapiens
uuccacacagaaugcaaccaagu

SEQ ID NO: 787267 - RNA, 21 nt, Homo sapiens
uuccaccaagcguuucccagu

SEQ ID NO: 787268 - RNA, 15 nt, Homo sapiens
uuccacccuggagac

SEQ ID NO: 787269 - RNA, 16 nt, Homo sapiens
uuccaccuucuacgca

SEQ ID NO: 787270 - RNA, 17 nt, Homo sapiens
uuccacuuaggaagaaa

SEQ ID NO: 787271 - RNA, 17 nt, Homo sapiens
uuccacuuguguauauu

SEQ ID NO: 787272 - RNA, 17 nt, Homo sapiens
uuccacuuguuugcacu

SEQ ID NO: 787273 - RNA, 22 nt, Homo sapiens
uuccagaaacuuuaagaacaaa

SEQ ID NO: 787274 - RNA, 21 nt, Homo sapiens
uuccagaagaaagauggaaau

SEQ ID NO: 787275 - RNA, 15 nt, Homo sapiens
uuccagaaugcugaa

SEQ ID NO: 787276 - RNA, 13 nt, Homo sapiens
uuccagacugcuu

SEQ ID NO: 787277 - RNA, 19 nt, Homo sapiens
uuccagacuuccuugagac

SEQ ID NO: 787278 - RNA, 17 nt, Homo sapiens
uuccagaguccuccuuu

SEQ ID NO: 787279 - RNA, 22 nt, Homo sapiens
uuccagccuucuacugcucucc

SEQ ID NO: 787280 - RNA, 20 nt, Homo sapiens
uuccagcugacaucuugcac

SEQ ID NO: 787281 - RNA, 23 nt, Homo sapiens
uuccagcuuagaaugcaucucau

SEQ ID NO: 787282 - RNA, 19 nt, Homo sapiens
gaaggaggagucagggaga

SEQ ID NO: 787283 - RNA, 15 nt, Homo sapiens
gaaggauaaaagccc

SEQ ID NO: 787284 - RNA, 17 nt, Homo sapiens
gaaggaucauucaaaag

SEQ ID NO: 787285 - RNA, 15 nt, Homo sapiens
gaaggcaaccuggaa

SEQ ID NO: 787286 - RNA, 23 nt, Homo sapiens
gaaggcaauuuuaguguauuaau

SEQ ID NO: 787287 - RNA, 20 nt, Homo sapiens
gaaggcagagguugcaguga

SEQ ID NO: 787288 - RNA, 14 nt, Homo sapiens
gaaggcauaugcac

SEQ ID NO: 787289 - RNA, 13 nt, Homo sapiens
gaaggccacuuga

SEQ ID NO: 787290 - RNA, 23 nt, Homo sapiens
gaaggccucuuguugagugccag

SEQ ID NO: 787291 - RNA, 11 nt, Homo sapiens
gaaucucugag

SEQ ID NO: 787292 - RNA, 20 nt, Homo sapiens
gaaucucuucacuacccuga

SEQ ID NO: 787293 - RNA, 20 nt, Homo sapiens
gaaucucuuggaugcagcuu

SEQ ID NO: 787294 - RNA, 20 nt, Homo sapiens
gaaucugugcagaugagcag

SEQ ID NO: 787295 - RNA, 19 nt, Homo sapiens
gaaucugugggucugggag

SEQ ID NO: 787296 - RNA, 19 nt, Homo sapiens
gaaucuguuucucugcugu

SEQ ID NO: 787297 - RNA, 18 nt, Homo sapiens
caugaagauaaacuguuc

SEQ ID NO: 787298 - RNA, 14 nt, Homo sapiens
caugaagcacauca

SEQ ID NO: 787299 - RNA, 21 nt, Homo sapiens
caugaagcccaagugaaauca

SEQ ID NO: 787300 - RNA, 23 nt, Homo sapiens
caugaagcuguugcggacaucau

SEQ ID NO: 787301 - RNA, 18 nt, Homo sapiens
caugaaggauaaaagccc

SEQ ID NO: 787302 - RNA, 21 nt, Homo sapiens
caugaaggauaaaagccccaa

SEQ ID NO: 787303 - RNA, 14 nt, Homo sapiens
caugaagugcacag

SEQ ID NO: 787304 - RNA, 20 nt, Homo sapiens
caugaaguggaaaaaggaga

SEQ ID NO: 787305 - RNA, 19 nt, Homo sapiens
caugaauauaaaugggaaa

SEQ ID NO: 787306 - RNA, 21 nt, Homo sapiens
caugaauauaaaugggaaauc

SEQ ID NO: 787307 - RNA, 23 nt, Homo sapiens
caugaauauuucauaucuauaaa

SEQ ID NO: 787308 - RNA, 23 nt, Homo sapiens
caugaaucccacccacaugugac

SEQ ID NO: 787309 - RNA, 17 nt, Homo sapiens
caugaauguaucaggaa

SEQ ID NO: 787310 - RNA, 13 nt, Homo sapiens
caugaaugugcug

SEQ ID NO: 787311 - RNA, 11 nt, Homo sapiens
caugacacuga

SEQ ID NO: 787312 - RNA, 18 nt, Homo sapiens
caugacacugaccuugga

SEQ ID NO: 787313 - RNA, 19 nt, Homo sapiens
caugacauucuuagcugua

SEQ ID NO: 787314 - RNA, 15 nt, Homo sapiens
caugacucagacugc

SEQ ID NO: 787315 - RNA, 18 nt, Homo sapiens
caugacuuuauauggaug

SEQ ID NO: 787316 - RNA, 14 nt, Homo sapiens
caugagaauaagag

SEQ ID NO: 787317 - RNA, 23 nt, Homo sapiens
caugagauguguggacuguggca

SEQ ID NO: 787318 - RNA, 17 nt, Homo sapiens
caugaggacagaccaca

SEQ ID NO: 787319 - RNA, 20 nt, Homo sapiens
caugaggccaccaguaaaag

SEQ ID NO: 787320 - RNA, 15 nt, Homo sapiens
caugagggacuccuc

SEQ ID NO: 787321 - RNA, 17 nt, Homo sapiens
caugagggcaggcacau

SEQ ID NO: 787322 - RNA, 17 nt, Homo sapiens
caugagucagauacaca

SEQ ID NO: 787323 - RNA, 15 nt, Homo sapiens
caugaguccuugaaa

SEQ ID NO: 787324 - RNA, 16 nt, Homo sapiens
caugauacaaauucca

SEQ ID NO: 787325 - RNA, 22 nt, Homo sapiens
caugaucccuguguugucucua

SEQ ID NO: 787326 - RNA, 21 nt, Homo sapiens
caugaucgagccacugcacuc

SEQ ID NO: 787327 - RNA, 16 nt, Homo sapiens
caugaugcccugcuga

SEQ ID NO: 787328 - RNA, 19 nt, Homo sapiens
caugauggagcgcaccugc

SEQ ID NO: 787329 - RNA, 23 nt, Homo sapiens
caugauggcaccacugcacucca

SEQ ID NO: 787330 - RNA, 19 nt, Homo sapiens
caugauggccuuacacuga

SEQ ID NO: 787331 - RNA, 21 nt, Homo sapiens
caugauggccuuacacugaaa

SEQ ID NO: 787332 - RNA, 15 nt, Homo sapiens
caugaugucaacuca

SEQ ID NO: 787333 - RNA, 17 nt, Homo sapiens
caugaugucaacucacu

SEQ ID NO: 787334 - RNA, 14 nt, Homo sapiens
caugauucuuuaau

SEQ ID NO: 787335 - RNA, 15 nt, Homo sapiens
caugauuguuuacag

SEQ ID NO: 787336 - RNA, 22 nt, Homo sapiens
caugauuguuugacacaccauu

SEQ ID NO: 787337 - RNA, 19 nt, Homo sapiens
caugauuucccacugcacu

SEQ ID NO: 787338 - RNA, 20 nt, Homo sapiens
caugcaagaaguacugccaa

SEQ ID NO: 787339 - RNA, 14 nt, Homo sapiens
caugcaaggugccc

SEQ ID NO: 787340 - RNA, 21 nt, Homo sapiens
gacuuucugauuacuguccag

SEQ ID NO: 787341 - RNA, 18 nt, Homo sapiens
gacuuuguguucauuuca

SEQ ID NO: 787342 - RNA, 15 nt, Homo sapiens
gagaaaaaaaggaaa

SEQ ID NO: 787343 - RNA, 14 nt, Homo sapiens
gagaaaagccucuc

SEQ ID NO: 787344 - RNA, 22 nt, Homo sapiens
gagaaaauaaagaccuugcuua

SEQ ID NO: 787345 - RNA, 16 nt, Homo sapiens
gagaaaauauuacuua

SEQ ID NO: 787346 - RNA, 16 nt, Homo sapiens
gagaaaauuccuagaa

SEQ ID NO: 787347 - RNA, 20 nt, Homo sapiens
gagaaaccuuauuguaccuc

SEQ ID NO: 787348 - RNA, 15 nt, Homo sapiens
gagaaagacuauuca

SEQ ID NO: 787349 - RNA, 23 nt, Homo sapiens
gagaaaggauugauuugaacuua

SEQ ID NO: 787350 - RNA, 21 nt, Homo sapiens
gagaaagggagugcaugugcg

SEQ ID NO: 787351 - RNA, 17 nt, Homo sapiens
gagaaaguucucauuua

SEQ ID NO: 787352 - RNA, 14 nt, Homo sapiens
gagaacagcauuua

SEQ ID NO: 787353 - RNA, 13 nt, Homo sapiens
gagaaccucaggc

SEQ ID NO: 787354 - RNA, 17 nt, Homo sapiens
gagaacuugaaacagau

SEQ ID NO: 787355 - RNA, 22 nt, Homo sapiens
gagaagaaaacaucuauucucu

SEQ ID NO: 787356 - RNA, 18 nt, Homo sapiens
gagaagauuuuauucuua

SEQ ID NO: 787357 - RNA, 17 nt, Homo sapiens
gagaagcaaguggcuuu

SEQ ID NO: 787358 - RNA, 20 nt, Homo sapiens
gagaagccaggaauuuccca

SEQ ID NO: 787359 - RNA, 18 nt, Homo sapiens
gagaagcuccucucccca

SEQ ID NO: 787360 - RNA, 15 nt, Homo sapiens
gagaaggcacacaga

SEQ ID NO: 787361 - RNA, 22 nt, Homo sapiens
gagaaguacaaagguugcagug

SEQ ID NO: 787362 - RNA, 18 nt, Homo sapiens
gagaaguucccauuauua

SEQ ID NO: 787363 - RNA, 23 nt, Homo sapiens
gagaaucccacauuagcuuguua

SEQ ID NO: 787364 - RNA, 22 nt, Homo sapiens
gagaaugaucaaggaucuggac

SEQ ID NO: 787365 - RNA, 21 nt, Homo sapiens
gagaauguguuucaaaaccau

SEQ ID NO: 787366 - RNA, 16 nt, Homo sapiens
gagaauguuguauuca

SEQ ID NO: 787367 - RNA, 18 nt, Homo sapiens
gagaauuccuccuggcag

SEQ ID NO: 787368 - RNA, 20 nt, Homo sapiens
gagaauugugcuuucaccag

SEQ ID NO: 787369 - RNA, 16 nt, Homo sapiens
gagaauuuaaacaaug

SEQ ID NO: 787370 - RNA, 17 nt, Homo sapiens
gagacaaacuuguucaa

SEQ ID NO: 787371 - RNA, 12 nt, Homo sapiens
gagacaccaaac

SEQ ID NO: 787372 - RNA, 18 nt, Homo sapiens
gagacaccacaaggcagc

SEQ ID NO: 787373 - RNA, 13 nt, Homo sapiens
gagacaccaggca

SEQ ID NO: 787374 - RNA, 19 nt, Homo sapiens
gagacaccauccugagcca

SEQ ID NO: 787375 - RNA, 22 nt, Homo sapiens
gagacacuauuuaucugugcaa

SEQ ID NO: 787376 - RNA, 23 nt, Homo sapiens
gagacacuauuuaucugugcaaa

SEQ ID NO: 787377 - RNA, 12 nt, Homo sapiens
gagacagaauag

SEQ ID NO: 787378 - RNA, 21 nt, Homo sapiens
gagacagagucuuacucuguu

SEQ ID NO: 787379 - RNA, 18 nt, Homo sapiens
gagacagcgcuaaggaug

SEQ ID NO: 787380 - RNA, 15 nt, Homo sapiens
gagacaggagccuag

SEQ ID NO: 787381 - RNA, 22 nt, Homo sapiens
gagacauacuugaagggccaga

SEQ ID NO: 787382 - RNA, 21 nt, Homo sapiens
gagaccacacugcacacagug

SEQ ID NO: 787383 - RNA, 20 nt, Homo sapiens
gagaccaccuuuuugaguga

SEQ ID NO: 787384 - RNA, 15 nt, Homo sapiens
gagaccauccuggcc

SEQ ID NO: 787385 - RNA, 15 nt, Homo sapiens
gagacccaacagcag

SEQ ID NO: 787386 - RNA, 23 nt, Homo sapiens
gagacccccacaccucaguuccc

SEQ ID NO: 787387 - RNA, 14 nt, Homo sapiens
gagacgcaggaaug

SEQ ID NO: 787388 - RNA, 16 nt, Homo sapiens
gagacuaggagggaau

SEQ ID NO: 787389 - RNA, 20 nt, Homo sapiens
gagacucaccucugccucaa

SEQ ID NO: 787390 - RNA, 23 nt, Homo sapiens
gagacuccaucucuuuaaaaaca

SEQ ID NO: 787391 - RNA, 14 nt, Homo sapiens
gagacuccgucuca

SEQ ID NO: 787392 - RNA, 18 nt, Homo sapiens
gagacuccgucucaagga

SEQ ID NO: 787393 - RNA, 19 nt, Homo sapiens
gagacucgagaacuuucau

SEQ ID NO: 787394 - RNA, 13 nt, Homo sapiens
gagacucuagggu

SEQ ID NO: 787395 - RNA, 16 nt, Homo sapiens
gagacucuagggucca

SEQ ID NO: 787396 - RNA, 20 nt, Homo sapiens
gagacugggagccacuucuc

SEQ ID NO: 787397 - RNA, 16 nt, Homo sapiens
gagacugucccugaaa

SEQ ID NO: 787398 - RNA, 21 nt, Homo sapiens
gagacugucucaagagggcac

SEQ ID NO: 787399 - RNA, 22 nt, Homo sapiens
gagacuugguacccacugggac

SEQ ID NO: 787400 - RNA, 13 nt, Homo sapiens
gagagaaaaaaga

SEQ ID NO: 787401 - RNA, 13 nt, Homo sapiens
gagagaacuggag

SEQ ID NO: 787402 - RNA, 22 nt, Homo sapiens
gagagaaguuaauccacaucuu

SEQ ID NO: 787403 - RNA, 21 nt, Homo sapiens
gagagacccugucucaaaaaa

SEQ ID NO: 787404 - RNA, 18 nt, Homo sapiens
gagagaggcugccucagc

SEQ ID NO: 787405 - RNA, 17 nt, Homo sapiens
gagagcagcaggugcug

SEQ ID NO: 787406 - RNA, 13 nt, Homo sapiens
gagagccaagacg

SEQ ID NO: 787407 - RNA, 14 nt, Homo sapiens
gagagcccauuccc

SEQ ID NO: 787408 - RNA, 15 nt, Homo sapiens
gagagccuugguuca

SEQ ID NO: 787409 - RNA, 19 nt, Homo sapiens
gagagcggggaugugacau

SEQ ID NO: 787410 - RNA, 18 nt, Homo sapiens
gagagcuugcugugacua

SEQ ID NO: 787411 - RNA, 13 nt, Homo sapiens
gagaggaacccag

SEQ ID NO: 787412 - RNA, 22 nt, Homo sapiens
gagaggcagcaagguggccaca

SEQ ID NO: 787413 - RNA, 18 nt, Homo sapiens
gagaggccuuuuggaaug

SEQ ID NO: 787414 - RNA, 15 nt, Homo sapiens
gagaggcucugagaa

SEQ ID NO: 787415 - RNA, 21 nt, Homo sapiens
gagaggggccugcaggugagc

SEQ ID NO: 787416 - RNA, 13 nt, Homo sapiens
gagaggggggcca

SEQ ID NO: 787417 - RNA, 17 nt, Homo sapiens
gagaguaauggguuuca

SEQ ID NO: 787418 - RNA, 19 nt, Homo sapiens
gagaguaguuuuucagcua

SEQ ID NO: 787419 - RNA, 17 nt, Homo sapiens
gagagugugcucucccc

SEQ ID NO: 787420 - RNA, 18 nt, Homo sapiens
gagaguuaaaagcagcag

SEQ ID NO: 787421 - RNA, 14 nt, Homo sapiens
gagaguuucuguua

SEQ ID NO: 787422 - RNA, 13 nt, Homo sapiens
gagaguuugccug

SEQ ID NO: 787423 - RNA, 15 nt, Homo sapiens
gagauaaaagcaauu

SEQ ID NO: 787424 - RNA, 14 nt, Homo sapiens
gagauaaagucaaa

SEQ ID NO: 787425 - RNA, 16 nt, Homo sapiens
gagauaagucuuucau

SEQ ID NO: 787426 - RNA, 19 nt, Homo sapiens
gagauacugaacauuuugc

SEQ ID NO: 787427 - RNA, 21 nt, Homo sapiens
gagauaggccugugggccaga

SEQ ID NO: 787428 - RNA, 18 nt, Homo sapiens
gagauauguguguguuug

SEQ ID NO: 787429 - RNA, 23 nt, Homo sapiens
gagauauguugaauuaacauaau

SEQ ID NO: 787430 - RNA, 13 nt, Homo sapiens
gagaucaacaaca

SEQ ID NO: 787431 - RNA, 20 nt, Homo sapiens
gagaucaucacuuccuugcc

SEQ ID NO: 787432 - RNA, 15 nt, Homo sapiens
gagauccagugcagu

SEQ ID NO: 787433 - RNA, 14 nt, Homo sapiens
gagaucgagaccau

SEQ ID NO: 787434 - RNA, 16 nt, Homo sapiens
gagaucguuguuuaca

SEQ ID NO: 787435 - RNA, 20 nt, Homo sapiens
gagaucguuguuuacagugu

SEQ ID NO: 787436 - RNA, 20 nt, Homo sapiens
gagaugaaucaaaaccagug

SEQ ID NO: 787437 - RNA, 14 nt, Homo sapiens
gagaugacagggaa

SEQ ID NO: 787438 - RNA, 22 nt, Homo sapiens
gagaugcagucacuuauugucc

SEQ ID NO: 787439 - RNA, 18 nt, Homo sapiens
gagaugccacuucucacu

SEQ ID NO: 787440 - RNA, 16 nt, Homo sapiens
gagaugcccauucucu

SEQ ID NO: 787441 - RNA, 17 nt, Homo sapiens
gagauggaggaaaguga

SEQ ID NO: 787442 - RNA, 21 nt, Homo sapiens
gagaugggacaagcagucccu

SEQ ID NO: 787443 - RNA, 23 nt, Homo sapiens
gagaugggcuuguuuucuugcca

SEQ ID NO: 787444 - RNA, 17 nt, Homo sapiens
gagauggguuugacaag

SEQ ID NO: 787445 - RNA, 11 nt, Homo sapiens
gagauguaucc

SEQ ID NO: 787446 - RNA, 22 nt, Homo sapiens
gagauugcacuauugcacucca

SEQ ID NO: 787447 - RNA, 16 nt, Homo sapiens
gagauuggcuuugccu

SEQ ID NO: 787448 - RNA, 17 nt, Homo sapiens
gagauuguuguuugcca

SEQ ID NO: 787449 - RNA, 11 nt, Homo sapiens
gagauuugcca

SEQ ID NO: 787450 - RNA, 13 nt, Homo sapiens
gagcaaacugcuc

SEQ ID NO: 787451 - RNA, 19 nt, Homo sapiens
gagcaaaucaauucuaguc

SEQ ID NO: 787452 - RNA, 20 nt, Homo sapiens
gagcaaaucaauucuaguca

SEQ ID NO: 787453 - RNA, 22 nt, Homo sapiens
cuuauuuuguaagagugagcuc

SEQ ID NO: 787454 - RNA, 21 nt, Homo sapiens
cuuauuuugugugcuuuccca

SEQ ID NO: 787455 - RNA, 19 nt, Homo sapiens
cuuauuuuuguucauauua

SEQ ID NO: 787456 - RNA, 20 nt, Homo sapiens
cuucaaagccuucucccuag

SEQ ID NO: 787457 - RNA, 21 nt, Homo sapiens
cuucaaauuagaagacauuua

SEQ ID NO: 787458 - RNA, 22 nt, Homo sapiens
cuucaaauuagaagacauuuau

SEQ ID NO: 787459 - RNA, 14 nt, Homo sapiens
cuucaacccagugg

SEQ ID NO: 787460 - RNA, 16 nt, Homo sapiens
cuucaagaacauucua

SEQ ID NO: 787461 - RNA, 18 nt, Homo sapiens
cuucaagccugugcaaug

SEQ ID NO: 787462 - RNA, 21 nt, Homo sapiens
cuucaaguauaacaacuuuga

SEQ ID NO: 787463 - RNA, 14 nt, Homo sapiens
cuucaagugccaaa

SEQ ID NO: 787464 - RNA, 16 nt, Homo sapiens
cuucaaguuagcucag

SEQ ID NO: 787465 - RNA, 14 nt, Homo sapiens
cuucaauacuuaaa

SEQ ID NO: 787466 - RNA, 23 nt, Homo sapiens
cuucaaucucuguucugcuccca

SEQ ID NO: 787467 - RNA, 19 nt, Homo sapiens
cuucaaucucuugcacuca

SEQ ID NO: 787468 - RNA, 21 nt, Homo sapiens
cuucaaucucuugcacucaaa

SEQ ID NO: 787469 - RNA, 15 nt, Homo sapiens
cuucacaaucuguca

SEQ ID NO: 787470 - RNA, 22 nt, Homo sapiens
cuucacaggcagugcaugugaa

SEQ ID NO: 787471 - RNA, 12 nt, Homo sapiens
cuucacaguacc

SEQ ID NO: 787472 - RNA, 17 nt, Homo sapiens
cuucacaguacccaaac

SEQ ID NO: 787473 - RNA, 18 nt, Homo sapiens
cuucacccacgcauauac

SEQ ID NO: 787474 - RNA, 19 nt, Homo sapiens
cuucaccccuacacuguga

SEQ ID NO: 787475 - RNA, 19 nt, Homo sapiens
cuucaccuacauuaucuca

SEQ ID NO: 787476 - RNA, 16 nt, Homo sapiens
cuucacucaggucuca

SEQ ID NO: 787477 - RNA, 11 nt, Homo sapiens
cuucacuguau

SEQ ID NO: 787478 - RNA, 17 nt, Homo sapiens
cuucagaagacacugca

SEQ ID NO: 787479 - RNA, 23 nt, Homo sapiens
cuucagaagacacugcaaaggcg

SEQ ID NO: 787480 - RNA, 12 nt, Homo sapiens
cuucagacaccc

SEQ ID NO: 787481 - RNA, 23 nt, Homo sapiens
cuucagagaaaucugcauucuau

SEQ ID NO: 787482 - RNA, 15 nt, Homo sapiens
cuucagagacuaucu

SEQ ID NO: 787483 - RNA, 17 nt, Homo sapiens
cuucagaggagaaagaa

SEQ ID NO: 787484 - RNA, 17 nt, Homo sapiens
cuucagauacaaacugc

SEQ ID NO: 787485 - RNA, 15 nt, Homo sapiens
cuucagaucugaggu

SEQ ID NO: 787486 - RNA, 16 nt, Homo sapiens
cuucagaugaccucaa

SEQ ID NO: 787487 - RNA, 16 nt, Homo sapiens
cuucagauuaaacccu

SEQ ID NO: 787488 - RNA, 14 nt, Homo sapiens
cuucagauuugccu

SEQ ID NO: 787489 - RNA, 16 nt, Homo sapiens
cuucagcagcagcuca

SEQ ID NO: 787490 - RNA, 16 nt, Homo sapiens
cuucagccaaacacaa

SEQ ID NO: 787491 - RNA, 16 nt, Homo sapiens
cuucagcccaccaccc

SEQ ID NO: 787492 - RNA, 21 nt, Homo sapiens
cuucagccuagccgaccucag

SEQ ID NO: 787493 - RNA, 22 nt, Homo sapiens
cuucagccuagccgaccucagc

SEQ ID NO: 787494 - RNA, 17 nt, Homo sapiens
cuucagccuucaaagua

SEQ ID NO: 787495 - RNA, 21 nt, Homo sapiens
cuucagcugggucacauccau

SEQ ID NO: 787496 - RNA, 22 nt, Homo sapiens
cuucagcugggucacauccauc

SEQ ID NO: 787497 - RNA, 17 nt, Homo sapiens
cuucagcuuaauaagua

SEQ ID NO: 787498 - RNA, 21 nt, Homo sapiens
cuucagggcagggcucugaua

SEQ ID NO: 787499 - RNA, 23 nt, Homo sapiens
cuucaggggcacuucauugagag

SEQ ID NO: 787500 - RNA, 22 nt, Homo sapiens
cuucagguucuuagugucacuu

SEQ ID NO: 787501 - RNA, 22 nt, Homo sapiens
cuucaguauuuuuaaauuguaa

SEQ ID NO: 787502 - RNA, 17 nt, Homo sapiens
cuucagucucacagaga

SEQ ID NO: 787503 - RNA, 19 nt, Homo sapiens
cuucagugacaaacauauc

SEQ ID NO: 787504 - RNA, 17 nt, Homo sapiens
cuucaguuucacagaaa

SEQ ID NO: 787505 - RNA, 14 nt, Homo sapiens
cuucauacuccuuu

SEQ ID NO: 787506 - RNA, 15 nt, Homo sapiens
cuucauauaccagca

SEQ ID NO: 787507 - RNA, 23 nt, Homo sapiens
cuucauauguuggguaagaaaca

SEQ ID NO: 787508 - RNA, 15 nt, Homo sapiens
cuucauccaauguga

SEQ ID NO: 787509 - RNA, 22 nt, Homo sapiens
cuucauccucugagugugacca

SEQ ID NO: 787510 - RNA, 19 nt, Homo sapiens
cuucaucuucacugcaauu

SEQ ID NO: 787511 - RNA, 15 nt, Homo sapiens
cuucaugcaaugaca

SEQ ID NO: 787512 - RNA, 12 nt, Homo sapiens
cuucaugcuuuu

SEQ ID NO: 787513 - RNA, 14 nt, Homo sapiens
cuucaugugcugcc

SEQ ID NO: 787514 - RNA, 22 nt, Homo sapiens
cuucaugugguucagugccuuc

SEQ ID NO: 787515 - RNA, 14 nt, Homo sapiens
cuucauuaccucag

SEQ ID NO: 787516 - RNA, 20 nt, Homo sapiens
cuucauucuccuuguuguug

SEQ ID NO: 787517 - RNA, 18 nt, Homo sapiens
cuucauuguuacauguaa

SEQ ID NO: 787518 - RNA, 15 nt, Homo sapiens
cuucauuucaggaag

SEQ ID NO: 787519 - RNA, 24 nt, Homo sapiens
cuucauuugaugcuaaauaggaga

SEQ ID NO: 787520 - RNA, 23 nt, Homo sapiens
cuuccaaacaacucuuaggauug

SEQ ID NO: 787521 - RNA, 22 nt, Homo sapiens
cuuccaaagagaguuaaaagca

SEQ ID NO: 787522 - RNA, 23 nt, Homo sapiens
cuuccaaauccuggaaggacaca

SEQ ID NO: 787523 - RNA, 17 nt, Homo sapiens
cuuccaaaugugucaga

SEQ ID NO: 787524 - RNA, 14 nt, Homo sapiens
cuuccaacaaggaa

SEQ ID NO: 787525 - RNA, 11 nt, Homo sapiens
cuuccaaggau

SEQ ID NO: 787526 - RNA, 22 nt, Homo sapiens
cuuccacgucuuccuccaagag

SEQ ID NO: 787527 - RNA, 19 nt, Homo sapiens
cuuccacucuggaaccuua

SEQ ID NO: 787528 - RNA, 18 nt, Homo sapiens
cuuccagaaacuacauga

SEQ ID NO: 787529 - RNA, 17 nt, Homo sapiens
cuuccagaucacugcca

SEQ ID NO: 787530 - RNA, 22 nt, Homo sapiens
cuuccagauggucauccagacu

SEQ ID NO: 787531 - RNA, 18 nt, Homo sapiens
cuuccagauugacgacaa

SEQ ID NO: 787532 - RNA, 18 nt, Homo sapiens
cuuccaggggaaccugcc

SEQ ID NO: 787533 - RNA, 16 nt, Homo sapiens
cuuccaguuugcuuga

SEQ ID NO: 787534 - RNA, 22 nt, Homo sapiens
cuuccauaauuaugacaguuau

SEQ ID NO: 787535 - RNA, 21 nt, Homo sapiens
cuuccauaggacauacugcau

SEQ ID NO: 787536 - RNA, 23 nt, Homo sapiens
cuuccauaggacauacugcaugu

SEQ ID NO: 787537 - RNA, 18 nt, Homo sapiens
cuuccaucaucacuguaa

SEQ ID NO: 787538 - RNA, 19 nt, Homo sapiens
cuuccauccaucuuuccau

SEQ ID NO: 787539 - RNA, 14 nt, Homo sapiens
cuuccaucuaguca

SEQ ID NO: 787540 - RNA, 11 nt, Homo sapiens
cuuccaugccc

SEQ ID NO: 787541 - RNA, 13 nt, Homo sapiens
cuuccaugcccca

SEQ ID NO: 787542 - RNA, 19 nt, Homo sapiens
cuuccauucacaccagcua

SEQ ID NO: 787543 - RNA, 15 nt, Homo sapiens
cuuccauuccacaca

SEQ ID NO: 787544 - RNA, 21 nt, Homo sapiens
cuucccaaaguccugggauua

SEQ ID NO: 787545 - RNA, 14 nt, Homo sapiens
cuucccaacuugcc

SEQ ID NO: 787546 - RNA, 22 nt, Homo sapiens
uuccuuuaugaugacugcuuaa

SEQ ID NO: 787547 - RNA, 11 nt, Homo sapiens
uuccuuugaac

SEQ ID NO: 787548 - RNA, 20 nt, Homo sapiens
uuccuuuuuaauaugcuuaa

SEQ ID NO: 787549 - RNA, 13 nt, Homo sapiens
uucgaaaggccuu

SEQ ID NO: 787550 - RNA, 18 nt, Homo sapiens
uucgaggacuacaaccaa

SEQ ID NO: 787551 - RNA, 23 nt, Homo sapiens
uucgauacaccgggccuggagaa

SEQ ID NO: 787552 - RNA, 12 nt, Homo sapiens
uucggaagaccu

SEQ ID NO: 787553 - RNA, 20 nt, Homo sapiens
uucggacaugcuuuucugcc

SEQ ID NO: 787554 - RNA, 23 nt, Homo sapiens
uucggagaggccaagucuaauga

SEQ ID NO: 787555 - RNA, 17 nt, Homo sapiens
uucggauuuggggugga

SEQ ID NO: 787556 - RNA, 15 nt, Homo sapiens
uucggguuggcaaaa

SEQ ID NO: 787557 - RNA, 14 nt, Homo sapiens
uucggucuuuccca

SEQ ID NO: 787558 - RNA, 14 nt, Homo sapiens
uucggugugcugcc

SEQ ID NO: 787559 - RNA, 16 nt, Homo sapiens
uucguaugccagcuca

SEQ ID NO: 787560 - RNA, 15 nt, Homo sapiens
uucgugacaacaugc

SEQ ID NO: 787561 - RNA, 20 nt, Homo sapiens
uucuaaaacauucuuuaaca

SEQ ID NO: 787562 - RNA, 23 nt, Homo sapiens
uucuaaacuaucaauaauacaaa

SEQ ID NO: 787563 - RNA, 17 nt, Homo sapiens
uucuaaaggcuugauau

SEQ ID NO: 787564 - RNA, 18 nt, Homo sapiens
uucuaaauaaauuuccca

SEQ ID NO: 787565 - RNA, 19 nt, Homo sapiens
uucuaaauccgacuugaau

SEQ ID NO: 787566 - RNA, 21 nt, Homo sapiens
uucuaaccuugaaugcugcca

SEQ ID NO: 787567 - RNA, 14 nt, Homo sapiens
cuugacacauuaca

SEQ ID NO: 787568 - RNA, 18 nt, Homo sapiens
cuugaccaauacugaccc

SEQ ID NO: 787569 - RNA, 20 nt, Homo sapiens
cuugaccacggcuguucccc

SEQ ID NO: 787570 - RNA, 16 nt, Homo sapiens
cuugaccagcagaucc

SEQ ID NO: 787571 - RNA, 13 nt, Homo sapiens
cuugaccauucuc

SEQ ID NO: 787572 - RNA, 14 nt, Homo sapiens
cuugaccauucuca

SEQ ID NO: 787573 - RNA, 16 nt, Homo sapiens
cuugacccugagcuua

SEQ ID NO: 787574 - RNA, 14 nt, Homo sapiens
cuugacucuacuau

SEQ ID NO: 787575 - RNA, 13 nt, Homo sapiens
cuugacuggggau

SEQ ID NO: 787576 - RNA, 19 nt, Homo sapiens
cuugacuuccccacugcuc

SEQ ID NO: 787577 - RNA, 21 nt, Homo sapiens
cuugagaaaccuuauuguacc

SEQ ID NO: 787578 - RNA, 19 nt, Homo sapiens
cuugagaccuggaaccaga

SEQ ID NO: 787579 - RNA, 11 nt, Homo sapiens
cuugagccauc

SEQ ID NO: 787580 - RNA, 22 nt, Homo sapiens
cuugagccuauaucagucguuu

SEQ ID NO: 787581 - RNA, 22 nt, Homo sapiens
cuugagcgugaaucuguaucuu

SEQ ID NO: 787582 - RNA, 13 nt, Homo sapiens
cuugagcucuaaa

SEQ ID NO: 787583 - RNA, 15 nt, Homo sapiens
cuugagcuucugggg

SEQ ID NO: 787584 - RNA, 18 nt, Homo sapiens
cuugagcuuggcagcuga

SEQ ID NO: 787585 - RNA, 23 nt, Homo sapiens
cuugaggaccugcgaaauccaga

SEQ ID NO: 787586 - RNA, 14 nt, Homo sapiens
cuugaguucccaga

SEQ ID NO: 787587 - RNA, 14 nt, Homo sapiens
cuugaguuggagua

SEQ ID NO: 787588 - RNA, 15 nt, Homo sapiens
cuugaguuggggcca

SEQ ID NO: 787589 - RNA, 17 nt, Homo sapiens
cuugauacaggggccaa

SEQ ID NO: 787590 - RNA, 18 nt, Homo sapiens
cuugauacauguaauucu

SEQ ID NO: 787591 - RNA, 21 nt, Homo sapiens
cuugauauguaaguacuucca

SEQ ID NO: 787592 - RNA, 23 nt, Homo sapiens
cuugaucaacaucuuuucuugcc

SEQ ID NO: 787593 - RNA, 18 nt, Homo sapiens
cuugaucuguauauacaa

SEQ ID NO: 787594 - RNA, 20 nt, Homo sapiens
cuugauguuccaccugccac

SEQ ID NO: 787595 - RNA, 19 nt, Homo sapiens
cuugauguugcuuagucac

SEQ ID NO: 787596 - RNA, 13 nt, Homo sapiens
cuugauuaagggc

SEQ ID NO: 787597 - RNA, 20 nt, Homo sapiens
cuugauuagugccuucugcc

SEQ ID NO: 787598 - RNA, 18 nt, Homo sapiens
cuugauucagucacaugg

SEQ ID NO: 787599 - RNA, 12 nt, Homo sapiens
cuugauucucuc

SEQ ID NO: 787600 - RNA, 15 nt, Homo sapiens
cuugcaaagauuucu

SEQ ID NO: 787601 - RNA, 16 nt, Homo sapiens
cuugcaauaccaaugu

SEQ ID NO: 787602 - RNA, 18 nt, Homo sapiens
cuugcaauggaucagcca

SEQ ID NO: 787603 - RNA, 18 nt, Homo sapiens
cuugcaauguagucaaua

SEQ ID NO: 787604 - RNA, 22 nt, Homo sapiens
cuugcacuggggugggauuugg

SEQ ID NO: 787605 - RNA, 23 nt, Homo sapiens
cuugcagcauuuacuaugcacaa

SEQ ID NO: 787606 - RNA, 17 nt, Homo sapiens
cuugcagcuaguuuucu

SEQ ID NO: 787607 - RNA, 16 nt, Homo sapiens
cuugcaguugcucuga

SEQ ID NO: 787608 - RNA, 10 nt, Homo sapiens
cuugcauaau

SEQ ID NO: 787609 - RNA, 13 nt, Homo sapiens
cuugcauacagag

SEQ ID NO: 787610 - RNA, 15 nt, Homo sapiens
cuugcauacagagac

SEQ ID NO: 787611 - RNA, 18 nt, Homo sapiens
cuugcauacagagacaga

SEQ ID NO: 787612 - RNA, 17 nt, Homo sapiens
cuugcauaggcucuuaa

SEQ ID NO: 787613 - RNA, 19 nt, Homo sapiens
cuugcaugaauuacuguau

SEQ ID NO: 787614 - RNA, 13 nt, Homo sapiens
cuugcauucauuu

SEQ ID NO: 787615 - RNA, 23 nt, Homo sapiens
cuugccaagcagugcacauuuca

SEQ ID NO: 787616 - RNA, 12 nt, Homo sapiens
cuugccaauggu

SEQ ID NO: 787617 - RNA, 14 nt, Homo sapiens
cuugccacugcacu

SEQ ID NO: 787618 - RNA, 12 nt, Homo sapiens
cuugccagagau

SEQ ID NO: 787619 - RNA, 21 nt, Homo sapiens
cuugccuaaauuuaaugcugc

SEQ ID NO: 787620 - RNA, 19 nt, Homo sapiens
cuugccuaagacuugccca

SEQ ID NO: 787621 - RNA, 20 nt, Homo sapiens
cuugccuaaggugcguaguc

SEQ ID NO: 787622 - RNA, 19 nt, Homo sapiens
cuugccuccaggugcagag

SEQ ID NO: 787623 - RNA, 17 nt, Homo sapiens
cuugccugaacuccugc

SEQ ID NO: 787624 - RNA, 18 nt, Homo sapiens
cuugccugcagggccaug

SEQ ID NO: 787625 - RNA, 21 nt, Homo sapiens
cuugcgauaguuuacugagaa

SEQ ID NO: 787626 - RNA, 21 nt, Homo sapiens
cuugcuaaaagauuauagaag

SEQ ID NO: 787627 - RNA, 17 nt, Homo sapiens
cuugcuaccugugagca

SEQ ID NO: 787628 - RNA, 15 nt, Homo sapiens
cuugcuagacacacu

SEQ ID NO: 787629 - RNA, 21 nt, Homo sapiens
cuugcuauuugagcaugcaca

SEQ ID NO: 787630 - RNA, 22 nt, Homo sapiens
cuugcuauuugagcaugcacag

SEQ ID NO: 787631 - RNA, 12 nt, Homo sapiens
cuugcucagugg

SEQ ID NO: 787632 - RNA, 21 nt, Homo sapiens
cuugcucauccaaggauuaaa

SEQ ID NO: 787633 - RNA, 17 nt, Homo sapiens
cuugcuccuguguaaaa

SEQ ID NO: 787634 - RNA, 17 nt, Homo sapiens
cuugcucuguuacccag

SEQ ID NO: 787635 - RNA, 16 nt, Homo sapiens
cuugcucuguugccca

SEQ ID NO: 787636 - RNA, 16 nt, Homo sapiens
cuugcugcugagugca

SEQ ID NO: 787637 - RNA, 20 nt, Homo sapiens
cuugcuggaaaacccaaagu

SEQ ID NO: 787638 - RNA, 15 nt, Homo sapiens
cuugcuggcucugag

SEQ ID NO: 787639 - RNA, 15 nt, Homo sapiens
cuugcuggucuaguc

SEQ ID NO: 787640 - RNA, 16 nt, Homo sapiens
cuugcuggucuaguca

SEQ ID NO: 787641 - RNA, 22 nt, Homo sapiens
cuugcuucauuguuacauguaa

SEQ ID NO: 787642 - RNA, 23 nt, Homo sapiens
cuugcuuguugggauuccugacc

SEQ ID NO: 787643 - RNA, 15 nt, Homo sapiens
cuugcuuuccccggg

SEQ ID NO: 787644 - RNA, 21 nt, Homo sapiens
cuugcuuugcagccccacaga

SEQ ID NO: 787645 - RNA, 14 nt, Homo sapiens
cuuggaaaggacca

SEQ ID NO: 787646 - RNA, 18 nt, Homo sapiens
cuuggaaaugguggugcu

SEQ ID NO: 787647 - RNA, 14 nt, Homo sapiens
cuuggaacugcauu

SEQ ID NO: 787648 - RNA, 23 nt, Homo sapiens
cuuggaagagaaugucugaucua

SEQ ID NO: 787649 - RNA, 20 nt, Homo sapiens
cuuggaaguguuucaaaaaa

SEQ ID NO: 787650 - RNA, 23 nt, Homo sapiens
cuuggacugaagggguucucaca

SEQ ID NO: 787651 - RNA, 14 nt, Homo sapiens
cuuggagacuccug

SEQ ID NO: 787652 - RNA, 23 nt, Homo sapiens
cuuggagagagaggcugccucag

SEQ ID NO: 787653 - RNA, 15 nt, Homo sapiens
cuuggagcaaucaga

SEQ ID NO: 787654 - RNA, 19 nt, Homo sapiens
cuuggagccccagugccaa

SEQ ID NO: 787655 - RNA, 18 nt, Homo sapiens
cuuggaggccaccgggac

SEQ ID NO: 787656 - RNA, 13 nt, Homo sapiens
cuuggaugugguu

SEQ ID NO: 787657 - RNA, 23 nt, Homo sapiens
cuuggauuucauuuguaacuuua

SEQ ID NO: 787658 - RNA, 20 nt, Homo sapiens
cuuggcaguguggcagugac

SEQ ID NO: 787659 - RNA, 17 nt, Homo sapiens
cuuggcccaggagcucu

SEQ ID NO: 787660 - RNA, 22 nt, Homo sapiens
cuuggccucccaaagugcuagu

SEQ ID NO: 787661 - RNA, 23 nt, Homo sapiens
cuuggcucccauucacucuucca

SEQ ID NO: 787662 - RNA, 16 nt, Homo sapiens
cuuggcuucugugaug

SEQ ID NO: 787663 - RNA, 19 nt, Homo sapiens
uugacauaccuaccaguau

SEQ ID NO: 787664 - RNA, 11 nt, Homo sapiens
uugacauuccu

SEQ ID NO: 787665 - RNA, 12 nt, Homo sapiens
uugaccaaauaa

SEQ ID NO: 787666 - RNA, 22 nt, Homo sapiens
uugaccaaauaaaguaccauua

SEQ ID NO: 787667 - RNA, 18 nt, Homo sapiens
uugaccaagaacugcaug

SEQ ID NO: 787668 - RNA, 12 nt, Homo sapiens
uugaccacagag

SEQ ID NO: 787669 - RNA, 15 nt, Homo sapiens
uugaccucagcugca

SEQ ID NO: 787670 - RNA, 21 nt, Homo sapiens
uugaccuguuucaccaguguu

SEQ ID NO: 787671 - RNA, 14 nt, Homo sapiens
uugacguuugcuca

SEQ ID NO: 787672 - RNA, 21 nt, Homo sapiens
uugacuaaagcuauguuacau

SEQ ID NO: 787673 - RNA, 20 nt, Homo sapiens
uugacuaaguuuuuauacca

SEQ ID NO: 787674 - RNA, 17 nt, Homo sapiens
uugacucuaaaugcagu

SEQ ID NO: 787675 - RNA, 15 nt, Homo sapiens
uugacugugauuuau

SEQ ID NO: 787676 - RNA, 13 nt, Homo sapiens
uugacuucugaca

SEQ ID NO: 787677 - RNA, 15 nt, Homo sapiens
uugacuucugacaaa

SEQ ID NO: 787678 - RNA, 23 nt, Homo sapiens
uugacuucugacaaaggugguaa

SEQ ID NO: 787679 - RNA, 19 nt, Homo sapiens
uugacuugaaaugcucuuu

SEQ ID NO: 787680 - RNA, 19 nt, Homo sapiens
uugacuuuuauaaagcaug

SEQ ID NO: 787681 - RNA, 12 nt, Homo sapiens
uugagaaugagu

SEQ ID NO: 787682 - RNA, 21 nt, Homo sapiens
aagagagaacaacuacuguga

SEQ ID NO: 787683 - RNA, 17 nt, Homo sapiens
aagagagagacccucac

SEQ ID NO: 787684 - RNA, 21 nt, Homo sapiens
aagagaggaaugccuguguga

SEQ ID NO: 787685 - RNA, 18 nt, Homo sapiens
aagagagggacaggcacu

SEQ ID NO: 787686 - RNA, 17 nt, Homo sapiens
aagagauaaacgaccaa

SEQ ID NO: 787687 - RNA, 19 nt, Homo sapiens
aagagauagagaccaucuu

SEQ ID NO: 787688 - RNA, 21 nt, Homo sapiens
aagagauaggaaccagcagga

SEQ ID NO: 787689 - RNA, 12 nt, Homo sapiens
aagagccaaaga

SEQ ID NO: 787690 - RNA, 22 nt, Homo sapiens
aagagcccucaagcggcccuua

SEQ ID NO: 787691 - RNA, 14 nt, Homo sapiens
aagagcgaguacag

SEQ ID NO: 787692 - RNA, 18 nt, Homo sapiens
aagagcguagacaggugu

SEQ ID NO: 787693 - RNA, 23 nt, Homo sapiens
aagagcuaagauaaagacugugg

SEQ ID NO: 787694 - RNA, 19 nt, Homo sapiens
aagagcuauggcccagaaa

SEQ ID NO: 787695 - RNA, 19 nt, Homo sapiens
aagagcuguggguaaauua

SEQ ID NO: 787696 - RNA, 14 nt, Homo sapiens
aagagcuugucagc

SEQ ID NO: 787697 - RNA, 22 nt, Homo sapiens
aagagcuuuccuacuugcacuc

SEQ ID NO: 787698 - RNA, 14 nt, Homo sapiens
aagaggaaagggag

SEQ ID NO: 787699 - RNA, 14 nt, Homo sapiens
aagaggaacagcac

SEQ ID NO: 787700 - RNA, 14 nt, Homo sapiens
aagaggacugagac

SEQ ID NO: 787701 - RNA, 21 nt, Homo sapiens
aagaggacuguguuguggucu

SEQ ID NO: 787702 - RNA, 22 nt, Homo sapiens
aagaggacuuaguuugugaugu

SEQ ID NO: 787703 - RNA, 13 nt, Homo sapiens
aagaggccuguuu

SEQ ID NO: 787704 - RNA, 21 nt, Homo sapiens
aagaggcugccccucucacca

SEQ ID NO: 787705 - RNA, 19 nt, Homo sapiens
aagagggacaggcugaaga

SEQ ID NO: 787706 - RNA, 14 nt, Homo sapiens
aagagguuacuuua

SEQ ID NO: 787707 - RNA, 22 nt, Homo sapiens
aagaguacagaagcuuuagcaa

SEQ ID NO: 787708 - RNA, 22 nt, Homo sapiens
aagaguauuuuuaacacuuaaa

SEQ ID NO: 787709 - RNA, 22 nt, Homo sapiens
aagagucaagugaccaucauuu

SEQ ID NO: 787710 - RNA, 12 nt, Homo sapiens
aagagucaucca

SEQ ID NO: 787711 - RNA, 19 nt, Homo sapiens
aagaguccagguaaauggu

SEQ ID NO: 787712 - RNA, 19 nt, Homo sapiens
aagagugagacuccaccuc

SEQ ID NO: 787713 - RNA, 16 nt, Homo sapiens
aagagugucacugagc

SEQ ID NO: 787714 - RNA, 13 nt, Homo sapiens
aagaguguggugu

SEQ ID NO: 787715 - RNA, 18 nt, Homo sapiens
aagauaaaccaguugaau

SEQ ID NO: 787716 - RNA, 14 nt, Homo sapiens
aagauaaaugugcu

SEQ ID NO: 787717 - RNA, 19 nt, Homo sapiens
aagauaacaagaucuuuca

SEQ ID NO: 787718 - RNA, 15 nt, Homo sapiens
aagauaauuuacuua

SEQ ID NO: 787719 - RNA, 12 nt, Homo sapiens
aagauagacuuc

SEQ ID NO: 787720 - RNA, 19 nt, Homo sapiens
aagauagucuucaguuuca

SEQ ID NO: 787721 - RNA, 23 nt, Homo sapiens
aagauauucagguggccagaaga

SEQ ID NO: 787722 - RNA, 16 nt, Homo sapiens
aagauauuguacauaa

SEQ ID NO: 787723 - RNA, 16 nt, Homo sapiens
aagauauuuacucaaa

SEQ ID NO: 787724 - RNA, 23 nt, Homo sapiens
aagaucaaaagcuuauucaucug

SEQ ID NO: 787725 - RNA, 20 nt, Homo sapiens
aagauccaccuccccacugc

SEQ ID NO: 787726 - RNA, 17 nt, Homo sapiens
aagaucuugucuccacu

SEQ ID NO: 787727 - RNA, 24 nt, Homo sapiens
aagaucuuucaggacucuaccuca

SEQ ID NO: 787728 - RNA, 15 nt, Homo sapiens
aagaugaaacugaaa

SEQ ID NO: 787729 - RNA, 21 nt, Homo sapiens
aagaugaagcugagcuuuuga

SEQ ID NO: 787730 - RNA, 23 nt, Homo sapiens
aagaugagauuugccagcacagg

SEQ ID NO: 787731 - RNA, 21 nt, Homo sapiens
aagaugaguuauuuaacuggu

SEQ ID NO: 787732 - RNA, 18 nt, Homo sapiens
aagaugcaacuaggaaga

SEQ ID NO: 787733 - RNA, 11 nt, Homo sapiens
aagaugcagug

SEQ ID NO: 787734 - RNA, 21 nt, Homo sapiens
aagaugcuuuguuucuuucau

SEQ ID NO: 787735 - RNA, 12 nt, Homo sapiens
aagauggcauaa

SEQ ID NO: 787736 - RNA, 21 nt, Homo sapiens
aagauggcauaaccugucuca

SEQ ID NO: 787737 - RNA, 20 nt, Homo sapiens
aagaugguguggguguccug

SEQ ID NO: 787738 - RNA, 16 nt, Homo sapiens
aagaugguucuagcau

SEQ ID NO: 787739 - RNA, 17 nt, Homo sapiens
aagaugguucuagcaug

SEQ ID NO: 787740 - RNA, 14 nt, Homo sapiens
aagauguacuucuc

SEQ ID NO: 787741 - RNA, 17 nt, Homo sapiens
aagauguauccuuccaa

SEQ ID NO: 787742 - RNA, 17 nt, Homo sapiens
aagaugugaaaauuaca

SEQ ID NO: 787743 - RNA, 17 nt, Homo sapiens
aagauguucacuguggc

SEQ ID NO: 787744 - RNA, 18 nt, Homo sapiens
aagauguugucuugcgau

SEQ ID NO: 787745 - RNA, 21 nt, Homo sapiens
aagauuauaauaugugccuua

SEQ ID NO: 787746 - RNA, 21 nt, Homo sapiens
aagauuauagauucuaaagau

SEQ ID NO: 787747 - RNA, 23 nt, Homo sapiens
aagauuauugugacuucacugua

SEQ ID NO: 787748 - RNA, 21 nt, Homo sapiens
aagauucacauaguuuauuuc

SEQ ID NO: 787749 - RNA, 18 nt, Homo sapiens
aagauucuugacuuauau

SEQ ID NO: 787750 - RNA, 13 nt, Homo sapiens
aagauucuuugug

SEQ ID NO: 787751 - RNA, 14 nt, Homo sapiens
aagauucuuuguga

SEQ ID NO: 787752 - RNA, 16 nt, Homo sapiens
aagauugagaagccau

SEQ ID NO: 787753 - RNA, 20 nt, Homo sapiens
aagauugcgccauugcacuc

SEQ ID NO: 787754 - RNA, 19 nt, Homo sapiens
aagauuguacuuagccagu

SEQ ID NO: 787755 - RNA, 21 nt, Homo sapiens
aagauuguuggugaauuuuca

SEQ ID NO: 787756 - RNA, 22 nt, Homo sapiens
aagauuuagaaaaaaguuuaca

SEQ ID NO: 787757 - RNA, 23 nt, Homo sapiens
aagauuuagaaaaaaguuuacaa

SEQ ID NO: 787758 - RNA, 19 nt, Homo sapiens
aagauuuaugaugcacuua

SEQ ID NO: 787759 - RNA, 15 nt, Homo sapiens
aagauuuuauucuua

SEQ ID NO: 787760 - RNA, 16 nt, Homo sapiens
aagcaaaaugcuuaca

SEQ ID NO: 787761 - RNA, 14 nt, Homo sapiens
aagcaaccaugaac

SEQ ID NO: 787762 - RNA, 21 nt, Homo sapiens
aagcaagacccuaaacaucca

SEQ ID NO: 787763 - RNA, 22 nt, Homo sapiens
aagcaaggcuggggucuugggu

SEQ ID NO: 787764 - RNA, 20 nt, Homo sapiens
aagcaaguagcuuuccacau

SEQ ID NO: 787765 - RNA, 15 nt, Homo sapiens
aagcaaguggcuuuc

SEQ ID NO: 787766 - RNA, 16 nt, Homo sapiens
aagcaauacuguuucc

SEQ ID NO: 787767 - RNA, 20 nt, Homo sapiens
aagcaauccucccacuucag

SEQ ID NO: 787768 - RNA, 12 nt, Homo sapiens
aagcacaagcag

SEQ ID NO: 787769 - RNA, 22 nt, Homo sapiens
aagcacacucagaaggcuucau

SEQ ID NO: 787770 - RNA, 20 nt, Homo sapiens
aagcacagauuugcauuuca

SEQ ID NO: 787771 - RNA, 14 nt, Homo sapiens
aagcacagcccuua

SEQ ID NO: 787772 - RNA, 13 nt, Homo sapiens
aagcacaugaaua

SEQ ID NO: 787773 - RNA, 19 nt, Homo sapiens
aagcacaugaauaauuuca

SEQ ID NO: 787774 - RNA, 12 nt, Homo sapiens
aagcacauucca

SEQ ID NO: 787775 - RNA, 15 nt, Homo sapiens
aagcaccccaugcca

SEQ ID NO: 787776 - RNA, 20 nt, Homo sapiens
aagcaccuuccccuccauuc

SEQ ID NO: 787777 - RNA, 18 nt, Homo sapiens
aagcacuacaccuugccu

SEQ ID NO: 787778 - RNA, 22 nt, Homo sapiens
aagcacugcucacgucucugcc

SEQ ID NO: 787779 - RNA, 23 nt, Homo sapiens
aagcacuguuggagcuacugcaa

SEQ ID NO: 787780 - RNA, 22 nt, Homo sapiens
aagcacuuugaaaaauuguucc

SEQ ID NO: 787781 - RNA, 16 nt, Homo sapiens
aagcacuuugcacuua

SEQ ID NO: 787782 - RNA, 17 nt, Homo sapiens
aagcacuuugcacuuaa

SEQ ID NO: 787783 - RNA, 22 nt, Homo sapiens
aagcagaaaguucaacuuccaa

SEQ ID NO: 787784 - RNA, 17 nt, Homo sapiens
aagcagagaaaauaauu

SEQ ID NO: 787785 - RNA, 13 nt, Homo sapiens
aagcagagcucac

SEQ ID NO: 787786 - RNA, 14 nt, Homo sapiens
aagcagagcucaca

SEQ ID NO: 787787 - RNA, 14 nt, Homo sapiens
aagcagauacuuga

SEQ ID NO: 787788 - RNA, 17 nt, Homo sapiens
aagcagauuuaacaauu

SEQ ID NO: 787789 - RNA, 22 nt, Homo sapiens
aagcagcaucuucugguuuaaa

SEQ ID NO: 787790 - RNA, 15 nt, Homo sapiens
aagcaggaaagggag

SEQ ID NO: 787791 - RNA, 17 nt, Homo sapiens
aagcaggcgacaaaauc

SEQ ID NO: 787792 - RNA, 21 nt, Homo sapiens
aagcaggcuugcccaguacau

SEQ ID NO: 787793 - RNA, 17 nt, Homo sapiens
aagcaggugaacuggga

SEQ ID NO: 787794 - RNA, 19 nt, Homo sapiens
aagcaguaagcuaucuuca

SEQ ID NO: 787795 - RNA, 15 nt, Homo sapiens
aagcagucagcccuu

SEQ ID NO: 787796 - RNA, 18 nt, Homo sapiens
aagucacaguuaucucca

SEQ ID NO: 787797 - RNA, 14 nt, Homo sapiens
aagucacugacccu

SEQ ID NO: 787798 - RNA, 23 nt, Homo sapiens
aagucacugcacagugcaucuca

SEQ ID NO: 787799 - RNA, 13 nt, Homo sapiens
aagucacuuuuau

SEQ ID NO: 787800 - RNA, 16 nt, Homo sapiens
aagucagaucuggucu

SEQ ID NO: 787801 - RNA, 13 nt, Homo sapiens
aagucagcuccag

SEQ ID NO: 787802 - RNA, 13 nt, Homo sapiens
aagucagcuuuca

SEQ ID NO: 787803 - RNA, 18 nt, Homo sapiens
aagucaguaucauauuau

SEQ ID NO: 787804 - RNA, 22 nt, Homo sapiens
aagucagugcccaacuguuaua

SEQ ID NO: 787805 - RNA, 14 nt, Homo sapiens
aagucaucuacuua

SEQ ID NO: 787806 - RNA, 22 nt, Homo sapiens
aagucaucuguuuaauuuacac

SEQ ID NO: 787807 - RNA, 13 nt, Homo sapiens
aagucaucuugcu

SEQ ID NO: 787808 - RNA, 18 nt, Homo sapiens
aagucauuuuaacuuuau

SEQ ID NO: 787809 - RNA, 16 nt, Homo sapiens
aaguccacuuuacuca

SEQ ID NO: 787810 - RNA, 15 nt, Homo sapiens
aaguccaguguuucu

SEQ ID NO: 787811 - RNA, 21 nt, Homo sapiens
aagucccagccgcacugggag

SEQ ID NO: 787812 - RNA, 18 nt, Homo sapiens
aaguccucccuccugcag

SEQ ID NO: 787813 - RNA, 14 nt, Homo sapiens
aaguccucugcucc

SEQ ID NO: 787814 - RNA, 17 nt, Homo sapiens
aaguccuuucuaaguau

SEQ ID NO: 787815 - RNA, 14 nt, Homo sapiens
aagucuaacgcuga

SEQ ID NO: 787816 - RNA, 14 nt, Homo sapiens
aagucucacugugu

SEQ ID NO: 787817 - RNA, 22 nt, Homo sapiens
aagucuccugucuuauggucca

SEQ ID NO: 787818 - RNA, 23 nt, Homo sapiens
aagucugggauguagaacuucaa

SEQ ID NO: 787819 - RNA, 17 nt, Homo sapiens
aagucuugcucugccac

SEQ ID NO: 787820 - RNA, 21 nt, Homo sapiens
aagucuugcucugccacccag

SEQ ID NO: 787821 - RNA, 13 nt, Homo sapiens
aagugaacuauga

SEQ ID NO: 787822 - RNA, 14 nt, Homo sapiens
aagugaacuugaug

SEQ ID NO: 787823 - RNA, 13 nt, Homo sapiens
aagugaaggagaa

SEQ ID NO: 787824 - RNA, 23 nt, Homo sapiens
aagugaauguuuaccaugaagau

SEQ ID NO: 787825 - RNA, 13 nt, Homo sapiens
aagugacacagca

SEQ ID NO: 787826 - RNA, 13 nt, Homo sapiens
aagugacccuguu

SEQ ID NO: 787827 - RNA, 15 nt, Homo sapiens
aagugagagagacaa

SEQ ID NO: 787828 - RNA, 22 nt, Homo sapiens
aagugagagagacaagaagcaa

SEQ ID NO: 787829 - RNA, 12 nt, Homo sapiens
aagugagcagag

SEQ ID NO: 787830 - RNA, 18 nt, Homo sapiens
aagugaggaagaguuuau

SEQ ID NO: 787831 - RNA, 19 nt, Homo sapiens
aagugaguccuguucuucc

SEQ ID NO: 787832 - RNA, 15 nt, Homo sapiens
aagugauacuaucca

SEQ ID NO: 787833 - RNA, 19 nt, Homo sapiens
aagugauccuuccaccuca

SEQ ID NO: 787834 - RNA, 20 nt, Homo sapiens
aagugauccuuccaccucag

SEQ ID NO: 787835 - RNA, 19 nt, Homo sapiens
aagugaucugcccaccuca

SEQ ID NO: 787836 - RNA, 20 nt, Homo sapiens
aagugaucugcccaccucag

SEQ ID NO: 787837 - RNA, 18 nt, Homo sapiens
aagugccuagacuguuac

SEQ ID NO: 787838 - RNA, 22 nt, Homo sapiens
aagugcuggcccacccagucca

SEQ ID NO: 787839 - RNA, 11 nt, Homo sapiens
aagugcuguuu

SEQ ID NO: 787840 - RNA, 17 nt, Homo sapiens
aagugcuuugcauugaa

SEQ ID NO: 787841 - RNA, 19 nt, Homo sapiens
aaguggcagcuucacucga

SEQ ID NO: 787842 - RNA, 20 nt, Homo sapiens
aagugggacauucaaaaaac

SEQ ID NO: 787843 - RNA, 20 nt, Homo sapiens
aaguggucgcuuacuuugag

SEQ ID NO: 787844 - RNA, 20 nt, Homo sapiens
aagugguuuguagacuuccu

SEQ ID NO: 787845 - RNA, 19 nt, Homo sapiens
aaguguaaaaaaugucuca

SEQ ID NO: 787846 - RNA, 15 nt, Homo sapiens
aaguguaaauccuuu

SEQ ID NO: 787847 - RNA, 12 nt, Homo sapiens
aaguguaacaau

SEQ ID NO: 787848 - RNA, 24 nt, Homo sapiens
aaguguauuuauuuuacagcucau

SEQ ID NO: 787849 - RNA, 13 nt, Homo sapiens
aaguguccugaaa

SEQ ID NO: 787850 - RNA, 13 nt, Homo sapiens
aagugugucuucc

SEQ ID NO: 787851 - RNA, 11 nt, Homo sapiens
aaguguuccag

SEQ ID NO: 787852 - RNA, 22 nt, Homo sapiens
aaguguucucuagaauccagca

SEQ ID NO: 787853 - RNA, 15 nt, Homo sapiens
aaguuaacuuccaau

SEQ ID NO: 787854 - RNA, 17 nt, Homo sapiens
aaguuacaugcuguaua

SEQ ID NO: 787855 - RNA, 13 nt, Homo sapiens
aaguuacuuuaug

SEQ ID NO: 787856 - RNA, 14 nt, Homo sapiens
aaguuagccuccac

SEQ ID NO: 787857 - RNA, 23 nt, Homo sapiens
aaguuaggguuuaggcaucauuu

SEQ ID NO: 787858 - RNA, 19 nt, Homo sapiens
aaguuagucaauccuguca

SEQ ID NO: 787859 - RNA, 20 nt, Homo sapiens
aaguuagucaauccugucau

SEQ ID NO: 787860 - RNA, 23 nt, Homo sapiens
aaguuagucaauccugucauaua

SEQ ID NO: 787861 - RNA, 22 nt, Homo sapiens
aaguuauacuguggcuaugcaa

SEQ ID NO: 787862 - RNA, 19 nt, Homo sapiens
aaguuauugauaaguucau

SEQ ID NO: 787863 - RNA, 22 nt, Homo sapiens
aaguuauugauaaguucauaca

SEQ ID NO: 787864 - RNA, 13 nt, Homo sapiens
aaguuauuuacuu

SEQ ID NO: 787865 - RNA, 17 nt, Homo sapiens
aaguucaauacucuuga

SEQ ID NO: 787866 - RNA, 14 nt, Homo sapiens
aaguucauaggguc

SEQ ID NO: 787867 - RNA, 12 nt, Homo sapiens
aaguucauaucu

SEQ ID NO: 787868 - RNA, 21 nt, Homo sapiens
aaguuccaagagucuaaagau

SEQ ID NO: 787869 - RNA, 18 nt, Homo sapiens
aaguuccaguguucucuc

SEQ ID NO: 787870 - RNA, 22 nt, Homo sapiens
aaguuccaguguucucucuuau

SEQ ID NO: 787871 - RNA, 20 nt, Homo sapiens
aaguuccccaucccugucau

SEQ ID NO: 787872 - RNA, 21 nt, Homo sapiens
aaguuccccaucccugucauu

SEQ ID NO: 787873 - RNA, 23 nt, Homo sapiens
aaguuccccaucccugucauuuu

SEQ ID NO: 787874 - RNA, 15 nt, Homo sapiens
aaguuccucuagugc

SEQ ID NO: 787875 - RNA, 22 nt, Homo sapiens
aaguucgaagcuccgugaguga

SEQ ID NO: 787876 - RNA, 19 nt, Homo sapiens
aaguucuggagaaagguau

SEQ ID NO: 787877 - RNA, 15 nt, Homo sapiens
aaguucuucuaagcu

SEQ ID NO: 787878 - RNA, 20 nt, Homo sapiens
aaguugaagcuaagauuuag

SEQ ID NO: 787879 - RNA, 21 nt, Homo sapiens
aaguugaggagguuucugcau

SEQ ID NO: 787880 - RNA, 14 nt, Homo sapiens
aaguugaugcaauc

SEQ ID NO: 787881 - RNA, 22 nt, Homo sapiens
aaguugcaucagaaagcuuuau

SEQ ID NO: 787882 - RNA, 18 nt, Homo sapiens
aaguugcuuuuuugacuc

SEQ ID NO: 787883 - RNA, 22 nt, Homo sapiens
aaguuguugacugugauuagau

SEQ ID NO: 787884 - RNA, 20 nt, Homo sapiens
aaguuguuuaccucuuuguc

SEQ ID NO: 787885 - RNA, 13 nt, Homo sapiens
aaguuguuugcau

SEQ ID NO: 787886 - RNA, 14 nt, Homo sapiens
aaguuuacuucucu

SEQ ID NO: 787887 - RNA, 14 nt, Homo sapiens
aaguuucacucaca

SEQ ID NO: 787888 - RNA, 20 nt, Homo sapiens
aaguuuuaggguacaugugc

SEQ ID NO: 787889 - RNA, 19 nt, Homo sapiens
aaguuuuauugucaagaca

SEQ ID NO: 787890 - RNA, 14 nt, Homo sapiens
aaguuuugaugaaa

SEQ ID NO: 787891 - RNA, 21 nt, Homo sapiens
aaguuuuguaaaagaaaucau

SEQ ID NO: 787892 - RNA, 18 nt, Homo sapiens
aauaaaaaagcucuuuua

SEQ ID NO: 787893 - RNA, 15 nt, Homo sapiens
aauaaaaacagagaa

SEQ ID NO: 787894 - RNA, 14 nt, Homo sapiens
aauaaaacugagcu

SEQ ID NO: 787895 - RNA, 13 nt, Homo sapiens
aauaaaagcacaa

SEQ ID NO: 787896 - RNA, 22 nt, Homo sapiens
aauaaaagcugaccccaaagac

SEQ ID NO: 787897 - RNA, 14 nt, Homo sapiens
aauaaaauuaacaa

SEQ ID NO: 787898 - RNA, 19 nt, Homo sapiens
aauaaaauuccuaucucau

SEQ ID NO: 787899 - RNA, 18 nt, Homo sapiens
aauaaaauuuaggaccaa

SEQ ID NO: 787900 - RNA, 15 nt, Homo sapiens
aauaaacccuuccug

SEQ ID NO: 787901 - RNA, 14 nt, Homo sapiens
aauaaacuaugagg

SEQ ID NO: 787902 - RNA, 20 nt, Homo sapiens
aauaaacuguguuuacucag

SEQ ID NO: 787903 - RNA, 12 nt, Homo sapiens
aauaaagacagg

SEQ ID NO: 787904 - RNA, 15 nt, Homo sapiens
aauaaagaccugaga

SEQ ID NO: 787905 - RNA, 13 nt, Homo sapiens
aauaaagcauucu

SEQ ID NO: 787906 - RNA, 16 nt, Homo sapiens
aauaaagcguccucuc

SEQ ID NO: 787907 - RNA, 19 nt, Homo sapiens
aauaaagcguccucucagu

SEQ ID NO: 787908 - RNA, 18 nt, Homo sapiens
aauaaaggcagcugccuc

SEQ ID NO: 787909 - RNA, 13 nt, Homo sapiens
aauaaagguuuaa

SEQ ID NO: 787910 - RNA, 14 nt, Homo sapiens
aauaaagugacccu

SEQ ID NO: 787911 - RNA, 17 nt, Homo sapiens
acugugccucaggccag

SEQ ID NO: 787912 - RNA, 23 nt, Homo sapiens
acugugccuuguuucaacaguuu

SEQ ID NO: 787913 - RNA, 16 nt, Homo sapiens
acugugcugugcagcu

SEQ ID NO: 787914 - RNA, 18 nt, Homo sapiens
acuguggcuagugacaaa

SEQ ID NO: 787915 - RNA, 22 nt, Homo sapiens
acuguggcugcuagcacuugga

SEQ ID NO: 787916 - RNA, 15 nt, Homo sapiens
acuguguaacuuucu

SEQ ID NO: 787917 - RNA, 18 nt, Homo sapiens
acuguguacauaacugaa

SEQ ID NO: 787918 - RNA, 15 nt, Homo sapiens
acugugucacccaga

SEQ ID NO: 787919 - RNA, 22 nt, Homo sapiens
acugugucacccagacuggaau

SEQ ID NO: 787920 - RNA, 11 nt, Homo sapiens
acugugucagg

SEQ ID NO: 787921 - RNA, 23 nt, Homo sapiens
acugugucauucuguuagauacu

SEQ ID NO: 787922 - RNA, 12 nt, Homo sapiens
acuguguuggcc

SEQ ID NO: 787923 - RNA, 13 nt, Homo sapiens
acuguguuugcau

SEQ ID NO: 787924 - RNA, 24 nt, Homo sapiens
acuguuacagcuuucugugcagag

SEQ ID NO: 787925 - RNA, 18 nt, Homo sapiens
acuguuagugacagagcc

SEQ ID NO: 787926 - RNA, 21 nt, Homo sapiens
acuguucuaccaagaacugaa

SEQ ID NO: 787927 - RNA, 13 nt, Homo sapiens
acuguucuguccu

SEQ ID NO: 787928 - RNA, 13 nt, Homo sapiens
acuguugaacuua

SEQ ID NO: 787929 - RNA, 23 nt, Homo sapiens
acuguugagaggguuacuuacau

SEQ ID NO: 787930 - RNA, 14 nt, Homo sapiens
acuguugcacugau

SEQ ID NO: 787931 - RNA, 13 nt, Homo sapiens
acuguugcucaaa

SEQ ID NO: 787932 - RNA, 20 nt, Homo sapiens
acuguuggagcuacugcaaa

SEQ ID NO: 787933 - RNA, 22 nt, Homo sapiens
acuguugguauuauauaauuca

SEQ ID NO: 787934 - RNA, 23 nt, Homo sapiens
acuguuucaaaaauaaauuugca

SEQ ID NO: 787935 - RNA, 19 nt, Homo sapiens
acuguuucuggacccuuau

SEQ ID NO: 787936 - RNA, 21 nt, Homo sapiens
acuguuuuauaaacugcugua

SEQ ID NO: 787937 - RNA, 13 nt, Homo sapiens
acuguuuuaucug

SEQ ID NO: 787938 - RNA, 19 nt, Homo sapiens
acuguuuugaaucucauaa

SEQ ID NO: 787939 - RNA, 18 nt, Homo sapiens
acuguuuugggccuccau

SEQ ID NO: 787940 - RNA, 14 nt, Homo sapiens
acuuaaacuugcau

SEQ ID NO: 787941 - RNA, 13 nt, Homo sapiens
acuuaaagugcaa

SEQ ID NO: 787942 - RNA, 21 nt, Homo sapiens
acuuaaauaauaaacagugga

SEQ ID NO: 787943 - RNA, 18 nt, Homo sapiens
acuuaacggaccaaagca

SEQ ID NO: 787944 - RNA, 15 nt, Homo sapiens
acuuaagcacaagca

SEQ ID NO: 787945 - RNA, 20 nt, Homo sapiens
acuuaagcccagugcacuga

SEQ ID NO: 787946 - RNA, 22 nt, Homo sapiens
acuuaagcugggauaaucacau

SEQ ID NO: 787947 - RNA, 18 nt, Homo sapiens
acuuaagggaacugaauc

SEQ ID NO: 787948 - RNA, 20 nt, Homo sapiens
acuuaaguuuuagaaaugag

SEQ ID NO: 787949 - RNA, 20 nt, Homo sapiens
acuuaauaauuuuuaccuaa

SEQ ID NO: 787950 - RNA, 17 nt, Homo sapiens
acuuaauacaugcaaca

SEQ ID NO: 787951 - RNA, 23 nt, Homo sapiens
acuuaauacucaaaugaguaaca

SEQ ID NO: 787952 - RNA, 13 nt, Homo sapiens
acuuaaugcacag

SEQ ID NO: 787953 - RNA, 11 nt, Homo sapiens
acuuaaugucu

SEQ ID NO: 787954 - RNA, 21 nt, Homo sapiens
acuuaauguuuguaagacuua

SEQ ID NO: 787955 - RNA, 14 nt, Homo sapiens
acuuacaacccagg

SEQ ID NO: 787956 - RNA, 19 nt, Homo sapiens
acuuacucuuuaaccagga

SEQ ID NO: 787957 - RNA, 22 nt, Homo sapiens
acuuagaaauugcauuuccuga

SEQ ID NO: 787958 - RNA, 17 nt, Homo sapiens
acuuagaucaucaguca

SEQ ID NO: 787959 - RNA, 18 nt, Homo sapiens
acuuauauugaagacaau

SEQ ID NO: 787960 - RNA, 15 nt, Homo sapiens
acuuaucucucaaaa

SEQ ID NO: 787961 - RNA, 20 nt, Homo sapiens
acuuauguauuuaugaccuu

SEQ ID NO: 787962 - RNA, 17 nt, Homo sapiens
acuuauguuauacaaua

SEQ ID NO: 787963 - RNA, 21 nt, Homo sapiens
acuuauuaugaggcuauuaaa

SEQ ID NO: 787964 - RNA, 15 nt, Homo sapiens
acuuauuucauaaac

SEQ ID NO: 787965 - RNA, 13 nt, Homo sapiens
acuuauuuugcuu

SEQ ID NO: 787966 - RNA, 14 nt, Homo sapiens
acuucaaauguggu

SEQ ID NO: 787967 - RNA, 19 nt, Homo sapiens
acuucaaaugugguauaca

SEQ ID NO: 787968 - RNA, 19 nt, Homo sapiens
acuucaauccauguaggaa

SEQ ID NO: 787969 - RNA, 18 nt, Homo sapiens
acuucaaugggcucuucc

SEQ ID NO: 787970 - RNA, 19 nt, Homo sapiens
acuucaaugggcucuucca

SEQ ID NO: 787971 - RNA, 14 nt, Homo sapiens
acuucaauuuacuu

SEQ ID NO: 787972 - RNA, 14 nt, Homo sapiens
acuucacacacagg

SEQ ID NO: 787973 - RNA, 12 nt, Homo sapiens
acuucagggauc

SEQ ID NO: 787974 - RNA, 18 nt, Homo sapiens
acuucaguugcuuugcag

SEQ ID NO: 787975 - RNA, 22 nt, Homo sapiens
acuucaucuucaaaacugccau

SEQ ID NO: 787976 - RNA, 19 nt, Homo sapiens
acuucauuugaugcuaaau

SEQ ID NO: 787977 - RNA, 13 nt, Homo sapiens
acuuccaagugau

SEQ ID NO: 787978 - RNA, 20 nt, Homo sapiens
acuuccaggggaaccugcca

SEQ ID NO: 787979 - RNA, 22 nt, Homo sapiens
acuucccaaguguaagacucug

SEQ ID NO: 787980 - RNA, 14 nt, Homo sapiens
acuuccccugggca

SEQ ID NO: 787981 - RNA, 16 nt, Homo sapiens
acuucccguuuccucu

SEQ ID NO: 787982 - RNA, 16 nt, Homo sapiens
acuucccuaaugaagu

SEQ ID NO: 787983 - RNA, 19 nt, Homo sapiens
acuuccgccuccuguguuc

SEQ ID NO: 787984 - RNA, 19 nt, Homo sapiens
acuuccguccauccauuca

SEQ ID NO: 787985 - RNA, 17 nt, Homo sapiens
acuuccuguguacucuu

SEQ ID NO: 787986 - RNA, 18 nt, Homo sapiens
acuuccuucaaucuucau

SEQ ID NO: 787987 - RNA, 12 nt, Homo sapiens
acuuccuugcau

SEQ ID NO: 787988 - RNA, 21 nt, Homo sapiens
acuuccuuggacucauuuuaa

SEQ ID NO: 787989 - RNA, 16 nt, Homo sapiens
acuucgaaaccuggga

SEQ ID NO: 787990 - RNA, 18 nt, Homo sapiens
acuucgacucaggaucca

SEQ ID NO: 787991 - RNA, 13 nt, Homo sapiens
acuucgccagcug

SEQ ID NO: 787992 - RNA, 20 nt, Homo sapiens
acuucuaaguaaaaccacag

SEQ ID NO: 787993 - RNA, 23 nt, Homo sapiens
acuucuagacucaccuguucuca

SEQ ID NO: 787994 - RNA, 18 nt, Homo sapiens
acuucucacucaccacua

SEQ ID NO: 787995 - RNA, 16 nt, Homo sapiens
acuucuccccuggguc

SEQ ID NO: 787996 - RNA, 20 nt, Homo sapiens
acuucucucaucugggcaaa

SEQ ID NO: 787997 - RNA, 19 nt, Homo sapiens
acuucucugaaauauuuag

SEQ ID NO: 787998 - RNA, 14 nt, Homo sapiens
acuucucugugaac

SEQ ID NO: 787999 - RNA, 18 nt, Homo sapiens
acuucucugugugcacac

SEQ ID NO: 788000 - RNA, 17 nt, Homo sapiens
acuucugacuacuuguu

SEQ ID NO: 788001 - RNA, 16 nt, Homo sapiens
acuucuggcagggaag

SEQ ID NO: 788002 - RNA, 23 nt, Homo sapiens
acuucuggcauaacuaaaauuaa

SEQ ID NO: 788003 - RNA, 15 nt, Homo sapiens
acuucugggcagcca

SEQ ID NO: 788004 - RNA, 19 nt, Homo sapiens
acuucuuauacauuugaua

SEQ ID NO: 788005 - RNA, 22 nt, Homo sapiens
acuucuuuaagcggacccgcua

SEQ ID NO: 788006 - RNA, 23 nt, Homo sapiens
acuugaacccgggggacagaggu

SEQ ID NO: 788007 - RNA, 18 nt, Homo sapiens
acuugaagggccagagcc

SEQ ID NO: 788008 - RNA, 13 nt, Homo sapiens
acuugaauuucaa

SEQ ID NO: 788009 - RNA, 13 nt, Homo sapiens
acuugagaaaaua

SEQ ID NO: 788010 - RNA, 14 nt, Homo sapiens
acuugagauguaug

SEQ ID NO: 788011 - RNA, 17 nt, Homo sapiens
acuugagccuauaucag

SEQ ID NO: 788012 - RNA, 15 nt, Homo sapiens
acuugaugauacaau

SEQ ID NO: 788013 - RNA, 14 nt, Homo sapiens
acuugaugccauuc

SEQ ID NO: 788014 - RNA, 17 nt, Homo sapiens
acuugauuaacuccucc

SEQ ID NO: 788015 - RNA, 16 nt, Homo sapiens
acuugcauacagagac

SEQ ID NO: 788016 - RNA, 14 nt, Homo sapiens
acuugcaucacuua

SEQ ID NO: 788017 - RNA, 19 nt, Homo sapiens
acuugccaggcucccuuuc

SEQ ID NO: 788018 - RNA, 16 nt, Homo sapiens
acuugcccaaguccca

SEQ ID NO: 788019 - RNA, 14 nt, Homo sapiens
acuugccucugcac

SEQ ID NO: 788020 - RNA, 19 nt, Homo sapiens
acuugcuaaagcacuuugc

SEQ ID NO: 788021 - RNA, 16 nt, Homo sapiens
acuugcuaacaaauca

SEQ ID NO: 788022 - RNA, 23 nt, Homo sapiens
acuugcugcugagugcaccacuu

SEQ ID NO: 788023 - RNA, 22 nt, Homo sapiens
acuugcugcuucugcacuucau

SEQ ID NO: 788024 - RNA, 13 nt, Homo sapiens
acuugcuguccag

SEQ ID NO: 788025 - RNA, 14 nt, Homo sapiens
agacaggagacaug

SEQ ID NO: 788026 - RNA, 20 nt, Homo sapiens
agacagguccaaguucaagc

SEQ ID NO: 788027 - RNA, 19 nt, Homo sapiens
agacaguauuuugacaaaa

SEQ ID NO: 788028 - RNA, 20 nt, Homo sapiens
agacaguccuuucccaccau

SEQ ID NO: 788029 - RNA, 20 nt, Homo sapiens
agacauacagcugccuaccu

SEQ ID NO: 788030 - RNA, 13 nt, Homo sapiens
agacauacauuuc

SEQ ID NO: 788031 - RNA, 16 nt, Homo sapiens
agacauacauuucuca

SEQ ID NO: 788032 - RNA, 19 nt, Homo sapiens
agacauacgaaacacaaac

SEQ ID NO: 788033 - RNA, 19 nt, Homo sapiens
agacauacuccuuccauca

SEQ ID NO: 788034 - RNA, 13 nt, Homo sapiens
agacauacuugaa

SEQ ID NO: 788035 - RNA, 14 nt, Homo sapiens
agacaucaaugaaa

SEQ ID NO: 788036 - RNA, 14 nt, Homo sapiens
agacaugaaccaag

SEQ ID NO: 788037 - RNA, 14 nt, Homo sapiens
agacaugaaugcac

SEQ ID NO: 788038 - RNA, 20 nt, Homo sapiens
agacaugagccuccgcgccu

SEQ ID NO: 788039 - RNA, 16 nt, Homo sapiens
agacauguaucacugu

SEQ ID NO: 788040 - RNA, 19 nt, Homo sapiens
agacaugugaggaggaaaa

SEQ ID NO: 788041 - RNA, 14 nt, Homo sapiens
agacauguuucaag

SEQ ID NO: 788042 - RNA, 19 nt, Homo sapiens
agacauuaaaucuaugaag

SEQ ID NO: 788043 - RNA, 13 nt, Homo sapiens
agacauucucaca

SEQ ID NO: 788044 - RNA, 14 nt, Homo sapiens
agacauucuuccaa

SEQ ID NO: 788045 - RNA, 14 nt, Homo sapiens
agacauugcucuca

SEQ ID NO: 788046 - RNA, 17 nt, Homo sapiens
agacauuucucuaacuc

SEQ ID NO: 788047 - RNA, 21 nt, Homo sapiens
agacauuucucuaacuccugc

SEQ ID NO: 788048 - RNA, 18 nt, Homo sapiens
agacauuugcuaugagcu

SEQ ID NO: 788049 - RNA, 16 nt, Homo sapiens
agaccaaaguuugcaa

SEQ ID NO: 788050 - RNA, 14 nt, Homo sapiens
agaccaaaucucag

SEQ ID NO: 788051 - RNA, 22 nt, Homo sapiens
agaccaacagaacuucacagug

SEQ ID NO: 788052 - RNA, 23 nt, Homo sapiens
agaccaacagaacuucacaguga

SEQ ID NO: 788053 - RNA, 19 nt, Homo sapiens
agaccaagacacagaucac

SEQ ID NO: 788054 - RNA, 22 nt, Homo sapiens
agaccaagacuuuugucugauc

SEQ ID NO: 788055 - RNA, 14 nt, Homo sapiens
agaccaaggcacug

SEQ ID NO: 788056 - RNA, 17 nt, Homo sapiens
agaccaaguccuggcua

SEQ ID NO: 788057 - RNA, 21 nt, Homo sapiens
agaccacacugcacacaguga

SEQ ID NO: 788058 - RNA, 22 nt, Homo sapiens
agaccagccaaggguccucacc

SEQ ID NO: 788059 - RNA, 19 nt, Homo sapiens
agaccagggugguugggac

SEQ ID NO: 788060 - RNA, 19 nt, Homo sapiens
agaccaguugggagcacug

SEQ ID NO: 788061 - RNA, 14 nt, Homo sapiens
agaccauaauguua

SEQ ID NO: 788062 - RNA, 16 nt, Homo sapiens
agaccauggauuucau

SEQ ID NO: 788063 - RNA, 13 nt, Homo sapiens
agaccauugcaau

SEQ ID NO: 788064 - RNA, 20 nt, Homo sapiens
agaccauuuaucugggauua

SEQ ID NO: 788065 - RNA, 13 nt, Homo sapiens
agacccacagacu

SEQ ID NO: 788066 - RNA, 14 nt, Homo sapiens
agacccagugcacu

SEQ ID NO: 788067 - RNA, 19 nt, Homo sapiens
agacccaguggacucuucc

SEQ ID NO: 788068 - RNA, 16 nt, Homo sapiens
agaccccaaagaucuc

SEQ ID NO: 788069 - RNA, 14 nt, Homo sapiens
agaccccuguucau

SEQ ID NO: 788070 - RNA, 14 nt, Homo sapiens
agaccccuuggcca

SEQ ID NO: 788071 - RNA, 20 nt, Homo sapiens
agacccuccuauucuauaaa

SEQ ID NO: 788072 - RNA, 19 nt, Homo sapiens
agacccugagacuccagaa

SEQ ID NO: 788073 - RNA, 19 nt, Homo sapiens
agacccugucucaaaaaau

SEQ ID NO: 788074 - RNA, 16 nt, Homo sapiens
agaccuaggauuucau

SEQ ID NO: 788075 - RNA, 15 nt, Homo sapiens
agaccucaucugugg

SEQ ID NO: 788076 - RNA, 19 nt, Homo sapiens
agaccucuaggaggagcua

SEQ ID NO: 788077 - RNA, 14 nt, Homo sapiens
agaccugauccugg

SEQ ID NO: 788078 - RNA, 15 nt, Homo sapiens
agaccuggaaccaga

SEQ ID NO: 788079 - RNA, 21 nt, Homo sapiens
agaccuggcuccacucuugau

SEQ ID NO: 788080 - RNA, 12 nt, Homo sapiens
agaccugucacc

SEQ ID NO: 788081 - RNA, 20 nt, Homo sapiens
agaccuguguuacuaaaaaa

SEQ ID NO: 788082 - RNA, 19 nt, Homo sapiens
agaccuuggcauccugugc

SEQ ID NO: 788083 - RNA, 22 nt, Homo sapiens
agaccuuuucccugcaccacuc

SEQ ID NO: 788084 - RNA, 23 nt, Homo sapiens
agaccuuuuggcccaaucucugc

SEQ ID NO: 788085 - RNA, 17 nt, Homo sapiens
agacgaaauagugacau

SEQ ID NO: 788086 - RNA, 23 nt, Homo sapiens
agacgaccuuuaccuccugccuu

SEQ ID NO: 788087 - RNA, 21 nt, Homo sapiens
agacgagguuucacuguguug

SEQ ID NO: 788088 - RNA, 15 nt, Homo sapiens
agacgcugcugucac

SEQ ID NO: 788089 - RNA, 13 nt, Homo sapiens
agacgucugccuu

SEQ ID NO: 788090 - RNA, 16 nt, Homo sapiens
agacuacauuugugaa

SEQ ID NO: 788091 - RNA, 22 nt, Homo sapiens
agacuagauggaccugccugca

SEQ ID NO: 788092 - RNA, 19 nt, Homo sapiens
agacuagauguaguauuuu

SEQ ID NO: 788093 - RNA, 17 nt, Homo sapiens
agacuagccacuccugc

SEQ ID NO: 788094 - RNA, 13 nt, Homo sapiens
agacuagucucaa

SEQ ID NO: 788095 - RNA, 12 nt, Homo sapiens
agacuaugauuu

SEQ ID NO: 788096 - RNA, 21 nt, Homo sapiens
agacuauggugcugccuugcu

SEQ ID NO: 788097 - RNA, 22 nt, Homo sapiens
agacuauguagcaauauaucag

SEQ ID NO: 788098 - RNA, 23 nt, Homo sapiens
agacuauuaauaaauaagacugu

SEQ ID NO: 788099 - RNA, 12 nt, Homo sapiens
agacucaccuca

SEQ ID NO: 788100 - RNA, 22 nt, Homo sapiens
agacucaccucauccuuaccgc

SEQ ID NO: 788101 - RNA, 19 nt, Homo sapiens
agacucagacauuggcacc

SEQ ID NO: 788102 - RNA, 20 nt, Homo sapiens
agacucagggccccagcacu

SEQ ID NO: 788103 - RNA, 13 nt, Homo sapiens
agacuccaaagaa

SEQ ID NO: 788104 - RNA, 23 nt, Homo sapiens
agacuccaauggggccagcacug

SEQ ID NO: 788105 - RNA, 14 nt, Homo sapiens
agacuccaccucaa

SEQ ID NO: 788106 - RNA, 12 nt, Homo sapiens
agacuccaucuc

SEQ ID NO: 788107 - RNA, 15 nt, Homo sapiens
agacuccugugcaac

SEQ ID NO: 788108 - RNA, 17 nt, Homo sapiens
agacucuggaggucauc

SEQ ID NO: 788109 - RNA, 21 nt, Homo sapiens
agacucuggaggucaucuggc

SEQ ID NO: 788110 - RNA, 18 nt, Homo sapiens
agacucuguaauugaaua

SEQ ID NO: 788111 - RNA, 19 nt, Homo sapiens
agacucuguaauugaauau

SEQ ID NO: 788112 - RNA, 18 nt, Homo sapiens
agacucugucuaccuggu

SEQ ID NO: 788113 - RNA, 20 nt, Homo sapiens
agacucuuuggguccauuca

SEQ ID NO: 788114 - RNA, 23 nt, Homo sapiens
agacucuuuggguccauucagau

SEQ ID NO: 788115 - RNA, 23 nt, Homo sapiens
agacucuuuuuuugagugacagc

SEQ ID NO: 788116 - RNA, 19 nt, Homo sapiens
agacugcaugacagucaca

SEQ ID NO: 788117 - RNA, 18 nt, Homo sapiens
agacugcuaaguaggggc

SEQ ID NO: 788118 - RNA, 19 nt, Homo sapiens
agacugcugggacuggcca

SEQ ID NO: 788119 - RNA, 22 nt, Homo sapiens
agacuggaauauaauuucaaac

SEQ ID NO: 788120 - RNA, 18 nt, Homo sapiens
agacuguaagcuccauga

SEQ ID NO: 788121 - RNA, 19 nt, Homo sapiens
agacugucccugaaaccua

SEQ ID NO: 788122 - RNA, 19 nt, Homo sapiens
agacuguggcuagugacaa

SEQ ID NO: 788123 - RNA, 18 nt, Homo sapiens
agacuguuacuuuggcaa

SEQ ID NO: 788124 - RNA, 18 nt, Homo sapiens
agacuguucuuacuguaa

SEQ ID NO: 788125 - RNA, 14 nt, Homo sapiens
agacuguugcucaa

SEQ ID NO: 788126 - RNA, 23 nt, Homo sapiens
agacuguugcucaaaucuauuca

SEQ ID NO: 788127 - RNA, 14 nt, Homo sapiens
agacuuaaaagagc

SEQ ID NO: 788128 - RNA, 17 nt, Homo sapiens
agacuuaaaucacagau

SEQ ID NO: 788129 - RNA, 19 nt, Homo sapiens
agacuuaagcccagugcac

SEQ ID NO: 788130 - RNA, 17 nt, Homo sapiens
agacuuaauucugauua

SEQ ID NO: 788131 - RNA, 17 nt, Homo sapiens
agacuuccaucuaguca

SEQ ID NO: 788132 - RNA, 13 nt, Homo sapiens
agacuucccugaa

SEQ ID NO: 788133 - RNA, 10 nt, Homo sapiens
agacuuccug

SEQ ID NO: 788134 - RNA, 19 nt, Homo sapiens
agacuugacaacaucccac

SEQ ID NO: 788135 - RNA, 23 nt, Homo sapiens
agacuugcuuuucuaacuaagag

SEQ ID NO: 788136 - RNA, 20 nt, Homo sapiens
agacuugggaaacuauucau

SEQ ID NO: 788137 - RNA, 17 nt, Homo sapiens
agacuuuaaaccaccua

SEQ ID NO: 788138 - RNA, 13 nt, Homo sapiens
agacuuugcccag

SEQ ID NO: 788139 - RNA, 22 nt, Homo sapiens
agaugcauggcuggcacauugu

SEQ ID NO: 788140 - RNA, 21 nt, Homo sapiens
agaugcuagaaaaauguucuu

SEQ ID NO: 788141 - RNA, 14 nt, Homo sapiens
agaugcuggcccag

SEQ ID NO: 788142 - RNA, 16 nt, Homo sapiens
agaugcuggguuggug

SEQ ID NO: 788143 - RNA, 15 nt, Homo sapiens
agaugcuuggagcaa

SEQ ID NO: 788144 - RNA, 15 nt, Homo sapiens
agauggaaaaacuga

SEQ ID NO: 788145 - RNA, 22 nt, Homo sapiens
agauggaaaaacugaggcuuag

SEQ ID NO: 788146 - RNA, 19 nt, Homo sapiens
agauggaaaagaaauugca

SEQ ID NO: 788147 - RNA, 15 nt, Homo sapiens
agauggaaugcugug

SEQ ID NO: 788148 - RNA, 17 nt, Homo sapiens
agauggagacacccucu

SEQ ID NO: 788149 - RNA, 20 nt, Homo sapiens
agauggaguucuugugccau

SEQ ID NO: 788150 - RNA, 21 nt, Homo sapiens
agauggaguucuugugccaua

SEQ ID NO: 788151 - RNA, 17 nt, Homo sapiens
agauggauuuguaucaa

SEQ ID NO: 788152 - RNA, 20 nt, Homo sapiens
agauggcauaaccugucuca

SEQ ID NO: 788153 - RNA, 22 nt, Homo sapiens
agaugggcaaauuaaggcauaa

SEQ ID NO: 788154 - RNA, 22 nt, Homo sapiens
agauggguauuaaacuugucag

SEQ ID NO: 788155 - RNA, 15 nt, Homo sapiens
agaugggugucacuu

SEQ ID NO: 788156 - RNA, 15 nt, Homo sapiens
agaugguagaacuaa

SEQ ID NO: 788157 - RNA, 22 nt, Homo sapiens
agaugguccgugcccaggcccu

SEQ ID NO: 788158 - RNA, 17 nt, Homo sapiens
agaugguuaagucaauu

SEQ ID NO: 788159 - RNA, 23 nt, Homo sapiens
agaugguugagauaugaguucuu

SEQ ID NO: 788160 - RNA, 14 nt, Homo sapiens
agauguacugcaaa

SEQ ID NO: 788161 - RNA, 22 nt, Homo sapiens
agauguacuucucugugugcac

SEQ ID NO: 788162 - RNA, 21 nt, Homo sapiens
agauguagauaaacucagaaa

SEQ ID NO: 788163 - RNA, 22 nt, Homo sapiens
agauguauuuguuguagacuua

SEQ ID NO: 788164 - RNA, 22 nt, Homo sapiens
agaugucauuuaguucagcauc

SEQ ID NO: 788165 - RNA, 18 nt, Homo sapiens
agaugucuuggaacauug

SEQ ID NO: 788166 - RNA, 16 nt, Homo sapiens
agaugugaaaacaucu

SEQ ID NO: 788167 - RNA, 19 nt, Homo sapiens
agaugugaaaacaucucaa

SEQ ID NO: 788168 - RNA, 16 nt, Homo sapiens
agaugugaacuugaag

SEQ ID NO: 788169 - RNA, 22 nt, Homo sapiens
agauguggacuuguaugcugcc

SEQ ID NO: 788170 - RNA, 20 nt, Homo sapiens
agauguggcaaagugcugua

SEQ ID NO: 788171 - RNA, 17 nt, Homo sapiens
agaugugggcagugaug

SEQ ID NO: 788172 - RNA, 19 nt, Homo sapiens
agaugugggcagugauguc

SEQ ID NO: 788173 - RNA, 20 nt, Homo sapiens
agauguggucaauggaagaa

SEQ ID NO: 788174 - RNA, 17 nt, Homo sapiens
agauguguuauuacuuc

SEQ ID NO: 788175 - RNA, 11 nt, Homo sapiens
agauguucaaa

SEQ ID NO: 788176 - RNA, 17 nt, Homo sapiens
agauguucacuguggca

SEQ ID NO: 788177 - RNA, 20 nt, Homo sapiens
agauguuguguuuacguuac

SEQ ID NO: 788178 - RNA, 11 nt, Homo sapiens
agauguuuaca

SEQ ID NO: 788179 - RNA, 17 nt, Homo sapiens
agauguuuaugauguaa

SEQ ID NO: 788180 - RNA, 17 nt, Homo sapiens
agauguuuggaaaccac

SEQ ID NO: 788181 - RNA, 18 nt, Homo sapiens
agauguuuggaaaccaca

SEQ ID NO: 788182 - RNA, 13 nt, Homo sapiens
agauuaaguauaa

SEQ ID NO: 788183 - RNA, 12 nt, Homo sapiens
agauuacccaaa

SEQ ID NO: 788184 - RNA, 16 nt, Homo sapiens
agauuagguagacuuu

SEQ ID NO: 788185 - RNA, 23 nt, Homo sapiens
agauuaguauuuuccacgucacu

SEQ ID NO: 788186 - RNA, 13 nt, Homo sapiens
agauucagacuug

SEQ ID NO: 788187 - RNA, 22 nt, Homo sapiens
agauucagguauguugccuuua

SEQ ID NO: 788188 - RNA, 20 nt, Homo sapiens
agauucccaaaccuaaugau

SEQ ID NO: 788189 - RNA, 12 nt, Homo sapiens
agauucccacug

SEQ ID NO: 788190 - RNA, 15 nt, Homo sapiens
agauucccacugccg

SEQ ID NO: 788191 - RNA, 17 nt, Homo sapiens
agauuccccugugucau

SEQ ID NO: 788192 - RNA, 18 nt, Homo sapiens
agauuccccugugucauc

SEQ ID NO: 788193 - RNA, 13 nt, Homo sapiens
agauucuaaagau

SEQ ID NO: 788194 - RNA, 17 nt, Homo sapiens
agauucuaaagauucua

SEQ ID NO: 788195 - RNA, 16 nt, Homo sapiens
agauucuaaagcucaa

SEQ ID NO: 788196 - RNA, 14 nt, Homo sapiens
agauucuagaugau

SEQ ID NO: 788197 - RNA, 17 nt, Homo sapiens
agauucuagaugauuaa

SEQ ID NO: 788198 - RNA, 15 nt, Homo sapiens
agauucugugaucuu

SEQ ID NO: 788199 - RNA, 14 nt, Homo sapiens
agauucuuccccaa

SEQ ID NO: 788200 - RNA, 12 nt, Homo sapiens
agauugaaucug

SEQ ID NO: 788201 - RNA, 20 nt, Homo sapiens
agauugaaucugaaccaugu

SEQ ID NO: 788202 - RNA, 13 nt, Homo sapiens
agauugauacuuu

SEQ ID NO: 788203 - RNA, 20 nt, Homo sapiens
agauugcaccauugcgcucu

SEQ ID NO: 788204 - RNA, 20 nt, Homo sapiens
agauuggcucacacugagaa

SEQ ID NO: 788205 - RNA, 21 nt, Homo sapiens
agauugggguagagggaaaag

SEQ ID NO: 788206 - RNA, 20 nt, Homo sapiens
agauuguuaggagugguucu

SEQ ID NO: 788207 - RNA, 21 nt, Homo sapiens
agauuuaaaguggcagcuuca

SEQ ID NO: 788208 - RNA, 14 nt, Homo sapiens
agauuuaagaauac

SEQ ID NO: 788209 - RNA, 13 nt, Homo sapiens
agauuuacccauc

SEQ ID NO: 788210 - RNA, 22 nt, Homo sapiens
agauuuagaaaaaaguuuacaa

SEQ ID NO: 788211 - RNA, 17 nt, Homo sapiens
agauuuaugaugcacuu

SEQ ID NO: 788212 - RNA, 13 nt, Homo sapiens
agauuucaucugc

SEQ ID NO: 788213 - RNA, 14 nt, Homo sapiens
agauuucauucuca

SEQ ID NO: 788214 - RNA, 21 nt, Homo sapiens
agauuucccuaaaaauuccac

SEQ ID NO: 788215 - RNA, 14 nt, Homo sapiens
agauuugaggcugg

SEQ ID NO: 788216 - RNA, 20 nt, Homo sapiens
agauuugggagaagggcaga

SEQ ID NO: 788217 - RNA, 18 nt, Homo sapiens
agauuugucuaauugcau

SEQ ID NO: 788218 - RNA, 18 nt, Homo sapiens
agauuuguugacagcaaa

SEQ ID NO: 788219 - RNA, 17 nt, Homo sapiens
agauuuuaagggggaaa

SEQ ID NO: 788220 - RNA, 15 nt, Homo sapiens
agauuuuaccuaucc

SEQ ID NO: 788221 - RNA, 19 nt, Homo sapiens
agauuuuauucuuauuuca

SEQ ID NO: 788222 - RNA, 14 nt, Homo sapiens
agauuuuggccaug

SEQ ID NO: 788223 - RNA, 15 nt, Homo sapiens
agauuuuuaaaaagc

SEQ ID NO: 788224 - RNA, 19 nt, Homo sapiens
agauuuuuuuuggacuguu

SEQ ID NO: 788225 - RNA, 15 nt, Homo sapiens
agcaaaaaaauuauu

SEQ ID NO: 788226 - RNA, 17 nt, Homo sapiens
agcaaaacaucucugca

SEQ ID NO: 788227 - RNA, 17 nt, Homo sapiens
agcaaaagucauuacac

SEQ ID NO: 788228 - RNA, 17 nt, Homo sapiens
agcaaacaagcuugauu

SEQ ID NO: 788229 - RNA, 18 nt, Homo sapiens
agcaaacacuuacagaau

SEQ ID NO: 788230 - RNA, 21 nt, Homo sapiens
agcaaacacuugaagugagaa

SEQ ID NO: 788231 - RNA, 15 nt, Homo sapiens
agcaaagcaaaacaa

SEQ ID NO: 788232 - RNA, 21 nt, Homo sapiens
agcaaagcugaugacaacuuc

SEQ ID NO: 788233 - RNA, 23 nt, Homo sapiens
agcaaaggacuuaaaauuaccaa

SEQ ID NO: 788234 - RNA, 18 nt, Homo sapiens
agcaaagggagcacuggg

SEQ ID NO: 788235 - RNA, 23 nt, Homo sapiens
agcaaaggggagucucagcuuuc

SEQ ID NO: 788236 - RNA, 13 nt, Homo sapiens
agcaaagguuaca

SEQ ID NO: 788237 - RNA, 16 nt, Homo sapiens
agcaaaugggggaaaa

SEQ ID NO: 788238 - RNA, 16 nt, Homo sapiens
agcaaauguugggaaa

SEQ ID NO: 788239 - RNA, 16 nt, Homo sapiens
agcaaauuuucagcau

SEQ ID NO: 788240 - RNA, 19 nt, Homo sapiens
agcaacaaaaucauggcuu

SEQ ID NO: 788241 - RNA, 17 nt, Homo sapiens
agcaacaggaaucucag

SEQ ID NO: 788242 - RNA, 18 nt, Homo sapiens
agcaacaggaaucucaga

SEQ ID NO: 788243 - RNA, 15 nt, Homo sapiens
agcaacaugugacaa

SEQ ID NO: 788244 - RNA, 15 nt, Homo sapiens
agcaaccaugaacuc

SEQ ID NO: 788245 - RNA, 15 nt, Homo sapiens
agcaaccuacugucu

SEQ ID NO: 788246 - RNA, 16 nt, Homo sapiens
agcaacuaggaaaauc

SEQ ID NO: 788247 - RNA, 13 nt, Homo sapiens
agcaacucagaga

SEQ ID NO: 788248 - RNA, 13 nt, Homo sapiens
agcaacugcagaa

SEQ ID NO: 788249 - RNA, 23 nt, Homo sapiens
agcaagacaaauuagccauuuca

SEQ ID NO: 788250 - RNA, 17 nt, Homo sapiens
agcaagacauacuuaau

SEQ ID NO: 788251 - RNA, 22 nt, Homo sapiens
agcaagccaucauccuccauug

SEQ ID NO: 788252 - RNA, 13 nt, Homo sapiens
agcaaggagcaca

SEQ ID NO: 788253 - RNA, 21 nt, Homo sapiens
agcaaggaguuuaaaugagac

SEQ ID NO: 788254 - RNA, 13 nt, Homo sapiens
auccuccacagag

SEQ ID NO: 788255 - RNA, 13 nt, Homo sapiens
auccucccaccuc

SEQ ID NO: 788256 - RNA, 21 nt, Homo sapiens
auccucccuggcagacacaac

SEQ ID NO: 788257 - RNA, 22 nt, Homo sapiens
auccucuuaaugugcagcaaaa

SEQ ID NO: 788258 - RNA, 22 nt, Homo sapiens
auccugauaaacauuaaacacu

SEQ ID NO: 788259 - RNA, 14 nt, Homo sapiens
auccugcccagugu

SEQ ID NO: 788260 - RNA, 16 nt, Homo sapiens
auccugcuagcuguag

SEQ ID NO: 788261 - RNA, 22 nt, Homo sapiens
auccuggaaaauucuauggaau

SEQ ID NO: 788262 - RNA, 19 nt, Homo sapiens
auccuggagggcuacagca

SEQ ID NO: 788263 - RNA, 11 nt, Homo sapiens
auccugggcug

SEQ ID NO: 788264 - RNA, 15 nt, Homo sapiens
auccugucauauaau

SEQ ID NO: 788265 - RNA, 18 nt, Homo sapiens
auccugucuuuaaggaaa

SEQ ID NO: 788266 - RNA, 16 nt, Homo sapiens
auccugugacauguaa

SEQ ID NO: 788267 - RNA, 16 nt, Homo sapiens
auccuguguuaucugu

SEQ ID NO: 788268 - RNA, 16 nt, Homo sapiens
auccuuaacauuucuc

SEQ ID NO: 788269 - RNA, 16 nt, Homo sapiens
auccuucagcacagga

SEQ ID NO: 788270 - RNA, 21 nt, Homo sapiens
auccuuccacuaucauuccca

SEQ ID NO: 788271 - RNA, 13 nt, Homo sapiens
auccuuccaucca

SEQ ID NO: 788272 - RNA, 14 nt, Homo sapiens
auccuuggugcugu

SEQ ID NO: 788273 - RNA, 14 nt, Homo sapiens
auccuuuacauuca

SEQ ID NO: 788274 - RNA, 16 nt, Homo sapiens
aucgaccacaccagcc

SEQ ID NO: 788275 - RNA, 19 nt, Homo sapiens
aucgagaccauccuggcua

SEQ ID NO: 788276 - RNA, 17 nt, Homo sapiens
aucgagagugugcucuc

SEQ ID NO: 788277 - RNA, 14 nt, Homo sapiens
aucgagccacugca

SEQ ID NO: 788278 - RNA, 23 nt, Homo sapiens
aucgcugcgauacuggcauuucc

SEQ ID NO: 788279 - RNA, 17 nt, Homo sapiens
aucggagacagugaucu

SEQ ID NO: 788280 - RNA, 23 nt, Homo sapiens
aucggaucuggggcucugggaua

SEQ ID NO: 788281 - RNA, 16 nt, Homo sapiens
aucguagacacaggga

SEQ ID NO: 788282 - RNA, 18 nt, Homo sapiens
aucguccucccaggccag

SEQ ID NO: 788283 - RNA, 18 nt, Homo sapiens
aucgugaaaccccaucuc

SEQ ID NO: 788284 - RNA, 12 nt, Homo sapiens
aucgugcuaaau

SEQ ID NO: 788285 - RNA, 21 nt, Homo sapiens
aucgugcuguuugccuuggcu

SEQ ID NO: 788286 - RNA, 11 nt, Homo sapiens
aucgugugcca

SEQ ID NO: 788287 - RNA, 17 nt, Homo sapiens
aucguuguuuacagugu

SEQ ID NO: 788288 - RNA, 21 nt, Homo sapiens
aucguuuaaaaacaaaggaau

SEQ ID NO: 788289 - RNA, 20 nt, Homo sapiens
aucuacauuuguuuguauuc

SEQ ID NO: 788290 - RNA, 22 nt, Homo sapiens
aucuacuccuuguaaagacugu

SEQ ID NO: 788291 - RNA, 23 nt, Homo sapiens
aucuacugaauuggcuuccagau

SEQ ID NO: 788292 - RNA, 23 nt, Homo sapiens
aucuacuggaaauguagcacuua

SEQ ID NO: 788293 - RNA, 17 nt, Homo sapiens
aucuagaagacugucag

SEQ ID NO: 788294 - RNA, 16 nt, Homo sapiens
aucuagaauggauuca

SEQ ID NO: 788295 - RNA, 14 nt, Homo sapiens
aucuagagaaggca

SEQ ID NO: 788296 - RNA, 15 nt, Homo sapiens
aucuagagcuuaaug

SEQ ID NO: 788297 - RNA, 20 nt, Homo sapiens
aucuagcaagaagauucuaa

SEQ ID NO: 788298 - RNA, 20 nt, Homo sapiens
aucuaggagaagggucucau

SEQ ID NO: 788299 - RNA, 15 nt, Homo sapiens
aucuagguucaggaa

SEQ ID NO: 788300 - RNA, 13 nt, Homo sapiens
aucuauacauacc

SEQ ID NO: 788301 - RNA, 18 nt, Homo sapiens
aucuaucaccugucauca

SEQ ID NO: 788302 - RNA, 19 nt, Homo sapiens
aucuauguuugugugauuu

SEQ ID NO: 788303 - RNA, 15 nt, Homo sapiens
aucuauugcucauca

SEQ ID NO: 788304 - RNA, 13 nt, Homo sapiens
aucuauuuauuaa

SEQ ID NO: 788305 - RNA, 16 nt, Homo sapiens
aucucaaagaaggcau

SEQ ID NO: 788306 - RNA, 17 nt, Homo sapiens
aucucaaagaaggcauu

SEQ ID NO: 788307 - RNA, 12 nt, Homo sapiens
aucucagcacuu

SEQ ID NO: 788308 - RNA, 13 nt, Homo sapiens
aucucagcacuuu

SEQ ID NO: 788309 - RNA, 14 nt, Homo sapiens
aucucagcacuuug

SEQ ID NO: 788310 - RNA, 15 nt, Homo sapiens
aucucagcuuugaga

SEQ ID NO: 788311 - RNA, 15 nt, Homo sapiens
aucucaggauuucac

SEQ ID NO: 788312 - RNA, 19 nt, Homo sapiens
aucucaggggucuuaccuu

SEQ ID NO: 788313 - RNA, 15 nt, Homo sapiens
aucucaguaccccau

SEQ ID NO: 788314 - RNA, 19 nt, Homo sapiens
aucucauaccucugaccaa

SEQ ID NO: 788315 - RNA, 16 nt, Homo sapiens
aucucauggaaacugg

SEQ ID NO: 788316 - RNA, 16 nt, Homo sapiens
aucucauggcagcuaa

SEQ ID NO: 788317 - RNA, 18 nt, Homo sapiens
aucucauuucauucucac

SEQ ID NO: 788318 - RNA, 18 nt, Homo sapiens
aucucauuuuacacaaag

SEQ ID NO: 788319 - RNA, 17 nt, Homo sapiens
aucuccauauguuacac

SEQ ID NO: 788320 - RNA, 15 nt, Homo sapiens
aucuccaucucaaaa

SEQ ID NO: 788321 - RNA, 17 nt, Homo sapiens
aucuccccaggccucca

SEQ ID NO: 788322 - RNA, 23 nt, Homo sapiens
aucucccgugggcaucucaagcc

SEQ ID NO: 788323 - RNA, 14 nt, Homo sapiens
aucucccuccucca

SEQ ID NO: 788324 - RNA, 22 nt, Homo sapiens
aucucccugccgccucaaugug

SEQ ID NO: 788325 - RNA, 21 nt, Homo sapiens
aucuccuaacaaaagaacuaa

SEQ ID NO: 788326 - RNA, 15 nt, Homo sapiens
aucuccuggcuuuac

SEQ ID NO: 788327 - RNA, 22 nt, Homo sapiens
aucuccuggcuuuacagacaaa

SEQ ID NO: 788328 - RNA, 22 nt, Homo sapiens
aucucggcucacugcaaccucu

SEQ ID NO: 788329 - RNA, 18 nt, Homo sapiens
aucucuaauacaguguga

SEQ ID NO: 788330 - RNA, 20 nt, Homo sapiens
aucucuacuaaaaacacaaa

SEQ ID NO: 788331 - RNA, 20 nt, Homo sapiens
aucucuacuaccacaaggaa

SEQ ID NO: 788332 - RNA, 14 nt, Homo sapiens
aucucuauguauau

SEQ ID NO: 788333 - RNA, 22 nt, Homo sapiens
aucucugggaguuauaggucau

SEQ ID NO: 788334 - RNA, 18 nt, Homo sapiens
aucucuucagguucucau

SEQ ID NO: 788335 - RNA, 16 nt, Homo sapiens
aucucuucagucucua

SEQ ID NO: 788336 - RNA, 16 nt, Homo sapiens
aucucuuccacauggg

SEQ ID NO: 788337 - RNA, 22 nt, Homo sapiens
aucucuucuuugcugcagucau

SEQ ID NO: 788338 - RNA, 15 nt, Homo sapiens
aucucuuuaccuccu

SEQ ID NO: 788339 - RNA, 14 nt, Homo sapiens
aucugaaaauguau

SEQ ID NO: 788340 - RNA, 13 nt, Homo sapiens
aucugaacacagu

SEQ ID NO: 788341 - RNA, 13 nt, Homo sapiens
aucugacaagacu

SEQ ID NO: 788342 - RNA, 21 nt, Homo sapiens
aucugacacaaaaaaaguuga

SEQ ID NO: 788343 - RNA, 13 nt, Homo sapiens
aucugaccaaaac

SEQ ID NO: 788344 - RNA, 12 nt, Homo sapiens
aucugaccaaac

SEQ ID NO: 788345 - RNA, 13 nt, Homo sapiens
aucugaccaucug

SEQ ID NO: 788346 - RNA, 16 nt, Homo sapiens
aucugaccaucuguga

SEQ ID NO: 788347 - RNA, 13 nt, Homo sapiens
aucugacuaugac

SEQ ID NO: 788348 - RNA, 19 nt, Homo sapiens
aucugacugccaagccaga

SEQ ID NO: 788349 - RNA, 14 nt, Homo sapiens
aucugagaggcucu

SEQ ID NO: 788350 - RNA, 21 nt, Homo sapiens
aucugagggagacugcaaaug

SEQ ID NO: 788351 - RNA, 16 nt, Homo sapiens
aucugagguuggauuu

SEQ ID NO: 788352 - RNA, 16 nt, Homo sapiens
aucugaucaaauguau

SEQ ID NO: 788353 - RNA, 20 nt, Homo sapiens
aucugauuuccuaaugucag

SEQ ID NO: 788354 - RNA, 18 nt, Homo sapiens
aucugcaaauaguuucaa

SEQ ID NO: 788355 - RNA, 14 nt, Homo sapiens
aucugcaauucaaa

SEQ ID NO: 788356 - RNA, 16 nt, Homo sapiens
aucugcacucaccuca

SEQ ID NO: 788357 - RNA, 17 nt, Homo sapiens
aucugcacucaccucac

SEQ ID NO: 788358 - RNA, 16 nt, Homo sapiens
aucugcagccacuuuc

SEQ ID NO: 788359 - RNA, 13 nt, Homo sapiens
aucugcaguuuaa

SEQ ID NO: 788360 - RNA, 18 nt, Homo sapiens
aucugcauuuucacccca

SEQ ID NO: 788361 - RNA, 15 nt, Homo sapiens
aucugccacaaaaac

SEQ ID NO: 788362 - RNA, 14 nt, Homo sapiens
aucugccaugugaa

SEQ ID NO: 788363 - RNA, 21 nt, Homo sapiens
aucugccuuaaaaccaaagag

SEQ ID NO: 788364 - RNA, 21 nt, Homo sapiens
aucugcucuuaggugcuucuu

SEQ ID NO: 788365 - RNA, 23 nt, Homo sapiens
aucugcugaaggcagucauauca

SEQ ID NO: 788366 - RNA, 15 nt, Homo sapiens
aucugcugcauagcu

SEQ ID NO: 788367 - RNA, 13 nt, Homo sapiens
aucugcuggauau

SEQ ID NO: 788368 - RNA, 17 nt, Homo sapiens
aucugcuggauauuuag

SEQ ID NO: 788369 - RNA, 24 nt, Homo sapiens
augcaaaauuguuuucacuuguau

SEQ ID NO: 788370 - RNA, 17 nt, Homo sapiens
augcaaacaaaauccaa

SEQ ID NO: 788371 - RNA, 20 nt, Homo sapiens
augcaaacaaaauccaagau

SEQ ID NO: 788372 - RNA, 14 nt, Homo sapiens
augcaaagaugaac

SEQ ID NO: 788373 - RNA, 15 nt, Homo sapiens
augcaaaguagcaau

SEQ ID NO: 788374 - RNA, 16 nt, Homo sapiens
augcaaaguagcaauu

SEQ ID NO: 788375 - RNA, 16 nt, Homo sapiens
augcaaauacaaucag

SEQ ID NO: 788376 - RNA, 19 nt, Homo sapiens
augcaaauacaaucagccc

SEQ ID NO: 788377 - RNA, 19 nt, Homo sapiens
augcaaaugagcucugaaa

SEQ ID NO: 788378 - RNA, 13 nt, Homo sapiens
augcaaaugccuc

SEQ ID NO: 788379 - RNA, 13 nt, Homo sapiens
augcaaauucauc

SEQ ID NO: 788380 - RNA, 18 nt, Homo sapiens
augcaagaguggacugaa

SEQ ID NO: 788381 - RNA, 15 nt, Homo sapiens
augcaaggcacugac

SEQ ID NO: 788382 - RNA, 19 nt, Homo sapiens
augcaauguaagcauacuu

SEQ ID NO: 788383 - RNA, 16 nt, Homo sapiens
augcacaacagaguaa

SEQ ID NO: 788384 - RNA, 21 nt, Homo sapiens
augcacacacacacaucucau

SEQ ID NO: 788385 - RNA, 20 nt, Homo sapiens
augcacacacuugcauacau

SEQ ID NO: 788386 - RNA, 13 nt, Homo sapiens
augcacacagugc

SEQ ID NO: 788387 - RNA, 14 nt, Homo sapiens
augcacacauauau

SEQ ID NO: 788388 - RNA, 13 nt, Homo sapiens
augcacaucucau

SEQ ID NO: 788389 - RNA, 14 nt, Homo sapiens
augcacgaucucag

SEQ ID NO: 788390 - RNA, 15 nt, Homo sapiens
augcacgaucucagu

SEQ ID NO: 788391 - RNA, 18 nt, Homo sapiens
augcacugacccuuccag

SEQ ID NO: 788392 - RNA, 16 nt, Homo sapiens
augcacugaguaugca

SEQ ID NO: 788393 - RNA, 12 nt, Homo sapiens
augcacugccug

SEQ ID NO: 788394 - RNA, 11 nt, Homo sapiens
augcacugcug

SEQ ID NO: 788395 - RNA, 21 nt, Homo sapiens
augcacuuaaguuagccucca

SEQ ID NO: 788396 - RNA, 12 nt, Homo sapiens
augcacuuccug

SEQ ID NO: 788397 - RNA, 19 nt, Homo sapiens
augcacuuggccugacuca

SEQ ID NO: 788398 - RNA, 22 nt, Homo sapiens
augcagacaaccucaucagcug

SEQ ID NO: 788399 - RNA, 17 nt, Homo sapiens
augcagagccacagcug

SEQ ID NO: 788400 - RNA, 20 nt, Homo sapiens
augcagccaaccaagaugca

SEQ ID NO: 788401 - RNA, 23 nt, Homo sapiens
augcagcuguggcagaguuacag

SEQ ID NO: 788402 - RNA, 23 nt, Homo sapiens
augcaggagccuacuucuagcug

SEQ ID NO: 788403 - RNA, 16 nt, Homo sapiens
augcagggagcacugu

SEQ ID NO: 788404 - RNA, 21 nt, Homo sapiens
augcagguggugggacacugg

SEQ ID NO: 788405 - RNA, 15 nt, Homo sapiens
augcagugcuuccaa

SEQ ID NO: 788406 - RNA, 23 nt, Homo sapiens
augcaguuuuucagaguggaaug

SEQ ID NO: 788407 - RNA, 21 nt, Homo sapiens
augcauagcuuugcacuucaa

SEQ ID NO: 788408 - RNA, 21 nt, Homo sapiens
augcauggugccccaggacca

SEQ ID NO: 788409 - RNA, 23 nt, Homo sapiens
augcauuauuuauugcuguguaa

SEQ ID NO: 788410 - RNA, 16 nt, Homo sapiens
augcauucuuuucaga

SEQ ID NO: 788411 - RNA, 22 nt, Homo sapiens
augcauuuugaguguuuauaga

SEQ ID NO: 788412 - RNA, 18 nt, Homo sapiens
augccaaacacuagcucu

SEQ ID NO: 788413 - RNA, 15 nt, Homo sapiens
augccaaauguucca

SEQ ID NO: 788414 - RNA, 14 nt, Homo sapiens
augccaaauucuua

SEQ ID NO: 788415 - RNA, 21 nt, Homo sapiens
augccaauaaaguuugcccau

SEQ ID NO: 788416 - RNA, 19 nt, Homo sapiens
augccaccaacacugcuca

SEQ ID NO: 788417 - RNA, 15 nt, Homo sapiens
augccaccacccacc

SEQ ID NO: 788418 - RNA, 16 nt, Homo sapiens
augccacccugcaaua

SEQ ID NO: 788419 - RNA, 17 nt, Homo sapiens
augccacccuguuuuca

SEQ ID NO: 788420 - RNA, 17 nt, Homo sapiens
augccacugcuuuccag

SEQ ID NO: 788421 - RNA, 17 nt, Homo sapiens
augccagacccacugaa

SEQ ID NO: 788422 - RNA, 15 nt, Homo sapiens
augccagagggccag

SEQ ID NO: 788423 - RNA, 21 nt, Homo sapiens
augccagcuacuuccuccucc

SEQ ID NO: 788424 - RNA, 16 nt, Homo sapiens
augccaggaaccuguc

SEQ ID NO: 788425 - RNA, 20 nt, Homo sapiens
augccaggcucaaggucuua

SEQ ID NO: 788426 - RNA, 19 nt, Homo sapiens
augccagggacugacaaaa

SEQ ID NO: 788427 - RNA, 23 nt, Homo sapiens
augccagugaaacuucaagcaaa

SEQ ID NO: 788428 - RNA, 13 nt, Homo sapiens
augccauaaucag

SEQ ID NO: 788429 - RNA, 23 nt, Homo sapiens
augccauagcaagauugcuuaaa

SEQ ID NO: 788430 - RNA, 13 nt, Homo sapiens
augccauucuucc

SEQ ID NO: 788431 - RNA, 17 nt, Homo sapiens
augcccucaaucccagc

SEQ ID NO: 788432 - RNA, 17 nt, Homo sapiens
augcccugugcaugcca

SEQ ID NO: 788433 - RNA, 17 nt, Homo sapiens
augcccuucacugucac

SEQ ID NO: 788434 - RNA, 19 nt, Homo sapiens
augccgagguaaaaguucu

SEQ ID NO: 788435 - RNA, 16 nt, Homo sapiens
augccggggacagaga

SEQ ID NO: 788436 - RNA, 23 nt, Homo sapiens
augccucgcucccuucaagacga

SEQ ID NO: 788437 - RNA, 16 nt, Homo sapiens
augccucugagcagag

SEQ ID NO: 788438 - RNA, 16 nt, Homo sapiens
augccucuguauuuaa

SEQ ID NO: 788439 - RNA, 21 nt, Homo sapiens
augccugccccccucaucuca

SEQ ID NO: 788440 - RNA, 16 nt, Homo sapiens
augccugguauuuuca

SEQ ID NO: 788441 - RNA, 17 nt, Homo sapiens
augccuguaaucucagc

SEQ ID NO: 788442 - RNA, 23 nt, Homo sapiens
augccuguaaucucagcacuuug

SEQ ID NO: 788443 - RNA, 14 nt, Homo sapiens
augccugucuuaga

SEQ ID NO: 788444 - RNA, 17 nt, Homo sapiens
augccuucacuuuacaa

SEQ ID NO: 788445 - RNA, 22 nt, Homo sapiens
augccuuccagcacccugcaaa

SEQ ID NO: 788446 - RNA, 13 nt, Homo sapiens
augccuuuaguca

SEQ ID NO: 788447 - RNA, 16 nt, Homo sapiens
augcgcacaaggcuga

SEQ ID NO: 788448 - RNA, 15 nt, Homo sapiens
augcgcacugcauuc

SEQ ID NO: 788449 - RNA, 14 nt, Homo sapiens
augcggccauucaa

SEQ ID NO: 788450 - RNA, 17 nt, Homo sapiens
augcggcccacuuuccu

SEQ ID NO: 788451 - RNA, 20 nt, Homo sapiens
augcgucccaagauguugau

SEQ ID NO: 788452 - RNA, 15 nt, Homo sapiens
augcgucuacccaga

SEQ ID NO: 788453 - RNA, 22 nt, Homo sapiens
augcuaccccacuaugacagag

SEQ ID NO: 788454 - RNA, 22 nt, Homo sapiens
augcuagacagaaaccaagcca

SEQ ID NO: 788455 - RNA, 13 nt, Homo sapiens
augcuagcagcug

SEQ ID NO: 788456 - RNA, 16 nt, Homo sapiens
augcuagcagcuguga

SEQ ID NO: 788457 - RNA, 13 nt, Homo sapiens
augcuauauaucu

SEQ ID NO: 788458 - RNA, 16 nt, Homo sapiens
augcuauugucaguca

SEQ ID NO: 788459 - RNA, 16 nt, Homo sapiens
augcuauuucacuuga

SEQ ID NO: 788460 - RNA, 13 nt, Homo sapiens
augcucagaaagg

SEQ ID NO: 788461 - RNA, 17 nt, Homo sapiens
augcucagcgcuuaaaa

SEQ ID NO: 788462 - RNA, 21 nt, Homo sapiens
augcuccaucccaaccaggca

SEQ ID NO: 788463 - RNA, 23 nt, Homo sapiens
augcucccuccccugcccugguc

SEQ ID NO: 788464 - RNA, 19 nt, Homo sapiens
augcucugccccaagcccc

SEQ ID NO: 788465 - RNA, 12 nt, Homo sapiens
augcucuugucc

SEQ ID NO: 788466 - RNA, 14 nt, Homo sapiens
augcucuuuugcac

SEQ ID NO: 788467 - RNA, 17 nt, Homo sapiens
augcucuuuugcacaag

SEQ ID NO: 788468 - RNA, 19 nt, Homo sapiens
augcucuuuugcacaagga

SEQ ID NO: 788469 - RNA, 21 nt, Homo sapiens
augcucuuuugcacaaggaaa

SEQ ID NO: 788470 - RNA, 23 nt, Homo sapiens
augcugaaaaucaaaguaaaaaa

SEQ ID NO: 788471 - RNA, 21 nt, Homo sapiens
augcugaacugaaggcucaga

SEQ ID NO: 788472 - RNA, 21 nt, Homo sapiens
augcugaggccacccacugac

SEQ ID NO: 788473 - RNA, 15 nt, Homo sapiens
augcugcacagaaau

SEQ ID NO: 788474 - RNA, 18 nt, Homo sapiens
augcugcaggacuugaga

SEQ ID NO: 788475 - RNA, 13 nt, Homo sapiens
augcugcagugag

SEQ ID NO: 788476 - RNA, 19 nt, Homo sapiens
augcugcccagccacucca

SEQ ID NO: 788477 - RNA, 18 nt, Homo sapiens
augcugcucauccaaagu

SEQ ID NO: 788478 - RNA, 15 nt, Homo sapiens
augcugcuguuuaca

SEQ ID NO: 788479 - RNA, 18 nt, Homo sapiens
augcugggaaugagacau

SEQ ID NO: 788480 - RNA, 20 nt, Homo sapiens
augcugggcucaucuucuag

SEQ ID NO: 788481 - RNA, 15 nt, Homo sapiens
augcugugcuaugaa

SEQ ID NO: 788482 - RNA, 16 nt, Homo sapiens
augcuguuagguugcg

SEQ ID NO: 788483 - RNA, 19 nt, Homo sapiens
gccgcacccugcaccugcu

SEQ ID NO: 788484 - RNA, 14 nt, Homo sapiens
gccgcagacgggca

SEQ ID NO: 788485 - RNA, 15 nt, Homo sapiens
gccgccgaccuguga

SEQ ID NO: 788486 - RNA, 17 nt, Homo sapiens
gccgccgaccugugacu

SEQ ID NO: 788487 - RNA, 15 nt, Homo sapiens
gccgcucucucugag

SEQ ID NO: 788488 - RNA, 18 nt, Homo sapiens
gccgcuggcaacaacagc

SEQ ID NO: 788489 - RNA, 15 nt, Homo sapiens
gccgcugucucugag

SEQ ID NO: 788490 - RNA, 15 nt, Homo sapiens
gccgcuuucucugag

SEQ ID NO: 788491 - RNA, 15 nt, Homo sapiens
gccgggaaccucauc

SEQ ID NO: 788492 - RNA, 16 nt, Homo sapiens
gccgggaccacccuga

SEQ ID NO: 788493 - RNA, 13 nt, Homo sapiens
gccgggcgcagug

SEQ ID NO: 788494 - RNA, 18 nt, Homo sapiens
gccguccauggcaccagc

SEQ ID NO: 788495 - RNA, 21 nt, Homo sapiens
gccguccuggcgccuggcagu

SEQ ID NO: 788496 - RNA, 17 nt, Homo sapiens
gccgucuccucccucag

SEQ ID NO: 788497 - RNA, 18 nt, Homo sapiens
gccgucugugugguggga

SEQ ID NO: 788498 - RNA, 19 nt, Homo sapiens
gccgugccuucagcucuac

SEQ ID NO: 788499 - RNA, 22 nt, Homo sapiens
gccguggggccgccgccucuuu

SEQ ID NO: 788500 - RNA, 16 nt, Homo sapiens
gccguguggcacacac

SEQ ID NO: 788501 - RNA, 23 nt, Homo sapiens
gccguuuccccuccuuggcuuua

SEQ ID NO: 788502 - RNA, 23 nt, Homo sapiens
gccguuugagaagaaaacaucua

SEQ ID NO: 788503 - RNA, 22 nt, Homo sapiens
gccguuuucuugcucaaaggga

SEQ ID NO: 788504 - RNA, 23 nt, Homo sapiens
gccguuuucuugcucaaagggaa

SEQ ID NO: 788505 - RNA, 13 nt, Homo sapiens
gccuaaacuuaau

SEQ ID NO: 788506 - RNA, 20 nt, Homo sapiens
gccuaaagauuuugaucuca

SEQ ID NO: 788507 - RNA, 22 nt, Homo sapiens
gccuaaauuuaaugcugccuuu

SEQ ID NO: 788508 - RNA, 17 nt, Homo sapiens
caguaaauagugucaua

SEQ ID NO: 788509 - RNA, 23 nt, Homo sapiens
caguaaauguacaacugcaccug

SEQ ID NO: 788510 - RNA, 21 nt, Homo sapiens
caguaacaaauaaagugcagu

SEQ ID NO: 788511 - RNA, 15 nt, Homo sapiens
caguaaccaugcccg

SEQ ID NO: 788512 - RNA, 17 nt, Homo sapiens
caguaacgcgucuuccu

SEQ ID NO: 788513 - RNA, 10 nt, Homo sapiens
caguaacuga

SEQ ID NO: 788514 - RNA, 16 nt, Homo sapiens
caguaacugugacuga

SEQ ID NO: 788515 - RNA, 19 nt, Homo sapiens
caguaacugugacugauga

SEQ ID NO: 788516 - RNA, 20 nt, Homo sapiens
caguaagcugcucuauugua

SEQ ID NO: 788517 - RNA, 17 nt, Homo sapiens
caguaagucacaguuau

SEQ ID NO: 788518 - RNA, 17 nt, Homo sapiens
caguaauuccuguuacu

SEQ ID NO: 788519 - RNA, 18 nt, Homo sapiens
caguacacccaguugcca

SEQ ID NO: 788520 - RNA, 19 nt, Homo sapiens
caguacaugggaaaggagg

SEQ ID NO: 788521 - RNA, 18 nt, Homo sapiens
caguacccucucagcucc

SEQ ID NO: 788522 - RNA, 14 nt, Homo sapiens
caguacucacuuuu

SEQ ID NO: 788523 - RNA, 22 nt, Homo sapiens
caguacuguucccaacucagcu

SEQ ID NO: 788524 - RNA, 21 nt, Homo sapiens
caguacuugugaaacacagcu

SEQ ID NO: 788525 - RNA, 18 nt, Homo sapiens
caguagaaauaauaugca

SEQ ID NO: 788526 - RNA, 19 nt, Homo sapiens
caguagaaauaauaugcau

SEQ ID NO: 788527 - RNA, 14 nt, Homo sapiens
caguagagaucuau

SEQ ID NO: 788528 - RNA, 23 nt, Homo sapiens
caguagagcaaaucuaugagauu

SEQ ID NO: 788529 - RNA, 15 nt, Homo sapiens
caguagagccagcuu

SEQ ID NO: 788530 - RNA, 16 nt, Homo sapiens
caguagagucaucucc

SEQ ID NO: 788531 - RNA, 14 nt, Homo sapiens
caguagcauuugcu

SEQ ID NO: 788532 - RNA, 12 nt, Homo sapiens
caguagcugcua

SEQ ID NO: 788533 - RNA, 16 nt, Homo sapiens
caguagcuguggugag

SEQ ID NO: 788534 - RNA, 17 nt, Homo sapiens
caguagggaggucagug

SEQ ID NO: 788535 - RNA, 23 nt, Homo sapiens
caguagucccugcacagugacuu

SEQ ID NO: 788536 - RNA, 21 nt, Homo sapiens
caguaguuuugacacuuccca

SEQ ID NO: 788537 - RNA, 21 nt, Homo sapiens
caguauaggccaucaauauca

SEQ ID NO: 788538 - RNA, 21 nt, Homo sapiens
caguauauucuuugguuguga

SEQ ID NO: 788539 - RNA, 20 nt, Homo sapiens
caguauauuuauagucacaa

SEQ ID NO: 788540 - RNA, 20 nt, Homo sapiens
caguaucuauauauguguau

SEQ ID NO: 788541 - RNA, 14 nt, Homo sapiens
caguaucucuucag

SEQ ID NO: 788542 - RNA, 19 nt, Homo sapiens
caguaucucuucagucucu

SEQ ID NO: 788543 - RNA, 14 nt, Homo sapiens
caguaugacaguau

SEQ ID NO: 788544 - RNA, 21 nt, Homo sapiens
caguauguuuguuucauugug

SEQ ID NO: 788545 - RNA, 15 nt, Homo sapiens
caguauuacaguguc

SEQ ID NO: 788546 - RNA, 18 nt, Homo sapiens
caguauuagaugcacuua

SEQ ID NO: 788547 - RNA, 17 nt, Homo sapiens
caguauuuuguguccuc

SEQ ID NO: 788548 - RNA, 15 nt, Homo sapiens
cagucaacaguucaa

SEQ ID NO: 788549 - RNA, 16 nt, Homo sapiens
cagucaaguucagagu

SEQ ID NO: 788550 - RNA, 16 nt, Homo sapiens
cagucacauggcaugg

SEQ ID NO: 788551 - RNA, 20 nt, Homo sapiens
cagucacugcugcaaggugg

SEQ ID NO: 788552 - RNA, 22 nt, Homo sapiens
cagucagauccuguuacuugcu

SEQ ID NO: 788553 - RNA, 12 nt, Homo sapiens
cagucaguucau

SEQ ID NO: 788554 - RNA, 22 nt, Homo sapiens
cagucaguuugcacaacaagau

SEQ ID NO: 788555 - RNA, 19 nt, Homo sapiens
cagucauggccugagaugc

SEQ ID NO: 788556 - RNA, 16 nt, Homo sapiens
caguccaauaggugua

SEQ ID NO: 788557 - RNA, 13 nt, Homo sapiens
caguccauugcuc

SEQ ID NO: 788558 - RNA, 20 nt, Homo sapiens
cagucccuauguauuugcag

SEQ ID NO: 788559 - RNA, 23 nt, Homo sapiens
cagucccugguuccuagaugugu

SEQ ID NO: 788560 - RNA, 15 nt, Homo sapiens
caguccuauucugua

SEQ ID NO: 788561 - RNA, 14 nt, Homo sapiens
caguccucuuucaa

SEQ ID NO: 788562 - RNA, 23 nt, Homo sapiens
caguccuggagggaguggguuaa

SEQ ID NO: 788563 - RNA, 14 nt, Homo sapiens
caguccuguuugca

SEQ ID NO: 788564 - RNA, 18 nt, Homo sapiens
cagucuaaggucucaugc

SEQ ID NO: 788565 - RNA, 14 nt, Homo sapiens
cagucuaguuccug

SEQ ID NO: 788566 - RNA, 22 nt, Homo sapiens
cagucuaucauuguuggacauu

SEQ ID NO: 788567 - RNA, 23 nt, Homo sapiens
cagucuauuccaggcaugcacaa

SEQ ID NO: 788568 - RNA, 13 nt, Homo sapiens
cagucuauuucca

SEQ ID NO: 788569 - RNA, 18 nt, Homo sapiens
cagucucagcugcugaaa

SEQ ID NO: 788570 - RNA, 23 nt, Homo sapiens
cagucucuauaccaauaaaguga

SEQ ID NO: 788571 - RNA, 18 nt, Homo sapiens
cagucucuucuaagcaaa

SEQ ID NO: 788572 - RNA, 19 nt, Homo sapiens
cagucucuucuaagcaaaa

SEQ ID NO: 788573 - RNA, 23 nt, Homo sapiens
cagucuguuaugcacugugguuu

SEQ ID NO: 788574 - RNA, 16 nt, Homo sapiens
cagucuucuaauuccu

SEQ ID NO: 788575 - RNA, 19 nt, Homo sapiens
cagucuucuucacuucccu

SEQ ID NO: 788576 - RNA, 13 nt, Homo sapiens
cagucuuucuuga

SEQ ID NO: 788577 - RNA, 21 nt, Homo sapiens
cagugaaauaauuacagaaua

SEQ ID NO: 788578 - RNA, 16 nt, Homo sapiens
cagugaagcagcacug

SEQ ID NO: 788579 - RNA, 18 nt, Homo sapiens
cagugaaggcuaaaugag

SEQ ID NO: 788580 - RNA, 16 nt, Homo sapiens
cagugacacuggacca

SEQ ID NO: 788581 - RNA, 17 nt, Homo sapiens
cagugagaagccagcuu

SEQ ID NO: 788582 - RNA, 14 nt, Homo sapiens
cagugagacugugg

SEQ ID NO: 788583 - RNA, 15 nt, Homo sapiens
cagugagccauguuc

SEQ ID NO: 788584 - RNA, 19 nt, Homo sapiens
cagugagccgagaucacac

SEQ ID NO: 788585 - RNA, 22 nt, Homo sapiens
cagugagccgagaucacaccac

SEQ ID NO: 788586 - RNA, 20 nt, Homo sapiens
cagugagccgagauggcgcu

SEQ ID NO: 788587 - RNA, 19 nt, Homo sapiens
cagugagcugagauugugc

SEQ ID NO: 788588 - RNA, 23 nt, Homo sapiens
cagugagcuggggccgucugugu

SEQ ID NO: 788589 - RNA, 19 nt, Homo sapiens
cagugagguucuuggguuu

SEQ ID NO: 788590 - RNA, 15 nt, Homo sapiens
cagugaucuccauau

SEQ ID NO: 788591 - RNA, 23 nt, Homo sapiens
cagugaugcugugcuaugaauuu

SEQ ID NO: 788592 - RNA, 13 nt, Homo sapiens
cagugauucagca

SEQ ID NO: 788593 - RNA, 13 nt, Homo sapiens
cagugcaaaccac

SEQ ID NO: 788594 - RNA, 15 nt, Homo sapiens
cagugcaaaccacuu

SEQ ID NO: 788595 - RNA, 16 nt, Homo sapiens
cagugcaaaugcaugc

SEQ ID NO: 788596 - RNA, 19 nt, Homo sapiens
cagugcaacugacaaguua

SEQ ID NO: 788597 - RNA, 12 nt, Homo sapiens
cagugcagugaa

SEQ ID NO: 788598 - RNA, 15 nt, Homo sapiens
cagugcagugaagga

SEQ ID NO: 788599 - RNA, 22 nt, Homo sapiens
cagugcaguuucuuuucacauu

SEQ ID NO: 788600 - RNA, 13 nt, Homo sapiens
cagugcauaugca

SEQ ID NO: 788601 - RNA, 17 nt, Homo sapiens
cagugcccggcugaggg

SEQ ID NO: 788602 - RNA, 16 nt, Homo sapiens
cagugcccucauuuua

SEQ ID NO: 788603 - RNA, 22 nt, Homo sapiens
cagugccuacccaccugugagg

SEQ ID NO: 788604 - RNA, 15 nt, Homo sapiens
cagugccuuccauaa

SEQ ID NO: 788605 - RNA, 16 nt, Homo sapiens
cagugccuuccauaau

SEQ ID NO: 788606 - RNA, 13 nt, Homo sapiens
cagugcuacugaa

SEQ ID NO: 788607 - RNA, 17 nt, Homo sapiens
cagugcugaauuucccu

SEQ ID NO: 788608 - RNA, 12 nt, Homo sapiens
cagugcugccag

SEQ ID NO: 788609 - RNA, 19 nt, Homo sapiens
cagugcugccaguuuccca

SEQ ID NO: 788610 - RNA, 14 nt, Homo sapiens
cagugcuggauuug

SEQ ID NO: 788611 - RNA, 17 nt, Homo sapiens
cagugcuucagccugag

SEQ ID NO: 788612 - RNA, 19 nt, Homo sapiens
caguggaagcaguuucaga

SEQ ID NO: 788613 - RNA, 22 nt, Homo sapiens
caguggaugccacagcccagcu

SEQ ID NO: 788614 - RNA, 13 nt, Homo sapiens
caguggauucuca

SEQ ID NO: 788615 - RNA, 14 nt, Homo sapiens
caguggauucucau

SEQ ID NO: 788616 - RNA, 17 nt, Homo sapiens
caguggcagacaaacag

SEQ ID NO: 788617 - RNA, 17 nt, Homo sapiens
caguggcaucaucucag

SEQ ID NO: 788618 - RNA, 16 nt, Homo sapiens
caguggcaugauguca

SEQ ID NO: 788619 - RNA, 13 nt, Homo sapiens
caguggcccugag

SEQ ID NO: 788620 - RNA, 18 nt, Homo sapiens
caguggcccugagcagua

SEQ ID NO: 788621 - RNA, 17 nt, Homo sapiens
caguggcgcgaucucag

SEQ ID NO: 788622 - RNA, 20 nt, Homo sapiens
caguggcgcgaucucagcuc

SEQ ID NO: 788623 - RNA, 12 nt, Homo sapiens
cgcucucaagac

SEQ ID NO: 788624 - RNA, 17 nt, Homo sapiens
cgcucuguggaugccag

SEQ ID NO: 788625 - RNA, 16 nt, Homo sapiens
cgcugccuggaacacc

SEQ ID NO: 788626 - RNA, 21 nt, Homo sapiens
cgcugcugucacaaccaagaa

SEQ ID NO: 788627 - RNA, 16 nt, Homo sapiens
cgcuggcucccugggc

SEQ ID NO: 788628 - RNA, 16 nt, Homo sapiens
cgcugugggcaauugu

SEQ ID NO: 788629 - RNA, 21 nt, Homo sapiens
cgcuuaaaaaaacaaauugga

SEQ ID NO: 788630 - RNA, 16 nt, Homo sapiens
cgcuuaaccuuuccag

SEQ ID NO: 788631 - RNA, 13 nt, Homo sapiens
cgcuuauguuaau

SEQ ID NO: 788632 - RNA, 12 nt, Homo sapiens
cgcuucuugccu

SEQ ID NO: 788633 - RNA, 13 nt, Homo sapiens
cgcuugcuuuagc

SEQ ID NO: 788634 - RNA, 15 nt, Homo sapiens
cgcuuuguugcccag

SEQ ID NO: 788635 - RNA, 18 nt, Homo sapiens
cggaaggucccucagaca

SEQ ID NO: 788636 - RNA, 21 nt, Homo sapiens
cggacaagacccccagcacuu

SEQ ID NO: 788637 - RNA, 20 nt, Homo sapiens
cggacacggcuucacugacc

SEQ ID NO: 788638 - RNA, 19 nt, Homo sapiens
cggacagcugcccagacac

SEQ ID NO: 788639 - RNA, 20 nt, Homo sapiens
cggacucaccaacuugccac

SEQ ID NO: 788640 - RNA, 14 nt, Homo sapiens
cggacucacuugau

SEQ ID NO: 788641 - RNA, 13 nt, Homo sapiens
cggagagagccaa

SEQ ID NO: 788642 - RNA, 15 nt, Homo sapiens
cggagauuuugaaca

SEQ ID NO: 788643 - RNA, 17 nt, Homo sapiens
cggaggagaccagcuca

SEQ ID NO: 788644 - RNA, 17 nt, Homo sapiens
cggagucuugcucugua

SEQ ID NO: 788645 - RNA, 14 nt, Homo sapiens
cggauacaaacugg

SEQ ID NO: 788646 - RNA, 10 nt, Homo sapiens
cggaucucug

SEQ ID NO: 788647 - RNA, 14 nt, Homo sapiens
cggaucucuggagu

SEQ ID NO: 788648 - RNA, 21 nt, Homo sapiens
cggaucuggggcucugggaua

SEQ ID NO: 788649 - RNA, 16 nt, Homo sapiens
cggaugaccaaaccag

SEQ ID NO: 788650 - RNA, 12 nt, Homo sapiens
cggauggugcau

SEQ ID NO: 788651 - RNA, 16 nt, Homo sapiens
cggauuccagcccaca

SEQ ID NO: 788652 - RNA, 13 nt, Homo sapiens
cggcaacaucucu

SEQ ID NO: 788653 - RNA, 19 nt, Homo sapiens
cggcaaugcccugugcaug

SEQ ID NO: 788654 - RNA, 15 nt, Homo sapiens
cggcagccuggaugu

SEQ ID NO: 788655 - RNA, 16 nt, Homo sapiens
cggccaccaugcugca

SEQ ID NO: 788656 - RNA, 20 nt, Homo sapiens
cggccacgucccugcacucu

SEQ ID NO: 788657 - RNA, 19 nt, Homo sapiens
cggccagugcggcugccag

SEQ ID NO: 788658 - RNA, 15 nt, Homo sapiens
cggccccucccacac

SEQ ID NO: 788659 - RNA, 13 nt, Homo sapiens
cggcccugaccaa

SEQ ID NO: 788660 - RNA, 13 nt, Homo sapiens
cggccgacugccu

SEQ ID NO: 788661 - RNA, 17 nt, Homo sapiens
cggccugcccagucgac

SEQ ID NO: 788662 - RNA, 22 nt, Homo sapiens
cggccuggggcgagcacuguga

SEQ ID NO: 788663 - RNA, 15 nt, Homo sapiens
cggccuuuguugcuc

SEQ ID NO: 788664 - RNA, 13 nt, Homo sapiens
cggcucccggggc

SEQ ID NO: 788665 - RNA, 11 nt, Homo sapiens
cggcugaccau

SEQ ID NO: 788666 - RNA, 16 nt, Homo sapiens
cggcuguuuacugcuu

SEQ ID NO: 788667 - RNA, 15 nt, Homo sapiens
cggcuucaaguggca

SEQ ID NO: 788668 - RNA, 17 nt, Homo sapiens
cgggaaagccuuaaaaa

SEQ ID NO: 788669 - RNA, 15 nt, Homo sapiens
cgggacacagaauua

SEQ ID NO: 788670 - RNA, 20 nt, Homo sapiens
cgggagacugacacgaagcc

SEQ ID NO: 788671 - RNA, 13 nt, Homo sapiens
cgggagcacagcu

SEQ ID NO: 788672 - RNA, 15 nt, Homo sapiens
cgggagcagugucuu

SEQ ID NO: 788673 - RNA, 14 nt, Homo sapiens
cgggagccauguca

SEQ ID NO: 788674 - RNA, 13 nt, Homo sapiens
cgggcaccuguag

SEQ ID NO: 788675 - RNA, 21 nt, Homo sapiens
cgggccuggagaacuagagaa

SEQ ID NO: 788676 - RNA, 15 nt, Homo sapiens
cgggcugcugcugau

SEQ ID NO: 788677 - RNA, 20 nt, Homo sapiens
cgggcuguagaucagguuug

SEQ ID NO: 788678 - RNA, 16 nt, Homo sapiens
cgggcuucggaacacg

SEQ ID NO: 788679 - RNA, 14 nt, Homo sapiens
cggggacccuguga

SEQ ID NO: 788680 - RNA, 17 nt, Homo sapiens
cggggacuuuaccugcu

SEQ ID NO: 788681 - RNA, 15 nt, Homo sapiens
cggggccagcacuuc

SEQ ID NO: 788682 - RNA, 18 nt, Homo sapiens
cggggccagcacuuccau

SEQ ID NO: 788683 - RNA, 22 nt, Homo sapiens
cgggucucaacuuuaagauaga

SEQ ID NO: 788684 - RNA, 23 nt, Homo sapiens
cgggugagcugagcuuggcguuu

SEQ ID NO: 788685 - RNA, 20 nt, Homo sapiens
cggguggaucacaaggucaa

SEQ ID NO: 788686 - RNA, 19 nt, Homo sapiens
cggguguguacaccaaggu

SEQ ID NO: 788687 - RNA, 19 nt, Homo sapiens
cggguucaccauguugccc

SEQ ID NO: 788688 - RNA, 14 nt, Homo sapiens
cggguuuguaacug

SEQ ID NO: 788689 - RNA, 20 nt, Homo sapiens
cggucccaguuuuguugccc

SEQ ID NO: 788690 - RNA, 15 nt, Homo sapiens
cggucccccaugcca

SEQ ID NO: 788691 - RNA, 13 nt, Homo sapiens
cggucggggacuu

SEQ ID NO: 788692 - RNA, 15 nt, Homo sapiens
cggucugcuuuggau

SEQ ID NO: 788693 - RNA, 22 nt, Homo sapiens
cggugaaaccccgucucuacua

SEQ ID NO: 788694 - RNA, 13 nt, Homo sapiens
cgguggaccaaag

SEQ ID NO: 788695 - RNA, 18 nt, Homo sapiens
cgguggcucaugccugua

SEQ ID NO: 788696 - RNA, 17 nt, Homo sapiens
cgguggcugccccggcc

SEQ ID NO: 788697 - RNA, 16 nt, Homo sapiens
cggugugcaccaacau

SEQ ID NO: 788698 - RNA, 11 nt, Homo sapiens
cgguguucuaa

SEQ ID NO: 788699 - RNA, 13 nt, Homo sapiens
cgguguucugucc

SEQ ID NO: 788700 - RNA, 14 nt, Homo sapiens
cgguguuuugccau

SEQ ID NO: 788701 - RNA, 14 nt, Homo sapiens
cgguuaccucugca

SEQ ID NO: 788702 - RNA, 15 nt, Homo sapiens
cgguuaccucugcau

SEQ ID NO: 788703 - RNA, 16 nt, Homo sapiens
cgguucaccagccucu

SEQ ID NO: 788704 - RNA, 21 nt, Homo sapiens
cgguugaacucacuccacugu

SEQ ID NO: 788705 - RNA, 19 nt, Homo sapiens
cgguugauugaaauaucag

SEQ ID NO: 788706 - RNA, 16 nt, Homo sapiens
cguaagggaucuuccu

SEQ ID NO: 788707 - RNA, 19 nt, Homo sapiens
cguacugauucuaaugggg

SEQ ID NO: 788708 - RNA, 14 nt, Homo sapiens
cguacuuguaauau

SEQ ID NO: 788709 - RNA, 15 nt, Homo sapiens
cguagacagguguua

SEQ ID NO: 788710 - RNA, 13 nt, Homo sapiens
cguagccaucucu

SEQ ID NO: 788711 - RNA, 19 nt, Homo sapiens
cguagcuccauauuggaca

SEQ ID NO: 788712 - RNA, 19 nt, Homo sapiens
cguagguauuagugcuagu

SEQ ID NO: 788713 - RNA, 18 nt, Homo sapiens
cguaguauuaugauugca

SEQ ID NO: 788714 - RNA, 14 nt, Homo sapiens
cguaguucccugaa

SEQ ID NO: 788715 - RNA, 13 nt, Homo sapiens
cguauagguugau

SEQ ID NO: 788716 - RNA, 18 nt, Homo sapiens
cguauuuauacucacuga

SEQ ID NO: 788717 - RNA, 16 nt, Homo sapiens
cguauuuuacaugaag

SEQ ID NO: 788718 - RNA, 21 nt, Homo sapiens
cgucaagagcaugcacaugcu

SEQ ID NO: 788719 - RNA, 15 nt, Homo sapiens
cgucacuaauacaca

SEQ ID NO: 788720 - RNA, 14 nt, Homo sapiens
cgucacuccagugc

SEQ ID NO: 788721 - RNA, 11 nt, Homo sapiens
cgucauguccu

SEQ ID NO: 788722 - RNA, 19 nt, Homo sapiens
cguccauauuuaacaugua

SEQ ID NO: 788723 - RNA, 14 nt, Homo sapiens
cguccauccauuca

SEQ ID NO: 788724 - RNA, 15 nt, Homo sapiens
cguccaucucccuua

SEQ ID NO: 788725 - RNA, 22 nt, Homo sapiens
cgucccaggccacccccaugga

SEQ ID NO: 788726 - RNA, 19 nt, Homo sapiens
cgucccgugucuccagggg

SEQ ID NO: 788727 - RNA, 21 nt, Homo sapiens
cguccgcgcgccagcacagaa

SEQ ID NO: 788728 - RNA, 16 nt, Homo sapiens
cgucuacccagacuca

SEQ ID NO: 788729 - RNA, 13 nt, Homo sapiens
cgucuacugcaag

SEQ ID NO: 788730 - RNA, 17 nt, Homo sapiens
cgucuccgaagauuugg

SEQ ID NO: 788731 - RNA, 21 nt, Homo sapiens
cgucucuacuaaaaaauacaa

SEQ ID NO: 788732 - RNA, 22 nt, Homo sapiens
cgucugugacuuaucuaccauu

SEQ ID NO: 788733 - RNA, 17 nt, Homo sapiens
cgugaaaccccaucucu

SEQ ID NO: 788734 - RNA, 17 nt, Homo sapiens
cgugaaaccccgucucu

SEQ ID NO: 788735 - RNA, 19 nt, Homo sapiens
cgugaagaagccuguaaca

SEQ ID NO: 788736 - RNA, 15 nt, Homo sapiens
cgugacuguggcaca

SEQ ID NO: 788737 - RNA, 15 nt, Homo sapiens
cgugcaauguuuuaa

SEQ ID NO: 788738 - RNA, 12 nt, Homo sapiens
cgugcacucugc

SEQ ID NO: 788739 - RNA, 12 nt, Homo sapiens
cuuuuguacuga

SEQ ID NO: 788740 - RNA, 13 nt, Homo sapiens
cuuuuguacugaa

SEQ ID NO: 788741 - RNA, 22 nt, Homo sapiens
cuuuugugcaaagccaaaaccu

SEQ ID NO: 788742 - RNA, 18 nt, Homo sapiens
cuuuuguuccuuuguuaa

SEQ ID NO: 788743 - RNA, 15 nt, Homo sapiens
cuuuuguuucuagaa

SEQ ID NO: 788744 - RNA, 23 nt, Homo sapiens
cuuuuuaauggaaaccaagccaa

SEQ ID NO: 788745 - RNA, 12 nt, Homo sapiens
cuuuuuacuguu

SEQ ID NO: 788746 - RNA, 22 nt, Homo sapiens
cuuuuuaugugcuaugcaaaau

SEQ ID NO: 788747 - RNA, 13 nt, Homo sapiens
cuuuuucuuugag

SEQ ID NO: 788748 - RNA, 15 nt, Homo sapiens
cuuuuuggagagugc

SEQ ID NO: 788749 - RNA, 19 nt, Homo sapiens
cuuuuugggagaaugaugu

SEQ ID NO: 788750 - RNA, 21 nt, Homo sapiens
cuuuuuguacugaaaacaauu

SEQ ID NO: 788751 - RNA, 20 nt, Homo sapiens
cuuuuuuaaaaacaaacaaa

SEQ ID NO: 788752 - RNA, 16 nt, Homo sapiens
cuuuuuuaauuuccag

SEQ ID NO: 788753 - RNA, 20 nt, Homo sapiens
cuuuuuuagaaaugcaaaau

SEQ ID NO: 788754 - RNA, 16 nt, Homo sapiens
cuuuuuuucuguacca

SEQ ID NO: 788755 - RNA, 14 nt, Homo sapiens
cuuuuuuucuuugg

SEQ ID NO: 788756 - RNA, 18 nt, Homo sapiens
cuuuuuuuuaaaaaaacu

SEQ ID NO: 788757 - RNA, 14 nt, Homo sapiens
cuuuuuuuuaagga

SEQ ID NO: 788758 - RNA, 21 nt, Homo sapiens
gaaaaaaaaaagaaaugcaaa

SEQ ID NO: 788759 - RNA, 17 nt, Homo sapiens
gaaaaaaaagugucuca

SEQ ID NO: 788760 - RNA, 18 nt, Homo sapiens
gaaaaaaaccacacaaag

SEQ ID NO: 788761 - RNA, 13 nt, Homo sapiens
gaaaaaaagggag

SEQ ID NO: 788762 - RNA, 21 nt, Homo sapiens
gaaaaaaauacaaaaagcaaa

SEQ ID NO: 788763 - RNA, 14 nt, Homo sapiens
gaaaaaaauuacua

SEQ ID NO: 788764 - RNA, 16 nt, Homo sapiens
gaaaaaagaaccaaaa

SEQ ID NO: 788765 - RNA, 17 nt, Homo sapiens
gaaaaaagguuacuuug

SEQ ID NO: 788766 - RNA, 14 nt, Homo sapiens
gaaaaacaaaaagg

SEQ ID NO: 788767 - RNA, 20 nt, Homo sapiens
gaaaaacaaaaaggaaauga

SEQ ID NO: 788768 - RNA, 18 nt, Homo sapiens
gaaaaacauuccaggaaa

SEQ ID NO: 788769 - RNA, 14 nt, Homo sapiens
gaaaaagauggaau

SEQ ID NO: 788770 - RNA, 18 nt, Homo sapiens
gaaaaagcccuaauagca

SEQ ID NO: 788771 - RNA, 20 nt, Homo sapiens
gaaaaauaguaaacauuaag

SEQ ID NO: 788772 - RNA, 22 nt, Homo sapiens
gaaaaauauaauguugauaaua

SEQ ID NO: 788773 - RNA, 17 nt, Homo sapiens
gaaaaauaucuuggccu

SEQ ID NO: 788774 - RNA, 19 nt, Homo sapiens
gaaaaauaugauacucuca

SEQ ID NO: 788775 - RNA, 20 nt, Homo sapiens
gaaaaaucagaugaauugau

SEQ ID NO: 788776 - RNA, 17 nt, Homo sapiens
gaaaacaagaagucaua

SEQ ID NO: 788777 - RNA, 16 nt, Homo sapiens
gaaaacagaacacuua

SEQ ID NO: 788778 - RNA, 19 nt, Homo sapiens
gaaaacagggucugggaca

SEQ ID NO: 788779 - RNA, 20 nt, Homo sapiens
gaaaacauagcaucucagga

SEQ ID NO: 788780 - RNA, 18 nt, Homo sapiens
gaaaacaucucaauaaca

SEQ ID NO: 788781 - RNA, 14 nt, Homo sapiens
gaaaacauguuaau

SEQ ID NO: 788782 - RNA, 14 nt, Homo sapiens
gaaaaccacaguca

SEQ ID NO: 788783 - RNA, 17 nt, Homo sapiens
gaaaaccucuccugacc

SEQ ID NO: 788784 - RNA, 20 nt, Homo sapiens
gaaaacuacugauacuuuca

SEQ ID NO: 788785 - RNA, 16 nt, Homo sapiens
gaaaacugaaugucaa

SEQ ID NO: 788786 - RNA, 18 nt, Homo sapiens
gaaaacuguagucucuga

SEQ ID NO: 788787 - RNA, 16 nt, Homo sapiens
gaaaagaagacucuga

SEQ ID NO: 788788 - RNA, 23 nt, Homo sapiens
gaaaagcccccaguuaauacucc

SEQ ID NO: 788789 - RNA, 21 nt, Homo sapiens
gaaaagcugaauccagaucau

SEQ ID NO: 788790 - RNA, 14 nt, Homo sapiens
gaaaagcugccauu

SEQ ID NO: 788791 - RNA, 16 nt, Homo sapiens
gaaaaggaagacuaga

SEQ ID NO: 788792 - RNA, 13 nt, Homo sapiens
gaaaaggacaaau

SEQ ID NO: 788793 - RNA, 16 nt, Homo sapiens
gaaaaggauaugcagu

SEQ ID NO: 788794 - RNA, 18 nt, Homo sapiens
gaaaaggcugcugugaac

SEQ ID NO: 788795 - RNA, 15 nt, Homo sapiens
gaaaaggcugguaca

SEQ ID NO: 788796 - RNA, 15 nt, Homo sapiens
gaaaagggaucugcu

SEQ ID NO: 788797 - RNA, 22 nt, Homo sapiens
gaaaagguagcuuaccugacac

SEQ ID NO: 788798 - RNA, 20 nt, Homo sapiens
gaaaaggucuuggugccucu

SEQ ID NO: 788799 - RNA, 16 nt, Homo sapiens
gaaaaguacauuuaau

SEQ ID NO: 788800 - RNA, 18 nt, Homo sapiens
gaaaaguccacauaaccc

SEQ ID NO: 788801 - RNA, 14 nt, Homo sapiens
gaaaagugcauauu

SEQ ID NO: 788802 - RNA, 15 nt, Homo sapiens
gaaaaguguggcuug

SEQ ID NO: 788803 - RNA, 15 nt, Homo sapiens
gaaaaguuagucaau

SEQ ID NO: 788804 - RNA, 22 nt, Homo sapiens
gaaaaguuagucaauccuguca

SEQ ID NO: 788805 - RNA, 19 nt, Homo sapiens
gaaaaguugaaauguguaa

SEQ ID NO: 788806 - RNA, 21 nt, Homo sapiens
gaaaaguuuaaagacacuuag

SEQ ID NO: 788807 - RNA, 14 nt, Homo sapiens
gaaaauaaacugac

SEQ ID NO: 788808 - RNA, 14 nt, Homo sapiens
gaaaauaucuugcu

SEQ ID NO: 788809 - RNA, 18 nt, Homo sapiens
gaaaaucacuugccaaaa

SEQ ID NO: 788810 - RNA, 23 nt, Homo sapiens
gaaaaucaucaagaagggcugca

SEQ ID NO: 788811 - RNA, 14 nt, Homo sapiens
gaaaaugagaaaau

SEQ ID NO: 788812 - RNA, 11 nt, Homo sapiens
gaaaaugcaaa

SEQ ID NO: 788813 - RNA, 18 nt, Homo sapiens
gaaaaugcaucacaugau

SEQ ID NO: 788814 - RNA, 22 nt, Homo sapiens
gaaaaugcaucacaugaugaaa

SEQ ID NO: 788815 - RNA, 17 nt, Homo sapiens
gaaaaugucacauucua

SEQ ID NO: 788816 - RNA, 14 nt, Homo sapiens
gaaaauguccuccc

SEQ ID NO: 788817 - RNA, 20 nt, Homo sapiens
gaaaauuauuuuguucauac

SEQ ID NO: 788818 - RNA, 13 nt, Homo sapiens
gaaaauugcaaua

SEQ ID NO: 788819 - RNA, 22 nt, Homo sapiens
gaaaauugggcaugccauuaca

SEQ ID NO: 788820 - RNA, 16 nt, Homo sapiens
gaaaauuuuacuucca

SEQ ID NO: 788821 - RNA, 16 nt, Homo sapiens
gaaacaaaaagcccca

SEQ ID NO: 788822 - RNA, 14 nt, Homo sapiens
gaaacaacagggga

SEQ ID NO: 788823 - RNA, 19 nt, Homo sapiens
gaaacaagcaacagaugga

SEQ ID NO: 788824 - RNA, 20 nt, Homo sapiens
gaaacacacaagcaacaaac

SEQ ID NO: 788825 - RNA, 23 nt, Homo sapiens
gaaacacauucuuauugacaauu

SEQ ID NO: 788826 - RNA, 17 nt, Homo sapiens
gaaacagauaacaccaa

SEQ ID NO: 788827 - RNA, 12 nt, Homo sapiens
gaaacagccacu

SEQ ID NO: 788828 - RNA, 17 nt, Homo sapiens
gaaacaguuaauaccau

SEQ ID NO: 788829 - RNA, 12 nt, Homo sapiens
gaaacaguucuc

SEQ ID NO: 788830 - RNA, 19 nt, Homo sapiens
gaaacaguugguaacuuuu

SEQ ID NO: 788831 - RNA, 16 nt, Homo sapiens
gaaacaguuucuugcu

SEQ ID NO: 788832 - RNA, 23 nt, Homo sapiens
gaaacauagccucaccaagguga

SEQ ID NO: 788833 - RNA, 20 nt, Homo sapiens
gaaacauggaggaacaguau

SEQ ID NO: 788834 - RNA, 21 nt, Homo sapiens
gaaacauuauuagcacuuccc

SEQ ID NO: 788835 - RNA, 16 nt, Homo sapiens
gaaacauuccgaagag

SEQ ID NO: 788836 - RNA, 20 nt, Homo sapiens
gaaaccaaggaaagugaaac

SEQ ID NO: 788837 - RNA, 18 nt, Homo sapiens
gaaaccacagucagugga

SEQ ID NO: 788838 - RNA, 23 nt, Homo sapiens
gaaaccagaaggauauuuacuac

SEQ ID NO: 788839 - RNA, 19 nt, Homo sapiens
gaaacccaccucucuggaa

SEQ ID NO: 788840 - RNA, 18 nt, Homo sapiens
gaaacccccaguguaaua

SEQ ID NO: 788841 - RNA, 15 nt, Homo sapiens
gaaacccccaucucu

SEQ ID NO: 788842 - RNA, 17 nt, Homo sapiens
gaaaccuuauuguaccu

SEQ ID NO: 788843 - RNA, 20 nt, Homo sapiens
gaaaccuuauuguaccucuc

SEQ ID NO: 788844 - RNA, 20 nt, Homo sapiens
gaaacuaauauuuuauguga

SEQ ID NO: 788845 - RNA, 19 nt, Homo sapiens
gaaacuaguguacauuucu

SEQ ID NO: 788846 - RNA, 21 nt, Homo sapiens
gaaacuauaaaguuuuauuug

SEQ ID NO: 788847 - RNA, 18 nt, Homo sapiens
gaaacuauaaguaauucu

SEQ ID NO: 788848 - RNA, 15 nt, Homo sapiens
gaaacucacacuccc

SEQ ID NO: 788849 - RNA, 22 nt, Homo sapiens
gaaacucuacauguaacuauuu

SEQ ID NO: 788850 - RNA, 11 nt, Homo sapiens
gaaacugagua

SEQ ID NO: 788851 - RNA, 21 nt, Homo sapiens
gaaacugcucccaucauuccu

SEQ ID NO: 788852 - RNA, 17 nt, Homo sapiens
gaaacuguagucucagg

SEQ ID NO: 788853 - RNA, 17 nt, Homo sapiens
gaagucucccuuggaaa

SEQ ID NO: 788854 - RNA, 11 nt, Homo sapiens
gaagucucuuu

SEQ ID NO: 788855 - RNA, 20 nt, Homo sapiens
gaagucuucuccuccaugaa

SEQ ID NO: 788856 - RNA, 21 nt, Homo sapiens
gaagugaccuggaaucaguga

SEQ ID NO: 788857 - RNA, 16 nt, Homo sapiens
gaagugagggcucacu

SEQ ID NO: 788858 - RNA, 10 nt, Homo sapiens
gaaguggaag

SEQ ID NO: 788859 - RNA, 20 nt, Homo sapiens
gaaguggcugaugggaacca

SEQ ID NO: 788860 - RNA, 15 nt, Homo sapiens
gaaguggggacauca

SEQ ID NO: 788861 - RNA, 15 nt, Homo sapiens
gaagugucacagccu

SEQ ID NO: 788862 - RNA, 16 nt, Homo sapiens
gaagugucugccagcu

SEQ ID NO: 788863 - RNA, 19 nt, Homo sapiens
gaagugugacccugugaca

SEQ ID NO: 788864 - RNA, 17 nt, Homo sapiens
gaagugugggucugugu

SEQ ID NO: 788865 - RNA, 18 nt, Homo sapiens
gaaguuaacagucucauu

SEQ ID NO: 788866 - RNA, 16 nt, Homo sapiens
gaaguuaugcugucau

SEQ ID NO: 788867 - RNA, 14 nt, Homo sapiens
gaaguugugcaacg

SEQ ID NO: 788868 - RNA, 20 nt, Homo sapiens
gaaguuucguaugcacuccc

SEQ ID NO: 788869 - RNA, 12 nt, Homo sapiens
gaaguuugccaa

SEQ ID NO: 788870 - RNA, 13 nt, Homo sapiens
gaaguuuuacuag

SEQ ID NO: 788871 - RNA, 13 nt, Homo sapiens
gaauaaaacacuc

SEQ ID NO: 788872 - RNA, 16 nt, Homo sapiens
gaauaaaauuauggga

SEQ ID NO: 788873 - RNA, 19 nt, Homo sapiens
gaauaaaauuccuaucuca

SEQ ID NO: 788874 - RNA, 20 nt, Homo sapiens
gaauaaaauuccuaucucau

SEQ ID NO: 788875 - RNA, 16 nt, Homo sapiens
gaauaaacaggaaaau

SEQ ID NO: 788876 - RNA, 16 nt, Homo sapiens
gaauaaaguccaaagu

SEQ ID NO: 788877 - RNA, 14 nt, Homo sapiens
gaauaaauuuggga

SEQ ID NO: 788878 - RNA, 15 nt, Homo sapiens
gaauaaccacuuaaa

SEQ ID NO: 788879 - RNA, 14 nt, Homo sapiens
gaauaacuaugcca

SEQ ID NO: 788880 - RNA, 14 nt, Homo sapiens
gaauaacugguaca

SEQ ID NO: 788881 - RNA, 20 nt, Homo sapiens
gaauaacuguguuuccuacc

SEQ ID NO: 788882 - RNA, 14 nt, Homo sapiens
gaauaaucacuugg

SEQ ID NO: 788883 - RNA, 23 nt, Homo sapiens
gaauaauuagauauauauauuca

SEQ ID NO: 788884 - RNA, 23 nt, Homo sapiens
gaauacaggaggcagacaaugac

SEQ ID NO: 788885 - RNA, 12 nt, Homo sapiens
gaauacaguaag

SEQ ID NO: 788886 - RNA, 20 nt, Homo sapiens
gaauacauuaacggugcuaa

SEQ ID NO: 788887 - RNA, 14 nt, Homo sapiens
gaauaccaguguua

SEQ ID NO: 788888 - RNA, 19 nt, Homo sapiens
gaauacccuauaagccaga

SEQ ID NO: 788889 - RNA, 19 nt, Homo sapiens
gaauaccuuggucucaccu

SEQ ID NO: 788890 - RNA, 17 nt, Homo sapiens
gaauacugaauuuugag

SEQ ID NO: 788891 - RNA, 20 nt, Homo sapiens
gaauacugcauuuacagugu

SEQ ID NO: 788892 - RNA, 14 nt, Homo sapiens
gaauacugugcaua

SEQ ID NO: 788893 - RNA, 14 nt, Homo sapiens
gaauacuuaacuca

SEQ ID NO: 788894 - RNA, 15 nt, Homo sapiens
gaauacuugaacucu

SEQ ID NO: 788895 - RNA, 21 nt, Homo sapiens
gaauagaagaagcuacugcau

SEQ ID NO: 788896 - RNA, 20 nt, Homo sapiens
gaauagacuaucuagaacuu

SEQ ID NO: 788897 - RNA, 19 nt, Homo sapiens
gaauagcuuugaauguggc

SEQ ID NO: 788898 - RNA, 14 nt, Homo sapiens
gaauaguacagaca

SEQ ID NO: 788899 - RNA, 12 nt, Homo sapiens
gaauaguccuug

SEQ ID NO: 788900 - RNA, 17 nt, Homo sapiens
gaauauaaaacagucau

SEQ ID NO: 788901 - RNA, 18 nt, Homo sapiens
gaauauaaaacagucaug

SEQ ID NO: 788902 - RNA, 20 nt, Homo sapiens
gaauauaauuucaaaccaca

SEQ ID NO: 788903 - RNA, 14 nt, Homo sapiens
gaauaucagucacu

SEQ ID NO: 788904 - RNA, 15 nt, Homo sapiens
gaauauccuauacug

SEQ ID NO: 788905 - RNA, 19 nt, Homo sapiens
gaauauggugggcacagaa

SEQ ID NO: 788906 - RNA, 16 nt, Homo sapiens
gaauauuccuggacuu

SEQ ID NO: 788907 - RNA, 20 nt, Homo sapiens
gaauauuuuaagaauuucac

SEQ ID NO: 788908 - RNA, 15 nt, Homo sapiens
gaaucaagacaagac

SEQ ID NO: 788909 - RNA, 12 nt, Homo sapiens
gaaucaagcaau

SEQ ID NO: 788910 - RNA, 22 nt, Homo sapiens
gaaucaaucuuuaacaaccucu

SEQ ID NO: 788911 - RNA, 22 nt, Homo sapiens
gaaucacagcccucaugaucau

SEQ ID NO: 788912 - RNA, 13 nt, Homo sapiens
gaaucacauucuu

SEQ ID NO: 788913 - RNA, 18 nt, Homo sapiens
gaaucagacuucacacug

SEQ ID NO: 788914 - RNA, 21 nt, Homo sapiens
gaaucaugagccugcuggaag

SEQ ID NO: 788915 - RNA, 15 nt, Homo sapiens
gaauccaagccucca

SEQ ID NO: 788916 - RNA, 14 nt, Homo sapiens
gaauccaauacugc

SEQ ID NO: 788917 - RNA, 21 nt, Homo sapiens
gaauccagaccaaccuuccau

SEQ ID NO: 788918 - RNA, 21 nt, Homo sapiens
gaauccaggaggcaguggaca

SEQ ID NO: 788919 - RNA, 19 nt, Homo sapiens
gaauccauguaaauugcaa

SEQ ID NO: 788920 - RNA, 16 nt, Homo sapiens
gaaucccaauguuuga

SEQ ID NO: 788921 - RNA, 20 nt, Homo sapiens
gaaucccacccacaugugac

SEQ ID NO: 788922 - RNA, 23 nt, Homo sapiens
gaaucgguuguucuuuccucaca

SEQ ID NO: 788923 - RNA, 14 nt, Homo sapiens
gaaucuacauucac

SEQ ID NO: 788924 - RNA, 21 nt, Homo sapiens
gaaucuauccauugaacuaaa

SEQ ID NO: 788925 - RNA, 21 nt, Homo sapiens
gaaucucaauguacauagacc

SEQ ID NO: 788926 - RNA, 15 nt, Homo sapiens
gaaucucaccugcug

SEQ ID NO: 788927 - RNA, 18 nt, Homo sapiens
gaaucuccccuccucaca

SEQ ID NO: 788928 - RNA, 17 nt, Homo sapiens
gaaucucuauguauauu

SEQ ID NO: 788929 - RNA, 15 nt, Homo sapiens
gaaucucugugccuu

SEQ ID NO: 788930 - RNA, 13 nt, Homo sapiens
gaaucucuuggau

SEQ ID NO: 788931 - RNA, 22 nt, Homo sapiens
gaaucuggcaggaaucuaucca

SEQ ID NO: 788932 - RNA, 17 nt, Homo sapiens
gaaucuuaaugcuugua

SEQ ID NO: 788933 - RNA, 15 nt, Homo sapiens
gaaucuucaccucag

SEQ ID NO: 788934 - RNA, 13 nt, Homo sapiens
gaaugaaacugau

SEQ ID NO: 788935 - RNA, 19 nt, Homo sapiens
gaaugaacaaaccugugau

SEQ ID NO: 788936 - RNA, 23 nt, Homo sapiens
gaaugaagcguugccauugaacu

SEQ ID NO: 788937 - RNA, 16 nt, Homo sapiens
gaaugaauacugggaa

SEQ ID NO: 788938 - RNA, 13 nt, Homo sapiens
gaaugaauuucaa

SEQ ID NO: 788939 - RNA, 16 nt, Homo sapiens
gaaugagaauggacgu

SEQ ID NO: 788940 - RNA, 18 nt, Homo sapiens
gaaugagagguuccuaag

SEQ ID NO: 788941 - RNA, 18 nt, Homo sapiens
gaaugagaguuccuucuc

SEQ ID NO: 788942 - RNA, 22 nt, Homo sapiens
gaaugauuaaucaaaggcauau

SEQ ID NO: 788943 - RNA, 22 nt, Homo sapiens
gaaugauuuagguacgucaaag

SEQ ID NO: 788944 - RNA, 16 nt, Homo sapiens
gaaugcaaccaaguca

SEQ ID NO: 788945 - RNA, 14 nt, Homo sapiens
gaaugcaauaucau

SEQ ID NO: 788946 - RNA, 19 nt, Homo sapiens
gaaugcaccauggucaaaa

SEQ ID NO: 788947 - RNA, 18 nt, Homo sapiens
gaaugcagaggucuccaa

SEQ ID NO: 788948 - RNA, 14 nt, Homo sapiens
gaaugccggggaca

SEQ ID NO: 788949 - RNA, 14 nt, Homo sapiens
gaaugcuguguuaa

SEQ ID NO: 788950 - RNA, 20 nt, Homo sapiens
gaauggagggcaacauucca

SEQ ID NO: 788951 - RNA, 19 nt, Homo sapiens
gaauggauucaacacugug

SEQ ID NO: 788952 - RNA, 14 nt, Homo sapiens
gaaugggagccaga

SEQ ID NO: 788953 - RNA, 20 nt, Homo sapiens
gaaugggcuugaaacauuau

SEQ ID NO: 788954 - RNA, 20 nt, Homo sapiens
gaauggguguuguaugggga

SEQ ID NO: 788955 - RNA, 18 nt, Homo sapiens
gaauggucaagugaugaa

SEQ ID NO: 788956 - RNA, 22 nt, Homo sapiens
gaauggucuggcaauauucugu

SEQ ID NO: 788957 - RNA, 13 nt, Homo sapiens
gaauggucuuucu

SEQ ID NO: 788958 - RNA, 18 nt, Homo sapiens
gaaugguguuguaugccu

SEQ ID NO: 788959 - RNA, 16 nt, Homo sapiens
gaaugguguuuuguca

SEQ ID NO: 788960 - RNA, 18 nt, Homo sapiens
gaaugguuucaacaaaga

SEQ ID NO: 788961 - RNA, 15 nt, Homo sapiens
gaaugucagggccag

SEQ ID NO: 788962 - RNA, 18 nt, Homo sapiens
gaaugucuuacugugauc

SEQ ID NO: 788963 - RNA, 18 nt, Homo sapiens
gaauguggaauaccuaag

SEQ ID NO: 788964 - RNA, 19 nt, Homo sapiens
gaaugugguaguacccagg

SEQ ID NO: 788965 - RNA, 15 nt, Homo sapiens
gaauguguuugaaca

SEQ ID NO: 788966 - RNA, 17 nt, Homo sapiens
gaauguuuacacucuuu

SEQ ID NO: 788967 - RNA, 14 nt, Homo sapiens
gaauguuucacuag

SEQ ID NO: 788968 - RNA, 22 nt, Homo sapiens
gcugcacccugcgccuccagag

SEQ ID NO: 788969 - RNA, 21 nt, Homo sapiens
gcugcacucaagcuuggguga

SEQ ID NO: 788970 - RNA, 21 nt, Homo sapiens
gcugcacucuugaacugggcg

SEQ ID NO: 788971 - RNA, 20 nt, Homo sapiens
gcugcagguguuugaccucc

SEQ ID NO: 788972 - RNA, 22 nt, Homo sapiens
gcugcagguuccuuaucuguca

SEQ ID NO: 788973 - RNA, 19 nt, Homo sapiens
gcugcauaguauuccaugg

SEQ ID NO: 788974 - RNA, 19 nt, Homo sapiens
gcugcauuugccugucaug

SEQ ID NO: 788975 - RNA, 14 nt, Homo sapiens
gcugccacaaccag

SEQ ID NO: 788976 - RNA, 15 nt, Homo sapiens
gcugccagcacagua

SEQ ID NO: 788977 - RNA, 16 nt, Homo sapiens
gcugccagccuucucc

SEQ ID NO: 788978 - RNA, 18 nt, Homo sapiens
gcugccauccaugugcua

SEQ ID NO: 788979 - RNA, 15 nt, Homo sapiens
gcugccauccucacc

SEQ ID NO: 788980 - RNA, 20 nt, Homo sapiens
gcugccaugccacugccagg

SEQ ID NO: 788981 - RNA, 13 nt, Homo sapiens
gcugcccacuguu

SEQ ID NO: 788982 - RNA, 16 nt, Homo sapiens
gcugcccagccacucc

SEQ ID NO: 788983 - RNA, 16 nt, Homo sapiens
gcugccccaccugccg

SEQ ID NO: 788984 - RNA, 18 nt, Homo sapiens
gcugccgugccugugucc

SEQ ID NO: 788985 - RNA, 15 nt, Homo sapiens
gcugccuaccagggg

SEQ ID NO: 788986 - RNA, 23 nt, Homo sapiens
gcugccuucccuagcuuuagacc

SEQ ID NO: 788987 - RNA, 16 nt, Homo sapiens
gcugcgcacugugucc

SEQ ID NO: 788988 - RNA, 15 nt, Homo sapiens
gcugcgggcacccau

SEQ ID NO: 788989 - RNA, 12 nt, Homo sapiens
gcugcuacugcu

SEQ ID NO: 788990 - RNA, 16 nt, Homo sapiens
gcugcuagagccagca

SEQ ID NO: 788991 - RNA, 17 nt, Homo sapiens
gcugcuagagccagcaa

SEQ ID NO: 788992 - RNA, 15 nt, Homo sapiens
gcugcuccacugggu

SEQ ID NO: 788993 - RNA, 14 nt, Homo sapiens
gcugcuccauggau

SEQ ID NO: 788994 - RNA, 15 nt, Homo sapiens
gcugcuccgguuugg

SEQ ID NO: 788995 - RNA, 18 nt, Homo sapiens
gcugcucucuccgagggg

SEQ ID NO: 788996 - RNA, 23 nt, Homo sapiens
gcugcucuuagugcccgccuagg

SEQ ID NO: 788997 - RNA, 17 nt, Homo sapiens
gcugcugcccauucaaa

SEQ ID NO: 788998 - RNA, 22 nt, Homo sapiens
gcugcuuccuguaaugcaggac

SEQ ID NO: 788999 - RNA, 22 nt, Homo sapiens
gcugcuucuuauuaaucauaca

SEQ ID NO: 789000 - RNA, 12 nt, Homo sapiens
gcuggaagggaa

SEQ ID NO: 789001 - RNA, 18 nt, Homo sapiens
gcuggaagucuccaugaa

SEQ ID NO: 789002 - RNA, 18 nt, Homo sapiens
gcuggacuucuaccugcc

SEQ ID NO: 789003 - RNA, 20 nt, Homo sapiens
gcuggaguacaguggcacga

SEQ ID NO: 789004 - RNA, 19 nt, Homo sapiens
gcuggagugaagugguaca

SEQ ID NO: 789005 - RNA, 13 nt, Homo sapiens
gcuggagugcagu

SEQ ID NO: 789006 - RNA, 20 nt, Homo sapiens
gcuggagugcaguagcacga

SEQ ID NO: 789007 - RNA, 20 nt, Homo sapiens
gcuggagugcaguggcgcga

SEQ ID NO: 789008 - RNA, 20 nt, Homo sapiens
gcuggagugcaguggugcaa

SEQ ID NO: 789009 - RNA, 22 nt, Homo sapiens
gcuggagugcaguggugcaauc

SEQ ID NO: 789010 - RNA, 20 nt, Homo sapiens
gcuggagugcagugguguga

SEQ ID NO: 789011 - RNA, 19 nt, Homo sapiens
gcuggaucugguacaaagc

SEQ ID NO: 789012 - RNA, 14 nt, Homo sapiens
gcuggcaccucuca

SEQ ID NO: 789013 - RNA, 15 nt, Homo sapiens
gcuggcaucaagagg

SEQ ID NO: 789014 - RNA, 19 nt, Homo sapiens
gcuggcccgucauguuccu

SEQ ID NO: 789015 - RNA, 14 nt, Homo sapiens
gcuggccgcggugg

SEQ ID NO: 789016 - RNA, 22 nt, Homo sapiens
gcuggccucacccaccccugca

SEQ ID NO: 789017 - RNA, 17 nt, Homo sapiens
gcuggccucucuagcac

SEQ ID NO: 789018 - RNA, 16 nt, Homo sapiens
gcuggcuccccaaagg

SEQ ID NO: 789019 - RNA, 14 nt, Homo sapiens
gcuggcuccucugc

SEQ ID NO: 789020 - RNA, 14 nt, Homo sapiens
gcuggcucugagaa

SEQ ID NO: 789021 - RNA, 16 nt, Homo sapiens
gcuggcugaagaauga

SEQ ID NO: 789022 - RNA, 14 nt, Homo sapiens
gcuggcugcagcgg

SEQ ID NO: 789023 - RNA, 15 nt, Homo sapiens
gcuggcugggccuuc

SEQ ID NO: 789024 - RNA, 13 nt, Homo sapiens
gcuggcuugcagu

SEQ ID NO: 789025 - RNA, 23 nt, Homo sapiens
gcugggaaaaaaguuuugaugaa

SEQ ID NO: 789026 - RNA, 17 nt, Homo sapiens
gcugggagcacuggugu

SEQ ID NO: 789027 - RNA, 20 nt, Homo sapiens
gcugggaggcaagaggggug

SEQ ID NO: 789028 - RNA, 16 nt, Homo sapiens
gcugggccauguccaa

SEQ ID NO: 789029 - RNA, 22 nt, Homo sapiens
gcugggcgugcuagagguugca

SEQ ID NO: 789030 - RNA, 14 nt, Homo sapiens
gcuggggaccucac

SEQ ID NO: 789031 - RNA, 14 nt, Homo sapiens
gcuggggagggaga

SEQ ID NO: 789032 - RNA, 21 nt, Homo sapiens
gcuggggcuucaccagucugu

SEQ ID NO: 789033 - RNA, 15 nt, Homo sapiens
gcugggucacaucca

SEQ ID NO: 789034 - RNA, 20 nt, Homo sapiens
gcugggugaccgacuacccc

SEQ ID NO: 789035 - RNA, 13 nt, Homo sapiens
gcuggguuuacac

SEQ ID NO: 789036 - RNA, 18 nt, Homo sapiens
gcugguaacaguggcugc

SEQ ID NO: 789037 - RNA, 21 nt, Homo sapiens
gcugguccccuccucagugac

SEQ ID NO: 789038 - RNA, 17 nt, Homo sapiens
gcuggucucacccaacu

SEQ ID NO: 789039 - RNA, 19 nt, Homo sapiens
gcuggucucugcugaaggu

SEQ ID NO: 789040 - RNA, 20 nt, Homo sapiens
gcuggugaauaacuaugcca

SEQ ID NO: 789041 - RNA, 13 nt, Homo sapiens
gcuggugaauauu

SEQ ID NO: 789042 - RNA, 19 nt, Homo sapiens
gcuggugggacagugguga

SEQ ID NO: 789043 - RNA, 16 nt, Homo sapiens
gcugguggguggccca

SEQ ID NO: 789044 - RNA, 20 nt, Homo sapiens
gcuguaacguggcacuggua

SEQ ID NO: 789045 - RNA, 20 nt, Homo sapiens
gcuguacccuuccaccuccu

SEQ ID NO: 789046 - RNA, 19 nt, Homo sapiens
gcuguacuuuuaccaguuu

SEQ ID NO: 789047 - RNA, 19 nt, Homo sapiens
gcuguagacauuugcuaug

SEQ ID NO: 789048 - RNA, 17 nt, Homo sapiens
gcuguaguaccccaaga

SEQ ID NO: 789049 - RNA, 17 nt, Homo sapiens
gcuguauccauccaugg

SEQ ID NO: 789050 - RNA, 19 nt, Homo sapiens
gcugucccuugcuugccug

SEQ ID NO: 789051 - RNA, 15 nt, Homo sapiens
gcuguccugcucacc

SEQ ID NO: 789052 - RNA, 14 nt, Homo sapiens
gcuguccugcugcc

SEQ ID NO: 789053 - RNA, 20 nt, Homo sapiens
gcugucuuccuguguaccuc

SEQ ID NO: 789054 - RNA, 14 nt, Homo sapiens
gcugugaauacuua

SEQ ID NO: 789055 - RNA, 20 nt, Homo sapiens
gcugugaucggccuggggaa

SEQ ID NO: 789056 - RNA, 17 nt, Homo sapiens
gcugugccaccaagcau

SEQ ID NO: 789057 - RNA, 19 nt, Homo sapiens
gcuguggaggauugcuauc

SEQ ID NO: 789058 - RNA, 22 nt, Homo sapiens
gcugugggcaagccuaagggau

SEQ ID NO: 789059 - RNA, 15 nt, Homo sapiens
gcugugggcaauugu

SEQ ID NO: 789060 - RNA, 16 nt, Homo sapiens
gcuguggggaccacac

SEQ ID NO: 789061 - RNA, 13 nt, Homo sapiens
gcuguggggcccu

SEQ ID NO: 789062 - RNA, 19 nt, Homo sapiens
gcuguggguuuuggugugg

SEQ ID NO: 789063 - RNA, 17 nt, Homo sapiens
gcuguguaagcucacau

SEQ ID NO: 789064 - RNA, 13 nt, Homo sapiens
gcuguguuugcag

SEQ ID NO: 789065 - RNA, 14 nt, Homo sapiens
gcuguuaacacugc

SEQ ID NO: 789066 - RNA, 23 nt, Homo sapiens
gcuguucauguuacucaugacuc

SEQ ID NO: 789067 - RNA, 14 nt, Homo sapiens
gcuguucugcugaa

SEQ ID NO: 789068 - RNA, 22 nt, Homo sapiens
gcuguugacaucagccugcuuc

SEQ ID NO: 789069 - RNA, 21 nt, Homo sapiens
gcuguuuauuuauucacugua

SEQ ID NO: 789070 - RNA, 15 nt, Homo sapiens
gcuguuuucuucuau

SEQ ID NO: 789071 - RNA, 13 nt, Homo sapiens
gcuuaaaagcaag

SEQ ID NO: 789072 - RNA, 22 nt, Homo sapiens
gcuuaaaauccaaagugucaua

SEQ ID NO: 789073 - RNA, 17 nt, Homo sapiens
gcuuaaaaucugugaag

SEQ ID NO: 789074 - RNA, 16 nt, Homo sapiens
gcuuaaaccaacaaua

SEQ ID NO: 789075 - RNA, 20 nt, Homo sapiens
gcuuaaacccauacaaugua

SEQ ID NO: 789076 - RNA, 16 nt, Homo sapiens
gcuuaaaggcaguauu

SEQ ID NO: 789077 - RNA, 18 nt, Homo sapiens
gcuuaaaguuauguuauu

SEQ ID NO: 789078 - RNA, 16 nt, Homo sapiens
gcuuaaaguugucacu

SEQ ID NO: 789079 - RNA, 14 nt, Homo sapiens
gcuuaaauccaguu

SEQ ID NO: 789080 - RNA, 22 nt, Homo sapiens
gcuuaaauuucuuaugugacau

SEQ ID NO: 789081 - RNA, 21 nt, Homo sapiens
gcuuaaccuuuccaguuuaua

SEQ ID NO: 789082 - RNA, 19 nt, Homo sapiens
ggagugaauuaaagccuuu

SEQ ID NO: 789083 - RNA, 15 nt, Homo sapiens
ggagugaggaccugu

SEQ ID NO: 789084 - RNA, 14 nt, Homo sapiens
ggagugauucccaa

SEQ ID NO: 789085 - RNA, 15 nt, Homo sapiens
ggagugcagugccac

SEQ ID NO: 789086 - RNA, 12 nt, Homo sapiens
ggagugcagugg

SEQ ID NO: 789087 - RNA, 14 nt, Homo sapiens
ggaguggcugccau

SEQ ID NO: 789088 - RNA, 20 nt, Homo sapiens
ggaguguccucuucccucuc

SEQ ID NO: 789089 - RNA, 12 nt, Homo sapiens
ggagugugggcu

SEQ ID NO: 789090 - RNA, 15 nt, Homo sapiens
ggaguuagaggccag

SEQ ID NO: 789091 - RNA, 14 nt, Homo sapiens
ggaguugaaacugc

SEQ ID NO: 789092 - RNA, 21 nt, Homo sapiens
ggauaaguuucuauucuguca

SEQ ID NO: 789093 - RNA, 20 nt, Homo sapiens
ggauaaugcuguugccucau

SEQ ID NO: 789094 - RNA, 16 nt, Homo sapiens
ggauaauuccuuggug

SEQ ID NO: 789095 - RNA, 17 nt, Homo sapiens
ggauacuggugcaguca

SEQ ID NO: 789096 - RNA, 12 nt, Homo sapiens
ggauaugcugcu

SEQ ID NO: 789097 - RNA, 22 nt, Homo sapiens
ggauauuaguuaaugagccauc

SEQ ID NO: 789098 - RNA, 17 nt, Homo sapiens
ggauauugucagucuuu

SEQ ID NO: 789099 - RNA, 13 nt, Homo sapiens
ggauauuugcacu

SEQ ID NO: 789100 - RNA, 16 nt, Homo sapiens
ggaucacaagauggaa

SEQ ID NO: 789101 - RNA, 13 nt, Homo sapiens
ggaucacugccaa

SEQ ID NO: 789102 - RNA, 21 nt, Homo sapiens
ggaucagaugacucucuccaa

SEQ ID NO: 789103 - RNA, 11 nt, Homo sapiens
ggauccaguga

SEQ ID NO: 789104 - RNA, 17 nt, Homo sapiens
ggaucccuccugagcuc

SEQ ID NO: 789105 - RNA, 14 nt, Homo sapiens
ggauccuuugcugc

SEQ ID NO: 789106 - RNA, 14 nt, Homo sapiens
ggaucuacacccac

SEQ ID NO: 789107 - RNA, 13 nt, Homo sapiens
ggaucuucccaca

SEQ ID NO: 789108 - RNA, 23 nt, Homo sapiens
ggaucuucccacaggagggccag

SEQ ID NO: 789109 - RNA, 22 nt, Homo sapiens
ggaugaagaacacagcaugugc

SEQ ID NO: 789110 - RNA, 20 nt, Homo sapiens
ggaugaagauucuccugugc

SEQ ID NO: 789111 - RNA, 11 nt, Homo sapiens
ggaugaagcuc

SEQ ID NO: 789112 - RNA, 21 nt, Homo sapiens
ggaugaaggcaaaaacuguac

SEQ ID NO: 789113 - RNA, 12 nt, Homo sapiens
ggaugaauggaa

SEQ ID NO: 789114 - RNA, 19 nt, Homo sapiens
ggaugaucuugauuguggg

SEQ ID NO: 789115 - RNA, 13 nt, Homo sapiens
ggaugaugcaguu

SEQ ID NO: 789116 - RNA, 12 nt, Homo sapiens
ggaugaugccuc

SEQ ID NO: 789117 - RNA, 15 nt, Homo sapiens
ggaugaugcugucau

SEQ ID NO: 789118 - RNA, 23 nt, Homo sapiens
ggaugauuaagagauugccauuu

SEQ ID NO: 789119 - RNA, 17 nt, Homo sapiens
ggaugcagcuucaagaa

SEQ ID NO: 789120 - RNA, 23 nt, Homo sapiens
ggaugccgagguaaaaguucuuu

SEQ ID NO: 789121 - RNA, 15 nt, Homo sapiens
ggaugcgacccaaga

SEQ ID NO: 789122 - RNA, 19 nt, Homo sapiens
ggaugcuccgacagcgucu

SEQ ID NO: 789123 - RNA, 19 nt, Homo sapiens
ggaugcuguugagggccaa

SEQ ID NO: 789124 - RNA, 22 nt, Homo sapiens
ggauggagagcagccagcaccc

SEQ ID NO: 789125 - RNA, 17 nt, Homo sapiens
ggauggcacccuggaac

SEQ ID NO: 789126 - RNA, 14 nt, Homo sapiens
ggauggcaccucag

SEQ ID NO: 789127 - RNA, 20 nt, Homo sapiens
ggaugggcccuaugucucag

SEQ ID NO: 789128 - RNA, 15 nt, Homo sapiens
ggauggguccucacg

SEQ ID NO: 789129 - RNA, 15 nt, Homo sapiens
ggaugguucugugac

SEQ ID NO: 789130 - RNA, 22 nt, Homo sapiens
ggaugguuuuaucuucccuuua

SEQ ID NO: 789131 - RNA, 18 nt, Homo sapiens
ggauguaagccuggagcu

SEQ ID NO: 789132 - RNA, 19 nt, Homo sapiens
ggauguccacagaugccuc

SEQ ID NO: 789133 - RNA, 15 nt, Homo sapiens
ggaugucucucauga

SEQ ID NO: 789134 - RNA, 11 nt, Homo sapiens
ggaugugauga

SEQ ID NO: 789135 - RNA, 22 nt, Homo sapiens
ggauguuuggaaaaaacucuga

SEQ ID NO: 789136 - RNA, 13 nt, Homo sapiens
ggauuacaggcau

SEQ ID NO: 789137 - RNA, 23 nt, Homo sapiens
ggauuacaggugugggccacugc

SEQ ID NO: 789138 - RNA, 18 nt, Homo sapiens
ggauuacuauugcaaaag

SEQ ID NO: 789139 - RNA, 17 nt, Homo sapiens
ggauucaucagcauuug

SEQ ID NO: 789140 - RNA, 16 nt, Homo sapiens
ggauugaaauaaauga

SEQ ID NO: 789141 - RNA, 15 nt, Homo sapiens
ggauugacucugcau

SEQ ID NO: 789142 - RNA, 19 nt, Homo sapiens
ggauugacuuugcugucaa

SEQ ID NO: 789143 - RNA, 18 nt, Homo sapiens
ggauuggccaaacaucag

SEQ ID NO: 789144 - RNA, 19 nt, Homo sapiens
ggauuggcuauaacauguc

SEQ ID NO: 789145 - RNA, 15 nt, Homo sapiens
ggauuggcuuugugc

SEQ ID NO: 789146 - RNA, 18 nt, Homo sapiens
ggauuucauuuguaacuu

SEQ ID NO: 789147 - RNA, 16 nt, Homo sapiens
ggauuucugggacccc

SEQ ID NO: 789148 - RNA, 23 nt, Homo sapiens
ggauuugggcuacccuaaaggga

SEQ ID NO: 789149 - RNA, 13 nt, Homo sapiens
ggauuuguugcca

SEQ ID NO: 789150 - RNA, 17 nt, Homo sapiens
ggcaaaaacaaaacucu

SEQ ID NO: 789151 - RNA, 15 nt, Homo sapiens
ggcaaaugacaugca

SEQ ID NO: 789152 - RNA, 21 nt, Homo sapiens
ggcaacaacagcaaaacucca

SEQ ID NO: 789153 - RNA, 14 nt, Homo sapiens
ggcaacaaugagca

SEQ ID NO: 789154 - RNA, 20 nt, Homo sapiens
ggcaacagagcaagacucca

SEQ ID NO: 789155 - RNA, 20 nt, Homo sapiens
ggcaacagagcgagauucca

SEQ ID NO: 789156 - RNA, 23 nt, Homo sapiens
ggcaacagagcgagauuccaucu

SEQ ID NO: 789157 - RNA, 19 nt, Homo sapiens
ggcaacguagccugggcuc

SEQ ID NO: 789158 - RNA, 18 nt, Homo sapiens
ggcaacgugcgugucucu

SEQ ID NO: 789159 - RNA, 21 nt, Homo sapiens
ggcaacgugcgugucucugcc

SEQ ID NO: 789160 - RNA, 21 nt, Homo sapiens
ggcaacuggaaaauacauguc

SEQ ID NO: 789161 - RNA, 15 nt, Homo sapiens
ggcaagccuggccau

SEQ ID NO: 789162 - RNA, 14 nt, Homo sapiens
ggcaaggaugucug

SEQ ID NO: 789163 - RNA, 17 nt, Homo sapiens
ggcaagguuaagccuuu

SEQ ID NO: 789164 - RNA, 21 nt, Homo sapiens
ggcaagguuuacacugcggaa

SEQ ID NO: 789165 - RNA, 13 nt, Homo sapiens
ggcaagugauauc

SEQ ID NO: 789166 - RNA, 17 nt, Homo sapiens
ggcaagugcaucuuugc

SEQ ID NO: 789167 - RNA, 19 nt, Homo sapiens
ggcaagugugggggguccu

SEQ ID NO: 789168 - RNA, 16 nt, Homo sapiens
ggcaaguugcaucaga

SEQ ID NO: 789169 - RNA, 23 nt, Homo sapiens
ggcaauaaauauuagaagccugc

SEQ ID NO: 789170 - RNA, 20 nt, Homo sapiens
ggcaaucaugagcaagugaa

SEQ ID NO: 789171 - RNA, 22 nt, Homo sapiens
ggcaaugcccugugcaugccau

SEQ ID NO: 789172 - RNA, 12 nt, Homo sapiens
ggcacacagcua

SEQ ID NO: 789173 - RNA, 12 nt, Homo sapiens
ggcacagccuuu

SEQ ID NO: 789174 - RNA, 19 nt, Homo sapiens
ggcacagccuuugcccaaa

SEQ ID NO: 789175 - RNA, 22 nt, Homo sapiens
ggcacauacaccucgucaagag

SEQ ID NO: 789176 - RNA, 12 nt, Homo sapiens
ggcacaucugcu

SEQ ID NO: 789177 - RNA, 23 nt, Homo sapiens
ggcaccacucuccuuucacagag

SEQ ID NO: 789178 - RNA, 23 nt, Homo sapiens
ggcacccacaaauaaaugacaag

SEQ ID NO: 789179 - RNA, 15 nt, Homo sapiens
ggcacugacugagca

SEQ ID NO: 789180 - RNA, 22 nt, Homo sapiens
ggcacugacugauagcuuacac

SEQ ID NO: 789181 - RNA, 14 nt, Homo sapiens
ggcacugagcccuu

SEQ ID NO: 789182 - RNA, 20 nt, Homo sapiens
ggcacugcccuuuucaggaa

SEQ ID NO: 789183 - RNA, 15 nt, Homo sapiens
ggcacuggggcacuu

SEQ ID NO: 789184 - RNA, 21 nt, Homo sapiens
ggcacuguaguucuaagacuc

SEQ ID NO: 789185 - RNA, 21 nt, Homo sapiens
ggcagagccuuccacagugaa

SEQ ID NO: 789186 - RNA, 20 nt, Homo sapiens
ggcagagguugcaguguggu

SEQ ID NO: 789187 - RNA, 14 nt, Homo sapiens
ggcagauugaaaag

SEQ ID NO: 789188 - RNA, 20 nt, Homo sapiens
ggcagauuuucaugcaaaag

SEQ ID NO: 789189 - RNA, 23 nt, Homo sapiens
ggcagcagagcauucagacucca

SEQ ID NO: 789190 - RNA, 17 nt, Homo sapiens
ggcagcagccagggacc

SEQ ID NO: 789191 - RNA, 14 nt, Homo sapiens
ggcagccaucaaag

SEQ ID NO: 789192 - RNA, 13 nt, Homo sapiens
ggcagccuuuacg

SEQ ID NO: 789193 - RNA, 22 nt, Homo sapiens
ggcagcugccucugcucccucu

SEQ ID NO: 789194 - RNA, 20 nt, Homo sapiens
ggcaggaccgccauggugcu

SEQ ID NO: 789195 - RNA, 20 nt, Homo sapiens
ggcaggagaauugcuugaac

SEQ ID NO: 789196 - RNA, 23 nt, Homo sapiens
ggcaggaggcuuuggguggcuca

SEQ ID NO: 789197 - RNA, 19 nt, Homo sapiens
uuuuaauuacugcuauaaa

SEQ ID NO: 789198 - RNA, 15 nt, Homo sapiens
uuuuaauuugaugaa

SEQ ID NO: 789199 - RNA, 23 nt, Homo sapiens
uuuuacaauaaaacuuugcugcc

SEQ ID NO: 789200 - RNA, 13 nt, Homo sapiens
uuuuacacaggaa

SEQ ID NO: 789201 - RNA, 14 nt, Homo sapiens
uuuuacacauuaga

SEQ ID NO: 789202 - RNA, 15 nt, Homo sapiens
uuuuacacuugcauc

SEQ ID NO: 789203 - RNA, 17 nt, Homo sapiens
uuuuacauauauuccca

SEQ ID NO: 789204 - RNA, 21 nt, Homo sapiens
uuuuaccaaagcaucaauaca

SEQ ID NO: 789205 - RNA, 20 nt, Homo sapiens
uuuuacccuauacauccaca

SEQ ID NO: 789206 - RNA, 20 nt, Homo sapiens
uuuuacccugaggucacugc

SEQ ID NO: 789207 - RNA, 21 nt, Homo sapiens
uuuuaccuuucagaagguguu

SEQ ID NO: 789208 - RNA, 20 nt, Homo sapiens
uuuuacugugaaacuggcac

SEQ ID NO: 789209 - RNA, 12 nt, Homo sapiens
uuuuacuuucag

SEQ ID NO: 789210 - RNA, 15 nt, Homo sapiens
uuuuagaaaugagau

SEQ ID NO: 789211 - RNA, 13 nt, Homo sapiens
uuuuagaacaguc

SEQ ID NO: 789212 - RNA, 15 nt, Homo sapiens
uuuuagccacucaaa

SEQ ID NO: 789213 - RNA, 15 nt, Homo sapiens
uuuuaggacaucuua

SEQ ID NO: 789214 - RNA, 19 nt, Homo sapiens
uuuuauaaaaaugagugcu

SEQ ID NO: 789215 - RNA, 22 nt, Homo sapiens
uuuuauaaauucagaaagucau

SEQ ID NO: 789216 - RNA, 20 nt, Homo sapiens
uuuuauaagacuacuauaca

SEQ ID NO: 789217 - RNA, 14 nt, Homo sapiens
uuuuauacuuucag

SEQ ID NO: 789218 - RNA, 13 nt, Homo sapiens
uuuuauauguugc

SEQ ID NO: 789219 - RNA, 16 nt, Homo sapiens
uuuuaugaacauugua

SEQ ID NO: 789220 - RNA, 21 nt, Homo sapiens
uuuuaugccuucacuuuacaa

SEQ ID NO: 789221 - RNA, 18 nt, Homo sapiens
uuuuauuaauuuauaugu

SEQ ID NO: 789222 - RNA, 12 nt, Homo sapiens
uuuuauuugacu

SEQ ID NO: 789223 - RNA, 13 nt, Homo sapiens
uuuucaaaacaca

SEQ ID NO: 789224 - RNA, 18 nt, Homo sapiens
uuuucaaagauguguugc

SEQ ID NO: 789225 - RNA, 17 nt, Homo sapiens
uuuucaacaaguaacuu

SEQ ID NO: 789226 - RNA, 18 nt, Homo sapiens
uuuucaagaugguguuau

SEQ ID NO: 789227 - RNA, 21 nt, Homo sapiens
uuuucaagcuucacauuugcg

SEQ ID NO: 789228 - RNA, 22 nt, Homo sapiens
uuuucaagguuuuaaaacaguc

SEQ ID NO: 789229 - RNA, 13 nt, Homo sapiens
uuuucaccugaga

SEQ ID NO: 789230 - RNA, 17 nt, Homo sapiens
uuuucacuuuauugcua

SEQ ID NO: 789231 - RNA, 13 nt, Homo sapiens
uuuucacuuugaa

SEQ ID NO: 789232 - RNA, 22 nt, Homo sapiens
uuuucagaaaauauuauguguu

SEQ ID NO: 789233 - RNA, 15 nt, Homo sapiens
uuuucagacuuuaaa

SEQ ID NO: 789234 - RNA, 17 nt, Homo sapiens
uuuucagaguugcuuua

SEQ ID NO: 789235 - RNA, 17 nt, Homo sapiens
uuuucagccauaccucu

SEQ ID NO: 789236 - RNA, 17 nt, Homo sapiens
uuuucaggaauacauuu

SEQ ID NO: 789237 - RNA, 12 nt, Homo sapiens
uuuucaguauga

SEQ ID NO: 789238 - RNA, 16 nt, Homo sapiens
uuuucauaauaccuca

SEQ ID NO: 789239 - RNA, 14 nt, Homo sapiens
uuuucaucugaaaa

SEQ ID NO: 789240 - RNA, 19 nt, Homo sapiens
uuuucaucugaaaagcagu

SEQ ID NO: 789241 - RNA, 11 nt, Homo sapiens
uuuucauucau

SEQ ID NO: 789242 - RNA, 23 nt, Homo sapiens
uuuucauugcccgaaaccagagc

SEQ ID NO: 789243 - RNA, 16 nt, Homo sapiens
uuuucauuuagugcua

SEQ ID NO: 789244 - RNA, 11 nt, Homo sapiens
uuuucccaaag

SEQ ID NO: 789245 - RNA, 16 nt, Homo sapiens
uuuucccagucuguga

SEQ ID NO: 789246 - RNA, 14 nt, Homo sapiens
uuuucccauuucaa

SEQ ID NO: 789247 - RNA, 14 nt, Homo sapiens
uuuuccccauuaua

SEQ ID NO: 789248 - RNA, 16 nt, Homo sapiens
uuuuccugauggcugg

SEQ ID NO: 789249 - RNA, 18 nt, Homo sapiens
uuuuccuggcucaucucu

SEQ ID NO: 789250 - RNA, 18 nt, Homo sapiens
uuuucuaagaaaagcauu

SEQ ID NO: 789251 - RNA, 13 nt, Homo sapiens
uuuucuaccuccu

SEQ ID NO: 789252 - RNA, 20 nt, Homo sapiens
uuuucuauagaaaaaguaaa

SEQ ID NO: 789253 - RNA, 16 nt, Homo sapiens
uuuucuauauggggau

SEQ ID NO: 789254 - RNA, 14 nt, Homo sapiens
uuuucuaucaaaua

SEQ ID NO: 789255 - RNA, 12 nt, Homo sapiens
uuuucucaggac

SEQ ID NO: 789256 - RNA, 15 nt, Homo sapiens
uaaaacuaagcacaa

SEQ ID NO: 789257 - RNA, 21 nt, Homo sapiens
uaaaacugauuuuuagcuuua

SEQ ID NO: 789258 - RNA, 21 nt, Homo sapiens
uaaaacugcgaggacaucaaa

SEQ ID NO: 789259 - RNA, 19 nt, Homo sapiens
uaaaacuggcaucugacac

SEQ ID NO: 789260 - RNA, 19 nt, Homo sapiens
uaaaacuguuauuuuuaca

SEQ ID NO: 789261 - RNA, 16 nt, Homo sapiens
uaaaacuuaugcuagu

SEQ ID NO: 789262 - RNA, 16 nt, Homo sapiens
uaaaacuucaguuuca

SEQ ID NO: 789263 - RNA, 18 nt, Homo sapiens
uaaaacuuuggguacuua

SEQ ID NO: 789264 - RNA, 19 nt, Homo sapiens
uaaaagaaggaacauugca

SEQ ID NO: 789265 - RNA, 21 nt, Homo sapiens
uaaaagaauaaaauugcacuu

SEQ ID NO: 789266 - RNA, 14 nt, Homo sapiens
uaaaagagaagcca

SEQ ID NO: 789267 - RNA, 14 nt, Homo sapiens
uaaaagaugcagag

SEQ ID NO: 789268 - RNA, 21 nt, Homo sapiens
uaaaagauguuuaugauguaa

SEQ ID NO: 789269 - RNA, 14 nt, Homo sapiens
uaaaagcacacucc

SEQ ID NO: 789270 - RNA, 13 nt, Homo sapiens
uaaaagcaguuga

SEQ ID NO: 789271 - RNA, 17 nt, Homo sapiens
uaaaagccuuauucuaa

SEQ ID NO: 789272 - RNA, 24 nt, Homo sapiens
uaaaagcggaaaguuagugcuugu

SEQ ID NO: 789273 - RNA, 20 nt, Homo sapiens
uaaaagcugaccccaaagac

SEQ ID NO: 789274 - RNA, 18 nt, Homo sapiens
uaaaaggaaauguaaaag

SEQ ID NO: 789275 - RNA, 20 nt, Homo sapiens
uaaaagguaugguggggaua

SEQ ID NO: 789276 - RNA, 14 nt, Homo sapiens
uaaaaguaaauuca

SEQ ID NO: 789277 - RNA, 19 nt, Homo sapiens
uaaaaguaaauucauguaa

SEQ ID NO: 789278 - RNA, 21 nt, Homo sapiens
uaaaagucacgugaaacagag

SEQ ID NO: 789279 - RNA, 22 nt, Homo sapiens
uaaaagucacgugaaacagagu

SEQ ID NO: 789280 - RNA, 19 nt, Homo sapiens
uaaaagugaucuacaugag

SEQ ID NO: 789281 - RNA, 14 nt, Homo sapiens
uaaaagugcuuugc

SEQ ID NO: 789282 - RNA, 13 nt, Homo sapiens
uaaaauaaacuag

SEQ ID NO: 789283 - RNA, 14 nt, Homo sapiens
uaaaauaaaugcaa

SEQ ID NO: 789284 - RNA, 17 nt, Homo sapiens
uaaaauaaaugcaauug

SEQ ID NO: 789285 - RNA, 22 nt, Homo sapiens
uaaaauaacaguaugugggaua

SEQ ID NO: 789286 - RNA, 16 nt, Homo sapiens
uaaaauaaugaacacu

SEQ ID NO: 789287 - RNA, 19 nt, Homo sapiens
uaaaauaauuuucauucau

SEQ ID NO: 789288 - RNA, 15 nt, Homo sapiens
uaaaauaccacugua

SEQ ID NO: 789289 - RNA, 17 nt, Homo sapiens
uaaaauacuauucucau

SEQ ID NO: 789290 - RNA, 18 nt, Homo sapiens
uaaaauacuauucucauu

SEQ ID NO: 789291 - RNA, 16 nt, Homo sapiens
uaaaauacuauugccu

SEQ ID NO: 789292 - RNA, 21 nt, Homo sapiens
uaaaauacuuuuacucugccu

SEQ ID NO: 789293 - RNA, 24 nt, Homo sapiens
uaaaauacuuuuacucugccuaca

SEQ ID NO: 789294 - RNA, 23 nt, Homo sapiens
uaaaauaggacauacuccccaau

SEQ ID NO: 789295 - RNA, 16 nt, Homo sapiens
uaaaauauccugugua

SEQ ID NO: 789296 - RNA, 15 nt, Homo sapiens
uaaaauauucacucu

SEQ ID NO: 789297 - RNA, 18 nt, Homo sapiens
uaaaauauuuaucugauu

SEQ ID NO: 789298 - RNA, 19 nt, Homo sapiens
uaaaauauuuaugagaaag

SEQ ID NO: 789299 - RNA, 21 nt, Homo sapiens
uaaaauauuuuagauaauucu

SEQ ID NO: 789300 - RNA, 13 nt, Homo sapiens
uaaaaucacucaa

SEQ ID NO: 789301 - RNA, 24 nt, Homo sapiens
uaaaauccaauauuguaauccuag

SEQ ID NO: 789302 - RNA, 13 nt, Homo sapiens
uaaaaucugugaa

SEQ ID NO: 789303 - RNA, 16 nt, Homo sapiens
uaaaaucuguuaccau

SEQ ID NO: 789304 - RNA, 15 nt, Homo sapiens
uaaaaugacagaucc

SEQ ID NO: 789305 - RNA, 21 nt, Homo sapiens
uaaaaugugauguucuaaggc

SEQ ID NO: 789306 - RNA, 18 nt, Homo sapiens
uaaaauguguacagugaa

SEQ ID NO: 789307 - RNA, 20 nt, Homo sapiens
uaaaauuaucaauaucuaau

SEQ ID NO: 789308 - RNA, 18 nt, Homo sapiens
uaaaauuauuacuaauga

SEQ ID NO: 789309 - RNA, 19 nt, Homo sapiens
uaaaauucagaugcuguua

SEQ ID NO: 789310 - RNA, 16 nt, Homo sapiens
uaaaauuccuaucuca

SEQ ID NO: 789311 - RNA, 17 nt, Homo sapiens
uaaaauuccuaucucau

SEQ ID NO: 789312 - RNA, 19 nt, Homo sapiens
uaacuagacuaagaagauu

SEQ ID NO: 789313 - RNA, 17 nt, Homo sapiens
uaacuagauacagaaua

SEQ ID NO: 789314 - RNA, 18 nt, Homo sapiens
uaacuauauuugcuuuuu

SEQ ID NO: 789315 - RNA, 16 nt, Homo sapiens
uaacuauuuuuccuca

SEQ ID NO: 789316 - RNA, 18 nt, Homo sapiens
uaacucaccagauuuacu

SEQ ID NO: 789317 - RNA, 23 nt, Homo sapiens
uaacucaccagccccacugccag

SEQ ID NO: 789318 - RNA, 18 nt, Homo sapiens
uaacucaccucucaaggu

SEQ ID NO: 789319 - RNA, 15 nt, Homo sapiens
uaacucacugagggu

SEQ ID NO: 789320 - RNA, 21 nt, Homo sapiens
uaacucacugccuaggaggcu

SEQ ID NO: 789321 - RNA, 22 nt, Homo sapiens
uaacucagucuuuaaucugaga

SEQ ID NO: 789322 - RNA, 21 nt, Homo sapiens
uaacucgaauucucacaagga

SEQ ID NO: 789323 - RNA, 18 nt, Homo sapiens
uaacucguguuuggagcu

SEQ ID NO: 789324 - RNA, 15 nt, Homo sapiens
uaacucuggugcucu

SEQ ID NO: 789325 - RNA, 11 nt, Homo sapiens
uaacugagauu

SEQ ID NO: 789326 - RNA, 14 nt, Homo sapiens
uaacugaguuauau

SEQ ID NO: 789327 - RNA, 12 nt, Homo sapiens
uaacugcaauuu

SEQ ID NO: 789328 - RNA, 14 nt, Homo sapiens
uaacugcacaaaca

SEQ ID NO: 789329 - RNA, 14 nt, Homo sapiens
uaacugcauugaga

SEQ ID NO: 789330 - RNA, 17 nt, Homo sapiens
uaacugccuuguguaca

SEQ ID NO: 789331 - RNA, 17 nt, Homo sapiens
uaacuggaaaacagaac

SEQ ID NO: 789332 - RNA, 13 nt, Homo sapiens
uaacuguguuuua

SEQ ID NO: 789333 - RNA, 13 nt, Homo sapiens
uaacuguuucccu

SEQ ID NO: 789334 - RNA, 12 nt, Homo sapiens
uaacuuacauuc

SEQ ID NO: 789335 - RNA, 19 nt, Homo sapiens
uaacuuaguaagugcuuuu

SEQ ID NO: 789336 - RNA, 14 nt, Homo sapiens
uaacuuauauugaa

SEQ ID NO: 789337 - RNA, 20 nt, Homo sapiens
uaacuucaaggcccauaucu

SEQ ID NO: 789338 - RNA, 18 nt, Homo sapiens
uaacuucucugugaacua

SEQ ID NO: 789339 - RNA, 16 nt, Homo sapiens
uaacuugauauagaaa

SEQ ID NO: 789340 - RNA, 21 nt, Homo sapiens
uaacuuggagccccagugcca

SEQ ID NO: 789341 - RNA, 18 nt, Homo sapiens
uaacuuggccauguucuc

SEQ ID NO: 789342 - RNA, 21 nt, Homo sapiens
uaacuuggccauguucuccau

SEQ ID NO: 789343 - RNA, 16 nt, Homo sapiens
uaacuuggcugcauuu

SEQ ID NO: 789344 - RNA, 16 nt, Homo sapiens
uaacuuguauauucca

SEQ ID NO: 789345 - RNA, 17 nt, Homo sapiens
uaacuuuccacucuucc

SEQ ID NO: 789346 - RNA, 17 nt, Homo sapiens
uaacuuuucaccaauga

SEQ ID NO: 789347 - RNA, 17 nt, Homo sapiens
uaacuuuuguaagacaa

SEQ ID NO: 789348 - RNA, 13 nt, Homo sapiens
uaagaaacauaac

SEQ ID NO: 789349 - RNA, 16 nt, Homo sapiens
uaagaaagaucaaaga

SEQ ID NO: 789350 - RNA, 23 nt, Homo sapiens
uaagaaauuccauacuucucuca

SEQ ID NO: 789351 - RNA, 22 nt, Homo sapiens
uaagaacagaucaggaauucua

SEQ ID NO: 789352 - RNA, 13 nt, Homo sapiens
uaagaacugugca

SEQ ID NO: 789353 - RNA, 22 nt, Homo sapiens
uaagaagaaauacccacuaaca

SEQ ID NO: 789354 - RNA, 12 nt, Homo sapiens
uaagaagacauu

SEQ ID NO: 789355 - RNA, 23 nt, Homo sapiens
uaagaagcaauaacuauuuuucc

SEQ ID NO: 789356 - RNA, 21 nt, Homo sapiens
uaagaagccuuaccacgcagu

SEQ ID NO: 789357 - RNA, 12 nt, Homo sapiens
uaagaagcucug

SEQ ID NO: 789358 - RNA, 15 nt, Homo sapiens
uaagaagcucuggcc

SEQ ID NO: 789359 - RNA, 13 nt, Homo sapiens
uaagaauaccaca

SEQ ID NO: 789360 - RNA, 17 nt, Homo sapiens
uaagaaugcagauuccu

SEQ ID NO: 789361 - RNA, 13 nt, Homo sapiens
uaagaauuucaca

SEQ ID NO: 789362 - RNA, 17 nt, Homo sapiens
uaagaauuucacaagcu

SEQ ID NO: 789363 - RNA, 20 nt, Homo sapiens
uaagaauuucacaagcuauu

SEQ ID NO: 789364 - RNA, 19 nt, Homo sapiens
uaagacaauggacccuuuu

SEQ ID NO: 789365 - RNA, 17 nt, Homo sapiens
uaagacagagucucacu

SEQ ID NO: 789366 - RNA, 21 nt, Homo sapiens
uaagacauacuccuuccauca

SEQ ID NO: 789367 - RNA, 16 nt, Homo sapiens
uaagacccagcauuuu

SEQ ID NO: 789368 - RNA, 15 nt, Homo sapiens
uaagaggaguaggcc

SEQ ID NO: 789369 - RNA, 21 nt, Homo sapiens
uaagaggauagaauacaugga

SEQ ID NO: 789370 - RNA, 20 nt, Homo sapiens
uaagagggcauauacaguga

SEQ ID NO: 789371 - RNA, 17 nt, Homo sapiens
gagcaagaugauguaau

SEQ ID NO: 789372 - RNA, 22 nt, Homo sapiens
gagcaauggaguggcugccaug

SEQ ID NO: 789373 - RNA, 11 nt, Homo sapiens
gagcacacugu

SEQ ID NO: 789374 - RNA, 18 nt, Homo sapiens
gagcacacuuaugggcca

SEQ ID NO: 789375 - RNA, 19 nt, Homo sapiens
gagcacauacuaccuagaa

SEQ ID NO: 789376 - RNA, 18 nt, Homo sapiens
gagcacucauuccuuccc

SEQ ID NO: 789377 - RNA, 15 nt, Homo sapiens
gagcacuggccagag

SEQ ID NO: 789378 - RNA, 11 nt, Homo sapiens
gagcacuguga

SEQ ID NO: 789379 - RNA, 23 nt, Homo sapiens
gagcagacaccagcagcccuguc

SEQ ID NO: 789380 - RNA, 18 nt, Homo sapiens
gagcagagcgggacucug

SEQ ID NO: 789381 - RNA, 17 nt, Homo sapiens
gagcagaggucucccaa

SEQ ID NO: 789382 - RNA, 14 nt, Homo sapiens
gagcagcagcacca

SEQ ID NO: 789383 - RNA, 23 nt, Homo sapiens
gagcagccagcaaguaagcuagc

SEQ ID NO: 789384 - RNA, 14 nt, Homo sapiens
gagcagccucugcc

SEQ ID NO: 789385 - RNA, 13 nt, Homo sapiens
gagcagcugagau

SEQ ID NO: 789386 - RNA, 19 nt, Homo sapiens
gagcagcuuuggaaacagg

SEQ ID NO: 789387 - RNA, 19 nt, Homo sapiens
gagcaggaagccgauguga

SEQ ID NO: 789388 - RNA, 22 nt, Homo sapiens
gagcaggaagccgaugugacug

SEQ ID NO: 789389 - RNA, 18 nt, Homo sapiens
gagcaggaccuacuagga

SEQ ID NO: 789390 - RNA, 14 nt, Homo sapiens
gagcaggcuacugu

SEQ ID NO: 789391 - RNA, 18 nt, Homo sapiens
gagcagggagaagccaga

SEQ ID NO: 789392 - RNA, 18 nt, Homo sapiens
gagcagggauuaaccucu

SEQ ID NO: 789393 - RNA, 19 nt, Homo sapiens
gagcaguggcugguccagg

SEQ ID NO: 789394 - RNA, 14 nt, Homo sapiens
gagcagugucuucc

SEQ ID NO: 789395 - RNA, 17 nt, Homo sapiens
gagcauaaugcucccau

SEQ ID NO: 789396 - RNA, 16 nt, Homo sapiens
gagcauaguccaaaaa

SEQ ID NO: 789397 - RNA, 17 nt, Homo sapiens
gagcauaguccaaaaag

SEQ ID NO: 789398 - RNA, 23 nt, Homo sapiens
gagcaucaggcuaagacccugug

SEQ ID NO: 789399 - RNA, 12 nt, Homo sapiens
gagcaugaccug

SEQ ID NO: 789400 - RNA, 19 nt, Homo sapiens
gagcauguuugccuagaca

SEQ ID NO: 789401 - RNA, 21 nt, Homo sapiens
gagcauucagacuccaaacag

SEQ ID NO: 789402 - RNA, 21 nt, Homo sapiens
gagcauuggccccugagccca

SEQ ID NO: 789403 - RNA, 16 nt, Homo sapiens
gagccaagauugcacc

SEQ ID NO: 789404 - RNA, 21 nt, Homo sapiens
gagccacaagcugcacuguga

SEQ ID NO: 789405 - RNA, 16 nt, Homo sapiens
gagccaccacauccag

SEQ ID NO: 789406 - RNA, 15 nt, Homo sapiens
gagccagcucccucu

SEQ ID NO: 789407 - RNA, 16 nt, Homo sapiens
gagccaggacccagga

SEQ ID NO: 789408 - RNA, 20 nt, Homo sapiens
gagccaggagaccugcucuc

SEQ ID NO: 789409 - RNA, 18 nt, Homo sapiens
gagccagggcugucuucg

SEQ ID NO: 789410 - RNA, 20 nt, Homo sapiens
gagccaguccuccacucgac

SEQ ID NO: 789411 - RNA, 15 nt, Homo sapiens
gagccaguggugcua

SEQ ID NO: 789412 - RNA, 21 nt, Homo sapiens
gagccaugauuucccacugca

SEQ ID NO: 789413 - RNA, 13 nt, Homo sapiens
gagccauucugug

SEQ ID NO: 789414 - RNA, 21 nt, Homo sapiens
gagcccagaucgcaccacugc

SEQ ID NO: 789415 - RNA, 18 nt, Homo sapiens
gagcccagcuacauuccu

SEQ ID NO: 789416 - RNA, 20 nt, Homo sapiens
gagcccaggccguuccccuu

SEQ ID NO: 789417 - RNA, 16 nt, Homo sapiens
gagcccccacauucuc

SEQ ID NO: 789418 - RNA, 18 nt, Homo sapiens
gagccccuacagcauugu

SEQ ID NO: 789419 - RNA, 22 nt, Homo sapiens
gagccccuccucccccggcugg

SEQ ID NO: 789420 - RNA, 14 nt, Homo sapiens
gagccccugacccc

SEQ ID NO: 789421 - RNA, 21 nt, Homo sapiens
gagcccgcuuuuguucuuccc

SEQ ID NO: 789422 - RNA, 19 nt, Homo sapiens
gagcccuaagcauugacuu

SEQ ID NO: 789423 - RNA, 13 nt, Homo sapiens
gagcccuccaggc

SEQ ID NO: 789424 - RNA, 13 nt, Homo sapiens
gagccgguggugc

SEQ ID NO: 789425 - RNA, 14 nt, Homo sapiens
gagccuagccaccu

SEQ ID NO: 789426 - RNA, 14 nt, Homo sapiens
gagccuauaucagu

SEQ ID NO: 789427 - RNA, 12 nt, Homo sapiens
gagccucuuagu

SEQ ID NO: 789428 - RNA, 14 nt, Homo sapiens
gagccugcagauga

SEQ ID NO: 789429 - RNA, 18 nt, Homo sapiens
gagccugcccucacuccc

SEQ ID NO: 789430 - RNA, 22 nt, Homo sapiens
gagccuggcuggagagcugcua

SEQ ID NO: 789431 - RNA, 18 nt, Homo sapiens
gagccuucaagugccaaa

SEQ ID NO: 789432 - RNA, 16 nt, Homo sapiens
gagccuuccacaguga

SEQ ID NO: 789433 - RNA, 20 nt, Homo sapiens
gagccuucucagaagcacag

SEQ ID NO: 789434 - RNA, 16 nt, Homo sapiens
gagccuugguguacag

SEQ ID NO: 789435 - RNA, 14 nt, Homo sapiens
gagccuuucuucca

SEQ ID NO: 789436 - RNA, 13 nt, Homo sapiens
gagcgcuccugcc

SEQ ID NO: 789437 - RNA, 19 nt, Homo sapiens
gagcgugaccuugcaaugu

SEQ ID NO: 789438 - RNA, 13 nt, Homo sapiens
gagcuacugauga

SEQ ID NO: 789439 - RNA, 17 nt, Homo sapiens
gagcuagaaacucagga

SEQ ID NO: 789440 - RNA, 21 nt, Homo sapiens
gagcuagcuucugcaauguuu

SEQ ID NO: 789441 - RNA, 21 nt, Homo sapiens
gagcucacacuccaguggcag

SEQ ID NO: 789442 - RNA, 17 nt, Homo sapiens
gagcucagcugggccag

SEQ ID NO: 789443 - RNA, 13 nt, Homo sapiens
gagcucaugaggg

SEQ ID NO: 789444 - RNA, 15 nt, Homo sapiens
gagcucccaccuccc

SEQ ID NO: 789445 - RNA, 19 nt, Homo sapiens
gagcuccugcugcggagga

SEQ ID NO: 789446 - RNA, 19 nt, Homo sapiens
gagcucgcauuugucaaug

SEQ ID NO: 789447 - RNA, 17 nt, Homo sapiens
gagcucuccaggccagg

SEQ ID NO: 789448 - RNA, 14 nt, Homo sapiens
gagcugaaagggag

SEQ ID NO: 789449 - RNA, 21 nt, Homo sapiens
gagcugaauuaccuuucacuu

SEQ ID NO: 789450 - RNA, 18 nt, Homo sapiens
gagcugagugcuagagua

SEQ ID NO: 789451 - RNA, 14 nt, Homo sapiens
gagcugcagggugg

SEQ ID NO: 789452 - RNA, 22 nt, Homo sapiens
gagcugccaagagugaagggaa

SEQ ID NO: 789453 - RNA, 14 nt, Homo sapiens
gagcuggaaggcag

SEQ ID NO: 789454 - RNA, 21 nt, Homo sapiens
gagcuggauuugggagcucug

SEQ ID NO: 789455 - RNA, 20 nt, Homo sapiens
gagcuggccucucuagcaca

SEQ ID NO: 789456 - RNA, 20 nt, Homo sapiens
gagcugggggaagaagggau

SEQ ID NO: 789457 - RNA, 16 nt, Homo sapiens
gagcugucugaacuca

SEQ ID NO: 789458 - RNA, 17 nt, Homo sapiens
gagcuguguucuugcca

SEQ ID NO: 789459 - RNA, 13 nt, Homo sapiens
gagcuguuaacuu

SEQ ID NO: 789460 - RNA, 19 nt, Homo sapiens
gagcuuccaaaugugucag

SEQ ID NO: 789461 - RNA, 21 nt, Homo sapiens
gagcuuccccaagcacggugu

SEQ ID NO: 789462 - RNA, 14 nt, Homo sapiens
gagcuugcuccaga

SEQ ID NO: 789463 - RNA, 23 nt, Homo sapiens
gaggaaaagagaaggaaagugau

SEQ ID NO: 789464 - RNA, 12 nt, Homo sapiens
gaggaaagggag

SEQ ID NO: 789465 - RNA, 13 nt, Homo sapiens
gaggaacaagcau

SEQ ID NO: 789466 - RNA, 20 nt, Homo sapiens
gaggaacguggucaacucac

SEQ ID NO: 789467 - RNA, 16 nt, Homo sapiens
gaggaagccuauuuga

SEQ ID NO: 789468 - RNA, 12 nt, Homo sapiens
gaggaagggaca

SEQ ID NO: 789469 - RNA, 21 nt, Homo sapiens
gaggaauaacaucaccacugu

SEQ ID NO: 789470 - RNA, 23 nt, Homo sapiens
gaggaauaagaauggagcaguac

SEQ ID NO: 789471 - RNA, 20 nt, Homo sapiens
gaggaaugcuggacuggagg

SEQ ID NO: 789472 - RNA, 21 nt, Homo sapiens
gaggaccagguuugaugccug

SEQ ID NO: 789473 - RNA, 13 nt, Homo sapiens
gaggacucaccac

SEQ ID NO: 789474 - RNA, 17 nt, Homo sapiens
gaggacugagacuggca

SEQ ID NO: 789475 - RNA, 19 nt, Homo sapiens
gaggacuugugucucugug

SEQ ID NO: 789476 - RNA, 15 nt, Homo sapiens
gaggagaaaugcaau

SEQ ID NO: 789477 - RNA, 16 nt, Homo sapiens
gaggagacccuggaau

SEQ ID NO: 789478 - RNA, 19 nt, Homo sapiens
gaggagcaacagcuggaag

SEQ ID NO: 789479 - RNA, 12 nt, Homo sapiens
gaggagccuuuu

SEQ ID NO: 789480 - RNA, 17 nt, Homo sapiens
gaggagcuggaggggug

SEQ ID NO: 789481 - RNA, 18 nt, Homo sapiens
gaggagcuggaggggugg

SEQ ID NO: 789482 - RNA, 11 nt, Homo sapiens
gccuggugggc

SEQ ID NO: 789483 - RNA, 22 nt, Homo sapiens
gccuguaacacauaguggcuuc

SEQ ID NO: 789484 - RNA, 13 nt, Homo sapiens
gccuguaauccca

SEQ ID NO: 789485 - RNA, 10 nt, Homo sapiens
gccugucauu

SEQ ID NO: 789486 - RNA, 14 nt, Homo sapiens
gccugucuucagag

SEQ ID NO: 789487 - RNA, 15 nt, Homo sapiens
gccugugaagcaguc

SEQ ID NO: 789488 - RNA, 14 nt, Homo sapiens
gccugugauuuccu

SEQ ID NO: 789489 - RNA, 15 nt, Homo sapiens
gccugugccuaucac

SEQ ID NO: 789490 - RNA, 21 nt, Homo sapiens
gccugugguuaacaucucaga

SEQ ID NO: 789491 - RNA, 20 nt, Homo sapiens
gccugugguuacagugcaga

SEQ ID NO: 789492 - RNA, 17 nt, Homo sapiens
gccugugucccaugacc

SEQ ID NO: 789493 - RNA, 15 nt, Homo sapiens
gccuguuaacuggua

SEQ ID NO: 789494 - RNA, 18 nt, Homo sapiens
gccuguuggggaccucac

SEQ ID NO: 789495 - RNA, 23 nt, Homo sapiens
gccuguuucuggauuugcaggug

SEQ ID NO: 789496 - RNA, 19 nt, Homo sapiens
gccuuaaacacacauugca

SEQ ID NO: 789497 - RNA, 17 nt, Homo sapiens
gccuuaaacacucaccu

SEQ ID NO: 789498 - RNA, 16 nt, Homo sapiens
gccuuaacacacuggc

SEQ ID NO: 789499 - RNA, 14 nt, Homo sapiens
gccuuaaccagucu

SEQ ID NO: 789500 - RNA, 14 nt, Homo sapiens
gccuuaagcagaac

SEQ ID NO: 789501 - RNA, 21 nt, Homo sapiens
gccuuaaguggcagaauauaa

SEQ ID NO: 789502 - RNA, 18 nt, Homo sapiens
gccuuaaugacauucccc

SEQ ID NO: 789503 - RNA, 15 nt, Homo sapiens
gccuuacacugaaaa

SEQ ID NO: 789504 - RNA, 16 nt, Homo sapiens
gccuucaagugccaaa

SEQ ID NO: 789505 - RNA, 14 nt, Homo sapiens
gccuucacugacag

SEQ ID NO: 789506 - RNA, 17 nt, Homo sapiens
gccuucagaaugcuccu

SEQ ID NO: 789507 - RNA, 16 nt, Homo sapiens
gccuuccucucucuac

SEQ ID NO: 789508 - RNA, 14 nt, Homo sapiens
gccuuccucugcag

SEQ ID NO: 789509 - RNA, 16 nt, Homo sapiens
gccuucucucagcucc

SEQ ID NO: 789510 - RNA, 15 nt, Homo sapiens
gccuucugcccuccc

SEQ ID NO: 789511 - RNA, 11 nt, Homo sapiens
uagauugugag

SEQ ID NO: 789512 - RNA, 19 nt, Homo sapiens
uagauuuacagaacaaagu

SEQ ID NO: 789513 - RNA, 14 nt, Homo sapiens
uagauuuagcuauu

SEQ ID NO: 789514 - RNA, 17 nt, Homo sapiens
uagauuucuacacugag

SEQ ID NO: 789515 - RNA, 17 nt, Homo sapiens
uagauuucuucucuuua

SEQ ID NO: 789516 - RNA, 13 nt, Homo sapiens
uagauuuggcauc

SEQ ID NO: 789517 - RNA, 22 nt, Homo sapiens
uagcaaaaacauguaugugcau

SEQ ID NO: 789518 - RNA, 23 nt, Homo sapiens
uagcaaagauuaaaugugucauu

SEQ ID NO: 789519 - RNA, 21 nt, Homo sapiens
uagcaaaggaaaaauugauga

SEQ ID NO: 789520 - RNA, 20 nt, Homo sapiens
uagcaaccuucugcauucau

SEQ ID NO: 789521 - RNA, 23 nt, Homo sapiens
uagcaagauagucuucaguuuca

SEQ ID NO: 789522 - RNA, 20 nt, Homo sapiens
uagcaagcugccgaaccaaa

SEQ ID NO: 789523 - RNA, 14 nt, Homo sapiens
uagcaagugugcac

SEQ ID NO: 789524 - RNA, 23 nt, Homo sapiens
uagcaauacuucagugagauuaa

SEQ ID NO: 789525 - RNA, 14 nt, Homo sapiens
uagcaauauaucag

SEQ ID NO: 789526 - RNA, 16 nt, Homo sapiens
uagcacaaacuacaau

SEQ ID NO: 789527 - RNA, 18 nt, Homo sapiens
uagcacaucauuccuccu

SEQ ID NO: 789528 - RNA, 14 nt, Homo sapiens
uagcacuauuuaca

SEQ ID NO: 789529 - RNA, 17 nt, Homo sapiens
uagcacuauuuacauac

SEQ ID NO: 789530 - RNA, 14 nt, Homo sapiens
uagcacugacagau

SEQ ID NO: 789531 - RNA, 10 nt, Homo sapiens
uagcacugag

SEQ ID NO: 789532 - RNA, 15 nt, Homo sapiens
uagcagacccagcuu

SEQ ID NO: 789533 - RNA, 20 nt, Homo sapiens
uagcagaguuaaaucucaaa

SEQ ID NO: 789534 - RNA, 18 nt, Homo sapiens
uagcaggccuaagacaug

SEQ ID NO: 789535 - RNA, 19 nt, Homo sapiens
uagcaguuuagaauggagg

SEQ ID NO: 789536 - RNA, 12 nt, Homo sapiens
uagcaucagagg

SEQ ID NO: 789537 - RNA, 13 nt, Homo sapiens
uagcaucuaauga

SEQ ID NO: 789538 - RNA, 16 nt, Homo sapiens
uagcaucuaauuucaa

SEQ ID NO: 789539 - RNA, 15 nt, Homo sapiens
uagcaugaaccaccc

SEQ ID NO: 789540 - RNA, 15 nt, Homo sapiens
uagcaugcugcuuuu

SEQ ID NO: 789541 - RNA, 13 nt, Homo sapiens
uagcaugugaagu

SEQ ID NO: 789542 - RNA, 23 nt, Homo sapiens
uagcaugugaaguuuugcaaaua

SEQ ID NO: 789543 - RNA, 14 nt, Homo sapiens
uagccaagugcagg

SEQ ID NO: 789544 - RNA, 13 nt, Homo sapiens
uagccagacacuc

SEQ ID NO: 789545 - RNA, 14 nt, Homo sapiens
uagccagacacucu

SEQ ID NO: 789546 - RNA, 17 nt, Homo sapiens
uagccagcugugcacuu

SEQ ID NO: 789547 - RNA, 17 nt, Homo sapiens
uagccaggaaguacuuc

SEQ ID NO: 789548 - RNA, 19 nt, Homo sapiens
uagccagugcuccaggcac

SEQ ID NO: 789549 - RNA, 23 nt, Homo sapiens
uagccaucccaugaacacacugu

SEQ ID NO: 789550 - RNA, 16 nt, Homo sapiens
uagccaucuaaugcuu

SEQ ID NO: 789551 - RNA, 13 nt, Homo sapiens
uagcccagcacug

SEQ ID NO: 789552 - RNA, 14 nt, Homo sapiens
uagccgaccucagc

SEQ ID NO: 789553 - RNA, 22 nt, Homo sapiens
uagccuaaaagacaauuuuccu

SEQ ID NO: 789554 - RNA, 14 nt, Homo sapiens
uagccucaccaagg

SEQ ID NO: 789555 - RNA, 13 nt, Homo sapiens
uagccuggaccaa

SEQ ID NO: 789556 - RNA, 13 nt, Homo sapiens
uagccugugcacg

SEQ ID NO: 789557 - RNA, 13 nt, Homo sapiens
uagccuugcacuu

SEQ ID NO: 789558 - RNA, 14 nt, Homo sapiens
uagccuugcacuuu

SEQ ID NO: 789559 - RNA, 14 nt, Homo sapiens
uagcgaacugcacu

SEQ ID NO: 789560 - RNA, 19 nt, Homo sapiens
uagcgacugucaacagcgu

SEQ ID NO: 789561 - RNA, 20 nt, Homo sapiens
uagcgggacucagugagcug

SEQ ID NO: 789562 - RNA, 17 nt, Homo sapiens
uagcggucaauuugccu

SEQ ID NO: 789563 - RNA, 20 nt, Homo sapiens
uagcuacauucacacacuca

SEQ ID NO: 789564 - RNA, 17 nt, Homo sapiens
uagcuaccuucucuacc

SEQ ID NO: 789565 - RNA, 20 nt, Homo sapiens
uagcucaaauaggucaucau

SEQ ID NO: 789566 - RNA, 23 nt, Homo sapiens
uagcucaccaggccuggccucug

SEQ ID NO: 789567 - RNA, 13 nt, Homo sapiens
uagcucacugaau

SEQ ID NO: 789568 - RNA, 15 nt, Homo sapiens
uagcucagucaucaa

SEQ ID NO: 789569 - RNA, 12 nt, Homo sapiens
uagcucuauguu

SEQ ID NO: 789570 - RNA, 23 nt, Homo sapiens
uagcucucccaacucuugcacag

SEQ ID NO: 789571 - RNA, 12 nt, Homo sapiens
uauagacagucc

SEQ ID NO: 789572 - RNA, 17 nt, Homo sapiens
uauagagccuaccugua

SEQ ID NO: 789573 - RNA, 22 nt, Homo sapiens
uauagagguguaacacuuguca

SEQ ID NO: 789574 - RNA, 18 nt, Homo sapiens
uauagaucacugcccuuu

SEQ ID NO: 789575 - RNA, 12 nt, Homo sapiens
uauagauuuagc

SEQ ID NO: 789576 - RNA, 20 nt, Homo sapiens
uauagccuauggcagaaaaa

SEQ ID NO: 789577 - RNA, 21 nt, Homo sapiens
uauagcgauugaaagggcaau

SEQ ID NO: 789578 - RNA, 14 nt, Homo sapiens
uauaggaccaagau

SEQ ID NO: 789579 - RNA, 13 nt, Homo sapiens
uauaggacucuca

SEQ ID NO: 789580 - RNA, 13 nt, Homo sapiens
uauaggcauuugg

SEQ ID NO: 789581 - RNA, 16 nt, Homo sapiens
uauaguaaguuucuau

SEQ ID NO: 789582 - RNA, 22 nt, Homo sapiens
uauagugaacucccaucuauua

SEQ ID NO: 789583 - RNA, 21 nt, Homo sapiens
uauagugacccacccuagauc

SEQ ID NO: 789584 - RNA, 14 nt, Homo sapiens
uauaguucuaggca

SEQ ID NO: 789585 - RNA, 21 nt, Homo sapiens
uauaguuuauugacaauaauu

SEQ ID NO: 789586 - RNA, 16 nt, Homo sapiens
uauauaaaauacauaa

SEQ ID NO: 789587 - RNA, 11 nt, Homo sapiens
uauauaaacuc

SEQ ID NO: 789588 - RNA, 17 nt, Homo sapiens
uauauaauguugccagc

SEQ ID NO: 789589 - RNA, 13 nt, Homo sapiens
uauauacauucuu

SEQ ID NO: 789590 - RNA, 17 nt, Homo sapiens
uauauacccacauguac

SEQ ID NO: 789591 - RNA, 23 nt, Homo sapiens
uauauaguggguacaucaagucc

SEQ ID NO: 789592 - RNA, 14 nt, Homo sapiens
uauauauguauaua

SEQ ID NO: 789593 - RNA, 13 nt, Homo sapiens
uauauauuacaag

SEQ ID NO: 789594 - RNA, 20 nt, Homo sapiens
uauauauuucuuuguuauca

SEQ ID NO: 789595 - RNA, 14 nt, Homo sapiens
uauaucacuaagcu

SEQ ID NO: 789596 - RNA, 18 nt, Homo sapiens
uauaucacuucacuguuc

SEQ ID NO: 789597 - RNA, 12 nt, Homo sapiens
uauaucagggaa

SEQ ID NO: 789598 - RNA, 13 nt, Homo sapiens
uauaucaguccuc

SEQ ID NO: 789599 - RNA, 14 nt, Homo sapiens
uauaucaucuauca

SEQ ID NO: 789600 - RNA, 12 nt, Homo sapiens
uauauccuguga

SEQ ID NO: 789601 - RNA, 20 nt, Homo sapiens
uauaucgcuggccagcauua

SEQ ID NO: 789602 - RNA, 16 nt, Homo sapiens
uauaucugaagagcua

SEQ ID NO: 789603 - RNA, 17 nt, Homo sapiens
uauaucuguacagauca

SEQ ID NO: 789604 - RNA, 14 nt, Homo sapiens
uauaugauucacau

SEQ ID NO: 789605 - RNA, 11 nt, Homo sapiens
uauaugcucug

SEQ ID NO: 789606 - RNA, 20 nt, Homo sapiens
uauaugguauauauacauau

SEQ ID NO: 789607 - RNA, 15 nt, Homo sapiens
uauauuaaaauacca

SEQ ID NO: 789608 - RNA, 17 nt, Homo sapiens
uauauuacaagggauaa

SEQ ID NO: 789609 - RNA, 13 nt, Homo sapiens
uauauuauggaag

SEQ ID NO: 789610 - RNA, 14 nt, Homo sapiens
uauauucuaagcca

SEQ ID NO: 789611 - RNA, 15 nt, Homo sapiens
uauauucuuacccua

SEQ ID NO: 789612 - RNA, 20 nt, Homo sapiens
uauauugaagacaauuugau

SEQ ID NO: 789613 - RNA, 16 nt, Homo sapiens
uauauuuauugugcuu

SEQ ID NO: 789614 - RNA, 12 nt, Homo sapiens
uauauuucacau

SEQ ID NO: 789615 - RNA, 21 nt, Homo sapiens
uauauuucagguuauauccaa

SEQ ID NO: 789616 - RNA, 18 nt, Homo sapiens
uauauuugggccugcucc

SEQ ID NO: 789617 - RNA, 18 nt, Homo sapiens
uauauuuguugauauuaa

SEQ ID NO: 789618 - RNA, 21 nt, Homo sapiens
uauauuuugugugaaauugca

SEQ ID NO: 789619 - RNA, 21 nt, Homo sapiens
uaucaagccaguacgugcuaa

SEQ ID NO: 789620 - RNA, 15 nt, Homo sapiens
uaucaauaauacaaa

SEQ ID NO: 789621 - RNA, 15 nt, Homo sapiens
uaucaauaucuaaua

SEQ ID NO: 789622 - RNA, 15 nt, Homo sapiens
uaucaaucaguauaa

SEQ ID NO: 789623 - RNA, 20 nt, Homo sapiens
uaucaaugaguaacaggaaa

SEQ ID NO: 789624 - RNA, 16 nt, Homo sapiens
uaucacauauuugaua

SEQ ID NO: 789625 - RNA, 23 nt, Homo sapiens
uaucacaugaauauaaaugggaa

SEQ ID NO: 789626 - RNA, 22 nt, Homo sapiens
uaucaccuagcagccucaaaac

SEQ ID NO: 789627 - RNA, 19 nt, Homo sapiens
uaucacuucacuguucucu

SEQ ID NO: 789628 - RNA, 18 nt, Homo sapiens
uaucagcucucugcagaa

SEQ ID NO: 789629 - RNA, 19 nt, Homo sapiens
uaucaggguauaaauuaua

SEQ ID NO: 789630 - RNA, 14 nt, Homo sapiens
uaucaguugcaaua

SEQ ID NO: 789631 - RNA, 16 nt, Homo sapiens
uaucaguugcaauaau

SEQ ID NO: 789632 - RNA, 20 nt, Homo sapiens
uaucauaauucagcacuuaa

SEQ ID NO: 789633 - RNA, 14 nt, Homo sapiens
uaucauaugaacuu

SEQ ID NO: 789634 - RNA, 11 nt, Homo sapiens
uaucaucuuuu

SEQ ID NO: 789635 - RNA, 19 nt, Homo sapiens
uaugaccauuugacuguuc

SEQ ID NO: 789636 - RNA, 14 nt, Homo sapiens
uaugaccuaaguca

SEQ ID NO: 789637 - RNA, 21 nt, Homo sapiens
uaugagaagaaaaauggaaaa

SEQ ID NO: 789638 - RNA, 22 nt, Homo sapiens
uaugagcuggggaugucucuca

SEQ ID NO: 789639 - RNA, 23 nt, Homo sapiens
uaugagcuggggaugucucucau

SEQ ID NO: 789640 - RNA, 14 nt, Homo sapiens
uaugaggcuauuaa

SEQ ID NO: 789641 - RNA, 12 nt, Homo sapiens
uaugagggaaaa

SEQ ID NO: 789642 - RNA, 23 nt, Homo sapiens
uaugaguaucuguauguauauau

SEQ ID NO: 789643 - RNA, 19 nt, Homo sapiens
uaugaguuuucuccuugau

SEQ ID NO: 789644 - RNA, 13 nt, Homo sapiens
uaugaucuuggcu

SEQ ID NO: 789645 - RNA, 15 nt, Homo sapiens
uaugauguaaucucu

SEQ ID NO: 789646 - RNA, 23 nt, Homo sapiens
uaugauguaaucucucugcagcu

SEQ ID NO: 789647 - RNA, 18 nt, Homo sapiens
uaugauguuagaagaaga

SEQ ID NO: 789648 - RNA, 19 nt, Homo sapiens
uaugauuuaaaacauguaa

SEQ ID NO: 789649 - RNA, 17 nt, Homo sapiens
uaugcaaauacaaucag

SEQ ID NO: 789650 - RNA, 20 nt, Homo sapiens
uaugcaaauacaaucagccc

SEQ ID NO: 789651 - RNA, 17 nt, Homo sapiens
uaugcaagggucccuua

SEQ ID NO: 789652 - RNA, 12 nt, Homo sapiens
uaugcaaucuga

SEQ ID NO: 789653 - RNA, 17 nt, Homo sapiens
uaugcacaaaucugcca

SEQ ID NO: 789654 - RNA, 19 nt, Homo sapiens
uaugcacucccuugaggau

SEQ ID NO: 789655 - RNA, 17 nt, Homo sapiens
uaugcagggagcacugu

SEQ ID NO: 789656 - RNA, 17 nt, Homo sapiens
uaugcaguaugcuuaau

SEQ ID NO: 789657 - RNA, 15 nt, Homo sapiens
uaugcauaaagccaa

SEQ ID NO: 789658 - RNA, 16 nt, Homo sapiens
uaugcauaaagccaaa

SEQ ID NO: 789659 - RNA, 18 nt, Homo sapiens
uaugcauagcuuugcacu

SEQ ID NO: 789660 - RNA, 12 nt, Homo sapiens
uaugcauaucag

SEQ ID NO: 789661 - RNA, 17 nt, Homo sapiens
uaugcauucacauuuag

SEQ ID NO: 789662 - RNA, 15 nt, Homo sapiens
uaugcauuugcauuu

SEQ ID NO: 789663 - RNA, 18 nt, Homo sapiens
uaugccagugcucaaggu

SEQ ID NO: 789664 - RNA, 15 nt, Homo sapiens
uaugccucuguauuu

SEQ ID NO: 789665 - RNA, 16 nt, Homo sapiens
uaugccugccucuuuc

SEQ ID NO: 789666 - RNA, 20 nt, Homo sapiens
uaugccuuuaaaucugugau

SEQ ID NO: 789667 - RNA, 21 nt, Homo sapiens
uaugcggaggaaagcaagugu

SEQ ID NO: 789668 - RNA, 18 nt, Homo sapiens
uaugcuauuauucuguaa

SEQ ID NO: 789669 - RNA, 20 nt, Homo sapiens
uaugcucauugaacuuuaag

SEQ ID NO: 789670 - RNA, 16 nt, Homo sapiens
uaugcugcucauccaa

SEQ ID NO: 789671 - RNA, 16 nt, Homo sapiens
uaugcuuuuucucaga

SEQ ID NO: 789672 - RNA, 23 nt, Homo sapiens
uauggaaaagggucuucuuggca

SEQ ID NO: 789673 - RNA, 16 nt, Homo sapiens
uauggaacucucucca

SEQ ID NO: 789674 - RNA, 22 nt, Homo sapiens
uauggaagcaaccagcaaauua

SEQ ID NO: 789675 - RNA, 23 nt, Homo sapiens
uauggacaaaauugcagauacca

SEQ ID NO: 789676 - RNA, 20 nt, Homo sapiens
uauggacaggaugggguucu

SEQ ID NO: 789677 - RNA, 14 nt, Homo sapiens
uauggacucugcac

SEQ ID NO: 789678 - RNA, 15 nt, Homo sapiens
uauggacucugcaca

SEQ ID NO: 789679 - RNA, 20 nt, Homo sapiens
uauggaguaccauguggcaa

SEQ ID NO: 789680 - RNA, 23 nt, Homo sapiens
uauggagugccugcuguggaccc

SEQ ID NO: 789681 - RNA, 13 nt, Homo sapiens
uauggcaagugau

SEQ ID NO: 789682 - RNA, 13 nt, Homo sapiens
uauggcuagacag

SEQ ID NO: 789683 - RNA, 14 nt, Homo sapiens
uauggcuccuccau

SEQ ID NO: 789684 - RNA, 16 nt, Homo sapiens
uauggcuuaaugacac

SEQ ID NO: 789685 - RNA, 17 nt, Homo sapiens
uauggcuucacauucau

SEQ ID NO: 789686 - RNA, 21 nt, Homo sapiens
uauggcuuuucacaugggcuu

SEQ ID NO: 789687 - RNA, 21 nt, Homo sapiens
uaugggccaagcccagcuuaa

SEQ ID NO: 789688 - RNA, 18 nt, Homo sapiens
uauggguuaaaucaaaga

SEQ ID NO: 789689 - RNA, 14 nt, Homo sapiens
uaugguucucaggc

SEQ ID NO: 789690 - RNA, 15 nt, Homo sapiens
uaugguugacacuag

SEQ ID NO: 789691 - RNA, 23 nt, Homo sapiens
uauguaacagucaaauaucauuu

SEQ ID NO: 789692 - RNA, 16 nt, Homo sapiens
uauguaaguacuucca

SEQ ID NO: 789693 - RNA, 16 nt, Homo sapiens
uauguacuaagcagua

SEQ ID NO: 789694 - RNA, 21 nt, Homo sapiens
uauguagaucaaggaugucca

SEQ ID NO: 789695 - RNA, 13 nt, Homo sapiens
uauguagcacuac

SEQ ID NO: 789696 - RNA, 12 nt, Homo sapiens
uauguaguauua

SEQ ID NO: 789697 - RNA, 14 nt, Homo sapiens
uauguagugcauuu

SEQ ID NO: 789698 - RNA, 19 nt, Homo sapiens
uauguaguuuuguacauaa

SEQ ID NO: 789699 - RNA, 21 nt, Homo sapiens
uauguauaacaagccaaacau

SEQ ID NO: 789700 - RNA, 17 nt, Homo sapiens
uauguauacaugugcca

SEQ ID NO: 789701 - RNA, 12 nt, Homo sapiens
uauguaucauaa

SEQ ID NO: 789702 - RNA, 17 nt, Homo sapiens
uauguaugaguaucugu

SEQ ID NO: 789703 - RNA, 13 nt, Homo sapiens
uauguauggaaua

SEQ ID NO: 789704 - RNA, 20 nt, Homo sapiens
uaugucaauuuguauaucau

SEQ ID NO: 789705 - RNA, 20 nt, Homo sapiens
uaugucaggcaaagugcugc

SEQ ID NO: 789706 - RNA, 22 nt, Homo sapiens
uaugucaggcaaagugcugcug

SEQ ID NO: 789707 - RNA, 13 nt, Homo sapiens
uaugucauacucu

SEQ ID NO: 789708 - RNA, 13 nt, Homo sapiens
uaugucauagaaa

SEQ ID NO: 789709 - RNA, 23 nt, Homo sapiens
uaugucaugugcaccuuugcaca

SEQ ID NO: 789710 - RNA, 21 nt, Homo sapiens
uauguccguucaucccugaga

SEQ ID NO: 789711 - RNA, 14 nt, Homo sapiens
uaugucguaaguca

SEQ ID NO: 789712 - RNA, 13 nt, Homo sapiens
uaugucugccuuc

SEQ ID NO: 789713 - RNA, 18 nt, Homo sapiens
uaugucuuggacacugua

SEQ ID NO: 789714 - RNA, 13 nt, Homo sapiens
uaugugacuguga

SEQ ID NO: 789715 - RNA, 20 nt, Homo sapiens
uaugugacugugacuuucaa

SEQ ID NO: 789716 - RNA, 18 nt, Homo sapiens
uaugugcagucuugcuua

SEQ ID NO: 789717 - RNA, 17 nt, Homo sapiens
uaugugcgucucucuuu

SEQ ID NO: 789718 - RNA, 16 nt, Homo sapiens
uaugugcuauacacac

SEQ ID NO: 789719 - RNA, 20 nt, Homo sapiens
uauguggaagaacugugaua

SEQ ID NO: 789720 - RNA, 20 nt, Homo sapiens
uauguggcagcuggggagca

SEQ ID NO: 789721 - RNA, 14 nt, Homo sapiens
uauguggcuguauc

SEQ ID NO: 789722 - RNA, 16 nt, Homo sapiens
uaugugggggucugug

SEQ ID NO: 789723 - RNA, 18 nt, Homo sapiens
uaugugggugcuccucuu

SEQ ID NO: 789724 - RNA, 12 nt, Homo sapiens
uauguguaaaau

SEQ ID NO: 789725 - RNA, 22 nt, Homo sapiens
uaugugucccgaauccacaguc

SEQ ID NO: 789726 - RNA, 13 nt, Homo sapiens
uauguguguauau

SEQ ID NO: 789727 - RNA, 13 nt, Homo sapiens
uauguuauugcau

SEQ ID NO: 789728 - RNA, 18 nt, Homo sapiens
uauguucaaagacuguga

SEQ ID NO: 789729 - RNA, 22 nt, Homo sapiens
uauguucaacuggagacacuau

SEQ ID NO: 789730 - RNA, 17 nt, Homo sapiens
uauguucugucuuccca

SEQ ID NO: 789731 - RNA, 20 nt, Homo sapiens
uauguucuuuaguuugcugc

SEQ ID NO: 789732 - RNA, 15 nt, Homo sapiens
uauguuuacauauca

SEQ ID NO: 789733 - RNA, 20 nt, Homo sapiens
uauguuuccgaggcacuguu

SEQ ID NO: 789734 - RNA, 13 nt, Homo sapiens
uauguuugcacuu

SEQ ID NO: 789735 - RNA, 13 nt, Homo sapiens
uauguuugcugau

SEQ ID NO: 789736 - RNA, 14 nt, Homo sapiens
uauuaaaacacaaa

SEQ ID NO: 789737 - RNA, 15 nt, Homo sapiens
uauuaaaacacagcu

SEQ ID NO: 789738 - RNA, 15 nt, Homo sapiens
uauuaaaauucugau

SEQ ID NO: 789739 - RNA, 15 nt, Homo sapiens
uauuaacggugguga

SEQ ID NO: 789740 - RNA, 16 nt, Homo sapiens
uauuaacugcucagug

SEQ ID NO: 789741 - RNA, 17 nt, Homo sapiens
uauuaacuuuaauucuc

SEQ ID NO: 789742 - RNA, 23 nt, Homo sapiens
uauuaagaggcagaaaauugcac

SEQ ID NO: 789743 - RNA, 13 nt, Homo sapiens
uauuaagcacuuu

SEQ ID NO: 789744 - RNA, 15 nt, Homo sapiens
uauuaagcacuuuaa

SEQ ID NO: 789745 - RNA, 23 nt, Homo sapiens
uauuaauaaagcauucuuuaaca

SEQ ID NO: 789746 - RNA, 23 nt, Homo sapiens
uauuaaucaagagaaacuucaaa

SEQ ID NO: 789747 - RNA, 21 nt, Homo sapiens
uauuaaucauacaaacucuca

SEQ ID NO: 789748 - RNA, 16 nt, Homo sapiens
uauuacaucuuucaca

SEQ ID NO: 789749 - RNA, 11 nt, Homo sapiens
uauuaccuccc

SEQ ID NO: 789750 - RNA, 20 nt, Homo sapiens
uauuacuguugcauuuacuu

SEQ ID NO: 789751 - RNA, 22 nt, Homo sapiens
uauuacuuauuuuugacagugu

SEQ ID NO: 789752 - RNA, 17 nt, Homo sapiens
uauuagauaaauuucaa

SEQ ID NO: 789753 - RNA, 17 nt, Homo sapiens
uauuaggaaauucugau

SEQ ID NO: 789754 - RNA, 19 nt, Homo sapiens
uauuaggucgguacuaaga

SEQ ID NO: 789755 - RNA, 15 nt, Homo sapiens
uauuaguacugcucu

SEQ ID NO: 789756 - RNA, 14 nt, Homo sapiens
uauuauauuugaca

SEQ ID NO: 789757 - RNA, 23 nt, Homo sapiens
uauuaucagagacuauguagcaa

SEQ ID NO: 789758 - RNA, 14 nt, Homo sapiens
uauuaugcauauau

SEQ ID NO: 789759 - RNA, 14 nt, Homo sapiens
uauuaugcuggaau

SEQ ID NO: 789760 - RNA, 17 nt, Homo sapiens
uauuauguaaauuuugc

SEQ ID NO: 789761 - RNA, 14 nt, Homo sapiens
uauuauguguuucc

SEQ ID NO: 789762 - RNA, 15 nt, Homo sapiens
uauuauuuugcacug

SEQ ID NO: 789763 - RNA, 17 nt, Homo sapiens
uauuauuuuugagacag

SEQ ID NO: 789764 - RNA, 14 nt, Homo sapiens
uauucaaaaaauca

SEQ ID NO: 789765 - RNA, 14 nt, Homo sapiens
uauucaggagagua

SEQ ID NO: 789766 - RNA, 16 nt, Homo sapiens
uauucaguaguggaaa

SEQ ID NO: 789767 - RNA, 11 nt, Homo sapiens
uauuccacuua

SEQ ID NO: 789768 - RNA, 20 nt, Homo sapiens
uauucccaaguaugccuuaa

SEQ ID NO: 789769 - RNA, 11 nt, Homo sapiens
uauuccugcug

SEQ ID NO: 789770 - RNA, 14 nt, Homo sapiens
uauuccuguagggg

SEQ ID NO: 789771 - RNA, 16 nt, Homo sapiens
uauucuaaaaccauuc

SEQ ID NO: 789772 - RNA, 18 nt, Homo sapiens
uauucuaaacagacucau

SEQ ID NO: 789773 - RNA, 18 nt, Homo sapiens
uauucuaagccaguuuuc

SEQ ID NO: 789774 - RNA, 13 nt, Homo sapiens
uauucuacuaugc

SEQ ID NO: 789775 - RNA, 16 nt, Homo sapiens
uauucucaguguaggg

SEQ ID NO: 789776 - RNA, 17 nt, Homo sapiens
uauucucuuaauuuuuc

SEQ ID NO: 789777 - RNA, 17 nt, Homo sapiens
uauucucuucacuccca

SEQ ID NO: 789778 - RNA, 18 nt, Homo sapiens
uauucuguaguugcagcu

SEQ ID NO: 789779 - RNA, 20 nt, Homo sapiens
uauucuguuugcguacuugu

SEQ ID NO: 789780 - RNA, 16 nt, Homo sapiens
uauucuguuuugcaca

SEQ ID NO: 789781 - RNA, 20 nt, Homo sapiens
uauugaagaugcugccugua

SEQ ID NO: 789782 - RNA, 14 nt, Homo sapiens
uauugaaucuuaau

SEQ ID NO: 789783 - RNA, 18 nt, Homo sapiens
uauugacaauaauuucag

SEQ ID NO: 789784 - RNA, 13 nt, Homo sapiens
uauugacacugaa

SEQ ID NO: 789785 - RNA, 18 nt, Homo sapiens
uauugacccucuaugaua

SEQ ID NO: 789786 - RNA, 13 nt, Homo sapiens
uauugacucuuuc

SEQ ID NO: 789787 - RNA, 16 nt, Homo sapiens
uauugauaaguucaua

SEQ ID NO: 789788 - RNA, 17 nt, Homo sapiens
uauugcaccauacuccu

SEQ ID NO: 789789 - RNA, 20 nt, Homo sapiens
uauugcagaagcaguuauug

SEQ ID NO: 789790 - RNA, 22 nt, Homo sapiens
uauugcagagacucauuucaca

SEQ ID NO: 789791 - RNA, 15 nt, Homo sapiens
uauugcccaggcugu

SEQ ID NO: 789792 - RNA, 11 nt, Homo sapiens
uauugcugcuc

SEQ ID NO: 789793 - RNA, 17 nt, Homo sapiens
uauugcuucaccauggc

SEQ ID NO: 789794 - RNA, 22 nt, Homo sapiens
uauugcuucccugcuauuuccc

SEQ ID NO: 789795 - RNA, 20 nt, Homo sapiens
uauuggaugacuaacuauca

SEQ ID NO: 789796 - RNA, 23 nt, Homo sapiens
uauuggcccuaaauagcagaaag

SEQ ID NO: 789797 - RNA, 22 nt, Homo sapiens
uauuggcgcaccaagaucucca

SEQ ID NO: 789798 - RNA, 20 nt, Homo sapiens
uauugggagaggucauaaaa

SEQ ID NO: 789799 - RNA, 22 nt, Homo sapiens
uauugguccagcuugcucuuca

SEQ ID NO: 789800 - RNA, 23 nt, Homo sapiens
uauugguuuugguuuugacucac

SEQ ID NO: 789801 - RNA, 15 nt, Homo sapiens
uauuguaaauacugg

SEQ ID NO: 789802 - RNA, 20 nt, Homo sapiens
uauuguaaucgugugccaug

SEQ ID NO: 789803 - RNA, 14 nt, Homo sapiens
uauuguacauaaaa

SEQ ID NO: 789804 - RNA, 16 nt, Homo sapiens
uauugucgcuauguga

SEQ ID NO: 789805 - RNA, 14 nt, Homo sapiens
uauuguucacuuua

SEQ ID NO: 789806 - RNA, 23 nt, Homo sapiens
uauuuaaaaauuguuucuugaca

SEQ ID NO: 789807 - RNA, 23 nt, Homo sapiens
uauuuaaauaaagucucucugac

SEQ ID NO: 789808 - RNA, 14 nt, Homo sapiens
uauuuaacaacugg

SEQ ID NO: 789809 - RNA, 19 nt, Homo sapiens
uauuuaacagugcaaaagg

SEQ ID NO: 789810 - RNA, 21 nt, Homo sapiens
uauuuaagaaaacaccaugga

SEQ ID NO: 789811 - RNA, 14 nt, Homo sapiens
uauuuaaguucaua

SEQ ID NO: 789812 - RNA, 12 nt, Homo sapiens
uauuuacauuua

SEQ ID NO: 789813 - RNA, 21 nt, Homo sapiens
uauuuacugagcuucucugug

SEQ ID NO: 789814 - RNA, 23 nt, Homo sapiens
uacccuccuguaaaugguguaca

SEQ ID NO: 789815 - RNA, 17 nt, Homo sapiens
uacccucgcaugacugu

SEQ ID NO: 789816 - RNA, 21 nt, Homo sapiens
uacccugagauacuucccaaa

SEQ ID NO: 789817 - RNA, 20 nt, Homo sapiens
uacccuuacucugccagagu

SEQ ID NO: 789818 - RNA, 20 nt, Homo sapiens
uacccuuggcaguguggcag

SEQ ID NO: 789819 - RNA, 23 nt, Homo sapiens
uacccuugugagagcccauuccc

SEQ ID NO: 789820 - RNA, 21 nt, Homo sapiens
uacccuuuggccccacuuuga

SEQ ID NO: 789821 - RNA, 17 nt, Homo sapiens
uaccgaaguaaacugau

SEQ ID NO: 789822 - RNA, 14 nt, Homo sapiens
uaccgcuggcccug

SEQ ID NO: 789823 - RNA, 20 nt, Homo sapiens
uaccuacauacguguuccua

SEQ ID NO: 789824 - RNA, 17 nt, Homo sapiens
uaccuaccacagugucu

SEQ ID NO: 789825 - RNA, 17 nt, Homo sapiens
uaccucaagggggacug

SEQ ID NO: 789826 - RNA, 22 nt, Homo sapiens
uaccucaguucccucuugcuca

SEQ ID NO: 789827 - RNA, 15 nt, Homo sapiens
uaccuccacccugca

SEQ ID NO: 789828 - RNA, 17 nt, Homo sapiens
uaccuccacccugcauu

SEQ ID NO: 789829 - RNA, 22 nt, Homo sapiens
uaccuccacccugcauuuuccu

SEQ ID NO: 789830 - RNA, 20 nt, Homo sapiens
uaccuccuccucuggacaaa

SEQ ID NO: 789831 - RNA, 14 nt, Homo sapiens
uaccucuuggcugc

SEQ ID NO: 789832 - RNA, 15 nt, Homo sapiens
uaccugagauggagg

SEQ ID NO: 789833 - RNA, 19 nt, Homo sapiens
uaccugagauggaggaguc

SEQ ID NO: 789834 - RNA, 12 nt, Homo sapiens
uaccugccucag

SEQ ID NO: 789835 - RNA, 14 nt, Homo sapiens
uaccugccucagcc

SEQ ID NO: 789836 - RNA, 23 nt, Homo sapiens
uaccugcucagcccugcaccaug

SEQ ID NO: 789837 - RNA, 20 nt, Homo sapiens
uaccugcuguggaugcuuca

SEQ ID NO: 789838 - RNA, 19 nt, Homo sapiens
uaccuggcccugugccuug

SEQ ID NO: 789839 - RNA, 20 nt, Homo sapiens
uaccuggcccugugccuugg

SEQ ID NO: 789840 - RNA, 21 nt, Homo sapiens
uaccugguagaucaagcauua

SEQ ID NO: 789841 - RNA, 16 nt, Homo sapiens
uaccuggugagcucag

SEQ ID NO: 789842 - RNA, 21 nt, Homo sapiens
uaccuguacuaaaccaccuca

SEQ ID NO: 789843 - RNA, 17 nt, Homo sapiens
uaccuguauacagugca

SEQ ID NO: 789844 - RNA, 21 nt, Homo sapiens
uaccugucauuuugcacugua

SEQ ID NO: 789845 - RNA, 23 nt, Homo sapiens
uaccugucauuuugcacuguaaa

SEQ ID NO: 789846 - RNA, 15 nt, Homo sapiens
uaccuguuauuuauc

SEQ ID NO: 789847 - RNA, 22 nt, Homo sapiens
uaccuuaaaauguaaaacaaaa

SEQ ID NO: 789848 - RNA, 21 nt, Homo sapiens
uaccuucaggcagccagugug

SEQ ID NO: 789849 - RNA, 23 nt, Homo sapiens
uaccuucaugugauucacugccu

SEQ ID NO: 789850 - RNA, 14 nt, Homo sapiens
uaccuucuaccucu

SEQ ID NO: 789851 - RNA, 15 nt, Homo sapiens
uaccuucuaccucuu

SEQ ID NO: 789852 - RNA, 16 nt, Homo sapiens
uaccuucuuguugaua

SEQ ID NO: 789853 - RNA, 19 nt, Homo sapiens
uaccuucuuuucuuccuca

SEQ ID NO: 789854 - RNA, 21 nt, Homo sapiens
uaccuugacuugaaaugcucu

SEQ ID NO: 789855 - RNA, 22 nt, Homo sapiens
uaccuugacuugaaaugcucuu

SEQ ID NO: 789856 - RNA, 17 nt, Homo sapiens
uaccuugagccaguaau

SEQ ID NO: 789857 - RNA, 15 nt, Homo sapiens
uaccuuguugcagau

SEQ ID NO: 789858 - RNA, 23 nt, Homo sapiens
uaccuuuguaacggcucuuagca

SEQ ID NO: 789859 - RNA, 22 nt, Homo sapiens
uaccuuuuauuuuaauguuucc

SEQ ID NO: 789860 - RNA, 18 nt, Homo sapiens
uaccuuuucucacaaaaa

SEQ ID NO: 789861 - RNA, 19 nt, Homo sapiens
uaccuuuuuauuugcaugu

SEQ ID NO: 789862 - RNA, 16 nt, Homo sapiens
uacgaagacaaagucc

SEQ ID NO: 789863 - RNA, 12 nt, Homo sapiens
uacgauuucacu

SEQ ID NO: 789864 - RNA, 18 nt, Homo sapiens
uacgcuauccaguugcag

SEQ ID NO: 789865 - RNA, 21 nt, Homo sapiens
uacggagaagaauagaggucc

SEQ ID NO: 789866 - RNA, 16 nt, Homo sapiens
uacggagggugggcuc

SEQ ID NO: 789867 - RNA, 14 nt, Homo sapiens
uacggcccaugcaa

SEQ ID NO: 789868 - RNA, 18 nt, Homo sapiens
uacggcuuuuccaaugau

SEQ ID NO: 789869 - RNA, 23 nt, Homo sapiens
uacgguggcacgugccugugauc

SEQ ID NO: 789870 - RNA, 12 nt, Homo sapiens
uacgugccacuc

SEQ ID NO: 789871 - RNA, 15 nt, Homo sapiens
uacuaaaccaccuca

SEQ ID NO: 789872 - RNA, 19 nt, Homo sapiens
uacuaaaucuaaucaggaa

SEQ ID NO: 789873 - RNA, 18 nt, Homo sapiens
uacuaaauuuucuaauua

SEQ ID NO: 789874 - RNA, 19 nt, Homo sapiens
uacuaacauuuucauugau

SEQ ID NO: 789875 - RNA, 24 nt, Homo sapiens
uacuaacauuuucauugaugagca

SEQ ID NO: 789876 - RNA, 20 nt, Homo sapiens
uacuaacuaaauaccauuca

SEQ ID NO: 789877 - RNA, 23 nt, Homo sapiens
uacuaagauguucacuguggcau

SEQ ID NO: 789878 - RNA, 17 nt, Homo sapiens
uacuaaggaaucuuucu

SEQ ID NO: 789879 - RNA, 20 nt, Homo sapiens
uacuaauaugccuagcacaa

SEQ ID NO: 789880 - RNA, 18 nt, Homo sapiens
uacuaaugaugcuuuuau

SEQ ID NO: 789881 - RNA, 18 nt, Homo sapiens
uacuaaugccucuucauu

SEQ ID NO: 789882 - RNA, 14 nt, Homo sapiens
uacuaccacaagga

SEQ ID NO: 789883 - RNA, 15 nt, Homo sapiens
uacuaccacaaggaa

SEQ ID NO: 789884 - RNA, 15 nt, Homo sapiens
uacuagaaguuuuac

SEQ ID NO: 789885 - RNA, 19 nt, Homo sapiens
uacuaggagaggggggcca

SEQ ID NO: 789886 - RNA, 21 nt, Homo sapiens
uacuaggauacagaaaugcaa

SEQ ID NO: 789887 - RNA, 18 nt, Homo sapiens
uacuaguucagacacuuu

SEQ ID NO: 789888 - RNA, 22 nt, Homo sapiens
uacuaguuuuaguuuucucuua

SEQ ID NO: 789889 - RNA, 14 nt, Homo sapiens
uacuauucacugau

SEQ ID NO: 789890 - RNA, 15 nt, Homo sapiens
uacuauugaaguaug

SEQ ID NO: 789891 - RNA, 16 nt, Homo sapiens
uacuauuuuuacuaau

SEQ ID NO: 789892 - RNA, 21 nt, Homo sapiens
uacuauuuuuacuaaucuuuc

SEQ ID NO: 789893 - RNA, 14 nt, Homo sapiens
uacucacauauaac

SEQ ID NO: 789894 - RNA, 22 nt, Homo sapiens
uacucagacgugugaccuccau

SEQ ID NO: 789895 - RNA, 19 nt, Homo sapiens
uacucaggaggcugaggca

SEQ ID NO: 789896 - RNA, 17 nt, Homo sapiens
uacucaggcaaggggca

SEQ ID NO: 789897 - RNA, 21 nt, Homo sapiens
uacucagguuaaugcugaaaa

SEQ ID NO: 789898 - RNA, 17 nt, Homo sapiens
uacucagugcuaaacau

SEQ ID NO: 789899 - RNA, 13 nt, Homo sapiens
uacucauccagac

SEQ ID NO: 789900 - RNA, 18 nt, Homo sapiens
uacuccacugcccuggca

SEQ ID NO: 789901 - RNA, 18 nt, Homo sapiens
uacuccaucauggcugcu

SEQ ID NO: 789902 - RNA, 22 nt, Homo sapiens
uacuccgcggagugaucaugga

SEQ ID NO: 789903 - RNA, 17 nt, Homo sapiens
uacuccgugaggcugcu

SEQ ID NO: 789904 - RNA, 22 nt, Homo sapiens
uacuccuuuugccacugcugug

SEQ ID NO: 789905 - RNA, 20 nt, Homo sapiens
uacucuaucagagaaaaaca

SEQ ID NO: 789906 - RNA, 14 nt, Homo sapiens
uacucuccaaccug

SEQ ID NO: 789907 - RNA, 14 nt, Homo sapiens
uacucugcagugau

SEQ ID NO: 789908 - RNA, 13 nt, Homo sapiens
uacucugccagag

SEQ ID NO: 789909 - RNA, 19 nt, Homo sapiens
uacucuucuuacuggugcu

SEQ ID NO: 789910 - RNA, 14 nt, Homo sapiens
uacugaaaacaauu

SEQ ID NO: 789911 - RNA, 18 nt, Homo sapiens
uacugaacacauguguau

SEQ ID NO: 789912 - RNA, 22 nt, Homo sapiens
uacugaacaugggagcucuuga

SEQ ID NO: 789913 - RNA, 19 nt, Homo sapiens
uacugacuuggaucccaaa

SEQ ID NO: 789914 - RNA, 13 nt, Homo sapiens
uacugaucuuacu

SEQ ID NO: 789915 - RNA, 20 nt, Homo sapiens
uacugauucaagaacaagca

SEQ ID NO: 789916 - RNA, 23 nt, Homo sapiens
uacugauucaagaacaagcaaug

SEQ ID NO: 789917 - RNA, 15 nt, Homo sapiens
uacugauucacugca

SEQ ID NO: 789918 - RNA, 18 nt, Homo sapiens
uacugcacucagauuuaa

SEQ ID NO: 789919 - RNA, 20 nt, Homo sapiens
uacugcacuuacgcuaucca

SEQ ID NO: 789920 - RNA, 18 nt, Homo sapiens
uacugcauuuacagugua

SEQ ID NO: 789921 - RNA, 22 nt, Homo sapiens
uacugcucaucauuccuugaga

SEQ ID NO: 789922 - RNA, 19 nt, Homo sapiens
uacugcugagucagacugu

SEQ ID NO: 789923 - RNA, 15 nt, Homo sapiens
uacugcuuuucauua

SEQ ID NO: 789924 - RNA, 19 nt, Homo sapiens
uacuggaaaaaaauacaaa

SEQ ID NO: 789925 - RNA, 23 nt, Homo sapiens
uacuggaaaaaaauacaaaaagc

SEQ ID NO: 789926 - RNA, 17 nt, Homo sapiens
uacuggaaacuaauugu

SEQ ID NO: 789927 - RNA, 17 nt, Homo sapiens
uacuggucccuuccuuu

SEQ ID NO: 789928 - RNA, 19 nt, Homo sapiens
uacugguguucuguuucaa

SEQ ID NO: 789929 - RNA, 18 nt, Homo sapiens
uacuguaauagugugauu

SEQ ID NO: 789930 - RNA, 12 nt, Homo sapiens
uacuguacuuaa

SEQ ID NO: 789931 - RNA, 13 nt, Homo sapiens
uacuguacuuaau

SEQ ID NO: 789932 - RNA, 19 nt, Homo sapiens
uacuguaggaacaagcaug

SEQ ID NO: 789933 - RNA, 23 nt, Homo sapiens
uacugucaaacaauaaagggaga

SEQ ID NO: 789934 - RNA, 17 nt, Homo sapiens
uacugucucacugaaac

SEQ ID NO: 789935 - RNA, 17 nt, Homo sapiens
uacugugaaacuggcac

SEQ ID NO: 789936 - RNA, 19 nt, Homo sapiens
uacuguguguuuucccaaa

SEQ ID NO: 789937 - RNA, 13 nt, Homo sapiens
uacuguuuugcca

SEQ ID NO: 789938 - RNA, 13 nt, Homo sapiens
uacuuaacaaagu

SEQ ID NO: 789939 - RNA, 14 nt, Homo sapiens
uacuuaaguuuuag

SEQ ID NO: 789940 - RNA, 19 nt, Homo sapiens
uacuuauauccacacugca

SEQ ID NO: 789941 - RNA, 15 nt, Homo sapiens
uacuuaucuuaugcc

SEQ ID NO: 789942 - RNA, 19 nt, Homo sapiens
uacuuaugaugaugaaggg

SEQ ID NO: 789943 - RNA, 13 nt, Homo sapiens
uacuuaugcaaga

SEQ ID NO: 789944 - RNA, 17 nt, Homo sapiens
uacuuauucuagauuac

SEQ ID NO: 789945 - RNA, 21 nt, Homo sapiens
uacuucaaccagccuacaagc

SEQ ID NO: 789946 - RNA, 14 nt, Homo sapiens
uacuucacuucaaa

SEQ ID NO: 789947 - RNA, 18 nt, Homo sapiens
uacuucaucauuuugaca

SEQ ID NO: 789948 - RNA, 14 nt, Homo sapiens
uacuucuccacugu

SEQ ID NO: 789949 - RNA, 20 nt, Homo sapiens
uacuucuggaagucaucuca

SEQ ID NO: 789950 - RNA, 22 nt, Homo sapiens
uacuugacaaauuugugugaca

SEQ ID NO: 789951 - RNA, 22 nt, Homo sapiens
uacuuggcugcuuccugugaca

SEQ ID NO: 789952 - RNA, 20 nt, Homo sapiens
uacuuguagaguggugcugc

SEQ ID NO: 789953 - RNA, 15 nt, Homo sapiens
uacuuuaaaauuaca

SEQ ID NO: 789954 - RNA, 19 nt, Homo sapiens
uacuuuauacagcaaagga

SEQ ID NO: 789955 - RNA, 20 nt, Homo sapiens
uacuuuauuucugaucuaua

SEQ ID NO: 789956 - RNA, 19 nt, Homo sapiens
uacuuugaguuagugccau

SEQ ID NO: 789957 - RNA, 13 nt, Homo sapiens
uacuuugcagaug

SEQ ID NO: 789958 - RNA, 24 nt, Homo sapiens
uacuuugggacgcccacguggcag

SEQ ID NO: 789959 - RNA, 22 nt, Homo sapiens
uacuuugguuucugucuguaag

SEQ ID NO: 789960 - RNA, 15 nt, Homo sapiens
uacuuugugcauucu

SEQ ID NO: 789961 - RNA, 19 nt, Homo sapiens
uacuuuuaaaaacauaaca

SEQ ID NO: 789962 - RNA, 18 nt, Homo sapiens
uacuuuuaaacuguguac

SEQ ID NO: 789963 - RNA, 15 nt, Homo sapiens
uacuuuuacucugcc

SEQ ID NO: 789964 - RNA, 19 nt, Homo sapiens
uacuuuugacccaugugca

SEQ ID NO: 789965 - RNA, 15 nt, Homo sapiens
uacuuuuuaguaauu

SEQ ID NO: 789966 - RNA, 22 nt, Homo sapiens
uacuuuuuccuggcucaucucu

SEQ ID NO: 789967 - RNA, 23 nt, Homo sapiens
uagaaaaccuaauuaaggaagua

SEQ ID NO: 789968 - RNA, 22 nt, Homo sapiens
uagaaaaguguggcuugggcau

SEQ ID NO: 789969 - RNA, 22 nt, Homo sapiens
uagaaaaugaggaaaugccaca

SEQ ID NO: 789970 - RNA, 12 nt, Homo sapiens
uagaaacacagu

SEQ ID NO: 789971 - RNA, 15 nt, Homo sapiens
uagaaacaugacacu

SEQ ID NO: 789972 - RNA, 17 nt, Homo sapiens
uagaaagagaaacaguu

SEQ ID NO: 789973 - RNA, 18 nt, Homo sapiens
uagaaagcaaagauuauu

SEQ ID NO: 789974 - RNA, 18 nt, Homo sapiens
uagaaagcugcugugauc

SEQ ID NO: 789975 - RNA, 17 nt, Homo sapiens
uagaaaggacaacaguu

SEQ ID NO: 789976 - RNA, 11 nt, Homo sapiens
uagaaaugcaa

SEQ ID NO: 789977 - RNA, 18 nt, Homo sapiens
uagaaauuggcuggaugu

SEQ ID NO: 789978 - RNA, 19 nt, Homo sapiens
uagaaauugggcagucuua

SEQ ID NO: 789979 - RNA, 17 nt, Homo sapiens
uagaacaacgccuguca

SEQ ID NO: 789980 - RNA, 18 nt, Homo sapiens
uagaaccaagcuucagag

SEQ ID NO: 789981 - RNA, 20 nt, Homo sapiens
uagaacggaauguguggggu

SEQ ID NO: 789982 - RNA, 18 nt, Homo sapiens
uagaacuagccaaaccag

SEQ ID NO: 789983 - RNA, 12 nt, Homo sapiens
uagaacugagaa

SEQ ID NO: 789984 - RNA, 16 nt, Homo sapiens
uagaacugauccagca

SEQ ID NO: 789985 - RNA, 19 nt, Homo sapiens
uagaacugucccacaaaau

SEQ ID NO: 789986 - RNA, 12 nt, Homo sapiens
uagaacuugcag

SEQ ID NO: 789987 - RNA, 20 nt, Homo sapiens
uagaacuuuauuaaguaaaa

SEQ ID NO: 789988 - RNA, 18 nt, Homo sapiens
uagaagaaaugcuaucag

SEQ ID NO: 789989 - RNA, 16 nt, Homo sapiens
uagaagaagaggaaga

SEQ ID NO: 789990 - RNA, 18 nt, Homo sapiens
uagaagagaaaugcugcu

SEQ ID NO: 789991 - RNA, 21 nt, Homo sapiens
uagaagaggguuuuagguaga

SEQ ID NO: 789992 - RNA, 20 nt, Homo sapiens
uagaagccuauguccguuca

SEQ ID NO: 789993 - RNA, 18 nt, Homo sapiens
uagaaggggaggacacug

SEQ ID NO: 789994 - RNA, 20 nt, Homo sapiens
uagaaggguaccuugaacac

SEQ ID NO: 789995 - RNA, 22 nt, Homo sapiens
uagaaguagcaaaaaguauuga

SEQ ID NO: 789996 - RNA, 23 nt, Homo sapiens
uagaagugguuuguagacuuccu

SEQ ID NO: 789997 - RNA, 17 nt, Homo sapiens
uagaaguuacugaaugc

SEQ ID NO: 789998 - RNA, 23 nt, Homo sapiens
uagaaguuuggcugcugucauaa

SEQ ID NO: 789999 - RNA, 14 nt, Homo sapiens
uagaauaagccuuc

SEQ ID NO: 790000 - RNA, 13 nt, Homo sapiens
uagaauacauuaa

SEQ ID NO: 790001 - RNA, 18 nt, Homo sapiens
uagaauauccuauacugg

SEQ ID NO: 790002 - RNA, 21 nt, Homo sapiens
uagaauauuuuaagaauuuca

SEQ ID NO: 790003 - RNA, 16 nt, Homo sapiens
uagaauccgaagggaa

SEQ ID NO: 790004 - RNA, 19 nt, Homo sapiens
uagaaugaucuauugcuca

SEQ ID NO: 790005 - RNA, 20 nt, Homo sapiens
uagaaugaucuauugcucau

SEQ ID NO: 790006 - RNA, 12 nt, Homo sapiens
uagaaugcagcu

SEQ ID NO: 790007 - RNA, 23 nt, Homo sapiens
uagaauggaggaagaacaacaaa

SEQ ID NO: 790008 - RNA, 22 nt, Homo sapiens
uagaauggagggcaacauucca

SEQ ID NO: 790009 - RNA, 20 nt, Homo sapiens
uagaauggauucaacacugu

SEQ ID NO: 790010 - RNA, 14 nt, Homo sapiens
uagaauguaaggua

SEQ ID NO: 790011 - RNA, 20 nt, Homo sapiens
uagaauguggauuugauuca

SEQ ID NO: 790012 - RNA, 18 nt, Homo sapiens
uagaauuauaacuguaaa

SEQ ID NO: 790013 - RNA, 16 nt, Homo sapiens
uagaauucuagugcug

SEQ ID NO: 790014 - RNA, 15 nt, Homo sapiens
uagacaaaaaguaua

SEQ ID NO: 790015 - RNA, 15 nt, Homo sapiens
uagacaaacagcauc

SEQ ID NO: 790016 - RNA, 16 nt, Homo sapiens
uagacaaucacuacaa

SEQ ID NO: 790017 - RNA, 22 nt, Homo sapiens
uagacacagggaugauucccac

SEQ ID NO: 790018 - RNA, 21 nt, Homo sapiens
uagacauggagguucuaaggc

SEQ ID NO: 790019 - RNA, 14 nt, Homo sapiens
uagaccaccuaaua

SEQ ID NO: 790020 - RNA, 22 nt, Homo sapiens
uagaccuccacacccgugagaa

SEQ ID NO: 790021 - RNA, 15 nt, Homo sapiens
uagacuacaguucug

SEQ ID NO: 790022 - RNA, 14 nt, Homo sapiens
uagacuagcaaucu

SEQ ID NO: 790023 - RNA, 15 nt, Homo sapiens
uagacugagguauaa

SEQ ID NO: 790024 - RNA, 23 nt, Homo sapiens
uagacugccaugcuagacaagcu

SEQ ID NO: 790025 - RNA, 17 nt, Homo sapiens
uagacuuacugcaguua

SEQ ID NO: 790026 - RNA, 15 nt, Homo sapiens
uagagaaauggauuc

SEQ ID NO: 790027 - RNA, 13 nt, Homo sapiens
uagagaagcugaa

SEQ ID NO: 790028 - RNA, 19 nt, Homo sapiens
uagagaaguuacacagaaa

SEQ ID NO: 790029 - RNA, 23 nt, Homo sapiens
uagagacaggacagaauguguuc

SEQ ID NO: 790030 - RNA, 22 nt, Homo sapiens
uagagacaggguuucacugugu

SEQ ID NO: 790031 - RNA, 22 nt, Homo sapiens
uagagacgaggucuugugauau

SEQ ID NO: 790032 - RNA, 20 nt, Homo sapiens
uagagacgguguuuugccau

SEQ ID NO: 790033 - RNA, 15 nt, Homo sapiens
uagagagagaacuuu

SEQ ID NO: 790034 - RNA, 14 nt, Homo sapiens
uagagagagacuau

SEQ ID NO: 790035 - RNA, 13 nt, Homo sapiens
uagagagccuuaa

SEQ ID NO: 790036 - RNA, 19 nt, Homo sapiens
uagagaggacaauacuggg

SEQ ID NO: 790037 - RNA, 18 nt, Homo sapiens
uagagauauguaucauaa

SEQ ID NO: 790038 - RNA, 20 nt, Homo sapiens
uagagauauucuuauuucac

SEQ ID NO: 790039 - RNA, 14 nt, Homo sapiens
uagagaugcaguuu

SEQ ID NO: 790040 - RNA, 19 nt, Homo sapiens
uagagcagccacaaccaaa

SEQ ID NO: 790041 - RNA, 12 nt, Homo sapiens
uagagccagcuu

SEQ ID NO: 790042 - RNA, 22 nt, Homo sapiens
uagagcuaagauacugaugaca

SEQ ID NO: 790043 - RNA, 15 nt, Homo sapiens
uagagcuagcugcca

SEQ ID NO: 790044 - RNA, 14 nt, Homo sapiens
uagagcugccugug

SEQ ID NO: 790045 - RNA, 20 nt, Homo sapiens
uagagcuggaggcuguggga

SEQ ID NO: 790046 - RNA, 21 nt, Homo sapiens
uagaggaaggcugaacucuuc

SEQ ID NO: 790047 - RNA, 17 nt, Homo sapiens
uagaggacgugggaccg

SEQ ID NO: 790048 - RNA, 21 nt, Homo sapiens
uagaggacuucuggcagggaa

SEQ ID NO: 790049 - RNA, 15 nt, Homo sapiens
uagaggcgagccagg

SEQ ID NO: 790050 - RNA, 22 nt, Homo sapiens
uagagguccucaugggucccuu

SEQ ID NO: 790051 - RNA, 23 nt, Homo sapiens
uagaggugggcagcugggcccca

SEQ ID NO: 790052 - RNA, 21 nt, Homo sapiens
uagagguguaacacuugucaa

SEQ ID NO: 790053 - RNA, 13 nt, Homo sapiens
uagaguaacacau

SEQ ID NO: 790054 - RNA, 20 nt, Homo sapiens
uagaguagagguauaauugu

SEQ ID NO: 790055 - RNA, 14 nt, Homo sapiens
uagaguguagccua

SEQ ID NO: 790056 - RNA, 22 nt, Homo sapiens
uagaguguagccuaaagggcag

SEQ ID NO: 790057 - RNA, 18 nt, Homo sapiens
uagaguguuaucagucau

SEQ ID NO: 790058 - RNA, 21 nt, Homo sapiens
uagaguuuacuauuuuagcag

SEQ ID NO: 790059 - RNA, 23 nt, Homo sapiens
uagauaaaagaaccgagcaauuu

SEQ ID NO: 790060 - RNA, 15 nt, Homo sapiens
uagauaaauuucaau

SEQ ID NO: 790061 - RNA, 23 nt, Homo sapiens
uagauaaccuguacuucaaguua

SEQ ID NO: 790062 - RNA, 21 nt, Homo sapiens
uagauacacuaaaaaucugag

SEQ ID NO: 790063 - RNA, 14 nt, Homo sapiens
uagauauaugccuu

SEQ ID NO: 790064 - RNA, 21 nt, Homo sapiens
uagauauugugaaguacauau

SEQ ID NO: 790065 - RNA, 14 nt, Homo sapiens
uagaucaagcauua

SEQ ID NO: 790066 - RNA, 23 nt, Homo sapiens
uagaucaauuauacuacuucuaa

SEQ ID NO: 790067 - RNA, 18 nt, Homo sapiens
uagauccccccacugagc

SEQ ID NO: 790068 - RNA, 13 nt, Homo sapiens
uagaucuuucuag

SEQ ID NO: 790069 - RNA, 14 nt, Homo sapiens
uagaugauguauuu

SEQ ID NO: 790070 - RNA, 22 nt, Homo sapiens
uagaugauuaaauaagauucua

SEQ ID NO: 790071 - RNA, 19 nt, Homo sapiens
uagaugcacguggggccca

SEQ ID NO: 790072 - RNA, 12 nt, Homo sapiens
uagaugcaggag

SEQ ID NO: 790073 - RNA, 20 nt, Homo sapiens
uagaugcauggcuggcacau

SEQ ID NO: 790074 - RNA, 15 nt, Homo sapiens
uagaugccaaaccac

SEQ ID NO: 790075 - RNA, 17 nt, Homo sapiens
uagaugcugacuguacu

SEQ ID NO: 790076 - RNA, 14 nt, Homo sapiens
uagaugcugugaca

SEQ ID NO: 790077 - RNA, 16 nt, Homo sapiens
uagauggaauuuggaa

SEQ ID NO: 790078 - RNA, 21 nt, Homo sapiens
uagauguucuuuucuauuuau

SEQ ID NO: 790079 - RNA, 15 nt, Homo sapiens
uagauuaaacaaaca

SEQ ID NO: 790080 - RNA, 17 nt, Homo sapiens
uagauuaugucuuucca

SEQ ID NO: 790081 - RNA, 15 nt, Homo sapiens
uagauuuaagugaau

SEQ ID NO: 790082 - RNA, 13 nt, Homo sapiens
uagauuucuaaag

SEQ ID NO: 790083 - RNA, 21 nt, Homo sapiens
uagauuucuauaggauuuuuc

SEQ ID NO: 790084 - RNA, 20 nt, Homo sapiens
uagauuuggaggcuaccuca

SEQ ID NO: 790085 - RNA, 19 nt, Homo sapiens
uagauuuucuuuugccuuu

SEQ ID NO: 790086 - RNA, 14 nt, Homo sapiens
uagcaaacuuugua

SEQ ID NO: 790087 - RNA, 20 nt, Homo sapiens
uagcaaacuuuguaugucau

SEQ ID NO: 790088 - RNA, 23 nt, Homo sapiens
uagcaaagcaaaaggcugagaag

SEQ ID NO: 790089 - RNA, 13 nt, Homo sapiens
uagcaaaugacau

SEQ ID NO: 790090 - RNA, 19 nt, Homo sapiens
uagcaaauggcagaaccaa

SEQ ID NO: 790091 - RNA, 20 nt, Homo sapiens
uagcaaauggcagaaccaaa

SEQ ID NO: 790092 - RNA, 21 nt, Homo sapiens
uagcaaauggcagaaccaaag

SEQ ID NO: 790093 - RNA, 17 nt, Homo sapiens
uagcaagaagauucuaa

SEQ ID NO: 790094 - RNA, 16 nt, Homo sapiens
uagcaagcuuuugcuc

SEQ ID NO: 790095 - RNA, 22 nt, Homo sapiens
uagcaaugugccuugauugauu

SEQ ID NO: 790096 - RNA, 20 nt, Homo sapiens
uagcaauuuaauauuuugca

SEQ ID NO: 790097 - RNA, 17 nt, Homo sapiens
uagcacacuuuuccaca

SEQ ID NO: 790098 - RNA, 18 nt, Homo sapiens
uagcaccuccacauaccu

SEQ ID NO: 790099 - RNA, 18 nt, Homo sapiens
uagcaccuuaucuaugau

SEQ ID NO: 790100 - RNA, 13 nt, Homo sapiens
uagcagaaaucua

SEQ ID NO: 790101 - RNA, 14 nt, Homo sapiens
uagcagauggagua

SEQ ID NO: 790102 - RNA, 16 nt, Homo sapiens
uagcagaugguuucca

SEQ ID NO: 790103 - RNA, 21 nt, Homo sapiens
uagcagcaggcucaggcacau

SEQ ID NO: 790104 - RNA, 17 nt, Homo sapiens
uagcagcuaucucucag

SEQ ID NO: 790105 - RNA, 13 nt, Homo sapiens
uagcagcugugau

SEQ ID NO: 790106 - RNA, 22 nt, Homo sapiens
uagcaucaguagauuucuggca

SEQ ID NO: 790107 - RNA, 14 nt, Homo sapiens
uagcaucccuggaa

SEQ ID NO: 790108 - RNA, 22 nt, Homo sapiens
uagcaugcugcuuuuuguacuu

SEQ ID NO: 790109 - RNA, 20 nt, Homo sapiens
uagcauguuccuccuuuucu

SEQ ID NO: 790110 - RNA, 13 nt, Homo sapiens
uagcauugcacuu

SEQ ID NO: 790111 - RNA, 20 nt, Homo sapiens
uagccaaaccaggacccugu

SEQ ID NO: 790112 - RNA, 23 nt, Homo sapiens
uagccaagugcagggccuguaau

SEQ ID NO: 790113 - RNA, 15 nt, Homo sapiens
uagccaaugucuccu

SEQ ID NO: 790114 - RNA, 16 nt, Homo sapiens
uagccacaauucuguc

SEQ ID NO: 790115 - RNA, 17 nt, Homo sapiens
uagccagcacuuguaua

SEQ ID NO: 790116 - RNA, 12 nt, Homo sapiens
uagccagcauuu

SEQ ID NO: 790117 - RNA, 18 nt, Homo sapiens
uagccagcugugcacuuu

SEQ ID NO: 790118 - RNA, 19 nt, Homo sapiens
uagccagcugugcacuuuc

SEQ ID NO: 790119 - RNA, 19 nt, Homo sapiens
uagccauaucagggguaca

SEQ ID NO: 790120 - RNA, 16 nt, Homo sapiens
uagccaucauaacuca

SEQ ID NO: 790121 - RNA, 16 nt, Homo sapiens
uagcccagcacuguga

SEQ ID NO: 790122 - RNA, 16 nt, Homo sapiens
uagcccuaaaaugaca

SEQ ID NO: 790123 - RNA, 23 nt, Homo sapiens
uagcccuaaaaugacaagccuuc

SEQ ID NO: 790124 - RNA, 14 nt, Homo sapiens
uagcccugucugcu

SEQ ID NO: 790125 - RNA, 17 nt, Homo sapiens
uagccgcccaugcacug

SEQ ID NO: 790126 - RNA, 22 nt, Homo sapiens
uagccuggauauuauucuugua

SEQ ID NO: 790127 - RNA, 18 nt, Homo sapiens
uagccugggcucacugug

SEQ ID NO: 790128 - RNA, 15 nt, Homo sapiens
uagccuuugucccag

SEQ ID NO: 790129 - RNA, 17 nt, Homo sapiens
uagcuagaagugggcca

SEQ ID NO: 790130 - RNA, 17 nt, Homo sapiens
uagcuaugagcuuuuaa

SEQ ID NO: 790131 - RNA, 19 nt, Homo sapiens
uagcuccauaaaguacaaa

SEQ ID NO: 790132 - RNA, 15 nt, Homo sapiens
uagcuccccugcuga

SEQ ID NO: 790133 - RNA, 20 nt, Homo sapiens
uagcucucccaacucuugca

SEQ ID NO: 790134 - RNA, 23 nt, Homo sapiens
uagcugagaagcaaugggucacu

SEQ ID NO: 790135 - RNA, 18 nt, Homo sapiens
uagcugggacuacagggg

SEQ ID NO: 790136 - RNA, 15 nt, Homo sapiens
uagcugugucagaau

SEQ ID NO: 790137 - RNA, 23 nt, Homo sapiens
uagcugugucauguauauaccuu

SEQ ID NO: 790138 - RNA, 18 nt, Homo sapiens
uagcuuaaaccaacaaua

SEQ ID NO: 790139 - RNA, 16 nt, Homo sapiens
uagcuuagaccucagc

SEQ ID NO: 790140 - RNA, 19 nt, Homo sapiens
uagcuuagaccucagccug

SEQ ID NO: 790141 - RNA, 13 nt, Homo sapiens
uagcuuagcuguc

SEQ ID NO: 790142 - RNA, 14 nt, Homo sapiens
uagcuuagcugucu

SEQ ID NO: 790143 - RNA, 18 nt, Homo sapiens
uagcuuagcugucucaga

SEQ ID NO: 790144 - RNA, 23 nt, Homo sapiens
uagcuuauaagagggcauauaca

SEQ ID NO: 790145 - RNA, 17 nt, Homo sapiens
uagcuucugcaauguuu

SEQ ID NO: 790146 - RNA, 20 nt, Homo sapiens
uagcuucugcaauguuuauc

SEQ ID NO: 790147 - RNA, 13 nt, Homo sapiens
uagcuugcaccuu

SEQ ID NO: 790148 - RNA, 16 nt, Homo sapiens
uagcuuuagggcaaua

SEQ ID NO: 790149 - RNA, 15 nt, Homo sapiens
uagcuuuauucuuca

SEQ ID NO: 790150 - RNA, 21 nt, Homo sapiens
uagcuuuccuggucccucacc

SEQ ID NO: 790151 - RNA, 18 nt, Homo sapiens
uaggaaagaggaagcaaa

SEQ ID NO: 790152 - RNA, 17 nt, Homo sapiens
uaggaaauuccuucaua

SEQ ID NO: 790153 - RNA, 23 nt, Homo sapiens
uaggaacaaucuuugcuguauac

SEQ ID NO: 790154 - RNA, 16 nt, Homo sapiens
uaggaacgguaaauuu

SEQ ID NO: 790155 - RNA, 14 nt, Homo sapiens
uauauccauaagau

SEQ ID NO: 790156 - RNA, 14 nt, Homo sapiens
uauauccugugacu

SEQ ID NO: 790157 - RNA, 14 nt, Homo sapiens
uauaucgaucucuu

SEQ ID NO: 790158 - RNA, 15 nt, Homo sapiens
uauaucuaccccaga

SEQ ID NO: 790159 - RNA, 14 nt, Homo sapiens
uauaucuauuugag

SEQ ID NO: 790160 - RNA, 22 nt, Homo sapiens
uauaucuguaaauuuaacugca

SEQ ID NO: 790161 - RNA, 14 nt, Homo sapiens
uauaugcacauaua

SEQ ID NO: 790162 - RNA, 19 nt, Homo sapiens
uauaugcuuuuucucagau

SEQ ID NO: 790163 - RNA, 15 nt, Homo sapiens
uauaugguucuccaa

SEQ ID NO: 790164 - RNA, 20 nt, Homo sapiens
uauaugugauuuacauuuca

SEQ ID NO: 790165 - RNA, 13 nt, Homo sapiens
uauauguguauau

SEQ ID NO: 790166 - RNA, 14 nt, Homo sapiens
uauaugugugccua

SEQ ID NO: 790167 - RNA, 17 nt, Homo sapiens
uauauguguguguauau

SEQ ID NO: 790168 - RNA, 17 nt, Homo sapiens
uauauuauaaucuucca

SEQ ID NO: 790169 - RNA, 19 nt, Homo sapiens
uauauuccgcacucaagga

SEQ ID NO: 790170 - RNA, 12 nt, Homo sapiens
uauauugcagua

SEQ ID NO: 790171 - RNA, 21 nt, Homo sapiens
uauauuguagcaguuacagcu

SEQ ID NO: 790172 - RNA, 18 nt, Homo sapiens
uauauuguauaggggcaa

SEQ ID NO: 790173 - RNA, 14 nt, Homo sapiens
uauauuuauacucu

SEQ ID NO: 790174 - RNA, 15 nt, Homo sapiens
uauauuuauacucua

SEQ ID NO: 790175 - RNA, 19 nt, Homo sapiens
uauauuugaaauaguauac

SEQ ID NO: 790176 - RNA, 18 nt, Homo sapiens
uauauuuguaaacuacaa

SEQ ID NO: 790177 - RNA, 19 nt, Homo sapiens
uauauuuguaaacuacaaa

SEQ ID NO: 790178 - RNA, 21 nt, Homo sapiens
uauauuuuccugauagcauau

SEQ ID NO: 790179 - RNA, 19 nt, Homo sapiens
uauauuuuugguugucaau

SEQ ID NO: 790180 - RNA, 21 nt, Homo sapiens
uaucaaaaagcuaaugugcag

SEQ ID NO: 790181 - RNA, 18 nt, Homo sapiens
uaucaacauaccuuggcc

SEQ ID NO: 790182 - RNA, 13 nt, Homo sapiens
uaucaagcuuuua

SEQ ID NO: 790183 - RNA, 16 nt, Homo sapiens
uaucaauggauuuauc

SEQ ID NO: 790184 - RNA, 14 nt, Homo sapiens
uaucaccucucuuc

SEQ ID NO: 790185 - RNA, 18 nt, Homo sapiens
uaucaccucuuaugcaca

SEQ ID NO: 790186 - RNA, 20 nt, Homo sapiens
uaucacugucuuugacugug

SEQ ID NO: 790187 - RNA, 18 nt, Homo sapiens
uaucagaaauagauuucc

SEQ ID NO: 790188 - RNA, 18 nt, Homo sapiens
uaucagaucuaucuuguc

SEQ ID NO: 790189 - RNA, 16 nt, Homo sapiens
uaucagccuugcuaaa

SEQ ID NO: 790190 - RNA, 15 nt, Homo sapiens
uaucagcucucugca

SEQ ID NO: 790191 - RNA, 17 nt, Homo sapiens
uaucaggggugcauucu

SEQ ID NO: 790192 - RNA, 22 nt, Homo sapiens
uaucaggggugcauucuggcca

SEQ ID NO: 790193 - RNA, 15 nt, Homo sapiens
uaucaguacaugccu

SEQ ID NO: 790194 - RNA, 15 nt, Homo sapiens
uaucaguauugugaa

SEQ ID NO: 790195 - RNA, 14 nt, Homo sapiens
uaucagucauaacu

SEQ ID NO: 790196 - RNA, 15 nt, Homo sapiens
uaucaguuacccacu

SEQ ID NO: 790197 - RNA, 21 nt, Homo sapiens
uaucaguugagcuucauauac

SEQ ID NO: 790198 - RNA, 17 nt, Homo sapiens
uaucaguugcaauaaua

SEQ ID NO: 790199 - RNA, 19 nt, Homo sapiens
uaucauaauucagcacuua

SEQ ID NO: 790200 - RNA, 19 nt, Homo sapiens
uaucaugaagcacaucaau

SEQ ID NO: 790201 - RNA, 16 nt, Homo sapiens
uaucauuccaauucua

SEQ ID NO: 790202 - RNA, 23 nt, Homo sapiens
uaucauugcuaaacugaugacuu

SEQ ID NO: 790203 - RNA, 19 nt, Homo sapiens
uauccaagaaucagugaag

SEQ ID NO: 790204 - RNA, 23 nt, Homo sapiens
uauccaagacuuagagcugggaa

SEQ ID NO: 790205 - RNA, 13 nt, Homo sapiens
uauccaccaagaa

SEQ ID NO: 790206 - RNA, 18 nt, Homo sapiens
uauccagcagaucauuua

SEQ ID NO: 790207 - RNA, 19 nt, Homo sapiens
uauccaggcuuaccaaagu

SEQ ID NO: 790208 - RNA, 23 nt, Homo sapiens
uauccauauuuuacugaucucuu

SEQ ID NO: 790209 - RNA, 13 nt, Homo sapiens
uauccauccaugg

SEQ ID NO: 790210 - RNA, 12 nt, Homo sapiens
uauccaucuccu

SEQ ID NO: 790211 - RNA, 12 nt, Homo sapiens
uauccauggcaa

SEQ ID NO: 790212 - RNA, 17 nt, Homo sapiens
uauccuaauuguccaca

SEQ ID NO: 790213 - RNA, 15 nt, Homo sapiens
uauccuagucuucac

SEQ ID NO: 790214 - RNA, 14 nt, Homo sapiens
uauccuauguuaaa

SEQ ID NO: 790215 - RNA, 15 nt, Homo sapiens
uaucgggaacagugu

SEQ ID NO: 790216 - RNA, 20 nt, Homo sapiens
uaucuaauauauaugaauaa

SEQ ID NO: 790217 - RNA, 12 nt, Homo sapiens
uaucuacuacaa

SEQ ID NO: 790218 - RNA, 12 nt, Homo sapiens
uaucuacugugg

SEQ ID NO: 790219 - RNA, 20 nt, Homo sapiens
uaucuauuuguacaauuuua

SEQ ID NO: 790220 - RNA, 21 nt, Homo sapiens
uaucuccagcggcccugucau

SEQ ID NO: 790221 - RNA, 16 nt, Homo sapiens
uaucucuucagucucu

SEQ ID NO: 790222 - RNA, 17 nt, Homo sapiens
uaucucuucagucucua

SEQ ID NO: 790223 - RNA, 23 nt, Homo sapiens
uaucugauuuccuaaugucagag

SEQ ID NO: 790224 - RNA, 19 nt, Homo sapiens
uaucugcaugugucaugaa

SEQ ID NO: 790225 - RNA, 21 nt, Homo sapiens
uaucugcucuuaggugcuucu

SEQ ID NO: 790226 - RNA, 20 nt, Homo sapiens
uaucuggaggccuuccagcu

SEQ ID NO: 790227 - RNA, 19 nt, Homo sapiens
uaucugugugugauuugcu

SEQ ID NO: 790228 - RNA, 20 nt, Homo sapiens
uaucugugugugauuugcua

SEQ ID NO: 790229 - RNA, 13 nt, Homo sapiens
uaucuguucuguu

SEQ ID NO: 790230 - RNA, 17 nt, Homo sapiens
uaucuguuuucuaccuc

SEQ ID NO: 790231 - RNA, 19 nt, Homo sapiens
uaucuguuuucuaccuccu

SEQ ID NO: 790232 - RNA, 20 nt, Homo sapiens
uaucuuccaaaugcaauuug

SEQ ID NO: 790233 - RNA, 17 nt, Homo sapiens
uaucuuccagaaacuac

SEQ ID NO: 790234 - RNA, 22 nt, Homo sapiens
uaucuucccuuuauuacaagaa

SEQ ID NO: 790235 - RNA, 17 nt, Homo sapiens
uaucuucucaaguucua

SEQ ID NO: 790236 - RNA, 21 nt, Homo sapiens
uaucuucuguuucauaaugca

SEQ ID NO: 790237 - RNA, 18 nt, Homo sapiens
uaucuugauuucacugga

SEQ ID NO: 790238 - RNA, 19 nt, Homo sapiens
uaucuugcaccccaaagcu

SEQ ID NO: 790239 - RNA, 20 nt, Homo sapiens
uaucuuguagcuuuaucaaa

SEQ ID NO: 790240 - RNA, 14 nt, Homo sapiens
uaucuugugcuucu

SEQ ID NO: 790241 - RNA, 16 nt, Homo sapiens
uaucuuucgugauaaa

SEQ ID NO: 790242 - RNA, 17 nt, Homo sapiens
uaucuuucuaaaacugc

SEQ ID NO: 790243 - RNA, 13 nt, Homo sapiens
uaucuuugauucu

SEQ ID NO: 790244 - RNA, 20 nt, Homo sapiens
uaucuuuugaauucuugaua

SEQ ID NO: 790245 - RNA, 14 nt, Homo sapiens
uaugaaaagaauuu

SEQ ID NO: 790246 - RNA, 18 nt, Homo sapiens
uaugaaaagaggggacca

SEQ ID NO: 790247 - RNA, 13 nt, Homo sapiens
uaugaaacuauug

SEQ ID NO: 790248 - RNA, 12 nt, Homo sapiens
uaugaacacaga

SEQ ID NO: 790249 - RNA, 15 nt, Homo sapiens
uaugaaccuucuuaa

SEQ ID NO: 790250 - RNA, 13 nt, Homo sapiens
uaugaacuuuaua

SEQ ID NO: 790251 - RNA, 22 nt, Homo sapiens
uaugacagugaagcagcacugu

SEQ ID NO: 790252 - RNA, 16 nt, Homo sapiens
uaugacaucacuugua

SEQ ID NO: 790253 - RNA, 20 nt, Homo sapiens
uaugaccauauuuacucuuu

SEQ ID NO: 790254 - RNA, 18 nt, Homo sapiens
uaugacugauuacucaga

SEQ ID NO: 790255 - RNA, 18 nt, Homo sapiens
uaugagaauauaccuuau

SEQ ID NO: 790256 - RNA, 22 nt, Homo sapiens
uaugagccaggcaucauacuaa

SEQ ID NO: 790257 - RNA, 20 nt, Homo sapiens
uaugaguaauacaucaaaga

SEQ ID NO: 790258 - RNA, 16 nt, Homo sapiens
uaugagucuucuguaa

SEQ ID NO: 790259 - RNA, 21 nt, Homo sapiens
uaugaguuuuugauagcuuua

SEQ ID NO: 790260 - RNA, 23 nt, Homo sapiens
uaugaguuuuugauagcuuuauu

SEQ ID NO: 790261 - RNA, 18 nt, Homo sapiens
uaugaucaauaaaggaca

SEQ ID NO: 790262 - RNA, 20 nt, Homo sapiens
uaugaugagcauacacacag

SEQ ID NO: 790263 - RNA, 12 nt, Homo sapiens
uaugaugcacuu

SEQ ID NO: 790264 - RNA, 18 nt, Homo sapiens
uaugauucucuugagaua

SEQ ID NO: 790265 - RNA, 17 nt, Homo sapiens
uaugauucugcuuuuac

SEQ ID NO: 790266 - RNA, 18 nt, Homo sapiens
uaugauuuaagacuauga

SEQ ID NO: 790267 - RNA, 19 nt, Homo sapiens
uaugauuuaagacuaugau

SEQ ID NO: 790268 - RNA, 18 nt, Homo sapiens
uaugcaaaccucaucuuu

SEQ ID NO: 790269 - RNA, 20 nt, Homo sapiens
uaugcaaagaugaacccgag

SEQ ID NO: 790270 - RNA, 17 nt, Homo sapiens
ucugcaugucuacucag

SEQ ID NO: 790271 - RNA, 19 nt, Homo sapiens
ucugcauguuacauaagau

SEQ ID NO: 790272 - RNA, 19 nt, Homo sapiens
ucugcauuccugaugacca

SEQ ID NO: 790273 - RNA, 16 nt, Homo sapiens
ucugccagaauacugg

SEQ ID NO: 790274 - RNA, 22 nt, Homo sapiens
ucugccagcaucugcagccacu

SEQ ID NO: 790275 - RNA, 23 nt, Homo sapiens
ucugccagcgccaaaacaagcca

SEQ ID NO: 790276 - RNA, 16 nt, Homo sapiens
ucugccauaucaguga

SEQ ID NO: 790277 - RNA, 15 nt, Homo sapiens
ucugccauguggcag

SEQ ID NO: 790278 - RNA, 18 nt, Homo sapiens
ucugccauuaaaacauua

SEQ ID NO: 790279 - RNA, 13 nt, Homo sapiens
ucugcccaccuac

SEQ ID NO: 790280 - RNA, 16 nt, Homo sapiens
ucugcccagaauucua

SEQ ID NO: 790281 - RNA, 19 nt, Homo sapiens
ucugcccuggguucuucca

SEQ ID NO: 790282 - RNA, 13 nt, Homo sapiens
ucugccgccucag

SEQ ID NO: 790283 - RNA, 16 nt, Homo sapiens
ucugccgcuaccuccc

SEQ ID NO: 790284 - RNA, 16 nt, Homo sapiens
ucugccgugugcccuc

SEQ ID NO: 790285 - RNA, 21 nt, Homo sapiens
ucugccucagccuccugagua

SEQ ID NO: 790286 - RNA, 12 nt, Homo sapiens
ucugccugugga

SEQ ID NO: 790287 - RNA, 19 nt, Homo sapiens
ucugccuguuauaacucug

SEQ ID NO: 790288 - RNA, 22 nt, Homo sapiens
ucugccuguuauaacucugcac

SEQ ID NO: 790289 - RNA, 23 nt, Homo sapiens
ucugccuuaaacacacauugcag

SEQ ID NO: 790290 - RNA, 13 nt, Homo sapiens
ucugccuucaggc

SEQ ID NO: 790291 - RNA, 15 nt, Homo sapiens
ucugccuucucagga

SEQ ID NO: 790292 - RNA, 16 nt, Homo sapiens
ucugcgcuguguacaa

SEQ ID NO: 790293 - RNA, 19 nt, Homo sapiens
ucugcucaaaacuuucaaa

SEQ ID NO: 790294 - RNA, 10 nt, Homo sapiens
ucugcuccac

SEQ ID NO: 790295 - RNA, 13 nt, Homo sapiens
ucugcuccugcuu

SEQ ID NO: 790296 - RNA, 21 nt, Homo sapiens
ucugcugaaucaaaucucuuc

SEQ ID NO: 790297 - RNA, 15 nt, Homo sapiens
ucugcugaccaaaug

SEQ ID NO: 790298 - RNA, 12 nt, Homo sapiens
ucugcuuaccuu

SEQ ID NO: 790299 - RNA, 16 nt, Homo sapiens
ucugcuucuccaagga

SEQ ID NO: 790300 - RNA, 17 nt, Homo sapiens
ucugcuuuucccauugc

SEQ ID NO: 790301 - RNA, 23 nt, Homo sapiens
ucuggaaaaaaacaaaaacagaa

SEQ ID NO: 790302 - RNA, 23 nt, Homo sapiens
ucuggaacauggacuuucuugca

SEQ ID NO: 790303 - RNA, 13 nt, Homo sapiens
ucuggaaccucag

SEQ ID NO: 790304 - RNA, 13 nt, Homo sapiens
ucuggaaccuuau

SEQ ID NO: 790305 - RNA, 14 nt, Homo sapiens
ucuggaacugucug

SEQ ID NO: 790306 - RNA, 16 nt, Homo sapiens
ucuggaagucaucuca

SEQ ID NO: 790307 - RNA, 13 nt, Homo sapiens
ucuggaaucugga

SEQ ID NO: 790308 - RNA, 14 nt, Homo sapiens
ucuggaccccaaag

SEQ ID NO: 790309 - RNA, 15 nt, Homo sapiens
ucuggaccccaaaga

SEQ ID NO: 790310 - RNA, 15 nt, Homo sapiens
ucuggaccuagggug

SEQ ID NO: 790311 - RNA, 22 nt, Homo sapiens
ucuggagggacaaacucacuca

SEQ ID NO: 790312 - RNA, 17 nt, Homo sapiens
ucuggagugauucuaga

SEQ ID NO: 790313 - RNA, 19 nt, Homo sapiens
ucuggaucuccugcugccu

SEQ ID NO: 790314 - RNA, 20 nt, Homo sapiens
ucuggcaacccuagucugcu

SEQ ID NO: 790315 - RNA, 19 nt, Homo sapiens
ucuggcaagccugucuuca

SEQ ID NO: 790316 - RNA, 14 nt, Homo sapiens
ucuggcacacuccc

SEQ ID NO: 790317 - RNA, 19 nt, Homo sapiens
ucuggcaccaucagccugu

SEQ ID NO: 790318 - RNA, 20 nt, Homo sapiens
ucuggcaucuuagaccucca

SEQ ID NO: 790319 - RNA, 14 nt, Homo sapiens
ucuggccaggcaug

SEQ ID NO: 790320 - RNA, 13 nt, Homo sapiens
ucuggcccagaaa

SEQ ID NO: 790321 - RNA, 16 nt, Homo sapiens
ucuggcccuugcuuac

SEQ ID NO: 790322 - RNA, 14 nt, Homo sapiens
ucuggcucuugagg

SEQ ID NO: 790323 - RNA, 19 nt, Homo sapiens
ucuggcugccccaaccugc

SEQ ID NO: 790324 - RNA, 14 nt, Homo sapiens
ucuggcuuugcucu

SEQ ID NO: 790325 - RNA, 19 nt, Homo sapiens
ucugggaaucaacagcaua

SEQ ID NO: 790326 - RNA, 22 nt, Homo sapiens
ucugggacugugcgcuggacuu

SEQ ID NO: 790327 - RNA, 21 nt, Homo sapiens
ucugggagacuuugaagacca

SEQ ID NO: 790328 - RNA, 19 nt, Homo sapiens
ucugggcacaguggacuca

SEQ ID NO: 790329 - RNA, 13 nt, Homo sapiens
ucugggccaguga

SEQ ID NO: 790330 - RNA, 18 nt, Homo sapiens
ucugggcugccaugugaa

SEQ ID NO: 790331 - RNA, 20 nt, Homo sapiens
ucugggcuuggggcuuccua

SEQ ID NO: 790332 - RNA, 17 nt, Homo sapiens
ucuggggagcucaggaa

SEQ ID NO: 790333 - RNA, 21 nt, Homo sapiens
ucuggggaggcaggcauuccu

SEQ ID NO: 790334 - RNA, 21 nt, Homo sapiens
ucuggggggacccagugcaga

SEQ ID NO: 790335 - RNA, 22 nt, Homo sapiens
ucuggggggacccagugcagaa

SEQ ID NO: 790336 - RNA, 16 nt, Homo sapiens
ucuggguuacucuucg

SEQ ID NO: 790337 - RNA, 16 nt, Homo sapiens
ucugguaaaacuuuag

SEQ ID NO: 790338 - RNA, 17 nt, Homo sapiens
ucugguauaauugugua

SEQ ID NO: 790339 - RNA, 16 nt, Homo sapiens
ucuggugacaccagcc

SEQ ID NO: 790340 - RNA, 17 nt, Homo sapiens
ucuggugcuuucuguca

SEQ ID NO: 790341 - RNA, 21 nt, Homo sapiens
ucugguuugaaagaugcagug

SEQ ID NO: 790342 - RNA, 21 nt, Homo sapiens
ucuguaaauuuaacugcauau

SEQ ID NO: 790343 - RNA, 13 nt, Homo sapiens
ucuguaacagacu

SEQ ID NO: 790344 - RNA, 16 nt, Homo sapiens
ucuguaaugguacuga

SEQ ID NO: 790345 - RNA, 13 nt, Homo sapiens
ucuguacuguuac

SEQ ID NO: 790346 - RNA, 15 nt, Homo sapiens
ucuguaguaaacuau

SEQ ID NO: 790347 - RNA, 13 nt, Homo sapiens
ucuguauguguau

SEQ ID NO: 790348 - RNA, 15 nt, Homo sapiens
ucugucaaaugcagu

SEQ ID NO: 790349 - RNA, 13 nt, Homo sapiens
ucugucaacauca

SEQ ID NO: 790350 - RNA, 17 nt, Homo sapiens
ucugucauccucaggaa

SEQ ID NO: 790351 - RNA, 12 nt, Homo sapiens
ucugucaugaac

SEQ ID NO: 790352 - RNA, 18 nt, Homo sapiens
ucuguccugauuucuaca

SEQ ID NO: 790353 - RNA, 18 nt, Homo sapiens
ucuguccuuuaugauccc

SEQ ID NO: 790354 - RNA, 20 nt, Homo sapiens
ucugucuacuguggugaucu

SEQ ID NO: 790355 - RNA, 17 nt, Homo sapiens
ucugucuagacuggccu

SEQ ID NO: 790356 - RNA, 23 nt, Homo sapiens
ucugucucuaaccauucaaauga

SEQ ID NO: 790357 - RNA, 13 nt, Homo sapiens
ucugucuggcuga

SEQ ID NO: 790358 - RNA, 14 nt, Homo sapiens
ucugucuuguucau

SEQ ID NO: 790359 - RNA, 15 nt, Homo sapiens
ucugugaaauucuca

SEQ ID NO: 790360 - RNA, 14 nt, Homo sapiens
ucugugaagaaaga

SEQ ID NO: 790361 - RNA, 14 nt, Homo sapiens
ucugugaugauccu

SEQ ID NO: 790362 - RNA, 15 nt, Homo sapiens
ucugugcacuagccu

SEQ ID NO: 790363 - RNA, 23 nt, Homo sapiens
ucugugcagagaugacuguccaa

SEQ ID NO: 790364 - RNA, 14 nt, Homo sapiens
ucugugccagagau

SEQ ID NO: 790365 - RNA, 14 nt, Homo sapiens
ucugugccccaugc

SEQ ID NO: 790366 - RNA, 16 nt, Homo sapiens
ucugugccccaugccu

SEQ ID NO: 790367 - RNA, 17 nt, Homo sapiens
ucuguggaccacugcau

SEQ ID NO: 790368 - RNA, 22 nt, Homo sapiens
ucugugucccacccaugcagac

SEQ ID NO: 790369 - RNA, 21 nt, Homo sapiens
ucugugugcgcucuguggaug

SEQ ID NO: 790370 - RNA, 17 nt, Homo sapiens
ucuguuaacucuugaag

SEQ ID NO: 790371 - RNA, 15 nt, Homo sapiens
ucuguuaaucaugua

SEQ ID NO: 790372 - RNA, 16 nt, Homo sapiens
ucuguucagaugugca

SEQ ID NO: 790373 - RNA, 17 nt, Homo sapiens
ucuguucccugggcuga

SEQ ID NO: 790374 - RNA, 18 nt, Homo sapiens
ucuguucucccugggaag

SEQ ID NO: 790375 - RNA, 17 nt, Homo sapiens
ucuguugcaaacucagu

SEQ ID NO: 790376 - RNA, 14 nt, Homo sapiens
ucuguuuaacauuu

SEQ ID NO: 790377 - RNA, 17 nt, Homo sapiens
ucuguuuccuuguucca

SEQ ID NO: 790378 - RNA, 12 nt, Homo sapiens
ucuguuugaaac

SEQ ID NO: 790379 - RNA, 14 nt, Homo sapiens
ucuguuugacuuua

SEQ ID NO: 790380 - RNA, 16 nt, Homo sapiens
ucuguuuggaucuaua

SEQ ID NO: 790381 - RNA, 16 nt, Homo sapiens
ucuguuuugccuucac

SEQ ID NO: 790382 - RNA, 19 nt, Homo sapiens
ucuguuuuguuuugcugaa

SEQ ID NO: 790383 - RNA, 17 nt, Homo sapiens
ucuuaaaaguacuuuaa

SEQ ID NO: 790384 - RNA, 15 nt, Homo sapiens
ucuuaaaauguuaac

SEQ ID NO: 790385 - RNA, 19 nt, Homo sapiens
ucuuaaacuggaacaugcu

SEQ ID NO: 790386 - RNA, 16 nt, Homo sapiens
ugaaagaugaucauuu

SEQ ID NO: 790387 - RNA, 13 nt, Homo sapiens
ugaaagaugcagu

SEQ ID NO: 790388 - RNA, 16 nt, Homo sapiens
ugaaagcaaguguuca

SEQ ID NO: 790389 - RNA, 24 nt, Homo sapiens
ugaaagcacaugaauaauuucacu

SEQ ID NO: 790390 - RNA, 22 nt, Homo sapiens
ugaaagccaacaacucugccuu

SEQ ID NO: 790391 - RNA, 17 nt, Homo sapiens
ugaaagcccaaggugcu

SEQ ID NO: 790392 - RNA, 15 nt, Homo sapiens
ugaaaggaacacugg

SEQ ID NO: 790393 - RNA, 19 nt, Homo sapiens
ugaaaggagacauugcucu

SEQ ID NO: 790394 - RNA, 14 nt, Homo sapiens
ugaaaggaugaucc

SEQ ID NO: 790395 - RNA, 16 nt, Homo sapiens
ugaaaggauguggaag

SEQ ID NO: 790396 - RNA, 19 nt, Homo sapiens
ugaaaggggacaccuguac

SEQ ID NO: 790397 - RNA, 23 nt, Homo sapiens
ugaaagguacuauauuugcuaga

SEQ ID NO: 790398 - RNA, 14 nt, Homo sapiens
ugaaaguaauugag

SEQ ID NO: 790399 - RNA, 23 nt, Homo sapiens
ugaaaguagagcuagcugccacu

SEQ ID NO: 790400 - RNA, 17 nt, Homo sapiens
ugaaaguauaaugcagu

SEQ ID NO: 790401 - RNA, 23 nt, Homo sapiens
ugaaagucacggcugcgcacugu

SEQ ID NO: 790402 - RNA, 17 nt, Homo sapiens
ugaaaguggacaaggag

SEQ ID NO: 790403 - RNA, 15 nt, Homo sapiens
ugaaaguuaacauua

SEQ ID NO: 790404 - RNA, 18 nt, Homo sapiens
ugaaauaacuaccuucca

SEQ ID NO: 790405 - RNA, 16 nt, Homo sapiens
ugaaauaaugcacuga

SEQ ID NO: 790406 - RNA, 16 nt, Homo sapiens
ugaaauauaaucagaa

SEQ ID NO: 790407 - RNA, 12 nt, Homo sapiens
ugaaauaugcau

SEQ ID NO: 790408 - RNA, 15 nt, Homo sapiens
ugaaaucaaguucca

SEQ ID NO: 790409 - RNA, 15 nt, Homo sapiens
ugaaaugaaagggaa

SEQ ID NO: 790410 - RNA, 16 nt, Homo sapiens
ugaaaugaaugucuga

SEQ ID NO: 790411 - RNA, 16 nt, Homo sapiens
ugaaaugcaucagguc

SEQ ID NO: 790412 - RNA, 19 nt, Homo sapiens
ugaaaugcucuuuugcaca

SEQ ID NO: 790413 - RNA, 21 nt, Homo sapiens
ugaaaugcucuuuugcacaag

SEQ ID NO: 790414 - RNA, 13 nt, Homo sapiens
ugaaaugcuucca

SEQ ID NO: 790415 - RNA, 15 nt, Homo sapiens
ugaaaugguugucac

SEQ ID NO: 790416 - RNA, 18 nt, Homo sapiens
ugaaauguucaagucaug

SEQ ID NO: 790417 - RNA, 16 nt, Homo sapiens
ugaaauuagggcccaa

SEQ ID NO: 790418 - RNA, 15 nt, Homo sapiens
ugaaauuauaaucug

SEQ ID NO: 790419 - RNA, 20 nt, Homo sapiens
ugaaauuauguauguuuaca

SEQ ID NO: 790420 - RNA, 22 nt, Homo sapiens
ugaaauucaggaugcugugaua

SEQ ID NO: 790421 - RNA, 15 nt, Homo sapiens
ugaaauucucaucag

SEQ ID NO: 790422 - RNA, 15 nt, Homo sapiens
ugaaauuguaucuca

SEQ ID NO: 790423 - RNA, 14 nt, Homo sapiens
ugaaauugucaaag

SEQ ID NO: 790424 - RNA, 23 nt, Homo sapiens
ugaaauuguuuuaccagcuccca

SEQ ID NO: 790425 - RNA, 15 nt, Homo sapiens
ugaaauuuauucaca

SEQ ID NO: 790426 - RNA, 13 nt, Homo sapiens
ugaaauuuuaccg

SEQ ID NO: 790427 - RNA, 23 nt, Homo sapiens
ugaacaaacuaugaucacaguga

SEQ ID NO: 790428 - RNA, 13 nt, Homo sapiens
ugaacacaguguc

SEQ ID NO: 790429 - RNA, 15 nt, Homo sapiens
ugaacacaucagcuu

SEQ ID NO: 790430 - RNA, 20 nt, Homo sapiens
ugaacaccuauugcacuugg

SEQ ID NO: 790431 - RNA, 19 nt, Homo sapiens
ugaacacucuacuacaugu

SEQ ID NO: 790432 - RNA, 23 nt, Homo sapiens
ugaacacucuacuacaugugacu

SEQ ID NO: 790433 - RNA, 19 nt, Homo sapiens
ugaacacuuauaagugaag

SEQ ID NO: 790434 - RNA, 21 nt, Homo sapiens
ugaacaucuuuaggagacuaa

SEQ ID NO: 790435 - RNA, 18 nt, Homo sapiens
ugaacauuaguugcacua

SEQ ID NO: 790436 - RNA, 20 nt, Homo sapiens
ugaacauuggagaaucucaa

SEQ ID NO: 790437 - RNA, 15 nt, Homo sapiens
ugaacauuguacugu

SEQ ID NO: 790438 - RNA, 19 nt, Homo sapiens
ugaacauuguacuguugcu

SEQ ID NO: 790439 - RNA, 11 nt, Homo sapiens
ugaacauuuca

SEQ ID NO: 790440 - RNA, 23 nt, Homo sapiens
ugaacauuuugcaaaacuuauca

SEQ ID NO: 790441 - RNA, 21 nt, Homo sapiens
ugaaccaaugcuuucucaugu

SEQ ID NO: 790442 - RNA, 19 nt, Homo sapiens
ugaaccccuggccagcucu

SEQ ID NO: 790443 - RNA, 18 nt, Homo sapiens
ugaacccgaggcugagaa

SEQ ID NO: 790444 - RNA, 12 nt, Homo sapiens
ugaacccugugc

SEQ ID NO: 790445 - RNA, 16 nt, Homo sapiens
ugaaccuucugcaaca

SEQ ID NO: 790446 - RNA, 18 nt, Homo sapiens
ugaacggcugaauaugaa

SEQ ID NO: 790447 - RNA, 17 nt, Homo sapiens
ugaacuaaucugauguu

SEQ ID NO: 790448 - RNA, 19 nt, Homo sapiens
ugaacuaaucugauguuaa

SEQ ID NO: 790449 - RNA, 20 nt, Homo sapiens
ugaacuacagcuauaccuca

SEQ ID NO: 790450 - RNA, 22 nt, Homo sapiens
ugaacuaccaucugauguuuca

SEQ ID NO: 790451 - RNA, 16 nt, Homo sapiens
ugaacucacccuggga

SEQ ID NO: 790452 - RNA, 17 nt, Homo sapiens
ugaacuccaccgaccaa

SEQ ID NO: 790453 - RNA, 11 nt, Homo sapiens
ugaacuggaag

SEQ ID NO: 790454 - RNA, 15 nt, Homo sapiens
ugaacuuagaacuau

SEQ ID NO: 790455 - RNA, 21 nt, Homo sapiens
ugaacuuggaaagaaaugccc

SEQ ID NO: 790456 - RNA, 18 nt, Homo sapiens
ugaacuuggcuguaauca

SEQ ID NO: 790457 - RNA, 16 nt, Homo sapiens
ugaagaaaagagucca

SEQ ID NO: 790458 - RNA, 20 nt, Homo sapiens
ugaagaaaauucagaaugaa

SEQ ID NO: 790459 - RNA, 18 nt, Homo sapiens
ugaagaacaguaacugcc

SEQ ID NO: 790460 - RNA, 12 nt, Homo sapiens
ugaagaacugac

SEQ ID NO: 790461 - RNA, 23 nt, Homo sapiens
ugaagaagagacucuuugcauau

SEQ ID NO: 790462 - RNA, 19 nt, Homo sapiens
ugaagaagaguuucuccuu

SEQ ID NO: 790463 - RNA, 20 nt, Homo sapiens
ugaagaagaugagccuugca

SEQ ID NO: 790464 - RNA, 23 nt, Homo sapiens
ugaagaaggggguggggggaguu

SEQ ID NO: 790465 - RNA, 15 nt, Homo sapiens
ugaagaaucuaauga

SEQ ID NO: 790466 - RNA, 19 nt, Homo sapiens
ugaagaaucuaaugaaugu

SEQ ID NO: 790467 - RNA, 20 nt, Homo sapiens
ugaagacccuggaguucaaa

SEQ ID NO: 790468 - RNA, 20 nt, Homo sapiens
ugaagagaaccgagcaaaga

SEQ ID NO: 790469 - RNA, 18 nt, Homo sapiens
ugaagagaccaagacucu

SEQ ID NO: 790470 - RNA, 23 nt, Homo sapiens
ugaagagagggacaggcacucca

SEQ ID NO: 790471 - RNA, 21 nt, Homo sapiens
ugaagagauccuucuguaaag

SEQ ID NO: 790472 - RNA, 18 nt, Homo sapiens
ugaagagggagaagggau

SEQ ID NO: 790473 - RNA, 22 nt, Homo sapiens
ugaagaguccgugguugcccua

SEQ ID NO: 790474 - RNA, 19 nt, Homo sapiens
ugaagagugagagggcaug

SEQ ID NO: 790475 - RNA, 20 nt, Homo sapiens
ugaagaguuuacugaagcaa

SEQ ID NO: 790476 - RNA, 14 nt, Homo sapiens
ugaagaguuucaca

SEQ ID NO: 790477 - RNA, 20 nt, Homo sapiens
ugaagauaagaaaugaucuu

SEQ ID NO: 790478 - RNA, 22 nt, Homo sapiens
ugaagaucuaaacuuuugagaa

SEQ ID NO: 790479 - RNA, 23 nt, Homo sapiens
ugaagauguuucaaaaaaucuga

SEQ ID NO: 790480 - RNA, 11 nt, Homo sapiens
ugaagcacuua

SEQ ID NO: 790481 - RNA, 13 nt, Homo sapiens
ugaagcacuuaag

SEQ ID NO: 790482 - RNA, 23 nt, Homo sapiens
ugaagcacuuaagucuuccuuaa

SEQ ID NO: 790483 - RNA, 17 nt, Homo sapiens
ugaagcagaaauguacu

SEQ ID NO: 790484 - RNA, 13 nt, Homo sapiens
ugaagcagugauu

SEQ ID NO: 790485 - RNA, 23 nt, Homo sapiens
ugaagcauaccccggccucucag

SEQ ID NO: 790486 - RNA, 13 nt, Homo sapiens
ugaagccaaagaa

SEQ ID NO: 790487 - RNA, 13 nt, Homo sapiens
ugaagccacugaa

SEQ ID NO: 790488 - RNA, 14 nt, Homo sapiens
ugaagccauuugcc

SEQ ID NO: 790489 - RNA, 20 nt, Homo sapiens
ugaagcguuuuucucaaagg

SEQ ID NO: 790490 - RNA, 21 nt, Homo sapiens
ugaagcuuuaggcagagccau

SEQ ID NO: 790491 - RNA, 16 nt, Homo sapiens
ugaaggaaaaacacaa

SEQ ID NO: 790492 - RNA, 16 nt, Homo sapiens
ugaaggaacauuccuu

SEQ ID NO: 790493 - RNA, 18 nt, Homo sapiens
ugaaggaacauuccuuag

SEQ ID NO: 790494 - RNA, 13 nt, Homo sapiens
ugaaggacacuuc

SEQ ID NO: 790495 - RNA, 14 nt, Homo sapiens
ugaaggauaagaga

SEQ ID NO: 790496 - RNA, 20 nt, Homo sapiens
ugaaggcauccccaggcccu

SEQ ID NO: 790497 - RNA, 15 nt, Homo sapiens
ugaaggcauguaagg

SEQ ID NO: 790498 - RNA, 15 nt, Homo sapiens
ugaaggcuuacuuca

SEQ ID NO: 790499 - RNA, 16 nt, Homo sapiens
ugaaggcuuacuucag

SEQ ID NO: 790500 - RNA, 13 nt, Homo sapiens
ugagagacugcca

SEQ ID NO: 790501 - RNA, 16 nt, Homo sapiens
ugagagcgacacagac

SEQ ID NO: 790502 - RNA, 19 nt, Homo sapiens
ugagaggccacagugcaau

SEQ ID NO: 790503 - RNA, 14 nt, Homo sapiens
ugagagucaaagcu

SEQ ID NO: 790504 - RNA, 22 nt, Homo sapiens
ugagagucuagauucucuggcu

SEQ ID NO: 790505 - RNA, 20 nt, Homo sapiens
ugagaguggugcccuggaac

SEQ ID NO: 790506 - RNA, 22 nt, Homo sapiens
ugagaugcaggugaugccauua

SEQ ID NO: 790507 - RNA, 17 nt, Homo sapiens
ugagauggagugagcug

SEQ ID NO: 790508 - RNA, 15 nt, Homo sapiens
ugagaugugcuuugc

SEQ ID NO: 790509 - RNA, 21 nt, Homo sapiens
ugagauucagaugucauuuag

SEQ ID NO: 790510 - RNA, 17 nt, Homo sapiens
ugagauuugggcugugc

SEQ ID NO: 790511 - RNA, 22 nt, Homo sapiens
ugagauuuugaaaaucuaccaa

SEQ ID NO: 790512 - RNA, 19 nt, Homo sapiens
ugagcaagaugauguaaug

SEQ ID NO: 790513 - RNA, 22 nt, Homo sapiens
ugagcaaggagcacaagccaca

SEQ ID NO: 790514 - RNA, 18 nt, Homo sapiens
ugagcaagggggcccaaa

SEQ ID NO: 790515 - RNA, 21 nt, Homo sapiens
ugagcacacccgugugcacac

SEQ ID NO: 790516 - RNA, 17 nt, Homo sapiens
ugagcagaauacugguc

SEQ ID NO: 790517 - RNA, 12 nt, Homo sapiens
ugagcagaugau

SEQ ID NO: 790518 - RNA, 15 nt, Homo sapiens
ugagcagaugauucc

SEQ ID NO: 790519 - RNA, 16 nt, Homo sapiens
ugagcagucacacugu

SEQ ID NO: 790520 - RNA, 14 nt, Homo sapiens
ugagccacagacca

SEQ ID NO: 790521 - RNA, 20 nt, Homo sapiens
ugagccaugaaaucaacuca

SEQ ID NO: 790522 - RNA, 14 nt, Homo sapiens
ugagccccuacccc

SEQ ID NO: 790523 - RNA, 16 nt, Homo sapiens
ugagccccuaccccac

SEQ ID NO: 790524 - RNA, 20 nt, Homo sapiens
ugagccccuggaggcacuga

SEQ ID NO: 790525 - RNA, 21 nt, Homo sapiens
ugagccuggcccauagaaaca

SEQ ID NO: 790526 - RNA, 23 nt, Homo sapiens
ugagccuggcuggagagcugcua

SEQ ID NO: 790527 - RNA, 13 nt, Homo sapiens
ugagcguuugcac

SEQ ID NO: 790528 - RNA, 13 nt, Homo sapiens
ugagcuacaguag

SEQ ID NO: 790529 - RNA, 13 nt, Homo sapiens
ugagcucaggcau

SEQ ID NO: 790530 - RNA, 21 nt, Homo sapiens
ugagcucccaccucccuuccc

SEQ ID NO: 790531 - RNA, 19 nt, Homo sapiens
ugagcucccucgcuguaug

SEQ ID NO: 790532 - RNA, 16 nt, Homo sapiens
ugagcucugacagugu

SEQ ID NO: 790533 - RNA, 22 nt, Homo sapiens
ugagcugcaacuucuuacuucc

SEQ ID NO: 790534 - RNA, 13 nt, Homo sapiens
ugagcugcuccau

SEQ ID NO: 790535 - RNA, 18 nt, Homo sapiens
ugagcuggaaggggccac

SEQ ID NO: 790536 - RNA, 17 nt, Homo sapiens
ugagcuggaucacuuga

SEQ ID NO: 790537 - RNA, 19 nt, Homo sapiens
ugagcuggcaaccagccag

SEQ ID NO: 790538 - RNA, 21 nt, Homo sapiens
ugagcuggccucucuagcaca

SEQ ID NO: 790539 - RNA, 18 nt, Homo sapiens
ugagcuucaaggugauca

SEQ ID NO: 790540 - RNA, 13 nt, Homo sapiens
ugagcuucuuuag

SEQ ID NO: 790541 - RNA, 21 nt, Homo sapiens
ugagcuuggaaaggaccagua

SEQ ID NO: 790542 - RNA, 23 nt, Homo sapiens
ugagcuuuccauguugcugccaa

SEQ ID NO: 790543 - RNA, 15 nt, Homo sapiens
ugagcuuugcugcua

SEQ ID NO: 790544 - RNA, 16 nt, Homo sapiens
ugaggaaaauucuuaa

SEQ ID NO: 790545 - RNA, 12 nt, Homo sapiens
ugaggaacuguc

SEQ ID NO: 790546 - RNA, 16 nt, Homo sapiens
ugaggaauauuucaag

SEQ ID NO: 790547 - RNA, 18 nt, Homo sapiens
ugaggaauguacuuuuaa

SEQ ID NO: 790548 - RNA, 15 nt, Homo sapiens
ugaggaccacuccug

SEQ ID NO: 790549 - RNA, 20 nt, Homo sapiens
ugaggagagcacccuaggca

SEQ ID NO: 790550 - RNA, 19 nt, Homo sapiens
ugaggaggaggacacagca

SEQ ID NO: 790551 - RNA, 22 nt, Homo sapiens
ugaggaggcuugccccacccaa

SEQ ID NO: 790552 - RNA, 16 nt, Homo sapiens
ugaggagugaggaaua

SEQ ID NO: 790553 - RNA, 19 nt, Homo sapiens
ugaggauaucaaaggacaa

SEQ ID NO: 790554 - RNA, 14 nt, Homo sapiens
ugaggcaauaaaaa

SEQ ID NO: 790555 - RNA, 18 nt, Homo sapiens
ugaggcaauuagacacuu

SEQ ID NO: 790556 - RNA, 20 nt, Homo sapiens
ugaggcaggagaagaacaag

SEQ ID NO: 790557 - RNA, 20 nt, Homo sapiens
ugaggcaggaggaucauuug

SEQ ID NO: 790558 - RNA, 19 nt, Homo sapiens
ugaggcagggcaaaugaca

SEQ ID NO: 790559 - RNA, 17 nt, Homo sapiens
ugaggccaucucaggag

SEQ ID NO: 790560 - RNA, 19 nt, Homo sapiens
ugaggccaucucaggagau

SEQ ID NO: 790561 - RNA, 16 nt, Homo sapiens
ugaggcccugcccaau

SEQ ID NO: 790562 - RNA, 19 nt, Homo sapiens
ugaggccgggcgcaguggc

SEQ ID NO: 790563 - RNA, 18 nt, Homo sapiens
ugaggccuagacucuguc

SEQ ID NO: 790564 - RNA, 14 nt, Homo sapiens
ugaggccucucauu

SEQ ID NO: 790565 - RNA, 16 nt, Homo sapiens
ugaggcggagaauugc

SEQ ID NO: 790566 - RNA, 13 nt, Homo sapiens
ugaggcucuucac

SEQ ID NO: 790567 - RNA, 18 nt, Homo sapiens
ugaggcugcagauuucca

SEQ ID NO: 790568 - RNA, 14 nt, Homo sapiens
ugaggcugcagcga

SEQ ID NO: 790569 - RNA, 14 nt, Homo sapiens
ugaggcugucacag

SEQ ID NO: 790570 - RNA, 16 nt, Homo sapiens
ugagggaaaaugagua

SEQ ID NO: 790571 - RNA, 18 nt, Homo sapiens
ugagggaucacugccaaa

SEQ ID NO: 790572 - RNA, 17 nt, Homo sapiens
ugagggcagacuggggc

SEQ ID NO: 790573 - RNA, 22 nt, Homo sapiens
ugagggcaguucugaguguuua

SEQ ID NO: 790574 - RNA, 15 nt, Homo sapiens
ugagggcauggguaa

SEQ ID NO: 790575 - RNA, 13 nt, Homo sapiens
ugaggggaggcac

SEQ ID NO: 790576 - RNA, 17 nt, Homo sapiens
ugaggggaggcaccucc

SEQ ID NO: 790577 - RNA, 14 nt, Homo sapiens
ugaggggucucgga

SEQ ID NO: 790578 - RNA, 19 nt, Homo sapiens
ugagggugacuauggagcu

SEQ ID NO: 790579 - RNA, 12 nt, Homo sapiens
ugaggguggaag

SEQ ID NO: 790580 - RNA, 21 nt, Homo sapiens
ugagggugggggugcucucuc

SEQ ID NO: 790581 - RNA, 16 nt, Homo sapiens
ugagguauaaagacaa

SEQ ID NO: 790582 - RNA, 16 nt, Homo sapiens
ugaggugccuguccca

SEQ ID NO: 790583 - RNA, 18 nt, Homo sapiens
ugaggugcgcucaccuca

SEQ ID NO: 790584 - RNA, 22 nt, Homo sapiens
ugagguuaaguuucucuucacc

SEQ ID NO: 790585 - RNA, 18 nt, Homo sapiens
ugagguuaguucugugug

SEQ ID NO: 790586 - RNA, 15 nt, Homo sapiens
ugaguaaaacacaua

SEQ ID NO: 790587 - RNA, 19 nt, Homo sapiens
ugaguaaacugagacuuaa

SEQ ID NO: 790588 - RNA, 15 nt, Homo sapiens
ugaguaacauuugcu

SEQ ID NO: 790589 - RNA, 17 nt, Homo sapiens
ugaguaauacaucaaag

SEQ ID NO: 790590 - RNA, 17 nt, Homo sapiens
ugaguacauauuguggu

SEQ ID NO: 790591 - RNA, 20 nt, Homo sapiens
ugaguagaaaagucggggau

SEQ ID NO: 790592 - RNA, 17 nt, Homo sapiens
ugaguagaguugaucaa

SEQ ID NO: 790593 - RNA, 18 nt, Homo sapiens
ugaguagcucugccuuug

SEQ ID NO: 790594 - RNA, 20 nt, Homo sapiens
ugaguagcuggauuacaggc

SEQ ID NO: 790595 - RNA, 20 nt, Homo sapiens
ugagucaugaucucccugcc

SEQ ID NO: 790596 - RNA, 22 nt, Homo sapiens
ugaguccaagaggguccuuuag

SEQ ID NO: 790597 - RNA, 18 nt, Homo sapiens
ugaguccaucuaacauca

SEQ ID NO: 790598 - RNA, 21 nt, Homo sapiens
ugaguccgacccagacaucca

SEQ ID NO: 790599 - RNA, 17 nt, Homo sapiens
ugaguccuaggacuuaa

SEQ ID NO: 790600 - RNA, 22 nt, Homo sapiens
ugagucuuuauuuuuuguuacc

SEQ ID NO: 790601 - RNA, 23 nt, Homo sapiens
ugagugcaccugccuccaccagc

SEQ ID NO: 790602 - RNA, 16 nt, Homo sapiens
ugagugcacuaaacaa

SEQ ID NO: 790603 - RNA, 22 nt, Homo sapiens
ugagugguucaagcacacugga

SEQ ID NO: 790604 - RNA, 15 nt, Homo sapiens
ugaguguaaguguga

SEQ ID NO: 790605 - RNA, 19 nt, Homo sapiens
ugaguugcuuuucagcuga

SEQ ID NO: 790606 - RNA, 21 nt, Homo sapiens
ugaguuuaaaaaaauaacauc

SEQ ID NO: 790607 - RNA, 22 nt, Homo sapiens
ugaguuucuggcucuugaggca

SEQ ID NO: 790608 - RNA, 17 nt, Homo sapiens
ugaguuucuguucuccc

SEQ ID NO: 790609 - RNA, 22 nt, Homo sapiens
ugaguuucuuaacccuuuccag

SEQ ID NO: 790610 - RNA, 19 nt, Homo sapiens
ugaguuucuuagacuuuuc

SEQ ID NO: 790611 - RNA, 16 nt, Homo sapiens
ugaguuuuguguuugu

SEQ ID NO: 790612 - RNA, 19 nt, Homo sapiens
ugaguuuuuacaagaugua

SEQ ID NO: 790613 - RNA, 15 nt, Homo sapiens
ugauaaaacacugcc

SEQ ID NO: 790614 - RNA, 14 nt, Homo sapiens
uuacauguguaaag

SEQ ID NO: 790615 - RNA, 21 nt, Homo sapiens
uuacauuagccauucauguau

SEQ ID NO: 790616 - RNA, 14 nt, Homo sapiens
uuacauucaucuca

SEQ ID NO: 790617 - RNA, 15 nt, Homo sapiens
uuacauuccauuuca

SEQ ID NO: 790618 - RNA, 18 nt, Homo sapiens
uuacauuucauacaacag

SEQ ID NO: 790619 - RNA, 14 nt, Homo sapiens
uuaccaaaaaagga

SEQ ID NO: 790620 - RNA, 15 nt, Homo sapiens
uuaccaaagcaucaa

SEQ ID NO: 790621 - RNA, 16 nt, Homo sapiens
uuaccaaggaugaauu

SEQ ID NO: 790622 - RNA, 16 nt, Homo sapiens
uuaccaauagccugaa

SEQ ID NO: 790623 - RNA, 18 nt, Homo sapiens
uuaccaccgucugucuca

SEQ ID NO: 790624 - RNA, 21 nt, Homo sapiens
uuaccagacgguucaccagcc

SEQ ID NO: 790625 - RNA, 22 nt, Homo sapiens
uuaccagacgguucaccagccu

SEQ ID NO: 790626 - RNA, 15 nt, Homo sapiens
uuaccaggugagaag

SEQ ID NO: 790627 - RNA, 19 nt, Homo sapiens
uuaccauuucacacauaag

SEQ ID NO: 790628 - RNA, 14 nt, Homo sapiens
uuacccaagcugug

SEQ ID NO: 790629 - RNA, 16 nt, Homo sapiens
uuacccaguauuccau

SEQ ID NO: 790630 - RNA, 13 nt, Homo sapiens
uuacccagugccg

SEQ ID NO: 790631 - RNA, 17 nt, Homo sapiens
uuacccucuuugcugca

SEQ ID NO: 790632 - RNA, 23 nt, Homo sapiens
uuacccuuuggccccacuuugaa

SEQ ID NO: 790633 - RNA, 17 nt, Homo sapiens
uuaccggcgugagccac

SEQ ID NO: 790634 - RNA, 21 nt, Homo sapiens
uuaccgguugauugaaauauc

SEQ ID NO: 790635 - RNA, 14 nt, Homo sapiens
uuaccuaaacagau

SEQ ID NO: 790636 - RNA, 19 nt, Homo sapiens
uuaccuaaucuccacuuuu

SEQ ID NO: 790637 - RNA, 17 nt, Homo sapiens
uuaccuacaagaacaau

SEQ ID NO: 790638 - RNA, 21 nt, Homo sapiens
uuaccuagauuuacagccuca

SEQ ID NO: 790639 - RNA, 14 nt, Homo sapiens
uuaccuccauccau

SEQ ID NO: 790640 - RNA, 15 nt, Homo sapiens
uuaccuccauccauc

SEQ ID NO: 790641 - RNA, 21 nt, Homo sapiens
uuaccugauuugaugauacau

SEQ ID NO: 790642 - RNA, 13 nt, Homo sapiens
uuaccugggaccu

SEQ ID NO: 790643 - RNA, 16 nt, Homo sapiens
uuaccugggaccucac

SEQ ID NO: 790644 - RNA, 16 nt, Homo sapiens
uuaccuuuguucccaa

SEQ ID NO: 790645 - RNA, 22 nt, Homo sapiens
uuaccuuuuauuuuaauguuuc

SEQ ID NO: 790646 - RNA, 14 nt, Homo sapiens
uuacgacacuuugg

SEQ ID NO: 790647 - RNA, 12 nt, Homo sapiens
uuacuaaauccu

SEQ ID NO: 790648 - RNA, 13 nt, Homo sapiens
uuacuaaauuuuc

SEQ ID NO: 790649 - RNA, 21 nt, Homo sapiens
uuacuaacuaaauaccauuca

SEQ ID NO: 790650 - RNA, 16 nt, Homo sapiens
uuacuaucauaauuca

SEQ ID NO: 790651 - RNA, 20 nt, Homo sapiens
uuacuaugguaacacuuugc

SEQ ID NO: 790652 - RNA, 22 nt, Homo sapiens
uuacuauuauagcaacuuuaag

SEQ ID NO: 790653 - RNA, 23 nt, Homo sapiens
uuacucaaggaauuugcauuuag

SEQ ID NO: 790654 - RNA, 17 nt, Homo sapiens
uuacucagagcagauga

SEQ ID NO: 790655 - RNA, 14 nt, Homo sapiens
uuacucagguuuga

SEQ ID NO: 790656 - RNA, 19 nt, Homo sapiens
uuacuccaucauggcugcu

SEQ ID NO: 790657 - RNA, 11 nt, Homo sapiens
uuacucugaag

SEQ ID NO: 790658 - RNA, 13 nt, Homo sapiens
uuacucuuugaac

SEQ ID NO: 790659 - RNA, 13 nt, Homo sapiens
uuacugaugugau

SEQ ID NO: 790660 - RNA, 15 nt, Homo sapiens
uuacugcaguucauc

SEQ ID NO: 790661 - RNA, 14 nt, Homo sapiens
uuacugcauagcag

SEQ ID NO: 790662 - RNA, 17 nt, Homo sapiens
uuacugcuuaaauucca

SEQ ID NO: 790663 - RNA, 21 nt, Homo sapiens
uuacugcuucuuuucacuuca

SEQ ID NO: 790664 - RNA, 23 nt, Homo sapiens
uuacuggugcagaugguugacau

SEQ ID NO: 790665 - RNA, 18 nt, Homo sapiens
uuacuguuuugccaagaa

SEQ ID NO: 790666 - RNA, 22 nt, Homo sapiens
uuacuucaaugggcucuuccaa

SEQ ID NO: 790667 - RNA, 18 nt, Homo sapiens
uuacuucuggcauaacua

SEQ ID NO: 790668 - RNA, 22 nt, Homo sapiens
uuacuugaaccugggaggcaga

SEQ ID NO: 790669 - RNA, 23 nt, Homo sapiens
uuacuuuaaaauaaaaaaguaac

SEQ ID NO: 790670 - RNA, 15 nt, Homo sapiens
uuacuuuggaauaca

SEQ ID NO: 790671 - RNA, 16 nt, Homo sapiens
uuacuuuuaccacuau

SEQ ID NO: 790672 - RNA, 16 nt, Homo sapiens
uuacuuuucacacugu

SEQ ID NO: 790673 - RNA, 17 nt, Homo sapiens
uuagaaaaaaguuuaca

SEQ ID NO: 790674 - RNA, 17 nt, Homo sapiens
uuagaaaauagagcuuu

SEQ ID NO: 790675 - RNA, 14 nt, Homo sapiens
uuagaaaaugcagu

SEQ ID NO: 790676 - RNA, 19 nt, Homo sapiens
uuagaaacucaaaaacuga

SEQ ID NO: 790677 - RNA, 17 nt, Homo sapiens
uuagaaagcaaagauua

SEQ ID NO: 790678 - RNA, 23 nt, Homo sapiens
uuagaaaugacugcauuugauau

SEQ ID NO: 790679 - RNA, 22 nt, Homo sapiens
uuagaacccauaaccauacaca

SEQ ID NO: 790680 - RNA, 14 nt, Homo sapiens
uuagaacuaugcua

SEQ ID NO: 790681 - RNA, 12 nt, Homo sapiens
uuagaacuauua

SEQ ID NO: 790682 - RNA, 13 nt, Homo sapiens
uuagaauaaugaa

SEQ ID NO: 790683 - RNA, 15 nt, Homo sapiens
uuagaaugcaucuca

SEQ ID NO: 790684 - RNA, 21 nt, Homo sapiens
uuagaaugggaucacgaggaa

SEQ ID NO: 790685 - RNA, 18 nt, Homo sapiens
uuagacguccuccgucca

SEQ ID NO: 790686 - RNA, 14 nt, Homo sapiens
uuagacuacauuua

SEQ ID NO: 790687 - RNA, 18 nt, Homo sapiens
uuagacucaucuuacugu

SEQ ID NO: 790688 - RNA, 18 nt, Homo sapiens
uuagagauauagauauua

SEQ ID NO: 790689 - RNA, 15 nt, Homo sapiens
uuagaggaaggagau

SEQ ID NO: 790690 - RNA, 22 nt, Homo sapiens
uuagaggagaaaaagcuuaaug

SEQ ID NO: 790691 - RNA, 16 nt, Homo sapiens
uuagaguguagcugua

SEQ ID NO: 790692 - RNA, 22 nt, Homo sapiens
uuagaguugcucuacaaugaca

SEQ ID NO: 790693 - RNA, 12 nt, Homo sapiens
uuagaguuuacu

SEQ ID NO: 790694 - RNA, 20 nt, Homo sapiens
uuagauaauaacugucuucu

SEQ ID NO: 790695 - RNA, 22 nt, Homo sapiens
uuagauauuuuucauaaacaag

SEQ ID NO: 790696 - RNA, 19 nt, Homo sapiens
uuagaucaaauaguugcau

SEQ ID NO: 790697 - RNA, 24 nt, Homo sapiens
uuagaucaaccuccaacaacgaca

SEQ ID NO: 790698 - RNA, 21 nt, Homo sapiens
uuagaugagggugacugucaa

SEQ ID NO: 790699 - RNA, 14 nt, Homo sapiens
uuagauugaaucug

SEQ ID NO: 790700 - RNA, 12 nt, Homo sapiens
uuagauugcaaa

SEQ ID NO: 790701 - RNA, 12 nt, Homo sapiens
uuagauugugag

SEQ ID NO: 790702 - RNA, 22 nt, Homo sapiens
uuagcaaacuuuguaugucauu

SEQ ID NO: 790703 - RNA, 18 nt, Homo sapiens
uuagcaacaguuaucaca

SEQ ID NO: 790704 - RNA, 22 nt, Homo sapiens
uuagcauaaaauuuucuacucu

SEQ ID NO: 790705 - RNA, 12 nt, Homo sapiens
uuagcaugcugc

SEQ ID NO: 790706 - RNA, 20 nt, Homo sapiens
uuagcauuauuggaugucaa

SEQ ID NO: 790707 - RNA, 12 nt, Homo sapiens
uuagccauucau

SEQ ID NO: 790708 - RNA, 12 nt, Homo sapiens
uuagcccaagag

SEQ ID NO: 790709 - RNA, 20 nt, Homo sapiens
uuagcuaggcuaaaacaccu

SEQ ID NO: 790710 - RNA, 20 nt, Homo sapiens
uuagcuaguuuuauucuugg

SEQ ID NO: 790711 - RNA, 9 nt, Homo sapiens
uuagcucau

SEQ ID NO: 790712 - RNA, 23 nt, Homo sapiens
uuagcucucccaacucuugcaca

SEQ ID NO: 790713 - RNA, 12 nt, Homo sapiens
uuagcugucacc

SEQ ID NO: 790714 - RNA, 15 nt, Homo sapiens
uuagcugucugcuca

SEQ ID NO: 790715 - RNA, 22 nt, Homo sapiens
uuagcugugcgcaauugcucau

SEQ ID NO: 790716 - RNA, 17 nt, Homo sapiens
uuagcuuagaccucagc

SEQ ID NO: 790717 - RNA, 18 nt, Homo sapiens
uuagcuuugggugccuuu

SEQ ID NO: 790718 - RNA, 16 nt, Homo sapiens
uuaggaaggccuucag

SEQ ID NO: 790719 - RNA, 23 nt, Homo sapiens
uuaggauuuaacagucauuuaaa

SEQ ID NO: 790720 - RNA, 12 nt, Homo sapiens
uuagggcacugg

SEQ ID NO: 790721 - RNA, 23 nt, Homo sapiens
uuagguggugguagagaagcaag

SEQ ID NO: 790722 - RNA, 15 nt, Homo sapiens
uuaggugucuguccu

SEQ ID NO: 790723 - RNA, 18 nt, Homo sapiens
uuagguugucuccaggcc

SEQ ID NO: 790724 - RNA, 20 nt, Homo sapiens
uuaguaaugcucugaccaag

SEQ ID NO: 790725 - RNA, 16 nt, Homo sapiens
uuaguaauuucuugcu

SEQ ID NO: 790726 - RNA, 17 nt, Homo sapiens
uuaguacaauaaucucu

SEQ ID NO: 790727 - RNA, 16 nt, Homo sapiens
uuaguagagacagggu

SEQ ID NO: 790728 - RNA, 22 nt, Homo sapiens
uuagucccgauaggguauuuga

SEQ ID NO: 790729 - RNA, 19 nt, Homo sapiens
uuauucaaugugacaccua

SEQ ID NO: 790730 - RNA, 15 nt, Homo sapiens
uuauucccuuucaca

SEQ ID NO: 790731 - RNA, 15 nt, Homo sapiens
uuauucuacaucauu

SEQ ID NO: 790732 - RNA, 16 nt, Homo sapiens
uuauucugauuccacu

SEQ ID NO: 790733 - RNA, 12 nt, Homo sapiens
uuauucugccuu

SEQ ID NO: 790734 - RNA, 16 nt, Homo sapiens
uuauucugccuuccag

SEQ ID NO: 790735 - RNA, 23 nt, Homo sapiens
uuauugaaaggggacaccuguac

SEQ ID NO: 790736 - RNA, 14 nt, Homo sapiens
uuauugacacugaa

SEQ ID NO: 790737 - RNA, 21 nt, Homo sapiens
uuauugaguucgaggacuaca

SEQ ID NO: 790738 - RNA, 18 nt, Homo sapiens
uuauugauaaguucauac

SEQ ID NO: 790739 - RNA, 21 nt, Homo sapiens
uuauugauauuuaauuaugaa

SEQ ID NO: 790740 - RNA, 20 nt, Homo sapiens
uuauugcaauaaaguauaau

SEQ ID NO: 790741 - RNA, 15 nt, Homo sapiens
uuauuggcugagaua

SEQ ID NO: 790742 - RNA, 19 nt, Homo sapiens
uuauugggcaagugauuga

SEQ ID NO: 790743 - RNA, 14 nt, Homo sapiens
uuauuguaccucuc

SEQ ID NO: 790744 - RNA, 20 nt, Homo sapiens
uuauugugacuucacuguau

SEQ ID NO: 790745 - RNA, 13 nt, Homo sapiens
uuauuguucaaua

SEQ ID NO: 790746 - RNA, 20 nt, Homo sapiens
uuauuuauccuaguauuccu

SEQ ID NO: 790747 - RNA, 21 nt, Homo sapiens
uuauuuaugcacugugggaug

SEQ ID NO: 790748 - RNA, 13 nt, Homo sapiens
uuauuuauuguau

SEQ ID NO: 790749 - RNA, 15 nt, Homo sapiens
uuauuucaaagggaa

SEQ ID NO: 790750 - RNA, 12 nt, Homo sapiens
uuauuucacuuu

SEQ ID NO: 790751 - RNA, 22 nt, Homo sapiens
uuauuuccccagccacaggcca

SEQ ID NO: 790752 - RNA, 14 nt, Homo sapiens
uuauuuccugagaa

SEQ ID NO: 790753 - RNA, 19 nt, Homo sapiens
uuauuucugaucuauacaa

SEQ ID NO: 790754 - RNA, 16 nt, Homo sapiens
uuauuugaaggccagc

SEQ ID NO: 790755 - RNA, 18 nt, Homo sapiens
uuauuugacaacaaucca

SEQ ID NO: 790756 - RNA, 22 nt, Homo sapiens
uuauuuguauuacuagauucau

SEQ ID NO: 790757 - RNA, 22 nt, Homo sapiens
uuauuuuguugaaauugucaaa

SEQ ID NO: 790758 - RNA, 16 nt, Homo sapiens
uuauuuuuacaguucu

SEQ ID NO: 790759 - RNA, 13 nt, Homo sapiens
uucaaaagugauu

SEQ ID NO: 790760 - RNA, 13 nt, Homo sapiens
uucaaaccauuuu

SEQ ID NO: 790761 - RNA, 17 nt, Homo sapiens
uucaaacugcaugauuc

SEQ ID NO: 790762 - RNA, 22 nt, Homo sapiens
uucaaacugcugcauacuuuga

SEQ ID NO: 790763 - RNA, 22 nt, Homo sapiens
uucaaacugugaagcauuuaca

SEQ ID NO: 790764 - RNA, 20 nt, Homo sapiens
uucaaagacagagaagacca

SEQ ID NO: 790765 - RNA, 22 nt, Homo sapiens
uucaaagacagagaagaccaaa

SEQ ID NO: 790766 - RNA, 13 nt, Homo sapiens
uucaaagacugug

SEQ ID NO: 790767 - RNA, 20 nt, Homo sapiens
uucaaagagcaauauuccag

SEQ ID NO: 790768 - RNA, 12 nt, Homo sapiens
uucaaagugaua

SEQ ID NO: 790769 - RNA, 21 nt, Homo sapiens
uucaaauccucccuacuucca

SEQ ID NO: 790770 - RNA, 21 nt, Homo sapiens
uucaaaugcagaauacuugac

SEQ ID NO: 790771 - RNA, 17 nt, Homo sapiens
uucaaauuauaaaccaa

SEQ ID NO: 790772 - RNA, 15 nt, Homo sapiens
uucaacagagacuga

SEQ ID NO: 790773 - RNA, 18 nt, Homo sapiens
uucaacccagccaugcaa

SEQ ID NO: 790774 - RNA, 11 nt, Homo sapiens
uucaacuggag

SEQ ID NO: 790775 - RNA, 13 nt, Homo sapiens
uucaacuguauag

SEQ ID NO: 790776 - RNA, 21 nt, Homo sapiens
uucaagaccauccuggacuga

SEQ ID NO: 790777 - RNA, 22 nt, Homo sapiens
uucaagaucucauccaagcaaa

SEQ ID NO: 790778 - RNA, 14 nt, Homo sapiens
uucaagauuguuga

SEQ ID NO: 790779 - RNA, 14 nt, Homo sapiens
uucaagcagcaucu

SEQ ID NO: 790780 - RNA, 23 nt, Homo sapiens
uucaagccuaaagacaauucauu

SEQ ID NO: 790781 - RNA, 16 nt, Homo sapiens
uucaagccugugaaua

SEQ ID NO: 790782 - RNA, 15 nt, Homo sapiens
uucaagccuguuaua

SEQ ID NO: 790783 - RNA, 14 nt, Homo sapiens
uucaagcuauuuaa

SEQ ID NO: 790784 - RNA, 23 nt, Homo sapiens
uucaagcucaucuguuaugcaua

SEQ ID NO: 790785 - RNA, 15 nt, Homo sapiens
uucaaggaacagcca

SEQ ID NO: 790786 - RNA, 22 nt, Homo sapiens
uucaaggacuguuucaguguga

SEQ ID NO: 790787 - RNA, 23 nt, Homo sapiens
uucaaggcauuucuaucacauau

SEQ ID NO: 790788 - RNA, 19 nt, Homo sapiens
uucaaguauucauuguuga

SEQ ID NO: 790789 - RNA, 11 nt, Homo sapiens
uucaagugauu

SEQ ID NO: 790790 - RNA, 17 nt, Homo sapiens
uucaagugcuucuccag

SEQ ID NO: 790791 - RNA, 23 nt, Homo sapiens
uucaagugcuucuccagccucag

SEQ ID NO: 790792 - RNA, 16 nt, Homo sapiens
uucaaguuaaagugaa

SEQ ID NO: 790793 - RNA, 20 nt, Homo sapiens
uucaauaaagcacugagcaa

SEQ ID NO: 790794 - RNA, 14 nt, Homo sapiens
uucaauauugacau

SEQ ID NO: 790795 - RNA, 14 nt, Homo sapiens
uucaauccuacuuu

SEQ ID NO: 790796 - RNA, 18 nt, Homo sapiens
uucaaucuguaaacugug

SEQ ID NO: 790797 - RNA, 14 nt, Homo sapiens
uucaauuuugaaaa

SEQ ID NO: 790798 - RNA, 15 nt, Homo sapiens
uucacaaacugugaa

SEQ ID NO: 790799 - RNA, 13 nt, Homo sapiens
uucacaacuuuga

SEQ ID NO: 790800 - RNA, 20 nt, Homo sapiens
uucacaaugugaaacugaag

SEQ ID NO: 790801 - RNA, 17 nt, Homo sapiens
uucacacaaagacuccu

SEQ ID NO: 790802 - RNA, 20 nt, Homo sapiens
uucacacagggcucuuugau

SEQ ID NO: 790803 - RNA, 19 nt, Homo sapiens
uucacaccgcugcacucaa

SEQ ID NO: 790804 - RNA, 14 nt, Homo sapiens
uucacacuaagaaa

SEQ ID NO: 790805 - RNA, 19 nt, Homo sapiens
uucacacuuccaccagccu

SEQ ID NO: 790806 - RNA, 19 nt, Homo sapiens
uucacauaguuuauuucaa

SEQ ID NO: 790807 - RNA, 21 nt, Homo sapiens
uucacauaucuaguaugaaau

SEQ ID NO: 790808 - RNA, 11 nt, Homo sapiens
uucacauucau

SEQ ID NO: 790809 - RNA, 21 nt, Homo sapiens
uucacauuugauguacaugug

SEQ ID NO: 790810 - RNA, 22 nt, Homo sapiens
uucacauuuuuaaaagaacaau

SEQ ID NO: 790811 - RNA, 11 nt, Homo sapiens
uucaccaaaau

SEQ ID NO: 790812 - RNA, 11 nt, Homo sapiens
uucaccagagc

SEQ ID NO: 790813 - RNA, 19 nt, Homo sapiens
uucaccaggaccaguucac

SEQ ID NO: 790814 - RNA, 22 nt, Homo sapiens
uucaccagucugucuacugugg

SEQ ID NO: 790815 - RNA, 21 nt, Homo sapiens
uucacccauccaugagcugcu

SEQ ID NO: 790816 - RNA, 19 nt, Homo sapiens
uucaccccuacacugugaa

SEQ ID NO: 790817 - RNA, 20 nt, Homo sapiens
uucaccccuacacugugaag

SEQ ID NO: 790818 - RNA, 16 nt, Homo sapiens
uucaccuaacuagaga

SEQ ID NO: 790819 - RNA, 19 nt, Homo sapiens
uucaccugcugcuugcccc

SEQ ID NO: 790820 - RNA, 13 nt, Homo sapiens
uucaccuguaaac

SEQ ID NO: 790821 - RNA, 15 nt, Homo sapiens
uucaccugugacaaa

SEQ ID NO: 790822 - RNA, 13 nt, Homo sapiens
uucaccuugggau

SEQ ID NO: 790823 - RNA, 17 nt, Homo sapiens
uucacgaacaugggcau

SEQ ID NO: 790824 - RNA, 19 nt, Homo sapiens
uucacgggcaaucaugagc

SEQ ID NO: 790825 - RNA, 20 nt, Homo sapiens
uucacuagaaaaugagaaaa

SEQ ID NO: 790826 - RNA, 18 nt, Homo sapiens
uucacugcaaccucugcc

SEQ ID NO: 790827 - RNA, 15 nt, Homo sapiens
uucacuguacugcau

SEQ ID NO: 790828 - RNA, 16 nt, Homo sapiens
uucacuguacugcaug

SEQ ID NO: 790829 - RNA, 18 nt, Homo sapiens
uucacuguagaaugauuu

SEQ ID NO: 790830 - RNA, 22 nt, Homo sapiens
uucacugucaggaagaaaucac

SEQ ID NO: 790831 - RNA, 18 nt, Homo sapiens
uucacuugaugauacaau

SEQ ID NO: 790832 - RNA, 15 nt, Homo sapiens
uucacuugccaugca

SEQ ID NO: 790833 - RNA, 14 nt, Homo sapiens
uucacuuuacaaau

SEQ ID NO: 790834 - RNA, 10 nt, Homo sapiens
uucacuuuga

SEQ ID NO: 790835 - RNA, 20 nt, Homo sapiens
uucagaauaacagcacguga

SEQ ID NO: 790836 - RNA, 14 nt, Homo sapiens
uucagacaccuguu

SEQ ID NO: 790837 - RNA, 17 nt, Homo sapiens
uucagacacuucaugga

SEQ ID NO: 790838 - RNA, 17 nt, Homo sapiens
uucagaccaaugcucaa

SEQ ID NO: 790839 - RNA, 21 nt, Homo sapiens
uucagacuccagccugaaugu

SEQ ID NO: 790840 - RNA, 23 nt, Homo sapiens
uucagacucccauuccugaagaa

SEQ ID NO: 790841 - RNA, 12 nt, Homo sapiens
uucagacucuca

SEQ ID NO: 790842 - RNA, 13 nt, Homo sapiens
uucagacucucag

SEQ ID NO: 790843 - RNA, 12 nt, Homo sapiens
uucagacuguuu

SEQ ID NO: 790844 - RNA, 16 nt, Homo sapiens
uuccuucccugggaag

SEQ ID NO: 790845 - RNA, 20 nt, Homo sapiens
uuccuucuugacauuuauca

SEQ ID NO: 790846 - RNA, 18 nt, Homo sapiens
uuccuucuuuaaacacuc

SEQ ID NO: 790847 - RNA, 16 nt, Homo sapiens
uuccuuggaacacaua

SEQ ID NO: 790848 - RNA, 16 nt, Homo sapiens
uuccuuggccaugcag

SEQ ID NO: 790849 - RNA, 17 nt, Homo sapiens
uuccuugggaugaucuu

SEQ ID NO: 790850 - RNA, 21 nt, Homo sapiens
uuccuugugguugaaaaccac

SEQ ID NO: 790851 - RNA, 15 nt, Homo sapiens
uuccuuuacuacgaa

SEQ ID NO: 790852 - RNA, 21 nt, Homo sapiens
uuccuuuaugaugacugcuua

SEQ ID NO: 790853 - RNA, 15 nt, Homo sapiens
uuccuuucaggccaa

SEQ ID NO: 790854 - RNA, 18 nt, Homo sapiens
uuccuuuccuaaaagugu

SEQ ID NO: 790855 - RNA, 16 nt, Homo sapiens
uuccuuuguugcacaa

SEQ ID NO: 790856 - RNA, 18 nt, Homo sapiens
uucgaccgacuuucccca

SEQ ID NO: 790857 - RNA, 14 nt, Homo sapiens
uucgacuacugcuc

SEQ ID NO: 790858 - RNA, 19 nt, Homo sapiens
uucgagaccagccugacca

SEQ ID NO: 790859 - RNA, 15 nt, Homo sapiens
uucgaguccaggaca

SEQ ID NO: 790860 - RNA, 17 nt, Homo sapiens
uucgcauuaagcacaca

SEQ ID NO: 790861 - RNA, 20 nt, Homo sapiens
uucggacagugcccaugcaa

SEQ ID NO: 790862 - RNA, 14 nt, Homo sapiens
uucggauuugccau

SEQ ID NO: 790863 - RNA, 15 nt, Homo sapiens
uucggccuuggugaa

SEQ ID NO: 790864 - RNA, 23 nt, Homo sapiens
uucggcuccgggcaaauggcuga

SEQ ID NO: 790865 - RNA, 18 nt, Homo sapiens
uucgguugacccagguca

SEQ ID NO: 790866 - RNA, 12 nt, Homo sapiens
uucgguuucaaa

SEQ ID NO: 790867 - RNA, 13 nt, Homo sapiens
uucguaguuuuca

SEQ ID NO: 790868 - RNA, 12 nt, Homo sapiens
uucguaugcacu

SEQ ID NO: 790869 - RNA, 17 nt, Homo sapiens
uucguauucccauuaga

SEQ ID NO: 790870 - RNA, 12 nt, Homo sapiens
uucguauuucaa

SEQ ID NO: 790871 - RNA, 13 nt, Homo sapiens
uucgucuacugca

SEQ ID NO: 790872 - RNA, 19 nt, Homo sapiens
uucgugaaguauacuguau

SEQ ID NO: 790873 - RNA, 17 nt, Homo sapiens
uucguggaaggcuguau

SEQ ID NO: 790874 - RNA, 21 nt, Homo sapiens
uucgugguuuuuacauucaau

SEQ ID NO: 790875 - RNA, 21 nt, Homo sapiens
uucguuuuuuuaaaucacaag

SEQ ID NO: 790876 - RNA, 16 nt, Homo sapiens
uucuaaaaaugguuau

SEQ ID NO: 790877 - RNA, 21 nt, Homo sapiens
uucuaaaagccauuauuauga

SEQ ID NO: 790878 - RNA, 21 nt, Homo sapiens
uucuaaaaucuuauaguucua

SEQ ID NO: 790879 - RNA, 22 nt, Homo sapiens
uucuaaagauucuauaguucua

SEQ ID NO: 790880 - RNA, 17 nt, Homo sapiens
uucuaaagcucugacau

SEQ ID NO: 790881 - RNA, 14 nt, Homo sapiens
uucuaaaguucuaa

SEQ ID NO: 790882 - RNA, 22 nt, Homo sapiens
uucuaacagugaaguuuuacug

SEQ ID NO: 790883 - RNA, 20 nt, Homo sapiens
uucuaacauguuuugugcag

SEQ ID NO: 790884 - RNA, 23 nt, Homo sapiens
uucuaacccaagacaugacauuc

SEQ ID NO: 790885 - RNA, 16 nt, Homo sapiens
uucuaacuucuuucac

SEQ ID NO: 790886 - RNA, 21 nt, Homo sapiens
uucuaagacuuacucuaagau

SEQ ID NO: 790887 - RNA, 14 nt, Homo sapiens
uucuaagauucuaa

SEQ ID NO: 790888 - RNA, 17 nt, Homo sapiens
uucuaagcaaaauugcu

SEQ ID NO: 790889 - RNA, 22 nt, Homo sapiens
uucuaaggaccugaaauuccaa

SEQ ID NO: 790890 - RNA, 23 nt, Homo sapiens
uucuaagguccgguguucuaaga

SEQ ID NO: 790891 - RNA, 17 nt, Homo sapiens
uucuaaguuucuaagau

SEQ ID NO: 790892 - RNA, 20 nt, Homo sapiens
uucuaauaaauauacuauga

SEQ ID NO: 790893 - RNA, 20 nt, Homo sapiens
uucuaaugguagucagauuu

SEQ ID NO: 790894 - RNA, 22 nt, Homo sapiens
uucuaauuugcauugugucaga

SEQ ID NO: 790895 - RNA, 17 nt, Homo sapiens
uucuaauuuuuaagcaa

SEQ ID NO: 790896 - RNA, 22 nt, Homo sapiens
uucuacaacugauugcaacaga

SEQ ID NO: 790897 - RNA, 22 nt, Homo sapiens
uucuacaauuucaauuucuccc

SEQ ID NO: 790898 - RNA, 13 nt, Homo sapiens
uucuacacaguaa

SEQ ID NO: 790899 - RNA, 17 nt, Homo sapiens
uucuacaucauuaacca

SEQ ID NO: 790900 - RNA, 13 nt, Homo sapiens
uucuaccugcccu

SEQ ID NO: 790901 - RNA, 23 nt, Homo sapiens
uucuacuggaaaaaaauacaaaa

SEQ ID NO: 790902 - RNA, 23 nt, Homo sapiens
uucuacuucuggaagucaucuca

SEQ ID NO: 790903 - RNA, 21 nt, Homo sapiens
uucuagaacaguaaaagccuu

SEQ ID NO: 790904 - RNA, 14 nt, Homo sapiens
uucuagaucucagc

SEQ ID NO: 790905 - RNA, 17 nt, Homo sapiens
uucuagguaggggccca

SEQ ID NO: 790906 - RNA, 13 nt, Homo sapiens
uucuagucaugug

SEQ ID NO: 790907 - RNA, 15 nt, Homo sapiens
uucuagucuuggcca

SEQ ID NO: 790908 - RNA, 14 nt, Homo sapiens
uucuaguuaccaca

SEQ ID NO: 790909 - RNA, 15 nt, Homo sapiens
uucuaguuucucuca

SEQ ID NO: 790910 - RNA, 21 nt, Homo sapiens
uucuauacaacaggcagugga

SEQ ID NO: 790911 - RNA, 16 nt, Homo sapiens
uucuauacccacccag

SEQ ID NO: 790912 - RNA, 17 nt, Homo sapiens
uucuauacccacccaga

SEQ ID NO: 790913 - RNA, 22 nt, Homo sapiens
uucuauauaguuccuugccuua

SEQ ID NO: 790914 - RNA, 21 nt, Homo sapiens
uucuauauauauauaaauaua

SEQ ID NO: 790915 - RNA, 21 nt, Homo sapiens
uucuauaugaauuuaaauaua

SEQ ID NO: 790916 - RNA, 17 nt, Homo sapiens
uucuaugcaaaugccuc

SEQ ID NO: 790917 - RNA, 19 nt, Homo sapiens
uucuaugcuaaacugugaa

SEQ ID NO: 790918 - RNA, 16 nt, Homo sapiens
uucuauguccauucuc

SEQ ID NO: 790919 - RNA, 21 nt, Homo sapiens
uucuauuaaaauuuagcccua

SEQ ID NO: 790920 - RNA, 22 nt, Homo sapiens
uucuauuaauaucaacucugaa

SEQ ID NO: 790921 - RNA, 19 nt, Homo sapiens
uucuauuuaacaacugggu

SEQ ID NO: 790922 - RNA, 15 nt, Homo sapiens
uucuauuuauuuacu

SEQ ID NO: 790923 - RNA, 21 nt, Homo sapiens
uucucaaaagagguuacuuua

SEQ ID NO: 790924 - RNA, 21 nt, Homo sapiens
uucucaaguucuaagauucua

SEQ ID NO: 790925 - RNA, 19 nt, Homo sapiens
uucucaaucagugcaguga

SEQ ID NO: 790926 - RNA, 20 nt, Homo sapiens
uucucaaucagugcagugau

SEQ ID NO: 790927 - RNA, 19 nt, Homo sapiens
uucucacaaugucccuuca

SEQ ID NO: 790928 - RNA, 16 nt, Homo sapiens
uucucaccauuugagu

SEQ ID NO: 790929 - RNA, 16 nt, Homo sapiens
uucucacccugugaaa

SEQ ID NO: 790930 - RNA, 14 nt, Homo sapiens
uucucacucagaug

SEQ ID NO: 790931 - RNA, 14 nt, Homo sapiens
uucucagaccucca

SEQ ID NO: 790932 - RNA, 23 nt, Homo sapiens
uucucagauguugaaacuuugaa

SEQ ID NO: 790933 - RNA, 20 nt, Homo sapiens
uucucaguguagggcagaga

SEQ ID NO: 790934 - RNA, 17 nt, Homo sapiens
uucuccaagaaacugaa

SEQ ID NO: 790935 - RNA, 13 nt, Homo sapiens
uucuccaauauca

SEQ ID NO: 790936 - RNA, 14 nt, Homo sapiens
uucuccacaaagua

SEQ ID NO: 790937 - RNA, 21 nt, Homo sapiens
uucuccaccuagacuguaaac

SEQ ID NO: 790938 - RNA, 16 nt, Homo sapiens
uucuccaccuccccca

SEQ ID NO: 790939 - RNA, 23 nt, Homo sapiens
uucuccagacccaccacaccgca

SEQ ID NO: 790940 - RNA, 12 nt, Homo sapiens
uucucccagcgu

SEQ ID NO: 790941 - RNA, 14 nt, Homo sapiens
uucucccugggaag

SEQ ID NO: 790942 - RNA, 15 nt, Homo sapiens
uucuccugucucagc

SEQ ID NO: 790943 - RNA, 16 nt, Homo sapiens
uucuccugugacccca

SEQ ID NO: 790944 - RNA, 15 nt, Homo sapiens
uucuccuuuugaacu

SEQ ID NO: 790945 - RNA, 19 nt, Homo sapiens
uucuccuuuugaccaaaua

SEQ ID NO: 790946 - RNA, 16 nt, Homo sapiens
uucucgcauuguagaa

SEQ ID NO: 790947 - RNA, 14 nt, Homo sapiens
uucucuaaauauga

SEQ ID NO: 790948 - RNA, 16 nt, Homo sapiens
uucucuauacucaggu

SEQ ID NO: 790949 - RNA, 22 nt, Homo sapiens
uucucucacuguguuacugcuu

SEQ ID NO: 790950 - RNA, 20 nt, Homo sapiens
uucucucacuuugauuugcu

SEQ ID NO: 790951 - RNA, 22 nt, Homo sapiens
uucucucagcucccaggccaac

SEQ ID NO: 790952 - RNA, 15 nt, Homo sapiens
uucucucuccagggu

SEQ ID NO: 790953 - RNA, 17 nt, Homo sapiens
uucucucugaccuuuca

SEQ ID NO: 790954 - RNA, 22 nt, Homo sapiens
uucucucugccugugagccagu

SEQ ID NO: 790955 - RNA, 18 nt, Homo sapiens
uucucucuuauuccacuu

SEQ ID NO: 790956 - RNA, 17 nt, Homo sapiens
uucucugcuccaccaca

SEQ ID NO: 790957 - RNA, 19 nt, Homo sapiens
uucucuggcgacaguuuuc

SEQ ID NO: 790958 - RNA, 12 nt, Homo sapiens
uauuuacuguua

SEQ ID NO: 790959 - RNA, 18 nt, Homo sapiens
uauuuagauauaacacua

SEQ ID NO: 790960 - RNA, 17 nt, Homo sapiens
uauuuaguucaacugua

SEQ ID NO: 790961 - RNA, 13 nt, Homo sapiens
uauuuauaaacua

SEQ ID NO: 790962 - RNA, 21 nt, Homo sapiens
uauuuauaauuccuauauccu

SEQ ID NO: 790963 - RNA, 18 nt, Homo sapiens
uauuuauagaacaguuga

SEQ ID NO: 790964 - RNA, 21 nt, Homo sapiens
uauuuaugagaaaguucucau

SEQ ID NO: 790965 - RNA, 17 nt, Homo sapiens
uauuuauuacuuccuca

SEQ ID NO: 790966 - RNA, 14 nt, Homo sapiens
uauuuauuagccaa

SEQ ID NO: 790967 - RNA, 17 nt, Homo sapiens
uauuuauucuuuaacug

SEQ ID NO: 790968 - RNA, 17 nt, Homo sapiens
uauuucaagcucugcaa

SEQ ID NO: 790969 - RNA, 13 nt, Homo sapiens
uauuucacaagaa

SEQ ID NO: 790970 - RNA, 20 nt, Homo sapiens
uauuucagcccccaucaccc

SEQ ID NO: 790971 - RNA, 16 nt, Homo sapiens
uauuuccacugaacaa

SEQ ID NO: 790972 - RNA, 19 nt, Homo sapiens
uauuucccauuugugccag

SEQ ID NO: 790973 - RNA, 22 nt, Homo sapiens
uauuuccuaaaaucacaggaca

SEQ ID NO: 790974 - RNA, 12 nt, Homo sapiens
uauuuccuugcc

SEQ ID NO: 790975 - RNA, 14 nt, Homo sapiens
uauuucuacacagu

SEQ ID NO: 790976 - RNA, 17 nt, Homo sapiens
uauuucucuugcuggaa

SEQ ID NO: 790977 - RNA, 23 nt, Homo sapiens
uauuucuucaaauaaaucucucc

SEQ ID NO: 790978 - RNA, 15 nt, Homo sapiens
uauuucuugcuuuca

SEQ ID NO: 790979 - RNA, 21 nt, Homo sapiens
uauuugaacuuauuuacacau

SEQ ID NO: 790980 - RNA, 15 nt, Homo sapiens
uauuugacaacaauc

SEQ ID NO: 790981 - RNA, 18 nt, Homo sapiens
uauuugagaaguucucag

SEQ ID NO: 790982 - RNA, 19 nt, Homo sapiens
uauuugaugaaacucauga

SEQ ID NO: 790983 - RNA, 19 nt, Homo sapiens
uauuugcacuauuuccaca

SEQ ID NO: 790984 - RNA, 21 nt, Homo sapiens
uauuugcaguucaccugcacu

SEQ ID NO: 790985 - RNA, 13 nt, Homo sapiens
uauuugcuaugaa

SEQ ID NO: 790986 - RNA, 15 nt, Homo sapiens
uauuugcuauguccu

SEQ ID NO: 790987 - RNA, 17 nt, Homo sapiens
uauuugcuuuaaugaga

SEQ ID NO: 790988 - RNA, 16 nt, Homo sapiens
uauuugcuuuuugcua

SEQ ID NO: 790989 - RNA, 19 nt, Homo sapiens
uauuuggaaauaaagucag

SEQ ID NO: 790990 - RNA, 14 nt, Homo sapiens
uauuuggaaccuug

SEQ ID NO: 790991 - RNA, 20 nt, Homo sapiens
uauuuguuuggugaauuugu

SEQ ID NO: 790992 - RNA, 22 nt, Homo sapiens
uauuuuacaaucaacaaaaugg

SEQ ID NO: 790993 - RNA, 15 nt, Homo sapiens
uauuuuacacagaaa

SEQ ID NO: 790994 - RNA, 17 nt, Homo sapiens
uauuuuacugaucucuu

SEQ ID NO: 790995 - RNA, 21 nt, Homo sapiens
uauuuucagccuacaguuaug

SEQ ID NO: 790996 - RNA, 15 nt, Homo sapiens
uauuuucaguauacu

SEQ ID NO: 790997 - RNA, 17 nt, Homo sapiens
uauuuucuacagugguu

SEQ ID NO: 790998 - RNA, 16 nt, Homo sapiens
uauuuucucuuaacaa

SEQ ID NO: 790999 - RNA, 14 nt, Homo sapiens
uauuuucuuuauca

SEQ ID NO: 791000 - RNA, 18 nt, Homo sapiens
uauuuugcauaguaccaa

SEQ ID NO: 791001 - RNA, 19 nt, Homo sapiens
uauuuuguaagagugagcu

SEQ ID NO: 791002 - RNA, 13 nt, Homo sapiens
uauuuuucugaua

SEQ ID NO: 791003 - RNA, 14 nt, Homo sapiens
uauuuuucugcccu

SEQ ID NO: 791004 - RNA, 20 nt, Homo sapiens
uauuuuuguacugaaucuca

SEQ ID NO: 791005 - RNA, 14 nt, Homo sapiens
uauuuuuguagcac

SEQ ID NO: 791006 - RNA, 18 nt, Homo sapiens
uauuuuuuaaacauacga

SEQ ID NO: 791007 - RNA, 18 nt, Homo sapiens
uauuuuuuagugaugaga

SEQ ID NO: 791008 - RNA, 15 nt, Homo sapiens
uauuuuuucuugcaa

SEQ ID NO: 791009 - RNA, 21 nt, Homo sapiens
uauuuuuuuuuaauuuugaua

SEQ ID NO: 791010 - RNA, 22 nt, Homo sapiens
uauuuuuuuuuuuccaagacag

SEQ ID NO: 791011 - RNA, 23 nt, Homo sapiens
uauuuuuuuuuuuccaagacaga

SEQ ID NO: 791012 - RNA, 23 nt, Homo sapiens
ucaaaaaaaaaaaaaagaaucca

SEQ ID NO: 791013 - RNA, 16 nt, Homo sapiens
ucaaaaaaccuuuaca

SEQ ID NO: 791014 - RNA, 23 nt, Homo sapiens
ucaaaaaagaaaaaagaaaagaa

SEQ ID NO: 791015 - RNA, 14 nt, Homo sapiens
ucaaaaacaaagag

SEQ ID NO: 791016 - RNA, 13 nt, Homo sapiens
ucaaaaacauucu

SEQ ID NO: 791017 - RNA, 14 nt, Homo sapiens
ucaaaaacauucuu

SEQ ID NO: 791018 - RNA, 23 nt, Homo sapiens
ucaaaaaccauauuugcauucca

SEQ ID NO: 791019 - RNA, 12 nt, Homo sapiens
ucaaaaagggaa

SEQ ID NO: 791020 - RNA, 17 nt, Homo sapiens
ucaaaacaauuggcaaa

SEQ ID NO: 791021 - RNA, 12 nt, Homo sapiens
ucaaaacacaua

SEQ ID NO: 791022 - RNA, 17 nt, Homo sapiens
ucaaaacagagauguga

SEQ ID NO: 791023 - RNA, 14 nt, Homo sapiens
ucaaaaccuuucaa

SEQ ID NO: 791024 - RNA, 22 nt, Homo sapiens
ucaaaacuguuuguuaucucuu

SEQ ID NO: 791025 - RNA, 23 nt, Homo sapiens
ucaaaagcggggcuucaucugca

SEQ ID NO: 791026 - RNA, 19 nt, Homo sapiens
ucaaaaguuuuuucuaagu

SEQ ID NO: 791027 - RNA, 22 nt, Homo sapiens
ucaaaauaaaaagugacacagc

SEQ ID NO: 791028 - RNA, 13 nt, Homo sapiens
ucaaaauaaugaa

SEQ ID NO: 791029 - RNA, 14 nt, Homo sapiens
ucaaaauaguucua

SEQ ID NO: 791030 - RNA, 18 nt, Homo sapiens
ucaaaauauacauucaaa

SEQ ID NO: 791031 - RNA, 14 nt, Homo sapiens
ucaaaaucaauuaa

SEQ ID NO: 791032 - RNA, 17 nt, Homo sapiens
ucaaaauggcagaacca

SEQ ID NO: 791033 - RNA, 22 nt, Homo sapiens
ucaaaccauuuuuaaaauguga

SEQ ID NO: 791034 - RNA, 18 nt, Homo sapiens
ucaaaccucacauuugug

SEQ ID NO: 791035 - RNA, 17 nt, Homo sapiens
ucaaaccugaccacaga

SEQ ID NO: 791036 - RNA, 19 nt, Homo sapiens
ucaaacgaugugcaauaca

SEQ ID NO: 791037 - RNA, 20 nt, Homo sapiens
ucaaacgccgcugacugcca

SEQ ID NO: 791038 - RNA, 17 nt, Homo sapiens
ucaaacugcaugauuca

SEQ ID NO: 791039 - RNA, 21 nt, Homo sapiens
ucaaacugcaugauucaugcc

SEQ ID NO: 791040 - RNA, 12 nt, Homo sapiens
ucaaacugugaa

SEQ ID NO: 791041 - RNA, 14 nt, Homo sapiens
ucaaagaaagugua

SEQ ID NO: 791042 - RNA, 22 nt, Homo sapiens
ucaaagaaaguguauugguuua

SEQ ID NO: 791043 - RNA, 14 nt, Homo sapiens
ucaaagaagacuca

SEQ ID NO: 791044 - RNA, 20 nt, Homo sapiens
ucaaagacagagaagaccaa

SEQ ID NO: 791045 - RNA, 20 nt, Homo sapiens
ucaaagacauagaugugaaa

SEQ ID NO: 791046 - RNA, 17 nt, Homo sapiens
ucaaagaggaaccagga

SEQ ID NO: 791047 - RNA, 19 nt, Homo sapiens
ucaaagagguauauuugaa

SEQ ID NO: 791048 - RNA, 20 nt, Homo sapiens
ucaaagcacagaauuuguca

SEQ ID NO: 791049 - RNA, 13 nt, Homo sapiens
ucaaagcaguagu

SEQ ID NO: 791050 - RNA, 17 nt, Homo sapiens
ucaaagcauuuacaagu

SEQ ID NO: 791051 - RNA, 16 nt, Homo sapiens
ucaaagccuugguuua

SEQ ID NO: 791052 - RNA, 20 nt, Homo sapiens
ucaaaggaaaauaguaaugu

SEQ ID NO: 791053 - RNA, 15 nt, Homo sapiens
ucaaaggaagacuug

SEQ ID NO: 791054 - RNA, 21 nt, Homo sapiens
ucaaaggacaaagacaguauu

SEQ ID NO: 791055 - RNA, 22 nt, Homo sapiens
ucaaaggagagucacagaacaa

SEQ ID NO: 791056 - RNA, 17 nt, Homo sapiens
ucaaaggcccucaguga

SEQ ID NO: 791057 - RNA, 11 nt, Homo sapiens
ucaaagggaaa

SEQ ID NO: 791058 - RNA, 11 nt, Homo sapiens
ucaaagggaac

SEQ ID NO: 791059 - RNA, 16 nt, Homo sapiens
ucaaagguaauucuga

SEQ ID NO: 791060 - RNA, 16 nt, Homo sapiens
ucaaaguaaaacuugc

SEQ ID NO: 791061 - RNA, 17 nt, Homo sapiens
ucaaagugacuauucag

SEQ ID NO: 791062 - RNA, 21 nt, Homo sapiens
ucaaaguguuuuucaagccug

SEQ ID NO: 791063 - RNA, 21 nt, Homo sapiens
ucaaaguuuggauuguaucaa

SEQ ID NO: 791064 - RNA, 21 nt, Homo sapiens
ucaaauacacauuugcuacug

SEQ ID NO: 791065 - RNA, 22 nt, Homo sapiens
ucaaauacacauuugcuacugu

SEQ ID NO: 791066 - RNA, 22 nt, Homo sapiens
ucaaauaggcuauuaaaaaagu

SEQ ID NO: 791067 - RNA, 19 nt, Homo sapiens
ucaaauaguugcauagcag

SEQ ID NO: 791068 - RNA, 14 nt, Homo sapiens
ucaaauaugcaaag

SEQ ID NO: 791069 - RNA, 23 nt, Homo sapiens
ucaaauauuucugauacugcuga

SEQ ID NO: 791070 - RNA, 13 nt, Homo sapiens
ucaaauccagugg

SEQ ID NO: 791071 - RNA, 14 nt, Homo sapiens
ucaaaucucuucca

SEQ ID NO: 791072 - RNA, 15 nt, Homo sapiens
ucaaaucugagggag

SEQ ID NO: 791073 - RNA, 18 nt, Homo sapiens
ucaagcuucacauuugcg

SEQ ID NO: 791074 - RNA, 15 nt, Homo sapiens
ucaaggaaagaauga

SEQ ID NO: 791075 - RNA, 20 nt, Homo sapiens
ucaaggaauaauucaaguca

SEQ ID NO: 791076 - RNA, 22 nt, Homo sapiens
ucaaggagaauguacuggcgau

SEQ ID NO: 791077 - RNA, 15 nt, Homo sapiens
ucaaggagcccagaa

SEQ ID NO: 791078 - RNA, 21 nt, Homo sapiens
ucaaggcccauaucugugaaa

SEQ ID NO: 791079 - RNA, 15 nt, Homo sapiens
ucaaggcccucagca

SEQ ID NO: 791080 - RNA, 17 nt, Homo sapiens
ucaaggccugcucccug

SEQ ID NO: 791081 - RNA, 13 nt, Homo sapiens
ucaaggccuucag

SEQ ID NO: 791082 - RNA, 23 nt, Homo sapiens
ucaaggcgggagggccugcagug

SEQ ID NO: 791083 - RNA, 15 nt, Homo sapiens
ucaaggcugcaguga

SEQ ID NO: 791084 - RNA, 19 nt, Homo sapiens
ucaaggcuucagugagcca

SEQ ID NO: 791085 - RNA, 19 nt, Homo sapiens
ucaaggcuuccacugcaaa

SEQ ID NO: 791086 - RNA, 15 nt, Homo sapiens
ucaaggugaagcaca

SEQ ID NO: 791087 - RNA, 16 nt, Homo sapiens
ucaagguuacugggag

SEQ ID NO: 791088 - RNA, 18 nt, Homo sapiens
ucaagguuuaaccuuaaa

SEQ ID NO: 791089 - RNA, 18 nt, Homo sapiens
ucaaguauaacaacuuug

SEQ ID NO: 791090 - RNA, 17 nt, Homo sapiens
ucaagucggaucuaguc

SEQ ID NO: 791091 - RNA, 16 nt, Homo sapiens
ucaagucuucccugau

SEQ ID NO: 791092 - RNA, 11 nt, Homo sapiens
ucaaguggcag

SEQ ID NO: 791093 - RNA, 16 nt, Homo sapiens
ucaaguuaacaaggaa

SEQ ID NO: 791094 - RNA, 18 nt, Homo sapiens
ucaaguuaugaaauacuu

SEQ ID NO: 791095 - RNA, 20 nt, Homo sapiens
ucaaguucccaacugaguca

SEQ ID NO: 791096 - RNA, 16 nt, Homo sapiens
ucaaguugugcuuguu

SEQ ID NO: 791097 - RNA, 19 nt, Homo sapiens
ucaaguuguugacugugau

SEQ ID NO: 791098 - RNA, 20 nt, Homo sapiens
ucaaguuguugacugugauu

SEQ ID NO: 791099 - RNA, 16 nt, Homo sapiens
ucaauaaaaugugauu

SEQ ID NO: 791100 - RNA, 17 nt, Homo sapiens
ucaauaaacaacagcug

SEQ ID NO: 791101 - RNA, 22 nt, Homo sapiens
ucaauaaacagcuucaugccuu

SEQ ID NO: 791102 - RNA, 17 nt, Homo sapiens
ucaauaaaggacaggcu

SEQ ID NO: 791103 - RNA, 15 nt, Homo sapiens
ucaauaauacaaagc

SEQ ID NO: 791104 - RNA, 15 nt, Homo sapiens
ucaauaauuacugua

SEQ ID NO: 791105 - RNA, 18 nt, Homo sapiens
ucaauaccgcucaguauu

SEQ ID NO: 791106 - RNA, 12 nt, Homo sapiens
ucaauacuaugg

SEQ ID NO: 791107 - RNA, 20 nt, Homo sapiens
ucaauacuauggaguaccau

SEQ ID NO: 791108 - RNA, 20 nt, Homo sapiens
ucaauauccaccccauccaa

SEQ ID NO: 791109 - RNA, 11 nt, Homo sapiens
ucaaucacugu

SEQ ID NO: 791110 - RNA, 16 nt, Homo sapiens
ucaaucagugcaguga

SEQ ID NO: 791111 - RNA, 18 nt, Homo sapiens
ucaaucccagcuacucaa

SEQ ID NO: 791112 - RNA, 15 nt, Homo sapiens
ucaauccucuaagcu

SEQ ID NO: 791113 - RNA, 18 nt, Homo sapiens
ucaauccugggcaaucag

SEQ ID NO: 791114 - RNA, 14 nt, Homo sapiens
ucaauccugucaua

SEQ ID NO: 791115 - RNA, 17 nt, Homo sapiens
ucaaucuccuaaccuug

SEQ ID NO: 791116 - RNA, 22 nt, Homo sapiens
ucaaucugcaguuuaacaaaau

SEQ ID NO: 791117 - RNA, 17 nt, Homo sapiens
ucaaucuucgacagcug

SEQ ID NO: 791118 - RNA, 21 nt, Homo sapiens
ucaaugggaaauacuacuccu

SEQ ID NO: 791119 - RNA, 16 nt, Homo sapiens
ucaaugguagcauuua

SEQ ID NO: 791120 - RNA, 15 nt, Homo sapiens
ucaaugucacuuaaa

SEQ ID NO: 791121 - RNA, 12 nt, Homo sapiens
ucaaugucuucc

SEQ ID NO: 791122 - RNA, 13 nt, Homo sapiens
ucaaugucuuccc

SEQ ID NO: 791123 - RNA, 16 nt, Homo sapiens
ucaauucuagucauau

SEQ ID NO: 791124 - RNA, 18 nt, Homo sapiens
ucaauuguuaauuguaau

SEQ ID NO: 791125 - RNA, 18 nt, Homo sapiens
ucaauuucuugguauuau

SEQ ID NO: 791126 - RNA, 18 nt, Homo sapiens
ucaauuuguaauugcuua

SEQ ID NO: 791127 - RNA, 18 nt, Homo sapiens
ucaauuuuucccaguauu

SEQ ID NO: 791128 - RNA, 21 nt, Homo sapiens
ucacaaaacgaaaugcuauga

SEQ ID NO: 791129 - RNA, 19 nt, Homo sapiens
ucacaaaucuuaacuugaa

SEQ ID NO: 791130 - RNA, 16 nt, Homo sapiens
ucacaaauugaucaag

SEQ ID NO: 791131 - RNA, 21 nt, Homo sapiens
ucacaaauuugucuugccuua

SEQ ID NO: 791132 - RNA, 13 nt, Homo sapiens
ucacaacagugaa

SEQ ID NO: 791133 - RNA, 15 nt, Homo sapiens
ucacaacauuccuca

SEQ ID NO: 791134 - RNA, 20 nt, Homo sapiens
ucacaaccaagaauguuaug

SEQ ID NO: 791135 - RNA, 17 nt, Homo sapiens
ucacaaccucucugauc

SEQ ID NO: 791136 - RNA, 19 nt, Homo sapiens
ucacaaccucucugaucuu

SEQ ID NO: 791137 - RNA, 21 nt, Homo sapiens
ucacaagggauuggcaauugu

SEQ ID NO: 791138 - RNA, 17 nt, Homo sapiens
ucccugggcagugcucc

SEQ ID NO: 791139 - RNA, 20 nt, Homo sapiens
ucccugggccuuagguuuga

SEQ ID NO: 791140 - RNA, 21 nt, Homo sapiens
ucccuggugccucugugcaca

SEQ ID NO: 791141 - RNA, 22 nt, Homo sapiens
ucccuguacaguagauuuucca

SEQ ID NO: 791142 - RNA, 16 nt, Homo sapiens
ucccugucauuugaac

SEQ ID NO: 791143 - RNA, 18 nt, Homo sapiens
ucccugucauuuuuaaca

SEQ ID NO: 791144 - RNA, 23 nt, Homo sapiens
ucccugucauuuuuaacagcaug

SEQ ID NO: 791145 - RNA, 21 nt, Homo sapiens
ucccuguccuccucggaucac

SEQ ID NO: 791146 - RNA, 19 nt, Homo sapiens
ucccuguggguggggagcu

SEQ ID NO: 791147 - RNA, 18 nt, Homo sapiens
ucccuguuuaaugauuga

SEQ ID NO: 791148 - RNA, 21 nt, Homo sapiens
ucccuuaaagauuuucugcuu

SEQ ID NO: 791149 - RNA, 22 nt, Homo sapiens
ucccuuaauauugaggcugcag

SEQ ID NO: 791150 - RNA, 17 nt, Homo sapiens
ucccuucuuugcugcug

SEQ ID NO: 791151 - RNA, 15 nt, Homo sapiens
ucccuugcagggguc

SEQ ID NO: 791152 - RNA, 22 nt, Homo sapiens
ucccuuggaauaaaaacauuuc

SEQ ID NO: 791153 - RNA, 16 nt, Homo sapiens
ucccuuggccucagaa

SEQ ID NO: 791154 - RNA, 18 nt, Homo sapiens
ucccuugggaagggcagg

SEQ ID NO: 791155 - RNA, 15 nt, Homo sapiens
ucccuuucacuaaaa

SEQ ID NO: 791156 - RNA, 13 nt, Homo sapiens
ucccuuugcuccc

SEQ ID NO: 791157 - RNA, 20 nt, Homo sapiens
ucccuuuuacauacugcugu

SEQ ID NO: 791158 - RNA, 23 nt, Homo sapiens
ucccuuuuuauaucccauuuuua

SEQ ID NO: 791159 - RNA, 19 nt, Homo sapiens
uccgagaggugggccaguc

SEQ ID NO: 791160 - RNA, 16 nt, Homo sapiens
uccgagcggcuacaaa

SEQ ID NO: 791161 - RNA, 20 nt, Homo sapiens
uccgaggcuccccgccucca

SEQ ID NO: 791162 - RNA, 19 nt, Homo sapiens
uccgagucucagcccugac

SEQ ID NO: 791163 - RNA, 18 nt, Homo sapiens
uccgauuccccuguagca

SEQ ID NO: 791164 - RNA, 22 nt, Homo sapiens
uccgcaagcaucaucccuggau

SEQ ID NO: 791165 - RNA, 13 nt, Homo sapiens
uccgcacuguaaa

SEQ ID NO: 791166 - RNA, 14 nt, Homo sapiens
uccgcccugccacu

SEQ ID NO: 791167 - RNA, 20 nt, Homo sapiens
uccgccucccauguucaagc

SEQ ID NO: 791168 - RNA, 17 nt, Homo sapiens
uccgcuuucucuugcug

SEQ ID NO: 791169 - RNA, 19 nt, Homo sapiens
uccgucccccaaacauguu

SEQ ID NO: 791170 - RNA, 14 nt, Homo sapiens
uccgucucuguccu

SEQ ID NO: 791171 - RNA, 16 nt, Homo sapiens
uccgucuucacacugc

SEQ ID NO: 791172 - RNA, 19 nt, Homo sapiens
uccgugccuccaccaccac

SEQ ID NO: 791173 - RNA, 19 nt, Homo sapiens
uccguggucagagugccac

SEQ ID NO: 791174 - RNA, 15 nt, Homo sapiens
uccguucaauaagca

SEQ ID NO: 791175 - RNA, 19 nt, Homo sapiens
uccuaaaaaucuguggcaa

SEQ ID NO: 791176 - RNA, 13 nt, Homo sapiens
uccuaaaaucaca

SEQ ID NO: 791177 - RNA, 14 nt, Homo sapiens
uccuaaacauaauu

SEQ ID NO: 791178 - RNA, 20 nt, Homo sapiens
uccuaaauuuuuacaucaaa

SEQ ID NO: 791179 - RNA, 23 nt, Homo sapiens
uccuaacaggaugaaaguucccc

SEQ ID NO: 791180 - RNA, 23 nt, Homo sapiens
uccuaacauccuuggacugagaa

SEQ ID NO: 791181 - RNA, 23 nt, Homo sapiens
uccuaagcuggagugcaguggca

SEQ ID NO: 791182 - RNA, 19 nt, Homo sapiens
uccuaaggaauuaccaaga

SEQ ID NO: 791183 - RNA, 15 nt, Homo sapiens
uccuaauaugcuuua

SEQ ID NO: 791184 - RNA, 22 nt, Homo sapiens
uccuaauaugcuuuacaaucug

SEQ ID NO: 791185 - RNA, 16 nt, Homo sapiens
uccuguauuccugacc

SEQ ID NO: 791186 - RNA, 14 nt, Homo sapiens
uccuguccagcucc

SEQ ID NO: 791187 - RNA, 23 nt, Homo sapiens
uccuguccagcuccaaccugcaa

SEQ ID NO: 791188 - RNA, 13 nt, Homo sapiens
uccugucugccag

SEQ ID NO: 791189 - RNA, 21 nt, Homo sapiens
uccugucuuaugguccagaaa

SEQ ID NO: 791190 - RNA, 16 nt, Homo sapiens
uccugugaagggacac

SEQ ID NO: 791191 - RNA, 22 nt, Homo sapiens
uccugugacaacacucaucaca

SEQ ID NO: 791192 - RNA, 13 nt, Homo sapiens
uccugugacuguc

SEQ ID NO: 791193 - RNA, 20 nt, Homo sapiens
uccugugacugucucacuua

SEQ ID NO: 791194 - RNA, 13 nt, Homo sapiens
uccugugauccac

SEQ ID NO: 791195 - RNA, 18 nt, Homo sapiens
uccugugauuuaugccaa

SEQ ID NO: 791196 - RNA, 13 nt, Homo sapiens
uccugugcuggaa

SEQ ID NO: 791197 - RNA, 14 nt, Homo sapiens
uccuguguagcaua

SEQ ID NO: 791198 - RNA, 17 nt, Homo sapiens
uccuguguguacucugu

SEQ ID NO: 791199 - RNA, 14 nt, Homo sapiens
uccuguguucuaga

SEQ ID NO: 791200 - RNA, 23 nt, Homo sapiens
uccuguucuuccuauuucuuuca

SEQ ID NO: 791201 - RNA, 17 nt, Homo sapiens
uccuguugcugucuuca

SEQ ID NO: 791202 - RNA, 21 nt, Homo sapiens
uccuuaaaacaauucugugac

SEQ ID NO: 791203 - RNA, 20 nt, Homo sapiens
uccuuaaauaugugaaagga

SEQ ID NO: 791204 - RNA, 14 nt, Homo sapiens
uccuuaaccuuaac

SEQ ID NO: 791205 - RNA, 15 nt, Homo sapiens
uccuuaacuucaggg

SEQ ID NO: 791206 - RNA, 14 nt, Homo sapiens
uccuuaagggacaa

SEQ ID NO: 791207 - RNA, 23 nt, Homo sapiens
uccuuaauaacaacagaucugca

SEQ ID NO: 791208 - RNA, 13 nt, Homo sapiens
uccuuaaugcaga

SEQ ID NO: 791209 - RNA, 13 nt, Homo sapiens
uccuuaccgcaca

SEQ ID NO: 791210 - RNA, 20 nt, Homo sapiens
uccuuacgcuuugucacaca

SEQ ID NO: 791211 - RNA, 13 nt, Homo sapiens
uccuuacugauau

SEQ ID NO: 791212 - RNA, 19 nt, Homo sapiens
uccuuagucucaagggcua

SEQ ID NO: 791213 - RNA, 17 nt, Homo sapiens
uccuuaguuggcuggaa

SEQ ID NO: 791214 - RNA, 15 nt, Homo sapiens
uccuuaucacugaca

SEQ ID NO: 791215 - RNA, 18 nt, Homo sapiens
uccuuauuguuaaaaaca

SEQ ID NO: 791216 - RNA, 21 nt, Homo sapiens
uccuuauuuugugugcuuucc

SEQ ID NO: 791217 - RNA, 15 nt, Homo sapiens
uccuucaagaacucu

SEQ ID NO: 791218 - RNA, 23 nt, Homo sapiens
uccuucacaggcagugcauguga

SEQ ID NO: 791219 - RNA, 13 nt, Homo sapiens
uccuucauucacu

SEQ ID NO: 791220 - RNA, 14 nt, Homo sapiens
uccuuccaccucag

SEQ ID NO: 791221 - RNA, 13 nt, Homo sapiens
uccuuccauucca

SEQ ID NO: 791222 - RNA, 22 nt, Homo sapiens
uccuucccacccccaguccugu

SEQ ID NO: 791223 - RNA, 14 nt, Homo sapiens
uccuuccuaccucu

SEQ ID NO: 791224 - RNA, 19 nt, Homo sapiens
uccuucgaaaggccuucag

SEQ ID NO: 791225 - RNA, 21 nt, Homo sapiens
uccuucugccuaacuuguaaa

SEQ ID NO: 791226 - RNA, 23 nt, Homo sapiens
uccuugagaagugggagcacccu

SEQ ID NO: 791227 - RNA, 23 nt, Homo sapiens
uccuugagaggagaaaugcaaua

SEQ ID NO: 791228 - RNA, 12 nt, Homo sapiens
uccuugcacuuu

SEQ ID NO: 791229 - RNA, 18 nt, Homo sapiens
uccuugcccccauuucac

SEQ ID NO: 791230 - RNA, 15 nt, Homo sapiens
uccuuggcagaggca

SEQ ID NO: 791231 - RNA, 15 nt, Homo sapiens
uccuuggccacagac

SEQ ID NO: 791232 - RNA, 14 nt, Homo sapiens
uccuuggcuuuaug

SEQ ID NO: 791233 - RNA, 15 nt, Homo sapiens
uccuuggcuuuaugc

SEQ ID NO: 791234 - RNA, 16 nt, Homo sapiens
uccuuggggagcacuu

SEQ ID NO: 791235 - RNA, 17 nt, Homo sapiens
uccuuguaaagacugua

SEQ ID NO: 791236 - RNA, 22 nt, Homo sapiens
uccuugugcaaaauauuugacu

SEQ ID NO: 791237 - RNA, 23 nt, Homo sapiens
uccuugugcaaaauauuugacua

SEQ ID NO: 791238 - RNA, 22 nt, Homo sapiens
uccuugugguugaaaaccacag

SEQ ID NO: 791239 - RNA, 19 nt, Homo sapiens
uccuuuacuacgaaguaua

SEQ ID NO: 791240 - RNA, 18 nt, Homo sapiens
uccuuuaguaccugaaaa

SEQ ID NO: 791241 - RNA, 20 nt, Homo sapiens
uccuuuaugaugacugcuua

SEQ ID NO: 791242 - RNA, 13 nt, Homo sapiens
uccuuucuugcag

SEQ ID NO: 791243 - RNA, 16 nt, Homo sapiens
uccuuugaagcuuuag

SEQ ID NO: 791244 - RNA, 20 nt, Homo sapiens
uccuuugccugauccuccaa

SEQ ID NO: 791245 - RNA, 19 nt, Homo sapiens
uccuuugcucccuguugcu

SEQ ID NO: 791246 - RNA, 15 nt, Homo sapiens
uccuuugcugcugag

SEQ ID NO: 791247 - RNA, 22 nt, Homo sapiens
uccuuuggaacaagacagccuu

SEQ ID NO: 791248 - RNA, 18 nt, Homo sapiens
uccuuuuaguauucuuag

SEQ ID NO: 791249 - RNA, 13 nt, Homo sapiens
uccuuuuccuuau

SEQ ID NO: 791250 - RNA, 13 nt, Homo sapiens
uccuuuucuuccc

SEQ ID NO: 791251 - RNA, 23 nt, Homo sapiens
uccuuuugaaagaaucagucuug

SEQ ID NO: 791252 - RNA, 21 nt, Homo sapiens
ucacaagugaaaaacauccag

SEQ ID NO: 791253 - RNA, 13 nt, Homo sapiens
ucacaaguucaau

SEQ ID NO: 791254 - RNA, 18 nt, Homo sapiens
ucacaauacucaaaagag

SEQ ID NO: 791255 - RNA, 20 nt, Homo sapiens
ucacaaucuuggggcugaug

SEQ ID NO: 791256 - RNA, 19 nt, Homo sapiens
ucacacaacacugauguga

SEQ ID NO: 791257 - RNA, 17 nt, Homo sapiens
ucacacaccccucaaaa

SEQ ID NO: 791258 - RNA, 11 nt, Homo sapiens
ucacacagugu

SEQ ID NO: 791259 - RNA, 14 nt, Homo sapiens
ucacaccaacagug

SEQ ID NO: 791260 - RNA, 21 nt, Homo sapiens
ucacacugaaucagcugcuga

SEQ ID NO: 791261 - RNA, 17 nt, Homo sapiens
ucacacuuccaccagcc

SEQ ID NO: 791262 - RNA, 22 nt, Homo sapiens
ucacagaaaguucuuaaacuca

SEQ ID NO: 791263 - RNA, 19 nt, Homo sapiens
ucacagaacuauguacuuu

SEQ ID NO: 791264 - RNA, 12 nt, Homo sapiens
ucacagagucaa

SEQ ID NO: 791265 - RNA, 19 nt, Homo sapiens
ucacagagugagacuccau

SEQ ID NO: 791266 - RNA, 23 nt, Homo sapiens
ucacagagugagacuccaucuca

SEQ ID NO: 791267 - RNA, 15 nt, Homo sapiens
ucacagagugcauug

SEQ ID NO: 791268 - RNA, 16 nt, Homo sapiens
ucacagagugcauugu

SEQ ID NO: 791269 - RNA, 23 nt, Homo sapiens
ucacagcccagcccgcccacugg

SEQ ID NO: 791270 - RNA, 17 nt, Homo sapiens
ucacagcccucaugauc

SEQ ID NO: 791271 - RNA, 16 nt, Homo sapiens
ucacagcuccucccac

SEQ ID NO: 791272 - RNA, 15 nt, Homo sapiens
ucacaguaauguguc

SEQ ID NO: 791273 - RNA, 17 nt, Homo sapiens
ucacagugacacuggac

SEQ ID NO: 791274 - RNA, 19 nt, Homo sapiens
ucacagugacccuucccaa

SEQ ID NO: 791275 - RNA, 21 nt, Homo sapiens
ucacaguguuuuuauugcucg

SEQ ID NO: 791276 - RNA, 23 nt, Homo sapiens
ucacaguucuuugggccagacau

SEQ ID NO: 791277 - RNA, 17 nt, Homo sapiens
ucacaucagcaauuuca

SEQ ID NO: 791278 - RNA, 19 nt, Homo sapiens
ucacauccaucccuccauu

SEQ ID NO: 791279 - RNA, 16 nt, Homo sapiens
ucacaucugcaucuua

SEQ ID NO: 791280 - RNA, 22 nt, Homo sapiens
ucacaucuuccaccagcaccuu

SEQ ID NO: 791281 - RNA, 20 nt, Homo sapiens
ucacaugcuagcagcuguga

SEQ ID NO: 791282 - RNA, 18 nt, Homo sapiens
ucacauggccuaugcaca

SEQ ID NO: 791283 - RNA, 20 nt, Homo sapiens
ucacauggccuaugcacaua

SEQ ID NO: 791284 - RNA, 22 nt, Homo sapiens
ucacauggccuaugcacauaug

SEQ ID NO: 791285 - RNA, 23 nt, Homo sapiens
ucacauuggcuauuuaaagacaa

SEQ ID NO: 791286 - RNA, 11 nt, Homo sapiens
ucacauuugcg

SEQ ID NO: 791287 - RNA, 14 nt, Homo sapiens
ucaccaagugcaau

SEQ ID NO: 791288 - RNA, 17 nt, Homo sapiens
ucaccaaugagccuuag

SEQ ID NO: 791289 - RNA, 18 nt, Homo sapiens
ucaccaaugagccuuagu

SEQ ID NO: 791290 - RNA, 17 nt, Homo sapiens
ucaccaccaaaugccaa

SEQ ID NO: 791291 - RNA, 15 nt, Homo sapiens
ucaccacccugcuca

SEQ ID NO: 791292 - RNA, 23 nt, Homo sapiens
ucaccacugaaacccugcacuua

SEQ ID NO: 791293 - RNA, 15 nt, Homo sapiens
ucaccagauuugcua

SEQ ID NO: 791294 - RNA, 18 nt, Homo sapiens
ucaccagccccacugcca

SEQ ID NO: 791295 - RNA, 12 nt, Homo sapiens
ucaccaggggag

SEQ ID NO: 791296 - RNA, 17 nt, Homo sapiens
ucaccaggggugcucac

SEQ ID NO: 791297 - RNA, 19 nt, Homo sapiens
ucaccaggguuucucugaa

SEQ ID NO: 791298 - RNA, 20 nt, Homo sapiens
ucaccagucugucuacugug

SEQ ID NO: 791299 - RNA, 14 nt, Homo sapiens
ucaccauguacaua

SEQ ID NO: 791300 - RNA, 12 nt, Homo sapiens
ucaccauguugg

SEQ ID NO: 791301 - RNA, 13 nt, Homo sapiens
ucgucuacugcaa

SEQ ID NO: 791302 - RNA, 20 nt, Homo sapiens
ucgucugcgcagugguugcu

SEQ ID NO: 791303 - RNA, 19 nt, Homo sapiens
ucgugaaaccccaucucua

SEQ ID NO: 791304 - RNA, 16 nt, Homo sapiens
ucgugaagaagccugu

SEQ ID NO: 791305 - RNA, 13 nt, Homo sapiens
ucgugcacucugc

SEQ ID NO: 791306 - RNA, 15 nt, Homo sapiens
ucguggacugugcug

SEQ ID NO: 791307 - RNA, 13 nt, Homo sapiens
ucguuaccagaga

SEQ ID NO: 791308 - RNA, 13 nt, Homo sapiens
ucguucccagugu

SEQ ID NO: 791309 - RNA, 16 nt, Homo sapiens
ucguucuccacccacc

SEQ ID NO: 791310 - RNA, 17 nt, Homo sapiens
ucguuuaaaaacaaagg

SEQ ID NO: 791311 - RNA, 16 nt, Homo sapiens
ucguuuugaugccauu

SEQ ID NO: 791312 - RNA, 15 nt, Homo sapiens
ucuaaaaucugcuag

SEQ ID NO: 791313 - RNA, 23 nt, Homo sapiens
ucuaaagcuuuggacaaguccuu

SEQ ID NO: 791314 - RNA, 23 nt, Homo sapiens
ucuaaauuugaauguuaagcaga

SEQ ID NO: 791315 - RNA, 20 nt, Homo sapiens
ucuaaauuuuauaucuugua

SEQ ID NO: 791316 - RNA, 17 nt, Homo sapiens
ucuaacaaaacaaguug

SEQ ID NO: 791317 - RNA, 12 nt, Homo sapiens
ucuaacauuucc

SEQ ID NO: 791318 - RNA, 12 nt, Homo sapiens
ucuaaccauuca

SEQ ID NO: 791319 - RNA, 19 nt, Homo sapiens
ucuaacuagaaaucugcca

SEQ ID NO: 791320 - RNA, 20 nt, Homo sapiens
ucuaacuagaaaucugccaa

SEQ ID NO: 791321 - RNA, 18 nt, Homo sapiens
ucuaacucagaaacauca

SEQ ID NO: 791322 - RNA, 16 nt, Homo sapiens
ucuaacucagaauuau

SEQ ID NO: 791323 - RNA, 12 nt, Homo sapiens
ucuaacucuccc

SEQ ID NO: 791324 - RNA, 21 nt, Homo sapiens
ucuaacuuuugugaagaacua

SEQ ID NO: 791325 - RNA, 20 nt, Homo sapiens
ucuaagacuacuaugaacag

SEQ ID NO: 791326 - RNA, 12 nt, Homo sapiens
ucuaagcugugu

SEQ ID NO: 791327 - RNA, 18 nt, Homo sapiens
ucuaagcuuauuucuaac

SEQ ID NO: 791328 - RNA, 19 nt, Homo sapiens
ucuaagguaguaacuuucc

SEQ ID NO: 791329 - RNA, 16 nt, Homo sapiens
ucuaaguaaaaccaca

SEQ ID NO: 791330 - RNA, 19 nt, Homo sapiens
ucuaaguaaaaccacagca

SEQ ID NO: 791331 - RNA, 14 nt, Homo sapiens
ucuaagugggagaa

SEQ ID NO: 791332 - RNA, 17 nt, Homo sapiens
ucuaaguucauguuugu

SEQ ID NO: 791333 - RNA, 15 nt, Homo sapiens
ucuaauaauuauuca

SEQ ID NO: 791334 - RNA, 17 nt, Homo sapiens
ucuaaucaagaaaagaa

SEQ ID NO: 791335 - RNA, 22 nt, Homo sapiens
ucuaaucaagaaaagaauuaca

SEQ ID NO: 791336 - RNA, 18 nt, Homo sapiens
ucuaaugagacugaccau

SEQ ID NO: 791337 - RNA, 18 nt, Homo sapiens
ucuaauucggauuugcca

SEQ ID NO: 791338 - RNA, 13 nt, Homo sapiens
ucuaauugcugug

SEQ ID NO: 791339 - RNA, 15 nt, Homo sapiens
ucuacaaaaaaccag

SEQ ID NO: 791340 - RNA, 16 nt, Homo sapiens
ucuacaaaaugccaag

SEQ ID NO: 791341 - RNA, 14 nt, Homo sapiens
ucuacaacauagca

SEQ ID NO: 791342 - RNA, 20 nt, Homo sapiens
ucuacacagauggaaucucu

SEQ ID NO: 791343 - RNA, 23 nt, Homo sapiens
ucuacaccaaugaaaacauguac

SEQ ID NO: 791344 - RNA, 17 nt, Homo sapiens
ucuacacugagguuuga

SEQ ID NO: 791345 - RNA, 23 nt, Homo sapiens
ucuacagcagcacuguucugucc

SEQ ID NO: 791346 - RNA, 17 nt, Homo sapiens
ucuacauaaguaauuca

SEQ ID NO: 791347 - RNA, 21 nt, Homo sapiens
ucuacauaaguaauucaagaa

SEQ ID NO: 791348 - RNA, 15 nt, Homo sapiens
ucuacauacuaugga

SEQ ID NO: 791349 - RNA, 22 nt, Homo sapiens
ucuacauuaaaucacuugaauc

SEQ ID NO: 791350 - RNA, 18 nt, Homo sapiens
ucuacauugagcauuuga

SEQ ID NO: 791351 - RNA, 21 nt, Homo sapiens
ucuacauuucaccuacuuugu

SEQ ID NO: 791352 - RNA, 16 nt, Homo sapiens
ucuaccaggcaaauuc

SEQ ID NO: 791353 - RNA, 17 nt, Homo sapiens
ucuaccaggcaaauuca

SEQ ID NO: 791354 - RNA, 18 nt, Homo sapiens
ucuaccagucuauuucca

SEQ ID NO: 791355 - RNA, 16 nt, Homo sapiens
ucuaccccugcuccca

SEQ ID NO: 791356 - RNA, 19 nt, Homo sapiens
ucuaccugccucagccucc

SEQ ID NO: 791357 - RNA, 16 nt, Homo sapiens
ucuaccuugcagugua

SEQ ID NO: 791358 - RNA, 18 nt, Homo sapiens
ucuaccuuuugcuacuua

SEQ ID NO: 791359 - RNA, 20 nt, Homo sapiens
ucuaccuuuugcuacuuauu

SEQ ID NO: 791360 - RNA, 20 nt, Homo sapiens
ucuacgaggccauccagucc

SEQ ID NO: 791361 - RNA, 19 nt, Homo sapiens
ucuacuaaaaacacaaaaa

SEQ ID NO: 791362 - RNA, 20 nt, Homo sapiens
ucuacuacaaacuucaaaga

SEQ ID NO: 791363 - RNA, 16 nt, Homo sapiens
ucuacuacaugugacu

SEQ ID NO: 791364 - RNA, 17 nt, Homo sapiens
ucuacuccuaccucagc

SEQ ID NO: 791365 - RNA, 21 nt, Homo sapiens
ucuacucugucuuaaaugaga

SEQ ID NO: 791366 - RNA, 17 nt, Homo sapiens
ucuacucuugucauuuu

SEQ ID NO: 791367 - RNA, 21 nt, Homo sapiens
ucuacugcuuggauccauaca

SEQ ID NO: 791368 - RNA, 15 nt, Homo sapiens
ucuacuucagucuuc

SEQ ID NO: 791369 - RNA, 23 nt, Homo sapiens
agcauuacccuccucucucccca

SEQ ID NO: 791370 - RNA, 23 nt, Homo sapiens
agcauugguuauucaaguauuca

SEQ ID NO: 791371 - RNA, 20 nt, Homo sapiens
agcauuuccaacaccacaga

SEQ ID NO: 791372 - RNA, 23 nt, Homo sapiens
agcauuuccaacaccacagacac

SEQ ID NO: 791373 - RNA, 19 nt, Homo sapiens
agcauuucuuuucuggcca

SEQ ID NO: 791374 - RNA, 23 nt, Homo sapiens
agcauuugguagaaggacugaac

SEQ ID NO: 791375 - RNA, 22 nt, Homo sapiens
agcauuugguuuuacacaggaa

SEQ ID NO: 791376 - RNA, 14 nt, Homo sapiens
agccaaacccauga

SEQ ID NO: 791377 - RNA, 23 nt, Homo sapiens
agccaaaccccuagagacaguga

SEQ ID NO: 791378 - RNA, 20 nt, Homo sapiens
agccaacuguuucccugcug

SEQ ID NO: 791379 - RNA, 13 nt, Homo sapiens
agccaagggcuga

SEQ ID NO: 791380 - RNA, 16 nt, Homo sapiens
agccaagggcugagug

SEQ ID NO: 791381 - RNA, 14 nt, Homo sapiens
agccacagccugac

SEQ ID NO: 791382 - RNA, 21 nt, Homo sapiens
agccacaggccugagauuuca

SEQ ID NO: 791383 - RNA, 19 nt, Homo sapiens
agccacccguggggugcug

SEQ ID NO: 791384 - RNA, 13 nt, Homo sapiens
agccaccugcaag

SEQ ID NO: 791385 - RNA, 14 nt, Homo sapiens
agccacgugaaugg

SEQ ID NO: 791386 - RNA, 11 nt, Homo sapiens
agccacuggaa

SEQ ID NO: 791387 - RNA, 17 nt, Homo sapiens
agccacuggcuuggaac

SEQ ID NO: 791388 - RNA, 16 nt, Homo sapiens
agccacugguuucuca

SEQ ID NO: 791389 - RNA, 17 nt, Homo sapiens
agccacugguuucucag

SEQ ID NO: 791390 - RNA, 18 nt, Homo sapiens
agccacugguuucucaga

SEQ ID NO: 791391 - RNA, 16 nt, Homo sapiens
agugggagccaaugaa

SEQ ID NO: 791392 - RNA, 20 nt, Homo sapiens
agugggagcugagcuggaag

SEQ ID NO: 791393 - RNA, 14 nt, Homo sapiens
agugggcuccagua

SEQ ID NO: 791394 - RNA, 16 nt, Homo sapiens
aguggggaacuacugc

SEQ ID NO: 791395 - RNA, 15 nt, Homo sapiens
agugggguagguugg

SEQ ID NO: 791396 - RNA, 21 nt, Homo sapiens
aguggguuugccccaucacuu

SEQ ID NO: 791397 - RNA, 14 nt, Homo sapiens
agugguacaaucug

SEQ ID NO: 791398 - RNA, 18 nt, Homo sapiens
agugguacaaucuggcuc

SEQ ID NO: 791399 - RNA, 19 nt, Homo sapiens
agugguauagaguacugca

SEQ ID NO: 791400 - RNA, 12 nt, Homo sapiens
aguggucuucaa

SEQ ID NO: 791401 - RNA, 16 nt, Homo sapiens
aguggugcccuggaac

SEQ ID NO: 791402 - RNA, 21 nt, Homo sapiens
aguggugcccuggaacacucc

SEQ ID NO: 791403 - RNA, 14 nt, Homo sapiens
aguggugcugcuuu

SEQ ID NO: 791404 - RNA, 21 nt, Homo sapiens
agugguguucagccaagugac

SEQ ID NO: 791405 - RNA, 13 nt, Homo sapiens
agugguucaagca

SEQ ID NO: 791406 - RNA, 14 nt, Homo sapiens
agugguuguugcca

SEQ ID NO: 791407 - RNA, 13 nt, Homo sapiens
agugguuucccau

SEQ ID NO: 791408 - RNA, 18 nt, Homo sapiens
aguguaaaaacaaugugc

SEQ ID NO: 791409 - RNA, 13 nt, Homo sapiens
aguguaacacugc

SEQ ID NO: 791410 - RNA, 17 nt, Homo sapiens
aguguacaaaacuguaa

SEQ ID NO: 791411 - RNA, 14 nt, Homo sapiens
aguguacucuauaa

SEQ ID NO: 791412 - RNA, 15 nt, Homo sapiens
aguguagacuguggc

SEQ ID NO: 791413 - RNA, 20 nt, Homo sapiens
ugauagauuucuacacugag

SEQ ID NO: 791414 - RNA, 19 nt, Homo sapiens
ugauagcguggaggcugca

SEQ ID NO: 791415 - RNA, 17 nt, Homo sapiens
ugauagcuuacacugag

SEQ ID NO: 791416 - RNA, 11 nt, Homo sapiens
ugauagcuuua

SEQ ID NO: 791417 - RNA, 13 nt, Homo sapiens
ugauagcuuuauu

SEQ ID NO: 791418 - RNA, 21 nt, Homo sapiens
ugauaggaagcgucuggcaga

SEQ ID NO: 791419 - RNA, 18 nt, Homo sapiens
ugauagucaccugcuggu

SEQ ID NO: 791420 - RNA, 14 nt, Homo sapiens
ugauauauugcugu

SEQ ID NO: 791421 - RNA, 15 nt, Homo sapiens
ugauauauuucagcu

SEQ ID NO: 791422 - RNA, 15 nt, Homo sapiens
ugauaucaacagcuu

SEQ ID NO: 791423 - RNA, 15 nt, Homo sapiens
ugauaugcaacugca

SEQ ID NO: 791424 - RNA, 12 nt, Homo sapiens
ugauaugcauau

SEQ ID NO: 791425 - RNA, 18 nt, Homo sapiens
ugauauguaaacauaauu

SEQ ID NO: 791426 - RNA, 16 nt, Homo sapiens
ugauauguaaguacuu

SEQ ID NO: 791427 - RNA, 19 nt, Homo sapiens
ugauauguauccaucagga

SEQ ID NO: 791428 - RNA, 21 nt, Homo sapiens
ugauauuauggcaagugauau

SEQ ID NO: 791429 - RNA, 15 nt, Homo sapiens
ugaucaaaaacuauu

SEQ ID NO: 791430 - RNA, 18 nt, Homo sapiens
ugaucaaaggacaaagac

SEQ ID NO: 791431 - RNA, 16 nt, Homo sapiens
ugaucaaauauuucaa

SEQ ID NO: 791432 - RNA, 20 nt, Homo sapiens
ugaucaagguuaacaaagaa

SEQ ID NO: 791433 - RNA, 17 nt, Homo sapiens
ugaucaauaaaauguga

SEQ ID NO: 791434 - RNA, 17 nt, Homo sapiens
ugaucaccaagcaggaa

SEQ ID NO: 791435 - RNA, 17 nt, Homo sapiens
ugaucagaguuccuccu

SEQ ID NO: 791436 - RNA, 22 nt, Homo sapiens
ugaucagaguuccuccuacuua

SEQ ID NO: 791437 - RNA, 21 nt, Homo sapiens
ugaucaggcuauguauggaau

SEQ ID NO: 791438 - RNA, 17 nt, Homo sapiens
ugaucaugccacugcac

SEQ ID NO: 791439 - RNA, 21 nt, Homo sapiens
ugaucauguguggaaguuauu

SEQ ID NO: 791440 - RNA, 16 nt, Homo sapiens
ugauccagagcacaga

SEQ ID NO: 791441 - RNA, 12 nt, Homo sapiens
ugauccauaaag

SEQ ID NO: 791442 - RNA, 13 nt, Homo sapiens
ugaucccagucac

SEQ ID NO: 791443 - RNA, 14 nt, Homo sapiens
ugauccuaaccuug

SEQ ID NO: 791444 - RNA, 15 nt, Homo sapiens
ugauccuuccaccuc

SEQ ID NO: 791445 - RNA, 18 nt, Homo sapiens
ugaucuaagcaguggcau

SEQ ID NO: 791446 - RNA, 14 nt, Homo sapiens
ugaucuaauuuaca

SEQ ID NO: 791447 - RNA, 16 nt, Homo sapiens
ugaucuacuugccuca

SEQ ID NO: 791448 - RNA, 11 nt, Homo sapiens
ugaucucagcu

SEQ ID NO: 791449 - RNA, 21 nt, Homo sapiens
ugaucucaggggucuuaccuu

SEQ ID NO: 791450 - RNA, 19 nt, Homo sapiens
ugaucucggcucacugcaa

SEQ ID NO: 791451 - RNA, 20 nt, Homo sapiens
ugaucuuggcaguggaacau

SEQ ID NO: 791452 - RNA, 16 nt, Homo sapiens
ugaugaaaauggcagu

SEQ ID NO: 791453 - RNA, 17 nt, Homo sapiens
ugaugaaagcugauuac

SEQ ID NO: 791454 - RNA, 23 nt, Homo sapiens
ugaugacuuagcgucaagacauu

SEQ ID NO: 791455 - RNA, 19 nt, Homo sapiens
ugaugacuugccauuaaaa

SEQ ID NO: 791456 - RNA, 23 nt, Homo sapiens
ugaugagacccuuuuaucugcug

SEQ ID NO: 791457 - RNA, 13 nt, Homo sapiens
ugaugaugaaggg

SEQ ID NO: 791458 - RNA, 15 nt, Homo sapiens
ugaugccauucuucc

SEQ ID NO: 791459 - RNA, 15 nt, Homo sapiens
ugauggcaccacugc

SEQ ID NO: 791460 - RNA, 18 nt, Homo sapiens
ugauggcccauacuugua

SEQ ID NO: 791461 - RNA, 15 nt, Homo sapiens
ugauguaacauugua

SEQ ID NO: 791462 - RNA, 17 nt, Homo sapiens
ugcaguguggaguucac

SEQ ID NO: 791463 - RNA, 14 nt, Homo sapiens
ugcaguugcucagg

SEQ ID NO: 791464 - RNA, 18 nt, Homo sapiens
ugcaguuggacucucagg

SEQ ID NO: 791465 - RNA, 13 nt, Homo sapiens
ugcaguugugauu

SEQ ID NO: 791466 - RNA, 14 nt, Homo sapiens
ugcaguugugauuu

SEQ ID NO: 791467 - RNA, 22 nt, Homo sapiens
ugcaguuuacuauugcuaucuu

SEQ ID NO: 791468 - RNA, 15 nt, Homo sapiens
ugcauaaaugcauaa

SEQ ID NO: 791469 - RNA, 14 nt, Homo sapiens
ugcauaagauuaaa

SEQ ID NO: 791470 - RNA, 18 nt, Homo sapiens
ugcauaagcugaacuaaa

SEQ ID NO: 791471 - RNA, 14 nt, Homo sapiens
ugcauaauaagcua

SEQ ID NO: 791472 - RNA, 22 nt, Homo sapiens
ugcauaauguuucuggauuuca

SEQ ID NO: 791473 - RNA, 14 nt, Homo sapiens
ugcauacccgggca

SEQ ID NO: 791474 - RNA, 20 nt, Homo sapiens
ugcauacuuucccucaucca

SEQ ID NO: 791475 - RNA, 21 nt, Homo sapiens
ugcauacuuucccucauccau

SEQ ID NO: 791476 - RNA, 20 nt, Homo sapiens
ugcauagcagaccacacaga

SEQ ID NO: 791477 - RNA, 15 nt, Homo sapiens
ugcauaggcucuuaa

SEQ ID NO: 791478 - RNA, 13 nt, Homo sapiens
ugcauauuugcua

SEQ ID NO: 791479 - RNA, 21 nt, Homo sapiens
ugcaucacauauucauauugu

SEQ ID NO: 791480 - RNA, 22 nt, Homo sapiens
ugcauccccuuggcccaucugu

SEQ ID NO: 791481 - RNA, 22 nt, Homo sapiens
ugcaucuuugccucaacuccag

SEQ ID NO: 791482 - RNA, 15 nt, Homo sapiens
ugcaugacagucaca

SEQ ID NO: 791483 - RNA, 16 nt, Homo sapiens
ugcaugauaagagcau

SEQ ID NO: 791484 - RNA, 21 nt, Homo sapiens
ugcaugcccuaagagugucac

SEQ ID NO: 791485 - RNA, 18 nt, Homo sapiens
ugcaugugcauauagaca

SEQ ID NO: 791486 - RNA, 14 nt, Homo sapiens
ugcauuauaucaaa

SEQ ID NO: 791487 - RNA, 16 nt, Homo sapiens
ugcauuauaucaaauc

SEQ ID NO: 791488 - RNA, 15 nt, Homo sapiens
ugcauucacccagac

SEQ ID NO: 791489 - RNA, 21 nt, Homo sapiens
ugcauucuucugagcacuguu

SEQ ID NO: 791490 - RNA, 18 nt, Homo sapiens
ugcauugucuaaugacag

SEQ ID NO: 791491 - RNA, 20 nt, Homo sapiens
ugcauuuaaaacagacacug

SEQ ID NO: 791492 - RNA, 15 nt, Homo sapiens
ugcauuuacuuuuaa

SEQ ID NO: 791493 - RNA, 22 nt, Homo sapiens
ugcauuuauggucaacacuuaa

SEQ ID NO: 791494 - RNA, 16 nt, Homo sapiens
ugcauuucacaugccu

SEQ ID NO: 791495 - RNA, 20 nt, Homo sapiens
ugcauuugugguaaucuaca

SEQ ID NO: 791496 - RNA, 17 nt, Homo sapiens
ugcauuuuuaaauacaa

SEQ ID NO: 791497 - RNA, 16 nt, Homo sapiens
ugcauuuuuagaccau

SEQ ID NO: 791498 - RNA, 20 nt, Homo sapiens
ugccaaaaacuaaaauucaa

SEQ ID NO: 791499 - RNA, 22 nt, Homo sapiens
ugccaaaauaccagagccuuca

SEQ ID NO: 791500 - RNA, 14 nt, Homo sapiens
ugccaaaccacaag

SEQ ID NO: 791501 - RNA, 19 nt, Homo sapiens
ugccaaaguagcugaugua

SEQ ID NO: 791502 - RNA, 23 nt, Homo sapiens
ugccaaaguuuugcugucucuua

SEQ ID NO: 791503 - RNA, 19 nt, Homo sapiens
ugccaaauagccccagacu

SEQ ID NO: 791504 - RNA, 13 nt, Homo sapiens
ugccaaauugcug

SEQ ID NO: 791505 - RNA, 20 nt, Homo sapiens
ugccaaccagagcagcucac

SEQ ID NO: 791506 - RNA, 20 nt, Homo sapiens
ugccaaccucuggagcaaug

SEQ ID NO: 791507 - RNA, 18 nt, Homo sapiens
ugccaacuugauguucca

SEQ ID NO: 791508 - RNA, 22 nt, Homo sapiens
ugccaacuuuuuguuacagauu

SEQ ID NO: 791509 - RNA, 13 nt, Homo sapiens
ugccaagacuccu

SEQ ID NO: 791510 - RNA, 12 nt, Homo sapiens
ugccaagccaga

SEQ ID NO: 791511 - RNA, 21 nt, Homo sapiens
ugccaaggaaacccccagugu

SEQ ID NO: 791512 - RNA, 22 nt, Homo sapiens
ugccaaggaaacccccagugua

SEQ ID NO: 791513 - RNA, 19 nt, Homo sapiens
ugccaauggcggacucaaa

SEQ ID NO: 791514 - RNA, 22 nt, Homo sapiens
ugccaaugguggaucuuugcua

SEQ ID NO: 791515 - RNA, 23 nt, Homo sapiens
ugccaauugaauaggaucaaauu

SEQ ID NO: 791516 - RNA, 12 nt, Homo sapiens
ugccacaaccag

SEQ ID NO: 791517 - RNA, 13 nt, Homo sapiens
ugccacacugaau

SEQ ID NO: 791518 - RNA, 16 nt, Homo sapiens
ugccacagaugauacu

SEQ ID NO: 791519 - RNA, 21 nt, Homo sapiens
ugccacagaugauacuuccaa

SEQ ID NO: 791520 - RNA, 18 nt, Homo sapiens
ugccaccaacacugcuca

SEQ ID NO: 791521 - RNA, 20 nt, Homo sapiens
ugccaccacccaccccaaac

SEQ ID NO: 791522 - RNA, 23 nt, Homo sapiens
ugccacccaggcuggagugcagu

SEQ ID NO: 791523 - RNA, 20 nt, Homo sapiens
ugccacccugccccuugcca

SEQ ID NO: 791524 - RNA, 18 nt, Homo sapiens
ugccacuggaagggcaga

SEQ ID NO: 791525 - RNA, 19 nt, Homo sapiens
ugccacuggggaaaacucc

SEQ ID NO: 791526 - RNA, 18 nt, Homo sapiens
ugccacuuaauguauguu

SEQ ID NO: 791527 - RNA, 14 nt, Homo sapiens
ugccagacaugugg

SEQ ID NO: 791528 - RNA, 17 nt, Homo sapiens
ugccagacauugcucuc

SEQ ID NO: 791529 - RNA, 15 nt, Homo sapiens
ugccagagauguacu

SEQ ID NO: 791530 - RNA, 19 nt, Homo sapiens
ugccagaugauuguucaaa

SEQ ID NO: 791531 - RNA, 22 nt, Homo sapiens
ugccagauuaccgacacuguca

SEQ ID NO: 791532 - RNA, 22 nt, Homo sapiens
ugccagcauauacugaagucuu

SEQ ID NO: 791533 - RNA, 23 nt, Homo sapiens
ugccagcaugguugcagauaaac

SEQ ID NO: 791534 - RNA, 15 nt, Homo sapiens
ugccagcgcaugugu

SEQ ID NO: 791535 - RNA, 21 nt, Homo sapiens
ugccaggcguuggugccacuu

SEQ ID NO: 791536 - RNA, 19 nt, Homo sapiens
ugccaggcuggagugcagu

SEQ ID NO: 791537 - RNA, 18 nt, Homo sapiens
ugccagggacugacaaaa

SEQ ID NO: 791538 - RNA, 15 nt, Homo sapiens
ugccagugcacuccg

SEQ ID NO: 791539 - RNA, 22 nt, Homo sapiens
ugccagugccuuaccuccugcc

SEQ ID NO: 791540 - RNA, 13 nt, Homo sapiens
ugccaguggcuua

SEQ ID NO: 791541 - RNA, 14 nt, Homo sapiens
ugccauagcaagau

SEQ ID NO: 791542 - RNA, 18 nt, Homo sapiens
ugccauagcugacuacaa

SEQ ID NO: 791543 - RNA, 24 nt, Homo sapiens
ugccauaucagugaaccuuuagaa

SEQ ID NO: 791544 - RNA, 16 nt, Homo sapiens
ugccauggccugugcu

SEQ ID NO: 791545 - RNA, 21 nt, Homo sapiens
ugccauuaaaagcauugucca

SEQ ID NO: 791546 - RNA, 20 nt, Homo sapiens
ugccauucuucuggugcuac

SEQ ID NO: 791547 - RNA, 15 nt, Homo sapiens
ugccauugcacucca

SEQ ID NO: 791548 - RNA, 18 nt, Homo sapiens
ugcccaaacaccagucac

SEQ ID NO: 791549 - RNA, 18 nt, Homo sapiens
ugcccaagagugggguuu

SEQ ID NO: 791550 - RNA, 20 nt, Homo sapiens
ugcccaagcuggagugaagu

SEQ ID NO: 791551 - RNA, 21 nt, Homo sapiens
ugcccaaggauagguauuuua

SEQ ID NO: 791552 - RNA, 15 nt, Homo sapiens
ugcccacaccaacga

SEQ ID NO: 791553 - RNA, 13 nt, Homo sapiens
ugcccacaccuaa

SEQ ID NO: 791554 - RNA, 17 nt, Homo sapiens
ugcccacccgucuucaa

SEQ ID NO: 791555 - RNA, 20 nt, Homo sapiens
ugcccacucuccauccuccc

SEQ ID NO: 791556 - RNA, 17 nt, Homo sapiens
ugcccagacuacagggc

SEQ ID NO: 791557 - RNA, 17 nt, Homo sapiens
ugcccagcacagugccu

SEQ ID NO: 791558 - RNA, 21 nt, Homo sapiens
ugcccagcccggaccuuggca

SEQ ID NO: 791559 - RNA, 22 nt, Homo sapiens
ugcccagcuucaauaauuacca

SEQ ID NO: 791560 - RNA, 18 nt, Homo sapiens
ugcccagggccacucugc

SEQ ID NO: 791561 - RNA, 17 nt, Homo sapiens
ugcccaggguuuugccc

SEQ ID NO: 791562 - RNA, 22 nt, Homo sapiens
ugcccaguguuguuuguaaaua

SEQ ID NO: 791563 - RNA, 17 nt, Homo sapiens
ugcccauccugacugaa

SEQ ID NO: 791564 - RNA, 15 nt, Homo sapiens
ugcccauugucuuau

SEQ ID NO: 791565 - RNA, 18 nt, Homo sapiens
ugccccaaguccucauuu

SEQ ID NO: 791566 - RNA, 12 nt, Homo sapiens
ugccccaccugc

SEQ ID NO: 791567 - RNA, 14 nt, Homo sapiens
ugccccacugaauu

SEQ ID NO: 791568 - RNA, 18 nt, Homo sapiens
ugccccagaaaaauaacu

SEQ ID NO: 791569 - RNA, 15 nt, Homo sapiens
ugccccagagcuguu

SEQ ID NO: 791570 - RNA, 18 nt, Homo sapiens
ugccccaggccugaaaga

SEQ ID NO: 791571 - RNA, 22 nt, Homo sapiens
ugccccaugacuugaugcaguu

SEQ ID NO: 791572 - RNA, 17 nt, Homo sapiens
ugccccaugccugucca

SEQ ID NO: 791573 - RNA, 17 nt, Homo sapiens
ugcccccaccccgggga

SEQ ID NO: 791574 - RNA, 18 nt, Homo sapiens
ugcccccagccccggggu

SEQ ID NO: 791575 - RNA, 14 nt, Homo sapiens
ugccccccaugagg

SEQ ID NO: 791576 - RNA, 16 nt, Homo sapiens
ugccccccuugccaga

SEQ ID NO: 791577 - RNA, 20 nt, Homo sapiens
ugcccccgcggguucuagac

SEQ ID NO: 791578 - RNA, 14 nt, Homo sapiens
ugcccccuccccca

SEQ ID NO: 791579 - RNA, 21 nt, Homo sapiens
ugcccccucccccaugggcug

SEQ ID NO: 791580 - RNA, 20 nt, Homo sapiens
ugcccccugcugccaugugg

SEQ ID NO: 791581 - RNA, 15 nt, Homo sapiens
ugccccucucucagu

SEQ ID NO: 791582 - RNA, 20 nt, Homo sapiens
ugccccugagacaaauggag

SEQ ID NO: 791583 - RNA, 17 nt, Homo sapiens
ugccccuggaccaguac

SEQ ID NO: 791584 - RNA, 14 nt, Homo sapiens
ugcccgaaaagcau

SEQ ID NO: 791585 - RNA, 19 nt, Homo sapiens
ugcccguguaguccccaac

SEQ ID NO: 791586 - RNA, 24 nt, Homo sapiens
ugcccguucuugaaauguaggcau

SEQ ID NO: 791587 - RNA, 16 nt, Homo sapiens
ugcccucaccaccaca

SEQ ID NO: 791588 - RNA, 22 nt, Homo sapiens
ugcccucacuauugaugcauuu

SEQ ID NO: 791589 - RNA, 19 nt, Homo sapiens
ugcccucauacccaugcac

SEQ ID NO: 791590 - RNA, 15 nt, Homo sapiens
ugcccucuaccugac

SEQ ID NO: 791591 - RNA, 15 nt, Homo sapiens
ugcccucucugccag

SEQ ID NO: 791592 - RNA, 15 nt, Homo sapiens
ugcccucugcucugc

SEQ ID NO: 791593 - RNA, 20 nt, Homo sapiens
ugcccucuuguggugcauug

SEQ ID NO: 791594 - RNA, 17 nt, Homo sapiens
ugcccugaguccaagag

SEQ ID NO: 791595 - RNA, 20 nt, Homo sapiens
ugcccuggcagcaugacuca

SEQ ID NO: 791596 - RNA, 16 nt, Homo sapiens
ugcccugguccaggga

SEQ ID NO: 791597 - RNA, 18 nt, Homo sapiens
ugcccugugcaugccaug

SEQ ID NO: 791598 - RNA, 16 nt, Homo sapiens
ugcccuguguacuucc

SEQ ID NO: 791599 - RNA, 14 nt, Homo sapiens
ugcccuguguggcu

SEQ ID NO: 791600 - RNA, 13 nt, Homo sapiens
ugcccuucagccu

SEQ ID NO: 791601 - RNA, 14 nt, Homo sapiens
ugcccuucagccuu

SEQ ID NO: 791602 - RNA, 22 nt, Homo sapiens
ugcccuuggccugaagucccag

SEQ ID NO: 791603 - RNA, 22 nt, Homo sapiens
ugccgaaccaaaagaauuugca

SEQ ID NO: 791604 - RNA, 14 nt, Homo sapiens
ugccgcaugacaac

SEQ ID NO: 791605 - RNA, 12 nt, Homo sapiens
ugccgcauuugg

SEQ ID NO: 791606 - RNA, 15 nt, Homo sapiens
ugccgcucucucuga

SEQ ID NO: 791607 - RNA, 19 nt, Homo sapiens
ugccgcucucucugagggg

SEQ ID NO: 791608 - RNA, 19 nt, Homo sapiens
ugccggccggggcugagac

SEQ ID NO: 791609 - RNA, 19 nt, Homo sapiens
ugccggguucuagucuccu

SEQ ID NO: 791610 - RNA, 17 nt, Homo sapiens
ugccguaacaacugugg

SEQ ID NO: 791611 - RNA, 22 nt, Homo sapiens
ugccguguccaagggccgugcc

SEQ ID NO: 791612 - RNA, 23 nt, Homo sapiens
ugccuaaaucccaagaaauggaa

SEQ ID NO: 791613 - RNA, 20 nt, Homo sapiens
ugccuaaguccaguguuucu

SEQ ID NO: 791614 - RNA, 16 nt, Homo sapiens
ugccuagaaauaucuu

SEQ ID NO: 791615 - RNA, 20 nt, Homo sapiens
ugccuagaaauaucuuucuc

SEQ ID NO: 791616 - RNA, 20 nt, Homo sapiens
ugccuagacuguuacuuugg

SEQ ID NO: 791617 - RNA, 15 nt, Homo sapiens
ugccuaguaacacau

SEQ ID NO: 791618 - RNA, 15 nt, Homo sapiens
ugccuauaucugaga

SEQ ID NO: 791619 - RNA, 15 nt, Homo sapiens
ugccuaucugaccaa

SEQ ID NO: 791620 - RNA, 16 nt, Homo sapiens
ugccucaagccccaga

SEQ ID NO: 791621 - RNA, 20 nt, Homo sapiens
ugccucagccaguggcacag

SEQ ID NO: 791622 - RNA, 14 nt, Homo sapiens
ugccucauuucccu

SEQ ID NO: 791623 - RNA, 15 nt, Homo sapiens
ugccuccaccaccac

SEQ ID NO: 791624 - RNA, 20 nt, Homo sapiens
ugccuccaccccccagaacc

SEQ ID NO: 791625 - RNA, 13 nt, Homo sapiens
ugccuccagcauu

SEQ ID NO: 791626 - RNA, 18 nt, Homo sapiens
ugccucccaagguccucu

SEQ ID NO: 791627 - RNA, 22 nt, Homo sapiens
ugccucccaagguccucucagu

SEQ ID NO: 791628 - RNA, 16 nt, Homo sapiens
ugccucccacuucacu

SEQ ID NO: 791629 - RNA, 21 nt, Homo sapiens
ugccucccccuaaauuaauga

SEQ ID NO: 791630 - RNA, 23 nt, Homo sapiens
ugccuccucccugggcagaaagu

SEQ ID NO: 791631 - RNA, 23 nt, Homo sapiens
ugccucucuuuuugggcuuucau

SEQ ID NO: 791632 - RNA, 14 nt, Homo sapiens
ugccucugccuccc

SEQ ID NO: 791633 - RNA, 12 nt, Homo sapiens
ugccucugcucc

SEQ ID NO: 791634 - RNA, 15 nt, Homo sapiens
ugccugaaccuucca

SEQ ID NO: 791635 - RNA, 16 nt, Homo sapiens
ugccugaaccuuccau

SEQ ID NO: 791636 - RNA, 19 nt, Homo sapiens
ugccugcaaaaaugaaauc

SEQ ID NO: 791637 - RNA, 23 nt, Homo sapiens
ugccugcacccuucccucuuccc

SEQ ID NO: 791638 - RNA, 15 nt, Homo sapiens
ugccugcagcacaug

SEQ ID NO: 791639 - RNA, 15 nt, Homo sapiens
ugccugccacccugc

SEQ ID NO: 791640 - RNA, 15 nt, Homo sapiens
ugccugccaccuuca

SEQ ID NO: 791641 - RNA, 12 nt, Homo sapiens
ugccugccauuu

SEQ ID NO: 791642 - RNA, 15 nt, Homo sapiens
ugccugcuaauauga

SEQ ID NO: 791643 - RNA, 15 nt, Homo sapiens
ugccuggacacugua

SEQ ID NO: 791644 - RNA, 18 nt, Homo sapiens
ugccuggacagaggacaa

SEQ ID NO: 791645 - RNA, 15 nt, Homo sapiens
ugccuggacugacca

SEQ ID NO: 791646 - RNA, 20 nt, Homo sapiens
ugccuggccaggcagaucug

SEQ ID NO: 791647 - RNA, 16 nt, Homo sapiens
ugccuguaacaaugua

SEQ ID NO: 791648 - RNA, 22 nt, Homo sapiens
ugccuguaaucucagcacuuug

SEQ ID NO: 791649 - RNA, 21 nt, Homo sapiens
ugccuguuaaggaaacuuuau

SEQ ID NO: 791650 - RNA, 19 nt, Homo sapiens
ugccuuaaccagucucuca

SEQ ID NO: 791651 - RNA, 18 nt, Homo sapiens
ugccuucacugugcucca

SEQ ID NO: 791652 - RNA, 19 nt, Homo sapiens
ugccuuccucucucuacca

SEQ ID NO: 791653 - RNA, 22 nt, Homo sapiens
ugccuucucuguucccuugcag

SEQ ID NO: 791654 - RNA, 17 nt, Homo sapiens
ugccuucugcacauaaa

SEQ ID NO: 791655 - RNA, 14 nt, Homo sapiens
ugccuucuggccuu

SEQ ID NO: 791656 - RNA, 19 nt, Homo sapiens
ugccuucuuacaacagaga

SEQ ID NO: 791657 - RNA, 21 nt, Homo sapiens
ugccuugaaggggcagcugug

SEQ ID NO: 791658 - RNA, 22 nt, Homo sapiens
ugccuugcaauggaucagccaa

SEQ ID NO: 791659 - RNA, 13 nt, Homo sapiens
ugccuugcaccuc

SEQ ID NO: 791660 - RNA, 16 nt, Homo sapiens
ugccuuggagaucaaa

SEQ ID NO: 791661 - RNA, 16 nt, Homo sapiens
ugccuuggcuucaggg

SEQ ID NO: 791662 - RNA, 18 nt, Homo sapiens
ugccuuucgaggccugaa

SEQ ID NO: 791663 - RNA, 17 nt, Homo sapiens
ugccuuuugcaccccuc

SEQ ID NO: 791664 - RNA, 20 nt, Homo sapiens
ugcgaagacccucuugccca

SEQ ID NO: 791665 - RNA, 16 nt, Homo sapiens
ugcgagagaaagggag

SEQ ID NO: 791666 - RNA, 22 nt, Homo sapiens
ugcgagagaaagggagugcaug

SEQ ID NO: 791667 - RNA, 22 nt, Homo sapiens
ugcgauuuuguuaacccagcga

SEQ ID NO: 791668 - RNA, 14 nt, Homo sapiens
ugcgcaacuggagc

SEQ ID NO: 791669 - RNA, 14 nt, Homo sapiens
ugcgcacugcauuc

SEQ ID NO: 791670 - RNA, 18 nt, Homo sapiens
ugcgcagugguugcuguc

SEQ ID NO: 791671 - RNA, 20 nt, Homo sapiens
ugcgcccuucauugccacac

SEQ ID NO: 791672 - RNA, 13 nt, Homo sapiens
ugcgcuuaaucca

SEQ ID NO: 791673 - RNA, 14 nt, Homo sapiens
ugcggaagccaaag

SEQ ID NO: 791674 - RNA, 19 nt, Homo sapiens
ugcggaggaaagcaagugu

SEQ ID NO: 791675 - RNA, 22 nt, Homo sapiens
ugcggagucuccucucuuggca

SEQ ID NO: 791676 - RNA, 13 nt, Homo sapiens
ugcggccauucaa

SEQ ID NO: 791677 - RNA, 18 nt, Homo sapiens
ugcggggggcaccagagg

SEQ ID NO: 791678 - RNA, 13 nt, Homo sapiens
ugcgguuccucau

SEQ ID NO: 791679 - RNA, 17 nt, Homo sapiens
ugcgugcgagcacacac

SEQ ID NO: 791680 - RNA, 18 nt, Homo sapiens
ugcgugcgagcacacaca

SEQ ID NO: 791681 - RNA, 21 nt, Homo sapiens
ugcguguguguucacguguuc

SEQ ID NO: 791682 - RNA, 22 nt, Homo sapiens
ugcuaaauaguucuaucaggaa

SEQ ID NO: 791683 - RNA, 16 nt, Homo sapiens
ugcuaacauagauuua

SEQ ID NO: 791684 - RNA, 11 nt, Homo sapiens
ugcuaacuggu

SEQ ID NO: 791685 - RNA, 12 nt, Homo sapiens
ugcuaaguauuu

SEQ ID NO: 791686 - RNA, 18 nt, Homo sapiens
ugcuaauucaaagcucua

SEQ ID NO: 791687 - RNA, 11 nt, Homo sapiens
ugcuacaacau

SEQ ID NO: 791688 - RNA, 20 nt, Homo sapiens
ugcuacaguuauuaaucugg

SEQ ID NO: 791689 - RNA, 17 nt, Homo sapiens
ugcuaccaaaacaguua

SEQ ID NO: 791690 - RNA, 20 nt, Homo sapiens
ugcuaccacagcaacuauau

SEQ ID NO: 791691 - RNA, 15 nt, Homo sapiens
ugcuaccccuuugau

SEQ ID NO: 791692 - RNA, 17 nt, Homo sapiens
ugcuaccucacuggggu

SEQ ID NO: 791693 - RNA, 13 nt, Homo sapiens
ugcuaccugugag

SEQ ID NO: 791694 - RNA, 12 nt, Homo sapiens
ugcuacugcacu

SEQ ID NO: 791695 - RNA, 20 nt, Homo sapiens
ugcuagaugugcaaaugcaa

SEQ ID NO: 791696 - RNA, 12 nt, Homo sapiens
ugcuagauuucu

SEQ ID NO: 791697 - RNA, 13 nt, Homo sapiens
ugcuagucacugg

SEQ ID NO: 791698 - RNA, 23 nt, Homo sapiens
ugcuagugggcccucucucuggg

SEQ ID NO: 791699 - RNA, 13 nt, Homo sapiens
ugcuaucagaaau

SEQ ID NO: 791700 - RNA, 21 nt, Homo sapiens
ugcuauccccaucucccugcc

SEQ ID NO: 791701 - RNA, 13 nt, Homo sapiens
ugcuaugacugua

SEQ ID NO: 791702 - RNA, 19 nt, Homo sapiens
ugcuauuguagagccagag

SEQ ID NO: 791703 - RNA, 21 nt, Homo sapiens
ugcuauuguagagccagaggu

SEQ ID NO: 791704 - RNA, 22 nt, Homo sapiens
ugcuauugugaauagugccgca

SEQ ID NO: 791705 - RNA, 15 nt, Homo sapiens
ugcuauuucaucugg

SEQ ID NO: 791706 - RNA, 12 nt, Homo sapiens
ugcuauuugccu

SEQ ID NO: 791707 - RNA, 13 nt, Homo sapiens
ugcucaaagggaa

SEQ ID NO: 791708 - RNA, 19 nt, Homo sapiens
ugcucaaggcaaccagagg

SEQ ID NO: 791709 - RNA, 19 nt, Homo sapiens
ugcucaagguuacugggag

SEQ ID NO: 791710 - RNA, 22 nt, Homo sapiens
ugcucacagccuuucugaggac

SEQ ID NO: 791711 - RNA, 20 nt, Homo sapiens
ugcucaccuuuaucaccuca

SEQ ID NO: 791712 - RNA, 20 nt, Homo sapiens
ugcucagcccugcaccaugc

SEQ ID NO: 791713 - RNA, 15 nt, Homo sapiens
ugcucaguggaucac

SEQ ID NO: 791714 - RNA, 22 nt, Homo sapiens
ugcucagugggggcagagccac

SEQ ID NO: 791715 - RNA, 16 nt, Homo sapiens
ugcucauugaacuuua

SEQ ID NO: 791716 - RNA, 17 nt, Homo sapiens
ugcucauugaacuuuaa

SEQ ID NO: 791717 - RNA, 18 nt, Homo sapiens
ugcucauugaacuuuaag

SEQ ID NO: 791718 - RNA, 15 nt, Homo sapiens
ugcuccaagauucua

SEQ ID NO: 791719 - RNA, 13 nt, Homo sapiens
ugcuccaccagca

SEQ ID NO: 791720 - RNA, 14 nt, Homo sapiens
ugcuccagggcuuu

SEQ ID NO: 791721 - RNA, 22 nt, Homo sapiens
ugcuccaugacuggcugucugc

SEQ ID NO: 791722 - RNA, 18 nt, Homo sapiens
ugcuccauggaugcaugc

SEQ ID NO: 791723 - RNA, 20 nt, Homo sapiens
ugcuccgaggacccaggaaa

SEQ ID NO: 791724 - RNA, 21 nt, Homo sapiens
ugcuccgaggacccaggaaag

SEQ ID NO: 791725 - RNA, 21 nt, Homo sapiens
ugcuccucaccccuguaggga

SEQ ID NO: 791726 - RNA, 15 nt, Homo sapiens
ugcucgagacacagu

SEQ ID NO: 791727 - RNA, 18 nt, Homo sapiens
ugcucuagauucauaaau

SEQ ID NO: 791728 - RNA, 18 nt, Homo sapiens
ugcucuccuccaccucaa

SEQ ID NO: 791729 - RNA, 21 nt, Homo sapiens
ugcucucucacucccccauga

SEQ ID NO: 791730 - RNA, 19 nt, Homo sapiens
ugcucugaauguccugaca

SEQ ID NO: 791731 - RNA, 13 nt, Homo sapiens
ugcucugaccaag

SEQ ID NO: 791732 - RNA, 13 nt, Homo sapiens
ugcucugccaccc

SEQ ID NO: 791733 - RNA, 19 nt, Homo sapiens
ugcucuggagccugcagau

SEQ ID NO: 791734 - RNA, 21 nt, Homo sapiens
ugcucugucuucuuugcccac

SEQ ID NO: 791735 - RNA, 14 nt, Homo sapiens
ugcucuguuaccca

SEQ ID NO: 791736 - RNA, 17 nt, Homo sapiens
ugcucuucccaguucag

SEQ ID NO: 791737 - RNA, 14 nt, Homo sapiens
ugcucuugagucuu

SEQ ID NO: 791738 - RNA, 20 nt, Homo sapiens
ugcucuugcaucugggccag

SEQ ID NO: 791739 - RNA, 23 nt, Homo sapiens
ugcucuuuaugaaugaaaaaaca

SEQ ID NO: 791740 - RNA, 18 nt, Homo sapiens
ugcucuuucagaacaaac

SEQ ID NO: 791741 - RNA, 18 nt, Homo sapiens
ugcucuuuugcacaagga

SEQ ID NO: 791742 - RNA, 13 nt, Homo sapiens
ugcugaaaccaua

SEQ ID NO: 791743 - RNA, 20 nt, Homo sapiens
ugcugaaaguucauaucugg

SEQ ID NO: 791744 - RNA, 13 nt, Homo sapiens
ugcugaagcugcu

SEQ ID NO: 791745 - RNA, 19 nt, Homo sapiens
ugcugacaacuuagcucag

SEQ ID NO: 791746 - RNA, 16 nt, Homo sapiens
ugcugaccaugcagcc

SEQ ID NO: 791747 - RNA, 19 nt, Homo sapiens
ugcugaccucccagugacc

SEQ ID NO: 791748 - RNA, 15 nt, Homo sapiens
ugcugagcauguacu

SEQ ID NO: 791749 - RNA, 17 nt, Homo sapiens
ugcugaggcccagugca

SEQ ID NO: 791750 - RNA, 22 nt, Homo sapiens
ugcugaguaacaggugccuucc

SEQ ID NO: 791751 - RNA, 16 nt, Homo sapiens
ugcugagucagacugu

SEQ ID NO: 791752 - RNA, 18 nt, Homo sapiens
ugcugagucagacuguca

SEQ ID NO: 791753 - RNA, 15 nt, Homo sapiens
ugcugcaaacacuua

SEQ ID NO: 791754 - RNA, 19 nt, Homo sapiens
ugcugcaaagccuuuccag

SEQ ID NO: 791755 - RNA, 15 nt, Homo sapiens
ugcugcacaaaagca

SEQ ID NO: 791756 - RNA, 13 nt, Homo sapiens
ugcugccaugugg

SEQ ID NO: 791757 - RNA, 20 nt, Homo sapiens
ugcugcccagugcaaaccac

SEQ ID NO: 791758 - RNA, 17 nt, Homo sapiens
ugcugcucuucauccca

SEQ ID NO: 791759 - RNA, 23 nt, Homo sapiens
ugcugcugcgcccuuaccuuccc

SEQ ID NO: 791760 - RNA, 20 nt, Homo sapiens
ugcugcuggggaagacagug

SEQ ID NO: 791761 - RNA, 15 nt, Homo sapiens
ugcugcuggugcaca

SEQ ID NO: 791762 - RNA, 14 nt, Homo sapiens
ugcugcuguuuaca

SEQ ID NO: 791763 - RNA, 12 nt, Homo sapiens
ugcugcuugccc

SEQ ID NO: 791764 - RNA, 13 nt, Homo sapiens
ugcuggaacuguu

SEQ ID NO: 791765 - RNA, 13 nt, Homo sapiens
ugcuggacuguca

SEQ ID NO: 791766 - RNA, 17 nt, Homo sapiens
ugcuggcagaaagcaaa

SEQ ID NO: 791767 - RNA, 22 nt, Homo sapiens
ugcuggcagaaagcaaauguga

SEQ ID NO: 791768 - RNA, 14 nt, Homo sapiens
ugcuggcauuugca

SEQ ID NO: 791769 - RNA, 20 nt, Homo sapiens
ugcuggccaaauagcaaaga

SEQ ID NO: 791770 - RNA, 18 nt, Homo sapiens
ugcuggccagggacccag

SEQ ID NO: 791771 - RNA, 14 nt, Homo sapiens
ugcuggcucugaga

SEQ ID NO: 791772 - RNA, 19 nt, Homo sapiens
ugcuggcucugagaaucac

SEQ ID NO: 791773 - RNA, 22 nt, Homo sapiens
ugcuggcucugcuguccuugcc

SEQ ID NO: 791774 - RNA, 14 nt, Homo sapiens
ugcuggcugccuua

SEQ ID NO: 791775 - RNA, 15 nt, Homo sapiens
ugcugggaccagagc

SEQ ID NO: 791776 - RNA, 14 nt, Homo sapiens
ugcugggagugugg

SEQ ID NO: 791777 - RNA, 23 nt, Homo sapiens
ugcugggauuacaggcgugaucc

SEQ ID NO: 791778 - RNA, 15 nt, Homo sapiens
ugcugggcuuggcag

SEQ ID NO: 791779 - RNA, 12 nt, Homo sapiens
ugcuggggagcc

SEQ ID NO: 791780 - RNA, 21 nt, Homo sapiens
ugcuggggagucccugccaca

SEQ ID NO: 791781 - RNA, 19 nt, Homo sapiens
ugcugggggccgcccugua

SEQ ID NO: 791782 - RNA, 20 nt, Homo sapiens
ugcuggucagagagaccuca

SEQ ID NO: 791783 - RNA, 23 nt, Homo sapiens
ugcugguccccuccucagugaca

SEQ ID NO: 791784 - RNA, 12 nt, Homo sapiens
ugcuggugauuu

SEQ ID NO: 791785 - RNA, 17 nt, Homo sapiens
ugcugguuguugccagg

SEQ ID NO: 791786 - RNA, 20 nt, Homo sapiens
ugcuguagacauuugcuaug

SEQ ID NO: 791787 - RNA, 13 nt, Homo sapiens
ugcugucacuguu

SEQ ID NO: 791788 - RNA, 22 nt, Homo sapiens
ugcugucauuaguauuucacaa

SEQ ID NO: 791789 - RNA, 15 nt, Homo sapiens
ugcugucauuagucu

SEQ ID NO: 791790 - RNA, 14 nt, Homo sapiens
ugcugugaacaauu

SEQ ID NO: 791791 - RNA, 22 nt, Homo sapiens
ugcugugaggcuguccuguaca

SEQ ID NO: 791792 - RNA, 20 nt, Homo sapiens
ugcuguggggaccacacuga

SEQ ID NO: 791793 - RNA, 14 nt, Homo sapiens
ugcuguguguccca

SEQ ID NO: 791794 - RNA, 21 nt, Homo sapiens
ugcuguugauucagacuuuca

SEQ ID NO: 791795 - RNA, 14 nt, Homo sapiens
ugcuguugggauau

SEQ ID NO: 791796 - RNA, 19 nt, Homo sapiens
ugcuguugggauauaguca

SEQ ID NO: 791797 - RNA, 22 nt, Homo sapiens
ugcuguuguaaacaacguguau

SEQ ID NO: 791798 - RNA, 16 nt, Homo sapiens
ugcuguuuuaaacauu

SEQ ID NO: 791799 - RNA, 22 nt, Homo sapiens
ugcuuaaaagguuaaauuucaa

SEQ ID NO: 791800 - RNA, 14 nt, Homo sapiens
ugcuuaaaauagca

SEQ ID NO: 791801 - RNA, 21 nt, Homo sapiens
ugcuuaaaauuaauaaaucau

SEQ ID NO: 791802 - RNA, 18 nt, Homo sapiens
ugcuuaaugguagcaacu

SEQ ID NO: 791803 - RNA, 12 nt, Homo sapiens
ugcuuacauuuu

SEQ ID NO: 791804 - RNA, 16 nt, Homo sapiens
ugcuuaccugaucuca

SEQ ID NO: 791805 - RNA, 16 nt, Homo sapiens
ugcuuagcucaucuua

SEQ ID NO: 791806 - RNA, 19 nt, Homo sapiens
uguucucuauuagacuuua

SEQ ID NO: 791807 - RNA, 17 nt, Homo sapiens
uguucucuuaugaucac

SEQ ID NO: 791808 - RNA, 19 nt, Homo sapiens
uguucugccuggagacaag

SEQ ID NO: 791809 - RNA, 21 nt, Homo sapiens
uguucugcugauaucaacagc

SEQ ID NO: 791810 - RNA, 20 nt, Homo sapiens
uguucugggccaggucccag

SEQ ID NO: 791811 - RNA, 12 nt, Homo sapiens
uguucuguacaa

SEQ ID NO: 791812 - RNA, 13 nt, Homo sapiens
uguucugucccag

SEQ ID NO: 791813 - RNA, 13 nt, Homo sapiens
uguucugugccug

SEQ ID NO: 791814 - RNA, 15 nt, Homo sapiens
uguucuguggcauag

SEQ ID NO: 791815 - RNA, 16 nt, Homo sapiens
uguucuguugauccca

SEQ ID NO: 791816 - RNA, 20 nt, Homo sapiens
uguucuguuuggcacuugua

SEQ ID NO: 791817 - RNA, 21 nt, Homo sapiens
uguugaaaacccagacugucu

SEQ ID NO: 791818 - RNA, 17 nt, Homo sapiens
uguugaaaauguucaga

SEQ ID NO: 791819 - RNA, 14 nt, Homo sapiens
uguugaaugcugcu

SEQ ID NO: 791820 - RNA, 13 nt, Homo sapiens
uguugacugugau

SEQ ID NO: 791821 - RNA, 12 nt, Homo sapiens
uguugaggacaa

SEQ ID NO: 791822 - RNA, 15 nt, Homo sapiens
uguugauuuccucug

SEQ ID NO: 791823 - RNA, 14 nt, Homo sapiens
uguugcacacucac

SEQ ID NO: 791824 - RNA, 21 nt, Homo sapiens
uguugcccaggcuggucucaa

SEQ ID NO: 791825 - RNA, 15 nt, Homo sapiens
uguugcccaguguga

SEQ ID NO: 791826 - RNA, 19 nt, Homo sapiens
uguuggaguggaacauugg

SEQ ID NO: 791827 - RNA, 19 nt, Homo sapiens
uguuggauaaagaccuucc

SEQ ID NO: 791828 - RNA, 15 nt, Homo sapiens
uguugggaaaguauu

SEQ ID NO: 791829 - RNA, 14 nt, Homo sapiens
uguugggaggacag

SEQ ID NO: 791830 - RNA, 17 nt, Homo sapiens
uguugguauuauauaau

SEQ ID NO: 791831 - RNA, 21 nt, Homo sapiens
uguuguaaaagaugcagagua

SEQ ID NO: 791832 - RNA, 18 nt, Homo sapiens
uguuguagguuucaggga

SEQ ID NO: 791833 - RNA, 19 nt, Homo sapiens
uguuguagugaaauuauac

SEQ ID NO: 791834 - RNA, 18 nt, Homo sapiens
uguugucacccaagagau

SEQ ID NO: 791835 - RNA, 22 nt, Homo sapiens
uguugucuacauuaaaucacuu

SEQ ID NO: 791836 - RNA, 14 nt, Homo sapiens
uguuguguagucaa

SEQ ID NO: 791837 - RNA, 14 nt, Homo sapiens
uguuuaaaaaguau

SEQ ID NO: 791838 - RNA, 21 nt, Homo sapiens
uguuuaaaaucauuucugcau

SEQ ID NO: 791839 - RNA, 23 nt, Homo sapiens
uguuuaaagaaucuacuauacuu

SEQ ID NO: 791840 - RNA, 20 nt, Homo sapiens
uguuuaaauagccuaaauga

SEQ ID NO: 791841 - RNA, 14 nt, Homo sapiens
uguuuaaauucaca

SEQ ID NO: 791842 - RNA, 18 nt, Homo sapiens
uguuuaauuguacucaau

SEQ ID NO: 791843 - RNA, 19 nt, Homo sapiens
uguuuacagcacuacucug

SEQ ID NO: 791844 - RNA, 23 nt, Homo sapiens
uguuuacauaucaccucauggcc

SEQ ID NO: 791845 - RNA, 13 nt, Homo sapiens
uguuuaccaugaa

SEQ ID NO: 791846 - RNA, 18 nt, Homo sapiens
uguuuaccucuucuaugc

SEQ ID NO: 791847 - RNA, 15 nt, Homo sapiens
uguuuacgauuucac

SEQ ID NO: 791848 - RNA, 12 nt, Homo sapiens
uguuuaguugca

SEQ ID NO: 791849 - RNA, 23 nt, Homo sapiens
uguuuauuucaggcauuggauau

SEQ ID NO: 791850 - RNA, 16 nt, Homo sapiens
uguuucaaacuuugga

SEQ ID NO: 791851 - RNA, 18 nt, Homo sapiens
uguuucacaauaccucau

SEQ ID NO: 791852 - RNA, 23 nt, Homo sapiens
uguuucauaaugcagaaguauuc

SEQ ID NO: 791853 - RNA, 21 nt, Homo sapiens
uguuucauauucaugcaagua

SEQ ID NO: 791854 - RNA, 17 nt, Homo sapiens
uguuucauuggucucua

SEQ ID NO: 791855 - RNA, 22 nt, Homo sapiens
uguuucgguugacccaggucau

SEQ ID NO: 791856 - RNA, 18 nt, Homo sapiens
uguuucuaaaacuauggu

SEQ ID NO: 791857 - RNA, 19 nt, Homo sapiens
uguuucuaaaacuaugguu

SEQ ID NO: 791858 - RNA, 12 nt, Homo sapiens
uguuucuuccaa

SEQ ID NO: 791859 - RNA, 13 nt, Homo sapiens
uguuucuuccaaa

SEQ ID NO: 791860 - RNA, 17 nt, Homo sapiens
uguuucuuucauaugaa

SEQ ID NO: 791861 - RNA, 12 nt, Homo sapiens
uguuugacaaaa

SEQ ID NO: 791862 - RNA, 9 nt, Homo sapiens
uguuugaug

SEQ ID NO: 791863 - RNA, 16 nt, Homo sapiens
uguuugcagcugugag

SEQ ID NO: 791864 - RNA, 12 nt, Homo sapiens
uguuugccucau

SEQ ID NO: 791865 - RNA, 16 nt, Homo sapiens
uguuuggaaaccacag

SEQ ID NO: 791866 - RNA, 23 nt, Homo sapiens
uguuuggaaauaaacugugcaau

SEQ ID NO: 791867 - RNA, 15 nt, Homo sapiens
uguuuggccucucua

SEQ ID NO: 791868 - RNA, 23 nt, Homo sapiens
uguuugggauauuaaaacacaaa

SEQ ID NO: 791869 - RNA, 22 nt, Homo sapiens
uguuugguggggguagagcuga

SEQ ID NO: 791870 - RNA, 20 nt, Homo sapiens
uguuugguguuugucugugu

SEQ ID NO: 791871 - RNA, 23 nt, Homo sapiens
uguuugucauagggcaguuggaa

SEQ ID NO: 791872 - RNA, 16 nt, Homo sapiens
uguuugugaaagacau

SEQ ID NO: 791873 - RNA, 17 nt, Homo sapiens
uguuuguuucuguagaa

SEQ ID NO: 791874 - RNA, 19 nt, Homo sapiens
uguuuuaauucaacccagc

SEQ ID NO: 791875 - RNA, 23 nt, Homo sapiens
uguuuuacucagaggagcugcaa

SEQ ID NO: 791876 - RNA, 16 nt, Homo sapiens
uguuuuagucauuaau

SEQ ID NO: 791877 - RNA, 19 nt, Homo sapiens
uguuuucaagaugguguua

SEQ ID NO: 791878 - RNA, 12 nt, Homo sapiens
uguuuucacuaa

SEQ ID NO: 791879 - RNA, 23 nt, Homo sapiens
uguuuucauuaaauuagcuauuu

SEQ ID NO: 791880 - RNA, 14 nt, Homo sapiens
uguuuuccuauaau

SEQ ID NO: 791881 - RNA, 20 nt, Homo sapiens
uguuuucuugccaaugaggu

SEQ ID NO: 791882 - RNA, 15 nt, Homo sapiens
uguuuuggcuuuaug

SEQ ID NO: 791883 - RNA, 17 nt, Homo sapiens
uguuuuuacaguggaau

SEQ ID NO: 791884 - RNA, 23 nt, Homo sapiens
uguuuuuacccugccccugccuu

SEQ ID NO: 791885 - RNA, 20 nt, Homo sapiens
uguuuuuagcugguggcaau

SEQ ID NO: 791886 - RNA, 16 nt, Homo sapiens
uguuuuucaagccugu

SEQ ID NO: 791887 - RNA, 20 nt, Homo sapiens
uguuuuucuuuuuccacaag

SEQ ID NO: 791888 - RNA, 17 nt, Homo sapiens
uguuuuuguacaguuuu

SEQ ID NO: 791889 - RNA, 20 nt, Homo sapiens
uguuuuuucagucugugaaa

SEQ ID NO: 791890 - RNA, 22 nt, Homo sapiens
uguuuuuugccacagcuuuugc

SEQ ID NO: 791891 - RNA, 15 nt, Homo sapiens
uguuuuuugccuaaa

SEQ ID NO: 791892 - RNA, 19 nt, Homo sapiens
uguuuuuuuuuuccacuua

SEQ ID NO: 791893 - RNA, 23 nt, Homo sapiens
uuaaaaaaaaaaaguacaauuca

SEQ ID NO: 791894 - RNA, 19 nt, Homo sapiens
uuaaaaaaaaauacugaug

SEQ ID NO: 791895 - RNA, 20 nt, Homo sapiens
uuaaaaaaaggagacugugu

SEQ ID NO: 791896 - RNA, 15 nt, Homo sapiens
uuaaaaaaauuccau

SEQ ID NO: 791897 - RNA, 19 nt, Homo sapiens
uuaaaaaauaaaaacugac

SEQ ID NO: 791898 - RNA, 14 nt, Homo sapiens
uuaaaaaauaacau

SEQ ID NO: 791899 - RNA, 15 nt, Homo sapiens
uuaaaaaauaacaua

SEQ ID NO: 791900 - RNA, 15 nt, Homo sapiens
uuaaaaauacuucuc

SEQ ID NO: 791901 - RNA, 22 nt, Homo sapiens
uuaaaaauggcucaaguagaaa

SEQ ID NO: 791902 - RNA, 13 nt, Homo sapiens
uuaaaacaaagaa

SEQ ID NO: 791903 - RNA, 18 nt, Homo sapiens
uuaaaacaauucugugac

SEQ ID NO: 791904 - RNA, 19 nt, Homo sapiens
uuaaaacaauucugugaca

SEQ ID NO: 791905 - RNA, 19 nt, Homo sapiens
uuaaaacacagcuuuacaa

SEQ ID NO: 791906 - RNA, 16 nt, Homo sapiens
uuaaaacagacacugg

SEQ ID NO: 791907 - RNA, 13 nt, Homo sapiens
uuaaaacagucua

SEQ ID NO: 791908 - RNA, 17 nt, Homo sapiens
uuaaaacuugaaguagg

SEQ ID NO: 791909 - RNA, 23 nt, Homo sapiens
uuaaaagcaaguuucagugaagg

SEQ ID NO: 791910 - RNA, 16 nt, Homo sapiens
uuaaaagcacacuccc

SEQ ID NO: 791911 - RNA, 22 nt, Homo sapiens
uuaaaaggaaauguaaaagcac

SEQ ID NO: 791912 - RNA, 15 nt, Homo sapiens
uuaaaagucuacagc

SEQ ID NO: 791913 - RNA, 22 nt, Homo sapiens
uuaaaauaaugaacacuacaga

SEQ ID NO: 791914 - RNA, 15 nt, Homo sapiens
uuaaaauauuuuaga

SEQ ID NO: 791915 - RNA, 22 nt, Homo sapiens
uuaaaauccaaagugucauauu

SEQ ID NO: 791916 - RNA, 18 nt, Homo sapiens
uuaaaaucuacagaacua

SEQ ID NO: 791917 - RNA, 14 nt, Homo sapiens
uuaaaaugagaucg

SEQ ID NO: 791918 - RNA, 15 nt, Homo sapiens
uuaaaaugagcauug

SEQ ID NO: 791919 - RNA, 12 nt, Homo sapiens
uuaaaaugauua

SEQ ID NO: 791920 - RNA, 21 nt, Homo sapiens
uuaaaaugucaagacagggaa

SEQ ID NO: 791921 - RNA, 17 nt, Homo sapiens
ugcuuagucccucaugc

SEQ ID NO: 791922 - RNA, 18 nt, Homo sapiens
ugcuuaguguacuuggag

SEQ ID NO: 791923 - RNA, 16 nt, Homo sapiens
ugcuuaugugugaagc

SEQ ID NO: 791924 - RNA, 22 nt, Homo sapiens
ugcuuauuuuaaaaugacagug

SEQ ID NO: 791925 - RNA, 22 nt, Homo sapiens
ugcuucaaauaaaguccugaca

SEQ ID NO: 791926 - RNA, 23 nt, Homo sapiens
ugcuucagacauguaauguuguu

SEQ ID NO: 791927 - RNA, 15 nt, Homo sapiens
ugcuucagaguuugu

SEQ ID NO: 791928 - RNA, 20 nt, Homo sapiens
ugcuucagaguuugugugua

SEQ ID NO: 791929 - RNA, 17 nt, Homo sapiens
ugcuucaguacuuguga

SEQ ID NO: 791930 - RNA, 14 nt, Homo sapiens
ugcuucauuccaaa

SEQ ID NO: 791931 - RNA, 17 nt, Homo sapiens
ugcuucccccaccccuc

SEQ ID NO: 791932 - RNA, 14 nt, Homo sapiens
ugcuucccgaguga

SEQ ID NO: 791933 - RNA, 22 nt, Homo sapiens
ugcuuccucccaacaagcagcu

SEQ ID NO: 791934 - RNA, 20 nt, Homo sapiens
ugcuuccugucccacuacug

SEQ ID NO: 791935 - RNA, 14 nt, Homo sapiens
ugcuuccuuccaga

SEQ ID NO: 791936 - RNA, 13 nt, Homo sapiens
ugcuucucggggu

SEQ ID NO: 791937 - RNA, 16 nt, Homo sapiens
ugcuucuuaugguggu

SEQ ID NO: 791938 - RNA, 15 nt, Homo sapiens
ugcuucuugccauca

SEQ ID NO: 791939 - RNA, 14 nt, Homo sapiens
ugcuugaacccaag

SEQ ID NO: 791940 - RNA, 21 nt, Homo sapiens
ugcuugaacccagaaggcaga

SEQ ID NO: 791941 - RNA, 21 nt, Homo sapiens
ugcuugacauaccuaccagua

SEQ ID NO: 791942 - RNA, 23 nt, Homo sapiens
ugcuugauauguaaguacuucca

SEQ ID NO: 791943 - RNA, 18 nt, Homo sapiens
ugcuugcaauguagucaa

SEQ ID NO: 791944 - RNA, 12 nt, Homo sapiens
ugcuugccugau

SEQ ID NO: 791945 - RNA, 11 nt, Homo sapiens
ugcuugcugaa

SEQ ID NO: 791946 - RNA, 18 nt, Homo sapiens
ugcuuggaagccagguac

SEQ ID NO: 791947 - RNA, 14 nt, Homo sapiens
ugcuuggguguaac

SEQ ID NO: 791948 - RNA, 18 nt, Homo sapiens
ugcuugguuaaaauggcu

SEQ ID NO: 791949 - RNA, 23 nt, Homo sapiens
ugcuuguugggauuccugaccca

SEQ ID NO: 791950 - RNA, 19 nt, Homo sapiens
ugcuuuaaaguaccuguag

SEQ ID NO: 791951 - RNA, 21 nt, Homo sapiens
ugcuuuagucacuaauugcuu

SEQ ID NO: 791952 - RNA, 14 nt, Homo sapiens
ugcuuucagcacuc

SEQ ID NO: 791953 - RNA, 20 nt, Homo sapiens
ugcuuuccagccugggcaac

SEQ ID NO: 791954 - RNA, 17 nt, Homo sapiens
ugcuuugaaacuugccu

SEQ ID NO: 791955 - RNA, 13 nt, Homo sapiens
ugcuuugcaggaa

SEQ ID NO: 791956 - RNA, 15 nt, Homo sapiens
ugcuuugccaaaaua

SEQ ID NO: 791957 - RNA, 18 nt, Homo sapiens
ugcuuuuagcaaccauaa

SEQ ID NO: 791958 - RNA, 16 nt, Homo sapiens
ugcuuuucauguagaa

SEQ ID NO: 791959 - RNA, 15 nt, Homo sapiens
ugcuuuuccaucuaa

SEQ ID NO: 791960 - RNA, 17 nt, Homo sapiens
ugcuuuugaaaaguuga

SEQ ID NO: 791961 - RNA, 20 nt, Homo sapiens
ugcuuuugagagaacauaga

SEQ ID NO: 791962 - RNA, 14 nt, Homo sapiens
ugcuuuugcauuuc

SEQ ID NO: 791963 - RNA, 19 nt, Homo sapiens
ugcuuuugggagacuggaa

SEQ ID NO: 791964 - RNA, 21 nt, Homo sapiens
ugcuuuuuaaagaaugcucuu

SEQ ID NO: 791965 - RNA, 19 nt, Homo sapiens
ugcuuuuuuaaacuugaau

SEQ ID NO: 791966 - RNA, 15 nt, Homo sapiens
uggaaaaaacucuga

SEQ ID NO: 791967 - RNA, 19 nt, Homo sapiens
uggaaaaaugguugaugga

SEQ ID NO: 791968 - RNA, 18 nt, Homo sapiens
uggaaaacagaacacuua

SEQ ID NO: 791969 - RNA, 20 nt, Homo sapiens
uggaaaagaaaagaaaugaa

SEQ ID NO: 791970 - RNA, 17 nt, Homo sapiens
uggaaaagaagaaacuu

SEQ ID NO: 791971 - RNA, 19 nt, Homo sapiens
uggaaaagcaaaacuguag

SEQ ID NO: 791972 - RNA, 20 nt, Homo sapiens
uggaaaauaaacaucaguuu

SEQ ID NO: 791973 - RNA, 19 nt, Homo sapiens
uggaaaauucuauggaaua

SEQ ID NO: 791974 - RNA, 18 nt, Homo sapiens
uggaaacagcaugaauaa

SEQ ID NO: 791975 - RNA, 15 nt, Homo sapiens
uggaaacauuuacaa

SEQ ID NO: 791976 - RNA, 12 nt, Homo sapiens
uggaaaccacag

SEQ ID NO: 791977 - RNA, 15 nt, Homo sapiens
uggaaaccacaguca

SEQ ID NO: 791978 - RNA, 20 nt, Homo sapiens
uggaaaccacagucagugga

SEQ ID NO: 791979 - RNA, 12 nt, Homo sapiens
uggaaacuaaga

SEQ ID NO: 791980 - RNA, 13 nt, Homo sapiens
uggaaacuggcca

SEQ ID NO: 791981 - RNA, 20 nt, Homo sapiens
uggaaagguggcuuuuagca

SEQ ID NO: 791982 - RNA, 15 nt, Homo sapiens
uggaaaguuacugua

SEQ ID NO: 791983 - RNA, 13 nt, Homo sapiens
uggaaauccagau

SEQ ID NO: 791984 - RNA, 18 nt, Homo sapiens
uggaaaucugaacauucu

SEQ ID NO: 791985 - RNA, 21 nt, Homo sapiens
uggaaauuccuguacuguguc

SEQ ID NO: 791986 - RNA, 18 nt, Homo sapiens
uggaaauucugaaaacug

SEQ ID NO: 791987 - RNA, 19 nt, Homo sapiens
uggaaauucugaaaacuga

SEQ ID NO: 791988 - RNA, 20 nt, Homo sapiens
uggaacaagacagccuucac

SEQ ID NO: 791989 - RNA, 17 nt, Homo sapiens
uggaacacucaugucug

SEQ ID NO: 791990 - RNA, 21 nt, Homo sapiens
uggaacacuccucuacucuua

SEQ ID NO: 791991 - RNA, 21 nt, Homo sapiens
uggaacagcgggagaccugug

SEQ ID NO: 791992 - RNA, 21 nt, Homo sapiens
uggaacaggcucagaucucau

SEQ ID NO: 791993 - RNA, 13 nt, Homo sapiens
uggaacagugucu

SEQ ID NO: 791994 - RNA, 21 nt, Homo sapiens
uggaaccaaucccgugaaaga

SEQ ID NO: 791995 - RNA, 16 nt, Homo sapiens
uggaacccccaucucu

SEQ ID NO: 791996 - RNA, 20 nt, Homo sapiens
uggaaccucagccuggccag

SEQ ID NO: 791997 - RNA, 21 nt, Homo sapiens
uggaaccuuguagaggagcag

SEQ ID NO: 791998 - RNA, 16 nt, Homo sapiens
uggaacgugaacucag

SEQ ID NO: 791999 - RNA, 14 nt, Homo sapiens
uggaacucuacuca

SEQ ID NO: 792000 - RNA, 22 nt, Homo sapiens
uggaagaaaaaaaccacacaaa

SEQ ID NO: 792001 - RNA, 16 nt, Homo sapiens
uggaagaaagcaacaa

SEQ ID NO: 792002 - RNA, 12 nt, Homo sapiens
uggaagaaggga

SEQ ID NO: 792003 - RNA, 18 nt, Homo sapiens
uggaagaagugagcagug

SEQ ID NO: 792004 - RNA, 16 nt, Homo sapiens
uggaagacaacucugc

SEQ ID NO: 792005 - RNA, 13 nt, Homo sapiens
uggaagacacuuc

SEQ ID NO: 792006 - RNA, 18 nt, Homo sapiens
uggaagacuuaauucuga

SEQ ID NO: 792007 - RNA, 20 nt, Homo sapiens
uggaagagaguuccgggaaa

SEQ ID NO: 792008 - RNA, 16 nt, Homo sapiens
uggaagaggaacagca

SEQ ID NO: 792009 - RNA, 17 nt, Homo sapiens
uggaagaguaguaauag

SEQ ID NO: 792010 - RNA, 19 nt, Homo sapiens
uggaagcaguuucagagaa

SEQ ID NO: 792011 - RNA, 21 nt, Homo sapiens
uggaagccaccucaccaagga

SEQ ID NO: 792012 - RNA, 20 nt, Homo sapiens
uggaagcuuguugaaaaccc

SEQ ID NO: 792013 - RNA, 23 nt, Homo sapiens
uggaagcuuguugaaaacccaga

SEQ ID NO: 792014 - RNA, 16 nt, Homo sapiens
uggaaggacacaguga

SEQ ID NO: 792015 - RNA, 13 nt, Homo sapiens
uggaaggggccac

SEQ ID NO: 792016 - RNA, 13 nt, Homo sapiens
uggaaggggucca

SEQ ID NO: 792017 - RNA, 15 nt, Homo sapiens
uggaagucaucucau

SEQ ID NO: 792018 - RNA, 20 nt, Homo sapiens
uggaagucaucucauuccac

SEQ ID NO: 792019 - RNA, 21 nt, Homo sapiens
uggaaguguauuuauuuuaca

SEQ ID NO: 792020 - RNA, 23 nt, Homo sapiens
uggaaguuaaagggcauuuccaa

SEQ ID NO: 792021 - RNA, 20 nt, Homo sapiens
uggaaguuauuaacuuuaau

SEQ ID NO: 792022 - RNA, 20 nt, Homo sapiens
uggaauaaagucacagaauu

SEQ ID NO: 792023 - RNA, 20 nt, Homo sapiens
uggaauaaaguugcagauga

SEQ ID NO: 792024 - RNA, 15 nt, Homo sapiens
uggaauagaugucuc

SEQ ID NO: 792025 - RNA, 21 nt, Homo sapiens
uggaauauaauuucaaaccac

SEQ ID NO: 792026 - RNA, 20 nt, Homo sapiens
uggaauauuaaaaaacuuca

SEQ ID NO: 792027 - RNA, 13 nt, Homo sapiens
uggaaucagugaa

SEQ ID NO: 792028 - RNA, 15 nt, Homo sapiens
uggaaucuagccgau

SEQ ID NO: 792029 - RNA, 15 nt, Homo sapiens
uggaaugauucacau

SEQ ID NO: 792030 - RNA, 22 nt, Homo sapiens
uggaaugcauaucgcugggcuc

SEQ ID NO: 792031 - RNA, 14 nt, Homo sapiens
uggaaugcccuuca

SEQ ID NO: 792032 - RNA, 20 nt, Homo sapiens
uggaaugcccuucacuguca

SEQ ID NO: 792033 - RNA, 20 nt, Homo sapiens
uggaaugccgcugucucuga

SEQ ID NO: 792034 - RNA, 16 nt, Homo sapiens
uggaaugcuguguuaa

SEQ ID NO: 792035 - RNA, 18 nt, Homo sapiens
uguggccuguguccagca

SEQ ID NO: 792036 - RNA, 17 nt, Homo sapiens
uguggcugcuagcacuu

SEQ ID NO: 792037 - RNA, 21 nt, Homo sapiens
uguggcugcuagcacuuggag

SEQ ID NO: 792038 - RNA, 17 nt, Homo sapiens
ugugggacugagaugca

SEQ ID NO: 792039 - RNA, 19 nt, Homo sapiens
ugugggagaccgaggacac

SEQ ID NO: 792040 - RNA, 16 nt, Homo sapiens
ugugggcaggaaguga

SEQ ID NO: 792041 - RNA, 15 nt, Homo sapiens
ugugggccaccagag

SEQ ID NO: 792042 - RNA, 16 nt, Homo sapiens
ugugggccaccagaga

SEQ ID NO: 792043 - RNA, 21 nt, Homo sapiens
ugugggcgcucucccuaccuu

SEQ ID NO: 792044 - RNA, 14 nt, Homo sapiens
ugugggcuugacca

SEQ ID NO: 792045 - RNA, 20 nt, Homo sapiens
uguggggacacagcagugag

SEQ ID NO: 792046 - RNA, 20 nt, Homo sapiens
uguggggggaagcuuugaua

SEQ ID NO: 792047 - RNA, 13 nt, Homo sapiens
ugugggggguccu

SEQ ID NO: 792048 - RNA, 14 nt, Homo sapiens
uguggguaaauuaa

SEQ ID NO: 792049 - RNA, 20 nt, Homo sapiens
uguggguuucucugugcucu

SEQ ID NO: 792050 - RNA, 17 nt, Homo sapiens
ugugguaaucuacacca

SEQ ID NO: 792051 - RNA, 20 nt, Homo sapiens
uguggucacuuguaccauau

SEQ ID NO: 792052 - RNA, 13 nt, Homo sapiens
uguggucugggga

SEQ ID NO: 792053 - RNA, 16 nt, Homo sapiens
uguggugagaucaugc

SEQ ID NO: 792054 - RNA, 19 nt, Homo sapiens
uguggugccggugcuucca

SEQ ID NO: 792055 - RNA, 23 nt, Homo sapiens
ugugguggcacgcgccuguaauc

SEQ ID NO: 792056 - RNA, 20 nt, Homo sapiens
ugugguuaacaucucagaaa

SEQ ID NO: 792057 - RNA, 16 nt, Homo sapiens
ugugguuacaguuuga

SEQ ID NO: 792058 - RNA, 19 nt, Homo sapiens
ugugguugaaaaccacagu

SEQ ID NO: 792059 - RNA, 13 nt, Homo sapiens
ugugguugcucac

SEQ ID NO: 792060 - RNA, 19 nt, Homo sapiens
uguguaauuuaagugacac

SEQ ID NO: 792061 - RNA, 23 nt, Homo sapiens
uguguaauuuuuuuuccuugccu

SEQ ID NO: 792062 - RNA, 15 nt, Homo sapiens
uguguacaacuuaag

SEQ ID NO: 792063 - RNA, 14 nt, Homo sapiens
uguguacaauguga

SEQ ID NO: 792064 - RNA, 15 nt, Homo sapiens
uguguaccacuuccu

SEQ ID NO: 792065 - RNA, 20 nt, Homo sapiens
uguguaccugugacuaaaca

SEQ ID NO: 792066 - RNA, 12 nt, Homo sapiens
uguguacugugg

SEQ ID NO: 792067 - RNA, 17 nt, Homo sapiens
uguguauagcuuaccug

SEQ ID NO: 792068 - RNA, 20 nt, Homo sapiens
uguguauauaaauacaugca

SEQ ID NO: 792069 - RNA, 19 nt, Homo sapiens
uguguaugcugaugaucaa

SEQ ID NO: 792070 - RNA, 17 nt, Homo sapiens
uguguauucuagugaau

SEQ ID NO: 792071 - RNA, 18 nt, Homo sapiens
uguguauuuccagugcaa

SEQ ID NO: 792072 - RNA, 19 nt, Homo sapiens
uguguauuuccagugcaau

SEQ ID NO: 792073 - RNA, 19 nt, Homo sapiens
ugugucaaggugaagcaca

SEQ ID NO: 792074 - RNA, 19 nt, Homo sapiens
ugugucccaggcagggaga

SEQ ID NO: 792075 - RNA, 15 nt, Homo sapiens
uguguccuggugcuc

SEQ ID NO: 792076 - RNA, 21 nt, Homo sapiens
uguguccuguccuuucuugca

SEQ ID NO: 792077 - RNA, 20 nt, Homo sapiens
ugugucgcgcacacagcuua

SEQ ID NO: 792078 - RNA, 12 nt, Homo sapiens
ugugucuguaca

SEQ ID NO: 792079 - RNA, 12 nt, Homo sapiens
ugugugaucaaa

SEQ ID NO: 792080 - RNA, 13 nt, Homo sapiens
ugugugccacuca

SEQ ID NO: 792081 - RNA, 17 nt, Homo sapiens
gacccucguggccuucc

SEQ ID NO: 792082 - RNA, 13 nt, Homo sapiens
aaaaaaaagagag

SEQ ID NO: 792083 - RNA, 11 nt, Homo sapiens
aaaaaaaagca

SEQ ID NO: 792084 - RNA, 15 nt, Homo sapiens
aaaaaaaagugucuc

SEQ ID NO: 792085 - RNA, 12 nt, Homo sapiens
aaaaaaagccaa

SEQ ID NO: 792086 - RNA, 12 nt, Homo sapiens
aaaaaaagggag

SEQ ID NO: 792087 - RNA, 12 nt, Homo sapiens
aaaaaacagagg

SEQ ID NO: 792088 - RNA, 13 nt, Homo sapiens
aaaaaagaacaca

SEQ ID NO: 792089 - RNA, 16 nt, Homo sapiens
aaaaaagccuccaagg

SEQ ID NO: 792090 - RNA, 13 nt, Homo sapiens
aaaaaauagcaca

SEQ ID NO: 792091 - RNA, 12 nt, Homo sapiens
aaaaaauccauu

SEQ ID NO: 792092 - RNA, 12 nt, Homo sapiens
aaaaaaucugac

SEQ ID NO: 792093 - RNA, 21 nt, Homo sapiens
aaaaaaugauaaggcucugaa

SEQ ID NO: 792094 - RNA, 14 nt, Homo sapiens
aaaaaauuaugaca

SEQ ID NO: 792095 - RNA, 22 nt, Homo sapiens
aaaaacaaacaaacaaacuguu

SEQ ID NO: 792096 - RNA, 14 nt, Homo sapiens
aaaaacaaauggga

SEQ ID NO: 792097 - RNA, 11 nt, Homo sapiens
aaaaacaacca

SEQ ID NO: 792098 - RNA, 14 nt, Homo sapiens
aaaaacaacuuuau

SEQ ID NO: 792099 - RNA, 15 nt, Homo sapiens
aaaaacaaugugcug

SEQ ID NO: 792100 - RNA, 12 nt, Homo sapiens
aaaaacaauuau

SEQ ID NO: 792101 - RNA, 21 nt, Homo sapiens
aaaaacagguauauacuuuga

SEQ ID NO: 792102 - RNA, 16 nt, Homo sapiens
aaaaaccaaaacugug

SEQ ID NO: 792103 - RNA, 18 nt, Homo sapiens
aaaaaccaauagcuuuaa

SEQ ID NO: 792104 - RNA, 23 nt, Homo sapiens
aaaaaccucuaugcaaucugagu

SEQ ID NO: 792105 - RNA, 18 nt, Homo sapiens
aaaaacuaacacccaguc

SEQ ID NO: 792106 - RNA, 11 nt, Homo sapiens
aaaaacuacuu

SEQ ID NO: 792107 - RNA, 12 nt, Homo sapiens
aaaaacuauucu

SEQ ID NO: 792108 - RNA, 13 nt, Homo sapiens
aaaaagaaaugca

SEQ ID NO: 792109 - RNA, 14 nt, Homo sapiens
aaaaagaaccaaaa

SEQ ID NO: 792110 - RNA, 18 nt, Homo sapiens
aaaaagacauucuuccaa

SEQ ID NO: 792111 - RNA, 17 nt, Homo sapiens
aaaaagacuaagccaga

SEQ ID NO: 792112 - RNA, 21 nt, Homo sapiens
aaaaagcaacaucuucauaga

SEQ ID NO: 792113 - RNA, 16 nt, Homo sapiens
aaaaagcaugaucuga

SEQ ID NO: 792114 - RNA, 15 nt, Homo sapiens
aaaaagccugucauu

SEQ ID NO: 792115 - RNA, 12 nt, Homo sapiens
aaaacauuugcu

SEQ ID NO: 792116 - RNA, 16 nt, Homo sapiens
aaaaccaauagcuuua

SEQ ID NO: 792117 - RNA, 15 nt, Homo sapiens
aaaaccagugaacuu

SEQ ID NO: 792118 - RNA, 13 nt, Homo sapiens
aaaacccagagag

SEQ ID NO: 792119 - RNA, 14 nt, Homo sapiens
aaaaccccaucucu

SEQ ID NO: 792120 - RNA, 20 nt, Homo sapiens
aaaaccccaucuuuacuaaa

SEQ ID NO: 792121 - RNA, 22 nt, Homo sapiens
aaaacccuugauuauacucugu

SEQ ID NO: 792122 - RNA, 16 nt, Homo sapiens
aaaacccuugggccag

SEQ ID NO: 792123 - RNA, 22 nt, Homo sapiens
aaaaccuacgcacauaccuuca

SEQ ID NO: 792124 - RNA, 12 nt, Homo sapiens
aaaaccucaaac

SEQ ID NO: 792125 - RNA, 16 nt, Homo sapiens
aaaaccucuaugcaau

SEQ ID NO: 792126 - RNA, 14 nt, Homo sapiens
aaaaccugugccag

SEQ ID NO: 792127 - RNA, 13 nt, Homo sapiens
aaaaccuuccuuc

SEQ ID NO: 792128 - RNA, 16 nt, Homo sapiens
aaaaccuuccuucccu

SEQ ID NO: 792129 - RNA, 17 nt, Homo sapiens
aaaaccuuuacaguuag

SEQ ID NO: 792130 - RNA, 13 nt, Homo sapiens
aaaacuaagcaca

SEQ ID NO: 792131 - RNA, 20 nt, Homo sapiens
aaaacuaauuuccucugaca

SEQ ID NO: 792132 - RNA, 11 nt, Homo sapiens
aaaacuacuga

SEQ ID NO: 792133 - RNA, 11 nt, Homo sapiens
aaaacuacuuc

SEQ ID NO: 792134 - RNA, 17 nt, Homo sapiens
aaaacuaugcuauuaaa

SEQ ID NO: 792135 - RNA, 20 nt, Homo sapiens
aaaacucauuuccuauguaa

SEQ ID NO: 792136 - RNA, 14 nt, Homo sapiens
aaaacuccgucuca

SEQ ID NO: 792137 - RNA, 11 nt, Homo sapiens
aaaacucucug

SEQ ID NO: 792138 - RNA, 22 nt, Homo sapiens
aaaacucugggaaauaagagag

SEQ ID NO: 792139 - RNA, 21 nt, Homo sapiens
aaaacucugguaaaugaucac

SEQ ID NO: 792140 - RNA, 17 nt, Homo sapiens
aaaacuggcaucugaca

SEQ ID NO: 792141 - RNA, 15 nt, Homo sapiens
aaaacugugccuugu

SEQ ID NO: 792142 - RNA, 21 nt, Homo sapiens
aaaacuguuuguuaucucuug

SEQ ID NO: 792143 - RNA, 14 nt, Homo sapiens
aaaacuuaacauuc

SEQ ID NO: 792144 - RNA, 12 nt, Homo sapiens
aaaacuuaucac

SEQ ID NO: 792145 - RNA, 21 nt, Homo sapiens
aaaacuucauucuaaaccaaa

SEQ ID NO: 792146 - RNA, 22 nt, Homo sapiens
aaaacuugauguguuaucucuu

SEQ ID NO: 792147 - RNA, 19 nt, Homo sapiens
aaaacuuguuacuaaagaa

SEQ ID NO: 792148 - RNA, 21 nt, Homo sapiens
aaaacuuuggaguccccucac

SEQ ID NO: 792149 - RNA, 18 nt, Homo sapiens
aaaagaaagaaccacuca

SEQ ID NO: 792150 - RNA, 22 nt, Homo sapiens
aaaagaaauuuugccugccauu

SEQ ID NO: 792151 - RNA, 12 nt, Homo sapiens
aaaagaaccaaa

SEQ ID NO: 792152 - RNA, 18 nt, Homo sapiens
aaaagaaccgagcaauuu

SEQ ID NO: 792153 - RNA, 13 nt, Homo sapiens
aaaagaacuaaga

SEQ ID NO: 792154 - RNA, 21 nt, Homo sapiens
aaaagaagacaacauuucuca

SEQ ID NO: 792155 - RNA, 20 nt, Homo sapiens
aaaagaauuacagacucuga

SEQ ID NO: 792156 - RNA, 16 nt, Homo sapiens
aaaagacauucuucca

SEQ ID NO: 792157 - RNA, 19 nt, Homo sapiens
aaaagacucugaccagaga

SEQ ID NO: 792158 - RNA, 13 nt, Homo sapiens
aaaagagaauaau

SEQ ID NO: 792159 - RNA, 15 nt, Homo sapiens
aaaagagagaucuug

SEQ ID NO: 792160 - RNA, 17 nt, Homo sapiens
aaaagagagaucuugau

SEQ ID NO: 792161 - RNA, 16 nt, Homo sapiens
aaaagauaacaagauc

SEQ ID NO: 792162 - RNA, 16 nt, Homo sapiens
aaaagcaauacuguuu

SEQ ID NO: 792163 - RNA, 16 nt, Homo sapiens
aaaagccuaaucacag

SEQ ID NO: 792164 - RNA, 17 nt, Homo sapiens
aaaagccuaaucacagu

SEQ ID NO: 792165 - RNA, 16 nt, Homo sapiens
aaaagccuguauuuaa

SEQ ID NO: 792166 - RNA, 19 nt, Homo sapiens
aaaagccuuggccucagag

SEQ ID NO: 792167 - RNA, 16 nt, Homo sapiens
aaaagcgacccauuca

SEQ ID NO: 792168 - RNA, 20 nt, Homo sapiens
aaaagcgacccauucagaga

SEQ ID NO: 792169 - RNA, 16 nt, Homo sapiens
aaaagcuacaguuuug

SEQ ID NO: 792170 - RNA, 18 nt, Homo sapiens
aaaagcuagauacuggaa

SEQ ID NO: 792171 - RNA, 10 nt, Homo sapiens
aaaagcuuuu

SEQ ID NO: 792172 - RNA, 22 nt, Homo sapiens
aaaaggaacucuagaagaccaa

SEQ ID NO: 792173 - RNA, 13 nt, Homo sapiens
aaaaggacuguga

SEQ ID NO: 792174 - RNA, 19 nt, Homo sapiens
aaaaggagucaagaacaau

SEQ ID NO: 792175 - RNA, 16 nt, Homo sapiens
aaaaggauaugcagua

SEQ ID NO: 792176 - RNA, 14 nt, Homo sapiens
aaaagggagauuca

SEQ ID NO: 792177 - RNA, 17 nt, Homo sapiens
aaaagggaggcucucug

SEQ ID NO: 792178 - RNA, 16 nt, Homo sapiens
caugacccagccugaa

SEQ ID NO: 792179 - RNA, 13 nt, Homo sapiens
caugaccuggaaa

SEQ ID NO: 792180 - RNA, 13 nt, Homo sapiens
caugacggggaca

SEQ ID NO: 792181 - RNA, 15 nt, Homo sapiens
caugacggguuguga

SEQ ID NO: 792182 - RNA, 15 nt, Homo sapiens
caugacguaguauua

SEQ ID NO: 792183 - RNA, 18 nt, Homo sapiens
caugacuuauuaugcaua

SEQ ID NO: 792184 - RNA, 23 nt, Homo sapiens
caugacuuuauauggaugauuca

SEQ ID NO: 792185 - RNA, 15 nt, Homo sapiens
caugagacucagugc

SEQ ID NO: 792186 - RNA, 21 nt, Homo sapiens
caugagagaauuguaucauuu

SEQ ID NO: 792187 - RNA, 13 nt, Homo sapiens
caugagauuuaua

SEQ ID NO: 792188 - RNA, 21 nt, Homo sapiens
caugagcgucuguggagccau

SEQ ID NO: 792189 - RNA, 19 nt, Homo sapiens
caugagcugcucauuacag

SEQ ID NO: 792190 - RNA, 20 nt, Homo sapiens
caugaggagggaaaagagug

SEQ ID NO: 792191 - RNA, 18 nt, Homo sapiens
caugaggccaccaguaaa

SEQ ID NO: 792192 - RNA, 19 nt, Homo sapiens
caugaggccaucucaggag

SEQ ID NO: 792193 - RNA, 24 nt, Homo sapiens
caugagucaaaacaaagcagcuuu

SEQ ID NO: 792194 - RNA, 14 nt, Homo sapiens
caugauaggauuug

SEQ ID NO: 792195 - RNA, 14 nt, Homo sapiens
caugaucauucuca

SEQ ID NO: 792196 - RNA, 19 nt, Homo sapiens
caugaugcuagccagcaaa

SEQ ID NO: 792197 - RNA, 20 nt, Homo sapiens
caugauggagcgcaccugcc

SEQ ID NO: 792198 - RNA, 18 nt, Homo sapiens
caugauggcaacagaucu

SEQ ID NO: 792199 - RNA, 21 nt, Homo sapiens
caugauggcccauacuuguaa

SEQ ID NO: 792200 - RNA, 23 nt, Homo sapiens
caugaugugaagaguuucacaaa

SEQ ID NO: 792201 - RNA, 19 nt, Homo sapiens
caugaugugugaguguaau

SEQ ID NO: 792202 - RNA, 16 nt, Homo sapiens
caugauuagauugcaa

SEQ ID NO: 792203 - RNA, 16 nt, Homo sapiens
caugauuguuugacac

SEQ ID NO: 792204 - RNA, 12 nt, Homo sapiens
caugauuuccca

SEQ ID NO: 792205 - RNA, 14 nt, Homo sapiens
caugcaaaugagcu

SEQ ID NO: 792206 - RNA, 11 nt, Homo sapiens
caugcacacac

SEQ ID NO: 792207 - RNA, 21 nt, Homo sapiens
caugcacacacacacaucuca

SEQ ID NO: 792208 - RNA, 13 nt, Homo sapiens
caugcacaugccu

SEQ ID NO: 792209 - RNA, 12 nt, Homo sapiens
caugcacugacc

SEQ ID NO: 792210 - RNA, 21 nt, Homo sapiens
caugcagcuguggcagaguua

SEQ ID NO: 792211 - RNA, 16 nt, Homo sapiens
caugccaaauguucca

SEQ ID NO: 792212 - RNA, 15 nt, Homo sapiens
caugccacugccagg

SEQ ID NO: 792213 - RNA, 19 nt, Homo sapiens
caugccagacccacugaaa

SEQ ID NO: 792214 - RNA, 15 nt, Homo sapiens
caugcccacagauca

SEQ ID NO: 792215 - RNA, 14 nt, Homo sapiens
caugcccaugauga

SEQ ID NO: 792216 - RNA, 16 nt, Homo sapiens
caugcccucaauccca

SEQ ID NO: 792217 - RNA, 18 nt, Homo sapiens
caugccucagccucucaa

SEQ ID NO: 792218 - RNA, 13 nt, Homo sapiens
caugccucugaua

SEQ ID NO: 792219 - RNA, 17 nt, Homo sapiens
caugccuuaagccaguu

SEQ ID NO: 792220 - RNA, 15 nt, Homo sapiens
caugccuugcaaugg

SEQ ID NO: 792221 - RNA, 17 nt, Homo sapiens
caugcguauaugugcgu

SEQ ID NO: 792222 - RNA, 15 nt, Homo sapiens
caugcucaaccuuca

SEQ ID NO: 792223 - RNA, 16 nt, Homo sapiens
caugcucaggagccac

SEQ ID NO: 792224 - RNA, 21 nt, Homo sapiens
caugcucaggagccaccagca

SEQ ID NO: 792225 - RNA, 22 nt, Homo sapiens
caugcuccagauuagagccugu

SEQ ID NO: 792226 - RNA, 11 nt, Homo sapiens
caugcucccuc

SEQ ID NO: 792227 - RNA, 13 nt, Homo sapiens
caugcuccucacc

SEQ ID NO: 792228 - RNA, 15 nt, Homo sapiens
caugcugcuggggaa

SEQ ID NO: 792229 - RNA, 18 nt, Homo sapiens
caugcugggaaugagaca

SEQ ID NO: 792230 - RNA, 14 nt, Homo sapiens
caugcuggggcaag

SEQ ID NO: 792231 - RNA, 14 nt, Homo sapiens
caugcugugcugug

SEQ ID NO: 792232 - RNA, 19 nt, Homo sapiens
caugcuguugcugcuacug

SEQ ID NO: 792233 - RNA, 19 nt, Homo sapiens
caugcuuguggaugacucu

SEQ ID NO: 792234 - RNA, 22 nt, Homo sapiens
caugcuuuguuuuucacauaua

SEQ ID NO: 792235 - RNA, 21 nt, Homo sapiens
caugcuuuucugccacuccau

SEQ ID NO: 792236 - RNA, 14 nt, Homo sapiens
cauggaagcgcaca

SEQ ID NO: 792237 - RNA, 14 nt, Homo sapiens
cauggaggccaaga

SEQ ID NO: 792238 - RNA, 19 nt, Homo sapiens
cauggaggccaagaacuug

SEQ ID NO: 792239 - RNA, 16 nt, Homo sapiens
cauggcaccaaagcca

SEQ ID NO: 792240 - RNA, 20 nt, Homo sapiens
cauggcagaagucaacgccu

SEQ ID NO: 792241 - RNA, 20 nt, Homo sapiens
cauggccccaguccaugcuu

SEQ ID NO: 792242 - RNA, 14 nt, Homo sapiens
cauggccuaugcac

SEQ ID NO: 792243 - RNA, 16 nt, Homo sapiens
cauggccuaugcacau

SEQ ID NO: 792244 - RNA, 17 nt, Homo sapiens
cauggccuaugcacaua

SEQ ID NO: 792245 - RNA, 18 nt, Homo sapiens
cauggcguaaugggccug

SEQ ID NO: 792246 - RNA, 14 nt, Homo sapiens
cauggcugaacgcg

SEQ ID NO: 792247 - RNA, 14 nt, Homo sapiens
cauggcugaaguca

SEQ ID NO: 792248 - RNA, 15 nt, Homo sapiens
cauggcuggcacauu

SEQ ID NO: 792249 - RNA, 16 nt, Homo sapiens
cauggcuggcacauug

SEQ ID NO: 792250 - RNA, 17 nt, Homo sapiens
cauggcuguguuugcag

SEQ ID NO: 792251 - RNA, 18 nt, Homo sapiens
caugggcaccaaccugca

SEQ ID NO: 792252 - RNA, 16 nt, Homo sapiens
cauggggcugauugua

SEQ ID NO: 792253 - RNA, 18 nt, Homo sapiens
cauggguaaaaauauuuc

SEQ ID NO: 792254 - RNA, 17 nt, Homo sapiens
caugguaauucacuuca

SEQ ID NO: 792255 - RNA, 23 nt, Homo sapiens
cauggugagccuagcccugggac

SEQ ID NO: 792256 - RNA, 13 nt, Homo sapiens
cauggugcacuga

SEQ ID NO: 792257 - RNA, 16 nt, Homo sapiens
cauggugccccaggac

SEQ ID NO: 792258 - RNA, 22 nt, Homo sapiens
caugguggaaaacgaagcucau

SEQ ID NO: 792259 - RNA, 13 nt, Homo sapiens
caugguggcacac

SEQ ID NO: 792260 - RNA, 16 nt, Homo sapiens
caugguuugacucugg

SEQ ID NO: 792261 - RNA, 21 nt, Homo sapiens
cauguaaaagccuaggucuau

SEQ ID NO: 792262 - RNA, 15 nt, Homo sapiens
cauguaaauugcaaa

SEQ ID NO: 792263 - RNA, 19 nt, Homo sapiens
cauguaacauacauauucc

SEQ ID NO: 792264 - RNA, 17 nt, Homo sapiens
cauguaagcucuuugag

SEQ ID NO: 792265 - RNA, 21 nt, Homo sapiens
cauguaauguuaauguuauau

SEQ ID NO: 792266 - RNA, 17 nt, Homo sapiens
cauguacagacauacau

SEQ ID NO: 792267 - RNA, 16 nt, Homo sapiens
cauguacauagcuuga

SEQ ID NO: 792268 - RNA, 19 nt, Homo sapiens
cauguagguguuuguucau

SEQ ID NO: 792269 - RNA, 20 nt, Homo sapiens
cauguaucucaguaccccau

SEQ ID NO: 792270 - RNA, 16 nt, Homo sapiens
cauguauuaaauuaca

SEQ ID NO: 792271 - RNA, 21 nt, Homo sapiens
caugucaccucagcugauauu

SEQ ID NO: 792272 - RNA, 20 nt, Homo sapiens
caugucacuucccugcuuaa

SEQ ID NO: 792273 - RNA, 23 nt, Homo sapiens
caugucgaggcuagaggcauuug

SEQ ID NO: 792274 - RNA, 17 nt, Homo sapiens
caugucucaauaguaaa

SEQ ID NO: 792275 - RNA, 16 nt, Homo sapiens
caugucuccuacugag

SEQ ID NO: 792276 - RNA, 18 nt, Homo sapiens
caugucuuguacaugugu

SEQ ID NO: 792277 - RNA, 22 nt, Homo sapiens
caugugaaguguauaugauucu

SEQ ID NO: 792278 - RNA, 20 nt, Homo sapiens
caugugaaguuuugcaaaua

SEQ ID NO: 792279 - RNA, 15 nt, Homo sapiens
caugugacacauaug

SEQ ID NO: 792280 - RNA, 20 nt, Homo sapiens
caugugacacauaugcaccu

SEQ ID NO: 792281 - RNA, 17 nt, Homo sapiens
caugugcaaaugugcug

SEQ ID NO: 792282 - RNA, 14 nt, Homo sapiens
caugugcaccugcc

SEQ ID NO: 792283 - RNA, 18 nt, Homo sapiens
caugugccuuucuuugcc

SEQ ID NO: 792284 - RNA, 19 nt, Homo sapiens
cauguggaagcacuuuaag

SEQ ID NO: 792285 - RNA, 18 nt, Homo sapiens
cauguguagccugugcau

SEQ ID NO: 792286 - RNA, 13 nt, Homo sapiens
cauguguauuucc

SEQ ID NO: 792287 - RNA, 16 nt, Homo sapiens
caugugucaugaagaa

SEQ ID NO: 792288 - RNA, 12 nt, Homo sapiens
cauguguggaag

SEQ ID NO: 792289 - RNA, 17 nt, Homo sapiens
cauguguguaagugugu

SEQ ID NO: 792290 - RNA, 15 nt, Homo sapiens
cauguguugcaaauu

SEQ ID NO: 792291 - RNA, 18 nt, Homo sapiens
cauguuacugaccagcaa

SEQ ID NO: 792292 - RNA, 21 nt, Homo sapiens
cauguuaggaaaauuucacau

SEQ ID NO: 792293 - RNA, 14 nt, Homo sapiens
cauuucuaucacau

SEQ ID NO: 792294 - RNA, 21 nt, Homo sapiens
cauuucuauuuauuuacugag

SEQ ID NO: 792295 - RNA, 19 nt, Homo sapiens
cauuucucugcuuacccuu

SEQ ID NO: 792296 - RNA, 20 nt, Homo sapiens
cauuucuggacaguaccuga

SEQ ID NO: 792297 - RNA, 21 nt, Homo sapiens
cauuucuggggguuggcuuuu

SEQ ID NO: 792298 - RNA, 15 nt, Homo sapiens
cauuucugucuccag

SEQ ID NO: 792299 - RNA, 22 nt, Homo sapiens
cauuucuguugaggcugcagau

SEQ ID NO: 792300 - RNA, 18 nt, Homo sapiens
cauuucuuugcauuccag

SEQ ID NO: 792301 - RNA, 16 nt, Homo sapiens
cauuugaguauuacaa

SEQ ID NO: 792302 - RNA, 20 nt, Homo sapiens
cauuugauggccaccagcuu

SEQ ID NO: 792303 - RNA, 15 nt, Homo sapiens
cauuugauguacaug

SEQ ID NO: 792304 - RNA, 13 nt, Homo sapiens
cauuugauuguca

SEQ ID NO: 792305 - RNA, 13 nt, Homo sapiens
cauuugcaccuac

SEQ ID NO: 792306 - RNA, 15 nt, Homo sapiens
cauuugccaagugag

SEQ ID NO: 792307 - RNA, 14 nt, Homo sapiens
cauuugcucuucag

SEQ ID NO: 792308 - RNA, 11 nt, Homo sapiens
cauuugcugaa

SEQ ID NO: 792309 - RNA, 20 nt, Homo sapiens
cauuugcugaacucagcaca

SEQ ID NO: 792310 - RNA, 14 nt, Homo sapiens
cauuugcugccauu

SEQ ID NO: 792311 - RNA, 11 nt, Homo sapiens
cauuuggucuc

SEQ ID NO: 792312 - RNA, 15 nt, Homo sapiens
cauuuggugacugug

SEQ ID NO: 792313 - RNA, 16 nt, Homo sapiens
cauuuggugacugugu

SEQ ID NO: 792314 - RNA, 17 nt, Homo sapiens
cauuuguagcaauuuaa

SEQ ID NO: 792315 - RNA, 17 nt, Homo sapiens
cauuuguauuacugcuu

SEQ ID NO: 792316 - RNA, 12 nt, Homo sapiens
cauuugucacag

SEQ ID NO: 792317 - RNA, 15 nt, Homo sapiens
cauuugucucuacuu

SEQ ID NO: 792318 - RNA, 17 nt, Homo sapiens
cauuugucuuuguaaua

SEQ ID NO: 792319 - RNA, 15 nt, Homo sapiens
cauuuguguacacag

SEQ ID NO: 792320 - RNA, 22 nt, Homo sapiens
cauuuguguggaaaucauacca

SEQ ID NO: 792321 - RNA, 20 nt, Homo sapiens
cauuuguguuuugaaagccc

SEQ ID NO: 792322 - RNA, 22 nt, Homo sapiens
cauuuguguuuugaaagcccaa

SEQ ID NO: 792323 - RNA, 12 nt, Homo sapiens
cauuuguucuca

SEQ ID NO: 792324 - RNA, 20 nt, Homo sapiens
caccuaugccagugcucaag

SEQ ID NO: 792325 - RNA, 14 nt, Homo sapiens
caccucaccaaaac

SEQ ID NO: 792326 - RNA, 21 nt, Homo sapiens
caccucaccucccgaagccac

SEQ ID NO: 792327 - RNA, 22 nt, Homo sapiens
caccucccacuccugcugcaca

SEQ ID NO: 792328 - RNA, 20 nt, Homo sapiens
caccucccauuacuuugaua

SEQ ID NO: 792329 - RNA, 23 nt, Homo sapiens
caccucccccuuucacacuggau

SEQ ID NO: 792330 - RNA, 15 nt, Homo sapiens
caccuccucuaaggu

SEQ ID NO: 792331 - RNA, 22 nt, Homo sapiens
caccucucuccuuugcugaggc

SEQ ID NO: 792332 - RNA, 18 nt, Homo sapiens
caccucugccucaaugug

SEQ ID NO: 792333 - RNA, 15 nt, Homo sapiens
caccucuuaugcaca

SEQ ID NO: 792334 - RNA, 17 nt, Homo sapiens
caccucuuccuugaugu

SEQ ID NO: 792335 - RNA, 20 nt, Homo sapiens
caccugcagcccauggugag

SEQ ID NO: 792336 - RNA, 17 nt, Homo sapiens
caccugcuggggaccuc

SEQ ID NO: 792337 - RNA, 17 nt, Homo sapiens
caccuggcccuugcaau

SEQ ID NO: 792338 - RNA, 21 nt, Homo sapiens
caccugggagaaggucuccaa

SEQ ID NO: 792339 - RNA, 23 nt, Homo sapiens
caccugggccgggcuguagauca

SEQ ID NO: 792340 - RNA, 14 nt, Homo sapiens
caccuguaauccca

SEQ ID NO: 792341 - RNA, 17 nt, Homo sapiens
caccugucuuggccucc

SEQ ID NO: 792342 - RNA, 13 nt, Homo sapiens
caccugugacaaa

SEQ ID NO: 792343 - RNA, 14 nt, Homo sapiens
caccugugauccca

SEQ ID NO: 792344 - RNA, 14 nt, Homo sapiens
caccugugugccca

SEQ ID NO: 792345 - RNA, 21 nt, Homo sapiens
caccuuccagcuccuguaaca

SEQ ID NO: 792346 - RNA, 17 nt, Homo sapiens
caccuuccccagaacca

SEQ ID NO: 792347 - RNA, 13 nt, Homo sapiens
caccuucuucucc

SEQ ID NO: 792348 - RNA, 17 nt, Homo sapiens
caccuugccuugcuguu

SEQ ID NO: 792349 - RNA, 19 nt, Homo sapiens
caccuuggccuucugggaa

SEQ ID NO: 792350 - RNA, 13 nt, Homo sapiens
caccuugggauga

SEQ ID NO: 792351 - RNA, 14 nt, Homo sapiens
caccuuuuaugaau

SEQ ID NO: 792352 - RNA, 18 nt, Homo sapiens
caccuuuugcacauaaca

SEQ ID NO: 792353 - RNA, 13 nt, Homo sapiens
cacgaacuggccu

SEQ ID NO: 792354 - RNA, 18 nt, Homo sapiens
cacgaauuccaucuugua

SEQ ID NO: 792355 - RNA, 11 nt, Homo sapiens
cacgaggucag

SEQ ID NO: 792356 - RNA, 16 nt, Homo sapiens
cacgaucguuaugcug

SEQ ID NO: 792357 - RNA, 16 nt, Homo sapiens
cacgcagacccaguac

SEQ ID NO: 792358 - RNA, 14 nt, Homo sapiens
cacgcagccaggac

SEQ ID NO: 792359 - RNA, 21 nt, Homo sapiens
cacgcaguaacuaaagcuuua

SEQ ID NO: 792360 - RNA, 17 nt, Homo sapiens
cacgccugcaggcugga

SEQ ID NO: 792361 - RNA, 14 nt, Homo sapiens
cacgccugccaucu

SEQ ID NO: 792362 - RNA, 22 nt, Homo sapiens
cacgccuguaaucccagcacuu

SEQ ID NO: 792363 - RNA, 14 nt, Homo sapiens
cacgcgaaaaccuu

SEQ ID NO: 792364 - RNA, 18 nt, Homo sapiens
cacggaggagggaugcug

SEQ ID NO: 792365 - RNA, 22 nt, Homo sapiens
cacggagggggacggggcucag

SEQ ID NO: 792366 - RNA, 16 nt, Homo sapiens
cacggauggugcaugg

SEQ ID NO: 792367 - RNA, 18 nt, Homo sapiens
cacggcguuguaccugua

SEQ ID NO: 792368 - RNA, 23 nt, Homo sapiens
cacggcuccuccuuaugacucca

SEQ ID NO: 792369 - RNA, 14 nt, Homo sapiens
cacgguuuccagau

SEQ ID NO: 792370 - RNA, 12 nt, Homo sapiens
cacguaccuuca

SEQ ID NO: 792371 - RNA, 16 nt, Homo sapiens
cacguaucucuuggua

SEQ ID NO: 792372 - RNA, 21 nt, Homo sapiens
cacguaugguggcucaugucu

SEQ ID NO: 792373 - RNA, 12 nt, Homo sapiens
cacgucugcuaa

SEQ ID NO: 792374 - RNA, 15 nt, Homo sapiens
cacgucuugcuauuu

SEQ ID NO: 792375 - RNA, 20 nt, Homo sapiens
cacgucuuuucucauaucau

SEQ ID NO: 792376 - RNA, 15 nt, Homo sapiens
cacguuagauuugcc

SEQ ID NO: 792377 - RNA, 16 nt, Homo sapiens
cacuaaagcaugaaau

SEQ ID NO: 792378 - RNA, 19 nt, Homo sapiens
cacuaaaguuacaaacaga

SEQ ID NO: 792379 - RNA, 22 nt, Homo sapiens
cacuaaauucuagaaaguacuu

SEQ ID NO: 792380 - RNA, 13 nt, Homo sapiens
cacuaacauauau

SEQ ID NO: 792381 - RNA, 16 nt, Homo sapiens
cacuacaacagaauuu

SEQ ID NO: 792382 - RNA, 14 nt, Homo sapiens
cacuacauuguaca

SEQ ID NO: 792383 - RNA, 20 nt, Homo sapiens
cacuaccaaacacucagucc

SEQ ID NO: 792384 - RNA, 17 nt, Homo sapiens
cacuaccguaaaugucc

SEQ ID NO: 792385 - RNA, 20 nt, Homo sapiens
cacuacgugacuguggcaca

SEQ ID NO: 792386 - RNA, 14 nt, Homo sapiens
cacuagccagacac

SEQ ID NO: 792387 - RNA, 15 nt, Homo sapiens
cacuaggauugugau

SEQ ID NO: 792388 - RNA, 20 nt, Homo sapiens
cacuauaauguaagcucuac

SEQ ID NO: 792389 - RNA, 16 nt, Homo sapiens
cacuauaucuguauau

SEQ ID NO: 792390 - RNA, 17 nt, Homo sapiens
cacuaucacgagccuuu

SEQ ID NO: 792391 - RNA, 19 nt, Homo sapiens
cacuaugaagauguuucaa

SEQ ID NO: 792392 - RNA, 21 nt, Homo sapiens
cacuaugaaucuauuauacug

SEQ ID NO: 792393 - RNA, 14 nt, Homo sapiens
cacuauguauauac

SEQ ID NO: 792394 - RNA, 17 nt, Homo sapiens
cacuauguauauacaua

SEQ ID NO: 792395 - RNA, 19 nt, Homo sapiens
cacuauuuaucugugcaaa

SEQ ID NO: 792396 - RNA, 13 nt, Homo sapiens
cacucaagcaaca

SEQ ID NO: 792397 - RNA, 15 nt, Homo sapiens
cacucaaugccaacu

SEQ ID NO: 792398 - RNA, 12 nt, Homo sapiens
cacucacacugg

SEQ ID NO: 792399 - RNA, 15 nt, Homo sapiens
cacucacagagucaa

SEQ ID NO: 792400 - RNA, 15 nt, Homo sapiens
cacucaccccagcga

SEQ ID NO: 792401 - RNA, 12 nt, Homo sapiens
cacucagauuua

SEQ ID NO: 792402 - RNA, 16 nt, Homo sapiens
cacucagggagcauuu

SEQ ID NO: 792403 - RNA, 15 nt, Homo sapiens
cacucaguugcaacu

SEQ ID NO: 792404 - RNA, 16 nt, Homo sapiens
cacucaugaagcauac

SEQ ID NO: 792405 - RNA, 17 nt, Homo sapiens
cacucauuccuucacuc

SEQ ID NO: 792406 - RNA, 21 nt, Homo sapiens
cacuccaggauauugacaaga

SEQ ID NO: 792407 - RNA, 19 nt, Homo sapiens
cacuccagugcucagcugu

SEQ ID NO: 792408 - RNA, 12 nt, Homo sapiens
cacucccaaagc

SEQ ID NO: 792409 - RNA, 17 nt, Homo sapiens
cacucccucugccuuca

SEQ ID NO: 792410 - RNA, 19 nt, Homo sapiens
cacuccucgguacucccau

SEQ ID NO: 792411 - RNA, 21 nt, Homo sapiens
cacuccugcuuaaucuucaaa

SEQ ID NO: 792412 - RNA, 20 nt, Homo sapiens
cacuccuucucucacugugu

SEQ ID NO: 792413 - RNA, 15 nt, Homo sapiens
cacucgaugagauaa

SEQ ID NO: 792414 - RNA, 13 nt, Homo sapiens
cacucuacccuau

SEQ ID NO: 792415 - RNA, 20 nt, Homo sapiens
cacucucccaccuccuggug

SEQ ID NO: 792416 - RNA, 17 nt, Homo sapiens
cacucugaauccucaug

SEQ ID NO: 792417 - RNA, 19 nt, Homo sapiens
cacucuggagaguaaucug

SEQ ID NO: 792418 - RNA, 19 nt, Homo sapiens
cacucuguaguuacugugg

SEQ ID NO: 792419 - RNA, 18 nt, Homo sapiens
cacucuguugguagcaau

SEQ ID NO: 792420 - RNA, 21 nt, Homo sapiens
cacucuuaucuacauaaggau

SEQ ID NO: 792421 - RNA, 21 nt, Homo sapiens
cacugaaacugguugaagggu

SEQ ID NO: 792422 - RNA, 16 nt, Homo sapiens
caucacugguugcacu

SEQ ID NO: 792423 - RNA, 17 nt, Homo sapiens
caucacuguaaagacaa

SEQ ID NO: 792424 - RNA, 19 nt, Homo sapiens
caucagagguuugcuuccu

SEQ ID NO: 792425 - RNA, 20 nt, Homo sapiens
caucagaguauuaucacugc

SEQ ID NO: 792426 - RNA, 16 nt, Homo sapiens
caucagccuguagcuc

SEQ ID NO: 792427 - RNA, 17 nt, Homo sapiens
caucagcgggucuccuc

SEQ ID NO: 792428 - RNA, 14 nt, Homo sapiens
caucagcuccagcu

SEQ ID NO: 792429 - RNA, 20 nt, Homo sapiens
caucagcuugcccuguuaaa

SEQ ID NO: 792430 - RNA, 13 nt, Homo sapiens
caucagcuuuauu

SEQ ID NO: 792431 - RNA, 15 nt, Homo sapiens
caucaggaaacagga

SEQ ID NO: 792432 - RNA, 19 nt, Homo sapiens
caucaggaccacucaguua

SEQ ID NO: 792433 - RNA, 21 nt, Homo sapiens
caucaggugaggugugcucca

SEQ ID NO: 792434 - RNA, 16 nt, Homo sapiens
caucagucaacaacuu

SEQ ID NO: 792435 - RNA, 18 nt, Homo sapiens
caucagucuccaacaugu

SEQ ID NO: 792436 - RNA, 12 nt, Homo sapiens
caucaguucccc

SEQ ID NO: 792437 - RNA, 20 nt, Homo sapiens
caucauacuaaaagcaaugu

SEQ ID NO: 792438 - RNA, 12 nt, Homo sapiens
caucaugcaugu

SEQ ID NO: 792439 - RNA, 10 nt, Homo sapiens
cauccaaagu

SEQ ID NO: 792440 - RNA, 13 nt, Homo sapiens
cauccaacacugg

SEQ ID NO: 792441 - RNA, 18 nt, Homo sapiens
cauccaacuaacuccaga

SEQ ID NO: 792442 - RNA, 18 nt, Homo sapiens
cauccaaggagaaacaga

SEQ ID NO: 792443 - RNA, 22 nt, Homo sapiens
cauccacaggguuuugacacuu

SEQ ID NO: 792444 - RNA, 22 nt, Homo sapiens
cauccaccaccuugccaauggu

SEQ ID NO: 792445 - RNA, 16 nt, Homo sapiens
cauccaccucaucacu

SEQ ID NO: 792446 - RNA, 22 nt, Homo sapiens
cauccaccuucccuucuacaag

SEQ ID NO: 792447 - RNA, 17 nt, Homo sapiens
cauccaggccagggcuc

SEQ ID NO: 792448 - RNA, 16 nt, Homo sapiens
cauccaggucuugacu

SEQ ID NO: 792449 - RNA, 14 nt, Homo sapiens
cauccagugacaaa

SEQ ID NO: 792450 - RNA, 15 nt, Homo sapiens
cauccauaauuguga

SEQ ID NO: 792451 - RNA, 16 nt, Homo sapiens
cauccauaauugugau

SEQ ID NO: 792452 - RNA, 22 nt, Homo sapiens
cacccuuguccuugagugcucu

SEQ ID NO: 792453 - RNA, 12 nt, Homo sapiens
caccgagaccaa

SEQ ID NO: 792454 - RNA, 23 nt, Homo sapiens
caccgccuccccaccuccaggcu

SEQ ID NO: 792455 - RNA, 22 nt, Homo sapiens
caccgcgcccagccucaucucu

SEQ ID NO: 792456 - RNA, 15 nt, Homo sapiens
caccggcucucaccu

SEQ ID NO: 792457 - RNA, 22 nt, Homo sapiens
caccguacaucugcaauaugaa

SEQ ID NO: 792458 - RNA, 12 nt, Homo sapiens
caccgucuuucu

SEQ ID NO: 792459 - RNA, 19 nt, Homo sapiens
caccuaagucucugugaau

SEQ ID NO: 792460 - RNA, 22 nt, Homo sapiens
caccuaauccaggcagauccag

SEQ ID NO: 792461 - RNA, 21 nt, Homo sapiens
caccuaauguuuaugagccag

SEQ ID NO: 792462 - RNA, 13 nt, Homo sapiens
caccuacccagcu

SEQ ID NO: 792463 - RNA, 16 nt, Homo sapiens
caccuaccgaguucaa

SEQ ID NO: 792464 - RNA, 23 nt, Homo sapiens
caccuaccuuagaaaacaaguau

SEQ ID NO: 792465 - RNA, 19 nt, Homo sapiens
caccuagaacacuaacuca

SEQ ID NO: 792466 - RNA, 15 nt, Homo sapiens
caccuagacuguaaa

SEQ ID NO: 792467 - RNA, 14 nt, Homo sapiens
caccuaguucuccc

SEQ ID NO: 792468 - RNA, 17 nt, Homo sapiens
cacagggagugcacaua

SEQ ID NO: 792469 - RNA, 16 nt, Homo sapiens
cacagggcaccagagg

SEQ ID NO: 792470 - RNA, 12 nt, Homo sapiens
cacagucacugc

SEQ ID NO: 792471 - RNA, 14 nt, Homo sapiens
cacagucacuggau

SEQ ID NO: 792472 - RNA, 15 nt, Homo sapiens
cacagucaguggaga

SEQ ID NO: 792473 - RNA, 16 nt, Homo sapiens
cacagugacacuggac

SEQ ID NO: 792474 - RNA, 13 nt, Homo sapiens
cacagugcaucuc

SEQ ID NO: 792475 - RNA, 15 nt, Homo sapiens
cacagugcaucucag

SEQ ID NO: 792476 - RNA, 21 nt, Homo sapiens
cacagugcccaagaguggggu

SEQ ID NO: 792477 - RNA, 14 nt, Homo sapiens
cacagugcugggau

SEQ ID NO: 792478 - RNA, 13 nt, Homo sapiens
cacagugggaacu

SEQ ID NO: 792479 - RNA, 15 nt, Homo sapiens
cacagugguggugcc

SEQ ID NO: 792480 - RNA, 11 nt, Homo sapiens
cacagugucug

SEQ ID NO: 792481 - RNA, 18 nt, Homo sapiens
cacaguguugcauaugag

SEQ ID NO: 792482 - RNA, 15 nt, Homo sapiens
cacaguucauugcag

SEQ ID NO: 792483 - RNA, 23 nt, Homo sapiens
cacaguucuuugggccagacaug

SEQ ID NO: 792484 - RNA, 14 nt, Homo sapiens
cacaaauagaaacc

SEQ ID NO: 792485 - RNA, 14 nt, Homo sapiens
cacaaauauaguug

SEQ ID NO: 792486 - RNA, 23 nt, Homo sapiens
cacaaaucaaagcaagggcucca

SEQ ID NO: 792487 - RNA, 21 nt, Homo sapiens
cacaaaucauccuaguaauaa

SEQ ID NO: 792488 - RNA, 13 nt, Homo sapiens
cacaacacagaua

SEQ ID NO: 792489 - RNA, 17 nt, Homo sapiens
cacaacauuuacuuaac

SEQ ID NO: 792490 - RNA, 14 nt, Homo sapiens
cacaacccaaaagg

SEQ ID NO: 792491 - RNA, 16 nt, Homo sapiens
cacaacuugagaagac

SEQ ID NO: 792492 - RNA, 21 nt, Homo sapiens
cacaacuuggguucuucucag

SEQ ID NO: 792493 - RNA, 19 nt, Homo sapiens
cacaagaggaauaagaaug

SEQ ID NO: 792494 - RNA, 23 nt, Homo sapiens
cacaagaggaauaagaauggagc

SEQ ID NO: 792495 - RNA, 14 nt, Homo sapiens
cacaagagugaauu

SEQ ID NO: 792496 - RNA, 15 nt, Homo sapiens
cacaagcaacaaacc

SEQ ID NO: 792497 - RNA, 17 nt, Homo sapiens
cacaagcagagugcaca

SEQ ID NO: 792498 - RNA, 22 nt, Homo sapiens
cacaagccacaagucuuccaga

SEQ ID NO: 792499 - RNA, 21 nt, Homo sapiens
cccaggaaagguuuuccuuau

SEQ ID NO: 792500 - RNA, 17 nt, Homo sapiens
cccaggaccaagccaca

SEQ ID NO: 792501 - RNA, 15 nt, Homo sapiens
cccaggacccaucac

SEQ ID NO: 792502 - RNA, 18 nt, Homo sapiens
cccaggacccugaagggg

SEQ ID NO: 792503 - RNA, 23 nt, Homo sapiens
cccaggacccugaaggggccaug

SEQ ID NO: 792504 - RNA, 21 nt, Homo sapiens
cccaggagguggcuauggcca

SEQ ID NO: 792505 - RNA, 14 nt, Homo sapiens
cccaggaguuugag

SEQ ID NO: 792506 - RNA, 17 nt, Homo sapiens
cccaggcaaacuugcac

SEQ ID NO: 792507 - RNA, 18 nt, Homo sapiens
cccaggccagagugcagu

SEQ ID NO: 792508 - RNA, 19 nt, Homo sapiens
cccaggccgggguggagca

SEQ ID NO: 792509 - RNA, 23 nt, Homo sapiens
cccaggccuaucuggaagccacc

SEQ ID NO: 792510 - RNA, 16 nt, Homo sapiens
cccaggccucccugca

SEQ ID NO: 792511 - RNA, 21 nt, Homo sapiens
cccaggccuguacagauguau

SEQ ID NO: 792512 - RNA, 17 nt, Homo sapiens
cccaggcuggacugcaa

SEQ ID NO: 792513 - RNA, 17 nt, Homo sapiens
cccaggcuggagugcag

SEQ ID NO: 792514 - RNA, 23 nt, Homo sapiens
cccaggcuggagugcagugccac

SEQ ID NO: 792515 - RNA, 22 nt, Homo sapiens
cccaggcuggauacuaagcaca

SEQ ID NO: 792516 - RNA, 21 nt, Homo sapiens
cccagggagcccccagaggac

SEQ ID NO: 792517 - RNA, 19 nt, Homo sapiens
cccagggcuccugcacuua

SEQ ID NO: 792518 - RNA, 17 nt, Homo sapiens
cccaggggcagccacac

SEQ ID NO: 792519 - RNA, 14 nt, Homo sapiens
cccagguaccagcu

SEQ ID NO: 792520 - RNA, 17 nt, Homo sapiens
cccagguggagggcaca

SEQ ID NO: 792521 - RNA, 18 nt, Homo sapiens
cccagguuggagugcagu

SEQ ID NO: 792522 - RNA, 19 nt, Homo sapiens
cccagguuggagugcagug

SEQ ID NO: 792523 - RNA, 22 nt, Homo sapiens
cccaguaucucuucagucucua

SEQ ID NO: 792524 - RNA, 15 nt, Homo sapiens
cccaguaugaaaugg

SEQ ID NO: 792525 - RNA, 13 nt, Homo sapiens
cccagucagagau

SEQ ID NO: 792526 - RNA, 13 nt, Homo sapiens
cccaguccaugcu

SEQ ID NO: 792527 - RNA, 14 nt, Homo sapiens
cccaguccaugcuu

SEQ ID NO: 792528 - RNA, 15 nt, Homo sapiens
cccagucccauuccu

SEQ ID NO: 792529 - RNA, 17 nt, Homo sapiens
cccagugacaacaucgc

SEQ ID NO: 792530 - RNA, 11 nt, Homo sapiens
cccagugcaaa

SEQ ID NO: 792531 - RNA, 18 nt, Homo sapiens
cccagugcaugguggcca

SEQ ID NO: 792532 - RNA, 17 nt, Homo sapiens
cccagugcccccacuga

SEQ ID NO: 792533 - RNA, 20 nt, Homo sapiens
cccagugcccccacugacca

SEQ ID NO: 792534 - RNA, 22 nt, Homo sapiens
cccagugcccccacugaccaga

SEQ ID NO: 792535 - RNA, 18 nt, Homo sapiens
cccaguggacucuuccac

SEQ ID NO: 792536 - RNA, 15 nt, Homo sapiens
cccaguguccaugga

SEQ ID NO: 792537 - RNA, 20 nt, Homo sapiens
cccagugugcaagggcagug

SEQ ID NO: 792538 - RNA, 23 nt, Homo sapiens
cccaguuaaauuuucauuucaga

SEQ ID NO: 792539 - RNA, 22 nt, Homo sapiens
cccaguucacccugauuuagga

SEQ ID NO: 792540 - RNA, 19 nt, Homo sapiens
cccaguuggugacugggaa

SEQ ID NO: 792541 - RNA, 18 nt, Homo sapiens
cccauaauugcuuugcca

SEQ ID NO: 792542 - RNA, 16 nt, Homo sapiens
cccauacaauguaugu

SEQ ID NO: 792543 - RNA, 22 nt, Homo sapiens
cccauacaauguauguacaaua

SEQ ID NO: 792544 - RNA, 23 nt, Homo sapiens
cccauagaaacaugacacugacc

SEQ ID NO: 792545 - RNA, 16 nt, Homo sapiens
cccauagaaacauucu

SEQ ID NO: 792546 - RNA, 13 nt, Homo sapiens
cccauagcacugg

SEQ ID NO: 792547 - RNA, 14 nt, Homo sapiens
cccauagcacuggg

SEQ ID NO: 792548 - RNA, 23 nt, Homo sapiens
cccauaucugugaaaugcuggca

SEQ ID NO: 792549 - RNA, 17 nt, Homo sapiens
cccaucagcuccagcug

SEQ ID NO: 792550 - RNA, 21 nt, Homo sapiens
cccauccaggucuugacucau

SEQ ID NO: 792551 - RNA, 22 nt, Homo sapiens
cccaucccacacccuggaggau

SEQ ID NO: 792552 - RNA, 20 nt, Homo sapiens
cccaucgucucggccuucac

SEQ ID NO: 792553 - RNA, 22 nt, Homo sapiens
cccaucgucucggccuucacaa

SEQ ID NO: 792554 - RNA, 12 nt, Homo sapiens
cccaucuaugag

SEQ ID NO: 792555 - RNA, 13 nt, Homo sapiens
cccaucucaaaaa

SEQ ID NO: 792556 - RNA, 15 nt, Homo sapiens
cccaucucuacugaa

SEQ ID NO: 792557 - RNA, 22 nt, Homo sapiens
cccaucugugcaguaagccugu

SEQ ID NO: 792558 - RNA, 14 nt, Homo sapiens
cccaugcacuguga

SEQ ID NO: 792559 - RNA, 21 nt, Homo sapiens
cccaugcugagcucaucuggc

SEQ ID NO: 792560 - RNA, 18 nt, Homo sapiens
cccaugggggcacuugag

SEQ ID NO: 792561 - RNA, 17 nt, Homo sapiens
cccauggguuaagagcu

SEQ ID NO: 792562 - RNA, 15 nt, Homo sapiens
cccauggucaaugca

SEQ ID NO: 792563 - RNA, 18 nt, Homo sapiens
cccauggucaaugcaguu

SEQ ID NO: 792564 - RNA, 14 nt, Homo sapiens
cccaugucaccuca

SEQ ID NO: 792565 - RNA, 14 nt, Homo sapiens
cccauuccugaaga

SEQ ID NO: 792566 - RNA, 21 nt, Homo sapiens
cccauugcugccaagguggag

SEQ ID NO: 792567 - RNA, 17 nt, Homo sapiens
cccauuggugaccugcg

SEQ ID NO: 792568 - RNA, 21 nt, Homo sapiens
cccauuguuccugcgcugcaa

SEQ ID NO: 792569 - RNA, 13 nt, Homo sapiens
cccauuugggaca

SEQ ID NO: 792570 - RNA, 21 nt, Homo sapiens
cccauuuuuaaaauacauugu

SEQ ID NO: 792571 - RNA, 23 nt, Homo sapiens
ccccaacacuguccuucccugcc

SEQ ID NO: 792572 - RNA, 13 nt, Homo sapiens
ccccaacacuucc

SEQ ID NO: 792573 - RNA, 17 nt, Homo sapiens
ccccaacaugcacugau

SEQ ID NO: 792574 - RNA, 16 nt, Homo sapiens
ccccaaccugcugaag

SEQ ID NO: 792575 - RNA, 23 nt, Homo sapiens
ccccaagagaacucgcgcucagu

SEQ ID NO: 792576 - RNA, 21 nt, Homo sapiens
ccccaagguuuuggagucagu

SEQ ID NO: 792577 - RNA, 21 nt, Homo sapiens
ccccaauaguagucucuguga

SEQ ID NO: 792578 - RNA, 23 nt, Homo sapiens
ccccacaauuccauuacuaagaa

SEQ ID NO: 792579 - RNA, 22 nt, Homo sapiens
ccccacacugaccuguguuccc

SEQ ID NO: 792580 - RNA, 16 nt, Homo sapiens
ccccaccaccacuuac

SEQ ID NO: 792581 - RNA, 19 nt, Homo sapiens
ccccaccauccagguggag

SEQ ID NO: 792582 - RNA, 21 nt, Homo sapiens
ccccacugccugucccagaga

SEQ ID NO: 792583 - RNA, 19 nt, Homo sapiens
ccccagaacauacacugug

SEQ ID NO: 792584 - RNA, 14 nt, Homo sapiens
ccccagagcucuuu

SEQ ID NO: 792585 - RNA, 12 nt, Homo sapiens
ccccagcacuug

SEQ ID NO: 792586 - RNA, 13 nt, Homo sapiens
ccccagcagggaa

SEQ ID NO: 792587 - RNA, 16 nt, Homo sapiens
ccccagcucgcuggcu

SEQ ID NO: 792588 - RNA, 14 nt, Homo sapiens
ccccagcucuggau

SEQ ID NO: 792589 - RNA, 19 nt, Homo sapiens
ccccaggccuuuuccacuu

SEQ ID NO: 792590 - RNA, 23 nt, Homo sapiens
ccccaggucucuccacugcucuc

SEQ ID NO: 792591 - RNA, 12 nt, Homo sapiens
ccccagucccag

SEQ ID NO: 792592 - RNA, 14 nt, Homo sapiens
acacaggaaaccaa

SEQ ID NO: 792593 - RNA, 23 nt, Homo sapiens
acacaggaaaccaacacccaaag

SEQ ID NO: 792594 - RNA, 16 nt, Homo sapiens
acacaggcuguccuua

SEQ ID NO: 792595 - RNA, 14 nt, Homo sapiens
acacagggcacuga

SEQ ID NO: 792596 - RNA, 19 nt, Homo sapiens
acacaguugggacccaaaa

SEQ ID NO: 792597 - RNA, 17 nt, Homo sapiens
acacauaauuaacacuu

SEQ ID NO: 792598 - RNA, 22 nt, Homo sapiens
acacauagauuaauggcacuga

SEQ ID NO: 792599 - RNA, 13 nt, Homo sapiens
acacaucaaauau

SEQ ID NO: 792600 - RNA, 17 nt, Homo sapiens
acacaucaggaguucaa

SEQ ID NO: 792601 - RNA, 22 nt, Homo sapiens
acacauccccagaauccauaaa

SEQ ID NO: 792602 - RNA, 21 nt, Homo sapiens
acacauggcuuaagugacaaa

SEQ ID NO: 792603 - RNA, 15 nt, Homo sapiens
acacauuacgugcuc

SEQ ID NO: 792604 - RNA, 22 nt, Homo sapiens
acacauucaggaguuaaauauu

SEQ ID NO: 792605 - RNA, 19 nt, Homo sapiens
acacauuggaauugauguc

SEQ ID NO: 792606 - RNA, 16 nt, Homo sapiens
acaccaaaaaugaugc

SEQ ID NO: 792607 - RNA, 13 nt, Homo sapiens
acaccaaaccaaa

SEQ ID NO: 792608 - RNA, 18 nt, Homo sapiens
acaccaaauuuuucuauc

SEQ ID NO: 792609 - RNA, 22 nt, Homo sapiens
acaccaaugaaaacauguacua

SEQ ID NO: 792610 - RNA, 17 nt, Homo sapiens
acaccacuguacuccag

SEQ ID NO: 792611 - RNA, 18 nt, Homo sapiens
acaccagcagcacuggaa

SEQ ID NO: 792612 - RNA, 17 nt, Homo sapiens
acaccaggagagcuucu

SEQ ID NO: 792613 - RNA, 16 nt, Homo sapiens
acaccauagugucaca

SEQ ID NO: 792614 - RNA, 17 nt, Homo sapiens
acaccauucuccugccu

SEQ ID NO: 792615 - RNA, 20 nt, Homo sapiens
acaccauucuccugccucac

SEQ ID NO: 792616 - RNA, 14 nt, Homo sapiens
acacccaagaagaa

SEQ ID NO: 792617 - RNA, 19 nt, Homo sapiens
acacccagcccagcuugcc

SEQ ID NO: 792618 - RNA, 19 nt, Homo sapiens
acacccagucuguucccca

SEQ ID NO: 792619 - RNA, 16 nt, Homo sapiens
acacccaguugccaaa

SEQ ID NO: 792620 - RNA, 14 nt, Homo sapiens
acaccccacugagc

SEQ ID NO: 792621 - RNA, 15 nt, Homo sapiens
acaccccacugagcc

SEQ ID NO: 792622 - RNA, 12 nt, Homo sapiens
acacccuaccuu

SEQ ID NO: 792623 - RNA, 23 nt, Homo sapiens
acacccuauauuuugcauaguac

SEQ ID NO: 792624 - RNA, 14 nt, Homo sapiens
acacccuggaugcu

SEQ ID NO: 792625 - RNA, 13 nt, Homo sapiens
acacccuguacug

SEQ ID NO: 792626 - RNA, 14 nt, Homo sapiens
acaguagcauuaug

SEQ ID NO: 792627 - RNA, 23 nt, Homo sapiens
acaguaugagaagaaaaauggaa

SEQ ID NO: 792628 - RNA, 18 nt, Homo sapiens
acaguauuacaguguccu

SEQ ID NO: 792629 - RNA, 15 nt, Homo sapiens
acaguauuuugacaa

SEQ ID NO: 792630 - RNA, 15 nt, Homo sapiens
acagucaucugccac

SEQ ID NO: 792631 - RNA, 16 nt, Homo sapiens
acaguccuugggguua

SEQ ID NO: 792632 - RNA, 13 nt, Homo sapiens
acagucucaggaa

SEQ ID NO: 792633 - RNA, 20 nt, Homo sapiens
acagucucaggaaaucaaau

SEQ ID NO: 792634 - RNA, 15 nt, Homo sapiens
acagucucuggaaaa

SEQ ID NO: 792635 - RNA, 21 nt, Homo sapiens
acagugaaauacauccuucaa

SEQ ID NO: 792636 - RNA, 19 nt, Homo sapiens
acagugaagcagcacugug

SEQ ID NO: 792637 - RNA, 20 nt, Homo sapiens
acagugaagcagcacuguga

SEQ ID NO: 792638 - RNA, 22 nt, Homo sapiens
acagugaagcagcacugugagu

SEQ ID NO: 792639 - RNA, 21 nt, Homo sapiens
acagugaaguucaaaugcccu

SEQ ID NO: 792640 - RNA, 15 nt, Homo sapiens
acagugagaaaccau

SEQ ID NO: 792641 - RNA, 21 nt, Homo sapiens
acagugagacccccaucucua

SEQ ID NO: 792642 - RNA, 22 nt, Homo sapiens
acagugaucuccauauguuaca

SEQ ID NO: 792643 - RNA, 19 nt, Homo sapiens
acagugccgacagcucucc

SEQ ID NO: 792644 - RNA, 13 nt, Homo sapiens
acagugccugcau

SEQ ID NO: 792645 - RNA, 20 nt, Homo sapiens
acaguggcggcaacauugaa

SEQ ID NO: 792646 - RNA, 12 nt, Homo sapiens
acaguggcugcu

SEQ ID NO: 792647 - RNA, 18 nt, Homo sapiens
acagugggaacucugaca

SEQ ID NO: 792648 - RNA, 17 nt, Homo sapiens
acaguggugagaucaca

SEQ ID NO: 792649 - RNA, 18 nt, Homo sapiens
acaguguagaguaacaca

SEQ ID NO: 792650 - RNA, 22 nt, Homo sapiens
acaguguauguacuaagcagua

SEQ ID NO: 792651 - RNA, 20 nt, Homo sapiens
acaguguccuaccacucuaa

SEQ ID NO: 792652 - RNA, 18 nt, Homo sapiens
acagugucuugagcucua

SEQ ID NO: 792653 - RNA, 23 nt, Homo sapiens
acaguguuggagguuaaggcaua

SEQ ID NO: 792654 - RNA, 16 nt, Homo sapiens
acaguuaacuuucaga

SEQ ID NO: 792655 - RNA, 14 nt, Homo sapiens
acaguucugugguu

SEQ ID NO: 792656 - RNA, 17 nt, Homo sapiens
acaguucuuugggccag

SEQ ID NO: 792657 - RNA, 13 nt, Homo sapiens
acaguugccaugu

SEQ ID NO: 792658 - RNA, 11 nt, Homo sapiens
ccauugcaaug

SEQ ID NO: 792659 - RNA, 11 nt, Homo sapiens
ccauugcacaa

SEQ ID NO: 792660 - RNA, 13 nt, Homo sapiens
ccauugcucuuga

SEQ ID NO: 792661 - RNA, 18 nt, Homo sapiens
ccauugggacaugaaguu

SEQ ID NO: 792662 - RNA, 22 nt, Homo sapiens
ccauugucgucuuuauguccgc

SEQ ID NO: 792663 - RNA, 12 nt, Homo sapiens
ccauuguuccug

SEQ ID NO: 792664 - RNA, 20 nt, Homo sapiens
ccauuguuccugcgcugcaa

SEQ ID NO: 792665 - RNA, 21 nt, Homo sapiens
ccauuuauuauuuuguaacuu

SEQ ID NO: 792666 - RNA, 16 nt, Homo sapiens
ccauuucaaagacuca

SEQ ID NO: 792667 - RNA, 23 nt, Homo sapiens
ccauuucucucuuguuugagaga

SEQ ID NO: 792668 - RNA, 12 nt, Homo sapiens
ccauuugaagca

SEQ ID NO: 792669 - RNA, 14 nt, Homo sapiens
ccauuugacuguuc

SEQ ID NO: 792670 - RNA, 17 nt, Homo sapiens
ccauuugacuguucaau

SEQ ID NO: 792671 - RNA, 15 nt, Homo sapiens
ccauuugcucuucag

SEQ ID NO: 792672 - RNA, 13 nt, Homo sapiens
ccauuuguuccug

SEQ ID NO: 792673 - RNA, 19 nt, Homo sapiens
ccauuuuggaaguuuucag

SEQ ID NO: 792674 - RNA, 18 nt, Homo sapiens
ccauuuuucuagacuguc

SEQ ID NO: 792675 - RNA, 22 nt, Homo sapiens
cccaaaacugauacccuuugaa

SEQ ID NO: 792676 - RNA, 15 nt, Homo sapiens
cccaaacaccaguca

SEQ ID NO: 792677 - RNA, 20 nt, Homo sapiens
cccaaagcucagacuugcca

SEQ ID NO: 792678 - RNA, 22 nt, Homo sapiens
cccaaaucuuguuuacaaaaua

SEQ ID NO: 792679 - RNA, 20 nt, Homo sapiens
cccaaauuucauaccuauca

SEQ ID NO: 792680 - RNA, 13 nt, Homo sapiens
cccaacagcacuu

SEQ ID NO: 792681 - RNA, 17 nt, Homo sapiens
cccaacaucgaaugugu

SEQ ID NO: 792682 - RNA, 16 nt, Homo sapiens
cccaaccccaguggau

SEQ ID NO: 792683 - RNA, 23 nt, Homo sapiens
cccaaccucaaugcccugccauu

SEQ ID NO: 792684 - RNA, 21 nt, Homo sapiens
cccaaccuucuugucauugaa

SEQ ID NO: 792685 - RNA, 16 nt, Homo sapiens
cccaacgcacaggaaa

SEQ ID NO: 792686 - RNA, 17 nt, Homo sapiens
cccaacgugcaaagcca

SEQ ID NO: 792687 - RNA, 22 nt, Homo sapiens
cccaacugggggcaaagguuug

SEQ ID NO: 792688 - RNA, 15 nt, Homo sapiens
cccaagaagaugaaa

SEQ ID NO: 792689 - RNA, 22 nt, Homo sapiens
cccaagagauuguuguuugcca

SEQ ID NO: 792690 - RNA, 22 nt, Homo sapiens
cccaagaggacugagacuggca

SEQ ID NO: 792691 - RNA, 22 nt, Homo sapiens
cccaagccugauacuuuagcca

SEQ ID NO: 792692 - RNA, 16 nt, Homo sapiens
cccaagcuguggcagc

SEQ ID NO: 792693 - RNA, 18 nt, Homo sapiens
cccaaggcucaugguccu

SEQ ID NO: 792694 - RNA, 19 nt, Homo sapiens
cccaagggacagcaaguga

SEQ ID NO: 792695 - RNA, 16 nt, Homo sapiens
cccaagggcccagacc

SEQ ID NO: 792696 - RNA, 13 nt, Homo sapiens
cccaauaauugca

SEQ ID NO: 792697 - RNA, 16 nt, Homo sapiens
cccaauaggugaucuu

SEQ ID NO: 792698 - RNA, 22 nt, Homo sapiens
cccaaucucugccauaucagug

SEQ ID NO: 792699 - RNA, 18 nt, Homo sapiens
cccaauuaagaaauucca

SEQ ID NO: 792700 - RNA, 14 nt, Homo sapiens
cccacacacaaaga

SEQ ID NO: 792701 - RNA, 17 nt, Homo sapiens
cccacacacacuggccu

SEQ ID NO: 792702 - RNA, 22 nt, Homo sapiens
cccacacugaccuguguucccu

SEQ ID NO: 792703 - RNA, 17 nt, Homo sapiens
cccacacuggagccauc

SEQ ID NO: 792704 - RNA, 15 nt, Homo sapiens
cccacagaaccuuca

SEQ ID NO: 792705 - RNA, 17 nt, Homo sapiens
cccacagaacugcuuac

SEQ ID NO: 792706 - RNA, 19 nt, Homo sapiens
cccacaguucagaccaaug

SEQ ID NO: 792707 - RNA, 19 nt, Homo sapiens
cccacaugcuccagauuag

SEQ ID NO: 792708 - RNA, 19 nt, Homo sapiens
cccacauguccagcaccuu

SEQ ID NO: 792709 - RNA, 22 nt, Homo sapiens
cccacauuugggcucaggguug

SEQ ID NO: 792710 - RNA, 20 nt, Homo sapiens
cccaccagagugaugugugg

SEQ ID NO: 792711 - RNA, 19 nt, Homo sapiens
cccaccagcaauacaaaga

SEQ ID NO: 792712 - RNA, 11 nt, Homo sapiens
cccaccagcuc

SEQ ID NO: 792713 - RNA, 14 nt, Homo sapiens
cccaccagugccuu

SEQ ID NO: 792714 - RNA, 17 nt, Homo sapiens
cccacccaacaagccau

SEQ ID NO: 792715 - RNA, 14 nt, Homo sapiens
cccacccacaugug

SEQ ID NO: 792716 - RNA, 13 nt, Homo sapiens
cccaccccaucca

SEQ ID NO: 792717 - RNA, 15 nt, Homo sapiens
cccaccgguccagcu

SEQ ID NO: 792718 - RNA, 16 nt, Homo sapiens
cccaccuacugcacuu

SEQ ID NO: 792719 - RNA, 16 nt, Homo sapiens
cccaccugcauugcuc

SEQ ID NO: 792720 - RNA, 14 nt, Homo sapiens
cccaccuggccacc

SEQ ID NO: 792721 - RNA, 15 nt, Homo sapiens
cccaccugguacuga

SEQ ID NO: 792722 - RNA, 18 nt, Homo sapiens
cccacgagaccccggcuu

SEQ ID NO: 792723 - RNA, 12 nt, Homo sapiens
cccacggcaccu

SEQ ID NO: 792724 - RNA, 12 nt, Homo sapiens
cccacuacugua

SEQ ID NO: 792725 - RNA, 13 nt, Homo sapiens
cccacugccagca

SEQ ID NO: 792726 - RNA, 13 nt, Homo sapiens
cccacuucccacc

SEQ ID NO: 792727 - RNA, 17 nt, Homo sapiens
cccacuucugugccacc

SEQ ID NO: 792728 - RNA, 10 nt, Homo sapiens
cccacuuuga

SEQ ID NO: 792729 - RNA, 12 nt, Homo sapiens
cccacuuugaag

SEQ ID NO: 792730 - RNA, 23 nt, Homo sapiens
cccagaaggcagagguugcagug

SEQ ID NO: 792731 - RNA, 18 nt, Homo sapiens
cccagaaugccuccugca

SEQ ID NO: 792732 - RNA, 21 nt, Homo sapiens
cccagacaccaugugcaauaa

SEQ ID NO: 792733 - RNA, 23 nt, Homo sapiens
cccagacacuggcguuacugcuu

SEQ ID NO: 792734 - RNA, 12 nt, Homo sapiens
cccagacagcuc

SEQ ID NO: 792735 - RNA, 17 nt, Homo sapiens
cccagacuagauguagu

SEQ ID NO: 792736 - RNA, 24 nt, Homo sapiens
cccagacucuuuuuuugagugaca

SEQ ID NO: 792737 - RNA, 20 nt, Homo sapiens
cccagagaagcaaguggcuu

SEQ ID NO: 792738 - RNA, 18 nt, Homo sapiens
cccagagacauacuugaa

SEQ ID NO: 792739 - RNA, 18 nt, Homo sapiens
cccagagcaaaauaauuu

SEQ ID NO: 792740 - RNA, 18 nt, Homo sapiens
cccagagcugugccagca

SEQ ID NO: 792741 - RNA, 19 nt, Homo sapiens
cccagaggcucccaaucag

SEQ ID NO: 792742 - RNA, 16 nt, Homo sapiens
cccagagucaucugau

SEQ ID NO: 792743 - RNA, 14 nt, Homo sapiens
cccagaguggccca

SEQ ID NO: 792744 - RNA, 16 nt, Homo sapiens
cccagauacaugguga

SEQ ID NO: 792745 - RNA, 12 nt, Homo sapiens
cccagaucucau

SEQ ID NO: 792746 - RNA, 15 nt, Homo sapiens
cccagaucugguccc

SEQ ID NO: 792747 - RNA, 19 nt, Homo sapiens
cccagaugaucccagucac

SEQ ID NO: 792748 - RNA, 20 nt, Homo sapiens
cccagauucuucagcuugau

SEQ ID NO: 792749 - RNA, 24 nt, Homo sapiens
cccagcaaaggggagucucagcuu

SEQ ID NO: 792750 - RNA, 13 nt, Homo sapiens
cccagcacugagg

SEQ ID NO: 792751 - RNA, 13 nt, Homo sapiens
aacuuuugugcuc

SEQ ID NO: 792752 - RNA, 17 nt, Homo sapiens
aacuuuuuguuacagau

SEQ ID NO: 792753 - RNA, 18 nt, Homo sapiens
aacuuuuuuuucucucuu

SEQ ID NO: 792754 - RNA, 23 nt, Homo sapiens
aagaaaaagggcugccgggccag

SEQ ID NO: 792755 - RNA, 15 nt, Homo sapiens
aagaaaaggauuuaa

SEQ ID NO: 792756 - RNA, 16 nt, Homo sapiens
aagaaaauggauuuaa

SEQ ID NO: 792757 - RNA, 13 nt, Homo sapiens
aagaaacccaagu

SEQ ID NO: 792758 - RNA, 22 nt, Homo sapiens
aagaaacgucuauguguacaga

SEQ ID NO: 792759 - RNA, 14 nt, Homo sapiens
aagaaacuuauuuc

SEQ ID NO: 792760 - RNA, 14 nt, Homo sapiens
aagaaagacuaucu

SEQ ID NO: 792761 - RNA, 14 nt, Homo sapiens
aagaaagcugagaa

SEQ ID NO: 792762 - RNA, 17 nt, Homo sapiens
aagaaaguguuggcuaa

SEQ ID NO: 792763 - RNA, 23 nt, Homo sapiens
aagaaaucauuuagugacuuaau

SEQ ID NO: 792764 - RNA, 17 nt, Homo sapiens
aagaaaucccugagaca

SEQ ID NO: 792765 - RNA, 19 nt, Homo sapiens
aagaaaucuuucucccuca

SEQ ID NO: 792766 - RNA, 12 nt, Homo sapiens
aagaaaugaaua

SEQ ID NO: 792767 - RNA, 11 nt, Homo sapiens
aagaaaugcaa

SEQ ID NO: 792768 - RNA, 14 nt, Homo sapiens
aagaaaugcccaaa

SEQ ID NO: 792769 - RNA, 14 nt, Homo sapiens
aagaaauucuguca

SEQ ID NO: 792770 - RNA, 12 nt, Homo sapiens
aagaaauuggaa

SEQ ID NO: 792771 - RNA, 11 nt, Homo sapiens
aagaacacagg

SEQ ID NO: 792772 - RNA, 17 nt, Homo sapiens
aagaacaguaacugcca

SEQ ID NO: 792773 - RNA, 17 nt, Homo sapiens
aagaaccaaauaccuca

SEQ ID NO: 792774 - RNA, 16 nt, Homo sapiens
aagaaccacagcacuu

SEQ ID NO: 792775 - RNA, 12 nt, Homo sapiens
aagaaccagaga

SEQ ID NO: 792776 - RNA, 21 nt, Homo sapiens
aagaacccaagugccucaccu

SEQ ID NO: 792777 - RNA, 13 nt, Homo sapiens
aagaaccuugccu

SEQ ID NO: 792778 - RNA, 20 nt, Homo sapiens
aagaacgagaagcagcauuu

SEQ ID NO: 792779 - RNA, 23 nt, Homo sapiens
aagaacuggaaccccagcuuccc

SEQ ID NO: 792780 - RNA, 17 nt, Homo sapiens
aagaacuguacauugug

SEQ ID NO: 792781 - RNA, 20 nt, Homo sapiens
aagaacuugcaauaccaaug

SEQ ID NO: 792782 - RNA, 23 nt, Homo sapiens
aagaacuugggauaagaguguga

SEQ ID NO: 792783 - RNA, 22 nt, Homo sapiens
aagaagacaccucuaaucugga

SEQ ID NO: 792784 - RNA, 16 nt, Homo sapiens
aagaagacauggagac

SEQ ID NO: 792785 - RNA, 12 nt, Homo sapiens
aagaagacauuu

SEQ ID NO: 792786 - RNA, 18 nt, Homo sapiens
aagaagaguuuacagaca

SEQ ID NO: 792787 - RNA, 14 nt, Homo sapiens
aagaagaugagccu

SEQ ID NO: 792788 - RNA, 22 nt, Homo sapiens
aagaagauggcaaaaucaucuu

SEQ ID NO: 792789 - RNA, 17 nt, Homo sapiens
aagaagauguccgugag

SEQ ID NO: 792790 - RNA, 17 nt, Homo sapiens
aagaagcccauaucaca

SEQ ID NO: 792791 - RNA, 16 nt, Homo sapiens
aagaagcccuggccaa

SEQ ID NO: 792792 - RNA, 15 nt, Homo sapiens
aagaagcugugaaua

SEQ ID NO: 792793 - RNA, 13 nt, Homo sapiens
aagaaggaacaau

SEQ ID NO: 792794 - RNA, 13 nt, Homo sapiens
aagaaggcauuug

SEQ ID NO: 792795 - RNA, 13 nt, Homo sapiens
aagaagggcugca

SEQ ID NO: 792796 - RNA, 22 nt, Homo sapiens
aagaagguuggugaauuucaca

SEQ ID NO: 792797 - RNA, 18 nt, Homo sapiens
aagaagucggaaugucau

SEQ ID NO: 792798 - RNA, 21 nt, Homo sapiens
aagaaguuaaaaaacagcugc

SEQ ID NO: 792799 - RNA, 12 nt, Homo sapiens
acaaaugcaggg

SEQ ID NO: 792800 - RNA, 20 nt, Homo sapiens
acaaaugggacugaugucau

SEQ ID NO: 792801 - RNA, 17 nt, Homo sapiens
acaaauuaauuuuacuc

SEQ ID NO: 792802 - RNA, 17 nt, Homo sapiens
acaaauuauguuacauc

SEQ ID NO: 792803 - RNA, 13 nt, Homo sapiens
acaaauuccacag

SEQ ID NO: 792804 - RNA, 15 nt, Homo sapiens
acaacaacaaaaaac

SEQ ID NO: 792805 - RNA, 23 nt, Homo sapiens
acaacagcaaaacuccaucucaa

SEQ ID NO: 792806 - RNA, 20 nt, Homo sapiens
acaacagguaaaacagggcc

SEQ ID NO: 792807 - RNA, 13 nt, Homo sapiens
acaacagugaaaa

SEQ ID NO: 792808 - RNA, 14 nt, Homo sapiens
acaacagugagaaa

SEQ ID NO: 792809 - RNA, 19 nt, Homo sapiens
acaacaguucugagcugua

SEQ ID NO: 792810 - RNA, 22 nt, Homo sapiens
acaacauaaucuaguuuacaga

SEQ ID NO: 792811 - RNA, 19 nt, Homo sapiens
acaacauccuuaagucaaa

SEQ ID NO: 792812 - RNA, 14 nt, Homo sapiens
acaacaucgcaaua

SEQ ID NO: 792813 - RNA, 10 nt, Homo sapiens
acaacauguu

SEQ ID NO: 792814 - RNA, 13 nt, Homo sapiens
acaacauguucua

SEQ ID NO: 792815 - RNA, 22 nt, Homo sapiens
acaacauuucucaaaugcacau

SEQ ID NO: 792816 - RNA, 16 nt, Homo sapiens
acaaccaaaaaauucu

SEQ ID NO: 792817 - RNA, 22 nt, Homo sapiens
acaaccaacggccgacugccug

SEQ ID NO: 792818 - RNA, 19 nt, Homo sapiens
acaaccaauuccaaguuuu

SEQ ID NO: 792819 - RNA, 22 nt, Homo sapiens
acaaccugaaauuuauucacau

SEQ ID NO: 792820 - RNA, 22 nt, Homo sapiens
acaacgccugucacagaguaga

SEQ ID NO: 792821 - RNA, 13 nt, Homo sapiens
acaacuaccuccu

SEQ ID NO: 792822 - RNA, 15 nt, Homo sapiens
acaacuaccuccuca

SEQ ID NO: 792823 - RNA, 16 nt, Homo sapiens
acaacucaaugaaaau

SEQ ID NO: 792824 - RNA, 22 nt, Homo sapiens
acaacuccugucuaacugcugu

SEQ ID NO: 792825 - RNA, 14 nt, Homo sapiens
acaacugauugcaa

SEQ ID NO: 792826 - RNA, 13 nt, Homo sapiens
acaacugugacug

SEQ ID NO: 792827 - RNA, 13 nt, Homo sapiens
acaacuuagcuca

SEQ ID NO: 792828 - RNA, 21 nt, Homo sapiens
acaacuucaguccaacuguca

SEQ ID NO: 792829 - RNA, 23 nt, Homo sapiens
acaagaaaaguugaagaagauau

SEQ ID NO: 792830 - RNA, 16 nt, Homo sapiens
acaagaaacagccacu

SEQ ID NO: 792831 - RNA, 18 nt, Homo sapiens
acaagaauguaacuccag

SEQ ID NO: 792832 - RNA, 18 nt, Homo sapiens
acaagaccccgucucaaa

SEQ ID NO: 792833 - RNA, 17 nt, Homo sapiens
acaagacuggcagucca

SEQ ID NO: 792834 - RNA, 16 nt, Homo sapiens
aacucaccacaguguu

SEQ ID NO: 792835 - RNA, 17 nt, Homo sapiens
aacucaccagauuuacu

SEQ ID NO: 792836 - RNA, 21 nt, Homo sapiens
aacucacuccacuguacccag

SEQ ID NO: 792837 - RNA, 20 nt, Homo sapiens
aacucagcgugaguuacccu

SEQ ID NO: 792838 - RNA, 18 nt, Homo sapiens
aacucauaauuuuugcag

SEQ ID NO: 792839 - RNA, 20 nt, Homo sapiens
aacucauaauuuuugcagaa

SEQ ID NO: 792840 - RNA, 21 nt, Homo sapiens
aacucaucugcugguaccuau

SEQ ID NO: 792841 - RNA, 19 nt, Homo sapiens
aacucaugucuuucucaga

SEQ ID NO: 792842 - RNA, 17 nt, Homo sapiens
aacuccaucucuacuga

SEQ ID NO: 792843 - RNA, 22 nt, Homo sapiens
aacuccugauuuuguaguuaau

SEQ ID NO: 792844 - RNA, 15 nt, Homo sapiens
aacuccuggccucaa

SEQ ID NO: 792845 - RNA, 24 nt, Homo sapiens
aacucgcgaguguaacuuucauac

SEQ ID NO: 792846 - RNA, 17 nt, Homo sapiens
aacucuacucaacccau

SEQ ID NO: 792847 - RNA, 20 nt, Homo sapiens
aacucuccccuuucuuugca

SEQ ID NO: 792848 - RNA, 21 nt, Homo sapiens
aacucucugguuuacuucaaa

SEQ ID NO: 792849 - RNA, 22 nt, Homo sapiens
aacucugacaagggcugaccug

SEQ ID NO: 792850 - RNA, 15 nt, Homo sapiens
aacucugcacuacuc

SEQ ID NO: 792851 - RNA, 16 nt, Homo sapiens
aacucugcacuacucc

SEQ ID NO: 792852 - RNA, 16 nt, Homo sapiens
aacucugccagccaca

SEQ ID NO: 792853 - RNA, 18 nt, Homo sapiens
aacucugcccaggugugc

SEQ ID NO: 792854 - RNA, 21 nt, Homo sapiens
aacucugccugagacuuucag

SEQ ID NO: 792855 - RNA, 17 nt, Homo sapiens
aacucugggcugccaug

SEQ ID NO: 792856 - RNA, 16 nt, Homo sapiens
aacugaaaauggaccu

SEQ ID NO: 792857 - RNA, 19 nt, Homo sapiens
aacugaaacucacaguaau

SEQ ID NO: 792858 - RNA, 18 nt, Homo sapiens
aacugaaagcacaugaau

SEQ ID NO: 792859 - RNA, 14 nt, Homo sapiens
aacugaagccagaa

SEQ ID NO: 792860 - RNA, 22 nt, Homo sapiens
aacugaaugcuccagucaacaa

SEQ ID NO: 792861 - RNA, 20 nt, Homo sapiens
aacugaauuuugggacuucu

SEQ ID NO: 792862 - RNA, 10 nt, Homo sapiens
aacugacaca

SEQ ID NO: 792863 - RNA, 16 nt, Homo sapiens
aacugagaccaaagaa

SEQ ID NO: 792864 - RNA, 16 nt, Homo sapiens
aacugauaaaccaaaa

SEQ ID NO: 792865 - RNA, 13 nt, Homo sapiens
aacugaugaagga

SEQ ID NO: 792866 - RNA, 17 nt, Homo sapiens
aacugcaccaacgagcu

SEQ ID NO: 792867 - RNA, 22 nt, Homo sapiens
aacugcauucuucugagcacug

SEQ ID NO: 792868 - RNA, 12 nt, Homo sapiens
aacugccagcaa

SEQ ID NO: 792869 - RNA, 21 nt, Homo sapiens
aacugccuuggcuucagggga

SEQ ID NO: 792870 - RNA, 21 nt, Homo sapiens
aacuggaaaacagaacacuua

SEQ ID NO: 792871 - RNA, 17 nt, Homo sapiens
aacuggaagaaagcaac

SEQ ID NO: 792872 - RNA, 19 nt, Homo sapiens
aacuggaauaaguguuuau

SEQ ID NO: 792873 - RNA, 20 nt, Homo sapiens
aacuggaggaguuccuugau

SEQ ID NO: 792874 - RNA, 21 nt, Homo sapiens
aacuggaggaguuccuugauc

SEQ ID NO: 792875 - RNA, 16 nt, Homo sapiens
aacuggauagaaccac

SEQ ID NO: 792876 - RNA, 20 nt, Homo sapiens
aacuggauugcagacuguuc

SEQ ID NO: 792877 - RNA, 14 nt, Homo sapiens
aacuggcaguuuuc

SEQ ID NO: 792878 - RNA, 17 nt, Homo sapiens
aacuggcaguuuuccau

SEQ ID NO: 792879 - RNA, 14 nt, Homo sapiens
aacuggcaucugac

SEQ ID NO: 792880 - RNA, 21 nt, Homo sapiens
aacugggggcucuguauauag

SEQ ID NO: 792881 - RNA, 21 nt, Homo sapiens
aacuggguuaaauauuuugcu

SEQ ID NO: 792882 - RNA, 15 nt, Homo sapiens
aacuguacuguguuu

SEQ ID NO: 792883 - RNA, 16 nt, Homo sapiens
aacuguagucucagga

SEQ ID NO: 792884 - RNA, 17 nt, Homo sapiens
aacuguauauauuccca

SEQ ID NO: 792885 - RNA, 13 nt, Homo sapiens
aacugucaaccua

SEQ ID NO: 792886 - RNA, 15 nt, Homo sapiens
aacugucuuccucaa

SEQ ID NO: 792887 - RNA, 20 nt, Homo sapiens
aacugugaauacuugaacuc

SEQ ID NO: 792888 - RNA, 11 nt, Homo sapiens
aacugugauaa

SEQ ID NO: 792889 - RNA, 15 nt, Homo sapiens
aacugugcaaggccu

SEQ ID NO: 792890 - RNA, 15 nt, Homo sapiens
aacuguggucaaucc

SEQ ID NO: 792891 - RNA, 15 nt, Homo sapiens
aacuguuaccaguug

SEQ ID NO: 792892 - RNA, 16 nt, Homo sapiens
aacuguuucccugcug

SEQ ID NO: 792893 - RNA, 23 nt, Homo sapiens
aacuguuucccuuugauucucca

SEQ ID NO: 792894 - RNA, 22 nt, Homo sapiens
aacuuaagcugggauaaucaca

SEQ ID NO: 792895 - RNA, 22 nt, Homo sapiens
aacuuaagggaaaaguucuccu

SEQ ID NO: 792896 - RNA, 20 nt, Homo sapiens
aacuuagaucaucagucacc

SEQ ID NO: 792897 - RNA, 17 nt, Homo sapiens
aacuuauaggugaauga

SEQ ID NO: 792898 - RNA, 17 nt, Homo sapiens
aacuuauggaaagccca

SEQ ID NO: 792899 - RNA, 17 nt, Homo sapiens
aacuuauuuugcuuuaa

SEQ ID NO: 792900 - RNA, 12 nt, Homo sapiens
aacuucaaagag

SEQ ID NO: 792901 - RNA, 13 nt, Homo sapiens
aacuucaaagagg

SEQ ID NO: 792902 - RNA, 15 nt, Homo sapiens
aacuucaaagaggaa

SEQ ID NO: 792903 - RNA, 21 nt, Homo sapiens
aacuucaagggacaaguauua

SEQ ID NO: 792904 - RNA, 20 nt, Homo sapiens
aacuucacagugacacugga

SEQ ID NO: 792905 - RNA, 21 nt, Homo sapiens
aacuucaccuacauuaucuca

SEQ ID NO: 792906 - RNA, 20 nt, Homo sapiens
aacuucaguccaacugucaa

SEQ ID NO: 792907 - RNA, 21 nt, Homo sapiens
aacuuccacaagagugaauuu

SEQ ID NO: 792908 - RNA, 10 nt, Homo sapiens
aacuucccag

SEQ ID NO: 792909 - RNA, 16 nt, Homo sapiens
aacuucccagugaauu

SEQ ID NO: 792910 - RNA, 12 nt, Homo sapiens
aacuucugccuc

SEQ ID NO: 792911 - RNA, 16 nt, Homo sapiens
aacuucuuccugugaa

SEQ ID NO: 792912 - RNA, 17 nt, Homo sapiens
aacuucuuccugugaag

SEQ ID NO: 792913 - RNA, 18 nt, Homo sapiens
aacuucuugcuucuuucu

SEQ ID NO: 792914 - RNA, 18 nt, Homo sapiens
aacuucuuuuaaaccuca

SEQ ID NO: 792915 - RNA, 15 nt, Homo sapiens
aacuugaaacagauu

SEQ ID NO: 792916 - RNA, 20 nt, Homo sapiens
aacuugaauuucuggaagau

SEQ ID NO: 792917 - RNA, 20 nt, Homo sapiens
aacuugauguguuaucucuu

SEQ ID NO: 792918 - RNA, 14 nt, Homo sapiens
aacuugcaauacca

SEQ ID NO: 792919 - RNA, 15 nt, Homo sapiens
aacuugcaauaccaa

SEQ ID NO: 792920 - RNA, 20 nt, Homo sapiens
aacuugcaauaccaauguuc

SEQ ID NO: 792921 - RNA, 20 nt, Homo sapiens
aacuugcacgacgccugcca

SEQ ID NO: 792922 - RNA, 22 nt, Homo sapiens
aacuugcagaauugagagugau

SEQ ID NO: 792923 - RNA, 15 nt, Homo sapiens
aacuugcugcugagu

SEQ ID NO: 792924 - RNA, 20 nt, Homo sapiens
aacuugcugugucugaggua

SEQ ID NO: 792925 - RNA, 22 nt, Homo sapiens
aacuuggcugcauuugccuguc

SEQ ID NO: 792926 - RNA, 20 nt, Homo sapiens
aacuugggauaagaguguga

SEQ ID NO: 792927 - RNA, 15 nt, Homo sapiens
aacuuguauuuccaa

SEQ ID NO: 792928 - RNA, 14 nt, Homo sapiens
aacuuguccugacu

SEQ ID NO: 792929 - RNA, 17 nt, Homo sapiens
aacuuguguacugauaa

SEQ ID NO: 792930 - RNA, 22 nt, Homo sapiens
aacuuguuugguaguuagccau

SEQ ID NO: 792931 - RNA, 14 nt, Homo sapiens
aacuuuaagucuca

SEQ ID NO: 792932 - RNA, 15 nt, Homo sapiens
aacuuuaaugaacua

SEQ ID NO: 792933 - RNA, 16 nt, Homo sapiens
aacuuuauaaauccag

SEQ ID NO: 792934 - RNA, 14 nt, Homo sapiens
aacuuuauacccag

SEQ ID NO: 792935 - RNA, 14 nt, Homo sapiens
aacuuuaucacuua

SEQ ID NO: 792936 - RNA, 21 nt, Homo sapiens
aacuuucaaaauauauuuuca

SEQ ID NO: 792937 - RNA, 22 nt, Homo sapiens
aacuuuccucgccugacaacca

SEQ ID NO: 792938 - RNA, 23 nt, Homo sapiens
aacuuugacaaccaugagaccac

SEQ ID NO: 792939 - RNA, 23 nt, Homo sapiens
aacuuugccaaauauaaucucac

SEQ ID NO: 792940 - RNA, 20 nt, Homo sapiens
aacuuuggaguccccucacc

SEQ ID NO: 792941 - RNA, 16 nt, Homo sapiens
aacuuuggguacuuau

SEQ ID NO: 792942 - RNA, 19 nt, Homo sapiens
aacuuuggugaacaguuuu

SEQ ID NO: 792943 - RNA, 13 nt, Homo sapiens
aacuuuguauuaa

SEQ ID NO: 792944 - RNA, 12 nt, Homo sapiens
aacuuuuaucua

SEQ ID NO: 792945 - RNA, 21 nt, Homo sapiens
aacuuuucaccaaugagccuu

SEQ ID NO: 792946 - RNA, 21 nt, Homo sapiens
aacuuuuccuuucauacgucu

SEQ ID NO: 792947 - RNA, 18 nt, Homo sapiens
aacuuuucugcugauaag

SEQ ID NO: 792948 - RNA, 16 nt, Homo sapiens
aggagcagcugugcug

SEQ ID NO: 792949 - RNA, 21 nt, Homo sapiens
aggagcauaugauugcuccag

SEQ ID NO: 792950 - RNA, 16 nt, Homo sapiens
aggagcccagccagaa

SEQ ID NO: 792951 - RNA, 14 nt, Homo sapiens
aggagcccuucuau

SEQ ID NO: 792952 - RNA, 21 nt, Homo sapiens
aggagccuacuucuagcugua

SEQ ID NO: 792953 - RNA, 19 nt, Homo sapiens
aggagccuugcugggccag

SEQ ID NO: 792954 - RNA, 13 nt, Homo sapiens
aggagcucaagaa

SEQ ID NO: 792955 - RNA, 22 nt, Homo sapiens
aggagcucaagaacgagaagca

SEQ ID NO: 792956 - RNA, 15 nt, Homo sapiens
aggagcucugcgcca

SEQ ID NO: 792957 - RNA, 21 nt, Homo sapiens
aggagcugcuggcuugcagug

SEQ ID NO: 792958 - RNA, 15 nt, Homo sapiens
aggagcuggacaccu

SEQ ID NO: 792959 - RNA, 15 nt, Homo sapiens
aggagcuggaggggu

SEQ ID NO: 792960 - RNA, 13 nt, Homo sapiens
aggagcuguuacu

SEQ ID NO: 792961 - RNA, 18 nt, Homo sapiens
aggagcuucuuguuuccu

SEQ ID NO: 792962 - RNA, 20 nt, Homo sapiens
aggagcuugggugugcugac

SEQ ID NO: 792963 - RNA, 18 nt, Homo sapiens
aggagcuuuggaccuaau

SEQ ID NO: 792964 - RNA, 21 nt, Homo sapiens
aggaggacgguuaacuuguau

SEQ ID NO: 792965 - RNA, 19 nt, Homo sapiens
aggaggcugcaugcucugg

SEQ ID NO: 792966 - RNA, 17 nt, Homo sapiens
aggagggagcugcucag

SEQ ID NO: 792967 - RNA, 22 nt, Homo sapiens
aggagggaugcugccugaguca

SEQ ID NO: 792968 - RNA, 23 nt, Homo sapiens
aggagggccagcgcuguggaccu

SEQ ID NO: 792969 - RNA, 20 nt, Homo sapiens
aggaggucaaggcuucagug

SEQ ID NO: 792970 - RNA, 17 nt, Homo sapiens
aggagucggagaagcug

SEQ ID NO: 792971 - RNA, 22 nt, Homo sapiens
aggagugggaaaacacugccau

SEQ ID NO: 792972 - RNA, 15 nt, Homo sapiens
aggagugguucucau

SEQ ID NO: 792973 - RNA, 18 nt, Homo sapiens
aggagugugaccacugaa

SEQ ID NO: 792974 - RNA, 22 nt, Homo sapiens
aggaguucucaucccucuguca

SEQ ID NO: 792975 - RNA, 18 nt, Homo sapiens
aggaguuuauuacaaugu

SEQ ID NO: 792976 - RNA, 13 nt, Homo sapiens
aggauaagccacu

SEQ ID NO: 792977 - RNA, 14 nt, Homo sapiens
aggauagaugcugg

SEQ ID NO: 792978 - RNA, 13 nt, Homo sapiens
aggauaugcagua

SEQ ID NO: 792979 - RNA, 21 nt, Homo sapiens
aggauauuaaauguugcuuua

SEQ ID NO: 792980 - RNA, 15 nt, Homo sapiens
aggauauuaacaaca

SEQ ID NO: 792981 - RNA, 19 nt, Homo sapiens
aggauauuaacaacaauaa

SEQ ID NO: 792982 - RNA, 14 nt, Homo sapiens
aggauauugcuaau

SEQ ID NO: 792983 - RNA, 17 nt, Homo sapiens
aggauauuuucuuccaa

SEQ ID NO: 792984 - RNA, 17 nt, Homo sapiens
aggaucauuugagccca

SEQ ID NO: 792985 - RNA, 17 nt, Homo sapiens
aggauccaagcuaagca

SEQ ID NO: 792986 - RNA, 22 nt, Homo sapiens
aggaucuaagggaagaucacug

SEQ ID NO: 792987 - RNA, 17 nt, Homo sapiens
aggaucucaaacuugau

SEQ ID NO: 792988 - RNA, 23 nt, Homo sapiens
aggaugaaucauauucauaugca

SEQ ID NO: 792989 - RNA, 14 nt, Homo sapiens
aggaugcacaguca

SEQ ID NO: 792990 - RNA, 22 nt, Homo sapiens
aggauggagagcagccagcacc

SEQ ID NO: 792991 - RNA, 17 nt, Homo sapiens
aggauggcaaguugcau

SEQ ID NO: 792992 - RNA, 19 nt, Homo sapiens
aggauggcuugaggccaga

SEQ ID NO: 792993 - RNA, 14 nt, Homo sapiens
aggauguaagccug

SEQ ID NO: 792994 - RNA, 12 nt, Homo sapiens
aggaugugauga

SEQ ID NO: 792995 - RNA, 13 nt, Homo sapiens
aggauguggagcu

SEQ ID NO: 792996 - RNA, 11 nt, Homo sapiens
aggauguugcc

SEQ ID NO: 792997 - RNA, 23 nt, Homo sapiens
aggauguugccacuggcaaaugu

SEQ ID NO: 792998 - RNA, 21 nt, Homo sapiens
aggauucagggaauauuccag

SEQ ID NO: 792999 - RNA, 21 nt, Homo sapiens
aggauuccaaaaacauuuuau

SEQ ID NO: 793000 - RNA, 22 nt, Homo sapiens
aggauucccuucugggcuucau

SEQ ID NO: 793001 - RNA, 15 nt, Homo sapiens
aggauuucaugauuu

SEQ ID NO: 793002 - RNA, 21 nt, Homo sapiens
aggauuuucacauucuuggcu

SEQ ID NO: 793003 - RNA, 17 nt, Homo sapiens
aggauuuuuauugauug

SEQ ID NO: 793004 - RNA, 13 nt, Homo sapiens
aggcaaaaagaca

SEQ ID NO: 793005 - RNA, 19 nt, Homo sapiens
aggcaaagugcugcuggaa

SEQ ID NO: 793006 - RNA, 13 nt, Homo sapiens
aggcaaaguggaa

SEQ ID NO: 793007 - RNA, 16 nt, Homo sapiens
aggcaaauauaagcug

SEQ ID NO: 793008 - RNA, 14 nt, Homo sapiens
aggcaaauguguac

SEQ ID NO: 793009 - RNA, 14 nt, Homo sapiens
cuuggcugacauga

SEQ ID NO: 793010 - RNA, 17 nt, Homo sapiens
cuuggcugcaggcaaca

SEQ ID NO: 793011 - RNA, 22 nt, Homo sapiens
cuuggcugcauuugccugucau

SEQ ID NO: 793012 - RNA, 22 nt, Homo sapiens
cuuggcuuacugcagccuuugc

SEQ ID NO: 793013 - RNA, 19 nt, Homo sapiens
cuuggcuuauccacuuuga

SEQ ID NO: 793014 - RNA, 17 nt, Homo sapiens
cuuggcuucugugauga

SEQ ID NO: 793015 - RNA, 22 nt, Homo sapiens
cuuggcuucugugaugagcuga

SEQ ID NO: 793016 - RNA, 13 nt, Homo sapiens
cuuggcuugccau

SEQ ID NO: 793017 - RNA, 17 nt, Homo sapiens
cuuggcuuuaugcaaau

SEQ ID NO: 793018 - RNA, 20 nt, Homo sapiens
cuuggcuuuaugcaaauaca

SEQ ID NO: 793019 - RNA, 22 nt, Homo sapiens
cuuggcuuuaugcaaauacaau

SEQ ID NO: 793020 - RNA, 15 nt, Homo sapiens
cuugggaacuccacu

SEQ ID NO: 793021 - RNA, 14 nt, Homo sapiens
cuugggaccguguu

SEQ ID NO: 793022 - RNA, 17 nt, Homo sapiens
cuugggcacaucugcug

SEQ ID NO: 793023 - RNA, 17 nt, Homo sapiens
cuuggggaaauggggcu

SEQ ID NO: 793024 - RNA, 13 nt, Homo sapiens
cuuggggacuaac

SEQ ID NO: 793025 - RNA, 17 nt, Homo sapiens
cuuggggagcacuuguc

SEQ ID NO: 793026 - RNA, 16 nt, Homo sapiens
cuuggggccaccaaag

SEQ ID NO: 793027 - RNA, 22 nt, Homo sapiens
cuugggucucauuuagaacuug

SEQ ID NO: 793028 - RNA, 17 nt, Homo sapiens
cuuggucccuccagaac

SEQ ID NO: 793029 - RNA, 16 nt, Homo sapiens
cuugguggagcagcca

SEQ ID NO: 793030 - RNA, 21 nt, Homo sapiens
cuugguucaucaguguuaaaa

SEQ ID NO: 793031 - RNA, 23 nt, Homo sapiens
cuuguaaaaagggggcugcauuc

SEQ ID NO: 793032 - RNA, 14 nt, Homo sapiens
cuuguaaagacugu

SEQ ID NO: 793033 - RNA, 23 nt, Homo sapiens
cuuguaacaagaaaacauaagag

SEQ ID NO: 793034 - RNA, 20 nt, Homo sapiens
cuuguaauaccugauugauc

SEQ ID NO: 793035 - RNA, 18 nt, Homo sapiens
cuuguaauucuaaaugaa

SEQ ID NO: 793036 - RNA, 16 nt, Homo sapiens
cuuguagaguggugcu

SEQ ID NO: 793037 - RNA, 14 nt, Homo sapiens
cuuguagaugcauu

SEQ ID NO: 793038 - RNA, 21 nt, Homo sapiens
cuuguaguuccauguacugua

SEQ ID NO: 793039 - RNA, 16 nt, Homo sapiens
cuuguauauacgcauc

SEQ ID NO: 793040 - RNA, 12 nt, Homo sapiens
cuuguaugcuuc

SEQ ID NO: 793041 - RNA, 14 nt, Homo sapiens
cuuguauuuccaaa

SEQ ID NO: 793042 - RNA, 16 nt, Homo sapiens
cuugucacgaauucca

SEQ ID NO: 793043 - RNA, 17 nt, Homo sapiens
cuugucauguguauaaa

SEQ ID NO: 793044 - RNA, 14 nt, Homo sapiens
cuugucauuccaga

SEQ ID NO: 793045 - RNA, 15 nt, Homo sapiens
cuugucauugccagc

SEQ ID NO: 793046 - RNA, 20 nt, Homo sapiens
cuuguccacgucuuuucuca

SEQ ID NO: 793047 - RNA, 15 nt, Homo sapiens
cuuguccuaugucaa

SEQ ID NO: 793048 - RNA, 12 nt, Homo sapiens
cuuguccugacu

SEQ ID NO: 793049 - RNA, 19 nt, Homo sapiens
cuugucuaacuuuugugaa

SEQ ID NO: 793050 - RNA, 22 nt, Homo sapiens
cuugugauuuuuauaauacaaa

SEQ ID NO: 793051 - RNA, 16 nt, Homo sapiens
cuugugccauagucac

SEQ ID NO: 793052 - RNA, 16 nt, Homo sapiens
cuugugcccaggguuu

SEQ ID NO: 793053 - RNA, 14 nt, Homo sapiens
cuugugcucaagga

SEQ ID NO: 793054 - RNA, 22 nt, Homo sapiens
cuugugguugaaaaccacaguc

SEQ ID NO: 793055 - RNA, 16 nt, Homo sapiens
cuuguguuacuugcca

SEQ ID NO: 793056 - RNA, 14 nt, Homo sapiens
cuuguuacugugau

SEQ ID NO: 793057 - RNA, 13 nt, Homo sapiens
cuuguucagauua

SEQ ID NO: 793058 - RNA, 23 nt, Homo sapiens
cuuguucccuaggggacacuucc

SEQ ID NO: 793059 - RNA, 13 nt, Homo sapiens
cuuguugcucaaa

SEQ ID NO: 793060 - RNA, 23 nt, Homo sapiens
cuuguuggugacaccucaccuca

SEQ ID NO: 793061 - RNA, 15 nt, Homo sapiens
cuuguuuaccaaaga

SEQ ID NO: 793062 - RNA, 22 nt, Homo sapiens
cuuguuucccagauuucaggaa

SEQ ID NO: 793063 - RNA, 17 nt, Homo sapiens
cuuguuugucagcaucu

SEQ ID NO: 793064 - RNA, 22 nt, Homo sapiens
cuuguuuguuugagcuuaggga

SEQ ID NO: 793065 - RNA, 22 nt, Homo sapiens
cuuguuuuaacguucugcugcu

SEQ ID NO: 793066 - RNA, 13 nt, Homo sapiens
cuuguuuuggaca

SEQ ID NO: 793067 - RNA, 23 nt, Homo sapiens
cuuguuuuuccacuacugcuacc

SEQ ID NO: 793068 - RNA, 22 nt, Homo sapiens
cuuguuuuuuuaauucauuaac

SEQ ID NO: 793069 - RNA, 18 nt, Homo sapiens
cuuuaaaauuacauucua

SEQ ID NO: 793070 - RNA, 13 nt, Homo sapiens
cuuuaaaauucua

SEQ ID NO: 793071 - RNA, 23 nt, Homo sapiens
cuuuaaaauuuguccuacauucg

SEQ ID NO: 793072 - RNA, 11 nt, Homo sapiens
cuuuaaaccac

SEQ ID NO: 793073 - RNA, 14 nt, Homo sapiens
cuuuaaaccaccua

SEQ ID NO: 793074 - RNA, 16 nt, Homo sapiens
cuuuaaaccacuaaaa

SEQ ID NO: 793075 - RNA, 20 nt, Homo sapiens
cuuuaaagggauggcaagau

SEQ ID NO: 793076 - RNA, 19 nt, Homo sapiens
cuuuaaagucagguccaau

SEQ ID NO: 793077 - RNA, 13 nt, Homo sapiens
cuuuaaauggaaa

SEQ ID NO: 793078 - RNA, 14 nt, Homo sapiens
cuuuaacugacuua

SEQ ID NO: 793079 - RNA, 17 nt, Homo sapiens
cuuuaacuuuuacaaaa

SEQ ID NO: 793080 - RNA, 22 nt, Homo sapiens
cuuuaagaagcaguguuuuaga

SEQ ID NO: 793081 - RNA, 22 nt, Homo sapiens
aucauuugagcucaugagggcc

SEQ ID NO: 793082 - RNA, 22 nt, Homo sapiens
aucauuuuacucuuaugaucaa

SEQ ID NO: 793083 - RNA, 23 nt, Homo sapiens
aucauuuuacucuuaugaucaau

SEQ ID NO: 793084 - RNA, 17 nt, Homo sapiens
auccaaagcugaauaca

SEQ ID NO: 793085 - RNA, 19 nt, Homo sapiens
auccaaccccccaccugcc

SEQ ID NO: 793086 - RNA, 16 nt, Homo sapiens
auccaacuaacuccag

SEQ ID NO: 793087 - RNA, 23 nt, Homo sapiens
auccaagaaggccuucauggccc

SEQ ID NO: 793088 - RNA, 18 nt, Homo sapiens
auccaagauuuaaaugcc

SEQ ID NO: 793089 - RNA, 12 nt, Homo sapiens
auccaauacugc

SEQ ID NO: 793090 - RNA, 18 nt, Homo sapiens
auccaauccucacugggu

SEQ ID NO: 793091 - RNA, 16 nt, Homo sapiens
auccacaauagcugac

SEQ ID NO: 793092 - RNA, 17 nt, Homo sapiens
auccacaguacucacuu

SEQ ID NO: 793093 - RNA, 12 nt, Homo sapiens
auccaccaccuu

SEQ ID NO: 793094 - RNA, 21 nt, Homo sapiens
auccacccaacccuaucuccu

SEQ ID NO: 793095 - RNA, 19 nt, Homo sapiens
auccaccccguugcucaag

SEQ ID NO: 793096 - RNA, 23 nt, Homo sapiens
auccacccgggggagcccaguga

SEQ ID NO: 793097 - RNA, 20 nt, Homo sapiens
auccagaacucaaaugagcc

SEQ ID NO: 793098 - RNA, 19 nt, Homo sapiens
auccagaccaaccuuccau

SEQ ID NO: 793099 - RNA, 14 nt, Homo sapiens
auccagagugauuc

SEQ ID NO: 793100 - RNA, 16 nt, Homo sapiens
auccagaucauuccuc

SEQ ID NO: 793101 - RNA, 13 nt, Homo sapiens
auccagcacuggu

SEQ ID NO: 793102 - RNA, 17 nt, Homo sapiens
auccagcacuggugaac

SEQ ID NO: 793103 - RNA, 15 nt, Homo sapiens
auccagccuuuccaa

SEQ ID NO: 793104 - RNA, 16 nt, Homo sapiens
auccagcuaugaauau

SEQ ID NO: 793105 - RNA, 17 nt, Homo sapiens
auccagcuccccuucug

SEQ ID NO: 793106 - RNA, 20 nt, Homo sapiens
auccagcucuugcucaguga

SEQ ID NO: 793107 - RNA, 17 nt, Homo sapiens
auccaggcaccaggacu

SEQ ID NO: 793108 - RNA, 16 nt, Homo sapiens
aggcagcuucuagaca

SEQ ID NO: 793109 - RNA, 20 nt, Homo sapiens
aggcaggagaaucacucgaa

SEQ ID NO: 793110 - RNA, 20 nt, Homo sapiens
aggcaggagaauuacuugaa

SEQ ID NO: 793111 - RNA, 20 nt, Homo sapiens
aggcaggauauuccaagggc

SEQ ID NO: 793112 - RNA, 21 nt, Homo sapiens
aggcagggccuugcccagaga

SEQ ID NO: 793113 - RNA, 16 nt, Homo sapiens
aggcagggcugggaag

SEQ ID NO: 793114 - RNA, 13 nt, Homo sapiens
aggcaggggacaa

SEQ ID NO: 793115 - RNA, 16 nt, Homo sapiens
aggcagguccacagag

SEQ ID NO: 793116 - RNA, 16 nt, Homo sapiens
aggcaggugccuccag

SEQ ID NO: 793117 - RNA, 17 nt, Homo sapiens
aggcagguugagacuac

SEQ ID NO: 793118 - RNA, 15 nt, Homo sapiens
aggcaguaaugccuu

SEQ ID NO: 793119 - RNA, 16 nt, Homo sapiens
aggcaguagaacucca

SEQ ID NO: 793120 - RNA, 18 nt, Homo sapiens
aggcaguauuuugugucc

SEQ ID NO: 793121 - RNA, 19 nt, Homo sapiens
aggcaguauuuuguguccu

SEQ ID NO: 793122 - RNA, 13 nt, Homo sapiens
aggcagugucccu

SEQ ID NO: 793123 - RNA, 14 nt, Homo sapiens
aggcagugugguua

SEQ ID NO: 793124 - RNA, 14 nt, Homo sapiens
aggcaguucuagaa

SEQ ID NO: 793125 - RNA, 16 nt, Homo sapiens
aggcaguucuagaagc

SEQ ID NO: 793126 - RNA, 16 nt, Homo sapiens
aggcauagaggcuucu

SEQ ID NO: 793127 - RNA, 17 nt, Homo sapiens
aggcaucucuguacuuu

SEQ ID NO: 793128 - RNA, 15 nt, Homo sapiens
aggcaugacuaaugc

SEQ ID NO: 793129 - RNA, 19 nt, Homo sapiens
aggcaugagccacugcacu

SEQ ID NO: 793130 - RNA, 16 nt, Homo sapiens
aggcaugguggcucau

SEQ ID NO: 793131 - RNA, 21 nt, Homo sapiens
aggcauucuucuaaagcagac

SEQ ID NO: 793132 - RNA, 16 nt, Homo sapiens
aggcauuuggucucac

SEQ ID NO: 793133 - RNA, 18 nt, Homo sapiens
aggcauuuucaucuuucc

SEQ ID NO: 793134 - RNA, 17 nt, Homo sapiens
aggccaacagcaagugu

SEQ ID NO: 793135 - RNA, 15 nt, Homo sapiens
aggccaacagcaccu

SEQ ID NO: 793136 - RNA, 16 nt, Homo sapiens
aggccaaggcuaugaa

SEQ ID NO: 793137 - RNA, 17 nt, Homo sapiens
aggccaagucuaaugaa

SEQ ID NO: 793138 - RNA, 17 nt, Homo sapiens
aggccacagugcaauuu

SEQ ID NO: 793139 - RNA, 20 nt, Homo sapiens
aggccacccccuauccucug

SEQ ID NO: 793140 - RNA, 14 nt, Homo sapiens
aggccacuggggac

SEQ ID NO: 793141 - RNA, 16 nt, Homo sapiens
aggccagcaagcucuu

SEQ ID NO: 793142 - RNA, 15 nt, Homo sapiens
aggccagcaccaucu

SEQ ID NO: 793143 - RNA, 17 nt, Homo sapiens
aggccagcaccaucucu

SEQ ID NO: 793144 - RNA, 20 nt, Homo sapiens
aggccagcccggaccucugg

SEQ ID NO: 793145 - RNA, 19 nt, Homo sapiens
aggccagggagcaguggcu

SEQ ID NO: 793146 - RNA, 22 nt, Homo sapiens
aggccaggggaccccugccagu

SEQ ID NO: 793147 - RNA, 12 nt, Homo sapiens
aggccagugcua

SEQ ID NO: 793148 - RNA, 22 nt, Homo sapiens
aggccagugugccgaccucucu

SEQ ID NO: 793149 - RNA, 20 nt, Homo sapiens
aggccaugaaaaaaaugauc

SEQ ID NO: 793150 - RNA, 15 nt, Homo sapiens
aggccauuaugccug

SEQ ID NO: 793151 - RNA, 21 nt, Homo sapiens
aggcccaacugugagcaagga

SEQ ID NO: 793152 - RNA, 13 nt, Homo sapiens
aggcccaagagau

SEQ ID NO: 793153 - RNA, 15 nt, Homo sapiens
aggcccagcugcuca

SEQ ID NO: 793154 - RNA, 20 nt, Homo sapiens
aggccccugcaaugugguga

SEQ ID NO: 793155 - RNA, 16 nt, Homo sapiens
aggcccgcaccgcugg

SEQ ID NO: 793156 - RNA, 18 nt, Homo sapiens
aggcccggacucaccaac

SEQ ID NO: 793157 - RNA, 15 nt, Homo sapiens
aggcccuacuaccca

SEQ ID NO: 793158 - RNA, 16 nt, Homo sapiens
aggcccugcugaguca

SEQ ID NO: 793159 - RNA, 18 nt, Homo sapiens
aggcccugggucuugcca

SEQ ID NO: 793160 - RNA, 23 nt, Homo sapiens
aggcccuuccucuccacugccuu

SEQ ID NO: 793161 - RNA, 21 nt, Homo sapiens
aggccgagagcagacaccagc

SEQ ID NO: 793162 - RNA, 16 nt, Homo sapiens
aggccgaggaccacca

SEQ ID NO: 793163 - RNA, 16 nt, Homo sapiens
aggccgaguggcugcc

SEQ ID NO: 793164 - RNA, 19 nt, Homo sapiens
aggccgggcgcaguggcuc

SEQ ID NO: 793165 - RNA, 20 nt, Homo sapiens
aggccgggcgcaguggcuca

SEQ ID NO: 793166 - RNA, 21 nt, Homo sapiens
aggccggugugggcugugucg

SEQ ID NO: 793167 - RNA, 17 nt, Homo sapiens
aggccguccucccgggc

SEQ ID NO: 793168 - RNA, 15 nt, Homo sapiens
aggccgugugucugu

SEQ ID NO: 793169 - RNA, 18 nt, Homo sapiens
aggccgugugucugucag

SEQ ID NO: 793170 - RNA, 15 nt, Homo sapiens
aggccuagacucugu

SEQ ID NO: 793171 - RNA, 17 nt, Homo sapiens
aggccuauuuauuaaua

SEQ ID NO: 793172 - RNA, 15 nt, Homo sapiens
aggccucaucuccuu

SEQ ID NO: 793173 - RNA, 22 nt, Homo sapiens
aggccucuccaguuugcaccug

SEQ ID NO: 793174 - RNA, 19 nt, Homo sapiens
aggccucucggugcuccau

SEQ ID NO: 793175 - RNA, 21 nt, Homo sapiens
aggccucuuguugagugccag

SEQ ID NO: 793176 - RNA, 22 nt, Homo sapiens
aggccugaccucaagcaaccau

SEQ ID NO: 793177 - RNA, 16 nt, Homo sapiens
aggccugcaggggcaa

SEQ ID NO: 793178 - RNA, 18 nt, Homo sapiens
aggccugggaauccgcug

SEQ ID NO: 793179 - RNA, 21 nt, Homo sapiens
aggccuucaguuuauuuccac

SEQ ID NO: 793180 - RNA, 16 nt, Homo sapiens
aggccuuccagcugcu

SEQ ID NO: 793181 - RNA, 24 nt, Homo sapiens
aggccuugaagaauacacugugac

SEQ ID NO: 793182 - RNA, 13 nt, Homo sapiens
aggccuugcuuuu

SEQ ID NO: 793183 - RNA, 14 nt, Homo sapiens
aggccuuuugcccg

SEQ ID NO: 793184 - RNA, 16 nt, Homo sapiens
aggcgagcuccuugaa

SEQ ID NO: 793185 - RNA, 15 nt, Homo sapiens
aggcgauccaccugu

SEQ ID NO: 793186 - RNA, 22 nt, Homo sapiens
aggcgauccaccugucucagcc

SEQ ID NO: 793187 - RNA, 17 nt, Homo sapiens
aggcgauucuccugccu

SEQ ID NO: 793188 - RNA, 21 nt, Homo sapiens
aggcgcaggagcagccagcug

SEQ ID NO: 793189 - RNA, 14 nt, Homo sapiens
aggcgcuaauuuau

SEQ ID NO: 793190 - RNA, 22 nt, Homo sapiens
aggcgggagggccugcagugau

SEQ ID NO: 793191 - RNA, 19 nt, Homo sapiens
aggcgggauuuaugugcac

SEQ ID NO: 793192 - RNA, 17 nt, Homo sapiens
aggcggggugcuguggu

SEQ ID NO: 793193 - RNA, 14 nt, Homo sapiens
aggcggggugggca

SEQ ID NO: 793194 - RNA, 20 nt, Homo sapiens
aggcggguggaucacuugag

SEQ ID NO: 793195 - RNA, 15 nt, Homo sapiens
aggcgugguggugca

SEQ ID NO: 793196 - RNA, 14 nt, Homo sapiens
aggcuaaaugagau

SEQ ID NO: 793197 - RNA, 20 nt, Homo sapiens
aggcuaagacccuguguccu

SEQ ID NO: 793198 - RNA, 13 nt, Homo sapiens
aggcuaagcacuu

SEQ ID NO: 793199 - RNA, 14 nt, Homo sapiens
aggcuaagcacuuu

SEQ ID NO: 793200 - RNA, 16 nt, Homo sapiens
aggcuaugagugggau

SEQ ID NO: 793201 - RNA, 15 nt, Homo sapiens
aggcuauguauggaa

SEQ ID NO: 793202 - RNA, 15 nt, Homo sapiens
aggcucaugccauca

SEQ ID NO: 793203 - RNA, 18 nt, Homo sapiens
aggcucauuuaaaacagg

SEQ ID NO: 793204 - RNA, 15 nt, Homo sapiens
aggcuccugccugag

SEQ ID NO: 793205 - RNA, 21 nt, Homo sapiens
aggcuccuuccugucuuccug

SEQ ID NO: 793206 - RNA, 21 nt, Homo sapiens
auaggcuucucacggcgacca

SEQ ID NO: 793207 - RNA, 20 nt, Homo sapiens
auagggagacccccaucuuu

SEQ ID NO: 793208 - RNA, 22 nt, Homo sapiens
auagggagacccccaucuuuac

SEQ ID NO: 793209 - RNA, 14 nt, Homo sapiens
auagguaaaccaaa

SEQ ID NO: 793210 - RNA, 20 nt, Homo sapiens
auaggugcuacaaaaacaca

SEQ ID NO: 793211 - RNA, 14 nt, Homo sapiens
auaguaaaugcuuu

SEQ ID NO: 793212 - RNA, 13 nt, Homo sapiens
auagucacacuuu

SEQ ID NO: 793213 - RNA, 23 nt, Homo sapiens
auagucacauggccuaugcacau

SEQ ID NO: 793214 - RNA, 21 nt, Homo sapiens
auagucauuccaaauaugaga

SEQ ID NO: 793215 - RNA, 16 nt, Homo sapiens
auaguccagacacuua

SEQ ID NO: 793216 - RNA, 17 nt, Homo sapiens
auagucccagcuacuca

SEQ ID NO: 793217 - RNA, 18 nt, Homo sapiens
auagucuuugccagucau

SEQ ID NO: 793218 - RNA, 16 nt, Homo sapiens
auagugacaugcacac

SEQ ID NO: 793219 - RNA, 13 nt, Homo sapiens
auagugcaauagu

SEQ ID NO: 793220 - RNA, 17 nt, Homo sapiens
auagugcaauagugcaa

SEQ ID NO: 793221 - RNA, 20 nt, Homo sapiens
auagugcaauagugcaacau

SEQ ID NO: 793222 - RNA, 21 nt, Homo sapiens
auagugggguuccaugaguua

SEQ ID NO: 793223 - RNA, 17 nt, Homo sapiens
auaguguagcugaggag

SEQ ID NO: 793224 - RNA, 18 nt, Homo sapiens
auaguucaguagaauuac

SEQ ID NO: 793225 - RNA, 16 nt, Homo sapiens
auaguuccuugccuua

SEQ ID NO: 793226 - RNA, 15 nt, Homo sapiens
auaguugcuugccug

SEQ ID NO: 793227 - RNA, 16 nt, Homo sapiens
auaguuuacugagaau

SEQ ID NO: 793228 - RNA, 20 nt, Homo sapiens
auauaaaauguuuaaucucu

SEQ ID NO: 793229 - RNA, 18 nt, Homo sapiens
auauaaacaugcuugcau

SEQ ID NO: 793230 - RNA, 18 nt, Homo sapiens
auauaaauuauuaguuua

SEQ ID NO: 793231 - RNA, 18 nt, Homo sapiens
auauaaauucuaagccau

SEQ ID NO: 793232 - RNA, 19 nt, Homo sapiens
auauaaauuuguguucuca

SEQ ID NO: 793233 - RNA, 12 nt, Homo sapiens
auauaacaugua

SEQ ID NO: 793234 - RNA, 22 nt, Homo sapiens
auauaaggaaagugauccaaaa

SEQ ID NO: 793235 - RNA, 16 nt, Homo sapiens
auauaaguacugacca

SEQ ID NO: 793236 - RNA, 18 nt, Homo sapiens
auauaaguuugaaggaaa

SEQ ID NO: 793237 - RNA, 13 nt, Homo sapiens
auauaaucaauca

SEQ ID NO: 793238 - RNA, 16 nt, Homo sapiens
auauaauguugccagc

SEQ ID NO: 793239 - RNA, 16 nt, Homo sapiens
auauaauuucaaacca

SEQ ID NO: 793240 - RNA, 15 nt, Homo sapiens
auauacaauaacaua

SEQ ID NO: 793241 - RNA, 17 nt, Homo sapiens
auauacaauaacauaau

SEQ ID NO: 793242 - RNA, 16 nt, Homo sapiens
auauacaguaacuuua

SEQ ID NO: 793243 - RNA, 15 nt, Homo sapiens
auauacaugcucaac

SEQ ID NO: 793244 - RNA, 14 nt, Homo sapiens
auauacucaugucc

SEQ ID NO: 793245 - RNA, 13 nt, Homo sapiens
auauacugcauau

SEQ ID NO: 793246 - RNA, 18 nt, Homo sapiens
auauacugguucacaucc

SEQ ID NO: 793247 - RNA, 12 nt, Homo sapiens
auauacuuugaa

SEQ ID NO: 793248 - RNA, 15 nt, Homo sapiens
auauagaaacucuca

SEQ ID NO: 793249 - RNA, 16 nt, Homo sapiens
auauagacauucucac

SEQ ID NO: 793250 - RNA, 14 nt, Homo sapiens
auauagaguggaau

SEQ ID NO: 793251 - RNA, 17 nt, Homo sapiens
auauagccaaaaauguc

SEQ ID NO: 793252 - RNA, 15 nt, Homo sapiens
auauaggcuucucac

SEQ ID NO: 793253 - RNA, 15 nt, Homo sapiens
auauagucacacuuu

SEQ ID NO: 793254 - RNA, 23 nt, Homo sapiens
auauaguccagacacuuaacuca

SEQ ID NO: 793255 - RNA, 19 nt, Homo sapiens
auauaguuccuugccuuaa

SEQ ID NO: 793256 - RNA, 13 nt, Homo sapiens
auauauaugucaa

SEQ ID NO: 793257 - RNA, 15 nt, Homo sapiens
auauaucuaccccag

SEQ ID NO: 793258 - RNA, 21 nt, Homo sapiens
auauaucuaugucuauaucau

SEQ ID NO: 793259 - RNA, 17 nt, Homo sapiens
auauaugcacuauguau

SEQ ID NO: 793260 - RNA, 18 nt, Homo sapiens
auauaugccuucccccac

SEQ ID NO: 793261 - RNA, 21 nt, Homo sapiens
auauaugcuaagcauaauuaa

SEQ ID NO: 793262 - RNA, 19 nt, Homo sapiens
auauauucaguaaugaaga

SEQ ID NO: 793263 - RNA, 12 nt, Homo sapiens
auauauucccaa

SEQ ID NO: 793264 - RNA, 15 nt, Homo sapiens
auauauucuuucaaa

SEQ ID NO: 793265 - RNA, 12 nt, Homo sapiens
auauauugaacu

SEQ ID NO: 793266 - RNA, 18 nt, Homo sapiens
auauauuugaaauaguau

SEQ ID NO: 793267 - RNA, 16 nt, Homo sapiens
auauauuuuagcauuu

SEQ ID NO: 793268 - RNA, 23 nt, Homo sapiens
auauauuuuugguugucaauauu

SEQ ID NO: 793269 - RNA, 22 nt, Homo sapiens
auaucaaaaaaccuuuacaguu

SEQ ID NO: 793270 - RNA, 17 nt, Homo sapiens
auaucaaaagcaaauaa

SEQ ID NO: 793271 - RNA, 14 nt, Homo sapiens
auaucaccucucuu

SEQ ID NO: 793272 - RNA, 14 nt, Homo sapiens
auaucagagcucuu

SEQ ID NO: 793273 - RNA, 13 nt, Homo sapiens
auaucagugacag

SEQ ID NO: 793274 - RNA, 20 nt, Homo sapiens
auaucaguuugcuagcagaa

SEQ ID NO: 793275 - RNA, 18 nt, Homo sapiens
auaucaugguagucacua

SEQ ID NO: 793276 - RNA, 22 nt, Homo sapiens
auaucauuuauuuuuuacauua

SEQ ID NO: 793277 - RNA, 22 nt, Homo sapiens
auauccaagauuuaaaugccau

SEQ ID NO: 793278 - RNA, 18 nt, Homo sapiens
auauccaggcaccaggac

SEQ ID NO: 793279 - RNA, 14 nt, Homo sapiens
auauccugugacug

SEQ ID NO: 793280 - RNA, 15 nt, Homo sapiens
auauccugugacugu

SEQ ID NO: 793281 - RNA, 14 nt, Homo sapiens
auaucgcugaugca

SEQ ID NO: 793282 - RNA, 18 nt, Homo sapiens
auaucuaauauauaugaa

SEQ ID NO: 793283 - RNA, 16 nt, Homo sapiens
auaucugaaaauguau

SEQ ID NO: 793284 - RNA, 15 nt, Homo sapiens
auaucugcauguguc

SEQ ID NO: 793285 - RNA, 23 nt, Homo sapiens
auaucuucuguuucauaaugcag

SEQ ID NO: 793286 - RNA, 21 nt, Homo sapiens
auaucuuuuguaagacauuuc

SEQ ID NO: 793287 - RNA, 15 nt, Homo sapiens
auaugaaacauuuaa

SEQ ID NO: 793288 - RNA, 20 nt, Homo sapiens
auaugaaauaaaauuacaca

SEQ ID NO: 793289 - RNA, 17 nt, Homo sapiens
auaugaagaacugagga

SEQ ID NO: 793290 - RNA, 12 nt, Homo sapiens
auaugaccaaaa

SEQ ID NO: 793291 - RNA, 19 nt, Homo sapiens
auaugaccauuugacuguu

SEQ ID NO: 793292 - RNA, 21 nt, Homo sapiens
auaugaccauuugacuguuca

SEQ ID NO: 793293 - RNA, 13 nt, Homo sapiens
auaugacuuccua

SEQ ID NO: 793294 - RNA, 17 nt, Homo sapiens
auaugagaauauaccuu

SEQ ID NO: 793295 - RNA, 19 nt, Homo sapiens
aucaauagaaggauguaca

SEQ ID NO: 793296 - RNA, 22 nt, Homo sapiens
aucaaucuuguuacugcugauu

SEQ ID NO: 793297 - RNA, 21 nt, Homo sapiens
aucaaugcaagagugauugca

SEQ ID NO: 793298 - RNA, 19 nt, Homo sapiens
aucaaugcauguuacccau

SEQ ID NO: 793299 - RNA, 15 nt, Homo sapiens
aucaaugucaaguac

SEQ ID NO: 793300 - RNA, 11 nt, Homo sapiens
aucaaugucac

SEQ ID NO: 793301 - RNA, 15 nt, Homo sapiens
aucaaugucacuuaa

SEQ ID NO: 793302 - RNA, 14 nt, Homo sapiens
aucaauuuuuccca

SEQ ID NO: 793303 - RNA, 21 nt, Homo sapiens
aucaauuuuucccaguauuuu

SEQ ID NO: 793304 - RNA, 11 nt, Homo sapiens
aucacaacauu

SEQ ID NO: 793305 - RNA, 16 nt, Homo sapiens
aucacaacauuccuca

SEQ ID NO: 793306 - RNA, 19 nt, Homo sapiens
aucacaacauuuacuuaac

SEQ ID NO: 793307 - RNA, 11 nt, Homo sapiens
aucacaccuca

SEQ ID NO: 793308 - RNA, 19 nt, Homo sapiens
aucacagcuucagccagga

SEQ ID NO: 793309 - RNA, 16 nt, Homo sapiens
aucacaggacauuaag

SEQ ID NO: 793310 - RNA, 23 nt, Homo sapiens
aucacagggccccagaaggcagg

SEQ ID NO: 793311 - RNA, 16 nt, Homo sapiens
aucacaguguuuuuau

SEQ ID NO: 793312 - RNA, 17 nt, Homo sapiens
aucacauauucuagugu

SEQ ID NO: 793313 - RNA, 14 nt, Homo sapiens
aucacauccacaaa

SEQ ID NO: 793314 - RNA, 15 nt, Homo sapiens
aucacauucuuucca

SEQ ID NO: 793315 - RNA, 20 nt, Homo sapiens
aucacccucuuccugugauc

SEQ ID NO: 793316 - RNA, 13 nt, Homo sapiens
aucaccuauuuaa

SEQ ID NO: 793317 - RNA, 15 nt, Homo sapiens
aucaccucaggccag

SEQ ID NO: 793318 - RNA, 15 nt, Homo sapiens
aucaccucucuucag

SEQ ID NO: 793319 - RNA, 21 nt, Homo sapiens
aucaccuugauaaugggauga

SEQ ID NO: 793320 - RNA, 18 nt, Homo sapiens
aucaccuuguauucucuu

SEQ ID NO: 793321 - RNA, 18 nt, Homo sapiens
aucacgagaucaagagau

SEQ ID NO: 793322 - RNA, 17 nt, Homo sapiens
auacaguguacauguac

SEQ ID NO: 793323 - RNA, 17 nt, Homo sapiens
auacauauuaucucauu

SEQ ID NO: 793324 - RNA, 18 nt, Homo sapiens
auacauauuuuuauuuga

SEQ ID NO: 793325 - RNA, 17 nt, Homo sapiens
auacaucaagccaauac

SEQ ID NO: 793326 - RNA, 23 nt, Homo sapiens
auacaugcaacagaagugacuuc

SEQ ID NO: 793327 - RNA, 18 nt, Homo sapiens
auacaugcauacaaagag

SEQ ID NO: 793328 - RNA, 12 nt, Homo sapiens
auacaugcucuu

SEQ ID NO: 793329 - RNA, 20 nt, Homo sapiens
auacauucuuuaucuugaca

SEQ ID NO: 793330 - RNA, 12 nt, Homo sapiens
auacauugcaau

SEQ ID NO: 793331 - RNA, 14 nt, Homo sapiens
auacauuucaauua

SEQ ID NO: 793332 - RNA, 17 nt, Homo sapiens
auacauuugaggggaaa

SEQ ID NO: 793333 - RNA, 14 nt, Homo sapiens
auaccaacuguaca

SEQ ID NO: 793334 - RNA, 13 nt, Homo sapiens
auaccaagcuugu

SEQ ID NO: 793335 - RNA, 15 nt, Homo sapiens
auaccagaaagcucu

SEQ ID NO: 793336 - RNA, 17 nt, Homo sapiens
auaccagaaagcucuac

SEQ ID NO: 793337 - RNA, 18 nt, Homo sapiens
auaccagcauacgcucac

SEQ ID NO: 793338 - RNA, 15 nt, Homo sapiens
auacccacuaacaaa

SEQ ID NO: 793339 - RNA, 21 nt, Homo sapiens
auaccccggugugccugugga

SEQ ID NO: 793340 - RNA, 16 nt, Homo sapiens
auaccgcucaguauuu

SEQ ID NO: 793341 - RNA, 17 nt, Homo sapiens
auaccgcucaguauuuu

SEQ ID NO: 793342 - RNA, 16 nt, Homo sapiens
auaccguguggcccaa

SEQ ID NO: 793343 - RNA, 21 nt, Homo sapiens
auaccucaacccccauuucua

SEQ ID NO: 793344 - RNA, 19 nt, Homo sapiens
auaccucaguuugcauauu

SEQ ID NO: 793345 - RNA, 14 nt, Homo sapiens
auaccucugaccaa

SEQ ID NO: 793346 - RNA, 22 nt, Homo sapiens
auaccugcucuuguucuacuga

SEQ ID NO: 793347 - RNA, 16 nt, Homo sapiens
auaccugcuucaguga

SEQ ID NO: 793348 - RNA, 18 nt, Homo sapiens
auaccuggcuuuuacuuu

SEQ ID NO: 793349 - RNA, 18 nt, Homo sapiens
auaccuggggacuugaug

SEQ ID NO: 793350 - RNA, 16 nt, Homo sapiens
auaccuuccuucccug

SEQ ID NO: 793351 - RNA, 22 nt, Homo sapiens
auaccuucugaacuacacugca

SEQ ID NO: 793352 - RNA, 15 nt, Homo sapiens
auaccuuuuuguguc

SEQ ID NO: 793353 - RNA, 13 nt, Homo sapiens
auacgcaucagac

SEQ ID NO: 793354 - RNA, 20 nt, Homo sapiens
auacgcucaggugguugugg

SEQ ID NO: 793355 - RNA, 15 nt, Homo sapiens
auacggcagaccucu

SEQ ID NO: 793356 - RNA, 15 nt, Homo sapiens
auacgugcacagggu

SEQ ID NO: 793357 - RNA, 20 nt, Homo sapiens
auacguuugaaauaguugau

SEQ ID NO: 793358 - RNA, 21 nt, Homo sapiens
auacuaaaccagcauacccuu

SEQ ID NO: 793359 - RNA, 13 nt, Homo sapiens
auacuagaauuca

SEQ ID NO: 793360 - RNA, 21 nt, Homo sapiens
auacuagauuccacagggaaa

SEQ ID NO: 793361 - RNA, 15 nt, Homo sapiens
auacuaggugccuuu

SEQ ID NO: 793362 - RNA, 23 nt, Homo sapiens
auacuaguuugcuuugcugacca

SEQ ID NO: 793363 - RNA, 16 nt, Homo sapiens
auacuauccaguuacu

SEQ ID NO: 793364 - RNA, 14 nt, Homo sapiens
auacuauugccuca

SEQ ID NO: 793365 - RNA, 16 nt, Homo sapiens
auacuauugccucaua

SEQ ID NO: 793366 - RNA, 22 nt, Homo sapiens
auacuauuuaaagccuccucau

SEQ ID NO: 793367 - RNA, 22 nt, Homo sapiens
auacuauuuaagaugugaaaau

SEQ ID NO: 793368 - RNA, 13 nt, Homo sapiens
auacucagguuaa

SEQ ID NO: 793369 - RNA, 22 nt, Homo sapiens
auacuccauacauaacuugaua

SEQ ID NO: 793370 - RNA, 19 nt, Homo sapiens
auacucuagaacaugcaca

SEQ ID NO: 793371 - RNA, 13 nt, Homo sapiens
auacucugcuauu

SEQ ID NO: 793372 - RNA, 18 nt, Homo sapiens
auacucuguguaaucucu

SEQ ID NO: 793373 - RNA, 18 nt, Homo sapiens
auacugaaggaaaaacac

SEQ ID NO: 793374 - RNA, 17 nt, Homo sapiens
auacugaccuaccucaa

SEQ ID NO: 793375 - RNA, 18 nt, Homo sapiens
auacugacuucaguggga

SEQ ID NO: 793376 - RNA, 22 nt, Homo sapiens
auacugcauguaagccaaguca

SEQ ID NO: 793377 - RNA, 19 nt, Homo sapiens
auacugcucaucauuccuu

SEQ ID NO: 793378 - RNA, 19 nt, Homo sapiens
auacuggccuggacuguuu

SEQ ID NO: 793379 - RNA, 22 nt, Homo sapiens
auacuguauuaagagugaaaau

SEQ ID NO: 793380 - RNA, 17 nt, Homo sapiens
auacuuaaaauaucucu

SEQ ID NO: 793381 - RNA, 23 nt, Homo sapiens
auacuucauucucucucauuauu

SEQ ID NO: 793382 - RNA, 17 nt, Homo sapiens
auacuugaagggccaga

SEQ ID NO: 793383 - RNA, 13 nt, Homo sapiens
auacuuuacaaag

SEQ ID NO: 793384 - RNA, 19 nt, Homo sapiens
auacuuuauuucugaucua

SEQ ID NO: 793385 - RNA, 18 nt, Homo sapiens
auacuuugcauauugucu

SEQ ID NO: 793386 - RNA, 16 nt, Homo sapiens
auacuuugucugaaaa

SEQ ID NO: 793387 - RNA, 19 nt, Homo sapiens
auacuuuuacucugccuac

SEQ ID NO: 793388 - RNA, 18 nt, Homo sapiens
auagaaaaauaacuuuag

SEQ ID NO: 793389 - RNA, 14 nt, Homo sapiens
auagaaaaauguau

SEQ ID NO: 793390 - RNA, 16 nt, Homo sapiens
auagaaacaugacacu

SEQ ID NO: 793391 - RNA, 14 nt, Homo sapiens
auagaaacucucau

SEQ ID NO: 793392 - RNA, 14 nt, Homo sapiens
auagaaauuuugua

SEQ ID NO: 793393 - RNA, 12 nt, Homo sapiens
auagaacaucca

SEQ ID NO: 793394 - RNA, 20 nt, Homo sapiens
auagaacugucccacaaaau

SEQ ID NO: 793395 - RNA, 18 nt, Homo sapiens
auagaagagaagagccau

SEQ ID NO: 793396 - RNA, 17 nt, Homo sapiens
auagaaguagcaaaaag

SEQ ID NO: 793397 - RNA, 22 nt, Homo sapiens
auagaauacauggaaacgcaaa

SEQ ID NO: 793398 - RNA, 12 nt, Homo sapiens
auagacaaauag

SEQ ID NO: 793399 - RNA, 15 nt, Homo sapiens
auagacaauuugcac

SEQ ID NO: 793400 - RNA, 18 nt, Homo sapiens
auagacacauacauguca

SEQ ID NO: 793401 - RNA, 13 nt, Homo sapiens
auagacauucuca

SEQ ID NO: 793402 - RNA, 15 nt, Homo sapiens
auagacauucucaca

SEQ ID NO: 793403 - RNA, 20 nt, Homo sapiens
auagacugccaugcuagaca

SEQ ID NO: 793404 - RNA, 18 nt, Homo sapiens
auagagauuugucuaauu

SEQ ID NO: 793405 - RNA, 20 nt, Homo sapiens
auagagcuuucaaguacaug

SEQ ID NO: 793406 - RNA, 12 nt, Homo sapiens
auagaggcuagc

SEQ ID NO: 793407 - RNA, 12 nt, Homo sapiens
auagaggcuucu

SEQ ID NO: 793408 - RNA, 18 nt, Homo sapiens
auagaguaaauacaggua

SEQ ID NO: 793409 - RNA, 15 nt, Homo sapiens
auagaguauaugcac

SEQ ID NO: 793410 - RNA, 18 nt, Homo sapiens
auagagucucacuguguc

SEQ ID NO: 793411 - RNA, 20 nt, Homo sapiens
auagauauaugcucugcaug

SEQ ID NO: 793412 - RNA, 14 nt, Homo sapiens
auagaucuucauga

SEQ ID NO: 793413 - RNA, 22 nt, Homo sapiens
auagaugcuggcccagggccca

SEQ ID NO: 793414 - RNA, 19 nt, Homo sapiens
auagauggguuauuucaac

SEQ ID NO: 793415 - RNA, 17 nt, Homo sapiens
auagauuaauggcacug

SEQ ID NO: 793416 - RNA, 18 nt, Homo sapiens
auagauuuagcuauuuau

SEQ ID NO: 793417 - RNA, 20 nt, Homo sapiens
auagauuucuacacugaggu

SEQ ID NO: 793418 - RNA, 18 nt, Homo sapiens
auagcaagaccucaucuc

SEQ ID NO: 793419 - RNA, 14 nt, Homo sapiens
auagcaagugaaag

SEQ ID NO: 793420 - RNA, 15 nt, Homo sapiens
auagcaccuccacau

SEQ ID NO: 793421 - RNA, 17 nt, Homo sapiens
auagcagcuuuagccaa

SEQ ID NO: 793422 - RNA, 18 nt, Homo sapiens
auagcagcuuugucucug

SEQ ID NO: 793423 - RNA, 15 nt, Homo sapiens
auagcauguaauggu

SEQ ID NO: 793424 - RNA, 13 nt, Homo sapiens
auagcccacagcu

SEQ ID NO: 793425 - RNA, 22 nt, Homo sapiens
auagcucuggggugggcaguuu

SEQ ID NO: 793426 - RNA, 13 nt, Homo sapiens
auagcugcuuccg

SEQ ID NO: 793427 - RNA, 12 nt, Homo sapiens
auagcuucagga

SEQ ID NO: 793428 - RNA, 14 nt, Homo sapiens
auagcuuugcacuu

SEQ ID NO: 793429 - RNA, 15 nt, Homo sapiens
auagcuuuuacucug

SEQ ID NO: 793430 - RNA, 22 nt, Homo sapiens
auaggaaaccacacagacuugg

SEQ ID NO: 793431 - RNA, 19 nt, Homo sapiens
auaggaacaauaagaacaa

SEQ ID NO: 793432 - RNA, 12 nt, Homo sapiens
auaggacauacu

SEQ ID NO: 793433 - RNA, 13 nt, Homo sapiens
auaggcaauaaua

SEQ ID NO: 793434 - RNA, 17 nt, Homo sapiens
auaggccagaguugcaa

SEQ ID NO: 793435 - RNA, 21 nt, Homo sapiens
auaggccugucccuugccucu

SEQ ID NO: 793436 - RNA, 22 nt, Homo sapiens
auaggcugacuuuugcagaugg

SEQ ID NO: 793437 - RNA, 22 nt, Homo sapiens
aggacucccucuaaguggaaua

SEQ ID NO: 793438 - RNA, 23 nt, Homo sapiens
aggacucuccacucaaugucuua

SEQ ID NO: 793439 - RNA, 13 nt, Homo sapiens
aggacucuuccac

SEQ ID NO: 793440 - RNA, 18 nt, Homo sapiens
aggacugaccucuuccuc

SEQ ID NO: 793441 - RNA, 22 nt, Homo sapiens
aggacugagcacccucuggauu

SEQ ID NO: 793442 - RNA, 23 nt, Homo sapiens
aggacugcgggacuugggucuca

SEQ ID NO: 793443 - RNA, 14 nt, Homo sapiens
aggacugggccacu

SEQ ID NO: 793444 - RNA, 10 nt, Homo sapiens
aggacugugu

SEQ ID NO: 793445 - RNA, 19 nt, Homo sapiens
aggacuuagugcaucagau

SEQ ID NO: 793446 - RNA, 20 nt, Homo sapiens
aggacuugcuaaagcacuuu

SEQ ID NO: 793447 - RNA, 23 nt, Homo sapiens
aggacuugcuaaagcacuuugca

SEQ ID NO: 793448 - RNA, 22 nt, Homo sapiens
aggacuuuaucuaauaccucug

SEQ ID NO: 793449 - RNA, 14 nt, Homo sapiens
aggagaagcugcau

SEQ ID NO: 793450 - RNA, 23 nt, Homo sapiens
aggagaagggggcucugccccag

SEQ ID NO: 793451 - RNA, 17 nt, Homo sapiens
aggagaaucacuugcac

SEQ ID NO: 793452 - RNA, 18 nt, Homo sapiens
aggagaaugaaauguaug

SEQ ID NO: 793453 - RNA, 22 nt, Homo sapiens
aggagaaugaaauguaugugcu

SEQ ID NO: 793454 - RNA, 20 nt, Homo sapiens
aggagaaugaauacugggaa

SEQ ID NO: 793455 - RNA, 16 nt, Homo sapiens
aggagacagaccacuu

SEQ ID NO: 793456 - RNA, 12 nt, Homo sapiens
aggagaccucca

SEQ ID NO: 793457 - RNA, 14 nt, Homo sapiens
aggagaccuccagc

SEQ ID NO: 793458 - RNA, 15 nt, Homo sapiens
aggagagagccagga

SEQ ID NO: 793459 - RNA, 21 nt, Homo sapiens
aggagaggcgggagaacugaa

SEQ ID NO: 793460 - RNA, 13 nt, Homo sapiens
aggagauacugaa

SEQ ID NO: 793461 - RNA, 14 nt, Homo sapiens
aggagauacugaac

SEQ ID NO: 793462 - RNA, 16 nt, Homo sapiens
aggagaucgagaccau

SEQ ID NO: 793463 - RNA, 20 nt, Homo sapiens
aggagaucgagaccauccug

SEQ ID NO: 793464 - RNA, 19 nt, Homo sapiens
aggagaugccacuucucac

SEQ ID NO: 793465 - RNA, 20 nt, Homo sapiens
aggagauggaaguugcagug

SEQ ID NO: 793466 - RNA, 17 nt, Homo sapiens
aggagcacgaggucugg

SEQ ID NO: 793467 - RNA, 19 nt, Homo sapiens
aggagcagagggcaggggu

SEQ ID NO: 793468 - RNA, 18 nt, Homo sapiens
aggagcagauuuuugcaa

SEQ ID NO: 793469 - RNA, 19 nt, Homo sapiens
aggagccaacauaacagau

SEQ ID NO: 793470 - RNA, 15 nt, Homo sapiens
aggagcccugcagug

SEQ ID NO: 793471 - RNA, 15 nt, Homo sapiens
aggagccggcugccu

SEQ ID NO: 793472 - RNA, 21 nt, Homo sapiens
aggagccuuuuuaaaacacau

SEQ ID NO: 793473 - RNA, 15 nt, Homo sapiens
aggagcgcuacccac

SEQ ID NO: 793474 - RNA, 18 nt, Homo sapiens
aggagcugauacuuugac

SEQ ID NO: 793475 - RNA, 19 nt, Homo sapiens
aggagcuugggugugcuga

SEQ ID NO: 793476 - RNA, 23 nt, Homo sapiens
aggagcuuucucaaugucuuccc

SEQ ID NO: 793477 - RNA, 17 nt, Homo sapiens
aggaggaauaaggggaa

SEQ ID NO: 793478 - RNA, 18 nt, Homo sapiens
aggaggccaccucuccaa

SEQ ID NO: 793479 - RNA, 16 nt, Homo sapiens
aggaggcccagcugcu

SEQ ID NO: 793480 - RNA, 17 nt, Homo sapiens
aggaggccccuggccca

SEQ ID NO: 793481 - RNA, 16 nt, Homo sapiens
aggaggcugcaugcuc

SEQ ID NO: 793482 - RNA, 17 nt, Homo sapiens
aggaggcuggcagguau

SEQ ID NO: 793483 - RNA, 20 nt, Homo sapiens
aggaggcuuaggacuuucca

SEQ ID NO: 793484 - RNA, 19 nt, Homo sapiens
aggaggcuuggaaagcauc

SEQ ID NO: 793485 - RNA, 15 nt, Homo sapiens
aggagggcaaaaauu

SEQ ID NO: 793486 - RNA, 23 nt, Homo sapiens
aggagggcgugacucacccaagc

SEQ ID NO: 793487 - RNA, 19 nt, Homo sapiens
aggagggguuaaagcugcc

SEQ ID NO: 793488 - RNA, 19 nt, Homo sapiens
aggagggugacgcccagcu

SEQ ID NO: 793489 - RNA, 22 nt, Homo sapiens
aggaggugcuaucgcaccacug

SEQ ID NO: 793490 - RNA, 22 nt, Homo sapiens
aggagguuauaccaggauuuau

SEQ ID NO: 793491 - RNA, 14 nt, Homo sapiens
aggaguaauggcau

SEQ ID NO: 793492 - RNA, 14 nt, Homo sapiens
aggagucagggaga

SEQ ID NO: 793493 - RNA, 15 nt, Homo sapiens
aggagucccugccau

SEQ ID NO: 793494 - RNA, 14 nt, Homo sapiens
aggagugguucuca

SEQ ID NO: 793495 - RNA, 19 nt, Homo sapiens
aggaguguccucuucccuc

SEQ ID NO: 793496 - RNA, 21 nt, Homo sapiens
aggaguguccucuucccucuc

SEQ ID NO: 793497 - RNA, 22 nt, Homo sapiens
aggaguuacagggaaguggucu

SEQ ID NO: 793498 - RNA, 16 nt, Homo sapiens
aggaguugauaugcaa

SEQ ID NO: 793499 - RNA, 14 nt, Homo sapiens
aggaguuuuguucc

SEQ ID NO: 793500 - RNA, 14 nt, Homo sapiens
aggauaaagccacu

SEQ ID NO: 793501 - RNA, 13 nt, Homo sapiens
aggauacagaaau

SEQ ID NO: 793502 - RNA, 18 nt, Homo sapiens
aggauacuuuacaugguu

SEQ ID NO: 793503 - RNA, 19 nt, Homo sapiens
aggauauauuuaacaaacc

SEQ ID NO: 793504 - RNA, 18 nt, Homo sapiens
aggaucauuugagcucau

SEQ ID NO: 793505 - RNA, 17 nt, Homo sapiens
aggaucgccugagccca

SEQ ID NO: 793506 - RNA, 13 nt, Homo sapiens
aggaucgcucaag

SEQ ID NO: 793507 - RNA, 13 nt, Homo sapiens
aggaugacuguau

SEQ ID NO: 793508 - RNA, 15 nt, Homo sapiens
aggaugauggccaca

SEQ ID NO: 793509 - RNA, 22 nt, Homo sapiens
aggaugauggccacaacaugaa

SEQ ID NO: 793510 - RNA, 17 nt, Homo sapiens
aggauggcaggggcaaa

SEQ ID NO: 793511 - RNA, 15 nt, Homo sapiens
aggauguaagccugg

SEQ ID NO: 793512 - RNA, 21 nt, Homo sapiens
aggauguagagagaacaggug

SEQ ID NO: 793513 - RNA, 20 nt, Homo sapiens
aggaugucugagaccacuug

SEQ ID NO: 793514 - RNA, 21 nt, Homo sapiens
aggauguggaagagcauuagc

SEQ ID NO: 793515 - RNA, 19 nt, Homo sapiens
aggauucaggcagcagugu

SEQ ID NO: 793516 - RNA, 14 nt, Homo sapiens
aggauuguggucac

SEQ ID NO: 793517 - RNA, 22 nt, Homo sapiens
aggauuucucuaacccuauccu

SEQ ID NO: 793518 - RNA, 21 nt, Homo sapiens
aggauuuggggcagagggaca

SEQ ID NO: 793519 - RNA, 16 nt, Homo sapiens
aggauuuuaccaaagc

SEQ ID NO: 793520 - RNA, 14 nt, Homo sapiens
aggcaaaguggaau

SEQ ID NO: 793521 - RNA, 18 nt, Homo sapiens
aggcaaccucccauccca

SEQ ID NO: 793522 - RNA, 22 nt, Homo sapiens
aggcaacuggaaaauacauguc

SEQ ID NO: 793523 - RNA, 20 nt, Homo sapiens
aggcaagccaggcucacuca

SEQ ID NO: 793524 - RNA, 17 nt, Homo sapiens
aggcaagcuaacugcuu

SEQ ID NO: 793525 - RNA, 23 nt, Homo sapiens
aggcaaggaguuugagaccagcu

SEQ ID NO: 793526 - RNA, 19 nt, Homo sapiens
aggcaaggcuaugugauua

SEQ ID NO: 793527 - RNA, 17 nt, Homo sapiens
aggcaagggauaacucu

SEQ ID NO: 793528 - RNA, 23 nt, Homo sapiens
aggcaauaauaagugaugugcug

SEQ ID NO: 793529 - RNA, 21 nt, Homo sapiens
aggcaauuccugauggaaaau

SEQ ID NO: 793530 - RNA, 18 nt, Homo sapiens
aggcacacuuucuggcaa

SEQ ID NO: 793531 - RNA, 22 nt, Homo sapiens
aggcacaggccauuaugccugg

SEQ ID NO: 793532 - RNA, 16 nt, Homo sapiens
aggcacauacaccucg

SEQ ID NO: 793533 - RNA, 15 nt, Homo sapiens
aggcaccugugguga

SEQ ID NO: 793534 - RNA, 22 nt, Homo sapiens
aggcacucgcuguuaucaaaua

SEQ ID NO: 793535 - RNA, 19 nt, Homo sapiens
agcucagaggcccaggaau

SEQ ID NO: 793536 - RNA, 16 nt, Homo sapiens
agcucagccagugggg

SEQ ID NO: 793537 - RNA, 13 nt, Homo sapiens
agcucaggugccu

SEQ ID NO: 793538 - RNA, 12 nt, Homo sapiens
agcucaguuuau

SEQ ID NO: 793539 - RNA, 20 nt, Homo sapiens
agcucaucuguuaugcauag

SEQ ID NO: 793540 - RNA, 22 nt, Homo sapiens
agcucauucccaacgugcaaag

SEQ ID NO: 793541 - RNA, 19 nt, Homo sapiens
agcuccacacccucuccca

SEQ ID NO: 793542 - RNA, 17 nt, Homo sapiens
agcuccagcgauggugc

SEQ ID NO: 793543 - RNA, 22 nt, Homo sapiens
agcuccgcaagcaucaucccug

SEQ ID NO: 793544 - RNA, 17 nt, Homo sapiens
agcuccgccucccgggu

SEQ ID NO: 793545 - RNA, 21 nt, Homo sapiens
agcuccucccacaaugcugaa

SEQ ID NO: 793546 - RNA, 16 nt, Homo sapiens
agcucgcauuugucaa

SEQ ID NO: 793547 - RNA, 20 nt, Homo sapiens
agcucgcgggacccgacccc

SEQ ID NO: 793548 - RNA, 21 nt, Homo sapiens
agcucuaaaguagcaacugcu

SEQ ID NO: 793549 - RNA, 15 nt, Homo sapiens
agcucuaguucaaau

SEQ ID NO: 793550 - RNA, 19 nt, Homo sapiens
agcucuccccaaacuugcu

SEQ ID NO: 793551 - RNA, 21 nt, Homo sapiens
agcucugcaacagggggcaaa

SEQ ID NO: 793552 - RNA, 14 nt, Homo sapiens
agcucugcuugccg

SEQ ID NO: 793553 - RNA, 23 nt, Homo sapiens
agcucuggacagccccacccugg

SEQ ID NO: 793554 - RNA, 22 nt, Homo sapiens
agcucuggccacaacagggcau

SEQ ID NO: 793555 - RNA, 15 nt, Homo sapiens
agcucuggcuuccag

SEQ ID NO: 793556 - RNA, 15 nt, Homo sapiens
agcucuggguugugc

SEQ ID NO: 793557 - RNA, 15 nt, Homo sapiens
agcucugguauauaa

SEQ ID NO: 793558 - RNA, 19 nt, Homo sapiens
agcucuggugacaccagcc

SEQ ID NO: 793559 - RNA, 21 nt, Homo sapiens
agcucuggugacaccagccuu

SEQ ID NO: 793560 - RNA, 14 nt, Homo sapiens
agcucuggugaccu

SEQ ID NO: 793561 - RNA, 16 nt, Homo sapiens
agcucuggugcuuuag

SEQ ID NO: 793562 - RNA, 17 nt, Homo sapiens
agcucuguaucugccau

SEQ ID NO: 793563 - RNA, 21 nt, Homo sapiens
agcucuguauggucaggaugu

SEQ ID NO: 793564 - RNA, 15 nt, Homo sapiens
agcucuuaauguugc

SEQ ID NO: 793565 - RNA, 16 nt, Homo sapiens
agcucuuagucucuuu

SEQ ID NO: 793566 - RNA, 23 nt, Homo sapiens
agcucuugugaacugucuuggcu

SEQ ID NO: 793567 - RNA, 22 nt, Homo sapiens
agcucuuuggaucagucuuugu

SEQ ID NO: 793568 - RNA, 22 nt, Homo sapiens
agcugaagaccauggauuucau

SEQ ID NO: 793569 - RNA, 17 nt, Homo sapiens
agcugaaggcaguggca

SEQ ID NO: 793570 - RNA, 15 nt, Homo sapiens
agcugaauucacuua

SEQ ID NO: 793571 - RNA, 19 nt, Homo sapiens
agcugacaauuuccaaagc

SEQ ID NO: 793572 - RNA, 22 nt, Homo sapiens
agcugaccucagaggaguuuaa

SEQ ID NO: 793573 - RNA, 22 nt, Homo sapiens
agcugagacuacaagugugugc

SEQ ID NO: 793574 - RNA, 15 nt, Homo sapiens
agcugagauuccugg

SEQ ID NO: 793575 - RNA, 15 nt, Homo sapiens
agcugaggccuugcc

SEQ ID NO: 793576 - RNA, 13 nt, Homo sapiens
agcugauccaguu

SEQ ID NO: 793577 - RNA, 18 nt, Homo sapiens
agcugaugccugaaugua

SEQ ID NO: 793578 - RNA, 23 nt, Homo sapiens
agcugaugccugaauguauccua

SEQ ID NO: 793579 - RNA, 14 nt, Homo sapiens
agcugcacaugugc

SEQ ID NO: 793580 - RNA, 14 nt, Homo sapiens
agcugcacauuccu

SEQ ID NO: 793581 - RNA, 15 nt, Homo sapiens
agcugcaccugccag

SEQ ID NO: 793582 - RNA, 17 nt, Homo sapiens
agcugcagaccaugcca

SEQ ID NO: 793583 - RNA, 16 nt, Homo sapiens
agcugcagccacuuuc

SEQ ID NO: 793584 - RNA, 12 nt, Homo sapiens
agcugcauauga

SEQ ID NO: 793585 - RNA, 21 nt, Homo sapiens
agcugcauuucacaugccuug

SEQ ID NO: 793586 - RNA, 23 nt, Homo sapiens
agcugccaaggaaacccccagug

SEQ ID NO: 793587 - RNA, 11 nt, Homo sapiens
agcugcccuag

SEQ ID NO: 793588 - RNA, 13 nt, Homo sapiens
agcugccgugccu

SEQ ID NO: 793589 - RNA, 14 nt, Homo sapiens
agcugccucacuuc

SEQ ID NO: 793590 - RNA, 19 nt, Homo sapiens
agcugccucugccacugac

SEQ ID NO: 793591 - RNA, 13 nt, Homo sapiens
agcugccucugcu

SEQ ID NO: 793592 - RNA, 16 nt, Homo sapiens
agcugcucugcaagag

SEQ ID NO: 793593 - RNA, 15 nt, Homo sapiens
agcugcugacugcca

SEQ ID NO: 793594 - RNA, 20 nt, Homo sapiens
agcugcuguccuuuuaggaa

SEQ ID NO: 793595 - RNA, 17 nt, Homo sapiens
agcugcuguucuuagca

SEQ ID NO: 793596 - RNA, 18 nt, Homo sapiens
agcugcuuuugcauuucu

SEQ ID NO: 793597 - RNA, 23 nt, Homo sapiens
agcuggaagggucaacaucuuuu

SEQ ID NO: 793598 - RNA, 17 nt, Homo sapiens
agcuggagcucuuggaa

SEQ ID NO: 793599 - RNA, 15 nt, Homo sapiens
agcuggagugcagug

SEQ ID NO: 793600 - RNA, 14 nt, Homo sapiens
agcuggcucuguga

SEQ ID NO: 793601 - RNA, 12 nt, Homo sapiens
agcugggagcac

SEQ ID NO: 793602 - RNA, 20 nt, Homo sapiens
agcugggaugacuggcuuug

SEQ ID NO: 793603 - RNA, 14 nt, Homo sapiens
agcugggcaugcca

SEQ ID NO: 793604 - RNA, 16 nt, Homo sapiens
agcugggggaagaagg

SEQ ID NO: 793605 - RNA, 20 nt, Homo sapiens
agcuggguacugacugagau

SEQ ID NO: 793606 - RNA, 17 nt, Homo sapiens
agcuggguguguuggca

SEQ ID NO: 793607 - RNA, 18 nt, Homo sapiens
agcugguaaucuugcucu

SEQ ID NO: 793608 - RNA, 14 nt, Homo sapiens
agcuggucugggug

SEQ ID NO: 793609 - RNA, 14 nt, Homo sapiens
agcuggugagauca

SEQ ID NO: 793610 - RNA, 20 nt, Homo sapiens
agcuguaacccucacccaca

SEQ ID NO: 793611 - RNA, 23 nt, Homo sapiens
agcuguacccuugagaccuggaa

SEQ ID NO: 793612 - RNA, 23 nt, Homo sapiens
agcuguagaccaccuaauaucaa

SEQ ID NO: 793613 - RNA, 17 nt, Homo sapiens
agcuguagccauggcuc

SEQ ID NO: 793614 - RNA, 17 nt, Homo sapiens
agcugucagaacacucc

SEQ ID NO: 793615 - RNA, 18 nt, Homo sapiens
agcugucaggcugauuau

SEQ ID NO: 793616 - RNA, 14 nt, Homo sapiens
agcugucccauggg

SEQ ID NO: 793617 - RNA, 19 nt, Homo sapiens
agcugucccucacuguuga

SEQ ID NO: 793618 - RNA, 15 nt, Homo sapiens
agcugucgacuucau

SEQ ID NO: 793619 - RNA, 21 nt, Homo sapiens
agcugucuuccuguguaccuc

SEQ ID NO: 793620 - RNA, 19 nt, Homo sapiens
agcugugacauauucugag

SEQ ID NO: 793621 - RNA, 16 nt, Homo sapiens
agcugugcaggcaugg

SEQ ID NO: 793622 - RNA, 19 nt, Homo sapiens
agcuguggccagcuuguua

SEQ ID NO: 793623 - RNA, 17 nt, Homo sapiens
agcuguuccuguucagu

SEQ ID NO: 793624 - RNA, 17 nt, Homo sapiens
agcuguugugugagguu

SEQ ID NO: 793625 - RNA, 16 nt, Homo sapiens
agcuguuuucccugac

SEQ ID NO: 793626 - RNA, 18 nt, Homo sapiens
agcuuaaaccaacaauaa

SEQ ID NO: 793627 - RNA, 22 nt, Homo sapiens
agcuuaaaguuauguuauuaua

SEQ ID NO: 793628 - RNA, 15 nt, Homo sapiens
agcuuaagaaccauu

SEQ ID NO: 793629 - RNA, 15 nt, Homo sapiens
agcuuaauagcugua

SEQ ID NO: 793630 - RNA, 18 nt, Homo sapiens
agcuuaccugacacaaga

SEQ ID NO: 793631 - RNA, 14 nt, Homo sapiens
agcuuagaaugcau

SEQ ID NO: 793632 - RNA, 18 nt, Homo sapiens
agcuuagcaucagagguu

SEQ ID NO: 793633 - RNA, 22 nt, Homo sapiens
agcuuagccaaugugggagcag

SEQ ID NO: 793634 - RNA, 22 nt, Homo sapiens
agcuuagggaugagauacuuau

SEQ ID NO: 793635 - RNA, 20 nt, Homo sapiens
agcuuauaagagggcauaua

SEQ ID NO: 793636 - RNA, 22 nt, Homo sapiens
acuuuggaaccagacucuugcc

SEQ ID NO: 793637 - RNA, 22 nt, Homo sapiens
acuuuggaauguacucuguuca

SEQ ID NO: 793638 - RNA, 20 nt, Homo sapiens
acuuuggaggcaaaucuuuc

SEQ ID NO: 793639 - RNA, 19 nt, Homo sapiens
acuuuggcuucuccuguga

SEQ ID NO: 793640 - RNA, 19 nt, Homo sapiens
acuuugggcuuaguauuuc

SEQ ID NO: 793641 - RNA, 13 nt, Homo sapiens
acuuugugcauuc

SEQ ID NO: 793642 - RNA, 17 nt, Homo sapiens
acuuuguguucauuuca

SEQ ID NO: 793643 - RNA, 23 nt, Homo sapiens
acuuuguuugucacaaguggugu

SEQ ID NO: 793644 - RNA, 19 nt, Homo sapiens
acuuuuaaaaaauacucug

SEQ ID NO: 793645 - RNA, 17 nt, Homo sapiens
acuuuuaaguugcugau

SEQ ID NO: 793646 - RNA, 23 nt, Homo sapiens
acuuuuaaguugcugaugaacuc

SEQ ID NO: 793647 - RNA, 22 nt, Homo sapiens
acuuuuacacgaccauuugaua

SEQ ID NO: 793648 - RNA, 16 nt, Homo sapiens
acuuuuacucugccua

SEQ ID NO: 793649 - RNA, 17 nt, Homo sapiens
acuuuucaagcugcuga

SEQ ID NO: 793650 - RNA, 14 nt, Homo sapiens
acuuuucacacugu

SEQ ID NO: 793651 - RNA, 16 nt, Homo sapiens
acuuuucaccaaugag

SEQ ID NO: 793652 - RNA, 18 nt, Homo sapiens
acuuuucguuaacauuga

SEQ ID NO: 793653 - RNA, 15 nt, Homo sapiens
acuuuucugcugaua

SEQ ID NO: 793654 - RNA, 15 nt, Homo sapiens
acuuuugaccaaaua

SEQ ID NO: 793655 - RNA, 16 nt, Homo sapiens
acuuuuguaccaaaua

SEQ ID NO: 793656 - RNA, 14 nt, Homo sapiens
acuuuuucccucac

SEQ ID NO: 793657 - RNA, 17 nt, Homo sapiens
acuuuuuccuggcucau

SEQ ID NO: 793658 - RNA, 21 nt, Homo sapiens
acuuuuuccuggcucaucucu

SEQ ID NO: 793659 - RNA, 19 nt, Homo sapiens
acuuuuucugagcuuuuca

SEQ ID NO: 793660 - RNA, 15 nt, Homo sapiens
acuuuuugcauuuaa

SEQ ID NO: 793661 - RNA, 19 nt, Homo sapiens
acuuuuuuagaaaugcaaa

SEQ ID NO: 793662 - RNA, 18 nt, Homo sapiens
acuuuuuuuuuaaagcca

SEQ ID NO: 793663 - RNA, 20 nt, Homo sapiens
agaaaaaauaacacacauau

SEQ ID NO: 793664 - RNA, 12 nt, Homo sapiens
agaaaaaaucug

SEQ ID NO: 793665 - RNA, 15 nt, Homo sapiens
agaaaaacaugucau

SEQ ID NO: 793666 - RNA, 15 nt, Homo sapiens
agaaaaaggugccau

SEQ ID NO: 793667 - RNA, 13 nt, Homo sapiens
agaaaacauuucu

SEQ ID NO: 793668 - RNA, 17 nt, Homo sapiens
agaaaaccuagaucugc

SEQ ID NO: 793669 - RNA, 12 nt, Homo sapiens
agaaaagauuau

SEQ ID NO: 793670 - RNA, 12 nt, Homo sapiens
agaaaagcagac

SEQ ID NO: 793671 - RNA, 22 nt, Homo sapiens
agaaaagcccugcuuaugugug

SEQ ID NO: 793672 - RNA, 14 nt, Homo sapiens
agaaaagcugccau

SEQ ID NO: 793673 - RNA, 19 nt, Homo sapiens
agaaaaggacaaauaucuu

SEQ ID NO: 793674 - RNA, 12 nt, Homo sapiens
agaaaagggaug

SEQ ID NO: 793675 - RNA, 21 nt, Homo sapiens
agaaaaguagguuuacauuca

SEQ ID NO: 793676 - RNA, 15 nt, Homo sapiens
agaaaauacaauaaa

SEQ ID NO: 793677 - RNA, 12 nt, Homo sapiens
agaaaauaucuu

SEQ ID NO: 793678 - RNA, 17 nt, Homo sapiens
agaaaauauguauuaac

SEQ ID NO: 793679 - RNA, 15 nt, Homo sapiens
agaaaauauuacuua

SEQ ID NO: 793680 - RNA, 13 nt, Homo sapiens
agaaaaugcaguc

SEQ ID NO: 793681 - RNA, 14 nt, Homo sapiens
agaaaauugcacaa

SEQ ID NO: 793682 - RNA, 22 nt, Homo sapiens
agaaaauuggaacucuacucaa

SEQ ID NO: 793683 - RNA, 16 nt, Homo sapiens
agaaaauuguugugcu

SEQ ID NO: 793684 - RNA, 16 nt, Homo sapiens
agaaacaaacaucuaa

SEQ ID NO: 793685 - RNA, 14 nt, Homo sapiens
agaaacaagcugug

SEQ ID NO: 793686 - RNA, 21 nt, Homo sapiens
agaaacacauucuuauugaca

SEQ ID NO: 793687 - RNA, 22 nt, Homo sapiens
agaaacaccccucugucuagga

SEQ ID NO: 793688 - RNA, 18 nt, Homo sapiens
agaaacacuaagcucucu

SEQ ID NO: 793689 - RNA, 14 nt, Homo sapiens
agaaacacugccuu

SEQ ID NO: 793690 - RNA, 23 nt, Homo sapiens
agaaaccaagugcgcuuugcaau

SEQ ID NO: 793691 - RNA, 18 nt, Homo sapiens
agaaaccucuuuauccaa

SEQ ID NO: 793692 - RNA, 17 nt, Homo sapiens
agaaacuagcagauuug

SEQ ID NO: 793693 - RNA, 21 nt, Homo sapiens
agaaacuccuguuucuccuua

SEQ ID NO: 793694 - RNA, 19 nt, Homo sapiens
agaaacugggcagcccuga

SEQ ID NO: 793695 - RNA, 14 nt, Homo sapiens
agaaacuucccaag

SEQ ID NO: 793696 - RNA, 21 nt, Homo sapiens
agaaacuuucuggugcugucu

SEQ ID NO: 793697 - RNA, 15 nt, Homo sapiens
agaaagaaugcaaga

SEQ ID NO: 793698 - RNA, 15 nt, Homo sapiens
agaaagacuaucuaa

SEQ ID NO: 793699 - RNA, 23 nt, Homo sapiens
agaaagacuauucaaacagucuc

SEQ ID NO: 793700 - RNA, 14 nt, Homo sapiens
agaaagcaaacuua

SEQ ID NO: 793701 - RNA, 23 nt, Homo sapiens
agaaagcaaaugugaccuguguc

SEQ ID NO: 793702 - RNA, 19 nt, Homo sapiens
agaaagccucucucucccu

SEQ ID NO: 793703 - RNA, 20 nt, Homo sapiens
agaaagcucauggcuguguc

SEQ ID NO: 793704 - RNA, 19 nt, Homo sapiens
agaaagcuccuuccagacc

SEQ ID NO: 793705 - RNA, 20 nt, Homo sapiens
agaaagcugcacuggugcua

SEQ ID NO: 793706 - RNA, 14 nt, Homo sapiens
agaaaggcaaagua

SEQ ID NO: 793707 - RNA, 18 nt, Homo sapiens
agaaaggugugcugguca

SEQ ID NO: 793708 - RNA, 20 nt, Homo sapiens
agaaaggugugcuggucaug

SEQ ID NO: 793709 - RNA, 17 nt, Homo sapiens
agaaagguuuuauucua

SEQ ID NO: 793710 - RNA, 19 nt, Homo sapiens
agaaaguaaaaaguugcuu

SEQ ID NO: 793711 - RNA, 18 nt, Homo sapiens
agaaagugacauuugcuu

SEQ ID NO: 793712 - RNA, 13 nt, Homo sapiens
agaaagugccuga

SEQ ID NO: 793713 - RNA, 17 nt, Homo sapiens
agaaaguucaacuucca

SEQ ID NO: 793714 - RNA, 15 nt, Homo sapiens
agaaauaauaugcau

SEQ ID NO: 793715 - RNA, 20 nt, Homo sapiens
agaaauaauaugcauuguca

SEQ ID NO: 793716 - RNA, 13 nt, Homo sapiens
agaaauacuuuca

SEQ ID NO: 793717 - RNA, 17 nt, Homo sapiens
agaaauacuuucaggca

SEQ ID NO: 793718 - RNA, 22 nt, Homo sapiens
agaaauauacucucccagauuu

SEQ ID NO: 793719 - RNA, 19 nt, Homo sapiens
agaaaucaauaguugaauu

SEQ ID NO: 793720 - RNA, 14 nt, Homo sapiens
agaaaucaauggua

SEQ ID NO: 793721 - RNA, 22 nt, Homo sapiens
agaaaucaaugguagcauuuag

SEQ ID NO: 793722 - RNA, 17 nt, Homo sapiens
agaaaucauaguuuaaa

SEQ ID NO: 793723 - RNA, 14 nt, Homo sapiens
agaaauccauaucu

SEQ ID NO: 793724 - RNA, 13 nt, Homo sapiens
agaaaucccugag

SEQ ID NO: 793725 - RNA, 18 nt, Homo sapiens
agaaauccuaguaugcca

SEQ ID NO: 793726 - RNA, 14 nt, Homo sapiens
agaaaucuacugaa

SEQ ID NO: 793727 - RNA, 22 nt, Homo sapiens
agaaaucuccuaacaaaagaac

SEQ ID NO: 793728 - RNA, 21 nt, Homo sapiens
agaaaucugggauguacuguu

SEQ ID NO: 793729 - RNA, 19 nt, Homo sapiens
agaaaucuuucucccucaa

SEQ ID NO: 793730 - RNA, 12 nt, Homo sapiens
agaaaugaauag

SEQ ID NO: 793731 - RNA, 19 nt, Homo sapiens
agaaaugaauagacuaucu

SEQ ID NO: 793732 - RNA, 21 nt, Homo sapiens
agaaaugaauagacuaucuag

SEQ ID NO: 793733 - RNA, 18 nt, Homo sapiens
agaaaugaugauguggaa

SEQ ID NO: 793734 - RNA, 11 nt, Homo sapiens
agaaaugcaaa

SEQ ID NO: 793735 - RNA, 12 nt, Homo sapiens
agaaauggccaa

SEQ ID NO: 793736 - RNA, 22 nt, Homo sapiens
agaaauggccaaauauauuucc

SEQ ID NO: 793737 - RNA, 14 nt, Homo sapiens
agaaauguacuuag

SEQ ID NO: 793738 - RNA, 19 nt, Homo sapiens
agaaaugugucaucaggag

SEQ ID NO: 793739 - RNA, 17 nt, Homo sapiens
agaaauuaccuguggau

SEQ ID NO: 793740 - RNA, 23 nt, Homo sapiens
agaaauuaguuucaaauuuaccu

SEQ ID NO: 793741 - RNA, 12 nt, Homo sapiens
agaaauugauua

SEQ ID NO: 793742 - RNA, 17 nt, Homo sapiens
agaaauugugugugcaa

SEQ ID NO: 793743 - RNA, 23 nt, Homo sapiens
agaaauuugccuuguucaauaau

SEQ ID NO: 793744 - RNA, 21 nt, Homo sapiens
agaaauuuggcauugaucuua

SEQ ID NO: 793745 - RNA, 22 nt, Homo sapiens
ccccgucucuauaccaaccaaa

SEQ ID NO: 793746 - RNA, 15 nt, Homo sapiens
ccccgugacugcaau

SEQ ID NO: 793747 - RNA, 14 nt, Homo sapiens
ccccuaagagccau

SEQ ID NO: 793748 - RNA, 19 nt, Homo sapiens
ccccuaaucccagcacuuu

SEQ ID NO: 793749 - RNA, 13 nt, Homo sapiens
ccccuacaugaaa

SEQ ID NO: 793750 - RNA, 16 nt, Homo sapiens
ccccuacugcugugaa

SEQ ID NO: 793751 - RNA, 11 nt, Homo sapiens
ccccucaaaaa

SEQ ID NO: 793752 - RNA, 15 nt, Homo sapiens
ccccuccccaaagcc

SEQ ID NO: 793753 - RNA, 18 nt, Homo sapiens
ccccucgugcgcaucuca

SEQ ID NO: 793754 - RNA, 23 nt, Homo sapiens
ccccucguuagccuuccucugau

SEQ ID NO: 793755 - RNA, 18 nt, Homo sapiens
ccccugaccucacuguga

SEQ ID NO: 793756 - RNA, 24 nt, Homo sapiens
ccccugacgugcagccacacacag

SEQ ID NO: 793757 - RNA, 15 nt, Homo sapiens
ccccugauguuugaa

SEQ ID NO: 793758 - RNA, 17 nt, Homo sapiens
ccccugcgggcgcgggc

SEQ ID NO: 793759 - RNA, 18 nt, Homo sapiens
ccccuggaucuaccagca

SEQ ID NO: 793760 - RNA, 15 nt, Homo sapiens
ccccuggccacagua

SEQ ID NO: 793761 - RNA, 23 nt, Homo sapiens
ccccuggggcuucuccugaccca

SEQ ID NO: 793762 - RNA, 16 nt, Homo sapiens
ccccuguacauuugug

SEQ ID NO: 793763 - RNA, 14 nt, Homo sapiens
ccccuguaccuuuu

SEQ ID NO: 793764 - RNA, 18 nt, Homo sapiens
ccccugucuacucaucca

SEQ ID NO: 793765 - RNA, 22 nt, Homo sapiens
ccccugucucggggcuugcccc

SEQ ID NO: 793766 - RNA, 20 nt, Homo sapiens
ccccuguggccaacugcaaa

SEQ ID NO: 793767 - RNA, 16 nt, Homo sapiens
ccccugugucauccca

SEQ ID NO: 793768 - RNA, 14 nt, Homo sapiens
ccccuguugugugg

SEQ ID NO: 793769 - RNA, 21 nt, Homo sapiens
ccccuguuguguggacuuuga

SEQ ID NO: 793770 - RNA, 22 nt, Homo sapiens
ccccuuccagaucacugccaca

SEQ ID NO: 793771 - RNA, 16 nt, Homo sapiens
ccccuuccuucuuugu

SEQ ID NO: 793772 - RNA, 20 nt, Homo sapiens
ccccuugguacugaaaauga

SEQ ID NO: 793773 - RNA, 13 nt, Homo sapiens
cccgaacaccauu

SEQ ID NO: 793774 - RNA, 16 nt, Homo sapiens
cccgacuccucaaaag

SEQ ID NO: 793775 - RNA, 15 nt, Homo sapiens
cccgacugccugucu

SEQ ID NO: 793776 - RNA, 17 nt, Homo sapiens
cccgagggcgccaugca

SEQ ID NO: 793777 - RNA, 18 nt, Homo sapiens
cccgaguaacugagauua

SEQ ID NO: 793778 - RNA, 15 nt, Homo sapiens
cccgagugagcaugg

SEQ ID NO: 793779 - RNA, 17 nt, Homo sapiens
cccgcagggccaugcag

SEQ ID NO: 793780 - RNA, 21 nt, Homo sapiens
cccgccaccucagggcacgca

SEQ ID NO: 793781 - RNA, 19 nt, Homo sapiens
cccggagguugggugggcc

SEQ ID NO: 793782 - RNA, 18 nt, Homo sapiens
cccggaguaaucaggcag

SEQ ID NO: 793783 - RNA, 22 nt, Homo sapiens
cccggggcuggcggcuacucag

SEQ ID NO: 793784 - RNA, 16 nt, Homo sapiens
cccgggggugaagggg

SEQ ID NO: 793785 - RNA, 23 nt, Homo sapiens
cccggugggacccccguggggca

SEQ ID NO: 793786 - RNA, 15 nt, Homo sapiens
cccguacuagguugg

SEQ ID NO: 793787 - RNA, 22 nt, Homo sapiens
cccgucauguuccucaaaagca

SEQ ID NO: 793788 - RNA, 20 nt, Homo sapiens
cccgugacuguuacuuuaua

SEQ ID NO: 793789 - RNA, 13 nt, Homo sapiens
cccgugucuccag

SEQ ID NO: 793790 - RNA, 22 nt, Homo sapiens
cccguuucuuaaaaaacauaua

SEQ ID NO: 793791 - RNA, 23 nt, Homo sapiens
cccguuucuuaaaaaacauauau

SEQ ID NO: 793792 - RNA, 10 nt, Homo sapiens
cccuaaggga

SEQ ID NO: 793793 - RNA, 13 nt, Homo sapiens
cccuacacuguga

SEQ ID NO: 793794 - RNA, 17 nt, Homo sapiens
cccuacagccugcacac

SEQ ID NO: 793795 - RNA, 9 nt, Homo sapiens
cccuaccuu

SEQ ID NO: 793796 - RNA, 21 nt, Homo sapiens
cccuagagagaauaaauugga

SEQ ID NO: 793797 - RNA, 21 nt, Homo sapiens
cccuagcagcccacccugcug

SEQ ID NO: 793798 - RNA, 17 nt, Homo sapiens
cccuagcauugcacuug

SEQ ID NO: 793799 - RNA, 23 nt, Homo sapiens
cccuaucucgaacauggaacuca

SEQ ID NO: 793800 - RNA, 14 nt, Homo sapiens
cccucaaaucugag

SEQ ID NO: 793801 - RNA, 17 nt, Homo sapiens
cccucaaaucugaggga

SEQ ID NO: 793802 - RNA, 19 nt, Homo sapiens
cccucaccugguaccugga

SEQ ID NO: 793803 - RNA, 19 nt, Homo sapiens
cccucacuauugaugcauu

SEQ ID NO: 793804 - RNA, 14 nt, Homo sapiens
cccucagugagaua

SEQ ID NO: 793805 - RNA, 13 nt, Homo sapiens
cccucaugaaaac

SEQ ID NO: 793806 - RNA, 14 nt, Homo sapiens
cccuccacauuucc

SEQ ID NO: 793807 - RNA, 14 nt, Homo sapiens
cccuccaguccucu

SEQ ID NO: 793808 - RNA, 22 nt, Homo sapiens
cccuccauucauccuuccaucc

SEQ ID NO: 793809 - RNA, 14 nt, Homo sapiens
cccucccaccacuc

SEQ ID NO: 793810 - RNA, 22 nt, Homo sapiens
cccucccaguuacguuguguau

SEQ ID NO: 793811 - RNA, 23 nt, Homo sapiens
cccuccccaacaccccacugagc

SEQ ID NO: 793812 - RNA, 18 nt, Homo sapiens
cccucccuggcugugagc

SEQ ID NO: 793813 - RNA, 20 nt, Homo sapiens
cccucccuguuccccagaga

SEQ ID NO: 793814 - RNA, 14 nt, Homo sapiens
cccucccuuucucc

SEQ ID NO: 793815 - RNA, 14 nt, Homo sapiens
cccuccgaccacuu

SEQ ID NO: 793816 - RNA, 21 nt, Homo sapiens
cccuccucagauggggcacca

SEQ ID NO: 793817 - RNA, 13 nt, Homo sapiens
cccuccugcuccu

SEQ ID NO: 793818 - RNA, 15 nt, Homo sapiens
cccucgcaugacugu

SEQ ID NO: 793819 - RNA, 19 nt, Homo sapiens
cccucgcaugacuguuaca

SEQ ID NO: 793820 - RNA, 17 nt, Homo sapiens
cccucgcgcccaaaaga

SEQ ID NO: 793821 - RNA, 16 nt, Homo sapiens
cccucucucaguguca

SEQ ID NO: 793822 - RNA, 22 nt, Homo sapiens
cccucugccccaucauugcacc

SEQ ID NO: 793823 - RNA, 19 nt, Homo sapiens
cccucuggucuacucuaga

SEQ ID NO: 793824 - RNA, 15 nt, Homo sapiens
cccucugucuuguga

SEQ ID NO: 793825 - RNA, 16 nt, Homo sapiens
cccucuucauggaugg

SEQ ID NO: 793826 - RNA, 15 nt, Homo sapiens
cccucuuccugugau

SEQ ID NO: 793827 - RNA, 18 nt, Homo sapiens
cccucuucucuuuugccc

SEQ ID NO: 793828 - RNA, 17 nt, Homo sapiens
cccucuuucacuucaua

SEQ ID NO: 793829 - RNA, 19 nt, Homo sapiens
cccucuuuguuucugcuuc

SEQ ID NO: 793830 - RNA, 23 nt, Homo sapiens
cccucuuuguuucugcuucauuu

SEQ ID NO: 793831 - RNA, 22 nt, Homo sapiens
cccucuuuucugaucugcaguu

SEQ ID NO: 793832 - RNA, 17 nt, Homo sapiens
cccugaaaacccagaga

SEQ ID NO: 793833 - RNA, 15 nt, Homo sapiens
cccugaaauuucuca

SEQ ID NO: 793834 - RNA, 16 nt, Homo sapiens
cccugaacucccagaa

SEQ ID NO: 793835 - RNA, 21 nt, Homo sapiens
cccugaacucccagaaccacu

SEQ ID NO: 793836 - RNA, 20 nt, Homo sapiens
cccugaccucacugugaccu

SEQ ID NO: 793837 - RNA, 15 nt, Homo sapiens
cccugacgugcagcc

SEQ ID NO: 793838 - RNA, 17 nt, Homo sapiens
cccugacuggccaaacc

SEQ ID NO: 793839 - RNA, 16 nt, Homo sapiens
cccugagacaaaugga

SEQ ID NO: 793840 - RNA, 13 nt, Homo sapiens
acugccuuugcag

SEQ ID NO: 793841 - RNA, 14 nt, Homo sapiens
acugcgacugugac

SEQ ID NO: 793842 - RNA, 17 nt, Homo sapiens
acugcuacaaucaaggc

SEQ ID NO: 793843 - RNA, 18 nt, Homo sapiens
acugcucuguguuuacag

SEQ ID NO: 793844 - RNA, 19 nt, Homo sapiens
acugcugcuagagccagca

SEQ ID NO: 793845 - RNA, 19 nt, Homo sapiens
acugcuggaaaaagcccua

SEQ ID NO: 793846 - RNA, 23 nt, Homo sapiens
acugcuguaacugguaguguuca

SEQ ID NO: 793847 - RNA, 20 nt, Homo sapiens
acugcuguucauguuacuca

SEQ ID NO: 793848 - RNA, 23 nt, Homo sapiens
acugcuuaaauuccaaguccuga

SEQ ID NO: 793849 - RNA, 17 nt, Homo sapiens
acugcuucccacugggg

SEQ ID NO: 793850 - RNA, 18 nt, Homo sapiens
acugcuuuucaguucugu

SEQ ID NO: 793851 - RNA, 21 nt, Homo sapiens
acugcuuuuccucaagcaaua

SEQ ID NO: 793852 - RNA, 22 nt, Homo sapiens
acuggaaaaaaauacaaaaagc

SEQ ID NO: 793853 - RNA, 13 nt, Homo sapiens
acuggaaaccuaa

SEQ ID NO: 793854 - RNA, 19 nt, Homo sapiens
acuggaaauguagcacuua

SEQ ID NO: 793855 - RNA, 17 nt, Homo sapiens
acuggaaccaccuggac

SEQ ID NO: 793856 - RNA, 20 nt, Homo sapiens
acuggaaccaccuggacgaa

SEQ ID NO: 793857 - RNA, 23 nt, Homo sapiens
acuggaauauaauuucaaaccac

SEQ ID NO: 793858 - RNA, 13 nt, Homo sapiens
acuggacccuguu

SEQ ID NO: 793859 - RNA, 18 nt, Homo sapiens
acuggacugugugcaacg

SEQ ID NO: 793860 - RNA, 19 nt, Homo sapiens
acuggagccccaucagcuc

SEQ ID NO: 793861 - RNA, 13 nt, Homo sapiens
acuggaguccagu

SEQ ID NO: 793862 - RNA, 17 nt, Homo sapiens
acuggaguccagucucu

SEQ ID NO: 793863 - RNA, 15 nt, Homo sapiens
acuggaguuccuuau

SEQ ID NO: 793864 - RNA, 16 nt, Homo sapiens
acuggauauguuguua

SEQ ID NO: 793865 - RNA, 19 nt, Homo sapiens
acuggauucuuaaccaaga

SEQ ID NO: 793866 - RNA, 22 nt, Homo sapiens
acuggcacaguuuucugagaaa

SEQ ID NO: 793867 - RNA, 14 nt, Homo sapiens
acuggccaugguga

SEQ ID NO: 793868 - RNA, 17 nt, Homo sapiens
acuggcgccuucucgga

SEQ ID NO: 793869 - RNA, 22 nt, Homo sapiens
acuggcuaccgaaguaaacuga

SEQ ID NO: 793870 - RNA, 13 nt, Homo sapiens
acuggcugugaga

SEQ ID NO: 793871 - RNA, 17 nt, Homo sapiens
acuggcuucucuugagu

SEQ ID NO: 793872 - RNA, 14 nt, Homo sapiens
acugggaaucaaga

SEQ ID NO: 793873 - RNA, 22 nt, Homo sapiens
acugggacagcccaggaaacaa

SEQ ID NO: 793874 - RNA, 20 nt, Homo sapiens
acugggcuccggaggacuca

SEQ ID NO: 793875 - RNA, 17 nt, Homo sapiens
acugggugguccaaaga

SEQ ID NO: 793876 - RNA, 17 nt, Homo sapiens
acugguaaaaagaucca

SEQ ID NO: 793877 - RNA, 13 nt, Homo sapiens
acugguaaagccu

SEQ ID NO: 793878 - RNA, 22 nt, Homo sapiens
acugguauguguggaugaugcu

SEQ ID NO: 793879 - RNA, 23 nt, Homo sapiens
acugguggaucuaagaagggcug

SEQ ID NO: 793880 - RNA, 17 nt, Homo sapiens
acugguuugccaggcca

SEQ ID NO: 793881 - RNA, 21 nt, Homo sapiens
acugguuugccaggccaaugu

SEQ ID NO: 793882 - RNA, 17 nt, Homo sapiens
acuguaaaaugugggau

SEQ ID NO: 793883 - RNA, 17 nt, Homo sapiens
acuguaacugacugccu

SEQ ID NO: 793884 - RNA, 18 nt, Homo sapiens
acuguaacugacugccuu

SEQ ID NO: 793885 - RNA, 18 nt, Homo sapiens
acuguaagcuccaugagg

SEQ ID NO: 793886 - RNA, 14 nt, Homo sapiens
acuguaagggauug

SEQ ID NO: 793887 - RNA, 21 nt, Homo sapiens
acuguaauggguaauucugac

SEQ ID NO: 793888 - RNA, 12 nt, Homo sapiens
acuguacauaaa

SEQ ID NO: 793889 - RNA, 17 nt, Homo sapiens
acuguacauugugagcu

SEQ ID NO: 793890 - RNA, 16 nt, Homo sapiens
acuguagcugaugaaa

SEQ ID NO: 793891 - RNA, 15 nt, Homo sapiens
acuguaucaagucau

SEQ ID NO: 793892 - RNA, 17 nt, Homo sapiens
acuguaucaagucaugg

SEQ ID NO: 793893 - RNA, 18 nt, Homo sapiens
acuguaugccucugagca

SEQ ID NO: 793894 - RNA, 16 nt, Homo sapiens
acuguauuccugucau

SEQ ID NO: 793895 - RNA, 18 nt, Homo sapiens
acuguauuugaaauaaga

SEQ ID NO: 793896 - RNA, 18 nt, Homo sapiens
acugucagcugagcuuga

SEQ ID NO: 793897 - RNA, 12 nt, Homo sapiens
acugucaggguu

SEQ ID NO: 793898 - RNA, 14 nt, Homo sapiens
acugucauagaaau

SEQ ID NO: 793899 - RNA, 17 nt, Homo sapiens
acugucauccucaaaga

SEQ ID NO: 793900 - RNA, 13 nt, Homo sapiens
acugucauguggc

SEQ ID NO: 793901 - RNA, 20 nt, Homo sapiens
acuguccagcuuauagucuu

SEQ ID NO: 793902 - RNA, 14 nt, Homo sapiens
acugucccuugccu

SEQ ID NO: 793903 - RNA, 19 nt, Homo sapiens
acuguccuguccugcucau

SEQ ID NO: 793904 - RNA, 21 nt, Homo sapiens
acugucuccacccaccuugac

SEQ ID NO: 793905 - RNA, 12 nt, Homo sapiens
acugucuuucag

SEQ ID NO: 793906 - RNA, 22 nt, Homo sapiens
acugugaaccaacccccaucuc

SEQ ID NO: 793907 - RNA, 21 nt, Homo sapiens
acugugaccuagagacuucac

SEQ ID NO: 793908 - RNA, 23 nt, Homo sapiens
acugugagcaaggagcacaagcc

SEQ ID NO: 793909 - RNA, 18 nt, Homo sapiens
acugugaggguaaaggcu

SEQ ID NO: 793910 - RNA, 19 nt, Homo sapiens
acugugauuagaucacauc

SEQ ID NO: 793911 - RNA, 20 nt, Homo sapiens
acugugccaacuacuacugg

SEQ ID NO: 793912 - RNA, 24 nt, Homo sapiens
acuguggaaaugccaaaccaagca

SEQ ID NO: 793913 - RNA, 20 nt, Homo sapiens
acuguggagacuuucuguua

SEQ ID NO: 793914 - RNA, 23 nt, Homo sapiens
acuguggagacuuucuguuacua

SEQ ID NO: 793915 - RNA, 21 nt, Homo sapiens
acuguggcuagugacaaauaa

SEQ ID NO: 793916 - RNA, 20 nt, Homo sapiens
acuguggcugcuagcacuug

SEQ ID NO: 793917 - RNA, 17 nt, Homo sapiens
acugugguacugaugga

SEQ ID NO: 793918 - RNA, 13 nt, Homo sapiens
acuguguacugug

SEQ ID NO: 793919 - RNA, 15 nt, Homo sapiens
acuguguacugugga

SEQ ID NO: 793920 - RNA, 16 nt, Homo sapiens
acuguguauuccaaga

SEQ ID NO: 793921 - RNA, 15 nt, Homo sapiens
acugugucucaugga

SEQ ID NO: 793922 - RNA, 22 nt, Homo sapiens
acuguguguuuucccaaagcac

SEQ ID NO: 793923 - RNA, 23 nt, Homo sapiens
acuguguugggcaagaccucuuc

SEQ ID NO: 793924 - RNA, 18 nt, Homo sapiens
acuguguuucgcauuaag

SEQ ID NO: 793925 - RNA, 18 nt, Homo sapiens
acuguguuuuuccuccau

SEQ ID NO: 793926 - RNA, 13 nt, Homo sapiens
acuguuacuuugg

SEQ ID NO: 793927 - RNA, 13 nt, Homo sapiens
acuguucaucuca

SEQ ID NO: 793928 - RNA, 10 nt, Homo sapiens
acuguugaaa

SEQ ID NO: 793929 - RNA, 12 nt, Homo sapiens
acuguugcacug

SEQ ID NO: 793930 - RNA, 20 nt, Homo sapiens
acuguuuauacacuguguaa

SEQ ID NO: 793931 - RNA, 21 nt, Homo sapiens
acuguuuccccagagcaggag

SEQ ID NO: 793932 - RNA, 20 nt, Homo sapiens
acuuaaaaaauguccaugau

SEQ ID NO: 793933 - RNA, 13 nt, Homo sapiens
acuuaacacuucu

SEQ ID NO: 793934 - RNA, 14 nt, Homo sapiens
acuuaaccuugcaa

SEQ ID NO: 793935 - RNA, 17 nt, Homo sapiens
acuuaacggaccaaagc

SEQ ID NO: 793936 - RNA, 15 nt, Homo sapiens
acuuaagaagccuua

SEQ ID NO: 793937 - RNA, 21 nt, Homo sapiens
acuuaagcaucuggcucuaau

SEQ ID NO: 793938 - RNA, 23 nt, Homo sapiens
acuuaagguuaccuuuguuccca

SEQ ID NO: 793939 - RNA, 17 nt, Homo sapiens
acuuaagucuuccuuaa

SEQ ID NO: 793940 - RNA, 15 nt, Homo sapiens
acuuaagugcacuuu

SEQ ID NO: 793941 - RNA, 17 nt, Homo sapiens
acuuaaguggcauuaaa

SEQ ID NO: 793942 - RNA, 23 nt, Homo sapiens
acuuaauguuuguaagacuuaca

SEQ ID NO: 793943 - RNA, 16 nt, Homo sapiens
acuuaauucugauuag

SEQ ID NO: 793944 - RNA, 19 nt, Homo sapiens
acuuaccgagucagacuuu

SEQ ID NO: 793945 - RNA, 23 nt, Homo sapiens
acuuagaaauugcauuuccugac

SEQ ID NO: 793946 - RNA, 17 nt, Homo sapiens
acuuagaagaaaucauu

SEQ ID NO: 793947 - RNA, 23 nt, Homo sapiens
acuuagaucaucagucaccgaag

SEQ ID NO: 793948 - RNA, 15 nt, Homo sapiens
acuuagcagaaccac

SEQ ID NO: 793949 - RNA, 18 nt, Homo sapiens
acuuagcaucuaauuuca

SEQ ID NO: 793950 - RNA, 22 nt, Homo sapiens
cacaugggaguuuagugugaua

SEQ ID NO: 793951 - RNA, 18 nt, Homo sapiens
cacauggugugaguccaa

SEQ ID NO: 793952 - RNA, 20 nt, Homo sapiens
cacaugucuuguacaugugu

SEQ ID NO: 793953 - RNA, 17 nt, Homo sapiens
cacaugugacacauaug

SEQ ID NO: 793954 - RNA, 18 nt, Homo sapiens
cacaugugacacauaugc

SEQ ID NO: 793955 - RNA, 21 nt, Homo sapiens
cacaugugagcaugucacuuc

SEQ ID NO: 793956 - RNA, 13 nt, Homo sapiens
cacaugugcaguc

SEQ ID NO: 793957 - RNA, 18 nt, Homo sapiens
cacaugugccacacagug

SEQ ID NO: 793958 - RNA, 14 nt, Homo sapiens
cacauguggccaug

SEQ ID NO: 793959 - RNA, 17 nt, Homo sapiens
cacauguguaugauacu

SEQ ID NO: 793960 - RNA, 23 nt, Homo sapiens
cacauguguuucugucucuccau

SEQ ID NO: 793961 - RNA, 22 nt, Homo sapiens
cacauguugccuugcauuugug

SEQ ID NO: 793962 - RNA, 18 nt, Homo sapiens
cacauguuguucucauug

SEQ ID NO: 793963 - RNA, 15 nt, Homo sapiens
cacauuaacucccuc

SEQ ID NO: 793964 - RNA, 16 nt, Homo sapiens
cacauuacgugcuccc

SEQ ID NO: 793965 - RNA, 23 nt, Homo sapiens
cacauuaucgggagcagugucuu

SEQ ID NO: 793966 - RNA, 13 nt, Homo sapiens
cacauugauguaa

SEQ ID NO: 793967 - RNA, 12 nt, Homo sapiens
cacauugcccau

SEQ ID NO: 793968 - RNA, 15 nt, Homo sapiens
cacauugugccuuuu

SEQ ID NO: 793969 - RNA, 20 nt, Homo sapiens
cacauuucccccuagccugc

SEQ ID NO: 793970 - RNA, 15 nt, Homo sapiens
cacauuucuaugcca

SEQ ID NO: 793971 - RNA, 17 nt, Homo sapiens
cacauuucuaugccaaa

SEQ ID NO: 793972 - RNA, 13 nt, Homo sapiens
cacauuuuacucu

SEQ ID NO: 793973 - RNA, 15 nt, Homo sapiens
caccaaaacgaugaa

SEQ ID NO: 793974 - RNA, 15 nt, Homo sapiens
caccaaagacaucag

SEQ ID NO: 793975 - RNA, 13 nt, Homo sapiens
caccaaagccacc

SEQ ID NO: 793976 - RNA, 14 nt, Homo sapiens
caccaaagcugccc

SEQ ID NO: 793977 - RNA, 18 nt, Homo sapiens
caccaaccuuccaagugu

SEQ ID NO: 793978 - RNA, 22 nt, Homo sapiens
caccaaccuuccaaguguaaaa

SEQ ID NO: 793979 - RNA, 20 nt, Homo sapiens
caccaagaggguggaucaca

SEQ ID NO: 793980 - RNA, 19 nt, Homo sapiens
caccaagaucaagcagaga

SEQ ID NO: 793981 - RNA, 20 nt, Homo sapiens
caccaaggaacucuacuuca

SEQ ID NO: 793982 - RNA, 22 nt, Homo sapiens
caccaaguaccaguauaagcau

SEQ ID NO: 793983 - RNA, 16 nt, Homo sapiens
caccaaugaaaacaug

SEQ ID NO: 793984 - RNA, 21 nt, Homo sapiens
caccaaugaaaacauguacua

SEQ ID NO: 793985 - RNA, 23 nt, Homo sapiens
caccacaacaagcaagugcauuu

SEQ ID NO: 793986 - RNA, 16 nt, Homo sapiens
caccacaccuggcuaa

SEQ ID NO: 793987 - RNA, 13 nt, Homo sapiens
caccaccacuuac

SEQ ID NO: 793988 - RNA, 15 nt, Homo sapiens
caccacccacuugau

SEQ ID NO: 793989 - RNA, 15 nt, Homo sapiens
caccaccuccagcuu

SEQ ID NO: 793990 - RNA, 16 nt, Homo sapiens
caccaccuucccagcu

SEQ ID NO: 793991 - RNA, 13 nt, Homo sapiens
caccaccuugcca

SEQ ID NO: 793992 - RNA, 18 nt, Homo sapiens
caccacgggacaucacag

SEQ ID NO: 793993 - RNA, 20 nt, Homo sapiens
caccacgugcaguaucucaa

SEQ ID NO: 793994 - RNA, 14 nt, Homo sapiens
caccacuggccacc

SEQ ID NO: 793995 - RNA, 12 nt, Homo sapiens
caccacuguaua

SEQ ID NO: 793996 - RNA, 20 nt, Homo sapiens
caccagagcauuuccaacac

SEQ ID NO: 793997 - RNA, 21 nt, Homo sapiens
caccagaggucagguguucaa

SEQ ID NO: 793998 - RNA, 15 nt, Homo sapiens
caccagcagcacugg

SEQ ID NO: 793999 - RNA, 18 nt, Homo sapiens
caccagcccugaccccag

SEQ ID NO: 794000 - RNA, 20 nt, Homo sapiens
caccagcccugaccccagug

SEQ ID NO: 794001 - RNA, 19 nt, Homo sapiens
caccaggacugaaagaaga

SEQ ID NO: 794002 - RNA, 19 nt, Homo sapiens
caccauacacauucuuaga

SEQ ID NO: 794003 - RNA, 13 nt, Homo sapiens
caccauauugcua

SEQ ID NO: 794004 - RNA, 18 nt, Homo sapiens
caccaucucuuuaccucc

SEQ ID NO: 794005 - RNA, 19 nt, Homo sapiens
caccaucucuuuaccuccu

SEQ ID NO: 794006 - RNA, 14 nt, Homo sapiens
caccaucuggaguu

SEQ ID NO: 794007 - RNA, 18 nt, Homo sapiens
caccaucuucuauucaaa

SEQ ID NO: 794008 - RNA, 14 nt, Homo sapiens
caccaugcugcagg

SEQ ID NO: 794009 - RNA, 18 nt, Homo sapiens
caccaugcugcuggggaa

SEQ ID NO: 794010 - RNA, 16 nt, Homo sapiens
caccauucccugccuu

SEQ ID NO: 794011 - RNA, 23 nt, Homo sapiens
cacccaaaagucaaaaggugccu

SEQ ID NO: 794012 - RNA, 15 nt, Homo sapiens
cacccaacaagccau

SEQ ID NO: 794013 - RNA, 22 nt, Homo sapiens
cacccaacccuaucuccugaca

SEQ ID NO: 794014 - RNA, 17 nt, Homo sapiens
cacccaaguauuuuaaa

SEQ ID NO: 794015 - RNA, 12 nt, Homo sapiens
cacccaccagag

SEQ ID NO: 794016 - RNA, 15 nt, Homo sapiens
cacccacgcauauac

SEQ ID NO: 794017 - RNA, 12 nt, Homo sapiens
cacccacugacc

SEQ ID NO: 794018 - RNA, 15 nt, Homo sapiens
cacccacuuugucca

SEQ ID NO: 794019 - RNA, 22 nt, Homo sapiens
cacccaggcccgcaccgcuggg

SEQ ID NO: 794020 - RNA, 15 nt, Homo sapiens
cacccaggcugcacu

SEQ ID NO: 794021 - RNA, 18 nt, Homo sapiens
cacccaggcuggagugca

SEQ ID NO: 794022 - RNA, 16 nt, Homo sapiens
cacccagugacugaca

SEQ ID NO: 794023 - RNA, 15 nt, Homo sapiens
cacccagugcugaau

SEQ ID NO: 794024 - RNA, 21 nt, Homo sapiens
cacccaguuggugacugggaa

SEQ ID NO: 794025 - RNA, 16 nt, Homo sapiens
cacccaucuuccugcu

SEQ ID NO: 794026 - RNA, 19 nt, Homo sapiens
cacccaugaaccuacuacc

SEQ ID NO: 794027 - RNA, 13 nt, Homo sapiens
cacccaugcaagc

SEQ ID NO: 794028 - RNA, 15 nt, Homo sapiens
cacccaugccagaga

SEQ ID NO: 794029 - RNA, 16 nt, Homo sapiens
cacccaugccagagag

SEQ ID NO: 794030 - RNA, 12 nt, Homo sapiens
caccccaagaga

SEQ ID NO: 794031 - RNA, 18 nt, Homo sapiens
auucuuauguugaauaug

SEQ ID NO: 794032 - RNA, 18 nt, Homo sapiens
auucuuauuucacuaaau

SEQ ID NO: 794033 - RNA, 21 nt, Homo sapiens
auucuucagauacaaacugca

SEQ ID NO: 794034 - RNA, 17 nt, Homo sapiens
auucuuccaucaucacu

SEQ ID NO: 794035 - RNA, 21 nt, Homo sapiens
auucuucugagcacuguuuau

SEQ ID NO: 794036 - RNA, 15 nt, Homo sapiens
auucuugaguucugg

SEQ ID NO: 794037 - RNA, 15 nt, Homo sapiens
auucuuguaguuuac

SEQ ID NO: 794038 - RNA, 20 nt, Homo sapiens
auucuuguaguuuaccucuu

SEQ ID NO: 794039 - RNA, 14 nt, Homo sapiens
auucuuguuauacc

SEQ ID NO: 794040 - RNA, 19 nt, Homo sapiens
auucuuguuuuaagugccu

SEQ ID NO: 794041 - RNA, 14 nt, Homo sapiens
auucuuuaccucag

SEQ ID NO: 794042 - RNA, 17 nt, Homo sapiens
auucuuuaccucagguu

SEQ ID NO: 794043 - RNA, 13 nt, Homo sapiens
auucuuuccccag

SEQ ID NO: 794044 - RNA, 15 nt, Homo sapiens
auucuuugaccuguu

SEQ ID NO: 794045 - RNA, 14 nt, Homo sapiens
auucuuugcaagau

SEQ ID NO: 794046 - RNA, 14 nt, Homo sapiens
auucuuuguuacag

SEQ ID NO: 794047 - RNA, 23 nt, Homo sapiens
auugaaaacagauauuacagcuu

SEQ ID NO: 794048 - RNA, 20 nt, Homo sapiens
auugaaaacagugucuugag

SEQ ID NO: 794049 - RNA, 17 nt, Homo sapiens
auugaaaggcauucucu

SEQ ID NO: 794050 - RNA, 23 nt, Homo sapiens
auugaaauaaaugacaauguaau

SEQ ID NO: 794051 - RNA, 14 nt, Homo sapiens
auugaacucugaga

SEQ ID NO: 794052 - RNA, 21 nt, Homo sapiens
auugaaggaaagcuauaucua

SEQ ID NO: 794053 - RNA, 21 nt, Homo sapiens
auugaaugauuacuauaugca

SEQ ID NO: 794054 - RNA, 13 nt, Homo sapiens
auugaauguggua

SEQ ID NO: 794055 - RNA, 21 nt, Homo sapiens
auugaauuauauguucagauu

SEQ ID NO: 794056 - RNA, 14 nt, Homo sapiens
auugacaacugcac

SEQ ID NO: 794057 - RNA, 22 nt, Homo sapiens
auugacaacugcacaugaaagu

SEQ ID NO: 794058 - RNA, 17 nt, Homo sapiens
auugacacacagcacuc

SEQ ID NO: 794059 - RNA, 12 nt, Homo sapiens
auugacacugaa

SEQ ID NO: 794060 - RNA, 12 nt, Homo sapiens
auugacauuugu

SEQ ID NO: 794061 - RNA, 19 nt, Homo sapiens
auugaccaagaacugcaug

SEQ ID NO: 794062 - RNA, 22 nt, Homo sapiens
auugaccaagaacugcauggac

SEQ ID NO: 794063 - RNA, 15 nt, Homo sapiens
auugaccagcucucu

SEQ ID NO: 794064 - RNA, 15 nt, Homo sapiens
auugaccuacuuugg

SEQ ID NO: 794065 - RNA, 14 nt, Homo sapiens
auugaccucagcug

SEQ ID NO: 794066 - RNA, 15 nt, Homo sapiens
auugacgaacuggcu

SEQ ID NO: 794067 - RNA, 14 nt, Homo sapiens
auugacgacuucac

SEQ ID NO: 794068 - RNA, 20 nt, Homo sapiens
auugacuaacaggccaaaga

SEQ ID NO: 794069 - RNA, 12 nt, Homo sapiens
auugacucugca

SEQ ID NO: 794070 - RNA, 18 nt, Homo sapiens
auugacuuugacaauuac

SEQ ID NO: 794071 - RNA, 22 nt, Homo sapiens
auugagaaagauguuccaguga

SEQ ID NO: 794072 - RNA, 15 nt, Homo sapiens
auugagaacugcaua

SEQ ID NO: 794073 - RNA, 22 nt, Homo sapiens
auugagaagaucggaacagcuc

SEQ ID NO: 794074 - RNA, 15 nt, Homo sapiens
auugagaagccaugu

SEQ ID NO: 794075 - RNA, 14 nt, Homo sapiens
auugagaccugagu

SEQ ID NO: 794076 - RNA, 16 nt, Homo sapiens
auugagaccugaguga

SEQ ID NO: 794077 - RNA, 19 nt, Homo sapiens
auugagauaauaucuguga

SEQ ID NO: 794078 - RNA, 20 nt, Homo sapiens
auugagauaaugauacuuaa

SEQ ID NO: 794079 - RNA, 17 nt, Homo sapiens
auugagcaguuagcuca

SEQ ID NO: 794080 - RNA, 17 nt, Homo sapiens
auugagccaguggugcu

SEQ ID NO: 794081 - RNA, 18 nt, Homo sapiens
auugagccaguggugcua

SEQ ID NO: 794082 - RNA, 15 nt, Homo sapiens
auugaguuuuuacaa

SEQ ID NO: 794083 - RNA, 14 nt, Homo sapiens
auugauaaguucau

SEQ ID NO: 794084 - RNA, 17 nt, Homo sapiens
auugauaaguucauaca

SEQ ID NO: 794085 - RNA, 21 nt, Homo sapiens
auugaucuuuugcuaaugcaa

SEQ ID NO: 794086 - RNA, 19 nt, Homo sapiens
auugauuauaagcauguau

SEQ ID NO: 794087 - RNA, 15 nt, Homo sapiens
auugcaaagguucca

SEQ ID NO: 794088 - RNA, 17 nt, Homo sapiens
auugcaacaaaauacau

SEQ ID NO: 794089 - RNA, 16 nt, Homo sapiens
auugcaagaguuuaau

SEQ ID NO: 794090 - RNA, 13 nt, Homo sapiens
auugcacaaguuc

SEQ ID NO: 794091 - RNA, 14 nt, Homo sapiens
auugcacuccaguc

SEQ ID NO: 794092 - RNA, 19 nt, Homo sapiens
auugcacucuagccuggca

SEQ ID NO: 794093 - RNA, 15 nt, Homo sapiens
auugcacugcuguuc

SEQ ID NO: 794094 - RNA, 16 nt, Homo sapiens
auugcagaauucaaaa

SEQ ID NO: 794095 - RNA, 13 nt, Homo sapiens
auugcagacuguu

SEQ ID NO: 794096 - RNA, 15 nt, Homo sapiens
auugcaucaguucau

SEQ ID NO: 794097 - RNA, 17 nt, Homo sapiens
auugcaucccaaaccac

SEQ ID NO: 794098 - RNA, 13 nt, Homo sapiens
auugcaugacaaa

SEQ ID NO: 794099 - RNA, 16 nt, Homo sapiens
auugcauuucugcucu

SEQ ID NO: 794100 - RNA, 20 nt, Homo sapiens
auugccaccaggagaaccac

SEQ ID NO: 794101 - RNA, 14 nt, Homo sapiens
auugccugcagauu

SEQ ID NO: 794102 - RNA, 16 nt, Homo sapiens
gaugggaaacugcuuu

SEQ ID NO: 794103 - RNA, 13 nt, Homo sapiens
gaugggaucccag

SEQ ID NO: 794104 - RNA, 22 nt, Homo sapiens
gaugggguuucaccauguuggc

SEQ ID NO: 794105 - RNA, 22 nt, Homo sapiens
gauggguauuaaacuugucaga

SEQ ID NO: 794106 - RNA, 21 nt, Homo sapiens
gauggguggggagcaaaucau

SEQ ID NO: 794107 - RNA, 21 nt, Homo sapiens
gaugguaucuggguaagaaga

SEQ ID NO: 794108 - RNA, 16 nt, Homo sapiens
gaugguccgugcccag

SEQ ID NO: 794109 - RNA, 16 nt, Homo sapiens
gauggucucgaucucc

SEQ ID NO: 794110 - RNA, 17 nt, Homo sapiens
gauggucucgaucuccu

SEQ ID NO: 794111 - RNA, 15 nt, Homo sapiens
gauggugcaugccug

SEQ ID NO: 794112 - RNA, 23 nt, Homo sapiens
gauggugcaugccuguagucuca

SEQ ID NO: 794113 - RNA, 17 nt, Homo sapiens
gaugguuuaauagguaa

SEQ ID NO: 794114 - RNA, 20 nt, Homo sapiens
gauguaccagcaucucccag

SEQ ID NO: 794115 - RNA, 18 nt, Homo sapiens
gauguaggguaaggugcc

SEQ ID NO: 794116 - RNA, 19 nt, Homo sapiens
gauguaggguaaggugccu

SEQ ID NO: 794117 - RNA, 23 nt, Homo sapiens
gauguauuuuugauguauauauc

SEQ ID NO: 794118 - RNA, 22 nt, Homo sapiens
gaugucaaaacaagacuccuca

SEQ ID NO: 794119 - RNA, 15 nt, Homo sapiens
gaugucaggcccaga

SEQ ID NO: 794120 - RNA, 22 nt, Homo sapiens
gaugucaucuugagcucuucau

SEQ ID NO: 794121 - RNA, 20 nt, Homo sapiens
gauguccagaagaauauuca

SEQ ID NO: 794122 - RNA, 17 nt, Homo sapiens
gaugucuccacuuucac

SEQ ID NO: 794123 - RNA, 18 nt, Homo sapiens
gaugucuuaacgaauaaa

SEQ ID NO: 794124 - RNA, 14 nt, Homo sapiens
gaugucuucuagcu

SEQ ID NO: 794125 - RNA, 16 nt, Homo sapiens
gaugucuuugcugcag

SEQ ID NO: 794126 - RNA, 22 nt, Homo sapiens
gaugugaaaacaucucaauaac

SEQ ID NO: 794127 - RNA, 14 nt, Homo sapiens
gaugugaacacauc

SEQ ID NO: 794128 - RNA, 22 nt, Homo sapiens
gaugugaauuauugacacugaa

SEQ ID NO: 794129 - RNA, 17 nt, Homo sapiens
gaugugauuaaagcuaa

SEQ ID NO: 794130 - RNA, 16 nt, Homo sapiens
gaugugauuagugucu

SEQ ID NO: 794131 - RNA, 19 nt, Homo sapiens
gauguggagcuacugauga

SEQ ID NO: 794132 - RNA, 16 nt, Homo sapiens
gauguggucaauggaa

SEQ ID NO: 794133 - RNA, 20 nt, Homo sapiens
gauguguauacguaggaauu

SEQ ID NO: 794134 - RNA, 12 nt, Homo sapiens
gauguugcucag

SEQ ID NO: 794135 - RNA, 20 nt, Homo sapiens
gauguuguuccuggcuagau

SEQ ID NO: 794136 - RNA, 19 nt, Homo sapiens
gauguuuccagacuuccuu

SEQ ID NO: 794137 - RNA, 14 nt, Homo sapiens
gauguuucugugaa

SEQ ID NO: 794138 - RNA, 17 nt, Homo sapiens
gauuaaaaucacucuca

SEQ ID NO: 794139 - RNA, 20 nt, Homo sapiens
gauuaaacaaacaaacaauu

SEQ ID NO: 794140 - RNA, 23 nt, Homo sapiens
gauuaaacgugcagacuaugcaa

SEQ ID NO: 794141 - RNA, 15 nt, Homo sapiens
gauuaagaguugcca

SEQ ID NO: 794142 - RNA, 17 nt, Homo sapiens
gauuaagaguugccaaa

SEQ ID NO: 794143 - RNA, 22 nt, Homo sapiens
gauuaagaucagcaaagggagg

SEQ ID NO: 794144 - RNA, 15 nt, Homo sapiens
gauuaauguuuugua

SEQ ID NO: 794145 - RNA, 20 nt, Homo sapiens
gauuaauuugguugucaagu

SEQ ID NO: 794146 - RNA, 17 nt, Homo sapiens
gauuaauuuuuccauaa

SEQ ID NO: 794147 - RNA, 15 nt, Homo sapiens
gauuacaggcaccca

SEQ ID NO: 794148 - RNA, 19 nt, Homo sapiens
gauuacaggcaugagccac

SEQ ID NO: 794149 - RNA, 17 nt, Homo sapiens
gauuaccgacacuguca

SEQ ID NO: 794150 - RNA, 23 nt, Homo sapiens
gauuaccgacacugucacuugac

SEQ ID NO: 794151 - RNA, 20 nt, Homo sapiens
gauuacuaucauggcauaua

SEQ ID NO: 794152 - RNA, 23 nt, Homo sapiens
gauuacucgaucaaaaccuuccu

SEQ ID NO: 794153 - RNA, 21 nt, Homo sapiens
gauuacugccauucacuucau

SEQ ID NO: 794154 - RNA, 22 nt, Homo sapiens
gauuagugccuucugcccuccc

SEQ ID NO: 794155 - RNA, 20 nt, Homo sapiens
gauuauauaaaauacauaau

SEQ ID NO: 794156 - RNA, 12 nt, Homo sapiens
gauuauauucac

SEQ ID NO: 794157 - RNA, 19 nt, Homo sapiens
gauuaugcagacaaccuca

SEQ ID NO: 794158 - RNA, 17 nt, Homo sapiens
gauuaugccacugcuuu

SEQ ID NO: 794159 - RNA, 14 nt, Homo sapiens
augugcaaguuuau

SEQ ID NO: 794160 - RNA, 14 nt, Homo sapiens
augugcagcaaaag

SEQ ID NO: 794161 - RNA, 19 nt, Homo sapiens
augugcagguuuugaaaau

SEQ ID NO: 794162 - RNA, 15 nt, Homo sapiens
augugcaguacuuaa

SEQ ID NO: 794163 - RNA, 15 nt, Homo sapiens
augugcagucacugg

SEQ ID NO: 794164 - RNA, 15 nt, Homo sapiens
augugcuaugcaaaa

SEQ ID NO: 794165 - RNA, 21 nt, Homo sapiens
augugcuaugcaaaauagaca

SEQ ID NO: 794166 - RNA, 13 nt, Homo sapiens
augugcucaugca

SEQ ID NO: 794167 - RNA, 16 nt, Homo sapiens
augugcucaugcauug

SEQ ID NO: 794168 - RNA, 22 nt, Homo sapiens
augugcugaaugguuuucaaaa

SEQ ID NO: 794169 - RNA, 22 nt, Homo sapiens
auguggaccuuagaauacaguu

SEQ ID NO: 794170 - RNA, 19 nt, Homo sapiens
auguggagugagaacagca

SEQ ID NO: 794171 - RNA, 17 nt, Homo sapiens
auguggauuugauucau

SEQ ID NO: 794172 - RNA, 17 nt, Homo sapiens
auguggccuuuaucuca

SEQ ID NO: 794173 - RNA, 18 nt, Homo sapiens
auguggcucagugccuuc

SEQ ID NO: 794174 - RNA, 20 nt, Homo sapiens
auguggcuggaagauccugc

SEQ ID NO: 794175 - RNA, 22 nt, Homo sapiens
auguggggguggggguggagaa

SEQ ID NO: 794176 - RNA, 15 nt, Homo sapiens
augugggugagccag

SEQ ID NO: 794177 - RNA, 17 nt, Homo sapiens
augugggugucagucag

SEQ ID NO: 794178 - RNA, 21 nt, Homo sapiens
augugggugucagucagggac

SEQ ID NO: 794179 - RNA, 15 nt, Homo sapiens
augugguaggugaua

SEQ ID NO: 794180 - RNA, 17 nt, Homo sapiens
augugguauacaauucu

SEQ ID NO: 794181 - RNA, 21 nt, Homo sapiens
auguggucuaagguucagccu

SEQ ID NO: 794182 - RNA, 20 nt, Homo sapiens
auguguagggaaaguuaaaa

SEQ ID NO: 794183 - RNA, 12 nt, Homo sapiens
auguguauauau

SEQ ID NO: 794184 - RNA, 11 nt, Homo sapiens
auguguauuau

SEQ ID NO: 794185 - RNA, 19 nt, Homo sapiens
augugugaguguaauucca

SEQ ID NO: 794186 - RNA, 14 nt, Homo sapiens
augugugugccaau

SEQ ID NO: 794187 - RNA, 14 nt, Homo sapiens
auguguuaaaauac

SEQ ID NO: 794188 - RNA, 22 nt, Homo sapiens
auguguucggguuaagugauga

SEQ ID NO: 794189 - RNA, 20 nt, Homo sapiens
auguguucucggagugugua

SEQ ID NO: 794190 - RNA, 17 nt, Homo sapiens
auguguugcagcuuuau

SEQ ID NO: 794191 - RNA, 22 nt, Homo sapiens
auguguuguguauuccacuuag

SEQ ID NO: 794192 - RNA, 18 nt, Homo sapiens
auguguuucaaaaccaug

SEQ ID NO: 794193 - RNA, 15 nt, Homo sapiens
auguguuuggaagac

SEQ ID NO: 794194 - RNA, 21 nt, Homo sapiens
auguguuuggaagacaacucu

SEQ ID NO: 794195 - RNA, 18 nt, Homo sapiens
auguuaaagagaaugagu

SEQ ID NO: 794196 - RNA, 16 nt, Homo sapiens
auguuaaccucagugu

SEQ ID NO: 794197 - RNA, 14 nt, Homo sapiens
auguuaacugagcu

SEQ ID NO: 794198 - RNA, 22 nt, Homo sapiens
auguuaagauaacuuacuguau

SEQ ID NO: 794199 - RNA, 13 nt, Homo sapiens
auguuacugacca

SEQ ID NO: 794200 - RNA, 14 nt, Homo sapiens
auguuacugaccag

SEQ ID NO: 794201 - RNA, 14 nt, Homo sapiens
auguuauaucauau

SEQ ID NO: 794202 - RNA, 13 nt, Homo sapiens
auguuaugcauaa

SEQ ID NO: 794203 - RNA, 14 nt, Homo sapiens
auguucaacuggag

SEQ ID NO: 794204 - RNA, 17 nt, Homo sapiens
auguucacuguaugccu

SEQ ID NO: 794205 - RNA, 16 nt, Homo sapiens
auguucacuguggcau

SEQ ID NO: 794206 - RNA, 12 nt, Homo sapiens
auguucagucac

SEQ ID NO: 794207 - RNA, 18 nt, Homo sapiens
auguuccaaacccuccug

SEQ ID NO: 794208 - RNA, 20 nt, Homo sapiens
auguuccaccauugcuggaa

SEQ ID NO: 794209 - RNA, 22 nt, Homo sapiens
auguuccagugaggaacccuga

SEQ ID NO: 794210 - RNA, 22 nt, Homo sapiens
auguuccccaggauucagcuau

SEQ ID NO: 794211 - RNA, 15 nt, Homo sapiens
auguuccugcuguau

SEQ ID NO: 794212 - RNA, 15 nt, Homo sapiens
auguucuaaggcucu

SEQ ID NO: 794213 - RNA, 16 nt, Homo sapiens
auguucuaaguuucua

SEQ ID NO: 794214 - RNA, 15 nt, Homo sapiens
auguucucagauuuc

SEQ ID NO: 794215 - RNA, 23 nt, Homo sapiens
auguucuuuuaaaugauugaauu

SEQ ID NO: 794216 - RNA, 9 nt, Homo sapiens
auguugaaa

SEQ ID NO: 794217 - RNA, 17 nt, Homo sapiens
auguugaaagaucaaaa

SEQ ID NO: 794218 - RNA, 20 nt, Homo sapiens
auguugaccuuugcaaaaug

SEQ ID NO: 794219 - RNA, 17 nt, Homo sapiens
auguugaucuuucucaa

SEQ ID NO: 794220 - RNA, 23 nt, Homo sapiens
auguugauuuuuacuguguuuua

SEQ ID NO: 794221 - RNA, 14 nt, Homo sapiens
auguugcacaauga

SEQ ID NO: 794222 - RNA, 18 nt, Homo sapiens
auguugccauguguuuua

SEQ ID NO: 794223 - RNA, 21 nt, Homo sapiens
auguuggcuagacuagucuca

SEQ ID NO: 794224 - RNA, 18 nt, Homo sapiens
auguugggaaacuuggcu

SEQ ID NO: 794225 - RNA, 15 nt, Homo sapiens
auguugguguuccac

SEQ ID NO: 794226 - RNA, 18 nt, Homo sapiens
auguuguaauucaugcca

SEQ ID NO: 794227 - RNA, 20 nt, Homo sapiens
gauauaacacuauguuuauu

SEQ ID NO: 794228 - RNA, 20 nt, Homo sapiens
gauauaauucuuaugccaua

SEQ ID NO: 794229 - RNA, 23 nt, Homo sapiens
gauauaauuuaacuguguuuuag

SEQ ID NO: 794230 - RNA, 21 nt, Homo sapiens
gauauacauuuauuuacacuc

SEQ ID NO: 794231 - RNA, 15 nt, Homo sapiens
gauauacuuacucau

SEQ ID NO: 794232 - RNA, 20 nt, Homo sapiens
gauaucuuggacaaaucaca

SEQ ID NO: 794233 - RNA, 12 nt, Homo sapiens
gauaucuuggcu

SEQ ID NO: 794234 - RNA, 18 nt, Homo sapiens
gauaucuuggcuuugcca

SEQ ID NO: 794235 - RNA, 15 nt, Homo sapiens
gauaugaaggauuac

SEQ ID NO: 794236 - RNA, 13 nt, Homo sapiens
gauaugaccaaaa

SEQ ID NO: 794237 - RNA, 17 nt, Homo sapiens
gauaugacccacacugc

SEQ ID NO: 794238 - RNA, 16 nt, Homo sapiens
gauaugcugcuuuaaa

SEQ ID NO: 794239 - RNA, 16 nt, Homo sapiens
gauaugggacugagcc

SEQ ID NO: 794240 - RNA, 20 nt, Homo sapiens
gauauuaauagauaauauga

SEQ ID NO: 794241 - RNA, 14 nt, Homo sapiens
gauauuacauuuau

SEQ ID NO: 794242 - RNA, 16 nt, Homo sapiens
gauauucagaaguaua

SEQ ID NO: 794243 - RNA, 18 nt, Homo sapiens
gauauuuauuacuuccuc

SEQ ID NO: 794244 - RNA, 16 nt, Homo sapiens
gauauuuuaaauaucc

SEQ ID NO: 794245 - RNA, 17 nt, Homo sapiens
gauauuuucacacuggu

SEQ ID NO: 794246 - RNA, 14 nt, Homo sapiens
gaucaaaaucaauu

SEQ ID NO: 794247 - RNA, 16 nt, Homo sapiens
gaucaaacuacauauu

SEQ ID NO: 794248 - RNA, 19 nt, Homo sapiens
gaucaaauguauagacuug

SEQ ID NO: 794249 - RNA, 23 nt, Homo sapiens
gaucaagggaauguaacugcuga

SEQ ID NO: 794250 - RNA, 21 nt, Homo sapiens
gaucaagucaccggagcuuuc

SEQ ID NO: 794251 - RNA, 21 nt, Homo sapiens
gaucaaguccuaguuguucag

SEQ ID NO: 794252 - RNA, 18 nt, Homo sapiens
gaucaauaaaaugugauu

SEQ ID NO: 794253 - RNA, 19 nt, Homo sapiens
gaucacaccacuguacucc

SEQ ID NO: 794254 - RNA, 12 nt, Homo sapiens
gaucacaccuca

SEQ ID NO: 794255 - RNA, 18 nt, Homo sapiens
gaucacuacaaguauuau

SEQ ID NO: 794256 - RNA, 14 nt, Homo sapiens
gaucacugccacac

SEQ ID NO: 794257 - RNA, 16 nt, Homo sapiens
gaucacuggcaaugaa

SEQ ID NO: 794258 - RNA, 18 nt, Homo sapiens
gaucacuugaguucagga

SEQ ID NO: 794259 - RNA, 14 nt, Homo sapiens
gaucaggaauucua

SEQ ID NO: 794260 - RNA, 16 nt, Homo sapiens
gaucaguacugacuuu

SEQ ID NO: 794261 - RNA, 17 nt, Homo sapiens
gaucaucuaauucucug

SEQ ID NO: 794262 - RNA, 16 nt, Homo sapiens
gaucaucuuuccuguu

SEQ ID NO: 794263 - RNA, 15 nt, Homo sapiens
gaucaucuuugccac

SEQ ID NO: 794264 - RNA, 18 nt, Homo sapiens
gaucaugauguagagugu

SEQ ID NO: 794265 - RNA, 20 nt, Homo sapiens
gaucaugccacuacacucca

SEQ ID NO: 794266 - RNA, 18 nt, Homo sapiens
gaucauuaucagccugug

SEQ ID NO: 794267 - RNA, 19 nt, Homo sapiens
gaucauugaaauucugaga

SEQ ID NO: 794268 - RNA, 12 nt, Homo sapiens
gaucauugcugg

SEQ ID NO: 794269 - RNA, 15 nt, Homo sapiens
gauccagaauggagu

SEQ ID NO: 794270 - RNA, 21 nt, Homo sapiens
gauccagccuuuccaagucac

SEQ ID NO: 794271 - RNA, 22 nt, Homo sapiens
gauccagucuggaaaacagaaa

SEQ ID NO: 794272 - RNA, 20 nt, Homo sapiens
gauccauccaucuccaggga

SEQ ID NO: 794273 - RNA, 18 nt, Homo sapiens
gaucccaagacaaugaaa

SEQ ID NO: 794274 - RNA, 18 nt, Homo sapiens
gaucccacuucacuguga

SEQ ID NO: 794275 - RNA, 14 nt, Homo sapiens
gaucccaggccagg

SEQ ID NO: 794276 - RNA, 20 nt, Homo sapiens
gauccccaaaacaggccagg

SEQ ID NO: 794277 - RNA, 16 nt, Homo sapiens
gauccccaagugugaa

SEQ ID NO: 794278 - RNA, 15 nt, Homo sapiens
gauccccccacugag

SEQ ID NO: 794279 - RNA, 19 nt, Homo sapiens
gaucccgagguauggcaga

SEQ ID NO: 794280 - RNA, 17 nt, Homo sapiens
gaucccugcucucugag

SEQ ID NO: 794281 - RNA, 15 nt, Homo sapiens
gauccuccacagaga

SEQ ID NO: 794282 - RNA, 16 nt, Homo sapiens
gauccucccaccucag

SEQ ID NO: 794283 - RNA, 18 nt, Homo sapiens
gauccugcuccagcagca

SEQ ID NO: 794284 - RNA, 17 nt, Homo sapiens
gauccuguuacuugcuu

SEQ ID NO: 794285 - RNA, 19 nt, Homo sapiens
cuuuuaagaaacacagggu

SEQ ID NO: 794286 - RNA, 14 nt, Homo sapiens
cuuuuaaucaguga

SEQ ID NO: 794287 - RNA, 22 nt, Homo sapiens
cuuuuaauguauuuguuugcaa

SEQ ID NO: 794288 - RNA, 13 nt, Homo sapiens
cuuuuacauucug

SEQ ID NO: 794289 - RNA, 21 nt, Homo sapiens
cuuuuagacaacuagauuugu

SEQ ID NO: 794290 - RNA, 16 nt, Homo sapiens
cuuuuaguuguaucuc

SEQ ID NO: 794291 - RNA, 14 nt, Homo sapiens
cuuuuauagcugcu

SEQ ID NO: 794292 - RNA, 21 nt, Homo sapiens
cuuuuaugauauauauaugcu

SEQ ID NO: 794293 - RNA, 14 nt, Homo sapiens
cuuuucaagcugcu

SEQ ID NO: 794294 - RNA, 12 nt, Homo sapiens
cuuuucacggga

SEQ ID NO: 794295 - RNA, 13 nt, Homo sapiens
cuuuuccaaugau

SEQ ID NO: 794296 - RNA, 19 nt, Homo sapiens
cuuuuccacacgcauuaau

SEQ ID NO: 794297 - RNA, 14 nt, Homo sapiens
cuuuuccacuuuaa

SEQ ID NO: 794298 - RNA, 15 nt, Homo sapiens
cuuuuccacuuuaaa

SEQ ID NO: 794299 - RNA, 16 nt, Homo sapiens
cuuuucccaccagcuc

SEQ ID NO: 794300 - RNA, 17 nt, Homo sapiens
cuuuucccauugccaug

SEQ ID NO: 794301 - RNA, 14 nt, Homo sapiens
cuuuucccauuuca

SEQ ID NO: 794302 - RNA, 17 nt, Homo sapiens
cuuuucccugcaccacu

SEQ ID NO: 794303 - RNA, 16 nt, Homo sapiens
cuuuuccuucagugaa

SEQ ID NO: 794304 - RNA, 23 nt, Homo sapiens
cuuuucggccccauguaucucag

SEQ ID NO: 794305 - RNA, 16 nt, Homo sapiens
cuuuucucacucagau

SEQ ID NO: 794306 - RNA, 22 nt, Homo sapiens
cuuuucucugagacauuccacc

SEQ ID NO: 794307 - RNA, 17 nt, Homo sapiens
cuuuucugccacuccau

SEQ ID NO: 794308 - RNA, 16 nt, Homo sapiens
cuuuucuggccaaaag

SEQ ID NO: 794309 - RNA, 19 nt, Homo sapiens
cuuuucuggugauucucca

SEQ ID NO: 794310 - RNA, 16 nt, Homo sapiens
cuuuucugugccagac

SEQ ID NO: 794311 - RNA, 18 nt, Homo sapiens
cuuuucuugccucugucc

SEQ ID NO: 794312 - RNA, 19 nt, Homo sapiens
cuuuucuugggaugcuuau

SEQ ID NO: 794313 - RNA, 15 nt, Homo sapiens
cuuuucuuuccucag

SEQ ID NO: 794314 - RNA, 16 nt, Homo sapiens
cuuuugaaaagcuuuu

SEQ ID NO: 794315 - RNA, 13 nt, Homo sapiens
cuuuugagcauau

SEQ ID NO: 794316 - RNA, 13 nt, Homo sapiens
cuuuugaggggcu

SEQ ID NO: 794317 - RNA, 21 nt, Homo sapiens
cuuuugaggggcugacuucaa

SEQ ID NO: 794318 - RNA, 16 nt, Homo sapiens
cuuuugcauuaaucua

SEQ ID NO: 794319 - RNA, 16 nt, Homo sapiens
cuuuugccaguauuau

SEQ ID NO: 794320 - RNA, 22 nt, Homo sapiens
cuuuugccaguauuaugcauau

SEQ ID NO: 794321 - RNA, 23 nt, Homo sapiens
cuuuugcuagagcugacagcuuu

SEQ ID NO: 794322 - RNA, 21 nt, Homo sapiens
cuuuugcucauggugaauaua

SEQ ID NO: 794323 - RNA, 16 nt, Homo sapiens
cuuuuggauaugcuga

SEQ ID NO: 794324 - RNA, 22 nt, Homo sapiens
cuuuugggccuccuucccaugc

SEQ ID NO: 794325 - RNA, 18 nt, Homo sapiens
cuuuuggucccauccucu

SEQ ID NO: 794326 - RNA, 15 nt, Homo sapiens
cuuuuguaauaucaa

SEQ ID NO: 794327 - RNA, 13 nt, Homo sapiens
cuuuugucccaga

SEQ ID NO: 794328 - RNA, 23 nt, Homo sapiens
cuuuugugaauuaggcuguaacu

SEQ ID NO: 794329 - RNA, 13 nt, Homo sapiens
cuuuuguguacag

SEQ ID NO: 794330 - RNA, 14 nt, Homo sapiens
cuuuuguguagcuc

SEQ ID NO: 794331 - RNA, 19 nt, Homo sapiens
cuuuuguucagggcuguga

SEQ ID NO: 794332 - RNA, 20 nt, Homo sapiens
cuuuuuaauauugauaugcu

SEQ ID NO: 794333 - RNA, 16 nt, Homo sapiens
cuuuuuacucaaagag

SEQ ID NO: 794334 - RNA, 22 nt, Homo sapiens
cuuuuuaugaucugccauuuca

SEQ ID NO: 794335 - RNA, 13 nt, Homo sapiens
cuuuuuaugcauu

SEQ ID NO: 794336 - RNA, 16 nt, Homo sapiens
cuuuuuauuagagcuc

SEQ ID NO: 794337 - RNA, 15 nt, Homo sapiens
cuuuuucacuuugaa

SEQ ID NO: 794338 - RNA, 18 nt, Homo sapiens
cuuuuucauauuucuacc

SEQ ID NO: 794339 - RNA, 14 nt, Homo sapiens
cuuuuugacacuga

SEQ ID NO: 794340 - RNA, 19 nt, Homo sapiens
cuuuuugcguacacagaga

SEQ ID NO: 794341 - RNA, 17 nt, Homo sapiens
cuuuuugggcuuucaua

SEQ ID NO: 794342 - RNA, 12 nt, Homo sapiens
cuuuuuguacuu

SEQ ID NO: 794343 - RNA, 18 nt, Homo sapiens
cuuuuuguuacagauuaa

SEQ ID NO: 794344 - RNA, 19 nt, Homo sapiens
cuuuuuuaggcuacagugu

SEQ ID NO: 794345 - RNA, 16 nt, Homo sapiens
cuuuuuuaucuugcac

SEQ ID NO: 794346 - RNA, 16 nt, Homo sapiens
cuuuuuucuaguuuca

SEQ ID NO: 794347 - RNA, 22 nt, Homo sapiens
cuuuuuuuauaucagaaugagg

SEQ ID NO: 794348 - RNA, 14 nt, Homo sapiens
cuuuuuuuguaugu

SEQ ID NO: 794349 - RNA, 16 nt, Homo sapiens
cuuuuuuuuaugauca

SEQ ID NO: 794350 - RNA, 18 nt, Homo sapiens
cuuuuuuuuuaaggugaa

SEQ ID NO: 794351 - RNA, 20 nt, Homo sapiens
cuuuuuuuuuuucugccuga

SEQ ID NO: 794352 - RNA, 17 nt, Homo sapiens
gaaaaaaaaaacacuug

SEQ ID NO: 794353 - RNA, 14 nt, Homo sapiens
gaaaaaaacauaaa

SEQ ID NO: 794354 - RNA, 13 nt, Homo sapiens
gaaaaaagcaagu

SEQ ID NO: 794355 - RNA, 18 nt, Homo sapiens
gaaaaaaggacaauuuca

SEQ ID NO: 794356 - RNA, 17 nt, Homo sapiens
ugaaaaaaacauaucca

SEQ ID NO: 794357 - RNA, 15 nt, Homo sapiens
ugaaaaaaaugcauu

SEQ ID NO: 794358 - RNA, 22 nt, Homo sapiens
ugaaaaaagguuguguagcugu

SEQ ID NO: 794359 - RNA, 15 nt, Homo sapiens
ugaaaaacaaaaugg

SEQ ID NO: 794360 - RNA, 16 nt, Homo sapiens
ugaaaaacaaaauggg

SEQ ID NO: 794361 - RNA, 19 nt, Homo sapiens
ugaaaaacagaaagcaucc

SEQ ID NO: 794362 - RNA, 12 nt, Homo sapiens
ugaaaaacauuc

SEQ ID NO: 794363 - RNA, 13 nt, Homo sapiens
ugaaaaauacauc

SEQ ID NO: 794364 - RNA, 17 nt, Homo sapiens
ugaaaaauaguucuaaa

SEQ ID NO: 794365 - RNA, 17 nt, Homo sapiens
ugaaaaauggcaaagaa

SEQ ID NO: 794366 - RNA, 21 nt, Homo sapiens
ugaaaaaugguaauuguugcu

SEQ ID NO: 794367 - RNA, 22 nt, Homo sapiens
ugaaaacaaacaagaggacugu

SEQ ID NO: 794368 - RNA, 16 nt, Homo sapiens
ugaaaacacacauaca

SEQ ID NO: 794369 - RNA, 12 nt, Homo sapiens
ugaaaacacuua

SEQ ID NO: 794370 - RNA, 23 nt, Homo sapiens
ugaaaacagugucuugagcucua

SEQ ID NO: 794371 - RNA, 18 nt, Homo sapiens
ugaaaacauagcaucuca

SEQ ID NO: 794372 - RNA, 19 nt, Homo sapiens
ugaaaacauguacuacagc

SEQ ID NO: 794373 - RNA, 23 nt, Homo sapiens
ugaaaacauguacuacagcuaua

SEQ ID NO: 794374 - RNA, 12 nt, Homo sapiens
ugaaaacauuca

SEQ ID NO: 794375 - RNA, 22 nt, Homo sapiens
ugaaaacucacagaacuaugua

SEQ ID NO: 794376 - RNA, 19 nt, Homo sapiens
ugaaaacucuaauugucca

SEQ ID NO: 794377 - RNA, 23 nt, Homo sapiens
ugaaaacuuagagagguacaagu

SEQ ID NO: 794378 - RNA, 15 nt, Homo sapiens
ugaaaagaaggaaua

SEQ ID NO: 794379 - RNA, 16 nt, Homo sapiens
ugaaaagacuccaaag

SEQ ID NO: 794380 - RNA, 20 nt, Homo sapiens
ugaaaagcacacacaauaaa

SEQ ID NO: 794381 - RNA, 17 nt, Homo sapiens
ugaaaaggaaguuaaua

SEQ ID NO: 794382 - RNA, 17 nt, Homo sapiens
ugaaaagguugccugaa

SEQ ID NO: 794383 - RNA, 11 nt, Homo sapiens
ugaaaauaacu

SEQ ID NO: 794384 - RNA, 21 nt, Homo sapiens
ugaaaauauagacauucucac

SEQ ID NO: 794385 - RNA, 16 nt, Homo sapiens
ugaaaaucaaaguaaa

SEQ ID NO: 794386 - RNA, 14 nt, Homo sapiens
ugaaaaugaaugcu

SEQ ID NO: 794387 - RNA, 23 nt, Homo sapiens
ugaaaaugcaucacaugaugaaa

SEQ ID NO: 794388 - RNA, 12 nt, Homo sapiens
ugaaaauguuca

SEQ ID NO: 794389 - RNA, 16 nt, Homo sapiens
ugaaaauuuuacuucc

SEQ ID NO: 794390 - RNA, 19 nt, Homo sapiens
ugaaaauuuuuacauucau

SEQ ID NO: 794391 - RNA, 22 nt, Homo sapiens
ugaaaccagaaggauauuuacu

SEQ ID NO: 794392 - RNA, 15 nt, Homo sapiens
ugaaacccccaucuc

SEQ ID NO: 794393 - RNA, 23 nt, Homo sapiens
ugaaacccuuguauaaguaauac

SEQ ID NO: 794394 - RNA, 19 nt, Homo sapiens
ugaaacgucccacacuuug

SEQ ID NO: 794395 - RNA, 20 nt, Homo sapiens
ugaaacgucccacacuuuga

SEQ ID NO: 794396 - RNA, 20 nt, Homo sapiens
uccaggacagggaagggagc

SEQ ID NO: 794397 - RNA, 16 nt, Homo sapiens
uccaggaucuuugacu

SEQ ID NO: 794398 - RNA, 15 nt, Homo sapiens
uccaggauugagcag

SEQ ID NO: 794399 - RNA, 19 nt, Homo sapiens
uccaggauuuaggccuuaa

SEQ ID NO: 794400 - RNA, 23 nt, Homo sapiens
uccaggccaugauggccuuacac

SEQ ID NO: 794401 - RNA, 15 nt, Homo sapiens
uccaggcccaucuca

SEQ ID NO: 794402 - RNA, 17 nt, Homo sapiens
uccaggccccaccuccu

SEQ ID NO: 794403 - RNA, 15 nt, Homo sapiens
uccaggccugaaguc

SEQ ID NO: 794404 - RNA, 16 nt, Homo sapiens
uccagggcauugcuca

SEQ ID NO: 794405 - RNA, 17 nt, Homo sapiens
uccagggcauugcucag

SEQ ID NO: 794406 - RNA, 16 nt, Homo sapiens
uccagggccagaugag

SEQ ID NO: 794407 - RNA, 19 nt, Homo sapiens
uccagggcuggacugaggc

SEQ ID NO: 794408 - RNA, 13 nt, Homo sapiens
uccaggguggaug

SEQ ID NO: 794409 - RNA, 12 nt, Homo sapiens
uccaggugcaga

SEQ ID NO: 794410 - RNA, 14 nt, Homo sapiens
uccagguggcguga

SEQ ID NO: 794411 - RNA, 21 nt, Homo sapiens
uccagguuuccuuaagggaca

SEQ ID NO: 794412 - RNA, 14 nt, Homo sapiens
uccaguauaaccag

SEQ ID NO: 794413 - RNA, 23 nt, Homo sapiens
uccagucucuucugcuggcagaa

SEQ ID NO: 794414 - RNA, 14 nt, Homo sapiens
uccagugcaauugu

SEQ ID NO: 794415 - RNA, 14 nt, Homo sapiens
uccagugggacccc

SEQ ID NO: 794416 - RNA, 20 nt, Homo sapiens
uccagugugggcuugaccag

SEQ ID NO: 794417 - RNA, 20 nt, Homo sapiens
uccauaaagacaaucacugc

SEQ ID NO: 794418 - RNA, 22 nt, Homo sapiens
uccauaaagacaaucacugcca

SEQ ID NO: 794419 - RNA, 23 nt, Homo sapiens
uccauaaagacaaucacugccaa

SEQ ID NO: 794420 - RNA, 15 nt, Homo sapiens
uccauaaaguacaaa

SEQ ID NO: 794421 - RNA, 23 nt, Homo sapiens
uccauaaaugacacuacuugaua

SEQ ID NO: 794422 - RNA, 16 nt, Homo sapiens
uccauaaauguguucc

SEQ ID NO: 794423 - RNA, 12 nt, Homo sapiens
ucauugcuaaaa

SEQ ID NO: 794424 - RNA, 16 nt, Homo sapiens
ucauugcuaaccacug

SEQ ID NO: 794425 - RNA, 13 nt, Homo sapiens
ucauugcuaauau

SEQ ID NO: 794426 - RNA, 17 nt, Homo sapiens
ucauuguagaaacacag

SEQ ID NO: 794427 - RNA, 22 nt, Homo sapiens
ucauugucuacauagugacaug

SEQ ID NO: 794428 - RNA, 19 nt, Homo sapiens
ucauuuaaaacaggcaaag

SEQ ID NO: 794429 - RNA, 14 nt, Homo sapiens
ucauuuagaacuug

SEQ ID NO: 794430 - RNA, 17 nt, Homo sapiens
ucauuucacccaaguau

SEQ ID NO: 794431 - RNA, 21 nt, Homo sapiens
ucauuugaaugugugaauuca

SEQ ID NO: 794432 - RNA, 14 nt, Homo sapiens
ucauuugaguuuag

SEQ ID NO: 794433 - RNA, 19 nt, Homo sapiens
ucauuuuacacaaagggaa

SEQ ID NO: 794434 - RNA, 13 nt, Homo sapiens
ucauuuugcacug

SEQ ID NO: 794435 - RNA, 17 nt, Homo sapiens
ucauuuuuaacagcaug

SEQ ID NO: 794436 - RNA, 23 nt, Homo sapiens
ucauuuuuaacagcaugcugcuu

SEQ ID NO: 794437 - RNA, 18 nt, Homo sapiens
ucauuuuuuauggcugca

SEQ ID NO: 794438 - RNA, 23 nt, Homo sapiens
uccaaaaaugcacccaacuagcu

SEQ ID NO: 794439 - RNA, 13 nt, Homo sapiens
uccaaaagacaaa

SEQ ID NO: 794440 - RNA, 22 nt, Homo sapiens
uccaaaccugucuuggggccac

SEQ ID NO: 794441 - RNA, 19 nt, Homo sapiens
uccaaacucaaacuugaga

SEQ ID NO: 794442 - RNA, 15 nt, Homo sapiens
uccaaagaaagauua

SEQ ID NO: 794443 - RNA, 17 nt, Homo sapiens
uccaaagacugaaggag

SEQ ID NO: 794444 - RNA, 22 nt, Homo sapiens
uccaaagaggcugccccucuca

SEQ ID NO: 794445 - RNA, 20 nt, Homo sapiens
uccaaagcacauugaaagag

SEQ ID NO: 794446 - RNA, 17 nt, Homo sapiens
uccaaaggucugauguc

SEQ ID NO: 794447 - RNA, 21 nt, Homo sapiens
uccaaaguucccacuccuuca

SEQ ID NO: 794448 - RNA, 18 nt, Homo sapiens
uccaaaucugccuagaaa

SEQ ID NO: 794449 - RNA, 16 nt, Homo sapiens
ucauauaccagcaaua

SEQ ID NO: 794450 - RNA, 18 nt, Homo sapiens
ucauauauuaaacaucca

SEQ ID NO: 794451 - RNA, 20 nt, Homo sapiens
ucauaugaaaaaaaugcauu

SEQ ID NO: 794452 - RNA, 22 nt, Homo sapiens
ucauauuggacugauaaucucu

SEQ ID NO: 794453 - RNA, 15 nt, Homo sapiens
ucauauuguucaaua

SEQ ID NO: 794454 - RNA, 20 nt, Homo sapiens
ucauauuuauacuuugcaau

SEQ ID NO: 794455 - RNA, 16 nt, Homo sapiens
ucauauuucauuucca

SEQ ID NO: 794456 - RNA, 17 nt, Homo sapiens
ucaucaaaaacuuugga

SEQ ID NO: 794457 - RNA, 17 nt, Homo sapiens
ucaucaaaaagaacaac

SEQ ID NO: 794458 - RNA, 14 nt, Homo sapiens
ucaucaaaaagccu

SEQ ID NO: 794459 - RNA, 14 nt, Homo sapiens
ucaucaaacauugg

SEQ ID NO: 794460 - RNA, 19 nt, Homo sapiens
ucaucaacacgagaauaca

SEQ ID NO: 794461 - RNA, 22 nt, Homo sapiens
ucaucaacuuauuauaugacua

SEQ ID NO: 794462 - RNA, 18 nt, Homo sapiens
ucaucaauggggccaguc

SEQ ID NO: 794463 - RNA, 12 nt, Homo sapiens
ucaucaaugugc

SEQ ID NO: 794464 - RNA, 13 nt, Homo sapiens
ucaucaccaagau

SEQ ID NO: 794465 - RNA, 12 nt, Homo sapiens
ucaucacuggau

SEQ ID NO: 794466 - RNA, 19 nt, Homo sapiens
ucaucacuggaugaagauu

SEQ ID NO: 794467 - RNA, 21 nt, Homo sapiens
ucaucagccuguguaggcagu

SEQ ID NO: 794468 - RNA, 18 nt, Homo sapiens
ucaucagcuuugugccac

SEQ ID NO: 794469 - RNA, 23 nt, Homo sapiens
ucaucaggugcauagcaagugaa

SEQ ID NO: 794470 - RNA, 19 nt, Homo sapiens
ucaucauauuguauguaag

SEQ ID NO: 794471 - RNA, 13 nt, Homo sapiens
ucaucaugauaag

SEQ ID NO: 794472 - RNA, 12 nt, Homo sapiens
ucaucauucccu

SEQ ID NO: 794473 - RNA, 16 nt, Homo sapiens
ucaucauucccucuca

SEQ ID NO: 794474 - RNA, 22 nt, Homo sapiens
uagcucccuccucccaucuccu

SEQ ID NO: 794475 - RNA, 16 nt, Homo sapiens
uagcucuauguuuaca

SEQ ID NO: 794476 - RNA, 17 nt, Homo sapiens
uagcucuggaccugucu

SEQ ID NO: 794477 - RNA, 18 nt, Homo sapiens
uagcucuuugggccucuc

SEQ ID NO: 794478 - RNA, 20 nt, Homo sapiens
uagcugcccaggaugcugcu

SEQ ID NO: 794479 - RNA, 16 nt, Homo sapiens
uagcugggacuacagg

SEQ ID NO: 794480 - RNA, 18 nt, Homo sapiens
uagcugggauuacaggug

SEQ ID NO: 794481 - RNA, 19 nt, Homo sapiens
uagcugggauuacaggugu

SEQ ID NO: 794482 - RNA, 15 nt, Homo sapiens
uagcugucugcucag

SEQ ID NO: 794483 - RNA, 14 nt, Homo sapiens
uagcugugcucaga

SEQ ID NO: 794484 - RNA, 22 nt, Homo sapiens
uagcuuacacugaggacugugg

SEQ ID NO: 794485 - RNA, 14 nt, Homo sapiens
uagcuuagaccuca

SEQ ID NO: 794486 - RNA, 13 nt, Homo sapiens
uaccaauguucua

SEQ ID NO: 794487 - RNA, 16 nt, Homo sapiens
uaccacaaacacauua

SEQ ID NO: 794488 - RNA, 22 nt, Homo sapiens
uaccacagcucagccacuguga

SEQ ID NO: 794489 - RNA, 20 nt, Homo sapiens
uaccaccuuuacugugcuua

SEQ ID NO: 794490 - RNA, 13 nt, Homo sapiens
uaccacuacuuag

SEQ ID NO: 794491 - RNA, 14 nt, Homo sapiens
uaccacugcacugu

SEQ ID NO: 794492 - RNA, 12 nt, Homo sapiens
uaccacuguaau

SEQ ID NO: 794493 - RNA, 15 nt, Homo sapiens
uaccagagauuuacc

SEQ ID NO: 794494 - RNA, 23 nt, Homo sapiens
uaccagagccuucaagugccaaa

SEQ ID NO: 794495 - RNA, 20 nt, Homo sapiens
uaccagaggaaguuauggca

SEQ ID NO: 794496 - RNA, 14 nt, Homo sapiens
uaccagaugcugac

SEQ ID NO: 794497 - RNA, 15 nt, Homo sapiens
uaccagcauacgcuc

SEQ ID NO: 794498 - RNA, 18 nt, Homo sapiens
uaccagucuauuuccacu

SEQ ID NO: 794499 - RNA, 13 nt, Homo sapiens
uaccaguugccuu

SEQ ID NO: 794500 - RNA, 23 nt, Homo sapiens
uaccaguuuguccaucuugagau

SEQ ID NO: 794501 - RNA, 18 nt, Homo sapiens
uaccauaagugacaccaa

SEQ ID NO: 794502 - RNA, 15 nt, Homo sapiens
uaccaucugcaucca

SEQ ID NO: 794503 - RNA, 17 nt, Homo sapiens
uaccaucuuguauacac

SEQ ID NO: 794504 - RNA, 13 nt, Homo sapiens
uaccauguggcaa

SEQ ID NO: 794505 - RNA, 16 nt, Homo sapiens
uaccauucacuacuca

SEQ ID NO: 794506 - RNA, 16 nt, Homo sapiens
uaccauugcuguucua

SEQ ID NO: 794507 - RNA, 17 nt, Homo sapiens
uacccaacccugcccug

SEQ ID NO: 794508 - RNA, 14 nt, Homo sapiens
uacccacugccaug

SEQ ID NO: 794509 - RNA, 20 nt, Homo sapiens
uacccagagaauauauacau

SEQ ID NO: 794510 - RNA, 18 nt, Homo sapiens
uacccaggcuuuagcauu

SEQ ID NO: 794511 - RNA, 17 nt, Homo sapiens
uacccaguuacuuauga

SEQ ID NO: 794512 - RNA, 17 nt, Homo sapiens
uacccaucuaguacuug

SEQ ID NO: 794513 - RNA, 14 nt, Homo sapiens
uacccaugaagauu

SEQ ID NO: 794514 - RNA, 22 nt, Homo sapiens
uacccauuuuuuaaaaaagcaa

SEQ ID NO: 794515 - RNA, 13 nt, Homo sapiens
uaccccaccacga

SEQ ID NO: 794516 - RNA, 23 nt, Homo sapiens
uaccccagguucuagucaugugu

SEQ ID NO: 794517 - RNA, 20 nt, Homo sapiens
uacccccugaaagugacaga

SEQ ID NO: 794518 - RNA, 20 nt, Homo sapiens
uaccccgagggcgccaugca

SEQ ID NO: 794519 - RNA, 13 nt, Homo sapiens
uacccuaaccaag

SEQ ID NO: 794520 - RNA, 22 nt, Homo sapiens
uacccuauucuauccaucuccu

SEQ ID NO: 794521 - RNA, 21 nt, Homo sapiens
uacccuccacacaaaccuaaa

SEQ ID NO: 794522 - RNA, 11 nt, Homo sapiens
uacccucucag

SEQ ID NO: 794523 - RNA, 19 nt, Homo sapiens
uacccugaaauucaggaug

SEQ ID NO: 794524 - RNA, 19 nt, Homo sapiens
uacccugagauacuuccca

SEQ ID NO: 794525 - RNA, 16 nt, Homo sapiens
uacccuucuuguccaa

SEQ ID NO: 794526 - RNA, 23 nt, Homo sapiens
uaccgaaguaaacugauguacug

SEQ ID NO: 794527 - RNA, 21 nt, Homo sapiens
uaccgaguucaagugauuuuc

SEQ ID NO: 794528 - RNA, 17 nt, Homo sapiens
uaccgaugcagcucucu

SEQ ID NO: 794529 - RNA, 17 nt, Homo sapiens
uaccgggcuggccugug

SEQ ID NO: 794530 - RNA, 21 nt, Homo sapiens
uaccuaaggacaagacacuga

SEQ ID NO: 794531 - RNA, 17 nt, Homo sapiens
uaccuacaagaacaaug

SEQ ID NO: 794532 - RNA, 15 nt, Homo sapiens
uaccuacaucaguca

SEQ ID NO: 794533 - RNA, 18 nt, Homo sapiens
uaccuagaauagucucac

SEQ ID NO: 794534 - RNA, 16 nt, Homo sapiens
uaccuagggacacaca

SEQ ID NO: 794535 - RNA, 15 nt, Homo sapiens
uaccuauacaaugua

SEQ ID NO: 794536 - RNA, 15 nt, Homo sapiens
uaccuaucaucuuaa

SEQ ID NO: 794537 - RNA, 20 nt, Homo sapiens
uaccucaaagggcaguuuug

SEQ ID NO: 794538 - RNA, 23 nt, Homo sapiens
uaccuccuaauuccacacccuca

SEQ ID NO: 794539 - RNA, 16 nt, Homo sapiens
uaccucucagccuuag

SEQ ID NO: 794540 - RNA, 12 nt, Homo sapiens
uaccucugagaa

SEQ ID NO: 794541 - RNA, 13 nt, Homo sapiens
uaccucugagaag

SEQ ID NO: 794542 - RNA, 18 nt, Homo sapiens
uaccucuucucucucagu

SEQ ID NO: 794543 - RNA, 19 nt, Homo sapiens
uaccucuuggcugccuugu

SEQ ID NO: 794544 - RNA, 16 nt, Homo sapiens
uaccucuuucaggguu

SEQ ID NO: 794545 - RNA, 23 nt, Homo sapiens
uaccugcccccaucauaagggca

SEQ ID NO: 794546 - RNA, 15 nt, Homo sapiens
uaccuggaccugucc

SEQ ID NO: 794547 - RNA, 15 nt, Homo sapiens
uaccugggaccucac

SEQ ID NO: 794548 - RNA, 13 nt, Homo sapiens
uaccugggcauuc

SEQ ID NO: 794549 - RNA, 21 nt, Homo sapiens
uaccugggcauucuuguuuca

SEQ ID NO: 794550 - RNA, 14 nt, Homo sapiens
uaccugguuuacuu

SEQ ID NO: 794551 - RNA, 22 nt, Homo sapiens
uaccuguaagggcaaagucaau

SEQ ID NO: 794552 - RNA, 18 nt, Homo sapiens
uaccuguacuaaaccacc

SEQ ID NO: 794553 - RNA, 16 nt, Homo sapiens
uaccuguagugagaaa

SEQ ID NO: 794554 - RNA, 11 nt, Homo sapiens
uaccugucaau

SEQ ID NO: 794555 - RNA, 22 nt, Homo sapiens
uaccuucaggcagccaguguga

SEQ ID NO: 794556 - RNA, 23 nt, Homo sapiens
uaccuucauguggcucagugccu

SEQ ID NO: 794557 - RNA, 23 nt, Homo sapiens
uaccuucaugugguucagugccu

SEQ ID NO: 794558 - RNA, 19 nt, Homo sapiens
uaccuuccuuaagccagga

SEQ ID NO: 794559 - RNA, 21 nt, Homo sapiens
uaccuucuaccucuuggcugc

SEQ ID NO: 794560 - RNA, 14 nt, Homo sapiens
uaccuucuuucacu

SEQ ID NO: 794561 - RNA, 17 nt, Homo sapiens
uaccuugaacacugggg

SEQ ID NO: 794562 - RNA, 18 nt, Homo sapiens
uaccuuggcugauguugc

SEQ ID NO: 794563 - RNA, 13 nt, Homo sapiens
uaccuuugcugau

SEQ ID NO: 794564 - RNA, 15 nt, Homo sapiens
uacgaugacaguguu

SEQ ID NO: 794565 - RNA, 17 nt, Homo sapiens
uacgcauggcuuccucc

SEQ ID NO: 794566 - RNA, 16 nt, Homo sapiens
uacgcugcugcaggac

SEQ ID NO: 794567 - RNA, 15 nt, Homo sapiens
uacgcuuugcucaaa

SEQ ID NO: 794568 - RNA, 20 nt, Homo sapiens
uacgguaccuggcaauguuu

SEQ ID NO: 794569 - RNA, 13 nt, Homo sapiens
uacguaucugcuc

SEQ ID NO: 794570 - RNA, 15 nt, Homo sapiens
uacgucaaagcagua

SEQ ID NO: 794571 - RNA, 17 nt, Homo sapiens
uacgugacuguggcaca

SEQ ID NO: 794572 - RNA, 21 nt, Homo sapiens
uacguggaaacaauccuguua

SEQ ID NO: 794573 - RNA, 20 nt, Homo sapiens
uacguucaucaccugcuaga

SEQ ID NO: 794574 - RNA, 20 nt, Homo sapiens
uacguuuccugagaaguguc

SEQ ID NO: 794575 - RNA, 19 nt, Homo sapiens
uacguuugaaauaguugau

SEQ ID NO: 794576 - RNA, 14 nt, Homo sapiens
uacuaaaacauaca

SEQ ID NO: 794577 - RNA, 18 nt, Homo sapiens
uacuaaaagcaauguuua

SEQ ID NO: 794578 - RNA, 15 nt, Homo sapiens
uacuaaagacgguau

SEQ ID NO: 794579 - RNA, 14 nt, Homo sapiens
uacuaagcauuuca

SEQ ID NO: 794580 - RNA, 21 nt, Homo sapiens
uacuaauuuucuagauuuucu

SEQ ID NO: 794581 - RNA, 19 nt, Homo sapiens
uacuacaaacuucaaagag

SEQ ID NO: 794582 - RNA, 16 nt, Homo sapiens
uacuacccagcucugu

SEQ ID NO: 794583 - RNA, 14 nt, Homo sapiens
uacuaccugucaag

SEQ ID NO: 794584 - RNA, 14 nt, Homo sapiens
uacuagcacuuuga

SEQ ID NO: 794585 - RNA, 21 nt, Homo sapiens
uacuauccuguaaauauaucu

SEQ ID NO: 794586 - RNA, 16 nt, Homo sapiens
uacuaugcacaacaga

SEQ ID NO: 794587 - RNA, 18 nt, Homo sapiens
uacuaugcucuagagaaa

SEQ ID NO: 794588 - RNA, 12 nt, Homo sapiens
uacuauguuaau

SEQ ID NO: 794589 - RNA, 14 nt, Homo sapiens
uacuauugcaaaag

SEQ ID NO: 794590 - RNA, 21 nt, Homo sapiens
uacucaaagcaaaagugcugc

SEQ ID NO: 794591 - RNA, 20 nt, Homo sapiens
uacucaacccauuguuguca

SEQ ID NO: 794592 - RNA, 22 nt, Homo sapiens
uagacacaucuauaauuuuaca

SEQ ID NO: 794593 - RNA, 10 nt, Homo sapiens
uagacaccaa

SEQ ID NO: 794594 - RNA, 17 nt, Homo sapiens
uagacagaaaccaagcc

SEQ ID NO: 794595 - RNA, 16 nt, Homo sapiens
uagacagaguugcuua

SEQ ID NO: 794596 - RNA, 19 nt, Homo sapiens
uagacagguguuacuuaca

SEQ ID NO: 794597 - RNA, 20 nt, Homo sapiens
uagacagguguuacuuacag

SEQ ID NO: 794598 - RNA, 12 nt, Homo sapiens
uagaccuuggca

SEQ ID NO: 794599 - RNA, 13 nt, Homo sapiens
uagaccuuuuccc

SEQ ID NO: 794600 - RNA, 16 nt, Homo sapiens
uagacggugcucacuc

SEQ ID NO: 794601 - RNA, 13 nt, Homo sapiens
uagacuacauuua

SEQ ID NO: 794602 - RNA, 14 nt, Homo sapiens
uagacuacauuuag

SEQ ID NO: 794603 - RNA, 20 nt, Homo sapiens
cauuggaagcuuugaguuga

SEQ ID NO: 794604 - RNA, 20 nt, Homo sapiens
cauuggaauucuacuggaaa

SEQ ID NO: 794605 - RNA, 21 nt, Homo sapiens
cauuggaccuuuccugaggaa

SEQ ID NO: 794606 - RNA, 13 nt, Homo sapiens
cauuggagcauuu

SEQ ID NO: 794607 - RNA, 21 nt, Homo sapiens
cauuggauucaucagcauuug

SEQ ID NO: 794608 - RNA, 17 nt, Homo sapiens
cauuggccgacaucaca

SEQ ID NO: 794609 - RNA, 16 nt, Homo sapiens
cauugggagucuguag

SEQ ID NO: 794610 - RNA, 19 nt, Homo sapiens
cauugggcugacaccuacc

SEQ ID NO: 794611 - RNA, 17 nt, Homo sapiens
cauugguaagaaugagc

SEQ ID NO: 794612 - RNA, 21 nt, Homo sapiens
cauuggugaccugcggcagua

SEQ ID NO: 794613 - RNA, 15 nt, Homo sapiens
cauuguagaaacaca

SEQ ID NO: 794614 - RNA, 17 nt, Homo sapiens
cauuguagaagcagcau

SEQ ID NO: 794615 - RNA, 20 nt, Homo sapiens
cauugucuacauagugacau

SEQ ID NO: 794616 - RNA, 19 nt, Homo sapiens
cauugugacuguguuugca

SEQ ID NO: 794617 - RNA, 18 nt, Homo sapiens
cauuguggacuguaucca

SEQ ID NO: 794618 - RNA, 22 nt, Homo sapiens
cauuguguucucuauugcugcu

SEQ ID NO: 794619 - RNA, 21 nt, Homo sapiens
cauuguuuuugucauguagcu

SEQ ID NO: 794620 - RNA, 17 nt, Homo sapiens
cauuuaaaacaggcaaa

SEQ ID NO: 794621 - RNA, 16 nt, Homo sapiens
cauuuaaaauucaauu

SEQ ID NO: 794622 - RNA, 22 nt, Homo sapiens
cauuuaaaauugcuauguuacu

SEQ ID NO: 794623 - RNA, 20 nt, Homo sapiens
cauuuaauacagcaguguca

SEQ ID NO: 794624 - RNA, 20 nt, Homo sapiens
cauuuacaagugcugcaagu

SEQ ID NO: 794625 - RNA, 12 nt, Homo sapiens
cauuuacuuaac

SEQ ID NO: 794626 - RNA, 22 nt, Homo sapiens
cauuuacuuagcagaaccacau

SEQ ID NO: 794627 - RNA, 15 nt, Homo sapiens
cauuuagaacuugca

SEQ ID NO: 794628 - RNA, 16 nt, Homo sapiens
cauuuagaacuuuaag

SEQ ID NO: 794629 - RNA, 19 nt, Homo sapiens
cauuuaggagaauagcaga

SEQ ID NO: 794630 - RNA, 17 nt, Homo sapiens
cauuuagucuugccagg

SEQ ID NO: 794631 - RNA, 15 nt, Homo sapiens
cauuuauaaaaccau

SEQ ID NO: 794632 - RNA, 12 nt, Homo sapiens
cauuuauacuaa

SEQ ID NO: 794633 - RNA, 16 nt, Homo sapiens
cauuuauguguagaau

SEQ ID NO: 794634 - RNA, 18 nt, Homo sapiens
cauuuauuuugacuguga

SEQ ID NO: 794635 - RNA, 16 nt, Homo sapiens
cauuuauuuuuaguua

SEQ ID NO: 794636 - RNA, 20 nt, Homo sapiens
cauuucaucagcaaguuugg

SEQ ID NO: 794637 - RNA, 20 nt, Homo sapiens
cauuucauuaagguuccagu

SEQ ID NO: 794638 - RNA, 16 nt, Homo sapiens
cauuucauugcagaua

SEQ ID NO: 794639 - RNA, 18 nt, Homo sapiens
cauuuccaacaccacaga

SEQ ID NO: 794640 - RNA, 16 nt, Homo sapiens
cauuucccaucugcac

SEQ ID NO: 794641 - RNA, 16 nt, Homo sapiens
cauuuccuggucagug

SEQ ID NO: 794642 - RNA, 16 nt, Homo sapiens
cauuuccuuccuucca

SEQ ID NO: 794643 - RNA, 19 nt, Homo sapiens
cauuucucaaaugcacauc

SEQ ID NO: 794644 - RNA, 22 nt, Homo sapiens
cauuucucaaucagugcaguga

SEQ ID NO: 794645 - RNA, 17 nt, Homo sapiens
cauuucugucacucaca

SEQ ID NO: 794646 - RNA, 14 nt, Homo sapiens
cauuucugucucca

SEQ ID NO: 794647 - RNA, 13 nt, Homo sapiens
cauuucuugaugu

SEQ ID NO: 794648 - RNA, 13 nt, Homo sapiens
cauuucuuugugc

SEQ ID NO: 794649 - RNA, 16 nt, Homo sapiens
cauuugaagcagugau

SEQ ID NO: 794650 - RNA, 18 nt, Homo sapiens
cauuugagauaaagucaa

SEQ ID NO: 794651 - RNA, 19 nt, Homo sapiens
cauuugagauaaagucaaa

SEQ ID NO: 794652 - RNA, 20 nt, Homo sapiens
cauuugaguugcccaucuug

SEQ ID NO: 794653 - RNA, 17 nt, Homo sapiens
cauuugauugucauuuu

SEQ ID NO: 794654 - RNA, 15 nt, Homo sapiens
cauuugcaccuaccu

SEQ ID NO: 794655 - RNA, 23 nt, Homo sapiens
gugagcuauaauguuucccucaa

SEQ ID NO: 794656 - RNA, 16 nt, Homo sapiens
guggcaggaggcuuug

SEQ ID NO: 794657 - RNA, 20 nt, Homo sapiens
guggcaucaucucagcucac

SEQ ID NO: 794658 - RNA, 15 nt, Homo sapiens
guggcaucuugccaa

SEQ ID NO: 794659 - RNA, 12 nt, Homo sapiens
guggcaugcaug

SEQ ID NO: 794660 - RNA, 13 nt, Homo sapiens
guggcauguggcc

SEQ ID NO: 794661 - RNA, 14 nt, Homo sapiens
guggcccaagacaa

SEQ ID NO: 794662 - RNA, 20 nt, Homo sapiens
guggccucccugcucuaucc

SEQ ID NO: 794663 - RNA, 14 nt, Homo sapiens
guggccugccuuca

SEQ ID NO: 794664 - RNA, 14 nt, Homo sapiens
guggccuuccccuu

SEQ ID NO: 794665 - RNA, 17 nt, Homo sapiens
guggccuugaccuccaa

SEQ ID NO: 794666 - RNA, 14 nt, Homo sapiens
guggcgcgaucuca

SEQ ID NO: 794667 - RNA, 18 nt, Homo sapiens
guggcucacccuguccag

SEQ ID NO: 794668 - RNA, 24 nt, Homo sapiens
guggcucacuacugaacacaugug

SEQ ID NO: 794669 - RNA, 13 nt, Homo sapiens
guggcugcaguua

SEQ ID NO: 794670 - RNA, 17 nt, Homo sapiens
guggcugccccaccugc

SEQ ID NO: 794671 - RNA, 20 nt, Homo sapiens
guggcugccccggccuccuc

SEQ ID NO: 794672 - RNA, 19 nt, Homo sapiens
guggcugugccaccaagca

SEQ ID NO: 794673 - RNA, 19 nt, Homo sapiens
guggcuuguaucaacacug

SEQ ID NO: 794674 - RNA, 19 nt, Homo sapiens
gugggaacucacuuucccu

SEQ ID NO: 794675 - RNA, 17 nt, Homo sapiens
gugggacacaacacaga

SEQ ID NO: 794676 - RNA, 23 nt, Homo sapiens
gugggacuuugcaccucugcuga

SEQ ID NO: 794677 - RNA, 15 nt, Homo sapiens
gugggagaucuucac

SEQ ID NO: 794678 - RNA, 21 nt, Homo sapiens
gugggagcagcgguuugggga

SEQ ID NO: 794679 - RNA, 16 nt, Homo sapiens
gugggagggacuuugc

SEQ ID NO: 794680 - RNA, 21 nt, Homo sapiens
gugggauauugaauguuaaag

SEQ ID NO: 794681 - RNA, 22 nt, Homo sapiens
gugggaucauccagaggagcug

SEQ ID NO: 794682 - RNA, 21 nt, Homo sapiens
gugggcaggcaggagcagggg

SEQ ID NO: 794683 - RNA, 15 nt, Homo sapiens
gugggccacagccau

SEQ ID NO: 794684 - RNA, 12 nt, Homo sapiens
gugggcccagca

SEQ ID NO: 794685 - RNA, 21 nt, Homo sapiens
gugggcccccaaugacaccca

SEQ ID NO: 794686 - RNA, 17 nt, Homo sapiens
gugggccguguggcaca

SEQ ID NO: 794687 - RNA, 12 nt, Homo sapiens
gugggcugugag

SEQ ID NO: 794688 - RNA, 18 nt, Homo sapiens
guggggcaggagugccag

SEQ ID NO: 794689 - RNA, 23 nt, Homo sapiens
gugggggugccgcugucucugag

SEQ ID NO: 794690 - RNA, 20 nt, Homo sapiens
gugggggugcucucucugag

SEQ ID NO: 794691 - RNA, 14 nt, Homo sapiens
gugggguacauuuc

SEQ ID NO: 794692 - RNA, 21 nt, Homo sapiens
gugggguauagaaaaaggaau

SEQ ID NO: 794693 - RNA, 19 nt, Homo sapiens
gugggugaaacagaacaau

SEQ ID NO: 794694 - RNA, 21 nt, Homo sapiens
guggguggcuucuaguuugca

SEQ ID NO: 794695 - RNA, 14 nt, Homo sapiens
gugguacagcacug

SEQ ID NO: 794696 - RNA, 19 nt, Homo sapiens
gugguacuuuauucuugcu

SEQ ID NO: 794697 - RNA, 21 nt, Homo sapiens
gugguagagaagcaaguaaaa

SEQ ID NO: 794698 - RNA, 18 nt, Homo sapiens
gugguauacauguguaca

SEQ ID NO: 794699 - RNA, 21 nt, Homo sapiens
gugguaucugugaacauguua

SEQ ID NO: 794700 - RNA, 16 nt, Homo sapiens
gugguaugucugccau

SEQ ID NO: 794701 - RNA, 19 nt, Homo sapiens
guggucagagggacuguca

SEQ ID NO: 794702 - RNA, 20 nt, Homo sapiens
guggucagagggacugucag

SEQ ID NO: 794703 - RNA, 16 nt, Homo sapiens
guggucagagugccac

SEQ ID NO: 794704 - RNA, 17 nt, Homo sapiens
guggucuccuugcacuu

SEQ ID NO: 794705 - RNA, 15 nt, Homo sapiens
guggucuugaucucc

SEQ ID NO: 794706 - RNA, 14 nt, Homo sapiens
guggugacaccucc

SEQ ID NO: 794707 - RNA, 17 nt, Homo sapiens
guggugacaccuccccc

SEQ ID NO: 794708 - RNA, 14 nt, Homo sapiens
guggugauguugcc

SEQ ID NO: 794709 - RNA, 13 nt, Homo sapiens
gugguggcacuga

SEQ ID NO: 794710 - RNA, 23 nt, Homo sapiens
gugguggcauacgccuguagucc

SEQ ID NO: 794711 - RNA, 17 nt, Homo sapiens
gugguuccucugcucac

SEQ ID NO: 794712 - RNA, 21 nt, Homo sapiens
gugguugucuuauugcaccau

SEQ ID NO: 794713 - RNA, 15 nt, Homo sapiens
gugguuugagacacu

SEQ ID NO: 794714 - RNA, 22 nt, Homo sapiens
gugguuuuauacugaaggaaaa

SEQ ID NO: 794715 - RNA, 14 nt, Homo sapiens
guguaaaaagcaaa

SEQ ID NO: 794716 - RNA, 15 nt, Homo sapiens
guguaacagauauca

SEQ ID NO: 794717 - RNA, 17 nt, Homo sapiens
guguaagcucacaucca

SEQ ID NO: 794718 - RNA, 14 nt, Homo sapiens
guguaaguaauuau

SEQ ID NO: 794719 - RNA, 19 nt, Homo sapiens
guguaauggaaaccaagga

SEQ ID NO: 794720 - RNA, 14 nt, Homo sapiens
guguaccacuacuu

SEQ ID NO: 794721 - RNA, 13 nt, Homo sapiens
guguacucuuuau

SEQ ID NO: 794722 - RNA, 12 nt, Homo sapiens
guguacugugga

SEQ ID NO: 794723 - RNA, 14 nt, Homo sapiens
guguagaauuugaa

SEQ ID NO: 794724 - RNA, 14 nt, Homo sapiens
guguagacauguca

SEQ ID NO: 794725 - RNA, 17 nt, Homo sapiens
guguagagcaagccagu

SEQ ID NO: 794726 - RNA, 14 nt, Homo sapiens
guguagccugugca

SEQ ID NO: 794727 - RNA, 20 nt, Homo sapiens
guguagcuguccucucagaa

SEQ ID NO: 794728 - RNA, 23 nt, Homo sapiens
guguauauaguaugaaugcagug

SEQ ID NO: 794729 - RNA, 14 nt, Homo sapiens
guguauaugugcca

SEQ ID NO: 794730 - RNA, 22 nt, Homo sapiens
guguauccaugcaccuaccuua

SEQ ID NO: 794731 - RNA, 23 nt, Homo sapiens
guguaucggaugcuuuuguucag

SEQ ID NO: 794732 - RNA, 17 nt, Homo sapiens
guguaucuuuaagaaaa

SEQ ID NO: 794733 - RNA, 15 nt, Homo sapiens
guguaugcacagggu

SEQ ID NO: 794734 - RNA, 13 nt, Homo sapiens
guguaugcugaug

SEQ ID NO: 794735 - RNA, 18 nt, Homo sapiens
guguauggccugaagcuc

SEQ ID NO: 794736 - RNA, 22 nt, Homo sapiens
guguauggguuaaaucaaagau

SEQ ID NO: 794737 - RNA, 14 nt, Homo sapiens
guguauucauuuua

SEQ ID NO: 794738 - RNA, 14 nt, Homo sapiens
gugucaaaagccag

SEQ ID NO: 794739 - RNA, 19 nt, Homo sapiens
gugucaccuacgugccacu

SEQ ID NO: 794740 - RNA, 22 nt, Homo sapiens
gugucacuacucacagucucuu

SEQ ID NO: 794741 - RNA, 20 nt, Homo sapiens
gugucaggcagguuugccag

SEQ ID NO: 794742 - RNA, 12 nt, Homo sapiens
gugucaggugac

SEQ ID NO: 794743 - RNA, 23 nt, Homo sapiens
gugucauaucaucccugcaaaaa

SEQ ID NO: 794744 - RNA, 18 nt, Homo sapiens
gugucaugaagugcacag

SEQ ID NO: 794745 - RNA, 18 nt, Homo sapiens
gugucauuggaagccauc

SEQ ID NO: 794746 - RNA, 14 nt, Homo sapiens
guguccaaggagca

SEQ ID NO: 794747 - RNA, 20 nt, Homo sapiens
guguccguccacccuuccau

SEQ ID NO: 794748 - RNA, 16 nt, Homo sapiens
gugucgcgcacacagc

SEQ ID NO: 794749 - RNA, 17 nt, Homo sapiens
gugucuaguuugcauac

SEQ ID NO: 794750 - RNA, 17 nt, Homo sapiens
gugucucugcaugugua

SEQ ID NO: 794751 - RNA, 20 nt, Homo sapiens
gugucuguacacguguccug

SEQ ID NO: 794752 - RNA, 16 nt, Homo sapiens
gugugaccauguucau

SEQ ID NO: 794753 - RNA, 17 nt, Homo sapiens
gugugcauagcguccug

SEQ ID NO: 794754 - RNA, 18 nt, Homo sapiens
gugugccaagaguucgau

SEQ ID NO: 794755 - RNA, 19 nt, Homo sapiens
gugugcugacgagcagggu

SEQ ID NO: 794756 - RNA, 13 nt, Homo sapiens
guguggacugugc

SEQ ID NO: 794757 - RNA, 22 nt, Homo sapiens
guguggacuuugagcacacuuu

SEQ ID NO: 794758 - RNA, 13 nt, Homo sapiens
guguggcugugaa

SEQ ID NO: 794759 - RNA, 21 nt, Homo sapiens
guguggggcugccgaugggaa

SEQ ID NO: 794760 - RNA, 11 nt, Homo sapiens
gugugguggcu

SEQ ID NO: 794761 - RNA, 22 nt, Homo sapiens
gugugguugcucacagcuguaa

SEQ ID NO: 794762 - RNA, 12 nt, Homo sapiens
guguguccaaaa

SEQ ID NO: 794763 - RNA, 20 nt, Homo sapiens
gugugucugguggguggagu

SEQ ID NO: 794764 - RNA, 14 nt, Homo sapiens
gugugugcccgugu

SEQ ID NO: 794765 - RNA, 17 nt, Homo sapiens
guguguguauacaugcc

SEQ ID NO: 794766 - RNA, 14 nt, Homo sapiens
guguguugauccca

SEQ ID NO: 794767 - RNA, 17 nt, Homo sapiens
guguuacuguugcacug

SEQ ID NO: 794768 - RNA, 18 nt, Homo sapiens
guguucacaaacugugaa

SEQ ID NO: 794769 - RNA, 16 nt, Homo sapiens
guguucagccaaguga

SEQ ID NO: 794770 - RNA, 22 nt, Homo sapiens
guguuccauugccauagcugac

SEQ ID NO: 794771 - RNA, 19 nt, Homo sapiens
gucauggaggccaagaacu

SEQ ID NO: 794772 - RNA, 19 nt, Homo sapiens
gucauucaagccugugaau

SEQ ID NO: 794773 - RNA, 22 nt, Homo sapiens
gucauucuaggauguggagcua

SEQ ID NO: 794774 - RNA, 23 nt, Homo sapiens
gucauuuuuaacagcaugcugcu

SEQ ID NO: 794775 - RNA, 16 nt, Homo sapiens
guccaaacugccuaag

SEQ ID NO: 794776 - RNA, 17 nt, Homo sapiens
guccaacaagaaugcau

SEQ ID NO: 794777 - RNA, 18 nt, Homo sapiens
guccaauacacgcgugug

SEQ ID NO: 794778 - RNA, 13 nt, Homo sapiens
guccacaaagcau

SEQ ID NO: 794779 - RNA, 13 nt, Homo sapiens
guccacaggucua

SEQ ID NO: 794780 - RNA, 21 nt, Homo sapiens
guccacccucauuucugccag

SEQ ID NO: 794781 - RNA, 14 nt, Homo sapiens
guccacugucaggg

SEQ ID NO: 794782 - RNA, 18 nt, Homo sapiens
guccagaagaauauucag

SEQ ID NO: 794783 - RNA, 18 nt, Homo sapiens
guccagagggacagucag

SEQ ID NO: 794784 - RNA, 11 nt, Homo sapiens
guccagcaccu

SEQ ID NO: 794785 - RNA, 13 nt, Homo sapiens
guccagcaccuug

SEQ ID NO: 794786 - RNA, 11 nt, Homo sapiens
guccaggaaac

SEQ ID NO: 794787 - RNA, 19 nt, Homo sapiens
guccaggagcuaaucugac

SEQ ID NO: 794788 - RNA, 23 nt, Homo sapiens
guccaggccugugaggugcagag

SEQ ID NO: 794789 - RNA, 19 nt, Homo sapiens
guccaggguggaugaucuc

SEQ ID NO: 794790 - RNA, 18 nt, Homo sapiens
guccagucucuucugcug

SEQ ID NO: 794791 - RNA, 14 nt, Homo sapiens
guccagucugugau

SEQ ID NO: 794792 - RNA, 22 nt, Homo sapiens
guccauacacuuuguugcaaga

SEQ ID NO: 794793 - RNA, 19 nt, Homo sapiens
guccauguaauauucccau

SEQ ID NO: 794794 - RNA, 14 nt, Homo sapiens
guccauuuugcccu

SEQ ID NO: 794795 - RNA, 21 nt, Homo sapiens
gucccaagauguugauuuuua

SEQ ID NO: 794796 - RNA, 19 nt, Homo sapiens
gucccagaaaugucaugag

SEQ ID NO: 794797 - RNA, 15 nt, Homo sapiens
gucccagaguggcug

SEQ ID NO: 794798 - RNA, 18 nt, Homo sapiens
gucccagccgcacuggga

SEQ ID NO: 794799 - RNA, 15 nt, Homo sapiens
gucccagcuacucag

SEQ ID NO: 794800 - RNA, 16 nt, Homo sapiens
gucccaggagcaggac

SEQ ID NO: 794801 - RNA, 22 nt, Homo sapiens
gucccagggaagguggggcccu

SEQ ID NO: 794802 - RNA, 18 nt, Homo sapiens
gucccaguagccaaggcc

SEQ ID NO: 794803 - RNA, 21 nt, Homo sapiens
gucccaugaccuugggguaca

SEQ ID NO: 794804 - RNA, 17 nt, Homo sapiens
guccccaguuugcagaa

SEQ ID NO: 794805 - RNA, 16 nt, Homo sapiens
gucccccaaacauguu

SEQ ID NO: 794806 - RNA, 16 nt, Homo sapiens
guccccgaugcugacc

SEQ ID NO: 794807 - RNA, 19 nt, Homo sapiens
guccccgaugcugaccuca

SEQ ID NO: 794808 - RNA, 19 nt, Homo sapiens
guccccgcucagucuuuga

SEQ ID NO: 794809 - RNA, 17 nt, Homo sapiens
guccccucaccuccucu

SEQ ID NO: 794810 - RNA, 21 nt, Homo sapiens
guccccuccccggcccuacca

SEQ ID NO: 794811 - RNA, 23 nt, Homo sapiens
guccccucuuuucccuucagucu

SEQ ID NO: 794812 - RNA, 19 nt, Homo sapiens
gucccggggccagcacuuc

SEQ ID NO: 794813 - RNA, 20 nt, Homo sapiens
gucccggggccagcacuucc

SEQ ID NO: 794814 - RNA, 16 nt, Homo sapiens
gucccggguguguaca

SEQ ID NO: 794815 - RNA, 11 nt, Homo sapiens
gucccuaccuc

SEQ ID NO: 794816 - RNA, 23 nt, Homo sapiens
gucccucuccuauguggcagcug

SEQ ID NO: 794817 - RNA, 18 nt, Homo sapiens
gucccugccacacucagu

SEQ ID NO: 794818 - RNA, 22 nt, Homo sapiens
gucccugguucauugauggaug

SEQ ID NO: 794819 - RNA, 19 nt, Homo sapiens
gucccuugcuguaugcuga

SEQ ID NO: 794820 - RNA, 17 nt, Homo sapiens
gucccuugcugugagca

SEQ ID NO: 794821 - RNA, 20 nt, Homo sapiens
gucccuuuaugcagagccac

SEQ ID NO: 794822 - RNA, 17 nt, Homo sapiens
gucccuuucccuaccuu

SEQ ID NO: 794823 - RNA, 22 nt, Homo sapiens
gucccuuugagcagaaauuuau

SEQ ID NO: 794824 - RNA, 17 nt, Homo sapiens
guccgcgcgccagcaca

SEQ ID NO: 794825 - RNA, 13 nt, Homo sapiens
guccuaaggccca

SEQ ID NO: 794826 - RNA, 22 nt, Homo sapiens
guccuaccacucuaaucaagaa

SEQ ID NO: 794827 - RNA, 20 nt, Homo sapiens
guccuaccuuugcugaugcc

SEQ ID NO: 794828 - RNA, 15 nt, Homo sapiens
guccuaggacuuaaa

SEQ ID NO: 794829 - RNA, 13 nt, Homo sapiens
guccuauucugua

SEQ ID NO: 794830 - RNA, 17 nt, Homo sapiens
guccucacaucuuucac

SEQ ID NO: 794831 - RNA, 12 nt, Homo sapiens
guccucacccau

SEQ ID NO: 794832 - RNA, 19 nt, Homo sapiens
guccucagccuugccagag

SEQ ID NO: 794833 - RNA, 21 nt, Homo sapiens
guccucauuauaaaaugggaa

SEQ ID NO: 794834 - RNA, 12 nt, Homo sapiens
guccucauucuu

SEQ ID NO: 794835 - RNA, 15 nt, Homo sapiens
guccucccaggccag

SEQ ID NO: 794836 - RNA, 23 nt, Homo sapiens
guccuccccuauugcgcucucaa

SEQ ID NO: 794837 - RNA, 15 nt, Homo sapiens
guccuccuaucuccc

SEQ ID NO: 794838 - RNA, 14 nt, Homo sapiens
guccucucaguaau

SEQ ID NO: 794839 - RNA, 12 nt, Homo sapiens
guccucucugag

SEQ ID NO: 794840 - RNA, 16 nt, Homo sapiens
guccugacacuauuca

SEQ ID NO: 794841 - RNA, 12 nt, Homo sapiens
guccugaccacc

SEQ ID NO: 794842 - RNA, 16 nt, Homo sapiens
guccugcucucuucag

SEQ ID NO: 794843 - RNA, 18 nt, Homo sapiens
guccuggcugcacucuug

SEQ ID NO: 794844 - RNA, 14 nt, Homo sapiens
guccuggggaccau

SEQ ID NO: 794845 - RNA, 17 nt, Homo sapiens
guccuggggaccauuca

SEQ ID NO: 794846 - RNA, 17 nt, Homo sapiens
guccuggucaugcacau

SEQ ID NO: 794847 - RNA, 15 nt, Homo sapiens
guccuggugucucca

SEQ ID NO: 794848 - RNA, 15 nt, Homo sapiens
guccuguacauugug

SEQ ID NO: 794849 - RNA, 16 nt, Homo sapiens
guccuguccugcucau

SEQ ID NO: 794850 - RNA, 23 nt, Homo sapiens
guccuuaaaaaucacacuguaaa

SEQ ID NO: 794851 - RNA, 19 nt, Homo sapiens
guccuucgcccugugcacc

SEQ ID NO: 794852 - RNA, 20 nt, Homo sapiens
guccuugggccuggccaguc

SEQ ID NO: 794853 - RNA, 19 nt, Homo sapiens
guccuuguuguuucuugcc

SEQ ID NO: 794854 - RNA, 20 nt, Homo sapiens
guccuuuaaucacugcauuu

SEQ ID NO: 794855 - RNA, 14 nt, Homo sapiens
guccuuucauuugu

SEQ ID NO: 794856 - RNA, 23 nt, Homo sapiens
guccuuucccuucaguacccucu

SEQ ID NO: 794857 - RNA, 18 nt, Homo sapiens
guccuuucuaaguauuuu

SEQ ID NO: 794858 - RNA, 14 nt, Homo sapiens
guccuuucuugcag

SEQ ID NO: 794859 - RNA, 14 nt, Homo sapiens
guccuuuugacacu

SEQ ID NO: 794860 - RNA, 21 nt, Homo sapiens
guccuuuugacacugcucuaa

SEQ ID NO: 794861 - RNA, 16 nt, Homo sapiens
guccuuuuguaccaug

SEQ ID NO: 794862 - RNA, 18 nt, Homo sapiens
guccuuuuucacuuugaa

SEQ ID NO: 794863 - RNA, 17 nt, Homo sapiens
gucgaugaucaccaagc

SEQ ID NO: 794864 - RNA, 20 nt, Homo sapiens
gucggaacccaagcuuagaa

SEQ ID NO: 794865 - RNA, 14 nt, Homo sapiens
gucggauccuguga

SEQ ID NO: 794866 - RNA, 19 nt, Homo sapiens
gucgucaaugaugaguccu

SEQ ID NO: 794867 - RNA, 19 nt, Homo sapiens
gucuaagguucagccugaa

SEQ ID NO: 794868 - RNA, 19 nt, Homo sapiens
gucuaauagucuuugccag

SEQ ID NO: 794869 - RNA, 14 nt, Homo sapiens
gucuaaugacagau

SEQ ID NO: 794870 - RNA, 13 nt, Homo sapiens
gucuaauguuugu

SEQ ID NO: 794871 - RNA, 17 nt, Homo sapiens
gucuacauugagcauuu

SEQ ID NO: 794872 - RNA, 19 nt, Homo sapiens
gucuacauugagcauuuga

SEQ ID NO: 794873 - RNA, 20 nt, Homo sapiens
gucuaccagagcgugcacuu

SEQ ID NO: 794874 - RNA, 20 nt, Homo sapiens
gucuacccagacucagagac

SEQ ID NO: 794875 - RNA, 14 nt, Homo sapiens
gucuagauucucug

SEQ ID NO: 794876 - RNA, 20 nt, Homo sapiens
gucuaggagacagagccaag

SEQ ID NO: 794877 - RNA, 21 nt, Homo sapiens
gucuaguguuccugcaccaaa

SEQ ID NO: 794878 - RNA, 13 nt, Homo sapiens
gucuauguguaca

SEQ ID NO: 794879 - RNA, 22 nt, Homo sapiens
gucuauguucaaagacugugaa

SEQ ID NO: 794880 - RNA, 19 nt, Homo sapiens
gucuauuuucucagucauu

SEQ ID NO: 794881 - RNA, 12 nt, Homo sapiens
aaaaaaaagccu

SEQ ID NO: 794882 - RNA, 14 nt, Homo sapiens
aaaaaaagaaucac

SEQ ID NO: 794883 - RNA, 18 nt, Homo sapiens
aaaaaaccuucagugaaa

SEQ ID NO: 794884 - RNA, 13 nt, Homo sapiens
aaaaaacuacuuc

SEQ ID NO: 794885 - RNA, 18 nt, Homo sapiens
aaaaaagagaacaccucc

SEQ ID NO: 794886 - RNA, 13 nt, Homo sapiens
aaaaaauacauua

SEQ ID NO: 794887 - RNA, 21 nt, Homo sapiens
aaaaacacccgacgucaugua

SEQ ID NO: 794888 - RNA, 18 nt, Homo sapiens
aaaaacagaaccaaauaa

SEQ ID NO: 794889 - RNA, 11 nt, Homo sapiens
aaaaacaugua

SEQ ID NO: 794890 - RNA, 13 nt, Homo sapiens
aaaaacaugucau

SEQ ID NO: 794891 - RNA, 17 nt, Homo sapiens
aaaaaccccaaacuguu

SEQ ID NO: 794892 - RNA, 22 nt, Homo sapiens
aaaaaccucuaugcaaucugag

SEQ ID NO: 794893 - RNA, 15 nt, Homo sapiens
aaaaaccugauggaa

SEQ ID NO: 794894 - RNA, 20 nt, Homo sapiens
aaaaaccuuuacaguuagca

SEQ ID NO: 794895 - RNA, 23 nt, Homo sapiens
aaaaacuagacuucguacuguga

SEQ ID NO: 794896 - RNA, 15 nt, Homo sapiens
aaaaacuagagcaca

SEQ ID NO: 794897 - RNA, 23 nt, Homo sapiens
aaaaacucuuuggugcacaagua

SEQ ID NO: 794898 - RNA, 11 nt, Homo sapiens
aaaaacugacu

SEQ ID NO: 794899 - RNA, 12 nt, Homo sapiens
aaaaacuuccau

SEQ ID NO: 794900 - RNA, 22 nt, Homo sapiens
aaaaacuuccuucaaucuucau

SEQ ID NO: 794901 - RNA, 21 nt, Homo sapiens
aaaaagauucucaucacucaa

SEQ ID NO: 794902 - RNA, 18 nt, Homo sapiens
aaaaagcaacaucuucau

SEQ ID NO: 794903 - RNA, 13 nt, Homo sapiens
aaaaagcauacuu

SEQ ID NO: 794904 - RNA, 17 nt, Homo sapiens
aaaaagcccuaauagca

SEQ ID NO: 794905 - RNA, 14 nt, Homo sapiens
aaaaagccugugaa

SEQ ID NO: 794906 - RNA, 19 nt, Homo sapiens
aaaaagcuaaugugcaggg

SEQ ID NO: 794907 - RNA, 15 nt, Homo sapiens
aaaaagcuagcacua

SEQ ID NO: 794908 - RNA, 21 nt, Homo sapiens
aaaaagggauccguacauuca

SEQ ID NO: 794909 - RNA, 22 nt, Homo sapiens
aaaaagggauccguacauucaa

SEQ ID NO: 794910 - RNA, 15 nt, Homo sapiens
aaaaaguagagacag

SEQ ID NO: 794911 - RNA, 23 nt, Homo sapiens
aaaaaguccuugauuuagcacua

SEQ ID NO: 794912 - RNA, 16 nt, Homo sapiens
aaaaaguuucacaggu

SEQ ID NO: 794913 - RNA, 16 nt, Homo sapiens
aaaaauaaaaaagauc

SEQ ID NO: 794914 - RNA, 23 nt, Homo sapiens
aaaaauaaaguaccacacauauu

SEQ ID NO: 794915 - RNA, 15 nt, Homo sapiens
auucuccugucucag

SEQ ID NO: 794916 - RNA, 15 nt, Homo sapiens
auucucguuuaaaca

SEQ ID NO: 794917 - RNA, 21 nt, Homo sapiens
auucucucucauuauugagau

SEQ ID NO: 794918 - RNA, 15 nt, Homo sapiens
auucucuuacugcuu

SEQ ID NO: 794919 - RNA, 18 nt, Homo sapiens
auucucuucuugcuauau

SEQ ID NO: 794920 - RNA, 19 nt, Homo sapiens
auucucuugacguuuacau

SEQ ID NO: 794921 - RNA, 13 nt, Homo sapiens
auucucuuugaua

SEQ ID NO: 794922 - RNA, 15 nt, Homo sapiens
auucugaccauuuca

SEQ ID NO: 794923 - RNA, 18 nt, Homo sapiens
auucugaggaagucuuau

SEQ ID NO: 794924 - RNA, 15 nt, Homo sapiens
auucugaggcaggua

SEQ ID NO: 794925 - RNA, 16 nt, Homo sapiens
auucugauauguaucc

SEQ ID NO: 794926 - RNA, 20 nt, Homo sapiens
auucugauguuucugugaaa

SEQ ID NO: 794927 - RNA, 13 nt, Homo sapiens
auucugcuaccaa

SEQ ID NO: 794928 - RNA, 14 nt, Homo sapiens
auucugcuaccaau

SEQ ID NO: 794929 - RNA, 22 nt, Homo sapiens
auucuggcaucuuagaccucca

SEQ ID NO: 794930 - RNA, 23 nt, Homo sapiens
auucugggcuccuggaaccaauc

SEQ ID NO: 794931 - RNA, 22 nt, Homo sapiens
auucugucuucauccccucaga

SEQ ID NO: 794932 - RNA, 18 nt, Homo sapiens
auucuguggauucuauau

SEQ ID NO: 794933 - RNA, 17 nt, Homo sapiens
auucuguugcuuuacag

SEQ ID NO: 794934 - RNA, 14 nt, Homo sapiens
auucuuaaccaaga

SEQ ID NO: 794935 - RNA, 16 nt, Homo sapiens
auucuuaaccaagaaa

SEQ ID NO: 794936 - RNA, 19 nt, Homo sapiens
auucuuaugauuacuauca

SEQ ID NO: 794937 - RNA, 14 nt, Homo sapiens
auucuuauguucca

SEQ ID NO: 794938 - RNA, 17 nt, Homo sapiens
auucuuauguugaauau

SEQ ID NO: 794939 - RNA, 20 nt, Homo sapiens
auucuucagauacaaacugc

SEQ ID NO: 794940 - RNA, 17 nt, Homo sapiens
auucuuccuaaugucag

SEQ ID NO: 794941 - RNA, 13 nt, Homo sapiens
auucuuccugcuu

SEQ ID NO: 794942 - RNA, 18 nt, Homo sapiens
auucuucugagcacuguu

SEQ ID NO: 794943 - RNA, 16 nt, Homo sapiens
auucuugaaguucaug

SEQ ID NO: 794944 - RNA, 19 nt, Homo sapiens
auucuuguauauuauggaa

SEQ ID NO: 794945 - RNA, 17 nt, Homo sapiens
auucuuguucagauuaa

SEQ ID NO: 794946 - RNA, 22 nt, Homo sapiens
auucuuguuugaauuccuccuc

SEQ ID NO: 794947 - RNA, 17 nt, Homo sapiens
auucuuuacugcacuca

SEQ ID NO: 794948 - RNA, 15 nt, Homo sapiens
auucuuuccccagag

SEQ ID NO: 794949 - RNA, 18 nt, Homo sapiens
auucuuugaacaugaacu

SEQ ID NO: 794950 - RNA, 19 nt, Homo sapiens
auucuuuguauaugcauuc

SEQ ID NO: 794951 - RNA, 16 nt, Homo sapiens
auucuuuucucagugu

SEQ ID NO: 794952 - RNA, 20 nt, Homo sapiens
auucuuuucuuuuccauuua

SEQ ID NO: 794953 - RNA, 14 nt, Homo sapiens
auugaaaacacuua

SEQ ID NO: 794954 - RNA, 14 nt, Homo sapiens
auugaaagaaccag

SEQ ID NO: 794955 - RNA, 16 nt, Homo sapiens
auugaaagaaccagag

SEQ ID NO: 794956 - RNA, 17 nt, Homo sapiens
auugaaagcuuuuguua

SEQ ID NO: 794957 - RNA, 17 nt, Homo sapiens
auugaaaucaagcuuau

SEQ ID NO: 794958 - RNA, 22 nt, Homo sapiens
auugaacaaaaauguuuccacu

SEQ ID NO: 794959 - RNA, 21 nt, Homo sapiens
auugaacuuuuguacugaauu

SEQ ID NO: 794960 - RNA, 16 nt, Homo sapiens
auugaaggaaagcuau

SEQ ID NO: 794961 - RNA, 19 nt, Homo sapiens
auugaagguuguauguaaa

SEQ ID NO: 794962 - RNA, 12 nt, Homo sapiens
auugaaguaaug

SEQ ID NO: 794963 - RNA, 12 nt, Homo sapiens
auugaaugaaac

SEQ ID NO: 794964 - RNA, 13 nt, Homo sapiens
auugaauucuaaa

SEQ ID NO: 794965 - RNA, 22 nt, Homo sapiens
auugaauuuuuaagcuacuuau

SEQ ID NO: 794966 - RNA, 21 nt, Homo sapiens
auugacaaccgagaagguuua

SEQ ID NO: 794967 - RNA, 18 nt, Homo sapiens
auugaccaauuccugaca

SEQ ID NO: 794968 - RNA, 23 nt, Homo sapiens
auugaccauuuuuuaauuuacuu

SEQ ID NO: 794969 - RNA, 17 nt, Homo sapiens
auugacuaucaaacuga

SEQ ID NO: 794970 - RNA, 17 nt, Homo sapiens
auugacugucacuguuc

SEQ ID NO: 794971 - RNA, 24 nt, Homo sapiens
auugagaguaaaugacugucuuau

SEQ ID NO: 794972 - RNA, 14 nt, Homo sapiens
auauucaugguugu

SEQ ID NO: 794973 - RNA, 21 nt, Homo sapiens
auauuccugguguagcacuua

SEQ ID NO: 794974 - RNA, 18 nt, Homo sapiens
auauucuauuaacuuuaa

SEQ ID NO: 794975 - RNA, 15 nt, Homo sapiens
auauucucauuuuaa

SEQ ID NO: 794976 - RNA, 18 nt, Homo sapiens
auauucugguuacugugg

SEQ ID NO: 794977 - RNA, 16 nt, Homo sapiens
auauucuuugguugug

SEQ ID NO: 794978 - RNA, 16 nt, Homo sapiens
auauugagggagacag

SEQ ID NO: 794979 - RNA, 17 nt, Homo sapiens
auauuguaaauacugga

SEQ ID NO: 794980 - RNA, 12 nt, Homo sapiens
auauugugauuc

SEQ ID NO: 794981 - RNA, 16 nt, Homo sapiens
auauuguuuucagugu

SEQ ID NO: 794982 - RNA, 16 nt, Homo sapiens
auauuuaaaacaaaga

SEQ ID NO: 794983 - RNA, 16 nt, Homo sapiens
auauuuauaacucauc

SEQ ID NO: 794984 - RNA, 13 nt, Homo sapiens
auauuuaucugau

SEQ ID NO: 794985 - RNA, 17 nt, Homo sapiens
auauuuauucaucuggg

SEQ ID NO: 794986 - RNA, 21 nt, Homo sapiens
auauuuauuuauguguucaca

SEQ ID NO: 794987 - RNA, 23 nt, Homo sapiens
auauuuccuauuguucacuuuau

SEQ ID NO: 794988 - RNA, 18 nt, Homo sapiens
auauuucuaccugaguga

SEQ ID NO: 794989 - RNA, 20 nt, Homo sapiens
auauuucuuaucaccacagu

SEQ ID NO: 794990 - RNA, 17 nt, Homo sapiens
auauuucuugcuuucaa

SEQ ID NO: 794991 - RNA, 20 nt, Homo sapiens
auauuugaaauaguauacau

SEQ ID NO: 794992 - RNA, 17 nt, Homo sapiens
auauuugcuaugaagcg

SEQ ID NO: 794993 - RNA, 19 nt, Homo sapiens
auauuugggccugcuccag

SEQ ID NO: 794994 - RNA, 14 nt, Homo sapiens
auauuuuaaauauc

SEQ ID NO: 794995 - RNA, 22 nt, Homo sapiens
auauuuuaauuuuuaaaugcag

SEQ ID NO: 794996 - RNA, 14 nt, Homo sapiens
auauuuuagcauuu

SEQ ID NO: 794997 - RNA, 17 nt, Homo sapiens
auauuuuagcauuuuaa

SEQ ID NO: 794998 - RNA, 23 nt, Homo sapiens
auauuuuccugauagcauaugac

SEQ ID NO: 794999 - RNA, 14 nt, Homo sapiens
auauuuucugugcc

SEQ ID NO: 795000 - RNA, 22 nt, Homo sapiens
auauuuuuaguagagacagggu

SEQ ID NO: 795001 - RNA, 19 nt, Homo sapiens
auauuuuucacauaucuag

SEQ ID NO: 795002 - RNA, 22 nt, Homo sapiens
auauuuuuguacugaaucucau

SEQ ID NO: 795003 - RNA, 19 nt, Homo sapiens
auauuuuuucuuuugacau

SEQ ID NO: 795004 - RNA, 19 nt, Homo sapiens
aucaaaaauauuccaucca

SEQ ID NO: 795005 - RNA, 20 nt, Homo sapiens
aucaaaagggagagaacaaa

SEQ ID NO: 795006 - RNA, 16 nt, Homo sapiens
aucaaaaucacuaucu

SEQ ID NO: 795007 - RNA, 17 nt, Homo sapiens
aucaaaaucacuaucuu

SEQ ID NO: 795008 - RNA, 21 nt, Homo sapiens
aucaaaaucuggcagagucag

SEQ ID NO: 795009 - RNA, 12 nt, Homo sapiens
aucaaacauaau

SEQ ID NO: 795010 - RNA, 23 nt, Homo sapiens
aucaaacaugcauggaugggucc

SEQ ID NO: 795011 - RNA, 23 nt, Homo sapiens
aucaaacauuggauuuuuccuua

SEQ ID NO: 795012 - RNA, 16 nt, Homo sapiens
aucaaagaaauucaga

SEQ ID NO: 795013 - RNA, 13 nt, Homo sapiens
aucaaagaauuac

SEQ ID NO: 795014 - RNA, 18 nt, Homo sapiens
aucaaagacucauugcuu

SEQ ID NO: 795015 - RNA, 23 nt, Homo sapiens
aucaaagugugauauacaaagug

SEQ ID NO: 795016 - RNA, 14 nt, Homo sapiens
aucaaauaauaccu

SEQ ID NO: 795017 - RNA, 16 nt, Homo sapiens
aucaaaucagucagug

SEQ ID NO: 795018 - RNA, 17 nt, Homo sapiens
aucaaaucucuuccaca

SEQ ID NO: 795019 - RNA, 23 nt, Homo sapiens
aucaaaucugcuuuuuaaagaau

SEQ ID NO: 795020 - RNA, 21 nt, Homo sapiens
aucaacacgagaauacaggag

SEQ ID NO: 795021 - RNA, 18 nt, Homo sapiens
aucaacaucuuggucaga

SEQ ID NO: 795022 - RNA, 17 nt, Homo sapiens
aucaacauuuguuccau

SEQ ID NO: 795023 - RNA, 20 nt, Homo sapiens
aucaacgccucacugaaaca

SEQ ID NO: 795024 - RNA, 15 nt, Homo sapiens
aucaacgugcaaugu

SEQ ID NO: 795025 - RNA, 22 nt, Homo sapiens
aucaacuaaaguuguacuuuaa

SEQ ID NO: 795026 - RNA, 20 nt, Homo sapiens
aucaacuuauuauaugacua

SEQ ID NO: 795027 - RNA, 13 nt, Homo sapiens
aucaacuuuagcu

SEQ ID NO: 795028 - RNA, 18 nt, Homo sapiens
aucaagaaaaacaucuuu

SEQ ID NO: 795029 - RNA, 16 nt, Homo sapiens
aucaagccucugguca

SEQ ID NO: 795030 - RNA, 14 nt, Homo sapiens
aucaaguccuacaa

SEQ ID NO: 795031 - RNA, 22 nt, Homo sapiens
aucaaguccuaguuguucagca

SEQ ID NO: 795032 - RNA, 21 nt, Homo sapiens
aucaaguuccaguaacccaaa

SEQ ID NO: 795033 - RNA, 16 nt, Homo sapiens
aucaauacaaccagcc

SEQ ID NO: 795034 - RNA, 23 nt, Homo sapiens
aucaauaguugaauuagugagua

SEQ ID NO: 795035 - RNA, 22 nt, Homo sapiens
aucaauccugggcaaucagaca

SEQ ID NO: 795036 - RNA, 14 nt, Homo sapiens
aucaaucuuuaaca

SEQ ID NO: 795037 - RNA, 22 nt, Homo sapiens
aucaaugcaagagugauugcag

SEQ ID NO: 795038 - RNA, 15 nt, Homo sapiens
auuauuucaccagca

SEQ ID NO: 795039 - RNA, 20 nt, Homo sapiens
auuauuuggagccugccaag

SEQ ID NO: 795040 - RNA, 20 nt, Homo sapiens
auuauuugucauucauucaa

SEQ ID NO: 795041 - RNA, 13 nt, Homo sapiens
auuauuuugcacu

SEQ ID NO: 795042 - RNA, 13 nt, Homo sapiens
auuauuuuuacag

SEQ ID NO: 795043 - RNA, 14 nt, Homo sapiens
auucaaaagugauu

SEQ ID NO: 795044 - RNA, 15 nt, Homo sapiens
auucaaaauugacau

SEQ ID NO: 795045 - RNA, 17 nt, Homo sapiens
auucaaagaaguacuuu

SEQ ID NO: 795046 - RNA, 18 nt, Homo sapiens
auucaaagaaguacuuua

SEQ ID NO: 795047 - RNA, 17 nt, Homo sapiens
auucaaagagacauaua

SEQ ID NO: 795048 - RNA, 13 nt, Homo sapiens
auucaaagcucua

SEQ ID NO: 795049 - RNA, 16 nt, Homo sapiens
auucaaaucacaugga

SEQ ID NO: 795050 - RNA, 15 nt, Homo sapiens
auucaaauugcugcu

SEQ ID NO: 795051 - RNA, 23 nt, Homo sapiens
auucaacagggaagaaacuuucu

SEQ ID NO: 795052 - RNA, 20 nt, Homo sapiens
auucaacaguaugcacaaaa

SEQ ID NO: 795053 - RNA, 14 nt, Homo sapiens
auucaaccacugua

SEQ ID NO: 795054 - RNA, 16 nt, Homo sapiens
auucaacucuccaaug

SEQ ID NO: 795055 - RNA, 22 nt, Homo sapiens
auucaacugccauguuuugcca

SEQ ID NO: 795056 - RNA, 12 nt, Homo sapiens
auucaaggggag

SEQ ID NO: 795057 - RNA, 14 nt, Homo sapiens
auucaaguauuuga

SEQ ID NO: 795058 - RNA, 13 nt, Homo sapiens
auucaaugcauuu

SEQ ID NO: 795059 - RNA, 20 nt, Homo sapiens
auucacaauaaaagcuuaaa

SEQ ID NO: 795060 - RNA, 14 nt, Homo sapiens
auucacagagccuu

SEQ ID NO: 795061 - RNA, 20 nt, Homo sapiens
auucacagcaagucacuggc

SEQ ID NO: 795062 - RNA, 20 nt, Homo sapiens
auucacauaguuuauuucaa

SEQ ID NO: 795063 - RNA, 17 nt, Homo sapiens
auucacauauaucaaag

SEQ ID NO: 795064 - RNA, 12 nt, Homo sapiens
auucacauuuag

SEQ ID NO: 795065 - RNA, 22 nt, Homo sapiens
auucaccaaaauagucuucuca

SEQ ID NO: 795066 - RNA, 22 nt, Homo sapiens
auucaccuuccagugucucgga

SEQ ID NO: 795067 - RNA, 23 nt, Homo sapiens
auucacgcuguuuguuucauaua

SEQ ID NO: 795068 - RNA, 15 nt, Homo sapiens
auucacuagaccaga

SEQ ID NO: 795069 - RNA, 19 nt, Homo sapiens
auucacucaagaguucagu

SEQ ID NO: 795070 - RNA, 15 nt, Homo sapiens
auucacuccagucaa

SEQ ID NO: 795071 - RNA, 20 nt, Homo sapiens
auucacucccacacccaaga

SEQ ID NO: 795072 - RNA, 16 nt, Homo sapiens
auucacuugcauuucu

SEQ ID NO: 795073 - RNA, 22 nt, Homo sapiens
auucacuuuugcuauuccaauc

SEQ ID NO: 795074 - RNA, 19 nt, Homo sapiens
auucagaaggaucuucauc

SEQ ID NO: 795075 - RNA, 20 nt, Homo sapiens
auucagaaggaucuucaucu

SEQ ID NO: 795076 - RNA, 21 nt, Homo sapiens
auucagacaacauuaugaucu

SEQ ID NO: 795077 - RNA, 18 nt, Homo sapiens
auucagagcuauggugcu

SEQ ID NO: 795078 - RNA, 22 nt, Homo sapiens
auucagaugaauagauggaauu

SEQ ID NO: 795079 - RNA, 18 nt, Homo sapiens
auucagcaaaaaucuccc

SEQ ID NO: 795080 - RNA, 13 nt, Homo sapiens
auucagcaugggu

SEQ ID NO: 795081 - RNA, 16 nt, Homo sapiens
auucagcugaugcuca

SEQ ID NO: 795082 - RNA, 22 nt, Homo sapiens
auucagcuuuucauaauaucua

SEQ ID NO: 795083 - RNA, 14 nt, Homo sapiens
auucaggacuugaa

SEQ ID NO: 795084 - RNA, 16 nt, Homo sapiens
auucaggauuacaugc

SEQ ID NO: 795085 - RNA, 19 nt, Homo sapiens
auucagguauuuguaauag

SEQ ID NO: 795086 - RNA, 13 nt, Homo sapiens
auucaguauuaaa

SEQ ID NO: 795087 - RNA, 21 nt, Homo sapiens
auucagucucuucuaagcaaa

SEQ ID NO: 795088 - RNA, 16 nt, Homo sapiens
auucauaaggauucag

SEQ ID NO: 795089 - RNA, 20 nt, Homo sapiens
auucauacccacacacccag

SEQ ID NO: 795090 - RNA, 18 nt, Homo sapiens
auucauaguaagauugau

SEQ ID NO: 795091 - RNA, 20 nt, Homo sapiens
auucauauaggccagaguug

SEQ ID NO: 795092 - RNA, 17 nt, Homo sapiens
auucaucauagggauaa

SEQ ID NO: 795093 - RNA, 22 nt, Homo sapiens
auucaugaaaauaaauguacau

SEQ ID NO: 795094 - RNA, 23 nt, Homo sapiens
gauuaaccucugcacuacugaca

SEQ ID NO: 795095 - RNA, 18 nt, Homo sapiens
gauuaagaguugccaaaa

SEQ ID NO: 795096 - RNA, 17 nt, Homo sapiens
gauuaaucuaccuugca

SEQ ID NO: 795097 - RNA, 13 nt, Homo sapiens
gauuaauuugaaa

SEQ ID NO: 795098 - RNA, 23 nt, Homo sapiens
gauuacaaggcuuuaucucaggg

SEQ ID NO: 795099 - RNA, 21 nt, Homo sapiens
gauuacaggcaugagccaccg

SEQ ID NO: 795100 - RNA, 15 nt, Homo sapiens
gauuacaggugugag

SEQ ID NO: 795101 - RNA, 19 nt, Homo sapiens
gauuaccugccaauugcua

SEQ ID NO: 795102 - RNA, 16 nt, Homo sapiens
gauuacucuccauauc

SEQ ID NO: 795103 - RNA, 21 nt, Homo sapiens
gauuagguagacuuugcuuag

SEQ ID NO: 795104 - RNA, 18 nt, Homo sapiens
gauuaggugagguuuaua

SEQ ID NO: 795105 - RNA, 21 nt, Homo sapiens
gauuaguugaaaggccucaag

SEQ ID NO: 795106 - RNA, 22 nt, Homo sapiens
gauuauuagccagguaauguga

SEQ ID NO: 795107 - RNA, 20 nt, Homo sapiens
gauuauuauguuuauuacaa

SEQ ID NO: 795108 - RNA, 15 nt, Homo sapiens
gauucaaauugcugc

SEQ ID NO: 795109 - RNA, 14 nt, Homo sapiens
gaaagaaugcaaga

SEQ ID NO: 795110 - RNA, 13 nt, Homo sapiens
gaaagaauugagg

SEQ ID NO: 795111 - RNA, 15 nt, Homo sapiens
gaaagacacugccug

SEQ ID NO: 795112 - RNA, 19 nt, Homo sapiens
gaaagacucuauguuuggc

SEQ ID NO: 795113 - RNA, 17 nt, Homo sapiens
gaaagacugagcucaag

SEQ ID NO: 795114 - RNA, 18 nt, Homo sapiens
gaaagagcaagugacuuu

SEQ ID NO: 795115 - RNA, 12 nt, Homo sapiens
gaucuacaccca

SEQ ID NO: 795116 - RNA, 17 nt, Homo sapiens
gaucuacacccaccaga

SEQ ID NO: 795117 - RNA, 14 nt, Homo sapiens
gaucuagaagggac

SEQ ID NO: 795118 - RNA, 22 nt, Homo sapiens
gaucuauauuuuuguacugaau

SEQ ID NO: 795119 - RNA, 17 nt, Homo sapiens
gaucuaucaccugucau

SEQ ID NO: 795120 - RNA, 17 nt, Homo sapiens
gaucuauguacuguaau

SEQ ID NO: 795121 - RNA, 21 nt, Homo sapiens
gaucucaauuugcaguauuca

SEQ ID NO: 795122 - RNA, 13 nt, Homo sapiens
gaucucagcucac

SEQ ID NO: 795123 - RNA, 17 nt, Homo sapiens
gaucuccaacagccagu

SEQ ID NO: 795124 - RNA, 19 nt, Homo sapiens
gaucucccugccgccucaa

SEQ ID NO: 795125 - RNA, 11 nt, Homo sapiens
gaucucucuug

SEQ ID NO: 795126 - RNA, 18 nt, Homo sapiens
gaucucugggaguuauag

SEQ ID NO: 795127 - RNA, 23 nt, Homo sapiens
gaucugauaaggaucuaggagaa

SEQ ID NO: 795128 - RNA, 18 nt, Homo sapiens
cuuuggacauggaaagaa

SEQ ID NO: 795129 - RNA, 23 nt, Homo sapiens
cuuuggauugacucugcauuuga

SEQ ID NO: 795130 - RNA, 17 nt, Homo sapiens
cuuuggccccacuuuga

SEQ ID NO: 795131 - RNA, 21 nt, Homo sapiens
cuuuggccccucgacccugug

SEQ ID NO: 795132 - RNA, 18 nt, Homo sapiens
cuuugggauucuuuccau

SEQ ID NO: 795133 - RNA, 19 nt, Homo sapiens
cuuugggccagacaugcca

SEQ ID NO: 795134 - RNA, 21 nt, Homo sapiens
cuuugggccagacaugccaca

SEQ ID NO: 795135 - RNA, 20 nt, Homo sapiens
cuuugggcuugacaccuguc

SEQ ID NO: 795136 - RNA, 16 nt, Homo sapiens
cuuugggugaccagcc

SEQ ID NO: 795137 - RNA, 21 nt, Homo sapiens
cuuuggguggcucacuacuga

SEQ ID NO: 795138 - RNA, 13 nt, Homo sapiens
cuuuggugcacaa

SEQ ID NO: 795139 - RNA, 19 nt, Homo sapiens
cuuugguuucugucuguaa

SEQ ID NO: 795140 - RNA, 19 nt, Homo sapiens
cuuuguaacggcucuuagc

SEQ ID NO: 795141 - RNA, 15 nt, Homo sapiens
cuuuguaauaccaga

SEQ ID NO: 795142 - RNA, 16 nt, Homo sapiens
cuuuguaauauuuucc

SEQ ID NO: 795143 - RNA, 21 nt, Homo sapiens
cuuuguauauaggcuucucac

SEQ ID NO: 795144 - RNA, 14 nt, Homo sapiens
cuuuguauaugcau

SEQ ID NO: 795145 - RNA, 14 nt, Homo sapiens
cuuuguauauuaca

SEQ ID NO: 795146 - RNA, 16 nt, Homo sapiens
cuuuguauauuacaua

SEQ ID NO: 795147 - RNA, 19 nt, Homo sapiens
cuuuguauauuacauacau

SEQ ID NO: 795148 - RNA, 14 nt, Homo sapiens
cuuuguaugacagu

SEQ ID NO: 795149 - RNA, 17 nt, Homo sapiens
cuuuguaugcacuuugu

SEQ ID NO: 795150 - RNA, 15 nt, Homo sapiens
cuuuguauuccuuaa

SEQ ID NO: 795151 - RNA, 13 nt, Homo sapiens
cuuugucugaaaa

SEQ ID NO: 795152 - RNA, 14 nt, Homo sapiens
cuuugucugcaggu

SEQ ID NO: 795153 - RNA, 12 nt, Homo sapiens
cuuugucugugg

SEQ ID NO: 795154 - RNA, 17 nt, Homo sapiens
cuuuguggcaguggcca

SEQ ID NO: 795155 - RNA, 21 nt, Homo sapiens
cuuuguguagaaagccaaaua

SEQ ID NO: 795156 - RNA, 17 nt, Homo sapiens
cuuuguguccagaguuu

SEQ ID NO: 795157 - RNA, 16 nt, Homo sapiens
cuuugugugauugaau

SEQ ID NO: 795158 - RNA, 20 nt, Homo sapiens
cuuuguugcaagaugugaau

SEQ ID NO: 795159 - RNA, 20 nt, Homo sapiens
cuuuuaaaaaauacucugcu

SEQ ID NO: 795160 - RNA, 19 nt, Homo sapiens
cuuuuaaaaacauaacaua

SEQ ID NO: 795161 - RNA, 17 nt, Homo sapiens
cuuuuaaaagcacguau

SEQ ID NO: 795162 - RNA, 17 nt, Homo sapiens
cuuuuaaagccuauuca

SEQ ID NO: 795163 - RNA, 15 nt, Homo sapiens
cuuuuaaaugcauaa

SEQ ID NO: 795164 - RNA, 14 nt, Homo sapiens
cuuuuaacccagug

SEQ ID NO: 795165 - RNA, 17 nt, Homo sapiens
cuuuuaagaaacacagg

SEQ ID NO: 795166 - RNA, 18 nt, Homo sapiens
cuuuuaagaaacacaggg

SEQ ID NO: 795167 - RNA, 15 nt, Homo sapiens
cuuuuaaggcuaaaa

SEQ ID NO: 795168 - RNA, 13 nt, Homo sapiens
cuuuuaaguugcu

SEQ ID NO: 795169 - RNA, 13 nt, Homo sapiens
cuuuuaaugaugc

SEQ ID NO: 795170 - RNA, 17 nt, Homo sapiens
cuuuuacucugccuaca

SEQ ID NO: 795171 - RNA, 22 nt, Homo sapiens
cuuuuagaaaaugcagucauuu

SEQ ID NO: 795172 - RNA, 19 nt, Homo sapiens
cuuuuagcaugugaaguuu

SEQ ID NO: 795173 - RNA, 21 nt, Homo sapiens
cuuuuaggacccuucccuuga

SEQ ID NO: 795174 - RNA, 21 nt, Homo sapiens
cuuuuagucaggagagugcag

SEQ ID NO: 795175 - RNA, 19 nt, Homo sapiens
cuuuuauacucagcuuucu

SEQ ID NO: 795176 - RNA, 14 nt, Homo sapiens
cuuuuauagaggcu

SEQ ID NO: 795177 - RNA, 23 nt, Homo sapiens
cuuuuauaggugagaaaaaaaca

SEQ ID NO: 795178 - RNA, 21 nt, Homo sapiens
cuuuuaucaaucccagcauuu

SEQ ID NO: 795179 - RNA, 20 nt, Homo sapiens
cuuuuaucugcccagaauuc

SEQ ID NO: 795180 - RNA, 19 nt, Homo sapiens
cuuuuaucuuggacugaca

SEQ ID NO: 795181 - RNA, 14 nt, Homo sapiens
cuuuuaugccuuca

SEQ ID NO: 795182 - RNA, 12 nt, Homo sapiens
cuuuuauuacau

SEQ ID NO: 795183 - RNA, 15 nt, Homo sapiens
cuuuuauuuuacaca

SEQ ID NO: 795184 - RNA, 13 nt, Homo sapiens
cuuuucaccaaug

SEQ ID NO: 795185 - RNA, 18 nt, Homo sapiens
cuuuucaccaaugagccu

SEQ ID NO: 795186 - RNA, 14 nt, Homo sapiens
cuuuucauguagaa

SEQ ID NO: 795187 - RNA, 23 nt, Homo sapiens
cuuuucauuagcaguugcucaca

SEQ ID NO: 795188 - RNA, 15 nt, Homo sapiens
cuuuuccaagcuccu

SEQ ID NO: 795189 - RNA, 16 nt, Homo sapiens
cuuuuccaagcuccuu

SEQ ID NO: 795190 - RNA, 14 nt, Homo sapiens
cuuuuccaaugaug

SEQ ID NO: 795191 - RNA, 19 nt, Homo sapiens
cuuuuccacuccuauggaa

SEQ ID NO: 795192 - RNA, 12 nt, Homo sapiens
cuuuuccagucu

SEQ ID NO: 795193 - RNA, 14 nt, Homo sapiens
cuuuucccauuugu

SEQ ID NO: 795194 - RNA, 17 nt, Homo sapiens
cuuuuccccagucccag

SEQ ID NO: 795195 - RNA, 21 nt, Homo sapiens
cuuuuccccggucccuugaga

SEQ ID NO: 795196 - RNA, 18 nt, Homo sapiens
cuuuucccugcaccacuc

SEQ ID NO: 795197 - RNA, 16 nt, Homo sapiens
cuuuucccuucagucu

SEQ ID NO: 795198 - RNA, 16 nt, Homo sapiens
cuuuuccucaccagga

SEQ ID NO: 795199 - RNA, 22 nt, Homo sapiens
cuuuucggccccauguaucuca

SEQ ID NO: 795200 - RNA, 21 nt, Homo sapiens
cuuuucucacaaaaaggcaaa

SEQ ID NO: 795201 - RNA, 13 nt, Homo sapiens
cuuuucucaggac

SEQ ID NO: 795202 - RNA, 21 nt, Homo sapiens
cuuuucuccucacuguaucca

SEQ ID NO: 795203 - RNA, 22 nt, Homo sapiens
cuuuucugccacuccauauuaa

SEQ ID NO: 795204 - RNA, 15 nt, Homo sapiens
cuuuucugugccaga

SEQ ID NO: 795205 - RNA, 14 nt, Homo sapiens
cuuuugaccaaaua

SEQ ID NO: 795206 - RNA, 23 nt, Homo sapiens
cuuuugaccaaauaaaguaccau

SEQ ID NO: 795207 - RNA, 22 nt, Homo sapiens
cuuuugagccaacaacucugau

SEQ ID NO: 795208 - RNA, 20 nt, Homo sapiens
cuuuugagugugugugugca

SEQ ID NO: 795209 - RNA, 14 nt, Homo sapiens
cuuuugcacaagga

SEQ ID NO: 795210 - RNA, 15 nt, Homo sapiens
cuuuugcacaccuuu

SEQ ID NO: 795211 - RNA, 14 nt, Homo sapiens
cuuuugccugcaag

SEQ ID NO: 795212 - RNA, 13 nt, Homo sapiens
cuuuugccuuuug

SEQ ID NO: 795213 - RNA, 16 nt, Homo sapiens
cuuuugcuaaugcaau

SEQ ID NO: 795214 - RNA, 19 nt, Homo sapiens
cuuuugcuaaugcaauuag

SEQ ID NO: 795215 - RNA, 19 nt, Homo sapiens
cuuuuggugguauguuggu

SEQ ID NO: 795216 - RNA, 18 nt, Homo sapiens
cuuuugugaugaacauau

SEQ ID NO: 795217 - RNA, 22 nt, Homo sapiens
cuuuuguuuugaagcuguugcu

SEQ ID NO: 795218 - RNA, 18 nt, Homo sapiens
cuuuuuaaagaaugcucu

SEQ ID NO: 795219 - RNA, 19 nt, Homo sapiens
cuuuuuaugaucugccauu

SEQ ID NO: 795220 - RNA, 12 nt, Homo sapiens
cuuuuucauaua

SEQ ID NO: 795221 - RNA, 12 nt, Homo sapiens
cuuuuuccagag

SEQ ID NO: 795222 - RNA, 15 nt, Homo sapiens
cuuuuugacacugaa

SEQ ID NO: 795223 - RNA, 15 nt, Homo sapiens
cuuuuugugucucca

SEQ ID NO: 795224 - RNA, 14 nt, Homo sapiens
cuuuuuuaauuucc

SEQ ID NO: 795225 - RNA, 12 nt, Homo sapiens
cuuuuuuaucuu

SEQ ID NO: 795226 - RNA, 17 nt, Homo sapiens
cuuuuuucaaaagaaag

SEQ ID NO: 795227 - RNA, 23 nt, Homo sapiens
cuuuuuugucccccaacuugaga

SEQ ID NO: 795228 - RNA, 17 nt, Homo sapiens
cuuuuuuuaacugguga

SEQ ID NO: 795229 - RNA, 21 nt, Homo sapiens
cuuuuuuuuccccaaguauua

SEQ ID NO: 795230 - RNA, 21 nt, Homo sapiens
cuuuuuuuuuuucugccugag

SEQ ID NO: 795231 - RNA, 23 nt, Homo sapiens
cuuuuuuuuuuuuuaaagacaga

SEQ ID NO: 795232 - RNA, 16 nt, Homo sapiens
gaaaaaaacaucagaa

SEQ ID NO: 795233 - RNA, 13 nt, Homo sapiens
gaaaaaaagugag

SEQ ID NO: 795234 - RNA, 22 nt, Homo sapiens
gaaaaaacugugccuuguuuca

SEQ ID NO: 795235 - RNA, 14 nt, Homo sapiens
gaaaaaacuuugac

SEQ ID NO: 795236 - RNA, 20 nt, Homo sapiens
gaaaaaaugcagggugauuu

SEQ ID NO: 795237 - RNA, 13 nt, Homo sapiens
gaaaaaauggaug

SEQ ID NO: 795238 - RNA, 19 nt, Homo sapiens
gaaaaaauuagcugggcau

SEQ ID NO: 795239 - RNA, 16 nt, Homo sapiens
gaaaaacaaaugccau

SEQ ID NO: 795240 - RNA, 19 nt, Homo sapiens
gaaaaacaccgcuucugcc

SEQ ID NO: 795241 - RNA, 14 nt, Homo sapiens
gaaaaacaugucau

SEQ ID NO: 795242 - RNA, 21 nt, Homo sapiens
gaaaaacuaacuagacuaaga

SEQ ID NO: 795243 - RNA, 18 nt, Homo sapiens
ugaaccgcacagcucagg

SEQ ID NO: 795244 - RNA, 15 nt, Homo sapiens
ugaaccuagauugca

SEQ ID NO: 795245 - RNA, 13 nt, Homo sapiens
ugaaccuggaaau

SEQ ID NO: 795246 - RNA, 15 nt, Homo sapiens
ugaaccuugagcaaa

SEQ ID NO: 795247 - RNA, 19 nt, Homo sapiens
ugaacgcagaagaaagggu

SEQ ID NO: 795248 - RNA, 24 nt, Homo sapiens
ugaacuaaauuuaagcuuaagcca

SEQ ID NO: 795249 - RNA, 15 nt, Homo sapiens
ugaacuaacugacag

SEQ ID NO: 795250 - RNA, 13 nt, Homo sapiens
ugaacuacacugc

SEQ ID NO: 795251 - RNA, 17 nt, Homo sapiens
ugaacuaccaucugaug

SEQ ID NO: 795252 - RNA, 18 nt, Homo sapiens
ugaacuagggaagcucag

SEQ ID NO: 795253 - RNA, 19 nt, Homo sapiens
ugaacuauuagagcugccu

SEQ ID NO: 795254 - RNA, 14 nt, Homo sapiens
ugaacucagcuauu

SEQ ID NO: 795255 - RNA, 15 nt, Homo sapiens
ugaacucaucauuuu

SEQ ID NO: 795256 - RNA, 17 nt, Homo sapiens
ugaacucuuucuggccu

SEQ ID NO: 795257 - RNA, 18 nt, Homo sapiens
ugaacugacaaugaaggg

SEQ ID NO: 795258 - RNA, 22 nt, Homo sapiens
ugaacuggauucuuaaccaaga

SEQ ID NO: 795259 - RNA, 11 nt, Homo sapiens
ugaacuuccau

SEQ ID NO: 795260 - RNA, 14 nt, Homo sapiens
ugaacuuugcaaag

SEQ ID NO: 795261 - RNA, 18 nt, Homo sapiens
ugaacuuuuuuccacuga

SEQ ID NO: 795262 - RNA, 16 nt, Homo sapiens
ugaagaagauauguga

SEQ ID NO: 795263 - RNA, 17 nt, Homo sapiens
ugaagaagauaugugaa

SEQ ID NO: 795264 - RNA, 21 nt, Homo sapiens
ugaagaagguugucagcugca

SEQ ID NO: 795265 - RNA, 20 nt, Homo sapiens
ugaagaaguuggucaguauu

SEQ ID NO: 795266 - RNA, 16 nt, Homo sapiens
ugaagaaugagcaaga

SEQ ID NO: 795267 - RNA, 15 nt, Homo sapiens
ugaagacaacagcau

SEQ ID NO: 795268 - RNA, 17 nt, Homo sapiens
ugaagacacagccuccc

SEQ ID NO: 795269 - RNA, 15 nt, Homo sapiens
ugaagacauguuuca

SEQ ID NO: 795270 - RNA, 22 nt, Homo sapiens
ugaagacccuauuucagaaaua

SEQ ID NO: 795271 - RNA, 16 nt, Homo sapiens
ugaagacuuaaaagag

SEQ ID NO: 795272 - RNA, 18 nt, Homo sapiens
ugaagagcgauugugagg

SEQ ID NO: 795273 - RNA, 17 nt, Homo sapiens
ugaagagguugaagcua

SEQ ID NO: 795274 - RNA, 21 nt, Homo sapiens
ugaagauauucuacuaugcau

SEQ ID NO: 795275 - RNA, 14 nt, Homo sapiens
ugaagcagcacugu

SEQ ID NO: 795276 - RNA, 15 nt, Homo sapiens
ugaagcagucuugcu

SEQ ID NO: 795277 - RNA, 16 nt, Homo sapiens
ugaagcagucuugcuc

SEQ ID NO: 795278 - RNA, 16 nt, Homo sapiens
ugaagcaugcucugua

SEQ ID NO: 795279 - RNA, 20 nt, Homo sapiens
ugaagcaugcuuugcugcua

SEQ ID NO: 795280 - RNA, 17 nt, Homo sapiens
ugaagcccacccagaaa

SEQ ID NO: 795281 - RNA, 18 nt, Homo sapiens
ugaaggacacuuccugcc

SEQ ID NO: 795282 - RNA, 16 nt, Homo sapiens
ugaaggagaaggugcc

SEQ ID NO: 795283 - RNA, 19 nt, Homo sapiens
ugaaggaguccuugcauca

SEQ ID NO: 795284 - RNA, 16 nt, Homo sapiens
ugaaggauuacucucc

SEQ ID NO: 795285 - RNA, 19 nt, Homo sapiens
auacaagaaagcaaugcca

SEQ ID NO: 795286 - RNA, 21 nt, Homo sapiens
auacaaggugagugugacuuc

SEQ ID NO: 795287 - RNA, 12 nt, Homo sapiens
auacaaucagcc

SEQ ID NO: 795288 - RNA, 21 nt, Homo sapiens
auacaaucagcccagugcaaa

SEQ ID NO: 795289 - RNA, 14 nt, Homo sapiens
auacaaucauguga

SEQ ID NO: 795290 - RNA, 23 nt, Homo sapiens
auacaauggguaucgcugagacu

SEQ ID NO: 795291 - RNA, 14 nt, Homo sapiens
auacacaguacuuu

SEQ ID NO: 795292 - RNA, 23 nt, Homo sapiens
auacacauauauacccacaugua

SEQ ID NO: 795293 - RNA, 14 nt, Homo sapiens
auacacaugugcac

SEQ ID NO: 795294 - RNA, 15 nt, Homo sapiens
auacacaugugcaca

SEQ ID NO: 795295 - RNA, 18 nt, Homo sapiens
auacacccaaacacuuac

SEQ ID NO: 795296 - RNA, 23 nt, Homo sapiens
auacacguuacugaucuuacuca

SEQ ID NO: 795297 - RNA, 13 nt, Homo sapiens
auacacuaugaag

SEQ ID NO: 795298 - RNA, 12 nt, Homo sapiens
auacacugugac

SEQ ID NO: 795299 - RNA, 13 nt, Homo sapiens
auacacuuacacu

SEQ ID NO: 795300 - RNA, 20 nt, Homo sapiens
auacacuuuuuaaaaucuca

SEQ ID NO: 795301 - RNA, 15 nt, Homo sapiens
auacagaguuuuaga

SEQ ID NO: 795302 - RNA, 16 nt, Homo sapiens
auacagaucucagggc

SEQ ID NO: 795303 - RNA, 15 nt, Homo sapiens
auacagcugcacuga

SEQ ID NO: 795304 - RNA, 18 nt, Homo sapiens
auacaggaggcagacaau

SEQ ID NO: 795305 - RNA, 17 nt, Homo sapiens
auacaguagugucauca

SEQ ID NO: 795306 - RNA, 18 nt, Homo sapiens
auacagugaagaguaagu

SEQ ID NO: 795307 - RNA, 13 nt, Homo sapiens
auacagugauaua

SEQ ID NO: 795308 - RNA, 21 nt, Homo sapiens
auacagugauauacuuacuca

SEQ ID NO: 795309 - RNA, 14 nt, Homo sapiens
auacaguguacaug

SEQ ID NO: 795310 - RNA, 21 nt, Homo sapiens
auacauaauauaugacuuccu

SEQ ID NO: 795311 - RNA, 18 nt, Homo sapiens
auacauauauguauauau

SEQ ID NO: 795312 - RNA, 15 nt, Homo sapiens
auacauauuaucuca

SEQ ID NO: 795313 - RNA, 22 nt, Homo sapiens
auacauccacaggguuuugaca

SEQ ID NO: 795314 - RNA, 22 nt, Homo sapiens
auacaugccagugacacuucca

SEQ ID NO: 795315 - RNA, 13 nt, Homo sapiens
auacaugcugcua

SEQ ID NO: 795316 - RNA, 14 nt, Homo sapiens
auacauguaauucu

SEQ ID NO: 795317 - RNA, 15 nt, Homo sapiens
auacauguaauucua

SEQ ID NO: 795318 - RNA, 23 nt, Homo sapiens
auacauuauacuuuauaacuaau

SEQ ID NO: 795319 - RNA, 13 nt, Homo sapiens
auacauugcaauc

SEQ ID NO: 795320 - RNA, 18 nt, Homo sapiens
auacauuuaugcacauuc

SEQ ID NO: 795321 - RNA, 22 nt, Homo sapiens
auacauuuguauuuugugauga

SEQ ID NO: 795322 - RNA, 17 nt, Homo sapiens
auaccaaccaaaccaau

SEQ ID NO: 795323 - RNA, 16 nt, Homo sapiens
auaccaauaaagugac

SEQ ID NO: 795324 - RNA, 13 nt, Homo sapiens
auaccacugcacu

SEQ ID NO: 795325 - RNA, 13 nt, Homo sapiens
auaccacuguaau

SEQ ID NO: 795326 - RNA, 16 nt, Homo sapiens
auaccagagccuucaa

SEQ ID NO: 795327 - RNA, 23 nt, Homo sapiens
auaccagagccuucaagugccaa

SEQ ID NO: 795328 - RNA, 12 nt, Homo sapiens
auaccagcaaua

SEQ ID NO: 795329 - RNA, 23 nt, Homo sapiens
auaccagcaggagguucugggcc

SEQ ID NO: 795330 - RNA, 20 nt, Homo sapiens
auaccauuauuaucaaguag

SEQ ID NO: 795331 - RNA, 12 nt, Homo sapiens
ucuccacaaagu

SEQ ID NO: 795332 - RNA, 18 nt, Homo sapiens
ucuccaccuuaguacuuu

SEQ ID NO: 795333 - RNA, 12 nt, Homo sapiens
ucuccacugcuc

SEQ ID NO: 795334 - RNA, 19 nt, Homo sapiens
ucuccacuucuuguucccc

SEQ ID NO: 795335 - RNA, 17 nt, Homo sapiens
ucuccagaaagcuaaaa

SEQ ID NO: 795336 - RNA, 20 nt, Homo sapiens
ucuccagcaauaauguuuuc

SEQ ID NO: 795337 - RNA, 16 nt, Homo sapiens
ucuccaggggaucaca

SEQ ID NO: 795338 - RNA, 21 nt, Homo sapiens
ucuccagguccucuacuuaau

SEQ ID NO: 795339 - RNA, 13 nt, Homo sapiens
ucuccaguggauu

SEQ ID NO: 795340 - RNA, 17 nt, Homo sapiens
ucuccaucacaaccaga

SEQ ID NO: 795341 - RNA, 20 nt, Homo sapiens
ucuccaucacaaccagauuu

SEQ ID NO: 795342 - RNA, 18 nt, Homo sapiens
ucuccaucucugucucaa

SEQ ID NO: 795343 - RNA, 23 nt, Homo sapiens
ucuccaucucuugaccucgugau

SEQ ID NO: 795344 - RNA, 22 nt, Homo sapiens
ucuccauguuugauguaucuga

SEQ ID NO: 795345 - RNA, 20 nt, Homo sapiens
ucuccauuagaaaauuuugu

SEQ ID NO: 795346 - RNA, 20 nt, Homo sapiens
ucucccaacucuugcacagu

SEQ ID NO: 795347 - RNA, 18 nt, Homo sapiens
ucucccacagggugcugg

SEQ ID NO: 795348 - RNA, 18 nt, Homo sapiens
ucucccaggacccaucac

SEQ ID NO: 795349 - RNA, 19 nt, Homo sapiens
ucucccaggacccaucacg

SEQ ID NO: 795350 - RNA, 21 nt, Homo sapiens
ucucccaggccaggcuccuuc

SEQ ID NO: 795351 - RNA, 15 nt, Homo sapiens
ucucccaggucccag

SEQ ID NO: 795352 - RNA, 14 nt, Homo sapiens
ucucccauccuuga

SEQ ID NO: 795353 - RNA, 21 nt, Homo sapiens
ucuccccacucuaggggucag

SEQ ID NO: 795354 - RNA, 18 nt, Homo sapiens
ucuccccagcccagagac

SEQ ID NO: 795355 - RNA, 22 nt, Homo sapiens
ucuccccaguguaugucuugua

SEQ ID NO: 795356 - RNA, 17 nt, Homo sapiens
ucucccccugggcucug

SEQ ID NO: 795357 - RNA, 23 nt, Homo sapiens
ucucccggcaacaucucugggaa

SEQ ID NO: 795358 - RNA, 12 nt, Homo sapiens
ucucccuaccuu

SEQ ID NO: 795359 - RNA, 13 nt, Homo sapiens
ucucccucucagu

SEQ ID NO: 795360 - RNA, 16 nt, Homo sapiens
ucucccuggcccucag

SEQ ID NO: 795361 - RNA, 17 nt, Homo sapiens
ucucccugggucugcgu

SEQ ID NO: 795362 - RNA, 22 nt, Homo sapiens
ucuccgcaacagccaaguggaa

SEQ ID NO: 795363 - RNA, 11 nt, Homo sapiens
ucuccuacuuu

SEQ ID NO: 795364 - RNA, 23 nt, Homo sapiens
ucuccuccagcccagacccagug

SEQ ID NO: 795365 - RNA, 20 nt, Homo sapiens
ucuccucuucauggcaucuu

SEQ ID NO: 795366 - RNA, 21 nt, Homo sapiens
ucuccugccucacccucccaa

SEQ ID NO: 795367 - RNA, 22 nt, Homo sapiens
ucuccuggcuuuacagacaaaa

SEQ ID NO: 795368 - RNA, 14 nt, Homo sapiens
ucuccuucaaaaca

SEQ ID NO: 795369 - RNA, 16 nt, Homo sapiens
ucuccuucaaaacacu

SEQ ID NO: 795370 - RNA, 23 nt, Homo sapiens
ucuccuuccucuuggcugagaua

SEQ ID NO: 795371 - RNA, 21 nt, Homo sapiens
ucuccuuucucuuaugcuuaa

SEQ ID NO: 795372 - RNA, 20 nt, Homo sapiens
ucuccuuugcucucuggcca

SEQ ID NO: 795373 - RNA, 14 nt, Homo sapiens
ucuccuuugcugag

SEQ ID NO: 795374 - RNA, 13 nt, Homo sapiens
ucuccuuuuccua

SEQ ID NO: 795375 - RNA, 23 nt, Homo sapiens
ucuccuuuugaccaaauaaagua

SEQ ID NO: 795376 - RNA, 20 nt, Homo sapiens
ucucgaacuccuggccucaa

SEQ ID NO: 795377 - RNA, 15 nt, Homo sapiens
ucucgacaguaucca

SEQ ID NO: 795378 - RNA, 17 nt, Homo sapiens
ucucgauggacaaugaa

SEQ ID NO: 795379 - RNA, 18 nt, Homo sapiens
ucucgccacugcacucca

SEQ ID NO: 795380 - RNA, 15 nt, Homo sapiens
ucucgggcacaggcc

SEQ ID NO: 795381 - RNA, 13 nt, Homo sapiens
ucucuaaaacugc

SEQ ID NO: 795382 - RNA, 23 nt, Homo sapiens
ucucuaaaauucuagucucugau

SEQ ID NO: 795383 - RNA, 14 nt, Homo sapiens
ucucuaacauuucc

SEQ ID NO: 795384 - RNA, 20 nt, Homo sapiens
ucucuaaccauucaaaugac

SEQ ID NO: 795385 - RNA, 20 nt, Homo sapiens
ucucuaagugggcauugcca

SEQ ID NO: 795386 - RNA, 21 nt, Homo sapiens
ucucuaagugggcauugccau

SEQ ID NO: 795387 - RNA, 15 nt, Homo sapiens
ucucuacugcuggac

SEQ ID NO: 795388 - RNA, 12 nt, Homo sapiens
ucucuacugcuu

SEQ ID NO: 795389 - RNA, 18 nt, Homo sapiens
ucucuacuuuucccugua

SEQ ID NO: 795390 - RNA, 23 nt, Homo sapiens
ucucuagaaggaaacgucuuuau

SEQ ID NO: 795391 - RNA, 15 nt, Homo sapiens
ucucuauaccaauaa

SEQ ID NO: 795392 - RNA, 18 nt, Homo sapiens
ucucuauucucugcaauu

SEQ ID NO: 795393 - RNA, 15 nt, Homo sapiens
ucucucaaugaauaa

SEQ ID NO: 795394 - RNA, 16 nt, Homo sapiens
ucucucacaaagucca

SEQ ID NO: 795395 - RNA, 17 nt, Homo sapiens
ucucucacuguugcagu

SEQ ID NO: 795396 - RNA, 18 nt, Homo sapiens
ucucucagugaacuguga

SEQ ID NO: 795397 - RNA, 12 nt, Homo sapiens
ucucucaucucu

SEQ ID NO: 795398 - RNA, 15 nt, Homo sapiens
ucucuccagccugac

SEQ ID NO: 795399 - RNA, 12 nt, Homo sapiens
auagaguggaau

SEQ ID NO: 795400 - RNA, 19 nt, Homo sapiens
auagauccccccacugagc

SEQ ID NO: 795401 - RNA, 13 nt, Homo sapiens
auagaucuuuuca

SEQ ID NO: 795402 - RNA, 23 nt, Homo sapiens
auagaugaguuuugccaguucaa

SEQ ID NO: 795403 - RNA, 22 nt, Homo sapiens
auagaugccgcggaaggucccu

SEQ ID NO: 795404 - RNA, 15 nt, Homo sapiens
auagaugcuguguau

SEQ ID NO: 795405 - RNA, 17 nt, Homo sapiens
auagaugugagccagca

SEQ ID NO: 795406 - RNA, 12 nt, Homo sapiens
auagauuacuga

SEQ ID NO: 795407 - RNA, 12 nt, Homo sapiens
auagauuuagcu

SEQ ID NO: 795408 - RNA, 19 nt, Homo sapiens
auagcaaauguuuugacau

SEQ ID NO: 795409 - RNA, 14 nt, Homo sapiens
auagcaauuucgcc

SEQ ID NO: 795410 - RNA, 20 nt, Homo sapiens
auagcaccuccacauaccug

SEQ ID NO: 795411 - RNA, 16 nt, Homo sapiens
auagcacuaaugcuuu

SEQ ID NO: 795412 - RNA, 21 nt, Homo sapiens
auagcagaaauaaacauugag

SEQ ID NO: 795413 - RNA, 22 nt, Homo sapiens
auagcagccuuucucucuuuau

SEQ ID NO: 795414 - RNA, 15 nt, Homo sapiens
auagcagcuuuagcc

SEQ ID NO: 795415 - RNA, 14 nt, Homo sapiens
auagcaucucagga

SEQ ID NO: 795416 - RNA, 18 nt, Homo sapiens
auagcauugcuuucgugu

SEQ ID NO: 795417 - RNA, 23 nt, Homo sapiens
auagccaacugcuguucauguua

SEQ ID NO: 795418 - RNA, 13 nt, Homo sapiens
auagccacuuuua

SEQ ID NO: 795419 - RNA, 17 nt, Homo sapiens
auagccuacguuaaccc

SEQ ID NO: 795420 - RNA, 20 nt, Homo sapiens
auagccucaccaaggugaca

SEQ ID NO: 795421 - RNA, 17 nt, Homo sapiens
auagcuacaguguaaua

SEQ ID NO: 795422 - RNA, 20 nt, Homo sapiens
auagcuacuuuggaggacaa

SEQ ID NO: 795423 - RNA, 20 nt, Homo sapiens
auagcuggggcuucaccagu

SEQ ID NO: 795424 - RNA, 16 nt, Homo sapiens
auagcuugaagcccaa

SEQ ID NO: 795425 - RNA, 15 nt, Homo sapiens
auaggaauaguccau

SEQ ID NO: 795426 - RNA, 16 nt, Homo sapiens
auaggacauacugcau

SEQ ID NO: 795427 - RNA, 20 nt, Homo sapiens
auaggacucaaaguuucaga

SEQ ID NO: 795428 - RNA, 15 nt, Homo sapiens
auaggccugggugcu

SEQ ID NO: 795429 - RNA, 23 nt, Homo sapiens
auaggcggggcacgguggcucau

SEQ ID NO: 795430 - RNA, 18 nt, Homo sapiens
auagguuccagugaugaa

SEQ ID NO: 795431 - RNA, 17 nt, Homo sapiens
auaguacagacagaagg

SEQ ID NO: 795432 - RNA, 20 nt, Homo sapiens
auaguacucuuuguagcaaa

SEQ ID NO: 795433 - RNA, 19 nt, Homo sapiens
auaguacuggcaugguacg

SEQ ID NO: 795434 - RNA, 17 nt, Homo sapiens
auaguaugaaugcagug

SEQ ID NO: 795435 - RNA, 17 nt, Homo sapiens
auagucaaugaugguuu

SEQ ID NO: 795436 - RNA, 22 nt, Homo sapiens
auagucauuccaaauaugagau

SEQ ID NO: 795437 - RNA, 18 nt, Homo sapiens
auagucccagcuacccag

SEQ ID NO: 795438 - RNA, 18 nt, Homo sapiens
auagucucugcccucaua

SEQ ID NO: 795439 - RNA, 13 nt, Homo sapiens
auagucuguccaa

SEQ ID NO: 795440 - RNA, 23 nt, Homo sapiens
auagucuugaaaugaaagggaaa

SEQ ID NO: 795441 - RNA, 11 nt, Homo sapiens
auagucuuuca

SEQ ID NO: 795442 - RNA, 14 nt, Homo sapiens
auagucuuugccag

SEQ ID NO: 795443 - RNA, 19 nt, Homo sapiens
auagugaaaccccaucucu

SEQ ID NO: 795444 - RNA, 16 nt, Homo sapiens
auagugcaacaucucu

SEQ ID NO: 795445 - RNA, 18 nt, Homo sapiens
auagugcaacaucucuga

SEQ ID NO: 795446 - RNA, 14 nt, Homo sapiens
auagugccuaaaau

SEQ ID NO: 795447 - RNA, 11 nt, Homo sapiens
auagugcuugc

SEQ ID NO: 795448 - RNA, 16 nt, Homo sapiens
auaguggagagaacug

SEQ ID NO: 795449 - RNA, 15 nt, Homo sapiens
auaguggaucacuca

SEQ ID NO: 795450 - RNA, 16 nt, Homo sapiens
auagugggacccuguc

SEQ ID NO: 795451 - RNA, 20 nt, Homo sapiens
auagugggcaccccacugca

SEQ ID NO: 795452 - RNA, 17 nt, Homo sapiens
auagugucugcugcugc

SEQ ID NO: 795453 - RNA, 20 nt, Homo sapiens
auaguguucacaaacuguga

SEQ ID NO: 795454 - RNA, 21 nt, Homo sapiens
auaguguucacaaacugugaa

SEQ ID NO: 795455 - RNA, 17 nt, Homo sapiens
auaguguucugcuccug

SEQ ID NO: 795456 - RNA, 21 nt, Homo sapiens
auaguucuaggcacuguaguu

SEQ ID NO: 795457 - RNA, 17 nt, Homo sapiens
auaguugauauguaaca

SEQ ID NO: 795458 - RNA, 22 nt, Homo sapiens
auaguugauguaacauuguaga

SEQ ID NO: 795459 - RNA, 21 nt, Homo sapiens
auaguuguuuuauauguugcu

SEQ ID NO: 795460 - RNA, 20 nt, Homo sapiens
auaguuuaaacugcauuaua

SEQ ID NO: 795461 - RNA, 19 nt, Homo sapiens
auaguuuaaguugauuaaa

SEQ ID NO: 795462 - RNA, 14 nt, Homo sapiens
auaguuuaccugaa

SEQ ID NO: 795463 - RNA, 15 nt, Homo sapiens
auaguuuacugagaa

SEQ ID NO: 795464 - RNA, 19 nt, Homo sapiens
auaguuucaaaucuguaau

SEQ ID NO: 795465 - RNA, 16 nt, Homo sapiens
auaguuugaauucagu

SEQ ID NO: 795466 - RNA, 18 nt, Homo sapiens
auaguuuuauuuacuucu

SEQ ID NO: 795467 - RNA, 17 nt, Homo sapiens
auaguuuuuuacuucuc

SEQ ID NO: 795468 - RNA, 15 nt, Homo sapiens
auauaaaacagucau

SEQ ID NO: 795469 - RNA, 14 nt, Homo sapiens
auauaaaaggcaaa

SEQ ID NO: 795470 - RNA, 17 nt, Homo sapiens
auauaaagacugccugc

SEQ ID NO: 795471 - RNA, 18 nt, Homo sapiens
auauaaaguacaucucua

SEQ ID NO: 795472 - RNA, 17 nt, Homo sapiens
auauaaauaaucacaca

SEQ ID NO: 795473 - RNA, 13 nt, Homo sapiens
auauaacaugcaa

SEQ ID NO: 795474 - RNA, 23 nt, Homo sapiens
auauaacccuaggaauuuagaca

SEQ ID NO: 795475 - RNA, 13 nt, Homo sapiens
auauaagccauag

SEQ ID NO: 795476 - RNA, 20 nt, Homo sapiens
auauaauaugcacacagugc

SEQ ID NO: 795477 - RNA, 12 nt, Homo sapiens
auauacaaauag

SEQ ID NO: 795478 - RNA, 19 nt, Homo sapiens
auauaccuggcuuuuacuu

SEQ ID NO: 795479 - RNA, 17 nt, Homo sapiens
auauaccugguuuacuu

SEQ ID NO: 795480 - RNA, 12 nt, Homo sapiens
auauacuaugaa

SEQ ID NO: 795481 - RNA, 13 nt, Homo sapiens
auauacuaugaaa

SEQ ID NO: 795482 - RNA, 22 nt, Homo sapiens
auauacugcuugucaucugcau

SEQ ID NO: 795483 - RNA, 15 nt, Homo sapiens
auauacugugugcuu

SEQ ID NO: 795484 - RNA, 17 nt, Homo sapiens
auauagaaaaauaacuu

SEQ ID NO: 795485 - RNA, 22 nt, Homo sapiens
auauagaaugaucuauugcuca

SEQ ID NO: 795486 - RNA, 16 nt, Homo sapiens
auauagacaccaagga

SEQ ID NO: 795487 - RNA, 15 nt, Homo sapiens
auauagaguggaauc

SEQ ID NO: 795488 - RNA, 23 nt, Homo sapiens
auauaggccagaguugcaaagau

SEQ ID NO: 795489 - RNA, 19 nt, Homo sapiens
auauaguccagacacuuaa

SEQ ID NO: 795490 - RNA, 14 nt, Homo sapiens
auauauaacauaua

SEQ ID NO: 795491 - RNA, 13 nt, Homo sapiens
auauauacaggca

SEQ ID NO: 795492 - RNA, 13 nt, Homo sapiens
auauauacauaua

SEQ ID NO: 795493 - RNA, 17 nt, Homo sapiens
auauauacccacaugua

SEQ ID NO: 795494 - RNA, 22 nt, Homo sapiens
auauauaggcaguugcaugcua

SEQ ID NO: 795495 - RNA, 21 nt, Homo sapiens
auauauauguauauacauauc

SEQ ID NO: 795496 - RNA, 13 nt, Homo sapiens
auauauauuacaa

SEQ ID NO: 795497 - RNA, 18 nt, Homo sapiens
auauauauuauauauauc

SEQ ID NO: 795498 - RNA, 15 nt, Homo sapiens
auauaucacuaagcu

SEQ ID NO: 795499 - RNA, 14 nt, Homo sapiens
auauaugucaauau

SEQ ID NO: 795500 - RNA, 20 nt, Homo sapiens
auauauuuaaaaauaaguca

SEQ ID NO: 795501 - RNA, 16 nt, Homo sapiens
auauauuuauaacuca

SEQ ID NO: 795502 - RNA, 22 nt, Homo sapiens
auauauuuauuuaagcuuaugu

SEQ ID NO: 795503 - RNA, 13 nt, Homo sapiens
auauauuuuuaga

SEQ ID NO: 795504 - RNA, 20 nt, Homo sapiens
auaucaaaaaaccuuuacag

SEQ ID NO: 795505 - RNA, 19 nt, Homo sapiens
auaucacauuggagucacu

SEQ ID NO: 795506 - RNA, 13 nt, Homo sapiens
auaucagagcucu

SEQ ID NO: 795507 - RNA, 20 nt, Homo sapiens
auaucagggguacauucuag

SEQ ID NO: 795508 - RNA, 19 nt, Homo sapiens
auaucagugcucgagacac

SEQ ID NO: 795509 - RNA, 17 nt, Homo sapiens
auaucaugguagucacu

SEQ ID NO: 795510 - RNA, 20 nt, Homo sapiens
auauccaggcuuaccaaagu

SEQ ID NO: 795511 - RNA, 18 nt, Homo sapiens
auaucccaagugcacuuu

SEQ ID NO: 795512 - RNA, 18 nt, Homo sapiens
auaucccuuccucucagg

SEQ ID NO: 795513 - RNA, 18 nt, Homo sapiens
auauccuacuuggcagaa

SEQ ID NO: 795514 - RNA, 16 nt, Homo sapiens
gcucaucugauuuuug

SEQ ID NO: 795515 - RNA, 17 nt, Homo sapiens
gcucaucuguacauacu

SEQ ID NO: 795516 - RNA, 19 nt, Homo sapiens
gcucaucuguacauacugu

SEQ ID NO: 795517 - RNA, 20 nt, Homo sapiens
gcucaugaccuggaaauaaa

SEQ ID NO: 795518 - RNA, 19 nt, Homo sapiens
gcucaugccuguaaucuca

SEQ ID NO: 795519 - RNA, 15 nt, Homo sapiens
gcucauuugagauaa

SEQ ID NO: 795520 - RNA, 22 nt, Homo sapiens
gcucauuugagauaaagucaaa

SEQ ID NO: 795521 - RNA, 22 nt, Homo sapiens
gcuccaaccugcaaagaucugu

SEQ ID NO: 795522 - RNA, 14 nt, Homo sapiens
gcuccaccaagggg

SEQ ID NO: 795523 - RNA, 20 nt, Homo sapiens
gcuccaccagcagcauggca

SEQ ID NO: 795524 - RNA, 17 nt, Homo sapiens
gcuccacgcagucugcu

SEQ ID NO: 795525 - RNA, 18 nt, Homo sapiens
gcuccagauucugaugca

SEQ ID NO: 795526 - RNA, 14 nt, Homo sapiens
gcuccagcagcaca

SEQ ID NO: 795527 - RNA, 13 nt, Homo sapiens
gcuccagcaucca

SEQ ID NO: 795528 - RNA, 13 nt, Homo sapiens
gcuccaguaucuc

SEQ ID NO: 795529 - RNA, 13 nt, Homo sapiens
gcuccaugcaccu

SEQ ID NO: 795530 - RNA, 13 nt, Homo sapiens
gcuccauguauau

SEQ ID NO: 795531 - RNA, 14 nt, Homo sapiens
gcucccaacagagg

SEQ ID NO: 795532 - RNA, 19 nt, Homo sapiens
gcucccaccaccagugaga

SEQ ID NO: 795533 - RNA, 16 nt, Homo sapiens
gcucccagagaccuug

SEQ ID NO: 795534 - RNA, 12 nt, Homo sapiens
gcucccauuccu

SEQ ID NO: 795535 - RNA, 15 nt, Homo sapiens
aaccccauguccuca

SEQ ID NO: 795536 - RNA, 20 nt, Homo sapiens
aaccccauguccucagcauu

SEQ ID NO: 795537 - RNA, 13 nt, Homo sapiens
aacccccaucucc

SEQ ID NO: 795538 - RNA, 16 nt, Homo sapiens
aacccccaucucccua

SEQ ID NO: 795539 - RNA, 13 nt, Homo sapiens
aacccccaucucu

SEQ ID NO: 795540 - RNA, 18 nt, Homo sapiens
aaccccccagcacugagg

SEQ ID NO: 795541 - RNA, 19 nt, Homo sapiens
aaccccccuccugcuccuc

SEQ ID NO: 795542 - RNA, 17 nt, Homo sapiens
aaccccgcggugcucug

SEQ ID NO: 795543 - RNA, 16 nt, Homo sapiens
aaccccgucucuacua

SEQ ID NO: 795544 - RNA, 21 nt, Homo sapiens
aaccccuagagacagugaugc

SEQ ID NO: 795545 - RNA, 14 nt, Homo sapiens
aaccccugcuccag

SEQ ID NO: 795546 - RNA, 16 nt, Homo sapiens
aaccccugcuccaguc

SEQ ID NO: 795547 - RNA, 22 nt, Homo sapiens
aaccccuuccagaucacugcca

SEQ ID NO: 795548 - RNA, 23 nt, Homo sapiens
aaccccuuccagaucacugccac

SEQ ID NO: 795549 - RNA, 20 nt, Homo sapiens
aacccguuucccgguucagg

SEQ ID NO: 795550 - RNA, 19 nt, Homo sapiens
aacccuaucuccugacaga

SEQ ID NO: 795551 - RNA, 17 nt, Homo sapiens
aacccucucucuuaccu

SEQ ID NO: 795552 - RNA, 14 nt, Homo sapiens
aaccgagcaauuuu

SEQ ID NO: 795553 - RNA, 21 nt, Homo sapiens
aaccgaugguccucacaagcc

SEQ ID NO: 795554 - RNA, 19 nt, Homo sapiens
aaccguaucauuuuuucac

SEQ ID NO: 795555 - RNA, 18 nt, Homo sapiens
aaccuaauaucacuuaaa

SEQ ID NO: 795556 - RNA, 17 nt, Homo sapiens
aaccuacgcacauaccu

SEQ ID NO: 795557 - RNA, 18 nt, Homo sapiens
aaccuacugcccacauuu

SEQ ID NO: 795558 - RNA, 15 nt, Homo sapiens
aaccuagaucugcac

SEQ ID NO: 795559 - RNA, 18 nt, Homo sapiens
aaccuagggugccuuaaa

SEQ ID NO: 795560 - RNA, 12 nt, Homo sapiens
aaccuagugaau

SEQ ID NO: 795561 - RNA, 21 nt, Homo sapiens
aaccucagccuggccagacac

SEQ ID NO: 795562 - RNA, 20 nt, Homo sapiens
aaccucaggcuuccuuggca

SEQ ID NO: 795563 - RNA, 23 nt, Homo sapiens
aaccucagggcucccaggggucu

SEQ ID NO: 795564 - RNA, 20 nt, Homo sapiens
aaccuccaccucgcagguuc

SEQ ID NO: 795565 - RNA, 13 nt, Homo sapiens
aaccuccaucucc

SEQ ID NO: 795566 - RNA, 20 nt, Homo sapiens
aaccuccgcauccgggguuc

SEQ ID NO: 795567 - RNA, 14 nt, Homo sapiens
aaccuccgccuccc

SEQ ID NO: 795568 - RNA, 15 nt, Homo sapiens
aaccucuagagucac

SEQ ID NO: 795569 - RNA, 18 nt, Homo sapiens
aaccucuaugcaaucuga

SEQ ID NO: 795570 - RNA, 22 nt, Homo sapiens
aaccucucugaucuugugcuca

SEQ ID NO: 795571 - RNA, 16 nt, Homo sapiens
aaccucucugugccau

SEQ ID NO: 795572 - RNA, 18 nt, Homo sapiens
aaccucucuucuaccuua

SEQ ID NO: 795573 - RNA, 17 nt, Homo sapiens
aaccucuucuggcucaa

SEQ ID NO: 795574 - RNA, 19 nt, Homo sapiens
aaccucuuuucugcaucau

SEQ ID NO: 795575 - RNA, 23 nt, Homo sapiens
aaccugaauauaaauuuguguuc

SEQ ID NO: 795576 - RNA, 21 nt, Homo sapiens
aaccugaauuaucuauuucau

SEQ ID NO: 795577 - RNA, 14 nt, Homo sapiens
aaccugcugugaua

SEQ ID NO: 795578 - RNA, 12 nt, Homo sapiens
aaccugcuuccu

SEQ ID NO: 795579 - RNA, 16 nt, Homo sapiens
aaccugcuuccuucag

SEQ ID NO: 795580 - RNA, 17 nt, Homo sapiens
aaccuggauccagcacu

SEQ ID NO: 795581 - RNA, 16 nt, Homo sapiens
aaccugggcauggugg

SEQ ID NO: 795582 - RNA, 14 nt, Homo sapiens
aaccuguccuugca

SEQ ID NO: 795583 - RNA, 18 nt, Homo sapiens
aaccuguuaaaacaacca

SEQ ID NO: 795584 - RNA, 21 nt, Homo sapiens
aaccuuaaagaaccaucagca

SEQ ID NO: 795585 - RNA, 22 nt, Homo sapiens
aaccuuaaagaaccaucagcau

SEQ ID NO: 795586 - RNA, 14 nt, Homo sapiens
aaccuuacaugugu

SEQ ID NO: 795587 - RNA, 13 nt, Homo sapiens
aaccuuaguuuca

SEQ ID NO: 795588 - RNA, 18 nt, Homo sapiens
aaccuuauguagguugcc

SEQ ID NO: 795589 - RNA, 18 nt, Homo sapiens
aaccuuauuguaccucuc

SEQ ID NO: 795590 - RNA, 15 nt, Homo sapiens
aaccuucaacccagu

SEQ ID NO: 795591 - RNA, 22 nt, Homo sapiens
aaccuugaaaaaaaacagugga

SEQ ID NO: 795592 - RNA, 18 nt, Homo sapiens
aaccuugaaugcugccag

SEQ ID NO: 795593 - RNA, 18 nt, Homo sapiens
aacgaaacuccaucucaa

SEQ ID NO: 795594 - RNA, 20 nt, Homo sapiens
aacgaagaguucccuugaaa

SEQ ID NO: 795595 - RNA, 15 nt, Homo sapiens
aacgacaaagccaaa

SEQ ID NO: 795596 - RNA, 13 nt, Homo sapiens
aacgacacauuca

SEQ ID NO: 795597 - RNA, 12 nt, Homo sapiens
aacgaccaaacu

SEQ ID NO: 795598 - RNA, 20 nt, Homo sapiens
aacgagaagcagcauuugau

SEQ ID NO: 795599 - RNA, 15 nt, Homo sapiens
aacgauauguagcag

SEQ ID NO: 795600 - RNA, 15 nt, Homo sapiens
aacgccgagugcacu

SEQ ID NO: 795601 - RNA, 16 nt, Homo sapiens
aacgccgagugcacug

SEQ ID NO: 795602 - RNA, 17 nt, Homo sapiens
aacgccgagugcacugc

SEQ ID NO: 795603 - RNA, 17 nt, Homo sapiens
aacgccgcugacugcca

SEQ ID NO: 795604 - RNA, 22 nt, Homo sapiens
aacgccuggugccccagcacca

SEQ ID NO: 795605 - RNA, 16 nt, Homo sapiens
aacgcguaucuaggcu

SEQ ID NO: 795606 - RNA, 17 nt, Homo sapiens
aacggaggaagcccaca

SEQ ID NO: 795607 - RNA, 21 nt, Homo sapiens
aacguagcuucuaccaugaac

SEQ ID NO: 795608 - RNA, 15 nt, Homo sapiens
aacgucuauguguac

SEQ ID NO: 795609 - RNA, 19 nt, Homo sapiens
aacgugaaauucuauugaa

SEQ ID NO: 795610 - RNA, 12 nt, Homo sapiens
aacguggcccag

SEQ ID NO: 795611 - RNA, 17 nt, Homo sapiens
aacgugucagaauccuu

SEQ ID NO: 795612 - RNA, 22 nt, Homo sapiens
aacguuuacuuaucuuaugcca

SEQ ID NO: 795613 - RNA, 18 nt, Homo sapiens
aacguuugucauuccagu

SEQ ID NO: 795614 - RNA, 17 nt, Homo sapiens
aacguuuugaacuaaua

SEQ ID NO: 795615 - RNA, 14 nt, Homo sapiens
aacuaaaaagccau

SEQ ID NO: 795616 - RNA, 17 nt, Homo sapiens
aacuaaaaggaagucau

SEQ ID NO: 795617 - RNA, 20 nt, Homo sapiens
aacuaaaaggaagucaucca

SEQ ID NO: 795618 - RNA, 17 nt, Homo sapiens
aacuaaacaauaagcaa

SEQ ID NO: 795619 - RNA, 15 nt, Homo sapiens
aacuaaacagauaaa

SEQ ID NO: 795620 - RNA, 22 nt, Homo sapiens
aacuaaagccaaggguauccaa

SEQ ID NO: 795621 - RNA, 22 nt, Homo sapiens
aacuaaagcuuuaggaugacug

SEQ ID NO: 795622 - RNA, 14 nt, Homo sapiens
aacuaaauaaagcu

SEQ ID NO: 795623 - RNA, 15 nt, Homo sapiens
aacuaaccagcauuc

SEQ ID NO: 795624 - RNA, 21 nt, Homo sapiens
aacuaagaaaauucuauguua

SEQ ID NO: 795625 - RNA, 13 nt, Homo sapiens
aacuaagcacaaa

SEQ ID NO: 795626 - RNA, 23 nt, Homo sapiens
aacuaauuuccucugacauguaa

SEQ ID NO: 795627 - RNA, 20 nt, Homo sapiens
aacuacagaaagagcgucau

SEQ ID NO: 795628 - RNA, 18 nt, Homo sapiens
aacuacagcuauaccuca

SEQ ID NO: 795629 - RNA, 23 nt, Homo sapiens
gcugcaggccugacuacugccca

SEQ ID NO: 795630 - RNA, 22 nt, Homo sapiens
gcugcagguugcauaggugagg

SEQ ID NO: 795631 - RNA, 16 nt, Homo sapiens
gcugcagucacauuga

SEQ ID NO: 795632 - RNA, 15 nt, Homo sapiens
gcugcagucaucuac

SEQ ID NO: 795633 - RNA, 23 nt, Homo sapiens
gcugcaucccuguguccacugag

SEQ ID NO: 795634 - RNA, 23 nt, Homo sapiens
gcugccaaccauaccuuccuucc

SEQ ID NO: 795635 - RNA, 21 nt, Homo sapiens
gcugccaccacgucugccagg

SEQ ID NO: 795636 - RNA, 14 nt, Homo sapiens
gcugccacugggca

SEQ ID NO: 795637 - RNA, 19 nt, Homo sapiens
gcugccagaugauuguuca

SEQ ID NO: 795638 - RNA, 20 nt, Homo sapiens
gcugccagaugauuguucaa

SEQ ID NO: 795639 - RNA, 14 nt, Homo sapiens
gcugccauccaugu

SEQ ID NO: 795640 - RNA, 22 nt, Homo sapiens
gcugccccaaccugcugaaggg

SEQ ID NO: 795641 - RNA, 19 nt, Homo sapiens
gcugccccuggcaccugug

SEQ ID NO: 795642 - RNA, 18 nt, Homo sapiens
gcugcccuagcugacccc

SEQ ID NO: 795643 - RNA, 22 nt, Homo sapiens
gcugcccuggcccugaggugug

SEQ ID NO: 795644 - RNA, 14 nt, Homo sapiens
gcugccuaguggga

SEQ ID NO: 795645 - RNA, 20 nt, Homo sapiens
gcugccuggaacaccagcag

SEQ ID NO: 795646 - RNA, 17 nt, Homo sapiens
gcugccuuggcucagac

SEQ ID NO: 795647 - RNA, 13 nt, Homo sapiens
gcugcgcacugug

SEQ ID NO: 795648 - RNA, 20 nt, Homo sapiens
gcugcggggggcaccagagg

SEQ ID NO: 795649 - RNA, 13 nt, Homo sapiens
gcugcucuuccca

SEQ ID NO: 795650 - RNA, 20 nt, Homo sapiens
aacucaaccuggacacucuc

SEQ ID NO: 795651 - RNA, 16 nt, Homo sapiens
aacucaacuuugacaa

SEQ ID NO: 795652 - RNA, 21 nt, Homo sapiens
aacucaccagccccacugcca

SEQ ID NO: 795653 - RNA, 17 nt, Homo sapiens
aacucacuaacagggag

SEQ ID NO: 795654 - RNA, 16 nt, Homo sapiens
aacucacucugggcug

SEQ ID NO: 795655 - RNA, 21 nt, Homo sapiens
aacucacugaggguaucugac

SEQ ID NO: 795656 - RNA, 14 nt, Homo sapiens
aacucacugccuag

SEQ ID NO: 795657 - RNA, 23 nt, Homo sapiens
aacucagauccagggacagaggc

SEQ ID NO: 795658 - RNA, 15 nt, Homo sapiens
aacucaguuccaaag

SEQ ID NO: 795659 - RNA, 17 nt, Homo sapiens
aacucaguuucuaggca

SEQ ID NO: 795660 - RNA, 22 nt, Homo sapiens
aacucaucugcugguaccuauu

SEQ ID NO: 795661 - RNA, 14 nt, Homo sapiens
aacucaucuguuau

SEQ ID NO: 795662 - RNA, 18 nt, Homo sapiens
aacucaugucuuucucag

SEQ ID NO: 795663 - RNA, 22 nt, Homo sapiens
aacucauucucuucuugcuaua

SEQ ID NO: 795664 - RNA, 18 nt, Homo sapiens
aacuccaaaugagccaua

SEQ ID NO: 795665 - RNA, 17 nt, Homo sapiens
aacuccuagcugacuca

SEQ ID NO: 795666 - RNA, 14 nt, Homo sapiens
aacuccugaccuca

SEQ ID NO: 795667 - RNA, 14 nt, Homo sapiens
aacuccugccauuc

SEQ ID NO: 795668 - RNA, 18 nt, Homo sapiens
aacuccuuucagccacau

SEQ ID NO: 795669 - RNA, 14 nt, Homo sapiens
aacucggaaacuau

SEQ ID NO: 795670 - RNA, 19 nt, Homo sapiens
aacucuaauuguccauucu

SEQ ID NO: 795671 - RNA, 15 nt, Homo sapiens
aacucuagaagacca

SEQ ID NO: 795672 - RNA, 19 nt, Homo sapiens
aacucuagagagccuuaac

SEQ ID NO: 795673 - RNA, 20 nt, Homo sapiens
aacucuauaaccucagcuuu

SEQ ID NO: 795674 - RNA, 13 nt, Homo sapiens
aacucucaagugu

SEQ ID NO: 795675 - RNA, 13 nt, Homo sapiens
aacucuccccagu

SEQ ID NO: 795676 - RNA, 18 nt, Homo sapiens
aacucuccccagugccug

SEQ ID NO: 795677 - RNA, 23 nt, Homo sapiens
aacucuccuuugcucucuggcca

SEQ ID NO: 795678 - RNA, 18 nt, Homo sapiens
aacucugacaagggcuga

SEQ ID NO: 795679 - RNA, 22 nt, Homo sapiens
aacucuggacacucuauaugua

SEQ ID NO: 795680 - RNA, 20 nt, Homo sapiens
aacucuggcuccaggcagaa

SEQ ID NO: 795681 - RNA, 21 nt, Homo sapiens
aacucuguccacgauucacuc

SEQ ID NO: 795682 - RNA, 15 nt, Homo sapiens
aacucuucaguuaau

SEQ ID NO: 795683 - RNA, 21 nt, Homo sapiens
aacucuucaguuaauucuuag

SEQ ID NO: 795684 - RNA, 18 nt, Homo sapiens
aacucuuggcuccaagug

SEQ ID NO: 795685 - RNA, 21 nt, Homo sapiens
aacugaacuuaaucaugucgu

SEQ ID NO: 795686 - RNA, 13 nt, Homo sapiens
aacugaaggcaua

SEQ ID NO: 795687 - RNA, 14 nt, Homo sapiens
aacugaaggccacu

SEQ ID NO: 795688 - RNA, 21 nt, Homo sapiens
aacugaaggggugcacccacc

SEQ ID NO: 795689 - RNA, 16 nt, Homo sapiens
aacugaaucacuuaaa

SEQ ID NO: 795690 - RNA, 15 nt, Homo sapiens
aacugacaagccauc

SEQ ID NO: 795691 - RNA, 16 nt, Homo sapiens
aacugacaaugaaggg

SEQ ID NO: 795692 - RNA, 22 nt, Homo sapiens
aacugacuagugagauggccug

SEQ ID NO: 795693 - RNA, 22 nt, Homo sapiens
aacugacugaaggaaaagcaag

SEQ ID NO: 795694 - RNA, 18 nt, Homo sapiens
aacugagauuacaggcac

SEQ ID NO: 795695 - RNA, 21 nt, Homo sapiens
aacugaggagcggacucacuu

SEQ ID NO: 795696 - RNA, 16 nt, Homo sapiens
aacugaggcagagcaa

SEQ ID NO: 795697 - RNA, 23 nt, Homo sapiens
aacugagggccagggacccaggu

SEQ ID NO: 795698 - RNA, 14 nt, Homo sapiens
aacugaucucaggu

SEQ ID NO: 795699 - RNA, 12 nt, Homo sapiens
aacugauucucu

SEQ ID NO: 795700 - RNA, 20 nt, Homo sapiens
aacugauucucuaugacaug

SEQ ID NO: 795701 - RNA, 18 nt, Homo sapiens
aacugauuuaugaucacu

SEQ ID NO: 795702 - RNA, 21 nt, Homo sapiens
aacugauuuuuagcuuuacaa

SEQ ID NO: 795703 - RNA, 14 nt, Homo sapiens
aacugcaaaccaug

SEQ ID NO: 795704 - RNA, 22 nt, Homo sapiens
aacugcaggcccuggccucccc

SEQ ID NO: 795705 - RNA, 21 nt, Homo sapiens
aacugcauggaccuaacauuc

SEQ ID NO: 795706 - RNA, 19 nt, Homo sapiens
aacugccaggcugccuccu

SEQ ID NO: 795707 - RNA, 11 nt, Homo sapiens
aacugccauua

SEQ ID NO: 795708 - RNA, 19 nt, Homo sapiens
aacugcccuuccagguggg

SEQ ID NO: 795709 - RNA, 18 nt, Homo sapiens
aacugcgaggacaucaaa

SEQ ID NO: 795710 - RNA, 14 nt, Homo sapiens
aacugcuuuuccac

SEQ ID NO: 795711 - RNA, 17 nt, Homo sapiens
aacuggaaaacagaaca

SEQ ID NO: 795712 - RNA, 19 nt, Homo sapiens
aacuggaggaguuccuuga

SEQ ID NO: 795713 - RNA, 13 nt, Homo sapiens
aacuggagggugg

SEQ ID NO: 795714 - RNA, 20 nt, Homo sapiens
aacuggauucuuaaccaaga

SEQ ID NO: 795715 - RNA, 23 nt, Homo sapiens
aacuggggaaugggguauggaag

SEQ ID NO: 795716 - RNA, 20 nt, Homo sapiens
aacugggggcucuguauaua

SEQ ID NO: 795717 - RNA, 15 nt, Homo sapiens
aacugguaguguuca

SEQ ID NO: 795718 - RNA, 20 nt, Homo sapiens
aacugguaguguucaguaaa

SEQ ID NO: 795719 - RNA, 22 nt, Homo sapiens
aacugguuaaacauuaauauuu

SEQ ID NO: 795720 - RNA, 16 nt, Homo sapiens
aacuguagaugaugua

SEQ ID NO: 795721 - RNA, 16 nt, Homo sapiens
aacuguauauauuccc

SEQ ID NO: 795722 - RNA, 17 nt, Homo sapiens
aacugucucaaaaggau

SEQ ID NO: 795723 - RNA, 15 nt, Homo sapiens
aacugugaaauacca

SEQ ID NO: 795724 - RNA, 18 nt, Homo sapiens
aacugugaaauaccacaa

SEQ ID NO: 795725 - RNA, 22 nt, Homo sapiens
aacugugaaauaccacaagccu

SEQ ID NO: 795726 - RNA, 17 nt, Homo sapiens
aacugugaagcauuuac

SEQ ID NO: 795727 - RNA, 22 nt, Homo sapiens
aacugugaaguuuacauuguaa

SEQ ID NO: 795728 - RNA, 16 nt, Homo sapiens
aacugugacuaggcau

SEQ ID NO: 795729 - RNA, 12 nt, Homo sapiens
aacugugacugu

SEQ ID NO: 795730 - RNA, 17 nt, Homo sapiens
aacuguguauguacaua

SEQ ID NO: 795731 - RNA, 17 nt, Homo sapiens
aacuguguggacuguga

SEQ ID NO: 795732 - RNA, 18 nt, Homo sapiens
aacuguuccugacuuuau

SEQ ID NO: 795733 - RNA, 17 nt, Homo sapiens
aacuuaaaaaaaugaca

SEQ ID NO: 795734 - RNA, 14 nt, Homo sapiens
aacuuaagcaaagg

SEQ ID NO: 795735 - RNA, 12 nt, Homo sapiens
aacuuaauguuc

SEQ ID NO: 795736 - RNA, 22 nt, Homo sapiens
aacuuacauacuaggugccuuu

SEQ ID NO: 795737 - RNA, 15 nt, Homo sapiens
aacuuacuagcuuua

SEQ ID NO: 795738 - RNA, 13 nt, Homo sapiens
aacuuagaacuau

SEQ ID NO: 795739 - RNA, 16 nt, Homo sapiens
aacuuagagacuuuag

SEQ ID NO: 795740 - RNA, 14 nt, Homo sapiens
aacuuagagaggua

SEQ ID NO: 795741 - RNA, 22 nt, Homo sapiens
aacuuagaggaaaagggcacag

SEQ ID NO: 795742 - RNA, 14 nt, Homo sapiens
aacuuagugacaaa

SEQ ID NO: 795743 - RNA, 15 nt, Homo sapiens
aagacauaugcauuu

SEQ ID NO: 795744 - RNA, 13 nt, Homo sapiens
aagacaugaacca

SEQ ID NO: 795745 - RNA, 15 nt, Homo sapiens
aagacaugacauucu

SEQ ID NO: 795746 - RNA, 21 nt, Homo sapiens
aagacauuaccaugaguaaua

SEQ ID NO: 795747 - RNA, 17 nt, Homo sapiens
aagaccaaaguuugcaa

SEQ ID NO: 795748 - RNA, 12 nt, Homo sapiens
aagaccaagaca

SEQ ID NO: 795749 - RNA, 22 nt, Homo sapiens
aagaccaagacuuuugucugau

SEQ ID NO: 795750 - RNA, 19 nt, Homo sapiens
aagacccaacaggugcuga

SEQ ID NO: 795751 - RNA, 15 nt, Homo sapiens
aagaccccaucucaa

SEQ ID NO: 795752 - RNA, 13 nt, Homo sapiens
aagacccucccau

SEQ ID NO: 795753 - RNA, 18 nt, Homo sapiens
aagaccuauaaaucauua

SEQ ID NO: 795754 - RNA, 13 nt, Homo sapiens
aagaccucaucuc

SEQ ID NO: 795755 - RNA, 17 nt, Homo sapiens
aagacguggacuccucu

SEQ ID NO: 795756 - RNA, 14 nt, Homo sapiens
aagacuacaaaaau

SEQ ID NO: 795757 - RNA, 13 nt, Homo sapiens
aagacuacugaau

SEQ ID NO: 795758 - RNA, 18 nt, Homo sapiens
aagacuagaggcuugcau

SEQ ID NO: 795759 - RNA, 14 nt, Homo sapiens
aagacuauaccuua

SEQ ID NO: 795760 - RNA, 14 nt, Homo sapiens
aagacuauucaaac

SEQ ID NO: 795761 - RNA, 18 nt, Homo sapiens
aagacuauuuaguggaac

SEQ ID NO: 795762 - RNA, 22 nt, Homo sapiens
aagacucaggagucugccacuu

SEQ ID NO: 795763 - RNA, 14 nt, Homo sapiens
aagacuccaucuca

SEQ ID NO: 795764 - RNA, 22 nt, Homo sapiens
aagacucuacccauauuacaga

SEQ ID NO: 795765 - RNA, 20 nt, Homo sapiens
gcuucuccuucuccuuccca

SEQ ID NO: 795766 - RNA, 17 nt, Homo sapiens
gcuucucuccacagugu

SEQ ID NO: 795767 - RNA, 19 nt, Homo sapiens
gcuucucuugagucacacu

SEQ ID NO: 795768 - RNA, 14 nt, Homo sapiens
gcuucugauaugca

SEQ ID NO: 795769 - RNA, 13 nt, Homo sapiens
gcuucugcaaugu

SEQ ID NO: 795770 - RNA, 15 nt, Homo sapiens
gcuucugcacuucau

SEQ ID NO: 795771 - RNA, 23 nt, Homo sapiens
gcuucuggaauuuguucaaguuu

SEQ ID NO: 795772 - RNA, 17 nt, Homo sapiens
gcuucugggccacucag

SEQ ID NO: 795773 - RNA, 20 nt, Homo sapiens
gcuucugggccacucaggcc

SEQ ID NO: 795774 - RNA, 20 nt, Homo sapiens
gcuucuugccucugugcugu

SEQ ID NO: 795775 - RNA, 15 nt, Homo sapiens
gcuucuuggaccuug

SEQ ID NO: 795776 - RNA, 20 nt, Homo sapiens
gcuucuuggaccuuggcgcu

SEQ ID NO: 795777 - RNA, 13 nt, Homo sapiens
gcuucuuuaccaa

SEQ ID NO: 795778 - RNA, 13 nt, Homo sapiens
gcuucuuuucacu

SEQ ID NO: 795779 - RNA, 14 nt, Homo sapiens
gcuugaaccuggga

SEQ ID NO: 795780 - RNA, 15 nt, Homo sapiens
gcuugaagccaaaga

SEQ ID NO: 795781 - RNA, 14 nt, Homo sapiens
gcuugaauguuugu

SEQ ID NO: 795782 - RNA, 15 nt, Homo sapiens
gcuugagcccaggag

SEQ ID NO: 795783 - RNA, 23 nt, Homo sapiens
gcuugagcuccccuggagccagc

SEQ ID NO: 795784 - RNA, 14 nt, Homo sapiens
gcuugagucucaag

SEQ ID NO: 795785 - RNA, 22 nt, Homo sapiens
gcuugagucucaaggguggcag

SEQ ID NO: 795786 - RNA, 22 nt, Homo sapiens
gcuugauauuuuccaaauggau

SEQ ID NO: 795787 - RNA, 14 nt, Homo sapiens
gcuugcacacuucc

SEQ ID NO: 795788 - RNA, 15 nt, Homo sapiens
gcuugcacacuuccc

SEQ ID NO: 795789 - RNA, 21 nt, Homo sapiens
gcuugcccuguuaaaagauga

SEQ ID NO: 795790 - RNA, 19 nt, Homo sapiens
gcuuggcccuuuccuucca

SEQ ID NO: 795791 - RNA, 18 nt, Homo sapiens
gcuuggcugcucuuccag

SEQ ID NO: 795792 - RNA, 11 nt, Homo sapiens
gcuugggcauu

SEQ ID NO: 795793 - RNA, 17 nt, Homo sapiens
gcuugggcccugcacag

SEQ ID NO: 795794 - RNA, 13 nt, Homo sapiens
gcuuguaaucaag

SEQ ID NO: 795795 - RNA, 14 nt, Homo sapiens
gcuugucagaaaca

SEQ ID NO: 795796 - RNA, 18 nt, Homo sapiens
gcuuguuauugccucuac

SEQ ID NO: 795797 - RNA, 13 nt, Homo sapiens
gcuuguugcuguu

SEQ ID NO: 795798 - RNA, 16 nt, Homo sapiens
gcuuguuguuugcgca

SEQ ID NO: 795799 - RNA, 20 nt, Homo sapiens
gcuuguuuacagcacuacuc

SEQ ID NO: 795800 - RNA, 23 nt, Homo sapiens
gcuuguuuacagcacuacucugu

SEQ ID NO: 795801 - RNA, 14 nt, Homo sapiens
gcuuuaaaaccaca

SEQ ID NO: 795802 - RNA, 20 nt, Homo sapiens
gcuuuaaacacccuucacau

SEQ ID NO: 795803 - RNA, 16 nt, Homo sapiens
gcuuuaaacugcauuu

SEQ ID NO: 795804 - RNA, 16 nt, Homo sapiens
gcuuuaauaugagcuu

SEQ ID NO: 795805 - RNA, 19 nt, Homo sapiens
gcuuuacaguuacaguuga

SEQ ID NO: 795806 - RNA, 16 nt, Homo sapiens
gcuuuauacaguugaa

SEQ ID NO: 795807 - RNA, 16 nt, Homo sapiens
gcuuuaugcaaauaca

SEQ ID NO: 795808 - RNA, 21 nt, Homo sapiens
gcuuucaagugccuuucugca

SEQ ID NO: 795809 - RNA, 14 nt, Homo sapiens
gcuuucagagccag

SEQ ID NO: 795810 - RNA, 19 nt, Homo sapiens
gcuuuccaauguagcucag

SEQ ID NO: 795811 - RNA, 17 nt, Homo sapiens
gcuuuccuuaguuuucu

SEQ ID NO: 795812 - RNA, 18 nt, Homo sapiens
gcuuucgaugcguguguu

SEQ ID NO: 795813 - RNA, 20 nt, Homo sapiens
gcuuucguaguuuucauuua

SEQ ID NO: 795814 - RNA, 23 nt, Homo sapiens
gcuuucguguaaauuauguaaug

SEQ ID NO: 795815 - RNA, 17 nt, Homo sapiens
gcuuugaguuaacucac

SEQ ID NO: 795816 - RNA, 21 nt, Homo sapiens
gcuuugcaauauuuauuacac

SEQ ID NO: 795817 - RNA, 13 nt, Homo sapiens
gcuuugcaggcuc

SEQ ID NO: 795818 - RNA, 15 nt, Homo sapiens
gcuuugcagugacag

SEQ ID NO: 795819 - RNA, 23 nt, Homo sapiens
gcuuugcccaccccucacucccc

SEQ ID NO: 795820 - RNA, 19 nt, Homo sapiens
gcuuugccccugagacaaa

SEQ ID NO: 795821 - RNA, 23 nt, Homo sapiens
gcuuugcugaccaaaugccuggu

SEQ ID NO: 795822 - RNA, 13 nt, Homo sapiens
gcuuugcugcuac

SEQ ID NO: 795823 - RNA, 17 nt, Homo sapiens
gcuuuggguggcucacu

SEQ ID NO: 795824 - RNA, 21 nt, Homo sapiens
gcuuugguuccuucucugggu

SEQ ID NO: 795825 - RNA, 12 nt, Homo sapiens
gcuuugugauuc

SEQ ID NO: 795826 - RNA, 19 nt, Homo sapiens
gcuuuguuuugucuuacaa

SEQ ID NO: 795827 - RNA, 16 nt, Homo sapiens
gcuuuuaacuuuauaa

SEQ ID NO: 795828 - RNA, 18 nt, Homo sapiens
gcuuuuaagaaacacagg

SEQ ID NO: 795829 - RNA, 15 nt, Homo sapiens
gcuuuuaauucucau

SEQ ID NO: 795830 - RNA, 23 nt, Homo sapiens
gcuuuuccagcgcgcucgucauu

SEQ ID NO: 795831 - RNA, 15 nt, Homo sapiens
gcuuuucugucccuu

SEQ ID NO: 795832 - RNA, 22 nt, Homo sapiens
gcuuuucuuuuuuaauuuccag

SEQ ID NO: 795833 - RNA, 22 nt, Homo sapiens
gcuuuugcccacacacuuucca

SEQ ID NO: 795834 - RNA, 17 nt, Homo sapiens
gcuuuugcuugcaaugu

SEQ ID NO: 795835 - RNA, 14 nt, Homo sapiens
gcuuuuguuuucau

SEQ ID NO: 795836 - RNA, 20 nt, Homo sapiens
gcuuuuucacagucacugau

SEQ ID NO: 795837 - RNA, 15 nt, Homo sapiens
gcuuuuugcuucuug

SEQ ID NO: 795838 - RNA, 18 nt, Homo sapiens
gcuuuuuguucagaauua

SEQ ID NO: 795839 - RNA, 20 nt, Homo sapiens
ggaaaaaaguuuugaugaaa

SEQ ID NO: 795840 - RNA, 21 nt, Homo sapiens
ggaaaaacaacaucauuccaa

SEQ ID NO: 795841 - RNA, 17 nt, Homo sapiens
ggaaaaauaauucuauu

SEQ ID NO: 795842 - RNA, 15 nt, Homo sapiens
ggaaaacaggacuua

SEQ ID NO: 795843 - RNA, 15 nt, Homo sapiens
ggaaaagcagcucaa

SEQ ID NO: 795844 - RNA, 21 nt, Homo sapiens
ggaaaaggaaaaaaagcaaaa

SEQ ID NO: 795845 - RNA, 22 nt, Homo sapiens
ggaaaagguagcuuaccugaca

SEQ ID NO: 795846 - RNA, 13 nt, Homo sapiens
ggaaaagguuguu

SEQ ID NO: 795847 - RNA, 14 nt, Homo sapiens
ggaaaaguucuccu

SEQ ID NO: 795848 - RNA, 12 nt, Homo sapiens
ggaaaauggagc

SEQ ID NO: 795849 - RNA, 22 nt, Homo sapiens
ggaaaauuuuaaaaauacagau

SEQ ID NO: 795850 - RNA, 18 nt, Homo sapiens
ggaaacagcaugaauaaa

SEQ ID NO: 795851 - RNA, 14 nt, Homo sapiens
ggaaacccccagug

SEQ ID NO: 795852 - RNA, 20 nt, Homo sapiens
ggaaacugaaacucacagua

SEQ ID NO: 795853 - RNA, 22 nt, Homo sapiens
ggaaacugcucccaucauuccu

SEQ ID NO: 795854 - RNA, 17 nt, Homo sapiens
ggaaagaaaaagcaaua

SEQ ID NO: 795855 - RNA, 17 nt, Homo sapiens
ggaaagaaguugcuaag

SEQ ID NO: 795856 - RNA, 16 nt, Homo sapiens
ggaaagauuugugaac

SEQ ID NO: 795857 - RNA, 16 nt, Homo sapiens
ggaaagcauaugcagc

SEQ ID NO: 795858 - RNA, 21 nt, Homo sapiens
guacaaaauacguuuuguaaa

SEQ ID NO: 795859 - RNA, 15 nt, Homo sapiens
guacaaaaucuugca

SEQ ID NO: 795860 - RNA, 21 nt, Homo sapiens
guacaaauaaaccugaggcag

SEQ ID NO: 795861 - RNA, 15 nt, Homo sapiens
guacaacuuaacuca

SEQ ID NO: 795862 - RNA, 16 nt, Homo sapiens
guacaagagaugggau

SEQ ID NO: 795863 - RNA, 19 nt, Homo sapiens
guacaaugguuuauuccca

SEQ ID NO: 795864 - RNA, 12 nt, Homo sapiens
guacacaacaau

SEQ ID NO: 795865 - RNA, 23 nt, Homo sapiens
guacacauuccugcauucaugua

SEQ ID NO: 795866 - RNA, 17 nt, Homo sapiens
guacacccaguugccaa

SEQ ID NO: 795867 - RNA, 13 nt, Homo sapiens
guacagacacucc

SEQ ID NO: 795868 - RNA, 14 nt, Homo sapiens
guacagagcacauu

SEQ ID NO: 795869 - RNA, 11 nt, Homo sapiens
guacagauuag

SEQ ID NO: 795870 - RNA, 16 nt, Homo sapiens
guacaggaaugaaccu

SEQ ID NO: 795871 - RNA, 16 nt, Homo sapiens
guacaggcaacaauga

SEQ ID NO: 795872 - RNA, 21 nt, Homo sapiens
guacaguauguuuuacaugua

SEQ ID NO: 795873 - RNA, 23 nt, Homo sapiens
guacaguucugggguacauguua

SEQ ID NO: 795874 - RNA, 15 nt, Homo sapiens
guacauacgauuuaa

SEQ ID NO: 795875 - RNA, 12 nt, Homo sapiens
guacaucuggcc

SEQ ID NO: 795876 - RNA, 21 nt, Homo sapiens
guacauggaauaacauguaau

SEQ ID NO: 795877 - RNA, 22 nt, Homo sapiens
guacauggaauaacauguaauu

SEQ ID NO: 795878 - RNA, 18 nt, Homo sapiens
guacauguaacauuaaag

SEQ ID NO: 795879 - RNA, 14 nt, Homo sapiens
guacauguauuaaa

SEQ ID NO: 795880 - RNA, 14 nt, Homo sapiens
guacaugugcacau

SEQ ID NO: 795881 - RNA, 17 nt, Homo sapiens
guacauuuaucacugaa

SEQ ID NO: 795882 - RNA, 17 nt, Homo sapiens
guaccacacauauugca

SEQ ID NO: 795883 - RNA, 17 nt, Homo sapiens
guaccacguggguccuc

SEQ ID NO: 795884 - RNA, 16 nt, Homo sapiens
aauuguuuugagcuuu

SEQ ID NO: 795885 - RNA, 20 nt, Homo sapiens
aauuguuuuuuaaagcaagu

SEQ ID NO: 795886 - RNA, 18 nt, Homo sapiens
aauuuaaaaggugucaac

SEQ ID NO: 795887 - RNA, 19 nt, Homo sapiens
aauuuaaagggaaaacccu

SEQ ID NO: 795888 - RNA, 19 nt, Homo sapiens
aauuuaaaggguguacuua

SEQ ID NO: 795889 - RNA, 17 nt, Homo sapiens
aauuuaaguacuugaga

SEQ ID NO: 795890 - RNA, 13 nt, Homo sapiens
aauuuaauaccag

SEQ ID NO: 795891 - RNA, 15 nt, Homo sapiens
aauuuacacugccau

SEQ ID NO: 795892 - RNA, 18 nt, Homo sapiens
aauuuagaccccauacaa

SEQ ID NO: 795893 - RNA, 19 nt, Homo sapiens
aauuuaggaaaugucuuga

SEQ ID NO: 795894 - RNA, 18 nt, Homo sapiens
aauuuaggaccaauaccu

SEQ ID NO: 795895 - RNA, 21 nt, Homo sapiens
aauuuaggaccaauaccuccu

SEQ ID NO: 795896 - RNA, 18 nt, Homo sapiens
aauuuaucuuuaccaaaa

SEQ ID NO: 795897 - RNA, 22 nt, Homo sapiens
aauuuaucuuuaccaaaaacca

SEQ ID NO: 795898 - RNA, 14 nt, Homo sapiens
aauuuaucuuucaa

SEQ ID NO: 795899 - RNA, 11 nt, Homo sapiens
aauuuaugcaa

SEQ ID NO: 795900 - RNA, 12 nt, Homo sapiens
aauuuauuacaa

SEQ ID NO: 795901 - RNA, 16 nt, Homo sapiens
aauuuauuacugaaaa

SEQ ID NO: 795902 - RNA, 20 nt, Homo sapiens
aauuuauuucaaaaagggaa

SEQ ID NO: 795903 - RNA, 15 nt, Homo sapiens
aauuucaaaccacac

SEQ ID NO: 795904 - RNA, 16 nt, Homo sapiens
aauuucacaagcuauu

SEQ ID NO: 795905 - RNA, 20 nt, Homo sapiens
aauuucaguaaacaaugaau

SEQ ID NO: 795906 - RNA, 16 nt, Homo sapiens
aauuucauaccuauca

SEQ ID NO: 795907 - RNA, 14 nt, Homo sapiens
aauuucauguguau

SEQ ID NO: 795908 - RNA, 15 nt, Homo sapiens
aauuuccucugacau

SEQ ID NO: 795909 - RNA, 14 nt, Homo sapiens
aauuuccugauaca

SEQ ID NO: 795910 - RNA, 21 nt, Homo sapiens
aauuuccuuuuugacacugaa

SEQ ID NO: 795911 - RNA, 14 nt, Homo sapiens
aauuucgccuuaaa

SEQ ID NO: 795912 - RNA, 20 nt, Homo sapiens
aauuucuaccuuuacuacau

SEQ ID NO: 795913 - RNA, 15 nt, Homo sapiens
aauuucucccaguca

SEQ ID NO: 795914 - RNA, 13 nt, Homo sapiens
aauuucugucaaa

SEQ ID NO: 795915 - RNA, 15 nt, Homo sapiens
aauuucuuacuaaac

SEQ ID NO: 795916 - RNA, 17 nt, Homo sapiens
aauuucuuaugugacau

SEQ ID NO: 795917 - RNA, 14 nt, Homo sapiens
aauuucuuugucau

SEQ ID NO: 795918 - RNA, 16 nt, Homo sapiens
aauuugaauacugcau

SEQ ID NO: 795919 - RNA, 14 nt, Homo sapiens
aauuugauacauaa

SEQ ID NO: 795920 - RNA, 13 nt, Homo sapiens
aauuugauuugaa

SEQ ID NO: 795921 - RNA, 21 nt, Homo sapiens
aauuugcaaagaaaaguuuca

SEQ ID NO: 795922 - RNA, 18 nt, Homo sapiens
aauuugcauugugucaga

SEQ ID NO: 795923 - RNA, 23 nt, Homo sapiens
aauuugcuaaauacaacacugau

SEQ ID NO: 795924 - RNA, 17 nt, Homo sapiens
aauuuggaaaggaccaa

SEQ ID NO: 795925 - RNA, 21 nt, Homo sapiens
aauuuggagcacaaaauucaa

SEQ ID NO: 795926 - RNA, 21 nt, Homo sapiens
aauuuggccagacacaggugc

SEQ ID NO: 795927 - RNA, 18 nt, Homo sapiens
aauuuggccugcacuaau

SEQ ID NO: 795928 - RNA, 20 nt, Homo sapiens
aauuuggccuuaagaacugu

SEQ ID NO: 795929 - RNA, 22 nt, Homo sapiens
aauuuggguugacuccugagca

SEQ ID NO: 795930 - RNA, 15 nt, Homo sapiens
aauuuguacuucuua

SEQ ID NO: 795931 - RNA, 18 nt, Homo sapiens
aauuugugccacuuuaau

SEQ ID NO: 795932 - RNA, 22 nt, Homo sapiens
aauuuguguguuuuuagcugug

SEQ ID NO: 795933 - RNA, 17 nt, Homo sapiens
aauuuuaaaaaagggag

SEQ ID NO: 795934 - RNA, 19 nt, Homo sapiens
aauuuuaaauuauaacuua

SEQ ID NO: 795935 - RNA, 16 nt, Homo sapiens
aauuuuauuaaaugca

SEQ ID NO: 795936 - RNA, 14 nt, Homo sapiens
aauuuuauugcaaa

SEQ ID NO: 795937 - RNA, 13 nt, Homo sapiens
aauuuucauucau

SEQ ID NO: 795938 - RNA, 18 nt, Homo sapiens
aauuuucauucauucacu

SEQ ID NO: 795939 - RNA, 22 nt, Homo sapiens
aauuuuccaagaacauaguuua

SEQ ID NO: 795940 - RNA, 20 nt, Homo sapiens
aauuuucuguggaucauuuc

SEQ ID NO: 795941 - RNA, 24 nt, Homo sapiens
aauuuucuucaugcaaugacaucu

SEQ ID NO: 795942 - RNA, 12 nt, Homo sapiens
aauuuugcugga

SEQ ID NO: 795943 - RNA, 23 nt, Homo sapiens
aauuuuguguguaccugugacua

SEQ ID NO: 795944 - RNA, 20 nt, Homo sapiens
aauuuuguucucugggagaa

SEQ ID NO: 795945 - RNA, 20 nt, Homo sapiens
aauuuuguuuaaaacucaga

SEQ ID NO: 795946 - RNA, 14 nt, Homo sapiens
aauuuuuacauuca

SEQ ID NO: 795947 - RNA, 19 nt, Homo sapiens
aauuuuuaccuaaucucca

SEQ ID NO: 795948 - RNA, 12 nt, Homo sapiens
aauuuuucuucc

SEQ ID NO: 795949 - RNA, 21 nt, Homo sapiens
aauuuuuuaaaguuacuuugu

SEQ ID NO: 795950 - RNA, 21 nt, Homo sapiens
aauuuuuuaguauaaguacau

SEQ ID NO: 795951 - RNA, 20 nt, Homo sapiens
acaaaaaaaccucuaugcaa

SEQ ID NO: 795952 - RNA, 18 nt, Homo sapiens
acaaaaaacaacaaauaa

SEQ ID NO: 795953 - RNA, 19 nt, Homo sapiens
acaaaaaacuaucaacuac

SEQ ID NO: 795954 - RNA, 13 nt, Homo sapiens
acaaaaacagaau

SEQ ID NO: 795955 - RNA, 22 nt, Homo sapiens
acaaaaacagguauauacuuug

SEQ ID NO: 795956 - RNA, 13 nt, Homo sapiens
acaaaaauugaga

SEQ ID NO: 795957 - RNA, 12 nt, Homo sapiens
acaaaacaaaca

SEQ ID NO: 795958 - RNA, 16 nt, Homo sapiens
acaaaacaaucucuca

SEQ ID NO: 795959 - RNA, 16 nt, Homo sapiens
acaaaacaccaaagaa

SEQ ID NO: 795960 - RNA, 14 nt, Homo sapiens
acaaaacaguuuga

SEQ ID NO: 795961 - RNA, 15 nt, Homo sapiens
acaaaaccacuggga

SEQ ID NO: 795962 - RNA, 21 nt, Homo sapiens
acaaaacccucagcacuguua

SEQ ID NO: 795963 - RNA, 21 nt, Homo sapiens
acaaaacgaaaugcuaugacu

SEQ ID NO: 795964 - RNA, 15 nt, Homo sapiens
acaaaagauguaucc

SEQ ID NO: 795965 - RNA, 18 nt, Homo sapiens
acaaaauauuuaagugaa

SEQ ID NO: 795966 - RNA, 12 nt, Homo sapiens
acaaaaugguca

SEQ ID NO: 795967 - RNA, 21 nt, Homo sapiens
acaaaauggucauccaaacuc

SEQ ID NO: 795968 - RNA, 17 nt, Homo sapiens
acaaaauucaaagcaug

SEQ ID NO: 795969 - RNA, 21 nt, Homo sapiens
acaaaauuuuauuuugugcuc

SEQ ID NO: 795970 - RNA, 15 nt, Homo sapiens
acaaacaaacagaaa

SEQ ID NO: 795971 - RNA, 23 nt, Homo sapiens
acaaacaagaggacuguguugug

SEQ ID NO: 795972 - RNA, 21 nt, Homo sapiens
acaaacacugccauauugugu

SEQ ID NO: 795973 - RNA, 17 nt, Homo sapiens
gucagcugcagccacuu

SEQ ID NO: 795974 - RNA, 22 nt, Homo sapiens
gucagcuguaacccucacccac

SEQ ID NO: 795975 - RNA, 14 nt, Homo sapiens
gucaggaacagaag

SEQ ID NO: 795976 - RNA, 15 nt, Homo sapiens
gucaggcugcagagg

SEQ ID NO: 795977 - RNA, 21 nt, Homo sapiens
gucagggagaggucaccagcu

SEQ ID NO: 795978 - RNA, 14 nt, Homo sapiens
gucaguacuauuca

SEQ ID NO: 795979 - RNA, 15 nt, Homo sapiens
gucaguauguggaag

SEQ ID NO: 795980 - RNA, 16 nt, Homo sapiens
gucagucaugauggca

SEQ ID NO: 795981 - RNA, 19 nt, Homo sapiens
gucagugcccaacuguuau

SEQ ID NO: 795982 - RNA, 18 nt, Homo sapiens
gucagugguggucuucaa

SEQ ID NO: 795983 - RNA, 18 nt, Homo sapiens
gucaguuuuaggguugcc

SEQ ID NO: 795984 - RNA, 22 nt, Homo sapiens
gucauagcaagcuuuugcucaa

SEQ ID NO: 795985 - RNA, 13 nt, Homo sapiens
gucauagcauuca

SEQ ID NO: 795986 - RNA, 20 nt, Homo sapiens
gucauauauuaaacauccac

SEQ ID NO: 795987 - RNA, 18 nt, Homo sapiens
gucauauuaauauauuuc

SEQ ID NO: 795988 - RNA, 16 nt, Homo sapiens
gucaucaaagcagaag

SEQ ID NO: 795989 - RNA, 19 nt, Homo sapiens
gucaucaaccgaugguccu

SEQ ID NO: 795990 - RNA, 22 nt, Homo sapiens
gucaucaaccgaugguccucac

SEQ ID NO: 795991 - RNA, 14 nt, Homo sapiens
gucaucacuuugac

SEQ ID NO: 795992 - RNA, 17 nt, Homo sapiens
gucaucaggugcauagc

SEQ ID NO: 795993 - RNA, 14 nt, Homo sapiens
gucaucaucacauu

SEQ ID NO: 795994 - RNA, 22 nt, Homo sapiens
gucaucaugaacuggcuuguac

SEQ ID NO: 795995 - RNA, 15 nt, Homo sapiens
gucauccugccaacu

SEQ ID NO: 795996 - RNA, 16 nt, Homo sapiens
gucaucuucaauuuau

SEQ ID NO: 795997 - RNA, 15 nt, Homo sapiens
gucaucuuuuuccac

SEQ ID NO: 795998 - RNA, 23 nt, Homo sapiens
gucaugauggcaccacugcacuc

SEQ ID NO: 795999 - RNA, 16 nt, Homo sapiens
gucauggccugagaug

SEQ ID NO: 796000 - RNA, 15 nt, Homo sapiens
acacagcgagacucc

SEQ ID NO: 796001 - RNA, 21 nt, Homo sapiens
acacagcgcgguuuuuuccac

SEQ ID NO: 796002 - RNA, 11 nt, Homo sapiens
acacagcugcc

SEQ ID NO: 796003 - RNA, 13 nt, Homo sapiens
acacagcuguucu

SEQ ID NO: 796004 - RNA, 18 nt, Homo sapiens
acacaggcaaaauccuug

SEQ ID NO: 796005 - RNA, 17 nt, Homo sapiens
acacagggcccggccac

SEQ ID NO: 796006 - RNA, 15 nt, Homo sapiens
acacagggcucuuug

SEQ ID NO: 796007 - RNA, 19 nt, Homo sapiens
acacaguccagacucaaac

SEQ ID NO: 796008 - RNA, 13 nt, Homo sapiens
acacagugaugaa

SEQ ID NO: 796009 - RNA, 19 nt, Homo sapiens
acacaguuguaggguuaca

SEQ ID NO: 796010 - RNA, 16 nt, Homo sapiens
acacauaaaucugucu

SEQ ID NO: 796011 - RNA, 13 nt, Homo sapiens
acacauaccuuca

SEQ ID NO: 796012 - RNA, 14 nt, Homo sapiens
acacauaccuucau

SEQ ID NO: 796013 - RNA, 15 nt, Homo sapiens
acacauagauaccuu

SEQ ID NO: 796014 - RNA, 18 nt, Homo sapiens
acacauaguggcuucucc

SEQ ID NO: 796015 - RNA, 13 nt, Homo sapiens
acacauauugcac

SEQ ID NO: 796016 - RNA, 21 nt, Homo sapiens
acacaucccggccucuuccac

SEQ ID NO: 796017 - RNA, 15 nt, Homo sapiens
acacaucuauugcag

SEQ ID NO: 796018 - RNA, 20 nt, Homo sapiens
acacaugcuauguucugucu

SEQ ID NO: 796019 - RNA, 24 nt, Homo sapiens
acacauggugugaguccaaagaag

SEQ ID NO: 796020 - RNA, 13 nt, Homo sapiens
acacaugugcaca

SEQ ID NO: 796021 - RNA, 15 nt, Homo sapiens
acacaugugcaguca

SEQ ID NO: 796022 - RNA, 16 nt, Homo sapiens
acacaugugcagucac

SEQ ID NO: 796023 - RNA, 18 nt, Homo sapiens
acacauucuuauugacaa

SEQ ID NO: 796024 - RNA, 20 nt, Homo sapiens
acacauugcauuuugauaaa

SEQ ID NO: 796025 - RNA, 20 nt, Homo sapiens
acacauuugguuucugaaua

SEQ ID NO: 796026 - RNA, 21 nt, Homo sapiens
acacauuuuuauaaaaaugag

SEQ ID NO: 796027 - RNA, 21 nt, Homo sapiens
acaccaaaaaauaucuaguaa

SEQ ID NO: 796028 - RNA, 20 nt, Homo sapiens
acaccacuaaccauccccaa

SEQ ID NO: 796029 - RNA, 19 nt, Homo sapiens
acaccauucuccugccuca

SEQ ID NO: 796030 - RNA, 15 nt, Homo sapiens
acacccacagaagga

SEQ ID NO: 796031 - RNA, 19 nt, Homo sapiens
acacccaguguccuuccau

SEQ ID NO: 796032 - RNA, 22 nt, Homo sapiens
acacccccaccuccugcaauaa

SEQ ID NO: 796033 - RNA, 17 nt, Homo sapiens
acacccgacuccucaaa

SEQ ID NO: 796034 - RNA, 16 nt, Homo sapiens
acaccgucccucagug

SEQ ID NO: 796035 - RNA, 17 nt, Homo sapiens
acaccuaaguguuagaa

SEQ ID NO: 796036 - RNA, 15 nt, Homo sapiens
acaccuacucuauca

SEQ ID NO: 796037 - RNA, 15 nt, Homo sapiens
acaccuagcuuuauu

SEQ ID NO: 796038 - RNA, 16 nt, Homo sapiens
acaccucaguucccuu

SEQ ID NO: 796039 - RNA, 21 nt, Homo sapiens
acaccugagcgcuguggacug

SEQ ID NO: 796040 - RNA, 15 nt, Homo sapiens
acaccuguaguccca

SEQ ID NO: 796041 - RNA, 18 nt, Homo sapiens
acaccuguagucccagcu

SEQ ID NO: 796042 - RNA, 22 nt, Homo sapiens
acacgaagccagcagaggucag

SEQ ID NO: 796043 - RNA, 13 nt, Homo sapiens
acacgacuuguaa

SEQ ID NO: 796044 - RNA, 14 nt, Homo sapiens
acacgaguuccaga

SEQ ID NO: 796045 - RNA, 16 nt, Homo sapiens
acacgaugcauuuaau

SEQ ID NO: 796046 - RNA, 22 nt, Homo sapiens
acacgcccuccccagacuccac

SEQ ID NO: 796047 - RNA, 14 nt, Homo sapiens
acacggaggcaucc

SEQ ID NO: 796048 - RNA, 14 nt, Homo sapiens
acacggaggcaucu

SEQ ID NO: 796049 - RNA, 15 nt, Homo sapiens
acacggggcaguggc

SEQ ID NO: 796050 - RNA, 16 nt, Homo sapiens
acacguaaguauaaau

SEQ ID NO: 796051 - RNA, 17 nt, Homo sapiens
acacguaccucucauca

SEQ ID NO: 796052 - RNA, 15 nt, Homo sapiens
acacguguccuguag

SEQ ID NO: 796053 - RNA, 22 nt, Homo sapiens
acacguguggcgggcaguggga

SEQ ID NO: 796054 - RNA, 15 nt, Homo sapiens
acacuaaaaggugac

SEQ ID NO: 796055 - RNA, 14 nt, Homo sapiens
acacuaacuaugca

SEQ ID NO: 796056 - RNA, 15 nt, Homo sapiens
acacuaacucaccag

SEQ ID NO: 796057 - RNA, 17 nt, Homo sapiens
acacuagccugugcacg

SEQ ID NO: 796058 - RNA, 18 nt, Homo sapiens
acacucagaaggcuucau

SEQ ID NO: 796059 - RNA, 19 nt, Homo sapiens
acacucaucuuagugccug

SEQ ID NO: 796060 - RNA, 13 nt, Homo sapiens
acacucaugaagc

SEQ ID NO: 796061 - RNA, 10 nt, Homo sapiens
acacuccacu

SEQ ID NO: 796062 - RNA, 17 nt, Homo sapiens
acacucccacuuggcau

SEQ ID NO: 796063 - RNA, 15 nt, Homo sapiens
acacugaaaauguca

SEQ ID NO: 796064 - RNA, 14 nt, Homo sapiens
acacugaaaggaaa

SEQ ID NO: 796065 - RNA, 17 nt, Homo sapiens
acacugaaguuaacaga

SEQ ID NO: 796066 - RNA, 20 nt, Homo sapiens
acacugaaucucaccugcug

SEQ ID NO: 796067 - RNA, 14 nt, Homo sapiens
acacugaggacugu

SEQ ID NO: 796068 - RNA, 18 nt, Homo sapiens
acacugauacacuugaag

SEQ ID NO: 796069 - RNA, 22 nt, Homo sapiens
acacugaucugcuagugcugua

SEQ ID NO: 796070 - RNA, 14 nt, Homo sapiens
acacugaucuggcu

SEQ ID NO: 796071 - RNA, 21 nt, Homo sapiens
acacugcaaauaaacuuggua

SEQ ID NO: 796072 - RNA, 13 nt, Homo sapiens
acacugcaguuuc

SEQ ID NO: 796073 - RNA, 17 nt, Homo sapiens
acacugcggaagccaaa

SEQ ID NO: 796074 - RNA, 16 nt, Homo sapiens
acacuggagccaucuc

SEQ ID NO: 796075 - RNA, 23 nt, Homo sapiens
acacugggccuggagcccugggc

SEQ ID NO: 796076 - RNA, 12 nt, Homo sapiens
acacuguacaag

SEQ ID NO: 796077 - RNA, 12 nt, Homo sapiens
acacugugacuu

SEQ ID NO: 796078 - RNA, 14 nt, Homo sapiens
acacugugacuuaa

SEQ ID NO: 796079 - RNA, 22 nt, Homo sapiens
acacuguucugaaagugacuca

SEQ ID NO: 796080 - RNA, 16 nt, Homo sapiens
acacuuacagaauuau

SEQ ID NO: 796081 - RNA, 14 nt, Homo sapiens
acacuuaguaugca

SEQ ID NO: 796082 - RNA, 18 nt, Homo sapiens
acacuuauguuauacaau

SEQ ID NO: 796083 - RNA, 14 nt, Homo sapiens
acacuucuauuuaa

SEQ ID NO: 796084 - RNA, 22 nt, Homo sapiens
acacuugcugucaauguuuuga

SEQ ID NO: 796085 - RNA, 16 nt, Homo sapiens
acacuuggcauacaaa

SEQ ID NO: 796086 - RNA, 15 nt, Homo sapiens
acacuuguauuugga

SEQ ID NO: 796087 - RNA, 16 nt, Homo sapiens
acagaaaaguccacau

SEQ ID NO: 796088 - RNA, 19 nt, Homo sapiens
acucugaccacagcccgcu

SEQ ID NO: 796089 - RNA, 14 nt, Homo sapiens
acucugcacaugaa

SEQ ID NO: 796090 - RNA, 14 nt, Homo sapiens
acucugcacauguc

SEQ ID NO: 796091 - RNA, 18 nt, Homo sapiens
acucugcacaugucuugu

SEQ ID NO: 796092 - RNA, 19 nt, Homo sapiens
acucugcagugauuagaag

SEQ ID NO: 796093 - RNA, 20 nt, Homo sapiens
acucugccuuuaugaugcua

SEQ ID NO: 796094 - RNA, 22 nt, Homo sapiens
acucugcuugauuuuugccucu

SEQ ID NO: 796095 - RNA, 20 nt, Homo sapiens
acucugggaauacaggggug

SEQ ID NO: 796096 - RNA, 22 nt, Homo sapiens
acucugggcagggacccggggu

SEQ ID NO: 796097 - RNA, 23 nt, Homo sapiens
acucugggcuguaacguggcacu

SEQ ID NO: 796098 - RNA, 18 nt, Homo sapiens
acucugguaaaugaucac

SEQ ID NO: 796099 - RNA, 14 nt, Homo sapiens
acucugguggcaca

SEQ ID NO: 796100 - RNA, 22 nt, Homo sapiens
acucuguaguuacuguggucac

SEQ ID NO: 796101 - RNA, 21 nt, Homo sapiens
acucuguccacgauucacuca

SEQ ID NO: 796102 - RNA, 23 nt, Homo sapiens
acucuguccuucgcccugugcac

SEQ ID NO: 796103 - RNA, 15 nt, Homo sapiens
acucugucuaccugg

SEQ ID NO: 796104 - RNA, 16 nt, Homo sapiens
acucuuacagagccuu

SEQ ID NO: 796105 - RNA, 16 nt, Homo sapiens
acucuuaucuacauaa

SEQ ID NO: 796106 - RNA, 15 nt, Homo sapiens
acucuuaugaucaau

SEQ ID NO: 796107 - RNA, 15 nt, Homo sapiens
acucuucagaggaau

SEQ ID NO: 796108 - RNA, 18 nt, Homo sapiens
acucuuccaccucccaac

SEQ ID NO: 796109 - RNA, 21 nt, Homo sapiens
acucuuccuuccuaauaggca

SEQ ID NO: 796110 - RNA, 14 nt, Homo sapiens
acucuucuaaaaau

SEQ ID NO: 796111 - RNA, 14 nt, Homo sapiens
acucuugccuguuu

SEQ ID NO: 796112 - RNA, 20 nt, Homo sapiens
acucuugugaauuauucuga

SEQ ID NO: 796113 - RNA, 21 nt, Homo sapiens
acucuuucugaggagcuguua

SEQ ID NO: 796114 - RNA, 23 nt, Homo sapiens
acucuuucugaggagcuguuacu

SEQ ID NO: 796115 - RNA, 21 nt, Homo sapiens
acucuuuuuuaugccuauucu

SEQ ID NO: 796116 - RNA, 19 nt, Homo sapiens
acugaaaaaaacauaucca

SEQ ID NO: 796117 - RNA, 21 nt, Homo sapiens
acugaaaaaaacauauccaaa

SEQ ID NO: 796118 - RNA, 23 nt, Homo sapiens
acugaaaaaugguaauuguugcu

SEQ ID NO: 796119 - RNA, 13 nt, Homo sapiens
acugaaacauuca

SEQ ID NO: 796120 - RNA, 23 nt, Homo sapiens
uaaaugucauuucacuacuggug

SEQ ID NO: 796121 - RNA, 15 nt, Homo sapiens
uaaauguuaccucua

SEQ ID NO: 796122 - RNA, 22 nt, Homo sapiens
uaaauguuuaacaucauugcau

SEQ ID NO: 796123 - RNA, 17 nt, Homo sapiens
uaaauguuuuacucaga

SEQ ID NO: 796124 - RNA, 15 nt, Homo sapiens
uaaauuaaagagaaa

SEQ ID NO: 796125 - RNA, 22 nt, Homo sapiens
uaaauuacuguuuugccaagaa

SEQ ID NO: 796126 - RNA, 17 nt, Homo sapiens
uaaauuauuaguuuaca

SEQ ID NO: 796127 - RNA, 17 nt, Homo sapiens
uaaauuauuauuugaca

SEQ ID NO: 796128 - RNA, 21 nt, Homo sapiens
uaaauucacagcgcuaugcaa

SEQ ID NO: 796129 - RNA, 19 nt, Homo sapiens
uaaauucacaucucaagga

SEQ ID NO: 796130 - RNA, 20 nt, Homo sapiens
uaaauucuauaggaacauau

SEQ ID NO: 796131 - RNA, 15 nt, Homo sapiens
uaaauugauguugcu

SEQ ID NO: 796132 - RNA, 16 nt, Homo sapiens
uaaauugcaucacugu

SEQ ID NO: 796133 - RNA, 14 nt, Homo sapiens
uaaauuguguuucc

SEQ ID NO: 796134 - RNA, 15 nt, Homo sapiens
uaaauuuaugugaug

SEQ ID NO: 796135 - RNA, 16 nt, Homo sapiens
uaaauuuaugugaugg

SEQ ID NO: 796136 - RNA, 15 nt, Homo sapiens
uaaauuucccaguua

SEQ ID NO: 796137 - RNA, 14 nt, Homo sapiens
uaaauuugauuucc

SEQ ID NO: 796138 - RNA, 14 nt, Homo sapiens
uaaauuugcuagca

SEQ ID NO: 796139 - RNA, 19 nt, Homo sapiens
uaaauuuguaacuuugcag

SEQ ID NO: 796140 - RNA, 17 nt, Homo sapiens
uaaauuuuacccuuuag

SEQ ID NO: 796141 - RNA, 17 nt, Homo sapiens
uaacaaagaacaagcau

SEQ ID NO: 796142 - RNA, 18 nt, Homo sapiens
uaacaaauaaagugcagu

SEQ ID NO: 796143 - RNA, 21 nt, Homo sapiens
uaacaacugcccaguuuccag

SEQ ID NO: 796144 - RNA, 23 nt, Homo sapiens
uaacaagaccucagugccuuccu

SEQ ID NO: 796145 - RNA, 15 nt, Homo sapiens
uaacaagccaaacau

SEQ ID NO: 796146 - RNA, 21 nt, Homo sapiens
uaacaaggugucuuuuccacu

SEQ ID NO: 796147 - RNA, 14 nt, Homo sapiens
uaacacacuggcca

SEQ ID NO: 796148 - RNA, 20 nt, Homo sapiens
uaacaccgucccagggcucu

SEQ ID NO: 796149 - RNA, 15 nt, Homo sapiens
uaacacucaugaagc

SEQ ID NO: 796150 - RNA, 12 nt, Homo sapiens
uaacacuuguca

SEQ ID NO: 796151 - RNA, 16 nt, Homo sapiens
uaacagaaauuguaua

SEQ ID NO: 796152 - RNA, 15 nt, Homo sapiens
uaacagaacagucac

SEQ ID NO: 796153 - RNA, 15 nt, Homo sapiens
uaacagaauacauag

SEQ ID NO: 796154 - RNA, 23 nt, Homo sapiens
uaacagaccacuguauguuuacu

SEQ ID NO: 796155 - RNA, 10 nt, Homo sapiens
uaacagagag

SEQ ID NO: 796156 - RNA, 20 nt, Homo sapiens
uaacagaugcaaugugcuac

SEQ ID NO: 796157 - RNA, 19 nt, Homo sapiens
uaacaguucacuuuuuaca

SEQ ID NO: 796158 - RNA, 18 nt, Homo sapiens
uaacaguugugaugacua

SEQ ID NO: 796159 - RNA, 19 nt, Homo sapiens
uaacauggacugcuucauc

SEQ ID NO: 796160 - RNA, 20 nt, Homo sapiens
uaacaugucuuucagcauua

SEQ ID NO: 796161 - RNA, 23 nt, Homo sapiens
uaacauuaaugccugcuuuuugg

SEQ ID NO: 796162 - RNA, 19 nt, Homo sapiens
uaacauuagcuaaaacugc

SEQ ID NO: 796163 - RNA, 15 nt, Homo sapiens
uaacauucccacugc

SEQ ID NO: 796164 - RNA, 17 nt, Homo sapiens
uaacauucccacugcca

SEQ ID NO: 796165 - RNA, 16 nt, Homo sapiens
uaacauuucuguucuc

SEQ ID NO: 796166 - RNA, 23 nt, Homo sapiens
uaacauuuguguaauaugaaaua

SEQ ID NO: 796167 - RNA, 19 nt, Homo sapiens
uaaccaaagucacaaauca

SEQ ID NO: 796168 - RNA, 23 nt, Homo sapiens
uaaccaaugccuuuuuagaugua

SEQ ID NO: 796169 - RNA, 19 nt, Homo sapiens
uaaccacaaagcacaguuu

SEQ ID NO: 796170 - RNA, 22 nt, Homo sapiens
uaaccaucacugguugcacuua

SEQ ID NO: 796171 - RNA, 15 nt, Homo sapiens
uaaccauucaaauga

SEQ ID NO: 796172 - RNA, 15 nt, Homo sapiens
uaacccaaaucuugu

SEQ ID NO: 796173 - RNA, 19 nt, Homo sapiens
uaacccaagacaugacauu

SEQ ID NO: 796174 - RNA, 21 nt, Homo sapiens
uaacccaagacaugacauucu

SEQ ID NO: 796175 - RNA, 18 nt, Homo sapiens
uaacccaaugccugugaa

SEQ ID NO: 796176 - RNA, 15 nt, Homo sapiens
uaacccucacccaca

SEQ ID NO: 796177 - RNA, 12 nt, Homo sapiens
uaacccuuuuuc

SEQ ID NO: 796178 - RNA, 16 nt, Homo sapiens
uaaccuagaaguauuu

SEQ ID NO: 796179 - RNA, 17 nt, Homo sapiens
uaaccucucugugccau

SEQ ID NO: 796180 - RNA, 18 nt, Homo sapiens
uaaccugggcauuguuga

SEQ ID NO: 796181 - RNA, 19 nt, Homo sapiens
uaacggcagugucauuccc

SEQ ID NO: 796182 - RNA, 16 nt, Homo sapiens
uaacgucaucucaggg

SEQ ID NO: 796183 - RNA, 14 nt, Homo sapiens
uaacguggcacugg

SEQ ID NO: 796184 - RNA, 17 nt, Homo sapiens
uaacuaauaaugcugga

SEQ ID NO: 796185 - RNA, 17 nt, Homo sapiens
uaacuaauacuacugug

SEQ ID NO: 796186 - RNA, 15 nt, Homo sapiens
uaacuaaucaagaaa

SEQ ID NO: 796187 - RNA, 16 nt, Homo sapiens
uaacuagaaagugagu

SEQ ID NO: 796188 - RNA, 19 nt, Homo sapiens
uaacuagaaaucugccaau

SEQ ID NO: 796189 - RNA, 12 nt, Homo sapiens
uaacuagaauuu

SEQ ID NO: 796190 - RNA, 18 nt, Homo sapiens
uaacuagaggagaauuua

SEQ ID NO: 796191 - RNA, 14 nt, Homo sapiens
uaacuauauuugcu

SEQ ID NO: 796192 - RNA, 18 nt, Homo sapiens
uaacuaugagccaggcau

SEQ ID NO: 796193 - RNA, 12 nt, Homo sapiens
uaacuaugcuuu

SEQ ID NO: 796194 - RNA, 17 nt, Homo sapiens
uaacucaaaccaugcaa

SEQ ID NO: 796195 - RNA, 17 nt, Homo sapiens
uaacucaccagauuuac

SEQ ID NO: 796196 - RNA, 14 nt, Homo sapiens
uaacucaucugcug

SEQ ID NO: 796197 - RNA, 15 nt, Homo sapiens
uaacucccuccacca

SEQ ID NO: 796198 - RNA, 19 nt, Homo sapiens
uaacuccuagcugacucag

SEQ ID NO: 796199 - RNA, 20 nt, Homo sapiens
uaacuccuuuuccacuuuaa

SEQ ID NO: 796200 - RNA, 15 nt, Homo sapiens
uaacucggauuccag

SEQ ID NO: 796201 - RNA, 17 nt, Homo sapiens
uaacucugcacuacucc

SEQ ID NO: 796202 - RNA, 22 nt, Homo sapiens
acuucacgggcaaucaugagca

SEQ ID NO: 796203 - RNA, 18 nt, Homo sapiens
acuucagagcacacuuau

SEQ ID NO: 796204 - RNA, 17 nt, Homo sapiens
acuucaggggcacuuca

SEQ ID NO: 796205 - RNA, 12 nt, Homo sapiens
acuucagucuuc

SEQ ID NO: 796206 - RNA, 17 nt, Homo sapiens
acuucagugagauuaag

SEQ ID NO: 796207 - RNA, 12 nt, Homo sapiens
acuucagugugu

SEQ ID NO: 796208 - RNA, 17 nt, Homo sapiens
acuucaguugcuuugca

SEQ ID NO: 796209 - RNA, 21 nt, Homo sapiens
acuucauagaaaccucucuau

SEQ ID NO: 796210 - RNA, 21 nt, Homo sapiens
acuucauuuauccaucaauau

SEQ ID NO: 796211 - RNA, 19 nt, Homo sapiens
acuuccacaagagugaauu

SEQ ID NO: 796212 - RNA, 16 nt, Homo sapiens
acuuccacucgaugau

SEQ ID NO: 796213 - RNA, 16 nt, Homo sapiens
acuuccacugccaucc

SEQ ID NO: 796214 - RNA, 13 nt, Homo sapiens
acuuccacuuugu

SEQ ID NO: 796215 - RNA, 21 nt, Homo sapiens
acuuccaguguuggcugugug

SEQ ID NO: 796216 - RNA, 14 nt, Homo sapiens
acuuccauuugcuu

SEQ ID NO: 796217 - RNA, 14 nt, Homo sapiens
acuucccagugaau

SEQ ID NO: 796218 - RNA, 11 nt, Homo sapiens
acuucccugaa

SEQ ID NO: 796219 - RNA, 15 nt, Homo sapiens
acuucccuuaagagu

SEQ ID NO: 796220 - RNA, 15 nt, Homo sapiens
acuuccgagcuaugu

SEQ ID NO: 796221 - RNA, 21 nt, Homo sapiens
acuuccguccauccauucaga

SEQ ID NO: 796222 - RNA, 14 nt, Homo sapiens
acuuccuacuguag

SEQ ID NO: 796223 - RNA, 16 nt, Homo sapiens
acuuccuggucuuccu

SEQ ID NO: 796224 - RNA, 21 nt, Homo sapiens
acuuccuugcccccauuucac

SEQ ID NO: 796225 - RNA, 15 nt, Homo sapiens
acuucgaugaugaug

SEQ ID NO: 796226 - RNA, 20 nt, Homo sapiens
acuucgcuaaccaacuguuc

SEQ ID NO: 796227 - RNA, 15 nt, Homo sapiens
acuucuaaaugcaua

SEQ ID NO: 796228 - RNA, 19 nt, Homo sapiens
acuucuaaguaaaaccaca

SEQ ID NO: 796229 - RNA, 22 nt, Homo sapiens
acuucuaaguaaaaccacagca

SEQ ID NO: 796230 - RNA, 13 nt, Homo sapiens
acuucuaccugcc

SEQ ID NO: 796231 - RNA, 14 nt, Homo sapiens
acuucuaccugccc

SEQ ID NO: 796232 - RNA, 18 nt, Homo sapiens
acuucuaugcaaaugccu

SEQ ID NO: 796233 - RNA, 12 nt, Homo sapiens
acuucucugaaa

SEQ ID NO: 796234 - RNA, 20 nt, Homo sapiens
acuucugagaucuguugauu

SEQ ID NO: 796235 - RNA, 23 nt, Homo sapiens
acuucugcaacaagcaugcagcu

SEQ ID NO: 796236 - RNA, 23 nt, Homo sapiens
uaaucaaaagaaccagacugugu

SEQ ID NO: 796237 - RNA, 20 nt, Homo sapiens
uaaucaagagaaacuucaaa

SEQ ID NO: 796238 - RNA, 14 nt, Homo sapiens
uaaucaagccucug

SEQ ID NO: 796239 - RNA, 14 nt, Homo sapiens
uaaucacaguguug

SEQ ID NO: 796240 - RNA, 20 nt, Homo sapiens
uaaucagcaauaaaaauccu

SEQ ID NO: 796241 - RNA, 22 nt, Homo sapiens
uaaucagggaggucauuuuggu

SEQ ID NO: 796242 - RNA, 22 nt, Homo sapiens
uaaucaguuguuuaauaauuua

SEQ ID NO: 796243 - RNA, 12 nt, Homo sapiens
uaaucauacaaa

SEQ ID NO: 796244 - RNA, 19 nt, Homo sapiens
uaauccaaugaguguuaca

SEQ ID NO: 796245 - RNA, 13 nt, Homo sapiens
uaaucccagcacu

SEQ ID NO: 796246 - RNA, 18 nt, Homo sapiens
uaaucuaagaaaagggga

SEQ ID NO: 796247 - RNA, 12 nt, Homo sapiens
uaaucuacuuuc

SEQ ID NO: 796248 - RNA, 15 nt, Homo sapiens
uaaucucagcacuuu

SEQ ID NO: 796249 - RNA, 20 nt, Homo sapiens
uaaucucuaaaauucuaguc

SEQ ID NO: 796250 - RNA, 19 nt, Homo sapiens
uaaucucucugcagcugcc

SEQ ID NO: 796251 - RNA, 21 nt, Homo sapiens
uaaucugagaggccacagugc

SEQ ID NO: 796252 - RNA, 15 nt, Homo sapiens
uaaucugauguuaac

SEQ ID NO: 796253 - RNA, 14 nt, Homo sapiens
uaaugaacauguga

SEQ ID NO: 796254 - RNA, 16 nt, Homo sapiens
uaaugaaggacaguga

SEQ ID NO: 796255 - RNA, 16 nt, Homo sapiens
uaaugaaggcauguaa

SEQ ID NO: 796256 - RNA, 15 nt, Homo sapiens
uaaugagaauagaaa

SEQ ID NO: 796257 - RNA, 14 nt, Homo sapiens
uaaugagugcaccu

SEQ ID NO: 796258 - RNA, 14 nt, Homo sapiens
uaaugaucacauuc

SEQ ID NO: 796259 - RNA, 13 nt, Homo sapiens
uaaugaugccaug

SEQ ID NO: 796260 - RNA, 20 nt, Homo sapiens
uaaugauugacguacuuagc

SEQ ID NO: 796261 - RNA, 18 nt, Homo sapiens
uaaugcucaacaauuuau

SEQ ID NO: 796262 - RNA, 16 nt, Homo sapiens
uaaugcucaccuuuau

SEQ ID NO: 796263 - RNA, 10 nt, Homo sapiens
uaaugcugug

SEQ ID NO: 796264 - RNA, 15 nt, Homo sapiens
uaaugcuuccaggga

SEQ ID NO: 796265 - RNA, 13 nt, Homo sapiens
uaauggaaaccaa

SEQ ID NO: 796266 - RNA, 14 nt, Homo sapiens
uaauggaaaccaag

SEQ ID NO: 796267 - RNA, 17 nt, Homo sapiens
uaauggauucaguauua

SEQ ID NO: 796268 - RNA, 20 nt, Homo sapiens
uaauggauuguuaaaaucau

SEQ ID NO: 796269 - RNA, 19 nt, Homo sapiens
uaauggcucaugaccugga

SEQ ID NO: 796270 - RNA, 13 nt, Homo sapiens
uaaugggauuuca

SEQ ID NO: 796271 - RNA, 17 nt, Homo sapiens
uaauggggacacagauc

SEQ ID NO: 796272 - RNA, 18 nt, Homo sapiens
uaauggggacacagauca

SEQ ID NO: 796273 - RNA, 18 nt, Homo sapiens
uaauggggcagacacaac

SEQ ID NO: 796274 - RNA, 16 nt, Homo sapiens
uaaugguagucagauu

SEQ ID NO: 796275 - RNA, 20 nt, Homo sapiens
uaaugguagucagauuucau

SEQ ID NO: 796276 - RNA, 19 nt, Homo sapiens
uaaugguguagaacacuaa

SEQ ID NO: 796277 - RNA, 14 nt, Homo sapiens
uaaugguguuuuaa

SEQ ID NO: 796278 - RNA, 16 nt, Homo sapiens
uaauguaaaauucaua

SEQ ID NO: 796279 - RNA, 18 nt, Homo sapiens
uaauguacacauugcauu

SEQ ID NO: 796280 - RNA, 20 nt, Homo sapiens
uaauguacagaagagcaaaa

SEQ ID NO: 796281 - RNA, 14 nt, Homo sapiens
uaauguacaucugg

SEQ ID NO: 796282 - RNA, 23 nt, Homo sapiens
uaauguaccaaugaugaauuuau

SEQ ID NO: 796283 - RNA, 21 nt, Homo sapiens
uaauguauuuguuugcaauuu

SEQ ID NO: 796284 - RNA, 18 nt, Homo sapiens
uaaugucuccuuugcucu

SEQ ID NO: 796285 - RNA, 12 nt, Homo sapiens
uaaugugcagca

SEQ ID NO: 796286 - RNA, 20 nt, Homo sapiens
uaauguuauaucauauguau

SEQ ID NO: 796287 - RNA, 18 nt, Homo sapiens
uaauguuuaauauugaga

SEQ ID NO: 796288 - RNA, 19 nt, Homo sapiens
uaauguuuuauacuguuua

SEQ ID NO: 796289 - RNA, 18 nt, Homo sapiens
uaauuaaaagcaaaucau

SEQ ID NO: 796290 - RNA, 23 nt, Homo sapiens
uaauuaaauuuugaguucuacau

SEQ ID NO: 796291 - RNA, 14 nt, Homo sapiens
uaauuaauauucau

SEQ ID NO: 796292 - RNA, 17 nt, Homo sapiens
uaauuacucuaacaaac

SEQ ID NO: 796293 - RNA, 12 nt, Homo sapiens
uaauuacuguac

SEQ ID NO: 796294 - RNA, 19 nt, Homo sapiens
uaauuagaucaauuacuua

SEQ ID NO: 796295 - RNA, 22 nt, Homo sapiens
uaauuagcauggccccagucca

SEQ ID NO: 796296 - RNA, 13 nt, Homo sapiens
uaauuagcugugc

SEQ ID NO: 796297 - RNA, 17 nt, Homo sapiens
uaauuauacuacuuugu

SEQ ID NO: 796298 - RNA, 19 nt, Homo sapiens
uaauucagaaggaucuuca

SEQ ID NO: 796299 - RNA, 14 nt, Homo sapiens
uaauucagcacuua

SEQ ID NO: 796300 - RNA, 23 nt, Homo sapiens
uaauucaugguuguuccaaagau

SEQ ID NO: 796301 - RNA, 14 nt, Homo sapiens
uaauuccucuccag

SEQ ID NO: 796302 - RNA, 16 nt, Homo sapiens
uaauuccugaucuucc

SEQ ID NO: 796303 - RNA, 20 nt, Homo sapiens
uaauuccuguuacuuuacag

SEQ ID NO: 796304 - RNA, 16 nt, Homo sapiens
uaauucggauuugcca

SEQ ID NO: 796305 - RNA, 17 nt, Homo sapiens
uaauucuaagacuuuug

SEQ ID NO: 796306 - RNA, 15 nt, Homo sapiens
uaauucuaaguuauu

SEQ ID NO: 796307 - RNA, 12 nt, Homo sapiens
uaauucugcaga

SEQ ID NO: 796308 - RNA, 13 nt, Homo sapiens
uaauucuuguaga

SEQ ID NO: 796309 - RNA, 14 nt, Homo sapiens
uaauucuuuuauca

SEQ ID NO: 796310 - RNA, 15 nt, Homo sapiens
uaauugaacuaacaa

SEQ ID NO: 796311 - RNA, 14 nt, Homo sapiens
uaauugauuucaag

SEQ ID NO: 796312 - RNA, 15 nt, Homo sapiens
uaauugcaugacaaa

SEQ ID NO: 796313 - RNA, 16 nt, Homo sapiens
uaauugcuuugccaaa

SEQ ID NO: 796314 - RNA, 17 nt, Homo sapiens
uaauugcuuugccaaaa

SEQ ID NO: 796315 - RNA, 15 nt, Homo sapiens
uaauuggucauguga

SEQ ID NO: 796316 - RNA, 14 nt, Homo sapiens
uaauuguacaauac

SEQ ID NO: 796317 - RNA, 19 nt, Homo sapiens
uaauuuaguuccacaaaug

SEQ ID NO: 796318 - RNA, 23 nt, Homo sapiens
uacaguuugauuuuugaccagug

SEQ ID NO: 796319 - RNA, 16 nt, Homo sapiens
uacauaagcagcauuu

SEQ ID NO: 796320 - RNA, 16 nt, Homo sapiens
uacauaaggaugacuu

SEQ ID NO: 796321 - RNA, 23 nt, Homo sapiens
uacauaauaaaaaauuaugacaa

SEQ ID NO: 796322 - RNA, 22 nt, Homo sapiens
uacauaaucaaagcuaccugug

SEQ ID NO: 796323 - RNA, 23 nt, Homo sapiens
uacauacaggccauacuuuacaa

SEQ ID NO: 796324 - RNA, 18 nt, Homo sapiens
uacauacuaggugccuuu

SEQ ID NO: 796325 - RNA, 14 nt, Homo sapiens
uacauagagaauaa

SEQ ID NO: 796326 - RNA, 15 nt, Homo sapiens
uacauauauauguca

SEQ ID NO: 796327 - RNA, 17 nt, Homo sapiens
uacauauauaugucagg

SEQ ID NO: 796328 - RNA, 15 nt, Homo sapiens
uacauauaucucugu

SEQ ID NO: 796329 - RNA, 19 nt, Homo sapiens
uacauaugagaauauaccu

SEQ ID NO: 796330 - RNA, 13 nt, Homo sapiens
uacauauuaucuc

SEQ ID NO: 796331 - RNA, 16 nt, Homo sapiens
uacauauuaucucauu

SEQ ID NO: 796332 - RNA, 20 nt, Homo sapiens
uacauauuccugguguagca

SEQ ID NO: 796333 - RNA, 13 nt, Homo sapiens
uacaucaaagcuu

SEQ ID NO: 796334 - RNA, 20 nt, Homo sapiens
uacaucaaguccaucugaca

SEQ ID NO: 796335 - RNA, 23 nt, Homo sapiens
uacaucagacucuagaaaaaagg

SEQ ID NO: 796336 - RNA, 18 nt, Homo sapiens
uacauccagucacuuugc

SEQ ID NO: 796337 - RNA, 13 nt, Homo sapiens
uacaucuaacuca

SEQ ID NO: 796338 - RNA, 14 nt, Homo sapiens
uacaucuuucacau

SEQ ID NO: 796339 - RNA, 15 nt, Homo sapiens
uacaugaauugcauu

SEQ ID NO: 796340 - RNA, 14 nt, Homo sapiens
uacaugcauacaaa

SEQ ID NO: 796341 - RNA, 19 nt, Homo sapiens
uacaugcugugcucuuuga

SEQ ID NO: 796342 - RNA, 22 nt, Homo sapiens
uacaugggugaauuauguuucc

SEQ ID NO: 796343 - RNA, 15 nt, Homo sapiens
uacauguaauccauc

SEQ ID NO: 796344 - RNA, 16 nt, Homo sapiens
uacauguaauccauca

SEQ ID NO: 796345 - RNA, 21 nt, Homo sapiens
uacauguauuaaauuacauuu

SEQ ID NO: 796346 - RNA, 14 nt, Homo sapiens
uacaugucuuccau

SEQ ID NO: 796347 - RNA, 15 nt, Homo sapiens
uacauguggcccaac

SEQ ID NO: 796348 - RNA, 11 nt, Homo sapiens
uacauguuaag

SEQ ID NO: 796349 - RNA, 21 nt, Homo sapiens
uacauguuuauaaaucuuaug

SEQ ID NO: 796350 - RNA, 15 nt, Homo sapiens
uacauuaauuaccuu

SEQ ID NO: 796351 - RNA, 17 nt, Homo sapiens
agaaaaagcuagcacua

SEQ ID NO: 796352 - RNA, 13 nt, Homo sapiens
agaaaacaaucaa

SEQ ID NO: 796353 - RNA, 12 nt, Homo sapiens
agaaaacaucua

SEQ ID NO: 796354 - RNA, 20 nt, Homo sapiens
agaaaacguaaauaaacuaa

SEQ ID NO: 796355 - RNA, 23 nt, Homo sapiens
agaaaacucugguaaaugaucac

SEQ ID NO: 796356 - RNA, 11 nt, Homo sapiens
agaaaacuggg

SEQ ID NO: 796357 - RNA, 18 nt, Homo sapiens
agaaaacuguuugggaaa

SEQ ID NO: 796358 - RNA, 23 nt, Homo sapiens
agaaaacuuuuguuuagagcccu

SEQ ID NO: 796359 - RNA, 16 nt, Homo sapiens
agaaaagaaauuaguu

SEQ ID NO: 796360 - RNA, 19 nt, Homo sapiens
agaaaagauuauauauuau

SEQ ID NO: 796361 - RNA, 17 nt, Homo sapiens
agaaaagcaauacuguu

SEQ ID NO: 796362 - RNA, 19 nt, Homo sapiens
agaaaagcaauacuguuuc

SEQ ID NO: 796363 - RNA, 16 nt, Homo sapiens
agaaaagcaguggcuc

SEQ ID NO: 796364 - RNA, 19 nt, Homo sapiens
agaaaagcaguggcuccau

SEQ ID NO: 796365 - RNA, 19 nt, Homo sapiens
agaaaagcccaaguucaug

SEQ ID NO: 796366 - RNA, 15 nt, Homo sapiens
agaaaagccucucca

SEQ ID NO: 796367 - RNA, 13 nt, Homo sapiens
agaaaagccugaa

SEQ ID NO: 796368 - RNA, 16 nt, Homo sapiens
agaaaagccugaaacu

SEQ ID NO: 796369 - RNA, 17 nt, Homo sapiens
agaaaaggcaagacuug

SEQ ID NO: 796370 - RNA, 18 nt, Homo sapiens
agaaaaggcggugcucag

SEQ ID NO: 796371 - RNA, 19 nt, Homo sapiens
agaaaaguagguuuacauu

SEQ ID NO: 796372 - RNA, 21 nt, Homo sapiens
agaaaagugcauauuuaucca

SEQ ID NO: 796373 - RNA, 17 nt, Homo sapiens
agaaaauagagcuuuua

SEQ ID NO: 796374 - RNA, 23 nt, Homo sapiens
agaaaauauauucuuucaaagga

SEQ ID NO: 796375 - RNA, 23 nt, Homo sapiens
agaaaaugacuuauuucugcucu

SEQ ID NO: 796376 - RNA, 16 nt, Homo sapiens
agaaaaugagacaaaa

SEQ ID NO: 796377 - RNA, 13 nt, Homo sapiens
agaaaaugccuca

SEQ ID NO: 796378 - RNA, 18 nt, Homo sapiens
agaaaauggguuuauuca

SEQ ID NO: 796379 - RNA, 21 nt, Homo sapiens
agaaaauguaaaggagggaga

SEQ ID NO: 796380 - RNA, 17 nt, Homo sapiens
agaaaauguaguuagcu

SEQ ID NO: 796381 - RNA, 16 nt, Homo sapiens
agaaaauguguccuau

SEQ ID NO: 796382 - RNA, 21 nt, Homo sapiens
agaaaauuccuagaaauugaa

SEQ ID NO: 796383 - RNA, 17 nt, Homo sapiens
agaaaauugcugugccu

SEQ ID NO: 796384 - RNA, 23 nt, Homo sapiens
agaaaauugcugugccucccaaa

SEQ ID NO: 796385 - RNA, 15 nt, Homo sapiens
agaaaauuuuguaaa

SEQ ID NO: 796386 - RNA, 23 nt, Homo sapiens
agaaacaaccguuggaaacauaa

SEQ ID NO: 796387 - RNA, 16 nt, Homo sapiens
agaaacaagcugugca

SEQ ID NO: 796388 - RNA, 23 nt, Homo sapiens
agaaacaccccucugucuaggac

SEQ ID NO: 796389 - RNA, 19 nt, Homo sapiens
agaaacacucuuauuccca

SEQ ID NO: 796390 - RNA, 14 nt, Homo sapiens
agaaacagcuuuca

SEQ ID NO: 796391 - RNA, 19 nt, Homo sapiens
agaaacaguugguaacuuu

SEQ ID NO: 796392 - RNA, 17 nt, Homo sapiens
agaaacaugacacugac

SEQ ID NO: 796393 - RNA, 19 nt, Homo sapiens
agaaaccagaaaagcaaua

SEQ ID NO: 796394 - RNA, 23 nt, Homo sapiens
agaaacccuugcugcuuuagucc

SEQ ID NO: 796395 - RNA, 13 nt, Homo sapiens
agaaaccucggga

SEQ ID NO: 796396 - RNA, 20 nt, Homo sapiens
agaaaccuuauuguaccucu

SEQ ID NO: 796397 - RNA, 22 nt, Homo sapiens
agaaacgucuauguguacagau

SEQ ID NO: 796398 - RNA, 13 nt, Homo sapiens
agaaacucaccau

SEQ ID NO: 796399 - RNA, 20 nt, Homo sapiens
agaaacuuauuucucauauc

SEQ ID NO: 796400 - RNA, 16 nt, Homo sapiens
agaaacuugcuuauca

SEQ ID NO: 796401 - RNA, 18 nt, Homo sapiens
agaaacuuugaguacaga

SEQ ID NO: 796402 - RNA, 21 nt, Homo sapiens
agaaagaaguugauuccuuca

SEQ ID NO: 796403 - RNA, 14 nt, Homo sapiens
agaaagacuauuca

SEQ ID NO: 796404 - RNA, 23 nt, Homo sapiens
agaaagagauuuucacccaucca

SEQ ID NO: 796405 - RNA, 14 nt, Homo sapiens
agaaagaucaaaga

SEQ ID NO: 796406 - RNA, 15 nt, Homo sapiens
agaaagaucaaagac

SEQ ID NO: 796407 - RNA, 21 nt, Homo sapiens
agaaagcaaaugugaccugug

SEQ ID NO: 796408 - RNA, 23 nt, Homo sapiens
agaaagcacgugucucagacugc

SEQ ID NO: 796409 - RNA, 15 nt, Homo sapiens
agaaagcacuacaau

SEQ ID NO: 796410 - RNA, 22 nt, Homo sapiens
agaaagcaggagcagcugugcu

SEQ ID NO: 796411 - RNA, 21 nt, Homo sapiens
agaaagcauccuaaauauauc

SEQ ID NO: 796412 - RNA, 13 nt, Homo sapiens
agaaagcauuaca

SEQ ID NO: 796413 - RNA, 12 nt, Homo sapiens
agaaagccaaau

SEQ ID NO: 796414 - RNA, 11 nt, Homo sapiens
agaaagcucua

SEQ ID NO: 796415 - RNA, 13 nt, Homo sapiens
agaaagcuggacu

SEQ ID NO: 796416 - RNA, 17 nt, Homo sapiens
agaaagcuggacugacc

SEQ ID NO: 796417 - RNA, 22 nt, Homo sapiens
agaaaggagaacuauccaaaac

SEQ ID NO: 796418 - RNA, 15 nt, Homo sapiens
agaaaggguuccaaa

SEQ ID NO: 796419 - RNA, 18 nt, Homo sapiens
agaaaguaaaaaguugcu

SEQ ID NO: 796420 - RNA, 20 nt, Homo sapiens
agaaagucauagauuucuga

SEQ ID NO: 796421 - RNA, 19 nt, Homo sapiens
agaaagugauaagugcagg

SEQ ID NO: 796422 - RNA, 20 nt, Homo sapiens
agaaaguguuuaacuuguca

SEQ ID NO: 796423 - RNA, 16 nt, Homo sapiens
agaaauaaagaucuca

SEQ ID NO: 796424 - RNA, 18 nt, Homo sapiens
agaaauaacacugugaau

SEQ ID NO: 796425 - RNA, 21 nt, Homo sapiens
agaaauaaggacaagccuaac

SEQ ID NO: 796426 - RNA, 14 nt, Homo sapiens
agaaauaauaugca

SEQ ID NO: 796427 - RNA, 16 nt, Homo sapiens
agaaauacaguacugu

SEQ ID NO: 796428 - RNA, 20 nt, Homo sapiens
agaaauacucaugugcaaua

SEQ ID NO: 796429 - RNA, 19 nt, Homo sapiens
agaaaucuagaagacuguc

SEQ ID NO: 796430 - RNA, 12 nt, Homo sapiens
agaaaugaauau

SEQ ID NO: 796431 - RNA, 15 nt, Homo sapiens
agaaaugaucuuuac

SEQ ID NO: 796432 - RNA, 17 nt, Homo sapiens
agcuaauugagaccaca

SEQ ID NO: 796433 - RNA, 20 nt, Homo sapiens
agcuaauuguacuaaucuga

SEQ ID NO: 796434 - RNA, 22 nt, Homo sapiens
agcuacaaucuguucaauguuu

SEQ ID NO: 796435 - RNA, 19 nt, Homo sapiens
agcuacacagaucacagcu

SEQ ID NO: 796436 - RNA, 12 nt, Homo sapiens
agcuacaguaga

SEQ ID NO: 796437 - RNA, 15 nt, Homo sapiens
agcuacaugguggag

SEQ ID NO: 796438 - RNA, 18 nt, Homo sapiens
agcuacauuccucagcug

SEQ ID NO: 796439 - RNA, 14 nt, Homo sapiens
agcuaccagguguu

SEQ ID NO: 796440 - RNA, 20 nt, Homo sapiens
agcuaccucacuaugcugcu

SEQ ID NO: 796441 - RNA, 19 nt, Homo sapiens
agcuaccugcucagcccug

SEQ ID NO: 796442 - RNA, 18 nt, Homo sapiens
agcuacggguaggucuau

SEQ ID NO: 796443 - RNA, 19 nt, Homo sapiens
agcuacucagaagccugag

SEQ ID NO: 796444 - RNA, 22 nt, Homo sapiens
agcuacucaggaggcugagaca

SEQ ID NO: 796445 - RNA, 20 nt, Homo sapiens
agcuacucaggagguugagg

SEQ ID NO: 796446 - RNA, 14 nt, Homo sapiens
agcuacugacuaug

SEQ ID NO: 796447 - RNA, 23 nt, Homo sapiens
agcuacuugggaggcugagccag

SEQ ID NO: 796448 - RNA, 14 nt, Homo sapiens
agcuagaacacugc

SEQ ID NO: 796449 - RNA, 14 nt, Homo sapiens
agcuagauacugga

SEQ ID NO: 796450 - RNA, 14 nt, Homo sapiens
agcuagcuucugca

SEQ ID NO: 796451 - RNA, 14 nt, Homo sapiens
agcuaggaugguuc

SEQ ID NO: 796452 - RNA, 21 nt, Homo sapiens
agcuaggaugguucugugacc

SEQ ID NO: 796453 - RNA, 14 nt, Homo sapiens
agcuagugccuuua

SEQ ID NO: 796454 - RNA, 17 nt, Homo sapiens
agcuaguggcuucaaaa

SEQ ID NO: 796455 - RNA, 17 nt, Homo sapiens
agcuaguguaccuccuc

SEQ ID NO: 796456 - RNA, 13 nt, Homo sapiens
agcuauacaggaa

SEQ ID NO: 796457 - RNA, 20 nt, Homo sapiens
agcuaucucucagugaacug

SEQ ID NO: 796458 - RNA, 20 nt, Homo sapiens
agcuaugauuaugccacugc

SEQ ID NO: 796459 - RNA, 17 nt, Homo sapiens
agcuaugggagccccag

SEQ ID NO: 796460 - RNA, 14 nt, Homo sapiens
agcucaaagacuuc

SEQ ID NO: 796461 - RNA, 15 nt, Homo sapiens
agcucaagaugacag

SEQ ID NO: 796462 - RNA, 20 nt, Homo sapiens
agcucaagaugacagcucuu

SEQ ID NO: 796463 - RNA, 19 nt, Homo sapiens
agcucaagucuucccugau

SEQ ID NO: 796464 - RNA, 21 nt, Homo sapiens
agcucaagucuucccugauca

SEQ ID NO: 796465 - RNA, 17 nt, Homo sapiens
agcucacacccuaccuu

SEQ ID NO: 796466 - RNA, 19 nt, Homo sapiens
agcucacacccuaccuucc

SEQ ID NO: 796467 - RNA, 12 nt, Homo sapiens
agcucacgucac

SEQ ID NO: 796468 - RNA, 11 nt, Homo sapiens
agcucacucau

SEQ ID NO: 796469 - RNA, 17 nt, Homo sapiens
agcucacugcaaccucc

SEQ ID NO: 796470 - RNA, 17 nt, Homo sapiens
agcucacugcaaccucu

SEQ ID NO: 796471 - RNA, 14 nt, Homo sapiens
agcucagccagugg

SEQ ID NO: 796472 - RNA, 16 nt, Homo sapiens
ucaaauguuuccuuaa

SEQ ID NO: 796473 - RNA, 15 nt, Homo sapiens
ucaaauuaucuucac

SEQ ID NO: 796474 - RNA, 19 nt, Homo sapiens
ucaaauucuucugaacuca

SEQ ID NO: 796475 - RNA, 19 nt, Homo sapiens
ucaaauuggugaacagugu

SEQ ID NO: 796476 - RNA, 22 nt, Homo sapiens
ucaaauuucuguucucucuucc

SEQ ID NO: 796477 - RNA, 21 nt, Homo sapiens
ucaaauuuuggcgaaucucaa

SEQ ID NO: 796478 - RNA, 18 nt, Homo sapiens
ucaaauuuuuacugagaa

SEQ ID NO: 796479 - RNA, 19 nt, Homo sapiens
ucaacaaaauggucaucca

SEQ ID NO: 796480 - RNA, 14 nt, Homo sapiens
ucaacaagauuucc

SEQ ID NO: 796481 - RNA, 19 nt, Homo sapiens
ucaacaauuuauccauuca

SEQ ID NO: 796482 - RNA, 14 nt, Homo sapiens
ucaacaauuucaau

SEQ ID NO: 796483 - RNA, 13 nt, Homo sapiens
ucaacacuguuac

SEQ ID NO: 796484 - RNA, 12 nt, Homo sapiens
ucaacagaauuu

SEQ ID NO: 796485 - RNA, 20 nt, Homo sapiens
ucaacaucuuuuacauucug

SEQ ID NO: 796486 - RNA, 17 nt, Homo sapiens
ucaacauggcagaacca

SEQ ID NO: 796487 - RNA, 12 nt, Homo sapiens
ucaacauugcau

SEQ ID NO: 796488 - RNA, 15 nt, Homo sapiens
ucaaccaauguagaa

SEQ ID NO: 796489 - RNA, 22 nt, Homo sapiens
ucaacccauauuucauccagga

SEQ ID NO: 796490 - RNA, 18 nt, Homo sapiens
ucaaccuaagcaacagaa

SEQ ID NO: 796491 - RNA, 19 nt, Homo sapiens
ucaaccucuucuggcucaa
